United States Patent 11,640,849 (METHODS FOR HISTOLOGICAL DIAGNOSIS AND TREATMENT OF DISEASES) - sequence listing, part 62

SEQ ID NO: 2363077 - protein, 11 aa, Entamoeba dispar
ENNTNEEQQRL

SEQ ID NO: 2363078 - protein, 4 aa, Entamoeba dispar
ENPI

SEQ ID NO: 2363079 - protein, 7 aa, Entamoeba dispar
ENPIAEG

SEQ ID NO: 2363080 - protein, 7 aa, Entamoeba dispar
ENPQIID

SEQ ID NO: 2363081 - protein, 5 aa, Entamoeba dispar
ENPTY

SEQ ID NO: 2363082 - protein, 22 aa, Entamoeba dispar
ENQEQNKKVSNKKKQTSSSYDS

SEQ ID NO: 2363083 - protein, 7 aa, Entamoeba dispar
ENQESPL

SEQ ID NO: 2363084 - protein, 4 aa, Entamoeba dispar
ENQF

SEQ ID NO: 2363085 - protein, 7 aa, Entamoeba dispar
ENQIKNG

SEQ ID NO: 2363086 - protein, 9 aa, Entamoeba dispar
ENQKRKTEL

SEQ ID NO: 2363087 - protein, 6 aa, Entamoeba dispar
ENQNDE

SEQ ID NO: 2363088 - protein, 8 aa, Entamoeba dispar
ENQNDEEI

SEQ ID NO: 2363089 - protein, 5 aa, Entamoeba dispar
ENQNE

SEQ ID NO: 2363090 - protein, 7 aa, Entamoeba dispar
ENQNYQE

SEQ ID NO: 2363091 - protein, 5 aa, Entamoeba dispar
ENQQI

SEQ ID NO: 2363092 - protein, 4 aa, Entamoeba dispar
ENQV

SEQ ID NO: 2363093 - protein, 13 aa, Entamoeba dispar
ENRDDFEPTNAKY

SEQ ID NO: 2363094 - protein, 7 aa, Entamoeba dispar
ENREGPM

SEQ ID NO: 2363095 - protein, 7 aa, Entamoeba dispar
ENRQQQV

SEQ ID NO: 2363096 - protein, 8 aa, Entamoeba dispar
ENRTKATS

SEQ ID NO: 2363097 - protein, 8 aa, Entamoeba dispar
ENSEFNQR

SEQ ID NO: 2363098 - protein, 6 aa, Entamoeba dispar
ENSELN

SEQ ID NO: 2363099 - protein, 5 aa, Entamoeba dispar
ENSGI

SEQ ID NO: 2363100 - protein, 6 aa, Entamoeba dispar
ENSHPN

SEQ ID NO: 2363101 - protein, 8 aa, Entamoeba dispar
ENSINTQS

SEQ ID NO: 2363102 - protein, 6 aa, Entamoeba dispar
ENSIQQ

SEQ ID NO: 2363103 - protein, 8 aa, Entamoeba dispar
ENSIQTEL

SEQ ID NO: 2363104 - protein, 5 aa, Entamoeba dispar
ENSIY

SEQ ID NO: 2363105 - protein, 14 aa, Entamoeba dispar
ENSKIRKSSANLEK

SEQ ID NO: 2363106 - protein, 19 aa, Entamoeba dispar
ENSPYGHRGSHTKLEMEKG

SEQ ID NO: 2363107 - protein, 5 aa, Entamoeba dispar
ENSQF

SEQ ID NO: 2363108 - protein, 6 aa, Entamoeba dispar
ENSQKN

SEQ ID NO: 2363109 - protein, 7 aa, Entamoeba dispar
ENSQMLG

SEQ ID NO: 2363110 - protein, 18 aa, Entamoeba dispar
ENSQTIKINQKRKSISSV

SEQ ID NO: 2363111 - protein, 7 aa, Entamoeba dispar
ENSRCTK

SEQ ID NO: 2363112 - protein, 5 aa, Entamoeba dispar
ENSSK

SEQ ID NO: 2363113 - protein, 22 aa, Entamoeba dispar
ENSSSCSGVGIEQTTNVNDDNL

SEQ ID NO: 2363114 - protein, 7 aa, Entamoeba dispar
ENSTIDD

SEQ ID NO: 2363115 - protein, 6 aa, Entamoeba dispar
ENSTTT

SEQ ID NO: 2363116 - protein, 9 aa, Entamoeba dispar
ENSVSTKDF

SEQ ID NO: 2363117 - protein, 7 aa, Entamoeba dispar
ENSYQTE

SEQ ID NO: 2363118 - protein, 8 aa, Entamoeba dispar
ENTCQSCK

SEQ ID NO: 2363119 - protein, 6 aa, Entamoeba dispar
ENTIAL

SEQ ID NO: 2363120 - protein, 5 aa, Entamoeba dispar
ENTIR

SEQ ID NO: 2363121 - protein, 40 aa, Entamoeba dispar
ENTKIENSIQQKEKENEVMKEENKKKEKEIEEIKKEKEIT

SEQ ID NO: 2363122 - protein, 26 aa, Entamoeba dispar
ENTMSNRSKRRKIEKEALKSSKNKID

SEQ ID NO: 2363123 - protein, 8 aa, Entamoeba dispar
ENTQALER

SEQ ID NO: 2363124 - protein, 10 aa, Entamoeba dispar
ENTQPPTEDQ

SEQ ID NO: 2363125 - protein, 7 aa, Entamoeba dispar
ENTYPQD

SEQ ID NO: 2363126 - protein, 7 aa, Entamoeba dispar
ENTYTIA

SEQ ID NO: 2363127 - protein, 7 aa, Entamoeba dispar
ENVQQCN

SEQ ID NO: 2363128 - protein, 8 aa, Entamoeba dispar
ENWPEAGD

SEQ ID NO: 2363129 - protein, 6 aa, Entamoeba dispar
ENYAEN

SEQ ID NO: 2363130 - protein, 5 aa, Entamoeba dispar
ENYNE

SEQ ID NO: 2363131 - protein, 7 aa, Entamoeba dispar
ENYPNEM

SEQ ID NO: 2363132 - protein, 4 aa, Entamoeba dispar
ENYQ

SEQ ID NO: 2363133 - protein, 5 aa, Entamoeba dispar
EPAKR

SEQ ID NO: 2363134 - protein, 9 aa, Entamoeba dispar
EPAPNGTDP

SEQ ID NO: 2363135 - protein, 6 aa, Entamoeba dispar
EPASIP

SEQ ID NO: 2363136 - protein, 9 aa, Entamoeba dispar
EPASPDSPV

SEQ ID NO: 2363137 - protein, 8 aa, Entamoeba dispar
EPCPTNQV

SEQ ID NO: 2363138 - protein, 8 aa, Entamoeba dispar
EPDLPEDA

SEQ ID NO: 2363139 - protein, 5 aa, Entamoeba dispar
EPEHC

SEQ ID NO: 2363140 - protein, 4 aa, Entamoeba dispar
EPEN

SEQ ID NO: 2363141 - protein, 6 aa, Entamoeba dispar
EPFPKQ

SEQ ID NO: 2363142 - protein, 6 aa, Entamoeba dispar
EPHHSR

SEQ ID NO: 2363143 - protein, 10 aa, Entamoeba dispar
EPIDNPIPHN

SEQ ID NO: 2363144 - protein, 7 aa, Entamoeba dispar
EPIGEGA

SEQ ID NO: 2363145 - protein, 5 aa, Entamoeba dispar
EPKER

SEQ ID NO: 2363146 - protein, 6 aa, Entamoeba dispar
EPKERF

SEQ ID NO: 2363147 - protein, 7 aa, Entamoeba dispar
EPKERLP

SEQ ID NO: 2363148 - protein, 12 aa, Entamoeba dispar
EPKGFSPLKSRG

SEQ ID NO: 2363149 - protein, 6 aa, Entamoeba dispar
EPKQPV

SEQ ID NO: 2363150 - protein, 4 aa, Entamoeba dispar
EPLP

SEQ ID NO: 2363151 - protein, 4 aa, Entamoeba dispar
EPLQ

SEQ ID NO: 2363152 - protein, 4 aa, Entamoeba dispar
EPLT

SEQ ID NO: 2363153 - protein, 4 aa, Entamoeba dispar
EPMT

SEQ ID NO: 2363154 - protein, 11 aa, Entamoeba dispar
EPNDKFKQYSP

SEQ ID NO: 2363155 - protein, 10 aa, Entamoeba dispar
EPNDNLPTEP

SEQ ID NO: 2363156 - protein, 18 aa, Entamoeba dispar
EPNDNQVKINSKNETEHH

SEQ ID NO: 2363157 - protein, 10 aa, Entamoeba dispar
EPNEKEEEFE

SEQ ID NO: 2363158 - protein, 25 aa, Entamoeba dispar
EPNGGSATVSKPQNRRSSQLSGGMR

SEQ ID NO: 2363159 - protein, 4 aa, Entamoeba dispar
EPNQ

SEQ ID NO: 2363160 - protein, 5 aa, Entamoeba dispar
EPPGI

SEQ ID NO: 2363161 - protein, 9 aa, Entamoeba dispar
EPPGTGSVI

SEQ ID NO: 2363162 - protein, 10 aa, Entamoeba dispar
EPPKGTLAYS

SEQ ID NO: 2363163 - protein, 9 aa, Entamoeba dispar
EPPKNPTLQ

SEQ ID NO: 2363164 - protein, 6 aa, Entamoeba dispar
EPPNDK

SEQ ID NO: 2363165 - protein, 18 aa, Entamoeba dispar
EPPNEKYNKKMKKNLNKT

SEQ ID NO: 2363166 - protein, 10 aa, Entamoeba dispar
EPPPDDPTTS

SEQ ID NO: 2363167 - protein, 7 aa, Entamoeba dispar
EPPPHYD

SEQ ID NO: 2363168 - protein, 5 aa, Entamoeba dispar
EPPQL

SEQ ID NO: 2363169 - protein, 13 aa, Entamoeba dispar
EPPRYTLKSGEAM

SEQ ID NO: 2363170 - protein, 11 aa, Entamoeba dispar
EPQINVPQSKN

SEQ ID NO: 2363171 - protein, 5 aa, Entamoeba dispar
EPQVA

SEQ ID NO: 2363172 - protein, 4 aa, Entamoeba dispar
EPSE

SEQ ID NO: 2363173 - protein, 31 aa, Entamoeba dispar
EPSEDNSKNEKENEETQPLLPSEEVKESTEV

SEQ ID NO: 2363174 - protein, 8 aa, Entamoeba dispar
EPSGETSL

SEQ ID NO: 2363175 - protein, 11 aa, Entamoeba dispar
EPSKKSLLGSS

SEQ ID NO: 2363176 - protein, 7 aa, Entamoeba dispar
EPSNTAL

SEQ ID NO: 2363177 - protein, 6 aa, Entamoeba dispar
EPSQRI

SEQ ID NO: 2363178 - protein, 9 aa, Entamoeba dispar
EPSTANGRK

SEQ ID NO: 2363179 - protein, 33 aa, Entamoeba dispar
EPSYSLESDYPYIDGSGSTSTSCSPRGDQNPNV

SEQ ID NO: 2363180 - protein, 6 aa, Entamoeba dispar
EPTEPL

SEQ ID NO: 2363181 - protein, 8 aa, Entamoeba dispar
EPTERKID

SEQ ID NO: 2363182 - protein, 6 aa, Entamoeba dispar
EPTIIT

SEQ ID NO: 2363183 - protein, 9 aa, Entamoeba dispar
EPTISKDNK

SEQ ID NO: 2363184 - protein, 5 aa, Entamoeba dispar
EPTNR

SEQ ID NO: 2363185 - protein, 6 aa, Entamoeba dispar
EPTNSV

SEQ ID NO: 2363186 - protein, 5 aa, Entamoeba dispar
EPTPI

SEQ ID NO: 2363187 - protein, 5 aa, Entamoeba dispar
EPTSN

SEQ ID NO: 2363188 - protein, 6 aa, Entamoeba dispar
EPTTGL

SEQ ID NO: 2363189 - protein, 11 aa, Entamoeba dispar
EPTTGMDPVSR

SEQ ID NO: 2363190 - protein, 15 aa, Entamoeba dispar
EPVDTPNGKVTTRAQ

SEQ ID NO: 2363191 - protein, 5 aa, Entamoeba dispar
EPVKT

SEQ ID NO: 2363192 - protein, 5 aa, Entamoeba dispar
EPYKD

SEQ ID NO: 2363193 - protein, 4 aa, Entamoeba dispar
EPYN

SEQ ID NO: 2363194 - protein, 5 aa, Entamoeba dispar
EPYRE

SEQ ID NO: 2363195 - protein, 9 aa, Entamoeba dispar
EPYRKNITE

SEQ ID NO: 2363196 - protein, 12 aa, Entamoeba dispar
EQATSKEECSKD

SEQ ID NO: 2363197 - protein, 5 aa, Entamoeba dispar
EQATV

SEQ ID NO: 2363198 - protein, 4 aa, Entamoeba dispar
EQAY

SEQ ID NO: 2363199 - protein, 26 aa, Entamoeba dispar
EQCDGIEGCGNDCQCTKGYTADGNGN

SEQ ID NO: 2363200 - protein, 11 aa, Entamoeba dispar
EQCDGSEGCGK

SEQ ID NO: 2363201 - protein, 8 aa, Entamoeba dispar
EQCKNEEL

SEQ ID NO: 2363202 - protein, 8 aa, Entamoeba dispar
EQCSTNPV

SEQ ID NO: 2363203 - protein, 5 aa, Entamoeba dispar
EQDDI

SEQ ID NO: 2363204 - protein, 7 aa, Entamoeba dispar
EQDQSLN

SEQ ID NO: 2363205 - protein, 7 aa, Entamoeba dispar
EQDTRKR

SEQ ID NO: 2363206 - protein, 16 aa, Entamoeba dispar
EQEKTKEIKELENEKL

SEQ ID NO: 2363207 - protein, 5 aa, Entamoeba dispar
EQELD

SEQ ID NO: 2363208 - protein, 9 aa, Entamoeba dispar
EQETENEKD

SEQ ID NO: 2363209 - protein, 17 aa, Entamoeba dispar
EQFEEGFGSHTPMYTGQ

SEQ ID NO: 2363210 - protein, 11 aa, Entamoeba dispar
EQFGERKSHYD

SEQ ID NO: 2363211 - protein, 9 aa, Entamoeba dispar
EQFKSQNKS

SEQ ID NO: 2363212 - protein, 5 aa, Entamoeba dispar
EQGGI

SEQ ID NO: 2363213 - protein, 4 aa, Entamoeba dispar
EQGN

SEQ ID NO: 2363214 - protein, 7 aa, Entamoeba dispar
EQGTSIE

SEQ ID NO: 2363215 - protein, 4 aa, Entamoeba dispar
EQHS

SEQ ID NO: 2363216 - protein, 5 aa, Entamoeba dispar
EQIEE

SEQ ID NO: 2363217 - protein, 12 aa, Entamoeba dispar
EQINNTPLSQED

SEQ ID NO: 2363218 - protein, 11 aa, Entamoeba dispar
EQIPRTQNQRM

SEQ ID NO: 2363219 - protein, 8 aa, Entamoeba dispar
EQKEEGTF

SEQ ID NO: 2363220 - protein, 16 aa, Entamoeba dispar
EQKEETVEADQTEKLT

SEQ ID NO: 2363221 - protein, 5 aa, Entamoeba dispar
EQKEP

SEQ ID NO: 2363222 - protein, 14 aa, Entamoeba dispar
EQKESTEKGTMESP

SEQ ID NO: 2363223 - protein, 5 aa, Entamoeba dispar
EQKGL

SEQ ID NO: 2363224 - protein, 15 aa, Entamoeba dispar
EQKKEEEQDTNQENI

SEQ ID NO: 2363225 - protein, 14 aa, Entamoeba dispar
EQKKIEEMEEVKEK

SEQ ID NO: 2363226 - protein, 5 aa, Entamoeba dispar
EQKLQ

SEQ ID NO: 2363227 - protein, 10 aa, Entamoeba dispar
EQKSHSFNSG

SEQ ID NO: 2363228 - protein, 10 aa, Entamoeba dispar
EQKYKSEGIK

SEQ ID NO: 2363229 - protein, 9 aa, Entamoeba dispar
EQKYSEKGS

SEQ ID NO: 2363230 - protein, 17 aa, Entamoeba dispar
EQLDSSSKIKPSLPPKA

SEQ ID NO: 2363231 - protein, 6 aa, Entamoeba dispar
EQLKSY

SEQ ID NO: 2363232 - protein, 10 aa, Entamoeba dispar
EQLSKQNDLT

SEQ ID NO: 2363233 - protein, 14 aa, Entamoeba dispar
EQNDKEKRKPIPRG

SEQ ID NO: 2363234 - protein, 5 aa, Entamoeba dispar
EQNEQ

SEQ ID NO: 2363235 - protein, 10 aa, Entamoeba dispar
EQNERKISSS

SEQ ID NO: 2363236 - protein, 8 aa, Entamoeba dispar
EQNGIEDY

SEQ ID NO: 2363237 - protein, 20 aa, Entamoeba dispar
EQNGVSFGKRKTKQAKKTVQ

SEQ ID NO: 2363238 - protein, 7 aa, Entamoeba dispar
EQNGYGC

SEQ ID NO: 2363239 - protein, 6 aa, Entamoeba dispar
EQNNGQ

SEQ ID NO: 2363240 - protein, 13 aa, Entamoeba dispar
EQNNTLAKSSLNY

SEQ ID NO: 2363241 - protein, 8 aa, Entamoeba dispar
EQNPQYKE

SEQ ID NO: 2363242 - protein, 14 aa, Entamoeba dispar
EQPEEGILVDEQIS

SEQ ID NO: 2363243 - protein, 9 aa, Entamoeba dispar
EQPEESHRG

SEQ ID NO: 2363244 - protein, 12 aa, Entamoeba dispar
EQPEKKKNFELK

SEQ ID NO: 2363245 - protein, 7 aa, Entamoeba dispar
EQPFQSA

SEQ ID NO: 2363246 - protein, 8 aa, Entamoeba dispar
EQPPVGAG

SEQ ID NO: 2363247 - protein, 9 aa, Entamoeba dispar
EQPSNRPDF

SEQ ID NO: 2363248 - protein, 7 aa, Entamoeba dispar
EQPSNTH

SEQ ID NO: 2363249 - protein, 9 aa, Entamoeba dispar
EQPSPCDRN

SEQ ID NO: 2363250 - protein, 8 aa, Entamoeba dispar
EQPTNPAI

SEQ ID NO: 2363251 - protein, 6 aa, Entamoeba dispar
EQQEQI

SEQ ID NO: 2363252 - protein, 8 aa, Entamoeba dispar
EQQETTSI

SEQ ID NO: 2363253 - protein, 11 aa, Entamoeba dispar
EQQKEEVNEQM

SEQ ID NO: 2363254 - protein, 6 aa, Entamoeba dispar
EQQKYK

SEQ ID NO: 2363255 - protein, 8 aa, Entamoeba dispar
EQQLKNKT

SEQ ID NO: 2363256 - protein, 6 aa, Entamoeba dispar
EQQNKV

SEQ ID NO: 2363257 - protein, 8 aa, Entamoeba dispar
EQQPSQFT

SEQ ID NO: 2363258 - protein, 7 aa, Entamoeba dispar
EQRAENN

SEQ ID NO: 2363259 - protein, 4 aa, Entamoeba dispar
EQRK

SEQ ID NO: 2363260 - protein, 33 aa, Entamoeba dispar
EQSDNTISKTQEEIEQEINSQKENIQNKEQNEF

SEQ ID NO: 2363261 - protein, 7 aa, Entamoeba dispar
EQSESEE

SEQ ID NO: 2363262 - protein, 10 aa, Entamoeba dispar
EQSHPKPSAM

SEQ ID NO: 2363263 - protein, 9 aa, Entamoeba dispar
EQSNKGTTL

SEQ ID NO: 2363264 - protein, 8 aa, Entamoeba dispar
EQSNTDQK

SEQ ID NO: 2363265 - protein, 6 aa, Entamoeba dispar
EQSSDD

SEQ ID NO: 2363266 - protein, 20 aa, Entamoeba dispar
EQSTKKHVKENYTRSRGYGK

SEQ ID NO: 2363267 - protein, 6 aa, Entamoeba dispar
EQSTLL

SEQ ID NO: 2363268 - protein, 11 aa, Entamoeba dispar
EQTASHARLGE

SEQ ID NO: 2363269 - protein, 20 aa, Entamoeba dispar
EQTEQLKAGNEQEGATDKLN

SEQ ID NO: 2363270 - protein, 8 aa, Entamoeba dispar
EQTNAHEE

SEQ ID NO: 2363271 - protein, 6 aa, Entamoeba dispar
EQTPIE

SEQ ID NO: 2363272 - protein, 7 aa, Entamoeba dispar
EQTSGSD

SEQ ID NO: 2363273 - protein, 15 aa, Entamoeba dispar
EQTTSQSTKNTGRQA

SEQ ID NO: 2363274 - protein, 8 aa, Entamoeba dispar
EQTYGIND

SEQ ID NO: 2363275 - protein, 7 aa, Entamoeba dispar
EQVKKTD

SEQ ID NO: 2363276 - protein, 9 aa, Entamoeba dispar
EQVNQSINL

SEQ ID NO: 2363277 - protein, 15 aa, Entamoeba dispar
EQVQDKTKLLESIEL

SEQ ID NO: 2363278 - protein, 5 aa, Entamoeba dispar
EQYDE

SEQ ID NO: 2363279 - protein, 4 aa, Entamoeba dispar
EQYE

SEQ ID NO: 2363280 - protein, 8 aa, Entamoeba dispar
EQYPQGIR

SEQ ID NO: 2363281 - protein, 5 aa, Entamoeba dispar
EQYSA

SEQ ID NO: 2363282 - protein, 10 aa, Entamoeba dispar
ERAKEKDELP

SEQ ID NO: 2363283 - protein, 9 aa, Entamoeba dispar
ERALKSKEE

SEQ ID NO: 2363284 - protein, 6 aa, Entamoeba dispar
ERANSN

SEQ ID NO: 2363285 - protein, 4 aa, Entamoeba dispar
ERAS

SEQ ID NO: 2363286 - protein, 4 aa, Entamoeba dispar
ERCI

SEQ ID NO: 2363287 - protein, 9 aa, Entamoeba dispar
ERDDEDQND

SEQ ID NO: 2363288 - protein, 34 aa, Entamoeba dispar
ERDESFYNETTSFSLNNSSSNIIQDEDDKDDMRK

SEQ ID NO: 2363289 - protein, 17 aa, Entamoeba dispar
ERDKPLDLNNTKLGEEV

SEQ ID NO: 2363290 - protein, 12 aa, Entamoeba dispar
ERDPRTTKQALS

SEQ ID NO: 2363291 - protein, 13 aa, Entamoeba dispar
EREERIKKVVKTL

SEQ ID NO: 2363292 - protein, 5 aa, Entamoeba dispar
EREPI

SEQ ID NO: 2363293 - protein, 6 aa, Entamoeba dispar
EREPKI

SEQ ID NO: 2363294 - protein, 7 aa, Entamoeba dispar
EREVPES

SEQ ID NO: 2363295 - protein, 9 aa, Entamoeba dispar
ERGIPDPTK

SEQ ID NO: 2363296 - protein, 12 aa, Entamoeba dispar
ERGRIADPHTIG

SEQ ID NO: 2363297 - protein, 6 aa, Entamoeba dispar
ERGSSH

SEQ ID NO: 2363298 - protein, 4 aa, Entamoeba dispar
ERIA

SEQ ID NO: 2363299 - protein, 6 aa, Entamoeba dispar
ERIETD

SEQ ID NO: 2363300 - protein, 51 aa, Entamoeba dispar
ERIGKKERKMKIKESKINTNYSTRKDIKNNRNIKQDEKKKEEKESEKQFET

SEQ ID NO: 2363301 - protein, 22 aa, Entamoeba dispar
ERIKNNKEKNINNQNDIQKINK

SEQ ID NO: 2363302 - protein, 13 aa, Entamoeba dispar
ERINSSKISSEAP

SEQ ID NO: 2363303 - protein, 8 aa, Entamoeba dispar
ERITNDGE

SEQ ID NO: 2363304 - protein, 8 aa, Entamoeba dispar
ERITNGTG

SEQ ID NO: 2363305 - protein, 9 aa, Entamoeba dispar
ERKDENNNI

SEQ ID NO: 2363306 - protein, 8 aa, Entamoeba dispar
ERKECPNE

SEQ ID NO: 2363307 - protein, 9 aa, Entamoeba dispar
ERKEQQEIH

SEQ ID NO: 2363308 - protein, 12 aa, Entamoeba dispar
ERKFGRTSANAL

SEQ ID NO: 2363309 - protein, 7 aa, Entamoeba dispar
ERKYEKQ

SEQ ID NO: 2363310 - protein, 6 aa, Entamoeba dispar
ERLGKE

SEQ ID NO: 2363311 - protein, 7 aa, Entamoeba dispar
ERNIDNE

SEQ ID NO: 2363312 - protein, 26 aa, Entamoeba dispar
ERNNGCTKCGNGVIDENEECDPSNKT

SEQ ID NO: 2363313 - protein, 8 aa, Entamoeba dispar
ERPDNMPD

SEQ ID NO: 2363314 - protein, 16 aa, Entamoeba dispar
ERPEEKESISNKVEEL

SEQ ID NO: 2363315 - protein, 6 aa, Entamoeba dispar
ERPFSN

SEQ ID NO: 2363316 - protein, 36 aa, Entamoeba dispar
ERPKKKKKQSKEGNEKEMNDELNTENISGSETKQVG

SEQ ID NO: 2363317 - protein, 12 aa, Entamoeba dispar
ERPRKKASTTRQ

SEQ ID NO: 2363318 - protein, 7 aa, Entamoeba dispar
ERQVPPK

SEQ ID NO: 2363319 - protein, 12 aa, Entamoeba dispar
ERREKENNPQTL

SEQ ID NO: 2363320 - protein, 29 aa, Entamoeba dispar
ERSDIGDYSYSSFSPDEETLCDASKKNGV

SEQ ID NO: 2363321 - protein, 4 aa, Entamoeba dispar
ERSE

SEQ ID NO: 2363322 - protein, 8 aa, Entamoeba dispar
ERSFGGKL

SEQ ID NO: 2363323 - protein, 8 aa, Entamoeba dispar
ERTEGEEC

SEQ ID NO: 2363324 - protein, 10 aa, Entamoeba dispar
ERTKKNKKRN

SEQ ID NO: 2363325 - protein, 19 aa, Entamoeba dispar
ERTKKRKRREEEKKKRKDG

SEQ ID NO: 2363326 - protein, 7 aa, Entamoeba dispar
ERTQPTD

SEQ ID NO: 2363327 - protein, 7 aa, Entamoeba dispar
ERTQSSF

SEQ ID NO: 2363328 - protein, 5 aa, Entamoeba dispar
ERTSK

SEQ ID NO: 2363329 - protein, 5 aa, Entamoeba dispar
ERVPA

SEQ ID NO: 2363330 - protein, 7 aa, Entamoeba dispar
ERVPTIP

SEQ ID NO: 2363331 - protein, 4 aa, Entamoeba dispar
ERWT

SEQ ID NO: 2363332 - protein, 6 aa, Entamoeba dispar
ERYGGD

SEQ ID NO: 2363333 - protein, 9 aa, Entamoeba dispar
ERYIPEEGK

SEQ ID NO: 2363334 - protein, 8 aa, Entamoeba dispar
ERYKNDKE

SEQ ID NO: 2363335 - protein, 13 aa, Entamoeba dispar
ERYNAVSQSNEFQ

SEQ ID NO: 2363336 - protein, 4 aa, Entamoeba dispar
ERYR

SEQ ID NO: 2363337 - protein, 18 aa, Entamoeba dispar
ERYSNSRITKNGLIDSNK

SEQ ID NO: 2363338 - protein, 8 aa, Entamoeba dispar
ERYVETSD

SEQ ID NO: 2363339 - protein, 8 aa, Entamoeba dispar
ESAGSEEL

SEQ ID NO: 2363340 - protein, 18 aa, Entamoeba dispar
ESAKRIKAKEIISGLKAV

SEQ ID NO: 2363341 - protein, 6 aa, Entamoeba dispar
ESAKSI

SEQ ID NO: 2363342 - protein, 13 aa, Entamoeba dispar
ESCKSCDKTNGKC

SEQ ID NO: 2363343 - protein, 6 aa, Entamoeba dispar
ESCPVK

SEQ ID NO: 2363344 - protein, 4 aa, Entamoeba dispar
ESCS

SEQ ID NO: 2363345 - protein, 9 aa, Entamoeba dispar
ESDARRKRK

SEQ ID NO: 2363346 - protein, 8 aa, Entamoeba dispar
ESDDDEQL

SEQ ID NO: 2363347 - protein, 8 aa, Entamoeba dispar
ESDDPGVV

SEQ ID NO: 2363348 - protein, 6 aa, Entamoeba dispar
ESDEIN

SEQ ID NO: 2363349 - protein, 8 aa, Entamoeba dispar
ESDHECPN

SEQ ID NO: 2363350 - protein, 17 aa, Entamoeba dispar
ESDMTGEPVAVKKSEKD

SEQ ID NO: 2363351 - protein, 9 aa, Entamoeba dispar
ESDNPDLRD

SEQ ID NO: 2363352 - protein, 7 aa, Entamoeba dispar
ESDNPIN

SEQ ID NO: 2363353 - protein, 8 aa, Entamoeba dispar
ESDQQTAR

SEQ ID NO: 2363354 - protein, 4 aa, Entamoeba dispar
ESDS

SEQ ID NO: 2363355 - protein, 10 aa, Entamoeba dispar
ESEDSPVDAS

SEQ ID NO: 2363356 - protein, 9 aa, Entamoeba dispar
ESEDSSDFG

SEQ ID NO: 2363357 - protein, 5 aa, Entamoeba dispar
ESEDT

SEQ ID NO: 2363358 - protein, 6 aa, Entamoeba dispar
ESEEGI

SEQ ID NO: 2363359 - protein, 6 aa, Entamoeba dispar
ESEEMV

SEQ ID NO: 2363360 - protein, 12 aa, Entamoeba dispar
ESEKENDGRYTH

SEQ ID NO: 2363361 - protein, 8 aa, Entamoeba dispar
ESEKGGRI

SEQ ID NO: 2363362 - protein, 8 aa, Entamoeba dispar
ESEKINEQ

SEQ ID NO: 2363363 - protein, 17 aa, Entamoeba dispar
ESESSSSSEENEGCPEG

SEQ ID NO: 2363364 - protein, 7 aa, Entamoeba dispar
ESEYEEE

SEQ ID NO: 2363365 - protein, 18 aa, Entamoeba dispar
ESFESKEEKKEEEIKEQK

SEQ ID NO: 2363366 - protein, 4 aa, Entamoeba dispar
ESFK

SEQ ID NO: 2363367 - protein, 13 aa, Entamoeba dispar
ESFSDKNQMYNNE

SEQ ID NO: 2363368 - protein, 13 aa, Entamoeba dispar
ESGEDYIKDEENG

SEQ ID NO: 2363369 - protein, 6 aa, Entamoeba dispar
ESGEYK

SEQ ID NO: 2363370 - protein, 5 aa, Entamoeba dispar
ESGKN

SEQ ID NO: 2363371 - protein, 6 aa, Entamoeba dispar
ESGPIT

SEQ ID NO: 2363372 - protein, 8 aa, Entamoeba dispar
ESGSIEMT

SEQ ID NO: 2363373 - protein, 11 aa, Entamoeba dispar
ESGSPFEGECT

SEQ ID NO: 2363374 - protein, 7 aa, Entamoeba dispar
ESGTNDG

SEQ ID NO: 2363375 - protein, 12 aa, Entamoeba dispar
ESGYGFNSDKSA

SEQ ID NO: 2363376 - protein, 5 aa, Entamoeba dispar
ESHNG

SEQ ID NO: 2363377 - protein, 7 aa, Entamoeba dispar
ESHNSNV

SEQ ID NO: 2363378 - protein, 4 aa, Entamoeba dispar
ESID

SEQ ID NO: 2363379 - protein, 8 aa, Entamoeba dispar
ESIDAKCT

SEQ ID NO: 2363380 - protein, 6 aa, Entamoeba dispar
ESIDKR

SEQ ID NO: 2363381 - protein, 8 aa, Entamoeba dispar
ESIENNEI

SEQ ID NO: 2363382 - protein, 6 aa, Entamoeba dispar
ESINDP

SEQ ID NO: 2363383 - protein, 8 aa, Entamoeba dispar
ESISEEEV

SEQ ID NO: 2363384 - protein, 8 aa, Entamoeba dispar
ESITSSPK

SEQ ID NO: 2363385 - protein, 7 aa, Entamoeba dispar
ESIWNSN

SEQ ID NO: 2363386 - protein, 8 aa, Entamoeba dispar
ESKDKVQE

SEQ ID NO: 2363387 - protein, 4 aa, Entamoeba dispar
ESKE

SEQ ID NO: 2363388 - protein, 7 aa, Entamoeba dispar
ESKEGIE

SEQ ID NO: 2363389 - protein, 7 aa, Entamoeba dispar
ESKGLDE

SEQ ID NO: 2363390 - protein, 13 aa, Entamoeba dispar
ESKISELIAIAWY

SEQ ID NO: 2363391 - protein, 12 aa, Entamoeba dispar
ESKKEPDPSKAQ

SEQ ID NO: 2363392 - protein, 8 aa, Entamoeba dispar
ESKLELST

SEQ ID NO: 2363393 - protein, 9 aa, Entamoeba dispar
ESKNSKKIV

SEQ ID NO: 2363394 - protein, 5 aa, Entamoeba dispar
ESKPL

SEQ ID NO: 2363395 - protein, 14 aa, Entamoeba dispar
ESKPNKNSSDYIDG

SEQ ID NO: 2363396 - protein, 10 aa, Entamoeba dispar
ESKPSKSFSK

SEQ ID NO: 2363397 - protein, 10 aa, Entamoeba dispar
ESKQGKQEIP

SEQ ID NO: 2363398 - protein, 28 aa, Entamoeba dispar
ESKQTSSTHPHPDDHDDDDDDDDDDDDF

SEQ ID NO: 2363399 - protein, 10 aa, Entamoeba dispar
ESKSSISLES

SEQ ID NO: 2363400 - protein, 7 aa, Entamoeba dispar
ESKSTLN

SEQ ID NO: 2363401 - protein, 7 aa, Entamoeba dispar
ESKTPNI

SEQ ID NO: 2363402 - protein, 7 aa, Entamoeba dispar
ESKTPYS

SEQ ID NO: 2363403 - protein, 5 aa, Entamoeba dispar
ESKTY

SEQ ID NO: 2363404 - protein, 14 aa, Entamoeba dispar
ESKYQRIKEQKITS

SEQ ID NO: 2363405 - protein, 4 aa, Entamoeba dispar
ESLE

SEQ ID NO: 2363406 - protein, 7 aa, Entamoeba dispar
ESLGSPS

SEQ ID NO: 2363407 - protein, 5 aa, Entamoeba dispar
ESLHQ

SEQ ID NO: 2363408 - protein, 5 aa, Entamoeba dispar
ESLTS

SEQ ID NO: 2363409 - protein, 6 aa, Entamoeba dispar
ESLTST

SEQ ID NO: 2363410 - protein, 6 aa, Entamoeba dispar
ESLTTS

SEQ ID NO: 2363411 - protein, 8 aa, Entamoeba dispar
ESMAEQQV

SEQ ID NO: 2363412 - protein, 4 aa, Entamoeba dispar
ESMV

SEQ ID NO: 2363413 - protein, 12 aa, Entamoeba dispar
ESMVSTTKKGNT

SEQ ID NO: 2363414 - protein, 7 aa, Entamoeba dispar
ESNASYA

SEQ ID NO: 2363415 - protein, 6 aa, Entamoeba dispar
ESNATE

SEQ ID NO: 2363416 - protein, 9 aa, Entamoeba dispar
ESNDSGCSK

SEQ ID NO: 2363417 - protein, 5 aa, Entamoeba dispar
ESNEH

SEQ ID NO: 2363418 - protein, 5 aa, Entamoeba dispar
ESNFP

SEQ ID NO: 2363419 - protein, 8 aa, Entamoeba dispar
ESNKSVPL

SEQ ID NO: 2363420 - protein, 14 aa, Entamoeba dispar
ESNNKKITSGQENK

SEQ ID NO: 2363421 - protein, 11 aa, Entamoeba dispar
ESNNSDNPSEE

SEQ ID NO: 2363422 - protein, 7 aa, Entamoeba dispar
ESNPSTI

SEQ ID NO: 2363423 - protein, 5 aa, Entamoeba dispar
ESNRI

SEQ ID NO: 2363424 - protein, 7 aa, Entamoeba dispar
ESNSQVS

SEQ ID NO: 2363425 - protein, 37 aa, Entamoeba dispar
ESNSSSPFEELESPSLSPKCKRSYSVSSNGGRTPRLN

SEQ ID NO: 2363426 - protein, 6 aa, Entamoeba dispar
ESNTEV

SEQ ID NO: 2363427 - protein, 5 aa, Entamoeba dispar
ESNTK

SEQ ID NO: 2363428 - protein, 5 aa, Entamoeba dispar
ESNYK

SEQ ID NO: 2363429 - protein, 4 aa, Entamoeba dispar
ESPF

SEQ ID NO: 2363430 - protein, 14 aa, Entamoeba dispar
ESPINSSSGYTQPN

SEQ ID NO: 2363431 - protein, 5 aa, Entamoeba dispar
ESPKS

SEQ ID NO: 2363432 - protein, 9 aa, Entamoeba dispar
ESPNNNEYK

SEQ ID NO: 2363433 - protein, 10 aa, Entamoeba dispar
ESPPSIDQDQ

SEQ ID NO: 2363434 - protein, 6 aa, Entamoeba dispar
ESPQPV

SEQ ID NO: 2363435 - protein, 6 aa, Entamoeba dispar
ESPSQS

SEQ ID NO: 2363436 - protein, 4 aa, Entamoeba dispar
ESPY

SEQ ID NO: 2363437 - protein, 7 aa, Entamoeba dispar
ESPYPSG

SEQ ID NO: 2363438 - protein, 8 aa, Entamoeba dispar
ESQGTSGQ

SEQ ID NO: 2363439 - protein, 10 aa, Entamoeba dispar
ESQIGKSQSY

SEQ ID NO: 2363440 - protein, 18 aa, Entamoeba dispar
ESQKDRIKKQLEETRNTM

SEQ ID NO: 2363441 - protein, 5 aa, Entamoeba dispar
ESQKN

SEQ ID NO: 2363442 - protein, 19 aa, Entamoeba dispar
ESQLTENELKSDDERKSFD

SEQ ID NO: 2363443 - protein, 7 aa, Entamoeba dispar
ESQSSSL

SEQ ID NO: 2363444 - protein, 6 aa, Entamoeba dispar
ESQYER

SEQ ID NO: 2363445 - protein, 5 aa, Entamoeba dispar
ESRQL

SEQ ID NO: 2363446 - protein, 15 aa, Entamoeba dispar
ESRRMEKEGNPKLAD

SEQ ID NO: 2363447 - protein, 27 aa, Entamoeba dispar
ESRSSMSKSEDNEEINEASVSSEMVND

SEQ ID NO: 2363448 - protein, 14 aa, Entamoeba dispar
ESSATEANTTNRHG

SEQ ID NO: 2363449 - protein, 15 aa, Entamoeba dispar
ESSEDELEVKSGTQY

SEQ ID NO: 2363450 - protein, 15 aa, Entamoeba dispar
ESSGGNQNLGGNNFD

SEQ ID NO: 2363451 - protein, 5 aa, Entamoeba dispar
ESSGM

SEQ ID NO: 2363452 - protein, 11 aa, Entamoeba dispar
ESSKAVDTEGT

SEQ ID NO: 2363453 - protein, 9 aa, Entamoeba dispar
ESSKEGNYI

SEQ ID NO: 2363454 - protein, 16 aa, Entamoeba dispar
ESSKFQPDISKRDPNH

SEQ ID NO: 2363455 - protein, 7 aa, Entamoeba dispar
ESSKQYE

SEQ ID NO: 2363456 - protein, 16 aa, Entamoeba dispar
ESSKVNGKLTDFGSSR

SEQ ID NO: 2363457 - protein, 9 aa, Entamoeba dispar
ESSNEGTTL

SEQ ID NO: 2363458 - protein, 7 aa, Entamoeba dispar
ESSNFNC

SEQ ID NO: 2363459 - protein, 7 aa, Entamoeba dispar
ESSNNIT

SEQ ID NO: 2363460 - protein, 8 aa, Entamoeba dispar
ESSNQTTF

SEQ ID NO: 2363461 - protein, 7 aa, Entamoeba dispar
ESSNVSK

SEQ ID NO: 2363462 - protein, 8 aa, Entamoeba dispar
ESSPDPYN

SEQ ID NO: 2363463 - protein, 7 aa, Entamoeba dispar
ESSPNPS

SEQ ID NO: 2363464 - protein, 10 aa, Entamoeba dispar
ESSSDNGPSL

SEQ ID NO: 2363465 - protein, 9 aa, Entamoeba dispar
ESSSSENLF

SEQ ID NO: 2363466 - protein, 5 aa, Entamoeba dispar
ESSSY

SEQ ID NO: 2363467 - protein, 8 aa, Entamoeba dispar
ESSTEKLE

SEQ ID NO: 2363468 - protein, 6 aa, Entamoeba dispar
ESSYKD

SEQ ID NO: 2363469 - protein, 9 aa, Entamoeba dispar
ESSYKNVSS

SEQ ID NO: 2363470 - protein, 4 aa, Entamoeba dispar
ESTE

SEQ ID NO: 2363471 - protein, 12 aa, Entamoeba dispar
ESTEEEQEQIND

SEQ ID NO: 2363472 - protein, 8 aa, Entamoeba dispar
ESTELPTT

SEQ ID NO: 2363473 - protein, 6 aa, Entamoeba dispar
ESTNDM

SEQ ID NO: 2363474 - protein, 8 aa, Entamoeba dispar
ESTNGDGQ

SEQ ID NO: 2363475 - protein, 7 aa, Entamoeba dispar
ESTNLSG

SEQ ID NO: 2363476 - protein, 9 aa, Entamoeba dispar
ESTNLTTEL

SEQ ID NO: 2363477 - protein, 7 aa, Entamoeba dispar
ESTNQTK

SEQ ID NO: 2363478 - protein, 11 aa, Entamoeba dispar
ESTRTDRETSK

SEQ ID NO: 2363479 - protein, 7 aa, Entamoeba dispar
ESTSTMK

SEQ ID NO: 2363480 - protein, 7 aa, Entamoeba dispar
ESTVKSC

SEQ ID NO: 2363481 - protein, 5 aa, Entamoeba dispar
ESTVY

SEQ ID NO: 2363482 - protein, 11 aa, Entamoeba dispar
ESTYKSYGLTQ

SEQ ID NO: 2363483 - protein, 13 aa, Entamoeba dispar
ESVENAKRVKAPT

SEQ ID NO: 2363484 - protein, 12 aa, Entamoeba dispar
ESVGKASFNGEN

SEQ ID NO: 2363485 - protein, 5 aa, Entamoeba dispar
ESVKT

SEQ ID NO: 2363486 - protein, 5 aa, Entamoeba dispar
ESVNS

SEQ ID NO: 2363487 - protein, 16 aa, Entamoeba dispar
ESVRNNDLKTGKNGLE

SEQ ID NO: 2363488 - protein, 7 aa, Entamoeba dispar
ESVTPGS

SEQ ID NO: 2363489 - protein, 11 aa, Entamoeba dispar
ESWTQDDQKLL

SEQ ID NO: 2363490 - protein, 7 aa, Entamoeba dispar
ESYEDTI

SEQ ID NO: 2363491 - protein, 7 aa, Entamoeba dispar
ESYSSPS

SEQ ID NO: 2363492 - protein, 9 aa, Entamoeba dispar
ESYYEKNGS

SEQ ID NO: 2363493 - protein, 5 aa, Entamoeba dispar
ETAKD

SEQ ID NO: 2363494 - protein, 5 aa, Entamoeba dispar
ETAQN

SEQ ID NO: 2363495 - protein, 15 aa, Entamoeba dispar
ETCERREKGINPQTL

SEQ ID NO: 2363496 - protein, 16 aa, Entamoeba dispar
ETCERREQENNPKTFG

SEQ ID NO: 2363497 - protein, 8 aa, Entamoeba dispar
ETCQRRRG

SEQ ID NO: 2363498 - protein, 5 aa, Entamoeba dispar
ETCSS

SEQ ID NO: 2363499 - protein, 32 aa, Entamoeba dispar
  misc_feature (17)..(18): Xaa can be any naturally occurring amino acid
ETDDSSYVTYDATTPLXXDLKTSISVLFFFCL

SEQ ID NO: 2363500 - protein, 7 aa, Entamoeba dispar
ETDEKDE

SEQ ID NO: 2363501 - protein, 12 aa, Entamoeba dispar
ETDFPPTPDQYK

SEQ ID NO: 2363502 - protein, 5 aa, Entamoeba dispar
ETDIS

SEQ ID NO: 2363503 - protein, 4 aa, Entamoeba dispar
ETDL

SEQ ID NO: 2363504 - protein, 15 aa, Entamoeba dispar
ETDPWDEEEKPNNGT

SEQ ID NO: 2363505 - protein, 7 aa, Entamoeba dispar
ETDQGIE

SEQ ID NO: 2363506 - protein, 7 aa, Entamoeba dispar
ETDRDKG

SEQ ID NO: 2363507 - protein, 7 aa, Entamoeba dispar
ETDTEYY

SEQ ID NO: 2363508 - protein, 7 aa, Entamoeba dispar
ETEEIEK

SEQ ID NO: 2363509 - protein, 6 aa, Entamoeba dispar
ETEEIP

SEQ ID NO: 2363510 - protein, 8 aa, Entamoeba dispar
ETEEVGGS

SEQ ID NO: 2363511 - protein, 5 aa, Entamoeba dispar
ETEIQ

SEQ ID NO: 2363512 - protein, 23 aa, Entamoeba dispar
ETEITSRLDPDELKEDKKLGEGS

SEQ ID NO: 2363513 - protein, 21 aa, Entamoeba dispar
ETEKYKAEDDENKARIETKNQ

SEQ ID NO: 2363514 - protein, 10 aa, Entamoeba dispar
ETELDETSKQ

SEQ ID NO: 2363515 - protein, 5 aa, Entamoeba dispar
ETENL

SEQ ID NO: 2363516 - protein, 7 aa, Entamoeba dispar
ETENSES

SEQ ID NO: 2363517 - protein, 11 aa, Entamoeba dispar
ETEQEEDVDDG

SEQ ID NO: 2363518 - protein, 6 aa, Entamoeba dispar
ETEQFY

SEQ ID NO: 2363519 - protein, 7 aa, Entamoeba dispar
ETERTKR

SEQ ID NO: 2363520 - protein, 5 aa, Entamoeba dispar
ETESQ

SEQ ID NO: 2363521 - protein, 8 aa, Entamoeba dispar
ETETNKRA

SEQ ID NO: 2363522 - protein, 4 aa, Entamoeba dispar
ETEV

SEQ ID NO: 2363523 - protein, 48 aa, Entamoeba dispar
ETEYQQTSINSLKTGLTANESQNIQEISTQGSELNNSVQEFPQKQGKK

SEQ ID NO: 2363524 - protein, 5 aa, Entamoeba dispar
ETFDS

SEQ ID NO: 2363525 - protein, 4 aa, Entamoeba dispar
ETFN

SEQ ID NO: 2363526 - protein, 16 aa, Entamoeba dispar
ETGIELKQNNSSWTSF

SEQ ID NO: 2363527 - protein, 10 aa, Entamoeba dispar
ETGKTENNFV

SEQ ID NO: 2363528 - protein, 14 aa, Entamoeba dispar
ETGREEGDKLETKG

SEQ ID NO: 2363529 - protein, 11 aa, Entamoeba dispar
ETGYNGSKYTK

SEQ ID NO: 2363530 - protein, 9 aa, Entamoeba dispar
ETHEETRND

SEQ ID NO: 2363531 - protein, 15 aa, Entamoeba dispar
ETHNSNVKTKTMDSY

SEQ ID NO: 2363532 - protein, 6 aa, Entamoeba dispar
ETIAKE

SEQ ID NO: 2363533 - protein, 4 aa, Entamoeba dispar
ETIE

SEQ ID NO: 2363534 - protein, 6 aa, Entamoeba dispar
ETIESG

SEQ ID NO: 2363535 - protein, 11 aa, Entamoeba dispar
ETIPEDQSGPC

SEQ ID NO: 2363536 - protein, 5 aa, Entamoeba dispar
ETIPK

SEQ ID NO: 2363537 - protein, 18 aa, Entamoeba dispar
ETKDSCSTLDEDQESQTI

SEQ ID NO: 2363538 - protein, 5 aa, Entamoeba dispar
ETKEC

SEQ ID NO: 2363539 - protein, 8 aa, Entamoeba dispar
ETKEELYE

SEQ ID NO: 2363540 - protein, 6 aa, Entamoeba dispar
ETKNFS

SEQ ID NO: 2363541 - protein, 8 aa, Entamoeba dispar
ETKNSEDD

SEQ ID NO: 2363542 - protein, 5 aa, Entamoeba dispar
ETKNY

SEQ ID NO: 2363543 - protein, 4 aa, Entamoeba dispar
ETKQ

SEQ ID NO: 2363544 - protein, 7 aa, Entamoeba dispar
ETKQILN

SEQ ID NO: 2363545 - protein, 15 aa, Entamoeba dispar
ETKSSNENVCAKSKQ

SEQ ID NO: 2363546 - protein, 11 aa, Entamoeba dispar
ETKVKKGKTGV

SEQ ID NO: 2363547 - protein, 12 aa, Entamoeba dispar
ETLKVSKENMVR

SEQ ID NO: 2363548 - protein, 15 aa, Entamoeba dispar
ETLPSPDACHSKEMK

SEQ ID NO: 2363549 - protein, 4 aa, Entamoeba dispar
ETLQ

SEQ ID NO: 2363550 - protein, 7 aa, Entamoeba dispar
ETLRTKP

SEQ ID NO: 2363551 - protein, 7 aa, Entamoeba dispar
ETLSNET

SEQ ID NO: 2363552 - protein, 5 aa, Entamoeba dispar
ETMDT

SEQ ID NO: 2363553 - protein, 5 aa, Entamoeba dispar
ETMGD

SEQ ID NO: 2363554 - protein, 5 aa, Entamoeba dispar
ETMGP

SEQ ID NO: 2363555 - protein, 7 aa, Entamoeba dispar
ETMGSSI

SEQ ID NO: 2363556 - protein, 4 aa, Entamoeba dispar
ETMS

SEQ ID NO: 2363557 - protein, 10 aa, Entamoeba dispar
ETNDRNGSER

SEQ ID NO: 2363558 - protein, 9 aa, Entamoeba dispar
ETNENVPSK

SEQ ID NO: 2363559 - protein, 6 aa, Entamoeba dispar
ETNEPT

SEQ ID NO: 2363560 - protein, 51 aa, Entamoeba dispar
ETNESIHSRQNEKLESYQSQQEKDSRSESDDSLPAPKTQASNASNSEEKIE

SEQ ID NO: 2363561 - protein, 20 aa, Entamoeba dispar
ETNGEYNEALENQYNEYYED

SEQ ID NO: 2363562 - protein, 5 aa, Entamoeba dispar
ETNGV

SEQ ID NO: 2363563 - protein, 7 aa, Entamoeba dispar
ETNKITG

SEQ ID NO: 2363564 - protein, 6 aa, Entamoeba dispar
ETNLSR

SEQ ID NO: 2363565 - protein, 5 aa, Entamoeba dispar
ETNND

SEQ ID NO: 2363566 - protein, 5 aa, Entamoeba dispar
ETNPY

SEQ ID NO: 2363567 - protein, 4 aa, Entamoeba dispar
ETNR

SEQ ID NO: 2363568 - protein, 7 aa, Entamoeba dispar
ETNVTKE

SEQ ID NO: 2363569 - protein, 8 aa, Entamoeba dispar
ETNWKANS

SEQ ID NO: 2363570 - protein, 7 aa, Entamoeba dispar
ETNYSKP

SEQ ID NO: 2363571 - protein, 42 aa, Entamoeba dispar
ETPANFSKATTPSRLPSRPTSRISQNSVKQFSKSSTPSQLST

SEQ ID NO: 2363572 - protein, 5 aa, Entamoeba dispar
ETPEL

SEQ ID NO: 2363573 - protein, 7 aa, Entamoeba dispar
ETPFEDT

SEQ ID NO: 2363574 - protein, 5 aa, Entamoeba dispar
ETPFQ

SEQ ID NO: 2363575 - protein, 5 aa, Entamoeba dispar
ETPKF

SEQ ID NO: 2363576 - protein, 10 aa, Entamoeba dispar
ETPLKSEKDM

SEQ ID NO: 2363577 - protein, 7 aa, Entamoeba dispar
ETPPRSK

SEQ ID NO: 2363578 - protein, 5 aa, Entamoeba dispar
ETPSH

SEQ ID NO: 2363579 - protein, 4 aa, Entamoeba dispar
ETPT

SEQ ID NO: 2363580 - protein, 4 aa, Entamoeba dispar
ETPY

SEQ ID NO: 2363581 - protein, 10 aa, Entamoeba dispar
ETQKTRNETV

SEQ ID NO: 2363582 - protein, 6 aa, Entamoeba dispar
ETQNKD

SEQ ID NO: 2363583 - protein, 4 aa, Entamoeba dispar
ETQP

SEQ ID NO: 2363584 - protein, 7 aa, Entamoeba dispar
ETQTNPS

SEQ ID NO: 2363585 - protein, 8 aa, Entamoeba dispar
ETRDQKVE

SEQ ID NO: 2363586 - protein, 6 aa, Entamoeba dispar
ETRDQR

SEQ ID NO: 2363587 - protein, 9 aa, Entamoeba dispar
ETRKGNEKY

SEQ ID NO: 2363588 - protein, 6 aa, Entamoeba dispar
ETRSVT

SEQ ID NO: 2363589 - protein, 6 aa, Entamoeba dispar
ETSCSN

SEQ ID NO: 2363590 - protein, 7 aa, Entamoeba dispar
ETSISDY

SEQ ID NO: 2363591 - protein, 9 aa, Entamoeba dispar
ETSKSEENI

SEQ ID NO: 2363592 - protein, 9 aa, Entamoeba dispar
ETSKSEILG

SEQ ID NO: 2363593 - protein, 20 aa, Entamoeba dispar
ETSNEGTTSIKEVENNDKSI

SEQ ID NO: 2363594 - protein, 10 aa, Entamoeba dispar
ETSNGKCSKC

SEQ ID NO: 2363595 - protein, 17 aa, Entamoeba dispar
ETSPISDIAGKKSSTYI

SEQ ID NO: 2363596 - protein, 10 aa, Entamoeba dispar
ETSSCNDREL

SEQ ID NO: 2363597 - protein, 18 aa, Entamoeba dispar
ETSSFKSNYPKKTDKYNR

SEQ ID NO: 2363598 - protein, 6 aa, Entamoeba dispar
ETSSNC

SEQ ID NO: 2363599 - protein, 10 aa, Entamoeba dispar
ETTAKNQNIS

SEQ ID NO: 2363600 - protein, 4 aa, Entamoeba dispar
ETTE

SEQ ID NO: 2363601 - protein, 10 aa, Entamoeba dispar
ETTEEENEDI

SEQ ID NO: 2363602 - protein, 10 aa, Entamoeba dispar
ETTEEENNDI

SEQ ID NO: 2363603 - protein, 7 aa, Entamoeba dispar
ETTEELY

SEQ ID NO: 2363604 - protein, 5 aa, Entamoeba dispar
ETTEY

SEQ ID NO: 2363605 - protein, 4 aa, Entamoeba dispar
ETTF

SEQ ID NO: 2363606 - protein, 10 aa, Entamoeba dispar
ETTGKRTQQL

SEQ ID NO: 2363607 - protein, 6 aa, Entamoeba dispar
ETTGNT

SEQ ID NO: 2363608 - protein, 13 aa, Entamoeba dispar
ETTKEESEQYVHL

SEQ ID NO: 2363609 - protein, 8 aa, Entamoeba dispar
ETTLTTNK

SEQ ID NO: 2363610 - protein, 8 aa, Entamoeba dispar
ETTPTLNQ

SEQ ID NO: 2363611 - protein, 10 aa, Entamoeba dispar
ETTSRDQWNN

SEQ ID NO: 2363612 - protein, 5 aa, Entamoeba dispar
ETTSS

SEQ ID NO: 2363613 - protein, 8 aa, Entamoeba dispar
ETTSTKKS

SEQ ID NO: 2363614 - protein, 4 aa, Entamoeba dispar
ETVP

SEQ ID NO: 2363615 - protein, 8 aa, Entamoeba dispar
ETVRSSKN

SEQ ID NO: 2363616 - protein, 5 aa, Entamoeba dispar
ETVST

SEQ ID NO: 2363617 - protein, 5 aa, Entamoeba dispar
ETYED

SEQ ID NO: 2363618 - protein, 13 aa, Entamoeba dispar
ETYETIAASSNRA

SEQ ID NO: 2363619 - protein, 7 aa, Entamoeba dispar
ETYNRLQ

SEQ ID NO: 2363620 - protein, 8 aa, Entamoeba dispar
EVDEDTKT

SEQ ID NO: 2363621 - protein, 7 aa, Entamoeba dispar
EVDGDGC

SEQ ID NO: 2363622 - protein, 5 aa, Entamoeba dispar
EVDKD

SEQ ID NO: 2363623 - protein, 31 aa, Entamoeba dispar
EVDKEEKPRRIKPFTTGDYPGSDQKPEDRAA

SEQ ID NO: 2363624 - protein, 20 aa, Entamoeba dispar
EVDNGYSKVDGEENVNDVVV

SEQ ID NO: 2363625 - protein, 5 aa, Entamoeba dispar
EVEPE

SEQ ID NO: 2363626 - protein, 5 aa, Entamoeba dispar
EVGDK

SEQ ID NO: 2363627 - protein, 8 aa, Entamoeba dispar
EVGERSET

SEQ ID NO: 2363628 - protein, 12 aa, Entamoeba dispar
EVGINNTNTIAR

SEQ ID NO: 2363629 - protein, 8 aa, Entamoeba dispar
EVGRRSET

SEQ ID NO: 2363630 - protein, 12 aa, Entamoeba dispar
EVIESDKTSLQN

SEQ ID NO: 2363631 - protein, 4 aa, Entamoeba dispar
EVIP

SEQ ID NO: 2363632 - protein, 7 aa, Entamoeba dispar
EVKDSTM

SEQ ID NO: 2363633 - protein, 5 aa, Entamoeba dispar
EVKDT

SEQ ID NO: 2363634 - protein, 6 aa, Entamoeba dispar
EVKGNV

SEQ ID NO: 2363635 - protein, 9 aa, Entamoeba dispar
EVKKGDPVY

SEQ ID NO: 2363636 - protein, 12 aa, Entamoeba dispar
EVKKKPEKDYMP

SEQ ID NO: 2363637 - protein, 4 aa, Entamoeba dispar
EVKS

SEQ ID NO: 2363638 - protein, 13 aa, Entamoeba dispar
EVLGNTKGSEGYN

SEQ ID NO: 2363639 - protein, 8 aa, Entamoeba dispar
EVNGGPGA

SEQ ID NO: 2363640 - protein, 31 aa, Entamoeba dispar
EVNNSNDSQLIDRNDSFERKAERSLSLSPRV

SEQ ID NO: 2363641 - protein, 6 aa, Entamoeba dispar
EVPEPK

SEQ ID NO: 2363642 - protein, 5 aa, Entamoeba dispar
EVPKD

SEQ ID NO: 2363643 - protein, 9 aa, Entamoeba dispar
EVPYKEDPN

SEQ ID NO: 2363644 - protein, 16 aa, Entamoeba dispar
EVQIDRKENYEDDREI

SEQ ID NO: 2363645 - protein, 24 aa, Entamoeba dispar
EVRDRIKTEKQEKEKKDNQKSTEL

SEQ ID NO: 2363646 - protein, 13 aa, Entamoeba dispar
EVSFSQENDGTTI

SEQ ID NO: 2363647 - protein, 4 aa, Entamoeba dispar
EVSP

SEQ ID NO: 2363648 - protein, 8 aa, Entamoeba dispar
EVSSNGTY

SEQ ID NO: 2363649 - protein, 15 aa, Entamoeba dispar
EVSSSPELTFYVPKL

SEQ ID NO: 2363650 - protein, 9 aa, Entamoeba dispar
EVTKSTSNI

SEQ ID NO: 2363651 - protein, 19 aa, Entamoeba dispar
EVVGGGQQSTIKEKEYSSV

SEQ ID NO: 2363652 - protein, 9 aa, Entamoeba dispar
EVYQSTSQI

SEQ ID NO: 2363653 - protein, 7 aa, Entamoeba dispar
EWKDAST

SEQ ID NO: 2363654 - protein, 13 aa, Entamoeba dispar
EWKQSKSKYIGKL

SEQ ID NO: 2363655 - protein, 4 aa, Entamoeba dispar
EWNA

SEQ ID NO: 2363656 - protein, 12 aa, Entamoeba dispar
EWNNTQSNERIN

SEQ ID NO: 2363657 - protein, 7 aa, Entamoeba dispar
EWPKESS

SEQ ID NO: 2363658 - protein, 7 aa, Entamoeba dispar
EWSPSGS

SEQ ID NO: 2363659 - protein, 10 aa, Entamoeba dispar
EYDEKNERHY

SEQ ID NO: 2363660 - protein, 10 aa, Entamoeba dispar
EYDQTSYNYD

SEQ ID NO: 2363661 - protein, 4 aa, Entamoeba dispar
EYEA

SEQ ID NO: 2363662 - protein, 4 aa, Entamoeba dispar
EYEE

SEQ ID NO: 2363663 - protein, 19 aa, Entamoeba dispar
EYEEKEEREIIEETKDTIT

SEQ ID NO: 2363664 - protein, 22 aa, Entamoeba dispar
EYEIPATSSEIEEAITMIIPCV

SEQ ID NO: 2363665 - protein, 8 aa, Entamoeba dispar
EYEKDEDL

SEQ ID NO: 2363666 - protein, 11 aa, Entamoeba dispar
EYELEGKDPVY

SEQ ID NO: 2363667 - protein, 5 aa, Entamoeba dispar
EYEPT

SEQ ID NO: 2363668 - protein, 12 aa, Entamoeba dispar
EYGDAENKQQKK

SEQ ID NO: 2363669 - protein, 9 aa, Entamoeba dispar
EYGDTKSKL

SEQ ID NO: 2363670 - protein, 10 aa, Entamoeba dispar
EYGGSQSDKK

SEQ ID NO: 2363671 - protein, 9 aa, Entamoeba dispar
EYGKTGGYG

SEQ ID NO: 2363672 - protein, 17 aa, Entamoeba dispar
EYGPYGEFRNNTDVPQR

SEQ ID NO: 2363673 - protein, 19 aa, Entamoeba dispar
EYHRTPSGQSKRTKKTWGK

SEQ ID NO: 2363674 - protein, 13 aa, Entamoeba dispar
EYKEENNNNQEII

SEQ ID NO: 2363675 - protein, 8 aa, Entamoeba dispar
EYKGNDNG

SEQ ID NO: 2363676 - protein, 5 aa, Entamoeba dispar
EYKRE

SEQ ID NO: 2363677 - protein, 8 aa, Entamoeba dispar
EYKSTTSV

SEQ ID NO: 2363678 - protein, 7 aa, Entamoeba dispar
EYLPETP

SEQ ID NO: 2363679 - protein, 4 aa, Entamoeba dispar
EYND

SEQ ID NO: 2363680 - protein, 5 aa, Entamoeba dispar
EYNLP

SEQ ID NO: 2363681 - protein, 5 aa, Entamoeba dispar
EYNNS

SEQ ID NO: 2363682 - protein, 9 aa, Entamoeba dispar
EYNPTPRRT

SEQ ID NO: 2363683 - protein, 10 aa, Entamoeba dispar
EYNQKDETRK

SEQ ID NO: 2363684 - protein, 8 aa, Entamoeba dispar
EYNRSREG

SEQ ID NO: 2363685 - protein, 6 aa, Entamoeba dispar
EYNSAG

SEQ ID NO: 2363686 - protein, 5 aa, Entamoeba dispar
EYNTN

SEQ ID NO: 2363687 - protein, 4 aa, Entamoeba dispar
EYPE

SEQ ID NO: 2363688 - protein, 6 aa, Entamoeba dispar
EYPEQV

SEQ ID NO: 2363689 - protein, 4 aa, Entamoeba dispar
EYPG

SEQ ID NO: 2363690 - protein, 9 aa, Entamoeba dispar
EYPKGSNGY

SEQ ID NO: 2363691 - protein, 6 aa, Entamoeba dispar
EYPPTS

SEQ ID NO: 2363692 - protein, 8 aa, Entamoeba dispar
EYPSSLPN

SEQ ID NO: 2363693 - protein, 5 aa, Entamoeba dispar
EYPVN

SEQ ID NO: 2363694 - protein, 20 aa, Entamoeba dispar
EYQEYATEQIKKKKEKDEKL

SEQ ID NO: 2363695 - protein, 5 aa, Entamoeba dispar
EYQHQ

SEQ ID NO: 2363696 - protein, 4 aa, Entamoeba dispar
EYRR

SEQ ID NO: 2363697 - protein, 5 aa, Entamoeba dispar
EYRSK

SEQ ID NO: 2363698 - protein, 9 aa, Entamoeba dispar
EYSKSYDGY

SEQ ID NO: 2363699 - protein, 5 aa, Entamoeba dispar
EYSND

SEQ ID NO: 2363700 - protein, 11 aa, Entamoeba dispar
EYSNNSPDQVS

SEQ ID NO: 2363701 - protein, 4 aa, Entamoeba dispar
EYSP

SEQ ID NO: 2363702 - protein, 4 aa, Entamoeba dispar
EYSQ

SEQ ID NO: 2363703 - protein, 5 aa, Entamoeba dispar
EYSSS

SEQ ID NO: 2363704 - protein, 9 aa, Entamoeba dispar
EYSTPPPHS

SEQ ID NO: 2363705 - protein, 4 aa, Entamoeba dispar
EYTF

SEQ ID NO: 2363706 - protein, 13 aa, Entamoeba dispar
EYTGEPNGTPYYS

SEQ ID NO: 2363707 - protein, 11 aa, Entamoeba dispar
EYTPEKGQAES

SEQ ID NO: 2363708 - protein, 5 aa, Entamoeba dispar
EYTQE

SEQ ID NO: 2363709 - protein, 19 aa, Entamoeba dispar
EYTQIDSNSTILQKNSTSK

SEQ ID NO: 2363710 - protein, 14 aa, Entamoeba dispar
EYTTTVKETKRGFF

SEQ ID NO: 2363711 - protein, 8 aa, Entamoeba dispar
EYYSKEDK

SEQ ID NO: 2363712 - protein, 11 aa, Entamoeba dispar
FADIDGDDSLD

SEQ ID NO: 2363713 - protein, 8 aa, Entamoeba dispar
FADKTGVD

SEQ ID NO: 2363714 - protein, 7 aa, Entamoeba dispar
FAESPRQ

SEQ ID NO: 2363715 - protein, 23 aa, Entamoeba dispar
FAETKEKEELQKETCNGSDAGCM

SEQ ID NO: 2363716 - protein, 8 aa, Entamoeba dispar
FAGPETKI

SEQ ID NO: 2363717 - protein, 4 aa, Entamoeba dispar
FAKE

SEQ ID NO: 2363718 - protein, 10 aa, Entamoeba dispar
FAKSEKESYK

SEQ ID NO: 2363719 - protein, 11 aa, Entamoeba dispar
FANDGKSETMC

SEQ ID NO: 2363720 - protein, 6 aa, Entamoeba dispar
FAPPAL

SEQ ID NO: 2363721 - protein, 8 aa, Entamoeba dispar
FARSGKPA

SEQ ID NO: 2363722 - protein, 10 aa, Entamoeba dispar
FATNSTSNEL

SEQ ID NO: 2363723 - protein, 11 aa, Entamoeba dispar
FDAGNSPTPVI

SEQ ID NO: 2363724 - protein, 5 aa, Entamoeba dispar
FDASA

SEQ ID NO: 2363725 - protein, 18 aa, Entamoeba dispar
FDDEEQKLVKQNSKEENS

SEQ ID NO: 2363726 - protein, 5 aa, Entamoeba dispar
FDDES

SEQ ID NO: 2363727 - protein, 5 aa, Entamoeba dispar
FDDPE

SEQ ID NO: 2363728 - protein, 6 aa, Entamoeba dispar
FDDPQR

SEQ ID NO: 2363729 - protein, 4 aa, Entamoeba dispar
FDDS

SEQ ID NO: 2363730 - protein, 10 aa, Entamoeba dispar
FDDTRKPREF

SEQ ID NO: 2363731 - protein, 11 aa, Entamoeba dispar
FDDTSSFTIEN

SEQ ID NO: 2363732 - protein, 4 aa, Entamoeba dispar
FDEG

SEQ ID NO: 2363733 - protein, 7 aa, Entamoeba dispar
FDENDIA

SEQ ID NO: 2363734 - protein, 8 aa, Entamoeba dispar
FDENNGPI

SEQ ID NO: 2363735 - protein, 6 aa, Entamoeba dispar
FDESQS

SEQ ID NO: 2363736 - protein, 12 aa, Entamoeba dispar
FDESSGNCKPCP

SEQ ID NO: 2363737 - protein, 11 aa, Entamoeba dispar
FDGSNSNLEIQ

SEQ ID NO: 2363738 - protein, 13 aa, Entamoeba dispar
FDKDDTSKSDNDI

SEQ ID NO: 2363739 - protein, 8 aa, Entamoeba dispar
FDNANKKE

SEQ ID NO: 2363740 - protein, 4 aa, Entamoeba dispar
FDND

SEQ ID NO: 2363741 - protein, 15 aa, Entamoeba dispar
FDNKPQKKKQCFCVM

SEQ ID NO: 2363742 - protein, 9 aa, Entamoeba dispar
FDNTSSENG

SEQ ID NO: 2363743 - protein, 13 aa, Entamoeba dispar
FDNWTQDDQKQME

SEQ ID NO: 2363744 - protein, 10 aa, Entamoeba dispar
FDNWTQDDQL

SEQ ID NO: 2363745 - protein, 4 aa, Entamoeba dispar
FDPE

SEQ ID NO: 2363746 - protein, 19 aa, Entamoeba dispar
FDPNSKNPGICGEDSEDVS

SEQ ID NO: 2363747 - protein, 7 aa, Entamoeba dispar
FDPPKYL

SEQ ID NO: 2363748 - protein, 9 aa, Entamoeba dispar
FDPSDAKKI

SEQ ID NO: 2363749 - protein, 4 aa, Entamoeba dispar
FDPT

SEQ ID NO: 2363750 - protein, 12 aa, Entamoeba dispar
FDQEDSSFTELT

SEQ ID NO: 2363751 - protein, 12 aa, Entamoeba dispar
FDRSSIRRSEAS

SEQ ID NO: 2363752 - protein, 4 aa, Entamoeba dispar
FDSD

SEQ ID NO: 2363753 - protein, 8 aa, Entamoeba dispar
FDSDDDQI

SEQ ID NO: 2363754 - protein, 6 aa, Entamoeba dispar
FDSDRK

SEQ ID NO: 2363755 - protein, 8 aa, Entamoeba dispar
FDSEETEQ

SEQ ID NO: 2363756 - protein, 9 aa, Entamoeba dispar
FDSEGTEKV

SEQ ID NO: 2363757 - protein, 8 aa, Entamoeba dispar
FDSRGELE

SEQ ID NO: 2363758 - protein, 4 aa, Entamoeba dispar
FDSS

SEQ ID NO: 2363759 - protein, 8 aa, Entamoeba dispar
FDSSNSQF

SEQ ID NO: 2363760 - protein, 15 aa, Entamoeba dispar
FDSTTSPNLKRETTS

SEQ ID NO: 2363761 - protein, 26 aa, Entamoeba dispar
FDSYNKNENKLNDNRTTRIKKPFKEQ

SEQ ID NO: 2363762 - protein, 4 aa, Entamoeba dispar
FDTK

SEQ ID NO: 2363763 - protein, 8 aa, Entamoeba dispar
FDTPKQFQ

SEQ ID NO: 2363764 - protein, 6 aa, Entamoeba dispar
FDTPNY

SEQ ID NO: 2363765 - protein, 6 aa, Entamoeba dispar
FDTPQN

SEQ ID NO: 2363766 - protein, 15 aa, Entamoeba dispar
FDTRKAAKEQAESVG

SEQ ID NO: 2363767 - protein, 10 aa, Entamoeba dispar
FDTSSFGDIP

SEQ ID NO: 2363768 - protein, 6 aa, Entamoeba dispar
FDVNGD

SEQ ID NO: 2363769 - protein, 8 aa, Entamoeba dispar
FDYEGADQ

SEQ ID NO: 2363770 - protein, 6 aa, Entamoeba dispar
FEAGTL

SEQ ID NO: 2363771 - protein, 6 aa, Entamoeba dispar
FECTTT

SEQ ID NO: 2363772 - protein, 5 aa, Entamoeba dispar
FEDER

SEQ ID NO: 2363773 - protein, 10 aa, Entamoeba dispar
FEDNTSKEIA

SEQ ID NO: 2363774 - protein, 6 aa, Entamoeba dispar
FEDPES

SEQ ID NO: 2363775 - protein, 8 aa, Entamoeba dispar
FEEDNNEN

SEQ ID NO: 2363776 - protein, 6 aa, Entamoeba dispar
FEEETQ

SEQ ID NO: 2363777 - protein, 4 aa, Entamoeba dispar
FEEG

SEQ ID NO: 2363778 - protein, 4 aa, Entamoeba dispar
FEEH

SEQ ID NO: 2363779 - protein, 8 aa, Entamoeba dispar
FEENEEKD

SEQ ID NO: 2363780 - protein, 8 aa, Entamoeba dispar
FEESRDGF

SEQ ID NO: 2363781 - protein, 25 aa, Entamoeba dispar
FEETNKTRTKQNENNEYQPNCSPEN

SEQ ID NO: 2363782 - protein, 12 aa, Entamoeba dispar
FEEWTSTDQETM

SEQ ID NO: 2363783 - protein, 5 aa, Entamoeba dispar
FEKDP

SEQ ID NO: 2363784 - protein, 11 aa, Entamoeba dispar
FEKESTEIVSS

SEQ ID NO: 2363785 - protein, 8 aa, Entamoeba dispar
FEKETIPR

SEQ ID NO: 2363786 - protein, 9 aa, Entamoeba dispar
FEKGPFGSS

SEQ ID NO: 2363787 - protein, 11 aa, Entamoeba dispar
FEKKSRSQSVA

SEQ ID NO: 2363788 - protein, 8 aa, Entamoeba dispar
FEKNEERT

SEQ ID NO: 2363789 - protein, 11 aa, Entamoeba dispar
FENEKQQEKFT

SEQ ID NO: 2363790 - protein, 5 aa, Entamoeba dispar
FENGK

SEQ ID NO: 2363791 - protein, 19 aa, Entamoeba dispar
FENSYKPTCADAKTVSFPG

SEQ ID NO: 2363792 - protein, 4 aa, Entamoeba dispar
FENY

SEQ ID NO: 2363793 - protein, 8 aa, Entamoeba dispar
FEPSTSIG

SEQ ID NO: 2363794 - protein, 4 aa, Entamoeba dispar
FEQQ

SEQ ID NO: 2363795 - protein, 12 aa, Entamoeba dispar
FESATENSQEQI

SEQ ID NO: 2363796 - protein, 10 aa, Entamoeba dispar
FESDNCDANC

SEQ ID NO: 2363797 - protein, 11 aa, Entamoeba dispar
FESDNCDTNCY

SEQ ID NO: 2363798 - protein, 9 aa, Entamoeba dispar
FESDPQVQA

SEQ ID NO: 2363799 - protein, 5 aa, Entamoeba dispar
FESGD

SEQ ID NO: 2363800 - protein, 10 aa, Entamoeba dispar
FETKSNETNK

SEQ ID NO: 2363801 - protein, 7 aa, Entamoeba dispar
FETLPNK

SEQ ID NO: 2363802 - protein, 8 aa, Entamoeba dispar
FETPKAKV

SEQ ID NO: 2363803 - protein, 7 aa, Entamoeba dispar
FETRTAA

SEQ ID NO: 2363804 - protein, 6 aa, Entamoeba dispar
FEYGDK

SEQ ID NO: 2363805 - protein, 5 aa, Entamoeba dispar
FGASR

SEQ ID NO: 2363806 - protein, 7 aa, Entamoeba dispar
FGASRNV

SEQ ID NO: 2363807 - protein, 7 aa, Entamoeba dispar
FGEGDTY

SEQ ID NO: 2363808 - protein, 17 aa, Entamoeba dispar
FGEGTAAQQAKKRGSAY

SEQ ID NO: 2363809 - protein, 10 aa, Entamoeba dispar
FGESPDSSYL

SEQ ID NO: 2363810 - protein, 24 aa, Entamoeba dispar
FGETGKSEIQFKSQRRPGISPVKE

SEQ ID NO: 2363811 - protein, 13 aa, Entamoeba dispar
FGGEDDKECSHSD

SEQ ID NO: 2363812 - protein, 4 aa, Entamoeba dispar
FGGT

SEQ ID NO: 2363813 - protein, 4 aa, Entamoeba dispar
FGLK

SEQ ID NO: 2363814 - protein, 4 aa, Entamoeba dispar
FGLS

SEQ ID NO: 2363815 - protein, 10 aa, Entamoeba dispar
FGNKTKENEM

SEQ ID NO: 2363816 - protein, 6 aa, Entamoeba dispar
FGNKTW

SEQ ID NO: 2363817 - protein, 5 aa, Entamoeba dispar
FGNMG

SEQ ID NO: 2363818 - protein, 5 aa, Entamoeba dispar
FGNNN

SEQ ID NO: 2363819 - protein, 4 aa, Entamoeba dispar
FGNS

SEQ ID NO: 2363820 - protein, 10 aa, Entamoeba dispar
FGNSSNSTNI

SEQ ID NO: 2363821 - protein, 8 aa, Entamoeba dispar
FGNTSSSS

SEQ ID NO: 2363822 - protein, 5 aa, Entamoeba dispar
FGPNE

SEQ ID NO: 2363823 - protein, 40 aa, Entamoeba dispar
FGQTVEKKSPKETPVVTSKKEEKKEKKSKSSSSSSSSDEK

SEQ ID NO: 2363824 - protein, 13 aa, Entamoeba dispar
FGREGISAKGITE

SEQ ID NO: 2363825 - protein, 14 aa, Entamoeba dispar
FGRSGTEPVPVDEE

SEQ ID NO: 2363826 - protein, 5 aa, Entamoeba dispar
FGSAR

SEQ ID NO: 2363827 - protein, 6 aa, Entamoeba dispar
FGSARS

SEQ ID NO: 2363828 - protein, 15 aa, Entamoeba dispar
FGSESGKFNEPTSIE

SEQ ID NO: 2363829 - protein, 7 aa, Entamoeba dispar
FGSHSQE

SEQ ID NO: 2363830 - protein, 5 aa, Entamoeba dispar
FGSRD

SEQ ID NO: 2363831 - protein, 5 aa, Entamoeba dispar
FGTSR

SEQ ID NO: 2363832 - protein, 19 aa, Entamoeba dispar
FGTSRFTKRKNNDKGLGTP

SEQ ID NO: 2363833 - protein, 24 aa, Entamoeba dispar
FGYDDSSNDEEKEVVEKKKPQSVL

SEQ ID NO: 2363834 - protein, 6 aa, Entamoeba dispar
FGYPTY

SEQ ID NO: 2363835 - protein, 4 aa, Entamoeba dispar
FHPD

SEQ ID NO: 2363836 - protein, 10 aa, Entamoeba dispar
FIDPGQPSSF

SEQ ID NO: 2363837 - protein, 6 aa, Entamoeba dispar
FIESSG

SEQ ID NO: 2363838 - protein, 8 aa, Entamoeba dispar
FIESSGKI

SEQ ID NO: 2363839 - protein, 7 aa, Entamoeba dispar
FIESSGN

SEQ ID NO: 2363840 - protein, 8 aa, Entamoeba dispar
FIESSNSV

SEQ ID NO: 2363841 - protein, 6 aa, Entamoeba dispar
FIESSQ

SEQ ID NO: 2363842 - protein, 4 aa, Entamoeba dispar
FKAG

SEQ ID NO: 2363843 - protein, 5 aa, Entamoeba dispar
FKAGP

SEQ ID NO: 2363844 - protein, 18 aa, Entamoeba dispar
FKDGFESGKDKQCESLSN

SEQ ID NO: 2363845 - protein, 4 aa, Entamoeba dispar
FKDR

SEQ ID NO: 2363846 - protein, 10 aa, Entamoeba dispar
FKDSKGCNNV

SEQ ID NO: 2363847 - protein, 9 aa, Entamoeba dispar
FKEDEEDDF

SEQ ID NO: 2363848 - protein, 8 aa, Entamoeba dispar
FKEDGKQT

SEQ ID NO: 2363849 - protein, 9 aa, Entamoeba dispar
FKEEDNPTL

SEQ ID NO: 2363850 - protein, 7 aa, Entamoeba dispar
FKEEGEQ

SEQ ID NO: 2363851 - protein, 5 aa, Entamoeba dispar
FKEEI

SEQ ID NO: 2363852 - protein, 7 aa, Entamoeba dispar
FKEENKK

SEQ ID NO: 2363853 - protein, 8 aa, Entamoeba dispar
FKEKEEKQ

SEQ ID NO: 2363854 - protein, 6 aa, Entamoeba dispar
FKGEDH

SEQ ID NO: 2363855 - protein, 7 aa, Entamoeba dispar
FKGETKK

SEQ ID NO: 2363856 - protein, 7 aa, Entamoeba dispar
FKGNNNI

SEQ ID NO: 2363857 - protein, 4 aa, Entamoeba dispar
FKGT

SEQ ID NO: 2363858 - protein, 8 aa, Entamoeba dispar
FKKDDEDD

SEQ ID NO: 2363859 - protein, 9 aa, Entamoeba dispar
FKKDDEDDF

SEQ ID NO: 2363860 - protein, 7 aa, Entamoeba dispar
FKKEQPD

SEQ ID NO: 2363861 - protein, 7 aa, Entamoeba dispar
FKKEQQP

SEQ ID NO: 2363862 - protein, 4 aa, Entamoeba dispar
FKKI

SEQ ID NO: 2363863 - protein, 5 aa, Entamoeba dispar
FKKNG

SEQ ID NO: 2363864 - protein, 11 aa, Entamoeba dispar
FKNESDELEKR

SEQ ID NO: 2363865 - protein, 4 aa, Entamoeba dispar
FKNK

SEQ ID NO: 2363866 - protein, 15 aa, Entamoeba dispar
FKNQVGKRKILIPFI

SEQ ID NO: 2363867 - protein, 9 aa, Entamoeba dispar
FKNSKSDNI

SEQ ID NO: 2363868 - protein, 16 aa, Entamoeba dispar
FKNYTNSFGPNIKSQG

SEQ ID NO: 2363869 - protein, 16 aa, Entamoeba dispar
FKPAKDSKNKMKEEEA

SEQ ID NO: 2363870 - protein, 9 aa, Entamoeba dispar
FKPKQQYYY

SEQ ID NO: 2363871 - protein, 5 aa, Entamoeba dispar
FKPKV

SEQ ID NO: 2363872 - protein, 10 aa, Entamoeba dispar
FKQPTKSEEI

SEQ ID NO: 2363873 - protein, 13 aa, Entamoeba dispar
FKRNQDSQQLEEQ

SEQ ID NO: 2363874 - protein, 11 aa, Entamoeba dispar
FKRSSDMVTSN

SEQ ID NO: 2363875 - protein, 4 aa, Entamoeba dispar
FKSE

SEQ ID NO: 2363876 - protein, 19 aa, Entamoeba dispar
FKSEKTAQRALDKAAGRTS

SEQ ID NO: 2363877 - protein, 18 aa, Entamoeba dispar
FKSKDKEERENQNRRNEY

SEQ ID NO: 2363878 - protein, 7 aa, Entamoeba dispar
FKSKNSL

SEQ ID NO: 2363879 - protein, 7 aa, Entamoeba dispar
FKSNNKK

SEQ ID NO: 2363880 - protein, 10 aa, Entamoeba dispar
FKSSENAEGY

SEQ ID NO: 2363881 - protein, 19 aa, Entamoeba dispar
FKSSTTELNGSDKTSYIDQ

SEQ ID NO: 2363882 - protein, 7 aa, Entamoeba dispar
FKTEETK

SEQ ID NO: 2363883 - protein, 5 aa, Entamoeba dispar
FKTSC

SEQ ID NO: 2363884 - protein, 7 aa, Entamoeba dispar
FKTSTAI

SEQ ID NO: 2363885 - protein, 12 aa, Entamoeba dispar
FKVSADPNSVTK

SEQ ID NO: 2363886 - protein, 14 aa, Entamoeba dispar
FKVSDDPKSVTKKA

SEQ ID NO: 2363887 - protein, 7 aa, Entamoeba dispar
FKYTQER

SEQ ID NO: 2363888 - protein, 5 aa, Entamoeba dispar
FLSDG

SEQ ID NO: 2363889 - protein, 16 aa, Entamoeba dispar
FLSSDNAKCKIKKDHD

SEQ ID NO: 2363890 - protein, 12 aa, Entamoeba dispar
FNAASSAMTDRD

SEQ ID NO: 2363891 - protein, 4 aa, Entamoeba dispar
FNAS

SEQ ID NO: 2363892 - protein, 6 aa, Entamoeba dispar
FNDEAE

SEQ ID NO: 2363893 - protein, 14 aa, Entamoeba dispar
FNDENKLSEHSNSG

SEQ ID NO: 2363894 - protein, 11 aa, Entamoeba dispar
FNDQPTETSNF

SEQ ID NO: 2363895 - protein, 12 aa, Entamoeba dispar
FNDWNQSDQLQM

SEQ ID NO: 2363896 - protein, 7 aa, Entamoeba dispar
FNEGGKV

SEQ ID NO: 2363897 - protein, 12 aa, Entamoeba dispar
FNENGQLNQNRH

SEQ ID NO: 2363898 - protein, 12 aa, Entamoeba dispar
FNEQNKEETERL

SEQ ID NO: 2363899 - protein, 24 aa, Entamoeba dispar
FNESNDPQSVTKETIGSYGEGDRQ

SEQ ID NO: 2363900 - protein, 4 aa, Entamoeba dispar
FNET

SEQ ID NO: 2363901 - protein, 6 aa, Entamoeba dispar
FNETDV

SEQ ID NO: 2363902 - protein, 53 aa, Entamoeba dispar
FNEVNEKKRKEDLEKLKKAKEELSKLEEEKTLAEKEKEEANEKVQKLEEEMRE

SEQ ID NO: 2363903 - protein, 5 aa, Entamoeba dispar
FNGKA

SEQ ID NO: 2363904 - protein, 8 aa, Entamoeba dispar
FNGKTYDS

SEQ ID NO: 2363905 - protein, 4 aa, Entamoeba dispar
FNGL

SEQ ID NO: 2363906 - protein, 7 aa, Entamoeba dispar
FNGNSGY

SEQ ID NO: 2363907 - protein, 14 aa, Entamoeba dispar
FNKHNRARATEKEI

SEQ ID NO: 2363908 - protein, 4 aa, Entamoeba dispar
FNKT

SEQ ID NO: 2363909 - protein, 12 aa, Entamoeba dispar
FNKYPDKQESVE

SEQ ID NO: 2363910 - protein, 15 aa, Entamoeba dispar
FNNDKNESLCRPKSD

SEQ ID NO: 2363911 - protein, 5 aa, Entamoeba dispar
FNNGT

SEQ ID NO: 2363912 - protein, 5 aa, Entamoeba dispar
FNNKE

SEQ ID NO: 2363913 - protein, 7 aa, Entamoeba dispar
FNNNGRS

SEQ ID NO: 2363914 - protein, 12 aa, Entamoeba dispar
FNNNSNKGFKGE

SEQ ID NO: 2363915 - protein, 26 aa, Entamoeba dispar
FNNSSLPENDDKRIREIEKNDQNIDN

SEQ ID NO: 2363916 - protein, 8 aa, Entamoeba dispar
FNPEEVQK

SEQ ID NO: 2363917 - protein, 11 aa, Entamoeba dispar
FNPESLSSLGT

SEQ ID NO: 2363918 - protein, 13 aa, Entamoeba dispar
FNPETRKCEGCDS

SEQ ID NO: 2363919 - protein, 5 aa, Entamoeba dispar
FNPNN

SEQ ID NO: 2363920 - protein, 6 aa, Entamoeba dispar
FNPQSK

SEQ ID NO: 2363921 - protein, 4 aa, Entamoeba dispar
FNPS

SEQ ID NO: 2363922 - protein, 4 aa, Entamoeba dispar
FNQD

SEQ ID NO: 2363923 - protein, 11 aa, Entamoeba dispar
FNQDTTIKPNA

SEQ ID NO: 2363924 - protein, 8 aa, Entamoeba dispar
FNQKENST

SEQ ID NO: 2363925 - protein, 5 aa, Entamoeba dispar
FNQPK

SEQ ID NO: 2363926 - protein, 7 aa, Entamoeba dispar
FNQSETE

SEQ ID NO: 2363927 - protein, 10 aa, Entamoeba dispar
FNQSFNNSSG

SEQ ID NO: 2363928 - protein, 13 aa, Entamoeba dispar
FNRPEENKEAFTE

SEQ ID NO: 2363929 - protein, 13 aa, Entamoeba dispar
FNRPEESKEAFTE

SEQ ID NO: 2363930 - protein, 18 aa, Entamoeba dispar
FNRTPSDNQLKEIELIEE

SEQ ID NO: 2363931 - protein, 7 aa, Entamoeba dispar
FNSAADS

SEQ ID NO: 2363932 - protein, 11 aa, Entamoeba dispar
FNSEDGCSSCA

SEQ ID NO: 2363933 - protein, 8 aa, Entamoeba dispar
FNSIEPQM

SEQ ID NO: 2363934 - protein, 9 aa, Entamoeba dispar
FNSKEQHSN

SEQ ID NO: 2363935 - protein, 6 aa, Entamoeba dispar
FNSNGS

SEQ ID NO: 2363936 - protein, 8 aa, Entamoeba dispar
FNSPYNEF

SEQ ID NO: 2363937 - protein, 4 aa, Entamoeba dispar
FNSQ

SEQ ID NO: 2363938 - protein, 10 aa, Entamoeba dispar
FNSTDNPIPV

SEQ ID NO: 2363939 - protein, 14 aa, Entamoeba dispar
FNSYDKSEFVRLAS

SEQ ID NO: 2363940 - protein, 9 aa, Entamoeba dispar
FNTDNNKNF

SEQ ID NO: 2363941 - protein, 5 aa, Entamoeba dispar
FNTNS

SEQ ID NO: 2363942 - protein, 7 aa, Entamoeba dispar
FNTSESV

SEQ ID NO: 2363943 - protein, 6 aa, Entamoeba dispar
FNTSNI

SEQ ID NO: 2363944 - protein, 8 aa, Entamoeba dispar
FNTTQENP

SEQ ID NO: 2363945 - protein, 12 aa, Entamoeba dispar
FPAPDEVPQQTE

SEQ ID NO: 2363946 - protein, 8 aa, Entamoeba dispar
FPDSSGDS

SEQ ID NO: 2363947 - protein, 9 aa, Entamoeba dispar
FPECSTNSK

SEQ ID NO: 2363948 - protein, 6 aa, Entamoeba dispar
FPEDDV

SEQ ID NO: 2363949 - protein, 7 aa, Entamoeba dispar
FPEEQKE

SEQ ID NO: 2363950 - protein, 11 aa, Entamoeba dispar
FPEEQKKETTL

SEQ ID NO: 2363951 - protein, 5 aa, Entamoeba dispar
FPIEE

SEQ ID NO: 2363952 - protein, 5 aa, Entamoeba dispar
FPING

SEQ ID NO: 2363953 - protein, 5 aa, Entamoeba dispar
FPISS

SEQ ID NO: 2363954 - protein, 4 aa, Entamoeba dispar
FPKD

SEQ ID NO: 2363955 - protein, 4 aa, Entamoeba dispar
FPKE

SEQ ID NO: 2363956 - protein, 6 aa, Entamoeba dispar
FPKNEL

SEQ ID NO: 2363957 - protein, 18 aa, Entamoeba dispar
FPKPNQTITNDISNSNKF

SEQ ID NO: 2363958 - protein, 5 aa, Entamoeba dispar
FPKPS

SEQ ID NO: 2363959 - protein, 13 aa, Entamoeba dispar
FPKTLTGKRPPII

SEQ ID NO: 2363960 - protein, 9 aa, Entamoeba dispar
FPKTSTEEY

SEQ ID NO: 2363961 - protein, 14 aa, Entamoeba dispar
FPNTLDKNKRRDKE

SEQ ID NO: 2363962 - protein, 14 aa, Entamoeba dispar
FPPAKKDKNTEPLM

SEQ ID NO: 2363963 - protein, 4 aa, Entamoeba dispar
FPPT

SEQ ID NO: 2363964 - protein, 12 aa, Entamoeba dispar
FPPTSSSQIYDE

SEQ ID NO: 2363965 - protein, 4 aa, Entamoeba dispar
FPQT

SEQ ID NO: 2363966 - protein, 6 aa, Entamoeba dispar
FPRNTS

SEQ ID NO: 2363967 - protein, 8 aa, Entamoeba dispar
FPSGHSSA

SEQ ID NO: 2363968 - protein, 5 aa, Entamoeba dispar
FPSSV

SEQ ID NO: 2363969 - protein, 11 aa, Entamoeba dispar
FPSTGKNGINN

SEQ ID NO: 2363970 - protein, 5 aa, Entamoeba dispar
FPTDD

SEQ ID NO: 2363971 - protein, 5 aa, Entamoeba dispar
FPTDT

SEQ ID NO: 2363972 - protein, 11 aa, Entamoeba dispar
FPTEISQNEEI

SEQ ID NO: 2363973 - protein, 7 aa, Entamoeba dispar
FPTKGQD

SEQ ID NO: 2363974 - protein, 8 aa, Entamoeba dispar
FPTPTSEQ

SEQ ID NO: 2363975 - protein, 5 aa, Entamoeba dispar
FQAPQ

SEQ ID NO: 2363976 - protein, 6 aa, Entamoeba dispar
FQDDKP

SEQ ID NO: 2363977 - protein, 6 aa, Entamoeba dispar
FQDEMS

SEQ ID NO: 2363978 - protein, 6 aa, Entamoeba dispar
FQEPQK

SEQ ID NO: 2363979 - protein, 12 aa, Entamoeba dispar
FQETEKDRIKDI

SEQ ID NO: 2363980 - protein, 6 aa, Entamoeba dispar
FQGEND

SEQ ID NO: 2363981 - protein, 5 aa, Entamoeba dispar
FQGNK

SEQ ID NO: 2363982 - protein, 7 aa, Entamoeba dispar
FQKSSPI

SEQ ID NO: 2363983 - protein, 18 aa, Entamoeba dispar
FQKYPGKTECKRCETEYG

SEQ ID NO: 2363984 - protein, 7 aa, Entamoeba dispar
FQNKTTS

SEQ ID NO: 2363985 - protein, 7 aa, Entamoeba dispar
FQPETNK

SEQ ID NO: 2363986 - protein, 4 aa, Entamoeba dispar
FQPN

SEQ ID NO: 2363987 - protein, 9 aa, Entamoeba dispar
FQPTDKAEI

SEQ ID NO: 2363988 - protein, 8 aa, Entamoeba dispar
FQQEGTSL

SEQ ID NO: 2363989 - protein, 4 aa, Entamoeba dispar
FQQS

SEQ ID NO: 2363990 - protein, 6 aa, Entamoeba dispar
FQQTAR

SEQ ID NO: 2363991 - protein, 14 aa, Entamoeba dispar
FQSLANKKNSVPSI

SEQ ID NO: 2363992 - protein, 10 aa, Entamoeba dispar
FQYTPSSDKM

SEQ ID NO: 2363993 - protein, 12 aa, Entamoeba dispar
FREEEEEDKEIE

SEQ ID NO: 2363994 - protein, 4 aa, Entamoeba dispar
FRGN

SEQ ID NO: 2363995 - protein, 12 aa, Entamoeba dispar
FRGTANEVSKEY

SEQ ID NO: 2363996 - protein, 17 aa, Entamoeba dispar
FRGTANQYELPNFNLID

SEQ ID NO: 2363997 - protein, 9 aa, Entamoeba dispar
FRKASTDLK

SEQ ID NO: 2363998 - protein, 11 aa, Entamoeba dispar
FRKEPKTKGEM

SEQ ID NO: 2363999 - protein, 19 aa, Entamoeba dispar
FRLGNTDNSTIGIEQGSSI

SEQ ID NO: 2364000 - protein, 4 aa, Entamoeba dispar
FRNQ

SEQ ID NO: 2364001 - protein, 4 aa, Entamoeba dispar
FRPE

SEQ ID NO: 2364002 - protein, 5 aa, Entamoeba dispar
FRSPK

SEQ ID NO: 2364003 - protein, 11 aa, Entamoeba dispar
FRSSEDNDYYS

SEQ ID NO: 2364004 - protein, 22 aa, Entamoeba dispar
FRSSSFSETASDVWSSPTCPCT

SEQ ID NO: 2364005 - protein, 14 aa, Entamoeba dispar
FSAPPDSLAAKGNI

SEQ ID NO: 2364006 - protein, 10 aa, Entamoeba dispar
FSCTSSAKIV

SEQ ID NO: 2364007 - protein, 4 aa, Entamoeba dispar
FSDE

SEQ ID NO: 2364008 - protein, 13 aa, Entamoeba dispar
FSDEDRENSTKTL

SEQ ID NO: 2364009 - protein, 13 aa, Entamoeba dispar
FSDGASTKQPNIK

SEQ ID NO: 2364010 - protein, 37 aa, Entamoeba dispar
FSDHTSQQTRSSLAKTTSYHSDRESLPTPSANPNPNQ

SEQ ID NO: 2364011 - protein, 4 aa, Entamoeba dispar
FSDQ

SEQ ID NO: 2364012 - protein, 15 aa, Entamoeba dispar
FSDSQEALGKSTLTE

SEQ ID NO: 2364013 - protein, 5 aa, Entamoeba dispar
FSDSS

SEQ ID NO: 2364014 - protein, 6 aa, Entamoeba dispar
FSEGSS

SEQ ID NO: 2364015 - protein, 10 aa, Entamoeba dispar
FSEKGKNSEM

SEQ ID NO: 2364016 - protein, 27 aa, Entamoeba dispar
FSESNNYKIHNNAEDISSFDEQEMDTL

SEQ ID NO: 2364017 - protein, 5 aa, Entamoeba dispar
FSGKY

SEQ ID NO: 2364018 - protein, 11 aa, Entamoeba dispar
FSGNKQNQYRP

SEQ ID NO: 2364019 - protein, 6 aa, Entamoeba dispar
FSGQSL

SEQ ID NO: 2364020 - protein, 9 aa, Entamoeba dispar
FSGRKMSKK

SEQ ID NO: 2364021 - protein, 5 aa, Entamoeba dispar
FSGTA

SEQ ID NO: 2364022 - protein, 8 aa, Entamoeba dispar
FSGTKKGE

SEQ ID NO: 2364023 - protein, 6 aa, Entamoeba dispar
FSHEPP

SEQ ID NO: 2364024 - protein, 7 aa, Entamoeba dispar
FSKKTGI

SEQ ID NO: 2364025 - protein, 7 aa, Entamoeba dispar
FSKNDEL

SEQ ID NO: 2364026 - protein, 11 aa, Entamoeba dispar
FSKSNGTGVFG

SEQ ID NO: 2364027 - protein, 10 aa, Entamoeba dispar
FSLSGSETLT

SEQ ID NO: 2364028 - protein, 8 aa, Entamoeba dispar
FSNPNNSD

SEQ ID NO: 2364029 - protein, 9 aa, Entamoeba dispar
FSNPNSSDK

SEQ ID NO: 2364030 - protein, 5 aa, Entamoeba dispar
FSNSP

SEQ ID NO: 2364031 - protein, 7 aa, Entamoeba dispar
FSPNSPL

SEQ ID NO: 2364032 - protein, 9 aa, Entamoeba dispar
FSPSDGITS

SEQ ID NO: 2364033 - protein, 7 aa, Entamoeba dispar
FSPSSSS

SEQ ID NO: 2364034 - protein, 5 aa, Entamoeba dispar
FSQGN

SEQ ID NO: 2364035 - protein, 6 aa, Entamoeba dispar
FSQSTT

SEQ ID NO: 2364036 - protein, 23 aa, Entamoeba dispar
FSRPRSFTKHSRGNTKNLPSLNP

SEQ ID NO: 2364037 - protein, 12 aa, Entamoeba dispar
FSRSKQYDTFPS

SEQ ID NO: 2364038 - protein, 11 aa, Entamoeba dispar
FSRTTSTTNKS

SEQ ID NO: 2364039 - protein, 9 aa, Entamoeba dispar
FSSETKKNL

SEQ ID NO: 2364040 - protein, 12 aa, Entamoeba dispar
FSSGGSYTVSNN

SEQ ID NO: 2364041 - protein, 6 aa, Entamoeba dispar
FSSGRS

SEQ ID NO: 2364042 - protein, 12 aa, Entamoeba dispar
FSSKKVNGEVIP

SEQ ID NO: 2364043 - protein, 5 aa, Entamoeba dispar
FSSKT

SEQ ID NO: 2364044 - protein, 5 aa, Entamoeba dispar
FSSNT

SEQ ID NO: 2364045 - protein, 4 aa, Entamoeba dispar
FSSP

SEQ ID NO: 2364046 - protein, 12 aa, Entamoeba dispar
FSSPPIQKRIFI

SEQ ID NO: 2364047 - protein, 9 aa, Entamoeba dispar
FSSQQTARK

SEQ ID NO: 2364048 - protein, 5 aa, Entamoeba dispar
FSSRI

SEQ ID NO: 2364049 - protein, 8 aa, Entamoeba dispar
FSSSKKKN

SEQ ID NO: 2364050 - protein, 8 aa, Entamoeba dispar
FSSTPSRE

SEQ ID NO: 2364051 - protein, 4 aa, Entamoeba dispar
FSTD

SEQ ID NO: 2364052 - protein, 5 aa, Entamoeba dispar
FSTEL

SEQ ID NO: 2364053 - protein, 9 aa, Entamoeba dispar
FSTKPNDSL

SEQ ID NO: 2364054 - protein, 6 aa, Entamoeba dispar
FSTNTK

SEQ ID NO: 2364055 - protein, 18 aa, Entamoeba dispar
FSTPENPPVNQSNSQIGM

SEQ ID NO: 2364056 - protein, 17 aa, Entamoeba dispar
FSTSDSTNRISSKSNLE

SEQ ID NO: 2364057 - protein, 10 aa, Entamoeba dispar
FSTSFKQQEM

SEQ ID NO: 2364058 - protein, 4 aa, Entamoeba dispar
FTDD

SEQ ID NO: 2364059 - protein, 6 aa, Entamoeba dispar
FTDSDE

SEQ ID NO: 2364060 - protein, 11 aa, Entamoeba dispar
FTDTGPSSECT

SEQ ID NO: 2364061 - protein, 11 aa, Entamoeba dispar
FTEAKDDLVEG

SEQ ID NO: 2364062 - protein, 5 aa, Entamoeba dispar
FTEAR

SEQ ID NO: 2364063 - protein, 35 aa, Entamoeba dispar
FTEEENERKKSELRNATSPEINQKNVKTNLPKEGK

SEQ ID NO: 2364064 - protein, 8 aa, Entamoeba dispar
FTELDRSN

SEQ ID NO: 2364065 - protein, 10 aa, Entamoeba dispar
FTESDCNGYG

SEQ ID NO: 2364066 - protein, 5 aa, Entamoeba dispar
FTGGE

SEQ ID NO: 2364067 - protein, 9 aa, Entamoeba dispar
FTHNNSQEI

SEQ ID NO: 2364068 - protein, 8 aa, Entamoeba dispar
FTHPSSDL

SEQ ID NO: 2364069 - protein, 8 aa, Entamoeba dispar
FTKDEEDD

SEQ ID NO: 2364070 - protein, 9 aa, Entamoeba dispar
FTKGQPNKV

SEQ ID NO: 2364071 - protein, 5 aa, Entamoeba dispar
FTKSG

SEQ ID NO: 2364072 - protein, 9 aa, Entamoeba dispar
FTNGGNLQV

SEQ ID NO: 2364073 - protein, 12 aa, Entamoeba dispar
FTNKGINYNSGG

SEQ ID NO: 2364074 - protein, 6 aa, Entamoeba dispar
FTNSEG

SEQ ID NO: 2364075 - protein, 8 aa, Entamoeba dispar
FTNSGSSE

SEQ ID NO: 2364076 - protein, 18 aa, Entamoeba dispar
FTNSSGEGQCYYGEPGCN

SEQ ID NO: 2364077 - protein, 18 aa, Entamoeba dispar
FTPHRPSYSRSSSSLTKT

SEQ ID NO: 2364078 - protein, 4 aa, Entamoeba dispar
FTPK

SEQ ID NO: 2364079 - protein, 5 aa, Entamoeba dispar
FTQDS

SEQ ID NO: 2364080 - protein, 5 aa, Entamoeba dispar
FTQKL

SEQ ID NO: 2364081 - protein, 7 aa, Entamoeba dispar
FTQNQKT

SEQ ID NO: 2364082 - protein, 15 aa, Entamoeba dispar
FTQTKDKCDPHAPSY

SEQ ID NO: 2364083 - protein, 9 aa, Entamoeba dispar
FTQTNNRNT

SEQ ID NO: 2364084 - protein, 10 aa, Entamoeba dispar
FTQTQSKIEQ

SEQ ID NO: 2364085 - protein, 5 aa, Entamoeba dispar
FTRSE

SEQ ID NO: 2364086 - protein, 8 aa, Entamoeba dispar
FTRSSNPV

SEQ ID NO: 2364087 - protein, 5 aa, Entamoeba dispar
FTRTA

SEQ ID NO: 2364088 - protein, 10 aa, Entamoeba dispar
FTSDNSDYLS

SEQ ID NO: 2364089 - protein, 12 aa, Entamoeba dispar
FTSEDKTSCGSG

SEQ ID NO: 2364090 - protein, 6 aa, Entamoeba dispar
FTSERM

SEQ ID NO: 2364091 - protein, 15 aa, Entamoeba dispar
FTSIPTNSVSPQMTD

SEQ ID NO: 2364092 - protein, 9 aa, Entamoeba dispar
FTSPDSKKS

SEQ ID NO: 2364093 - protein, 29 aa, Entamoeba dispar
FTSQNTTDLQSPLVQPESSFYAKSENGYN

SEQ ID NO: 2364094 - protein, 11 aa, Entamoeba dispar
FTSSSDTSQYE

SEQ ID NO: 2364095 - protein, 5 aa, Entamoeba dispar
FTSYK

SEQ ID NO: 2364096 - protein, 16 aa, Entamoeba dispar
FTTGNGLTKDKTSTIK

SEQ ID NO: 2364097 - protein, 7 aa, Entamoeba dispar
FTTKGNR

SEQ ID NO: 2364098 - protein, 11 aa, Entamoeba dispar
FTTKKGDSIDL

SEQ ID NO: 2364099 - protein, 9 aa, Entamoeba dispar
FTTNGKPTT

SEQ ID NO: 2364100 - protein, 5 aa, Entamoeba dispar
FTTNH

SEQ ID NO: 2364101 - protein, 6 aa, Entamoeba dispar
FTTPDD

SEQ ID NO: 2364102 - protein, 6 aa, Entamoeba dispar
FTTSKG

SEQ ID NO: 2364103 - protein, 8 aa, Entamoeba dispar
FTTSWKDG

SEQ ID NO: 2364104 - protein, 48 aa, Entamoeba dispar
FVGSSSSSSSSSKRGDSKTIIGNKKDEPDSSAVGESAGGGGDKKSIKT

SEQ ID NO: 2364105 - protein, 11 aa, Entamoeba dispar
FVSSDSANSCT

SEQ ID NO: 2364106 - protein, 4 aa, Entamoeba dispar
GAAA

SEQ ID NO: 2364107 - protein, 11 aa, Entamoeba dispar
GAAAGVGAIGG

SEQ ID NO: 2364108 - protein, 17 aa, Entamoeba dispar
GAAAGVGVGAGAGAVKT

SEQ ID NO: 2364109 - protein, 4 aa, Entamoeba dispar
GAAV

SEQ ID NO: 2364110 - protein, 7 aa, Entamoeba dispar
GADLSSA

SEQ ID NO: 2364111 - protein, 12 aa, Entamoeba dispar
GADYTTSSSFDK

SEQ ID NO: 2364112 - protein, 9 aa, Entamoeba dispar
GAEDDGTNS

SEQ ID NO: 2364113 - protein, 9 aa, Entamoeba dispar
GAEQNGEVA

SEQ ID NO: 2364114 - protein, 7 aa, Entamoeba dispar
GAETPEK

SEQ ID NO: 2364115 - protein, 20 aa, Entamoeba dispar
GAGDALSASTVSALQRGEPI

SEQ ID NO: 2364116 - protein, 9 aa, Entamoeba dispar
GAGSVNEAL

SEQ ID NO: 2364117 - protein, 5 aa, Entamoeba dispar
GAIPA

SEQ ID NO: 2364118 - protein, 5 aa, Entamoeba dispar
GAISA

SEQ ID NO: 2364119 - protein, 9 aa, Entamoeba dispar
GAKDIEEKK

SEQ ID NO: 2364120 - protein, 6 aa, Entamoeba dispar
GAKKGI

SEQ ID NO: 2364121 - protein, 18 aa, Entamoeba dispar
GAKRFGYNGGDNNEVQED

SEQ ID NO: 2364122 - protein, 8 aa, Entamoeba dispar
GAKSKTQK

SEQ ID NO: 2364123 - protein, 4 aa, Entamoeba dispar
GANG

SEQ ID NO: 2364124 - protein, 11 aa, Entamoeba dispar
GAPEELKKTCP

SEQ ID NO: 2364125 - protein, 5 aa, Entamoeba dispar
GAPLY

SEQ ID NO: 2364126 - protein, 13 aa, Entamoeba dispar
GAPNESESITTSV

SEQ ID NO: 2364127 - protein, 6 aa, Entamoeba dispar
GAQSDG

SEQ ID NO: 2364128 - protein, 9 aa, Entamoeba dispar
GAQSSGKST

SEQ ID NO: 2364129 - protein, 4 aa, Entamoeba dispar
GARS

SEQ ID NO: 2364130 - protein, 7 aa, Entamoeba dispar
GARTTVE

SEQ ID NO: 2364131 - protein, 9 aa, Entamoeba dispar
GASEGVGRS

SEQ ID NO: 2364132 - protein, 14 aa, Entamoeba dispar
GASLQTKTISGTTP

SEQ ID NO: 2364133 - protein, 10 aa, Entamoeba dispar
GASSSDKTTQ

SEQ ID NO: 2364134 - protein, 6 aa, Entamoeba dispar
GASSSL

SEQ ID NO: 2364135 - protein, 6 aa, Entamoeba dispar
GATREN

SEQ ID NO: 2364136 - protein, 9 aa, Entamoeba dispar
GATSGKIFS

SEQ ID NO: 2364137 - protein, 25 aa, Entamoeba dispar
GATTNKTKKQEDEGPKEINPIQTPE

SEQ ID NO: 2364138 - protein, 4 aa, Entamoeba dispar
GAYG

SEQ ID NO: 2364139 - protein, 7 aa, Entamoeba dispar
GAYGTEP

SEQ ID NO: 2364140 - protein, 7 aa, Entamoeba dispar
GCAGTTL

SEQ ID NO: 2364141 - protein, 9 aa, Entamoeba dispar
GCDPTLPNR

SEQ ID NO: 2364142 - protein, 5 aa, Entamoeba dispar
GCEAC

SEQ ID NO: 2364143 - protein, 6 aa, Entamoeba dispar
GCEPNC

SEQ ID NO: 2364144 - protein, 6 aa, Entamoeba dispar
GCESSK

SEQ ID NO: 2364145 - protein, 8 aa, Entamoeba dispar
GCGDNDRS

SEQ ID NO: 2364146 - protein, 9 aa, Entamoeba dispar
GCGDRENRV

SEQ ID NO: 2364147 - protein, 7 aa, Entamoeba dispar
GCGKSTT

SEQ ID NO: 2364148 - protein, 6 aa, Entamoeba dispar
GCGRTP

SEQ ID NO: 2364149 - protein, 10 aa, Entamoeba dispar
GCNEPAKTKY

SEQ ID NO: 2364150 - protein, 8 aa, Entamoeba dispar
GCNSETGI

SEQ ID NO: 2364151 - protein, 6 aa, Entamoeba dispar
GCPCDG

SEQ ID NO: 2364152 - protein, 6 aa, Entamoeba dispar
GCREPY

SEQ ID NO: 2364153 - protein, 9 aa, Entamoeba dispar
GCSCDGDSC

SEQ ID NO: 2364154 - protein, 5 aa, Entamoeba dispar
GCSDG

SEQ ID NO: 2364155 - protein, 11 aa, Entamoeba dispar
GCSNDSNGQAK

SEQ ID NO: 2364156 - protein, 10 aa, Entamoeba dispar
GCSQLERADG

SEQ ID NO: 2364157 - protein, 5 aa, Entamoeba dispar
GCSTI

SEQ ID NO: 2364158 - protein, 5 aa, Entamoeba dispar
GCSYT

SEQ ID NO: 2364159 - protein, 7 aa, Entamoeba dispar
GCTQCGN

SEQ ID NO: 2364160 - protein, 4 aa, Entamoeba dispar
GCYK

SEQ ID NO: 2364161 - protein, 13 aa, Entamoeba dispar
GCYSGGDNCTAVQ

SEQ ID NO: 2364162 - protein, 7 aa, Entamoeba dispar
GCYTPDE

SEQ ID NO: 2364163 - protein, 25 aa, Entamoeba dispar
GDADIQPEDLPITAKKDINTSSTKR

SEQ ID NO: 2364164 - protein, 5 aa, Entamoeba dispar
GDAIP

SEQ ID NO: 2364165 - protein, 5 aa, Entamoeba dispar
GDAKE

SEQ ID NO: 2364166 - protein, 13 aa, Entamoeba dispar
GDAPIAEATEGCG

SEQ ID NO: 2364167 - protein, 7 aa, Entamoeba dispar
GDAYTNG

SEQ ID NO: 2364168 - protein, 9 aa, Entamoeba dispar
GDDGKWSTE

SEQ ID NO: 2364169 - protein, 19 aa, Entamoeba dispar
GDDIPKDDIKDIDGEIQEL

SEQ ID NO: 2364170 - protein, 4 aa, Entamoeba dispar
GDDL

SEQ ID NO: 2364171 - protein, 6 aa, Entamoeba dispar
GDDNDI

SEQ ID NO: 2364172 - protein, 7 aa, Entamoeba dispar
GDDVKEM

SEQ ID NO: 2364173 - protein, 7 aa, Entamoeba dispar
GDEESNS

SEQ ID NO: 2364174 - protein, 5 aa, Entamoeba dispar
GDEGC

SEQ ID NO: 2364175 - protein, 10 aa, Entamoeba dispar
GDEGKINVQG

SEQ ID NO: 2364176 - protein, 5 aa, Entamoeba dispar
GDEIT

SEQ ID NO: 2364177 - protein, 4 aa, Entamoeba dispar
GDEL

SEQ ID NO: 2364178 - protein, 16 aa, Entamoeba dispar
GDEPSIPIQPVPTTTV

SEQ ID NO: 2364179 - protein, 9 aa, Entamoeba dispar
GDESKYTAY

SEQ ID NO: 2364180 - protein, 17 aa, Entamoeba dispar
GDETTTESDAQDDSTIL

SEQ ID NO: 2364181 - protein, 6 aa, Entamoeba dispar
GDGAND

SEQ ID NO: 2364182 - protein, 7 aa, Entamoeba dispar
GDGANDV

SEQ ID NO: 2364183 - protein, 7 aa, Entamoeba dispar
GDGFPGL

SEQ ID NO: 2364184 - protein, 7 aa, Entamoeba dispar
GDGGNDI

SEQ ID NO: 2364185 - protein, 5 aa, Entamoeba dispar
GDGIL

SEQ ID NO: 2364186 - protein, 6 aa, Entamoeba dispar
GDGKRY

SEQ ID NO: 2364187 - protein, 6 aa, Entamoeba dispar
GDGNQI

SEQ ID NO: 2364188 - protein, 4 aa, Entamoeba dispar
GDGR

SEQ ID NO: 2364189 - protein, 5 aa, Entamoeba dispar
GDGRR

SEQ ID NO: 2364190 - protein, 6 aa, Entamoeba dispar
GDGSHD

SEQ ID NO: 2364191 - protein, 14 aa, Entamoeba dispar
GDGVNDAPAIKSSN

SEQ ID NO: 2364192 - protein, 10 aa, Entamoeba dispar
GDHPKTAGAI

SEQ ID NO: 2364193 - protein, 20 aa, Entamoeba dispar
GDIEMSEDVKNKPEQSVEIT

SEQ ID NO: 2364194 - protein, 9 aa, Entamoeba dispar
GDIENEEST

SEQ ID NO: 2364195 - protein, 8 aa, Entamoeba dispar
GDIETVGN

SEQ ID NO: 2364196 - protein, 8 aa, Entamoeba dispar
GDIQTSEN

SEQ ID NO: 2364197 - protein, 6 aa, Entamoeba dispar
GDITSE

SEQ ID NO: 2364198 - protein, 9 aa, Entamoeba dispar
GDKKETAFN

SEQ ID NO: 2364199 - protein, 60 aa, Entamoeba dispar
GDKKIQGSDASSSTSVPSSAQEPSTNSTSTPTDDKPSSSSEQKTSSESKKKSESTNQEEL

SEQ ID NO: 2364200 - protein, 17 aa, Entamoeba dispar
GDKRERAINVGKSSGII

SEQ ID NO: 2364201 - protein, 9 aa, Entamoeba dispar
GDKSFKESN

SEQ ID NO: 2364202 - protein, 16 aa, Entamoeba dispar
GDKSKEGFSPIGNDNK

SEQ ID NO: 2364203 - protein, 9 aa, Entamoeba dispar
GDLDGSQDF

SEQ ID NO: 2364204 - protein, 8 aa, Entamoeba dispar
GDLGNPVA

SEQ ID NO: 2364205 - protein, 5 aa, Entamoeba dispar
GDMST

SEQ ID NO: 2364206 - protein, 5 aa, Entamoeba dispar
GDNEE

SEQ ID NO: 2364207 - protein, 5 aa, Entamoeba dispar
GDNGG

SEQ ID NO: 2364208 - protein, 7 aa, Entamoeba dispar
GDNIPTN

SEQ ID NO: 2364209 - protein, 5 aa, Entamoeba dispar
GDNKG

SEQ ID NO: 2364210 - protein, 8 aa, Entamoeba dispar
GDNSFSQN

SEQ ID NO: 2364211 - protein, 7 aa, Entamoeba dispar
GDNYDNS

SEQ ID NO: 2364212 - protein, 24 aa, Entamoeba dispar
GDNYTKQTQLNQLEKKKKKMSKKI

SEQ ID NO: 2364213 - protein, 9 aa, Entamoeba dispar
GDPEGEKEL

SEQ ID NO: 2364214 - protein, 27 aa, Entamoeba dispar
GDPNKETIDQDLKEDEEEENKKKEKFI

SEQ ID NO: 2364215 - protein, 7 aa, Entamoeba dispar
GDPSFEG

SEQ ID NO: 2364216 - protein, 9 aa, Entamoeba dispar
GDPYGEDDD

SEQ ID NO: 2364217 - protein, 10 aa, Entamoeba dispar
GDPYGKDDEF

SEQ ID NO: 2364218 - protein, 19 aa, Entamoeba dispar
GDPYGKDEEFEVGQAPSNR

SEQ ID NO: 2364219 - protein, 10 aa, Entamoeba dispar
GDQNDKIKET

SEQ ID NO: 2364220 - protein, 8 aa, Entamoeba dispar
GDRDGGTV

SEQ ID NO: 2364221 - protein, 8 aa, Entamoeba dispar
GDREGGGV

SEQ ID NO: 2364222 - protein, 4 aa, Entamoeba dispar
GDRF

SEQ ID NO: 2364223 - protein, 18 aa, Entamoeba dispar
GDRSDYDKEGSNKLWNIC

SEQ ID NO: 2364224 - protein, 12 aa, Entamoeba dispar
GDSGDEKRHIPP

SEQ ID NO: 2364225 - protein, 8 aa, Entamoeba dispar
GDSISPLD

SEQ ID NO: 2364226 - protein, 12 aa, Entamoeba dispar
GDSLSSQSDCYQ

SEQ ID NO: 2364227 - protein, 7 aa, Entamoeba dispar
GDSQNEF

SEQ ID NO: 2364228 - protein, 5 aa, Entamoeba dispar
GDSSN

SEQ ID NO: 2364229 - protein, 24 aa, Entamoeba dispar
GDSTPVTINSGKCGSISTSSSLTI

SEQ ID NO: 2364230 - protein, 6 aa, Entamoeba dispar
GDSVGK

SEQ ID NO: 2364231 - protein, 10 aa, Entamoeba dispar
GDSYGKDDEF

SEQ ID NO: 2364232 - protein, 32 aa, Entamoeba dispar
GDTIDSNEEPSSSIQNKEETKLITKNSTTQIK

SEQ ID NO: 2364233 - protein, 5 aa, Entamoeba dispar
GDTNK

SEQ ID NO: 2364234 - protein, 11 aa, Entamoeba dispar
GDTPNSTPYGY

SEQ ID NO: 2364235 - protein, 11 aa, Entamoeba dispar
GDTSKSPVSGS

SEQ ID NO: 2364236 - protein, 7 aa, Entamoeba dispar
GDVGRTR

SEQ ID NO: 2364237 - protein, 4 aa, Entamoeba dispar
GDYF

SEQ ID NO: 2364238 - protein, 9 aa, Entamoeba dispar
GDYHSSSKS

SEQ ID NO: 2364239 - protein, 5 aa, Entamoeba dispar
GDYPK

SEQ ID NO: 2364240 - protein, 12 aa, Entamoeba dispar
GDYQTNQEEQKK

SEQ ID NO: 2364241 - protein, 9 aa, Entamoeba dispar
GDYSEKGSV

SEQ ID NO: 2364242 - protein, 4 aa, Entamoeba dispar
GEAC

SEQ ID NO: 2364243 - protein, 4 aa, Entamoeba dispar
GECK

SEQ ID NO: 2364244 - protein, 8 aa, Entamoeba dispar
GECKKGQV

SEQ ID NO: 2364245 - protein, 10 aa, Entamoeba dispar
GECPYTSGRQ

SEQ ID NO: 2364246 - protein, 9 aa, Entamoeba dispar
GECQPPDNY

SEQ ID NO: 2364247 - protein, 8 aa, Entamoeba dispar
GECSPASK

SEQ ID NO: 2364248 - protein, 4 aa, Entamoeba dispar
GECY

SEQ ID NO: 2364249 - protein, 17 aa, Entamoeba dispar
GEDCDPSVSSDPLCDSS

SEQ ID NO: 2364250 - protein, 7 aa, Entamoeba dispar
GEDEKGY

SEQ ID NO: 2364251 - protein, 10 aa, Entamoeba dispar
GEDESKLYNV

SEQ ID NO: 2364252 - protein, 6 aa, Entamoeba dispar
GEDGTI

SEQ ID NO: 2364253 - protein, 6 aa, Entamoeba dispar
GEDKRM

SEQ ID NO: 2364254 - protein, 11 aa, Entamoeba dispar
GEDQKDRDADN

SEQ ID NO: 2364255 - protein, 9 aa, Entamoeba dispar
GEECDEKGY

SEQ ID NO: 2364256 - protein, 29 aa, Entamoeba dispar
GEECDGGEGCTEECTCDSSQNYKYSNSKC

SEQ ID NO: 2364257 - protein, 11 aa, Entamoeba dispar
GEECDGGTNCD

SEQ ID NO: 2364258 - protein, 13 aa, Entamoeba dispar
GEEDIKKLNSEKG

SEQ ID NO: 2364259 - protein, 12 aa, Entamoeba dispar
GEEDKKDSSIPL

SEQ ID NO: 2364260 - protein, 6 aa, Entamoeba dispar
GEEFPK

SEQ ID NO: 2364261 - protein, 5 aa, Entamoeba dispar
GEEGE

SEQ ID NO: 2364262 - protein, 8 aa, Entamoeba dispar
GEEGQCTL

SEQ ID NO: 2364263 - protein, 12 aa, Entamoeba dispar
GEEIGKKFAENN

SEQ ID NO: 2364264 - protein, 11 aa, Entamoeba dispar
GEENDKGVSEQ

SEQ ID NO: 2364265 - protein, 13 aa, Entamoeba dispar
GEERNDPNPTNAI

SEQ ID NO: 2364266 - protein, 18 aa, Entamoeba dispar
GEESTDTINVGNGGKSKL

SEQ ID NO: 2364267 - protein, 8 aa, Entamoeba dispar
GEESTTRH

SEQ ID NO: 2364268 - protein, 7 aa, Entamoeba dispar
GEEVEGE

SEQ ID NO: 2364269 - protein, 4 aa, Entamoeba dispar
GEEY

SEQ ID NO: 2364270 - protein, 4 aa, Entamoeba dispar
GEGC

SEQ ID NO: 2364271 - protein, 5 aa, Entamoeba dispar
GEGDL

SEQ ID NO: 2364272 - protein, 8 aa, Entamoeba dispar
GEGELEKG

SEQ ID NO: 2364273 - protein, 10 aa, Entamoeba dispar
GEGKPSSTLN

SEQ ID NO: 2364274 - protein, 4 aa, Entamoeba dispar
GEGL

SEQ ID NO: 2364275 - protein, 7 aa, Entamoeba dispar
GEGLNGD

SEQ ID NO: 2364276 - protein, 13 aa, Entamoeba dispar
GEGNPIEGDCPER

SEQ ID NO: 2364277 - protein, 5 aa, Entamoeba dispar
GEGTY

SEQ ID NO: 2364278 - protein, 10 aa, Entamoeba dispar
GEHEENDPNH

SEQ ID NO: 2364279 - protein, 8 aa, Entamoeba dispar
GEHSEWDE

SEQ ID NO: 2364280 - protein, 6 aa, Entamoeba dispar
GEHSKK

SEQ ID NO: 2364281 - protein, 4 aa, Entamoeba dispar
GEHY

SEQ ID NO: 2364282 - protein, 8 aa, Entamoeba dispar
GEIKTGEK

SEQ ID NO: 2364283 - protein, 6 aa, Entamoeba dispar
GEITSK

SEQ ID NO: 2364284 - protein, 10 aa, Entamoeba dispar
GEKASEGRTT

SEQ ID NO: 2364285 - protein, 8 aa, Entamoeba dispar
GEKELRGD

SEQ ID NO: 2364286 - protein, 8 aa, Entamoeba dispar
GEKERTEI

SEQ ID NO: 2364287 - protein, 7 aa, Entamoeba dispar
GEKESCQ

SEQ ID NO: 2364288 - protein, 14 aa, Entamoeba dispar
GEKETKKYQYQTSE

SEQ ID NO: 2364289 - protein, 10 aa, Entamoeba dispar
GEKKEKGKES

SEQ ID NO: 2364290 - protein, 5 aa, Entamoeba dispar
GEKMD

SEQ ID NO: 2364291 - protein, 10 aa, Entamoeba dispar
GEKSNGGANI

SEQ ID NO: 2364292 - protein, 13 aa, Entamoeba dispar
GELDNEEDGLSGG

SEQ ID NO: 2364293 - protein, 11 aa, Entamoeba dispar
GELKKDSPERV

SEQ ID NO: 2364294 - protein, 12 aa, Entamoeba dispar
GELNTKEHNHEN

SEQ ID NO: 2364295 - protein, 10 aa, Entamoeba dispar
GELSKKEDLN

SEQ ID NO: 2364296 - protein, 4 aa, Entamoeba dispar
GEMG

SEQ ID NO: 2364297 - protein, 4 aa, Entamoeba dispar
GEMN

SEQ ID NO: 2364298 - protein, 11 aa, Entamoeba dispar
GENEEPEKEED

SEQ ID NO: 2364299 - protein, 7 aa, Entamoeba dispar
GENIKSI

SEQ ID NO: 2364300 - protein, 7 aa, Entamoeba dispar
GENKGDK

SEQ ID NO: 2364301 - protein, 9 aa, Entamoeba dispar
GENYKKEKS

SEQ ID NO: 2364302 - protein, 9 aa, Entamoeba dispar
GEPKEVQSK

SEQ ID NO: 2364303 - protein, 8 aa, Entamoeba dispar
GEPNNENY

SEQ ID NO: 2364304 - protein, 7 aa, Entamoeba dispar
GEQYGNY

SEQ ID NO: 2364305 - protein, 4 aa, Entamoeba dispar
GERA

SEQ ID NO: 2364306 - protein, 5 aa, Entamoeba dispar
GEREK

SEQ ID NO: 2364307 - protein, 6 aa, Entamoeba dispar
GEREKY

SEQ ID NO: 2364308 - protein, 14 aa, Entamoeba dispar
GERGTSLSGGQKQR

SEQ ID NO: 2364309 - protein, 6 aa, Entamoeba dispar
GERNKG

SEQ ID NO: 2364310 - protein, 15 aa, Entamoeba dispar
GERRKRKEIKDIKEG

SEQ ID NO: 2364311 - protein, 7 aa, Entamoeba dispar
GESETDW

SEQ ID NO: 2364312 - protein, 7 aa, Entamoeba dispar
GESFPQE

SEQ ID NO: 2364313 - protein, 9 aa, Entamoeba dispar
GESKLTGGV

SEQ ID NO: 2364314 - protein, 15 aa, Entamoeba dispar
GESNPIEKKKDEISV

SEQ ID NO: 2364315 - protein, 8 aa, Entamoeba dispar
GESNPTKI

SEQ ID NO: 2364316 - protein, 9 aa, Entamoeba dispar
GESNSHEKA

SEQ ID NO: 2364317 - protein, 7 aa, Entamoeba dispar
GESNTAT

SEQ ID NO: 2364318 - protein, 7 aa, Entamoeba dispar
GESPQWS

SEQ ID NO: 2364319 - protein, 8 aa, Entamoeba dispar
GESPYRRA

SEQ ID NO: 2364320 - protein, 7 aa, Entamoeba dispar
GESSKDF

SEQ ID NO: 2364321 - protein, 5 aa, Entamoeba dispar
GESTI

SEQ ID NO: 2364322 - protein, 8 aa, Entamoeba dispar
GESTLKGK

SEQ ID NO: 2364323 - protein, 6 aa, Entamoeba dispar
GESTYD

SEQ ID NO: 2364324 - protein, 7 aa, Entamoeba dispar
GETEKDV

SEQ ID NO: 2364325 - protein, 7 aa, Entamoeba dispar
GETKSIN

SEQ ID NO: 2364326 - protein, 12 aa, Entamoeba dispar
GETLGSQSCQAL

SEQ ID NO: 2364327 - protein, 6 aa, Entamoeba dispar
GETLSK

SEQ ID NO: 2364328 - protein, 20 aa, Entamoeba dispar
GETPGVTPEQAQKYVGKERH

SEQ ID NO: 2364329 - protein, 4 aa, Entamoeba dispar
GETQ

SEQ ID NO: 2364330 - protein, 5 aa, Entamoeba dispar
GETST

SEQ ID NO: 2364331 - protein, 10 aa, Entamoeba dispar
GETSYSSTLS

SEQ ID NO: 2364332 - protein, 9 aa, Entamoeba dispar
GETTSKDIN

SEQ ID NO: 2364333 - protein, 7 aa, Entamoeba dispar
GEVEEGE

SEQ ID NO: 2364334 - protein, 5 aa, Entamoeba dispar
GEVIE

SEQ ID NO: 2364335 - protein, 10 aa, Entamoeba dispar
GEVNKEEDQY

SEQ ID NO: 2364336 - protein, 17 aa, Entamoeba dispar
GEYEKDGNELPVNEESR

SEQ ID NO: 2364337 - protein, 5 aa, Entamoeba dispar
GEYLP

SEQ ID NO: 2364338 - protein, 6 aa, Entamoeba dispar
GEYNHR

SEQ ID NO: 2364339 - protein, 21 aa, Entamoeba dispar
GEYPLSSSIASEDAKPHNRGR

SEQ ID NO: 2364340 - protein, 8 aa, Entamoeba dispar
GEYSGRYT

SEQ ID NO: 2364341 - protein, 6 aa, Entamoeba dispar
GEYTES

SEQ ID NO: 2364342 - protein, 8 aa, Entamoeba dispar
GFAPNTKG

SEQ ID NO: 2364343 - protein, 9 aa, Entamoeba dispar
GFDDKTGIG

SEQ ID NO: 2364344 - protein, 4 aa, Entamoeba dispar
GFDK

SEQ ID NO: 2364345 - protein, 7 aa, Entamoeba dispar
GFDRETS

SEQ ID NO: 2364346 - protein, 11 aa, Entamoeba dispar
GFEEESSTGIS

SEQ ID NO: 2364347 - protein, 5 aa, Entamoeba dispar
GFEKP

SEQ ID NO: 2364348 - protein, 8 aa, Entamoeba dispar
GFEPGSVD

SEQ ID NO: 2364349 - protein, 6 aa, Entamoeba dispar
GFEPLS

SEQ ID NO: 2364350 - protein, 8 aa, Entamoeba dispar
GFETEDNV

SEQ ID NO: 2364351 - protein, 4 aa, Entamoeba dispar
GFGT

SEQ ID NO: 2364352 - protein, 4 aa, Entamoeba dispar
GFKG

SEQ ID NO: 2364353 - protein, 4 aa, Entamoeba dispar
GFNA

SEQ ID NO: 2364354 - protein, 5 aa, Entamoeba dispar
GFNGS

SEQ ID NO: 2364355 - protein, 27 aa, Entamoeba dispar
GFNNAKYTRVNVSDGNLTSITSAEVRT

SEQ ID NO: 2364356 - protein, 5 aa, Entamoeba dispar
GFNNE

SEQ ID NO: 2364357 - protein, 10 aa, Entamoeba dispar
GFNNKYPGST

SEQ ID NO: 2364358 - protein, 10 aa, Entamoeba dispar
GFNSKTNESL

SEQ ID NO: 2364359 - protein, 5 aa, Entamoeba dispar
GFPEK

SEQ ID NO: 2364360 - protein, 5 aa, Entamoeba dispar
GFPER

SEQ ID NO: 2364361 - protein, 6 aa, Entamoeba dispar
GFPTHS

SEQ ID NO: 2364362 - protein, 6 aa, Entamoeba dispar
GFQGDV

SEQ ID NO: 2364363 - protein, 8 aa, Entamoeba dispar
GFQNNKNP

SEQ ID NO: 2364364 - protein, 7 aa, Entamoeba dispar
GFSEEPI

SEQ ID NO: 2364365 - protein, 4 aa, Entamoeba dispar
GFSG

SEQ ID NO: 2364366 - protein, 5 aa, Entamoeba dispar
GFSKQ

SEQ ID NO: 2364367 - protein, 8 aa, Entamoeba dispar
GFSVRGNS

SEQ ID NO: 2364368 - protein, 6 aa, Entamoeba dispar
GFTSSE

SEQ ID NO: 2364369 - protein, 6 aa, Entamoeba dispar
GGAARK

SEQ ID NO: 2364370 - protein, 5 aa, Entamoeba dispar
GGAQK

SEQ ID NO: 2364371 - protein, 20 aa, Entamoeba dispar
GGCDKTGESTSKFVAKTSDN

SEQ ID NO: 2364372 - protein, 7 aa, Entamoeba dispar
GGCTEPD

SEQ ID NO: 2364373 - protein, 13 aa, Entamoeba dispar
GGDPENNEFDIGT

SEQ ID NO: 2364374 - protein, 8 aa, Entamoeba dispar
GGDSDKPG

SEQ ID NO: 2364375 - protein, 9 aa, Entamoeba dispar
GGDSGALKP

SEQ ID NO: 2364376 - protein, 6 aa, Entamoeba dispar
GGDVKI

SEQ ID NO: 2364377 - protein, 6 aa, Entamoeba dispar
GGEDQS

SEQ ID NO: 2364378 - protein, 9 aa, Entamoeba dispar
GGEEPTAVG

SEQ ID NO: 2364379 - protein, 7 aa, Entamoeba dispar
GGEQTSP

SEQ ID NO: 2364380 - protein, 9 aa, Entamoeba dispar
GGESENNDD

SEQ ID NO: 2364381 - protein, 16 aa, Entamoeba dispar
GGFENGKDKQCESLSN

SEQ ID NO: 2364382 - protein, 6 aa, Entamoeba dispar
GGFNTQ

SEQ ID NO: 2364383 - protein, 5 aa, Entamoeba dispar
GGGDT

SEQ ID NO: 2364384 - protein, 4 aa, Entamoeba dispar
GGGY

SEQ ID NO: 2364385 - protein, 7 aa, Entamoeba dispar
GGGYADL

SEQ ID NO: 2364386 - protein, 10 aa, Entamoeba dispar
GGGYGDLESN

SEQ ID NO: 2364387 - protein, 7 aa, Entamoeba dispar
GGHGEYA

SEQ ID NO: 2364388 - protein, 4 aa, Entamoeba dispar
GGHT

SEQ ID NO: 2364389 - protein, 4 aa, Entamoeba dispar
GGIE

SEQ ID NO: 2364390 - protein, 8 aa, Entamoeba dispar
GGIEGSDL

SEQ ID NO: 2364391 - protein, 8 aa, Entamoeba dispar
GGIGGGIG

SEQ ID NO: 2364392 - protein, 6 aa, Entamoeba dispar
GGIPPA

SEQ ID NO: 2364393 - protein, 10 aa, Entamoeba dispar
GGKDKSFTVT

SEQ ID NO: 2364394 - protein, 9 aa, Entamoeba dispar
GGKDPYSKL

SEQ ID NO: 2364395 - protein, 8 aa, Entamoeba dispar
GGKIGEKG

SEQ ID NO: 2364396 - protein, 4 aa, Entamoeba dispar
GGKM

SEQ ID NO: 2364397 - protein, 7 aa, Entamoeba dispar
GGKPIKY

SEQ ID NO: 2364398 - protein, 6 aa, Entamoeba dispar
GGLEQG

SEQ ID NO: 2364399 - protein, 4 aa, Entamoeba dispar
GGLL

SEQ ID NO: 2364400 - protein, 10 aa, Entamoeba dispar
GGLRRERDRA

SEQ ID NO: 2364401 - protein, 7 aa, Entamoeba dispar
GGNCQSG

SEQ ID NO: 2364402 - protein, 4 aa, Entamoeba dispar
GGNP

SEQ ID NO: 2364403 - protein, 5 aa, Entamoeba dispar
GGNQI

SEQ ID NO: 2364404 - protein, 6 aa, Entamoeba dispar
GGPIGN

SEQ ID NO: 2364405 - protein, 4 aa, Entamoeba dispar
GGPV

SEQ ID NO: 2364406 - protein, 11 aa, Entamoeba dispar
GGQPRKEKDLA

SEQ ID NO: 2364407 - protein, 7 aa, Entamoeba dispar
GGQYDPS

SEQ ID NO: 2364408 - protein, 6 aa, Entamoeba dispar
GGRGIY

SEQ ID NO: 2364409 - protein, 25 aa, Entamoeba dispar
GGRRQLNKKLSNSFPSTNSKETKDE

SEQ ID NO: 2364410 - protein, 5 aa, Entamoeba dispar
GGRSD

SEQ ID NO: 2364411 - protein, 12 aa, Entamoeba dispar
GGRVASDSSTTT

SEQ ID NO: 2364412 - protein, 7 aa, Entamoeba dispar
GGSEPLN

SEQ ID NO: 2364413 - protein, 9 aa, Entamoeba dispar
GGSGAGKST

SEQ ID NO: 2364414 - protein, 10 aa, Entamoeba dispar
GGSGEEITEK

SEQ ID NO: 2364415 - protein, 9 aa, Entamoeba dispar
GGSMGGSVS

SEQ ID NO: 2364416 - protein, 12 aa, Entamoeba dispar
GGSNLSGGQKQR

SEQ ID NO: 2364417 - protein, 21 aa, Entamoeba dispar
GGSRYDSKKKSLYVGNSECSP

SEQ ID NO: 2364418 - protein, 7 aa, Entamoeba dispar
GGTCEEC

SEQ ID NO: 2364419 - protein, 16 aa, Entamoeba dispar
GGTNEKTRTAHLTANS

SEQ ID NO: 2364420 - protein, 5 aa, Entamoeba dispar
GGVHR

SEQ ID NO: 2364421 - protein, 4 aa, Entamoeba dispar
GGYK

SEQ ID NO: 2364422 - protein, 11 aa, Entamoeba dispar
GGYSKTINGTY

SEQ ID NO: 2364423 - protein, 8 aa, Entamoeba dispar
GGYTDGPL

SEQ ID NO: 2364424 - protein, 13 aa, Entamoeba dispar
GHATETDCDAQNE

SEQ ID NO: 2364425 - protein, 6 aa, Entamoeba dispar
GHGGDD

SEQ ID NO: 2364426 - protein, 4 aa, Entamoeba dispar
GHGL

SEQ ID NO: 2364427 - protein, 11 aa, Entamoeba dispar
GHGRSSGDRGY

SEQ ID NO: 2364428 - protein, 15 aa, Entamoeba dispar
GHGRSSGIPNKPKTF

SEQ ID NO: 2364429 - protein, 4 aa, Entamoeba dispar
GHGS

SEQ ID NO: 2364430 - protein, 17 aa, Entamoeba dispar
GHKKNNEDISDEEMTEM

SEQ ID NO: 2364431 - protein, 8 aa, Entamoeba dispar
GHRNQGLS

SEQ ID NO: 2364432 - protein, 12 aa, Entamoeba dispar
GHRRPQNNLPDN

SEQ ID NO: 2364433 - protein, 9 aa, Entamoeba dispar
GHSGGEDFS

SEQ ID NO: 2364434 - protein, 7 aa, Entamoeba dispar
GHTGGFG

SEQ ID NO: 2364435 - protein, 6 aa, Entamoeba dispar
GHTHDG

SEQ ID NO: 2364436 - protein, 13 aa, Entamoeba dispar
GHTPDPDDPTSCI

SEQ ID NO: 2364437 - protein, 7 aa, Entamoeba dispar
GHTSSMN

SEQ ID NO: 2364438 - protein, 10 aa, Entamoeba dispar
GHYQDKEGEY

SEQ ID NO: 2364439 - protein, 10 aa, Entamoeba dispar
GIAKEGIEAK

SEQ ID NO: 2364440 - protein, 6 aa, Entamoeba dispar
GIASEI

SEQ ID NO: 2364441 - protein, 22 aa, Entamoeba dispar
GICDESYNKRQEQFGKNRTPDP

SEQ ID NO: 2364442 - protein, 4 aa, Entamoeba dispar
GIDD

SEQ ID NO: 2364443 - protein, 7 aa, Entamoeba dispar
GIDDPAN

SEQ ID NO: 2364444 - protein, 7 aa, Entamoeba dispar
GIDGNPL

SEQ ID NO: 2364445 - protein, 7 aa, Entamoeba dispar
GIECDEE

SEQ ID NO: 2364446 - protein, 5 aa, Entamoeba dispar
GIEDS

SEQ ID NO: 2364447 - protein, 4 aa, Entamoeba dispar
GIEE

SEQ ID NO: 2364448 - protein, 14 aa, Entamoeba dispar
GIEEDSTESSDENI

SEQ ID NO: 2364449 - protein, 15 aa, Entamoeba dispar
GIEEDSTESSDENIN

SEQ ID NO: 2364450 - protein, 11 aa, Entamoeba dispar
GIEEESNWSEG

SEQ ID NO: 2364451 - protein, 13 aa, Entamoeba dispar
GIEGKEGKQAALA

SEQ ID NO: 2364452 - protein, 13 aa, Entamoeba dispar
GIEGKEGKQASMA

SEQ ID NO: 2364453 - protein, 4 aa, Entamoeba dispar
GIEK

SEQ ID NO: 2364454 - protein, 5 aa, Entamoeba dispar
GIELQ

SEQ ID NO: 2364455 - protein, 7 aa, Entamoeba dispar
GIELSSE

SEQ ID NO: 2364456 - protein, 4 aa, Entamoeba dispar
GIES

SEQ ID NO: 2364457 - protein, 4 aa, Entamoeba dispar
GIET

SEQ ID NO: 2364458 - protein, 7 aa, Entamoeba dispar
GIEVTTG

SEQ ID NO: 2364459 - protein, 10 aa, Entamoeba dispar
GIGGDDGGIY

SEQ ID NO: 2364460 - protein, 11 aa, Entamoeba dispar
GIGGNDGGDVP

SEQ ID NO: 2364461 - protein, 7 aa, Entamoeba dispar
GIGSPTY

SEQ ID NO: 2364462 - protein, 6 aa, Entamoeba dispar
GIGTPA

SEQ ID NO: 2364463 - protein, 11 aa, Entamoeba dispar
GIGTPAYTAPE

SEQ ID NO: 2364464 - protein, 7 aa, Entamoeba dispar
GIGTPTY

SEQ ID NO: 2364465 - protein, 8 aa, Entamoeba dispar
GIKAKGKS

SEQ ID NO: 2364466 - protein, 5 aa, Entamoeba dispar
GIKTN

SEQ ID NO: 2364467 - protein, 6 aa, Entamoeba dispar
GINEPR

SEQ ID NO: 2364468 - protein, 10 aa, Entamoeba dispar
GINNKEITSA

SEQ ID NO: 2364469 - protein, 9 aa, Entamoeba dispar
GINNPNNCL

SEQ ID NO: 2364470 - protein, 6 aa, Entamoeba dispar
GINSSS

SEQ ID NO: 2364471 - protein, 16 aa, Entamoeba dispar
GIPEKEIKQDKETNVY

SEQ ID NO: 2364472 - protein, 25 aa, Entamoeba dispar
GIPEKEVKQEKENNTIKSPRSPRNS

SEQ ID NO: 2364473 - protein, 9 aa, Entamoeba dispar
GIPHSQSSF

SEQ ID NO: 2364474 - protein, 10 aa, Entamoeba dispar
GIPKEKKKVN

SEQ ID NO: 2364475 - protein, 12 aa, Entamoeba dispar
GIPKSDDRCSKE

SEQ ID NO: 2364476 - protein, 5 aa, Entamoeba dispar
GIPNQ

SEQ ID NO: 2364477 - protein, 11 aa, Entamoeba dispar
GIPNRSTQTIA

SEQ ID NO: 2364478 - protein, 8 aa, Entamoeba dispar
GIPSDKNI

SEQ ID NO: 2364479 - protein, 6 aa, Entamoeba dispar
GIQENK

SEQ ID NO: 2364480 - protein, 6 aa, Entamoeba dispar
GIQENQ

SEQ ID NO: 2364481 - protein, 5 aa, Entamoeba dispar
GIRQR

SEQ ID NO: 2364482 - protein, 5 aa, Entamoeba dispar
GISAP

SEQ ID NO: 2364483 - protein, 8 aa, Entamoeba dispar
GISISSDG

SEQ ID NO: 2364484 - protein, 5 aa, Entamoeba dispar
GISKS

SEQ ID NO: 2364485 - protein, 14 aa, Entamoeba dispar
GISNEGASIPSTNN

SEQ ID NO: 2364486 - protein, 7 aa, Entamoeba dispar
GISNGKQ

SEQ ID NO: 2364487 - protein, 8 aa, Entamoeba dispar
GISPRGYV

SEQ ID NO: 2364488 - protein, 15 aa, Entamoeba dispar
GISQYGSELFNKLQQ

SEQ ID NO: 2364489 - protein, 12 aa, Entamoeba dispar
GISSNPKSYFTG

SEQ ID NO: 2364490 - protein, 5 aa, Entamoeba dispar
GITPK

SEQ ID NO: 2364491 - protein, 5 aa, Entamoeba dispar
GITPP

SEQ ID NO: 2364492 - protein, 5 aa, Entamoeba dispar
GITQR

SEQ ID NO: 2364493 - protein, 7 aa, Entamoeba dispar
GITRKTA

SEQ ID NO: 2364494 - protein, 4 aa, Entamoeba dispar
GITT

SEQ ID NO: 2364495 - protein, 7 aa, Entamoeba dispar
GITTNER

SEQ ID NO: 2364496 - protein, 13 aa, Entamoeba dispar
GITTNIEKSDLTT

SEQ ID NO: 2364497 - protein, 8 aa, Entamoeba dispar
GIVGSKSQ

SEQ ID NO: 2364498 - protein, 8 aa, Entamoeba dispar
GKAAPKEF

SEQ ID NO: 2364499 - protein, 8 aa, Entamoeba dispar
GKAAPQEF

SEQ ID NO: 2364500 - protein, 5 aa, Entamoeba dispar
GKAKT

SEQ ID NO: 2364501 - protein, 7 aa, Entamoeba dispar
GKANTKR

SEQ ID NO: 2364502 - protein, 10 aa, Entamoeba dispar
GKASGNNGNI

SEQ ID NO: 2364503 - protein, 6 aa, Entamoeba dispar
GKATTP

SEQ ID NO: 2364504 - protein, 4 aa, Entamoeba dispar
GKAV

SEQ ID NO: 2364505 - protein, 8 aa, Entamoeba dispar
GKAVGAAK

SEQ ID NO: 2364506 - protein, 5 aa, Entamoeba dispar
GKCDM

SEQ ID NO: 2364507 - protein, 7 aa, Entamoeba dispar
GKCESCE

SEQ ID NO: 2364508 - protein, 10 aa, Entamoeba dispar
GKCKEGYYQD

SEQ ID NO: 2364509 - protein, 10 aa, Entamoeba dispar
GKCNPCSDIP

SEQ ID NO: 2364510 - protein, 13 aa, Entamoeba dispar
GKCRCNPGFGGDD

SEQ ID NO: 2364511 - protein, 17 aa, Entamoeba dispar
GKCSIKEKNQNGKNEEI

SEQ ID NO: 2364512 - protein, 8 aa, Entamoeba dispar
GKCSKCQD

SEQ ID NO: 2364513 - protein, 17 aa, Entamoeba dispar
GKCSNKEKNQNGKNEEI

SEQ ID NO: 2364514 - protein, 7 aa, Entamoeba dispar
GKCSTQC

SEQ ID NO: 2364515 - protein, 8 aa, Entamoeba dispar
GKDEIKGS

SEQ ID NO: 2364516 - protein, 6 aa, Entamoeba dispar
GKDGEH

SEQ ID NO: 2364517 - protein, 5 aa, Entamoeba dispar
GKDLR

SEQ ID NO: 2364518 - protein, 6 aa, Entamoeba dispar
GKDLVG

SEQ ID NO: 2364519 - protein, 6 aa, Entamoeba dispar
GKDPKT

SEQ ID NO: 2364520 - protein, 9 aa, Entamoeba dispar
GKDQNGTLN

SEQ ID NO: 2364521 - protein, 4 aa, Entamoeba dispar
GKDS

SEQ ID NO: 2364522 - protein, 8 aa, Entamoeba dispar
GKDTAKVK

SEQ ID NO: 2364523 - protein, 5 aa, Entamoeba dispar
GKDTC

SEQ ID NO: 2364524 - protein, 10 aa, Entamoeba dispar
GKDYQEEPYN

SEQ ID NO: 2364525 - protein, 19 aa, Entamoeba dispar
GKECETCESKNCKKCDSVS

SEQ ID NO: 2364526 - protein, 6 aa, Entamoeba dispar
GKEDGR

SEQ ID NO: 2364527 - protein, 7 aa, Entamoeba dispar
GKEEENI

SEQ ID NO: 2364528 - protein, 8 aa, Entamoeba dispar
GKEESTLT

SEQ ID NO: 2364529 - protein, 7 aa, Entamoeba dispar
GKEFNYQ

SEQ ID NO: 2364530 - protein, 12 aa, Entamoeba dispar
GKEGNQAARASD

SEQ ID NO: 2364531 - protein, 13 aa, Entamoeba dispar
GKEGSQAARSADY

SEQ ID NO: 2364532 - protein, 18 aa, Entamoeba dispar
GKEIKQLTGRKYRKRYSQ

SEQ ID NO: 2364533 - protein, 10 aa, Entamoeba dispar
GKEKETGDIQ

SEQ ID NO: 2364534 - protein, 26 aa, Entamoeba dispar
GKEKKPKKVKTKPVKQNKENKKKEKV

SEQ ID NO: 2364535 - protein, 6 aa, Entamoeba dispar
GKEKTN

SEQ ID NO: 2364536 - protein, 7 aa, Entamoeba dispar
GKENEQQ

SEQ ID NO: 2364537 - protein, 7 aa, Entamoeba dispar
GKENPKY

SEQ ID NO: 2364538 - protein, 5 aa, Entamoeba dispar
GKESN

SEQ ID NO: 2364539 - protein, 8 aa, Entamoeba dispar
GKETENNI

SEQ ID NO: 2364540 - protein, 14 aa, Entamoeba dispar
GKETKIEMSKEEPV

SEQ ID NO: 2364541 - protein, 16 aa, Entamoeba dispar
GKETRSSMNRNGQRNV

SEQ ID NO: 2364542 - protein, 10 aa, Entamoeba dispar
GKETSKNNIA

SEQ ID NO: 2364543 - protein, 8 aa, Entamoeba dispar
GKEVDDKI

SEQ ID NO: 2364544 - protein, 14 aa, Entamoeba dispar
GKFDDEEVCDPSVE

SEQ ID NO: 2364545 - protein, 5 aa, Entamoeba dispar
GKFQE

SEQ ID NO: 2364546 - protein, 16 aa, Entamoeba dispar
GKFSKKEYQSIDSSDD

SEQ ID NO: 2364547 - protein, 8 aa, Entamoeba dispar
GKFSSDSS

SEQ ID NO: 2364548 - protein, 18 aa, Entamoeba dispar
GKGCSKCRDGYSVTSDRL

SEQ ID NO: 2364549 - protein, 11 aa, Entamoeba dispar
GKGGTDNVKAG

SEQ ID NO: 2364550 - protein, 4 aa, Entamoeba dispar
GKGI

SEQ ID NO: 2364551 - protein, 6 aa, Entamoeba dispar
GKGKQD

SEQ ID NO: 2364552 - protein, 5 aa, Entamoeba dispar
GKGSF

SEQ ID NO: 2364553 - protein, 6 aa, Entamoeba dispar
GKGTKQ

SEQ ID NO: 2364554 - protein, 11 aa, Entamoeba dispar
GKGTRFNATKR

SEQ ID NO: 2364555 - protein, 12 aa, Entamoeba dispar
GKHDEDDETKAC

SEQ ID NO: 2364556 - protein, 14 aa, Entamoeba dispar
GKHKKASNKEDYKK

SEQ ID NO: 2364557 - protein, 5 aa, Entamoeba dispar
GKHRG

SEQ ID NO: 2364558 - protein, 8 aa, Entamoeba dispar
GKIADKTN

SEQ ID NO: 2364559 - protein, 4 aa, Entamoeba dispar
GKIC

SEQ ID NO: 2364560 - protein, 6 aa, Entamoeba dispar
GKIDAK

SEQ ID NO: 2364561 - protein, 5 aa, Entamoeba dispar
GKIDS

SEQ ID NO: 2364562 - protein, 13 aa, Entamoeba dispar
GKIKKEQCDSGVN

SEQ ID NO: 2364563 - protein, 12 aa, Entamoeba dispar
GKIKSSILRKIL

SEQ ID NO: 2364564 - protein, 7 aa, Entamoeba dispar
GKITSKI

SEQ ID NO: 2364565 - protein, 5 aa, Entamoeba dispar
GKIVE

SEQ ID NO: 2364566 - protein, 18 aa, Entamoeba dispar
GKIYGKEEKEESFEEEEE

SEQ ID NO: 2364567 - protein, 7 aa, Entamoeba dispar
GKKEEKL

SEQ ID NO: 2364568 - protein, 6 aa, Entamoeba dispar
GKKHPQ

SEQ ID NO: 2364569 - protein, 10 aa, Entamoeba dispar
GKKINNNNGV

SEQ ID NO: 2364570 - protein, 14 aa, Entamoeba dispar
GKKKSENSKDQNIV

SEQ ID NO: 2364571 - protein, 5 aa, Entamoeba dispar
GKKKT

SEQ ID NO: 2364572 - protein, 9 aa, Entamoeba dispar
GKKLDENGN

SEQ ID NO: 2364573 - protein, 9 aa, Entamoeba dispar
GKKLDSKNL

SEQ ID NO: 2364574 - protein, 7 aa, Entamoeba dispar
GKKLDTQ

SEQ ID NO: 2364575 - protein, 10 aa, Entamoeba dispar
GKKNGHRAPS

SEQ ID NO: 2364576 - protein, 9 aa, Entamoeba dispar
GKKNKVSGL

SEQ ID NO: 2364577 - protein, 13 aa, Entamoeba dispar
GKKQAANDLNIKT

SEQ ID NO: 2364578 - protein, 10 aa, Entamoeba dispar
GKKQTTTYQA

SEQ ID NO: 2364579 - protein, 8 aa, Entamoeba dispar
GKKREVLG

SEQ ID NO: 2364580 - protein, 17 aa, Entamoeba dispar
GKKTPMEKKEESSSDQF

SEQ ID NO: 2364581 - protein, 10 aa, Entamoeba dispar
GKKYSERAEQ

SEQ ID NO: 2364582 - protein, 14 aa, Entamoeba dispar
GKLDEDEECDPSIE

SEQ ID NO: 2364583 - protein, 5 aa, Entamoeba dispar
GKLDK

SEQ ID NO: 2364584 - protein, 4 aa, Entamoeba dispar
GKLE

SEQ ID NO: 2364585 - protein, 6 aa, Entamoeba dispar
GKLHSN

SEQ ID NO: 2364586 - protein, 6 aa, Entamoeba dispar
GKLQEA

SEQ ID NO: 2364587 - protein, 7 aa, Entamoeba dispar
GKLTTNS

SEQ ID NO: 2364588 - protein, 5 aa, Entamoeba dispar
GKMAG

SEQ ID NO: 2364589 - protein, 6 aa, Entamoeba dispar
GKMEVP

SEQ ID NO: 2364590 - protein, 5 aa, Entamoeba dispar
GKMVG

SEQ ID NO: 2364591 - protein, 7 aa, Entamoeba dispar
GKNEEGF

SEQ ID NO: 2364592 - protein, 7 aa, Entamoeba dispar
GKNGPIE

SEQ ID NO: 2364593 - protein, 7 aa, Entamoeba dispar
GKNIEGI

SEQ ID NO: 2364594 - protein, 9 aa, Entamoeba dispar
GKNNSTIES

SEQ ID NO: 2364595 - protein, 6 aa, Entamoeba dispar
GKNSKC

SEQ ID NO: 2364596 - protein, 8 aa, Entamoeba dispar
GKNSRIIT

SEQ ID NO: 2364597 - protein, 8 aa, Entamoeba dispar
GKNTTESY

SEQ ID NO: 2364598 - protein, 6 aa, Entamoeba dispar
GKPTDA

SEQ ID NO: 2364599 - protein, 5 aa, Entamoeba dispar
GKPTL

SEQ ID NO: 2364600 - protein, 9 aa, Entamoeba dispar
GKPVSTKAD

SEQ ID NO: 2364601 - protein, 5 aa, Entamoeba dispar
GKPVT

SEQ ID NO: 2364602 - protein, 8 aa, Entamoeba dispar
GKPYSSDQ

SEQ ID NO: 2364603 - protein, 8 aa, Entamoeba dispar
GKQKERLE

SEQ ID NO: 2364604 - protein, 7 aa, Entamoeba dispar
GKQPQQL

SEQ ID NO: 2364605 - protein, 11 aa, Entamoeba dispar
GKQTRKKDTIK

SEQ ID NO: 2364606 - protein, 6 aa, Entamoeba dispar
GKRIEL

SEQ ID NO: 2364607 - protein, 16 aa, Entamoeba dispar
GKRKKSGEKKVNPVRV

SEQ ID NO: 2364608 - protein, 7 aa, Entamoeba dispar
GKRLERP

SEQ ID NO: 2364609 - protein, 13 aa, Entamoeba dispar
GKRREQCDGGTNC

SEQ ID NO: 2364610 - protein, 14 aa, Entamoeba dispar
GKRVEVSNNIPPTI

SEQ ID NO: 2364611 - protein, 5 aa, Entamoeba dispar
GKRVK

SEQ ID NO: 2364612 - protein, 7 aa, Entamoeba dispar
GKSISKE

SEQ ID NO: 2364613 - protein, 22 aa, Entamoeba dispar
GKSISSKHNRHSGGLNTTKIPS

SEQ ID NO: 2364614 - protein, 14 aa, Entamoeba dispar
GKSLSRQSKRFANK

SEQ ID NO: 2364615 - protein, 6 aa, Entamoeba dispar
GKSNEK

SEQ ID NO: 2364616 - protein, 6 aa, Entamoeba dispar
GKSPRL

SEQ ID NO: 2364617 - protein, 9 aa, Entamoeba dispar
GKSSSGNQL

SEQ ID NO: 2364618 - protein, 11 aa, Entamoeba dispar
GKTAAQRTSRL

SEQ ID NO: 2364619 - protein, 8 aa, Entamoeba dispar
GKTGIQNI

SEQ ID NO: 2364620 - protein, 14 aa, Entamoeba dispar
GKTHYNRKECTDPF

SEQ ID NO: 2364621 - protein, 6 aa, Entamoeba dispar
GKTIKK

SEQ ID NO: 2364622 - protein, 31 aa, Entamoeba dispar
  misc_feature (17)..(18): Xaa can be any naturally occurring amino acid
GKTKESLNQDKPRPTPXXPTPLQEKLDELAE

SEQ ID NO: 2364623 - protein, 8 aa, Entamoeba dispar
GKTKNGWG

SEQ ID NO: 2364624 - protein, 5 aa, Entamoeba dispar
GKTNG

SEQ ID NO: 2364625 - protein, 6 aa, Entamoeba dispar
GKTNKK

SEQ ID NO: 2364626 - protein, 29 aa, Entamoeba dispar
GKTPTELNDGLDPEEEQQCYQGKSITKDG

SEQ ID NO: 2364627 - protein, 5 aa, Entamoeba dispar
GKTQI

SEQ ID NO: 2364628 - protein, 5 aa, Entamoeba dispar
GKTSY

SEQ ID NO: 2364629 - protein, 5 aa, Entamoeba dispar
GKTTI

SEQ ID NO: 2364630 - protein, 8 aa, Entamoeba dispar
GKTTSVPL

SEQ ID NO: 2364631 - protein, 7 aa, Entamoeba dispar
GKTTYEN

SEQ ID NO: 2364632 - protein, 7 aa, Entamoeba dispar
GKTYNSI

SEQ ID NO: 2364633 - protein, 7 aa, Entamoeba dispar
GKVISPK

SEQ ID NO: 2364634 - protein, 7 aa, Entamoeba dispar
GKVPGNC

SEQ ID NO: 2364635 - protein, 6 aa, Entamoeba dispar
GKVPPK

SEQ ID NO: 2364636 - protein, 6 aa, Entamoeba dispar
GKVQGG

SEQ ID NO: 2364637 - protein, 22 aa, Entamoeba dispar
GKVTEIGKISSELNKKIDKTMP

SEQ ID NO: 2364638 - protein, 7 aa, Entamoeba dispar
GKVTGTN

SEQ ID NO: 2364639 - protein, 7 aa, Entamoeba dispar
GKYDDSY

SEQ ID NO: 2364640 - protein, 5 aa, Entamoeba dispar
GKYGI

SEQ ID NO: 2364641 - protein, 7 aa, Entamoeba dispar
GKYLNEG

SEQ ID NO: 2364642 - protein, 8 aa, Entamoeba dispar
GKYNRREE

SEQ ID NO: 2364643 - protein, 7 aa, Entamoeba dispar
GKYPATI

SEQ ID NO: 2364644 - protein, 5 aa, Entamoeba dispar
GKYQI

SEQ ID NO: 2364645 - protein, 7 aa, Entamoeba dispar
GLDEESA

SEQ ID NO: 2364646 - protein, 4 aa, Entamoeba dispar
GLDM

SEQ ID NO: 2364647 - protein, 7 aa, Entamoeba dispar
GLDMPDG

SEQ ID NO: 2364648 - protein, 6 aa, Entamoeba dispar
GLEDGK

SEQ ID NO: 2364649 - protein, 6 aa, Entamoeba dispar
GLEEES

SEQ ID NO: 2364650 - protein, 7 aa, Entamoeba dispar
GLEENDS

SEQ ID NO: 2364651 - protein, 14 aa, Entamoeba dispar
GLELNSKANERVTG

SEQ ID NO: 2364652 - protein, 4 aa, Entamoeba dispar
GLES

SEQ ID NO: 2364653 - protein, 10 aa, Entamoeba dispar
GLGKPERAHH

SEQ ID NO: 2364654 - protein, 5 aa, Entamoeba dispar
GLGNN

SEQ ID NO: 2364655 - protein, 4 aa, Entamoeba dispar
GLGQ

SEQ ID NO: 2364656 - protein, 5 aa, Entamoeba dispar
GLGRL

SEQ ID NO: 2364657 - protein, 10 aa, Entamoeba dispar
GLINSGNWGP

SEQ ID NO: 2364658 - protein, 9 aa, Entamoeba dispar
GLKDDPFKL

SEQ ID NO: 2364659 - protein, 10 aa, Entamoeba dispar
GLKERDDEIM

SEQ ID NO: 2364660 - protein, 7 aa, Entamoeba dispar
GLKNPNR

SEQ ID NO: 2364661 - protein, 8 aa, Entamoeba dispar
GLPAAYKQ

SEQ ID NO: 2364662 - protein, 6 aa, Entamoeba dispar
GLPPHK

SEQ ID NO: 2364663 - protein, 8 aa, Entamoeba dispar
GLREEGEQ

SEQ ID NO: 2364664 - protein, 10 aa, Entamoeba dispar
GLSAASGKIG

SEQ ID NO: 2364665 - protein, 9 aa, Entamoeba dispar
GLSDSESEI

SEQ ID NO: 2364666 - protein, 6 aa, Entamoeba dispar
GLSNEN

SEQ ID NO: 2364667 - protein, 6 aa, Entamoeba dispar
GLSPEI

SEQ ID NO: 2364668 - protein, 4 aa, Entamoeba dispar
GLST

SEQ ID NO: 2364669 - protein, 10 aa, Entamoeba dispar
GLTGELSDTQ

SEQ ID NO: 2364670 - protein, 11 aa, Entamoeba dispar
GLTKDKQRVRY

SEQ ID NO: 2364671 - protein, 10 aa, Entamoeba dispar
GLTPAESAIN

SEQ ID NO: 2364672 - protein, 9 aa, Entamoeba dispar
GLYNQDAKS

SEQ ID NO: 2364673 - protein, 8 aa, Entamoeba dispar
GMDKERSL

SEQ ID NO: 2364674 - protein, 5 aa, Entamoeba dispar
GMERI

SEQ ID NO: 2364675 - protein, 10 aa, Entamoeba dispar
GMGHEARDSG

SEQ ID NO: 2364676 - protein, 10 aa, Entamoeba dispar
GMKDGETTWE

SEQ ID NO: 2364677 - protein, 5 aa, Entamoeba dispar
GMKTI

SEQ ID NO: 2364678 - protein, 12 aa, Entamoeba dispar
GMNDGSEETTFS

SEQ ID NO: 2364679 - protein, 8 aa, Entamoeba dispar
GMNEKETI

SEQ ID NO: 2364680 - protein, 5 aa, Entamoeba dispar
GMNQT

SEQ ID NO: 2364681 - protein, 7 aa, Entamoeba dispar
GMPDEVR

SEQ ID NO: 2364682 - protein, 6 aa, Entamoeba dispar
GMSSTQ

SEQ ID NO: 2364683 - protein, 4 aa, Entamoeba dispar
GMSY

SEQ ID NO: 2364684 - protein, 13 aa, Entamoeba dispar
GMYQDEKGQKECK

SEQ ID NO: 2364685 - protein, 10 aa, Entamoeba dispar
GMYSPSSKNI

SEQ ID NO: 2364686 - protein, 9 aa, Entamoeba dispar
GNAQQIPSS

SEQ ID NO: 2364687 - protein, 6 aa, Entamoeba dispar
GNATQE

SEQ ID NO: 2364688 - protein, 12 aa, Entamoeba dispar
GNCRCDASTSYQ

SEQ ID NO: 2364689 - protein, 6 aa, Entamoeba dispar
GNCSKY

SEQ ID NO: 2364690 - protein, 6 aa, Entamoeba dispar
GNDDYD

SEQ ID NO: 2364691 - protein, 7 aa, Entamoeba dispar
GNDNEAT

SEQ ID NO: 2364692 - protein, 5 aa, Entamoeba dispar
GNDNN

SEQ ID NO: 2364693 - protein, 7 aa, Entamoeba dispar
GNDNNNY

SEQ ID NO: 2364694 - protein, 6 aa, Entamoeba dispar
GNDNYN

SEQ ID NO: 2364695 - protein, 7 aa, Entamoeba dispar
GNDNYNN

SEQ ID NO: 2364696 - protein, 9 aa, Entamoeba dispar
GNDQKELEG

SEQ ID NO: 2364697 - protein, 5 aa, Entamoeba dispar
GNDSC

SEQ ID NO: 2364698 - protein, 6 aa, Entamoeba dispar
GNDSQH

SEQ ID NO: 2364699 - protein, 7 aa, Entamoeba dispar
GNDTKKK

SEQ ID NO: 2364700 - protein, 25 aa, Entamoeba dispar
GNDTRLARNRKQNGNVKRGKTEDEV

SEQ ID NO: 2364701 - protein, 7 aa, Entamoeba dispar
GNECSKC

SEQ ID NO: 2364702 - protein, 5 aa, Entamoeba dispar
GNECT

SEQ ID NO: 2364703 - protein, 4 aa, Entamoeba dispar
GNEE

SEQ ID NO: 2364704 - protein, 9 aa, Entamoeba dispar
GNEEKVKEK

SEQ ID NO: 2364705 - protein, 11 aa, Entamoeba dispar
GNEGDFNEGSV

SEQ ID NO: 2364706 - protein, 7 aa, Entamoeba dispar
GNEIQEY

SEQ ID NO: 2364707 - protein, 8 aa, Entamoeba dispar
GNEKSKIQ

SEQ ID NO: 2364708 - protein, 7 aa, Entamoeba dispar
GNELDGP

SEQ ID NO: 2364709 - protein, 19 aa, Entamoeba dispar
GNENKSNKKDSLLSDESKF

SEQ ID NO: 2364710 - protein, 6 aa, Entamoeba dispar
GNENTL

SEQ ID NO: 2364711 - protein, 4 aa, Entamoeba dispar
GNER

SEQ ID NO: 2364712 - protein, 5 aa, Entamoeba dispar
GNERS

SEQ ID NO: 2364713 - protein, 9 aa, Entamoeba dispar
GNEYKRKEE

SEQ ID NO: 2364714 - protein, 7 aa, Entamoeba dispar
GNEYNNS

SEQ ID NO: 2364715 - protein, 8 aa, Entamoeba dispar
GNFNPEKR

SEQ ID NO: 2364716 - protein, 6 aa, Entamoeba dispar
GNGDRI

SEQ ID NO: 2364717 - protein, 17 aa, Entamoeba dispar
GNGEIDEGEKCDGGDGC

SEQ ID NO: 2364718 - protein, 7 aa, Entamoeba dispar
GNGEYVD

SEQ ID NO: 2364719 - protein, 4 aa, Entamoeba dispar
GNGF

SEQ ID NO: 2364720 - protein, 13 aa, Entamoeba dispar
GNGIDSYQTQQEM

SEQ ID NO: 2364721 - protein, 22 aa, Entamoeba dispar
GNGKIDDGEECDLSAQEDKYCA

SEQ ID NO: 2364722 - protein, 5 aa, Entamoeba dispar
GNGKL

SEQ ID NO: 2364723 - protein, 5 aa, Entamoeba dispar
GNGLI

SEQ ID NO: 2364724 - protein, 7 aa, Entamoeba dispar
GNGMAGL

SEQ ID NO: 2364725 - protein, 13 aa, Entamoeba dispar
GNGNRTLKGKSHH

SEQ ID NO: 2364726 - protein, 5 aa, Entamoeba dispar
GNGPF

SEQ ID NO: 2364727 - protein, 17 aa, Entamoeba dispar
GNGQIDKGEECDGGNGC

SEQ ID NO: 2364728 - protein, 16 aa, Entamoeba dispar
GNGRIDSGEECDGGKG

SEQ ID NO: 2364729 - protein, 9 aa, Entamoeba dispar
GNGSGNLAT

SEQ ID NO: 2364730 - protein, 18 aa, Entamoeba dispar
GNGSSSSAASKKNDGDYQ

SEQ ID NO: 2364731 - protein, 12 aa, Entamoeba dispar
GNGTEKGNDGSK

SEQ ID NO: 2364732 - protein, 7 aa, Entamoeba dispar
GNHDSDG

SEQ ID NO: 2364733 - protein, 6 aa, Entamoeba dispar
GNHEDP

SEQ ID NO: 2364734 - protein, 6 aa, Entamoeba dispar
GNHLYS

SEQ ID NO: 2364735 - protein, 7 aa, Entamoeba dispar
GNHNGKE

SEQ ID NO: 2364736 - protein, 21 aa, Entamoeba dispar
GNIEPISPSKRRNSLTSFNES

SEQ ID NO: 2364737 - protein, 4 aa, Entamoeba dispar
GNIP

SEQ ID NO: 2364738 - protein, 7 aa, Entamoeba dispar
GNIRGGQ

SEQ ID NO: 2364739 - protein, 7 aa, Entamoeba dispar
GNISPSN

SEQ ID NO: 2364740 - protein, 7 aa, Entamoeba dispar
GNISSQF

SEQ ID NO: 2364741 - protein, 8 aa, Entamoeba dispar
GNKDNNNK

SEQ ID NO: 2364742 - protein, 5 aa, Entamoeba dispar
GNKDV

SEQ ID NO: 2364743 - protein, 6 aa, Entamoeba dispar
GNKENG

SEQ ID NO: 2364744 - protein, 8 aa, Entamoeba dispar
GNKEVKER

SEQ ID NO: 2364745 - protein, 7 aa, Entamoeba dispar
GNKGIKG

SEQ ID NO: 2364746 - protein, 16 aa, Entamoeba dispar
GNKKWDKGEECDGGDG

SEQ ID NO: 2364747 - protein, 9 aa, Entamoeba dispar
GNKREEDKF

SEQ ID NO: 2364748 - protein, 8 aa, Entamoeba dispar
GNKYLQDT

SEQ ID NO: 2364749 - protein, 5 aa, Entamoeba dispar
GNKYN

SEQ ID NO: 2364750 - protein, 4 aa, Entamoeba dispar
GNLD

SEQ ID NO: 2364751 - protein, 4 aa, Entamoeba dispar
GNLP

SEQ ID NO: 2364752 - protein, 4 aa, Entamoeba dispar
GNND

SEQ ID NO: 2364753 - protein, 4 aa, Entamoeba dispar
GNNE

SEQ ID NO: 2364754 - protein, 15 aa, Entamoeba dispar
GNNELKHSSNPTNKP

SEQ ID NO: 2364755 - protein, 27 aa, Entamoeba dispar
GNNERRIKRDKPYNKRKKQAGSSEDIL

SEQ ID NO: 2364756 - protein, 9 aa, Entamoeba dispar
GNNGGKQVA

SEQ ID NO: 2364757 - protein, 7 aa, Entamoeba dispar
GNNGTFT

SEQ ID NO: 2364758 - protein, 4 aa, Entamoeba dispar
GNNL

SEQ ID NO: 2364759 - protein, 5 aa, Entamoeba dispar
GNNVN

SEQ ID NO: 2364760 - protein, 103 aa, Entamoeba dispar
GNPEFDESSQEDSESSYTTSESDSSYSSEESSYSSESDDEELPVQQEQEKINPPNSVNNDKIIQSQNKGSDTKNITKEEINKNEKEKTKKFEEEQLKKAQEVI

SEQ ID NO: 2364761 - protein, 6 aa, Entamoeba dispar
GNPPLR

SEQ ID NO: 2364762 - protein, 7 aa, Entamoeba dispar
GNPPYYD

SEQ ID NO: 2364763 - protein, 26 aa, Entamoeba dispar
GNQCSQCSATKCERCDDGTPLQKDGT

SEQ ID NO: 2364764 - protein, 15 aa, Entamoeba dispar
GNQTPPVNSNKQALQ

SEQ ID NO: 2364765 - protein, 5 aa, Entamoeba dispar
GNRID

SEQ ID NO: 2364766 - protein, 8 aa, Entamoeba dispar
GNRPKIPD

SEQ ID NO: 2364767 - protein, 7 aa, Entamoeba dispar
GNRPQTI

SEQ ID NO: 2364768 - protein, 5 aa, Entamoeba dispar
GNRTN

SEQ ID NO: 2364769 - protein, 5 aa, Entamoeba dispar
GNSEM

SEQ ID NO: 2364770 - protein, 7 aa, Entamoeba dispar
GNSGDEQ

SEQ ID NO: 2364771 - protein, 6 aa, Entamoeba dispar
GNSGKH

SEQ ID NO: 2364772 - protein, 12 aa, Entamoeba dispar
GNSIRYAKDGCS

SEQ ID NO: 2364773 - protein, 9 aa, Entamoeba dispar
GNSNKDNSL

SEQ ID NO: 2364774 - protein, 10 aa, Entamoeba dispar
GNSPTRITGD

SEQ ID NO: 2364775 - protein, 11 aa, Entamoeba dispar
GNSPTRITGDA

SEQ ID NO: 2364776 - protein, 5 aa, Entamoeba dispar
GNSQD

SEQ ID NO: 2364777 - protein, 8 aa, Entamoeba dispar
GNSSHTKC

SEQ ID NO: 2364778 - protein, 10 aa, Entamoeba dispar
GNSYDFQEQE

SEQ ID NO: 2364779 - protein, 12 aa, Entamoeba dispar
GNTEDVKEALEQ

SEQ ID NO: 2364780 - protein, 5 aa, Entamoeba dispar
GNTIS

SEQ ID NO: 2364781 - protein, 6 aa, Entamoeba dispar
GNTKMT

SEQ ID NO: 2364782 - protein, 5 aa, Entamoeba dispar
GNTKS

SEQ ID NO: 2364783 - protein, 14 aa, Entamoeba dispar
GNTLKSSRRTHTSQ

SEQ ID NO: 2364784 - protein, 4 aa, Entamoeba dispar
GNTR

SEQ ID NO: 2364785 - protein, 7 aa, Entamoeba dispar
GNTSSAS

SEQ ID NO: 2364786 - protein, 7 aa, Entamoeba dispar
GNTSSSS

SEQ ID NO: 2364787 - protein, 8 aa, Entamoeba dispar
GNTSSSSV

SEQ ID NO: 2364788 - protein, 8 aa, Entamoeba dispar
GNTSTESL

SEQ ID NO: 2364789 - protein, 8 aa, Entamoeba dispar
GNTYEFQQ

SEQ ID NO: 2364790 - protein, 9 aa, Entamoeba dispar
GNTYQTGTT

SEQ ID NO: 2364791 - protein, 5 aa, Entamoeba dispar
GNVQS

SEQ ID NO: 2364792 - protein, 7 aa, Entamoeba dispar
GNWNPAK

SEQ ID NO: 2364793 - protein, 5 aa, Entamoeba dispar
GNWQS

SEQ ID NO: 2364794 - protein, 7 aa, Entamoeba dispar
GNYINKP

SEQ ID NO: 2364795 - protein, 4 aa, Entamoeba dispar
GNYN

SEQ ID NO: 2364796 - protein, 16 aa, Entamoeba dispar
GNYPGSTGRNARGSHS

SEQ ID NO: 2364797 - protein, 16 aa, Entamoeba dispar
GNYTGENRKKCNNETY

SEQ ID NO: 2364798 - protein, 5 aa, Entamoeba dispar
GNYTV

SEQ ID NO: 2364799 - protein, 4 aa, Entamoeba dispar
GNYY

SEQ ID NO: 2364800 - protein, 6 aa, Entamoeba dispar
GNYYGR

SEQ ID NO: 2364801 - protein, 4 aa, Entamoeba dispar
GPCP

SEQ ID NO: 2364802 - protein, 16 aa, Entamoeba dispar
GPDNQDDTTKPILLGM

SEQ ID NO: 2364803 - protein, 4 aa, Entamoeba dispar
GPDS

SEQ ID NO: 2364804 - protein, 6 aa, Entamoeba dispar
GPDTQI

SEQ ID NO: 2364805 - protein, 11 aa, Entamoeba dispar
GPEDQEDTNRA

SEQ ID NO: 2364806 - protein, 5 aa, Entamoeba dispar
GPETH

SEQ ID NO: 2364807 - protein, 13 aa, Entamoeba dispar
GPFESTENNSRTM

SEQ ID NO: 2364808 - protein, 4 aa, Entamoeba dispar
GPFG

SEQ ID NO: 2364809 - protein, 5 aa, Entamoeba dispar
GPFNK

SEQ ID NO: 2364810 - protein, 10 aa, Entamoeba dispar
GPGMTAEQER

SEQ ID NO: 2364811 - protein, 8 aa, Entamoeba dispar
GPGQMSAR

SEQ ID NO: 2364812 - protein, 4 aa, Entamoeba dispar
GPGT

SEQ ID NO: 2364813 - protein, 7 aa, Entamoeba dispar
GPGTGNL

SEQ ID NO: 2364814 - protein, 5 aa, Entamoeba dispar
GPIDL

SEQ ID NO: 2364815 - protein, 5 aa, Entamoeba dispar
GPIDS

SEQ ID NO: 2364816 - protein, 9 aa, Entamoeba dispar
GPIEGGTNV

SEQ ID NO: 2364817 - protein, 5 aa, Entamoeba dispar
GPING

SEQ ID NO: 2364818 - protein, 14 aa, Entamoeba dispar
GPKISEQNPDYQAE

SEQ ID NO: 2364819 - protein, 10 aa, Entamoeba dispar
GPKSNHINKQ

SEQ ID NO: 2364820 - protein, 6 aa, Entamoeba dispar
GPLADE

SEQ ID NO: 2364821 - protein, 6 aa, Entamoeba dispar
GPLPTL

SEQ ID NO: 2364822 - protein, 5 aa, Entamoeba dispar
GPLRE

SEQ ID NO: 2364823 - protein, 7 aa, Entamoeba dispar
GPNTTTY

SEQ ID NO: 2364824 - protein, 7 aa, Entamoeba dispar
GPPFATG

SEQ ID NO: 2364825 - protein, 9 aa, Entamoeba dispar
GPQNSGKST

SEQ ID NO: 2364826 - protein, 9 aa, Entamoeba dispar
GPQRTQLSP

SEQ ID NO: 2364827 - protein, 4 aa, Entamoeba dispar
GPRG

SEQ ID NO: 2364828 - protein, 8 aa, Entamoeba dispar
GPRKSGKS

SEQ ID NO: 2364829 - protein, 6 aa, Entamoeba dispar
GPRRSK

SEQ ID NO: 2364830 - protein, 13 aa, Entamoeba dispar
GPSADDEDPRDGL

SEQ ID NO: 2364831 - protein, 9 aa, Entamoeba dispar
GPSGCGKST

SEQ ID NO: 2364832 - protein, 5 aa, Entamoeba dispar
GPSGT

SEQ ID NO: 2364833 - protein, 5 aa, Entamoeba dispar
GPSIK

SEQ ID NO: 2364834 - protein, 4 aa, Entamoeba dispar
GPSK

SEQ ID NO: 2364835 - protein, 8 aa, Entamoeba dispar
GPSKNETI

SEQ ID NO: 2364836 - protein, 6 aa, Entamoeba dispar
GPSLKS

SEQ ID NO: 2364837 - protein, 6 aa, Entamoeba dispar
GPSQNP

SEQ ID NO: 2364838 - protein, 9 aa, Entamoeba dispar
GPSSCGKST

SEQ ID NO: 2364839 - protein, 4 aa, Entamoeba dispar
GPTF

SEQ ID NO: 2364840 - protein, 11 aa, Entamoeba dispar
GPTKREPKCAE

SEQ ID NO: 2364841 - protein, 5 aa, Entamoeba dispar
GPTLE

SEQ ID NO: 2364842 - protein, 5 aa, Entamoeba dispar
GPVGD

SEQ ID NO: 2364843 - protein, 5 aa, Entamoeba dispar
GQAYY

SEQ ID NO: 2364844 - protein, 4 aa, Entamoeba dispar
GQCE

SEQ ID NO: 2364845 - protein, 7 aa, Entamoeba dispar
GQDEIVP

SEQ ID NO: 2364846 - protein, 8 aa, Entamoeba dispar
GQDESPQH

SEQ ID NO: 2364847 - protein, 10 aa, Entamoeba dispar
GQDESSRSCG

SEQ ID NO: 2364848 - protein, 4 aa, Entamoeba dispar
GQDL

SEQ ID NO: 2364849 - protein, 12 aa, Entamoeba dispar
GQDLNKQKSAVE

SEQ ID NO: 2364850 - protein, 11 aa, Entamoeba dispar
GQDNSYTETRV

SEQ ID NO: 2364851 - protein, 14 aa, Entamoeba dispar
GQEYDRFSGANRAK

SEQ ID NO: 2364852 - protein, 12 aa, Entamoeba dispar
GQFEEYSNNQCT

SEQ ID NO: 2364853 - protein, 4 aa, Entamoeba dispar
GQFS

SEQ ID NO: 2364854 - protein, 4 aa, Entamoeba dispar
GQGC

SEQ ID NO: 2364855 - protein, 4 aa, Entamoeba dispar
GQGK

SEQ ID NO: 2364856 - protein, 6 aa, Entamoeba dispar
GQGKQD

SEQ ID NO: 2364857 - protein, 7 aa, Entamoeba dispar
GQGNDEY

SEQ ID NO: 2364858 - protein, 5 aa, Entamoeba dispar
GQGRM

SEQ ID NO: 2364859 - protein, 5 aa, Entamoeba dispar
GQGTF

SEQ ID NO: 2364860 - protein, 7 aa, Entamoeba dispar
GQKEQSL

SEQ ID NO: 2364861 - protein, 5 aa, Entamoeba dispar
GQKRW

SEQ ID NO: 2364862 - protein, 9 aa, Entamoeba dispar
GQKSDGTQL

SEQ ID NO: 2364863 - protein, 10 aa, Entamoeba dispar
GQKSSSGTAI

SEQ ID NO: 2364864 - protein, 4 aa, Entamoeba dispar
GQLG

SEQ ID NO: 2364865 - protein, 25 aa, Entamoeba dispar
GQLGPKDECAQGSDGCTETCRCDTE

SEQ ID NO: 2364866 - protein, 10 aa, Entamoeba dispar
GQLSDASSKG

SEQ ID NO: 2364867 - protein, 10 aa, Entamoeba dispar
GQLTETASAL

SEQ ID NO: 2364868 - protein, 6 aa, Entamoeba dispar
GQMPSN

SEQ ID NO: 2364869 - protein, 4 aa, Entamoeba dispar
GQNH

SEQ ID NO: 2364870 - protein, 7 aa, Entamoeba dispar
GQNKSNS

SEQ ID NO: 2364871 - protein, 8 aa, Entamoeba dispar
GQNQRAQN

SEQ ID NO: 2364872 - protein, 5 aa, Entamoeba dispar
GQPFE

SEQ ID NO: 2364873 - protein, 6 aa, Entamoeba dispar
GQPFTE

SEQ ID NO: 2364874 - protein, 16 aa, Entamoeba dispar
GQPQTFTEDNADNCKY

SEQ ID NO: 2364875 - protein, 10 aa, Entamoeba dispar
GQPTQPVQQQ

SEQ ID NO: 2364876 - protein, 7 aa, Entamoeba dispar
GQRDAFD

SEQ ID NO: 2364877 - protein, 5 aa, Entamoeba dispar
GQRLE

SEQ ID NO: 2364878 - protein, 15 aa, Entamoeba dispar
GQRVDPTTLVPKFIK

SEQ ID NO: 2364879 - protein, 6 aa, Entamoeba dispar
GQRVPS

SEQ ID NO: 2364880 - protein, 9 aa, Entamoeba dispar
GQSAGEIEE

SEQ ID NO: 2364881 - protein, 4 aa, Entamoeba dispar
GQSI

SEQ ID NO: 2364882 - protein, 17 aa, Entamoeba dispar
GQSPSSVVEGTELNTAE

SEQ ID NO: 2364883 - protein, 11 aa, Entamoeba dispar
GQTLLSGSSDF

SEQ ID NO: 2364884 - protein, 10 aa, Entamoeba dispar
GQTNDVASKG

SEQ ID NO: 2364885 - protein, 13 aa, Entamoeba dispar
GQTPYIPSIDTSK

SEQ ID NO: 2364886 - protein, 9 aa, Entamoeba dispar
GQTSTIIPR

SEQ ID NO: 2364887 - protein, 8 aa, Entamoeba dispar
GRADPRIT

SEQ ID NO: 2364888 - protein, 5 aa, Entamoeba dispar
GRCEC

SEQ ID NO: 2364889 - protein, 5 aa, Entamoeba dispar
GRDEE

SEQ ID NO: 2364890 - protein, 10 aa, Entamoeba dispar
GRDKISCEDN

SEQ ID NO: 2364891 - protein, 11 aa, Entamoeba dispar
GRDQSYADDDG

SEQ ID NO: 2364892 - protein, 5 aa, Entamoeba dispar
GREEE

SEQ ID NO: 2364893 - protein, 12 aa, Entamoeba dispar
GREENDYNNGHI

SEQ ID NO: 2364894 - protein, 6 aa, Entamoeba dispar
GRESSY

SEQ ID NO: 2364895 - protein, 13 aa, Entamoeba dispar
GRFNNNNENGKFD

SEQ ID NO: 2364896 - protein, 4 aa, Entamoeba dispar
GRGS

SEQ ID NO: 2364897 - protein, 4 aa, Entamoeba dispar
GRGY

SEQ ID NO: 2364898 - protein, 8 aa, Entamoeba dispar
GRIKPKES

SEQ ID NO: 2364899 - protein, 4 aa, Entamoeba dispar
GRIR

SEQ ID NO: 2364900 - protein, 4 aa, Entamoeba dispar
GRIV

SEQ ID NO: 2364901 - protein, 6 aa, Entamoeba dispar
GRIVGT

SEQ ID NO: 2364902 - protein, 8 aa, Entamoeba dispar
GRKGSLNV

SEQ ID NO: 2364903 - protein, 9 aa, Entamoeba dispar
GRKKGTQNH

SEQ ID NO: 2364904 - protein, 4 aa, Entamoeba dispar
GRLN

SEQ ID NO: 2364905 - protein, 17 aa, Entamoeba dispar
GRPFDKSFTTAAPYSKN

SEQ ID NO: 2364906 - protein, 6 aa, Entamoeba dispar
GRPRPN

SEQ ID NO: 2364907 - protein, 7 aa, Entamoeba dispar
GRRIEQE

SEQ ID NO: 2364908 - protein, 8 aa, Entamoeba dispar
GRSARDKK

SEQ ID NO: 2364909 - protein, 7 aa, Entamoeba dispar
GRSETLS

SEQ ID NO: 2364910 - protein, 6 aa, Entamoeba dispar
GRSNER

SEQ ID NO: 2364911 - protein, 25 aa, Entamoeba dispar
GRSPNLQTSQTGFQRGTRRGDENKD

SEQ ID NO: 2364912 - protein, 5 aa, Entamoeba dispar
GRSPR

SEQ ID NO: 2364913 - protein, 7 aa, Entamoeba dispar
GRSRTTH

SEQ ID NO: 2364914 - protein, 11 aa, Entamoeba dispar
GRSSGKPKTYF

SEQ ID NO: 2364915 - protein, 12 aa, Entamoeba dispar
GRSSTLKTSASL

SEQ ID NO: 2364916 - protein, 9 aa, Entamoeba dispar
GRTGAGKSS

SEQ ID NO: 2364917 - protein, 12 aa, Entamoeba dispar
GRYEKSITENTL

SEQ ID NO: 2364918 - protein, 7 aa, Entamoeba dispar
GRYGASN

SEQ ID NO: 2364919 - protein, 15 aa, Entamoeba dispar
GSAFAGNSSVINGES

SEQ ID NO: 2364920 - protein, 17 aa, Entamoeba dispar
GSAFGEKAQENKTECGE

SEQ ID NO: 2364921 - protein, 8 aa, Entamoeba dispar
GSAGSSIT

SEQ ID NO: 2364922 - protein, 7 aa, Entamoeba dispar
GSANGIA

SEQ ID NO: 2364923 - protein, 7 aa, Entamoeba dispar
GSAPAYE

SEQ ID NO: 2364924 - protein, 9 aa, Entamoeba dispar
GSATTGKVD

SEQ ID NO: 2364925 - protein, 6 aa, Entamoeba dispar
GSAYGG

SEQ ID NO: 2364926 - protein, 7 aa, Entamoeba dispar
GSCNKDE

SEQ ID NO: 2364927 - protein, 10 aa, Entamoeba dispar
GSCQQITTPT

SEQ ID NO: 2364928 - protein, 8 aa, Entamoeba dispar
GSDDYSSN

SEQ ID NO: 2364929 - protein, 5 aa, Entamoeba dispar
GSDGF

SEQ ID NO: 2364930 - protein, 10 aa, Entamoeba dispar
GSDGSIREDD

SEQ ID NO: 2364931 - protein, 4 aa, Entamoeba dispar
GSDH

SEQ ID NO: 2364932 - protein, 27 aa, Entamoeba dispar
GSDINQIQQQPKEEINIKPSENTEKYD

SEQ ID NO: 2364933 - protein, 14 aa, Entamoeba dispar
GSDPTGLTRGNDIG

SEQ ID NO: 2364934 - protein, 5 aa, Entamoeba dispar
GSDTG

SEQ ID NO: 2364935 - protein, 6 aa, Entamoeba dispar
GSDTIR

SEQ ID NO: 2364936 - protein, 7 aa, Entamoeba dispar
GSDVYSS

SEQ ID NO: 2364937 - protein, 8 aa, Entamoeba dispar
GSDYGTPV

SEQ ID NO: 2364938 - protein, 9 aa, Entamoeba dispar
GSEDKNCDG

SEQ ID NO: 2364939 - protein, 13 aa, Entamoeba dispar
GSEFDAETAFDRN

SEQ ID NO: 2364940 - protein, 9 aa, Entamoeba dispar
GSEGSKCTS

SEQ ID NO: 2364941 - protein, 8 aa, Entamoeba dispar
GSEIDTSL

SEQ ID NO: 2364942 - protein, 5 aa, Entamoeba dispar
GSELR

SEQ ID NO: 2364943 - protein, 7 aa, Entamoeba dispar
GSEQTLD

SEQ ID NO: 2364944 - protein, 4 aa, Entamoeba dispar
GSES

SEQ ID NO: 2364945 - protein, 5 aa, Entamoeba dispar
GSEST

SEQ ID NO: 2364946 - protein, 5 aa, Entamoeba dispar
GSETK

SEQ ID NO: 2364947 - protein, 6 aa, Entamoeba dispar
GSEWSN

SEQ ID NO: 2364948 - protein, 13 aa, Entamoeba dispar
GSFEDSDSEEDNY

SEQ ID NO: 2364949 - protein, 5 aa, Entamoeba dispar
GSFGY

SEQ ID NO: 2364950 - protein, 6 aa, Entamoeba dispar
GSFSNT

SEQ ID NO: 2364951 - protein, 7 aa, Entamoeba dispar
GSGAAHS

SEQ ID NO: 2364952 - protein, 9 aa, Entamoeba dispar
GSGASSLEE

SEQ ID NO: 2364953 - protein, 7 aa, Entamoeba dispar
GSGFDDA

SEQ ID NO: 2364954 - protein, 11 aa, Entamoeba dispar
GSGGFGLKTSE

SEQ ID NO: 2364955 - protein, 4 aa, Entamoeba dispar
GSGI

SEQ ID NO: 2364956 - protein, 5 aa, Entamoeba dispar
GSGKS

SEQ ID NO: 2364957 - protein, 8 aa, Entamoeba dispar
GSGNIKNC

SEQ ID NO: 2364958 - protein, 6 aa, Entamoeba dispar
GSGPLT

SEQ ID NO: 2364959 - protein, 6 aa, Entamoeba dispar
GSGPYT

SEQ ID NO: 2364960 - protein, 4 aa, Entamoeba dispar
GSGQ

SEQ ID NO: 2364961 - protein, 5 aa, Entamoeba dispar
GSGSC

SEQ ID NO: 2364962 - protein, 7 aa, Entamoeba dispar
GSGSYGD

SEQ ID NO: 2364963 - protein, 11 aa, Entamoeba dispar
GSGTDLTKQSA

SEQ ID NO: 2364964 - protein, 6 aa, Entamoeba dispar
GSGTIT

SEQ ID NO: 2364965 - protein, 22 aa, Entamoeba dispar
GSHVGTEERPANDSRTEHAILA

SEQ ID NO: 2364966 - protein, 5 aa, Entamoeba dispar
GSIET

SEQ ID NO: 2364967 - protein, 7 aa, Entamoeba dispar
GSINQEE

SEQ ID NO: 2364968 - protein, 4 aa, Entamoeba dispar
GSIP

SEQ ID NO: 2364969 - protein, 5 aa, Entamoeba dispar
GSISG

SEQ ID NO: 2364970 - protein, 7 aa, Entamoeba dispar
GSISLNG

SEQ ID NO: 2364971 - protein, 6 aa, Entamoeba dispar
GSITAR

SEQ ID NO: 2364972 - protein, 12 aa, Entamoeba dispar
GSITSESCSVEQ

SEQ ID NO: 2364973 - protein, 11 aa, Entamoeba dispar
GSKDSKIKIKQ

SEQ ID NO: 2364974 - protein, 15 aa, Entamoeba dispar
GSKESFKSIENKEEI

SEQ ID NO: 2364975 - protein, 7 aa, Entamoeba dispar
GSKFSGE

SEQ ID NO: 2364976 - protein, 7 aa, Entamoeba dispar
GSKGIDV

SEQ ID NO: 2364977 - protein, 6 aa, Entamoeba dispar
GSKKSW

SEQ ID NO: 2364978 - protein, 12 aa, Entamoeba dispar
GSKQAAQLNQQI

SEQ ID NO: 2364979 - protein, 10 aa, Entamoeba dispar
GSKSKSGALK

SEQ ID NO: 2364980 - protein, 6 aa, Entamoeba dispar
GSKTYV

SEQ ID NO: 2364981 - protein, 7 aa, Entamoeba dispar
GSLEEKK

SEQ ID NO: 2364982 - protein, 20 aa, Entamoeba dispar
GSLGRMPEKFGGEKQFEADE

SEQ ID NO: 2364983 - protein, 6 aa, Entamoeba dispar
GSLNPN

SEQ ID NO: 2364984 - protein, 8 aa, Entamoeba dispar
GSLPQTKG

SEQ ID NO: 2364985 - protein, 10 aa, Entamoeba dispar
GSLSKNLRVD

SEQ ID NO: 2364986 - protein, 7 aa, Entamoeba dispar
GSLTEEN

SEQ ID NO: 2364987 - protein, 12 aa, Entamoeba dispar
GSMGDVSEDIAD

SEQ ID NO: 2364988 - protein, 7 aa, Entamoeba dispar
GSNDEDL

SEQ ID NO: 2364989 - protein, 6 aa, Entamoeba dispar
GSNDQI

SEQ ID NO: 2364990 - protein, 7 aa, Entamoeba dispar
GSNGKEY

SEQ ID NO: 2364991 - protein, 6 aa, Entamoeba dispar
GSNIDL

SEQ ID NO: 2364992 - protein, 14 aa, Entamoeba dispar
GSNKFNKYHKRSST

SEQ ID NO: 2364993 - protein, 13 aa, Entamoeba dispar
GSNKTGPSKENNY

SEQ ID NO: 2364994 - protein, 7 aa, Entamoeba dispar
GSNLDTS

SEQ ID NO: 2364995 - protein, 9 aa, Entamoeba dispar
GSNLNRPGI

SEQ ID NO: 2364996 - protein, 5 aa, Entamoeba dispar
GSNNR

SEQ ID NO: 2364997 - protein, 6 aa, Entamoeba dispar
GSNQLR

SEQ ID NO: 2364998 - protein, 4 aa, Entamoeba dispar
GSNS

SEQ ID NO: 2364999 - protein, 16 aa, Entamoeba dispar
GSNSNGCGTLASYDAQ

SEQ ID NO: 2365000 - protein, 4 aa, Entamoeba dispar
GSNT

SEQ ID NO: 2365001 - protein, 5 aa, Entamoeba dispar
GSNTN

SEQ ID NO: 2365002 - protein, 16 aa, Entamoeba dispar
GSPDIPELGLQQVDHD

SEQ ID NO: 2365003 - protein, 9 aa, Entamoeba dispar
GSPDKTFQA

SEQ ID NO: 2365004 - protein, 4 aa, Entamoeba dispar
GSPF

SEQ ID NO: 2365005 - protein, 6 aa, Entamoeba dispar
GSPHAR

SEQ ID NO: 2365006 - protein, 10 aa, Entamoeba dispar
GSPIDSQETC

SEQ ID NO: 2365007 - protein, 15 aa, Entamoeba dispar
GSPKVTKDKSETYLT

SEQ ID NO: 2365008 - protein, 9 aa, Entamoeba dispar
GSPNCEDNC

SEQ ID NO: 2365009 - protein, 11 aa, Entamoeba dispar
GSQEGEKPTND

SEQ ID NO: 2365010 - protein, 8 aa, Entamoeba dispar
GSQEHDNY

SEQ ID NO: 2365011 - protein, 5 aa, Entamoeba dispar
GSQLD

SEQ ID NO: 2365012 - protein, 7 aa, Entamoeba dispar
GSQTTPD

SEQ ID NO: 2365013 - protein, 5 aa, Entamoeba dispar
GSRQI

SEQ ID NO: 2365014 - protein, 4 aa, Entamoeba dispar
GSSD

SEQ ID NO: 2365015 - protein, 4 aa, Entamoeba dispar
GSSG

SEQ ID NO: 2365016 - protein, 11 aa, Entamoeba dispar
GSSISDYSKQK

SEQ ID NO: 2365017 - protein, 12 aa, Entamoeba dispar
GSSKKPSNYPDE

SEQ ID NO: 2365018 - protein, 8 aa, Entamoeba dispar
GSSLQSSK

SEQ ID NO: 2365019 - protein, 18 aa, Entamoeba dispar
GSSSGTSYQPTVSDDKTE

SEQ ID NO: 2365020 - protein, 7 aa, Entamoeba dispar
GSSSNYN

SEQ ID NO: 2365021 - protein, 8 aa, Entamoeba dispar
GSSSTQED

SEQ ID NO: 2365022 - protein, 13 aa, Entamoeba dispar
GSSTDLTKEGSHM

SEQ ID NO: 2365023 - protein, 10 aa, Entamoeba dispar
GSSYSQCSSP

SEQ ID NO: 2365024 - protein, 5 aa, Entamoeba dispar
GSTAK

SEQ ID NO: 2365025 - protein, 9 aa, Entamoeba dispar
GSTKSTANL

SEQ ID NO: 2365026 - protein, 4 aa, Entamoeba dispar
GSTQ

SEQ ID NO: 2365027 - protein, 8 aa, Entamoeba dispar
GSTSQGLD

SEQ ID NO: 2365028 - protein, 12 aa, Entamoeba dispar
GSTSSEKEIARQ

SEQ ID NO: 2365029 - protein, 5 aa, Entamoeba dispar
GSTVT

SEQ ID NO: 2365030 - protein, 5 aa, Entamoeba dispar
GSVGS

SEQ ID NO: 2365031 - protein, 6 aa, Entamoeba dispar
GSVKER

SEQ ID NO: 2365032 - protein, 11 aa, Entamoeba dispar
GSVPQNKRTEI

SEQ ID NO: 2365033 - protein, 6 aa, Entamoeba dispar
GSVPVD

SEQ ID NO: 2365034 - protein, 13 aa, Entamoeba dispar
GSVQRSDDTSPID

SEQ ID NO: 2365035 - protein, 7 aa, Entamoeba dispar
GSYKGHP

SEQ ID NO: 2365036 - protein, 10 aa, Entamoeba dispar
GSYLNTQTNK

SEQ ID NO: 2365037 - protein, 10 aa, Entamoeba dispar
GSYQSEQKQK

SEQ ID NO: 2365038 - protein, 7 aa, Entamoeba dispar
GSYTDCS

SEQ ID NO: 2365039 - protein, 8 aa, Entamoeba dispar
GTANGRKV

SEQ ID NO: 2365040 - protein, 7 aa, Entamoeba dispar
GTCSEYQ

SEQ ID NO: 2365041 - protein, 13 aa, Entamoeba dispar
GTCTSDMTTVDSQ

SEQ ID NO: 2365042 - protein, 13 aa, Entamoeba dispar
GTDESPDKNQSKN

SEQ ID NO: 2365043 - protein, 7 aa, Entamoeba dispar
GTDKTGV

SEQ ID NO: 2365044 - protein, 7 aa, Entamoeba dispar
GTDNKEY

SEQ ID NO: 2365045 - protein, 6 aa, Entamoeba dispar
GTDNSN

SEQ ID NO: 2365046 - protein, 9 aa, Entamoeba dispar
GTDPTGLER

SEQ ID NO: 2365047 - protein, 18 aa, Entamoeba dispar
GTDQGLPSFGISPPGTFL

SEQ ID NO: 2365048 - protein, 4 aa, Entamoeba dispar
GTDS

SEQ ID NO: 2365049 - protein, 6 aa, Entamoeba dispar
GTDSAF

SEQ ID NO: 2365050 - protein, 8 aa, Entamoeba dispar
GTDVAKQA

SEQ ID NO: 2365051 - protein, 16 aa, Entamoeba dispar
GTDWGDKGTAKLSTDS

SEQ ID NO: 2365052 - protein, 18 aa, Entamoeba dispar
GTEENKKFVESGEKESNE

SEQ ID NO: 2365053 - protein, 4 aa, Entamoeba dispar
GTEI

SEQ ID NO: 2365054 - protein, 7 aa, Entamoeba dispar
GTEIPKD

SEQ ID NO: 2365055 - protein, 9 aa, Entamoeba dispar
GTEKPTDSL

SEQ ID NO: 2365056 - protein, 9 aa, Entamoeba dispar
GTEKPTPSL

SEQ ID NO: 2365057 - protein, 5 aa, Entamoeba dispar
GTELD

SEQ ID NO: 2365058 - protein, 4 aa, Entamoeba dispar
GTFG

SEQ ID NO: 2365059 - protein, 11 aa, Entamoeba dispar
GTFINNGNNIK

SEQ ID NO: 2365060 - protein, 12 aa, Entamoeba dispar
GTFSSDKYQTVD

SEQ ID NO: 2365061 - protein, 9 aa, Entamoeba dispar
GTFSTNSGS

SEQ ID NO: 2365062 - protein, 7 aa, Entamoeba dispar
GTGATPS

SEQ ID NO: 2365063 - protein, 10 aa, Entamoeba dispar
GTGDGKSSLG

SEQ ID NO: 2365064 - protein, 8 aa, Entamoeba dispar
GTGHTLPE

SEQ ID NO: 2365065 - protein, 47 aa, Entamoeba dispar
GTGKGQGMTTKGRSTKGTTHDHRSKKSKKGLSKGGPSKGSGSLSNQD

SEQ ID NO: 2365066 - protein, 4 aa, Entamoeba dispar
GTGM

SEQ ID NO: 2365067 - protein, 5 aa, Entamoeba dispar
GTGQP

SEQ ID NO: 2365068 - protein, 5 aa, Entamoeba dispar
GTGSE

SEQ ID NO: 2365069 - protein, 9 aa, Entamoeba dispar
GTGSFEKEQ

SEQ ID NO: 2365070 - protein, 7 aa, Entamoeba dispar
GTGTGVS

SEQ ID NO: 2365071 - protein, 4 aa, Entamoeba dispar
GTGV

SEQ ID NO: 2365072 - protein, 5 aa, Entamoeba dispar
GTHAT

SEQ ID NO: 2365073 - protein, 6 aa, Entamoeba dispar
GTHEEK

SEQ ID NO: 2365074 - protein, 8 aa, Entamoeba dispar
GTIAPGTQ

SEQ ID NO: 2365075 - protein, 11 aa, Entamoeba dispar
GTIESEESHYN

SEQ ID NO: 2365076 - protein, 8 aa, Entamoeba dispar
GTIKTPVE

SEQ ID NO: 2365077 - protein, 15 aa, Entamoeba dispar
GTINKVTSTTSNDKC

SEQ ID NO: 2365078 - protein, 5 aa, Entamoeba dispar
GTIQP

SEQ ID NO: 2365079 - protein, 8 aa, Entamoeba dispar
GTIRPKES

SEQ ID NO: 2365080 - protein, 9 aa, Entamoeba dispar
GTKEKQPIQ

SEQ ID NO: 2365081 - protein, 5 aa, Entamoeba dispar
GTKQY

SEQ ID NO: 2365082 - protein, 5 aa, Entamoeba dispar
GTKRM

SEQ ID NO: 2365083 - protein, 8 aa, Entamoeba dispar
GTKTNCTT

SEQ ID NO: 2365084 - protein, 7 aa, Entamoeba dispar
GTNCPHP

SEQ ID NO: 2365085 - protein, 13 aa, Entamoeba dispar
GTNECPQTNGVNY

SEQ ID NO: 2365086 - protein, 8 aa, Entamoeba dispar
GTNETTKT

SEQ ID NO: 2365087 - protein, 5 aa, Entamoeba dispar
GTNGS

SEQ ID NO: 2365088 - protein, 6 aa, Entamoeba dispar
GTNNCQ

SEQ ID NO: 2365089 - protein, 10 aa, Entamoeba dispar
GTNNINNEIT

SEQ ID NO: 2365090 - protein, 7 aa, Entamoeba dispar
GTNSDVN

SEQ ID NO: 2365091 - protein, 5 aa, Entamoeba dispar
GTNSQ

SEQ ID NO: 2365092 - protein, 12 aa, Entamoeba dispar
GTNSSKKACGTF

SEQ ID NO: 2365093 - protein, 13 aa, Entamoeba dispar
GTNSSQSITNGSI

SEQ ID NO: 2365094 - protein, 11 aa, Entamoeba dispar
GTNTNTKEFKE

SEQ ID NO: 2365095 - protein, 9 aa, Entamoeba dispar
GTNYSSGNL

SEQ ID NO: 2365096 - protein, 16 aa, Entamoeba dispar
GTPATDSSKSNYNSVK

SEQ ID NO: 2365097 - protein, 34 aa, Entamoeba dispar
GTPDDESCDRKGYGTKTCYKRDESQYYYESESSS

SEQ ID NO: 2365098 - protein, 34 aa, Entamoeba dispar
GTPGDESCDRKGYGTKTCYKRDESQYYYESESSS

SEQ ID NO: 2365099 - protein, 9 aa, Entamoeba dispar
GTPNPSWAS

SEQ ID NO: 2365100 - protein, 9 aa, Entamoeba dispar
GTPPSQPTL

SEQ ID NO: 2365101 - protein, 19 aa, Entamoeba dispar
GTPTLGSSTIVPPNEESVM

SEQ ID NO: 2365102 - protein, 4 aa, Entamoeba dispar
GTPV

SEQ ID NO: 2365103 - protein, 4 aa, Entamoeba dispar
GTQR

SEQ ID NO: 2365104 - protein, 10 aa, Entamoeba dispar
GTRAKPEKIV

SEQ ID NO: 2365105 - protein, 5 aa, Entamoeba dispar
GTRNE

SEQ ID NO: 2365106 - protein, 4 aa, Entamoeba dispar
GTRS

SEQ ID NO: 2365107 - protein, 4 aa, Entamoeba dispar
GTSC

SEQ ID NO: 2365108 - protein, 4 aa, Entamoeba dispar
GTSK

SEQ ID NO: 2365109 - protein, 8 aa, Entamoeba dispar
GTSKYAKA

SEQ ID NO: 2365110 - protein, 8 aa, Entamoeba dispar
GTSLAGRT

SEQ ID NO: 2365111 - protein, 5 aa, Entamoeba dispar
GTSQA

SEQ ID NO: 2365112 - protein, 22 aa, Entamoeba dispar
GTSRFTKKNNKNSEDKGLGTPI

SEQ ID NO: 2365113 - protein, 21 aa, Entamoeba dispar
GTSRFTKKNNTNSDDKGLGTP

SEQ ID NO: 2365114 - protein, 20 aa, Entamoeba dispar
GTSRFTKKTNKLTDKGLGTP

SEQ ID NO: 2365115 - protein, 16 aa, Entamoeba dispar
GTSRIKKTQKEQRGLN

SEQ ID NO: 2365116 - protein, 22 aa, Entamoeba dispar
GTSRITEKNKIDGNDNKGLGTP

SEQ ID NO: 2365117 - protein, 6 aa, Entamoeba dispar
GTSSNI

SEQ ID NO: 2365118 - protein, 5 aa, Entamoeba dispar
GTSTN

SEQ ID NO: 2365119 - protein, 6 aa, Entamoeba dispar
GTSTNM

SEQ ID NO: 2365120 - protein, 13 aa, Entamoeba dispar
GTSYCSSTKRTDN

SEQ ID NO: 2365121 - protein, 8 aa, Entamoeba dispar
GTSYKTPI

SEQ ID NO: 2365122 - protein, 7 aa, Entamoeba dispar
GTSYRQY

SEQ ID NO: 2365123 - protein, 7 aa, Entamoeba dispar
GTTASDV

SEQ ID NO: 2365124 - protein, 7 aa, Entamoeba dispar
GTTCKKC

SEQ ID NO: 2365125 - protein, 8 aa, Entamoeba dispar
GTTDGKEI

SEQ ID NO: 2365126 - protein, 6 aa, Entamoeba dispar
GTTEIE

SEQ ID NO: 2365127 - protein, 6 aa, Entamoeba dispar
GTTFPT

SEQ ID NO: 2365128 - protein, 4 aa, Entamoeba dispar
GTTG

SEQ ID NO: 2365129 - protein, 7 aa, Entamoeba dispar
GTTGNGV

SEQ ID NO: 2365130 - protein, 5 aa, Entamoeba dispar
GTTKC

SEQ ID NO: 2365131 - protein, 4 aa, Entamoeba dispar
GTTN

SEQ ID NO: 2365132 - protein, 12 aa, Entamoeba dispar
GTTNNSVVIFEN

SEQ ID NO: 2365133 - protein, 4 aa, Entamoeba dispar
GTTQ

SEQ ID NO: 2365134 - protein, 6 aa, Entamoeba dispar
GTTSDL

SEQ ID NO: 2365135 - protein, 14 aa, Entamoeba dispar
GTTSYKIGDNESIS

SEQ ID NO: 2365136 - protein, 7 aa, Entamoeba dispar
GTTTSPG

SEQ ID NO: 2365137 - protein, 26 aa, Entamoeba dispar
GTVDIQDKGRMGMGKNAASWSRSVNK

SEQ ID NO: 2365138 - protein, 10 aa, Entamoeba dispar
GTVDSRPSFK

SEQ ID NO: 2365139 - protein, 4 aa, Entamoeba dispar
GTVG

SEQ ID NO: 2365140 - protein, 16 aa, Entamoeba dispar
GTVGKEAGIGHEARNS

SEQ ID NO: 2365141 - protein, 8 aa, Entamoeba dispar
GTVHPSES

SEQ ID NO: 2365142 - protein, 5 aa, Entamoeba dispar
GTYDY

SEQ ID NO: 2365143 - protein, 5 aa, Entamoeba dispar
GTYEG

SEQ ID NO: 2365144 - protein, 4 aa, Entamoeba dispar
GTYP

SEQ ID NO: 2365145 - protein, 12 aa, Entamoeba dispar
GTYQNETGSTYC

SEQ ID NO: 2365146 - protein, 6 aa, Entamoeba dispar
GTYQNI

SEQ ID NO: 2365147 - protein, 12 aa, Entamoeba dispar
GTYQRDDNNEDH

SEQ ID NO: 2365148 - protein, 9 aa, Entamoeba dispar
GTYSEKYKG

SEQ ID NO: 2365149 - protein, 6 aa, Entamoeba dispar
GTYSST

SEQ ID NO: 2365150 - protein, 10 aa, Entamoeba dispar
GVAENNRCTG

SEQ ID NO: 2365151 - protein, 5 aa, Entamoeba dispar
GVDGD

SEQ ID NO: 2365152 - protein, 9 aa, Entamoeba dispar
GVDGKTTTE

SEQ ID NO: 2365153 - protein, 9 aa, Entamoeba dispar
GVDGNPQEF

SEQ ID NO: 2365154 - protein, 7 aa, Entamoeba dispar
GVDSSEV

SEQ ID NO: 2365155 - protein, 8 aa, Entamoeba dispar
GVEEDDQI

SEQ ID NO: 2365156 - protein, 10 aa, Entamoeba dispar
GVEKGVGSLS

SEQ ID NO: 2365157 - protein, 6 aa, Entamoeba dispar
GVEQES

SEQ ID NO: 2365158 - protein, 4 aa, Entamoeba dispar
GVET

SEQ ID NO: 2365159 - protein, 5 aa, Entamoeba dispar
GVIAR

SEQ ID NO: 2365160 - protein, 8 aa, Entamoeba dispar
GVKNSDVQ

SEQ ID NO: 2365161 - protein, 6 aa, Entamoeba dispar
GVNEDD

SEQ ID NO: 2365162 - protein, 7 aa, Entamoeba dispar
GVNENEN

SEQ ID NO: 2365163 - protein, 6 aa, Entamoeba dispar
GVNESH

SEQ ID NO: 2365164 - protein, 6 aa, Entamoeba dispar
GVNPEG

SEQ ID NO: 2365165 - protein, 14 aa, Entamoeba dispar
GVNPSLNENNYYNH

SEQ ID NO: 2365166 - protein, 6 aa, Entamoeba dispar
GVNPST

SEQ ID NO: 2365167 - protein, 4 aa, Entamoeba dispar
GVNR

SEQ ID NO: 2365168 - protein, 18 aa, Entamoeba dispar
GVPDSWRSVNGSVVVPED

SEQ ID NO: 2365169 - protein, 9 aa, Entamoeba dispar
GVPKNSSKG

SEQ ID NO: 2365170 - protein, 13 aa, Entamoeba dispar
GVQNQKVDKHTKV

SEQ ID NO: 2365171 - protein, 5 aa, Entamoeba dispar
GVQSD

SEQ ID NO: 2365172 - protein, 7 aa, Entamoeba dispar
GVRGTQG

SEQ ID NO: 2365173 - protein, 6 aa, Entamoeba dispar
GVRTPK

SEQ ID NO: 2365174 - protein, 5 aa, Entamoeba dispar
GVSMD

SEQ ID NO: 2365175 - protein, 9 aa, Entamoeba dispar
GVSNNTETC

SEQ ID NO: 2365176 - protein, 4 aa, Entamoeba dispar
GVSP

SEQ ID NO: 2365177 - protein, 32 aa, Entamoeba dispar
GVSPEPKKDKNSKSKEKFSQSIEEKEKQEYNQ

SEQ ID NO: 2365178 - protein, 5 aa, Entamoeba dispar
GVSSY

SEQ ID NO: 2365179 - protein, 4 aa, Entamoeba dispar
GVSV

SEQ ID NO: 2365180 - protein, 11 aa, Entamoeba dispar
GVTDSKAFKQE

SEQ ID NO: 2365181 - protein, 8 aa, Entamoeba dispar
GVTNGQCE

SEQ ID NO: 2365182 - protein, 11 aa, Entamoeba dispar
GVTQKGYNTIA

SEQ ID NO: 2365183 - protein, 15 aa, Entamoeba dispar
GVTTQKCRGGTCTSC

SEQ ID NO: 2365184 - protein, 8 aa, Entamoeba dispar
GWGDGDNY

SEQ ID NO: 2365185 - protein, 11 aa, Entamoeba dispar
GWSRKSKFSFE

SEQ ID NO: 2365186 - protein, 7 aa, Entamoeba dispar
GWTEEER

SEQ ID NO: 2365187 - protein, 21 aa, Entamoeba dispar
GWTTAEVQPPKYSSFLLETEN

SEQ ID NO: 2365188 - protein, 19 aa, Entamoeba dispar
GYCTTQETPPLSTRKDGME

SEQ ID NO: 2365189 - protein, 11 aa, Entamoeba dispar
GYDDNDDSCEK

SEQ ID NO: 2365190 - protein, 12 aa, Entamoeba dispar
GYDKKYKENLRR

SEQ ID NO: 2365191 - protein, 6 aa, Entamoeba dispar
GYDTDS

SEQ ID NO: 2365192 - protein, 20 aa, Entamoeba dispar
GYDVSDCSEISSTVDALNKE

SEQ ID NO: 2365193 - protein, 13 aa, Entamoeba dispar
GYEPDPNQPGSCR

SEQ ID NO: 2365194 - protein, 12 aa, Entamoeba dispar
GYGNKNNKRGAI

SEQ ID NO: 2365195 - protein, 4 aa, Entamoeba dispar
GYGQ

SEQ ID NO: 2365196 - protein, 13 aa, Entamoeba dispar
GYHSSSNRCKPCS

SEQ ID NO: 2365197 - protein, 22 aa, Entamoeba dispar
GYIKEKGECQKNDNKCNKSERN

SEQ ID NO: 2365198 - protein, 12 aa, Entamoeba dispar
GYKCGANGKWSD

SEQ ID NO: 2365199 - protein, 12 aa, Entamoeba dispar
GYKGVGCDGGNI

SEQ ID NO: 2365200 - protein, 10 aa, Entamoeba dispar
GYKQYSPESK

SEQ ID NO: 2365201 - protein, 13 aa, Entamoeba dispar
GYKTDSSDKTRCI

SEQ ID NO: 2365202 - protein, 9 aa, Entamoeba dispar
GYKTTDSDS

SEQ ID NO: 2365203 - protein, 8 aa, Entamoeba dispar
GYNKDDRR

SEQ ID NO: 2365204 - protein, 4 aa, Entamoeba dispar
GYNQ

SEQ ID NO: 2365205 - protein, 10 aa, Entamoeba dispar
GYPNPSLPSC

SEQ ID NO: 2365206 - protein, 6 aa, Entamoeba dispar
GYQKGM

SEQ ID NO: 2365207 - protein, 4 aa, Entamoeba dispar
GYQL

SEQ ID NO: 2365208 - protein, 5 aa, Entamoeba dispar
GYQSN

SEQ ID NO: 2365209 - protein, 11 aa, Entamoeba dispar
GYRLNKDSSCE

SEQ ID NO: 2365210 - protein, 8 aa, Entamoeba dispar
GYRNVNGT

SEQ ID NO: 2365211 - protein, 12 aa, Entamoeba dispar
GYRPPLDKNETY

SEQ ID NO: 2365212 - protein, 9 aa, Entamoeba dispar
GYRSYGQKE

SEQ ID NO: 2365213 - protein, 5 aa, Entamoeba dispar
GYSDG

SEQ ID NO: 2365214 - protein, 6 aa, Entamoeba dispar
GYSEGV

SEQ ID NO: 2365215 - protein, 6 aa, Entamoeba dispar
GYSFGG

SEQ ID NO: 2365216 - protein, 4 aa, Entamoeba dispar
GYSG

SEQ ID NO: 2365217 - protein, 4 aa, Entamoeba dispar
GYSP

SEQ ID NO: 2365218 - protein, 5 aa, Entamoeba dispar
GYSPI

SEQ ID NO: 2365219 - protein, 5 aa, Entamoeba dispar
GYSPR

SEQ ID NO: 2365220 - protein, 5 aa, Entamoeba dispar
GYSRY

SEQ ID NO: 2365221 - protein, 13 aa, Entamoeba dispar
GYSYDKEKNVCNP

SEQ ID NO: 2365222 - protein, 5 aa, Entamoeba dispar
GYTAI

SEQ ID NO: 2365223 - protein, 9 aa, Entamoeba dispar
GYTANGNGT

SEQ ID NO: 2365224 - protein, 5 aa, Entamoeba dispar
GYTKD

SEQ ID NO: 2365225 - protein, 7 aa, Entamoeba dispar
GYTKNKN

SEQ ID NO: 2365226 - protein, 17 aa, Entamoeba dispar
GYTKSTSPCSLNTQQTG

SEQ ID NO: 2365227 - protein, 13 aa, Entamoeba dispar
GYTLSDDGCSKEI

SEQ ID NO: 2365228 - protein, 13 aa, Entamoeba dispar
GYTLSDDQCSKEI

SEQ ID NO: 2365229 - protein, 9 aa, Entamoeba dispar
GYTPNEKQT

SEQ ID NO: 2365230 - protein, 4 aa, Entamoeba dispar
GYYC

SEQ ID NO: 2365231 - protein, 15 aa, Entamoeba dispar
GYYKAEDGKNCNKCD

SEQ ID NO: 2365232 - protein, 5 aa, Entamoeba dispar
GYYKK

SEQ ID NO: 2365233 - protein, 8 aa, Entamoeba dispar
GYYKNSTD

SEQ ID NO: 2365234 - protein, 5 aa, Entamoeba dispar
GYYPN

SEQ ID NO: 2365235 - protein, 7 aa, Entamoeba dispar
GYYPNEG

SEQ ID NO: 2365236 - protein, 6 aa, Entamoeba dispar
GYYPNG

SEQ ID NO: 2365237 - protein, 12 aa, Entamoeba dispar
GYYPNGNGCEEC

SEQ ID NO: 2365238 - protein, 29 aa, Entamoeba dispar
GYYPNGNGCSTCSSKNCGDDCNTSDGTCT

SEQ ID NO: 2365239 - protein, 9 aa, Entamoeba dispar
GYYQNETRS

SEQ ID NO: 2365240 - protein, 5 aa, Entamoeba dispar
GYYRD

SEQ ID NO: 2365241 - protein, 8 aa, Entamoeba dispar
GYYSSGKG

SEQ ID NO: 2365242 - protein, 14 aa, Entamoeba dispar
HAGPCGPCTAGGKT

SEQ ID NO: 2365243 - protein, 16 aa, Entamoeba dispar
HAGSKVSVDNLYEETI

SEQ ID NO: 2365244 - protein, 4 aa, Entamoeba dispar
HAKT

SEQ ID NO: 2365245 - protein, 17 aa, Entamoeba dispar
HAQTNKSKEVQKEFPEG

SEQ ID NO: 2365246 - protein, 6 aa, Entamoeba dispar
HASSNT

SEQ ID NO: 2365247 - protein, 7 aa, Entamoeba dispar
HATNKKK

SEQ ID NO: 2365248 - protein, 8 aa, Entamoeba dispar
HATPSKTT

SEQ ID NO: 2365249 - protein, 10 aa, Entamoeba dispar
HCASQSEEFS

SEQ ID NO: 2365250 - protein, 10 aa, Entamoeba dispar
HCESSSNNVC

SEQ ID NO: 2365251 - protein, 5 aa, Entamoeba dispar
HCSPG

SEQ ID NO: 2365252 - protein, 5 aa, Entamoeba dispar
HCTQC

SEQ ID NO: 2365253 - protein, 9 aa, Entamoeba dispar
HDEKPIRKP

SEQ ID NO: 2365254 - protein, 6 aa, Entamoeba dispar
HDETPY

SEQ ID NO: 2365255 - protein, 4 aa, Entamoeba dispar
HDGY

SEQ ID NO: 2365256 - protein, 5 aa, Entamoeba dispar
HDNFD

SEQ ID NO: 2365257 - protein, 21 aa, Entamoeba dispar
HDNTCNEPDGIDVPNTELSGG

SEQ ID NO: 2365258 - protein, 8 aa, Entamoeba dispar
HDPKQRPV

SEQ ID NO: 2365259 - protein, 9 aa, Entamoeba dispar
HDPSEDPLL

SEQ ID NO: 2365260 - protein, 7 aa, Entamoeba dispar
HDPSFKY

SEQ ID NO: 2365261 - protein, 35 aa, Entamoeba dispar
HDPTDEKEESSEEENEESSEEENEEKEEEKEENKE

SEQ ID NO: 2365262 - protein, 4 aa, Entamoeba dispar
HDQN

SEQ ID NO: 2365263 - protein, 28 aa, Entamoeba dispar
HDQNHSYSTPTMAGSPQLDEYTKEELEK

SEQ ID NO: 2365264 - protein, 19 aa, Entamoeba dispar
HDQPRQVSRWGNDTKYRIE

SEQ ID NO: 2365265 - protein, 5 aa, Entamoeba dispar
HDSNS

SEQ ID NO: 2365266 - protein, 13 aa, Entamoeba dispar
HDSSDDCSSCEDG

SEQ ID NO: 2365267 - protein, 6 aa, Entamoeba dispar
HDTFTA

SEQ ID NO: 2365268 - protein, 13 aa, Entamoeba dispar
HDTKDAPSENDYS

SEQ ID NO: 2365269 - protein, 5 aa, Entamoeba dispar
HEASN

SEQ ID NO: 2365270 - protein, 4 aa, Entamoeba dispar
HEDD

SEQ ID NO: 2365271 - protein, 7 aa, Entamoeba dispar
HEEEDEK

SEQ ID NO: 2365272 - protein, 7 aa, Entamoeba dispar
HEEESFR

SEQ ID NO: 2365273 - protein, 30 aa, Entamoeba dispar
HEGDKIKGITYSKSTSCSGKSVSEILSKGS

SEQ ID NO: 2365274 - protein, 4 aa, Entamoeba dispar
HEGH

SEQ ID NO: 2365275 - protein, 10 aa, Entamoeba dispar
HEHTRPENAI

SEQ ID NO: 2365276 - protein, 6 aa, Entamoeba dispar
HEKKGI

SEQ ID NO: 2365277 - protein, 6 aa, Entamoeba dispar
HEKPED

SEQ ID NO: 2365278 - protein, 10 aa, Entamoeba dispar
HEKVNQKTLQ

SEQ ID NO: 2365279 - protein, 6 aa, Entamoeba dispar
HENFPT

SEQ ID NO: 2365280 - protein, 6 aa, Entamoeba dispar
HENGLK

SEQ ID NO: 2365281 - protein, 6 aa, Entamoeba dispar
HENNIP

SEQ ID NO: 2365282 - protein, 10 aa, Entamoeba dispar
HENYPGSPYT

SEQ ID NO: 2365283 - protein, 6 aa, Entamoeba dispar
HEPPKD

SEQ ID NO: 2365284 - protein, 4 aa, Entamoeba dispar
HEQD

SEQ ID NO: 2365285 - protein, 12 aa, Entamoeba dispar
HEQRIKDTNRGI

SEQ ID NO: 2365286 - protein, 10 aa, Entamoeba dispar
HERKTEPEEI

SEQ ID NO: 2365287 - protein, 5 aa, Entamoeba dispar
HERSI

SEQ ID NO: 2365288 - protein, 5 aa, Entamoeba dispar
HERTV

SEQ ID NO: 2365289 - protein, 5 aa, Entamoeba dispar
HETAI

SEQ ID NO: 2365290 - protein, 6 aa, Entamoeba dispar
HETCQN

SEQ ID NO: 2365291 - protein, 7 aa, Entamoeba dispar
HETDGDV

SEQ ID NO: 2365292 - protein, 7 aa, Entamoeba dispar
HETDGSI

SEQ ID NO: 2365293 - protein, 7 aa, Entamoeba dispar
HETGKKV

SEQ ID NO: 2365294 - protein, 9 aa, Entamoeba dispar
HETKVSGKV

SEQ ID NO: 2365295 - protein, 7 aa, Entamoeba dispar
HETRKKE

SEQ ID NO: 2365296 - protein, 11 aa, Entamoeba dispar
HEVSLGEEGLT

SEQ ID NO: 2365297 - protein, 10 aa, Entamoeba dispar
HFDGKTDDYF

SEQ ID NO: 2365298 - protein, 5 aa, Entamoeba dispar
HFDKN

SEQ ID NO: 2365299 - protein, 7 aa, Entamoeba dispar
HGDATLS

SEQ ID NO: 2365300 - protein, 9 aa, Entamoeba dispar
HGDEKQMEE

SEQ ID NO: 2365301 - protein, 13 aa, Entamoeba dispar
HGEYEYGDNGEWS

SEQ ID NO: 2365302 - protein, 4 aa, Entamoeba dispar
HGFE

SEQ ID NO: 2365303 - protein, 6 aa, Entamoeba dispar
HGGDQV

SEQ ID NO: 2365304 - protein, 16 aa, Entamoeba dispar
HGHGGYECGDKGEWST

SEQ ID NO: 2365305 - protein, 11 aa, Entamoeba dispar
HGHGKLSSKEK

SEQ ID NO: 2365306 - protein, 12 aa, Entamoeba dispar
HGHRNDVPEQKR

SEQ ID NO: 2365307 - protein, 14 aa, Entamoeba dispar
HGISENEVTENSTR

SEQ ID NO: 2365308 - protein, 7 aa, Entamoeba dispar
HGNIRPE

SEQ ID NO: 2365309 - protein, 4 aa, Entamoeba dispar
HGNL

SEQ ID NO: 2365310 - protein, 4 aa, Entamoeba dispar
HGNQ

SEQ ID NO: 2365311 - protein, 9 aa, Entamoeba dispar
HGNQFGKSA

SEQ ID NO: 2365312 - protein, 7 aa, Entamoeba dispar
HGRCTEN

SEQ ID NO: 2365313 - protein, 11 aa, Entamoeba dispar
HGRSSGEPKGW

SEQ ID NO: 2365314 - protein, 4 aa, Entamoeba dispar
HGSD

SEQ ID NO: 2365315 - protein, 4 aa, Entamoeba dispar
HGTG

SEQ ID NO: 2365316 - protein, 4 aa, Entamoeba dispar
HGVY

SEQ ID NO: 2365317 - protein, 7 aa, Entamoeba dispar
HHESSNK

SEQ ID NO: 2365318 - protein, 9 aa, Entamoeba dispar
HHFKENNTS

SEQ ID NO: 2365319 - protein, 12 aa, Entamoeba dispar
HHKSSYNTLPEN

SEQ ID NO: 2365320 - protein, 9 aa, Entamoeba dispar
HHSCSSSSF

SEQ ID NO: 2365321 - protein, 13 aa, Entamoeba dispar
HHSHHQHTAADTF

SEQ ID NO: 2365322 - protein, 15 aa, Entamoeba dispar
HHSKDGDDDETPISK

SEQ ID NO: 2365323 - protein, 4 aa, Entamoeba dispar
HIPS

SEQ ID NO: 2365324 - protein, 6 aa, Entamoeba dispar
HISDNR

SEQ ID NO: 2365325 - protein, 13 aa, Entamoeba dispar
HISNSRTNSDTYI

SEQ ID NO: 2365326 - protein, 5 aa, Entamoeba dispar
HISPS

SEQ ID NO: 2365327 - protein, 13 aa, Entamoeba dispar
HISPSHPSRSIPY

SEQ ID NO: 2365328 - protein, 4 aa, Entamoeba dispar
HITD

SEQ ID NO: 2365329 - protein, 8 aa, Entamoeba dispar
HKDKNEPI

SEQ ID NO: 2365330 - protein, 7 aa, Entamoeba dispar
HKDKRNE

SEQ ID NO: 2365331 - protein, 16 aa, Entamoeba dispar
HKDTIDEELSYTDTQR

SEQ ID NO: 2365332 - protein, 9 aa, Entamoeba dispar
HKECSENGL

SEQ ID NO: 2365333 - protein, 10 aa, Entamoeba dispar
HKEESFHKTN

SEQ ID NO: 2365334 - protein, 12 aa, Entamoeba dispar
HKEFDKDVSNKR

SEQ ID NO: 2365335 - protein, 8 aa, Entamoeba dispar
HKEQRQKE

SEQ ID NO: 2365336 - protein, 4 aa, Entamoeba dispar
HKIT

SEQ ID NO: 2365337 - protein, 10 aa, Entamoeba dispar
HKITEGSSKS

SEQ ID NO: 2365338 - protein, 4 aa, Entamoeba dispar
HKKI

SEQ ID NO: 2365339 - protein, 12 aa, Entamoeba dispar
HKKNTTKSIKPF

SEQ ID NO: 2365340 - protein, 9 aa, Entamoeba dispar
HKKSIRRAT

SEQ ID NO: 2365341 - protein, 8 aa, Entamoeba dispar
HKLGEKSR

SEQ ID NO: 2365342 - protein, 12 aa, Entamoeba dispar
HKNEENKQMKRI

SEQ ID NO: 2365343 - protein, 8 aa, Entamoeba dispar
HKNKNEPI

SEQ ID NO: 2365344 - protein, 14 aa, Entamoeba dispar
HKNSLKNLNTEQKQ

SEQ ID NO: 2365345 - protein, 11 aa, Entamoeba dispar
HKPECADIPPR

SEQ ID NO: 2365346 - protein, 7 aa, Entamoeba dispar
HKSEKNI

SEQ ID NO: 2365347 - protein, 9 aa, Entamoeba dispar
HKSERSIGP

SEQ ID NO: 2365348 - protein, 7 aa, Entamoeba dispar
HKSKSAR

SEQ ID NO: 2365349 - protein, 4 aa, Entamoeba dispar
HKSL

SEQ ID NO: 2365350 - protein, 6 aa, Entamoeba dispar
HKSSNV

SEQ ID NO: 2365351 - protein, 6 aa, Entamoeba dispar
HKSTGS

SEQ ID NO: 2365352 - protein, 4 aa, Entamoeba dispar
HKTE

SEQ ID NO: 2365353 - protein, 8 aa, Entamoeba dispar
HKTVNSKQ

SEQ ID NO: 2365354 - protein, 4 aa, Entamoeba dispar
HKVK

SEQ ID NO: 2365355 - protein, 12 aa, Entamoeba dispar
HKVSQPSLDKGG

SEQ ID NO: 2365356 - protein, 10 aa, Entamoeba dispar
HKVSQPSTLN

SEQ ID NO: 2365357 - protein, 6 aa, Entamoeba dispar
HKVTQP

SEQ ID NO: 2365358 - protein, 7 aa, Entamoeba dispar
HKYKENE

SEQ ID NO: 2365359 - protein, 5 aa, Entamoeba dispar
HKYSD

SEQ ID NO: 2365360 - protein, 9 aa, Entamoeba dispar
HLDESNKTL

SEQ ID NO: 2365361 - protein, 8 aa, Entamoeba dispar
HLDSTGSY

SEQ ID NO: 2365362 - protein, 10 aa, Entamoeba dispar
HLGDSKMKEF

SEQ ID NO: 2365363 - protein, 6 aa, Entamoeba dispar
HLNSDS

SEQ ID NO: 2365364 - protein, 7 aa, Entamoeba dispar
HLPTSPD

SEQ ID NO: 2365365 - protein, 5 aa, Entamoeba dispar
HMETG

SEQ ID NO: 2365366 - protein, 6 aa, Entamoeba dispar
HNAPEY

SEQ ID NO: 2365367 - protein, 6 aa, Entamoeba dispar
HNDKTT

SEQ ID NO: 2365368 - protein, 5 aa, Entamoeba dispar
HNDNS

SEQ ID NO: 2365369 - protein, 27 aa, Entamoeba dispar
HNESNNQQETTYTELDEEKSESENRQS

SEQ ID NO: 2365370 - protein, 4 aa, Entamoeba dispar
HNET

SEQ ID NO: 2365371 - protein, 6 aa, Entamoeba dispar
HNGDGV

SEQ ID NO: 2365372 - protein, 4 aa, Entamoeba dispar
HNKK

SEQ ID NO: 2365373 - protein, 7 aa, Entamoeba dispar
HNKQEMT

SEQ ID NO: 2365374 - protein, 6 aa, Entamoeba dispar
HNLDEK

SEQ ID NO: 2365375 - protein, 8 aa, Entamoeba dispar
HNNAQGLR

SEQ ID NO: 2365376 - protein, 7 aa, Entamoeba dispar
HNNDREI

SEQ ID NO: 2365377 - protein, 4 aa, Entamoeba dispar
HNNP

SEQ ID NO: 2365378 - protein, 9 aa, Entamoeba dispar
HNPKLGDAS

SEQ ID NO: 2365379 - protein, 7 aa, Entamoeba dispar
HNRPPEK

SEQ ID NO: 2365380 - protein, 11 aa, Entamoeba dispar
HNRYGLPHQPT

SEQ ID NO: 2365381 - protein, 10 aa, Entamoeba dispar
HNSGEMTSRM

SEQ ID NO: 2365382 - protein, 17 aa, Entamoeba dispar
HNTGSIVAGGGDDTFKE

SEQ ID NO: 2365383 - protein, 4 aa, Entamoeba dispar
HNTY

SEQ ID NO: 2365384 - protein, 5 aa, Entamoeba dispar
HPDVG

SEQ ID NO: 2365385 - protein, 11 aa, Entamoeba dispar
HPEDERKQTSI

SEQ ID NO: 2365386 - protein, 10 aa, Entamoeba dispar
HPELDNGVDY

SEQ ID NO: 2365387 - protein, 26 aa, Entamoeba dispar
HPEQNQEHKVHQNQGPDDHDVVQTDK

SEQ ID NO: 2365388 - protein, 15 aa, Entamoeba dispar
HPEREELDENGIIVN

SEQ ID NO: 2365389 - protein, 7 aa, Entamoeba dispar
HPGETGE

SEQ ID NO: 2365390 - protein, 6 aa, Entamoeba dispar
HPHETR

SEQ ID NO: 2365391 - protein, 7 aa, Entamoeba dispar
HPHTSSS

SEQ ID NO: 2365392 - protein, 19 aa, Entamoeba dispar
HPINDENESVSKDSKSSSS

SEQ ID NO: 2365393 - protein, 5 aa, Entamoeba dispar
HPIQT

SEQ ID NO: 2365394 - protein, 8 aa, Entamoeba dispar
HPKDRERE

SEQ ID NO: 2365395 - protein, 10 aa, Entamoeba dispar
HPKRKKSFDY

SEQ ID NO: 2365396 - protein, 5 aa, Entamoeba dispar
HPMKQ

SEQ ID NO: 2365397 - protein, 13 aa, Entamoeba dispar
HPNAIPPTYIPTT

SEQ ID NO: 2365398 - protein, 4 aa, Entamoeba dispar
HPNP

SEQ ID NO: 2365399 - protein, 9 aa, Entamoeba dispar
HPNSVSDPM

SEQ ID NO: 2365400 - protein, 5 aa, Entamoeba dispar
HPNVD

SEQ ID NO: 2365401 - protein, 4 aa, Entamoeba dispar
HPPV

SEQ ID NO: 2365402 - protein, 6 aa, Entamoeba dispar
HPSDWA

SEQ ID NO: 2365403 - protein, 8 aa, Entamoeba dispar
HPSFKSDV

SEQ ID NO: 2365404 - protein, 18 aa, Entamoeba dispar
HPSGEKTVAEEMNYKSTE

SEQ ID NO: 2365405 - protein, 6 aa, Entamoeba dispar
HPSGKK

SEQ ID NO: 2365406 - protein, 6 aa, Entamoeba dispar
HPSIQP

SEQ ID NO: 2365407 - protein, 4 aa, Entamoeba dispar
HPSM

SEQ ID NO: 2365408 - protein, 5 aa, Entamoeba dispar
HPSTT

SEQ ID NO: 2365409 - protein, 7 aa, Entamoeba dispar
HPTGFEK

SEQ ID NO: 2365410 - protein, 13 aa, Entamoeba dispar
HPTKGERGIEPQY

SEQ ID NO: 2365411 - protein, 5 aa, Entamoeba dispar
HPTRQ

SEQ ID NO: 2365412 - protein, 5 aa, Entamoeba dispar
HPTSS

SEQ ID NO: 2365413 - protein, 7 aa, Entamoeba dispar
HPTSTTK

SEQ ID NO: 2365414 - protein, 25 aa, Entamoeba dispar
HPTTGTTSEKISRKQSLSKKDDESQ

SEQ ID NO: 2365415 - protein, 22 aa, Entamoeba dispar
HQDEFSAEGSINSRSESPTTPS

SEQ ID NO: 2365416 - protein, 10 aa, Entamoeba dispar
HQEDTELAEQ

SEQ ID NO: 2365417 - protein, 6 aa, Entamoeba dispar
HQEFEE

SEQ ID NO: 2365418 - protein, 7 aa, Entamoeba dispar
HQGEESA

SEQ ID NO: 2365419 - protein, 6 aa, Entamoeba dispar
HQKELD

SEQ ID NO: 2365420 - protein, 4 aa, Entamoeba dispar
HQLE

SEQ ID NO: 2365421 - protein, 4 aa, Entamoeba dispar
HQNA

SEQ ID NO: 2365422 - protein, 6 aa, Entamoeba dispar
HQPQEQ

SEQ ID NO: 2365423 - protein, 6 aa, Entamoeba dispar
HQRKPT

SEQ ID NO: 2365424 - protein, 6 aa, Entamoeba dispar
HQSKGD

SEQ ID NO: 2365425 - protein, 17 aa, Entamoeba dispar
HQTAELTPLSDCTKGRI

SEQ ID NO: 2365426 - protein, 5 aa, Entamoeba dispar
HQTTD

SEQ ID NO: 2365427 - protein, 8 aa, Entamoeba dispar
HQYTQTDH

SEQ ID NO: 2365428 - protein, 6 aa, Entamoeba dispar
HRCSPC

SEQ ID NO: 2365429 - protein, 8 aa, Entamoeba dispar
HRDPTTAS

SEQ ID NO: 2365430 - protein, 13 aa, Entamoeba dispar
HRGGRGIKPENTI

SEQ ID NO: 2365431 - protein, 5 aa, Entamoeba dispar
HRLEE

SEQ ID NO: 2365432 - protein, 4 aa, Entamoeba dispar
HRNL

SEQ ID NO: 2365433 - protein, 5 aa, Entamoeba dispar
HRNNS

SEQ ID NO: 2365434 - protein, 4 aa, Entamoeba dispar
HRNT

SEQ ID NO: 2365435 - protein, 7 aa, Entamoeba dispar
HRRNKSI

SEQ ID NO: 2365436 - protein, 7 aa, Entamoeba dispar
HRSGGNV

SEQ ID NO: 2365437 - protein, 9 aa, Entamoeba dispar
HRSSTETMT

SEQ ID NO: 2365438 - protein, 21 aa, Entamoeba dispar
HRTTTNLSSYTRRSAPTAKQF

SEQ ID NO: 2365439 - protein, 9 aa, Entamoeba dispar
HSASIPKQS

SEQ ID NO: 2365440 - protein, 4 aa, Entamoeba dispar
HSDD

SEQ ID NO: 2365441 - protein, 7 aa, Entamoeba dispar
HSDGSSW

SEQ ID NO: 2365442 - protein, 14 aa, Entamoeba dispar
HSEKEEEAKSEEEI

SEQ ID NO: 2365443 - protein, 5 aa, Entamoeba dispar
HSEVT

SEQ ID NO: 2365444 - protein, 7 aa, Entamoeba dispar
HSGGEDF

SEQ ID NO: 2365445 - protein, 5 aa, Entamoeba dispar
HSGPL

SEQ ID NO: 2365446 - protein, 7 aa, Entamoeba dispar
HSKDTFK

SEQ ID NO: 2365447 - protein, 18 aa, Entamoeba dispar
HSKGSRLKIGKNRNGSII

SEQ ID NO: 2365448 - protein, 5 aa, Entamoeba dispar
HSKQD

SEQ ID NO: 2365449 - protein, 4 aa, Entamoeba dispar
HSLD

SEQ ID NO: 2365450 - protein, 5 aa, Entamoeba dispar
HSLGD

SEQ ID NO: 2365451 - protein, 18 aa, Entamoeba dispar
HSLSESAELNQKKWLDDG

SEQ ID NO: 2365452 - protein, 20 aa, Entamoeba dispar
HSNSTTPTKNVPISNTSNDD

SEQ ID NO: 2365453 - protein, 5 aa, Entamoeba dispar
HSPNV

SEQ ID NO: 2365454 - protein, 6 aa, Entamoeba dispar
HSPPEE

SEQ ID NO: 2365455 - protein, 6 aa, Entamoeba dispar
HSPSDL

SEQ ID NO: 2365456 - protein, 6 aa, Entamoeba dispar
HSPSKI

SEQ ID NO: 2365457 - protein, 9 aa, Entamoeba dispar
HSPSVTSPL

SEQ ID NO: 2365458 - protein, 10 aa, Entamoeba dispar
HSQEPQRGWD

SEQ ID NO: 2365459 - protein, 6 aa, Entamoeba dispar
HSQKGL

SEQ ID NO: 2365460 - protein, 9 aa, Entamoeba dispar
HSRSGSLGT

SEQ ID NO: 2365461 - protein, 7 aa, Entamoeba dispar
HSSDNYG

SEQ ID NO: 2365462 - protein, 11 aa, Entamoeba dispar
HSSGHTPTLRK

SEQ ID NO: 2365463 - protein, 5 aa, Entamoeba dispar
HSSNQ

SEQ ID NO: 2365464 - protein, 7 aa, Entamoeba dispar
HSSNTSW

SEQ ID NO: 2365465 - protein, 6 aa, Entamoeba dispar
HSSSFQ

SEQ ID NO: 2365466 - protein, 18 aa, Entamoeba dispar
HSSSHSPFSEKEKISYSL

SEQ ID NO: 2365467 - protein, 8 aa, Entamoeba dispar
HSSSSSSS

SEQ ID NO: 2365468 - protein, 7 aa, Entamoeba dispar
HSTNDQA

SEQ ID NO: 2365469 - protein, 6 aa, Entamoeba dispar
HSTPKL

SEQ ID NO: 2365470 - protein, 12 aa, Entamoeba dispar
HSYQDGSSYSTT

SEQ ID NO: 2365471 - protein, 18 aa, Entamoeba dispar
HTADKTDKGYSASSADEE

SEQ ID NO: 2365472 - protein, 9 aa, Entamoeba dispar
HTATHPTET

SEQ ID NO: 2365473 - protein, 9 aa, Entamoeba dispar
HTATTQEHR

SEQ ID NO: 2365474 - protein, 4 aa, Entamoeba dispar
HTDA

SEQ ID NO: 2365475 - protein, 10 aa, Entamoeba dispar
HTEESKSSLL

SEQ ID NO: 2365476 - protein, 8 aa, Entamoeba dispar
HTEKSMQD

SEQ ID NO: 2365477 - protein, 11 aa, Entamoeba dispar
HTKKYNSTSAN

SEQ ID NO: 2365478 - protein, 5 aa, Entamoeba dispar
HTNDS

SEQ ID NO: 2365479 - protein, 4 aa, Entamoeba dispar
HTNE

SEQ ID NO: 2365480 - protein, 5 aa, Entamoeba dispar
HTPAS

SEQ ID NO: 2365481 - protein, 12 aa, Entamoeba dispar
HTPSERPSFKEI

SEQ ID NO: 2365482 - protein, 6 aa, Entamoeba dispar
HTRRSQ

SEQ ID NO: 2365483 - protein, 18 aa, Entamoeba dispar
HTSEKEERDTSTSSKEVN

SEQ ID NO: 2365484 - protein, 6 aa, Entamoeba dispar
HTSEKL

SEQ ID NO: 2365485 - protein, 11 aa, Entamoeba dispar
HTSSHSKPVKS

SEQ ID NO: 2365486 - protein, 7 aa, Entamoeba dispar
HTTGANQ

SEQ ID NO: 2365487 - protein, 7 aa, Entamoeba dispar
HTTNPDW

SEQ ID NO: 2365488 - protein, 6 aa, Entamoeba dispar
HTTPKV

SEQ ID NO: 2365489 - protein, 7 aa, Entamoeba dispar
HTTSPET

SEQ ID NO: 2365490 - protein, 9 aa, Entamoeba dispar
HTTTTSNNW

SEQ ID NO: 2365491 - protein, 5 aa, Entamoeba dispar
HVETQ

SEQ ID NO: 2365492 - protein, 36 aa, Entamoeba dispar
HVHETNGATISNSERRNSLDDNYSTKQKSKQRCSSF

SEQ ID NO: 2365493 - protein, 7 aa, Entamoeba dispar
HVYGQPR

SEQ ID NO: 2365494 - protein, 5 aa, Entamoeba dispar
HYDRP

SEQ ID NO: 2365495 - protein, 10 aa, Entamoeba dispar
HYGGGKNNAA

SEQ ID NO: 2365496 - protein, 6 aa, Entamoeba dispar
HYKPEE

SEQ ID NO: 2365497 - protein, 5 aa, Entamoeba dispar
HYKYP

SEQ ID NO: 2365498 - protein, 5 aa, Entamoeba dispar
HYNQS

SEQ ID NO: 2365499 - protein, 5 aa, Entamoeba dispar
HYQQN

SEQ ID NO: 2365500 - protein, 11 aa, Entamoeba dispar
HYTEDDPSYPF

SEQ ID NO: 2365501 - protein, 7 aa, Entamoeba dispar
HYTPNDT

SEQ ID NO: 2365502 - protein, 11 aa, Entamoeba dispar
HYTYQADKQNE

SEQ ID NO: 2365503 - protein, 20 aa, Entamoeba dispar
IAASSEVSSANELISKKNAR

SEQ ID NO: 2365504 - protein, 6 aa, Entamoeba dispar
IAATNQ

SEQ ID NO: 2365505 - protein, 5 aa, Entamoeba dispar
IADGS

SEQ ID NO: 2365506 - protein, 7 aa, Entamoeba dispar
IADSGLE

SEQ ID NO: 2365507 - protein, 14 aa, Entamoeba dispar
IAEESSKCSNAETI

SEQ ID NO: 2365508 - protein, 5 aa, Entamoeba dispar
IAEKS

SEQ ID NO: 2365509 - protein, 10 aa, Entamoeba dispar
IAEQNKNNYS

SEQ ID NO: 2365510 - protein, 12 aa, Entamoeba dispar
IAESETVAVNTS

SEQ ID NO: 2365511 - protein, 7 aa, Entamoeba dispar
IAETSVT

SEQ ID NO: 2365512 - protein, 6 aa, Entamoeba dispar
IAGDTA

SEQ ID NO: 2365513 - protein, 8 aa, Entamoeba dispar
IAHDGRPK

SEQ ID NO: 2365514 - protein, 6 aa, Entamoeba dispar
IANKQV

SEQ ID NO: 2365515 - protein, 7 aa, Entamoeba dispar
IANTTKK

SEQ ID NO: 2365516 - protein, 4 aa, Entamoeba dispar
IAPK

SEQ ID NO: 2365517 - protein, 12 aa, Entamoeba dispar
IAPPEAPSNGYR

SEQ ID NO: 2365518 - protein, 11 aa, Entamoeba dispar
IAQSNAKITDY

SEQ ID NO: 2365519 - protein, 4 aa, Entamoeba dispar
IASG

SEQ ID NO: 2365520 - protein, 7 aa, Entamoeba dispar
IASSEED

SEQ ID NO: 2365521 - protein, 5 aa, Entamoeba dispar
IASTI

SEQ ID NO: 2365522 - protein, 6 aa, Entamoeba dispar
IATEEQ

SEQ ID NO: 2365523 - protein, 9 aa, Entamoeba dispar
IATQNGTTP

SEQ ID NO: 2365524 - protein, 6 aa, Entamoeba dispar
ICGDGE

SEQ ID NO: 2365525 - protein, 4 aa, Entamoeba dispar
ICQK

SEQ ID NO: 2365526 - protein, 9 aa, Entamoeba dispar
ICSSNSESS

SEQ ID NO: 2365527 - protein, 12 aa, Entamoeba dispar
IDDDENCSHRDE

SEQ ID NO: 2365528 - protein, 5 aa, Entamoeba dispar
IDDEP

SEQ ID NO: 2365529 - protein, 4 aa, Entamoeba dispar
IDDG

SEQ ID NO: 2365530 - protein, 6 aa, Entamoeba dispar
IDDITG

SEQ ID NO: 2365531 - protein, 13 aa, Entamoeba dispar
IDDNSETISINEL

SEQ ID NO: 2365532 - protein, 9 aa, Entamoeba dispar
IDDPYEAPL

SEQ ID NO: 2365533 - protein, 9 aa, Entamoeba dispar
IDDQTKETA

SEQ ID NO: 2365534 - protein, 12 aa, Entamoeba dispar
IDDSYPRTNGKD

SEQ ID NO: 2365535 - protein, 4 aa, Entamoeba dispar
IDEA

SEQ ID NO: 2365536 - protein, 4 aa, Entamoeba dispar
IDED

SEQ ID NO: 2365537 - protein, 5 aa, Entamoeba dispar
IDEDS

SEQ ID NO: 2365538 - protein, 10 aa, Entamoeba dispar
IDEIKGKSHN

SEQ ID NO: 2365539 - protein, 4 aa, Entamoeba dispar
IDEM

SEQ ID NO: 2365540 - protein, 4 aa, Entamoeba dispar
IDEN

SEQ ID NO: 2365541 - protein, 9 aa, Entamoeba dispar
IDENDEDTN

SEQ ID NO: 2365542 - protein, 6 aa, Entamoeba dispar
IDENTN

SEQ ID NO: 2365543 - protein, 5 aa, Entamoeba dispar
IDEQE

SEQ ID NO: 2365544 - protein, 5 aa, Entamoeba dispar
IDERS

SEQ ID NO: 2365545 - protein, 16 aa, Entamoeba dispar
IDFGDKRPEIDEPIET

SEQ ID NO: 2365546 - protein, 15 aa, Entamoeba dispar
IDFSDTRPEINDPVD

SEQ ID NO: 2365547 - protein, 6 aa, Entamoeba dispar
IDGDGI

SEQ ID NO: 2365548 - protein, 8 aa, Entamoeba dispar
IDGDGKND

SEQ ID NO: 2365549 - protein, 11 aa, Entamoeba dispar
IDGDSYSNPYK

SEQ ID NO: 2365550 - protein, 6 aa, Entamoeba dispar
IDGEKK

SEQ ID NO: 2365551 - protein, 15 aa, Entamoeba dispar
IDKENNSSKNETHHY

SEQ ID NO: 2365552 - protein, 10 aa, Entamoeba dispar
IDKKNQDKHI

SEQ ID NO: 2365553 - protein, 6 aa, Entamoeba dispar
IDKSGI

SEQ ID NO: 2365554 - protein, 9 aa, Entamoeba dispar
IDKSSDVSI

SEQ ID NO: 2365555 - protein, 15 aa, Entamoeba dispar
IDLDKSSSESTTLNS

SEQ ID NO: 2365556 - protein, 15 aa, Entamoeba dispar
IDLDTDDIKSEYGDL

SEQ ID NO: 2365557 - protein, 11 aa, Entamoeba dispar
IDNGPNSETSL

SEQ ID NO: 2365558 - protein, 5 aa, Entamoeba dispar
IDNKT

SEQ ID NO: 2365559 - protein, 4 aa, Entamoeba dispar
IDNN

SEQ ID NO: 2365560 - protein, 18 aa, Entamoeba dispar
IDNNDDELTDFNDNQYSL

SEQ ID NO: 2365561 - protein, 8 aa, Entamoeba dispar
IDNNGNAI

SEQ ID NO: 2365562 - protein, 49 aa, Entamoeba dispar
IDNNNINNTNNEIKEENHTKQEHHITKSNSLQSDSTSFIQDKENKQREI

SEQ ID NO: 2365563 - protein, 17 aa, Entamoeba dispar
IDNNQNNSIKEEQKQDF

SEQ ID NO: 2365564 - protein, 12 aa, Entamoeba dispar
IDNQKEETTADH

SEQ ID NO: 2365565 - protein, 16 aa, Entamoeba dispar
IDPDSSLSKNDGWEEL

SEQ ID NO: 2365566 - protein, 5 aa, Entamoeba dispar
IDPND

SEQ ID NO: 2365567 - protein, 32 aa, Entamoeba dispar
IDPNGSKEGYLKEEKKKKTQIIKNQSKRSNYK

SEQ ID NO: 2365568 - protein, 8 aa, Entamoeba dispar
IDPNTEND

SEQ ID NO: 2365569 - protein, 6 aa, Entamoeba dispar
IDPQKD

SEQ ID NO: 2365570 - protein, 6 aa, Entamoeba dispar
IDPSGK

SEQ ID NO: 2365571 - protein, 7 aa, Entamoeba dispar
IDPSSTS

SEQ ID NO: 2365572 - protein, 13 aa, Entamoeba dispar
IDQNEECDGGKGC

SEQ ID NO: 2365573 - protein, 19 aa, Entamoeba dispar
IDQRREKYGTNELPKPPKV

SEQ ID NO: 2365574 - protein, 5 aa, Entamoeba dispar
IDQTR

SEQ ID NO: 2365575 - protein, 29 aa, Entamoeba dispar
IDRNRNQRRENSNNLNSSSSTTNQKYNNL

SEQ ID NO: 2365576 - protein, 32 aa, Entamoeba dispar
IDSEEEGGDDESTSSSSSEDEIQKKKKKKRIA

SEQ ID NO: 2365577 - protein, 4 aa, Entamoeba dispar
IDSG

SEQ ID NO: 2365578 - protein, 12 aa, Entamoeba dispar
IDSGKEPKATQM

SEQ ID NO: 2365579 - protein, 10 aa, Entamoeba dispar
IDSGTPRKYT

SEQ ID NO: 2365580 - protein, 8 aa, Entamoeba dispar
IDSKGETL

SEQ ID NO: 2365581 - protein, 8 aa, Entamoeba dispar
IDSKKKKF

SEQ ID NO: 2365582 - protein, 13 aa, Entamoeba dispar
IDSNSEGKGCVNG

SEQ ID NO: 2365583 - protein, 18 aa, Entamoeba dispar
IDSNSSSSNEDFSSEEID

SEQ ID NO: 2365584 - protein, 5 aa, Entamoeba dispar
IDSSK

SEQ ID NO: 2365585 - protein, 7 aa, Entamoeba dispar
IDSSKPI

SEQ ID NO: 2365586 - protein, 28 aa, Entamoeba dispar
IDSSNDIKKDISTSNLSTESSGFDYSTE

SEQ ID NO: 2365587 - protein, 8 aa, Entamoeba dispar
IDSSNNNR

SEQ ID NO: 2365588 - protein, 4 aa, Entamoeba dispar
IDSY

SEQ ID NO: 2365589 - protein, 8 aa, Entamoeba dispar
IDTEPSKV

SEQ ID NO: 2365590 - protein, 4 aa, Entamoeba dispar
IDTG

SEQ ID NO: 2365591 - protein, 10 aa, Entamoeba dispar
IDTKADSQTI

SEQ ID NO: 2365592 - protein, 14 aa, Entamoeba dispar
IDTNHTKPDSYKNG

SEQ ID NO: 2365593 - protein, 6 aa, Entamoeba dispar
IDTSSG

SEQ ID NO: 2365594 - protein, 7 aa, Entamoeba dispar
IDTTEDV

SEQ ID NO: 2365595 - protein, 7 aa, Entamoeba dispar
IDTTPEN

SEQ ID NO: 2365596 - protein, 4 aa, Entamoeba dispar
IDTV

SEQ ID NO: 2365597 - protein, 15 aa, Entamoeba dispar
IEAETSVCPNSRGSV

SEQ ID NO: 2365598 - protein, 23 aa, Entamoeba dispar
IECSDGQYLDTSGECKNCDSSKH

SEQ ID NO: 2365599 - protein, 6 aa, Entamoeba dispar
IEDAAT

SEQ ID NO: 2365600 - protein, 13 aa, Entamoeba dispar
IEDDTLKHSKISS

SEQ ID NO: 2365601 - protein, 5 aa, Entamoeba dispar
IEDFE

SEQ ID NO: 2365602 - protein, 11 aa, Entamoeba dispar
IEDKLQDGVPE

SEQ ID NO: 2365603 - protein, 4 aa, Entamoeba dispar
IEDP

SEQ ID NO: 2365604 - protein, 6 aa, Entamoeba dispar
IEDQSS

SEQ ID NO: 2365605 - protein, 6 aa, Entamoeba dispar
IEEAEP

SEQ ID NO: 2365606 - protein, 4 aa, Entamoeba dispar
IEEE

SEQ ID NO: 2365607 - protein, 14 aa, Entamoeba dispar
IEEEEEENEIDLSN

SEQ ID NO: 2365608 - protein, 6 aa, Entamoeba dispar
IEEEEG

SEQ ID NO: 2365609 - protein, 5 aa, Entamoeba dispar
IEEEK

SEQ ID NO: 2365610 - protein, 11 aa, Entamoeba dispar
IEEKKSKNKII

SEQ ID NO: 2365611 - protein, 6 aa, Entamoeba dispar
IEEKNG

SEQ ID NO: 2365612 - protein, 17 aa, Entamoeba dispar
IEEKTKTTYNKQKLTTT

SEQ ID NO: 2365613 - protein, 4 aa, Entamoeba dispar
IEEM

SEQ ID NO: 2365614 - protein, 5 aa, Entamoeba dispar
IEEPQ

SEQ ID NO: 2365615 - protein, 7 aa, Entamoeba dispar
IEESGND

SEQ ID NO: 2365616 - protein, 10 aa, Entamoeba dispar
IEESKKPTFI

SEQ ID NO: 2365617 - protein, 5 aa, Entamoeba dispar
IEETP

SEQ ID NO: 2365618 - protein, 17 aa, Entamoeba dispar
IEEVEEKQIKRRKPRRK

SEQ ID NO: 2365619 - protein, 9 aa, Entamoeba dispar
IEGASQSTN

SEQ ID NO: 2365620 - protein, 7 aa, Entamoeba dispar
IEGEGKI

SEQ ID NO: 2365621 - protein, 12 aa, Entamoeba dispar
IEGESKETHDFY

SEQ ID NO: 2365622 - protein, 4 aa, Entamoeba dispar
IEGG

SEQ ID NO: 2365623 - protein, 8 aa, Entamoeba dispar
IEGKEKKY

SEQ ID NO: 2365624 - protein, 6 aa, Entamoeba dispar
IEGKKG

SEQ ID NO: 2365625 - protein, 4 aa, Entamoeba dispar
IEGR

SEQ ID NO: 2365626 - protein, 5 aa, Entamoeba dispar
IEGSE

SEQ ID NO: 2365627 - protein, 15 aa, Entamoeba dispar
IEGTMESSSTSIPEL

SEQ ID NO: 2365628 - protein, 6 aa, Entamoeba dispar
IEHHNQ

SEQ ID NO: 2365629 - protein, 47 aa, Entamoeba dispar
IEIPNTTQSINNSQKSKGEENPVDTSTEMEKEQQEETNKQQNEEEHQ

SEQ ID NO: 2365630 - protein, 5 aa, Entamoeba dispar
IEISR

SEQ ID NO: 2365631 - protein, 5 aa, Entamoeba dispar
IEKDD

SEQ ID NO: 2365632 - protein, 6 aa, Entamoeba dispar
IEKDRD

SEQ ID NO: 2365633 - protein, 10 aa, Entamoeba dispar
IEKEKPKEKH

SEQ ID NO: 2365634 - protein, 7 aa, Entamoeba dispar
IEKEKTF

SEQ ID NO: 2365635 - protein, 29 aa, Entamoeba dispar
IEKGFTSSIDKNGDEQNSQIKEDQPMAVD

SEQ ID NO: 2365636 - protein, 14 aa, Entamoeba dispar
IEKGGDWDRRNRRR

SEQ ID NO: 2365637 - protein, 8 aa, Entamoeba dispar
IEKKEHND

SEQ ID NO: 2365638 - protein, 19 aa, Entamoeba dispar
IEKKNIDNTLTQQLQQKED

SEQ ID NO: 2365639 - protein, 7 aa, Entamoeba dispar
IEKKQEF

SEQ ID NO: 2365640 - protein, 8 aa, Entamoeba dispar
IEKNNPEV

SEQ ID NO: 2365641 - protein, 25 aa, Entamoeba dispar
IEKRKEEFKRRQEEIRKLEKKKKIR

SEQ ID NO: 2365642 - protein, 6 aa, Entamoeba dispar
IEKSGK

SEQ ID NO: 2365643 - protein, 7 aa, Entamoeba dispar
IEKSSGK

SEQ ID NO: 2365644 - protein, 8 aa, Entamoeba dispar
IEKSSLPS

SEQ ID NO: 2365645 - protein, 7 aa, Entamoeba dispar
IEKTPAG

SEQ ID NO: 2365646 - protein, 6 aa, Entamoeba dispar
IEKYGK

SEQ ID NO: 2365647 - protein, 16 aa, Entamoeba dispar
IEMSENDRKKLIKMYL

SEQ ID NO: 2365648 - protein, 16 aa, Entamoeba dispar
IENDIKKKREIDSNEV

SEQ ID NO: 2365649 - protein, 14 aa, Entamoeba dispar
IENDSESSESVNEI

SEQ ID NO: 2365650 - protein, 18 aa, Entamoeba dispar
IENEKVNEEKKENNNSKR

SEQ ID NO: 2365651 - protein, 6 aa, Entamoeba dispar
IENEPT

SEQ ID NO: 2365652 - protein, 7 aa, Entamoeba dispar
IENGTRN

SEQ ID NO: 2365653 - protein, 6 aa, Entamoeba dispar
IENKSN

SEQ ID NO: 2365654 - protein, 4 aa, Entamoeba dispar
IENN

SEQ ID NO: 2365655 - protein, 6 aa, Entamoeba dispar
IENRIG

SEQ ID NO: 2365656 - protein, 4 aa, Entamoeba dispar
IENS

SEQ ID NO: 2365657 - protein, 6 aa, Entamoeba dispar
IENSLE

SEQ ID NO: 2365658 - protein, 9 aa, Entamoeba dispar
IENTPNKSI

SEQ ID NO: 2365659 - protein, 7 aa, Entamoeba dispar
IENTSNN

SEQ ID NO: 2365660 - protein, 7 aa, Entamoeba dispar
IEPDIDT

SEQ ID NO: 2365661 - protein, 11 aa, Entamoeba dispar
IEPDSKETIKL

SEQ ID NO: 2365662 - protein, 8 aa, Entamoeba dispar
IEPNGLST

SEQ ID NO: 2365663 - protein, 21 aa, Entamoeba dispar
IEPPTEKKDQNDNHPSTQPSI

SEQ ID NO: 2365664 - protein, 10 aa, Entamoeba dispar
IEPRKITEQT

SEQ ID NO: 2365665 - protein, 7 aa, Entamoeba dispar
IEPRTSS

SEQ ID NO: 2365666 - protein, 6 aa, Entamoeba dispar
IEQDGT

SEQ ID NO: 2365667 - protein, 10 aa, Entamoeba dispar
IEQEPENEKI

SEQ ID NO: 2365668 - protein, 6 aa, Entamoeba dispar
IEQEQK

SEQ ID NO: 2365669 - protein, 15 aa, Entamoeba dispar
IEQGVEYTKEKGETL

SEQ ID NO: 2365670 - protein, 14 aa, Entamoeba dispar
IEQLNKEAEEKHRL

SEQ ID NO: 2365671 - protein, 5 aa, Entamoeba dispar
IEQNS

SEQ ID NO: 2365672 - protein, 7 aa, Entamoeba dispar
IEQRPQI

SEQ ID NO: 2365673 - protein, 19 aa, Entamoeba dispar
IEQTEEETHEEEVKKQHEE

SEQ ID NO: 2365674 - protein, 8 aa, Entamoeba dispar
IEQTIQNK

SEQ ID NO: 2365675 - protein, 8 aa, Entamoeba dispar
IEQTNSNY

SEQ ID NO: 2365676 - protein, 13 aa, Entamoeba dispar
IEQTTMKEYKNKY

SEQ ID NO: 2365677 - protein, 17 aa, Entamoeba dispar
IEQYNQEEGIKNTPISK

SEQ ID NO: 2365678 - protein, 4 aa, Entamoeba dispar
IERD

SEQ ID NO: 2365679 - protein, 14 aa, Entamoeba dispar
IERKEEKNHPQSAK

SEQ ID NO: 2365680 - protein, 18 aa, Entamoeba dispar
IERKGWTQEYKKVGAKNS

SEQ ID NO: 2365681 - protein, 5 aa, Entamoeba dispar
IERKR

SEQ ID NO: 2365682 - protein, 7 aa, Entamoeba dispar
IERNERS

SEQ ID NO: 2365683 - protein, 4 aa, Entamoeba dispar
IESA

SEQ ID NO: 2365684 - protein, 8 aa, Entamoeba dispar
IESDNDNN

SEQ ID NO: 2365685 - protein, 4 aa, Entamoeba dispar
IESE

SEQ ID NO: 2365686 - protein, 7 aa, Entamoeba dispar
IESENQE

SEQ ID NO: 2365687 - protein, 9 aa, Entamoeba dispar
IESERGNST

SEQ ID NO: 2365688 - protein, 4 aa, Entamoeba dispar
IESK

SEQ ID NO: 2365689 - protein, 10 aa, Entamoeba dispar
IESKENNNIE

SEQ ID NO: 2365690 - protein, 7 aa, Entamoeba dispar
IESKSSQ

SEQ ID NO: 2365691 - protein, 20 aa, Entamoeba dispar
IESNETVDINEASSNKKKAM

SEQ ID NO: 2365692 - protein, 6 aa, Entamoeba dispar
IESRKR

SEQ ID NO: 2365693 - protein, 14 aa, Entamoeba dispar
IESTEEKQQTTTQS

SEQ ID NO: 2365694 - protein, 14 aa, Entamoeba dispar
IESTGTGDNTNNEY

SEQ ID NO: 2365695 - protein, 14 aa, Entamoeba dispar
IESTKQENKQLTEE

SEQ ID NO: 2365696 - protein, 16 aa, Entamoeba dispar
IESTSTIDNSKCSLPQ

SEQ ID NO: 2365697 - protein, 9 aa, Entamoeba dispar
IETNELQNT

SEQ ID NO: 2365698 - protein, 17 aa, Entamoeba dispar
IETNKNTLKEKSNERNQ

SEQ ID NO: 2365699 - protein, 13 aa, Entamoeba dispar
IETPDENQDNSLR

SEQ ID NO: 2365700 - protein, 36 aa, Entamoeba dispar
IETPKTSKGEDTNIHKEDETLTKEENTNIPKEESIK

SEQ ID NO: 2365701 - protein, 8 aa, Entamoeba dispar
IETTDEPI

SEQ ID NO: 2365702 - protein, 6 aa, Entamoeba dispar
IETTNE

SEQ ID NO: 2365703 - protein, 9 aa, Entamoeba dispar
IETVGKEVN

SEQ ID NO: 2365704 - protein, 6 aa, Entamoeba dispar
IEYQNN

SEQ ID NO: 2365705 - protein, 13 aa, Entamoeba dispar
IEYSENACQNNKS

SEQ ID NO: 2365706 - protein, 4 aa, Entamoeba dispar
IFSE

SEQ ID NO: 2365707 - protein, 4 aa, Entamoeba dispar
IGAE

SEQ ID NO: 2365708 - protein, 7 aa, Entamoeba dispar
IGCPENC

SEQ ID NO: 2365709 - protein, 6 aa, Entamoeba dispar
IGCSSK

SEQ ID NO: 2365710 - protein, 10 aa, Entamoeba dispar
IGDAKEEHED

SEQ ID NO: 2365711 - protein, 12 aa, Entamoeba dispar
IGDDGKKVDNGI

SEQ ID NO: 2365712 - protein, 10 aa, Entamoeba dispar
IGDEENNSEI

SEQ ID NO: 2365713 - protein, 8 aa, Entamoeba dispar
IGDGANDI

SEQ ID NO: 2365714 - protein, 5 aa, Entamoeba dispar
IGDGC

SEQ ID NO: 2365715 - protein, 9 aa, Entamoeba dispar
IGDMSDSSI

SEQ ID NO: 2365716 - protein, 6 aa, Entamoeba dispar
IGDSSS

SEQ ID NO: 2365717 - protein, 4 aa, Entamoeba dispar
IGDY

SEQ ID NO: 2365718 - protein, 5 aa, Entamoeba dispar
IGEEE

SEQ ID NO: 2365719 - protein, 7 aa, Entamoeba dispar
IGEETKA

SEQ ID NO: 2365720 - protein, 5 aa, Entamoeba dispar
IGEGS

SEQ ID NO: 2365721 - protein, 7 aa, Entamoeba dispar
IGEGSFG

SEQ ID NO: 2365722 - protein, 7 aa, Entamoeba dispar
IGEKKSD

SEQ ID NO: 2365723 - protein, 6 aa, Entamoeba dispar
IGERHE

SEQ ID NO: 2365724 - protein, 15 aa, Entamoeba dispar
IGESLQTKLEKHPNV

SEQ ID NO: 2365725 - protein, 4 aa, Entamoeba dispar
IGET

SEQ ID NO: 2365726 - protein, 6 aa, Entamoeba dispar
IGETQK

SEQ ID NO: 2365727 - protein, 8 aa, Entamoeba dispar
IGEYTNKD

SEQ ID NO: 2365728 - protein, 4 aa, Entamoeba dispar
IGGA

SEQ ID NO: 2365729 - protein, 9 aa, Entamoeba dispar
IGGKGQIDW

SEQ ID NO: 2365730 - protein, 6 aa, Entamoeba dispar
IGGNKT

SEQ ID NO: 2365731 - protein, 4 aa, Entamoeba dispar
IGGQ

SEQ ID NO: 2365732 - protein, 6 aa, Entamoeba dispar
IGGYDS

SEQ ID NO: 2365733 - protein, 6 aa, Entamoeba dispar
IGHPET

SEQ ID NO: 2365734 - protein, 4 aa, Entamoeba dispar
IGIG

SEQ ID NO: 2365735 - protein, 5 aa, Entamoeba dispar
IGIGT

SEQ ID NO: 2365736 - protein, 8 aa, Entamoeba dispar
IGKDGLNG

SEQ ID NO: 2365737 - protein, 6 aa, Entamoeba dispar
IGKEYL

SEQ ID NO: 2365738 - protein, 4 aa, Entamoeba dispar
IGKL

SEQ ID NO: 2365739 - protein, 12 aa, Entamoeba dispar
IGKNGKKITAST

SEQ ID NO: 2365740 - protein, 18 aa, Entamoeba dispar
IGKSGQLFTTKENEIPTR

SEQ ID NO: 2365741 - protein, 6 aa, Entamoeba dispar
IGKTNV

SEQ ID NO: 2365742 - protein, 10 aa, Entamoeba dispar
IGNGNYELNN

SEQ ID NO: 2365743 - protein, 11 aa, Entamoeba dispar
IGNKDEQKKRL

SEQ ID NO: 2365744 - protein, 11 aa, Entamoeba dispar
IGNKNKWSGLS

SEQ ID NO: 2365745 - protein, 6 aa, Entamoeba dispar
IGNKTE

SEQ ID NO: 2365746 - protein, 5 aa, Entamoeba dispar
IGNPD

SEQ ID NO: 2365747 - protein, 4 aa, Entamoeba dispar
IGNS

SEQ ID NO: 2365748 - protein, 8 aa, Entamoeba dispar
IGNSKSTI

SEQ ID NO: 2365749 - protein, 6 aa, Entamoeba dispar
IGNSRS

SEQ ID NO: 2365750 - protein, 10 aa, Entamoeba dispar
IGNTTEKKSI

SEQ ID NO: 2365751 - protein, 6 aa, Entamoeba dispar
IGNYPN

SEQ ID NO: 2365752 - protein, 15 aa, Entamoeba dispar
IGPNSSPKSSSKYDR

SEQ ID NO: 2365753 - protein, 6 aa, Entamoeba dispar
IGRGAY

SEQ ID NO: 2365754 - protein, 4 aa, Entamoeba dispar
IGSD

SEQ ID NO: 2365755 - protein, 15 aa, Entamoeba dispar
IGSDSTKGGSDFPHT

SEQ ID NO: 2365756 - protein, 4 aa, Entamoeba dispar
IGSG

SEQ ID NO: 2365757 - protein, 10 aa, Entamoeba dispar
IGSKEKKEVR

SEQ ID NO: 2365758 - protein, 9 aa, Entamoeba dispar
IGSKVDEKK

SEQ ID NO: 2365759 - protein, 8 aa, Entamoeba dispar
IGSLSSQT

SEQ ID NO: 2365760 - protein, 4 aa, Entamoeba dispar
IGSN

SEQ ID NO: 2365761 - protein, 4 aa, Entamoeba dispar
IGSP

SEQ ID NO: 2365762 - protein, 10 aa, Entamoeba dispar
IGSSNGKPNI

SEQ ID NO: 2365763 - protein, 5 aa, Entamoeba dispar
IGSYG

SEQ ID NO: 2365764 - protein, 4 aa, Entamoeba dispar
IGTK

SEQ ID NO: 2365765 - protein, 6 aa, Entamoeba dispar
IGTLNT

SEQ ID NO: 2365766 - protein, 6 aa, Entamoeba dispar
IGTPKY

SEQ ID NO: 2365767 - protein, 15 aa, Entamoeba dispar
IGTPSTGLNETTGFQ

SEQ ID NO: 2365768 - protein, 14 aa, Entamoeba dispar
IGTQDPSQCSSNTT

SEQ ID NO: 2365769 - protein, 28 aa, Entamoeba dispar
IGTSDLSEITNEQTDTTSIEESEEPYQI

SEQ ID NO: 2365770 - protein, 29 aa, Entamoeba dispar
IGTSDLSEITNEQTDTTSIEESEEPYQVN

SEQ ID NO: 2365771 - protein, 7 aa, Entamoeba dispar
IGTSSFK

SEQ ID NO: 2365772 - protein, 6 aa, Entamoeba dispar
IGTTDN

SEQ ID NO: 2365773 - protein, 5 aa, Entamoeba dispar
IGTTG

SEQ ID NO: 2365774 - protein, 8 aa, Entamoeba dispar
IGVGASGS

SEQ ID NO: 2365775 - protein, 8 aa, Entamoeba dispar
IGVTQPRR

SEQ ID NO: 2365776 - protein, 9 aa, Entamoeba dispar
IGYKDKKSL

SEQ ID NO: 2365777 - protein, 6 aa, Entamoeba dispar
IGYSLS

SEQ ID NO: 2365778 - protein, 6 aa, Entamoeba dispar
IGYTTY

SEQ ID NO: 2365779 - protein, 16 aa, Entamoeba dispar
IHDNSVSLQNSSRQEY

SEQ ID NO: 2365780 - protein, 6 aa, Entamoeba dispar
IHESNA

SEQ ID NO: 2365781 - protein, 7 aa, Entamoeba dispar
IHGNIKP

SEQ ID NO: 2365782 - protein, 9 aa, Entamoeba dispar
IHGSGEEKR

SEQ ID NO: 2365783 - protein, 9 aa, Entamoeba dispar
IHNSDPAKR

SEQ ID NO: 2365784 - protein, 5 aa, Entamoeba dispar
IHSGN

SEQ ID NO: 2365785 - protein, 11 aa, Entamoeba dispar
IIAGEGKDVRT

SEQ ID NO: 2365786 - protein, 4 aa, Entamoeba dispar
IIDN

SEQ ID NO: 2365787 - protein, 6 aa, Entamoeba dispar
IIEGKE

SEQ ID NO: 2365788 - protein, 9 aa, Entamoeba dispar
IIENTSPIK

SEQ ID NO: 2365789 - protein, 10 aa, Entamoeba dispar
IIEPNSELQV

SEQ ID NO: 2365790 - protein, 17 aa, Entamoeba dispar
IIKPSEEKENKVNEENI

SEQ ID NO: 2365791 - protein, 6 aa, Entamoeba dispar
IINEEE

SEQ ID NO: 2365792 - protein, 18 aa, Entamoeba dispar
IIPDPQEQYYTGQVPSQY

SEQ ID NO: 2365793 - protein, 10 aa, Entamoeba dispar
IIPKDGYRKQ

SEQ ID NO: 2365794 - protein, 15 aa, Entamoeba dispar
IIPPTQNQQGSQADQ

SEQ ID NO: 2365795 - protein, 6 aa, Entamoeba dispar
IIQPQD

SEQ ID NO: 2365796 - protein, 9 aa, Entamoeba dispar
IISTEGKVE

SEQ ID NO: 2365797 - protein, 19 aa, Entamoeba dispar
IITDSSKSEVTNTNSGESI

SEQ ID NO: 2365798 - protein, 7 aa, Entamoeba dispar
IITTDKS

SEQ ID NO: 2365799 - protein, 11 aa, Entamoeba dispar
IKAKESSNVIS

SEQ ID NO: 2365800 - protein, 16 aa, Entamoeba dispar
IKDKQNKITEEDIKKE

SEQ ID NO: 2365801 - protein, 9 aa, Entamoeba dispar
IKDQTKVSK

SEQ ID NO: 2365802 - protein, 8 aa, Entamoeba dispar
IKDQTLPE

SEQ ID NO: 2365803 - protein, 9 aa, Entamoeba dispar
IKDSQKETY

SEQ ID NO: 2365804 - protein, 8 aa, Entamoeba dispar
IKDTYTSE

SEQ ID NO: 2365805 - protein, 15 aa, Entamoeba dispar
IKEEDDDDEIDEDVD

SEQ ID NO: 2365806 - protein, 12 aa, Entamoeba dispar
IKEEEEENKEKV

SEQ ID NO: 2365807 - protein, 6 aa, Entamoeba dispar
IKEEEY

SEQ ID NO: 2365808 - protein, 10 aa, Entamoeba dispar
IKEEGDNYNT

SEQ ID NO: 2365809 - protein, 21 aa, Entamoeba dispar
IKEEIKEQREKEQTKRESEAA

SEQ ID NO: 2365810 - protein, 12 aa, Entamoeba dispar
IKEEKDISPVKT

SEQ ID NO: 2365811 - protein, 11 aa, Entamoeba dispar
IKEEKIKEKIS

SEQ ID NO: 2365812 - protein, 5 aa, Entamoeba dispar
IKEFN

SEQ ID NO: 2365813 - protein, 7 aa, Entamoeba dispar
IKEGGLL

SEQ ID NO: 2365814 - protein, 13 aa, Entamoeba dispar
IKEGVKNNKESKN

SEQ ID NO: 2365815 - protein, 6 aa, Entamoeba dispar
IKEHTG

SEQ ID NO: 2365816 - protein, 22 aa, Entamoeba dispar
IKEIEEKKKNLIRQKTEERMNK

SEQ ID NO: 2365817 - protein, 9 aa, Entamoeba dispar
IKEIEGGKV

SEQ ID NO: 2365818 - protein, 4 aa, Entamoeba dispar
IKEK

SEQ ID NO: 2365819 - protein, 12 aa, Entamoeba dispar
IKEKDKEEDINE

SEQ ID NO: 2365820 - protein, 11 aa, Entamoeba dispar
IKEKEPEKVRK

SEQ ID NO: 2365821 - protein, 19 aa, Entamoeba dispar
IKEMGDKISSEDKKKAEEI

SEQ ID NO: 2365822 - protein, 4 aa, Entamoeba dispar
IKEN

SEQ ID NO: 2365823 - protein, 17 aa, Entamoeba dispar
IKENNQNSDETIKNDEE

SEQ ID NO: 2365824 - protein, 8 aa, Entamoeba dispar
IKENPQVN

SEQ ID NO: 2365825 - protein, 11 aa, Entamoeba dispar
IKEPGEETNNV

SEQ ID NO: 2365826 - protein, 4 aa, Entamoeba dispar
IKEQ

SEQ ID NO: 2365827 - protein, 11 aa, Entamoeba dispar
IKEREKEIKPF

SEQ ID NO: 2365828 - protein, 22 aa, Entamoeba dispar
IKESFTSSEDTSSTEINDSFGP

SEQ ID NO: 2365829 - protein, 20 aa, Entamoeba dispar
IKESKTTLTEKDKEQFEQEV

SEQ ID NO: 2365830 - protein, 8 aa, Entamoeba dispar
IKESNGCI

SEQ ID NO: 2365831 - protein, 9 aa, Entamoeba dispar
IKESQSTEK

SEQ ID NO: 2365832 - protein, 7 aa, Entamoeba dispar
IKESRSE

SEQ ID NO: 2365833 - protein, 8 aa, Entamoeba dispar
IKGDNEID

SEQ ID NO: 2365834 - protein, 20 aa, Entamoeba dispar
IKGEKGNIHRKPISENNESM

SEQ ID NO: 2365835 - protein, 26 aa, Entamoeba dispar
IKGETQISTRLDPDEIKEEKKIGEGT

SEQ ID NO: 2365836 - protein, 26 aa, Entamoeba dispar
IKGETQISTRLDPDEIKEKNKIGEGS

SEQ ID NO: 2365837 - protein, 12 aa, Entamoeba dispar
IKGGKNECLEGK

SEQ ID NO: 2365838 - protein, 7 aa, Entamoeba dispar
IKGKTSI

SEQ ID NO: 2365839 - protein, 8 aa, Entamoeba dispar
IKGNQLPK

SEQ ID NO: 2365840 - protein, 7 aa, Entamoeba dispar
IKGSGTI

SEQ ID NO: 2365841 - protein, 6 aa, Entamoeba dispar
IKGTPT

SEQ ID NO: 2365842 - protein, 7 aa, Entamoeba dispar
IKHEENL

SEQ ID NO: 2365843 - protein, 8 aa, Entamoeba dispar
IKINSDDT

SEQ ID NO: 2365844 - protein, 15 aa, Entamoeba dispar
IKISEEGKFTATGET

SEQ ID NO: 2365845 - protein, 7 aa, Entamoeba dispar
IKKDSGT

SEQ ID NO: 2365846 - protein, 12 aa, Entamoeba dispar
IKKEKEEEKALK

SEQ ID NO: 2365847 - protein, 35 aa, Entamoeba dispar
IKKEKEGLKGNKEEPLTKETITTNENNNNKDDVEI

SEQ ID NO: 2365848 - protein, 17 aa, Entamoeba dispar
IKKERQRKEQELQRLEQ

SEQ ID NO: 2365849 - protein, 17 aa, Entamoeba dispar
IKKESNETIKQLKESGH

SEQ ID NO: 2365850 - protein, 9 aa, Entamoeba dispar
IKKGDEDDF

SEQ ID NO: 2365851 - protein, 9 aa, Entamoeba dispar
IKKGGDKVE

SEQ ID NO: 2365852 - protein, 12 aa, Entamoeba dispar
IKKKEENNKEIN

SEQ ID NO: 2365853 - protein, 7 aa, Entamoeba dispar
IKKPPKH

SEQ ID NO: 2365854 - protein, 7 aa, Entamoeba dispar
IKKRSAE

SEQ ID NO: 2365855 - protein, 6 aa, Entamoeba dispar
IKKSIK

SEQ ID NO: 2365856 - protein, 6 aa, Entamoeba dispar
IKKSKK

SEQ ID NO: 2365857 - protein, 6 aa, Entamoeba dispar
IKKTEE

SEQ ID NO: 2365858 - protein, 7 aa, Entamoeba dispar
IKKTENN

SEQ ID NO: 2365859 - protein, 10 aa, Entamoeba dispar
IKLDENEDNY

SEQ ID NO: 2365860 - protein, 4 aa, Entamoeba dispar
IKNE

SEQ ID NO: 2365861 - protein, 13 aa, Entamoeba dispar
IKNEEKETTNTTT

SEQ ID NO: 2365862 - protein, 5 aa, Entamoeba dispar
IKNEN

SEQ ID NO: 2365863 - protein, 4 aa, Entamoeba dispar
IKNH

SEQ ID NO: 2365864 - protein, 11 aa, Entamoeba dispar
IKNKEINKEDI

SEQ ID NO: 2365865 - protein, 6 aa, Entamoeba dispar
IKNKET

SEQ ID NO: 2365866 - protein, 7 aa, Entamoeba dispar
IKNKSEI

SEQ ID NO: 2365867 - protein, 4 aa, Entamoeba dispar
IKNN

SEQ ID NO: 2365868 - protein, 10 aa, Entamoeba dispar
IKNNPAAKLD

SEQ ID NO: 2365869 - protein, 14 aa, Entamoeba dispar
IKNNSNAQIGTGPY

SEQ ID NO: 2365870 - protein, 7 aa, Entamoeba dispar
IKNNTIS

SEQ ID NO: 2365871 - protein, 5 aa, Entamoeba dispar
IKNPK

SEQ ID NO: 2365872 - protein, 7 aa, Entamoeba dispar
IKNSSVQ

SEQ ID NO: 2365873 - protein, 8 aa, Entamoeba dispar
IKNTGGNV

SEQ ID NO: 2365874 - protein, 7 aa, Entamoeba dispar
IKNTNFN

SEQ ID NO: 2365875 - protein, 65 aa, Entamoeba dispar
IKPDRNEKKEIKEEKNEDTEKIEETEKKMKNNKTTKKSKEQKRNERNEKKAEKLRKEEEALNQKV

SEQ ID NO: 2365876 - protein, 10 aa, Entamoeba dispar
IKPEEKKKVK

SEQ ID NO: 2365877 - protein, 7 aa, Entamoeba dispar
IKPEFGE

SEQ ID NO: 2365878 - protein, 7 aa, Entamoeba dispar
IKPEKSL

SEQ ID NO: 2365879 - protein, 5 aa, Entamoeba dispar
IKPNS

SEQ ID NO: 2365880 - protein, 6 aa, Entamoeba dispar
IKPRHR

SEQ ID NO: 2365881 - protein, 4 aa, Entamoeba dispar
IKPS

SEQ ID NO: 2365882 - protein, 7 aa, Entamoeba dispar
IKPSGPV

SEQ ID NO: 2365883 - protein, 8 aa, Entamoeba dispar
IKPSKKEQ

SEQ ID NO: 2365884 - protein, 9 aa, Entamoeba dispar
IKPTKEIDS

SEQ ID NO: 2365885 - protein, 7 aa, Entamoeba dispar
IKPTTKQ

SEQ ID NO: 2365886 - protein, 7 aa, Entamoeba dispar
IKQDIDD

SEQ ID NO: 2365887 - protein, 7 aa, Entamoeba dispar
IKQEIDE

SEQ ID NO: 2365888 - protein, 8 aa, Entamoeba dispar
IKQEIEDE

SEQ ID NO: 2365889 - protein, 15 aa, Entamoeba dispar
IKQESDGLDQQNEMI

SEQ ID NO: 2365890 - protein, 4 aa, Entamoeba dispar
IKQG

SEQ ID NO: 2365891 - protein, 4 aa, Entamoeba dispar
IKQK

SEQ ID NO: 2365892 - protein, 9 aa, Entamoeba dispar
IKQKGSVVD

SEQ ID NO: 2365893 - protein, 7 aa, Entamoeba dispar
IKQKQDL

SEQ ID NO: 2365894 - protein, 9 aa, Entamoeba dispar
IKQPNPNYQ

SEQ ID NO: 2365895 - protein, 5 aa, Entamoeba dispar
IKQPR

SEQ ID NO: 2365896 - protein, 8 aa, Entamoeba dispar
IKQSDDQL

SEQ ID NO: 2365897 - protein, 46 aa, Entamoeba dispar
IKRNNERKSEEKKDKIEEQETINTSPQKGSIVQTPRGKFSNGKKLE

SEQ ID NO: 2365898 - protein, 11 aa, Entamoeba dispar
IKRRSLSNSLS

SEQ ID NO: 2365899 - protein, 7 aa, Entamoeba dispar
IKSDDTA

SEQ ID NO: 2365900 - protein, 5 aa, Entamoeba dispar
IKSDT

SEQ ID NO: 2365901 - protein, 4 aa, Entamoeba dispar
IKSE

SEQ ID NO: 2365902 - protein, 17 aa, Entamoeba dispar
IKSEQNQIEQLKKESTL

SEQ ID NO: 2365903 - protein, 7 aa, Entamoeba dispar
IKSITEQ

SEQ ID NO: 2365904 - protein, 9 aa, Entamoeba dispar
IKSLNEENI

SEQ ID NO: 2365905 - protein, 8 aa, Entamoeba dispar
IKSMPGQR

SEQ ID NO: 2365906 - protein, 7 aa, Entamoeba dispar
IKSPIKQ

SEQ ID NO: 2365907 - protein, 7 aa, Entamoeba dispar
IKSPQAV

SEQ ID NO: 2365908 - protein, 7 aa, Entamoeba dispar
IKSQTGE

SEQ ID NO: 2365909 - protein, 8 aa, Entamoeba dispar
IKSSNTIK

SEQ ID NO: 2365910 - protein, 10 aa, Entamoeba dispar
IKSTKTRESS

SEQ ID NO: 2365911 - protein, 9 aa, Entamoeba dispar
IKSTNSTII

SEQ ID NO: 2365912 - protein, 8 aa, Entamoeba dispar
IKTASSLN

SEQ ID NO: 2365913 - protein, 6 aa, Entamoeba dispar
IKTEDE

SEQ ID NO: 2365914 - protein, 11 aa, Entamoeba dispar
IKTEESQEISN

SEQ ID NO: 2365915 - protein, 11 aa, Entamoeba dispar
IKTEKESIESN

SEQ ID NO: 2365916 - protein, 9 aa, Entamoeba dispar
IKTENENIQ

SEQ ID NO: 2365917 - protein, 6 aa, Entamoeba dispar
IKTENQ

SEQ ID NO: 2365918 - protein, 10 aa, Entamoeba dispar
IKTKTKIGNS

SEQ ID NO: 2365919 - protein, 4 aa, Entamoeba dispar
IKTQ

SEQ ID NO: 2365920 - protein, 7 aa, Entamoeba dispar
IKTSIED

SEQ ID NO: 2365921 - protein, 29 aa, Entamoeba dispar
IKTSISENQTPRNTEQKGVNLKEDIITPE

SEQ ID NO: 2365922 - protein, 14 aa, Entamoeba dispar
IKTSKQIKDQEQQR

SEQ ID NO: 2365923 - protein, 7 aa, Entamoeba dispar
IKTSKSN

SEQ ID NO: 2365924 - protein, 8 aa, Entamoeba dispar
IKTSNENE

SEQ ID NO: 2365925 - protein, 9 aa, Entamoeba dispar
IKTSNETKS

SEQ ID NO: 2365926 - protein, 5 aa, Entamoeba dispar
IKYKN

SEQ ID NO: 2365927 - protein, 6 aa, Entamoeba dispar
IKYPAT

SEQ ID NO: 2365928 - protein, 7 aa, Entamoeba dispar
ILDQQNS

SEQ ID NO: 2365929 - protein, 8 aa, Entamoeba dispar
ILNGGTDD

SEQ ID NO: 2365930 - protein, 10 aa, Entamoeba dispar
ILNQPQETHQ

SEQ ID NO: 2365931 - protein, 11 aa, Entamoeba dispar
ILPDDSNKQRS

SEQ ID NO: 2365932 - protein, 6 aa, Entamoeba dispar
ILPNTN

SEQ ID NO: 2365933 - protein, 7 aa, Entamoeba dispar
ILSEEND

SEQ ID NO: 2365934 - protein, 6 aa, Entamoeba dispar
ILSSSN

SEQ ID NO: 2365935 - protein, 12 aa, Entamoeba dispar
ILTSEGKCVTAS

SEQ ID NO: 2365936 - protein, 7 aa, Entamoeba dispar
INAGEQG

SEQ ID NO: 2365937 - protein, 7 aa, Entamoeba dispar
INAKTEP

SEQ ID NO: 2365938 - protein, 10 aa, Entamoeba dispar
INARTESEKA

SEQ ID NO: 2365939 - protein, 4 aa, Entamoeba dispar
INDD

SEQ ID NO: 2365940 - protein, 5 aa, Entamoeba dispar
INDDQ

SEQ ID NO: 2365941 - protein, 9 aa, Entamoeba dispar
INDEENVGK

SEQ ID NO: 2365942 - protein, 5 aa, Entamoeba dispar
INDEK

SEQ ID NO: 2365943 - protein, 11 aa, Entamoeba dispar
INDKSTSKRKW

SEQ ID NO: 2365944 - protein, 16 aa, Entamoeba dispar
INDNDFKEAIDKANKK

SEQ ID NO: 2365945 - protein, 6 aa, Entamoeba dispar
INDPFQ

SEQ ID NO: 2365946 - protein, 4 aa, Entamoeba dispar
INDQ

SEQ ID NO: 2365947 - protein, 6 aa, Entamoeba dispar
INDSSH

SEQ ID NO: 2365948 - protein, 5 aa, Entamoeba dispar
INDTN

SEQ ID NO: 2365949 - protein, 12 aa, Entamoeba dispar
INDTTKPKQQTY

SEQ ID NO: 2365950 - protein, 27 aa, Entamoeba dispar
INEATKRIEEKENQKKKKKGKKEKGES

SEQ ID NO: 2365951 - protein, 9 aa, Entamoeba dispar
INEDDQLKE

SEQ ID NO: 2365952 - protein, 6 aa, Entamoeba dispar
INEDPK

SEQ ID NO: 2365953 - protein, 8 aa, Entamoeba dispar
INEDSTKC

SEQ ID NO: 2365954 - protein, 8 aa, Entamoeba dispar
INEEDNIS

SEQ ID NO: 2365955 - protein, 10 aa, Entamoeba dispar
INEEEVNELR

SEQ ID NO: 2365956 - protein, 9 aa, Entamoeba dispar
INEEKSREY

SEQ ID NO: 2365957 - protein, 4 aa, Entamoeba dispar
INEG

SEQ ID NO: 2365958 - protein, 9 aa, Entamoeba dispar
INEGGKTFA

SEQ ID NO: 2365959 - protein, 5 aa, Entamoeba dispar
INEGL

SEQ ID NO: 2365960 - protein, 11 aa, Entamoeba dispar
INEKDKEKYEY

SEQ ID NO: 2365961 - protein, 11 aa, Entamoeba dispar
INEKTKPKIAK

SEQ ID NO: 2365962 - protein, 9 aa, Entamoeba dispar
INELSEEKE

SEQ ID NO: 2365963 - protein, 9 aa, Entamoeba dispar
INENGRGME

SEQ ID NO: 2365964 - protein, 6 aa, Entamoeba dispar
INENKT

SEQ ID NO: 2365965 - protein, 10 aa, Entamoeba dispar
INENNSSIIE

SEQ ID NO: 2365966 - protein, 9 aa, Entamoeba dispar
INEQKIQPT

SEQ ID NO: 2365967 - protein, 4 aa, Entamoeba dispar
INER

SEQ ID NO: 2365968 - protein, 16 aa, Entamoeba dispar
INERKTGNFEKRSREI

SEQ ID NO: 2365969 - protein, 14 aa, Entamoeba dispar
INERSLSQSGKHIK

SEQ ID NO: 2365970 - protein, 6 aa, Entamoeba dispar
INEVPR

SEQ ID NO: 2365971 - protein, 4 aa, Entamoeba dispar
INEY

SEQ ID NO: 2365972 - protein, 8 aa, Entamoeba dispar
INGDMTTV

SEQ ID NO: 2365973 - protein, 8 aa, Entamoeba dispar
INGEGSKK

SEQ ID NO: 2365974 - protein, 11 aa, Entamoeba dispar
INGENRDVDEQ

SEQ ID NO: 2365975 - protein, 9 aa, Entamoeba dispar
INGESPSIS

SEQ ID NO: 2365976 - protein, 12 aa, Entamoeba dispar
INGGNDKMKNSW

SEQ ID NO: 2365977 - protein, 6 aa, Entamoeba dispar
INGNDP

SEQ ID NO: 2365978 - protein, 16 aa, Entamoeba dispar
INGNKNSITLSQNQYN

SEQ ID NO: 2365979 - protein, 6 aa, Entamoeba dispar
INGNNQ

SEQ ID NO: 2365980 - protein, 7 aa, Entamoeba dispar
INGNQYD

SEQ ID NO: 2365981 - protein, 7 aa, Entamoeba dispar
INGNTIR

SEQ ID NO: 2365982 - protein, 8 aa, Entamoeba dispar
INGPKNTF

SEQ ID NO: 2365983 - protein, 4 aa, Entamoeba dispar
INGR

SEQ ID NO: 2365984 - protein, 6 aa, Entamoeba dispar
INGYGK

SEQ ID NO: 2365985 - protein, 23 aa, Entamoeba dispar
INHKTDDTDEVINENKKENNLGK

SEQ ID NO: 2365986 - protein, 8 aa, Entamoeba dispar
INHPQPPK

SEQ ID NO: 2365987 - protein, 6 aa, Entamoeba dispar
ININNG

SEQ ID NO: 2365988 - protein, 5 aa, Entamoeba dispar
INKAP

SEQ ID NO: 2365989 - protein, 13 aa, Entamoeba dispar
INKEEQDPSKIYN

SEQ ID NO: 2365990 - protein, 9 aa, Entamoeba dispar
INKELEEKD

SEQ ID NO: 2365991 - protein, 6 aa, Entamoeba dispar
INKENS

SEQ ID NO: 2365992 - protein, 11 aa, Entamoeba dispar
INKGNLPESIY

SEQ ID NO: 2365993 - protein, 9 aa, Entamoeba dispar
INKNGNSRI

SEQ ID NO: 2365994 - protein, 9 aa, Entamoeba dispar
INKNNEVHS

SEQ ID NO: 2365995 - protein, 7 aa, Entamoeba dispar
INKPEQF

SEQ ID NO: 2365996 - protein, 8 aa, Entamoeba dispar
INKPTNPS

SEQ ID NO: 2365997 - protein, 4 aa, Entamoeba dispar
INKQ

SEQ ID NO: 2365998 - protein, 4 aa, Entamoeba dispar
INKR

SEQ ID NO: 2365999 - protein, 12 aa, Entamoeba dispar
INKTDSETTENI

SEQ ID NO: 2366000 - protein, 22 aa, Entamoeba dispar
INNCTGKELSIKGESVTITNSK

SEQ ID NO: 2366001 - protein, 4 aa, Entamoeba dispar
INNI

SEQ ID NO: 2366002 - protein, 4 aa, Entamoeba dispar
INNK

SEQ ID NO: 2366003 - protein, 15 aa, Entamoeba dispar
INNNGGDNDGKSQYP

SEQ ID NO: 2366004 - protein, 18 aa, Entamoeba dispar
INNNNKEIKEEKQEIKEI

SEQ ID NO: 2366005 - protein, 6 aa, Entamoeba dispar
INNPNE

SEQ ID NO: 2366006 - protein, 6 aa, Entamoeba dispar
INNPPK

SEQ ID NO: 2366007 - protein, 28 aa, Entamoeba dispar
INNQNTRPHQNSYHQEYQQPYSGYSYFP

SEQ ID NO: 2366008 - protein, 8 aa, Entamoeba dispar
INNREYDN

SEQ ID NO: 2366009 - protein, 7 aa, Entamoeba dispar
INNTQPL

SEQ ID NO: 2366010 - protein, 8 aa, Entamoeba dispar
INNTSNTD

SEQ ID NO: 2366011 - protein, 13 aa, Entamoeba dispar
INPKSATLKPGTA

SEQ ID NO: 2366012 - protein, 7 aa, Entamoeba dispar
INPLNSN

SEQ ID NO: 2366013 - protein, 10 aa, Entamoeba dispar
INPPDNDSEV

SEQ ID NO: 2366014 - protein, 7 aa, Entamoeba dispar
INPQGTV

SEQ ID NO: 2366015 - protein, 7 aa, Entamoeba dispar
INPSPNQ

SEQ ID NO: 2366016 - protein, 7 aa, Entamoeba dispar
INPSSTM

SEQ ID NO: 2366017 - protein, 8 aa, Entamoeba dispar
INPSTGGS

SEQ ID NO: 2366018 - protein, 5 aa, Entamoeba dispar
INPTI

SEQ ID NO: 2366019 - protein, 7 aa, Entamoeba dispar
INPTTNG

SEQ ID NO: 2366020 - protein, 57 aa, Entamoeba dispar
INQENKNNKEIDNKEIEINQNEEEIKSEEENLISEEEEIESDNERIGSEEEEEEKIK

SEQ ID NO: 2366021 - protein, 5 aa, Entamoeba dispar
INQNE

SEQ ID NO: 2366022 - protein, 10 aa, Entamoeba dispar
INQNEEENYE

SEQ ID NO: 2366023 - protein, 8 aa, Entamoeba dispar
INQNNGTV

SEQ ID NO: 2366024 - protein, 8 aa, Entamoeba dispar
INQNTGSE

SEQ ID NO: 2366025 - protein, 17 aa, Entamoeba dispar
INQQAKASTKSAPNYPQ

SEQ ID NO: 2366026 - protein, 9 aa, Entamoeba dispar
INQQENSTL

SEQ ID NO: 2366027 - protein, 5 aa, Entamoeba dispar
INQQK

SEQ ID NO: 2366028 - protein, 7 aa, Entamoeba dispar
INQSNQN

SEQ ID NO: 2366029 - protein, 8 aa, Entamoeba dispar
INQTSDGS

SEQ ID NO: 2366030 - protein, 6 aa, Entamoeba dispar
INRDAP

SEQ ID NO: 2366031 - protein, 13 aa, Entamoeba dispar
INRNGGNEYDESG

SEQ ID NO: 2366032 - protein, 5 aa, Entamoeba dispar
INRPT

SEQ ID NO: 2366033 - protein, 6 aa, Entamoeba dispar
INRTGG

SEQ ID NO: 2366034 - protein, 15 aa, Entamoeba dispar
INSAASESNTGSTQC

SEQ ID NO: 2366035 - protein, 8 aa, Entamoeba dispar
INSEIDYK

SEQ ID NO: 2366036 - protein, 8 aa, Entamoeba dispar
INSENIKN

SEQ ID NO: 2366037 - protein, 14 aa, Entamoeba dispar
INSGKIKENLNDGI

SEQ ID NO: 2366038 - protein, 8 aa, Entamoeba dispar
INSHEDPG

SEQ ID NO: 2366039 - protein, 7 aa, Entamoeba dispar
INSKPTK

SEQ ID NO: 2366040 - protein, 9 aa, Entamoeba dispar
INSNDNKEW

SEQ ID NO: 2366041 - protein, 5 aa, Entamoeba dispar
INSPN

SEQ ID NO: 2366042 - protein, 8 aa, Entamoeba dispar
INSPRGKV

SEQ ID NO: 2366043 - protein, 8 aa, Entamoeba dispar
INSPTGYP

SEQ ID NO: 2366044 - protein, 16 aa, Entamoeba dispar
INSSSFDRSIETPRSK

SEQ ID NO: 2366045 - protein, 8 aa, Entamoeba dispar
INSSSQPI

SEQ ID NO: 2366046 - protein, 6 aa, Entamoeba dispar
INSSTT

SEQ ID NO: 2366047 - protein, 8 aa, Entamoeba dispar
INSTETKT

SEQ ID NO: 2366048 - protein, 10 aa, Entamoeba dispar
INSTQPDSLK

SEQ ID NO: 2366049 - protein, 10 aa, Entamoeba dispar
INTDETQQLN

SEQ ID NO: 2366050 - protein, 9 aa, Entamoeba dispar
INTETKNET

SEQ ID NO: 2366051 - protein, 7 aa, Entamoeba dispar
INTGENK

SEQ ID NO: 2366052 - protein, 8 aa, Entamoeba dispar
INTNEKGI

SEQ ID NO: 2366053 - protein, 9 aa, Entamoeba dispar
INTNETIKP

SEQ ID NO: 2366054 - protein, 11 aa, Entamoeba dispar
INTNQTSIKPK

SEQ ID NO: 2366055 - protein, 6 aa, Entamoeba dispar
INTNSH

SEQ ID NO: 2366056 - protein, 7 aa, Entamoeba dispar
INTNTVS

SEQ ID NO: 2366057 - protein, 13 aa, Entamoeba dispar
INTPPSKEAKYEI

SEQ ID NO: 2366058 - protein, 14 aa, Entamoeba dispar
INTRSKKLDSLLTL

SEQ ID NO: 2366059 - protein, 24 aa, Entamoeba dispar
INTSKSQQQIKYQSTNVPLFDFTL

SEQ ID NO: 2366060 - protein, 20 aa, Entamoeba dispar
INTTTAQGVSNDNSTLTNPL

SEQ ID NO: 2366061 - protein, 5 aa, Entamoeba dispar
INVDD

SEQ ID NO: 2366062 - protein, 14 aa, Entamoeba dispar
INVQSITGSCDNTE

SEQ ID NO: 2366063 - protein, 7 aa, Entamoeba dispar
INVSGRS

SEQ ID NO: 2366064 - protein, 5 aa, Entamoeba dispar
INYGT

SEQ ID NO: 2366065 - protein, 12 aa, Entamoeba dispar
INYSTSKRLQND

SEQ ID NO: 2366066 - protein, 4 aa, Entamoeba dispar
IPAD

SEQ ID NO: 2366067 - protein, 4 aa, Entamoeba dispar
IPCS

SEQ ID NO: 2366068 - protein, 6 aa, Entamoeba dispar
IPDDEE

SEQ ID NO: 2366069 - protein, 12 aa, Entamoeba dispar
IPDNNDNSHDGS

SEQ ID NO: 2366070 - protein, 5 aa, Entamoeba dispar
IPDNT

SEQ ID NO: 2366071 - protein, 11 aa, Entamoeba dispar
IPDPDNPGSCM

SEQ ID NO: 2366072 - protein, 4 aa, Entamoeba dispar
IPDS

SEQ ID NO: 2366073 - protein, 13 aa, Entamoeba dispar
IPDTSSPSESSLS

SEQ ID NO: 2366074 - protein, 4 aa, Entamoeba dispar
IPDV

SEQ ID NO: 2366075 - protein, 12 aa, Entamoeba dispar
IPEDWPKEGKIE

SEQ ID NO: 2366076 - protein, 4 aa, Entamoeba dispar
IPEE

SEQ ID NO: 2366077 - protein, 8 aa, Entamoeba dispar
IPEGSQKI

SEQ ID NO: 2366078 - protein, 4 aa, Entamoeba dispar
IPEL

SEQ ID NO: 2366079 - protein, 12 aa, Entamoeba dispar
IPESVSSFNKSV

SEQ ID NO: 2366080 - protein, 6 aa, Entamoeba dispar
IPETPR

SEQ ID NO: 2366081 - protein, 13 aa, Entamoeba dispar
IPGAEIKECPENS

SEQ ID NO: 2366082 - protein, 4 aa, Entamoeba dispar
IPGE

SEQ ID NO: 2366083 - protein, 10 aa, Entamoeba dispar
IPGKKQCGEA

SEQ ID NO: 2366084 - protein, 20 aa, Entamoeba dispar
IPGQPGLPNQQSQQTTFQTY

SEQ ID NO: 2366085 - protein, 12 aa, Entamoeba dispar
IPGSKLPELPTH

SEQ ID NO: 2366086 - protein, 6 aa, Entamoeba dispar
IPHNTA

SEQ ID NO: 2366087 - protein, 15 aa, Entamoeba dispar
IPIEDNEPSSLSRKS

SEQ ID NO: 2366088 - protein, 11 aa, Entamoeba dispar
IPIRRDSDYQI

SEQ ID NO: 2366089 - protein, 12 aa, Entamoeba dispar
IPKEGKVTISTK

SEQ ID NO: 2366090 - protein, 7 aa, Entamoeba dispar
IPKHENN

SEQ ID NO: 2366091 - protein, 7 aa, Entamoeba dispar
IPKPENT

SEQ ID NO: 2366092 - protein, 7 aa, Entamoeba dispar
IPKPSIQ

SEQ ID NO: 2366093 - protein, 10 aa, Entamoeba dispar
IPKQPNGKYD

SEQ ID NO: 2366094 - protein, 6 aa, Entamoeba dispar
IPKRPQ

SEQ ID NO: 2366095 - protein, 12 aa, Entamoeba dispar
IPKRTPSSRECF

SEQ ID NO: 2366096 - protein, 4 aa, Entamoeba dispar
IPLN

SEQ ID NO: 2366097 - protein, 4 aa, Entamoeba dispar
IPLP

SEQ ID NO: 2366098 - protein, 40 aa, Entamoeba dispar
IPLPTQSSIKSKSISDNTHNSSSVSIEKSLKDKPNQKSYT

SEQ ID NO: 2366099 - protein, 5 aa, Entamoeba dispar
IPMEE

SEQ ID NO: 2366100 - protein, 6 aa, Entamoeba dispar
IPNDDD

SEQ ID NO: 2366101 - protein, 8 aa, Entamoeba dispar
IPNEDDSV

SEQ ID NO: 2366102 - protein, 8 aa, Entamoeba dispar
IPNEERAE

SEQ ID NO: 2366103 - protein, 4 aa, Entamoeba dispar
IPNG

SEQ ID NO: 2366104 - protein, 9 aa, Entamoeba dispar
IPNNGECPK

SEQ ID NO: 2366105 - protein, 5 aa, Entamoeba dispar
IPNSN

SEQ ID NO: 2366106 - protein, 4 aa, Entamoeba dispar
IPNT

SEQ ID NO: 2366107 - protein, 10 aa, Entamoeba dispar
IPNTLNGKNI

SEQ ID NO: 2366108 - protein, 11 aa, Entamoeba dispar
IPNYQKESIGH

SEQ ID NO: 2366109 - protein, 8 aa, Entamoeba dispar
IPPAPTRT

SEQ ID NO: 2366110 - protein, 13 aa, Entamoeba dispar
IPPKDNVNDTSPL

SEQ ID NO: 2366111 - protein, 6 aa, Entamoeba dispar
IPPQPI

SEQ ID NO: 2366112 - protein, 4 aa, Entamoeba dispar
IPQE

SEQ ID NO: 2366113 - protein, 6 aa, Entamoeba dispar
IPQLGA

SEQ ID NO: 2366114 - protein, 5 aa, Entamoeba dispar
IPRNI

SEQ ID NO: 2366115 - protein, 6 aa, Entamoeba dispar
IPRQTN

SEQ ID NO: 2366116 - protein, 6 aa, Entamoeba dispar
IPRSKE

SEQ ID NO: 2366117 - protein, 10 aa, Entamoeba dispar
IPRSRKVGQS

SEQ ID NO: 2366118 - protein, 11 aa, Entamoeba dispar
IPRTLKQRKKN

SEQ ID NO: 2366119 - protein, 8 aa, Entamoeba dispar
IPSEESSS

SEQ ID NO: 2366120 - protein, 10 aa, Entamoeba dispar
IPSEHPENHK

SEQ ID NO: 2366121 - protein, 15 aa, Entamoeba dispar
IPSELQGNKPSSEIQ

SEQ ID NO: 2366122 - protein, 7 aa, Entamoeba dispar
IPSGKGI

SEQ ID NO: 2366123 - protein, 4 aa, Entamoeba dispar
IPSI

SEQ ID NO: 2366124 - protein, 5 aa, Entamoeba dispar
IPSKL

SEQ ID NO: 2366125 - protein, 6 aa, Entamoeba dispar
IPSQNN

SEQ ID NO: 2366126 - protein, 44 aa, Entamoeba dispar
IPSSDSSSSLPPSPDASSNQPSTSSSAPSPSGESSNNAEDNNGV

SEQ ID NO: 2366127 - protein, 11 aa, Entamoeba dispar
IPSSKSFERSE

SEQ ID NO: 2366128 - protein, 6 aa, Entamoeba dispar
IPSSLR

SEQ ID NO: 2366129 - protein, 5 aa, Entamoeba dispar
IPSSN

SEQ ID NO: 2366130 - protein, 4 aa, Entamoeba dispar
IPST

SEQ ID NO: 2366131 - protein, 4 aa, Entamoeba dispar
IPSV

SEQ ID NO: 2366132 - protein, 4 aa, Entamoeba dispar
IPTI

SEQ ID NO: 2366133 - protein, 17 aa, Entamoeba dispar
IPTNEEAETKQRNEEYG

SEQ ID NO: 2366134 - protein, 78 aa, Entamoeba dispar
IPTNPFDEPTTPTHTTTNPFDEPSSKQVPSTNPFDEPSTQQQSLSPKKSINPFENSYSPKRYQNKTTTITPSQTQSCQ

SEQ ID NO: 2366135 - protein, 18 aa, Entamoeba dispar
IPTPPNEDIDSPEEKITK

SEQ ID NO: 2366136 - protein, 11 aa, Entamoeba dispar
IPTTSNEYLKT

SEQ ID NO: 2366137 - protein, 5 aa, Entamoeba dispar
IPYGT

SEQ ID NO: 2366138 - protein, 4 aa, Entamoeba dispar
IPYP

SEQ ID NO: 2366139 - protein, 4 aa, Entamoeba dispar
IPYS

SEQ ID NO: 2366140 - protein, 6 aa, Entamoeba dispar
IQDALQ

SEQ ID NO: 2366141 - protein, 9 aa, Entamoeba dispar
IQDDEADKV

SEQ ID NO: 2366142 - protein, 8 aa, Entamoeba dispar
IQDKQSDP

SEQ ID NO: 2366143 - protein, 12 aa, Entamoeba dispar
IQDPAKESKSHY

SEQ ID NO: 2366144 - protein, 29 aa, Entamoeba dispar
IQEEDDEQGTGPKLLPQDESQEAQQQAKI

SEQ ID NO: 2366145 - protein, 26 aa, Entamoeba dispar
IQEEEEKEKAKKIREENAERMEKEKA

SEQ ID NO: 2366146 - protein, 4 aa, Entamoeba dispar
IQEK

SEQ ID NO: 2366147 - protein, 11 aa, Entamoeba dispar
IQEKPQQELTQ

SEQ ID NO: 2366148 - protein, 12 aa, Entamoeba dispar
IQEQDGKISNTP

SEQ ID NO: 2366149 - protein, 13 aa, Entamoeba dispar
IQETDKDQETHTK

SEQ ID NO: 2366150 - protein, 5 aa, Entamoeba dispar
IQETI

SEQ ID NO: 2366151 - protein, 4 aa, Entamoeba dispar
IQGD

SEQ ID NO: 2366152 - protein, 6 aa, Entamoeba dispar
IQGNGE

SEQ ID NO: 2366153 - protein, 5 aa, Entamoeba dispar
IQIGG

SEQ ID NO: 2366154 - protein, 64 aa, Entamoeba dispar
IQINNKEKQVNDKEREINDKERKINDKERKINDKERKINDKEREINQKKEQLDTRTKEQEQSLN

SEQ ID NO: 2366155 - protein, 4 aa, Entamoeba dispar
IQIT

SEQ ID NO: 2366156 - protein, 12 aa, Entamoeba dispar
IQKLQKKNNNQM

SEQ ID NO: 2366157 - protein, 10 aa, Entamoeba dispar
IQKNNDKLEN

SEQ ID NO: 2366158 - protein, 8 aa, Entamoeba dispar
IQKSSAVS

SEQ ID NO: 2366159 - protein, 11 aa, Entamoeba dispar
IQLQNNTSGYI

SEQ ID NO: 2366160 - protein, 4 aa, Entamoeba dispar
IQNE

SEQ ID NO: 2366161 - protein, 10 aa, Entamoeba dispar
IQNGKTKEFI

SEQ ID NO: 2366162 - protein, 10 aa, Entamoeba dispar
IQNNDGNTPL

SEQ ID NO: 2366163 - protein, 9 aa, Entamoeba dispar
IQNNPKESD

SEQ ID NO: 2366164 - protein, 9 aa, Entamoeba dispar
IQNNQQDTT

SEQ ID NO: 2366165 - protein, 5 aa, Entamoeba dispar
IQNNS

SEQ ID NO: 2366166 - protein, 7 aa, Entamoeba dispar
IQNQTNN

SEQ ID NO: 2366167 - protein, 10 aa, Entamoeba dispar
IQNSSDNEIE

SEQ ID NO: 2366168 - protein, 12 aa, Entamoeba dispar
IQPATEQEVKSI

SEQ ID NO: 2366169 - protein, 14 aa, Entamoeba dispar
IQPERSDPSNYDGG

SEQ ID NO: 2366170 - protein, 9 aa, Entamoeba dispar
IQPKEESNL

SEQ ID NO: 2366171 - protein, 7 aa, Entamoeba dispar
IQPKGFS

SEQ ID NO: 2366172 - protein, 12 aa, Entamoeba dispar
IQPLADDEGNVQ

SEQ ID NO: 2366173 - protein, 16 aa, Entamoeba dispar
IQPSGSVLNANDDFER

SEQ ID NO: 2366174 - protein, 4 aa, Entamoeba dispar
IQPT

SEQ ID NO: 2366175 - protein, 41 aa, Entamoeba dispar
IQQKKESKKKNNKKTIKTNKKKNKKRVKGLKKSKENEEEFQ

SEQ ID NO: 2366176 - protein, 7 aa, Entamoeba dispar
IQQPYAP

SEQ ID NO: 2366177 - protein, 15 aa, Entamoeba dispar
IQQSSLSESSKEKEK

SEQ ID NO: 2366178 - protein, 17 aa, Entamoeba dispar
IQQSSSSSSSSDSTSSS

SEQ ID NO: 2366179 - protein, 7 aa, Entamoeba dispar
IQRTHKE

SEQ ID NO: 2366180 - protein, 9 aa, Entamoeba dispar
IQRTPISDQ

SEQ ID NO: 2366181 - protein, 5 aa, Entamoeba dispar
IQSAG

SEQ ID NO: 2366182 - protein, 11 aa, Entamoeba dispar
IQSGNKISGYT

SEQ ID NO: 2366183 - protein, 5 aa, Entamoeba dispar
IQSKD

SEQ ID NO: 2366184 - protein, 10 aa, Entamoeba dispar
IQSNNKPDSI

SEQ ID NO: 2366185 - protein, 5 aa, Entamoeba dispar
IQSSN

SEQ ID NO: 2366186 - protein, 9 aa, Entamoeba dispar
IQSSTDDIN

SEQ ID NO: 2366187 - protein, 15 aa, Entamoeba dispar
IQTASSSLPGSLKDT

SEQ ID NO: 2366188 - protein, 9 aa, Entamoeba dispar
IQTEENKKR

SEQ ID NO: 2366189 - protein, 5 aa, Entamoeba dispar
IQTEI

SEQ ID NO: 2366190 - protein, 10 aa, Entamoeba dispar
IQTKDNDDWG

SEQ ID NO: 2366191 - protein, 4 aa, Entamoeba dispar
IQTN

SEQ ID NO: 2366192 - protein, 5 aa, Entamoeba dispar
IQTNQ

SEQ ID NO: 2366193 - protein, 10 aa, Entamoeba dispar
IQTNSSPDME

SEQ ID NO: 2366194 - protein, 6 aa, Entamoeba dispar
IQTQET

SEQ ID NO: 2366195 - protein, 10 aa, Entamoeba dispar
IRAGERPQFK

SEQ ID NO: 2366196 - protein, 15 aa, Entamoeba dispar
IRDEKEKINAQESIR

SEQ ID NO: 2366197 - protein, 11 aa, Entamoeba dispar
IRDGTAPNELL

SEQ ID NO: 2366198 - protein, 5 aa, Entamoeba dispar
IRDTE

SEQ ID NO: 2366199 - protein, 6 aa, Entamoeba dispar
IREEDS

SEQ ID NO: 2366200 - protein, 15 aa, Entamoeba dispar
IRGESSERMVDTTGI

SEQ ID NO: 2366201 - protein, 9 aa, Entamoeba dispar
IRGKNVPRY

SEQ ID NO: 2366202 - protein, 9 aa, Entamoeba dispar
IRGKSVPRY

SEQ ID NO: 2366203 - protein, 5 aa, Entamoeba dispar
IRGRE

SEQ ID NO: 2366204 - protein, 5 aa, Entamoeba dispar
IRKDS

SEQ ID NO: 2366205 - protein, 11 aa, Entamoeba dispar
IRKENDTIPVS

SEQ ID NO: 2366206 - protein, 13 aa, Entamoeba dispar
IRKERKKRKSYYN

SEQ ID NO: 2366207 - protein, 12 aa, Entamoeba dispar
IRKKKNKKKYNG

SEQ ID NO: 2366208 - protein, 8 aa, Entamoeba dispar
IRKNNSEN

SEQ ID NO: 2366209 - protein, 5 aa, Entamoeba dispar
IRKTR

SEQ ID NO: 2366210 - protein, 8 aa, Entamoeba dispar
IRNKSGNK

SEQ ID NO: 2366211 - protein, 9 aa, Entamoeba dispar
IRNTPTSEE

SEQ ID NO: 2366212 - protein, 5 aa, Entamoeba dispar
IRPDK

SEQ ID NO: 2366213 - protein, 27 aa, Entamoeba dispar
IRPKSQDNFDDSITSPTKTNQVKSNSL

SEQ ID NO: 2366214 - protein, 7 aa, Entamoeba dispar
IRPTNSK

SEQ ID NO: 2366215 - protein, 12 aa, Entamoeba dispar
IRQPDNTYLTTT

SEQ ID NO: 2366216 - protein, 4 aa, Entamoeba dispar
IRSD

SEQ ID NO: 2366217 - protein, 5 aa, Entamoeba dispar
IRSDP

SEQ ID NO: 2366218 - protein, 12 aa, Entamoeba dispar
IRSNNQSELNDD

SEQ ID NO: 2366219 - protein, 7 aa, Entamoeba dispar
IRSPKNS

SEQ ID NO: 2366220 - protein, 8 aa, Entamoeba dispar
IRSSSSDA

SEQ ID NO: 2366221 - protein, 6 aa, Entamoeba dispar
IRSTYK

SEQ ID NO: 2366222 - protein, 4 aa, Entamoeba dispar
IRTN

SEQ ID NO: 2366223 - protein, 5 aa, Entamoeba dispar
IRTNP

SEQ ID NO: 2366224 - protein, 6 aa, Entamoeba dispar
IRTNSN

SEQ ID NO: 2366225 - protein, 5 aa, Entamoeba dispar
IRTQI

SEQ ID NO: 2366226 - protein, 9 aa, Entamoeba dispar
IRTSNGQET

SEQ ID NO: 2366227 - protein, 6 aa, Entamoeba dispar
IRTSPQ

SEQ ID NO: 2366228 - protein, 17 aa, Entamoeba dispar
ISAASSFADIDGDDALN

SEQ ID NO: 2366229 - protein, 11 aa, Entamoeba dispar
ISAGERPETIN

SEQ ID NO: 2366230 - protein, 12 aa, Entamoeba dispar
ISAKSGTERKAK

SEQ ID NO: 2366231 - protein, 9 aa, Entamoeba dispar
ISATKVSGS

SEQ ID NO: 2366232 - protein, 7 aa, Entamoeba dispar
ISDASDN

SEQ ID NO: 2366233 - protein, 4 aa, Entamoeba dispar
ISDE

SEQ ID NO: 2366234 - protein, 11 aa, Entamoeba dispar
ISDESKPKTKI

SEQ ID NO: 2366235 - protein, 16 aa, Entamoeba dispar
ISDESSNSSKYYDSGA

SEQ ID NO: 2366236 - protein, 5 aa, Entamoeba dispar
ISDGS

SEQ ID NO: 2366237 - protein, 6 aa, Entamoeba dispar
ISDISP

SEQ ID NO: 2366238 - protein, 7 aa, Entamoeba dispar
ISDNAKC

SEQ ID NO: 2366239 - protein, 6 aa, Entamoeba dispar
ISDNRQ

SEQ ID NO: 2366240 - protein, 14 aa, Entamoeba dispar
ISDTPAAQTCETSY

SEQ ID NO: 2366241 - protein, 6 aa, Entamoeba dispar
ISDTPI

SEQ ID NO: 2366242 - protein, 4 aa, Entamoeba dispar
ISDV

SEQ ID NO: 2366243 - protein, 11 aa, Entamoeba dispar
ISEENSYSTED

SEQ ID NO: 2366244 - protein, 8 aa, Entamoeba dispar
ISEKEIKN

SEQ ID NO: 2366245 - protein, 41 aa, Entamoeba dispar
ISENEQINSTPETKAEKASNRIKERKQNNLNKEKHRENERI

SEQ ID NO: 2366246 - protein, 41 aa, Entamoeba dispar
ISENETDKLTNSQVRVGPNHEGSKPKLLTKAQRKSKKEEII

SEQ ID NO: 2366247 - protein, 12 aa, Entamoeba dispar
ISENKKRFSSME

SEQ ID NO: 2366248 - protein, 7 aa, Entamoeba dispar
ISEPNDP

SEQ ID NO: 2366249 - protein, 10 aa, Entamoeba dispar
ISEPSKQVYE

SEQ ID NO: 2366250 - protein, 6 aa, Entamoeba dispar
ISEQRH

SEQ ID NO: 2366251 - protein, 20 aa, Entamoeba dispar
ISERNRLNKELTQGIGTPTY

SEQ ID NO: 2366252 - protein, 6 aa, Entamoeba dispar
ISERSL

SEQ ID NO: 2366253 - protein, 8 aa, Entamoeba dispar
ISESSDSC

SEQ ID NO: 2366254 - protein, 12 aa, Entamoeba dispar
ISETEISQVDST

SEQ ID NO: 2366255 - protein, 5 aa, Entamoeba dispar
ISFNG

SEQ ID NO: 2366256 - protein, 7 aa, Entamoeba dispar
ISGEEGL

SEQ ID NO: 2366257 - protein, 19 aa, Entamoeba dispar
ISGKEEKEKKEEKGDSMDT

SEQ ID NO: 2366258 - protein, 6 aa, Entamoeba dispar
ISGNEL

SEQ ID NO: 2366259 - protein, 6 aa, Entamoeba dispar
ISGREQ

SEQ ID NO: 2366260 - protein, 25 aa, Entamoeba dispar
ISGSESASVSESGRNEVASVGGGEW

SEQ ID NO: 2366261 - protein, 8 aa, Entamoeba dispar
ISGSFNNE

SEQ ID NO: 2366262 - protein, 13 aa, Entamoeba dispar
ISINGECQSTTTL

SEQ ID NO: 2366263 - protein, 6 aa, Entamoeba dispar
ISIPNE

SEQ ID NO: 2366264 - protein, 4 aa, Entamoeba dispar
ISKA

SEQ ID NO: 2366265 - protein, 10 aa, Entamoeba dispar
ISKENETKEE

SEQ ID NO: 2366266 - protein, 10 aa, Entamoeba dispar
ISKEQTKESL

SEQ ID NO: 2366267 - protein, 12 aa, Entamoeba dispar
ISKGKRPNIPNT

SEQ ID NO: 2366268 - protein, 10 aa, Entamoeba dispar
ISKGSEGCMK

SEQ ID NO: 2366269 - protein, 4 aa, Entamoeba dispar
ISKK

SEQ ID NO: 2366270 - protein, 11 aa, Entamoeba dispar
ISKKTKQIHND

SEQ ID NO: 2366271 - protein, 9 aa, Entamoeba dispar
ISKNENTTT

SEQ ID NO: 2366272 - protein, 5 aa, Entamoeba dispar
ISKNS

SEQ ID NO: 2366273 - protein, 8 aa, Entamoeba dispar
ISKTTNVS

SEQ ID NO: 2366274 - protein, 10 aa, Entamoeba dispar
ISKYSGSEKL

SEQ ID NO: 2366275 - protein, 5 aa, Entamoeba dispar
ISMDN

SEQ ID NO: 2366276 - protein, 8 aa, Entamoeba dispar
ISNAEEKI

SEQ ID NO: 2366277 - protein, 14 aa, Entamoeba dispar
ISNDDEYGITAYTQ

SEQ ID NO: 2366278 - protein, 18 aa, Entamoeba dispar
ISNELREKLSDAKNNEEF

SEQ ID NO: 2366279 - protein, 7 aa, Entamoeba dispar
ISNENKK

SEQ ID NO: 2366280 - protein, 9 aa, Entamoeba dispar
ISNGQNEFK

SEQ ID NO: 2366281 - protein, 9 aa, Entamoeba dispar
ISNGQSEFK

SEQ ID NO: 2366282 - protein, 4 aa, Entamoeba dispar
ISNH

SEQ ID NO: 2366283 - protein, 8 aa, Entamoeba dispar
ISNNLKPD

SEQ ID NO: 2366284 - protein, 7 aa, Entamoeba dispar
ISNNSKN

SEQ ID NO: 2366285 - protein, 9 aa, Entamoeba dispar
ISNQNGNQR

SEQ ID NO: 2366286 - protein, 5 aa, Entamoeba dispar
ISNQP

SEQ ID NO: 2366287 - protein, 10 aa, Entamoeba dispar
ISNREGSKEC

SEQ ID NO: 2366288 - protein, 6 aa, Entamoeba dispar
ISNSQL

SEQ ID NO: 2366289 - protein, 7 aa, Entamoeba dispar
ISNSTKE

SEQ ID NO: 2366290 - protein, 9 aa, Entamoeba dispar
ISNTESGKN

SEQ ID NO: 2366291 - protein, 4 aa, Entamoeba dispar
ISNY

SEQ ID NO: 2366292 - protein, 5 aa, Entamoeba dispar
ISNYQ

SEQ ID NO: 2366293 - protein, 8 aa, Entamoeba dispar
ISPESSAR

SEQ ID NO: 2366294 - protein, 10 aa, Entamoeba dispar
ISPEVSEETP

SEQ ID NO: 2366295 - protein, 6 aa, Entamoeba dispar
ISPGAE

SEQ ID NO: 2366296 - protein, 4 aa, Entamoeba dispar
ISPM

SEQ ID NO: 2366297 - protein, 18 aa, Entamoeba dispar
ISPNSTPLNNGPILPTGP

SEQ ID NO: 2366298 - protein, 8 aa, Entamoeba dispar
ISPPETDE

SEQ ID NO: 2366299 - protein, 6 aa, Entamoeba dispar
ISPQQT

SEQ ID NO: 2366300 - protein, 14 aa, Entamoeba dispar
ISPSLNGNGPKGFG

SEQ ID NO: 2366301 - protein, 19 aa, Entamoeba dispar
ISPTPVKNENDSLKQSRQQ

SEQ ID NO: 2366302 - protein, 5 aa, Entamoeba dispar
ISPWT

SEQ ID NO: 2366303 - protein, 8 aa, Entamoeba dispar
ISQDATSL

SEQ ID NO: 2366304 - protein, 7 aa, Entamoeba dispar
ISQEKNI

SEQ ID NO: 2366305 - protein, 22 aa, Entamoeba dispar
ISQKEEKEIELTNNKESEVRVE

SEQ ID NO: 2366306 - protein, 6 aa, Entamoeba dispar
ISQQDQ

SEQ ID NO: 2366307 - protein, 11 aa, Entamoeba dispar
ISQSNSSSNEL

SEQ ID NO: 2366308 - protein, 8 aa, Entamoeba dispar
ISQTTHGS

SEQ ID NO: 2366309 - protein, 4 aa, Entamoeba dispar
ISRD

SEQ ID NO: 2366310 - protein, 11 aa, Entamoeba dispar
ISRDPKEYETE

SEQ ID NO: 2366311 - protein, 14 aa, Entamoeba dispar
ISRKSNINNCTPTN

SEQ ID NO: 2366312 - protein, 12 aa, Entamoeba dispar
ISRRSDFGDTVP

SEQ ID NO: 2366313 - protein, 5 aa, Entamoeba dispar
ISRSA

SEQ ID NO: 2366314 - protein, 6 aa, Entamoeba dispar
ISRTPQ

SEQ ID NO: 2366315 - protein, 21 aa, Entamoeba dispar
ISSEKEENISENEFNKNKQIS

SEQ ID NO: 2366316 - protein, 9 aa, Entamoeba dispar
ISSKDAWSR

SEQ ID NO: 2366317 - protein, 11 aa, Entamoeba dispar
ISSLPNEKHDL

SEQ ID NO: 2366318 - protein, 10 aa, Entamoeba dispar
ISSNNTNNIS

SEQ ID NO: 2366319 - protein, 12 aa, Entamoeba dispar
ISSPITTERART

SEQ ID NO: 2366320 - protein, 6 aa, Entamoeba dispar
ISSSDI

SEQ ID NO: 2366321 - protein, 8 aa, Entamoeba dispar
ISSSNSFD

SEQ ID NO: 2366322 - protein, 12 aa, Entamoeba dispar
ISSTLPKSYGGK

SEQ ID NO: 2366323 - protein, 4 aa, Entamoeba dispar
ISTA

SEQ ID NO: 2366324 - protein, 10 aa, Entamoeba dispar
ISTAKALGAQ

SEQ ID NO: 2366325 - protein, 8 aa, Entamoeba dispar
ISTDNDYS

SEQ ID NO: 2366326 - protein, 19 aa, Entamoeba dispar
ISTDNGTKCQECDENQAPY

SEQ ID NO: 2366327 - protein, 4 aa, Entamoeba dispar
ISTE

SEQ ID NO: 2366328 - protein, 8 aa, Entamoeba dispar
ISTEMDSV

SEQ ID NO: 2366329 - protein, 8 aa, Entamoeba dispar
ISTFSPSN

SEQ ID NO: 2366330 - protein, 10 aa, Entamoeba dispar
ISTGDGLQLS

SEQ ID NO: 2366331 - protein, 5 aa, Entamoeba dispar
ISTGN

SEQ ID NO: 2366332 - protein, 7 aa, Entamoeba dispar
ISTINGG

SEQ ID NO: 2366333 - protein, 10 aa, Entamoeba dispar
ISTNDKNTKV

SEQ ID NO: 2366334 - protein, 6 aa, Entamoeba dispar
ISTNPD

SEQ ID NO: 2366335 - protein, 6 aa, Entamoeba dispar
ISTNSS

SEQ ID NO: 2366336 - protein, 5 aa, Entamoeba dispar
ISTPK

SEQ ID NO: 2366337 - protein, 6 aa, Entamoeba dispar
ISTRTA

SEQ ID NO: 2366338 - protein, 33 aa, Entamoeba dispar
ISTSKSDKSNKSQRSGRSSLSSLSNQNSTSSEE

SEQ ID NO: 2366339 - protein, 11 aa, Entamoeba dispar
ISTTDESISEF

SEQ ID NO: 2366340 - protein, 8 aa, Entamoeba dispar
ISTTGSTL

SEQ ID NO: 2366341 - protein, 6 aa, Entamoeba dispar
ISTTIN

SEQ ID NO: 2366342 - protein, 8 aa, Entamoeba dispar
ISTTQTIN

SEQ ID NO: 2366343 - protein, 12 aa, Entamoeba dispar
ISTYAQSAANKV

SEQ ID NO: 2366344 - protein, 14 aa, Entamoeba dispar
ISVESGIPDFRSSN

SEQ ID NO: 2366345 - protein, 18 aa, Entamoeba dispar
ISVPSTTTIETNNNNIQP

SEQ ID NO: 2366346 - protein, 7 aa, Entamoeba dispar
ISYSTSS

SEQ ID NO: 2366347 - protein, 6 aa, Entamoeba dispar
ISYTDG

SEQ ID NO: 2366348 - protein, 10 aa, Entamoeba dispar
ISYTQTGDQL

SEQ ID NO: 2366349 - protein, 7 aa, Entamoeba dispar
ITAKYKA

SEQ ID NO: 2366350 - protein, 5 aa, Entamoeba dispar
ITANT

SEQ ID NO: 2366351 - protein, 11 aa, Entamoeba dispar
ITAPTYVGSDR

SEQ ID NO: 2366352 - protein, 18 aa, Entamoeba dispar
ITASGSCTGSVYTSGKFN

SEQ ID NO: 2366353 - protein, 9 aa, Entamoeba dispar
ITDDSNRVQ

SEQ ID NO: 2366354 - protein, 10 aa, Entamoeba dispar
ITDESTKERL

SEQ ID NO: 2366355 - protein, 7 aa, Entamoeba dispar
ITDSRTK

SEQ ID NO: 2366356 - protein, 17 aa, Entamoeba dispar
ITEAKIDEDTVESLSIS

SEQ ID NO: 2366357 - protein, 4 aa, Entamoeba dispar
ITED

SEQ ID NO: 2366358 - protein, 10 aa, Entamoeba dispar
ITEKDEREDL

SEQ ID NO: 2366359 - protein, 6 aa, Entamoeba dispar
ITEKNK

SEQ ID NO: 2366360 - protein, 4 aa, Entamoeba dispar
ITEL

SEQ ID NO: 2366361 - protein, 7 aa, Entamoeba dispar
ITEPPKY

SEQ ID NO: 2366362 - protein, 9 aa, Entamoeba dispar
ITERNERVR

SEQ ID NO: 2366363 - protein, 9 aa, Entamoeba dispar
ITESKGKWS

SEQ ID NO: 2366364 - protein, 15 aa, Entamoeba dispar
ITESYKNLPDKEQAR

SEQ ID NO: 2366365 - protein, 8 aa, Entamoeba dispar
ITETNKPD

SEQ ID NO: 2366366 - protein, 11 aa, Entamoeba dispar
ITGEAEKTPVR

SEQ ID NO: 2366367 - protein, 5 aa, Entamoeba dispar
ITGSC

SEQ ID NO: 2366368 - protein, 5 aa, Entamoeba dispar
ITGTR

SEQ ID NO: 2366369 - protein, 8 aa, Entamoeba dispar
ITGTTTND

SEQ ID NO: 2366370 - protein, 5 aa, Entamoeba dispar
ITHSP

SEQ ID NO: 2366371 - protein, 5 aa, Entamoeba dispar
ITIKT

SEQ ID NO: 2366372 - protein, 5 aa, Entamoeba dispar
ITISG

SEQ ID NO: 2366373 - protein, 9 aa, Entamoeba dispar
ITKHDEKEL

SEQ ID NO: 2366374 - protein, 4 aa, Entamoeba dispar
ITKK

SEQ ID NO: 2366375 - protein, 8 aa, Entamoeba dispar
ITKKGKAI

SEQ ID NO: 2366376 - protein, 7 aa, Entamoeba dispar
ITKKSNR

SEQ ID NO: 2366377 - protein, 10 aa, Entamoeba dispar
ITKNDQKDTN

SEQ ID NO: 2366378 - protein, 9 aa, Entamoeba dispar
ITKPQTTRY

SEQ ID NO: 2366379 - protein, 5 aa, Entamoeba dispar
ITKRG

SEQ ID NO: 2366380 - protein, 17 aa, Entamoeba dispar
ITKSTNIDISDSQSYTL

SEQ ID NO: 2366381 - protein, 6 aa, Entamoeba dispar
ITLEDQ

SEQ ID NO: 2366382 - protein, 10 aa, Entamoeba dispar
ITLSGGQKQR

SEQ ID NO: 2366383 - protein, 14 aa, Entamoeba dispar
ITMKEGVDKVKAQA

SEQ ID NO: 2366384 - protein, 7 aa, Entamoeba dispar
ITNASDT

SEQ ID NO: 2366385 - protein, 10 aa, Entamoeba dispar
ITNEEARKDN

SEQ ID NO: 2366386 - protein, 7 aa, Entamoeba dispar
ITNEKEE

SEQ ID NO: 2366387 - protein, 13 aa, Entamoeba dispar
ITNESYDDHTLSP

SEQ ID NO: 2366388 - protein, 11 aa, Entamoeba dispar
ITNITPSNQPV

SEQ ID NO: 2366389 - protein, 4 aa, Entamoeba dispar
ITNK

SEQ ID NO: 2366390 - protein, 10 aa, Entamoeba dispar
ITNKDDSFTD

SEQ ID NO: 2366391 - protein, 11 aa, Entamoeba dispar
ITNKENNKSNA

SEQ ID NO: 2366392 - protein, 15 aa, Entamoeba dispar
ITNKKEIEIGEGEEM

SEQ ID NO: 2366393 - protein, 4 aa, Entamoeba dispar
ITNN

SEQ ID NO: 2366394 - protein, 21 aa, Entamoeba dispar
ITNNEISQHKNENNDIQQHPS

SEQ ID NO: 2366395 - protein, 9 aa, Entamoeba dispar
ITNNSTVNK

SEQ ID NO: 2366396 - protein, 7 aa, Entamoeba dispar
ITNQVTS

SEQ ID NO: 2366397 - protein, 7 aa, Entamoeba dispar
ITNRGKG

SEQ ID NO: 2366398 - protein, 9 aa, Entamoeba dispar
ITNSDNTIT

SEQ ID NO: 2366399 - protein, 7 aa, Entamoeba dispar
ITNSNEK

SEQ ID NO: 2366400 - protein, 6 aa, Entamoeba dispar
ITNSPT

SEQ ID NO: 2366401 - protein, 7 aa, Entamoeba dispar
ITNTGRI

SEQ ID NO: 2366402 - protein, 4 aa, Entamoeba dispar
ITNV

SEQ ID NO: 2366403 - protein, 5 aa, Entamoeba dispar
ITNYD

SEQ ID NO: 2366404 - protein, 5 aa, Entamoeba dispar
ITPDF

SEQ ID NO: 2366405 - protein, 9 aa, Entamoeba dispar
ITPGASGGY

SEQ ID NO: 2366406 - protein, 5 aa, Entamoeba dispar
ITPNE

SEQ ID NO: 2366407 - protein, 15 aa, Entamoeba dispar
ITPPQSISPQTLSGI

SEQ ID NO: 2366408 - protein, 9 aa, Entamoeba dispar
ITPQTNVPT

SEQ ID NO: 2366409 - protein, 6 aa, Entamoeba dispar
ITPSSQ

SEQ ID NO: 2366410 - protein, 6 aa, Entamoeba dispar
ITPTPS

SEQ ID NO: 2366411 - protein, 24 aa, Entamoeba dispar
ITPTQVNDQIQERKLSNSSYRNTL

SEQ ID NO: 2366412 - protein, 5 aa, Entamoeba dispar
ITPTT

SEQ ID NO: 2366413 - protein, 9 aa, Entamoeba dispar
ITPVKGQLA

SEQ ID NO: 2366414 - protein, 4 aa, Entamoeba dispar
ITQG

SEQ ID NO: 2366415 - protein, 8 aa, Entamoeba dispar
ITQPEQSI

SEQ ID NO: 2366416 - protein, 7 aa, Entamoeba dispar
ITQQHSG

SEQ ID NO: 2366417 - protein, 12 aa, Entamoeba dispar
ITQSENNESTTI

SEQ ID NO: 2366418 - protein, 12 aa, Entamoeba dispar
ITRSRSKSRLGI

SEQ ID NO: 2366419 - protein, 4 aa, Entamoeba dispar
ITRY

SEQ ID NO: 2366420 - protein, 15 aa, Entamoeba dispar
ITSEELKKRRRAERF

SEQ ID NO: 2366421 - protein, 5 aa, Entamoeba dispar
ITSET

SEQ ID NO: 2366422 - protein, 6 aa, Entamoeba dispar
ITSGSG

SEQ ID NO: 2366423 - protein, 21 aa, Entamoeba dispar
ITSKINKQIEEKRKEEIPQKN

SEQ ID NO: 2366424 - protein, 11 aa, Entamoeba dispar
ITSKSSNDKYF

SEQ ID NO: 2366425 - protein, 9 aa, Entamoeba dispar
ITSNNPRIS

SEQ ID NO: 2366426 - protein, 12 aa, Entamoeba dispar
ITSPQPQSPSLF

SEQ ID NO: 2366427 - protein, 6 aa, Entamoeba dispar
ITSSKN

SEQ ID NO: 2366428 - protein, 4 aa, Entamoeba dispar
ITTG

SEQ ID NO: 2366429 - protein, 9 aa, Entamoeba dispar
ITTGKRPTI

SEQ ID NO: 2366430 - protein, 7 aa, Entamoeba dispar
ITTGQSK

SEQ ID NO: 2366431 - protein, 7 aa, Entamoeba dispar
ITTKRNI

SEQ ID NO: 2366432 - protein, 7 aa, Entamoeba dispar
ITTNADN

SEQ ID NO: 2366433 - protein, 8 aa, Entamoeba dispar
ITTPPHLG

SEQ ID NO: 2366434 - protein, 9 aa, Entamoeba dispar
ITTPSGVTR

SEQ ID NO: 2366435 - protein, 4 aa, Entamoeba dispar
ITTR

SEQ ID NO: 2366436 - protein, 4 aa, Entamoeba dispar
ITTT

SEQ ID NO: 2366437 - protein, 18 aa, Entamoeba dispar
ITTTSSASPWQENCQPTC

SEQ ID NO: 2366438 - protein, 4 aa, Entamoeba dispar
ITYT

SEQ ID NO: 2366439 - protein, 9 aa, Entamoeba dispar
IVEDEENKQ

SEQ ID NO: 2366440 - protein, 5 aa, Entamoeba dispar
IVKQP

SEQ ID NO: 2366441 - protein, 13 aa, Entamoeba dispar
IVNEQQNNIPIPT

SEQ ID NO: 2366442 - protein, 7 aa, Entamoeba dispar
IVQGGEH

SEQ ID NO: 2366443 - protein, 21 aa, Entamoeba dispar
IVQPTETKDVIDNSSVQIDRN

SEQ ID NO: 2366444 - protein, 17 aa, Entamoeba dispar
IVSGNNFGGKFTESSEG

SEQ ID NO: 2366445 - protein, 8 aa, Entamoeba dispar
IVTPTTTI

SEQ ID NO: 2366446 - protein, 4 aa, Entamoeba dispar
IYDG

SEQ ID NO: 2366447 - protein, 15 aa, Entamoeba dispar
IYDSDEGKFGGKENG

SEQ ID NO: 2366448 - protein, 11 aa, Entamoeba dispar
IYEGNNQFSIP

SEQ ID NO: 2366449 - protein, 9 aa, Entamoeba dispar
IYKNDRKND

SEQ ID NO: 2366450 - protein, 14 aa, Entamoeba dispar
IYKTDAKKYHIGSG

SEQ ID NO: 2366451 - protein, 23 aa, Entamoeba dispar
IYNTTKSFPLPDHRSSALSAQGS

SEQ ID NO: 2366452 - protein, 6 aa, Entamoeba dispar
IYPGTR

SEQ ID NO: 2366453 - protein, 7 aa, Entamoeba dispar
IYSDRRD

SEQ ID NO: 2366454 - protein, 8 aa, Entamoeba dispar
KAAAGRTS

SEQ ID NO: 2366455 - protein, 5 aa, Entamoeba dispar
KAAGL

SEQ ID NO: 2366456 - protein, 6 aa, Entamoeba dispar
KAAINS

SEQ ID NO: 2366457 - protein, 8 aa, Entamoeba dispar
KAANDALE

SEQ ID NO: 2366458 - protein, 14 aa, Entamoeba dispar
KAASETKNDNSSKL

SEQ ID NO: 2366459 - protein, 4 aa, Entamoeba dispar
KACS

SEQ ID NO: 2366460 - protein, 4 aa, Entamoeba dispar
KADL

SEQ ID NO: 2366461 - protein, 5 aa, Entamoeba dispar
KADMA

SEQ ID NO: 2366462 - protein, 8 aa, Entamoeba dispar
KADNIEGS

SEQ ID NO: 2366463 - protein, 7 aa, Entamoeba dispar
KADRTSN

SEQ ID NO: 2366464 - protein, 5 aa, Entamoeba dispar
KADSD

SEQ ID NO: 2366465 - protein, 4 aa, Entamoeba dispar
KAED

SEQ ID NO: 2366466 - protein, 8 aa, Entamoeba dispar
KAEEENGK

SEQ ID NO: 2366467 - protein, 10 aa, Entamoeba dispar
KAEEQPNKSV

SEQ ID NO: 2366468 - protein, 7 aa, Entamoeba dispar
KAEESLK

SEQ ID NO: 2366469 - protein, 8 aa, Entamoeba dispar
KAENPDLQ

SEQ ID NO: 2366470 - protein, 13 aa, Entamoeba dispar
KAENVKPENDDED

SEQ ID NO: 2366471 - protein, 16 aa, Entamoeba dispar
KAENVKPENDDEESTI

SEQ ID NO: 2366472 - protein, 13 aa, Entamoeba dispar
KAEREQNQIHGST

SEQ ID NO: 2366473 - protein, 12 aa, Entamoeba dispar
KAGLTTTEGSSY

SEQ ID NO: 2366474 - protein, 11 aa, Entamoeba dispar
KAGNFSSDTGL

SEQ ID NO: 2366475 - protein, 7 aa, Entamoeba dispar
KAGQTRV

SEQ ID NO: 2366476 - protein, 7 aa, Entamoeba dispar
KAHCSPQ

SEQ ID NO: 2366477 - protein, 8 aa, Entamoeba dispar
KAHSVDNN

SEQ ID NO: 2366478 - protein, 8 aa, Entamoeba dispar
KAKAEAEK

SEQ ID NO: 2366479 - protein, 9 aa, Entamoeba dispar
KAKDSISET

SEQ ID NO: 2366480 - protein, 28 aa, Entamoeba dispar
KAKEEQQQKEEDSLNKNNELNDKTKEKS

SEQ ID NO: 2366481 - protein, 9 aa, Entamoeba dispar
KAKEKAKPK

SEQ ID NO: 2366482 - protein, 15 aa, Entamoeba dispar
KAKERNIQQDRNEMR

SEQ ID NO: 2366483 - protein, 10 aa, Entamoeba dispar
KAKETKTEQE

SEQ ID NO: 2366484 - protein, 7 aa, Entamoeba dispar
KAKGKIK

SEQ ID NO: 2366485 - protein, 17 aa, Entamoeba dispar
KAKIKTKKYEMTNDGEC

SEQ ID NO: 2366486 - protein, 16 aa, Entamoeba dispar
KAKKAQEKETEVIETT

SEQ ID NO: 2366487 - protein, 10 aa, Entamoeba dispar
KAKSLKDCEP

SEQ ID NO: 2366488 - protein, 8 aa, Entamoeba dispar
KALEEAHE

SEQ ID NO: 2366489 - protein, 9 aa, Entamoeba dispar
KALEENDRI

SEQ ID NO: 2366490 - protein, 21 aa, Entamoeba dispar
KALQETGISGTSFTISPSEIQ

SEQ ID NO: 2366491 - protein, 14 aa, Entamoeba dispar
KALSSDEKVFNENK

SEQ ID NO: 2366492 - protein, 24 aa, Entamoeba dispar
KALSSTTPKIVNDNESVSSTDSRE

SEQ ID NO: 2366493 - protein, 4 aa, Entamoeba dispar
KAMQ

SEQ ID NO: 2366494 - protein, 9 aa, Entamoeba dispar
KANDSLRQA

SEQ ID NO: 2366495 - protein, 18 aa, Entamoeba dispar
KANESSTTMDDLVIPFYL

SEQ ID NO: 2366496 - protein, 6 aa, Entamoeba dispar
KANEYG

SEQ ID NO: 2366497 - protein, 8 aa, Entamoeba dispar
KANGLSNQ

SEQ ID NO: 2366498 - protein, 6 aa, Entamoeba dispar
KANHCT

SEQ ID NO: 2366499 - protein, 13 aa, Entamoeba dispar
KANMSNDKTKIHE

SEQ ID NO: 2366500 - protein, 6 aa, Entamoeba dispar
KANNLE

SEQ ID NO: 2366501 - protein, 4 aa, Entamoeba dispar
KANQ

SEQ ID NO: 2366502 - protein, 6 aa, Entamoeba dispar
KAPALD

SEQ ID NO: 2366503 - protein, 5 aa, Entamoeba dispar
KAPEF

SEQ ID NO: 2366504 - protein, 6 aa, Entamoeba dispar
KAPKHI

SEQ ID NO: 2366505 - protein, 4 aa, Entamoeba dispar
KAPS

SEQ ID NO: 2366506 - protein, 11 aa, Entamoeba dispar
KAPSPLTNEVR

SEQ ID NO: 2366507 - protein, 13 aa, Entamoeba dispar
KAPTTTCQPDKNK

SEQ ID NO: 2366508 - protein, 7 aa, Entamoeba dispar
KAPVPYD

SEQ ID NO: 2366509 - protein, 7 aa, Entamoeba dispar
KAQAGGF

SEQ ID NO: 2366510 - protein, 4 aa, Entamoeba dispar
KAQE

SEQ ID NO: 2366511 - protein, 6 aa, Entamoeba dispar
KAQEKS

SEQ ID NO: 2366512 - protein, 4 aa, Entamoeba dispar
KAQM

SEQ ID NO: 2366513 - protein, 7 aa, Entamoeba dispar
KAQPGNN

SEQ ID NO: 2366514 - protein, 6 aa, Entamoeba dispar
KAQSIV

SEQ ID NO: 2366515 - protein, 6 aa, Entamoeba dispar
KARVSG

SEQ ID NO: 2366516 - protein, 8 aa, Entamoeba dispar
KASCNNAE

SEQ ID NO: 2366517 - protein, 8 aa, Entamoeba dispar
KASESGED

SEQ ID NO: 2366518 - protein, 8 aa, Entamoeba dispar
KASGEHDK

SEQ ID NO: 2366519 - protein, 9 aa, Entamoeba dispar
KASGNKEIK

SEQ ID NO: 2366520 - protein, 6 aa, Entamoeba dispar
KASMNT

SEQ ID NO: 2366521 - protein, 6 aa, Entamoeba dispar
KASNNT

SEQ ID NO: 2366522 - protein, 8 aa, Entamoeba dispar
KASREENV

SEQ ID NO: 2366523 - protein, 10 aa, Entamoeba dispar
KATDSKGISN

SEQ ID NO: 2366524 - protein, 6 aa, Entamoeba dispar
KATESF

SEQ ID NO: 2366525 - protein, 7 aa, Entamoeba dispar
KATGPLN

SEQ ID NO: 2366526 - protein, 6 aa, Entamoeba dispar
KATIND

SEQ ID NO: 2366527 - protein, 9 aa, Entamoeba dispar
KATKGKCEE

SEQ ID NO: 2366528 - protein, 10 aa, Entamoeba dispar
KATKPNPVHL

SEQ ID NO: 2366529 - protein, 5 aa, Entamoeba dispar
KATLN

SEQ ID NO: 2366530 - protein, 13 aa, Entamoeba dispar
KATTENEKEKAIN

SEQ ID NO: 2366531 - protein, 5 aa, Entamoeba dispar
KATVR

SEQ ID NO: 2366532 - protein, 16 aa, Entamoeba dispar
KAVEEIKQAETYQKAT

SEQ ID NO: 2366533 - protein, 12 aa, Entamoeba dispar
KAVQESSSSSSD

SEQ ID NO: 2366534 - protein, 37 aa, Entamoeba dispar
KAVSKGVQHPRSNKTFKEKDEEKLKSLGGFQEGVVII

SEQ ID NO: 2366535 - protein, 11 aa, Entamoeba dispar
KAYCKNKSKAL

SEQ ID NO: 2366536 - protein, 4 aa, Entamoeba dispar
KCDE

SEQ ID NO: 2366537 - protein, 11 aa, Entamoeba dispar
KCDPSCSTCSK

SEQ ID NO: 2366538 - protein, 9 aa, Entamoeba dispar
KCDPSSSTI

SEQ ID NO: 2366539 - protein, 11 aa, Entamoeba dispar
KCDSAEGSSNQ

SEQ ID NO: 2366540 - protein, 11 aa, Entamoeba dispar
KCEAKKFKKSL

SEQ ID NO: 2366541 - protein, 7 aa, Entamoeba dispar
KCEDKTN

SEQ ID NO: 2366542 - protein, 9 aa, Entamoeba dispar
KCESSDGLK

SEQ ID NO: 2366543 - protein, 10 aa, Entamoeba dispar
KCGDDGKWSN

SEQ ID NO: 2366544 - protein, 11 aa, Entamoeba dispar
KCGENDDGTCK

SEQ ID NO: 2366545 - protein, 5 aa, Entamoeba dispar
KCGGG

SEQ ID NO: 2366546 - protein, 8 aa, Entamoeba dispar
KCGGKGVV

SEQ ID NO: 2366547 - protein, 10 aa, Entamoeba dispar
KCGKCDDGEY

SEQ ID NO: 2366548 - protein, 9 aa, Entamoeba dispar
KCGNDNKWT

SEQ ID NO: 2366549 - protein, 19 aa, Entamoeba dispar
KCGNGKLDEEEECDNGDGC

SEQ ID NO: 2366550 - protein, 22 aa, Entamoeba dispar
KCGNGKLDNEEECDNSVEGYQD

SEQ ID NO: 2366551 - protein, 12 aa, Entamoeba dispar
KCKEGNFLSDDG

SEQ ID NO: 2366552 - protein, 14 aa, Entamoeba dispar
KCKQNEKDKSYSCE

SEQ ID NO: 2366553 - protein, 11 aa, Entamoeba dispar
KCKRSGTIGSD

SEQ ID NO: 2366554 - protein, 4 aa, Entamoeba dispar
KCKS

SEQ ID NO: 2366555 - protein, 6 aa, Entamoeba dispar
KCLSNK

SEQ ID NO: 2366556 - protein, 6 aa, Entamoeba dispar
KCLTDQ

SEQ ID NO: 2366557 - protein, 6 aa, Entamoeba dispar
KCNEYN

SEQ ID NO: 2366558 - protein, 8 aa, Entamoeba dispar
KCNGDETC

SEQ ID NO: 2366559 - protein, 15 aa, Entamoeba dispar
KCNPNTQYLSKEDNK

SEQ ID NO: 2366560 - protein, 9 aa, Entamoeba dispar
KCNQDNGHG

SEQ ID NO: 2366561 - protein, 8 aa, Entamoeba dispar
KCNQNTEV

SEQ ID NO: 2366562 - protein, 9 aa, Entamoeba dispar
KCNSPDNTW

SEQ ID NO: 2366563 - protein, 12 aa, Entamoeba dispar
KCPAGSASAVRN

SEQ ID NO: 2366564 - protein, 9 aa, Entamoeba dispar
KCPSANKLK

SEQ ID NO: 2366565 - protein, 7 aa, Entamoeba dispar
KCPSGSS

SEQ ID NO: 2366566 - protein, 5 aa, Entamoeba dispar
KCPTT

SEQ ID NO: 2366567 - protein, 9 aa, Entamoeba dispar
KCQEKRKRM

SEQ ID NO: 2366568 - protein, 11 aa, Entamoeba dispar
KCQENCTKCSN

SEQ ID NO: 2366569 - protein, 5 aa, Entamoeba dispar
KCQNC

SEQ ID NO: 2366570 - protein, 11 aa, Entamoeba dispar
KCRGGPPLRST

SEQ ID NO: 2366571 - protein, 17 aa, Entamoeba dispar
KCSKEKYDDIKDETRGC

SEQ ID NO: 2366572 - protein, 15 aa, Entamoeba dispar
KCSKERYDDIKDEVR

SEQ ID NO: 2366573 - protein, 8 aa, Entamoeba dispar
KCSKGYYK

SEQ ID NO: 2366574 - protein, 12 aa, Entamoeba dispar
KCSKKEYKEEFK

SEQ ID NO: 2366575 - protein, 6 aa, Entamoeba dispar
KCSPCP

SEQ ID NO: 2366576 - protein, 11 aa, Entamoeba dispar
KCSPSTCNNGV

SEQ ID NO: 2366577 - protein, 9 aa, Entamoeba dispar
KCSPTNDCD

SEQ ID NO: 2366578 - protein, 6 aa, Entamoeba dispar
KCSSDS

SEQ ID NO: 2366579 - protein, 13 aa, Entamoeba dispar
KCSSGYTPEGKYC

SEQ ID NO: 2366580 - protein, 10 aa, Entamoeba dispar
KCTAENTDIG

SEQ ID NO: 2366581 - protein, 18 aa, Entamoeba dispar
KCTGSTSISNELEGDYTK

SEQ ID NO: 2366582 - protein, 18 aa, Entamoeba dispar
KCTPCSSKYQNCSTCNST

SEQ ID NO: 2366583 - protein, 7 aa, Entamoeba dispar
KCTSRQD

SEQ ID NO: 2366584 - protein, 8 aa, Entamoeba dispar
KCVSNQQD

SEQ ID NO: 2366585 - protein, 11 aa, Entamoeba dispar
KDAASPEDQER

SEQ ID NO: 2366586 - protein, 7 aa, Entamoeba dispar
KDAFSPP

SEQ ID NO: 2366587 - protein, 6 aa, Entamoeba dispar
KDAKDL

SEQ ID NO: 2366588 - protein, 6 aa, Entamoeba dispar
KDAKQN

SEQ ID NO: 2366589 - protein, 10 aa, Entamoeba dispar
KDCEDPEDCE

SEQ ID NO: 2366590 - protein, 6 aa, Entamoeba dispar
KDCENL

SEQ ID NO: 2366591 - protein, 8 aa, Entamoeba dispar
KDCKADKI

SEQ ID NO: 2366592 - protein, 16 aa, Entamoeba dispar
KDCQPGYYKNTTGKSC

SEQ ID NO: 2366593 - protein, 11 aa, Entamoeba dispar
KDDDPNQIPID

SEQ ID NO: 2366594 - protein, 9 aa, Entamoeba dispar
KDDDSTHLT

SEQ ID NO: 2366595 - protein, 7 aa, Entamoeba dispar
KDDGSTL

SEQ ID NO: 2366596 - protein, 11 aa, Entamoeba dispar
KDDKNKKINKQ

SEQ ID NO: 2366597 - protein, 7 aa, Entamoeba dispar
KDDKTNV

SEQ ID NO: 2366598 - protein, 7 aa, Entamoeba dispar
KDDNGDI

SEQ ID NO: 2366599 - protein, 11 aa, Entamoeba dispar
KDDNKCSHQNN

SEQ ID NO: 2366600 - protein, 5 aa, Entamoeba dispar
KDDPI

SEQ ID NO: 2366601 - protein, 7 aa, Entamoeba dispar
KDDRYNQ

SEQ ID NO: 2366602 - protein, 16 aa, Entamoeba dispar
KDDSPYNNSYFELTQF

SEQ ID NO: 2366603 - protein, 11 aa, Entamoeba dispar
KDEEESTKTCH

SEQ ID NO: 2366604 - protein, 9 aa, Entamoeba dispar
KDEEIEENG

SEQ ID NO: 2366605 - protein, 8 aa, Entamoeba dispar
KDEETYTF

SEQ ID NO: 2366606 - protein, 5 aa, Entamoeba dispar
KDEEV

SEQ ID NO: 2366607 - protein, 4 aa, Entamoeba dispar
KDEI

SEQ ID NO: 2366608 - protein, 8 aa, Entamoeba dispar
KDEKAYST

SEQ ID NO: 2366609 - protein, 12 aa, Entamoeba dispar
KDEKQPLLTGVD

SEQ ID NO: 2366610 - protein, 30 aa, Entamoeba dispar
KDEKRISEEEVDDKIRKTKKRFDDVPKNDK

SEQ ID NO: 2366611 - protein, 11 aa, Entamoeba dispar
KDELPNNYDEI

SEQ ID NO: 2366612 - protein, 7 aa, Entamoeba dispar
KDENIRS

SEQ ID NO: 2366613 - protein, 9 aa, Entamoeba dispar
KDENQQRPS

SEQ ID NO: 2366614 - protein, 15 aa, Entamoeba dispar
KDEPVKSSLEEPATT

SEQ ID NO: 2366615 - protein, 6 aa, Entamoeba dispar
KDERVP

SEQ ID NO: 2366616 - protein, 7 aa, Entamoeba dispar
KDERYST

SEQ ID NO: 2366617 - protein, 8 aa, Entamoeba dispar
KDETRADL

SEQ ID NO: 2366618 - protein, 8 aa, Entamoeba dispar
KDETVNAK

SEQ ID NO: 2366619 - protein, 4 aa, Entamoeba dispar
KDFK

SEQ ID NO: 2366620 - protein, 6 aa, Entamoeba dispar
KDFTST

SEQ ID NO: 2366621 - protein, 10 aa, Entamoeba dispar
KDGEEEQLKE

SEQ ID NO: 2366622 - protein, 8 aa, Entamoeba dispar
KDGEKGQY

SEQ ID NO: 2366623 - protein, 13 aa, Entamoeba dispar
KDGEKPKIRENLK

SEQ ID NO: 2366624 - protein, 7 aa, Entamoeba dispar
KDGENIA

SEQ ID NO: 2366625 - protein, 6 aa, Entamoeba dispar
KDGETI

SEQ ID NO: 2366626 - protein, 10 aa, Entamoeba dispar
KDGEVKISET

SEQ ID NO: 2366627 - protein, 21 aa, Entamoeba dispar
KDGFEDRSGEANSKCTTLGGY

SEQ ID NO: 2366628 - protein, 9 aa, Entamoeba dispar
KDGFKTKEF

SEQ ID NO: 2366629 - protein, 9 aa, Entamoeba dispar
KDGIAKATS

SEQ ID NO: 2366630 - protein, 5 aa, Entamoeba dispar
KDGIK

SEQ ID NO: 2366631 - protein, 10 aa, Entamoeba dispar
KDGKGDPRIL

SEQ ID NO: 2366632 - protein, 7 aa, Entamoeba dispar
KDGNGDI

SEQ ID NO: 2366633 - protein, 9 aa, Entamoeba dispar
KDGRKQNNF

SEQ ID NO: 2366634 - protein, 28 aa, Entamoeba dispar
KDGVKTTTCKSTSKTTCDTNNKKIEEAR

SEQ ID NO: 2366635 - protein, 8 aa, Entamoeba dispar
KDGYEQTT

SEQ ID NO: 2366636 - protein, 8 aa, Entamoeba dispar
KDGYGGES

SEQ ID NO: 2366637 - protein, 8 aa, Entamoeba dispar
KDHMENNK

SEQ ID NO: 2366638 - protein, 17 aa, Entamoeba dispar
KDIAGAEVRNSTLPEEL

SEQ ID NO: 2366639 - protein, 4 aa, Entamoeba dispar
KDIC

SEQ ID NO: 2366640 - protein, 16 aa, Entamoeba dispar
KDIDKFNEKGISNDYV

SEQ ID NO: 2366641 - protein, 19 aa, Entamoeba dispar
KDIEDSKLLNNSNEKTRTK

SEQ ID NO: 2366642 - protein, 23 aa, Entamoeba dispar
KDIETKDITRKDNEGKTKENKKI

SEQ ID NO: 2366643 - protein, 4 aa, Entamoeba dispar
KDIK

SEQ ID NO: 2366644 - protein, 6 aa, Entamoeba dispar
KDINKT

SEQ ID NO: 2366645 - protein, 5 aa, Entamoeba dispar
KDIPT

SEQ ID NO: 2366646 - protein, 4 aa, Entamoeba dispar
KDIS

SEQ ID NO: 2366647 - protein, 6 aa, Entamoeba dispar
KDITKY

SEQ ID NO: 2366648 - protein, 7 aa, Entamoeba dispar
KDKEVNY

SEQ ID NO: 2366649 - protein, 6 aa, Entamoeba dispar
KDKGFR

SEQ ID NO: 2366650 - protein, 9 aa, Entamoeba dispar
KDKGGCEMT

SEQ ID NO: 2366651 - protein, 8 aa, Entamoeba dispar
KDKGLGTP

SEQ ID NO: 2366652 - protein, 6 aa, Entamoeba dispar
KDKIDL

SEQ ID NO: 2366653 - protein, 10 aa, Entamoeba dispar
KDKKPEVDQI

SEQ ID NO: 2366654 - protein, 7 aa, Entamoeba dispar
KDKNGDC

SEQ ID NO: 2366655 - protein, 9 aa, Entamoeba dispar
KDKNGDPVN

SEQ ID NO: 2366656 - protein, 8 aa, Entamoeba dispar
KDKNPIVS

SEQ ID NO: 2366657 - protein, 17 aa, Entamoeba dispar
KDKNRFEEVGKNADDKI

SEQ ID NO: 2366658 - protein, 6 aa, Entamoeba dispar
KDKPNL

SEQ ID NO: 2366659 - protein, 9 aa, Entamoeba dispar
KDKRPKNGG

SEQ ID NO: 2366660 - protein, 9 aa, Entamoeba dispar
KDKSDDRIR

SEQ ID NO: 2366661 - protein, 5 aa, Entamoeba dispar
KDKSN

SEQ ID NO: 2366662 - protein, 8 aa, Entamoeba dispar
KDKSTNKH

SEQ ID NO: 2366663 - protein, 10 aa, Entamoeba dispar
KDLHDNTQNE

SEQ ID NO: 2366664 - protein, 8 aa, Entamoeba dispar
KDLKDPNN

SEQ ID NO: 2366665 - protein, 4 aa, Entamoeba dispar
KDLL

SEQ ID NO: 2366666 - protein, 13 aa, Entamoeba dispar
KDLNESDDTKKYY

SEQ ID NO: 2366667 - protein, 8 aa, Entamoeba dispar
KDLQPGVR

SEQ ID NO: 2366668 - protein, 6 aa, Entamoeba dispar
KDNDNA

SEQ ID NO: 2366669 - protein, 7 aa, Entamoeba dispar
KDNEINN

SEQ ID NO: 2366670 - protein, 4 aa, Entamoeba dispar
KDNI

SEQ ID NO: 2366671 - protein, 5 aa, Entamoeba dispar
KDNIK

SEQ ID NO: 2366672 - protein, 12 aa, Entamoeba dispar
KDNKDLDLPSQR

SEQ ID NO: 2366673 - protein, 5 aa, Entamoeba dispar
KDNKK

SEQ ID NO: 2366674 - protein, 6 aa, Entamoeba dispar
KDNLDD

SEQ ID NO: 2366675 - protein, 7 aa, Entamoeba dispar
KDNNGEL

SEQ ID NO: 2366676 - protein, 8 aa, Entamoeba dispar
KDNNTTEK

SEQ ID NO: 2366677 - protein, 7 aa, Entamoeba dispar
KDNSLYK

SEQ ID NO: 2366678 - protein, 7 aa, Entamoeba dispar
KDNSSIT

SEQ ID NO: 2366679 - protein, 12 aa, Entamoeba dispar
KDNTKSITKSNF

SEQ ID NO: 2366680 - protein, 6 aa, Entamoeba dispar
KDNTNC

SEQ ID NO: 2366681 - protein, 7 aa, Entamoeba dispar
KDNTSKM

SEQ ID NO: 2366682 - protein, 7 aa, Entamoeba dispar
KDNVEKD

SEQ ID NO: 2366683 - protein, 13 aa, Entamoeba dispar
KDNVETDDTTTIN

SEQ ID NO: 2366684 - protein, 11 aa, Entamoeba dispar
KDNWKSSLARK

SEQ ID NO: 2366685 - protein, 5 aa, Entamoeba dispar
KDPDI

SEQ ID NO: 2366686 - protein, 8 aa, Entamoeba dispar
KDPDPSYS

SEQ ID NO: 2366687 - protein, 8 aa, Entamoeba dispar
KDPKETDK

SEQ ID NO: 2366688 - protein, 11 aa, Entamoeba dispar
KDPKSWEDATS

SEQ ID NO: 2366689 - protein, 5 aa, Entamoeba dispar
KDPNE

SEQ ID NO: 2366690 - protein, 6 aa, Entamoeba dispar
KDPQYV

SEQ ID NO: 2366691 - protein, 7 aa, Entamoeba dispar
KDPSSIS

SEQ ID NO: 2366692 - protein, 6 aa, Entamoeba dispar
KDPSTL

SEQ ID NO: 2366693 - protein, 9 aa, Entamoeba dispar
KDPYGAERG

SEQ ID NO: 2366694 - protein, 5 aa, Entamoeba dispar
KDPYV

SEQ ID NO: 2366695 - protein, 5 aa, Entamoeba dispar
KDQAG

SEQ ID NO: 2366696 - protein, 8 aa, Entamoeba dispar
KDQDIEKE

SEQ ID NO: 2366697 - protein, 16 aa, Entamoeba dispar
KDQIKKEYPSEKETSK

SEQ ID NO: 2366698 - protein, 8 aa, Entamoeba dispar
KDQINNKT

SEQ ID NO: 2366699 - protein, 15 aa, Entamoeba dispar
KDQKRNENGQGQDNY

SEQ ID NO: 2366700 - protein, 14 aa, Entamoeba dispar
KDQNGGDRKWRTKE

SEQ ID NO: 2366701 - protein, 23 aa, Entamoeba dispar
KDQNGKCNKNNNIQNCSNKSYVN

SEQ ID NO: 2366702 - protein, 11 aa, Entamoeba dispar
KDQNGKCNNNN

SEQ ID NO: 2366703 - protein, 12 aa, Entamoeba dispar
KDQNGKCNNNNI

SEQ ID NO: 2366704 - protein, 5 aa, Entamoeba dispar
KDQTL

SEQ ID NO: 2366705 - protein, 21 aa, Entamoeba dispar
KDRCTKCSSGRVNYDGTCPKC

SEQ ID NO: 2366706 - protein, 6 aa, Entamoeba dispar
KDRCTS

SEQ ID NO: 2366707 - protein, 4 aa, Entamoeba dispar
KDRI

SEQ ID NO: 2366708 - protein, 20 aa, Entamoeba dispar
KDRLNRDNVPTRKNTTQDNI

SEQ ID NO: 2366709 - protein, 8 aa, Entamoeba dispar
KDRQNERQ

SEQ ID NO: 2366710 - protein, 9 aa, Entamoeba dispar
KDRSHGDES

SEQ ID NO: 2366711 - protein, 5 aa, Entamoeba dispar
KDRTG

SEQ ID NO: 2366712 - protein, 5 aa, Entamoeba dispar
KDRVT

SEQ ID NO: 2366713 - protein, 7 aa, Entamoeba dispar
KDSALTR

SEQ ID NO: 2366714 - protein, 11 aa, Entamoeba dispar
KDSDNQNHCTQ

SEQ ID NO: 2366715 - protein, 7 aa, Entamoeba dispar
KDSGLTR

SEQ ID NO: 2366716 - protein, 5 aa, Entamoeba dispar
KDSLT

SEQ ID NO: 2366717 - protein, 4 aa, Entamoeba dispar
KDSN

SEQ ID NO: 2366718 - protein, 6 aa, Entamoeba dispar
KDSNYR

SEQ ID NO: 2366719 - protein, 7 aa, Entamoeba dispar
KDSNYRK

SEQ ID NO: 2366720 - protein, 4 aa, Entamoeba dispar
KDSP

SEQ ID NO: 2366721 - protein, 6 aa, Entamoeba dispar
KDSSAE

SEQ ID NO: 2366722 - protein, 5 aa, Entamoeba dispar
KDSSP

SEQ ID NO: 2366723 - protein, 8 aa, Entamoeba dispar
KDSSTEYR

SEQ ID NO: 2366724 - protein, 9 aa, Entamoeba dispar
KDSTLDKNG

SEQ ID NO: 2366725 - protein, 5 aa, Entamoeba dispar
KDSTN

SEQ ID NO: 2366726 - protein, 7 aa, Entamoeba dispar
KDSVSND

SEQ ID NO: 2366727 - protein, 9 aa, Entamoeba dispar
KDSYGITKK

SEQ ID NO: 2366728 - protein, 6 aa, Entamoeba dispar
KDTEKC

SEQ ID NO: 2366729 - protein, 6 aa, Entamoeba dispar
KDTIGT

SEQ ID NO: 2366730 - protein, 7 aa, Entamoeba dispar
KDTKGDV

SEQ ID NO: 2366731 - protein, 14 aa, Entamoeba dispar
KDTKGDVRFLTKGD

SEQ ID NO: 2366732 - protein, 15 aa, Entamoeba dispar
KDTKKQQKEEQFKEE

SEQ ID NO: 2366733 - protein, 8 aa, Entamoeba dispar
KDTKTQNF

SEQ ID NO: 2366734 - protein, 14 aa, Entamoeba dispar
KDTNDANEGTGKIT

SEQ ID NO: 2366735 - protein, 11 aa, Entamoeba dispar
KDTTGDGYGDI

SEQ ID NO: 2366736 - protein, 19 aa, Entamoeba dispar
KDVDDDDDKMNKENQGENY

SEQ ID NO: 2366737 - protein, 9 aa, Entamoeba dispar
KDVDKLSEQ

SEQ ID NO: 2366738 - protein, 10 aa, Entamoeba dispar
KDVGSSGGQY

SEQ ID NO: 2366739 - protein, 19 aa, Entamoeba dispar
KDVKNVAQEIGGKIDVQKE

SEQ ID NO: 2366740 - protein, 7 aa, Entamoeba dispar
KDVNGNP

SEQ ID NO: 2366741 - protein, 19 aa, Entamoeba dispar
KDVNGNSIIPKNGMSVKEG

SEQ ID NO: 2366742 - protein, 5 aa, Entamoeba dispar
KDVRK

SEQ ID NO: 2366743 - protein, 4 aa, Entamoeba dispar
KDVY

SEQ ID NO: 2366744 - protein, 14 aa, Entamoeba dispar
KDYEDSNNLTWSTT

SEQ ID NO: 2366745 - protein, 12 aa, Entamoeba dispar
KDYERNEKSTRI

SEQ ID NO: 2366746 - protein, 9 aa, Entamoeba dispar
KDYEYNRER

SEQ ID NO: 2366747 - protein, 4 aa, Entamoeba dispar
KDYI

SEQ ID NO: 2366748 - protein, 14 aa, Entamoeba dispar
KDYKSCPNTFNENA

SEQ ID NO: 2366749 - protein, 5 aa, Entamoeba dispar
KDYNK

SEQ ID NO: 2366750 - protein, 13 aa, Entamoeba dispar
KDYNTRPNDLNEI

SEQ ID NO: 2366751 - protein, 14 aa, Entamoeba dispar
KDYPKDKMEGDVPK

SEQ ID NO: 2366752 - protein, 6 aa, Entamoeba dispar
KDYSPY

SEQ ID NO: 2366753 - protein, 8 aa, Entamoeba dispar
KDYSSEYN

SEQ ID NO: 2366754 - protein, 8 aa, Entamoeba dispar
KDYTNTNE

SEQ ID NO: 2366755 - protein, 5 aa, Entamoeba dispar
KDYTS

SEQ ID NO: 2366756 - protein, 20 aa, Entamoeba dispar
KEAAGPDYKIPEEDAEFKPT

SEQ ID NO: 2366757 - protein, 15 aa, Entamoeba dispar
KEADDGCGKSSKSSI

SEQ ID NO: 2366758 - protein, 8 aa, Entamoeba dispar
KEADKEAY

SEQ ID NO: 2366759 - protein, 5 aa, Entamoeba dispar
KEAEK

SEQ ID NO: 2366760 - protein, 8 aa, Entamoeba dispar
KEAESDDK

SEQ ID NO: 2366761 - protein, 11 aa, Entamoeba dispar
KEAESTLTERQ

SEQ ID NO: 2366762 - protein, 9 aa, Entamoeba dispar
KEAHGDGGY

SEQ ID NO: 2366763 - protein, 7 aa, Entamoeba dispar
KEAKATL

SEQ ID NO: 2366764 - protein, 12 aa, Entamoeba dispar
KEAKIKEEQTKE

SEQ ID NO: 2366765 - protein, 9 aa, Entamoeba dispar
KEANESPLM

SEQ ID NO: 2366766 - protein, 10 aa, Entamoeba dispar
KEARNQGKTE

SEQ ID NO: 2366767 - protein, 11 aa, Entamoeba dispar
KEARYENKNHD

SEQ ID NO: 2366768 - protein, 8 aa, Entamoeba dispar
KEASEIEG

SEQ ID NO: 2366769 - protein, 8 aa, Entamoeba dispar
KEAVTPSI

SEQ ID NO: 2366770 - protein, 8 aa, Entamoeba dispar
KEAYKKKG

SEQ ID NO: 2366771 - protein, 6 aa, Entamoeba dispar
KECDQQ

SEQ ID NO: 2366772 - protein, 10 aa, Entamoeba dispar
KECGPTGFSS

SEQ ID NO: 2366773 - protein, 5 aa, Entamoeba dispar
KECGS

SEQ ID NO: 2366774 - protein, 4 aa, Entamoeba dispar
KECK

SEQ ID NO: 2366775 - protein, 6 aa, Entamoeba dispar
KECNCR

SEQ ID NO: 2366776 - protein, 16 aa, Entamoeba dispar
KECNNENDESFSQNSL

SEQ ID NO: 2366777 - protein, 9 aa, Entamoeba dispar
KECSPNTDS

SEQ ID NO: 2366778 - protein, 18 aa, Entamoeba dispar
KECSTKFGKDCKKCDEER

SEQ ID NO: 2366779 - protein, 8 aa, Entamoeba dispar
KECTSKGK

SEQ ID NO: 2366780 - protein, 6 aa, Entamoeba dispar
KEDAQV

SEQ ID NO: 2366781 - protein, 9 aa, Entamoeba dispar
KEDDTGKLT

SEQ ID NO: 2366782 - protein, 21 aa, Entamoeba dispar
KEDFASKKRFSVDQTQAIESN

SEQ ID NO: 2366783 - protein, 8 aa, Entamoeba dispar
KEDFETSV

SEQ ID NO: 2366784 - protein, 6 aa, Entamoeba dispar
KEDGEC

SEQ ID NO: 2366785 - protein, 9 aa, Entamoeba dispar
KEDGGSVLT

SEQ ID NO: 2366786 - protein, 9 aa, Entamoeba dispar
KEDINNNQI

SEQ ID NO: 2366787 - protein, 6 aa, Entamoeba dispar
KEDITK

SEQ ID NO: 2366788 - protein, 11 aa, Entamoeba dispar
KEDKVDEIENE

SEQ ID NO: 2366789 - protein, 7 aa, Entamoeba dispar
KEDPPAY

SEQ ID NO: 2366790 - protein, 6 aa, Entamoeba dispar
KEDQIA

SEQ ID NO: 2366791 - protein, 12 aa, Entamoeba dispar
KEDQPSFISSPS

SEQ ID NO: 2366792 - protein, 19 aa, Entamoeba dispar
KEDREDDIEETDNEQEEEM

SEQ ID NO: 2366793 - protein, 5 aa, Entamoeba dispar
KEDRS

SEQ ID NO: 2366794 - protein, 10 aa, Entamoeba dispar
KEDSKEKYTT

SEQ ID NO: 2366795 - protein, 7 aa, Entamoeba dispar
KEDSPKT

SEQ ID NO: 2366796 - protein, 9 aa, Entamoeba dispar
KEDTNKYSF

SEQ ID NO: 2366797 - protein, 18 aa, Entamoeba dispar
KEDVKKEDDKTQTNLTED

SEQ ID NO: 2366798 - protein, 10 aa, Entamoeba dispar
KEEAKKNKNE

SEQ ID NO: 2366799 - protein, 9 aa, Entamoeba dispar
KEECNNKND

SEQ ID NO: 2366800 - protein, 6 aa, Entamoeba dispar
KEECQS

SEQ ID NO: 2366801 - protein, 10 aa, Entamoeba dispar
KEEECDGGEG

SEQ ID NO: 2366802 - protein, 7 aa, Entamoeba dispar
KEEEEEI

SEQ ID NO: 2366803 - protein, 26 aa, Entamoeba dispar
KEEEEEKKKDKKRNNDEGIKDKKQQA

SEQ ID NO: 2366804 - protein, 9 aa, Entamoeba dispar
KEEEEGNDE

SEQ ID NO: 2366805 - protein, 9 aa, Entamoeba dispar
KEEEGFDAD

SEQ ID NO: 2366806 - protein, 8 aa, Entamoeba dispar
KEEEKELR

SEQ ID NO: 2366807 - protein, 11 aa, Entamoeba dispar
KEEEKVEKIRK

SEQ ID NO: 2366808 - protein, 9 aa, Entamoeba dispar
KEEERKDMK

SEQ ID NO: 2366809 - protein, 7 aa, Entamoeba dispar
KEEERQK

SEQ ID NO: 2366810 - protein, 19 aa, Entamoeba dispar
KEEESESSTLSSSSNNSED

SEQ ID NO: 2366811 - protein, 5 aa, Entamoeba dispar
KEEFN

SEQ ID NO: 2366812 - protein, 6 aa, Entamoeba dispar
KEEGDI

SEQ ID NO: 2366813 - protein, 6 aa, Entamoeba dispar
KEEGIP

SEQ ID NO: 2366814 - protein, 7 aa, Entamoeba dispar
KEEGISG

SEQ ID NO: 2366815 - protein, 6 aa, Entamoeba dispar
KEEGNY

SEQ ID NO: 2366816 - protein, 4 aa, Entamoeba dispar
KEEI

SEQ ID NO: 2366817 - protein, 29 aa, Entamoeba dispar
KEEIEVKKEQENKMKEFENELKKTSESLN

SEQ ID NO: 2366818 - protein, 14 aa, Entamoeba dispar
KEEIKEETERNEKY

SEQ ID NO: 2366819 - protein, 8 aa, Entamoeba dispar
KEEINKSI

SEQ ID NO: 2366820 - protein, 7 aa, Entamoeba dispar
KEEITTQ

SEQ ID NO: 2366821 - protein, 50 aa, Entamoeba dispar
KEEKQPKQNEEEYKSQNKEETKEETKEETKEENKEENKESKVVTPSSQIH

SEQ ID NO: 2366822 - protein, 5 aa, Entamoeba dispar
KEEKY

SEQ ID NO: 2366823 - protein, 13 aa, Entamoeba dispar
KEELNKQCNDNEK

SEQ ID NO: 2366824 - protein, 13 aa, Entamoeba dispar
KEELTNGKKIGQI

SEQ ID NO: 2366825 - protein, 6 aa, Entamoeba dispar
KEEMKG

SEQ ID NO: 2366826 - protein, 11 aa, Entamoeba dispar
KEENCGGTKSR

SEQ ID NO: 2366827 - protein, 6 aa, Entamoeba dispar
KEENEI

SEQ ID NO: 2366828 - protein, 9 aa, Entamoeba dispar
KEENEKRIK

SEQ ID NO: 2366829 - protein, 8 aa, Entamoeba dispar
KEENESLK

SEQ ID NO: 2366830 - protein, 6 aa, Entamoeba dispar
KEEPEI

SEQ ID NO: 2366831 - protein, 5 aa, Entamoeba dispar
KEEPK

SEQ ID NO: 2366832 - protein, 7 aa, Entamoeba dispar
KEEPNLN

SEQ ID NO: 2366833 - protein, 16 aa, Entamoeba dispar
KEEQKGYQTNKIENNK

SEQ ID NO: 2366834 - protein, 13 aa, Entamoeba dispar
KEEQKTKDQLPNQ

SEQ ID NO: 2366835 - protein, 23 aa, Entamoeba dispar
KEERENKEGSKESPHSSSPTVEL

SEQ ID NO: 2366836 - protein, 8 aa, Entamoeba dispar
KEESEETN

SEQ ID NO: 2366837 - protein, 7 aa, Entamoeba dispar
KEESKEI

SEQ ID NO: 2366838 - protein, 5 aa, Entamoeba dispar
KEEST

SEQ ID NO: 2366839 - protein, 8 aa, Entamoeba dispar
KEETINNS

SEQ ID NO: 2366840 - protein, 20 aa, Entamoeba dispar
KEETNKNLISETPSLYEEDE

SEQ ID NO: 2366841 - protein, 9 aa, Entamoeba dispar
KEETQNGLP

SEQ ID NO: 2366842 - protein, 21 aa, Entamoeba dispar
KEETTINKDIRKSKTQPSVTS

SEQ ID NO: 2366843 - protein, 5 aa, Entamoeba dispar
KEETV

SEQ ID NO: 2366844 - protein, 7 aa, Entamoeba dispar
KEETVKK

SEQ ID NO: 2366845 - protein, 12 aa, Entamoeba dispar
KEEVEEDTKKEG

SEQ ID NO: 2366846 - protein, 6 aa, Entamoeba dispar
KEEVGT

SEQ ID NO: 2366847 - protein, 6 aa, Entamoeba dispar
KEEYED

SEQ ID NO: 2366848 - protein, 7 aa, Entamoeba dispar
KEEYEEE

SEQ ID NO: 2366849 - protein, 5 aa, Entamoeba dispar
KEEYN

SEQ ID NO: 2366850 - protein, 6 aa, Entamoeba dispar
KEFDEA

SEQ ID NO: 2366851 - protein, 4 aa, Entamoeba dispar
KEFE

SEQ ID NO: 2366852 - protein, 6 aa, Entamoeba dispar
KEFEGR

SEQ ID NO: 2366853 - protein, 12 aa, Entamoeba dispar
KEFENYKQTEQY

SEQ ID NO: 2366854 - protein, 6 aa, Entamoeba dispar
KEFEQQ

SEQ ID NO: 2366855 - protein, 6 aa, Entamoeba dispar
KEFNTK

SEQ ID NO: 2366856 - protein, 11 aa, Entamoeba dispar
KEFPGEPRKPQ

SEQ ID NO: 2366857 - protein, 5 aa, Entamoeba dispar
KEFPV

SEQ ID NO: 2366858 - protein, 5 aa, Entamoeba dispar
KEFQR

SEQ ID NO: 2366859 - protein, 6 aa, Entamoeba dispar
KEFSEG

SEQ ID NO: 2366860 - protein, 5 aa, Entamoeba dispar
KEFSN

SEQ ID NO: 2366861 - protein, 13 aa, Entamoeba dispar
KEFTESKENREGE

SEQ ID NO: 2366862 - protein, 10 aa, Entamoeba dispar
KEFTTPRGEY

SEQ ID NO: 2366863 - protein, 5 aa, Entamoeba dispar
KEGAQ

SEQ ID NO: 2366864 - protein, 5 aa, Entamoeba dispar
KEGCE

SEQ ID NO: 2366865 - protein, 12 aa, Entamoeba dispar
KEGCKKCSSISD

SEQ ID NO: 2366866 - protein, 7 aa, Entamoeba dispar
KEGCSQT

SEQ ID NO: 2366867 - protein, 8 aa, Entamoeba dispar
KEGDEHYE

SEQ ID NO: 2366868 - protein, 8 aa, Entamoeba dispar
KEGEENFK

SEQ ID NO: 2366869 - protein, 9 aa, Entamoeba dispar
KEGGQPIKL

SEQ ID NO: 2366870 - protein, 6 aa, Entamoeba dispar
KEGINS

SEQ ID NO: 2366871 - protein, 5 aa, Entamoeba dispar
KEGKF

SEQ ID NO: 2366872 - protein, 7 aa, Entamoeba dispar
KEGKRYI

SEQ ID NO: 2366873 - protein, 6 aa, Entamoeba dispar
KEGLDK

SEQ ID NO: 2366874 - protein, 6 aa, Entamoeba dispar
KEGQKI

SEQ ID NO: 2366875 - protein, 4 aa, Entamoeba dispar
KEGR

SEQ ID NO: 2366876 - protein, 13 aa, Entamoeba dispar
KEGTQAAQTSDYA

SEQ ID NO: 2366877 - protein, 12 aa, Entamoeba dispar
KEGTQAARASDY

SEQ ID NO: 2366878 - protein, 10 aa, Entamoeba dispar
KEGTVTPDTV

SEQ ID NO: 2366879 - protein, 5 aa, Entamoeba dispar
KEGVS

SEQ ID NO: 2366880 - protein, 8 aa, Entamoeba dispar
KEGYEEFN

SEQ ID NO: 2366881 - protein, 8 aa, Entamoeba dispar
KEGYGGDN

SEQ ID NO: 2366882 - protein, 5 aa, Entamoeba dispar
KEGYL

SEQ ID NO: 2366883 - protein, 6 aa, Entamoeba dispar
KEGYSY

SEQ ID NO: 2366884 - protein, 8 aa, Entamoeba dispar
KEHCQRCT

SEQ ID NO: 2366885 - protein, 21 aa, Entamoeba dispar
KEHENDTGYYIPEGSQTCQPC

SEQ ID NO: 2366886 - protein, 6 aa, Entamoeba dispar
KEHSFY

SEQ ID NO: 2366887 - protein, 5 aa, Entamoeba dispar
KEIDK

SEQ ID NO: 2366888 - protein, 8 aa, Entamoeba dispar
KEIEEDEM

SEQ ID NO: 2366889 - protein, 9 aa, Entamoeba dispar
KEIEEEQEI

SEQ ID NO: 2366890 - protein, 7 aa, Entamoeba dispar
KEIEERE

SEQ ID NO: 2366891 - protein, 7 aa, Entamoeba dispar
KEIERNV

SEQ ID NO: 2366892 - protein, 8 aa, Entamoeba dispar
KEIGEDTR

SEQ ID NO: 2366893 - protein, 11 aa, Entamoeba dispar
KEIGKKRDDEI

SEQ ID NO: 2366894 - protein, 8 aa, Entamoeba dispar
KEIKEENI

SEQ ID NO: 2366895 - protein, 9 aa, Entamoeba dispar
KEIKLGGSL

SEQ ID NO: 2366896 - protein, 12 aa, Entamoeba dispar
KEIKLNQEGYHD

SEQ ID NO: 2366897 - protein, 8 aa, Entamoeba dispar
KEIKNQRS

SEQ ID NO: 2366898 - protein, 6 aa, Entamoeba dispar
KEINCE

SEQ ID NO: 2366899 - protein, 6 aa, Entamoeba dispar
KEINSS

SEQ ID NO: 2366900 - protein, 6 aa, Entamoeba dispar
KEIPAD

SEQ ID NO: 2366901 - protein, 7 aa, Entamoeba dispar
KEIPADG

SEQ ID NO: 2366902 - protein, 13 aa, Entamoeba dispar
KEIPTSTPEDKKE

SEQ ID NO: 2366903 - protein, 18 aa, Entamoeba dispar
KEIQEKNDEEKKTRKNKI

SEQ ID NO: 2366904 - protein, 10 aa, Entamoeba dispar
KEIQKKNPSL

SEQ ID NO: 2366905 - protein, 5 aa, Entamoeba dispar
KEIQN

SEQ ID NO: 2366906 - protein, 5 aa, Entamoeba dispar
KEIRE

SEQ ID NO: 2366907 - protein, 6 aa, Entamoeba dispar
KEISIQ

SEQ ID NO: 2366908 - protein, 5 aa, Entamoeba dispar
KEISN

SEQ ID NO: 2366909 - protein, 10 aa, Entamoeba dispar
KEISQEQYNE

SEQ ID NO: 2366910 - protein, 12 aa, Entamoeba dispar
KEITERINEENP

SEQ ID NO: 2366911 - protein, 19 aa, Entamoeba dispar
KEITTSTNQSQSSASPSQI

SEQ ID NO: 2366912 - protein, 22 aa, Entamoeba dispar
KEITYEKNESITRTEEKNIATY

SEQ ID NO: 2366913 - protein, 19 aa, Entamoeba dispar
KEKDKQKHHHSSKLKPTLK

SEQ ID NO: 2366914 - protein, 8 aa, Entamoeba dispar
KEKEGTTI

SEQ ID NO: 2366915 - protein, 15 aa, Entamoeba dispar
KEKEIKEEKKEKENY

SEQ ID NO: 2366916 - protein, 27 aa, Entamoeba dispar
KEKEKDKKKKIRKDKAVPNEPTSLPED

SEQ ID NO: 2366917 - protein, 13 aa, Entamoeba dispar
KEKENNNKDINNK

SEQ ID NO: 2366918 - protein, 35 aa, Entamoeba dispar
KEKENSSDSSSVSMEDEIKSTDSQIFESQQSKAFH

SEQ ID NO: 2366919 - protein, 7 aa, Entamoeba dispar
KEKERKE

SEQ ID NO: 2366920 - protein, 9 aa, Entamoeba dispar
KEKEYQSKI

SEQ ID NO: 2366921 - protein, 19 aa, Entamoeba dispar
KEKGECKEKDNKCNKSERN

SEQ ID NO: 2366922 - protein, 7 aa, Entamoeba dispar
KEKGEEN

SEQ ID NO: 2366923 - protein, 5 aa, Entamoeba dispar
KEKGY

SEQ ID NO: 2366924 - protein, 8 aa, Entamoeba dispar
KEKHEEAL

SEQ ID NO: 2366925 - protein, 4 aa, Entamoeba dispar
KEKI

SEQ ID NO: 2366926 - protein, 8 aa, Entamoeba dispar
KEKIREQS

SEQ ID NO: 2366927 - protein, 10 aa, Entamoeba dispar
KEKKAEKQAL

SEQ ID NO: 2366928 - protein, 28 aa, Entamoeba dispar
KEKKDGKKIKIPTLKTKGKDKEDSCNEG

SEQ ID NO: 2366929 - protein, 8 aa, Entamoeba dispar
KEKKNEIK

SEQ ID NO: 2366930 - protein, 8 aa, Entamoeba dispar
KEKKRNGV

SEQ ID NO: 2366931 - protein, 9 aa, Entamoeba dispar
KEKKSNQVG

SEQ ID NO: 2366932 - protein, 12 aa, Entamoeba dispar
KEKLNKKKKEVF

SEQ ID NO: 2366933 - protein, 9 aa, Entamoeba dispar
KEKLNKKSL

SEQ ID NO: 2366934 - protein, 18 aa, Entamoeba dispar
KEKPEGEKEIRDKTGIEE

SEQ ID NO: 2366935 - protein, 9 aa, Entamoeba dispar
KEKPNDGVS

SEQ ID NO: 2366936 - protein, 9 aa, Entamoeba dispar
KEKPRKVSY

SEQ ID NO: 2366937 - protein, 8 aa, Entamoeba dispar
KEKPYRTI

SEQ ID NO: 2366938 - protein, 6 aa, Entamoeba dispar
KEKQDI

SEQ ID NO: 2366939 - protein, 9 aa, Entamoeba dispar
KEKQIEKRK

SEQ ID NO: 2366940 - protein, 20 aa, Entamoeba dispar
KEKQYQKKIRTRDRKRNDQL

SEQ ID NO: 2366941 - protein, 4 aa, Entamoeba dispar
KEKR

SEQ ID NO: 2366942 - protein, 7 aa, Entamoeba dispar
KEKRPTA

SEQ ID NO: 2366943 - protein, 5 aa, Entamoeba dispar
KEKSN

SEQ ID NO: 2366944 - protein, 22 aa, Entamoeba dispar
KEKTKNYSKTEIKSGQTEDKKE

SEQ ID NO: 2366945 - protein, 7 aa, Entamoeba dispar
KEKTSLT

SEQ ID NO: 2366946 - protein, 9 aa, Entamoeba dispar
KEKVTRDKI

SEQ ID NO: 2366947 - protein, 8 aa, Entamoeba dispar
KEKYNPNG

SEQ ID NO: 2366948 - protein, 7 aa, Entamoeba dispar
KEKYQEQ

SEQ ID NO: 2366949 - protein, 13 aa, Entamoeba dispar
KEKYQPIKRKPNE

SEQ ID NO: 2366950 - protein, 11 aa, Entamoeba dispar
KELDKKKKQLV

SEQ ID NO: 2366951 - protein, 6 aa, Entamoeba dispar
KELESK

SEQ ID NO: 2366952 - protein, 6 aa, Entamoeba dispar
KELGDF

SEQ ID NO: 2366953 - protein, 5 aa, Entamoeba dispar
KELGE

SEQ ID NO: 2366954 - protein, 4 aa, Entamoeba dispar
KELK

SEQ ID NO: 2366955 - protein, 12 aa, Entamoeba dispar
KELKERNNEKIQ

SEQ ID NO: 2366956 - protein, 10 aa, Entamoeba dispar
KELKGENKNL

SEQ ID NO: 2366957 - protein, 16 aa, Entamoeba dispar
KELNEKDNRSKHDKQI

SEQ ID NO: 2366958 - protein, 5 aa, Entamoeba dispar
KELNG

SEQ ID NO: 2366959 - protein, 20 aa, Entamoeba dispar
KELQGTSKTHSDSLKSNDEI

SEQ ID NO: 2366960 - protein, 6 aa, Entamoeba dispar
KELRDK

SEQ ID NO: 2366961 - protein, 7 aa, Entamoeba dispar
KELSEEM

SEQ ID NO: 2366962 - protein, 4 aa, Entamoeba dispar
KELT

SEQ ID NO: 2366963 - protein, 11 aa, Entamoeba dispar
KELTGKNLTNE

SEQ ID NO: 2366964 - protein, 7 aa, Entamoeba dispar
KELTINR

SEQ ID NO: 2366965 - protein, 7 aa, Entamoeba dispar
KENDDET

SEQ ID NO: 2366966 - protein, 5 aa, Entamoeba dispar
KENDN

SEQ ID NO: 2366967 - protein, 4 aa, Entamoeba dispar
KENE

SEQ ID NO: 2366968 - protein, 8 aa, Entamoeba dispar
KENEEPLS

SEQ ID NO: 2366969 - protein, 7 aa, Entamoeba dispar
KENENKI

SEQ ID NO: 2366970 - protein, 6 aa, Entamoeba dispar
KENESI

SEQ ID NO: 2366971 - protein, 11 aa, Entamoeba dispar
KENETEGEQCT

SEQ ID NO: 2366972 - protein, 6 aa, Entamoeba dispar
KENEVN

SEQ ID NO: 2366973 - protein, 5 aa, Entamoeba dispar
KENFP

SEQ ID NO: 2366974 - protein, 18 aa, Entamoeba dispar
KENFTGKTPEEIKKNEIQ

SEQ ID NO: 2366975 - protein, 17 aa, Entamoeba dispar
KENGAINDNIENDSKEV

SEQ ID NO: 2366976 - protein, 22 aa, Entamoeba dispar
KENGECKKIDNKCNKSERNYYK

SEQ ID NO: 2366977 - protein, 19 aa, Entamoeba dispar
KENGECQKIDNKCNKSERN

SEQ ID NO: 2366978 - protein, 8 aa, Entamoeba dispar
KENGELPL

SEQ ID NO: 2366979 - protein, 11 aa, Entamoeba dispar
KENIGKYPSNP

SEQ ID NO: 2366980 - protein, 7 aa, Entamoeba dispar
KENIQPK

SEQ ID NO: 2366981 - protein, 7 aa, Entamoeba dispar
KENKKEQ

SEQ ID NO: 2366982 - protein, 13 aa, Entamoeba dispar
KENKTDDDDTEDK

SEQ ID NO: 2366983 - protein, 5 aa, Entamoeba dispar
KENNE

SEQ ID NO: 2366984 - protein, 12 aa, Entamoeba dispar
KENNNNQQQDII

SEQ ID NO: 2366985 - protein, 11 aa, Entamoeba dispar
KENNSGKTIKY

SEQ ID NO: 2366986 - protein, 7 aa, Entamoeba dispar
KENPERK

SEQ ID NO: 2366987 - protein, 7 aa, Entamoeba dispar
KENPTNN

SEQ ID NO: 2366988 - protein, 5 aa, Entamoeba dispar
KENRC

SEQ ID NO: 2366989 - protein, 7 aa, Entamoeba dispar
KENRKRL

SEQ ID NO: 2366990 - protein, 5 aa, Entamoeba dispar
KENRP

SEQ ID NO: 2366991 - protein, 10 aa, Entamoeba dispar
KENSNQDSGI

SEQ ID NO: 2366992 - protein, 6 aa, Entamoeba dispar
KENTAE

SEQ ID NO: 2366993 - protein, 10 aa, Entamoeba dispar
KENTKEKSVE

SEQ ID NO: 2366994 - protein, 9 aa, Entamoeba dispar
KENTQTYAG

SEQ ID NO: 2366995 - protein, 6 aa, Entamoeba dispar
KENTSK

SEQ ID NO: 2366996 - protein, 4 aa, Entamoeba dispar
KEPE

SEQ ID NO: 2366997 - protein, 6 aa, Entamoeba dispar
KEPFNQ

SEQ ID NO: 2366998 - protein, 4 aa, Entamoeba dispar
KEPI

SEQ ID NO: 2366999 - protein, 6 aa, Entamoeba dispar
KEPIDY

SEQ ID NO: 2367000 - protein, 22 aa, Entamoeba dispar
KEPKKRPKINEVEEELLKIEET

SEQ ID NO: 2367001 - protein, 7 aa, Entamoeba dispar
KEPKRDY

SEQ ID NO: 2367002 - protein, 9 aa, Entamoeba dispar
KEPNEQNRE

SEQ ID NO: 2367003 - protein, 7 aa, Entamoeba dispar
KEPNYDD

SEQ ID NO: 2367004 - protein, 10 aa, Entamoeba dispar
KEPPIGNGSM

SEQ ID NO: 2367005 - protein, 6 aa, Entamoeba dispar
KEPPND

SEQ ID NO: 2367006 - protein, 5 aa, Entamoeba dispar
KEPQF

SEQ ID NO: 2367007 - protein, 4 aa, Entamoeba dispar
KEPS

SEQ ID NO: 2367008 - protein, 5 aa, Entamoeba dispar
KEPTE

SEQ ID NO: 2367009 - protein, 7 aa, Entamoeba dispar
KEPTNNY

SEQ ID NO: 2367010 - protein, 13 aa, Entamoeba dispar
KEPYDSVKFPDSE

SEQ ID NO: 2367011 - protein, 7 aa, Entamoeba dispar
KEPYTIT

SEQ ID NO: 2367012 - protein, 8 aa, Entamoeba dispar
KEQDRMKR

SEQ ID NO: 2367013 - protein, 8 aa, Entamoeba dispar
KEQEAHPE

SEQ ID NO: 2367014 - protein, 15 aa, Entamoeba dispar
KEQERKLKESIQKPY

SEQ ID NO: 2367015 - protein, 4 aa, Entamoeba dispar
KEQI

SEQ ID NO: 2367016 - protein, 6 aa, Entamoeba dispar
KEQIDK

SEQ ID NO: 2367017 - protein, 8 aa, Entamoeba dispar
KEQKAEIK

SEQ ID NO: 2367018 - protein, 8 aa, Entamoeba dispar
KEQKEIND

SEQ ID NO: 2367019 - protein, 22 aa, Entamoeba dispar
KEQKGIIDQEKENNNKIKNSLA

SEQ ID NO: 2367020 - protein, 8 aa, Entamoeba dispar
KEQNTYGC

SEQ ID NO: 2367021 - protein, 9 aa, Entamoeba dispar
KEQNYQQYK

SEQ ID NO: 2367022 - protein, 7 aa, Entamoeba dispar
KEQQTSL

SEQ ID NO: 2367023 - protein, 8 aa, Entamoeba dispar
KEQYSTSA

SEQ ID NO: 2367024 - protein, 5 aa, Entamoeba dispar
KERAH

SEQ ID NO: 2367025 - protein, 4 aa, Entamoeba dispar
KERD

SEQ ID NO: 2367026 - protein, 13 aa, Entamoeba dispar
KERIDKKKRNRAF

SEQ ID NO: 2367027 - protein, 8 aa, Entamoeba dispar
KERISDSK

SEQ ID NO: 2367028 - protein, 10 aa, Entamoeba dispar
KERKDNERYT

SEQ ID NO: 2367029 - protein, 13 aa, Entamoeba dispar
KERKKEENNEIER

SEQ ID NO: 2367030 - protein, 8 aa, Entamoeba dispar
KERKTPAH

SEQ ID NO: 2367031 - protein, 13 aa, Entamoeba dispar
KERLGARTTPLEY

SEQ ID NO: 2367032 - protein, 6 aa, Entamoeba dispar
KERNEV

SEQ ID NO: 2367033 - protein, 8 aa, Entamoeba dispar
KERNGKIN

SEQ ID NO: 2367034 - protein, 13 aa, Entamoeba dispar
KERNSEEIITSEG

SEQ ID NO: 2367035 - protein, 19 aa, Entamoeba dispar
KERQEQLSDLRSKKREGML

SEQ ID NO: 2367036 - protein, 5 aa, Entamoeba dispar
KERYP

SEQ ID NO: 2367037 - protein, 5 aa, Entamoeba dispar
KESEK

SEQ ID NO: 2367038 - protein, 6 aa, Entamoeba dispar
KESEPL

SEQ ID NO: 2367039 - protein, 9 aa, Entamoeba dispar
KESERDRID

SEQ ID NO: 2367040 - protein, 8 aa, Entamoeba dispar
KESERSAK

SEQ ID NO: 2367041 - protein, 8 aa, Entamoeba dispar
KESETCKK

SEQ ID NO: 2367042 - protein, 4 aa, Entamoeba dispar
KESI

SEQ ID NO: 2367043 - protein, 6 aa, Entamoeba dispar
KESIPK

SEQ ID NO: 2367044 - protein, 40 aa, Entamoeba dispar
KESITSETFNSSIDKSISSKSSGGQSSKRRVNKILSRRFD

SEQ ID NO: 2367045 - protein, 4 aa, Entamoeba dispar
KESK

SEQ ID NO: 2367046 - protein, 5 aa, Entamoeba dispar
KESKK

SEQ ID NO: 2367047 - protein, 19 aa, Entamoeba dispar
KESKKKRIKSTTADKVGTY

SEQ ID NO: 2367048 - protein, 4 aa, Entamoeba dispar
KESL

SEQ ID NO: 2367049 - protein, 13 aa, Entamoeba dispar
KESLEDKTELKPS

SEQ ID NO: 2367050 - protein, 8 aa, Entamoeba dispar
KESLSNED

SEQ ID NO: 2367051 - protein, 5 aa, Entamoeba dispar
KESNC

SEQ ID NO: 2367052 - protein, 20 aa, Entamoeba dispar
KESNDTTKKKNKGSGENGIE

SEQ ID NO: 2367053 - protein, 6 aa, Entamoeba dispar
KESNHC

SEQ ID NO: 2367054 - protein, 5 aa, Entamoeba dispar
KESNI

SEQ ID NO: 2367055 - protein, 6 aa, Entamoeba dispar
KESNNI

SEQ ID NO: 2367056 - protein, 15 aa, Entamoeba dispar
KESQKEKEYEDKRKE

SEQ ID NO: 2367057 - protein, 14 aa, Entamoeba dispar
KESRKQQEKEEKIG

SEQ ID NO: 2367058 - protein, 7 aa, Entamoeba dispar
KESRNTL

SEQ ID NO: 2367059 - protein, 5 aa, Entamoeba dispar
KESSF

SEQ ID NO: 2367060 - protein, 9 aa, Entamoeba dispar
KESSNKKIG

SEQ ID NO: 2367061 - protein, 10 aa, Entamoeba dispar
KESSNNEKLL

SEQ ID NO: 2367062 - protein, 14 aa, Entamoeba dispar
KESTATISSPTNTN

SEQ ID NO: 2367063 - protein, 6 aa, Entamoeba dispar
KESTIH

SEQ ID NO: 2367064 - protein, 6 aa, Entamoeba dispar
KESTLE

SEQ ID NO: 2367065 - protein, 8 aa, Entamoeba dispar
KESTSPRF

SEQ ID NO: 2367066 - protein, 11 aa, Entamoeba dispar
KESYSTNALRP

SEQ ID NO: 2367067 - protein, 8 aa, Entamoeba dispar
KETATDVL

SEQ ID NO: 2367068 - protein, 4 aa, Entamoeba dispar
KETE

SEQ ID NO: 2367069 - protein, 6 aa, Entamoeba dispar
KETFDT

SEQ ID NO: 2367070 - protein, 8 aa, Entamoeba dispar
KETGKDVN

SEQ ID NO: 2367071 - protein, 6 aa, Entamoeba dispar
KETGYK

SEQ ID NO: 2367072 - protein, 5 aa, Entamoeba dispar
KETIN

SEQ ID NO: 2367073 - protein, 19 aa, Entamoeba dispar
KETKEGIQKEKRRKKRSYI

SEQ ID NO: 2367074 - protein, 9 aa, Entamoeba dispar
KETKKGYSS

SEQ ID NO: 2367075 - protein, 5 aa, Entamoeba dispar
KETLS

SEQ ID NO: 2367076 - protein, 14 aa, Entamoeba dispar
KETMEEGIIENQEG

SEQ ID NO: 2367077 - protein, 10 aa, Entamoeba dispar
KETNKPKYLK

SEQ ID NO: 2367078 - protein, 14 aa, Entamoeba dispar
KETPDNKDEITNHR

SEQ ID NO: 2367079 - protein, 6 aa, Entamoeba dispar
KETQDI

SEQ ID NO: 2367080 - protein, 6 aa, Entamoeba dispar
KETQNL

SEQ ID NO: 2367081 - protein, 6 aa, Entamoeba dispar
KETQTI

SEQ ID NO: 2367082 - protein, 4 aa, Entamoeba dispar
KETR

SEQ ID NO: 2367083 - protein, 8 aa, Entamoeba dispar
KETSLTEK

SEQ ID NO: 2367084 - protein, 7 aa, Entamoeba dispar
KETSLTL

SEQ ID NO: 2367085 - protein, 9 aa, Entamoeba dispar
KETSREPLE

SEQ ID NO: 2367086 - protein, 10 aa, Entamoeba dispar
KETTGKEEGI

SEQ ID NO: 2367087 - protein, 9 aa, Entamoeba dispar
KETTGTTEN

SEQ ID NO: 2367088 - protein, 5 aa, Entamoeba dispar
KETTI

SEQ ID NO: 2367089 - protein, 9 aa, Entamoeba dispar
KETTQTQSL

SEQ ID NO: 2367090 - protein, 5 aa, Entamoeba dispar
KETWT

SEQ ID NO: 2367091 - protein, 10 aa, Entamoeba dispar
KETYDEKTQE

SEQ ID NO: 2367092 - protein, 14 aa, Entamoeba dispar
KEVANNLNQQVDKQ

SEQ ID NO: 2367093 - protein, 7 aa, Entamoeba dispar
KEVEDNI

SEQ ID NO: 2367094 - protein, 6 aa, Entamoeba dispar
KEVENG

SEQ ID NO: 2367095 - protein, 5 aa, Entamoeba dispar
KEVIT

SEQ ID NO: 2367096 - protein, 4 aa, Entamoeba dispar
KEVM

SEQ ID NO: 2367097 - protein, 6 aa, Entamoeba dispar
KEVPPV

SEQ ID NO: 2367098 - protein, 8 aa, Entamoeba dispar
KEVPVSSV

SEQ ID NO: 2367099 - protein, 12 aa, Entamoeba dispar
KEVRKTLTEAGI

SEQ ID NO: 2367100 - protein, 10 aa, Entamoeba dispar
KEVSESAKKA

SEQ ID NO: 2367101 - protein, 6 aa, Entamoeba dispar
KEVSKT

SEQ ID NO: 2367102 - protein, 10 aa, Entamoeba dispar
KEVSSGKSLS

SEQ ID NO: 2367103 - protein, 6 aa, Entamoeba dispar
KEVTER

SEQ ID NO: 2367104 - protein, 6 aa, Entamoeba dispar
KEVTKT

SEQ ID NO: 2367105 - protein, 23 aa, Entamoeba dispar
KEWFDSDEDEQQEGENEEERKKK

SEQ ID NO: 2367106 - protein, 9 aa, Entamoeba dispar
KEWKKGEVI

SEQ ID NO: 2367107 - protein, 6 aa, Entamoeba dispar
KEYDHQ

SEQ ID NO: 2367108 - protein, 6 aa, Entamoeba dispar
KEYESN

SEQ ID NO: 2367109 - protein, 6 aa, Entamoeba dispar
KEYIGQ

SEQ ID NO: 2367110 - protein, 5 aa, Entamoeba dispar
KEYKD

SEQ ID NO: 2367111 - protein, 5 aa, Entamoeba dispar
KEYKE

SEQ ID NO: 2367112 - protein, 11 aa, Entamoeba dispar
KEYKGETDGID

SEQ ID NO: 2367113 - protein, 9 aa, Entamoeba dispar
KEYKNEVGN

SEQ ID NO: 2367114 - protein, 9 aa, Entamoeba dispar
KEYKTNGDD

SEQ ID NO: 2367115 - protein, 9 aa, Entamoeba dispar
KEYLETYDD

SEQ ID NO: 2367116 - protein, 6 aa, Entamoeba dispar
KEYNHQ

SEQ ID NO: 2367117 - protein, 7 aa, Entamoeba dispar
KEYPQKP

SEQ ID NO: 2367118 - protein, 6 aa, Entamoeba dispar
KEYPTG

SEQ ID NO: 2367119 - protein, 9 aa, Entamoeba dispar
KEYSRDDTI

SEQ ID NO: 2367120 - protein, 7 aa, Entamoeba dispar
KEYTSNS

SEQ ID NO: 2367121 - protein, 18 aa, Entamoeba dispar
KEYVSGKRAPYSKETDIE

SEQ ID NO: 2367122 - protein, 19 aa, Entamoeba dispar
KEYVSGKRAPYSKETDIEL

SEQ ID NO: 2367123 - protein, 5 aa, Entamoeba dispar
KFAPA

SEQ ID NO: 2367124 - protein, 9 aa, Entamoeba dispar
KFDNGKAEG

SEQ ID NO: 2367125 - protein, 9 aa, Entamoeba dispar
KFDPKNKET

SEQ ID NO: 2367126 - protein, 7 aa, Entamoeba dispar
KFDRTNQ

SEQ ID NO: 2367127 - protein, 8 aa, Entamoeba dispar
KFENYGKK

SEQ ID NO: 2367128 - protein, 10 aa, Entamoeba dispar
KFETDKEVQC

SEQ ID NO: 2367129 - protein, 6 aa, Entamoeba dispar
KFETTK

SEQ ID NO: 2367130 - protein, 6 aa, Entamoeba dispar
KFEYPN

SEQ ID NO: 2367131 - protein, 11 aa, Entamoeba dispar
KFGCNPENEIS

SEQ ID NO: 2367132 - protein, 16 aa, Entamoeba dispar
KFGGTTLSIGDGANDC

SEQ ID NO: 2367133 - protein, 8 aa, Entamoeba dispar
KFIPPDED

SEQ ID NO: 2367134 - protein, 12 aa, Entamoeba dispar
KFKEENNNDFTE

SEQ ID NO: 2367135 - protein, 17 aa, Entamoeba dispar
KFKGDNTQEGIKNDESY

SEQ ID NO: 2367136 - protein, 8 aa, Entamoeba dispar
KFKSKGLD

SEQ ID NO: 2367137 - protein, 8 aa, Entamoeba dispar
KFKSNNKK

SEQ ID NO: 2367138 - protein, 9 aa, Entamoeba dispar
KFNERKNNI

SEQ ID NO: 2367139 - protein, 5 aa, Entamoeba dispar
KFNQT

SEQ ID NO: 2367140 - protein, 5 aa, Entamoeba dispar
KFNTF

SEQ ID NO: 2367141 - protein, 6 aa, Entamoeba dispar
KFNTPD

SEQ ID NO: 2367142 - protein, 9 aa, Entamoeba dispar
KFNTTQELN

SEQ ID NO: 2367143 - protein, 5 aa, Entamoeba dispar
KFPDG

SEQ ID NO: 2367144 - protein, 6 aa, Entamoeba dispar
KFPDLS

SEQ ID NO: 2367145 - protein, 5 aa, Entamoeba dispar
KFQEA

SEQ ID NO: 2367146 - protein, 8 aa, Entamoeba dispar
KFQSGDSV

SEQ ID NO: 2367147 - protein, 15 aa, Entamoeba dispar
KFREEKEKNTKQDGS

SEQ ID NO: 2367148 - protein, 7 aa, Entamoeba dispar
KFRPPRS

SEQ ID NO: 2367149 - protein, 29 aa, Entamoeba dispar
KFSGKQGVSCTTTTTKSKAKGNGKQNNVK

SEQ ID NO: 2367150 - protein, 14 aa, Entamoeba dispar
KFSNKQTITTTNSF

SEQ ID NO: 2367151 - protein, 6 aa, Entamoeba dispar
KFSNTN

SEQ ID NO: 2367152 - protein, 6 aa, Entamoeba dispar
KFSSDR

SEQ ID NO: 2367153 - protein, 10 aa, Entamoeba dispar
KFSTNKDVTV

SEQ ID NO: 2367154 - protein, 13 aa, Entamoeba dispar
KFTEGKNDNGKLS

SEQ ID NO: 2367155 - protein, 7 aa, Entamoeba dispar
KFTNKTD

SEQ ID NO: 2367156 - protein, 5 aa, Entamoeba dispar
KGAIS

SEQ ID NO: 2367157 - protein, 25 aa, Entamoeba dispar
KGALKNSIKHSNNSQFKYTSDDNNV

SEQ ID NO: 2367158 - protein, 8 aa, Entamoeba dispar
KGANGVKN

SEQ ID NO: 2367159 - protein, 5 aa, Entamoeba dispar
KGAPE

SEQ ID NO: 2367160 - protein, 7 aa, Entamoeba dispar
KGCEKMG

SEQ ID NO: 2367161 - protein, 13 aa, Entamoeba dispar
KGCRDDCTCSENY

SEQ ID NO: 2367162 - protein, 14 aa, Entamoeba dispar
KGCTSTTEELTVQI

SEQ ID NO: 2367163 - protein, 11 aa, Entamoeba dispar
KGDDKENGLST

SEQ ID NO: 2367164 - protein, 13 aa, Entamoeba dispar
KGDDLRKDEGAEI

SEQ ID NO: 2367165 - protein, 5 aa, Entamoeba dispar
KGDGI

SEQ ID NO: 2367166 - protein, 13 aa, Entamoeba dispar
KGDNNPVDDRGLY

SEQ ID NO: 2367167 - protein, 10 aa, Entamoeba dispar
KGDQITATEE

SEQ ID NO: 2367168 - protein, 26 aa, Entamoeba dispar
KGDQITATEEKCKNEEKQKNMENEYL

SEQ ID NO: 2367169 - protein, 8 aa, Entamoeba dispar
KGDSETKS

SEQ ID NO: 2367170 - protein, 9 aa, Entamoeba dispar
KGDTSQRES

SEQ ID NO: 2367171 - protein, 5 aa, Entamoeba dispar
KGEAF

SEQ ID NO: 2367172 - protein, 4 aa, Entamoeba dispar
KGEE

SEQ ID NO: 2367173 - protein, 7 aa, Entamoeba dispar
KGEECKE

SEQ ID NO: 2367174 - protein, 6 aa, Entamoeba dispar
KGEGTH

SEQ ID NO: 2367175 - protein, 8 aa, Entamoeba dispar
KGEIDKEY

SEQ ID NO: 2367176 - protein, 11 aa, Entamoeba dispar
KGEINGGPETW

SEQ ID NO: 2367177 - protein, 5 aa, Entamoeba dispar
KGEIY

SEQ ID NO: 2367178 - protein, 9 aa, Entamoeba dispar
KGEKEEEIE

SEQ ID NO: 2367179 - protein, 7 aa, Entamoeba dispar
KGEKEPI

SEQ ID NO: 2367180 - protein, 9 aa, Entamoeba dispar
KGEKFEPEN

SEQ ID NO: 2367181 - protein, 9 aa, Entamoeba dispar
KGEKSEEEK

SEQ ID NO: 2367182 - protein, 22 aa, Entamoeba dispar
KGELVGTQCGNGYYNNTNNQCT

SEQ ID NO: 2367183 - protein, 8 aa, Entamoeba dispar
KGEQNGAP

SEQ ID NO: 2367184 - protein, 5 aa, Entamoeba dispar
KGEQQ

SEQ ID NO: 2367185 - protein, 8 aa, Entamoeba dispar
KGETELKR

SEQ ID NO: 2367186 - protein, 6 aa, Entamoeba dispar
KGETHY

SEQ ID NO: 2367187 - protein, 5 aa, Entamoeba dispar
KGETL

SEQ ID NO: 2367188 - protein, 8 aa, Entamoeba dispar
KGFGGSAK

SEQ ID NO: 2367189 - protein, 12 aa, Entamoeba dispar
KGFKDDKQLAPN

SEQ ID NO: 2367190 - protein, 11 aa, Entamoeba dispar
KGFPNDSPIGL

SEQ ID NO: 2367191 - protein, 17 aa, Entamoeba dispar
KGGDEEQSSEDKNDPYN

SEQ ID NO: 2367192 - protein, 8 aa, Entamoeba dispar
KGGEDEEL

SEQ ID NO: 2367193 - protein, 6 aa, Entamoeba dispar
KGGEGF

SEQ ID NO: 2367194 - protein, 6 aa, Entamoeba dispar
KGGFRP

SEQ ID NO: 2367195 - protein, 10 aa, Entamoeba dispar
KGGTKEDGYV

SEQ ID NO: 2367196 - protein, 6 aa, Entamoeba dispar
KGGYSD

SEQ ID NO: 2367197 - protein, 7 aa, Entamoeba dispar
KGIEPNV

SEQ ID NO: 2367198 - protein, 6 aa, Entamoeba dispar
KGIKNQ

SEQ ID NO: 2367199 - protein, 21 aa, Entamoeba dispar
KGIKTTIKTPISGKVSATYQS

SEQ ID NO: 2367200 - protein, 7 aa, Entamoeba dispar
KGINKEY

SEQ ID NO: 2367201 - protein, 17 aa, Entamoeba dispar
KGINPDKPRNLAKAVTV

SEQ ID NO: 2367202 - protein, 8 aa, Entamoeba dispar
KGIPSSDI

SEQ ID NO: 2367203 - protein, 6 aa, Entamoeba dispar
KGISDE

SEQ ID NO: 2367204 - protein, 8 aa, Entamoeba dispar
KGISGHPN

SEQ ID NO: 2367205 - protein, 6 aa, Entamoeba dispar
KGISQN

SEQ ID NO: 2367206 - protein, 5 aa, Entamoeba dispar
KGKAC

SEQ ID NO: 2367207 - protein, 9 aa, Entamoeba dispar
KGKCETCNS

SEQ ID NO: 2367208 - protein, 11 aa, Entamoeba dispar
KGKDVKNEDLD

SEQ ID NO: 2367209 - protein, 5 aa, Entamoeba dispar
KGKES

SEQ ID NO: 2367210 - protein, 5 aa, Entamoeba dispar
KGKGC

SEQ ID NO: 2367211 - protein, 6 aa, Entamoeba dispar
KGKGMT

SEQ ID NO: 2367212 - protein, 5 aa, Entamoeba dispar
KGKHE

SEQ ID NO: 2367213 - protein, 10 aa, Entamoeba dispar
KGKIKGTETK

SEQ ID NO: 2367214 - protein, 9 aa, Entamoeba dispar
KGKKQEIEN

SEQ ID NO: 2367215 - protein, 6 aa, Entamoeba dispar
KGKKYH

SEQ ID NO: 2367216 - protein, 10 aa, Entamoeba dispar
KGKLTEIKED

SEQ ID NO: 2367217 - protein, 6 aa, Entamoeba dispar
KGKNIG

SEQ ID NO: 2367218 - protein, 8 aa, Entamoeba dispar
KGKNTYIQ

SEQ ID NO: 2367219 - protein, 7 aa, Entamoeba dispar
KGKPDND

SEQ ID NO: 2367220 - protein, 5 aa, Entamoeba dispar
KGKQF

SEQ ID NO: 2367221 - protein, 7 aa, Entamoeba dispar
KGKQIEY

SEQ ID NO: 2367222 - protein, 7 aa, Entamoeba dispar
KGKQYEA

SEQ ID NO: 2367223 - protein, 10 aa, Entamoeba dispar
KGKSTISKIT

SEQ ID NO: 2367224 - protein, 7 aa, Entamoeba dispar
KGKYDKE

SEQ ID NO: 2367225 - protein, 13 aa, Entamoeba dispar
KGLEPMKEKIDER

SEQ ID NO: 2367226 - protein, 7 aa, Entamoeba dispar
KGLETFT

SEQ ID NO: 2367227 - protein, 8 aa, Entamoeba dispar
KGLGLKKK

SEQ ID NO: 2367228 - protein, 12 aa, Entamoeba dispar
KGLNFKKKNSNL

SEQ ID NO: 2367229 - protein, 12 aa, Entamoeba dispar
KGLNFKKKNSTL

SEQ ID NO: 2367230 - protein, 9 aa, Entamoeba dispar
KGLNSGNRE

SEQ ID NO: 2367231 - protein, 13 aa, Entamoeba dispar
KGLPRKWEPTDDV

SEQ ID NO: 2367232 - protein, 7 aa, Entamoeba dispar
KGNDEIA

SEQ ID NO: 2367233 - protein, 6 aa, Entamoeba dispar
KGNDSI

SEQ ID NO: 2367234 - protein, 8 aa, Entamoeba dispar
KGNEEQTR

SEQ ID NO: 2367235 - protein, 6 aa, Entamoeba dispar
KGNENK

SEQ ID NO: 2367236 - protein, 6 aa, Entamoeba dispar
KGNEQC

SEQ ID NO: 2367237 - protein, 9 aa, Entamoeba dispar
KGNETKGIE

SEQ ID NO: 2367238 - protein, 19 aa, Entamoeba dispar
KGNGLETEIAEGGSNFSIG

SEQ ID NO: 2367239 - protein, 9 aa, Entamoeba dispar
KGNHEGHDA

SEQ ID NO: 2367240 - protein, 6 aa, Entamoeba dispar
KGNKEG

SEQ ID NO: 2367241 - protein, 6 aa, Entamoeba dispar
KGNKQG

SEQ ID NO: 2367242 - protein, 10 aa, Entamoeba dispar
KGNKYNEERL

SEQ ID NO: 2367243 - protein, 14 aa, Entamoeba dispar
KGNQLVNEKRGEKV

SEQ ID NO: 2367244 - protein, 9 aa, Entamoeba dispar
KGNRKSEVP

SEQ ID NO: 2367245 - protein, 12 aa, Entamoeba dispar
KGNSGKDDQYSS

SEQ ID NO: 2367246 - protein, 7 aa, Entamoeba dispar
KGNVTNC

SEQ ID NO: 2367247 - protein, 7 aa, Entamoeba dispar
KGNYKGN

SEQ ID NO: 2367248 - protein, 6 aa, Entamoeba dispar
KGNYTS

SEQ ID NO: 2367249 - protein, 7 aa, Entamoeba dispar
KGPINIE

SEQ ID NO: 2367250 - protein, 9 aa, Entamoeba dispar
KGPSETDFA

SEQ ID NO: 2367251 - protein, 7 aa, Entamoeba dispar
KGQDETG

SEQ ID NO: 2367252 - protein, 7 aa, Entamoeba dispar
KGQDKEI

SEQ ID NO: 2367253 - protein, 4 aa, Entamoeba dispar
KGQE

SEQ ID NO: 2367254 - protein, 13 aa, Entamoeba dispar
KGQEPVPLEDEEK

SEQ ID NO: 2367255 - protein, 5 aa, Entamoeba dispar
KGQNL

SEQ ID NO: 2367256 - protein, 5 aa, Entamoeba dispar
KGQPT

SEQ ID NO: 2367257 - protein, 19 aa, Entamoeba dispar
KGQTQPEGGIINNSNPSYY

SEQ ID NO: 2367258 - protein, 5 aa, Entamoeba dispar
KGRFN

SEQ ID NO: 2367259 - protein, 7 aa, Entamoeba dispar
KGRNGEG

SEQ ID NO: 2367260 - protein, 8 aa, Entamoeba dispar
KGSEPEIA

SEQ ID NO: 2367261 - protein, 8 aa, Entamoeba dispar
KGSERREE

SEQ ID NO: 2367262 - protein, 10 aa, Entamoeba dispar
KGSKEGEYQT

SEQ ID NO: 2367263 - protein, 8 aa, Entamoeba dispar
KGSNTNII

SEQ ID NO: 2367264 - protein, 8 aa, Entamoeba dispar
KGSSLDNK

SEQ ID NO: 2367265 - protein, 8 aa, Entamoeba dispar
KGSSSSRV

SEQ ID NO: 2367266 - protein, 7 aa, Entamoeba dispar
KGSTTLS

SEQ ID NO: 2367267 - protein, 10 aa, Entamoeba dispar
KGSVKRPSLS

SEQ ID NO: 2367268 - protein, 19 aa, Entamoeba dispar
KGTEETQETVSIPQSKQEM

SEQ ID NO: 2367269 - protein, 12 aa, Entamoeba dispar
KGTEKQYTITTT

SEQ ID NO: 2367270 - protein, 7 aa, Entamoeba dispar
KGTFSQD

SEQ ID NO: 2367271 - protein, 8 aa, Entamoeba dispar
KGTFTPET

SEQ ID NO: 2367272 - protein, 6 aa, Entamoeba dispar
KGTIKN

SEQ ID NO: 2367273 - protein, 17 aa, Entamoeba dispar
KGTIKTLDTKQLDLSDQ

SEQ ID NO: 2367274 - protein, 4 aa, Entamoeba dispar
KGTN

SEQ ID NO: 2367275 - protein, 7 aa, Entamoeba dispar
KGTPKQL

SEQ ID NO: 2367276 - protein, 6 aa, Entamoeba dispar
KGTSSA

SEQ ID NO: 2367277 - protein, 8 aa, Entamoeba dispar
KGTTIESN

SEQ ID NO: 2367278 - protein, 12 aa, Entamoeba dispar
KGTTPPESAGHL

SEQ ID NO: 2367279 - protein, 12 aa, Entamoeba dispar
KGTTSDSESAGY

SEQ ID NO: 2367280 - protein, 7 aa, Entamoeba dispar
KGTVTNN

SEQ ID NO: 2367281 - protein, 8 aa, Entamoeba dispar
KGVGTPSF

SEQ ID NO: 2367282 - protein, 9 aa, Entamoeba dispar
KGVGTPSYM

SEQ ID NO: 2367283 - protein, 5 aa, Entamoeba dispar
KGVKS

SEQ ID NO: 2367284 - protein, 6 aa, Entamoeba dispar
KGVPKK

SEQ ID NO: 2367285 - protein, 8 aa, Entamoeba dispar
KGVSASPY

SEQ ID NO: 2367286 - protein, 6 aa, Entamoeba dispar
KGVSMD

SEQ ID NO: 2367287 - protein, 7 aa, Entamoeba dispar
KGWGPLQ

SEQ ID NO: 2367288 - protein, 4 aa, Entamoeba dispar
KGYA

SEQ ID NO: 2367289 - protein, 20 aa, Entamoeba dispar
KGYDDHYNRDYNEPPPLPEG

SEQ ID NO: 2367290 - protein, 10 aa, Entamoeba dispar
KGYKPDKKGN

SEQ ID NO: 2367291 - protein, 6 aa, Entamoeba dispar
KGYKSV

SEQ ID NO: 2367292 - protein, 10 aa, Entamoeba dispar
KGYNLNDKNC

SEQ ID NO: 2367293 - protein, 9 aa, Entamoeba dispar
KGYPAHSTS

SEQ ID NO: 2367294 - protein, 7 aa, Entamoeba dispar
KGYREDC

SEQ ID NO: 2367295 - protein, 17 aa, Entamoeba dispar
KGYSFDSSNPNKCNKCT

SEQ ID NO: 2367296 - protein, 6 aa, Entamoeba dispar
KGYTIK

SEQ ID NO: 2367297 - protein, 10 aa, Entamoeba dispar
KGYTPDKKGN

SEQ ID NO: 2367298 - protein, 6 aa, Entamoeba dispar
KGYYPR

SEQ ID NO: 2367299 - protein, 6 aa, Entamoeba dispar
KHAETT

SEQ ID NO: 2367300 - protein, 11 aa, Entamoeba dispar
KHDEKSFNGIN

SEQ ID NO: 2367301 - protein, 7 aa, Entamoeba dispar
KHDNDLY

SEQ ID NO: 2367302 - protein, 23 aa, Entamoeba dispar
KHEKEKEKKNSKEEQVIEEEEDW

SEQ ID NO: 2367303 - protein, 7 aa, Entamoeba dispar
KHGENPF

SEQ ID NO: 2367304 - protein, 8 aa, Entamoeba dispar
KHIPQGMQ

SEQ ID NO: 2367305 - protein, 8 aa, Entamoeba dispar
KHKEDPKI

SEQ ID NO: 2367306 - protein, 9 aa, Entamoeba dispar
KHKKRYPKS

SEQ ID NO: 2367307 - protein, 11 aa, Entamoeba dispar
KHKPSDRPTFK

SEQ ID NO: 2367308 - protein, 4 aa, Entamoeba dispar
KHNE

SEQ ID NO: 2367309 - protein, 10 aa, Entamoeba dispar
KHNPKDRPQF

SEQ ID NO: 2367310 - protein, 11 aa, Entamoeba dispar
KHNPSERPTFK

SEQ ID NO: 2367311 - protein, 11 aa, Entamoeba dispar
KHNRNTKHKNK

SEQ ID NO: 2367312 - protein, 12 aa, Entamoeba dispar
KHPENELSSKSV

SEQ ID NO: 2367313 - protein, 7 aa, Entamoeba dispar
KHPYGDS

SEQ ID NO: 2367314 - protein, 15 aa, Entamoeba dispar
KHQNLETGISKRSTR

SEQ ID NO: 2367315 - protein, 4 aa, Entamoeba dispar
KHQS

SEQ ID NO: 2367316 - protein, 14 aa, Entamoeba dispar
KHQYSDNLCSSGDS

SEQ ID NO: 2367317 - protein, 72 aa, Entamoeba dispar
KHSEDRPEVEDENKTDSGEQEMSYSEENDNQKGTKKYNKNNESIQSSDSLISEGNSVNEESSSEQEGESKEI

SEQ ID NO: 2367318 - protein, 12 aa, Entamoeba dispar
KHSFGPYKSYGT

SEQ ID NO: 2367319 - protein, 17 aa, Entamoeba dispar
KHSMDQSKRKVINLKTT

SEQ ID NO: 2367320 - protein, 6 aa, Entamoeba dispar
KHTDEE

SEQ ID NO: 2367321 - protein, 13 aa, Entamoeba dispar
KHTKGETSYEENG

SEQ ID NO: 2367322 - protein, 4 aa, Entamoeba dispar
KHTL

SEQ ID NO: 2367323 - protein, 8 aa, Entamoeba dispar
KHTPPLHP

SEQ ID NO: 2367324 - protein, 6 aa, Entamoeba dispar
KHTTNK

SEQ ID NO: 2367325 - protein, 18 aa, Entamoeba dispar
KIADGSICKDGECADSNG

SEQ ID NO: 2367326 - protein, 13 aa, Entamoeba dispar
KIDEEENAKLVKE

SEQ ID NO: 2367327 - protein, 6 aa, Entamoeba dispar
KIDENM

SEQ ID NO: 2367328 - protein, 18 aa, Entamoeba dispar
KIDNEETKGSNSQQSSEI

SEQ ID NO: 2367329 - protein, 50 aa, Entamoeba dispar
KIDNNNINNTNNEIKEENHTKQEHHITKSNSLQSDSTSFIQDKENKQREI

SEQ ID NO: 2367330 - protein, 7 aa, Entamoeba dispar
KIDPQQK

SEQ ID NO: 2367331 - protein, 7 aa, Entamoeba dispar
KIDPQSN

SEQ ID NO: 2367332 - protein, 7 aa, Entamoeba dispar
KIDSYGG

SEQ ID NO: 2367333 - protein, 24 aa, Entamoeba dispar
KIDVPTEIENNKNNYVKSINGDDP

SEQ ID NO: 2367334 - protein, 7 aa, Entamoeba dispar
KIEDSHG

SEQ ID NO: 2367335 - protein, 10 aa, Entamoeba dispar
KIEENQKKNI

SEQ ID NO: 2367336 - protein, 11 aa, Entamoeba dispar
KIEESKRVKER

SEQ ID NO: 2367337 - protein, 10 aa, Entamoeba dispar
KIEESPLVQT

SEQ ID NO: 2367338 - protein, 5 aa, Entamoeba dispar
KIEGC

SEQ ID NO: 2367339 - protein, 9 aa, Entamoeba dispar
KIEKEEPIG

SEQ ID NO: 2367340 - protein, 7 aa, Entamoeba dispar
KIEKEYE

SEQ ID NO: 2367341 - protein, 5 aa, Entamoeba dispar
KIEKK

SEQ ID NO: 2367342 - protein, 9 aa, Entamoeba dispar
KIESQEVNN

SEQ ID NO: 2367343 - protein, 9 aa, Entamoeba dispar
KIESQEVNS

SEQ ID NO: 2367344 - protein, 5 aa, Entamoeba dispar
KIETA

SEQ ID NO: 2367345 - protein, 7 aa, Entamoeba dispar
KIGDERN

SEQ ID NO: 2367346 - protein, 11 aa, Entamoeba dispar
KIGDIKSDDDT

SEQ ID NO: 2367347 - protein, 6 aa, Entamoeba dispar
KIGEGS

SEQ ID NO: 2367348 - protein, 9 aa, Entamoeba dispar
KIGEGSTGV

SEQ ID NO: 2367349 - protein, 31 aa, Entamoeba dispar
KIGERGKKVADLEKQADTMKQASSDLSASAV

SEQ ID NO: 2367350 - protein, 7 aa, Entamoeba dispar
KIGKTHN

SEQ ID NO: 2367351 - protein, 19 aa, Entamoeba dispar
KIISNSTISSVDSSITSST

SEQ ID NO: 2367352 - protein, 8 aa, Entamoeba dispar
KIKDKTEQ

SEQ ID NO: 2367353 - protein, 6 aa, Entamoeba dispar
KIKGNN

SEQ ID NO: 2367354 - protein, 13 aa, Entamoeba dispar
KIKNEGKRHISEI

SEQ ID NO: 2367355 - protein, 9 aa, Entamoeba dispar
KIKNELKEM

SEQ ID NO: 2367356 - protein, 10 aa, Entamoeba dispar
KIKQNNKSVT

SEQ ID NO: 2367357 - protein, 9 aa, Entamoeba dispar
KIKSDGIGK

SEQ ID NO: 2367358 - protein, 7 aa, Entamoeba dispar
KIKTDKK

SEQ ID NO: 2367359 - protein, 12 aa, Entamoeba dispar
KILDEEKGEGIN

SEQ ID NO: 2367360 - protein, 11 aa, Entamoeba dispar
KILTRNNNGEF

SEQ ID NO: 2367361 - protein, 10 aa, Entamoeba dispar
KINENEINSK

SEQ ID NO: 2367362 - protein, 9 aa, Entamoeba dispar
KINEPSESP

SEQ ID NO: 2367363 - protein, 8 aa, Entamoeba dispar
KINGNNVG

SEQ ID NO: 2367364 - protein, 7 aa, Entamoeba dispar
KINKDIN

SEQ ID NO: 2367365 - protein, 6 aa, Entamoeba dispar
KINKIN

SEQ ID NO: 2367366 - protein, 9 aa, Entamoeba dispar
KINKPSSSL

SEQ ID NO: 2367367 - protein, 6 aa, Entamoeba dispar
KINRPL

SEQ ID NO: 2367368 - protein, 8 aa, Entamoeba dispar
KINTKTTR

SEQ ID NO: 2367369 - protein, 10 aa, Entamoeba dispar
KIPGYQGNFT

SEQ ID NO: 2367370 - protein, 5 aa, Entamoeba dispar
KIPPI

SEQ ID NO: 2367371 - protein, 6 aa, Entamoeba dispar
KIPPKR

SEQ ID NO: 2367372 - protein, 7 aa, Entamoeba dispar
KIPPSLN

SEQ ID NO: 2367373 - protein, 6 aa, Entamoeba dispar
KIPSQL

SEQ ID NO: 2367374 - protein, 10 aa, Entamoeba dispar
KIQKRDMSAS

SEQ ID NO: 2367375 - protein, 17 aa, Entamoeba dispar
KIQNNQCNGDKEDQCYY

SEQ ID NO: 2367376 - protein, 8 aa, Entamoeba dispar
KIQRSKHE

SEQ ID NO: 2367377 - protein, 8 aa, Entamoeba dispar
KIQSLSKN

SEQ ID NO: 2367378 - protein, 9 aa, Entamoeba dispar
KIRENHKKV

SEQ ID NO: 2367379 - protein, 7 aa, Entamoeba dispar
KIRERED

SEQ ID NO: 2367380 - protein, 9 aa, Entamoeba dispar
KISASTSQK

SEQ ID NO: 2367381 - protein, 5 aa, Entamoeba dispar
KISED

SEQ ID NO: 2367382 - protein, 5 aa, Entamoeba dispar
KISEE

SEQ ID NO: 2367383 - protein, 8 aa, Entamoeba dispar
KISESSIG

SEQ ID NO: 2367384 - protein, 6 aa, Entamoeba dispar
KISGGA

SEQ ID NO: 2367385 - protein, 5 aa, Entamoeba dispar
KISGK

SEQ ID NO: 2367386 - protein, 7 aa, Entamoeba dispar
KISGPRE

SEQ ID NO: 2367387 - protein, 5 aa, Entamoeba dispar
KISLS

SEQ ID NO: 2367388 - protein, 8 aa, Entamoeba dispar
KISNGSNS

SEQ ID NO: 2367389 - protein, 14 aa, Entamoeba dispar
KISQKERRSTAPIS

SEQ ID NO: 2367390 - protein, 9 aa, Entamoeba dispar
KISRKRPSH

SEQ ID NO: 2367391 - protein, 7 aa, Entamoeba dispar
KISTKSK

SEQ ID NO: 2367392 - protein, 12 aa, Entamoeba dispar
KISTQSVPSNIE

SEQ ID NO: 2367393 - protein, 8 aa, Entamoeba dispar
KITDKKEV

SEQ ID NO: 2367394 - protein, 5 aa, Entamoeba dispar
KITDN

SEQ ID NO: 2367395 - protein, 10 aa, Entamoeba dispar
KITDSKKSMI

SEQ ID NO: 2367396 - protein, 7 aa, Entamoeba dispar
KITEASN

SEQ ID NO: 2367397 - protein, 7 aa, Entamoeba dispar
KITEEEK

SEQ ID NO: 2367398 - protein, 16 aa, Entamoeba dispar
KITEGKEQECIEDNDN

SEQ ID NO: 2367399 - protein, 8 aa, Entamoeba dispar
KITENKND

SEQ ID NO: 2367400 - protein, 13 aa, Entamoeba dispar
KITGTSSKVSLDY

SEQ ID NO: 2367401 - protein, 9 aa, Entamoeba dispar
KITIPKDSS

SEQ ID NO: 2367402 - protein, 5 aa, Entamoeba dispar
KITQP

SEQ ID NO: 2367403 - protein, 14 aa, Entamoeba dispar
KITQPSINKWSPKK

SEQ ID NO: 2367404 - protein, 6 aa, Entamoeba dispar
KITRSN

SEQ ID NO: 2367405 - protein, 5 aa, Entamoeba dispar
KITSD

SEQ ID NO: 2367406 - protein, 9 aa, Entamoeba dispar
KITSDQSSY

SEQ ID NO: 2367407 - protein, 5 aa, Entamoeba dispar
KITSK

SEQ ID NO: 2367408 - protein, 7 aa, Entamoeba dispar
KITTNTT

SEQ ID NO: 2367409 - protein, 7 aa, Entamoeba dispar
KITTPQE

SEQ ID NO: 2367410 - protein, 11 aa, Entamoeba dispar
KIVNTSNKNGV

SEQ ID NO: 2367411 - protein, 14 aa, Entamoeba dispar
KIVQSGYGLDNSET

SEQ ID NO: 2367412 - protein, 12 aa, Entamoeba dispar
KIYDENTKQYIP

SEQ ID NO: 2367413 - protein, 5 aa, Entamoeba dispar
KIYEE

SEQ ID NO: 2367414 - protein, 4 aa, Entamoeba dispar
KIYS

SEQ ID NO: 2367415 - protein, 8 aa, Entamoeba dispar
KKAAGEGY

SEQ ID NO: 2367416 - protein, 7 aa, Entamoeba dispar
KKADGND

SEQ ID NO: 2367417 - protein, 34 aa, Entamoeba dispar
KKADSSKSVEELKQEYEELKNKNKELENKLKTKE

SEQ ID NO: 2367418 - protein, 7 aa, Entamoeba dispar
KKAEMEK

SEQ ID NO: 2367419 - protein, 9 aa, Entamoeba dispar
KKAGQLLST

SEQ ID NO: 2367420 - protein, 13 aa, Entamoeba dispar
KKAKSNKDNEEKL

SEQ ID NO: 2367421 - protein, 4 aa, Entamoeba dispar
KKAP

SEQ ID NO: 2367422 - protein, 7 aa, Entamoeba dispar
KKAPITG

SEQ ID NO: 2367423 - protein, 6 aa, Entamoeba dispar
KKAPKH

SEQ ID NO: 2367424 - protein, 14 aa, Entamoeba dispar
KKAPSYKKLPDRKA

SEQ ID NO: 2367425 - protein, 4 aa, Entamoeba dispar
KKAQ

SEQ ID NO: 2367426 - protein, 8 aa, Entamoeba dispar
KKASTTIY

SEQ ID NO: 2367427 - protein, 8 aa, Entamoeba dispar
KKATIPPT

SEQ ID NO: 2367428 - protein, 6 aa, Entamoeba dispar
KKATKD

SEQ ID NO: 2367429 - protein, 8 aa, Entamoeba dispar
KKAVNKTS

SEQ ID NO: 2367430 - protein, 7 aa, Entamoeba dispar
KKAVSAN

SEQ ID NO: 2367431 - protein, 7 aa, Entamoeba dispar
KKAYSYQ

SEQ ID NO: 2367432 - protein, 13 aa, Entamoeba dispar
KKCNGKKDGECSK

SEQ ID NO: 2367433 - protein, 14 aa, Entamoeba dispar
KKCNGSGKVSETKE

SEQ ID NO: 2367434 - protein, 5 aa, Entamoeba dispar
KKCPP

SEQ ID NO: 2367435 - protein, 7 aa, Entamoeba dispar
KKCRDDN

SEQ ID NO: 2367436 - protein, 10 aa, Entamoeba dispar
KKCSEKTLNS

SEQ ID NO: 2367437 - protein, 7 aa, Entamoeba dispar
KKCSFKD

SEQ ID NO: 2367438 - protein, 28 aa, Entamoeba dispar
KKCSSKSSEECDKSDKTGKEKEDQIVDK

SEQ ID NO: 2367439 - protein, 4 aa, Entamoeba dispar
KKCT

SEQ ID NO: 2367440 - protein, 6 aa, Entamoeba dispar
KKDDPS

SEQ ID NO: 2367441 - protein, 9 aa, Entamoeba dispar
KKDDYETQQ

SEQ ID NO: 2367442 - protein, 9 aa, Entamoeba dispar
KKDENGNCV

SEQ ID NO: 2367443 - protein, 17 aa, Entamoeba dispar
KKDEQRYIKKVDYPSDL

SEQ ID NO: 2367444 - protein, 11 aa, Entamoeba dispar
KKDERFNPKNT

SEQ ID NO: 2367445 - protein, 13 aa, Entamoeba dispar
KKDFGKDSIKTPY

SEQ ID NO: 2367446 - protein, 5 aa, Entamoeba dispar
KKDGE

SEQ ID NO: 2367447 - protein, 8 aa, Entamoeba dispar
KKDGKDSV

SEQ ID NO: 2367448 - protein, 13 aa, Entamoeba dispar
KKDGKSKKWRQTW

SEQ ID NO: 2367449 - protein, 8 aa, Entamoeba dispar
KKDKENLK

SEQ ID NO: 2367450 - protein, 17 aa, Entamoeba dispar
KKDKHGDKCTGKTTNCQ

SEQ ID NO: 2367451 - protein, 9 aa, Entamoeba dispar
KKDKKEDIE

SEQ ID NO: 2367452 - protein, 5 aa, Entamoeba dispar
KKDLE

SEQ ID NO: 2367453 - protein, 6 aa, Entamoeba dispar
KKDNEK

SEQ ID NO: 2367454 - protein, 13 aa, Entamoeba dispar
KKDNNLEQKVKEL

SEQ ID NO: 2367455 - protein, 14 aa, Entamoeba dispar
KKDNNRIYDIDSLH

SEQ ID NO: 2367456 - protein, 7 aa, Entamoeba dispar
KKDPNDV

SEQ ID NO: 2367457 - protein, 8 aa, Entamoeba dispar
KKDREEMR

SEQ ID NO: 2367458 - protein, 5 aa, Entamoeba dispar
KKDVQ

SEQ ID NO: 2367459 - protein, 33 aa, Entamoeba dispar
KKDYDKYSREAEKRKEIEKNQRIKAAHERKEFE

SEQ ID NO: 2367460 - protein, 4 aa, Entamoeba dispar
KKEA

SEQ ID NO: 2367461 - protein, 16 aa, Entamoeba dispar
KKEAETSAHKKRVEEI

SEQ ID NO: 2367462 - protein, 8 aa, Entamoeba dispar
KKEALNQS

SEQ ID NO: 2367463 - protein, 16 aa, Entamoeba dispar
KKECSSGIDTEPPDYY

SEQ ID NO: 2367464 - protein, 6 aa, Entamoeba dispar
KKEDIF

SEQ ID NO: 2367465 - protein, 7 aa, Entamoeba dispar
KKEDLSD

SEQ ID NO: 2367466 - protein, 12 aa, Entamoeba dispar
KKEDNKEGKENN

SEQ ID NO: 2367467 - protein, 7 aa, Entamoeba dispar
KKEDNQH

SEQ ID NO: 2367468 - protein, 6 aa, Entamoeba dispar
KKEEEL

SEQ ID NO: 2367469 - protein, 8 aa, Entamoeba dispar
KKEEELNN

SEQ ID NO: 2367470 - protein, 43 aa, Entamoeba dispar
KKEEERKREEETKKKEDDKKKDDDKKTEEEKKKEEIKKKEEEL

SEQ ID NO: 2367471 - protein, 7 aa, Entamoeba dispar
KKEEESE

SEQ ID NO: 2367472 - protein, 22 aa, Entamoeba dispar
KKEEYNEKAKELSKKLDEHQKT

SEQ ID NO: 2367473 - protein, 11 aa, Entamoeba dispar
KKEGGKNNSEY

SEQ ID NO: 2367474 - protein, 10 aa, Entamoeba dispar
KKEGKNQKLK

SEQ ID NO: 2367475 - protein, 7 aa, Entamoeba dispar
KKEIEEY

SEQ ID NO: 2367476 - protein, 8 aa, Entamoeba dispar
KKEKEITQ

SEQ ID NO: 2367477 - protein, 11 aa, Entamoeba dispar
KKEKENKNIDE

SEQ ID NO: 2367478 - protein, 8 aa, Entamoeba dispar
KKEKGYKR

SEQ ID NO: 2367479 - protein, 17 aa, Entamoeba dispar
KKEKHTLDSRKNKNKRS

SEQ ID NO: 2367480 - protein, 30 aa, Entamoeba dispar
KKEKKITPRKKRSTSEKPLIKKSDTPENWD

SEQ ID NO: 2367481 - protein, 7 aa, Entamoeba dispar
KKEKKKM

SEQ ID NO: 2367482 - protein, 9 aa, Entamoeba dispar
KKEKKSTIS

SEQ ID NO: 2367483 - protein, 17 aa, Entamoeba dispar
KKEKQKRKEKKKQSKMR

SEQ ID NO: 2367484 - protein, 10 aa, Entamoeba dispar
KKEKSKTKSW

SEQ ID NO: 2367485 - protein, 6 aa, Entamoeba dispar
KKEKYE

SEQ ID NO: 2367486 - protein, 8 aa, Entamoeba dispar
KKELEDSA

SEQ ID NO: 2367487 - protein, 6 aa, Entamoeba dispar
KKENDK

SEQ ID NO: 2367488 - protein, 8 aa, Entamoeba dispar
KKENGNDY

SEQ ID NO: 2367489 - protein, 8 aa, Entamoeba dispar
KKENKELN

SEQ ID NO: 2367490 - protein, 17 aa, Entamoeba dispar
KKENKKKFKVVAKMDGK

SEQ ID NO: 2367491 - protein, 16 aa, Entamoeba dispar
KKENNEKSKKTNRNSS

SEQ ID NO: 2367492 - protein, 7 aa, Entamoeba dispar
KKENNIN

SEQ ID NO: 2367493 - protein, 7 aa, Entamoeba dispar
KKENPDL

SEQ ID NO: 2367494 - protein, 8 aa, Entamoeba dispar
KKENPDLI

SEQ ID NO: 2367495 - protein, 73 aa, Entamoeba dispar
KKENPDLIPQNSQSSQNSESDNKSHSSSTNGSSSQKNSHTSLSTQKNTPSGSGKSGSSHDSDSKKKKGKSKVS

SEQ ID NO: 2367496 - protein, 7 aa, Entamoeba dispar
KKENPEM

SEQ ID NO: 2367497 - protein, 6 aa, Entamoeba dispar
KKENQK

SEQ ID NO: 2367498 - protein, 18 aa, Entamoeba dispar
KKENRKGVSFGKPGSNQV

SEQ ID NO: 2367499 - protein, 10 aa, Entamoeba dispar
KKENSTGRLA

SEQ ID NO: 2367500 - protein, 17 aa, Entamoeba dispar
KKENSVNSHCNGDKRVE

SEQ ID NO: 2367501 - protein, 15 aa, Entamoeba dispar
KKEPSKHINKTQSIN

SEQ ID NO: 2367502 - protein, 7 aa, Entamoeba dispar
KKEPSKV

SEQ ID NO: 2367503 - protein, 5 aa, Entamoeba dispar
KKEQD

SEQ ID NO: 2367504 - protein, 5 aa, Entamoeba dispar
KKEQL

SEQ ID NO: 2367505 - protein, 11 aa, Entamoeba dispar
KKEQYDKSTYN

SEQ ID NO: 2367506 - protein, 7 aa, Entamoeba dispar
KKEREQR

SEQ ID NO: 2367507 - protein, 13 aa, Entamoeba dispar
KKERKNKQRNGIS

SEQ ID NO: 2367508 - protein, 9 aa, Entamoeba dispar
KKESGLEGK

SEQ ID NO: 2367509 - protein, 6 aa, Entamoeba dispar
KKESLT

SEQ ID NO: 2367510 - protein, 5 aa, Entamoeba dispar
KKETD

SEQ ID NO: 2367511 - protein, 6 aa, Entamoeba dispar
KKETFG

SEQ ID NO: 2367512 - protein, 11 aa, Entamoeba dispar
KKETIEEAPRR

SEQ ID NO: 2367513 - protein, 8 aa, Entamoeba dispar
KKETIKKN

SEQ ID NO: 2367514 - protein, 55 aa, Entamoeba dispar
KKETSKEIKEQTSLNQEKSIEEIKDNTKEKKESKQKLEIKKENKKIHKKEERKKT

SEQ ID NO: 2367515 - protein, 15 aa, Entamoeba dispar
KKEYEGVKKIKEEDT

SEQ ID NO: 2367516 - protein, 9 aa, Entamoeba dispar
KKEYGEWNK

SEQ ID NO: 2367517 - protein, 13 aa, Entamoeba dispar
KKEYKATEVKEPV

SEQ ID NO: 2367518 - protein, 9 aa, Entamoeba dispar
KKFEKRSDD

SEQ ID NO: 2367519 - protein, 7 aa, Entamoeba dispar
KKFGNNS

SEQ ID NO: 2367520 - protein, 7 aa, Entamoeba dispar
KKFNEDS

SEQ ID NO: 2367521 - protein, 7 aa, Entamoeba dispar
KKFPTGD

SEQ ID NO: 2367522 - protein, 7 aa, Entamoeba dispar
KKFPTSD

SEQ ID NO: 2367523 - protein, 12 aa, Entamoeba dispar
KKGAEAKLGKRV

SEQ ID NO: 2367524 - protein, 7 aa, Entamoeba dispar
KKGCSTK

SEQ ID NO: 2367525 - protein, 9 aa, Entamoeba dispar
KKGDEKEKD

SEQ ID NO: 2367526 - protein, 8 aa, Entamoeba dispar
KKGDNQTL

SEQ ID NO: 2367527 - protein, 18 aa, Entamoeba dispar
KKGEEERNEIKKENDVMK

SEQ ID NO: 2367528 - protein, 8 aa, Entamoeba dispar
KKGEEINP

SEQ ID NO: 2367529 - protein, 9 aa, Entamoeba dispar
KKGESIYQQ

SEQ ID NO: 2367530 - protein, 6 aa, Entamoeba dispar
KKGGDY

SEQ ID NO: 2367531 - protein, 9 aa, Entamoeba dispar
KKGIDNKTQ

SEQ ID NO: 2367532 - protein, 8 aa, Entamoeba dispar
KKGITPSS

SEQ ID NO: 2367533 - protein, 8 aa, Entamoeba dispar
KKGKKEGM

SEQ ID NO: 2367534 - protein, 7 aa, Entamoeba dispar
KKGLGTV

SEQ ID NO: 2367535 - protein, 8 aa, Entamoeba dispar
KKGLNGQK

SEQ ID NO: 2367536 - protein, 8 aa, Entamoeba dispar
KKGNNEKK

SEQ ID NO: 2367537 - protein, 7 aa, Entamoeba dispar
KKGNQEF

SEQ ID NO: 2367538 - protein, 6 aa, Entamoeba dispar
KKGNTL

SEQ ID NO: 2367539 - protein, 8 aa, Entamoeba dispar
KKGSGYND

SEQ ID NO: 2367540 - protein, 8 aa, Entamoeba dispar
KKGTPVEK

SEQ ID NO: 2367541 - protein, 10 aa, Entamoeba dispar
KKGTTTESNI

SEQ ID NO: 2367542 - protein, 5 aa, Entamoeba dispar
KKGYG

SEQ ID NO: 2367543 - protein, 12 aa, Entamoeba dispar
KKHKTKDHGKET

SEQ ID NO: 2367544 - protein, 6 aa, Entamoeba dispar
KKHQDI

SEQ ID NO: 2367545 - protein, 32 aa, Entamoeba dispar
KKIAENNSHISTTWTPSPIPPPSTPTPRPESI

SEQ ID NO: 2367546 - protein, 6 aa, Entamoeba dispar
KKIDTE

SEQ ID NO: 2367547 - protein, 23 aa, Entamoeba dispar
KKIEDRTDSLFDKGGSSKEKDSW

SEQ ID NO: 2367548 - protein, 12 aa, Entamoeba dispar
KKIEEAKQNESI

SEQ ID NO: 2367549 - protein, 14 aa, Entamoeba dispar
KKIEEINKEIKEER

SEQ ID NO: 2367550 - protein, 13 aa, Entamoeba dispar
KKIEEKRKEIEKK

SEQ ID NO: 2367551 - protein, 5 aa, Entamoeba dispar
KKIEG

SEQ ID NO: 2367552 - protein, 8 aa, Entamoeba dispar
KKIEGTEY

SEQ ID NO: 2367553 - protein, 12 aa, Entamoeba dispar
KKIEKKDDEKII

SEQ ID NO: 2367554 - protein, 13 aa, Entamoeba dispar
KKIERSNKRTNRR

SEQ ID NO: 2367555 - protein, 9 aa, Entamoeba dispar
KKIESEECS

SEQ ID NO: 2367556 - protein, 21 aa, Entamoeba dispar
KKIESPDISQNEETKRLIDSQ

SEQ ID NO: 2367557 - protein, 4 aa, Entamoeba dispar
KKIG

SEQ ID NO: 2367558 - protein, 7 aa, Entamoeba dispar
KKIGEGT

SEQ ID NO: 2367559 - protein, 6 aa, Entamoeba dispar
KKIHGT

SEQ ID NO: 2367560 - protein, 6 aa, Entamoeba dispar
KKIKGF

SEQ ID NO: 2367561 - protein, 12 aa, Entamoeba dispar
KKIKSDAETKGT

SEQ ID NO: 2367562 - protein, 11 aa, Entamoeba dispar
KKINDKTLTNN

SEQ ID NO: 2367563 - protein, 20 aa, Entamoeba dispar
KKINSLNKKEEGKSEKSEIE

SEQ ID NO: 2367564 - protein, 7 aa, Entamoeba dispar
KKIPSKS

SEQ ID NO: 2367565 - protein, 6 aa, Entamoeba dispar
KKISNA

SEQ ID NO: 2367566 - protein, 6 aa, Entamoeba dispar
KKITGK

SEQ ID NO: 2367567 - protein, 7 aa, Entamoeba dispar
KKITNSL

SEQ ID NO: 2367568 - protein, 6 aa, Entamoeba dispar
KKITVT

SEQ ID NO: 2367569 - protein, 6 aa, Entamoeba dispar
KKKAYP

SEQ ID NO: 2367570 - protein, 9 aa, Entamoeba dispar
KKKDESEVS

SEQ ID NO: 2367571 - protein, 12 aa, Entamoeba dispar
KKKEAESHFLNM

SEQ ID NO: 2367572 - protein, 21 aa, Entamoeba dispar
KKKEEENKKLEGDEDDDPLER

SEQ ID NO: 2367573 - protein, 11 aa, Entamoeba dispar
KKKEGEPERGY

SEQ ID NO: 2367574 - protein, 8 aa, Entamoeba dispar
KKKEGNDF

SEQ ID NO: 2367575 - protein, 7 aa, Entamoeba dispar
KKKEQCA

SEQ ID NO: 2367576 - protein, 9 aa, Entamoeba dispar
KKKESIERG

SEQ ID NO: 2367577 - protein, 17 aa, Entamoeba dispar
KKKGGKGDSKEKEEEEI

SEQ ID NO: 2367578 - protein, 9 aa, Entamoeba dispar
KKKGIIEQR

SEQ ID NO: 2367579 - protein, 6 aa, Entamoeba dispar
KKKHPS

SEQ ID NO: 2367580 - protein, 33 aa, Entamoeba dispar
KKKIKSKEESQIKETTQETSYKQEKEIINEKNK

SEQ ID NO: 2367581 - protein, 31 aa, Entamoeba dispar
KKKKEEEKMSNEHPSNSTHDQPQSTPNINRP

SEQ ID NO: 2367582 - protein, 9 aa, Entamoeba dispar
KKKKEQEKT

SEQ ID NO: 2367583 - protein, 8 aa, Entamoeba dispar
KKKKSTKF

SEQ ID NO: 2367584 - protein, 6 aa, Entamoeba dispar
KKKKYY

SEQ ID NO: 2367585 - protein, 8 aa, Entamoeba dispar
KKKLNIES

SEQ ID NO: 2367586 - protein, 8 aa, Entamoeba dispar
KKKMSVSK

SEQ ID NO: 2367587 - protein, 7 aa, Entamoeba dispar
KKKNEKL

SEQ ID NO: 2367588 - protein, 8 aa, Entamoeba dispar
KKKPPTIE

SEQ ID NO: 2367589 - protein, 6 aa, Entamoeba dispar
KKKPYC

SEQ ID NO: 2367590 - protein, 7 aa, Entamoeba dispar
KKKRGVQ

SEQ ID NO: 2367591 - protein, 9 aa, Entamoeba dispar
KKKSELGET

SEQ ID NO: 2367592 - protein, 15 aa, Entamoeba dispar
KKKSKNEDKGLGTPI

SEQ ID NO: 2367593 - protein, 12 aa, Entamoeba dispar
KKKSNGEIEETN

SEQ ID NO: 2367594 - protein, 9 aa, Entamoeba dispar
KKKTKSSKY

SEQ ID NO: 2367595 - protein, 12 aa, Entamoeba dispar
KKKTSTQSSYGG

SEQ ID NO: 2367596 - protein, 6 aa, Entamoeba dispar
KKKTYP

SEQ ID NO: 2367597 - protein, 10 aa, Entamoeba dispar
KKKVSSSKMT

SEQ ID NO: 2367598 - protein, 16 aa, Entamoeba dispar
KKKYTLEGKLNNSSLE

SEQ ID NO: 2367599 - protein, 5 aa, Entamoeba dispar
KKLEE

SEQ ID NO: 2367600 - protein, 13 aa, Entamoeba dispar
KKLEEEEKELNNK

SEQ ID NO: 2367601 - protein, 12 aa, Entamoeba dispar
KKLEERKAKITE

SEQ ID NO: 2367602 - protein, 7 aa, Entamoeba dispar
KKLGEGA

SEQ ID NO: 2367603 - protein, 35 aa, Entamoeba dispar
KKLIQSSGNWRQKNEEAKKLQQEKEEKERKIKEEK

SEQ ID NO: 2367604 - protein, 21 aa, Entamoeba dispar
KKLKKHKQTILDGKSDPFSKQ

SEQ ID NO: 2367605 - protein, 9 aa, Entamoeba dispar
KKLNKKPLV

SEQ ID NO: 2367606 - protein, 7 aa, Entamoeba dispar
KKLPDTK

SEQ ID NO: 2367607 - protein, 7 aa, Entamoeba dispar
KKLPKEA

SEQ ID NO: 2367608 - protein, 7 aa, Entamoeba dispar
KKLPPIN

SEQ ID NO: 2367609 - protein, 38 aa, Entamoeba dispar
KKLTNKSITITNGGEINYSEKTGLLSQEKEEIQTKIDP

SEQ ID NO: 2367610 - protein, 10 aa, Entamoeba dispar
KKMAQGKSGF

SEQ ID NO: 2367611 - protein, 4 aa, Entamoeba dispar
KKMT

SEQ ID NO: 2367612 - protein, 13 aa, Entamoeba dispar
KKNDGTESNPDEC

SEQ ID NO: 2367613 - protein, 9 aa, Entamoeba dispar
KKNDKKKYR

SEQ ID NO: 2367614 - protein, 7 aa, Entamoeba dispar
KKNDYQD

SEQ ID NO: 2367615 - protein, 5 aa, Entamoeba dispar
KKNEN

SEQ ID NO: 2367616 - protein, 9 aa, Entamoeba dispar
KKNETNSIN

SEQ ID NO: 2367617 - protein, 9 aa, Entamoeba dispar
KKNGGKRHS

SEQ ID NO: 2367618 - protein, 9 aa, Entamoeba dispar
KKNGGNSEL

SEQ ID NO: 2367619 - protein, 8 aa, Entamoeba dispar
KKNGTKIY

SEQ ID NO: 2367620 - protein, 8 aa, Entamoeba dispar
KKNIEEVT

SEQ ID NO: 2367621 - protein, 5 aa, Entamoeba dispar
KKNIL

SEQ ID NO: 2367622 - protein, 29 aa, Entamoeba dispar
KKNIQNNINENQNEISEIENKEDDNDEWD

SEQ ID NO: 2367623 - protein, 7 aa, Entamoeba dispar
KKNITTK

SEQ ID NO: 2367624 - protein, 7 aa, Entamoeba dispar
KKNKDKI

SEQ ID NO: 2367625 - protein, 16 aa, Entamoeba dispar
KKNKKFPGNKVSTTKY

SEQ ID NO: 2367626 - protein, 7 aa, Entamoeba dispar
KKNKTHI

SEQ ID NO: 2367627 - protein, 8 aa, Entamoeba dispar
KKNKTRYN

SEQ ID NO: 2367628 - protein, 8 aa, Entamoeba dispar
KKNLTENI

SEQ ID NO: 2367629 - protein, 6 aa, Entamoeba dispar
KKNNER

SEQ ID NO: 2367630 - protein, 5 aa, Entamoeba dispar
KKNPK

SEQ ID NO: 2367631 - protein, 8 aa, Entamoeba dispar
KKNPNYTF

SEQ ID NO: 2367632 - protein, 8 aa, Entamoeba dispar
KKNPTEVK

SEQ ID NO: 2367633 - protein, 8 aa, Entamoeba dispar
KKNQPYKN

SEQ ID NO: 2367634 - protein, 20 aa, Entamoeba dispar
KKNSNDSDIPKIISTIDISS

SEQ ID NO: 2367635 - protein, 8 aa, Entamoeba dispar
KKNTEKLH

SEQ ID NO: 2367636 - protein, 6 aa, Entamoeba dispar
KKNYEN

SEQ ID NO: 2367637 - protein, 9 aa, Entamoeba dispar
KKNYNKYDS

SEQ ID NO: 2367638 - protein, 5 aa, Entamoeba dispar
KKPAD

SEQ ID NO: 2367639 - protein, 7 aa, Entamoeba dispar
KKPEQPR

SEQ ID NO: 2367640 - protein, 4 aa, Entamoeba dispar
KKPS

SEQ ID NO: 2367641 - protein, 6 aa, Entamoeba dispar
KKPTWN

SEQ ID NO: 2367642 - protein, 6 aa, Entamoeba dispar
KKPYTY

SEQ ID NO: 2367643 - protein, 15 aa, Entamoeba dispar
KKQDEQLDKLSENIN

SEQ ID NO: 2367644 - protein, 7 aa, Entamoeba dispar
KKQGNDS

SEQ ID NO: 2367645 - protein, 28 aa, Entamoeba dispar
KKQKETNIESPEDDSSIIATDETDAEIM

SEQ ID NO: 2367646 - protein, 24 aa, Entamoeba dispar
KKQKPTDENGIELKERKSTDENIE

SEQ ID NO: 2367647 - protein, 9 aa, Entamoeba dispar
KKQKSTNHL

SEQ ID NO: 2367648 - protein, 8 aa, Entamoeba dispar
KKQLGNEE

SEQ ID NO: 2367649 - protein, 13 aa, Entamoeba dispar
KKQNEEIKPLNTQ

SEQ ID NO: 2367650 - protein, 11 aa, Entamoeba dispar
KKQNEELKKKC

SEQ ID NO: 2367651 - protein, 31 aa, Entamoeba dispar
KKQNKLSNEPFQESIKTNAAPIPSSLKTKPI

SEQ ID NO: 2367652 - protein, 12 aa, Entamoeba dispar
KKQPKNTRNSGN

SEQ ID NO: 2367653 - protein, 5 aa, Entamoeba dispar
KKQRI

SEQ ID NO: 2367654 - protein, 13 aa, Entamoeba dispar
KKQRQSFKNSQET

SEQ ID NO: 2367655 - protein, 7 aa, Entamoeba dispar
KKQRTEV

SEQ ID NO: 2367656 - protein, 5 aa, Entamoeba dispar
KKQSI

SEQ ID NO: 2367657 - protein, 8 aa, Entamoeba dispar
KKQTNEYF

SEQ ID NO: 2367658 - protein, 4 aa, Entamoeba dispar
KKRA

SEQ ID NO: 2367659 - protein, 17 aa, Entamoeba dispar
KKREGNNEKKKEQHHKK

SEQ ID NO: 2367660 - protein, 5 aa, Entamoeba dispar
KKREK

SEQ ID NO: 2367661 - protein, 17 aa, Entamoeba dispar
KKRFTQDQVNELLNQCT

SEQ ID NO: 2367662 - protein, 5 aa, Entamoeba dispar
KKRME

SEQ ID NO: 2367663 - protein, 6 aa, Entamoeba dispar
KKRNDK

SEQ ID NO: 2367664 - protein, 8 aa, Entamoeba dispar
KKRPEQSH

SEQ ID NO: 2367665 - protein, 11 aa, Entamoeba dispar
KKRPTKPDDMR

SEQ ID NO: 2367666 - protein, 4 aa, Entamoeba dispar
KKRQ

SEQ ID NO: 2367667 - protein, 14 aa, Entamoeba dispar
KKRSNEYPQYKPNK

SEQ ID NO: 2367668 - protein, 10 aa, Entamoeba dispar
KKRTENLSDN

SEQ ID NO: 2367669 - protein, 9 aa, Entamoeba dispar
KKSADTGAE

SEQ ID NO: 2367670 - protein, 4 aa, Entamoeba dispar
KKSF

SEQ ID NO: 2367671 - protein, 10 aa, Entamoeba dispar
KKSGKEEIKD

SEQ ID NO: 2367672 - protein, 6 aa, Entamoeba dispar
KKSHTL

SEQ ID NO: 2367673 - protein, 5 aa, Entamoeba dispar
KKSID

SEQ ID NO: 2367674 - protein, 14 aa, Entamoeba dispar
KKSIPKTTTPPKLQ

SEQ ID NO: 2367675 - protein, 11 aa, Entamoeba dispar
KKSIPSNVDGL

SEQ ID NO: 2367676 - protein, 4 aa, Entamoeba dispar
KKSK

SEQ ID NO: 2367677 - protein, 8 aa, Entamoeba dispar
KKSKKSVK

SEQ ID NO: 2367678 - protein, 14 aa, Entamoeba dispar
KKSKNPTTNTYRSR

SEQ ID NO: 2367679 - protein, 10 aa, Entamoeba dispar
KKSKSDYKSS

SEQ ID NO: 2367680 - protein, 8 aa, Entamoeba dispar
KKSKSKGI

SEQ ID NO: 2367681 - protein, 14 aa, Entamoeba dispar
KKSLKIDRKNQKIS

SEQ ID NO: 2367682 - protein, 11 aa, Entamoeba dispar
KKSPWKELRGK

SEQ ID NO: 2367683 - protein, 6 aa, Entamoeba dispar
KKSQAI

SEQ ID NO: 2367684 - protein, 7 aa, Entamoeba dispar
KKSQTPI

SEQ ID NO: 2367685 - protein, 15 aa, Entamoeba dispar
KKSSCDNENKGLGTP

SEQ ID NO: 2367686 - protein, 8 aa, Entamoeba dispar
KKSSEKAI

SEQ ID NO: 2367687 - protein, 12 aa, Entamoeba dispar
KKSSKKDFACLL

SEQ ID NO: 2367688 - protein, 9 aa, Entamoeba dispar
KKSSLSLPN

SEQ ID NO: 2367689 - protein, 12 aa, Entamoeba dispar
KKSTLSQKVIVI

SEQ ID NO: 2367690 - protein, 8 aa, Entamoeba dispar
KKSTNEIK

SEQ ID NO: 2367691 - protein, 9 aa, Entamoeba dispar
KKSTSSSVE

SEQ ID NO: 2367692 - protein, 13 aa, Entamoeba dispar
KKSTVTKRPHIKH

SEQ ID NO: 2367693 - protein, 5 aa, Entamoeba dispar
KKSYL

SEQ ID NO: 2367694 - protein, 12 aa, Entamoeba dispar
KKTAEDQSALDS

SEQ ID NO: 2367695 - protein, 7 aa, Entamoeba dispar
KKTCEIE

SEQ ID NO: 2367696 - protein, 7 aa, Entamoeba dispar
KKTEDKH

SEQ ID NO: 2367697 - protein, 15 aa, Entamoeba dispar
KKTEEEHETKPGQSH

SEQ ID NO: 2367698 - protein, 8 aa, Entamoeba dispar
KKTENEIP

SEQ ID NO: 2367699 - protein, 8 aa, Entamoeba dispar
KKTEPRIE

SEQ ID NO: 2367700 - protein, 8 aa, Entamoeba dispar
KKTEQKPI

SEQ ID NO: 2367701 - protein, 8 aa, Entamoeba dispar
KKTGGLTR

SEQ ID NO: 2367702 - protein, 21 aa, Entamoeba dispar
KKTISLTKTETLKKRSGSSGI

SEQ ID NO: 2367703 - protein, 4 aa, Entamoeba dispar
KKTK

SEQ ID NO: 2367704 - protein, 5 aa, Entamoeba dispar
KKTKQ

SEQ ID NO: 2367705 - protein, 31 aa, Entamoeba dispar
KKTNEYSKVGNNENWDDDFGNAKNENSDEGF

SEQ ID NO: 2367706 - protein, 15 aa, Entamoeba dispar
KKTNKSEDKGLGTPI

SEQ ID NO: 2367707 - protein, 7 aa, Entamoeba dispar
KKTNKTR

SEQ ID NO: 2367708 - protein, 7 aa, Entamoeba dispar
KKTQAKQ

SEQ ID NO: 2367709 - protein, 10 aa, Entamoeba dispar
KKTQEELRTS

SEQ ID NO: 2367710 - protein, 7 aa, Entamoeba dispar
KKTQSRL

SEQ ID NO: 2367711 - protein, 44 aa, Entamoeba dispar
KKTQTNIVTEKKEISDNLKNSQPQSQLPLSNEQSTSFNTTIPPK

SEQ ID NO: 2367712 - protein, 63 aa, Entamoeba dispar
KKTSDKSKSDSHNKNHSGSTKTNTKSKDISSSEQKSTTNTTTNTLEDQGESIEASASSQIVDD

SEQ ID NO: 2367713 - protein, 30 aa, Entamoeba dispar
KKTSDKSKSDSNNKNNSSSTKTNTKSKDIS

SEQ ID NO: 2367714 - protein, 6 aa, Entamoeba dispar
KKTSEL

SEQ ID NO: 2367715 - protein, 6 aa, Entamoeba dispar
KKTSNQ

SEQ ID NO: 2367716 - protein, 8 aa, Entamoeba dispar
KKTSSVKI

SEQ ID NO: 2367717 - protein, 4 aa, Entamoeba dispar
KKTV

SEQ ID NO: 2367718 - protein, 13 aa, Entamoeba dispar
KKVDELKEELNQV

SEQ ID NO: 2367719 - protein, 8 aa, Entamoeba dispar
KKVDNKPL

SEQ ID NO: 2367720 - protein, 8 aa, Entamoeba dispar
KKVGEGSF

SEQ ID NO: 2367721 - protein, 6 aa, Entamoeba dispar
KKVISS

SEQ ID NO: 2367722 - protein, 10 aa, Entamoeba dispar
KKVKAKKGFT

SEQ ID NO: 2367723 - protein, 5 aa, Entamoeba dispar
KKVLD

SEQ ID NO: 2367724 - protein, 4 aa, Entamoeba dispar
KKVN

SEQ ID NO: 2367725 - protein, 7 aa, Entamoeba dispar
KKVPNER

SEQ ID NO: 2367726 - protein, 5 aa, Entamoeba dispar
KKVSH

SEQ ID NO: 2367727 - protein, 4 aa, Entamoeba dispar
KKWD

SEQ ID NO: 2367728 - protein, 16 aa, Entamoeba dispar
KKYDEADSSVAGHDEN

SEQ ID NO: 2367729 - protein, 7 aa, Entamoeba dispar
KKYEITS

SEQ ID NO: 2367730 - protein, 8 aa, Entamoeba dispar
KKYEKPAD

SEQ ID NO: 2367731 - protein, 6 aa, Entamoeba dispar
KKYGSI

SEQ ID NO: 2367732 - protein, 8 aa, Entamoeba dispar
KKYIDKRN

SEQ ID NO: 2367733 - protein, 10 aa, Entamoeba dispar
KKYKKEGKKY

SEQ ID NO: 2367734 - protein, 8 aa, Entamoeba dispar
KKYKTAAD

SEQ ID NO: 2367735 - protein, 12 aa, Entamoeba dispar
KLAKEEKEIRNE

SEQ ID NO: 2367736 - protein, 20 aa, Entamoeba dispar
KLDPSTSSFSNSTTKGSIGW

SEQ ID NO: 2367737 - protein, 7 aa, Entamoeba dispar
KLDQPTE

SEQ ID NO: 2367738 - protein, 10 aa, Entamoeba dispar
KLDSSSSSSK

SEQ ID NO: 2367739 - protein, 7 aa, Entamoeba dispar
KLEDGSC

SEQ ID NO: 2367740 - protein, 6 aa, Entamoeba dispar
KLEEKT

SEQ ID NO: 2367741 - protein, 5 aa, Entamoeba dispar
KLEER

SEQ ID NO: 2367742 - protein, 28 aa, Entamoeba dispar
KLEESNKSLKENDYHTKESKKEDTQNIK

SEQ ID NO: 2367743 - protein, 14 aa, Entamoeba dispar
KLEKAKKAKNKFKG

SEQ ID NO: 2367744 - protein, 5 aa, Entamoeba dispar
KLEKE

SEQ ID NO: 2367745 - protein, 9 aa, Entamoeba dispar
KLEKGVKES

SEQ ID NO: 2367746 - protein, 22 aa, Entamoeba dispar
KLEKKEKEKEHKFTENEAYQSD

SEQ ID NO: 2367747 - protein, 22 aa, Entamoeba dispar
KLEKKEKEKEHKFTENETYQSD

SEQ ID NO: 2367748 - protein, 11 aa, Entamoeba dispar
KLERGNNEEIA

SEQ ID NO: 2367749 - protein, 12 aa, Entamoeba dispar
KLFGEPAERNGI

SEQ ID NO: 2367750 - protein, 10 aa, Entamoeba dispar
KLFKTQKEYY

SEQ ID NO: 2367751 - protein, 6 aa, Entamoeba dispar
KLGELT

SEQ ID NO: 2367752 - protein, 5 aa, Entamoeba dispar
KLGEY

SEQ ID NO: 2367753 - protein, 12 aa, Entamoeba dispar
KLGGLESKAEEL

SEQ ID NO: 2367754 - protein, 22 aa, Entamoeba dispar
KLGGYENKKKREKLEKDQSTLK

SEQ ID NO: 2367755 - protein, 16 aa, Entamoeba dispar
KLGKNTCAVGDGGNDV

SEQ ID NO: 2367756 - protein, 7 aa, Entamoeba dispar
KLGKTKR

SEQ ID NO: 2367757 - protein, 10 aa, Entamoeba dispar
KLGNHPISNT

SEQ ID NO: 2367758 - protein, 9 aa, Entamoeba dispar
KLGSDSSEI

SEQ ID NO: 2367759 - protein, 8 aa, Entamoeba dispar
KLGSSSGP

SEQ ID NO: 2367760 - protein, 9 aa, Entamoeba dispar
KLINTSNKT

SEQ ID NO: 2367761 - protein, 4 aa, Entamoeba dispar
KLKD

SEQ ID NO: 2367762 - protein, 14 aa, Entamoeba dispar
KLKEDKKKNEKEDI

SEQ ID NO: 2367763 - protein, 6 aa, Entamoeba dispar
KLKEGD

SEQ ID NO: 2367764 - protein, 12 aa, Entamoeba dispar
KLKEKTDSISES

SEQ ID NO: 2367765 - protein, 5 aa, Entamoeba dispar
KLKHS

SEQ ID NO: 2367766 - protein, 8 aa, Entamoeba dispar
KLKKEDHS

SEQ ID NO: 2367767 - protein, 12 aa, Entamoeba dispar
KLKKKKAKKGFT

SEQ ID NO: 2367768 - protein, 7 aa, Entamoeba dispar
KLKNPTM

SEQ ID NO: 2367769 - protein, 8 aa, Entamoeba dispar
KLKPNEDY

SEQ ID NO: 2367770 - protein, 10 aa, Entamoeba dispar
KLKQSESSIR

SEQ ID NO: 2367771 - protein, 14 aa, Entamoeba dispar
KLNEKETIPEDESL

SEQ ID NO: 2367772 - protein, 5 aa, Entamoeba dispar
KLNEL

SEQ ID NO: 2367773 - protein, 9 aa, Entamoeba dispar
KLNEQHKSK

SEQ ID NO: 2367774 - protein, 4 aa, Entamoeba dispar
KLNK

SEQ ID NO: 2367775 - protein, 7 aa, Entamoeba dispar
KLNKETH

SEQ ID NO: 2367776 - protein, 28 aa, Entamoeba dispar
KLNKKEQEEIKENKELNYKESTSISEEF

SEQ ID NO: 2367777 - protein, 9 aa, Entamoeba dispar
KLNKPKSEL

SEQ ID NO: 2367778 - protein, 7 aa, Entamoeba dispar
KLNKQQK

SEQ ID NO: 2367779 - protein, 9 aa, Entamoeba dispar
KLNNKTPFK

SEQ ID NO: 2367780 - protein, 5 aa, Entamoeba dispar
KLNNT

SEQ ID NO: 2367781 - protein, 9 aa, Entamoeba dispar
KLNQNSSAS

SEQ ID NO: 2367782 - protein, 14 aa, Entamoeba dispar
KLNSSSNQSSIEKI

SEQ ID NO: 2367783 - protein, 4 aa, Entamoeba dispar
KLNY

SEQ ID NO: 2367784 - protein, 13 aa, Entamoeba dispar
KLPDETDSLTGEV

SEQ ID NO: 2367785 - protein, 6 aa, Entamoeba dispar
KLPHPN

SEQ ID NO: 2367786 - protein, 6 aa, Entamoeba dispar
KLPNDY

SEQ ID NO: 2367787 - protein, 5 aa, Entamoeba dispar
KLPPI

SEQ ID NO: 2367788 - protein, 4 aa, Entamoeba dispar
KLPQ

SEQ ID NO: 2367789 - protein, 8 aa, Entamoeba dispar
KLPQGSLK

SEQ ID NO: 2367790 - protein, 11 aa, Entamoeba dispar
KLPSKKSKNTL

SEQ ID NO: 2367791 - protein, 9 aa, Entamoeba dispar
KLPSNENEE

SEQ ID NO: 2367792 - protein, 8 aa, Entamoeba dispar
KLPTKLTS

SEQ ID NO: 2367793 - protein, 6 aa, Entamoeba dispar
KLPTNL

SEQ ID NO: 2367794 - protein, 6 aa, Entamoeba dispar
KLPVSV

SEQ ID NO: 2367795 - protein, 6 aa, Entamoeba dispar
KLPWKG

SEQ ID NO: 2367796 - protein, 9 aa, Entamoeba dispar
KLQEEHKVT

SEQ ID NO: 2367797 - protein, 15 aa, Entamoeba dispar
KLQEEKQETDKERDL

SEQ ID NO: 2367798 - protein, 12 aa, Entamoeba dispar
KLQENEKRKGIG

SEQ ID NO: 2367799 - protein, 8 aa, Entamoeba dispar
KLQESTLK

SEQ ID NO: 2367800 - protein, 5 aa, Entamoeba dispar
KLQIQ

SEQ ID NO: 2367801 - protein, 7 aa, Entamoeba dispar
KLQTVNT

SEQ ID NO: 2367802 - protein, 7 aa, Entamoeba dispar
KLRDRKK

SEQ ID NO: 2367803 - protein, 5 aa, Entamoeba dispar
KLRIE

SEQ ID NO: 2367804 - protein, 4 aa, Entamoeba dispar
KLRN

SEQ ID NO: 2367805 - protein, 10 aa, Entamoeba dispar
KLRRKTKEDY

SEQ ID NO: 2367806 - protein, 7 aa, Entamoeba dispar
KLSDDNI

SEQ ID NO: 2367807 - protein, 8 aa, Entamoeba dispar
KLSDSTSY

SEQ ID NO: 2367808 - protein, 8 aa, Entamoeba dispar
KLSENTRN

SEQ ID NO: 2367809 - protein, 6 aa, Entamoeba dispar
KLSEQQ

SEQ ID NO: 2367810 - protein, 31 aa, Entamoeba dispar
KLSKKEKEKIEKAKEEEQRKKEEEKQRRREE

SEQ ID NO: 2367811 - protein, 6 aa, Entamoeba dispar
KLSNQE

SEQ ID NO: 2367812 - protein, 7 aa, Entamoeba dispar
KLSNQRM

SEQ ID NO: 2367813 - protein, 18 aa, Entamoeba dispar
KLSPLESPSHLNETSNEL

SEQ ID NO: 2367814 - protein, 5 aa, Entamoeba dispar
KLSPY

SEQ ID NO: 2367815 - protein, 6 aa, Entamoeba dispar
KLSQGP

SEQ ID NO: 2367816 - protein, 6 aa, Entamoeba dispar
KLSQKQ

SEQ ID NO: 2367817 - protein, 39 aa, Entamoeba dispar
KLSQSDEFSSEESSGNKQSDKNDDSSENEESQKSDNPTK

SEQ ID NO: 2367818 - protein, 6 aa, Entamoeba dispar
KLSRDR

SEQ ID NO: 2367819 - protein, 8 aa, Entamoeba dispar
KLSSDQIT

SEQ ID NO: 2367820 - protein, 16 aa, Entamoeba dispar
KLSTPTSIEGITSGLN

SEQ ID NO: 2367821 - protein, 6 aa, Entamoeba dispar
KLSTRL

SEQ ID NO: 2367822 - protein, 19 aa, Entamoeba dispar
KLTDAQNDLKKGSKDQQLS

SEQ ID NO: 2367823 - protein, 9 aa, Entamoeba dispar
KLTDFGSAR

SEQ ID NO: 2367824 - protein, 30 aa, Entamoeba dispar
KLTDFGTSRNINSFQQNKTFTKGIGTPTYM

SEQ ID NO: 2367825 - protein, 18 aa, Entamoeba dispar
KLTGTTQSMSCGSSVEKV

SEQ ID NO: 2367826 - protein, 10 aa, Entamoeba dispar
KLTKPKNDPY

SEQ ID NO: 2367827 - protein, 10 aa, Entamoeba dispar
KLTNPTNTFS

SEQ ID NO: 2367828 - protein, 15 aa, Entamoeba dispar
KLTQGGDNRKGNNYI

SEQ ID NO: 2367829 - protein, 6 aa, Entamoeba dispar
KLTQSN

SEQ ID NO: 2367830 - protein, 15 aa, Entamoeba dispar
KLTQYRKHHEVYNLQ

SEQ ID NO: 2367831 - protein, 4 aa, Entamoeba dispar
KLTS

SEQ ID NO: 2367832 - protein, 7 aa, Entamoeba dispar
KLYPAED

SEQ ID NO: 2367833 - protein, 5 aa, Entamoeba dispar
KMETA

SEQ ID NO: 2367834 - protein, 9 aa, Entamoeba dispar
KMETKPENT

SEQ ID NO: 2367835 - protein, 5 aa, Entamoeba dispar
KMGDE

SEQ ID NO: 2367836 - protein, 6 aa, Entamoeba dispar
KMKQPN

SEQ ID NO: 2367837 - protein, 9 aa, Entamoeba dispar
KMNEKQTTF

SEQ ID NO: 2367838 - protein, 12 aa, Entamoeba dispar
KMPNTSKLNNSD

SEQ ID NO: 2367839 - protein, 4 aa, Entamoeba dispar
KMPT

SEQ ID NO: 2367840 - protein, 11 aa, Entamoeba dispar
KMQKENKRNEF

SEQ ID NO: 2367841 - protein, 6 aa, Entamoeba dispar
KMRQGQ

SEQ ID NO: 2367842 - protein, 13 aa, Entamoeba dispar
KMRQGQTLISFFY

SEQ ID NO: 2367843 - protein, 9 aa, Entamoeba dispar
KMSKDTKIE

SEQ ID NO: 2367844 - protein, 10 aa, Entamoeba dispar
KMSKPKEYTT

SEQ ID NO: 2367845 - protein, 5 aa, Entamoeba dispar
KMSNG

SEQ ID NO: 2367846 - protein, 29 aa, Entamoeba dispar
KMSNSNQERRITKNDIRRTRRQIGENINI

SEQ ID NO: 2367847 - protein, 10 aa, Entamoeba dispar
KMSQEEYQEF

SEQ ID NO: 2367848 - protein, 20 aa, Entamoeba dispar
KMTSNLEQAEDLEEKTNEMV

SEQ ID NO: 2367849 - protein, 4 aa, Entamoeba dispar
KNAG

SEQ ID NO: 2367850 - protein, 7 aa, Entamoeba dispar
KNAIQNR

SEQ ID NO: 2367851 - protein, 18 aa, Entamoeba dispar
KNAKESKNKELANELTSK

SEQ ID NO: 2367852 - protein, 8 aa, Entamoeba dispar
KNAPATVK

SEQ ID NO: 2367853 - protein, 15 aa, Entamoeba dispar
KNAPGNVAEIRTPGN

SEQ ID NO: 2367854 - protein, 6 aa, Entamoeba dispar
KNAPKM

SEQ ID NO: 2367855 - protein, 6 aa, Entamoeba dispar
KNARKK

SEQ ID NO: 2367856 - protein, 9 aa, Entamoeba dispar
KNARSNYSK

SEQ ID NO: 2367857 - protein, 6 aa, Entamoeba dispar
KNATGG

SEQ ID NO: 2367858 - protein, 10 aa, Entamoeba dispar
KNAYDGDERF

SEQ ID NO: 2367859 - protein, 4 aa, Entamoeba dispar
KNCD

SEQ ID NO: 2367860 - protein, 5 aa, Entamoeba dispar
KNCEN

SEQ ID NO: 2367861 - protein, 7 aa, Entamoeba dispar
KNCKNHP

SEQ ID NO: 2367862 - protein, 7 aa, Entamoeba dispar
KNDDVQS

SEQ ID NO: 2367863 - protein, 8 aa, Entamoeba dispar
KNDEDDDF

SEQ ID NO: 2367864 - protein, 8 aa, Entamoeba dispar
KNDETTRE

SEQ ID NO: 2367865 - protein, 10 aa, Entamoeba dispar
KNDKQERRPY

SEQ ID NO: 2367866 - protein, 7 aa, Entamoeba dispar
KNDLRDT

SEQ ID NO: 2367867 - protein, 7 aa, Entamoeba dispar
KNDNKTL

SEQ ID NO: 2367868 - protein, 7 aa, Entamoeba dispar
KNDPKHY

SEQ ID NO: 2367869 - protein, 13 aa, Entamoeba dispar
KNDPRLNSFVHQF

SEQ ID NO: 2367870 - protein, 4 aa, Entamoeba dispar
KNDQ

SEQ ID NO: 2367871 - protein, 7 aa, Entamoeba dispar
KNDQTNI

SEQ ID NO: 2367872 - protein, 7 aa, Entamoeba dispar
KNEDPKV

SEQ ID NO: 2367873 - protein, 5 aa, Entamoeba dispar
KNEFK

SEQ ID NO: 2367874 - protein, 11 aa, Entamoeba dispar
KNEGKRHISEI

SEQ ID NO: 2367875 - protein, 7 aa, Entamoeba dispar
KNEIETK

SEQ ID NO: 2367876 - protein, 9 aa, Entamoeba dispar
KNEKTTENQ

SEQ ID NO: 2367877 - protein, 9 aa, Entamoeba dispar
KNENEQTEF

SEQ ID NO: 2367878 - protein, 10 aa, Entamoeba dispar
KNENESIEDE

SEQ ID NO: 2367879 - protein, 10 aa, Entamoeba dispar
KNENISKKRT

SEQ ID NO: 2367880 - protein, 5 aa, Entamoeba dispar
KNENL

SEQ ID NO: 2367881 - protein, 5 aa, Entamoeba dispar
KNEPK

SEQ ID NO: 2367882 - protein, 5 aa, Entamoeba dispar
KNEQY

SEQ ID NO: 2367883 - protein, 10 aa, Entamoeba dispar
KNERAKLKKR

SEQ ID NO: 2367884 - protein, 10 aa, Entamoeba dispar
KNESDTECTT

SEQ ID NO: 2367885 - protein, 6 aa, Entamoeba dispar
KNESEG

SEQ ID NO: 2367886 - protein, 9 aa, Entamoeba dispar
KNESKEECG

SEQ ID NO: 2367887 - protein, 10 aa, Entamoeba dispar
KNESSKRMKD

SEQ ID NO: 2367888 - protein, 9 aa, Entamoeba dispar
KNESTNQAK

SEQ ID NO: 2367889 - protein, 4 aa, Entamoeba dispar
KNET

SEQ ID NO: 2367890 - protein, 5 aa, Entamoeba dispar
KNETG

SEQ ID NO: 2367891 - protein, 6 aa, Entamoeba dispar
KNETKY

SEQ ID NO: 2367892 - protein, 5 aa, Entamoeba dispar
KNETL

SEQ ID NO: 2367893 - protein, 6 aa, Entamoeba dispar
KNETQI

SEQ ID NO: 2367894 - protein, 12 aa, Entamoeba dispar
KNETQYLSTEDN

SEQ ID NO: 2367895 - protein, 15 aa, Entamoeba dispar
KNETSETISKKEKRY

SEQ ID NO: 2367896 - protein, 6 aa, Entamoeba dispar
KNETTV

SEQ ID NO: 2367897 - protein, 6 aa, Entamoeba dispar
KNEVKK

SEQ ID NO: 2367898 - protein, 8 aa, Entamoeba dispar
KNEYKYDE

SEQ ID NO: 2367899 - protein, 6 aa, Entamoeba dispar
KNFPTT

SEQ ID NO: 2367900 - protein, 4 aa, Entamoeba dispar
KNFT

SEQ ID NO: 2367901 - protein, 5 aa, Entamoeba dispar
KNFTW

SEQ ID NO: 2367902 - protein, 15 aa, Entamoeba dispar
KNGAERHNLSKTQYL

SEQ ID NO: 2367903 - protein, 7 aa, Entamoeba dispar
KNGAEVA

SEQ ID NO: 2367904 - protein, 8 aa, Entamoeba dispar
KNGANGRF

SEQ ID NO: 2367905 - protein, 22 aa, Entamoeba dispar
KNGCKECEKGYSAKDNGTCSKN

SEQ ID NO: 2367906 - protein, 7 aa, Entamoeba dispar
KNGDKVD

SEQ ID NO: 2367907 - protein, 5 aa, Entamoeba dispar
KNGEE

SEQ ID NO: 2367908 - protein, 5 aa, Entamoeba dispar
KNGGG

SEQ ID NO: 2367909 - protein, 11 aa, Entamoeba dispar
KNGGGDAKYSQ

SEQ ID NO: 2367910 - protein, 7 aa, Entamoeba dispar
KNGGGYG

SEQ ID NO: 2367911 - protein, 9 aa, Entamoeba dispar
KNGKCSPCN

SEQ ID NO: 2367912 - protein, 6 aa, Entamoeba dispar
KNGKEV

SEQ ID NO: 2367913 - protein, 12 aa, Entamoeba dispar
KNGKKGIEQRTR

SEQ ID NO: 2367914 - protein, 7 aa, Entamoeba dispar
KNGKKLH

SEQ ID NO: 2367915 - protein, 6 aa, Entamoeba dispar
KNGKNQ

SEQ ID NO: 2367916 - protein, 4 aa, Entamoeba dispar
KNGM

SEQ ID NO: 2367917 - protein, 4 aa, Entamoeba dispar
KNGN

SEQ ID NO: 2367918 - protein, 5 aa, Entamoeba dispar
KNGNL

SEQ ID NO: 2367919 - protein, 8 aa, Entamoeba dispar
KNGPTNQL

SEQ ID NO: 2367920 - protein, 10 aa, Entamoeba dispar
KNGTCGEGEY

SEQ ID NO: 2367921 - protein, 6 aa, Entamoeba dispar
KNGTQR

SEQ ID NO: 2367922 - protein, 14 aa, Entamoeba dispar
KNGYNELRGYDEEL

SEQ ID NO: 2367923 - protein, 12 aa, Entamoeba dispar
KNGYTKDCTGCQ

SEQ ID NO: 2367924 - protein, 30 aa, Entamoeba dispar
KNHEESSVTTTGESKESDSSSEGEKEKKPF

SEQ ID NO: 2367925 - protein, 9 aa, Entamoeba dispar
KNHNTSEYI

SEQ ID NO: 2367926 - protein, 8 aa, Entamoeba dispar
KNHNTYQS

SEQ ID NO: 2367927 - protein, 7 aa, Entamoeba dispar
KNIAERQ

SEQ ID NO: 2367928 - protein, 5 aa, Entamoeba dispar
KNIEL

SEQ ID NO: 2367929 - protein, 4 aa, Entamoeba dispar
KNII

SEQ ID NO: 2367930 - protein, 7 aa, Entamoeba dispar
KNIKPRE

SEQ ID NO: 2367931 - protein, 4 aa, Entamoeba dispar
KNIP

SEQ ID NO: 2367932 - protein, 5 aa, Entamoeba dispar
KNITK

SEQ ID NO: 2367933 - protein, 9 aa, Entamoeba dispar
KNITRTTEQ

SEQ ID NO: 2367934 - protein, 9 aa, Entamoeba dispar
KNKAGNAHD

SEQ ID NO: 2367935 - protein, 8 aa, Entamoeba dispar
KNKDPEIG

SEQ ID NO: 2367936 - protein, 7 aa, Entamoeba dispar
KNKEEEL

SEQ ID NO: 2367937 - protein, 8 aa, Entamoeba dispar
KNKEFDKG

SEQ ID NO: 2367938 - protein, 7 aa, Entamoeba dispar
KNKEIGE

SEQ ID NO: 2367939 - protein, 9 aa, Entamoeba dispar
KNKESNDTI

SEQ ID NO: 2367940 - protein, 7 aa, Entamoeba dispar
KNKFRND

SEQ ID NO: 2367941 - protein, 9 aa, Entamoeba dispar
KNKGNEEPE

SEQ ID NO: 2367942 - protein, 5 aa, Entamoeba dispar
KNKKD

SEQ ID NO: 2367943 - protein, 14 aa, Entamoeba dispar
KNKKIAEKTERERL

SEQ ID NO: 2367944 - protein, 15 aa, Entamoeba dispar
KNKKSKENDEINLTK

SEQ ID NO: 2367945 - protein, 7 aa, Entamoeba dispar
KNKNGIE

SEQ ID NO: 2367946 - protein, 8 aa, Entamoeba dispar
KNKNNKYK

SEQ ID NO: 2367947 - protein, 18 aa, Entamoeba dispar
KNKNQPTKTEKPTTSQDN

SEQ ID NO: 2367948 - protein, 5 aa, Entamoeba dispar
KNKPF

SEQ ID NO: 2367949 - protein, 8 aa, Entamoeba dispar
KNKQITPD

SEQ ID NO: 2367950 - protein, 6 aa, Entamoeba dispar
KNKQKR

SEQ ID NO: 2367951 - protein, 6 aa, Entamoeba dispar
KNKQVN

SEQ ID NO: 2367952 - protein, 4 aa, Entamoeba dispar
KNKR

SEQ ID NO: 2367953 - protein, 6 aa, Entamoeba dispar
KNKRNE

SEQ ID NO: 2367954 - protein, 9 aa, Entamoeba dispar
KNKSETYYQ

SEQ ID NO: 2367955 - protein, 7 aa, Entamoeba dispar
KNKSGNK

SEQ ID NO: 2367956 - protein, 6 aa, Entamoeba dispar
KNKSKV

SEQ ID NO: 2367957 - protein, 8 aa, Entamoeba dispar
KNKSTKVS

SEQ ID NO: 2367958 - protein, 6 aa, Entamoeba dispar
KNKTSS

SEQ ID NO: 2367959 - protein, 6 aa, Entamoeba dispar
KNKVNE

SEQ ID NO: 2367960 - protein, 25 aa, Entamoeba dispar
KNLIETKKEEKEKKGEEYKEEEEEI

SEQ ID NO: 2367961 - protein, 24 aa, Entamoeba dispar
KNLLTTKEIDSDTDDIKNEYGDLN

SEQ ID NO: 2367962 - protein, 6 aa, Entamoeba dispar
KNLSNK

SEQ ID NO: 2367963 - protein, 5 aa, Entamoeba dispar
KNLTN

SEQ ID NO: 2367964 - protein, 6 aa, Entamoeba dispar
KNLVEK

SEQ ID NO: 2367965 - protein, 13 aa, Entamoeba dispar
KNMSGDSETIEEF

SEQ ID NO: 2367966 - protein, 25 aa, Entamoeba dispar
KNNDGQKSRGFEPSRFSDNLNSTNE

SEQ ID NO: 2367967 - protein, 5 aa, Entamoeba dispar
KNNDL

SEQ ID NO: 2367968 - protein, 6 aa, Entamoeba dispar
KNNDLN

SEQ ID NO: 2367969 - protein, 10 aa, Entamoeba dispar
KNNEKPRYID

SEQ ID NO: 2367970 - protein, 8 aa, Entamoeba dispar
KNNFESTS

SEQ ID NO: 2367971 - protein, 5 aa, Entamoeba dispar
KNNGC

SEQ ID NO: 2367972 - protein, 9 aa, Entamoeba dispar
KNNGCSECS

SEQ ID NO: 2367973 - protein, 6 aa, Entamoeba dispar
KNNGGL

SEQ ID NO: 2367974 - protein, 7 aa, Entamoeba dispar
KNNGGSV

SEQ ID NO: 2367975 - protein, 8 aa, Entamoeba dispar
KNNGINTT

SEQ ID NO: 2367976 - protein, 7 aa, Entamoeba dispar
KNNIKSA

SEQ ID NO: 2367977 - protein, 11 aa, Entamoeba dispar
KNNKKPEISNE

SEQ ID NO: 2367978 - protein, 5 aa, Entamoeba dispar
KNNNE

SEQ ID NO: 2367979 - protein, 8 aa, Entamoeba dispar
KNNNEYGK

SEQ ID NO: 2367980 - protein, 8 aa, Entamoeba dispar
KNNNITKC

SEQ ID NO: 2367981 - protein, 18 aa, Entamoeba dispar
KNNNNRNEFGNKEYNSVK

SEQ ID NO: 2367982 - protein, 10 aa, Entamoeba dispar
KNNNTCTQCQ

SEQ ID NO: 2367983 - protein, 5 aa, Entamoeba dispar
KNNPE

SEQ ID NO: 2367984 - protein, 9 aa, Entamoeba dispar
KNNPENQKT

SEQ ID NO: 2367985 - protein, 8 aa, Entamoeba dispar
KNNPSTDC

SEQ ID NO: 2367986 - protein, 6 aa, Entamoeba dispar
KNNPVE

SEQ ID NO: 2367987 - protein, 11 aa, Entamoeba dispar
KNNQSDNEIGI

SEQ ID NO: 2367988 - protein, 6 aa, Entamoeba dispar
KNNRDI

SEQ ID NO: 2367989 - protein, 4 aa, Entamoeba dispar
KNNT

SEQ ID NO: 2367990 - protein, 7 aa, Entamoeba dispar
KNNTCGS

SEQ ID NO: 2367991 - protein, 4 aa, Entamoeba dispar
KNNV

SEQ ID NO: 2367992 - protein, 6 aa, Entamoeba dispar
KNNVDT

SEQ ID NO: 2367993 - protein, 6 aa, Entamoeba dispar
KNNWKD

SEQ ID NO: 2367994 - protein, 5 aa, Entamoeba dispar
KNNYK

SEQ ID NO: 2367995 - protein, 7 aa, Entamoeba dispar
KNNYNSI

SEQ ID NO: 2367996 - protein, 5 aa, Entamoeba dispar
KNPDC

SEQ ID NO: 2367997 - protein, 7 aa, Entamoeba dispar
KNPDNSE

SEQ ID NO: 2367998 - protein, 6 aa, Entamoeba dispar
KNPETI

SEQ ID NO: 2367999 - protein, 5 aa, Entamoeba dispar
KNPGD

SEQ ID NO: 2368000 - protein, 11 aa, Entamoeba dispar
KNPGDESSDSY

SEQ ID NO: 2368001 - protein, 5 aa, Entamoeba dispar
KNPGL

SEQ ID NO: 2368002 - protein, 4 aa, Entamoeba dispar
KNPI

SEQ ID NO: 2368003 - protein, 8 aa, Entamoeba dispar
KNPIKESP

SEQ ID NO: 2368004 - protein, 5 aa, Entamoeba dispar
KNPIN

SEQ ID NO: 2368005 - protein, 5 aa, Entamoeba dispar
KNPKA

SEQ ID NO: 2368006 - protein, 9 aa, Entamoeba dispar
KNPKTKLTQ

SEQ ID NO: 2368007 - protein, 4 aa, Entamoeba dispar
KNPL

SEQ ID NO: 2368008 - protein, 13 aa, Entamoeba dispar
KNPPQPKGSDTYH

SEQ ID NO: 2368009 - protein, 9 aa, Entamoeba dispar
KNPPQPSFD

SEQ ID NO: 2368010 - protein, 12 aa, Entamoeba dispar
KNPPQPSFDSQY

SEQ ID NO: 2368011 - protein, 13 aa, Entamoeba dispar
KNPPQPSFSNNYY

SEQ ID NO: 2368012 - protein, 9 aa, Entamoeba dispar
KNPPTGSYY

SEQ ID NO: 2368013 - protein, 10 aa, Entamoeba dispar
KNPPTQTGTY

SEQ ID NO: 2368014 - protein, 8 aa, Entamoeba dispar
KNPRKPTE

SEQ ID NO: 2368015 - protein, 7 aa, Entamoeba dispar
KNPRNSL

SEQ ID NO: 2368016 - protein, 8 aa, Entamoeba dispar
KNPSGNNK

SEQ ID NO: 2368017 - protein, 10 aa, Entamoeba dispar
KNPTQEQQIK

SEQ ID NO: 2368018 - protein, 6 aa, Entamoeba dispar
KNPYDP

SEQ ID NO: 2368019 - protein, 10 aa, Entamoeba dispar
KNQAQCNKCG

SEQ ID NO: 2368020 - protein, 9 aa, Entamoeba dispar
KNQCEPCGR

SEQ ID NO: 2368021 - protein, 4 aa, Entamoeba dispar
KNQF

SEQ ID NO: 2368022 - protein, 7 aa, Entamoeba dispar
KNQISKI

SEQ ID NO: 2368023 - protein, 5 aa, Entamoeba dispar
KNQKI

SEQ ID NO: 2368024 - protein, 6 aa, Entamoeba dispar
KNQKKS

SEQ ID NO: 2368025 - protein, 7 aa, Entamoeba dispar
KNQKTNI

SEQ ID NO: 2368026 - protein, 6 aa, Entamoeba dispar
KNQLDK

SEQ ID NO: 2368027 - protein, 5 aa, Entamoeba dispar
KNQNA

SEQ ID NO: 2368028 - protein, 10 aa, Entamoeba dispar
KNQNKLGNGW

SEQ ID NO: 2368029 - protein, 8 aa, Entamoeba dispar
KNQPVSPL

SEQ ID NO: 2368030 - protein, 7 aa, Entamoeba dispar
KNQVKQN

SEQ ID NO: 2368031 - protein, 5 aa, Entamoeba dispar
KNQYD

SEQ ID NO: 2368032 - protein, 8 aa, Entamoeba dispar
KNRIRPED

SEQ ID NO: 2368033 - protein, 5 aa, Entamoeba dispar
KNRSN

SEQ ID NO: 2368034 - protein, 6 aa, Entamoeba dispar
KNRTNE

SEQ ID NO: 2368035 - protein, 6 aa, Entamoeba dispar
KNSERY

SEQ ID NO: 2368036 - protein, 6 aa, Entamoeba dispar
KNSGDL

SEQ ID NO: 2368037 - protein, 19 aa, Entamoeba dispar
KNSGEIKTEEYREFDDNFI

SEQ ID NO: 2368038 - protein, 6 aa, Entamoeba dispar
KNSHSF

SEQ ID NO: 2368039 - protein, 4 aa, Entamoeba dispar
KNSK

SEQ ID NO: 2368040 - protein, 9 aa, Entamoeba dispar
KNSKSKYIE

SEQ ID NO: 2368041 - protein, 7 aa, Entamoeba dispar
KNSLNKG

SEQ ID NO: 2368042 - protein, 7 aa, Entamoeba dispar
KNSLSRN

SEQ ID NO: 2368043 - protein, 5 aa, Entamoeba dispar
KNSMD

SEQ ID NO: 2368044 - protein, 9 aa, Entamoeba dispar
KNSNEKDKI

SEQ ID NO: 2368045 - protein, 12 aa, Entamoeba dispar
KNSPQKYRGKNT

SEQ ID NO: 2368046 - protein, 7 aa, Entamoeba dispar
KNSSLQG

SEQ ID NO: 2368047 - protein, 7 aa, Entamoeba dispar
KNSSNEI

SEQ ID NO: 2368048 - protein, 5 aa, Entamoeba dispar
KNSTG

SEQ ID NO: 2368049 - protein, 5 aa, Entamoeba dispar
KNSVT

SEQ ID NO: 2368050 - protein, 7 aa, Entamoeba dispar
KNSWRKK

SEQ ID NO: 2368051 - protein, 26 aa, Entamoeba dispar
KNTDINDNTIDLSSPNSYEGNIDQGC

SEQ ID NO: 2368052 - protein, 10 aa, Entamoeba dispar
KNTDKNLSQF

SEQ ID NO: 2368053 - protein, 8 aa, Entamoeba dispar
KNTGTEVK

SEQ ID NO: 2368054 - protein, 5 aa, Entamoeba dispar
KNTIA

SEQ ID NO: 2368055 - protein, 5 aa, Entamoeba dispar
KNTIS

SEQ ID NO: 2368056 - protein, 14 aa, Entamoeba dispar
KNTKRKIEINQPEQ

SEQ ID NO: 2368057 - protein, 12 aa, Entamoeba dispar
KNTLSLNSNKYK

SEQ ID NO: 2368058 - protein, 14 aa, Entamoeba dispar
KNTLSLNSNKYKDI

SEQ ID NO: 2368059 - protein, 4 aa, Entamoeba dispar
KNTM

SEQ ID NO: 2368060 - protein, 13 aa, Entamoeba dispar
KNTNYNSETDGKI

SEQ ID NO: 2368061 - protein, 9 aa, Entamoeba dispar
KNTPNQQQV

SEQ ID NO: 2368062 - protein, 19 aa, Entamoeba dispar
KNTQEVPPIKTDVYLLDDS

SEQ ID NO: 2368063 - protein, 4 aa, Entamoeba dispar
KNTS

SEQ ID NO: 2368064 - protein, 8 aa, Entamoeba dispar
KNTSNSKR

SEQ ID NO: 2368065 - protein, 5 aa, Entamoeba dispar
KNTTE

SEQ ID NO: 2368066 - protein, 9 aa, Entamoeba dispar
KNTTSDDTN

SEQ ID NO: 2368067 - protein, 6 aa, Entamoeba dispar
KNVETS

SEQ ID NO: 2368068 - protein, 10 aa, Entamoeba dispar
KNVPENYEEH

SEQ ID NO: 2368069 - protein, 6 aa, Entamoeba dispar
KNVQKQ

SEQ ID NO: 2368070 - protein, 4 aa, Entamoeba dispar
KNVY

SEQ ID NO: 2368071 - protein, 6 aa, Entamoeba dispar
KNYESS

SEQ ID NO: 2368072 - protein, 5 aa, Entamoeba dispar
KNYSE

SEQ ID NO: 2368073 - protein, 7 aa, Entamoeba dispar
KNYSSPS

SEQ ID NO: 2368074 - protein, 5 aa, Entamoeba dispar
KNYTL

SEQ ID NO: 2368075 - protein, 8 aa, Entamoeba dispar
KNYTTSAD

SEQ ID NO: 2368076 - protein, 5 aa, Entamoeba dispar
KNYYT

SEQ ID NO: 2368077 - protein, 6 aa, Entamoeba dispar
KPAKKA

SEQ ID NO: 2368078 - protein, 4 aa, Entamoeba dispar
KPAL

SEQ ID NO: 2368079 - protein, 6 aa, Entamoeba dispar
KPCDSN

SEQ ID NO: 2368080 - protein, 7 aa, Entamoeba dispar
KPCKTKK

SEQ ID NO: 2368081 - protein, 25 aa, Entamoeba dispar
KPDDYGYTSYDEDISNVDCSDSSHT

SEQ ID NO: 2368082 - protein, 8 aa, Entamoeba dispar
KPDGYSDE

SEQ ID NO: 2368083 - protein, 11 aa, Entamoeba dispar
KPDKCSSCDTR

SEQ ID NO: 2368084 - protein, 8 aa, Entamoeba dispar
KPDPQGLK

SEQ ID NO: 2368085 - protein, 7 aa, Entamoeba dispar
KPDTFSK

SEQ ID NO: 2368086 - protein, 5 aa, Entamoeba dispar
KPDYE

SEQ ID NO: 2368087 - protein, 6 aa, Entamoeba dispar
KPEISN

SEQ ID NO: 2368088 - protein, 8 aa, Entamoeba dispar
KPELPPQN

SEQ ID NO: 2368089 - protein, 7 aa, Entamoeba dispar
KPENPKD

SEQ ID NO: 2368090 - protein, 14 aa, Entamoeba dispar
KPERGTVKINGRNI

SEQ ID NO: 2368091 - protein, 7 aa, Entamoeba dispar
KPERSHH

SEQ ID NO: 2368092 - protein, 5 aa, Entamoeba dispar
KPESV

SEQ ID NO: 2368093 - protein, 16 aa, Entamoeba dispar
KPETPTSNGGLDNENQ

SEQ ID NO: 2368094 - protein, 4 aa, Entamoeba dispar
KPFG

SEQ ID NO: 2368095 - protein, 7 aa, Entamoeba dispar
KPFGKEK

SEQ ID NO: 2368096 - protein, 6 aa, Entamoeba dispar
KPFGRK

SEQ ID NO: 2368097 - protein, 4 aa, Entamoeba dispar
KPFK

SEQ ID NO: 2368098 - protein, 8 aa, Entamoeba dispar
KPFKRTDS

SEQ ID NO: 2368099 - protein, 5 aa, Entamoeba dispar
KPFSE

SEQ ID NO: 2368100 - protein, 6 aa, Entamoeba dispar
KPGDPL

SEQ ID NO: 2368101 - protein, 4 aa, Entamoeba dispar
KPHP

SEQ ID NO: 2368102 - protein, 7 aa, Entamoeba dispar
KPHPTRK

SEQ ID NO: 2368103 - protein, 5 aa, Entamoeba dispar
KPIEA

SEQ ID NO: 2368104 - protein, 7 aa, Entamoeba dispar
KPIEVET

SEQ ID NO: 2368105 - protein, 9 aa, Entamoeba dispar
KPINGTCTE

SEQ ID NO: 2368106 - protein, 5 aa, Entamoeba dispar
KPIPL

SEQ ID NO: 2368107 - protein, 7 aa, Entamoeba dispar
KPIPNSV

SEQ ID NO: 2368108 - protein, 5 aa, Entamoeba dispar
KPKDQ

SEQ ID NO: 2368109 - protein, 26 aa, Entamoeba dispar
KPKFSNAKKPRASEVVKQKKEQKKAL

SEQ ID NO: 2368110 - protein, 8 aa, Entamoeba dispar
KPKKIDLG

SEQ ID NO: 2368111 - protein, 13 aa, Entamoeba dispar
KPKKINRRSGIPP

SEQ ID NO: 2368112 - protein, 11 aa, Entamoeba dispar
KPKKYKTKTLT

SEQ ID NO: 2368113 - protein, 6 aa, Entamoeba dispar
KPKNGW

SEQ ID NO: 2368114 - protein, 9 aa, Entamoeba dispar
KPKNRPTFN

SEQ ID NO: 2368115 - protein, 8 aa, Entamoeba dispar
KPKNTTKV

SEQ ID NO: 2368116 - protein, 17 aa, Entamoeba dispar
KPKQKLSEYGKVESNIS

SEQ ID NO: 2368117 - protein, 9 aa, Entamoeba dispar
KPKRNNVKE

SEQ ID NO: 2368118 - protein, 7 aa, Entamoeba dispar
KPKRNYN

SEQ ID NO: 2368119 - protein, 8 aa, Entamoeba dispar
KPKRRPCD

SEQ ID NO: 2368120 - protein, 8 aa, Entamoeba dispar
KPKTEMKT

SEQ ID NO: 2368121 - protein, 8 aa, Entamoeba dispar
KPKTIKYG

SEQ ID NO: 2368122 - protein, 15 aa, Entamoeba dispar
KPLENHDNTRSENEI

SEQ ID NO: 2368123 - protein, 5 aa, Entamoeba dispar
KPLGT

SEQ ID NO: 2368124 - protein, 7 aa, Entamoeba dispar
KPLNTDE

SEQ ID NO: 2368125 - protein, 9 aa, Entamoeba dispar
KPLPADYYE

SEQ ID NO: 2368126 - protein, 7 aa, Entamoeba dispar
KPLPKEK

SEQ ID NO: 2368127 - protein, 5 aa, Entamoeba dispar
KPLPT

SEQ ID NO: 2368128 - protein, 7 aa, Entamoeba dispar
KPLRSNH

SEQ ID NO: 2368129 - protein, 6 aa, Entamoeba dispar
KPLSQR

SEQ ID NO: 2368130 - protein, 10 aa, Entamoeba dispar
KPLTKTKTIP

SEQ ID NO: 2368131 - protein, 4 aa, Entamoeba dispar
KPMF

SEQ ID NO: 2368132 - protein, 5 aa, Entamoeba dispar
KPMKT

SEQ ID NO: 2368133 - protein, 8 aa, Entamoeba dispar
KPMRSNKQ

SEQ ID NO: 2368134 - protein, 5 aa, Entamoeba dispar
KPNDS

SEQ ID NO: 2368135 - protein, 6 aa, Entamoeba dispar
KPNDSV

SEQ ID NO: 2368136 - protein, 6 aa, Entamoeba dispar
KPNEKI

SEQ ID NO: 2368137 - protein, 11 aa, Entamoeba dispar
KPNGDPKDVGS

SEQ ID NO: 2368138 - protein, 7 aa, Entamoeba dispar
KPNGETY

SEQ ID NO: 2368139 - protein, 5 aa, Entamoeba dispar
KPNKE

SEQ ID NO: 2368140 - protein, 4 aa, Entamoeba dispar
KPNL

SEQ ID NO: 2368141 - protein, 8 aa, Entamoeba dispar
KPNPIKYP

SEQ ID NO: 2368142 - protein, 17 aa, Entamoeba dispar
KPNQKTEDEIYSNTECS

SEQ ID NO: 2368143 - protein, 7 aa, Entamoeba dispar
KPNSTTI

SEQ ID NO: 2368144 - protein, 11 aa, Entamoeba dispar
KPNTGKTTTPI

SEQ ID NO: 2368145 - protein, 11 aa, Entamoeba dispar
KPNTGRTTNPV

SEQ ID NO: 2368146 - protein, 6 aa, Entamoeba dispar
KPPECI

SEQ ID NO: 2368147 - protein, 6 aa, Entamoeba dispar
KPPIRK

SEQ ID NO: 2368148 - protein, 8 aa, Entamoeba dispar
KPQDDLPS

SEQ ID NO: 2368149 - protein, 12 aa, Entamoeba dispar
KPQENNEDVNYA

SEQ ID NO: 2368150 - protein, 6 aa, Entamoeba dispar
KPQIQI

SEQ ID NO: 2368151 - protein, 7 aa, Entamoeba dispar
KPQPNHK

SEQ ID NO: 2368152 - protein, 5 aa, Entamoeba dispar
KPQQF

SEQ ID NO: 2368153 - protein, 18 aa, Entamoeba dispar
KPQQQEKKQSPVNQKEQI

SEQ ID NO: 2368154 - protein, 6 aa, Entamoeba dispar
KPQRYK

SEQ ID NO: 2368155 - protein, 4 aa, Entamoeba dispar
KPQT

SEQ ID NO: 2368156 - protein, 23 aa, Entamoeba dispar
KPQTQQPCNKSSSQLGVEIEMNN

SEQ ID NO: 2368157 - protein, 7 aa, Entamoeba dispar
KPRAART

SEQ ID NO: 2368158 - protein, 13 aa, Entamoeba dispar
KPRARSGGKKGGY

SEQ ID NO: 2368159 - protein, 8 aa, Entamoeba dispar
KPRKNAKL

SEQ ID NO: 2368160 - protein, 6 aa, Entamoeba dispar
KPRKQT

SEQ ID NO: 2368161 - protein, 9 aa, Entamoeba dispar
KPRNQENPS

SEQ ID NO: 2368162 - protein, 22 aa, Entamoeba dispar
KPRQETVETKPKEVTTGSPATK

SEQ ID NO: 2368163 - protein, 16 aa, Entamoeba dispar
KPRSVHSQNRGDNNDA

SEQ ID NO: 2368164 - protein, 5 aa, Entamoeba dispar
KPRTF

SEQ ID NO: 2368165 - protein, 5 aa, Entamoeba dispar
KPSAR

SEQ ID NO: 2368166 - protein, 8 aa, Entamoeba dispar
KPSEANPL

SEQ ID NO: 2368167 - protein, 4 aa, Entamoeba dispar
KPSI

SEQ ID NO: 2368168 - protein, 6 aa, Entamoeba dispar
KPSIVT

SEQ ID NO: 2368169 - protein, 5 aa, Entamoeba dispar
KPSNS

SEQ ID NO: 2368170 - protein, 20 aa, Entamoeba dispar
KPSPEPFYEEAPDQDFADMQ

SEQ ID NO: 2368171 - protein, 6 aa, Entamoeba dispar
KPSPIH

SEQ ID NO: 2368172 - protein, 12 aa, Entamoeba dispar
KPSSDSISDGTL

SEQ ID NO: 2368173 - protein, 14 aa, Entamoeba dispar
KPSSQTACSSKDAY

SEQ ID NO: 2368174 - protein, 14 aa, Entamoeba dispar
KPSSYSSTNLDDSI

SEQ ID NO: 2368175 - protein, 12 aa, Entamoeba dispar
KPSYTLTPKNAA

SEQ ID NO: 2368176 - protein, 5 aa, Entamoeba dispar
KPTAS

SEQ ID NO: 2368177 - protein, 4 aa, Entamoeba dispar
KPTE

SEQ ID NO: 2368178 - protein, 5 aa, Entamoeba dispar
KPTID

SEQ ID NO: 2368179 - protein, 4 aa, Entamoeba dispar
KPTK

SEQ ID NO: 2368180 - protein, 12 aa, Entamoeba dispar
KPTLPPKHDTFI

SEQ ID NO: 2368181 - protein, 5 aa, Entamoeba dispar
KPTLR

SEQ ID NO: 2368182 - protein, 6 aa, Entamoeba dispar
KPTNCS

SEQ ID NO: 2368183 - protein, 5 aa, Entamoeba dispar
KPTNL

SEQ ID NO: 2368184 - protein, 17 aa, Entamoeba dispar
KPTNNLKNNKRNVNKQE

SEQ ID NO: 2368185 - protein, 6 aa, Entamoeba dispar
KPTNTQ

SEQ ID NO: 2368186 - protein, 6 aa, Entamoeba dispar
KPTPNY

SEQ ID NO: 2368187 - protein, 7 aa, Entamoeba dispar
KPTQSEL

SEQ ID NO: 2368188 - protein, 6 aa, Entamoeba dispar
KPTTGI

SEQ ID NO: 2368189 - protein, 5 aa, Entamoeba dispar
KPTTN

SEQ ID NO: 2368190 - protein, 10 aa, Entamoeba dispar
KPTTPPSPSF

SEQ ID NO: 2368191 - protein, 4 aa, Entamoeba dispar
KPVN

SEQ ID NO: 2368192 - protein, 8 aa, Entamoeba dispar
KPVNKMST

SEQ ID NO: 2368193 - protein, 17 aa, Entamoeba dispar
KPVSKEPKIKTSGNLKY

SEQ ID NO: 2368194 - protein, 24 aa, Entamoeba dispar
KPVSKEPSATFTPKIGSTRQTPVN

SEQ ID NO: 2368195 - protein, 5 aa, Entamoeba dispar
KPYLQ

SEQ ID NO: 2368196 - protein, 6 aa, Entamoeba dispar
KPYPGI

SEQ ID NO: 2368197 - protein, 6 aa, Entamoeba dispar
KQAESE

SEQ ID NO: 2368198 - protein, 13 aa, Entamoeba dispar
KQALRKTKREEML

SEQ ID NO: 2368199 - protein, 7 aa, Entamoeba dispar
KQALSNA

SEQ ID NO: 2368200 - protein, 12 aa, Entamoeba dispar
KQANNDKPKRKL

SEQ ID NO: 2368201 - protein, 6 aa, Entamoeba dispar
KQARTI

SEQ ID NO: 2368202 - protein, 6 aa, Entamoeba dispar
KQASKP

SEQ ID NO: 2368203 - protein, 4 aa, Entamoeba dispar
KQAT

SEQ ID NO: 2368204 - protein, 4 aa, Entamoeba dispar
KQCD

SEQ ID NO: 2368205 - protein, 10 aa, Entamoeba dispar
KQCEKNTNEY

SEQ ID NO: 2368206 - protein, 5 aa, Entamoeba dispar
KQCES

SEQ ID NO: 2368207 - protein, 9 aa, Entamoeba dispar
KQCGDCDSI

SEQ ID NO: 2368208 - protein, 8 aa, Entamoeba dispar
KQCTEYNQ

SEQ ID NO: 2368209 - protein, 10 aa, Entamoeba dispar
KQDDSNKCSN

SEQ ID NO: 2368210 - protein, 4 aa, Entamoeba dispar
KQDF

SEQ ID NO: 2368211 - protein, 5 aa, Entamoeba dispar
KQDIP

SEQ ID NO: 2368212 - protein, 7 aa, Entamoeba dispar
KQDNSSQ

SEQ ID NO: 2368213 - protein, 4 aa, Entamoeba dispar
KQDS

SEQ ID NO: 2368214 - protein, 6 aa, Entamoeba dispar
KQECQY

SEQ ID NO: 2368215 - protein, 7 aa, Entamoeba dispar
KQECQYN

SEQ ID NO: 2368216 - protein, 9 aa, Entamoeba dispar
KQEDDSNFT

SEQ ID NO: 2368217 - protein, 70 aa, Entamoeba dispar
KQEEELKKIQEEEAKKKAEEEEEAKKKAEEEEEAKKKAEEEEEAKKKAEELKKVQEEEAKKKAEEELQKD

SEQ ID NO: 2368218 - protein, 8 aa, Entamoeba dispar
KQEFSDPV

SEQ ID NO: 2368219 - protein, 8 aa, Entamoeba dispar
KQEKNRLE

SEQ ID NO: 2368220 - protein, 5 aa, Entamoeba dispar
KQEKY

SEQ ID NO: 2368221 - protein, 7 aa, Entamoeba dispar
KQENGGF

SEQ ID NO: 2368222 - protein, 7 aa, Entamoeba dispar
KQENGKC

SEQ ID NO: 2368223 - protein, 9 aa, Entamoeba dispar
KQENKLPTG

SEQ ID NO: 2368224 - protein, 6 aa, Entamoeba dispar
KQENRD

SEQ ID NO: 2368225 - protein, 7 aa, Entamoeba dispar
KQETGHT

SEQ ID NO: 2368226 - protein, 6 aa, Entamoeba dispar
KQETNG

SEQ ID NO: 2368227 - protein, 7 aa, Entamoeba dispar
KQETRKA

SEQ ID NO: 2368228 - protein, 7 aa, Entamoeba dispar
KQGCSIG

SEQ ID NO: 2368229 - protein, 5 aa, Entamoeba dispar
KQGDM

SEQ ID NO: 2368230 - protein, 5 aa, Entamoeba dispar
KQGKL

SEQ ID NO: 2368231 - protein, 6 aa, Entamoeba dispar
KQGNEK

SEQ ID NO: 2368232 - protein, 18 aa, Entamoeba dispar
KQGTEDLKQAHEYAKQSS

SEQ ID NO: 2368233 - protein, 8 aa, Entamoeba dispar
KQHGKVGG

SEQ ID NO: 2368234 - protein, 11 aa, Entamoeba dispar
KQIAEKEEPHG

SEQ ID NO: 2368235 - protein, 9 aa, Entamoeba dispar
KQIEKENGE

SEQ ID NO: 2368236 - protein, 7 aa, Entamoeba dispar
KQIGKGS

SEQ ID NO: 2368237 - protein, 7 aa, Entamoeba dispar
KQINEEL

SEQ ID NO: 2368238 - protein, 14 aa, Entamoeba dispar
KQINEEQNKKLQES

SEQ ID NO: 2368239 - protein, 6 aa, Entamoeba dispar
KQINEK

SEQ ID NO: 2368240 - protein, 11 aa, Entamoeba dispar
KQINGSIEKEE

SEQ ID NO: 2368241 - protein, 5 aa, Entamoeba dispar
KQIQY

SEQ ID NO: 2368242 - protein, 26 aa, Entamoeba dispar
KQITSKEKTENNPKKITPVQSEKINN

SEQ ID NO: 2368243 - protein, 7 aa, Entamoeba dispar
KQKAQKS

SEQ ID NO: 2368244 - protein, 9 aa, Entamoeba dispar
KQKENTKTA

SEQ ID NO: 2368245 - protein, 17 aa, Entamoeba dispar
KQKEVSNECPKSVPSEI

SEQ ID NO: 2368246 - protein, 5 aa, Entamoeba dispar
KQKEY

SEQ ID NO: 2368247 - protein, 4 aa, Entamoeba dispar
KQKI

SEQ ID NO: 2368248 - protein, 8 aa, Entamoeba dispar
KQKIPDTS

SEQ ID NO: 2368249 - protein, 9 aa, Entamoeba dispar
KQKKGSLNE

SEQ ID NO: 2368250 - protein, 8 aa, Entamoeba dispar
KQKKQALV

SEQ ID NO: 2368251 - protein, 8 aa, Entamoeba dispar
KQKNEASI

SEQ ID NO: 2368252 - protein, 12 aa, Entamoeba dispar
KQKNEINETKEE

SEQ ID NO: 2368253 - protein, 8 aa, Entamoeba dispar
KQKNTNEE

SEQ ID NO: 2368254 - protein, 8 aa, Entamoeba dispar
KQKPIVNK

SEQ ID NO: 2368255 - protein, 5 aa, Entamoeba dispar
KQKPL

SEQ ID NO: 2368256 - protein, 8 aa, Entamoeba dispar
KQKPLTEK

SEQ ID NO: 2368257 - protein, 5 aa, Entamoeba dispar
KQKQA

SEQ ID NO: 2368258 - protein, 10 aa, Entamoeba dispar
KQKQTELKNE

SEQ ID NO: 2368259 - protein, 6 aa, Entamoeba dispar
KQKTLS

SEQ ID NO: 2368260 - protein, 11 aa, Entamoeba dispar
KQKTRNSINKT

SEQ ID NO: 2368261 - protein, 5 aa, Entamoeba dispar
KQKTV

SEQ ID NO: 2368262 - protein, 10 aa, Entamoeba dispar
KQKYSKENNK

SEQ ID NO: 2368263 - protein, 12 aa, Entamoeba dispar
KQLDGKGNVEEK

SEQ ID NO: 2368264 - protein, 18 aa, Entamoeba dispar
KQLSGEYSKEKRKTWKED

SEQ ID NO: 2368265 - protein, 15 aa, Entamoeba dispar
KQLSSDVVSAERAVS

SEQ ID NO: 2368266 - protein, 17 aa, Entamoeba dispar
KQLTDTLKYDDMIIITI

SEQ ID NO: 2368267 - protein, 4 aa, Entamoeba dispar
KQNA

SEQ ID NO: 2368268 - protein, 7 aa, Entamoeba dispar
KQNEHSV

SEQ ID NO: 2368269 - protein, 5 aa, Entamoeba dispar
KQNEI

SEQ ID NO: 2368270 - protein, 9 aa, Entamoeba dispar
KQNGTSSKK

SEQ ID NO: 2368271 - protein, 5 aa, Entamoeba dispar
KQNIH

SEQ ID NO: 2368272 - protein, 9 aa, Entamoeba dispar
KQNKNKNWK

SEQ ID NO: 2368273 - protein, 6 aa, Entamoeba dispar
KQNPIY

SEQ ID NO: 2368274 - protein, 9 aa, Entamoeba dispar
KQNPKDRYT

SEQ ID NO: 2368275 - protein, 5 aa, Entamoeba dispar
KQNPL

SEQ ID NO: 2368276 - protein, 8 aa, Entamoeba dispar
KQNPQDRI

SEQ ID NO: 2368277 - protein, 8 aa, Entamoeba dispar
KQNQDKKF

SEQ ID NO: 2368278 - protein, 7 aa, Entamoeba dispar
KQNVEQS

SEQ ID NO: 2368279 - protein, 7 aa, Entamoeba dispar
KQPATND

SEQ ID NO: 2368280 - protein, 7 aa, Entamoeba dispar
KQPNESK

SEQ ID NO: 2368281 - protein, 7 aa, Entamoeba dispar
KQPPKYI

SEQ ID NO: 2368282 - protein, 8 aa, Entamoeba dispar
KQPPLGDG

SEQ ID NO: 2368283 - protein, 9 aa, Entamoeba dispar
KQPPVGQGS

SEQ ID NO: 2368284 - protein, 8 aa, Entamoeba dispar
KQQAISTL

SEQ ID NO: 2368285 - protein, 8 aa, Entamoeba dispar
KQQEQHNK

SEQ ID NO: 2368286 - protein, 11 aa, Entamoeba dispar
KQQKAHPESRP

SEQ ID NO: 2368287 - protein, 37 aa, Entamoeba dispar
KQQKDVSVTVKEDDTKQEKDVIKASGQGDDSKQQSMT

SEQ ID NO: 2368288 - protein, 41 aa, Entamoeba dispar
KQQKTGEPTLSPRSPKPVPQSPVNRYPQKQTPTVPSLPQKL

SEQ ID NO: 2368289 - protein, 6 aa, Entamoeba dispar
KQQPLK

SEQ ID NO: 2368290 - protein, 5 aa, Entamoeba dispar
KQQPQ

SEQ ID NO: 2368291 - protein, 6 aa, Entamoeba dispar
KQQSEI

SEQ ID NO: 2368292 - protein, 8 aa, Entamoeba dispar
KQQSGSLN

SEQ ID NO: 2368293 - protein, 13 aa, Entamoeba dispar
KQQTGYTNKTIPT

SEQ ID NO: 2368294 - protein, 14 aa, Entamoeba dispar
KQQVKEIKNSEHHV

SEQ ID NO: 2368295 - protein, 5 aa, Entamoeba dispar
KQREV

SEQ ID NO: 2368296 - protein, 4 aa, Entamoeba dispar
KQRL

SEQ ID NO: 2368297 - protein, 12 aa, Entamoeba dispar
KQRPKVNEKNTQ

SEQ ID NO: 2368298 - protein, 8 aa, Entamoeba dispar
KQRQFTEE

SEQ ID NO: 2368299 - protein, 5 aa, Entamoeba dispar
KQRRH

SEQ ID NO: 2368300 - protein, 9 aa, Entamoeba dispar
KQSERRNEL

SEQ ID NO: 2368301 - protein, 12 aa, Entamoeba dispar
KQSGINSTEIKE

SEQ ID NO: 2368302 - protein, 4 aa, Entamoeba dispar
KQSL

SEQ ID NO: 2368303 - protein, 9 aa, Entamoeba dispar
KQSNEGTTL

SEQ ID NO: 2368304 - protein, 10 aa, Entamoeba dispar
KQSNRGEDGL

SEQ ID NO: 2368305 - protein, 8 aa, Entamoeba dispar
KQSPSSYP

SEQ ID NO: 2368306 - protein, 11 aa, Entamoeba dispar
KQSYSNNGEFD

SEQ ID NO: 2368307 - protein, 7 aa, Entamoeba dispar
KQTDSYE

SEQ ID NO: 2368308 - protein, 8 aa, Entamoeba dispar
KQTENRMD

SEQ ID NO: 2368309 - protein, 7 aa, Entamoeba dispar
KQTETSI

SEQ ID NO: 2368310 - protein, 4 aa, Entamoeba dispar
KQTI

SEQ ID NO: 2368311 - protein, 5 aa, Entamoeba dispar
KQTKK

SEQ ID NO: 2368312 - protein, 8 aa, Entamoeba dispar
KQTKTSNT

SEQ ID NO: 2368313 - protein, 12 aa, Entamoeba dispar
KQTNSLEKEIEP

SEQ ID NO: 2368314 - protein, 8 aa, Entamoeba dispar
KQTNTSFQ

SEQ ID NO: 2368315 - protein, 7 aa, Entamoeba dispar
KQTPSDL

SEQ ID NO: 2368316 - protein, 5 aa, Entamoeba dispar
KQTQK

SEQ ID NO: 2368317 - protein, 8 aa, Entamoeba dispar
KQTTNTNK

SEQ ID NO: 2368318 - protein, 7 aa, Entamoeba dispar
KQTTSVK

SEQ ID NO: 2368319 - protein, 5 aa, Entamoeba dispar
KQVEQ

SEQ ID NO: 2368320 - protein, 6 aa, Entamoeba dispar
KQVQKG

SEQ ID NO: 2368321 - protein, 12 aa, Entamoeba dispar
KQVQNNDTELNQ

SEQ ID NO: 2368322 - protein, 4 aa, Entamoeba dispar
KQVV

SEQ ID NO: 2368323 - protein, 6 aa, Entamoeba dispar
KQYDGT

SEQ ID NO: 2368324 - protein, 7 aa, Entamoeba dispar
KQYDNIS

SEQ ID NO: 2368325 - protein, 7 aa, Entamoeba dispar
KQYEKEN

SEQ ID NO: 2368326 - protein, 5 aa, Entamoeba dispar
KQYEN

SEQ ID NO: 2368327 - protein, 6 aa, Entamoeba dispar
KQYNRD

SEQ ID NO: 2368328 - protein, 5 aa, Entamoeba dispar
KQYPS

SEQ ID NO: 2368329 - protein, 7 aa, Entamoeba dispar
KRAASLE

SEQ ID NO: 2368330 - protein, 20 aa, Entamoeba dispar
KRAPSAGSESDWSDSDSITM

SEQ ID NO: 2368331 - protein, 7 aa, Entamoeba dispar
KRASNLD

SEQ ID NO: 2368332 - protein, 9 aa, Entamoeba dispar
KRCSKEECY

SEQ ID NO: 2368333 - protein, 11 aa, Entamoeba dispar
KRDAPIAEQKE

SEQ ID NO: 2368334 - protein, 8 aa, Entamoeba dispar
KRDDLNEQ

SEQ ID NO: 2368335 - protein, 6 aa, Entamoeba dispar
KRDEDI

SEQ ID NO: 2368336 - protein, 8 aa, Entamoeba dispar
KRDMEGLE

SEQ ID NO: 2368337 - protein, 6 aa, Entamoeba dispar
KRDPTK

SEQ ID NO: 2368338 - protein, 6 aa, Entamoeba dispar
KRDPTL

SEQ ID NO: 2368339 - protein, 6 aa, Entamoeba dispar
KRDQNG

SEQ ID NO: 2368340 - protein, 9 aa, Entamoeba dispar
KREERKGDK

SEQ ID NO: 2368341 - protein, 16 aa, Entamoeba dispar
KREERTPYDLQSEDGM

SEQ ID NO: 2368342 - protein, 18 aa, Entamoeba dispar
KREEWSQPIDAPEKLNEG

SEQ ID NO: 2368343 - protein, 9 aa, Entamoeba dispar
KREKAKTVN

SEQ ID NO: 2368344 - protein, 15 aa, Entamoeba dispar
KREKRVKHNGEISET

SEQ ID NO: 2368345 - protein, 7 aa, Entamoeba dispar
KRENPDL

SEQ ID NO: 2368346 - protein, 9 aa, Entamoeba dispar
KREQDETQA

SEQ ID NO: 2368347 - protein, 24 aa, Entamoeba dispar
KREQGRNQYYASNDDSVHCQSSDN

SEQ ID NO: 2368348 - protein, 10 aa, Entamoeba dispar
KREQKQEYQN

SEQ ID NO: 2368349 - protein, 6 aa, Entamoeba dispar
KRESDQ

SEQ ID NO: 2368350 - protein, 15 aa, Entamoeba dispar
KRETAVKGSNKSIKF

SEQ ID NO: 2368351 - protein, 22 aa, Entamoeba dispar
KREYNQKKIRRTTKQEEREKEI

SEQ ID NO: 2368352 - protein, 10 aa, Entamoeba dispar
KRFASSNDSY

SEQ ID NO: 2368353 - protein, 14 aa, Entamoeba dispar
KRFSKTDSLNIKAK

SEQ ID NO: 2368354 - protein, 7 aa, Entamoeba dispar
KRFSQNP

SEQ ID NO: 2368355 - protein, 15 aa, Entamoeba dispar
KRGDLEPSAQVNEIS

SEQ ID NO: 2368356 - protein, 8 aa, Entamoeba dispar
KRGETRSE

SEQ ID NO: 2368357 - protein, 7 aa, Entamoeba dispar
KRGIPGY

SEQ ID NO: 2368358 - protein, 5 aa, Entamoeba dispar
KRGKD

SEQ ID NO: 2368359 - protein, 8 aa, Entamoeba dispar
KRGNETKQ

SEQ ID NO: 2368360 - protein, 8 aa, Entamoeba dispar
KRGQGPPC

SEQ ID NO: 2368361 - protein, 8 aa, Entamoeba dispar
KRGSIECN

SEQ ID NO: 2368362 - protein, 8 aa, Entamoeba dispar
KRGTSTHC

SEQ ID NO: 2368363 - protein, 10 aa, Entamoeba dispar
KRGVYGDEGI

SEQ ID NO: 2368364 - protein, 13 aa, Entamoeba dispar
KRHQQYEDAYHNV

SEQ ID NO: 2368365 - protein, 11 aa, Entamoeba dispar
KRHRDANRSSL

SEQ ID NO: 2368366 - protein, 7 aa, Entamoeba dispar
KRHSEEM

SEQ ID NO: 2368367 - protein, 7 aa, Entamoeba dispar
KRHVGND

SEQ ID NO: 2368368 - protein, 4 aa, Entamoeba dispar
KRID

SEQ ID NO: 2368369 - protein, 4 aa, Entamoeba dispar
KRIE

SEQ ID NO: 2368370 - protein, 25 aa, Entamoeba dispar
KRINDENKKFETSSKQKRKNRNERR

SEQ ID NO: 2368371 - protein, 7 aa, Entamoeba dispar
KRINKRG

SEQ ID NO: 2368372 - protein, 4 aa, Entamoeba dispar
KRIT

SEQ ID NO: 2368373 - protein, 17 aa, Entamoeba dispar
KRITSKSSKDVEELNNQ

SEQ ID NO: 2368374 - protein, 12 aa, Entamoeba dispar
KRITTKSTGCSP

SEQ ID NO: 2368375 - protein, 11 aa, Entamoeba dispar
KRIYKKKKKSL

SEQ ID NO: 2368376 - protein, 11 aa, Entamoeba dispar
KRKEAKSVEEV

SEQ ID NO: 2368377 - protein, 9 aa, Entamoeba dispar
KRKEDKSYL

SEQ ID NO: 2368378 - protein, 10 aa, Entamoeba dispar
KRKEEETNMS

SEQ ID NO: 2368379 - protein, 16 aa, Entamoeba dispar
KRKEEQEQVRTFEGQT

SEQ ID NO: 2368380 - protein, 8 aa, Entamoeba dispar
KRKEETIN

SEQ ID NO: 2368381 - protein, 5 aa, Entamoeba dispar
KRKEL

SEQ ID NO: 2368382 - protein, 9 aa, Entamoeba dispar
KRKGSSSKQ

SEQ ID NO: 2368383 - protein, 5 aa, Entamoeba dispar
KRKKN

SEQ ID NO: 2368384 - protein, 7 aa, Entamoeba dispar
KRKQLRE

SEQ ID NO: 2368385 - protein, 14 aa, Entamoeba dispar
KRKSTEVELEDIRE

SEQ ID NO: 2368386 - protein, 4 aa, Entamoeba dispar
KRKT

SEQ ID NO: 2368387 - protein, 8 aa, Entamoeba dispar
KRKTKKRN

SEQ ID NO: 2368388 - protein, 6 aa, Entamoeba dispar
KRKTMM

SEQ ID NO: 2368389 - protein, 4 aa, Entamoeba dispar
KRLD

SEQ ID NO: 2368390 - protein, 5 aa, Entamoeba dispar
KRLDV

SEQ ID NO: 2368391 - protein, 15 aa, Entamoeba dispar
KRLEESNDEGEQKVI

SEQ ID NO: 2368392 - protein, 9 aa, Entamoeba dispar
KRLSKGTEI

SEQ ID NO: 2368393 - protein, 7 aa, Entamoeba dispar
KRLSSSI

SEQ ID NO: 2368394 - protein, 10 aa, Entamoeba dispar
KRLTKPKTME

SEQ ID NO: 2368395 - protein, 4 aa, Entamoeba dispar
KRME

SEQ ID NO: 2368396 - protein, 17 aa, Entamoeba dispar
KRMEEKTELEKKNEELQ

SEQ ID NO: 2368397 - protein, 8 aa, Entamoeba dispar
KRNEDINY

SEQ ID NO: 2368398 - protein, 15 aa, Entamoeba dispar
KRNELGPQIGMPNPN

SEQ ID NO: 2368399 - protein, 10 aa, Entamoeba dispar
KRNENNEENN

SEQ ID NO: 2368400 - protein, 9 aa, Entamoeba dispar
KRNESFSAP

SEQ ID NO: 2368401 - protein, 28 aa, Entamoeba dispar
KRNIERDEDMKNKKGKVKGKNAGLNEEL

SEQ ID NO: 2368402 - protein, 8 aa, Entamoeba dispar
KRNLSSIS

SEQ ID NO: 2368403 - protein, 26 aa, Entamoeba dispar
KRNNLGESKIKNPKSEDSDVQKEYKK

SEQ ID NO: 2368404 - protein, 6 aa, Entamoeba dispar
KRNNYR

SEQ ID NO: 2368405 - protein, 4 aa, Entamoeba dispar
KRNQ

SEQ ID NO: 2368406 - protein, 7 aa, Entamoeba dispar
KRNQLNN

SEQ ID NO: 2368407 - protein, 8 aa, Entamoeba dispar
KRNSENIT

SEQ ID NO: 2368408 - protein, 4 aa, Entamoeba dispar
KRNW

SEQ ID NO: 2368409 - protein, 7 aa, Entamoeba dispar
KRPAISK

SEQ ID NO: 2368410 - protein, 6 aa, Entamoeba dispar
KRPSNI

SEQ ID NO: 2368411 - protein, 10 aa, Entamoeba dispar
KRPTKPAKLT

SEQ ID NO: 2368412 - protein, 8 aa, Entamoeba dispar
KRPYSKLT

SEQ ID NO: 2368413 - protein, 57 aa, Entamoeba dispar
KRQAKRADPTAGYHEYTPDQPKNVSTPQPSTVPEPKQKGDNLANVNSSNTQQIEMEP

SEQ ID NO: 2368414 - protein, 27 aa, Entamoeba dispar
KRQAKRADPTSHSENNEGPSSIETTKL

SEQ ID NO: 2368415 - protein, 8 aa, Entamoeba dispar
KRQAPTIY

SEQ ID NO: 2368416 - protein, 6 aa, Entamoeba dispar
KRQENI

SEQ ID NO: 2368417 - protein, 18 aa, Entamoeba dispar
KRQEQKIKEKEKIKEREM

SEQ ID NO: 2368418 - protein, 7 aa, Entamoeba dispar
KRQESYS

SEQ ID NO: 2368419 - protein, 9 aa, Entamoeba dispar
KRQPIPEKK

SEQ ID NO: 2368420 - protein, 7 aa, Entamoeba dispar
KRQTSSL

SEQ ID NO: 2368421 - protein, 5 aa, Entamoeba dispar
KRRAE

SEQ ID NO: 2368422 - protein, 5 aa, Entamoeba dispar
KRRGE

SEQ ID NO: 2368423 - protein, 11 aa, Entamoeba dispar
KRRKNYKREEH

SEQ ID NO: 2368424 - protein, 13 aa, Entamoeba dispar
KRRVTKKKVHQAT

SEQ ID NO: 2368425 - protein, 8 aa, Entamoeba dispar
KRSEDDSI

SEQ ID NO: 2368426 - protein, 10 aa, Entamoeba dispar
KRSKSNTWTF

SEQ ID NO: 2368427 - protein, 8 aa, Entamoeba dispar
KRSNNPLS

SEQ ID NO: 2368428 - protein, 7 aa, Entamoeba dispar
KRSWRNK

SEQ ID NO: 2368429 - protein, 6 aa, Entamoeba dispar
KRTAVK

SEQ ID NO: 2368430 - protein, 8 aa, Entamoeba dispar
KRTGLGNH

SEQ ID NO: 2368431 - protein, 6 aa, Entamoeba dispar
KRTGTV

SEQ ID NO: 2368432 - protein, 7 aa, Entamoeba dispar
KRTKMSA

SEQ ID NO: 2368433 - protein, 9 aa, Entamoeba dispar
KRTNAEIPN

SEQ ID NO: 2368434 - protein, 11 aa, Entamoeba dispar
KRTRKFSPSVQ

SEQ ID NO: 2368435 - protein, 17 aa, Entamoeba dispar
KRTVRSKVNGPQQEEDY

SEQ ID NO: 2368436 - protein, 8 aa, Entamoeba dispar
KRVGEGAG

SEQ ID NO: 2368437 - protein, 6 aa, Entamoeba dispar
KRVREK

SEQ ID NO: 2368438 - protein, 9 aa, Entamoeba dispar
KRWNEEKGG

SEQ ID NO: 2368439 - protein, 8 aa, Entamoeba dispar
KRYKTTAD

SEQ ID NO: 2368440 - protein, 6 aa, Entamoeba dispar
KRYNQR

SEQ ID NO: 2368441 - protein, 8 aa, Entamoeba dispar
KRYPYRGK

SEQ ID NO: 2368442 - protein, 8 aa, Entamoeba dispar
KSAAKKMK

SEQ ID NO: 2368443 - protein, 12 aa, Entamoeba dispar
KSAALKNATNTL

SEQ ID NO: 2368444 - protein, 8 aa, Entamoeba dispar
KSAGPELD

SEQ ID NO: 2368445 - protein, 6 aa, Entamoeba dispar
KSAKVN

SEQ ID NO: 2368446 - protein, 10 aa, Entamoeba dispar
KSAQSQSPDI

SEQ ID NO: 2368447 - protein, 6 aa, Entamoeba dispar
KSARQA

SEQ ID NO: 2368448 - protein, 7 aa, Entamoeba dispar
KSATITD

SEQ ID NO: 2368449 - protein, 7 aa, Entamoeba dispar
KSCQSIG

SEQ ID NO: 2368450 - protein, 14 aa, Entamoeba dispar
KSDAQRSEKYKKLP

SEQ ID NO: 2368451 - protein, 13 aa, Entamoeba dispar
KSDDFSSSENLDE

SEQ ID NO: 2368452 - protein, 7 aa, Entamoeba dispar
KSDDGRY

SEQ ID NO: 2368453 - protein, 12 aa, Entamoeba dispar
KSDEINVDETHQ

SEQ ID NO: 2368454 - protein, 34 aa, Entamoeba dispar
KSDHSTTSSMTDTDTNTSTDTSSDNTDRSTKRRR

SEQ ID NO: 2368455 - protein, 4 aa, Entamoeba dispar
KSDI

SEQ ID NO: 2368456 - protein, 12 aa, Entamoeba dispar
KSDKMKKEKLES

SEQ ID NO: 2368457 - protein, 10 aa, Entamoeba dispar
KSDKNASVSG

SEQ ID NO: 2368458 - protein, 5 aa, Entamoeba dispar
KSDLN

SEQ ID NO: 2368459 - protein, 5 aa, Entamoeba dispar
KSDLV

SEQ ID NO: 2368460 - protein, 10 aa, Entamoeba dispar
KSDNDKSKCT

SEQ ID NO: 2368461 - protein, 10 aa, Entamoeba dispar
KSDNEKSKCT

SEQ ID NO: 2368462 - protein, 8 aa, Entamoeba dispar
KSDNKRIY

SEQ ID NO: 2368463 - protein, 6 aa, Entamoeba dispar
KSDSML

SEQ ID NO: 2368464 - protein, 10 aa, Entamoeba dispar
KSDSQTINGT

SEQ ID NO: 2368465 - protein, 5 aa, Entamoeba dispar
KSDSR

SEQ ID NO: 2368466 - protein, 10 aa, Entamoeba dispar
KSDSSCRSQT

SEQ ID NO: 2368467 - protein, 7 aa, Entamoeba dispar
KSDTSFD

SEQ ID NO: 2368468 - protein, 12 aa, Entamoeba dispar
KSEDIKEENKSI

SEQ ID NO: 2368469 - protein, 7 aa, Entamoeba dispar
KSEEDDG

SEQ ID NO: 2368470 - protein, 6 aa, Entamoeba dispar
KSEEYQ

SEQ ID NO: 2368471 - protein, 8 aa, Entamoeba dispar
KSEGSNKI

SEQ ID NO: 2368472 - protein, 23 aa, Entamoeba dispar
KSEKCSSTTGCTECENGYYSKDG

SEQ ID NO: 2368473 - protein, 7 aa, Entamoeba dispar
KSELNEN

SEQ ID NO: 2368474 - protein, 5 aa, Entamoeba dispar
KSELR

SEQ ID NO: 2368475 - protein, 11 aa, Entamoeba dispar
KSEMEEKGKNV

SEQ ID NO: 2368476 - protein, 5 aa, Entamoeba dispar
KSENE

SEQ ID NO: 2368477 - protein, 13 aa, Entamoeba dispar
KSENESSDTEEVD

SEQ ID NO: 2368478 - protein, 5 aa, Entamoeba dispar
KSENF

SEQ ID NO: 2368479 - protein, 48 aa, Entamoeba dispar
KSEPSLTKQKEVKQKKLSKTEPKKESLSEKIKRRNTKISSSSSSSSDS

SEQ ID NO: 2368480 - protein, 7 aa, Entamoeba dispar
KSERVYP

SEQ ID NO: 2368481 - protein, 5 aa, Entamoeba dispar
KSESV

SEQ ID NO: 2368482 - protein, 5 aa, Entamoeba dispar
KSETA

SEQ ID NO: 2368483 - protein, 5 aa, Entamoeba dispar
KSEVQ

SEQ ID NO: 2368484 - protein, 6 aa, Entamoeba dispar
KSEYSL

SEQ ID NO: 2368485 - protein, 15 aa, Entamoeba dispar
KSFDSKASPVPVTDT

SEQ ID NO: 2368486 - protein, 54 aa, Entamoeba dispar
KSFENQNSYRNSLTKPSNDNSPSPSSSPNFIDPNDDEWVSGNTIKRRSEPPHPI

SEQ ID NO: 2368487 - protein, 4 aa, Entamoeba dispar
KSFL

SEQ ID NO: 2368488 - protein, 11 aa, Entamoeba dispar
KSFNENNKEEI

SEQ ID NO: 2368489 - protein, 6 aa, Entamoeba dispar
KSFNTS

SEQ ID NO: 2368490 - protein, 10 aa, Entamoeba dispar
KSFPSGHSSF

SEQ ID NO: 2368491 - protein, 6 aa, Entamoeba dispar
KSFQGR

SEQ ID NO: 2368492 - protein, 5 aa, Entamoeba dispar
KSFSQ

SEQ ID NO: 2368493 - protein, 5 aa, Entamoeba dispar
KSGAA

SEQ ID NO: 2368494 - protein, 19 aa, Entamoeba dispar
KSGCREDVDDGQGTHIDSY

SEQ ID NO: 2368495 - protein, 10 aa, Entamoeba dispar
KSGCTDGDNV

SEQ ID NO: 2368496 - protein, 5 aa, Entamoeba dispar
KSGDF

SEQ ID NO: 2368497 - protein, 7 aa, Entamoeba dispar
KSGDSIC

SEQ ID NO: 2368498 - protein, 13 aa, Entamoeba dispar
KSGFESVGNPSIL

SEQ ID NO: 2368499 - protein, 6 aa, Entamoeba dispar
KSGGPI

SEQ ID NO: 2368500 - protein, 8 aa, Entamoeba dispar
KSGKRLPF

SEQ ID NO: 2368501 - protein, 13 aa, Entamoeba dispar
KSGLGKDIKDIGT

SEQ ID NO: 2368502 - protein, 14 aa, Entamoeba dispar
KSGLTKGKLEQVEE

SEQ ID NO: 2368503 - protein, 6 aa, Entamoeba dispar
KSGNEQ

SEQ ID NO: 2368504 - protein, 7 aa, Entamoeba dispar
KSGRITS

SEQ ID NO: 2368505 - protein, 8 aa, Entamoeba dispar
KSGSIPNY

SEQ ID NO: 2368506 - protein, 7 aa, Entamoeba dispar
KSGSPIK

SEQ ID NO: 2368507 - protein, 7 aa, Entamoeba dispar
KSGSTTL

SEQ ID NO: 2368508 - protein, 7 aa, Entamoeba dispar
KSGWTEG

SEQ ID NO: 2368509 - protein, 9 aa, Entamoeba dispar
KSGYYKNST

SEQ ID NO: 2368510 - protein, 14 aa, Entamoeba dispar
KSHEEETQSIQSMT

SEQ ID NO: 2368511 - protein, 5 aa, Entamoeba dispar
KSHEY

SEQ ID NO: 2368512 - protein, 8 aa, Entamoeba dispar
KSHLNSPN

SEQ ID NO: 2368513 - protein, 13 aa, Entamoeba dispar
KSHRKESKRYSQE

SEQ ID NO: 2368514 - protein, 4 aa, Entamoeba dispar
KSHS

SEQ ID NO: 2368515 - protein, 7 aa, Entamoeba dispar
KSHSTNN

SEQ ID NO: 2368516 - protein, 13 aa, Entamoeba dispar
KSIDEDGSQPIEL

SEQ ID NO: 2368517 - protein, 7 aa, Entamoeba dispar
KSIDEKE

SEQ ID NO: 2368518 - protein, 16 aa, Entamoeba dispar
KSIKEELKEMNNKEIE

SEQ ID NO: 2368519 - protein, 24 aa, Entamoeba dispar
KSIPSTPGEIRRKQKRENESNEIK

SEQ ID NO: 2368520 - protein, 38 aa, Entamoeba dispar
KSIQKKNQEIRNDTTTEKKELIKSNEHLKKTQTKEHPI

SEQ ID NO: 2368521 - protein, 6 aa, Entamoeba dispar
KSIREE

SEQ ID NO: 2368522 - protein, 6 aa, Entamoeba dispar
KSISEM

SEQ ID NO: 2368523 - protein, 6 aa, Entamoeba dispar
KSISTS

SEQ ID NO: 2368524 - protein, 7 aa, Entamoeba dispar
KSITEER

SEQ ID NO: 2368525 - protein, 8 aa, Entamoeba dispar
KSKDENSV

SEQ ID NO: 2368526 - protein, 9 aa, Entamoeba dispar
KSKDFNSSH

SEQ ID NO: 2368527 - protein, 8 aa, Entamoeba dispar
KSKDNEIA

SEQ ID NO: 2368528 - protein, 7 aa, Entamoeba dispar
KSKDRDD

SEQ ID NO: 2368529 - protein, 21 aa, Entamoeba dispar
KSKERKRNNRVNANRNDYGNE

SEQ ID NO: 2368530 - protein, 4 aa, Entamoeba dispar
KSKF

SEQ ID NO: 2368531 - protein, 4 aa, Entamoeba dispar
KSKG

SEQ ID NO: 2368532 - protein, 6 aa, Entamoeba dispar
KSKGTE

SEQ ID NO: 2368533 - protein, 9 aa, Entamoeba dispar
KSKHCSKPQ

SEQ ID NO: 2368534 - protein, 16 aa, Entamoeba dispar
KSKKALRDEQQKPYAD

SEQ ID NO: 2368535 - protein, 9 aa, Entamoeba dispar
KSKKNNERD

SEQ ID NO: 2368536 - protein, 8 aa, Entamoeba dispar
KSKLPEKL

SEQ ID NO: 2368537 - protein, 11 aa, Entamoeba dispar
KSKLPSSQRRV

SEQ ID NO: 2368538 - protein, 9 aa, Entamoeba dispar
KSKNELSLS

SEQ ID NO: 2368539 - protein, 7 aa, Entamoeba dispar
KSKNLTS

SEQ ID NO: 2368540 - protein, 6 aa, Entamoeba dispar
KSKNNK

SEQ ID NO: 2368541 - protein, 7 aa, Entamoeba dispar
KSKNQIY

SEQ ID NO: 2368542 - protein, 7 aa, Entamoeba dispar
KSKPLRT

SEQ ID NO: 2368543 - protein, 8 aa, Entamoeba dispar
KSKRSSKR

SEQ ID NO: 2368544 - protein, 4 aa, Entamoeba dispar
KSKS

SEQ ID NO: 2368545 - protein, 6 aa, Entamoeba dispar
KSKSFQ

SEQ ID NO: 2368546 - protein, 7 aa, Entamoeba dispar
KSKSVAV

SEQ ID NO: 2368547 - protein, 7 aa, Entamoeba dispar
KSKSYLT

SEQ ID NO: 2368548 - protein, 19 aa, Entamoeba dispar
KSKYASIGEEEEVYPTIIT

SEQ ID NO: 2368549 - protein, 12 aa, Entamoeba dispar
KSKYNSKDQTLT

SEQ ID NO: 2368550 - protein, 6 aa, Entamoeba dispar
KSKYTC

SEQ ID NO: 2368551 - protein, 8 aa, Entamoeba dispar
KSKYTPQN

SEQ ID NO: 2368552 - protein, 8 aa, Entamoeba dispar
KSLDPQSD

SEQ ID NO: 2368553 - protein, 12 aa, Entamoeba dispar
KSLDTVEGTGPA

SEQ ID NO: 2368554 - protein, 16 aa, Entamoeba dispar
KSLEEEKKKKEDAKEI

SEQ ID NO: 2368555 - protein, 9 aa, Entamoeba dispar
KSLNTDTQP

SEQ ID NO: 2368556 - protein, 23 aa, Entamoeba dispar
KSLSEIGCSNPKSLKNTSTIVPP

SEQ ID NO: 2368557 - protein, 9 aa, Entamoeba dispar
KSLSSTAQN

SEQ ID NO: 2368558 - protein, 10 aa, Entamoeba dispar
KSLSTQNLKS

SEQ ID NO: 2368559 - protein, 7 aa, Entamoeba dispar
KSLSTSC

SEQ ID NO: 2368560 - protein, 9 aa, Entamoeba dispar
KSLSTTPHG

SEQ ID NO: 2368561 - protein, 6 aa, Entamoeba dispar
KSLTPF

SEQ ID NO: 2368562 - protein, 25 aa, Entamoeba dispar
KSLTPGSSNNSPSSERSGWEKGEET

SEQ ID NO: 2368563 - protein, 6 aa, Entamoeba dispar
KSLTPI

SEQ ID NO: 2368564 - protein, 9 aa, Entamoeba dispar
KSMKAAKHS

SEQ ID NO: 2368565 - protein, 9 aa, Entamoeba dispar
KSMKAARHS

SEQ ID NO: 2368566 - protein, 7 aa, Entamoeba dispar
KSMNGSS

SEQ ID NO: 2368567 - protein, 15 aa, Entamoeba dispar
KSMPGVQKLQKKKNK

SEQ ID NO: 2368568 - protein, 6 aa, Entamoeba dispar
KSMTFN

SEQ ID NO: 2368569 - protein, 9 aa, Entamoeba dispar
KSNDYCNET

SEQ ID NO: 2368570 - protein, 13 aa, Entamoeba dispar
KSNEKEVKKNKKY

SEQ ID NO: 2368571 - protein, 14 aa, Entamoeba dispar
KSNEKEVKKNKKYT

SEQ ID NO: 2368572 - protein, 7 aa, Entamoeba dispar
KSNEVQS

SEQ ID NO: 2368573 - protein, 4 aa, Entamoeba dispar
KSNF

SEQ ID NO: 2368574 - protein, 5 aa, Entamoeba dispar
KSNIT

SEQ ID NO: 2368575 - protein, 14 aa, Entamoeba dispar
KSNKKKEKKRSSEV

SEQ ID NO: 2368576 - protein, 9 aa, Entamoeba dispar
KSNKLKPSH

SEQ ID NO: 2368577 - protein, 21 aa, Entamoeba dispar
KSNKLPPPTPRNYYRGSHSSK

SEQ ID NO: 2368578 - protein, 6 aa, Entamoeba dispar
KSNKTE

SEQ ID NO: 2368579 - protein, 4 aa, Entamoeba dispar
KSNL

SEQ ID NO: 2368580 - protein, 6 aa, Entamoeba dispar
KSNMVS

SEQ ID NO: 2368581 - protein, 21 aa, Entamoeba dispar
KSNNGNNKEENNKKNSSTTYN

SEQ ID NO: 2368582 - protein, 9 aa, Entamoeba dispar
KSNNKEEIV

SEQ ID NO: 2368583 - protein, 8 aa, Entamoeba dispar
KSNPPTSL

SEQ ID NO: 2368584 - protein, 7 aa, Entamoeba dispar
KSNSLNK

SEQ ID NO: 2368585 - protein, 7 aa, Entamoeba dispar
KSNTDDI

SEQ ID NO: 2368586 - protein, 6 aa, Entamoeba dispar
KSNTGS

SEQ ID NO: 2368587 - protein, 9 aa, Entamoeba dispar
KSPDPFNSS

SEQ ID NO: 2368588 - protein, 5 aa, Entamoeba dispar
KSPEI

SEQ ID NO: 2368589 - protein, 15 aa, Entamoeba dispar
KSPGIEKTKKNSLLT

SEQ ID NO: 2368590 - protein, 21 aa, Entamoeba dispar
KSPHAQFTNSKSSTLDNSFTQ

SEQ ID NO: 2368591 - protein, 7 aa, Entamoeba dispar
KSPHELS

SEQ ID NO: 2368592 - protein, 6 aa, Entamoeba dispar
KSPKIR

SEQ ID NO: 2368593 - protein, 12 aa, Entamoeba dispar
KSPLNESGSGTF

SEQ ID NO: 2368594 - protein, 7 aa, Entamoeba dispar
KSPPPDM

SEQ ID NO: 2368595 - protein, 9 aa, Entamoeba dispar
KSPPQPSFN

SEQ ID NO: 2368596 - protein, 8 aa, Entamoeba dispar
KSPVGQHG

SEQ ID NO: 2368597 - protein, 6 aa, Entamoeba dispar
KSQCNQ

SEQ ID NO: 2368598 - protein, 7 aa, Entamoeba dispar
KSQCTNI

SEQ ID NO: 2368599 - protein, 5 aa, Entamoeba dispar
KSQDL

SEQ ID NO: 2368600 - protein, 7 aa, Entamoeba dispar
KSQDRRE

SEQ ID NO: 2368601 - protein, 7 aa, Entamoeba dispar
KSQELES

SEQ ID NO: 2368602 - protein, 9 aa, Entamoeba dispar
KSQEVYTDI

SEQ ID NO: 2368603 - protein, 25 aa, Entamoeba dispar
KSQFNKNQRVKKESENKLNKEIENL

SEQ ID NO: 2368604 - protein, 4 aa, Entamoeba dispar
KSQI

SEQ ID NO: 2368605 - protein, 15 aa, Entamoeba dispar
KSQNSFNKKISTSTI

SEQ ID NO: 2368606 - protein, 8 aa, Entamoeba dispar
KSQQDSNK

SEQ ID NO: 2368607 - protein, 5 aa, Entamoeba dispar
KSQRE

SEQ ID NO: 2368608 - protein, 11 aa, Entamoeba dispar
KSQSKEECSGI

SEQ ID NO: 2368609 - protein, 9 aa, Entamoeba dispar
KSRDSNTSY

SEQ ID NO: 2368610 - protein, 5 aa, Entamoeba dispar
KSRNE

SEQ ID NO: 2368611 - protein, 13 aa, Entamoeba dispar
KSRSDGCGTNSKL

SEQ ID NO: 2368612 - protein, 9 aa, Entamoeba dispar
KSRSNKNDE

SEQ ID NO: 2368613 - protein, 8 aa, Entamoeba dispar
KSRTLQEK

SEQ ID NO: 2368614 - protein, 8 aa, Entamoeba dispar
KSSDGHTI

SEQ ID NO: 2368615 - protein, 14 aa, Entamoeba dispar
KSSENISGVTSDSI

SEQ ID NO: 2368616 - protein, 21 aa, Entamoeba dispar
KSSFTEDNYNKLQQSKGTLDS

SEQ ID NO: 2368617 - protein, 8 aa, Entamoeba dispar
KSSGISKV

SEQ ID NO: 2368618 - protein, 10 aa, Entamoeba dispar
KSSGKLTKPY

SEQ ID NO: 2368619 - protein, 11 aa, Entamoeba dispar
KSSIETNNDIK

SEQ ID NO: 2368620 - protein, 10 aa, Entamoeba dispar
KSSINNQQSP

SEQ ID NO: 2368621 - protein, 7 aa, Entamoeba dispar
KSSIPNS

SEQ ID NO: 2368622 - protein, 8 aa, Entamoeba dispar
KSSNLNTN

SEQ ID NO: 2368623 - protein, 5 aa, Entamoeba dispar
KSSNN

SEQ ID NO: 2368624 - protein, 8 aa, Entamoeba dispar
KSSNNELY

SEQ ID NO: 2368625 - protein, 13 aa, Entamoeba dispar
KSSNSNEIKSDSI

SEQ ID NO: 2368626 - protein, 24 aa, Entamoeba dispar
KSSPENLSINSSSSFSEEESEPID

SEQ ID NO: 2368627 - protein, 16 aa, Entamoeba dispar
KSSPIQVHKNVLFINY

SEQ ID NO: 2368628 - protein, 5 aa, Entamoeba dispar
KSSQN

SEQ ID NO: 2368629 - protein, 6 aa, Entamoeba dispar
KSSRSF

SEQ ID NO: 2368630 - protein, 13 aa, Entamoeba dispar
KSSRVELENTGYE

SEQ ID NO: 2368631 - protein, 9 aa, Entamoeba dispar
KSSSENQRS

SEQ ID NO: 2368632 - protein, 8 aa, Entamoeba dispar
KSSSEQEC

SEQ ID NO: 2368633 - protein, 8 aa, Entamoeba dispar
KSSSGNAI

SEQ ID NO: 2368634 - protein, 7 aa, Entamoeba dispar
KSSSIKN

SEQ ID NO: 2368635 - protein, 8 aa, Entamoeba dispar
KSSSKLEV

SEQ ID NO: 2368636 - protein, 7 aa, Entamoeba dispar
KSSSNYW

SEQ ID NO: 2368637 - protein, 9 aa, Entamoeba dispar
KSSTQLPRT

SEQ ID NO: 2368638 - protein, 7 aa, Entamoeba dispar
KSSTTLE

SEQ ID NO: 2368639 - protein, 6 aa, Entamoeba dispar
KSSYSF

SEQ ID NO: 2368640 - protein, 10 aa, Entamoeba dispar
KSSYSGNDNQ

SEQ ID NO: 2368641 - protein, 8 aa, Entamoeba dispar
KSSYSNNV

SEQ ID NO: 2368642 - protein, 6 aa, Entamoeba dispar
KSTAIT

SEQ ID NO: 2368643 - protein, 8 aa, Entamoeba dispar
KSTANKQI

SEQ ID NO: 2368644 - protein, 14 aa, Entamoeba dispar
KSTDNSCGTPETNE

SEQ ID NO: 2368645 - protein, 7 aa, Entamoeba dispar
KSTEERW

SEQ ID NO: 2368646 - protein, 7 aa, Entamoeba dispar
KSTFKQS

SEQ ID NO: 2368647 - protein, 5 aa, Entamoeba dispar
KSTIQ

SEQ ID NO: 2368648 - protein, 7 aa, Entamoeba dispar
KSTNSLL

SEQ ID NO: 2368649 - protein, 9 aa, Entamoeba dispar
KSTPTQRQE

SEQ ID NO: 2368650 - protein, 7 aa, Entamoeba dispar
KSTSKSY

SEQ ID NO: 2368651 - protein, 8 aa, Entamoeba dispar
KSTSQNNV

SEQ ID NO: 2368652 - protein, 6 aa, Entamoeba dispar
KSTSSL

SEQ ID NO: 2368653 - protein, 7 aa, Entamoeba dispar
KSTSTSL

SEQ ID NO: 2368654 - protein, 4 aa, Entamoeba dispar
KSTT

SEQ ID NO: 2368655 - protein, 12 aa, Entamoeba dispar
KSTTFARSGVNG

SEQ ID NO: 2368656 - protein, 8 aa, Entamoeba dispar
KSTTNNIS

SEQ ID NO: 2368657 - protein, 7 aa, Entamoeba dispar
KSTTQGF

SEQ ID NO: 2368658 - protein, 7 aa, Entamoeba dispar
KSVDQLT

SEQ ID NO: 2368659 - protein, 21 aa, Entamoeba dispar
KSVEASKKWYGNGINEGVRRN

SEQ ID NO: 2368660 - protein, 5 aa, Entamoeba dispar
KSVET

SEQ ID NO: 2368661 - protein, 8 aa, Entamoeba dispar
KSVGSVTD

SEQ ID NO: 2368662 - protein, 6 aa, Entamoeba dispar
KSVNSM

SEQ ID NO: 2368663 - protein, 8 aa, Entamoeba dispar
KSVPNNQF

SEQ ID NO: 2368664 - protein, 6 aa, Entamoeba dispar
KSVTGP

SEQ ID NO: 2368665 - protein, 7 aa, Entamoeba dispar
KSYDDNH

SEQ ID NO: 2368666 - protein, 8 aa, Entamoeba dispar
KSYPKNAP

SEQ ID NO: 2368667 - protein, 6 aa, Entamoeba dispar
KSYSLQ

SEQ ID NO: 2368668 - protein, 13 aa, Entamoeba dispar
KTAEDKTTCTKKG

SEQ ID NO: 2368669 - protein, 12 aa, Entamoeba dispar
KTAGEAKWTTEA

SEQ ID NO: 2368670 - protein, 14 aa, Entamoeba dispar
KTAKAESKAIKPYH

SEQ ID NO: 2368671 - protein, 11 aa, Entamoeba dispar
KTAVPRRNYKS

SEQ ID NO: 2368672 - protein, 16 aa, Entamoeba dispar
KTCECKPDGDSTTSNY

SEQ ID NO: 2368673 - protein, 7 aa, Entamoeba dispar
KTCEDYA

SEQ ID NO: 2368674 - protein, 14 aa, Entamoeba dispar
KTCEKRGVYGDEGI

SEQ ID NO: 2368675 - protein, 14 aa, Entamoeba dispar
KTCGNKQKNEFEEC

SEQ ID NO: 2368676 - protein, 7 aa, Entamoeba dispar
KTCHQDG

SEQ ID NO: 2368677 - protein, 58 aa, Entamoeba dispar
KTCPPPPPPPCRGKDCDHPHHPDCDGDDCPKPEPTPDPIPEPEPVPQECNATANFSRI

SEQ ID NO: 2368678 - protein, 20 aa, Entamoeba dispar
KTCSQIDPNCESCSSTTNKC

SEQ ID NO: 2368679 - protein, 5 aa, Entamoeba dispar
KTCSS

SEQ ID NO: 2368680 - protein, 7 aa, Entamoeba dispar
KTCTVSE

SEQ ID NO: 2368681 - protein, 14 aa, Entamoeba dispar
KTDASAKTITTTTE

SEQ ID NO: 2368682 - protein, 9 aa, Entamoeba dispar
KTDEEKEEA

SEQ ID NO: 2368683 - protein, 5 aa, Entamoeba dispar
KTDEQ

SEQ ID NO: 2368684 - protein, 8 aa, Entamoeba dispar
KTDEQMEN

SEQ ID NO: 2368685 - protein, 8 aa, Entamoeba dispar
KTDETDET

SEQ ID NO: 2368686 - protein, 6 aa, Entamoeba dispar
KTDGFS

SEQ ID NO: 2368687 - protein, 6 aa, Entamoeba dispar
KTDIED

SEQ ID NO: 2368688 - protein, 8 aa, Entamoeba dispar
KTDIPKDE

SEQ ID NO: 2368689 - protein, 5 aa, Entamoeba dispar
KTDLR

SEQ ID NO: 2368690 - protein, 6 aa, Entamoeba dispar
KTDNNA

SEQ ID NO: 2368691 - protein, 28 aa, Entamoeba dispar
KTDNNGHDKIEKKREGNNEKKKEQHHKK

SEQ ID NO: 2368692 - protein, 8 aa, Entamoeba dispar
KTDNNGHI

SEQ ID NO: 2368693 - protein, 5 aa, Entamoeba dispar
KTDPA

SEQ ID NO: 2368694 - protein, 7 aa, Entamoeba dispar
KTDRKVA

SEQ ID NO: 2368695 - protein, 9 aa, Entamoeba dispar
KTDTGSQQG

SEQ ID NO: 2368696 - protein, 5 aa, Entamoeba dispar
KTDTI

SEQ ID NO: 2368697 - protein, 8 aa, Entamoeba dispar
KTEDMTPN

SEQ ID NO: 2368698 - protein, 8 aa, Entamoeba dispar
KTEDSKCS

SEQ ID NO: 2368699 - protein, 10 aa, Entamoeba dispar
KTEEKNPNIV

SEQ ID NO: 2368700 - protein, 5 aa, Entamoeba dispar
KTEHE

SEQ ID NO: 2368701 - protein, 6 aa, Entamoeba dispar
KTEHKI

SEQ ID NO: 2368702 - protein, 8 aa, Entamoeba dispar
KTEISHPT

SEQ ID NO: 2368703 - protein, 8 aa, Entamoeba dispar
KTEKGQNY

SEQ ID NO: 2368704 - protein, 5 aa, Entamoeba dispar
KTEKK

SEQ ID NO: 2368705 - protein, 29 aa, Entamoeba dispar
KTENDNQNKKLEKQTQIKEINKKKKENPI

SEQ ID NO: 2368706 - protein, 7 aa, Entamoeba dispar
KTENECI

SEQ ID NO: 2368707 - protein, 7 aa, Entamoeba dispar
KTEQGEY

SEQ ID NO: 2368708 - protein, 11 aa, Entamoeba dispar
KTESEGITDSA

SEQ ID NO: 2368709 - protein, 10 aa, Entamoeba dispar
KTESKVSGTG

SEQ ID NO: 2368710 - protein, 6 aa, Entamoeba dispar
KTEVDS

SEQ ID NO: 2368711 - protein, 15 aa, Entamoeba dispar
KTEVSGAWDEAVPST

SEQ ID NO: 2368712 - protein, 6 aa, Entamoeba dispar
KTEWNE

SEQ ID NO: 2368713 - protein, 17 aa, Entamoeba dispar
KTFGGDEKGIDLAKTDS

SEQ ID NO: 2368714 - protein, 6 aa, Entamoeba dispar
KTFPEE

SEQ ID NO: 2368715 - protein, 5 aa, Entamoeba dispar
KTGFS

SEQ ID NO: 2368716 - protein, 6 aa, Entamoeba dispar
KTGIGH

SEQ ID NO: 2368717 - protein, 5 aa, Entamoeba dispar
KTGII

SEQ ID NO: 2368718 - protein, 7 aa, Entamoeba dispar
KTGISSF

SEQ ID NO: 2368719 - protein, 7 aa, Entamoeba dispar
KTGKEVD

SEQ ID NO: 2368720 - protein, 5 aa, Entamoeba dispar
KTGKL

SEQ ID NO: 2368721 - protein, 5 aa, Entamoeba dispar
KTGLQ

SEQ ID NO: 2368722 - protein, 6 aa, Entamoeba dispar
KTGTEV

SEQ ID NO: 2368723 - protein, 6 aa, Entamoeba dispar
KTGTFV

SEQ ID NO: 2368724 - protein, 7 aa, Entamoeba dispar
KTGTLTQ

SEQ ID NO: 2368725 - protein, 10 aa, Entamoeba dispar
KTGTLTSDEV

SEQ ID NO: 2368726 - protein, 7 aa, Entamoeba dispar
KTGTTNN

SEQ ID NO: 2368727 - protein, 6 aa, Entamoeba dispar
KTGYKA

SEQ ID NO: 2368728 - protein, 7 aa, Entamoeba dispar
KTHLNKS

SEQ ID NO: 2368729 - protein, 7 aa, Entamoeba dispar
KTHPQVN

SEQ ID NO: 2368730 - protein, 7 aa, Entamoeba dispar
KTHQNGL

SEQ ID NO: 2368731 - protein, 6 aa, Entamoeba dispar
KTIGLS

SEQ ID NO: 2368732 - protein, 6 aa, Entamoeba dispar
KTIGRP

SEQ ID NO: 2368733 - protein, 13 aa, Entamoeba dispar
KTIKSDKERAADE

SEQ ID NO: 2368734 - protein, 55 aa, Entamoeba dispar
KTINPTDEKSNDHSEASNNQEDSSMNQSDEKSMSPSEEESKSYSEDSSNHNIDGA

SEQ ID NO: 2368735 - protein, 4 aa, Entamoeba dispar
KTIR

SEQ ID NO: 2368736 - protein, 21 aa, Entamoeba dispar
KTIRAGQGKMRGRKIKERKGP

SEQ ID NO: 2368737 - protein, 13 aa, Entamoeba dispar
KTISSDAQSFSGT

SEQ ID NO: 2368738 - protein, 4 aa, Entamoeba dispar
KTIT

SEQ ID NO: 2368739 - protein, 21 aa, Entamoeba dispar
KTKCNPKNKRLVKRDEKCDKE

SEQ ID NO: 2368740 - protein, 10 aa, Entamoeba dispar
KTKCNPNNKR

SEQ ID NO: 2368741 - protein, 23 aa, Entamoeba dispar
KTKDDKLKKETKEQGSGYTVFHD

SEQ ID NO: 2368742 - protein, 9 aa, Entamoeba dispar
KTKDSTDNA

SEQ ID NO: 2368743 - protein, 31 aa, Entamoeba dispar
KTKEERKEKRRRKSSVEMNKRKTKEGNNTEK

SEQ ID NO: 2368744 - protein, 28 aa, Entamoeba dispar
KTKEKYNGYERFQSDEGEKEENEETTMI

SEQ ID NO: 2368745 - protein, 7 aa, Entamoeba dispar
KTKENLK

SEQ ID NO: 2368746 - protein, 5 aa, Entamoeba dispar
KTKHG

SEQ ID NO: 2368747 - protein, 5 aa, Entamoeba dispar
KTKID

SEQ ID NO: 2368748 - protein, 12 aa, Entamoeba dispar
KTKISDKKNCQQ

SEQ ID NO: 2368749 - protein, 7 aa, Entamoeba dispar
KTKKESQ

SEQ ID NO: 2368750 - protein, 8 aa, Entamoeba dispar
KTKKPESL

SEQ ID NO: 2368751 - protein, 16 aa, Entamoeba dispar
KTKLQHGKIASGNGKQ

SEQ ID NO: 2368752 - protein, 7 aa, Entamoeba dispar
KTKNESF

SEQ ID NO: 2368753 - protein, 5 aa, Entamoeba dispar
KTKNG

SEQ ID NO: 2368754 - protein, 7 aa, Entamoeba dispar
KTKNGNN

SEQ ID NO: 2368755 - protein, 7 aa, Entamoeba dispar
KTKNNNV

SEQ ID NO: 2368756 - protein, 10 aa, Entamoeba dispar
KTKNNTQQAN

SEQ ID NO: 2368757 - protein, 12 aa, Entamoeba dispar
KTKPNHNLTESD

SEQ ID NO: 2368758 - protein, 16 aa, Entamoeba dispar
KTKQGRNKPHKSDDNK

SEQ ID NO: 2368759 - protein, 11 aa, Entamoeba dispar
KTKRSKESVET

SEQ ID NO: 2368760 - protein, 17 aa, Entamoeba dispar
KTKSIDNTNESESYYLS

SEQ ID NO: 2368761 - protein, 10 aa, Entamoeba dispar
KTKSKVKPSI

SEQ ID NO: 2368762 - protein, 6 aa, Entamoeba dispar
KTKSQV

SEQ ID NO: 2368763 - protein, 9 aa, Entamoeba dispar
KTKTPFSGP

SEQ ID NO: 2368764 - protein, 13 aa, Entamoeba dispar
KTKTYDIDEPREA

SEQ ID NO: 2368765 - protein, 6 aa, Entamoeba dispar
KTKVQE

SEQ ID NO: 2368766 - protein, 4 aa, Entamoeba dispar
KTKY

SEQ ID NO: 2368767 - protein, 6 aa, Entamoeba dispar
KTLGGY

SEQ ID NO: 2368768 - protein, 8 aa, Entamoeba dispar
KTLISGTS

SEQ ID NO: 2368769 - protein, 16 aa, Entamoeba dispar
KTLKKGWSKMDEEEIP

SEQ ID NO: 2368770 - protein, 7 aa, Entamoeba dispar
KTLNGTN

SEQ ID NO: 2368771 - protein, 12 aa, Entamoeba dispar
KTLNKSNKRYKR

SEQ ID NO: 2368772 - protein, 7 aa, Entamoeba dispar
KTLPEEY

SEQ ID NO: 2368773 - protein, 6 aa, Entamoeba dispar
KTLPGS

SEQ ID NO: 2368774 - protein, 31 aa, Entamoeba dispar
KTLQTRTKYSWSSRRGSTVLRPNSTGSFEIE

SEQ ID NO: 2368775 - protein, 11 aa, Entamoeba dispar
KTLSNEGKKYL

SEQ ID NO: 2368776 - protein, 7 aa, Entamoeba dispar
KTLTGVE

SEQ ID NO: 2368777 - protein, 5 aa, Entamoeba dispar
KTMEE

SEQ ID NO: 2368778 - protein, 9 aa, Entamoeba dispar
KTMSSLRKS

SEQ ID NO: 2368779 - protein, 6 aa, Entamoeba dispar
KTNAGS

SEQ ID NO: 2368780 - protein, 8 aa, Entamoeba dispar
KTNDEDTL

SEQ ID NO: 2368781 - protein, 9 aa, Entamoeba dispar
KTNDKGKDQ

SEQ ID NO: 2368782 - protein, 34 aa, Entamoeba dispar
KTNEKGLVNKENKVDEKKEELLKKEKTKKVGTIK

SEQ ID NO: 2368783 - protein, 8 aa, Entamoeba dispar
KTNEPKQC

SEQ ID NO: 2368784 - protein, 6 aa, Entamoeba dispar
KTNEYP

SEQ ID NO: 2368785 - protein, 8 aa, Entamoeba dispar
KTNGNDHW

SEQ ID NO: 2368786 - protein, 6 aa, Entamoeba dispar
KTNKPL

SEQ ID NO: 2368787 - protein, 8 aa, Entamoeba dispar
KTNKTIAP

SEQ ID NO: 2368788 - protein, 4 aa, Entamoeba dispar
KTNL

SEQ ID NO: 2368789 - protein, 4 aa, Entamoeba dispar
KTNN

SEQ ID NO: 2368790 - protein, 7 aa, Entamoeba dispar
KTNNENI

SEQ ID NO: 2368791 - protein, 12 aa, Entamoeba dispar
KTNNKNDYKDKE

SEQ ID NO: 2368792 - protein, 22 aa, Entamoeba dispar
KTNNNSKNTERTTSQNKISDLS

SEQ ID NO: 2368793 - protein, 6 aa, Entamoeba dispar
KTNNPG

SEQ ID NO: 2368794 - protein, 6 aa, Entamoeba dispar
KTNPMS

SEQ ID NO: 2368795 - protein, 23 aa, Entamoeba dispar
KTNPRKEELKNIDHKKQKLSRKK

SEQ ID NO: 2368796 - protein, 5 aa, Entamoeba dispar
KTNPT

SEQ ID NO: 2368797 - protein, 4 aa, Entamoeba dispar
KTNQ

SEQ ID NO: 2368798 - protein, 9 aa, Entamoeba dispar
KTNQDSEMC

SEQ ID NO: 2368799 - protein, 8 aa, Entamoeba dispar
KTNQKSIE

SEQ ID NO: 2368800 - protein, 14 aa, Entamoeba dispar
KTNQQQNISNKANE

SEQ ID NO: 2368801 - protein, 5 aa, Entamoeba dispar
KTNQS

SEQ ID NO: 2368802 - protein, 4 aa, Entamoeba dispar
KTNS

SEQ ID NO: 2368803 - protein, 5 aa, Entamoeba dispar
KTNSQ

SEQ ID NO: 2368804 - protein, 5 aa, Entamoeba dispar
KTNTL

SEQ ID NO: 2368805 - protein, 7 aa, Entamoeba dispar
KTNTTND

SEQ ID NO: 2368806 - protein, 7 aa, Entamoeba dispar
KTPIAQR

SEQ ID NO: 2368807 - protein, 8 aa, Entamoeba dispar
KTPKKIRF

SEQ ID NO: 2368808 - protein, 4 aa, Entamoeba dispar
KTPL

SEQ ID NO: 2368809 - protein, 6 aa, Entamoeba dispar
KTPMDE

SEQ ID NO: 2368810 - protein, 17 aa, Entamoeba dispar
KTPRNKTPRNTLTPRKS

SEQ ID NO: 2368811 - protein, 7 aa, Entamoeba dispar
KTPSKRG

SEQ ID NO: 2368812 - protein, 4 aa, Entamoeba dispar
KTPV

SEQ ID NO: 2368813 - protein, 6 aa, Entamoeba dispar
KTQCDS

SEQ ID NO: 2368814 - protein, 11 aa, Entamoeba dispar
KTQCSGTNSTI

SEQ ID NO: 2368815 - protein, 8 aa, Entamoeba dispar
KTQGRQTY

SEQ ID NO: 2368816 - protein, 5 aa, Entamoeba dispar
KTQIQ

SEQ ID NO: 2368817 - protein, 6 aa, Entamoeba dispar
KTQKAA

SEQ ID NO: 2368818 - protein, 6 aa, Entamoeba dispar
KTQKIE

SEQ ID NO: 2368819 - protein, 9 aa, Entamoeba dispar
KTQLSGEGQ

SEQ ID NO: 2368820 - protein, 5 aa, Entamoeba dispar
KTQND

SEQ ID NO: 2368821 - protein, 7 aa, Entamoeba dispar
KTQNRYS

SEQ ID NO: 2368822 - protein, 5 aa, Entamoeba dispar
KTQPA

SEQ ID NO: 2368823 - protein, 10 aa, Entamoeba dispar
KTQQDNATRA

SEQ ID NO: 2368824 - protein, 6 aa, Entamoeba dispar
KTQTGI

SEQ ID NO: 2368825 - protein, 8 aa, Entamoeba dispar
KTQTKHSI

SEQ ID NO: 2368826 - protein, 8 aa, Entamoeba dispar
KTQTQQEN

SEQ ID NO: 2368827 - protein, 5 aa, Entamoeba dispar
KTRII

SEQ ID NO: 2368828 - protein, 7 aa, Entamoeba dispar
KTRLQNE

SEQ ID NO: 2368829 - protein, 9 aa, Entamoeba dispar
KTRNGAQMK

SEQ ID NO: 2368830 - protein, 6 aa, Entamoeba dispar
KTRSAF

SEQ ID NO: 2368831 - protein, 7 aa, Entamoeba dispar
KTRSLIP

SEQ ID NO: 2368832 - protein, 6 aa, Entamoeba dispar
KTRSNN

SEQ ID NO: 2368833 - protein, 6 aa, Entamoeba dispar
KTRSYL

SEQ ID NO: 2368834 - protein, 7 aa, Entamoeba dispar
KTSDEEM

SEQ ID NO: 2368835 - protein, 59 aa, Entamoeba dispar
KTSDKSKSDSHNKNHSGSTKTNTKSKDISSSDQKSTTNTTNGTDENNDTSVSSQSIEKS

SEQ ID NO: 2368836 - protein, 6 aa, Entamoeba dispar
KTSDYT

SEQ ID NO: 2368837 - protein, 10 aa, Entamoeba dispar
KTSEDLQQKL

SEQ ID NO: 2368838 - protein, 5 aa, Entamoeba dispar
KTSGF

SEQ ID NO: 2368839 - protein, 8 aa, Entamoeba dispar
KTSGHSAN

SEQ ID NO: 2368840 - protein, 8 aa, Entamoeba dispar
KTSGIPPS

SEQ ID NO: 2368841 - protein, 17 aa, Entamoeba dispar
KTSIETDKTKKKKKLTY

SEQ ID NO: 2368842 - protein, 20 aa, Entamoeba dispar
KTSIETSEINGRNELEKKEG

SEQ ID NO: 2368843 - protein, 10 aa, Entamoeba dispar
KTSLTSSNLG

SEQ ID NO: 2368844 - protein, 4 aa, Entamoeba dispar
KTSN

SEQ ID NO: 2368845 - protein, 9 aa, Entamoeba dispar
KTSSSSGTL

SEQ ID NO: 2368846 - protein, 7 aa, Entamoeba dispar
KTSSSTK

SEQ ID NO: 2368847 - protein, 4 aa, Entamoeba dispar
KTST

SEQ ID NO: 2368848 - protein, 6 aa, Entamoeba dispar
KTSTLR

SEQ ID NO: 2368849 - protein, 9 aa, Entamoeba dispar
KTSTQPASK

SEQ ID NO: 2368850 - protein, 5 aa, Entamoeba dispar
KTSYQ

SEQ ID NO: 2368851 - protein, 5 aa, Entamoeba dispar
KTTDH

SEQ ID NO: 2368852 - protein, 14 aa, Entamoeba dispar
KTTDNSSVLTPYTE

SEQ ID NO: 2368853 - protein, 9 aa, Entamoeba dispar
KTTETGNST

SEQ ID NO: 2368854 - protein, 7 aa, Entamoeba dispar
KTTETVE

SEQ ID NO: 2368855 - protein, 7 aa, Entamoeba dispar
KTTKIPA

SEQ ID NO: 2368856 - protein, 13 aa, Entamoeba dispar
KTTKKSAKEACSG

SEQ ID NO: 2368857 - protein, 7 aa, Entamoeba dispar
KTTNGIK

SEQ ID NO: 2368858 - protein, 6 aa, Entamoeba dispar
KTTNIK

SEQ ID NO: 2368859 - protein, 6 aa, Entamoeba dispar
KTTNRE

SEQ ID NO: 2368860 - protein, 7 aa, Entamoeba dispar
KTTNTSL

SEQ ID NO: 2368861 - protein, 8 aa, Entamoeba dispar
KTTPSSTL

SEQ ID NO: 2368862 - protein, 7 aa, Entamoeba dispar
KTTSGIG

SEQ ID NO: 2368863 - protein, 6 aa, Entamoeba dispar
KTTSSL

SEQ ID NO: 2368864 - protein, 10 aa, Entamoeba dispar
KTTTSFEEGL

SEQ ID NO: 2368865 - protein, 8 aa, Entamoeba dispar
KTTWSQNS

SEQ ID NO: 2368866 - protein, 7 aa, Entamoeba dispar
KTVDKEK

SEQ ID NO: 2368867 - protein, 5 aa, Entamoeba dispar
KTVGS

SEQ ID NO: 2368868 - protein, 6 aa, Entamoeba dispar
KTVKDK

SEQ ID NO: 2368869 - protein, 24 aa, Entamoeba dispar
KTVPGGANVTSSSSAFQVKEGTYS

SEQ ID NO: 2368870 - protein, 6 aa, Entamoeba dispar
KTVSEA

SEQ ID NO: 2368871 - protein, 10 aa, Entamoeba dispar
KTVTNNKEVE

SEQ ID NO: 2368872 - protein, 7 aa, Entamoeba dispar
KTWNKNA

SEQ ID NO: 2368873 - protein, 13 aa, Entamoeba dispar
KTYEAKKEALEKI

SEQ ID NO: 2368874 - protein, 5 aa, Entamoeba dispar
KTYER

SEQ ID NO: 2368875 - protein, 8 aa, Entamoeba dispar
KTYESTYR

SEQ ID NO: 2368876 - protein, 10 aa, Entamoeba dispar
KTYGCGENSR

SEQ ID NO: 2368877 - protein, 6 aa, Entamoeba dispar
KTYLSN

SEQ ID NO: 2368878 - protein, 6 aa, Entamoeba dispar
KTYQNP

SEQ ID NO: 2368879 - protein, 8 aa, Entamoeba dispar
KTYSPTEI

SEQ ID NO: 2368880 - protein, 4 aa, Entamoeba dispar
KVAA

SEQ ID NO: 2368881 - protein, 5 aa, Entamoeba dispar
KVAAE

SEQ ID NO: 2368882 - protein, 7 aa, Entamoeba dispar
KVAPTMS

SEQ ID NO: 2368883 - protein, 6 aa, Entamoeba dispar
KVCKKD

SEQ ID NO: 2368884 - protein, 7 aa, Entamoeba dispar
KVDDDIS

SEQ ID NO: 2368885 - protein, 8 aa, Entamoeba dispar
KVDDGTVG

SEQ ID NO: 2368886 - protein, 30 aa, Entamoeba dispar
KVDDNASFTCSHGGSVGWQAPEAIKGERLT

SEQ ID NO: 2368887 - protein, 4 aa, Entamoeba dispar
KVDG

SEQ ID NO: 2368888 - protein, 4 aa, Entamoeba dispar
KVDL

SEQ ID NO: 2368889 - protein, 8 aa, Entamoeba dispar
KVDNSPKL

SEQ ID NO: 2368890 - protein, 6 aa, Entamoeba dispar
KVDPSI

SEQ ID NO: 2368891 - protein, 10 aa, Entamoeba dispar
KVDTQKNTTM

SEQ ID NO: 2368892 - protein, 8 aa, Entamoeba dispar
KVEAPETH

SEQ ID NO: 2368893 - protein, 48 aa, Entamoeba dispar
KVEEEAKDNEIELSNSKENKAETSKSSSTSSRSSDEIQHPEEDIKELN

SEQ ID NO: 2368894 - protein, 11 aa, Entamoeba dispar
KVEEQRKKEEE

SEQ ID NO: 2368895 - protein, 4 aa, Entamoeba dispar
KVEG

SEQ ID NO: 2368896 - protein, 6 aa, Entamoeba dispar
KVEGNQ

SEQ ID NO: 2368897 - protein, 11 aa, Entamoeba dispar
KVEKEEIERRA

SEQ ID NO: 2368898 - protein, 5 aa, Entamoeba dispar
KVENA

SEQ ID NO: 2368899 - protein, 5 aa, Entamoeba dispar
KVETA

SEQ ID NO: 2368900 - protein, 6 aa, Entamoeba dispar
KVETAI

SEQ ID NO: 2368901 - protein, 6 aa, Entamoeba dispar
KVETAT

SEQ ID NO: 2368902 - protein, 7 aa, Entamoeba dispar
KVFDDEP

SEQ ID NO: 2368903 - protein, 9 aa, Entamoeba dispar
KVFRENNET

SEQ ID NO: 2368904 - protein, 11 aa, Entamoeba dispar
KVGPSTEQDYG

SEQ ID NO: 2368905 - protein, 5 aa, Entamoeba dispar
KVGQF

SEQ ID NO: 2368906 - protein, 14 aa, Entamoeba dispar
KVIGSSGDAWTESN

SEQ ID NO: 2368907 - protein, 6 aa, Entamoeba dispar
KVKEEV

SEQ ID NO: 2368908 - protein, 16 aa, Entamoeba dispar
KVKEKGFENDEDKKKS

SEQ ID NO: 2368909 - protein, 10 aa, Entamoeba dispar
KVKENDSYTN

SEQ ID NO: 2368910 - protein, 6 aa, Entamoeba dispar
KVKENK

SEQ ID NO: 2368911 - protein, 18 aa, Entamoeba dispar
KVKGKSKWYTGGEQALTS

SEQ ID NO: 2368912 - protein, 21 aa, Entamoeba dispar
KVKKEKEKEREQERNNYKNSI

SEQ ID NO: 2368913 - protein, 12 aa, Entamoeba dispar
KVKNGNYCDSNK

SEQ ID NO: 2368914 - protein, 7 aa, Entamoeba dispar
KVKPPKI

SEQ ID NO: 2368915 - protein, 6 aa, Entamoeba dispar
KVKTSK

SEQ ID NO: 2368916 - protein, 19 aa, Entamoeba dispar
KVLGKKNENKPVEALNKKE

SEQ ID NO: 2368917 - protein, 7 aa, Entamoeba dispar
KVLSNSP

SEQ ID NO: 2368918 - protein, 23 aa, Entamoeba dispar
KVNDTPNSITQKTEGSYGEDDRN

SEQ ID NO: 2368919 - protein, 12 aa, Entamoeba dispar
KVNEKNNDNEHK

SEQ ID NO: 2368920 - protein, 22 aa, Entamoeba dispar
KVNEQNNGCDCTDGYTANGPQR

SEQ ID NO: 2368921 - protein, 4 aa, Entamoeba dispar
KVNG

SEQ ID NO: 2368922 - protein, 8 aa, Entamoeba dispar
KVNKLGNS

SEQ ID NO: 2368923 - protein, 7 aa, Entamoeba dispar
KVNQETK

SEQ ID NO: 2368924 - protein, 8 aa, Entamoeba dispar
KVNSTTFP

SEQ ID NO: 2368925 - protein, 7 aa, Entamoeba dispar
KVNTESK

SEQ ID NO: 2368926 - protein, 7 aa, Entamoeba dispar
KVPASKP

SEQ ID NO: 2368927 - protein, 9 aa, Entamoeba dispar
KVPCPSSLG

SEQ ID NO: 2368928 - protein, 10 aa, Entamoeba dispar
KVPKGLPTKA

SEQ ID NO: 2368929 - protein, 6 aa, Entamoeba dispar
KVPNGT

SEQ ID NO: 2368930 - protein, 5 aa, Entamoeba dispar
KVPNS

SEQ ID NO: 2368931 - protein, 6 aa, Entamoeba dispar
KVPNSI

SEQ ID NO: 2368932 - protein, 8 aa, Entamoeba dispar
KVPYSDEN

SEQ ID NO: 2368933 - protein, 12 aa, Entamoeba dispar
KVQCSNEPGAIT

SEQ ID NO: 2368934 - protein, 14 aa, Entamoeba dispar
KVQTSSEESKLEDS

SEQ ID NO: 2368935 - protein, 6 aa, Entamoeba dispar
KVRGYG

SEQ ID NO: 2368936 - protein, 10 aa, Entamoeba dispar
KVRNKEGKIE

SEQ ID NO: 2368937 - protein, 36 aa, Entamoeba dispar
KVSDIDSSESENSEDFNKQKNKEETSDSEEWSESDS

SEQ ID NO: 2368938 - protein, 138 aa, Entamoeba dispar
KVSEVEQKDFPEESPSGRKSDEKRLSSQDSEKLSSNSTLSQTKSDSSNEKSEQDKDESQEKDEGDKEKVEDEEKKDEIKDKESKEEVQVESEEKNEEIKDKEEKKEEIKDKVEATKEVEKKEEQKKNKKDQEKEVITE

SEQ ID NO: 2368939 - protein, 6 aa, Entamoeba dispar
KVSGET

SEQ ID NO: 2368940 - protein, 9 aa, Entamoeba dispar
KVSIQDSSL

SEQ ID NO: 2368941 - protein, 19 aa, Entamoeba dispar
KVSNTIKRISSKKSSSSVK

SEQ ID NO: 2368942 - protein, 4 aa, Entamoeba dispar
KVSP

SEQ ID NO: 2368943 - protein, 15 aa, Entamoeba dispar
KVSPTKQTLKQAVPA

SEQ ID NO: 2368944 - protein, 6 aa, Entamoeba dispar
KVSSFD

SEQ ID NO: 2368945 - protein, 8 aa, Entamoeba dispar
KVSSGTVS

SEQ ID NO: 2368946 - protein, 10 aa, Entamoeba dispar
KVSSTCSGLT

SEQ ID NO: 2368947 - protein, 4 aa, Entamoeba dispar
KVTH

SEQ ID NO: 2368948 - protein, 4 aa, Entamoeba dispar
KVTN

SEQ ID NO: 2368949 - protein, 7 aa, Entamoeba dispar
KVTQKTN

SEQ ID NO: 2368950 - protein, 8 aa, Entamoeba dispar
KVTSENEH

SEQ ID NO: 2368951 - protein, 10 aa, Entamoeba dispar
KVVEQGTHDE

SEQ ID NO: 2368952 - protein, 6 aa, Entamoeba dispar
KVVNSK

SEQ ID NO: 2368953 - protein, 11 aa, Entamoeba dispar
KVVTNNSLQQS

SEQ ID NO: 2368954 - protein, 9 aa, Entamoeba dispar
KVYETPSQK

SEQ ID NO: 2368955 - protein, 7 aa, Entamoeba dispar
KWDKDDC

SEQ ID NO: 2368956 - protein, 12 aa, Entamoeba dispar
KWDYDGQDYQAK

SEQ ID NO: 2368957 - protein, 8 aa, Entamoeba dispar
KWPKQNGY

SEQ ID NO: 2368958 - protein, 11 aa, Entamoeba dispar
KWSNRRDGAAE

SEQ ID NO: 2368959 - protein, 4 aa, Entamoeba dispar
KYAE

SEQ ID NO: 2368960 - protein, 7 aa, Entamoeba dispar
KYAEGMS

SEQ ID NO: 2368961 - protein, 7 aa, Entamoeba dispar
KYANYSK

SEQ ID NO: 2368962 - protein, 8 aa, Entamoeba dispar
KYAPQVTR

SEQ ID NO: 2368963 - protein, 5 aa, Entamoeba dispar
KYDDS

SEQ ID NO: 2368964 - protein, 8 aa, Entamoeba dispar
KYDEERKE

SEQ ID NO: 2368965 - protein, 7 aa, Entamoeba dispar
KYDEGDI

SEQ ID NO: 2368966 - protein, 9 aa, Entamoeba dispar
KYDKSPNSI

SEQ ID NO: 2368967 - protein, 6 aa, Entamoeba dispar
KYDSLT

SEQ ID NO: 2368968 - protein, 6 aa, Entamoeba dispar
KYDTET

SEQ ID NO: 2368969 - protein, 6 aa, Entamoeba dispar
KYEDGY

SEQ ID NO: 2368970 - protein, 19 aa, Entamoeba dispar
KYEENMKEKWEKESHSKHP

SEQ ID NO: 2368971 - protein, 4 aa, Entamoeba dispar
KYEK

SEQ ID NO: 2368972 - protein, 5 aa, Entamoeba dispar
KYEKY

SEQ ID NO: 2368973 - protein, 5 aa, Entamoeba dispar
KYENE

SEQ ID NO: 2368974 - protein, 8 aa, Entamoeba dispar
KYETENKG

SEQ ID NO: 2368975 - protein, 12 aa, Entamoeba dispar
KYGDNFTATTIQ

SEQ ID NO: 2368976 - protein, 6 aa, Entamoeba dispar
KYGEKS

SEQ ID NO: 2368977 - protein, 7 aa, Entamoeba dispar
KYGKPAD

SEQ ID NO: 2368978 - protein, 12 aa, Entamoeba dispar
KYGSEEELKRNP

SEQ ID NO: 2368979 - protein, 5 aa, Entamoeba dispar
KYGSL

SEQ ID NO: 2368980 - protein, 5 aa, Entamoeba dispar
KYGSV

SEQ ID NO: 2368981 - protein, 5 aa, Entamoeba dispar
KYGTP

SEQ ID NO: 2368982 - protein, 7 aa, Entamoeba dispar
KYGTPES

SEQ ID NO: 2368983 - protein, 6 aa, Entamoeba dispar
KYIDNN

SEQ ID NO: 2368984 - protein, 6 aa, Entamoeba dispar
KYIGSS

SEQ ID NO: 2368985 - protein, 5 aa, Entamoeba dispar
KYINE

SEQ ID NO: 2368986 - protein, 13 aa, Entamoeba dispar
KYIRKGRKGSLNV

SEQ ID NO: 2368987 - protein, 7 aa, Entamoeba dispar
KYIRKGS

SEQ ID NO: 2368988 - protein, 4 aa, Entamoeba dispar
KYKE

SEQ ID NO: 2368989 - protein, 8 aa, Entamoeba dispar
KYKELGNT

SEQ ID NO: 2368990 - protein, 9 aa, Entamoeba dispar
KYKGKSNWN

SEQ ID NO: 2368991 - protein, 7 aa, Entamoeba dispar
KYKGTFP

SEQ ID NO: 2368992 - protein, 6 aa, Entamoeba dispar
KYKKMS

SEQ ID NO: 2368993 - protein, 8 aa, Entamoeba dispar
KYKKSTEI

SEQ ID NO: 2368994 - protein, 6 aa, Entamoeba dispar
KYKLPS

SEQ ID NO: 2368995 - protein, 6 aa, Entamoeba dispar
KYKMPA

SEQ ID NO: 2368996 - protein, 8 aa, Entamoeba dispar
KYKQSEKC

SEQ ID NO: 2368997 - protein, 10 aa, Entamoeba dispar
KYKRNKEYDD

SEQ ID NO: 2368998 - protein, 6 aa, Entamoeba dispar
KYKRNL

SEQ ID NO: 2368999 - protein, 4 aa, Entamoeba dispar
KYKS

SEQ ID NO: 2369000 - protein, 9 aa, Entamoeba dispar
KYKTSNGPI

SEQ ID NO: 2369001 - protein, 7 aa, Entamoeba dispar
KYLNPTT

SEQ ID NO: 2369002 - protein, 9 aa, Entamoeba dispar
KYLSQSEEI

SEQ ID NO: 2369003 - protein, 4 aa, Entamoeba dispar
KYNE

SEQ ID NO: 2369004 - protein, 5 aa, Entamoeba dispar
KYNEK

SEQ ID NO: 2369005 - protein, 9 aa, Entamoeba dispar
KYNEKETSV

SEQ ID NO: 2369006 - protein, 4 aa, Entamoeba dispar
KYNG

SEQ ID NO: 2369007 - protein, 11 aa, Entamoeba dispar
KYNGEEYKNDP

SEQ ID NO: 2369008 - protein, 14 aa, Entamoeba dispar
KYNHYQQNNSHNHF

SEQ ID NO: 2369009 - protein, 8 aa, Entamoeba dispar
KYNKGDYQ

SEQ ID NO: 2369010 - protein, 7 aa, Entamoeba dispar
KYNKREA

SEQ ID NO: 2369011 - protein, 11 aa, Entamoeba dispar
KYNNTNQNSIY

SEQ ID NO: 2369012 - protein, 4 aa, Entamoeba dispar
KYNP

SEQ ID NO: 2369013 - protein, 6 aa, Entamoeba dispar
KYNPHS

SEQ ID NO: 2369014 - protein, 5 aa, Entamoeba dispar
KYNQE

SEQ ID NO: 2369015 - protein, 7 aa, Entamoeba dispar
KYNQPTN

SEQ ID NO: 2369016 - protein, 5 aa, Entamoeba dispar
KYNSH

SEQ ID NO: 2369017 - protein, 20 aa, Entamoeba dispar
KYNSPSSHIENKTSIQSPKI

SEQ ID NO: 2369018 - protein, 5 aa, Entamoeba dispar
KYNTY

SEQ ID NO: 2369019 - protein, 5 aa, Entamoeba dispar
KYPED

SEQ ID NO: 2369020 - protein, 6 aa, Entamoeba dispar
KYPIQT

SEQ ID NO: 2369021 - protein, 6 aa, Entamoeba dispar
KYPKEY

SEQ ID NO: 2369022 - protein, 6 aa, Entamoeba dispar
KYPNIN

SEQ ID NO: 2369023 - protein, 6 aa, Entamoeba dispar
KYPPYQ

SEQ ID NO: 2369024 - protein, 10 aa, Entamoeba dispar
KYPSRSHTSW

SEQ ID NO: 2369025 - protein, 5 aa, Entamoeba dispar
KYPST

SEQ ID NO: 2369026 - protein, 7 aa, Entamoeba dispar
KYPTPDD

SEQ ID NO: 2369027 - protein, 5 aa, Entamoeba dispar
KYPTS

SEQ ID NO: 2369028 - protein, 4 aa, Entamoeba dispar
KYPY

SEQ ID NO: 2369029 - protein, 5 aa, Entamoeba dispar
KYQDV

SEQ ID NO: 2369030 - protein, 5 aa, Entamoeba dispar
KYQEM

SEQ ID NO: 2369031 - protein, 5 aa, Entamoeba dispar
KYQGN

SEQ ID NO: 2369032 - protein, 13 aa, Entamoeba dispar
KYQNKHNKSSFGT

SEQ ID NO: 2369033 - protein, 4 aa, Entamoeba dispar
KYQQ

SEQ ID NO: 2369034 - protein, 7 aa, Entamoeba dispar
KYQTQGI

SEQ ID NO: 2369035 - protein, 6 aa, Entamoeba dispar
KYRGTT

SEQ ID NO: 2369036 - protein, 7 aa, Entamoeba dispar
KYRLSGG

SEQ ID NO: 2369037 - protein, 20 aa, Entamoeba dispar
KYRRGNKVKYNGEVEEGEWT

SEQ ID NO: 2369038 - protein, 16 aa, Entamoeba dispar
KYRTETVKKTIEPQWK

SEQ ID NO: 2369039 - protein, 10 aa, Entamoeba dispar
KYSDEQIKTK

SEQ ID NO: 2369040 - protein, 4 aa, Entamoeba dispar
KYSF

SEQ ID NO: 2369041 - protein, 7 aa, Entamoeba dispar
KYSIEDG

SEQ ID NO: 2369042 - protein, 6 aa, Entamoeba dispar
KYSKAR

SEQ ID NO: 2369043 - protein, 11 aa, Entamoeba dispar
KYSNKNKGRVS

SEQ ID NO: 2369044 - protein, 26 aa, Entamoeba dispar
KYSPFKSPHAQFTNSKSSILDNSFTQ

SEQ ID NO: 2369045 - protein, 10 aa, Entamoeba dispar
KYSQDDTNTI

SEQ ID NO: 2369046 - protein, 10 aa, Entamoeba dispar
KYSQELSRTK

SEQ ID NO: 2369047 - protein, 10 aa, Entamoeba dispar
KYSRKSRQTL

SEQ ID NO: 2369048 - protein, 5 aa, Entamoeba dispar
KYSRR

SEQ ID NO: 2369049 - protein, 9 aa, Entamoeba dispar
KYSSECDNQ

SEQ ID NO: 2369050 - protein, 5 aa, Entamoeba dispar
KYSSF

SEQ ID NO: 2369051 - protein, 21 aa, Entamoeba dispar
KYSSFKSPHAQFTNSKSSILD

SEQ ID NO: 2369052 - protein, 6 aa, Entamoeba dispar
KYSSKK

SEQ ID NO: 2369053 - protein, 8 aa, Entamoeba dispar
KYSTAGNC

SEQ ID NO: 2369054 - protein, 9 aa, Entamoeba dispar
KYSTKPKNY

SEQ ID NO: 2369055 - protein, 29 aa, Entamoeba dispar
KYSTQEPFTDNNGNGFKYTGGSRSRSGDL

SEQ ID NO: 2369056 - protein, 12 aa, Entamoeba dispar
KYTESEIPNDPF

SEQ ID NO: 2369057 - protein, 7 aa, Entamoeba dispar
KYTGDCQ

SEQ ID NO: 2369058 - protein, 20 aa, Entamoeba dispar
KYTKQTLNSSKPINKNSTLD

SEQ ID NO: 2369059 - protein, 6 aa, Entamoeba dispar
KYTLNN

SEQ ID NO: 2369060 - protein, 23 aa, Entamoeba dispar
KYTLNNEKCSNKEKNQNGKNEEI

SEQ ID NO: 2369061 - protein, 22 aa, Entamoeba dispar
KYTLNNGKCSNKENQNGKNEEI

SEQ ID NO: 2369062 - protein, 22 aa, Entamoeba dispar
KYTLNNGKCSNKENRNGKNEEI

SEQ ID NO: 2369063 - protein, 4 aa, Entamoeba dispar
KYTS

SEQ ID NO: 2369064 - protein, 6 aa, Entamoeba dispar
KYVGSS

SEQ ID NO: 2369065 - protein, 5 aa, Entamoeba dispar
KYYDS

SEQ ID NO: 2369066 - protein, 5 aa, Entamoeba dispar
KYYNA

SEQ ID NO: 2369067 - protein, 13 aa, Entamoeba dispar
LAADATKLNGVTG

SEQ ID NO: 2369068 - protein, 6 aa, Entamoeba dispar
LADPNE

SEQ ID NO: 2369069 - protein, 4 aa, Entamoeba dispar
LAEN

SEQ ID NO: 2369070 - protein, 7 aa, Entamoeba dispar
LAEREPF

SEQ ID NO: 2369071 - protein, 10 aa, Entamoeba dispar
LAESEQTKIG

SEQ ID NO: 2369072 - protein, 11 aa, Entamoeba dispar
LAETQRKKIGT

SEQ ID NO: 2369073 - protein, 11 aa, Entamoeba dispar
LAGGGNKLSDL

SEQ ID NO: 2369074 - protein, 4 aa, Entamoeba dispar
LAGN

SEQ ID NO: 2369075 - protein, 38 aa, Entamoeba dispar
LAKGEASIAETLKAEDEKKKKQDDKSSESTEKTKRSNA

SEQ ID NO: 2369076 - protein, 36 aa, Entamoeba dispar
LAKGEASIAETLKAEDEKKKKQDDKSSESTEKTKRV

SEQ ID NO: 2369077 - protein, 7 aa, Entamoeba dispar
LAKKEGI

SEQ ID NO: 2369078 - protein, 11 aa, Entamoeba dispar
LAKNSSKPKIK

SEQ ID NO: 2369079 - protein, 9 aa, Entamoeba dispar
LALNQPSLR

SEQ ID NO: 2369080 - protein, 5 aa, Entamoeba dispar
LANKT

SEQ ID NO: 2369081 - protein, 6 aa, Entamoeba dispar
LAPAGS

SEQ ID NO: 2369082 - protein, 8 aa, Entamoeba dispar
LAPGDKQA

SEQ ID NO: 2369083 - protein, 10 aa, Entamoeba dispar
LAPSNDVNQI

SEQ ID NO: 2369084 - protein, 30 aa, Entamoeba dispar
LAQPNELPKRTNSSSPTKEINKQNNSLSPR

SEQ ID NO: 2369085 - protein, 8 aa, Entamoeba dispar
LARKTNKT

SEQ ID NO: 2369086 - protein, 7 aa, Entamoeba dispar
LASHTAG

SEQ ID NO: 2369087 - protein, 9 aa, Entamoeba dispar
LASKNGDVK

SEQ ID NO: 2369088 - protein, 6 aa, Entamoeba dispar
LASKYY

SEQ ID NO: 2369089 - protein, 33 aa, Entamoeba dispar
LATGCADDIGSPVDPHNSLGNYTVGDNNDPMKA

SEQ ID NO: 2369090 - protein, 10 aa, Entamoeba dispar
LATKNNDEKL

SEQ ID NO: 2369091 - protein, 12 aa, Entamoeba dispar
LATPTLKTTGRI

SEQ ID NO: 2369092 - protein, 10 aa, Entamoeba dispar
LCENSEKGRG

SEQ ID NO: 2369093 - protein, 5 aa, Entamoeba dispar
LCNGN

SEQ ID NO: 2369094 - protein, 7 aa, Entamoeba dispar
LDASQKI

SEQ ID NO: 2369095 - protein, 11 aa, Entamoeba dispar
LDDKNGGNHQI

SEQ ID NO: 2369096 - protein, 11 aa, Entamoeba dispar
LDEARKQELIK

SEQ ID NO: 2369097 - protein, 4 aa, Entamoeba dispar
LDEC

SEQ ID NO: 2369098 - protein, 10 aa, Entamoeba dispar
LDEEKQMEEF

SEQ ID NO: 2369099 - protein, 10 aa, Entamoeba dispar
LDELGTDDPL

SEQ ID NO: 2369100 - protein, 20 aa, Entamoeba dispar
LDENEDCDPTIKGNNDTQCT

SEQ ID NO: 2369101 - protein, 6 aa, Entamoeba dispar
LDENGC

SEQ ID NO: 2369102 - protein, 17 aa, Entamoeba dispar
LDENKVASFDGDTTKQT

SEQ ID NO: 2369103 - protein, 5 aa, Entamoeba dispar
LDENN

SEQ ID NO: 2369104 - protein, 14 aa, Entamoeba dispar
LDEQCDQVDNCDEN

SEQ ID NO: 2369105 - protein, 7 aa, Entamoeba dispar
LDEQEHK

SEQ ID NO: 2369106 - protein, 4 aa, Entamoeba dispar
LDER

SEQ ID NO: 2369107 - protein, 5 aa, Entamoeba dispar
LDERT

SEQ ID NO: 2369108 - protein, 19 aa, Entamoeba dispar
LDESDMTGESVAVKKSEKS

SEQ ID NO: 2369109 - protein, 13 aa, Entamoeba dispar
LDETDDTIPQTTT

SEQ ID NO: 2369110 - protein, 5 aa, Entamoeba dispar
LDETT

SEQ ID NO: 2369111 - protein, 6 aa, Entamoeba dispar
LDGETN

SEQ ID NO: 2369112 - protein, 7 aa, Entamoeba dispar
LDGETNL

SEQ ID NO: 2369113 - protein, 7 aa, Entamoeba dispar
LDGNCNE

SEQ ID NO: 2369114 - protein, 10 aa, Entamoeba dispar
LDKASKEGQM

SEQ ID NO: 2369115 - protein, 9 aa, Entamoeba dispar
LDKTTTKME

SEQ ID NO: 2369116 - protein, 4 aa, Entamoeba dispar
LDLE

SEQ ID NO: 2369117 - protein, 12 aa, Entamoeba dispar
LDLSPSLSSLPS

SEQ ID NO: 2369118 - protein, 12 aa, Entamoeba dispar
LDNGSKNTEKLK

SEQ ID NO: 2369119 - protein, 19 aa, Entamoeba dispar
LDNIYTEDNETSLEERTMD

SEQ ID NO: 2369120 - protein, 4 aa, Entamoeba dispar
LDNK

SEQ ID NO: 2369121 - protein, 20 aa, Entamoeba dispar
LDNNGIDDKGDKNEQKEKKT

SEQ ID NO: 2369122 - protein, 13 aa, Entamoeba dispar
LDNSISMSNQTAE

SEQ ID NO: 2369123 - protein, 12 aa, Entamoeba dispar
LDNTDSSGTIDN

SEQ ID NO: 2369124 - protein, 9 aa, Entamoeba dispar
LDNTSNPQI

SEQ ID NO: 2369125 - protein, 6 aa, Entamoeba dispar
LDPDEI

SEQ ID NO: 2369126 - protein, 7 aa, Entamoeba dispar
LDPDNEA

SEQ ID NO: 2369127 - protein, 11 aa, Entamoeba dispar
LDPKRRKQVQN

SEQ ID NO: 2369128 - protein, 7 aa, Entamoeba dispar
LDPNINK

SEQ ID NO: 2369129 - protein, 9 aa, Entamoeba dispar
LDPQIPSGV

SEQ ID NO: 2369130 - protein, 9 aa, Entamoeba dispar
LDPSAKSFP

SEQ ID NO: 2369131 - protein, 5 aa, Entamoeba dispar
LDQNT

SEQ ID NO: 2369132 - protein, 14 aa, Entamoeba dispar
LDRSGNTLPPPNKE

SEQ ID NO: 2369133 - protein, 37 aa, Entamoeba dispar
LDRSNKSQRSFRSSFSSVSNQNSTSSDEVPLKPSKAK

SEQ ID NO: 2369134 - protein, 18 aa, Entamoeba dispar
LDSDDSSDDIMKPQTDDK

SEQ ID NO: 2369135 - protein, 13 aa, Entamoeba dispar
LDSESANTVSNEA

SEQ ID NO: 2369136 - protein, 8 aa, Entamoeba dispar
LDSKTYSY

SEQ ID NO: 2369137 - protein, 4 aa, Entamoeba dispar
LDSL

SEQ ID NO: 2369138 - protein, 7 aa, Entamoeba dispar
LDSNNFE

SEQ ID NO: 2369139 - protein, 10 aa, Entamoeba dispar
LDSQDYYSTE

SEQ ID NO: 2369140 - protein, 8 aa, Entamoeba dispar
LDSSSTRI

SEQ ID NO: 2369141 - protein, 4 aa, Entamoeba dispar
LDTP

SEQ ID NO: 2369142 - protein, 7 aa, Entamoeba dispar
LDTPNSK

SEQ ID NO: 2369143 - protein, 7 aa, Entamoeba dispar
LDTTETS

SEQ ID NO: 2369144 - protein, 9 aa, Entamoeba dispar
LDVPTTPNF

SEQ ID NO: 2369145 - protein, 8 aa, Entamoeba dispar
LDVSPSNI

SEQ ID NO: 2369146 - protein, 4 aa, Entamoeba dispar
LEAK

SEQ ID NO: 2369147 - protein, 14 aa, Entamoeba dispar
LEDGNGSTKDIPVS

SEQ ID NO: 2369148 - protein, 9 aa, Entamoeba dispar
LEDGNNDID

SEQ ID NO: 2369149 - protein, 9 aa, Entamoeba dispar
LEDKTIPTL

SEQ ID NO: 2369150 - protein, 8 aa, Entamoeba dispar
LEDNKPGT

SEQ ID NO: 2369151 - protein, 10 aa, Entamoeba dispar
LEDNQEEEFQ

SEQ ID NO: 2369152 - protein, 5 aa, Entamoeba dispar
LEDQD

SEQ ID NO: 2369153 - protein, 8 aa, Entamoeba dispar
LEDVNKSE

SEQ ID NO: 2369154 - protein, 7 aa, Entamoeba dispar
LEEASKE

SEQ ID NO: 2369155 - protein, 12 aa, Entamoeba dispar
LEEEDKEEKTKT

SEQ ID NO: 2369156 - protein, 5 aa, Entamoeba dispar
LEEEY

SEQ ID NO: 2369157 - protein, 4 aa, Entamoeba dispar
LEEF

SEQ ID NO: 2369158 - protein, 4 aa, Entamoeba dispar
LEEI

SEQ ID NO: 2369159 - protein, 9 aa, Entamoeba dispar
LEELTGQKV

SEQ ID NO: 2369160 - protein, 5 aa, Entamoeba dispar
LEESR

SEQ ID NO: 2369161 - protein, 4 aa, Entamoeba dispar
LEET

SEQ ID NO: 2369162 - protein, 8 aa, Entamoeba dispar
LEETEEKD

SEQ ID NO: 2369163 - protein, 5 aa, Entamoeba dispar
LEFTK

SEQ ID NO: 2369164 - protein, 5 aa, Entamoeba dispar
LEGIN

SEQ ID NO: 2369165 - protein, 20 aa, Entamoeba dispar
LEGKKNIEKEFEDAKKRIEE

SEQ ID NO: 2369166 - protein, 17 aa, Entamoeba dispar
LEGTDELTISKKEGIAD

SEQ ID NO: 2369167 - protein, 13 aa, Entamoeba dispar
LEHEESIKTENAS

SEQ ID NO: 2369168 - protein, 7 aa, Entamoeba dispar
LEKEPEK

SEQ ID NO: 2369169 - protein, 12 aa, Entamoeba dispar
LEKEQIKRTNEV

SEQ ID NO: 2369170 - protein, 13 aa, Entamoeba dispar
LEKEQTKRTNEVK

SEQ ID NO: 2369171 - protein, 5 aa, Entamoeba dispar
LEKGQ

SEQ ID NO: 2369172 - protein, 10 aa, Entamoeba dispar
LEKNKNNPEH

SEQ ID NO: 2369173 - protein, 10 aa, Entamoeba dispar
LEKPESMSES

SEQ ID NO: 2369174 - protein, 9 aa, Entamoeba dispar
LEKPQEIND

SEQ ID NO: 2369175 - protein, 7 aa, Entamoeba dispar
LEKQVDE

SEQ ID NO: 2369176 - protein, 25 aa, Entamoeba dispar
LEKRAAKKKEIQKRKEELQSNAGLQ

SEQ ID NO: 2369177 - protein, 8 aa, Entamoeba dispar
LEKSKGEC

SEQ ID NO: 2369178 - protein, 6 aa, Entamoeba dispar
LENDKE

SEQ ID NO: 2369179 - protein, 32 aa, Entamoeba dispar
LENDKENKNQQELKGRKEATLSRAGIDGGSRV

SEQ ID NO: 2369180 - protein, 8 aa, Entamoeba dispar
LENKDNGS

SEQ ID NO: 2369181 - protein, 8 aa, Entamoeba dispar
LENNDKSI

SEQ ID NO: 2369182 - protein, 8 aa, Entamoeba dispar
LENQTGVQ

SEQ ID NO: 2369183 - protein, 9 aa, Entamoeba dispar
LENTTPSEI

SEQ ID NO: 2369184 - protein, 5 aa, Entamoeba dispar
LEPND

SEQ ID NO: 2369185 - protein, 17 aa, Entamoeba dispar
LEPPKEIKRSRSHSRHS

SEQ ID NO: 2369186 - protein, 4 aa, Entamoeba dispar
LEPQ

SEQ ID NO: 2369187 - protein, 4 aa, Entamoeba dispar
LEPT

SEQ ID NO: 2369188 - protein, 4 aa, Entamoeba dispar
LEQL

SEQ ID NO: 2369189 - protein, 17 aa, Entamoeba dispar
LEQNEEIGKHEYTPRGG

SEQ ID NO: 2369190 - protein, 5 aa, Entamoeba dispar
LEQPG

SEQ ID NO: 2369191 - protein, 6 aa, Entamoeba dispar
LEQSSI

SEQ ID NO: 2369192 - protein, 8 aa, Entamoeba dispar
LEQTYENS

SEQ ID NO: 2369193 - protein, 5 aa, Entamoeba dispar
LERNS

SEQ ID NO: 2369194 - protein, 12 aa, Entamoeba dispar
LERQNSNNSGVN

SEQ ID NO: 2369195 - protein, 11 aa, Entamoeba dispar
LESEQKAKSVG

SEQ ID NO: 2369196 - protein, 6 aa, Entamoeba dispar
LESGNC

SEQ ID NO: 2369197 - protein, 19 aa, Entamoeba dispar
LESQNQEDSKKNRNELQKE

SEQ ID NO: 2369198 - protein, 18 aa, Entamoeba dispar
LESSEEEFSEDNIPEQIY

SEQ ID NO: 2369199 - protein, 5 aa, Entamoeba dispar
LESTF

SEQ ID NO: 2369200 - protein, 12 aa, Entamoeba dispar
LETDREKVDRKF

SEQ ID NO: 2369201 - protein, 8 aa, Entamoeba dispar
LETGEQEK

SEQ ID NO: 2369202 - protein, 4 aa, Entamoeba dispar
LETK

SEQ ID NO: 2369203 - protein, 9 aa, Entamoeba dispar
LETKEEEDP

SEQ ID NO: 2369204 - protein, 9 aa, Entamoeba dispar
LETNTMSYA

SEQ ID NO: 2369205 - protein, 5 aa, Entamoeba dispar
LETTN

SEQ ID NO: 2369206 - protein, 9 aa, Entamoeba dispar
LEVENAEEE

SEQ ID NO: 2369207 - protein, 4 aa, Entamoeba dispar
LEVQ

SEQ ID NO: 2369208 - protein, 13 aa, Entamoeba dispar
LFDPTKYAGYAEQ

SEQ ID NO: 2369209 - protein, 6 aa, Entamoeba dispar
LFQPSQ

SEQ ID NO: 2369210 - protein, 9 aa, Entamoeba dispar
LGAETSAIE

SEQ ID NO: 2369211 - protein, 5 aa, Entamoeba dispar
LGANS

SEQ ID NO: 2369212 - protein, 6 aa, Entamoeba dispar
LGASTS

SEQ ID NO: 2369213 - protein, 10 aa, Entamoeba dispar
LGDDDGGDSL

SEQ ID NO: 2369214 - protein, 5 aa, Entamoeba dispar
LGDDS

SEQ ID NO: 2369215 - protein, 6 aa, Entamoeba dispar
LGDESV

SEQ ID NO: 2369216 - protein, 6 aa, Entamoeba dispar
LGDLST

SEQ ID NO: 2369217 - protein, 4 aa, Entamoeba dispar
LGDM

SEQ ID NO: 2369218 - protein, 6 aa, Entamoeba dispar
LGDPNF

SEQ ID NO: 2369219 - protein, 7 aa, Entamoeba dispar
LGDSQNK

SEQ ID NO: 2369220 - protein, 8 aa, Entamoeba dispar
LGDSTEDI

SEQ ID NO: 2369221 - protein, 26 aa, Entamoeba dispar
LGDTCKQAECTKYNDNGCGKGSTGST

SEQ ID NO: 2369222 - protein, 5 aa, Entamoeba dispar
LGEDF

SEQ ID NO: 2369223 - protein, 9 aa, Entamoeba dispar
LGEDQNGKC

SEQ ID NO: 2369224 - protein, 24 aa, Entamoeba dispar
LGEEFSSDEEDDIQINTQPANTKS

SEQ ID NO: 2369225 - protein, 6 aa, Entamoeba dispar
LGEGGF

SEQ ID NO: 2369226 - protein, 5 aa, Entamoeba dispar
LGEGS

SEQ ID NO: 2369227 - protein, 8 aa, Entamoeba dispar
LGEGTGQQ

SEQ ID NO: 2369228 - protein, 5 aa, Entamoeba dispar
LGEIK

SEQ ID NO: 2369229 - protein, 8 aa, Entamoeba dispar
LGENESFQ

SEQ ID NO: 2369230 - protein, 10 aa, Entamoeba dispar
LGESDDDGSA

SEQ ID NO: 2369231 - protein, 17 aa, Entamoeba dispar
LGGDEKRTPRSQQEATI

SEQ ID NO: 2369232 - protein, 12 aa, Entamoeba dispar
LGGESSGDKIKQ

SEQ ID NO: 2369233 - protein, 9 aa, Entamoeba dispar
LGGKNPAIV

SEQ ID NO: 2369234 - protein, 8 aa, Entamoeba dispar
LGGNSSLG

SEQ ID NO: 2369235 - protein, 15 aa, Entamoeba dispar
LGGPEKTKACGHSNM

SEQ ID NO: 2369236 - protein, 6 aa, Entamoeba dispar
LGGSQA

SEQ ID NO: 2369237 - protein, 6 aa, Entamoeba dispar
LGGTEG

SEQ ID NO: 2369238 - protein, 9 aa, Entamoeba dispar
LGHENRNTS

SEQ ID NO: 2369239 - protein, 14 aa, Entamoeba dispar
LGIEGKEGKQASMA

SEQ ID NO: 2369240 - protein, 7 aa, Entamoeba dispar
LGKDKKH

SEQ ID NO: 2369241 - protein, 15 aa, Entamoeba dispar
LGKGEDDYNKFDELT

SEQ ID NO: 2369242 - protein, 26 aa, Entamoeba dispar
LGKHKSHSKYQQTQVTERKSNEHKKT

SEQ ID NO: 2369243 - protein, 8 aa, Entamoeba dispar
LGMSGGSQ

SEQ ID NO: 2369244 - protein, 12 aa, Entamoeba dispar
LGNEGKCKQCPD

SEQ ID NO: 2369245 - protein, 8 aa, Entamoeba dispar
LGNEPYDD

SEQ ID NO: 2369246 - protein, 9 aa, Entamoeba dispar
LGNGNSNTN

SEQ ID NO: 2369247 - protein, 12 aa, Entamoeba dispar
LGPEYEKTAEEC

SEQ ID NO: 2369248 - protein, 21 aa, Entamoeba dispar
LGPGKGLGTDFRPTSSTISFS

SEQ ID NO: 2369249 - protein, 4 aa, Entamoeba dispar
LGPP

SEQ ID NO: 2369250 - protein, 9 aa, Entamoeba dispar
LGPSTTSMP

SEQ ID NO: 2369251 - protein, 4 aa, Entamoeba dispar
LGPT

SEQ ID NO: 2369252 - protein, 20 aa, Entamoeba dispar
LGQDDKRESRFYQSLQTEEH

SEQ ID NO: 2369253 - protein, 13 aa, Entamoeba dispar
LGQPNEYSTHNKP

SEQ ID NO: 2369254 - protein, 13 aa, Entamoeba dispar
LGQQTSKKTPGSI

SEQ ID NO: 2369255 - protein, 6 aa, Entamoeba dispar
LGREEM

SEQ ID NO: 2369256 - protein, 14 aa, Entamoeba dispar
LGRNNYASISPNKL

SEQ ID NO: 2369257 - protein, 7 aa, Entamoeba dispar
LGRPSPV

SEQ ID NO: 2369258 - protein, 4 aa, Entamoeba dispar
LGSA

SEQ ID NO: 2369259 - protein, 9 aa, Entamoeba dispar
LGSSDDSMK

SEQ ID NO: 2369260 - protein, 7 aa, Entamoeba dispar
LGSSINE

SEQ ID NO: 2369261 - protein, 10 aa, Entamoeba dispar
LGSSKDPCSF

SEQ ID NO: 2369262 - protein, 30 aa, Entamoeba dispar
LGSSSDSGFLSQTGKTSRDCEDLSKTNDYS

SEQ ID NO: 2369263 - protein, 4 aa, Entamoeba dispar
LGST

SEQ ID NO: 2369264 - protein, 4 aa, Entamoeba dispar
LGSV

SEQ ID NO: 2369265 - protein, 10 aa, Entamoeba dispar
LGTEKPTDSL

SEQ ID NO: 2369266 - protein, 8 aa, Entamoeba dispar
LGTEKPTI

SEQ ID NO: 2369267 - protein, 9 aa, Entamoeba dispar
LGTKATTTL

SEQ ID NO: 2369268 - protein, 5 aa, Entamoeba dispar
LGTNG

SEQ ID NO: 2369269 - protein, 11 aa, Entamoeba dispar
LGTSENEDEWG

SEQ ID NO: 2369270 - protein, 7 aa, Entamoeba dispar
LGTVDSQ

SEQ ID NO: 2369271 - protein, 5 aa, Entamoeba dispar
LGTYG

SEQ ID NO: 2369272 - protein, 4 aa, Entamoeba dispar
LGVS

SEQ ID NO: 2369273 - protein, 11 aa, Entamoeba dispar
LGYTSDCQGCN

SEQ ID NO: 2369274 - protein, 14 aa, Entamoeba dispar
LHADTVRESIQPEI

SEQ ID NO: 2369275 - protein, 8 aa, Entamoeba dispar
LHEEDIPK

SEQ ID NO: 2369276 - protein, 4 aa, Entamoeba dispar
LHGC

SEQ ID NO: 2369277 - protein, 7 aa, Entamoeba dispar
LHNQQSY

SEQ ID NO: 2369278 - protein, 6 aa, Entamoeba dispar
LHPGNQ

SEQ ID NO: 2369279 - protein, 7 aa, Entamoeba dispar
LHPQSKV

SEQ ID NO: 2369280 - protein, 9 aa, Entamoeba dispar
LHQQAGSKN

SEQ ID NO: 2369281 - protein, 6 aa, Entamoeba dispar
LHQTSG

SEQ ID NO: 2369282 - protein, 13 aa, Entamoeba dispar
LHSNDKEKRKTKC

SEQ ID NO: 2369283 - protein, 9 aa, Entamoeba dispar
LHSNDTARV

SEQ ID NO: 2369284 - protein, 7 aa, Entamoeba dispar
LHSNSSS

SEQ ID NO: 2369285 - protein, 6 aa, Entamoeba dispar
LHSTPF

SEQ ID NO: 2369286 - protein, 4 aa, Entamoeba dispar
LIAQ

SEQ ID NO: 2369287 - protein, 9 aa, Entamoeba dispar
LIEPSSEKV

SEQ ID NO: 2369288 - protein, 42 aa, Entamoeba dispar
LIKPEEDKSESIKPENIKSETDQFELKEKKEECNTQQETKQD

SEQ ID NO: 2369289 - protein, 10 aa, Entamoeba dispar
LINEEDTYEV

SEQ ID NO: 2369290 - protein, 5 aa, Entamoeba dispar
LINEN

SEQ ID NO: 2369291 - protein, 7 aa, Entamoeba dispar
LINPKNG

SEQ ID NO: 2369292 - protein, 7 aa, Entamoeba dispar
LISSPEN

SEQ ID NO: 2369293 - protein, 14 aa, Entamoeba dispar
LITPTKENQQLFNL

SEQ ID NO: 2369294 - protein, 6 aa, Entamoeba dispar
LITSGQ

SEQ ID NO: 2369295 - protein, 6 aa, Entamoeba dispar
LKADER

SEQ ID NO: 2369296 - protein, 7 aa, Entamoeba dispar
LKASNNP

SEQ ID NO: 2369297 - protein, 4 aa, Entamoeba dispar
LKDE

SEQ ID NO: 2369298 - protein, 6 aa, Entamoeba dispar
LKDESE

SEQ ID NO: 2369299 - protein, 6 aa, Entamoeba dispar
LKDGRI

SEQ ID NO: 2369300 - protein, 9 aa, Entamoeba dispar
LKDNKQTIR

SEQ ID NO: 2369301 - protein, 11 aa, Entamoeba dispar
LKDPTDPLSEC

SEQ ID NO: 2369302 - protein, 18 aa, Entamoeba dispar
LKDQSNEYDPDKESKTDT

SEQ ID NO: 2369303 - protein, 7 aa, Entamoeba dispar
LKDSDNY

SEQ ID NO: 2369304 - protein, 4 aa, Entamoeba dispar
LKDT

SEQ ID NO: 2369305 - protein, 6 aa, Entamoeba dispar
LKDYEN

SEQ ID NO: 2369306 - protein, 4 aa, Entamoeba dispar
LKEE

SEQ ID NO: 2369307 - protein, 14 aa, Entamoeba dispar
LKEEISKSENDIKM

SEQ ID NO: 2369308 - protein, 11 aa, Entamoeba dispar
LKEEKGTVSTR

SEQ ID NO: 2369309 - protein, 7 aa, Entamoeba dispar
LKEEKSI

SEQ ID NO: 2369310 - protein, 22 aa, Entamoeba dispar
LKEEQSKLNDSQKEVKRLSQNL

SEQ ID NO: 2369311 - protein, 4 aa, Entamoeba dispar
LKEG

SEQ ID NO: 2369312 - protein, 16 aa, Entamoeba dispar
LKENSINKQWPSQHYK

SEQ ID NO: 2369313 - protein, 9 aa, Entamoeba dispar
LKEPGKPQI

SEQ ID NO: 2369314 - protein, 4 aa, Entamoeba dispar
LKEQ

SEQ ID NO: 2369315 - protein, 11 aa, Entamoeba dispar
LKEQPPQSRDH

SEQ ID NO: 2369316 - protein, 7 aa, Entamoeba dispar
LKEQYEK

SEQ ID NO: 2369317 - protein, 16 aa, Entamoeba dispar
LKERTDNIGAKQEFNK

SEQ ID NO: 2369318 - protein, 10 aa, Entamoeba dispar
LKESIGRQKG

SEQ ID NO: 2369319 - protein, 24 aa, Entamoeba dispar
LKESTNPTVSKKQPKLLSQKEQYK

SEQ ID NO: 2369320 - protein, 12 aa, Entamoeba dispar
LKETKKEIYQEP

SEQ ID NO: 2369321 - protein, 6 aa, Entamoeba dispar
LKETTV

SEQ ID NO: 2369322 - protein, 4 aa, Entamoeba dispar
LKEY

SEQ ID NO: 2369323 - protein, 13 aa, Entamoeba dispar
LKGDKLPKYEIEE

SEQ ID NO: 2369324 - protein, 11 aa, Entamoeba dispar
LKGLSKNSTAY

SEQ ID NO: 2369325 - protein, 10 aa, Entamoeba dispar
LKGRNEDTEL

SEQ ID NO: 2369326 - protein, 10 aa, Entamoeba dispar
LKGSKLEAKG

SEQ ID NO: 2369327 - protein, 19 aa, Entamoeba dispar
LKHKDDKVEGSENNEVAPT

SEQ ID NO: 2369328 - protein, 9 aa, Entamoeba dispar
LKHQRKPTK

SEQ ID NO: 2369329 - protein, 7 aa, Entamoeba dispar
LKHTETA

SEQ ID NO: 2369330 - protein, 14 aa, Entamoeba dispar
LKKEEEEEINHNHL

SEQ ID NO: 2369331 - protein, 9 aa, Entamoeba dispar
LKKERSDLA

SEQ ID NO: 2369332 - protein, 9 aa, Entamoeba dispar
LKKESKKVR

SEQ ID NO: 2369333 - protein, 5 aa, Entamoeba dispar
LKKGD

SEQ ID NO: 2369334 - protein, 8 aa, Entamoeba dispar
LKKGDKKR

SEQ ID NO: 2369335 - protein, 7 aa, Entamoeba dispar
LKKGGIP

SEQ ID NO: 2369336 - protein, 5 aa, Entamoeba dispar
LKKPT

SEQ ID NO: 2369337 - protein, 7 aa, Entamoeba dispar
LKKTQPE

SEQ ID NO: 2369338 - protein, 7 aa, Entamoeba dispar
LKNEIQK

SEQ ID NO: 2369339 - protein, 7 aa, Entamoeba dispar
LKNGSYS

SEQ ID NO: 2369340 - protein, 11 aa, Entamoeba dispar
LKNHPNQNPRL

SEQ ID NO: 2369341 - protein, 24 aa, Entamoeba dispar
LKNNEALKQHEKIREATAIINQEY

SEQ ID NO: 2369342 - protein, 11 aa, Entamoeba dispar
LKNQRYNSSTN

SEQ ID NO: 2369343 - protein, 7 aa, Entamoeba dispar
LKNRSEE

SEQ ID NO: 2369344 - protein, 5 aa, Entamoeba dispar
LKPGK

SEQ ID NO: 2369345 - protein, 7 aa, Entamoeba dispar
LKPGTTR

SEQ ID NO: 2369346 - protein, 5 aa, Entamoeba dispar
LKPIT

SEQ ID NO: 2369347 - protein, 7 aa, Entamoeba dispar
LKPQKGE

SEQ ID NO: 2369348 - protein, 9 aa, Entamoeba dispar
LKPQPDGTF

SEQ ID NO: 2369349 - protein, 5 aa, Entamoeba dispar
LKPSG

SEQ ID NO: 2369350 - protein, 5 aa, Entamoeba dispar
LKPSY

SEQ ID NO: 2369351 - protein, 5 aa, Entamoeba dispar
LKPVP

SEQ ID NO: 2369352 - protein, 8 aa, Entamoeba dispar
LKQDSTEL

SEQ ID NO: 2369353 - protein, 16 aa, Entamoeba dispar
LKQEGKSIDDITNSPK

SEQ ID NO: 2369354 - protein, 42 aa, Entamoeba dispar
LKQIPQSTTNLHDKQTPSLPPKQLVEQSKKQLPSLPPKPILK

SEQ ID NO: 2369355 - protein, 20 aa, Entamoeba dispar
LKQNSTKMKRKEDIQQNSET

SEQ ID NO: 2369356 - protein, 18 aa, Entamoeba dispar
LKQPEKSQRNQNDPMTPF

SEQ ID NO: 2369357 - protein, 5 aa, Entamoeba dispar
LKQSL

SEQ ID NO: 2369358 - protein, 4 aa, Entamoeba dispar
LKRF

SEQ ID NO: 2369359 - protein, 9 aa, Entamoeba dispar
LKRNNKNKI

SEQ ID NO: 2369360 - protein, 14 aa, Entamoeba dispar
LKRSEEAKKKELEE

SEQ ID NO: 2369361 - protein, 10 aa, Entamoeba dispar
LKRSSKSFEA

SEQ ID NO: 2369362 - protein, 14 aa, Entamoeba dispar
LKRTYRESKKPKEL

SEQ ID NO: 2369363 - protein, 8 aa, Entamoeba dispar
LKSAPGTF

SEQ ID NO: 2369364 - protein, 11 aa, Entamoeba dispar
LKSARESSASW

SEQ ID NO: 2369365 - protein, 7 aa, Entamoeba dispar
LKSDDTA

SEQ ID NO: 2369366 - protein, 15 aa, Entamoeba dispar
LKSEYSDSSCTIKKK

SEQ ID NO: 2369367 - protein, 15 aa, Entamoeba dispar
LKSGGSKKELKEQTT

SEQ ID NO: 2369368 - protein, 7 aa, Entamoeba dispar
LKSNDSL

SEQ ID NO: 2369369 - protein, 7 aa, Entamoeba dispar
LKSNPEN

SEQ ID NO: 2369370 - protein, 12 aa, Entamoeba dispar
LKSPDDKEAIES

SEQ ID NO: 2369371 - protein, 7 aa, Entamoeba dispar
LKSPTTW

SEQ ID NO: 2369372 - protein, 8 aa, Entamoeba dispar
LKTAPRNT

SEQ ID NO: 2369373 - protein, 17 aa, Entamoeba dispar
LKTCSNCNGISNKQSKC

SEQ ID NO: 2369374 - protein, 7 aa, Entamoeba dispar
LKTEDGF

SEQ ID NO: 2369375 - protein, 7 aa, Entamoeba dispar
LKTGEHE

SEQ ID NO: 2369376 - protein, 6 aa, Entamoeba dispar
LKTIET

SEQ ID NO: 2369377 - protein, 10 aa, Entamoeba dispar
LKTKEPINIS

SEQ ID NO: 2369378 - protein, 8 aa, Entamoeba dispar
LKTKEYQN

SEQ ID NO: 2369379 - protein, 6 aa, Entamoeba dispar
LKTKGV

SEQ ID NO: 2369380 - protein, 8 aa, Entamoeba dispar
LKTNNEIS

SEQ ID NO: 2369381 - protein, 15 aa, Entamoeba dispar
LKTNSYAPGSNEDPM

SEQ ID NO: 2369382 - protein, 8 aa, Entamoeba dispar
LKTNTNET

SEQ ID NO: 2369383 - protein, 9 aa, Entamoeba dispar
LKTQGVSDV

SEQ ID NO: 2369384 - protein, 16 aa, Entamoeba dispar
LKTSLPDVKRTKYDQR

SEQ ID NO: 2369385 - protein, 21 aa, Entamoeba dispar
LKTSSDNKKVFTATSSTVSFP

SEQ ID NO: 2369386 - protein, 8 aa, Entamoeba dispar
LKVKQTKE

SEQ ID NO: 2369387 - protein, 10 aa, Entamoeba dispar
LLAPPKPQRI

SEQ ID NO: 2369388 - protein, 10 aa, Entamoeba dispar
LLPDTEEYNN

SEQ ID NO: 2369389 - protein, 12 aa, Entamoeba dispar
LLPTKTPRDKAI

SEQ ID NO: 2369390 - protein, 13 aa, Entamoeba dispar
LLSKNKPKKRAKI

SEQ ID NO: 2369391 - protein, 9 aa, Entamoeba dispar
LLTSESEGI

SEQ ID NO: 2369392 - protein, 10 aa, Entamoeba dispar
LMTQGKNNKY

SEQ ID NO: 2369393 - protein, 6 aa, Entamoeba dispar
LNAPDN

SEQ ID NO: 2369394 - protein, 7 aa, Entamoeba dispar
LNATGYG

SEQ ID NO: 2369395 - protein, 18 aa, Entamoeba dispar
LNATHSKNKTNSIKNTIN

SEQ ID NO: 2369396 - protein, 9 aa, Entamoeba dispar
LNATPLSKE

SEQ ID NO: 2369397 - protein, 10 aa, Entamoeba dispar
LNCPKTNQIP

SEQ ID NO: 2369398 - protein, 5 aa, Entamoeba dispar
LNDIS

SEQ ID NO: 2369399 - protein, 21 aa, Entamoeba dispar
LNDKDNLKQQQKNPKKDEEEK

SEQ ID NO: 2369400 - protein, 8 aa, Entamoeba dispar
LNDNALSP

SEQ ID NO: 2369401 - protein, 20 aa, Entamoeba dispar
LNDPKTCNKRGKLNDQKEIQ

SEQ ID NO: 2369402 - protein, 5 aa, Entamoeba dispar
LNDPS

SEQ ID NO: 2369403 - protein, 5 aa, Entamoeba dispar
LNDQD

SEQ ID NO: 2369404 - protein, 9 aa, Entamoeba dispar
LNDTTKQAL

SEQ ID NO: 2369405 - protein, 11 aa, Entamoeba dispar
LNEDNNTINSV

SEQ ID NO: 2369406 - protein, 6 aa, Entamoeba dispar
LNEEND

SEQ ID NO: 2369407 - protein, 14 aa, Entamoeba dispar
LNEESKTHIKQRII

SEQ ID NO: 2369408 - protein, 9 aa, Entamoeba dispar
LNEFSQEAQ

SEQ ID NO: 2369409 - protein, 8 aa, Entamoeba dispar
LNEGDMKH

SEQ ID NO: 2369410 - protein, 11 aa, Entamoeba dispar
LNEKIKQSSMS

SEQ ID NO: 2369411 - protein, 29 aa, Entamoeba dispar
LNELKKNQNNSSSDDRLITKEEEEENEEE

SEQ ID NO: 2369412 - protein, 5 aa, Entamoeba dispar
LNEQK

SEQ ID NO: 2369413 - protein, 7 aa, Entamoeba dispar
LNEQNAE

SEQ ID NO: 2369414 - protein, 8 aa, Entamoeba dispar
LNGESLGD

SEQ ID NO: 2369415 - protein, 9 aa, Entamoeba dispar
LNGNDYSPL

SEQ ID NO: 2369416 - protein, 5 aa, Entamoeba dispar
LNHQS

SEQ ID NO: 2369417 - protein, 31 aa, Entamoeba dispar
LNIPDGKIQGKVSDRLTKITNTQRFSTPSVH

SEQ ID NO: 2369418 - protein, 6 aa, Entamoeba dispar
LNITGS

SEQ ID NO: 2369419 - protein, 11 aa, Entamoeba dispar
LNKAENENRIA

SEQ ID NO: 2369420 - protein, 4 aa, Entamoeba dispar
LNKE

SEQ ID NO: 2369421 - protein, 9 aa, Entamoeba dispar
LNKEPLKTN

SEQ ID NO: 2369422 - protein, 10 aa, Entamoeba dispar
LNKKQNKNEL

SEQ ID NO: 2369423 - protein, 6 aa, Entamoeba dispar
LNKNYR

SEQ ID NO: 2369424 - protein, 7 aa, Entamoeba dispar
LNKPNSE

SEQ ID NO: 2369425 - protein, 8 aa, Entamoeba dispar
LNKPPNGK

SEQ ID NO: 2369426 - protein, 12 aa, Entamoeba dispar
LNKTQEEIIKSI

SEQ ID NO: 2369427 - protein, 6 aa, Entamoeba dispar
LNMPEG

SEQ ID NO: 2369428 - protein, 9 aa, Entamoeba dispar
LNNDSPNTL

SEQ ID NO: 2369429 - protein, 8 aa, Entamoeba dispar
LNNEKTLE

SEQ ID NO: 2369430 - protein, 4 aa, Entamoeba dispar
LNNG

SEQ ID NO: 2369431 - protein, 20 aa, Entamoeba dispar
LNNGKCSNKEKNQNGKNEEI

SEQ ID NO: 2369432 - protein, 7 aa, Entamoeba dispar
LNNKQQL

SEQ ID NO: 2369433 - protein, 5 aa, Entamoeba dispar
LNNNE

SEQ ID NO: 2369434 - protein, 5 aa, Entamoeba dispar
LNNNG

SEQ ID NO: 2369435 - protein, 6 aa, Entamoeba dispar
LNNNKG

SEQ ID NO: 2369436 - protein, 10 aa, Entamoeba dispar
LNNNYEKSEA

SEQ ID NO: 2369437 - protein, 6 aa, Entamoeba dispar
LNNPSS

SEQ ID NO: 2369438 - protein, 8 aa, Entamoeba dispar
LNNSQRSV

SEQ ID NO: 2369439 - protein, 8 aa, Entamoeba dispar
LNNTNESI

SEQ ID NO: 2369440 - protein, 7 aa, Entamoeba dispar
LNNTNKV

SEQ ID NO: 2369441 - protein, 6 aa, Entamoeba dispar
LNPAES

SEQ ID NO: 2369442 - protein, 15 aa, Entamoeba dispar
LNPDSTLSLATPKSL

SEQ ID NO: 2369443 - protein, 11 aa, Entamoeba dispar
LNPPNGMSATN

SEQ ID NO: 2369444 - protein, 7 aa, Entamoeba dispar
LNPRPIK

SEQ ID NO: 2369445 - protein, 6 aa, Entamoeba dispar
LNQGDQ

SEQ ID NO: 2369446 - protein, 19 aa, Entamoeba dispar
LNQNGEEAEFYEDQKDQIN

SEQ ID NO: 2369447 - protein, 9 aa, Entamoeba dispar
LNQNSQLKT

SEQ ID NO: 2369448 - protein, 14 aa, Entamoeba dispar
LNQNVEEYKNQNNE

SEQ ID NO: 2369449 - protein, 9 aa, Entamoeba dispar
LNQQPLTFS

SEQ ID NO: 2369450 - protein, 10 aa, Entamoeba dispar
LNQTKSTVQE

SEQ ID NO: 2369451 - protein, 15 aa, Entamoeba dispar
LNQTPPKLKKSNIDK

SEQ ID NO: 2369452 - protein, 6 aa, Entamoeba dispar
LNRNNG

SEQ ID NO: 2369453 - protein, 12 aa, Entamoeba dispar
LNRYTSVANKSI

SEQ ID NO: 2369454 - protein, 14 aa, Entamoeba dispar
LNSCGCPKQNKSEC

SEQ ID NO: 2369455 - protein, 5 aa, Entamoeba dispar
LNSEK

SEQ ID NO: 2369456 - protein, 4 aa, Entamoeba dispar
LNSI

SEQ ID NO: 2369457 - protein, 13 aa, Entamoeba dispar
LNSIGGPTDPLPI

SEQ ID NO: 2369458 - protein, 15 aa, Entamoeba dispar
LNSKNAAPAKAAYEQ

SEQ ID NO: 2369459 - protein, 7 aa, Entamoeba dispar
LNSLEED

SEQ ID NO: 2369460 - protein, 24 aa, Entamoeba dispar
LNSNTNDSLDSQKKIQFDQTKQGI

SEQ ID NO: 2369461 - protein, 8 aa, Entamoeba dispar
LNSPKENL

SEQ ID NO: 2369462 - protein, 10 aa, Entamoeba dispar
LNSPSLEEEP

SEQ ID NO: 2369463 - protein, 7 aa, Entamoeba dispar
LNSQDDL

SEQ ID NO: 2369464 - protein, 6 aa, Entamoeba dispar
LNSQRY

SEQ ID NO: 2369465 - protein, 4 aa, Entamoeba dispar
LNTE

SEQ ID NO: 2369466 - protein, 9 aa, Entamoeba dispar
LNTGEQDMT

SEQ ID NO: 2369467 - protein, 4 aa, Entamoeba dispar
LNTI

SEQ ID NO: 2369468 - protein, 6 aa, Entamoeba dispar
LNTKNK

SEQ ID NO: 2369469 - protein, 8 aa, Entamoeba dispar
LNTNTNTC

SEQ ID NO: 2369470 - protein, 7 aa, Entamoeba dispar
LNTQGDI

SEQ ID NO: 2369471 - protein, 9 aa, Entamoeba dispar
LNTRNSSPS

SEQ ID NO: 2369472 - protein, 4 aa, Entamoeba dispar
LNTS

SEQ ID NO: 2369473 - protein, 5 aa, Entamoeba dispar
LNTSG

SEQ ID NO: 2369474 - protein, 5 aa, Entamoeba dispar
LNTSK

SEQ ID NO: 2369475 - protein, 8 aa, Entamoeba dispar
LNTTKEGN

SEQ ID NO: 2369476 - protein, 13 aa, Entamoeba dispar
LPADASKCAYPAA

SEQ ID NO: 2369477 - protein, 9 aa, Entamoeba dispar
LPAGQEDTY

SEQ ID NO: 2369478 - protein, 15 aa, Entamoeba dispar
LPAIPQSSSLRKSYN

SEQ ID NO: 2369479 - protein, 5 aa, Entamoeba dispar
LPAPT

SEQ ID NO: 2369480 - protein, 4 aa, Entamoeba dispar
LPAQ

SEQ ID NO: 2369481 - protein, 12 aa, Entamoeba dispar
LPATSNKECKYA

SEQ ID NO: 2369482 - protein, 5 aa, Entamoeba dispar
LPDDY

SEQ ID NO: 2369483 - protein, 12 aa, Entamoeba dispar
LPDPNGKSSGYL

SEQ ID NO: 2369484 - protein, 4 aa, Entamoeba dispar
LPDS

SEQ ID NO: 2369485 - protein, 6 aa, Entamoeba dispar
LPDSIS

SEQ ID NO: 2369486 - protein, 5 aa, Entamoeba dispar
LPEDI

SEQ ID NO: 2369487 - protein, 21 aa, Entamoeba dispar
LPEDQVSCPSDRMARSTETKE

SEQ ID NO: 2369488 - protein, 6 aa, Entamoeba dispar
LPEEKY

SEQ ID NO: 2369489 - protein, 12 aa, Entamoeba dispar
LPENDEACGRCP

SEQ ID NO: 2369490 - protein, 10 aa, Entamoeba dispar
LPENDSSSSF

SEQ ID NO: 2369491 - protein, 15 aa, Entamoeba dispar
LPEQKDIESITTGST

SEQ ID NO: 2369492 - protein, 5 aa, Entamoeba dispar
LPGAD

SEQ ID NO: 2369493 - protein, 8 aa, Entamoeba dispar
LPGESSSY

SEQ ID NO: 2369494 - protein, 6 aa, Entamoeba dispar
LPGGTC

SEQ ID NO: 2369495 - protein, 5 aa, Entamoeba dispar
LPGTS

SEQ ID NO: 2369496 - protein, 10 aa, Entamoeba dispar
LPGYEQDNSC

SEQ ID NO: 2369497 - protein, 8 aa, Entamoeba dispar
LPHETSTR

SEQ ID NO: 2369498 - protein, 4 aa, Entamoeba dispar
LPHN

SEQ ID NO: 2369499 - protein, 14 aa, Entamoeba dispar
LPHQPKIPPTGKSL

SEQ ID NO: 2369500 - protein, 39 aa, Entamoeba dispar
LPHTGNERQPNNQNNNNNNDNNNNGDNDYVNNDYSSDIG

SEQ ID NO: 2369501 - protein, 4 aa, Entamoeba dispar
LPIE

SEQ ID NO: 2369502 - protein, 17 aa, Entamoeba dispar
LPIKSRSSISRRTTSSD

SEQ ID NO: 2369503 - protein, 8 aa, Entamoeba dispar
LPIPSSDL

SEQ ID NO: 2369504 - protein, 11 aa, Entamoeba dispar
LPIRQSKDDII

SEQ ID NO: 2369505 - protein, 21 aa, Entamoeba dispar
LPKDQREMNEITSEVNANDFE

SEQ ID NO: 2369506 - protein, 6 aa, Entamoeba dispar
LPKEIR

SEQ ID NO: 2369507 - protein, 4 aa, Entamoeba dispar
LPKL

SEQ ID NO: 2369508 - protein, 6 aa, Entamoeba dispar
LPKPSV

SEQ ID NO: 2369509 - protein, 19 aa, Entamoeba dispar
LPLDKNNNIKYPTINEERV

SEQ ID NO: 2369510 - protein, 10 aa, Entamoeba dispar
LPLDSSMPTE

SEQ ID NO: 2369511 - protein, 11 aa, Entamoeba dispar
LPNAKKAKRTI

SEQ ID NO: 2369512 - protein, 6 aa, Entamoeba dispar
LPNDEN

SEQ ID NO: 2369513 - protein, 8 aa, Entamoeba dispar
LPNEIPEN

SEQ ID NO: 2369514 - protein, 11 aa, Entamoeba dispar
LPNEKEKREAE

SEQ ID NO: 2369515 - protein, 11 aa, Entamoeba dispar
LPNKKDSLSHI

SEQ ID NO: 2369516 - protein, 4 aa, Entamoeba dispar
LPNN

SEQ ID NO: 2369517 - protein, 6 aa, Entamoeba dispar
LPNQSI

SEQ ID NO: 2369518 - protein, 11 aa, Entamoeba dispar
LPNSNKNQKNE

SEQ ID NO: 2369519 - protein, 6 aa, Entamoeba dispar
LPPAER

SEQ ID NO: 2369520 - protein, 10 aa, Entamoeba dispar
LPPEGTSRIG

SEQ ID NO: 2369521 - protein, 5 aa, Entamoeba dispar
LPPEQ

SEQ ID NO: 2369522 - protein, 5 aa, Entamoeba dispar
LPPIE

SEQ ID NO: 2369523 - protein, 7 aa, Entamoeba dispar
LPPPCPY

SEQ ID NO: 2369524 - protein, 15 aa, Entamoeba dispar
LPPTWDRFYNFENKI

SEQ ID NO: 2369525 - protein, 4 aa, Entamoeba dispar
LPPY

SEQ ID NO: 2369526 - protein, 5 aa, Entamoeba dispar
LPQEC

SEQ ID NO: 2369527 - protein, 6 aa, Entamoeba dispar
LPQPTN

SEQ ID NO: 2369528 - protein, 8 aa, Entamoeba dispar
LPQTQKEH

SEQ ID NO: 2369529 - protein, 5 aa, Entamoeba dispar
LPSDG

SEQ ID NO: 2369530 - protein, 11 aa, Entamoeba dispar
LPSDTPKKEPI

SEQ ID NO: 2369531 - protein, 8 aa, Entamoeba dispar
LPSEVQQG

SEQ ID NO: 2369532 - protein, 8 aa, Entamoeba dispar
LPSINNSR

SEQ ID NO: 2369533 - protein, 5 aa, Entamoeba dispar
LPSKN

SEQ ID NO: 2369534 - protein, 11 aa, Entamoeba dispar
LPSKQQSHITE

SEQ ID NO: 2369535 - protein, 5 aa, Entamoeba dispar
LPSNV

SEQ ID NO: 2369536 - protein, 6 aa, Entamoeba dispar
LPSPVN

SEQ ID NO: 2369537 - protein, 4 aa, Entamoeba dispar
LPSS

SEQ ID NO: 2369538 - protein, 6 aa, Entamoeba dispar
LPSSET

SEQ ID NO: 2369539 - protein, 6 aa, Entamoeba dispar
LPSSSP

SEQ ID NO: 2369540 - protein, 7 aa, Entamoeba dispar
LPSTLKQ

SEQ ID NO: 2369541 - protein, 4 aa, Entamoeba dispar
LPTE

SEQ ID NO: 2369542 - protein, 6 aa, Entamoeba dispar
LPTPIN

SEQ ID NO: 2369543 - protein, 11 aa, Entamoeba dispar
LPVETEPQNEL

SEQ ID NO: 2369544 - protein, 6 aa, Entamoeba dispar
LPYQTK

SEQ ID NO: 2369545 - protein, 6 aa, Entamoeba dispar
LQAEGV

SEQ ID NO: 2369546 - protein, 10 aa, Entamoeba dispar
LQCDSKPLTY

SEQ ID NO: 2369547 - protein, 9 aa, Entamoeba dispar
LQDGNGPKF

SEQ ID NO: 2369548 - protein, 7 aa, Entamoeba dispar
LQDNGSC

SEQ ID NO: 2369549 - protein, 4 aa, Entamoeba dispar
LQEK

SEQ ID NO: 2369550 - protein, 8 aa, Entamoeba dispar
LQEKYGTG

SEQ ID NO: 2369551 - protein, 8 aa, Entamoeba dispar
LQENKPPI

SEQ ID NO: 2369552 - protein, 10 aa, Entamoeba dispar
LQEPDVDNSD

SEQ ID NO: 2369553 - protein, 5 aa, Entamoeba dispar
LQEYN

SEQ ID NO: 2369554 - protein, 5 aa, Entamoeba dispar
LQGNE

SEQ ID NO: 2369555 - protein, 9 aa, Entamoeba dispar
LQKDGKHQK

SEQ ID NO: 2369556 - protein, 13 aa, Entamoeba dispar
LQKEDEDAEIDDD

SEQ ID NO: 2369557 - protein, 9 aa, Entamoeba dispar
LQKEKEEKE

SEQ ID NO: 2369558 - protein, 20 aa, Entamoeba dispar
LQKENEELRADKKRLEESVE

SEQ ID NO: 2369559 - protein, 18 aa, Entamoeba dispar
LQLTNASEISVDSSLQRS

SEQ ID NO: 2369560 - protein, 17 aa, Entamoeba dispar
LQNKEKMNKEKKEDKKE

SEQ ID NO: 2369561 - protein, 8 aa, Entamoeba dispar
LQNKGAVK

SEQ ID NO: 2369562 - protein, 22 aa, Entamoeba dispar
LQNPENCQERFNSSNPNSNDLG

SEQ ID NO: 2369563 - protein, 8 aa, Entamoeba dispar
LQNQNDEF

SEQ ID NO: 2369564 - protein, 10 aa, Entamoeba dispar
LQNSSSEEVR

SEQ ID NO: 2369565 - protein, 4 aa, Entamoeba dispar
LQNT

SEQ ID NO: 2369566 - protein, 6 aa, Entamoeba dispar
LQNYDA

SEQ ID NO: 2369567 - protein, 5 aa, Entamoeba dispar
LQNYE

SEQ ID NO: 2369568 - protein, 6 aa, Entamoeba dispar
LQNYET

SEQ ID NO: 2369569 - protein, 5 aa, Entamoeba dispar
LQPEN

SEQ ID NO: 2369570 - protein, 10 aa, Entamoeba dispar
LQPEPENEKI

SEQ ID NO: 2369571 - protein, 14 aa, Entamoeba dispar
LQPNSSNKKDKPKQ

SEQ ID NO: 2369572 - protein, 12 aa, Entamoeba dispar
LQPRGSDDFKPK

SEQ ID NO: 2369573 - protein, 13 aa, Entamoeba dispar
LQPTKKDVTISTI

SEQ ID NO: 2369574 - protein, 17 aa, Entamoeba dispar
LQPTQPLQHPQKKKFTR

SEQ ID NO: 2369575 - protein, 9 aa, Entamoeba dispar
LQPVGNKKQ

SEQ ID NO: 2369576 - protein, 10 aa, Entamoeba dispar
LQQQNTNQEV

SEQ ID NO: 2369577 - protein, 8 aa, Entamoeba dispar
LQQTSNDN

SEQ ID NO: 2369578 - protein, 12 aa, Entamoeba dispar
LQQYTKEYEEAI

SEQ ID NO: 2369579 - protein, 17 aa, Entamoeba dispar
LQRTRSPVTSFLSRRPA

SEQ ID NO: 2369580 - protein, 8 aa, Entamoeba dispar
LQSDGSCG

SEQ ID NO: 2369581 - protein, 4 aa, Entamoeba dispar
LQSG

SEQ ID NO: 2369582 - protein, 8 aa, Entamoeba dispar
LQSNPSTN

SEQ ID NO: 2369583 - protein, 8 aa, Entamoeba dispar
LQSPQGKN

SEQ ID NO: 2369584 - protein, 13 aa, Entamoeba dispar
LQSPQQSNTLSLA

SEQ ID NO: 2369585 - protein, 20 aa, Entamoeba dispar
LQSPRKGERSSPSLDGTKKI

SEQ ID NO: 2369586 - protein, 11 aa, Entamoeba dispar
LQSRDDPSITA

SEQ ID NO: 2369587 - protein, 4 aa, Entamoeba dispar
LQSS

SEQ ID NO: 2369588 - protein, 10 aa, Entamoeba dispar
LQSSKSNTLC

SEQ ID NO: 2369589 - protein, 9 aa, Entamoeba dispar
LQSSPSISP

SEQ ID NO: 2369590 - protein, 31 aa, Entamoeba dispar
LQTESSISSPHKDNVLNSPRSDTSTEDQQQS

SEQ ID NO: 2369591 - protein, 14 aa, Entamoeba dispar
LQTESSTKNSTHEQ

SEQ ID NO: 2369592 - protein, 6 aa, Entamoeba dispar
LQTLPD

SEQ ID NO: 2369593 - protein, 6 aa, Entamoeba dispar
LQTNPT

SEQ ID NO: 2369594 - protein, 14 aa, Entamoeba dispar
LQTRTSYDSEKERY

SEQ ID NO: 2369595 - protein, 17 aa, Entamoeba dispar
LQTRTSYDSEKERYTSK

SEQ ID NO: 2369596 - protein, 9 aa, Entamoeba dispar
LQTSNSSST

SEQ ID NO: 2369597 - protein, 8 aa, Entamoeba dispar
LQTTTRNC

SEQ ID NO: 2369598 - protein, 8 aa, Entamoeba dispar
LQTVNGEL

SEQ ID NO: 2369599 - protein, 7 aa, Entamoeba dispar
LRANNEQ

SEQ ID NO: 2369600 - protein, 6 aa, Entamoeba dispar
LRDEEI

SEQ ID NO: 2369601 - protein, 7 aa, Entamoeba dispar
LRDEIEQ

SEQ ID NO: 2369602 - protein, 8 aa, Entamoeba dispar
LRDETTNI

SEQ ID NO: 2369603 - protein, 6 aa, Entamoeba dispar
LREKAR

SEQ ID NO: 2369604 - protein, 20 aa, Entamoeba dispar
LREKGTTTLVEESEDKEVNI

SEQ ID NO: 2369605 - protein, 9 aa, Entamoeba dispar
LREPTSSIG

SEQ ID NO: 2369606 - protein, 16 aa, Entamoeba dispar
LRFGSEKAPVEINKPL

SEQ ID NO: 2369607 - protein, 4 aa, Entamoeba dispar
LRGD

SEQ ID NO: 2369608 - protein, 15 aa, Entamoeba dispar
LRGDNTSSATTLPKT

SEQ ID NO: 2369609 - protein, 4 aa, Entamoeba dispar
LRHK

SEQ ID NO: 2369610 - protein, 21 aa, Entamoeba dispar
LRIDESEMTGESVSVKKSEKN

SEQ ID NO: 2369611 - protein, 8 aa, Entamoeba dispar
LRKKQQNK

SEQ ID NO: 2369612 - protein, 9 aa, Entamoeba dispar
LRKKTKGNG

SEQ ID NO: 2369613 - protein, 9 aa, Entamoeba dispar
LRKNAKRQL

SEQ ID NO: 2369614 - protein, 7 aa, Entamoeba dispar
LRKPLSG

SEQ ID NO: 2369615 - protein, 20 aa, Entamoeba dispar
LRNKQKEDDMYAEPFIDPDN

SEQ ID NO: 2369616 - protein, 6 aa, Entamoeba dispar
LRNLSE

SEQ ID NO: 2369617 - protein, 20 aa, Entamoeba dispar
LRQNSVGDFSGKTIKISSNG

SEQ ID NO: 2369618 - protein, 13 aa, Entamoeba dispar
LRSENIRQEYDKT

SEQ ID NO: 2369619 - protein, 18 aa, Entamoeba dispar
LRSRSNKQLKGDPISTYS

SEQ ID NO: 2369620 - protein, 9 aa, Entamoeba dispar
LSASGQFKE

SEQ ID NO: 2369621 - protein, 7 aa, Entamoeba dispar
LSASPTY

SEQ ID NO: 2369622 - protein, 7 aa, Entamoeba dispar
LSASSSS

SEQ ID NO: 2369623 - protein, 10 aa, Entamoeba dispar
LSCKEKSTKG

SEQ ID NO: 2369624 - protein, 7 aa, Entamoeba dispar
LSDEESK

SEQ ID NO: 2369625 - protein, 5 aa, Entamoeba dispar
LSDEK

SEQ ID NO: 2369626 - protein, 6 aa, Entamoeba dispar
LSDLSS

SEQ ID NO: 2369627 - protein, 10 aa, Entamoeba dispar
LSDPSPKDIT

SEQ ID NO: 2369628 - protein, 6 aa, Entamoeba dispar
LSDRSL

SEQ ID NO: 2369629 - protein, 8 aa, Entamoeba dispar
LSDSQTSN

SEQ ID NO: 2369630 - protein, 6 aa, Entamoeba dispar
LSEASY

SEQ ID NO: 2369631 - protein, 4 aa, Entamoeba dispar
LSEC

SEQ ID NO: 2369632 - protein, 12 aa, Entamoeba dispar
LSEHQTHSTNTP

SEQ ID NO: 2369633 - protein, 4 aa, Entamoeba dispar
LSEI

SEQ ID NO: 2369634 - protein, 4 aa, Entamoeba dispar
LSEL

SEQ ID NO: 2369635 - protein, 6 aa, Entamoeba dispar
LSENET

SEQ ID NO: 2369636 - protein, 6 aa, Entamoeba dispar
LSESHI

SEQ ID NO: 2369637 - protein, 6 aa, Entamoeba dispar
LSFNPN

SEQ ID NO: 2369638 - protein, 6 aa, Entamoeba dispar
LSFPPY

SEQ ID NO: 2369639 - protein, 12 aa, Entamoeba dispar
LSGAESRDFNTD

SEQ ID NO: 2369640 - protein, 7 aa, Entamoeba dispar
LSGDSVE

SEQ ID NO: 2369641 - protein, 19 aa, Entamoeba dispar
LSGNAESVSIKTTKNKGKI

SEQ ID NO: 2369642 - protein, 8 aa, Entamoeba dispar
LSGPYDEN

SEQ ID NO: 2369643 - protein, 9 aa, Entamoeba dispar
LSGSKKTEM

SEQ ID NO: 2369644 - protein, 14 aa, Entamoeba dispar
LSGTDCKRKDTFEK

SEQ ID NO: 2369645 - protein, 12 aa, Entamoeba dispar
LSGYEQKRSHPS

SEQ ID NO: 2369646 - protein, 12 aa, Entamoeba dispar
LSKAEAQKNEGV

SEQ ID NO: 2369647 - protein, 13 aa, Entamoeba dispar
LSKEKEENKEINT

SEQ ID NO: 2369648 - protein, 18 aa, Entamoeba dispar
LSKEKQKRINGKRNGYND

SEQ ID NO: 2369649 - protein, 7 aa, Entamoeba dispar
LSKKNIP

SEQ ID NO: 2369650 - protein, 10 aa, Entamoeba dispar
LSKKTRNSHR

SEQ ID NO: 2369651 - protein, 6 aa, Entamoeba dispar
LSKNPI

SEQ ID NO: 2369652 - protein, 11 aa, Entamoeba dispar
LSKQSNKSVQI

SEQ ID NO: 2369653 - protein, 5 aa, Entamoeba dispar
LSKRK

SEQ ID NO: 2369654 - protein, 5 aa, Entamoeba dispar
LSKSV

SEQ ID NO: 2369655 - protein, 6 aa, Entamoeba dispar
LSKTNK

SEQ ID NO: 2369656 - protein, 4 aa, Entamoeba dispar
LSLN

SEQ ID NO: 2369657 - protein, 24 aa, Entamoeba dispar
LSLTTKAATGSLTKSPCIAETRNG

SEQ ID NO: 2369658 - protein, 4 aa, Entamoeba dispar
LSND

SEQ ID NO: 2369659 - protein, 31 aa, Entamoeba dispar
LSNEPKELTTENSFDETKQEISKNTKSYQQE

SEQ ID NO: 2369660 - protein, 7 aa, Entamoeba dispar
LSNETID

SEQ ID NO: 2369661 - protein, 5 aa, Entamoeba dispar
LSNEY

SEQ ID NO: 2369662 - protein, 6 aa, Entamoeba dispar
LSNGLG

SEQ ID NO: 2369663 - protein, 11 aa, Entamoeba dispar
LSNGPRGGTIS

SEQ ID NO: 2369664 - protein, 20 aa, Entamoeba dispar
LSNKQDVRIDSTDSNQNDKT

SEQ ID NO: 2369665 - protein, 9 aa, Entamoeba dispar
LSNKQKDKL

SEQ ID NO: 2369666 - protein, 7 aa, Entamoeba dispar
LSNNADD

SEQ ID NO: 2369667 - protein, 5 aa, Entamoeba dispar
LSNQE

SEQ ID NO: 2369668 - protein, 12 aa, Entamoeba dispar
LSNSVSPKMATS

SEQ ID NO: 2369669 - protein, 11 aa, Entamoeba dispar
LSNSYSSKMQP

SEQ ID NO: 2369670 - protein, 8 aa, Entamoeba dispar
LSPATRTT

SEQ ID NO: 2369671 - protein, 11 aa, Entamoeba dispar
LSPEGLKKGDS

SEQ ID NO: 2369672 - protein, 10 aa, Entamoeba dispar
LSPENLTKPG

SEQ ID NO: 2369673 - protein, 12 aa, Entamoeba dispar
LSPGTVQAQNEV

SEQ ID NO: 2369674 - protein, 23 aa, Entamoeba dispar
LSPIKLGTNDDKKKEEQNHSINE

SEQ ID NO: 2369675 - protein, 6 aa, Entamoeba dispar
LSPKGF

SEQ ID NO: 2369676 - protein, 6 aa, Entamoeba dispar
LSPPSC

SEQ ID NO: 2369677 - protein, 4 aa, Entamoeba dispar
LSPQ

SEQ ID NO: 2369678 - protein, 4 aa, Entamoeba dispar
LSPR

SEQ ID NO: 2369679 - protein, 4 aa, Entamoeba dispar
LSPS

SEQ ID NO: 2369680 - protein, 21 aa, Entamoeba dispar
LSPSSNIQTVSKYDDKNPFTQ

SEQ ID NO: 2369681 - protein, 15 aa, Entamoeba dispar
LSPSTETKSTCKNEF

SEQ ID NO: 2369682 - protein, 7 aa, Entamoeba dispar
LSPSTNI

SEQ ID NO: 2369683 - protein, 6 aa, Entamoeba dispar
LSPTGR

SEQ ID NO: 2369684 - protein, 7 aa, Entamoeba dispar
LSPTGRY

SEQ ID NO: 2369685 - protein, 13 aa, Entamoeba dispar
LSPTNSPQGHDNL

SEQ ID NO: 2369686 - protein, 5 aa, Entamoeba dispar
LSPTP

SEQ ID NO: 2369687 - protein, 4 aa, Entamoeba dispar
LSPV

SEQ ID NO: 2369688 - protein, 9 aa, Entamoeba dispar
LSQETWSQT

SEQ ID NO: 2369689 - protein, 6 aa, Entamoeba dispar
LSQIST

SEQ ID NO: 2369690 - protein, 10 aa, Entamoeba dispar
LSQKSRRPTY

SEQ ID NO: 2369691 - protein, 13 aa, Entamoeba dispar
LSQQQPLNENINE

SEQ ID NO: 2369692 - protein, 5 aa, Entamoeba dispar
LSRFT

SEQ ID NO: 2369693 - protein, 12 aa, Entamoeba dispar
LSRKSSKTDSIE

SEQ ID NO: 2369694 - protein, 14 aa, Entamoeba dispar
LSRNKKDQLSREGR

SEQ ID NO: 2369695 - protein, 7 aa, Entamoeba dispar
LSRPNPV

SEQ ID NO: 2369696 - protein, 6 aa, Entamoeba dispar
LSRRGN

SEQ ID NO: 2369697 - protein, 5 aa, Entamoeba dispar
LSRRR

SEQ ID NO: 2369698 - protein, 14 aa, Entamoeba dispar
LSRSQTSLLLSSPK

SEQ ID NO: 2369699 - protein, 8 aa, Entamoeba dispar
LSRTNTYS

SEQ ID NO: 2369700 - protein, 8 aa, Entamoeba dispar
LSSASYKN

SEQ ID NO: 2369701 - protein, 7 aa, Entamoeba dispar
LSSEEKK

SEQ ID NO: 2369702 - protein, 10 aa, Entamoeba dispar
LSSGESMSSQ

SEQ ID NO: 2369703 - protein, 7 aa, Entamoeba dispar
LSSGQRL

SEQ ID NO: 2369704 - protein, 4 aa, Entamoeba dispar
LSSK

SEQ ID NO: 2369705 - protein, 15 aa, Entamoeba dispar
LSSKDCNKCSKGETN

SEQ ID NO: 2369706 - protein, 8 aa, Entamoeba dispar
LSSKDSNF

SEQ ID NO: 2369707 - protein, 26 aa, Entamoeba dispar
LSSKKSENNEENGEVLSGDGCNTKIR

SEQ ID NO: 2369708 - protein, 34 aa, Entamoeba dispar
LSSKKSENNEENGEVLSGDSYNTKTREEGKELGR

SEQ ID NO: 2369709 - protein, 9 aa, Entamoeba dispar
LSSKPVDSD

SEQ ID NO: 2369710 - protein, 8 aa, Entamoeba dispar
LSSKRVKG

SEQ ID NO: 2369711 - protein, 12 aa, Entamoeba dispar
LSSKSSEDDNRI

SEQ ID NO: 2369712 - protein, 12 aa, Entamoeba dispar
LSSKTSEDDNRI

SEQ ID NO: 2369713 - protein, 4 aa, Entamoeba dispar
LSSL

SEQ ID NO: 2369714 - protein, 11 aa, Entamoeba dispar
LSSPAPKKVSY

SEQ ID NO: 2369715 - protein, 5 aa, Entamoeba dispar
LSSQH

SEQ ID NO: 2369716 - protein, 16 aa, Entamoeba dispar
LSSRKDDTNSIRKRRT

SEQ ID NO: 2369717 - protein, 8 aa, Entamoeba dispar
LSSSNDDG

SEQ ID NO: 2369718 - protein, 7 aa, Entamoeba dispar
LSSSSNA

SEQ ID NO: 2369719 - protein, 10 aa, Entamoeba dispar
LSSTDAKEQV

SEQ ID NO: 2369720 - protein, 5 aa, Entamoeba dispar
LSSTG

SEQ ID NO: 2369721 - protein, 6 aa, Entamoeba dispar
LSSTKG

SEQ ID NO: 2369722 - protein, 15 aa, Entamoeba dispar
LSSTKSPLQTDLNPD

SEQ ID NO: 2369723 - protein, 8 aa, Entamoeba dispar
LSSTSCDE

SEQ ID NO: 2369724 - protein, 7 aa, Entamoeba dispar
LSSTSCK

SEQ ID NO: 2369725 - protein, 12 aa, Entamoeba dispar
LSSYGKTHLENS

SEQ ID NO: 2369726 - protein, 11 aa, Entamoeba dispar
LSTFSQSKSKT

SEQ ID NO: 2369727 - protein, 9 aa, Entamoeba dispar
LSTGPKGGN

SEQ ID NO: 2369728 - protein, 9 aa, Entamoeba dispar
LSTKENRTQ

SEQ ID NO: 2369729 - protein, 8 aa, Entamoeba dispar
LSTKTSSL

SEQ ID NO: 2369730 - protein, 14 aa, Entamoeba dispar
LSTNDDSVKGCGSA

SEQ ID NO: 2369731 - protein, 14 aa, Entamoeba dispar
LSTPTKNGQIDTDK

SEQ ID NO: 2369732 - protein, 11 aa, Entamoeba dispar
LSTQPNSGFKI

SEQ ID NO: 2369733 - protein, 4 aa, Entamoeba dispar
LSTR

SEQ ID NO: 2369734 - protein, 11 aa, Entamoeba dispar
LSTSDLEVKKE

SEQ ID NO: 2369735 - protein, 8 aa, Entamoeba dispar
LSTSSGSI

SEQ ID NO: 2369736 - protein, 6 aa, Entamoeba dispar
LSVESS

SEQ ID NO: 2369737 - protein, 9 aa, Entamoeba dispar
LSVNSVQTD

SEQ ID NO: 2369738 - protein, 4 aa, Entamoeba dispar
LSYD

SEQ ID NO: 2369739 - protein, 11 aa, Entamoeba dispar
LSYDGNDDKHF

SEQ ID NO: 2369740 - protein, 11 aa, Entamoeba dispar
LSYKCPGNTQC

SEQ ID NO: 2369741 - protein, 14 aa, Entamoeba dispar
LSYRDSTSSTTVSL

SEQ ID NO: 2369742 - protein, 12 aa, Entamoeba dispar
LSYSGNGSKPFN

SEQ ID NO: 2369743 - protein, 12 aa, Entamoeba dispar
LSYSGSGSKPFD

SEQ ID NO: 2369744 - protein, 4 aa, Entamoeba dispar
LTAG

SEQ ID NO: 2369745 - protein, 13 aa, Entamoeba dispar
LTCPADATYRTYT

SEQ ID NO: 2369746 - protein, 6 aa, Entamoeba dispar
LTDEEI

SEQ ID NO: 2369747 - protein, 6 aa, Entamoeba dispar
LTDEEV

SEQ ID NO: 2369748 - protein, 8 aa, Entamoeba dispar
LTDEQANS

SEQ ID NO: 2369749 - protein, 10 aa, Entamoeba dispar
LTDKGEIKIK

SEQ ID NO: 2369750 - protein, 5 aa, Entamoeba dispar
LTDKS

SEQ ID NO: 2369751 - protein, 11 aa, Entamoeba dispar
LTDNDSKDISA

SEQ ID NO: 2369752 - protein, 9 aa, Entamoeba dispar
LTDNKNTIP

SEQ ID NO: 2369753 - protein, 10 aa, Entamoeba dispar
LTDPKKHGEM

SEQ ID NO: 2369754 - protein, 7 aa, Entamoeba dispar
LTDRPDL

SEQ ID NO: 2369755 - protein, 10 aa, Entamoeba dispar
LTDSPNVQTE

SEQ ID NO: 2369756 - protein, 10 aa, Entamoeba dispar
LTEEHEEEEG

SEQ ID NO: 2369757 - protein, 5 aa, Entamoeba dispar
LTEGQ

SEQ ID NO: 2369758 - protein, 8 aa, Entamoeba dispar
LTEGRQNR

SEQ ID NO: 2369759 - protein, 7 aa, Entamoeba dispar
LTEGSSL

SEQ ID NO: 2369760 - protein, 6 aa, Entamoeba dispar
LTEGTQ

SEQ ID NO: 2369761 - protein, 4 aa, Entamoeba dispar
LTEI

SEQ ID NO: 2369762 - protein, 39 aa, Entamoeba dispar
LTEINEGSTEDKSGDKNEDKSGDKNEDKSHNKNEKLDNL

SEQ ID NO: 2369763 - protein, 4 aa, Entamoeba dispar
LTEK

SEQ ID NO: 2369764 - protein, 6 aa, Entamoeba dispar
LTELAK

SEQ ID NO: 2369765 - protein, 12 aa, Entamoeba dispar
LTEPSKSSRYSI

SEQ ID NO: 2369766 - protein, 11 aa, Entamoeba dispar
LTEQKTNRHSK

SEQ ID NO: 2369767 - protein, 8 aa, Entamoeba dispar
LTERKTTH

SEQ ID NO: 2369768 - protein, 18 aa, Entamoeba dispar
LTEYGKSRTIYQEGSVEA

SEQ ID NO: 2369769 - protein, 5 aa, Entamoeba dispar
LTFEN

SEQ ID NO: 2369770 - protein, 10 aa, Entamoeba dispar
LTGESTPHMR

SEQ ID NO: 2369771 - protein, 18 aa, Entamoeba dispar
LTGETDELGENAKSKANQ

SEQ ID NO: 2369772 - protein, 9 aa, Entamoeba dispar
LTGKTKEQF

SEQ ID NO: 2369773 - protein, 5 aa, Entamoeba dispar
LTGQT

SEQ ID NO: 2369774 - protein, 4 aa, Entamoeba dispar
LTGT

SEQ ID NO: 2369775 - protein, 14 aa, Entamoeba dispar
LTHKKEKVGGLKPS

SEQ ID NO: 2369776 - protein, 11 aa, Entamoeba dispar
LTHPKKDVSYD

SEQ ID NO: 2369777 - protein, 12 aa, Entamoeba dispar
LTHSQKNYIKSS

SEQ ID NO: 2369778 - protein, 6 aa, Entamoeba dispar
LTHYKS

SEQ ID NO: 2369779 - protein, 10 aa, Entamoeba dispar
LTIDSTKQSL

SEQ ID NO: 2369780 - protein, 5 aa, Entamoeba dispar
LTIEN

SEQ ID NO: 2369781 - protein, 11 aa, Entamoeba dispar
LTIPKGKNMTF

SEQ ID NO: 2369782 - protein, 5 aa, Entamoeba dispar
LTIRN

SEQ ID NO: 2369783 - protein, 4 aa, Entamoeba dispar
LTIS

SEQ ID NO: 2369784 - protein, 10 aa, Entamoeba dispar
LTKDGSYEEW

SEQ ID NO: 2369785 - protein, 7 aa, Entamoeba dispar
LTKNNNR

SEQ ID NO: 2369786 - protein, 9 aa, Entamoeba dispar
LTKNYYPGK

SEQ ID NO: 2369787 - protein, 4 aa, Entamoeba dispar
LTKR

SEQ ID NO: 2369788 - protein, 20 aa, Entamoeba dispar
LTKSEITTTNSIETTTDSTE

SEQ ID NO: 2369789 - protein, 10 aa, Entamoeba dispar
LTKSKSNDKI

SEQ ID NO: 2369790 - protein, 11 aa, Entamoeba dispar
LTLKDDNKTTI

SEQ ID NO: 2369791 - protein, 32 aa, Entamoeba dispar
LTNEPEKIPSPTPIETSEANAADDLTASLLDS

SEQ ID NO: 2369792 - protein, 7 aa, Entamoeba dispar
LTNEQTS

SEQ ID NO: 2369793 - protein, 10 aa, Entamoeba dispar
LTNGDIAEQQ

SEQ ID NO: 2369794 - protein, 13 aa, Entamoeba dispar
LTNPKTNPDKTGR

SEQ ID NO: 2369795 - protein, 11 aa, Entamoeba dispar
LTNPPPPPPLM

SEQ ID NO: 2369796 - protein, 10 aa, Entamoeba dispar
LTNSNEELKD

SEQ ID NO: 2369797 - protein, 17 aa, Entamoeba dispar
LTNSPHPMSPRKRTLNR

SEQ ID NO: 2369798 - protein, 15 aa, Entamoeba dispar
LTPERADRSGLNAEF

SEQ ID NO: 2369799 - protein, 9 aa, Entamoeba dispar
LTPKITTEY

SEQ ID NO: 2369800 - protein, 6 aa, Entamoeba dispar
LTPPPL

SEQ ID NO: 2369801 - protein, 7 aa, Entamoeba dispar
LTPQQLS

SEQ ID NO: 2369802 - protein, 5 aa, Entamoeba dispar
LTPQT

SEQ ID NO: 2369803 - protein, 17 aa, Entamoeba dispar
LTPRKEENKEIKEIKDK

SEQ ID NO: 2369804 - protein, 5 aa, Entamoeba dispar
LTPSG

SEQ ID NO: 2369805 - protein, 10 aa, Entamoeba dispar
LTPSNPTWQQ

SEQ ID NO: 2369806 - protein, 7 aa, Entamoeba dispar
LTPSSTE

SEQ ID NO: 2369807 - protein, 10 aa, Entamoeba dispar
LTQEQKEMVE

SEQ ID NO: 2369808 - protein, 6 aa, Entamoeba dispar
LTQQQP

SEQ ID NO: 2369809 - protein, 6 aa, Entamoeba dispar
LTQRGK

SEQ ID NO: 2369810 - protein, 14 aa, Entamoeba dispar
LTQTEEDKKKFEKA

SEQ ID NO: 2369811 - protein, 8 aa, Entamoeba dispar
LTQTTPES

SEQ ID NO: 2369812 - protein, 11 aa, Entamoeba dispar
LTRDDNEIEVS

SEQ ID NO: 2369813 - protein, 5 aa, Entamoeba dispar
LTREN

SEQ ID NO: 2369814 - protein, 7 aa, Entamoeba dispar
LTRGSSS

SEQ ID NO: 2369815 - protein, 9 aa, Entamoeba dispar
LTSAKGTLS

SEQ ID NO: 2369816 - protein, 16 aa, Entamoeba dispar
LTSGGSTLATKYNDGS

SEQ ID NO: 2369817 - protein, 11 aa, Entamoeba dispar
LTSITSSSSMS

SEQ ID NO: 2369818 - protein, 9 aa, Entamoeba dispar
LTSKQPTSA

SEQ ID NO: 2369819 - protein, 5 aa, Entamoeba dispar
LTSKS

SEQ ID NO: 2369820 - protein, 7 aa, Entamoeba dispar
LTSLTQK

SEQ ID NO: 2369821 - protein, 6 aa, Entamoeba dispar
LTSNDV

SEQ ID NO: 2369822 - protein, 6 aa, Entamoeba dispar
LTSPID

SEQ ID NO: 2369823 - protein, 8 aa, Entamoeba dispar
LTSPSITI

SEQ ID NO: 2369824 - protein, 14 aa, Entamoeba dispar
LTSSSSKLKTDNNS

SEQ ID NO: 2369825 - protein, 8 aa, Entamoeba dispar
LTTEESIR

SEQ ID NO: 2369826 - protein, 9 aa, Entamoeba dispar
LTTKEENDR

SEQ ID NO: 2369827 - protein, 6 aa, Entamoeba dispar
LTTKKS

SEQ ID NO: 2369828 - protein, 7 aa, Entamoeba dispar
LTTKPST

SEQ ID NO: 2369829 - protein, 10 aa, Entamoeba dispar
LTTKSKEFFS

SEQ ID NO: 2369830 - protein, 6 aa, Entamoeba dispar
LTTNGV

SEQ ID NO: 2369831 - protein, 10 aa, Entamoeba dispar
LTTNTRSSGY

SEQ ID NO: 2369832 - protein, 9 aa, Entamoeba dispar
LTTQPDPNF

SEQ ID NO: 2369833 - protein, 6 aa, Entamoeba dispar
LTTQSM

SEQ ID NO: 2369834 - protein, 10 aa, Entamoeba dispar
LTTRLDPDEL

SEQ ID NO: 2369835 - protein, 26 aa, Entamoeba dispar
LTTSLSSQRFNNSSSIQLSSTPSTTI

SEQ ID NO: 2369836 - protein, 7 aa, Entamoeba dispar
LTTTADQ

SEQ ID NO: 2369837 - protein, 8 aa, Entamoeba dispar
LTTTNSFQ

SEQ ID NO: 2369838 - protein, 13 aa, Entamoeba dispar
LTYNSKGKKNTVV

SEQ ID NO: 2369839 - protein, 11 aa, Entamoeba dispar
LTYNTERGNGF

SEQ ID NO: 2369840 - protein, 8 aa, Entamoeba dispar
LVESSQQT

SEQ ID NO: 2369841 - protein, 5 aa, Entamoeba dispar
LVKQP

SEQ ID NO: 2369842 - protein, 10 aa, Entamoeba dispar
LVPSDKNKPI

SEQ ID NO: 2369843 - protein, 6 aa, Entamoeba dispar
LVTESE

SEQ ID NO: 2369844 - protein, 16 aa, Entamoeba dispar
LVTKQSNKKNDSPLTT

SEQ ID NO: 2369845 - protein, 4 aa, Entamoeba dispar
LWPA

SEQ ID NO: 2369846 - protein, 10 aa, Entamoeba dispar
LYDPTDNSCS

SEQ ID NO: 2369847 - protein, 14 aa, Entamoeba dispar
LYKPKEKNKSITKY

SEQ ID NO: 2369848 - protein, 6 aa, Entamoeba dispar
LYKQQQ

SEQ ID NO: 2369849 - protein, 4 aa, Entamoeba dispar
LYNK

SEQ ID NO: 2369850 - protein, 14 aa, Entamoeba dispar
LYSETKQNTCQKEQ

SEQ ID NO: 2369851 - protein, 12 aa, Entamoeba dispar
LYSQSNQKEESV

SEQ ID NO: 2369852 - protein, 10 aa, Entamoeba dispar
LYTPTNDGAE

SEQ ID NO: 2369853 - protein, 63 aa, Entamoeba dispar
MAENQEDDSDNTNKTEEKKEDDNDSTNKTEEKKEEDNNDVPSPQESEEEELNSESVKSEEEND

SEQ ID NO: 2369854 - protein, 9 aa, Entamoeba dispar
MAKTQDSYY

SEQ ID NO: 2369855 - protein, 16 aa, Entamoeba dispar
MDDDGEPTPTSTAKAQ

SEQ ID NO: 2369856 - protein, 5 aa, Entamoeba dispar
MDEED

SEQ ID NO: 2369857 - protein, 11 aa, Entamoeba dispar
MDGESNDEDLS

SEQ ID NO: 2369858 - protein, 9 aa, Entamoeba dispar
MDGTNYPTN

SEQ ID NO: 2369859 - protein, 8 aa, Entamoeba dispar
MDKDNNYI

SEQ ID NO: 2369860 - protein, 7 aa, Entamoeba dispar
MDKESTL

SEQ ID NO: 2369861 - protein, 7 aa, Entamoeba dispar
MDQNNKD

SEQ ID NO: 2369862 - protein, 8 aa, Entamoeba dispar
MDQYEQQQ

SEQ ID NO: 2369863 - protein, 22 aa, Entamoeba dispar
MDRERSGMGDVNSSGRPTVNGL

SEQ ID NO: 2369864 - protein, 4 aa, Entamoeba dispar
MDTT

SEQ ID NO: 2369865 - protein, 6 aa, Entamoeba dispar
MEEKEF

SEQ ID NO: 2369866 - protein, 5 aa, Entamoeba dispar
MEETP

SEQ ID NO: 2369867 - protein, 8 aa, Entamoeba dispar
MEKDTNAT

SEQ ID NO: 2369868 - protein, 12 aa, Entamoeba dispar
MEKKRKHTLDSR

SEQ ID NO: 2369869 - protein, 8 aa, Entamoeba dispar
MEKSKNVT

SEQ ID NO: 2369870 - protein, 10 aa, Entamoeba dispar
MEKTSKSVTY

SEQ ID NO: 2369871 - protein, 19 aa, Entamoeba dispar
MENDGLNNLQEKDKKDSGI

SEQ ID NO: 2369872 - protein, 18 aa, Entamoeba dispar
MENDGTCTTCGDSIETNS

SEQ ID NO: 2369873 - protein, 14 aa, Entamoeba dispar
MENESKIKKSTFGS

SEQ ID NO: 2369874 - protein, 10 aa, Entamoeba dispar
MENKSTNSKY

SEQ ID NO: 2369875 - protein, 21 aa, Entamoeba dispar
MENSEDPLKPYGKDLTTEDTA

SEQ ID NO: 2369876 - protein, 5 aa, Entamoeba dispar
MEPDE

SEQ ID NO: 2369877 - protein, 31 aa, Entamoeba dispar
MESTSDHSISVSGDSSSEITINGNGKTETIT

SEQ ID NO: 2369878 - protein, 4 aa, Entamoeba dispar
META

SEQ ID NO: 2369879 - protein, 5 aa, Entamoeba dispar
MFPST

SEQ ID NO: 2369880 - protein, 33 aa, Entamoeba dispar
MGASPEPKKDKSSKSKEKFSQSVEEKEKQEYNQ

SEQ ID NO: 2369881 - protein, 10 aa, Entamoeba dispar
MGDDEEAMEE

SEQ ID NO: 2369882 - protein, 10 aa, Entamoeba dispar
MGGEKDYING

SEQ ID NO: 2369883 - protein, 4 aa, Entamoeba dispar
MGGT

SEQ ID NO: 2369884 - protein, 6 aa, Entamoeba dispar
MGINKS

SEQ ID NO: 2369885 - protein, 6 aa, Entamoeba dispar
MGKDVQ

SEQ ID NO: 2369886 - protein, 9 aa, Entamoeba dispar
MGKTDMETV

SEQ ID NO: 2369887 - protein, 5 aa, Entamoeba dispar
MGNTQ

SEQ ID NO: 2369888 - protein, 10 aa, Entamoeba dispar
MGSAKDPISR

SEQ ID NO: 2369889 - protein, 5 aa, Entamoeba dispar
MGSGG

SEQ ID NO: 2369890 - protein, 5 aa, Entamoeba dispar
MGSPL

SEQ ID NO: 2369891 - protein, 12 aa, Entamoeba dispar
MGTGLYDPETCE

SEQ ID NO: 2369892 - protein, 4 aa, Entamoeba dispar
MGTV

SEQ ID NO: 2369893 - protein, 12 aa, Entamoeba dispar
MGYTTDKEIPQG

SEQ ID NO: 2369894 - protein, 20 aa, Entamoeba dispar
MIEKETGMTNQQLKKEFKLL

SEQ ID NO: 2369895 - protein, 5 aa, Entamoeba dispar
MIGTT

SEQ ID NO: 2369896 - protein, 14 aa, Entamoeba dispar
MKATTRAIRENDPN

SEQ ID NO: 2369897 - protein, 10 aa, Entamoeba dispar
MKDDYKTKRY

SEQ ID NO: 2369898 - protein, 4 aa, Entamoeba dispar
MKEE

SEQ ID NO: 2369899 - protein, 5 aa, Entamoeba dispar
MKENE

SEQ ID NO: 2369900 - protein, 14 aa, Entamoeba dispar
MKENKETGSIKENE

SEQ ID NO: 2369901 - protein, 7 aa, Entamoeba dispar
MKERGNG

SEQ ID NO: 2369902 - protein, 7 aa, Entamoeba dispar
MKESPKQ

SEQ ID NO: 2369903 - protein, 6 aa, Entamoeba dispar
MKESSQ

SEQ ID NO: 2369904 - protein, 8 aa, Entamoeba dispar
MKGNPLDE

SEQ ID NO: 2369905 - protein, 16 aa, Entamoeba dispar
MKKDIKANTRSKIKEM

SEQ ID NO: 2369906 - protein, 8 aa, Entamoeba dispar
MKKEQREM

SEQ ID NO: 2369907 - protein, 12 aa, Entamoeba dispar
MKKQQDSLQKKF

SEQ ID NO: 2369908 - protein, 7 aa, Entamoeba dispar
MKKSNPS

SEQ ID NO: 2369909 - protein, 8 aa, Entamoeba dispar
MKKTPGQY

SEQ ID NO: 2369910 - protein, 7 aa, Entamoeba dispar
MKKTTLE

SEQ ID NO: 2369911 - protein, 12 aa, Entamoeba dispar
MKNDQARKRVST

SEQ ID NO: 2369912 - protein, 10 aa, Entamoeba dispar
MKNETTPEIT

SEQ ID NO: 2369913 - protein, 9 aa, Entamoeba dispar
MKPENFESN

SEQ ID NO: 2369914 - protein, 8 aa, Entamoeba dispar
MKPTTHTV

SEQ ID NO: 2369915 - protein, 10 aa, Entamoeba dispar
MKRESKSFEA

SEQ ID NO: 2369916 - protein, 6 aa, Entamoeba dispar
MKRGEV

SEQ ID NO: 2369917 - protein, 6 aa, Entamoeba dispar
MKRNNW

SEQ ID NO: 2369918 - protein, 7 aa, Entamoeba dispar
MKSDGTL

SEQ ID NO: 2369919 - protein, 4 aa, Entamoeba dispar
MKTA

SEQ ID NO: 2369920 - protein, 8 aa, Entamoeba dispar
MKTESNNC

SEQ ID NO: 2369921 - protein, 7 aa, Entamoeba dispar
MKTGIPP

SEQ ID NO: 2369922 - protein, 4 aa, Entamoeba dispar
MKTV

SEQ ID NO: 2369923 - protein, 13 aa, Entamoeba dispar
MNAQKKSVIGNNR

SEQ ID NO: 2369924 - protein, 4 aa, Entamoeba dispar
MNDK

SEQ ID NO: 2369925 - protein, 17 aa, Entamoeba dispar
MNEKTIPENCKKNSQSK

SEQ ID NO: 2369926 - protein, 5 aa, Entamoeba dispar
MNESK

SEQ ID NO: 2369927 - protein, 4 aa, Entamoeba dispar
MNGN

SEQ ID NO: 2369928 - protein, 20 aa, Entamoeba dispar
MNGNEKQETGSDEDPIGTPN

SEQ ID NO: 2369929 - protein, 7 aa, Entamoeba dispar
MNGRQAA

SEQ ID NO: 2369930 - protein, 7 aa, Entamoeba dispar
MNNENIN

SEQ ID NO: 2369931 - protein, 8 aa, Entamoeba dispar
MNNIPRDQ

SEQ ID NO: 2369932 - protein, 8 aa, Entamoeba dispar
MNNKSGIL

SEQ ID NO: 2369933 - protein, 7 aa, Entamoeba dispar
MNNPSNI

SEQ ID NO: 2369934 - protein, 7 aa, Entamoeba dispar
MNPIPTK

SEQ ID NO: 2369935 - protein, 7 aa, Entamoeba dispar
MNQETTI

SEQ ID NO: 2369936 - protein, 6 aa, Entamoeba dispar
MNSDEY

SEQ ID NO: 2369937 - protein, 6 aa, Entamoeba dispar
MNYDEN

SEQ ID NO: 2369938 - protein, 7 aa, Entamoeba dispar
MPAPKQV

SEQ ID NO: 2369939 - protein, 22 aa, Entamoeba dispar
MPFSSDYSAPGSPVANFSRKEE

SEQ ID NO: 2369940 - protein, 4 aa, Entamoeba dispar
MPKA

SEQ ID NO: 2369941 - protein, 11 aa, Entamoeba dispar
MPNTPSAEDSS

SEQ ID NO: 2369942 - protein, 8 aa, Entamoeba dispar
MPSENDYS

SEQ ID NO: 2369943 - protein, 4 aa, Entamoeba dispar
MPTA

SEQ ID NO: 2369944 - protein, 17 aa, Entamoeba dispar
MPTERDKDGSMIQKGKS

SEQ ID NO: 2369945 - protein, 14 aa, Entamoeba dispar
MPTGMTDERPNHSR

SEQ ID NO: 2369946 - protein, 13 aa, Entamoeba dispar
MQARRTKSSSALG

SEQ ID NO: 2369947 - protein, 6 aa, Entamoeba dispar
MQEKYK

SEQ ID NO: 2369948 - protein, 4 aa, Entamoeba dispar
MQGQ

SEQ ID NO: 2369949 - protein, 24 aa, Entamoeba dispar
MQKDNKQGIPKKKNIQKQVKTAPL

SEQ ID NO: 2369950 - protein, 7 aa, Entamoeba dispar
MQNTNTG

SEQ ID NO: 2369951 - protein, 9 aa, Entamoeba dispar
MQPEKESSS

SEQ ID NO: 2369952 - protein, 30 aa, Entamoeba dispar
MQQQNQQKIQRSTTDNINSSTNQLKQTSTT

SEQ ID NO: 2369953 - protein, 8 aa, Entamoeba dispar
MQQRDSTN

SEQ ID NO: 2369954 - protein, 12 aa, Entamoeba dispar
MREHNAKGSSYR

SEQ ID NO: 2369955 - protein, 5 aa, Entamoeba dispar
MRESN

SEQ ID NO: 2369956 - protein, 4 aa, Entamoeba dispar
MRGG

SEQ ID NO: 2369957 - protein, 18 aa, Entamoeba dispar
MRQENNDIPYLPSENDGY

SEQ ID NO: 2369958 - protein, 7 aa, Entamoeba dispar
MRQSNDY

SEQ ID NO: 2369959 - protein, 6 aa, Entamoeba dispar
MRQTAN

SEQ ID NO: 2369960 - protein, 7 aa, Entamoeba dispar
MRSSKRV

SEQ ID NO: 2369961 - protein, 6 aa, Entamoeba dispar
MSDDSE

SEQ ID NO: 2369962 - protein, 6 aa, Entamoeba dispar
MSEPSN

SEQ ID NO: 2369963 - protein, 6 aa, Entamoeba dispar
MSEPSR

SEQ ID NO: 2369964 - protein, 6 aa, Entamoeba dispar
MSGQPS

SEQ ID NO: 2369965 - protein, 4 aa, Entamoeba dispar
MSGT

SEQ ID NO: 2369966 - protein, 5 aa, Entamoeba dispar
MSKAA

SEQ ID NO: 2369967 - protein, 16 aa, Entamoeba dispar
MSKDQINHQNKKGETA

SEQ ID NO: 2369968 - protein, 17 aa, Entamoeba dispar
MSKESDFIGEKESLKAL

SEQ ID NO: 2369969 - protein, 9 aa, Entamoeba dispar
MSKPRKPTE

SEQ ID NO: 2369970 - protein, 5 aa, Entamoeba dispar
MSLTD

SEQ ID NO: 2369971 - protein, 6 aa, Entamoeba dispar
MSNKTT

SEQ ID NO: 2369972 - protein, 12 aa, Entamoeba dispar
MSNQKLTSSPFE

SEQ ID NO: 2369973 - protein, 9 aa, Entamoeba dispar
MSPQASQLY

SEQ ID NO: 2369974 - protein, 10 aa, Entamoeba dispar
MSQTTSNQLG

SEQ ID NO: 2369975 - protein, 6 aa, Entamoeba dispar
MSREEK

SEQ ID NO: 2369976 - protein, 28 aa, Entamoeba dispar
MSRSSADAGRSSMDTVRTSTSLDGSDIY

SEQ ID NO: 2369977 - protein, 4 aa, Entamoeba dispar
MSSE

SEQ ID NO: 2369978 - protein, 6 aa, Entamoeba dispar
MSSGYG

SEQ ID NO: 2369979 - protein, 8 aa, Entamoeba dispar
MSSKAGKN

SEQ ID NO: 2369980 - protein, 6 aa, Entamoeba dispar
MSTKDA

SEQ ID NO: 2369981 - protein, 4 aa, Entamoeba dispar
MSTR

SEQ ID NO: 2369982 - protein, 7 aa, Entamoeba dispar
MTDDEIK

SEQ ID NO: 2369983 - protein, 16 aa, Entamoeba dispar
MTDKIAKEENENAREL

SEQ ID NO: 2369984 - protein, 4 aa, Entamoeba dispar
MTED

SEQ ID NO: 2369985 - protein, 12 aa, Entamoeba dispar
MTEEEKQRLKKK

SEQ ID NO: 2369986 - protein, 6 aa, Entamoeba dispar
MTEGKD

SEQ ID NO: 2369987 - protein, 6 aa, Entamoeba dispar
MTENNF

SEQ ID NO: 2369988 - protein, 5 aa, Entamoeba dispar
MTGEC

SEQ ID NO: 2369989 - protein, 5 aa, Entamoeba dispar
MTGKH

SEQ ID NO: 2369990 - protein, 5 aa, Entamoeba dispar
MTNDE

SEQ ID NO: 2369991 - protein, 27 aa, Entamoeba dispar
MTPDERRKYEEKQRNKLVKRKQVKVRM

SEQ ID NO: 2369992 - protein, 5 aa, Entamoeba dispar
MTPEE

SEQ ID NO: 2369993 - protein, 4 aa, Entamoeba dispar
MTRR

SEQ ID NO: 2369994 - protein, 22 aa, Entamoeba dispar
MTSEFSEETLSTTDARESKTRT

SEQ ID NO: 2369995 - protein, 13 aa, Entamoeba dispar
MTSRSDKTNFDSV

SEQ ID NO: 2369996 - protein, 14 aa, Entamoeba dispar
MTSSKYSSIPGYGP

SEQ ID NO: 2369997 - protein, 5 aa, Entamoeba dispar
MTSSR

SEQ ID NO: 2369998 - protein, 12 aa, Entamoeba dispar
MTSSRGDKCRPC

SEQ ID NO: 2369999 - protein, 7 aa, Entamoeba dispar
MTSTQST

SEQ ID NO: 2370000 - protein, 90 aa, Entamoeba dispar
MYPPPQQQGMYPPPQQQGMYPPPQQQGMYPPPQQQGMYPPPQQQGMYPPPQQGMYPPPAQPVYQASPEEKKKKKSSSSSSSNDDKERHQF

SEQ ID NO: 2370001 - protein, 9 aa, Entamoeba dispar
MYQKSSKLI

SEQ ID NO: 2370002 - protein, 7 aa, Entamoeba dispar
NAADEQL

SEQ ID NO: 2370003 - protein, 6 aa, Entamoeba dispar
NAAEHY

SEQ ID NO: 2370004 - protein, 23 aa, Entamoeba dispar
NAATENSLLNPTNPYAATKAGAE

SEQ ID NO: 2370005 - protein, 23 aa, Entamoeba dispar
NAATENSLLNPTNPYSATKAGAE

SEQ ID NO: 2370006 - protein, 8 aa, Entamoeba dispar
NACDRNQH

SEQ ID NO: 2370007 - protein, 13 aa, Entamoeba dispar
NACYESNTTKTQS

SEQ ID NO: 2370008 - protein, 14 aa, Entamoeba dispar
NADGIRKRKPYDLP

SEQ ID NO: 2370009 - protein, 13 aa, Entamoeba dispar
NADRELKQTQYSD

SEQ ID NO: 2370010 - protein, 6 aa, Entamoeba dispar
NADSGE

SEQ ID NO: 2370011 - protein, 7 aa, Entamoeba dispar
NADTNIK

SEQ ID NO: 2370012 - protein, 13 aa, Entamoeba dispar
NADTTLVDSNGQN

SEQ ID NO: 2370013 - protein, 11 aa, Entamoeba dispar
NAEGKRTTPSC

SEQ ID NO: 2370014 - protein, 5 aa, Entamoeba dispar
NAENA

SEQ ID NO: 2370015 - protein, 10 aa, Entamoeba dispar
NAENEERLAG

SEQ ID NO: 2370016 - protein, 11 aa, Entamoeba dispar
NAENLQEHTVG

SEQ ID NO: 2370017 - protein, 8 aa, Entamoeba dispar
NAEPSNGF

SEQ ID NO: 2370018 - protein, 6 aa, Entamoeba dispar
NAEQDA

SEQ ID NO: 2370019 - protein, 7 aa, Entamoeba dispar
NAERLSG

SEQ ID NO: 2370020 - protein, 11 aa, Entamoeba dispar
NAESNDFSPPL

SEQ ID NO: 2370021 - protein, 13 aa, Entamoeba dispar
NAETERKRRPYDM

SEQ ID NO: 2370022 - protein, 7 aa, Entamoeba dispar
NAEVNAQ

SEQ ID NO: 2370023 - protein, 10 aa, Entamoeba dispar
NAEVSYETTS

SEQ ID NO: 2370024 - protein, 6 aa, Entamoeba dispar
NAFTKG

SEQ ID NO: 2370025 - protein, 5 aa, Entamoeba dispar
NAGCS

SEQ ID NO: 2370026 - protein, 24 aa, Entamoeba dispar
NAGKSVEEIKEQHKDTQQPQEKIS

SEQ ID NO: 2370027 - protein, 8 aa, Entamoeba dispar
NAGKYGKM

SEQ ID NO: 2370028 - protein, 5 aa, Entamoeba dispar
NAGPM

SEQ ID NO: 2370029 - protein, 4 aa, Entamoeba dispar
NAGT

SEQ ID NO: 2370030 - protein, 14 aa, Entamoeba dispar
NAHSGSSALKASLS

SEQ ID NO: 2370031 - protein, 5 aa, Entamoeba dispar
NAHTS

SEQ ID NO: 2370032 - protein, 6 aa, Entamoeba dispar
NAIGIP

SEQ ID NO: 2370033 - protein, 13 aa, Entamoeba dispar
NAIQSNSVCNKNK

SEQ ID NO: 2370034 - protein, 11 aa, Entamoeba dispar
NAISKNGKYGI

SEQ ID NO: 2370035 - protein, 6 aa, Entamoeba dispar
NAISSM

SEQ ID NO: 2370036 - protein, 13 aa, Entamoeba dispar
NAITNRKRRPYDY

SEQ ID NO: 2370037 - protein, 29 aa, Entamoeba dispar
NAITTDKKVNEGNKEIDTAEKYQRKSSKK

SEQ ID NO: 2370038 - protein, 26 aa, Entamoeba dispar
NAITTTNENAEYVGAENEATNAATYN

SEQ ID NO: 2370039 - protein, 11 aa, Entamoeba dispar
NAKDGSGKAVQ

SEQ ID NO: 2370040 - protein, 7 aa, Entamoeba dispar
NAKIGAS

SEQ ID NO: 2370041 - protein, 8 aa, Entamoeba dispar
NAKNRTGK

SEQ ID NO: 2370042 - protein, 7 aa, Entamoeba dispar
NAKPSYD

SEQ ID NO: 2370043 - protein, 26 aa, Entamoeba dispar
NAKSKTGSKTFNIENEYKQATQIGGK

SEQ ID NO: 2370044 - protein, 10 aa, Entamoeba dispar
NALNSAQRSV

SEQ ID NO: 2370045 - protein, 12 aa, Entamoeba dispar
NALPENGKCSKC

SEQ ID NO: 2370046 - protein, 6 aa, Entamoeba dispar
NALPGS

SEQ ID NO: 2370047 - protein, 7 aa, Entamoeba dispar
NAMSKQR

SEQ ID NO: 2370048 - protein, 9 aa, Entamoeba dispar
NANCKGLSK

SEQ ID NO: 2370049 - protein, 6 aa, Entamoeba dispar
NANENV

SEQ ID NO: 2370050 - protein, 7 aa, Entamoeba dispar
NANFPLK

SEQ ID NO: 2370051 - protein, 12 aa, Entamoeba dispar
NANKFTSDGSSV

SEQ ID NO: 2370052 - protein, 6 aa, Entamoeba dispar
NANPVT

SEQ ID NO: 2370053 - protein, 5 aa, Entamoeba dispar
NANTA

SEQ ID NO: 2370054 - protein, 14 aa, Entamoeba dispar
NAPDEVESKEEFTT

SEQ ID NO: 2370055 - protein, 8 aa, Entamoeba dispar
NAPDGGEF

SEQ ID NO: 2370056 - protein, 27 aa, Entamoeba dispar
NAPKMNEDSDETEDENEVIKKEDKKRL

SEQ ID NO: 2370057 - protein, 5 aa, Entamoeba dispar
NAPPH

SEQ ID NO: 2370058 - protein, 5 aa, Entamoeba dispar
NAPSC

SEQ ID NO: 2370059 - protein, 14 aa, Entamoeba dispar
NAPSGTDLSSLTPY

SEQ ID NO: 2370060 - protein, 7 aa, Entamoeba dispar
NAQDSSQ

SEQ ID NO: 2370061 - protein, 7 aa, Entamoeba dispar
NAQPRSI

SEQ ID NO: 2370062 - protein, 6 aa, Entamoeba dispar
NAQQQK

SEQ ID NO: 2370063 - protein, 4 aa, Entamoeba dispar
NARK

SEQ ID NO: 2370064 - protein, 6 aa, Entamoeba dispar
NASASI

SEQ ID NO: 2370065 - protein, 11 aa, Entamoeba dispar
NASDAKQLEEF

SEQ ID NO: 2370066 - protein, 13 aa, Entamoeba dispar
NASGLSEEKKSAM

SEQ ID NO: 2370067 - protein, 11 aa, Entamoeba dispar
NASNPNEKNSS

SEQ ID NO: 2370068 - protein, 8 aa, Entamoeba dispar
NASSCQKA

SEQ ID NO: 2370069 - protein, 4 aa, Entamoeba dispar
NATD

SEQ ID NO: 2370070 - protein, 6 aa, Entamoeba dispar
NATDFD

SEQ ID NO: 2370071 - protein, 6 aa, Entamoeba dispar
NATNDP

SEQ ID NO: 2370072 - protein, 8 aa, Entamoeba dispar
NATQQLQD

SEQ ID NO: 2370073 - protein, 21 aa, Entamoeba dispar
NATYDKCTAPTGYSPSDKTPV

SEQ ID NO: 2370074 - protein, 4 aa, Entamoeba dispar
NAYP

SEQ ID NO: 2370075 - protein, 6 aa, Entamoeba dispar
NCDGTV

SEQ ID NO: 2370076 - protein, 8 aa, Entamoeba dispar
NCDNTEQK

SEQ ID NO: 2370077 - protein, 8 aa, Entamoeba dispar
NCDQTTLD

SEQ ID NO: 2370078 - protein, 12 aa, Entamoeba dispar
NCDTSVKNGTVT

SEQ ID NO: 2370079 - protein, 7 aa, Entamoeba dispar
NCENYTD

SEQ ID NO: 2370080 - protein, 5 aa, Entamoeba dispar
NCERK

SEQ ID NO: 2370081 - protein, 7 aa, Entamoeba dispar
NCETNTQ

SEQ ID NO: 2370082 - protein, 9 aa, Entamoeba dispar
NCGSGEKEY

SEQ ID NO: 2370083 - protein, 8 aa, Entamoeba dispar
NCKEQTGY

SEQ ID NO: 2370084 - protein, 15 aa, Entamoeba dispar
NCKNNNEECEIEDKN

SEQ ID NO: 2370085 - protein, 10 aa, Entamoeba dispar
NCKNNNKNDI

SEQ ID NO: 2370086 - protein, 8 aa, Entamoeba dispar
NCKPPEIR

SEQ ID NO: 2370087 - protein, 11 aa, Entamoeba dispar
NCLSPTEITDG

SEQ ID NO: 2370088 - protein, 9 aa, Entamoeba dispar
NCNEPAKTR

SEQ ID NO: 2370089 - protein, 11 aa, Entamoeba dispar
NCPCSEAGSEI

SEQ ID NO: 2370090 - protein, 6 aa, Entamoeba dispar
NCPEDQ

SEQ ID NO: 2370091 - protein, 13 aa, Entamoeba dispar
NCPNGCDTCSSSD

SEQ ID NO: 2370092 - protein, 10 aa, Entamoeba dispar
NCQECKDNNC

SEQ ID NO: 2370093 - protein, 4 aa, Entamoeba dispar
NCQH

SEQ ID NO: 2370094 - protein, 10 aa, Entamoeba dispar
NCQHQTGTKW

SEQ ID NO: 2370095 - protein, 7 aa, Entamoeba dispar
NCQRSTT

SEQ ID NO: 2370096 - protein, 19 aa, Entamoeba dispar
NCSEEEKQQAIERETFGKE

SEQ ID NO: 2370097 - protein, 4 aa, Entamoeba dispar
NCSG

SEQ ID NO: 2370098 - protein, 7 aa, Entamoeba dispar
NCSGSEL

SEQ ID NO: 2370099 - protein, 6 aa, Entamoeba dispar
NCSSPS

SEQ ID NO: 2370100 - protein, 12 aa, Entamoeba dispar
NCTENGCEDGYG

SEQ ID NO: 2370101 - protein, 9 aa, Entamoeba dispar
NCTQEANFG

SEQ ID NO: 2370102 - protein, 7 aa, Entamoeba dispar
NCTTQDE

SEQ ID NO: 2370103 - protein, 16 aa, Entamoeba dispar
NCVDAKSDHCETASNS

SEQ ID NO: 2370104 - protein, 4 aa, Entamoeba dispar
NDAE

SEQ ID NO: 2370105 - protein, 27 aa, Entamoeba dispar
NDAKNDQRRLRTRENRNRQTGDATNLR

SEQ ID NO: 2370106 - protein, 5 aa, Entamoeba dispar
NDANQ

SEQ ID NO: 2370107 - protein, 16 aa, Entamoeba dispar
NDAQEENQEMSDSEQF

SEQ ID NO: 2370108 - protein, 6 aa, Entamoeba dispar
NDCYEG

SEQ ID NO: 2370109 - protein, 4 aa, Entamoeba dispar
NDDE

SEQ ID NO: 2370110 - protein, 10 aa, Entamoeba dispar
NDDEELNEEK

SEQ ID NO: 2370111 - protein, 4 aa, Entamoeba dispar
NDDF

SEQ ID NO: 2370112 - protein, 22 aa, Entamoeba dispar
NDDGTCKECSKNFGSECTKCTA

SEQ ID NO: 2370113 - protein, 5 aa, Entamoeba dispar
NDDNF

SEQ ID NO: 2370114 - protein, 5 aa, Entamoeba dispar
NDDPE

SEQ ID NO: 2370115 - protein, 9 aa, Entamoeba dispar
NDDSEICGN

SEQ ID NO: 2370116 - protein, 14 aa, Entamoeba dispar
NDDSETEELEPKEN

SEQ ID NO: 2370117 - protein, 12 aa, Entamoeba dispar
NDDSPECGSSAS

SEQ ID NO: 2370118 - protein, 4 aa, Entamoeba dispar
NDDT

SEQ ID NO: 2370119 - protein, 4 aa, Entamoeba dispar
NDDV

SEQ ID NO: 2370120 - protein, 4 aa, Entamoeba dispar
NDED

SEQ ID NO: 2370121 - protein, 5 aa, Entamoeba dispar
NDEFS

SEQ ID NO: 2370122 - protein, 6 aa, Entamoeba dispar
NDEGKQ

SEQ ID NO: 2370123 - protein, 9 aa, Entamoeba dispar
NDEKEIESH

SEQ ID NO: 2370124 - protein, 8 aa, Entamoeba dispar
NDENNQKY

SEQ ID NO: 2370125 - protein, 14 aa, Entamoeba dispar
NDENTISNDSPTHL

SEQ ID NO: 2370126 - protein, 8 aa, Entamoeba dispar
NDEPEGGI

SEQ ID NO: 2370127 - protein, 7 aa, Entamoeba dispar
NDEPTTQ

SEQ ID NO: 2370128 - protein, 5 aa, Entamoeba dispar
NDESV

SEQ ID NO: 2370129 - protein, 19 aa, Entamoeba dispar
NDESVTMKGAQIKSTHLKN

SEQ ID NO: 2370130 - protein, 5 aa, Entamoeba dispar
NDESW

SEQ ID NO: 2370131 - protein, 6 aa, Entamoeba dispar
NDEVEG

SEQ ID NO: 2370132 - protein, 5 aa, Entamoeba dispar
NDFDN

SEQ ID NO: 2370133 - protein, 4 aa, Entamoeba dispar
NDFK

SEQ ID NO: 2370134 - protein, 13 aa, Entamoeba dispar
NDFKSYNGDIPNG

SEQ ID NO: 2370135 - protein, 11 aa, Entamoeba dispar
NDFPDKPEYIK

SEQ ID NO: 2370136 - protein, 7 aa, Entamoeba dispar
NDFPSSF

SEQ ID NO: 2370137 - protein, 5 aa, Entamoeba dispar
NDFRP

SEQ ID NO: 2370138 - protein, 12 aa, Entamoeba dispar
NDGEECDGGDGC

SEQ ID NO: 2370139 - protein, 13 aa, Entamoeba dispar
NDGEMKEKKPVKQ

SEQ ID NO: 2370140 - protein, 8 aa, Entamoeba dispar
NDGETVNT

SEQ ID NO: 2370141 - protein, 8 aa, Entamoeba dispar
NDGKTLDN

SEQ ID NO: 2370142 - protein, 4 aa, Entamoeba dispar
NDGL

SEQ ID NO: 2370143 - protein, 6 aa, Entamoeba dispar
NDGLKN

SEQ ID NO: 2370144 - protein, 5 aa, Entamoeba dispar
NDGLQ

SEQ ID NO: 2370145 - protein, 4 aa, Entamoeba dispar
NDGN

SEQ ID NO: 2370146 - protein, 7 aa, Entamoeba dispar
NDGNDDF

SEQ ID NO: 2370147 - protein, 9 aa, Entamoeba dispar
NDGNDQAKV

SEQ ID NO: 2370148 - protein, 13 aa, Entamoeba dispar
NDGNKTITSDSTI

SEQ ID NO: 2370149 - protein, 6 aa, Entamoeba dispar
NDGQSP

SEQ ID NO: 2370150 - protein, 6 aa, Entamoeba dispar
NDGTTI

SEQ ID NO: 2370151 - protein, 7 aa, Entamoeba dispar
NDHEKTQ

SEQ ID NO: 2370152 - protein, 6 aa, Entamoeba dispar
NDHSNY

SEQ ID NO: 2370153 - protein, 5 aa, Entamoeba dispar
NDHYK

SEQ ID NO: 2370154 - protein, 7 aa, Entamoeba dispar
NDIDEDT

SEQ ID NO: 2370155 - protein, 9 aa, Entamoeba dispar
NDIDNNGVK

SEQ ID NO: 2370156 - protein, 11 aa, Entamoeba dispar
NDIESGRISDL

SEQ ID NO: 2370157 - protein, 4 aa, Entamoeba dispar
NDIG

SEQ ID NO: 2370158 - protein, 11 aa, Entamoeba dispar
NDIKENNNSRC

SEQ ID NO: 2370159 - protein, 4 aa, Entamoeba dispar
NDIN

SEQ ID NO: 2370160 - protein, 6 aa, Entamoeba dispar
NDINDT

SEQ ID NO: 2370161 - protein, 5 aa, Entamoeba dispar
NDINQ

SEQ ID NO: 2370162 - protein, 5 aa, Entamoeba dispar
NDIPV

SEQ ID NO: 2370163 - protein, 10 aa, Entamoeba dispar
NDKENRPSID

SEQ ID NO: 2370164 - protein, 7 aa, Entamoeba dispar
NDKGEMK

SEQ ID NO: 2370165 - protein, 5 aa, Entamoeba dispar
NDKKE

SEQ ID NO: 2370166 - protein, 18 aa, Entamoeba dispar
NDKLQKEKQLKVTPVRET

SEQ ID NO: 2370167 - protein, 8 aa, Entamoeba dispar
NDKNAAEI

SEQ ID NO: 2370168 - protein, 9 aa, Entamoeba dispar
NDKNRKNLS

SEQ ID NO: 2370169 - protein, 8 aa, Entamoeba dispar
NDKQLKNK

SEQ ID NO: 2370170 - protein, 11 aa, Entamoeba dispar
NDKQPSEEYEM

SEQ ID NO: 2370171 - protein, 55 aa, Entamoeba dispar
NDKSKSDSHKDQSASTKTETKSKDPSSERVSTTNTTEESIEASVSSQVPETGVEN

SEQ ID NO: 2370172 - protein, 10 aa, Entamoeba dispar
NDKTQRIKDV

SEQ ID NO: 2370173 - protein, 8 aa, Entamoeba dispar
NDKYGGDD

SEQ ID NO: 2370174 - protein, 9 aa, Entamoeba dispar
NDKYKRRMK

SEQ ID NO: 2370175 - protein, 20 aa, Entamoeba dispar
NDLAENASTQQDNSSDEDED

SEQ ID NO: 2370176 - protein, 7 aa, Entamoeba dispar
NDLGASS

SEQ ID NO: 2370177 - protein, 14 aa, Entamoeba dispar
NDLGENIEKEMKEE

SEQ ID NO: 2370178 - protein, 6 aa, Entamoeba dispar
NDLKTQ

SEQ ID NO: 2370179 - protein, 4 aa, Entamoeba dispar
NDLQ

SEQ ID NO: 2370180 - protein, 6 aa, Entamoeba dispar
NDLSKG

SEQ ID NO: 2370181 - protein, 9 aa, Entamoeba dispar
NDMRTRQFS

SEQ ID NO: 2370182 - protein, 6 aa, Entamoeba dispar
NDMSSS

SEQ ID NO: 2370183 - protein, 14 aa, Entamoeba dispar
NDMYSSEPSQISDN

SEQ ID NO: 2370184 - protein, 7 aa, Entamoeba dispar
NDNDFRS

SEQ ID NO: 2370185 - protein, 5 aa, Entamoeba dispar
NDNES

SEQ ID NO: 2370186 - protein, 6 aa, Entamoeba dispar
NDNGHR

SEQ ID NO: 2370187 - protein, 8 aa, Entamoeba dispar
NDNKSTTE

SEQ ID NO: 2370188 - protein, 11 aa, Entamoeba dispar
NDNLPNGINAS

SEQ ID NO: 2370189 - protein, 4 aa, Entamoeba dispar
NDNN

SEQ ID NO: 2370190 - protein, 8 aa, Entamoeba dispar
NDNRTGYS

SEQ ID NO: 2370191 - protein, 8 aa, Entamoeba dispar
NDNSFRSS

SEQ ID NO: 2370192 - protein, 16 aa, Entamoeba dispar
NDNSIASMNSQGGFDI

SEQ ID NO: 2370193 - protein, 12 aa, Entamoeba dispar
NDNSKSKYISEI

SEQ ID NO: 2370194 - protein, 11 aa, Entamoeba dispar
NDNSLDFGRNP

SEQ ID NO: 2370195 - protein, 8 aa, Entamoeba dispar
NDNSMNEY

SEQ ID NO: 2370196 - protein, 7 aa, Entamoeba dispar
NDNVNEA

SEQ ID NO: 2370197 - protein, 11 aa, Entamoeba dispar
NDPFPKSDERF

SEQ ID NO: 2370198 - protein, 5 aa, Entamoeba dispar
NDPLG

SEQ ID NO: 2370199 - protein, 4 aa, Entamoeba dispar
NDPS

SEQ ID NO: 2370200 - protein, 5 aa, Entamoeba dispar
NDPSL

SEQ ID NO: 2370201 - protein, 4 aa, Entamoeba dispar
NDPT

SEQ ID NO: 2370202 - protein, 5 aa, Entamoeba dispar
NDPTS

SEQ ID NO: 2370203 - protein, 9 aa, Entamoeba dispar
NDPTTNEVK

SEQ ID NO: 2370204 - protein, 14 aa, Entamoeba dispar
NDQCTGDKKLHEEQ

SEQ ID NO: 2370205 - protein, 5 aa, Entamoeba dispar
NDQDE

SEQ ID NO: 2370206 - protein, 5 aa, Entamoeba dispar
NDQDI

SEQ ID NO: 2370207 - protein, 4 aa, Entamoeba dispar
NDQL

SEQ ID NO: 2370208 - protein, 22 aa, Entamoeba dispar
NDQPIAEPPLDTSNDALGCLVL

SEQ ID NO: 2370209 - protein, 7 aa, Entamoeba dispar
NDQQKKK

SEQ ID NO: 2370210 - protein, 13 aa, Entamoeba dispar
NDQQSSIDETTNS

SEQ ID NO: 2370211 - protein, 8 aa, Entamoeba dispar
NDREERRK

SEQ ID NO: 2370212 - protein, 5 aa, Entamoeba dispar
NDRKG

SEQ ID NO: 2370213 - protein, 4 aa, Entamoeba dispar
NDRM

SEQ ID NO: 2370214 - protein, 7 aa, Entamoeba dispar
NDRNDYC

SEQ ID NO: 2370215 - protein, 7 aa, Entamoeba dispar
NDSDFRN

SEQ ID NO: 2370216 - protein, 7 aa, Entamoeba dispar
NDSGAIQ

SEQ ID NO: 2370217 - protein, 4 aa, Entamoeba dispar
NDSI

SEQ ID NO: 2370218 - protein, 6 aa, Entamoeba dispar
NDSKNK

SEQ ID NO: 2370219 - protein, 13 aa, Entamoeba dispar
NDSLNKTDTNGNY

SEQ ID NO: 2370220 - protein, 8 aa, Entamoeba dispar
NDSNKIRV

SEQ ID NO: 2370221 - protein, 6 aa, Entamoeba dispar
NDSNTC

SEQ ID NO: 2370222 - protein, 6 aa, Entamoeba dispar
NDSPET

SEQ ID NO: 2370223 - protein, 7 aa, Entamoeba dispar
NDSPSNF

SEQ ID NO: 2370224 - protein, 6 aa, Entamoeba dispar
NDSQIK

SEQ ID NO: 2370225 - protein, 7 aa, Entamoeba dispar
NDSRDPQ

SEQ ID NO: 2370226 - protein, 8 aa, Entamoeba dispar
NDSSPHGA

SEQ ID NO: 2370227 - protein, 12 aa, Entamoeba dispar
NDSSSSGSFSFS

SEQ ID NO: 2370228 - protein, 14 aa, Entamoeba dispar
NDSVEGKDIEGSSF

SEQ ID NO: 2370229 - protein, 5 aa, Entamoeba dispar
NDSYK

SEQ ID NO: 2370230 - protein, 7 aa, Entamoeba dispar
NDTEATI

SEQ ID NO: 2370231 - protein, 5 aa, Entamoeba dispar
NDTFK

SEQ ID NO: 2370232 - protein, 4 aa, Entamoeba dispar
NDTI

SEQ ID NO: 2370233 - protein, 5 aa, Entamoeba dispar
NDTIK

SEQ ID NO: 2370234 - protein, 7 aa, Entamoeba dispar
NDTKKEL

SEQ ID NO: 2370235 - protein, 16 aa, Entamoeba dispar
NDTLSKTLERGDFEEY

SEQ ID NO: 2370236 - protein, 6 aa, Entamoeba dispar
NDTMNS

SEQ ID NO: 2370237 - protein, 7 aa, Entamoeba dispar
NDTNCTE

SEQ ID NO: 2370238 - protein, 8 aa, Entamoeba dispar
NDTPVGKS

SEQ ID NO: 2370239 - protein, 11 aa, Entamoeba dispar
NDTRGCNGGGY

SEQ ID NO: 2370240 - protein, 9 aa, Entamoeba dispar
NDTSEIKQQ

SEQ ID NO: 2370241 - protein, 8 aa, Entamoeba dispar
NDTSFTPK

SEQ ID NO: 2370242 - protein, 8 aa, Entamoeba dispar
NDVKNDTI

SEQ ID NO: 2370243 - protein, 9 aa, Entamoeba dispar
NDVKNDTVE

SEQ ID NO: 2370244 - protein, 11 aa, Entamoeba dispar
NDVNLNEKSLS

SEQ ID NO: 2370245 - protein, 4 aa, Entamoeba dispar
NDVS

SEQ ID NO: 2370246 - protein, 8 aa, Entamoeba dispar
NDVSDGRI

SEQ ID NO: 2370247 - protein, 5 aa, Entamoeba dispar
NDVTN

SEQ ID NO: 2370248 - protein, 10 aa, Entamoeba dispar
NDVTSDINQT

SEQ ID NO: 2370249 - protein, 6 aa, Entamoeba dispar
NDYKNK

SEQ ID NO: 2370250 - protein, 16 aa, Entamoeba dispar
NDYTGKFDPAKDGYPK

SEQ ID NO: 2370251 - protein, 9 aa, Entamoeba dispar
NEAEALEQK

SEQ ID NO: 2370252 - protein, 14 aa, Entamoeba dispar
NEAIGETASEVGGK

SEQ ID NO: 2370253 - protein, 7 aa, Entamoeba dispar
NEAKEKF

SEQ ID NO: 2370254 - protein, 4 aa, Entamoeba dispar
NEAQ

SEQ ID NO: 2370255 - protein, 196 aa, Entamoeba dispar
NEASPEKLEENKEDEEKEKSSSSNTGDEPDNNSEAKSDDEPEASSNDKSDDKVEASSSDKPEASSSDKPDNKPEASSSDKPEASSSDKPEASSSDKPDNKPEESSSDKPDNKPEASSSDKPEASSSDKPDNKPEASSSDKPDNKPEASSSDKPDNKPEASSSDKPDNKPEASSATNSNDNSESSSDDHNNLDAASS

SEQ ID NO: 2370256 - protein, 5 aa, Entamoeba dispar
NECGD

SEQ ID NO: 2370257 - protein, 6 aa, Entamoeba dispar
NECKDC

SEQ ID NO: 2370258 - protein, 21 aa, Entamoeba dispar
NECKNGKLGSGDECIQNSEGC

SEQ ID NO: 2370259 - protein, 6 aa, Entamoeba dispar
NECREC

SEQ ID NO: 2370260 - protein, 11 aa, Entamoeba dispar
NECVEKTTTNC

SEQ ID NO: 2370261 - protein, 9 aa, Entamoeba dispar
NEDEIEDSP

SEQ ID NO: 2370262 - protein, 6 aa, Entamoeba dispar
NEDENV

SEQ ID NO: 2370263 - protein, 7 aa, Entamoeba dispar
NEDEQKF

SEQ ID NO: 2370264 - protein, 4 aa, Entamoeba dispar
NEDF

SEQ ID NO: 2370265 - protein, 5 aa, Entamoeba dispar
NEDGW

SEQ ID NO: 2370266 - protein, 8 aa, Entamoeba dispar
NEDKINTM

SEQ ID NO: 2370267 - protein, 6 aa, Entamoeba dispar
NEDPNI

SEQ ID NO: 2370268 - protein, 8 aa, Entamoeba dispar
NEDQKKII

SEQ ID NO: 2370269 - protein, 5 aa, Entamoeba dispar
NEDQW

SEQ ID NO: 2370270 - protein, 5 aa, Entamoeba dispar
NEDRT

SEQ ID NO: 2370271 - protein, 5 aa, Entamoeba dispar
NEDYS

SEQ ID NO: 2370272 - protein, 11 aa, Entamoeba dispar
NEECDSTTGCG

SEQ ID NO: 2370273 - protein, 8 aa, Entamoeba dispar
NEECQENI

SEQ ID NO: 2370274 - protein, 12 aa, Entamoeba dispar
NEEDETKLSIGT

SEQ ID NO: 2370275 - protein, 8 aa, Entamoeba dispar
NEEDPLRP

SEQ ID NO: 2370276 - protein, 6 aa, Entamoeba dispar
NEEEQQ

SEQ ID NO: 2370277 - protein, 19 aa, Entamoeba dispar
NEEGESKEEKKIKQNINTH

SEQ ID NO: 2370278 - protein, 6 aa, Entamoeba dispar
NEEGGL

SEQ ID NO: 2370279 - protein, 5 aa, Entamoeba dispar
NEEIE

SEQ ID NO: 2370280 - protein, 22 aa, Entamoeba dispar
NEEIEKENNLKKQIKKDDDKKI

SEQ ID NO: 2370281 - protein, 7 aa, Entamoeba dispar
NEEIRTD

SEQ ID NO: 2370282 - protein, 17 aa, Entamoeba dispar
NEEKCTGCDNCERNKEI

SEQ ID NO: 2370283 - protein, 8 aa, Entamoeba dispar
NEEKDYAI

SEQ ID NO: 2370284 - protein, 4 aa, Entamoeba dispar
NEEN

SEQ ID NO: 2370285 - protein, 6 aa, Entamoeba dispar
NEENPY

SEQ ID NO: 2370286 - protein, 5 aa, Entamoeba dispar
NEEQK

SEQ ID NO: 2370287 - protein, 8 aa, Entamoeba dispar
NEEQPTQF

SEQ ID NO: 2370288 - protein, 74 aa, Entamoeba dispar
NEESTNSSSSLLKEEKKEEIQHEQQNEVLQEQEGVTITPTKELDSSPLPESDKPIELQSKEDVEKENTHATSHD

SEQ ID NO: 2370289 - protein, 4 aa, Entamoeba dispar
NEFT

SEQ ID NO: 2370290 - protein, 6 aa, Entamoeba dispar
NEFTNN

SEQ ID NO: 2370291 - protein, 4 aa, Entamoeba dispar
NEGD

SEQ ID NO: 2370292 - protein, 5 aa, Entamoeba dispar
NEGEC

SEQ ID NO: 2370293 - protein, 10 aa, Entamoeba dispar
NEGGDADIEG

SEQ ID NO: 2370294 - protein, 13 aa, Entamoeba dispar
NEGKFSSQSPDEE

SEQ ID NO: 2370295 - protein, 18 aa, Entamoeba dispar
NEGLPKKWKQNEDLSKPY

SEQ ID NO: 2370296 - protein, 18 aa, Entamoeba dispar
NEGNNQEQEKTDNQFVAQ

SEQ ID NO: 2370297 - protein, 7 aa, Entamoeba dispar
NEGRTPP

SEQ ID NO: 2370298 - protein, 4 aa, Entamoeba dispar
NEGY

SEQ ID NO: 2370299 - protein, 10 aa, Entamoeba dispar
NEHKNEDSCK

SEQ ID NO: 2370300 - protein, 6 aa, Entamoeba dispar
NEHKPK

SEQ ID NO: 2370301 - protein, 6 aa, Entamoeba dispar
NEHRNT

SEQ ID NO: 2370302 - protein, 8 aa, Entamoeba dispar
NEHRTKQQ

SEQ ID NO: 2370303 - protein, 7 aa, Entamoeba dispar
NEIASSI

SEQ ID NO: 2370304 - protein, 4 aa, Entamoeba dispar
NEIE

SEQ ID NO: 2370305 - protein, 8 aa, Entamoeba dispar
NEIESGRI

SEQ ID NO: 2370306 - protein, 7 aa, Entamoeba dispar
NEIGGDF

SEQ ID NO: 2370307 - protein, 21 aa, Entamoeba dispar
NEIKEMRKKDLNGIGISPDWK

SEQ ID NO: 2370308 - protein, 12 aa, Entamoeba dispar
NEIKKNKKGWNK

SEQ ID NO: 2370309 - protein, 5 aa, Entamoeba dispar
NEINE

SEQ ID NO: 2370310 - protein, 6 aa, Entamoeba dispar
NEIPSS

SEQ ID NO: 2370311 - protein, 7 aa, Entamoeba dispar
NEIQEDD

SEQ ID NO: 2370312 - protein, 21 aa, Entamoeba dispar
NEIQENDENDRKERESNMNIT

SEQ ID NO: 2370313 - protein, 5 aa, Entamoeba dispar
NEIRN

SEQ ID NO: 2370314 - protein, 11 aa, Entamoeba dispar
NEIRWGTSTNC

SEQ ID NO: 2370315 - protein, 4 aa, Entamoeba dispar
NEIS

SEQ ID NO: 2370316 - protein, 4 aa, Entamoeba dispar
NEIT

SEQ ID NO: 2370317 - protein, 6 aa, Entamoeba dispar
NEKEDI

SEQ ID NO: 2370318 - protein, 6 aa, Entamoeba dispar
NEKEEK

SEQ ID NO: 2370319 - protein, 8 aa, Entamoeba dispar
NEKEGRHE

SEQ ID NO: 2370320 - protein, 33 aa, Entamoeba dispar
NEKETENNSESSPQTGITEFTSKTEDNSEEEQF

SEQ ID NO: 2370321 - protein, 11 aa, Entamoeba dispar
NEKGKRGKGKI

SEQ ID NO: 2370322 - protein, 10 aa, Entamoeba dispar
NEKGKYYSPN

SEQ ID NO: 2370323 - protein, 9 aa, Entamoeba dispar
NEKGQELNE

SEQ ID NO: 2370324 - protein, 13 aa, Entamoeba dispar
NEKIKQQIRRIKS

SEQ ID NO: 2370325 - protein, 25 aa, Entamoeba dispar
NEKKEKKKIQISNKEENEKYSIRTN

SEQ ID NO: 2370326 - protein, 15 aa, Entamoeba dispar
NEKKEKKKIQISSKE

SEQ ID NO: 2370327 - protein, 25 aa, Entamoeba dispar
NEKKEKKKIQISSKEENEKYSIRTK

SEQ ID NO: 2370328 - protein, 7 aa, Entamoeba dispar
NEKKIEG

SEQ ID NO: 2370329 - protein, 11 aa, Entamoeba dispar
NEKLGSPEEVK

SEQ ID NO: 2370330 - protein, 7 aa, Entamoeba dispar
NEKLQDS

SEQ ID NO: 2370331 - protein, 16 aa, Entamoeba dispar
NEKNEINNKRISENIQ

SEQ ID NO: 2370332 - protein, 7 aa, Entamoeba dispar
NEKNGME

SEQ ID NO: 2370333 - protein, 6 aa, Entamoeba dispar
NEKNHQ

SEQ ID NO: 2370334 - protein, 5 aa, Entamoeba dispar
NEKQN

SEQ ID NO: 2370335 - protein, 22 aa, Entamoeba dispar
NEKTHGEDNNKEQQEESINEPE

SEQ ID NO: 2370336 - protein, 32 aa, Entamoeba dispar
NEKTLQETINQKDRELKKVNDELSQIKEANEK

SEQ ID NO: 2370337 - protein, 6 aa, Entamoeba dispar
NEKTNK

SEQ ID NO: 2370338 - protein, 8 aa, Entamoeba dispar
NEKYEGLK

SEQ ID NO: 2370339 - protein, 10 aa, Entamoeba dispar
NELEGDYTKY

SEQ ID NO: 2370340 - protein, 5 aa, Entamoeba dispar
NELEY

SEQ ID NO: 2370341 - protein, 4 aa, Entamoeba dispar
NELK

SEQ ID NO: 2370342 - protein, 14 aa, Entamoeba dispar
NELKNGKKQLKERN

SEQ ID NO: 2370343 - protein, 12 aa, Entamoeba dispar
NELNSQRIDPDD

SEQ ID NO: 2370344 - protein, 11 aa, Entamoeba dispar
NELNTTTSFSG

SEQ ID NO: 2370345 - protein, 8 aa, Entamoeba dispar
NELPGSKE

SEQ ID NO: 2370346 - protein, 5 aa, Entamoeba dispar
NELTG

SEQ ID NO: 2370347 - protein, 8 aa, Entamoeba dispar
NELTKTPT

SEQ ID NO: 2370348 - protein, 15 aa, Entamoeba dispar
NELTQSKKEKINNLL

SEQ ID NO: 2370349 - protein, 5 aa, Entamoeba dispar
NEMEG

SEQ ID NO: 2370350 - protein, 10 aa, Entamoeba dispar
NENCTTCSRT

SEQ ID NO: 2370351 - protein, 16 aa, Entamoeba dispar
NENDAKKLESIETPSK

SEQ ID NO: 2370352 - protein, 8 aa, Entamoeba dispar
NENDPLVQ

SEQ ID NO: 2370353 - protein, 7 aa, Entamoeba dispar
NENDTAK

SEQ ID NO: 2370354 - protein, 19 aa, Entamoeba dispar
NENEEEEQVEINPTWNVHE

SEQ ID NO: 2370355 - protein, 6 aa, Entamoeba dispar
NENEFN

SEQ ID NO: 2370356 - protein, 15 aa, Entamoeba dispar
NENETSYKQNQSCRN

SEQ ID NO: 2370357 - protein, 9 aa, Entamoeba dispar
NENEVGKEP

SEQ ID NO: 2370358 - protein, 8 aa, Entamoeba dispar
NENGRGME

SEQ ID NO: 2370359 - protein, 5 aa, Entamoeba dispar
NENHY

SEQ ID NO: 2370360 - protein, 6 aa, Entamoeba dispar
NENKEG

SEQ ID NO: 2370361 - protein, 10 aa, Entamoeba dispar
NENKEKKKIQ

SEQ ID NO: 2370362 - protein, 30 aa, Entamoeba dispar
NENKEKKKIQISSKEENEKYSIRTNPNIIT

SEQ ID NO: 2370363 - protein, 21 aa, Entamoeba dispar
NENKEKKKIQISSKEGNEKYS

SEQ ID NO: 2370364 - protein, 7 aa, Entamoeba dispar
NENNTRI

SEQ ID NO: 2370365 - protein, 9 aa, Entamoeba dispar
NENPSSNQL

SEQ ID NO: 2370366 - protein, 4 aa, Entamoeba dispar
NENS

SEQ ID NO: 2370367 - protein, 10 aa, Entamoeba dispar
NENSKRKSYV

SEQ ID NO: 2370368 - protein, 7 aa, Entamoeba dispar
NENSLSI

SEQ ID NO: 2370369 - protein, 4 aa, Entamoeba dispar
NENT

SEQ ID NO: 2370370 - protein, 19 aa, Entamoeba dispar
NENTEKEVLTEGNKKIKTI

SEQ ID NO: 2370371 - protein, 7 aa, Entamoeba dispar
NENTGSE

SEQ ID NO: 2370372 - protein, 4 aa, Entamoeba dispar
NEPE

SEQ ID NO: 2370373 - protein, 5 aa, Entamoeba dispar
NEPES

SEQ ID NO: 2370374 - protein, 6 aa, Entamoeba dispar
NEPGKY

SEQ ID NO: 2370375 - protein, 45 aa, Entamoeba dispar
NEPKQDDSLQVPQPLEHTEELTQEIPREISTEKEELTQQNQVITD

SEQ ID NO: 2370376 - protein, 6 aa, Entamoeba dispar
NEPPEL

SEQ ID NO: 2370377 - protein, 4 aa, Entamoeba dispar
NEPS

SEQ ID NO: 2370378 - protein, 10 aa, Entamoeba dispar
NEQDKESQCK

SEQ ID NO: 2370379 - protein, 6 aa, Entamoeba dispar
NEQEEV

SEQ ID NO: 2370380 - protein, 14 aa, Entamoeba dispar
NEQGLSDSDKHWSS

SEQ ID NO: 2370381 - protein, 6 aa, Entamoeba dispar
NEQKTK

SEQ ID NO: 2370382 - protein, 23 aa, Entamoeba dispar
NEQNEKGVPKNFANSTNDPQIDQ

SEQ ID NO: 2370383 - protein, 19 aa, Entamoeba dispar
NEQPNELEVDNTKVSQEVV

SEQ ID NO: 2370384 - protein, 14 aa, Entamoeba dispar
NEQPSAFKTEDAQN

SEQ ID NO: 2370385 - protein, 5 aa, Entamoeba dispar
NEQQE

SEQ ID NO: 2370386 - protein, 7 aa, Entamoeba dispar
NEQTDKY

SEQ ID NO: 2370387 - protein, 7 aa, Entamoeba dispar
NEQTEQK

SEQ ID NO: 2370388 - protein, 5 aa, Entamoeba dispar
NERAW

SEQ ID NO: 2370389 - protein, 5 aa, Entamoeba dispar
NERER

SEQ ID NO: 2370390 - protein, 5 aa, Entamoeba dispar
NERGY

SEQ ID NO: 2370391 - protein, 8 aa, Entamoeba dispar
NERNNDSL

SEQ ID NO: 2370392 - protein, 8 aa, Entamoeba dispar
NERPDEYK

SEQ ID NO: 2370393 - protein, 8 aa, Entamoeba dispar
NERSEARH

SEQ ID NO: 2370394 - protein, 7 aa, Entamoeba dispar
NERSNVN

SEQ ID NO: 2370395 - protein, 4 aa, Entamoeba dispar
NERT

SEQ ID NO: 2370396 - protein, 4 aa, Entamoeba dispar
NERY

SEQ ID NO: 2370397 - protein, 34 aa, Entamoeba dispar
NESADTNESSTNIESNDEASSESQSLNNHQSEES

SEQ ID NO: 2370398 - protein, 9 aa, Entamoeba dispar
NESDRTNQT

SEQ ID NO: 2370399 - protein, 6 aa, Entamoeba dispar
NESENI

SEQ ID NO: 2370400 - protein, 4 aa, Entamoeba dispar
NESH

SEQ ID NO: 2370401 - protein, 8 aa, Entamoeba dispar
NESHSQRS

SEQ ID NO: 2370402 - protein, 4 aa, Entamoeba dispar
NESI

SEQ ID NO: 2370403 - protein, 5 aa, Entamoeba dispar
NESNG

SEQ ID NO: 2370404 - protein, 4 aa, Entamoeba dispar
NESQ

SEQ ID NO: 2370405 - protein, 6 aa, Entamoeba dispar
NESRSR

SEQ ID NO: 2370406 - protein, 9 aa, Entamoeba dispar
NESSNSEQL

SEQ ID NO: 2370407 - protein, 4 aa, Entamoeba dispar
NESV

SEQ ID NO: 2370408 - protein, 5 aa, Entamoeba dispar
NESVD

SEQ ID NO: 2370409 - protein, 7 aa, Entamoeba dispar
NESYNED

SEQ ID NO: 2370410 - protein, 7 aa, Entamoeba dispar
NETDTSS

SEQ ID NO: 2370411 - protein, 4 aa, Entamoeba dispar
NETE

SEQ ID NO: 2370412 - protein, 5 aa, Entamoeba dispar
NETEF

SEQ ID NO: 2370413 - protein, 7 aa, Entamoeba dispar
NETEQQG

SEQ ID NO: 2370414 - protein, 4 aa, Entamoeba dispar
NETG

SEQ ID NO: 2370415 - protein, 4 aa, Entamoeba dispar
NETI

SEQ ID NO: 2370416 - protein, 5 aa, Entamoeba dispar
NETID

SEQ ID NO: 2370417 - protein, 7 aa, Entamoeba dispar
NETIKQQ

SEQ ID NO: 2370418 - protein, 5 aa, Entamoeba dispar
NETIP

SEQ ID NO: 2370419 - protein, 5 aa, Entamoeba dispar
NETIR

SEQ ID NO: 2370420 - protein, 5 aa, Entamoeba dispar
NETIS

SEQ ID NO: 2370421 - protein, 10 aa, Entamoeba dispar
NETISQNNPD

SEQ ID NO: 2370422 - protein, 14 aa, Entamoeba dispar
NETISSVSNEASDG

SEQ ID NO: 2370423 - protein, 7 aa, Entamoeba dispar
NETKEIQ

SEQ ID NO: 2370424 - protein, 9 aa, Entamoeba dispar
NETKENEEG

SEQ ID NO: 2370425 - protein, 9 aa, Entamoeba dispar
NETKKIRQE

SEQ ID NO: 2370426 - protein, 13 aa, Entamoeba dispar
NETKPDNKTIKEL

SEQ ID NO: 2370427 - protein, 13 aa, Entamoeba dispar
NETKQLQNAKGIK

SEQ ID NO: 2370428 - protein, 16 aa, Entamoeba dispar
NETLSKTLEKGDFEEY

SEQ ID NO: 2370429 - protein, 6 aa, Entamoeba dispar
NETNFE

SEQ ID NO: 2370430 - protein, 8 aa, Entamoeba dispar
NETNKNEL

SEQ ID NO: 2370431 - protein, 10 aa, Entamoeba dispar
NETNNPNNSI

SEQ ID NO: 2370432 - protein, 12 aa, Entamoeba dispar
NETNSDYQPTSL

SEQ ID NO: 2370433 - protein, 5 aa, Entamoeba dispar
NETNT

SEQ ID NO: 2370434 - protein, 12 aa, Entamoeba dispar
NETQTSSPSQYF

SEQ ID NO: 2370435 - protein, 4 aa, Entamoeba dispar
NETR

SEQ ID NO: 2370436 - protein, 4 aa, Entamoeba dispar
NETS

SEQ ID NO: 2370437 - protein, 6 aa, Entamoeba dispar
NETVVR

SEQ ID NO: 2370438 - protein, 4 aa, Entamoeba dispar
NETY

SEQ ID NO: 2370439 - protein, 6 aa, Entamoeba dispar
NEVPPS

SEQ ID NO: 2370440 - protein, 15 aa, Entamoeba dispar
NEVSKSLDESSDGKY

SEQ ID NO: 2370441 - protein, 7 aa, Entamoeba dispar
NEVSQLD

SEQ ID NO: 2370442 - protein, 5 aa, Entamoeba dispar
NEVTD

SEQ ID NO: 2370443 - protein, 7 aa, Entamoeba dispar
NEYATSS

SEQ ID NO: 2370444 - protein, 4 aa, Entamoeba dispar
NEYE

SEQ ID NO: 2370445 - protein, 5 aa, Entamoeba dispar
NEYEE

SEQ ID NO: 2370446 - protein, 4 aa, Entamoeba dispar
NEYG

SEQ ID NO: 2370447 - protein, 7 aa, Entamoeba dispar
NEYNDDD

SEQ ID NO: 2370448 - protein, 7 aa, Entamoeba dispar
NEYPHYN

SEQ ID NO: 2370449 - protein, 7 aa, Entamoeba dispar
NEYQTEY

SEQ ID NO: 2370450 - protein, 5 aa, Entamoeba dispar
NEYRE

SEQ ID NO: 2370451 - protein, 5 aa, Entamoeba dispar
NFDDE

SEQ ID NO: 2370452 - protein, 9 aa, Entamoeba dispar
NFDGKPLNQ

SEQ ID NO: 2370453 - protein, 10 aa, Entamoeba dispar
NFGAKPCESL

SEQ ID NO: 2370454 - protein, 6 aa, Entamoeba dispar
NFGDNG

SEQ ID NO: 2370455 - protein, 12 aa, Entamoeba dispar
NFGGEKKSVQQV

SEQ ID NO: 2370456 - protein, 12 aa, Entamoeba dispar
NFGGTEDAFTGA

SEQ ID NO: 2370457 - protein, 8 aa, Entamoeba dispar
NFGTEDNL

SEQ ID NO: 2370458 - protein, 18 aa, Entamoeba dispar
NFHDTEDEEQMKNKPFKE

SEQ ID NO: 2370459 - protein, 7 aa, Entamoeba dispar
NFHGNTP

SEQ ID NO: 2370460 - protein, 8 aa, Entamoeba dispar
NFKNEGEI

SEQ ID NO: 2370461 - protein, 5 aa, Entamoeba dispar
NFKTD

SEQ ID NO: 2370462 - protein, 6 aa, Entamoeba dispar
NFNQRS

SEQ ID NO: 2370463 - protein, 7 aa, Entamoeba dispar
NFPKASD

SEQ ID NO: 2370464 - protein, 4 aa, Entamoeba dispar
NFPV

SEQ ID NO: 2370465 - protein, 4 aa, Entamoeba dispar
NFQE

SEQ ID NO: 2370466 - protein, 7 aa, Entamoeba dispar
NFSATGN

SEQ ID NO: 2370467 - protein, 9 aa, Entamoeba dispar
NFSKSNKSH

SEQ ID NO: 2370468 - protein, 7 aa, Entamoeba dispar
NFTKEQA

SEQ ID NO: 2370469 - protein, 7 aa, Entamoeba dispar
NGAGKST

SEQ ID NO: 2370470 - protein, 6 aa, Entamoeba dispar
NGAPDV

SEQ ID NO: 2370471 - protein, 19 aa, Entamoeba dispar
NGCPNSLSSDQSPITSPGL

SEQ ID NO: 2370472 - protein, 5 aa, Entamoeba dispar
NGDCR

SEQ ID NO: 2370473 - protein, 6 aa, Entamoeba dispar
NGDDDC

SEQ ID NO: 2370474 - protein, 38 aa, Entamoeba dispar
NGDDYEERDYYSTNCTKSEFSTNDNGDKVVPVKSDNTD

SEQ ID NO: 2370475 - protein, 6 aa, Entamoeba dispar
NGDEEI

SEQ ID NO: 2370476 - protein, 4 aa, Entamoeba dispar
NGDG

SEQ ID NO: 2370477 - protein, 8 aa, Entamoeba dispar
NGDPCYNE

SEQ ID NO: 2370478 - protein, 11 aa, Entamoeba dispar
NGDPNGKDEEF

SEQ ID NO: 2370479 - protein, 8 aa, Entamoeba dispar
NGDQTTNR

SEQ ID NO: 2370480 - protein, 6 aa, Entamoeba dispar
NGDSRS

SEQ ID NO: 2370481 - protein, 4 aa, Entamoeba dispar
NGDY

SEQ ID NO: 2370482 - protein, 7 aa, Entamoeba dispar
NGECKKK

SEQ ID NO: 2370483 - protein, 10 aa, Entamoeba dispar
NGEDENENQL

SEQ ID NO: 2370484 - protein, 5 aa, Entamoeba dispar
NGEEN

SEQ ID NO: 2370485 - protein, 5 aa, Entamoeba dispar
NGEHS

SEQ ID NO: 2370486 - protein, 18 aa, Entamoeba dispar
NGEKEAYKRIKEEERKDA

SEQ ID NO: 2370487 - protein, 8 aa, Entamoeba dispar
NGEKGESL

SEQ ID NO: 2370488 - protein, 7 aa, Entamoeba dispar
NGEKKYS

SEQ ID NO: 2370489 - protein, 11 aa, Entamoeba dispar
NGEKNKYIRDD

SEQ ID NO: 2370490 - protein, 9 aa, Entamoeba dispar
NGENDQPHL

SEQ ID NO: 2370491 - protein, 8 aa, Entamoeba dispar
NGEPVGPF

SEQ ID NO: 2370492 - protein, 4 aa, Entamoeba dispar
NGER

SEQ ID NO: 2370493 - protein, 6 aa, Entamoeba dispar
NGESVD

SEQ ID NO: 2370494 - protein, 7 aa, Entamoeba dispar
NGESVSV

SEQ ID NO: 2370495 - protein, 6 aa, Entamoeba dispar
NGESVT

SEQ ID NO: 2370496 - protein, 8 aa, Entamoeba dispar
NGETNKRN

SEQ ID NO: 2370497 - protein, 4 aa, Entamoeba dispar
NGEY

SEQ ID NO: 2370498 - protein, 4 aa, Entamoeba dispar
NGFE

SEQ ID NO: 2370499 - protein, 8 aa, Entamoeba dispar
NGFNEEDI

SEQ ID NO: 2370500 - protein, 5 aa, Entamoeba dispar
NGFSS

SEQ ID NO: 2370501 - protein, 7 aa, Entamoeba dispar
NGGEKNM

SEQ ID NO: 2370502 - protein, 5 aa, Entamoeba dispar
NGGES

SEQ ID NO: 2370503 - protein, 9 aa, Entamoeba dispar
NGGGGINQG

SEQ ID NO: 2370504 - protein, 10 aa, Entamoeba dispar
NGGGSGDLVS

SEQ ID NO: 2370505 - protein, 6 aa, Entamoeba dispar
NGGGYV

SEQ ID NO: 2370506 - protein, 10 aa, Entamoeba dispar
NGGHSKYVNS

SEQ ID NO: 2370507 - protein, 10 aa, Entamoeba dispar
NGGIENNRES

SEQ ID NO: 2370508 - protein, 4 aa, Entamoeba dispar
NGGL

SEQ ID NO: 2370509 - protein, 5 aa, Entamoeba dispar
NGGNC

SEQ ID NO: 2370510 - protein, 13 aa, Entamoeba dispar
NGGNPSEKYVSNK

SEQ ID NO: 2370511 - protein, 8 aa, Entamoeba dispar
NGGSVTFK

SEQ ID NO: 2370512 - protein, 7 aa, Entamoeba dispar
NGGTSNY

SEQ ID NO: 2370513 - protein, 6 aa, Entamoeba dispar
NGGVTN

SEQ ID NO: 2370514 - protein, 7 aa, Entamoeba dispar
NGHFPGH

SEQ ID NO: 2370515 - protein, 12 aa, Entamoeba dispar
NGHTECKKYSEG

SEQ ID NO: 2370516 - protein, 11 aa, Entamoeba dispar
NGIDDNHLQGD

SEQ ID NO: 2370517 - protein, 8 aa, Entamoeba dispar
NGIDTDTP

SEQ ID NO: 2370518 - protein, 4 aa, Entamoeba dispar
NGIE

SEQ ID NO: 2370519 - protein, 11 aa, Entamoeba dispar
NGIKGGYVNEK

SEQ ID NO: 2370520 - protein, 7 aa, Entamoeba dispar
NGIPNKL

SEQ ID NO: 2370521 - protein, 11 aa, Entamoeba dispar
NGIPTKTNSTS

SEQ ID NO: 2370522 - protein, 4 aa, Entamoeba dispar
NGIQ

SEQ ID NO: 2370523 - protein, 7 aa, Entamoeba dispar
NGKCNSC

SEQ ID NO: 2370524 - protein, 8 aa, Entamoeba dispar
NGKDRGGA

SEQ ID NO: 2370525 - protein, 8 aa, Entamoeba dispar
NGKEGASA

SEQ ID NO: 2370526 - protein, 9 aa, Entamoeba dispar
NGKEGVENV

SEQ ID NO: 2370527 - protein, 15 aa, Entamoeba dispar
NGKGIKEIEEEFGND

SEQ ID NO: 2370528 - protein, 17 aa, Entamoeba dispar
NGKIEEGEECDNTTSCN

SEQ ID NO: 2370529 - protein, 6 aa, Entamoeba dispar
NGKKLD

SEQ ID NO: 2370530 - protein, 10 aa, Entamoeba dispar
NGKLDEGEEC

SEQ ID NO: 2370531 - protein, 10 aa, Entamoeba dispar
NGKLDEGEIC

SEQ ID NO: 2370532 - protein, 8 aa, Entamoeba dispar
NGKNDEAR

SEQ ID NO: 2370533 - protein, 5 aa, Entamoeba dispar
NGKQD

SEQ ID NO: 2370534 - protein, 13 aa, Entamoeba dispar
NGKQNIKTQHKNV

SEQ ID NO: 2370535 - protein, 5 aa, Entamoeba dispar
NGKRR

SEQ ID NO: 2370536 - protein, 8 aa, Entamoeba dispar
NGKRRPKI

SEQ ID NO: 2370537 - protein, 8 aa, Entamoeba dispar
NGKSELPI

SEQ ID NO: 2370538 - protein, 7 aa, Entamoeba dispar
NGKSGNI

SEQ ID NO: 2370539 - protein, 10 aa, Entamoeba dispar
NGKSIPNPQT

SEQ ID NO: 2370540 - protein, 8 aa, Entamoeba dispar
NGKTSGMV

SEQ ID NO: 2370541 - protein, 9 aa, Entamoeba dispar
NGLASPDGI

SEQ ID NO: 2370542 - protein, 9 aa, Entamoeba dispar
NGLDMSDGK

SEQ ID NO: 2370543 - protein, 8 aa, Entamoeba dispar
NGLEGDKY

SEQ ID NO: 2370544 - protein, 6 aa, Entamoeba dispar
NGLKSI

SEQ ID NO: 2370545 - protein, 5 aa, Entamoeba dispar
NGLQE

SEQ ID NO: 2370546 - protein, 12 aa, Entamoeba dispar
NGMDPSTAGTAL

SEQ ID NO: 2370547 - protein, 4 aa, Entamoeba dispar
NGMP

SEQ ID NO: 2370548 - protein, 15 aa, Entamoeba dispar
NGMRDEGEDCDGGEY

SEQ ID NO: 2370549 - protein, 6 aa, Entamoeba dispar
NGNASS

SEQ ID NO: 2370550 - protein, 9 aa, Entamoeba dispar
NGNATVNGD

SEQ ID NO: 2370551 - protein, 14 aa, Entamoeba dispar
NGNCSSCETSYTLT

SEQ ID NO: 2370552 - protein, 5 aa, Entamoeba dispar
NGNDI

SEQ ID NO: 2370553 - protein, 8 aa, Entamoeba dispar
NGNDTTEL

SEQ ID NO: 2370554 - protein, 13 aa, Entamoeba dispar
NGNELTDQISDAP

SEQ ID NO: 2370555 - protein, 7 aa, Entamoeba dispar
NGNENGI

SEQ ID NO: 2370556 - protein, 4 aa, Entamoeba dispar
NGNF

SEQ ID NO: 2370557 - protein, 8 aa, Entamoeba dispar
NGNHIETR

SEQ ID NO: 2370558 - protein, 9 aa, Entamoeba dispar
NGNLTGNRN

SEQ ID NO: 2370559 - protein, 15 aa, Entamoeba dispar
NGNNGDSEVKCGEYG

SEQ ID NO: 2370560 - protein, 7 aa, Entamoeba dispar
NGNNINQ

SEQ ID NO: 2370561 - protein, 7 aa, Entamoeba dispar
NGNQTVD

SEQ ID NO: 2370562 - protein, 6 aa, Entamoeba dispar
NGNQYS

SEQ ID NO: 2370563 - protein, 7 aa, Entamoeba dispar
NGNSLQN

SEQ ID NO: 2370564 - protein, 4 aa, Entamoeba dispar
NGNT

SEQ ID NO: 2370565 - protein, 10 aa, Entamoeba dispar
NGNVGLNGGL

SEQ ID NO: 2370566 - protein, 7 aa, Entamoeba dispar
NGPSMKP

SEQ ID NO: 2370567 - protein, 4 aa, Entamoeba dispar
NGQI

SEQ ID NO: 2370568 - protein, 10 aa, Entamoeba dispar
NGQKQSKYDT

SEQ ID NO: 2370569 - protein, 11 aa, Entamoeba dispar
NGQLENKTDIE

SEQ ID NO: 2370570 - protein, 8 aa, Entamoeba dispar
NGQPEAIN

SEQ ID NO: 2370571 - protein, 8 aa, Entamoeba dispar
NGQPFDES

SEQ ID NO: 2370572 - protein, 8 aa, Entamoeba dispar
NGQSDNVN

SEQ ID NO: 2370573 - protein, 20 aa, Entamoeba dispar
NGQTQPEGGIINNSKPSYYY

SEQ ID NO: 2370574 - protein, 8 aa, Entamoeba dispar
NGQTVSTG

SEQ ID NO: 2370575 - protein, 6 aa, Entamoeba dispar
NGQWDN

SEQ ID NO: 2370576 - protein, 10 aa, Entamoeba dispar
NGRCQANTLA

SEQ ID NO: 2370577 - protein, 4 aa, Entamoeba dispar
NGRQ

SEQ ID NO: 2370578 - protein, 4 aa, Entamoeba dispar
NGRV

SEQ ID NO: 2370579 - protein, 11 aa, Entamoeba dispar
NGSCQTCDSPT

SEQ ID NO: 2370580 - protein, 6 aa, Entamoeba dispar
NGSFQC

SEQ ID NO: 2370581 - protein, 7 aa, Entamoeba dispar
NGSGTLS

SEQ ID NO: 2370582 - protein, 6 aa, Entamoeba dispar
NGSIST

SEQ ID NO: 2370583 - protein, 9 aa, Entamoeba dispar
NGSKETDYS

SEQ ID NO: 2370584 - protein, 5 aa, Entamoeba dispar
NGSNF

SEQ ID NO: 2370585 - protein, 15 aa, Entamoeba dispar
NGSNGIVSTGKYNNQ

SEQ ID NO: 2370586 - protein, 4 aa, Entamoeba dispar
NGSS

SEQ ID NO: 2370587 - protein, 6 aa, Entamoeba dispar
NGSSPI

SEQ ID NO: 2370588 - protein, 18 aa, Entamoeba dispar
NGSSQNDDSSNSNDIKEH

SEQ ID NO: 2370589 - protein, 16 aa, Entamoeba dispar
NGSSTLLNKTDNTNVC

SEQ ID NO: 2370590 - protein, 16 aa, Entamoeba dispar
NGSTCENNINESGEII

SEQ ID NO: 2370591 - protein, 5 aa, Entamoeba dispar
NGSTI

SEQ ID NO: 2370592 - protein, 5 aa, Entamoeba dispar
NGSVE

SEQ ID NO: 2370593 - protein, 7 aa, Entamoeba dispar
NGSYKSF

SEQ ID NO: 2370594 - protein, 14 aa, Entamoeba dispar
NGTCSSPKGKNCYN

SEQ ID NO: 2370595 - protein, 11 aa, Entamoeba dispar
NGTDNKCSECN

SEQ ID NO: 2370596 - protein, 7 aa, Entamoeba dispar
NGTEEQI

SEQ ID NO: 2370597 - protein, 4 aa, Entamoeba dispar
NGTF

SEQ ID NO: 2370598 - protein, 4 aa, Entamoeba dispar
NGTI

SEQ ID NO: 2370599 - protein, 5 aa, Entamoeba dispar
NGTNS

SEQ ID NO: 2370600 - protein, 8 aa, Entamoeba dispar
NGTPAMRK

SEQ ID NO: 2370601 - protein, 7 aa, Entamoeba dispar
NGTTALD

SEQ ID NO: 2370602 - protein, 17 aa, Entamoeba dispar
NGTVTPSNFSLTPEQSL

SEQ ID NO: 2370603 - protein, 4 aa, Entamoeba dispar
NGTY

SEQ ID NO: 2370604 - protein, 9 aa, Entamoeba dispar
NGTYAEREG

SEQ ID NO: 2370605 - protein, 25 aa, Entamoeba dispar
NGVASGITKISKSDVTCSSTGKSAS

SEQ ID NO: 2370606 - protein, 4 aa, Entamoeba dispar
NGVD

SEQ ID NO: 2370607 - protein, 16 aa, Entamoeba dispar
NGVKDSPSQHNEKAST

SEQ ID NO: 2370608 - protein, 6 aa, Entamoeba dispar
NGVSNR

SEQ ID NO: 2370609 - protein, 8 aa, Entamoeba dispar
NGVTSDGQ

SEQ ID NO: 2370610 - protein, 12 aa, Entamoeba dispar
NGWKSKNCPCKG

SEQ ID NO: 2370611 - protein, 6 aa, Entamoeba dispar
NGYDQK

SEQ ID NO: 2370612 - protein, 8 aa, Entamoeba dispar
NGYEGGWG

SEQ ID NO: 2370613 - protein, 8 aa, Entamoeba dispar
NGYESVNN

SEQ ID NO: 2370614 - protein, 20 aa, Entamoeba dispar
NGYKIENNQCDGDKEDQCYY

SEQ ID NO: 2370615 - protein, 20 aa, Entamoeba dispar
NGYKIENNQCNGDNEDQCYY

SEQ ID NO: 2370616 - protein, 6 aa, Entamoeba dispar
NGYKIQ

SEQ ID NO: 2370617 - protein, 20 aa, Entamoeba dispar
NGYKIQNNQCDGDKEDQCYY

SEQ ID NO: 2370618 - protein, 20 aa, Entamoeba dispar
NGYKIQNNQCNGDNDDQCYY

SEQ ID NO: 2370619 - protein, 19 aa, Entamoeba dispar
NGYKIQNNQCNGDNEDQCY

SEQ ID NO: 2370620 - protein, 5 aa, Entamoeba dispar
NGYKL

SEQ ID NO: 2370621 - protein, 6 aa, Entamoeba dispar
NGYTLN

SEQ ID NO: 2370622 - protein, 14 aa, Entamoeba dispar
NGYTSQNDPTTGNV

SEQ ID NO: 2370623 - protein, 5 aa, Entamoeba dispar
NGYTT

SEQ ID NO: 2370624 - protein, 6 aa, Entamoeba dispar
NGYYRD

SEQ ID NO: 2370625 - protein, 9 aa, Entamoeba dispar
NHCDTNQNS

SEQ ID NO: 2370626 - protein, 9 aa, Entamoeba dispar
NHCSKGNTV

SEQ ID NO: 2370627 - protein, 7 aa, Entamoeba dispar
NHDSSNI

SEQ ID NO: 2370628 - protein, 8 aa, Entamoeba dispar
NHDTNVKT

SEQ ID NO: 2370629 - protein, 12 aa, Entamoeba dispar
NHDVDGVYGRKN

SEQ ID NO: 2370630 - protein, 7 aa, Entamoeba dispar
NHERKQQ

SEQ ID NO: 2370631 - protein, 11 aa, Entamoeba dispar
NHHGSKHSNSW

SEQ ID NO: 2370632 - protein, 11 aa, Entamoeba dispar
NHKPSERPSFK

SEQ ID NO: 2370633 - protein, 9 aa, Entamoeba dispar
NHKPTLPKE

SEQ ID NO: 2370634 - protein, 6 aa, Entamoeba dispar
NHLPQY

SEQ ID NO: 2370635 - protein, 4 aa, Entamoeba dispar
NHLS

SEQ ID NO: 2370636 - protein, 7 aa, Entamoeba dispar
NHNGLGY

SEQ ID NO: 2370637 - protein, 8 aa, Entamoeba dispar
NHNKQTIK

SEQ ID NO: 2370638 - protein, 8 aa, Entamoeba dispar
NHNNSCTS

SEQ ID NO: 2370639 - protein, 12 aa, Entamoeba dispar
NHNNSSDEFKGN

SEQ ID NO: 2370640 - protein, 6 aa, Entamoeba dispar
NHNQLN

SEQ ID NO: 2370641 - protein, 5 aa, Entamoeba dispar
NHNSV

SEQ ID NO: 2370642 - protein, 9 aa, Entamoeba dispar
NHNTRNKGV

SEQ ID NO: 2370643 - protein, 10 aa, Entamoeba dispar
NHNYNSYQKR

SEQ ID NO: 2370644 - protein, 6 aa, Entamoeba dispar
NHPNED

SEQ ID NO: 2370645 - protein, 5 aa, Entamoeba dispar
NHPNL

SEQ ID NO: 2370646 - protein, 6 aa, Entamoeba dispar
NHPRSP

SEQ ID NO: 2370647 - protein, 4 aa, Entamoeba dispar
NHQE

SEQ ID NO: 2370648 - protein, 5 aa, Entamoeba dispar
NHQET

SEQ ID NO: 2370649 - protein, 10 aa, Entamoeba dispar
NHQQSTTTEI

SEQ ID NO: 2370650 - protein, 7 aa, Entamoeba dispar
NHQTEMA

SEQ ID NO: 2370651 - protein, 8 aa, Entamoeba dispar
NHSKPNEH

SEQ ID NO: 2370652 - protein, 22 aa, Entamoeba dispar
NHSVPQRRSTVASVSDAAKKAQ

SEQ ID NO: 2370653 - protein, 4 aa, Entamoeba dispar
NHTL

SEQ ID NO: 2370654 - protein, 8 aa, Entamoeba dispar
NHTSKETK

SEQ ID NO: 2370655 - protein, 24 aa, Entamoeba dispar
NIDEELNSSIENTTFNNGVSSDKI

SEQ ID NO: 2370656 - protein, 5 aa, Entamoeba dispar
NIDGH

SEQ ID NO: 2370657 - protein, 17 aa, Entamoeba dispar
NIDGRQARRTKNATPLG

SEQ ID NO: 2370658 - protein, 10 aa, Entamoeba dispar
NIDGTETPVV

SEQ ID NO: 2370659 - protein, 5 aa, Entamoeba dispar
NIEDG

SEQ ID NO: 2370660 - protein, 7 aa, Entamoeba dispar
NIEEQKH

SEQ ID NO: 2370661 - protein, 9 aa, Entamoeba dispar
NIEKPKGIN

SEQ ID NO: 2370662 - protein, 7 aa, Entamoeba dispar
NIEKPKN

SEQ ID NO: 2370663 - protein, 10 aa, Entamoeba dispar
NIENNSLDEV

SEQ ID NO: 2370664 - protein, 14 aa, Entamoeba dispar
NIEPTSGITIGRDS

SEQ ID NO: 2370665 - protein, 9 aa, Entamoeba dispar
NIESKYSLT

SEQ ID NO: 2370666 - protein, 5 aa, Entamoeba dispar
NIGTH

SEQ ID NO: 2370667 - protein, 5 aa, Entamoeba dispar
NIGTN

SEQ ID NO: 2370668 - protein, 14 aa, Entamoeba dispar
NIKDAYKSFPSGHS

SEQ ID NO: 2370669 - protein, 4 aa, Entamoeba dispar
NIKE

SEQ ID NO: 2370670 - protein, 19 aa, Entamoeba dispar
NIKEDEELSSSSSDEVESK

SEQ ID NO: 2370671 - protein, 12 aa, Entamoeba dispar
NIKEERKDQGIH

SEQ ID NO: 2370672 - protein, 5 aa, Entamoeba dispar
NIKER

SEQ ID NO: 2370673 - protein, 10 aa, Entamoeba dispar
NIKKKTSPTL

SEQ ID NO: 2370674 - protein, 11 aa, Entamoeba dispar
NIKKSTEKNIK

SEQ ID NO: 2370675 - protein, 8 aa, Entamoeba dispar
NIKLEDTR

SEQ ID NO: 2370676 - protein, 5 aa, Entamoeba dispar
NIKSS

SEQ ID NO: 2370677 - protein, 6 aa, Entamoeba dispar
NIKSTT

SEQ ID NO: 2370678 - protein, 8 aa, Entamoeba dispar
NIKYNGDI

SEQ ID NO: 2370679 - protein, 9 aa, Entamoeba dispar
NINGKNEKV

SEQ ID NO: 2370680 - protein, 9 aa, Entamoeba dispar
NINGKTEAE

SEQ ID NO: 2370681 - protein, 11 aa, Entamoeba dispar
NINHQKPNSMN

SEQ ID NO: 2370682 - protein, 5 aa, Entamoeba dispar
NINPS

SEQ ID NO: 2370683 - protein, 5 aa, Entamoeba dispar
NINSD

SEQ ID NO: 2370684 - protein, 8 aa, Entamoeba dispar
NINSNKAP

SEQ ID NO: 2370685 - protein, 5 aa, Entamoeba dispar
NINWK

SEQ ID NO: 2370686 - protein, 7 aa, Entamoeba dispar
NIPDGTE

SEQ ID NO: 2370687 - protein, 9 aa, Entamoeba dispar
NIPENSSSL

SEQ ID NO: 2370688 - protein, 8 aa, Entamoeba dispar
NIPKGDFE

SEQ ID NO: 2370689 - protein, 20 aa, Entamoeba dispar
NIPKNTGANLKLSSDKNHGI

SEQ ID NO: 2370690 - protein, 4 aa, Entamoeba dispar
NIPN

SEQ ID NO: 2370691 - protein, 11 aa, Entamoeba dispar
NIPPNNSISIT

SEQ ID NO: 2370692 - protein, 5 aa, Entamoeba dispar
NIPRP

SEQ ID NO: 2370693 - protein, 9 aa, Entamoeba dispar
NIPSEKYIN

SEQ ID NO: 2370694 - protein, 6 aa, Entamoeba dispar
NIPSSV

SEQ ID NO: 2370695 - protein, 4 aa, Entamoeba dispar
NIPT

SEQ ID NO: 2370696 - protein, 6 aa, Entamoeba dispar
NIPTDQ

SEQ ID NO: 2370697 - protein, 6 aa, Entamoeba dispar
NIPTNK

SEQ ID NO: 2370698 - protein, 14 aa, Entamoeba dispar
NIQEDEQHEENRSS

SEQ ID NO: 2370699 - protein, 8 aa, Entamoeba dispar
NIQGYERE

SEQ ID NO: 2370700 - protein, 10 aa, Entamoeba dispar
NIQKDKDGSV

SEQ ID NO: 2370701 - protein, 4 aa, Entamoeba dispar
NIQN

SEQ ID NO: 2370702 - protein, 10 aa, Entamoeba dispar
NIQTSSGYSS

SEQ ID NO: 2370703 - protein, 12 aa, Entamoeba dispar
NIRSGEGEGSPG

SEQ ID NO: 2370704 - protein, 12 aa, Entamoeba dispar
NIRTGNKFETTN

SEQ ID NO: 2370705 - protein, 14 aa, Entamoeba dispar
NISDDSGVECETQQ

SEQ ID NO: 2370706 - protein, 9 aa, Entamoeba dispar
NISDQNEYS

SEQ ID NO: 2370707 - protein, 5 aa, Entamoeba dispar
NISKK

SEQ ID NO: 2370708 - protein, 8 aa, Entamoeba dispar
NISPESSV

SEQ ID NO: 2370709 - protein, 7 aa, Entamoeba dispar
NISRGKE

SEQ ID NO: 2370710 - protein, 7 aa, Entamoeba dispar
NISSSET

SEQ ID NO: 2370711 - protein, 14 aa, Entamoeba dispar
NISTQIDSPFNSSP

SEQ ID NO: 2370712 - protein, 8 aa, Entamoeba dispar
NITANEEM

SEQ ID NO: 2370713 - protein, 24 aa, Entamoeba dispar
NITKEEKKEKNNSSKKKKQPKPIY

SEQ ID NO: 2370714 - protein, 7 aa, Entamoeba dispar
NITKKTF

SEQ ID NO: 2370715 - protein, 5 aa, Entamoeba dispar
NITNP

SEQ ID NO: 2370716 - protein, 6 aa, Entamoeba dispar
NITSTM

SEQ ID NO: 2370717 - protein, 4 aa, Entamoeba dispar
NITT

SEQ ID NO: 2370718 - protein, 19 aa, Entamoeba dispar
NITWSGGKLKPDIDDEKGL

SEQ ID NO: 2370719 - protein, 6 aa, Entamoeba dispar
NIVKQP

SEQ ID NO: 2370720 - protein, 16 aa, Entamoeba dispar
NIYSYGRGDTRKDNDI

SEQ ID NO: 2370721 - protein, 9 aa, Entamoeba dispar
NKADKLQPI

SEQ ID NO: 2370722 - protein, 12 aa, Entamoeba dispar
NKALVDKEYEQN

SEQ ID NO: 2370723 - protein, 6 aa, Entamoeba dispar
NKAPKT

SEQ ID NO: 2370724 - protein, 5 aa, Entamoeba dispar
NKARV

SEQ ID NO: 2370725 - protein, 9 aa, Entamoeba dispar
NKASGTEPL

SEQ ID NO: 2370726 - protein, 20 aa, Entamoeba dispar
NKATTSQKSQQDNSSMSKSS

SEQ ID NO: 2370727 - protein, 17 aa, Entamoeba dispar
NKAYPIKYSDKSQAPKL

SEQ ID NO: 2370728 - protein, 5 aa, Entamoeba dispar
NKCDK

SEQ ID NO: 2370729 - protein, 9 aa, Entamoeba dispar
NKCETCNEG

SEQ ID NO: 2370730 - protein, 15 aa, Entamoeba dispar
NKCSTTQDKKCEECQ

SEQ ID NO: 2370731 - protein, 6 aa, Entamoeba dispar
NKCTPI

SEQ ID NO: 2370732 - protein, 10 aa, Entamoeba dispar
NKDDDSFTPK

SEQ ID NO: 2370733 - protein, 14 aa, Entamoeba dispar
NKDDDSPKCGEQAK

SEQ ID NO: 2370734 - protein, 9 aa, Entamoeba dispar
NKDDVEKKL

SEQ ID NO: 2370735 - protein, 5 aa, Entamoeba dispar
NKDEA

SEQ ID NO: 2370736 - protein, 7 aa, Entamoeba dispar
NKDFNDD

SEQ ID NO: 2370737 - protein, 6 aa, Entamoeba dispar
NKDGEC

SEQ ID NO: 2370738 - protein, 8 aa, Entamoeba dispar
NKDGTKGA

SEQ ID NO: 2370739 - protein, 6 aa, Entamoeba dispar
NKDKEV

SEQ ID NO: 2370740 - protein, 8 aa, Entamoeba dispar
NKDKNDQK

SEQ ID NO: 2370741 - protein, 6 aa, Entamoeba dispar
NKDKTL

SEQ ID NO: 2370742 - protein, 5 aa, Entamoeba dispar
NKDNE

SEQ ID NO: 2370743 - protein, 9 aa, Entamoeba dispar
NKDQPDVDL

SEQ ID NO: 2370744 - protein, 4 aa, Entamoeba dispar
NKDS

SEQ ID NO: 2370745 - protein, 10 aa, Entamoeba dispar
NKDSKEFNDF

SEQ ID NO: 2370746 - protein, 14 aa, Entamoeba dispar
NKDSNDSSESINQY

SEQ ID NO: 2370747 - protein, 9 aa, Entamoeba dispar
NKDTNNRYK

SEQ ID NO: 2370748 - protein, 7 aa, Entamoeba dispar
NKDTNYS

SEQ ID NO: 2370749 - protein, 5 aa, Entamoeba dispar
NKDTT

SEQ ID NO: 2370750 - protein, 7 aa, Entamoeba dispar
NKDVPTE

SEQ ID NO: 2370751 - protein, 5 aa, Entamoeba dispar
NKECQ

SEQ ID NO: 2370752 - protein, 6 aa, Entamoeba dispar
NKECQI

SEQ ID NO: 2370753 - protein, 6 aa, Entamoeba dispar
NKECQL

SEQ ID NO: 2370754 - protein, 8 aa, Entamoeba dispar
NKECQPLP

SEQ ID NO: 2370755 - protein, 7 aa, Entamoeba dispar
NKECQVG

SEQ ID NO: 2370756 - protein, 7 aa, Entamoeba dispar
NKEDSAQ

SEQ ID NO: 2370757 - protein, 9 aa, Entamoeba dispar
NKEEEEIKV

SEQ ID NO: 2370758 - protein, 8 aa, Entamoeba dispar
NKEEKRRV

SEQ ID NO: 2370759 - protein, 10 aa, Entamoeba dispar
NKEGKTYQNA

SEQ ID NO: 2370760 - protein, 9 aa, Entamoeba dispar
NKEINKDNE

SEQ ID NO: 2370761 - protein, 50 aa, Entamoeba dispar
NKEITSPQKLREESIDPNMKTNTTTTTTTTTTLTSTINSDIGYNTNQTGM

SEQ ID NO: 2370762 - protein, 9 aa, Entamoeba dispar
NKEKDAVQY

SEQ ID NO: 2370763 - protein, 12 aa, Entamoeba dispar
NKEKEENKEINT

SEQ ID NO: 2370764 - protein, 9 aa, Entamoeba dispar
NKEKENGVY

SEQ ID NO: 2370765 - protein, 10 aa, Entamoeba dispar
NKEKKGAEEW

SEQ ID NO: 2370766 - protein, 7 aa, Entamoeba dispar
NKEKKKM

SEQ ID NO: 2370767 - protein, 11 aa, Entamoeba dispar
NKEKRNERLYS

SEQ ID NO: 2370768 - protein, 7 aa, Entamoeba dispar
NKELSKH

SEQ ID NO: 2370769 - protein, 5 aa, Entamoeba dispar
NKENV

SEQ ID NO: 2370770 - protein, 8 aa, Entamoeba dispar
NKEPSNNI

SEQ ID NO: 2370771 - protein, 8 aa, Entamoeba dispar
NKEQKGPL

SEQ ID NO: 2370772 - protein, 8 aa, Entamoeba dispar
NKERGWEL

SEQ ID NO: 2370773 - protein, 9 aa, Entamoeba dispar
NKESNPREF

SEQ ID NO: 2370774 - protein, 14 aa, Entamoeba dispar
NKESTKIKDKKDKL

SEQ ID NO: 2370775 - protein, 7 aa, Entamoeba dispar
NKETNEL

SEQ ID NO: 2370776 - protein, 7 aa, Entamoeba dispar
NKETSAA

SEQ ID NO: 2370777 - protein, 12 aa, Entamoeba dispar
NKEYCSESNCQC

SEQ ID NO: 2370778 - protein, 5 aa, Entamoeba dispar
NKEYT

SEQ ID NO: 2370779 - protein, 11 aa, Entamoeba dispar
NKFERIQSDYD

SEQ ID NO: 2370780 - protein, 8 aa, Entamoeba dispar
NKFGDNKD

SEQ ID NO: 2370781 - protein, 5 aa, Entamoeba dispar
NKFNR

SEQ ID NO: 2370782 - protein, 5 aa, Entamoeba dispar
NKGAI

SEQ ID NO: 2370783 - protein, 8 aa, Entamoeba dispar
NKGASYRS

SEQ ID NO: 2370784 - protein, 5 aa, Entamoeba dispar
NKGDI

SEQ ID NO: 2370785 - protein, 6 aa, Entamoeba dispar
NKGEER

SEQ ID NO: 2370786 - protein, 7 aa, Entamoeba dispar
NKGETTV

SEQ ID NO: 2370787 - protein, 4 aa, Entamoeba dispar
NKGK

SEQ ID NO: 2370788 - protein, 6 aa, Entamoeba dispar
NKGKNI

SEQ ID NO: 2370789 - protein, 6 aa, Entamoeba dispar
NKGKRD

SEQ ID NO: 2370790 - protein, 9 aa, Entamoeba dispar
NKGKRGNEL

SEQ ID NO: 2370791 - protein, 14 aa, Entamoeba dispar
NKGKRVSEKDHDIE

SEQ ID NO: 2370792 - protein, 8 aa, Entamoeba dispar
NKGNESVG

SEQ ID NO: 2370793 - protein, 11 aa, Entamoeba dispar
NKGTQDKIPES

SEQ ID NO: 2370794 - protein, 6 aa, Entamoeba dispar
NKGVNY

SEQ ID NO: 2370795 - protein, 8 aa, Entamoeba dispar
NKHTDSNV

SEQ ID NO: 2370796 - protein, 4 aa, Entamoeba dispar
NKID

SEQ ID NO: 2370797 - protein, 6 aa, Entamoeba dispar
NKINEN

SEQ ID NO: 2370798 - protein, 7 aa, Entamoeba dispar
NKINNEE

SEQ ID NO: 2370799 - protein, 12 aa, Entamoeba dispar
NKINNTNTYQNI

SEQ ID NO: 2370800 - protein, 6 aa, Entamoeba dispar
NKINTD

SEQ ID NO: 2370801 - protein, 5 aa, Entamoeba dispar
NKIPS

SEQ ID NO: 2370802 - protein, 6 aa, Entamoeba dispar
NKISKI

SEQ ID NO: 2370803 - protein, 12 aa, Entamoeba dispar
NKISNTNTYQNI

SEQ ID NO: 2370804 - protein, 4 aa, Entamoeba dispar
NKKA

SEQ ID NO: 2370805 - protein, 8 aa, Entamoeba dispar
NKKAPEKI

SEQ ID NO: 2370806 - protein, 15 aa, Entamoeba dispar
NKKCDEGEECDGGEG

SEQ ID NO: 2370807 - protein, 20 aa, Entamoeba dispar
NKKDEQLRRERRQKRREEKI

SEQ ID NO: 2370808 - protein, 7 aa, Entamoeba dispar
NKKDIEK

SEQ ID NO: 2370809 - protein, 10 aa, Entamoeba dispar
NKKDNNNLTM

SEQ ID NO: 2370810 - protein, 6 aa, Entamoeba dispar
NKKEEL

SEQ ID NO: 2370811 - protein, 6 aa, Entamoeba dispar
NKKEEY

SEQ ID NO: 2370812 - protein, 14 aa, Entamoeba dispar
NKKEIGEGEKIEVN

SEQ ID NO: 2370813 - protein, 8 aa, Entamoeba dispar
NKKEKEEL

SEQ ID NO: 2370814 - protein, 11 aa, Entamoeba dispar
NKKEKKNDTRL

SEQ ID NO: 2370815 - protein, 6 aa, Entamoeba dispar
NKKELK

SEQ ID NO: 2370816 - protein, 6 aa, Entamoeba dispar
NKKERI

SEQ ID NO: 2370817 - protein, 9 aa, Entamoeba dispar
NKKESERIE

SEQ ID NO: 2370818 - protein, 14 aa, Entamoeba dispar
NKKFCSNKVENNRY

SEQ ID NO: 2370819 - protein, 10 aa, Entamoeba dispar
NKKGSAGWDD

SEQ ID NO: 2370820 - protein, 7 aa, Entamoeba dispar
NKKHGDG

SEQ ID NO: 2370821 - protein, 5 aa, Entamoeba dispar
NKKIG

SEQ ID NO: 2370822 - protein, 9 aa, Entamoeba dispar
NKKINNKET

SEQ ID NO: 2370823 - protein, 29 aa, Entamoeba dispar
NKKKESHQDEKEIKEKSQLKDTNEKQIKT

SEQ ID NO: 2370824 - protein, 13 aa, Entamoeba dispar
NKKKNTFTSFNKL

SEQ ID NO: 2370825 - protein, 13 aa, Entamoeba dispar
NKKKVTPKKTHKQ

SEQ ID NO: 2370826 - protein, 6 aa, Entamoeba dispar
NKKKYV

SEQ ID NO: 2370827 - protein, 6 aa, Entamoeba dispar
NKKNEP

SEQ ID NO: 2370828 - protein, 10 aa, Entamoeba dispar
NKKNGRSKAK

SEQ ID NO: 2370829 - protein, 5 aa, Entamoeba dispar
NKKNN

SEQ ID NO: 2370830 - protein, 9 aa, Entamoeba dispar
NKKPIGNKT

SEQ ID NO: 2370831 - protein, 7 aa, Entamoeba dispar
NKKPKYN

SEQ ID NO: 2370832 - protein, 7 aa, Entamoeba dispar
NKKPNDC

SEQ ID NO: 2370833 - protein, 7 aa, Entamoeba dispar
NKKPTIQ

SEQ ID NO: 2370834 - protein, 9 aa, Entamoeba dispar
NKKQGFPNN

SEQ ID NO: 2370835 - protein, 16 aa, Entamoeba dispar
NKKQIQSNETSTKIEK

SEQ ID NO: 2370836 - protein, 20 aa, Entamoeba dispar
NKKQQEKIKAKEEGKNMKPI

SEQ ID NO: 2370837 - protein, 9 aa, Entamoeba dispar
NKKQTAMRR

SEQ ID NO: 2370838 - protein, 10 aa, Entamoeba dispar
NKKRSPKTKF

SEQ ID NO: 2370839 - protein, 15 aa, Entamoeba dispar
NKKSKSKQNNSSKTI

SEQ ID NO: 2370840 - protein, 5 aa, Entamoeba dispar
NKKSV

SEQ ID NO: 2370841 - protein, 10 aa, Entamoeba dispar
NKKVNKNNIQ

SEQ ID NO: 2370842 - protein, 7 aa, Entamoeba dispar
NKKVTVN

SEQ ID NO: 2370843 - protein, 15 aa, Entamoeba dispar
NKKWDEGEECDGGDG

SEQ ID NO: 2370844 - protein, 15 aa, Entamoeba dispar
NKKWDEGEECDGGEG

SEQ ID NO: 2370845 - protein, 7 aa, Entamoeba dispar
NKKYITK

SEQ ID NO: 2370846 - protein, 15 aa, Entamoeba dispar
NKLEDKKEKMGGLKP

SEQ ID NO: 2370847 - protein, 20 aa, Entamoeba dispar
NKLEDLSTSIEDFKNKDTNI

SEQ ID NO: 2370848 - protein, 13 aa, Entamoeba dispar
NKLKKEKEKIQEE

SEQ ID NO: 2370849 - protein, 6 aa, Entamoeba dispar
NKLKST

SEQ ID NO: 2370850 - protein, 4 aa, Entamoeba dispar
NKLP

SEQ ID NO: 2370851 - protein, 4 aa, Entamoeba dispar
NKMN

SEQ ID NO: 2370852 - protein, 7 aa, Entamoeba dispar
NKMPQPL

SEQ ID NO: 2370853 - protein, 4 aa, Entamoeba dispar
NKNC

SEQ ID NO: 2370854 - protein, 14 aa, Entamoeba dispar
NKNEEGVLEDSIPL

SEQ ID NO: 2370855 - protein, 10 aa, Entamoeba dispar
NKNEGINEKR

SEQ ID NO: 2370856 - protein, 8 aa, Entamoeba dispar
NKNELKYT

SEQ ID NO: 2370857 - protein, 8 aa, Entamoeba dispar
NKNETMSK

SEQ ID NO: 2370858 - protein, 7 aa, Entamoeba dispar
NKNFPLK

SEQ ID NO: 2370859 - protein, 12 aa, Entamoeba dispar
NKNGELEKLINQ

SEQ ID NO: 2370860 - protein, 8 aa, Entamoeba dispar
NKNGSQQL

SEQ ID NO: 2370861 - protein, 11 aa, Entamoeba dispar
NKNIKDLETDL

SEQ ID NO: 2370862 - protein, 5 aa, Entamoeba dispar
NKNIQ

SEQ ID NO: 2370863 - protein, 7 aa, Entamoeba dispar
NKNKELS

SEQ ID NO: 2370864 - protein, 19 aa, Entamoeba dispar
NKNKGKEEKLQTITETKEM

SEQ ID NO: 2370865 - protein, 4 aa, Entamoeba dispar
NKNM

SEQ ID NO: 2370866 - protein, 5 aa, Entamoeba dispar
NKNMG

SEQ ID NO: 2370867 - protein, 5 aa, Entamoeba dispar
NKNNN

SEQ ID NO: 2370868 - protein, 7 aa, Entamoeba dispar
NKNNYLP

SEQ ID NO: 2370869 - protein, 7 aa, Entamoeba dispar
NKNQNYD

SEQ ID NO: 2370870 - protein, 9 aa, Entamoeba dispar
NKNQPMSFP

SEQ ID NO: 2370871 - protein, 9 aa, Entamoeba dispar
NKNSKRTKF

SEQ ID NO: 2370872 - protein, 6 aa, Entamoeba dispar
NKNSTC

SEQ ID NO: 2370873 - protein, 6 aa, Entamoeba dispar
NKNTDY

SEQ ID NO: 2370874 - protein, 10 aa, Entamoeba dispar
NKNTPCSSTS

SEQ ID NO: 2370875 - protein, 8 aa, Entamoeba dispar
NKNTQYPT

SEQ ID NO: 2370876 - protein, 9 aa, Entamoeba dispar
NKNVEAHEP

SEQ ID NO: 2370877 - protein, 5 aa, Entamoeba dispar
NKNVQ

SEQ ID NO: 2370878 - protein, 13 aa, Entamoeba dispar
NKNVSSEVKRQSA

SEQ ID NO: 2370879 - protein, 5 aa, Entamoeba dispar
NKNWP

SEQ ID NO: 2370880 - protein, 8 aa, Entamoeba dispar
NKPAPVRE

SEQ ID NO: 2370881 - protein, 7 aa, Entamoeba dispar
NKPESFK

SEQ ID NO: 2370882 - protein, 6 aa, Entamoeba dispar
NKPGYT

SEQ ID NO: 2370883 - protein, 9 aa, Entamoeba dispar
NKPIPVQND

SEQ ID NO: 2370884 - protein, 6 aa, Entamoeba dispar
NKPLRP

SEQ ID NO: 2370885 - protein, 6 aa, Entamoeba dispar
NKPPPC

SEQ ID NO: 2370886 - protein, 10 aa, Entamoeba dispar
NKPPVQQQPV

SEQ ID NO: 2370887 - protein, 9 aa, Entamoeba dispar
NKPQRRQIE

SEQ ID NO: 2370888 - protein, 6 aa, Entamoeba dispar
NKPQTN

SEQ ID NO: 2370889 - protein, 5 aa, Entamoeba dispar
NKPTF

SEQ ID NO: 2370890 - protein, 15 aa, Entamoeba dispar
NKPTITKSSNPRSIQ

SEQ ID NO: 2370891 - protein, 4 aa, Entamoeba dispar
NKPV

SEQ ID NO: 2370892 - protein, 6 aa, Entamoeba dispar
NKPVAF

SEQ ID NO: 2370893 - protein, 6 aa, Entamoeba dispar
NKPVSN

SEQ ID NO: 2370894 - protein, 14 aa, Entamoeba dispar
NKPYKDNDVNENIE

SEQ ID NO: 2370895 - protein, 12 aa, Entamoeba dispar
NKQEEEKEKKKR

SEQ ID NO: 2370896 - protein, 5 aa, Entamoeba dispar
NKQKH

SEQ ID NO: 2370897 - protein, 11 aa, Entamoeba dispar
NKQQLNPRQTY

SEQ ID NO: 2370898 - protein, 6 aa, Entamoeba dispar
NKQSNL

SEQ ID NO: 2370899 - protein, 6 aa, Entamoeba dispar
NKRFES

SEQ ID NO: 2370900 - protein, 8 aa, Entamoeba dispar
NKRGNISG

SEQ ID NO: 2370901 - protein, 5 aa, Entamoeba dispar
NKRIQ

SEQ ID NO: 2370902 - protein, 7 aa, Entamoeba dispar
NKRNTPL

SEQ ID NO: 2370903 - protein, 38 aa, Entamoeba dispar
NKRQAKRVSISTDPNINQSNSTIPKENEEHKSSSINET

SEQ ID NO: 2370904 - protein, 7 aa, Entamoeba dispar
NKRRIQR

SEQ ID NO: 2370905 - protein, 34 aa, Entamoeba dispar
NKRRQAKRADPTKDYHQYQEENKKNTDCSIELTQ

SEQ ID NO: 2370906 - protein, 19 aa, Entamoeba dispar
NKRSSSELPEINSTSVDMS

SEQ ID NO: 2370907 - protein, 7 aa, Entamoeba dispar
NKRVHDN

SEQ ID NO: 2370908 - protein, 4 aa, Entamoeba dispar
NKRY

SEQ ID NO: 2370909 - protein, 7 aa, Entamoeba dispar
NKRYDEK

SEQ ID NO: 2370910 - protein, 7 aa, Entamoeba dispar
NKSCEPK

SEQ ID NO: 2370911 - protein, 18 aa, Entamoeba dispar
NKSCESSCDENKYYDGNN

SEQ ID NO: 2370912 - protein, 13 aa, Entamoeba dispar
NKSCFNNKWCLDS

SEQ ID NO: 2370913 - protein, 4 aa, Entamoeba dispar
NKSI

SEQ ID NO: 2370914 - protein, 8 aa, Entamoeba dispar
NKSIANKN

SEQ ID NO: 2370915 - protein, 7 aa, Entamoeba dispar
NKSIEGY

SEQ ID NO: 2370916 - protein, 8 aa, Entamoeba dispar
NKSIKSNR

SEQ ID NO: 2370917 - protein, 5 aa, Entamoeba dispar
NKSIS

SEQ ID NO: 2370918 - protein, 8 aa, Entamoeba dispar
NKSKEQLQ

SEQ ID NO: 2370919 - protein, 11 aa, Entamoeba dispar
NKSKYSSTAPY

SEQ ID NO: 2370920 - protein, 14 aa, Entamoeba dispar
NKSNCQTCSTNSSE

SEQ ID NO: 2370921 - protein, 7 aa, Entamoeba dispar
NKSNTQL

SEQ ID NO: 2370922 - protein, 6 aa, Entamoeba dispar
NKSPNY

SEQ ID NO: 2370923 - protein, 6 aa, Entamoeba dispar
NKSPRI

SEQ ID NO: 2370924 - protein, 7 aa, Entamoeba dispar
NKSPSNI

SEQ ID NO: 2370925 - protein, 6 aa, Entamoeba dispar
NKSRNK

SEQ ID NO: 2370926 - protein, 8 aa, Entamoeba dispar
NKSSISKQ

SEQ ID NO: 2370927 - protein, 9 aa, Entamoeba dispar
NKSSNITTT

SEQ ID NO: 2370928 - protein, 10 aa, Entamoeba dispar
NKSSTGCERC

SEQ ID NO: 2370929 - protein, 9 aa, Entamoeba dispar
NKSTGKQNF

SEQ ID NO: 2370930 - protein, 9 aa, Entamoeba dispar
NKSTNTVNR

SEQ ID NO: 2370931 - protein, 14 aa, Entamoeba dispar
NKTCPELAPNGTSL

SEQ ID NO: 2370932 - protein, 8 aa, Entamoeba dispar
NKTCQSCD

SEQ ID NO: 2370933 - protein, 8 aa, Entamoeba dispar
NKTDEGKA

SEQ ID NO: 2370934 - protein, 6 aa, Entamoeba dispar
NKTDLT

SEQ ID NO: 2370935 - protein, 8 aa, Entamoeba dispar
NKTDRDDN

SEQ ID NO: 2370936 - protein, 5 aa, Entamoeba dispar
NKTFS

SEQ ID NO: 2370937 - protein, 7 aa, Entamoeba dispar
NKTGENV

SEQ ID NO: 2370938 - protein, 6 aa, Entamoeba dispar
NKTKDI

SEQ ID NO: 2370939 - protein, 28 aa, Entamoeba dispar
NKTKNKMSKEAINRGDPQANQYFPSYGS

SEQ ID NO: 2370940 - protein, 6 aa, Entamoeba dispar
NKTKTI

SEQ ID NO: 2370941 - protein, 9 aa, Entamoeba dispar
NKTNISNDC

SEQ ID NO: 2370942 - protein, 9 aa, Entamoeba dispar
NKTNNVCSK

SEQ ID NO: 2370943 - protein, 11 aa, Entamoeba dispar
NKTNSQKIDIR

SEQ ID NO: 2370944 - protein, 11 aa, Entamoeba dispar
NKTNSSDCEDG

SEQ ID NO: 2370945 - protein, 8 aa, Entamoeba dispar
NKTQQGNN

SEQ ID NO: 2370946 - protein, 18 aa, Entamoeba dispar
NKTQSKLNLSNDKDKLRR

SEQ ID NO: 2370947 - protein, 16 aa, Entamoeba dispar
NKTRCDRCQPNYSPNI

SEQ ID NO: 2370948 - protein, 8 aa, Entamoeba dispar
NKTREQQI

SEQ ID NO: 2370949 - protein, 7 aa, Entamoeba dispar
NKTSCVP

SEQ ID NO: 2370950 - protein, 9 aa, Entamoeba dispar
NKTSFDNEQ

SEQ ID NO: 2370951 - protein, 9 aa, Entamoeba dispar
NKTSKTTYW

SEQ ID NO: 2370952 - protein, 7 aa, Entamoeba dispar
NKTSTID

SEQ ID NO: 2370953 - protein, 5 aa, Entamoeba dispar
NKTTK

SEQ ID NO: 2370954 - protein, 9 aa, Entamoeba dispar
NKTVTVTKD

SEQ ID NO: 2370955 - protein, 15 aa, Entamoeba dispar
NKVESDGKQIDEMQN

SEQ ID NO: 2370956 - protein, 6 aa, Entamoeba dispar
NKVFDD

SEQ ID NO: 2370957 - protein, 10 aa, Entamoeba dispar
NKVGVSEAKS

SEQ ID NO: 2370958 - protein, 5 aa, Entamoeba dispar
NKVGY

SEQ ID NO: 2370959 - protein, 11 aa, Entamoeba dispar
NKVHKKKRSIT

SEQ ID NO: 2370960 - protein, 6 aa, Entamoeba dispar
NKVNGS

SEQ ID NO: 2370961 - protein, 8 aa, Entamoeba dispar
NKVNPKQP

SEQ ID NO: 2370962 - protein, 8 aa, Entamoeba dispar
NKVNTKTT

SEQ ID NO: 2370963 - protein, 4 aa, Entamoeba dispar
NKVS

SEQ ID NO: 2370964 - protein, 9 aa, Entamoeba dispar
NKVSNTRTT

SEQ ID NO: 2370965 - protein, 11 aa, Entamoeba dispar
NKWNSHRSNEN

SEQ ID NO: 2370966 - protein, 7 aa, Entamoeba dispar
NKYEAYR

SEQ ID NO: 2370967 - protein, 5 aa, Entamoeba dispar
NKYGR

SEQ ID NO: 2370968 - protein, 9 aa, Entamoeba dispar
NKYKQITTN

SEQ ID NO: 2370969 - protein, 5 aa, Entamoeba dispar
NKYQD

SEQ ID NO: 2370970 - protein, 6 aa, Entamoeba dispar
NLAEEV

SEQ ID NO: 2370971 - protein, 6 aa, Entamoeba dispar
NLAKDG

SEQ ID NO: 2370972 - protein, 17 aa, Entamoeba dispar
NLAKTQKKNMISRSVSL

SEQ ID NO: 2370973 - protein, 6 aa, Entamoeba dispar
NLAREG

SEQ ID NO: 2370974 - protein, 7 aa, Entamoeba dispar
NLATNND

SEQ ID NO: 2370975 - protein, 8 aa, Entamoeba dispar
NLDGTDDV

SEQ ID NO: 2370976 - protein, 12 aa, Entamoeba dispar
NLDNSADTSSRL

SEQ ID NO: 2370977 - protein, 6 aa, Entamoeba dispar
NLDPTF

SEQ ID NO: 2370978 - protein, 7 aa, Entamoeba dispar
NLDQYNN

SEQ ID NO: 2370979 - protein, 7 aa, Entamoeba dispar
NLEDNEE

SEQ ID NO: 2370980 - protein, 12 aa, Entamoeba dispar
NLENKENITTEV

SEQ ID NO: 2370981 - protein, 7 aa, Entamoeba dispar
NLEPTFA

SEQ ID NO: 2370982 - protein, 7 aa, Entamoeba dispar
NLEQSSS

SEQ ID NO: 2370983 - protein, 5 aa, Entamoeba dispar
NLERT

SEQ ID NO: 2370984 - protein, 6 aa, Entamoeba dispar
NLERTT

SEQ ID NO: 2370985 - protein, 7 aa, Entamoeba dispar
NLGEEGQ

SEQ ID NO: 2370986 - protein, 6 aa, Entamoeba dispar
NLGETL

SEQ ID NO: 2370987 - protein, 6 aa, Entamoeba dispar
NLGPGG

SEQ ID NO: 2370988 - protein, 6 aa, Entamoeba dispar
NLGPSG

SEQ ID NO: 2370989 - protein, 17 aa, Entamoeba dispar
NLHSPNSLSTSITPSIT

SEQ ID NO: 2370990 - protein, 9 aa, Entamoeba dispar
NLIGTEKLK

SEQ ID NO: 2370991 - protein, 7 aa, Entamoeba dispar
NLKEEEI

SEQ ID NO: 2370992 - protein, 11 aa, Entamoeba dispar
NLKEKKDVGTP

SEQ ID NO: 2370993 - protein, 22 aa, Entamoeba dispar
NLKGQKNCKSCGDGTYQDGIGA

SEQ ID NO: 2370994 - protein, 10 aa, Entamoeba dispar
NLKKKEEKIR

SEQ ID NO: 2370995 - protein, 10 aa, Entamoeba dispar
NLKKKYDHQE

SEQ ID NO: 2370996 - protein, 7 aa, Entamoeba dispar
NLKNTEE

SEQ ID NO: 2370997 - protein, 4 aa, Entamoeba dispar
NLKP

SEQ ID NO: 2370998 - protein, 6 aa, Entamoeba dispar
NLKSKR

SEQ ID NO: 2370999 - protein, 11 aa, Entamoeba dispar
NLNEQSSSSIP

SEQ ID NO: 2371000 - protein, 4 aa, Entamoeba dispar
NLNI

SEQ ID NO: 2371001 - protein, 7 aa, Entamoeba dispar
NLNTSSN

SEQ ID NO: 2371002 - protein, 6 aa, Entamoeba dispar
NLNTTN

SEQ ID NO: 2371003 - protein, 6 aa, Entamoeba dispar
NLPDQQ

SEQ ID NO: 2371004 - protein, 10 aa, Entamoeba dispar
NLPGNHSSLQ

SEQ ID NO: 2371005 - protein, 11 aa, Entamoeba dispar
NLPKEAKKRIS

SEQ ID NO: 2371006 - protein, 6 aa, Entamoeba dispar
NLPKTI

SEQ ID NO: 2371007 - protein, 12 aa, Entamoeba dispar
NLPNPYDEGIKT

SEQ ID NO: 2371008 - protein, 4 aa, Entamoeba dispar
NLPR

SEQ ID NO: 2371009 - protein, 4 aa, Entamoeba dispar
NLPS

SEQ ID NO: 2371010 - protein, 4 aa, Entamoeba dispar
NLPT

SEQ ID NO: 2371011 - protein, 11 aa, Entamoeba dispar
NLQENKEQNDR

SEQ ID NO: 2371012 - protein, 11 aa, Entamoeba dispar
NLQNKARKTYT

SEQ ID NO: 2371013 - protein, 43 aa, Entamoeba dispar
NLQNSQKSGEFDNKSNPSSKQSSTIHSSVSNSSTKKKKNNKNI

SEQ ID NO: 2371014 - protein, 12 aa, Entamoeba dispar
NLQRRKKELNNR

SEQ ID NO: 2371015 - protein, 9 aa, Entamoeba dispar
NLQSSTPVL

SEQ ID NO: 2371016 - protein, 6 aa, Entamoeba dispar
NLSESL

SEQ ID NO: 2371017 - protein, 4 aa, Entamoeba dispar
NLSS

SEQ ID NO: 2371018 - protein, 7 aa, Entamoeba dispar
NLTATNT

SEQ ID NO: 2371019 - protein, 4 aa, Entamoeba dispar
NLTD

SEQ ID NO: 2371020 - protein, 5 aa, Entamoeba dispar
NLTDG

SEQ ID NO: 2371021 - protein, 7 aa, Entamoeba dispar
NLTDKEK

SEQ ID NO: 2371022 - protein, 5 aa, Entamoeba dispar
NLTLK

SEQ ID NO: 2371023 - protein, 13 aa, Entamoeba dispar
NLTNAKSQSLEAD

SEQ ID NO: 2371024 - protein, 5 aa, Entamoeba dispar
NLTNT

SEQ ID NO: 2371025 - protein, 4 aa, Entamoeba dispar
NLTP

SEQ ID NO: 2371026 - protein, 10 aa, Entamoeba dispar
NLTQPGSDMG

SEQ ID NO: 2371027 - protein, 10 aa, Entamoeba dispar
NLTSKENEIN

SEQ ID NO: 2371028 - protein, 4 aa, Entamoeba dispar
NMDE

SEQ ID NO: 2371029 - protein, 16 aa, Entamoeba dispar
NMDETGGHNNENPNTS

SEQ ID NO: 2371030 - protein, 8 aa, Entamoeba dispar
NMDETTED

SEQ ID NO: 2371031 - protein, 5 aa, Entamoeba dispar
NMEGN

SEQ ID NO: 2371032 - protein, 10 aa, Entamoeba dispar
NMGDESLKEF

SEQ ID NO: 2371033 - protein, 15 aa, Entamoeba dispar
NMGENELTPSQEQSI

SEQ ID NO: 2371034 - protein, 8 aa, Entamoeba dispar
NMKQEHAG

SEQ ID NO: 2371035 - protein, 6 aa, Entamoeba dispar
NMNDRT

SEQ ID NO: 2371036 - protein, 5 aa, Entamoeba dispar
NMPLN

SEQ ID NO: 2371037 - protein, 5 aa, Entamoeba dispar
NMPPY

SEQ ID NO: 2371038 - protein, 12 aa, Entamoeba dispar
NMQESLQKQTTT

SEQ ID NO: 2371039 - protein, 9 aa, Entamoeba dispar
NMSKSGPPL

SEQ ID NO: 2371040 - protein, 11 aa, Entamoeba dispar
NNADSKTTLGN

SEQ ID NO: 2371041 - protein, 4 aa, Entamoeba dispar
NNAQ

SEQ ID NO: 2371042 - protein, 13 aa, Entamoeba dispar
NNASGYFTHDGDK

SEQ ID NO: 2371043 - protein, 4 aa, Entamoeba dispar
NNAT

SEQ ID NO: 2371044 - protein, 9 aa, Entamoeba dispar
NNAVTPTGL

SEQ ID NO: 2371045 - protein, 19 aa, Entamoeba dispar
NNCDNNGLCSSHTGKCECN

SEQ ID NO: 2371046 - protein, 9 aa, Entamoeba dispar
NNCNDGIST

SEQ ID NO: 2371047 - protein, 9 aa, Entamoeba dispar
NNDAEKTTQ

SEQ ID NO: 2371048 - protein, 10 aa, Entamoeba dispar
NNDDSSKTHT

SEQ ID NO: 2371049 - protein, 11 aa, Entamoeba dispar
NNDDSSKTHTV

SEQ ID NO: 2371050 - protein, 12 aa, Entamoeba dispar
NNDDSSKTREVY

SEQ ID NO: 2371051 - protein, 8 aa, Entamoeba dispar
NNDESIRS

SEQ ID NO: 2371052 - protein, 10 aa, Entamoeba dispar
NNDETDETRI

SEQ ID NO: 2371053 - protein, 9 aa, Entamoeba dispar
NNDGSSTTY

SEQ ID NO: 2371054 - protein, 11 aa, Entamoeba dispar
NNDKGHGNCST

SEQ ID NO: 2371055 - protein, 8 aa, Entamoeba dispar
NNDLQIPK

SEQ ID NO: 2371056 - protein, 8 aa, Entamoeba dispar
NNDNNTIN

SEQ ID NO: 2371057 - protein, 39 aa, Entamoeba dispar
NNDPISGLTKTSITDFEGYSRNHPQSDRGLNCNPGDTAD

SEQ ID NO: 2371058 - protein, 9 aa, Entamoeba dispar
NNDQQQFSP

SEQ ID NO: 2371059 - protein, 5 aa, Entamoeba dispar
NNDRN

SEQ ID NO: 2371060 - protein, 9 aa, Entamoeba dispar
NNDSDSEFG

SEQ ID NO: 2371061 - protein, 7 aa, Entamoeba dispar
NNDSRDK

SEQ ID NO: 2371062 - protein, 4 aa, Entamoeba dispar
NNEA

SEQ ID NO: 2371063 - protein, 6 aa, Entamoeba dispar
NNEDVS

SEQ ID NO: 2371064 - protein, 5 aa, Entamoeba dispar
NNEEF

SEQ ID NO: 2371065 - protein, 9 aa, Entamoeba dispar
NNEEGTKCN

SEQ ID NO: 2371066 - protein, 12 aa, Entamoeba dispar
NNEEHDISKLRG

SEQ ID NO: 2371067 - protein, 10 aa, Entamoeba dispar
NNEENKKTFS

SEQ ID NO: 2371068 - protein, 9 aa, Entamoeba dispar
NNEERQQKW

SEQ ID NO: 2371069 - protein, 4 aa, Entamoeba dispar
NNEI

SEQ ID NO: 2371070 - protein, 5 aa, Entamoeba dispar
NNEIS

SEQ ID NO: 2371071 - protein, 7 aa, Entamoeba dispar
NNEISIQ

SEQ ID NO: 2371072 - protein, 10 aa, Entamoeba dispar
NNEKAKSQLV

SEQ ID NO: 2371073 - protein, 8 aa, Entamoeba dispar
NNEKELKK

SEQ ID NO: 2371074 - protein, 7 aa, Entamoeba dispar
NNEKGKM

SEQ ID NO: 2371075 - protein, 23 aa, Entamoeba dispar
NNEKNRTKRKKAPSQENIGKDPF

SEQ ID NO: 2371076 - protein, 7 aa, Entamoeba dispar
NNEKPHL

SEQ ID NO: 2371077 - protein, 8 aa, Entamoeba dispar
NNEKVGSV

SEQ ID NO: 2371078 - protein, 8 aa, Entamoeba dispar
NNELTGNE

SEQ ID NO: 2371079 - protein, 14 aa, Entamoeba dispar
NNEMQRTNTVSSSV

SEQ ID NO: 2371080 - protein, 8 aa, Entamoeba dispar
NNENIQEV

SEQ ID NO: 2371081 - protein, 5 aa, Entamoeba dispar
NNENK

SEQ ID NO: 2371082 - protein, 19 aa, Entamoeba dispar
NNENNIKKDEEEDNEEGNS

SEQ ID NO: 2371083 - protein, 5 aa, Entamoeba dispar
NNEPI

SEQ ID NO: 2371084 - protein, 4 aa, Entamoeba dispar
NNEQ

SEQ ID NO: 2371085 - protein, 7 aa, Entamoeba dispar
NNEQFEE

SEQ ID NO: 2371086 - protein, 6 aa, Entamoeba dispar
NNEQNE

SEQ ID NO: 2371087 - protein, 7 aa, Entamoeba dispar
NNEQNNL

SEQ ID NO: 2371088 - protein, 8 aa, Entamoeba dispar
NNERDKAF

SEQ ID NO: 2371089 - protein, 5 aa, Entamoeba dispar
NNERI

SEQ ID NO: 2371090 - protein, 7 aa, Entamoeba dispar
NNERNKI

SEQ ID NO: 2371091 - protein, 7 aa, Entamoeba dispar
NNETQSH

SEQ ID NO: 2371092 - protein, 9 aa, Entamoeba dispar
NNETVNSGA

SEQ ID NO: 2371093 - protein, 6 aa, Entamoeba dispar
NNEWNK

SEQ ID NO: 2371094 - protein, 8 aa, Entamoeba dispar
NNEYEDDK

SEQ ID NO: 2371095 - protein, 11 aa, Entamoeba dispar
NNFKPPPKVES

SEQ ID NO: 2371096 - protein, 5 aa, Entamoeba dispar
NNFTS

SEQ ID NO: 2371097 - protein, 4 aa, Entamoeba dispar
NNGE

SEQ ID NO: 2371098 - protein, 6 aa, Entamoeba dispar
NNGEER

SEQ ID NO: 2371099 - protein, 20 aa, Entamoeba dispar
NNGEYVTTGRSERQVAAASG

SEQ ID NO: 2371100 - protein, 5 aa, Entamoeba dispar
NNGFN

SEQ ID NO: 2371101 - protein, 9 aa, Entamoeba dispar
NNGGECKPC

SEQ ID NO: 2371102 - protein, 15 aa, Entamoeba dispar
NNGGFDSNSITPGTK

SEQ ID NO: 2371103 - protein, 5 aa, Entamoeba dispar
NNGIQ

SEQ ID NO: 2371104 - protein, 4 aa, Entamoeba dispar
NNGK

SEQ ID NO: 2371105 - protein, 10 aa, Entamoeba dispar
NNGKERLERK

SEQ ID NO: 2371106 - protein, 7 aa, Entamoeba dispar
NNGNDVG

SEQ ID NO: 2371107 - protein, 7 aa, Entamoeba dispar
NNGNECV

SEQ ID NO: 2371108 - protein, 8 aa, Entamoeba dispar
NNGNNKIK

SEQ ID NO: 2371109 - protein, 7 aa, Entamoeba dispar
NNGNNRI

SEQ ID NO: 2371110 - protein, 8 aa, Entamoeba dispar
NNGNYAEA

SEQ ID NO: 2371111 - protein, 16 aa, Entamoeba dispar
NNGSFEINKNPNDHYL

SEQ ID NO: 2371112 - protein, 7 aa, Entamoeba dispar
NNGTSSI

SEQ ID NO: 2371113 - protein, 7 aa, Entamoeba dispar
NNGVQYQ

SEQ ID NO: 2371114 - protein, 5 aa, Entamoeba dispar
NNHQN

SEQ ID NO: 2371115 - protein, 21 aa, Entamoeba dispar
NNIAPPPQQQSLGNAENEPLI

SEQ ID NO: 2371116 - protein, 11 aa, Entamoeba dispar
NNINGNYQDSK

SEQ ID NO: 2371117 - protein, 12 aa, Entamoeba dispar
NNININSQEKIY

SEQ ID NO: 2371118 - protein, 4 aa, Entamoeba dispar
NNIP

SEQ ID NO: 2371119 - protein, 7 aa, Entamoeba dispar
NNIPNQE

SEQ ID NO: 2371120 - protein, 8 aa, Entamoeba dispar
NNITTSPL

SEQ ID NO: 2371121 - protein, 20 aa, Entamoeba dispar
NNKASKGYQSFPSGHSSTTF

SEQ ID NO: 2371122 - protein, 4 aa, Entamoeba dispar
NNKC

SEQ ID NO: 2371123 - protein, 15 aa, Entamoeba dispar
NNKCDKSERKDNQKM

SEQ ID NO: 2371124 - protein, 10 aa, Entamoeba dispar
NNKCDSCQKK

SEQ ID NO: 2371125 - protein, 14 aa, Entamoeba dispar
NNKCEKSERSRNQQ

SEQ ID NO: 2371126 - protein, 9 aa, Entamoeba dispar
NNKCKRQQT

SEQ ID NO: 2371127 - protein, 9 aa, Entamoeba dispar
NNKCKSKEI

SEQ ID NO: 2371128 - protein, 7 aa, Entamoeba dispar
NNKEISE

SEQ ID NO: 2371129 - protein, 14 aa, Entamoeba dispar
NNKEISQEQKEKYR

SEQ ID NO: 2371130 - protein, 6 aa, Entamoeba dispar
NNKIDD

SEQ ID NO: 2371131 - protein, 7 aa, Entamoeba dispar
NNKKGYE

SEQ ID NO: 2371132 - protein, 7 aa, Entamoeba dispar
NNKKIST

SEQ ID NO: 2371133 - protein, 9 aa, Entamoeba dispar
NNKKTNESI

SEQ ID NO: 2371134 - protein, 12 aa, Entamoeba dispar
NNKNIQQPPDGN

SEQ ID NO: 2371135 - protein, 22 aa, Entamoeba dispar
NNKNQEDKHSTTSNKNDIVVEL

SEQ ID NO: 2371136 - protein, 6 aa, Entamoeba dispar
NNKNSQ

SEQ ID NO: 2371137 - protein, 6 aa, Entamoeba dispar
NNKPFI

SEQ ID NO: 2371138 - protein, 7 aa, Entamoeba dispar
NNKPIKH

SEQ ID NO: 2371139 - protein, 9 aa, Entamoeba dispar
NNKPTFNNT

SEQ ID NO: 2371140 - protein, 14 aa, Entamoeba dispar
NNKSETPSIEGTMS

SEQ ID NO: 2371141 - protein, 9 aa, Entamoeba dispar
NNKSPTAYH

SEQ ID NO: 2371142 - protein, 5 aa, Entamoeba dispar
NNKSY

SEQ ID NO: 2371143 - protein, 8 aa, Entamoeba dispar
NNLEEFEE

SEQ ID NO: 2371144 - protein, 7 aa, Entamoeba dispar
NNLGNIS

SEQ ID NO: 2371145 - protein, 18 aa, Entamoeba dispar
NNLGQSYENDKLNRPVEP

SEQ ID NO: 2371146 - protein, 5 aa, Entamoeba dispar
NNLHS

SEQ ID NO: 2371147 - protein, 5 aa, Entamoeba dispar
NNLNK

SEQ ID NO: 2371148 - protein, 8 aa, Entamoeba dispar
NNLNSEDV

SEQ ID NO: 2371149 - protein, 7 aa, Entamoeba dispar
NNLPSPR

SEQ ID NO: 2371150 - protein, 19 aa, Entamoeba dispar
NNLRQKLKSNAKKATKEKF

SEQ ID NO: 2371151 - protein, 8 aa, Entamoeba dispar
NNLTQSNQ

SEQ ID NO: 2371152 - protein, 8 aa, Entamoeba dispar
NNNAPRLE

SEQ ID NO: 2371153 - protein, 6 aa, Entamoeba dispar
NNNDIK

SEQ ID NO: 2371154 - protein, 5 aa, Entamoeba dispar
NNNDL

SEQ ID NO: 2371155 - protein, 9 aa, Entamoeba dispar
NNNEEDETI

SEQ ID NO: 2371156 - protein, 8 aa, Entamoeba dispar
NNNEGDFE

SEQ ID NO: 2371157 - protein, 9 aa, Entamoeba dispar
NNNENNEIS

SEQ ID NO: 2371158 - protein, 7 aa, Entamoeba dispar
NNNFPST

SEQ ID NO: 2371159 - protein, 9 aa, Entamoeba dispar
NNNKTIKTT

SEQ ID NO: 2371160 - protein, 6 aa, Entamoeba dispar
NNNLQL

SEQ ID NO: 2371161 - protein, 4 aa, Entamoeba dispar
NNNN

SEQ ID NO: 2371162 - protein, 16 aa, Entamoeba dispar
NNNNDGTNNDCGNIKP

SEQ ID NO: 2371163 - protein, 22 aa, Entamoeba dispar
NNNNGMRTTRRERRRKRKTRRV

SEQ ID NO: 2371164 - protein, 9 aa, Entamoeba dispar
NNNNNNQIN

SEQ ID NO: 2371165 - protein, 16 aa, Entamoeba dispar
NNNSNSVNDGSDDTID

SEQ ID NO: 2371166 - protein, 4 aa, Entamoeba dispar
NNNT

SEQ ID NO: 2371167 - protein, 7 aa, Entamoeba dispar
NNNTPHE

SEQ ID NO: 2371168 - protein, 15 aa, Entamoeba dispar
NNPAAGALADDHRND

SEQ ID NO: 2371169 - protein, 6 aa, Entamoeba dispar
NNPEGF

SEQ ID NO: 2371170 - protein, 7 aa, Entamoeba dispar
NNPHDAV

SEQ ID NO: 2371171 - protein, 12 aa, Entamoeba dispar
NNPIPPLPNSSS

SEQ ID NO: 2371172 - protein, 8 aa, Entamoeba dispar
NNPKSREI

SEQ ID NO: 2371173 - protein, 8 aa, Entamoeba dispar
NNPNNKII

SEQ ID NO: 2371174 - protein, 6 aa, Entamoeba dispar
NNPPNK

SEQ ID NO: 2371175 - protein, 7 aa, Entamoeba dispar
NNPQERL

SEQ ID NO: 2371176 - protein, 12 aa, Entamoeba dispar
NNPQMKKSASTL

SEQ ID NO: 2371177 - protein, 12 aa, Entamoeba dispar
NNPQREEKSKFN

SEQ ID NO: 2371178 - protein, 4 aa, Entamoeba dispar
NNPV

SEQ ID NO: 2371179 - protein, 14 aa, Entamoeba dispar
NNQDIPVSKINGKS

SEQ ID NO: 2371180 - protein, 5 aa, Entamoeba dispar
NNQDR

SEQ ID NO: 2371181 - protein, 24 aa, Entamoeba dispar
NNQEKKPLQRTKTHPKSLSKKQSI

SEQ ID NO: 2371182 - protein, 6 aa, Entamoeba dispar
NNQISS

SEQ ID NO: 2371183 - protein, 20 aa, Entamoeba dispar
NNQNGSKEEYEKKKEEMEKE

SEQ ID NO: 2371184 - protein, 4 aa, Entamoeba dispar
NNQQ

SEQ ID NO: 2371185 - protein, 7 aa, Entamoeba dispar
NNQQLSY

SEQ ID NO: 2371186 - protein, 8 aa, Entamoeba dispar
NNQQYGLE

SEQ ID NO: 2371187 - protein, 7 aa, Entamoeba dispar
NNQTLQD

SEQ ID NO: 2371188 - protein, 7 aa, Entamoeba dispar
NNQTTDL

SEQ ID NO: 2371189 - protein, 6 aa, Entamoeba dispar
NNQTTE

SEQ ID NO: 2371190 - protein, 4 aa, Entamoeba dispar
NNRD

SEQ ID NO: 2371191 - protein, 9 aa, Entamoeba dispar
NNRETTSII

SEQ ID NO: 2371192 - protein, 4 aa, Entamoeba dispar
NNRL

SEQ ID NO: 2371193 - protein, 7 aa, Entamoeba dispar
NNRNCQK

SEQ ID NO: 2371194 - protein, 12 aa, Entamoeba dispar
NNRRQKKRITPD

SEQ ID NO: 2371195 - protein, 9 aa, Entamoeba dispar
NNSDTQPFE

SEQ ID NO: 2371196 - protein, 4 aa, Entamoeba dispar
NNSI

SEQ ID NO: 2371197 - protein, 5 aa, Entamoeba dispar
NNSIR

SEQ ID NO: 2371198 - protein, 17 aa, Entamoeba dispar
NNSISNSGICSSYDRNE

SEQ ID NO: 2371199 - protein, 4 aa, Entamoeba dispar
NNSK

SEQ ID NO: 2371200 - protein, 7 aa, Entamoeba dispar
NNSKNPH

SEQ ID NO: 2371201 - protein, 6 aa, Entamoeba dispar
NNSKSF

SEQ ID NO: 2371202 - protein, 6 aa, Entamoeba dispar
NNSLLT

SEQ ID NO: 2371203 - protein, 15 aa, Entamoeba dispar
NNSLNKEEKEVKEIK

SEQ ID NO: 2371204 - protein, 9 aa, Entamoeba dispar
NNSLQDSPF

SEQ ID NO: 2371205 - protein, 9 aa, Entamoeba dispar
NNSLQTPKF

SEQ ID NO: 2371206 - protein, 6 aa, Entamoeba dispar
NNSLSY

SEQ ID NO: 2371207 - protein, 6 aa, Entamoeba dispar
NNSNID

SEQ ID NO: 2371208 - protein, 14 aa, Entamoeba dispar
NNSNVKISGIENSE

SEQ ID NO: 2371209 - protein, 13 aa, Entamoeba dispar
NNSPKKKRTNITY

SEQ ID NO: 2371210 - protein, 13 aa, Entamoeba dispar
NNSPNEKGSNSIE

SEQ ID NO: 2371211 - protein, 5 aa, Entamoeba dispar
NNSQE

SEQ ID NO: 2371212 - protein, 19 aa, Entamoeba dispar
NNSQEVKQEEFENEGKCGD

SEQ ID NO: 2371213 - protein, 9 aa, Entamoeba dispar
NNSSDYSYP

SEQ ID NO: 2371214 - protein, 8 aa, Entamoeba dispar
NNSSIKEH

SEQ ID NO: 2371215 - protein, 5 aa, Entamoeba dispar
NNSSK

SEQ ID NO: 2371216 - protein, 4 aa, Entamoeba dispar
NNST

SEQ ID NO: 2371217 - protein, 32 aa, Entamoeba dispar
NNSTMQRIDDTDVQPEYHSQTQQPSNSFTEKQ

SEQ ID NO: 2371218 - protein, 10 aa, Entamoeba dispar
NNSVERSSAF

SEQ ID NO: 2371219 - protein, 4 aa, Entamoeba dispar
NNTC

SEQ ID NO: 2371220 - protein, 7 aa, Entamoeba dispar
NNTCESC

SEQ ID NO: 2371221 - protein, 7 aa, Entamoeba dispar
NNTCSSC

SEQ ID NO: 2371222 - protein, 13 aa, Entamoeba dispar
NNTECSISNDKDC

SEQ ID NO: 2371223 - protein, 4 aa, Entamoeba dispar
NNTI

SEQ ID NO: 2371224 - protein, 5 aa, Entamoeba dispar
NNTID

SEQ ID NO: 2371225 - protein, 5 aa, Entamoeba dispar
NNTIN

SEQ ID NO: 2371226 - protein, 7 aa, Entamoeba dispar
NNTKKTY

SEQ ID NO: 2371227 - protein, 13 aa, Entamoeba dispar
NNTKNELEINENE

SEQ ID NO: 2371228 - protein, 8 aa, Entamoeba dispar
NNTKRDAV

SEQ ID NO: 2371229 - protein, 4 aa, Entamoeba dispar
NNTL

SEQ ID NO: 2371230 - protein, 8 aa, Entamoeba dispar
NNTNGNVE

SEQ ID NO: 2371231 - protein, 7 aa, Entamoeba dispar
NNTPTPL

SEQ ID NO: 2371232 - protein, 18 aa, Entamoeba dispar
NNTQEPFKSIKDKKTATK

SEQ ID NO: 2371233 - protein, 6 aa, Entamoeba dispar
NNTQQI

SEQ ID NO: 2371234 - protein, 18 aa, Entamoeba dispar
NNTRTTHTSDKIISQPNH

SEQ ID NO: 2371235 - protein, 4 aa, Entamoeba dispar
NNTT

SEQ ID NO: 2371236 - protein, 6 aa, Entamoeba dispar
NNTWNN

SEQ ID NO: 2371237 - protein, 10 aa, Entamoeba dispar
NNVKEEDYDA

SEQ ID NO: 2371238 - protein, 5 aa, Entamoeba dispar
NNVNS

SEQ ID NO: 2371239 - protein, 7 aa, Entamoeba dispar
NNVPQGN

SEQ ID NO: 2371240 - protein, 9 aa, Entamoeba dispar
NNVQTVTAD

SEQ ID NO: 2371241 - protein, 10 aa, Entamoeba dispar
NNVSTGPSLD

SEQ ID NO: 2371242 - protein, 9 aa, Entamoeba dispar
NNVTENVGK

SEQ ID NO: 2371243 - protein, 28 aa, Entamoeba dispar
NNVTEPNVNPNSSESITIKETSSSSDIE

SEQ ID NO: 2371244 - protein, 4 aa, Entamoeba dispar
NNWE

SEQ ID NO: 2371245 - protein, 4 aa, Entamoeba dispar
NNWS

SEQ ID NO: 2371246 - protein, 5 aa, Entamoeba dispar
NNYCS

SEQ ID NO: 2371247 - protein, 10 aa, Entamoeba dispar
NNYGEGSSLP

SEQ ID NO: 2371248 - protein, 11 aa, Entamoeba dispar
NNYKETNHSSS

SEQ ID NO: 2371249 - protein, 6 aa, Entamoeba dispar
NNYSRF

SEQ ID NO: 2371250 - protein, 5 aa, Entamoeba dispar
NPAEH

SEQ ID NO: 2371251 - protein, 12 aa, Entamoeba dispar
NPAERKLNSSNS

SEQ ID NO: 2371252 - protein, 6 aa, Entamoeba dispar
NPATGK

SEQ ID NO: 2371253 - protein, 6 aa, Entamoeba dispar
NPDDQG

SEQ ID NO: 2371254 - protein, 16 aa, Entamoeba dispar
NPDEGYSSKKKHNTIE

SEQ ID NO: 2371255 - protein, 8 aa, Entamoeba dispar
NPDERPNF

SEQ ID NO: 2371256 - protein, 8 aa, Entamoeba dispar
NPDLPPAV

SEQ ID NO: 2371257 - protein, 7 aa, Entamoeba dispar
NPEFNKL

SEQ ID NO: 2371258 - protein, 9 aa, Entamoeba dispar
NPEKQERIK

SEQ ID NO: 2371259 - protein, 5 aa, Entamoeba dispar
NPERT

SEQ ID NO: 2371260 - protein, 4 aa, Entamoeba dispar
NPFD

SEQ ID NO: 2371261 - protein, 7 aa, Entamoeba dispar
NPFDPVT

SEQ ID NO: 2371262 - protein, 6 aa, Entamoeba dispar
NPFEQE

SEQ ID NO: 2371263 - protein, 7 aa, Entamoeba dispar
NPFKSGN

SEQ ID NO: 2371264 - protein, 7 aa, Entamoeba dispar
NPFQPKQ

SEQ ID NO: 2371265 - protein, 4 aa, Entamoeba dispar
NPFS

SEQ ID NO: 2371266 - protein, 14 aa, Entamoeba dispar
NPFTLSSTHGKGVK

SEQ ID NO: 2371267 - protein, 4 aa, Entamoeba dispar
NPGE

SEQ ID NO: 2371268 - protein, 4 aa, Entamoeba dispar
NPGI

SEQ ID NO: 2371269 - protein, 9 aa, Entamoeba dispar
NPGIGPSAD

SEQ ID NO: 2371270 - protein, 10 aa, Entamoeba dispar
NPGPTGDSKV

SEQ ID NO: 2371271 - protein, 7 aa, Entamoeba dispar
NPHNPEE

SEQ ID NO: 2371272 - protein, 4 aa, Entamoeba dispar
NPHT

SEQ ID NO: 2371273 - protein, 4 aa, Entamoeba dispar
NPID

SEQ ID NO: 2371274 - protein, 4 aa, Entamoeba dispar
NPIE

SEQ ID NO: 2371275 - protein, 20 aa, Entamoeba dispar
NPIEKSTDLIKTPNVPVGDR

SEQ ID NO: 2371276 - protein, 7 aa, Entamoeba dispar
NPIETQQ

SEQ ID NO: 2371277 - protein, 7 aa, Entamoeba dispar
NPIETTK

SEQ ID NO: 2371278 - protein, 13 aa, Entamoeba dispar
NPIFDTPSSYGYY

SEQ ID NO: 2371279 - protein, 6 aa, Entamoeba dispar
NPIGAD

SEQ ID NO: 2371280 - protein, 5 aa, Entamoeba dispar
NPIKN

SEQ ID NO: 2371281 - protein, 12 aa, Entamoeba dispar
NPIKSDNKKFTE

SEQ ID NO: 2371282 - protein, 4 aa, Entamoeba dispar
NPIM

SEQ ID NO: 2371283 - protein, 16 aa, Entamoeba dispar
NPINEQPSQQTRDQKI

SEQ ID NO: 2371284 - protein, 36 aa, Entamoeba dispar
NPIQNSESTLTSNSTINGPQSETEKEQKNTTQQPID

SEQ ID NO: 2371285 - protein, 7 aa, Entamoeba dispar
NPIQTTS

SEQ ID NO: 2371286 - protein, 8 aa, Entamoeba dispar
NPIRKKEF

SEQ ID NO: 2371287 - protein, 17 aa, Entamoeba dispar
NPISTVSSSSNLQTQDQ

SEQ ID NO: 2371288 - protein, 9 aa, Entamoeba dispar
NPKEEIEKA

SEQ ID NO: 2371289 - protein, 7 aa, Entamoeba dispar
NPKINTN

SEQ ID NO: 2371290 - protein, 10 aa, Entamoeba dispar
NPKPAPQNHA

SEQ ID NO: 2371291 - protein, 5 aa, Entamoeba dispar
NPKRK

SEQ ID NO: 2371292 - protein, 8 aa, Entamoeba dispar
NPLASAGL

SEQ ID NO: 2371293 - protein, 5 aa, Entamoeba dispar
NPLPK

SEQ ID NO: 2371294 - protein, 4 aa, Entamoeba dispar
NPLS

SEQ ID NO: 2371295 - protein, 6 aa, Entamoeba dispar
NPLSES

SEQ ID NO: 2371296 - protein, 7 aa, Entamoeba dispar
NPLTKEE

SEQ ID NO: 2371297 - protein, 6 aa, Entamoeba dispar
NPLTSK

SEQ ID NO: 2371298 - protein, 4 aa, Entamoeba dispar
NPND

SEQ ID NO: 2371299 - protein, 4 aa, Entamoeba dispar
NPNF

SEQ ID NO: 2371300 - protein, 12 aa, Entamoeba dispar
NPNHYSSLLFAS

SEQ ID NO: 2371301 - protein, 5 aa, Entamoeba dispar
NPNIG

SEQ ID NO: 2371302 - protein, 9 aa, Entamoeba dispar
NPNKKEREP

SEQ ID NO: 2371303 - protein, 11 aa, Entamoeba dispar
NPNNTDEQKEI

SEQ ID NO: 2371304 - protein, 5 aa, Entamoeba dispar
NPNNW

SEQ ID NO: 2371305 - protein, 5 aa, Entamoeba dispar
NPNSI

SEQ ID NO: 2371306 - protein, 12 aa, Entamoeba dispar
NPNSLSPSQVSD

SEQ ID NO: 2371307 - protein, 8 aa, Entamoeba dispar
NPNSNYSE

SEQ ID NO: 2371308 - protein, 4 aa, Entamoeba dispar
NPNW

SEQ ID NO: 2371309 - protein, 13 aa, Entamoeba dispar
NPPKFNEPTKTNI

SEQ ID NO: 2371310 - protein, 5 aa, Entamoeba dispar
NPPNE

SEQ ID NO: 2371311 - protein, 6 aa, Entamoeba dispar
NPPSLP

SEQ ID NO: 2371312 - protein, 7 aa, Entamoeba dispar
NPPTCSS

SEQ ID NO: 2371313 - protein, 11 aa, Entamoeba dispar
NPPTDDGTPSM

SEQ ID NO: 2371314 - protein, 9 aa, Entamoeba dispar
NPPTDNGTI

SEQ ID NO: 2371315 - protein, 11 aa, Entamoeba dispar
NPPTDNGTPNM

SEQ ID NO: 2371316 - protein, 15 aa, Entamoeba dispar
NPPTDSESDDGTPSM

SEQ ID NO: 2371317 - protein, 13 aa, Entamoeba dispar
NPPTESDNGTPSM

SEQ ID NO: 2371318 - protein, 15 aa, Entamoeba dispar
NPPTESESDNGTPNM

SEQ ID NO: 2371319 - protein, 16 aa, Entamoeba dispar
NPPTESESESDNGTTC

SEQ ID NO: 2371320 - protein, 6 aa, Entamoeba dispar
NPQGTL

SEQ ID NO: 2371321 - protein, 19 aa, Entamoeba dispar
NPQGTTYCKEQTSSSSGAL

SEQ ID NO: 2371322 - protein, 12 aa, Entamoeba dispar
NPQHSGDFTTSD

SEQ ID NO: 2371323 - protein, 9 aa, Entamoeba dispar
NPQNTDQSK

SEQ ID NO: 2371324 - protein, 13 aa, Entamoeba dispar
NPQRISKKEEQKI

SEQ ID NO: 2371325 - protein, 16 aa, Entamoeba dispar
NPQSISPLSYEKNNPN

SEQ ID NO: 2371326 - protein, 14 aa, Entamoeba dispar
NPSDLTKNEINDDV

SEQ ID NO: 2371327 - protein, 8 aa, Entamoeba dispar
NPSDPLIG

SEQ ID NO: 2371328 - protein, 6 aa, Entamoeba dispar
NPSEEK

SEQ ID NO: 2371329 - protein, 34 aa, Entamoeba dispar
NPSEENGRYYDGNEEKEDKSNGVEVEVYNDEDEE

SEQ ID NO: 2371330 - protein, 6 aa, Entamoeba dispar
NPSEIE

SEQ ID NO: 2371331 - protein, 5 aa, Entamoeba dispar
NPSEN

SEQ ID NO: 2371332 - protein, 14 aa, Entamoeba dispar
NPSFSNKQCSHAAD

SEQ ID NO: 2371333 - protein, 4 aa, Entamoeba dispar
NPSK

SEQ ID NO: 2371334 - protein, 5 aa, Entamoeba dispar
NPSKE

SEQ ID NO: 2371335 - protein, 5 aa, Entamoeba dispar
NPSKF

SEQ ID NO: 2371336 - protein, 17 aa, Entamoeba dispar
NPSKYLQDNGLSSPNGV

SEQ ID NO: 2371337 - protein, 8 aa, Entamoeba dispar
NPSPSSSF

SEQ ID NO: 2371338 - protein, 5 aa, Entamoeba dispar
NPSRL

SEQ ID NO: 2371339 - protein, 6 aa, Entamoeba dispar
NPSSID

SEQ ID NO: 2371340 - protein, 9 aa, Entamoeba dispar
NPSSIQSEP

SEQ ID NO: 2371341 - protein, 5 aa, Entamoeba dispar
NPSSS

SEQ ID NO: 2371342 - protein, 14 aa, Entamoeba dispar
NPSTESESDNGTLS

SEQ ID NO: 2371343 - protein, 6 aa, Entamoeba dispar
NPTEQI

SEQ ID NO: 2371344 - protein, 6 aa, Entamoeba dispar
NPTEYI

SEQ ID NO: 2371345 - protein, 5 aa, Entamoeba dispar
NPTGL

SEQ ID NO: 2371346 - protein, 14 aa, Entamoeba dispar
NPTGSLNKRSDGIY

SEQ ID NO: 2371347 - protein, 17 aa, Entamoeba dispar
NPTGTLNTQGGQVAISS

SEQ ID NO: 2371348 - protein, 6 aa, Entamoeba dispar
NPTHNP

SEQ ID NO: 2371349 - protein, 4 aa, Entamoeba dispar
NPTI

SEQ ID NO: 2371350 - protein, 7 aa, Entamoeba dispar
NPTIEDE

SEQ ID NO: 2371351 - protein, 9 aa, Entamoeba dispar
NPTIKTPTI

SEQ ID NO: 2371352 - protein, 6 aa, Entamoeba dispar
NPTKCP

SEQ ID NO: 2371353 - protein, 6 aa, Entamoeba dispar
NPTKTI

SEQ ID NO: 2371354 - protein, 7 aa, Entamoeba dispar
NPTNELG

SEQ ID NO: 2371355 - protein, 6 aa, Entamoeba dispar
NPTNKP

SEQ ID NO: 2371356 - protein, 6 aa, Entamoeba dispar
NPTPSM

SEQ ID NO: 2371357 - protein, 5 aa, Entamoeba dispar
NPTQF

SEQ ID NO: 2371358 - protein, 5 aa, Entamoeba dispar
NPTSI

SEQ ID NO: 2371359 - protein, 6 aa, Entamoeba dispar
NPVNNK

SEQ ID NO: 2371360 - protein, 8 aa, Entamoeba dispar
NPVQTYPS

SEQ ID NO: 2371361 - protein, 10 aa, Entamoeba dispar
NPVTKKLSEE

SEQ ID NO: 2371362 - protein, 12 aa, Entamoeba dispar
NPWGKTKTLEGG

SEQ ID NO: 2371363 - protein, 12 aa, Entamoeba dispar
NPYDKDESSQFK

SEQ ID NO: 2371364 - protein, 12 aa, Entamoeba dispar
NPYPHDSFPDTE

SEQ ID NO: 2371365 - protein, 7 aa, Entamoeba dispar
NPYQNND

SEQ ID NO: 2371366 - protein, 6 aa, Entamoeba dispar
NPYSDP

SEQ ID NO: 2371367 - protein, 16 aa, Entamoeba dispar
NQAKASADPNKPTEEM

SEQ ID NO: 2371368 - protein, 8 aa, Entamoeba dispar
NQDDEIHS

SEQ ID NO: 2371369 - protein, 6 aa, Entamoeba dispar
NQDNSV

SEQ ID NO: 2371370 - protein, 11 aa, Entamoeba dispar
NQEDDDNKSSF

SEQ ID NO: 2371371 - protein, 15 aa, Entamoeba dispar
NQEEITKQKNSIRKG

SEQ ID NO: 2371372 - protein, 6 aa, Entamoeba dispar
NQEESL

SEQ ID NO: 2371373 - protein, 13 aa, Entamoeba dispar
NQEISDWRSPKSV

SEQ ID NO: 2371374 - protein, 5 aa, Entamoeba dispar
NQENG

SEQ ID NO: 2371375 - protein, 7 aa, Entamoeba dispar
NQENNDF

SEQ ID NO: 2371376 - protein, 8 aa, Entamoeba dispar
NQEREYEK

SEQ ID NO: 2371377 - protein, 4 aa, Entamoeba dispar
NQES

SEQ ID NO: 2371378 - protein, 5 aa, Entamoeba dispar
NQETK

SEQ ID NO: 2371379 - protein, 8 aa, Entamoeba dispar
NQETQGIT

SEQ ID NO: 2371380 - protein, 8 aa, Entamoeba dispar
NQGECDKC

SEQ ID NO: 2371381 - protein, 9 aa, Entamoeba dispar
NQGIDDSDL

SEQ ID NO: 2371382 - protein, 4 aa, Entamoeba dispar
NQGM

SEQ ID NO: 2371383 - protein, 6 aa, Entamoeba dispar
NQGSTC

SEQ ID NO: 2371384 - protein, 8 aa, Entamoeba dispar
NQGTTIKK

SEQ ID NO: 2371385 - protein, 14 aa, Entamoeba dispar
NQIDERETEQKSKQ

SEQ ID NO: 2371386 - protein, 5 aa, Entamoeba dispar
NQIEE

SEQ ID NO: 2371387 - protein, 4 aa, Entamoeba dispar
NQIN

SEQ ID NO: 2371388 - protein, 5 aa, Entamoeba dispar
NQIPI

SEQ ID NO: 2371389 - protein, 8 aa, Entamoeba dispar
NQIQSIDQ

SEQ ID NO: 2371390 - protein, 9 aa, Entamoeba dispar
NQKAPSTAK

SEQ ID NO: 2371391 - protein, 4 aa, Entamoeba dispar
NQKE

SEQ ID NO: 2371392 - protein, 7 aa, Entamoeba dispar
NQKEHNI

SEQ ID NO: 2371393 - protein, 7 aa, Entamoeba dispar
NQKINKD

SEQ ID NO: 2371394 - protein, 12 aa, Entamoeba dispar
NQKITGKEMKEN

SEQ ID NO: 2371395 - protein, 8 aa, Entamoeba dispar
NQKNTPSV

SEQ ID NO: 2371396 - protein, 20 aa, Entamoeba dispar
NQKPLSKNTLSGGAPKRPSF

SEQ ID NO: 2371397 - protein, 9 aa, Entamoeba dispar
NQKREKDID

SEQ ID NO: 2371398 - protein, 18 aa, Entamoeba dispar
NQKRQIKKNKENKKIKNE

SEQ ID NO: 2371399 - protein, 8 aa, Entamoeba dispar
NQKSPKVK

SEQ ID NO: 2371400 - protein, 8 aa, Entamoeba dispar
NQKTNTEN

SEQ ID NO: 2371401 - protein, 14 aa, Entamoeba dispar
NQLKDKSATKPSNW

SEQ ID NO: 2371402 - protein, 14 aa, Entamoeba dispar
NQLKDKSSRKPSNW

SEQ ID NO: 2371403 - protein, 9 aa, Entamoeba dispar
NQLKETQFN

SEQ ID NO: 2371404 - protein, 5 aa, Entamoeba dispar
NQLNE

SEQ ID NO: 2371405 - protein, 9 aa, Entamoeba dispar
NQLPQNKNE

SEQ ID NO: 2371406 - protein, 9 aa, Entamoeba dispar
NQLQNKEAV

SEQ ID NO: 2371407 - protein, 9 aa, Entamoeba dispar
NQLTPLDER

SEQ ID NO: 2371408 - protein, 13 aa, Entamoeba dispar
NQMSEKQKQEFKN

SEQ ID NO: 2371409 - protein, 4 aa, Entamoeba dispar
NQND

SEQ ID NO: 2371410 - protein, 10 aa, Entamoeba dispar
NQNEDTYNTS

SEQ ID NO: 2371411 - protein, 6 aa, Entamoeba dispar
NQNGFS

SEQ ID NO: 2371412 - protein, 10 aa, Entamoeba dispar
NQNIGGGQCS

SEQ ID NO: 2371413 - protein, 5 aa, Entamoeba dispar
NQNNS

SEQ ID NO: 2371414 - protein, 9 aa, Entamoeba dispar
NQNPDDRPT

SEQ ID NO: 2371415 - protein, 8 aa, Entamoeba dispar
NQNPKERI

SEQ ID NO: 2371416 - protein, 7 aa, Entamoeba dispar
NQNPPIC

SEQ ID NO: 2371417 - protein, 12 aa, Entamoeba dispar
NQNRSRMNNKKY

SEQ ID NO: 2371418 - protein, 13 aa, Entamoeba dispar
NQNTTNPTPQKEI

SEQ ID NO: 2371419 - protein, 4 aa, Entamoeba dispar
NQPA

SEQ ID NO: 2371420 - protein, 33 aa, Entamoeba dispar
NQPDESENQDRDEESNEDSDEVKEVKSHGEEMA

SEQ ID NO: 2371421 - protein, 15 aa, Entamoeba dispar
NQPFPDKPSSEVSGV

SEQ ID NO: 2371422 - protein, 6 aa, Entamoeba dispar
NQPKTC

SEQ ID NO: 2371423 - protein, 7 aa, Entamoeba dispar
NQPRDKH

SEQ ID NO: 2371424 - protein, 13 aa, Entamoeba dispar
NQPSAPVIPGPHI

SEQ ID NO: 2371425 - protein, 6 aa, Entamoeba dispar
NQPSNL

SEQ ID NO: 2371426 - protein, 4 aa, Entamoeba dispar
NQPT

SEQ ID NO: 2371427 - protein, 7 aa, Entamoeba dispar
NQPTSAE

SEQ ID NO: 2371428 - protein, 11 aa, Entamoeba dispar
NQPTSRFSSQT

SEQ ID NO: 2371429 - protein, 13 aa, Entamoeba dispar
NQPVDSRAKPQRS

SEQ ID NO: 2371430 - protein, 5 aa, Entamoeba dispar
NQPYL

SEQ ID NO: 2371431 - protein, 11 aa, Entamoeba dispar
NQPYTKTPIDK

SEQ ID NO: 2371432 - protein, 4 aa, Entamoeba dispar
NQQE

SEQ ID NO: 2371433 - protein, 4 aa, Entamoeba dispar
NQQI

SEQ ID NO: 2371434 - protein, 8 aa, Entamoeba dispar
NQQPFDNI

SEQ ID NO: 2371435 - protein, 6 aa, Entamoeba dispar
NQQQNE

SEQ ID NO: 2371436 - protein, 16 aa, Entamoeba dispar
NQQQQAKYREKEENGL

SEQ ID NO: 2371437 - protein, 25 aa, Entamoeba dispar
NQRKRKPYKTGLADTIESTKEIENN

SEQ ID NO: 2371438 - protein, 7 aa, Entamoeba dispar
NQRNIKR

SEQ ID NO: 2371439 - protein, 6 aa, Entamoeba dispar
NQRSQS

SEQ ID NO: 2371440 - protein, 16 aa, Entamoeba dispar
NQRSSQMTKNGIGRKQ

SEQ ID NO: 2371441 - protein, 6 aa, Entamoeba dispar
NQRTTL

SEQ ID NO: 2371442 - protein, 5 aa, Entamoeba dispar
NQSEL

SEQ ID NO: 2371443 - protein, 10 aa, Entamoeba dispar
NQSKNYGNEK

SEQ ID NO: 2371444 - protein, 10 aa, Entamoeba dispar
NQSNLPISSN

SEQ ID NO: 2371445 - protein, 14 aa, Entamoeba dispar
NQSQKSKKDIHSED

SEQ ID NO: 2371446 - protein, 27 aa, Entamoeba dispar
NQSSSDHSTSPVPEPQTTSNNLTTPSI

SEQ ID NO: 2371447 - protein, 16 aa, Entamoeba dispar
NQTFGSTVSTMDPSPI

SEQ ID NO: 2371448 - protein, 4 aa, Entamoeba dispar
NQTI

SEQ ID NO: 2371449 - protein, 10 aa, Entamoeba dispar
NQTLKNASIN

SEQ ID NO: 2371450 - protein, 5 aa, Entamoeba dispar
NQTNN

SEQ ID NO: 2371451 - protein, 7 aa, Entamoeba dispar
NQTQSTF

SEQ ID NO: 2371452 - protein, 7 aa, Entamoeba dispar
NQTSSHG

SEQ ID NO: 2371453 - protein, 15 aa, Entamoeba dispar
NQTYSVDSAEEIKEE

SEQ ID NO: 2371454 - protein, 11 aa, Entamoeba dispar
NQVKESSFKAN

SEQ ID NO: 2371455 - protein, 7 aa, Entamoeba dispar
NQVNGKI

SEQ ID NO: 2371456 - protein, 6 aa, Entamoeba dispar
NQVNTK

SEQ ID NO: 2371457 - protein, 9 aa, Entamoeba dispar
NQVPSNTMG

SEQ ID NO: 2371458 - protein, 25 aa, Entamoeba dispar
NQVTIEPTKQEETKQENKDKFVDPL

SEQ ID NO: 2371459 - protein, 6 aa, Entamoeba dispar
NQWNQI

SEQ ID NO: 2371460 - protein, 4 aa, Entamoeba dispar
NQYL

SEQ ID NO: 2371461 - protein, 20 aa, Entamoeba dispar
NQYPTYREATTTGIPPNYKG

SEQ ID NO: 2371462 - protein, 5 aa, Entamoeba dispar
NQYYG

SEQ ID NO: 2371463 - protein, 5 aa, Entamoeba dispar
NRADI

SEQ ID NO: 2371464 - protein, 10 aa, Entamoeba dispar
NRDKSTDYQT

SEQ ID NO: 2371465 - protein, 4 aa, Entamoeba dispar
NRDQ

SEQ ID NO: 2371466 - protein, 15 aa, Entamoeba dispar
NREIESFEKESTENL

SEQ ID NO: 2371467 - protein, 5 aa, Entamoeba dispar
NRFNP

SEQ ID NO: 2371468 - protein, 5 aa, Entamoeba dispar
NRGCC

SEQ ID NO: 2371469 - protein, 13 aa, Entamoeba dispar
NRGITCPDSTPLL

SEQ ID NO: 2371470 - protein, 6 aa, Entamoeba dispar
NRHHPK

SEQ ID NO: 2371471 - protein, 5 aa, Entamoeba dispar
NRIGS

SEQ ID NO: 2371472 - protein, 24 aa, Entamoeba dispar
NRINEQLKDEYSKEYNKKLQEMRK

SEQ ID NO: 2371473 - protein, 8 aa, Entamoeba dispar
NRIPETND

SEQ ID NO: 2371474 - protein, 18 aa, Entamoeba dispar
NRIPPSQVDKWASQCIES

SEQ ID NO: 2371475 - protein, 32 aa, Entamoeba dispar
NRKDSFNEITPKINQPNKFPSIEDSQENNLQQ

SEQ ID NO: 2371476 - protein, 32 aa, Entamoeba dispar
NRKDSFNEITPKINQPNKVPSIEDSQENNLQQ

SEQ ID NO: 2371477 - protein, 6 aa, Entamoeba dispar
NRKGFP

SEQ ID NO: 2371478 - protein, 26 aa, Entamoeba dispar
NRKKEKEQINEKYNKKEIENEGFKEK

SEQ ID NO: 2371479 - protein, 4 aa, Entamoeba dispar
NRKQ

SEQ ID NO: 2371480 - protein, 6 aa, Entamoeba dispar
NRKRED

SEQ ID NO: 2371481 - protein, 8 aa, Entamoeba dispar
NRKRRDDE

SEQ ID NO: 2371482 - protein, 9 aa, Entamoeba dispar
NRKSENNSY

SEQ ID NO: 2371483 - protein, 6 aa, Entamoeba dispar
NRKTFG

SEQ ID NO: 2371484 - protein, 7 aa, Entamoeba dispar
NRKTKED

SEQ ID NO: 2371485 - protein, 10 aa, Entamoeba dispar
NRLDCPEKVN

SEQ ID NO: 2371486 - protein, 10 aa, Entamoeba dispar
NRLDDSQKQI

SEQ ID NO: 2371487 - protein, 11 aa, Entamoeba dispar
NRLEKPDGIPD

SEQ ID NO: 2371488 - protein, 11 aa, Entamoeba dispar
NRLEKPDGIPE

SEQ ID NO: 2371489 - protein, 11 aa, Entamoeba dispar
NRLSKPDSIPD

SEQ ID NO: 2371490 - protein, 9 aa, Entamoeba dispar
NRMGESNLS

SEQ ID NO: 2371491 - protein, 21 aa, Entamoeba dispar
NRMSHKSKSTGTFNEQTRNTT

SEQ ID NO: 2371492 - protein, 4 aa, Entamoeba dispar
NRNG

SEQ ID NO: 2371493 - protein, 15 aa, Entamoeba dispar
NRNGKNQIDNNKQRV

SEQ ID NO: 2371494 - protein, 13 aa, Entamoeba dispar
NRPEETKNSFTED

SEQ ID NO: 2371495 - protein, 7 aa, Entamoeba dispar
NRPLSPD

SEQ ID NO: 2371496 - protein, 17 aa, Entamoeba dispar
NRQKSLSSNTPSSSSLG

SEQ ID NO: 2371497 - protein, 11 aa, Entamoeba dispar
NRREHSYDPQR

SEQ ID NO: 2371498 - protein, 6 aa, Entamoeba dispar
NRRKEL

SEQ ID NO: 2371499 - protein, 14 aa, Entamoeba dispar
NRSEEFKQSPLPKP

SEQ ID NO: 2371500 - protein, 6 aa, Entamoeba dispar
NRSIEG

SEQ ID NO: 2371501 - protein, 6 aa, Entamoeba dispar
NRSKDK

SEQ ID NO: 2371502 - protein, 4 aa, Entamoeba dispar
NRSM

SEQ ID NO: 2371503 - protein, 7 aa, Entamoeba dispar
NRSNEKG

SEQ ID NO: 2371504 - protein, 10 aa, Entamoeba dispar
NRSNNEINGM

SEQ ID NO: 2371505 - protein, 52 aa, Entamoeba dispar
NRSSSSEDISPSVTKSEPQLIPKTTPTPPQNKLPSPQPNTTSISGSQTPKQH

SEQ ID NO: 2371506 - protein, 15 aa, Entamoeba dispar
NRTEPISGIEKDPER

SEQ ID NO: 2371507 - protein, 17 aa, Entamoeba dispar
NRTNTGSCKDRSRYCSS

SEQ ID NO: 2371508 - protein, 5 aa, Entamoeba dispar
NRTPV

SEQ ID NO: 2371509 - protein, 9 aa, Entamoeba dispar
NRTSRNREG

SEQ ID NO: 2371510 - protein, 4 aa, Entamoeba dispar
NRTT

SEQ ID NO: 2371511 - protein, 18 aa, Entamoeba dispar
NRTTEYIENEELKNEYGS

SEQ ID NO: 2371512 - protein, 5 aa, Entamoeba dispar
NRTTI

SEQ ID NO: 2371513 - protein, 4 aa, Entamoeba dispar
NRTV

SEQ ID NO: 2371514 - protein, 7 aa, Entamoeba dispar
NRTVTEA

SEQ ID NO: 2371515 - protein, 4 aa, Entamoeba dispar
NRTY

SEQ ID NO: 2371516 - protein, 5 aa, Entamoeba dispar
NRVKE

SEQ ID NO: 2371517 - protein, 4 aa, Entamoeba dispar
NRYP

SEQ ID NO: 2371518 - protein, 7 aa, Entamoeba dispar
NRYSEEE

SEQ ID NO: 2371519 - protein, 7 aa, Entamoeba dispar
NSADDPV

SEQ ID NO: 2371520 - protein, 4 aa, Entamoeba dispar
NSAF

SEQ ID NO: 2371521 - protein, 9 aa, Entamoeba dispar
NSAGIEDTG

SEQ ID NO: 2371522 - protein, 6 aa, Entamoeba dispar
NSALDF

SEQ ID NO: 2371523 - protein, 10 aa, Entamoeba dispar
NSATKNQKNF

SEQ ID NO: 2371524 - protein, 16 aa, Entamoeba dispar
NSATKRKRKANNLPPR

SEQ ID NO: 2371525 - protein, 7 aa, Entamoeba dispar
NSATSRD

SEQ ID NO: 2371526 - protein, 17 aa, Entamoeba dispar
NSCDSTKCTSCKPGYKQ

SEQ ID NO: 2371527 - protein, 5 aa, Entamoeba dispar
NSCQE

SEQ ID NO: 2371528 - protein, 17 aa, Entamoeba dispar
NSCSSSGLTSSSDSDFK

SEQ ID NO: 2371529 - protein, 6 aa, Entamoeba dispar
NSCTRC

SEQ ID NO: 2371530 - protein, 7 aa, Entamoeba dispar
NSDDGYD

SEQ ID NO: 2371531 - protein, 8 aa, Entamoeba dispar
NSDEKIQS

SEQ ID NO: 2371532 - protein, 8 aa, Entamoeba dispar
NSDGECST

SEQ ID NO: 2371533 - protein, 4 aa, Entamoeba dispar
NSDK

SEQ ID NO: 2371534 - protein, 8 aa, Entamoeba dispar
NSDQKAFT

SEQ ID NO: 2371535 - protein, 5 aa, Entamoeba dispar
NSDRK

SEQ ID NO: 2371536 - protein, 8 aa, Entamoeba dispar
NSDSYETQ

SEQ ID NO: 2371537 - protein, 6 aa, Entamoeba dispar
NSDVRV

SEQ ID NO: 2371538 - protein, 4 aa, Entamoeba dispar
NSEE

SEQ ID NO: 2371539 - protein, 5 aa, Entamoeba dispar
NSEEL

SEQ ID NO: 2371540 - protein, 12 aa, Entamoeba dispar
NSEGKKIKHKYE

SEQ ID NO: 2371541 - protein, 4 aa, Entamoeba dispar
NSEI

SEQ ID NO: 2371542 - protein, 5 aa, Entamoeba dispar
NSELN

SEQ ID NO: 2371543 - protein, 7 aa, Entamoeba dispar
NSENEMS

SEQ ID NO: 2371544 - protein, 5 aa, Entamoeba dispar
NSERT

SEQ ID NO: 2371545 - protein, 7 aa, Entamoeba dispar
NSESQMS

SEQ ID NO: 2371546 - protein, 4 aa, Entamoeba dispar
NSET

SEQ ID NO: 2371547 - protein, 8 aa, Entamoeba dispar
NSETKDTG

SEQ ID NO: 2371548 - protein, 6 aa, Entamoeba dispar
NSETPH

SEQ ID NO: 2371549 - protein, 6 aa, Entamoeba dispar
NSEYTT

SEQ ID NO: 2371550 - protein, 19 aa, Entamoeba dispar
NSFAQSGDIDFSAQQNEQV

SEQ ID NO: 2371551 - protein, 13 aa, Entamoeba dispar
NSFDNSTSFQPNQ

SEQ ID NO: 2371552 - protein, 26 aa, Entamoeba dispar
NSFKETLNQSYQHYGDPHVGGSDEIA

SEQ ID NO: 2371553 - protein, 4 aa, Entamoeba dispar
NSFT

SEQ ID NO: 2371554 - protein, 7 aa, Entamoeba dispar
NSFTPQT

SEQ ID NO: 2371555 - protein, 5 aa, Entamoeba dispar
NSFTQ

SEQ ID NO: 2371556 - protein, 16 aa, Entamoeba dispar
NSGADIRVKTSNSLNV

SEQ ID NO: 2371557 - protein, 4 aa, Entamoeba dispar
NSGG

SEQ ID NO: 2371558 - protein, 4 aa, Entamoeba dispar
NSGI

SEQ ID NO: 2371559 - protein, 15 aa, Entamoeba dispar
NSGISNKEEEITDIK

SEQ ID NO: 2371560 - protein, 7 aa, Entamoeba dispar
NSGKNEI

SEQ ID NO: 2371561 - protein, 5 aa, Entamoeba dispar
NSGLT

SEQ ID NO: 2371562 - protein, 19 aa, Entamoeba dispar
NSGPEPQQAAAPVAERPKT

SEQ ID NO: 2371563 - protein, 13 aa, Entamoeba dispar
NSGPSGESIGYSN

SEQ ID NO: 2371564 - protein, 9 aa, Entamoeba dispar
NSGSCSDAS

SEQ ID NO: 2371565 - protein, 6 aa, Entamoeba dispar
NSHEQT

SEQ ID NO: 2371566 - protein, 10 aa, Entamoeba dispar
NSHSPRNKKT

SEQ ID NO: 2371567 - protein, 4 aa, Entamoeba dispar
NSHT

SEQ ID NO: 2371568 - protein, 8 aa, Entamoeba dispar
NSIDDTPT

SEQ ID NO: 2371569 - protein, 8 aa, Entamoeba dispar
NSIDKKKI

SEQ ID NO: 2371570 - protein, 7 aa, Entamoeba dispar
NSIEGRR

SEQ ID NO: 2371571 - protein, 5 aa, Entamoeba dispar
NSIET

SEQ ID NO: 2371572 - protein, 6 aa, Entamoeba dispar
NSIGEK

SEQ ID NO: 2371573 - protein, 6 aa, Entamoeba dispar
NSIKDE

SEQ ID NO: 2371574 - protein, 6 aa, Entamoeba dispar
NSIKRQ

SEQ ID NO: 2371575 - protein, 5 aa, Entamoeba dispar
NSINH

SEQ ID NO: 2371576 - protein, 10 aa, Entamoeba dispar
NSINPSVNED

SEQ ID NO: 2371577 - protein, 11 aa, Entamoeba dispar
NSIPDLKTRNK

SEQ ID NO: 2371578 - protein, 5 aa, Entamoeba dispar
NSIPN

SEQ ID NO: 2371579 - protein, 43 aa, Entamoeba dispar
NSIQTSSNSIKADNSITQSITSISNSLSDNSSFKTSSTNEEMK

SEQ ID NO: 2371580 - protein, 4 aa, Entamoeba dispar
NSIS

SEQ ID NO: 2371581 - protein, 21 aa, Entamoeba dispar
NSISEETDESEITGKSQSNTI

SEQ ID NO: 2371582 - protein, 6 aa, Entamoeba dispar
NSISSI

SEQ ID NO: 2371583 - protein, 27 aa, Entamoeba dispar
NSITETTKLRANDYGYEPCGNDEGRSY

SEQ ID NO: 2371584 - protein, 10 aa, Entamoeba dispar
NSITTSDRRL

SEQ ID NO: 2371585 - protein, 6 aa, Entamoeba dispar
NSKCES

SEQ ID NO: 2371586 - protein, 20 aa, Entamoeba dispar
NSKCIPKGKDCSLADQAGCK

SEQ ID NO: 2371587 - protein, 6 aa, Entamoeba dispar
NSKDDY

SEQ ID NO: 2371588 - protein, 14 aa, Entamoeba dispar
NSKDSDDEKQNETI

SEQ ID NO: 2371589 - protein, 7 aa, Entamoeba dispar
NSKEKKV

SEQ ID NO: 2371590 - protein, 6 aa, Entamoeba dispar
NSKKEV

SEQ ID NO: 2371591 - protein, 9 aa, Entamoeba dispar
NSKKSSINS

SEQ ID NO: 2371592 - protein, 8 aa, Entamoeba dispar
NSKKTTSV

SEQ ID NO: 2371593 - protein, 15 aa, Entamoeba dispar
NSKLNPDKELGDYED

SEQ ID NO: 2371594 - protein, 12 aa, Entamoeba dispar
NSKLQKSIESNS

SEQ ID NO: 2371595 - protein, 12 aa, Entamoeba dispar
NSKNCRDKSYGL

SEQ ID NO: 2371596 - protein, 10 aa, Entamoeba dispar
NSKNESRSEM

SEQ ID NO: 2371597 - protein, 8 aa, Entamoeba dispar
NSKPEEIG

SEQ ID NO: 2371598 - protein, 8 aa, Entamoeba dispar
NSKSQAKI

SEQ ID NO: 2371599 - protein, 14 aa, Entamoeba dispar
NSKSRSTCTNPAVD

SEQ ID NO: 2371600 - protein, 10 aa, Entamoeba dispar
NSKSSDGQAI

SEQ ID NO: 2371601 - protein, 6 aa, Entamoeba dispar
NSKSSS

SEQ ID NO: 2371602 - protein, 10 aa, Entamoeba dispar
NSKTIDEGTV

SEQ ID NO: 2371603 - protein, 6 aa, Entamoeba dispar
NSKTTC

SEQ ID NO: 2371604 - protein, 7 aa, Entamoeba dispar
NSKVPIN

SEQ ID NO: 2371605 - protein, 11 aa, Entamoeba dispar
NSLDEQHDFER

SEQ ID NO: 2371606 - protein, 13 aa, Entamoeba dispar
NSLDTTGKEYSYQ

SEQ ID NO: 2371607 - protein, 7 aa, Entamoeba dispar
NSLPTIS

SEQ ID NO: 2371608 - protein, 18 aa, Entamoeba dispar
NSLTLDGQCSSNEKTNNC

SEQ ID NO: 2371609 - protein, 26 aa, Entamoeba dispar
NSLTPSKYIGKNRERSFSDPLQPSIN

SEQ ID NO: 2371610 - protein, 5 aa, Entamoeba dispar
NSMAD

SEQ ID NO: 2371611 - protein, 9 aa, Entamoeba dispar
NSMAQNGSR

SEQ ID NO: 2371612 - protein, 8 aa, Entamoeba dispar
NSMDTPKN

SEQ ID NO: 2371613 - protein, 4 aa, Entamoeba dispar
NSMS

SEQ ID NO: 2371614 - protein, 6 aa, Entamoeba dispar
NSMSEK

SEQ ID NO: 2371615 - protein, 8 aa, Entamoeba dispar
NSNDNDDD

SEQ ID NO: 2371616 - protein, 7 aa, Entamoeba dispar
NSNDPNI

SEQ ID NO: 2371617 - protein, 7 aa, Entamoeba dispar
NSNEDNI

SEQ ID NO: 2371618 - protein, 7 aa, Entamoeba dispar
NSNEEGK

SEQ ID NO: 2371619 - protein, 6 aa, Entamoeba dispar
NSNEKQ

SEQ ID NO: 2371620 - protein, 6 aa, Entamoeba dispar
NSNENL

SEQ ID NO: 2371621 - protein, 15 aa, Entamoeba dispar
NSNEQETQDENNKKD

SEQ ID NO: 2371622 - protein, 7 aa, Entamoeba dispar
NSNGGNY

SEQ ID NO: 2371623 - protein, 6 aa, Entamoeba dispar
NSNGIE

SEQ ID NO: 2371624 - protein, 7 aa, Entamoeba dispar
NSNGKLE

SEQ ID NO: 2371625 - protein, 8 aa, Entamoeba dispar
NSNIKNAM

SEQ ID NO: 2371626 - protein, 8 aa, Entamoeba dispar
NSNIQDNT

SEQ ID NO: 2371627 - protein, 7 aa, Entamoeba dispar
NSNKNEF

SEQ ID NO: 2371628 - protein, 8 aa, Entamoeba dispar
NSNNATPV

SEQ ID NO: 2371629 - protein, 6 aa, Entamoeba dispar
NSNNKI

SEQ ID NO: 2371630 - protein, 7 aa, Entamoeba dispar
NSNNNIS

SEQ ID NO: 2371631 - protein, 9 aa, Entamoeba dispar
NSNNNSNKL

SEQ ID NO: 2371632 - protein, 16 aa, Entamoeba dispar
NSNNPILPEESNDLDG

SEQ ID NO: 2371633 - protein, 6 aa, Entamoeba dispar
NSNNPK

SEQ ID NO: 2371634 - protein, 7 aa, Entamoeba dispar
NSNNYSH

SEQ ID NO: 2371635 - protein, 4 aa, Entamoeba dispar
NSNP

SEQ ID NO: 2371636 - protein, 7 aa, Entamoeba dispar
NSNPEGK

SEQ ID NO: 2371637 - protein, 14 aa, Entamoeba dispar
NSNPTNLKFSSNNG

SEQ ID NO: 2371638 - protein, 6 aa, Entamoeba dispar
NSNPTT

SEQ ID NO: 2371639 - protein, 6 aa, Entamoeba dispar
NSNQIF

SEQ ID NO: 2371640 - protein, 6 aa, Entamoeba dispar
NSNRIY

SEQ ID NO: 2371641 - protein, 7 aa, Entamoeba dispar
NSNRRER

SEQ ID NO: 2371642 - protein, 7 aa, Entamoeba dispar
NSNSFGN

SEQ ID NO: 2371643 - protein, 7 aa, Entamoeba dispar
NSNSFNY

SEQ ID NO: 2371644 - protein, 7 aa, Entamoeba dispar
NSNSKIE

SEQ ID NO: 2371645 - protein, 7 aa, Entamoeba dispar
NSNSLNS

SEQ ID NO: 2371646 - protein, 6 aa, Entamoeba dispar
NSNSLT

SEQ ID NO: 2371647 - protein, 5 aa, Entamoeba dispar
NSNSQ

SEQ ID NO: 2371648 - protein, 6 aa, Entamoeba dispar
NSNSYE

SEQ ID NO: 2371649 - protein, 4 aa, Entamoeba dispar
NSNY

SEQ ID NO: 2371650 - protein, 6 aa, Entamoeba dispar
NSNYLD

SEQ ID NO: 2371651 - protein, 46 aa, Entamoeba dispar
NSPDDDDDDDDDNNDSSSSQTPTESSSSSNNNNNKDDDDNINDSTP

SEQ ID NO: 2371652 - protein, 20 aa, Entamoeba dispar
NSPGQSHSVSVDDDVSGNSL

SEQ ID NO: 2371653 - protein, 7 aa, Entamoeba dispar
NSPHQRP

SEQ ID NO: 2371654 - protein, 7 aa, Entamoeba dispar
NSPIPKI

SEQ ID NO: 2371655 - protein, 13 aa, Entamoeba dispar
NSPIPNEKNIDGD

SEQ ID NO: 2371656 - protein, 7 aa, Entamoeba dispar
NSPNNSH

SEQ ID NO: 2371657 - protein, 8 aa, Entamoeba dispar
NSPNSIEK

SEQ ID NO: 2371658 - protein, 10 aa, Entamoeba dispar
NSPQPSFSNN

SEQ ID NO: 2371659 - protein, 5 aa, Entamoeba dispar
NSPQS

SEQ ID NO: 2371660 - protein, 6 aa, Entamoeba dispar
NSPRNV

SEQ ID NO: 2371661 - protein, 8 aa, Entamoeba dispar
NSPSLTSS

SEQ ID NO: 2371662 - protein, 6 aa, Entamoeba dispar
NSPTFT

SEQ ID NO: 2371663 - protein, 7 aa, Entamoeba dispar
NSPTRII

SEQ ID NO: 2371664 - protein, 9 aa, Entamoeba dispar
NSPTRITGG

SEQ ID NO: 2371665 - protein, 6 aa, Entamoeba dispar
NSQCNQ

SEQ ID NO: 2371666 - protein, 7 aa, Entamoeba dispar
NSQIGNR

SEQ ID NO: 2371667 - protein, 7 aa, Entamoeba dispar
NSQIYTS

SEQ ID NO: 2371668 - protein, 5 aa, Entamoeba dispar
NSQKG

SEQ ID NO: 2371669 - protein, 10 aa, Entamoeba dispar
NSQKPLTSKE

SEQ ID NO: 2371670 - protein, 10 aa, Entamoeba dispar
NSQKTEQQKQ

SEQ ID NO: 2371671 - protein, 10 aa, Entamoeba dispar
NSQNDDPNQD

SEQ ID NO: 2371672 - protein, 7 aa, Entamoeba dispar
NSQNEGR

SEQ ID NO: 2371673 - protein, 5 aa, Entamoeba dispar
NSQPD

SEQ ID NO: 2371674 - protein, 7 aa, Entamoeba dispar
NSQPELY

SEQ ID NO: 2371675 - protein, 9 aa, Entamoeba dispar
NSQPPSVTI

SEQ ID NO: 2371676 - protein, 6 aa, Entamoeba dispar
NSQQPL

SEQ ID NO: 2371677 - protein, 8 aa, Entamoeba dispar
NSQTNEPD

SEQ ID NO: 2371678 - protein, 8 aa, Entamoeba dispar
NSQTTNGY

SEQ ID NO: 2371679 - protein, 6 aa, Entamoeba dispar
NSQTTQ

SEQ ID NO: 2371680 - protein, 6 aa, Entamoeba dispar
NSQYKR

SEQ ID NO: 2371681 - protein, 23 aa, Entamoeba dispar
NSRCSQCERGYEISSSGVSCEEK

SEQ ID NO: 2371682 - protein, 7 aa, Entamoeba dispar
NSRESAA

SEQ ID NO: 2371683 - protein, 4 aa, Entamoeba dispar
NSRF

SEQ ID NO: 2371684 - protein, 7 aa, Entamoeba dispar
NSRFESK

SEQ ID NO: 2371685 - protein, 8 aa, Entamoeba dispar
NSRIPADG

SEQ ID NO: 2371686 - protein, 6 aa, Entamoeba dispar
NSSCSS

SEQ ID NO: 2371687 - protein, 6 aa, Entamoeba dispar
NSSDSL

SEQ ID NO: 2371688 - protein, 7 aa, Entamoeba dispar
NSSESFP

SEQ ID NO: 2371689 - protein, 29 aa, Entamoeba dispar
NSSESKCSECSKGYRLDDEETGCVEKKKN

SEQ ID NO: 2371690 - protein, 5 aa, Entamoeba dispar
NSSEV

SEQ ID NO: 2371691 - protein, 6 aa, Entamoeba dispar
NSSGES

SEQ ID NO: 2371692 - protein, 15 aa, Entamoeba dispar
NSSISPDTTNDSNNI

SEQ ID NO: 2371693 - protein, 17 aa, Entamoeba dispar
NSSITQTEKQLKSISNL

SEQ ID NO: 2371694 - protein, 10 aa, Entamoeba dispar
NSSKPADGIY

SEQ ID NO: 2371695 - protein, 8 aa, Entamoeba dispar
NSSKPSSF

SEQ ID NO: 2371696 - protein, 5 aa, Entamoeba dispar
NSSKT

SEQ ID NO: 2371697 - protein, 5 aa, Entamoeba dispar
NSSLT

SEQ ID NO: 2371698 - protein, 10 aa, Entamoeba dispar
NSSNGTNDNE

SEQ ID NO: 2371699 - protein, 8 aa, Entamoeba dispar
NSSPSTPL

SEQ ID NO: 2371700 - protein, 6 aa, Entamoeba dispar
NSSPTN

SEQ ID NO: 2371701 - protein, 6 aa, Entamoeba dispar
NSSQGG

SEQ ID NO: 2371702 - protein, 55 aa, Entamoeba dispar
NSSQNSDISDELRNKSDTTSSYSTDKGHTITKSSSGISNGSGQSKSKKNKEDRLK

SEQ ID NO: 2371703 - protein, 5 aa, Entamoeba dispar
NSSRE

SEQ ID NO: 2371704 - protein, 9 aa, Entamoeba dispar
NSSSDKIQS

SEQ ID NO: 2371705 - protein, 8 aa, Entamoeba dispar
NSSSSTQL

SEQ ID NO: 2371706 - protein, 10 aa, Entamoeba dispar
NSSSVNSKSR

SEQ ID NO: 2371707 - protein, 22 aa, Entamoeba dispar
NSSTITIGSQAVEENNTVATGN

SEQ ID NO: 2371708 - protein, 19 aa, Entamoeba dispar
NSSTKVNEKGETEMIGDPT

SEQ ID NO: 2371709 - protein, 7 aa, Entamoeba dispar
NSSTSEV

SEQ ID NO: 2371710 - protein, 11 aa, Entamoeba dispar
NSSTSQQQETP

SEQ ID NO: 2371711 - protein, 5 aa, Entamoeba dispar
NSSYD

SEQ ID NO: 2371712 - protein, 16 aa, Entamoeba dispar
NSTCSQCTNSANQCTK

SEQ ID NO: 2371713 - protein, 19 aa, Entamoeba dispar
NSTDKCLTNETEEDKEFNT

SEQ ID NO: 2371714 - protein, 7 aa, Entamoeba dispar
NSTDYSY

SEQ ID NO: 2371715 - protein, 5 aa, Entamoeba dispar
NSTGG

SEQ ID NO: 2371716 - protein, 8 aa, Entamoeba dispar
NSTHYVSQ

SEQ ID NO: 2371717 - protein, 28 aa, Entamoeba dispar
NSTITQTTLGNTTIKAATVDNGTAQKKT

SEQ ID NO: 2371718 - protein, 5 aa, Entamoeba dispar
NSTKT

SEQ ID NO: 2371719 - protein, 9 aa, Entamoeba dispar
NSTKTLKIR

SEQ ID NO: 2371720 - protein, 13 aa, Entamoeba dispar
NSTNCDGDKEDIN

SEQ ID NO: 2371721 - protein, 6 aa, Entamoeba dispar
NSTNSN

SEQ ID NO: 2371722 - protein, 7 aa, Entamoeba dispar
NSTQSQK

SEQ ID NO: 2371723 - protein, 6 aa, Entamoeba dispar
NSTRDA

SEQ ID NO: 2371724 - protein, 4 aa, Entamoeba dispar
NSTS

SEQ ID NO: 2371725 - protein, 7 aa, Entamoeba dispar
NSTSEHH

SEQ ID NO: 2371726 - protein, 7 aa, Entamoeba dispar
NSTSGGE

SEQ ID NO: 2371727 - protein, 9 aa, Entamoeba dispar
NSTSKSSLG

SEQ ID NO: 2371728 - protein, 5 aa, Entamoeba dispar
NSTSQ

SEQ ID NO: 2371729 - protein, 7 aa, Entamoeba dispar
NSTSREQ

SEQ ID NO: 2371730 - protein, 9 aa, Entamoeba dispar
NSTSTSKDQ

SEQ ID NO: 2371731 - protein, 4 aa, Entamoeba dispar
NSTT

SEQ ID NO: 2371732 - protein, 6 aa, Entamoeba dispar
NSTTIE

SEQ ID NO: 2371733 - protein, 10 aa, Entamoeba dispar
NSTTKNSDQE

SEQ ID NO: 2371734 - protein, 7 aa, Entamoeba dispar
NSTTNAS

SEQ ID NO: 2371735 - protein, 4 aa, Entamoeba dispar
NSTV

SEQ ID NO: 2371736 - protein, 9 aa, Entamoeba dispar
NSTVFTPNN

SEQ ID NO: 2371737 - protein, 6 aa, Entamoeba dispar
NSVDKK

SEQ ID NO: 2371738 - protein, 9 aa, Entamoeba dispar
NSVHNTRSG

SEQ ID NO: 2371739 - protein, 22 aa, Entamoeba dispar
NSVNEKKNKKITQVRKSEIERR

SEQ ID NO: 2371740 - protein, 9 aa, Entamoeba dispar
NSVQPTKEC

SEQ ID NO: 2371741 - protein, 7 aa, Entamoeba dispar
NSVSGDA

SEQ ID NO: 2371742 - protein, 13 aa, Entamoeba dispar
NSVSNDTAHNITD

SEQ ID NO: 2371743 - protein, 5 aa, Entamoeba dispar
NSVST

SEQ ID NO: 2371744 - protein, 11 aa, Entamoeba dispar
NSVYDRTNNID

SEQ ID NO: 2371745 - protein, 4 aa, Entamoeba dispar
NSYD

SEQ ID NO: 2371746 - protein, 6 aa, Entamoeba dispar
NSYNEN

SEQ ID NO: 2371747 - protein, 17 aa, Entamoeba dispar
NSYPNDKCNTKERIEHN

SEQ ID NO: 2371748 - protein, 19 aa, Entamoeba dispar
NSYPNKNCSKNEITDRDQE

SEQ ID NO: 2371749 - protein, 7 aa, Entamoeba dispar
NSYTNIS

SEQ ID NO: 2371750 - protein, 8 aa, Entamoeba dispar
NSYTSTPN

SEQ ID NO: 2371751 - protein, 10 aa, Entamoeba dispar
NTAAIAAGTT

SEQ ID NO: 2371752 - protein, 6 aa, Entamoeba dispar
NTAKNK

SEQ ID NO: 2371753 - protein, 10 aa, Entamoeba dispar
NTAKRTSIGQ

SEQ ID NO: 2371754 - protein, 6 aa, Entamoeba dispar
NTATLG

SEQ ID NO: 2371755 - protein, 9 aa, Entamoeba dispar
NTCKTGNND

SEQ ID NO: 2371756 - protein, 8 aa, Entamoeba dispar
NTCSKDRE

SEQ ID NO: 2371757 - protein, 6 aa, Entamoeba dispar
NTCSTT

SEQ ID NO: 2371758 - protein, 13 aa, Entamoeba dispar
NTDDTGNTGNTKT

SEQ ID NO: 2371759 - protein, 7 aa, Entamoeba dispar
NTDEIEK

SEQ ID NO: 2371760 - protein, 17 aa, Entamoeba dispar
NTDEKPIKSKNNTKLQD

SEQ ID NO: 2371761 - protein, 14 aa, Entamoeba dispar
NTDGHNQQRPAPRT

SEQ ID NO: 2371762 - protein, 14 aa, Entamoeba dispar
NTDIGNKDSKSDTP

SEQ ID NO: 2371763 - protein, 5 aa, Entamoeba dispar
NTDQI

SEQ ID NO: 2371764 - protein, 6 aa, Entamoeba dispar
NTDVSE

SEQ ID NO: 2371765 - protein, 9 aa, Entamoeba dispar
NTDYEKEAT

SEQ ID NO: 2371766 - protein, 7 aa, Entamoeba dispar
NTECQYD

SEQ ID NO: 2371767 - protein, 4 aa, Entamoeba dispar
NTED

SEQ ID NO: 2371768 - protein, 4 aa, Entamoeba dispar
NTEF

SEQ ID NO: 2371769 - protein, 10 aa, Entamoeba dispar
NTEKGKKIRN

SEQ ID NO: 2371770 - protein, 11 aa, Entamoeba dispar
NTEKNTIKEEK

SEQ ID NO: 2371771 - protein, 4 aa, Entamoeba dispar
NTEL

SEQ ID NO: 2371772 - protein, 12 aa, Entamoeba dispar
NTENIIGEENGI

SEQ ID NO: 2371773 - protein, 6 aa, Entamoeba dispar
NTENNN

SEQ ID NO: 2371774 - protein, 5 aa, Entamoeba dispar
NTENT

SEQ ID NO: 2371775 - protein, 6 aa, Entamoeba dispar
NTETDE

SEQ ID NO: 2371776 - protein, 4 aa, Entamoeba dispar
NTFD

SEQ ID NO: 2371777 - protein, 4 aa, Entamoeba dispar
NTFK

SEQ ID NO: 2371778 - protein, 5 aa, Entamoeba dispar
NTFNE

SEQ ID NO: 2371779 - protein, 12 aa, Entamoeba dispar
NTFSGLKSPHAR

SEQ ID NO: 2371780 - protein, 7 aa, Entamoeba dispar
NTFSNEL

SEQ ID NO: 2371781 - protein, 4 aa, Entamoeba dispar
NTGE

SEQ ID NO: 2371782 - protein, 9 aa, Entamoeba dispar
NTGEDKTFK

SEQ ID NO: 2371783 - protein, 5 aa, Entamoeba dispar
NTGEL

SEQ ID NO: 2371784 - protein, 4 aa, Entamoeba dispar
NTGN

SEQ ID NO: 2371785 - protein, 4 aa, Entamoeba dispar
NTHE

SEQ ID NO: 2371786 - protein, 8 aa, Entamoeba dispar
NTHNKGPI

SEQ ID NO: 2371787 - protein, 5 aa, Entamoeba dispar
NTIEE

SEQ ID NO: 2371788 - protein, 6 aa, Entamoeba dispar
NTIESY

SEQ ID NO: 2371789 - protein, 6 aa, Entamoeba dispar
NTIETY

SEQ ID NO: 2371790 - protein, 15 aa, Entamoeba dispar
NTISFGSNSLNEREI

SEQ ID NO: 2371791 - protein, 4 aa, Entamoeba dispar
NTIT

SEQ ID NO: 2371792 - protein, 7 aa, Entamoeba dispar
NTITPNK

SEQ ID NO: 2371793 - protein, 6 aa, Entamoeba dispar
NTIYGT

SEQ ID NO: 2371794 - protein, 8 aa, Entamoeba dispar
NTKDIGSA

SEQ ID NO: 2371795 - protein, 5 aa, Entamoeba dispar
NTKDP

SEQ ID NO: 2371796 - protein, 9 aa, Entamoeba dispar
NTKMKEINT

SEQ ID NO: 2371797 - protein, 11 aa, Entamoeba dispar
NTKQEKKIGLG

SEQ ID NO: 2371798 - protein, 11 aa, Entamoeba dispar
NTKTKEEETGT

SEQ ID NO: 2371799 - protein, 8 aa, Entamoeba dispar
NTKTKENE

SEQ ID NO: 2371800 - protein, 9 aa, Entamoeba dispar
NTKVKSLTN

SEQ ID NO: 2371801 - protein, 9 aa, Entamoeba dispar
NTKVTNVKE

SEQ ID NO: 2371802 - protein, 10 aa, Entamoeba dispar
NTLAGDSTKL

SEQ ID NO: 2371803 - protein, 4 aa, Entamoeba dispar
NTLG

SEQ ID NO: 2371804 - protein, 17 aa, Entamoeba dispar
NTLGSTVHSGETPLNGK

SEQ ID NO: 2371805 - protein, 19 aa, Entamoeba dispar
NTLKDEELKEDTDNNFEPV

SEQ ID NO: 2371806 - protein, 19 aa, Entamoeba dispar
NTLQPSSYCPKLSSKCEEH

SEQ ID NO: 2371807 - protein, 7 aa, Entamoeba dispar
NTLQSNI

SEQ ID NO: 2371808 - protein, 40 aa, Entamoeba dispar
NTLQSSNGNSSLSKKSPNEKTKSRQNGGGVARLAGMYENM

SEQ ID NO: 2371809 - protein, 11 aa, Entamoeba dispar
NTLVKSNKKQS

SEQ ID NO: 2371810 - protein, 9 aa, Entamoeba dispar
NTLVTTKTS

SEQ ID NO: 2371811 - protein, 19 aa, Entamoeba dispar
NTMNEQLKQQKDSTFLKKE

SEQ ID NO: 2371812 - protein, 19 aa, Entamoeba dispar
NTMNEQLKQQKDSTLLKKE

SEQ ID NO: 2371813 - protein, 4 aa, Entamoeba dispar
NTND

SEQ ID NO: 2371814 - protein, 9 aa, Entamoeba dispar
NTNETTGQQ

SEQ ID NO: 2371815 - protein, 5 aa, Entamoeba dispar
NTNGN

SEQ ID NO: 2371816 - protein, 20 aa, Entamoeba dispar
NTNNNETTFDSINEPTSPFK

SEQ ID NO: 2371817 - protein, 9 aa, Entamoeba dispar
NTNNPVENL

SEQ ID NO: 2371818 - protein, 5 aa, Entamoeba dispar
NTNRS

SEQ ID NO: 2371819 - protein, 10 aa, Entamoeba dispar
NTPAEGQPEI

SEQ ID NO: 2371820 - protein, 28 aa, Entamoeba dispar
NTPDLTSKINERIKTNKNINNNKIDEEL

SEQ ID NO: 2371821 - protein, 7 aa, Entamoeba dispar
NTPEGSR

SEQ ID NO: 2371822 - protein, 63 aa, Entamoeba dispar
NTPIEPSEQSSEQPSEQPSEQPIEPSEESSEKPIEPSSDHSSSAGSSSGNSSDSENSEGINDK

SEQ ID NO: 2371823 - protein, 4 aa, Entamoeba dispar
NTPQ

SEQ ID NO: 2371824 - protein, 22 aa, Entamoeba dispar
NTPSASPMPLDGTLSNKTKSPL

SEQ ID NO: 2371825 - protein, 22 aa, Entamoeba dispar
NTPSASPMPLDGTVSNKAKSPL

SEQ ID NO: 2371826 - protein, 7 aa, Entamoeba dispar
NTPTNAR

SEQ ID NO: 2371827 - protein, 7 aa, Entamoeba dispar
NTPYSIS

SEQ ID NO: 2371828 - protein, 6 aa, Entamoeba dispar
NTQAGV

SEQ ID NO: 2371829 - protein, 10 aa, Entamoeba dispar
NTQDGTNGSQ

SEQ ID NO: 2371830 - protein, 4 aa, Entamoeba dispar
NTQI

SEQ ID NO: 2371831 - protein, 11 aa, Entamoeba dispar
NTQKDEDGKYV

SEQ ID NO: 2371832 - protein, 5 aa, Entamoeba dispar
NTQKV

SEQ ID NO: 2371833 - protein, 17 aa, Entamoeba dispar
NTQNGSEEGNEKTALLT

SEQ ID NO: 2371834 - protein, 4 aa, Entamoeba dispar
NTQP

SEQ ID NO: 2371835 - protein, 7 aa, Entamoeba dispar
NTQQGQN

SEQ ID NO: 2371836 - protein, 15 aa, Entamoeba dispar
NTREHNETSTLIKTI

SEQ ID NO: 2371837 - protein, 7 aa, Entamoeba dispar
NTRKPTE

SEQ ID NO: 2371838 - protein, 8 aa, Entamoeba dispar
NTRNKTSV

SEQ ID NO: 2371839 - protein, 6 aa, Entamoeba dispar
NTRPTI

SEQ ID NO: 2371840 - protein, 8 aa, Entamoeba dispar
NTSENEVE

SEQ ID NO: 2371841 - protein, 7 aa, Entamoeba dispar
NTSGRRV

SEQ ID NO: 2371842 - protein, 4 aa, Entamoeba dispar
NTSI

SEQ ID NO: 2371843 - protein, 8 aa, Entamoeba dispar
NTSKNEEV

SEQ ID NO: 2371844 - protein, 6 aa, Entamoeba dispar
NTSNDL

SEQ ID NO: 2371845 - protein, 6 aa, Entamoeba dispar
NTSNKS

SEQ ID NO: 2371846 - protein, 9 aa, Entamoeba dispar
NTSNTSSPI

SEQ ID NO: 2371847 - protein, 5 aa, Entamoeba dispar
NTSSD

SEQ ID NO: 2371848 - protein, 26 aa, Entamoeba dispar
NTSSTEVTSKLSNYDKTEYKLENVEK

SEQ ID NO: 2371849 - protein, 14 aa, Entamoeba dispar
NTSSVSQVKTSADI

SEQ ID NO: 2371850 - protein, 5 aa, Entamoeba dispar
NTSTI

SEQ ID NO: 2371851 - protein, 6 aa, Entamoeba dispar
NTSTLD

SEQ ID NO: 2371852 - protein, 8 aa, Entamoeba dispar
NTSTSEDS

SEQ ID NO: 2371853 - protein, 6 aa, Entamoeba dispar
NTSTYI

SEQ ID NO: 2371854 - protein, 7 aa, Entamoeba dispar
NTTDTQS

SEQ ID NO: 2371855 - protein, 9 aa, Entamoeba dispar
NTTKINGNC

SEQ ID NO: 2371856 - protein, 7 aa, Entamoeba dispar
NTTKSSP

SEQ ID NO: 2371857 - protein, 6 aa, Entamoeba dispar
NTTLRE

SEQ ID NO: 2371858 - protein, 4 aa, Entamoeba dispar
NTTN

SEQ ID NO: 2371859 - protein, 8 aa, Entamoeba dispar
NTTNNNDT

SEQ ID NO: 2371860 - protein, 10 aa, Entamoeba dispar
NTTQQDNAIN

SEQ ID NO: 2371861 - protein, 44 aa, Entamoeba dispar
NTTSRTRPPLPKRNISKSPLSTSASVVSTQRLQSQQSSSRPLPK

SEQ ID NO: 2371862 - protein, 6 aa, Entamoeba dispar
NTTTDS

SEQ ID NO: 2371863 - protein, 12 aa, Entamoeba dispar
NTTTKGRYEKEH

SEQ ID NO: 2371864 - protein, 16 aa, Entamoeba dispar
NTTTLNTTAESSSNSL

SEQ ID NO: 2371865 - protein, 8 aa, Entamoeba dispar
NTTTNTCD

SEQ ID NO: 2371866 - protein, 18 aa, Entamoeba dispar
NTTTPSQSTPAQPVQQQQ

SEQ ID NO: 2371867 - protein, 5 aa, Entamoeba dispar
NTTTY

SEQ ID NO: 2371868 - protein, 5 aa, Entamoeba dispar
NTTWD

SEQ ID NO: 2371869 - protein, 4 aa, Entamoeba dispar
NTVT

SEQ ID NO: 2371870 - protein, 5 aa, Entamoeba dispar
NTWNN

SEQ ID NO: 2371871 - protein, 4 aa, Entamoeba dispar
NTYD

SEQ ID NO: 2371872 - protein, 5 aa, Entamoeba dispar
NTYEI

SEQ ID NO: 2371873 - protein, 6 aa, Entamoeba dispar
NTYFTQ

SEQ ID NO: 2371874 - protein, 7 aa, Entamoeba dispar
NTYTNYN

SEQ ID NO: 2371875 - protein, 14 aa, Entamoeba dispar
NVDEKNLKKTYEKN

SEQ ID NO: 2371876 - protein, 4 aa, Entamoeba dispar
NVDG

SEQ ID NO: 2371877 - protein, 17 aa, Entamoeba dispar
NVDSQPPEASEKENEEV

SEQ ID NO: 2371878 - protein, 10 aa, Entamoeba dispar
NVDTTKDDSA

SEQ ID NO: 2371879 - protein, 5 aa, Entamoeba dispar
NVEEP

SEQ ID NO: 2371880 - protein, 8 aa, Entamoeba dispar
NVEQPIPS

SEQ ID NO: 2371881 - protein, 9 aa, Entamoeba dispar
NVFNSRGDE

SEQ ID NO: 2371882 - protein, 8 aa, Entamoeba dispar
NVGERPSF

SEQ ID NO: 2371883 - protein, 5 aa, Entamoeba dispar
NVKDE

SEQ ID NO: 2371884 - protein, 8 aa, Entamoeba dispar
NVKSPNKN

SEQ ID NO: 2371885 - protein, 9 aa, Entamoeba dispar
NVNPKECNP

SEQ ID NO: 2371886 - protein, 4 aa, Entamoeba dispar
NVNT

SEQ ID NO: 2371887 - protein, 6 aa, Entamoeba dispar
NVPDNY

SEQ ID NO: 2371888 - protein, 7 aa, Entamoeba dispar
NVPGDYY

SEQ ID NO: 2371889 - protein, 4 aa, Entamoeba dispar
NVPV

SEQ ID NO: 2371890 - protein, 8 aa, Entamoeba dispar
NVQDKNGL

SEQ ID NO: 2371891 - protein, 6 aa, Entamoeba dispar
NVQIEG

SEQ ID NO: 2371892 - protein, 7 aa, Entamoeba dispar
NVSDEIK

SEQ ID NO: 2371893 - protein, 50 aa, Entamoeba dispar
NVSPSLRSGFSEQGQMGRENCQSEMAEGVNSEDSSETSIASVSNQISKRV

SEQ ID NO: 2371894 - protein, 6 aa, Entamoeba dispar
NVSTFG

SEQ ID NO: 2371895 - protein, 26 aa, Entamoeba dispar
NVTKSNEKIKQGIRKPLTEEETKEMI

SEQ ID NO: 2371896 - protein, 9 aa, Entamoeba dispar
NVTKTQDSI

SEQ ID NO: 2371897 - protein, 4 aa, Entamoeba dispar
NVTN

SEQ ID NO: 2371898 - protein, 6 aa, Entamoeba dispar
NVVDST

SEQ ID NO: 2371899 - protein, 6 aa, Entamoeba dispar
NWANET

SEQ ID NO: 2371900 - protein, 6 aa, Entamoeba dispar
NWEENY

SEQ ID NO: 2371901 - protein, 7 aa, Entamoeba dispar
NWERTDE

SEQ ID NO: 2371902 - protein, 5 aa, Entamoeba dispar
NWIPS

SEQ ID NO: 2371903 - protein, 10 aa, Entamoeba dispar
NWKKRDNFTK

SEQ ID NO: 2371904 - protein, 4 aa, Entamoeba dispar
NWPG

SEQ ID NO: 2371905 - protein, 10 aa, Entamoeba dispar
NWSKDIQSKH

SEQ ID NO: 2371906 - protein, 10 aa, Entamoeba dispar
NWSPNGIPNL

SEQ ID NO: 2371907 - protein, 7 aa, Entamoeba dispar
NWTPSNN

SEQ ID NO: 2371908 - protein, 5 aa, Entamoeba dispar
NYAAI

SEQ ID NO: 2371909 - protein, 10 aa, Entamoeba dispar
NYAGKDGDFS

SEQ ID NO: 2371910 - protein, 4 aa, Entamoeba dispar
NYAK

SEQ ID NO: 2371911 - protein, 9 aa, Entamoeba dispar
NYCEDANSC

SEQ ID NO: 2371912 - protein, 5 aa, Entamoeba dispar
NYCYP

SEQ ID NO: 2371913 - protein, 6 aa, Entamoeba dispar
NYDGDT

SEQ ID NO: 2371914 - protein, 9 aa, Entamoeba dispar
NYDSSKTHR

SEQ ID NO: 2371915 - protein, 8 aa, Entamoeba dispar
NYEEESAQ

SEQ ID NO: 2371916 - protein, 14 aa, Entamoeba dispar
NYEGEYSIKRDSTS

SEQ ID NO: 2371917 - protein, 9 aa, Entamoeba dispar
NYEKTETKE

SEQ ID NO: 2371918 - protein, 7 aa, Entamoeba dispar
NYEPTNL

SEQ ID NO: 2371919 - protein, 6 aa, Entamoeba dispar
NYEQEE

SEQ ID NO: 2371920 - protein, 6 aa, Entamoeba dispar
NYEQKR

SEQ ID NO: 2371921 - protein, 9 aa, Entamoeba dispar
NYESYRRPP

SEQ ID NO: 2371922 - protein, 4 aa, Entamoeba dispar
NYGK

SEQ ID NO: 2371923 - protein, 11 aa, Entamoeba dispar
NYGPYKESTRE

SEQ ID NO: 2371924 - protein, 12 aa, Entamoeba dispar
NYGSSKTREVYT

SEQ ID NO: 2371925 - protein, 5 aa, Entamoeba dispar
NYGSW

SEQ ID NO: 2371926 - protein, 10 aa, Entamoeba dispar
NYISKDNTRG

SEQ ID NO: 2371927 - protein, 7 aa, Entamoeba dispar
NYKETKD

SEQ ID NO: 2371928 - protein, 12 aa, Entamoeba dispar
NYKFETRTNPQL

SEQ ID NO: 2371929 - protein, 5 aa, Entamoeba dispar
NYKLD

SEQ ID NO: 2371930 - protein, 10 aa, Entamoeba dispar
NYKPSKTHEV

SEQ ID NO: 2371931 - protein, 10 aa, Entamoeba dispar
NYKQKNKNCK

SEQ ID NO: 2371932 - protein, 6 aa, Entamoeba dispar
NYKQTS

SEQ ID NO: 2371933 - protein, 6 aa, Entamoeba dispar
NYKTIN

SEQ ID NO: 2371934 - protein, 5 aa, Entamoeba dispar
NYLDS

SEQ ID NO: 2371935 - protein, 17 aa, Entamoeba dispar
NYNDQRASWSYQNPEPV

SEQ ID NO: 2371936 - protein, 11 aa, Entamoeba dispar
NYNKKKSNYYD

SEQ ID NO: 2371937 - protein, 15 aa, Entamoeba dispar
NYNLSYSGNDNQPFN

SEQ ID NO: 2371938 - protein, 9 aa, Entamoeba dispar
NYNPSKTHR

SEQ ID NO: 2371939 - protein, 5 aa, Entamoeba dispar
NYNQY

SEQ ID NO: 2371940 - protein, 5 aa, Entamoeba dispar
NYNSL

SEQ ID NO: 2371941 - protein, 8 aa, Entamoeba dispar
NYPGQFSA

SEQ ID NO: 2371942 - protein, 6 aa, Entamoeba dispar
NYPNDL

SEQ ID NO: 2371943 - protein, 5 aa, Entamoeba dispar
NYPNS

SEQ ID NO: 2371944 - protein, 13 aa, Entamoeba dispar
NYPSSRKGNWFNF

SEQ ID NO: 2371945 - protein, 4 aa, Entamoeba dispar
NYQE

SEQ ID NO: 2371946 - protein, 22 aa, Entamoeba dispar
NYQNGTTKTETIKQTTANGASS

SEQ ID NO: 2371947 - protein, 9 aa, Entamoeba dispar
NYQNVTKSY

SEQ ID NO: 2371948 - protein, 5 aa, Entamoeba dispar
NYQQT

SEQ ID NO: 2371949 - protein, 5 aa, Entamoeba dispar
NYQTN

SEQ ID NO: 2371950 - protein, 11 aa, Entamoeba dispar
NYQVTGDTLSS

SEQ ID NO: 2371951 - protein, 22 aa, Entamoeba dispar
NYSEITDQDDKTVSEQNALQRN

SEQ ID NO: 2371952 - protein, 6 aa, Entamoeba dispar
NYSNNE

SEQ ID NO: 2371953 - protein, 8 aa, Entamoeba dispar
NYTADSDG

SEQ ID NO: 2371954 - protein, 6 aa, Entamoeba dispar
NYTEKY

SEQ ID NO: 2371955 - protein, 8 aa, Entamoeba dispar
NYTGKNQK

SEQ ID NO: 2371956 - protein, 20 aa, Entamoeba dispar
NYTPESKLEKDKTAKNEYKE

SEQ ID NO: 2371957 - protein, 4 aa, Entamoeba dispar
NYTQ

SEQ ID NO: 2371958 - protein, 4 aa, Entamoeba dispar
NYTR

SEQ ID NO: 2371959 - protein, 7 aa, Entamoeba dispar
NYTSDGN

SEQ ID NO: 2371960 - protein, 10 aa, Entamoeba dispar
NYTTDECNTT

SEQ ID NO: 2371961 - protein, 6 aa, Entamoeba dispar
NYYSTS

SEQ ID NO: 2371962 - protein, 4 aa, Entamoeba dispar
NYYT

SEQ ID NO: 2371963 - protein, 13 aa, Entamoeba dispar
PACENGPLEDSSD

SEQ ID NO: 2371964 - protein, 4 aa, Entamoeba dispar
PACG

SEQ ID NO: 2371965 - protein, 5 aa, Entamoeba dispar
PADSL

SEQ ID NO: 2371966 - protein, 5 aa, Entamoeba dispar
PAEEL

SEQ ID NO: 2371967 - protein, 7 aa, Entamoeba dispar
PAEGDKN

SEQ ID NO: 2371968 - protein, 4 aa, Entamoeba dispar
PAGD

SEQ ID NO: 2371969 - protein, 4 aa, Entamoeba dispar
PAKY

SEQ ID NO: 2371970 - protein, 7 aa, Entamoeba dispar
PALNPEW

SEQ ID NO: 2371971 - protein, 4 aa, Entamoeba dispar
PALP

SEQ ID NO: 2371972 - protein, 12 aa, Entamoeba dispar
PALSTTPSISKD

SEQ ID NO: 2371973 - protein, 17 aa, Entamoeba dispar
PANEAQQEEIPEGRFSK

SEQ ID NO: 2371974 - protein, 10 aa, Entamoeba dispar
PANGNSDWCA

SEQ ID NO: 2371975 - protein, 4 aa, Entamoeba dispar
PANN

SEQ ID NO: 2371976 - protein, 8 aa, Entamoeba dispar
PAPHLPPS

SEQ ID NO: 2371977 - protein, 5 aa, Entamoeba dispar
PAPPL

SEQ ID NO: 2371978 - protein, 4 aa, Entamoeba dispar
PAQP

SEQ ID NO: 2371979 - protein, 5 aa, Entamoeba dispar
PARAA

SEQ ID NO: 2371980 - protein, 7 aa, Entamoeba dispar
PARADQY

SEQ ID NO: 2371981 - protein, 5 aa, Entamoeba dispar
PARPY

SEQ ID NO: 2371982 - protein, 5 aa, Entamoeba dispar
PATEE

SEQ ID NO: 2371983 - protein, 6 aa, Entamoeba dispar
PAVRAE

SEQ ID NO: 2371984 - protein, 7 aa, Entamoeba dispar
PAYDKTT

SEQ ID NO: 2371985 - protein, 8 aa, Entamoeba dispar
PAYDNSDG

SEQ ID NO: 2371986 - protein, 11 aa, Entamoeba dispar
PAYKESTGNSM

SEQ ID NO: 2371987 - protein, 7 aa, Entamoeba dispar
PAYPKEQ

SEQ ID NO: 2371988 - protein, 12 aa, Entamoeba dispar
PCATPNEKAQSP

SEQ ID NO: 2371989 - protein, 16 aa, Entamoeba dispar
PCGDSTRRYIKTTSSI

SEQ ID NO: 2371990 - protein, 16 aa, Entamoeba dispar
PCGQEDQQSSKYTSAC

SEQ ID NO: 2371991 - protein, 7 aa, Entamoeba dispar
PCHEGKH

SEQ ID NO: 2371992 - protein, 14 aa, Entamoeba dispar
PCKQWTEASKATHN

SEQ ID NO: 2371993 - protein, 6 aa, Entamoeba dispar
PCNGNN

SEQ ID NO: 2371994 - protein, 5 aa, Entamoeba dispar
PCNKR

SEQ ID NO: 2371995 - protein, 4 aa, Entamoeba dispar
PCQG

SEQ ID NO: 2371996 - protein, 4 aa, Entamoeba dispar
PCSN

SEQ ID NO: 2371997 - protein, 7 aa, Entamoeba dispar
PCTTNDI

SEQ ID NO: 2371998 - protein, 8 aa, Entamoeba dispar
PDAEFDRH

SEQ ID NO: 2371999 - protein, 4 aa, Entamoeba dispar
PDAL

SEQ ID NO: 2372000 - protein, 25 aa, Entamoeba dispar
PDANQQPSSEIEQQAPETQQPQEIE

SEQ ID NO: 2372001 - protein, 8 aa, Entamoeba dispar
PDAVTPVN

SEQ ID NO: 2372002 - protein, 14 aa, Entamoeba dispar
PDDCPNESNSTKYK

SEQ ID NO: 2372003 - protein, 6 aa, Entamoeba dispar
PDDDDF

SEQ ID NO: 2372004 - protein, 10 aa, Entamoeba dispar
PDDDEQMEEF

SEQ ID NO: 2372005 - protein, 4 aa, Entamoeba dispar
PDDH

SEQ ID NO: 2372006 - protein, 23 aa, Entamoeba dispar
PDDQEVNLTKETKETAKALEQPP

SEQ ID NO: 2372007 - protein, 5 aa, Entamoeba dispar
PDDSI

SEQ ID NO: 2372008 - protein, 4 aa, Entamoeba dispar
PDDV

SEQ ID NO: 2372009 - protein, 13 aa, Entamoeba dispar
PDEPLDSSKAYDT

SEQ ID NO: 2372010 - protein, 6 aa, Entamoeba dispar
PDFDPE

SEQ ID NO: 2372011 - protein, 4 aa, Entamoeba dispar
PDFS

SEQ ID NO: 2372012 - protein, 10 aa, Entamoeba dispar
PDGTHKNVRG

SEQ ID NO: 2372013 - protein, 5 aa, Entamoeba dispar
PDGTL

SEQ ID NO: 2372014 - protein, 16 aa, Entamoeba dispar
PDIDSPEESIRNTTAR

SEQ ID NO: 2372015 - protein, 23 aa, Entamoeba dispar
PDIKTGSVSTNDSIKVNDQINKS

SEQ ID NO: 2372016 - protein, 7 aa, Entamoeba dispar
PDIPQNN

SEQ ID NO: 2372017 - protein, 10 aa, Entamoeba dispar
PDITKANSSL

SEQ ID NO: 2372018 - protein, 4 aa, Entamoeba dispar
PDKD

SEQ ID NO: 2372019 - protein, 8 aa, Entamoeba dispar
PDKDPAPM

SEQ ID NO: 2372020 - protein, 13 aa, Entamoeba dispar
PDKKLRKSYEDTI

SEQ ID NO: 2372021 - protein, 6 aa, Entamoeba dispar
PDKQEM

SEQ ID NO: 2372022 - protein, 7 aa, Entamoeba dispar
PDKTVST

SEQ ID NO: 2372023 - protein, 9 aa, Entamoeba dispar
PDLSKKHNT

SEQ ID NO: 2372024 - protein, 15 aa, Entamoeba dispar
PDNEGNQKLERKRHI

SEQ ID NO: 2372025 - protein, 7 aa, Entamoeba dispar
PDNIETS

SEQ ID NO: 2372026 - protein, 5 aa, Entamoeba dispar
PDNPK

SEQ ID NO: 2372027 - protein, 32 aa, Entamoeba dispar
PDNYPSETIPQEDINENQKEEGFDEEDELPEK

SEQ ID NO: 2372028 - protein, 7 aa, Entamoeba dispar
PDNYSNP

SEQ ID NO: 2372029 - protein, 9 aa, Entamoeba dispar
PDPNKTIDL

SEQ ID NO: 2372030 - protein, 10 aa, Entamoeba dispar
PDPPTTTAQR

SEQ ID NO: 2372031 - protein, 13 aa, Entamoeba dispar
PDPSGRPSTVNTS

SEQ ID NO: 2372032 - protein, 6 aa, Entamoeba dispar
PDPTTI

SEQ ID NO: 2372033 - protein, 6 aa, Entamoeba dispar
PDQESI

SEQ ID NO: 2372034 - protein, 6 aa, Entamoeba dispar
PDQNEE

SEQ ID NO: 2372035 - protein, 6 aa, Entamoeba dispar
PDRDPV

SEQ ID NO: 2372036 - protein, 6 aa, Entamoeba dispar
PDSISS

SEQ ID NO: 2372037 - protein, 5 aa, Entamoeba dispar
PDSLP

SEQ ID NO: 2372038 - protein, 7 aa, Entamoeba dispar
PDSTNIE

SEQ ID NO: 2372039 - protein, 4 aa, Entamoeba dispar
PDSV

SEQ ID NO: 2372040 - protein, 5 aa, Entamoeba dispar
PDSVH

SEQ ID NO: 2372041 - protein, 9 aa, Entamoeba dispar
PDSVSTKQE

SEQ ID NO: 2372042 - protein, 10 aa, Entamoeba dispar
PDTESTCGFG

SEQ ID NO: 2372043 - protein, 4 aa, Entamoeba dispar
PDTL

SEQ ID NO: 2372044 - protein, 8 aa, Entamoeba dispar
PDTLSTDK

SEQ ID NO: 2372045 - protein, 7 aa, Entamoeba dispar
PDYESIK

SEQ ID NO: 2372046 - protein, 12 aa, Entamoeba dispar
PDYINRKTPRGR

SEQ ID NO: 2372047 - protein, 5 aa, Entamoeba dispar
PDYKK

SEQ ID NO: 2372048 - protein, 14 aa, Entamoeba dispar
PDYPKNRTVLIPFL

SEQ ID NO: 2372049 - protein, 7 aa, Entamoeba dispar
PEAERIE

SEQ ID NO: 2372050 - protein, 9 aa, Entamoeba dispar
PEANSDTIR

SEQ ID NO: 2372051 - protein, 4 aa, Entamoeba dispar
PEAY

SEQ ID NO: 2372052 - protein, 7 aa, Entamoeba dispar
PEDACYD

SEQ ID NO: 2372053 - protein, 8 aa, Entamoeba dispar
PEDAQTGV

SEQ ID NO: 2372054 - protein, 5 aa, Entamoeba dispar
PEDAS

SEQ ID NO: 2372055 - protein, 14 aa, Entamoeba dispar
PEDDLTIEKLIAEF

SEQ ID NO: 2372056 - protein, 11 aa, Entamoeba dispar
PEDLKNPKEII

SEQ ID NO: 2372057 - protein, 10 aa, Entamoeba dispar
PEDPTITDLS

SEQ ID NO: 2372058 - protein, 10 aa, Entamoeba dispar
PEDYEIKEDN

SEQ ID NO: 2372059 - protein, 6 aa, Entamoeba dispar
PEEADH

SEQ ID NO: 2372060 - protein, 4 aa, Entamoeba dispar
PEEG

SEQ ID NO: 2372061 - protein, 12 aa, Entamoeba dispar
PEEGESKTKISV

SEQ ID NO: 2372062 - protein, 17 aa, Entamoeba dispar
PEEKEETLLQNEDKSFT

SEQ ID NO: 2372063 - protein, 17 aa, Entamoeba dispar
PEEKTLTKNVGEVNPRS

SEQ ID NO: 2372064 - protein, 4 aa, Entamoeba dispar
PEEN

SEQ ID NO: 2372065 - protein, 9 aa, Entamoeba dispar
PEENGSSTL

SEQ ID NO: 2372066 - protein, 6 aa, Entamoeba dispar
PEEPTA

SEQ ID NO: 2372067 - protein, 6 aa, Entamoeba dispar
PEEYEV

SEQ ID NO: 2372068 - protein, 7 aa, Entamoeba dispar
PEFDNGI

SEQ ID NO: 2372069 - protein, 6 aa, Entamoeba dispar
PEFDPN

SEQ ID NO: 2372070 - protein, 11 aa, Entamoeba dispar
PEGQKTCQSCS

SEQ ID NO: 2372071 - protein, 5 aa, Entamoeba dispar
PEIDE

SEQ ID NO: 2372072 - protein, 4 aa, Entamoeba dispar
PEIK

SEQ ID NO: 2372073 - protein, 8 aa, Entamoeba dispar
PEINDPVE

SEQ ID NO: 2372074 - protein, 7 aa, Entamoeba dispar
PEINEPI

SEQ ID NO: 2372075 - protein, 4 aa, Entamoeba dispar
PEIP

SEQ ID NO: 2372076 - protein, 9 aa, Entamoeba dispar
PEIYPTPTI

SEQ ID NO: 2372077 - protein, 9 aa, Entamoeba dispar
PEKNDETNE

SEQ ID NO: 2372078 - protein, 8 aa, Entamoeba dispar
PEKNETST

SEQ ID NO: 2372079 - protein, 8 aa, Entamoeba dispar
PEKQNDGK

SEQ ID NO: 2372080 - protein, 14 aa, Entamoeba dispar
PEKYPQANSKLKKQ

SEQ ID NO: 2372081 - protein, 7 aa, Entamoeba dispar
PENPSYI

SEQ ID NO: 2372082 - protein, 5 aa, Entamoeba dispar
PENQR

SEQ ID NO: 2372083 - protein, 9 aa, Entamoeba dispar
PENQRPTLY

SEQ ID NO: 2372084 - protein, 5 aa, Entamoeba dispar
PENRI

SEQ ID NO: 2372085 - protein, 7 aa, Entamoeba dispar
PENTKSK

SEQ ID NO: 2372086 - protein, 30 aa, Entamoeba dispar
PEPLPNDKISYGPKRSKGLKVEEVDDNGNV

SEQ ID NO: 2372087 - protein, 6 aa, Entamoeba dispar
PEPYYS

SEQ ID NO: 2372088 - protein, 5 aa, Entamoeba dispar
PEQAN

SEQ ID NO: 2372089 - protein, 8 aa, Entamoeba dispar
PEQCTANV

SEQ ID NO: 2372090 - protein, 13 aa, Entamoeba dispar
PEQEKTEEQSSNK

SEQ ID NO: 2372091 - protein, 14 aa, Entamoeba dispar
PEQIPKKENNDCQG

SEQ ID NO: 2372092 - protein, 19 aa, Entamoeba dispar
PEQSKSNSSHNSFNDQEIV

SEQ ID NO: 2372093 - protein, 9 aa, Entamoeba dispar
PEQTVDTSS

SEQ ID NO: 2372094 - protein, 6 aa, Entamoeba dispar
PEQYTG

SEQ ID NO: 2372095 - protein, 6 aa, Entamoeba dispar
PEQYTI

SEQ ID NO: 2372096 - protein, 6 aa, Entamoeba dispar
PERDPI

SEQ ID NO: 2372097 - protein, 4 aa, Entamoeba dispar
PESI

SEQ ID NO: 2372098 - protein, 5 aa, Entamoeba dispar
PESIK

SEQ ID NO: 2372099 - protein, 4 aa, Entamoeba dispar
PESM

SEQ ID NO: 2372100 - protein, 5 aa, Entamoeba dispar
PESRP

SEQ ID NO: 2372101 - protein, 9 aa, Entamoeba dispar
PESTSYEQK

SEQ ID NO: 2372102 - protein, 10 aa, Entamoeba dispar
PESTYHTLAP

SEQ ID NO: 2372103 - protein, 6 aa, Entamoeba dispar
PETCNP

SEQ ID NO: 2372104 - protein, 7 aa, Entamoeba dispar
PETCRRR

SEQ ID NO: 2372105 - protein, 4 aa, Entamoeba dispar
PETE

SEQ ID NO: 2372106 - protein, 12 aa, Entamoeba dispar
PETHALDNAPND

SEQ ID NO: 2372107 - protein, 4 aa, Entamoeba dispar
PETI

SEQ ID NO: 2372108 - protein, 31 aa, Entamoeba dispar
PETLQAESTSNDVIKTEDEDLEEKNKKDKMI

SEQ ID NO: 2372109 - protein, 9 aa, Entamoeba dispar
PETLQQTSE

SEQ ID NO: 2372110 - protein, 7 aa, Entamoeba dispar
PETTTEE

SEQ ID NO: 2372111 - protein, 11 aa, Entamoeba dispar
PETYHDEYSYA

SEQ ID NO: 2372112 - protein, 14 aa, Entamoeba dispar
PETYHDEYTNAGDV

SEQ ID NO: 2372113 - protein, 10 aa, Entamoeba dispar
PEVSEKQNNA

SEQ ID NO: 2372114 - protein, 4 aa, Entamoeba dispar
PEYA

SEQ ID NO: 2372115 - protein, 4 aa, Entamoeba dispar
PFEQ

SEQ ID NO: 2372116 - protein, 11 aa, Entamoeba dispar
PFESQKDDFDN

SEQ ID NO: 2372117 - protein, 7 aa, Entamoeba dispar
PFGGNSS

SEQ ID NO: 2372118 - protein, 4 aa, Entamoeba dispar
PFGI

SEQ ID NO: 2372119 - protein, 16 aa, Entamoeba dispar
PFGQTEDEVKASYSTN

SEQ ID NO: 2372120 - protein, 18 aa, Entamoeba dispar
PFKESYQKFDKEAETTSW

SEQ ID NO: 2372121 - protein, 31 aa, Entamoeba dispar
PFKGSSKNVSNHTDLKPPITKKNKKNEKTDL

SEQ ID NO: 2372122 - protein, 9 aa, Entamoeba dispar
PFKRNSDKD

SEQ ID NO: 2372123 - protein, 5 aa, Entamoeba dispar
PFNEK

SEQ ID NO: 2372124 - protein, 6 aa, Entamoeba dispar
PFNSNQ

SEQ ID NO: 2372125 - protein, 9 aa, Entamoeba dispar
PFPNEATEE

SEQ ID NO: 2372126 - protein, 4 aa, Entamoeba dispar
PFSD

SEQ ID NO: 2372127 - protein, 7 aa, Entamoeba dispar
PFSPNNT

SEQ ID NO: 2372128 - protein, 10 aa, Entamoeba dispar
PFSPSQGQYG

SEQ ID NO: 2372129 - protein, 4 aa, Entamoeba dispar
PFSS

SEQ ID NO: 2372130 - protein, 12 aa, Entamoeba dispar
PFSTPDVSESDV

SEQ ID NO: 2372131 - protein, 5 aa, Entamoeba dispar
PFSYD

SEQ ID NO: 2372132 - protein, 4 aa, Entamoeba dispar
PFTS

SEQ ID NO: 2372133 - protein, 24 aa, Entamoeba dispar
PGAQPDVVETSSGDSSGNTDGPKV

SEQ ID NO: 2372134 - protein, 11 aa, Entamoeba dispar
PGCNEPAKTRY

SEQ ID NO: 2372135 - protein, 11 aa, Entamoeba dispar
PGCNETPKTRY

SEQ ID NO: 2372136 - protein, 5 aa, Entamoeba dispar
PGCTS

SEQ ID NO: 2372137 - protein, 7 aa, Entamoeba dispar
PGENEPS

SEQ ID NO: 2372138 - protein, 13 aa, Entamoeba dispar
PGFQDSDGRDGEH

SEQ ID NO: 2372139 - protein, 6 aa, Entamoeba dispar
PGGENN

SEQ ID NO: 2372140 - protein, 18 aa, Entamoeba dispar
PGGSKENEGYIFDFFDDE

SEQ ID NO: 2372141 - protein, 12 aa, Entamoeba dispar
PGIRKNKQISSQ

SEQ ID NO: 2372142 - protein, 5 aa, Entamoeba dispar
PGKEY

SEQ ID NO: 2372143 - protein, 9 aa, Entamoeba dispar
PGKQSKEVE

SEQ ID NO: 2372144 - protein, 7 aa, Entamoeba dispar
PGKTFEE

SEQ ID NO: 2372145 - protein, 10 aa, Entamoeba dispar
PGKTQEPSME

SEQ ID NO: 2372146 - protein, 5 aa, Entamoeba dispar
PGLAE

SEQ ID NO: 2372147 - protein, 13 aa, Entamoeba dispar
PGLNDSDGFDNEG

SEQ ID NO: 2372148 - protein, 15 aa, Entamoeba dispar
PGLPSTDIDGKKEYS

SEQ ID NO: 2372149 - protein, 13 aa, Entamoeba dispar
PGLQDSDGFDNEG

SEQ ID NO: 2372150 - protein, 13 aa, Entamoeba dispar
PGLQDSEGRERQY

SEQ ID NO: 2372151 - protein, 13 aa, Entamoeba dispar
PGLQDSGEMDENQ

SEQ ID NO: 2372152 - protein, 4 aa, Entamoeba dispar
PGLS

SEQ ID NO: 2372153 - protein, 9 aa, Entamoeba dispar
PGNKKEERQ

SEQ ID NO: 2372154 - protein, 8 aa, Entamoeba dispar
PGNSSKVE

SEQ ID NO: 2372155 - protein, 4 aa, Entamoeba dispar
PGNY

SEQ ID NO: 2372156 - protein, 8 aa, Entamoeba dispar
PGQTNESK

SEQ ID NO: 2372157 - protein, 35 aa, Entamoeba dispar
PGSCKSKPKAITPKPECNKTKTIKISTNAKESISA

SEQ ID NO: 2372158 - protein, 7 aa, Entamoeba dispar
PGSGIPS

SEQ ID NO: 2372159 - protein, 9 aa, Entamoeba dispar
PGSNEAEKA

SEQ ID NO: 2372160 - protein, 6 aa, Entamoeba dispar
PGTGAW

SEQ ID NO: 2372161 - protein, 5 aa, Entamoeba dispar
PGTTS

SEQ ID NO: 2372162 - protein, 11 aa, Entamoeba dispar
PGTVDHEKKIE

SEQ ID NO: 2372163 - protein, 4 aa, Entamoeba dispar
PGYG

SEQ ID NO: 2372164 - protein, 12 aa, Entamoeba dispar
PGYSINKDKTKC

SEQ ID NO: 2372165 - protein, 12 aa, Entamoeba dispar
PGYSINNKTHCG

SEQ ID NO: 2372166 - protein, 5 aa, Entamoeba dispar
PHAQF

SEQ ID NO: 2372167 - protein, 6 aa, Entamoeba dispar
PHASQK

SEQ ID NO: 2372168 - protein, 4 aa, Entamoeba dispar
PHDE

SEQ ID NO: 2372169 - protein, 4 aa, Entamoeba dispar
PHIQ

SEQ ID NO: 2372170 - protein, 4 aa, Entamoeba dispar
PHIT

SEQ ID NO: 2372171 - protein, 19 aa, Entamoeba dispar
PHLSEKDSKINWESPLDKS

SEQ ID NO: 2372172 - protein, 47 aa, Entamoeba dispar
PHPTSTTRTSESTLLGSQPIGRFSEPPVPIKSASTISIKSKKNEEIR

SEQ ID NO: 2372173 - protein, 9 aa, Entamoeba dispar
PHQPISDTN

SEQ ID NO: 2372174 - protein, 7 aa, Entamoeba dispar
PHRKNKD

SEQ ID NO: 2372175 - protein, 5 aa, Entamoeba dispar
PHSNT

SEQ ID NO: 2372176 - protein, 12 aa, Entamoeba dispar
PHSYTCSASNNK

SEQ ID NO: 2372177 - protein, 10 aa, Entamoeba dispar
PIDDDYQGNE

SEQ ID NO: 2372178 - protein, 8 aa, Entamoeba dispar
PIDDNTEE

SEQ ID NO: 2372179 - protein, 7 aa, Entamoeba dispar
PIDEGLN

SEQ ID NO: 2372180 - protein, 10 aa, Entamoeba dispar
PIDKTSKVNI

SEQ ID NO: 2372181 - protein, 5 aa, Entamoeba dispar
PIEGN

SEQ ID NO: 2372182 - protein, 4 aa, Entamoeba dispar
PIEH

SEQ ID NO: 2372183 - protein, 5 aa, Entamoeba dispar
PIEPE

SEQ ID NO: 2372184 - protein, 7 aa, Entamoeba dispar
PIESPEQ

SEQ ID NO: 2372185 - protein, 8 aa, Entamoeba dispar
PIGEGTYS

SEQ ID NO: 2372186 - protein, 10 aa, Entamoeba dispar
PIGETGVSTR

SEQ ID NO: 2372187 - protein, 4 aa, Entamoeba dispar
PIGG

SEQ ID NO: 2372188 - protein, 7 aa, Entamoeba dispar
PIGPSSA

SEQ ID NO: 2372189 - protein, 11 aa, Entamoeba dispar
PIHTPTPRKKH

SEQ ID NO: 2372190 - protein, 4 aa, Entamoeba dispar
PIMG

SEQ ID NO: 2372191 - protein, 4 aa, Entamoeba dispar
PING

SEQ ID NO: 2372192 - protein, 5 aa, Entamoeba dispar
PINKR

SEQ ID NO: 2372193 - protein, 10 aa, Entamoeba dispar
PINNNKPLPY

SEQ ID NO: 2372194 - protein, 5 aa, Entamoeba dispar
PINTQ

SEQ ID NO: 2372195 - protein, 4 aa, Entamoeba dispar
PIPE

SEQ ID NO: 2372196 - protein, 12 aa, Entamoeba dispar
PIPKEIEDNAKE

SEQ ID NO: 2372197 - protein, 15 aa, Entamoeba dispar
PIPKKKKLKKSHPVP

SEQ ID NO: 2372198 - protein, 6 aa, Entamoeba dispar
PIPQRD

SEQ ID NO: 2372199 - protein, 13 aa, Entamoeba dispar
PIPVSTKSDSEYA

SEQ ID NO: 2372200 - protein, 9 aa, Entamoeba dispar
PIQNKNDKE

SEQ ID NO: 2372201 - protein, 5 aa, Entamoeba dispar
PISEE

SEQ ID NO: 2372202 - protein, 11 aa, Entamoeba dispar
PITEDNNTDIE

SEQ ID NO: 2372203 - protein, 15 aa, Entamoeba dispar
PITNNKSIELNTSQI

SEQ ID NO: 2372204 - protein, 6 aa, Entamoeba dispar
PITQDP

SEQ ID NO: 2372205 - protein, 11 aa, Entamoeba dispar
PIVDPKERELE

SEQ ID NO: 2372206 - protein, 11 aa, Entamoeba dispar
PIYGGEKGQVY

SEQ ID NO: 2372207 - protein, 14 aa, Entamoeba dispar
PKAKPKAKKECPDT

SEQ ID NO: 2372208 - protein, 6 aa, Entamoeba dispar
PKAPKI

SEQ ID NO: 2372209 - protein, 12 aa, Entamoeba dispar
PKCDEKLKGEHI

SEQ ID NO: 2372210 - protein, 16 aa, Entamoeba dispar
PKDANEEEIKKELKDT

SEQ ID NO: 2372211 - protein, 13 aa, Entamoeba dispar
PKDAYVKSYEDTI

SEQ ID NO: 2372212 - protein, 18 aa, Entamoeba dispar
PKDDNKDDDSTEETQEET

SEQ ID NO: 2372213 - protein, 17 aa, Entamoeba dispar
PKDTEKVSIQTDDVTTF

SEQ ID NO: 2372214 - protein, 22 aa, Entamoeba dispar
PKDVKDVYGDSIDQNEFEKSQN

SEQ ID NO: 2372215 - protein, 5 aa, Entamoeba dispar
PKEDA

SEQ ID NO: 2372216 - protein, 7 aa, Entamoeba dispar
PKEDNHL

SEQ ID NO: 2372217 - protein, 8 aa, Entamoeba dispar
PKEEQDSR

SEQ ID NO: 2372218 - protein, 20 aa, Entamoeba dispar
PKEIQGKDKREKNETGEEYD

SEQ ID NO: 2372219 - protein, 9 aa, Entamoeba dispar
PKEKQDSRI

SEQ ID NO: 2372220 - protein, 8 aa, Entamoeba dispar
PKENGSKM

SEQ ID NO: 2372221 - protein, 12 aa, Entamoeba dispar
PKERIDRTNCSN

SEQ ID NO: 2372222 - protein, 4 aa, Entamoeba dispar
PKET

SEQ ID NO: 2372223 - protein, 4 aa, Entamoeba dispar
PKEV

SEQ ID NO: 2372224 - protein, 5 aa, Entamoeba dispar
PKGIT

SEQ ID NO: 2372225 - protein, 8 aa, Entamoeba dispar
PKGKKIRV

SEQ ID NO: 2372226 - protein, 6 aa, Entamoeba dispar
PKGMQT

SEQ ID NO: 2372227 - protein, 5 aa, Entamoeba dispar
PKGNK

SEQ ID NO: 2372228 - protein, 7 aa, Entamoeba dispar
PKGNKGM

SEQ ID NO: 2372229 - protein, 7 aa, Entamoeba dispar
PKGNKPI

SEQ ID NO: 2372230 - protein, 4 aa, Entamoeba dispar
PKGS

SEQ ID NO: 2372231 - protein, 9 aa, Entamoeba dispar
PKGSKTGDI

SEQ ID NO: 2372232 - protein, 6 aa, Entamoeba dispar
PKGTNV

SEQ ID NO: 2372233 - protein, 4 aa, Entamoeba dispar
PKHM

SEQ ID NO: 2372234 - protein, 17 aa, Entamoeba dispar
PKHSPRYEEEEEIEEEL

SEQ ID NO: 2372235 - protein, 11 aa, Entamoeba dispar
PKHSSDCRTYS

SEQ ID NO: 2372236 - protein, 4 aa, Entamoeba dispar
PKIN

SEQ ID NO: 2372237 - protein, 11 aa, Entamoeba dispar
PKINDSSSEIE

SEQ ID NO: 2372238 - protein, 5 aa, Entamoeba dispar
PKIPE

SEQ ID NO: 2372239 - protein, 19 aa, Entamoeba dispar
PKIQPQGVDYQESVSDNSI

SEQ ID NO: 2372240 - protein, 11 aa, Entamoeba dispar
PKISHSDITGK

SEQ ID NO: 2372241 - protein, 4 aa, Entamoeba dispar
PKIY

SEQ ID NO: 2372242 - protein, 8 aa, Entamoeba dispar
PKKDKVSI

SEQ ID NO: 2372243 - protein, 4 aa, Entamoeba dispar
PKKF

SEQ ID NO: 2372244 - protein, 15 aa, Entamoeba dispar
PKKKKGHVTSKSEVR

SEQ ID NO: 2372245 - protein, 11 aa, Entamoeba dispar
PKLTSASGSVS

SEQ ID NO: 2372246 - protein, 7 aa, Entamoeba dispar
PKMAKKS

SEQ ID NO: 2372247 - protein, 11 aa, Entamoeba dispar
PKNATDEQIED

SEQ ID NO: 2372248 - protein, 9 aa, Entamoeba dispar
PKNDDPDAD

SEQ ID NO: 2372249 - protein, 7 aa, Entamoeba dispar
PKNINGV

SEQ ID NO: 2372250 - protein, 22 aa, Entamoeba dispar
PKNLTNPNSKELKSNLQNGQEV

SEQ ID NO: 2372251 - protein, 11 aa, Entamoeba dispar
PKNNECQRYSK

SEQ ID NO: 2372252 - protein, 7 aa, Entamoeba dispar
PKNPNYN

SEQ ID NO: 2372253 - protein, 6 aa, Entamoeba dispar
PKNPPE

SEQ ID NO: 2372254 - protein, 17 aa, Entamoeba dispar
PKNQSFINEDNKQTFNK

SEQ ID NO: 2372255 - protein, 22 aa, Entamoeba dispar
PKNSFEPQRSKTPELKKTKTIS

SEQ ID NO: 2372256 - protein, 12 aa, Entamoeba dispar
PKNSQIKKYSNN

SEQ ID NO: 2372257 - protein, 4 aa, Entamoeba dispar
PKNT

SEQ ID NO: 2372258 - protein, 24 aa, Entamoeba dispar
PKPEAPKRKRPQKKIQDDKPKSPL

SEQ ID NO: 2372259 - protein, 5 aa, Entamoeba dispar
PKPFQ

SEQ ID NO: 2372260 - protein, 4 aa, Entamoeba dispar
PKPI

SEQ ID NO: 2372261 - protein, 10 aa, Entamoeba dispar
PKPKCSEGYD

SEQ ID NO: 2372262 - protein, 7 aa, Entamoeba dispar
PKPKQQI

SEQ ID NO: 2372263 - protein, 17 aa, Entamoeba dispar
PKPKTETDEQQQIRKER

SEQ ID NO: 2372264 - protein, 31 aa, Entamoeba dispar
PKPLDDKNNKNNEIEMKQQPNNVSFTVNSCD

SEQ ID NO: 2372265 - protein, 12 aa, Entamoeba dispar
PKPNERPTFKEA

SEQ ID NO: 2372266 - protein, 8 aa, Entamoeba dispar
PKPSDSTT

SEQ ID NO: 2372267 - protein, 5 aa, Entamoeba dispar
PKPVM

SEQ ID NO: 2372268 - protein, 4 aa, Entamoeba dispar
PKQA

SEQ ID NO: 2372269 - protein, 11 aa, Entamoeba dispar
PKQHKKEKFQP

SEQ ID NO: 2372270 - protein, 4 aa, Entamoeba dispar
PKQI

SEQ ID NO: 2372271 - protein, 8 aa, Entamoeba dispar
PKQKAEIT

SEQ ID NO: 2372272 - protein, 10 aa, Entamoeba dispar
PKQKEVFDSN

SEQ ID NO: 2372273 - protein, 4 aa, Entamoeba dispar
PKQS

SEQ ID NO: 2372274 - protein, 23 aa, Entamoeba dispar
PKRKSEEKKNKKITKKKEKEDEI

SEQ ID NO: 2372275 - protein, 7 aa, Entamoeba dispar
PKRPTMY

SEQ ID NO: 2372276 - protein, 6 aa, Entamoeba dispar
PKSESI

SEQ ID NO: 2372277 - protein, 58 aa, Entamoeba dispar
PKSEVQNEVSKHSDENNNNNSKDSASSSSSSVSEKSSNGKKEEVNKSESRSSASSDDD

SEQ ID NO: 2372278 - protein, 9 aa, Entamoeba dispar
PKSIGDKLN

SEQ ID NO: 2372279 - protein, 4 aa, Entamoeba dispar
PKSM

SEQ ID NO: 2372280 - protein, 39 aa, Entamoeba dispar
PKSPRTSAYTYTQRNTSSNSNLGAQGLPRATRRGDENRD

SEQ ID NO: 2372281 - protein, 8 aa, Entamoeba dispar
PKSTTTQN

SEQ ID NO: 2372282 - protein, 10 aa, Entamoeba dispar
PKTATRRSEN

SEQ ID NO: 2372283 - protein, 5 aa, Entamoeba dispar
PKTEE

SEQ ID NO: 2372284 - protein, 7 aa, Entamoeba dispar
PKTEINE

SEQ ID NO: 2372285 - protein, 7 aa, Entamoeba dispar
PKTKSNW

SEQ ID NO: 2372286 - protein, 4 aa, Entamoeba dispar
PKTL

SEQ ID NO: 2372287 - protein, 15 aa, Entamoeba dispar
PKTLESGKSTNPTYY

SEQ ID NO: 2372288 - protein, 6 aa, Entamoeba dispar
PKTLND

SEQ ID NO: 2372289 - protein, 4 aa, Entamoeba dispar
PKTP

SEQ ID NO: 2372290 - protein, 6 aa, Entamoeba dispar
PKTPFT

SEQ ID NO: 2372291 - protein, 6 aa, Entamoeba dispar
PKTSSY

SEQ ID NO: 2372292 - protein, 4 aa, Entamoeba dispar
PKTT

SEQ ID NO: 2372293 - protein, 5 aa, Entamoeba dispar
PKTVV

SEQ ID NO: 2372294 - protein, 14 aa, Entamoeba dispar
PKVPIGDKKYKIEK

SEQ ID NO: 2372295 - protein, 7 aa, Entamoeba dispar
PKVPNSG

SEQ ID NO: 2372296 - protein, 10 aa, Entamoeba dispar
PKVPPPIPVT

SEQ ID NO: 2372297 - protein, 5 aa, Entamoeba dispar
PKVQE

SEQ ID NO: 2372298 - protein, 7 aa, Entamoeba dispar
PKYDAPE

SEQ ID NO: 2372299 - protein, 5 aa, Entamoeba dispar
PKYDP

SEQ ID NO: 2372300 - protein, 7 aa, Entamoeba dispar
PKYGEVN

SEQ ID NO: 2372301 - protein, 4 aa, Entamoeba dispar
PKYS

SEQ ID NO: 2372302 - protein, 17 aa, Entamoeba dispar
PLAGEQDTSPSETSRDN

SEQ ID NO: 2372303 - protein, 8 aa, Entamoeba dispar
PLDAEGLA

SEQ ID NO: 2372304 - protein, 8 aa, Entamoeba dispar
PLDSSTSK

SEQ ID NO: 2372305 - protein, 5 aa, Entamoeba dispar
PLEPP

SEQ ID NO: 2372306 - protein, 6 aa, Entamoeba dispar
PLFEKD

SEQ ID NO: 2372307 - protein, 12 aa, Entamoeba dispar
PLFNEDKNQVYK

SEQ ID NO: 2372308 - protein, 6 aa, Entamoeba dispar
PLGKQQ

SEQ ID NO: 2372309 - protein, 5 aa, Entamoeba dispar
PLGPF

SEQ ID NO: 2372310 - protein, 8 aa, Entamoeba dispar
PLGSGTYG

SEQ ID NO: 2372311 - protein, 6 aa, Entamoeba dispar
PLKEDQ

SEQ ID NO: 2372312 - protein, 9 aa, Entamoeba dispar
PLKEEQISN

SEQ ID NO: 2372313 - protein, 10 aa, Entamoeba dispar
PLKLTTNNGT

SEQ ID NO: 2372314 - protein, 18 aa, Entamoeba dispar
PLKPKKKTRKKTKAQCVV

SEQ ID NO: 2372315 - protein, 7 aa, Entamoeba dispar
PLNGKRN

SEQ ID NO: 2372316 - protein, 4 aa, Entamoeba dispar
PLNR

SEQ ID NO: 2372317 - protein, 14 aa, Entamoeba dispar
PLNSKDKCKTVNSS

SEQ ID NO: 2372318 - protein, 35 aa, Entamoeba dispar
PLNTPNSVSSSTTLTPSVISSPSDSRNSLEVPNQK

SEQ ID NO: 2372319 - protein, 10 aa, Entamoeba dispar
PLPGGERDIN

SEQ ID NO: 2372320 - protein, 12 aa, Entamoeba dispar
PLPKRENTNPLI

SEQ ID NO: 2372321 - protein, 7 aa, Entamoeba dispar
PLPNGKG

SEQ ID NO: 2372322 - protein, 5 aa, Entamoeba dispar
PLPPR

SEQ ID NO: 2372323 - protein, 4 aa, Entamoeba dispar
PLPS

SEQ ID NO: 2372324 - protein, 40 aa, Entamoeba dispar
PLQRKKKKKKHGKKKLKKIPNPPNIEEEKEFRKEYQKEEV

SEQ ID NO: 2372325 - protein, 8 aa, Entamoeba dispar
PLQTTNED

SEQ ID NO: 2372326 - protein, 14 aa, Entamoeba dispar
PLRGDGKREDTERR

SEQ ID NO: 2372327 - protein, 13 aa, Entamoeba dispar
PLRPNESKKITEN

SEQ ID NO: 2372328 - protein, 4 aa, Entamoeba dispar
PLSD

SEQ ID NO: 2372329 - protein, 10 aa, Entamoeba dispar
PLSDTPLSKE

SEQ ID NO: 2372330 - protein, 5 aa, Entamoeba dispar
PLSEV

SEQ ID NO: 2372331 - protein, 4 aa, Entamoeba dispar
PLSL

SEQ ID NO: 2372332 - protein, 24 aa, Entamoeba dispar
PLSLPQRNQVSSRNFDEITFRDND

SEQ ID NO: 2372333 - protein, 5 aa, Entamoeba dispar
PLSNT

SEQ ID NO: 2372334 - protein, 7 aa, Entamoeba dispar
PLSPSNN

SEQ ID NO: 2372335 - protein, 19 aa, Entamoeba dispar
PLSSKQGRVESQNYSIRLF

SEQ ID NO: 2372336 - protein, 4 aa, Entamoeba dispar
PLST

SEQ ID NO: 2372337 - protein, 8 aa, Entamoeba dispar
PLSTHSKE

SEQ ID NO: 2372338 - protein, 8 aa, Entamoeba dispar
PLTEQNNI

SEQ ID NO: 2372339 - protein, 5 aa, Entamoeba dispar
PLTLK

SEQ ID NO: 2372340 - protein, 6 aa, Entamoeba dispar
PLTNES

SEQ ID NO: 2372341 - protein, 20 aa, Entamoeba dispar
PLTNESKTDQQEMISNEEEQ

SEQ ID NO: 2372342 - protein, 10 aa, Entamoeba dispar
PLTNKSYTIQ

SEQ ID NO: 2372343 - protein, 6 aa, Entamoeba dispar
PLTSDE

SEQ ID NO: 2372344 - protein, 7 aa, Entamoeba dispar
PLTSNNP

SEQ ID NO: 2372345 - protein, 13 aa, Entamoeba dispar
PLVESTDKVKPGL

SEQ ID NO: 2372346 - protein, 9 aa, Entamoeba dispar
PMPTREPPV

SEQ ID NO: 2372347 - protein, 8 aa, Entamoeba dispar
PNAHEDPQ

SEQ ID NO: 2372348 - protein, 5 aa, Entamoeba dispar
PNAKS

SEQ ID NO: 2372349 - protein, 7 aa, Entamoeba dispar
PNASKTY

SEQ ID NO: 2372350 - protein, 13 aa, Entamoeba dispar
PNCEESCKSPSMC

SEQ ID NO: 2372351 - protein, 14 aa, Entamoeba dispar
PNCQPGHCNGTTGA

SEQ ID NO: 2372352 - protein, 5 aa, Entamoeba dispar
PNDET

SEQ ID NO: 2372353 - protein, 9 aa, Entamoeba dispar
PNDKAANYA

SEQ ID NO: 2372354 - protein, 9 aa, Entamoeba dispar
PNDPNARAI

SEQ ID NO: 2372355 - protein, 10 aa, Entamoeba dispar
PNEFNEEVRP

SEQ ID NO: 2372356 - protein, 4 aa, Entamoeba dispar
PNEK

SEQ ID NO: 2372357 - protein, 6 aa, Entamoeba dispar
PNEKVN

SEQ ID NO: 2372358 - protein, 8 aa, Entamoeba dispar
PNENGQKC

SEQ ID NO: 2372359 - protein, 5 aa, Entamoeba dispar
PNETN

SEQ ID NO: 2372360 - protein, 6 aa, Entamoeba dispar
PNETTS

SEQ ID NO: 2372361 - protein, 11 aa, Entamoeba dispar
PNETVASDETI

SEQ ID NO: 2372362 - protein, 6 aa, Entamoeba dispar
PNFSDV

SEQ ID NO: 2372363 - protein, 12 aa, Entamoeba dispar
PNFTQPTRCENI

SEQ ID NO: 2372364 - protein, 7 aa, Entamoeba dispar
PNGMNPE

SEQ ID NO: 2372365 - protein, 7 aa, Entamoeba dispar
PNGRSCA

SEQ ID NO: 2372366 - protein, 5 aa, Entamoeba dispar
PNGSL

SEQ ID NO: 2372367 - protein, 8 aa, Entamoeba dispar
PNGTNSTS

SEQ ID NO: 2372368 - protein, 13 aa, Entamoeba dispar
PNGTSLPSSQQNI

SEQ ID NO: 2372369 - protein, 12 aa, Entamoeba dispar
PNHEVNIKAIID

SEQ ID NO: 2372370 - protein, 6 aa, Entamoeba dispar
PNHSNG

SEQ ID NO: 2372371 - protein, 4 aa, Entamoeba dispar
PNIP

SEQ ID NO: 2372372 - protein, 17 aa, Entamoeba dispar
PNIPGCSARNTNLPEAL

SEQ ID NO: 2372373 - protein, 5 aa, Entamoeba dispar
PNIQN

SEQ ID NO: 2372374 - protein, 10 aa, Entamoeba dispar
PNIQQTEGLS

SEQ ID NO: 2372375 - protein, 9 aa, Entamoeba dispar
PNIRNERRP

SEQ ID NO: 2372376 - protein, 5 aa, Entamoeba dispar
PNISG

SEQ ID NO: 2372377 - protein, 11 aa, Entamoeba dispar
PNISKVKSTTV

SEQ ID NO: 2372378 - protein, 4 aa, Entamoeba dispar
PNIT

SEQ ID NO: 2372379 - protein, 12 aa, Entamoeba dispar
PNITSKQGKIGM

SEQ ID NO: 2372380 - protein, 8 aa, Entamoeba dispar
PNKDAQEI

SEQ ID NO: 2372381 - protein, 7 aa, Entamoeba dispar
PNKNETI

SEQ ID NO: 2372382 - protein, 6 aa, Entamoeba dispar
PNKPIL

SEQ ID NO: 2372383 - protein, 7 aa, Entamoeba dispar
PNKPLSD

SEQ ID NO: 2372384 - protein, 11 aa, Entamoeba dispar
PNKQPIDKHTS

SEQ ID NO: 2372385 - protein, 7 aa, Entamoeba dispar
PNLGEGK

SEQ ID NO: 2372386 - protein, 10 aa, Entamoeba dispar
PNLKKNNEIH

SEQ ID NO: 2372387 - protein, 24 aa, Entamoeba dispar
PNLNAAQGNSQEKGKKQKIKFKTR

SEQ ID NO: 2372388 - protein, 4 aa, Entamoeba dispar
PNNA

SEQ ID NO: 2372389 - protein, 7 aa, Entamoeba dispar
PNNEIKE

SEQ ID NO: 2372390 - protein, 6 aa, Entamoeba dispar
PNNIQN

SEQ ID NO: 2372391 - protein, 4 aa, Entamoeba dispar
PNNK

SEQ ID NO: 2372392 - protein, 5 aa, Entamoeba dispar
PNNKR

SEQ ID NO: 2372393 - protein, 4 aa, Entamoeba dispar
PNNN

SEQ ID NO: 2372394 - protein, 15 aa, Entamoeba dispar
PNNNMKKDERISHTK

SEQ ID NO: 2372395 - protein, 5 aa, Entamoeba dispar
PNNPK

SEQ ID NO: 2372396 - protein, 7 aa, Entamoeba dispar
PNNPNEY

SEQ ID NO: 2372397 - protein, 7 aa, Entamoeba dispar
PNNPSLK

SEQ ID NO: 2372398 - protein, 11 aa, Entamoeba dispar
PNNSTLKPGNA

SEQ ID NO: 2372399 - protein, 5 aa, Entamoeba dispar
PNPIT

SEQ ID NO: 2372400 - protein, 8 aa, Entamoeba dispar
PNPKKPTI

SEQ ID NO: 2372401 - protein, 6 aa, Entamoeba dispar
PNPLEN

SEQ ID NO: 2372402 - protein, 4 aa, Entamoeba dispar
PNPY

SEQ ID NO: 2372403 - protein, 4 aa, Entamoeba dispar
PNQE

SEQ ID NO: 2372404 - protein, 10 aa, Entamoeba dispar
PNQGSNAKSK

SEQ ID NO: 2372405 - protein, 4 aa, Entamoeba dispar
PNQQ

SEQ ID NO: 2372406 - protein, 7 aa, Entamoeba dispar
PNQQELE

SEQ ID NO: 2372407 - protein, 5 aa, Entamoeba dispar
PNQTA

SEQ ID NO: 2372408 - protein, 4 aa, Entamoeba dispar
PNRR

SEQ ID NO: 2372409 - protein, 8 aa, Entamoeba dispar
PNSEDIKT

SEQ ID NO: 2372410 - protein, 6 aa, Entamoeba dispar
PNSEPN

SEQ ID NO: 2372411 - protein, 4 aa, Entamoeba dispar
PNSF

SEQ ID NO: 2372412 - protein, 4 aa, Entamoeba dispar
PNSK

SEQ ID NO: 2372413 - protein, 45 aa, Entamoeba dispar
PNSKSFDNEIHTNSSSNSVINNENTPSRSIESVPISSSGPSVGID

SEQ ID NO: 2372414 - protein, 7 aa, Entamoeba dispar
PNSKTTE

SEQ ID NO: 2372415 - protein, 4 aa, Entamoeba dispar
PNSM

SEQ ID NO: 2372416 - protein, 4 aa, Entamoeba dispar
PNSN

SEQ ID NO: 2372417 - protein, 5 aa, Entamoeba dispar
PNSPK

SEQ ID NO: 2372418 - protein, 8 aa, Entamoeba dispar
PNSQIGTE

SEQ ID NO: 2372419 - protein, 4 aa, Entamoeba dispar
PNSS

SEQ ID NO: 2372420 - protein, 6 aa, Entamoeba dispar
PNSSRV

SEQ ID NO: 2372421 - protein, 19 aa, Entamoeba dispar
PNTISSKKISDTIKSQRGR

SEQ ID NO: 2372422 - protein, 5 aa, Entamoeba dispar
PNTPF

SEQ ID NO: 2372423 - protein, 4 aa, Entamoeba dispar
PNTQ

SEQ ID NO: 2372424 - protein, 8 aa, Entamoeba dispar
PNTQENIA

SEQ ID NO: 2372425 - protein, 11 aa, Entamoeba dispar
PNTSVPPNPQF

SEQ ID NO: 2372426 - protein, 7 aa, Entamoeba dispar
PNVNTSQ

SEQ ID NO: 2372427 - protein, 7 aa, Entamoeba dispar
PNVPPKT

SEQ ID NO: 2372428 - protein, 18 aa, Entamoeba dispar
PNVSDEEVKQAIESNDNA

SEQ ID NO: 2372429 - protein, 4 aa, Entamoeba dispar
PNYE

SEQ ID NO: 2372430 - protein, 11 aa, Entamoeba dispar
PNYEGYQSSPV

SEQ ID NO: 2372431 - protein, 6 aa, Entamoeba dispar
PNYETF

SEQ ID NO: 2372432 - protein, 7 aa, Entamoeba dispar
PNYRDSL

SEQ ID NO: 2372433 - protein, 9 aa, Entamoeba dispar
PNYSDTKTD

SEQ ID NO: 2372434 - protein, 8 aa, Entamoeba dispar
PPAIKGKV

SEQ ID NO: 2372435 - protein, 9 aa, Entamoeba dispar
PPCSPANSH

SEQ ID NO: 2372436 - protein, 5 aa, Entamoeba dispar
PPDIN

SEQ ID NO: 2372437 - protein, 14 aa, Entamoeba dispar
PPDKKGKWCEEQTD

SEQ ID NO: 2372438 - protein, 19 aa, Entamoeba dispar
PPDNSQSSTSDSSDKIKDD

SEQ ID NO: 2372439 - protein, 13 aa, Entamoeba dispar
PPEDSDEPPLLNK

SEQ ID NO: 2372440 - protein, 5 aa, Entamoeba dispar
PPERM

SEQ ID NO: 2372441 - protein, 10 aa, Entamoeba dispar
PPEVESKNDV

SEQ ID NO: 2372442 - protein, 13 aa, Entamoeba dispar
PPFKKKGNINLET

SEQ ID NO: 2372443 - protein, 4 aa, Entamoeba dispar
PPFT

SEQ ID NO: 2372444 - protein, 4 aa, Entamoeba dispar
PPGM

SEQ ID NO: 2372445 - protein, 6 aa, Entamoeba dispar
PPGTQI

SEQ ID NO: 2372446 - protein, 6 aa, Entamoeba dispar
PPHTTK

SEQ ID NO: 2372447 - protein, 5 aa, Entamoeba dispar
PPIGE

SEQ ID NO: 2372448 - protein, 5 aa, Entamoeba dispar
PPIKG

SEQ ID NO: 2372449 - protein, 10 aa, Entamoeba dispar
PPIPNEKVNK

SEQ ID NO: 2372450 - protein, 12 aa, Entamoeba dispar
PPKIPKEEKNKK

SEQ ID NO: 2372451 - protein, 6 aa, Entamoeba dispar
PPKLTA

SEQ ID NO: 2372452 - protein, 7 aa, Entamoeba dispar
PPLKSSK

SEQ ID NO: 2372453 - protein, 4 aa, Entamoeba dispar
PPLN

SEQ ID NO: 2372454 - protein, 6 aa, Entamoeba dispar
PPNDMK

SEQ ID NO: 2372455 - protein, 7 aa, Entamoeba dispar
PPNDTAW

SEQ ID NO: 2372456 - protein, 11 aa, Entamoeba dispar
PPNPNNGTPGM

SEQ ID NO: 2372457 - protein, 11 aa, Entamoeba dispar
PPNPSNGTPRM

SEQ ID NO: 2372458 - protein, 5 aa, Entamoeba dispar
PPPFN

SEQ ID NO: 2372459 - protein, 6 aa, Entamoeba dispar
PPPNIE

SEQ ID NO: 2372460 - protein, 7 aa, Entamoeba dispar
PPPPDTR

SEQ ID NO: 2372461 - protein, 10 aa, Entamoeba dispar
PPPPKPLRQY

SEQ ID NO: 2372462 - protein, 11 aa, Entamoeba dispar
PPPSVDSKYEY

SEQ ID NO: 2372463 - protein, 6 aa, Entamoeba dispar
PPQDTL

SEQ ID NO: 2372464 - protein, 4 aa, Entamoeba dispar
PPQS

SEQ ID NO: 2372465 - protein, 5 aa, Entamoeba dispar
PPRGW

SEQ ID NO: 2372466 - protein, 8 aa, Entamoeba dispar
PPRPNLNS

SEQ ID NO: 2372467 - protein, 8 aa, Entamoeba dispar
PPRSTQKC

SEQ ID NO: 2372468 - protein, 7 aa, Entamoeba dispar
PPSFTGE

SEQ ID NO: 2372469 - protein, 6 aa, Entamoeba dispar
PPSGCK

SEQ ID NO: 2372470 - protein, 8 aa, Entamoeba dispar
PPSIGEGT

SEQ ID NO: 2372471 - protein, 6 aa, Entamoeba dispar
PPSITS

SEQ ID NO: 2372472 - protein, 6 aa, Entamoeba dispar
PPSKST

SEQ ID NO: 2372473 - protein, 7 aa, Entamoeba dispar
PPSPLTT

SEQ ID NO: 2372474 - protein, 9 aa, Entamoeba dispar
PPSTGNKGI

SEQ ID NO: 2372475 - protein, 13 aa, Entamoeba dispar
PPTESESDNGTLN

SEQ ID NO: 2372476 - protein, 4 aa, Entamoeba dispar
PPTF

SEQ ID NO: 2372477 - protein, 5 aa, Entamoeba dispar
PPTGL

SEQ ID NO: 2372478 - protein, 17 aa, Entamoeba dispar
PPTSGTYVQPVYGLGQS

SEQ ID NO: 2372479 - protein, 6 aa, Entamoeba dispar
PPTTRT

SEQ ID NO: 2372480 - protein, 4 aa, Entamoeba dispar
PPWA

SEQ ID NO: 2372481 - protein, 16 aa, Entamoeba dispar
PPWEGSQEGNDGKIVD

SEQ ID NO: 2372482 - protein, 9 aa, Entamoeba dispar
PQDDTVDNE

SEQ ID NO: 2372483 - protein, 4 aa, Entamoeba dispar
PQDI

SEQ ID NO: 2372484 - protein, 10 aa, Entamoeba dispar
PQDNSDEEGC

SEQ ID NO: 2372485 - protein, 5 aa, Entamoeba dispar
PQDTL

SEQ ID NO: 2372486 - protein, 5 aa, Entamoeba dispar
PQDTV

SEQ ID NO: 2372487 - protein, 10 aa, Entamoeba dispar
PQEEKDLYGT

SEQ ID NO: 2372488 - protein, 5 aa, Entamoeba dispar
PQEGG

SEQ ID NO: 2372489 - protein, 5 aa, Entamoeba dispar
PQEID

SEQ ID NO: 2372490 - protein, 9 aa, Entamoeba dispar
PQEKKYGIR

SEQ ID NO: 2372491 - protein, 11 aa, Entamoeba dispar
PQEKYEDEDSF

SEQ ID NO: 2372492 - protein, 6 aa, Entamoeba dispar
PQEREN

SEQ ID NO: 2372493 - protein, 13 aa, Entamoeba dispar
PQGYKTSVQSGQI

SEQ ID NO: 2372494 - protein, 9 aa, Entamoeba dispar
PQHKETFDN

SEQ ID NO: 2372495 - protein, 10 aa, Entamoeba dispar
PQHNTQCEPQ

SEQ ID NO: 2372496 - protein, 6 aa, Entamoeba dispar
PQHPEM

SEQ ID NO: 2372497 - protein, 5 aa, Entamoeba dispar
PQIEG

SEQ ID NO: 2372498 - protein, 11 aa, Entamoeba dispar
PQLQSDSAMTA

SEQ ID NO: 2372499 - protein, 4 aa, Entamoeba dispar
PQMC

SEQ ID NO: 2372500 - protein, 9 aa, Entamoeba dispar
PQNQELKGN

SEQ ID NO: 2372501 - protein, 11 aa, Entamoeba dispar
PQPINQPSSGC

SEQ ID NO: 2372502 - protein, 5 aa, Entamoeba dispar
PQPKF

SEQ ID NO: 2372503 - protein, 4 aa, Entamoeba dispar
PQPL

SEQ ID NO: 2372504 - protein, 7 aa, Entamoeba dispar
PQPMSSD

SEQ ID NO: 2372505 - protein, 9 aa, Entamoeba dispar
PQPTQSIKN

SEQ ID NO: 2372506 - protein, 6 aa, Entamoeba dispar
PQQEFS

SEQ ID NO: 2372507 - protein, 10 aa, Entamoeba dispar
PQQLTSSNIP

SEQ ID NO: 2372508 - protein, 10 aa, Entamoeba dispar
PQQNDTLGTV

SEQ ID NO: 2372509 - protein, 9 aa, Entamoeba dispar
PQQQCPNDK

SEQ ID NO: 2372510 - protein, 5 aa, Entamoeba dispar
PQQSY

SEQ ID NO: 2372511 - protein, 4 aa, Entamoeba dispar
PQRF

SEQ ID NO: 2372512 - protein, 5 aa, Entamoeba dispar
PQRPE

SEQ ID NO: 2372513 - protein, 4 aa, Entamoeba dispar
PQSE

SEQ ID NO: 2372514 - protein, 12 aa, Entamoeba dispar
PQSFSKDIEGRN

SEQ ID NO: 2372515 - protein, 5 aa, Entamoeba dispar
PQSPV

SEQ ID NO: 2372516 - protein, 11 aa, Entamoeba dispar
PQTCEKSTAIT

SEQ ID NO: 2372517 - protein, 7 aa, Entamoeba dispar
PQTDKTQ

SEQ ID NO: 2372518 - protein, 6 aa, Entamoeba dispar
PQTKRA

SEQ ID NO: 2372519 - protein, 14 aa, Entamoeba dispar
PQTNKENEVNDTAA

SEQ ID NO: 2372520 - protein, 10 aa, Entamoeba dispar
PQTNNDSSER

SEQ ID NO: 2372521 - protein, 6 aa, Entamoeba dispar
PQTPLN

SEQ ID NO: 2372522 - protein, 13 aa, Entamoeba dispar
PQTQVKDNKENKS

SEQ ID NO: 2372523 - protein, 4 aa, Entamoeba dispar
PQVP

SEQ ID NO: 2372524 - protein, 4 aa, Entamoeba dispar
PQYD

SEQ ID NO: 2372525 - protein, 22 aa, Entamoeba dispar
PQYNQQYTQPPVYTQPASYQEG

SEQ ID NO: 2372526 - protein, 7 aa, Entamoeba dispar
PQYPPTP

SEQ ID NO: 2372527 - protein, 4 aa, Entamoeba dispar
PQYS

SEQ ID NO: 2372528 - protein, 5 aa, Entamoeba dispar
PQYSP

SEQ ID NO: 2372529 - protein, 6 aa, Entamoeba dispar
PQYTDN

SEQ ID NO: 2372530 - protein, 10 aa, Entamoeba dispar
PRANATQRES

SEQ ID NO: 2372531 - protein, 10 aa, Entamoeba dispar
PRDHSPLGFD

SEQ ID NO: 2372532 - protein, 8 aa, Entamoeba dispar
PRDIGPNI

SEQ ID NO: 2372533 - protein, 6 aa, Entamoeba dispar
PRFTDN

SEQ ID NO: 2372534 - protein, 4 aa, Entamoeba dispar
PRIS

SEQ ID NO: 2372535 - protein, 6 aa, Entamoeba dispar
PRKDEG

SEQ ID NO: 2372536 - protein, 7 aa, Entamoeba dispar
PRKKYEY

SEQ ID NO: 2372537 - protein, 5 aa, Entamoeba dispar
PRKQT

SEQ ID NO: 2372538 - protein, 6 aa, Entamoeba dispar
PRKREW

SEQ ID NO: 2372539 - protein, 4 aa, Entamoeba dispar
PRND

SEQ ID NO: 2372540 - protein, 17 aa, Entamoeba dispar
PRPPLSQNINEGFPSSH

SEQ ID NO: 2372541 - protein, 4 aa, Entamoeba dispar
PRPS

SEQ ID NO: 2372542 - protein, 4 aa, Entamoeba dispar
PRPT

SEQ ID NO: 2372543 - protein, 15 aa, Entamoeba dispar
PRQDISEENPVTIQR

SEQ ID NO: 2372544 - protein, 8 aa, Entamoeba dispar
PRQSTTIT

SEQ ID NO: 2372545 - protein, 41 aa, Entamoeba dispar
  misc_feature (18)..(19): Xaa can be any naturally occurring amino acid
PRRCEAKKFGGPGARAKXXIYFTMLFNHFSLSSSLSFFFTF

SEQ ID NO: 2372546 - protein, 6 aa, Entamoeba dispar
PRRSSV

SEQ ID NO: 2372547 - protein, 7 aa, Entamoeba dispar
PRRTDDR

SEQ ID NO: 2372548 - protein, 5 aa, Entamoeba dispar
PRSAG

SEQ ID NO: 2372549 - protein, 6 aa, Entamoeba dispar
PRSERI

SEQ ID NO: 2372550 - protein, 4 aa, Entamoeba dispar
PRSK

SEQ ID NO: 2372551 - protein, 5 aa, Entamoeba dispar
PRSPV

SEQ ID NO: 2372552 - protein, 13 aa, Entamoeba dispar
PRSSLSKNAKNMK

SEQ ID NO: 2372553 - protein, 7 aa, Entamoeba dispar
PRSTHTK

SEQ ID NO: 2372554 - protein, 7 aa, Entamoeba dispar
PRVDDQD

SEQ ID NO: 2372555 - protein, 4 aa, Entamoeba dispar
PRVG

SEQ ID NO: 2372556 - protein, 15 aa, Entamoeba dispar
PRVSLNNDNKPPFGP

SEQ ID NO: 2372557 - protein, 7 aa, Entamoeba dispar
PRYEQDE

SEQ ID NO: 2372558 - protein, 5 aa, Entamoeba dispar
PRYTG

SEQ ID NO: 2372559 - protein, 11 aa, Entamoeba dispar
PSADEEKETEL

SEQ ID NO: 2372560 - protein, 9 aa, Entamoeba dispar
PSDDGTYCQ

SEQ ID NO: 2372561 - protein, 4 aa, Entamoeba dispar
PSDE

SEQ ID NO: 2372562 - protein, 6 aa, Entamoeba dispar
PSDGPV

SEQ ID NO: 2372563 - protein, 10 aa, Entamoeba dispar
PSDRKSPNLQ

SEQ ID NO: 2372564 - protein, 9 aa, Entamoeba dispar
PSDRSMPLN

SEQ ID NO: 2372565 - protein, 7 aa, Entamoeba dispar
PSDSTIQ

SEQ ID NO: 2372566 - protein, 7 aa, Entamoeba dispar
PSDTSKL

SEQ ID NO: 2372567 - protein, 4 aa, Entamoeba dispar
PSEL

SEQ ID NO: 2372568 - protein, 7 aa, Entamoeba dispar
PSELPEN

SEQ ID NO: 2372569 - protein, 17 aa, Entamoeba dispar
PSERGIKETDPTVTGHV

SEQ ID NO: 2372570 - protein, 9 aa, Entamoeba dispar
PSESSLDTQ

SEQ ID NO: 2372571 - protein, 7 aa, Entamoeba dispar
PSFGHRP

SEQ ID NO: 2372572 - protein, 6 aa, Entamoeba dispar
PSFGTS

SEQ ID NO: 2372573 - protein, 4 aa, Entamoeba dispar
PSFL

SEQ ID NO: 2372574 - protein, 15 aa, Entamoeba dispar
PSFNDSKGPESQREY

SEQ ID NO: 2372575 - protein, 19 aa, Entamoeba dispar
PSFNENGEKYYQASSPDEV

SEQ ID NO: 2372576 - protein, 8 aa, Entamoeba dispar
PSFPSKKE

SEQ ID NO: 2372577 - protein, 8 aa, Entamoeba dispar
PSFSKTDF

SEQ ID NO: 2372578 - protein, 14 aa, Entamoeba dispar
PSGLSSESKPEKIW

SEQ ID NO: 2372579 - protein, 10 aa, Entamoeba dispar
PSGSASIIQS

SEQ ID NO: 2372580 - protein, 7 aa, Entamoeba dispar
PSGSSAY

SEQ ID NO: 2372581 - protein, 11 aa, Entamoeba dispar
PSHLDSPYTSI

SEQ ID NO: 2372582 - protein, 7 aa, Entamoeba dispar
PSHSSNE

SEQ ID NO: 2372583 - protein, 5 aa, Entamoeba dispar
PSIDF

SEQ ID NO: 2372584 - protein, 9 aa, Entamoeba dispar
PSINASPNV

SEQ ID NO: 2372585 - protein, 12 aa, Entamoeba dispar
PSINYSDVTGNP

SEQ ID NO: 2372586 - protein, 14 aa, Entamoeba dispar
PSIPSSEETTESTA

SEQ ID NO: 2372587 - protein, 11 aa, Entamoeba dispar
PSIREKAQQSM

SEQ ID NO: 2372588 - protein, 19 aa, Entamoeba dispar
PSISNEGERYYQASSPDEV

SEQ ID NO: 2372589 - protein, 10 aa, Entamoeba dispar
PSISTSTPFN

SEQ ID NO: 2372590 - protein, 6 aa, Entamoeba dispar
PSKIDE

SEQ ID NO: 2372591 - protein, 8 aa, Entamoeba dispar
PSKKEDVH

SEQ ID NO: 2372592 - protein, 8 aa, Entamoeba dispar
PSKLRGVA

SEQ ID NO: 2372593 - protein, 18 aa, Entamoeba dispar
PSKPTPPPHRANTQPLNT

SEQ ID NO: 2372594 - protein, 7 aa, Entamoeba dispar
PSKRPCC

SEQ ID NO: 2372595 - protein, 6 aa, Entamoeba dispar
PSKTYS

SEQ ID NO: 2372596 - protein, 4 aa, Entamoeba dispar
PSKV

SEQ ID NO: 2372597 - protein, 14 aa, Entamoeba dispar
PSLITTPNKNDLQL

SEQ ID NO: 2372598 - protein, 5 aa, Entamoeba dispar
PSLLS

SEQ ID NO: 2372599 - protein, 7 aa, Entamoeba dispar
PSLPQQP

SEQ ID NO: 2372600 - protein, 7 aa, Entamoeba dispar
PSLQQSL

SEQ ID NO: 2372601 - protein, 7 aa, Entamoeba dispar
PSLRPKF

SEQ ID NO: 2372602 - protein, 4 aa, Entamoeba dispar
PSLS

SEQ ID NO: 2372603 - protein, 4 aa, Entamoeba dispar
PSLT

SEQ ID NO: 2372604 - protein, 4 aa, Entamoeba dispar
PSME

SEQ ID NO: 2372605 - protein, 8 aa, Entamoeba dispar
PSNDGLSC

SEQ ID NO: 2372606 - protein, 18 aa, Entamoeba dispar
PSNDSKPCVNKPNISYEG

SEQ ID NO: 2372607 - protein, 9 aa, Entamoeba dispar
PSNEFDDSS

SEQ ID NO: 2372608 - protein, 6 aa, Entamoeba dispar
PSNEGK

SEQ ID NO: 2372609 - protein, 16 aa, Entamoeba dispar
PSNEYLSKPGDSRGTL

SEQ ID NO: 2372610 - protein, 5 aa, Entamoeba dispar
PSNIT

SEQ ID NO: 2372611 - protein, 8 aa, Entamoeba dispar
PSNNNDQL

SEQ ID NO: 2372612 - protein, 12 aa, Entamoeba dispar
PSNNTQHSNLMD

SEQ ID NO: 2372613 - protein, 5 aa, Entamoeba dispar
PSNPR

SEQ ID NO: 2372614 - protein, 7 aa, Entamoeba dispar
PSNTTCN

SEQ ID NO: 2372615 - protein, 18 aa, Entamoeba dispar
PSPGLGSAEAYTKRNKKL

SEQ ID NO: 2372616 - protein, 9 aa, Entamoeba dispar
PSPKEEGTY

SEQ ID NO: 2372617 - protein, 7 aa, Entamoeba dispar
PSPLGTT

SEQ ID NO: 2372618 - protein, 7 aa, Entamoeba dispar
PSPPQQT

SEQ ID NO: 2372619 - protein, 7 aa, Entamoeba dispar
PSPSIED

SEQ ID NO: 2372620 - protein, 9 aa, Entamoeba dispar
PSPSPEVRK

SEQ ID NO: 2372621 - protein, 7 aa, Entamoeba dispar
PSQEKRS

SEQ ID NO: 2372622 - protein, 8 aa, Entamoeba dispar
PSQKAKIV

SEQ ID NO: 2372623 - protein, 9 aa, Entamoeba dispar
PSQKQPNGR

SEQ ID NO: 2372624 - protein, 4 aa, Entamoeba dispar
PSQL

SEQ ID NO: 2372625 - protein, 5 aa, Entamoeba dispar
PSRFT

SEQ ID NO: 2372626 - protein, 8 aa, Entamoeba dispar
PSRGDYQI

SEQ ID NO: 2372627 - protein, 4 aa, Entamoeba dispar
PSRP

SEQ ID NO: 2372628 - protein, 7 aa, Entamoeba dispar
PSRPQTI

SEQ ID NO: 2372629 - protein, 10 aa, Entamoeba dispar
PSSCENGLCS

SEQ ID NO: 2372630 - protein, 4 aa, Entamoeba dispar
PSSD

SEQ ID NO: 2372631 - protein, 7 aa, Entamoeba dispar
PSSDSGG

SEQ ID NO: 2372632 - protein, 7 aa, Entamoeba dispar
PSSDYSF

SEQ ID NO: 2372633 - protein, 15 aa, Entamoeba dispar
PSSFEQQPDYSKYTA

SEQ ID NO: 2372634 - protein, 4 aa, Entamoeba dispar
PSSG

SEQ ID NO: 2372635 - protein, 17 aa, Entamoeba dispar
PSSGDPSNGPDDNKTTG

SEQ ID NO: 2372636 - protein, 4 aa, Entamoeba dispar
PSSL

SEQ ID NO: 2372637 - protein, 5 aa, Entamoeba dispar
PSSLK

SEQ ID NO: 2372638 - protein, 4 aa, Entamoeba dispar
PSSN

SEQ ID NO: 2372639 - protein, 10 aa, Entamoeba dispar
PSSPSPNSVL

SEQ ID NO: 2372640 - protein, 6 aa, Entamoeba dispar
PSSPYV

SEQ ID NO: 2372641 - protein, 6 aa, Entamoeba dispar
PSSQNA

SEQ ID NO: 2372642 - protein, 7 aa, Entamoeba dispar
PSSTYPD

SEQ ID NO: 2372643 - protein, 6 aa, Entamoeba dispar
PSTEYK

SEQ ID NO: 2372644 - protein, 19 aa, Entamoeba dispar
PSTFGYDNGPTTTQETGSF

SEQ ID NO: 2372645 - protein, 13 aa, Entamoeba dispar
PSTFLSSSNDIQT

SEQ ID NO: 2372646 - protein, 10 aa, Entamoeba dispar
PSTGDVKPTI

SEQ ID NO: 2372647 - protein, 9 aa, Entamoeba dispar
PSTGKIKSL

SEQ ID NO: 2372648 - protein, 5 aa, Entamoeba dispar
PSTKA

SEQ ID NO: 2372649 - protein, 4 aa, Entamoeba dispar
PSTN

SEQ ID NO: 2372650 - protein, 10 aa, Entamoeba dispar
PSTNYSGPVE

SEQ ID NO: 2372651 - protein, 4 aa, Entamoeba dispar
PSTP

SEQ ID NO: 2372652 - protein, 8 aa, Entamoeba dispar
PSTQQTPI

SEQ ID NO: 2372653 - protein, 26 aa, Entamoeba dispar
PSTRALSKKLDDNEDNNEDDNKDITI

SEQ ID NO: 2372654 - protein, 10 aa, Entamoeba dispar
PSTRNNRKIR

SEQ ID NO: 2372655 - protein, 4 aa, Entamoeba dispar
PSTT

SEQ ID NO: 2372656 - protein, 7 aa, Entamoeba dispar
PSTTCTT

SEQ ID NO: 2372657 - protein, 16 aa, Entamoeba dispar
PSTTNSVTLKGRNELK

SEQ ID NO: 2372658 - protein, 8 aa, Entamoeba dispar
PSTTSTAS

SEQ ID NO: 2372659 - protein, 5 aa, Entamoeba dispar
PSTVF

SEQ ID NO: 2372660 - protein, 11 aa, Entamoeba dispar
PSVKSKQINGE

SEQ ID NO: 2372661 - protein, 13 aa, Entamoeba dispar
PSVSNSSGESLHS

SEQ ID NO: 2372662 - protein, 5 aa, Entamoeba dispar
PSVTF

SEQ ID NO: 2372663 - protein, 7 aa, Entamoeba dispar
PSVYGSY

SEQ ID NO: 2372664 - protein, 7 aa, Entamoeba dispar
PSYQNNT

SEQ ID NO: 2372665 - protein, 5 aa, Entamoeba dispar
PSYQP

SEQ ID NO: 2372666 - protein, 4 aa, Entamoeba dispar
PTAG

SEQ ID NO: 2372667 - protein, 4 aa, Entamoeba dispar
PTCG

SEQ ID NO: 2372668 - protein, 18 aa, Entamoeba dispar
PTCGNGKIDEYEECDGGY

SEQ ID NO: 2372669 - protein, 18 aa, Entamoeba dispar
PTCGNGKVDEYEECDGGY

SEQ ID NO: 2372670 - protein, 5 aa, Entamoeba dispar
PTCPN

SEQ ID NO: 2372671 - protein, 7 aa, Entamoeba dispar
PTDNSYV

SEQ ID NO: 2372672 - protein, 8 aa, Entamoeba dispar
PTDSTLTS

SEQ ID NO: 2372673 - protein, 4 aa, Entamoeba dispar
PTEA

SEQ ID NO: 2372674 - protein, 5 aa, Entamoeba dispar
PTEFE

SEQ ID NO: 2372675 - protein, 9 aa, Entamoeba dispar
PTEGDCGES

SEQ ID NO: 2372676 - protein, 9 aa, Entamoeba dispar
PTEIENNKD

SEQ ID NO: 2372677 - protein, 20 aa, Entamoeba dispar
PTEIENNKNNQVKSINGKDP

SEQ ID NO: 2372678 - protein, 6 aa, Entamoeba dispar
PTENYL

SEQ ID NO: 2372679 - protein, 11 aa, Entamoeba dispar
PTEQNNESQDV

SEQ ID NO: 2372680 - protein, 7 aa, Entamoeba dispar
PTERSDI

SEQ ID NO: 2372681 - protein, 9 aa, Entamoeba dispar
PTESGEGVD

SEQ ID NO: 2372682 - protein, 5 aa, Entamoeba dispar
PTGAN

SEQ ID NO: 2372683 - protein, 4 aa, Entamoeba dispar
PTGC

SEQ ID NO: 2372684 - protein, 7 aa, Entamoeba dispar
PTGGGKS

SEQ ID NO: 2372685 - protein, 5 aa, Entamoeba dispar
PTGGI

SEQ ID NO: 2372686 - protein, 15 aa, Entamoeba dispar
PTGISSKEKVRKATE

SEQ ID NO: 2372687 - protein, 10 aa, Entamoeba dispar
PTGKSNPMSA

SEQ ID NO: 2372688 - protein, 4 aa, Entamoeba dispar
PTHE

SEQ ID NO: 2372689 - protein, 8 aa, Entamoeba dispar
PTIPNSPY

SEQ ID NO: 2372690 - protein, 5 aa, Entamoeba dispar
PTIPQ

SEQ ID NO: 2372691 - protein, 7 aa, Entamoeba dispar
PTITPNQ

SEQ ID NO: 2372692 - protein, 15 aa, Entamoeba dispar
PTKPTPKPLTPEEIE

SEQ ID NO: 2372693 - protein, 6 aa, Entamoeba dispar
PTKQHP

SEQ ID NO: 2372694 - protein, 8 aa, Entamoeba dispar
PTKTSGGH

SEQ ID NO: 2372695 - protein, 5 aa, Entamoeba dispar
PTKVN

SEQ ID NO: 2372696 - protein, 8 aa, Entamoeba dispar
PTKYPDGF

SEQ ID NO: 2372697 - protein, 6 aa, Entamoeba dispar
PTLGEL

SEQ ID NO: 2372698 - protein, 7 aa, Entamoeba dispar
PTLNKTQ

SEQ ID NO: 2372699 - protein, 6 aa, Entamoeba dispar
PTLTES

SEQ ID NO: 2372700 - protein, 13 aa, Entamoeba dispar
PTMASVPPPSNQY

SEQ ID NO: 2372701 - protein, 10 aa, Entamoeba dispar
PTNGEPRSIV

SEQ ID NO: 2372702 - protein, 6 aa, Entamoeba dispar
PTNIGS

SEQ ID NO: 2372703 - protein, 8 aa, Entamoeba dispar
PTNLGSSL

SEQ ID NO: 2372704 - protein, 8 aa, Entamoeba dispar
PTNPADEI

SEQ ID NO: 2372705 - protein, 6 aa, Entamoeba dispar
PTNSGS

SEQ ID NO: 2372706 - protein, 8 aa, Entamoeba dispar
PTNSSSSL

SEQ ID NO: 2372707 - protein, 4 aa, Entamoeba dispar
PTPF

SEQ ID NO: 2372708 - protein, 5 aa, Entamoeba dispar
PTPIE

SEQ ID NO: 2372709 - protein, 5 aa, Entamoeba dispar
PTPPY

SEQ ID NO: 2372710 - protein, 12 aa, Entamoeba dispar
PTPSIDQRGKKI

SEQ ID NO: 2372711 - protein, 4 aa, Entamoeba dispar
PTPT

SEQ ID NO: 2372712 - protein, 17 aa, Entamoeba dispar
PTPYINENKKETKFTPY

SEQ ID NO: 2372713 - protein, 6 aa, Entamoeba dispar
PTPYSG

SEQ ID NO: 2372714 - protein, 12 aa, Entamoeba dispar
PTQAPAGSMCET

SEQ ID NO: 2372715 - protein, 8 aa, Entamoeba dispar
PTQETTKS

SEQ ID NO: 2372716 - protein, 13 aa, Entamoeba dispar
PTQIKHDAKYNKH

SEQ ID NO: 2372717 - protein, 6 aa, Entamoeba dispar
PTQPPI

SEQ ID NO: 2372718 - protein, 35 aa, Entamoeba dispar
PTQYSNQPVQRPQINQPAPQEKPSVDQSSMPAPTI

SEQ ID NO: 2372719 - protein, 5 aa, Entamoeba dispar
PTRNI

SEQ ID NO: 2372720 - protein, 5 aa, Entamoeba dispar
PTRPI

SEQ ID NO: 2372721 - protein, 4 aa, Entamoeba dispar
PTSD

SEQ ID NO: 2372722 - protein, 15 aa, Entamoeba dispar
PTSKPKKFKKESASL

SEQ ID NO: 2372723 - protein, 14 aa, Entamoeba dispar
PTSKPKKFKNKPSF

SEQ ID NO: 2372724 - protein, 4 aa, Entamoeba dispar
PTSL

SEQ ID NO: 2372725 - protein, 4 aa, Entamoeba dispar
PTSV

SEQ ID NO: 2372726 - protein, 5 aa, Entamoeba dispar
PTSVE

SEQ ID NO: 2372727 - protein, 4 aa, Entamoeba dispar
PTTE

SEQ ID NO: 2372728 - protein, 7 aa, Entamoeba dispar
PTTGALH

SEQ ID NO: 2372729 - protein, 7 aa, Entamoeba dispar
PTTGLDS

SEQ ID NO: 2372730 - protein, 5 aa, Entamoeba dispar
PTTNT

SEQ ID NO: 2372731 - protein, 7 aa, Entamoeba dispar
PTTNTRD

SEQ ID NO: 2372732 - protein, 10 aa, Entamoeba dispar
PTTSGKVPNQ

SEQ ID NO: 2372733 - protein, 7 aa, Entamoeba dispar
PTTSSEK

SEQ ID NO: 2372734 - protein, 6 aa, Entamoeba dispar
PTTTIS

SEQ ID NO: 2372735 - protein, 11 aa, Entamoeba dispar
PTYNKTNSFTQ

SEQ ID NO: 2372736 - protein, 7 aa, Entamoeba dispar
PTYNVPE

SEQ ID NO: 2372737 - protein, 4 aa, Entamoeba dispar
PVDN

SEQ ID NO: 2372738 - protein, 23 aa, Entamoeba dispar
PVEEKTKKNKKQQKKEEVESEEL

SEQ ID NO: 2372739 - protein, 9 aa, Entamoeba dispar
PVEQPKRNK

SEQ ID NO: 2372740 - protein, 6 aa, Entamoeba dispar
PVETGI

SEQ ID NO: 2372741 - protein, 7 aa, Entamoeba dispar
PVGDPKD

SEQ ID NO: 2372742 - protein, 6 aa, Entamoeba dispar
PVGKSG

SEQ ID NO: 2372743 - protein, 12 aa, Entamoeba dispar
PVIKDDSEELDQ

SEQ ID NO: 2372744 - protein, 8 aa, Entamoeba dispar
PVKGEKRK

SEQ ID NO: 2372745 - protein, 6 aa, Entamoeba dispar
PVKPSP

SEQ ID NO: 2372746 - protein, 10 aa, Entamoeba dispar
PVNGKTGVSR

SEQ ID NO: 2372747 - protein, 12 aa, Entamoeba dispar
PVNKEKIKTLKN

SEQ ID NO: 2372748 - protein, 7 aa, Entamoeba dispar
PVNNENQ

SEQ ID NO: 2372749 - protein, 5 aa, Entamoeba dispar
PVNNK

SEQ ID NO: 2372750 - protein, 8 aa, Entamoeba dispar
PVPCTTYN

SEQ ID NO: 2372751 - protein, 12 aa, Entamoeba dispar
PVPEKDFGFPST

SEQ ID NO: 2372752 - protein, 6 aa, Entamoeba dispar
PVPSES

SEQ ID NO: 2372753 - protein, 11 aa, Entamoeba dispar
PVPSGEVPTQY

SEQ ID NO: 2372754 - protein, 5 aa, Entamoeba dispar
PVPSL

SEQ ID NO: 2372755 - protein, 32 aa, Entamoeba dispar
PVRKNNNPQQTNQNEEEEEMSEEEGVEEEESD

SEQ ID NO: 2372756 - protein, 4 aa, Entamoeba dispar
PVRQ

SEQ ID NO: 2372757 - protein, 29 aa, Entamoeba dispar
PVSTNQQITSSSSLNQSIQQQQLSNQPND

SEQ ID NO: 2372758 - protein, 8 aa, Entamoeba dispar
PVTGSLRQ

SEQ ID NO: 2372759 - protein, 10 aa, Entamoeba dispar
PVTTTQPKQL

SEQ ID NO: 2372760 - protein, 15 aa, Entamoeba dispar
PWEQEDNIQETNKES

SEQ ID NO: 2372761 - protein, 8 aa, Entamoeba dispar
PWPKDSSI

SEQ ID NO: 2372762 - protein, 7 aa, Entamoeba dispar
PYAKPRK

SEQ ID NO: 2372763 - protein, 13 aa, Entamoeba dispar
PYEAPPQYPYQPF

SEQ ID NO: 2372764 - protein, 6 aa, Entamoeba dispar
PYEDGY

SEQ ID NO: 2372765 - protein, 12 aa, Entamoeba dispar
PYEDTNNQNNSN

SEQ ID NO: 2372766 - protein, 14 aa, Entamoeba dispar
PYENGSYPEDDVQQ

SEQ ID NO: 2372767 - protein, 5 aa, Entamoeba dispar
PYGGN

SEQ ID NO: 2372768 - protein, 4 aa, Entamoeba dispar
PYHS

SEQ ID NO: 2372769 - protein, 5 aa, Entamoeba dispar
PYHTT

SEQ ID NO: 2372770 - protein, 22 aa, Entamoeba dispar
PYKRSTGANTEQQCDYRTEEAL

SEQ ID NO: 2372771 - protein, 12 aa, Entamoeba dispar
PYNPEQFPDSES

SEQ ID NO: 2372772 - protein, 5 aa, Entamoeba dispar
PYPDN

SEQ ID NO: 2372773 - protein, 4 aa, Entamoeba dispar
PYPI

SEQ ID NO: 2372774 - protein, 9 aa, Entamoeba dispar
PYPKGPVPI

SEQ ID NO: 2372775 - protein, 9 aa, Entamoeba dispar
PYPPPPIDN

SEQ ID NO: 2372776 - protein, 13 aa, Entamoeba dispar
PYPPQIDSYKGYD

SEQ ID NO: 2372777 - protein, 9 aa, Entamoeba dispar
PYQKTEHPL

SEQ ID NO: 2372778 - protein, 5 aa, Entamoeba dispar
PYQLE

SEQ ID NO: 2372779 - protein, 5 aa, Entamoeba dispar
PYQSL

SEQ ID NO: 2372780 - protein, 19 aa, Entamoeba dispar
PYQTEEDTSQMIKNDPEQF

SEQ ID NO: 2372781 - protein, 13 aa, Entamoeba dispar
PYSARPKFGERTQ

SEQ ID NO: 2372782 - protein, 9 aa, Entamoeba dispar
PYSEINSNN

SEQ ID NO: 2372783 - protein, 7 aa, Entamoeba dispar
PYSQSGV

SEQ ID NO: 2372784 - protein, 9 aa, Entamoeba dispar
PYSYPSNGK

SEQ ID NO: 2372785 - protein, 7 aa, Entamoeba dispar
PYTPPNK

SEQ ID NO: 2372786 - protein, 6 aa, Entamoeba dispar
PYTPTD

SEQ ID NO: 2372787 - protein, 22 aa, Entamoeba dispar
PYYSGREPSKRKTCVKGKRTPI

SEQ ID NO: 2372788 - protein, 7 aa, Entamoeba dispar
QAAAEKM

SEQ ID NO: 2372789 - protein, 9 aa, Entamoeba dispar
QAANDLNIK

SEQ ID NO: 2372790 - protein, 7 aa, Entamoeba dispar
QADCTRL

SEQ ID NO: 2372791 - protein, 4 aa, Entamoeba dispar
QADS

SEQ ID NO: 2372792 - protein, 17 aa, Entamoeba dispar
QADSSNVPNKFKTYPTN

SEQ ID NO: 2372793 - protein, 11 aa, Entamoeba dispar
QAENTDDKYRK

SEQ ID NO: 2372794 - protein, 32 aa, Entamoeba dispar
QAGCKECKNDLSAEGQKTRGYYVPTGKQRCEE

SEQ ID NO: 2372795 - protein, 13 aa, Entamoeba dispar
QAGISSESKLENE

SEQ ID NO: 2372796 - protein, 8 aa, Entamoeba dispar
QAGTSGCE

SEQ ID NO: 2372797 - protein, 6 aa, Entamoeba dispar
QAIDES

SEQ ID NO: 2372798 - protein, 6 aa, Entamoeba dispar
QAITPT

SEQ ID NO: 2372799 - protein, 4 aa, Entamoeba dispar
QAKD

SEQ ID NO: 2372800 - protein, 16 aa, Entamoeba dispar
QAMQRAGRAGREAPGQ

SEQ ID NO: 2372801 - protein, 6 aa, Entamoeba dispar
QANDYY

SEQ ID NO: 2372802 - protein, 9 aa, Entamoeba dispar
QANEESTKL

SEQ ID NO: 2372803 - protein, 9 aa, Entamoeba dispar
QANFTSQEG

SEQ ID NO: 2372804 - protein, 8 aa, Entamoeba dispar
QANMTGES

SEQ ID NO: 2372805 - protein, 8 aa, Entamoeba dispar
QANPKKGL

SEQ ID NO: 2372806 - protein, 9 aa, Entamoeba dispar
QAPMGQPVQ

SEQ ID NO: 2372807 - protein, 5 aa, Entamoeba dispar
QAQNG

SEQ ID NO: 2372808 - protein, 14 aa, Entamoeba dispar
QAQQESVDQTISTK

SEQ ID NO: 2372809 - protein, 14 aa, Entamoeba dispar
QAQRSVDDEINRET

SEQ ID NO: 2372810 - protein, 7 aa, Entamoeba dispar
QARDAIQ

SEQ ID NO: 2372811 - protein, 5 aa, Entamoeba dispar
QARNN

SEQ ID NO: 2372812 - protein, 9 aa, Entamoeba dispar
QASSNDEAA

SEQ ID NO: 2372813 - protein, 8 aa, Entamoeba dispar
QASSPDEI

SEQ ID NO: 2372814 - protein, 11 aa, Entamoeba dispar
QATNGNPITTP

SEQ ID NO: 2372815 - protein, 6 aa, Entamoeba dispar
QATRKN

SEQ ID NO: 2372816 - protein, 8 aa, Entamoeba dispar
QCEAAQIG

SEQ ID NO: 2372817 - protein, 10 aa, Entamoeba dispar
QCEEDELEEF

SEQ ID NO: 2372818 - protein, 6 aa, Entamoeba dispar
QCGNRK

SEQ ID NO: 2372819 - protein, 11 aa, Entamoeba dispar
QCHSSGSSSHF

SEQ ID NO: 2372820 - protein, 12 aa, Entamoeba dispar
QCIGDKEDQCYY

SEQ ID NO: 2372821 - protein, 14 aa, Entamoeba dispar
QCIPEDKNCDEYEN

SEQ ID NO: 2372822 - protein, 11 aa, Entamoeba dispar
QCNEYNQGYEI

SEQ ID NO: 2372823 - protein, 13 aa, Entamoeba dispar
QCPDGYYTDKYGQ

SEQ ID NO: 2372824 - protein, 6 aa, Entamoeba dispar
QCQSCS

SEQ ID NO: 2372825 - protein, 4 aa, Entamoeba dispar
QCRG

SEQ ID NO: 2372826 - protein, 7 aa, Entamoeba dispar
QCRNSTC

SEQ ID NO: 2372827 - protein, 11 aa, Entamoeba dispar
QCSEYNQGYEI

SEQ ID NO: 2372828 - protein, 10 aa, Entamoeba dispar
QCSPQNGVGT

SEQ ID NO: 2372829 - protein, 13 aa, Entamoeba dispar
QCSSATNVDLTNS

SEQ ID NO: 2372830 - protein, 5 aa, Entamoeba dispar
QCTEG

SEQ ID NO: 2372831 - protein, 14 aa, Entamoeba dispar
QCVKQSSASIVSPN

SEQ ID NO: 2372832 - protein, 14 aa, Entamoeba dispar
QDAPTISLDSPKIT

SEQ ID NO: 2372833 - protein, 14 aa, Entamoeba dispar
QDAYCDKETGEIET

SEQ ID NO: 2372834 - protein, 7 aa, Entamoeba dispar
QDCPNKI

SEQ ID NO: 2372835 - protein, 12 aa, Entamoeba dispar
QDDKITYSGDVP

SEQ ID NO: 2372836 - protein, 5 aa, Entamoeba dispar
QDDQM

SEQ ID NO: 2372837 - protein, 6 aa, Entamoeba dispar
QDDYKK

SEQ ID NO: 2372838 - protein, 7 aa, Entamoeba dispar
QDEAIQQ

SEQ ID NO: 2372839 - protein, 5 aa, Entamoeba dispar
QDEGF

SEQ ID NO: 2372840 - protein, 5 aa, Entamoeba dispar
QDETV

SEQ ID NO: 2372841 - protein, 4 aa, Entamoeba dispar
QDFE

SEQ ID NO: 2372842 - protein, 5 aa, Entamoeba dispar
QDFGN

SEQ ID NO: 2372843 - protein, 4 aa, Entamoeba dispar
QDFQ

SEQ ID NO: 2372844 - protein, 7 aa, Entamoeba dispar
QDGDLKL

SEQ ID NO: 2372845 - protein, 6 aa, Entamoeba dispar
QDGEHT

SEQ ID NO: 2372846 - protein, 10 aa, Entamoeba dispar
QDGESPLKDI

SEQ ID NO: 2372847 - protein, 14 aa, Entamoeba dispar
QDGKYSSDEQSCNK

SEQ ID NO: 2372848 - protein, 7 aa, Entamoeba dispar
QDGRNTN

SEQ ID NO: 2372849 - protein, 6 aa, Entamoeba dispar
QDGYNA

SEQ ID NO: 2372850 - protein, 4 aa, Entamoeba dispar
QDIE

SEQ ID NO: 2372851 - protein, 6 aa, Entamoeba dispar
QDIPQK

SEQ ID NO: 2372852 - protein, 6 aa, Entamoeba dispar
QDKGTV

SEQ ID NO: 2372853 - protein, 5 aa, Entamoeba dispar
QDKGV

SEQ ID NO: 2372854 - protein, 9 aa, Entamoeba dispar
QDLQSEKDK

SEQ ID NO: 2372855 - protein, 11 aa, Entamoeba dispar
QDNGLASPEGI

SEQ ID NO: 2372856 - protein, 11 aa, Entamoeba dispar
QDNGLSSPNGI

SEQ ID NO: 2372857 - protein, 4 aa, Entamoeba dispar
QDNK

SEQ ID NO: 2372858 - protein, 9 aa, Entamoeba dispar
QDNQNNCQP

SEQ ID NO: 2372859 - protein, 11 aa, Entamoeba dispar
QDNSLGSPNGI

SEQ ID NO: 2372860 - protein, 4 aa, Entamoeba dispar
QDPI

SEQ ID NO: 2372861 - protein, 9 aa, Entamoeba dispar
QDPRDRPSF

SEQ ID NO: 2372862 - protein, 4 aa, Entamoeba dispar
QDPS

SEQ ID NO: 2372863 - protein, 4 aa, Entamoeba dispar
QDQR

SEQ ID NO: 2372864 - protein, 7 aa, Entamoeba dispar
QDRTKKL

SEQ ID NO: 2372865 - protein, 7 aa, Entamoeba dispar
QDSFPRS

SEQ ID NO: 2372866 - protein, 4 aa, Entamoeba dispar
QDSL

SEQ ID NO: 2372867 - protein, 9 aa, Entamoeba dispar
QDSNNFDYE

SEQ ID NO: 2372868 - protein, 4 aa, Entamoeba dispar
QDSQ

SEQ ID NO: 2372869 - protein, 21 aa, Entamoeba dispar
QDSVEKEGKVGELRRKASDQA

SEQ ID NO: 2372870 - protein, 5 aa, Entamoeba dispar
QDTDS

SEQ ID NO: 2372871 - protein, 10 aa, Entamoeba dispar
QDTSEAPATT

SEQ ID NO: 2372872 - protein, 12 aa, Entamoeba dispar
QDVKPKKVSRKG

SEQ ID NO: 2372873 - protein, 4 aa, Entamoeba dispar
QDVN

SEQ ID NO: 2372874 - protein, 5 aa, Entamoeba dispar
QDVNR

SEQ ID NO: 2372875 - protein, 9 aa, Entamoeba dispar
QDVNSAETF

SEQ ID NO: 2372876 - protein, 11 aa, Entamoeba dispar
QEADKRPTATE

SEQ ID NO: 2372877 - protein, 4 aa, Entamoeba dispar
QEAG

SEQ ID NO: 2372878 - protein, 6 aa, Entamoeba dispar
QEARKA

SEQ ID NO: 2372879 - protein, 6 aa, Entamoeba dispar
QECDNG

SEQ ID NO: 2372880 - protein, 14 aa, Entamoeba dispar
QECGSNGKCSPYSG

SEQ ID NO: 2372881 - protein, 8 aa, Entamoeba dispar
QECPYTKE

SEQ ID NO: 2372882 - protein, 16 aa, Entamoeba dispar
QECQIGSQCNKTNKQN

SEQ ID NO: 2372883 - protein, 10 aa, Entamoeba dispar
QEDADYLSSD

SEQ ID NO: 2372884 - protein, 5 aa, Entamoeba dispar
QEDDM

SEQ ID NO: 2372885 - protein, 7 aa, Entamoeba dispar
QEDINNP

SEQ ID NO: 2372886 - protein, 6 aa, Entamoeba dispar
QEDSLQ

SEQ ID NO: 2372887 - protein, 9 aa, Entamoeba dispar
QEEDKNHLD

SEQ ID NO: 2372888 - protein, 12 aa, Entamoeba dispar
QEEGKDNNIEES

SEQ ID NO: 2372889 - protein, 7 aa, Entamoeba dispar
QEEIPDG

SEQ ID NO: 2372890 - protein, 5 aa, Entamoeba dispar
QEEKG

SEQ ID NO: 2372891 - protein, 4 aa, Entamoeba dispar
QEEL

SEQ ID NO: 2372892 - protein, 13 aa, Entamoeba dispar
QEENYEEDTNKID

SEQ ID NO: 2372893 - protein, 39 aa, Entamoeba dispar
QEESDRTGESYETIKQSTDRIKSSLNTQNNISETLNTSK

SEQ ID NO: 2372894 - protein, 8 aa, Entamoeba dispar
QEETNKLN

SEQ ID NO: 2372895 - protein, 6 aa, Entamoeba dispar
QEFEEK

SEQ ID NO: 2372896 - protein, 4 aa, Entamoeba dispar
QEFP

SEQ ID NO: 2372897 - protein, 10 aa, Entamoeba dispar
QEFSEKRNVT

SEQ ID NO: 2372898 - protein, 18 aa, Entamoeba dispar
QEGETKNKYALTPDDDGD

SEQ ID NO: 2372899 - protein, 8 aa, Entamoeba dispar
QEHIKNGE

SEQ ID NO: 2372900 - protein, 34 aa, Entamoeba dispar
QEIENQSTNIIQEEPNSNKEETISEISNKQMNEG

SEQ ID NO: 2372901 - protein, 15 aa, Entamoeba dispar
QEINTIKKNNEAEKL

SEQ ID NO: 2372902 - protein, 7 aa, Entamoeba dispar
QEIPKSY

SEQ ID NO: 2372903 - protein, 10 aa, Entamoeba dispar
QEIQNENEFK

SEQ ID NO: 2372904 - protein, 7 aa, Entamoeba dispar
QEIQNTK

SEQ ID NO: 2372905 - protein, 8 aa, Entamoeba dispar
QEIQPGGG

SEQ ID NO: 2372906 - protein, 5 aa, Entamoeba dispar
QEKDL

SEQ ID NO: 2372907 - protein, 6 aa, Entamoeba dispar
QEKEEY

SEQ ID NO: 2372908 - protein, 4 aa, Entamoeba dispar
QEKG

SEQ ID NO: 2372909 - protein, 7 aa, Entamoeba dispar
QEKLGYS

SEQ ID NO: 2372910 - protein, 9 aa, Entamoeba dispar
QEKMPTDPN

SEQ ID NO: 2372911 - protein, 5 aa, Entamoeba dispar
QEKPN

SEQ ID NO: 2372912 - protein, 9 aa, Entamoeba dispar
QEKQGITKR

SEQ ID NO: 2372913 - protein, 23 aa, Entamoeba dispar
QEKQREREEQKKLQELEEENDLR

SEQ ID NO: 2372914 - protein, 9 aa, Entamoeba dispar
QEKYKKEAD

SEQ ID NO: 2372915 - protein, 8 aa, Entamoeba dispar
QEKYTESA

SEQ ID NO: 2372916 - protein, 8 aa, Entamoeba dispar
QELGHETE

SEQ ID NO: 2372917 - protein, 11 aa, Entamoeba dispar
QELKDDPNGME

SEQ ID NO: 2372918 - protein, 19 aa, Entamoeba dispar
QELKKQREILEDDSRKLDR

SEQ ID NO: 2372919 - protein, 7 aa, Entamoeba dispar
QELSNGI

SEQ ID NO: 2372920 - protein, 9 aa, Entamoeba dispar
QELTEKTDV

SEQ ID NO: 2372921 - protein, 4 aa, Entamoeba dispar
QELY

SEQ ID NO: 2372922 - protein, 7 aa, Entamoeba dispar
QEMSDGV

SEQ ID NO: 2372923 - protein, 6 aa, Entamoeba dispar
QEMTDG

SEQ ID NO: 2372924 - protein, 6 aa, Entamoeba dispar
QENCEE

SEQ ID NO: 2372925 - protein, 5 aa, Entamoeba dispar
QENCK

SEQ ID NO: 2372926 - protein, 5 aa, Entamoeba dispar
QENDP

SEQ ID NO: 2372927 - protein, 4 aa, Entamoeba dispar
QENK

SEQ ID NO: 2372928 - protein, 10 aa, Entamoeba dispar
QENKKSEKHP

SEQ ID NO: 2372929 - protein, 8 aa, Entamoeba dispar
QENKSIKS

SEQ ID NO: 2372930 - protein, 6 aa, Entamoeba dispar
QENKYQ

SEQ ID NO: 2372931 - protein, 24 aa, Entamoeba dispar
QENNNNNENHQSQPNNIDNSMSVS

SEQ ID NO: 2372932 - protein, 6 aa, Entamoeba dispar
QENQTI

SEQ ID NO: 2372933 - protein, 4 aa, Entamoeba dispar
QENS

SEQ ID NO: 2372934 - protein, 5 aa, Entamoeba dispar
QENSA

SEQ ID NO: 2372935 - protein, 7 aa, Entamoeba dispar
QENTEQI

SEQ ID NO: 2372936 - protein, 8 aa, Entamoeba dispar
QEPDPQSV

SEQ ID NO: 2372937 - protein, 6 aa, Entamoeba dispar
QEPNDH

SEQ ID NO: 2372938 - protein, 8 aa, Entamoeba dispar
QEPNERPN

SEQ ID NO: 2372939 - protein, 9 aa, Entamoeba dispar
QEPNQRPNF

SEQ ID NO: 2372940 - protein, 12 aa, Entamoeba dispar
QEPNSQSTSEFN

SEQ ID NO: 2372941 - protein, 11 aa, Entamoeba dispar
QEQFQRDGCDN

SEQ ID NO: 2372942 - protein, 8 aa, Entamoeba dispar
QEQKEGNE

SEQ ID NO: 2372943 - protein, 10 aa, Entamoeba dispar
QERGITETKQ

SEQ ID NO: 2372944 - protein, 7 aa, Entamoeba dispar
QERNEPI

SEQ ID NO: 2372945 - protein, 9 aa, Entamoeba dispar
QESDDDDEI

SEQ ID NO: 2372946 - protein, 13 aa, Entamoeba dispar
QESENSNGFNSQN

SEQ ID NO: 2372947 - protein, 5 aa, Entamoeba dispar
QESES

SEQ ID NO: 2372948 - protein, 7 aa, Entamoeba dispar
QESNKCK

SEQ ID NO: 2372949 - protein, 7 aa, Entamoeba dispar
QESNTRR

SEQ ID NO: 2372950 - protein, 5 aa, Entamoeba dispar
QESPN

SEQ ID NO: 2372951 - protein, 9 aa, Entamoeba dispar
QETALPQDS

SEQ ID NO: 2372952 - protein, 7 aa, Entamoeba dispar
QETGKRI

SEQ ID NO: 2372953 - protein, 4 aa, Entamoeba dispar
QETI

SEQ ID NO: 2372954 - protein, 7 aa, Entamoeba dispar
QETIPNA

SEQ ID NO: 2372955 - protein, 8 aa, Entamoeba dispar
QETMSSTL

SEQ ID NO: 2372956 - protein, 4 aa, Entamoeba dispar
QETN

SEQ ID NO: 2372957 - protein, 15 aa, Entamoeba dispar
QETRLEEETNEEKNL

SEQ ID NO: 2372958 - protein, 5 aa, Entamoeba dispar
QETSR

SEQ ID NO: 2372959 - protein, 5 aa, Entamoeba dispar
QETTD

SEQ ID NO: 2372960 - protein, 19 aa, Entamoeba dispar
QETYKKKIEKERKDSIIPN

SEQ ID NO: 2372961 - protein, 8 aa, Entamoeba dispar
QEYRPPRS

SEQ ID NO: 2372962 - protein, 10 aa, Entamoeba dispar
QEYSNSLKTA

SEQ ID NO: 2372963 - protein, 5 aa, Entamoeba dispar
QEYYS

SEQ ID NO: 2372964 - protein, 9 aa, Entamoeba dispar
QFAKGKSVT

SEQ ID NO: 2372965 - protein, 10 aa, Entamoeba dispar
QFAPNGTFTK

SEQ ID NO: 2372966 - protein, 8 aa, Entamoeba dispar
QFDDGFTS

SEQ ID NO: 2372967 - protein, 5 aa, Entamoeba dispar
QFDES

SEQ ID NO: 2372968 - protein, 10 aa, Entamoeba dispar
QFDGGENDRY

SEQ ID NO: 2372969 - protein, 12 aa, Entamoeba dispar
QFDGPFGNLLNS

SEQ ID NO: 2372970 - protein, 12 aa, Entamoeba dispar
QFDNDCDTVDES

SEQ ID NO: 2372971 - protein, 20 aa, Entamoeba dispar
QFEDTSNQQTQQVSTGQQIG

SEQ ID NO: 2372972 - protein, 7 aa, Entamoeba dispar
QFENGDG

SEQ ID NO: 2372973 - protein, 8 aa, Entamoeba dispar
QFGQSSNG

SEQ ID NO: 2372974 - protein, 8 aa, Entamoeba dispar
QFGTGSRW

SEQ ID NO: 2372975 - protein, 5 aa, Entamoeba dispar
QFKQG

SEQ ID NO: 2372976 - protein, 7 aa, Entamoeba dispar
QFKTDNN

SEQ ID NO: 2372977 - protein, 8 aa, Entamoeba dispar
QFNGRSRW

SEQ ID NO: 2372978 - protein, 8 aa, Entamoeba dispar
QFNQGSCG

SEQ ID NO: 2372979 - protein, 8 aa, Entamoeba dispar
QFNTKSSD

SEQ ID NO: 2372980 - protein, 7 aa, Entamoeba dispar
QFPSGKI

SEQ ID NO: 2372981 - protein, 10 aa, Entamoeba dispar
QFRDKGGADF

SEQ ID NO: 2372982 - protein, 12 aa, Entamoeba dispar
QFSGDTSTQEAM

SEQ ID NO: 2372983 - protein, 5 aa, Entamoeba dispar
QFSPE

SEQ ID NO: 2372984 - protein, 15 aa, Entamoeba dispar
QFTGYNKDDSKVIDE

SEQ ID NO: 2372985 - protein, 7 aa, Entamoeba dispar
QGAEATG

SEQ ID NO: 2372986 - protein, 6 aa, Entamoeba dispar
QGATPV

SEQ ID NO: 2372987 - protein, 7 aa, Entamoeba dispar
QGDGKHR

SEQ ID NO: 2372988 - protein, 5 aa, Entamoeba dispar
QGDGV

SEQ ID NO: 2372989 - protein, 9 aa, Entamoeba dispar
QGDQDCSPC

SEQ ID NO: 2372990 - protein, 23 aa, Entamoeba dispar
QGEEVKQGIQPKLTPEEIKSRKE

SEQ ID NO: 2372991 - protein, 4 aa, Entamoeba dispar
QGEL

SEQ ID NO: 2372992 - protein, 14 aa, Entamoeba dispar
QGELKEEERENIKV

SEQ ID NO: 2372993 - protein, 10 aa, Entamoeba dispar
QGEPTNRGGH

SEQ ID NO: 2372994 - protein, 5 aa, Entamoeba dispar
QGETI

SEQ ID NO: 2372995 - protein, 7 aa, Entamoeba dispar
QGEYISA

SEQ ID NO: 2372996 - protein, 5 aa, Entamoeba dispar
QGGFT

SEQ ID NO: 2372997 - protein, 4 aa, Entamoeba dispar
QGGK

SEQ ID NO: 2372998 - protein, 10 aa, Entamoeba dispar
QGGSNSYSSI

SEQ ID NO: 2372999 - protein, 6 aa, Entamoeba dispar
QGHSQL

SEQ ID NO: 2373000 - protein, 8 aa, Entamoeba dispar
QGIDPNLG

SEQ ID NO: 2373001 - protein, 18 aa, Entamoeba dispar
QGKEKDAWKSFPSGHSAA

SEQ ID NO: 2373002 - protein, 4 aa, Entamoeba dispar
QGKI

SEQ ID NO: 2373003 - protein, 4 aa, Entamoeba dispar
QGKN

SEQ ID NO: 2373004 - protein, 14 aa, Entamoeba dispar
QGKTKYSPRLNPNE

SEQ ID NO: 2373005 - protein, 5 aa, Entamoeba dispar
QGLGG

SEQ ID NO: 2373006 - protein, 4 aa, Entamoeba dispar
QGLT

SEQ ID NO: 2373007 - protein, 4 aa, Entamoeba dispar
QGMD

SEQ ID NO: 2373008 - protein, 8 aa, Entamoeba dispar
QGNAYGED

SEQ ID NO: 2373009 - protein, 10 aa, Entamoeba dispar
QGNEANVERI

SEQ ID NO: 2373010 - protein, 8 aa, Entamoeba dispar
QGNEEQMK

SEQ ID NO: 2373011 - protein, 8 aa, Entamoeba dispar
QGNKTTNV

SEQ ID NO: 2373012 - protein, 5 aa, Entamoeba dispar
QGRKD

SEQ ID NO: 2373013 - protein, 7 aa, Entamoeba dispar
QGRSTLV

SEQ ID NO: 2373014 - protein, 7 aa, Entamoeba dispar
QGSEHYP

SEQ ID NO: 2373015 - protein, 10 aa, Entamoeba dispar
QGTDQSSVNV

SEQ ID NO: 2373016 - protein, 10 aa, Entamoeba dispar
QGTINENSFY

SEQ ID NO: 2373017 - protein, 14 aa, Entamoeba dispar
QGTLKIDHSINQYL

SEQ ID NO: 2373018 - protein, 11 aa, Entamoeba dispar
QGTSGSTQKTY

SEQ ID NO: 2373019 - protein, 5 aa, Entamoeba dispar
QGTTV

SEQ ID NO: 2373020 - protein, 10 aa, Entamoeba dispar
QGTVNNPIEV

SEQ ID NO: 2373021 - protein, 8 aa, Entamoeba dispar
QGVIPQPI

SEQ ID NO: 2373022 - protein, 10 aa, Entamoeba dispar
QGVTATQTTK

SEQ ID NO: 2373023 - protein, 26 aa, Entamoeba dispar
QGYNTTIGERGTSLSGGQKQRIALLE

SEQ ID NO: 2373024 - protein, 7 aa, Entamoeba dispar
QHDAYKK

SEQ ID NO: 2373025 - protein, 7 aa, Entamoeba dispar
QHESESI

SEQ ID NO: 2373026 - protein, 13 aa, Entamoeba dispar
QHHPDTHPGDSHY

SEQ ID NO: 2373027 - protein, 7 aa, Entamoeba dispar
QHNQQPP

SEQ ID NO: 2373028 - protein, 5 aa, Entamoeba dispar
QHNVT

SEQ ID NO: 2373029 - protein, 10 aa, Entamoeba dispar
QHRSSDRPTF

SEQ ID NO: 2373030 - protein, 6 aa, Entamoeba dispar
QHSSKF

SEQ ID NO: 2373031 - protein, 9 aa, Entamoeba dispar
QHTETKDQI

SEQ ID NO: 2373032 - protein, 6 aa, Entamoeba dispar
QHTNRP

SEQ ID NO: 2373033 - protein, 7 aa, Entamoeba dispar
QHTYDTV

SEQ ID NO: 2373034 - protein, 6 aa, Entamoeba dispar
QIAPSG

SEQ ID NO: 2373035 - protein, 4 aa, Entamoeba dispar
QIAS

SEQ ID NO: 2373036 - protein, 8 aa, Entamoeba dispar
QIDGETDW

SEQ ID NO: 2373037 - protein, 11 aa, Entamoeba dispar
QIDKDEDEMKE

SEQ ID NO: 2373038 - protein, 9 aa, Entamoeba dispar
QIDKEDHSS

SEQ ID NO: 2373039 - protein, 12 aa, Entamoeba dispar
QIEENEDKMKEF

SEQ ID NO: 2373040 - protein, 14 aa, Entamoeba dispar
QIEENENKKKEFEK

SEQ ID NO: 2373041 - protein, 12 aa, Entamoeba dispar
QIEESEDKMKEF

SEQ ID NO: 2373042 - protein, 13 aa, Entamoeba dispar
QIEPNPAFDVPAE

SEQ ID NO: 2373043 - protein, 4 aa, Entamoeba dispar
QIEQ

SEQ ID NO: 2373044 - protein, 5 aa, Entamoeba dispar
QIEQT

SEQ ID NO: 2373045 - protein, 13 aa, Entamoeba dispar
QIESTSSVGSSNV

SEQ ID NO: 2373046 - protein, 11 aa, Entamoeba dispar
QIETENIENDE

SEQ ID NO: 2373047 - protein, 6 aa, Entamoeba dispar
QIETTA

SEQ ID NO: 2373048 - protein, 7 aa, Entamoeba dispar
QIGEGTF

SEQ ID NO: 2373049 - protein, 4 aa, Entamoeba dispar
QIGN

SEQ ID NO: 2373050 - protein, 4 aa, Entamoeba dispar
QIGT

SEQ ID NO: 2373051 - protein, 12 aa, Entamoeba dispar
QIKEENNCQDSS

SEQ ID NO: 2373052 - protein, 7 aa, Entamoeba dispar
QIKKENH

SEQ ID NO: 2373053 - protein, 13 aa, Entamoeba dispar
QIKNQQPLEPTKY

SEQ ID NO: 2373054 - protein, 11 aa, Entamoeba dispar
QINDAKQIGGT

SEQ ID NO: 2373055 - protein, 13 aa, Entamoeba dispar
QINKQEYVDVNNS

SEQ ID NO: 2373056 - protein, 6 aa, Entamoeba dispar
QINNDE

SEQ ID NO: 2373057 - protein, 7 aa, Entamoeba dispar
QINNETK

SEQ ID NO: 2373058 - protein, 5 aa, Entamoeba dispar
QINNQ

SEQ ID NO: 2373059 - protein, 10 aa, Entamoeba dispar
QINPPDEDAS

SEQ ID NO: 2373060 - protein, 5 aa, Entamoeba dispar
QINPT

SEQ ID NO: 2373061 - protein, 10 aa, Entamoeba dispar
QINSNGKEEI

SEQ ID NO: 2373062 - protein, 12 aa, Entamoeba dispar
QINTQQPKGNVK

SEQ ID NO: 2373063 - protein, 13 aa, Entamoeba dispar
QIPEADNLKSING

SEQ ID NO: 2373064 - protein, 6 aa, Entamoeba dispar
QIPPQS

SEQ ID NO: 2373065 - protein, 5 aa, Entamoeba dispar
QIPQT

SEQ ID NO: 2373066 - protein, 5 aa, Entamoeba dispar
QIPSE

SEQ ID NO: 2373067 - protein, 5 aa, Entamoeba dispar
QIQPT

SEQ ID NO: 2373068 - protein, 11 aa, Entamoeba dispar
QIQSNKSLSPL

SEQ ID NO: 2373069 - protein, 21 aa, Entamoeba dispar
QIQTAQTINPNINQTTQIPQQ

SEQ ID NO: 2373070 - protein, 8 aa, Entamoeba dispar
QIRKEEDL

SEQ ID NO: 2373071 - protein, 8 aa, Entamoeba dispar
QISEPNDP

SEQ ID NO: 2373072 - protein, 10 aa, Entamoeba dispar
QISESDMNRE

SEQ ID NO: 2373073 - protein, 16 aa, Entamoeba dispar
QISGSTDNKDEPKAFN

SEQ ID NO: 2373074 - protein, 15 aa, Entamoeba dispar
QISNATDYNSPLRKK

SEQ ID NO: 2373075 - protein, 5 aa, Entamoeba dispar
QISNR

SEQ ID NO: 2373076 - protein, 12 aa, Entamoeba dispar
QISNSINSFPST

SEQ ID NO: 2373077 - protein, 10 aa, Entamoeba dispar
QITEQYDTTS

SEQ ID NO: 2373078 - protein, 18 aa, Entamoeba dispar
QITKRQTNEITDKRINEE

SEQ ID NO: 2373079 - protein, 8 aa, Entamoeba dispar
QITPTGDY

SEQ ID NO: 2373080 - protein, 8 aa, Entamoeba dispar
QKAPNAEV

SEQ ID NO: 2373081 - protein, 8 aa, Entamoeba dispar
QKATDSSC

SEQ ID NO: 2373082 - protein, 7 aa, Entamoeba dispar
QKCSSNC

SEQ ID NO: 2373083 - protein, 5 aa, Entamoeba dispar
QKDDD

SEQ ID NO: 2373084 - protein, 9 aa, Entamoeba dispar
QKDDTGNLS

SEQ ID NO: 2373085 - protein, 16 aa, Entamoeba dispar
QKDENTLKTASEETLR

SEQ ID NO: 2373086 - protein, 9 aa, Entamoeba dispar
QKDGERYYA

SEQ ID NO: 2373087 - protein, 7 aa, Entamoeba dispar
QKDHSSL

SEQ ID NO: 2373088 - protein, 8 aa, Entamoeba dispar
QKDRKSIA

SEQ ID NO: 2373089 - protein, 8 aa, Entamoeba dispar
QKDTTDQR

SEQ ID NO: 2373090 - protein, 6 aa, Entamoeba dispar
QKDYPN

SEQ ID NO: 2373091 - protein, 9 aa, Entamoeba dispar
QKEASEQYE

SEQ ID NO: 2373092 - protein, 9 aa, Entamoeba dispar
QKEINETKE

SEQ ID NO: 2373093 - protein, 9 aa, Entamoeba dispar
QKEKVEDDN

SEQ ID NO: 2373094 - protein, 13 aa, Entamoeba dispar
QKELKKEVEDNDV

SEQ ID NO: 2373095 - protein, 8 aa, Entamoeba dispar
QKENSFAK

SEQ ID NO: 2373096 - protein, 20 aa, Entamoeba dispar
QKEQEKLQGDEENYERETTP

SEQ ID NO: 2373097 - protein, 8 aa, Entamoeba dispar
QKERTARA

SEQ ID NO: 2373098 - protein, 5 aa, Entamoeba dispar
QKESS

SEQ ID NO: 2373099 - protein, 13 aa, Entamoeba dispar
QKETDREQRETEY

SEQ ID NO: 2373100 - protein, 11 aa, Entamoeba dispar
QKETTTNTTKN

SEQ ID NO: 2373101 - protein, 7 aa, Entamoeba dispar
QKFTSKA

SEQ ID NO: 2373102 - protein, 4 aa, Entamoeba dispar
QKGD

SEQ ID NO: 2373103 - protein, 13 aa, Entamoeba dispar
QKGEAISTQYQVK

SEQ ID NO: 2373104 - protein, 9 aa, Entamoeba dispar
QKGEVNEQM

SEQ ID NO: 2373105 - protein, 8 aa, Entamoeba dispar
QKGNANIL

SEQ ID NO: 2373106 - protein, 9 aa, Entamoeba dispar
QKGNEDEKE

SEQ ID NO: 2373107 - protein, 8 aa, Entamoeba dispar
QKGNTITC

SEQ ID NO: 2373108 - protein, 16 aa, Entamoeba dispar
QKGVCGNGKRHRFEEE

SEQ ID NO: 2373109 - protein, 12 aa, Entamoeba dispar
QKHNKNDDSEEC

SEQ ID NO: 2373110 - protein, 5 aa, Entamoeba dispar
QKHYD

SEQ ID NO: 2373111 - protein, 11 aa, Entamoeba dispar
QKIDNSNEFEQ

SEQ ID NO: 2373112 - protein, 14 aa, Entamoeba dispar
QKIDRSNESILNDE

SEQ ID NO: 2373113 - protein, 6 aa, Entamoeba dispar
QKIETV

SEQ ID NO: 2373114 - protein, 5 aa, Entamoeba dispar
QKISN

SEQ ID NO: 2373115 - protein, 8 aa, Entamoeba dispar
QKKEIQTE

SEQ ID NO: 2373116 - protein, 8 aa, Entamoeba dispar
QKKERTEE

SEQ ID NO: 2373117 - protein, 6 aa, Entamoeba dispar
QKKGQW

SEQ ID NO: 2373118 - protein, 9 aa, Entamoeba dispar
QKKKELNTN

SEQ ID NO: 2373119 - protein, 7 aa, Entamoeba dispar
QKKQRGV

SEQ ID NO: 2373120 - protein, 9 aa, Entamoeba dispar
QKKSPEQAL

SEQ ID NO: 2373121 - protein, 8 aa, Entamoeba dispar
QKKSSCKA

SEQ ID NO: 2373122 - protein, 12 aa, Entamoeba dispar
QKKTLRNEKQKW

SEQ ID NO: 2373123 - protein, 11 aa, Entamoeba dispar
QKKTTQREKQY

SEQ ID NO: 2373124 - protein, 7 aa, Entamoeba dispar
QKLAQKE

SEQ ID NO: 2373125 - protein, 9 aa, Entamoeba dispar
QKLDEATYD

SEQ ID NO: 2373126 - protein, 15 aa, Entamoeba dispar
QKLKSNAKKATKEKF

SEQ ID NO: 2373127 - protein, 7 aa, Entamoeba dispar
QKLQQTI

SEQ ID NO: 2373128 - protein, 5 aa, Entamoeba dispar
QKLSE

SEQ ID NO: 2373129 - protein, 11 aa, Entamoeba dispar
QKLTEATGGSL

SEQ ID NO: 2373130 - protein, 27 aa, Entamoeba dispar
QKMKEEEDRIAQKRHEKYVKRREKNPP

SEQ ID NO: 2373131 - protein, 9 aa, Entamoeba dispar
QKMNSEKIY

SEQ ID NO: 2373132 - protein, 10 aa, Entamoeba dispar
QKNETNDTTH

SEQ ID NO: 2373133 - protein, 6 aa, Entamoeba dispar
QKNEWA

SEQ ID NO: 2373134 - protein, 7 aa, Entamoeba dispar
QKNGNGW

SEQ ID NO: 2373135 - protein, 6 aa, Entamoeba dispar
QKNGVY

SEQ ID NO: 2373136 - protein, 6 aa, Entamoeba dispar
QKNKNV

SEQ ID NO: 2373137 - protein, 14 aa, Entamoeba dispar
QKNNEQLSDSEKKN

SEQ ID NO: 2373138 - protein, 7 aa, Entamoeba dispar
QKNNTIS

SEQ ID NO: 2373139 - protein, 8 aa, Entamoeba dispar
QKNNTNLS

SEQ ID NO: 2373140 - protein, 21 aa, Entamoeba dispar
QKNPEKISEIDENERETVADK

SEQ ID NO: 2373141 - protein, 9 aa, Entamoeba dispar
QKNPLTGKK

SEQ ID NO: 2373142 - protein, 9 aa, Entamoeba dispar
QKPDDRPDF

SEQ ID NO: 2373143 - protein, 9 aa, Entamoeba dispar
QKPDERPKF

SEQ ID NO: 2373144 - protein, 17 aa, Entamoeba dispar
QKPITKKDSSSSEEEGK

SEQ ID NO: 2373145 - protein, 8 aa, Entamoeba dispar
QKPLSKQN

SEQ ID NO: 2373146 - protein, 4 aa, Entamoeba dispar
QKPT

SEQ ID NO: 2373147 - protein, 7 aa, Entamoeba dispar
QKPTERP

SEQ ID NO: 2373148 - protein, 4 aa, Entamoeba dispar
QKQE

SEQ ID NO: 2373149 - protein, 7 aa, Entamoeba dispar
QKQEIGS

SEQ ID NO: 2373150 - protein, 6 aa, Entamoeba dispar
QKQQSS

SEQ ID NO: 2373151 - protein, 12 aa, Entamoeba dispar
QKQRYEKGEEAI

SEQ ID NO: 2373152 - protein, 8 aa, Entamoeba dispar
QKQSNPLS

SEQ ID NO: 2373153 - protein, 10 aa, Entamoeba dispar
QKREWNPKSP

SEQ ID NO: 2373154 - protein, 7 aa, Entamoeba dispar
QKRNGVK

SEQ ID NO: 2373155 - protein, 9 aa, Entamoeba dispar
QKRPPQRGG

SEQ ID NO: 2373156 - protein, 12 aa, Entamoeba dispar
QKSETKQQDTKI

SEQ ID NO: 2373157 - protein, 4 aa, Entamoeba dispar
QKSF

SEQ ID NO: 2373158 - protein, 11 aa, Entamoeba dispar
QKSLNENNTEF

SEQ ID NO: 2373159 - protein, 10 aa, Entamoeba dispar
QKSMENDKKS

SEQ ID NO: 2373160 - protein, 8 aa, Entamoeba dispar
QKSNETTI

SEQ ID NO: 2373161 - protein, 13 aa, Entamoeba dispar
QKSPLHSPPNGRV

SEQ ID NO: 2373162 - protein, 10 aa, Entamoeba dispar
QKSPSEEDDI

SEQ ID NO: 2373163 - protein, 9 aa, Entamoeba dispar
QKSSQRTTR

SEQ ID NO: 2373164 - protein, 4 aa, Entamoeba dispar
QKSY

SEQ ID NO: 2373165 - protein, 7 aa, Entamoeba dispar
QKSYPLQ

SEQ ID NO: 2373166 - protein, 4 aa, Entamoeba dispar
QKTN

SEQ ID NO: 2373167 - protein, 8 aa, Entamoeba dispar
QKTPKNCE

SEQ ID NO: 2373168 - protein, 5 aa, Entamoeba dispar
QKVDG

SEQ ID NO: 2373169 - protein, 6 aa, Entamoeba dispar
QKVDGK

SEQ ID NO: 2373170 - protein, 6 aa, Entamoeba dispar
QKYDDS

SEQ ID NO: 2373171 - protein, 4 aa, Entamoeba dispar
QKYI

SEQ ID NO: 2373172 - protein, 13 aa, Entamoeba dispar
QKYKEEQKKLKHS

SEQ ID NO: 2373173 - protein, 6 aa, Entamoeba dispar
QKYPRT

SEQ ID NO: 2373174 - protein, 9 aa, Entamoeba dispar
QLASLGPDD

SEQ ID NO: 2373175 - protein, 5 aa, Entamoeba dispar
QLDAK

SEQ ID NO: 2373176 - protein, 4 aa, Entamoeba dispar
QLDN

SEQ ID NO: 2373177 - protein, 12 aa, Entamoeba dispar
QLDNAKESVESY

SEQ ID NO: 2373178 - protein, 8 aa, Entamoeba dispar
QLDNQQPF

SEQ ID NO: 2373179 - protein, 11 aa, Entamoeba dispar
QLDSESKTKLI

SEQ ID NO: 2373180 - protein, 4 aa, Entamoeba dispar
QLES

SEQ ID NO: 2373181 - protein, 4 aa, Entamoeba dispar
QLET

SEQ ID NO: 2373182 - protein, 15 aa, Entamoeba dispar
QLGGKPKFYDTGDAS

SEQ ID NO: 2373183 - protein, 7 aa, Entamoeba dispar
QLGQSLP

SEQ ID NO: 2373184 - protein, 9 aa, Entamoeba dispar
QLKEKEKVI

SEQ ID NO: 2373185 - protein, 7 aa, Entamoeba dispar
QLKNENN

SEQ ID NO: 2373186 - protein, 14 aa, Entamoeba dispar
QLKNPWGKNKTIEG

SEQ ID NO: 2373187 - protein, 9 aa, Entamoeba dispar
QLKTSANYL

SEQ ID NO: 2373188 - protein, 7 aa, Entamoeba dispar
QLNNGQE

SEQ ID NO: 2373189 - protein, 9 aa, Entamoeba dispar
QLPEASSSI

SEQ ID NO: 2373190 - protein, 6 aa, Entamoeba dispar
QLPEPN

SEQ ID NO: 2373191 - protein, 4 aa, Entamoeba dispar
QLPP

SEQ ID NO: 2373192 - protein, 6 aa, Entamoeba dispar
QLPPGF

SEQ ID NO: 2373193 - protein, 4 aa, Entamoeba dispar
QLPS

SEQ ID NO: 2373194 - protein, 8 aa, Entamoeba dispar
QLQNKEAV

SEQ ID NO: 2373195 - protein, 4 aa, Entamoeba dispar
QLRN

SEQ ID NO: 2373196 - protein, 5 aa, Entamoeba dispar
QLRNK

SEQ ID NO: 2373197 - protein, 11 aa, Entamoeba dispar
QLRNNAPKGSI

SEQ ID NO: 2373198 - protein, 4 aa, Entamoeba dispar
QLSD

SEQ ID NO: 2373199 - protein, 12 aa, Entamoeba dispar
QLSKSSENSTLD

SEQ ID NO: 2373200 - protein, 9 aa, Entamoeba dispar
QLSNDSGID

SEQ ID NO: 2373201 - protein, 8 aa, Entamoeba dispar
QLSSSNRQ

SEQ ID NO: 2373202 - protein, 11 aa, Entamoeba dispar
QLSYQDSYNEV

SEQ ID NO: 2373203 - protein, 8 aa, Entamoeba dispar
QLTAQDYS

SEQ ID NO: 2373204 - protein, 10 aa, Entamoeba dispar
QLTERTKEFG

SEQ ID NO: 2373205 - protein, 10 aa, Entamoeba dispar
QLTNQSYQNC

SEQ ID NO: 2373206 - protein, 19 aa, Entamoeba dispar
QLTQDPSQIEKSKLHQTQE

SEQ ID NO: 2373207 - protein, 39 aa, Entamoeba dispar
QMENADIKKQNEQIDRAGQDANAMATDVSNTNAQLQEAR

SEQ ID NO: 2373208 - protein, 8 aa, Entamoeba dispar
QMKAEAAG

SEQ ID NO: 2373209 - protein, 15 aa, Entamoeba dispar
QMKKQKTKPKEVSDI

SEQ ID NO: 2373210 - protein, 10 aa, Entamoeba dispar
QMKNPRKPTE

SEQ ID NO: 2373211 - protein, 10 aa, Entamoeba dispar
QMQKDKNYCN

SEQ ID NO: 2373212 - protein, 8 aa, Entamoeba dispar
QMQSTNDR

SEQ ID NO: 2373213 - protein, 5 aa, Entamoeba dispar
QMSDL

SEQ ID NO: 2373214 - protein, 6 aa, Entamoeba dispar
QMSKDE

SEQ ID NO: 2373215 - protein, 4 aa, Entamoeba dispar
QMTA

SEQ ID NO: 2373216 - protein, 8 aa, Entamoeba dispar
QNAEPQQL

SEQ ID NO: 2373217 - protein, 4 aa, Entamoeba dispar
QNAG

SEQ ID NO: 2373218 - protein, 8 aa, Entamoeba dispar
QNAPRGRI

SEQ ID NO: 2373219 - protein, 4 aa, Entamoeba dispar
QNCP

SEQ ID NO: 2373220 - protein, 8 aa, Entamoeba dispar
QNDLTKSL

SEQ ID NO: 2373221 - protein, 8 aa, Entamoeba dispar
QNDTINDT

SEQ ID NO: 2373222 - protein, 7 aa, Entamoeba dispar
QNECNPL

SEQ ID NO: 2373223 - protein, 13 aa, Entamoeba dispar
QNECVDDGNQIKE

SEQ ID NO: 2373224 - protein, 7 aa, Entamoeba dispar
QNEEAEN

SEQ ID NO: 2373225 - protein, 6 aa, Entamoeba dispar
QNEEVK

SEQ ID NO: 2373226 - protein, 12 aa, Entamoeba dispar
QNEHEADDVEIP

SEQ ID NO: 2373227 - protein, 6 aa, Entamoeba dispar
QNEINK

SEQ ID NO: 2373228 - protein, 6 aa, Entamoeba dispar
QNENDY

SEQ ID NO: 2373229 - protein, 9 aa, Entamoeba dispar
QNEPEKEVE

SEQ ID NO: 2373230 - protein, 16 aa, Entamoeba dispar
QNESITPQLEPHTDTV

SEQ ID NO: 2373231 - protein, 6 aa, Entamoeba dispar
QNESLT

SEQ ID NO: 2373232 - protein, 4 aa, Entamoeba dispar
QNEV

SEQ ID NO: 2373233 - protein, 5 aa, Entamoeba dispar
QNFGD

SEQ ID NO: 2373234 - protein, 10 aa, Entamoeba dispar
QNGAGKTTTI

SEQ ID NO: 2373235 - protein, 8 aa, Entamoeba dispar
QNGCQSSI

SEQ ID NO: 2373236 - protein, 5 aa, Entamoeba dispar
QNGEQ

SEQ ID NO: 2373237 - protein, 7 aa, Entamoeba dispar
QNGIPNA

SEQ ID NO: 2373238 - protein, 13 aa, Entamoeba dispar
QNGLASAHKNGKT

SEQ ID NO: 2373239 - protein, 7 aa, Entamoeba dispar
QNHGSYR

SEQ ID NO: 2373240 - protein, 6 aa, Entamoeba dispar
QNHKKY

SEQ ID NO: 2373241 - protein, 5 aa, Entamoeba dispar
QNIEQ

SEQ ID NO: 2373242 - protein, 7 aa, Entamoeba dispar
QNIKSNK

SEQ ID NO: 2373243 - protein, 6 aa, Entamoeba dispar
QNIQQP

SEQ ID NO: 2373244 - protein, 4 aa, Entamoeba dispar
QNKE

SEQ ID NO: 2373245 - protein, 8 aa, Entamoeba dispar
QNKEERKD

SEQ ID NO: 2373246 - protein, 6 aa, Entamoeba dispar
QNKEKE

SEQ ID NO: 2373247 - protein, 8 aa, Entamoeba dispar
QNKENTNA

SEQ ID NO: 2373248 - protein, 12 aa, Entamoeba dispar
QNKEVKNTLDNL

SEQ ID NO: 2373249 - protein, 8 aa, Entamoeba dispar
QNKEYPIQ

SEQ ID NO: 2373250 - protein, 8 aa, Entamoeba dispar
QNKGDRLN

SEQ ID NO: 2373251 - protein, 6 aa, Entamoeba dispar
QNKKPN

SEQ ID NO: 2373252 - protein, 8 aa, Entamoeba dispar
QNKTLAPY

SEQ ID NO: 2373253 - protein, 5 aa, Entamoeba dispar
QNLNT

SEQ ID NO: 2373254 - protein, 10 aa, Entamoeba dispar
QNNANISQIN

SEQ ID NO: 2373255 - protein, 8 aa, Entamoeba dispar
QNNDPPKY

SEQ ID NO: 2373256 - protein, 7 aa, Entamoeba dispar
QNNEDIS

SEQ ID NO: 2373257 - protein, 10 aa, Entamoeba dispar
QNNETPDYDD

SEQ ID NO: 2373258 - protein, 5 aa, Entamoeba dispar
QNNGE

SEQ ID NO: 2373259 - protein, 11 aa, Entamoeba dispar
QNNKKIKKDTF

SEQ ID NO: 2373260 - protein, 9 aa, Entamoeba dispar
QNNKNSQNA

SEQ ID NO: 2373261 - protein, 10 aa, Entamoeba dispar
QNNLNRTSGF

SEQ ID NO: 2373262 - protein, 16 aa, Entamoeba dispar
QNNNGNCEQTTGKCQY

SEQ ID NO: 2373263 - protein, 5 aa, Entamoeba dispar
QNNYG

SEQ ID NO: 2373264 - protein, 5 aa, Entamoeba dispar
QNPED

SEQ ID NO: 2373265 - protein, 9 aa, Entamoeba dispar
QNPKERYNA

SEQ ID NO: 2373266 - protein, 7 aa, Entamoeba dispar
QNPNESL

SEQ ID NO: 2373267 - protein, 5 aa, Entamoeba dispar
QNPYF

SEQ ID NO: 2373268 - protein, 8 aa, Entamoeba dispar
QNQDSNNE

SEQ ID NO: 2373269 - protein, 10 aa, Entamoeba dispar
QNQENLPEDA

SEQ ID NO: 2373270 - protein, 7 aa, Entamoeba dispar
QNQPVSP

SEQ ID NO: 2373271 - protein, 5 aa, Entamoeba dispar
QNQTY

SEQ ID NO: 2373272 - protein, 5 aa, Entamoeba dispar
QNREQ

SEQ ID NO: 2373273 - protein, 9 aa, Entamoeba dispar
QNRGGVGHN

SEQ ID NO: 2373274 - protein, 7 aa, Entamoeba dispar
QNRGLSP

SEQ ID NO: 2373275 - protein, 18 aa, Entamoeba dispar
QNRTGTVDLNGEPKRPQI

SEQ ID NO: 2373276 - protein, 4 aa, Entamoeba dispar
QNSA

SEQ ID NO: 2373277 - protein, 6 aa, Entamoeba dispar
QNSDKS

SEQ ID NO: 2373278 - protein, 6 aa, Entamoeba dispar
QNSEYT

SEQ ID NO: 2373279 - protein, 9 aa, Entamoeba dispar
QNSGLSINK

SEQ ID NO: 2373280 - protein, 5 aa, Entamoeba dispar
QNSLN

SEQ ID NO: 2373281 - protein, 8 aa, Entamoeba dispar
QNSNSNSC

SEQ ID NO: 2373282 - protein, 5 aa, Entamoeba dispar
QNSPL

SEQ ID NO: 2373283 - protein, 7 aa, Entamoeba dispar
QNSQGYK

SEQ ID NO: 2373284 - protein, 7 aa, Entamoeba dispar
QNSQWGK

SEQ ID NO: 2373285 - protein, 9 aa, Entamoeba dispar
QNSSDSDNI

SEQ ID NO: 2373286 - protein, 8 aa, Entamoeba dispar
QNSTDYSY

SEQ ID NO: 2373287 - protein, 12 aa, Entamoeba dispar
QNTEINNESDLT

SEQ ID NO: 2373288 - protein, 4 aa, Entamoeba dispar
QNTI

SEQ ID NO: 2373289 - protein, 11 aa, Entamoeba dispar
QNTKKDKEVKV

SEQ ID NO: 2373290 - protein, 8 aa, Entamoeba dispar
QNTPKDSK

SEQ ID NO: 2373291 - protein, 7 aa, Entamoeba dispar
QNTQLKK

SEQ ID NO: 2373292 - protein, 8 aa, Entamoeba dispar
QNTSSLGY

SEQ ID NO: 2373293 - protein, 5 aa, Entamoeba dispar
QNTTI

SEQ ID NO: 2373294 - protein, 12 aa, Entamoeba dispar
QNVLGESEKAQV

SEQ ID NO: 2373295 - protein, 5 aa, Entamoeba dispar
QNVSE

SEQ ID NO: 2373296 - protein, 5 aa, Entamoeba dispar
QNYPN

SEQ ID NO: 2373297 - protein, 9 aa, Entamoeba dispar
QNYQERKAE

SEQ ID NO: 2373298 - protein, 9 aa, Entamoeba dispar
QPDDFIDQT

SEQ ID NO: 2373299 - protein, 8 aa, Entamoeba dispar
QPEEKRDG

SEQ ID NO: 2373300 - protein, 9 aa, Entamoeba dispar
QPEQSCNEN

SEQ ID NO: 2373301 - protein, 8 aa, Entamoeba dispar
QPERTEED

SEQ ID NO: 2373302 - protein, 23 aa, Entamoeba dispar
QPESGSNKTDESDDAPITDETYR

SEQ ID NO: 2373303 - protein, 5 aa, Entamoeba dispar
QPFDP

SEQ ID NO: 2373304 - protein, 4 aa, Entamoeba dispar
QPFE

SEQ ID NO: 2373305 - protein, 6 aa, Entamoeba dispar
QPFSKY

SEQ ID NO: 2373306 - protein, 5 aa, Entamoeba dispar
QPGFG

SEQ ID NO: 2373307 - protein, 9 aa, Entamoeba dispar
QPGSSEYVT

SEQ ID NO: 2373308 - protein, 6 aa, Entamoeba dispar
QPGSSN

SEQ ID NO: 2373309 - protein, 4 aa, Entamoeba dispar
QPGY

SEQ ID NO: 2373310 - protein, 7 aa, Entamoeba dispar
QPHLNSK

SEQ ID NO: 2373311 - protein, 9 aa, Entamoeba dispar
QPHNSNQIA

SEQ ID NO: 2373312 - protein, 11 aa, Entamoeba dispar
QPIAEGASGTV

SEQ ID NO: 2373313 - protein, 10 aa, Entamoeba dispar
QPIDNPNSDL

SEQ ID NO: 2373314 - protein, 4 aa, Entamoeba dispar
QPIN

SEQ ID NO: 2373315 - protein, 26 aa, Entamoeba dispar
QPKDSYSTTTDFSQKNKPKSLPHRRG

SEQ ID NO: 2373316 - protein, 12 aa, Entamoeba dispar
QPKETVKANETL

SEQ ID NO: 2373317 - protein, 12 aa, Entamoeba dispar
QPKKKKAKDNNM

SEQ ID NO: 2373318 - protein, 6 aa, Entamoeba dispar
QPKSQL

SEQ ID NO: 2373319 - protein, 14 aa, Entamoeba dispar
QPKYKNDETNPKKV

SEQ ID NO: 2373320 - protein, 11 aa, Entamoeba dispar
QPLNPENPQLP

SEQ ID NO: 2373321 - protein, 8 aa, Entamoeba dispar
QPLPPPQF

SEQ ID NO: 2373322 - protein, 9 aa, Entamoeba dispar
QPLPVETES

SEQ ID NO: 2373323 - protein, 5 aa, Entamoeba dispar
QPNEN

SEQ ID NO: 2373324 - protein, 6 aa, Entamoeba dispar
QPNETL

SEQ ID NO: 2373325 - protein, 8 aa, Entamoeba dispar
QPNKFDNE

SEQ ID NO: 2373326 - protein, 8 aa, Entamoeba dispar
QPNQSNKP

SEQ ID NO: 2373327 - protein, 11 aa, Entamoeba dispar
QPNQTINSNSI

SEQ ID NO: 2373328 - protein, 12 aa, Entamoeba dispar
QPNQTINSNSID

SEQ ID NO: 2373329 - protein, 7 aa, Entamoeba dispar
QPNSNFD

SEQ ID NO: 2373330 - protein, 6 aa, Entamoeba dispar
QPNTNS

SEQ ID NO: 2373331 - protein, 6 aa, Entamoeba dispar
QPPEER

SEQ ID NO: 2373332 - protein, 7 aa, Entamoeba dispar
QPPIGEG

SEQ ID NO: 2373333 - protein, 8 aa, Entamoeba dispar
QPPIKGSS

SEQ ID NO: 2373334 - protein, 5 aa, Entamoeba dispar
QPPNV

SEQ ID NO: 2373335 - protein, 7 aa, Entamoeba dispar
QPPPAQY

SEQ ID NO: 2373336 - protein, 5 aa, Entamoeba dispar
QPPQR

SEQ ID NO: 2373337 - protein, 12 aa, Entamoeba dispar
QPPSGDSISRAE

SEQ ID NO: 2373338 - protein, 11 aa, Entamoeba dispar
QPPTQPNGLEY

SEQ ID NO: 2373339 - protein, 12 aa, Entamoeba dispar
QPQEPVDKSLQN

SEQ ID NO: 2373340 - protein, 17 aa, Entamoeba dispar
QPQLKEETIEETSPKEN

SEQ ID NO: 2373341 - protein, 5 aa, Entamoeba dispar
QPQLS

SEQ ID NO: 2373342 - protein, 15 aa, Entamoeba dispar
QPQYYQQPQYYQQPP

SEQ ID NO: 2373343 - protein, 35 aa, Entamoeba dispar
QPQYYQQPQYYQQPPLSFSPYNQTLTTSEPKYEQQ

SEQ ID NO: 2373344 - protein, 15 aa, Entamoeba dispar
QPSFQSGSTTLNTDT

SEQ ID NO: 2373345 - protein, 10 aa, Entamoeba dispar
QPSGNTGKDQ

SEQ ID NO: 2373346 - protein, 21 aa, Entamoeba dispar
QPSKKKFSEIDCQPKEKYTPC

SEQ ID NO: 2373347 - protein, 6 aa, Entamoeba dispar
QPSKRR

SEQ ID NO: 2373348 - protein, 24 aa, Entamoeba dispar
QPSKTPNEIPNDHKNDDKPKEQVF

SEQ ID NO: 2373349 - protein, 5 aa, Entamoeba dispar
QPTLT

SEQ ID NO: 2373350 - protein, 6 aa, Entamoeba dispar
QPTNEV

SEQ ID NO: 2373351 - protein, 7 aa, Entamoeba dispar
QPTSDQL

SEQ ID NO: 2373352 - protein, 9 aa, Entamoeba dispar
QPTSTYYTP

SEQ ID NO: 2373353 - protein, 32 aa, Entamoeba dispar
QPVDDDYKENEPTKRKQLNKRKPVKKHSDVPK

SEQ ID NO: 2373354 - protein, 10 aa, Entamoeba dispar
QPVYSPNTPV

SEQ ID NO: 2373355 - protein, 7 aa, Entamoeba dispar
QPYPTPL

SEQ ID NO: 2373356 - protein, 8 aa, Entamoeba dispar
QQAPTDPQ

SEQ ID NO: 2373357 - protein, 8 aa, Entamoeba dispar
QQAQNNTQ

SEQ ID NO: 2373358 - protein, 5 aa, Entamoeba dispar
QQAQS

SEQ ID NO: 2373359 - protein, 4 aa, Entamoeba dispar
QQDE

SEQ ID NO: 2373360 - protein, 8 aa, Entamoeba dispar
QQDERNKQ

SEQ ID NO: 2373361 - protein, 12 aa, Entamoeba dispar
QQDKFSSEKANL

SEQ ID NO: 2373362 - protein, 6 aa, Entamoeba dispar
QQDPHE

SEQ ID NO: 2373363 - protein, 4 aa, Entamoeba dispar
QQDR

SEQ ID NO: 2373364 - protein, 5 aa, Entamoeba dispar
QQEFN

SEQ ID NO: 2373365 - protein, 56 aa, Entamoeba dispar
QQEHSGISKESSSHDDRSTSSSRKKADSLYQDKTNSLNSRGSKALSNTKKNKTKMS

SEQ ID NO: 2373366 - protein, 10 aa, Entamoeba dispar
QQEKHDEFEA

SEQ ID NO: 2373367 - protein, 5 aa, Entamoeba dispar
QQELK

SEQ ID NO: 2373368 - protein, 7 aa, Entamoeba dispar
QQESESA

SEQ ID NO: 2373369 - protein, 6 aa, Entamoeba dispar
QQESLN

SEQ ID NO: 2373370 - protein, 7 aa, Entamoeba dispar
QQGEWES

SEQ ID NO: 2373371 - protein, 7 aa, Entamoeba dispar
QQGGPKL

SEQ ID NO: 2373372 - protein, 7 aa, Entamoeba dispar
QQGKMES

SEQ ID NO: 2373373 - protein, 14 aa, Entamoeba dispar
QQHEEISKELRDDE

SEQ ID NO: 2373374 - protein, 5 aa, Entamoeba dispar
QQHQQ

SEQ ID NO: 2373375 - protein, 4 aa, Entamoeba dispar
QQHR

SEQ ID NO: 2373376 - protein, 8 aa, Entamoeba dispar
QQINQQEA

SEQ ID NO: 2373377 - protein, 10 aa, Entamoeba dispar
QQKDITTLTG

SEQ ID NO: 2373378 - protein, 6 aa, Entamoeba dispar
QQKETI

SEQ ID NO: 2373379 - protein, 5 aa, Entamoeba dispar
QQKKF

SEQ ID NO: 2373380 - protein, 4 aa, Entamoeba dispar
QQKN

SEQ ID NO: 2373381 - protein, 22 aa, Entamoeba dispar
QQKNEENNKSTIETNDKEKQIP

SEQ ID NO: 2373382 - protein, 10 aa, Entamoeba dispar
QQKSDKKQKN

SEQ ID NO: 2373383 - protein, 8 aa, Entamoeba dispar
QQKTSTTI

SEQ ID NO: 2373384 - protein, 9 aa, Entamoeba dispar
QQKYKKAAD

SEQ ID NO: 2373385 - protein, 8 aa, Entamoeba dispar
QQLDPDQQ

SEQ ID NO: 2373386 - protein, 6 aa, Entamoeba dispar
QQLKEK

SEQ ID NO: 2373387 - protein, 4 aa, Entamoeba dispar
QQLV

SEQ ID NO: 2373388 - protein, 9 aa, Entamoeba dispar
QQNDKIKKQ

SEQ ID NO: 2373389 - protein, 8 aa, Entamoeba dispar
QQNNDNES

SEQ ID NO: 2373390 - protein, 27 aa, Entamoeba dispar
QQNQNKTNDKAMNLTQTKESSSSNSSL

SEQ ID NO: 2373391 - protein, 8 aa, Entamoeba dispar
QQNTPTSF

SEQ ID NO: 2373392 - protein, 7 aa, Entamoeba dispar
QQPEERL

SEQ ID NO: 2373393 - protein, 5 aa, Entamoeba dispar
QQPID

SEQ ID NO: 2373394 - protein, 14 aa, Entamoeba dispar
QQPLSYQAPPNQSG

SEQ ID NO: 2373395 - protein, 9 aa, Entamoeba dispar
QQPQATSLQ

SEQ ID NO: 2373396 - protein, 8 aa, Entamoeba dispar
QQPSSNVT

SEQ ID NO: 2373397 - protein, 5 aa, Entamoeba dispar
QQPTY

SEQ ID NO: 2373398 - protein, 7 aa, Entamoeba dispar
QQPTYEA

SEQ ID NO: 2373399 - protein, 16 aa, Entamoeba dispar
QQQASKLDKLNDENSN

SEQ ID NO: 2373400 - protein, 16 aa, Entamoeba dispar
QQQASKLDRLNDENSN

SEQ ID NO: 2373401 - protein, 8 aa, Entamoeba dispar
QQQEFEEQ

SEQ ID NO: 2373402 - protein, 10 aa, Entamoeba dispar
QQQEKQQQQI

SEQ ID NO: 2373403 - protein, 8 aa, Entamoeba dispar
QQQGKEKV

SEQ ID NO: 2373404 - protein, 5 aa, Entamoeba dispar
QQQKE

SEQ ID NO: 2373405 - protein, 8 aa, Entamoeba dispar
QQQKKIKE

SEQ ID NO: 2373406 - protein, 6 aa, Entamoeba dispar
QQQPFQ

SEQ ID NO: 2373407 - protein, 5 aa, Entamoeba dispar
QQQPN

SEQ ID NO: 2373408 - protein, 6 aa, Entamoeba dispar
QQQQNN

SEQ ID NO: 2373409 - protein, 8 aa, Entamoeba dispar
QQQQQSLE

SEQ ID NO: 2373410 - protein, 6 aa, Entamoeba dispar
QQRCTV

SEQ ID NO: 2373411 - protein, 14 aa, Entamoeba dispar
QQRDQDKPKYLQNY

SEQ ID NO: 2373412 - protein, 8 aa, Entamoeba dispar
QQSKLTSI

SEQ ID NO: 2373413 - protein, 10 aa, Entamoeba dispar
QQSNRELDSQ

SEQ ID NO: 2373414 - protein, 4 aa, Entamoeba dispar
QQSS

SEQ ID NO: 2373415 - protein, 9 aa, Entamoeba dispar
QQSSYIDPQ

SEQ ID NO: 2373416 - protein, 6 aa, Entamoeba dispar
QQSTLR

SEQ ID NO: 2373417 - protein, 13 aa, Entamoeba dispar
QQSTNGYENDRNK

SEQ ID NO: 2373418 - protein, 14 aa, Entamoeba dispar
QQTLDQTVTRVNEN

SEQ ID NO: 2373419 - protein, 8 aa, Entamoeba dispar
QQTLSENS

SEQ ID NO: 2373420 - protein, 5 aa, Entamoeba dispar
QQTPM

SEQ ID NO: 2373421 - protein, 4 aa, Entamoeba dispar
QQTQ

SEQ ID NO: 2373422 - protein, 5 aa, Entamoeba dispar
QQTQI

SEQ ID NO: 2373423 - protein, 6 aa, Entamoeba dispar
QQTTEK

SEQ ID NO: 2373424 - protein, 13 aa, Entamoeba dispar
QQTYSSQENSEQT

SEQ ID NO: 2373425 - protein, 60 aa, Entamoeba dispar
QQVNKKEKEINDKEIQINNKEKQVNDKEKQVNDKEKQIIDKEKELSAKEKQVDNKEIQIN

SEQ ID NO: 2373426 - protein, 6 aa, Entamoeba dispar
QQVSCN

SEQ ID NO: 2373427 - protein, 6 aa, Entamoeba dispar
QQVSPL

SEQ ID NO: 2373428 - protein, 10 aa, Entamoeba dispar
QRANKKKKGV

SEQ ID NO: 2373429 - protein, 8 aa, Entamoeba dispar
QRANQQQI

SEQ ID NO: 2373430 - protein, 7 aa, Entamoeba dispar
QRDETNP

SEQ ID NO: 2373431 - protein, 12 aa, Entamoeba dispar
QRDSKTNQYKKE

SEQ ID NO: 2373432 - protein, 5 aa, Entamoeba dispar
QREAF

SEQ ID NO: 2373433 - protein, 17 aa, Entamoeba dispar
QREEQKENKSLSSEGES

SEQ ID NO: 2373434 - protein, 8 aa, Entamoeba dispar
QREKSSSR

SEQ ID NO: 2373435 - protein, 9 aa, Entamoeba dispar
QRENELRKG

SEQ ID NO: 2373436 - protein, 11 aa, Entamoeba dispar
QRFSNGISGVD

SEQ ID NO: 2373437 - protein, 5 aa, Entamoeba dispar
QRGVA

SEQ ID NO: 2373438 - protein, 6 aa, Entamoeba dispar
QRIGGG

SEQ ID NO: 2373439 - protein, 10 aa, Entamoeba dispar
QRKDKTNEKY

SEQ ID NO: 2373440 - protein, 7 aa, Entamoeba dispar
QRKGIEK

SEQ ID NO: 2373441 - protein, 5 aa, Entamoeba dispar
QRKKC

SEQ ID NO: 2373442 - protein, 4 aa, Entamoeba dispar
QRKM

SEQ ID NO: 2373443 - protein, 7 aa, Entamoeba dispar
QRKPKKR

SEQ ID NO: 2373444 - protein, 7 aa, Entamoeba dispar
QRKQEES

SEQ ID NO: 2373445 - protein, 8 aa, Entamoeba dispar
QRKQGSTK

SEQ ID NO: 2373446 - protein, 8 aa, Entamoeba dispar
QRKTPKQM

SEQ ID NO: 2373447 - protein, 5 aa, Entamoeba dispar
QRLEA

SEQ ID NO: 2373448 - protein, 15 aa, Entamoeba dispar
QRNDPSLLSVFGISI

SEQ ID NO: 2373449 - protein, 9 aa, Entamoeba dispar
QRNQKVEKE

SEQ ID NO: 2373450 - protein, 5 aa, Entamoeba dispar
QRNTE

SEQ ID NO: 2373451 - protein, 7 aa, Entamoeba dispar
QRPDKRL

SEQ ID NO: 2373452 - protein, 10 aa, Entamoeba dispar
QRPERRPGFS

SEQ ID NO: 2373453 - protein, 11 aa, Entamoeba dispar
QRPRESEKELG

SEQ ID NO: 2373454 - protein, 12 aa, Entamoeba dispar
QRPRKKSSQTQQ

SEQ ID NO: 2373455 - protein, 25 aa, Entamoeba dispar
QRRARTEEVQRNGGTRLTGKDTKER

SEQ ID NO: 2373456 - protein, 12 aa, Entamoeba dispar
QRRDINEAANAS

SEQ ID NO: 2373457 - protein, 4 aa, Entamoeba dispar
QRRY

SEQ ID NO: 2373458 - protein, 5 aa, Entamoeba dispar
QRSAC

SEQ ID NO: 2373459 - protein, 8 aa, Entamoeba dispar
QRSCPGGK

SEQ ID NO: 2373460 - protein, 13 aa, Entamoeba dispar
QRSDKRSKKDIKR

SEQ ID NO: 2373461 - protein, 13 aa, Entamoeba dispar
QRSDQKNKNEIQK

SEQ ID NO: 2373462 - protein, 11 aa, Entamoeba dispar
QRSDQRYKKDI

SEQ ID NO: 2373463 - protein, 17 aa, Entamoeba dispar
QRSDRRSKKDVKKISDA

SEQ ID NO: 2373464 - protein, 17 aa, Entamoeba dispar
QRSDSKLKTSIKPLTNS

SEQ ID NO: 2373465 - protein, 7 aa, Entamoeba dispar
QRSKREW

SEQ ID NO: 2373466 - protein, 6 aa, Entamoeba dispar
QRSPEI

SEQ ID NO: 2373467 - protein, 5 aa, Entamoeba dispar
QRTKK

SEQ ID NO: 2373468 - protein, 14 aa, Entamoeba dispar
QRTSPPKLSQTPPQ

SEQ ID NO: 2373469 - protein, 12 aa, Entamoeba dispar
QRVEERKQNAKL

SEQ ID NO: 2373470 - protein, 4 aa, Entamoeba dispar
QSAK

SEQ ID NO: 2373471 - protein, 14 aa, Entamoeba dispar
QSASMTKAVGTPAY

SEQ ID NO: 2373472 - protein, 4 aa, Entamoeba dispar
QSCQ

SEQ ID NO: 2373473 - protein, 7 aa, Entamoeba dispar
QSDDIDE

SEQ ID NO: 2373474 - protein, 8 aa, Entamoeba dispar
QSDEYTNK

SEQ ID NO: 2373475 - protein, 5 aa, Entamoeba dispar
QSDIA

SEQ ID NO: 2373476 - protein, 11 aa, Entamoeba dispar
QSDKQLSQLQD

SEQ ID NO: 2373477 - protein, 8 aa, Entamoeba dispar
QSDLTGKT

SEQ ID NO: 2373478 - protein, 9 aa, Entamoeba dispar
QSDPKNTDY

SEQ ID NO: 2373479 - protein, 9 aa, Entamoeba dispar
QSDRTQQLN

SEQ ID NO: 2373480 - protein, 14 aa, Entamoeba dispar
QSDTQSDGCKERIS

SEQ ID NO: 2373481 - protein, 14 aa, Entamoeba dispar
QSECINDGKQLKEE

SEQ ID NO: 2373482 - protein, 14 aa, Entamoeba dispar
QSEDITSPRSKIEL

SEQ ID NO: 2373483 - protein, 11 aa, Entamoeba dispar
QSEKRNKCCEN

SEQ ID NO: 2373484 - protein, 8 aa, Entamoeba dispar
QSEKTSCV

SEQ ID NO: 2373485 - protein, 25 aa, Entamoeba dispar
QSEKTSPKTSPRISPRTPPIIKDKE

SEQ ID NO: 2373486 - protein, 8 aa, Entamoeba dispar
QSELPKEH

SEQ ID NO: 2373487 - protein, 4 aa, Entamoeba dispar
QSEN

SEQ ID NO: 2373488 - protein, 6 aa, Entamoeba dispar
QSENYD

SEQ ID NO: 2373489 - protein, 5 aa, Entamoeba dispar
QSEPK

SEQ ID NO: 2373490 - protein, 5 aa, Entamoeba dispar
QSEQI

SEQ ID NO: 2373491 - protein, 4 aa, Entamoeba dispar
QSES

SEQ ID NO: 2373492 - protein, 4 aa, Entamoeba dispar
QSFE

SEQ ID NO: 2373493 - protein, 14 aa, Entamoeba dispar
QSFPSGHSSSISNG

SEQ ID NO: 2373494 - protein, 8 aa, Entamoeba dispar
QSGETKDV

SEQ ID NO: 2373495 - protein, 5 aa, Entamoeba dispar
QSGMS

SEQ ID NO: 2373496 - protein, 4 aa, Entamoeba dispar
QSHN

SEQ ID NO: 2373497 - protein, 6 aa, Entamoeba dispar
QSIHNP

SEQ ID NO: 2373498 - protein, 14 aa, Entamoeba dispar
QSINSTSPTLAVGT

SEQ ID NO: 2373499 - protein, 5 aa, Entamoeba dispar
QSISK

SEQ ID NO: 2373500 - protein, 22 aa, Entamoeba dispar
QSISQKLEGNLNNRTLQNSNNH

SEQ ID NO: 2373501 - protein, 7 aa, Entamoeba dispar
QSKCQNG

SEQ ID NO: 2373502 - protein, 6 aa, Entamoeba dispar
QSKEFP

SEQ ID NO: 2373503 - protein, 9 aa, Entamoeba dispar
QSKKEKISS

SEQ ID NO: 2373504 - protein, 6 aa, Entamoeba dispar
QSKKKV

SEQ ID NO: 2373505 - protein, 7 aa, Entamoeba dispar
QSKKPIA

SEQ ID NO: 2373506 - protein, 8 aa, Entamoeba dispar
QSKKTLHE

SEQ ID NO: 2373507 - protein, 9 aa, Entamoeba dispar
QSKLSDYKE

SEQ ID NO: 2373508 - protein, 15 aa, Entamoeba dispar
QSKLSTETHDPKECR

SEQ ID NO: 2373509 - protein, 6 aa, Entamoeba dispar
QSKLTK

SEQ ID NO: 2373510 - protein, 22 aa, Entamoeba dispar
QSKNTRQPEGVSTEAGKQHSAI

SEQ ID NO: 2373511 - protein, 6 aa, Entamoeba dispar
QSKPSS

SEQ ID NO: 2373512 - protein, 12 aa, Entamoeba dispar
QSKQDASKIRSE

SEQ ID NO: 2373513 - protein, 7 aa, Entamoeba dispar
QSKTKSC

SEQ ID NO: 2373514 - protein, 8 aa, Entamoeba dispar
QSKTNGNI

SEQ ID NO: 2373515 - protein, 7 aa, Entamoeba dispar
QSLNSTV

SEQ ID NO: 2373516 - protein, 5 aa, Entamoeba dispar
QSLTR

SEQ ID NO: 2373517 - protein, 6 aa, Entamoeba dispar
QSLTRE

SEQ ID NO: 2373518 - protein, 6 aa, Entamoeba dispar
QSMPTS

SEQ ID NO: 2373519 - protein, 8 aa, Entamoeba dispar
QSNAEKAK

SEQ ID NO: 2373520 - protein, 8 aa, Entamoeba dispar
QSNAQKVN

SEQ ID NO: 2373521 - protein, 4 aa, Entamoeba dispar
QSNE

SEQ ID NO: 2373522 - protein, 9 aa, Entamoeba dispar
QSNKCDDIE

SEQ ID NO: 2373523 - protein, 8 aa, Entamoeba dispar
QSNNPKTI

SEQ ID NO: 2373524 - protein, 16 aa, Entamoeba dispar
QSNQKIKQEKNRNKKW

SEQ ID NO: 2373525 - protein, 10 aa, Entamoeba dispar
QSNQQLENKE

SEQ ID NO: 2373526 - protein, 7 aa, Entamoeba dispar
QSNRTQV

SEQ ID NO: 2373527 - protein, 6 aa, Entamoeba dispar
QSNSME

SEQ ID NO: 2373528 - protein, 7 aa, Entamoeba dispar
QSNSPHG

SEQ ID NO: 2373529 - protein, 6 aa, Entamoeba dispar
QSNSTN

SEQ ID NO: 2373530 - protein, 7 aa, Entamoeba dispar
QSNYTTI

SEQ ID NO: 2373531 - protein, 33 aa, Entamoeba dispar
QSPAKLPQSNLADNETNTIKSDKKVSNNTIEDT

SEQ ID NO: 2373532 - protein, 7 aa, Entamoeba dispar
QSPEISG

SEQ ID NO: 2373533 - protein, 8 aa, Entamoeba dispar
QSPKFGSS

SEQ ID NO: 2373534 - protein, 6 aa, Entamoeba dispar
QSPLGS

SEQ ID NO: 2373535 - protein, 17 aa, Entamoeba dispar
QSPNHFEKKTNLNSSNQ

SEQ ID NO: 2373536 - protein, 6 aa, Entamoeba dispar
QSPRRE

SEQ ID NO: 2373537 - protein, 6 aa, Entamoeba dispar
QSPSKV

SEQ ID NO: 2373538 - protein, 8 aa, Entamoeba dispar
QSPTRTFP

SEQ ID NO: 2373539 - protein, 5 aa, Entamoeba dispar
QSQHN

SEQ ID NO: 2373540 - protein, 6 aa, Entamoeba dispar
QSQKTS

SEQ ID NO: 2373541 - protein, 7 aa, Entamoeba dispar
QSQSQIQ

SEQ ID NO: 2373542 - protein, 61 aa, Entamoeba dispar
QSQSSQNTSEFSERSSKSKSSSIRNNSSMNLRSPKTDSSKDKEDGSKGKSVERKKKQVKSL

SEQ ID NO: 2373543 - protein, 8 aa, Entamoeba dispar
QSQYGDCS

SEQ ID NO: 2373544 - protein, 7 aa, Entamoeba dispar
QSRISDV

SEQ ID NO: 2373545 - protein, 6 aa, Entamoeba dispar
QSRSVT

SEQ ID NO: 2373546 - protein, 7 aa, Entamoeba dispar
QSRTSRK

SEQ ID NO: 2373547 - protein, 7 aa, Entamoeba dispar
QSRYKTA

SEQ ID NO: 2373548 - protein, 40 aa, Entamoeba dispar
QSSEDDDGEEYDDEYNSENTEDGTYSNEQNEEDSQSQKEE

SEQ ID NO: 2373549 - protein, 16 aa, Entamoeba dispar
QSSGCTKCSTGYYARN

SEQ ID NO: 2373550 - protein, 11 aa, Entamoeba dispar
QSSIPSDKSSI

SEQ ID NO: 2373551 - protein, 5 aa, Entamoeba dispar
QSSKR

SEQ ID NO: 2373552 - protein, 8 aa, Entamoeba dispar
QSSNKSSV

SEQ ID NO: 2373553 - protein, 6 aa, Entamoeba dispar
QSSNNA

SEQ ID NO: 2373554 - protein, 8 aa, Entamoeba dispar
QSSPNPNY

SEQ ID NO: 2373555 - protein, 4 aa, Entamoeba dispar
QSSQ

SEQ ID NO: 2373556 - protein, 9 aa, Entamoeba dispar
QSSSIRDEK

SEQ ID NO: 2373557 - protein, 10 aa, Entamoeba dispar
QSSSKSESGK

SEQ ID NO: 2373558 - protein, 7 aa, Entamoeba dispar
QSSSQLD

SEQ ID NO: 2373559 - protein, 8 aa, Entamoeba dispar
QSSSYEPS

SEQ ID NO: 2373560 - protein, 4 aa, Entamoeba dispar
QSTA

SEQ ID NO: 2373561 - protein, 6 aa, Entamoeba dispar
QSTCIQ

SEQ ID NO: 2373562 - protein, 8 aa, Entamoeba dispar
QSTDPNII

SEQ ID NO: 2373563 - protein, 22 aa, Entamoeba dispar
QSTEELPKKIKQNLSKKTIKEM

SEQ ID NO: 2373564 - protein, 5 aa, Entamoeba dispar
QSTHI

SEQ ID NO: 2373565 - protein, 7 aa, Entamoeba dispar
QSTHPSP

SEQ ID NO: 2373566 - protein, 5 aa, Entamoeba dispar
QSTID

SEQ ID NO: 2373567 - protein, 11 aa, Entamoeba dispar
QSTLKNELDKR

SEQ ID NO: 2373568 - protein, 6 aa, Entamoeba dispar
QSTNIK

SEQ ID NO: 2373569 - protein, 7 aa, Entamoeba dispar
QSTNPFA

SEQ ID NO: 2373570 - protein, 8 aa, Entamoeba dispar
QSTPTFNP

SEQ ID NO: 2373571 - protein, 9 aa, Entamoeba dispar
QSTQNLINQ

SEQ ID NO: 2373572 - protein, 4 aa, Entamoeba dispar
QSTT

SEQ ID NO: 2373573 - protein, 7 aa, Entamoeba dispar
QSTTNEE

SEQ ID NO: 2373574 - protein, 4 aa, Entamoeba dispar
QSTV

SEQ ID NO: 2373575 - protein, 5 aa, Entamoeba dispar
QSVEH

SEQ ID NO: 2373576 - protein, 5 aa, Entamoeba dispar
QSVTK

SEQ ID NO: 2373577 - protein, 98 aa, Entamoeba dispar
QSYAKSNTTEQQEIEMQESNSGPISSNIADKNDANSVSGENDKNELQDRKTPENANNSPHSRSGISEEEQEINNTAKESITKEVSSEPSTEEEHDTIG

SEQ ID NO: 2373578 - protein, 7 aa, Entamoeba dispar
QSYEEKL

SEQ ID NO: 2373579 - protein, 7 aa, Entamoeba dispar
QSYEKEM

SEQ ID NO: 2373580 - protein, 12 aa, Entamoeba dispar
QSYLNSHTQGMD

SEQ ID NO: 2373581 - protein, 8 aa, Entamoeba dispar
QSYSSKSI

SEQ ID NO: 2373582 - protein, 12 aa, Entamoeba dispar
QTADEIKNKSKN

SEQ ID NO: 2373583 - protein, 6 aa, Entamoeba dispar
QTAEQF

SEQ ID NO: 2373584 - protein, 9 aa, Entamoeba dispar
QTAGSNGLS

SEQ ID NO: 2373585 - protein, 5 aa, Entamoeba dispar
QTAQG

SEQ ID NO: 2373586 - protein, 5 aa, Entamoeba dispar
QTCEK

SEQ ID NO: 2373587 - protein, 19 aa, Entamoeba dispar
QTCKTDKKHPGLEDTQKVR

SEQ ID NO: 2373588 - protein, 22 aa, Entamoeba dispar
QTDCNPSNDRLVKRSKDCDSKI

SEQ ID NO: 2373589 - protein, 9 aa, Entamoeba dispar
QTDCSKKVE

SEQ ID NO: 2373590 - protein, 8 aa, Entamoeba dispar
QTDINEET

SEQ ID NO: 2373591 - protein, 6 aa, Entamoeba dispar
QTDKLA

SEQ ID NO: 2373592 - protein, 8 aa, Entamoeba dispar
QTEGNPDL

SEQ ID NO: 2373593 - protein, 14 aa, Entamoeba dispar
QTENRKPGTRKRKS

SEQ ID NO: 2373594 - protein, 20 aa, Entamoeba dispar
QTEQVSQNSSFDEGHRKSKL

SEQ ID NO: 2373595 - protein, 8 aa, Entamoeba dispar
QTERKLPS

SEQ ID NO: 2373596 - protein, 14 aa, Entamoeba dispar
QTETHKPGSRKKKN

SEQ ID NO: 2373597 - protein, 13 aa, Entamoeba dispar
QTFTTSEPKYEQQ

SEQ ID NO: 2373598 - protein, 8 aa, Entamoeba dispar
QTGIKPEE

SEQ ID NO: 2373599 - protein, 7 aa, Entamoeba dispar
QTGPSLE

SEQ ID NO: 2373600 - protein, 5 aa, Entamoeba dispar
QTGVC

SEQ ID NO: 2373601 - protein, 5 aa, Entamoeba dispar
QTHKR

SEQ ID NO: 2373602 - protein, 4 aa, Entamoeba dispar
QTIP

SEQ ID NO: 2373603 - protein, 9 aa, Entamoeba dispar
QTIPEKSTI

SEQ ID NO: 2373604 - protein, 8 aa, Entamoeba dispar
QTIPHSND

SEQ ID NO: 2373605 - protein, 15 aa, Entamoeba dispar
QTIQEYNKRSFKEKH

SEQ ID NO: 2373606 - protein, 21 aa, Entamoeba dispar
QTKCNPKNKRLVKRDEKCDKE

SEQ ID NO: 2373607 - protein, 6 aa, Entamoeba dispar
QTKDHQ

SEQ ID NO: 2373608 - protein, 9 aa, Entamoeba dispar
QTKFENGNP

SEQ ID NO: 2373609 - protein, 6 aa, Entamoeba dispar
QTKNNT

SEQ ID NO: 2373610 - protein, 8 aa, Entamoeba dispar
QTKPLAQS

SEQ ID NO: 2373611 - protein, 10 aa, Entamoeba dispar
QTKPSFPKKI

SEQ ID NO: 2373612 - protein, 17 aa, Entamoeba dispar
QTKVNKNEPTREIRTFS

SEQ ID NO: 2373613 - protein, 5 aa, Entamoeba dispar
QTKYS

SEQ ID NO: 2373614 - protein, 8 aa, Entamoeba dispar
QTLGHPKS

SEQ ID NO: 2373615 - protein, 6 aa, Entamoeba dispar
QTLKSQ

SEQ ID NO: 2373616 - protein, 4 aa, Entamoeba dispar
QTLN

SEQ ID NO: 2373617 - protein, 17 aa, Entamoeba dispar
QTLQNSKRVEYQKIDET

SEQ ID NO: 2373618 - protein, 14 aa, Entamoeba dispar
QTLSSAEQTNSQEV

SEQ ID NO: 2373619 - protein, 6 aa, Entamoeba dispar
QTNDFN

SEQ ID NO: 2373620 - protein, 7 aa, Entamoeba dispar
QTNDKNQ

SEQ ID NO: 2373621 - protein, 8 aa, Entamoeba dispar
QTNEGYVD

SEQ ID NO: 2373622 - protein, 6 aa, Entamoeba dispar
QTNEIT

SEQ ID NO: 2373623 - protein, 5 aa, Entamoeba dispar
QTNGI

SEQ ID NO: 2373624 - protein, 15 aa, Entamoeba dispar
QTNGKLDNNLKETYT

SEQ ID NO: 2373625 - protein, 7 aa, Entamoeba dispar
QTNNPEV

SEQ ID NO: 2373626 - protein, 4 aa, Entamoeba dispar
QTNP

SEQ ID NO: 2373627 - protein, 9 aa, Entamoeba dispar
QTNPKYPNA

SEQ ID NO: 2373628 - protein, 22 aa, Entamoeba dispar
QTNPSTRKYIKSTQSLTTSHEP

SEQ ID NO: 2373629 - protein, 7 aa, Entamoeba dispar
QTNPTQN

SEQ ID NO: 2373630 - protein, 14 aa, Entamoeba dispar
QTNQQQKELLNELL

SEQ ID NO: 2373631 - protein, 6 aa, Entamoeba dispar
QTNRCG

SEQ ID NO: 2373632 - protein, 8 aa, Entamoeba dispar
QTNSADLQ

SEQ ID NO: 2373633 - protein, 5 aa, Entamoeba dispar
QTNTE

SEQ ID NO: 2373634 - protein, 5 aa, Entamoeba dispar
QTPPF

SEQ ID NO: 2373635 - protein, 26 aa, Entamoeba dispar
QTPSITNNTNNNEQSFSSGLGVTSTG

SEQ ID NO: 2373636 - protein, 7 aa, Entamoeba dispar
QTPYDSL

SEQ ID NO: 2373637 - protein, 8 aa, Entamoeba dispar
QTQQKTQK

SEQ ID NO: 2373638 - protein, 4 aa, Entamoeba dispar
QTQY

SEQ ID NO: 2373639 - protein, 6 aa, Entamoeba dispar
QTQYSQ

SEQ ID NO: 2373640 - protein, 7 aa, Entamoeba dispar
QTRDESI

SEQ ID NO: 2373641 - protein, 4 aa, Entamoeba dispar
QTSA

SEQ ID NO: 2373642 - protein, 11 aa, Entamoeba dispar
QTSGDENAQAL

SEQ ID NO: 2373643 - protein, 8 aa, Entamoeba dispar
QTSGEGVG

SEQ ID NO: 2373644 - protein, 4 aa, Entamoeba dispar
QTSS

SEQ ID NO: 2373645 - protein, 5 aa, Entamoeba dispar
QTSTD

SEQ ID NO: 2373646 - protein, 20 aa, Entamoeba dispar
QTSTELRFGKSNSQNPFPTA

SEQ ID NO: 2373647 - protein, 6 aa, Entamoeba dispar
QTSTPV

SEQ ID NO: 2373648 - protein, 14 aa, Entamoeba dispar
QTTDLNCETTADGY

SEQ ID NO: 2373649 - protein, 4 aa, Entamoeba dispar
QTTE

SEQ ID NO: 2373650 - protein, 5 aa, Entamoeba dispar
QTTHG

SEQ ID NO: 2373651 - protein, 10 aa, Entamoeba dispar
QTTKDIKKRD

SEQ ID NO: 2373652 - protein, 10 aa, Entamoeba dispar
QTTKITTSLD

SEQ ID NO: 2373653 - protein, 10 aa, Entamoeba dispar
QTTLEVGGQT

SEQ ID NO: 2373654 - protein, 9 aa, Entamoeba dispar
QTTPYPPTM

SEQ ID NO: 2373655 - protein, 13 aa, Entamoeba dispar
QTTQLKQNYNNTH

SEQ ID NO: 2373656 - protein, 8 aa, Entamoeba dispar
QTTSTPVI

SEQ ID NO: 2373657 - protein, 4 aa, Entamoeba dispar
QTTT

SEQ ID NO: 2373658 - protein, 17 aa, Entamoeba dispar
QTTTTTQTIAASTAQFK

SEQ ID NO: 2373659 - protein, 5 aa, Entamoeba dispar
QTTTY

SEQ ID NO: 2373660 - protein, 7 aa, Entamoeba dispar
QTTYHAS

SEQ ID NO: 2373661 - protein, 7 aa, Entamoeba dispar
QTVDQTP

SEQ ID NO: 2373662 - protein, 6 aa, Entamoeba dispar
QTVPNG

SEQ ID NO: 2373663 - protein, 7 aa, Entamoeba dispar
QTVRPSI

SEQ ID NO: 2373664 - protein, 20 aa, Entamoeba dispar
QTVTTTHSQVDDISTTNSSE

SEQ ID NO: 2373665 - protein, 6 aa, Entamoeba dispar
QTYPTA

SEQ ID NO: 2373666 - protein, 5 aa, Entamoeba dispar
QVAEM

SEQ ID NO: 2373667 - protein, 6 aa, Entamoeba dispar
QVDGET

SEQ ID NO: 2373668 - protein, 20 aa, Entamoeba dispar
QVEMGEKTEDQMEDEKYKED

SEQ ID NO: 2373669 - protein, 7 aa, Entamoeba dispar
QVKCSSE

SEQ ID NO: 2373670 - protein, 6 aa, Entamoeba dispar
QVKGPL

SEQ ID NO: 2373671 - protein, 7 aa, Entamoeba dispar
QVKKDDE

SEQ ID NO: 2373672 - protein, 23 aa, Entamoeba dispar
QVNDQTITSKEFKSITKDEFNKY

SEQ ID NO: 2373673 - protein, 8 aa, Entamoeba dispar
QVNQPGTV

SEQ ID NO: 2373674 - protein, 10 aa, Entamoeba dispar
QVPENDCQAS

SEQ ID NO: 2373675 - protein, 4 aa, Entamoeba dispar
QVPN

SEQ ID NO: 2373676 - protein, 7 aa, Entamoeba dispar
QVPSQLT

SEQ ID NO: 2373677 - protein, 7 aa, Entamoeba dispar
QVPSSTV

SEQ ID NO: 2373678 - protein, 11 aa, Entamoeba dispar
QVSEAEFNEEP

SEQ ID NO: 2373679 - protein, 20 aa, Entamoeba dispar
QVSQQPRYTAEFSKQGTSLL

SEQ ID NO: 2373680 - protein, 7 aa, Entamoeba dispar
QVSRKEY

SEQ ID NO: 2373681 - protein, 25 aa, Entamoeba dispar
QVTEPNTEQPQQEISEKLQENTNEL

SEQ ID NO: 2373682 - protein, 11 aa, Entamoeba dispar
QVTQKRHKRGD

SEQ ID NO: 2373683 - protein, 17 aa, Entamoeba dispar
QVTTTQLQNKPEKEIQK

SEQ ID NO: 2373684 - protein, 4 aa, Entamoeba dispar
QVYG

SEQ ID NO: 2373685 - protein, 29 aa, Entamoeba dispar
QWDNTTKSCIEGNDNCSRYSTDDGSCSTC

SEQ ID NO: 2373686 - protein, 20 aa, Entamoeba dispar
QWETQEDKYMEKPQPGTDST

SEQ ID NO: 2373687 - protein, 12 aa, Entamoeba dispar
QWGATTVAATSR

SEQ ID NO: 2373688 - protein, 42 aa, Entamoeba dispar
QWKNENEKRDATKATELVETSKPDITDNDNDDMKPSENGNNA

SEQ ID NO: 2373689 - protein, 16 aa, Entamoeba dispar
QWPDPLSDDANTPYPF

SEQ ID NO: 2373690 - protein, 7 aa, Entamoeba dispar
QWQDGEL

SEQ ID NO: 2373691 - protein, 5 aa, Entamoeba dispar
QWTEE

SEQ ID NO: 2373692 - protein, 22 aa, Entamoeba dispar
QYDNNGNHCTMESTDQNCVPTG

SEQ ID NO: 2373693 - protein, 6 aa, Entamoeba dispar
QYDPES

SEQ ID NO: 2373694 - protein, 6 aa, Entamoeba dispar
QYGADD

SEQ ID NO: 2373695 - protein, 4 aa, Entamoeba dispar
QYNG

SEQ ID NO: 2373696 - protein, 4 aa, Entamoeba dispar
QYNP

SEQ ID NO: 2373697 - protein, 5 aa, Entamoeba dispar
QYNPT

SEQ ID NO: 2373698 - protein, 4 aa, Entamoeba dispar
QYPK

SEQ ID NO: 2373699 - protein, 5 aa, Entamoeba dispar
QYQQP

SEQ ID NO: 2373700 - protein, 9 aa, Entamoeba dispar
QYQQSNNLQ

SEQ ID NO: 2373701 - protein, 11 aa, Entamoeba dispar
QYQTDTDQNEL

SEQ ID NO: 2373702 - protein, 4 aa, Entamoeba dispar
QYRR

SEQ ID NO: 2373703 - protein, 6 aa, Entamoeba dispar
QYSDTQ

SEQ ID NO: 2373704 - protein, 7 aa, Entamoeba dispar
QYSNCGD

SEQ ID NO: 2373705 - protein, 10 aa, Entamoeba dispar
QYTAGSGQVD

SEQ ID NO: 2373706 - protein, 5 aa, Entamoeba dispar
QYTPA

SEQ ID NO: 2373707 - protein, 4 aa, Entamoeba dispar
QYTQ

SEQ ID NO: 2373708 - protein, 4 aa, Entamoeba dispar
QYVD

SEQ ID NO: 2373709 - protein, 5 aa, Entamoeba dispar
QYVTK

SEQ ID NO: 2373710 - protein, 17 aa, Entamoeba dispar
QYYASNDDSVHCQSSDN

SEQ ID NO: 2373711 - protein, 11 aa, Entamoeba dispar
RAAEKQRETEI

SEQ ID NO: 2373712 - protein, 9 aa, Entamoeba dispar
RAALSNYST

SEQ ID NO: 2373713 - protein, 5 aa, Entamoeba dispar
RADND

SEQ ID NO: 2373714 - protein, 13 aa, Entamoeba dispar
RAEAQESEYIDGD

SEQ ID NO: 2373715 - protein, 9 aa, Entamoeba dispar
RAKSATKKQ

SEQ ID NO: 2373716 - protein, 9 aa, Entamoeba dispar
RAKVAAEKI

SEQ ID NO: 2373717 - protein, 34 aa, Entamoeba dispar
RALSKRLPTDQEKQEYWAEQSTKTPDTWPLLFNS

SEQ ID NO: 2373718 - protein, 6 aa, Entamoeba dispar
RANNRY

SEQ ID NO: 2373719 - protein, 6 aa, Entamoeba dispar
RAPRHN

SEQ ID NO: 2373720 - protein, 8 aa, Entamoeba dispar
RASEKSKG

SEQ ID NO: 2373721 - protein, 8 aa, Entamoeba dispar
RASEKSKS

SEQ ID NO: 2373722 - protein, 7 aa, Entamoeba dispar
RASEQKK

SEQ ID NO: 2373723 - protein, 8 aa, Entamoeba dispar
RASESSKS

SEQ ID NO: 2373724 - protein, 8 aa, Entamoeba dispar
RASTNNKG

SEQ ID NO: 2373725 - protein, 12 aa, Entamoeba dispar
RASYRKYSKEQF

SEQ ID NO: 2373726 - protein, 6 aa, Entamoeba dispar
RATTAD

SEQ ID NO: 2373727 - protein, 11 aa, Entamoeba dispar
RCDQPKPKINE

SEQ ID NO: 2373728 - protein, 16 aa, Entamoeba dispar
RCEVNTPEEENKEKNW

SEQ ID NO: 2373729 - protein, 8 aa, Entamoeba dispar
RCQPTSSL

SEQ ID NO: 2373730 - protein, 7 aa, Entamoeba dispar
RCRSPEI

SEQ ID NO: 2373731 - protein, 5 aa, Entamoeba dispar
RCSDA

SEQ ID NO: 2373732 - protein, 15 aa, Entamoeba dispar
RCSTCSSKTNKCSEC

SEQ ID NO: 2373733 - protein, 8 aa, Entamoeba dispar
RCTNDRSA

SEQ ID NO: 2373734 - protein, 8 aa, Entamoeba dispar
RCTQEGKE

SEQ ID NO: 2373735 - protein, 5 aa, Entamoeba dispar
RDADG

SEQ ID NO: 2373736 - protein, 16 aa, Entamoeba dispar
RDAETSPDCQSYTRPS

SEQ ID NO: 2373737 - protein, 11 aa, Entamoeba dispar
RDANGKVIKGD

SEQ ID NO: 2373738 - protein, 8 aa, Entamoeba dispar
RDANQVDN

SEQ ID NO: 2373739 - protein, 6 aa, Entamoeba dispar
RDASSF

SEQ ID NO: 2373740 - protein, 6 aa, Entamoeba dispar
RDDDDS

SEQ ID NO: 2373741 - protein, 6 aa, Entamoeba dispar
RDDDGI

SEQ ID NO: 2373742 - protein, 7 aa, Entamoeba dispar
RDEEERE

SEQ ID NO: 2373743 - protein, 5 aa, Entamoeba dispar
RDEIE

SEQ ID NO: 2373744 - protein, 4 aa, Entamoeba dispar
RDEN

SEQ ID NO: 2373745 - protein, 14 aa, Entamoeba dispar
RDESELSSEERKKI

SEQ ID NO: 2373746 - protein, 6 aa, Entamoeba dispar
RDETED

SEQ ID NO: 2373747 - protein, 6 aa, Entamoeba dispar
RDETIK

SEQ ID NO: 2373748 - protein, 8 aa, Entamoeba dispar
RDETMKTY

SEQ ID NO: 2373749 - protein, 13 aa, Entamoeba dispar
RDFPKSAFTSSSA

SEQ ID NO: 2373750 - protein, 6 aa, Entamoeba dispar
RDGNGR

SEQ ID NO: 2373751 - protein, 4 aa, Entamoeba dispar
RDGV

SEQ ID NO: 2373752 - protein, 11 aa, Entamoeba dispar
RDIDESDHTVR

SEQ ID NO: 2373753 - protein, 12 aa, Entamoeba dispar
RDIDGLKPSDFG

SEQ ID NO: 2373754 - protein, 11 aa, Entamoeba dispar
RDKVNLKEEEI

SEQ ID NO: 2373755 - protein, 9 aa, Entamoeba dispar
RDLPTSKTY

SEQ ID NO: 2373756 - protein, 9 aa, Entamoeba dispar
RDNKGTTFD

SEQ ID NO: 2373757 - protein, 9 aa, Entamoeba dispar
RDNNNNQYY

SEQ ID NO: 2373758 - protein, 7 aa, Entamoeba dispar
RDNPFKA

SEQ ID NO: 2373759 - protein, 11 aa, Entamoeba dispar
RDPNQRASSRD

SEQ ID NO: 2373760 - protein, 15 aa, Entamoeba dispar
RDPPKEKKDKEGIDL

SEQ ID NO: 2373761 - protein, 11 aa, Entamoeba dispar
RDQKKPFENTK

SEQ ID NO: 2373762 - protein, 6 aa, Entamoeba dispar
RDRIEE

SEQ ID NO: 2373763 - protein, 7 aa, Entamoeba dispar
RDRSSKI

SEQ ID NO: 2373764 - protein, 4 aa, Entamoeba dispar
RDSV

SEQ ID NO: 2373765 - protein, 4 aa, Entamoeba dispar
RDTE

SEQ ID NO: 2373766 - protein, 6 aa, Entamoeba dispar
RDTENM

SEQ ID NO: 2373767 - protein, 4 aa, Entamoeba dispar
RDYS

SEQ ID NO: 2373768 - protein, 9 aa, Entamoeba dispar
READTPFDQ

SEQ ID NO: 2373769 - protein, 5 aa, Entamoeba dispar
REASV

SEQ ID NO: 2373770 - protein, 7 aa, Entamoeba dispar
RECTPEG

SEQ ID NO: 2373771 - protein, 12 aa, Entamoeba dispar
REDAEMGELPYS

SEQ ID NO: 2373772 - protein, 6 aa, Entamoeba dispar
REDEKG

SEQ ID NO: 2373773 - protein, 8 aa, Entamoeba dispar
REDSAAVN

SEQ ID NO: 2373774 - protein, 16 aa, Entamoeba dispar
REEGEEMLSTSNAPAL

SEQ ID NO: 2373775 - protein, 10 aa, Entamoeba dispar
REEGNPFRHP

SEQ ID NO: 2373776 - protein, 5 aa, Entamoeba dispar
REEST

SEQ ID NO: 2373777 - protein, 6 aa, Entamoeba dispar
REEYLK

SEQ ID NO: 2373778 - protein, 15 aa, Entamoeba dispar
REGDDDDEGHDDDCE

SEQ ID NO: 2373779 - protein, 6 aa, Entamoeba dispar
REGPVG

SEQ ID NO: 2373780 - protein, 4 aa, Entamoeba dispar
REGR

SEQ ID NO: 2373781 - protein, 8 aa, Entamoeba dispar
REGSGNEF

SEQ ID NO: 2373782 - protein, 6 aa, Entamoeba dispar
REGSSN

SEQ ID NO: 2373783 - protein, 4 aa, Entamoeba dispar
REGT

SEQ ID NO: 2373784 - protein, 4 aa, Entamoeba dispar
REGY

SEQ ID NO: 2373785 - protein, 17 aa, Entamoeba dispar
REIEELKKRKGNEMRNE

SEQ ID NO: 2373786 - protein, 16 aa, Entamoeba dispar
REIEKSRNHVYGESRG

SEQ ID NO: 2373787 - protein, 12 aa, Entamoeba dispar
REINSNKEMKDE

SEQ ID NO: 2373788 - protein, 8 aa, Entamoeba dispar
REITAPRT

SEQ ID NO: 2373789 - protein, 5 aa, Entamoeba dispar
REKDI

SEQ ID NO: 2373790 - protein, 8 aa, Entamoeba dispar
REKDTENL

SEQ ID NO: 2373791 - protein, 35 aa, Entamoeba dispar
REKEELPEEPDDAEELLKSTKEDFDKEENEIDPEI

SEQ ID NO: 2373792 - protein, 7 aa, Entamoeba dispar
REKHMRE

SEQ ID NO: 2373793 - protein, 24 aa, Entamoeba dispar
REKLSKKIKNKRSTVNNELLKVYL

SEQ ID NO: 2373794 - protein, 6 aa, Entamoeba dispar
REKLSY

SEQ ID NO: 2373795 - protein, 6 aa, Entamoeba dispar
REKSDL

SEQ ID NO: 2373796 - protein, 8 aa, Entamoeba dispar
RENNERSK

SEQ ID NO: 2373797 - protein, 9 aa, Entamoeba dispar
RENSKQKDV

SEQ ID NO: 2373798 - protein, 7 aa, Entamoeba dispar
REPSSLP

SEQ ID NO: 2373799 - protein, 10 aa, Entamoeba dispar
REQDFDKDSD

SEQ ID NO: 2373800 - protein, 13 aa, Entamoeba dispar
REQTITSNLNDSE

SEQ ID NO: 2373801 - protein, 6 aa, Entamoeba dispar
RERISN

SEQ ID NO: 2373802 - protein, 15 aa, Entamoeba dispar
RERKGKIEERRRRGI

SEQ ID NO: 2373803 - protein, 4 aa, Entamoeba dispar
RERN

SEQ ID NO: 2373804 - protein, 10 aa, Entamoeba dispar
RESDGNRLSS

SEQ ID NO: 2373805 - protein, 7 aa, Entamoeba dispar
RESDNQV

SEQ ID NO: 2373806 - protein, 7 aa, Entamoeba dispar
RESECSE

SEQ ID NO: 2373807 - protein, 9 aa, Entamoeba dispar
RESEEKDIK

SEQ ID NO: 2373808 - protein, 6 aa, Entamoeba dispar
RESNDY

SEQ ID NO: 2373809 - protein, 5 aa, Entamoeba dispar
RESNS

SEQ ID NO: 2373810 - protein, 6 aa, Entamoeba dispar
RESNTI

SEQ ID NO: 2373811 - protein, 5 aa, Entamoeba dispar
RETET

SEQ ID NO: 2373812 - protein, 11 aa, Entamoeba dispar
RETFSESQSRR

SEQ ID NO: 2373813 - protein, 4 aa, Entamoeba dispar
RETK

SEQ ID NO: 2373814 - protein, 9 aa, Entamoeba dispar
RETPIAEGA

SEQ ID NO: 2373815 - protein, 7 aa, Entamoeba dispar
RETTPQN

SEQ ID NO: 2373816 - protein, 7 aa, Entamoeba dispar
REWENGE

SEQ ID NO: 2373817 - protein, 4 aa, Entamoeba dispar
REWY

SEQ ID NO: 2373818 - protein, 5 aa, Entamoeba dispar
REYEK

SEQ ID NO: 2373819 - protein, 7 aa, Entamoeba dispar
REYHNGT

SEQ ID NO: 2373820 - protein, 4 aa, Entamoeba dispar
REYK

SEQ ID NO: 2373821 - protein, 8 aa, Entamoeba dispar
REYSKSRC

SEQ ID NO: 2373822 - protein, 4 aa, Entamoeba dispar
REYT

SEQ ID NO: 2373823 - protein, 9 aa, Entamoeba dispar
RFEGTRKEN

SEQ ID NO: 2373824 - protein, 5 aa, Entamoeba dispar
RFEPV

SEQ ID NO: 2373825 - protein, 6 aa, Entamoeba dispar
RFGGPE

SEQ ID NO: 2373826 - protein, 14 aa, Entamoeba dispar
RFLGTQKKSQDKGI

SEQ ID NO: 2373827 - protein, 7 aa, Entamoeba dispar
RFNGDGS

SEQ ID NO: 2373828 - protein, 5 aa, Entamoeba dispar
RFNPK

SEQ ID NO: 2373829 - protein, 12 aa, Entamoeba dispar
RFPNNKDETLQK

SEQ ID NO: 2373830 - protein, 5 aa, Entamoeba dispar
RFPPE

SEQ ID NO: 2373831 - protein, 5 aa, Entamoeba dispar
RFQGV

SEQ ID NO: 2373832 - protein, 15 aa, Entamoeba dispar
RFRGGYGEAAQETSC

SEQ ID NO: 2373833 - protein, 6 aa, Entamoeba dispar
RGADRV

SEQ ID NO: 2373834 - protein, 6 aa, Entamoeba dispar
RGADTT

SEQ ID NO: 2373835 - protein, 8 aa, Entamoeba dispar
RGATYEQV

SEQ ID NO: 2373836 - protein, 5 aa, Entamoeba dispar
RGCGI

SEQ ID NO: 2373837 - protein, 9 aa, Entamoeba dispar
RGDETPQVT

SEQ ID NO: 2373838 - protein, 6 aa, Entamoeba dispar
RGDGME

SEQ ID NO: 2373839 - protein, 6 aa, Entamoeba dispar
RGDTPL

SEQ ID NO: 2373840 - protein, 6 aa, Entamoeba dispar
RGEGKM

SEQ ID NO: 2373841 - protein, 8 aa, Entamoeba dispar
RGEGPLSI

SEQ ID NO: 2373842 - protein, 7 aa, Entamoeba dispar
RGERSTC

SEQ ID NO: 2373843 - protein, 8 aa, Entamoeba dispar
RGESHKCY

SEQ ID NO: 2373844 - protein, 5 aa, Entamoeba dispar
RGETH

SEQ ID NO: 2373845 - protein, 10 aa, Entamoeba dispar
RGFENSEETL

SEQ ID NO: 2373846 - protein, 4 aa, Entamoeba dispar
RGFT

SEQ ID NO: 2373847 - protein, 7 aa, Entamoeba dispar
RGGIKSI

SEQ ID NO: 2373848 - protein, 12 aa, Entamoeba dispar
RGICSTSSGKCE

SEQ ID NO: 2373849 - protein, 12 aa, Entamoeba dispar
RGIPKGVEVTNE

SEQ ID NO: 2373850 - protein, 13 aa, Entamoeba dispar
RGIPKGVEVTNEQ

SEQ ID NO: 2373851 - protein, 8 aa, Entamoeba dispar
RGKGDWEC

SEQ ID NO: 2373852 - protein, 5 aa, Entamoeba dispar
RGKGK

SEQ ID NO: 2373853 - protein, 7 aa, Entamoeba dispar
RGNECSG

SEQ ID NO: 2373854 - protein, 12 aa, Entamoeba dispar
RGNGKKKISKED

SEQ ID NO: 2373855 - protein, 7 aa, Entamoeba dispar
RGNKEQI

SEQ ID NO: 2373856 - protein, 5 aa, Entamoeba dispar
RGNKV

SEQ ID NO: 2373857 - protein, 8 aa, Entamoeba dispar
RGNNGSFC

SEQ ID NO: 2373858 - protein, 4 aa, Entamoeba dispar
RGNP

SEQ ID NO: 2373859 - protein, 10 aa, Entamoeba dispar
RGNSKNSGNL

SEQ ID NO: 2373860 - protein, 6 aa, Entamoeba dispar
RGNSLT

SEQ ID NO: 2373861 - protein, 8 aa, Entamoeba dispar
RGNTEDKG

SEQ ID NO: 2373862 - protein, 6 aa, Entamoeba dispar
RGNVEC

SEQ ID NO: 2373863 - protein, 11 aa, Entamoeba dispar
RGPATVTSSDI

SEQ ID NO: 2373864 - protein, 5 aa, Entamoeba dispar
RGPPG

SEQ ID NO: 2373865 - protein, 4 aa, Entamoeba dispar
RGQI

SEQ ID NO: 2373866 - protein, 14 aa, Entamoeba dispar
RGQRRERPDNIPEP

SEQ ID NO: 2373867 - protein, 20 aa, Entamoeba dispar
RGRDYTAPPIASDKEKCEGL

SEQ ID NO: 2373868 - protein, 4 aa, Entamoeba dispar
RGSF

SEQ ID NO: 2373869 - protein, 5 aa, Entamoeba dispar
RGSIP

SEQ ID NO: 2373870 - protein, 6 aa, Entamoeba dispar
RGSRSV

SEQ ID NO: 2373871 - protein, 6 aa, Entamoeba dispar
RGSSIR

SEQ ID NO: 2373872 - protein, 6 aa, Entamoeba dispar
RGTAAG

SEQ ID NO: 2373873 - protein, 6 aa, Entamoeba dispar
RGTAAT

SEQ ID NO: 2373874 - protein, 10 aa, Entamoeba dispar
RGTDSKSDGI

SEQ ID NO: 2373875 - protein, 10 aa, Entamoeba dispar
RGTGSNSDGI

SEQ ID NO: 2373876 - protein, 38 aa, Entamoeba dispar
RGTLATSSEQRSFHNSGLKGQIPKKCRRSIGKTDEIDS

SEQ ID NO: 2373877 - protein, 6 aa, Entamoeba dispar
RGTRPE

SEQ ID NO: 2373878 - protein, 5 aa, Entamoeba dispar
RGTTL

SEQ ID NO: 2373879 - protein, 5 aa, Entamoeba dispar
RGTYQ

SEQ ID NO: 2373880 - protein, 4 aa, Entamoeba dispar
RGVI

SEQ ID NO: 2373881 - protein, 6 aa, Entamoeba dispar
RGVSEN

SEQ ID NO: 2373882 - protein, 14 aa, Entamoeba dispar
RGYDSAGIASINNN

SEQ ID NO: 2373883 - protein, 6 aa, Entamoeba dispar
RHGEPF

SEQ ID NO: 2373884 - protein, 5 aa, Entamoeba dispar
RHNGQ

SEQ ID NO: 2373885 - protein, 15 aa, Entamoeba dispar
RHNRDSANHNDYGNE

SEQ ID NO: 2373886 - protein, 10 aa, Entamoeba dispar
RHRADEEFNN

SEQ ID NO: 2373887 - protein, 11 aa, Entamoeba dispar
RHRDDNTINNK

SEQ ID NO: 2373888 - protein, 11 aa, Entamoeba dispar
RHRDDQRENNR

SEQ ID NO: 2373889 - protein, 8 aa, Entamoeba dispar
RHSEQTQL

SEQ ID NO: 2373890 - protein, 13 aa, Entamoeba dispar
RHSNDANTLNSLP

SEQ ID NO: 2373891 - protein, 10 aa, Entamoeba dispar
RHSPSERPTF

SEQ ID NO: 2373892 - protein, 5 aa, Entamoeba dispar
RIDKN

SEQ ID NO: 2373893 - protein, 17 aa, Entamoeba dispar
RIEYSGNQDATSPFEIS

SEQ ID NO: 2373894 - protein, 4 aa, Entamoeba dispar
RIGI

SEQ ID NO: 2373895 - protein, 10 aa, Entamoeba dispar
RIGPKRIKER

SEQ ID NO: 2373896 - protein, 5 aa, Entamoeba dispar
RIGQN

SEQ ID NO: 2373897 - protein, 7 aa, Entamoeba dispar
RIGTPKY

SEQ ID NO: 2373898 - protein, 5 aa, Entamoeba dispar
RINNT

SEQ ID NO: 2373899 - protein, 5 aa, Entamoeba dispar
RINSK

SEQ ID NO: 2373900 - protein, 7 aa, Entamoeba dispar
RINTTDK

SEQ ID NO: 2373901 - protein, 4 aa, Entamoeba dispar
RIPS

SEQ ID NO: 2373902 - protein, 9 aa, Entamoeba dispar
RIQSAGQKL

SEQ ID NO: 2373903 - protein, 6 aa, Entamoeba dispar
RISEPR

SEQ ID NO: 2373904 - protein, 19 aa, Entamoeba dispar
RISGSGSGRNGQGAFGNMT

SEQ ID NO: 2373905 - protein, 8 aa, Entamoeba dispar
RISGVSTS

SEQ ID NO: 2373906 - protein, 21 aa, Entamoeba dispar
RISNKESEITLESSESTSKFK

SEQ ID NO: 2373907 - protein, 4 aa, Entamoeba dispar
RISQ

SEQ ID NO: 2373908 - protein, 5 aa, Entamoeba dispar
RISSG

SEQ ID NO: 2373909 - protein, 11 aa, Entamoeba dispar
RISSKIKEKFK

SEQ ID NO: 2373910 - protein, 5 aa, Entamoeba dispar
RISSP

SEQ ID NO: 2373911 - protein, 11 aa, Entamoeba dispar
RITQDSHCTKC

SEQ ID NO: 2373912 - protein, 4 aa, Entamoeba dispar
RITT

SEQ ID NO: 2373913 - protein, 7 aa, Entamoeba dispar
RITYTGE

SEQ ID NO: 2373914 - protein, 5 aa, Entamoeba dispar
RIVDN

SEQ ID NO: 2373915 - protein, 11 aa, Entamoeba dispar
RIYSEEKVTKE

SEQ ID NO: 2373916 - protein, 5 aa, Entamoeba dispar
RKAPT

SEQ ID NO: 2373917 - protein, 8 aa, Entamoeba dispar
RKAYEKRG

SEQ ID NO: 2373918 - protein, 15 aa, Entamoeba dispar
RKCDSDLSDKSEDEL

SEQ ID NO: 2373919 - protein, 7 aa, Entamoeba dispar
RKCDYTG

SEQ ID NO: 2373920 - protein, 9 aa, Entamoeba dispar
RKDGEGLSP

SEQ ID NO: 2373921 - protein, 14 aa, Entamoeba dispar
RKDIKQKTSPTPLK

SEQ ID NO: 2373922 - protein, 9 aa, Entamoeba dispar
RKDKSGNFN

SEQ ID NO: 2373923 - protein, 7 aa, Entamoeba dispar
RKDLNRT

SEQ ID NO: 2373924 - protein, 7 aa, Entamoeba dispar
RKDNESY

SEQ ID NO: 2373925 - protein, 8 aa, Entamoeba dispar
RKDNPQRV

SEQ ID NO: 2373926 - protein, 7 aa, Entamoeba dispar
RKDSEYE

SEQ ID NO: 2373927 - protein, 15 aa, Entamoeba dispar
RKDSGLNGQSRHNIP

SEQ ID NO: 2373928 - protein, 5 aa, Entamoeba dispar
RKDYT

SEQ ID NO: 2373929 - protein, 8 aa, Entamoeba dispar
RKEAGLKV

SEQ ID NO: 2373930 - protein, 5 aa, Entamoeba dispar
RKEDY

SEQ ID NO: 2373931 - protein, 9 aa, Entamoeba dispar
RKEEEKKLR

SEQ ID NO: 2373932 - protein, 5 aa, Entamoeba dispar
RKEFG

SEQ ID NO: 2373933 - protein, 13 aa, Entamoeba dispar
RKEGETEHKLPQG

SEQ ID NO: 2373934 - protein, 12 aa, Entamoeba dispar
RKEKVGVDKKRV

SEQ ID NO: 2373935 - protein, 11 aa, Entamoeba dispar
RKEKYRHKGYS

SEQ ID NO: 2373936 - protein, 8 aa, Entamoeba dispar
RKELESVE

SEQ ID NO: 2373937 - protein, 10 aa, Entamoeba dispar
RKENEDSSLE

SEQ ID NO: 2373938 - protein, 8 aa, Entamoeba dispar
RKESGLEE

SEQ ID NO: 2373939 - protein, 4 aa, Entamoeba dispar
RKET

SEQ ID NO: 2373940 - protein, 5 aa, Entamoeba dispar
RKETL

SEQ ID NO: 2373941 - protein, 4 aa, Entamoeba dispar
RKEV

SEQ ID NO: 2373942 - protein, 12 aa, Entamoeba dispar
RKEYGEKDRKIQ

SEQ ID NO: 2373943 - protein, 13 aa, Entamoeba dispar
RKFKEASDKADSH

SEQ ID NO: 2373944 - protein, 6 aa, Entamoeba dispar
RKGENT

SEQ ID NO: 2373945 - protein, 4 aa, Entamoeba dispar
RKGG

SEQ ID NO: 2373946 - protein, 46 aa, Entamoeba dispar
RKGGDSNSKSENEIKRENGEEIAYEPKISTKNETTEPTDEDRVSQV

SEQ ID NO: 2373947 - protein, 10 aa, Entamoeba dispar
RKGKKGEDEA

SEQ ID NO: 2373948 - protein, 6 aa, Entamoeba dispar
RKGNTS

SEQ ID NO: 2373949 - protein, 12 aa, Entamoeba dispar
RKGQTDPTNQMS

SEQ ID NO: 2373950 - protein, 7 aa, Entamoeba dispar
RKHNPNK

SEQ ID NO: 2373951 - protein, 5 aa, Entamoeba dispar
RKINN

SEQ ID NO: 2373952 - protein, 14 aa, Entamoeba dispar
RKIYTNKKDQNIEK

SEQ ID NO: 2373953 - protein, 9 aa, Entamoeba dispar
RKKDRLSDF

SEQ ID NO: 2373954 - protein, 4 aa, Entamoeba dispar
RKKE

SEQ ID NO: 2373955 - protein, 8 aa, Entamoeba dispar
RKKEGLND

SEQ ID NO: 2373956 - protein, 16 aa, Entamoeba dispar
RKKINEKKPSALVGED

SEQ ID NO: 2373957 - protein, 9 aa, Entamoeba dispar
RKKKEREEK

SEQ ID NO: 2373958 - protein, 6 aa, Entamoeba dispar
RKKMVN

SEQ ID NO: 2373959 - protein, 5 aa, Entamoeba dispar
RKKNK

SEQ ID NO: 2373960 - protein, 9 aa, Entamoeba dispar
RKKNNTKSL

SEQ ID NO: 2373961 - protein, 10 aa, Entamoeba dispar
RKKQENEEKI

SEQ ID NO: 2373962 - protein, 15 aa, Entamoeba dispar
RKKREEEEKTEKGKN

SEQ ID NO: 2373963 - protein, 15 aa, Entamoeba dispar
RKKRTRQKEKDLVTA

SEQ ID NO: 2373964 - protein, 9 aa, Entamoeba dispar
RKKTKNGTV

SEQ ID NO: 2373965 - protein, 8 aa, Entamoeba dispar
RKKTSQIL

SEQ ID NO: 2373966 - protein, 8 aa, Entamoeba dispar
RKKVSDEI

SEQ ID NO: 2373967 - protein, 7 aa, Entamoeba dispar
RKMSSFD

SEQ ID NO: 2373968 - protein, 8 aa, Entamoeba dispar
RKNATYQT

SEQ ID NO: 2373969 - protein, 5 aa, Entamoeba dispar
RKNDF

SEQ ID NO: 2373970 - protein, 12 aa, Entamoeba dispar
RKNGSTKETRSL

SEQ ID NO: 2373971 - protein, 5 aa, Entamoeba dispar
RKNKK

SEQ ID NO: 2373972 - protein, 7 aa, Entamoeba dispar
RKNKSNY

SEQ ID NO: 2373973 - protein, 6 aa, Entamoeba dispar
RKNNLE

SEQ ID NO: 2373974 - protein, 7 aa, Entamoeba dispar
RKNNTST

SEQ ID NO: 2373975 - protein, 10 aa, Entamoeba dispar
RKNPDIENMT

SEQ ID NO: 2373976 - protein, 5 aa, Entamoeba dispar
RKNSP

SEQ ID NO: 2373977 - protein, 27 aa, Entamoeba dispar
RKNTIDNTVNNPQFTAKDDNATNANFN

SEQ ID NO: 2373978 - protein, 28 aa, Entamoeba dispar
RKNYGHVDESTKYYDDGQDSNGIELTKD

SEQ ID NO: 2373979 - protein, 6 aa, Entamoeba dispar
RKPEWD

SEQ ID NO: 2373980 - protein, 7 aa, Entamoeba dispar
RKPGIAK

SEQ ID NO: 2373981 - protein, 7 aa, Entamoeba dispar
RKPIDRT

SEQ ID NO: 2373982 - protein, 4 aa, Entamoeba dispar
RKPL

SEQ ID NO: 2373983 - protein, 7 aa, Entamoeba dispar
RKPNGFA

SEQ ID NO: 2373984 - protein, 9 aa, Entamoeba dispar
RKPRDPNSN

SEQ ID NO: 2373985 - protein, 8 aa, Entamoeba dispar
RKPTSGKF

SEQ ID NO: 2373986 - protein, 4 aa, Entamoeba dispar
RKQF

SEQ ID NO: 2373987 - protein, 6 aa, Entamoeba dispar
RKQKGK

SEQ ID NO: 2373988 - protein, 12 aa, Entamoeba dispar
RKQKQTMETYQQ

SEQ ID NO: 2373989 - protein, 11 aa, Entamoeba dispar
RKQLKQRLTNE

SEQ ID NO: 2373990 - protein, 5 aa, Entamoeba dispar
RKQPL

SEQ ID NO: 2373991 - protein, 4 aa, Entamoeba dispar
RKQR

SEQ ID NO: 2373992 - protein, 9 aa, Entamoeba dispar
RKQTEKEYE

SEQ ID NO: 2373993 - protein, 5 aa, Entamoeba dispar
RKRDR

SEQ ID NO: 2373994 - protein, 12 aa, Entamoeba dispar
RKRKDIKETNNI

SEQ ID NO: 2373995 - protein, 8 aa, Entamoeba dispar
RKRMQDKI

SEQ ID NO: 2373996 - protein, 7 aa, Entamoeba dispar
RKSFDPK

SEQ ID NO: 2373997 - protein, 5 aa, Entamoeba dispar
RKSFG

SEQ ID NO: 2373998 - protein, 12 aa, Entamoeba dispar
RKSGIEIPKASE

SEQ ID NO: 2373999 - protein, 10 aa, Entamoeba dispar
RKSKSFESQI

SEQ ID NO: 2374000 - protein, 8 aa, Entamoeba dispar
RKSNKKSI

SEQ ID NO: 2374001 - protein, 17 aa, Entamoeba dispar
RKSPQDPFSNEGEKNFT

SEQ ID NO: 2374002 - protein, 7 aa, Entamoeba dispar
RKSQKLS

SEQ ID NO: 2374003 - protein, 9 aa, Entamoeba dispar
RKSSQRTTR

SEQ ID NO: 2374004 - protein, 5 aa, Entamoeba dispar
RKTKD

SEQ ID NO: 2374005 - protein, 8 aa, Entamoeba dispar
RKTPATQI

SEQ ID NO: 2374006 - protein, 9 aa, Entamoeba dispar
RKTSEGLSP

SEQ ID NO: 2374007 - protein, 8 aa, Entamoeba dispar
RKTSSSFG

SEQ ID NO: 2374008 - protein, 5 aa, Entamoeba dispar
RKTTI

SEQ ID NO: 2374009 - protein, 9 aa, Entamoeba dispar
RKTYKSKGK

SEQ ID NO: 2374010 - protein, 8 aa, Entamoeba dispar
RKVGNDAE

SEQ ID NO: 2374011 - protein, 7 aa, Entamoeba dispar
RKVNGEH

SEQ ID NO: 2374012 - protein, 6 aa, Entamoeba dispar
RKYRTG

SEQ ID NO: 2374013 - protein, 14 aa, Entamoeba dispar
RKYSVEEEKIEKSN

SEQ ID NO: 2374014 - protein, 15 aa, Entamoeba dispar
RLDPGEECDGGSGCN

SEQ ID NO: 2374015 - protein, 6 aa, Entamoeba dispar
RLDSAG

SEQ ID NO: 2374016 - protein, 34 aa, Entamoeba dispar
RLEGELNAATQKLTKELSTDKKDVNVDDLNADEA

SEQ ID NO: 2374017 - protein, 4 aa, Entamoeba dispar
RLEI

SEQ ID NO: 2374018 - protein, 12 aa, Entamoeba dispar
RLEKPTKLPENE

SEQ ID NO: 2374019 - protein, 8 aa, Entamoeba dispar
RLERKDNM

SEQ ID NO: 2374020 - protein, 4 aa, Entamoeba dispar
RLET

SEQ ID NO: 2374021 - protein, 10 aa, Entamoeba dispar
RLKEDNSPVL

SEQ ID NO: 2374022 - protein, 9 aa, Entamoeba dispar
RLKGNEREI

SEQ ID NO: 2374023 - protein, 4 aa, Entamoeba dispar
RLNA

SEQ ID NO: 2374024 - protein, 9 aa, Entamoeba dispar
RLNNETDKY

SEQ ID NO: 2374025 - protein, 10 aa, Entamoeba dispar
RLPKPEGIPE

SEQ ID NO: 2374026 - protein, 12 aa, Entamoeba dispar
RLPKVSSITDEE

SEQ ID NO: 2374027 - protein, 10 aa, Entamoeba dispar
RLPTEEERAV

SEQ ID NO: 2374028 - protein, 6 aa, Entamoeba dispar
RLSQTK

SEQ ID NO: 2374029 - protein, 7 aa, Entamoeba dispar
RLSYTSG

SEQ ID NO: 2374030 - protein, 11 aa, Entamoeba dispar
RMKNSSGCYPS

SEQ ID NO: 2374031 - protein, 16 aa, Entamoeba dispar
RMKTSIPDVELQVITN

SEQ ID NO: 2374032 - protein, 11 aa, Entamoeba dispar
RMKTSSTSGGM

SEQ ID NO: 2374033 - protein, 4 aa, Entamoeba dispar
RMPG

SEQ ID NO: 2374034 - protein, 8 aa, Entamoeba dispar
RMSESNLS

SEQ ID NO: 2374035 - protein, 10 aa, Entamoeba dispar
RNAERTRESD

SEQ ID NO: 2374036 - protein, 8 aa, Entamoeba dispar
RNANGKTN

SEQ ID NO: 2374037 - protein, 4 aa, Entamoeba dispar
RNED

SEQ ID NO: 2374038 - protein, 27 aa, Entamoeba dispar
RNEEEGEKQIEKEYQIRKKNKKERGNN

SEQ ID NO: 2374039 - protein, 10 aa, Entamoeba dispar
RNEEKGLDND

SEQ ID NO: 2374040 - protein, 11 aa, Entamoeba dispar
RNEEKKEEIKE

SEQ ID NO: 2374041 - protein, 13 aa, Entamoeba dispar
RNEHTPSPQLPES

SEQ ID NO: 2374042 - protein, 10 aa, Entamoeba dispar
RNEISNSDHT

SEQ ID NO: 2374043 - protein, 5 aa, Entamoeba dispar
RNEPR

SEQ ID NO: 2374044 - protein, 7 aa, Entamoeba dispar
RNEPYKY

SEQ ID NO: 2374045 - protein, 17 aa, Entamoeba dispar
RNESSKGELSEKSSIKL

SEQ ID NO: 2374046 - protein, 6 aa, Entamoeba dispar
RNFGKN

SEQ ID NO: 2374047 - protein, 9 aa, Entamoeba dispar
RNFQKETGK

SEQ ID NO: 2374048 - protein, 7 aa, Entamoeba dispar
RNGAGSI

SEQ ID NO: 2374049 - protein, 5 aa, Entamoeba dispar
RNGDY

SEQ ID NO: 2374050 - protein, 9 aa, Entamoeba dispar
RNGEKERFE

SEQ ID NO: 2374051 - protein, 8 aa, Entamoeba dispar
RNGGEAEQ

SEQ ID NO: 2374052 - protein, 4 aa, Entamoeba dispar
RNGQ

SEQ ID NO: 2374053 - protein, 5 aa, Entamoeba dispar
RNHKE

SEQ ID NO: 2374054 - protein, 19 aa, Entamoeba dispar
RNIGTYDGNDISKCNKDTI

SEQ ID NO: 2374055 - protein, 10 aa, Entamoeba dispar
RNINSRNSFK

SEQ ID NO: 2374056 - protein, 8 aa, Entamoeba dispar
RNKAYFDG

SEQ ID NO: 2374057 - protein, 8 aa, Entamoeba dispar
RNKDPHEL

SEQ ID NO: 2374058 - protein, 10 aa, Entamoeba dispar
RNKDQKITRS

SEQ ID NO: 2374059 - protein, 8 aa, Entamoeba dispar
RNKDWEEI

SEQ ID NO: 2374060 - protein, 4 aa, Entamoeba dispar
RNKI

SEQ ID NO: 2374061 - protein, 15 aa, Entamoeba dispar
RNKKEGFPDNAVKTT

SEQ ID NO: 2374062 - protein, 37 aa, Entamoeba dispar
RNKQIFSDNEEQSLAPNEINNETPKTFGEIEEQPKRL

SEQ ID NO: 2374063 - protein, 5 aa, Entamoeba dispar
RNKST

SEQ ID NO: 2374064 - protein, 8 aa, Entamoeba dispar
RNKVNKSK

SEQ ID NO: 2374065 - protein, 9 aa, Entamoeba dispar
RNLPGDDMT

SEQ ID NO: 2374066 - protein, 4 aa, Entamoeba dispar
RNLT

SEQ ID NO: 2374067 - protein, 5 aa, Entamoeba dispar
RNNEL

SEQ ID NO: 2374068 - protein, 18 aa, Entamoeba dispar
RNNPQLLQDSSSTTSSSS

SEQ ID NO: 2374069 - protein, 7 aa, Entamoeba dispar
RNNSSYF

SEQ ID NO: 2374070 - protein, 7 aa, Entamoeba dispar
RNPEQSL

SEQ ID NO: 2374071 - protein, 7 aa, Entamoeba dispar
RNPSPEK

SEQ ID NO: 2374072 - protein, 5 aa, Entamoeba dispar
RNPTE

SEQ ID NO: 2374073 - protein, 7 aa, Entamoeba dispar
RNPYGRC

SEQ ID NO: 2374074 - protein, 5 aa, Entamoeba dispar
RNQKS

SEQ ID NO: 2374075 - protein, 5 aa, Entamoeba dispar
RNQKY

SEQ ID NO: 2374076 - protein, 5 aa, Entamoeba dispar
RNQLR

SEQ ID NO: 2374077 - protein, 7 aa, Entamoeba dispar
RNQLTNK

SEQ ID NO: 2374078 - protein, 7 aa, Entamoeba dispar
RNQNDIK

SEQ ID NO: 2374079 - protein, 17 aa, Entamoeba dispar
RNQTEETYSKEDRDKHN

SEQ ID NO: 2374080 - protein, 17 aa, Entamoeba dispar
RNQTSSISEDNKVTRKS

SEQ ID NO: 2374081 - protein, 24 aa, Entamoeba dispar
RNRRSLNSQPSSPFFTKDNGRPIT

SEQ ID NO: 2374082 - protein, 29 aa, Entamoeba dispar
RNRSGITRSEAKALRKKETNGKGHESVSD

SEQ ID NO: 2374083 - protein, 7 aa, Entamoeba dispar
RNSEQQQ

SEQ ID NO: 2374084 - protein, 9 aa, Entamoeba dispar
RNSKDGGVY

SEQ ID NO: 2374085 - protein, 4 aa, Entamoeba dispar
RNST

SEQ ID NO: 2374086 - protein, 7 aa, Entamoeba dispar
RNSTNLD

SEQ ID NO: 2374087 - protein, 4 aa, Entamoeba dispar
RNTC

SEQ ID NO: 2374088 - protein, 4 aa, Entamoeba dispar
RNTE

SEQ ID NO: 2374089 - protein, 8 aa, Entamoeba dispar
RNTEKYQR

SEQ ID NO: 2374090 - protein, 5 aa, Entamoeba dispar
RNTII

SEQ ID NO: 2374091 - protein, 8 aa, Entamoeba dispar
RNTKEKAQ

SEQ ID NO: 2374092 - protein, 6 aa, Entamoeba dispar
RNTLET

SEQ ID NO: 2374093 - protein, 4 aa, Entamoeba dispar
RNTN

SEQ ID NO: 2374094 - protein, 9 aa, Entamoeba dispar
RNTTLTKDN

SEQ ID NO: 2374095 - protein, 7 aa, Entamoeba dispar
RNVATGQ

SEQ ID NO: 2374096 - protein, 8 aa, Entamoeba dispar
RNVQQQFP

SEQ ID NO: 2374097 - protein, 5 aa, Entamoeba dispar
RNYCQ

SEQ ID NO: 2374098 - protein, 9 aa, Entamoeba dispar
RNYETVENE

SEQ ID NO: 2374099 - protein, 5 aa, Entamoeba dispar
RNYMT

SEQ ID NO: 2374100 - protein, 9 aa, Entamoeba dispar
RNYPIGEGE

SEQ ID NO: 2374101 - protein, 26 aa, Entamoeba dispar
RNYPSNSEKTQEHSESYSISEDYSDM

SEQ ID NO: 2374102 - protein, 8 aa, Entamoeba dispar
RNYTGNKV

SEQ ID NO: 2374103 - protein, 4 aa, Entamoeba dispar
RPAN

SEQ ID NO: 2374104 - protein, 7 aa, Entamoeba dispar
RPDIQSK

SEQ ID NO: 2374105 - protein, 10 aa, Entamoeba dispar
RPDSVYSNNN

SEQ ID NO: 2374106 - protein, 12 aa, Entamoeba dispar
RPEPLKSAQIKE

SEQ ID NO: 2374107 - protein, 6 aa, Entamoeba dispar
RPEQSD

SEQ ID NO: 2374108 - protein, 6 aa, Entamoeba dispar
RPERMA

SEQ ID NO: 2374109 - protein, 15 aa, Entamoeba dispar
RPERNSGRVKAATKC

SEQ ID NO: 2374110 - protein, 9 aa, Entamoeba dispar
RPERRSQKT

SEQ ID NO: 2374111 - protein, 11 aa, Entamoeba dispar
RPGEEKPSLDI

SEQ ID NO: 2374112 - protein, 6 aa, Entamoeba dispar
RPGVTT

SEQ ID NO: 2374113 - protein, 9 aa, Entamoeba dispar
RPIGEGKSV

SEQ ID NO: 2374114 - protein, 4 aa, Entamoeba dispar
RPKF

SEQ ID NO: 2374115 - protein, 12 aa, Entamoeba dispar
RPKKQKETTYPQ

SEQ ID NO: 2374116 - protein, 20 aa, Entamoeba dispar
RPLEIKTETKPSNQQTSISS

SEQ ID NO: 2374117 - protein, 24 aa, Entamoeba dispar
RPLPNRETQSMRNIPTSASFTKSQ

SEQ ID NO: 2374118 - protein, 6 aa, Entamoeba dispar
RPNPSK

SEQ ID NO: 2374119 - protein, 4 aa, Entamoeba dispar
RPPL

SEQ ID NO: 2374120 - protein, 7 aa, Entamoeba dispar
RPPPEGI

SEQ ID NO: 2374121 - protein, 5 aa, Entamoeba dispar
RPQDS

SEQ ID NO: 2374122 - protein, 20 aa, Entamoeba dispar
RPRKPQPASERKDVNSKSYK

SEQ ID NO: 2374123 - protein, 19 aa, Entamoeba dispar
RPRLNKPKNIQNKINDQEN

SEQ ID NO: 2374124 - protein, 9 aa, Entamoeba dispar
RPRNESNTY

SEQ ID NO: 2374125 - protein, 8 aa, Entamoeba dispar
RPRRTDDR

SEQ ID NO: 2374126 - protein, 5 aa, Entamoeba dispar
RPSGV

SEQ ID NO: 2374127 - protein, 4 aa, Entamoeba dispar
RPSI

SEQ ID NO: 2374128 - protein, 6 aa, Entamoeba dispar
RPSTIN

SEQ ID NO: 2374129 - protein, 21 aa, Entamoeba dispar
RPSTVNKNNPFDLSHSKTFED

SEQ ID NO: 2374130 - protein, 15 aa, Entamoeba dispar
RPSVEEQESLKETPT

SEQ ID NO: 2374131 - protein, 5 aa, Entamoeba dispar
RPTEY

SEQ ID NO: 2374132 - protein, 5 aa, Entamoeba dispar
RPTPM

SEQ ID NO: 2374133 - protein, 5 aa, Entamoeba dispar
RPYGE

SEQ ID NO: 2374134 - protein, 5 aa, Entamoeba dispar
RPYPE

SEQ ID NO: 2374135 - protein, 4 aa, Entamoeba dispar
RPYQ

SEQ ID NO: 2374136 - protein, 16 aa, Entamoeba dispar
RQAANLKREKGIYSKM

SEQ ID NO: 2374137 - protein, 8 aa, Entamoeba dispar
RQADGSGL

SEQ ID NO: 2374138 - protein, 18 aa, Entamoeba dispar
RQAISTKYQRIIKKLFDE

SEQ ID NO: 2374139 - protein, 10 aa, Entamoeba dispar
RQANDPSIYA

SEQ ID NO: 2374140 - protein, 8 aa, Entamoeba dispar
RQEAEKEK

SEQ ID NO: 2374141 - protein, 20 aa, Entamoeba dispar
RQEELPTQSKKQQKKEEEER

SEQ ID NO: 2374142 - protein, 6 aa, Entamoeba dispar
RQESHG

SEQ ID NO: 2374143 - protein, 14 aa, Entamoeba dispar
RQEYAQPSIKTPTI

SEQ ID NO: 2374144 - protein, 9 aa, Entamoeba dispar
RQFDNSDTC

SEQ ID NO: 2374145 - protein, 6 aa, Entamoeba dispar
RQFGDS

SEQ ID NO: 2374146 - protein, 4 aa, Entamoeba dispar
RQFP

SEQ ID NO: 2374147 - protein, 5 aa, Entamoeba dispar
RQGPN

SEQ ID NO: 2374148 - protein, 8 aa, Entamoeba dispar
RQKFKSKN

SEQ ID NO: 2374149 - protein, 7 aa, Entamoeba dispar
RQNANEL

SEQ ID NO: 2374150 - protein, 6 aa, Entamoeba dispar
RQNKNE

SEQ ID NO: 2374151 - protein, 6 aa, Entamoeba dispar
RQPLTS

SEQ ID NO: 2374152 - protein, 8 aa, Entamoeba dispar
RQPSLSHN

SEQ ID NO: 2374153 - protein, 6 aa, Entamoeba dispar
RQPTIP

SEQ ID NO: 2374154 - protein, 9 aa, Entamoeba dispar
RQPTKEEIC

SEQ ID NO: 2374155 - protein, 28 aa, Entamoeba dispar
RQQKQNTSIQQQQQQPSQTEIKEESPIA

SEQ ID NO: 2374156 - protein, 9 aa, Entamoeba dispar
RQRKDLKGV

SEQ ID NO: 2374157 - protein, 7 aa, Entamoeba dispar
RQRRSKE

SEQ ID NO: 2374158 - protein, 6 aa, Entamoeba dispar
RQRSRG

SEQ ID NO: 2374159 - protein, 10 aa, Entamoeba dispar
RQSRKTEKTI

SEQ ID NO: 2374160 - protein, 4 aa, Entamoeba dispar
RQSV

SEQ ID NO: 2374161 - protein, 5 aa, Entamoeba dispar
RQTID

SEQ ID NO: 2374162 - protein, 8 aa, Entamoeba dispar
RQTNVSDI

SEQ ID NO: 2374163 - protein, 25 aa, Entamoeba dispar
RQTRREIRKRKQDCNKNHEKEIEEE

SEQ ID NO: 2374164 - protein, 11 aa, Entamoeba dispar
RQTTFEGNKSK

SEQ ID NO: 2374165 - protein, 7 aa, Entamoeba dispar
RQTTPLN

SEQ ID NO: 2374166 - protein, 7 aa, Entamoeba dispar
RQVNQQK

SEQ ID NO: 2374167 - protein, 12 aa, Entamoeba dispar
RQVRGPSTLSCD

SEQ ID NO: 2374168 - protein, 5 aa, Entamoeba dispar
RQYGT

SEQ ID NO: 2374169 - protein, 7 aa, Entamoeba dispar
RQYNSSY

SEQ ID NO: 2374170 - protein, 4 aa, Entamoeba dispar
RRAE

SEQ ID NO: 2374171 - protein, 9 aa, Entamoeba dispar
RRDGSGLSP

SEQ ID NO: 2374172 - protein, 9 aa, Entamoeba dispar
RRDNETELP

SEQ ID NO: 2374173 - protein, 5 aa, Entamoeba dispar
RRDNY

SEQ ID NO: 2374174 - protein, 6 aa, Entamoeba dispar
RRDRNM

SEQ ID NO: 2374175 - protein, 5 aa, Entamoeba dispar
RREKG

SEQ ID NO: 2374176 - protein, 10 aa, Entamoeba dispar
RREPKKESWE

SEQ ID NO: 2374177 - protein, 7 aa, Entamoeba dispar
RRERDEQ

SEQ ID NO: 2374178 - protein, 9 aa, Entamoeba dispar
RRESGKGLY

SEQ ID NO: 2374179 - protein, 6 aa, Entamoeba dispar
RRESKL

SEQ ID NO: 2374180 - protein, 7 aa, Entamoeba dispar
RRETGSI

SEQ ID NO: 2374181 - protein, 4 aa, Entamoeba dispar
RREV

SEQ ID NO: 2374182 - protein, 6 aa, Entamoeba dispar
RREVPG

SEQ ID NO: 2374183 - protein, 10 aa, Entamoeba dispar
RRGEKSGEII

SEQ ID NO: 2374184 - protein, 8 aa, Entamoeba dispar
RRGNGGKY

SEQ ID NO: 2374185 - protein, 12 aa, Entamoeba dispar
RRGYKKRATLKR

SEQ ID NO: 2374186 - protein, 9 aa, Entamoeba dispar
RRKHNSKVE

SEQ ID NO: 2374187 - protein, 6 aa, Entamoeba dispar
RRKITT

SEQ ID NO: 2374188 - protein, 9 aa, Entamoeba dispar
RRLNSPNKT

SEQ ID NO: 2374189 - protein, 9 aa, Entamoeba dispar
RRMTPQERS

SEQ ID NO: 2374190 - protein, 15 aa, Entamoeba dispar
RRNAKRLNREEHPPT

SEQ ID NO: 2374191 - protein, 5 aa, Entamoeba dispar
RRNDI

SEQ ID NO: 2374192 - protein, 7 aa, Entamoeba dispar
RRPERAK

SEQ ID NO: 2374193 - protein, 13 aa, Entamoeba dispar
RRQAKRADPTNQD

SEQ ID NO: 2374194 - protein, 6 aa, Entamoeba dispar
RRQNQV

SEQ ID NO: 2374195 - protein, 15 aa, Entamoeba dispar
RRRREKIEKPEKDYE

SEQ ID NO: 2374196 - protein, 26 aa, Entamoeba dispar
RRRSESYSSDYSPRPRRSRWDEKPTV

SEQ ID NO: 2374197 - protein, 7 aa, Entamoeba dispar
RRSEEKE

SEQ ID NO: 2374198 - protein, 23 aa, Entamoeba dispar
RRSNKEAAYSQLEDGEKVAEKQA

SEQ ID NO: 2374199 - protein, 16 aa, Entamoeba dispar
RRSRDITPTQQEQHET

SEQ ID NO: 2374200 - protein, 8 aa, Entamoeba dispar
RRSTEKDD

SEQ ID NO: 2374201 - protein, 8 aa, Entamoeba dispar
RRSTKEDD

SEQ ID NO: 2374202 - protein, 5 aa, Entamoeba dispar
RRSVE

SEQ ID NO: 2374203 - protein, 7 aa, Entamoeba dispar
RRTNNEI

SEQ ID NO: 2374204 - protein, 14 aa, Entamoeba dispar
RRTVNRKPSDNQHF

SEQ ID NO: 2374205 - protein, 9 aa, Entamoeba dispar
RRTVRQNSV

SEQ ID NO: 2374206 - protein, 7 aa, Entamoeba dispar
RRVTSRL

SEQ ID NO: 2374207 - protein, 8 aa, Entamoeba dispar
RRYKKNIS

SEQ ID NO: 2374208 - protein, 10 aa, Entamoeba dispar
RRYKPNGSVS

SEQ ID NO: 2374209 - protein, 7 aa, Entamoeba dispar
RRYRESM

SEQ ID NO: 2374210 - protein, 17 aa, Entamoeba dispar
RSAGTNDITIFHIKPLE

SEQ ID NO: 2374211 - protein, 19 aa, Entamoeba dispar
RSAPLNDSWTKTNNLCSDT

SEQ ID NO: 2374212 - protein, 13 aa, Entamoeba dispar
RSCQDKNEEIEKK

SEQ ID NO: 2374213 - protein, 7 aa, Entamoeba dispar
RSDEIDI

SEQ ID NO: 2374214 - protein, 9 aa, Entamoeba dispar
RSDESGSKM

SEQ ID NO: 2374215 - protein, 5 aa, Entamoeba dispar
RSDGN

SEQ ID NO: 2374216 - protein, 7 aa, Entamoeba dispar
RSDITGG

SEQ ID NO: 2374217 - protein, 11 aa, Entamoeba dispar
RSDQRKKHNIQ

SEQ ID NO: 2374218 - protein, 6 aa, Entamoeba dispar
RSDSLD

SEQ ID NO: 2374219 - protein, 13 aa, Entamoeba dispar
RSDSRTKTKVAPI

SEQ ID NO: 2374220 - protein, 13 aa, Entamoeba dispar
RSEGFNIEGHTKD

SEQ ID NO: 2374221 - protein, 7 aa, Entamoeba dispar
RSEGSVS

SEQ ID NO: 2374222 - protein, 5 aa, Entamoeba dispar
RSEIP

SEQ ID NO: 2374223 - protein, 7 aa, Entamoeba dispar
RSELTNE

SEQ ID NO: 2374224 - protein, 4 aa, Entamoeba dispar
RSEN

SEQ ID NO: 2374225 - protein, 5 aa, Entamoeba dispar
RSEQT

SEQ ID NO: 2374226 - protein, 6 aa, Entamoeba dispar
RSEQTV

SEQ ID NO: 2374227 - protein, 4 aa, Entamoeba dispar
RSER

SEQ ID NO: 2374228 - protein, 6 aa, Entamoeba dispar
RSERSY

SEQ ID NO: 2374229 - protein, 7 aa, Entamoeba dispar
RSESHKI

SEQ ID NO: 2374230 - protein, 4 aa, Entamoeba dispar
RSFS

SEQ ID NO: 2374231 - protein, 15 aa, Entamoeba dispar
RSGEIGRQMLRKTTS

SEQ ID NO: 2374232 - protein, 33 aa, Entamoeba dispar
RSGNAQFLGGRNRSNLMTSSESNNNTGRSTEDD

SEQ ID NO: 2374233 - protein, 5 aa, Entamoeba dispar
RSGST

SEQ ID NO: 2374234 - protein, 4 aa, Entamoeba dispar
RSHG

SEQ ID NO: 2374235 - protein, 8 aa, Entamoeba dispar
RSIETKNK

SEQ ID NO: 2374236 - protein, 6 aa, Entamoeba dispar
RSIPTT

SEQ ID NO: 2374237 - protein, 13 aa, Entamoeba dispar
RSKGVNENDLVQF

SEQ ID NO: 2374238 - protein, 7 aa, Entamoeba dispar
RSKKEYE

SEQ ID NO: 2374239 - protein, 8 aa, Entamoeba dispar
RSKRRGIR

SEQ ID NO: 2374240 - protein, 9 aa, Entamoeba dispar
RSKTLEEDN

SEQ ID NO: 2374241 - protein, 6 aa, Entamoeba dispar
RSLQNK

SEQ ID NO: 2374242 - protein, 10 aa, Entamoeba dispar
RSLTGTINAD

SEQ ID NO: 2374243 - protein, 4 aa, Entamoeba dispar
RSND

SEQ ID NO: 2374244 - protein, 7 aa, Entamoeba dispar
RSNEFGD

SEQ ID NO: 2374245 - protein, 4 aa, Entamoeba dispar
RSNK

SEQ ID NO: 2374246 - protein, 12 aa, Entamoeba dispar
RSNKDRDEYKED

SEQ ID NO: 2374247 - protein, 7 aa, Entamoeba dispar
RSNNENV

SEQ ID NO: 2374248 - protein, 6 aa, Entamoeba dispar
RSNPNY

SEQ ID NO: 2374249 - protein, 7 aa, Entamoeba dispar
RSNPTKL

SEQ ID NO: 2374250 - protein, 6 aa, Entamoeba dispar
RSNQKF

SEQ ID NO: 2374251 - protein, 19 aa, Entamoeba dispar
RSNQKFQQALERSKRRGIR

SEQ ID NO: 2374252 - protein, 20 aa, Entamoeba dispar
RSNQKFQQALERSKRRGIRD

SEQ ID NO: 2374253 - protein, 7 aa, Entamoeba dispar
RSNQRQS

SEQ ID NO: 2374254 - protein, 7 aa, Entamoeba dispar
RSNQRVG

SEQ ID NO: 2374255 - protein, 6 aa, Entamoeba dispar
RSPDLP

SEQ ID NO: 2374256 - protein, 8 aa, Entamoeba dispar
RSPNDYKS

SEQ ID NO: 2374257 - protein, 18 aa, Entamoeba dispar
RSPQVDQLKQRSKPSLTL

SEQ ID NO: 2374258 - protein, 30 aa, Entamoeba dispar
RSPYSYTDERKTEVTKGEGENNKGEESIPA

SEQ ID NO: 2374259 - protein, 5 aa, Entamoeba dispar
RSQAE

SEQ ID NO: 2374260 - protein, 5 aa, Entamoeba dispar
RSQEL

SEQ ID NO: 2374261 - protein, 6 aa, Entamoeba dispar
RSQGDY

SEQ ID NO: 2374262 - protein, 15 aa, Entamoeba dispar
RSQNPEEERKSVDKE

SEQ ID NO: 2374263 - protein, 6 aa, Entamoeba dispar
RSQSPS

SEQ ID NO: 2374264 - protein, 12 aa, Entamoeba dispar
RSQYPGEQDSSN

SEQ ID NO: 2374265 - protein, 5 aa, Entamoeba dispar
RSRGN

SEQ ID NO: 2374266 - protein, 11 aa, Entamoeba dispar
RSRNSLNSQPQ

SEQ ID NO: 2374267 - protein, 12 aa, Entamoeba dispar
RSRSSKRPSFNE

SEQ ID NO: 2374268 - protein, 6 aa, Entamoeba dispar
RSSAEI

SEQ ID NO: 2374269 - protein, 9 aa, Entamoeba dispar
RSSCSGPDS

SEQ ID NO: 2374270 - protein, 8 aa, Entamoeba dispar
RSSDGTIK

SEQ ID NO: 2374271 - protein, 10 aa, Entamoeba dispar
RSSDNTNGEC

SEQ ID NO: 2374272 - protein, 5 aa, Entamoeba dispar
RSSEH

SEQ ID NO: 2374273 - protein, 5 aa, Entamoeba dispar
RSSGV

SEQ ID NO: 2374274 - protein, 6 aa, Entamoeba dispar
RSSHPD

SEQ ID NO: 2374275 - protein, 7 aa, Entamoeba dispar
RSSIERK

SEQ ID NO: 2374276 - protein, 9 aa, Entamoeba dispar
RSSIGKTTI

SEQ ID NO: 2374277 - protein, 5 aa, Entamoeba dispar
RSSLI

SEQ ID NO: 2374278 - protein, 9 aa, Entamoeba dispar
RSSQPTRYE

SEQ ID NO: 2374279 - protein, 9 aa, Entamoeba dispar
RSSSGAEGL

SEQ ID NO: 2374280 - protein, 26 aa, Entamoeba dispar
RSSSHHSHGSSRNSSSIKESSSFPTR

SEQ ID NO: 2374281 - protein, 31 aa, Entamoeba dispar
RSSSTPLTPKEIKPQNDKIINNENEKNDIQS

SEQ ID NO: 2374282 - protein, 55 aa, Entamoeba dispar
RSSTLENELGNTGKRNTNTTKKQEEEKKDNFSEKSQSNSSADSSIEEFDGKLETI

SEQ ID NO: 2374283 - protein, 7 aa, Entamoeba dispar
RSSTSQF

SEQ ID NO: 2374284 - protein, 29 aa, Entamoeba dispar
RSSVTPRMSNEYESKDAFETQIKPTKSTI

SEQ ID NO: 2374285 - protein, 13 aa, Entamoeba dispar
RSSYTCDSCNPGY

SEQ ID NO: 2374286 - protein, 10 aa, Entamoeba dispar
RSTDGKEHNC

SEQ ID NO: 2374287 - protein, 4 aa, Entamoeba dispar
RSTI

SEQ ID NO: 2374288 - protein, 12 aa, Entamoeba dispar
RSTNDSSTVSEW

SEQ ID NO: 2374289 - protein, 5 aa, Entamoeba dispar
RSTPI

SEQ ID NO: 2374290 - protein, 12 aa, Entamoeba dispar
RSTSAKSDEEKL

SEQ ID NO: 2374291 - protein, 9 aa, Entamoeba dispar
RSTSGYEGV

SEQ ID NO: 2374292 - protein, 5 aa, Entamoeba dispar
RSVDD

SEQ ID NO: 2374293 - protein, 9 aa, Entamoeba dispar
RSVKAETAA

SEQ ID NO: 2374294 - protein, 5 aa, Entamoeba dispar
RSVQL

SEQ ID NO: 2374295 - protein, 8 aa, Entamoeba dispar
RSVSPSNK

SEQ ID NO: 2374296 - protein, 13 aa, Entamoeba dispar
RSYQTQSSSEGTV

SEQ ID NO: 2374297 - protein, 5 aa, Entamoeba dispar
RSYRN

SEQ ID NO: 2374298 - protein, 23 aa, Entamoeba dispar
RTASSTQASYSVAGGIASETISN

SEQ ID NO: 2374299 - protein, 8 aa, Entamoeba dispar
RTCSIDAE

SEQ ID NO: 2374300 - protein, 7 aa, Entamoeba dispar
RTDEKGA

SEQ ID NO: 2374301 - protein, 9 aa, Entamoeba dispar
RTDGCNECN

SEQ ID NO: 2374302 - protein, 22 aa, Entamoeba dispar
RTDNNPAQYNPGYGYYNPQQYR

SEQ ID NO: 2374303 - protein, 6 aa, Entamoeba dispar
RTDSGH

SEQ ID NO: 2374304 - protein, 7 aa, Entamoeba dispar
RTEEFTT

SEQ ID NO: 2374305 - protein, 5 aa, Entamoeba dispar
RTEEQ

SEQ ID NO: 2374306 - protein, 6 aa, Entamoeba dispar
RTEKEG

SEQ ID NO: 2374307 - protein, 7 aa, Entamoeba dispar
RTENLEY

SEQ ID NO: 2374308 - protein, 11 aa, Entamoeba dispar
RTENNSTFSKE

SEQ ID NO: 2374309 - protein, 14 aa, Entamoeba dispar
RTERIQKQLKEINQ

SEQ ID NO: 2374310 - protein, 12 aa, Entamoeba dispar
RTETKEQYPFNQ

SEQ ID NO: 2374311 - protein, 13 aa, Entamoeba dispar
RTFPNDPQMTEDK

SEQ ID NO: 2374312 - protein, 15 aa, Entamoeba dispar
RTGAMSGKLANKGGV

SEQ ID NO: 2374313 - protein, 5 aa, Entamoeba dispar
RTGKL

SEQ ID NO: 2374314 - protein, 7 aa, Entamoeba dispar
RTHDGMD

SEQ ID NO: 2374315 - protein, 4 aa, Entamoeba dispar
RTHE

SEQ ID NO: 2374316 - protein, 6 aa, Entamoeba dispar
RTIDGT

SEQ ID NO: 2374317 - protein, 7 aa, Entamoeba dispar
RTIPSYS

SEQ ID NO: 2374318 - protein, 11 aa, Entamoeba dispar
RTKETTGTEES

SEQ ID NO: 2374319 - protein, 7 aa, Entamoeba dispar
RTKTKSL

SEQ ID NO: 2374320 - protein, 12 aa, Entamoeba dispar
RTKVADSSKPNI

SEQ ID NO: 2374321 - protein, 8 aa, Entamoeba dispar
RTLGDTEL

SEQ ID NO: 2374322 - protein, 16 aa, Entamoeba dispar
RTLNESPKRNTKIQLP

SEQ ID NO: 2374323 - protein, 10 aa, Entamoeba dispar
RTNGGDNYKC

SEQ ID NO: 2374324 - protein, 10 aa, Entamoeba dispar
RTNKPTEMLN

SEQ ID NO: 2374325 - protein, 5 aa, Entamoeba dispar
RTNSD

SEQ ID NO: 2374326 - protein, 5 aa, Entamoeba dispar
RTPDV

SEQ ID NO: 2374327 - protein, 8 aa, Entamoeba dispar
RTPGSQEW

SEQ ID NO: 2374328 - protein, 11 aa, Entamoeba dispar
RTPIPSTTQPI

SEQ ID NO: 2374329 - protein, 8 aa, Entamoeba dispar
RTPKGETK

SEQ ID NO: 2374330 - protein, 4 aa, Entamoeba dispar
RTQE

SEQ ID NO: 2374331 - protein, 8 aa, Entamoeba dispar
RTQNVPSA

SEQ ID NO: 2374332 - protein, 14 aa, Entamoeba dispar
RTQRMQDQLNEISH

SEQ ID NO: 2374333 - protein, 5 aa, Entamoeba dispar
RTQRN

SEQ ID NO: 2374334 - protein, 13 aa, Entamoeba dispar
RTRISKKYQGSFP

SEQ ID NO: 2374335 - protein, 10 aa, Entamoeba dispar
RTRPQPCDSI

SEQ ID NO: 2374336 - protein, 12 aa, Entamoeba dispar
RTSCERYAEGGQ

SEQ ID NO: 2374337 - protein, 24 aa, Entamoeba dispar
RTSNDKAFVGNRADTAFEQDERYS

SEQ ID NO: 2374338 - protein, 4 aa, Entamoeba dispar
RTSS

SEQ ID NO: 2374339 - protein, 11 aa, Entamoeba dispar
RTSTEKQTEIT

SEQ ID NO: 2374340 - protein, 5 aa, Entamoeba dispar
RTTES

SEQ ID NO: 2374341 - protein, 4 aa, Entamoeba dispar
RTTF

SEQ ID NO: 2374342 - protein, 10 aa, Entamoeba dispar
RTTIKKEKNE

SEQ ID NO: 2374343 - protein, 5 aa, Entamoeba dispar
RTTLQ

SEQ ID NO: 2374344 - protein, 5 aa, Entamoeba dispar
RTTLS

SEQ ID NO: 2374345 - protein, 8 aa, Entamoeba dispar
RTTLTTKK

SEQ ID NO: 2374346 - protein, 7 aa, Entamoeba dispar
RTTPECS

SEQ ID NO: 2374347 - protein, 7 aa, Entamoeba dispar
RTTPNYS

SEQ ID NO: 2374348 - protein, 7 aa, Entamoeba dispar
RTTSTFP

SEQ ID NO: 2374349 - protein, 7 aa, Entamoeba dispar
RTTYSNS

SEQ ID NO: 2374350 - protein, 35 aa, Entamoeba dispar
RVAKKKTTIFGSNSTKNTFNDPNKSSDSSDELKPE

SEQ ID NO: 2374351 - protein, 5 aa, Entamoeba dispar
RVDAG

SEQ ID NO: 2374352 - protein, 5 aa, Entamoeba dispar
RVDSG

SEQ ID NO: 2374353 - protein, 8 aa, Entamoeba dispar
RVEESRQK

SEQ ID NO: 2374354 - protein, 15 aa, Entamoeba dispar
RVEEVKKQQEKQKKY

SEQ ID NO: 2374355 - protein, 10 aa, Entamoeba dispar
RVGPKRLKEK

SEQ ID NO: 2374356 - protein, 24 aa, Entamoeba dispar
RVGTKALESFTSNKNADASKSVEE

SEQ ID NO: 2374357 - protein, 11 aa, Entamoeba dispar
RVKKGNRSGCK

SEQ ID NO: 2374358 - protein, 7 aa, Entamoeba dispar
RVLDGKK

SEQ ID NO: 2374359 - protein, 24 aa, Entamoeba dispar
RVNDSRSYDHSQNDNEGVVQQPRR

SEQ ID NO: 2374360 - protein, 6 aa, Entamoeba dispar
RVNQTD

SEQ ID NO: 2374361 - protein, 8 aa, Entamoeba dispar
RVNRDQEE

SEQ ID NO: 2374362 - protein, 4 aa, Entamoeba dispar
RVNS

SEQ ID NO: 2374363 - protein, 9 aa, Entamoeba dispar
RVPEKRSYK

SEQ ID NO: 2374364 - protein, 8 aa, Entamoeba dispar
RVPTQNFS

SEQ ID NO: 2374365 - protein, 10 aa, Entamoeba dispar
RVRDSEDGEF

SEQ ID NO: 2374366 - protein, 6 aa, Entamoeba dispar
RVSPNT

SEQ ID NO: 2374367 - protein, 8 aa, Entamoeba dispar
RVSSSSRL

SEQ ID NO: 2374368 - protein, 8 aa, Entamoeba dispar
RVTPQQKE

SEQ ID NO: 2374369 - protein, 9 aa, Entamoeba dispar
RVTRKQGTT

SEQ ID NO: 2374370 - protein, 7 aa, Entamoeba dispar
RVYPDGK

SEQ ID NO: 2374371 - protein, 7 aa, Entamoeba dispar
RWENPSM

SEQ ID NO: 2374372 - protein, 7 aa, Entamoeba dispar
RWTPNKH

SEQ ID NO: 2374373 - protein, 5 aa, Entamoeba dispar
RYATD

SEQ ID NO: 2374374 - protein, 6 aa, Entamoeba dispar
RYDKTT

SEQ ID NO: 2374375 - protein, 5 aa, Entamoeba dispar
RYDNY

SEQ ID NO: 2374376 - protein, 13 aa, Entamoeba dispar
RYENGRNGKFSVS

SEQ ID NO: 2374377 - protein, 5 aa, Entamoeba dispar
RYETQ

SEQ ID NO: 2374378 - protein, 4 aa, Entamoeba dispar
RYGE

SEQ ID NO: 2374379 - protein, 7 aa, Entamoeba dispar
RYGEPSV

SEQ ID NO: 2374380 - protein, 7 aa, Entamoeba dispar
RYGSYGS

SEQ ID NO: 2374381 - protein, 7 aa, Entamoeba dispar
RYGTNES

SEQ ID NO: 2374382 - protein, 4 aa, Entamoeba dispar
RYIP

SEQ ID NO: 2374383 - protein, 7 aa, Entamoeba dispar
RYKDDTA

SEQ ID NO: 2374384 - protein, 15 aa, Entamoeba dispar
RYKSTDFDEERKRRN

SEQ ID NO: 2374385 - protein, 8 aa, Entamoeba dispar
RYNERSKS

SEQ ID NO: 2374386 - protein, 10 aa, Entamoeba dispar
RYPRNENGEI

SEQ ID NO: 2374387 - protein, 17 aa, Entamoeba dispar
RYPSDLDRSVSISTNNL

SEQ ID NO: 2374388 - protein, 8 aa, Entamoeba dispar
RYSEEENK

SEQ ID NO: 2374389 - protein, 5 aa, Entamoeba dispar
RYSHQ

SEQ ID NO: 2374390 - protein, 12 aa, Entamoeba dispar
RYTANKQREKEF

SEQ ID NO: 2374391 - protein, 6 aa, Entamoeba dispar
RYTGTN

SEQ ID NO: 2374392 - protein, 23 aa, Entamoeba dispar
RYTLNNKKCSKKEKNQNGKNEEI

SEQ ID NO: 2374393 - protein, 10 aa, Entamoeba dispar
RYTTNKCTTC

SEQ ID NO: 2374394 - protein, 7 aa, Entamoeba dispar
SAASPVA

SEQ ID NO: 2374395 - protein, 8 aa, Entamoeba dispar
SACREPNS

SEQ ID NO: 2374396 - protein, 9 aa, Entamoeba dispar
SADDRDALK

SEQ ID NO: 2374397 - protein, 12 aa, Entamoeba dispar
SADGFKSSATRL

SEQ ID NO: 2374398 - protein, 13 aa, Entamoeba dispar
SADGGCPGNVGDV

SEQ ID NO: 2374399 - protein, 10 aa, Entamoeba dispar
SADGKCQECS

SEQ ID NO: 2374400 - protein, 25 aa, Entamoeba dispar
SADGLEQECTSCDKSCDTCEKNDSC

SEQ ID NO: 2374401 - protein, 6 aa, Entamoeba dispar
SADGNL

SEQ ID NO: 2374402 - protein, 6 aa, Entamoeba dispar
SADRSI

SEQ ID NO: 2374403 - protein, 8 aa, Entamoeba dispar
SADTSSNM

SEQ ID NO: 2374404 - protein, 4 aa, Entamoeba dispar
SAED

SEQ ID NO: 2374405 - protein, 9 aa, Entamoeba dispar
SAEEDTKTY

SEQ ID NO: 2374406 - protein, 4 aa, Entamoeba dispar
SAEF

SEQ ID NO: 2374407 - protein, 7 aa, Entamoeba dispar
SAEINRK

SEQ ID NO: 2374408 - protein, 7 aa, Entamoeba dispar
SAERETV

SEQ ID NO: 2374409 - protein, 6 aa, Entamoeba dispar
SAETEN

SEQ ID NO: 2374410 - protein, 8 aa, Entamoeba dispar
SAETRNYY

SEQ ID NO: 2374411 - protein, 20 aa, Entamoeba dispar
SAFEEEEKKEDEKSKSIKQL

SEQ ID NO: 2374412 - protein, 7 aa, Entamoeba dispar
SAGGGGE

SEQ ID NO: 2374413 - protein, 5 aa, Entamoeba dispar
SAGGI

SEQ ID NO: 2374414 - protein, 8 aa, Entamoeba dispar
SAGISSEA

SEQ ID NO: 2374415 - protein, 15 aa, Entamoeba dispar
SAGSPDATSELDEGV

SEQ ID NO: 2374416 - protein, 6 aa, Entamoeba dispar
SAGVGQ

SEQ ID NO: 2374417 - protein, 5 aa, Entamoeba dispar
SAHAK

SEQ ID NO: 2374418 - protein, 5 aa, Entamoeba dispar
SAHPT

SEQ ID NO: 2374419 - protein, 5 aa, Entamoeba dispar
SAKDL

SEQ ID NO: 2374420 - protein, 12 aa, Entamoeba dispar
SAKGSGNGIKER

SEQ ID NO: 2374421 - protein, 6 aa, Entamoeba dispar
SAKKIE

SEQ ID NO: 2374422 - protein, 9 aa, Entamoeba dispar
SAKNQDGDA

SEQ ID NO: 2374423 - protein, 44 aa, Entamoeba dispar
SAKQLKNKQRNPIGRNTDSLRKEKGNKKSIGKEKISEQKKSVPQ

SEQ ID NO: 2374424 - protein, 5 aa, Entamoeba dispar
SAKRR

SEQ ID NO: 2374425 - protein, 8 aa, Entamoeba dispar
SAKSKEDV

SEQ ID NO: 2374426 - protein, 11 aa, Entamoeba dispar
SALGSSTHRLS

SEQ ID NO: 2374427 - protein, 5 aa, Entamoeba dispar
SALPA

SEQ ID NO: 2374428 - protein, 6 aa, Entamoeba dispar
SALPRA

SEQ ID NO: 2374429 - protein, 6 aa, Entamoeba dispar
SALPSE

SEQ ID NO: 2374430 - protein, 4 aa, Entamoeba dispar
SALR

SEQ ID NO: 2374431 - protein, 8 aa, Entamoeba dispar
SALSTKID

SEQ ID NO: 2374432 - protein, 8 aa, Entamoeba dispar
SALSTKLD

SEQ ID NO: 2374433 - protein, 7 aa, Entamoeba dispar
SANGGTN

SEQ ID NO: 2374434 - protein, 5 aa, Entamoeba dispar
SANIV

SEQ ID NO: 2374435 - protein, 13 aa, Entamoeba dispar
SANKKVAKEYGDY

SEQ ID NO: 2374436 - protein, 6 aa, Entamoeba dispar
SANTQQ

SEQ ID NO: 2374437 - protein, 8 aa, Entamoeba dispar
SAPIDNRR

SEQ ID NO: 2374438 - protein, 9 aa, Entamoeba dispar
SAPRCEETN

SEQ ID NO: 2374439 - protein, 23 aa, Entamoeba dispar
SAPSTSDSTPQTPSSNRSSQEEI

SEQ ID NO: 2374440 - protein, 10 aa, Entamoeba dispar
SAPTSSGKTL

SEQ ID NO: 2374441 - protein, 7 aa, Entamoeba dispar
SAQNCNN

SEQ ID NO: 2374442 - protein, 10 aa, Entamoeba dispar
SAQPPDTSNL

SEQ ID NO: 2374443 - protein, 14 aa, Entamoeba dispar
SAQQKKYQTHSKTF

SEQ ID NO: 2374444 - protein, 5 aa, Entamoeba dispar
SAQTN

SEQ ID NO: 2374445 - protein, 8 aa, Entamoeba dispar
SARDSGNM

SEQ ID NO: 2374446 - protein, 12 aa, Entamoeba dispar
SAREKGNGRIQH

SEQ ID NO: 2374447 - protein, 6 aa, Entamoeba dispar
SARKRM

SEQ ID NO: 2374448 - protein, 8 aa, Entamoeba dispar
SARSETKY

SEQ ID NO: 2374449 - protein, 7 aa, Entamoeba dispar
SARTSWE

SEQ ID NO: 2374450 - protein, 8 aa, Entamoeba dispar
SASENRGS

SEQ ID NO: 2374451 - protein, 12 aa, Entamoeba dispar
SASEQETENEKD

SEQ ID NO: 2374452 - protein, 4 aa, Entamoeba dispar
SASF

SEQ ID NO: 2374453 - protein, 4 aa, Entamoeba dispar
SASG

SEQ ID NO: 2374454 - protein, 6 aa, Entamoeba dispar
SASHEV

SEQ ID NO: 2374455 - protein, 19 aa, Entamoeba dispar
SASKRKNYLKQYKNDSSFS

SEQ ID NO: 2374456 - protein, 17 aa, Entamoeba dispar
SASLSRSNSISPHSKSL

SEQ ID NO: 2374457 - protein, 8 aa, Entamoeba dispar
SASQQPQL

SEQ ID NO: 2374458 - protein, 7 aa, Entamoeba dispar
SASRSPI

SEQ ID NO: 2374459 - protein, 14 aa, Entamoeba dispar
SASRTTTGNSAVEG

SEQ ID NO: 2374460 - protein, 4 aa, Entamoeba dispar
SATE

SEQ ID NO: 2374461 - protein, 6 aa, Entamoeba dispar
SATEET

SEQ ID NO: 2374462 - protein, 19 aa, Entamoeba dispar
SATHSPPVKSKSPSIPKEI

SEQ ID NO: 2374463 - protein, 26 aa, Entamoeba dispar
SATLGSSTKIENLKTTNKASFSNSLS

SEQ ID NO: 2374464 - protein, 7 aa, Entamoeba dispar
SATLTDT

SEQ ID NO: 2374465 - protein, 7 aa, Entamoeba dispar
SATNPIT

SEQ ID NO: 2374466 - protein, 7 aa, Entamoeba dispar
SATPSYF

SEQ ID NO: 2374467 - protein, 9 aa, Entamoeba dispar
SATSAGTCA

SEQ ID NO: 2374468 - protein, 7 aa, Entamoeba dispar
SATTSFA

SEQ ID NO: 2374469 - protein, 5 aa, Entamoeba dispar
SATTY

SEQ ID NO: 2374470 - protein, 6 aa, Entamoeba dispar
SAVGRL

SEQ ID NO: 2374471 - protein, 5 aa, Entamoeba dispar
SAVSN

SEQ ID NO: 2374472 - protein, 4 aa, Entamoeba dispar
SAYT

SEQ ID NO: 2374473 - protein, 5 aa, Entamoeba dispar
SCDEA

SEQ ID NO: 2374474 - protein, 11 aa, Entamoeba dispar
SCEKGKGGAAH

SEQ ID NO: 2374475 - protein, 9 aa, Entamoeba dispar
SCESSEEVE

SEQ ID NO: 2374476 - protein, 12 aa, Entamoeba dispar
SCETKTNQNTCL

SEQ ID NO: 2374477 - protein, 10 aa, Entamoeba dispar
SCGDETTQLT

SEQ ID NO: 2374478 - protein, 4 aa, Entamoeba dispar
SCGF

SEQ ID NO: 2374479 - protein, 4 aa, Entamoeba dispar
SCGN

SEQ ID NO: 2374480 - protein, 20 aa, Entamoeba dispar
SCGNGINDNDEEECDGGEYC

SEQ ID NO: 2374481 - protein, 15 aa, Entamoeba dispar
SCGPSTLKKSASGII

SEQ ID NO: 2374482 - protein, 9 aa, Entamoeba dispar
SCKDSGEDT

SEQ ID NO: 2374483 - protein, 44 aa, Entamoeba dispar
SCKTNQSTGTDSSSSSQILTSSSSEDDGDNDKTEQQTIPKQPKD

SEQ ID NO: 2374484 - protein, 6 aa, Entamoeba dispar
SCLGEK

SEQ ID NO: 2374485 - protein, 14 aa, Entamoeba dispar
SCLTPSQGSGDVAL

SEQ ID NO: 2374486 - protein, 21 aa, Entamoeba dispar
SCNECEDGYEWNGSTCTQPVP

SEQ ID NO: 2374487 - protein, 6 aa, Entamoeba dispar
SCNENG

SEQ ID NO: 2374488 - protein, 6 aa, Entamoeba dispar
SCNNNK

SEQ ID NO: 2374489 - protein, 4 aa, Entamoeba dispar
SCNS

SEQ ID NO: 2374490 - protein, 8 aa, Entamoeba dispar
SCNSQECT

SEQ ID NO: 2374491 - protein, 7 aa, Entamoeba dispar
SCNSTTG

SEQ ID NO: 2374492 - protein, 9 aa, Entamoeba dispar
SCPNNKDEC

SEQ ID NO: 2374493 - protein, 9 aa, Entamoeba dispar
SCPSGPSVN

SEQ ID NO: 2374494 - protein, 9 aa, Entamoeba dispar
SCQPPYKLN

SEQ ID NO: 2374495 - protein, 6 aa, Entamoeba dispar
SCQSPI

SEQ ID NO: 2374496 - protein, 6 aa, Entamoeba dispar
SCRSKP

SEQ ID NO: 2374497 - protein, 18 aa, Entamoeba dispar
SCSDSTSSSSDLTGDYTK

SEQ ID NO: 2374498 - protein, 27 aa, Entamoeba dispar
SCSEDNPTAKCVATGSKSCGNGDTYHS

SEQ ID NO: 2374499 - protein, 7 aa, Entamoeba dispar
SCSGDKC

SEQ ID NO: 2374500 - protein, 8 aa, Entamoeba dispar
SCSGPDSC

SEQ ID NO: 2374501 - protein, 5 aa, Entamoeba dispar
SCSIS

SEQ ID NO: 2374502 - protein, 5 aa, Entamoeba dispar
SCSKG

SEQ ID NO: 2374503 - protein, 6 aa, Entamoeba dispar
SCSNEN

SEQ ID NO: 2374504 - protein, 7 aa, Entamoeba dispar
SCSNSNK

SEQ ID NO: 2374505 - protein, 7 aa, Entamoeba dispar
SCSNTQA

SEQ ID NO: 2374506 - protein, 6 aa, Entamoeba dispar
SCSQND

SEQ ID NO: 2374507 - protein, 11 aa, Entamoeba dispar
SCSSSKATCSR

SEQ ID NO: 2374508 - protein, 5 aa, Entamoeba dispar
SCSVE

SEQ ID NO: 2374509 - protein, 4 aa, Entamoeba dispar
SCTS

SEQ ID NO: 2374510 - protein, 5 aa, Entamoeba dispar
SCTSC

SEQ ID NO: 2374511 - protein, 6 aa, Entamoeba dispar
SCTSNG

SEQ ID NO: 2374512 - protein, 16 aa, Entamoeba dispar
SCVGANDGDPNGLCDG

SEQ ID NO: 2374513 - protein, 14 aa, Entamoeba dispar
SDAEDEDIVPRSPT

SEQ ID NO: 2374514 - protein, 7 aa, Entamoeba dispar
SDAIGNP

SEQ ID NO: 2374515 - protein, 7 aa, Entamoeba dispar
SDAPDGE

SEQ ID NO: 2374516 - protein, 11 aa, Entamoeba dispar
SDARSKTDIEE

SEQ ID NO: 2374517 - protein, 6 aa, Entamoeba dispar
SDCKKT

SEQ ID NO: 2374518 - protein, 13 aa, Entamoeba dispar
SDCSKIDKNKPIG

SEQ ID NO: 2374519 - protein, 10 aa, Entamoeba dispar
SDDADSLNDE

SEQ ID NO: 2374520 - protein, 9 aa, Entamoeba dispar
SDDDTVIDE

SEQ ID NO: 2374521 - protein, 8 aa, Entamoeba dispar
SDDECKNV

SEQ ID NO: 2374522 - protein, 13 aa, Entamoeba dispar
SDDEEINEDSTTQ

SEQ ID NO: 2374523 - protein, 10 aa, Entamoeba dispar
SDDEKQTYNK

SEQ ID NO: 2374524 - protein, 10 aa, Entamoeba dispar
SDDGNDADEF

SEQ ID NO: 2374525 - protein, 9 aa, Entamoeba dispar
SDDHCDDSY

SEQ ID NO: 2374526 - protein, 9 aa, Entamoeba dispar
SDDIKISQT

SEQ ID NO: 2374527 - protein, 8 aa, Entamoeba dispar
SDDKLDAI

SEQ ID NO: 2374528 - protein, 5 aa, Entamoeba dispar
SDDLE

SEQ ID NO: 2374529 - protein, 9 aa, Entamoeba dispar
SDDNKPVET

SEQ ID NO: 2374530 - protein, 5 aa, Entamoeba dispar
SDDRG

SEQ ID NO: 2374531 - protein, 7 aa, Entamoeba dispar
SDDTNSH

SEQ ID NO: 2374532 - protein, 34 aa, Entamoeba dispar
SDEDASSSSEDSSDDKEIKSPRTPKEGESTEEYI

SEQ ID NO: 2374533 - protein, 8 aa, Entamoeba dispar
SDEELERR

SEQ ID NO: 2374534 - protein, 8 aa, Entamoeba dispar
SDEEMSEL

SEQ ID NO: 2374535 - protein, 7 aa, Entamoeba dispar
SDEEPQI

SEQ ID NO: 2374536 - protein, 19 aa, Entamoeba dispar
SDEGQKELKTKKKYIDGIK

SEQ ID NO: 2374537 - protein, 5 aa, Entamoeba dispar
SDEKC

SEQ ID NO: 2374538 - protein, 8 aa, Entamoeba dispar
SDEKNTKT

SEQ ID NO: 2374539 - protein, 5 aa, Entamoeba dispar
SDELS

SEQ ID NO: 2374540 - protein, 4 aa, Entamoeba dispar
SDEN

SEQ ID NO: 2374541 - protein, 8 aa, Entamoeba dispar
SDENGEKV

SEQ ID NO: 2374542 - protein, 6 aa, Entamoeba dispar
SDENYK

SEQ ID NO: 2374543 - protein, 6 aa, Entamoeba dispar
SDERTK

SEQ ID NO: 2374544 - protein, 32 aa, Entamoeba dispar
SDESNSGKEDNSTEPQSPGGQFCEEGGEGDYT

SEQ ID NO: 2374545 - protein, 14 aa, Entamoeba dispar
SDETIKEFEEETKK

SEQ ID NO: 2374546 - protein, 11 aa, Entamoeba dispar
SDETKENNNNN

SEQ ID NO: 2374547 - protein, 6 aa, Entamoeba dispar
SDFERA

SEQ ID NO: 2374548 - protein, 7 aa, Entamoeba dispar
SDFGSSR

SEQ ID NO: 2374549 - protein, 7 aa, Entamoeba dispar
SDFGTSK

SEQ ID NO: 2374550 - protein, 24 aa, Entamoeba dispar
SDFGTTRNISSSSASDSMTKGIGT

SEQ ID NO: 2374551 - protein, 6 aa, Entamoeba dispar
SDFNSN

SEQ ID NO: 2374552 - protein, 5 aa, Entamoeba dispar
SDGCS

SEQ ID NO: 2374553 - protein, 5 aa, Entamoeba dispar
SDGDL

SEQ ID NO: 2374554 - protein, 6 aa, Entamoeba dispar
SDGFGE

SEQ ID NO: 2374555 - protein, 7 aa, Entamoeba dispar
SDGIDNP

SEQ ID NO: 2374556 - protein, 21 aa, Entamoeba dispar
SDGIEEAAGKFATKNGKRKFE

SEQ ID NO: 2374557 - protein, 12 aa, Entamoeba dispar
SDGKAHDGRPTY

SEQ ID NO: 2374558 - protein, 16 aa, Entamoeba dispar
SDGKKMSKRLKNYPDP

SEQ ID NO: 2374559 - protein, 23 aa, Entamoeba dispar
SDGKPLAGDYHDQKDVPSENDYS

SEQ ID NO: 2374560 - protein, 38 aa, Entamoeba dispar
SDGKSKTLNLDEEKENKPKEEITPIPKPQKKKVKIILP

SEQ ID NO: 2374561 - protein, 8 aa, Entamoeba dispar
SDGPINSS

SEQ ID NO: 2374562 - protein, 14 aa, Entamoeba dispar
SDGPLTNNCSSSTN

SEQ ID NO: 2374563 - protein, 5 aa, Entamoeba dispar
SDGSI

SEQ ID NO: 2374564 - protein, 8 aa, Entamoeba dispar
SDGTDFAP

SEQ ID NO: 2374565 - protein, 7 aa, Entamoeba dispar
SDHKPVS

SEQ ID NO: 2374566 - protein, 7 aa, Entamoeba dispar
SDHPPHG

SEQ ID NO: 2374567 - protein, 7 aa, Entamoeba dispar
SDHYPAS

SEQ ID NO: 2374568 - protein, 6 aa, Entamoeba dispar
SDIGKS

SEQ ID NO: 2374569 - protein, 6 aa, Entamoeba dispar
SDINES

SEQ ID NO: 2374570 - protein, 14 aa, Entamoeba dispar
SDIPGCQDNQCTTN

SEQ ID NO: 2374571 - protein, 13 aa, Entamoeba dispar
SDISSNPQTPANQ

SEQ ID NO: 2374572 - protein, 6 aa, Entamoeba dispar
SDISTT

SEQ ID NO: 2374573 - protein, 7 aa, Entamoeba dispar
SDITHPD

SEQ ID NO: 2374574 - protein, 6 aa, Entamoeba dispar
SDITSA

SEQ ID NO: 2374575 - protein, 4 aa, Entamoeba dispar
SDIV

SEQ ID NO: 2374576 - protein, 5 aa, Entamoeba dispar
SDIYE

SEQ ID NO: 2374577 - protein, 8 aa, Entamoeba dispar
SDKDIETP

SEQ ID NO: 2374578 - protein, 5 aa, Entamoeba dispar
SDKDN

SEQ ID NO: 2374579 - protein, 5 aa, Entamoeba dispar
SDKEN

SEQ ID NO: 2374580 - protein, 9 aa, Entamoeba dispar
SDKFSVDTT

SEQ ID NO: 2374581 - protein, 9 aa, Entamoeba dispar
SDKGGKVNV

SEQ ID NO: 2374582 - protein, 4 aa, Entamoeba dispar
SDKI

SEQ ID NO: 2374583 - protein, 8 aa, Entamoeba dispar
SDKITGYE

SEQ ID NO: 2374584 - protein, 17 aa, Entamoeba dispar
SDKLENSNNINKQNSSF

SEQ ID NO: 2374585 - protein, 6 aa, Entamoeba dispar
SDKNGK

SEQ ID NO: 2374586 - protein, 8 aa, Entamoeba dispar
SDKPFEEA

SEQ ID NO: 2374587 - protein, 11 aa, Entamoeba dispar
SDKRNKKEIEK

SEQ ID NO: 2374588 - protein, 5 aa, Entamoeba dispar
SDKRR

SEQ ID NO: 2374589 - protein, 9 aa, Entamoeba dispar
SDKTAGSKE

SEQ ID NO: 2374590 - protein, 7 aa, Entamoeba dispar
SDKTIKI

SEQ ID NO: 2374591 - protein, 4 aa, Entamoeba dispar
SDKY

SEQ ID NO: 2374592 - protein, 9 aa, Entamoeba dispar
SDLEETQGL

SEQ ID NO: 2374593 - protein, 5 aa, Entamoeba dispar
SDLGC

SEQ ID NO: 2374594 - protein, 7 aa, Entamoeba dispar
SDLPSTA

SEQ ID NO: 2374595 - protein, 7 aa, Entamoeba dispar
SDLSAEG

SEQ ID NO: 2374596 - protein, 18 aa, Entamoeba dispar
SDMDSSSFSHDRKQEVAN

SEQ ID NO: 2374597 - protein, 9 aa, Entamoeba dispar
SDNDESELS

SEQ ID NO: 2374598 - protein, 5 aa, Entamoeba dispar
SDNDI

SEQ ID NO: 2374599 - protein, 5 aa, Entamoeba dispar
SDNDK

SEQ ID NO: 2374600 - protein, 7 aa, Entamoeba dispar
SDNFGDC

SEQ ID NO: 2374601 - protein, 8 aa, Entamoeba dispar
SDNFSDDS

SEQ ID NO: 2374602 - protein, 17 aa, Entamoeba dispar
SDNGCTNKDGKEEEGTK

SEQ ID NO: 2374603 - protein, 6 aa, Entamoeba dispar
SDNGIN

SEQ ID NO: 2374604 - protein, 5 aa, Entamoeba dispar
SDNIG

SEQ ID NO: 2374605 - protein, 10 aa, Entamoeba dispar
SDNKCTKKIT

SEQ ID NO: 2374606 - protein, 9 aa, Entamoeba dispar
SDNNKSKQL

SEQ ID NO: 2374607 - protein, 7 aa, Entamoeba dispar
SDNPFKA

SEQ ID NO: 2374608 - protein, 9 aa, Entamoeba dispar
SDNPIAEGA

SEQ ID NO: 2374609 - protein, 5 aa, Entamoeba dispar
SDNSF

SEQ ID NO: 2374610 - protein, 20 aa, Entamoeba dispar
  misc_feature (14)..(15): Xaa can be any naturally occurring amino acid
SDNSLILTASINSXXRDRTV

SEQ ID NO: 2374611 - protein, 10 aa, Entamoeba dispar
SDNTNYQDGS

SEQ ID NO: 2374612 - protein, 8 aa, Entamoeba dispar
SDPAFSNS

SEQ ID NO: 2374613 - protein, 11 aa, Entamoeba dispar
SDPETNNNYGT

SEQ ID NO: 2374614 - protein, 9 aa, Entamoeba dispar
SDPFPKSID

SEQ ID NO: 2374615 - protein, 16 aa, Entamoeba dispar
SDPGIKSDTLSEEKTF

SEQ ID NO: 2374616 - protein, 5 aa, Entamoeba dispar
SDPGK

SEQ ID NO: 2374617 - protein, 7 aa, Entamoeba dispar
SDPIASE

SEQ ID NO: 2374618 - protein, 9 aa, Entamoeba dispar
SDPKGEQDL

SEQ ID NO: 2374619 - protein, 6 aa, Entamoeba dispar
SDPNKI

SEQ ID NO: 2374620 - protein, 6 aa, Entamoeba dispar
SDPPII

SEQ ID NO: 2374621 - protein, 14 aa, Entamoeba dispar
SDPQLRRDDKGEYT

SEQ ID NO: 2374622 - protein, 4 aa, Entamoeba dispar
SDPS

SEQ ID NO: 2374623 - protein, 6 aa, Entamoeba dispar
SDPSLR

SEQ ID NO: 2374624 - protein, 9 aa, Entamoeba dispar
SDPSSRENG

SEQ ID NO: 2374625 - protein, 7 aa, Entamoeba dispar
SDQEQLP

SEQ ID NO: 2374626 - protein, 5 aa, Entamoeba dispar
SDQLE

SEQ ID NO: 2374627 - protein, 4 aa, Entamoeba dispar
SDQR

SEQ ID NO: 2374628 - protein, 8 aa, Entamoeba dispar
SDQSTSIT

SEQ ID NO: 2374629 - protein, 6 aa, Entamoeba dispar
SDQTID

SEQ ID NO: 2374630 - protein, 7 aa, Entamoeba dispar
SDREGIQ

SEQ ID NO: 2374631 - protein, 4 aa, Entamoeba dispar
SDRK

SEQ ID NO: 2374632 - protein, 7 aa, Entamoeba dispar
SDRKRQS

SEQ ID NO: 2374633 - protein, 9 aa, Entamoeba dispar
SDRPFGSVN

SEQ ID NO: 2374634 - protein, 6 aa, Entamoeba dispar
SDRQNE

SEQ ID NO: 2374635 - protein, 24 aa, Entamoeba dispar
SDRRMKRDKPYNKRRKQVNSPEDI

SEQ ID NO: 2374636 - protein, 9 aa, Entamoeba dispar
SDRRNDQPL

SEQ ID NO: 2374637 - protein, 5 aa, Entamoeba dispar
SDSCN

SEQ ID NO: 2374638 - protein, 5 aa, Entamoeba dispar
SDSDN

SEQ ID NO: 2374639 - protein, 20 aa, Entamoeba dispar
SDSDSDSFDLDHQNEIELTN

SEQ ID NO: 2374640 - protein, 11 aa, Entamoeba dispar
SDSEPTTNNPY

SEQ ID NO: 2374641 - protein, 16 aa, Entamoeba dispar
SDSGAMKFSKDGDNIK

SEQ ID NO: 2374642 - protein, 4 aa, Entamoeba dispar
SDSH

SEQ ID NO: 2374643 - protein, 14 aa, Entamoeba dispar
SDSISSKKVEGLKS

SEQ ID NO: 2374644 - protein, 16 aa, Entamoeba dispar
SDSKDNSKSNTKPSNC

SEQ ID NO: 2374645 - protein, 5 aa, Entamoeba dispar
SDSLN

SEQ ID NO: 2374646 - protein, 11 aa, Entamoeba dispar
SDSLWKKEQGP

SEQ ID NO: 2374647 - protein, 9 aa, Entamoeba dispar
SDSNTCTKC

SEQ ID NO: 2374648 - protein, 7 aa, Entamoeba dispar
SDSPPAL

SEQ ID NO: 2374649 - protein, 4 aa, Entamoeba dispar
SDSS

SEQ ID NO: 2374650 - protein, 18 aa, Entamoeba dispar
SDSSCQTCNSTIDPNTNN

SEQ ID NO: 2374651 - protein, 15 aa, Entamoeba dispar
SDSSITTPPDNISDN

SEQ ID NO: 2374652 - protein, 6 aa, Entamoeba dispar
SDSTFK

SEQ ID NO: 2374653 - protein, 7 aa, Entamoeba dispar
SDSTMSS

SEQ ID NO: 2374654 - protein, 10 aa, Entamoeba dispar
SDSTRSKSTI

SEQ ID NO: 2374655 - protein, 9 aa, Entamoeba dispar
SDSVRKPAT

SEQ ID NO: 2374656 - protein, 4 aa, Entamoeba dispar
SDSY

SEQ ID NO: 2374657 - protein, 14 aa, Entamoeba dispar
SDTCGDYKNENQCY

SEQ ID NO: 2374658 - protein, 7 aa, Entamoeba dispar
SDTDPLK

SEQ ID NO: 2374659 - protein, 7 aa, Entamoeba dispar
SDTIRNN

SEQ ID NO: 2374660 - protein, 5 aa, Entamoeba dispar
SDTLP

SEQ ID NO: 2374661 - protein, 4 aa, Entamoeba dispar
SDTM

SEQ ID NO: 2374662 - protein, 24 aa, Entamoeba dispar
SDTNNDRNQEKENNEYDNIKEEIK

SEQ ID NO: 2374663 - protein, 6 aa, Entamoeba dispar
SDTPSV

SEQ ID NO: 2374664 - protein, 6 aa, Entamoeba dispar
SDTSKH

SEQ ID NO: 2374665 - protein, 9 aa, Entamoeba dispar
SDTTPSFEG

SEQ ID NO: 2374666 - protein, 5 aa, Entamoeba dispar
SDTTV

SEQ ID NO: 2374667 - protein, 5 aa, Entamoeba dispar
SDTYN

SEQ ID NO: 2374668 - protein, 28 aa, Entamoeba dispar
SDVPKGKYGKKSYKQEVQPKLYNGTDKY

SEQ ID NO: 2374669 - protein, 9 aa, Entamoeba dispar
SDVPSITPS

SEQ ID NO: 2374670 - protein, 5 aa, Entamoeba dispar
SDVQQ

SEQ ID NO: 2374671 - protein, 7 aa, Entamoeba dispar
SDYDTSE

SEQ ID NO: 2374672 - protein, 5 aa, Entamoeba dispar
SDYIA

SEQ ID NO: 2374673 - protein, 8 aa, Entamoeba dispar
SDYNSSRC

SEQ ID NO: 2374674 - protein, 4 aa, Entamoeba dispar
SDYS

SEQ ID NO: 2374675 - protein, 6 aa, Entamoeba dispar
SDYSGL

SEQ ID NO: 2374676 - protein, 7 aa, Entamoeba dispar
SDYSTMQ

SEQ ID NO: 2374677 - protein, 11 aa, Entamoeba dispar
SEAIDSRDTSY

SEQ ID NO: 2374678 - protein, 4 aa, Entamoeba dispar
SEAN

SEQ ID NO: 2374679 - protein, 17 aa, Entamoeba dispar
SEAPHGCSGTPENGKGK

SEQ ID NO: 2374680 - protein, 32 aa, Entamoeba dispar
SEAPIKDSSCSTPKRNKRATKSQICSAVDPTF

SEQ ID NO: 2374681 - protein, 4 aa, Entamoeba dispar
SEAV

SEQ ID NO: 2374682 - protein, 6 aa, Entamoeba dispar
SECKRN

SEQ ID NO: 2374683 - protein, 14 aa, Entamoeba dispar
SECPPGTHNPVTNT

SEQ ID NO: 2374684 - protein, 7 aa, Entamoeba dispar
SECPTSI

SEQ ID NO: 2374685 - protein, 12 aa, Entamoeba dispar
SEDASGEKGISL

SEQ ID NO: 2374686 - protein, 7 aa, Entamoeba dispar
SEDDDGI

SEQ ID NO: 2374687 - protein, 5 aa, Entamoeba dispar
SEDDI

SEQ ID NO: 2374688 - protein, 7 aa, Entamoeba dispar
SEDEEKS

SEQ ID NO: 2374689 - protein, 5 aa, Entamoeba dispar
SEDEF

SEQ ID NO: 2374690 - protein, 5 aa, Entamoeba dispar
SEDIT

SEQ ID NO: 2374691 - protein, 9 aa, Entamoeba dispar
SEDKTSATI

SEQ ID NO: 2374692 - protein, 5 aa, Entamoeba dispar
SEDPY

SEQ ID NO: 2374693 - protein, 8 aa, Entamoeba dispar
SEDQMEET

SEQ ID NO: 2374694 - protein, 6 aa, Entamoeba dispar
SEDVRL

SEQ ID NO: 2374695 - protein, 4 aa, Entamoeba dispar
SEEA

SEQ ID NO: 2374696 - protein, 9 aa, Entamoeba dispar
SEECTNKLR

SEQ ID NO: 2374697 - protein, 5 aa, Entamoeba dispar
SEEDK

SEQ ID NO: 2374698 - protein, 7 aa, Entamoeba dispar
SEEDLDG

SEQ ID NO: 2374699 - protein, 6 aa, Entamoeba dispar
SEEEED

SEQ ID NO: 2374700 - protein, 11 aa, Entamoeba dispar
SEEERSQAIER

SEQ ID NO: 2374701 - protein, 9 aa, Entamoeba dispar
SEEGETFND

SEQ ID NO: 2374702 - protein, 7 aa, Entamoeba dispar
SEEGKDY

SEQ ID NO: 2374703 - protein, 7 aa, Entamoeba dispar
SEEGNQL

SEQ ID NO: 2374704 - protein, 5 aa, Entamoeba dispar
SEEIE

SEQ ID NO: 2374705 - protein, 14 aa, Entamoeba dispar
SEEIRKEQSHESAV

SEQ ID NO: 2374706 - protein, 6 aa, Entamoeba dispar
SEEKEK

SEQ ID NO: 2374707 - protein, 28 aa, Entamoeba dispar
SEEKTNNKNLENEITNIKEEKKQREDEV

SEQ ID NO: 2374708 - protein, 5 aa, Entamoeba dispar
SEELT

SEQ ID NO: 2374709 - protein, 10 aa, Entamoeba dispar
SEENIEEDDK

SEQ ID NO: 2374710 - protein, 8 aa, Entamoeba dispar
SEEPIAEG

SEQ ID NO: 2374711 - protein, 13 aa, Entamoeba dispar
SEEPKKKISHCLI

SEQ ID NO: 2374712 - protein, 10 aa, Entamoeba dispar
SEEQKSKWTN

SEQ ID NO: 2374713 - protein, 4 aa, Entamoeba dispar
SEER

SEQ ID NO: 2374714 - protein, 6 aa, Entamoeba dispar
SEESIN

SEQ ID NO: 2374715 - protein, 12 aa, Entamoeba dispar
SEETSGVLSTDS

SEQ ID NO: 2374716 - protein, 6 aa, Entamoeba dispar
SEEYDY

SEQ ID NO: 2374717 - protein, 11 aa, Entamoeba dispar
SEFSATTTPEI

SEQ ID NO: 2374718 - protein, 19 aa, Entamoeba dispar
SEGEEVEESKEEKPEEEIN

SEQ ID NO: 2374719 - protein, 7 aa, Entamoeba dispar
SEGGAQY

SEQ ID NO: 2374720 - protein, 7 aa, Entamoeba dispar
SEGKIDK

SEQ ID NO: 2374721 - protein, 11 aa, Entamoeba dispar
SEGKRPKKDEV

SEQ ID NO: 2374722 - protein, 4 aa, Entamoeba dispar
SEGQ

SEQ ID NO: 2374723 - protein, 5 aa, Entamoeba dispar
SEGQH

SEQ ID NO: 2374724 - protein, 8 aa, Entamoeba dispar
SEGRQAYP

SEQ ID NO: 2374725 - protein, 8 aa, Entamoeba dispar
SEGSFDAT

SEQ ID NO: 2374726 - protein, 7 aa, Entamoeba dispar
SEGSNEL

SEQ ID NO: 2374727 - protein, 11 aa, Entamoeba dispar
SEGSSFNLSED

SEQ ID NO: 2374728 - protein, 4 aa, Entamoeba dispar
SEHE

SEQ ID NO: 2374729 - protein, 8 aa, Entamoeba dispar
SEHGNQFK

SEQ ID NO: 2374730 - protein, 7 aa, Entamoeba dispar
SEHPADC

SEQ ID NO: 2374731 - protein, 7 aa, Entamoeba dispar
SEHPEQV

SEQ ID NO: 2374732 - protein, 7 aa, Entamoeba dispar
SEHQPTS

SEQ ID NO: 2374733 - protein, 6 aa, Entamoeba dispar
SEICQT

SEQ ID NO: 2374734 - protein, 31 aa, Entamoeba dispar
SEIELSSPSSSISLSDSERKNESESHGYSNE

SEQ ID NO: 2374735 - protein, 21 aa, Entamoeba dispar
SEIPESESGCDETLRKKQGTW

SEQ ID NO: 2374736 - protein, 4 aa, Entamoeba dispar
SEIQ

SEQ ID NO: 2374737 - protein, 13 aa, Entamoeba dispar
SEIQTSLKGNSIN

SEQ ID NO: 2374738 - protein, 9 aa, Entamoeba dispar
SEISPENKD

SEQ ID NO: 2374739 - protein, 10 aa, Entamoeba dispar
SEISQIPSES

SEQ ID NO: 2374740 - protein, 5 aa, Entamoeba dispar
SEKAR

SEQ ID NO: 2374741 - protein, 19 aa, Entamoeba dispar
SEKEKESITTPDSGMNERT

SEQ ID NO: 2374742 - protein, 11 aa, Entamoeba dispar
SEKELEENQQT

SEQ ID NO: 2374743 - protein, 21 aa, Entamoeba dispar
SEKESKKKRIKSTTADKVGTY

SEQ ID NO: 2374744 - protein, 8 aa, Entamoeba dispar
SEKESLTR

SEQ ID NO: 2374745 - protein, 8 aa, Entamoeba dispar
SEKIESGV

SEQ ID NO: 2374746 - protein, 15 aa, Entamoeba dispar
SEKLDKNCKTCKNNY

SEQ ID NO: 2374747 - protein, 5 aa, Entamoeba dispar
SEKPD

SEQ ID NO: 2374748 - protein, 10 aa, Entamoeba dispar
SEKPNNEASQ

SEQ ID NO: 2374749 - protein, 11 aa, Entamoeba dispar
SEKQGERGNYV

SEQ ID NO: 2374750 - protein, 6 aa, Entamoeba dispar
SEKQVR

SEQ ID NO: 2374751 - protein, 7 aa, Entamoeba dispar
SEKSCKS

SEQ ID NO: 2374752 - protein, 7 aa, Entamoeba dispar
SEKTEFK

SEQ ID NO: 2374753 - protein, 28 aa, Entamoeba dispar
SEKTEQSDNEMDSDDEIESSESNGEKKI

SEQ ID NO: 2374754 - protein, 4 aa, Entamoeba dispar
SELG

SEQ ID NO: 2374755 - protein, 21 aa, Entamoeba dispar
SELKDNNLKDEDSDEGNEEEG

SEQ ID NO: 2374756 - protein, 9 aa, Entamoeba dispar
SELPIEQET

SEQ ID NO: 2374757 - protein, 14 aa, Entamoeba dispar
SELPQYSKFSTENQ

SEQ ID NO: 2374758 - protein, 8 aa, Entamoeba dispar
SELSTNEL

SEQ ID NO: 2374759 - protein, 8 aa, Entamoeba dispar
SELSTRID

SEQ ID NO: 2374760 - protein, 10 aa, Entamoeba dispar
SELTVDEETT

SEQ ID NO: 2374761 - protein, 7 aa, Entamoeba dispar
SEMETSE

SEQ ID NO: 2374762 - protein, 10 aa, Entamoeba dispar
SENDDGLNDL

SEQ ID NO: 2374763 - protein, 18 aa, Entamoeba dispar
SENDKKQLIEREKELTKQ

SEQ ID NO: 2374764 - protein, 7 aa, Entamoeba dispar
SENDRSD

SEQ ID NO: 2374765 - protein, 7 aa, Entamoeba dispar
SENDSPL

SEQ ID NO: 2374766 - protein, 10 aa, Entamoeba dispar
SENETDYSVS

SEQ ID NO: 2374767 - protein, 12 aa, Entamoeba dispar
SENPIAEGATSK

SEQ ID NO: 2374768 - protein, 11 aa, Entamoeba dispar
SENQYYNAGEC

SEQ ID NO: 2374769 - protein, 5 aa, Entamoeba dispar
SENSD

SEQ ID NO: 2374770 - protein, 6 aa, Entamoeba dispar
SENSDP

SEQ ID NO: 2374771 - protein, 10 aa, Entamoeba dispar
SENWKNEDYE

SEQ ID NO: 2374772 - protein, 5 aa, Entamoeba dispar
SEPFQ

SEQ ID NO: 2374773 - protein, 6 aa, Entamoeba dispar
SEPHWQ

SEQ ID NO: 2374774 - protein, 6 aa, Entamoeba dispar
SEPNKK

SEQ ID NO: 2374775 - protein, 5 aa, Entamoeba dispar
SEPPD

SEQ ID NO: 2374776 - protein, 7 aa, Entamoeba dispar
SEPPIQP

SEQ ID NO: 2374777 - protein, 8 aa, Entamoeba dispar
SEQETIEY

SEQ ID NO: 2374778 - protein, 5 aa, Entamoeba dispar
SEQKI

SEQ ID NO: 2374779 - protein, 6 aa, Entamoeba dispar
SEQNAS

SEQ ID NO: 2374780 - protein, 8 aa, Entamoeba dispar
SEQQKDER

SEQ ID NO: 2374781 - protein, 6 aa, Entamoeba dispar
SERDIP

SEQ ID NO: 2374782 - protein, 6 aa, Entamoeba dispar
SERDPV

SEQ ID NO: 2374783 - protein, 6 aa, Entamoeba dispar
SERISN

SEQ ID NO: 2374784 - protein, 4 aa, Entamoeba dispar
SERK

SEQ ID NO: 2374785 - protein, 5 aa, Entamoeba dispar
SERKR

SEQ ID NO: 2374786 - protein, 4 aa, Entamoeba dispar
SERN

SEQ ID NO: 2374787 - protein, 19 aa, Entamoeba dispar
SERNLSAKELSQGIGTPTY

SEQ ID NO: 2374788 - protein, 25 aa, Entamoeba dispar
SERPRMSATELQRNSITSSDSDIPA

SEQ ID NO: 2374789 - protein, 6 aa, Entamoeba dispar
SERPTY

SEQ ID NO: 2374790 - protein, 13 aa, Entamoeba dispar
SERQEGMKNKESF

SEQ ID NO: 2374791 - protein, 12 aa, Entamoeba dispar
SERRKMNGSNKN

SEQ ID NO: 2374792 - protein, 5 aa, Entamoeba dispar
SERVV

SEQ ID NO: 2374793 - protein, 5 aa, Entamoeba dispar
SESAE

SEQ ID NO: 2374794 - protein, 12 aa, Entamoeba dispar
SESEIKSSTGTY

SEQ ID NO: 2374795 - protein, 6 aa, Entamoeba dispar
SESENG

SEQ ID NO: 2374796 - protein, 17 aa, Entamoeba dispar
SESESGSSSRQSIDGGN

SEQ ID NO: 2374797 - protein, 40 aa, Entamoeba dispar
SESETEKSEDSSDISTDSIVNGTPSEIAQSGFSSSPTPFI

SEQ ID NO: 2374798 - protein, 6 aa, Entamoeba dispar
SESGQG

SEQ ID NO: 2374799 - protein, 8 aa, Entamoeba dispar
SESKEPIL

SEQ ID NO: 2374800 - protein, 5 aa, Entamoeba dispar
SESKV

SEQ ID NO: 2374801 - protein, 6 aa, Entamoeba dispar
SESLSI

SEQ ID NO: 2374802 - protein, 4 aa, Entamoeba dispar
SESN

SEQ ID NO: 2374803 - protein, 18 aa, Entamoeba dispar
SESNDTPPTSFISLSLFP

SEQ ID NO: 2374804 - protein, 4 aa, Entamoeba dispar
SESQ

SEQ ID NO: 2374805 - protein, 11 aa, Entamoeba dispar
SESSNREEESQ

SEQ ID NO: 2374806 - protein, 10 aa, Entamoeba dispar
SESTTDSIVR

SEQ ID NO: 2374807 - protein, 6 aa, Entamoeba dispar
SESVPQ

SEQ ID NO: 2374808 - protein, 5 aa, Entamoeba dispar
SESYT

SEQ ID NO: 2374809 - protein, 8 aa, Entamoeba dispar
SETDQIES

SEQ ID NO: 2374810 - protein, 6 aa, Entamoeba dispar
SETDSE

SEQ ID NO: 2374811 - protein, 6 aa, Entamoeba dispar
SETEIS

SEQ ID NO: 2374812 - protein, 7 aa, Entamoeba dispar
SETEPEL

SEQ ID NO: 2374813 - protein, 4 aa, Entamoeba dispar
SETF

SEQ ID NO: 2374814 - protein, 7 aa, Entamoeba dispar
SETGETL

SEQ ID NO: 2374815 - protein, 4 aa, Entamoeba dispar
SETI

SEQ ID NO: 2374816 - protein, 7 aa, Entamoeba dispar
SETIKLT

SEQ ID NO: 2374817 - protein, 4 aa, Entamoeba dispar
SETN

SEQ ID NO: 2374818 - protein, 7 aa, Entamoeba dispar
SETPITI

SEQ ID NO: 2374819 - protein, 12 aa, Entamoeba dispar
SETTDLSLLVND

SEQ ID NO: 2374820 - protein, 16 aa, Entamoeba dispar
SETTTEVTSVKGTDCD

SEQ ID NO: 2374821 - protein, 6 aa, Entamoeba dispar
SETTYQ

SEQ ID NO: 2374822 - protein, 4 aa, Entamoeba dispar
SETV

SEQ ID NO: 2374823 - protein, 17 aa, Entamoeba dispar
SETVIGGDSCKNATEIE

SEQ ID NO: 2374824 - protein, 4 aa, Entamoeba dispar
SEVE

SEQ ID NO: 2374825 - protein, 12 aa, Entamoeba dispar
SEVEEKNNIGRG

SEQ ID NO: 2374826 - protein, 13 aa, Entamoeba dispar
SEVGRDNARTPMQ

SEQ ID NO: 2374827 - protein, 4 aa, Entamoeba dispar
SEVT

SEQ ID NO: 2374828 - protein, 18 aa, Entamoeba dispar
SEYQSTKINLPNNDGLTP

SEQ ID NO: 2374829 - protein, 18 aa, Entamoeba dispar
SEYSLKTQSGFKSVEGDG

SEQ ID NO: 2374830 - protein, 9 aa, Entamoeba dispar
SFAPKNKEV

SEQ ID NO: 2374831 - protein, 5 aa, Entamoeba dispar
SFAQP

SEQ ID NO: 2374832 - protein, 8 aa, Entamoeba dispar
SFCNSNNS

SEQ ID NO: 2374833 - protein, 6 aa, Entamoeba dispar
SFDPDF

SEQ ID NO: 2374834 - protein, 13 aa, Entamoeba dispar
SFDPNSKYSKEEI

SEQ ID NO: 2374835 - protein, 5 aa, Entamoeba dispar
SFDRT

SEQ ID NO: 2374836 - protein, 8 aa, Entamoeba dispar
SFEAETTT

SEQ ID NO: 2374837 - protein, 38 aa, Entamoeba dispar
SFEEPNKEEPNKEEPNKEEPNKEELNKEELNKEELNKE

SEQ ID NO: 2374838 - protein, 6 aa, Entamoeba dispar
SFENTY

SEQ ID NO: 2374839 - protein, 13 aa, Entamoeba dispar
SFETWTPEDQAQM

SEQ ID NO: 2374840 - protein, 5 aa, Entamoeba dispar
SFGEP

SEQ ID NO: 2374841 - protein, 14 aa, Entamoeba dispar
SFGNEGKTTNINET

SEQ ID NO: 2374842 - protein, 20 aa, Entamoeba dispar
SFGNSPVPRRKSPGEETTEL

SEQ ID NO: 2374843 - protein, 25 aa, Entamoeba dispar
SFGPETNQTNQSTELKEKDKTIRSH

SEQ ID NO: 2374844 - protein, 7 aa, Entamoeba dispar
SFGPQTC

SEQ ID NO: 2374845 - protein, 9 aa, Entamoeba dispar
SFGSNTSVS

SEQ ID NO: 2374846 - protein, 6 aa, Entamoeba dispar
SFGSQN

SEQ ID NO: 2374847 - protein, 13 aa, Entamoeba dispar
SFGSTNQELTRTS

SEQ ID NO: 2374848 - protein, 7 aa, Entamoeba dispar
SFIESSS

SEQ ID NO: 2374849 - protein, 10 aa, Entamoeba dispar
SFIGNDKEKV

SEQ ID NO: 2374850 - protein, 5 aa, Entamoeba dispar
SFKDN

SEQ ID NO: 2374851 - protein, 9 aa, Entamoeba dispar
SFKEKNYQN

SEQ ID NO: 2374852 - protein, 13 aa, Entamoeba dispar
SFKEVEKGYTPEE

SEQ ID NO: 2374853 - protein, 5 aa, Entamoeba dispar
SFKGT

SEQ ID NO: 2374854 - protein, 7 aa, Entamoeba dispar
SFKNKNI

SEQ ID NO: 2374855 - protein, 10 aa, Entamoeba dispar
SFKPVDEANE

SEQ ID NO: 2374856 - protein, 4 aa, Entamoeba dispar
SFKR

SEQ ID NO: 2374857 - protein, 15 aa, Entamoeba dispar
SFKTNSVKNSEKGDF

SEQ ID NO: 2374858 - protein, 4 aa, Entamoeba dispar
SFNA

SEQ ID NO: 2374859 - protein, 4 aa, Entamoeba dispar
SFND

SEQ ID NO: 2374860 - protein, 9 aa, Entamoeba dispar
SFNDNPQII

SEQ ID NO: 2374861 - protein, 10 aa, Entamoeba dispar
SFNEKSDNLI

SEQ ID NO: 2374862 - protein, 4 aa, Entamoeba dispar
SFNP

SEQ ID NO: 2374863 - protein, 12 aa, Entamoeba dispar
SFNYNGKDEKNL

SEQ ID NO: 2374864 - protein, 5 aa, Entamoeba dispar
SFPSY

SEQ ID NO: 2374865 - protein, 5 aa, Entamoeba dispar
SFQKA

SEQ ID NO: 2374866 - protein, 7 aa, Entamoeba dispar
SFQTAAG

SEQ ID NO: 2374867 - protein, 9 aa, Entamoeba dispar
SFSEKESRE

SEQ ID NO: 2374868 - protein, 9 aa, Entamoeba dispar
SFSGKYSSS

SEQ ID NO: 2374869 - protein, 7 aa, Entamoeba dispar
SFSKQEY

SEQ ID NO: 2374870 - protein, 12 aa, Entamoeba dispar
SFSNSDNSRNNF

SEQ ID NO: 2374871 - protein, 5 aa, Entamoeba dispar
SFSPN

SEQ ID NO: 2374872 - protein, 5 aa, Entamoeba dispar
SFSQC

SEQ ID NO: 2374873 - protein, 9 aa, Entamoeba dispar
SFSSNSPLQ

SEQ ID NO: 2374874 - protein, 24 aa, Entamoeba dispar
SFSSSDSSSSDEDTSKPLTQVQIT

SEQ ID NO: 2374875 - protein, 7 aa, Entamoeba dispar
SFTNNSE

SEQ ID NO: 2374876 - protein, 5 aa, Entamoeba dispar
SFTSG

SEQ ID NO: 2374877 - protein, 7 aa, Entamoeba dispar
SFTTGDT

SEQ ID NO: 2374878 - protein, 4 aa, Entamoeba dispar
SFYS

SEQ ID NO: 2374879 - protein, 6 aa, Entamoeba dispar
SGAIYN

SEQ ID NO: 2374880 - protein, 11 aa, Entamoeba dispar
SGATISGKGSL

SEQ ID NO: 2374881 - protein, 7 aa, Entamoeba dispar
SGCADEL

SEQ ID NO: 2374882 - protein, 9 aa, Entamoeba dispar
SGCADELKR

SEQ ID NO: 2374883 - protein, 7 aa, Entamoeba dispar
SGCDGTI

SEQ ID NO: 2374884 - protein, 6 aa, Entamoeba dispar
SGCDRT

SEQ ID NO: 2374885 - protein, 7 aa, Entamoeba dispar
SGCGKST

SEQ ID NO: 2374886 - protein, 4 aa, Entamoeba dispar
SGCY

SEQ ID NO: 2374887 - protein, 4 aa, Entamoeba dispar
SGDD

SEQ ID NO: 2374888 - protein, 5 aa, Entamoeba dispar
SGDGE

SEQ ID NO: 2374889 - protein, 5 aa, Entamoeba dispar
SGDIM

SEQ ID NO: 2374890 - protein, 8 aa, Entamoeba dispar
SGDLDGGY

SEQ ID NO: 2374891 - protein, 5 aa, Entamoeba dispar
SGDNI

SEQ ID NO: 2374892 - protein, 21 aa, Entamoeba dispar
SGDPNGKDDEFEVGQSPSIHN

SEQ ID NO: 2374893 - protein, 19 aa, Entamoeba dispar
SGDPNGKDEEFEVGQSPSI

SEQ ID NO: 2374894 - protein, 9 aa, Entamoeba dispar
SGDPTSMNV

SEQ ID NO: 2374895 - protein, 10 aa, Entamoeba dispar
SGDTNLSHSA

SEQ ID NO: 2374896 - protein, 5 aa, Entamoeba dispar
SGDYI

SEQ ID NO: 2374897 - protein, 4 aa, Entamoeba dispar
SGEC

SEQ ID NO: 2374898 - protein, 7 aa, Entamoeba dispar
SGEEDIR

SEQ ID NO: 2374899 - protein, 13 aa, Entamoeba dispar
SGEKVPSPIDLFS

SEQ ID NO: 2374900 - protein, 4 aa, Entamoeba dispar
SGEL

SEQ ID NO: 2374901 - protein, 9 aa, Entamoeba dispar
SGEQDNSCS

SEQ ID NO: 2374902 - protein, 7 aa, Entamoeba dispar
SGERPSL

SEQ ID NO: 2374903 - protein, 8 aa, Entamoeba dispar
SGESRTVA

SEQ ID NO: 2374904 - protein, 8 aa, Entamoeba dispar
SGETEGVP

SEQ ID NO: 2374905 - protein, 7 aa, Entamoeba dispar
SGFANQT

SEQ ID NO: 2374906 - protein, 4 aa, Entamoeba dispar
SGFN

SEQ ID NO: 2374907 - protein, 8 aa, Entamoeba dispar
SGGGDGTL

SEQ ID NO: 2374908 - protein, 13 aa, Entamoeba dispar
SGGIKRVNKERED

SEQ ID NO: 2374909 - protein, 6 aa, Entamoeba dispar
SGGNKD

SEQ ID NO: 2374910 - protein, 4 aa, Entamoeba dispar
SGHI

SEQ ID NO: 2374911 - protein, 6 aa, Entamoeba dispar
SGHQNQ

SEQ ID NO: 2374912 - protein, 5 aa, Entamoeba dispar
SGHSG

SEQ ID NO: 2374913 - protein, 7 aa, Entamoeba dispar
SGHTGSI

SEQ ID NO: 2374914 - protein, 5 aa, Entamoeba dispar
SGIGG

SEQ ID NO: 2374915 - protein, 11 aa, Entamoeba dispar
SGIKDKEQVKV

SEQ ID NO: 2374916 - protein, 5 aa, Entamoeba dispar
SGIRR

SEQ ID NO: 2374917 - protein, 5 aa, Entamoeba dispar
SGISG

SEQ ID NO: 2374918 - protein, 17 aa, Entamoeba dispar
SGISLTSEAKINSISTD

SEQ ID NO: 2374919 - protein, 8 aa, Entamoeba dispar
SGKCTAYD

SEQ ID NO: 2374920 - protein, 7 aa, Entamoeba dispar
SGKDEYH

SEQ ID NO: 2374921 - protein, 7 aa, Entamoeba dispar
SGKEKQR

SEQ ID NO: 2374922 - protein, 8 aa, Entamoeba dispar
SGKGRTGL

SEQ ID NO: 2374923 - protein, 10 aa, Entamoeba dispar
SGKPEGNVYG

SEQ ID NO: 2374924 - protein, 8 aa, Entamoeba dispar
SGKPRPNY

SEQ ID NO: 2374925 - protein, 7 aa, Entamoeba dispar
SGKQKLK

SEQ ID NO: 2374926 - protein, 12 aa, Entamoeba dispar
SGKRLEKPNKMP

SEQ ID NO: 2374927 - protein, 10 aa, Entamoeba dispar
SGKRLPLDDS

SEQ ID NO: 2374928 - protein, 9 aa, Entamoeba dispar
SGKRNGDAA

SEQ ID NO: 2374929 - protein, 8 aa, Entamoeba dispar
SGKTSNVS

SEQ ID NO: 2374930 - protein, 5 aa, Entamoeba dispar
SGLGA

SEQ ID NO: 2374931 - protein, 4 aa, Entamoeba dispar
SGLP

SEQ ID NO: 2374932 - protein, 13 aa, Entamoeba dispar
SGLSKKNATRRFE

SEQ ID NO: 2374933 - protein, 8 aa, Entamoeba dispar
SGLSTKLD

SEQ ID NO: 2374934 - protein, 7 aa, Entamoeba dispar
SGLSYNN

SEQ ID NO: 2374935 - protein, 4 aa, Entamoeba dispar
SGLT

SEQ ID NO: 2374936 - protein, 4 aa, Entamoeba dispar
SGLV

SEQ ID NO: 2374937 - protein, 10 aa, Entamoeba dispar
SGMGGSEDGI

SEQ ID NO: 2374938 - protein, 9 aa, Entamoeba dispar
SGMKEDNRP

SEQ ID NO: 2374939 - protein, 5 aa, Entamoeba dispar
SGNDL

SEQ ID NO: 2374940 - protein, 4 aa, Entamoeba dispar
SGNF

SEQ ID NO: 2374941 - protein, 7 aa, Entamoeba dispar
SGNGKGS

SEQ ID NO: 2374942 - protein, 8 aa, Entamoeba dispar
SGNGNTDC

SEQ ID NO: 2374943 - protein, 10 aa, Entamoeba dispar
SGNKPFEEAI

SEQ ID NO: 2374944 - protein, 5 aa, Entamoeba dispar
SGNLE

SEQ ID NO: 2374945 - protein, 14 aa, Entamoeba dispar
SGNLKDRGEMTSPR

SEQ ID NO: 2374946 - protein, 5 aa, Entamoeba dispar
SGNNF

SEQ ID NO: 2374947 - protein, 9 aa, Entamoeba dispar
SGNNGSTAY

SEQ ID NO: 2374948 - protein, 16 aa, Entamoeba dispar
SGNRNEALSNGIHTSK

SEQ ID NO: 2374949 - protein, 9 aa, Entamoeba dispar
SGNSPNIPN

SEQ ID NO: 2374950 - protein, 11 aa, Entamoeba dispar
SGNSSKTLENV

SEQ ID NO: 2374951 - protein, 4 aa, Entamoeba dispar
SGNT

SEQ ID NO: 2374952 - protein, 8 aa, Entamoeba dispar
SGNTVSES

SEQ ID NO: 2374953 - protein, 10 aa, Entamoeba dispar
SGPCEECPTP

SEQ ID NO: 2374954 - protein, 5 aa, Entamoeba dispar
SGPGL

SEQ ID NO: 2374955 - protein, 12 aa, Entamoeba dispar
SGPSVTLPNQPI

SEQ ID NO: 2374956 - protein, 4 aa, Entamoeba dispar
SGQA

SEQ ID NO: 2374957 - protein, 8 aa, Entamoeba dispar
SGQAYKSG

SEQ ID NO: 2374958 - protein, 6 aa, Entamoeba dispar
SGQCES

SEQ ID NO: 2374959 - protein, 5 aa, Entamoeba dispar
SGSEL

SEQ ID NO: 2374960 - protein, 8 aa, Entamoeba dispar
SGSENSQI

SEQ ID NO: 2374961 - protein, 8 aa, Entamoeba dispar
SGSGKSVV

SEQ ID NO: 2374962 - protein, 6 aa, Entamoeba dispar
SGSKDC

SEQ ID NO: 2374963 - protein, 9 aa, Entamoeba dispar
SGSKTPTLN

SEQ ID NO: 2374964 - protein, 10 aa, Entamoeba dispar
SGSNTKVTTN

SEQ ID NO: 2374965 - protein, 9 aa, Entamoeba dispar
SGSPEIETI

SEQ ID NO: 2374966 - protein, 10 aa, Entamoeba dispar
SGSRDKRDQG

SEQ ID NO: 2374967 - protein, 4 aa, Entamoeba dispar
SGSS

SEQ ID NO: 2374968 - protein, 17 aa, Entamoeba dispar
SGSTAKLQQFEENEAER

SEQ ID NO: 2374969 - protein, 5 aa, Entamoeba dispar
SGSTI

SEQ ID NO: 2374970 - protein, 5 aa, Entamoeba dispar
SGSTR

SEQ ID NO: 2374971 - protein, 10 aa, Entamoeba dispar
SGSYSDEITT

SEQ ID NO: 2374972 - protein, 11 aa, Entamoeba dispar
SGSYSIGGKGS

SEQ ID NO: 2374973 - protein, 9 aa, Entamoeba dispar
SGTAKEPKG

SEQ ID NO: 2374974 - protein, 5 aa, Entamoeba dispar
SGTDA

SEQ ID NO: 2374975 - protein, 8 aa, Entamoeba dispar
SGTEKSND

SEQ ID NO: 2374976 - protein, 7 aa, Entamoeba dispar
SGTEPSI

SEQ ID NO: 2374977 - protein, 7 aa, Entamoeba dispar
SGTFNGS

SEQ ID NO: 2374978 - protein, 9 aa, Entamoeba dispar
SGTFNNDLA

SEQ ID NO: 2374979 - protein, 8 aa, Entamoeba dispar
SGTLEFNP

SEQ ID NO: 2374980 - protein, 11 aa, Entamoeba dispar
SGTLEGDYTKY

SEQ ID NO: 2374981 - protein, 6 aa, Entamoeba dispar
SGTNLR

SEQ ID NO: 2374982 - protein, 7 aa, Entamoeba dispar
SGTNQLN

SEQ ID NO: 2374983 - protein, 4 aa, Entamoeba dispar
SGTS

SEQ ID NO: 2374984 - protein, 10 aa, Entamoeba dispar
SGTSASPKGV

SEQ ID NO: 2374985 - protein, 5 aa, Entamoeba dispar
SGTSI

SEQ ID NO: 2374986 - protein, 10 aa, Entamoeba dispar
SGTSKDPKGV

SEQ ID NO: 2374987 - protein, 8 aa, Entamoeba dispar
SGTSSNDS

SEQ ID NO: 2374988 - protein, 10 aa, Entamoeba dispar
SGTTGTPKGV

SEQ ID NO: 2374989 - protein, 14 aa, Entamoeba dispar
SGTTQNNEYYPPTS

SEQ ID NO: 2374990 - protein, 8 aa, Entamoeba dispar
SGTYNEEE

SEQ ID NO: 2374991 - protein, 11 aa, Entamoeba dispar
SGTYSNLPQQQ

SEQ ID NO: 2374992 - protein, 11 aa, Entamoeba dispar
SGVDKGDKKEF

SEQ ID NO: 2374993 - protein, 4 aa, Entamoeba dispar
SGVE

SEQ ID NO: 2374994 - protein, 13 aa, Entamoeba dispar
SGVKANSCVWRKI

SEQ ID NO: 2374995 - protein, 5 aa, Entamoeba dispar
SGVTD

SEQ ID NO: 2374996 - protein, 8 aa, Entamoeba dispar
SGWTEGKT

SEQ ID NO: 2374997 - protein, 14 aa, Entamoeba dispar
SGYNSKGIKTENTI

SEQ ID NO: 2374998 - protein, 4 aa, Entamoeba dispar
SGYR

SEQ ID NO: 2374999 - protein, 6 aa, Entamoeba dispar
SGYTVP

SEQ ID NO: 2375000 - protein, 16 aa, Entamoeba dispar
SGYYPDGDCKNCTTIT

SEQ ID NO: 2375001 - protein, 4 aa, Entamoeba dispar
SHCT

SEQ ID NO: 2375002 - protein, 4 aa, Entamoeba dispar
SHDQ

SEQ ID NO: 2375003 - protein, 8 aa, Entamoeba dispar
SHENGLRE

SEQ ID NO: 2375004 - protein, 25 aa, Entamoeba dispar
SHESKKVDKMKTKPSHRQTISEHSQ

SEQ ID NO: 2375005 - protein, 8 aa, Entamoeba dispar
SHETGGST

SEQ ID NO: 2375006 - protein, 4 aa, Entamoeba dispar
SHFQ

SEQ ID NO: 2375007 - protein, 9 aa, Entamoeba dispar
SHGDEHGKR

SEQ ID NO: 2375008 - protein, 15 aa, Entamoeba dispar
SHGIDENKAKRHSEI

SEQ ID NO: 2375009 - protein, 6 aa, Entamoeba dispar
SHHPPV

SEQ ID NO: 2375010 - protein, 7 aa, Entamoeba dispar
SHIRGPQ

SEQ ID NO: 2375011 - protein, 4 aa, Entamoeba dispar
SHIS

SEQ ID NO: 2375012 - protein, 5 aa, Entamoeba dispar
SHKNT

SEQ ID NO: 2375013 - protein, 10 aa, Entamoeba dispar
SHNKRSKDFS

SEQ ID NO: 2375014 - protein, 5 aa, Entamoeba dispar
SHNNL

SEQ ID NO: 2375015 - protein, 7 aa, Entamoeba dispar
SHPKTDQ

SEQ ID NO: 2375016 - protein, 9 aa, Entamoeba dispar
SHQISKETS

SEQ ID NO: 2375017 - protein, 6 aa, Entamoeba dispar
SHQSQY

SEQ ID NO: 2375018 - protein, 6 aa, Entamoeba dispar
SHRDAN

SEQ ID NO: 2375019 - protein, 10 aa, Entamoeba dispar
SHRPSSNSSL

SEQ ID NO: 2375020 - protein, 5 aa, Entamoeba dispar
SHRPT

SEQ ID NO: 2375021 - protein, 13 aa, Entamoeba dispar
SHSDSLSEFFTPD

SEQ ID NO: 2375022 - protein, 18 aa, Entamoeba dispar
SHSDSPEDILSTDNMDSH

SEQ ID NO: 2375023 - protein, 8 aa, Entamoeba dispar
SHSKNTEE

SEQ ID NO: 2375024 - protein, 4 aa, Entamoeba dispar
SHSL

SEQ ID NO: 2375025 - protein, 8 aa, Entamoeba dispar
SHSPNLPS

SEQ ID NO: 2375026 - protein, 5 aa, Entamoeba dispar
SHSSN

SEQ ID NO: 2375027 - protein, 6 aa, Entamoeba dispar
SHSTKK

SEQ ID NO: 2375028 - protein, 9 aa, Entamoeba dispar
SHTGANKTL

SEQ ID NO: 2375029 - protein, 7 aa, Entamoeba dispar
SHTINPR

SEQ ID NO: 2375030 - protein, 6 aa, Entamoeba dispar
SHTNSR

SEQ ID NO: 2375031 - protein, 5 aa, Entamoeba dispar
SHTPQ

SEQ ID NO: 2375032 - protein, 7 aa, Entamoeba dispar
SIDETSK

SEQ ID NO: 2375033 - protein, 10 aa, Entamoeba dispar
SIDKRQKIEN

SEQ ID NO: 2375034 - protein, 14 aa, Entamoeba dispar
SIDKTTLDKFLFKQ

SEQ ID NO: 2375035 - protein, 5 aa, Entamoeba dispar
SIDPL

SEQ ID NO: 2375036 - protein, 4 aa, Entamoeba dispar
SIDQ

SEQ ID NO: 2375037 - protein, 7 aa, Entamoeba dispar
SIDSNGI

SEQ ID NO: 2375038 - protein, 4 aa, Entamoeba dispar
SIEC

SEQ ID NO: 2375039 - protein, 4 aa, Entamoeba dispar
SIEE

SEQ ID NO: 2375040 - protein, 4 aa, Entamoeba dispar
SIEK

SEQ ID NO: 2375041 - protein, 10 aa, Entamoeba dispar
SIEKEKNQKI

SEQ ID NO: 2375042 - protein, 4 aa, Entamoeba dispar
SIEL

SEQ ID NO: 2375043 - protein, 5 aa, Entamoeba dispar
SIEND

SEQ ID NO: 2375044 - protein, 15 aa, Entamoeba dispar
SIENSERNPKTSQPE

SEQ ID NO: 2375045 - protein, 6 aa, Entamoeba dispar
SIEPYK

SEQ ID NO: 2375046 - protein, 7 aa, Entamoeba dispar
SIEQKEE

SEQ ID NO: 2375047 - protein, 6 aa, Entamoeba dispar
SIERSA

SEQ ID NO: 2375048 - protein, 5 aa, Entamoeba dispar
SIESA

SEQ ID NO: 2375049 - protein, 5 aa, Entamoeba dispar
SIETG

SEQ ID NO: 2375050 - protein, 5 aa, Entamoeba dispar
SIETL

SEQ ID NO: 2375051 - protein, 7 aa, Entamoeba dispar
SIGAGEV

SEQ ID NO: 2375052 - protein, 9 aa, Entamoeba dispar
SIGDGEQCK

SEQ ID NO: 2375053 - protein, 5 aa, Entamoeba dispar
SIGEA

SEQ ID NO: 2375054 - protein, 10 aa, Entamoeba dispar
SIGENETKGC

SEQ ID NO: 2375055 - protein, 7 aa, Entamoeba dispar
SIGGRDT

SEQ ID NO: 2375056 - protein, 9 aa, Entamoeba dispar
SIGGTGSLK

SEQ ID NO: 2375057 - protein, 7 aa, Entamoeba dispar
SIGKPKV

SEQ ID NO: 2375058 - protein, 14 aa, Entamoeba dispar
SIGPTRKPRASFSI

SEQ ID NO: 2375059 - protein, 12 aa, Entamoeba dispar
SIGTKEGENNSL

SEQ ID NO: 2375060 - protein, 14 aa, Entamoeba dispar
SIHNYSKDKRPGHK

SEQ ID NO: 2375061 - protein, 9 aa, Entamoeba dispar
SIHSVQTTN

SEQ ID NO: 2375062 - protein, 16 aa, Entamoeba dispar
SIKADPQYFGYSDSKA

SEQ ID NO: 2375063 - protein, 6 aa, Entamoeba dispar
SIKEPT

SEQ ID NO: 2375064 - protein, 24 aa, Entamoeba dispar
SIKEQEKKKHKYSTQQTSTSNQVY

SEQ ID NO: 2375065 - protein, 7 aa, Entamoeba dispar
SIKERKD

SEQ ID NO: 2375066 - protein, 9 aa, Entamoeba dispar
SIKPGETKK

SEQ ID NO: 2375067 - protein, 14 aa, Entamoeba dispar
SIKRGKECSEENEE

SEQ ID NO: 2375068 - protein, 14 aa, Entamoeba dispar
SIKSNKDLDLPSQK

SEQ ID NO: 2375069 - protein, 8 aa, Entamoeba dispar
SIKSTGSH

SEQ ID NO: 2375070 - protein, 10 aa, Entamoeba dispar
SINDKTNSNI

SEQ ID NO: 2375071 - protein, 9 aa, Entamoeba dispar
SINEDKPYN

SEQ ID NO: 2375072 - protein, 14 aa, Entamoeba dispar
SINESMSPSSPVGR

SEQ ID NO: 2375073 - protein, 8 aa, Entamoeba dispar
SINGDKIN

SEQ ID NO: 2375074 - protein, 9 aa, Entamoeba dispar
SINGDKPHT

SEQ ID NO: 2375075 - protein, 10 aa, Entamoeba dispar
SINNSNDQFK

SEQ ID NO: 2375076 - protein, 7 aa, Entamoeba dispar
SINQNEN

SEQ ID NO: 2375077 - protein, 12 aa, Entamoeba dispar
SINSDKSKTNIN

SEQ ID NO: 2375078 - protein, 16 aa, Entamoeba dispar
SINSHSSQIPLTISSS

SEQ ID NO: 2375079 - protein, 5 aa, Entamoeba dispar
SINSS

SEQ ID NO: 2375080 - protein, 10 aa, Entamoeba dispar
SINSTEINNS

SEQ ID NO: 2375081 - protein, 5 aa, Entamoeba dispar
SINTS

SEQ ID NO: 2375082 - protein, 7 aa, Entamoeba dispar
SIPATCT

SEQ ID NO: 2375083 - protein, 6 aa, Entamoeba dispar
SIPEPD

SEQ ID NO: 2375084 - protein, 6 aa, Entamoeba dispar
SIPKNT

SEQ ID NO: 2375085 - protein, 7 aa, Entamoeba dispar
SIPKSSN

SEQ ID NO: 2375086 - protein, 7 aa, Entamoeba dispar
SIPNPEV

SEQ ID NO: 2375087 - protein, 5 aa, Entamoeba dispar
SIPNS

SEQ ID NO: 2375088 - protein, 4 aa, Entamoeba dispar
SIPQ

SEQ ID NO: 2375089 - protein, 15 aa, Entamoeba dispar
SIPRLPNPLSKYETP

SEQ ID NO: 2375090 - protein, 4 aa, Entamoeba dispar
SIPS

SEQ ID NO: 2375091 - protein, 7 aa, Entamoeba dispar
SIPSNAG

SEQ ID NO: 2375092 - protein, 4 aa, Entamoeba dispar
SIPT

SEQ ID NO: 2375093 - protein, 6 aa, Entamoeba dispar
SIPVSG

SEQ ID NO: 2375094 - protein, 7 aa, Entamoeba dispar
SIPYQSN

SEQ ID NO: 2375095 - protein, 12 aa, Entamoeba dispar
SIQEDEQEMKET

SEQ ID NO: 2375096 - protein, 8 aa, Entamoeba dispar
SIQKETSL

SEQ ID NO: 2375097 - protein, 5 aa, Entamoeba dispar
SIQQD

SEQ ID NO: 2375098 - protein, 11 aa, Entamoeba dispar
SIQQPDHSGAI

SEQ ID NO: 2375099 - protein, 7 aa, Entamoeba dispar
SIQRGGA

SEQ ID NO: 2375100 - protein, 8 aa, Entamoeba dispar
SIQSSTLQ

SEQ ID NO: 2375101 - protein, 4 aa, Entamoeba dispar
SIQT

SEQ ID NO: 2375102 - protein, 23 aa, Entamoeba dispar
SIQTSNTIPVQPSGSEISYSARS

SEQ ID NO: 2375103 - protein, 21 aa, Entamoeba dispar
SIRTTSTPPSLSTTPKEHERK

SEQ ID NO: 2375104 - protein, 9 aa, Entamoeba dispar
SISDDGELR

SEQ ID NO: 2375105 - protein, 7 aa, Entamoeba dispar
SISGGNE

SEQ ID NO: 2375106 - protein, 9 aa, Entamoeba dispar
SISGKGMEE

SEQ ID NO: 2375107 - protein, 11 aa, Entamoeba dispar
SISGKTYENGE

SEQ ID NO: 2375108 - protein, 13 aa, Entamoeba dispar
SISNCTQCQNEGN

SEQ ID NO: 2375109 - protein, 6 aa, Entamoeba dispar
SISPSG

SEQ ID NO: 2375110 - protein, 34 aa, Entamoeba dispar
SISPTISPPTIVNQDPSKQLGSVSVDDTSDDYVN

SEQ ID NO: 2375111 - protein, 15 aa, Entamoeba dispar
SISPTPVNKNKPLNT

SEQ ID NO: 2375112 - protein, 11 aa, Entamoeba dispar
SISRESTAGDA

SEQ ID NO: 2375113 - protein, 5 aa, Entamoeba dispar
SISSE

SEQ ID NO: 2375114 - protein, 9 aa, Entamoeba dispar
SISSEKEYD

SEQ ID NO: 2375115 - protein, 8 aa, Entamoeba dispar
SISSKQRL

SEQ ID NO: 2375116 - protein, 6 aa, Entamoeba dispar
SISSNR

SEQ ID NO: 2375117 - protein, 10 aa, Entamoeba dispar
SISSNYQSTS

SEQ ID NO: 2375118 - protein, 6 aa, Entamoeba dispar
SISSST

SEQ ID NO: 2375119 - protein, 6 aa, Entamoeba dispar
SISSTS

SEQ ID NO: 2375120 - protein, 9 aa, Entamoeba dispar
SISTQSDGG

SEQ ID NO: 2375121 - protein, 4 aa, Entamoeba dispar
SITD

SEQ ID NO: 2375122 - protein, 6 aa, Entamoeba dispar
SITDYP

SEQ ID NO: 2375123 - protein, 4 aa, Entamoeba dispar
SITE

SEQ ID NO: 2375124 - protein, 32 aa, Entamoeba dispar
SITERGKINELEGTAIRQDKLGSEKQISTAKR

SEQ ID NO: 2375125 - protein, 10 aa, Entamoeba dispar
SITGKPTKDL

SEQ ID NO: 2375126 - protein, 8 aa, Entamoeba dispar
SITGPTIS

SEQ ID NO: 2375127 - protein, 7 aa, Entamoeba dispar
SITGPTS

SEQ ID NO: 2375128 - protein, 5 aa, Entamoeba dispar
SITGQ

SEQ ID NO: 2375129 - protein, 7 aa, Entamoeba dispar
SITIQRN

SEQ ID NO: 2375130 - protein, 9 aa, Entamoeba dispar
SITKEGNEL

SEQ ID NO: 2375131 - protein, 10 aa, Entamoeba dispar
SITKQQSSSD

SEQ ID NO: 2375132 - protein, 7 aa, Entamoeba dispar
SITNKTI

SEQ ID NO: 2375133 - protein, 5 aa, Entamoeba dispar
SITPK

SEQ ID NO: 2375134 - protein, 7 aa, Entamoeba dispar
SITPPQL

SEQ ID NO: 2375135 - protein, 6 aa, Entamoeba dispar
SITPRH

SEQ ID NO: 2375136 - protein, 5 aa, Entamoeba dispar
SITPS

SEQ ID NO: 2375137 - protein, 11 aa, Entamoeba dispar
SITSGKRPPII

SEQ ID NO: 2375138 - protein, 11 aa, Entamoeba dispar
SITSNDPELSP

SEQ ID NO: 2375139 - protein, 5 aa, Entamoeba dispar
SITSS

SEQ ID NO: 2375140 - protein, 10 aa, Entamoeba dispar
SITTGKRPTI

SEQ ID NO: 2375141 - protein, 8 aa, Entamoeba dispar
SIVNPKGA

SEQ ID NO: 2375142 - protein, 13 aa, Entamoeba dispar
SIYNPSSGVVPSR

SEQ ID NO: 2375143 - protein, 7 aa, Entamoeba dispar
SIYTGPE

SEQ ID NO: 2375144 - protein, 8 aa, Entamoeba dispar
SKAANDAL

SEQ ID NO: 2375145 - protein, 22 aa, Entamoeba dispar
SKAFDGNTCTTGEGADTVSPTY

SEQ ID NO: 2375146 - protein, 8 aa, Entamoeba dispar
SKALEPLS

SEQ ID NO: 2375147 - protein, 7 aa, Entamoeba dispar
SKAMEND

SEQ ID NO: 2375148 - protein, 12 aa, Entamoeba dispar
SKANDNQTECDH

SEQ ID NO: 2375149 - protein, 8 aa, Entamoeba dispar
SKAVGGNV

SEQ ID NO: 2375150 - protein, 9 aa, Entamoeba dispar
SKCASTNDC

SEQ ID NO: 2375151 - protein, 14 aa, Entamoeba dispar
SKCDDNCNTCYGTK

SEQ ID NO: 2375152 - protein, 13 aa, Entamoeba dispar
SKCEEGKYLQNGS

SEQ ID NO: 2375153 - protein, 5 aa, Entamoeba dispar
SKCND

SEQ ID NO: 2375154 - protein, 9 aa, Entamoeba dispar
SKCSPNSDE

SEQ ID NO: 2375155 - protein, 7 aa, Entamoeba dispar
SKDEKDV

SEQ ID NO: 2375156 - protein, 9 aa, Entamoeba dispar
SKDFSSNGN

SEQ ID NO: 2375157 - protein, 5 aa, Entamoeba dispar
SKDIQ

SEQ ID NO: 2375158 - protein, 5 aa, Entamoeba dispar
SKDKK

SEQ ID NO: 2375159 - protein, 8 aa, Entamoeba dispar
SKDNPSMT

SEQ ID NO: 2375160 - protein, 6 aa, Entamoeba dispar
SKDQKL

SEQ ID NO: 2375161 - protein, 9 aa, Entamoeba dispar
SKDSHQNIQ

SEQ ID NO: 2375162 - protein, 9 aa, Entamoeba dispar
SKDSNHIRS

SEQ ID NO: 2375163 - protein, 6 aa, Entamoeba dispar
SKDSSV

SEQ ID NO: 2375164 - protein, 23 aa, Entamoeba dispar
SKEAAKFNSYAKQFNKKHSSNTV

SEQ ID NO: 2375165 - protein, 8 aa, Entamoeba dispar
SKEDYETF

SEQ ID NO: 2375166 - protein, 8 aa, Entamoeba dispar
SKEEDEEQ

SEQ ID NO: 2375167 - protein, 6 aa, Entamoeba dispar
SKEEDQ

SEQ ID NO: 2375168 - protein, 9 aa, Entamoeba dispar
SKEEETKVE

SEQ ID NO: 2375169 - protein, 9 aa, Entamoeba dispar
SKEESKINS

SEQ ID NO: 2375170 - protein, 5 aa, Entamoeba dispar
SKEGG

SEQ ID NO: 2375171 - protein, 8 aa, Entamoeba dispar
SKEHEQKG

SEQ ID NO: 2375172 - protein, 8 aa, Entamoeba dispar
SKEIKDKD

SEQ ID NO: 2375173 - protein, 7 aa, Entamoeba dispar
SKEKDNH

SEQ ID NO: 2375174 - protein, 9 aa, Entamoeba dispar
SKEKEGYSI

SEQ ID NO: 2375175 - protein, 15 aa, Entamoeba dispar
SKELPKINTTPQEDI

SEQ ID NO: 2375176 - protein, 6 aa, Entamoeba dispar
SKENNN

SEQ ID NO: 2375177 - protein, 7 aa, Entamoeba dispar
SKEPKLL

SEQ ID NO: 2375178 - protein, 11 aa, Entamoeba dispar
SKEPKPEDDTV

SEQ ID NO: 2375179 - protein, 5 aa, Entamoeba dispar
SKEPY

SEQ ID NO: 2375180 - protein, 8 aa, Entamoeba dispar
SKEQKDQY

SEQ ID NO: 2375181 - protein, 8 aa, Entamoeba dispar
SKEQTIQE

SEQ ID NO: 2375182 - protein, 7 aa, Entamoeba dispar
SKESFEE

SEQ ID NO: 2375183 - protein, 12 aa, Entamoeba dispar
SKESNNFDPEPL

SEQ ID NO: 2375184 - protein, 7 aa, Entamoeba dispar
SKETDCS

SEQ ID NO: 2375185 - protein, 15 aa, Entamoeba dispar
SKETDFGSEYGTTKG

SEQ ID NO: 2375186 - protein, 5 aa, Entamoeba dispar
SKFDG

SEQ ID NO: 2375187 - protein, 7 aa, Entamoeba dispar
SKFDPDE

SEQ ID NO: 2375188 - protein, 5 aa, Entamoeba dispar
SKFGT

SEQ ID NO: 2375189 - protein, 14 aa, Entamoeba dispar
SKFNPDKELGDYED

SEQ ID NO: 2375190 - protein, 10 aa, Entamoeba dispar
SKFPSNTREH

SEQ ID NO: 2375191 - protein, 8 aa, Entamoeba dispar
SKFQQGSC

SEQ ID NO: 2375192 - protein, 11 aa, Entamoeba dispar
SKFSGTKPKEW

SEQ ID NO: 2375193 - protein, 14 aa, Entamoeba dispar
SKGCEQCDSENGDC

SEQ ID NO: 2375194 - protein, 8 aa, Entamoeba dispar
SKGEGFGQ

SEQ ID NO: 2375195 - protein, 6 aa, Entamoeba dispar
SKGEVK

SEQ ID NO: 2375196 - protein, 28 aa, Entamoeba dispar
SKGFGTVSSTTTSSKQSSSPKVAEKQKS

SEQ ID NO: 2375197 - protein, 11 aa, Entamoeba dispar
SKGINSGERDE

SEQ ID NO: 2375198 - protein, 4 aa, Entamoeba dispar
SKGK

SEQ ID NO: 2375199 - protein, 7 aa, Entamoeba dispar
SKGLGIK

SEQ ID NO: 2375200 - protein, 7 aa, Entamoeba dispar
SKGNDVI

SEQ ID NO: 2375201 - protein, 7 aa, Entamoeba dispar
SKGNEVN

SEQ ID NO: 2375202 - protein, 7 aa, Entamoeba dispar
SKGTEGC

SEQ ID NO: 2375203 - protein, 6 aa, Entamoeba dispar
SKGYRT

SEQ ID NO: 2375204 - protein, 12 aa, Entamoeba dispar
SKGYTSDCQGCQ

SEQ ID NO: 2375205 - protein, 11 aa, Entamoeba dispar
SKHAKKRKEVT

SEQ ID NO: 2375206 - protein, 9 aa, Entamoeba dispar
SKHALGDYS

SEQ ID NO: 2375207 - protein, 4 aa, Entamoeba dispar
SKHD

SEQ ID NO: 2375208 - protein, 5 aa, Entamoeba dispar
SKHDQ

SEQ ID NO: 2375209 - protein, 12 aa, Entamoeba dispar
SKHHEKISKTED

SEQ ID NO: 2375210 - protein, 7 aa, Entamoeba dispar
SKHHPTK

SEQ ID NO: 2375211 - protein, 8 aa, Entamoeba dispar
SKHNTVTC

SEQ ID NO: 2375212 - protein, 5 aa, Entamoeba dispar
SKHPI

SEQ ID NO: 2375213 - protein, 10 aa, Entamoeba dispar
SKIDNSSNSV

SEQ ID NO: 2375214 - protein, 21 aa, Entamoeba dispar
SKIEEPLKEKEDKKESSQDLI

SEQ ID NO: 2375215 - protein, 9 aa, Entamoeba dispar
SKIEKKKFK

SEQ ID NO: 2375216 - protein, 6 aa, Entamoeba dispar
SKIGNN

SEQ ID NO: 2375217 - protein, 4 aa, Entamoeba dispar
SKIN

SEQ ID NO: 2375218 - protein, 14 aa, Entamoeba dispar
SKIPHSTSLNDEKV

SEQ ID NO: 2375219 - protein, 6 aa, Entamoeba dispar
SKISNG

SEQ ID NO: 2375220 - protein, 6 aa, Entamoeba dispar
SKISQY

SEQ ID NO: 2375221 - protein, 4 aa, Entamoeba dispar
SKKD

SEQ ID NO: 2375222 - protein, 9 aa, Entamoeba dispar
SKKDEKSEL

SEQ ID NO: 2375223 - protein, 8 aa, Entamoeba dispar
SKKEAYRQ

SEQ ID NO: 2375224 - protein, 6 aa, Entamoeba dispar
SKKEIY

SEQ ID NO: 2375225 - protein, 15 aa, Entamoeba dispar
SKKEKDISINEQEIE

SEQ ID NO: 2375226 - protein, 7 aa, Entamoeba dispar
SKKENQS

SEQ ID NO: 2375227 - protein, 10 aa, Entamoeba dispar
SKKESQEEKI

SEQ ID NO: 2375228 - protein, 14 aa, Entamoeba dispar
SKKFTTEKKDTQMN

SEQ ID NO: 2375229 - protein, 7 aa, Entamoeba dispar
SKKGTIE

SEQ ID NO: 2375230 - protein, 6 aa, Entamoeba dispar
SKKGVE

SEQ ID NO: 2375231 - protein, 5 aa, Entamoeba dispar
SKKGW

SEQ ID NO: 2375232 - protein, 12 aa, Entamoeba dispar
SKKIAESCDDRT

SEQ ID NO: 2375233 - protein, 5 aa, Entamoeba dispar
SKKIT

SEQ ID NO: 2375234 - protein, 7 aa, Entamoeba dispar
SKKKLQN

SEQ ID NO: 2375235 - protein, 10 aa, Entamoeba dispar
SKKKYRDETK

SEQ ID NO: 2375236 - protein, 8 aa, Entamoeba dispar
SKKPSALN

SEQ ID NO: 2375237 - protein, 14 aa, Entamoeba dispar
SKKRESKYVLFHDD

SEQ ID NO: 2375238 - protein, 16 aa, Entamoeba dispar
SKKSKNIKPSKLTPNM

SEQ ID NO: 2375239 - protein, 13 aa, Entamoeba dispar
SKKSQVDSLKDKK

SEQ ID NO: 2375240 - protein, 7 aa, Entamoeba dispar
SKKTCSR

SEQ ID NO: 2375241 - protein, 10 aa, Entamoeba dispar
SKKTEKQKAL

SEQ ID NO: 2375242 - protein, 11 aa, Entamoeba dispar
SKKTQKTKYEF

SEQ ID NO: 2375243 - protein, 9 aa, Entamoeba dispar
SKKVESEVD

SEQ ID NO: 2375244 - protein, 14 aa, Entamoeba dispar
SKKVTKKTTYPHYE

SEQ ID NO: 2375245 - protein, 4 aa, Entamoeba dispar
SKKY

SEQ ID NO: 2375246 - protein, 8 aa, Entamoeba dispar
SKKYESES

SEQ ID NO: 2375247 - protein, 12 aa, Entamoeba dispar
SKLKQKSNKDKQ

SEQ ID NO: 2375248 - protein, 16 aa, Entamoeba dispar
SKLNEKKNSEEKELDE

SEQ ID NO: 2375249 - protein, 7 aa, Entamoeba dispar
SKLSTRQ

SEQ ID NO: 2375250 - protein, 5 aa, Entamoeba dispar
SKLTG

SEQ ID NO: 2375251 - protein, 5 aa, Entamoeba dispar
SKLTN

SEQ ID NO: 2375252 - protein, 18 aa, Entamoeba dispar
SKMKDGSIIGDPAEKAAL

SEQ ID NO: 2375253 - protein, 7 aa, Entamoeba dispar
SKNCSSE

SEQ ID NO: 2375254 - protein, 27 aa, Entamoeba dispar
SKNEAAQEIQQNGIKDDEQNNKKFGEE

SEQ ID NO: 2375255 - protein, 7 aa, Entamoeba dispar
SKNEKEW

SEQ ID NO: 2375256 - protein, 8 aa, Entamoeba dispar
SKNENSRK

SEQ ID NO: 2375257 - protein, 17 aa, Entamoeba dispar
SKNGKAQSTRKEKENNL

SEQ ID NO: 2375258 - protein, 6 aa, Entamoeba dispar
SKNGYI

SEQ ID NO: 2375259 - protein, 4 aa, Entamoeba dispar
SKNI

SEQ ID NO: 2375260 - protein, 6 aa, Entamoeba dispar
SKNIKG

SEQ ID NO: 2375261 - protein, 4 aa, Entamoeba dispar
SKNK

SEQ ID NO: 2375262 - protein, 6 aa, Entamoeba dispar
SKNLKK

SEQ ID NO: 2375263 - protein, 17 aa, Entamoeba dispar
SKNMPKFADKEKISHTE

SEQ ID NO: 2375264 - protein, 9 aa, Entamoeba dispar
SKNNGELDT

SEQ ID NO: 2375265 - protein, 6 aa, Entamoeba dispar
SKNSIW

SEQ ID NO: 2375266 - protein, 7 aa, Entamoeba dispar
SKNSNDF

SEQ ID NO: 2375267 - protein, 8 aa, Entamoeba dispar
SKNSRCTQ

SEQ ID NO: 2375268 - protein, 9 aa, Entamoeba dispar
SKNSSTSLQ

SEQ ID NO: 2375269 - protein, 5 aa, Entamoeba dispar
SKNYL

SEQ ID NO: 2375270 - protein, 7 aa, Entamoeba dispar
SKNYRDD

SEQ ID NO: 2375271 - protein, 29 aa, Entamoeba dispar
SKPAPPLPSKKESTQIRSRSSSDNGIISQ

SEQ ID NO: 2375272 - protein, 4 aa, Entamoeba dispar
SKPC

SEQ ID NO: 2375273 - protein, 5 aa, Entamoeba dispar
SKPDL

SEQ ID NO: 2375274 - protein, 6 aa, Entamoeba dispar
SKPIDL

SEQ ID NO: 2375275 - protein, 15 aa, Entamoeba dispar
SKPKELTESYPQLPN

SEQ ID NO: 2375276 - protein, 4 aa, Entamoeba dispar
SKPL

SEQ ID NO: 2375277 - protein, 7 aa, Entamoeba dispar
SKPLTSL

SEQ ID NO: 2375278 - protein, 8 aa, Entamoeba dispar
SKPSEMKN

SEQ ID NO: 2375279 - protein, 11 aa, Entamoeba dispar
SKPSESTSLSG

SEQ ID NO: 2375280 - protein, 20 aa, Entamoeba dispar
SKPSGEISKSCGGYPEDSGT

SEQ ID NO: 2375281 - protein, 9 aa, Entamoeba dispar
SKPSRQEEK

SEQ ID NO: 2375282 - protein, 5 aa, Entamoeba dispar
SKPTF

SEQ ID NO: 2375283 - protein, 9 aa, Entamoeba dispar
SKPVPPSQC

SEQ ID NO: 2375284 - protein, 13 aa, Entamoeba dispar
SKQEKKLKKQYSE

SEQ ID NO: 2375285 - protein, 4 aa, Entamoeba dispar
SKQI

SEQ ID NO: 2375286 - protein, 4 aa, Entamoeba dispar
SKQL

SEQ ID NO: 2375287 - protein, 18 aa, Entamoeba dispar
SKQLDKYSAKYGTMTGSN

SEQ ID NO: 2375288 - protein, 7 aa, Entamoeba dispar
SKQLTSL

SEQ ID NO: 2375289 - protein, 4 aa, Entamoeba dispar
SKQP

SEQ ID NO: 2375290 - protein, 7 aa, Entamoeba dispar
SKQRPRK

SEQ ID NO: 2375291 - protein, 9 aa, Entamoeba dispar
SKQSSQTNC

SEQ ID NO: 2375292 - protein, 11 aa, Entamoeba dispar
SKQSVDYAQTV

SEQ ID NO: 2375293 - protein, 13 aa, Entamoeba dispar
SKQVQSIQTAAEN

SEQ ID NO: 2375294 - protein, 10 aa, Entamoeba dispar
SKRETKDGFN

SEQ ID NO: 2375295 - protein, 4 aa, Entamoeba dispar
SKRF

SEQ ID NO: 2375296 - protein, 8 aa, Entamoeba dispar
SKRGLSTN

SEQ ID NO: 2375297 - protein, 4 aa, Entamoeba dispar
SKRI

SEQ ID NO: 2375298 - protein, 10 aa, Entamoeba dispar
SKRKGKGSKI

SEQ ID NO: 2375299 - protein, 13 aa, Entamoeba dispar
SKRKLRADDFKPL

SEQ ID NO: 2375300 - protein, 6 aa, Entamoeba dispar
SKRPTF

SEQ ID NO: 2375301 - protein, 4 aa, Entamoeba dispar
SKRS

SEQ ID NO: 2375302 - protein, 9 aa, Entamoeba dispar
SKRSDSKMK

SEQ ID NO: 2375303 - protein, 8 aa, Entamoeba dispar
SKRSFENK

SEQ ID NO: 2375304 - protein, 9 aa, Entamoeba dispar
SKRTTKPTT

SEQ ID NO: 2375305 - protein, 24 aa, Entamoeba dispar
SKRVDESVKELRRSESNTSIQTPK

SEQ ID NO: 2375306 - protein, 9 aa, Entamoeba dispar
SKRYSPELS

SEQ ID NO: 2375307 - protein, 26 aa, Entamoeba dispar
SKSAPSSKTPSPGLNRNQSSTKLHPG

SEQ ID NO: 2375308 - protein, 9 aa, Entamoeba dispar
SKSASSRVT

SEQ ID NO: 2375309 - protein, 7 aa, Entamoeba dispar
SKSEDPV

SEQ ID NO: 2375310 - protein, 5 aa, Entamoeba dispar
SKSES

SEQ ID NO: 2375311 - protein, 7 aa, Entamoeba dispar
SKSFSSE

SEQ ID NO: 2375312 - protein, 6 aa, Entamoeba dispar
SKSGNI

SEQ ID NO: 2375313 - protein, 6 aa, Entamoeba dispar
SKSINK

SEQ ID NO: 2375314 - protein, 4 aa, Entamoeba dispar
SKSK

SEQ ID NO: 2375315 - protein, 7 aa, Entamoeba dispar
SKSKEIG

SEQ ID NO: 2375316 - protein, 9 aa, Entamoeba dispar
SKSKKKVEE

SEQ ID NO: 2375317 - protein, 11 aa, Entamoeba dispar
SKSLAEGQKGA

SEQ ID NO: 2375318 - protein, 15 aa, Entamoeba dispar
SKSLFEEQQTAPQIQ

SEQ ID NO: 2375319 - protein, 12 aa, Entamoeba dispar
SKSLNKQYKQQP

SEQ ID NO: 2375320 - protein, 10 aa, Entamoeba dispar
SKSLSNGPVS

SEQ ID NO: 2375321 - protein, 6 aa, Entamoeba dispar
SKSNKL

SEQ ID NO: 2375322 - protein, 9 aa, Entamoeba dispar
SKSNSYGMT

SEQ ID NO: 2375323 - protein, 7 aa, Entamoeba dispar
SKSPFIN

SEQ ID NO: 2375324 - protein, 9 aa, Entamoeba dispar
SKSPIDSSN

SEQ ID NO: 2375325 - protein, 12 aa, Entamoeba dispar
SKSPSYDRRKTA

SEQ ID NO: 2375326 - protein, 10 aa, Entamoeba dispar
SKSQSESRNK

SEQ ID NO: 2375327 - protein, 5 aa, Entamoeba dispar
SKSRI

SEQ ID NO: 2375328 - protein, 9 aa, Entamoeba dispar
SKSRSGFNS

SEQ ID NO: 2375329 - protein, 8 aa, Entamoeba dispar
SKSSTEPL

SEQ ID NO: 2375330 - protein, 16 aa, Entamoeba dispar
SKSTDSNTFDSTSFNN

SEQ ID NO: 2375331 - protein, 7 aa, Entamoeba dispar
SKSTLQE

SEQ ID NO: 2375332 - protein, 6 aa, Entamoeba dispar
SKSTMF

SEQ ID NO: 2375333 - protein, 6 aa, Entamoeba dispar
SKTDSL

SEQ ID NO: 2375334 - protein, 6 aa, Entamoeba dispar
SKTEPY

SEQ ID NO: 2375335 - protein, 15 aa, Entamoeba dispar
SKTFNDTKESKGRIE

SEQ ID NO: 2375336 - protein, 10 aa, Entamoeba dispar
SKTFNQQNKS

SEQ ID NO: 2375337 - protein, 6 aa, Entamoeba dispar
SKTFSN

SEQ ID NO: 2375338 - protein, 11 aa, Entamoeba dispar
SKTHSSNPLTQ

SEQ ID NO: 2375339 - protein, 5 aa, Entamoeba dispar
SKTLR

SEQ ID NO: 2375340 - protein, 9 aa, Entamoeba dispar
SKTMSEEGR

SEQ ID NO: 2375341 - protein, 8 aa, Entamoeba dispar
SKTNDDFT

SEQ ID NO: 2375342 - protein, 8 aa, Entamoeba dispar
SKTNEIQR

SEQ ID NO: 2375343 - protein, 8 aa, Entamoeba dispar
SKTPRVSQ

SEQ ID NO: 2375344 - protein, 4 aa, Entamoeba dispar
SKTQ

SEQ ID NO: 2375345 - protein, 6 aa, Entamoeba dispar
SKTQKR

SEQ ID NO: 2375346 - protein, 32 aa, Entamoeba dispar
SKTRTERLHEEEENTKRIKEFERRKQEIRKLE

SEQ ID NO: 2375347 - protein, 9 aa, Entamoeba dispar
SKTSDGLTN

SEQ ID NO: 2375348 - protein, 7 aa, Entamoeba dispar
SKTTKIK

SEQ ID NO: 2375349 - protein, 6 aa, Entamoeba dispar
SKTYNT

SEQ ID NO: 2375350 - protein, 9 aa, Entamoeba dispar
SKVAGEGEH

SEQ ID NO: 2375351 - protein, 16 aa, Entamoeba dispar
SKVAPTLPEKDTKNIQ

SEQ ID NO: 2375352 - protein, 5 aa, Entamoeba dispar
SKVEC

SEQ ID NO: 2375353 - protein, 4 aa, Entamoeba dispar
SKVI

SEQ ID NO: 2375354 - protein, 4 aa, Entamoeba dispar
SKVT

SEQ ID NO: 2375355 - protein, 7 aa, Entamoeba dispar
SKWNTED

SEQ ID NO: 2375356 - protein, 6 aa, Entamoeba dispar
SKYDSV

SEQ ID NO: 2375357 - protein, 8 aa, Entamoeba dispar
SKYETDNT

SEQ ID NO: 2375358 - protein, 7 aa, Entamoeba dispar
SKYNEMN

SEQ ID NO: 2375359 - protein, 7 aa, Entamoeba dispar
SKYNNNN

SEQ ID NO: 2375360 - protein, 5 aa, Entamoeba dispar
SKYNS

SEQ ID NO: 2375361 - protein, 18 aa, Entamoeba dispar
SKYSNNSKKSIQEYSNLE

SEQ ID NO: 2375362 - protein, 7 aa, Entamoeba dispar
SKYSNTN

SEQ ID NO: 2375363 - protein, 8 aa, Entamoeba dispar
SKYSSNKL

SEQ ID NO: 2375364 - protein, 7 aa, Entamoeba dispar
SKYSTQI

SEQ ID NO: 2375365 - protein, 12 aa, Entamoeba dispar
SLADKATSIPPQ

SEQ ID NO: 2375366 - protein, 5 aa, Entamoeba dispar
SLDEL

SEQ ID NO: 2375367 - protein, 8 aa, Entamoeba dispar
SLDEPEAK

SEQ ID NO: 2375368 - protein, 10 aa, Entamoeba dispar
SLDFPSTTSA

SEQ ID NO: 2375369 - protein, 5 aa, Entamoeba dispar
SLDGT

SEQ ID NO: 2375370 - protein, 8 aa, Entamoeba dispar
SLDKDSQF

SEQ ID NO: 2375371 - protein, 9 aa, Entamoeba dispar
SLDNQKKRQ

SEQ ID NO: 2375372 - protein, 9 aa, Entamoeba dispar
SLDPPPNHS

SEQ ID NO: 2375373 - protein, 9 aa, Entamoeba dispar
SLDSSLRPI

SEQ ID NO: 2375374 - protein, 17 aa, Entamoeba dispar
SLEGQTDDKKNQSIKED

SEQ ID NO: 2375375 - protein, 8 aa, Entamoeba dispar
SLEGQTYT

SEQ ID NO: 2375376 - protein, 13 aa, Entamoeba dispar
SLEISEKMSSDKL

SEQ ID NO: 2375377 - protein, 9 aa, Entamoeba dispar
SLEKDGIAP

SEQ ID NO: 2375378 - protein, 14 aa, Entamoeba dispar
SLEKEDSEKSNSSL

SEQ ID NO: 2375379 - protein, 8 aa, Entamoeba dispar
SLELTTNN

SEQ ID NO: 2375380 - protein, 12 aa, Entamoeba dispar
SLENTSTLDEGV

SEQ ID NO: 2375381 - protein, 4 aa, Entamoeba dispar
SLFN

SEQ ID NO: 2375382 - protein, 4 aa, Entamoeba dispar
SLGA

SEQ ID NO: 2375383 - protein, 16 aa, Entamoeba dispar
SLGANKFEGIEIIPLD

SEQ ID NO: 2375384 - protein, 6 aa, Entamoeba dispar
SLGATI

SEQ ID NO: 2375385 - protein, 12 aa, Entamoeba dispar
SLGDYSKKCNAY

SEQ ID NO: 2375386 - protein, 5 aa, Entamoeba dispar
SLGET

SEQ ID NO: 2375387 - protein, 8 aa, Entamoeba dispar
SLGETDVD

SEQ ID NO: 2375388 - protein, 7 aa, Entamoeba dispar
SLGGASV

SEQ ID NO: 2375389 - protein, 10 aa, Entamoeba dispar
SLGVDKKVGN

SEQ ID NO: 2375390 - protein, 4 aa, Entamoeba dispar
SLGY

SEQ ID NO: 2375391 - protein, 9 aa, Entamoeba dispar
SLHSSDNSV

SEQ ID NO: 2375392 - protein, 5 aa, Entamoeba dispar
SLIGN

SEQ ID NO: 2375393 - protein, 20 aa, Entamoeba dispar
SLIGTEKRRGISGGEKKRVS

SEQ ID NO: 2375394 - protein, 12 aa, Entamoeba dispar
SLKENKYKPNEI

SEQ ID NO: 2375395 - protein, 7 aa, Entamoeba dispar
SLKKGIN

SEQ ID NO: 2375396 - protein, 9 aa, Entamoeba dispar
SLKSEDATL

SEQ ID NO: 2375397 - protein, 8 aa, Entamoeba dispar
SLKSSNNL

SEQ ID NO: 2375398 - protein, 5 aa, Entamoeba dispar
SLNEE

SEQ ID NO: 2375399 - protein, 7 aa, Entamoeba dispar
SLNEVGN

SEQ ID NO: 2375400 - protein, 14 aa, Entamoeba dispar
SLNIQGQKVEYPES

SEQ ID NO: 2375401 - protein, 13 aa, Entamoeba dispar
SLNITTGKWRVNL

SEQ ID NO: 2375402 - protein, 11 aa, Entamoeba dispar
SLNKREINDEE

SEQ ID NO: 2375403 - protein, 19 aa, Entamoeba dispar
SLNLPSQSTLYQNSSHSLS

SEQ ID NO: 2375404 - protein, 6 aa, Entamoeba dispar
SLNPNR

SEQ ID NO: 2375405 - protein, 7 aa, Entamoeba dispar
SLNPSTH

SEQ ID NO: 2375406 - protein, 6 aa, Entamoeba dispar
SLNSIS

SEQ ID NO: 2375407 - protein, 9 aa, Entamoeba dispar
SLNSKDINT

SEQ ID NO: 2375408 - protein, 8 aa, Entamoeba dispar
SLNSKKKQ

SEQ ID NO: 2375409 - protein, 12 aa, Entamoeba dispar
SLNSNAGYNKLD

SEQ ID NO: 2375410 - protein, 11 aa, Entamoeba dispar
SLNSTSGSLDE

SEQ ID NO: 2375411 - protein, 6 aa, Entamoeba dispar
SLNTEE

SEQ ID NO: 2375412 - protein, 6 aa, Entamoeba dispar
SLNTTE

SEQ ID NO: 2375413 - protein, 5 aa, Entamoeba dispar
SLNTW

SEQ ID NO: 2375414 - protein, 12 aa, Entamoeba dispar
SLPDGTSLTIGN

SEQ ID NO: 2375415 - protein, 12 aa, Entamoeba dispar
SLPEEKRKEVKS

SEQ ID NO: 2375416 - protein, 16 aa, Entamoeba dispar
SLPEKSSLLNIVNESS

SEQ ID NO: 2375417 - protein, 6 aa, Entamoeba dispar
SLPFSR

SEQ ID NO: 2375418 - protein, 8 aa, Entamoeba dispar
SLPGPQEK

SEQ ID NO: 2375419 - protein, 7 aa, Entamoeba dispar
SLPKRSE

SEQ ID NO: 2375420 - protein, 21 aa, Entamoeba dispar
SLPKSWRGKENEELEEACGEK

SEQ ID NO: 2375421 - protein, 7 aa, Entamoeba dispar
SLPKTLE

SEQ ID NO: 2375422 - protein, 7 aa, Entamoeba dispar
SLPNNTN

SEQ ID NO: 2375423 - protein, 4 aa, Entamoeba dispar
SLPP

SEQ ID NO: 2375424 - protein, 6 aa, Entamoeba dispar
SLPPNL

SEQ ID NO: 2375425 - protein, 17 aa, Entamoeba dispar
SLPPNTHVKTTQKYNST

SEQ ID NO: 2375426 - protein, 5 aa, Entamoeba dispar
SLPPS

SEQ ID NO: 2375427 - protein, 9 aa, Entamoeba dispar
SLPPSDERQ

SEQ ID NO: 2375428 - protein, 8 aa, Entamoeba dispar
SLPSEKHL

SEQ ID NO: 2375429 - protein, 9 aa, Entamoeba dispar
SLPSNNEEF

SEQ ID NO: 2375430 - protein, 9 aa, Entamoeba dispar
SLPSSKFPT

SEQ ID NO: 2375431 - protein, 5 aa, Entamoeba dispar
SLPSV

SEQ ID NO: 2375432 - protein, 5 aa, Entamoeba dispar
SLPSY

SEQ ID NO: 2375433 - protein, 6 aa, Entamoeba dispar
SLPSYT

SEQ ID NO: 2375434 - protein, 4 aa, Entamoeba dispar
SLPT

SEQ ID NO: 2375435 - protein, 8 aa, Entamoeba dispar
SLPVDGEG

SEQ ID NO: 2375436 - protein, 26 aa, Entamoeba dispar
SLPVTSLTPPSLPQPVHQTQPLQQPN

SEQ ID NO: 2375437 - protein, 6 aa, Entamoeba dispar
SLQNGA

SEQ ID NO: 2375438 - protein, 7 aa, Entamoeba dispar
SLQNKLH

SEQ ID NO: 2375439 - protein, 5 aa, Entamoeba dispar
SLQRE

SEQ ID NO: 2375440 - protein, 19 aa, Entamoeba dispar
SLRKKNVNKDQSKSQLTST

SEQ ID NO: 2375441 - protein, 8 aa, Entamoeba dispar
SLRPGQSV

SEQ ID NO: 2375442 - protein, 11 aa, Entamoeba dispar
SLRPQPNPSPL

SEQ ID NO: 2375443 - protein, 5 aa, Entamoeba dispar
SLSCK

SEQ ID NO: 2375444 - protein, 10 aa, Entamoeba dispar
SLSDEHSDDL

SEQ ID NO: 2375445 - protein, 8 aa, Entamoeba dispar
SLSENTIK

SEQ ID NO: 2375446 - protein, 39 aa, Entamoeba dispar
SLSHSTPNVSKPTVPPKPLTMSTEKIKSNKERPTLPKKS

SEQ ID NO: 2375447 - protein, 5 aa, Entamoeba dispar
SLSID

SEQ ID NO: 2375448 - protein, 12 aa, Entamoeba dispar
SLSKKNSKQTIP

SEQ ID NO: 2375449 - protein, 8 aa, Entamoeba dispar
SLSNGSYK

SEQ ID NO: 2375450 - protein, 10 aa, Entamoeba dispar
SLSPSPDRLS

SEQ ID NO: 2375451 - protein, 5 aa, Entamoeba dispar
SLSQQ

SEQ ID NO: 2375452 - protein, 8 aa, Entamoeba dispar
SLSSDSVA

SEQ ID NO: 2375453 - protein, 10 aa, Entamoeba dispar
SLSSDYKDQF

SEQ ID NO: 2375454 - protein, 10 aa, Entamoeba dispar
SLSSEHSDDL

SEQ ID NO: 2375455 - protein, 17 aa, Entamoeba dispar
SLSSQETAPIGIGYVVT

SEQ ID NO: 2375456 - protein, 11 aa, Entamoeba dispar
SLTDAVDEAKG

SEQ ID NO: 2375457 - protein, 6 aa, Entamoeba dispar
SLTDSC

SEQ ID NO: 2375458 - protein, 4 aa, Entamoeba dispar
SLTE

SEQ ID NO: 2375459 - protein, 12 aa, Entamoeba dispar
SLTGAKQKETPL

SEQ ID NO: 2375460 - protein, 6 aa, Entamoeba dispar
SLTGEW

SEQ ID NO: 2375461 - protein, 6 aa, Entamoeba dispar
SLTGRE

SEQ ID NO: 2375462 - protein, 10 aa, Entamoeba dispar
SLTLSGNSSV

SEQ ID NO: 2375463 - protein, 7 aa, Entamoeba dispar
SLTNNRK

SEQ ID NO: 2375464 - protein, 7 aa, Entamoeba dispar
SLTPTTK

SEQ ID NO: 2375465 - protein, 6 aa, Entamoeba dispar
SLTTLS

SEQ ID NO: 2375466 - protein, 5 aa, Entamoeba dispar
SLTVP

SEQ ID NO: 2375467 - protein, 11 aa, Entamoeba dispar
SLVSKSGSTVK

SEQ ID NO: 2375468 - protein, 10 aa, Entamoeba dispar
SLYGNKKAKM

SEQ ID NO: 2375469 - protein, 8 aa, Entamoeba dispar
SLYTNQNQ

SEQ ID NO: 2375470 - protein, 4 aa, Entamoeba dispar
SMAT

SEQ ID NO: 2375471 - protein, 5 aa, Entamoeba dispar
SMDDG

SEQ ID NO: 2375472 - protein, 10 aa, Entamoeba dispar
SMDGKSKINL

SEQ ID NO: 2375473 - protein, 8 aa, Entamoeba dispar
SMDSGDSV

SEQ ID NO: 2375474 - protein, 15 aa, Entamoeba dispar
SMESSPAEKAYEESG

SEQ ID NO: 2375475 - protein, 4 aa, Entamoeba dispar
SMPK

SEQ ID NO: 2375476 - protein, 16 aa, Entamoeba dispar
SMPPCASASGSTSRVT

SEQ ID NO: 2375477 - protein, 5 aa, Entamoeba dispar
SMPTT

SEQ ID NO: 2375478 - protein, 6 aa, Entamoeba dispar
SMPYGQ

SEQ ID NO: 2375479 - protein, 6 aa, Entamoeba dispar
SMPYSN

SEQ ID NO: 2375480 - protein, 15 aa, Entamoeba dispar
SMQSSPAEKAYEESG

SEQ ID NO: 2375481 - protein, 9 aa, Entamoeba dispar
SMQSSTSSS

SEQ ID NO: 2375482 - protein, 12 aa, Entamoeba dispar
SMSITNEPTNIN

SEQ ID NO: 2375483 - protein, 5 aa, Entamoeba dispar
SMSPY

SEQ ID NO: 2375484 - protein, 10 aa, Entamoeba dispar
SMTENDRRKP

SEQ ID NO: 2375485 - protein, 5 aa, Entamoeba dispar
SMTTH

SEQ ID NO: 2375486 - protein, 4 aa, Entamoeba dispar
SMTW

SEQ ID NO: 2375487 - protein, 12 aa, Entamoeba dispar
SMYATHDGNQVT

SEQ ID NO: 2375488 - protein, 16 aa, Entamoeba dispar
SNADEIKSTYNKNIKK

SEQ ID NO: 2375489 - protein, 6 aa, Entamoeba dispar
SNAEAL

SEQ ID NO: 2375490 - protein, 8 aa, Entamoeba dispar
SNAESKLT

SEQ ID NO: 2375491 - protein, 6 aa, Entamoeba dispar
SNASKN

SEQ ID NO: 2375492 - protein, 8 aa, Entamoeba dispar
SNATYNGK

SEQ ID NO: 2375493 - protein, 4 aa, Entamoeba dispar
SNAV

SEQ ID NO: 2375494 - protein, 7 aa, Entamoeba dispar
SNCENSK

SEQ ID NO: 2375495 - protein, 8 aa, Entamoeba dispar
SNCKVTDQ

SEQ ID NO: 2375496 - protein, 11 aa, Entamoeba dispar
SNDDKNFNAVK

SEQ ID NO: 2375497 - protein, 9 aa, Entamoeba dispar
SNDDLNTNS

SEQ ID NO: 2375498 - protein, 13 aa, Entamoeba dispar
SNDDSPECGSSAS

SEQ ID NO: 2375499 - protein, 5 aa, Entamoeba dispar
SNDEI

SEQ ID NO: 2375500 - protein, 9 aa, Entamoeba dispar
SNDGKLSVA

SEQ ID NO: 2375501 - protein, 8 aa, Entamoeba dispar
SNDGKYNV

SEQ ID NO: 2375502 - protein, 14 aa, Entamoeba dispar
SNDGSLIQRSLIYF

SEQ ID NO: 2375503 - protein, 7 aa, Entamoeba dispar
SNDIEAN

SEQ ID NO: 2375504 - protein, 12 aa, Entamoeba dispar
SNDQMPQYERSI

SEQ ID NO: 2375505 - protein, 5 aa, Entamoeba dispar
SNDRG

SEQ ID NO: 2375506 - protein, 5 aa, Entamoeba dispar
SNDYT

SEQ ID NO: 2375507 - protein, 15 aa, Entamoeba dispar
SNECNPKSKLSTKTF

SEQ ID NO: 2375508 - protein, 7 aa, Entamoeba dispar
SNEEMEE

SEQ ID NO: 2375509 - protein, 7 aa, Entamoeba dispar
SNEEYTK

SEQ ID NO: 2375510 - protein, 8 aa, Entamoeba dispar
SNEIEDNQ

SEQ ID NO: 2375511 - protein, 8 aa, Entamoeba dispar
SNEITTTS

SEQ ID NO: 2375512 - protein, 10 aa, Entamoeba dispar
SNEITTTSDI

SEQ ID NO: 2375513 - protein, 5 aa, Entamoeba dispar
SNEKQ

SEQ ID NO: 2375514 - protein, 15 aa, Entamoeba dispar
SNENDLSSPSESSSS

SEQ ID NO: 2375515 - protein, 9 aa, Entamoeba dispar
SNENKSNNI

SEQ ID NO: 2375516 - protein, 7 aa, Entamoeba dispar
SNENPNL

SEQ ID NO: 2375517 - protein, 19 aa, Entamoeba dispar
SNENYTNINNKRNEYGDKY

SEQ ID NO: 2375518 - protein, 10 aa, Entamoeba dispar
SNEQMTSSDG

SEQ ID NO: 2375519 - protein, 7 aa, Entamoeba dispar
SNERNQD

SEQ ID NO: 2375520 - protein, 7 aa, Entamoeba dispar
SNESFQE

SEQ ID NO: 2375521 - protein, 6 aa, Entamoeba dispar
SNESQC

SEQ ID NO: 2375522 - protein, 4 aa, Entamoeba dispar
SNET

SEQ ID NO: 2375523 - protein, 8 aa, Entamoeba dispar
SNEWTENN

SEQ ID NO: 2375524 - protein, 4 aa, Entamoeba dispar
SNEY

SEQ ID NO: 2375525 - protein, 11 aa, Entamoeba dispar
SNFPNNDQSKY

SEQ ID NO: 2375526 - protein, 7 aa, Entamoeba dispar
SNFSSSK

SEQ ID NO: 2375527 - protein, 9 aa, Entamoeba dispar
SNGECKRDS

SEQ ID NO: 2375528 - protein, 7 aa, Entamoeba dispar
SNGEKCD

SEQ ID NO: 2375529 - protein, 7 aa, Entamoeba dispar
SNGIPDT

SEQ ID NO: 2375530 - protein, 8 aa, Entamoeba dispar
SNGKCSEC

SEQ ID NO: 2375531 - protein, 9 aa, Entamoeba dispar
SNGKSLKEN

SEQ ID NO: 2375532 - protein, 8 aa, Entamoeba dispar
SNGLSVGE

SEQ ID NO: 2375533 - protein, 7 aa, Entamoeba dispar
SNGMSGG

SEQ ID NO: 2375534 - protein, 9 aa, Entamoeba dispar
SNGNSENAV

SEQ ID NO: 2375535 - protein, 11 aa, Entamoeba dispar
SNGPIPSESLP

SEQ ID NO: 2375536 - protein, 5 aa, Entamoeba dispar
SNGQY

SEQ ID NO: 2375537 - protein, 9 aa, Entamoeba dispar
SNGSPGQYT

SEQ ID NO: 2375538 - protein, 6 aa, Entamoeba dispar
SNGSWN

SEQ ID NO: 2375539 - protein, 8 aa, Entamoeba dispar
SNGTCSPC

SEQ ID NO: 2375540 - protein, 5 aa, Entamoeba dispar
SNGYG

SEQ ID NO: 2375541 - protein, 8 aa, Entamoeba dispar
SNGYHSGM

SEQ ID NO: 2375542 - protein, 8 aa, Entamoeba dispar
SNHESNIR

SEQ ID NO: 2375543 - protein, 6 aa, Entamoeba dispar
SNIDSC

SEQ ID NO: 2375544 - protein, 5 aa, Entamoeba dispar
SNIEK

SEQ ID NO: 2375545 - protein, 26 aa, Entamoeba dispar
SNIKQSDSSYSRQSNITNNINTPQIE

SEQ ID NO: 2375546 - protein, 6 aa, Entamoeba dispar
SNIPNN

SEQ ID NO: 2375547 - protein, 8 aa, Entamoeba dispar
SNIPPSVQ

SEQ ID NO: 2375548 - protein, 8 aa, Entamoeba dispar
SNIQNQTE

SEQ ID NO: 2375549 - protein, 33 aa, Entamoeba dispar
SNISNKSGGSDKNSSHEQSQQSSKSSKKHHTER

SEQ ID NO: 2375550 - protein, 17 aa, Entamoeba dispar
SNISQLSSENTSKVSFS

SEQ ID NO: 2375551 - protein, 23 aa, Entamoeba dispar
SNKAHLEDHETDPLLPSEDDLAP

SEQ ID NO: 2375552 - protein, 8 aa, Entamoeba dispar
SNKCEPSY

SEQ ID NO: 2375553 - protein, 9 aa, Entamoeba dispar
SNKECKYNS

SEQ ID NO: 2375554 - protein, 16 aa, Entamoeba dispar
SNKENCKKCSTNSSEC

SEQ ID NO: 2375555 - protein, 4 aa, Entamoeba dispar
SNKG

SEQ ID NO: 2375556 - protein, 6 aa, Entamoeba dispar
SNKGIR

SEQ ID NO: 2375557 - protein, 5 aa, Entamoeba dispar
SNKGK

SEQ ID NO: 2375558 - protein, 5 aa, Entamoeba dispar
SNKKI

SEQ ID NO: 2375559 - protein, 6 aa, Entamoeba dispar
SNKKIK

SEQ ID NO: 2375560 - protein, 4 aa, Entamoeba dispar
SNKN

SEQ ID NO: 2375561 - protein, 10 aa, Entamoeba dispar
SNKNPGATTH

SEQ ID NO: 2375562 - protein, 8 aa, Entamoeba dispar
SNKPPYEI

SEQ ID NO: 2375563 - protein, 8 aa, Entamoeba dispar
SNKPTTQG

SEQ ID NO: 2375564 - protein, 6 aa, Entamoeba dispar
SNKQTE

SEQ ID NO: 2375565 - protein, 6 aa, Entamoeba dispar
SNKSEL

SEQ ID NO: 2375566 - protein, 7 aa, Entamoeba dispar
SNKSPFS

SEQ ID NO: 2375567 - protein, 7 aa, Entamoeba dispar
SNKSQNE

SEQ ID NO: 2375568 - protein, 9 aa, Entamoeba dispar
SNKSSPKNI

SEQ ID NO: 2375569 - protein, 8 aa, Entamoeba dispar
SNKSYDPF

SEQ ID NO: 2375570 - protein, 6 aa, Entamoeba dispar
SNKTIT

SEQ ID NO: 2375571 - protein, 10 aa, Entamoeba dispar
SNKTQRSGTL

SEQ ID NO: 2375572 - protein, 8 aa, Entamoeba dispar
SNKTSTYI

SEQ ID NO: 2375573 - protein, 4 aa, Entamoeba dispar
SNLI

SEQ ID NO: 2375574 - protein, 4 aa, Entamoeba dispar
SNLN

SEQ ID NO: 2375575 - protein, 9 aa, Entamoeba dispar
SNLQTSSTS

SEQ ID NO: 2375576 - protein, 9 aa, Entamoeba dispar
SNLTQSETF

SEQ ID NO: 2375577 - protein, 7 aa, Entamoeba dispar
SNMDTPG

SEQ ID NO: 2375578 - protein, 5 aa, Entamoeba dispar
SNNAG

SEQ ID NO: 2375579 - protein, 11 aa, Entamoeba dispar
SNNEIRSTAEK

SEQ ID NO: 2375580 - protein, 20 aa, Entamoeba dispar
SNNEQKRYSCDTTGGLKQRS

SEQ ID NO: 2375581 - protein, 6 aa, Entamoeba dispar
SNNIAS

SEQ ID NO: 2375582 - protein, 12 aa, Entamoeba dispar
SNNIPQNGYNRV

SEQ ID NO: 2375583 - protein, 13 aa, Entamoeba dispar
SNNKTTKNKEINE

SEQ ID NO: 2375584 - protein, 8 aa, Entamoeba dispar
SNNPNEFK

SEQ ID NO: 2375585 - protein, 8 aa, Entamoeba dispar
SNNPPQGE

SEQ ID NO: 2375586 - protein, 10 aa, Entamoeba dispar
SNNPTNVDTL

SEQ ID NO: 2375587 - protein, 8 aa, Entamoeba dispar
SNNQIEKI

SEQ ID NO: 2375588 - protein, 9 aa, Entamoeba dispar
SNNQISTLS

SEQ ID NO: 2375589 - protein, 8 aa, Entamoeba dispar
SNNRGGSF

SEQ ID NO: 2375590 - protein, 15 aa, Entamoeba dispar
SNNSTRISFTGTENT

SEQ ID NO: 2375591 - protein, 6 aa, Entamoeba dispar
SNNTLE

SEQ ID NO: 2375592 - protein, 16 aa, Entamoeba dispar
SNNTLSTQVSGKNDYY

SEQ ID NO: 2375593 - protein, 14 aa, Entamoeba dispar
SNNTNDSNSVPSES

SEQ ID NO: 2375594 - protein, 7 aa, Entamoeba dispar
SNNTNTT

SEQ ID NO: 2375595 - protein, 9 aa, Entamoeba dispar
SNNYREPGS

SEQ ID NO: 2375596 - protein, 8 aa, Entamoeba dispar
SNNYSPSE

SEQ ID NO: 2375597 - protein, 9 aa, Entamoeba dispar
SNPDERPSF

SEQ ID NO: 2375598 - protein, 7 aa, Entamoeba dispar
SNPDLEN

SEQ ID NO: 2375599 - protein, 5 aa, Entamoeba dispar
SNPEQ

SEQ ID NO: 2375600 - protein, 5 aa, Entamoeba dispar
SNPGI

SEQ ID NO: 2375601 - protein, 6 aa, Entamoeba dispar
SNPHNQ

SEQ ID NO: 2375602 - protein, 7 aa, Entamoeba dispar
SNPKILS

SEQ ID NO: 2375603 - protein, 8 aa, Entamoeba dispar
SNPLPDPE

SEQ ID NO: 2375604 - protein, 4 aa, Entamoeba dispar
SNPN

SEQ ID NO: 2375605 - protein, 11 aa, Entamoeba dispar
SNPNDEQQKKL

SEQ ID NO: 2375606 - protein, 20 aa, Entamoeba dispar
SNPPKQLSDFPTHENINPKQ

SEQ ID NO: 2375607 - protein, 7 aa, Entamoeba dispar
SNPRCGA

SEQ ID NO: 2375608 - protein, 14 aa, Entamoeba dispar
SNPTDNIGEKATIK

SEQ ID NO: 2375609 - protein, 6 aa, Entamoeba dispar
SNPYEL

SEQ ID NO: 2375610 - protein, 5 aa, Entamoeba dispar
SNPYP

SEQ ID NO: 2375611 - protein, 7 aa, Entamoeba dispar
SNQAKGV

SEQ ID NO: 2375612 - protein, 6 aa, Entamoeba dispar
SNQDGI

SEQ ID NO: 2375613 - protein, 16 aa, Entamoeba dispar
SNQDIEEAKTSGIRDA

SEQ ID NO: 2375614 - protein, 12 aa, Entamoeba dispar
SNQDNLDDNGPE

SEQ ID NO: 2375615 - protein, 9 aa, Entamoeba dispar
SNQDSISSI

SEQ ID NO: 2375616 - protein, 6 aa, Entamoeba dispar
SNQESY

SEQ ID NO: 2375617 - protein, 9 aa, Entamoeba dispar
SNQETKGNI

SEQ ID NO: 2375618 - protein, 4 aa, Entamoeba dispar
SNQI

SEQ ID NO: 2375619 - protein, 7 aa, Entamoeba dispar
SNQIGGF

SEQ ID NO: 2375620 - protein, 17 aa, Entamoeba dispar
SNQKFQQALERSKRRGI

SEQ ID NO: 2375621 - protein, 11 aa, Entamoeba dispar
SNQLDKNNDNY

SEQ ID NO: 2375622 - protein, 6 aa, Entamoeba dispar
SNQLDN

SEQ ID NO: 2375623 - protein, 16 aa, Entamoeba dispar
SNQRENKLDGSSSLST

SEQ ID NO: 2375624 - protein, 18 aa, Entamoeba dispar
SNQRNSVKDSLPSSISSV

SEQ ID NO: 2375625 - protein, 27 aa, Entamoeba dispar
SNQTKGLDGSDLKERYSQFGQNKYPDP

SEQ ID NO: 2375626 - protein, 5 aa, Entamoeba dispar
SNQTQ

SEQ ID NO: 2375627 - protein, 12 aa, Entamoeba dispar
SNRELVTSVVEM

SEQ ID NO: 2375628 - protein, 15 aa, Entamoeba dispar
SNRFISEKRETVEQT

SEQ ID NO: 2375629 - protein, 8 aa, Entamoeba dispar
SNRKPRTI

SEQ ID NO: 2375630 - protein, 5 aa, Entamoeba dispar
SNRKR

SEQ ID NO: 2375631 - protein, 7 aa, Entamoeba dispar
SNRMSEF

SEQ ID NO: 2375632 - protein, 7 aa, Entamoeba dispar
SNRSTNA

SEQ ID NO: 2375633 - protein, 4 aa, Entamoeba dispar
SNSD

SEQ ID NO: 2375634 - protein, 11 aa, Entamoeba dispar
SNSDLSSKFTD

SEQ ID NO: 2375635 - protein, 11 aa, Entamoeba dispar
SNSDNQIQKNF

SEQ ID NO: 2375636 - protein, 14 aa, Entamoeba dispar
SNSDTSSPYIEGTP

SEQ ID NO: 2375637 - protein, 18 aa, Entamoeba dispar
SNSEVNEVHSSSDSKEIE

SEQ ID NO: 2375638 - protein, 8 aa, Entamoeba dispar
SNSFQESN

SEQ ID NO: 2375639 - protein, 5 aa, Entamoeba dispar
SNSGA

SEQ ID NO: 2375640 - protein, 6 aa, Entamoeba dispar
SNSGGK

SEQ ID NO: 2375641 - protein, 6 aa, Entamoeba dispar
SNSGVA

SEQ ID NO: 2375642 - protein, 7 aa, Entamoeba dispar
SNSHSTK

SEQ ID NO: 2375643 - protein, 4 aa, Entamoeba dispar
SNSI

SEQ ID NO: 2375644 - protein, 7 aa, Entamoeba dispar
SNSILQK

SEQ ID NO: 2375645 - protein, 6 aa, Entamoeba dispar
SNSITS

SEQ ID NO: 2375646 - protein, 8 aa, Entamoeba dispar
SNSKFHSN

SEQ ID NO: 2375647 - protein, 19 aa, Entamoeba dispar
SNSNASTIKINSANDKSEN

SEQ ID NO: 2375648 - protein, 10 aa, Entamoeba dispar
SNSNCERSNI

SEQ ID NO: 2375649 - protein, 6 aa, Entamoeba dispar
SNSNIK

SEQ ID NO: 2375650 - protein, 7 aa, Entamoeba dispar
SNSNTID

SEQ ID NO: 2375651 - protein, 11 aa, Entamoeba dispar
SNSNVFDSTPT

SEQ ID NO: 2375652 - protein, 17 aa, Entamoeba dispar
SNSPPQINISSPHQNNP

SEQ ID NO: 2375653 - protein, 7 aa, Entamoeba dispar
SNSPQKI

SEQ ID NO: 2375654 - protein, 14 aa, Entamoeba dispar
SNSQPKHRTAEEYQ

SEQ ID NO: 2375655 - protein, 5 aa, Entamoeba dispar
SNSSN

SEQ ID NO: 2375656 - protein, 12 aa, Entamoeba dispar
SNSSNDNGNLPD

SEQ ID NO: 2375657 - protein, 7 aa, Entamoeba dispar
SNSSNRL

SEQ ID NO: 2375658 - protein, 7 aa, Entamoeba dispar
SNSSPNA

SEQ ID NO: 2375659 - protein, 9 aa, Entamoeba dispar
SNSTQCNGS

SEQ ID NO: 2375660 - protein, 14 aa, Entamoeba dispar
SNSYDYSKVPEVPL

SEQ ID NO: 2375661 - protein, 8 aa, Entamoeba dispar
SNTDEYEK

SEQ ID NO: 2375662 - protein, 7 aa, Entamoeba dispar
SNTEPKV

SEQ ID NO: 2375663 - protein, 7 aa, Entamoeba dispar
SNTIAGY

SEQ ID NO: 2375664 - protein, 4 aa, Entamoeba dispar
SNTK

SEQ ID NO: 2375665 - protein, 19 aa, Entamoeba dispar
SNTLESQEGDPVVTKRTSS

SEQ ID NO: 2375666 - protein, 6 aa, Entamoeba dispar
SNTLTI

SEQ ID NO: 2375667 - protein, 5 aa, Entamoeba dispar
SNTMG

SEQ ID NO: 2375668 - protein, 8 aa, Entamoeba dispar
SNTNHLTS

SEQ ID NO: 2375669 - protein, 6 aa, Entamoeba dispar
SNTNNI

SEQ ID NO: 2375670 - protein, 8 aa, Entamoeba dispar
SNTPGNKI

SEQ ID NO: 2375671 - protein, 5 aa, Entamoeba dispar
SNTPV

SEQ ID NO: 2375672 - protein, 19 aa, Entamoeba dispar
SNTQALAKLGSSEVIKPTG

SEQ ID NO: 2375673 - protein, 6 aa, Entamoeba dispar
SNTQDK

SEQ ID NO: 2375674 - protein, 6 aa, Entamoeba dispar
SNTSNV

SEQ ID NO: 2375675 - protein, 13 aa, Entamoeba dispar
SNTSVSQSYQNDT

SEQ ID NO: 2375676 - protein, 7 aa, Entamoeba dispar
SNTTGFK

SEQ ID NO: 2375677 - protein, 8 aa, Entamoeba dispar
SNTYSPNF

SEQ ID NO: 2375678 - protein, 8 aa, Entamoeba dispar
SNVESSTI

SEQ ID NO: 2375679 - protein, 5 aa, Entamoeba dispar
SNVPG

SEQ ID NO: 2375680 - protein, 5 aa, Entamoeba dispar
SNVSG

SEQ ID NO: 2375681 - protein, 5 aa, Entamoeba dispar
SNYDN

SEQ ID NO: 2375682 - protein, 6 aa, Entamoeba dispar
SNYEDY

SEQ ID NO: 2375683 - protein, 39 aa, Entamoeba dispar
SNYGMKSSTTPPVNEKSPKLQESGSIITPDKAQDTGHSQ

SEQ ID NO: 2375684 - protein, 12 aa, Entamoeba dispar
SNYQDDNSKPQF

SEQ ID NO: 2375685 - protein, 6 aa, Entamoeba dispar
SNYVNN

SEQ ID NO: 2375686 - protein, 8 aa, Entamoeba dispar
SPAATVSS

SEQ ID NO: 2375687 - protein, 7 aa, Entamoeba dispar
SPAETNN

SEQ ID NO: 2375688 - protein, 6 aa, Entamoeba dispar
SPAIPP

SEQ ID NO: 2375689 - protein, 12 aa, Entamoeba dispar
SPDACPSNKTFP

SEQ ID NO: 2375690 - protein, 6 aa, Entamoeba dispar
SPDARG

SEQ ID NO: 2375691 - protein, 9 aa, Entamoeba dispar
SPDNEISNR

SEQ ID NO: 2375692 - protein, 5 aa, Entamoeba dispar
SPDNI

SEQ ID NO: 2375693 - protein, 11 aa, Entamoeba dispar
SPDTESTCGFG

SEQ ID NO: 2375694 - protein, 15 aa, Entamoeba dispar
SPDYSNVSYSSSQWS

SEQ ID NO: 2375695 - protein, 14 aa, Entamoeba dispar
SPEAKGCCGGDTEE

SEQ ID NO: 2375696 - protein, 14 aa, Entamoeba dispar
SPEARNTFTTPSSD

SEQ ID NO: 2375697 - protein, 11 aa, Entamoeba dispar
SPEDAKKGSPF

SEQ ID NO: 2375698 - protein, 5 aa, Entamoeba dispar
SPEFG

SEQ ID NO: 2375699 - protein, 8 aa, Entamoeba dispar
SPEGRKSK

SEQ ID NO: 2375700 - protein, 5 aa, Entamoeba dispar
SPEIL

SEQ ID NO: 2375701 - protein, 5 aa, Entamoeba dispar
SPENY

SEQ ID NO: 2375702 - protein, 7 aa, Entamoeba dispar
SPETGEM

SEQ ID NO: 2375703 - protein, 5 aa, Entamoeba dispar
SPETL

SEQ ID NO: 2375704 - protein, 7 aa, Entamoeba dispar
SPFPKKN

SEQ ID NO: 2375705 - protein, 5 aa, Entamoeba dispar
SPFSA

SEQ ID NO: 2375706 - protein, 4 aa, Entamoeba dispar
SPFT

SEQ ID NO: 2375707 - protein, 10 aa, Entamoeba dispar
SPHEDERQTW

SEQ ID NO: 2375708 - protein, 9 aa, Entamoeba dispar
SPHGEYSSE

SEQ ID NO: 2375709 - protein, 5 aa, Entamoeba dispar
SPHGR

SEQ ID NO: 2375710 - protein, 7 aa, Entamoeba dispar
SPIDEGK

SEQ ID NO: 2375711 - protein, 9 aa, Entamoeba dispar
SPIDTLSTE

SEQ ID NO: 2375712 - protein, 21 aa, Entamoeba dispar
SPIESPDTLAPESLSSTHGVT

SEQ ID NO: 2375713 - protein, 25 aa, Entamoeba dispar
SPIGYQTKKSTKRVTTVKDENTVKP

SEQ ID NO: 2375714 - protein, 9 aa, Entamoeba dispar
SPIRNNPGL

SEQ ID NO: 2375715 - protein, 4 aa, Entamoeba dispar
SPIS

SEQ ID NO: 2375716 - protein, 6 aa, Entamoeba dispar
SPITTT

SEQ ID NO: 2375717 - protein, 6 aa, Entamoeba dispar
SPKAGE

SEQ ID NO: 2375718 - protein, 8 aa, Entamoeba dispar
SPKEIDDL

SEQ ID NO: 2375719 - protein, 8 aa, Entamoeba dispar
SPKFSDKQ

SEQ ID NO: 2375720 - protein, 4 aa, Entamoeba dispar
SPKG

SEQ ID NO: 2375721 - protein, 7 aa, Entamoeba dispar
SPKKQID

SEQ ID NO: 2375722 - protein, 4 aa, Entamoeba dispar
SPKL

SEQ ID NO: 2375723 - protein, 5 aa, Entamoeba dispar
SPKPH

SEQ ID NO: 2375724 - protein, 7 aa, Entamoeba dispar
SPKQKAD

SEQ ID NO: 2375725 - protein, 7 aa, Entamoeba dispar
SPKSQRI

SEQ ID NO: 2375726 - protein, 14 aa, Entamoeba dispar
SPKTGKLQPGYGET

SEQ ID NO: 2375727 - protein, 15 aa, Entamoeba dispar
SPLKTGKAFGASNKW

SEQ ID NO: 2375728 - protein, 25 aa, Entamoeba dispar
SPLREKKIKQEWSREEMPSEEFGKG

SEQ ID NO: 2375729 - protein, 7 aa, Entamoeba dispar
SPLSEDL

SEQ ID NO: 2375730 - protein, 4 aa, Entamoeba dispar
SPLY

SEQ ID NO: 2375731 - protein, 4 aa, Entamoeba dispar
SPNE

SEQ ID NO: 2375732 - protein, 13 aa, Entamoeba dispar
SPNECSTCKQPAY

SEQ ID NO: 2375733 - protein, 7 aa, Entamoeba dispar
SPNGDDP

SEQ ID NO: 2375734 - protein, 10 aa, Entamoeba dispar
SPNGFKGSYK

SEQ ID NO: 2375735 - protein, 14 aa, Entamoeba dispar
SPNHKEEKKTDISY

SEQ ID NO: 2375736 - protein, 6 aa, Entamoeba dispar
SPNIAK

SEQ ID NO: 2375737 - protein, 8 aa, Entamoeba dispar
SPNKAKQF

SEQ ID NO: 2375738 - protein, 4 aa, Entamoeba dispar
SPNL

SEQ ID NO: 2375739 - protein, 7 aa, Entamoeba dispar
SPNLQES

SEQ ID NO: 2375740 - protein, 6 aa, Entamoeba dispar
SPNNGL

SEQ ID NO: 2375741 - protein, 5 aa, Entamoeba dispar
SPNNY

SEQ ID NO: 2375742 - protein, 11 aa, Entamoeba dispar
SPNPLLDNSTS

SEQ ID NO: 2375743 - protein, 24 aa, Entamoeba dispar
SPNQILKSDPTSQQNSSSMESNRT

SEQ ID NO: 2375744 - protein, 15 aa, Entamoeba dispar
SPNSRISGSEKQLHS

SEQ ID NO: 2375745 - protein, 20 aa, Entamoeba dispar
SPNSVTKKTDECSGKGDRSD

SEQ ID NO: 2375746 - protein, 8 aa, Entamoeba dispar
SPNVPDTG

SEQ ID NO: 2375747 - protein, 7 aa, Entamoeba dispar
SPPGTYL

SEQ ID NO: 2375748 - protein, 5 aa, Entamoeba dispar
SPPIE

SEQ ID NO: 2375749 - protein, 9 aa, Entamoeba dispar
SPPKPSSFL

SEQ ID NO: 2375750 - protein, 12 aa, Entamoeba dispar
SPPNTVANDSIQ

SEQ ID NO: 2375751 - protein, 19 aa, Entamoeba dispar
SPPSALAKYSTTTLTTTGI

SEQ ID NO: 2375752 - protein, 6 aa, Entamoeba dispar
SPPSPL

SEQ ID NO: 2375753 - protein, 8 aa, Entamoeba dispar
SPPTDECA

SEQ ID NO: 2375754 - protein, 6 aa, Entamoeba dispar
SPPTFP

SEQ ID NO: 2375755 - protein, 6 aa, Entamoeba dispar
SPPVPM

SEQ ID NO: 2375756 - protein, 5 aa, Entamoeba dispar
SPQEI

SEQ ID NO: 2375757 - protein, 8 aa, Entamoeba dispar
SPQEKSDS

SEQ ID NO: 2375758 - protein, 5 aa, Entamoeba dispar
SPQHR

SEQ ID NO: 2375759 - protein, 8 aa, Entamoeba dispar
SPQKDDIK

SEQ ID NO: 2375760 - protein, 5 aa, Entamoeba dispar
SPQKI

SEQ ID NO: 2375761 - protein, 5 aa, Entamoeba dispar
SPQMK

SEQ ID NO: 2375762 - protein, 6 aa, Entamoeba dispar
SPQQKA

SEQ ID NO: 2375763 - protein, 6 aa, Entamoeba dispar
SPQSVY

SEQ ID NO: 2375764 - protein, 9 aa, Entamoeba dispar
SPRLKAANS

SEQ ID NO: 2375765 - protein, 5 aa, Entamoeba dispar
SPRND

SEQ ID NO: 2375766 - protein, 7 aa, Entamoeba dispar
SPSASQQ

SEQ ID NO: 2375767 - protein, 11 aa, Entamoeba dispar
SPSAVKSGYDL

SEQ ID NO: 2375768 - protein, 19 aa, Entamoeba dispar
SPSCSGNNEEQTLDINDES

SEQ ID NO: 2375769 - protein, 6 aa, Entamoeba dispar
SPSEPR

SEQ ID NO: 2375770 - protein, 4 aa, Entamoeba dispar
SPSH

SEQ ID NO: 2375771 - protein, 4 aa, Entamoeba dispar
SPSI

SEQ ID NO: 2375772 - protein, 9 aa, Entamoeba dispar
SPSKENDFS

SEQ ID NO: 2375773 - protein, 6 aa, Entamoeba dispar
SPSLPS

SEQ ID NO: 2375774 - protein, 25 aa, Entamoeba dispar
SPSLQQEIKESQKKNEQINQEEKDD

SEQ ID NO: 2375775 - protein, 5 aa, Entamoeba dispar
SPSNL

SEQ ID NO: 2375776 - protein, 5 aa, Entamoeba dispar
SPSPC

SEQ ID NO: 2375777 - protein, 6 aa, Entamoeba dispar
SPSPNR

SEQ ID NO: 2375778 - protein, 7 aa, Entamoeba dispar
SPSRNRI

SEQ ID NO: 2375779 - protein, 8 aa, Entamoeba dispar
SPSSSLQQ

SEQ ID NO: 2375780 - protein, 6 aa, Entamoeba dispar
SPSSVS

SEQ ID NO: 2375781 - protein, 7 aa, Entamoeba dispar
SPSTNQL

SEQ ID NO: 2375782 - protein, 11 aa, Entamoeba dispar
SPSTPLTPTQM

SEQ ID NO: 2375783 - protein, 13 aa, Entamoeba dispar
SPSTSPNTPTPQI

SEQ ID NO: 2375784 - protein, 7 aa, Entamoeba dispar
SPSTTNF

SEQ ID NO: 2375785 - protein, 17 aa, Entamoeba dispar
SPSTVSLSTSGESSGKV

SEQ ID NO: 2375786 - protein, 6 aa, Entamoeba dispar
SPSTYL

SEQ ID NO: 2375787 - protein, 7 aa, Entamoeba dispar
SPSVNEY

SEQ ID NO: 2375788 - protein, 8 aa, Entamoeba dispar
SPSYSDDD

SEQ ID NO: 2375789 - protein, 7 aa, Entamoeba dispar
SPTDPDT

SEQ ID NO: 2375790 - protein, 7 aa, Entamoeba dispar
SPTEGVP

SEQ ID NO: 2375791 - protein, 8 aa, Entamoeba dispar
SPTGTETV

SEQ ID NO: 2375792 - protein, 5 aa, Entamoeba dispar
SPTIE

SEQ ID NO: 2375793 - protein, 5 aa, Entamoeba dispar
SPTIS

SEQ ID NO: 2375794 - protein, 4 aa, Entamoeba dispar
SPTN

SEQ ID NO: 2375795 - protein, 10 aa, Entamoeba dispar
SPTNNSEDQR

SEQ ID NO: 2375796 - protein, 4 aa, Entamoeba dispar
SPTP

SEQ ID NO: 2375797 - protein, 6 aa, Entamoeba dispar
SPTQSQ

SEQ ID NO: 2375798 - protein, 5 aa, Entamoeba dispar
SPTSI

SEQ ID NO: 2375799 - protein, 4 aa, Entamoeba dispar
SPTT

SEQ ID NO: 2375800 - protein, 11 aa, Entamoeba dispar
SPTTPTKPRAL

SEQ ID NO: 2375801 - protein, 4 aa, Entamoeba dispar
SPVK

SEQ ID NO: 2375802 - protein, 5 aa, Entamoeba dispar
SPVPK

SEQ ID NO: 2375803 - protein, 4 aa, Entamoeba dispar
SPYD

SEQ ID NO: 2375804 - protein, 15 aa, Entamoeba dispar
SPYFESGYSSYKTTG

SEQ ID NO: 2375805 - protein, 4 aa, Entamoeba dispar
SPYG

SEQ ID NO: 2375806 - protein, 5 aa, Entamoeba dispar
SPYQE

SEQ ID NO: 2375807 - protein, 7 aa, Entamoeba dispar
SPYSPIK

SEQ ID NO: 2375808 - protein, 7 aa, Entamoeba dispar
SPYSPNL

SEQ ID NO: 2375809 - protein, 10 aa, Entamoeba dispar
SQADKMKSKG

SEQ ID NO: 2375810 - protein, 13 aa, Entamoeba dispar
SQCDEQMKNETRE

SEQ ID NO: 2375811 - protein, 9 aa, Entamoeba dispar
SQCKTGTCT

SEQ ID NO: 2375812 - protein, 10 aa, Entamoeba dispar
SQCKTTETLR

SEQ ID NO: 2375813 - protein, 16 aa, Entamoeba dispar
SQCSSIPTVPTPSSIR

SEQ ID NO: 2375814 - protein, 13 aa, Entamoeba dispar
SQCTKKTSKGCEE

SEQ ID NO: 2375815 - protein, 5 aa, Entamoeba dispar
SQCVK

SEQ ID NO: 2375816 - protein, 18 aa, Entamoeba dispar
SQDDPIAISSKGSRSRIS

SEQ ID NO: 2375817 - protein, 4 aa, Entamoeba dispar
SQDE

SEQ ID NO: 2375818 - protein, 7 aa, Entamoeba dispar
SQDEKNV

SEQ ID NO: 2375819 - protein, 4 aa, Entamoeba dispar
SQDI

SEQ ID NO: 2375820 - protein, 5 aa, Entamoeba dispar
SQDIN

SEQ ID NO: 2375821 - protein, 4 aa, Entamoeba dispar
SQDN

SEQ ID NO: 2375822 - protein, 6 aa, Entamoeba dispar
SQEDEV

SEQ ID NO: 2375823 - protein, 16 aa, Entamoeba dispar
SQEPGTIPIEQSQQTY

SEQ ID NO: 2375824 - protein, 12 aa, Entamoeba dispar
SQETTYSSIDGS

SEQ ID NO: 2375825 - protein, 6 aa, Entamoeba dispar
SQFEGT

SEQ ID NO: 2375826 - protein, 19 aa, Entamoeba dispar
SQFKDSSSAIIPKQSKGLS

SEQ ID NO: 2375827 - protein, 13 aa, Entamoeba dispar
SQFPPYQSVTPSL

SEQ ID NO: 2375828 - protein, 5 aa, Entamoeba dispar
SQFST

SEQ ID NO: 2375829 - protein, 21 aa, Entamoeba dispar
SQGAGGSPETQLPFGKNPQQA

SEQ ID NO: 2375830 - protein, 6 aa, Entamoeba dispar
SQGLDS

SEQ ID NO: 2375831 - protein, 11 aa, Entamoeba dispar
SQGNKSINIKG

SEQ ID NO: 2375832 - protein, 5 aa, Entamoeba dispar
SQGRN

SEQ ID NO: 2375833 - protein, 9 aa, Entamoeba dispar
SQGSVSDDI

SEQ ID NO: 2375834 - protein, 6 aa, Entamoeba dispar
SQGYSE

SEQ ID NO: 2375835 - protein, 18 aa, Entamoeba dispar
SQHESEKITKSEINKKQR

SEQ ID NO: 2375836 - protein, 8 aa, Entamoeba dispar
SQHNGGRT

SEQ ID NO: 2375837 - protein, 4 aa, Entamoeba dispar
SQHP

SEQ ID NO: 2375838 - protein, 4 aa, Entamoeba dispar
SQHT

SEQ ID NO: 2375839 - protein, 6 aa, Entamoeba dispar
SQIASE

SEQ ID NO: 2375840 - protein, 11 aa, Entamoeba dispar
SQIHPPDNNAS

SEQ ID NO: 2375841 - protein, 5 aa, Entamoeba dispar
SQIKE

SEQ ID NO: 2375842 - protein, 7 aa, Entamoeba dispar
SQIKIGS

SEQ ID NO: 2375843 - protein, 15 aa, Entamoeba dispar
SQIKKAQQTDEEQTK

SEQ ID NO: 2375844 - protein, 8 aa, Entamoeba dispar
SQITTKQH

SEQ ID NO: 2375845 - protein, 4 aa, Entamoeba dispar
SQKA

SEQ ID NO: 2375846 - protein, 4 aa, Entamoeba dispar
SQKD

SEQ ID NO: 2375847 - protein, 6 aa, Entamoeba dispar
SQKDAE

SEQ ID NO: 2375848 - protein, 6 aa, Entamoeba dispar
SQKDEL

SEQ ID NO: 2375849 - protein, 6 aa, Entamoeba dispar
SQKEKV

SEQ ID NO: 2375850 - protein, 19 aa, Entamoeba dispar
SQKGSRPKIPKTVENNEIT

SEQ ID NO: 2375851 - protein, 8 aa, Entamoeba dispar
SQKNNESF

SEQ ID NO: 2375852 - protein, 4 aa, Entamoeba dispar
SQKP

SEQ ID NO: 2375853 - protein, 36 aa, Entamoeba dispar
SQKSKSSKNVALTPTSNSQHATPSITPRYDSNDAKS

SEQ ID NO: 2375854 - protein, 7 aa, Entamoeba dispar
SQKTIGC

SEQ ID NO: 2375855 - protein, 6 aa, Entamoeba dispar
SQKTQI

SEQ ID NO: 2375856 - protein, 12 aa, Entamoeba dispar
SQLDGETNLKSK

SEQ ID NO: 2375857 - protein, 5 aa, Entamoeba dispar
SQLND

SEQ ID NO: 2375858 - protein, 7 aa, Entamoeba dispar
SQLSNKL

SEQ ID NO: 2375859 - protein, 5 aa, Entamoeba dispar
SQLSS

SEQ ID NO: 2375860 - protein, 9 aa, Entamoeba dispar
SQNDNNDEI

SEQ ID NO: 2375861 - protein, 8 aa, Entamoeba dispar
SQNDQSNH

SEQ ID NO: 2375862 - protein, 7 aa, Entamoeba dispar
SQNDSSL

SEQ ID NO: 2375863 - protein, 5 aa, Entamoeba dispar
SQNGP

SEQ ID NO: 2375864 - protein, 7 aa, Entamoeba dispar
SQNKESG

SEQ ID NO: 2375865 - protein, 15 aa, Entamoeba dispar
SQNLQRLQSTTKSPI

SEQ ID NO: 2375866 - protein, 4 aa, Entamoeba dispar
SQNN

SEQ ID NO: 2375867 - protein, 17 aa, Entamoeba dispar
SQNNSSPLNSNVTNSLN

SEQ ID NO: 2375868 - protein, 8 aa, Entamoeba dispar
SQNNTEIN

SEQ ID NO: 2375869 - protein, 10 aa, Entamoeba dispar
SQNPEDRPKF

SEQ ID NO: 2375870 - protein, 9 aa, Entamoeba dispar
SQNPEDRPT

SEQ ID NO: 2375871 - protein, 9 aa, Entamoeba dispar
SQNPSYSNS

SEQ ID NO: 2375872 - protein, 27 aa, Entamoeba dispar
SQNQGNDAFETEEKKKNLITTQEEPMT

SEQ ID NO: 2375873 - protein, 22 aa, Entamoeba dispar
SQNSSHVSENSQQQGEPRRSFS

SEQ ID NO: 2375874 - protein, 15 aa, Entamoeba dispar
SQNTENELDQEGFTT

SEQ ID NO: 2375875 - protein, 6 aa, Entamoeba dispar
SQNTIS

SEQ ID NO: 2375876 - protein, 6 aa, Entamoeba dispar
SQNTSL

SEQ ID NO: 2375877 - protein, 8 aa, Entamoeba dispar
SQNYSVSE

SEQ ID NO: 2375878 - protein, 16 aa, Entamoeba dispar
SQPDEDYDNIRSEKEI

SEQ ID NO: 2375879 - protein, 16 aa, Entamoeba dispar
SQPDEEDDNIRSENEI

SEQ ID NO: 2375880 - protein, 16 aa, Entamoeba dispar
SQPDEEGNNIRSENEI

SEQ ID NO: 2375881 - protein, 16 aa, Entamoeba dispar
SQPDEGEDNGRSEEEV

SEQ ID NO: 2375882 - protein, 6 aa, Entamoeba dispar
SQPDKH

SEQ ID NO: 2375883 - protein, 10 aa, Entamoeba dispar
SQPDKTHKQY

SEQ ID NO: 2375884 - protein, 15 aa, Entamoeba dispar
SQPEAGDNTRSEEEI

SEQ ID NO: 2375885 - protein, 6 aa, Entamoeba dispar
SQPEGA

SEQ ID NO: 2375886 - protein, 4 aa, Entamoeba dispar
SQPF

SEQ ID NO: 2375887 - protein, 16 aa, Entamoeba dispar
SQPIGNKYNDLDDSSF

SEQ ID NO: 2375888 - protein, 4 aa, Entamoeba dispar
SQPN

SEQ ID NO: 2375889 - protein, 14 aa, Entamoeba dispar
SQPTYQYPSGLQPT

SEQ ID NO: 2375890 - protein, 6 aa, Entamoeba dispar
SQQAEN

SEQ ID NO: 2375891 - protein, 9 aa, Entamoeba dispar
SQQEDGVSE

SEQ ID NO: 2375892 - protein, 7 aa, Entamoeba dispar
SQQELNE

SEQ ID NO: 2375893 - protein, 8 aa, Entamoeba dispar
SQQEMNSK

SEQ ID NO: 2375894 - protein, 5 aa, Entamoeba dispar
SQQHS

SEQ ID NO: 2375895 - protein, 7 aa, Entamoeba dispar
SQQKEGK

SEQ ID NO: 2375896 - protein, 9 aa, Entamoeba dispar
SQQKVISSS

SEQ ID NO: 2375897 - protein, 7 aa, Entamoeba dispar
SQQPHNF

SEQ ID NO: 2375898 - protein, 10 aa, Entamoeba dispar
SQQRTFQQPT

SEQ ID NO: 2375899 - protein, 6 aa, Entamoeba dispar
SQQYCK

SEQ ID NO: 2375900 - protein, 6 aa, Entamoeba dispar
SQRDIK

SEQ ID NO: 2375901 - protein, 20 aa, Entamoeba dispar
SQRKEFGKATSEKNTENESI

SEQ ID NO: 2375902 - protein, 11 aa, Entamoeba dispar
SQRPEPQDSKE

SEQ ID NO: 2375903 - protein, 5 aa, Entamoeba dispar
SQRST

SEQ ID NO: 2375904 - protein, 4 aa, Entamoeba dispar
SQRT

SEQ ID NO: 2375905 - protein, 6 aa, Entamoeba dispar
SQSDEI

SEQ ID NO: 2375906 - protein, 7 aa, Entamoeba dispar
SQSEDEI

SEQ ID NO: 2375907 - protein, 10 aa, Entamoeba dispar
SQSFEKENNF

SEQ ID NO: 2375908 - protein, 7 aa, Entamoeba dispar
SQSGRQV

SEQ ID NO: 2375909 - protein, 8 aa, Entamoeba dispar
SQSGRQVS

SEQ ID NO: 2375910 - protein, 5 aa, Entamoeba dispar
SQSIS

SEQ ID NO: 2375911 - protein, 18 aa, Entamoeba dispar
SQSISNITGDTDTPTSVT

SEQ ID NO: 2375912 - protein, 8 aa, Entamoeba dispar
SQSKEEIT

SEQ ID NO: 2375913 - protein, 10 aa, Entamoeba dispar
SQSKISNIPT

SEQ ID NO: 2375914 - protein, 7 aa, Entamoeba dispar
SQSNDIL

SEQ ID NO: 2375915 - protein, 9 aa, Entamoeba dispar
SQSNNNSDN

SEQ ID NO: 2375916 - protein, 8 aa, Entamoeba dispar
SQSNQTEI

SEQ ID NO: 2375917 - protein, 6 aa, Entamoeba dispar
SQSNYN

SEQ ID NO: 2375918 - protein, 41 aa, Entamoeba dispar
SQSPSWPGTNSTIISGPNGPTTINPPLTSVPYGQQQTQQRA

SEQ ID NO: 2375919 - protein, 18 aa, Entamoeba dispar
SQSSAPNERCDKAEEIKL

SEQ ID NO: 2375920 - protein, 58 aa, Entamoeba dispar
SQSSQNSEGEGNSQSSGTNGSNSIKKSHVSKSTPSGSGKSGSSHDSDSKKKKGKSKVS

SEQ ID NO: 2375921 - protein, 57 aa, Entamoeba dispar
SQSSQNSESEGRSQTSGTNGSNSVKKSRGPKITPSGSGKSGSSHDSDAKKKKGKTKI

SEQ ID NO: 2375922 - protein, 6 aa, Entamoeba dispar
SQSSSV

SEQ ID NO: 2375923 - protein, 5 aa, Entamoeba dispar
SQSTQ

SEQ ID NO: 2375924 - protein, 8 aa, Entamoeba dispar
SQSTSEGQ

SEQ ID NO: 2375925 - protein, 11 aa, Entamoeba dispar
SQTCGEEQEMN

SEQ ID NO: 2375926 - protein, 11 aa, Entamoeba dispar
SQTEKSCNKCS

SEQ ID NO: 2375927 - protein, 7 aa, Entamoeba dispar
SQTGEHK

SEQ ID NO: 2375928 - protein, 18 aa, Entamoeba dispar
SQTHPHQQPVSPPINTPQ

SEQ ID NO: 2375929 - protein, 5 aa, Entamoeba dispar
SQTIK

SEQ ID NO: 2375930 - protein, 5 aa, Entamoeba dispar
SQTND

SEQ ID NO: 2375931 - protein, 6 aa, Entamoeba dispar
SQTPVK

SEQ ID NO: 2375932 - protein, 4 aa, Entamoeba dispar
SQTS

SEQ ID NO: 2375933 - protein, 8 aa, Entamoeba dispar
SQTSITKE

SEQ ID NO: 2375934 - protein, 6 aa, Entamoeba dispar
SQTSSL

SEQ ID NO: 2375935 - protein, 5 aa, Entamoeba dispar
SQVKD

SEQ ID NO: 2375936 - protein, 8 aa, Entamoeba dispar
SQVNKRRS

SEQ ID NO: 2375937 - protein, 6 aa, Entamoeba dispar
SQVPVQ

SEQ ID NO: 2375938 - protein, 12 aa, Entamoeba dispar
SQYCDKRNGKCT

SEQ ID NO: 2375939 - protein, 6 aa, Entamoeba dispar
SQYGKE

SEQ ID NO: 2375940 - protein, 5 aa, Entamoeba dispar
SQYQS

SEQ ID NO: 2375941 - protein, 9 aa, Entamoeba dispar
SQYRTDTIQ

SEQ ID NO: 2375942 - protein, 9 aa, Entamoeba dispar
SRAKSDSVL

SEQ ID NO: 2375943 - protein, 8 aa, Entamoeba dispar
SRANPNSI

SEQ ID NO: 2375944 - protein, 8 aa, Entamoeba dispar
SRASTKKS

SEQ ID NO: 2375945 - protein, 8 aa, Entamoeba dispar
SRATINNP

SEQ ID NO: 2375946 - protein, 4 aa, Entamoeba dispar
SRCG

SEQ ID NO: 2375947 - protein, 6 aa, Entamoeba dispar
SRCRSS

SEQ ID NO: 2375948 - protein, 13 aa, Entamoeba dispar
SRDELCDGKDLGT

SEQ ID NO: 2375949 - protein, 8 aa, Entamoeba dispar
SRDFPPCD

SEQ ID NO: 2375950 - protein, 8 aa, Entamoeba dispar
SRDNDTNE

SEQ ID NO: 2375951 - protein, 8 aa, Entamoeba dispar
SRDNTFKA

SEQ ID NO: 2375952 - protein, 14 aa, Entamoeba dispar
SRECPSSLLKKNNV

SEQ ID NO: 2375953 - protein, 16 aa, Entamoeba dispar
SREPKKQVVQNEGTMA

SEQ ID NO: 2375954 - protein, 29 aa, Entamoeba dispar
SRESSAASNSFKYSGSYEMSTEEKKKLST

SEQ ID NO: 2375955 - protein, 9 aa, Entamoeba dispar
SRGKNAGSW

SEQ ID NO: 2375956 - protein, 4 aa, Entamoeba dispar
SRGY

SEQ ID NO: 2375957 - protein, 8 aa, Entamoeba dispar
SRHCPGGG

SEQ ID NO: 2375958 - protein, 5 aa, Entamoeba dispar
SRHDG

SEQ ID NO: 2375959 - protein, 16 aa, Entamoeba dispar
SRIEEKDKKLGKLARR

SEQ ID NO: 2375960 - protein, 6 aa, Entamoeba dispar
SRIKDE

SEQ ID NO: 2375961 - protein, 5 aa, Entamoeba dispar
SRISP

SEQ ID NO: 2375962 - protein, 6 aa, Entamoeba dispar
SRISSI

SEQ ID NO: 2375963 - protein, 10 aa, Entamoeba dispar
SRISSNNDQI

SEQ ID NO: 2375964 - protein, 6 aa, Entamoeba dispar
SRITQA

SEQ ID NO: 2375965 - protein, 4 aa, Entamoeba dispar
SRKA

SEQ ID NO: 2375966 - protein, 9 aa, Entamoeba dispar
SRKEEDKIF

SEQ ID NO: 2375967 - protein, 18 aa, Entamoeba dispar
SRKHAKSFTIDGQSYPFT

SEQ ID NO: 2375968 - protein, 5 aa, Entamoeba dispar
SRKIG

SEQ ID NO: 2375969 - protein, 8 aa, Entamoeba dispar
SRKKNINE

SEQ ID NO: 2375970 - protein, 8 aa, Entamoeba dispar
SRKKNYVD

SEQ ID NO: 2375971 - protein, 7 aa, Entamoeba dispar
SRKMSST

SEQ ID NO: 2375972 - protein, 7 aa, Entamoeba dispar
SRKPTNY

SEQ ID NO: 2375973 - protein, 4 aa, Entamoeba dispar
SRKR

SEQ ID NO: 2375974 - protein, 9 aa, Entamoeba dispar
SRKTEKSLR

SEQ ID NO: 2375975 - protein, 9 aa, Entamoeba dispar
SRKTENNIE

SEQ ID NO: 2375976 - protein, 8 aa, Entamoeba dispar
SRKVNGEH

SEQ ID NO: 2375977 - protein, 9 aa, Entamoeba dispar
SRKVNGETD

SEQ ID NO: 2375978 - protein, 5 aa, Entamoeba dispar
SRMVS

SEQ ID NO: 2375979 - protein, 5 aa, Entamoeba dispar
SRNIE

SEQ ID NO: 2375980 - protein, 18 aa, Entamoeba dispar
SRNIRGFTSRGTTSESKC

SEQ ID NO: 2375981 - protein, 10 aa, Entamoeba dispar
SRNQALGKKS

SEQ ID NO: 2375982 - protein, 37 aa, Entamoeba dispar
SRPTKKEDKEISEIKNNSNDTTNSHENKSYHSNEPHE

SEQ ID NO: 2375983 - protein, 4 aa, Entamoeba dispar
SRQC

SEQ ID NO: 2375984 - protein, 5 aa, Entamoeba dispar
SRQKL

SEQ ID NO: 2375985 - protein, 11 aa, Entamoeba dispar
SRQPNKQKQMD

SEQ ID NO: 2375986 - protein, 5 aa, Entamoeba dispar
SRQPS

SEQ ID NO: 2375987 - protein, 6 aa, Entamoeba dispar
SRRKEL

SEQ ID NO: 2375988 - protein, 8 aa, Entamoeba dispar
SRRNWSNA

SEQ ID NO: 2375989 - protein, 7 aa, Entamoeba dispar
SRRQETE

SEQ ID NO: 2375990 - protein, 9 aa, Entamoeba dispar
SRRVNGETD

SEQ ID NO: 2375991 - protein, 10 aa, Entamoeba dispar
SRSIKSTLPL

SEQ ID NO: 2375992 - protein, 4 aa, Entamoeba dispar
SRSM

SEQ ID NO: 2375993 - protein, 8 aa, Entamoeba dispar
SRSSGGCG

SEQ ID NO: 2375994 - protein, 16 aa, Entamoeba dispar
SRSSNVSVNKETTKFG

SEQ ID NO: 2375995 - protein, 5 aa, Entamoeba dispar
SRSSV

SEQ ID NO: 2375996 - protein, 4 aa, Entamoeba dispar
SRST

SEQ ID NO: 2375997 - protein, 4 aa, Entamoeba dispar
SRSV

SEQ ID NO: 2375998 - protein, 11 aa, Entamoeba dispar
SRTGLGEETYL

SEQ ID NO: 2375999 - protein, 5 aa, Entamoeba dispar
SRTRD

SEQ ID NO: 2376000 - protein, 7 aa, Entamoeba dispar
SSADLPK

SEQ ID NO: 2376001 - protein, 4 aa, Entamoeba dispar
SSAE

SEQ ID NO: 2376002 - protein, 14 aa, Entamoeba dispar
SSAPITGGSSIKIT

SEQ ID NO: 2376003 - protein, 48 aa, Entamoeba dispar
SSAQSLPSLGSLSSPIHSPYYSKSSRSCQQTPRTVTFSSQESQRTPFI

SEQ ID NO: 2376004 - protein, 16 aa, Entamoeba dispar
SSARESDNTKGIITQE

SEQ ID NO: 2376005 - protein, 10 aa, Entamoeba dispar
SSARESDNTL

SEQ ID NO: 2376006 - protein, 5 aa, Entamoeba dispar
SSASS

SEQ ID NO: 2376007 - protein, 29 aa, Entamoeba dispar
SSASYSMTTESNSNSNSYQEQLSMSSDSM

SEQ ID NO: 2376008 - protein, 4 aa, Entamoeba dispar
SSCD

SEQ ID NO: 2376009 - protein, 19 aa, Entamoeba dispar
SSCGDKQLDEGEECDGGDG

SEQ ID NO: 2376010 - protein, 9 aa, Entamoeba dispar
SSCGNETVL

SEQ ID NO: 2376011 - protein, 17 aa, Entamoeba dispar
SSCGNGKKDENEDCDNS

SEQ ID NO: 2376012 - protein, 18 aa, Entamoeba dispar
SSCKPCDDSCTTCTKTEE

SEQ ID NO: 2376013 - protein, 6 aa, Entamoeba dispar
SSCSCN

SEQ ID NO: 2376014 - protein, 7 aa, Entamoeba dispar
SSCSGGA

SEQ ID NO: 2376015 - protein, 6 aa, Entamoeba dispar
SSCTDG

SEQ ID NO: 2376016 - protein, 8 aa, Entamoeba dispar
SSCTSYQH

SEQ ID NO: 2376017 - protein, 16 aa, Entamoeba dispar
SSCVTQETNNCGNDGL

SEQ ID NO: 2376018 - protein, 17 aa, Entamoeba dispar
SSDASGSISFGESTESH

SEQ ID NO: 2376019 - protein, 8 aa, Entamoeba dispar
SSDCPPDV

SEQ ID NO: 2376020 - protein, 6 aa, Entamoeba dispar
SSDDDM

SEQ ID NO: 2376021 - protein, 14 aa, Entamoeba dispar
SSDDEESENEEMTE

SEQ ID NO: 2376022 - protein, 6 aa, Entamoeba dispar
SSDDQI

SEQ ID NO: 2376023 - protein, 7 aa, Entamoeba dispar
SSDEDGS

SEQ ID NO: 2376024 - protein, 5 aa, Entamoeba dispar
SSDEE

SEQ ID NO: 2376025 - protein, 14 aa, Entamoeba dispar
SSDENDRELTKSTL

SEQ ID NO: 2376026 - protein, 9 aa, Entamoeba dispar
SSDENPRVR

SEQ ID NO: 2376027 - protein, 9 aa, Entamoeba dispar
SSDEVPSGF

SEQ ID NO: 2376028 - protein, 4 aa, Entamoeba dispar
SSDF

SEQ ID NO: 2376029 - protein, 12 aa, Entamoeba dispar
SSDGQKKEYMKE

SEQ ID NO: 2376030 - protein, 7 aa, Entamoeba dispar
SSDKDNH

SEQ ID NO: 2376031 - protein, 6 aa, Entamoeba dispar
SSDLPT

SEQ ID NO: 2376032 - protein, 6 aa, Entamoeba dispar
SSDNGD

SEQ ID NO: 2376033 - protein, 6 aa, Entamoeba dispar
SSDNPY

SEQ ID NO: 2376034 - protein, 8 aa, Entamoeba dispar
SSDPERQL

SEQ ID NO: 2376035 - protein, 6 aa, Entamoeba dispar
SSDPVI

SEQ ID NO: 2376036 - protein, 7 aa, Entamoeba dispar
SSDQPFK

SEQ ID NO: 2376037 - protein, 4 aa, Entamoeba dispar
SSDS

SEQ ID NO: 2376038 - protein, 9 aa, Entamoeba dispar
SSDSIETDI

SEQ ID NO: 2376039 - protein, 6 aa, Entamoeba dispar
SSDSNY

SEQ ID NO: 2376040 - protein, 5 aa, Entamoeba dispar
SSDTD

SEQ ID NO: 2376041 - protein, 6 aa, Entamoeba dispar
SSDTNI

SEQ ID NO: 2376042 - protein, 5 aa, Entamoeba dispar
SSDYA

SEQ ID NO: 2376043 - protein, 11 aa, Entamoeba dispar
SSECETCNSAT

SEQ ID NO: 2376044 - protein, 6 aa, Entamoeba dispar
SSEDIK

SEQ ID NO: 2376045 - protein, 9 aa, Entamoeba dispar
SSEDNMGRS

SEQ ID NO: 2376046 - protein, 10 aa, Entamoeba dispar
SSEEAEEREE

SEQ ID NO: 2376047 - protein, 6 aa, Entamoeba dispar
SSEECK

SEQ ID NO: 2376048 - protein, 20 aa, Entamoeba dispar
SSEFPKTRPEKRPPPEEEKG

SEQ ID NO: 2376049 - protein, 11 aa, Entamoeba dispar
SSEGESKSGIK

SEQ ID NO: 2376050 - protein, 7 aa, Entamoeba dispar
SSEGIAS

SEQ ID NO: 2376051 - protein, 10 aa, Entamoeba dispar
SSEGKEIGNS

SEQ ID NO: 2376052 - protein, 7 aa, Entamoeba dispar
SSEGVRL

SEQ ID NO: 2376053 - protein, 4 aa, Entamoeba dispar
SSEH

SEQ ID NO: 2376054 - protein, 11 aa, Entamoeba dispar
SSEHLKDKKDY

SEQ ID NO: 2376055 - protein, 8 aa, Entamoeba dispar
SSENSYPK

SEQ ID NO: 2376056 - protein, 10 aa, Entamoeba dispar
SSEPKTPSIK

SEQ ID NO: 2376057 - protein, 8 aa, Entamoeba dispar
SSEPNGSC

SEQ ID NO: 2376058 - protein, 8 aa, Entamoeba dispar
SSEQPVEW

SEQ ID NO: 2376059 - protein, 7 aa, Entamoeba dispar
SSEQYKA

SEQ ID NO: 2376060 - protein, 11 aa, Entamoeba dispar
SSERSLSRTLD

SEQ ID NO: 2376061 - protein, 7 aa, Entamoeba dispar
SSESTGT

SEQ ID NO: 2376062 - protein, 6 aa, Entamoeba dispar
SSETGK

SEQ ID NO: 2376063 - protein, 19 aa, Entamoeba dispar
SSETKTKPIPKQYSDTTKE

SEQ ID NO: 2376064 - protein, 14 aa, Entamoeba dispar
SSETNKLNEKIDET

SEQ ID NO: 2376065 - protein, 14 aa, Entamoeba dispar
SSETVESNPRGVRG

SEQ ID NO: 2376066 - protein, 7 aa, Entamoeba dispar
SSETVSI

SEQ ID NO: 2376067 - protein, 7 aa, Entamoeba dispar
SSEVSSE

SEQ ID NO: 2376068 - protein, 5 aa, Entamoeba dispar
SSFDD

SEQ ID NO: 2376069 - protein, 8 aa, Entamoeba dispar
SSFDRDDT

SEQ ID NO: 2376070 - protein, 6 aa, Entamoeba dispar
SSFKND

SEQ ID NO: 2376071 - protein, 7 aa, Entamoeba dispar
SSFPTPE

SEQ ID NO: 2376072 - protein, 13 aa, Entamoeba dispar
SSFTSQLSQSVDG

SEQ ID NO: 2376073 - protein, 4 aa, Entamoeba dispar
SSGE

SEQ ID NO: 2376074 - protein, 6 aa, Entamoeba dispar
SSGGPF

SEQ ID NO: 2376075 - protein, 5 aa, Entamoeba dispar
SSGIA

SEQ ID NO: 2376076 - protein, 11 aa, Entamoeba dispar
SSGIGSCNRNN

SEQ ID NO: 2376077 - protein, 9 aa, Entamoeba dispar
SSGKTQKEK

SEQ ID NO: 2376078 - protein, 9 aa, Entamoeba dispar
SSGNNFDSI

SEQ ID NO: 2376079 - protein, 6 aa, Entamoeba dispar
SSGSGF

SEQ ID NO: 2376080 - protein, 7 aa, Entamoeba dispar
SSGSPTR

SEQ ID NO: 2376081 - protein, 10 aa, Entamoeba dispar
SSHEENPNVE

SEQ ID NO: 2376082 - protein, 7 aa, Entamoeba dispar
SSHIPSK

SEQ ID NO: 2376083 - protein, 7 aa, Entamoeba dispar
SSHKKYK

SEQ ID NO: 2376084 - protein, 26 aa, Entamoeba dispar
SSHPQPSTPSQKSARKLFSFGKKEEK

SEQ ID NO: 2376085 - protein, 5 aa, Entamoeba dispar
SSHSI

SEQ ID NO: 2376086 - protein, 28 aa, Entamoeba dispar
SSHSKEDKKKPELPKKTTTLNGNTLSKV

SEQ ID NO: 2376087 - protein, 8 aa, Entamoeba dispar
SSHSMDKS

SEQ ID NO: 2376088 - protein, 11 aa, Entamoeba dispar
SSIAGSPNPIM

SEQ ID NO: 2376089 - protein, 11 aa, Entamoeba dispar
SSIDQSENSRF

SEQ ID NO: 2376090 - protein, 19 aa, Entamoeba dispar
SSIETNNKPIITNKESNQL

SEQ ID NO: 2376091 - protein, 23 aa, Entamoeba dispar
SSIETNNSERLKNDCQGNISTQN

SEQ ID NO: 2376092 - protein, 7 aa, Entamoeba dispar
SSINEGQ

SEQ ID NO: 2376093 - protein, 5 aa, Entamoeba dispar
SSIPT

SEQ ID NO: 2376094 - protein, 6 aa, Entamoeba dispar
SSIPTM

SEQ ID NO: 2376095 - protein, 12 aa, Entamoeba dispar
SSIQSQENKEKL

SEQ ID NO: 2376096 - protein, 6 aa, Entamoeba dispar
SSIRPS

SEQ ID NO: 2376097 - protein, 12 aa, Entamoeba dispar
SSIRSGLRASKE

SEQ ID NO: 2376098 - protein, 4 aa, Entamoeba dispar
SSIS

SEQ ID NO: 2376099 - protein, 6 aa, Entamoeba dispar
SSISDN

SEQ ID NO: 2376100 - protein, 9 aa, Entamoeba dispar
SSISDYNKQ

SEQ ID NO: 2376101 - protein, 6 aa, Entamoeba dispar
SSISSS

SEQ ID NO: 2376102 - protein, 6 aa, Entamoeba dispar
SSITSN

SEQ ID NO: 2376103 - protein, 8 aa, Entamoeba dispar
SSITVNGN

SEQ ID NO: 2376104 - protein, 4 aa, Entamoeba dispar
SSIV

SEQ ID NO: 2376105 - protein, 8 aa, Entamoeba dispar
SSKDDKYQ

SEQ ID NO: 2376106 - protein, 8 aa, Entamoeba dispar
SSKDEMCK

SEQ ID NO: 2376107 - protein, 5 aa, Entamoeba dispar
SSKDI

SEQ ID NO: 2376108 - protein, 8 aa, Entamoeba dispar
SSKDKRAS

SEQ ID NO: 2376109 - protein, 7 aa, Entamoeba dispar
SSKENYS

SEQ ID NO: 2376110 - protein, 8 aa, Entamoeba dispar
SSKGVSNS

SEQ ID NO: 2376111 - protein, 8 aa, Entamoeba dispar
SSKGYYRS

SEQ ID NO: 2376112 - protein, 4 aa, Entamoeba dispar
SSKK

SEQ ID NO: 2376113 - protein, 17 aa, Entamoeba dispar
SSKLNKNEQVKKRKYNS

SEQ ID NO: 2376114 - protein, 14 aa, Entamoeba dispar
SSKNCGDDCNTSNG

SEQ ID NO: 2376115 - protein, 9 aa, Entamoeba dispar
SSKNEQTFS

SEQ ID NO: 2376116 - protein, 8 aa, Entamoeba dispar
SSKPLTDL

SEQ ID NO: 2376117 - protein, 6 aa, Entamoeba dispar
SSKQEL

SEQ ID NO: 2376118 - protein, 7 aa, Entamoeba dispar
SSKQTYA

SEQ ID NO: 2376119 - protein, 24 aa, Entamoeba dispar
SSKQWKSVSYNSGSSLSLKGQPFS

SEQ ID NO: 2376120 - protein, 7 aa, Entamoeba dispar
SSKSSFY

SEQ ID NO: 2376121 - protein, 6 aa, Entamoeba dispar
SSKTEE

SEQ ID NO: 2376122 - protein, 12 aa, Entamoeba dispar
SSKTKTKDFPKE

SEQ ID NO: 2376123 - protein, 9 aa, Entamoeba dispar
SSKVNKNNN

SEQ ID NO: 2376124 - protein, 23 aa, Entamoeba dispar
SSKYIPSSSIQQSCQPKLSSGTI

SEQ ID NO: 2376125 - protein, 14 aa, Entamoeba dispar
SSLANSGEVEQPTV

SEQ ID NO: 2376126 - protein, 6 aa, Entamoeba dispar
SSLARE

SEQ ID NO: 2376127 - protein, 16 aa, Entamoeba dispar
SSLDEKELANKLTSTY

SEQ ID NO: 2376128 - protein, 9 aa, Entamoeba dispar
SSLDQPNGR

SEQ ID NO: 2376129 - protein, 10 aa, Entamoeba dispar
SSLGPKEEPI

SEQ ID NO: 2376130 - protein, 4 aa, Entamoeba dispar
SSLH

SEQ ID NO: 2376131 - protein, 4 aa, Entamoeba dispar
SSLN

SEQ ID NO: 2376132 - protein, 5 aa, Entamoeba dispar
SSLNE

SEQ ID NO: 2376133 - protein, 5 aa, Entamoeba dispar
SSLNS

SEQ ID NO: 2376134 - protein, 8 aa, Entamoeba dispar
SSLPQELK

SEQ ID NO: 2376135 - protein, 11 aa, Entamoeba dispar
SSLRKDNDHPI

SEQ ID NO: 2376136 - protein, 5 aa, Entamoeba dispar
SSLRT

SEQ ID NO: 2376137 - protein, 6 aa, Entamoeba dispar
SSLSED

SEQ ID NO: 2376138 - protein, 8 aa, Entamoeba dispar
SSLSLSSG

SEQ ID NO: 2376139 - protein, 7 aa, Entamoeba dispar
SSLSSKG

SEQ ID NO: 2376140 - protein, 7 aa, Entamoeba dispar
SSLSTKL

SEQ ID NO: 2376141 - protein, 12 aa, Entamoeba dispar
SSLSTPNSYNSP

SEQ ID NO: 2376142 - protein, 9 aa, Entamoeba dispar
SSLTDESIQ

SEQ ID NO: 2376143 - protein, 5 aa, Entamoeba dispar
SSLTT

SEQ ID NO: 2376144 - protein, 5 aa, Entamoeba dispar
SSMST

SEQ ID NO: 2376145 - protein, 6 aa, Entamoeba dispar
SSNANK

SEQ ID NO: 2376146 - protein, 8 aa, Entamoeba dispar
SSNDDFGT

SEQ ID NO: 2376147 - protein, 7 aa, Entamoeba dispar
SSNEELR

SEQ ID NO: 2376148 - protein, 8 aa, Entamoeba dispar
SSNEGTTL

SEQ ID NO: 2376149 - protein, 7 aa, Entamoeba dispar
SSNEITF

SEQ ID NO: 2376150 - protein, 6 aa, Entamoeba dispar
SSNGEF

SEQ ID NO: 2376151 - protein, 5 aa, Entamoeba dispar
SSNGN

SEQ ID NO: 2376152 - protein, 10 aa, Entamoeba dispar
SSNGNGCTKC

SEQ ID NO: 2376153 - protein, 7 aa, Entamoeba dispar
SSNHPNG

SEQ ID NO: 2376154 - protein, 5 aa, Entamoeba dispar
SSNIA

SEQ ID NO: 2376155 - protein, 8 aa, Entamoeba dispar
SSNINEQQ

SEQ ID NO: 2376156 - protein, 8 aa, Entamoeba dispar
SSNLGTNE

SEQ ID NO: 2376157 - protein, 4 aa, Entamoeba dispar
SSNN

SEQ ID NO: 2376158 - protein, 10 aa, Entamoeba dispar
SSNNCSECNT

SEQ ID NO: 2376159 - protein, 5 aa, Entamoeba dispar
SSNNF

SEQ ID NO: 2376160 - protein, 5 aa, Entamoeba dispar
SSNNL

SEQ ID NO: 2376161 - protein, 7 aa, Entamoeba dispar
SSNNNSV

SEQ ID NO: 2376162 - protein, 7 aa, Entamoeba dispar
SSNNQYE

SEQ ID NO: 2376163 - protein, 6 aa, Entamoeba dispar
SSNPKF

SEQ ID NO: 2376164 - protein, 6 aa, Entamoeba dispar
SSNPNE

SEQ ID NO: 2376165 - protein, 8 aa, Entamoeba dispar
SSNPQPIQ

SEQ ID NO: 2376166 - protein, 6 aa, Entamoeba dispar
SSNPYF

SEQ ID NO: 2376167 - protein, 5 aa, Entamoeba dispar
SSNQE

SEQ ID NO: 2376168 - protein, 8 aa, Entamoeba dispar
SSNQNVVQ

SEQ ID NO: 2376169 - protein, 4 aa, Entamoeba dispar
SSNS

SEQ ID NO: 2376170 - protein, 9 aa, Entamoeba dispar
SSNSPFSDE

SEQ ID NO: 2376171 - protein, 9 aa, Entamoeba dispar
SSNSSFNLD

SEQ ID NO: 2376172 - protein, 7 aa, Entamoeba dispar
SSNSSVV

SEQ ID NO: 2376173 - protein, 8 aa, Entamoeba dispar
SSNSTECK

SEQ ID NO: 2376174 - protein, 7 aa, Entamoeba dispar
SSNSTKK

SEQ ID NO: 2376175 - protein, 6 aa, Entamoeba dispar
SSPALK

SEQ ID NO: 2376176 - protein, 6 aa, Entamoeba dispar
SSPAYP

SEQ ID NO: 2376177 - protein, 4 aa, Entamoeba dispar
SSPE

SEQ ID NO: 2376178 - protein, 5 aa, Entamoeba dispar
SSPEY

SEQ ID NO: 2376179 - protein, 7 aa, Entamoeba dispar
SSPGYTS

SEQ ID NO: 2376180 - protein, 11 aa, Entamoeba dispar
SSPKKTLNDKM

SEQ ID NO: 2376181 - protein, 6 aa, Entamoeba dispar
SSPLRC

SEQ ID NO: 2376182 - protein, 6 aa, Entamoeba dispar
SSPNKR

SEQ ID NO: 2376183 - protein, 21 aa, Entamoeba dispar
SSPNSTLSSNPHYSNTPSLQP

SEQ ID NO: 2376184 - protein, 5 aa, Entamoeba dispar
SSPPF

SEQ ID NO: 2376185 - protein, 9 aa, Entamoeba dispar
SSPPKNKGK

SEQ ID NO: 2376186 - protein, 7 aa, Entamoeba dispar
SSPSLNL

SEQ ID NO: 2376187 - protein, 5 aa, Entamoeba dispar
SSPSY

SEQ ID NO: 2376188 - protein, 4 aa, Entamoeba dispar
SSPV

SEQ ID NO: 2376189 - protein, 9 aa, Entamoeba dispar
SSPWKGERY

SEQ ID NO: 2376190 - protein, 5 aa, Entamoeba dispar
SSQEE

SEQ ID NO: 2376191 - protein, 5 aa, Entamoeba dispar
SSQES

SEQ ID NO: 2376192 - protein, 9 aa, Entamoeba dispar
SSQESIRKN

SEQ ID NO: 2376193 - protein, 4 aa, Entamoeba dispar
SSQG

SEQ ID NO: 2376194 - protein, 7 aa, Entamoeba dispar
SSQHDGD

SEQ ID NO: 2376195 - protein, 4 aa, Entamoeba dispar
SSQI

SEQ ID NO: 2376196 - protein, 18 aa, Entamoeba dispar
SSQINTPNDLARRQPSFE

SEQ ID NO: 2376197 - protein, 17 aa, Entamoeba dispar
SSQKEVQSQTYDSARDA

SEQ ID NO: 2376198 - protein, 11 aa, Entamoeba dispar
SSQKLSVEQQG

SEQ ID NO: 2376199 - protein, 7 aa, Entamoeba dispar
SSQNNLA

SEQ ID NO: 2376200 - protein, 6 aa, Entamoeba dispar
SSQNVE

SEQ ID NO: 2376201 - protein, 8 aa, Entamoeba dispar
SSQPTAYN

SEQ ID NO: 2376202 - protein, 8 aa, Entamoeba dispar
SSQRTLTS

SEQ ID NO: 2376203 - protein, 7 aa, Entamoeba dispar
SSQSNLP

SEQ ID NO: 2376204 - protein, 59 aa, Entamoeba dispar
SSQSSQNSESERSSKSSGTNGSNSTNKTNEQKLTPSGSGKFGSSHESDSKKKKEKSKVS

SEQ ID NO: 2376205 - protein, 43 aa, Entamoeba dispar
SSQTCESSSIESYQRSSIQDTTGNQNGNAVQGKSKNENLKPEP

SEQ ID NO: 2376206 - protein, 6 aa, Entamoeba dispar
SSQTNI

SEQ ID NO: 2376207 - protein, 8 aa, Entamoeba dispar
SSQTVYNE

SEQ ID NO: 2376208 - protein, 5 aa, Entamoeba dispar
SSQTY

SEQ ID NO: 2376209 - protein, 4 aa, Entamoeba dispar
SSQW

SEQ ID NO: 2376210 - protein, 4 aa, Entamoeba dispar
SSQY

SEQ ID NO: 2376211 - protein, 14 aa, Entamoeba dispar
SSRCIPKSCGNKKI

SEQ ID NO: 2376212 - protein, 14 aa, Entamoeba dispar
SSREIDTSASTFTV

SEQ ID NO: 2376213 - protein, 17 aa, Entamoeba dispar
SSRENTEGLNGEQLKEE

SEQ ID NO: 2376214 - protein, 6 aa, Entamoeba dispar
SSRESQ

SEQ ID NO: 2376215 - protein, 8 aa, Entamoeba dispar
SSRGSDCN

SEQ ID NO: 2376216 - protein, 13 aa, Entamoeba dispar
SSRIQNNRRMGAK

SEQ ID NO: 2376217 - protein, 7 aa, Entamoeba dispar
SSRLSSS

SEQ ID NO: 2376218 - protein, 4 aa, Entamoeba dispar
SSRN

SEQ ID NO: 2376219 - protein, 5 aa, Entamoeba dispar
SSRNP

SEQ ID NO: 2376220 - protein, 4 aa, Entamoeba dispar
SSRT

SEQ ID NO: 2376221 - protein, 8 aa, Entamoeba dispar
SSSAPMSG

SEQ ID NO: 2376222 - protein, 6 aa, Entamoeba dispar
SSSCPV

SEQ ID NO: 2376223 - protein, 9 aa, Entamoeba dispar
SSSDDYATF

SEQ ID NO: 2376224 - protein, 6 aa, Entamoeba dispar
SSSDRF

SEQ ID NO: 2376225 - protein, 7 aa, Entamoeba dispar
SSSDVGV

SEQ ID NO: 2376226 - protein, 14 aa, Entamoeba dispar
SSSEESNDLPYCGE

SEQ ID NO: 2376227 - protein, 7 aa, Entamoeba dispar
SSSEFSD

SEQ ID NO: 2376228 - protein, 6 aa, Entamoeba dispar
SSSENI

SEQ ID NO: 2376229 - protein, 14 aa, Entamoeba dispar
SSSESRKKNKYDLG

SEQ ID NO: 2376230 - protein, 17 aa, Entamoeba dispar
SSSESSEITDETNDETN

SEQ ID NO: 2376231 - protein, 10 aa, Entamoeba dispar
SSSGDNEQCS

SEQ ID NO: 2376232 - protein, 10 aa, Entamoeba dispar
SSSHSSSSHS

SEQ ID NO: 2376233 - protein, 4 aa, Entamoeba dispar
SSSI

SEQ ID NO: 2376234 - protein, 5 aa, Entamoeba dispar
SSSIE

SEQ ID NO: 2376235 - protein, 9 aa, Entamoeba dispar
SSSKCTTCA

SEQ ID NO: 2376236 - protein, 8 aa, Entamoeba dispar
SSSKGTFT

SEQ ID NO: 2376237 - protein, 18 aa, Entamoeba dispar
SSSKSRVVSPNNEDGKNC

SEQ ID NO: 2376238 - protein, 7 aa, Entamoeba dispar
SSSLEKM

SEQ ID NO: 2376239 - protein, 15 aa, Entamoeba dispar
SSSLKEFPSPTAQNK

SEQ ID NO: 2376240 - protein, 5 aa, Entamoeba dispar
SSSNI

SEQ ID NO: 2376241 - protein, 9 aa, Entamoeba dispar
SSSNKNGEL

SEQ ID NO: 2376242 - protein, 6 aa, Entamoeba dispar
SSSNQI

SEQ ID NO: 2376243 - protein, 9 aa, Entamoeba dispar
SSSNQPDYR

SEQ ID NO: 2376244 - protein, 13 aa, Entamoeba dispar
SSSNSNFKEKRNG

SEQ ID NO: 2376245 - protein, 42 aa, Entamoeba dispar
SSSNVGSLSKSCDGKISGSSRFYTGTDPKCNCEYSEGSFKQR

SEQ ID NO: 2376246 - protein, 7 aa, Entamoeba dispar
SSSPLTL

SEQ ID NO: 2376247 - protein, 6 aa, Entamoeba dispar
SSSRCS

SEQ ID NO: 2376248 - protein, 22 aa, Entamoeba dispar
SSSRSMSNSPILPTSERPTSFL

SEQ ID NO: 2376249 - protein, 11 aa, Entamoeba dispar
SSSSDAEISDR

SEQ ID NO: 2376250 - protein, 8 aa, Entamoeba dispar
SSSSESWI

SEQ ID NO: 2376251 - protein, 8 aa, Entamoeba dispar
SSSSIAFT

SEQ ID NO: 2376252 - protein, 6 aa, Entamoeba dispar
SSSSKE

SEQ ID NO: 2376253 - protein, 5 aa, Entamoeba dispar
SSSSS

SEQ ID NO: 2376254 - protein, 15 aa, Entamoeba dispar
SSSSSSPPQPNPSPL

SEQ ID NO: 2376255 - protein, 8 aa, Entamoeba dispar
SSSSSSSL

SEQ ID NO: 2376256 - protein, 12 aa, Entamoeba dispar
SSSSTDKEIRSA

SEQ ID NO: 2376257 - protein, 5 aa, Entamoeba dispar
SSSSY

SEQ ID NO: 2376258 - protein, 7 aa, Entamoeba dispar
SSSTDRI

SEQ ID NO: 2376259 - protein, 7 aa, Entamoeba dispar
SSSTETI

SEQ ID NO: 2376260 - protein, 6 aa, Entamoeba dispar
SSSTIH

SEQ ID NO: 2376261 - protein, 9 aa, Entamoeba dispar
SSSTSGYPH

SEQ ID NO: 2376262 - protein, 4 aa, Entamoeba dispar
SSSV

SEQ ID NO: 2376263 - protein, 9 aa, Entamoeba dispar
SSSVDNPKD

SEQ ID NO: 2376264 - protein, 14 aa, Entamoeba dispar
SSSVQLDDSEVDGS

SEQ ID NO: 2376265 - protein, 5 aa, Entamoeba dispar
SSSVT

SEQ ID NO: 2376266 - protein, 7 aa, Entamoeba dispar
SSSYSLK

SEQ ID NO: 2376267 - protein, 4 aa, Entamoeba dispar
SSTA

SEQ ID NO: 2376268 - protein, 13 aa, Entamoeba dispar
SSTDKNSCLQTSE

SEQ ID NO: 2376269 - protein, 6 aa, Entamoeba dispar
SSTDQN

SEQ ID NO: 2376270 - protein, 5 aa, Entamoeba dispar
SSTFS

SEQ ID NO: 2376271 - protein, 16 aa, Entamoeba dispar
SSTKEAGQYPKQLEGD

SEQ ID NO: 2376272 - protein, 10 aa, Entamoeba dispar
SSTKSQSDFP

SEQ ID NO: 2376273 - protein, 9 aa, Entamoeba dispar
SSTMSSASA

SEQ ID NO: 2376274 - protein, 14 aa, Entamoeba dispar
SSTNPSSLLTRITQ

SEQ ID NO: 2376275 - protein, 7 aa, Entamoeba dispar
SSTPKKR

SEQ ID NO: 2376276 - protein, 10 aa, Entamoeba dispar
SSTPQIEPNN

SEQ ID NO: 2376277 - protein, 8 aa, Entamoeba dispar
SSTPQLRS

SEQ ID NO: 2376278 - protein, 8 aa, Entamoeba dispar
SSTPSFPL

SEQ ID NO: 2376279 - protein, 10 aa, Entamoeba dispar
SSTPYDQGPC

SEQ ID NO: 2376280 - protein, 4 aa, Entamoeba dispar
SSTQ

SEQ ID NO: 2376281 - protein, 4 aa, Entamoeba dispar
SSTR

SEQ ID NO: 2376282 - protein, 5 aa, Entamoeba dispar
SSTSY

SEQ ID NO: 2376283 - protein, 4 aa, Entamoeba dispar
SSTT

SEQ ID NO: 2376284 - protein, 45 aa, Entamoeba dispar
SSTTATTSVESKEVLSDSGEEVTVSSVTSDATTSDNIVSTPDTLN

SEQ ID NO: 2376285 - protein, 8 aa, Entamoeba dispar
SSTTQDYY

SEQ ID NO: 2376286 - protein, 6 aa, Entamoeba dispar
SSTVKG

SEQ ID NO: 2376287 - protein, 6 aa, Entamoeba dispar
SSVDCD

SEQ ID NO: 2376288 - protein, 9 aa, Entamoeba dispar
SSVDNSPVY

SEQ ID NO: 2376289 - protein, 8 aa, Entamoeba dispar
SSVDSESG

SEQ ID NO: 2376290 - protein, 4 aa, Entamoeba dispar
SSVE

SEQ ID NO: 2376291 - protein, 14 aa, Entamoeba dispar
SSVEGKLENQGINQ

SEQ ID NO: 2376292 - protein, 6 aa, Entamoeba dispar
SSVGLS

SEQ ID NO: 2376293 - protein, 5 aa, Entamoeba dispar
SSVPT

SEQ ID NO: 2376294 - protein, 13 aa, Entamoeba dispar
SSVSCSATENYET

SEQ ID NO: 2376295 - protein, 14 aa, Entamoeba dispar
SSVSSYSSANEKTL

SEQ ID NO: 2376296 - protein, 9 aa, Entamoeba dispar
SSVTSYGNI

SEQ ID NO: 2376297 - protein, 5 aa, Entamoeba dispar
SSYAG

SEQ ID NO: 2376298 - protein, 17 aa, Entamoeba dispar
SSYDSKDSSKNITEDNP

SEQ ID NO: 2376299 - protein, 7 aa, Entamoeba dispar
SSYEGNV

SEQ ID NO: 2376300 - protein, 5 aa, Entamoeba dispar
SSYEQ

SEQ ID NO: 2376301 - protein, 9 aa, Entamoeba dispar
SSYFTHDGD

SEQ ID NO: 2376302 - protein, 8 aa, Entamoeba dispar
SSYGESVG

SEQ ID NO: 2376303 - protein, 5 aa, Entamoeba dispar
SSYGV

SEQ ID NO: 2376304 - protein, 4 aa, Entamoeba dispar
SSYL

SEQ ID NO: 2376305 - protein, 7 aa, Entamoeba dispar
SSYLDSS

SEQ ID NO: 2376306 - protein, 6 aa, Entamoeba dispar
SSYPGI

SEQ ID NO: 2376307 - protein, 31 aa, Entamoeba dispar
SSYPNNIHNNNESLSLSTEVSNNSLKDSQNI

SEQ ID NO: 2376308 - protein, 5 aa, Entamoeba dispar
SSYQT

SEQ ID NO: 2376309 - protein, 14 aa, Entamoeba dispar
SSYSNEDKGLGTPV

SEQ ID NO: 2376310 - protein, 7 aa, Entamoeba dispar
SSYTGSG

SEQ ID NO: 2376311 - protein, 5 aa, Entamoeba dispar
STAGH

SEQ ID NO: 2376312 - protein, 4 aa, Entamoeba dispar
STAL

SEQ ID NO: 2376313 - protein, 6 aa, Entamoeba dispar
STAQQL

SEQ ID NO: 2376314 - protein, 10 aa, Entamoeba dispar
STARDTTSHK

SEQ ID NO: 2376315 - protein, 6 aa, Entamoeba dispar
STASSV

SEQ ID NO: 2376316 - protein, 5 aa, Entamoeba dispar
STATP

SEQ ID NO: 2376317 - protein, 5 aa, Entamoeba dispar
STCEI

SEQ ID NO: 2376318 - protein, 9 aa, Entamoeba dispar
STCENSTSC

SEQ ID NO: 2376319 - protein, 18 aa, Entamoeba dispar
STCGNGKIDEYEECDGGY

SEQ ID NO: 2376320 - protein, 18 aa, Entamoeba dispar
STCGNNEINKYEECDGGY

SEQ ID NO: 2376321 - protein, 7 aa, Entamoeba dispar
STCKNYS

SEQ ID NO: 2376322 - protein, 7 aa, Entamoeba dispar
STCNNAN

SEQ ID NO: 2376323 - protein, 4 aa, Entamoeba dispar
STCS

SEQ ID NO: 2376324 - protein, 9 aa, Entamoeba dispar
STCSQTESK

SEQ ID NO: 2376325 - protein, 8 aa, Entamoeba dispar
STDEWKGE

SEQ ID NO: 2376326 - protein, 5 aa, Entamoeba dispar
STDKM

SEQ ID NO: 2376327 - protein, 8 aa, Entamoeba dispar
STDLPSSL

SEQ ID NO: 2376328 - protein, 7 aa, Entamoeba dispar
STDLSNY

SEQ ID NO: 2376329 - protein, 6 aa, Entamoeba dispar
STDRYT

SEQ ID NO: 2376330 - protein, 11 aa, Entamoeba dispar
STDSGKISPYR

SEQ ID NO: 2376331 - protein, 9 aa, Entamoeba dispar
STDSTISSI

SEQ ID NO: 2376332 - protein, 6 aa, Entamoeba dispar
STDYVS

SEQ ID NO: 2376333 - protein, 4 aa, Entamoeba dispar
STEE

SEQ ID NO: 2376334 - protein, 6 aa, Entamoeba dispar
STEEKC

SEQ ID NO: 2376335 - protein, 7 aa, Entamoeba dispar
STEESGS

SEQ ID NO: 2376336 - protein, 15 aa, Entamoeba dispar
STEESISINNREKKI

SEQ ID NO: 2376337 - protein, 21 aa, Entamoeba dispar
STEGESDQNTNEKGKKEFRNQ

SEQ ID NO: 2376338 - protein, 7 aa, Entamoeba dispar
STEGVET

SEQ ID NO: 2376339 - protein, 8 aa, Entamoeba dispar
STEKFDSK

SEQ ID NO: 2376340 - protein, 8 aa, Entamoeba dispar
STELARED

SEQ ID NO: 2376341 - protein, 14 aa, Entamoeba dispar
STELTTSAYGISSS

SEQ ID NO: 2376342 - protein, 12 aa, Entamoeba dispar
STENNEIINPAN

SEQ ID NO: 2376343 - protein, 10 aa, Entamoeba dispar
STENTANKVK

SEQ ID NO: 2376344 - protein, 10 aa, Entamoeba dispar
STERKTANNL

SEQ ID NO: 2376345 - protein, 7 aa, Entamoeba dispar
STESESI

SEQ ID NO: 2376346 - protein, 5 aa, Entamoeba dispar
STESH

SEQ ID NO: 2376347 - protein, 12 aa, Entamoeba dispar
STETKITETSGI

SEQ ID NO: 2376348 - protein, 5 aa, Entamoeba dispar
STETV

SEQ ID NO: 2376349 - protein, 5 aa, Entamoeba dispar
STEYK

SEQ ID NO: 2376350 - protein, 6 aa, Entamoeba dispar
STFESN

SEQ ID NO: 2376351 - protein, 5 aa, Entamoeba dispar
STFSP

SEQ ID NO: 2376352 - protein, 10 aa, Entamoeba dispar
STGCSECEPG

SEQ ID NO: 2376353 - protein, 6 aa, Entamoeba dispar
STGDCS

SEQ ID NO: 2376354 - protein, 6 aa, Entamoeba dispar
STGESA

SEQ ID NO: 2376355 - protein, 5 aa, Entamoeba dispar
STGGQ

SEQ ID NO: 2376356 - protein, 8 aa, Entamoeba dispar
STGKLTIT

SEQ ID NO: 2376357 - protein, 9 aa, Entamoeba dispar
STGKRYTET

SEQ ID NO: 2376358 - protein, 7 aa, Entamoeba dispar
STGKTVN

SEQ ID NO: 2376359 - protein, 8 aa, Entamoeba dispar
STGNKSKC

SEQ ID NO: 2376360 - protein, 11 aa, Entamoeba dispar
STGNSCNECTS

SEQ ID NO: 2376361 - protein, 6 aa, Entamoeba dispar
STGTKN

SEQ ID NO: 2376362 - protein, 5 aa, Entamoeba dispar
STGYV

SEQ ID NO: 2376363 - protein, 8 aa, Entamoeba dispar
STHESEPS

SEQ ID NO: 2376364 - protein, 37 aa, Entamoeba dispar
STIESSSSSMSHGSETISSSVSQESESSTSGRSQNNS

SEQ ID NO: 2376365 - protein, 9 aa, Entamoeba dispar
STIKNTEEA

SEQ ID NO: 2376366 - protein, 15 aa, Entamoeba dispar
STINTDNQSKHSFSS

SEQ ID NO: 2376367 - protein, 6 aa, Entamoeba dispar
STIPDV

SEQ ID NO: 2376368 - protein, 9 aa, Entamoeba dispar
STIQNRTTT

SEQ ID NO: 2376369 - protein, 6 aa, Entamoeba dispar
STIRTL

SEQ ID NO: 2376370 - protein, 5 aa, Entamoeba dispar
STISD

SEQ ID NO: 2376371 - protein, 4 aa, Entamoeba dispar
STIT

SEQ ID NO: 2376372 - protein, 5 aa, Entamoeba dispar
STITS

SEQ ID NO: 2376373 - protein, 6 aa, Entamoeba dispar
STITSF

SEQ ID NO: 2376374 - protein, 5 aa, Entamoeba dispar
STKCK

SEQ ID NO: 2376375 - protein, 8 aa, Entamoeba dispar
STKDQLDK

SEQ ID NO: 2376376 - protein, 9 aa, Entamoeba dispar
STKDQQKRL

SEQ ID NO: 2376377 - protein, 6 aa, Entamoeba dispar
STKDSP

SEQ ID NO: 2376378 - protein, 5 aa, Entamoeba dispar
STKDV

SEQ ID NO: 2376379 - protein, 4 aa, Entamoeba dispar
STKE

SEQ ID NO: 2376380 - protein, 59 aa, Entamoeba dispar
STKEEREASEKLKKEKSLNEDRSDIELKDENNEHSCVENEQSEEDPEKKNKASNKKDMN

SEQ ID NO: 2376381 - protein, 6 aa, Entamoeba dispar
STKEGD

SEQ ID NO: 2376382 - protein, 8 aa, Entamoeba dispar
STKENDTK

SEQ ID NO: 2376383 - protein, 8 aa, Entamoeba dispar
STKENQLK

SEQ ID NO: 2376384 - protein, 10 aa, Entamoeba dispar
STKENTNKFS

SEQ ID NO: 2376385 - protein, 6 aa, Entamoeba dispar
STKERM

SEQ ID NO: 2376386 - protein, 6 aa, Entamoeba dispar
STKGYQ

SEQ ID NO: 2376387 - protein, 6 aa, Entamoeba dispar
STKKRM

SEQ ID NO: 2376388 - protein, 11 aa, Entamoeba dispar
STKKSNKNLSS

SEQ ID NO: 2376389 - protein, 7 aa, Entamoeba dispar
STKLDHT

SEQ ID NO: 2376390 - protein, 11 aa, Entamoeba dispar
STKNCKRSSQN

SEQ ID NO: 2376391 - protein, 14 aa, Entamoeba dispar
STKNKWFINLCLTF

SEQ ID NO: 2376392 - protein, 12 aa, Entamoeba dispar
STKNQNEWNNRR

SEQ ID NO: 2376393 - protein, 7 aa, Entamoeba dispar
STKPPIK

SEQ ID NO: 2376394 - protein, 10 aa, Entamoeba dispar
STKSGGSMSL

SEQ ID NO: 2376395 - protein, 6 aa, Entamoeba dispar
STKSNR

SEQ ID NO: 2376396 - protein, 7 aa, Entamoeba dispar
STKTPHR

SEQ ID NO: 2376397 - protein, 16 aa, Entamoeba dispar
STLDSNCQTCSTNSTE

SEQ ID NO: 2376398 - protein, 5 aa, Entamoeba dispar
STLES

SEQ ID NO: 2376399 - protein, 13 aa, Entamoeba dispar
STLGECPNECNGN

SEQ ID NO: 2376400 - protein, 20 aa, Entamoeba dispar
STLKNSGRSRKSPRTNRGGT

SEQ ID NO: 2376401 - protein, 9 aa, Entamoeba dispar
STLKNSIDP

SEQ ID NO: 2376402 - protein, 8 aa, Entamoeba dispar
STLKSDSN

SEQ ID NO: 2376403 - protein, 4 aa, Entamoeba dispar
STLP

SEQ ID NO: 2376404 - protein, 6 aa, Entamoeba dispar
STLSEG

SEQ ID NO: 2376405 - protein, 6 aa, Entamoeba dispar
STLSGD

SEQ ID NO: 2376406 - protein, 9 aa, Entamoeba dispar
STLSGNFDE

SEQ ID NO: 2376407 - protein, 10 aa, Entamoeba dispar
STLTLTENTT

SEQ ID NO: 2376408 - protein, 11 aa, Entamoeba dispar
STNAKALPKIS

SEQ ID NO: 2376409 - protein, 16 aa, Entamoeba dispar
STNATQFSISNSDNSY

SEQ ID NO: 2376410 - protein, 5 aa, Entamoeba dispar
STNCC

SEQ ID NO: 2376411 - protein, 8 aa, Entamoeba dispar
STNDNTKK

SEQ ID NO: 2376412 - protein, 9 aa, Entamoeba dispar
STNDTTPLE

SEQ ID NO: 2376413 - protein, 6 aa, Entamoeba dispar
STNEKY

SEQ ID NO: 2376414 - protein, 6 aa, Entamoeba dispar
STNENI

SEQ ID NO: 2376415 - protein, 9 aa, Entamoeba dispar
STNENSISE

SEQ ID NO: 2376416 - protein, 6 aa, Entamoeba dispar
STNGID

SEQ ID NO: 2376417 - protein, 6 aa, Entamoeba dispar
STNIKS

SEQ ID NO: 2376418 - protein, 4 aa, Entamoeba dispar
STNK

SEQ ID NO: 2376419 - protein, 5 aa, Entamoeba dispar
STNKK

SEQ ID NO: 2376420 - protein, 6 aa, Entamoeba dispar
STNKQI

SEQ ID NO: 2376421 - protein, 16 aa, Entamoeba dispar
STNMSSPLNPSKMPEI

SEQ ID NO: 2376422 - protein, 6 aa, Entamoeba dispar
STNNEG

SEQ ID NO: 2376423 - protein, 20 aa, Entamoeba dispar
STNNIKANLTKKQQNENEDW

SEQ ID NO: 2376424 - protein, 7 aa, Entamoeba dispar
STNNQRI

SEQ ID NO: 2376425 - protein, 17 aa, Entamoeba dispar
STNPEVNYTRNNGKNVT

SEQ ID NO: 2376426 - protein, 4 aa, Entamoeba dispar
STNR

SEQ ID NO: 2376427 - protein, 8 aa, Entamoeba dispar
STNSPESL

SEQ ID NO: 2376428 - protein, 7 aa, Entamoeba dispar
STNTSEV

SEQ ID NO: 2376429 - protein, 5 aa, Entamoeba dispar
STNYD

SEQ ID NO: 2376430 - protein, 38 aa, Entamoeba dispar
STPEHLSESSEGKTPRTSEVNESKTSSKNSEESEPSIV

SEQ ID NO: 2376431 - protein, 10 aa, Entamoeba dispar
STPKEINEKK

SEQ ID NO: 2376432 - protein, 9 aa, Entamoeba dispar
STPMKQNTK

SEQ ID NO: 2376433 - protein, 7 aa, Entamoeba dispar
STPNDFQ

SEQ ID NO: 2376434 - protein, 8 aa, Entamoeba dispar
STPNLNDS

SEQ ID NO: 2376435 - protein, 43 aa, Entamoeba dispar
STPNTPVTSLNQSGIQTPRNRKRTNSIVQSSSIDKLNNIQDSK

SEQ ID NO: 2376436 - protein, 8 aa, Entamoeba dispar
STPPPTPI

SEQ ID NO: 2376437 - protein, 5 aa, Entamoeba dispar
STPQT

SEQ ID NO: 2376438 - protein, 13 aa, Entamoeba dispar
STPSEEKKPGDES

SEQ ID NO: 2376439 - protein, 6 aa, Entamoeba dispar
STPSYL

SEQ ID NO: 2376440 - protein, 4 aa, Entamoeba dispar
STPV

SEQ ID NO: 2376441 - protein, 11 aa, Entamoeba dispar
STQECIKGPSN

SEQ ID NO: 2376442 - protein, 21 aa, Entamoeba dispar
STQIPNQIQDQYTQDDKVSGN

SEQ ID NO: 2376443 - protein, 13 aa, Entamoeba dispar
STQLNGDTQTETL

SEQ ID NO: 2376444 - protein, 7 aa, Entamoeba dispar
STQPPTI

SEQ ID NO: 2376445 - protein, 5 aa, Entamoeba dispar
STQQT

SEQ ID NO: 2376446 - protein, 7 aa, Entamoeba dispar
STQTDNL

SEQ ID NO: 2376447 - protein, 25 aa, Entamoeba dispar
STRALSKKLDDNEDNNEDDNKDITI

SEQ ID NO: 2376448 - protein, 6 aa, Entamoeba dispar
STRIPE

SEQ ID NO: 2376449 - protein, 19 aa, Entamoeba dispar
STRLDPDEIKEEKKIGEGS

SEQ ID NO: 2376450 - protein, 5 aa, Entamoeba dispar
STSAC

SEQ ID NO: 2376451 - protein, 11 aa, Entamoeba dispar
STSDADNGYDI

SEQ ID NO: 2376452 - protein, 6 aa, Entamoeba dispar
STSDQS

SEQ ID NO: 2376453 - protein, 7 aa, Entamoeba dispar
STSEEEL

SEQ ID NO: 2376454 - protein, 8 aa, Entamoeba dispar
STSEEINP

SEQ ID NO: 2376455 - protein, 15 aa, Entamoeba dispar
STSGDLDGQDNSSKF

SEQ ID NO: 2376456 - protein, 4 aa, Entamoeba dispar
STSH

SEQ ID NO: 2376457 - protein, 5 aa, Entamoeba dispar
STSHD

SEQ ID NO: 2376458 - protein, 7 aa, Entamoeba dispar
STSHKYG

SEQ ID NO: 2376459 - protein, 7 aa, Entamoeba dispar
STSIEDK

SEQ ID NO: 2376460 - protein, 19 aa, Entamoeba dispar
STSITQDDPITNDPSGEYH

SEQ ID NO: 2376461 - protein, 9 aa, Entamoeba dispar
STSKHDRCE

SEQ ID NO: 2376462 - protein, 8 aa, Entamoeba dispar
STSKMNDV

SEQ ID NO: 2376463 - protein, 5 aa, Entamoeba dispar
STSKS

SEQ ID NO: 2376464 - protein, 8 aa, Entamoeba dispar
STSLPPVD

SEQ ID NO: 2376465 - protein, 9 aa, Entamoeba dispar
STSNATKNE

SEQ ID NO: 2376466 - protein, 5 aa, Entamoeba dispar
STSND

SEQ ID NO: 2376467 - protein, 12 aa, Entamoeba dispar
STSNINSFQQSG

SEQ ID NO: 2376468 - protein, 15 aa, Entamoeba dispar
STSNRNHANQFAQNE

SEQ ID NO: 2376469 - protein, 8 aa, Entamoeba dispar
STSNTFKA

SEQ ID NO: 2376470 - protein, 8 aa, Entamoeba dispar
STSNTTYS

SEQ ID NO: 2376471 - protein, 8 aa, Entamoeba dispar
STSPSPDY

SEQ ID NO: 2376472 - protein, 21 aa, Entamoeba dispar
STSQEGNKIIKSKKDKPNNQN

SEQ ID NO: 2376473 - protein, 6 aa, Entamoeba dispar
STSQTN

SEQ ID NO: 2376474 - protein, 8 aa, Entamoeba dispar
STSRSQYS

SEQ ID NO: 2376475 - protein, 14 aa, Entamoeba dispar
STSSSTSAQINSPI

SEQ ID NO: 2376476 - protein, 7 aa, Entamoeba dispar
STSTDTG

SEQ ID NO: 2376477 - protein, 9 aa, Entamoeba dispar
STSWTPDED

SEQ ID NO: 2376478 - protein, 7 aa, Entamoeba dispar
STTADKV

SEQ ID NO: 2376479 - protein, 6 aa, Entamoeba dispar
STTCDK

SEQ ID NO: 2376480 - protein, 8 aa, Entamoeba dispar
STTDVSNS

SEQ ID NO: 2376481 - protein, 12 aa, Entamoeba dispar
STTDVSNSKKFN

SEQ ID NO: 2376482 - protein, 5 aa, Entamoeba dispar
STTFN

SEQ ID NO: 2376483 - protein, 4 aa, Entamoeba dispar
STTI

SEQ ID NO: 2376484 - protein, 6 aa, Entamoeba dispar
STTKSF

SEQ ID NO: 2376485 - protein, 7 aa, Entamoeba dispar
STTNDMG

SEQ ID NO: 2376486 - protein, 4 aa, Entamoeba dispar
STTP

SEQ ID NO: 2376487 - protein, 4 aa, Entamoeba dispar
STTQ

SEQ ID NO: 2376488 - protein, 4 aa, Entamoeba dispar
STTS

SEQ ID NO: 2376489 - protein, 11 aa, Entamoeba dispar
STTSAPSKTAR

SEQ ID NO: 2376490 - protein, 6 aa, Entamoeba dispar
STTSTE

SEQ ID NO: 2376491 - protein, 7 aa, Entamoeba dispar
STTTNTC

SEQ ID NO: 2376492 - protein, 5 aa, Entamoeba dispar
STTTT

SEQ ID NO: 2376493 - protein, 6 aa, Entamoeba dispar
STTYAS

SEQ ID NO: 2376494 - protein, 11 aa, Entamoeba dispar
STTYNSGSKSL

SEQ ID NO: 2376495 - protein, 10 aa, Entamoeba dispar
STVAGDKDNS

SEQ ID NO: 2376496 - protein, 15 aa, Entamoeba dispar
STVAGENEGTRRKQW

SEQ ID NO: 2376497 - protein, 18 aa, Entamoeba dispar
STVGKEASIGKENRNSSI

SEQ ID NO: 2376498 - protein, 7 aa, Entamoeba dispar
STVHRNE

SEQ ID NO: 2376499 - protein, 8 aa, Entamoeba dispar
STVPEEGT

SEQ ID NO: 2376500 - protein, 25 aa, Entamoeba dispar
STVSSSNEKPEESNGLNDSTTKQFV

SEQ ID NO: 2376501 - protein, 8 aa, Entamoeba dispar
STYEGGST

SEQ ID NO: 2376502 - protein, 5 aa, Entamoeba dispar
STYHS

SEQ ID NO: 2376503 - protein, 8 aa, Entamoeba dispar
STYKQETS

SEQ ID NO: 2376504 - protein, 5 aa, Entamoeba dispar
STYNK

SEQ ID NO: 2376505 - protein, 7 aa, Entamoeba dispar
STYPNSL

SEQ ID NO: 2376506 - protein, 7 aa, Entamoeba dispar
STYQTFQ

SEQ ID NO: 2376507 - protein, 6 aa, Entamoeba dispar
STYSTI

SEQ ID NO: 2376508 - protein, 6 aa, Entamoeba dispar
SVAEGN

SEQ ID NO: 2376509 - protein, 16 aa, Entamoeba dispar
SVAGKTKCAPPSCGNG

SEQ ID NO: 2376510 - protein, 8 aa, Entamoeba dispar
SVAGSYDN

SEQ ID NO: 2376511 - protein, 10 aa, Entamoeba dispar
SVAPLQDKRK

SEQ ID NO: 2376512 - protein, 5 aa, Entamoeba dispar
SVASM

SEQ ID NO: 2376513 - protein, 10 aa, Entamoeba dispar
SVDDEPSISL

SEQ ID NO: 2376514 - protein, 12 aa, Entamoeba dispar
SVDKEKKYYQEQ

SEQ ID NO: 2376515 - protein, 9 aa, Entamoeba dispar
SVDKKQSTR

SEQ ID NO: 2376516 - protein, 10 aa, Entamoeba dispar
SVDSKDDPQC

SEQ ID NO: 2376517 - protein, 27 aa, Entamoeba dispar
SVDSTRSEKDDDTRSEKDDSTRSEKEI

SEQ ID NO: 2376518 - protein, 21 aa, Entamoeba dispar
SVDTSSAEAGSINCESSDSVE

SEQ ID NO: 2376519 - protein, 13 aa, Entamoeba dispar
SVEGSIDDIQSNG

SEQ ID NO: 2376520 - protein, 11 aa, Entamoeba dispar
SVEGSSSIVSN

SEQ ID NO: 2376521 - protein, 8 aa, Entamoeba dispar
SVENKTIS

SEQ ID NO: 2376522 - protein, 8 aa, Entamoeba dispar
SVEQSRSE

SEQ ID NO: 2376523 - protein, 8 aa, Entamoeba dispar
SVESKETF

SEQ ID NO: 2376524 - protein, 11 aa, Entamoeba dispar
SVESSITLTPE

SEQ ID NO: 2376525 - protein, 7 aa, Entamoeba dispar
SVFSNTP

SEQ ID NO: 2376526 - protein, 9 aa, Entamoeba dispar
SVFSSSDRI

SEQ ID NO: 2376527 - protein, 7 aa, Entamoeba dispar
SVGTPTY

SEQ ID NO: 2376528 - protein, 12 aa, Entamoeba dispar
SVHGNVNTNNLE

SEQ ID NO: 2376529 - protein, 12 aa, Entamoeba dispar
SVHSTMNKWILS

SEQ ID NO: 2376530 - protein, 14 aa, Entamoeba dispar
SVHSTNTPYTPENK

SEQ ID NO: 2376531 - protein, 4 aa, Entamoeba dispar
SVIA

SEQ ID NO: 2376532 - protein, 11 aa, Entamoeba dispar
SVIPKNQQSRG

SEQ ID NO: 2376533 - protein, 9 aa, Entamoeba dispar
SVISTDKGQ

SEQ ID NO: 2376534 - protein, 7 aa, Entamoeba dispar
SVITGGA

SEQ ID NO: 2376535 - protein, 9 aa, Entamoeba dispar
SVKAESTAI

SEQ ID NO: 2376536 - protein, 5 aa, Entamoeba dispar
SVKEG

SEQ ID NO: 2376537 - protein, 13 aa, Entamoeba dispar
SVKEKKRKLEIEQ

SEQ ID NO: 2376538 - protein, 7 aa, Entamoeba dispar
SVKENDI

SEQ ID NO: 2376539 - protein, 17 aa, Entamoeba dispar
SVKENDIDSIWNFLKSI

SEQ ID NO: 2376540 - protein, 7 aa, Entamoeba dispar
SVKSNER

SEQ ID NO: 2376541 - protein, 11 aa, Entamoeba dispar
SVKSNNVQGHD

SEQ ID NO: 2376542 - protein, 10 aa, Entamoeba dispar
SVKVEPKNIK

SEQ ID NO: 2376543 - protein, 6 aa, Entamoeba dispar
SVMDPQ

SEQ ID NO: 2376544 - protein, 5 aa, Entamoeba dispar
SVMES

SEQ ID NO: 2376545 - protein, 17 aa, Entamoeba dispar
SVNDQDKIADIEKEGNC

SEQ ID NO: 2376546 - protein, 21 aa, Entamoeba dispar
SVNESSVDSEEDRKDQQSQTI

SEQ ID NO: 2376547 - protein, 8 aa, Entamoeba dispar
SVNESTLS

SEQ ID NO: 2376548 - protein, 11 aa, Entamoeba dispar
SVNGDSVAVTN

SEQ ID NO: 2376549 - protein, 12 aa, Entamoeba dispar
SVNGTKGSGGDY

SEQ ID NO: 2376550 - protein, 9 aa, Entamoeba dispar
SVNSENNQI

SEQ ID NO: 2376551 - protein, 11 aa, Entamoeba dispar
SVNSKPLKENK

SEQ ID NO: 2376552 - protein, 4 aa, Entamoeba dispar
SVNT

SEQ ID NO: 2376553 - protein, 26 aa, Entamoeba dispar
SVNTNDNSKYKFKPKSVCSRSVNGKA

SEQ ID NO: 2376554 - protein, 8 aa, Entamoeba dispar
SVNTPNEI

SEQ ID NO: 2376555 - protein, 4 aa, Entamoeba dispar
SVNY

SEQ ID NO: 2376556 - protein, 7 aa, Entamoeba dispar
SVPDENK

SEQ ID NO: 2376557 - protein, 10 aa, Entamoeba dispar
SVPLDTDKPQ

SEQ ID NO: 2376558 - protein, 18 aa, Entamoeba dispar
SVPPAPVVSGNESSPLIN

SEQ ID NO: 2376559 - protein, 23 aa, Entamoeba dispar
SVPTSLNTSVSSSCSSSIRVSLD

SEQ ID NO: 2376560 - protein, 14 aa, Entamoeba dispar
SVQESSGETEDDYC

SEQ ID NO: 2376561 - protein, 7 aa, Entamoeba dispar
SVQPGKD

SEQ ID NO: 2376562 - protein, 32 aa, Entamoeba dispar
SVQPQKECTNPIPKISQPPIKEENQIKDTPIP

SEQ ID NO: 2376563 - protein, 8 aa, Entamoeba dispar
SVQPTKTH

SEQ ID NO: 2376564 - protein, 22 aa, Entamoeba dispar
SVQSVDSTSVKGDEPVDTTLDE

SEQ ID NO: 2376565 - protein, 10 aa, Entamoeba dispar
SVQTRETENF

SEQ ID NO: 2376566 - protein, 5 aa, Entamoeba dispar
SVQTV

SEQ ID NO: 2376567 - protein, 4 aa, Entamoeba dispar
SVRD

SEQ ID NO: 2376568 - protein, 10 aa, Entamoeba dispar
SVRGDGTGID

SEQ ID NO: 2376569 - protein, 7 aa, Entamoeba dispar
SVRTDVE

SEQ ID NO: 2376570 - protein, 28 aa, Entamoeba dispar
SVSDCSDSCSNRIDYERTNPNTYQSPET

SEQ ID NO: 2376571 - protein, 4 aa, Entamoeba dispar
SVSG

SEQ ID NO: 2376572 - protein, 4 aa, Entamoeba dispar
SVSN

SEQ ID NO: 2376573 - protein, 9 aa, Entamoeba dispar
SVSNCEPNV

SEQ ID NO: 2376574 - protein, 4 aa, Entamoeba dispar
SVSP

SEQ ID NO: 2376575 - protein, 7 aa, Entamoeba dispar
SVSPNAR

SEQ ID NO: 2376576 - protein, 4 aa, Entamoeba dispar
SVSS

SEQ ID NO: 2376577 - protein, 10 aa, Entamoeba dispar
SVSSKFQSST

SEQ ID NO: 2376578 - protein, 6 aa, Entamoeba dispar
SVSSNL

SEQ ID NO: 2376579 - protein, 12 aa, Entamoeba dispar
SVSTCSKDVSHN

SEQ ID NO: 2376580 - protein, 6 aa, Entamoeba dispar
SVSVSS

SEQ ID NO: 2376581 - protein, 9 aa, Entamoeba dispar
SVTKGLKEW

SEQ ID NO: 2376582 - protein, 12 aa, Entamoeba dispar
SVTPNKQSLIGE

SEQ ID NO: 2376583 - protein, 6 aa, Entamoeba dispar
SVTTDE

SEQ ID NO: 2376584 - protein, 10 aa, Entamoeba dispar
SVTTQSSSGS

SEQ ID NO: 2376585 - protein, 11 aa, Entamoeba dispar
SVVKPENTNRY

SEQ ID NO: 2376586 - protein, 5 aa, Entamoeba dispar
SVYNR

SEQ ID NO: 2376587 - protein, 8 aa, Entamoeba dispar
SWDNTEEC

SEQ ID NO: 2376588 - protein, 15 aa, Entamoeba dispar
SWEKNTTKLPKLPTN

SEQ ID NO: 2376589 - protein, 8 aa, Entamoeba dispar
SYCSDSNT

SEQ ID NO: 2376590 - protein, 16 aa, Entamoeba dispar
SYDENLSGNRVDKEFE

SEQ ID NO: 2376591 - protein, 4 aa, Entamoeba dispar
SYDL

SEQ ID NO: 2376592 - protein, 9 aa, Entamoeba dispar
SYDTEHNGE

SEQ ID NO: 2376593 - protein, 9 aa, Entamoeba dispar
SYDTEHSKE

SEQ ID NO: 2376594 - protein, 8 aa, Entamoeba dispar
SYDTNTNK

SEQ ID NO: 2376595 - protein, 11 aa, Entamoeba dispar
SYDTSTKKCNK

SEQ ID NO: 2376596 - protein, 10 aa, Entamoeba dispar
SYELTENAKG

SEQ ID NO: 2376597 - protein, 5 aa, Entamoeba dispar
SYESD

SEQ ID NO: 2376598 - protein, 7 aa, Entamoeba dispar
SYETTQK

SEQ ID NO: 2376599 - protein, 6 aa, Entamoeba dispar
SYFPNS

SEQ ID NO: 2376600 - protein, 8 aa, Entamoeba dispar
SYGNPSHP

SEQ ID NO: 2376601 - protein, 9 aa, Entamoeba dispar
SYGSDIDIS

SEQ ID NO: 2376602 - protein, 17 aa, Entamoeba dispar
SYIGDGDPNYYPSPTID

SEQ ID NO: 2376603 - protein, 20 aa, Entamoeba dispar
SYIKNNDQCELKQSTNQITN

SEQ ID NO: 2376604 - protein, 5 aa, Entamoeba dispar
SYIRS

SEQ ID NO: 2376605 - protein, 5 aa, Entamoeba dispar
SYIRT

SEQ ID NO: 2376606 - protein, 12 aa, Entamoeba dispar
SYISQEDNKTQE

SEQ ID NO: 2376607 - protein, 5 aa, Entamoeba dispar
SYITE

SEQ ID NO: 2376608 - protein, 6 aa, Entamoeba dispar
SYKNYS

SEQ ID NO: 2376609 - protein, 9 aa, Entamoeba dispar
SYKSSEQTY

SEQ ID NO: 2376610 - protein, 6 aa, Entamoeba dispar
SYLDEN

SEQ ID NO: 2376611 - protein, 10 aa, Entamoeba dispar
SYLKGNEDNI

SEQ ID NO: 2376612 - protein, 13 aa, Entamoeba dispar
SYNEIHNDNNAAV

SEQ ID NO: 2376613 - protein, 11 aa, Entamoeba dispar
SYNEQGKKTVN

SEQ ID NO: 2376614 - protein, 27 aa, Entamoeba dispar
SYNKVKNTEEMTEEELKKEEEKKKKEP

SEQ ID NO: 2376615 - protein, 9 aa, Entamoeba dispar
SYNPRKPTE

SEQ ID NO: 2376616 - protein, 4 aa, Entamoeba dispar
SYNS

SEQ ID NO: 2376617 - protein, 9 aa, Entamoeba dispar
SYNSRSSTI

SEQ ID NO: 2376618 - protein, 16 aa, Entamoeba dispar
SYNTTESDNDNDNSNL

SEQ ID NO: 2376619 - protein, 4 aa, Entamoeba dispar
SYNV

SEQ ID NO: 2376620 - protein, 10 aa, Entamoeba dispar
SYPASSNCTI

SEQ ID NO: 2376621 - protein, 4 aa, Entamoeba dispar
SYPD

SEQ ID NO: 2376622 - protein, 5 aa, Entamoeba dispar
SYPSK

SEQ ID NO: 2376623 - protein, 8 aa, Entamoeba dispar
SYPSLRST

SEQ ID NO: 2376624 - protein, 8 aa, Entamoeba dispar
SYPTQYDN

SEQ ID NO: 2376625 - protein, 9 aa, Entamoeba dispar
SYQDEEGKT

SEQ ID NO: 2376626 - protein, 12 aa, Entamoeba dispar
SYQKKYSKDISR

SEQ ID NO: 2376627 - protein, 12 aa, Entamoeba dispar
SYQLSDEEYPNE

SEQ ID NO: 2376628 - protein, 9 aa, Entamoeba dispar
SYQQTENES

SEQ ID NO: 2376629 - protein, 11 aa, Entamoeba dispar
SYQTATDNNQK

SEQ ID NO: 2376630 - protein, 9 aa, Entamoeba dispar
SYQTQPDTN

SEQ ID NO: 2376631 - protein, 6 aa, Entamoeba dispar
SYQTST

SEQ ID NO: 2376632 - protein, 7 aa, Entamoeba dispar
SYQTSTY

SEQ ID NO: 2376633 - protein, 12 aa, Entamoeba dispar
SYRKKTNNRKQK

SEQ ID NO: 2376634 - protein, 5 aa, Entamoeba dispar
SYRPL

SEQ ID NO: 2376635 - protein, 7 aa, Entamoeba dispar
SYSNGTY

SEQ ID NO: 2376636 - protein, 6 aa, Entamoeba dispar
SYSNTT

SEQ ID NO: 2376637 - protein, 4 aa, Entamoeba dispar
SYSP

SEQ ID NO: 2376638 - protein, 12 aa, Entamoeba dispar
SYSPNEKKYLKT

SEQ ID NO: 2376639 - protein, 8 aa, Entamoeba dispar
SYSQPSSL

SEQ ID NO: 2376640 - protein, 6 aa, Entamoeba dispar
SYSSLK

SEQ ID NO: 2376641 - protein, 16 aa, Entamoeba dispar
SYSSSYAKESGKGKGI

SEQ ID NO: 2376642 - protein, 5 aa, Entamoeba dispar
SYSTI

SEQ ID NO: 2376643 - protein, 5 aa, Entamoeba dispar
SYSTP

SEQ ID NO: 2376644 - protein, 9 aa, Entamoeba dispar
SYSTTAEVN

SEQ ID NO: 2376645 - protein, 5 aa, Entamoeba dispar
SYTDP

SEQ ID NO: 2376646 - protein, 12 aa, Entamoeba dispar
SYTGCPNNNNLA

SEQ ID NO: 2376647 - protein, 16 aa, Entamoeba dispar
SYTKSDEEATTNTEEC

SEQ ID NO: 2376648 - protein, 9 aa, Entamoeba dispar
SYTLNATKG

SEQ ID NO: 2376649 - protein, 11 aa, Entamoeba dispar
SYTNNSNENTD

SEQ ID NO: 2376650 - protein, 5 aa, Entamoeba dispar
SYYNG

SEQ ID NO: 2376651 - protein, 14 aa, Entamoeba dispar
TAAAGEGGKDLYKG

SEQ ID NO: 2376652 - protein, 10 aa, Entamoeba dispar
TAAGKSQPAN

SEQ ID NO: 2376653 - protein, 14 aa, Entamoeba dispar
TACPEDYKQYADTV

SEQ ID NO: 2376654 - protein, 12 aa, Entamoeba dispar
TADAQQSELSSE

SEQ ID NO: 2376655 - protein, 8 aa, Entamoeba dispar
TADPKNII

SEQ ID NO: 2376656 - protein, 13 aa, Entamoeba dispar
TADRAHKIKTSLK

SEQ ID NO: 2376657 - protein, 7 aa, Entamoeba dispar
TADTPNK

SEQ ID NO: 2376658 - protein, 11 aa, Entamoeba dispar
TADTSKTPDSY

SEQ ID NO: 2376659 - protein, 6 aa, Entamoeba dispar
TAEENR

SEQ ID NO: 2376660 - protein, 4 aa, Entamoeba dispar
TAEN

SEQ ID NO: 2376661 - protein, 12 aa, Entamoeba dispar
TAEQDVNSAGVT

SEQ ID NO: 2376662 - protein, 7 aa, Entamoeba dispar
TAEQNNA

SEQ ID NO: 2376663 - protein, 10 aa, Entamoeba dispar
TAFSGESDRV

SEQ ID NO: 2376664 - protein, 8 aa, Entamoeba dispar
TAGKSVDQ

SEQ ID NO: 2376665 - protein, 6 aa, Entamoeba dispar
TAGQLT

SEQ ID NO: 2376666 - protein, 7 aa, Entamoeba dispar
TAHLGSS

SEQ ID NO: 2376667 - protein, 12 aa, Entamoeba dispar
TAIDPSATSVSY

SEQ ID NO: 2376668 - protein, 4 aa, Entamoeba dispar
TAIR

SEQ ID NO: 2376669 - protein, 6 aa, Entamoeba dispar
TALSTH

SEQ ID NO: 2376670 - protein, 5 aa, Entamoeba dispar
TALTS

SEQ ID NO: 2376671 - protein, 16 aa, Entamoeba dispar
TANSNGICTERKPIER

SEQ ID NO: 2376672 - protein, 7 aa, Entamoeba dispar
TANTFNG

SEQ ID NO: 2376673 - protein, 9 aa, Entamoeba dispar
TANVDLQTE

SEQ ID NO: 2376674 - protein, 6 aa, Entamoeba dispar
TAPEIT

SEQ ID NO: 2376675 - protein, 7 aa, Entamoeba dispar
TAPIEPN

SEQ ID NO: 2376676 - protein, 5 aa, Entamoeba dispar
TAPNS

SEQ ID NO: 2376677 - protein, 4 aa, Entamoeba dispar
TAPS

SEQ ID NO: 2376678 - protein, 5 aa, Entamoeba dispar
TAPSQ

SEQ ID NO: 2376679 - protein, 11 aa, Entamoeba dispar
TAPTPAARRAA

SEQ ID NO: 2376680 - protein, 5 aa, Entamoeba dispar
TAQKG

SEQ ID NO: 2376681 - protein, 9 aa, Entamoeba dispar
TAQKRYDKN

SEQ ID NO: 2376682 - protein, 7 aa, Entamoeba dispar
TAQKYYN

SEQ ID NO: 2376683 - protein, 11 aa, Entamoeba dispar
TAQLTEEPTKV

SEQ ID NO: 2376684 - protein, 10 aa, Entamoeba dispar
TARKSTEDDW

SEQ ID NO: 2376685 - protein, 8 aa, Entamoeba dispar
TARSYTKR

SEQ ID NO: 2376686 - protein, 5 aa, Entamoeba dispar
TASID

SEQ ID NO: 2376687 - protein, 6 aa, Entamoeba dispar
TASSDS

SEQ ID NO: 2376688 - protein, 6 aa, Entamoeba dispar
TATAFG

SEQ ID NO: 2376689 - protein, 10 aa, Entamoeba dispar
TATENDLEKI

SEQ ID NO: 2376690 - protein, 5 aa, Entamoeba dispar
TATQW

SEQ ID NO: 2376691 - protein, 7 aa, Entamoeba dispar
TATSVER

SEQ ID NO: 2376692 - protein, 5 aa, Entamoeba dispar
TATTC

SEQ ID NO: 2376693 - protein, 14 aa, Entamoeba dispar
TAYAAESKNKDGNF

SEQ ID NO: 2376694 - protein, 18 aa, Entamoeba dispar
TCANGGVSKDEECLRGSE

SEQ ID NO: 2376695 - protein, 4 aa, Entamoeba dispar
TCAQ

SEQ ID NO: 2376696 - protein, 9 aa, Entamoeba dispar
TCDRESQRC

SEQ ID NO: 2376697 - protein, 7 aa, Entamoeba dispar
TCDSGEF

SEQ ID NO: 2376698 - protein, 7 aa, Entamoeba dispar
TCDSNEF

SEQ ID NO: 2376699 - protein, 10 aa, Entamoeba dispar
TCDTENGVNA

SEQ ID NO: 2376700 - protein, 5 aa, Entamoeba dispar
TCEEF

SEQ ID NO: 2376701 - protein, 9 aa, Entamoeba dispar
TCEEPTNGT

SEQ ID NO: 2376702 - protein, 8 aa, Entamoeba dispar
TCENKQEI

SEQ ID NO: 2376703 - protein, 8 aa, Entamoeba dispar
TCETSTNM

SEQ ID NO: 2376704 - protein, 13 aa, Entamoeba dispar
TCEVREKEINPQT

SEQ ID NO: 2376705 - protein, 14 aa, Entamoeba dispar
TCEVREKGINPQTL

SEQ ID NO: 2376706 - protein, 17 aa, Entamoeba dispar
TCGNGNVDEYEECDGGY

SEQ ID NO: 2376707 - protein, 28 aa, Entamoeba dispar
TCGNGQRDSITDSKGNEIGEECDGGKNC

SEQ ID NO: 2376708 - protein, 19 aa, Entamoeba dispar
TCGNNEIDDYEECDGGRGC

SEQ ID NO: 2376709 - protein, 19 aa, Entamoeba dispar
TCGNNQIDEYEECDGGNGC

SEQ ID NO: 2376710 - protein, 17 aa, Entamoeba dispar
TCGPEDTSSNIKAQIEG

SEQ ID NO: 2376711 - protein, 6 aa, Entamoeba dispar
TCGSTA

SEQ ID NO: 2376712 - protein, 5 aa, Entamoeba dispar
TCKNY

SEQ ID NO: 2376713 - protein, 13 aa, Entamoeba dispar
TCKRKTNSDELDQ

SEQ ID NO: 2376714 - protein, 8 aa, Entamoeba dispar
TCNEEQKK

SEQ ID NO: 2376715 - protein, 6 aa, Entamoeba dispar
TCNEGY

SEQ ID NO: 2376716 - protein, 8 aa, Entamoeba dispar
TCNKDCGE

SEQ ID NO: 2376717 - protein, 4 aa, Entamoeba dispar
TCNN

SEQ ID NO: 2376718 - protein, 10 aa, Entamoeba dispar
TCNNDKAKCT

SEQ ID NO: 2376719 - protein, 8 aa, Entamoeba dispar
TCNNSQDL

SEQ ID NO: 2376720 - protein, 4 aa, Entamoeba dispar
TCNS

SEQ ID NO: 2376721 - protein, 9 aa, Entamoeba dispar
TCNSPSEYD

SEQ ID NO: 2376722 - protein, 6 aa, Entamoeba dispar
TCPCSG

SEQ ID NO: 2376723 - protein, 4 aa, Entamoeba dispar
TCPN

SEQ ID NO: 2376724 - protein, 8 aa, Entamoeba dispar
TCQREASG

SEQ ID NO: 2376725 - protein, 9 aa, Entamoeba dispar
TCRESDPYI

SEQ ID NO: 2376726 - protein, 7 aa, Entamoeba dispar
TCRPDGS

SEQ ID NO: 2376727 - protein, 25 aa, Entamoeba dispar
TCSGDKCATCEDGYKLDAGSMSCSK

SEQ ID NO: 2376728 - protein, 6 aa, Entamoeba dispar
TCSGTG

SEQ ID NO: 2376729 - protein, 8 aa, Entamoeba dispar
TCSNDADQ

SEQ ID NO: 2376730 - protein, 6 aa, Entamoeba dispar
TCSNKE

SEQ ID NO: 2376731 - protein, 7 aa, Entamoeba dispar
TCSSDDT

SEQ ID NO: 2376732 - protein, 9 aa, Entamoeba dispar
TCTASEENT

SEQ ID NO: 2376733 - protein, 10 aa, Entamoeba dispar
TCTDTTSTDH

SEQ ID NO: 2376734 - protein, 6 aa, Entamoeba dispar
TCTGCN

SEQ ID NO: 2376735 - protein, 6 aa, Entamoeba dispar
TCTGNR

SEQ ID NO: 2376736 - protein, 4 aa, Entamoeba dispar
TCTN

SEQ ID NO: 2376737 - protein, 6 aa, Entamoeba dispar
TCTTCN

SEQ ID NO: 2376738 - protein, 11 aa, Entamoeba dispar
TCVTDKNNSVK

SEQ ID NO: 2376739 - protein, 11 aa, Entamoeba dispar
TCVTDNNNSVK

SEQ ID NO: 2376740 - protein, 4 aa, Entamoeba dispar
TCYG

SEQ ID NO: 2376741 - protein, 9 aa, Entamoeba dispar
TDAASSTHI

SEQ ID NO: 2376742 - protein, 24 aa, Entamoeba dispar
TDAIRSAEYAESIEGVRGETKEEY

SEQ ID NO: 2376743 - protein, 8 aa, Entamoeba dispar
TDASSSTF

SEQ ID NO: 2376744 - protein, 5 aa, Entamoeba dispar
TDASV

SEQ ID NO: 2376745 - protein, 12 aa, Entamoeba dispar
TDCSDTIQTTPF

SEQ ID NO: 2376746 - protein, 4 aa, Entamoeba dispar
TDDI

SEQ ID NO: 2376747 - protein, 8 aa, Entamoeba dispar
TDDNGDAV

SEQ ID NO: 2376748 - protein, 6 aa, Entamoeba dispar
TDDPSL

SEQ ID NO: 2376749 - protein, 11 aa, Entamoeba dispar
TDDQLENGGNL

SEQ ID NO: 2376750 - protein, 12 aa, Entamoeba dispar
TDDQLESCCRKY

SEQ ID NO: 2376751 - protein, 4 aa, Entamoeba dispar
TDDS

SEQ ID NO: 2376752 - protein, 10 aa, Entamoeba dispar
TDDSNTEEEF

SEQ ID NO: 2376753 - protein, 5 aa, Entamoeba dispar
TDECR

SEQ ID NO: 2376754 - protein, 6 aa, Entamoeba dispar
TDEEIE

SEQ ID NO: 2376755 - protein, 7 aa, Entamoeba dispar
TDEEIPN

SEQ ID NO: 2376756 - protein, 5 aa, Entamoeba dispar
TDEGE

SEQ ID NO: 2376757 - protein, 9 aa, Entamoeba dispar
TDEKDRAER

SEQ ID NO: 2376758 - protein, 6 aa, Entamoeba dispar
TDEKSC

SEQ ID NO: 2376759 - protein, 8 aa, Entamoeba dispar
TDFDPQRF

SEQ ID NO: 2376760 - protein, 7 aa, Entamoeba dispar
TDFDTSK

SEQ ID NO: 2376761 - protein, 7 aa, Entamoeba dispar
TDFGSAR

SEQ ID NO: 2376762 - protein, 8 aa, Entamoeba dispar
TDFGSARN

SEQ ID NO: 2376763 - protein, 10 aa, Entamoeba dispar
TDFGSSRNVN

SEQ ID NO: 2376764 - protein, 12 aa, Entamoeba dispar
TDFGSSRNVNSM

SEQ ID NO: 2376765 - protein, 8 aa, Entamoeba dispar
TDFGSSRS

SEQ ID NO: 2376766 - protein, 11 aa, Entamoeba dispar
TDFGSSRSITL

SEQ ID NO: 2376767 - protein, 19 aa, Entamoeba dispar
TDFGTSRIKRNSDKGLGTP

SEQ ID NO: 2376768 - protein, 4 aa, Entamoeba dispar
TDFS

SEQ ID NO: 2376769 - protein, 5 aa, Entamoeba dispar
TDFTP

SEQ ID NO: 2376770 - protein, 10 aa, Entamoeba dispar
TDGCASDSKL

SEQ ID NO: 2376771 - protein, 5 aa, Entamoeba dispar
TDGSA

SEQ ID NO: 2376772 - protein, 7 aa, Entamoeba dispar
TDGSGCG

SEQ ID NO: 2376773 - protein, 23 aa, Entamoeba dispar
TDGSKFSSSTLRSRERLQNDSTK

SEQ ID NO: 2376774 - protein, 21 aa, Entamoeba dispar
TDGSKFSSSTLRSRERSMNKD

SEQ ID NO: 2376775 - protein, 13 aa, Entamoeba dispar
TDGSYFDSTTRTC

SEQ ID NO: 2376776 - protein, 10 aa, Entamoeba dispar
TDIERTRSAM

SEQ ID NO: 2376777 - protein, 4 aa, Entamoeba dispar
TDIN

SEQ ID NO: 2376778 - protein, 4 aa, Entamoeba dispar
TDIP

SEQ ID NO: 2376779 - protein, 5 aa, Entamoeba dispar
TDIRK

SEQ ID NO: 2376780 - protein, 5 aa, Entamoeba dispar
TDISH

SEQ ID NO: 2376781 - protein, 7 aa, Entamoeba dispar
TDITQQK

SEQ ID NO: 2376782 - protein, 4 aa, Entamoeba dispar
TDKE

SEQ ID NO: 2376783 - protein, 10 aa, Entamoeba dispar
TDKENSLNST

SEQ ID NO: 2376784 - protein, 15 aa, Entamoeba dispar
TDKERYSMQDNSNTL

SEQ ID NO: 2376785 - protein, 5 aa, Entamoeba dispar
TDKKL

SEQ ID NO: 2376786 - protein, 4 aa, Entamoeba dispar
TDKQ

SEQ ID NO: 2376787 - protein, 63 aa, Entamoeba dispar
TDKSNSTKGHSGSTRTETKSQDISSSEKRYSINTSSSSTINNMEDNKGNEESIDTSISSQVLS

SEQ ID NO: 2376788 - protein, 8 aa, Entamoeba dispar
TDKSVTGP

SEQ ID NO: 2376789 - protein, 8 aa, Entamoeba dispar
TDKTETYD

SEQ ID NO: 2376790 - protein, 10 aa, Entamoeba dispar
TDKTGTLTEN

SEQ ID NO: 2376791 - protein, 11 aa, Entamoeba dispar
TDKTNQVRKDF

SEQ ID NO: 2376792 - protein, 16 aa, Entamoeba dispar
TDLKEQWEKEALSKHP

SEQ ID NO: 2376793 - protein, 7 aa, Entamoeba dispar
TDLSTGI

SEQ ID NO: 2376794 - protein, 6 aa, Entamoeba dispar
TDLTTK

SEQ ID NO: 2376795 - protein, 5 aa, Entamoeba dispar
TDMKD

SEQ ID NO: 2376796 - protein, 8 aa, Entamoeba dispar
TDNGSNGV

SEQ ID NO: 2376797 - protein, 10 aa, Entamoeba dispar
TDNKDGTYTC

SEQ ID NO: 2376798 - protein, 26 aa, Entamoeba dispar
TDNNTDTNHTNNTNNTNNTNNTTGTL

SEQ ID NO: 2376799 - protein, 4 aa, Entamoeba dispar
TDNP

SEQ ID NO: 2376800 - protein, 8 aa, Entamoeba dispar
TDNSSSIN

SEQ ID NO: 2376801 - protein, 8 aa, Entamoeba dispar
TDPFESDV

SEQ ID NO: 2376802 - protein, 5 aa, Entamoeba dispar
TDPHT

SEQ ID NO: 2376803 - protein, 5 aa, Entamoeba dispar
TDPKQ

SEQ ID NO: 2376804 - protein, 7 aa, Entamoeba dispar
TDPNGAS

SEQ ID NO: 2376805 - protein, 7 aa, Entamoeba dispar
TDPSRKL

SEQ ID NO: 2376806 - protein, 5 aa, Entamoeba dispar
TDQLS

SEQ ID NO: 2376807 - protein, 11 aa, Entamoeba dispar
TDQNNKSPVYI

SEQ ID NO: 2376808 - protein, 9 aa, Entamoeba dispar
TDQPSINEQ

SEQ ID NO: 2376809 - protein, 9 aa, Entamoeba dispar
TDQSNRTTK

SEQ ID NO: 2376810 - protein, 6 aa, Entamoeba dispar
TDQTCS

SEQ ID NO: 2376811 - protein, 5 aa, Entamoeba dispar
TDQYI

SEQ ID NO: 2376812 - protein, 12 aa, Entamoeba dispar
TDQYVKNGECAP

SEQ ID NO: 2376813 - protein, 6 aa, Entamoeba dispar
TDRERV

SEQ ID NO: 2376814 - protein, 11 aa, Entamoeba dispar
TDRGSDGSKYC

SEQ ID NO: 2376815 - protein, 4 aa, Entamoeba dispar
TDRL

SEQ ID NO: 2376816 - protein, 5 aa, Entamoeba dispar
TDRPD

SEQ ID NO: 2376817 - protein, 16 aa, Entamoeba dispar
TDSLRGTTTIYNTEKQ

SEQ ID NO: 2376818 - protein, 4 aa, Entamoeba dispar
TDSM

SEQ ID NO: 2376819 - protein, 7 aa, Entamoeba dispar
TDSPKYH

SEQ ID NO: 2376820 - protein, 9 aa, Entamoeba dispar
TDSQSSAIT

SEQ ID NO: 2376821 - protein, 10 aa, Entamoeba dispar
TDSTESGYNN

SEQ ID NO: 2376822 - protein, 4 aa, Entamoeba dispar
TDSY

SEQ ID NO: 2376823 - protein, 11 aa, Entamoeba dispar
TDSYGTPRYGE

SEQ ID NO: 2376824 - protein, 19 aa, Entamoeba dispar
TDTLGGNYTIKKGTANVVG

SEQ ID NO: 2376825 - protein, 6 aa, Entamoeba dispar
TDTNTI

SEQ ID NO: 2376826 - protein, 6 aa, Entamoeba dispar
TDTPNN

SEQ ID NO: 2376827 - protein, 4 aa, Entamoeba dispar
TDTT

SEQ ID NO: 2376828 - protein, 7 aa, Entamoeba dispar
TDTTTTG

SEQ ID NO: 2376829 - protein, 6 aa, Entamoeba dispar
TDTTYI

SEQ ID NO: 2376830 - protein, 6 aa, Entamoeba dispar
TDVPST

SEQ ID NO: 2376831 - protein, 16 aa, Entamoeba dispar
TDYDAAPYDGSQTIPE

SEQ ID NO: 2376832 - protein, 8 aa, Entamoeba dispar
TDYSSSIT

SEQ ID NO: 2376833 - protein, 9 aa, Entamoeba dispar
TEAAGSTHI

SEQ ID NO: 2376834 - protein, 10 aa, Entamoeba dispar
TEADKEKETV

SEQ ID NO: 2376835 - protein, 27 aa, Entamoeba dispar
TEAEEEQEISNQGDTTEENKNDITEDV

SEQ ID NO: 2376836 - protein, 14 aa, Entamoeba dispar
TEAKSSESDYALTQ

SEQ ID NO: 2376837 - protein, 8 aa, Entamoeba dispar
TEATMKTR

SEQ ID NO: 2376838 - protein, 15 aa, Entamoeba dispar
TECDSKCKECTSNNR

SEQ ID NO: 2376839 - protein, 11 aa, Entamoeba dispar
TECGVNEETEL

SEQ ID NO: 2376840 - protein, 4 aa, Entamoeba dispar
TECK

SEQ ID NO: 2376841 - protein, 16 aa, Entamoeba dispar
TECNDDPSKDRDCSDK

SEQ ID NO: 2376842 - protein, 5 aa, Entamoeba dispar
TECNE

SEQ ID NO: 2376843 - protein, 9 aa, Entamoeba dispar
TECTESNTI

SEQ ID NO: 2376844 - protein, 5 aa, Entamoeba dispar
TEDDK

SEQ ID NO: 2376845 - protein, 8 aa, Entamoeba dispar
TEDIGTQE

SEQ ID NO: 2376846 - protein, 14 aa, Entamoeba dispar
TEDRNELKSQNERN

SEQ ID NO: 2376847 - protein, 4 aa, Entamoeba dispar
TEDY

SEQ ID NO: 2376848 - protein, 4 aa, Entamoeba dispar
TEEE

SEQ ID NO: 2376849 - protein, 8 aa, Entamoeba dispar
TEEEDETI

SEQ ID NO: 2376850 - protein, 6 aa, Entamoeba dispar
TEEEGQ

SEQ ID NO: 2376851 - protein, 12 aa, Entamoeba dispar
TEEEIDQQNRDS

SEQ ID NO: 2376852 - protein, 7 aa, Entamoeba dispar
TEEEMND

SEQ ID NO: 2376853 - protein, 7 aa, Entamoeba dispar
TEEEMNE

SEQ ID NO: 2376854 - protein, 6 aa, Entamoeba dispar
TEEETL

SEQ ID NO: 2376855 - protein, 8 aa, Entamoeba dispar
TEEETNDL

SEQ ID NO: 2376856 - protein, 6 aa, Entamoeba dispar
TEEEVE

SEQ ID NO: 2376857 - protein, 4 aa, Entamoeba dispar
TEEH

SEQ ID NO: 2376858 - protein, 14 aa, Entamoeba dispar
TEEKEQTESMGNNG

SEQ ID NO: 2376859 - protein, 10 aa, Entamoeba dispar
TEEKLNENAE

SEQ ID NO: 2376860 - protein, 4 aa, Entamoeba dispar
TEEL

SEQ ID NO: 2376861 - protein, 8 aa, Entamoeba dispar
TEEQAKPY

SEQ ID NO: 2376862 - protein, 6 aa, Entamoeba dispar
TEEQTI

SEQ ID NO: 2376863 - protein, 9 aa, Entamoeba dispar
TEESPAPEE

SEQ ID NO: 2376864 - protein, 8 aa, Entamoeba dispar
TEFDQQSC

SEQ ID NO: 2376865 - protein, 7 aa, Entamoeba dispar
TEGCDET

SEQ ID NO: 2376866 - protein, 15 aa, Entamoeba dispar
TEGDNNSKNKNEGVL

SEQ ID NO: 2376867 - protein, 6 aa, Entamoeba dispar
TEGDQF

SEQ ID NO: 2376868 - protein, 12 aa, Entamoeba dispar
TEGFNKLDTEQI

SEQ ID NO: 2376869 - protein, 7 aa, Entamoeba dispar
TEGISSS

SEQ ID NO: 2376870 - protein, 10 aa, Entamoeba dispar
TEGSDTAPYI

SEQ ID NO: 2376871 - protein, 12 aa, Entamoeba dispar
TEGVDKKKGLNI

SEQ ID NO: 2376872 - protein, 5 aa, Entamoeba dispar
TEGVQ

SEQ ID NO: 2376873 - protein, 9 aa, Entamoeba dispar
TEHENGKKM

SEQ ID NO: 2376874 - protein, 4 aa, Entamoeba dispar
TEHQ

SEQ ID NO: 2376875 - protein, 5 aa, Entamoeba dispar
TEHQV

SEQ ID NO: 2376876 - protein, 11 aa, Entamoeba dispar
TEIDEGIKQET

SEQ ID NO: 2376877 - protein, 11 aa, Entamoeba dispar
TEIEEPPKNHS

SEQ ID NO: 2376878 - protein, 32 aa, Entamoeba dispar
TEIEQREKISQTDSLSNFENTNINSNTTTPEK

SEQ ID NO: 2376879 - protein, 22 aa, Entamoeba dispar
TEIISQQQKECPPLPKRDHPTQ

SEQ ID NO: 2376880 - protein, 4 aa, Entamoeba dispar
TEIK

SEQ ID NO: 2376881 - protein, 4 aa, Entamoeba dispar
TEIN

SEQ ID NO: 2376882 - protein, 6 aa, Entamoeba dispar
TEISTR

SEQ ID NO: 2376883 - protein, 4 aa, Entamoeba dispar
TEIT

SEQ ID NO: 2376884 - protein, 11 aa, Entamoeba dispar
TEKAHSSRSKC

SEQ ID NO: 2376885 - protein, 10 aa, Entamoeba dispar
TEKCDEQKRV

SEQ ID NO: 2376886 - protein, 4 aa, Entamoeba dispar
TEKE

SEQ ID NO: 2376887 - protein, 9 aa, Entamoeba dispar
TEKEEGYEN

SEQ ID NO: 2376888 - protein, 23 aa, Entamoeba dispar
TEKEGNILNPKSKKEKRLNSTVD

SEQ ID NO: 2376889 - protein, 10 aa, Entamoeba dispar
TEKEGRASIS

SEQ ID NO: 2376890 - protein, 4 aa, Entamoeba dispar
TEKF

SEQ ID NO: 2376891 - protein, 11 aa, Entamoeba dispar
TEKGCSKCDDG

SEQ ID NO: 2376892 - protein, 14 aa, Entamoeba dispar
TEKISGKPASSGDI

SEQ ID NO: 2376893 - protein, 6 aa, Entamoeba dispar
TEKIVN

SEQ ID NO: 2376894 - protein, 4 aa, Entamoeba dispar
TEKK

SEQ ID NO: 2376895 - protein, 11 aa, Entamoeba dispar
TEKKSTKAITV

SEQ ID NO: 2376896 - protein, 7 aa, Entamoeba dispar
TEKNSTM

SEQ ID NO: 2376897 - protein, 8 aa, Entamoeba dispar
TEKPQVKH

SEQ ID NO: 2376898 - protein, 10 aa, Entamoeba dispar
TEKQHSTELN

SEQ ID NO: 2376899 - protein, 4 aa, Entamoeba dispar
TEKS

SEQ ID NO: 2376900 - protein, 9 aa, Entamoeba dispar
TEKSGERLK

SEQ ID NO: 2376901 - protein, 28 aa, Entamoeba dispar
TEKSNIDPKARNPCETATCDPATGETVY

SEQ ID NO: 2376902 - protein, 6 aa, Entamoeba dispar
TEKTQL

SEQ ID NO: 2376903 - protein, 5 aa, Entamoeba dispar
TEKTR

SEQ ID NO: 2376904 - protein, 7 aa, Entamoeba dispar
TEKYQKT

SEQ ID NO: 2376905 - protein, 8 aa, Entamoeba dispar
TEKYQPQT

SEQ ID NO: 2376906 - protein, 9 aa, Entamoeba dispar
TELENEKSI

SEQ ID NO: 2376907 - protein, 4 aa, Entamoeba dispar
TELG

SEQ ID NO: 2376908 - protein, 4 aa, Entamoeba dispar
TELK

SEQ ID NO: 2376909 - protein, 4 aa, Entamoeba dispar
TELM

SEQ ID NO: 2376910 - protein, 4 aa, Entamoeba dispar
TELP

SEQ ID NO: 2376911 - protein, 25 aa, Entamoeba dispar
TELPEEDAMDSASAFNTQDKPKPFP

SEQ ID NO: 2376912 - protein, 9 aa, Entamoeba dispar
TELQNPKYS

SEQ ID NO: 2376913 - protein, 8 aa, Entamoeba dispar
TELSKKAE

SEQ ID NO: 2376914 - protein, 6 aa, Entamoeba dispar
TELSPK

SEQ ID NO: 2376915 - protein, 10 aa, Entamoeba dispar
TELTPPKNST

SEQ ID NO: 2376916 - protein, 9 aa, Entamoeba dispar
TENGENFSL

SEQ ID NO: 2376917 - protein, 8 aa, Entamoeba dispar
TENKDGMI

SEQ ID NO: 2376918 - protein, 9 aa, Entamoeba dispar
TENNTCESL

SEQ ID NO: 2376919 - protein, 7 aa, Entamoeba dispar
TENPNNS

SEQ ID NO: 2376920 - protein, 7 aa, Entamoeba dispar
TENPTER

SEQ ID NO: 2376921 - protein, 8 aa, Entamoeba dispar
TENRNELN

SEQ ID NO: 2376922 - protein, 14 aa, Entamoeba dispar
TENSYEQEDCSSEY

SEQ ID NO: 2376923 - protein, 14 aa, Entamoeba dispar
TENVIQSDDATREI

SEQ ID NO: 2376924 - protein, 4 aa, Entamoeba dispar
TENY

SEQ ID NO: 2376925 - protein, 8 aa, Entamoeba dispar
TEPEEDDY

SEQ ID NO: 2376926 - protein, 6 aa, Entamoeba dispar
TEPSYW

SEQ ID NO: 2376927 - protein, 4 aa, Entamoeba dispar
TEQE

SEQ ID NO: 2376928 - protein, 13 aa, Entamoeba dispar
TEQGHSKIKSYKD

SEQ ID NO: 2376929 - protein, 7 aa, Entamoeba dispar
TEQNDPY

SEQ ID NO: 2376930 - protein, 8 aa, Entamoeba dispar
TEQPFPDN

SEQ ID NO: 2376931 - protein, 7 aa, Entamoeba dispar
TEQPIAA

SEQ ID NO: 2376932 - protein, 9 aa, Entamoeba dispar
TEQPQNEVQ

SEQ ID NO: 2376933 - protein, 8 aa, Entamoeba dispar
TEQRKENV

SEQ ID NO: 2376934 - protein, 5 aa, Entamoeba dispar
TEQTL

SEQ ID NO: 2376935 - protein, 4 aa, Entamoeba dispar
TEQV

SEQ ID NO: 2376936 - protein, 9 aa, Entamoeba dispar
TERCDRNKC

SEQ ID NO: 2376937 - protein, 4 aa, Entamoeba dispar
TERD

SEQ ID NO: 2376938 - protein, 5 aa, Entamoeba dispar
TEREL

SEQ ID NO: 2376939 - protein, 4 aa, Entamoeba dispar
TERR

SEQ ID NO: 2376940 - protein, 17 aa, Entamoeba dispar
TERSTSTYYHSHSPSEF

SEQ ID NO: 2376941 - protein, 11 aa, Entamoeba dispar
TERTKKREMKE

SEQ ID NO: 2376942 - protein, 11 aa, Entamoeba dispar
TESAEGLGRSV

SEQ ID NO: 2376943 - protein, 11 aa, Entamoeba dispar
TESDLETRSKS

SEQ ID NO: 2376944 - protein, 6 aa, Entamoeba dispar
TESDSF

SEQ ID NO: 2376945 - protein, 20 aa, Entamoeba dispar
TESGCKRGNSINARKEREFK

SEQ ID NO: 2376946 - protein, 7 aa, Entamoeba dispar
TESKQPI

SEQ ID NO: 2376947 - protein, 6 aa, Entamoeba dispar
TESKVS

SEQ ID NO: 2376948 - protein, 9 aa, Entamoeba dispar
TESSAAKIE

SEQ ID NO: 2376949 - protein, 15 aa, Entamoeba dispar
TESSSCSGKKETDTF

SEQ ID NO: 2376950 - protein, 6 aa, Entamoeba dispar
TESSTA

SEQ ID NO: 2376951 - protein, 10 aa, Entamoeba dispar
TESSVTSETI

SEQ ID NO: 2376952 - protein, 6 aa, Entamoeba dispar
TETASL

SEQ ID NO: 2376953 - protein, 6 aa, Entamoeba dispar
TETCSG

SEQ ID NO: 2376954 - protein, 17 aa, Entamoeba dispar
TETEGVNQNDDSETVES

SEQ ID NO: 2376955 - protein, 15 aa, Entamoeba dispar
TETEMTTKLDPDELV

SEQ ID NO: 2376956 - protein, 6 aa, Entamoeba dispar
TETGTF

SEQ ID NO: 2376957 - protein, 4 aa, Entamoeba dispar
TETI

SEQ ID NO: 2376958 - protein, 10 aa, Entamoeba dispar
TETKGNKSHL

SEQ ID NO: 2376959 - protein, 27 aa, Entamoeba dispar
TETLQTENQSMENALRNTTKLNTNKKE

SEQ ID NO: 2376960 - protein, 7 aa, Entamoeba dispar
TETNGVV

SEQ ID NO: 2376961 - protein, 24 aa, Entamoeba dispar
TETPRNLASGFDSPIHKETEEALK

SEQ ID NO: 2376962 - protein, 30 aa, Entamoeba dispar
TETPTEDSTSSSQEGCSLRDQEKQSTENIL

SEQ ID NO: 2376963 - protein, 9 aa, Entamoeba dispar
TETSNEVNT

SEQ ID NO: 2376964 - protein, 21 aa, Entamoeba dispar
TETSSRTITEKKSNKKPKKSN

SEQ ID NO: 2376965 - protein, 5 aa, Entamoeba dispar
TETSY

SEQ ID NO: 2376966 - protein, 11 aa, Entamoeba dispar
TETTGMGTSTV

SEQ ID NO: 2376967 - protein, 5 aa, Entamoeba dispar
TETYI

SEQ ID NO: 2376968 - protein, 5 aa, Entamoeba dispar
TEVKQ

SEQ ID NO: 2376969 - protein, 7 aa, Entamoeba dispar
TEVPGQY

SEQ ID NO: 2376970 - protein, 9 aa, Entamoeba dispar
TEVQGDEFR

SEQ ID NO: 2376971 - protein, 4 aa, Entamoeba dispar
TEVR

SEQ ID NO: 2376972 - protein, 17 aa, Entamoeba dispar
TEYPGHEKEIAEKTDFS

SEQ ID NO: 2376973 - protein, 15 aa, Entamoeba dispar
TEYPSFREGTTTGLA

SEQ ID NO: 2376974 - protein, 9 aa, Entamoeba dispar
TEYQEPNES

SEQ ID NO: 2376975 - protein, 12 aa, Entamoeba dispar
TFARSSPPLPLT

SEQ ID NO: 2376976 - protein, 6 aa, Entamoeba dispar
TFDENF

SEQ ID NO: 2376977 - protein, 6 aa, Entamoeba dispar
TFDKEE

SEQ ID NO: 2376978 - protein, 5 aa, Entamoeba dispar
TFDNN

SEQ ID NO: 2376979 - protein, 18 aa, Entamoeba dispar
TFEEQKEDLVNDDFDPED

SEQ ID NO: 2376980 - protein, 6 aa, Entamoeba dispar
TFEEWN

SEQ ID NO: 2376981 - protein, 13 aa, Entamoeba dispar
TFERGDTQETIKS

SEQ ID NO: 2376982 - protein, 6 aa, Entamoeba dispar
TFESNQ

SEQ ID NO: 2376983 - protein, 6 aa, Entamoeba dispar
TFHPSG

SEQ ID NO: 2376984 - protein, 19 aa, Entamoeba dispar
TFKTENSNIDFNSESSYNE

SEQ ID NO: 2376985 - protein, 10 aa, Entamoeba dispar
TFMSGGESPL

SEQ ID NO: 2376986 - protein, 7 aa, Entamoeba dispar
TFNGNGE

SEQ ID NO: 2376987 - protein, 9 aa, Entamoeba dispar
TFNNGKNDY

SEQ ID NO: 2376988 - protein, 10 aa, Entamoeba dispar
TFNNNEKEQL

SEQ ID NO: 2376989 - protein, 5 aa, Entamoeba dispar
TFNPT

SEQ ID NO: 2376990 - protein, 4 aa, Entamoeba dispar
TFNS

SEQ ID NO: 2376991 - protein, 14 aa, Entamoeba dispar
TFQKTVESQYNPIT

SEQ ID NO: 2376992 - protein, 7 aa, Entamoeba dispar
TFQNEDG

SEQ ID NO: 2376993 - protein, 10 aa, Entamoeba dispar
TFQSGSPDEI

SEQ ID NO: 2376994 - protein, 5 aa, Entamoeba dispar
TFRGK

SEQ ID NO: 2376995 - protein, 12 aa, Entamoeba dispar
TFSEQQSVGEQL

SEQ ID NO: 2376996 - protein, 8 aa, Entamoeba dispar
TFSHSQDN

SEQ ID NO: 2376997 - protein, 7 aa, Entamoeba dispar
TFSNTYP

SEQ ID NO: 2376998 - protein, 4 aa, Entamoeba dispar
TFSS

SEQ ID NO: 2376999 - protein, 11 aa, Entamoeba dispar
TFSSDKYQTVD

SEQ ID NO: 2377000 - protein, 7 aa, Entamoeba dispar
TFSSGNR

SEQ ID NO: 2377001 - protein, 13 aa, Entamoeba dispar
TFSSPKSSQDHTI

SEQ ID NO: 2377002 - protein, 14 aa, Entamoeba dispar
TFSSTTATSSNNHN

SEQ ID NO: 2377003 - protein, 5 aa, Entamoeba dispar
TFTSN

SEQ ID NO: 2377004 - protein, 6 aa, Entamoeba dispar
TFYDSG

SEQ ID NO: 2377005 - protein, 6 aa, Entamoeba dispar
TGAKNV

SEQ ID NO: 2377006 - protein, 6 aa, Entamoeba dispar
TGASSN

SEQ ID NO: 2377007 - protein, 38 aa, Entamoeba dispar
TGATTSEYYTQSGNNVTVSQYNTSSECTGNKNETSVAV

SEQ ID NO: 2377008 - protein, 7 aa, Entamoeba dispar
TGCGKTT

SEQ ID NO: 2377009 - protein, 9 aa, Entamoeba dispar
TGCGKTTQL

SEQ ID NO: 2377010 - protein, 5 aa, Entamoeba dispar
TGCSS

SEQ ID NO: 2377011 - protein, 5 aa, Entamoeba dispar
TGCTK

SEQ ID NO: 2377012 - protein, 11 aa, Entamoeba dispar
TGDEQKEYEQP

SEQ ID NO: 2377013 - protein, 11 aa, Entamoeba dispar
TGDERFQSPAT

SEQ ID NO: 2377014 - protein, 9 aa, Entamoeba dispar
TGDFEKDTD

SEQ ID NO: 2377015 - protein, 5 aa, Entamoeba dispar
TGDKI

SEQ ID NO: 2377016 - protein, 7 aa, Entamoeba dispar
TGDKPQC

SEQ ID NO: 2377017 - protein, 14 aa, Entamoeba dispar
TGDLERNDDGSNHG

SEQ ID NO: 2377018 - protein, 12 aa, Entamoeba dispar
TGDLERNIDGAN

SEQ ID NO: 2377019 - protein, 15 aa, Entamoeba dispar
TGDNSCVATASTSSS

SEQ ID NO: 2377020 - protein, 6 aa, Entamoeba dispar
TGDYTK

SEQ ID NO: 2377021 - protein, 4 aa, Entamoeba dispar
TGEC

SEQ ID NO: 2377022 - protein, 10 aa, Entamoeba dispar
TGEEDDNCIQ

SEQ ID NO: 2377023 - protein, 14 aa, Entamoeba dispar
TGEFKSFKKSKKYQ

SEQ ID NO: 2377024 - protein, 16 aa, Entamoeba dispar
TGEGKISYSNASYSSP

SEQ ID NO: 2377025 - protein, 5 aa, Entamoeba dispar
TGEHQ

SEQ ID NO: 2377026 - protein, 9 aa, Entamoeba dispar
TGEKIKEAQ

SEQ ID NO: 2377027 - protein, 6 aa, Entamoeba dispar
TGELTS

SEQ ID NO: 2377028 - protein, 5 aa, Entamoeba dispar
TGETE

SEQ ID NO: 2377029 - protein, 7 aa, Entamoeba dispar
TGEVENL

SEQ ID NO: 2377030 - protein, 12 aa, Entamoeba dispar
TGFDDSGFNSTL

SEQ ID NO: 2377031 - protein, 19 aa, Entamoeba dispar
TGFDIEEGNEENQEEKGAK

SEQ ID NO: 2377032 - protein, 5 aa, Entamoeba dispar
TGFES

SEQ ID NO: 2377033 - protein, 13 aa, Entamoeba dispar
TGFHSSGGSKKIT

SEQ ID NO: 2377034 - protein, 8 aa, Entamoeba dispar
TGFTGTSQ

SEQ ID NO: 2377035 - protein, 7 aa, Entamoeba dispar
TGGQETL

SEQ ID NO: 2377036 - protein, 5 aa, Entamoeba dispar
TGGQG

SEQ ID NO: 2377037 - protein, 5 aa, Entamoeba dispar
TGGTS

SEQ ID NO: 2377038 - protein, 9 aa, Entamoeba dispar
TGGTSGIGE

SEQ ID NO: 2377039 - protein, 9 aa, Entamoeba dispar
TGHGKSSLG

SEQ ID NO: 2377040 - protein, 6 aa, Entamoeba dispar
TGIDEE

SEQ ID NO: 2377041 - protein, 4 aa, Entamoeba dispar
TGIN

SEQ ID NO: 2377042 - protein, 8 aa, Entamoeba dispar
TGISEDSI

SEQ ID NO: 2377043 - protein, 8 aa, Entamoeba dispar
TGKATYKE

SEQ ID NO: 2377044 - protein, 9 aa, Entamoeba dispar
TGKCDTNTG

SEQ ID NO: 2377045 - protein, 6 aa, Entamoeba dispar
TGKDAY

SEQ ID NO: 2377046 - protein, 9 aa, Entamoeba dispar
TGKDFGNEE

SEQ ID NO: 2377047 - protein, 13 aa, Entamoeba dispar
TGKEGMSAARAAD

SEQ ID NO: 2377048 - protein, 4 aa, Entamoeba dispar
TGKI

SEQ ID NO: 2377049 - protein, 11 aa, Entamoeba dispar
TGKKLKGHGRR

SEQ ID NO: 2377050 - protein, 5 aa, Entamoeba dispar
TGKSR

SEQ ID NO: 2377051 - protein, 15 aa, Entamoeba dispar
TGKSSNGSDANFPTF

SEQ ID NO: 2377052 - protein, 5 aa, Entamoeba dispar
TGKTR

SEQ ID NO: 2377053 - protein, 9 aa, Entamoeba dispar
TGLNASSNN

SEQ ID NO: 2377054 - protein, 4 aa, Entamoeba dispar
TGLQ

SEQ ID NO: 2377055 - protein, 5 aa, Entamoeba dispar
TGMAQ

SEQ ID NO: 2377056 - protein, 5 aa, Entamoeba dispar
TGNEH

SEQ ID NO: 2377057 - protein, 4 aa, Entamoeba dispar
TGNG

SEQ ID NO: 2377058 - protein, 6 aa, Entamoeba dispar
TGNGKI

SEQ ID NO: 2377059 - protein, 7 aa, Entamoeba dispar
TGNGYRT

SEQ ID NO: 2377060 - protein, 12 aa, Entamoeba dispar
TGNLTTNIHDAF

SEQ ID NO: 2377061 - protein, 8 aa, Entamoeba dispar
TGNNAGRY

SEQ ID NO: 2377062 - protein, 4 aa, Entamoeba dispar
TGNQ

SEQ ID NO: 2377063 - protein, 4 aa, Entamoeba dispar
TGNS

SEQ ID NO: 2377064 - protein, 9 aa, Entamoeba dispar
TGNSEVETT

SEQ ID NO: 2377065 - protein, 6 aa, Entamoeba dispar
TGNYTK

SEQ ID NO: 2377066 - protein, 5 aa, Entamoeba dispar
TGPGL

SEQ ID NO: 2377067 - protein, 6 aa, Entamoeba dispar
TGPINA

SEQ ID NO: 2377068 - protein, 7 aa, Entamoeba dispar
TGPSQTP

SEQ ID NO: 2377069 - protein, 7 aa, Entamoeba dispar
TGPTISS

SEQ ID NO: 2377070 - protein, 6 aa, Entamoeba dispar
TGPTQR

SEQ ID NO: 2377071 - protein, 9 aa, Entamoeba dispar
TGQKYTLGE

SEQ ID NO: 2377072 - protein, 5 aa, Entamoeba dispar
TGRHD

SEQ ID NO: 2377073 - protein, 11 aa, Entamoeba dispar
TGRKYRKRYSQ

SEQ ID NO: 2377074 - protein, 6 aa, Entamoeba dispar
TGRLND

SEQ ID NO: 2377075 - protein, 11 aa, Entamoeba dispar
TGRNGGFGIGN

SEQ ID NO: 2377076 - protein, 11 aa, Entamoeba dispar
TGRVTYTRKDA

SEQ ID NO: 2377077 - protein, 6 aa, Entamoeba dispar
TGSCTT

SEQ ID NO: 2377078 - protein, 7 aa, Entamoeba dispar
TGSLKDS

SEQ ID NO: 2377079 - protein, 5 aa, Entamoeba dispar
TGSNT

SEQ ID NO: 2377080 - protein, 5 aa, Entamoeba dispar
TGSSN

SEQ ID NO: 2377081 - protein, 7 aa, Entamoeba dispar
TGSSTEV

SEQ ID NO: 2377082 - protein, 4 aa, Entamoeba dispar
TGST

SEQ ID NO: 2377083 - protein, 7 aa, Entamoeba dispar
TGSTTNP

SEQ ID NO: 2377084 - protein, 14 aa, Entamoeba dispar
TGTCTKYDSTCKSV

SEQ ID NO: 2377085 - protein, 7 aa, Entamoeba dispar
TGTDKEK

SEQ ID NO: 2377086 - protein, 13 aa, Entamoeba dispar
TGTERARSNAGTF

SEQ ID NO: 2377087 - protein, 5 aa, Entamoeba dispar
TGTFE

SEQ ID NO: 2377088 - protein, 9 aa, Entamoeba dispar
TGTKGQTDI

SEQ ID NO: 2377089 - protein, 7 aa, Entamoeba dispar
TGTLTAN

SEQ ID NO: 2377090 - protein, 19 aa, Entamoeba dispar
TGTNHPTEFTTRRVIVVQM

SEQ ID NO: 2377091 - protein, 9 aa, Entamoeba dispar
TGTNPSMPQ

SEQ ID NO: 2377092 - protein, 6 aa, Entamoeba dispar
TGTPKY

SEQ ID NO: 2377093 - protein, 14 aa, Entamoeba dispar
TGTRSSDYYTHRGN

SEQ ID NO: 2377094 - protein, 7 aa, Entamoeba dispar
TGTSNIV

SEQ ID NO: 2377095 - protein, 7 aa, Entamoeba dispar
TGTSQLC

SEQ ID NO: 2377096 - protein, 8 aa, Entamoeba dispar
TGTTTLPN

SEQ ID NO: 2377097 - protein, 9 aa, Entamoeba dispar
TGTVKSGQT

SEQ ID NO: 2377098 - protein, 7 aa, Entamoeba dispar
TGVGKSA

SEQ ID NO: 2377099 - protein, 12 aa, Entamoeba dispar
TGVTNKDEGSYT

SEQ ID NO: 2377100 - protein, 5 aa, Entamoeba dispar
TGYNL

SEQ ID NO: 2377101 - protein, 4 aa, Entamoeba dispar
TGYY

SEQ ID NO: 2377102 - protein, 7 aa, Entamoeba dispar
THDLKKD

SEQ ID NO: 2377103 - protein, 6 aa, Entamoeba dispar
THEGSL

SEQ ID NO: 2377104 - protein, 5 aa, Entamoeba dispar
THEYT

SEQ ID NO: 2377105 - protein, 5 aa, Entamoeba dispar
THFSH

SEQ ID NO: 2377106 - protein, 42 aa, Entamoeba dispar
THGGHASFEDAGKVSGEENDPLMEEGSHRHEHHADEGAGGKG

SEQ ID NO: 2377107 - protein, 4 aa, Entamoeba dispar
THKT

SEQ ID NO: 2377108 - protein, 5 aa, Entamoeba dispar
THLDQ

SEQ ID NO: 2377109 - protein, 10 aa, Entamoeba dispar
THNKENCSPL

SEQ ID NO: 2377110 - protein, 16 aa, Entamoeba dispar
THPEDYAQDSFNQKTL

SEQ ID NO: 2377111 - protein, 4 aa, Entamoeba dispar
THQI

SEQ ID NO: 2377112 - protein, 5 aa, Entamoeba dispar
THQRT

SEQ ID NO: 2377113 - protein, 9 aa, Entamoeba dispar
THSNSQTIR

SEQ ID NO: 2377114 - protein, 4 aa, Entamoeba dispar
THVE

SEQ ID NO: 2377115 - protein, 8 aa, Entamoeba dispar
TIAGDNDG

SEQ ID NO: 2377116 - protein, 18 aa, Entamoeba dispar
TIAQPTSVEHISSPKNLQ

SEQ ID NO: 2377117 - protein, 10 aa, Entamoeba dispar
TIASRNIEED

SEQ ID NO: 2377118 - protein, 10 aa, Entamoeba dispar
TIDGKSNTIS

SEQ ID NO: 2377119 - protein, 10 aa, Entamoeba dispar
TIDGLNPRSF

SEQ ID NO: 2377120 - protein, 20 aa, Entamoeba dispar
TIDPTIQESDYYSKTSHELE

SEQ ID NO: 2377121 - protein, 4 aa, Entamoeba dispar
TIEI

SEQ ID NO: 2377122 - protein, 4 aa, Entamoeba dispar
TIEN

SEQ ID NO: 2377123 - protein, 5 aa, Entamoeba dispar
TIEQQ

SEQ ID NO: 2377124 - protein, 4 aa, Entamoeba dispar
TIER

SEQ ID NO: 2377125 - protein, 5 aa, Entamoeba dispar
TIESK

SEQ ID NO: 2377126 - protein, 13 aa, Entamoeba dispar
TIESQGINNAKKD

SEQ ID NO: 2377127 - protein, 4 aa, Entamoeba dispar
TIFN

SEQ ID NO: 2377128 - protein, 4 aa, Entamoeba dispar
TIGE

SEQ ID NO: 2377129 - protein, 4 aa, Entamoeba dispar
TIGN

SEQ ID NO: 2377130 - protein, 14 aa, Entamoeba dispar
TIGNDNNNNNQYTQ

SEQ ID NO: 2377131 - protein, 5 aa, Entamoeba dispar
TIGNQ

SEQ ID NO: 2377132 - protein, 14 aa, Entamoeba dispar
TIIEEDKKQEEVKH

SEQ ID NO: 2377133 - protein, 13 aa, Entamoeba dispar
TIKDNEKIRSRKV

SEQ ID NO: 2377134 - protein, 4 aa, Entamoeba dispar
TIKE

SEQ ID NO: 2377135 - protein, 9 aa, Entamoeba dispar
TIKNPKNAL

SEQ ID NO: 2377136 - protein, 8 aa, Entamoeba dispar
TIKPKESV

SEQ ID NO: 2377137 - protein, 7 aa, Entamoeba dispar
TIKPKIT

SEQ ID NO: 2377138 - protein, 12 aa, Entamoeba dispar
TIKSQDEIQSQE

SEQ ID NO: 2377139 - protein, 11 aa, Entamoeba dispar
TIKTNKNKTTN

SEQ ID NO: 2377140 - protein, 5 aa, Entamoeba dispar
TIKYG

SEQ ID NO: 2377141 - protein, 13 aa, Entamoeba dispar
TILPNSNTKSPVI

SEQ ID NO: 2377142 - protein, 8 aa, Entamoeba dispar
TILPPTKD

SEQ ID NO: 2377143 - protein, 7 aa, Entamoeba dispar
TILTESN

SEQ ID NO: 2377144 - protein, 6 aa, Entamoeba dispar
TINDPE

SEQ ID NO: 2377145 - protein, 9 aa, Entamoeba dispar
TINGANPQI

SEQ ID NO: 2377146 - protein, 5 aa, Entamoeba dispar
TINGE

SEQ ID NO: 2377147 - protein, 10 aa, Entamoeba dispar
TINNNNGING

SEQ ID NO: 2377148 - protein, 5 aa, Entamoeba dispar
TINRD

SEQ ID NO: 2377149 - protein, 27 aa, Entamoeba dispar
TINRKNKQIASITNDKKTLKLKGTSIT

SEQ ID NO: 2377150 - protein, 17 aa, Entamoeba dispar
TINSENEYNKDELKKKS

SEQ ID NO: 2377151 - protein, 5 aa, Entamoeba dispar
TINSN

SEQ ID NO: 2377152 - protein, 9 aa, Entamoeba dispar
TINTNQLEE

SEQ ID NO: 2377153 - protein, 5 aa, Entamoeba dispar
TIPGK

SEQ ID NO: 2377154 - protein, 20 aa, Entamoeba dispar
TIPLEGTNSLKSGALVSNGS

SEQ ID NO: 2377155 - protein, 4 aa, Entamoeba dispar
TIPP

SEQ ID NO: 2377156 - protein, 9 aa, Entamoeba dispar
TIPSQSFPT

SEQ ID NO: 2377157 - protein, 6 aa, Entamoeba dispar
TIPTLS

SEQ ID NO: 2377158 - protein, 9 aa, Entamoeba dispar
TIPVGEESR

SEQ ID NO: 2377159 - protein, 7 aa, Entamoeba dispar
TIPYSSE

SEQ ID NO: 2377160 - protein, 17 aa, Entamoeba dispar
TIQKGRRTNRLKENDRV

SEQ ID NO: 2377161 - protein, 13 aa, Entamoeba dispar
TIQNKTSNYTGTS

SEQ ID NO: 2377162 - protein, 4 aa, Entamoeba dispar
TIQT

SEQ ID NO: 2377163 - protein, 6 aa, Entamoeba dispar
TIREKP

SEQ ID NO: 2377164 - protein, 10 aa, Entamoeba dispar
TIRSTNFDDI

SEQ ID NO: 2377165 - protein, 14 aa, Entamoeba dispar
TISDSTIAKTGNES

SEQ ID NO: 2377166 - protein, 10 aa, Entamoeba dispar
TISEQTTSLT

SEQ ID NO: 2377167 - protein, 10 aa, Entamoeba dispar
TISKGNSVSV

SEQ ID NO: 2377168 - protein, 6 aa, Entamoeba dispar
TISNEK

SEQ ID NO: 2377169 - protein, 9 aa, Entamoeba dispar
TISPKGEKQ

SEQ ID NO: 2377170 - protein, 4 aa, Entamoeba dispar
TISS

SEQ ID NO: 2377171 - protein, 16 aa, Entamoeba dispar
TISSNKNTIKNNEAST

SEQ ID NO: 2377172 - protein, 12 aa, Entamoeba dispar
TISSQKNPTQSL

SEQ ID NO: 2377173 - protein, 6 aa, Entamoeba dispar
TISTQM

SEQ ID NO: 2377174 - protein, 4 aa, Entamoeba dispar
TITN

SEQ ID NO: 2377175 - protein, 5 aa, Entamoeba dispar
TITNN

SEQ ID NO: 2377176 - protein, 9 aa, Entamoeba dispar
TITPNNQPI

SEQ ID NO: 2377177 - protein, 15 aa, Entamoeba dispar
TITSDSELEVGSTSS

SEQ ID NO: 2377178 - protein, 20 aa, Entamoeba dispar
TITSPGKCPSPSSFSSQNTN

SEQ ID NO: 2377179 - protein, 11 aa, Entamoeba dispar
TITTGKRPPII

SEQ ID NO: 2377180 - protein, 10 aa, Entamoeba dispar
TITTGKRPTI

SEQ ID NO: 2377181 - protein, 11 aa, Entamoeba dispar
TITTGKRPTII

SEQ ID NO: 2377182 - protein, 10 aa, Entamoeba dispar
TIYNPRNANN

SEQ ID NO: 2377183 - protein, 6 aa, Entamoeba dispar
TIYPKE

SEQ ID NO: 2377184 - protein, 7 aa, Entamoeba dispar
TKATYPT

SEQ ID NO: 2377185 - protein, 9 aa, Entamoeba dispar
TKAVSSENE

SEQ ID NO: 2377186 - protein, 9 aa, Entamoeba dispar
TKCKDGYYN

SEQ ID NO: 2377187 - protein, 9 aa, Entamoeba dispar
TKCTNDGNC

SEQ ID NO: 2377188 - protein, 7 aa, Entamoeba dispar
TKDAIDA

SEQ ID NO: 2377189 - protein, 7 aa, Entamoeba dispar
TKDDQEY

SEQ ID NO: 2377190 - protein, 7 aa, Entamoeba dispar
TKDEEDD

SEQ ID NO: 2377191 - protein, 6 aa, Entamoeba dispar
TKDEGC

SEQ ID NO: 2377192 - protein, 4 aa, Entamoeba dispar
TKDG

SEQ ID NO: 2377193 - protein, 7 aa, Entamoeba dispar
TKDGTLP

SEQ ID NO: 2377194 - protein, 4 aa, Entamoeba dispar
TKDP

SEQ ID NO: 2377195 - protein, 9 aa, Entamoeba dispar
TKDQDVEKG

SEQ ID NO: 2377196 - protein, 6 aa, Entamoeba dispar
TKDRTL

SEQ ID NO: 2377197 - protein, 7 aa, Entamoeba dispar
TKDTTFT

SEQ ID NO: 2377198 - protein, 7 aa, Entamoeba dispar
TKDTTKN

SEQ ID NO: 2377199 - protein, 4 aa, Entamoeba dispar
TKEC

SEQ ID NO: 2377200 - protein, 5 aa, Entamoeba dispar
TKECI

SEQ ID NO: 2377201 - protein, 6 aa, Entamoeba dispar
TKECQI

SEQ ID NO: 2377202 - protein, 7 aa, Entamoeba dispar
TKECQYN

SEQ ID NO: 2377203 - protein, 29 aa, Entamoeba dispar
TKEDIKNDTKQSDLNDEKPSDLNDEKKNQ

SEQ ID NO: 2377204 - protein, 10 aa, Entamoeba dispar
TKEEEPADIQ

SEQ ID NO: 2377205 - protein, 6 aa, Entamoeba dispar
TKEEGY

SEQ ID NO: 2377206 - protein, 7 aa, Entamoeba dispar
TKEGQRS

SEQ ID NO: 2377207 - protein, 7 aa, Entamoeba dispar
TKEGTTI

SEQ ID NO: 2377208 - protein, 5 aa, Entamoeba dispar
TKEHD

SEQ ID NO: 2377209 - protein, 9 aa, Entamoeba dispar
TKEHQIDNK

SEQ ID NO: 2377210 - protein, 6 aa, Entamoeba dispar
TKELNK

SEQ ID NO: 2377211 - protein, 5 aa, Entamoeba dispar
TKEPK

SEQ ID NO: 2377212 - protein, 11 aa, Entamoeba dispar
TKEPTGTEGSV

SEQ ID NO: 2377213 - protein, 4 aa, Entamoeba dispar
TKEQ

SEQ ID NO: 2377214 - protein, 8 aa, Entamoeba dispar
TKEQTFNE

SEQ ID NO: 2377215 - protein, 4 aa, Entamoeba dispar
TKER

SEQ ID NO: 2377216 - protein, 8 aa, Entamoeba dispar
TKESNFED

SEQ ID NO: 2377217 - protein, 8 aa, Entamoeba dispar
TKESREKA

SEQ ID NO: 2377218 - protein, 6 aa, Entamoeba dispar
TKETQY

SEQ ID NO: 2377219 - protein, 8 aa, Entamoeba dispar
TKEVDESE

SEQ ID NO: 2377220 - protein, 24 aa, Entamoeba dispar
TKEVKKKEENETKKPKKMNEQNQK

SEQ ID NO: 2377221 - protein, 8 aa, Entamoeba dispar
TKEVPVEG

SEQ ID NO: 2377222 - protein, 6 aa, Entamoeba dispar
TKEYEL

SEQ ID NO: 2377223 - protein, 11 aa, Entamoeba dispar
TKEYNKAYGDS

SEQ ID NO: 2377224 - protein, 9 aa, Entamoeba dispar
TKFETDGDK

SEQ ID NO: 2377225 - protein, 4 aa, Entamoeba dispar
TKFP

SEQ ID NO: 2377226 - protein, 17 aa, Entamoeba dispar
TKGDGYSYPTNNSFNDT

SEQ ID NO: 2377227 - protein, 10 aa, Entamoeba dispar
TKGEKEKASL

SEQ ID NO: 2377228 - protein, 17 aa, Entamoeba dispar
TKGLSKKTKLAALQGGS

SEQ ID NO: 2377229 - protein, 7 aa, Entamoeba dispar
TKGMSKK

SEQ ID NO: 2377230 - protein, 9 aa, Entamoeba dispar
TKGNRLNIP

SEQ ID NO: 2377231 - protein, 6 aa, Entamoeba dispar
TKGSNK

SEQ ID NO: 2377232 - protein, 9 aa, Entamoeba dispar
TKGTNTKCT

SEQ ID NO: 2377233 - protein, 23 aa, Entamoeba dispar
TKHHTNDQLNNTIEDAADAEGIT

SEQ ID NO: 2377234 - protein, 8 aa, Entamoeba dispar
TKHPCGNF

SEQ ID NO: 2377235 - protein, 8 aa, Entamoeba dispar
TKHPRNPN

SEQ ID NO: 2377236 - protein, 7 aa, Entamoeba dispar
TKHQGHN

SEQ ID NO: 2377237 - protein, 4 aa, Entamoeba dispar
TKHS

SEQ ID NO: 2377238 - protein, 5 aa, Entamoeba dispar
TKIGT

SEQ ID NO: 2377239 - protein, 8 aa, Entamoeba dispar
TKIKEAKR

SEQ ID NO: 2377240 - protein, 13 aa, Entamoeba dispar
TKIKEENRKSGTV

SEQ ID NO: 2377241 - protein, 10 aa, Entamoeba dispar
TKIPPKKETL

SEQ ID NO: 2377242 - protein, 4 aa, Entamoeba dispar
TKIS

SEQ ID NO: 2377243 - protein, 12 aa, Entamoeba dispar
TKISGGISNLKT

SEQ ID NO: 2377244 - protein, 7 aa, Entamoeba dispar
TKKDETH

SEQ ID NO: 2377245 - protein, 7 aa, Entamoeba dispar
TKKEQQA

SEQ ID NO: 2377246 - protein, 6 aa, Entamoeba dispar
TKKKKE

SEQ ID NO: 2377247 - protein, 16 aa, Entamoeba dispar
TKKNDNTENTRDEYYK

SEQ ID NO: 2377248 - protein, 7 aa, Entamoeba dispar
TKKNKIG

SEQ ID NO: 2377249 - protein, 14 aa, Entamoeba dispar
TKKQTKSLEGTAPQ

SEQ ID NO: 2377250 - protein, 5 aa, Entamoeba dispar
TKKSI

SEQ ID NO: 2377251 - protein, 7 aa, Entamoeba dispar
TKKSLSP

SEQ ID NO: 2377252 - protein, 6 aa, Entamoeba dispar
TKKTPG

SEQ ID NO: 2377253 - protein, 8 aa, Entamoeba dispar
TKKTSGEI

SEQ ID NO: 2377254 - protein, 10 aa, Entamoeba dispar
TKKTSNPTIQ

SEQ ID NO: 2377255 - protein, 7 aa, Entamoeba dispar
TKKYAKA

SEQ ID NO: 2377256 - protein, 8 aa, Entamoeba dispar
TKKYANAR

SEQ ID NO: 2377257 - protein, 7 aa, Entamoeba dispar
TKKYNGK

SEQ ID NO: 2377258 - protein, 6 aa, Entamoeba dispar
TKLNPD

SEQ ID NO: 2377259 - protein, 17 aa, Entamoeba dispar
TKLTSDPTSLQGISAER

SEQ ID NO: 2377260 - protein, 5 aa, Entamoeba dispar
TKNES

SEQ ID NO: 2377261 - protein, 7 aa, Entamoeba dispar
TKNETGA

SEQ ID NO: 2377262 - protein, 8 aa, Entamoeba dispar
TKNFYTTT

SEQ ID NO: 2377263 - protein, 7 aa, Entamoeba dispar
TKNGRSL

SEQ ID NO: 2377264 - protein, 9 aa, Entamoeba dispar
TKNPYTAPL

SEQ ID NO: 2377265 - protein, 7 aa, Entamoeba dispar
TKNQAGF

SEQ ID NO: 2377266 - protein, 7 aa, Entamoeba dispar
TKNQCDI

SEQ ID NO: 2377267 - protein, 4 aa, Entamoeba dispar
TKNV

SEQ ID NO: 2377268 - protein, 5 aa, Entamoeba dispar
TKNVP

SEQ ID NO: 2377269 - protein, 5 aa, Entamoeba dispar
TKPED

SEQ ID NO: 2377270 - protein, 44 aa, Entamoeba dispar
TKPEEDNSYKLQSQSEIKEKINETSSGSYVTPYTAQNDSTLEEL

SEQ ID NO: 2377271 - protein, 5 aa, Entamoeba dispar
TKPFD

SEQ ID NO: 2377272 - protein, 8 aa, Entamoeba dispar
TKPIAGAS

SEQ ID NO: 2377273 - protein, 9 aa, Entamoeba dispar
TKPKESYYP

SEQ ID NO: 2377274 - protein, 10 aa, Entamoeba dispar
TKPKRPVVES

SEQ ID NO: 2377275 - protein, 6 aa, Entamoeba dispar
TKPKTV

SEQ ID NO: 2377276 - protein, 5 aa, Entamoeba dispar
TKPPQ

SEQ ID NO: 2377277 - protein, 8 aa, Entamoeba dispar
TKPSPINY

SEQ ID NO: 2377278 - protein, 6 aa, Entamoeba dispar
TKPSPV

SEQ ID NO: 2377279 - protein, 7 aa, Entamoeba dispar
TKPYTYG

SEQ ID NO: 2377280 - protein, 4 aa, Entamoeba dispar
TKQA

SEQ ID NO: 2377281 - protein, 9 aa, Entamoeba dispar
TKQADQCDG

SEQ ID NO: 2377282 - protein, 7 aa, Entamoeba dispar
TKQDASN

SEQ ID NO: 2377283 - protein, 6 aa, Entamoeba dispar
TKQENR

SEQ ID NO: 2377284 - protein, 10 aa, Entamoeba dispar
TKQEPLPSNI

SEQ ID NO: 2377285 - protein, 17 aa, Entamoeba dispar
TKQGKNSIKENVTTNTH

SEQ ID NO: 2377286 - protein, 7 aa, Entamoeba dispar
TKQNENQ

SEQ ID NO: 2377287 - protein, 11 aa, Entamoeba dispar
TKQNKQNLTQS

SEQ ID NO: 2377288 - protein, 7 aa, Entamoeba dispar
TKQPKHQ

SEQ ID NO: 2377289 - protein, 6 aa, Entamoeba dispar
TKQPTK

SEQ ID NO: 2377290 - protein, 8 aa, Entamoeba dispar
TKQPTNRY

SEQ ID NO: 2377291 - protein, 5 aa, Entamoeba dispar
TKQQI

SEQ ID NO: 2377292 - protein, 9 aa, Entamoeba dispar
TKQQKDEID

SEQ ID NO: 2377293 - protein, 9 aa, Entamoeba dispar
TKQSDENIK

SEQ ID NO: 2377294 - protein, 13 aa, Entamoeba dispar
TKQTRQDNPYDLG

SEQ ID NO: 2377295 - protein, 6 aa, Entamoeba dispar
TKRDTR

SEQ ID NO: 2377296 - protein, 4 aa, Entamoeba dispar
TKRG

SEQ ID NO: 2377297 - protein, 10 aa, Entamoeba dispar
TKRSTPENIT

SEQ ID NO: 2377298 - protein, 14 aa, Entamoeba dispar
TKRTFQKKNTTKLS

SEQ ID NO: 2377299 - protein, 22 aa, Entamoeba dispar
TKRYRDDSKIEVKQKSEEDEVN

SEQ ID NO: 2377300 - protein, 7 aa, Entamoeba dispar
TKSAKID

SEQ ID NO: 2377301 - protein, 15 aa, Entamoeba dispar
TKSATGTEKLTSKRL

SEQ ID NO: 2377302 - protein, 10 aa, Entamoeba dispar
TKSDSKDPCE

SEQ ID NO: 2377303 - protein, 16 aa, Entamoeba dispar
TKSGDKQVGNYSGGMK

SEQ ID NO: 2377304 - protein, 7 aa, Entamoeba dispar
TKSGESM

SEQ ID NO: 2377305 - protein, 6 aa, Entamoeba dispar
TKSIEL

SEQ ID NO: 2377306 - protein, 8 aa, Entamoeba dispar
TKSKSYCP

SEQ ID NO: 2377307 - protein, 6 aa, Entamoeba dispar
TKSNVT

SEQ ID NO: 2377308 - protein, 10 aa, Entamoeba dispar
TKSPLKNEGN

SEQ ID NO: 2377309 - protein, 22 aa, Entamoeba dispar
TKSPRENKNNPSSLQKSPSIRS

SEQ ID NO: 2377310 - protein, 7 aa, Entamoeba dispar
TKSQYNL

SEQ ID NO: 2377311 - protein, 14 aa, Entamoeba dispar
TKSSKDGVSSQQYQ

SEQ ID NO: 2377312 - protein, 25 aa, Entamoeba dispar
TKSSLDKKISKNKMFNPSNIKQQLT

SEQ ID NO: 2377313 - protein, 8 aa, Entamoeba dispar
TKSTCYGS

SEQ ID NO: 2377314 - protein, 9 aa, Entamoeba dispar
TKTEGDVSS

SEQ ID NO: 2377315 - protein, 8 aa, Entamoeba dispar
TKTKEKEM

SEQ ID NO: 2377316 - protein, 6 aa, Entamoeba dispar
TKTPGV

SEQ ID NO: 2377317 - protein, 5 aa, Entamoeba dispar
TKTPN

SEQ ID NO: 2377318 - protein, 6 aa, Entamoeba dispar
TKTPRF

SEQ ID NO: 2377319 - protein, 6 aa, Entamoeba dispar
TKTPTE

SEQ ID NO: 2377320 - protein, 8 aa, Entamoeba dispar
TKTQEGRS

SEQ ID NO: 2377321 - protein, 6 aa, Entamoeba dispar
TKTQKT

SEQ ID NO: 2377322 - protein, 7 aa, Entamoeba dispar
TKTQQTV

SEQ ID NO: 2377323 - protein, 6 aa, Entamoeba dispar
TKTRRE

SEQ ID NO: 2377324 - protein, 5 aa, Entamoeba dispar
TKTSE

SEQ ID NO: 2377325 - protein, 7 aa, Entamoeba dispar
TKTSGFE

SEQ ID NO: 2377326 - protein, 9 aa, Entamoeba dispar
TKTSTRNAK

SEQ ID NO: 2377327 - protein, 19 aa, Entamoeba dispar
TKTTKDPQPEQTPAEDPEV

SEQ ID NO: 2377328 - protein, 5 aa, Entamoeba dispar
TKTTV

SEQ ID NO: 2377329 - protein, 10 aa, Entamoeba dispar
TKTVNGTPTK

SEQ ID NO: 2377330 - protein, 8 aa, Entamoeba dispar
TKTYRRGN

SEQ ID NO: 2377331 - protein, 9 aa, Entamoeba dispar
TKVTDGNGQ

SEQ ID NO: 2377332 - protein, 11 aa, Entamoeba dispar
TKYDKELETQR

SEQ ID NO: 2377333 - protein, 8 aa, Entamoeba dispar
TKYEDPTQ

SEQ ID NO: 2377334 - protein, 13 aa, Entamoeba dispar
TKYNDTWNADNAR

SEQ ID NO: 2377335 - protein, 9 aa, Entamoeba dispar
TLDDDESSV

SEQ ID NO: 2377336 - protein, 11 aa, Entamoeba dispar
TLDESNKKPMR

SEQ ID NO: 2377337 - protein, 8 aa, Entamoeba dispar
TLDNEGSC

SEQ ID NO: 2377338 - protein, 36 aa, Entamoeba dispar
TLDSYEQEKDVPPTPRKGDHSQTGSDTPKKGTTVYS

SEQ ID NO: 2377339 - protein, 23 aa, Entamoeba dispar
TLDVPRSSDIMNSQQPSKLSSGN

SEQ ID NO: 2377340 - protein, 6 aa, Entamoeba dispar
TLEEKY

SEQ ID NO: 2377341 - protein, 8 aa, Entamoeba dispar
TLGEQNPV

SEQ ID NO: 2377342 - protein, 4 aa, Entamoeba dispar
TLGN

SEQ ID NO: 2377343 - protein, 6 aa, Entamoeba dispar
TLGTTE

SEQ ID NO: 2377344 - protein, 11 aa, Entamoeba dispar
TLHSPKKLTST

SEQ ID NO: 2377345 - protein, 5 aa, Entamoeba dispar
TLIGG

SEQ ID NO: 2377346 - protein, 5 aa, Entamoeba dispar
TLIPD

SEQ ID NO: 2377347 - protein, 8 aa, Entamoeba dispar
TLKDDDYN

SEQ ID NO: 2377348 - protein, 60 aa, Entamoeba dispar
TLKHSRSRRGTISREGSNSSDSKKKGSSTISSEEDSTDSTVKTNEGSEEGDKSDNNEGVY

SEQ ID NO: 2377349 - protein, 18 aa, Entamoeba dispar
TLKKEEKKFEHHDDLAYI

SEQ ID NO: 2377350 - protein, 11 aa, Entamoeba dispar
TLKKSNTATEM

SEQ ID NO: 2377351 - protein, 8 aa, Entamoeba dispar
TLKSNEVT

SEQ ID NO: 2377352 - protein, 8 aa, Entamoeba dispar
TLKYTSNN

SEQ ID NO: 2377353 - protein, 17 aa, Entamoeba dispar
TLNNDSLIEENKQNEDV

SEQ ID NO: 2377354 - protein, 13 aa, Entamoeba dispar
TLNNGGKYTVPEG

SEQ ID NO: 2377355 - protein, 8 aa, Entamoeba dispar
TLNPTNQT

SEQ ID NO: 2377356 - protein, 5 aa, Entamoeba dispar
TLPDI

SEQ ID NO: 2377357 - protein, 5 aa, Entamoeba dispar
TLPEY

SEQ ID NO: 2377358 - protein, 29 aa, Entamoeba dispar
TLPNEKESTIGPQNIEENKNTSTKKKNIN

SEQ ID NO: 2377359 - protein, 4 aa, Entamoeba dispar
TLPQ

SEQ ID NO: 2377360 - protein, 8 aa, Entamoeba dispar
TLPTRSLN

SEQ ID NO: 2377361 - protein, 35 aa, Entamoeba dispar
TLQEPNKSLQSNSVPKSDISKEEVQTDFVGNEEII

SEQ ID NO: 2377362 - protein, 10 aa, Entamoeba dispar
TLQESGITED

SEQ ID NO: 2377363 - protein, 9 aa, Entamoeba dispar
TLQNNPKIE

SEQ ID NO: 2377364 - protein, 13 aa, Entamoeba dispar
TLQPSEHNGVSKN

SEQ ID NO: 2377365 - protein, 5 aa, Entamoeba dispar
TLSAL

SEQ ID NO: 2377366 - protein, 6 aa, Entamoeba dispar
TLSDKD

SEQ ID NO: 2377367 - protein, 13 aa, Entamoeba dispar
TLSLKTEKTVNEK

SEQ ID NO: 2377368 - protein, 5 aa, Entamoeba dispar
TLSPA

SEQ ID NO: 2377369 - protein, 12 aa, Entamoeba dispar
TLSQRDSKTFQK

SEQ ID NO: 2377370 - protein, 7 aa, Entamoeba dispar
TLSSDAQ

SEQ ID NO: 2377371 - protein, 7 aa, Entamoeba dispar
TLSSDNS

SEQ ID NO: 2377372 - protein, 6 aa, Entamoeba dispar
TLSSNS

SEQ ID NO: 2377373 - protein, 4 aa, Entamoeba dispar
TLTG

SEQ ID NO: 2377374 - protein, 12 aa, Entamoeba dispar
TLTKGGSTQELQ

SEQ ID NO: 2377375 - protein, 4 aa, Entamoeba dispar
TLTL

SEQ ID NO: 2377376 - protein, 5 aa, Entamoeba dispar
TLTLE

SEQ ID NO: 2377377 - protein, 4 aa, Entamoeba dispar
TLTN

SEQ ID NO: 2377378 - protein, 13 aa, Entamoeba dispar
TLTNRHVSNAFFS

SEQ ID NO: 2377379 - protein, 5 aa, Entamoeba dispar
TLTSE

SEQ ID NO: 2377380 - protein, 8 aa, Entamoeba dispar
TLTSNKNN

SEQ ID NO: 2377381 - protein, 5 aa, Entamoeba dispar
TLTSP

SEQ ID NO: 2377382 - protein, 16 aa, Entamoeba dispar
TLTYEPKRDGADISKG

SEQ ID NO: 2377383 - protein, 4 aa, Entamoeba dispar
TMDD

SEQ ID NO: 2377384 - protein, 19 aa, Entamoeba dispar
TMGENENDDIKEVTEECQK

SEQ ID NO: 2377385 - protein, 8 aa, Entamoeba dispar
TMKQEEKL

SEQ ID NO: 2377386 - protein, 20 aa, Entamoeba dispar
TMNGNSYELSYSGSGSKPFN

SEQ ID NO: 2377387 - protein, 5 aa, Entamoeba dispar
TMTEY

SEQ ID NO: 2377388 - protein, 7 aa, Entamoeba dispar
TMTHNSD

SEQ ID NO: 2377389 - protein, 11 aa, Entamoeba dispar
TMTNSLPKEEL

SEQ ID NO: 2377390 - protein, 10 aa, Entamoeba dispar
TMTTENRKKR

SEQ ID NO: 2377391 - protein, 14 aa, Entamoeba dispar
TNAHSQVQHSGSIE

SEQ ID NO: 2377392 - protein, 14 aa, Entamoeba dispar
TNAIKKDSNESQQH

SEQ ID NO: 2377393 - protein, 4 aa, Entamoeba dispar
TNAL

SEQ ID NO: 2377394 - protein, 6 aa, Entamoeba dispar
TNASWD

SEQ ID NO: 2377395 - protein, 12 aa, Entamoeba dispar
TNCSSSRDHHKK

SEQ ID NO: 2377396 - protein, 5 aa, Entamoeba dispar
TNDAE

SEQ ID NO: 2377397 - protein, 6 aa, Entamoeba dispar
TNDEVS

SEQ ID NO: 2377398 - protein, 8 aa, Entamoeba dispar
TNDGTEAD

SEQ ID NO: 2377399 - protein, 5 aa, Entamoeba dispar
TNDIE

SEQ ID NO: 2377400 - protein, 5 aa, Entamoeba dispar
TNDIN

SEQ ID NO: 2377401 - protein, 11 aa, Entamoeba dispar
TNDKCEDKIDK

SEQ ID NO: 2377402 - protein, 7 aa, Entamoeba dispar
TNDPERI

SEQ ID NO: 2377403 - protein, 8 aa, Entamoeba dispar
TNDPLNKI

SEQ ID NO: 2377404 - protein, 9 aa, Entamoeba dispar
TNDPQMTNE

SEQ ID NO: 2377405 - protein, 6 aa, Entamoeba dispar
TNDRIP

SEQ ID NO: 2377406 - protein, 14 aa, Entamoeba dispar
TNEEERQCKQCSDG

SEQ ID NO: 2377407 - protein, 15 aa, Entamoeba dispar
TNEEKQNIIDENKEY

SEQ ID NO: 2377408 - protein, 12 aa, Entamoeba dispar
TNEENDSKCGRC

SEQ ID NO: 2377409 - protein, 5 aa, Entamoeba dispar
TNEEW

SEQ ID NO: 2377410 - protein, 10 aa, Entamoeba dispar
TNEGAQLSSG

SEQ ID NO: 2377411 - protein, 20 aa, Entamoeba dispar
TNEINFNSDRDKIKVNEESR

SEQ ID NO: 2377412 - protein, 5 aa, Entamoeba dispar
TNEKK

SEQ ID NO: 2377413 - protein, 10 aa, Entamoeba dispar
TNENNKQNNP

SEQ ID NO: 2377414 - protein, 6 aa, Entamoeba dispar
TNENSK

SEQ ID NO: 2377415 - protein, 8 aa, Entamoeba dispar
TNEQRASI

SEQ ID NO: 2377416 - protein, 6 aa, Entamoeba dispar
TNERIE

SEQ ID NO: 2377417 - protein, 6 aa, Entamoeba dispar
TNESPF

SEQ ID NO: 2377418 - protein, 7 aa, Entamoeba dispar
TNESTSL

SEQ ID NO: 2377419 - protein, 13 aa, Entamoeba dispar
TNETDELGNDAKN

SEQ ID NO: 2377420 - protein, 10 aa, Entamoeba dispar
TNETEENENN

SEQ ID NO: 2377421 - protein, 8 aa, Entamoeba dispar
TNFKNGDK

SEQ ID NO: 2377422 - protein, 4 aa, Entamoeba dispar
TNFN

SEQ ID NO: 2377423 - protein, 4 aa, Entamoeba dispar
TNFT

SEQ ID NO: 2377424 - protein, 7 aa, Entamoeba dispar
TNGAENG

SEQ ID NO: 2377425 - protein, 11 aa, Entamoeba dispar
TNGAYSVSGGF

SEQ ID NO: 2377426 - protein, 6 aa, Entamoeba dispar
TNGCPC

SEQ ID NO: 2377427 - protein, 4 aa, Entamoeba dispar
TNGI

SEQ ID NO: 2377428 - protein, 4 aa, Entamoeba dispar
TNGK

SEQ ID NO: 2377429 - protein, 8 aa, Entamoeba dispar
TNGNEANI

SEQ ID NO: 2377430 - protein, 28 aa, Entamoeba dispar
TNGPFEDEQTETPLSISKEDENIYRPEI

SEQ ID NO: 2377431 - protein, 5 aa, Entamoeba dispar
TNGPI

SEQ ID NO: 2377432 - protein, 5 aa, Entamoeba dispar
TNGST

SEQ ID NO: 2377433 - protein, 5 aa, Entamoeba dispar
TNGTC

SEQ ID NO: 2377434 - protein, 5 aa, Entamoeba dispar
TNGVN

SEQ ID NO: 2377435 - protein, 4 aa, Entamoeba dispar
TNGY

SEQ ID NO: 2377436 - protein, 7 aa, Entamoeba dispar
TNGYSVT

SEQ ID NO: 2377437 - protein, 56 aa, Entamoeba dispar
TNHENETNQNEIQQNTNLNINNKNQQEGNATNDNQQEDNVNNENQQEDNATNEIYK

SEQ ID NO: 2377438 - protein, 107 aa, Entamoeba dispar
TNHENETNQNEIQQNTNLNINNKNQQEGNATNDNQQEDNVNNENQQEDNVNNENQQEDNATNENIQKDNVNNENQQEVNVNNENQQEVNVNNENQQEVNVNNENIQE

SEQ ID NO: 2377439 - protein, 6 aa, Entamoeba dispar
TNIKGQ

SEQ ID NO: 2377440 - protein, 35 aa, Entamoeba dispar
TNIKQGNDEIEAMKGTKGDEHNNRYNQTKRRFENA

SEQ ID NO: 2377441 - protein, 21 aa, Entamoeba dispar
TNIQDNSNTNTISLNGASGVT

SEQ ID NO: 2377442 - protein, 5 aa, Entamoeba dispar
TNIYD

SEQ ID NO: 2377443 - protein, 6 aa, Entamoeba dispar
TNKDLS

SEQ ID NO: 2377444 - protein, 6 aa, Entamoeba dispar
TNKDTL

SEQ ID NO: 2377445 - protein, 13 aa, Entamoeba dispar
TNKEYAKTAKTYM

SEQ ID NO: 2377446 - protein, 9 aa, Entamoeba dispar
TNKIDDEEY

SEQ ID NO: 2377447 - protein, 8 aa, Entamoeba dispar
TNKINENI

SEQ ID NO: 2377448 - protein, 8 aa, Entamoeba dispar
TNKKDETF

SEQ ID NO: 2377449 - protein, 12 aa, Entamoeba dispar
TNKKEGDKEDMQ

SEQ ID NO: 2377450 - protein, 7 aa, Entamoeba dispar
TNKKGKL

SEQ ID NO: 2377451 - protein, 8 aa, Entamoeba dispar
TNKKNING

SEQ ID NO: 2377452 - protein, 8 aa, Entamoeba dispar
TNKPEGSI

SEQ ID NO: 2377453 - protein, 5 aa, Entamoeba dispar
TNKQN

SEQ ID NO: 2377454 - protein, 6 aa, Entamoeba dispar
TNKSAA

SEQ ID NO: 2377455 - protein, 4 aa, Entamoeba dispar
TNKT

SEQ ID NO: 2377456 - protein, 9 aa, Entamoeba dispar
TNKTENGCV

SEQ ID NO: 2377457 - protein, 23 aa, Entamoeba dispar
TNKTEYPSHNSPSPSTGSSNDTF

SEQ ID NO: 2377458 - protein, 11 aa, Entamoeba dispar
TNKTIKDEEQI

SEQ ID NO: 2377459 - protein, 4 aa, Entamoeba dispar
TNLK

SEQ ID NO: 2377460 - protein, 13 aa, Entamoeba dispar
TNLSTTNKHKDVE

SEQ ID NO: 2377461 - protein, 10 aa, Entamoeba dispar
TNMKGDVSTS

SEQ ID NO: 2377462 - protein, 4 aa, Entamoeba dispar
TNND

SEQ ID NO: 2377463 - protein, 7 aa, Entamoeba dispar
TNNETND

SEQ ID NO: 2377464 - protein, 8 aa, Entamoeba dispar
TNNIEYNS

SEQ ID NO: 2377465 - protein, 9 aa, Entamoeba dispar
TNNINQNTC

SEQ ID NO: 2377466 - protein, 13 aa, Entamoeba dispar
TNNKSMSIKEDLE

SEQ ID NO: 2377467 - protein, 7 aa, Entamoeba dispar
TNNNIEQ

SEQ ID NO: 2377468 - protein, 5 aa, Entamoeba dispar
TNNPR

SEQ ID NO: 2377469 - protein, 8 aa, Entamoeba dispar
TNNPSIKK

SEQ ID NO: 2377470 - protein, 10 aa, Entamoeba dispar
TNNREKGVRA

SEQ ID NO: 2377471 - protein, 39 aa, Entamoeba dispar
TNNREKNDNSEFKYNSTTNTLEINGNNELKHSLNPTNKP

SEQ ID NO: 2377472 - protein, 18 aa, Entamoeba dispar
TNNREKNNNSKFKYNSNT

SEQ ID NO: 2377473 - protein, 10 aa, Entamoeba dispar
TNNTESVHSE

SEQ ID NO: 2377474 - protein, 6 aa, Entamoeba dispar
TNPARV

SEQ ID NO: 2377475 - protein, 5 aa, Entamoeba dispar
TNPEL

SEQ ID NO: 2377476 - protein, 4 aa, Entamoeba dispar
TNPG

SEQ ID NO: 2377477 - protein, 5 aa, Entamoeba dispar
TNPHT

SEQ ID NO: 2377478 - protein, 19 aa, Entamoeba dispar
TNPKDARIKGTVDAVETSL

SEQ ID NO: 2377479 - protein, 5 aa, Entamoeba dispar
TNPLQ

SEQ ID NO: 2377480 - protein, 4 aa, Entamoeba dispar
TNPM

SEQ ID NO: 2377481 - protein, 5 aa, Entamoeba dispar
TNPMS

SEQ ID NO: 2377482 - protein, 7 aa, Entamoeba dispar
TNPNEAT

SEQ ID NO: 2377483 - protein, 4 aa, Entamoeba dispar
TNPQ

SEQ ID NO: 2377484 - protein, 11 aa, Entamoeba dispar
TNPQSKIDSQN

SEQ ID NO: 2377485 - protein, 14 aa, Entamoeba dispar
TNPRRIGAESVAER

SEQ ID NO: 2377486 - protein, 10 aa, Entamoeba dispar
TNPSKKSLKY

SEQ ID NO: 2377487 - protein, 7 aa, Entamoeba dispar
TNPSKWK

SEQ ID NO: 2377488 - protein, 10 aa, Entamoeba dispar
TNPSSSKTKF

SEQ ID NO: 2377489 - protein, 9 aa, Entamoeba dispar
TNQNKRPDN

SEQ ID NO: 2377490 - protein, 7 aa, Entamoeba dispar
TNQPNEL

SEQ ID NO: 2377491 - protein, 9 aa, Entamoeba dispar
TNQSGNEIT

SEQ ID NO: 2377492 - protein, 10 aa, Entamoeba dispar
TNQSNVNINE

SEQ ID NO: 2377493 - protein, 9 aa, Entamoeba dispar
TNQSPLEVT

SEQ ID NO: 2377494 - protein, 11 aa, Entamoeba dispar
TNQTPDVPYGD

SEQ ID NO: 2377495 - protein, 4 aa, Entamoeba dispar
TNRC

SEQ ID NO: 2377496 - protein, 15 aa, Entamoeba dispar
TNRNNSNPSKNNENG

SEQ ID NO: 2377497 - protein, 15 aa, Entamoeba dispar
TNRYSSEKKNETENN

SEQ ID NO: 2377498 - protein, 9 aa, Entamoeba dispar
TNSDNKINV

SEQ ID NO: 2377499 - protein, 4 aa, Entamoeba dispar
TNSE

SEQ ID NO: 2377500 - protein, 5 aa, Entamoeba dispar
TNSEM

SEQ ID NO: 2377501 - protein, 8 aa, Entamoeba dispar
TNSENSVN

SEQ ID NO: 2377502 - protein, 5 aa, Entamoeba dispar
TNSEV

SEQ ID NO: 2377503 - protein, 8 aa, Entamoeba dispar
TNSGTEAI

SEQ ID NO: 2377504 - protein, 7 aa, Entamoeba dispar
TNSGTQV

SEQ ID NO: 2377505 - protein, 7 aa, Entamoeba dispar
TNSHYDA

SEQ ID NO: 2377506 - protein, 6 aa, Entamoeba dispar
TNSLTT

SEQ ID NO: 2377507 - protein, 8 aa, Entamoeba dispar
TNSNSFDQ

SEQ ID NO: 2377508 - protein, 10 aa, Entamoeba dispar
TNSQSDAYTG

SEQ ID NO: 2377509 - protein, 11 aa, Entamoeba dispar
TNSQSKIDSQN

SEQ ID NO: 2377510 - protein, 8 aa, Entamoeba dispar
TNSQTPSI

SEQ ID NO: 2377511 - protein, 9 aa, Entamoeba dispar
TNSSFGNSS

SEQ ID NO: 2377512 - protein, 10 aa, Entamoeba dispar
TNSSKITGKY

SEQ ID NO: 2377513 - protein, 5 aa, Entamoeba dispar
TNSSS

SEQ ID NO: 2377514 - protein, 5 aa, Entamoeba dispar
TNSTD

SEQ ID NO: 2377515 - protein, 8 aa, Entamoeba dispar
TNSTSQKA

SEQ ID NO: 2377516 - protein, 7 aa, Entamoeba dispar
TNSYNEK

SEQ ID NO: 2377517 - protein, 9 aa, Entamoeba dispar
TNTDGNNIG

SEQ ID NO: 2377518 - protein, 7 aa, Entamoeba dispar
TNTEIPN

SEQ ID NO: 2377519 - protein, 5 aa, Entamoeba dispar
TNTEY

SEQ ID NO: 2377520 - protein, 6 aa, Entamoeba dispar
TNTHSC

SEQ ID NO: 2377521 - protein, 9 aa, Entamoeba dispar
TNTKERIKS

SEQ ID NO: 2377522 - protein, 8 aa, Entamoeba dispar
TNTKSECR

SEQ ID NO: 2377523 - protein, 7 aa, Entamoeba dispar
TNTNGFD

SEQ ID NO: 2377524 - protein, 23 aa, Entamoeba dispar
TNTNTKKSSTKTGGSSHSNEQNI

SEQ ID NO: 2377525 - protein, 5 aa, Entamoeba dispar
TNTPY

SEQ ID NO: 2377526 - protein, 23 aa, Entamoeba dispar
TNTQYQQMSGRAGRFGIDEKGES

SEQ ID NO: 2377527 - protein, 6 aa, Entamoeba dispar
TNTTSY

SEQ ID NO: 2377528 - protein, 19 aa, Entamoeba dispar
TNTVNRNQKKSKQQCHHSS

SEQ ID NO: 2377529 - protein, 5 aa, Entamoeba dispar
TNTYD

SEQ ID NO: 2377530 - protein, 6 aa, Entamoeba dispar
TNYDSR

SEQ ID NO: 2377531 - protein, 12 aa, Entamoeba dispar
TPAKRNKNKDTL

SEQ ID NO: 2377532 - protein, 4 aa, Entamoeba dispar
TPAY

SEQ ID NO: 2377533 - protein, 4 aa, Entamoeba dispar
TPCK

SEQ ID NO: 2377534 - protein, 5 aa, Entamoeba dispar
TPCQV

SEQ ID NO: 2377535 - protein, 5 aa, Entamoeba dispar
TPDKK

SEQ ID NO: 2377536 - protein, 11 aa, Entamoeba dispar
TPDKKEDLNTT

SEQ ID NO: 2377537 - protein, 10 aa, Entamoeba dispar
TPDPNELNKK

SEQ ID NO: 2377538 - protein, 7 aa, Entamoeba dispar
TPDPNNL

SEQ ID NO: 2377539 - protein, 10 aa, Entamoeba dispar
TPDQEEEIGM

SEQ ID NO: 2377540 - protein, 18 aa, Entamoeba dispar
TPDQNSKAMDQNETTQLM

SEQ ID NO: 2377541 - protein, 12 aa, Entamoeba dispar
TPDSPTTTDKKC

SEQ ID NO: 2377542 - protein, 8 aa, Entamoeba dispar
TPDTQSVS

SEQ ID NO: 2377543 - protein, 8 aa, Entamoeba dispar
TPDTREKA

SEQ ID NO: 2377544 - protein, 6 aa, Entamoeba dispar
TPEEIE

SEQ ID NO: 2377545 - protein, 18 aa, Entamoeba dispar
TPEEQVEQFKKEKNKFKE

SEQ ID NO: 2377546 - protein, 37 aa, Entamoeba dispar
TPEETTEHEESQNETESSETSGSGSDGNSRTSQVSSV

SEQ ID NO: 2377547 - protein, 14 aa, Entamoeba dispar
TPELPSEENTQTLN

SEQ ID NO: 2377548 - protein, 8 aa, Entamoeba dispar
TPENNTVS

SEQ ID NO: 2377549 - protein, 5 aa, Entamoeba dispar
TPENP

SEQ ID NO: 2377550 - protein, 11 aa, Entamoeba dispar
TPEPWKSKFDE

SEQ ID NO: 2377551 - protein, 8 aa, Entamoeba dispar
TPESIQKR

SEQ ID NO: 2377552 - protein, 6 aa, Entamoeba dispar
TPETSN

SEQ ID NO: 2377553 - protein, 4 aa, Entamoeba dispar
TPFT

SEQ ID NO: 2377554 - protein, 4 aa, Entamoeba dispar
TPFV

SEQ ID NO: 2377555 - protein, 6 aa, Entamoeba dispar
TPFVPT

SEQ ID NO: 2377556 - protein, 5 aa, Entamoeba dispar
TPGCD

SEQ ID NO: 2377557 - protein, 11 aa, Entamoeba dispar
TPGLNDSNNFD

SEQ ID NO: 2377558 - protein, 12 aa, Entamoeba dispar
TPGLQDSDGFDK

SEQ ID NO: 2377559 - protein, 27 aa, Entamoeba dispar
TPGVQTQATPAQPQQTNKPAVDLSFLG

SEQ ID NO: 2377560 - protein, 13 aa, Entamoeba dispar
TPGYGTSDKPYCG

SEQ ID NO: 2377561 - protein, 4 aa, Entamoeba dispar
TPHT

SEQ ID NO: 2377562 - protein, 14 aa, Entamoeba dispar
TPIKRRGKKTRKYT

SEQ ID NO: 2377563 - protein, 7 aa, Entamoeba dispar
TPINETY

SEQ ID NO: 2377564 - protein, 5 aa, Entamoeba dispar
TPIQS

SEQ ID NO: 2377565 - protein, 4 aa, Entamoeba dispar
TPIR

SEQ ID NO: 2377566 - protein, 16 aa, Entamoeba dispar
TPISDYESKPQKKEQE

SEQ ID NO: 2377567 - protein, 11 aa, Entamoeba dispar
TPISKDSQGKQ

SEQ ID NO: 2377568 - protein, 6 aa, Entamoeba dispar
TPKASG

SEQ ID NO: 2377569 - protein, 4 aa, Entamoeba dispar
TPKI

SEQ ID NO: 2377570 - protein, 11 aa, Entamoeba dispar
TPKKGAEENYL

SEQ ID NO: 2377571 - protein, 12 aa, Entamoeba dispar
TPKKRKGEMNSN

SEQ ID NO: 2377572 - protein, 6 aa, Entamoeba dispar
TPKKSK

SEQ ID NO: 2377573 - protein, 9 aa, Entamoeba dispar
TPKLSSDKY

SEQ ID NO: 2377574 - protein, 10 aa, Entamoeba dispar
TPKNKNQSQI

SEQ ID NO: 2377575 - protein, 12 aa, Entamoeba dispar
TPKPYNQDPSMD

SEQ ID NO: 2377576 - protein, 4 aa, Entamoeba dispar
TPKS

SEQ ID NO: 2377577 - protein, 7 aa, Entamoeba dispar
TPKTTSI

SEQ ID NO: 2377578 - protein, 5 aa, Entamoeba dispar
TPLGC

SEQ ID NO: 2377579 - protein, 5 aa, Entamoeba dispar
TPLNE

SEQ ID NO: 2377580 - protein, 8 aa, Entamoeba dispar
TPLQEDQF

SEQ ID NO: 2377581 - protein, 10 aa, Entamoeba dispar
TPMKENEENL

SEQ ID NO: 2377582 - protein, 8 aa, Entamoeba dispar
TPNDKSNV

SEQ ID NO: 2377583 - protein, 7 aa, Entamoeba dispar
TPNDSAG

SEQ ID NO: 2377584 - protein, 11 aa, Entamoeba dispar
TPNFGADENDT

SEQ ID NO: 2377585 - protein, 15 aa, Entamoeba dispar
TPNGIGRSSRMNGKH

SEQ ID NO: 2377586 - protein, 5 aa, Entamoeba dispar
TPNGV

SEQ ID NO: 2377587 - protein, 4 aa, Entamoeba dispar
TPNI

SEQ ID NO: 2377588 - protein, 6 aa, Entamoeba dispar
TPNIDA

SEQ ID NO: 2377589 - protein, 6 aa, Entamoeba dispar
TPNKEL

SEQ ID NO: 2377590 - protein, 10 aa, Entamoeba dispar
TPNNKEIKGR

SEQ ID NO: 2377591 - protein, 7 aa, Entamoeba dispar
TPNPYQY

SEQ ID NO: 2377592 - protein, 7 aa, Entamoeba dispar
TPNSLND

SEQ ID NO: 2377593 - protein, 8 aa, Entamoeba dispar
TPNSLNGN

SEQ ID NO: 2377594 - protein, 5 aa, Entamoeba dispar
TPPFS

SEQ ID NO: 2377595 - protein, 7 aa, Entamoeba dispar
TPPGYIK

SEQ ID NO: 2377596 - protein, 4 aa, Entamoeba dispar
TPPI

SEQ ID NO: 2377597 - protein, 9 aa, Entamoeba dispar
TPPPDLPDK

SEQ ID NO: 2377598 - protein, 17 aa, Entamoeba dispar
TPPTGDGIHFTKRIDII

SEQ ID NO: 2377599 - protein, 5 aa, Entamoeba dispar
TPPVN

SEQ ID NO: 2377600 - protein, 6 aa, Entamoeba dispar
TPQGTP

SEQ ID NO: 2377601 - protein, 6 aa, Entamoeba dispar
TPQPIA

SEQ ID NO: 2377602 - protein, 7 aa, Entamoeba dispar
TPQSDSR

SEQ ID NO: 2377603 - protein, 7 aa, Entamoeba dispar
TPQSVNA

SEQ ID NO: 2377604 - protein, 5 aa, Entamoeba dispar
TPRAR

SEQ ID NO: 2377605 - protein, 17 aa, Entamoeba dispar
TPRAYSSTNLDDSITSL

SEQ ID NO: 2377606 - protein, 6 aa, Entamoeba dispar
TPRNDY

SEQ ID NO: 2377607 - protein, 8 aa, Entamoeba dispar
TPRRKEYN

SEQ ID NO: 2377608 - protein, 8 aa, Entamoeba dispar
TPSDACDE

SEQ ID NO: 2377609 - protein, 11 aa, Entamoeba dispar
TPSDNKINRNL

SEQ ID NO: 2377610 - protein, 9 aa, Entamoeba dispar
TPSFTDPIQ

SEQ ID NO: 2377611 - protein, 6 aa, Entamoeba dispar
TPSKGL

SEQ ID NO: 2377612 - protein, 5 aa, Entamoeba dispar
TPSKI

SEQ ID NO: 2377613 - protein, 7 aa, Entamoeba dispar
TPSPSIS

SEQ ID NO: 2377614 - protein, 9 aa, Entamoeba dispar
TPSQGFQGF

SEQ ID NO: 2377615 - protein, 6 aa, Entamoeba dispar
TPSQRL

SEQ ID NO: 2377616 - protein, 13 aa, Entamoeba dispar
TPSSVSSPILPPS

SEQ ID NO: 2377617 - protein, 8 aa, Entamoeba dispar
TPSTITTS

SEQ ID NO: 2377618 - protein, 7 aa, Entamoeba dispar
TPSTKAV

SEQ ID NO: 2377619 - protein, 4 aa, Entamoeba dispar
TPSY

SEQ ID NO: 2377620 - protein, 8 aa, Entamoeba dispar
TPTGTEPI

SEQ ID NO: 2377621 - protein, 4 aa, Entamoeba dispar
TPTK

SEQ ID NO: 2377622 - protein, 7 aa, Entamoeba dispar
TPTKSID

SEQ ID NO: 2377623 - protein, 5 aa, Entamoeba dispar
TPTLE

SEQ ID NO: 2377624 - protein, 4 aa, Entamoeba dispar
TPTP

SEQ ID NO: 2377625 - protein, 7 aa, Entamoeba dispar
TPTPRIG

SEQ ID NO: 2377626 - protein, 6 aa, Entamoeba dispar
TPTQKI

SEQ ID NO: 2377627 - protein, 27 aa, Entamoeba dispar
TPTVSPLPHPINDENESVSKDSKSSSS

SEQ ID NO: 2377628 - protein, 6 aa, Entamoeba dispar
TPVKPD

SEQ ID NO: 2377629 - protein, 4 aa, Entamoeba dispar
TPYA

SEQ ID NO: 2377630 - protein, 5 aa, Entamoeba dispar
TPYAQ

SEQ ID NO: 2377631 - protein, 9 aa, Entamoeba dispar
TPYNKTQVP

SEQ ID NO: 2377632 - protein, 5 aa, Entamoeba dispar
TPYNT

SEQ ID NO: 2377633 - protein, 4 aa, Entamoeba dispar
TPYP

SEQ ID NO: 2377634 - protein, 5 aa, Entamoeba dispar
TPYPI

SEQ ID NO: 2377635 - protein, 6 aa, Entamoeba dispar
TPYSKA

SEQ ID NO: 2377636 - protein, 15 aa, Entamoeba dispar
TQALRRASEKEVENG

SEQ ID NO: 2377637 - protein, 8 aa, Entamoeba dispar
TQATKAPI

SEQ ID NO: 2377638 - protein, 11 aa, Entamoeba dispar
TQCSETNYRVG

SEQ ID NO: 2377639 - protein, 9 aa, Entamoeba dispar
TQDTNESGF

SEQ ID NO: 2377640 - protein, 5 aa, Entamoeba dispar
TQELE

SEQ ID NO: 2377641 - protein, 16 aa, Entamoeba dispar
TQENGMRLSTKSANEW

SEQ ID NO: 2377642 - protein, 5 aa, Entamoeba dispar
TQERK

SEQ ID NO: 2377643 - protein, 5 aa, Entamoeba dispar
TQESD

SEQ ID NO: 2377644 - protein, 15 aa, Entamoeba dispar
TQFRRRREGKTDYYA

SEQ ID NO: 2377645 - protein, 5 aa, Entamoeba dispar
TQGIG

SEQ ID NO: 2377646 - protein, 9 aa, Entamoeba dispar
TQGNIPRGV

SEQ ID NO: 2377647 - protein, 6 aa, Entamoeba dispar
TQGPVG

SEQ ID NO: 2377648 - protein, 5 aa, Entamoeba dispar
TQIDE

SEQ ID NO: 2377649 - protein, 4 aa, Entamoeba dispar
TQIG

SEQ ID NO: 2377650 - protein, 7 aa, Entamoeba dispar
TQIGERG

SEQ ID NO: 2377651 - protein, 8 aa, Entamoeba dispar
TQIQSSSI

SEQ ID NO: 2377652 - protein, 16 aa, Entamoeba dispar
TQKEKNKFQKFNEEAE

SEQ ID NO: 2377653 - protein, 7 aa, Entamoeba dispar
TQKHTQG

SEQ ID NO: 2377654 - protein, 10 aa, Entamoeba dispar
TQKISTDTLK

SEQ ID NO: 2377655 - protein, 7 aa, Entamoeba dispar
TQKLEDA

SEQ ID NO: 2377656 - protein, 5 aa, Entamoeba dispar
TQKSN

SEQ ID NO: 2377657 - protein, 8 aa, Entamoeba dispar
TQKVRGAS

SEQ ID NO: 2377658 - protein, 4 aa, Entamoeba dispar
TQLD

SEQ ID NO: 2377659 - protein, 12 aa, Entamoeba dispar
TQLPGATREPNS

SEQ ID NO: 2377660 - protein, 9 aa, Entamoeba dispar
TQLPSDEYE

SEQ ID NO: 2377661 - protein, 11 aa, Entamoeba dispar
TQLTGSTTTTE

SEQ ID NO: 2377662 - protein, 24 aa, Entamoeba dispar
TQMKPTTKNTSGKVNFTTNDDIED

SEQ ID NO: 2377663 - protein, 6 aa, Entamoeba dispar
TQNEIE

SEQ ID NO: 2377664 - protein, 10 aa, Entamoeba dispar
TQNENEPTSE

SEQ ID NO: 2377665 - protein, 12 aa, Entamoeba dispar
TQNFSKSMTGEL

SEQ ID NO: 2377666 - protein, 7 aa, Entamoeba dispar
TQNGEWK

SEQ ID NO: 2377667 - protein, 8 aa, Entamoeba dispar
TQNMPEKI

SEQ ID NO: 2377668 - protein, 5 aa, Entamoeba dispar
TQNNP

SEQ ID NO: 2377669 - protein, 6 aa, Entamoeba dispar
TQNPKQ

SEQ ID NO: 2377670 - protein, 10 aa, Entamoeba dispar
TQNSEQNTLT

SEQ ID NO: 2377671 - protein, 12 aa, Entamoeba dispar
TQNTDNQQQPTY

SEQ ID NO: 2377672 - protein, 5 aa, Entamoeba dispar
TQNYY

SEQ ID NO: 2377673 - protein, 5 aa, Entamoeba dispar
TQPEY

SEQ ID NO: 2377674 - protein, 6 aa, Entamoeba dispar
TQPGKV

SEQ ID NO: 2377675 - protein, 5 aa, Entamoeba dispar
TQPIQ

SEQ ID NO: 2377676 - protein, 9 aa, Entamoeba dispar
TQPKQPLPK

SEQ ID NO: 2377677 - protein, 6 aa, Entamoeba dispar
TQPLDK

SEQ ID NO: 2377678 - protein, 7 aa, Entamoeba dispar
TQPLRNA

SEQ ID NO: 2377679 - protein, 6 aa, Entamoeba dispar
TQPLSS

SEQ ID NO: 2377680 - protein, 16 aa, Entamoeba dispar
TQPQKSNNNSNEADDI

SEQ ID NO: 2377681 - protein, 8 aa, Entamoeba dispar
TQPQNNYQ

SEQ ID NO: 2377682 - protein, 12 aa, Entamoeba dispar
TQQKKSPRTSLA

SEQ ID NO: 2377683 - protein, 15 aa, Entamoeba dispar
TQQNNEEVSSPTELE

SEQ ID NO: 2377684 - protein, 7 aa, Entamoeba dispar
TQQPEEK

SEQ ID NO: 2377685 - protein, 7 aa, Entamoeba dispar
TQQPSYH

SEQ ID NO: 2377686 - protein, 8 aa, Entamoeba dispar
TQQQQTYQ

SEQ ID NO: 2377687 - protein, 10 aa, Entamoeba dispar
TQQYNTTTAY

SEQ ID NO: 2377688 - protein, 5 aa, Entamoeba dispar
TQRSP

SEQ ID NO: 2377689 - protein, 4 aa, Entamoeba dispar
TQSE

SEQ ID NO: 2377690 - protein, 5 aa, Entamoeba dispar
TQSLR

SEQ ID NO: 2377691 - protein, 14 aa, Entamoeba dispar
TQSPQSVSTIGETI

SEQ ID NO: 2377692 - protein, 6 aa, Entamoeba dispar
TQSQQI

SEQ ID NO: 2377693 - protein, 10 aa, Entamoeba dispar
TQSSGSDHTS

SEQ ID NO: 2377694 - protein, 19 aa, Entamoeba dispar
TQSSLYEAEDNESQNSLFQ

SEQ ID NO: 2377695 - protein, 8 aa, Entamoeba dispar
TQSSQLTQ

SEQ ID NO: 2377696 - protein, 22 aa, Entamoeba dispar
TQSSRTTQQSTLLKSSSTLHSI

SEQ ID NO: 2377697 - protein, 4 aa, Entamoeba dispar
TQST

SEQ ID NO: 2377698 - protein, 25 aa, Entamoeba dispar
TQSTPMVQPAQQPMYAQPAPMGQPI

SEQ ID NO: 2377699 - protein, 8 aa, Entamoeba dispar
TQSVSTIR

SEQ ID NO: 2377700 - protein, 4 aa, Entamoeba dispar
TQTH

SEQ ID NO: 2377701 - protein, 5 aa, Entamoeba dispar
TQTIE

SEQ ID NO: 2377702 - protein, 9 aa, Entamoeba dispar
TQTIPESKS

SEQ ID NO: 2377703 - protein, 5 aa, Entamoeba dispar
TQTKD

SEQ ID NO: 2377704 - protein, 5 aa, Entamoeba dispar
TQTPI

SEQ ID NO: 2377705 - protein, 4 aa, Entamoeba dispar
TQTQ

SEQ ID NO: 2377706 - protein, 7 aa, Entamoeba dispar
TQTQILK

SEQ ID NO: 2377707 - protein, 12 aa, Entamoeba dispar
TQTTDNQSTTLS

SEQ ID NO: 2377708 - protein, 7 aa, Entamoeba dispar
TQTTESD

SEQ ID NO: 2377709 - protein, 10 aa, Entamoeba dispar
TQTTKESGDY

SEQ ID NO: 2377710 - protein, 6 aa, Entamoeba dispar
TQVPRE

SEQ ID NO: 2377711 - protein, 6 aa, Entamoeba dispar
TQYDEN

SEQ ID NO: 2377712 - protein, 7 aa, Entamoeba dispar
TQYEEPS

SEQ ID NO: 2377713 - protein, 4 aa, Entamoeba dispar
TQYN

SEQ ID NO: 2377714 - protein, 4 aa, Entamoeba dispar
TQYQ

SEQ ID NO: 2377715 - protein, 8 aa, Entamoeba dispar
TRAETKSE

SEQ ID NO: 2377716 - protein, 13 aa, Entamoeba dispar
TRAQGGPPTKTET

SEQ ID NO: 2377717 - protein, 17 aa, Entamoeba dispar
TRASSIQYKDTSGNIST

SEQ ID NO: 2377718 - protein, 5 aa, Entamoeba dispar
TREDP

SEQ ID NO: 2377719 - protein, 4 aa, Entamoeba dispar
TREE

SEQ ID NO: 2377720 - protein, 12 aa, Entamoeba dispar
TREGETLNEEED

SEQ ID NO: 2377721 - protein, 15 aa, Entamoeba dispar
TREGITRPNVVQSNT

SEQ ID NO: 2377722 - protein, 5 aa, Entamoeba dispar
TREME

SEQ ID NO: 2377723 - protein, 8 aa, Entamoeba dispar
TRENPKWE

SEQ ID NO: 2377724 - protein, 6 aa, Entamoeba dispar
TRENRK

SEQ ID NO: 2377725 - protein, 19 aa, Entamoeba dispar
TRERENKGKTDSQIKEPEE

SEQ ID NO: 2377726 - protein, 4 aa, Entamoeba dispar
TREV

SEQ ID NO: 2377727 - protein, 17 aa, Entamoeba dispar
TRFDRGQRLSTSSLEQT

SEQ ID NO: 2377728 - protein, 9 aa, Entamoeba dispar
TRGKDEGLT

SEQ ID NO: 2377729 - protein, 8 aa, Entamoeba dispar
TRGLSKKN

SEQ ID NO: 2377730 - protein, 6 aa, Entamoeba dispar
TRGNAE

SEQ ID NO: 2377731 - protein, 6 aa, Entamoeba dispar
TRGNEM

SEQ ID NO: 2377732 - protein, 6 aa, Entamoeba dispar
TRGSHN

SEQ ID NO: 2377733 - protein, 11 aa, Entamoeba dispar
TRGTKLSSSDK

SEQ ID NO: 2377734 - protein, 7 aa, Entamoeba dispar
TRIEESA

SEQ ID NO: 2377735 - protein, 8 aa, Entamoeba dispar
TRITPRSK

SEQ ID NO: 2377736 - protein, 23 aa, Entamoeba dispar
TRKENNETKDIPEEIENNKSNLN

SEQ ID NO: 2377737 - protein, 8 aa, Entamoeba dispar
TRKKREIL

SEQ ID NO: 2377738 - protein, 6 aa, Entamoeba dispar
TRKQQR

SEQ ID NO: 2377739 - protein, 6 aa, Entamoeba dispar
TRKSAP

SEQ ID NO: 2377740 - protein, 5 aa, Entamoeba dispar
TRKSQ

SEQ ID NO: 2377741 - protein, 13 aa, Entamoeba dispar
TRKSSEDPKKKTF

SEQ ID NO: 2377742 - protein, 18 aa, Entamoeba dispar
TRLDPDEIKEEKKIGEGS

SEQ ID NO: 2377743 - protein, 9 aa, Entamoeba dispar
TRLDRTSPA

SEQ ID NO: 2377744 - protein, 8 aa, Entamoeba dispar
TRLNGKEI

SEQ ID NO: 2377745 - protein, 7 aa, Entamoeba dispar
TRLPQKQ

SEQ ID NO: 2377746 - protein, 5 aa, Entamoeba dispar
TRLSG

SEQ ID NO: 2377747 - protein, 4 aa, Entamoeba dispar
TRNE

SEQ ID NO: 2377748 - protein, 7 aa, Entamoeba dispar
TRNKKTS

SEQ ID NO: 2377749 - protein, 17 aa, Entamoeba dispar
TRNLEQAEDLEEKTDAM

SEQ ID NO: 2377750 - protein, 10 aa, Entamoeba dispar
TRNNISSKAE

SEQ ID NO: 2377751 - protein, 5 aa, Entamoeba dispar
TRNNR

SEQ ID NO: 2377752 - protein, 5 aa, Entamoeba dispar
TRNPT

SEQ ID NO: 2377753 - protein, 4 aa, Entamoeba dispar
TRNS

SEQ ID NO: 2377754 - protein, 6 aa, Entamoeba dispar
TRPDGP

SEQ ID NO: 2377755 - protein, 9 aa, Entamoeba dispar
TRPEDRPDF

SEQ ID NO: 2377756 - protein, 8 aa, Entamoeba dispar
TRPELGPT

SEQ ID NO: 2377757 - protein, 10 aa, Entamoeba dispar
TRRELNEYPQ

SEQ ID NO: 2377758 - protein, 5 aa, Entamoeba dispar
TRRGT

SEQ ID NO: 2377759 - protein, 4 aa, Entamoeba dispar
TRRH

SEQ ID NO: 2377760 - protein, 9 aa, Entamoeba dispar
TRRNATNSL

SEQ ID NO: 2377761 - protein, 14 aa, Entamoeba dispar
TRSDQRTKTDIANL

SEQ ID NO: 2377762 - protein, 5 aa, Entamoeba dispar
TRSLE

SEQ ID NO: 2377763 - protein, 4 aa, Entamoeba dispar
TRSN

SEQ ID NO: 2377764 - protein, 14 aa, Entamoeba dispar
TRSSSLTQDSVSNT

SEQ ID NO: 2377765 - protein, 10 aa, Entamoeba dispar
TRSTHRTNTS

SEQ ID NO: 2377766 - protein, 7 aa, Entamoeba dispar
TRTDHRH

SEQ ID NO: 2377767 - protein, 13 aa, Entamoeba dispar
TRTFNKKGVTIPS

SEQ ID NO: 2377768 - protein, 6 aa, Entamoeba dispar
TRTISL

SEQ ID NO: 2377769 - protein, 11 aa, Entamoeba dispar
TRTQKNEIKDS

SEQ ID NO: 2377770 - protein, 6 aa, Entamoeba dispar
TRTQNE

SEQ ID NO: 2377771 - protein, 8 aa, Entamoeba dispar
TRTSDTTG

SEQ ID NO: 2377772 - protein, 6 aa, Entamoeba dispar
TRYEKY

SEQ ID NO: 2377773 - protein, 4 aa, Entamoeba dispar
TRYQ

SEQ ID NO: 2377774 - protein, 9 aa, Entamoeba dispar
TSALDSESE

SEQ ID NO: 2377775 - protein, 9 aa, Entamoeba dispar
TSAQEQGSV

SEQ ID NO: 2377776 - protein, 7 aa, Entamoeba dispar
TSATEGA

SEQ ID NO: 2377777 - protein, 5 aa, Entamoeba dispar
TSCNE

SEQ ID NO: 2377778 - protein, 8 aa, Entamoeba dispar
TSCPSEES

SEQ ID NO: 2377779 - protein, 8 aa, Entamoeba dispar
TSCQPGYK

SEQ ID NO: 2377780 - protein, 8 aa, Entamoeba dispar
TSCTGTPY

SEQ ID NO: 2377781 - protein, 6 aa, Entamoeba dispar
TSCTSQ

SEQ ID NO: 2377782 - protein, 10 aa, Entamoeba dispar
TSCVGSKDTF

SEQ ID NO: 2377783 - protein, 8 aa, Entamoeba dispar
TSDDPIKE

SEQ ID NO: 2377784 - protein, 6 aa, Entamoeba dispar
TSDEGM

SEQ ID NO: 2377785 - protein, 8 aa, Entamoeba dispar
TSDGNDQL

SEQ ID NO: 2377786 - protein, 18 aa, Entamoeba dispar
TSDGRFTPLKKTNKQIQP

SEQ ID NO: 2377787 - protein, 6 aa, Entamoeba dispar
TSDNKI

SEQ ID NO: 2377788 - protein, 8 aa, Entamoeba dispar
TSDPEIKE

SEQ ID NO: 2377789 - protein, 7 aa, Entamoeba dispar
TSDSSGH

SEQ ID NO: 2377790 - protein, 6 aa, Entamoeba dispar
TSDSSI

SEQ ID NO: 2377791 - protein, 9 aa, Entamoeba dispar
TSDSVGQNC

SEQ ID NO: 2377792 - protein, 5 aa, Entamoeba dispar
TSEDI

SEQ ID NO: 2377793 - protein, 12 aa, Entamoeba dispar
TSEERDVLLKQA

SEQ ID NO: 2377794 - protein, 8 aa, Entamoeba dispar
TSEGIEKQ

SEQ ID NO: 2377795 - protein, 5 aa, Entamoeba dispar
TSEHI

SEQ ID NO: 2377796 - protein, 8 aa, Entamoeba dispar
TSEKEYQA

SEQ ID NO: 2377797 - protein, 11 aa, Entamoeba dispar
TSELDRNINEA

SEQ ID NO: 2377798 - protein, 5 aa, Entamoeba dispar
TSEPD

SEQ ID NO: 2377799 - protein, 9 aa, Entamoeba dispar
TSESDSYKK

SEQ ID NO: 2377800 - protein, 9 aa, Entamoeba dispar
TSESSNPKR

SEQ ID NO: 2377801 - protein, 15 aa, Entamoeba dispar
TSFDEDIEQPSPSLS

SEQ ID NO: 2377802 - protein, 20 aa, Entamoeba dispar
TSFDNQPIQTFGDGDGTVSL

SEQ ID NO: 2377803 - protein, 7 aa, Entamoeba dispar
TSFENCT

SEQ ID NO: 2377804 - protein, 7 aa, Entamoeba dispar
TSFGKPQ

SEQ ID NO: 2377805 - protein, 4 aa, Entamoeba dispar
TSFN

SEQ ID NO: 2377806 - protein, 7 aa, Entamoeba dispar
TSFNNKS

SEQ ID NO: 2377807 - protein, 6 aa, Entamoeba dispar
TSFSTQ

SEQ ID NO: 2377808 - protein, 4 aa, Entamoeba dispar
TSGE

SEQ ID NO: 2377809 - protein, 4 aa, Entamoeba dispar
TSGF

SEQ ID NO: 2377810 - protein, 5 aa, Entamoeba dispar
TSGIA

SEQ ID NO: 2377811 - protein, 6 aa, Entamoeba dispar
TSGKRL

SEQ ID NO: 2377812 - protein, 4 aa, Entamoeba dispar
TSHD

SEQ ID NO: 2377813 - protein, 5 aa, Entamoeba dispar
TSHEQ

SEQ ID NO: 2377814 - protein, 10 aa, Entamoeba dispar
TSHGNSKSSL

SEQ ID NO: 2377815 - protein, 11 aa, Entamoeba dispar
TSHPHDSISSE

SEQ ID NO: 2377816 - protein, 8 aa, Entamoeba dispar
TSHPPTMS

SEQ ID NO: 2377817 - protein, 5 aa, Entamoeba dispar
TSHRE

SEQ ID NO: 2377818 - protein, 7 aa, Entamoeba dispar
TSIDPQP

SEQ ID NO: 2377819 - protein, 9 aa, Entamoeba dispar
TSIENDNEK

SEQ ID NO: 2377820 - protein, 7 aa, Entamoeba dispar
TSIETTI

SEQ ID NO: 2377821 - protein, 14 aa, Entamoeba dispar
TSIPEDKYKVTNEE

SEQ ID NO: 2377822 - protein, 6 aa, Entamoeba dispar
TSIPET

SEQ ID NO: 2377823 - protein, 7 aa, Entamoeba dispar
TSIPRSF

SEQ ID NO: 2377824 - protein, 6 aa, Entamoeba dispar
TSIPSI

SEQ ID NO: 2377825 - protein, 8 aa, Entamoeba dispar
TSIPSSSF

SEQ ID NO: 2377826 - protein, 4 aa, Entamoeba dispar
TSIQ

SEQ ID NO: 2377827 - protein, 28 aa, Entamoeba dispar
TSIQEQSTDKYARDVRTAEKPKTTKEKC

SEQ ID NO: 2377828 - protein, 12 aa, Entamoeba dispar
TSISQKDKKKTK

SEQ ID NO: 2377829 - protein, 15 aa, Entamoeba dispar
TSKAMNTLGAKNDYE

SEQ ID NO: 2377830 - protein, 7 aa, Entamoeba dispar
TSKDPDV

SEQ ID NO: 2377831 - protein, 7 aa, Entamoeba dispar
TSKEQND

SEQ ID NO: 2377832 - protein, 8 aa, Entamoeba dispar
TSKESLEE

SEQ ID NO: 2377833 - protein, 7 aa, Entamoeba dispar
TSKGERK

SEQ ID NO: 2377834 - protein, 9 aa, Entamoeba dispar
TSKGLSETT

SEQ ID NO: 2377835 - protein, 4 aa, Entamoeba dispar
TSKI

SEQ ID NO: 2377836 - protein, 4 aa, Entamoeba dispar
TSKK

SEQ ID NO: 2377837 - protein, 8 aa, Entamoeba dispar
TSKKLDDK

SEQ ID NO: 2377838 - protein, 5 aa, Entamoeba dispar
TSKMQ

SEQ ID NO: 2377839 - protein, 5 aa, Entamoeba dispar
TSKNH

SEQ ID NO: 2377840 - protein, 4 aa, Entamoeba dispar
TSKQ

SEQ ID NO: 2377841 - protein, 9 aa, Entamoeba dispar
TSKSTPDYS

SEQ ID NO: 2377842 - protein, 5 aa, Entamoeba dispar
TSKSY

SEQ ID NO: 2377843 - protein, 5 aa, Entamoeba dispar
TSKTG

SEQ ID NO: 2377844 - protein, 9 aa, Entamoeba dispar
TSKTPAPYS

SEQ ID NO: 2377845 - protein, 6 aa, Entamoeba dispar
TSKTTG

SEQ ID NO: 2377846 - protein, 21 aa, Entamoeba dispar
TSKVSTSFSQPSSSSLSKSPA

SEQ ID NO: 2377847 - protein, 10 aa, Entamoeba dispar
TSKYYESKLP

SEQ ID NO: 2377848 - protein, 33 aa, Entamoeba dispar
TSLATNQQGLNNTDKKNEEGNPSLYSETTVETS

SEQ ID NO: 2377849 - protein, 5 aa, Entamoeba dispar
TSLDG

SEQ ID NO: 2377850 - protein, 7 aa, Entamoeba dispar
TSLESDL

SEQ ID NO: 2377851 - protein, 10 aa, Entamoeba dispar
TSLETNYGKN

SEQ ID NO: 2377852 - protein, 21 aa, Entamoeba dispar
TSLKRKDDKVEGSENNEVAPT

SEQ ID NO: 2377853 - protein, 12 aa, Entamoeba dispar
TSLNDNNSLEKA

SEQ ID NO: 2377854 - protein, 17 aa, Entamoeba dispar
TSLPPSSPVKEVKIVVE

SEQ ID NO: 2377855 - protein, 6 aa, Entamoeba dispar
TSLRTS

SEQ ID NO: 2377856 - protein, 9 aa, Entamoeba dispar
TSLSDKRIK

SEQ ID NO: 2377857 - protein, 8 aa, Entamoeba dispar
TSLSNSTF

SEQ ID NO: 2377858 - protein, 12 aa, Entamoeba dispar
TSLSPCSRQLQP

SEQ ID NO: 2377859 - protein, 8 aa, Entamoeba dispar
TSLSPSGL

SEQ ID NO: 2377860 - protein, 18 aa, Entamoeba dispar
TSLSSNITSSNQAIGNET

SEQ ID NO: 2377861 - protein, 4 aa, Entamoeba dispar
TSLT

SEQ ID NO: 2377862 - protein, 7 aa, Entamoeba dispar
TSLTKEI

SEQ ID NO: 2377863 - protein, 7 aa, Entamoeba dispar
TSLTQKQ

SEQ ID NO: 2377864 - protein, 4 aa, Entamoeba dispar
TSLV

SEQ ID NO: 2377865 - protein, 8 aa, Entamoeba dispar
TSMDDKSH

SEQ ID NO: 2377866 - protein, 4 aa, Entamoeba dispar
TSME

SEQ ID NO: 2377867 - protein, 9 aa, Entamoeba dispar
TSNCTTVSI

SEQ ID NO: 2377868 - protein, 8 aa, Entamoeba dispar
TSNENNTY

SEQ ID NO: 2377869 - protein, 4 aa, Entamoeba dispar
TSNG

SEQ ID NO: 2377870 - protein, 8 aa, Entamoeba dispar
TSNKEFNK

SEQ ID NO: 2377871 - protein, 10 aa, Entamoeba dispar
TSNKEGKHAD

SEQ ID NO: 2377872 - protein, 6 aa, Entamoeba dispar
TSNKTT

SEQ ID NO: 2377873 - protein, 6 aa, Entamoeba dispar
TSNNTE

SEQ ID NO: 2377874 - protein, 7 aa, Entamoeba dispar
TSNPTVS

SEQ ID NO: 2377875 - protein, 9 aa, Entamoeba dispar
TSNSKCSKC

SEQ ID NO: 2377876 - protein, 10 aa, Entamoeba dispar
TSNTDTLTGA

SEQ ID NO: 2377877 - protein, 6 aa, Entamoeba dispar
TSNTNE

SEQ ID NO: 2377878 - protein, 8 aa, Entamoeba dispar
TSNTTTPA

SEQ ID NO: 2377879 - protein, 9 aa, Entamoeba dispar
TSNVPQNDI

SEQ ID NO: 2377880 - protein, 6 aa, Entamoeba dispar
TSNVTG

SEQ ID NO: 2377881 - protein, 6 aa, Entamoeba dispar
TSPASL

SEQ ID NO: 2377882 - protein, 8 aa, Entamoeba dispar
TSPATFST

SEQ ID NO: 2377883 - protein, 4 aa, Entamoeba dispar
TSPG

SEQ ID NO: 2377884 - protein, 5 aa, Entamoeba dispar
TSPGI

SEQ ID NO: 2377885 - protein, 8 aa, Entamoeba dispar
TSPGNETY

SEQ ID NO: 2377886 - protein, 10 aa, Entamoeba dispar
TSPGTTPNGW

SEQ ID NO: 2377887 - protein, 7 aa, Entamoeba dispar
TSPIGNN

SEQ ID NO: 2377888 - protein, 19 aa, Entamoeba dispar
TSPIPSCDDTVEDSSTDTL

SEQ ID NO: 2377889 - protein, 8 aa, Entamoeba dispar
TSPISYTE

SEQ ID NO: 2377890 - protein, 7 aa, Entamoeba dispar
TSPKNIQ

SEQ ID NO: 2377891 - protein, 8 aa, Entamoeba dispar
TSPKTENN

SEQ ID NO: 2377892 - protein, 8 aa, Entamoeba dispar
TSPKVSKE

SEQ ID NO: 2377893 - protein, 5 aa, Entamoeba dispar
TSPNM

SEQ ID NO: 2377894 - protein, 9 aa, Entamoeba dispar
TSPSTNVRE

SEQ ID NO: 2377895 - protein, 6 aa, Entamoeba dispar
TSPTEE

SEQ ID NO: 2377896 - protein, 4 aa, Entamoeba dispar
TSPY

SEQ ID NO: 2377897 - protein, 9 aa, Entamoeba dispar
TSPYNSDLF

SEQ ID NO: 2377898 - protein, 14 aa, Entamoeba dispar
TSQAFSGFSDSGTM

SEQ ID NO: 2377899 - protein, 5 aa, Entamoeba dispar
TSQGG

SEQ ID NO: 2377900 - protein, 6 aa, Entamoeba dispar
TSQHTQ

SEQ ID NO: 2377901 - protein, 16 aa, Entamoeba dispar
TSQINTLSSSEYSPRQ

SEQ ID NO: 2377902 - protein, 6 aa, Entamoeba dispar
TSQKQW

SEQ ID NO: 2377903 - protein, 10 aa, Entamoeba dispar
TSQLDGETTL

SEQ ID NO: 2377904 - protein, 5 aa, Entamoeba dispar
TSQLG

SEQ ID NO: 2377905 - protein, 10 aa, Entamoeba dispar
TSQPNEGTAA

SEQ ID NO: 2377906 - protein, 25 aa, Entamoeba dispar
TSQRAEYYSNSQAPNYNPPAAQNFS

SEQ ID NO: 2377907 - protein, 7 aa, Entamoeba dispar
TSQRPKN

SEQ ID NO: 2377908 - protein, 8 aa, Entamoeba dispar
TSQTDTTF

SEQ ID NO: 2377909 - protein, 8 aa, Entamoeba dispar
TSQTQNDI

SEQ ID NO: 2377910 - protein, 5 aa, Entamoeba dispar
TSRGF

SEQ ID NO: 2377911 - protein, 8 aa, Entamoeba dispar
TSRNTPRI

SEQ ID NO: 2377912 - protein, 17 aa, Entamoeba dispar
TSRTSQTHCGGDSQKKG

SEQ ID NO: 2377913 - protein, 7 aa, Entamoeba dispar
TSSEDCE

SEQ ID NO: 2377914 - protein, 9 aa, Entamoeba dispar
TSSEHKKYL

SEQ ID NO: 2377915 - protein, 4 aa, Entamoeba dispar
TSSF

SEQ ID NO: 2377916 - protein, 4 aa, Entamoeba dispar
TSSG

SEQ ID NO: 2377917 - protein, 6 aa, Entamoeba dispar
TSSGCS

SEQ ID NO: 2377918 - protein, 21 aa, Entamoeba dispar
TSSKSEDEREEKTTSQNDYEL

SEQ ID NO: 2377919 - protein, 17 aa, Entamoeba dispar
TSSLNFNNKSNINNSNY

SEQ ID NO: 2377920 - protein, 12 aa, Entamoeba dispar
TSSLPTDKNPQC

SEQ ID NO: 2377921 - protein, 8 aa, Entamoeba dispar
TSSLTNST

SEQ ID NO: 2377922 - protein, 7 aa, Entamoeba dispar
TSSNQAS

SEQ ID NO: 2377923 - protein, 9 aa, Entamoeba dispar
TSSNQEELT

SEQ ID NO: 2377924 - protein, 9 aa, Entamoeba dispar
TSSQERSAS

SEQ ID NO: 2377925 - protein, 8 aa, Entamoeba dispar
TSSRDSHK

SEQ ID NO: 2377926 - protein, 6 aa, Entamoeba dispar
TSSRKR

SEQ ID NO: 2377927 - protein, 6 aa, Entamoeba dispar
TSSSFS

SEQ ID NO: 2377928 - protein, 7 aa, Entamoeba dispar
TSSSIPD

SEQ ID NO: 2377929 - protein, 5 aa, Entamoeba dispar
TSSSM

SEQ ID NO: 2377930 - protein, 5 aa, Entamoeba dispar
TSSTE

SEQ ID NO: 2377931 - protein, 5 aa, Entamoeba dispar
TSSTK

SEQ ID NO: 2377932 - protein, 10 aa, Entamoeba dispar
TSSTPAQTRV

SEQ ID NO: 2377933 - protein, 6 aa, Entamoeba dispar
TSTDTN

SEQ ID NO: 2377934 - protein, 8 aa, Entamoeba dispar
TSTEDSSL

SEQ ID NO: 2377935 - protein, 6 aa, Entamoeba dispar
TSTENL

SEQ ID NO: 2377936 - protein, 8 aa, Entamoeba dispar
TSTEVPEN

SEQ ID NO: 2377937 - protein, 8 aa, Entamoeba dispar
TSTGGTKH

SEQ ID NO: 2377938 - protein, 4 aa, Entamoeba dispar
TSTH

SEQ ID NO: 2377939 - protein, 13 aa, Entamoeba dispar
TSTIDESTKYSIE

SEQ ID NO: 2377940 - protein, 6 aa, Entamoeba dispar
TSTIPE

SEQ ID NO: 2377941 - protein, 8 aa, Entamoeba dispar
TSTITNKE

SEQ ID NO: 2377942 - protein, 21 aa, Entamoeba dispar
TSTKEDDVDSVSTQWESSDES

SEQ ID NO: 2377943 - protein, 7 aa, Entamoeba dispar
TSTKIQR

SEQ ID NO: 2377944 - protein, 8 aa, Entamoeba dispar
TSTKPENQ

SEQ ID NO: 2377945 - protein, 9 aa, Entamoeba dispar
TSTKVEREA

SEQ ID NO: 2377946 - protein, 6 aa, Entamoeba dispar
TSTNID

SEQ ID NO: 2377947 - protein, 7 aa, Entamoeba dispar
TSTNPKI

SEQ ID NO: 2377948 - protein, 36 aa, Entamoeba dispar
TSTNQLESEDLPTKEKKTEELNNISDQPKDKSTNNE

SEQ ID NO: 2377949 - protein, 10 aa, Entamoeba dispar
TSTPPKRSEE

SEQ ID NO: 2377950 - protein, 8 aa, Entamoeba dispar
TSTPSPVT

SEQ ID NO: 2377951 - protein, 7 aa, Entamoeba dispar
TSTQYSI

SEQ ID NO: 2377952 - protein, 9 aa, Entamoeba dispar
TSTSGNSAW

SEQ ID NO: 2377953 - protein, 5 aa, Entamoeba dispar
TSTSI

SEQ ID NO: 2377954 - protein, 6 aa, Entamoeba dispar
TSTSLI

SEQ ID NO: 2377955 - protein, 4 aa, Entamoeba dispar
TSTY

SEQ ID NO: 2377956 - protein, 7 aa, Entamoeba dispar
TSVNPEF

SEQ ID NO: 2377957 - protein, 9 aa, Entamoeba dispar
TSVPPNPQF

SEQ ID NO: 2377958 - protein, 7 aa, Entamoeba dispar
TSVSDPM

SEQ ID NO: 2377959 - protein, 6 aa, Entamoeba dispar
TSVSPK

SEQ ID NO: 2377960 - protein, 5 aa, Entamoeba dispar
TSVST

SEQ ID NO: 2377961 - protein, 5 aa, Entamoeba dispar
TSVTI

SEQ ID NO: 2377962 - protein, 12 aa, Entamoeba dispar
TSYDESAINQST

SEQ ID NO: 2377963 - protein, 17 aa, Entamoeba dispar
TSYGENGIETSNYPNQI

SEQ ID NO: 2377964 - protein, 8 aa, Entamoeba dispar
TSYPASQM

SEQ ID NO: 2377965 - protein, 6 aa, Entamoeba dispar
TSYPTQ

SEQ ID NO: 2377966 - protein, 8 aa, Entamoeba dispar
TSYYKGNI

SEQ ID NO: 2377967 - protein, 8 aa, Entamoeba dispar
TSYYPEGS

SEQ ID NO: 2377968 - protein, 10 aa, Entamoeba dispar
TTAPAGEQEM

SEQ ID NO: 2377969 - protein, 6 aa, Entamoeba dispar
TTAPQT

SEQ ID NO: 2377970 - protein, 18 aa, Entamoeba dispar
TTARTSETKCGGVKPRKG

SEQ ID NO: 2377971 - protein, 5 aa, Entamoeba dispar
TTASQ

SEQ ID NO: 2377972 - protein, 14 aa, Entamoeba dispar
TTASSLNKPNETKE

SEQ ID NO: 2377973 - protein, 19 aa, Entamoeba dispar
TTCGKEQSSETIKNYNKEP

SEQ ID NO: 2377974 - protein, 4 aa, Entamoeba dispar
TTDE

SEQ ID NO: 2377975 - protein, 6 aa, Entamoeba dispar
TTDNSN

SEQ ID NO: 2377976 - protein, 6 aa, Entamoeba dispar
TTDPLN

SEQ ID NO: 2377977 - protein, 4 aa, Entamoeba dispar
TTDS

SEQ ID NO: 2377978 - protein, 23 aa, Entamoeba dispar
TTDSLTSDNSKSQKKIVGKGTTV

SEQ ID NO: 2377979 - protein, 32 aa, Entamoeba dispar
TTDSLTSDNSKSQKKIVGKGTTVIKPQSKDVT

SEQ ID NO: 2377980 - protein, 5 aa, Entamoeba dispar
TTDTT

SEQ ID NO: 2377981 - protein, 7 aa, Entamoeba dispar
TTDYSKT

SEQ ID NO: 2377982 - protein, 7 aa, Entamoeba dispar
TTEEEKL

SEQ ID NO: 2377983 - protein, 20 aa, Entamoeba dispar
TTEEIKKEESSDDSEEFKPF

SEQ ID NO: 2377984 - protein, 7 aa, Entamoeba dispar
TTEEIPK

SEQ ID NO: 2377985 - protein, 15 aa, Entamoeba dispar
TTEEPTGDINSKKIE

SEQ ID NO: 2377986 - protein, 8 aa, Entamoeba dispar
TTEGEEGV

SEQ ID NO: 2377987 - protein, 4 aa, Entamoeba dispar
TTEN

SEQ ID NO: 2377988 - protein, 13 aa, Entamoeba dispar
TTENELEKVSSNF

SEQ ID NO: 2377989 - protein, 5 aa, Entamoeba dispar
TTENG

SEQ ID NO: 2377990 - protein, 4 aa, Entamoeba dispar
TTEQ

SEQ ID NO: 2377991 - protein, 9 aa, Entamoeba dispar
TTEQQKHGK

SEQ ID NO: 2377992 - protein, 6 aa, Entamoeba dispar
TTERNN

SEQ ID NO: 2377993 - protein, 4 aa, Entamoeba dispar
TTES

SEQ ID NO: 2377994 - protein, 10 aa, Entamoeba dispar
TTESKKDGLI

SEQ ID NO: 2377995 - protein, 12 aa, Entamoeba dispar
TTESYKGEENKK

SEQ ID NO: 2377996 - protein, 9 aa, Entamoeba dispar
TTETDSTQK

SEQ ID NO: 2377997 - protein, 13 aa, Entamoeba dispar
TTETTNVAEGETT

SEQ ID NO: 2377998 - protein, 12 aa, Entamoeba dispar
TTEVDDQQDAVV

SEQ ID NO: 2377999 - protein, 17 aa, Entamoeba dispar
TTEVGEECEDGDGCKTD

SEQ ID NO: 2378000 - protein, 7 aa, Entamoeba dispar
TTEVQKR

SEQ ID NO: 2378001 - protein, 11 aa, Entamoeba dispar
TTFDPSNLTPG

SEQ ID NO: 2378002 - protein, 9 aa, Entamoeba dispar
TTFKTTQRI

SEQ ID NO: 2378003 - protein, 5 aa, Entamoeba dispar
TTFTS

SEQ ID NO: 2378004 - protein, 16 aa, Entamoeba dispar
TTGAIPSNRTDSSVED

SEQ ID NO: 2378005 - protein, 6 aa, Entamoeba dispar
TTGDGY

SEQ ID NO: 2378006 - protein, 8 aa, Entamoeba dispar
TTGELTIP

SEQ ID NO: 2378007 - protein, 4 aa, Entamoeba dispar
TTGI

SEQ ID NO: 2378008 - protein, 6 aa, Entamoeba dispar
TTGIST

SEQ ID NO: 2378009 - protein, 5 aa, Entamoeba dispar
TTGKN

SEQ ID NO: 2378010 - protein, 6 aa, Entamoeba dispar
TTGMTK

SEQ ID NO: 2378011 - protein, 7 aa, Entamoeba dispar
TTGNTDY

SEQ ID NO: 2378012 - protein, 9 aa, Entamoeba dispar
TTGPTTNLT

SEQ ID NO: 2378013 - protein, 7 aa, Entamoeba dispar
TTGQETI

SEQ ID NO: 2378014 - protein, 4 aa, Entamoeba dispar
TTIE

SEQ ID NO: 2378015 - protein, 6 aa, Entamoeba dispar
TTIEDP

SEQ ID NO: 2378016 - protein, 4 aa, Entamoeba dispar
TTIH

SEQ ID NO: 2378017 - protein, 9 aa, Entamoeba dispar
TTINNAKTN

SEQ ID NO: 2378018 - protein, 4 aa, Entamoeba dispar
TTKE

SEQ ID NO: 2378019 - protein, 26 aa, Entamoeba dispar
TTKEKSIKAGASISLSSTLSKDQNIE

SEQ ID NO: 2378020 - protein, 14 aa, Entamoeba dispar
TTKFDKRINSSGIR

SEQ ID NO: 2378021 - protein, 24 aa, Entamoeba dispar
TTKHHTNDQLNNTIEDAADAEGIT

SEQ ID NO: 2378022 - protein, 6 aa, Entamoeba dispar
TTKPTV

SEQ ID NO: 2378023 - protein, 4 aa, Entamoeba dispar
TTKS

SEQ ID NO: 2378024 - protein, 5 aa, Entamoeba dispar
TTKSF

SEQ ID NO: 2378025 - protein, 7 aa, Entamoeba dispar
TTKTNID

SEQ ID NO: 2378026 - protein, 12 aa, Entamoeba dispar
TTKTSISTDSSL

SEQ ID NO: 2378027 - protein, 5 aa, Entamoeba dispar
TTKVD

SEQ ID NO: 2378028 - protein, 9 aa, Entamoeba dispar
TTLKESNDK

SEQ ID NO: 2378029 - protein, 11 aa, Entamoeba dispar
TTLSIKDENGI

SEQ ID NO: 2378030 - protein, 5 aa, Entamoeba dispar
TTLST

SEQ ID NO: 2378031 - protein, 9 aa, Entamoeba dispar
TTLSTNNTT

SEQ ID NO: 2378032 - protein, 4 aa, Entamoeba dispar
TTLT

SEQ ID NO: 2378033 - protein, 14 aa, Entamoeba dispar
TTLTSPSTDKNIST

SEQ ID NO: 2378034 - protein, 6 aa, Entamoeba dispar
TTMPEK

SEQ ID NO: 2378035 - protein, 12 aa, Entamoeba dispar
TTNIPRAQGGRL

SEQ ID NO: 2378036 - protein, 6 aa, Entamoeba dispar
TTNKSQ

SEQ ID NO: 2378037 - protein, 4 aa, Entamoeba dispar
TTNN

SEQ ID NO: 2378038 - protein, 9 aa, Entamoeba dispar
TTNQIKKTG

SEQ ID NO: 2378039 - protein, 4 aa, Entamoeba dispar
TTNS

SEQ ID NO: 2378040 - protein, 5 aa, Entamoeba dispar
TTNSI

SEQ ID NO: 2378041 - protein, 9 aa, Entamoeba dispar
TTNSPNDLT

SEQ ID NO: 2378042 - protein, 4 aa, Entamoeba dispar
TTNT

SEQ ID NO: 2378043 - protein, 17 aa, Entamoeba dispar
TTPCRSDNFDDPKTGER

SEQ ID NO: 2378044 - protein, 8 aa, Entamoeba dispar
TTPDTKEI

SEQ ID NO: 2378045 - protein, 4 aa, Entamoeba dispar
TTPE

SEQ ID NO: 2378046 - protein, 7 aa, Entamoeba dispar
TTPGNSV

SEQ ID NO: 2378047 - protein, 7 aa, Entamoeba dispar
TTPKEYA

SEQ ID NO: 2378048 - protein, 17 aa, Entamoeba dispar
TTPKTPKSSLAKSSRRS

SEQ ID NO: 2378049 - protein, 9 aa, Entamoeba dispar
TTPNNQRRK

SEQ ID NO: 2378050 - protein, 9 aa, Entamoeba dispar
TTPNQHTNC

SEQ ID NO: 2378051 - protein, 4 aa, Entamoeba dispar
TTPP

SEQ ID NO: 2378052 - protein, 7 aa, Entamoeba dispar
TTPPHQA

SEQ ID NO: 2378053 - protein, 5 aa, Entamoeba dispar
TTPPT

SEQ ID NO: 2378054 - protein, 8 aa, Entamoeba dispar
TTPRGRSC

SEQ ID NO: 2378055 - protein, 5 aa, Entamoeba dispar
TTPRI

SEQ ID NO: 2378056 - protein, 5 aa, Entamoeba dispar
TTPSI

SEQ ID NO: 2378057 - protein, 7 aa, Entamoeba dispar
TTPSLNQ

SEQ ID NO: 2378058 - protein, 14 aa, Entamoeba dispar
TTQDGNEKYNIRTE

SEQ ID NO: 2378059 - protein, 21 aa, Entamoeba dispar
TTQEERTAENNQVIEKGSRHP

SEQ ID NO: 2378060 - protein, 6 aa, Entamoeba dispar
TTQGDG

SEQ ID NO: 2378061 - protein, 13 aa, Entamoeba dispar
TTQITTNREPSEV

SEQ ID NO: 2378062 - protein, 15 aa, Entamoeba dispar
TTQNFQSGINKSDGY

SEQ ID NO: 2378063 - protein, 8 aa, Entamoeba dispar
TTQPPPDI

SEQ ID NO: 2378064 - protein, 6 aa, Entamoeba dispar
TTQSNT

SEQ ID NO: 2378065 - protein, 9 aa, Entamoeba dispar
TTRDQWDNT

SEQ ID NO: 2378066 - protein, 9 aa, Entamoeba dispar
TTRKRQNTI

SEQ ID NO: 2378067 - protein, 6 aa, Entamoeba dispar
TTRNNK

SEQ ID NO: 2378068 - protein, 6 aa, Entamoeba dispar
TTRSWN

SEQ ID NO: 2378069 - protein, 12 aa, Entamoeba dispar
TTRYTKDCTGCQ

SEQ ID NO: 2378070 - protein, 24 aa, Entamoeba dispar
TTSAPSSDTQQQNVTQLTEAQSTN

SEQ ID NO: 2378071 - protein, 5 aa, Entamoeba dispar
TTSDT

SEQ ID NO: 2378072 - protein, 8 aa, Entamoeba dispar
TTSFEEGL

SEQ ID NO: 2378073 - protein, 8 aa, Entamoeba dispar
TTSGKPTD

SEQ ID NO: 2378074 - protein, 7 aa, Entamoeba dispar
TTSIDKS

SEQ ID NO: 2378075 - protein, 6 aa, Entamoeba dispar
TTSIGR

SEQ ID NO: 2378076 - protein, 6 aa, Entamoeba dispar
TTSITH

SEQ ID NO: 2378077 - protein, 7 aa, Entamoeba dispar
TTSLPKR

SEQ ID NO: 2378078 - protein, 25 aa, Entamoeba dispar
TTSNENSFKKSQKTCVGSGGKNDTF

SEQ ID NO: 2378079 - protein, 6 aa, Entamoeba dispar
TTSPVS

SEQ ID NO: 2378080 - protein, 9 aa, Entamoeba dispar
TTSQNLQEL

SEQ ID NO: 2378081 - protein, 8 aa, Entamoeba dispar
TTSSESNK

SEQ ID NO: 2378082 - protein, 6 aa, Entamoeba dispar
TTSTPS

SEQ ID NO: 2378083 - protein, 7 aa, Entamoeba dispar
TTSTTVT

SEQ ID NO: 2378084 - protein, 14 aa, Entamoeba dispar
TTSVPQKTPDITQS

SEQ ID NO: 2378085 - protein, 4 aa, Entamoeba dispar
TTTA

SEQ ID NO: 2378086 - protein, 7 aa, Entamoeba dispar
TTTATNG

SEQ ID NO: 2378087 - protein, 4 aa, Entamoeba dispar
TTTD

SEQ ID NO: 2378088 - protein, 6 aa, Entamoeba dispar
TTTEEM

SEQ ID NO: 2378089 - protein, 4 aa, Entamoeba dispar
TTTF

SEQ ID NO: 2378090 - protein, 4 aa, Entamoeba dispar
TTTI

SEQ ID NO: 2378091 - protein, 4 aa, Entamoeba dispar
TTTM

SEQ ID NO: 2378092 - protein, 5 aa, Entamoeba dispar
TTTQN

SEQ ID NO: 2378093 - protein, 5 aa, Entamoeba dispar
TTTST

SEQ ID NO: 2378094 - protein, 10 aa, Entamoeba dispar
TTTSVNSKQE

SEQ ID NO: 2378095 - protein, 4 aa, Entamoeba dispar
TTVD

SEQ ID NO: 2378096 - protein, 4 aa, Entamoeba dispar
TTVE

SEQ ID NO: 2378097 - protein, 10 aa, Entamoeba dispar
TTVEQNRLKA

SEQ ID NO: 2378098 - protein, 7 aa, Entamoeba dispar
TTVLSQS

SEQ ID NO: 2378099 - protein, 4 aa, Entamoeba dispar
TTVT

SEQ ID NO: 2378100 - protein, 4 aa, Entamoeba dispar
TTYE

SEQ ID NO: 2378101 - protein, 19 aa, Entamoeba dispar
TTYSPTNVQKRRKSMGPTQ

SEQ ID NO: 2378102 - protein, 15 aa, Entamoeba dispar
TTYTQTSPTAFINEI

SEQ ID NO: 2378103 - protein, 4 aa, Entamoeba dispar
TTYY

SEQ ID NO: 2378104 - protein, 10 aa, Entamoeba dispar
TVADVEKTAQ

SEQ ID NO: 2378105 - protein, 6 aa, Entamoeba dispar
TVASEN

SEQ ID NO: 2378106 - protein, 9 aa, Entamoeba dispar
TVDDKKQKS

SEQ ID NO: 2378107 - protein, 6 aa, Entamoeba dispar
TVDESK

SEQ ID NO: 2378108 - protein, 7 aa, Entamoeba dispar
TVDGSKK

SEQ ID NO: 2378109 - protein, 8 aa, Entamoeba dispar
TVDMDDKY

SEQ ID NO: 2378110 - protein, 5 aa, Entamoeba dispar
TVEGE

SEQ ID NO: 2378111 - protein, 6 aa, Entamoeba dispar
TVEGTA

SEQ ID NO: 2378112 - protein, 5 aa, Entamoeba dispar
TVGAD

SEQ ID NO: 2378113 - protein, 9 aa, Entamoeba dispar
TVHTATPRW

SEQ ID NO: 2378114 - protein, 4 aa, Entamoeba dispar
TVKD

SEQ ID NO: 2378115 - protein, 12 aa, Entamoeba dispar
TVKIPENPCTSN

SEQ ID NO: 2378116 - protein, 13 aa, Entamoeba dispar
TVKKQNYECNPNT

SEQ ID NO: 2378117 - protein, 4 aa, Entamoeba dispar
TVKN

SEQ ID NO: 2378118 - protein, 11 aa, Entamoeba dispar
TVKRTAKQAAY

SEQ ID NO: 2378119 - protein, 11 aa, Entamoeba dispar
TVKTALGNSNL

SEQ ID NO: 2378120 - protein, 6 aa, Entamoeba dispar
TVLPQT

SEQ ID NO: 2378121 - protein, 5 aa, Entamoeba dispar
TVLQS

SEQ ID NO: 2378122 - protein, 10 aa, Entamoeba dispar
TVNKNESSCL

SEQ ID NO: 2378123 - protein, 5 aa, Entamoeba dispar
TVNYE

SEQ ID NO: 2378124 - protein, 8 aa, Entamoeba dispar
TVPDSSSF

SEQ ID NO: 2378125 - protein, 5 aa, Entamoeba dispar
TVPGI

SEQ ID NO: 2378126 - protein, 5 aa, Entamoeba dispar
TVPSA

SEQ ID NO: 2378127 - protein, 9 aa, Entamoeba dispar
TVPSNYDYP

SEQ ID NO: 2378128 - protein, 12 aa, Entamoeba dispar
TVPSSSLPGSTE

SEQ ID NO: 2378129 - protein, 6 aa, Entamoeba dispar
TVQGNI

SEQ ID NO: 2378130 - protein, 10 aa, Entamoeba dispar
TVQPNCETCD

SEQ ID NO: 2378131 - protein, 5 aa, Entamoeba dispar
TVQTP

SEQ ID NO: 2378132 - protein, 6 aa, Entamoeba dispar
TVRPGD

SEQ ID NO: 2378133 - protein, 79 aa, Entamoeba dispar
TVSDAAKKYEQNSIQAMEDAKRTREEERKKQREEQTKREKELKEKKKAEPNEQKQINDLPKKTDQKEEMSQTKKEDKKM

SEQ ID NO: 2378134 - protein, 11 aa, Entamoeba dispar
TVSDSRNSENY

SEQ ID NO: 2378135 - protein, 10 aa, Entamoeba dispar
TVSEQSFTSN

SEQ ID NO: 2378136 - protein, 9 aa, Entamoeba dispar
TVSGYADEI

SEQ ID NO: 2378137 - protein, 9 aa, Entamoeba dispar
TVSKDTELS

SEQ ID NO: 2378138 - protein, 18 aa, Entamoeba dispar
TVSKENNDKNKPNADEDI

SEQ ID NO: 2378139 - protein, 6 aa, Entamoeba dispar
TVSNLD

SEQ ID NO: 2378140 - protein, 6 aa, Entamoeba dispar
TVSPIT

SEQ ID NO: 2378141 - protein, 8 aa, Entamoeba dispar
TVSPNSNG

SEQ ID NO: 2378142 - protein, 9 aa, Entamoeba dispar
TVSSDTKVD

SEQ ID NO: 2378143 - protein, 23 aa, Entamoeba dispar
TVSSKKKNNNKKEEQKQETTPQD

SEQ ID NO: 2378144 - protein, 8 aa, Entamoeba dispar
TVTDGNGT

SEQ ID NO: 2378145 - protein, 10 aa, Entamoeba dispar
TVTEQNSSDI

SEQ ID NO: 2378146 - protein, 8 aa, Entamoeba dispar
TVTPSTQT

SEQ ID NO: 2378147 - protein, 10 aa, Entamoeba dispar
TVTSGSSSNL

SEQ ID NO: 2378148 - protein, 10 aa, Entamoeba dispar
TVTSNGKTTV

SEQ ID NO: 2378149 - protein, 5 aa, Entamoeba dispar
TVTSS

SEQ ID NO: 2378150 - protein, 12 aa, Entamoeba dispar
TVTTGSESLETG

SEQ ID NO: 2378151 - protein, 8 aa, Entamoeba dispar
TWKNQQPP

SEQ ID NO: 2378152 - protein, 5 aa, Entamoeba dispar
TWNDQ

SEQ ID NO: 2378153 - protein, 4 aa, Entamoeba dispar
TWNS

SEQ ID NO: 2378154 - protein, 13 aa, Entamoeba dispar
TWQPKGNNGDGQC

SEQ ID NO: 2378155 - protein, 9 aa, Entamoeba dispar
TWRENKGLT

SEQ ID NO: 2378156 - protein, 9 aa, Entamoeba dispar
TWSSEGADE

SEQ ID NO: 2378157 - protein, 5 aa, Entamoeba dispar
TYASQ

SEQ ID NO: 2378158 - protein, 9 aa, Entamoeba dispar
TYATKTEAY

SEQ ID NO: 2378159 - protein, 5 aa, Entamoeba dispar
TYDGK

SEQ ID NO: 2378160 - protein, 4 aa, Entamoeba dispar
TYEG

SEQ ID NO: 2378161 - protein, 6 aa, Entamoeba dispar
TYGDAS

SEQ ID NO: 2378162 - protein, 10 aa, Entamoeba dispar
TYGGTKPKEP

SEQ ID NO: 2378163 - protein, 8 aa, Entamoeba dispar
TYGGTPNV

SEQ ID NO: 2378164 - protein, 9 aa, Entamoeba dispar
TYGHPHPNA

SEQ ID NO: 2378165 - protein, 6 aa, Entamoeba dispar
TYGKEE

SEQ ID NO: 2378166 - protein, 13 aa, Entamoeba dispar
TYKKQTIKSPRQI

SEQ ID NO: 2378167 - protein, 5 aa, Entamoeba dispar
TYKSG

SEQ ID NO: 2378168 - protein, 8 aa, Entamoeba dispar
TYKSNKID

SEQ ID NO: 2378169 - protein, 14 aa, Entamoeba dispar
TYKSYEEEKALRKT

SEQ ID NO: 2378170 - protein, 10 aa, Entamoeba dispar
TYLNETTQSA

SEQ ID NO: 2378171 - protein, 8 aa, Entamoeba dispar
TYNDNSDL

SEQ ID NO: 2378172 - protein, 9 aa, Entamoeba dispar
TYNDPGKYL

SEQ ID NO: 2378173 - protein, 12 aa, Entamoeba dispar
TYNDTKQQKSVP

SEQ ID NO: 2378174 - protein, 4 aa, Entamoeba dispar
TYNP

SEQ ID NO: 2378175 - protein, 5 aa, Entamoeba dispar
TYNSG

SEQ ID NO: 2378176 - protein, 4 aa, Entamoeba dispar
TYPK

SEQ ID NO: 2378177 - protein, 17 aa, Entamoeba dispar
TYPNNKCDESERSEEQQ

SEQ ID NO: 2378178 - protein, 11 aa, Entamoeba dispar
TYQEQEGGQEC

SEQ ID NO: 2378179 - protein, 9 aa, Entamoeba dispar
TYQPPIGEG

SEQ ID NO: 2378180 - protein, 15 aa, Entamoeba dispar
TYQYTGESCGKENFK

SEQ ID NO: 2378181 - protein, 7 aa, Entamoeba dispar
TYRDEKI

SEQ ID NO: 2378182 - protein, 6 aa, Entamoeba dispar
TYRGQD

SEQ ID NO: 2378183 - protein, 4 aa, Entamoeba dispar
TYRL

SEQ ID NO: 2378184 - protein, 15 aa, Entamoeba dispar
TYSETSNCEGDNPIT

SEQ ID NO: 2378185 - protein, 5 aa, Entamoeba dispar
TYSGE

SEQ ID NO: 2378186 - protein, 7 aa, Entamoeba dispar
TYSGQFD

SEQ ID NO: 2378187 - protein, 11 aa, Entamoeba dispar
TYSKGEKNTYC

SEQ ID NO: 2378188 - protein, 13 aa, Entamoeba dispar
TYSKPPNNISTDD

SEQ ID NO: 2378189 - protein, 13 aa, Entamoeba dispar
TYSKTKFRQGNPK

SEQ ID NO: 2378190 - protein, 7 aa, Entamoeba dispar
TYSNETK

SEQ ID NO: 2378191 - protein, 12 aa, Entamoeba dispar
TYSNGNDNEQIQ

SEQ ID NO: 2378192 - protein, 4 aa, Entamoeba dispar
TYSS

SEQ ID NO: 2378193 - protein, 25 aa, Entamoeba dispar
TYSSCGGDSTGSACKCDASTGNQCK

SEQ ID NO: 2378194 - protein, 8 aa, Entamoeba dispar
TYSSGGIN

SEQ ID NO: 2378195 - protein, 17 aa, Entamoeba dispar
TYSSTDDMECESTEFNG

SEQ ID NO: 2378196 - protein, 12 aa, Entamoeba dispar
TYSTEKSTTCSK

SEQ ID NO: 2378197 - protein, 19 aa, Entamoeba dispar
TYTDETGQLQQCSDDCNEA

SEQ ID NO: 2378198 - protein, 10 aa, Entamoeba dispar
TYTEKNGKCI

SEQ ID NO: 2378199 - protein, 9 aa, Entamoeba dispar
TYTESNEEY

SEQ ID NO: 2378200 - protein, 12 aa, Entamoeba dispar
TYTGRNGGWGEG

SEQ ID NO: 2378201 - protein, 8 aa, Entamoeba dispar
TYTGSMKG

SEQ ID NO: 2378202 - protein, 4 aa, Entamoeba dispar
TYTQ

SEQ ID NO: 2378203 - protein, 4 aa, Entamoeba dispar
TYTS

SEQ ID NO: 2378204 - protein, 9 aa, Entamoeba dispar
TYTSNTQRV

SEQ ID NO: 2378205 - protein, 11 aa, Entamoeba dispar
TYTVGDPSNTF

SEQ ID NO: 2378206 - protein, 10 aa, Entamoeba dispar
TYVSTEPNQF

SEQ ID NO: 2378207 - protein, 4 aa, Entamoeba dispar
TYYE

SEQ ID NO: 2378208 - protein, 7 aa, Entamoeba dispar
VADNTDG

SEQ ID NO: 2378209 - protein, 18 aa, Entamoeba dispar
VAGSPSPISLGGSKASST

SEQ ID NO: 2378210 - protein, 5 aa, Entamoeba dispar
VAGSY

SEQ ID NO: 2378211 - protein, 17 aa, Entamoeba dispar
VAKGKLKPKVSSTFGSH

SEQ ID NO: 2378212 - protein, 7 aa, Entamoeba dispar
VAKSDPG

SEQ ID NO: 2378213 - protein, 11 aa, Entamoeba dispar
VAPEPQDKSMS

SEQ ID NO: 2378214 - protein, 12 aa, Entamoeba dispar
VASCEGNNNDIN

SEQ ID NO: 2378215 - protein, 6 aa, Entamoeba dispar
VASGNT

SEQ ID NO: 2378216 - protein, 4 aa, Entamoeba dispar
VASN

SEQ ID NO: 2378217 - protein, 4 aa, Entamoeba dispar
VASS

SEQ ID NO: 2378218 - protein, 5 aa, Entamoeba dispar
VATAT

SEQ ID NO: 2378219 - protein, 8 aa, Entamoeba dispar
VCQADNKE

SEQ ID NO: 2378220 - protein, 9 aa, Entamoeba dispar
VDAKQKQKQ

SEQ ID NO: 2378221 - protein, 13 aa, Entamoeba dispar
VDDDENCTHSDNT

SEQ ID NO: 2378222 - protein, 7 aa, Entamoeba dispar
VDDDGNV

SEQ ID NO: 2378223 - protein, 5 aa, Entamoeba dispar
VDDDY

SEQ ID NO: 2378224 - protein, 8 aa, Entamoeba dispar
VDDGTEGK

SEQ ID NO: 2378225 - protein, 7 aa, Entamoeba dispar
VDDNSEK

SEQ ID NO: 2378226 - protein, 10 aa, Entamoeba dispar
VDDQNKETAK

SEQ ID NO: 2378227 - protein, 14 aa, Entamoeba dispar
VDDSTSKCYSLGNS

SEQ ID NO: 2378228 - protein, 8 aa, Entamoeba dispar
VDDTNGNY

SEQ ID NO: 2378229 - protein, 11 aa, Entamoeba dispar
VDEEEKEEDQY

SEQ ID NO: 2378230 - protein, 5 aa, Entamoeba dispar
VDEIP

SEQ ID NO: 2378231 - protein, 9 aa, Entamoeba dispar
VDENKELPN

SEQ ID NO: 2378232 - protein, 7 aa, Entamoeba dispar
VDEPNPD

SEQ ID NO: 2378233 - protein, 16 aa, Entamoeba dispar
VDEQNYSSACFMTKTV

SEQ ID NO: 2378234 - protein, 14 aa, Entamoeba dispar
VDEQQIESADINGK

SEQ ID NO: 2378235 - protein, 9 aa, Entamoeba dispar
VDETTKNEL

SEQ ID NO: 2378236 - protein, 5 aa, Entamoeba dispar
VDGDK

SEQ ID NO: 2378237 - protein, 4 aa, Entamoeba dispar
VDGE

SEQ ID NO: 2378238 - protein, 6 aa, Entamoeba dispar
VDGVDH

SEQ ID NO: 2378239 - protein, 8 aa, Entamoeba dispar
VDKSETKC

SEQ ID NO: 2378240 - protein, 7 aa, Entamoeba dispar
VDKTGGL

SEQ ID NO: 2378241 - protein, 6 aa, Entamoeba dispar
VDLPEK

SEQ ID NO: 2378242 - protein, 7 aa, Entamoeba dispar
VDMKTNE

SEQ ID NO: 2378243 - protein, 5 aa, Entamoeba dispar
VDNND

SEQ ID NO: 2378244 - protein, 5 aa, Entamoeba dispar
VDNPF

SEQ ID NO: 2378245 - protein, 7 aa, Entamoeba dispar
VDPGRRF

SEQ ID NO: 2378246 - protein, 13 aa, Entamoeba dispar
VDPHATKKAVGQE

SEQ ID NO: 2378247 - protein, 6 aa, Entamoeba dispar
VDPKHH

SEQ ID NO: 2378248 - protein, 8 aa, Entamoeba dispar
VDPTNNST

SEQ ID NO: 2378249 - protein, 6 aa, Entamoeba dispar
VDQDET

SEQ ID NO: 2378250 - protein, 9 aa, Entamoeba dispar
VDQGADIAQ

SEQ ID NO: 2378251 - protein, 8 aa, Entamoeba dispar
VDQPDITY

SEQ ID NO: 2378252 - protein, 19 aa, Entamoeba dispar
VDQQEIKSSYSGNNESTTS

SEQ ID NO: 2378253 - protein, 4 aa, Entamoeba dispar
VDQT

SEQ ID NO: 2378254 - protein, 82 aa, Entamoeba dispar
VDQTPQQETAQPTDNQVGQPEIVQPTSEAQQPVDPNVQQPVDPNVQQPVDPNVQQPVDPNVQQPVDPNVQQPTTQNTQQPMY

SEQ ID NO: 2378255 - protein, 8 aa, Entamoeba dispar
VDRENTQY

SEQ ID NO: 2378256 - protein, 8 aa, Entamoeba dispar
VDRGKQGI

SEQ ID NO: 2378257 - protein, 10 aa, Entamoeba dispar
VDSCSDGVGC

SEQ ID NO: 2378258 - protein, 12 aa, Entamoeba dispar
VDSNGSKVIDEK

SEQ ID NO: 2378259 - protein, 6 aa, Entamoeba dispar
VDSPQT

SEQ ID NO: 2378260 - protein, 4 aa, Entamoeba dispar
VDSS

SEQ ID NO: 2378261 - protein, 8 aa, Entamoeba dispar
VDSSDETV

SEQ ID NO: 2378262 - protein, 8 aa, Entamoeba dispar
VDSSDGGY

SEQ ID NO: 2378263 - protein, 9 aa, Entamoeba dispar
VDSTADENA

SEQ ID NO: 2378264 - protein, 9 aa, Entamoeba dispar
VDTTGEPLL

SEQ ID NO: 2378265 - protein, 6 aa, Entamoeba dispar
VDYESR

SEQ ID NO: 2378266 - protein, 6 aa, Entamoeba dispar
VEDEDY

SEQ ID NO: 2378267 - protein, 8 aa, Entamoeba dispar
VEDEIRPK

SEQ ID NO: 2378268 - protein, 12 aa, Entamoeba dispar
VEDKPQTYRLDG

SEQ ID NO: 2378269 - protein, 11 aa, Entamoeba dispar
VEDRLQDNVPQ

SEQ ID NO: 2378270 - protein, 15 aa, Entamoeba dispar
VEEDSEENARYDNPA

SEQ ID NO: 2378271 - protein, 5 aa, Entamoeba dispar
VEEEI

SEQ ID NO: 2378272 - protein, 7 aa, Entamoeba dispar
VEEGIQI

SEQ ID NO: 2378273 - protein, 6 aa, Entamoeba dispar
VEEGKR

SEQ ID NO: 2378274 - protein, 8 aa, Entamoeba dispar
VEEKVGTN

SEQ ID NO: 2378275 - protein, 18 aa, Entamoeba dispar
VEENAKKAKETVQEKSSS

SEQ ID NO: 2378276 - protein, 17 aa, Entamoeba dispar
VEENCSKYDQSGCKECK

SEQ ID NO: 2378277 - protein, 6 aa, Entamoeba dispar
VEENGC

SEQ ID NO: 2378278 - protein, 13 aa, Entamoeba dispar
VEENGKNLSSGTK

SEQ ID NO: 2378279 - protein, 9 aa, Entamoeba dispar
VEENKHESK

SEQ ID NO: 2378280 - protein, 9 aa, Entamoeba dispar
VEEQDSSYT

SEQ ID NO: 2378281 - protein, 10 aa, Entamoeba dispar
VEEQKKEGYP

SEQ ID NO: 2378282 - protein, 9 aa, Entamoeba dispar
VEESPKTNE

SEQ ID NO: 2378283 - protein, 8 aa, Entamoeba dispar
VEESSKGF

SEQ ID NO: 2378284 - protein, 20 aa, Entamoeba dispar
VEETSSQLTTPRRPANEDQQ

SEQ ID NO: 2378285 - protein, 7 aa, Entamoeba dispar
VEFTKDT

SEQ ID NO: 2378286 - protein, 5 aa, Entamoeba dispar
VEGDV

SEQ ID NO: 2378287 - protein, 9 aa, Entamoeba dispar
VEGKEIEKT

SEQ ID NO: 2378288 - protein, 14 aa, Entamoeba dispar
VEGKRPDISSYEPN

SEQ ID NO: 2378289 - protein, 4 aa, Entamoeba dispar
VEGL

SEQ ID NO: 2378290 - protein, 7 aa, Entamoeba dispar
VEHNGKI

SEQ ID NO: 2378291 - protein, 6 aa, Entamoeba dispar
VEIPSE

SEQ ID NO: 2378292 - protein, 11 aa, Entamoeba dispar
VEKDDNELKNE

SEQ ID NO: 2378293 - protein, 9 aa, Entamoeba dispar
VEKGNKGSL

SEQ ID NO: 2378294 - protein, 14 aa, Entamoeba dispar
VEKKKSIAKKLEGM

SEQ ID NO: 2378295 - protein, 4 aa, Entamoeba dispar
VEKP

SEQ ID NO: 2378296 - protein, 8 aa, Entamoeba dispar
VEKRTQSI

SEQ ID NO: 2378297 - protein, 4 aa, Entamoeba dispar
VELK

SEQ ID NO: 2378298 - protein, 4 aa, Entamoeba dispar
VELN

SEQ ID NO: 2378299 - protein, 8 aa, Entamoeba dispar
VELNEGKA

SEQ ID NO: 2378300 - protein, 13 aa, Entamoeba dispar
VEMNKEKQANDVE

SEQ ID NO: 2378301 - protein, 4 aa, Entamoeba dispar
VENA

SEQ ID NO: 2378302 - protein, 4 aa, Entamoeba dispar
VEND

SEQ ID NO: 2378303 - protein, 8 aa, Entamoeba dispar
VENGNSHG

SEQ ID NO: 2378304 - protein, 14 aa, Entamoeba dispar
VENKASEQTKKEKE

SEQ ID NO: 2378305 - protein, 11 aa, Entamoeba dispar
VENKGSDGTIT

SEQ ID NO: 2378306 - protein, 5 aa, Entamoeba dispar
VEPLK

SEQ ID NO: 2378307 - protein, 12 aa, Entamoeba dispar
VEPPLSDEQRQQ

SEQ ID NO: 2378308 - protein, 8 aa, Entamoeba dispar
VEPTDDLT

SEQ ID NO: 2378309 - protein, 15 aa, Entamoeba dispar
VEQDQSSCVSSYEPE

SEQ ID NO: 2378310 - protein, 22 aa, Entamoeba dispar
VEQEKEKKIKEEVEKAHQLREK

SEQ ID NO: 2378311 - protein, 9 aa, Entamoeba dispar
VEQENTFNQ

SEQ ID NO: 2378312 - protein, 7 aa, Entamoeba dispar
VEQEPIT

SEQ ID NO: 2378313 - protein, 4 aa, Entamoeba dispar
VEQF

SEQ ID NO: 2378314 - protein, 27 aa, Entamoeba dispar
VEQNESVSSQQLRNAAVEGNISEEIEP

SEQ ID NO: 2378315 - protein, 6 aa, Entamoeba dispar
VEQQLT

SEQ ID NO: 2378316 - protein, 5 aa, Entamoeba dispar
VEQQN

SEQ ID NO: 2378317 - protein, 5 aa, Entamoeba dispar
VERDE

SEQ ID NO: 2378318 - protein, 5 aa, Entamoeba dispar
VEREE

SEQ ID NO: 2378319 - protein, 13 aa, Entamoeba dispar
VERSHSSSNIKGL

SEQ ID NO: 2378320 - protein, 7 aa, Entamoeba dispar
VERSVKR

SEQ ID NO: 2378321 - protein, 7 aa, Entamoeba dispar
VESDSSL

SEQ ID NO: 2378322 - protein, 10 aa, Entamoeba dispar
VESGDSSKYH

SEQ ID NO: 2378323 - protein, 9 aa, Entamoeba dispar
VESGKRLGF

SEQ ID NO: 2378324 - protein, 12 aa, Entamoeba dispar
VESGKRLPLGDS

SEQ ID NO: 2378325 - protein, 6 aa, Entamoeba dispar
VESGNH

SEQ ID NO: 2378326 - protein, 7 aa, Entamoeba dispar
VESRSCK

SEQ ID NO: 2378327 - protein, 11 aa, Entamoeba dispar
VESSNDETNEK

SEQ ID NO: 2378328 - protein, 9 aa, Entamoeba dispar
VESSSYGAT

SEQ ID NO: 2378329 - protein, 7 aa, Entamoeba dispar
VESSTSI

SEQ ID NO: 2378330 - protein, 6 aa, Entamoeba dispar
VESTTE

SEQ ID NO: 2378331 - protein, 4 aa, Entamoeba dispar
VETG

SEQ ID NO: 2378332 - protein, 7 aa, Entamoeba dispar
VETIKKG

SEQ ID NO: 2378333 - protein, 7 aa, Entamoeba dispar
VETPETD

SEQ ID NO: 2378334 - protein, 17 aa, Entamoeba dispar
VETPKQSIELPREEKPI

SEQ ID NO: 2378335 - protein, 7 aa, Entamoeba dispar
VETQNAY

SEQ ID NO: 2378336 - protein, 12 aa, Entamoeba dispar
VETQRCGKNNSY

SEQ ID NO: 2378337 - protein, 10 aa, Entamoeba dispar
VETRLPPKQK

SEQ ID NO: 2378338 - protein, 8 aa, Entamoeba dispar
VETYDDDD

SEQ ID NO: 2378339 - protein, 8 aa, Entamoeba dispar
VEVKEERG

SEQ ID NO: 2378340 - protein, 9 aa, Entamoeba dispar
VEVQTQSTA

SEQ ID NO: 2378341 - protein, 13 aa, Entamoeba dispar
VFESESDNSDCSG

SEQ ID NO: 2378342 - protein, 8 aa, Entamoeba dispar
VFGSKNPA

SEQ ID NO: 2378343 - protein, 11 aa, Entamoeba dispar
VFNSSSSLTSV

SEQ ID NO: 2378344 - protein, 9 aa, Entamoeba dispar
VFTKDNTAA

SEQ ID NO: 2378345 - protein, 8 aa, Entamoeba dispar
VGANEGTM

SEQ ID NO: 2378346 - protein, 12 aa, Entamoeba dispar
VGDITDSNLDGK

SEQ ID NO: 2378347 - protein, 8 aa, Entamoeba dispar
VGDKSKCN

SEQ ID NO: 2378348 - protein, 9 aa, Entamoeba dispar
VGDTNTSIE

SEQ ID NO: 2378349 - protein, 9 aa, Entamoeba dispar
VGEEKPRSV

SEQ ID NO: 2378350 - protein, 11 aa, Entamoeba dispar
VGEGKKDMERR

SEQ ID NO: 2378351 - protein, 10 aa, Entamoeba dispar
VGEGSALTCK

SEQ ID NO: 2378352 - protein, 4 aa, Entamoeba dispar
VGEH

SEQ ID NO: 2378353 - protein, 6 aa, Entamoeba dispar
VGEKGS

SEQ ID NO: 2378354 - protein, 4 aa, Entamoeba dispar
VGET

SEQ ID NO: 2378355 - protein, 12 aa, Entamoeba dispar
VGETGKTKKGWD

SEQ ID NO: 2378356 - protein, 6 aa, Entamoeba dispar
VGGAES

SEQ ID NO: 2378357 - protein, 5 aa, Entamoeba dispar
VGGDW

SEQ ID NO: 2378358 - protein, 4 aa, Entamoeba dispar
VGGS

SEQ ID NO: 2378359 - protein, 7 aa, Entamoeba dispar
VGHDESV

SEQ ID NO: 2378360 - protein, 15 aa, Entamoeba dispar
VGHKKCTCSDNNKFT

SEQ ID NO: 2378361 - protein, 7 aa, Entamoeba dispar
VGHSTNG

SEQ ID NO: 2378362 - protein, 14 aa, Entamoeba dispar
VGKEAPKGQENRRS

SEQ ID NO: 2378363 - protein, 5 aa, Entamoeba dispar
VGKER

SEQ ID NO: 2378364 - protein, 6 aa, Entamoeba dispar
VGKESR

SEQ ID NO: 2378365 - protein, 9 aa, Entamoeba dispar
VGKKQEAIG

SEQ ID NO: 2378366 - protein, 6 aa, Entamoeba dispar
VGKNTV

SEQ ID NO: 2378367 - protein, 8 aa, Entamoeba dispar
VGKSGDVT

SEQ ID NO: 2378368 - protein, 7 aa, Entamoeba dispar
VGKTRTY

SEQ ID NO: 2378369 - protein, 10 aa, Entamoeba dispar
VGLSDPYYNP

SEQ ID NO: 2378370 - protein, 11 aa, Entamoeba dispar
VGNANENNIGG

SEQ ID NO: 2378371 - protein, 9 aa, Entamoeba dispar
VGNTSSSSV

SEQ ID NO: 2378372 - protein, 5 aa, Entamoeba dispar
VGPKP

SEQ ID NO: 2378373 - protein, 11 aa, Entamoeba dispar
VGPNGECVQNN

SEQ ID NO: 2378374 - protein, 7 aa, Entamoeba dispar
VGPSAVT

SEQ ID NO: 2378375 - protein, 16 aa, Entamoeba dispar
VGPTKQGIRQNIPDSS

SEQ ID NO: 2378376 - protein, 10 aa, Entamoeba dispar
VGSGEEKELE

SEQ ID NO: 2378377 - protein, 38 aa, Entamoeba dispar
VGSGTNKRCSLAETGSLGKRRSECLSPDEEGERLGSKK

SEQ ID NO: 2378378 - protein, 6 aa, Entamoeba dispar
VGSKQI

SEQ ID NO: 2378379 - protein, 12 aa, Entamoeba dispar
VGSPEPIKPNIS

SEQ ID NO: 2378380 - protein, 12 aa, Entamoeba dispar
VGSSKTKTKEFH

SEQ ID NO: 2378381 - protein, 9 aa, Entamoeba dispar
VGTPTPIHS

SEQ ID NO: 2378382 - protein, 6 aa, Entamoeba dispar
VGTSSA

SEQ ID NO: 2378383 - protein, 14 aa, Entamoeba dispar
VGVAGSGAALADAQ

SEQ ID NO: 2378384 - protein, 6 aa, Entamoeba dispar
VHPEDN

SEQ ID NO: 2378385 - protein, 7 aa, Entamoeba dispar
VHSDKAG

SEQ ID NO: 2378386 - protein, 20 aa, Entamoeba dispar
VIEPKKQRSEVKKRNIESMK

SEQ ID NO: 2378387 - protein, 6 aa, Entamoeba dispar
VIGASG

SEQ ID NO: 2378388 - protein, 5 aa, Entamoeba dispar
VIGEG

SEQ ID NO: 2378389 - protein, 5 aa, Entamoeba dispar
VIKSD

SEQ ID NO: 2378390 - protein, 5 aa, Entamoeba dispar
VIKSR

SEQ ID NO: 2378391 - protein, 4 aa, Entamoeba dispar
VIPK

SEQ ID NO: 2378392 - protein, 5 aa, Entamoeba dispar
VIPNP

SEQ ID NO: 2378393 - protein, 25 aa, Entamoeba dispar
VIQNKGKSKFKKRINKEENKKNELS

SEQ ID NO: 2378394 - protein, 7 aa, Entamoeba dispar
VISQQPK

SEQ ID NO: 2378395 - protein, 14 aa, Entamoeba dispar
VITTNKQQQTTQNL

SEQ ID NO: 2378396 - protein, 11 aa, Entamoeba dispar
VKAGAKEPEFQ

SEQ ID NO: 2378397 - protein, 7 aa, Entamoeba dispar
VKAPEQI

SEQ ID NO: 2378398 - protein, 7 aa, Entamoeba dispar
VKAQKAV

SEQ ID NO: 2378399 - protein, 8 aa, Entamoeba dispar
VKASSDWS

SEQ ID NO: 2378400 - protein, 17 aa, Entamoeba dispar
VKCGGSQSRILKESSKL

SEQ ID NO: 2378401 - protein, 9 aa, Entamoeba dispar
VKDQKDKLK

SEQ ID NO: 2378402 - protein, 13 aa, Entamoeba dispar
VKEAPIERDETRD

SEQ ID NO: 2378403 - protein, 6 aa, Entamoeba dispar
VKEATK

SEQ ID NO: 2378404 - protein, 10 aa, Entamoeba dispar
VKEDEDGTLS

SEQ ID NO: 2378405 - protein, 13 aa, Entamoeba dispar
VKEKPKMKKQEMK

SEQ ID NO: 2378406 - protein, 4 aa, Entamoeba dispar
VKEL

SEQ ID NO: 2378407 - protein, 5 aa, Entamoeba dispar
VKEND

SEQ ID NO: 2378408 - protein, 7 aa, Entamoeba dispar
VKEQGGI

SEQ ID NO: 2378409 - protein, 14 aa, Entamoeba dispar
VKEQKEQPTNQNSY

SEQ ID NO: 2378410 - protein, 7 aa, Entamoeba dispar
VKETQDV

SEQ ID NO: 2378411 - protein, 8 aa, Entamoeba dispar
VKETSTID

SEQ ID NO: 2378412 - protein, 8 aa, Entamoeba dispar
VKFQGKRS

SEQ ID NO: 2378413 - protein, 22 aa, Entamoeba dispar
VKGIKTNQEINKERKRKEKSTI

SEQ ID NO: 2378414 - protein, 13 aa, Entamoeba dispar
VKGNKEKRNNEPH

SEQ ID NO: 2378415 - protein, 7 aa, Entamoeba dispar
VKGREEK

SEQ ID NO: 2378416 - protein, 5 aa, Entamoeba dispar
VKGRG

SEQ ID NO: 2378417 - protein, 27 aa, Entamoeba dispar
VKKATSDQISEAKKRYLERKMKKGINP

SEQ ID NO: 2378418 - protein, 4 aa, Entamoeba dispar
VKKF

SEQ ID NO: 2378419 - protein, 8 aa, Entamoeba dispar
VKKGMKAS

SEQ ID NO: 2378420 - protein, 9 aa, Entamoeba dispar
VKKKPEKEF

SEQ ID NO: 2378421 - protein, 9 aa, Entamoeba dispar
VKKQDGNLV

SEQ ID NO: 2378422 - protein, 10 aa, Entamoeba dispar
VKKYSITGST

SEQ ID NO: 2378423 - protein, 5 aa, Entamoeba dispar
VKNAK

SEQ ID NO: 2378424 - protein, 6 aa, Entamoeba dispar
VKNAMK

SEQ ID NO: 2378425 - protein, 8 aa, Entamoeba dispar
VKNENKIT

SEQ ID NO: 2378426 - protein, 9 aa, Entamoeba dispar
VKNGKIKPN

SEQ ID NO: 2378427 - protein, 12 aa, Entamoeba dispar
VKNKKESNISLG

SEQ ID NO: 2378428 - protein, 15 aa, Entamoeba dispar
VKNNDSNNHPSIQRE

SEQ ID NO: 2378429 - protein, 7 aa, Entamoeba dispar
VKNNETS

SEQ ID NO: 2378430 - protein, 8 aa, Entamoeba dispar
VKNPTRNI

SEQ ID NO: 2378431 - protein, 9 aa, Entamoeba dispar
VKNQSNKTN

SEQ ID NO: 2378432 - protein, 6 aa, Entamoeba dispar
VKNQYS

SEQ ID NO: 2378433 - protein, 9 aa, Entamoeba dispar
VKNRSHPKT

SEQ ID NO: 2378434 - protein, 12 aa, Entamoeba dispar
VKPLSPSSSLSQ

SEQ ID NO: 2378435 - protein, 6 aa, Entamoeba dispar
VKPNSY

SEQ ID NO: 2378436 - protein, 6 aa, Entamoeba dispar
VKPSEE

SEQ ID NO: 2378437 - protein, 14 aa, Entamoeba dispar
VKPTEEDKNNPRFK

SEQ ID NO: 2378438 - protein, 27 aa, Entamoeba dispar
VKPTPACSECEGGKFTEKCKDQKLERK

SEQ ID NO: 2378439 - protein, 44 aa, Entamoeba dispar
VKRALDEKAIKEGKKPKFNTKDINEHKSKEIKEINEKLENNIEE

SEQ ID NO: 2378440 - protein, 6 aa, Entamoeba dispar
VKRSGI

SEQ ID NO: 2378441 - protein, 4 aa, Entamoeba dispar
VKSN

SEQ ID NO: 2378442 - protein, 11 aa, Entamoeba dispar
VKSNANAPKIG

SEQ ID NO: 2378443 - protein, 10 aa, Entamoeba dispar
VKSQGTPGSA

SEQ ID NO: 2378444 - protein, 11 aa, Entamoeba dispar
VKSSQKLPTGI

SEQ ID NO: 2378445 - protein, 4 aa, Entamoeba dispar
VKSY

SEQ ID NO: 2378446 - protein, 5 aa, Entamoeba dispar
VKTEF

SEQ ID NO: 2378447 - protein, 12 aa, Entamoeba dispar
VKTEQDDRDEDV

SEQ ID NO: 2378448 - protein, 4 aa, Entamoeba dispar
VKTI

SEQ ID NO: 2378449 - protein, 8 aa, Entamoeba dispar
VKTKDMEQ

SEQ ID NO: 2378450 - protein, 6 aa, Entamoeba dispar
VKTKEM

SEQ ID NO: 2378451 - protein, 9 aa, Entamoeba dispar
VKTNNITKA

SEQ ID NO: 2378452 - protein, 10 aa, Entamoeba dispar
VKTQGFEYTD

SEQ ID NO: 2378453 - protein, 23 aa, Entamoeba dispar
VKTQKETQENKETINLESNRTKI

SEQ ID NO: 2378454 - protein, 10 aa, Entamoeba dispar
VKTTNVGSNA

SEQ ID NO: 2378455 - protein, 5 aa, Entamoeba dispar
VKYDN

SEQ ID NO: 2378456 - protein, 11 aa, Entamoeba dispar
VKYGGEKDVDC

SEQ ID NO: 2378457 - protein, 5 aa, Entamoeba dispar
VKYRE

SEQ ID NO: 2378458 - protein, 24 aa, Entamoeba dispar
VLEKDKDALDKVNNDLDTSDKTLK

SEQ ID NO: 2378459 - protein, 13 aa, Entamoeba dispar
VLTGNKPTTKSDI

SEQ ID NO: 2378460 - protein, 7 aa, Entamoeba dispar
VNAQKAV

SEQ ID NO: 2378461 - protein, 8 aa, Entamoeba dispar
VNDDPATF

SEQ ID NO: 2378462 - protein, 4 aa, Entamoeba dispar
VNDE

SEQ ID NO: 2378463 - protein, 10 aa, Entamoeba dispar
VNDKESIEEF

SEQ ID NO: 2378464 - protein, 7 aa, Entamoeba dispar
VNDMPNQ

SEQ ID NO: 2378465 - protein, 10 aa, Entamoeba dispar
VNDPETYQTV

SEQ ID NO: 2378466 - protein, 5 aa, Entamoeba dispar
VNDQS

SEQ ID NO: 2378467 - protein, 31 aa, Entamoeba dispar
VNDRNEKKIRKEEKTKVQAENNKEGNTSTSV

SEQ ID NO: 2378468 - protein, 64 aa, Entamoeba dispar
VNDSDDIEKKEEVQDDNGENSISSESGSGSGSANDSGSGSVSSSYSASGSGSDNGSGSGSGSAS

SEQ ID NO: 2378469 - protein, 11 aa, Entamoeba dispar
VNDSDNEISGV

SEQ ID NO: 2378470 - protein, 8 aa, Entamoeba dispar
VNEDGSSQ

SEQ ID NO: 2378471 - protein, 15 aa, Entamoeba dispar
VNEEDNTKEDDGVST

SEQ ID NO: 2378472 - protein, 6 aa, Entamoeba dispar
VNEEKS

SEQ ID NO: 2378473 - protein, 8 aa, Entamoeba dispar
VNEKDEYY

SEQ ID NO: 2378474 - protein, 10 aa, Entamoeba dispar
VNEKQKEKPL

SEQ ID NO: 2378475 - protein, 5 aa, Entamoeba dispar
VNEKT

SEQ ID NO: 2378476 - protein, 9 aa, Entamoeba dispar
VNENRTTCS

SEQ ID NO: 2378477 - protein, 7 aa, Entamoeba dispar
VNENSQF

SEQ ID NO: 2378478 - protein, 4 aa, Entamoeba dispar
VNEQ

SEQ ID NO: 2378479 - protein, 33 aa, Entamoeba dispar
VNETKKVSSTIPSSKEEKKQKKCKSYNERRTEY

SEQ ID NO: 2378480 - protein, 5 aa, Entamoeba dispar
VNETT

SEQ ID NO: 2378481 - protein, 4 aa, Entamoeba dispar
VNGG

SEQ ID NO: 2378482 - protein, 6 aa, Entamoeba dispar
VNGHPD

SEQ ID NO: 2378483 - protein, 14 aa, Entamoeba dispar
VNHPELDTNTYADK

SEQ ID NO: 2378484 - protein, 8 aa, Entamoeba dispar
VNKDDSKY

SEQ ID NO: 2378485 - protein, 4 aa, Entamoeba dispar
VNKE

SEQ ID NO: 2378486 - protein, 4 aa, Entamoeba dispar
VNKG

SEQ ID NO: 2378487 - protein, 31 aa, Entamoeba dispar
VNKHENTLREEKSKRKLFSKESRIDKERRNE

SEQ ID NO: 2378488 - protein, 9 aa, Entamoeba dispar
VNKKIKASK

SEQ ID NO: 2378489 - protein, 5 aa, Entamoeba dispar
VNKNQ

SEQ ID NO: 2378490 - protein, 8 aa, Entamoeba dispar
VNKQDAYR

SEQ ID NO: 2378491 - protein, 4 aa, Entamoeba dispar
VNNA

SEQ ID NO: 2378492 - protein, 7 aa, Entamoeba dispar
VNNDKKN

SEQ ID NO: 2378493 - protein, 8 aa, Entamoeba dispar
VNNKQSQE

SEQ ID NO: 2378494 - protein, 5 aa, Entamoeba dispar
VNNLN

SEQ ID NO: 2378495 - protein, 8 aa, Entamoeba dispar
VNNNSTEL

SEQ ID NO: 2378496 - protein, 31 aa, Entamoeba dispar
VNNPDEQPQPDNQSQRTEQNDNTPDAIIIES

SEQ ID NO: 2378497 - protein, 16 aa, Entamoeba dispar
VNNPSASALADDHRND

SEQ ID NO: 2378498 - protein, 18 aa, Entamoeba dispar
VNNQTDIETSKQDDLKER

SEQ ID NO: 2378499 - protein, 10 aa, Entamoeba dispar
VNNTKENEHY

SEQ ID NO: 2378500 - protein, 7 aa, Entamoeba dispar
VNNYRRD

SEQ ID NO: 2378501 - protein, 4 aa, Entamoeba dispar
VNPD

SEQ ID NO: 2378502 - protein, 10 aa, Entamoeba dispar
VNPKHRNNKI

SEQ ID NO: 2378503 - protein, 7 aa, Entamoeba dispar
VNQKKQK

SEQ ID NO: 2378504 - protein, 6 aa, Entamoeba dispar
VNQNER

SEQ ID NO: 2378505 - protein, 5 aa, Entamoeba dispar
VNRRS

SEQ ID NO: 2378506 - protein, 5 aa, Entamoeba dispar
VNSGV

SEQ ID NO: 2378507 - protein, 11 aa, Entamoeba dispar
VNSPNDFYKNG

SEQ ID NO: 2378508 - protein, 4 aa, Entamoeba dispar
VNSS

SEQ ID NO: 2378509 - protein, 9 aa, Entamoeba dispar
VNSSSQFNQ

SEQ ID NO: 2378510 - protein, 7 aa, Entamoeba dispar
VNSTEGY

SEQ ID NO: 2378511 - protein, 8 aa, Entamoeba dispar
VNSTSKAK

SEQ ID NO: 2378512 - protein, 7 aa, Entamoeba dispar
VNSTTGK

SEQ ID NO: 2378513 - protein, 13 aa, Entamoeba dispar
VNSYNNEQPTSLD

SEQ ID NO: 2378514 - protein, 6 aa, Entamoeba dispar
VNTDIT

SEQ ID NO: 2378515 - protein, 9 aa, Entamoeba dispar
VNTSQSTTH

SEQ ID NO: 2378516 - protein, 7 aa, Entamoeba dispar
VNTTKPQ

SEQ ID NO: 2378517 - protein, 5 aa, Entamoeba dispar
VNTTS

SEQ ID NO: 2378518 - protein, 6 aa, Entamoeba dispar
VNVSSE

SEQ ID NO: 2378519 - protein, 7 aa, Entamoeba dispar
VNYPTGD

SEQ ID NO: 2378520 - protein, 12 aa, Entamoeba dispar
VPASEDKIKQEE

SEQ ID NO: 2378521 - protein, 5 aa, Entamoeba dispar
VPDIE

SEQ ID NO: 2378522 - protein, 4 aa, Entamoeba dispar
VPDK

SEQ ID NO: 2378523 - protein, 22 aa, Entamoeba dispar
VPDQSQSSSSNSDSNPTDDSTS

SEQ ID NO: 2378524 - protein, 12 aa, Entamoeba dispar
VPEQDADGTTIT

SEQ ID NO: 2378525 - protein, 25 aa, Entamoeba dispar
VPEQKDDDETEEEEVTEKNLQTTQT

SEQ ID NO: 2378526 - protein, 5 aa, Entamoeba dispar
VPERS

SEQ ID NO: 2378527 - protein, 7 aa, Entamoeba dispar
VPESDDN

SEQ ID NO: 2378528 - protein, 7 aa, Entamoeba dispar
VPESSSF

SEQ ID NO: 2378529 - protein, 6 aa, Entamoeba dispar
VPGDCY

SEQ ID NO: 2378530 - protein, 5 aa, Entamoeba dispar
VPGKD

SEQ ID NO: 2378531 - protein, 8 aa, Entamoeba dispar
VPGQDNPS

SEQ ID NO: 2378532 - protein, 10 aa, Entamoeba dispar
VPGTYKAQNV

SEQ ID NO: 2378533 - protein, 4 aa, Entamoeba dispar
VPIE

SEQ ID NO: 2378534 - protein, 5 aa, Entamoeba dispar
VPKEV

SEQ ID NO: 2378535 - protein, 8 aa, Entamoeba dispar
VPKGYDDD

SEQ ID NO: 2378536 - protein, 7 aa, Entamoeba dispar
VPKNNSN

SEQ ID NO: 2378537 - protein, 5 aa, Entamoeba dispar
VPKQK

SEQ ID NO: 2378538 - protein, 9 aa, Entamoeba dispar
VPKRTNPLK

SEQ ID NO: 2378539 - protein, 6 aa, Entamoeba dispar
VPKSSV

SEQ ID NO: 2378540 - protein, 9 aa, Entamoeba dispar
VPMESTSSQ

SEQ ID NO: 2378541 - protein, 8 aa, Entamoeba dispar
VPNEENDQ

SEQ ID NO: 2378542 - protein, 4 aa, Entamoeba dispar
VPNL

SEQ ID NO: 2378543 - protein, 6 aa, Entamoeba dispar
VPNSTA

SEQ ID NO: 2378544 - protein, 4 aa, Entamoeba dispar
VPPA

SEQ ID NO: 2378545 - protein, 13 aa, Entamoeba dispar
VPPDDTYKSSRYE

SEQ ID NO: 2378546 - protein, 41 aa, Entamoeba dispar
VPPNDTSSSSLEDSSYIPNESSSSSNTNETSSSELQEPTTD

SEQ ID NO: 2378547 - protein, 8 aa, Entamoeba dispar
VPQERPQF

SEQ ID NO: 2378548 - protein, 7 aa, Entamoeba dispar
VPSDPTI

SEQ ID NO: 2378549 - protein, 8 aa, Entamoeba dispar
VPSNNLNN

SEQ ID NO: 2378550 - protein, 5 aa, Entamoeba dispar
VPSPY

SEQ ID NO: 2378551 - protein, 8 aa, Entamoeba dispar
VPTCGNGK

SEQ ID NO: 2378552 - protein, 12 aa, Entamoeba dispar
VPTDLEKARRSL

SEQ ID NO: 2378553 - protein, 10 aa, Entamoeba dispar
VPTTKSNSID

SEQ ID NO: 2378554 - protein, 4 aa, Entamoeba dispar
VPYG

SEQ ID NO: 2378555 - protein, 4 aa, Entamoeba dispar
VQDE

SEQ ID NO: 2378556 - protein, 15 aa, Entamoeba dispar
VQEDPIGRVEAEGNS

SEQ ID NO: 2378557 - protein, 9 aa, Entamoeba dispar
VQEKEKKSS

SEQ ID NO: 2378558 - protein, 7 aa, Entamoeba dispar
VQGKPGE

SEQ ID NO: 2378559 - protein, 5 aa, Entamoeba dispar
VQLNG

SEQ ID NO: 2378560 - protein, 5 aa, Entamoeba dispar
VQPGE

SEQ ID NO: 2378561 - protein, 15 aa, Entamoeba dispar
VQPQMGQSSCEPCGD

SEQ ID NO: 2378562 - protein, 7 aa, Entamoeba dispar
VQPSLKA

SEQ ID NO: 2378563 - protein, 9 aa, Entamoeba dispar
VQPTKQPEH

SEQ ID NO: 2378564 - protein, 6 aa, Entamoeba dispar
VQQNVR

SEQ ID NO: 2378565 - protein, 9 aa, Entamoeba dispar
VQQPTTKNR

SEQ ID NO: 2378566 - protein, 16 aa, Entamoeba dispar
VQQPTVNVTTKDGDLV

SEQ ID NO: 2378567 - protein, 4 aa, Entamoeba dispar
VQQQ

SEQ ID NO: 2378568 - protein, 20 aa, Entamoeba dispar
VQQQPPHDQTKSIPQQLPHD

SEQ ID NO: 2378569 - protein, 7 aa, Entamoeba dispar
VQSDEVN

SEQ ID NO: 2378570 - protein, 19 aa, Entamoeba dispar
VQSFSQSKYLDQEDPNEEY

SEQ ID NO: 2378571 - protein, 6 aa, Entamoeba dispar
VQSKPE

SEQ ID NO: 2378572 - protein, 6 aa, Entamoeba dispar
VQSKRY

SEQ ID NO: 2378573 - protein, 14 aa, Entamoeba dispar
VQSLGKEDYFSQKY

SEQ ID NO: 2378574 - protein, 8 aa, Entamoeba dispar
VQSPSLDN

SEQ ID NO: 2378575 - protein, 9 aa, Entamoeba dispar
VQSQNKDIQ

SEQ ID NO: 2378576 - protein, 10 aa, Entamoeba dispar
VQTTTNKGRQ

SEQ ID NO: 2378577 - protein, 17 aa, Entamoeba dispar
VRAPPINKTDIDEEDGE

SEQ ID NO: 2378578 - protein, 7 aa, Entamoeba dispar
VRDDYDT

SEQ ID NO: 2378579 - protein, 7 aa, Entamoeba dispar
VRDKETI

SEQ ID NO: 2378580 - protein, 11 aa, Entamoeba dispar
VREDEDGSLSI

SEQ ID NO: 2378581 - protein, 11 aa, Entamoeba dispar
VREKGINPQTL

SEQ ID NO: 2378582 - protein, 21 aa, Entamoeba dispar
VREREKRKKEAAQHQKEPEDM

SEQ ID NO: 2378583 - protein, 17 aa, Entamoeba dispar
VRGEDKRAELTKKSLSD

SEQ ID NO: 2378584 - protein, 5 aa, Entamoeba dispar
VRGPD

SEQ ID NO: 2378585 - protein, 18 aa, Entamoeba dispar
VRIPQSGTIDKTLQPHPI

SEQ ID NO: 2378586 - protein, 7 aa, Entamoeba dispar
VRKEKPK

SEQ ID NO: 2378587 - protein, 15 aa, Entamoeba dispar
VRKGVTSKKGENEYL

SEQ ID NO: 2378588 - protein, 16 aa, Entamoeba dispar
VRKSRSLMSVDRKKVL

SEQ ID NO: 2378589 - protein, 7 aa, Entamoeba dispar
VRQPEPS

SEQ ID NO: 2378590 - protein, 16 aa, Entamoeba dispar
VRQTRDETKKENQELK

SEQ ID NO: 2378591 - protein, 5 aa, Entamoeba dispar
VRRSS

SEQ ID NO: 2378592 - protein, 8 aa, Entamoeba dispar
VRRSVSGN

SEQ ID NO: 2378593 - protein, 10 aa, Entamoeba dispar
VRSENQSLIS

SEQ ID NO: 2378594 - protein, 8 aa, Entamoeba dispar
VRSGIQNP

SEQ ID NO: 2378595 - protein, 6 aa, Entamoeba dispar
VRSKTD

SEQ ID NO: 2378596 - protein, 7 aa, Entamoeba dispar
VRTKPGK

SEQ ID NO: 2378597 - protein, 4 aa, Entamoeba dispar
VRTT

SEQ ID NO: 2378598 - protein, 9 aa, Entamoeba dispar
VSAENKEYD

SEQ ID NO: 2378599 - protein, 4 aa, Entamoeba dispar
VSAP

SEQ ID NO: 2378600 - protein, 9 aa, Entamoeba dispar
VSAQSSSQL

SEQ ID NO: 2378601 - protein, 24 aa, Entamoeba dispar
VSASRSGTGTLTGTLTTSKTKEKV

SEQ ID NO: 2378602 - protein, 8 aa, Entamoeba dispar
VSCNDGTD

SEQ ID NO: 2378603 - protein, 8 aa, Entamoeba dispar
VSCSENDS

SEQ ID NO: 2378604 - protein, 7 aa, Entamoeba dispar
VSCSPSS

SEQ ID NO: 2378605 - protein, 5 aa, Entamoeba dispar
VSCST

SEQ ID NO: 2378606 - protein, 4 aa, Entamoeba dispar
VSDE

SEQ ID NO: 2378607 - protein, 11 aa, Entamoeba dispar
VSDEDEDEGKY

SEQ ID NO: 2378608 - protein, 14 aa, Entamoeba dispar
VSDEEVEKIRSHTP

SEQ ID NO: 2378609 - protein, 5 aa, Entamoeba dispar
VSDER

SEQ ID NO: 2378610 - protein, 7 aa, Entamoeba dispar
VSDPLKS

SEQ ID NO: 2378611 - protein, 4 aa, Entamoeba dispar
VSDS

SEQ ID NO: 2378612 - protein, 12 aa, Entamoeba dispar
VSDSNKNIDETA

SEQ ID NO: 2378613 - protein, 21 aa, Entamoeba dispar
VSDSPNPETTEINGDYGEYDR

SEQ ID NO: 2378614 - protein, 8 aa, Entamoeba dispar
VSDTGNGR

SEQ ID NO: 2378615 - protein, 12 aa, Entamoeba dispar
VSEDSGDEEKYR

SEQ ID NO: 2378616 - protein, 5 aa, Entamoeba dispar
VSEEK

SEQ ID NO: 2378617 - protein, 6 aa, Entamoeba dispar
VSEETI

SEQ ID NO: 2378618 - protein, 9 aa, Entamoeba dispar
VSEKEESGF

SEQ ID NO: 2378619 - protein, 7 aa, Entamoeba dispar
VSEKSKY

SEQ ID NO: 2378620 - protein, 7 aa, Entamoeba dispar
VSENEKL

SEQ ID NO: 2378621 - protein, 9 aa, Entamoeba dispar
VSEPIPNVK

SEQ ID NO: 2378622 - protein, 8 aa, Entamoeba dispar
VSEPPIKP

SEQ ID NO: 2378623 - protein, 34 aa, Entamoeba dispar
VSERSLANKELSTGIGTPTYMSPESLQGTSNYSY

SEQ ID NO: 2378624 - protein, 5 aa, Entamoeba dispar
VSESN

SEQ ID NO: 2378625 - protein, 6 aa, Entamoeba dispar
VSFNQQ

SEQ ID NO: 2378626 - protein, 14 aa, Entamoeba dispar
VSGDEFDEEHSECE

SEQ ID NO: 2378627 - protein, 8 aa, Entamoeba dispar
VSGHEQTV

SEQ ID NO: 2378628 - protein, 10 aa, Entamoeba dispar
VSGKCNSNSA

SEQ ID NO: 2378629 - protein, 4 aa, Entamoeba dispar
VSGR

SEQ ID NO: 2378630 - protein, 6 aa, Entamoeba dispar
VSGSRI

SEQ ID NO: 2378631 - protein, 6 aa, Entamoeba dispar
VSGTTS

SEQ ID NO: 2378632 - protein, 18 aa, Entamoeba dispar
VSHNTTSSIKAYRKSSFS

SEQ ID NO: 2378633 - protein, 4 aa, Entamoeba dispar
VSID

SEQ ID NO: 2378634 - protein, 16 aa, Entamoeba dispar
VSIDDDNPDTSNSSNS

SEQ ID NO: 2378635 - protein, 4 aa, Entamoeba dispar
VSKE

SEQ ID NO: 2378636 - protein, 9 aa, Entamoeba dispar
VSKEKKIEK

SEQ ID NO: 2378637 - protein, 8 aa, Entamoeba dispar
VSKEPTSQ

SEQ ID NO: 2378638 - protein, 4 aa, Entamoeba dispar
VSKK

SEQ ID NO: 2378639 - protein, 30 aa, Entamoeba dispar
VSKNSTRYSTYGTSSDISEGEINEDIEQGN

SEQ ID NO: 2378640 - protein, 7 aa, Entamoeba dispar
VSKQISI

SEQ ID NO: 2378641 - protein, 6 aa, Entamoeba dispar
VSKQPI

SEQ ID NO: 2378642 - protein, 11 aa, Entamoeba dispar
VSLGKEKKKSG

SEQ ID NO: 2378643 - protein, 10 aa, Entamoeba dispar
VSNAKTMKEL

SEQ ID NO: 2378644 - protein, 5 aa, Entamoeba dispar
VSNDE

SEQ ID NO: 2378645 - protein, 6 aa, Entamoeba dispar
VSNDGS

SEQ ID NO: 2378646 - protein, 18 aa, Entamoeba dispar
VSNDNNQGYAKPRIYESE

SEQ ID NO: 2378647 - protein, 8 aa, Entamoeba dispar
VSNKENVE

SEQ ID NO: 2378648 - protein, 9 aa, Entamoeba dispar
VSNNAKLER

SEQ ID NO: 2378649 - protein, 7 aa, Entamoeba dispar
VSNNGAL

SEQ ID NO: 2378650 - protein, 6 aa, Entamoeba dispar
VSNSTI

SEQ ID NO: 2378651 - protein, 7 aa, Entamoeba dispar
VSPEDKL

SEQ ID NO: 2378652 - protein, 7 aa, Entamoeba dispar
VSPEPLK

SEQ ID NO: 2378653 - protein, 17 aa, Entamoeba dispar
VSPLESASLEPATVGSG

SEQ ID NO: 2378654 - protein, 7 aa, Entamoeba dispar
VSPMQKK

SEQ ID NO: 2378655 - protein, 8 aa, Entamoeba dispar
VSPPGTYL

SEQ ID NO: 2378656 - protein, 10 aa, Entamoeba dispar
VSPPKGSLGW

SEQ ID NO: 2378657 - protein, 11 aa, Entamoeba dispar
VSPQNEKCNNV

SEQ ID NO: 2378658 - protein, 12 aa, Entamoeba dispar
VSPQNEKCNSVG

SEQ ID NO: 2378659 - protein, 5 aa, Entamoeba dispar
VSPSE

SEQ ID NO: 2378660 - protein, 17 aa, Entamoeba dispar
VSPSQSQSNIQNSFDKR

SEQ ID NO: 2378661 - protein, 9 aa, Entamoeba dispar
VSPYEENPC

SEQ ID NO: 2378662 - protein, 6 aa, Entamoeba dispar
VSQGQR

SEQ ID NO: 2378663 - protein, 5 aa, Entamoeba dispar
VSQSA

SEQ ID NO: 2378664 - protein, 6 aa, Entamoeba dispar
VSQTEK

SEQ ID NO: 2378665 - protein, 8 aa, Entamoeba dispar
VSQTKKQY

SEQ ID NO: 2378666 - protein, 7 aa, Entamoeba dispar
VSRDHTY

SEQ ID NO: 2378667 - protein, 8 aa, Entamoeba dispar
VSRPFSDS

SEQ ID NO: 2378668 - protein, 8 aa, Entamoeba dispar
VSRSQTMK

SEQ ID NO: 2378669 - protein, 6 aa, Entamoeba dispar
VSSAKG

SEQ ID NO: 2378670 - protein, 8 aa, Entamoeba dispar
VSSDNAVH

SEQ ID NO: 2378671 - protein, 9 aa, Entamoeba dispar
VSSEGGTYK

SEQ ID NO: 2378672 - protein, 6 aa, Entamoeba dispar
VSSGVS

SEQ ID NO: 2378673 - protein, 5 aa, Entamoeba dispar
VSSKD

SEQ ID NO: 2378674 - protein, 23 aa, Entamoeba dispar
VSSKPKSETKNTVGYCGADSKSD

SEQ ID NO: 2378675 - protein, 4 aa, Entamoeba dispar
VSSL

SEQ ID NO: 2378676 - protein, 7 aa, Entamoeba dispar
VSSNDNN

SEQ ID NO: 2378677 - protein, 26 aa, Entamoeba dispar
VSSNKEERDADRSNSQEEDNGGDIYG

SEQ ID NO: 2378678 - protein, 8 aa, Entamoeba dispar
VSSPENNW

SEQ ID NO: 2378679 - protein, 12 aa, Entamoeba dispar
VSSQAKKPKRDV

SEQ ID NO: 2378680 - protein, 10 aa, Entamoeba dispar
VSSSSKELNE

SEQ ID NO: 2378681 - protein, 29 aa, Entamoeba dispar
VSSTKLQSATPTFNENQNSPKTPKGQKHS

SEQ ID NO: 2378682 - protein, 6 aa, Entamoeba dispar
VSSTQK

SEQ ID NO: 2378683 - protein, 27 aa, Entamoeba dispar
VSTNSPNNLTHSSENQIDTLSPPSESL

SEQ ID NO: 2378684 - protein, 6 aa, Entamoeba dispar
VSTSPT

SEQ ID NO: 2378685 - protein, 4 aa, Entamoeba dispar
VSVT

SEQ ID NO: 2378686 - protein, 11 aa, Entamoeba dispar
VSYQIQTTGSN

SEQ ID NO: 2378687 - protein, 11 aa, Entamoeba dispar
VSYTPQPNYNQ

SEQ ID NO: 2378688 - protein, 9 aa, Entamoeba dispar
VTASSGDNQ

SEQ ID NO: 2378689 - protein, 14 aa, Entamoeba dispar
VTCPSEQKEELLND

SEQ ID NO: 2378690 - protein, 8 aa, Entamoeba dispar
VTDCSDSF

SEQ ID NO: 2378691 - protein, 7 aa, Entamoeba dispar
VTDFGTS

SEQ ID NO: 2378692 - protein, 4 aa, Entamoeba dispar
VTDG

SEQ ID NO: 2378693 - protein, 9 aa, Entamoeba dispar
VTDPSGSNI

SEQ ID NO: 2378694 - protein, 12 aa, Entamoeba dispar
VTDTSSSVESIR

SEQ ID NO: 2378695 - protein, 4 aa, Entamoeba dispar
VTEN

SEQ ID NO: 2378696 - protein, 8 aa, Entamoeba dispar
VTENGLTD

SEQ ID NO: 2378697 - protein, 7 aa, Entamoeba dispar
VTEPPTK

SEQ ID NO: 2378698 - protein, 8 aa, Entamoeba dispar
VTETTTGS

SEQ ID NO: 2378699 - protein, 12 aa, Entamoeba dispar
VTGDGTNDVPAF

SEQ ID NO: 2378700 - protein, 14 aa, Entamoeba dispar
VTGDGTNDVPALKE

SEQ ID NO: 2378701 - protein, 6 aa, Entamoeba dispar
VTGEET

SEQ ID NO: 2378702 - protein, 5 aa, Entamoeba dispar
VTGGF

SEQ ID NO: 2378703 - protein, 8 aa, Entamoeba dispar
VTGGGQVA

SEQ ID NO: 2378704 - protein, 36 aa, Entamoeba dispar
VTGKGRKKTGSVNHSEITELSDTTSSDDIKRSGKEN

SEQ ID NO: 2378705 - protein, 4 aa, Entamoeba dispar
VTGQ

SEQ ID NO: 2378706 - protein, 8 aa, Entamoeba dispar
VTGTNNVG

SEQ ID NO: 2378707 - protein, 6 aa, Entamoeba dispar
VTGYAT

SEQ ID NO: 2378708 - protein, 5 aa, Entamoeba dispar
VTITR

SEQ ID NO: 2378709 - protein, 7 aa, Entamoeba dispar
VTKQNEM

SEQ ID NO: 2378710 - protein, 8 aa, Entamoeba dispar
VTKSLQES

SEQ ID NO: 2378711 - protein, 17 aa, Entamoeba dispar
VTKTEKLYNEEEENNKI

SEQ ID NO: 2378712 - protein, 12 aa, Entamoeba dispar
VTLEDGKEYDYT

SEQ ID NO: 2378713 - protein, 4 aa, Entamoeba dispar
VTNG

SEQ ID NO: 2378714 - protein, 5 aa, Entamoeba dispar
VTNKQ

SEQ ID NO: 2378715 - protein, 5 aa, Entamoeba dispar
VTNNE

SEQ ID NO: 2378716 - protein, 15 aa, Entamoeba dispar
VTPDTTFDGATLPDK

SEQ ID NO: 2378717 - protein, 13 aa, Entamoeba dispar
VTPIPKASIAPGS

SEQ ID NO: 2378718 - protein, 6 aa, Entamoeba dispar
VTPKQK

SEQ ID NO: 2378719 - protein, 10 aa, Entamoeba dispar
VTPNGKREIG

SEQ ID NO: 2378720 - protein, 7 aa, Entamoeba dispar
VTPNQHC

SEQ ID NO: 2378721 - protein, 8 aa, Entamoeba dispar
VTPPSTLQ

SEQ ID NO: 2378722 - protein, 6 aa, Entamoeba dispar
VTPSIP

SEQ ID NO: 2378723 - protein, 5 aa, Entamoeba dispar
VTQPI

SEQ ID NO: 2378724 - protein, 6 aa, Entamoeba dispar
VTQQNN

SEQ ID NO: 2378725 - protein, 12 aa, Entamoeba dispar
VTQSRRNQGIGK

SEQ ID NO: 2378726 - protein, 11 aa, Entamoeba dispar
VTQTGKTEPID

SEQ ID NO: 2378727 - protein, 10 aa, Entamoeba dispar
VTQYDDDDNE

SEQ ID NO: 2378728 - protein, 6 aa, Entamoeba dispar
VTRDGE

SEQ ID NO: 2378729 - protein, 8 aa, Entamoeba dispar
VTRSASGQ

SEQ ID NO: 2378730 - protein, 9 aa, Entamoeba dispar
VTRSDGSAS

SEQ ID NO: 2378731 - protein, 5 aa, Entamoeba dispar
VTRSQ

SEQ ID NO: 2378732 - protein, 6 aa, Entamoeba dispar
VTSASV

SEQ ID NO: 2378733 - protein, 7 aa, Entamoeba dispar
VTSNSSL

SEQ ID NO: 2378734 - protein, 4 aa, Entamoeba dispar
VTSP

SEQ ID NO: 2378735 - protein, 7 aa, Entamoeba dispar
VTSPPSN

SEQ ID NO: 2378736 - protein, 5 aa, Entamoeba dispar
VTSPT

SEQ ID NO: 2378737 - protein, 8 aa, Entamoeba dispar
VTSQSGKV

SEQ ID NO: 2378738 - protein, 14 aa, Entamoeba dispar
VTSRQTRVQNMLDE

SEQ ID NO: 2378739 - protein, 8 aa, Entamoeba dispar
VTSSDSHR

SEQ ID NO: 2378740 - protein, 6 aa, Entamoeba dispar
VTSSDT

SEQ ID NO: 2378741 - protein, 26 aa, Entamoeba dispar
VTTCSNGKYYGTTTCTECSNSCSTCN

SEQ ID NO: 2378742 - protein, 5 aa, Entamoeba dispar
VTTPD

SEQ ID NO: 2378743 - protein, 4 aa, Entamoeba dispar
VTTQ

SEQ ID NO: 2378744 - protein, 4 aa, Entamoeba dispar
VTTS

SEQ ID NO: 2378745 - protein, 8 aa, Entamoeba dispar
VTTSNGCM

SEQ ID NO: 2378746 - protein, 8 aa, Entamoeba dispar
VTTSTTGQ

SEQ ID NO: 2378747 - protein, 4 aa, Entamoeba dispar
VTVN

SEQ ID NO: 2378748 - protein, 6 aa, Entamoeba dispar
VTVNAG

SEQ ID NO: 2378749 - protein, 13 aa, Entamoeba dispar
VTVPGQSGKDSFY

SEQ ID NO: 2378750 - protein, 22 aa, Entamoeba dispar
VTVTENSADVVSRNTKETNRDD

SEQ ID NO: 2378751 - protein, 7 aa, Entamoeba dispar
VTYEEGK

SEQ ID NO: 2378752 - protein, 12 aa, Entamoeba dispar
VTYGTKGKRSTD

SEQ ID NO: 2378753 - protein, 22 aa, Entamoeba dispar
VVDANEDCDLSSGVNDTQCTDS

SEQ ID NO: 2378754 - protein, 5 aa, Entamoeba dispar
VVEEE

SEQ ID NO: 2378755 - protein, 5 aa, Entamoeba dispar
VVGGE

SEQ ID NO: 2378756 - protein, 6 aa, Entamoeba dispar
VVNGEC

SEQ ID NO: 2378757 - protein, 9 aa, Entamoeba dispar
VVNGECKEC

SEQ ID NO: 2378758 - protein, 18 aa, Entamoeba dispar
VVNGQVYKKSKKVHKKTF

SEQ ID NO: 2378759 - protein, 17 aa, Entamoeba dispar
VVNPGTSSERKTNYKKY

SEQ ID NO: 2378760 - protein, 7 aa, Entamoeba dispar
VVPMSTG

SEQ ID NO: 2378761 - protein, 10 aa, Entamoeba dispar
VVTPTKPKNH

SEQ ID NO: 2378762 - protein, 12 aa, Entamoeba dispar
VYESDNTGKEIV

SEQ ID NO: 2378763 - protein, 7 aa, Entamoeba dispar
VYGDNTN

SEQ ID NO: 2378764 - protein, 6 aa, Entamoeba dispar
VYGKES

SEQ ID NO: 2378765 - protein, 5 aa, Entamoeba dispar
VYNYD

SEQ ID NO: 2378766 - protein, 11 aa, Entamoeba dispar
VYPNGPNDDGL

SEQ ID NO: 2378767 - protein, 11 aa, Entamoeba dispar
VYSSNGKAGGW

SEQ ID NO: 2378768 - protein, 9 aa, Entamoeba dispar
VYSSTGSKW

SEQ ID NO: 2378769 - protein, 7 aa, Entamoeba dispar
VYTKETK

SEQ ID NO: 2378770 - protein, 4 aa, Entamoeba dispar
WADS

SEQ ID NO: 2378771 - protein, 8 aa, Entamoeba dispar
WASKGYRT

SEQ ID NO: 2378772 - protein, 8 aa, Entamoeba dispar
WDENEDKQ

SEQ ID NO: 2378773 - protein, 18 aa, Entamoeba dispar
WDRKEKKRFNPKKSSSQY

SEQ ID NO: 2378774 - protein, 5 aa, Entamoeba dispar
WDTGY

SEQ ID NO: 2378775 - protein, 4 aa, Entamoeba dispar
WDYT

SEQ ID NO: 2378776 - protein, 4 aa, Entamoeba dispar
WEEP

SEQ ID NO: 2378777 - protein, 6 aa, Entamoeba dispar
WEESMN

SEQ ID NO: 2378778 - protein, 4 aa, Entamoeba dispar
WEKP

SEQ ID NO: 2378779 - protein, 7 aa, Entamoeba dispar
WENKGKR

SEQ ID NO: 2378780 - protein, 8 aa, Entamoeba dispar
WEQQKERE

SEQ ID NO: 2378781 - protein, 7 aa, Entamoeba dispar
WESTPTR

SEQ ID NO: 2378782 - protein, 9 aa, Entamoeba dispar
WEYEETSHS

SEQ ID NO: 2378783 - protein, 6 aa, Entamoeba dispar
WGNAGH

SEQ ID NO: 2378784 - protein, 4 aa, Entamoeba dispar
WGNK

SEQ ID NO: 2378785 - protein, 5 aa, Entamoeba dispar
WGTGR

SEQ ID NO: 2378786 - protein, 11 aa, Entamoeba dispar
WGTREQHHEGS

SEQ ID NO: 2378787 - protein, 14 aa, Entamoeba dispar
WHEPSKDGSKCEYA

SEQ ID NO: 2378788 - protein, 8 aa, Entamoeba dispar
WKANGKES

SEQ ID NO: 2378789 - protein, 15 aa, Entamoeba dispar
WKDDENFESFISNNS

SEQ ID NO: 2378790 - protein, 12 aa, Entamoeba dispar
WKEEEKVEKIRK

SEQ ID NO: 2378791 - protein, 7 aa, Entamoeba dispar
WKEKSPK

SEQ ID NO: 2378792 - protein, 5 aa, Entamoeba dispar
WKGDP

SEQ ID NO: 2378793 - protein, 11 aa, Entamoeba dispar
WKKNGDESSTF

SEQ ID NO: 2378794 - protein, 5 aa, Entamoeba dispar
WKNPA

SEQ ID NO: 2378795 - protein, 9 aa, Entamoeba dispar
WKQEAKERL

SEQ ID NO: 2378796 - protein, 8 aa, Entamoeba dispar
WKQEPEQR

SEQ ID NO: 2378797 - protein, 10 aa, Entamoeba dispar
WKQNPSERYN

SEQ ID NO: 2378798 - protein, 16 aa, Entamoeba dispar
WKSGDMERRIEKEQEE

SEQ ID NO: 2378799 - protein, 14 aa, Entamoeba dispar
WKTQYGKAPYALSS

SEQ ID NO: 2378800 - protein, 6 aa, Entamoeba dispar
WNDEAI

SEQ ID NO: 2378801 - protein, 27 aa, Entamoeba dispar
WNEPIKSDIKRRPIKKLGENNDSYRRN

SEQ ID NO: 2378802 - protein, 6 aa, Entamoeba dispar
WNEPNK

SEQ ID NO: 2378803 - protein, 4 aa, Entamoeba dispar
WNKE

SEQ ID NO: 2378804 - protein, 6 aa, Entamoeba dispar
WNNAGT

SEQ ID NO: 2378805 - protein, 8 aa, Entamoeba dispar
WNNGRAQG

SEQ ID NO: 2378806 - protein, 11 aa, Entamoeba dispar
WNQNKGTCEAC

SEQ ID NO: 2378807 - protein, 5 aa, Entamoeba dispar
WNRNQ

SEQ ID NO: 2378808 - protein, 4 aa, Entamoeba dispar
WNRR

SEQ ID NO: 2378809 - protein, 5 aa, Entamoeba dispar
WNSKK

SEQ ID NO: 2378810 - protein, 9 aa, Entamoeba dispar
WNSNSEKVK

SEQ ID NO: 2378811 - protein, 7 aa, Entamoeba dispar
WNTEEKK

SEQ ID NO: 2378812 - protein, 5 aa, Entamoeba dispar
WPEVK

SEQ ID NO: 2378813 - protein, 9 aa, Entamoeba dispar
WPSLSTANA

SEQ ID NO: 2378814 - protein, 8 aa, Entamoeba dispar
WQNSGSDV

SEQ ID NO: 2378815 - protein, 5 aa, Entamoeba dispar
WQPIP

SEQ ID NO: 2378816 - protein, 12 aa, Entamoeba dispar
WQPSTNKGDNQC

SEQ ID NO: 2378817 - protein, 4 aa, Entamoeba dispar
WQTT

SEQ ID NO: 2378818 - protein, 7 aa, Entamoeba dispar
WQTTGTA

SEQ ID NO: 2378819 - protein, 4 aa, Entamoeba dispar
WRAQ

SEQ ID NO: 2378820 - protein, 4 aa, Entamoeba dispar
WRNT

SEQ ID NO: 2378821 - protein, 6 aa, Entamoeba dispar
WSDNKN

SEQ ID NO: 2378822 - protein, 5 aa, Entamoeba dispar
WSEER

SEQ ID NO: 2378823 - protein, 5 aa, Entamoeba dispar
WSGNK

SEQ ID NO: 2378824 - protein, 4 aa, Entamoeba dispar
WSPN

SEQ ID NO: 2378825 - protein, 12 aa, Entamoeba dispar
WSSGTGFAGVAG

SEQ ID NO: 2378826 - protein, 5 aa, Entamoeba dispar
WSTNE

SEQ ID NO: 2378827 - protein, 4 aa, Entamoeba dispar
WTAE

SEQ ID NO: 2378828 - protein, 4 aa, Entamoeba dispar
WTEN

SEQ ID NO: 2378829 - protein, 8 aa, Entamoeba dispar
WTGGGTTF

SEQ ID NO: 2378830 - protein, 12 aa, Entamoeba dispar
WTISDTNGKCRY

SEQ ID NO: 2378831 - protein, 4 aa, Entamoeba dispar
WTPY

SEQ ID NO: 2378832 - protein, 6 aa, Entamoeba dispar
WTQGSP

SEQ ID NO: 2378833 - protein, 6 aa, Entamoeba dispar
WTYEQS

SEQ ID NO: 2378834 - protein, 11 aa, Entamoeba dispar
WYTKPNTIKYG

SEQ ID NO: 2378835 - protein, 16 aa, Entamoeba dispar
YAAGGTLKSSLGSSTS

SEQ ID NO: 2378836 - protein, 21 aa, Entamoeba dispar
YADADKCKTNTEGTADENKYA

SEQ ID NO: 2378837 - protein, 9 aa, Entamoeba dispar
YADEDDPPV

SEQ ID NO: 2378838 - protein, 19 aa, Entamoeba dispar
YAGASGKSSNGSDANYPTF

SEQ ID NO: 2378839 - protein, 17 aa, Entamoeba dispar
YAGEGCKTYSDNVGCTQ

SEQ ID NO: 2378840 - protein, 8 aa, Entamoeba dispar
YAGRPRPN

SEQ ID NO: 2378841 - protein, 8 aa, Entamoeba dispar
YAGSDEVH

SEQ ID NO: 2378842 - protein, 11 aa, Entamoeba dispar
YAIKDGECEEV

SEQ ID NO: 2378843 - protein, 13 aa, Entamoeba dispar
YAKGNNVAELTEK

SEQ ID NO: 2378844 - protein, 13 aa, Entamoeba dispar
YAKTESSLKRSSY

SEQ ID NO: 2378845 - protein, 8 aa, Entamoeba dispar
YAPQNQYA

SEQ ID NO: 2378846 - protein, 7 aa, Entamoeba dispar
YASKPMG

SEQ ID NO: 2378847 - protein, 7 aa, Entamoeba dispar
YASKTIP

SEQ ID NO: 2378848 - protein, 7 aa, Entamoeba dispar
YASNTIP

SEQ ID NO: 2378849 - protein, 6 aa, Entamoeba dispar
YASRSY

SEQ ID NO: 2378850 - protein, 10 aa, Entamoeba dispar
YASSSTARFG

SEQ ID NO: 2378851 - protein, 13 aa, Entamoeba dispar
YASSTNDAPIQEA

SEQ ID NO: 2378852 - protein, 8 aa, Entamoeba dispar
YCEKTTPE

SEQ ID NO: 2378853 - protein, 9 aa, Entamoeba dispar
YCESSTDCS

SEQ ID NO: 2378854 - protein, 10 aa, Entamoeba dispar
YCNQNDCTCP

SEQ ID NO: 2378855 - protein, 9 aa, Entamoeba dispar
YCNSQEQNG

SEQ ID NO: 2378856 - protein, 7 aa, Entamoeba dispar
YCPGNDN

SEQ ID NO: 2378857 - protein, 5 aa, Entamoeba dispar
YCRNG

SEQ ID NO: 2378858 - protein, 18 aa, Entamoeba dispar
YCSGGSYKRYAKEGSDEA

SEQ ID NO: 2378859 - protein, 9 aa, Entamoeba dispar
YCSSNNGNI

SEQ ID NO: 2378860 - protein, 9 aa, Entamoeba dispar
YCTEGQCDN

SEQ ID NO: 2378861 - protein, 4 aa, Entamoeba dispar
YCTN

SEQ ID NO: 2378862 - protein, 14 aa, Entamoeba dispar
YCTSPERNNTNQCK

SEQ ID NO: 2378863 - protein, 10 aa, Entamoeba dispar
YCTTNDEGKG

SEQ ID NO: 2378864 - protein, 4 aa, Entamoeba dispar
YDAA

SEQ ID NO: 2378865 - protein, 10 aa, Entamoeba dispar
YDAKTGSTSV

SEQ ID NO: 2378866 - protein, 9 aa, Entamoeba dispar
YDAKTGTCK

SEQ ID NO: 2378867 - protein, 6 aa, Entamoeba dispar
YDDDRQ

SEQ ID NO: 2378868 - protein, 6 aa, Entamoeba dispar
YDDGTM

SEQ ID NO: 2378869 - protein, 7 aa, Entamoeba dispar
YDDNGDV

SEQ ID NO: 2378870 - protein, 13 aa, Entamoeba dispar
YDDNTCGGSNPRI

SEQ ID NO: 2378871 - protein, 19 aa, Entamoeba dispar
YDEEGDKQNEPIGTAGIPG

SEQ ID NO: 2378872 - protein, 15 aa, Entamoeba dispar
YDEGYSDEESTDKNE

SEQ ID NO: 2378873 - protein, 12 aa, Entamoeba dispar
YDEKDHKGETNV

SEQ ID NO: 2378874 - protein, 6 aa, Entamoeba dispar
YDEKKR

SEQ ID NO: 2378875 - protein, 8 aa, Entamoeba dispar
YDEMQNND

SEQ ID NO: 2378876 - protein, 16 aa, Entamoeba dispar
YDENELSSLGGPLIQY

SEQ ID NO: 2378877 - protein, 10 aa, Entamoeba dispar
YDFSSRGIKP

SEQ ID NO: 2378878 - protein, 4 aa, Entamoeba dispar
YDGI

SEQ ID NO: 2378879 - protein, 7 aa, Entamoeba dispar
YDGKEKG

SEQ ID NO: 2378880 - protein, 7 aa, Entamoeba dispar
YDGPNGQ

SEQ ID NO: 2378881 - protein, 7 aa, Entamoeba dispar
YDGSNKN

SEQ ID NO: 2378882 - protein, 4 aa, Entamoeba dispar
YDKE

SEQ ID NO: 2378883 - protein, 12 aa, Entamoeba dispar
YDKQYNNTEKRS

SEQ ID NO: 2378884 - protein, 7 aa, Entamoeba dispar
YDKTPNS

SEQ ID NO: 2378885 - protein, 4 aa, Entamoeba dispar
YDNG

SEQ ID NO: 2378886 - protein, 7 aa, Entamoeba dispar
YDNNDSF

SEQ ID NO: 2378887 - protein, 11 aa, Entamoeba dispar
YDPKSTYNKTC

SEQ ID NO: 2378888 - protein, 9 aa, Entamoeba dispar
YDPNVSPDK

SEQ ID NO: 2378889 - protein, 6 aa, Entamoeba dispar
YDPQHN

SEQ ID NO: 2378890 - protein, 7 aa, Entamoeba dispar
YDQEDLQ

SEQ ID NO: 2378891 - protein, 4 aa, Entamoeba dispar
YDQF

SEQ ID NO: 2378892 - protein, 7 aa, Entamoeba dispar
YDRQSAS

SEQ ID NO: 2378893 - protein, 18 aa, Entamoeba dispar
YDSPSYDDIADKQRNELS

SEQ ID NO: 2378894 - protein, 7 aa, Entamoeba dispar
YDSQTTT

SEQ ID NO: 2378895 - protein, 9 aa, Entamoeba dispar
YDSSDELEP

SEQ ID NO: 2378896 - protein, 15 aa, Entamoeba dispar
YDSSLNKSKDLNRRL

SEQ ID NO: 2378897 - protein, 8 aa, Entamoeba dispar
YDTDSGEV

SEQ ID NO: 2378898 - protein, 11 aa, Entamoeba dispar
YDTEGRGELDS

SEQ ID NO: 2378899 - protein, 7 aa, Entamoeba dispar
YDTKNNS

SEQ ID NO: 2378900 - protein, 8 aa, Entamoeba dispar
YDTQTNPV

SEQ ID NO: 2378901 - protein, 13 aa, Entamoeba dispar
YDTRRGLNEATNS

SEQ ID NO: 2378902 - protein, 5 aa, Entamoeba dispar
YDVPQ

SEQ ID NO: 2378903 - protein, 4 aa, Entamoeba dispar
YEAR

SEQ ID NO: 2378904 - protein, 7 aa, Entamoeba dispar
YEAVPDD

SEQ ID NO: 2378905 - protein, 13 aa, Entamoeba dispar
YECQNSQCTSCSD

SEQ ID NO: 2378906 - protein, 10 aa, Entamoeba dispar
YEDDRDYGSI

SEQ ID NO: 2378907 - protein, 9 aa, Entamoeba dispar
YEDEKNTLQ

SEQ ID NO: 2378908 - protein, 12 aa, Entamoeba dispar
YEDGNKAPINRT

SEQ ID NO: 2378909 - protein, 5 aa, Entamoeba dispar
YEDIS

SEQ ID NO: 2378910 - protein, 10 aa, Entamoeba dispar
YEDNSNTTSI

SEQ ID NO: 2378911 - protein, 4 aa, Entamoeba dispar
YEDP

SEQ ID NO: 2378912 - protein, 4 aa, Entamoeba dispar
YEDR

SEQ ID NO: 2378913 - protein, 11 aa, Entamoeba dispar
YEDSGNEENYY

SEQ ID NO: 2378914 - protein, 5 aa, Entamoeba dispar
YEEED

SEQ ID NO: 2378915 - protein, 11 aa, Entamoeba dispar
YEEEGETKDWE

SEQ ID NO: 2378916 - protein, 5 aa, Entamoeba dispar
YEEIN

SEQ ID NO: 2378917 - protein, 4 aa, Entamoeba dispar
YEEK

SEQ ID NO: 2378918 - protein, 6 aa, Entamoeba dispar
YEEKTN

SEQ ID NO: 2378919 - protein, 6 aa, Entamoeba dispar
YEENHN

SEQ ID NO: 2378920 - protein, 19 aa, Entamoeba dispar
YEENSNPQSQQVSAGQQIG

SEQ ID NO: 2378921 - protein, 10 aa, Entamoeba dispar
YEEQRNNNIQ

SEQ ID NO: 2378922 - protein, 23 aa, Entamoeba dispar
YEEQSSYDDTIPDINETDLPSQD

SEQ ID NO: 2378923 - protein, 16 aa, Entamoeba dispar
YEETGGYTSSDCDSLE

SEQ ID NO: 2378924 - protein, 5 aa, Entamoeba dispar
YEEVN

SEQ ID NO: 2378925 - protein, 4 aa, Entamoeba dispar
YEGE

SEQ ID NO: 2378926 - protein, 7 aa, Entamoeba dispar
YEGEEGK

SEQ ID NO: 2378927 - protein, 8 aa, Entamoeba dispar
YEGEESIT

SEQ ID NO: 2378928 - protein, 5 aa, Entamoeba dispar
YEGGP

SEQ ID NO: 2378929 - protein, 4 aa, Entamoeba dispar
YEGI

SEQ ID NO: 2378930 - protein, 5 aa, Entamoeba dispar
YEGKE

SEQ ID NO: 2378931 - protein, 6 aa, Entamoeba dispar
YEGNAV

SEQ ID NO: 2378932 - protein, 19 aa, Entamoeba dispar
YEGSINKITPKSSNDKYFS

SEQ ID NO: 2378933 - protein, 15 aa, Entamoeba dispar
YEGSINKITSTSLND

SEQ ID NO: 2378934 - protein, 21 aa, Entamoeba dispar
YEGSINQLTPKSSNDKYFSQT

SEQ ID NO: 2378935 - protein, 16 aa, Entamoeba dispar
YEGSINQVTPKSLNDK

SEQ ID NO: 2378936 - protein, 8 aa, Entamoeba dispar
YEGSSSRC

SEQ ID NO: 2378937 - protein, 20 aa, Entamoeba dispar
YEIEKSDYKQWEQTNSDEPL

SEQ ID NO: 2378938 - protein, 10 aa, Entamoeba dispar
YEKESSTGRC

SEQ ID NO: 2378939 - protein, 9 aa, Entamoeba dispar
YEKGRADFR

SEQ ID NO: 2378940 - protein, 5 aa, Entamoeba dispar
YEKGS

SEQ ID NO: 2378941 - protein, 4 aa, Entamoeba dispar
YEKH

SEQ ID NO: 2378942 - protein, 8 aa, Entamoeba dispar
YEKSSKII

SEQ ID NO: 2378943 - protein, 23 aa, Entamoeba dispar
YENASSEQLSSNERYKELSQSTH

SEQ ID NO: 2378944 - protein, 4 aa, Entamoeba dispar
YENE

SEQ ID NO: 2378945 - protein, 9 aa, Entamoeba dispar
YENKTFNTT

SEQ ID NO: 2378946 - protein, 9 aa, Entamoeba dispar
YENKTSLNN

SEQ ID NO: 2378947 - protein, 9 aa, Entamoeba dispar
YENNERTEL

SEQ ID NO: 2378948 - protein, 8 aa, Entamoeba dispar
YENNTENE

SEQ ID NO: 2378949 - protein, 6 aa, Entamoeba dispar
YENPSD

SEQ ID NO: 2378950 - protein, 6 aa, Entamoeba dispar
YENQGK

SEQ ID NO: 2378951 - protein, 8 aa, Entamoeba dispar
YENSDENF

SEQ ID NO: 2378952 - protein, 6 aa, Entamoeba dispar
YENSPL

SEQ ID NO: 2378953 - protein, 4 aa, Entamoeba dispar
YENY

SEQ ID NO: 2378954 - protein, 9 aa, Entamoeba dispar
YEPELPDGI

SEQ ID NO: 2378955 - protein, 5 aa, Entamoeba dispar
YEQDG

SEQ ID NO: 2378956 - protein, 9 aa, Entamoeba dispar
YEQKGTSAE

SEQ ID NO: 2378957 - protein, 14 aa, Entamoeba dispar
YEQNKKDPLSCTKK

SEQ ID NO: 2378958 - protein, 14 aa, Entamoeba dispar
YEQPKSQEEEEYSV

SEQ ID NO: 2378959 - protein, 8 aa, Entamoeba dispar
YEQTKESV

SEQ ID NO: 2378960 - protein, 7 aa, Entamoeba dispar
YESIGKE

SEQ ID NO: 2378961 - protein, 11 aa, Entamoeba dispar
YESNNEPNERC

SEQ ID NO: 2378962 - protein, 12 aa, Entamoeba dispar
YESQGNGKCSVR

SEQ ID NO: 2378963 - protein, 5 aa, Entamoeba dispar
YESST

SEQ ID NO: 2378964 - protein, 20 aa, Entamoeba dispar
YESVNGKEVKQSNDSKSKKL

SEQ ID NO: 2378965 - protein, 10 aa, Entamoeba dispar
YETGSKAEKA

SEQ ID NO: 2378966 - protein, 9 aa, Entamoeba dispar
YETLTDPSK

SEQ ID NO: 2378967 - protein, 6 aa, Entamoeba dispar
YETYTK

SEQ ID NO: 2378968 - protein, 6 aa, Entamoeba dispar
YEYNNK

SEQ ID NO: 2378969 - protein, 5 aa, Entamoeba dispar
YFDGS

SEQ ID NO: 2378970 - protein, 5 aa, Entamoeba dispar
YFETQ

SEQ ID NO: 2378971 - protein, 7 aa, Entamoeba dispar
YFGTPDT

SEQ ID NO: 2378972 - protein, 8 aa, Entamoeba dispar
YFNTNDKT

SEQ ID NO: 2378973 - protein, 6 aa, Entamoeba dispar
YFPEES

SEQ ID NO: 2378974 - protein, 7 aa, Entamoeba dispar
YFSPADN

SEQ ID NO: 2378975 - protein, 4 aa, Entamoeba dispar
YGDE

SEQ ID NO: 2378976 - protein, 7 aa, Entamoeba dispar
YGDGEAS

SEQ ID NO: 2378977 - protein, 5 aa, Entamoeba dispar
YGECD

SEQ ID NO: 2378978 - protein, 26 aa, Entamoeba dispar
YGEDFTKELKKKKAPINNAGFGGGDV

SEQ ID NO: 2378979 - protein, 9 aa, Entamoeba dispar
YGEETGKTN

SEQ ID NO: 2378980 - protein, 7 aa, Entamoeba dispar
YGEEYSD

SEQ ID NO: 2378981 - protein, 4 aa, Entamoeba dispar
YGEG

SEQ ID NO: 2378982 - protein, 10 aa, Entamoeba dispar
YGEKKINRNG

SEQ ID NO: 2378983 - protein, 6 aa, Entamoeba dispar
YGEPLG

SEQ ID NO: 2378984 - protein, 11 aa, Entamoeba dispar
YGESKEEFNYE

SEQ ID NO: 2378985 - protein, 13 aa, Entamoeba dispar
YGETNNDFNEEGR

SEQ ID NO: 2378986 - protein, 24 aa, Entamoeba dispar
YGEVSSRRTITRGNSSSRTNERTY

SEQ ID NO: 2378987 - protein, 7 aa, Entamoeba dispar
YGGCQKN

SEQ ID NO: 2378988 - protein, 7 aa, Entamoeba dispar
YGGEYSD

SEQ ID NO: 2378989 - protein, 7 aa, Entamoeba dispar
YGGQSTS

SEQ ID NO: 2378990 - protein, 4 aa, Entamoeba dispar
YGGS

SEQ ID NO: 2378991 - protein, 12 aa, Entamoeba dispar
YGIKSSSACTVT

SEQ ID NO: 2378992 - protein, 9 aa, Entamoeba dispar
YGISPQKVQ

SEQ ID NO: 2378993 - protein, 10 aa, Entamoeba dispar
YGKEGNQAAI

SEQ ID NO: 2378994 - protein, 9 aa, Entamoeba dispar
YGKNETDPF

SEQ ID NO: 2378995 - protein, 11 aa, Entamoeba dispar
YGKPNKPSKGI

SEQ ID NO: 2378996 - protein, 12 aa, Entamoeba dispar
YGKRRGQNQKKI

SEQ ID NO: 2378997 - protein, 7 aa, Entamoeba dispar
YGKSGKR

SEQ ID NO: 2378998 - protein, 18 aa, Entamoeba dispar
YGKSGQTYKVKASSTNIT

SEQ ID NO: 2378999 - protein, 6 aa, Entamoeba dispar
YGKTIS

SEQ ID NO: 2379000 - protein, 10 aa, Entamoeba dispar
YGLNENSEDI

SEQ ID NO: 2379001 - protein, 12 aa, Entamoeba dispar
YGLNTSSTDLSS

SEQ ID NO: 2379002 - protein, 10 aa, Entamoeba dispar
YGMNNQSNTL

SEQ ID NO: 2379003 - protein, 9 aa, Entamoeba dispar
YGNDTTATA

SEQ ID NO: 2379004 - protein, 9 aa, Entamoeba dispar
YGNEGVPTE

SEQ ID NO: 2379005 - protein, 8 aa, Entamoeba dispar
YGNEIKSG

SEQ ID NO: 2379006 - protein, 8 aa, Entamoeba dispar
YGNEIKTG

SEQ ID NO: 2379007 - protein, 13 aa, Entamoeba dispar
YGNENGTTDIEDT

SEQ ID NO: 2379008 - protein, 9 aa, Entamoeba dispar
YGNPQRTAG

SEQ ID NO: 2379009 - protein, 6 aa, Entamoeba dispar
YGNRTG

SEQ ID NO: 2379010 - protein, 10 aa, Entamoeba dispar
YGNYSNGETS

SEQ ID NO: 2379011 - protein, 7 aa, Entamoeba dispar
YGRAGKI

SEQ ID NO: 2379012 - protein, 5 aa, Entamoeba dispar
YGSGM

SEQ ID NO: 2379013 - protein, 4 aa, Entamoeba dispar
YGSI

SEQ ID NO: 2379014 - protein, 4 aa, Entamoeba dispar
YGSL

SEQ ID NO: 2379015 - protein, 4 aa, Entamoeba dispar
YGST

SEQ ID NO: 2379016 - protein, 5 aa, Entamoeba dispar
YGSTD

SEQ ID NO: 2379017 - protein, 5 aa, Entamoeba dispar
YGSYI

SEQ ID NO: 2379018 - protein, 4 aa, Entamoeba dispar
YGTD

SEQ ID NO: 2379019 - protein, 4 aa, Entamoeba dispar
YGTG

SEQ ID NO: 2379020 - protein, 4 aa, Entamoeba dispar
YGTI

SEQ ID NO: 2379021 - protein, 7 aa, Entamoeba dispar
YGTQPVE

SEQ ID NO: 2379022 - protein, 15 aa, Entamoeba dispar
YGTSPMSLSYNGKTE

SEQ ID NO: 2379023 - protein, 7 aa, Entamoeba dispar
YGTVSQR

SEQ ID NO: 2379024 - protein, 4 aa, Entamoeba dispar
YGVK

SEQ ID NO: 2379025 - protein, 33 aa, Entamoeba dispar
YGYEGNDNKVRISQGSTLSMQETDSRELNNLKR

SEQ ID NO: 2379026 - protein, 37 aa, Entamoeba dispar
YGYESNIEEVEEDIEEESFTDEISDTEEDDDEDELIE

SEQ ID NO: 2379027 - protein, 12 aa, Entamoeba dispar
YHPDKNKEEGAE

SEQ ID NO: 2379028 - protein, 12 aa, Entamoeba dispar
YHPDRNPNSTEF

SEQ ID NO: 2379029 - protein, 4 aa, Entamoeba dispar
YIDE

SEQ ID NO: 2379030 - protein, 8 aa, Entamoeba dispar
YIDGETSA

SEQ ID NO: 2379031 - protein, 9 aa, Entamoeba dispar
YIGKDDKKL

SEQ ID NO: 2379032 - protein, 21 aa, Entamoeba dispar
YIKEKGECKEKDNKCNKSERN

SEQ ID NO: 2379033 - protein, 21 aa, Entamoeba dispar
YIKEKGECKKIDNKCNKSERN

SEQ ID NO: 2379034 - protein, 21 aa, Entamoeba dispar
YIKENGECKEKDNKCNKSERN

SEQ ID NO: 2379035 - protein, 21 aa, Entamoeba dispar
YIKENGECKENDNKCNKSERN

SEQ ID NO: 2379036 - protein, 12 aa, Entamoeba dispar
YINRNGKCYDTN

SEQ ID NO: 2379037 - protein, 4 aa, Entamoeba dispar
YINS

SEQ ID NO: 2379038 - protein, 10 aa, Entamoeba dispar
YIPRKPEWTD

SEQ ID NO: 2379039 - protein, 10 aa, Entamoeba dispar
YIPSEPYSTQ

SEQ ID NO: 2379040 - protein, 6 aa, Entamoeba dispar
YIRKSS

SEQ ID NO: 2379041 - protein, 10 aa, Entamoeba dispar
YISGPNNTKI

SEQ ID NO: 2379042 - protein, 10 aa, Entamoeba dispar
YISNGSTPFE

SEQ ID NO: 2379043 - protein, 5 aa, Entamoeba dispar
YITEQ

SEQ ID NO: 2379044 - protein, 5 aa, Entamoeba dispar
YITSQ

SEQ ID NO: 2379045 - protein, 7 aa, Entamoeba dispar
YKANYNG

SEQ ID NO: 2379046 - protein, 5 aa, Entamoeba dispar
YKCDT

SEQ ID NO: 2379047 - protein, 9 aa, Entamoeba dispar
YKDEGKKLV

SEQ ID NO: 2379048 - protein, 11 aa, Entamoeba dispar
YKDNKGSNQQI

SEQ ID NO: 2379049 - protein, 8 aa, Entamoeba dispar
YKDTSITN

SEQ ID NO: 2379050 - protein, 17 aa, Entamoeba dispar
YKEDKENKKEKEEKKKE

SEQ ID NO: 2379051 - protein, 9 aa, Entamoeba dispar
YKEDSTTKY

SEQ ID NO: 2379052 - protein, 7 aa, Entamoeba dispar
YKEGISK

SEQ ID NO: 2379053 - protein, 15 aa, Entamoeba dispar
YKELNKQSYGQESQK

SEQ ID NO: 2379054 - protein, 9 aa, Entamoeba dispar
YKENSAGLN

SEQ ID NO: 2379055 - protein, 15 aa, Entamoeba dispar
YKERIESPKEESYYN

SEQ ID NO: 2379056 - protein, 23 aa, Entamoeba dispar
YKESLKKQGQLPKELYEESQKTI

SEQ ID NO: 2379057 - protein, 7 aa, Entamoeba dispar
YKETNGE

SEQ ID NO: 2379058 - protein, 9 aa, Entamoeba dispar
YKGETNKWS

SEQ ID NO: 2379059 - protein, 13 aa, Entamoeba dispar
YKGGCVPSSNGLS

SEQ ID NO: 2379060 - protein, 8 aa, Entamoeba dispar
YKGKEDEI

SEQ ID NO: 2379061 - protein, 4 aa, Entamoeba dispar
YKGR

SEQ ID NO: 2379062 - protein, 6 aa, Entamoeba dispar
YKGRDG

SEQ ID NO: 2379063 - protein, 8 aa, Entamoeba dispar
YKGTEERK

SEQ ID NO: 2379064 - protein, 7 aa, Entamoeba dispar
YKIPDGY

SEQ ID NO: 2379065 - protein, 11 aa, Entamoeba dispar
YKITGQNENHR

SEQ ID NO: 2379066 - protein, 9 aa, Entamoeba dispar
YKKDCDNKK

SEQ ID NO: 2379067 - protein, 45 aa, Entamoeba dispar
YKKEMGDNVPSNVNDSTPSNNPVSQVAEGEQKPKSESVSHSSSDE

SEQ ID NO: 2379068 - protein, 5 aa, Entamoeba dispar
YKKFS

SEQ ID NO: 2379069 - protein, 4 aa, Entamoeba dispar
YKKI

SEQ ID NO: 2379070 - protein, 16 aa, Entamoeba dispar
YKKRKTELYDPKEQDI

SEQ ID NO: 2379071 - protein, 5 aa, Entamoeba dispar
YKKRN

SEQ ID NO: 2379072 - protein, 9 aa, Entamoeba dispar
YKKSDLPSG

SEQ ID NO: 2379073 - protein, 10 aa, Entamoeba dispar
YKKTESSTEL

SEQ ID NO: 2379074 - protein, 4 aa, Entamoeba dispar
YKLP

SEQ ID NO: 2379075 - protein, 11 aa, Entamoeba dispar
YKNETSPYQRG

SEQ ID NO: 2379076 - protein, 5 aa, Entamoeba dispar
YKNGD

SEQ ID NO: 2379077 - protein, 8 aa, Entamoeba dispar
YKNKTTWG

SEQ ID NO: 2379078 - protein, 9 aa, Entamoeba dispar
YKNPSLKLS

SEQ ID NO: 2379079 - protein, 22 aa, Entamoeba dispar
YKNTSKYSEIKGIKKEKEIISK

SEQ ID NO: 2379080 - protein, 6 aa, Entamoeba dispar
YKPLPR

SEQ ID NO: 2379081 - protein, 7 aa, Entamoeba dispar
YKPNNKR

SEQ ID NO: 2379082 - protein, 4 aa, Entamoeba dispar
YKPS

SEQ ID NO: 2379083 - protein, 19 aa, Entamoeba dispar
YKPTKRKEDFYSMYTNIGE

SEQ ID NO: 2379084 - protein, 7 aa, Entamoeba dispar
YKPTSGI

SEQ ID NO: 2379085 - protein, 4 aa, Entamoeba dispar
YKPV

SEQ ID NO: 2379086 - protein, 8 aa, Entamoeba dispar
YKQGNQKD

SEQ ID NO: 2379087 - protein, 5 aa, Entamoeba dispar
YKQTS

SEQ ID NO: 2379088 - protein, 13 aa, Entamoeba dispar
YKRPKEKKNEEGF

SEQ ID NO: 2379089 - protein, 10 aa, Entamoeba dispar
YKRRNATMGI

SEQ ID NO: 2379090 - protein, 8 aa, Entamoeba dispar
YKSDDNNV

SEQ ID NO: 2379091 - protein, 7 aa, Entamoeba dispar
YKSDGKY

SEQ ID NO: 2379092 - protein, 9 aa, Entamoeba dispar
YKSEESQTK

SEQ ID NO: 2379093 - protein, 10 aa, Entamoeba dispar
YKSESCTGQI

SEQ ID NO: 2379094 - protein, 8 aa, Entamoeba dispar
YKSKNDVH

SEQ ID NO: 2379095 - protein, 16 aa, Entamoeba dispar
YKSKTSSCSKKSNQIS

SEQ ID NO: 2379096 - protein, 16 aa, Entamoeba dispar
YKSNEDNLEGINENDE

SEQ ID NO: 2379097 - protein, 5 aa, Entamoeba dispar
YKSPE

SEQ ID NO: 2379098 - protein, 12 aa, Entamoeba dispar
YKSSYSGNGIQP

SEQ ID NO: 2379099 - protein, 9 aa, Entamoeba dispar
YKTETSVDG

SEQ ID NO: 2379100 - protein, 10 aa, Entamoeba dispar
YKTGDTSCRS

SEQ ID NO: 2379101 - protein, 7 aa, Entamoeba dispar
YKTGETS

SEQ ID NO: 2379102 - protein, 9 aa, Entamoeba dispar
YKTNKQGKR

SEQ ID NO: 2379103 - protein, 10 aa, Entamoeba dispar
YKTNKQGKRV

SEQ ID NO: 2379104 - protein, 11 aa, Entamoeba dispar
YKTNTKNKCAT

SEQ ID NO: 2379105 - protein, 8 aa, Entamoeba dispar
YKTQPINT

SEQ ID NO: 2379106 - protein, 12 aa, Entamoeba dispar
YKTTDDDNTNKK

SEQ ID NO: 2379107 - protein, 10 aa, Entamoeba dispar
YKVNKEQIEN

SEQ ID NO: 2379108 - protein, 10 aa, Entamoeba dispar
YKYLNDDKTR

SEQ ID NO: 2379109 - protein, 15 aa, Entamoeba dispar
YLDDYSKKESDDDYP

SEQ ID NO: 2379110 - protein, 22 aa, Entamoeba dispar
YLNDESSKITIPPKARIPHGNP

SEQ ID NO: 2379111 - protein, 8 aa, Entamoeba dispar
YLNDKQKR

SEQ ID NO: 2379112 - protein, 12 aa, Entamoeba dispar
YLNGGNSNSERI

SEQ ID NO: 2379113 - protein, 7 aa, Entamoeba dispar
YLNSTTN

SEQ ID NO: 2379114 - protein, 12 aa, Entamoeba dispar
YLPNGERGEYEW

SEQ ID NO: 2379115 - protein, 7 aa, Entamoeba dispar
YLPQSGR

SEQ ID NO: 2379116 - protein, 8 aa, Entamoeba dispar
YMKKDGTT

SEQ ID NO: 2379117 - protein, 14 aa, Entamoeba dispar
YNANSCSFTSTDRK

SEQ ID NO: 2379118 - protein, 13 aa, Entamoeba dispar
YNDCTTSPNNNGA

SEQ ID NO: 2379119 - protein, 19 aa, Entamoeba dispar
YNDKYETSSSNKVKNNYTE

SEQ ID NO: 2379120 - protein, 6 aa, Entamoeba dispar
YNEEDL

SEQ ID NO: 2379121 - protein, 6 aa, Entamoeba dispar
YNEEEK

SEQ ID NO: 2379122 - protein, 8 aa, Entamoeba dispar
YNESTQTM

SEQ ID NO: 2379123 - protein, 4 aa, Entamoeba dispar
YNET

SEQ ID NO: 2379124 - protein, 10 aa, Entamoeba dispar
YNGDSSLQLS

SEQ ID NO: 2379125 - protein, 5 aa, Entamoeba dispar
YNGFG

SEQ ID NO: 2379126 - protein, 8 aa, Entamoeba dispar
YNGGNGEC

SEQ ID NO: 2379127 - protein, 7 aa, Entamoeba dispar
YNGGNNI

SEQ ID NO: 2379128 - protein, 9 aa, Entamoeba dispar
YNGNENTTE

SEQ ID NO: 2379129 - protein, 14 aa, Entamoeba dispar
YNKGYKGINKACQD

SEQ ID NO: 2379130 - protein, 10 aa, Entamoeba dispar
YNKKKSNYYN

SEQ ID NO: 2379131 - protein, 4 aa, Entamoeba dispar
YNKT

SEQ ID NO: 2379132 - protein, 13 aa, Entamoeba dispar
YNKVTGKSILNNS

SEQ ID NO: 2379133 - protein, 21 aa, Entamoeba dispar
YNLNDNSQDLSPIDCSTAPAK

SEQ ID NO: 2379134 - protein, 20 aa, Entamoeba dispar
YNNGDLEISRENKRNQRKSL

SEQ ID NO: 2379135 - protein, 8 aa, Entamoeba dispar
YNNLQNKV

SEQ ID NO: 2379136 - protein, 10 aa, Entamoeba dispar
YNNNQNNNQY

SEQ ID NO: 2379137 - protein, 5 aa, Entamoeba dispar
YNNTS

SEQ ID NO: 2379138 - protein, 5 aa, Entamoeba dispar
YNPER

SEQ ID NO: 2379139 - protein, 6 aa, Entamoeba dispar
YNPLRK

SEQ ID NO: 2379140 - protein, 7 aa, Entamoeba dispar
YNPSNSF

SEQ ID NO: 2379141 - protein, 7 aa, Entamoeba dispar
YNPSSLT

SEQ ID NO: 2379142 - protein, 6 aa, Entamoeba dispar
YNPTGS

SEQ ID NO: 2379143 - protein, 8 aa, Entamoeba dispar
YNQRSTNE

SEQ ID NO: 2379144 - protein, 4 aa, Entamoeba dispar
YNRL

SEQ ID NO: 2379145 - protein, 7 aa, Entamoeba dispar
YNRTNGK

SEQ ID NO: 2379146 - protein, 7 aa, Entamoeba dispar
YNSESEA

SEQ ID NO: 2379147 - protein, 4 aa, Entamoeba dispar
YNSN

SEQ ID NO: 2379148 - protein, 11 aa, Entamoeba dispar
YNSSQGTCSVR

SEQ ID NO: 2379149 - protein, 26 aa, Entamoeba dispar
YNSTTNTLEINGNNELKHSLNPSNKP

SEQ ID NO: 2379150 - protein, 26 aa, Entamoeba dispar
YNSTTNTLEINGNNELKHSLNPTNKP

SEQ ID NO: 2379151 - protein, 26 aa, Entamoeba dispar
YNSTTNTLEINGNNELKHSLNQSNKP

SEQ ID NO: 2379152 - protein, 27 aa, Entamoeba dispar
YNSTTNTLEINGNNELKHSSNPSNKPL

SEQ ID NO: 2379153 - protein, 26 aa, Entamoeba dispar
YNSTTNTLEINGNNKLKHSSNPTNKP

SEQ ID NO: 2379154 - protein, 22 aa, Entamoeba dispar
YNTFGNPRPLDENAQFKTTGTN

SEQ ID NO: 2379155 - protein, 7 aa, Entamoeba dispar
YNTNTTS

SEQ ID NO: 2379156 - protein, 6 aa, Entamoeba dispar
YNTRAL

SEQ ID NO: 2379157 - protein, 12 aa, Entamoeba dispar
YNYTSENNSMID

SEQ ID NO: 2379158 - protein, 4 aa, Entamoeba dispar
YNYV

SEQ ID NO: 2379159 - protein, 5 aa, Entamoeba dispar
YPAES

SEQ ID NO: 2379160 - protein, 6 aa, Entamoeba dispar
YPANQT

SEQ ID NO: 2379161 - protein, 10 aa, Entamoeba dispar
YPDDPNRSGF

SEQ ID NO: 2379162 - protein, 4 aa, Entamoeba dispar
YPDG

SEQ ID NO: 2379163 - protein, 6 aa, Entamoeba dispar
YPDPDI

SEQ ID NO: 2379164 - protein, 4 aa, Entamoeba dispar
YPDY

SEQ ID NO: 2379165 - protein, 5 aa, Entamoeba dispar
YPEDL

SEQ ID NO: 2379166 - protein, 4 aa, Entamoeba dispar
YPEN

SEQ ID NO: 2379167 - protein, 5 aa, Entamoeba dispar
YPENG

SEQ ID NO: 2379168 - protein, 9 aa, Entamoeba dispar
YPERGEGEF

SEQ ID NO: 2379169 - protein, 9 aa, Entamoeba dispar
YPFPATTTY

SEQ ID NO: 2379170 - protein, 14 aa, Entamoeba dispar
YPGCNEPAKTKYNC

SEQ ID NO: 2379171 - protein, 9 aa, Entamoeba dispar
YPGQEKGRL

SEQ ID NO: 2379172 - protein, 8 aa, Entamoeba dispar
YPGTMEST

SEQ ID NO: 2379173 - protein, 5 aa, Entamoeba dispar
YPGTY

SEQ ID NO: 2379174 - protein, 10 aa, Entamoeba dispar
YPIPRTNDKG

SEQ ID NO: 2379175 - protein, 4 aa, Entamoeba dispar
YPIT

SEQ ID NO: 2379176 - protein, 7 aa, Entamoeba dispar
YPKALTT

SEQ ID NO: 2379177 - protein, 6 aa, Entamoeba dispar
YPKKAQ

SEQ ID NO: 2379178 - protein, 6 aa, Entamoeba dispar
YPKNEE

SEQ ID NO: 2379179 - protein, 13 aa, Entamoeba dispar
YPKSHRETFTDKQ

SEQ ID NO: 2379180 - protein, 16 aa, Entamoeba dispar
YPNDKCDDGERTSQNT

SEQ ID NO: 2379181 - protein, 5 aa, Entamoeba dispar
YPNED

SEQ ID NO: 2379182 - protein, 10 aa, Entamoeba dispar
YPNGDDLPAT

SEQ ID NO: 2379183 - protein, 10 aa, Entamoeba dispar
YPNIPADKPV

SEQ ID NO: 2379184 - protein, 8 aa, Entamoeba dispar
YPNKPTDF

SEQ ID NO: 2379185 - protein, 5 aa, Entamoeba dispar
YPNNH

SEQ ID NO: 2379186 - protein, 5 aa, Entamoeba dispar
YPNSD

SEQ ID NO: 2379187 - protein, 4 aa, Entamoeba dispar
YPNT

SEQ ID NO: 2379188 - protein, 5 aa, Entamoeba dispar
YPNVY

SEQ ID NO: 2379189 - protein, 8 aa, Entamoeba dispar
YPPNSPRD

SEQ ID NO: 2379190 - protein, 6 aa, Entamoeba dispar
YPPTDE

SEQ ID NO: 2379191 - protein, 7 aa, Entamoeba dispar
YPPTDKQ

SEQ ID NO: 2379192 - protein, 7 aa, Entamoeba dispar
YPPTKIK

SEQ ID NO: 2379193 - protein, 4 aa, Entamoeba dispar
YPQD

SEQ ID NO: 2379194 - protein, 9 aa, Entamoeba dispar
YPQKPNDQL

SEQ ID NO: 2379195 - protein, 5 aa, Entamoeba dispar
YPQNL

SEQ ID NO: 2379196 - protein, 5 aa, Entamoeba dispar
YPQTS

SEQ ID NO: 2379197 - protein, 6 aa, Entamoeba dispar
YPRPQT

SEQ ID NO: 2379198 - protein, 7 aa, Entamoeba dispar
YPRPYQS

SEQ ID NO: 2379199 - protein, 8 aa, Entamoeba dispar
YPRQSRKL

SEQ ID NO: 2379200 - protein, 9 aa, Entamoeba dispar
YPSESVPDI

SEQ ID NO: 2379201 - protein, 4 aa, Entamoeba dispar
YPSG

SEQ ID NO: 2379202 - protein, 23 aa, Entamoeba dispar
YPSNEEISIEEKKEEEKEPLLYS

SEQ ID NO: 2379203 - protein, 5 aa, Entamoeba dispar
YPSRE

SEQ ID NO: 2379204 - protein, 7 aa, Entamoeba dispar
YPSSGNR

SEQ ID NO: 2379205 - protein, 8 aa, Entamoeba dispar
YPSSGNRT

SEQ ID NO: 2379206 - protein, 16 aa, Entamoeba dispar
YPTEKATSAIPFPSEY

SEQ ID NO: 2379207 - protein, 6 aa, Entamoeba dispar
YPTKKE

SEQ ID NO: 2379208 - protein, 7 aa, Entamoeba dispar
YPTQKVN

SEQ ID NO: 2379209 - protein, 6 aa, Entamoeba dispar
YPTRPE

SEQ ID NO: 2379210 - protein, 7 aa, Entamoeba dispar
YPTTKPT

SEQ ID NO: 2379211 - protein, 5 aa, Entamoeba dispar
YPVGD

SEQ ID NO: 2379212 - protein, 6 aa, Entamoeba dispar
YPVRSE

SEQ ID NO: 2379213 - protein, 6 aa, Entamoeba dispar
YPYSET

SEQ ID NO: 2379214 - protein, 26 aa, Entamoeba dispar
YQDAKESSTCKPCSSSCSSCSKTTGA

SEQ ID NO: 2379215 - protein, 6 aa, Entamoeba dispar
YQEQSP

SEQ ID NO: 2379216 - protein, 4 aa, Entamoeba dispar
YQEV

SEQ ID NO: 2379217 - protein, 8 aa, Entamoeba dispar
YQFEGGNS

SEQ ID NO: 2379218 - protein, 5 aa, Entamoeba dispar
YQGEY

SEQ ID NO: 2379219 - protein, 7 aa, Entamoeba dispar
YQGNGQK

SEQ ID NO: 2379220 - protein, 15 aa, Entamoeba dispar
YQGRGSNEFTGEEIQ

SEQ ID NO: 2379221 - protein, 13 aa, Entamoeba dispar
YQIEKQKEENDKI

SEQ ID NO: 2379222 - protein, 6 aa, Entamoeba dispar
YQISPK

SEQ ID NO: 2379223 - protein, 4 aa, Entamoeba dispar
YQKA

SEQ ID NO: 2379224 - protein, 10 aa, Entamoeba dispar
YQKKGKQGKI

SEQ ID NO: 2379225 - protein, 5 aa, Entamoeba dispar
YQKNE

SEQ ID NO: 2379226 - protein, 4 aa, Entamoeba dispar
YQLK

SEQ ID NO: 2379227 - protein, 27 aa, Entamoeba dispar
YQNAEEYTAKSAMEIDEAGKYQISGDK

SEQ ID NO: 2379228 - protein, 4 aa, Entamoeba dispar
YQND

SEQ ID NO: 2379229 - protein, 5 aa, Entamoeba dispar
YQNGT

SEQ ID NO: 2379230 - protein, 7 aa, Entamoeba dispar
YQNSEEN

SEQ ID NO: 2379231 - protein, 8 aa, Entamoeba dispar
YQPEDREN

SEQ ID NO: 2379232 - protein, 4 aa, Entamoeba dispar
YQPI

SEQ ID NO: 2379233 - protein, 9 aa, Entamoeba dispar
YQPTGDPLP

SEQ ID NO: 2379234 - protein, 8 aa, Entamoeba dispar
YQQNENGR

SEQ ID NO: 2379235 - protein, 5 aa, Entamoeba dispar
YQQQD

SEQ ID NO: 2379236 - protein, 7 aa, Entamoeba dispar
YQSREDR

SEQ ID NO: 2379237 - protein, 4 aa, Entamoeba dispar
YQTD

SEQ ID NO: 2379238 - protein, 11 aa, Entamoeba dispar
YQTEGAQNDQT

SEQ ID NO: 2379239 - protein, 9 aa, Entamoeba dispar
YQTKQRNGF

SEQ ID NO: 2379240 - protein, 22 aa, Entamoeba dispar
YQTNKDNEWKCDGKEQAQKTNA

SEQ ID NO: 2379241 - protein, 6 aa, Entamoeba dispar
YQTNKG

SEQ ID NO: 2379242 - protein, 7 aa, Entamoeba dispar
YQTNSSQ

SEQ ID NO: 2379243 - protein, 4 aa, Entamoeba dispar
YQYA

SEQ ID NO: 2379244 - protein, 5 aa, Entamoeba dispar
YRCNK

SEQ ID NO: 2379245 - protein, 10 aa, Entamoeba dispar
YRDEYTPAGD

SEQ ID NO: 2379246 - protein, 6 aa, Entamoeba dispar
YRDPSQ

SEQ ID NO: 2379247 - protein, 5 aa, Entamoeba dispar
YRGTQ

SEQ ID NO: 2379248 - protein, 15 aa, Entamoeba dispar
YRHNDSEKLCSPQSE

SEQ ID NO: 2379249 - protein, 5 aa, Entamoeba dispar
YRKGD

SEQ ID NO: 2379250 - protein, 6 aa, Entamoeba dispar
YRKGKG

SEQ ID NO: 2379251 - protein, 13 aa, Entamoeba dispar
YRKNGLEKGYLES

SEQ ID NO: 2379252 - protein, 11 aa, Entamoeba dispar
YRMNNEDGTYS

SEQ ID NO: 2379253 - protein, 11 aa, Entamoeba dispar
YRNSTEISETS

SEQ ID NO: 2379254 - protein, 6 aa, Entamoeba dispar
YRQNGI

SEQ ID NO: 2379255 - protein, 7 aa, Entamoeba dispar
YRRKGIG

SEQ ID NO: 2379256 - protein, 4 aa, Entamoeba dispar
YRRP

SEQ ID NO: 2379257 - protein, 14 aa, Entamoeba dispar
YRRSRNAQRPQNEI

SEQ ID NO: 2379258 - protein, 10 aa, Entamoeba dispar
YRSKSSGNSI

SEQ ID NO: 2379259 - protein, 14 aa, Entamoeba dispar
YRSPSKVPAFTSQG

SEQ ID NO: 2379260 - protein, 11 aa, Entamoeba dispar
YRSSFNPNASE

SEQ ID NO: 2379261 - protein, 5 aa, Entamoeba dispar
YRTAL

SEQ ID NO: 2379262 - protein, 6 aa, Entamoeba dispar
YRTPYK

SEQ ID NO: 2379263 - protein, 9 aa, Entamoeba dispar
YRTRGYSTT

SEQ ID NO: 2379264 - protein, 8 aa, Entamoeba dispar
YRTTKDDV

SEQ ID NO: 2379265 - protein, 9 aa, Entamoeba dispar
YRYKNSPQL

SEQ ID NO: 2379266 - protein, 13 aa, Entamoeba dispar
YRYSPDGKTFPFR

SEQ ID NO: 2379267 - protein, 7 aa, Entamoeba dispar
YSADGNG

SEQ ID NO: 2379268 - protein, 12 aa, Entamoeba dispar
YSADKGSNTISY

SEQ ID NO: 2379269 - protein, 4 aa, Entamoeba dispar
YSAS

SEQ ID NO: 2379270 - protein, 8 aa, Entamoeba dispar
YSDDLNPH

SEQ ID NO: 2379271 - protein, 4 aa, Entamoeba dispar
YSDG

SEQ ID NO: 2379272 - protein, 6 aa, Entamoeba dispar
YSDNEC

SEQ ID NO: 2379273 - protein, 5 aa, Entamoeba dispar
YSDPG

SEQ ID NO: 2379274 - protein, 11 aa, Entamoeba dispar
YSDREGQQDNC

SEQ ID NO: 2379275 - protein, 18 aa, Entamoeba dispar
YSDTETESNEETDDTDKI

SEQ ID NO: 2379276 - protein, 24 aa, Entamoeba dispar
YSDTETESNEETESNEETDDTDKI

SEQ ID NO: 2379277 - protein, 16 aa, Entamoeba dispar
YSEEEAMKSVDPELTE

SEQ ID NO: 2379278 - protein, 10 aa, Entamoeba dispar
YSEEGETFND

SEQ ID NO: 2379279 - protein, 10 aa, Entamoeba dispar
YSEEGETFNE

SEQ ID NO: 2379280 - protein, 7 aa, Entamoeba dispar
YSEGSDC

SEQ ID NO: 2379281 - protein, 6 aa, Entamoeba dispar
YSEKNY

SEQ ID NO: 2379282 - protein, 17 aa, Entamoeba dispar
YSENQRGDNDQEEGTKT

SEQ ID NO: 2379283 - protein, 11 aa, Entamoeba dispar
YSEPDKRNTEI

SEQ ID NO: 2379284 - protein, 9 aa, Entamoeba dispar
YSEPPRSGI

SEQ ID NO: 2379285 - protein, 10 aa, Entamoeba dispar
YSESRKLGPV

SEQ ID NO: 2379286 - protein, 9 aa, Entamoeba dispar
YSETPQQRR

SEQ ID NO: 2379287 - protein, 9 aa, Entamoeba dispar
YSETYYTTS

SEQ ID NO: 2379288 - protein, 5 aa, Entamoeba dispar
YSEYK

SEQ ID NO: 2379289 - protein, 4 aa, Entamoeba dispar
YSFE

SEQ ID NO: 2379290 - protein, 8 aa, Entamoeba dispar
YSFESDER

SEQ ID NO: 2379291 - protein, 10 aa, Entamoeba dispar
YSGDNGNDEI

SEQ ID NO: 2379292 - protein, 4 aa, Entamoeba dispar
YSGG

SEQ ID NO: 2379293 - protein, 6 aa, Entamoeba dispar
YSGIGS

SEQ ID NO: 2379294 - protein, 8 aa, Entamoeba dispar
YSGKPRPF

SEQ ID NO: 2379295 - protein, 4 aa, Entamoeba dispar
YSGN

SEQ ID NO: 2379296 - protein, 9 aa, Entamoeba dispar
YSGNPTSEL

SEQ ID NO: 2379297 - protein, 6 aa, Entamoeba dispar
YSGPLT

SEQ ID NO: 2379298 - protein, 12 aa, Entamoeba dispar
YSGTSKTGIKYE

SEQ ID NO: 2379299 - protein, 10 aa, Entamoeba dispar
YSHLRSENQR

SEQ ID NO: 2379300 - protein, 5 aa, Entamoeba dispar
YSIDD

SEQ ID NO: 2379301 - protein, 10 aa, Entamoeba dispar
YSIGRRRQTT

SEQ ID NO: 2379302 - protein, 4 aa, Entamoeba dispar
YSIP

SEQ ID NO: 2379303 - protein, 6 aa, Entamoeba dispar
YSISEQ

SEQ ID NO: 2379304 - protein, 14 aa, Entamoeba dispar
YSKDDEKRSIKEYQ

SEQ ID NO: 2379305 - protein, 14 aa, Entamoeba dispar
YSKECKDEGNEDIK

SEQ ID NO: 2379306 - protein, 5 aa, Entamoeba dispar
YSKTT

SEQ ID NO: 2379307 - protein, 10 aa, Entamoeba dispar
YSKWNKQREY

SEQ ID NO: 2379308 - protein, 12 aa, Entamoeba dispar
YSLDAGSMSCSK

SEQ ID NO: 2379309 - protein, 7 aa, Entamoeba dispar
YSLEDGK

SEQ ID NO: 2379310 - protein, 6 aa, Entamoeba dispar
YSLTTP

SEQ ID NO: 2379311 - protein, 4 aa, Entamoeba dispar
YSND

SEQ ID NO: 2379312 - protein, 13 aa, Entamoeba dispar
YSNDQYDLSDCET

SEQ ID NO: 2379313 - protein, 8 aa, Entamoeba dispar
YSNEPDFT

SEQ ID NO: 2379314 - protein, 15 aa, Entamoeba dispar
YSNGTTQQPSKKLPS

SEQ ID NO: 2379315 - protein, 5 aa, Entamoeba dispar
YSNHE

SEQ ID NO: 2379316 - protein, 7 aa, Entamoeba dispar
YSNNPKL

SEQ ID NO: 2379317 - protein, 8 aa, Entamoeba dispar
YSNNQTVS

SEQ ID NO: 2379318 - protein, 16 aa, Entamoeba dispar
YSNSNKAYIPTSTGCQ

SEQ ID NO: 2379319 - protein, 8 aa, Entamoeba dispar
YSNSPSLY

SEQ ID NO: 2379320 - protein, 8 aa, Entamoeba dispar
YSNSSDFQ

SEQ ID NO: 2379321 - protein, 6 aa, Entamoeba dispar
YSNTLN

SEQ ID NO: 2379322 - protein, 15 aa, Entamoeba dispar
YSNYISSKSSHAEKL

SEQ ID NO: 2379323 - protein, 5 aa, Entamoeba dispar
YSPDI

SEQ ID NO: 2379324 - protein, 4 aa, Entamoeba dispar
YSPE

SEQ ID NO: 2379325 - protein, 5 aa, Entamoeba dispar
YSPHA

SEQ ID NO: 2379326 - protein, 6 aa, Entamoeba dispar
YSPKKS

SEQ ID NO: 2379327 - protein, 14 aa, Entamoeba dispar
YSPLRSQKKYSRRC

SEQ ID NO: 2379328 - protein, 20 aa, Entamoeba dispar
YSPNDSTNDTSEEDNGLSGG

SEQ ID NO: 2379329 - protein, 8 aa, Entamoeba dispar
YSPNERVT

SEQ ID NO: 2379330 - protein, 6 aa, Entamoeba dispar
YSPPTK

SEQ ID NO: 2379331 - protein, 8 aa, Entamoeba dispar
YSPYYTPR

SEQ ID NO: 2379332 - protein, 6 aa, Entamoeba dispar
YSQDIQ

SEQ ID NO: 2379333 - protein, 5 aa, Entamoeba dispar
YSQND

SEQ ID NO: 2379334 - protein, 14 aa, Entamoeba dispar
YSQNKADCSSISRG

SEQ ID NO: 2379335 - protein, 14 aa, Entamoeba dispar
YSQNNADCSSRSQG

SEQ ID NO: 2379336 - protein, 5 aa, Entamoeba dispar
YSQPL

SEQ ID NO: 2379337 - protein, 8 aa, Entamoeba dispar
YSQPPSGM

SEQ ID NO: 2379338 - protein, 6 aa, Entamoeba dispar
YSRPTR

SEQ ID NO: 2379339 - protein, 6 aa, Entamoeba dispar
YSRQNI

SEQ ID NO: 2379340 - protein, 5 aa, Entamoeba dispar
YSSAC

SEQ ID NO: 2379341 - protein, 5 aa, Entamoeba dispar
YSSDD

SEQ ID NO: 2379342 - protein, 8 aa, Entamoeba dispar
YSSDKNLE

SEQ ID NO: 2379343 - protein, 9 aa, Entamoeba dispar
YSSKIGSKQ

SEQ ID NO: 2379344 - protein, 6 aa, Entamoeba dispar
YSSNEN

SEQ ID NO: 2379345 - protein, 8 aa, Entamoeba dispar
YSSNQTAE

SEQ ID NO: 2379346 - protein, 12 aa, Entamoeba dispar
YSSNQTNQLPNL

SEQ ID NO: 2379347 - protein, 7 aa, Entamoeba dispar
YSSPSNI

SEQ ID NO: 2379348 - protein, 10 aa, Entamoeba dispar
YSSSTKKDEN

SEQ ID NO: 2379349 - protein, 6 aa, Entamoeba dispar
YSSTNK

SEQ ID NO: 2379350 - protein, 10 aa, Entamoeba dispar
YSSTSDVSCP

SEQ ID NO: 2379351 - protein, 8 aa, Entamoeba dispar
YSTNKINS

SEQ ID NO: 2379352 - protein, 7 aa, Entamoeba dispar
YSTRSSS

SEQ ID NO: 2379353 - protein, 10 aa, Entamoeba dispar
YSTRTSITSS

SEQ ID NO: 2379354 - protein, 11 aa, Entamoeba dispar
YSTSPCSTQLE

SEQ ID NO: 2379355 - protein, 8 aa, Entamoeba dispar
YSTSSGMT

SEQ ID NO: 2379356 - protein, 10 aa, Entamoeba dispar
YSTSSGTTCK

SEQ ID NO: 2379357 - protein, 6 aa, Entamoeba dispar
YSTTSQ

SEQ ID NO: 2379358 - protein, 4 aa, Entamoeba dispar
YSVD

SEQ ID NO: 2379359 - protein, 7 aa, Entamoeba dispar
YSVDTNA

SEQ ID NO: 2379360 - protein, 8 aa, Entamoeba dispar
YSVEEKKK

SEQ ID NO: 2379361 - protein, 8 aa, Entamoeba dispar
YSVGPTKQ

SEQ ID NO: 2379362 - protein, 9 aa, Entamoeba dispar
YSVTNGKLD

SEQ ID NO: 2379363 - protein, 6 aa, Entamoeba dispar
YSYDSI

SEQ ID NO: 2379364 - protein, 10 aa, Entamoeba dispar
YSYKNEPNKV

SEQ ID NO: 2379365 - protein, 5 aa, Entamoeba dispar
YTADF

SEQ ID NO: 2379366 - protein, 11 aa, Entamoeba dispar
YTANKQREKEF

SEQ ID NO: 2379367 - protein, 8 aa, Entamoeba dispar
YTATRLNS

SEQ ID NO: 2379368 - protein, 10 aa, Entamoeba dispar
YTDIEQQRSI

SEQ ID NO: 2379369 - protein, 6 aa, Entamoeba dispar
YTDPTC

SEQ ID NO: 2379370 - protein, 9 aa, Entamoeba dispar
YTEKKYNKH

SEQ ID NO: 2379371 - protein, 11 aa, Entamoeba dispar
YTESKEEIQSK

SEQ ID NO: 2379372 - protein, 6 aa, Entamoeba dispar
YTETLQ

SEQ ID NO: 2379373 - protein, 11 aa, Entamoeba dispar
YTGSAASLDKI

SEQ ID NO: 2379374 - protein, 18 aa, Entamoeba dispar
YTGYGRNEGESSEINSVE

SEQ ID NO: 2379375 - protein, 5 aa, Entamoeba dispar
YTISK

SEQ ID NO: 2379376 - protein, 9 aa, Entamoeba dispar
YTISSGNNC

SEQ ID NO: 2379377 - protein, 4 aa, Entamoeba dispar
YTKE

SEQ ID NO: 2379378 - protein, 9 aa, Entamoeba dispar
YTKGTESDS

SEQ ID NO: 2379379 - protein, 6 aa, Entamoeba dispar
YTKKTQ

SEQ ID NO: 2379380 - protein, 6 aa, Entamoeba dispar
YTKQND

SEQ ID NO: 2379381 - protein, 6 aa, Entamoeba dispar
YTKSSS

SEQ ID NO: 2379382 - protein, 6 aa, Entamoeba dispar
YTKYST

SEQ ID NO: 2379383 - protein, 4 aa, Entamoeba dispar
YTLN

SEQ ID NO: 2379384 - protein, 5 aa, Entamoeba dispar
YTLNN

SEQ ID NO: 2379385 - protein, 21 aa, Entamoeba dispar
YTLNNGKCSNKENRNGKNEEI

SEQ ID NO: 2379386 - protein, 21 aa, Entamoeba dispar
YTLNNKKCSNKENRNGKNEEI

SEQ ID NO: 2379387 - protein, 4 aa, Entamoeba dispar
YTLP

SEQ ID NO: 2379388 - protein, 4 aa, Entamoeba dispar
YTLQ

SEQ ID NO: 2379389 - protein, 14 aa, Entamoeba dispar
YTLQRDGTKSICQS

SEQ ID NO: 2379390 - protein, 5 aa, Entamoeba dispar
YTNEM

SEQ ID NO: 2379391 - protein, 20 aa, Entamoeba dispar
YTNKNKNIELNKQTSYLNPE

SEQ ID NO: 2379392 - protein, 5 aa, Entamoeba dispar
YTNRP

SEQ ID NO: 2379393 - protein, 8 aa, Entamoeba dispar
YTNTLDGE

SEQ ID NO: 2379394 - protein, 5 aa, Entamoeba dispar
YTPPE

SEQ ID NO: 2379395 - protein, 4 aa, Entamoeba dispar
YTPR

SEQ ID NO: 2379396 - protein, 8 aa, Entamoeba dispar
YTPSIKEG

SEQ ID NO: 2379397 - protein, 12 aa, Entamoeba dispar
YTPSKDNGDNPL

SEQ ID NO: 2379398 - protein, 9 aa, Entamoeba dispar
YTPSTAGDE

SEQ ID NO: 2379399 - protein, 8 aa, Entamoeba dispar
YTPTPNGC

SEQ ID NO: 2379400 - protein, 12 aa, Entamoeba dispar
YTQPSYSDPPFD

SEQ ID NO: 2379401 - protein, 12 aa, Entamoeba dispar
YTQQPFQKSQNH

SEQ ID NO: 2379402 - protein, 18 aa, Entamoeba dispar
YTQQTGYQTVPPQYNPQP

SEQ ID NO: 2379403 - protein, 6 aa, Entamoeba dispar
YTQRGG

SEQ ID NO: 2379404 - protein, 7 aa, Entamoeba dispar
YTQYPEY

SEQ ID NO: 2379405 - protein, 8 aa, Entamoeba dispar
YTSDTISS

SEQ ID NO: 2379406 - protein, 5 aa, Entamoeba dispar
YTSFP

SEQ ID NO: 2379407 - protein, 5 aa, Entamoeba dispar
YTSGI

SEQ ID NO: 2379408 - protein, 15 aa, Entamoeba dispar
YTSSSTCTGNKNETF

SEQ ID NO: 2379409 - protein, 6 aa, Entamoeba dispar
YTTDNT

SEQ ID NO: 2379410 - protein, 4 aa, Entamoeba dispar
YTTH

SEQ ID NO: 2379411 - protein, 12 aa, Entamoeba dispar
YTTKEKSQRGSI

SEQ ID NO: 2379412 - protein, 10 aa, Entamoeba dispar
YTTNPKTGNY

SEQ ID NO: 2379413 - protein, 10 aa, Entamoeba dispar
YTTSDNNRRI

SEQ ID NO: 2379414 - protein, 5 aa, Entamoeba dispar
YTTSP

SEQ ID NO: 2379415 - protein, 11 aa, Entamoeba dispar
YTTSTNEHYGG

SEQ ID NO: 2379416 - protein, 9 aa, Entamoeba dispar
YTWEDNDSI

SEQ ID NO: 2379417 - protein, 10 aa, Entamoeba dispar
YTYRTPSLNV

SEQ ID NO: 2379418 - protein, 9 aa, Entamoeba dispar
YVANQEKGF

SEQ ID NO: 2379419 - protein, 17 aa, Entamoeba dispar
YVAQTKQLQNGTNNPVI

SEQ ID NO: 2379420 - protein, 6 aa, Entamoeba dispar
YVDNGG

SEQ ID NO: 2379421 - protein, 11 aa, Entamoeba dispar
YVGTDTTSPFA

SEQ ID NO: 2379422 - protein, 9 aa, Entamoeba dispar
YVKSSEGKC

SEQ ID NO: 2379423 - protein, 14 aa, Entamoeba dispar
YVNKDKQRPTPLQE

SEQ ID NO: 2379424 - protein, 21 aa, Entamoeba dispar
YVNSGDTCSTCGNGKLDEEEQ

SEQ ID NO: 2379425 - protein, 5 aa, Entamoeba dispar
YVNSS

SEQ ID NO: 2379426 - protein, 11 aa, Entamoeba dispar
YVPKKRQGTPI

SEQ ID NO: 2379427 - protein, 10 aa, Entamoeba dispar
YVQNDSGTGI

SEQ ID NO: 2379428 - protein, 6 aa, Entamoeba dispar
YVQYTN

SEQ ID NO: 2379429 - protein, 7 aa, Entamoeba dispar
YVRKDNE

SEQ ID NO: 2379430 - protein, 15 aa, Entamoeba dispar
YYAQKVKQDKAKKEF

SEQ ID NO: 2379431 - protein, 4 aa, Entamoeba dispar
YYAS

SEQ ID NO: 2379432 - protein, 5 aa, Entamoeba dispar
YYASE

SEQ ID NO: 2379433 - protein, 23 aa, Entamoeba dispar
YYDEPSFKNTKEEFEDKLRRTDE

SEQ ID NO: 2379434 - protein, 5 aa, Entamoeba dispar
YYDHD

SEQ ID NO: 2379435 - protein, 7 aa, Entamoeba dispar
YYDPEEG

SEQ ID NO: 2379436 - protein, 13 aa, Entamoeba dispar
YYDQDTKRCITNN

SEQ ID NO: 2379437 - protein, 5 aa, Entamoeba dispar
YYDSN

SEQ ID NO: 2379438 - protein, 4 aa, Entamoeba dispar
YYGG

SEQ ID NO: 2379439 - protein, 6 aa, Entamoeba dispar
YYGNGE

SEQ ID NO: 2379440 - protein, 4 aa, Entamoeba dispar
YYGS

SEQ ID NO: 2379441 - protein, 12 aa, Entamoeba dispar
YYKNNDKTFLNG

SEQ ID NO: 2379442 - protein, 10 aa, Entamoeba dispar
YYKPKAKAYV

SEQ ID NO: 2379443 - protein, 24 aa, Entamoeba dispar
YYKPKEVKRETFKPVDDSDAMKVT

SEQ ID NO: 2379444 - protein, 15 aa, Entamoeba dispar
YYKTNDGICNKAQDD

SEQ ID NO: 2379445 - protein, 4 aa, Entamoeba dispar
YYNE

SEQ ID NO: 2379446 - protein, 6 aa, Entamoeba dispar
YYNKKE

SEQ ID NO: 2379447 - protein, 4 aa, Entamoeba dispar
YYNN

SEQ ID NO: 2379448 - protein, 12 aa, Entamoeba dispar
YYNPSSCTKCPK

SEQ ID NO: 2379449 - protein, 6 aa, Entamoeba dispar
YYNQTE

SEQ ID NO: 2379450 - protein, 8 aa, Entamoeba dispar
YYNSPEVL

SEQ ID NO: 2379451 - protein, 11 aa, Entamoeba dispar
YYPENDGHLSR

SEQ ID NO: 2379452 - protein, 9 aa, Entamoeba dispar
YYPEPQDKQ

SEQ ID NO: 2379453 - protein, 10 aa, Entamoeba dispar
YYPHGPDCQS

SEQ ID NO: 2379454 - protein, 6 aa, Entamoeba dispar
YYPNEG

SEQ ID NO: 2379455 - protein, 4 aa, Entamoeba dispar
YYPP

SEQ ID NO: 2379456 - protein, 5 aa, Entamoeba dispar
YYQDS

SEQ ID NO: 2379457 - protein, 29 aa, Entamoeba dispar
YYQESSKIERSTRSQSQLCSNDSYGITPA

SEQ ID NO: 2379458 - protein, 4 aa, Entamoeba dispar
YYRE

SEQ ID NO: 2379459 - protein, 12 aa, Entamoeba dispar
YYRKGTSCPKCP

SEQ ID NO: 2379460 - protein, 12 aa, Entamoeba dispar
YYRNEKGCSKCE

SEQ ID NO: 2379461 - protein, 12 aa, Entamoeba dispar
YYRNEKGCSKCG

SEQ ID NO: 2379462 - protein, 7 aa, Entamoeba dispar
YYRSTAN

SEQ ID NO: 2379463 - protein, 4 aa, Entamoeba dispar
YYSP

SEQ ID NO: 2379464 - protein, 8 aa, Entamoeba dispar
YYSTENSP

SEQ ID NO: 2379465 - protein, 5 aa, Entamoeba dispar
YYTNQ

SEQ ID NO: 2379466 - protein, 8 aa, Entamoeba dispar
YYYNKQQK

SEQ ID NO: 2379467 - protein, 25 aa, Entamoeba dispar
LFFLFSRYILIFLFLFIILIHVYII

SEQ ID NO: 2379468 - protein, 24 aa, Entamoeba dispar
FLHLLNLYIPFIILLVYTLFFYII

SEQ ID NO: 2379469 - protein, 27 aa, Entamoeba dispar
DKEYGCRECLTGYYLINKECSKCGNKC

SEQ ID NO: 2379470 - protein, 17 aa, Entamoeba dispar
KEIVWWMIMIIIIIILI

SEQ ID NO: 2379471 - protein, 20 aa, Entamoeba dispar
ICLFLLYMFIPFKKYLEGDY

SEQ ID NO: 2379472 - protein, 24 aa, Entamoeba dispar
IYILCIYILYILCIYILFIYIIYI

SEQ ID NO: 2379473 - protein, 19 aa, Entamoeba dispar
KEIRELICIGNEKKEKKKI

SEQ ID NO: 2379474 - protein, 18 aa, Entamoeba dispar
LTIPINFITFITFTTFTT

SEQ ID NO: 2379475 - protein, 20 aa, Entamoeba dispar
TSFPYILTIPINFITFITFT

SEQ ID NO: 2379476 - protein, 27 aa, Entamoeba dispar
ETKNNKCSKCSFWYGINEEGTKCNKEI

SEQ ID NO: 2379477 - protein, 19 aa, Entamoeba dispar
GGYACEFEIFITIKCTTKI

SEQ ID NO: 2379478 - protein, 21 aa, Entamoeba dispar
SEAWVRTPPLAFYYILSLCTL

SEQ ID NO: 2379479 - protein, 25 aa, Entamoeba dispar
TKNNKCSKCSFWYGINEEGTKCNKE

SEQ ID NO: 2379480 - protein, 20 aa, Entamoeba dispar
ERNYCLKCSNGYKIENNQCN

SEQ ID NO: 2379481 - protein, 23 aa, Entamoeba dispar
QKDKCIICGEGYFMSSTGICKST

SEQ ID NO: 2379482 - protein, 26 aa, Entamoeba dispar
TKNNKCSKCSFWYGINEEGTKCNKEI

SEQ ID NO: 2379483 - protein, 27 aa, Entamoeba dispar
DKEYGCRECLTGYYLINKECSKCGKQC

SEQ ID NO: 2379484 - protein, 22 aa, Entamoeba dispar
FKPHLLHLLIVYSYYTSTYTIL

SEQ ID NO: 2379485 - protein, 18 aa, Entamoeba dispar
RRGFKPHLLHLLIVYSYY

SEQ ID NO: 2379486 - protein, 21 aa, Entamoeba dispar
SCLLLFYHVYYYSCFSTFYFL

SEQ ID NO: 2379487 - protein, 23 aa, Entamoeba dispar
TEIPNKIRIKFMIDGAKGISYLH

SEQ ID NO: 2379488 - protein, 21 aa, Entamoeba dispar
VYYYSCFSTFYFLQGNSKSGR

SEQ ID NO: 2379489 - protein, 18 aa, Entamoeba dispar
GYACEFEIFITIKCTTKI

SEQ ID NO: 2379490 - protein, 26 aa, Entamoeba dispar
ILSLCTLLYLYICHLSLYNLCYILNF

SEQ ID NO: 2379491 - protein, 20 aa, Entamoeba dispar
ERNYCLKCSNGYKIQNNQCN

SEQ ID NO: 2379492 - protein, 21 aa, Entamoeba dispar
GGYACEFEIFITIKCTTKIKE

SEQ ID NO: 2379493 - protein, 21 aa, Entamoeba dispar
KDKCIKCGEGYFMSSTGICKS

SEQ ID NO: 2379494 - protein, 19 aa, Entamoeba dispar
KEIRELICIGNENKEKKKI

SEQ ID NO: 2379495 - protein, 24 aa, Entamoeba dispar
TSFPYILTIPINFITFITFTTFTT

SEQ ID NO: 2379496 - protein, 20 aa, Entamoeba dispar
GSGCGICHKGYYRNGKGCSK

SEQ ID NO: 2379497 - protein, 22 aa, Entamoeba dispar
GSGCGICKNGYYRNGKGCSKCE

SEQ ID NO: 2379498 - protein, 17 aa, Entamoeba dispar
ICHLSLYNLCYILNFII

SEQ ID NO: 2379499 - protein, 22 aa, Entamoeba dispar
KEYGCRECLTGYYLINKECSKC

SEQ ID NO: 2379500 - protein, 17 aa, Entamoeba dispar
QSHCIECEYGYYLNSNK

SEQ ID NO: 2379501 - protein, 17 aa, Entamoeba dispar
TCEEFKNGCKIGNETYC

SEQ ID NO: 2379502 - protein, 17 aa, Entamoeba dispar
EVNKEIRELICIGNEKK

SEQ ID NO: 2379503 - protein, 22 aa, Entamoeba dispar
GSGCGICNKGYYRNGKGCSKCE

SEQ ID NO: 2379504 - protein, 23 aa, Entamoeba dispar
LFKYSDWIDLILLIIGIISSIGN

SEQ ID NO: 2379505 - protein, 24 aa, Entamoeba dispar
LSLYNLCYILNFIISTFLLFYFIP

SEQ ID NO: 2379506 - protein, 25 aa, Entamoeba dispar
NTEIPNKIRIKFMIDGAKGISYLHS

SEQ ID NO: 2379507 - protein, 24 aa, Entamoeba dispar
QKDKCIICGEGYFMSSTGICKSTT

SEQ ID NO: 2379508 - protein, 31 aa, Entamoeba dispar
SLRERRSATELSRLILLLPISIFTLSLYIFI

SEQ ID NO: 2379509 - protein, 21 aa, Entamoeba dispar
TEIPNKIRIKFMLDGAKGISY

SEQ ID NO: 2379510 - protein, 27 aa, Entamoeba dispar
YGCKRCKEGYYLTKDMKCLKCDDKCET

SEQ ID NO: 2379511 - protein, 24 aa, Entamoeba dispar
YVIIYHLFTFISFYYFIIHLLYTS

SEQ ID NO: 2379512 - protein, 19 aa, Entamoeba dispar
YYFLHYFHFLLITYYFLLI

SEQ ID NO: 2379513 - protein, 21 aa, Entamoeba dispar
ASKGRTTIIIAHRLSTIQNAD

SEQ ID NO: 2379514 - protein, 25 aa, Entamoeba dispar
CTADFKLERITGYTVTVFKNYCVAN

SEQ ID NO: 2379515 - protein, 19 aa, Entamoeba dispar
CVFADKYYVVDDFHSFTYF

SEQ ID NO: 2379516 - protein, 19 aa, Entamoeba dispar
DELKIKKGELVCVLGSVGS

SEQ ID NO: 2379517 - protein, 20 aa, Entamoeba dispar
EEIIKIISIKGETQISTRLD

SEQ ID NO: 2379518 - protein, 20 aa, Entamoeba dispar
EPKERIRIEEVVKMLERIEN

SEQ ID NO: 2379519 - protein, 17 aa, Entamoeba dispar
ETYRFNYEYNESIPREF

SEQ ID NO: 2379520 - protein, 17 aa, Entamoeba dispar
EVNKEIRELICIGNENK

SEQ ID NO: 2379521 - protein, 17 aa, Entamoeba dispar
EYIIHFYGAVFIPNKIC

SEQ ID NO: 2379522 - protein, 18 aa, Entamoeba dispar
FILLLPIQLMLIIFTLSY

SEQ ID NO: 2379523 - protein, 18 aa, Entamoeba dispar
FILYRLSILSLYYSYSVT

SEQ ID NO: 2379524 - protein, 19 aa, Entamoeba dispar
FQDGIGPKFGMIFQIFSMT

SEQ ID NO: 2379525 - protein, 22 aa, Entamoeba dispar
GSGCGICKNGYYRNGKGCSKCG

SEQ ID NO: 2379526 - protein, 23 aa, Entamoeba dispar
ILDNFRHEWFLSILGFIGGIGGG

SEQ ID NO: 2379527 - protein, 28 aa, Entamoeba dispar
ILSLCTLLYLYICHLSLYNLCYILNFII

SEQ ID NO: 2379528 - protein, 17 aa, Entamoeba dispar
IYSYLLVTYTINFIYSS

SEQ ID NO: 2379529 - protein, 25 aa, Entamoeba dispar
KEYGCRECLTGYYLINKECSKCGNK

SEQ ID NO: 2379530 - protein, 19 aa, Entamoeba dispar
KNFKNCTTLTIAHRLHSIM

SEQ ID NO: 2379531 - protein, 21 aa, Entamoeba dispar
LFILYICIYSYLLVTYTINFI

SEQ ID NO: 2379532 - protein, 19 aa, Entamoeba dispar
LKHSNRFVLLRVILDNFRH

SEQ ID NO: 2379533 - protein, 21 aa, Entamoeba dispar
LMELKGTYYGLVKRQSMEEEV

SEQ ID NO: 2379534 - protein, 17 aa, Entamoeba dispar
LNIKWLRNQIGIVGQEP

SEQ ID NO: 2379535 - protein, 25 aa, Entamoeba dispar
MLDKFRSEYIIQFYGAVFIPNKICM

SEQ ID NO: 2379536 - protein, 17 aa, Entamoeba dispar
NETYCYQCKEGFIKENG

SEQ ID NO: 2379537 - protein, 18 aa, Entamoeba dispar
NKEIVWWMIMIIIIIILI

SEQ ID NO: 2379538 - protein, 29 aa, Entamoeba dispar
PFPKTEFKFPWKIAEFISTGKRPTIIQEV

SEQ ID NO: 2379539 - protein, 22 aa, Entamoeba dispar
PIGEGAFGMVFRGTYRGREVAI

SEQ ID NO: 2379540 - protein, 17 aa, Entamoeba dispar
PKFGMIFQIFSMTITGY

SEQ ID NO: 2379541 - protein, 20 aa, Entamoeba dispar
RLSILSLYYSYSVTLFYSYI

SEQ ID NO: 2379542 - protein, 30 aa, Entamoeba dispar
SDVYSFAICMLEIWLGRDPYDPMKFPDSES

SEQ ID NO: 2379543 - protein, 19 aa, Entamoeba dispar
SEGRTTIVVAHRLTTVRNA

SEQ ID NO: 2379544 - protein, 27 aa, Entamoeba dispar
SENEIESLLKWARKLSFIDVDKVVKRD

SEQ ID NO: 2379545 - protein, 20 aa, Entamoeba dispar
SILISRSFSIYIFIYVLSIL

SEQ ID NO: 2379546 - protein, 23 aa, Entamoeba dispar
SLYNLCYILNFIISTFLLFYFIP

SEQ ID NO: 2379547 - protein, 24 aa, Entamoeba dispar
SLYNLCYILNFIISTFLLFYFIPL

SEQ ID NO: 2379548 - protein, 24 aa, Entamoeba dispar
TEIPNKIRIKFMIDGAKGISYLHS

SEQ ID NO: 2379549 - protein, 27 aa, Entamoeba dispar
TKKIGFKEKMMWTGITLLVFLVCSQIP

SEQ ID NO: 2379550 - protein, 26 aa, Entamoeba dispar
TKNNKCSKCSFWYGINEDGTKCNKEI

SEQ ID NO: 2379551 - protein, 17 aa, Entamoeba dispar
YCLNKSYVNGKCVECLN

SEQ ID NO: 2379552 - protein, 18 aa, Entamoeba dispar
YTPLCICTPYYVFYSFLL

SEQ ID NO: 2379553 - protein, 21 aa, Entamoeba dispar
AAKGRTTIVIAHRLSTIQNAD

SEQ ID NO: 2379554 - protein, 22 aa, Entamoeba dispar
ADSKLKRMTFRLITDKFVQIGI

SEQ ID NO: 2379555 - protein, 17 aa, Entamoeba dispar
AFQNGIIGIKGHRSVGG

SEQ ID NO: 2379556 - protein, 28 aa, Entamoeba dispar
AIFPFFTLKIVDLIMCLLSINSDTLTDD

SEQ ID NO: 2379557 - protein, 19 aa, Entamoeba dispar
AIPSYRYPDVDPFETTPFT

SEQ ID NO: 2379558 - protein, 25 aa, Entamoeba dispar
AKSGVCLKCQIGFNLASDQTKCVKC

SEQ ID NO: 2379559 - protein, 21 aa, Entamoeba dispar
ASFRCCGYDSISPSNCACKNP

SEQ ID NO: 2379560 - protein, 18 aa, Entamoeba dispar
AVIMWKTLCVLFVTEAPI

SEQ ID NO: 2379561 - protein, 22 aa, Entamoeba dispar
CACKNPMCFDVLCKTKFEELVQ

SEQ ID NO: 2379562 - protein, 20 aa, Entamoeba dispar
CALISPKSKYCLRCNTGYYM

SEQ ID NO: 2379563 - protein, 21 aa, Entamoeba dispar
CAVASLAYHYSYLLSKNMSSM

SEQ ID NO: 2379564 - protein, 20 aa, Entamoeba dispar
CKIKTSRGCESCEEGYYVSN

SEQ ID NO: 2379565 - protein, 20 aa, Entamoeba dispar
CLTTLLTQVMNPYGFYIGTY

SEQ ID NO: 2379566 - protein, 27 aa, Entamoeba dispar
CPSNCLKCLNGVCIQCKDNHYLDNGNC

SEQ ID NO: 2379567 - protein, 19 aa, Entamoeba dispar
CVFHKDCLISLFDQSIEEV

SEQ ID NO: 2379568 - protein, 28 aa, Entamoeba dispar
CVSCSSGGLHCMTCYSVSNNVFCSSCVD

SEQ ID NO: 2379569 - protein, 17 aa, Entamoeba dispar
CYQCKEGFIKEKGECKE

SEQ ID NO: 2379570 - protein, 19 aa, Entamoeba dispar
DEECILCKDGYLLNSNSCI

SEQ ID NO: 2379571 - protein, 20 aa, Entamoeba dispar
DELKIKKGELVCVLGSVGSG

SEQ ID NO: 2379572 - protein, 20 aa, Entamoeba dispar
DELTHCKIKTSRGCESCEEG

SEQ ID NO: 2379573 - protein, 27 aa, Entamoeba dispar
DESYSLLFVLLIPRVNLLPRYNNVGVG

SEQ ID NO: 2379574 - protein, 23 aa, Entamoeba dispar
DEVVVPYAMPGVFVLLSESIFFD

SEQ ID NO: 2379575 - protein, 17 aa, Entamoeba dispar
DFCTSCFTGYFKTPDML

SEQ ID NO: 2379576 - protein, 24 aa, Entamoeba dispar
DFTPFPKRTMEFFVEGEQLKQYHF

SEQ ID NO: 2379577 - protein, 23 aa, Entamoeba dispar
DGSGCGICNKGYYRNGKGCSKCE

SEQ ID NO: 2379578 - protein, 25 aa, Entamoeba dispar
DIACPEDRLAGYVKNTEFPKWTIGV

SEQ ID NO: 2379579 - protein, 29 aa, Entamoeba dispar
DIYLGAIIIICLVFRFFITKYRLIILRRY

SEQ ID NO: 2379580 - protein, 19 aa, Entamoeba dispar
DKCIKCGEGYFMSSTGICK

SEQ ID NO: 2379581 - protein, 23 aa, Entamoeba dispar
DKCINKAMVDHCIEVSNSQCTKC

SEQ ID NO: 2379582 - protein, 23 aa, Entamoeba dispar
DKFFNMIFPFVLFILDDSEKINE

SEQ ID NO: 2379583 - protein, 17 aa, Entamoeba dispar
DKFRSEYIIHFYGAVFI

SEQ ID NO: 2379584 - protein, 19 aa, Entamoeba dispar
DLNIKWLRNQIGLVGQEPI

SEQ ID NO: 2379585 - protein, 17 aa, Entamoeba dispar
DMKCLKCDDKCETCYGT

SEQ ID NO: 2379586 - protein, 18 aa, Entamoeba dispar
DNQWSKRYIEHFFTKIHF

SEQ ID NO: 2379587 - protein, 19 aa, Entamoeba dispar
DPKICPVTTTISVVVNPFM

SEQ ID NO: 2379588 - protein, 24 aa, Entamoeba dispar
DRKENRVGSLITRLSSDPTKLNGI

SEQ ID NO: 2379589 - protein, 18 aa, Entamoeba dispar
DRKGYGTKTCYKRDESQY

SEQ ID NO: 2379590 - protein, 19 aa, Entamoeba dispar
DSILVWKFIEDKIHHIFVL

SEQ ID NO: 2379591 - protein, 20 aa, Entamoeba dispar
DVLNEFNLLILKSGSKQTAH

SEQ ID NO: 2379592 - protein, 20 aa, Entamoeba dispar
EAIEGLHLFGDKKEMTLFKH

SEQ ID NO: 2379593 - protein, 21 aa, Entamoeba dispar
EEVPSQHKIQIITLNVNGSYK

SEQ ID NO: 2379594 - protein, 19 aa, Entamoeba dispar
EEVYKIWGNYYKELFYCGR

SEQ ID NO: 2379595 - protein, 23 aa, Entamoeba dispar
EEYVFDCIHFFGIDYYTNNSTLV

SEQ ID NO: 2379596 - protein, 22 aa, Entamoeba dispar
EGLPLSTIIGWIIGDFFKTIYF

SEQ ID NO: 2379597 - protein, 25 aa, Entamoeba dispar
EKVRLRASDKVSILIVGVLLVALVI

SEQ ID NO: 2379598 - protein, 19 aa, Entamoeba dispar
EKYGSSGFIKWGSELVNIF

SEQ ID NO: 2379599 - protein, 20 aa, Entamoeba dispar
ELIDLKGFYYTLAMQQFGTV

SEQ ID NO: 2379600 - protein, 20 aa, Entamoeba dispar
ELIELKGFYYTLAMQQFGTM

SEQ ID NO: 2379601 - protein, 28 aa, Entamoeba dispar
ELNVPFQFVCCGIFQLICDGILVSQILV

SEQ ID NO: 2379602 - protein, 22 aa, Entamoeba dispar
EMIECAKMANAHDFISHLPEGY

SEQ ID NO: 2379603 - protein, 19 aa, Entamoeba dispar
ENCQKCGQGCKVCDETGTC

SEQ ID NO: 2379604 - protein, 17 aa, Entamoeba dispar
ENKICCLTTSNKINTLI

SEQ ID NO: 2379605 - protein, 25 aa, Entamoeba dispar
EPETWKGVVYLIVIAFMQILTSFCF

SEQ ID NO: 2379606 - protein, 21 aa, Entamoeba dispar
EPKERIRIEEVVKMLEIIENK

SEQ ID NO: 2379607 - protein, 18 aa, Entamoeba dispar
EQYYKKENCQKCGQGCKV

SEQ ID NO: 2379608 - protein, 27 aa, Entamoeba dispar
ESPRSSTKLSFLIPSFMRKRSNSSSGA

SEQ ID NO: 2379609 - protein, 17 aa, Entamoeba dispar
ETRECIECEKGYYLNSN

SEQ ID NO: 2379610 - protein, 22 aa, Entamoeba dispar
EVNKEIRELICIGNENKEKKKI

SEQ ID NO: 2379611 - protein, 25 aa, Entamoeba dispar
EYDKACGKYISVGYDYLAVKNTSMV

SEQ ID NO: 2379612 - protein, 23 aa, Entamoeba dispar
FAAIILPFGLCWYNQEEDTSYIK

SEQ ID NO: 2379613 - protein, 18 aa, Entamoeba dispar
FAPFNILVYLFFKKAHGL

SEQ ID NO: 2379614 - protein, 19 aa, Entamoeba dispar
FCCSWSFGKAIGFVLGGPM

SEQ ID NO: 2379615 - protein, 24 aa, Entamoeba dispar
FEDYKFRYRRGLPLVLNGINALIE

SEQ ID NO: 2379616 - protein, 17 aa, Entamoeba dispar
FEIFITIKCTTKIKEQI

SEQ ID NO: 2379617 - protein, 17 aa, Entamoeba dispar
FFYFLPFTINIDNDKKM

SEQ ID NO: 2379618 - protein, 18 aa, Entamoeba dispar
FGIVPLEAMIKGVPVIAC

SEQ ID NO: 2379619 - protein, 25 aa, Entamoeba dispar
FIAGYAIGFAKDWDLTLVIMSMSPF

SEQ ID NO: 2379620 - protein, 17 aa, Entamoeba dispar
FKDICFRYPTRPDNSVL

SEQ ID NO: 2379621 - protein, 17 aa, Entamoeba dispar
FKHSITFETTPSLNQPQ

SEQ ID NO: 2379622 - protein, 21 aa, Entamoeba dispar
FKNGCKIGNETYCYQCKEGFI

SEQ ID NO: 2379623 - protein, 21 aa, Entamoeba dispar
FKNGCKIGNETYCYQCKEGYI

SEQ ID NO: 2379624 - protein, 27 aa, Entamoeba dispar
FKSRDCVFMFISWCCTLSALSVVNGLF

SEQ ID NO: 2379625 - protein, 20 aa, Entamoeba dispar
FKSWYSYILSLLVGLVYTFG

SEQ ID NO: 2379626 - protein, 17 aa, Entamoeba dispar
FLCVSRITFSQLDSILV

SEQ ID NO: 2379627 - protein, 17 aa, Entamoeba dispar
FLMNCPFDITLFILTSS

SEQ ID NO: 2379628 - protein, 18 aa, Entamoeba dispar
FLYYLNELVIHFTVYGTV

SEQ ID NO: 2379629 - protein, 22 aa, Entamoeba dispar
FMCTIFSREWIKVSGSSSADVK

SEQ ID NO: 2379630 - protein, 28 aa, Entamoeba dispar
FMKKIYRIPFDWLEEKSMGLSDSIVVNS

SEQ ID NO: 2379631 - protein, 25 aa, Entamoeba dispar
FNAIRRPFMNFGYFVSCVTTFKVAI

SEQ ID NO: 2379632 - protein, 18 aa, Entamoeba dispar
FRLITDKFVQIGIIALLI

SEQ ID NO: 2379633 - protein, 28 aa, Entamoeba dispar
FSAAYLCRLCAPLALNILHMIKFDGIHF

SEQ ID NO: 2379634 - protein, 23 aa, Entamoeba dispar
FSIQLLRHMICLFQLKLEEQCYY

SEQ ID NO: 2379635 - protein, 17 aa, Entamoeba dispar
FSSNYGIQYLISSYEGS

SEQ ID NO: 2379636 - protein, 30 aa, Entamoeba dispar
FVEGEFRIRYNIPITICLISTIIEFTVMKK

SEQ ID NO: 2379637 - protein, 20 aa, Entamoeba dispar
FVLIWRKKKLITFIVYCCLL

SEQ ID NO: 2379638 - protein, 26 aa, Entamoeba dispar
FVRPPKFAAATTFKLQNYKSLLYIIV

SEQ ID NO: 2379639 - protein, 18 aa, Entamoeba dispar
FWSKRDHFVGLSIKSIFV

SEQ ID NO: 2379640 - protein, 35 aa, Entamoeba dispar
GAICLALIYLRNGWVLCVLAIPIGIISGYDLQSNV

SEQ ID NO: 2379641 - protein, 32 aa, Entamoeba dispar
GALNHCYKIIFAFWKELNKAISFGYSSQSTII

SEQ ID NO: 2379642 - protein, 25 aa, Entamoeba dispar
GCKRCKEGYYLTKDMKCLKCDDKCE

SEQ ID NO: 2379643 - protein, 25 aa, Entamoeba dispar
GCMVAEMFFGIPLFVANSELGLLRK

SEQ ID NO: 2379644 - protein, 27 aa, Entamoeba dispar
GDNGEWSTKCVLAYCDDGYKFDYINNK

SEQ ID NO: 2379645 - protein, 26 aa, Entamoeba dispar
GDNGEWSTKCVLSYCDEGYKFDYNNN

SEQ ID NO: 2379646 - protein, 24 aa, Entamoeba dispar
GECGNITGGFAFVYGIIAAVCVII

SEQ ID NO: 2379647 - protein, 22 aa, Entamoeba dispar
GESWNDWSYLQLAGFFFLLEGL

SEQ ID NO: 2379648 - protein, 23 aa, Entamoeba dispar
GFIKWGSELVNIFQLSRREFSEK

SEQ ID NO: 2379649 - protein, 19 aa, Entamoeba dispar
GGYVEWLYAFTDLYDKVLP

SEQ ID NO: 2379650 - protein, 25 aa, Entamoeba dispar
GIACIPLCIGYAIYSLYNNEFKSWY

SEQ ID NO: 2379651 - protein, 18 aa, Entamoeba dispar
GKSSFLLSILGELEQSKG

SEQ ID NO: 2379652 - protein, 18 aa, Entamoeba dispar
GLSSFQVFLYGIIPGFYS

SEQ ID NO: 2379653 - protein, 18 aa, Entamoeba dispar
GPIKEIILPTIQVLGDTS

SEQ ID NO: 2379654 - protein, 19 aa, Entamoeba dispar
GRISFSWKDEEGLNDNSSN

SEQ ID NO: 2379655 - protein, 25 aa, Entamoeba dispar
GRLRIKEDYIRNAIDDMKMMYLSYV

SEQ ID NO: 2379656 - protein, 17 aa, Entamoeba dispar
GSFGIVYIGEFRGNQVA

SEQ ID NO: 2379657 - protein, 25 aa, Entamoeba dispar
GSKERVGGVKIFFDKYLTSTGSGRF

SEQ ID NO: 2379658 - protein, 23 aa, Entamoeba dispar
GSNRIPTIVGCLGPIMRQGAWYK

SEQ ID NO: 2379659 - protein, 19 aa, Entamoeba dispar
GTLAIPFAFLYSGWGIGLI

SEQ ID NO: 2379660 - protein, 18 aa, Entamoeba dispar
GVIKEVSNINGFRRYVIC

SEQ ID NO: 2379661 - protein, 21 aa, Entamoeba dispar
GWKTSFEVNYNYPLDVSVQQI

SEQ ID NO: 2379662 - protein, 20 aa, Entamoeba dispar
GYGCKRCEEGYYLTKDMKCL

SEQ ID NO: 2379663 - protein, 17 aa, Entamoeba dispar
GYVLRKGKCYKFESDNC

SEQ ID NO: 2379664 - protein, 17 aa, Entamoeba dispar
HKFKCIGIIGNHDIKLR

SEQ ID NO: 2379665 - protein, 17 aa, Entamoeba dispar
HKVSQPSVMKWEQMKLM

SEQ ID NO: 2379666 - protein, 26 aa, Entamoeba dispar
HLEVGKVFTCIAYFNAIRRPFMNFGY

SEQ ID NO: 2379667 - protein, 17 aa, Entamoeba dispar
HYFHSSCIDEWIRCHSF

SEQ ID NO: 2379668 - protein, 25 aa, Entamoeba dispar
IAIFVVICTCSYYLIIVVVLVLIAF

SEQ ID NO: 2379669 - protein, 21 aa, Entamoeba dispar
IAYSCYGIYSIIYPPTNGYQS

SEQ ID NO: 2379670 - protein, 23 aa, Entamoeba dispar
IEEVKCPKCHQPIFTQQDIPNQI

SEQ ID NO: 2379671 - protein, 23 aa, Entamoeba dispar
IEVNKEIRELICIGNEKKEKKKI

SEQ ID NO: 2379672 - protein, 30 aa, Entamoeba dispar
IGFALGIAFYYDWRVSLCVMAVSPVLIVVV

SEQ ID NO: 2379673 - protein, 34 aa, Entamoeba dispar
IGSLLVDVYSLWKGHRLEYCYLNLHSSKISKEFT

SEQ ID NO: 2379674 - protein, 26 aa, Entamoeba dispar
IGYLGIGCGIIVFIILSIYYIISQIT

SEQ ID NO: 2379675 - protein, 28 aa, Entamoeba dispar
IKIEKELEGPIYLLRTSYQNFISRFGVK

SEQ ID NO: 2379676 - protein, 22 aa, Entamoeba dispar
IKIRMLYFRALLRQDAGWYDFH

SEQ ID NO: 2379677 - protein, 24 aa, Entamoeba dispar
IKLSISCLLCMVVSGLIIYCVIIK

SEQ ID NO: 2379678 - protein, 37 aa, Entamoeba dispar
IKMPTLHRIACFRDDVIFLIYLYQRWIYPVDKNRMDS

SEQ ID NO: 2379679 - protein, 24 aa, Entamoeba dispar
IKRREMICSFILVFSFFCRCVFNL

SEQ ID NO: 2379680 - protein, 19 aa, Entamoeba dispar
ILACVCAFCIFFLIWWSFL

SEQ ID NO: 2379681 - protein, 18 aa, Entamoeba dispar
ILIFKCISLAPLITLPIT

SEQ ID NO: 2379682 - protein, 19 aa, Entamoeba dispar
ILVLITFCLSILTTFTFIF

SEQ ID NO: 2379683 - protein, 19 aa, Entamoeba dispar
INLFGSWSVVSSRGQMYPV

SEQ ID NO: 2379684 - protein, 17 aa, Entamoeba dispar
INNPLLFYLNSSSTVIP

SEQ ID NO: 2379685 - protein, 20 aa, Entamoeba dispar
IPAACIGIFIASRVEMVQMP

SEQ ID NO: 2379686 - protein, 39 aa, Entamoeba dispar
IPFIGCPLLLFKAWMLRWWKIMYLRLLDLQKWKVIHGLY

SEQ ID NO: 2379687 - protein, 25 aa, Entamoeba dispar
IPLSYKRIRIIPSIFLMSLVYLSLI

SEQ ID NO: 2379688 - protein, 23 aa, Entamoeba dispar
IPQIEYNRWLQLIYQILISIDES

SEQ ID NO: 2379689 - protein, 19 aa, Entamoeba dispar
IQFALPSFFIITGKSKNEL

SEQ ID NO: 2379690 - protein, 17 aa, Entamoeba dispar
IQFWSKRDHFVGLSIKS

SEQ ID NO: 2379691 - protein, 19 aa, Entamoeba dispar
IQLLEDFLFEKGYRYMYSL

SEQ ID NO: 2379692 - protein, 35 aa, Entamoeba dispar
IQSRFYRAPEVCIGYKYNCAIDMWSFGCMVAEMFF

SEQ ID NO: 2379693 - protein, 30 aa, Entamoeba dispar
IREFGKKYMGLKCPHAQFTLAKDYLVEGSL

SEQ ID NO: 2379694 - protein, 17 aa, Entamoeba dispar
IRNCKVCDYNLKSCIVC

SEQ ID NO: 2379695 - protein, 37 aa, Entamoeba dispar
ISKKLIKWIFLILFFIQWISFLLCYIIANYIVFYGIA

SEQ ID NO: 2379696 - protein, 24 aa, Entamoeba dispar
ISYFKMIMMHSLGHSFSMHEHMGT

SEQ ID NO: 2379697 - protein, 17 aa, Entamoeba dispar
ITFIINYVIGQTNSTSE

SEQ ID NO: 2379698 - protein, 24 aa, Entamoeba dispar
ITGSCAPILFLVVCIILLCIITYW

SEQ ID NO: 2379699 - protein, 28 aa, Entamoeba dispar
ITITEVIHLLGCLGDLTIKQQKDIQETQ

SEQ ID NO: 2379700 - protein, 24 aa, Entamoeba dispar
ITLWKLTRVFTFNFKEKGSFIQYK

SEQ ID NO: 2379701 - protein, 24 aa, Entamoeba dispar
ITSICLVGSFLSVGFFTEYLTKHQ

SEQ ID NO: 2379702 - protein, 20 aa, Entamoeba dispar
IVTELLGCSLYELMKLNKKS

SEQ ID NO: 2379703 - protein, 20 aa, Entamoeba dispar
KDKCIKCGEGYFMSSTGICK

SEQ ID NO: 2379704 - protein, 21 aa, Entamoeba dispar
KDKCIKCGEGYFMSSTGICKL

SEQ ID NO: 2379705 - protein, 19 aa, Entamoeba dispar
KDKKCLKCDSNCETCYGTP

SEQ ID NO: 2379706 - protein, 25 aa, Entamoeba dispar
KEGEGLQAIVLMPFQLLAFGKSVLD

SEQ ID NO: 2379707 - protein, 20 aa, Entamoeba dispar
KEPYQIIKFSLTIEQSNEGT

SEQ ID NO: 2379708 - protein, 24 aa, Entamoeba dispar
KETFKELENIIGYIDCIQSFATNE

SEQ ID NO: 2379709 - protein, 18 aa, Entamoeba dispar
KFVQIGIIALLIIAILLV

SEQ ID NO: 2379710 - protein, 25 aa, Entamoeba dispar
KGAVLICATTYYTCFLIAGVFYYHF

SEQ ID NO: 2379711 - protein, 21 aa, Entamoeba dispar
KHPLAACLIVVFIAYSCYGIY

SEQ ID NO: 2379712 - protein, 23 aa, Entamoeba dispar
KINKRLELVEGFYENSEIRLKIK

SEQ ID NO: 2379713 - protein, 24 aa, Entamoeba dispar
KISGSTLLILFGLMVVLVVFMVVV

SEQ ID NO: 2379714 - protein, 18 aa, Entamoeba dispar
KIYNGGYMTSLRWLCQIK

SEQ ID NO: 2379715 - protein, 33 aa, Entamoeba dispar
KKKRRTSLPNALPFKINATPFIPKRKRIENTIN

SEQ ID NO: 2379716 - protein, 19 aa, Entamoeba dispar
KKPIVRLILKEVDMSDNTD

SEQ ID NO: 2379717 - protein, 18 aa, Entamoeba dispar
KKRIFSITLLVIVFILFV

SEQ ID NO: 2379718 - protein, 33 aa, Entamoeba dispar
KKTIAIIVSSLFVSFLIVCAVILIVAVVVRKYL

SEQ ID NO: 2379719 - protein, 24 aa, Entamoeba dispar
KKYAKARAGCILATCGNKKWDEGE

SEQ ID NO: 2379720 - protein, 21 aa, Entamoeba dispar
KKYIESAKCIIFMIAGDEIKK

SEQ ID NO: 2379721 - protein, 19 aa, Entamoeba dispar
KLENLRVIARCSPQDKERL

SEQ ID NO: 2379722 - protein, 20 aa, Entamoeba dispar
KLIVFGGVFGVGSSAIVIQF

SEQ ID NO: 2379723 - protein, 19 aa, Entamoeba dispar
KPTDLYCVHHKKHICIECI

SEQ ID NO: 2379724 - protein, 23 aa, Entamoeba dispar
KQYPSIFGGMKFFETFPFILPNL

SEQ ID NO: 2379725 - protein, 19 aa, Entamoeba dispar
KSFHFIAALIYTLGIRSNA

SEQ ID NO: 2379726 - protein, 18 aa, Entamoeba dispar
KSTMMAGLFRIEEPAGGS

SEQ ID NO: 2379727 - protein, 20 aa, Entamoeba dispar
KTYCYQCKEGFIKENGECKE

SEQ ID NO: 2379728 - protein, 20 aa, Entamoeba dispar
KYNYAYRIAQIPVFILLIVA

SEQ ID NO: 2379729 - protein, 18 aa, Entamoeba dispar
LCKEGGFMKKIYRIPFDW

SEQ ID NO: 2379730 - protein, 20 aa, Entamoeba dispar
LCMRSEAVPGYFEEYQGYLS

SEQ ID NO: 2379731 - protein, 22 aa, Entamoeba dispar
LDLQKWKVIHGLYHLQYNQTSI

SEQ ID NO: 2379732 - protein, 24 aa, Entamoeba dispar
LEAMIKGVPVIACNNGGPLETVQN

SEQ ID NO: 2379733 - protein, 19 aa, Entamoeba dispar
LEHCNLCYESDKCNSCDGN

SEQ ID NO: 2379734 - protein, 21 aa, Entamoeba dispar
LELSPFMAFILYLVYIQIDYH

SEQ ID NO: 2379735 - protein, 19 aa, Entamoeba dispar
LGGFAPRLFGDYDDEWYSD

SEQ ID NO: 2379736 - protein, 20 aa, Entamoeba dispar
LIDLGSCCFDNYSLYSYIQS

SEQ ID NO: 2379737 - protein, 17 aa, Entamoeba dispar
LILLVAFILYAKLVLLK

SEQ ID NO: 2379738 - protein, 20 aa, Entamoeba dispar
LKFTSIISIICIFYTMITII

SEQ ID NO: 2379739 - protein, 17 aa, Entamoeba dispar
LKILISTTISSNKNTIK

SEQ ID NO: 2379740 - protein, 17 aa, Entamoeba dispar
LKLIDLGSCCFDNYSLY

SEQ ID NO: 2379741 - protein, 23 aa, Entamoeba dispar
LKVLSYFLPFSIYINDDNKKMYL

SEQ ID NO: 2379742 - protein, 18 aa, Entamoeba dispar
LLDFCYYTNAGVITTLIS

SEQ ID NO: 2379743 - protein, 21 aa, Entamoeba dispar
LLFVVCHAFELHPFVINKGKH

SEQ ID NO: 2379744 - protein, 23 aa, Entamoeba dispar
LMKNKRKPTEIVVYTDSYCYSAC

SEQ ID NO: 2379745 - protein, 18 aa, Entamoeba dispar
LMRKPRKPTEIVVYTDPL

SEQ ID NO: 2379746 - protein, 25 aa, Entamoeba dispar
LNEGECSICYSCLKRKCVAFSCGHK

SEQ ID NO: 2379747 - protein, 21 aa, Entamoeba dispar
LPEYGAFLFYASYGIETRGSS

SEQ ID NO: 2379748 - protein, 22 aa, Entamoeba dispar
LPSLSQRMVCFFLFILSCYLFS

SEQ ID NO: 2379749 - protein, 17 aa, Entamoeba dispar
LQKCILGLVALLIIFQA

SEQ ID NO: 2379750 - protein, 18 aa, Entamoeba dispar
LSALKFTSIISIICIFYT

SEQ ID NO: 2379751 - protein, 21 aa, Entamoeba dispar
LSEKYKFLFTTHLCPLSDHIK

SEQ ID NO: 2379752 - protein, 24 aa, Entamoeba dispar
LSIKSIFVSLAIEIIVLLYLIDND

SEQ ID NO: 2379753 - protein, 21 aa, Entamoeba dispar
LSSGFPAFLLLYVNTLPLLLF

SEQ ID NO: 2379754 - protein, 30 aa, Entamoeba dispar
LTSFCFQLSIKWIFVLSLRLRNGLISMIYE

SEQ ID NO: 2379755 - protein, 22 aa, Entamoeba dispar
LYTKSVCRSCVDGYYNNQNKCL

SEQ ID NO: 2379756 - protein, 22 aa, Entamoeba dispar
MGAFSLGSWYASVVLRGKGGKK

SEQ ID NO: 2379757 - protein, 21 aa, Entamoeba dispar
MISYGHLFLFPIILINCCSVV

SEQ ID NO: 2379758 - protein, 26 aa, Entamoeba dispar
MMLDKFRSEYIIQFYGAVFIPNKICM

SEQ ID NO: 2379759 - protein, 20 aa, Entamoeba dispar
MRSAFGYSFSLYFSALIVMV

SEQ ID NO: 2379760 - protein, 23 aa, Entamoeba dispar
MSTYFCWLIIPLLMKENGATPFD

SEQ ID NO: 2379761 - protein, 21 aa, Entamoeba dispar
NAFCFNGILLVLIAFGVNQFS

SEQ ID NO: 2379762 - protein, 19 aa, Entamoeba dispar
NAGPKIKGVILGMSECVGE

SEQ ID NO: 2379763 - protein, 29 aa, Entamoeba dispar
NAIYFKGEWKTPFKILPKKMKFEGDEEVI

SEQ ID NO: 2379764 - protein, 17 aa, Entamoeba dispar
NDIQFWSKRDHFVGLSI

SEQ ID NO: 2379765 - protein, 17 aa, Entamoeba dispar
NDLKILISTTISSNKNT

SEQ ID NO: 2379766 - protein, 24 aa, Entamoeba dispar
NEQFKCIQCKKGYYLNSKQECQYD

SEQ ID NO: 2379767 - protein, 20 aa, Entamoeba dispar
NEQWYLELLNIFKKVIERTI

SEQ ID NO: 2379768 - protein, 25 aa, Entamoeba dispar
NGIKKRIAPIIFHNTFWLIKDYYTP

SEQ ID NO: 2379769 - protein, 21 aa, Entamoeba dispar
NKCVKCAEGKYSIDGVSCTGD

SEQ ID NO: 2379770 - protein, 19 aa, Entamoeba dispar
NKEIVWWMIMIIIIIILII

SEQ ID NO: 2379771 - protein, 17 aa, Entamoeba dispar
NKRRIIRQFILNETVNS

SEQ ID NO: 2379772 - protein, 18 aa, Entamoeba dispar
NPAAKRTKSIIVAFLTSS

SEQ ID NO: 2379773 - protein, 25 aa, Entamoeba dispar
NQCLSCKTKLLLNGICTLSSDNCNS

SEQ ID NO: 2379774 - protein, 27 aa, Entamoeba dispar
NTSEYCPFGKLIGKFKTLRQFCQLWNI

SEQ ID NO: 2379775 - protein, 25 aa, Entamoeba dispar
NYGKYPFSQCVSSGKGWEYDRNSNP

SEQ ID NO: 2379776 - protein, 23 aa, Entamoeba dispar
NYTAKYCIGVNCECDVGYFYSTY

SEQ ID NO: 2379777 - protein, 23 aa, Entamoeba dispar
NYYRVSMFIFVFIGSLLVDVYSL

SEQ ID NO: 2379778 - protein, 17 aa, Entamoeba dispar
PIDTCPFLTQFTFIKVV

SEQ ID NO: 2379779 - protein, 19 aa, Entamoeba dispar
PKNKRLVKRDSRCDKEINI

SEQ ID NO: 2379780 - protein, 24 aa, Entamoeba dispar
PKSKYCLRCNTGYYMDKGECYPCQ

SEQ ID NO: 2379781 - protein, 22 aa, Entamoeba dispar
PQAQIYLSLFIKKASVIGLNSP

SEQ ID NO: 2379782 - protein, 20 aa, Entamoeba dispar
PRVNLLPRYNNVGVGGTFDR

SEQ ID NO: 2379783 - protein, 18 aa, Entamoeba dispar
PYQIIKFSLTLEQSNEGT

SEQ ID NO: 2379784 - protein, 17 aa, Entamoeba dispar
QIFFYLLFYPNKKEFAL

SEQ ID NO: 2379785 - protein, 23 aa, Entamoeba dispar
QKDKCIICGEGYFMSSTGICKLT

SEQ ID NO: 2379786 - protein, 22 aa, Entamoeba dispar
QKDKCIICGEGYFMSSTGICKS

SEQ ID NO: 2379787 - protein, 26 aa, Entamoeba dispar
QLLFKRFPTNFLINLFGSWSVVSSRG

SEQ ID NO: 2379788 - protein, 25 aa, Entamoeba dispar
QNGVCVFNRDCIFEKAKQLNIGLNR

SEQ ID NO: 2379789 - protein, 21 aa, Entamoeba dispar
QRQIICLARALLKKSKILIMD

SEQ ID NO: 2379790 - protein, 26 aa, Entamoeba dispar
QTDIELIMSFGCYFIVTQQTTFKSIS

SEQ ID NO: 2379791 - protein, 18 aa, Entamoeba dispar
REGLPLVLKGVDAIINDK

SEQ ID NO: 2379792 - protein, 24 aa, Entamoeba dispar
RIAARAGGMVFPLIFSTIVKQLCA

SEQ ID NO: 2379793 - protein, 24 aa, Entamoeba dispar
RIGHWLELNLLEFSDSINYMQVQL

SEQ ID NO: 2379794 - protein, 27 aa, Entamoeba dispar
RIIFDLLLEQYFRYFFMHWCDSVQFAF

SEQ ID NO: 2379795 - protein, 24 aa, Entamoeba dispar
RKEEELRKKYCIFDMSRSNIEFHS

SEQ ID NO: 2379796 - protein, 26 aa, Entamoeba dispar
RKLRTKELWCMGGTMSARSSLVTLML

SEQ ID NO: 2379797 - protein, 18 aa, Entamoeba dispar
RLNISIQLLEDFLFEKGY

SEQ ID NO: 2379798 - protein, 19 aa, Entamoeba dispar
RLTLFDFLNKCLTYKPEDR

SEQ ID NO: 2379799 - protein, 23 aa, Entamoeba dispar
RQLYRYANWLDLILLAVGIFGSI

SEQ ID NO: 2379800 - protein, 24 aa, Entamoeba dispar
RRGIYKWAPLLSIFNCLTTLLTQV

SEQ ID NO: 2379801 - protein, 17 aa, Entamoeba dispar
RRQVLLVDFAVAWPDDN

SEQ ID NO: 2379802 - protein, 28 aa, Entamoeba dispar
RTSYQNFISRFGVKFTITSNNNHLKGQA

SEQ ID NO: 2379803 - protein, 24 aa, Entamoeba dispar
SAAFIKKSLRLCLEAPTGSILIIL

SEQ ID NO: 2379804 - protein, 20 aa, Entamoeba dispar
SAQPYVNWFLAFMGGLAGGF

SEQ ID NO: 2379805 - protein, 22 aa, Entamoeba dispar
SAVICLFTSIILLILIPLSYKR

SEQ ID NO: 2379806 - protein, 19 aa, Entamoeba dispar
SCLLLFYHQEWPSGPRRPF

SEQ ID NO: 2379807 - protein, 19 aa, Entamoeba dispar
SCNQFGSLCQKCTPNQCTL

SEQ ID NO: 2379808 - protein, 29 aa, Entamoeba dispar
SECVGELTCCLCPLFAGLIATQTDDRKWA

SEQ ID NO: 2379809 - protein, 19 aa, Entamoeba dispar
SFALAFFWSICEYLLSNEI

SEQ ID NO: 2379810 - protein, 21 aa, Entamoeba dispar
SGAILSYIMCKAMNRSFMSVI

SEQ ID NO: 2379811 - protein, 18 aa, Entamoeba dispar
SIGYKNCNMMIYKEKTKE

SEQ ID NO: 2379812 - protein, 18 aa, Entamoeba dispar
SILLPTFLMYKALCLDTF

SEQ ID NO: 2379813 - protein, 20 aa, Entamoeba dispar
SKCTICKDGFILFNNECLST

SEQ ID NO: 2379814 - protein, 19 aa, Entamoeba dispar
SKGRTTIIVAHRLTTVRNA

SEQ ID NO: 2379815 - protein, 22 aa, Entamoeba dispar
SKRAPFTAIINGLVLGWVHAFI

SEQ ID NO: 2379816 - protein, 28 aa, Entamoeba dispar
SLCQKCTPNQCTLCLDGIINENGICVDP

SEQ ID NO: 2379817 - protein, 25 aa, Entamoeba dispar
SNEKFKCIQCKKGYYLNSKQECQID

SEQ ID NO: 2379818 - protein, 25 aa, Entamoeba dispar
SNGRCKKCGIGCKTCKESGDDSCTS

SEQ ID NO: 2379819 - protein, 21 aa, Entamoeba dispar
SNSQCTKCSFWHRPDINKTAC

SEQ ID NO: 2379820 - protein, 23 aa, Entamoeba dispar
SNVFRIGFYIGKPFEISLLIQSI

SEQ ID NO: 2379821 - protein, 20 aa, Entamoeba dispar
SPVSSFKCHSYRYTVFSILH

SEQ ID NO: 2379822 - protein, 23 aa, Entamoeba dispar
SREECAIVMKNCCDQLFAQTGID

SEQ ID NO: 2379823 - protein, 20 aa, Entamoeba dispar
SSQQCAICNDGYYRDGKVCS

SEQ ID NO: 2379824 - protein, 23 aa, Entamoeba dispar
SVANLPWRVFVYKFLNTIVDDLF

SEQ ID NO: 2379825 - protein, 18 aa, Entamoeba dispar
SVCMVCTMTCRFVDCFTD

SEQ ID NO: 2379826 - protein, 19 aa, Entamoeba dispar
SVGGVAWSTYWHYFRAGGF

SEQ ID NO: 2379827 - protein, 25 aa, Entamoeba dispar
SWCSPCTTIRCSSCQVGTYLSNGLC

SEQ ID NO: 2379828 - protein, 19 aa, Entamoeba dispar
SYILSLFGSKAFPSTAYDL

SEQ ID NO: 2379829 - protein, 17 aa, Entamoeba dispar
TCEEFKNGCKIGNKTYC

SEQ ID NO: 2379830 - protein, 42 aa, Entamoeba dispar
TCFLIAGVFYYHFWLLCILFCIARTSFELVRLFYDCQIPYIM

SEQ ID NO: 2379831 - protein, 25 aa, Entamoeba dispar
THDILSCIICSLIIIILILIIVNFM

SEQ ID NO: 2379832 - protein, 30 aa, Entamoeba dispar
THTKIGEKMIKEWIRQPLIDKDKINKRLEL

SEQ ID NO: 2379833 - protein, 19 aa, Entamoeba dispar
TKIKHIVKLISRMVVQVDR

SEQ ID NO: 2379834 - protein, 25 aa, Entamoeba dispar
TKNNKCSKCSFWYGINEDGTKCNKE

SEQ ID NO: 2379835 - protein, 18 aa, Entamoeba dispar
TLEMVLGVSTPIEVKSIK

SEQ ID NO: 2379836 - protein, 23 aa, Entamoeba dispar
TLTPRLLLSPVMSTYYDRLYKYL

SEQ ID NO: 2379837 - protein, 21 aa, Entamoeba dispar
TMILIGLIVMWWSSEYDDESF

SEQ ID NO: 2379838 - protein, 27 aa, Entamoeba dispar
TNGEVPKWAIAVIVVVGLIIIIALILL

SEQ ID NO: 2379839 - protein, 18 aa, Entamoeba dispar
TNNDGTCVECLFSETEEK

SEQ ID NO: 2379840 - protein, 21 aa, Entamoeba dispar
TPESLSLVFQKERMIPQTKIE

SEQ ID NO: 2379841 - protein, 18 aa, Entamoeba dispar
TQIEKSFLWEHLLLQQHP

SEQ ID NO: 2379842 - protein, 19 aa, Entamoeba dispar
TSRYFSILISRSFSIYIFI

SEQ ID NO: 2379843 - protein, 17 aa, Entamoeba dispar
TTLTIAHRLHSIMDSNR

SEQ ID NO: 2379844 - protein, 20 aa, Entamoeba dispar
TVRENICFLAPYNKEKYKQA

SEQ ID NO: 2379845 - protein, 24 aa, Entamoeba dispar
TYTPLCICTPYYVFYSFLLLLLFL

SEQ ID NO: 2379846 - protein, 19 aa, Entamoeba dispar
VAGRLPGHMNVLLAEANVP

SEQ ID NO: 2379847 - protein, 25 aa, Entamoeba dispar
VCIILLCIITYWAFIPIGVCLLFVC

SEQ ID NO: 2379848 - protein, 18 aa, Entamoeba dispar
VCPLCKQPILPLKINYEK

SEQ ID NO: 2379849 - protein, 19 aa, Entamoeba dispar
VCSNSSPNCLVCKNGYGLK

SEQ ID NO: 2379850 - protein, 22 aa, Entamoeba dispar
VDNEVLKGISFKAEQGKTIALV

SEQ ID NO: 2379851 - protein, 24 aa, Entamoeba dispar
VEIGNEYFVFVGFTQHDIYNPEPG

SEQ ID NO: 2379852 - protein, 18 aa, Entamoeba dispar
VILIVAVVVRKYLNLKSQ

SEQ ID NO: 2379853 - protein, 20 aa, Entamoeba dispar
VKRYLSKDVHDLFMNTLTQW

SEQ ID NO: 2379854 - protein, 18 aa, Entamoeba dispar
VKSNDFMLVMGPSTQINS

SEQ ID NO: 2379855 - protein, 18 aa, Entamoeba dispar
VSEHPFVSMVLLTVTMIL

SEQ ID NO: 2379856 - protein, 21 aa, Entamoeba dispar
VSQPSVMKWEQMKLMRKPRKP

SEQ ID NO: 2379857 - protein, 21 aa, Entamoeba dispar
VSTPRRRLLSLVSPRKTESPQ

SEQ ID NO: 2379858 - protein, 23 aa, Entamoeba dispar
VSVLCLLPLLIVILLIVLPSLIS

SEQ ID NO: 2379859 - protein, 24 aa, Entamoeba dispar
VTIPKFKIETSFSMNQQLKSLGLI

SEQ ID NO: 2379860 - protein, 20 aa, Entamoeba dispar
VVLCIPYLIGQMGIELDNII

SEQ ID NO: 2379861 - protein, 19 aa, Entamoeba dispar
VVVFSSVQVVFGLLSPFLQ

SEQ ID NO: 2379862 - protein, 21 aa, Entamoeba dispar
VVYLIACCGILGIAVYKFSKM

SEQ ID NO: 2379863 - protein, 25 aa, Entamoeba dispar
VVYVGFRFALGFVFYPFEVSNTYMN

SEQ ID NO: 2379864 - protein, 35 aa, Entamoeba dispar
VYVDDCNVCYSGGYRKCGLNSYIVMKLEKNHHYYI

SEQ ID NO: 2379865 - protein, 24 aa, Entamoeba dispar
YCEILWQYQGCFVLEASYTSTIFE

SEQ ID NO: 2379866 - protein, 19 aa, Entamoeba dispar
YCNHLCIVTELLGCSLYEL

SEQ ID NO: 2379867 - protein, 25 aa, Entamoeba dispar
YECSKYNPNCLVCSNSSPNCLVCKN

SEQ ID NO: 2379868 - protein, 17 aa, Entamoeba dispar
YFIHLVFTYSYILCLYT

SEQ ID NO: 2379869 - protein, 26 aa, Entamoeba dispar
YGCKRCKEGYYLTKDKKCLKCDDKCE

SEQ ID NO: 2379870 - protein, 20 aa, Entamoeba dispar
YGLLCANGLHKMMIRNLFGT

SEQ ID NO: 2379871 - protein, 24 aa, Entamoeba dispar
YIHSCVYIGFSQCFPVLVSWTQII

SEQ ID NO: 2379872 - protein, 19 aa, Entamoeba dispar
YIIFLGGFAPRLFGDYDDE

SEQ ID NO: 2379873 - protein, 24 aa, Entamoeba dispar
YLPRPFHEYPFKTTMALSREECAI

SEQ ID NO: 2379874 - protein, 33 aa, Entamoeba dispar
YMYLCIYLYIYICIYLYMYICIYVPSYYVYPII

SEQ ID NO: 2379875 - protein, 17 aa, Entamoeba dispar
YMYSLFYRKDGTIAGEV

SEQ ID NO: 2379876 - protein, 19 aa, Entamoeba dispar
YPLVCGICGSIGGLFSKGI

SEQ ID NO: 2379877 - protein, 22 aa, Entamoeba dispar
YQAYSLMCLHHLIVQHELNVPS

SEQ ID NO: 2379878 - protein, 19 aa, Entamoeba dispar
YQYSCPMSLSIIIKLSISC

SEQ ID NO: 2379879 - protein, 20 aa, Entamoeba dispar
YREGLPLVLKGVDAIINDKE

SEQ ID NO: 2379880 - protein, 24 aa, Entamoeba dispar
YRKKEPYQRIEFSLTIEQSNEGTT

SEQ ID NO: 2379881 - protein, 25 aa, Entamoeba dispar
YTTIRFLNDYGLEWNDIYFETRTSP

SEQ ID NO: 2379882 - protein, 28 aa, Entamoeba dispar
YVKNTEFPKWTIGVIVIFVIALIVIVVV

SEQ ID NO: 2379883 - protein, 17 aa, Entamoeba dispar
YYLEAYVFKDILKNPPQ

SEQ ID NO: 2379884 - protein, 24 aa, Entamoeba dispar
YYSHSTLFFKPSTEELLTPLNSLK

SEQ ID NO: 2379885 - protein, 26 aa, Entamoeba dispar
AAAHGVIIGCLFFDYSKSKKALRDEQ

SEQ ID NO: 2379886 - protein, 17 aa, Entamoeba dispar
AAGRTSVIIAHRLSTIR

SEQ ID NO: 2379887 - protein, 18 aa, Entamoeba dispar
AAGRTSVIIAHRLSTIRD

SEQ ID NO: 2379888 - protein, 17 aa, Entamoeba dispar
AAIGCGIVSGALGLVHI

SEQ ID NO: 2379889 - protein, 19 aa, Entamoeba dispar
AAIIICIIILISIIILIGI

SEQ ID NO: 2379890 - protein, 20 aa, Entamoeba dispar
AAIISKCYDFLNASTSPDAL

SEQ ID NO: 2379891 - protein, 18 aa, Entamoeba dispar
AAIITYWIVLGIEKNQLK

SEQ ID NO: 2379892 - protein, 23 aa, Entamoeba dispar
AAILPLFVFIIFPRQPKYKNDET

SEQ ID NO: 2379893 - protein, 19 aa, Entamoeba dispar
AAIPDFYIQTIVSYMSEKK

SEQ ID NO: 2379894 - protein, 30 aa, Entamoeba dispar
AAKISLLFIVIGFFFPLVWIINYVLFSSSK

SEQ ID NO: 2379895 - protein, 23 aa, Entamoeba dispar
AAKNCFYCECSLQSESGWILTMY

SEQ ID NO: 2379896 - protein, 22 aa, Entamoeba dispar
AALFFEIYFFFTIPSASIHFVV

SEQ ID NO: 2379897 - protein, 24 aa, Entamoeba dispar
AASLERFYTFFISYFFQLTTKTDI

SEQ ID NO: 2379898 - protein, 24 aa, Entamoeba dispar
AATSRIASMVGIKVFVTGGLGGVH

SEQ ID NO: 2379899 - protein, 27 aa, Entamoeba dispar
AAVVFIVLTLWWFYKALTFTGYVQPDD

SEQ ID NO: 2379900 - protein, 19 aa, Entamoeba dispar
ACGHPPVPHNCHFGPCPKC

SEQ ID NO: 2379901 - protein, 27 aa, Entamoeba dispar
ACIKHFRIVAVLLKYWLKIRNLNCPFK

SEQ ID NO: 2379902 - protein, 17 aa, Entamoeba dispar
ACLKSDVYSFGMVLWEM

SEQ ID NO: 2379903 - protein, 19 aa, Entamoeba dispar
ACLPGTIMRVIRFSIWYQG

SEQ ID NO: 2379904 - protein, 18 aa, Entamoeba dispar
ACQVSGTTSVKCFCTKGT

SEQ ID NO: 2379905 - protein, 22 aa, Entamoeba dispar
ACSKPSLSGMWFHLYGADRSLI

SEQ ID NO: 2379906 - protein, 23 aa, Entamoeba dispar
ACSQLPIFRFILSSNIYTMNVGY

SEQ ID NO: 2379907 - protein, 23 aa, Entamoeba dispar
ACSSRFPIVLVPAFMSSSLHIKS

SEQ ID NO: 2379908 - protein, 23 aa, Entamoeba dispar
ACYKMGIVGFVLWSLATIVYFIY

SEQ ID NO: 2379909 - protein, 17 aa, Entamoeba dispar
ADAQGAVKFDQKGKYNY

SEQ ID NO: 2379910 - protein, 20 aa, Entamoeba dispar
ADCINKIVKIQCYHVEITSS

SEQ ID NO: 2379911 - protein, 23 aa, Entamoeba dispar
ADDPKFKYQWQIAEYVCKGNRPQ

SEQ ID NO: 2379912 - protein, 17 aa, Entamoeba dispar
ADFIGRILIPYWIFLIL

SEQ ID NO: 2379913 - protein, 28 aa, Entamoeba dispar
ADFYIPLFISEALCFLFLIIFQGTFTNI

SEQ ID NO: 2379914 - protein, 19 aa, Entamoeba dispar
ADIDLSVGVLIVNDIEDIN

SEQ ID NO: 2379915 - protein, 19 aa, Entamoeba dispar
ADKNYSFFICSKVQSSFSL

SEQ ID NO: 2379916 - protein, 17 aa, Entamoeba dispar
ADKSNVLKNWEFPDNYP

SEQ ID NO: 2379917 - protein, 22 aa, Entamoeba dispar
ADLSSAIGRCVGSNPTGCILFI

SEQ ID NO: 2379918 - protein, 25 aa, Entamoeba dispar
ADMNCLYRFNLLLSSNITHLHFENY

SEQ ID NO: 2379919 - protein, 20 aa, Entamoeba dispar
ADNARNIWAYEYLQDLSNEY

SEQ ID NO: 2379920 - protein, 23 aa, Entamoeba dispar
ADNLYHPSCYIENFIKGGEDEEL

SEQ ID NO: 2379921 - protein, 19 aa, Entamoeba dispar
ADPCCNPKAPGKCNTFQER

SEQ ID NO: 2379922 - protein, 19 aa, Entamoeba dispar
ADPYPDIPRFHLIEKVGEI

SEQ ID NO: 2379923 - protein, 19 aa, Entamoeba dispar
ADRNVLEFIKTVSDLNQSG

SEQ ID NO: 2379924 - protein, 18 aa, Entamoeba dispar
ADSTIYRTEVSGLTKITF

SEQ ID NO: 2379925 - protein, 18 aa, Entamoeba dispar
ADTLFRWLNETVVKERKT

SEQ ID NO: 2379926 - protein, 19 aa, Entamoeba dispar
ADVGFKAGDKIAIFCETRY

SEQ ID NO: 2379927 - protein, 25 aa, Entamoeba dispar
ADWSFSLVFLPAWYVFGFYIIVTQL

SEQ ID NO: 2379928 - protein, 26 aa, Entamoeba dispar
ADYALPRLFVGVQIPVILSALSSLLS

SEQ ID NO: 2379929 - protein, 25 aa, Entamoeba dispar
ADYPSIRCADGFQIDLLIKLRETRL

SEQ ID NO: 2379930 - protein, 23 aa, Entamoeba dispar
ADYSRLIYYDISINLNYENSDEN

SEQ ID NO: 2379931 - protein, 23 aa, Entamoeba dispar
AEAEKILDLFSYIRMDPKDDNFS

SEQ ID NO: 2379932 - protein, 20 aa, Entamoeba dispar
AEALPFSALQDVIDYERLLI

SEQ ID NO: 2379933 - protein, 28 aa, Entamoeba dispar
AEDLFFKSGLLFYVLVILYIIVSRTIVS

SEQ ID NO: 2379934 - protein, 25 aa, Entamoeba dispar
AEDYFRYGLELSTLCLPQTQINNCL

SEQ ID NO: 2379935 - protein, 24 aa, Entamoeba dispar
AEEFISRLVLPLTRLLQNEILRDT

SEQ ID NO: 2379936 - protein, 24 aa, Entamoeba dispar
AEEVIKSYIWSSVGCELTNIRMRE

SEQ ID NO: 2379937 - protein, 25 aa, Entamoeba dispar
AEGMSPCRFEYIGGKVITFRSSSEF

SEQ ID NO: 2379938 - protein, 21 aa, Entamoeba dispar
AEGYSGGALKHGPFALIEKGL

SEQ ID NO: 2379939 - protein, 19 aa, Entamoeba dispar
AEHIDPFVALSFLDATLMI

SEQ ID NO: 2379940 - protein, 19 aa, Entamoeba dispar
AEHLIHRFVLLSKSFEKDP

SEQ ID NO: 2379941 - protein, 23 aa, Entamoeba dispar
AEISFNIFNVIWKRFLNKNYGIN

SEQ ID NO: 2379942 - protein, 21 aa, Entamoeba dispar
AEKFAKEGFNLIIMDRLAEPL

SEQ ID NO: 2379943 - protein, 17 aa, Entamoeba dispar
AELCGRCTDGSYFDSTT

SEQ ID NO: 2379944 - protein, 29 aa, Entamoeba dispar
AELLRIDFLSILSSFPYFVEVSVPVVTPT

SEQ ID NO: 2379945 - protein, 17 aa, Entamoeba dispar
AELRSKVLDLRRKRDRL

SEQ ID NO: 2379946 - protein, 17 aa, Entamoeba dispar
AEPKYLPFLKEFCETQM

SEQ ID NO: 2379947 - protein, 20 aa, Entamoeba dispar
AESMYKVILNIMNRTEFQPH

SEQ ID NO: 2379948 - protein, 18 aa, Entamoeba dispar
AESPCKALRVYVKQYFSR

SEQ ID NO: 2379949 - protein, 30 aa, Entamoeba dispar
AESQLIMFCCGHKYHCDCIINELNLHKTPF

SEQ ID NO: 2379950 - protein, 19 aa, Entamoeba dispar
AESVICCRVSPKQKADIAL

SEQ ID NO: 2379951 - protein, 17 aa, Entamoeba dispar
AETRNGNWFSLDGADHS

SEQ ID NO: 2379952 - protein, 17 aa, Entamoeba dispar
AEVKLKSLDSMIRLMFQ

SEQ ID NO: 2379953 - protein, 24 aa, Entamoeba dispar
AEYCRIHYLEIMLSTQSFKEKNYQ

SEQ ID NO: 2379954 - protein, 21 aa, Entamoeba dispar
AFCIIGIVGIWLSIFHITNSL

SEQ ID NO: 2379955 - protein, 25 aa, Entamoeba dispar
AFCSILKIIIHLSLLILVFGPPYSK

SEQ ID NO: 2379956 - protein, 18 aa, Entamoeba dispar
AFCYQLGVFISRSSLPLF

SEQ ID NO: 2379957 - protein, 26 aa, Entamoeba dispar
AFDRKCPYSMLGSSWEVLEFVNKGKR

SEQ ID NO: 2379958 - protein, 29 aa, Entamoeba dispar
AFEFPYECIPQFYSCYSLFTPNEKDFTCI

SEQ ID NO: 2379959 - protein, 26 aa, Entamoeba dispar
AFEYVWKCWSNFHFYFYIILAGMYIL

SEQ ID NO: 2379960 - protein, 17 aa, Entamoeba dispar
AFFAFKINHSLFQQLSI

SEQ ID NO: 2379961 - protein, 18 aa, Entamoeba dispar
AFFASRPKIYSSLKDSFP

SEQ ID NO: 2379962 - protein, 20 aa, Entamoeba dispar
AFFFIFPMRLGQIITALNQR

SEQ ID NO: 2379963 - protein, 18 aa, Entamoeba dispar
AFGIFLILCYIIVFIATL

SEQ ID NO: 2379964 - protein, 20 aa, Entamoeba dispar
AFGLFRKIIGGVFVEEINCS

SEQ ID NO: 2379965 - protein, 20 aa, Entamoeba dispar
AFGVVYRGTYRGIEVAVKKL

SEQ ID NO: 2379966 - protein, 19 aa, Entamoeba dispar
AFHMAFELLMSVLKDSFVH

SEQ ID NO: 2379967 - protein, 23 aa, Entamoeba dispar
AFKEADVALAMGLRGTDVAKQAA

SEQ ID NO: 2379968 - protein, 26 aa, Entamoeba dispar
AFKYSGLAFKCNRTYLDGKFTMTSSY

SEQ ID NO: 2379969 - protein, 17 aa, Entamoeba dispar
AFLLQILTGYFIYIIIF

SEQ ID NO: 2379970 - protein, 22 aa, Entamoeba dispar
AFNSGFLVLHFKNFFKEEDAQE

SEQ ID NO: 2379971 - protein, 24 aa, Entamoeba dispar
AFNVFPISLLMNFRPKAPKITWRL

SEQ ID NO: 2379972 - protein, 30 aa, Entamoeba dispar
AFRPLAVSLFGRYLKAIIIGGSALPSELQH

SEQ ID NO: 2379973 - protein, 25 aa, Entamoeba dispar
AFSCGHKFHYSCVIPWLQHNSVCPL

SEQ ID NO: 2379974 - protein, 27 aa, Entamoeba dispar
AFSCGHKFHYSCVIPWLQHNSVCPLCK

SEQ ID NO: 2379975 - protein, 19 aa, Entamoeba dispar
AFSDSSACLSHLVQNGSNF

SEQ ID NO: 2379976 - protein, 20 aa, Entamoeba dispar
AFSFCWNLVTQNGFSSISTL

SEQ ID NO: 2379977 - protein, 17 aa, Entamoeba dispar
AFSFLIIAGGKTILLTN

SEQ ID NO: 2379978 - protein, 21 aa, Entamoeba dispar
AFSLMLIICGFIIVVIEMFLY

SEQ ID NO: 2379979 - protein, 17 aa, Entamoeba dispar
AFVLFKVINDSWLAIKE

SEQ ID NO: 2379980 - protein, 25 aa, Entamoeba dispar
AFVVSFIICCIVAYKFCDKTESSVK

SEQ ID NO: 2379981 - protein, 25 aa, Entamoeba dispar
AFYFLIGFICSWTFGNDVLSPITKA

SEQ ID NO: 2379982 - protein, 17 aa, Entamoeba dispar
AGAYKFYCMPPLTYQIV

SEQ ID NO: 2379983 - protein, 28 aa, Entamoeba dispar
AGCDAMFAFPWYITWFLHSVEDIEVGLR

SEQ ID NO: 2379984 - protein, 24 aa, Entamoeba dispar
AGDAEFWLGVFSGMWTFGQSLGYL

SEQ ID NO: 2379985 - protein, 19 aa, Entamoeba dispar
AGDFLFNGETSFIVQTFKN

SEQ ID NO: 2379986 - protein, 25 aa, Entamoeba dispar
AGDIICIYGKLTPLRECAVKENFTL

SEQ ID NO: 2379987 - protein, 28 aa, Entamoeba dispar
AGDLDVFITFVLDCINVLNGLLDFTMNA

SEQ ID NO: 2379988 - protein, 18 aa, Entamoeba dispar
AGDVLTVFFTIWMASQTL

SEQ ID NO: 2379989 - protein, 18 aa, Entamoeba dispar
AGEGYSYIHVKWCQIIII

SEQ ID NO: 2379990 - protein, 23 aa, Entamoeba dispar
AGFIASHIVIHFVKRYPDCRIVN

SEQ ID NO: 2379991 - protein, 18 aa, Entamoeba dispar
AGGALVFIALTIYYIVSQ

SEQ ID NO: 2379992 - protein, 19 aa, Entamoeba dispar
AGGFIGLILCLMPFVVRCA

SEQ ID NO: 2379993 - protein, 21 aa, Entamoeba dispar
AGHLRSTIIGNFIANIHKLLG

SEQ ID NO: 2379994 - protein, 19 aa, Entamoeba dispar
AGIIPLPFFGTTIKTENEN

SEQ ID NO: 2379995 - protein, 23 aa, Entamoeba dispar
AGIVCGCCVILLIIILIIIGFII

SEQ ID NO: 2379996 - protein, 21 aa, Entamoeba dispar
AGKCLCILLTCSANQISFVKQ

SEQ ID NO: 2379997 - protein, 25 aa, Entamoeba dispar
AGKGRTGLMSACFLVYMLDSLNAHE

SEQ ID NO: 2379998 - protein, 25 aa, Entamoeba dispar
AGLSLDKDLHCFNSRVDTFDNNLFT

SEQ ID NO: 2379999 - protein, 26 aa, Entamoeba dispar
AGMFKCGMCVPVVEGQETIYAKYECE

SEQ ID NO: 2380000 - protein, 17 aa, Entamoeba dispar
AGNIIRIFTTLKEMDGD

SEQ ID NO: 2380001 - protein, 24 aa, Entamoeba dispar
AGNNKRLLCRSLIYNPEPYYSKYN

SEQ ID NO: 2380002 - protein, 17 aa, Entamoeba dispar
AGPTWLMILLSSPSILF

SEQ ID NO: 2380003 - protein, 25 aa, Entamoeba dispar
AGSLTLLVLIQWSGLFQIRHSLHTK

SEQ ID NO: 2380004 - protein, 39 aa, Entamoeba dispar
AGSLVFILCCVLCFLGLLCFSCIPCCLDGLKDAHHKWFV

SEQ ID NO: 2380005 - protein, 27 aa, Entamoeba dispar
AGTFGIVYRAKWRKIEIAVKVLKTDMV

SEQ ID NO: 2380006 - protein, 26 aa, Entamoeba dispar
AGTGCAICKDGFYRKDVDCQECIKNC

SEQ ID NO: 2380007 - protein, 18 aa, Entamoeba dispar
AGVNPRFIPLPDPNGKSS

SEQ ID NO: 2380008 - protein, 25 aa, Entamoeba dispar
AGYFYCSFCTSLLKKRKCDSDLSDK

SEQ ID NO: 2380009 - protein, 20 aa, Entamoeba dispar
AHCYAYAAEFILMYITITAM

SEQ ID NO: 2380010 - protein, 19 aa, Entamoeba dispar
AHFFPVKAVNCYNRKVISI

SEQ ID NO: 2380011 - protein, 19 aa, Entamoeba dispar
AHGGYKCGANGKWSDECVA

SEQ ID NO: 2380012 - protein, 19 aa, Entamoeba dispar
AHIFELCIEFAVIMHGGTV

SEQ ID NO: 2380013 - protein, 23 aa, Entamoeba dispar
AHIRMEFKTGKKLKGHGRRKYIL

SEQ ID NO: 2380014 - protein, 17 aa, Entamoeba dispar
AHLKYFYLSLPSLLLTY

SEQ ID NO: 2380015 - protein, 17 aa, Entamoeba dispar
AIATLFLPMSFIAALFG

SEQ ID NO: 2380016 - protein, 37 aa, Entamoeba dispar
AIAYPMLNLRPGFVNFLCMWGALVLTTFTSQGMYYAI

SEQ ID NO: 2380017 - protein, 28 aa, Entamoeba dispar
AICGFIIFRFIFKSEVPWIQKLGGCLGC

SEQ ID NO: 2380018 - protein, 18 aa, Entamoeba dispar
AICIDSCNRESKLGICST

SEQ ID NO: 2380019 - protein, 20 aa, Entamoeba dispar
AICKDGFYRKDVDCQECIKN

SEQ ID NO: 2380020 - protein, 21 aa, Entamoeba dispar
AICNHSRYLRDCFVSTAYGKE

SEQ ID NO: 2380021 - protein, 20 aa, Entamoeba dispar
AIDIFFKVIQTWPGLLTLTS

SEQ ID NO: 2380022 - protein, 19 aa, Entamoeba dispar
AIEMKGLMIKQSDKQLSQL

SEQ ID NO: 2380023 - protein, 19 aa, Entamoeba dispar
AIESTYFVNGCDYGTTTGL

SEQ ID NO: 2380024 - protein, 19 aa, Entamoeba dispar
AIFNCIKLPFQSFGYLIAC

SEQ ID NO: 2380025 - protein, 19 aa, Entamoeba dispar
AIFSKSVIKQQTFVRKRLQ

SEQ ID NO: 2380026 - protein, 18 aa, Entamoeba dispar
AIFSVSWSIGKAFGYLFG

SEQ ID NO: 2380027 - protein, 17 aa, Entamoeba dispar
AIGRGTFGNVYKATWRN

SEQ ID NO: 2380028 - protein, 19 aa, Entamoeba dispar
AIGSPQLHFTWMCELSHKL

SEQ ID NO: 2380029 - protein, 24 aa, Entamoeba dispar
AIGTLIGLIPCNFVVVYFSASMTN

SEQ ID NO: 2380030 - protein, 18 aa, Entamoeba dispar
AIIEPSGIILKESYLREI

SEQ ID NO: 2380031 - protein, 26 aa, Entamoeba dispar
AIIVTVCCFLLFFIIIAIIGVLLAYY

SEQ ID NO: 2380032 - protein, 21 aa, Entamoeba dispar
AIKEIRRLLISSGDITSEQMM

SEQ ID NO: 2380033 - protein, 25 aa, Entamoeba dispar
AIKTPCKKSRWILYDKELEACWKKL

SEQ ID NO: 2380034 - protein, 18 aa, Entamoeba dispar
AILDKSCTSFSNVFSLKF

SEQ ID NO: 2380035 - protein, 19 aa, Entamoeba dispar
AILHARNYLHYNIKPSNIL

SEQ ID NO: 2380036 - protein, 23 aa, Entamoeba dispar
AIQCGICYEIVGPKGVIRIRVVD

SEQ ID NO: 2380037 - protein, 20 aa, Entamoeba dispar
AIRLFPFVMAVSLFLNNTPV

SEQ ID NO: 2380038 - protein, 19 aa, Entamoeba dispar
AITAWEIFYQDEPYKDFKS

SEQ ID NO: 2380039 - protein, 22 aa, Entamoeba dispar
AITEFIKYIYLNGYYSLEEDKI

SEQ ID NO: 2380040 - protein, 20 aa, Entamoeba dispar
AITLKARISSPIDLFNLLEI

SEQ ID NO: 2380041 - protein, 20 aa, Entamoeba dispar
AIVAIWPSSKIAIYFSAAFW

SEQ ID NO: 2380042 - protein, 17 aa, Entamoeba dispar
AIVKPKNGWDYHQVEYN

SEQ ID NO: 2380043 - protein, 19 aa, Entamoeba dispar
AIVLLAFIIYRKCTSKNDY

SEQ ID NO: 2380044 - protein, 24 aa, Entamoeba dispar
AIYMLQKAFHCFGHKDEPVKSSLE

SEQ ID NO: 2380045 - protein, 19 aa, Entamoeba dispar
AKAAMIWIIGEYSDRITNV

SEQ ID NO: 2380046 - protein, 25 aa, Entamoeba dispar
AKALARGLLDLGLKKGDVIGFFSKR

SEQ ID NO: 2380047 - protein, 23 aa, Entamoeba dispar
AKDINKAVPCYKVVGEPFLESVN

SEQ ID NO: 2380048 - protein, 20 aa, Entamoeba dispar
AKEGNAFFSGLFGKRDLVLF

SEQ ID NO: 2380049 - protein, 25 aa, Entamoeba dispar
AKFANFQWSMFRGFPIMTVAFCGHY

SEQ ID NO: 2380050 - protein, 27 aa, Entamoeba dispar
AKFIRLKPLVFDFFKIPNYRVVMEKEL

SEQ ID NO: 2380051 - protein, 33 aa, Entamoeba dispar
AKFTYRHCFYLICGLVILLLILYFVFFKMDWSS

SEQ ID NO: 2380052 - protein, 17 aa, Entamoeba dispar
AKGKESFIFTDGKMNDG

SEQ ID NO: 2380053 - protein, 19 aa, Entamoeba dispar
AKIFFSLLIGSVFFNIQND

SEQ ID NO: 2380054 - protein, 19 aa, Entamoeba dispar
AKKRIGFLCTSIISDTTSI

SEQ ID NO: 2380055 - protein, 19 aa, Entamoeba dispar
AKKSLPFLTVVSLQRGSTF

SEQ ID NO: 2380056 - protein, 17 aa, Entamoeba dispar
AKLCLVKYYGFSGVQLK

SEQ ID NO: 2380057 - protein, 22 aa, Entamoeba dispar
AKLKKKRGVQHFDRETLQHSFN

SEQ ID NO: 2380058 - protein, 20 aa, Entamoeba dispar
AKLLFIRLLLYQLLFIFVLF

SEQ ID NO: 2380059 - protein, 20 aa, Entamoeba dispar
AKMANCHNFIYQLPQGYNTT

SEQ ID NO: 2380060 - protein, 19 aa, Entamoeba dispar
AKMGDEFKKILKEANESPL

SEQ ID NO: 2380061 - protein, 17 aa, Entamoeba dispar
AKNVMALMCKKPTPFTV

SEQ ID NO: 2380062 - protein, 18 aa, Entamoeba dispar
AKQFPRCLSIVDKVSATK

SEQ ID NO: 2380063 - protein, 23 aa, Entamoeba dispar
AKQSSKLMCIILIVVAIIMIIVV

SEQ ID NO: 2380064 - protein, 26 aa, Entamoeba dispar
AKRNPRLFCGIFEEFLGNGIEEESNW

SEQ ID NO: 2380065 - protein, 17 aa, Entamoeba dispar
AKRRGCEVFIVYRRSEY

SEQ ID NO: 2380066 - protein, 20 aa, Entamoeba dispar
AKSFPGVWVKFTSTINGYYS

SEQ ID NO: 2380067 - protein, 17 aa, Entamoeba dispar
AKSKFSLMLRDALLLYK

SEQ ID NO: 2380068 - protein, 29 aa, Entamoeba dispar
AKSLKDCEPFSELLRMIYYLFCQIKDSSR

SEQ ID NO: 2380069 - protein, 18 aa, Entamoeba dispar
AKSLLLKVDEAIALIKQP

SEQ ID NO: 2380070 - protein, 19 aa, Entamoeba dispar
AKSNIIIMHGFRGYSGPLT

SEQ ID NO: 2380071 - protein, 24 aa, Entamoeba dispar
AKSNLKTSIIFSSQLLRSIDYLES

SEQ ID NO: 2380072 - protein, 25 aa, Entamoeba dispar
AKTFKPALVSFKFTYGKNETDPFIV

SEQ ID NO: 2380073 - protein, 19 aa, Entamoeba dispar
AKTSFPLYIYTQSYELFEL

SEQ ID NO: 2380074 - protein, 18 aa, Entamoeba dispar
AKTYYGMWRLKKVCVKVL

SEQ ID NO: 2380075 - protein, 19 aa, Entamoeba dispar
AKVSLSIFIDFDIFNITQF

SEQ ID NO: 2380076 - protein, 19 aa, Entamoeba dispar
AKVYSKICQPEFYESGVKV

SEQ ID NO: 2380077 - protein, 19 aa, Entamoeba dispar
AKYGEWLRHVLEYFNYSTR

SEQ ID NO: 2380078 - protein, 20 aa, Entamoeba dispar
AKYGEWLRHVLEYFNYSTRH

SEQ ID NO: 2380079 - protein, 18 aa, Entamoeba dispar
AKYGWEIIRVVVREFKTS

SEQ ID NO: 2380080 - protein, 18 aa, Entamoeba dispar
AKYSQWIEKILAPRDDVN

SEQ ID NO: 2380081 - protein, 18 aa, Entamoeba dispar
ALASGFFVGPMLMEIAGK

SEQ ID NO: 2380082 - protein, 18 aa, Entamoeba dispar
ALCSMGVCTQCEDDYAIK

SEQ ID NO: 2380083 - protein, 19 aa, Entamoeba dispar
ALEGYRVLVAGVRNITNIY

SEQ ID NO: 2380084 - protein, 19 aa, Entamoeba dispar
ALFAMAICHNVTPTKSIDN

SEQ ID NO: 2380085 - protein, 23 aa, Entamoeba dispar
ALGCFTFSGIIFFILSIVLALFP

SEQ ID NO: 2380086 - protein, 24 aa, Entamoeba dispar
ALHLPKHLPIILGLIPYDFQNKEY

SEQ ID NO: 2380087 - protein, 23 aa, Entamoeba dispar
ALIRSECKGLGSVWINTLKQVRT

SEQ ID NO: 2380088 - protein, 21 aa, Entamoeba dispar
ALKAADVGLAMGIRGTDVAKQ

SEQ ID NO: 2380089 - protein, 22 aa, Entamoeba dispar
ALKAADVGLAMGIRGTDVAKQA

SEQ ID NO: 2380090 - protein, 23 aa, Entamoeba dispar
ALKEADVGLAMGIRGTDVAKQAS

SEQ ID NO: 2380091 - protein, 21 aa, Entamoeba dispar
ALKIDCLHPSISTTSISVSSS

SEQ ID NO: 2380092 - protein, 18 aa, Entamoeba dispar
ALLEHCTPQEICDKYYTL

SEQ ID NO: 2380093 - protein, 31 aa, Entamoeba dispar
ALLFALGFLCCCVWCYGWCQYRHSTNDQARM

SEQ ID NO: 2380094 - protein, 19 aa, Entamoeba dispar
ALLIIHYFIYIKLNKIIMK

SEQ ID NO: 2380095 - protein, 34 aa, Entamoeba dispar
ALLQLCKFKYTFINKRLVEIISRGMNCEETAQEC

SEQ ID NO: 2380096 - protein, 25 aa, Entamoeba dispar
ALLRARSEVFFAIPPFGHLINKYAA

SEQ ID NO: 2380097 - protein, 17 aa, Entamoeba dispar
ALMMVGFGLSFIVPEGK

SEQ ID NO: 2380098 - protein, 29 aa, Entamoeba dispar
ALMQYKSLFTRYSRRSVEHGIAIIQDGVE

SEQ ID NO: 2380099 - protein, 19 aa, Entamoeba dispar
ALMVFRCSTPLVIINEAEY

SEQ ID NO: 2380100 - protein, 25 aa, Entamoeba dispar
ALNLCSLPRFWIVLLYIVCIPLVKP

SEQ ID NO: 2380101 - protein, 19 aa, Entamoeba dispar
ALPPEIYPTPTIVKQSDTF

SEQ ID NO: 2380102 - protein, 20 aa, Entamoeba dispar
ALPSSYKIVSKVLFPNCDQS

SEQ ID NO: 2380103 - protein, 17 aa, Entamoeba dispar
ALQIFFISIQDSFLHNC

SEQ ID NO: 2380104 - protein, 28 aa, Entamoeba dispar
ALQIFLGVYICVMLFVWGGSQTIKASFV

SEQ ID NO: 2380105 - protein, 18 aa, Entamoeba dispar
ALQLKWANLTYLRDGKPQ

SEQ ID NO: 2380106 - protein, 18 aa, Entamoeba dispar
ALQMPYFYLYSLLAIILA

SEQ ID NO: 2380107 - protein, 19 aa, Entamoeba dispar
ALSDHASFSYGRRRPIMIL

SEQ ID NO: 2380108 - protein, 18 aa, Entamoeba dispar
ALSFEWIGVFVFILVFIY

SEQ ID NO: 2380109 - protein, 20 aa, Entamoeba dispar
ALSLRLPILTVVSHDDTYTE

SEQ ID NO: 2380110 - protein, 24 aa, Entamoeba dispar
ALTSCNLFFLLFADICNKNIPNFI

SEQ ID NO: 2380111 - protein, 18 aa, Entamoeba dispar
ALTYKPILPLLFESFEPP

SEQ ID NO: 2380112 - protein, 18 aa, Entamoeba dispar
ALVQIFWSLCLLLDRHFK

SEQ ID NO: 2380113 - protein, 19 aa, Entamoeba dispar
ALYLWIGVMTLNIIISLIF

SEQ ID NO: 2380114 - protein, 18 aa, Entamoeba dispar
ALYQANPKKGLKILGDVK

SEQ ID NO: 2380115 - protein, 25 aa, Entamoeba dispar
ALYYIKGTLLLPIFFILILQSFALA

SEQ ID NO: 2380116 - protein, 25 aa, Entamoeba dispar
AMALCTFPYLLLKYVFSDKMSKPKE

SEQ ID NO: 2380117 - protein, 26 aa, Entamoeba dispar
AMKRWKREIKQTVSIGNYIKKSDDFS

SEQ ID NO: 2380118 - protein, 18 aa, Entamoeba dispar
AMRVLKIAIRDGGLKTPG

SEQ ID NO: 2380119 - protein, 22 aa, Entamoeba dispar
AMSLCFFIEKLIELYKRRSNKE

SEQ ID NO: 2380120 - protein, 33 aa, Entamoeba dispar
AMVRNVMEPMRMITIWICSVFLYYVVDPDIGEK

SEQ ID NO: 2380121 - protein, 19 aa, Entamoeba dispar
AMVTYSIRWGNIIEIPQSL

SEQ ID NO: 2380122 - protein, 18 aa, Entamoeba dispar
ANAPKIGLRSSIGKTTIL

SEQ ID NO: 2380123 - protein, 22 aa, Entamoeba dispar
ANARFFLFYDYMMKHRSEIDRV

SEQ ID NO: 2380124 - protein, 23 aa, Entamoeba dispar
ANDVPFDYVEFLFMPTREYMDLL

SEQ ID NO: 2380125 - protein, 25 aa, Entamoeba dispar
ANELLKRILKIIALYPKSNQVLINT

SEQ ID NO: 2380126 - protein, 31 aa, Entamoeba dispar
ANGIGFSMMVVCMFVTLSLSKIRVYLLNSIN

SEQ ID NO: 2380127 - protein, 19 aa, Entamoeba dispar
ANGVFPLKHCNIELQTYPT

SEQ ID NO: 2380128 - protein, 23 aa, Entamoeba dispar
ANICDYIRIGVLMIAVFFVFKAP

SEQ ID NO: 2380129 - protein, 17 aa, Entamoeba dispar
ANICFIITFGYLLYRHI

SEQ ID NO: 2380130 - protein, 17 aa, Entamoeba dispar
ANIHKLLGFNVISMNWL

SEQ ID NO: 2380131 - protein, 23 aa, Entamoeba dispar
ANKKMKISLCDSSYEGNVSIQVI

SEQ ID NO: 2380132 - protein, 20 aa, Entamoeba dispar
ANLEGGCWLLFVAVIIYTIC

SEQ ID NO: 2380133 - protein, 18 aa, Entamoeba dispar
ANLMFYLFRGFNFNIVKM

SEQ ID NO: 2380134 - protein, 23 aa, Entamoeba dispar
ANLSIAFFEKFHRYVLTHYPSIQ

SEQ ID NO: 2380135 - protein, 19 aa, Entamoeba dispar
ANNWKHIWHIKLLNEPTIL

SEQ ID NO: 2380136 - protein, 19 aa, Entamoeba dispar
ANPKKGLKILGDVKSIVLI

SEQ ID NO: 2380137 - protein, 18 aa, Entamoeba dispar
ANQTGLWYFIEKSGFKIK

SEQ ID NO: 2380138 - protein, 24 aa, Entamoeba dispar
ANSSLEHFVGFIGYNERSEARHNM

SEQ ID NO: 2380139 - protein, 18 aa, Entamoeba dispar
ANSYDVYHLPEIATNIKS

SEQ ID NO: 2380140 - protein, 20 aa, Entamoeba dispar
ANTKRYFGIMSEEQRINLNV

SEQ ID NO: 2380141 - protein, 17 aa, Entamoeba dispar
ANVKRSGINTIIIDFIV

SEQ ID NO: 2380142 - protein, 17 aa, Entamoeba dispar
ANVPYKIVFAMEEIENL

SEQ ID NO: 2380143 - protein, 24 aa, Entamoeba dispar
ANVVLARFIVRQMRKLMIIKDTRV

SEQ ID NO: 2380144 - protein, 25 aa, Entamoeba dispar
ANVYNPLGWDSCVYMNPGPTGDSKV

SEQ ID NO: 2380145 - protein, 22 aa, Entamoeba dispar
ANYFCEIMTWIFFNIMTGFSLF

SEQ ID NO: 2380146 - protein, 23 aa, Entamoeba dispar
APAICLLSGIALTEFFNQIQKQL

SEQ ID NO: 2380147 - protein, 32 aa, Entamoeba dispar
APAIVIAFLMYYQRLSFINAFNKVQGLYPLID

SEQ ID NO: 2380148 - protein, 18 aa, Entamoeba dispar
APEYVPIVYTPRIGPKRI

SEQ ID NO: 2380149 - protein, 21 aa, Entamoeba dispar
APGRLMKVMFFETEFKGDFSL

SEQ ID NO: 2380150 - protein, 24 aa, Entamoeba dispar
APIFRELQCLVNVILLYSEDNVDI

SEQ ID NO: 2380151 - protein, 17 aa, Entamoeba dispar
APITFIICYIISALCDA

SEQ ID NO: 2380152 - protein, 20 aa, Entamoeba dispar
APKLYLLEDVSYPFVASTAL

SEQ ID NO: 2380153 - protein, 24 aa, Entamoeba dispar
APNAALDFKAIDFSPAATVSSSFI

SEQ ID NO: 2380154 - protein, 18 aa, Entamoeba dispar
APSFKIAAIMLIALFCYD

SEQ ID NO: 2380155 - protein, 25 aa, Entamoeba dispar
AQAIKDYLLALAICNEARPKKEGNK

SEQ ID NO: 2380156 - protein, 19 aa, Entamoeba dispar
AQAVVCCRCLPSQKADIVR

SEQ ID NO: 2380157 - protein, 31 aa, Entamoeba dispar
AQCRLMKFLLFRMNFKGDYSILLDSTTADKV

SEQ ID NO: 2380158 - protein, 24 aa, Entamoeba dispar
AQFTEARSAISFGSLSDTPLTKEY

SEQ ID NO: 2380159 - protein, 20 aa, Entamoeba dispar
AQFTEARSAISIGSLNATPL

SEQ ID NO: 2380160 - protein, 20 aa, Entamoeba dispar
AQIDRSVKVPFALKSLAIIV

SEQ ID NO: 2380161 - protein, 18 aa, Entamoeba dispar
AQIIGFASFRIEWLNQKE

SEQ ID NO: 2380162 - protein, 23 aa, Entamoeba dispar
AQKYCLEHKLPIYKNLLNPRHTG

SEQ ID NO: 2380163 - protein, 17 aa, Entamoeba dispar
AQLFLRVTIPPPSVDSK

SEQ ID NO: 2380164 - protein, 19 aa, Entamoeba dispar
AQLIVFPSGYSILVDAGEK

SEQ ID NO: 2380165 - protein, 33 aa, Entamoeba dispar
AQLQEARAYSCASRKWLIIGIVVGILVVIVIIA

SEQ ID NO: 2380166 - protein, 23 aa, Entamoeba dispar
AQLSSGFSRFDFQQNIGNYPNAI

SEQ ID NO: 2380167 - protein, 22 aa, Entamoeba dispar
AQSLKIQLLLDVPKINLFAMRY

SEQ ID NO: 2380168 - protein, 18 aa, Entamoeba dispar
AQTDLPFLESTIIPFNKT

SEQ ID NO: 2380169 - protein, 18 aa, Entamoeba dispar
AQTFLIYVAFIFICIIVN

SEQ ID NO: 2380170 - protein, 19 aa, Entamoeba dispar
AQVRCTIIMCSLGKVLEPS

SEQ ID NO: 2380171 - protein, 18 aa, Entamoeba dispar
AQYYYDWEENIKLNVKQR

SEQ ID NO: 2380172 - protein, 18 aa, Entamoeba dispar
ARAGCILATCGNKKCDEG

SEQ ID NO: 2380173 - protein, 19 aa, Entamoeba dispar
ARETLRYDIMFKPVTGTVK

SEQ ID NO: 2380174 - protein, 17 aa, Entamoeba dispar
AREYCLSTKCGNGKLDE

SEQ ID NO: 2380175 - protein, 24 aa, Entamoeba dispar
ARFYCGAITFKTCSSRTTEDDCIR

SEQ ID NO: 2380176 - protein, 20 aa, Entamoeba dispar
ARGSIPPHLHFYILSILIPS

SEQ ID NO: 2380177 - protein, 18 aa, Entamoeba dispar
ARHNMPIYYNRSNPTKLY

SEQ ID NO: 2380178 - protein, 18 aa, Entamoeba dispar
ARIDCLQSSCGDKQLDEG

SEQ ID NO: 2380179 - protein, 19 aa, Entamoeba dispar
ARIFFFKLILLKMTLAPSF

SEQ ID NO: 2380180 - protein, 18 aa, Entamoeba dispar
ARIFGFLCTFTFGGVFLI

SEQ ID NO: 2380181 - protein, 27 aa, Entamoeba dispar
ARIFQIPYDCCGWKLINTSSLTNSTCL

SEQ ID NO: 2380182 - protein, 17 aa, Entamoeba dispar
ARIGVLVLILHDVVDVF

SEQ ID NO: 2380183 - protein, 17 aa, Entamoeba dispar
ARIPHGNPRYYQMERGT

SEQ ID NO: 2380184 - protein, 20 aa, Entamoeba dispar
ARISISYSFIPFVIYTFIDS

SEQ ID NO: 2380185 - protein, 19 aa, Entamoeba dispar
ARISSPIDLFNLLEILYSS

SEQ ID NO: 2380186 - protein, 29 aa, Entamoeba dispar
ARKEREFKNQLAFQHCLLIGVLNQFASIV

SEQ ID NO: 2380187 - protein, 23 aa, Entamoeba dispar
ARLLSKPELFFFAFPKKPELVVP

SEQ ID NO: 2380188 - protein, 17 aa, Entamoeba dispar
ARLSYTSGNAVFFNNLL

SEQ ID NO: 2380189 - protein, 22 aa, Entamoeba dispar
ARMEVLYCLYRMVVDNKQALSN

SEQ ID NO: 2380190 - protein, 19 aa, Entamoeba dispar
ARNYLHYNIKPSNILLIST

SEQ ID NO: 2380191 - protein, 24 aa, Entamoeba dispar
ARPECFKRAPIDKFFDLEFTSLPH

SEQ ID NO: 2380192 - protein, 24 aa, Entamoeba dispar
ARQADGSGLQHCLIDGASKIVQSG

SEQ ID NO: 2380193 - protein, 17 aa, Entamoeba dispar
ARQALQRVVTPSHIENI

SEQ ID NO: 2380194 - protein, 21 aa, Entamoeba dispar
ARQIKEAIGYIQVDPNSSIPS

SEQ ID NO: 2380195 - protein, 26 aa, Entamoeba dispar
ARRNNFRAIVFIKRGLSGIEVTTGKL

SEQ ID NO: 2380196 - protein, 18 aa, Entamoeba dispar
ARSAISIGSLNATPLSKE

SEQ ID NO: 2380197 - protein, 22 aa, Entamoeba dispar
ARYCRMRGYNTLYVCGTDEYGT

SEQ ID NO: 2380198 - protein, 21 aa, Entamoeba dispar
ASCSIEILWIITIIIVIIIYL

SEQ ID NO: 2380199 - protein, 19 aa, Entamoeba dispar
ASDCPICRSHINLNENEEE

SEQ ID NO: 2380200 - protein, 24 aa, Entamoeba dispar
ASEEIIKIYAWEIAINDVTEFVVG

SEQ ID NO: 2380201 - protein, 33 aa, Entamoeba dispar
ASENRGSMVYQCCKLFVHLLEIRDCNTVMSNVL

SEQ ID NO: 2380202 - protein, 28 aa, Entamoeba dispar
ASEQLIKICAWCIEVNETIHFPVECVSE

SEQ ID NO: 2380203 - protein, 24 aa, Entamoeba dispar
ASFDRRFINEIKRCEEIERIIRLF

SEQ ID NO: 2380204 - protein, 27 aa, Entamoeba dispar
ASFSYGRRRPIMILGLGIWFIGSFGTL

SEQ ID NO: 2380205 - protein, 22 aa, Entamoeba dispar
ASGCAICKDGFYQIYKSCAPCN

SEQ ID NO: 2380206 - protein, 24 aa, Entamoeba dispar
ASGWSRKSKFSFEQKKILLFFIFL

SEQ ID NO: 2380207 - protein, 17 aa, Entamoeba dispar
ASHEVNSLISLILMYQY

SEQ ID NO: 2380208 - protein, 24 aa, Entamoeba dispar
ASIFAHKLIWFFIISILTMLFLYI

SEQ ID NO: 2380209 - protein, 17 aa, Entamoeba dispar
ASIGGKGQIDWKNAKQL

SEQ ID NO: 2380210 - protein, 19 aa, Entamoeba dispar
ASIIIKHLITLGSCLGSDG

SEQ ID NO: 2380211 - protein, 19 aa, Entamoeba dispar
ASIRELSCDDALNNDLNKF

SEQ ID NO: 2380212 - protein, 17 aa, Entamoeba dispar
ASIVFLCVSGLIHVLLY

SEQ ID NO: 2380213 - protein, 21 aa, Entamoeba dispar
ASKGRTTIIIAHRLTTVRNAD

SEQ ID NO: 2380214 - protein, 21 aa, Entamoeba dispar
ASKGRTTIVIAHRLSTIQNAD

SEQ ID NO: 2380215 - protein, 32 aa, Entamoeba dispar
ASLFTPSSLAFRFSILLSFLYFMIFSVYDVKY

SEQ ID NO: 2380216 - protein, 23 aa, Entamoeba dispar
ASLPSLFVCTVFLFINPYFALLY

SEQ ID NO: 2380217 - protein, 19 aa, Entamoeba dispar
ASQLQFFTQFIIKGDDHSK

SEQ ID NO: 2380218 - protein, 26 aa, Entamoeba dispar
ASRFIWDILCLFAILIHLSCMRSRGY

SEQ ID NO: 2380219 - protein, 24 aa, Entamoeba dispar
ASRYLPIQTLRFIFFYFDVVYLRL

SEQ ID NO: 2380220 - protein, 18 aa, Entamoeba dispar
ASSLLIRLIPFVRIFELF

SEQ ID NO: 2380221 - protein, 26 aa, Entamoeba dispar
ASSPLRCRADAFSLEALLLLKDVPGL

SEQ ID NO: 2380222 - protein, 28 aa, Entamoeba dispar
ASSRDLLKHKWFITNGIKIEESKKPTFI

SEQ ID NO: 2380223 - protein, 22 aa, Entamoeba dispar
ASSSTARFGRTFSIPINVIVSV

SEQ ID NO: 2380224 - protein, 24 aa, Entamoeba dispar
ASSVLFPLLQIIASFAKSNLISLD

SEQ ID NO: 2380225 - protein, 25 aa, Entamoeba dispar
ASTCYPETIIAPRIYYKIYINTCNK

SEQ ID NO: 2380226 - protein, 17 aa, Entamoeba dispar
ASTDLKRTMWWKNMKLW

SEQ ID NO: 2380227 - protein, 24 aa, Entamoeba dispar
ASTLSCIFIAVAIVVFISESLDQN

SEQ ID NO: 2380228 - protein, 30 aa, Entamoeba dispar
ASVFDFYSAQLWKLYFPMNLKLKASGEHDK

SEQ ID NO: 2380229 - protein, 24 aa, Entamoeba dispar
ASVSCPIRLCDRAYFATVSSTQKI

SEQ ID NO: 2380230 - protein, 24 aa, Entamoeba dispar
ASVYKRKNVFGFNRIQSPSKVTIE

SEQ ID NO: 2380231 - protein, 20 aa, Entamoeba dispar
ASWHPLRFSYDLIGLTDQSY

SEQ ID NO: 2380232 - protein, 17 aa, Entamoeba dispar
ASYFCNVCIKSLENDKE

SEQ ID NO: 2380233 - protein, 24 aa, Entamoeba dispar
ASYKNGILCFGFIVILVLTVFIRR

SEQ ID NO: 2380234 - protein, 30 aa, Entamoeba dispar
ASYVRLRCGVITMKVCDGRDKISCEDNQCN

SEQ ID NO: 2380235 - protein, 22 aa, Entamoeba dispar
ATCSGDKCATCEDGYKLDAGSM

SEQ ID NO: 2380236 - protein, 25 aa, Entamoeba dispar
ATDLTCYSLAYLIPANLMFYLFRGF

SEQ ID NO: 2380237 - protein, 17 aa, Entamoeba dispar
ATEACRMSIMIGDSLGR

SEQ ID NO: 2380238 - protein, 23 aa, Entamoeba dispar
ATECSCNLLLDSEHCIECSEGCH

SEQ ID NO: 2380239 - protein, 29 aa, Entamoeba dispar
ATFICILVIRECFPTLVQLFALSFVSVIP

SEQ ID NO: 2380240 - protein, 26 aa, Entamoeba dispar
ATFIKRFPFNFLAHFSFILYLILFVL

SEQ ID NO: 2380241 - protein, 28 aa, Entamoeba dispar
ATGIAMMRCCLPLEPPRDVIINKPYFFI

SEQ ID NO: 2380242 - protein, 26 aa, Entamoeba dispar
ATGIAMMRLCLPLEPPRDVIINKPYF

SEQ ID NO: 2380243 - protein, 19 aa, Entamoeba dispar
ATICGVFGLAAMFLQTSSQ

SEQ ID NO: 2380244 - protein, 18 aa, Entamoeba dispar
ATIFKLPFYLSTIISVFI

SEQ ID NO: 2380245 - protein, 21 aa, Entamoeba dispar
ATKLRCYMAYFSTIGIAIINK

SEQ ID NO: 2380246 - protein, 28 aa, Entamoeba dispar
ATKPSNWEVYFKWGLIIVNVIILVVGVL

SEQ ID NO: 2380247 - protein, 17 aa, Entamoeba dispar
ATLASLVTRELTLLYIS

SEQ ID NO: 2380248 - protein, 21 aa, Entamoeba dispar
ATLFLPMSFIAALFGMNVTVP

SEQ ID NO: 2380249 - protein, 21 aa, Entamoeba dispar
ATLRALYLSIIVAWKTNADIY

SEQ ID NO: 2380250 - protein, 21 aa, Entamoeba dispar
ATMKVEGFEPIEISLTNDGTE

SEQ ID NO: 2380251 - protein, 26 aa, Entamoeba dispar
ATNGEWYCIYPPFAFVQALERMNSDL

SEQ ID NO: 2380252 - protein, 20 aa, Entamoeba dispar
ATPFIKYIFGILSQIHCKVN

SEQ ID NO: 2380253 - protein, 24 aa, Entamoeba dispar
ATPLNLAGGFLFGFSKGSLINTIG

SEQ ID NO: 2380254 - protein, 28 aa, Entamoeba dispar
ATPRWIGSAKFFSRNCSFDFKENDNDWI

SEQ ID NO: 2380255 - protein, 23 aa, Entamoeba dispar
ATRFPIKLEFDREFINGYDNGKF

SEQ ID NO: 2380256 - protein, 18 aa, Entamoeba dispar
ATSGLVFLQACFSTLGAY

SEQ ID NO: 2380257 - protein, 19 aa, Entamoeba dispar
ATTCHWKVLTDYFPTPTSE

SEQ ID NO: 2380258 - protein, 26 aa, Entamoeba dispar
ATTILKRSISLIGIRYFYQKLFNLIY

SEQ ID NO: 2380259 - protein, 27 aa, Entamoeba dispar
ATTSLVCFQCIGTIFATEHPFLISLFI

SEQ ID NO: 2380260 - protein, 26 aa, Entamoeba dispar
ATTVKRWNGLIIFGFCVSIGSFFFTY

SEQ ID NO: 2380261 - protein, 27 aa, Entamoeba dispar
AVCKCCCLSISIFPCSIIFASIAVIVV

SEQ ID NO: 2380262 - protein, 21 aa, Entamoeba dispar
AVDTEGTFRLNVYTLNPPSHS

SEQ ID NO: 2380263 - protein, 19 aa, Entamoeba dispar
AVEILGNICRLYIKCNQKP

SEQ ID NO: 2380264 - protein, 18 aa, Entamoeba dispar
AVFTARLWIHRISYTNII

SEQ ID NO: 2380265 - protein, 20 aa, Entamoeba dispar
AVGLNLLMDCIWRFLETPFK

SEQ ID NO: 2380266 - protein, 18 aa, Entamoeba dispar
AVGYFYIRYRKQRVEERK

SEQ ID NO: 2380267 - protein, 21 aa, Entamoeba dispar
AVIFCFSYCYGINNQCSSATN

SEQ ID NO: 2380268 - protein, 19 aa, Entamoeba dispar
AVISFLWYLARPCLGGVRG

SEQ ID NO: 2380269 - protein, 25 aa, Entamoeba dispar
AVIYHEMVRLLGIIAARQPSLSHNV

SEQ ID NO: 2380270 - protein, 21 aa, Entamoeba dispar
AVKFNWWRITDLVDYFIIAVT

SEQ ID NO: 2380271 - protein, 22 aa, Entamoeba dispar
AVKKILCYKHGLYGETLSKHND

SEQ ID NO: 2380272 - protein, 26 aa, Entamoeba dispar
AVLIMVFSGIWPYTKLVILLFTWFMP

SEQ ID NO: 2380273 - protein, 18 aa, Entamoeba dispar
AVLPICISIILSKCYPQS

SEQ ID NO: 2380274 - protein, 17 aa, Entamoeba dispar
AVLSFLMFHELNNVFRA

SEQ ID NO: 2380275 - protein, 20 aa, Entamoeba dispar
AVLSIACILFGPRLQMKYRI

SEQ ID NO: 2380276 - protein, 22 aa, Entamoeba dispar
AVLTIKLIFSYFIDNPSYIPMY

SEQ ID NO: 2380277 - protein, 17 aa, Entamoeba dispar
AVMKLAISFIENGHDYN

SEQ ID NO: 2380278 - protein, 18 aa, Entamoeba dispar
AVQSFSLYAGLAIFIDFI

SEQ ID NO: 2380279 - protein, 26 aa, Entamoeba dispar
AVQTVAVLPFRAGIVAKPGNLKIKTG

SEQ ID NO: 2380280 - protein, 21 aa, Entamoeba dispar
AVTMYEVWNWNIVYKDKSRFH

SEQ ID NO: 2380281 - protein, 25 aa, Entamoeba dispar
AVVTRCALSLIVAGLKYGKPNKPSK

SEQ ID NO: 2380282 - protein, 18 aa, Entamoeba dispar
AYDTLNCPCGFKEVQTKY

SEQ ID NO: 2380283 - protein, 23 aa, Entamoeba dispar
AYFGSLIFYFGWGFVYGLITWIP

SEQ ID NO: 2380284 - protein, 18 aa, Entamoeba dispar
AYGSFSCIDIEIYKKVIT

SEQ ID NO: 2380285 - protein, 19 aa, Entamoeba dispar
AYKKKGWRLDLNIVSQCQN

SEQ ID NO: 2380286 - protein, 21 aa, Entamoeba dispar
AYLVKWKLFRSLALEDLKKTY

SEQ ID NO: 2380287 - protein, 28 aa, Entamoeba dispar
AYPTEEFKFPWKIADFISDGKRLLQPEN

SEQ ID NO: 2380288 - protein, 22 aa, Entamoeba dispar
AYQCPLKLFSGHLLTVYTSQTD

SEQ ID NO: 2380289 - protein, 18 aa, Entamoeba dispar
AYQIKFTATKAVSLTTCF

SEQ ID NO: 2380290 - protein, 20 aa, Entamoeba dispar
AYQWDCHNCGKGYHMEGFMN

SEQ ID NO: 2380291 - protein, 23 aa, Entamoeba dispar
AYREKMKLFGIFVAINVIFIVFV

SEQ ID NO: 2380292 - protein, 27 aa, Entamoeba dispar
AYYSFHTICIFILFIALVYRHTITLNW

SEQ ID NO: 2380293 - protein, 25 aa, Entamoeba dispar
CADIPPRKAVVFTVLIKPLVCCCIT

SEQ ID NO: 2380294 - protein, 17 aa, Entamoeba dispar
CAFSNQYVSPLFHALIV

SEQ ID NO: 2380295 - protein, 20 aa, Entamoeba dispar
CAGAIACGNTVFLKMSKYSM

SEQ ID NO: 2380296 - protein, 26 aa, Entamoeba dispar
CAKLFAGRPRPHFYSRLSEHPEQVKS

SEQ ID NO: 2380297 - protein, 24 aa, Entamoeba dispar
CAKRCYCKNLIIPEIPCISSCLDD

SEQ ID NO: 2380298 - protein, 20 aa, Entamoeba dispar
CALSGWRCLMYGPTTFLLSI

SEQ ID NO: 2380299 - protein, 24 aa, Entamoeba dispar
CAPLKEPWTFETFNLDEIMKTHKV

SEQ ID NO: 2380300 - protein, 17 aa, Entamoeba dispar
CAVCGERSFGGKLEEQC

SEQ ID NO: 2380301 - protein, 20 aa, Entamoeba dispar
CCAFNVISCIGNKEMVETLG

SEQ ID NO: 2380302 - protein, 17 aa, Entamoeba dispar
CCFGCLMYMFGVLCDRK

SEQ ID NO: 2380303 - protein, 31 aa, Entamoeba dispar
CCGWKEPRNYCSLKMLPTCYHVLITPHNTYK

SEQ ID NO: 2380304 - protein, 29 aa, Entamoeba dispar
CCPLPSFDIIFTDSFHSFWTYTNKNSVTI

SEQ ID NO: 2380305 - protein, 24 aa, Entamoeba dispar
CDDCIKGWYVYQAKCWECPSNCTE

SEQ ID NO: 2380306 - protein, 17 aa, Entamoeba dispar
CDDKLYIIIEHDNSDIF

SEQ ID NO: 2380307 - protein, 26 aa, Entamoeba dispar
CDDKWKLCDVAKTFLIDDIDEAVSTT

SEQ ID NO: 2380308 - protein, 23 aa, Entamoeba dispar
CDERSKLLLELTVGTELQNPKYS

SEQ ID NO: 2380309 - protein, 23 aa, Entamoeba dispar
CDFDCFIEGLSFTVDLEGKMSTM

SEQ ID NO: 2380310 - protein, 23 aa, Entamoeba dispar
CDFRDFLFVIGMSIIPIFTSILL

SEQ ID NO: 2380311 - protein, 25 aa, Entamoeba dispar
CDFTWKTIHRDSSSVKCLHSPFNIY

SEQ ID NO: 2380312 - protein, 25 aa, Entamoeba dispar
CDGGDGCIECECQPGWYSHNNANCK

SEQ ID NO: 2380313 - protein, 20 aa, Entamoeba dispar
CDGGDGCIECECQPGWYSNG

SEQ ID NO: 2380314 - protein, 26 aa, Entamoeba dispar
CDGGDGCIECECQPGWYSQEKAHCSP

SEQ ID NO: 2380315 - protein, 22 aa, Entamoeba dispar
CDGGDGCIECECQPGWYSQNKA

SEQ ID NO: 2380316 - protein, 19 aa, Entamoeba dispar
CDGGDGCVECECQEDWFEN

SEQ ID NO: 2380317 - protein, 20 aa, Entamoeba dispar
CDGGDGCYECECQSGWYKTG

SEQ ID NO: 2380318 - protein, 24 aa, Entamoeba dispar
CDGGEGCSFCRCIDNYVGHYIPEL

SEQ ID NO: 2380319 - protein, 18 aa, Entamoeba dispar
CDGGEGCYLCQCIEGYYS

SEQ ID NO: 2380320 - protein, 22 aa, Entamoeba dispar
CDGGKGCDHCLCQEGYVKYEKA

SEQ ID NO: 2380321 - protein, 25 aa, Entamoeba dispar
CDGGSGCYECKCENGWYNVDKLYCS

SEQ ID NO: 2380322 - protein, 18 aa, Entamoeba dispar
CDGHKFLWVRNSWGNDWG

SEQ ID NO: 2380323 - protein, 19 aa, Entamoeba dispar
CDGPNKWVHRSCINAYRIF

SEQ ID NO: 2380324 - protein, 23 aa, Entamoeba dispar
CDIEPYIRPVIFVNETTINNNNG

SEQ ID NO: 2380325 - protein, 23 aa, Entamoeba dispar
CDINCCNSCIKNCHEGHDTIYLG

SEQ ID NO: 2380326 - protein, 22 aa, Entamoeba dispar
CDKCSIDSNGIKKCSLCSSNYE

SEQ ID NO: 2380327 - protein, 19 aa, Entamoeba dispar
CDLLMVGVVTLIYGFGQCT

SEQ ID NO: 2380328 - protein, 17 aa, Entamoeba dispar
CDNVCNLMDIPRATLME

SEQ ID NO: 2380329 - protein, 22 aa, Entamoeba dispar
CDQIDIYGGMLFIHNKETFSCW

SEQ ID NO: 2380330 - protein, 28 aa, Entamoeba dispar
CDQLMCFPAALPAIFSFSNGNSIRYAKD

SEQ ID NO: 2380331 - protein, 19 aa, Entamoeba dispar
CDSFCYCVDGYIPDPDNPG

SEQ ID NO: 2380332 - protein, 17 aa, Entamoeba dispar
CDSRCGMSGCYSEGCYD

SEQ ID NO: 2380333 - protein, 18 aa, Entamoeba dispar
CDSSSCYCKLGYSSFSVA

SEQ ID NO: 2380334 - protein, 25 aa, Entamoeba dispar
CDSTDVIAAISWRRIVKKYTTHNAV

SEQ ID NO: 2380335 - protein, 18 aa, Entamoeba dispar
CDSTICLETSYSTIELKY

SEQ ID NO: 2380336 - protein, 18 aa, Entamoeba dispar
CDTMKRWCLKCSSEYYLN

SEQ ID NO: 2380337 - protein, 19 aa, Entamoeba dispar
CDYTGYKIEMGYMGEYVDP

SEQ ID NO: 2380338 - protein, 19 aa, Entamoeba dispar
CECSKEIFNKMILYYIPQC

SEQ ID NO: 2380339 - protein, 17 aa, Entamoeba dispar
CEEGYLLEKGICKYQDI

SEQ ID NO: 2380340 - protein, 17 aa, Entamoeba dispar
CEEKQCKMCLKGENGCI

SEQ ID NO: 2380341 - protein, 19 aa, Entamoeba dispar
CEELKLLIQKICSDALRIE

SEQ ID NO: 2380342 - protein, 20 aa, Entamoeba dispar
CEFEIFIIIKCTTKIKEQIM

SEQ ID NO: 2380343 - protein, 19 aa, Entamoeba dispar
CEFGEVFDYICVKFLKEQQ

SEQ ID NO: 2380344 - protein, 17 aa, Entamoeba dispar
CELCLTITNNSCIDCSD

SEQ ID NO: 2380345 - protein, 18 aa, Entamoeba dispar
CELSLPFISVLIVSVTFI

SEQ ID NO: 2380346 - protein, 28 aa, Entamoeba dispar
CELYRKNGLCDRCEEGFFSTGNSCNECT

SEQ ID NO: 2380347 - protein, 19 aa, Entamoeba dispar
CEMILKYNYSLLIQSINEK

SEQ ID NO: 2380348 - protein, 17 aa, Entamoeba dispar
CENGISFTCGNVELESS

SEQ ID NO: 2380349 - protein, 18 aa, Entamoeba dispar
CENGVPNILIMFGVFSIF

SEQ ID NO: 2380350 - protein, 20 aa, Entamoeba dispar
CENLSKFLVNYGIRATYYHA

SEQ ID NO: 2380351 - protein, 18 aa, Entamoeba dispar
CENYIVIVWFCLFISFIS

SEQ ID NO: 2380352 - protein, 21 aa, Entamoeba dispar
CEPKVKCMVPYCEGDSVTETC

SEQ ID NO: 2380353 - protein, 17 aa, Entamoeba dispar
CEPNCGSCVVGYQCNSI

SEQ ID NO: 2380354 - protein, 20 aa, Entamoeba dispar
CETFEGIYYPKSWELLKEFI

SEQ ID NO: 2380355 - protein, 32 aa, Entamoeba dispar
CEYPHKFSDVMYSWMKDSIIPFNIESVPKIEE

SEQ ID NO: 2380356 - protein, 18 aa, Entamoeba dispar
CFDMRNGCYYNKKEKSLF

SEQ ID NO: 2380357 - protein, 31 aa, Entamoeba dispar
CFEVKATLDNGCWCLFAGVIVYTVTTITIMK

SEQ ID NO: 2380358 - protein, 18 aa, Entamoeba dispar
CFEYHNFDTLLCVLLLFN

SEQ ID NO: 2380359 - protein, 20 aa, Entamoeba dispar
CFFFLFFIVSFCFCFAPFIF

SEQ ID NO: 2380360 - protein, 17 aa, Entamoeba dispar
CFFVYLSNANYTVFSNG

SEQ ID NO: 2380361 - protein, 19 aa, Entamoeba dispar
CFHYRPVLIGITILCLFVF

SEQ ID NO: 2380362 - protein, 19 aa, Entamoeba dispar
CFIACSFHPYSKVSYLSLD

SEQ ID NO: 2380363 - protein, 27 aa, Entamoeba dispar
CFILLLNRYTKLCVYTFSIILPIIAGI

SEQ ID NO: 2380364 - protein, 17 aa, Entamoeba dispar
CFIMFYSFSNATECSCN

SEQ ID NO: 2380365 - protein, 19 aa, Entamoeba dispar
CFKIEAVKKILCYKHGLYG

SEQ ID NO: 2380366 - protein, 21 aa, Entamoeba dispar
CFLHVHFIYYFLITFILLLVL

SEQ ID NO: 2380367 - protein, 20 aa, Entamoeba dispar
CFLISYEVPIIIYRKAIKML

SEQ ID NO: 2380368 - protein, 21 aa, Entamoeba dispar
CFLSCCFYGVTVIVTMGLGCV

SEQ ID NO: 2380369 - protein, 21 aa, Entamoeba dispar
CFNKFSVPWFDLRGNHDVDGV

SEQ ID NO: 2380370 - protein, 23 aa, Entamoeba dispar
CFPETKGRFQVFVHGDFLPITLF

SEQ ID NO: 2380371 - protein, 27 aa, Entamoeba dispar
CFSFCGCFSCNLLPWAWSPPRFECWWL

SEQ ID NO: 2380372 - protein, 18 aa, Entamoeba dispar
CFSKEYIGILTCFMNAVL

SEQ ID NO: 2380373 - protein, 18 aa, Entamoeba dispar
CFSPDTESTCGFGSTIQL

SEQ ID NO: 2380374 - protein, 21 aa, Entamoeba dispar
CFTTTCPYFLALFPLLHYIAE

SEQ ID NO: 2380375 - protein, 18 aa, Entamoeba dispar
CFVEGASILYDIREHNVQ

SEQ ID NO: 2380376 - protein, 17 aa, Entamoeba dispar
CFVESSKGLGIKDIGTP

SEQ ID NO: 2380377 - protein, 17 aa, Entamoeba dispar
CFYDLSVGQREAFDKDL

SEQ ID NO: 2380378 - protein, 20 aa, Entamoeba dispar
CGALLEKYVNCIKTQQLGGI

SEQ ID NO: 2380379 - protein, 19 aa, Entamoeba dispar
CGANGKWSDECVATYCDNG

SEQ ID NO: 2380380 - protein, 27 aa, Entamoeba dispar
CGDKGEWSTKCVLAYCDEGYKFDYNSN

SEQ ID NO: 2380381 - protein, 28 aa, Entamoeba dispar
CGDKGEWSTKCVLSYCDSGYKFDYNNNK

SEQ ID NO: 2380382 - protein, 17 aa, Entamoeba dispar
CGDSMTDHAVWYRITNK

SEQ ID NO: 2380383 - protein, 19 aa, Entamoeba dispar
CGEDSRLARLIQRIDSKHL

SEQ ID NO: 2380384 - protein, 26 aa, Entamoeba dispar
CGHDFHVSCLKEWLSGASDCPICRSH

SEQ ID NO: 2380385 - protein, 19 aa, Entamoeba dispar
CGHHCPFHPTICYLLGYLD

SEQ ID NO: 2380386 - protein, 17 aa, Entamoeba dispar
CGICNKGYYRNGKGCSK

SEQ ID NO: 2380387 - protein, 24 aa, Entamoeba dispar
CGIIGGVFALFSLLDYFIFHIYHS

SEQ ID NO: 2380388 - protein, 19 aa, Entamoeba dispar
CGIIYKLMKEIKEINQNIH

SEQ ID NO: 2380389 - protein, 19 aa, Entamoeba dispar
CGILLGKAFIPFGAPEHLK

SEQ ID NO: 2380390 - protein, 17 aa, Entamoeba dispar
CGINYGLKTKCELCLTI

SEQ ID NO: 2380391 - protein, 17 aa, Entamoeba dispar
CGKDKIDLNSCSCGETL

SEQ ID NO: 2380392 - protein, 20 aa, Entamoeba dispar
CGKIITVVVLLAMACFISLV

SEQ ID NO: 2380393 - protein, 26 aa, Entamoeba dispar
CGLFLINKVFHFLDFILTVLKPFNSQ

SEQ ID NO: 2380394 - protein, 19 aa, Entamoeba dispar
CGLNKFPIDLTLLSNLTSL

SEQ ID NO: 2380395 - protein, 25 aa, Entamoeba dispar
CGNIKPFKSSFIIKANSITGKPTKD

SEQ ID NO: 2380396 - protein, 18 aa, Entamoeba dispar
CGNNCYSCLDGLSCDICD

SEQ ID NO: 2380397 - protein, 18 aa, Entamoeba dispar
CGNRFVPQDAFFMCQCIF

SEQ ID NO: 2380398 - protein, 19 aa, Entamoeba dispar
CGSCENSTIYKCESKPNKN

SEQ ID NO: 2380399 - protein, 17 aa, Entamoeba dispar
CGTCCSEGKVFNGIIKL

SEQ ID NO: 2380400 - protein, 24 aa, Entamoeba dispar
CGVLECFWIKWFVLGNLMVTLGLF

SEQ ID NO: 2380401 - protein, 20 aa, Entamoeba dispar
CGYDFIPFKVLEKYNENYVV

SEQ ID NO: 2380402 - protein, 19 aa, Entamoeba dispar
CGYSEDFSYIEVMKLFTDH

SEQ ID NO: 2380403 - protein, 19 aa, Entamoeba dispar
CGYTLAINYCDYDATGRFY

SEQ ID NO: 2380404 - protein, 20 aa, Entamoeba dispar
CHLSLDLPEGAIVPNLICKA

SEQ ID NO: 2380405 - protein, 19 aa, Entamoeba dispar
CHLTYLSGIVLFALIVIPL

SEQ ID NO: 2380406 - protein, 18 aa, Entamoeba dispar
CHNSYWIVLVCMVIGVTI

SEQ ID NO: 2380407 - protein, 17 aa, Entamoeba dispar
CHTCMVSTCSLDLSLKD

SEQ ID NO: 2380408 - protein, 24 aa, Entamoeba dispar
CHYVDGCAPGQCDGIKCLRCKRGY

SEQ ID NO: 2380409 - protein, 26 aa, Entamoeba dispar
CIAPQWLMKRLSLVDGDYIDIQTVNL

SEQ ID NO: 2380410 - protein, 21 aa, Entamoeba dispar
CIAYAGAMVSMFIVVIFLILS

SEQ ID NO: 2380411 - protein, 19 aa, Entamoeba dispar
CICFHLSLRARIFGFLCTF

SEQ ID NO: 2380412 - protein, 18 aa, Entamoeba dispar
CICYCPWYIKTEMTKIRE

SEQ ID NO: 2380413 - protein, 20 aa, Entamoeba dispar
CIDCEGKMVWILSTLADMFV

SEQ ID NO: 2380414 - protein, 22 aa, Entamoeba dispar
CIDCSYHPMQVYFRQQVGNMFC

SEQ ID NO: 2380415 - protein, 27 aa, Entamoeba dispar
CIDLSELIVNWERFRVKKEGLKPLSEA

SEQ ID NO: 2380416 - protein, 18 aa, Entamoeba dispar
CIDSFKKDENGNCVYDGD

SEQ ID NO: 2380417 - protein, 19 aa, Entamoeba dispar
CIECEKGYYLNSNKECQYN

SEQ ID NO: 2380418 - protein, 24 aa, Entamoeba dispar
CIECSLSGCTTCKKGNYLNSTCYP

SEQ ID NO: 2380419 - protein, 19 aa, Entamoeba dispar
CIEKMMRVMVNRGYSICQL

SEQ ID NO: 2380420 - protein, 20 aa, Entamoeba dispar
CIESCTPPALNSAIVVNIVY

SEQ ID NO: 2380421 - protein, 20 aa, Entamoeba dispar
CIFLLMAVYIGVYFSGYMVS

SEQ ID NO: 2380422 - protein, 22 aa, Entamoeba dispar
CIGIAAACKVGFENEKQQEKFT

SEQ ID NO: 2380423 - protein, 20 aa, Entamoeba dispar
CIIFNRFSTITTYIIRTKFL

SEQ ID NO: 2380424 - protein, 19 aa, Entamoeba dispar
CIIFSYLLINGFFYALFIS

SEQ ID NO: 2380425 - protein, 19 aa, Entamoeba dispar
CIIHSPLLLLKCLILGFSL

SEQ ID NO: 2380426 - protein, 18 aa, Entamoeba dispar
CIILLCLKNHYISGLFNS

SEQ ID NO: 2380427 - protein, 22 aa, Entamoeba dispar
CIINFPKPVHHLHLTNPTKTIP

SEQ ID NO: 2380428 - protein, 27 aa, Entamoeba dispar
CIIRNTERLLLFIVYCGFDTKLAKNSS

SEQ ID NO: 2380429 - protein, 19 aa, Entamoeba dispar
CIKCNGKGCSKCRDGYSVT

SEQ ID NO: 2380430 - protein, 25 aa, Entamoeba dispar
CIKSKEWIMAISIGSTILILFVLII

SEQ ID NO: 2380431 - protein, 20 aa, Entamoeba dispar
CILCKTGYYASKGICNKCDS

SEQ ID NO: 2380432 - protein, 17 aa, Entamoeba dispar
CILFKNDTIFPLSTNHK

SEQ ID NO: 2380433 - protein, 22 aa, Entamoeba dispar
CILGCFKYYLNVSHWAQKNNTN

SEQ ID NO: 2380434 - protein, 19 aa, Entamoeba dispar
CILGGLKLSSASYKNGILC

SEQ ID NO: 2380435 - protein, 19 aa, Entamoeba dispar
CILGLVALLIIFQAFVLIF

SEQ ID NO: 2380436 - protein, 19 aa, Entamoeba dispar
CILLFFKSKGFHCSPGCTS

SEQ ID NO: 2380437 - protein, 21 aa, Entamoeba dispar
CILVSLNLFSLCNVWSIECDM

SEQ ID NO: 2380438 - protein, 24 aa, Entamoeba dispar
CINEIKNKISLFLNESSTEKLEEI

SEQ ID NO: 2380439 - protein, 18 aa, Entamoeba dispar
CIPCQEGYYSIGDGEQCK

SEQ ID NO: 2380440 - protein, 23 aa, Entamoeba dispar
CIPKCSIKGCDRECASPNECTSC

SEQ ID NO: 2380441 - protein, 20 aa, Entamoeba dispar
CIQAFPRNGLLLFVTTLRIG

SEQ ID NO: 2380442 - protein, 19 aa, Entamoeba dispar
CISVPFYGFIKSMEQKKIE

SEQ ID NO: 2380443 - protein, 20 aa, Entamoeba dispar
CITNCRKETLSFILHGHEEY

SEQ ID NO: 2380444 - protein, 24 aa, Entamoeba dispar
CIVAEMFLGIPLFPANSEYDLLYR

SEQ ID NO: 2380445 - protein, 32 aa, Entamoeba dispar
CIVFGIICGSLSFLFGYSIQFIGIYSIVVLVI

SEQ ID NO: 2380446 - protein, 23 aa, Entamoeba dispar
CIVNECLKHLCMAPDSCRYFKII

SEQ ID NO: 2380447 - protein, 20 aa, Entamoeba dispar
CKDCDSLIRGCKYCNDTKCF

SEQ ID NO: 2380448 - protein, 25 aa, Entamoeba dispar
CKDIIRWLMCVDGKRVCKLVIEEYS

SEQ ID NO: 2380449 - protein, 25 aa, Entamoeba dispar
CKDVSVRQPIEWEIEKSDSRWKVLV

SEQ ID NO: 2380450 - protein, 21 aa, Entamoeba dispar
CKEAFSTIYLIITIISNIPQF

SEQ ID NO: 2380451 - protein, 18 aa, Entamoeba dispar
CKEGYFIDNYQCRDNIEM

SEQ ID NO: 2380452 - protein, 29 aa, Entamoeba dispar
CKEKEELNQLLSLVSNWPLQKSISSNYQS

SEQ ID NO: 2380453 - protein, 25 aa, Entamoeba dispar
CKESGIFWWHILLIIIGSVWIAFIL

SEQ ID NO: 2380454 - protein, 19 aa, Entamoeba dispar
CKEYMKPKYNEVLQMFLNV

SEQ ID NO: 2380455 - protein, 21 aa, Entamoeba dispar
CKGLYRLTQFRLLSFVFFISF

SEQ ID NO: 2380456 - protein, 20 aa, Entamoeba dispar
CKHDRICMFSEKRVNLVKGI

SEQ ID NO: 2380457 - protein, 19 aa, Entamoeba dispar
CKIERLPIILPLIQEDVLS

SEQ ID NO: 2380458 - protein, 20 aa, Entamoeba dispar
CKKCDLKVSNCWECDETGIC

SEQ ID NO: 2380459 - protein, 21 aa, Entamoeba dispar
CKKGIQWYVCSGNTVKIPENP

SEQ ID NO: 2380460 - protein, 19 aa, Entamoeba dispar
CKNHPTHFCLKEHSRYIQW

SEQ ID NO: 2380461 - protein, 25 aa, Entamoeba dispar
CKNNYPRWLMWGSVVNGNQTVDGVL

SEQ ID NO: 2380462 - protein, 18 aa, Entamoeba dispar
CKNPLLINYGNLISNDFF

SEQ ID NO: 2380463 - protein, 21 aa, Entamoeba dispar
CKQGAICEFQFNIPKPMKTPV

SEQ ID NO: 2380464 - protein, 22 aa, Entamoeba dispar
CKRDSFGCGIHGRIIKKLEYKK

SEQ ID NO: 2380465 - protein, 18 aa, Entamoeba dispar
CKRSYSVSSNGGRTPRLN

SEQ ID NO: 2380466 - protein, 19 aa, Entamoeba dispar
CKSDFLLKFKADYHFYYFI

SEQ ID NO: 2380467 - protein, 26 aa, Entamoeba dispar
CKSDLCALEPTILIGVPTVFNRVRKA

SEQ ID NO: 2380468 - protein, 17 aa, Entamoeba dispar
CKSICNQCNAVFQRGLT

SEQ ID NO: 2380469 - protein, 20 aa, Entamoeba dispar
CKSLKTAPRNTGIYIVYNGE

SEQ ID NO: 2380470 - protein, 28 aa, Entamoeba dispar
CKTCPEHCLDCLNSEYCFKCENGYTAIN

SEQ ID NO: 2380471 - protein, 20 aa, Entamoeba dispar
CKTDTFCFSQDTIISTTCGK

SEQ ID NO: 2380472 - protein, 20 aa, Entamoeba dispar
CKTYDKFSFKSNYLDCSNDP

SEQ ID NO: 2380473 - protein, 17 aa, Entamoeba dispar
CLAMKPRMFMPIDENGK

SEQ ID NO: 2380474 - protein, 18 aa, Entamoeba dispar
CLCNKSLDENGCWNNVCC

SEQ ID NO: 2380475 - protein, 23 aa, Entamoeba dispar
CLCVNRLIIWLLYLIAISFCCLH

SEQ ID NO: 2380476 - protein, 20 aa, Entamoeba dispar
CLDEQLPLIYNDLVIIAGIS

SEQ ID NO: 2380477 - protein, 17 aa, Entamoeba dispar
CLDPHLVAKGRRMQFKR

SEQ ID NO: 2380478 - protein, 28 aa, Entamoeba dispar
CLESKLWKYLCLFVSFSIKQKNITRTTE

SEQ ID NO: 2380479 - protein, 18 aa, Entamoeba dispar
CLESTEYNLLIIIYSELI

SEQ ID NO: 2380480 - protein, 30 aa, Entamoeba dispar
CLFIEVIKFLKRRNEIFKTTFILTCGSGNN

SEQ ID NO: 2380481 - protein, 19 aa, Entamoeba dispar
CLFSAEKGSTISISTSLAT

SEQ ID NO: 2380482 - protein, 24 aa, Entamoeba dispar
CLGCTNEKCYICANEYILNNKQCE

SEQ ID NO: 2380483 - protein, 24 aa, Entamoeba dispar
CLGGVRGTQGCLCPKPFKKAAGEG

SEQ ID NO: 2380484 - protein, 28 aa, Entamoeba dispar
CLGIPVKPFRLFIPMSFINEIPFLIVLH

SEQ ID NO: 2380485 - protein, 26 aa, Entamoeba dispar
CLGPRIVFRIGNYFTILDGLLMGIGC

SEQ ID NO: 2380486 - protein, 17 aa, Entamoeba dispar
CLIDRKIKVDIVKAKQL

SEQ ID NO: 2380487 - protein, 20 aa, Entamoeba dispar
CLIGFIPFFVMTRFPLVNNI

SEQ ID NO: 2380488 - protein, 19 aa, Entamoeba dispar
CLIPCYLTHECIVKSPLQD

SEQ ID NO: 2380489 - protein, 18 aa, Entamoeba dispar
CLITIEIIYPIRLPKEVR

SEQ ID NO: 2380490 - protein, 24 aa, Entamoeba dispar
CLIVVGLLVLWLFIKNGSMTWDDT

SEQ ID NO: 2380491 - protein, 17 aa, Entamoeba dispar
CLKIIRNVFSKANAIKT

SEQ ID NO: 2380492 - protein, 25 aa, Entamoeba dispar
CLKSLPILFQYSISFLIEKDNNGEL

SEQ ID NO: 2380493 - protein, 20 aa, Entamoeba dispar
CLLCIPYIASEVIVMNDIPV

SEQ ID NO: 2380494 - protein, 19 aa, Entamoeba dispar
CLLCIPYIIFEYLTLNDSN

SEQ ID NO: 2380495 - protein, 18 aa, Entamoeba dispar
CLLFHEFINVIFISLTKR

SEQ ID NO: 2380496 - protein, 23 aa, Entamoeba dispar
CLLHCLTCLIIGLMFIHATSVLP

SEQ ID NO: 2380497 - protein, 18 aa, Entamoeba dispar
CLLKDVIEQSWRHSPSER

SEQ ID NO: 2380498 - protein, 18 aa, Entamoeba dispar
CLLREMYRFTEGFRKKEI

SEQ ID NO: 2380499 - protein, 20 aa, Entamoeba dispar
CLLVAPGWFYFCPISLLLWL

SEQ ID NO: 2380500 - protein, 18 aa, Entamoeba dispar
CLMPFVVRCASRVCYNLF

SEQ ID NO: 2380501 - protein, 20 aa, Entamoeba dispar
CLMYMFGVLCDRKPGIAKGI

SEQ ID NO: 2380502 - protein, 27 aa, Entamoeba dispar
CLNNKCLKCKYGTYPLGKECFQCNTIS

SEQ ID NO: 2380503 - protein, 24 aa, Entamoeba dispar
CLPCIDIHCKWCNNEMCFVCADDY

SEQ ID NO: 2380504 - protein, 21 aa, Entamoeba dispar
CLPNCRCDSSSGWKLSKQKGK

SEQ ID NO: 2380505 - protein, 20 aa, Entamoeba dispar
CLPNCVCAEGYVVTSDHKCR

SEQ ID NO: 2380506 - protein, 28 aa, Entamoeba dispar
CLPVYKRAPCSFTKVIYCTIPSCSIVAS

SEQ ID NO: 2380507 - protein, 19 aa, Entamoeba dispar
CLQGSPIFGCTECEEGYYF

SEQ ID NO: 2380508 - protein, 25 aa, Entamoeba dispar
CLQLNNFFIVVCIVTLFETSALHRL

SEQ ID NO: 2380509 - protein, 19 aa, Entamoeba dispar
CLQYIHLLCNKLTPERADR

SEQ ID NO: 2380510 - protein, 22 aa, Entamoeba dispar
CLSCKLTRDILKLVNYMNPSEE

SEQ ID NO: 2380511 - protein, 18 aa, Entamoeba dispar
CLSSCVFDIHGFYQTEEY

SEQ ID NO: 2380512 - protein, 23 aa, Entamoeba dispar
CLSSIPLKLLYKLILLIKPNNSL

SEQ ID NO: 2380513 - protein, 22 aa, Entamoeba dispar
CLSSVIPLIGLKAYQRVRTAAV

SEQ ID NO: 2380514 - protein, 28 aa, Entamoeba dispar
CLTCDSIECLSCSNDLFLKDNKCQNCSD

SEQ ID NO: 2380515 - protein, 21 aa, Entamoeba dispar
CLTIILGLICFVTVTFFLLFK

SEQ ID NO: 2380516 - protein, 22 aa, Entamoeba dispar
CLTKKLKMVILLIEQYHHPLVC

SEQ ID NO: 2380517 - protein, 18 aa, Entamoeba dispar
CLTRELILKTIYCRMNGT

SEQ ID NO: 2380518 - protein, 19 aa, Entamoeba dispar
CLVKTIIEQCWAPKPNERP

SEQ ID NO: 2380519 - protein, 21 aa, Entamoeba dispar
CLYVFLIIALMLRFFQVFWDC

SEQ ID NO: 2380520 - protein, 23 aa, Entamoeba dispar
CMTCANSGCYWCITSNECQAIPV

SEQ ID NO: 2380521 - protein, 17 aa, Entamoeba dispar
CMVLFKDTFLNIVSISF

SEQ ID NO: 2380522 - protein, 18 aa, Entamoeba dispar
CNACIPCQFNYNKTGVFI

SEQ ID NO: 2380523 - protein, 24 aa, Entamoeba dispar
CNCLYRGLYPYTIVQFDYFFIAFD

SEQ ID NO: 2380524 - protein, 25 aa, Entamoeba dispar
CNCQKESNCAFIFEDQEQITLHIPY

SEQ ID NO: 2380525 - protein, 24 aa, Entamoeba dispar
CNDCLCCERCCDWCCDNCFCCCDE

SEQ ID NO: 2380526 - protein, 18 aa, Entamoeba dispar
CNDFRDTWNRGWISQFFG

SEQ ID NO: 2380527 - protein, 27 aa, Entamoeba dispar
CNDGYYKKGSLCYGCPNSMETCFGPNH

SEQ ID NO: 2380528 - protein, 24 aa, Entamoeba dispar
CNECDNWYALAYDRKGCVRYTSGW

SEQ ID NO: 2380529 - protein, 20 aa, Entamoeba dispar
CNEICIKKPQILFDIITKIL

SEQ ID NO: 2380530 - protein, 21 aa, Entamoeba dispar
CNEIIKFFESFGWLMKLNNNN

SEQ ID NO: 2380531 - protein, 22 aa, Entamoeba dispar
CNKEIIWWMIMIIIIIILIIII

SEQ ID NO: 2380532 - protein, 22 aa, Entamoeba dispar
CNKEIVWWMIMIIIIIILIIII

SEQ ID NO: 2380533 - protein, 26 aa, Entamoeba dispar
CNKHFRIVAVLLKYWLKTRNLNCPFK

SEQ ID NO: 2380534 - protein, 18 aa, Entamoeba dispar
CNKIRFNYYPSLKDKILD

SEQ ID NO: 2380535 - protein, 17 aa, Entamoeba dispar
CNLGYFLYDGQCISCDI

SEQ ID NO: 2380536 - protein, 19 aa, Entamoeba dispar
CNNCGRIGVLVLILHDIVD

SEQ ID NO: 2380537 - protein, 19 aa, Entamoeba dispar
CNNNGICICEDGYVDNGGC

SEQ ID NO: 2380538 - protein, 19 aa, Entamoeba dispar
CNNVPHLGTLIGCVLSADV

SEQ ID NO: 2380539 - protein, 19 aa, Entamoeba dispar
CNPKAPGKCNTFQERPSIY

SEQ ID NO: 2380540 - protein, 17 aa, Entamoeba dispar
CNSGEYNGKIGIKSQIQ

SEQ ID NO: 2380541 - protein, 19 aa, Entamoeba dispar
CNTVAWGGCGGGFAEDVLN

SEQ ID NO: 2380542 - protein, 18 aa, Entamoeba dispar
CNVQERKTVISICDVIIS

SEQ ID NO: 2380543 - protein, 25 aa, Entamoeba dispar
CNVVECPYWLAPEVILNNHFTEASD

SEQ ID NO: 2380544 - protein, 25 aa, Entamoeba dispar
CNVVKRLNERIELLKDILKHLELND

SEQ ID NO: 2380545 - protein, 25 aa, Entamoeba dispar
CNVVKRLNERIELLKDILKHLEPND

SEQ ID NO: 2380546 - protein, 19 aa, Entamoeba dispar
CNYQLWRLITPIFLHGGII

SEQ ID NO: 2380547 - protein, 28 aa, Entamoeba dispar
CPCNTNPIFGPECIIVISNISQPIILSE

SEQ ID NO: 2380548 - protein, 21 aa, Entamoeba dispar
CPCTCVPPIPIMVGTDYRPFC

SEQ ID NO: 2380549 - protein, 20 aa, Entamoeba dispar
CPDDPCGTSDAVIIQNITND

SEQ ID NO: 2380550 - protein, 18 aa, Entamoeba dispar
CPEFLGNDCVDLYIFNNN

SEQ ID NO: 2380551 - protein, 28 aa, Entamoeba dispar
CPEPSFPWFYKLWRVQGYYNLLILKCYP

SEQ ID NO: 2380552 - protein, 20 aa, Entamoeba dispar
CPEQCLRCINSTNCVECASP

SEQ ID NO: 2380553 - protein, 30 aa, Entamoeba dispar
CPFNCKECYKDKCILCFGNDIVISGICYPM

SEQ ID NO: 2380554 - protein, 19 aa, Entamoeba dispar
CPKDPCGTNEAGVFSQVTN

SEQ ID NO: 2380555 - protein, 19 aa, Entamoeba dispar
CPKGCLSCYGTIENVICLE

SEQ ID NO: 2380556 - protein, 19 aa, Entamoeba dispar
CPKVIFNKRVICILNGTYW

SEQ ID NO: 2380557 - protein, 24 aa, Entamoeba dispar
CPLELKSACGAILYASPYFPDHTE

SEQ ID NO: 2380558 - protein, 18 aa, Entamoeba dispar
CPLKSIIEQSWQHRSSDR

SEQ ID NO: 2380559 - protein, 23 aa, Entamoeba dispar
CPNYCKSCTANSCTSCEDGFFLS

SEQ ID NO: 2380560 - protein, 22 aa, Entamoeba dispar
CPTTELGCNIILTSTLDCIKEQ

SEQ ID NO: 2380561 - protein, 17 aa, Entamoeba dispar
CPVCGANHQELKKIFLL

SEQ ID NO: 2380562 - protein, 28 aa, Entamoeba dispar
CPYITRHKWLLISLYFVGIMVCGILSPL

SEQ ID NO: 2380563 - protein, 30 aa, Entamoeba dispar
CQEKHMYRSHFLRMIEEIIDFIPSTEYKTS

SEQ ID NO: 2380564 - protein, 18 aa, Entamoeba dispar
CQGPCQCLNNQFLYYKHS

SEQ ID NO: 2380565 - protein, 18 aa, Entamoeba dispar
CQGPSCYIQTNLDKVILP

SEQ ID NO: 2380566 - protein, 20 aa, Entamoeba dispar
CQKLWPIVIIYTLLIVLMEM

SEQ ID NO: 2380567 - protein, 20 aa, Entamoeba dispar
CQLEGFKIKLDIKDGLIYGI

SEQ ID NO: 2380568 - protein, 24 aa, Entamoeba dispar
CQPKEKYTPCGTMLFQILIQSESG

SEQ ID NO: 2380569 - protein, 24 aa, Entamoeba dispar
CQSCEITGCLKCKTATTCSVCDVT

SEQ ID NO: 2380570 - protein, 17 aa, Entamoeba dispar
CQVSLELAKFAQGIFFE

SEQ ID NO: 2380571 - protein, 21 aa, Entamoeba dispar
CQYNRGTCWALATIGLLEQSY

SEQ ID NO: 2380572 - protein, 19 aa, Entamoeba dispar
CQYQRAFEIVKKLLPEQLK

SEQ ID NO: 2380573 - protein, 22 aa, Entamoeba dispar
CRALKEHCEYVSPFEFYMTINV

SEQ ID NO: 2380574 - protein, 18 aa, Entamoeba dispar
CRDNIEMKESCKLYTATG

SEQ ID NO: 2380575 - protein, 17 aa, Entamoeba dispar
CRFKGACQCCPRLFPKN

SEQ ID NO: 2380576 - protein, 17 aa, Entamoeba dispar
CRGCAGTLIKTPRAYSS

SEQ ID NO: 2380577 - protein, 18 aa, Entamoeba dispar
CRGGPPLRSTVSHVILSG

SEQ ID NO: 2380578 - protein, 22 aa, Entamoeba dispar
CRKALEIKSFPAVVEGNTLAGD

SEQ ID NO: 2380579 - protein, 23 aa, Entamoeba dispar
CRKRECFCISNILKNHLYFHLEE

SEQ ID NO: 2380580 - protein, 21 aa, Entamoeba dispar
CRKVSVWLYWVLYLVTIIILY

SEQ ID NO: 2380581 - protein, 19 aa, Entamoeba dispar
CRLFKIPLFNSQLIINETK

SEQ ID NO: 2380582 - protein, 18 aa, Entamoeba dispar
CRRCHGSYFFNSIKYENH

SEQ ID NO: 2380583 - protein, 19 aa, Entamoeba dispar
CRRKIQLMYFDESFNEEKC

SEQ ID NO: 2380584 - protein, 25 aa, Entamoeba dispar
CRRKVITYLAIFVFITSYITLYLLV

SEQ ID NO: 2380585 - protein, 18 aa, Entamoeba dispar
CRSKPIGWWVWLLIALGI

SEQ ID NO: 2380586 - protein, 19 aa, Entamoeba dispar
CRYFKIILITMQIVLLSPL

SEQ ID NO: 2380587 - protein, 21 aa, Entamoeba dispar
CSAFGKTWLHFLNIFMCCCGI

SEQ ID NO: 2380588 - protein, 23 aa, Entamoeba dispar
CSATSANSPICYCSYDPYVDQSC

SEQ ID NO: 2380589 - protein, 22 aa, Entamoeba dispar
CSECLHRFEADFVRQYSPENFR

SEQ ID NO: 2380590 - protein, 19 aa, Entamoeba dispar
CSEIGLAQKVCKLKNTDIN

SEQ ID NO: 2380591 - protein, 17 aa, Entamoeba dispar
CSEKSKANNCIIGSDTG

SEQ ID NO: 2380592 - protein, 17 aa, Entamoeba dispar
CSELCYYNGKWRNDIKE

SEQ ID NO: 2380593 - protein, 20 aa, Entamoeba dispar
CSFCNKELYKFDKLRCPLCD

SEQ ID NO: 2380594 - protein, 18 aa, Entamoeba dispar
CSFILKVAQSIVLNSEDQ

SEQ ID NO: 2380595 - protein, 17 aa, Entamoeba dispar
CSFLQPKHLFSLMQTNT

SEQ ID NO: 2380596 - protein, 22 aa, Entamoeba dispar
CSFNGLLPFARLNMKTGEMTFF

SEQ ID NO: 2380597 - protein, 20 aa, Entamoeba dispar
CSFVSLWKKFAPSLTHDKFT

SEQ ID NO: 2380598 - protein, 19 aa, Entamoeba dispar
CSGIIPLCVCQHQGDGKHR

SEQ ID NO: 2380599 - protein, 18 aa, Entamoeba dispar
CSGLTEGVFLEFPDMAKV

SEQ ID NO: 2380600 - protein, 19 aa, Entamoeba dispar
CSHPTIITFETKVGPSTEQ

SEQ ID NO: 2380601 - protein, 20 aa, Entamoeba dispar
CSIDVHSWIFLPSFIPDESF

SEQ ID NO: 2380602 - protein, 17 aa, Entamoeba dispar
CSIRITRTHTIVIISII

SEQ ID NO: 2380603 - protein, 23 aa, Entamoeba dispar
CSKCLDGTYLYNGECYLCPHNCT

SEQ ID NO: 2380604 - protein, 19 aa, Entamoeba dispar
CSKEIAQDCLLYYNNKCVK

SEQ ID NO: 2380605 - protein, 17 aa, Entamoeba dispar
CSKKFQHFIAIISVILL

SEQ ID NO: 2380606 - protein, 18 aa, Entamoeba dispar
CSKSGGPILYYPDPNKIS

SEQ ID NO: 2380607 - protein, 24 aa, Entamoeba dispar
CSKTNWALIIPLIIVAVIIIIIIL

SEQ ID NO: 2380608 - protein, 24 aa, Entamoeba dispar
CSKTNWALIIPLIIVGIIIIIVII

SEQ ID NO: 2380609 - protein, 20 aa, Entamoeba dispar
CSLFFFYVLMRMAFKPIMAK

SEQ ID NO: 2380610 - protein, 27 aa, Entamoeba dispar
CSLLILHIYWFKLIIEMIFKVASHEGV

SEQ ID NO: 2380611 - protein, 26 aa, Entamoeba dispar
CSLQTFFPPMLPFLFRSLTQPKQPLP

SEQ ID NO: 2380612 - protein, 21 aa, Entamoeba dispar
CSNCNKYIHQRCLEKFSNTYC

SEQ ID NO: 2380613 - protein, 20 aa, Entamoeba dispar
CSNDIWTLLFPNGMTISLTP

SEQ ID NO: 2380614 - protein, 26 aa, Entamoeba dispar
CSNINGCKRCENILRKGDMSTKICYE

SEQ ID NO: 2380615 - protein, 17 aa, Entamoeba dispar
CSNKSYVNGKCVECSNT

SEQ ID NO: 2380616 - protein, 32 aa, Entamoeba dispar
CSNRVQLRLLKIVLNWLIPEVFNECLYFKGEF

SEQ ID NO: 2380617 - protein, 19 aa, Entamoeba dispar
CSPQSLLVRQLKYWGTLVI

SEQ ID NO: 2380618 - protein, 20 aa, Entamoeba dispar
CSQFFKDLFKGYLKCTTNLL

SEQ ID NO: 2380619 - protein, 33 aa, Entamoeba dispar
CSQLERADGFGMEILPLLKFIGSSQTYAEFLTT

SEQ ID NO: 2380620 - protein, 27 aa, Entamoeba dispar
CSQTCSCLNGFIPLKGSSRCIPKSCGN

SEQ ID NO: 2380621 - protein, 17 aa, Entamoeba dispar
CSSCAKGYINYPYCTAL

SEQ ID NO: 2380622 - protein, 20 aa, Entamoeba dispar
CSSCISGFMLQENTCISAKQ

SEQ ID NO: 2380623 - protein, 21 aa, Entamoeba dispar
CSSCLSYSLSPLIAGVISTLL

SEQ ID NO: 2380624 - protein, 20 aa, Entamoeba dispar
CSSFNCLFLPQLKELEIKSS

SEQ ID NO: 2380625 - protein, 18 aa, Entamoeba dispar
CSSIDWYISTSYLALYYN

SEQ ID NO: 2380626 - protein, 21 aa, Entamoeba dispar
CSSKMVVDVLSFREPIEPENV

SEQ ID NO: 2380627 - protein, 27 aa, Entamoeba dispar
CSSNENWKWKYLIHLSSYLTPTVLGKV

SEQ ID NO: 2380628 - protein, 18 aa, Entamoeba dispar
CSSTCSFVSTASSVSDLI

SEQ ID NO: 2380629 - protein, 21 aa, Entamoeba dispar
CSSTGKSASFFDLKANTTTYV

SEQ ID NO: 2380630 - protein, 24 aa, Entamoeba dispar
CSSTIAKFMFFIGIVDILFELLHF

SEQ ID NO: 2380631 - protein, 24 aa, Entamoeba dispar
CSSTKSNCEISLFSSQPTYQYPSG

SEQ ID NO: 2380632 - protein, 17 aa, Entamoeba dispar
CSTCKQCIGRYDHHCLL

SEQ ID NO: 2380633 - protein, 20 aa, Entamoeba dispar
CSTMVGCLICSPKEERCLTC

SEQ ID NO: 2380634 - protein, 21 aa, Entamoeba dispar
CSVCSEGYYPHGPDCQSCKSI

SEQ ID NO: 2380635 - protein, 18 aa, Entamoeba dispar
CSVLCLLISLLTFLVLSS

SEQ ID NO: 2380636 - protein, 26 aa, Entamoeba dispar
CSVLPHLSALVAIVFPRLNDTEATIT

SEQ ID NO: 2380637 - protein, 17 aa, Entamoeba dispar
CSVSLIGSFISGKEKET

SEQ ID NO: 2380638 - protein, 17 aa, Entamoeba dispar
CSYHLTKDFSYSLNNIM

SEQ ID NO: 2380639 - protein, 18 aa, Entamoeba dispar
CSYMKELGVSSVYLHALA

SEQ ID NO: 2380640 - protein, 20 aa, Entamoeba dispar
CSYTSFILKHGICNGDIVIV

SEQ ID NO: 2380641 - protein, 25 aa, Entamoeba dispar
CSYVQIRGSIPLLWSQIPNIKYKPK

SEQ ID NO: 2380642 - protein, 20 aa, Entamoeba dispar
CTACSIKGCEECKHGIDSCN

SEQ ID NO: 2380643 - protein, 17 aa, Entamoeba dispar
CTARYNITGNLSIPLGE

SEQ ID NO: 2380644 - protein, 19 aa, Entamoeba dispar
CTCILRCKIPVTLRYGQAK

SEQ ID NO: 2380645 - protein, 17 aa, Entamoeba dispar
CTCKVDDPILIVSSDVK

SEQ ID NO: 2380646 - protein, 20 aa, Entamoeba dispar
CTEFSCLVIDTLIGILPTQV

SEQ ID NO: 2380647 - protein, 23 aa, Entamoeba dispar
CTEHCRTCLYNSDFCLTCDNKSF

SEQ ID NO: 2380648 - protein, 26 aa, Entamoeba dispar
CTEPFRIPFAGIVDICAFDKTGTLTS

SEQ ID NO: 2380649 - protein, 26 aa, Entamoeba dispar
CTFLLMSTLIYWVFGYSFIQKNQIET

SEQ ID NO: 2380650 - protein, 17 aa, Entamoeba dispar
CTGCQPGYMWFGEGNCL

SEQ ID NO: 2380651 - protein, 27 aa, Entamoeba dispar
CTGVCSHFALGLVLRGSSISVTYGYEG

SEQ ID NO: 2380652 - protein, 27 aa, Entamoeba dispar
CTIEGIPLFVEHAFRFFELLSKIEKEV

SEQ ID NO: 2380653 - protein, 21 aa, Entamoeba dispar
CTILYFNELRSFSCLKCGDYI

SEQ ID NO: 2380654 - protein, 18 aa, Entamoeba dispar
CTINVRPALIKGLADIMY

SEQ ID NO: 2380655 - protein, 18 aa, Entamoeba dispar
CTISMIILIVPNFRTINQ

SEQ ID NO: 2380656 - protein, 24 aa, Entamoeba dispar
CTKCLPDYFLKDGYCYSCYKCKSE

SEQ ID NO: 2380657 - protein, 20 aa, Entamoeba dispar
CTLTIHWQFDVTLRGLRKVL

SEQ ID NO: 2380658 - protein, 18 aa, Entamoeba dispar
CTLYRYLDNLFRYSYLNN

SEQ ID NO: 2380659 - protein, 22 aa, Entamoeba dispar
CTNCCAEALAIVKENTKIRKSS

SEQ ID NO: 2380660 - protein, 19 aa, Entamoeba dispar
CTNLTCWLALFQNGTGVPY

SEQ ID NO: 2380661 - protein, 18 aa, Entamoeba dispar
CTNVFMKQGIHFCHNEND

SEQ ID NO: 2380662 - protein, 21 aa, Entamoeba dispar
CTPLSNFEAGMAYRDVPDPAV

SEQ ID NO: 2380663 - protein, 26 aa, Entamoeba dispar
CTQRMCFAESFTGYYDKTMKRITTKS

SEQ ID NO: 2380664 - protein, 20 aa, Entamoeba dispar
CTSCSTISCYSCEENYVLIG

SEQ ID NO: 2380665 - protein, 17 aa, Entamoeba dispar
CTSCTSQGCISCDQGYI

SEQ ID NO: 2380666 - protein, 18 aa, Entamoeba dispar
CTSFSNVFSLKFKTSSST

SEQ ID NO: 2380667 - protein, 18 aa, Entamoeba dispar
CTTILKERVPVTLRYGKL

SEQ ID NO: 2380668 - protein, 20 aa, Entamoeba dispar
CVASYCDPGYKFDRFNNRCI

SEQ ID NO: 2380669 - protein, 35 aa, Entamoeba dispar
CVCGWSDRCTFKYGRRRIFIGIGVLFEFISITLLI

SEQ ID NO: 2380670 - protein, 24 aa, Entamoeba dispar
CVFGLLCLIPYLFLQEHSTKPPIK

SEQ ID NO: 2380671 - protein, 18 aa, Entamoeba dispar
CVICRDTLTEAVHLSCGH

SEQ ID NO: 2380672 - protein, 28 aa, Entamoeba dispar
CVILIIFGSWCLVNFILGKRGVAVLPLY

SEQ ID NO: 2380673 - protein, 19 aa, Entamoeba dispar
CVITKIFIYNVLLKQKSII

SEQ ID NO: 2380674 - protein, 20 aa, Entamoeba dispar
CVIVTLIVLVIGLIFCVKKK

SEQ ID NO: 2380675 - protein, 21 aa, Entamoeba dispar
CVLSCVVGAFMARRISPSIHI

SEQ ID NO: 2380676 - protein, 18 aa, Entamoeba dispar
CVMSRLVLILAPAICLLS

SEQ ID NO: 2380677 - protein, 21 aa, Entamoeba dispar
CVNLVMSIGITIEFCVHIAHA

SEQ ID NO: 2380678 - protein, 19 aa, Entamoeba dispar
CVSEKCLNSILSDDLECFR

SEQ ID NO: 2380679 - protein, 19 aa, Entamoeba dispar
CVTFTIYLIYAYRKTVHHL

SEQ ID NO: 2380680 - protein, 25 aa, Entamoeba dispar
CVVCKKGYYRYGLDCTQCNSSCLSC

SEQ ID NO: 2380681 - protein, 18 aa, Entamoeba dispar
CVVLCILSIIGTIIETVT

SEQ ID NO: 2380682 - protein, 19 aa, Entamoeba dispar
CVYGLPVFIWVTLCGALLP

SEQ ID NO: 2380683 - protein, 19 aa, Entamoeba dispar
CVYKRIIRKCWAHKPKNRP

SEQ ID NO: 2380684 - protein, 34 aa, Entamoeba dispar
CWLVNICLCCCKFKTGSLFPILSVIMLLVYTLIS

SEQ ID NO: 2380685 - protein, 18 aa, Entamoeba dispar
CWRSRSSKRPSFNEIEKE

SEQ ID NO: 2380686 - protein, 18 aa, Entamoeba dispar
CYFNAMLQQSGFKKRFVK

SEQ ID NO: 2380687 - protein, 20 aa, Entamoeba dispar
CYGLSAGLEKVDFTLNDKEY

SEQ ID NO: 2380688 - protein, 17 aa, Entamoeba dispar
CYGVLLCFICFTHSLCS

SEQ ID NO: 2380689 - protein, 19 aa, Entamoeba dispar
CYIQTGIFIKPSLNINQNN

SEQ ID NO: 2380690 - protein, 17 aa, Entamoeba dispar
CYKCLGDYCKAEEENGK

SEQ ID NO: 2380691 - protein, 18 aa, Entamoeba dispar
CYLCNEGKNYYCNSQEQN

SEQ ID NO: 2380692 - protein, 21 aa, Entamoeba dispar
CYLGTPGCDKHCKCKEGYSYQ

SEQ ID NO: 2380693 - protein, 19 aa, Entamoeba dispar
CYLSSPSLVCRSLVRLQPY

SEQ ID NO: 2380694 - protein, 25 aa, Entamoeba dispar
CYNHNILGHWFRFIGNKSVSYQIQT

SEQ ID NO: 2380695 - protein, 25 aa, Entamoeba dispar
CYNLFSITVVYSWKNPDNSEIFLST

SEQ ID NO: 2380696 - protein, 25 aa, Entamoeba dispar
CYNSIRPHWNISIVKLITIIIIISI

SEQ ID NO: 2380697 - protein, 17 aa, Entamoeba dispar
CYPAESSLEVFKYDQCP

SEQ ID NO: 2380698 - protein, 17 aa, Entamoeba dispar
CYQCKEGFIKENGECKK

SEQ ID NO: 2380699 - protein, 20 aa, Entamoeba dispar
CYQSIKWSEKITHFCLEELI

SEQ ID NO: 2380700 - protein, 18 aa, Entamoeba dispar
CYSACALLTKGMWERGSA

SEQ ID NO: 2380701 - protein, 33 aa, Entamoeba dispar
CYSACSIMTKGLKEWGGAIIVGFSGDPNGKDEE

SEQ ID NO: 2380702 - protein, 32 aa, Entamoeba dispar
CYSACSWVTKGLKEWGGAIIVGFDGDPNGKDD

SEQ ID NO: 2380703 - protein, 20 aa, Entamoeba dispar
CYSCKSGYYKNSTIGCVPCI

SEQ ID NO: 2380704 - protein, 22 aa, Entamoeba dispar
CYSDDFYDIFSLVKGNQLVDVA

SEQ ID NO: 2380705 - protein, 32 aa, Entamoeba dispar
CYSGCSTLAKGLKEWGSAIIVGYGGDLYGTDD

SEQ ID NO: 2380706 - protein, 32 aa, Entamoeba dispar
CYSGCSTLAKGLKEWGSAIIVGYGGDLYGTDE

SEQ ID NO: 2380707 - protein, 19 aa, Entamoeba dispar
CYSHVWDAHLRHIISFQTI

SEQ ID NO: 2380708 - protein, 18 aa, Entamoeba dispar
CYSHVWDAHLRHLAASPI

SEQ ID NO: 2380709 - protein, 18 aa, Entamoeba dispar
CYSHVWDGHLRHLSNSPL

SEQ ID NO: 2380710 - protein, 17 aa, Entamoeba dispar
CYSKEGFLFKKYDQTLI

SEQ ID NO: 2380711 - protein, 19 aa, Entamoeba dispar
CYSNSLLPDCEQVSKEFDY

SEQ ID NO: 2380712 - protein, 19 aa, Entamoeba dispar
CYVCKDGYFSNGYLNCKPL

SEQ ID NO: 2380713 - protein, 27 aa, Entamoeba dispar
CYVDYDLRTPFLFMPLVKLVDAMIFKP

SEQ ID NO: 2380714 - protein, 28 aa, Entamoeba dispar
CYYRQKYRLGKWFKLDMSSIYTDTLSIN

SEQ ID NO: 2380715 - protein, 19 aa, Entamoeba dispar
DAASSPFIILFAFIMAIVF

SEQ ID NO: 2380716 - protein, 22 aa, Entamoeba dispar
DACAECLPGFYPAGKECETCES

SEQ ID NO: 2380717 - protein, 21 aa, Entamoeba dispar
DACYYPCKKCVKSADICYECN

SEQ ID NO: 2380718 - protein, 19 aa, Entamoeba dispar
DADLALMAKKPLRFTSDII

SEQ ID NO: 2380719 - protein, 30 aa, Entamoeba dispar
DAFGISVLLICWKKMIGLIESGVQINQLAE

SEQ ID NO: 2380720 - protein, 17 aa, Entamoeba dispar
DAKCLSDGLNIRGRETF

SEQ ID NO: 2380721 - protein, 19 aa, Entamoeba dispar
DALGKWSMLDSYVMVLMIV

SEQ ID NO: 2380722 - protein, 19 aa, Entamoeba dispar
DALKIFILLNLNRKDLAAA

SEQ ID NO: 2380723 - protein, 18 aa, Entamoeba dispar
DALKRLGQLLALGHFPKH

SEQ ID NO: 2380724 - protein, 25 aa, Entamoeba dispar
DALLPTIQCLYQWLCTIQDNTEWYQ

SEQ ID NO: 2380725 - protein, 18 aa, Entamoeba dispar
DALRRMGQMLALGNFPQH

SEQ ID NO: 2380726 - protein, 24 aa, Entamoeba dispar
DANYCLVCGKQVFFENKKKKEEEK

SEQ ID NO: 2380727 - protein, 31 aa, Entamoeba dispar
DASFKCDVFSFSICLLEIWLTHQPYNPEQFP

SEQ ID NO: 2380728 - protein, 20 aa, Entamoeba dispar
DASHLAYYLAYFTLIMLLGA

SEQ ID NO: 2380729 - protein, 19 aa, Entamoeba dispar
DASLWVFGCSLSLKSMSYW

SEQ ID NO: 2380730 - protein, 25 aa, Entamoeba dispar
DATNLRTTILFFIGCFVIIAMGCFQ

SEQ ID NO: 2380731 - protein, 26 aa, Entamoeba dispar
DCCKKICAIGGITFSLPLFKPTYPMK

SEQ ID NO: 2380732 - protein, 28 aa, Entamoeba dispar
DCETVPMCLYDFLIVHIFPLITPLISLL

SEQ ID NO: 2380733 - protein, 19 aa, Entamoeba dispar
DCHKLCYYNNQWQVDDYKG

SEQ ID NO: 2380734 - protein, 18 aa, Entamoeba dispar
DCIPKGYNFEDGFENGKD

SEQ ID NO: 2380735 - protein, 19 aa, Entamoeba dispar
DCPRKFHVPNVDTYKQLGH

SEQ ID NO: 2380736 - protein, 24 aa, Entamoeba dispar
DCSLEKDSTCYKCVSGKYFDGSSC

SEQ ID NO: 2380737 - protein, 21 aa, Entamoeba dispar
DCSPEAKGCCGGDTEEILKSF

SEQ ID NO: 2380738 - protein, 18 aa, Entamoeba dispar
DCTGCQPGYMWYGEGNCS

SEQ ID NO: 2380739 - protein, 21 aa, Entamoeba dispar
DCTKGRITYYDQWASGGSCSY

SEQ ID NO: 2380740 - protein, 25 aa, Entamoeba dispar
DCVSCNINTCLKCKTSKLINGKCVI

SEQ ID NO: 2380741 - protein, 33 aa, Entamoeba dispar
DCVYREIIKQCWRQRPERRPGFSQINEMISTLV

SEQ ID NO: 2380742 - protein, 19 aa, Entamoeba dispar
DCWSSLQLPIEVWTGKYTC

SEQ ID NO: 2380743 - protein, 24 aa, Entamoeba dispar
DCYEGKCYRCEDSFDGILENNQCI

SEQ ID NO: 2380744 - protein, 24 aa, Entamoeba dispar
DCYSSACKKNCRFCNITTLNCVEC

SEQ ID NO: 2380745 - protein, 24 aa, Entamoeba dispar
DDAAEKSWLYSFIKYEKKAPKSNH

SEQ ID NO: 2380746 - protein, 19 aa, Entamoeba dispar
DDAKLFRKFLREATIKNPK

SEQ ID NO: 2380747 - protein, 18 aa, Entamoeba dispar
DDCAEFLQYFQVVVDCDY

SEQ ID NO: 2380748 - protein, 21 aa, Entamoeba dispar
DDCHKLCYYNGKWQVNDYSSL

SEQ ID NO: 2380749 - protein, 23 aa, Entamoeba dispar
DDCRKLCYYNGKFYNGNATVNGD

SEQ ID NO: 2380750 - protein, 22 aa, Entamoeba dispar
DDEIANFAWNYFCRHLVRQEEV

SEQ ID NO: 2380751 - protein, 22 aa, Entamoeba dispar
DDGEIEWVYYFRKYNSKFFYPN

SEQ ID NO: 2380752 - protein, 26 aa, Entamoeba dispar
DDGKWSNQCVAAYCDKGYKFDFYNQK

SEQ ID NO: 2380753 - protein, 25 aa, Entamoeba dispar
DDGLRMGLIILCVFAIFQCLSVFIF

SEQ ID NO: 2380754 - protein, 23 aa, Entamoeba dispar
DDIIKRYNQVFYINKLSDHGICF

SEQ ID NO: 2380755 - protein, 23 aa, Entamoeba dispar
DDIKCSFSHKPECADIPPRKAVV

SEQ ID NO: 2380756 - protein, 17 aa, Entamoeba dispar
DDIPILVACASFCLVMA

SEQ ID NO: 2380757 - protein, 25 aa, Entamoeba dispar
DDKLKHLICNGFEIKCSVKITEPPK

SEQ ID NO: 2380758 - protein, 20 aa, Entamoeba dispar
DDKTRFGFIAQELKEVIPEA

SEQ ID NO: 2380759 - protein, 22 aa, Entamoeba dispar
DDLCMKEEIFGPILPVIEYDTL

SEQ ID NO: 2380760 - protein, 19 aa, Entamoeba dispar
DDLECFRGTEGCLENCYCD

SEQ ID NO: 2380761 - protein, 25 aa, Entamoeba dispar
DDLKFGKILLWLSIGVYLFYILAIY

SEQ ID NO: 2380762 - protein, 18 aa, Entamoeba dispar
DDMTDCSLFFFYVLMRMA

SEQ ID NO: 2380763 - protein, 20 aa, Entamoeba dispar
DDPQCLYRNGGLSKYILSPR

SEQ ID NO: 2380764 - protein, 20 aa, Entamoeba dispar
DDSFYILVGMIFFISLLLIF

SEQ ID NO: 2380765 - protein, 24 aa, Entamoeba dispar
DDSPRLSKAVDIFTLGCLFYYIAT

SEQ ID NO: 2380766 - protein, 21 aa, Entamoeba dispar
DDWVMTCFNTFFTSLPPAAIA

SEQ ID NO: 2380767 - protein, 22 aa, Entamoeba dispar
DECITRYPLFIQTLISGISQEK

SEQ ID NO: 2380768 - protein, 17 aa, Entamoeba dispar
DECKNVKSLAITSTSSN

SEQ ID NO: 2380769 - protein, 22 aa, Entamoeba dispar
DECLECSSGVLINGRCGSCKNR

SEQ ID NO: 2380770 - protein, 20 aa, Entamoeba dispar
DEFERCRVLFITRIDQVYEN

SEQ ID NO: 2380771 - protein, 20 aa, Entamoeba dispar
DEFSMLFSVVGIFFGISNSF

SEQ ID NO: 2380772 - protein, 18 aa, Entamoeba dispar
DEGEECDGGDGCIECECQ

SEQ ID NO: 2380773 - protein, 25 aa, Entamoeba dispar
DEGEECDGGEGCIECECQPEWYSQD

SEQ ID NO: 2380774 - protein, 22 aa, Entamoeba dispar
DEGIICTRLLLSMSNETIDKKI

SEQ ID NO: 2380775 - protein, 24 aa, Entamoeba dispar
DEIHIGAPIRPRLNKPKNIQNKIN

SEQ ID NO: 2380776 - protein, 26 aa, Entamoeba dispar
DEIKELKELWILPVACLIHGILQFFI

SEQ ID NO: 2380777 - protein, 18 aa, Entamoeba dispar
DEILLHITTLSSIDLSGS

SEQ ID NO: 2380778 - protein, 21 aa, Entamoeba dispar
DEISKCDIALIGEKENKPIGY

SEQ ID NO: 2380779 - protein, 17 aa, Entamoeba dispar
DEKIDVFSFAVVMYESY

SEQ ID NO: 2380780 - protein, 25 aa, Entamoeba dispar
DEKKRLPHFFQILSLTPIGRGILKD

SEQ ID NO: 2380781 - protein, 24 aa, Entamoeba dispar
DEKLKIKFCLDAAKGIQYLHSNGI

SEQ ID NO: 2380782 - protein, 18 aa, Entamoeba dispar
DEKVSSFDKKICHGIDLN

SEQ ID NO: 2380783 - protein, 25 aa, Entamoeba dispar
DELFRIDVVITKSCPYIGTDLQKSP

SEQ ID NO: 2380784 - protein, 23 aa, Entamoeba dispar
DELKIKKGELVCVLGSVGSGKSS

SEQ ID NO: 2380785 - protein, 21 aa, Entamoeba dispar
DELKKKSLEILKIQEEKEELV

SEQ ID NO: 2380786 - protein, 21 aa, Entamoeba dispar
DELKKNILLVSFIPTKKEQQA

SEQ ID NO: 2380787 - protein, 22 aa, Entamoeba dispar
DELKLFCSRMIETYSNNPKLSK

SEQ ID NO: 2380788 - protein, 21 aa, Entamoeba dispar
DELPEKMELYGMYIYIQGNKT

SEQ ID NO: 2380789 - protein, 25 aa, Entamoeba dispar
DEMCWLIKKNCCEIVSGSINIEAEK

SEQ ID NO: 2380790 - protein, 17 aa, Entamoeba dispar
DENCVACSDRMPGCKNC

SEQ ID NO: 2380791 - protein, 20 aa, Entamoeba dispar
DENKDIIGYFITNEENVKPD

SEQ ID NO: 2380792 - protein, 17 aa, Entamoeba dispar
DENRDIIGFFMNGDEKV

SEQ ID NO: 2380793 - protein, 24 aa, Entamoeba dispar
DETYFWARYFKLLFLKSNKLGEYS

SEQ ID NO: 2380794 - protein, 29 aa, Entamoeba dispar
DEVHWYSIYICSALCLFLLTVLIFASYKR

SEQ ID NO: 2380795 - protein, 28 aa, Entamoeba dispar
DEWMIRPYSKYIICWFGLDTLQLLNFSI

SEQ ID NO: 2380796 - protein, 20 aa, Entamoeba dispar
DEYSPLAVIDREFIAGKREV

SEQ ID NO: 2380797 - protein, 20 aa, Entamoeba dispar
DFATRIIIGSSCIDGVTSSC

SEQ ID NO: 2380798 - protein, 37 aa, Entamoeba dispar
DFEQRWWRLTLIFFLLGFCCFPFWIPSFVLSRKSSQR

SEQ ID NO: 2380799 - protein, 39 aa, Entamoeba dispar
DFEQRWWRLTLIFFLLGFCFFPFWIPSFILSQKSSQRTT

SEQ ID NO: 2380800 - protein, 26 aa, Entamoeba dispar
DFESECIRWLGAFRFILWTLWYCVTL

SEQ ID NO: 2380801 - protein, 29 aa, Entamoeba dispar
DFEVICFNPDLTIRWRQNYYKPKAKAYVQ

SEQ ID NO: 2380802 - protein, 22 aa, Entamoeba dispar
DFIGCATSGWFDHYKKCERLVI

SEQ ID NO: 2380803 - protein, 19 aa, Entamoeba dispar
DFIVRFRVSLFTRSIEISL

SEQ ID NO: 2380804 - protein, 39 aa, Entamoeba dispar
DFKECHDILRPSLRWYFSILFWRRIKTLKSTFKQSTLEF

SEQ ID NO: 2380805 - protein, 22 aa, Entamoeba dispar
DFKMQQCAISYFLTKFNNYTAD

SEQ ID NO: 2380806 - protein, 28 aa, Entamoeba dispar
DFLDIRWRYKLILSFCSSMLIVIIYPGS

SEQ ID NO: 2380807 - protein, 25 aa, Entamoeba dispar
DFLGLCEQIHFFLPFHFINIEDNFV

SEQ ID NO: 2380808 - protein, 18 aa, Entamoeba dispar
DFLICPLSALGTTFYRMM

SEQ ID NO: 2380809 - protein, 19 aa, Entamoeba dispar
DFLPITLFGYFYIFFATIR

SEQ ID NO: 2380810 - protein, 19 aa, Entamoeba dispar
DFLPITLFGYFYIFFATLR

SEQ ID NO: 2380811 - protein, 20 aa, Entamoeba dispar
DFLSGCFQYDPKLRFTPKQA

SEQ ID NO: 2380812 - protein, 23 aa, Entamoeba dispar
DFLTTYKHFVFKTITIKTFLHQL

SEQ ID NO: 2380813 - protein, 18 aa, Entamoeba dispar
DFMKVFQIFIKQKKENNI

SEQ ID NO: 2380814 - protein, 24 aa, Entamoeba dispar
DFNNNLPFSMYWSGHYHQKNLYVY

SEQ ID NO: 2380815 - protein, 20 aa, Entamoeba dispar
DFSLKCPFFPEKSLETLKEY

SEQ ID NO: 2380816 - protein, 18 aa, Entamoeba dispar
DFSPAATVSSSFINVNSV

SEQ ID NO: 2380817 - protein, 20 aa, Entamoeba dispar
DFTSLLALQIDNLFYKLDNE

SEQ ID NO: 2380818 - protein, 19 aa, Entamoeba dispar
DFYRPIIVLVQLLFIISNV

SEQ ID NO: 2380819 - protein, 26 aa, Entamoeba dispar
DGCVPFCGTCKFGFSCNKAAKCVRTI

SEQ ID NO: 2380820 - protein, 24 aa, Entamoeba dispar
DGDSEVCLRRGMCQPIGGQSLVGR

SEQ ID NO: 2380821 - protein, 21 aa, Entamoeba dispar
DGEGIINLLFNYGLIPKVQII

SEQ ID NO: 2380822 - protein, 26 aa, Entamoeba dispar
DGEQCKKCGCSICDKKQGCSIGCDPG

SEQ ID NO: 2380823 - protein, 19 aa, Entamoeba dispar
DGFNKVFKRNSLAVDLLPI

SEQ ID NO: 2380824 - protein, 25 aa, Entamoeba dispar
DGFQYKANCYRFNKQTGVCNSNCYL

SEQ ID NO: 2380825 - protein, 23 aa, Entamoeba dispar
DGFSYNLLEQFCFPDVTYRKKRT

SEQ ID NO: 2380826 - protein, 19 aa, Entamoeba dispar
DGFYLRTGKKREVLGAEQL

SEQ ID NO: 2380827 - protein, 20 aa, Entamoeba dispar
DGGKGCIECECQPGWYPKHS

SEQ ID NO: 2380828 - protein, 20 aa, Entamoeba dispar
DGGYGCDHCVCVNGTKKYAK

SEQ ID NO: 2380829 - protein, 21 aa, Entamoeba dispar
DGGYGCDHCVCVNGTKKYAKA

SEQ ID NO: 2380830 - protein, 24 aa, Entamoeba dispar
DGIKCLRCKRGYYSSGKGCIKCDE

SEQ ID NO: 2380831 - protein, 17 aa, Entamoeba dispar
DGKCIDGIGCQECQPKY

SEQ ID NO: 2380832 - protein, 23 aa, Entamoeba dispar
DGKCVIKCPKYCKTCERETLECT

SEQ ID NO: 2380833 - protein, 23 aa, Entamoeba dispar
DGKWRLLVYALQYVIVPLIRVHH

SEQ ID NO: 2380834 - protein, 22 aa, Entamoeba dispar
DGLLRKLGWLTFLDVLPLPITP

SEQ ID NO: 2380835 - protein, 26 aa, Entamoeba dispar
DGLSGLPSMCVLSLMAFANQPLAIIL

SEQ ID NO: 2380836 - protein, 18 aa, Entamoeba dispar
DGMAFWLTPEQLEIGTAL

SEQ ID NO: 2380837 - protein, 20 aa, Entamoeba dispar
DGSCGIPHCQIEEDGKCSLC

SEQ ID NO: 2380838 - protein, 23 aa, Entamoeba dispar
DGSGCGICKNGYYRNGKGCSKCE

SEQ ID NO: 2380839 - protein, 24 aa, Entamoeba dispar
DGSGCGICKNGYYRNGKGCSKCEK

SEQ ID NO: 2380840 - protein, 23 aa, Entamoeba dispar
DGSGCGICNKGYYRNGKGCSKCG

SEQ ID NO: 2380841 - protein, 26 aa, Entamoeba dispar
DGTCPKCSYSPCTQCNILEECVSCSF

SEQ ID NO: 2380842 - protein, 23 aa, Entamoeba dispar
DGTECIYHLNLFIIIGIPIIIIF

SEQ ID NO: 2380843 - protein, 23 aa, Entamoeba dispar
DGTKEGFAKCISRLCHDNNLRQK

SEQ ID NO: 2380844 - protein, 23 aa, Entamoeba dispar
DGTKEGFAKCISRLCRDNNLRQK

SEQ ID NO: 2380845 - protein, 23 aa, Entamoeba dispar
DGYYKKDSICFSCEDPMETCITE

SEQ ID NO: 2380846 - protein, 17 aa, Entamoeba dispar
DGYYLIFNECFKCSTHC

SEQ ID NO: 2380847 - protein, 18 aa, Entamoeba dispar
DHFFKRKQLRKIYNKMKY

SEQ ID NO: 2380848 - protein, 20 aa, Entamoeba dispar
DHHCPWIGQCVGFKNHKYFI

SEQ ID NO: 2380849 - protein, 18 aa, Entamoeba dispar
DHHCPWVSNCIGKNNMKF

SEQ ID NO: 2380850 - protein, 23 aa, Entamoeba dispar
DHLESLLKLLGLIYDILPYFIKT

SEQ ID NO: 2380851 - protein, 17 aa, Entamoeba dispar
DHLHYHKVFSFVFPGKR

SEQ ID NO: 2380852 - protein, 17 aa, Entamoeba dispar
DHLYTFKSKISTFSPSN

SEQ ID NO: 2380853 - protein, 25 aa, Entamoeba dispar
DHQEKIFSLWGFIISYIVSKGGIVT

SEQ ID NO: 2380854 - protein, 28 aa, Entamoeba dispar
DHSFRPREFFNITVLLRLSKALDIQIAI

SEQ ID NO: 2380855 - protein, 25 aa, Entamoeba dispar
DHSSYCIYFKEDIFRFENKQICSQW

SEQ ID NO: 2380856 - protein, 29 aa, Entamoeba dispar
DHVYYCFWRYVRFEIVRIIKTYLFNKTKN

SEQ ID NO: 2380857 - protein, 22 aa, Entamoeba dispar
DICAKCSSLTCPADATYRTYTY

SEQ ID NO: 2380858 - protein, 17 aa, Entamoeba dispar
DICLYKYEEGEFVGHLL

SEQ ID NO: 2380859 - protein, 26 aa, Entamoeba dispar
DIDEIRFNSFWNYKKFEIKMCDGTGH

SEQ ID NO: 2380860 - protein, 20 aa, Entamoeba dispar
DIDIVICNCSLFNPTPSISA

SEQ ID NO: 2380861 - protein, 23 aa, Entamoeba dispar
DIDIVICNCSLFNPTPSISAMLM

SEQ ID NO: 2380862 - protein, 17 aa, Entamoeba dispar
DIDVVFRAICPHDCNHK

SEQ ID NO: 2380863 - protein, 18 aa, Entamoeba dispar
DIDYCLDEQLPLIYNDLV

SEQ ID NO: 2380864 - protein, 23 aa, Entamoeba dispar
DIECPKDVISLFEIEKTGKLKKM

SEQ ID NO: 2380865 - protein, 21 aa, Entamoeba dispar
DIEGAWEIFFRIYKRIHKSIN

SEQ ID NO: 2380866 - protein, 36 aa, Entamoeba dispar
DIELTFKIICHNDCHYKEGYGFCNLMSKGCECKEGY

SEQ ID NO: 2380867 - protein, 31 aa, Entamoeba dispar
DIERKECPNEELFGVFCIYDITMEKKLTENY

SEQ ID NO: 2380868 - protein, 21 aa, Entamoeba dispar
DIETLYIIFFFILKNLKEETV

SEQ ID NO: 2380869 - protein, 17 aa, Entamoeba dispar
DIFLYLIDMIQHKLNMK

SEQ ID NO: 2380870 - protein, 17 aa, Entamoeba dispar
DIFMYFVFSQSRQKLSL

SEQ ID NO: 2380871 - protein, 17 aa, Entamoeba dispar
DIFRAKGDVIVRDLTGK

SEQ ID NO: 2380872 - protein, 22 aa, Entamoeba dispar
DIFTLGCLFYYIATRKHPYGDS

SEQ ID NO: 2380873 - protein, 18 aa, Entamoeba dispar
DIGLSKCLPPLLSYFQFV

SEQ ID NO: 2380874 - protein, 17 aa, Entamoeba dispar
DIHLLQGIVLNLAKPLK

SEQ ID NO: 2380875 - protein, 25 aa, Entamoeba dispar
DIHPLATPCLFSFNANNYYFSLSID

SEQ ID NO: 2380876 - protein, 21 aa, Entamoeba dispar
DIIACWYYDKFLFIGIYVLFF

SEQ ID NO: 2380877 - protein, 19 aa, Entamoeba dispar
DIIEIMSTVSFGFGIGLYF

SEQ ID NO: 2380878 - protein, 17 aa, Entamoeba dispar
DIIELIPSVSFETFKHT

SEQ ID NO: 2380879 - protein, 17 aa, Entamoeba dispar
DIIETIAIYSGIIILLL

SEQ ID NO: 2380880 - protein, 19 aa, Entamoeba dispar
DIIFIFRIFTKLLSSKENY

SEQ ID NO: 2380881 - protein, 17 aa, Entamoeba dispar
DIIGCILGGLKLSSASY

SEQ ID NO: 2380882 - protein, 20 aa, Entamoeba dispar
DIIGMRFDKFHSVCENLTLV

SEQ ID NO: 2380883 - protein, 17 aa, Entamoeba dispar
DIIHIVITFIIRGISQS

SEQ ID NO: 2380884 - protein, 23 aa, Entamoeba dispar
DIIKEIQSAMLFSQEDINALNTI

SEQ ID NO: 2380885 - protein, 19 aa, Entamoeba dispar
DIIKGYKLIMKHIEEDLDI

SEQ ID NO: 2380886 - protein, 27 aa, Entamoeba dispar
DIIQIRFRYAYELEYWDKILNELCELA

SEQ ID NO: 2380887 - protein, 24 aa, Entamoeba dispar
DIITLCVGITFFLFSLHVTVFHVQ

SEQ ID NO: 2380888 - protein, 18 aa, Entamoeba dispar
DIITLTWKDHINTIRIES

SEQ ID NO: 2380889 - protein, 24 aa, Entamoeba dispar
DIKEFKRLGLRKIKHNKKVISSSY

SEQ ID NO: 2380890 - protein, 22 aa, Entamoeba dispar
DIKGTLNIRTGNKFETTNIKVY

SEQ ID NO: 2380891 - protein, 17 aa, Entamoeba dispar
DIKRMCEDYMIKLIDKY

SEQ ID NO: 2380892 - protein, 20 aa, Entamoeba dispar
DIKSLCLNNYIISKLSITIH

SEQ ID NO: 2380893 - protein, 25 aa, Entamoeba dispar
DIKSSLKMKVIRKMKIYNPSLNDNM

SEQ ID NO: 2380894 - protein, 23 aa, Entamoeba dispar
DIKVMYLCMFFVLKNISYSTMKS

SEQ ID NO: 2380895 - protein, 25 aa, Entamoeba dispar
DILKLKESFEIISILFESTSIEKVC

SEQ ID NO: 2380896 - protein, 24 aa, Entamoeba dispar
DILNCVTCSRSSYTCDSCNPGYYL

SEQ ID NO: 2380897 - protein, 18 aa, Entamoeba dispar
DILQWRNGTRLMSVNNDI

SEQ ID NO: 2380898 - protein, 17 aa, Entamoeba dispar
DILSFLFTIFAHSQLIP

SEQ ID NO: 2380899 - protein, 23 aa, Entamoeba dispar
DIMSGASALGRLNIWHRDYKGDN

SEQ ID NO: 2380900 - protein, 18 aa, Entamoeba dispar
DIMTLPFNKIFLKESIDK

SEQ ID NO: 2380901 - protein, 25 aa, Entamoeba dispar
DINEAANASTLWFAIIIIVVVILLT

SEQ ID NO: 2380902 - protein, 25 aa, Entamoeba dispar
DINNKGIFCINWRVDYFKKTEHKIK

SEQ ID NO: 2380903 - protein, 25 aa, Entamoeba dispar
DINPMRYWRIGVLFGGTIYVIILLI

SEQ ID NO: 2380904 - protein, 27 aa, Entamoeba dispar
DIPNGLSLKCTNRAFMYVGSASNNFKC

SEQ ID NO: 2380905 - protein, 24 aa, Entamoeba dispar
DIQAMVCLKCTTVINERVPVTIRF

SEQ ID NO: 2380906 - protein, 26 aa, Entamoeba dispar
DIQFGENGERVMGNKGYVSIKYPMLI

SEQ ID NO: 2380907 - protein, 18 aa, Entamoeba dispar
DIQLRYLIKKVTLEEENV

SEQ ID NO: 2380908 - protein, 22 aa, Entamoeba dispar
DIRCVQFPAFHLEGHLGNVTDF

SEQ ID NO: 2380909 - protein, 23 aa, Entamoeba dispar
DIRINATSVFYLFVRTNYEILGS

SEQ ID NO: 2380910 - protein, 20 aa, Entamoeba dispar
DIRVNLPLAAPNDMYLGLFF

SEQ ID NO: 2380911 - protein, 17 aa, Entamoeba dispar
DISSLAWYFNQLTPNGV

SEQ ID NO: 2380912 - protein, 24 aa, Entamoeba dispar
DITRSLPLYLSIFIFGESSNEELR

SEQ ID NO: 2380913 - protein, 25 aa, Entamoeba dispar
DIVIYRYLLNATFVYPTEQNNESQD

SEQ ID NO: 2380914 - protein, 23 aa, Entamoeba dispar
DIVLYLLVLFFSWISERKLDKVI

SEQ ID NO: 2380915 - protein, 19 aa, Entamoeba dispar
DIWALGCTIIELITGNPPY

SEQ ID NO: 2380916 - protein, 19 aa, Entamoeba dispar
DIWLHVIPQIIARIQSNVP

SEQ ID NO: 2380917 - protein, 25 aa, Entamoeba dispar
DIYCPSCLEKGFFHIVNQESLKKGI

SEQ ID NO: 2380918 - protein, 19 aa, Entamoeba dispar
DIYSFAVTMYEVWNWNIVY

SEQ ID NO: 2380919 - protein, 20 aa, Entamoeba dispar
DIYSLAIVIVEAFDRKCPYS

SEQ ID NO: 2380920 - protein, 26 aa, Entamoeba dispar
DIYSLAVSMYQTWSWKNPYDKDESSQ

SEQ ID NO: 2380921 - protein, 23 aa, Entamoeba dispar
DKDIFINCIEWIDKERIAITTRN

SEQ ID NO: 2380922 - protein, 18 aa, Entamoeba dispar
DKDIPVIIFFGIYASSDT

SEQ ID NO: 2380923 - protein, 27 aa, Entamoeba dispar
DKDLIGIRFFYYIHLISSGFSKQQELL

SEQ ID NO: 2380924 - protein, 24 aa, Entamoeba dispar
DKDNSLWAILFVYRNADAKQNTMR

SEQ ID NO: 2380925 - protein, 18 aa, Entamoeba dispar
DKEFPRKEVRQMFEEDQY

SEQ ID NO: 2380926 - protein, 18 aa, Entamoeba dispar
DKEFQRYSLGLVTTPIFQ

SEQ ID NO: 2380927 - protein, 18 aa, Entamoeba dispar
DKEICVVLGSGGHTMEML

SEQ ID NO: 2380928 - protein, 31 aa, Entamoeba dispar
DKEIIRYLIRNCGDRELFIWYCETNNDMVGL

SEQ ID NO: 2380929 - protein, 23 aa, Entamoeba dispar
DKENWFQFKMTLRIVDYNLSYCN

SEQ ID NO: 2380930 - protein, 22 aa, Entamoeba dispar
DKESIEIKKQCCYKTNQQQNIS

SEQ ID NO: 2380931 - protein, 26 aa, Entamoeba dispar
DKFIVWGCIAFCFIMAASFPLVHFAQ

SEQ ID NO: 2380932 - protein, 18 aa, Entamoeba dispar
DKFKHLYDFNLIEAVDNR

SEQ ID NO: 2380933 - protein, 18 aa, Entamoeba dispar
DKFRSEYIIHFYGAVFIP

SEQ ID NO: 2380934 - protein, 24 aa, Entamoeba dispar
DKFTLKFGGGDTFEHLFFIGNDTN

SEQ ID NO: 2380935 - protein, 25 aa, Entamoeba dispar
DKFVHRKDRRLGFFGEIIHNIKFIK

SEQ ID NO: 2380936 - protein, 19 aa, Entamoeba dispar
DKGECYPCQPNCLTCDSKQ

SEQ ID NO: 2380937 - protein, 23 aa, Entamoeba dispar
DKIEATGVNWVWFTLYQTNSAFN

SEQ ID NO: 2380938 - protein, 18 aa, Entamoeba dispar
DKIFISSSIPLILSPIST

SEQ ID NO: 2380939 - protein, 25 aa, Entamoeba dispar
DKIFTRRIEITGGEIEINNMITFSE

SEQ ID NO: 2380940 - protein, 26 aa, Entamoeba dispar
DKIIKKRLFYSFIIHIEVILPFFFLP

SEQ ID NO: 2380941 - protein, 20 aa, Entamoeba dispar
DKIKKICERYMIKLVDKTQG

SEQ ID NO: 2380942 - protein, 20 aa, Entamoeba dispar
DKIMHLFEVIILMTICIIIT

SEQ ID NO: 2380943 - protein, 25 aa, Entamoeba dispar
DKITYSGDVPKQFYLACYGRALIYN

SEQ ID NO: 2380944 - protein, 17 aa, Entamoeba dispar
DKKCLKCDSNCETCYGI

SEQ ID NO: 2380945 - protein, 25 aa, Entamoeba dispar
DKKLCKEVIETALLLSQKMGEKYIL

SEQ ID NO: 2380946 - protein, 18 aa, Entamoeba dispar
DKKMKEFMNIASKYLDRV

SEQ ID NO: 2380947 - protein, 19 aa, Entamoeba dispar
DKKRLHLDTTFKSVMVYVY

SEQ ID NO: 2380948 - protein, 20 aa, Entamoeba dispar
DKLFELFSILPSYSFSIYLY

SEQ ID NO: 2380949 - protein, 23 aa, Entamoeba dispar
DKMKEFEKEVGMLDKFRSEYIIH

SEQ ID NO: 2380950 - protein, 18 aa, Entamoeba dispar
DKNGCKECEKGYSAKDNG

SEQ ID NO: 2380951 - protein, 25 aa, Entamoeba dispar
DKNVKGIITWFSLHNCQTRFEGTRK

SEQ ID NO: 2380952 - protein, 20 aa, Entamoeba dispar
DKPYCGGGYVFFDNILDFGY

SEQ ID NO: 2380953 - protein, 26 aa, Entamoeba dispar
DKRPGHKLRIKFMIDAAKGIEYLHSN

SEQ ID NO: 2380954 - protein, 21 aa, Entamoeba dispar
DKSDDRIRACDAISRLERLIT

SEQ ID NO: 2380955 - protein, 18 aa, Entamoeba dispar
DKSSWLLSLPEDWFEFGL

SEQ ID NO: 2380956 - protein, 23 aa, Entamoeba dispar
DKTQGRQTYPFAFTETLAPIIGV

SEQ ID NO: 2380957 - protein, 20 aa, Entamoeba dispar
DKVNCLYRNGGLSEYILSPR

SEQ ID NO: 2380958 - protein, 20 aa, Entamoeba dispar
DKVSCLVCDGIILNGNCVNY

SEQ ID NO: 2380959 - protein, 22 aa, Entamoeba dispar
DKVYCIYSPLSSFISDELISSL

SEQ ID NO: 2380960 - protein, 22 aa, Entamoeba dispar
DKYGCKLCNKGYVHSSDIGCIL

SEQ ID NO: 2380961 - protein, 23 aa, Entamoeba dispar
DKYGCKLCNKGYVHSSDIGCILS

SEQ ID NO: 2380962 - protein, 23 aa, Entamoeba dispar
DKYGMAYSLLWINYLVDQFFFRV

SEQ ID NO: 2380963 - protein, 25 aa, Entamoeba dispar
DKYNICALSEAFILYIQAMGGIFIP

SEQ ID NO: 2380964 - protein, 20 aa, Entamoeba dispar
DKYTPLWIRNEFKERYPDVR

SEQ ID NO: 2380965 - protein, 19 aa, Entamoeba dispar
DLASILGINAIQLILNENM

SEQ ID NO: 2380966 - protein, 37 aa, Entamoeba dispar
DLDALWKLWDYLLLSEDPCFFVFILVALFLLKEKMLG

SEQ ID NO: 2380967 - protein, 23 aa, Entamoeba dispar
DLEKRIFDGLTFAFIEQTSGDEN

SEQ ID NO: 2380968 - protein, 25 aa, Entamoeba dispar
DLFHLPHLFYICILELIWYLTENKC

SEQ ID NO: 2380969 - protein, 20 aa, Entamoeba dispar
DLFMRFLSIYLPHISIICAI

SEQ ID NO: 2380970 - protein, 20 aa, Entamoeba dispar
DLFVRDWQKYFPMKTLLFLS

SEQ ID NO: 2380971 - protein, 18 aa, Entamoeba dispar
DLHCLILIAPAGLYYCFK

SEQ ID NO: 2380972 - protein, 20 aa, Entamoeba dispar
DLHFKAICIDSCNRESKLGI

SEQ ID NO: 2380973 - protein, 17 aa, Entamoeba dispar
DLHREFVDNLVIEKNGK

SEQ ID NO: 2380974 - protein, 22 aa, Entamoeba dispar
DLICKAIGGPVYISSNLPSIPV

SEQ ID NO: 2380975 - protein, 31 aa, Entamoeba dispar
DLIFKEGQILLSFSGCSIVNIFSNSETIIKS

SEQ ID NO: 2380976 - protein, 25 aa, Entamoeba dispar
DLIKMFNCFLLTLGLAFNFISTTEM

SEQ ID NO: 2380977 - protein, 30 aa, Entamoeba dispar
DLKRTMWWKNMKLWFIIGGVVAIIVIVIII

SEQ ID NO: 2380978 - protein, 17 aa, Entamoeba dispar
DLLCSTASFIRSHTPLT

SEQ ID NO: 2380979 - protein, 19 aa, Entamoeba dispar
DLLECSDLLSFIATQTNFG

SEQ ID NO: 2380980 - protein, 25 aa, Entamoeba dispar
DLLKQLRPGMDLGRISFPSHILEPR

SEQ ID NO: 2380981 - protein, 18 aa, Entamoeba dispar
DLLSKLRNPFVVNYVGSV

SEQ ID NO: 2380982 - protein, 24 aa, Entamoeba dispar
DLMLKKWKESLISYTSYLTPTKLL

SEQ ID NO: 2380983 - protein, 24 aa, Entamoeba dispar
DLNKCIIEGNGIKGGYVNEKQSFT

SEQ ID NO: 2380984 - protein, 26 aa, Entamoeba dispar
DLPEMMRLPIIQGFIGRSECAVEPEV

SEQ ID NO: 2380985 - protein, 22 aa, Entamoeba dispar
DLRGYSVLHYAVFINSSEFLDK

SEQ ID NO: 2380986 - protein, 24 aa, Entamoeba dispar
DLTQERYLRFSSRFLTNTKSECRY

SEQ ID NO: 2380987 - protein, 22 aa, Entamoeba dispar
DLTRTFLIVAILVSFCIFISFF

SEQ ID NO: 2380988 - protein, 28 aa, Entamoeba dispar
DLVCPCQNLNGYECELEFTGSTTNPIIF

SEQ ID NO: 2380989 - protein, 19 aa, Entamoeba dispar
DLVCVSCKSGYFMKEDFTC

SEQ ID NO: 2380990 - protein, 18 aa, Entamoeba dispar
DLVDLGELLPNFMQEAEM

SEQ ID NO: 2380991 - protein, 27 aa, Entamoeba dispar
DLVGKWGWRLKEIRNQNDIKEWKEMEK

SEQ ID NO: 2380992 - protein, 25 aa, Entamoeba dispar
DLVHFLPCILQRCIDVLNDRKREEI

SEQ ID NO: 2380993 - protein, 17 aa, Entamoeba dispar
DLVSECDCQSFIQKVKD

SEQ ID NO: 2380994 - protein, 22 aa, Entamoeba dispar
DMIKQLKKFIVILLSVNIILIA

SEQ ID NO: 2380995 - protein, 20 aa, Entamoeba dispar
DMINLYGADALRLSLINSPA

SEQ ID NO: 2380996 - protein, 18 aa, Entamoeba dispar
DMPMFAFMMLIMLFVFEG

SEQ ID NO: 2380997 - protein, 19 aa, Entamoeba dispar
DMRFFRWRLYTKINGLINK

SEQ ID NO: 2380998 - protein, 26 aa, Entamoeba dispar
DNARFRIGNFHFFKTILSEEMIKFIF

SEQ ID NO: 2380999 - protein, 18 aa, Entamoeba dispar
DNCFGCYISKAPSYMGIG

SEQ ID NO: 2381000 - protein, 17 aa, Entamoeba dispar
DNCKECLSSTSCDECMN

SEQ ID NO: 2381001 - protein, 17 aa, Entamoeba dispar
DNCKECLSSTSCKECMK

SEQ ID NO: 2381002 - protein, 21 aa, Entamoeba dispar
DNCKEGLAIHKGQMKAEAAGL

SEQ ID NO: 2381003 - protein, 23 aa, Entamoeba dispar
DNCKYTPVCILEIKEDITDDLKA

SEQ ID NO: 2381004 - protein, 24 aa, Entamoeba dispar
DNCLYKSIIEECWKVNPDERPNFK

SEQ ID NO: 2381005 - protein, 18 aa, Entamoeba dispar
DNFIGCKTLQLYNKKCEY

SEQ ID NO: 2381006 - protein, 17 aa, Entamoeba dispar
DNFNILKNYNIQGSIPI

SEQ ID NO: 2381007 - protein, 20 aa, Entamoeba dispar
DNFVSFNFFIMYFAQTIMFG

SEQ ID NO: 2381008 - protein, 18 aa, Entamoeba dispar
DNHWCVFETVATNNYCTY

SEQ ID NO: 2381009 - protein, 19 aa, Entamoeba dispar
DNILFKYSGSLIIEKGIGD

SEQ ID NO: 2381010 - protein, 19 aa, Entamoeba dispar
DNLCPLIQCTINSNKNEFL

SEQ ID NO: 2381011 - protein, 18 aa, Entamoeba dispar
DNLFSFGPSSFVVPTAVT

SEQ ID NO: 2381012 - protein, 23 aa, Entamoeba dispar
DNLPRHLLVAFLYDTSCFFYWIV

SEQ ID NO: 2381013 - protein, 23 aa, Entamoeba dispar
DNLPTEPLFGVFSIYSADETDPN

SEQ ID NO: 2381014 - protein, 22 aa, Entamoeba dispar
DNNEYPITIILPMNGGGSGDLV

SEQ ID NO: 2381015 - protein, 26 aa, Entamoeba dispar
DNNSFKFYSLCGGLVISDLPEDQVSC

SEQ ID NO: 2381016 - protein, 20 aa, Entamoeba dispar
DNRKFASWLGANLLDKENIG

SEQ ID NO: 2381017 - protein, 19 aa, Entamoeba dispar
DNSFVLFLCGLNFKYYGLV

SEQ ID NO: 2381018 - protein, 18 aa, Entamoeba dispar
DNTFPLKDIEALIKYLPN

SEQ ID NO: 2381019 - protein, 18 aa, Entamoeba dispar
DNTLSILKKGYMEYFVDP

SEQ ID NO: 2381020 - protein, 23 aa, Entamoeba dispar
DNVKAGTVLVVFMSVLFATQSLS

SEQ ID NO: 2381021 - protein, 31 aa, Entamoeba dispar
DNVWKQTVLHFFSFLNMFSFLVPVSCLVSLE

SEQ ID NO: 2381022 - protein, 18 aa, Entamoeba dispar
DNWYALSYTRTSCERYAE

SEQ ID NO: 2381023 - protein, 25 aa, Entamoeba dispar
DNYDFAKEQLKQWILTLKHLYEHID

SEQ ID NO: 2381024 - protein, 19 aa, Entamoeba dispar
DNYKCTNAFSISKKPFNII

SEQ ID NO: 2381025 - protein, 19 aa, Entamoeba dispar
DPCINRFFISNAKHISELT

SEQ ID NO: 2381026 - protein, 17 aa, Entamoeba dispar
DPDFINWMRPAVSSTFR

SEQ ID NO: 2381027 - protein, 25 aa, Entamoeba dispar
DPESYKYWHHWALINFEIVSYIELD

SEQ ID NO: 2381028 - protein, 27 aa, Entamoeba dispar
DPFPKTQFKFAWDIADLVANGKRTNQI

SEQ ID NO: 2381029 - protein, 22 aa, Entamoeba dispar
DPGPQILYCCVAFKTNILAEYY

SEQ ID NO: 2381030 - protein, 20 aa, Entamoeba dispar
DPGYKFDRFNNRCIVDVCFQ

SEQ ID NO: 2381031 - protein, 24 aa, Entamoeba dispar
DPHFSKWWINHAIKRMNEFCSSTL

SEQ ID NO: 2381032 - protein, 23 aa, Entamoeba dispar
DPHVLGVGIVTVFRQFHPSTLWT

SEQ ID NO: 2381033 - protein, 18 aa, Entamoeba dispar
DPIGCTIVPSSGDPSNGP

SEQ ID NO: 2381034 - protein, 19 aa, Entamoeba dispar
DPISTCFLYSTPLRLNQDF

SEQ ID NO: 2381035 - protein, 19 aa, Entamoeba dispar
DPLFIAFSGKKAYSYQGKF

SEQ ID NO: 2381036 - protein, 28 aa, Entamoeba dispar
DPLFKEGFCKHLIPAALHRYEEQSSYDD

SEQ ID NO: 2381037 - protein, 21 aa, Entamoeba dispar
DPNSIPFVFTLLVELTDNMSN

SEQ ID NO: 2381038 - protein, 25 aa, Entamoeba dispar
DPQGWPLQVGPIMGRIVVEDVTRDG

SEQ ID NO: 2381039 - protein, 24 aa, Entamoeba dispar
DPQPRIICPNGYLYVKGECIKSKE

SEQ ID NO: 2381040 - protein, 22 aa, Entamoeba dispar
DPRFKCNWHISEFIMSGKHLEK

SEQ ID NO: 2381041 - protein, 23 aa, Entamoeba dispar
DPSMPKKIPIVWSSNETSFITIK

SEQ ID NO: 2381042 - protein, 20 aa, Entamoeba dispar
DPTQYSCCLFTGEDSINVDE

SEQ ID NO: 2381043 - protein, 26 aa, Entamoeba dispar
DPYECKKSNGLNCVASYTGSAASLDK

SEQ ID NO: 2381044 - protein, 18 aa, Entamoeba dispar
DPYFNYRASKYLLANGLD

SEQ ID NO: 2381045 - protein, 20 aa, Entamoeba dispar
DPYGSFDFWATMKGYIDGDS

SEQ ID NO: 2381046 - protein, 17 aa, Entamoeba dispar
DPYWFHYFEDWSYDCLP

SEQ ID NO: 2381047 - protein, 22 aa, Entamoeba dispar
DQFIPHLFKPSSLDFPSTTSAF

SEQ ID NO: 2381048 - protein, 17 aa, Entamoeba dispar
DQIFGRIHFRDHSKDTF

SEQ ID NO: 2381049 - protein, 23 aa, Entamoeba dispar
DQIIKEKICILIGKRDKFTDLFT

SEQ ID NO: 2381050 - protein, 33 aa, Entamoeba dispar
DQLSREGRFRFGGFWGKKWAKLTVNKNESSCLN

SEQ ID NO: 2381051 - protein, 17 aa, Entamoeba dispar
DQSICYLLLQKIGVVEQ

SEQ ID NO: 2381052 - protein, 22 aa, Entamoeba dispar
DQYCNLRIGVELGTDKCLTAFN

SEQ ID NO: 2381053 - protein, 23 aa, Entamoeba dispar
DQYIPKLLPFSGHVLPSVRTAVM

SEQ ID NO: 2381054 - protein, 19 aa, Entamoeba dispar
DQYVLKHQVCIYWKDIKKC

SEQ ID NO: 2381055 - protein, 21 aa, Entamoeba dispar
DRGCGVAAKLMHKLNSLHDYF

SEQ ID NO: 2381056 - protein, 27 aa, Entamoeba dispar
DRGTTLRGECWFPSEYLDIIVTKLSEL

SEQ ID NO: 2381057 - protein, 19 aa, Entamoeba dispar
DRKIKKFLCSSSGDNEQCS

SEQ ID NO: 2381058 - protein, 25 aa, Entamoeba dispar
DRKTCKGFCDGGARCTCPMCCHNEC

SEQ ID NO: 2381059 - protein, 23 aa, Entamoeba dispar
DRLSCKKLNLGLIISLIIVGLLF

SEQ ID NO: 2381060 - protein, 23 aa, Entamoeba dispar
DRNAVKFIKLEFEKCYRTSSINS

SEQ ID NO: 2381061 - protein, 19 aa, Entamoeba dispar
DRNCKTKAVALTFDDSPSG

SEQ ID NO: 2381062 - protein, 21 aa, Entamoeba dispar
DRPRFSFYDGPPFATGLPHYG

SEQ ID NO: 2381063 - protein, 22 aa, Entamoeba dispar
DRQELYPRIIFNEGNGSTESGM

SEQ ID NO: 2381064 - protein, 24 aa, Entamoeba dispar
DRQLRVCTTIAIAVVADSCAPFTV

SEQ ID NO: 2381065 - protein, 23 aa, Entamoeba dispar
DRSSKIPVHFDITFPYSSCPITS

SEQ ID NO: 2381066 - protein, 18 aa, Entamoeba dispar
DRTGMVFALASSLCQVLE

SEQ ID NO: 2381067 - protein, 19 aa, Entamoeba dispar
DSAFECLEQVVGCTDYVYA

SEQ ID NO: 2381068 - protein, 18 aa, Entamoeba dispar
DSAGYCFASTLNLTYFEG

SEQ ID NO: 2381069 - protein, 17 aa, Entamoeba dispar
DSAIEWLFNSCDIPKPE

SEQ ID NO: 2381070 - protein, 17 aa, Entamoeba dispar
DSCRSCIDNTKVVNGEC

SEQ ID NO: 2381071 - protein, 20 aa, Entamoeba dispar
DSDFCLECSDSYYLTTMGKC

SEQ ID NO: 2381072 - protein, 18 aa, Entamoeba dispar
DSDINLAREIYCDDNKRE

SEQ ID NO: 2381073 - protein, 23 aa, Entamoeba dispar
DSDISFLYTFKWVGFGTAFTHTA

SEQ ID NO: 2381074 - protein, 25 aa, Entamoeba dispar
DSFDLRKCIPLIIVGNGAYGTIIKV

SEQ ID NO: 2381075 - protein, 19 aa, Entamoeba dispar
DSFELFTILAKQDIPQKEF

SEQ ID NO: 2381076 - protein, 23 aa, Entamoeba dispar
DSGCSKCEIGFMFGKTSDNKITC

SEQ ID NO: 2381077 - protein, 20 aa, Entamoeba dispar
DSIAGFWKYKHQPFVLMDIF

SEQ ID NO: 2381078 - protein, 29 aa, Entamoeba dispar
DSICRYQKCYLFYTIIGLFVLFAYTGNIL

SEQ ID NO: 2381079 - protein, 22 aa, Entamoeba dispar
DSKCSHCSFGYKLNENKEGCIY

SEQ ID NO: 2381080 - protein, 23 aa, Entamoeba dispar
DSKYRIAVDVSFDNRIRFIQEVD

SEQ ID NO: 2381081 - protein, 17 aa, Entamoeba dispar
DSLELLTSYILIEVDDR

SEQ ID NO: 2381082 - protein, 17 aa, Entamoeba dispar
DSLEVGNEIIFKIKSVS

SEQ ID NO: 2381083 - protein, 18 aa, Entamoeba dispar
DSLLSLTTFELLKNYSLK

SEQ ID NO: 2381084 - protein, 18 aa, Entamoeba dispar
DSLQLHCCCVSVKERHNW

SEQ ID NO: 2381085 - protein, 32 aa, Entamoeba dispar
DSLRMRIFGFHWKTSFPLIFFFTLVFMSFTIF

SEQ ID NO: 2381086 - protein, 20 aa, Entamoeba dispar
DSNECLICIDKYFPTSFNCT

SEQ ID NO: 2381087 - protein, 18 aa, Entamoeba dispar
DSNGICYFIIPSKSKNQI

SEQ ID NO: 2381088 - protein, 17 aa, Entamoeba dispar
DSNRLTNRISWHQCKNT

SEQ ID NO: 2381089 - protein, 19 aa, Entamoeba dispar
DSNSISMIIGITISSIIIF

SEQ ID NO: 2381090 - protein, 24 aa, Entamoeba dispar
DSNYRKEFYFAIQHDSEVIEWSSL

SEQ ID NO: 2381091 - protein, 19 aa, Entamoeba dispar
DSPETWNFLVLNKDDKKHY

SEQ ID NO: 2381092 - protein, 17 aa, Entamoeba dispar
DSQIKRRSFADIHRCVN

SEQ ID NO: 2381093 - protein, 23 aa, Entamoeba dispar
DSRGTLKIKVVNLVSLVPTMKEI

SEQ ID NO: 2381094 - protein, 22 aa, Entamoeba dispar
DSRMAVVRMTLILKVMGSNFTK

SEQ ID NO: 2381095 - protein, 19 aa, Entamoeba dispar
DSRYFFLVMVICLIVLVLQ

SEQ ID NO: 2381096 - protein, 18 aa, Entamoeba dispar
DSSCIAYVCLTRLMEAYF

SEQ ID NO: 2381097 - protein, 24 aa, Entamoeba dispar
DSSGDSFIDIIISFIVTIPLVVGL

SEQ ID NO: 2381098 - protein, 19 aa, Entamoeba dispar
DSSILGLTVLCWGNSVGDF

SEQ ID NO: 2381099 - protein, 23 aa, Entamoeba dispar
DSSKHCKTCFAADKCISCEDNYY

SEQ ID NO: 2381100 - protein, 21 aa, Entamoeba dispar
DSSYYILIKLFRMGTKKQTKS

SEQ ID NO: 2381101 - protein, 22 aa, Entamoeba dispar
DSTSAFCLLAAIATKRDTRYLC

SEQ ID NO: 2381102 - protein, 26 aa, Entamoeba dispar
DSVAFCSNCKCEYGYSYDKEKNVCNP

SEQ ID NO: 2381103 - protein, 24 aa, Entamoeba dispar
DSVKGCGSAARLIFNDKRKTSFYV

SEQ ID NO: 2381104 - protein, 19 aa, Entamoeba dispar
DSYHLYNGICIKIEDSNNE

SEQ ID NO: 2381105 - protein, 19 aa, Entamoeba dispar
DSYIFRLNNFGVYEYLPTI

SEQ ID NO: 2381106 - protein, 24 aa, Entamoeba dispar
DSYNCLQCKKGYYLDDRSCKSCNI

SEQ ID NO: 2381107 - protein, 28 aa, Entamoeba dispar
DSYNPIWKGSDCSFLIQRNNQIQSIDQD

SEQ ID NO: 2381108 - protein, 19 aa, Entamoeba dispar
DTFEVHFNFSIFSSKPIMG

SEQ ID NO: 2381109 - protein, 24 aa, Entamoeba dispar
DTFKNLRMGVHFLMKTLNENETSY

SEQ ID NO: 2381110 - protein, 19 aa, Entamoeba dispar
DTFLAYFLPMFLTVIVYLF

SEQ ID NO: 2381111 - protein, 17 aa, Entamoeba dispar
DTFQEWTTIVVLVVALS

SEQ ID NO: 2381112 - protein, 19 aa, Entamoeba dispar
DTFTIWISLEESFLGTQKT

SEQ ID NO: 2381113 - protein, 26 aa, Entamoeba dispar
DTIAIKLKGSFGYKNKMVLNDINLEI

SEQ ID NO: 2381114 - protein, 17 aa, Entamoeba dispar
DTIILSRPQLPSHFDSI

SEQ ID NO: 2381115 - protein, 20 aa, Entamoeba dispar
DTILLLAFELIEKCDNELLK

SEQ ID NO: 2381116 - protein, 23 aa, Entamoeba dispar
DTIRIMKNNHRFTSILSEKLNKQ

SEQ ID NO: 2381117 - protein, 22 aa, Entamoeba dispar
DTKEIKKILIIGVSEVLLLIIV

SEQ ID NO: 2381118 - protein, 24 aa, Entamoeba dispar
DTLGRRPLLLFGCLGSIMCTLSLG

SEQ ID NO: 2381119 - protein, 23 aa, Entamoeba dispar
DTLIPCDYLSFGPGISVKTTNVG

SEQ ID NO: 2381120 - protein, 17 aa, Entamoeba dispar
DTPIKWKEVDVRTTEMT

SEQ ID NO: 2381121 - protein, 19 aa, Entamoeba dispar
DTPKFSYFNSLTITDVKLN

SEQ ID NO: 2381122 - protein, 21 aa, Entamoeba dispar
DTPKNWKWRMFNIVMLGIGFL

SEQ ID NO: 2381123 - protein, 18 aa, Entamoeba dispar
DTPSCFGTAYGVVGRKLV

SEQ ID NO: 2381124 - protein, 21 aa, Entamoeba dispar
DTSCLYCKWTDPNDDVYETFI

SEQ ID NO: 2381125 - protein, 19 aa, Entamoeba dispar
DTSLEVIKVLSAQEIAESM

SEQ ID NO: 2381126 - protein, 24 aa, Entamoeba dispar
DTTKWKWGEYKQFHMIGYINDNSI

SEQ ID NO: 2381127 - protein, 25 aa, Entamoeba dispar
DTTSPFAEFDCNLYATNMESPLLVF

SEQ ID NO: 2381128 - protein, 24 aa, Entamoeba dispar
DTVIKRFIGCLIIYIPIPENSINT

SEQ ID NO: 2381129 - protein, 20 aa, Entamoeba dispar
DTVKEFSILKASSREIDTSA

SEQ ID NO: 2381130 - protein, 25 aa, Entamoeba dispar
DTVYRISKEEKFYCTLKSGVDSIIF

SEQ ID NO: 2381131 - protein, 23 aa, Entamoeba dispar
DVCGFLKRCIEIASEGFQAEDKV

SEQ ID NO: 2381132 - protein, 20 aa, Entamoeba dispar
DVDSILRFVCAGKRLEIPQE

SEQ ID NO: 2381133 - protein, 25 aa, Entamoeba dispar
DVDYELTRIVPLYLAVHIFAESPCK

SEQ ID NO: 2381134 - protein, 18 aa, Entamoeba dispar
DVFGCNALGIWLGSKTLQ

SEQ ID NO: 2381135 - protein, 17 aa, Entamoeba dispar
DVFKGIFTNYIFIGIEL

SEQ ID NO: 2381136 - protein, 27 aa, Entamoeba dispar
DVFLNDEFRYIFVYGTGGQETLSVGIV

SEQ ID NO: 2381137 - protein, 28 aa, Entamoeba dispar
DVFSYAICILEIWICESVYPEDEFHESN

SEQ ID NO: 2381138 - protein, 30 aa, Entamoeba dispar
DVINPPFKMSWRIAITFLVSLFDAITEDDK

SEQ ID NO: 2381139 - protein, 22 aa, Entamoeba dispar
DVISIILRKIFKEIEKNNIIIK

SEQ ID NO: 2381140 - protein, 22 aa, Entamoeba dispar
DVKGENLLIFSINPHSPVCAKL

SEQ ID NO: 2381141 - protein, 21 aa, Entamoeba dispar
DVKIFYCKYNDPLYIKIEKLE

SEQ ID NO: 2381142 - protein, 20 aa, Entamoeba dispar
DVLDSLLLSLNRFFLDYVTR

SEQ ID NO: 2381143 - protein, 24 aa, Entamoeba dispar
DVLLEAFFPFVMLVMNFEGKVALI

SEQ ID NO: 2381144 - protein, 20 aa, Entamoeba dispar
DVLLWAQNRIKNHFNTIEKC

SEQ ID NO: 2381145 - protein, 27 aa, Entamoeba dispar
DVNCKAMAILAFCNFFSVCDQDQFEKL

SEQ ID NO: 2381146 - protein, 25 aa, Entamoeba dispar
DVPRKYRYCFEIKTAAASSTHIDMD

SEQ ID NO: 2381147 - protein, 19 aa, Entamoeba dispar
DVQLLFIRVIQFIHLAMFL

SEQ ID NO: 2381148 - protein, 28 aa, Entamoeba dispar
DVSIKWQAAEIIAIIVTFGGIDIVRKAA

SEQ ID NO: 2381149 - protein, 19 aa, Entamoeba dispar
DVSLLWKGIIFEPRFGLTI

SEQ ID NO: 2381150 - protein, 24 aa, Entamoeba dispar
DVSSCFKKLLPIVFSEDCLTVSVM

SEQ ID NO: 2381151 - protein, 38 aa, Entamoeba dispar
DVYAFAIVSYEVFLRKIPYGNGCFVHSWDVSDFVSQGQ

SEQ ID NO: 2381152 - protein, 26 aa, Entamoeba dispar
DVYSFAICMLEVWISKDPYNSIKFPD

SEQ ID NO: 2381153 - protein, 26 aa, Entamoeba dispar
DWGRVPLESGITFLANVSNCYEILLV

SEQ ID NO: 2381154 - protein, 20 aa, Entamoeba dispar
DWIEGIAILLAVLGVSLGGS

SEQ ID NO: 2381155 - protein, 20 aa, Entamoeba dispar
DWIEGLAILAAVLVASLGSS

SEQ ID NO: 2381156 - protein, 20 aa, Entamoeba dispar
DWRTKIAIYGSFIINLCLCI

SEQ ID NO: 2381157 - protein, 25 aa, Entamoeba dispar
DWWLSLCKIGYMLSVSFFSFINCNT

SEQ ID NO: 2381158 - protein, 21 aa, Entamoeba dispar
DYAIKRTLAFLTTYQGNEEQM

SEQ ID NO: 2381159 - protein, 20 aa, Entamoeba dispar
DYEIKCNYQLWRLITPIFLH

SEQ ID NO: 2381160 - protein, 25 aa, Entamoeba dispar
DYGYVPRFVEIMKIHGNYEYQYFGY

SEQ ID NO: 2381161 - protein, 24 aa, Entamoeba dispar
DYIKRCLTLLIDLHPNFIIDEYLD

SEQ ID NO: 2381162 - protein, 25 aa, Entamoeba dispar
DYIKRCLTLLIDLHPNFIIDEYLDI

SEQ ID NO: 2381163 - protein, 23 aa, Entamoeba dispar
DYKKEHFIDFLGISYLTVGSVVL

SEQ ID NO: 2381164 - protein, 24 aa, Entamoeba dispar
DYLCECLFNLSLILKEHIGNPVVY

SEQ ID NO: 2381165 - protein, 23 aa, Entamoeba dispar
DYNGMVCVLDLDTGILLQKYEYP

SEQ ID NO: 2381166 - protein, 18 aa, Entamoeba dispar
DYSDCSSIPTALKMIRFH

SEQ ID NO: 2381167 - protein, 23 aa, Entamoeba dispar
DYSGSSYLLLLSMFVINIYLNYF

SEQ ID NO: 2381168 - protein, 28 aa, Entamoeba dispar
DYVKLPYKLKVRMLFDTARGMQFLHENR

SEQ ID NO: 2381169 - protein, 25 aa, Entamoeba dispar
DYVNETFPLIAHWRDSFNSKEQHSN

SEQ ID NO: 2381170 - protein, 24 aa, Entamoeba dispar
DYVSAPQLHMTWIAKLANEHRTKQ

SEQ ID NO: 2381171 - protein, 24 aa, Entamoeba dispar
DYVSAPQLHMTWIAKLAQQHRLKE

SEQ ID NO: 2381172 - protein, 23 aa, Entamoeba dispar
DYWILPETKIEFVGERRAWAEIN

SEQ ID NO: 2381173 - protein, 26 aa, Entamoeba dispar
DYYRYSPLLWYRLACSCIQYHYNYIK

SEQ ID NO: 2381174 - protein, 20 aa, Entamoeba dispar
EACKFAFEIGIKYTKHTIPI

SEQ ID NO: 2381175 - protein, 17 aa, Entamoeba dispar
EAFRETRRQVLINFFDM

SEQ ID NO: 2381176 - protein, 22 aa, Entamoeba dispar
EAIDKRGILSLEYPMQKEPIDY

SEQ ID NO: 2381177 - protein, 25 aa, Entamoeba dispar
EAIFDYELTCSKKIILLCNSPSELY

SEQ ID NO: 2381178 - protein, 21 aa, Entamoeba dispar
EAIFLACLNEFCDIQIHKPAK

SEQ ID NO: 2381179 - protein, 19 aa, Entamoeba dispar
EAIGTFFLNLTVMVCIHKT

SEQ ID NO: 2381180 - protein, 22 aa, Entamoeba dispar
EAINVEGSYYWYDNTHICTYET

SEQ ID NO: 2381181 - protein, 18 aa, Entamoeba dispar
EAISRVGTYIKRNDLLNG

SEQ ID NO: 2381182 - protein, 19 aa, Entamoeba dispar
EAITRLKVNPCYQELSLET

SEQ ID NO: 2381183 - protein, 17 aa, Entamoeba dispar
EAKERIRIEEVVKMLER

SEQ ID NO: 2381184 - protein, 21 aa, Entamoeba dispar
EAKERLRIEEVVKMLERIENK

SEQ ID NO: 2381185 - protein, 24 aa, Entamoeba dispar
EAKKCGICYEMVGPSGTLRFRIDS

SEQ ID NO: 2381186 - protein, 22 aa, Entamoeba dispar
EAKKRISPFRVLPLRKEAEKYI

SEQ ID NO: 2381187 - protein, 20 aa, Entamoeba dispar
EALASGFFVGPMLMEIAGKS

SEQ ID NO: 2381188 - protein, 28 aa, Entamoeba dispar
EALLRAMFDFTFYWYNFMPLSRGTAATG

SEQ ID NO: 2381189 - protein, 21 aa, Entamoeba dispar
EANVLKSFDFEGVLRFFSEMN

SEQ ID NO: 2381190 - protein, 19 aa, Entamoeba dispar
EAPITFLPTYKFEKGTNNY

SEQ ID NO: 2381191 - protein, 25 aa, Entamoeba dispar
EASNSVCLSCTFWYTPSNDGLSCEK

SEQ ID NO: 2381192 - protein, 20 aa, Entamoeba dispar
EAVKAQILIGAHLSRLHEEL

SEQ ID NO: 2381193 - protein, 18 aa, Entamoeba dispar
EAVKQGPVSLVLVLVQGQ

SEQ ID NO: 2381194 - protein, 22 aa, Entamoeba dispar
EAVVCLFVILTFYFLYKRKIWL

SEQ ID NO: 2381195 - protein, 19 aa, Entamoeba dispar
EAYNLFKRAHCDTLQKKIE

SEQ ID NO: 2381196 - protein, 24 aa, Entamoeba dispar
ECAQCSFSGCTSCNEGYYLHGVKC

SEQ ID NO: 2381197 - protein, 22 aa, Entamoeba dispar
ECASPMKLLEGKCVPSIDNCAR

SEQ ID NO: 2381198 - protein, 20 aa, Entamoeba dispar
ECCYSGTILYNLPKVTQIYS

SEQ ID NO: 2381199 - protein, 20 aa, Entamoeba dispar
ECDGGDGCFECECQNKWYKR

SEQ ID NO: 2381200 - protein, 21 aa, Entamoeba dispar
ECDGGEGCYECECQAGWFEAH

SEQ ID NO: 2381201 - protein, 27 aa, Entamoeba dispar
ECDGGNGCKDCLCSPHYLPYSIPRLSC

SEQ ID NO: 2381202 - protein, 26 aa, Entamoeba dispar
ECDNQIKYFYCEGVSHVEPQCLDNQE

SEQ ID NO: 2381203 - protein, 18 aa, Entamoeba dispar
ECFGSFILIFVLMLITYR

SEQ ID NO: 2381204 - protein, 19 aa, Entamoeba dispar
ECFNCLTHIIGIIFSLFQL

SEQ ID NO: 2381205 - protein, 17 aa, Entamoeba dispar
ECGCLQKKCNLCEDHLM

SEQ ID NO: 2381206 - protein, 19 aa, Entamoeba dispar
ECHFNCYLSSPSLVCRSLV

SEQ ID NO: 2381207 - protein, 23 aa, Entamoeba dispar
ECIGYETVCMMLFIFHNLSRVSR

SEQ ID NO: 2381208 - protein, 18 aa, Entamoeba dispar
ECIRCSSHNLLLSDLGEM

SEQ ID NO: 2381209 - protein, 21 aa, Entamoeba dispar
ECKNGIESVCFAKNESDTECT

SEQ ID NO: 2381210 - protein, 21 aa, Entamoeba dispar
ECKSSPVWWVIVLAIIGGIMF

SEQ ID NO: 2381211 - protein, 25 aa, Entamoeba dispar
ECKSSPVWWVIVLVIIGGIVLTVIT

SEQ ID NO: 2381212 - protein, 18 aa, Entamoeba dispar
ECLELTGPSQTPFNCIVV

SEQ ID NO: 2381213 - protein, 20 aa, Entamoeba dispar
ECLEQVVGCTDYVYAKFDSC

SEQ ID NO: 2381214 - protein, 20 aa, Entamoeba dispar
ECLKCGEGNPIEGDCPERPI

SEQ ID NO: 2381215 - protein, 24 aa, Entamoeba dispar
ECMCSCCSIMLSAILLLQQYLFGM

SEQ ID NO: 2381216 - protein, 19 aa, Entamoeba dispar
ECNEGFPICYNCKNNYKLD

SEQ ID NO: 2381217 - protein, 17 aa, Entamoeba dispar
ECNESCELCYSDNSMCP

SEQ ID NO: 2381218 - protein, 27 aa, Entamoeba dispar
ECNLMERIRCPYVLSFVGSVQMPDQLC

SEQ ID NO: 2381219 - protein, 21 aa, Entamoeba dispar
ECPKDPCGTNEAGVFSQVTNG

SEQ ID NO: 2381220 - protein, 21 aa, Entamoeba dispar
ECPLGCCLFIRVIPVEDLIIL

SEQ ID NO: 2381221 - protein, 23 aa, Entamoeba dispar
ECPYKGLIQRCWNQVPQERPQFK

SEQ ID NO: 2381222 - protein, 24 aa, Entamoeba dispar
ECQEYILKHCIDWLQVINSNQEYL

SEQ ID NO: 2381223 - protein, 17 aa, Entamoeba dispar
ECSDSYYLTTMGKCTVN

SEQ ID NO: 2381224 - protein, 18 aa, Entamoeba dispar
ECSKNFYKNITYGCSPIS

SEQ ID NO: 2381225 - protein, 23 aa, Entamoeba dispar
ECSSAFWKFMDLIASKKEQLNWN

SEQ ID NO: 2381226 - protein, 22 aa, Entamoeba dispar
ECSTCKIAHCGQCPDIEKCEKC

SEQ ID NO: 2381227 - protein, 17 aa, Entamoeba dispar
ECTEGSYQFEGRCVFSG

SEQ ID NO: 2381228 - protein, 31 aa, Entamoeba dispar
ECTIISSLLLNFTEGVSFYFEQEPNSQSTSE

SEQ ID NO: 2381229 - protein, 25 aa, Entamoeba dispar
ECTKCTATECLSCSNSYIINSNGIC

SEQ ID NO: 2381230 - protein, 18 aa, Entamoeba dispar
ECTPEGMFNKGCEPNCGS

SEQ ID NO: 2381231 - protein, 20 aa, Entamoeba dispar
ECTTRYRLSQGLCIGCPTES

SEQ ID NO: 2381232 - protein, 17 aa, Entamoeba dispar
ECVNGYFLNEGCLSCSA

SEQ ID NO: 2381233 - protein, 21 aa, Entamoeba dispar
ECVSCSFSTGYCLDSSECVLQ

SEQ ID NO: 2381234 - protein, 24 aa, Entamoeba dispar
ECYIKRGQMELAFKTYKIAADNNN

SEQ ID NO: 2381235 - protein, 26 aa, Entamoeba dispar
EDAQEIIDRINLFPGVTNGLKKSFLV

SEQ ID NO: 2381236 - protein, 22 aa, Entamoeba dispar
EDDAWVLYRYCIRRQRRWYTKP

SEQ ID NO: 2381237 - protein, 20 aa, Entamoeba dispar
EDFKLYFNLINKFNSSQIPL

SEQ ID NO: 2381238 - protein, 24 aa, Entamoeba dispar
EDGECKLCSLVLSNCKRCSDATEC

SEQ ID NO: 2381239 - protein, 19 aa, Entamoeba dispar
EDIESFYFTSWQPSKRRRW

SEQ ID NO: 2381240 - protein, 19 aa, Entamoeba dispar
EDIKYAFNVESYKKEMGDN

SEQ ID NO: 2381241 - protein, 24 aa, Entamoeba dispar
EDILSVIYLCYAYVSWSSERSLSR

SEQ ID NO: 2381242 - protein, 22 aa, Entamoeba dispar
EDIQKITIIFKIGMEEKIEKEY

SEQ ID NO: 2381243 - protein, 20 aa, Entamoeba dispar
EDIRRWIADRGFNNAKYTRV

SEQ ID NO: 2381244 - protein, 37 aa, Entamoeba dispar
EDITKYCSVKGWKLSSLEIKLIMTLRIDFSKQKIRSL

SEQ ID NO: 2381245 - protein, 19 aa, Entamoeba dispar
EDKKCYKISASTSQKYVYV

SEQ ID NO: 2381246 - protein, 26 aa, Entamoeba dispar
EDKYCAETCKCYFGFTPITINGITKC

SEQ ID NO: 2381247 - protein, 18 aa, Entamoeba dispar
EDLKYCNYDFTKLNVNDY

SEQ ID NO: 2381248 - protein, 25 aa, Entamoeba dispar
EDLRKRKKLPIGFKYLQMVQQEHFQ

SEQ ID NO: 2381249 - protein, 23 aa, Entamoeba dispar
EDLRTRHCFGGFLTIICVVIIII

SEQ ID NO: 2381250 - protein, 24 aa, Entamoeba dispar
EDLVRDGCLIKRCNKTSKTTYWEN

SEQ ID NO: 2381251 - protein, 23 aa, Entamoeba dispar
EDLWCFTPGLFPLIRSGATDIRT

SEQ ID NO: 2381252 - protein, 17 aa, Entamoeba dispar
EDNIYCSDDLIITTENE

SEQ ID NO: 2381253 - protein, 23 aa, Entamoeba dispar
EDQFDMFHRCFSLILSALQQLFI

SEQ ID NO: 2381254 - protein, 25 aa, Entamoeba dispar
EDTKKEGCIICRSCEDSENDPLGFL

SEQ ID NO: 2381255 - protein, 18 aa, Entamoeba dispar
EDVMKLYDGYGFLEDNEK

SEQ ID NO: 2381256 - protein, 25 aa, Entamoeba dispar
EDVNYASAMALIFMGKYEDSLKVVD

SEQ ID NO: 2381257 - protein, 23 aa, Entamoeba dispar
EDYCGFHIWPYSYIERNQKYRGF

SEQ ID NO: 2381258 - protein, 31 aa, Entamoeba dispar
EDYVKLPYRLKIRMLFDTARGMQFLHENRIM

SEQ ID NO: 2381259 - protein, 20 aa, Entamoeba dispar
EEAFKLLLFVFEQLDIQIRP

SEQ ID NO: 2381260 - protein, 22 aa, Entamoeba dispar
EECDGGEGCIECECQPGWYSQN

SEQ ID NO: 2381261 - protein, 23 aa, Entamoeba dispar
EECDGGMGCEYCFCVNGTQPYFI

SEQ ID NO: 2381262 - protein, 29 aa, Entamoeba dispar
EECIFKWLIQQPRCPMCRDLVVQPQTFVG

SEQ ID NO: 2381263 - protein, 19 aa, Entamoeba dispar
EECIKFYKSCNVLLQTICM

SEQ ID NO: 2381264 - protein, 17 aa, Entamoeba dispar
EECKEPFTIINTIISIL

SEQ ID NO: 2381265 - protein, 23 aa, Entamoeba dispar
EEEFKNMIKYGIVYHHSGITIEE

SEQ ID NO: 2381266 - protein, 26 aa, Entamoeba dispar
EEEPFCDFQDLFSIKSHVLAGYRLPF

SEQ ID NO: 2381267 - protein, 24 aa, Entamoeba dispar
EEGIKEIIETIMIIGIQEEKRNII

SEQ ID NO: 2381268 - protein, 20 aa, Entamoeba dispar
EEGISFPMFFVDSQPDEGED

SEQ ID NO: 2381269 - protein, 20 aa, Entamoeba dispar
EEGKEALIYIHGLNHTLVDA

SEQ ID NO: 2381270 - protein, 26 aa, Entamoeba dispar
EEGKNVLKLTSSFIRNNLKTSSDNKK

SEQ ID NO: 2381271 - protein, 24 aa, Entamoeba dispar
EEGTKTMTVWSILILINIIVFLLS

SEQ ID NO: 2381272 - protein, 24 aa, Entamoeba dispar
EEICKSPEIYKDFNCFAEDRQGWK

SEQ ID NO: 2381273 - protein, 29 aa, Entamoeba dispar
EEIDCVICNCSLFCCTPSLAAMLMNHYKM

SEQ ID NO: 2381274 - protein, 19 aa, Entamoeba dispar
EEIELFKGEIKTLIETIKN

SEQ ID NO: 2381275 - protein, 21 aa, Entamoeba dispar
EEIKKLCIPFLKYITNAETER

SEQ ID NO: 2381276 - protein, 17 aa, Entamoeba dispar
EEILNWARKTSFLECYF

SEQ ID NO: 2381277 - protein, 20 aa, Entamoeba dispar
EEIPKMNALEIKKTEQKPIE

SEQ ID NO: 2381278 - protein, 22 aa, Entamoeba dispar
EEIRKTKIIIVGSLALIILGIA

SEQ ID NO: 2381279 - protein, 25 aa, Entamoeba dispar
EEIRKTKIIIVGSLALIILGIAMLL

SEQ ID NO: 2381280 - protein, 24 aa, Entamoeba dispar
EEKGILERFIHLFDMQQIQLCLNG

SEQ ID NO: 2381281 - protein, 27 aa, Entamoeba dispar
EEKILRAMFSFTFFWYNFMPLTRGTAA

SEQ ID NO: 2381282 - protein, 25 aa, Entamoeba dispar
EEKMKRVCIIPIWLSHEDYPYLLSS

SEQ ID NO: 2381283 - protein, 24 aa, Entamoeba dispar
EEKSKWWISLIILGVLLILFIITI

SEQ ID NO: 2381284 - protein, 21 aa, Entamoeba dispar
EEKSRFIGLQLGETVLNKPPN

SEQ ID NO: 2381285 - protein, 24 aa, Entamoeba dispar
EELERRFGEEMAHDKSLKKELIDS

SEQ ID NO: 2381286 - protein, 17 aa, Entamoeba dispar
EELEVEQPFGFPEYVAK

SEQ ID NO: 2381287 - protein, 43 aa, Entamoeba dispar
EELFKERISIIDWKCEIDPFFTRKKILCLRGIKKYKTSNGPIE

SEQ ID NO: 2381288 - protein, 25 aa, Entamoeba dispar
EELKELFGNVVDVCFAYESITERNE

SEQ ID NO: 2381289 - protein, 25 aa, Entamoeba dispar
EELKKTCPEFAALVSKTGFDIEEGN

SEQ ID NO: 2381290 - protein, 17 aa, Entamoeba dispar
EELKLEPIVNTFNKEEL

SEQ ID NO: 2381291 - protein, 25 aa, Entamoeba dispar
EELPYSSYCIYFFNNFAYGMPGIEF

SEQ ID NO: 2381292 - protein, 29 aa, Entamoeba dispar
EEMADKAIWRIIFIISPITLILLILGIVG

SEQ ID NO: 2381293 - protein, 25 aa, Entamoeba dispar
EEMKEFKIKVVYSVLNKLSELVEKN

SEQ ID NO: 2381294 - protein, 23 aa, Entamoeba dispar
EEMKRDLKDALSYLKYLNDEYSK

SEQ ID NO: 2381295 - protein, 20 aa, Entamoeba dispar
EEMSHTVLLMAKKAGQTRVN

SEQ ID NO: 2381296 - protein, 21 aa, Entamoeba dispar
EEPFQKFIYVIAIQASRYLPI

SEQ ID NO: 2381297 - protein, 19 aa, Entamoeba dispar
EEPMMIFKHCEWKEQERKL

SEQ ID NO: 2381298 - protein, 25 aa, Entamoeba dispar
EEPYKEFKSLFDIKNFVCNGKRLPL

SEQ ID NO: 2381299 - protein, 38 aa, Entamoeba dispar
EEPYPILQWVLRSCVLIAYFFCFILYFFMNILHHSSSI

SEQ ID NO: 2381300 - protein, 25 aa, Entamoeba dispar
EEQKKEGYPWCDIDKNMSWCDINDE

SEQ ID NO: 2381301 - protein, 23 aa, Entamoeba dispar
EERSCIAEMYFSYVNYVCIEYKR

SEQ ID NO: 2381302 - protein, 26 aa, Entamoeba dispar
EESIKCILKLCIEDIYLIKIKIEEED

SEQ ID NO: 2381303 - protein, 22 aa, Entamoeba dispar
EETELPNTFILELPNIPIIASN

SEQ ID NO: 2381304 - protein, 20 aa, Entamoeba dispar
EETRECIECEKGYYLNSNKE

SEQ ID NO: 2381305 - protein, 22 aa, Entamoeba dispar
EETRECIECEYGYYLNSNKECQ

SEQ ID NO: 2381306 - protein, 39 aa, Entamoeba dispar
EETSCCCLLCKMKKVVLRKSYIPWISLVRIIYLSLMSLY

SEQ ID NO: 2381307 - protein, 20 aa, Entamoeba dispar
EEVAELKSQFNKNQRVKKES

SEQ ID NO: 2381308 - protein, 19 aa, Entamoeba dispar
EEVIPCIQFEETFIVMFSK

SEQ ID NO: 2381309 - protein, 20 aa, Entamoeba dispar
EEWKVFKKELIYLIEFNDIF

SEQ ID NO: 2381310 - protein, 17 aa, Entamoeba dispar
EEWSESDSEIFLSEVQE

SEQ ID NO: 2381311 - protein, 20 aa, Entamoeba dispar
EEYCPCNDCELIVEESQPVI

SEQ ID NO: 2381312 - protein, 27 aa, Entamoeba dispar
EEYSGCLQLRLTSLQIINTILTKDNTS

SEQ ID NO: 2381313 - protein, 23 aa, Entamoeba dispar
EEYVSSILQYYGIIYLKNQVTQI

SEQ ID NO: 2381314 - protein, 18 aa, Entamoeba dispar
EFCVFELEVGTYSGELEC

SEQ ID NO: 2381315 - protein, 17 aa, Entamoeba dispar
EFDEWRYYFDVTVNSVI

SEQ ID NO: 2381316 - protein, 18 aa, Entamoeba dispar
EFDGFLRICFLRKHKTLS

SEQ ID NO: 2381317 - protein, 22 aa, Entamoeba dispar
EFDPYFNFRATKYLVEHGPTAF

SEQ ID NO: 2381318 - protein, 20 aa, Entamoeba dispar
EFDYTLLLCPLTQSKTKSCQ

SEQ ID NO: 2381319 - protein, 24 aa, Entamoeba dispar
EFEKEVMIEYIIQFYGAVFIPNKI

SEQ ID NO: 2381320 - protein, 24 aa, Entamoeba dispar
EFEQEMWLHLCITPHTREGLLKFI

SEQ ID NO: 2381321 - protein, 22 aa, Entamoeba dispar
EFEVKMYHSLVCKYIESKQTSS

SEQ ID NO: 2381322 - protein, 18 aa, Entamoeba dispar
EFEYMKFFGNFKNLYISA

SEQ ID NO: 2381323 - protein, 21 aa, Entamoeba dispar
EFGASYCRATKFIIKGKKTIK

SEQ ID NO: 2381324 - protein, 26 aa, Entamoeba dispar
EFIEGFICCLFMIVAGILLLIRKLVQ

SEQ ID NO: 2381325 - protein, 24 aa, Entamoeba dispar
EFIFRKKSTVDWIGHVSFKHLITF

SEQ ID NO: 2381326 - protein, 24 aa, Entamoeba dispar
EFILGKPCYLMYMQLIGYLLLIGM

SEQ ID NO: 2381327 - protein, 26 aa, Entamoeba dispar
EFIMFGYLILCFIIKLVMIALAIIFS

SEQ ID NO: 2381328 - protein, 24 aa, Entamoeba dispar
EFIVNCYLLLSWIYECIVNLHTQR

SEQ ID NO: 2381329 - protein, 26 aa, Entamoeba dispar
EFLKSVKWYYCLGITLCDITATFCLV

SEQ ID NO: 2381330 - protein, 24 aa, Entamoeba dispar
EFLPICIASLIVLMSYNIYIVAIN

SEQ ID NO: 2381331 - protein, 25 aa, Entamoeba dispar
EFLSFKFFFIESVINIALYLFGNKL

SEQ ID NO: 2381332 - protein, 20 aa, Entamoeba dispar
EFNDRITLAVCPRGRDYTAP

SEQ ID NO: 2381333 - protein, 19 aa, Entamoeba dispar
EFNECKPAILVELKEQLDS

SEQ ID NO: 2381334 - protein, 20 aa, Entamoeba dispar
EFNEKIVFVMYYIPSKEQKD

SEQ ID NO: 2381335 - protein, 24 aa, Entamoeba dispar
EFQFTSDCKIIFQTADMFTLADIN

SEQ ID NO: 2381336 - protein, 20 aa, Entamoeba dispar
EFSKSKFFIVKSVTSELLKF

SEQ ID NO: 2381337 - protein, 21 aa, Entamoeba dispar
EFSNQFKLPFCSISVIHSKNK

SEQ ID NO: 2381338 - protein, 25 aa, Entamoeba dispar
EFSSIEIINGLLLIGSNENKSNNIS

SEQ ID NO: 2381339 - protein, 30 aa, Entamoeba dispar
EFTSFEVFWRITLLTCMCCCTLFFMYILRG

SEQ ID NO: 2381340 - protein, 24 aa, Entamoeba dispar
EFVVPAKERKKCNFVITVYIREDD

SEQ ID NO: 2381341 - protein, 19 aa, Entamoeba dispar
EFYCAATRCIAIMSKSERV

SEQ ID NO: 2381342 - protein, 25 aa, Entamoeba dispar
EFYPSSLKRLYCQREQLPHCLNVEE

SEQ ID NO: 2381343 - protein, 17 aa, Entamoeba dispar
EGCRVIGDFLLNKIGGN

SEQ ID NO: 2381344 - protein, 18 aa, Entamoeba dispar
EGCYDCVDGFVLEEKKCI

SEQ ID NO: 2381345 - protein, 25 aa, Entamoeba dispar
EGDESWKIIQLLKIDFIRDLHQFVY

SEQ ID NO: 2381346 - protein, 25 aa, Entamoeba dispar
EGECKKGQVEACLFSAEKGSTISIS

SEQ ID NO: 2381347 - protein, 27 aa, Entamoeba dispar
EGECLSCSLKACKLCNSMTGECSSCLP

SEQ ID NO: 2381348 - protein, 17 aa, Entamoeba dispar
EGEECDGGDGCVECECQ

SEQ ID NO: 2381349 - protein, 24 aa, Entamoeba dispar
EGEWKWKPKRNYNWDVTKDDQEYR

SEQ ID NO: 2381350 - protein, 28 aa, Entamoeba dispar
EGFPSSHAQFWCCFLVLFCYYTNQQSKL

SEQ ID NO: 2381351 - protein, 29 aa, Entamoeba dispar
EGFVKLPYKLKIKMLFDTARGMEFLHENN

SEQ ID NO: 2381352 - protein, 17 aa, Entamoeba dispar
EGGHYYLFVGMKRGVDC

SEQ ID NO: 2381353 - protein, 24 aa, Entamoeba dispar
EGGKKMKCNLCEYLSDVDDNYFSP

SEQ ID NO: 2381354 - protein, 25 aa, Entamoeba dispar
EGGYACEFEIFITIKCTTKIKEQIM

SEQ ID NO: 2381355 - protein, 22 aa, Entamoeba dispar
EGHLWTAKIFREHITALTNQLQ

SEQ ID NO: 2381356 - protein, 19 aa, Entamoeba dispar
EGIEIKTIIYKKGDDLRKD

SEQ ID NO: 2381357 - protein, 20 aa, Entamoeba dispar
EGIETLSSIIIRTETEISTR

SEQ ID NO: 2381358 - protein, 20 aa, Entamoeba dispar
EGILKLKSDVFSFAICMLEI

SEQ ID NO: 2381359 - protein, 23 aa, Entamoeba dispar
EGINRPTECIDIFDHENSPYGHR

SEQ ID NO: 2381360 - protein, 19 aa, Entamoeba dispar
EGITRSPIFIHFDQTLLGL

SEQ ID NO: 2381361 - protein, 17 aa, Entamoeba dispar
EGKCESCEGIVKHCLKC

SEQ ID NO: 2381362 - protein, 19 aa, Entamoeba dispar
EGKGVICFCSTKKGCEKMG

SEQ ID NO: 2381363 - protein, 21 aa, Entamoeba dispar
EGKHADGIALWFTQSPLKTGK

SEQ ID NO: 2381364 - protein, 20 aa, Entamoeba dispar
EGKRYIPLESLHNYVVFNPP

SEQ ID NO: 2381365 - protein, 21 aa, Entamoeba dispar
EGKSFIPSLIGWKIHQYVVWF

SEQ ID NO: 2381366 - protein, 19 aa, Entamoeba dispar
EGKTQWYAYIIRYLIVFFP

SEQ ID NO: 2381367 - protein, 22 aa, Entamoeba dispar
EGKTVLFMWDLLKGLDNTTVIA

SEQ ID NO: 2381368 - protein, 26 aa, Entamoeba dispar
EGKVGVKIGRELLKCVTRALTQNMNI

SEQ ID NO: 2381369 - protein, 21 aa, Entamoeba dispar
EGLKKTVEWYSKHRNNWERID

SEQ ID NO: 2381370 - protein, 28 aa, Entamoeba dispar
EGLKTKYNCISHIWDIHLRYLNGSKESF

SEQ ID NO: 2381371 - protein, 19 aa, Entamoeba dispar
EGNCCGWKTLKIEGCQAKD

SEQ ID NO: 2381372 - protein, 28 aa, Entamoeba dispar
EGNGKEIFSKWGIQNIIGFNDNDNIFRI

SEQ ID NO: 2381373 - protein, 20 aa, Entamoeba dispar
EGQYLMKYICSLYNVGTQRG

SEQ ID NO: 2381374 - protein, 20 aa, Entamoeba dispar
EGRSFGIVYIGEFRGNQVAI

SEQ ID NO: 2381375 - protein, 18 aa, Entamoeba dispar
EGSCLSCNCDSCNSTTGV

SEQ ID NO: 2381376 - protein, 20 aa, Entamoeba dispar
EGSFGIVFKGKYRGTTVVIK

SEQ ID NO: 2381377 - protein, 20 aa, Entamoeba dispar
EGSFGIVYEGIFRGRRVAIK

SEQ ID NO: 2381378 - protein, 22 aa, Entamoeba dispar
EGSFGIVYKGIFRGESVAIKTL

SEQ ID NO: 2381379 - protein, 25 aa, Entamoeba dispar
EGSSFLKKWSVVKIKTSVSPKDFII

SEQ ID NO: 2381380 - protein, 24 aa, Entamoeba dispar
EGSSQCFYCPDGTYYEQGHCYNCP

SEQ ID NO: 2381381 - protein, 25 aa, Entamoeba dispar
EGTCSSIRGIGCKFGPDIVNRFLSD

SEQ ID NO: 2381382 - protein, 23 aa, Entamoeba dispar
EGTFGIVYKGHWRNLDVAVKCVK

SEQ ID NO: 2381383 - protein, 24 aa, Entamoeba dispar
EGTFGVVYKGIWRSVDVAVKQLKT

SEQ ID NO: 2381384 - protein, 17 aa, Entamoeba dispar
EGTVIFKTIPKTLHAKV

SEQ ID NO: 2381385 - protein, 25 aa, Entamoeba dispar
EGTYGIVYKAEWRKVDVAVKIMKTD

SEQ ID NO: 2381386 - protein, 18 aa, Entamoeba dispar
EGVCKTCDILNCVTCSRS

SEQ ID NO: 2381387 - protein, 19 aa, Entamoeba dispar
EGVFLEFPDMAKVPVTLST

SEQ ID NO: 2381388 - protein, 17 aa, Entamoeba dispar
EGVLIICGTGINKAPAI

SEQ ID NO: 2381389 - protein, 39 aa, Entamoeba dispar
EGVLLNCFLMILPVLKPHRRLAIALAIEYLKKMNSCISS

SEQ ID NO: 2381390 - protein, 18 aa, Entamoeba dispar
EGVMYQCGAISTMVLSVV

SEQ ID NO: 2381391 - protein, 26 aa, Entamoeba dispar
EGWLKKKGYDFHTWKKRYFIIKNEFI

SEQ ID NO: 2381392 - protein, 20 aa, Entamoeba dispar
EGYGGDNCVLKCWYNNLWQP

SEQ ID NO: 2381393 - protein, 19 aa, Entamoeba dispar
EGYLKDDHCELCEDEYRIY

SEQ ID NO: 2381394 - protein, 24 aa, Entamoeba dispar
EGYLRSCRDGVGSIVILNPSKTYS

SEQ ID NO: 2381395 - protein, 24 aa, Entamoeba dispar
EHCRREMLAAIDLRGYSVLHYAVF

SEQ ID NO: 2381396 - protein, 25 aa, Entamoeba dispar
EHCTSIQCIKCIKGYVLNINDKQKC

SEQ ID NO: 2381397 - protein, 18 aa, Entamoeba dispar
EHEELTLYLSGFAMTLFT

SEQ ID NO: 2381398 - protein, 22 aa, Entamoeba dispar
EHFFHGLLIRQYIKLIVKDIQE

SEQ ID NO: 2381399 - protein, 25 aa, Entamoeba dispar
EHIFPKLGDKFIFYKSYWEPGVREF

SEQ ID NO: 2381400 - protein, 18 aa, Entamoeba dispar
EHKEALKIEDWEIQQKGL

SEQ ID NO: 2381401 - protein, 18 aa, Entamoeba dispar
EHLLRLRAAYHEGITYDS

SEQ ID NO: 2381402 - protein, 24 aa, Entamoeba dispar
EHLNEFRIQLDMDRRMYSISKKSK

SEQ ID NO: 2381403 - protein, 21 aa, Entamoeba dispar
EHPHPVYLYLLKKGFKDRPLV

SEQ ID NO: 2381404 - protein, 24 aa, Entamoeba dispar
EHQLELWKNYLIYFPSNMEIDIGL

SEQ ID NO: 2381405 - protein, 22 aa, Entamoeba dispar
EHRKMFSSLFLKFTSNPINIYI

SEQ ID NO: 2381406 - protein, 22 aa, Entamoeba dispar
EHTGALIPFQFFIEMVEGISEA

SEQ ID NO: 2381407 - protein, 28 aa, Entamoeba dispar
EHYVVLPLFALDLLFMYLKEVVGHCLSV

SEQ ID NO: 2381408 - protein, 29 aa, Entamoeba dispar
EIAEKHFPRLFSWRSFHSYIKELSIDEQE

SEQ ID NO: 2381409 - protein, 19 aa, Entamoeba dispar
EIAFKGYCNDVLLTYNNLH

SEQ ID NO: 2381410 - protein, 22 aa, Entamoeba dispar
EIATCKFSDLFIEDDYLTKCIH

SEQ ID NO: 2381411 - protein, 20 aa, Entamoeba dispar
EICCICGDQLGFFSKKCELC

SEQ ID NO: 2381412 - protein, 17 aa, Entamoeba dispar
EICHHFDMILSMLESNG

SEQ ID NO: 2381413 - protein, 33 aa, Entamoeba dispar
EICRYQKCYLYYLKIGLLILLSYAGNTFLPCDF

SEQ ID NO: 2381414 - protein, 20 aa, Entamoeba dispar
EICSCIWYIASYIPYAQTCL

SEQ ID NO: 2381415 - protein, 23 aa, Entamoeba dispar
EIDKSFFRFFFPIAPSYLHSSFL

SEQ ID NO: 2381416 - protein, 19 aa, Entamoeba dispar
EIEELKKRKGNEMRNEIQP

SEQ ID NO: 2381417 - protein, 18 aa, Entamoeba dispar
EIEGIIGVHELEKSNYLI

SEQ ID NO: 2381418 - protein, 27 aa, Entamoeba dispar
EIEGSRDWFVKRLVKVVDYCATSGRIE

SEQ ID NO: 2381419 - protein, 26 aa, Entamoeba dispar
EIEKNCKFKEERHCIYGMDGDLIILT

SEQ ID NO: 2381420 - protein, 17 aa, Entamoeba dispar
EIERRLDKEIAQEMKRQ

SEQ ID NO: 2381421 - protein, 22 aa, Entamoeba dispar
EIESLLKWARKLSFIDVDKVVK

SEQ ID NO: 2381422 - protein, 19 aa, Entamoeba dispar
EIESTLKLLSSKQELSQLF

SEQ ID NO: 2381423 - protein, 25 aa, Entamoeba dispar
EIETMKMIAKRGIKIKENIHINGID

SEQ ID NO: 2381424 - protein, 19 aa, Entamoeba dispar
EIFALCVCDDTFPMRESFV

SEQ ID NO: 2381425 - protein, 21 aa, Entamoeba dispar
EIFHRYIKYCIISHLDCLYNF

SEQ ID NO: 2381426 - protein, 21 aa, Entamoeba dispar
EIFNKMILYYIPQCWMEYRII

SEQ ID NO: 2381427 - protein, 17 aa, Entamoeba dispar
EIGEIYLTTSFMDVDII

SEQ ID NO: 2381428 - protein, 34 aa, Entamoeba dispar
EIGNKFFTGCGFQLLEIIRKGYQFHIRMNKGVVG

SEQ ID NO: 2381429 - protein, 30 aa, Entamoeba dispar
EIGTALGGQEQWKGLAIFVDTFQNSYTSTP

SEQ ID NO: 2381430 - protein, 23 aa, Entamoeba dispar
EIHQRIKAILSILLNFIENNYLN

SEQ ID NO: 2381431 - protein, 24 aa, Entamoeba dispar
EIIFDFAGIIAFFLAFTLPCLFIF

SEQ ID NO: 2381432 - protein, 19 aa, Entamoeba dispar
EIIFIFQIIELGFYVWYVS

SEQ ID NO: 2381433 - protein, 26 aa, Entamoeba dispar
EIIMPNFLFLIKICLQNKDICRVLDY

SEQ ID NO: 2381434 - protein, 22 aa, Entamoeba dispar
EIIPCDCVPIYSSLPDGICKVE

SEQ ID NO: 2381435 - protein, 23 aa, Entamoeba dispar
EIIPELNELFSLVSFPSDELKYR

SEQ ID NO: 2381436 - protein, 17 aa, Entamoeba dispar
EIIRIAEMYGKWLDVKE

SEQ ID NO: 2381437 - protein, 20 aa, Entamoeba dispar
EIKEEWRAQTDLPFLESTII

SEQ ID NO: 2381438 - protein, 21 aa, Entamoeba dispar
EIKILKDHALLLFNNILGECD

SEQ ID NO: 2381439 - protein, 20 aa, Entamoeba dispar
EIKKASVISFCISSLTLYSN

SEQ ID NO: 2381440 - protein, 20 aa, Entamoeba dispar
EIKNKIKFVVIGGARDEEDL

SEQ ID NO: 2381441 - protein, 19 aa, Entamoeba dispar
EIKQRSCPGGKIYTYTPSI

SEQ ID NO: 2381442 - protein, 26 aa, Entamoeba dispar
EIKWRIIKLTLFIPKEIKAEDKIIER

SEQ ID NO: 2381443 - protein, 24 aa, Entamoeba dispar
EILEFKVLAIFSFNSDRKRQSVIV

SEQ ID NO: 2381444 - protein, 24 aa, Entamoeba dispar
EILEPRAEMNIHFEIQLHCNCSCK

SEQ ID NO: 2381445 - protein, 20 aa, Entamoeba dispar
EILGTGVGFIFSLIWAITHH

SEQ ID NO: 2381446 - protein, 17 aa, Entamoeba dispar
EILINFYHFLKRYLKVI

SEQ ID NO: 2381447 - protein, 20 aa, Entamoeba dispar
EILISVPVIGIFEKAAQIVP

SEQ ID NO: 2381448 - protein, 17 aa, Entamoeba dispar
EILKLDLNGGWGDQWNQ

SEQ ID NO: 2381449 - protein, 20 aa, Entamoeba dispar
EILKRITYYYGSFVTSVKAS

SEQ ID NO: 2381450 - protein, 23 aa, Entamoeba dispar
EILLEGIGALLIAKALVDYSTIK

SEQ ID NO: 2381451 - protein, 24 aa, Entamoeba dispar
EILLSIRLQKIFNLPSDVLAVSIV

SEQ ID NO: 2381452 - protein, 26 aa, Entamoeba dispar
EILQEFIRLVFHLNLEHCMLIRQVGE

SEQ ID NO: 2381453 - protein, 18 aa, Entamoeba dispar
EIMIKGIIQFNSQNEGRI

SEQ ID NO: 2381454 - protein, 22 aa, Entamoeba dispar
EINDSFGPLSLEAVTPDTTFDG

SEQ ID NO: 2381455 - protein, 21 aa, Entamoeba dispar
EINICPYIRYETVPSSSLPGS

SEQ ID NO: 2381456 - protein, 19 aa, Entamoeba dispar
EINIKWWIIIIIIFIIIIG

SEQ ID NO: 2381457 - protein, 24 aa, Entamoeba dispar
EINKDFFHHLSFPIKLTKKVILDD

SEQ ID NO: 2381458 - protein, 24 aa, Entamoeba dispar
EINLKGWNKYCGKLDTKFETDGDK

SEQ ID NO: 2381459 - protein, 37 aa, Entamoeba dispar
EINRISIAVNMLFDICLELGYFFTLKKSRKMSSTIRI

SEQ ID NO: 2381460 - protein, 22 aa, Entamoeba dispar
EIPEFVAFSIVALFSLVGLILV

SEQ ID NO: 2381461 - protein, 25 aa, Entamoeba dispar
EIPLTIYMLLNWLWLLGTLIYLNYV

SEQ ID NO: 2381462 - protein, 23 aa, Entamoeba dispar
EIPNKIRIKFMIDGAKGISYLHS

SEQ ID NO: 2381463 - protein, 24 aa, Entamoeba dispar
EIPQLIEIVTIYFIQIRKLIPSDC

SEQ ID NO: 2381464 - protein, 20 aa, Entamoeba dispar
EIPQSLSFTNGFIFPMIAYS

SEQ ID NO: 2381465 - protein, 17 aa, Entamoeba dispar
EIQECIECEKGYYLNSN

SEQ ID NO: 2381466 - protein, 18 aa, Entamoeba dispar
EIQECIQCEKGYYLNSNK

SEQ ID NO: 2381467 - protein, 19 aa, Entamoeba dispar
EIQTEISFTKPAHKIYIEL

SEQ ID NO: 2381468 - protein, 18 aa, Entamoeba dispar
EIRELICIGNEKKEKKKI

SEQ ID NO: 2381469 - protein, 23 aa, Entamoeba dispar
EIRGWKNFLFFAIGTLILIGGIV

SEQ ID NO: 2381470 - protein, 27 aa, Entamoeba dispar
EIRIYCNGEIRYGNWKIIKVESNEITT

SEQ ID NO: 2381471 - protein, 17 aa, Entamoeba dispar
EIRPDIAQALRGEIIIK

SEQ ID NO: 2381472 - protein, 32 aa, Entamoeba dispar
EIRTKRNLKRFCYAYLFIICCFTVVECLFIPF

SEQ ID NO: 2381473 - protein, 19 aa, Entamoeba dispar
EISCKDCHSVIRLQSDPKN

SEQ ID NO: 2381474 - protein, 26 aa, Entamoeba dispar
EISILLPKFLTFYALPIESVNKCLYL

SEQ ID NO: 2381475 - protein, 22 aa, Entamoeba dispar
EISRIKKYFLLFVNNLTIGKGL

SEQ ID NO: 2381476 - protein, 17 aa, Entamoeba dispar
EISSFVTDCLFAGSESY

SEQ ID NO: 2381477 - protein, 20 aa, Entamoeba dispar
EISYCVGGKYLSIVVQLSAF

SEQ ID NO: 2381478 - protein, 23 aa, Entamoeba dispar
EITKCVISIIGIMLTRKDVTIFS

SEQ ID NO: 2381479 - protein, 17 aa, Entamoeba dispar
EITLPFTEVRVLGLHKI

SEQ ID NO: 2381480 - protein, 21 aa, Entamoeba dispar
EITRISFIYFLIISIIEGIIT

SEQ ID NO: 2381481 - protein, 25 aa, Entamoeba dispar
EITSGMPEWYFLIIQNSWKQNPSER

SEQ ID NO: 2381482 - protein, 24 aa, Entamoeba dispar
EITTCKKLGLYDRKCKLTDSLYTY

SEQ ID NO: 2381483 - protein, 21 aa, Entamoeba dispar
EITTMRYSLFLYYKNSGLSYN

SEQ ID NO: 2381484 - protein, 17 aa, Entamoeba dispar
EIVFKRDDTIIVNSLIT

SEQ ID NO: 2381485 - protein, 26 aa, Entamoeba dispar
EIVHPCVAFPYVIQWNDIINTNGLSL

SEQ ID NO: 2381486 - protein, 20 aa, Entamoeba dispar
EIVLFWVFVLIWRKKKLITF

SEQ ID NO: 2381487 - protein, 18 aa, Entamoeba dispar
EIVLSWFSLLPIDSYPDD

SEQ ID NO: 2381488 - protein, 18 aa, Entamoeba dispar
EIVPRIANKIKEIREKRF

SEQ ID NO: 2381489 - protein, 29 aa, Entamoeba dispar
EIVSMKAIEIFFRFCELDLFKESKEILKP

SEQ ID NO: 2381490 - protein, 21 aa, Entamoeba dispar
EIYKYPWDIADAITTGKRPKI

SEQ ID NO: 2381491 - protein, 24 aa, Entamoeba dispar
EIYNFPWDIADAITSGKRPPIIQE

SEQ ID NO: 2381492 - protein, 25 aa, Entamoeba dispar
EIYNFPWDIADAITTGKRPTIIQEV

SEQ ID NO: 2381493 - protein, 37 aa, Entamoeba dispar
EIYPSPFRIAYELPIKLPYHYPLWKAMIAITSLLIPI

SEQ ID NO: 2381494 - protein, 18 aa, Entamoeba dispar
EKCGKCDDGEYTWCKNGA

SEQ ID NO: 2381495 - protein, 24 aa, Entamoeba dispar
EKDDAWVLYRYCIKRQRRWYTKPK

SEQ ID NO: 2381496 - protein, 22 aa, Entamoeba dispar
EKDFTCIRFPKIFADNSKQFIL

SEQ ID NO: 2381497 - protein, 21 aa, Entamoeba dispar
EKDGICTKCGNGIVDVDEECD

SEQ ID NO: 2381498 - protein, 25 aa, Entamoeba dispar
EKDWTMKEIIEEGSKFYNNIKLFGK

SEQ ID NO: 2381499 - protein, 25 aa, Entamoeba dispar
EKEIYEVLIKWGYFVQMPSVSPFIE

SEQ ID NO: 2381500 - protein, 26 aa, Entamoeba dispar
EKEKKKRIINMIGIIMYQMRKSLYEW

SEQ ID NO: 2381501 - protein, 24 aa, Entamoeba dispar
EKEKWEWTDMEGLEISPFDIKQVS

SEQ ID NO: 2381502 - protein, 23 aa, Entamoeba dispar
EKERMIKELIKIIQRSGHQNQWK

SEQ ID NO: 2381503 - protein, 41 aa, Entamoeba dispar
EKERYLHFLSNSFFFERIMTFYIALIFRFHIFIGTPELMRK

SEQ ID NO: 2381504 - protein, 34 aa, Entamoeba dispar
EKESMTWKGFLLMLIPAFCDFLATYLMNFGLIVV

SEQ ID NO: 2381505 - protein, 25 aa, Entamoeba dispar
EKESRECLYRNGGISEYIRNPRLTA

SEQ ID NO: 2381506 - protein, 31 aa, Entamoeba dispar
EKETIPRAHLQWRCGYIQYITSIIIKDVYIV

SEQ ID NO: 2381507 - protein, 23 aa, Entamoeba dispar
EKEYEIYQQLTLIALLNVYCTFK

SEQ ID NO: 2381508 - protein, 18 aa, Entamoeba dispar
EKGDEILVFVGADSTAEG

SEQ ID NO: 2381509 - protein, 20 aa, Entamoeba dispar
EKGKESCVVIVRHLTGLRMD

SEQ ID NO: 2381510 - protein, 19 aa, Entamoeba dispar
EKHQTICYCLNYFGMQEEA

SEQ ID NO: 2381511 - protein, 25 aa, Entamoeba dispar
EKIIIKTWWRLVIFIINGIMVGIMN

SEQ ID NO: 2381512 - protein, 23 aa, Entamoeba dispar
EKIIKLKQQFHLFLPEINMIQKL

SEQ ID NO: 2381513 - protein, 25 aa, Entamoeba dispar
EKIKMKRMNGIFALRHCTVTMMNYP

SEQ ID NO: 2381514 - protein, 24 aa, Entamoeba dispar
EKIREFIKFLIFFQPHFNIKQQKL

SEQ ID NO: 2381515 - protein, 23 aa, Entamoeba dispar
EKKANEIELRMTLEDRINEIIEL

SEQ ID NO: 2381516 - protein, 23 aa, Entamoeba dispar
EKKFIKITESFRVDINNSDVRVS

SEQ ID NO: 2381517 - protein, 21 aa, Entamoeba dispar
EKKNQFAFSCFVFIVIIIMFI

SEQ ID NO: 2381518 - protein, 20 aa, Entamoeba dispar
EKKPKYSILLPGVEAKEQNK

SEQ ID NO: 2381519 - protein, 23 aa, Entamoeba dispar
EKKRNGVCVTVYLRDNDNDKFTP

SEQ ID NO: 2381520 - protein, 19 aa, Entamoeba dispar
EKKSSMILLSQRFQINLTR

SEQ ID NO: 2381521 - protein, 22 aa, Entamoeba dispar
EKKTFFASLPFLEKGKLIDDKE

SEQ ID NO: 2381522 - protein, 23 aa, Entamoeba dispar
EKKYCVSAICILEPSTGKIKSLT

SEQ ID NO: 2381523 - protein, 19 aa, Entamoeba dispar
EKLGWKTTTSFEEGLKKTV

SEQ ID NO: 2381524 - protein, 32 aa, Entamoeba dispar
EKLKEGDLFGAYNIYKGIGIFINFEDVDIPMI

SEQ ID NO: 2381525 - protein, 26 aa, Entamoeba dispar
EKLKSGIKMTWWLGINLTLIYFFEYI

SEQ ID NO: 2381526 - protein, 23 aa, Entamoeba dispar
EKLKYNKMFVVSLIRNVFTNNFL

SEQ ID NO: 2381527 - protein, 25 aa, Entamoeba dispar
EKLLFGINCSYHFAMYHLLILYVVS

SEQ ID NO: 2381528 - protein, 17 aa, Entamoeba dispar
EKLWAIANLILGIGFVF

SEQ ID NO: 2381529 - protein, 26 aa, Entamoeba dispar
EKMGGLKPSWEIAYCSWEESINYAIS

SEQ ID NO: 2381530 - protein, 17 aa, Entamoeba dispar
EKNFVCLSGCTVTDGNG

SEQ ID NO: 2381531 - protein, 22 aa, Entamoeba dispar
EKNRKFILGFYITIIVIIFPVS

SEQ ID NO: 2381532 - protein, 23 aa, Entamoeba dispar
EKPKGINRYGFFHSEDEEKSIIY

SEQ ID NO: 2381533 - protein, 22 aa, Entamoeba dispar
EKPKPLISYLWNGMISLIIIYF

SEQ ID NO: 2381534 - protein, 30 aa, Entamoeba dispar
EKPMKKRIWWLRIVEEIWLVLVGFVRSSFY

SEQ ID NO: 2381535 - protein, 21 aa, Entamoeba dispar
EKQFRRIIVSSIGGNKTQFVF

SEQ ID NO: 2381536 - protein, 25 aa, Entamoeba dispar
EKREELRLSTLQVLLKGILSAEVNG

SEQ ID NO: 2381537 - protein, 26 aa, Entamoeba dispar
EKSDSRWKVLVGISIFTYLMELLFCS

SEQ ID NO: 2381538 - protein, 25 aa, Entamoeba dispar
EKSELRYPTIHLFDYQRNKKEGFPD

SEQ ID NO: 2381539 - protein, 19 aa, Entamoeba dispar
EKSPKIWLYSSRLVAAVPP

SEQ ID NO: 2381540 - protein, 23 aa, Entamoeba dispar
EKSRRIIGFSVFNIIIVFIFIIV

SEQ ID NO: 2381541 - protein, 26 aa, Entamoeba dispar
EKSSNWKIGLVIGVLIVVLIIIIILI

SEQ ID NO: 2381542 - protein, 23 aa, Entamoeba dispar
EKSTTCSKCPFGYTPNEKQTDCI

SEQ ID NO: 2381543 - protein, 29 aa, Entamoeba dispar
EKTACIFYSKKQWIVYLLSFLIFAIVLII

SEQ ID NO: 2381544 - protein, 20 aa, Entamoeba dispar
EKTFKGLRVDCKDCTSFSLN

SEQ ID NO: 2381545 - protein, 27 aa, Entamoeba dispar
EKTGKLKKMIIEWSMNIKLFDKKNDKK

SEQ ID NO: 2381546 - protein, 22 aa, Entamoeba dispar
EKTMSFFSRWLDTIGKKKFPME

SEQ ID NO: 2381547 - protein, 17 aa, Entamoeba dispar
EKTRILITQTFQYLPEC

SEQ ID NO: 2381548 - protein, 28 aa, Entamoeba dispar
EKVCTECEFPCYAAASGEYIRDDSNAKT

SEQ ID NO: 2381549 - protein, 24 aa, Entamoeba dispar
EKVCYKAFGIRTLYYQFKITTNNV

SEQ ID NO: 2381550 - protein, 29 aa, Entamoeba dispar
EKVFFFCDEFMFKRWTKYINDSVEGKDIE

SEQ ID NO: 2381551 - protein, 18 aa, Entamoeba dispar
EKVIGCMCPSLSLDEIEW

SEQ ID NO: 2381552 - protein, 17 aa, Entamoeba dispar
EKVKRALDEKAIKEGKK

SEQ ID NO: 2381553 - protein, 29 aa, Entamoeba dispar
EKVQFIFRFACRALKEKKVLWIVTGSSSI

SEQ ID NO: 2381554 - protein, 17 aa, Entamoeba dispar
EKVRKATEWAVQKVNLI

SEQ ID NO: 2381555 - protein, 22 aa, Entamoeba dispar
EKWGCLQFGLLNPARADQYSAI

SEQ ID NO: 2381556 - protein, 17 aa, Entamoeba dispar
EKYCSYVQIRGSIPLLW

SEQ ID NO: 2381557 - protein, 21 aa, Entamoeba dispar
EKYERIIWRTFQVFESIYQYT

SEQ ID NO: 2381558 - protein, 20 aa, Entamoeba dispar
EKYHFVMLYFIMNFPNDVKN

SEQ ID NO: 2381559 - protein, 24 aa, Entamoeba dispar
EKYIRATMSISFIFTLLLIGVFIG

SEQ ID NO: 2381560 - protein, 25 aa, Entamoeba dispar
EKYKWKEMFLNFDLIQKLWKITGII

SEQ ID NO: 2381561 - protein, 17 aa, Entamoeba dispar
EKYSQFISLEFFTSLLL

SEQ ID NO: 2381562 - protein, 23 aa, Entamoeba dispar
ELDEIKIIILLLIGMIKEILEGF

SEQ ID NO: 2381563 - protein, 18 aa, Entamoeba dispar
ELENIIGCIDCIQSFATV

SEQ ID NO: 2381564 - protein, 19 aa, Entamoeba dispar
ELFDMKERILSSGQRLEKI

SEQ ID NO: 2381565 - protein, 19 aa, Entamoeba dispar
ELFEIVDSPIVIFIDCLEK

SEQ ID NO: 2381566 - protein, 22 aa, Entamoeba dispar
ELFIRNNFHSIVAITILLNAFI

SEQ ID NO: 2381567 - protein, 17 aa, Entamoeba dispar
ELFRVKDLIPEDFINPS

SEQ ID NO: 2381568 - protein, 19 aa, Entamoeba dispar
ELGIDFSLITKRIISRLNP

SEQ ID NO: 2381569 - protein, 25 aa, Entamoeba dispar
ELHNYDLLCCISFTFNKSAIYRLKR

SEQ ID NO: 2381570 - protein, 24 aa, Entamoeba dispar
ELICCCSNLFPFYIKTGEHEENDP

SEQ ID NO: 2381571 - protein, 18 aa, Entamoeba dispar
ELIECVKELIPIINTLNY

SEQ ID NO: 2381572 - protein, 23 aa, Entamoeba dispar
ELIELKGTYYGLVKRQSMEEEVD

SEQ ID NO: 2381573 - protein, 18 aa, Entamoeba dispar
ELIEMCWLEDPSKRPCCS

SEQ ID NO: 2381574 - protein, 36 aa, Entamoeba dispar
ELIHLPSPLLKIAESCLRLPLPADKLVSLMFISLPI

SEQ ID NO: 2381575 - protein, 18 aa, Entamoeba dispar
ELIPLTLHDHLFIKLQQM

SEQ ID NO: 2381576 - protein, 24 aa, Entamoeba dispar
ELISRPELYLTVSSVYTLKTVILW

SEQ ID NO: 2381577 - protein, 19 aa, Entamoeba dispar
ELKCEGNFLFFIRQSPKGC

SEQ ID NO: 2381578 - protein, 20 aa, Entamoeba dispar
ELKKTLKVNTLLTVETISSG

SEQ ID NO: 2381579 - protein, 24 aa, Entamoeba dispar
ELKNCKIKTPLGCSQCEKGYYVDN

SEQ ID NO: 2381580 - protein, 20 aa, Entamoeba dispar
ELKYVIKRYHHFFIIKTDAA

SEQ ID NO: 2381581 - protein, 18 aa, Entamoeba dispar
ELLFYQAQYYLKQKVYQK

SEQ ID NO: 2381582 - protein, 30 aa, Entamoeba dispar
ELLGSVLCCPGCFTLLRLEAIYDDNLRNKR

SEQ ID NO: 2381583 - protein, 19 aa, Entamoeba dispar
ELLIRDGFQIKTKRSKESV

SEQ ID NO: 2381584 - protein, 23 aa, Entamoeba dispar
ELLKQVRPGMDLSRITFPSHILE

SEQ ID NO: 2381585 - protein, 22 aa, Entamoeba dispar
ELLLPLYFDYHFTVTKTMKEFL

SEQ ID NO: 2381586 - protein, 24 aa, Entamoeba dispar
ELLMTLKVTLNFGNILNASSPLRC

SEQ ID NO: 2381587 - protein, 17 aa, Entamoeba dispar
ELLQMCEKIGYVFKKRP

SEQ ID NO: 2381588 - protein, 20 aa, Entamoeba dispar
ELLRRPERNSGRVKAATKCV

SEQ ID NO: 2381589 - protein, 23 aa, Entamoeba dispar
ELMELKGTYYGLVKRQSMEEEVD

SEQ ID NO: 2381590 - protein, 17 aa, Entamoeba dispar
ELMKIKYERIIKQMKVS

SEQ ID NO: 2381591 - protein, 17 aa, Entamoeba dispar
ELMKMGGISTVLHYCQK

SEQ ID NO: 2381592 - protein, 17 aa, Entamoeba dispar
ELMNFQVIIGSFVPLEP

SEQ ID NO: 2381593 - protein, 24 aa, Entamoeba dispar
ELNEMEWYCAIFIFQQKNNEMVCE

SEQ ID NO: 2381594 - protein, 26 aa, Entamoeba dispar
ELNEWILSCVYGIFVTVFAYFHSDRK

SEQ ID NO: 2381595 - protein, 21 aa, Entamoeba dispar
ELNGICISCKQFGNQCSQCSA

SEQ ID NO: 2381596 - protein, 19 aa, Entamoeba dispar
ELNIKWLRNQIGIVGQEPI

SEQ ID NO: 2381597 - protein, 17 aa, Entamoeba dispar
ELNNLILNGQFTITNIP

SEQ ID NO: 2381598 - protein, 17 aa, Entamoeba dispar
ELNNLMCTDARCMKEAD

SEQ ID NO: 2381599 - protein, 25 aa, Entamoeba dispar
ELNRVTGICILLLFIVVLIMTICTT

SEQ ID NO: 2381600 - protein, 23 aa, Entamoeba dispar
ELNWFPKRYAIQFDNYKKYMDTI

SEQ ID NO: 2381601 - protein, 24 aa, Entamoeba dispar
ELNYNAKVAQYFSFTSNIQNNIAP

SEQ ID NO: 2381602 - protein, 17 aa, Entamoeba dispar
ELPCRHACIAICHDGPC

SEQ ID NO: 2381603 - protein, 18 aa, Entamoeba dispar
ELPFLHILHYIFSSSCSL

SEQ ID NO: 2381604 - protein, 21 aa, Entamoeba dispar
ELPNIRGCIFLYKHSNGCTIC

SEQ ID NO: 2381605 - protein, 18 aa, Entamoeba dispar
ELPSNVNGYLILDGATKS

SEQ ID NO: 2381606 - protein, 25 aa, Entamoeba dispar
ELQQRLKPFLKEEMVIAEIERKFNQ

SEQ ID NO: 2381607 - protein, 20 aa, Entamoeba dispar
ELRFHCCGWKTLPADASKCA

SEQ ID NO: 2381608 - protein, 24 aa, Entamoeba dispar
ELRRHIRADLSIDHAAAYRYAKLL

SEQ ID NO: 2381609 - protein, 20 aa, Entamoeba dispar
ELSELLSFNGILYGFDDRTG

SEQ ID NO: 2381610 - protein, 28 aa, Entamoeba dispar
ELSEQWFAHQMCCFLLPYYDCSSNIVEL

SEQ ID NO: 2381611 - protein, 19 aa, Entamoeba dispar
ELSNYEFLYEVNRYANRSF

SEQ ID NO: 2381612 - protein, 21 aa, Entamoeba dispar
ELTEDILLFDCYKISNFTPIV

SEQ ID NO: 2381613 - protein, 25 aa, Entamoeba dispar
ELTGCKQCYIGYVFDTEKKLCVSDE

SEQ ID NO: 2381614 - protein, 24 aa, Entamoeba dispar
ELTKLRSPLLINIIGIVTTPKHEC

SEQ ID NO: 2381615 - protein, 17 aa, Entamoeba dispar
ELTKNCTGIKGWIGELI

SEQ ID NO: 2381616 - protein, 17 aa, Entamoeba dispar
ELYDCIEHSLSIIAYYC

SEQ ID NO: 2381617 - protein, 19 aa, Entamoeba dispar
ELYPIYYYFNINLIISQLW

SEQ ID NO: 2381618 - protein, 20 aa, Entamoeba dispar
ELYWKKEGFCNKHQDKFNGN

SEQ ID NO: 2381619 - protein, 24 aa, Entamoeba dispar
EMAGFLTERIEVIVNTLSQISNAT

SEQ ID NO: 2381620 - protein, 23 aa, Entamoeba dispar
EMELKEGVLYYIRATCIISDCAV

SEQ ID NO: 2381621 - protein, 23 aa, Entamoeba dispar
EMFAHRYAECWSDKMKEMNITSN

SEQ ID NO: 2381622 - protein, 19 aa, Entamoeba dispar
EMGDEAYLVKWKLFRSLAL

SEQ ID NO: 2381623 - protein, 23 aa, Entamoeba dispar
EMIECAKMANAHDFISHLPEGYD

SEQ ID NO: 2381624 - protein, 19 aa, Entamoeba dispar
EMILNLLLLIFSFIDGFSI

SEQ ID NO: 2381625 - protein, 22 aa, Entamoeba dispar
EMINSAILEICYSPKMFPIPIP

SEQ ID NO: 2381626 - protein, 22 aa, Entamoeba dispar
EMIPMLKQYIMKNITEGVINDN

SEQ ID NO: 2381627 - protein, 22 aa, Entamoeba dispar
EMKAPAFIRRFVKSIDNKTRLR

SEQ ID NO: 2381628 - protein, 24 aa, Entamoeba dispar
EMKELAESLVRDWPAIEKSVEASK

SEQ ID NO: 2381629 - protein, 27 aa, Entamoeba dispar
EMMFMICSFGYLCFLIILKWCNPDKDP

SEQ ID NO: 2381630 - protein, 28 aa, Entamoeba dispar
EMMKMLGMKMTPYWVLHIVYFFCIFLIQ

SEQ ID NO: 2381631 - protein, 19 aa, Entamoeba dispar
EMNWFEILLGIAIIFFSFV

SEQ ID NO: 2381632 - protein, 25 aa, Entamoeba dispar
EMPNEFTHRINIIFLLLLIEEGIDY

SEQ ID NO: 2381633 - protein, 20 aa, Entamoeba dispar
EMQICPNVRSFEQWTPLDED

SEQ ID NO: 2381634 - protein, 21 aa, Entamoeba dispar
EMTSATEGAVFKCKTAEDKTT

SEQ ID NO: 2381635 - protein, 18 aa, Entamoeba dispar
EMVNGWSSGTGFAGVAGS

SEQ ID NO: 2381636 - protein, 21 aa, Entamoeba dispar
ENELEYCLSLLYSTLSIRCNF

SEQ ID NO: 2381637 - protein, 30 aa, Entamoeba dispar
ENEMSLDFKLRCMYDIAHGMFYLHQNDIIH

SEQ ID NO: 2381638 - protein, 19 aa, Entamoeba dispar
ENFPLTALTNVTFDYYDVL

SEQ ID NO: 2381639 - protein, 19 aa, Entamoeba dispar
ENFYEPNWFELSKRSFKRE

SEQ ID NO: 2381640 - protein, 18 aa, Entamoeba dispar
ENGCKKCLYQIKSKLSNQ

SEQ ID NO: 2381641 - protein, 23 aa, Entamoeba dispar
ENGLKSLFEKECISKRETKDGFN

SEQ ID NO: 2381642 - protein, 39 aa, Entamoeba dispar
ENGRCILCSSKFHGCSMCSPQECYSCFNSSEIITTDKSC

SEQ ID NO: 2381643 - protein, 20 aa, Entamoeba dispar
ENHSFFNPWSLKKEYKKLYS

SEQ ID NO: 2381644 - protein, 25 aa, Entamoeba dispar
ENIHRIGNDILFISAIGNDLLGKML

SEQ ID NO: 2381645 - protein, 25 aa, Entamoeba dispar
ENIKFVVQCLYRFVTHSTSLDIKQI

SEQ ID NO: 2381646 - protein, 27 aa, Entamoeba dispar
ENIRKSLYFCLGSILVIGLEFFMLLMS

SEQ ID NO: 2381647 - protein, 23 aa, Entamoeba dispar
ENKDGSEELGIWIQKLLTPNYDA

SEQ ID NO: 2381648 - protein, 26 aa, Entamoeba dispar
ENKEGCIYHVIWWIVLLEIIIALFIL

SEQ ID NO: 2381649 - protein, 21 aa, Entamoeba dispar
ENKELFVHMLAIASGCGVAST

SEQ ID NO: 2381650 - protein, 17 aa, Entamoeba dispar
ENKICCLTTSNKVNTFI

SEQ ID NO: 2381651 - protein, 29 aa, Entamoeba dispar
ENKLPTGCYCTYSLISKQECIFDCENENE

SEQ ID NO: 2381652 - protein, 23 aa, Entamoeba dispar
ENKYACGSCVDSVKTICPSNTPD

SEQ ID NO: 2381653 - protein, 23 aa, Entamoeba dispar
ENLCHKHKIVILSDFHFQQDQTT

SEQ ID NO: 2381654 - protein, 26 aa, Entamoeba dispar
ENLDFSYKLLRGIMNYCNYPDPDIRI

SEQ ID NO: 2381655 - protein, 19 aa, Entamoeba dispar
ENLFFYFKFPNLNSLPLNF

SEQ ID NO: 2381656 - protein, 22 aa, Entamoeba dispar
ENLFPYRYVLNHPKKCKYISRA

SEQ ID NO: 2381657 - protein, 27 aa, Entamoeba dispar
ENLKPEPMYKLYISIEEAMNGCQKLVP

SEQ ID NO: 2381658 - protein, 24 aa, Entamoeba dispar
ENMLSNCYEWLYDRVISSQMHLTL

SEQ ID NO: 2381659 - protein, 21 aa, Entamoeba dispar
ENNCCGWKTLKLYGCGSPIDS

SEQ ID NO: 2381660 - protein, 17 aa, Entamoeba dispar
ENNCGLPPHKEYLPVKL

SEQ ID NO: 2381661 - protein, 19 aa, Entamoeba dispar
ENNRILKCRDDLLMNENGS

SEQ ID NO: 2381662 - protein, 23 aa, Entamoeba dispar
ENPQLPLSLGMQYIRNMTTLLRT

SEQ ID NO: 2381663 - protein, 22 aa, Entamoeba dispar
ENQELINILFLQMGYNMNYTES

SEQ ID NO: 2381664 - protein, 19 aa, Entamoeba dispar
ENQQRPSFFSMLADCDETK

SEQ ID NO: 2381665 - protein, 22 aa, Entamoeba dispar
ENQRGIGYISHMLGHIAQQSNR

SEQ ID NO: 2381666 - protein, 23 aa, Entamoeba dispar
ENQRTTLGFGYPTVIKMYELFSL

SEQ ID NO: 2381667 - protein, 20 aa, Entamoeba dispar
ENQTLFSFFQSIFFTFQTTF

SEQ ID NO: 2381668 - protein, 25 aa, Entamoeba dispar
ENRKRLDAITLMYLFTKCNYITTYD

SEQ ID NO: 2381669 - protein, 30 aa, Entamoeba dispar
ENSEIKYQIPLYLIVLVIFFGFDEFIAILT

SEQ ID NO: 2381670 - protein, 17 aa, Entamoeba dispar
ENSFKWLTMSAEQENTI

SEQ ID NO: 2381671 - protein, 25 aa, Entamoeba dispar
ENSPCLQCMPGTYSGIGSAKCHQCP

SEQ ID NO: 2381672 - protein, 23 aa, Entamoeba dispar
ENSRCTKCSFGHTIIDDTYCSNF

SEQ ID NO: 2381673 - protein, 27 aa, Entamoeba dispar
ENSVFYRALFIFLRFLYHQSCDPYFLE

SEQ ID NO: 2381674 - protein, 23 aa, Entamoeba dispar
ENTEYKLGIELKEQKAEIKKLNQ

SEQ ID NO: 2381675 - protein, 19 aa, Entamoeba dispar
ENTKIIVLIITFIVLIIIN

SEQ ID NO: 2381676 - protein, 21 aa, Entamoeba dispar
ENVIRIKSLIPKMDHSELLNS

SEQ ID NO: 2381677 - protein, 26 aa, Entamoeba dispar
ENVMKYSWILFTILFKGIVMMINSGK

SEQ ID NO: 2381678 - protein, 25 aa, Entamoeba dispar
ENWLRNARDWAISRNRFWGTPIPIW

SEQ ID NO: 2381679 - protein, 30 aa, Entamoeba dispar
ENYKKEKSFRMFIELGKKILIPLQLRTKLL

SEQ ID NO: 2381680 - protein, 23 aa, Entamoeba dispar
ENYQEFDFIFTLGPLKITFPLVI

SEQ ID NO: 2381681 - protein, 21 aa, Entamoeba dispar
ENYSSIFLNKCSFELYLNKLY

SEQ ID NO: 2381682 - protein, 21 aa, Entamoeba dispar
EPANFACLFFFVGTLVSYLII

SEQ ID NO: 2381683 - protein, 29 aa, Entamoeba dispar
EPCNYFKGDICYKCPLGYYNINGICTKCK

SEQ ID NO: 2381684 - protein, 26 aa, Entamoeba dispar
EPDPGLRMLGLVKWLLSGFYLMPTGI

SEQ ID NO: 2381685 - protein, 27 aa, Entamoeba dispar
EPDPGLRMLGLVKWLLSGFYLMPTGIK

SEQ ID NO: 2381686 - protein, 19 aa, Entamoeba dispar
EPEKICGMYPILKQAIKQQ

SEQ ID NO: 2381687 - protein, 21 aa, Entamoeba dispar
EPFAMIGGFIWSVGNVFSVPA

SEQ ID NO: 2381688 - protein, 21 aa, Entamoeba dispar
EPIARLNCCKVLMRTLEYLLI

SEQ ID NO: 2381689 - protein, 29 aa, Entamoeba dispar
EPISHVIFWSIFEGIVFLLWIISLLLLVI

SEQ ID NO: 2381690 - protein, 20 aa, Entamoeba dispar
EPKERIRIEEVIRMLERIEN

SEQ ID NO: 2381691 - protein, 20 aa, Entamoeba dispar
EPKERIRIEEVVRMLERIEN

SEQ ID NO: 2381692 - protein, 22 aa, Entamoeba dispar
EPKKQFIIHLFQLVLTGAVLVL

SEQ ID NO: 2381693 - protein, 21 aa, Entamoeba dispar
EPMMKQAILPIIDDFLEDFLI

SEQ ID NO: 2381694 - protein, 18 aa, Entamoeba dispar
EPNYHFFEELDLQKQYER

SEQ ID NO: 2381695 - protein, 19 aa, Entamoeba dispar
EPQIKKWWYVISLVLMPML

SEQ ID NO: 2381696 - protein, 22 aa, Entamoeba dispar
EPSISLPSLKIFSNGNLTLKGK

SEQ ID NO: 2381697 - protein, 18 aa, Entamoeba dispar
EPSSLPLSVYRPSTTFYL

SEQ ID NO: 2381698 - protein, 21 aa, Entamoeba dispar
EPTCKMCNITCRICDNNPNWC

SEQ ID NO: 2381699 - protein, 19 aa, Entamoeba dispar
EPYGCVCIISPWNFPANLS

SEQ ID NO: 2381700 - protein, 22 aa, Entamoeba dispar
EPYKEFKSLFDIKQYVTDGKRL

SEQ ID NO: 2381701 - protein, 19 aa, Entamoeba dispar
EPYQIIKFSLTIEQSNKGT

SEQ ID NO: 2381702 - protein, 23 aa, Entamoeba dispar
EQAFECIESVKVNRTVTEAIKKD

SEQ ID NO: 2381703 - protein, 18 aa, Entamoeba dispar
EQCNIKEVFCDGKISMNF

SEQ ID NO: 2381704 - protein, 22 aa, Entamoeba dispar
EQEWSPSGSITCFPCNENCQEC

SEQ ID NO: 2381705 - protein, 18 aa, Entamoeba dispar
EQFEYEWENNCGLPPHKE

SEQ ID NO: 2381706 - protein, 18 aa, Entamoeba dispar
EQFKYPWEIADFISEGKR

SEQ ID NO: 2381707 - protein, 19 aa, Entamoeba dispar
EQFKYPWQIAQFVCDKKRP

SEQ ID NO: 2381708 - protein, 23 aa, Entamoeba dispar
EQGELLIGTWIDGVPVGPFESTE

SEQ ID NO: 2381709 - protein, 17 aa, Entamoeba dispar
EQHSGIASFVMKKEDSL

SEQ ID NO: 2381710 - protein, 17 aa, Entamoeba dispar
EQIAICRDAIFNTEDAR

SEQ ID NO: 2381711 - protein, 24 aa, Entamoeba dispar
EQIIKMDTYRGWTEEERSCIAEMY

SEQ ID NO: 2381712 - protein, 17 aa, Entamoeba dispar
EQIKIIIDRAYKNIQCQ

SEQ ID NO: 2381713 - protein, 20 aa, Entamoeba dispar
EQKCKIITCGNGKIEEGEEC

SEQ ID NO: 2381714 - protein, 17 aa, Entamoeba dispar
EQKICFFCKQSILTNMP

SEQ ID NO: 2381715 - protein, 24 aa, Entamoeba dispar
EQKKRLEQFLSIKKLEPFACELLA

SEQ ID NO: 2381716 - protein, 20 aa, Entamoeba dispar
EQKLKFMIDCCKGMTMMHSF

SEQ ID NO: 2381717 - protein, 25 aa, Entamoeba dispar
EQKRLAIPLKVDFKGIVSNEEVDIV

SEQ ID NO: 2381718 - protein, 23 aa, Entamoeba dispar
EQLKECYFLCLDNPTQLYSYLVD

SEQ ID NO: 2381719 - protein, 25 aa, Entamoeba dispar
EQLRSPCIISFIGYCITNESICLVM

SEQ ID NO: 2381720 - protein, 24 aa, Entamoeba dispar
EQLYYKHYPAFEVDSIVDVHGAGD

SEQ ID NO: 2381721 - protein, 27 aa, Entamoeba dispar
EQNKSILWLSLCMLFIPLTAAFARQRN

SEQ ID NO: 2381722 - protein, 20 aa, Entamoeba dispar
EQPVEWKKRGSIECNNNQCI

SEQ ID NO: 2381723 - protein, 26 aa, Entamoeba dispar
EQRIRCQSCIGVFRDCIFKSQNKESG

SEQ ID NO: 2381724 - protein, 19 aa, Entamoeba dispar
EQRIWRYYYIHYKQIQCDQ

SEQ ID NO: 2381725 - protein, 25 aa, Entamoeba dispar
EQSYKYCYIGMIFICGEQETGKRIK

SEQ ID NO: 2381726 - protein, 24 aa, Entamoeba dispar
EQTPKLLFFTGIALYASFVASLFK

SEQ ID NO: 2381727 - protein, 17 aa, Entamoeba dispar
ERDRAMSLSVTRGTKLS

SEQ ID NO: 2381728 - protein, 21 aa, Entamoeba dispar
EREEVRAQLQVIISRETIQKG

SEQ ID NO: 2381729 - protein, 22 aa, Entamoeba dispar
ERERQVYFTLNMFYVDEGHSHL

SEQ ID NO: 2381730 - protein, 24 aa, Entamoeba dispar
ERGNGFCSASFYGKSGQTYKVKAS

SEQ ID NO: 2381731 - protein, 22 aa, Entamoeba dispar
ERGYFRFVIFSVIMEAANMMML

SEQ ID NO: 2381732 - protein, 25 aa, Entamoeba dispar
ERILKEEPKHIVTIHRFHKNANDLF

SEQ ID NO: 2381733 - protein, 19 aa, Entamoeba dispar
ERIPREFLTDIIDERVNIY

SEQ ID NO: 2381734 - protein, 17 aa, Entamoeba dispar
ERIQWKILQVLNFFILI

SEQ ID NO: 2381735 - protein, 19 aa, Entamoeba dispar
ERITVEFINPIYVPGTINY

SEQ ID NO: 2381736 - protein, 22 aa, Entamoeba dispar
ERKELRSFIIVRCDNVYFVWCG

SEQ ID NO: 2381737 - protein, 17 aa, Entamoeba dispar
ERLDLFGYLSCKELHLK

SEQ ID NO: 2381738 - protein, 28 aa, Entamoeba dispar
ERLIESFNCSKCPAGSASAVRNTIQCQL

SEQ ID NO: 2381739 - protein, 17 aa, Entamoeba dispar
ERLLICMHMNKFYQKII

SEQ ID NO: 2381740 - protein, 27 aa, Entamoeba dispar
ERNIQLCVYGCGFALLSTFIFDSNSIL

SEQ ID NO: 2381741 - protein, 25 aa, Entamoeba dispar
ERNVVICFFLGFILFIPFLVAYIIG

SEQ ID NO: 2381742 - protein, 24 aa, Entamoeba dispar
ERNYCLKCLNGYKIENNQCNGDND

SEQ ID NO: 2381743 - protein, 19 aa, Entamoeba dispar
ERNYCLKCSNGYKIENNQC

SEQ ID NO: 2381744 - protein, 20 aa, Entamoeba dispar
ERNYCLKCSNGYKIENNQCD

SEQ ID NO: 2381745 - protein, 20 aa, Entamoeba dispar
ERNYCLKCSNGYKIQNNQCD

SEQ ID NO: 2381746 - protein, 20 aa, Entamoeba dispar
ERNYCLKCSNGYKIQNNQCI

SEQ ID NO: 2381747 - protein, 22 aa, Entamoeba dispar
ERNYCLKCSNGYKIQNNQCNGD

SEQ ID NO: 2381748 - protein, 20 aa, Entamoeba dispar
ERNYCLKCSNGYKIYINNGK

SEQ ID NO: 2381749 - protein, 17 aa, Entamoeba dispar
ERPQFKPNIIIDNSLKE

SEQ ID NO: 2381750 - protein, 24 aa, Entamoeba dispar
ERSRLLPYTLFRLGGAAILLTNKW

SEQ ID NO: 2381751 - protein, 18 aa, Entamoeba dispar
ERVDRGFTPYQIVINRKE

SEQ ID NO: 2381752 - protein, 21 aa, Entamoeba dispar
ERVPSHFIHDAFYLTLFSLIV

SEQ ID NO: 2381753 - protein, 25 aa, Entamoeba dispar
ERYGRIIDLLRKWKNSKVPINETCA

SEQ ID NO: 2381754 - protein, 25 aa, Entamoeba dispar
ERYSHCLSCDEQICHLCKEGYVILS

SEQ ID NO: 2381755 - protein, 18 aa, Entamoeba dispar
ERYSTTFLIKIQYCDGKI

SEQ ID NO: 2381756 - protein, 17 aa, Entamoeba dispar
ESADYWDGVYLYSNSIS

SEQ ID NO: 2381757 - protein, 26 aa, Entamoeba dispar
ESALPRAKKILLLLGEAPSPTFEEEL

SEQ ID NO: 2381758 - protein, 26 aa, Entamoeba dispar
ESALVPFIELCRAICNHSRYLRDCFV

SEQ ID NO: 2381759 - protein, 18 aa, Entamoeba dispar
ESDSEIFLSEVQETYKKK

SEQ ID NO: 2381760 - protein, 21 aa, Entamoeba dispar
ESEIYCVPISLQQNMEEMKLM

SEQ ID NO: 2381761 - protein, 23 aa, Entamoeba dispar
ESELSCSVRFSLNDGSISLNGKG

SEQ ID NO: 2381762 - protein, 24 aa, Entamoeba dispar
ESEVKLLVRTICYTYFLYSLIIDE

SEQ ID NO: 2381763 - protein, 21 aa, Entamoeba dispar
ESEYKYTYVLHYTASSSNGNA

SEQ ID NO: 2381764 - protein, 18 aa, Entamoeba dispar
ESFLPSKISFFLNQPYHF

SEQ ID NO: 2381765 - protein, 24 aa, Entamoeba dispar
ESGKRLGFDTSIPMLLKGLIQDCW

SEQ ID NO: 2381766 - protein, 24 aa, Entamoeba dispar
ESGYRYTKCLNVWTGTPHGVFADE

SEQ ID NO: 2381767 - protein, 22 aa, Entamoeba dispar
ESHGFLYIIMEYMESGSLLNIV

SEQ ID NO: 2381768 - protein, 30 aa, Entamoeba dispar
ESICKERLKYCWVIYSLLIKSIIGYLKDYK

SEQ ID NO: 2381769 - protein, 29 aa, Entamoeba dispar
ESIDMPCLYPMAVALTFSREVFQKISNNK

SEQ ID NO: 2381770 - protein, 24 aa, Entamoeba dispar
ESIHRCVNELLKLVNVTAQPINDK

SEQ ID NO: 2381771 - protein, 20 aa, Entamoeba dispar
ESIIRPGVISVDLDKGIIYG

SEQ ID NO: 2381772 - protein, 27 aa, Entamoeba dispar
ESIKLFIDCVLPMYWSIRSSRNTHLFF

SEQ ID NO: 2381773 - protein, 20 aa, Entamoeba dispar
ESINYAISVVEWLAQLVENV

SEQ ID NO: 2381774 - protein, 26 aa, Entamoeba dispar
ESIPKLSIRLRFLLDAAKGIQYLHNN

SEQ ID NO: 2381775 - protein, 25 aa, Entamoeba dispar
ESKLFRGDQFLNFILQREKVDDGTV

SEQ ID NO: 2381776 - protein, 24 aa, Entamoeba dispar
ESKMFKSMFTFCVVQMACYLRFLK

SEQ ID NO: 2381777 - protein, 19 aa, Entamoeba dispar
ESKNCKKCDSVSGVCSLCN

SEQ ID NO: 2381778 - protein, 20 aa, Entamoeba dispar
ESKTICLLYHEYYSICTDKE

SEQ ID NO: 2381779 - protein, 27 aa, Entamoeba dispar
ESKYFPLCICWSTIPILSWLVPCLGHT

SEQ ID NO: 2381780 - protein, 20 aa, Entamoeba dispar
ESLAIPSAFLIILFIIVVII

SEQ ID NO: 2381781 - protein, 17 aa, Entamoeba dispar
ESLEVFCFMIQTDRSFQ

SEQ ID NO: 2381782 - protein, 18 aa, Entamoeba dispar
ESLKELYLIWKKGGYIGL

SEQ ID NO: 2381783 - protein, 28 aa, Entamoeba dispar
ESLLEGMYFKSCKLVNWSSVPKLIKYLQ

SEQ ID NO: 2381784 - protein, 20 aa, Entamoeba dispar
ESNELFDFFETVMGKEETVK

SEQ ID NO: 2381785 - protein, 24 aa, Entamoeba dispar
ESNHMFWGQSFIEPILFIFTILSV

SEQ ID NO: 2381786 - protein, 18 aa, Entamoeba dispar
ESPCCIKITDFGTSRFIK

SEQ ID NO: 2381787 - protein, 20 aa, Entamoeba dispar
ESPRMYCLSNKCGNNVLDEG

SEQ ID NO: 2381788 - protein, 23 aa, Entamoeba dispar
ESQSKFFFDDFVSVVGAEDDGTN

SEQ ID NO: 2381789 - protein, 23 aa, Entamoeba dispar
ESREIKIRTSICGGLIALCILLR

SEQ ID NO: 2381790 - protein, 21 aa, Entamoeba dispar
ESSASFFKIFSEFVRDISSVM

SEQ ID NO: 2381791 - protein, 24 aa, Entamoeba dispar
ESSICLICSSGYYKTNDGICNKAQ

SEQ ID NO: 2381792 - protein, 19 aa, Entamoeba dispar
ESSKDYYYWIDLIGIVLPF

SEQ ID NO: 2381793 - protein, 22 aa, Entamoeba dispar
ESSYCPNEIIAILKDLLSIIPD

SEQ ID NO: 2381794 - protein, 17 aa, Entamoeba dispar
ESTCGFGSTIQLELYER

SEQ ID NO: 2381795 - protein, 24 aa, Entamoeba dispar
ESTLKEIIVFLIKEFQHLFPENVS

SEQ ID NO: 2381796 - protein, 18 aa, Entamoeba dispar
ESTWIWEIHGDKSYKEMA

SEQ ID NO: 2381797 - protein, 17 aa, Entamoeba dispar
ESVDLAAQMLVIDPLAF

SEQ ID NO: 2381798 - protein, 17 aa, Entamoeba dispar
ESVNKCLYLFTQLKLLN

SEQ ID NO: 2381799 - protein, 21 aa, Entamoeba dispar
ESVYNFVLTCWDKEPKKRPKI

SEQ ID NO: 2381800 - protein, 20 aa, Entamoeba dispar
ESYRYKYSYDESIPREFLTD

SEQ ID NO: 2381801 - protein, 27 aa, Entamoeba dispar
ETAELFKDIFFHTAFWMRTSGEVFYEY

SEQ ID NO: 2381802 - protein, 18 aa, Entamoeba dispar
ETCLKCKNNFYISSNSCI

SEQ ID NO: 2381803 - protein, 22 aa, Entamoeba dispar
ETCLSCLSGYYLSLGQCQSCEV

SEQ ID NO: 2381804 - protein, 20 aa, Entamoeba dispar
ETCRRRRSLVKTAISIFDII

SEQ ID NO: 2381805 - protein, 23 aa, Entamoeba dispar
ETCYKLPEHCLSCNFEKGYYLAE

SEQ ID NO: 2381806 - protein, 18 aa, Entamoeba dispar
ETDECRRKIQLMYFDESF

SEQ ID NO: 2381807 - protein, 34 aa, Entamoeba dispar
ETDLLRVLLIKMCNRINPTLAMYEAYATHALSLY

SEQ ID NO: 2381808 - protein, 27 aa, Entamoeba dispar
ETDWKFRRCIKEFQGLDLLSLENTTFC

SEQ ID NO: 2381809 - protein, 24 aa, Entamoeba dispar
ETEDILDMYCYFRIEENDDQFKFT

SEQ ID NO: 2381810 - protein, 20 aa, Entamoeba dispar
ETEKKCKFVEGDCRNKELVD

SEQ ID NO: 2381811 - protein, 27 aa, Entamoeba dispar
ETELKRKDWYGVLAFSGIEPINEINEK

SEQ ID NO: 2381812 - protein, 20 aa, Entamoeba dispar
ETFFICFLMFYVLSMFEALR

SEQ ID NO: 2381813 - protein, 32 aa, Entamoeba dispar
ETFHWGECYPKLLFKFPWAIADFINRGQRRER

SEQ ID NO: 2381814 - protein, 23 aa, Entamoeba dispar
ETFPFLFCCIFSWCIPVVVIFYF

SEQ ID NO: 2381815 - protein, 17 aa, Entamoeba dispar
ETFSCWITIQNPEIALL

SEQ ID NO: 2381816 - protein, 21 aa, Entamoeba dispar
ETGELLFQFLTNIPYTLYHSI

SEQ ID NO: 2381817 - protein, 17 aa, Entamoeba dispar
ETIEFLIRGGIKVWMIT

SEQ ID NO: 2381818 - protein, 26 aa, Entamoeba dispar
ETIKKGESLFVFATTILREGSGNEFG

SEQ ID NO: 2381819 - protein, 19 aa, Entamoeba dispar
ETIPCWWSNKITDISQVET

SEQ ID NO: 2381820 - protein, 26 aa, Entamoeba dispar
ETITLLNRIICWILMISHNFTTPDDI

SEQ ID NO: 2381821 - protein, 19 aa, Entamoeba dispar
ETIVSLSLLKNPISIIDAL

SEQ ID NO: 2381822 - protein, 23 aa, Entamoeba dispar
ETKEILYLWNFIHQQRDILDIEN

SEQ ID NO: 2381823 - protein, 26 aa, Entamoeba dispar
ETKNNKCSKCSFWYEINEEGTKCNKE

SEQ ID NO: 2381824 - protein, 19 aa, Entamoeba dispar
ETKQSCCFEIYSENEHMVY

SEQ ID NO: 2381825 - protein, 18 aa, Entamoeba dispar
ETLDYLWIKYIESKKPSA

SEQ ID NO: 2381826 - protein, 17 aa, Entamoeba dispar
ETLKSQIAALMFPLISY

SEQ ID NO: 2381827 - protein, 26 aa, Entamoeba dispar
ETLLTILKEHVCKFDILSKLISPDFS

SEQ ID NO: 2381828 - protein, 17 aa, Entamoeba dispar
ETLSFFLEVAKFCIALN

SEQ ID NO: 2381829 - protein, 22 aa, Entamoeba dispar
ETNSQCKFSLSGQCLVPNKGYA

SEQ ID NO: 2381830 - protein, 17 aa, Entamoeba dispar
ETNWKANSYDVYHLPEI

SEQ ID NO: 2381831 - protein, 24 aa, Entamoeba dispar
ETNYRVGTDIGCYCKLKSSNSNEI

SEQ ID NO: 2381832 - protein, 22 aa, Entamoeba dispar
ETPFIYKNFYVVQSRFLDFLLS

SEQ ID NO: 2381833 - protein, 17 aa, Entamoeba dispar
ETPKTRYNCYAHLWDLH

SEQ ID NO: 2381834 - protein, 24 aa, Entamoeba dispar
ETQDLYLCLIWVLKNLNREVLKRY

SEQ ID NO: 2381835 - protein, 19 aa, Entamoeba dispar
ETQLRRCDLVYQQEIALNK

SEQ ID NO: 2381836 - protein, 20 aa, Entamoeba dispar
ETQNAYPLCPSADIRLHKNL

SEQ ID NO: 2381837 - protein, 26 aa, Entamoeba dispar
ETQNLSELLKLFGYIYLNVDNEKTKS

SEQ ID NO: 2381838 - protein, 18 aa, Entamoeba dispar
ETRECIECEKGYYLNSNK

SEQ ID NO: 2381839 - protein, 17 aa, Entamoeba dispar
ETRECIECEKGYYLNST

SEQ ID NO: 2381840 - protein, 18 aa, Entamoeba dispar
ETRECIQCEKGYYLNSTK

SEQ ID NO: 2381841 - protein, 20 aa, Entamoeba dispar
ETTNRLIIEGNYFIYSLETS

SEQ ID NO: 2381842 - protein, 17 aa, Entamoeba dispar
ETVCKAALSLPPSDERQ

SEQ ID NO: 2381843 - protein, 19 aa, Entamoeba dispar
ETVQLIKFTQLWNDQLDIM

SEQ ID NO: 2381844 - protein, 22 aa, Entamoeba dispar
ETVWYSGRCIYYSKIPYCIKAE

SEQ ID NO: 2381845 - protein, 23 aa, Entamoeba dispar
ETYFNTLIEMCWKSNPDERPSFD

SEQ ID NO: 2381846 - protein, 26 aa, Entamoeba dispar
ETYTQELLRWNRLIVTVCLNNCSIER

SEQ ID NO: 2381847 - protein, 19 aa, Entamoeba dispar
ETYYDYGPCITRKEKQNRY

SEQ ID NO: 2381848 - protein, 20 aa, Entamoeba dispar
ETYYDYGPCITRKEKQNRYR

SEQ ID NO: 2381849 - protein, 20 aa, Entamoeba dispar
EVASKIPLFECLMSDIFQFI

SEQ ID NO: 2381850 - protein, 17 aa, Entamoeba dispar
EVDEFSMLFSVVGIFFG

SEQ ID NO: 2381851 - protein, 18 aa, Entamoeba dispar
EVDSHWVKRCGSVAEGNI

SEQ ID NO: 2381852 - protein, 24 aa, Entamoeba dispar
EVDSPQTFPIVFAPSSNVRFRDVE

SEQ ID NO: 2381853 - protein, 24 aa, Entamoeba dispar
EVEAFKKSRVLVLLLMVFNPNSLP

SEQ ID NO: 2381854 - protein, 17 aa, Entamoeba dispar
EVFDCWFESGSMPYGQS

SEQ ID NO: 2381855 - protein, 17 aa, Entamoeba dispar
EVFYNFIKKLCYNFFDS

SEQ ID NO: 2381856 - protein, 22 aa, Entamoeba dispar
EVGCGKTAFFKSLLGNLHKTNG

SEQ ID NO: 2381857 - protein, 17 aa, Entamoeba dispar
EVGEFICQYGLDVLIEL

SEQ ID NO: 2381858 - protein, 31 aa, Entamoeba dispar
EVGHCKHYHIFKLLGIQSIQFFVIFKFIEFF

SEQ ID NO: 2381859 - protein, 17 aa, Entamoeba dispar
EVGIFLVVHSAILIIIT

SEQ ID NO: 2381860 - protein, 19 aa, Entamoeba dispar
EVGIPVLVVIAGMVMYVYK

SEQ ID NO: 2381861 - protein, 19 aa, Entamoeba dispar
EVGQLIYHKKVFVGQDNSY

SEQ ID NO: 2381862 - protein, 25 aa, Entamoeba dispar
EVIGYLKICYYLLFIFVSIGRILFH

SEQ ID NO: 2381863 - protein, 18 aa, Entamoeba dispar
EVISIRWISSSGCDGTIS

SEQ ID NO: 2381864 - protein, 24 aa, Entamoeba dispar
EVKCGEYGVSDYCYVISKDITNPK

SEQ ID NO: 2381865 - protein, 22 aa, Entamoeba dispar
EVKDSFDYWSLIKNPMIIMALV

SEQ ID NO: 2381866 - protein, 29 aa, Entamoeba dispar
EVKHGVQLFKIAHVYSFAIALYNFIIPYF

SEQ ID NO: 2381867 - protein, 20 aa, Entamoeba dispar
EVLDGFQLEIRVGKIVEAGP

SEQ ID NO: 2381868 - protein, 19 aa, Entamoeba dispar
EVLDIPIDVPEEIVNNEKV

SEQ ID NO: 2381869 - protein, 21 aa, Entamoeba dispar
EVLKISIHFIVFILSILSFSP

SEQ ID NO: 2381870 - protein, 26 aa, Entamoeba dispar
EVLKTRCCVCGIEASKIIYNCAICMT

SEQ ID NO: 2381871 - protein, 22 aa, Entamoeba dispar
EVLQKISTYYLKDYLIWGKSMI

SEQ ID NO: 2381872 - protein, 19 aa, Entamoeba dispar
EVMLLSSSVICCRVTPKQK

SEQ ID NO: 2381873 - protein, 22 aa, Entamoeba dispar
EVNKEIRELICIGNEKKEKKKI

SEQ ID NO: 2381874 - protein, 24 aa, Entamoeba dispar
EVPRRLKLKLLIDAAHGIKYLHQN

SEQ ID NO: 2381875 - protein, 20 aa, Entamoeba dispar
EVPSQHKIQIITLNVNGSYK

SEQ ID NO: 2381876 - protein, 27 aa, Entamoeba dispar
EVRCYTSDLKLRWKQQVYSSIAQPYVQ

SEQ ID NO: 2381877 - protein, 23 aa, Entamoeba dispar
EVRGWKNFIFFGIGTFILIIGIV

SEQ ID NO: 2381878 - protein, 23 aa, Entamoeba dispar
EVRKMVSQYGNFVEIHNATPISV

SEQ ID NO: 2381879 - protein, 18 aa, Entamoeba dispar
EVRLRGMKLSNIKKITRQ

SEQ ID NO: 2381880 - protein, 24 aa, Entamoeba dispar
EVRSEVWKLLLLKDLDYKTLQDEF

SEQ ID NO: 2381881 - protein, 21 aa, Entamoeba dispar
EVSKFIKIICQMYHKDEWEVK

SEQ ID NO: 2381882 - protein, 22 aa, Entamoeba dispar
EVTDEAYLVYGPKGSILNVPQV

SEQ ID NO: 2381883 - protein, 27 aa, Entamoeba dispar
EVTKGLKEWGGAILVGFDGDPNGKDEE

SEQ ID NO: 2381884 - protein, 20 aa, Entamoeba dispar
EVTKTGYIILRFKKNVFYNS

SEQ ID NO: 2381885 - protein, 20 aa, Entamoeba dispar
EVTRMFRLIIGCVQDVCGSE

SEQ ID NO: 2381886 - protein, 25 aa, Entamoeba dispar
EVVKIPIKKGESIYQQKKRHVGNDR

SEQ ID NO: 2381887 - protein, 23 aa, Entamoeba dispar
EVVLFGLWGIFLFLIIPSIIVFS

SEQ ID NO: 2381888 - protein, 18 aa, Entamoeba dispar
EVVMTRGNWKTQYGKAPY

SEQ ID NO: 2381889 - protein, 17 aa, Entamoeba dispar
EVVVLKPHFPLLEDIFS

SEQ ID NO: 2381890 - protein, 21 aa, Entamoeba dispar
EVWKCLNEIQNIFLKKTLPFQ

SEQ ID NO: 2381891 - protein, 24 aa, Entamoeba dispar
EVYAFKTGVLFCFAPASVFLTSVY

SEQ ID NO: 2381892 - protein, 31 aa, Entamoeba dispar
EVYCPCYSSNCILQLLPSISFFDIDHFFEGI

SEQ ID NO: 2381893 - protein, 19 aa, Entamoeba dispar
EVYDPLKLDKINEITIKID

SEQ ID NO: 2381894 - protein, 20 aa, Entamoeba dispar
EWRILARVSHCYCDGMAAMR

SEQ ID NO: 2381895 - protein, 20 aa, Entamoeba dispar
EWRLKEAKATIIVLHGYGEY

SEQ ID NO: 2381896 - protein, 24 aa, Entamoeba dispar
EYAEYGNARICYRRGEMQPLLRAK

SEQ ID NO: 2381897 - protein, 18 aa, Entamoeba dispar
EYAIPFKYSLPIEPLAKE

SEQ ID NO: 2381898 - protein, 24 aa, Entamoeba dispar
EYAKNYRRPMEFRCLNQFTNELCS

SEQ ID NO: 2381899 - protein, 23 aa, Entamoeba dispar
EYARYHRRMGLFSPAITLLGELE

SEQ ID NO: 2381900 - protein, 20 aa, Entamoeba dispar
EYCEKHPKFIILLPSKNEAA

SEQ ID NO: 2381901 - protein, 40 aa, Entamoeba dispar
EYCKSNRGCCSSCKTMLAEGKLKVGMEVVSSRHDGFDIEW

SEQ ID NO: 2381902 - protein, 17 aa, Entamoeba dispar
EYCLIVVDIFYKLIDSQ

SEQ ID NO: 2381903 - protein, 27 aa, Entamoeba dispar
EYDELILCPTCLILGVDKYSAIPLKEI

SEQ ID NO: 2381904 - protein, 23 aa, Entamoeba dispar
EYEENYCVFWCERENTLGKYVNM

SEQ ID NO: 2381905 - protein, 27 aa, Entamoeba dispar
EYEFSESITTFFLFIGIHFFFLSGHAF

SEQ ID NO: 2381906 - protein, 19 aa, Entamoeba dispar
EYFHFMNFLSYYEIAVLRL

SEQ ID NO: 2381907 - protein, 24 aa, Entamoeba dispar
EYFILRPLFHSLLPFSLPKLHRRE

SEQ ID NO: 2381908 - protein, 17 aa, Entamoeba dispar
EYFIVIIVFKYYLLYSI

SEQ ID NO: 2381909 - protein, 19 aa, Entamoeba dispar
EYFIVTGLYLQIYEIKKRE

SEQ ID NO: 2381910 - protein, 20 aa, Entamoeba dispar
EYFLPIFSGQPFEGYLTSTY

SEQ ID NO: 2381911 - protein, 21 aa, Entamoeba dispar
EYGCKECLTGYYLINKECSKC

SEQ ID NO: 2381912 - protein, 20 aa, Entamoeba dispar
EYGCRECLTGYYLINKECSK

SEQ ID NO: 2381913 - protein, 18 aa, Entamoeba dispar
EYHLDVFNSVPFDRLLIT

SEQ ID NO: 2381914 - protein, 18 aa, Entamoeba dispar
EYHRGLWITMDGYNLMIY

SEQ ID NO: 2381915 - protein, 22 aa, Entamoeba dispar
EYHYTFYIDLFLPHMLNGDLNI

SEQ ID NO: 2381916 - protein, 18 aa, Entamoeba dispar
EYIDLSKMILVFSSDPGI

SEQ ID NO: 2381917 - protein, 19 aa, Entamoeba dispar
EYIFCTLGLIGGIGAGAAF

SEQ ID NO: 2381918 - protein, 29 aa, Entamoeba dispar
EYIIHFYGARCLTGYYLINKECSKCGNKC

SEQ ID NO: 2381919 - protein, 18 aa, Entamoeba dispar
EYIIHFYGAVFIPNKICM

SEQ ID NO: 2381920 - protein, 19 aa, Entamoeba dispar
EYIKAFKLKKLMLKFNLGV

SEQ ID NO: 2381921 - protein, 30 aa, Entamoeba dispar
EYILTPRLIIHLQPSIPIYVFIHSPYGKTI

SEQ ID NO: 2381922 - protein, 20 aa, Entamoeba dispar
EYIPIQWYFGMIILIIGVIL

SEQ ID NO: 2381923 - protein, 25 aa, Entamoeba dispar
EYITYRFIHRYGFDLDSGMICKDNC

SEQ ID NO: 2381924 - protein, 26 aa, Entamoeba dispar
EYKDGFKTKEFKGIDLTLATKISTIK

SEQ ID NO: 2381925 - protein, 20 aa, Entamoeba dispar
EYKETIPLRTFRLTQVDRFL

SEQ ID NO: 2381926 - protein, 21 aa, Entamoeba dispar
EYKRIVKLSGTFVDKYTHPAL

SEQ ID NO: 2381927 - protein, 17 aa, Entamoeba dispar
EYLPSINGIILIDNQYY

SEQ ID NO: 2381928 - protein, 18 aa, Entamoeba dispar
EYNKCIPGKLLVSCLNGK

SEQ ID NO: 2381929 - protein, 27 aa, Entamoeba dispar
EYPHCALNSFKNGIKMYVSDHEELYKG

SEQ ID NO: 2381930 - protein, 18 aa, Entamoeba dispar
EYQCFTVQDGINFKMKND

SEQ ID NO: 2381931 - protein, 19 aa, Entamoeba dispar
EYQCTYPGCNEGLKTKYNC

SEQ ID NO: 2381932 - protein, 18 aa, Entamoeba dispar
EYQILRMKLGYYTKDLYR

SEQ ID NO: 2381933 - protein, 27 aa, Entamoeba dispar
EYRVLIHVCCEWMKVAVQYDLEGTINI

SEQ ID NO: 2381934 - protein, 25 aa, Entamoeba dispar
EYSDRGCGINSRLIHQLSSEYDYFI

SEQ ID NO: 2381935 - protein, 20 aa, Entamoeba dispar
EYSGSELLITFSFQPGSSNY

SEQ ID NO: 2381936 - protein, 24 aa, Entamoeba dispar
EYTFTSSCNLDFVVNGEYNTFGNP

SEQ ID NO: 2381937 - protein, 22 aa, Entamoeba dispar
EYTPRGGKLFKLLTSSNYHAVN

SEQ ID NO: 2381938 - protein, 20 aa, Entamoeba dispar
EYVFPFIKNLFQTHCKDRAF

SEQ ID NO: 2381939 - protein, 23 aa, Entamoeba dispar
EYVKCAKIILGQLTLPFLNCKND

SEQ ID NO: 2381940 - protein, 24 aa, Entamoeba dispar
EYVSRLYIGPKIAPLFVNKFEHCT

SEQ ID NO: 2381941 - protein, 19 aa, Entamoeba dispar
EYWIEYFFFPNLKTCPYIY

SEQ ID NO: 2381942 - protein, 21 aa, Entamoeba dispar
EYYLYSFGFCITGILFLYCSY

SEQ ID NO: 2381943 - protein, 17 aa, Entamoeba dispar
EYYVLVFLFSFLLMISM

SEQ ID NO: 2381944 - protein, 20 aa, Entamoeba dispar
FACPRPSGVWQPFKEIDFGL

SEQ ID NO: 2381945 - protein, 24 aa, Entamoeba dispar
FAFVSVIYLCYLYNIFIDDPVFVL

SEQ ID NO: 2381946 - protein, 17 aa, Entamoeba dispar
FAIACILSCGGSVGSIP

SEQ ID NO: 2381947 - protein, 21 aa, Entamoeba dispar
FAICLIPFYEVYRGCSCWCNI

SEQ ID NO: 2381948 - protein, 25 aa, Entamoeba dispar
FAICVSTSPGIRWGISIIPRIIMCL

SEQ ID NO: 2381949 - protein, 17 aa, Entamoeba dispar
FAIIISFQIAKLSMFIF

SEQ ID NO: 2381950 - protein, 22 aa, Entamoeba dispar
FAISDQCYIYFNSDKNVLNYGK

SEQ ID NO: 2381951 - protein, 17 aa, Entamoeba dispar
FAISIYSVMTWEDPYPK

SEQ ID NO: 2381952 - protein, 17 aa, Entamoeba dispar
FAIWNFYPSMRRYKEDK

SEQ ID NO: 2381953 - protein, 20 aa, Entamoeba dispar
FAKMEACGLIYRSDSQIKRR

SEQ ID NO: 2381954 - protein, 24 aa, Entamoeba dispar
FAKTSMFYKLWLKVEDIHAELYMN

SEQ ID NO: 2381955 - protein, 17 aa, Entamoeba dispar
FALAFFWSICEYLLSNE

SEQ ID NO: 2381956 - protein, 18 aa, Entamoeba dispar
FALAISIGGLGIVHTYQV

SEQ ID NO: 2381957 - protein, 29 aa, Entamoeba dispar
FALFLTDLLRIYRRCVILEAIDRYLSIIA

SEQ ID NO: 2381958 - protein, 21 aa, Entamoeba dispar
FALQVSFRFSGITILSYLFLF

SEQ ID NO: 2381959 - protein, 19 aa, Entamoeba dispar
FALVLFKAIYFWISAPLGI

SEQ ID NO: 2381960 - protein, 35 aa, Entamoeba dispar
FAPFIDLFHAIKMIRLDIVFILLALMFGWFAFQPF

SEQ ID NO: 2381961 - protein, 19 aa, Entamoeba dispar
FARASFKTYAWVEMSMFLK

SEQ ID NO: 2381962 - protein, 21 aa, Entamoeba dispar
FAREGYRTLVLGYKIIPDSVF

SEQ ID NO: 2381963 - protein, 24 aa, Entamoeba dispar
FASEGLRTLFIAKRVFTLEEIIQW

SEQ ID NO: 2381964 - protein, 19 aa, Entamoeba dispar
FASNHVIHALAYYSTENNE

SEQ ID NO: 2381965 - protein, 26 aa, Entamoeba dispar
FASNRISIYILFGIVLIVSLFSISYY

SEQ ID NO: 2381966 - protein, 17 aa, Entamoeba dispar
FATACNFSSNLQTSSTS

SEQ ID NO: 2381967 - protein, 19 aa, Entamoeba dispar
FATKHLKTVFDYYSNHDII

SEQ ID NO: 2381968 - protein, 17 aa, Entamoeba dispar
FATTILREGSGNEFGTF

SEQ ID NO: 2381969 - protein, 17 aa, Entamoeba dispar
FATVILIMFLNDDRYNL

SEQ ID NO: 2381970 - protein, 23 aa, Entamoeba dispar
FAVCNACTIGKVIERTKKRKRRE

SEQ ID NO: 2381971 - protein, 19 aa, Entamoeba dispar
FAVCPSFVISAIITLLLLL

SEQ ID NO: 2381972 - protein, 18 aa, Entamoeba dispar
FAVLRALGLSSIKMVLIY

SEQ ID NO: 2381973 - protein, 20 aa, Entamoeba dispar
FAVSMASYFILKDQVQKLSE

SEQ ID NO: 2381974 - protein, 18 aa, Entamoeba dispar
FAVVFLKKVMLKGTIESQ

SEQ ID NO: 2381975 - protein, 23 aa, Entamoeba dispar
FCATFIIDIGVVFSVASAIFSIF

SEQ ID NO: 2381976 - protein, 17 aa, Entamoeba dispar
FCCLVSVVFYGSNYIVV

SEQ ID NO: 2381977 - protein, 19 aa, Entamoeba dispar
FCCYAVLRPLYAILGISQN

SEQ ID NO: 2381978 - protein, 17 aa, Entamoeba dispar
FCDKNLRCLSTYSDNSF

SEQ ID NO: 2381979 - protein, 25 aa, Entamoeba dispar
FCDVSKAVICARCSPQQKAEVVLAA

SEQ ID NO: 2381980 - protein, 17 aa, Entamoeba dispar
FCECTRKQKGKIVKIIQ

SEQ ID NO: 2381981 - protein, 21 aa, Entamoeba dispar
FCEKDNPFLIKCFNIDSPNEI

SEQ ID NO: 2381982 - protein, 28 aa, Entamoeba dispar
FCEPYCGKCGPGLRCISGKCGYLTTNTR

SEQ ID NO: 2381983 - protein, 30 aa, Entamoeba dispar
FCETRYEWMAMLLACCRQGIIIVTVYATLG

SEQ ID NO: 2381984 - protein, 27 aa, Entamoeba dispar
FCFVLFDIAGLYGYIAHNFEKYNKREA

SEQ ID NO: 2381985 - protein, 23 aa, Entamoeba dispar
FCGTMPLFGSYLFAYKLPFIGCS

SEQ ID NO: 2381986 - protein, 25 aa, Entamoeba dispar
FCHKCNRQSVTFPYVVITLSYLIQT

SEQ ID NO: 2381987 - protein, 17 aa, Entamoeba dispar
FCIFISFFNNLFYSSQV

SEQ ID NO: 2381988 - protein, 25 aa, Entamoeba dispar
FCISISMTIPNPWFSKTLSTWDCDE

SEQ ID NO: 2381989 - protein, 17 aa, Entamoeba dispar
FCITGILFLYCSYHIHF

SEQ ID NO: 2381990 - protein, 18 aa, Entamoeba dispar
FCKTCNSGGCISCADSSY

SEQ ID NO: 2381991 - protein, 25 aa, Entamoeba dispar
FCLNKQKFSEIVHCLNLSDKEKEIY

SEQ ID NO: 2381992 - protein, 21 aa, Entamoeba dispar
FCLVDLILCYLIFPKTSTVHR

SEQ ID NO: 2381993 - protein, 19 aa, Entamoeba dispar
FCNQCLNGYYLLNSKCNKC

SEQ ID NO: 2381994 - protein, 24 aa, Entamoeba dispar
FCNTCNFTQCLSCMLNYSLNTMNN

SEQ ID NO: 2381995 - protein, 21 aa, Entamoeba dispar
FCNTLKILYLLVGETTEILSI

SEQ ID NO: 2381996 - protein, 23 aa, Entamoeba dispar
FCPCKSTDKMGCSYIIGTNQVNG

SEQ ID NO: 2381997 - protein, 17 aa, Entamoeba dispar
FCPLCKVPFHLNTFGKN

SEQ ID NO: 2381998 - protein, 20 aa, Entamoeba dispar
FCSCEINETILFIAVDIKTN

SEQ ID NO: 2381999 - protein, 21 aa, Entamoeba dispar
FCSEIRVVLDGAKPDVLEKAC

SEQ ID NO: 2382000 - protein, 26 aa, Entamoeba dispar
FCSENYPSIHLLYLIVSYRPELFSRQ

SEQ ID NO: 2382001 - protein, 19 aa, Entamoeba dispar
FCSGGKAIGFFSAGSLKAL

SEQ ID NO: 2382002 - protein, 22 aa, Entamoeba dispar
FCTIEIGWYIYIFIHQKASLTS

SEQ ID NO: 2382003 - protein, 17 aa, Entamoeba dispar
FCVFVMFYVLVIFEALR

SEQ ID NO: 2382004 - protein, 17 aa, Entamoeba dispar
FCVTIFYAILVLIVILV

SEQ ID NO: 2382005 - protein, 24 aa, Entamoeba dispar
FCVVQMACYLRFLKERKMYKKELD

SEQ ID NO: 2382006 - protein, 27 aa, Entamoeba dispar
FCYPGTCPLLKFIVVGGLGTIIDILIF

SEQ ID NO: 2382007 - protein, 21 aa, Entamoeba dispar
FCYSACSVFTKGLKEWGSAIL

SEQ ID NO: 2382008 - protein, 18 aa, Entamoeba dispar
FCYSTCSFITKGLKEWGG

SEQ ID NO: 2382009 - protein, 23 aa, Entamoeba dispar
FDAELITPCLLICIEQYYCGMFF

SEQ ID NO: 2382010 - protein, 22 aa, Entamoeba dispar
FDASYYKIIVWILFTIFGGTCA

SEQ ID NO: 2382011 - protein, 20 aa, Entamoeba dispar
FDCKLFGFGHYETYYYDIEQ

SEQ ID NO: 2382012 - protein, 21 aa, Entamoeba dispar
FDDRTGVVMAIDLEKKKTYPR

SEQ ID NO: 2382013 - protein, 23 aa, Entamoeba dispar
FDDYREAYRWLAHNTPEGSRIMS

SEQ ID NO: 2382014 - protein, 21 aa, Entamoeba dispar
FDENLECFKGIDSPYYGQIKY

SEQ ID NO: 2382015 - protein, 17 aa, Entamoeba dispar
FDFIDNFERITEIWTKK

SEQ ID NO: 2382016 - protein, 19 aa, Entamoeba dispar
FDFSSRPLVSATLQEPNKS

SEQ ID NO: 2382017 - protein, 19 aa, Entamoeba dispar
FDFSYDIITIIGLDKPIIY

SEQ ID NO: 2382018 - protein, 18 aa, Entamoeba dispar
FDGIITVRCDPFNDFDFS

SEQ ID NO: 2382019 - protein, 17 aa, Entamoeba dispar
FDGITGFITASVISTLR

SEQ ID NO: 2382020 - protein, 18 aa, Entamoeba dispar
FDHGKYLFMINEFDQNNL

SEQ ID NO: 2382021 - protein, 18 aa, Entamoeba dispar
FDHHCPWINQCVGEKNCK

SEQ ID NO: 2382022 - protein, 43 aa, Entamoeba dispar
FDHLKKLEIIDCPMPFFIFEWHYLWYVHAFNFEISLRVFDFIL

SEQ ID NO: 2382023 - protein, 24 aa, Entamoeba dispar
FDIAHAAIMFYSFYSFQINCDNYD

SEQ ID NO: 2382024 - protein, 22 aa, Entamoeba dispar
FDIKIEPPIAIIKKGKAVEIQI

SEQ ID NO: 2382025 - protein, 21 aa, Entamoeba dispar
FDIRYCNIVFISLPYNKQIMV

SEQ ID NO: 2382026 - protein, 22 aa, Entamoeba dispar
FDKKYSLDFCLKCNTIKQPRVT

SEQ ID NO: 2382027 - protein, 26 aa, Entamoeba dispar
FDLHIVCFFIPLGIYFMLKNITDESI

SEQ ID NO: 2382028 - protein, 20 aa, Entamoeba dispar
FDLILRKGIIGQIYNIGTTR

SEQ ID NO: 2382029 - protein, 21 aa, Entamoeba dispar
FDLRDCKRIPRNISKKILTQI

SEQ ID NO: 2382030 - protein, 17 aa, Entamoeba dispar
FDLYHSSIINFILPFRQ

SEQ ID NO: 2382031 - protein, 26 aa, Entamoeba dispar
FDNFGPRGTLIFSFIFGTIGYLLFAL

SEQ ID NO: 2382032 - protein, 21 aa, Entamoeba dispar
FDNGKAEGFCTWLDTAEQGEL

SEQ ID NO: 2382033 - protein, 27 aa, Entamoeba dispar
FDNSDTCPICYSLFYLRTTTIPNVACK

SEQ ID NO: 2382034 - protein, 24 aa, Entamoeba dispar
FDNSLRLVSFVLKKPIKPEFGENQ

SEQ ID NO: 2382035 - protein, 20 aa, Entamoeba dispar
FDPHCLECDESPMVCTKCNG

SEQ ID NO: 2382036 - protein, 17 aa, Entamoeba dispar
FDRTFILNLDKKIKDLH

SEQ ID NO: 2382037 - protein, 20 aa, Entamoeba dispar
FDRTPKVWLLGYDEDHKPLT

SEQ ID NO: 2382038 - protein, 18 aa, Entamoeba dispar
FDSCRSCIDNTKVVNGEC

SEQ ID NO: 2382039 - protein, 17 aa, Entamoeba dispar
FDSMPIDVIERINYINE

SEQ ID NO: 2382040 - protein, 18 aa, Entamoeba dispar
FDSTLIIDKNWNSVQPTK

SEQ ID NO: 2382041 - protein, 19 aa, Entamoeba dispar
FDTLFIFSLFELITLTYNK

SEQ ID NO: 2382042 - protein, 21 aa, Entamoeba dispar
FDVTGSFSFMLCFSLPCIFHY

SEQ ID NO: 2382043 - protein, 17 aa, Entamoeba dispar
FDVYKYQCNVKCNPHSV

SEQ ID NO: 2382044 - protein, 20 aa, Entamoeba dispar
FDVYSFFLTKSFDCEPLIKH

SEQ ID NO: 2382045 - protein, 17 aa, Entamoeba dispar
FEAILIPHCSCTINDYF

SEQ ID NO: 2382046 - protein, 17 aa, Entamoeba dispar
FEAKGRYIQFSLDSNSD

SEQ ID NO: 2382047 - protein, 30 aa, Entamoeba dispar
FEAPLAFMSMSLLHFMHLKGKYYYKNNDKT

SEQ ID NO: 2382048 - protein, 18 aa, Entamoeba dispar
FECNKCGINYGLKTKCEL

SEQ ID NO: 2382049 - protein, 21 aa, Entamoeba dispar
FEDFPINEIILIINTIVSITA

SEQ ID NO: 2382050 - protein, 17 aa, Entamoeba dispar
FEDISGIKAKGKSLRIL

SEQ ID NO: 2382051 - protein, 23 aa, Entamoeba dispar
FEECHCLLCQRGFLKFEKKPTWN

SEQ ID NO: 2382052 - protein, 18 aa, Entamoeba dispar
FEEDSLEIPKLVRLASKK

SEQ ID NO: 2382053 - protein, 17 aa, Entamoeba dispar
FEEFRFFTEIEDKVISG

SEQ ID NO: 2382054 - protein, 18 aa, Entamoeba dispar
FEESRDGFNKVFKRNSLA

SEQ ID NO: 2382055 - protein, 17 aa, Entamoeba dispar
FEFKHLPKTILKLVNKY

SEQ ID NO: 2382056 - protein, 18 aa, Entamoeba dispar
FEGDVMVGHGIFVSSTFI

SEQ ID NO: 2382057 - protein, 18 aa, Entamoeba dispar
FEGISWVFNYYLNKLPSW

SEQ ID NO: 2382058 - protein, 19 aa, Entamoeba dispar
FEGTSQFSAILLKNLLNLC

SEQ ID NO: 2382059 - protein, 18 aa, Entamoeba dispar
FEGVLRFFSEMNVVTHSK

SEQ ID NO: 2382060 - protein, 20 aa, Entamoeba dispar
FEHPMFLTFMMFVGMMLCLF

SEQ ID NO: 2382061 - protein, 17 aa, Entamoeba dispar
FEIRVGLDVNDTAFQDG

SEQ ID NO: 2382062 - protein, 17 aa, Entamoeba dispar
FEISCTLDFSEYDQTSY

SEQ ID NO: 2382063 - protein, 23 aa, Entamoeba dispar
FEKANILFILGIFIPLLQCMNWM

SEQ ID NO: 2382064 - protein, 17 aa, Entamoeba dispar
FEKEVAMLDKFRNEYLV

SEQ ID NO: 2382065 - protein, 33 aa, Entamoeba dispar
FEKGLCIIQNILACSVYSGDLCTNPYNKLPMVY

SEQ ID NO: 2382066 - protein, 25 aa, Entamoeba dispar
FELEEVKDPLFLLAVSGGGLVVNII

SEQ ID NO: 2382067 - protein, 26 aa, Entamoeba dispar
FELLIDIATDFGFIFITSKMKNKFNR

SEQ ID NO: 2382068 - protein, 17 aa, Entamoeba dispar
FELPISIEPLRPNESKK

SEQ ID NO: 2382069 - protein, 24 aa, Entamoeba dispar
FEMTMRVVFHLYKPITNHYMNDIL

SEQ ID NO: 2382070 - protein, 26 aa, Entamoeba dispar
FENEGKCGDGIWDWFSEECDGTSGCG

SEQ ID NO: 2382071 - protein, 19 aa, Entamoeba dispar
FENRVWLNLIGRLMISIII

SEQ ID NO: 2382072 - protein, 28 aa, Entamoeba dispar
FEPKCIKLQPGFGQSVIIKFEFLCTTKV

SEQ ID NO: 2382073 - protein, 17 aa, Entamoeba dispar
FEPLPFSTQTISVFEKL

SEQ ID NO: 2382074 - protein, 17 aa, Entamoeba dispar
FEQFVCSKVRVLYKLNW

SEQ ID NO: 2382075 - protein, 35 aa, Entamoeba dispar
FERIKANLFLANFIRDLMRFWKLTYVVGLIDMVMD

SEQ ID NO: 2382076 - protein, 17 aa, Entamoeba dispar
FERQRSVFFGTFVQIFI

SEQ ID NO: 2382077 - protein, 23 aa, Entamoeba dispar
FESKRYILFFILILIVFSSFIIF

SEQ ID NO: 2382078 - protein, 23 aa, Entamoeba dispar
FESMIKHAWLAVEDFELSEQWFA

SEQ ID NO: 2382079 - protein, 17 aa, Entamoeba dispar
FETRTAAGIAVEAMAKN

SEQ ID NO: 2382080 - protein, 22 aa, Entamoeba dispar
FETYRMCGMECIDRFKDSSPLI

SEQ ID NO: 2382081 - protein, 24 aa, Entamoeba dispar
FEVKGRIIEMISIIATKLNDKYIG

SEQ ID NO: 2382082 - protein, 19 aa, Entamoeba dispar
FEVLIQFILQKCSYFEVII

SEQ ID NO: 2382083 - protein, 32 aa, Entamoeba dispar
FEWHIPLKYLWPSIRVVLYRTVYGLIYGLTIY

SEQ ID NO: 2382084 - protein, 23 aa, Entamoeba dispar
FEYKELICQISLCLNCISCCSIP

SEQ ID NO: 2382085 - protein, 24 aa, Entamoeba dispar
FEYKELICQISLCLNCISCCSIPL

SEQ ID NO: 2382086 - protein, 28 aa, Entamoeba dispar
FEYVFPLLSSILLCFSLIDIFDINDFYF

SEQ ID NO: 2382087 - protein, 17 aa, Entamoeba dispar
FFAFSVMLITCIVQLIV

SEQ ID NO: 2382088 - protein, 18 aa, Entamoeba dispar
FFAPYLSMKGFDILTDGF

SEQ ID NO: 2382089 - protein, 25 aa, Entamoeba dispar
FFATWCGPCKMIAPYFEELARTNPS

SEQ ID NO: 2382090 - protein, 20 aa, Entamoeba dispar
FFCGKYLLSGDIGFGEIGIG

SEQ ID NO: 2382091 - protein, 21 aa, Entamoeba dispar
FFCIVIGYYGVMEFFVVDPRS

SEQ ID NO: 2382092 - protein, 17 aa, Entamoeba dispar
FFCVMLLIAVCNPYLSV

SEQ ID NO: 2382093 - protein, 28 aa, Entamoeba dispar
FFDKHWLELSVMLSWVFIIVFAAIIHGQ

SEQ ID NO: 2382094 - protein, 23 aa, Entamoeba dispar
FFECIKFNFLKERTHEQEIIIIQ

SEQ ID NO: 2382095 - protein, 25 aa, Entamoeba dispar
FFENCSKAQCSLELQMKGEVNKEED

SEQ ID NO: 2382096 - protein, 17 aa, Entamoeba dispar
FFESFGWLMKLNNNNII

SEQ ID NO: 2382097 - protein, 27 aa, Entamoeba dispar
FFFNLLKFKSLIFSLLTLFSFSSDSLR

SEQ ID NO: 2382098 - protein, 28 aa, Entamoeba dispar
FFFRVLDRIYFIIGIIICALILKYFIKR

SEQ ID NO: 2382099 - protein, 27 aa, Entamoeba dispar
FFFYHLFCFITFYLLFIFSTFYFYSLF

SEQ ID NO: 2382100 - protein, 20 aa, Entamoeba dispar
FFGACCLKDHICIVTEYAEY

SEQ ID NO: 2382101 - protein, 17 aa, Entamoeba dispar
FFGEKGLQIKQIVNKCW

SEQ ID NO: 2382102 - protein, 18 aa, Entamoeba dispar
FFGLILFLLNSFKATFVL

SEQ ID NO: 2382103 - protein, 20 aa, Entamoeba dispar
FFIDLHKFLLLKVVCCSIIL

SEQ ID NO: 2382104 - protein, 17 aa, Entamoeba dispar
FFIFCSYALGNWYGSIV

SEQ ID NO: 2382105 - protein, 17 aa, Entamoeba dispar
FFIFCSYALGSWYGSIV

SEQ ID NO: 2382106 - protein, 19 aa, Entamoeba dispar
FFIGLLYHRLNKIIKSDLE

SEQ ID NO: 2382107 - protein, 18 aa, Entamoeba dispar
FFIGWHMVMAIGGADMPV

SEQ ID NO: 2382108 - protein, 19 aa, Entamoeba dispar
FFIGWHMVMAIGGADMPVV

SEQ ID NO: 2382109 - protein, 17 aa, Entamoeba dispar
FFILCSFISYCFAFFSI

SEQ ID NO: 2382110 - protein, 17 aa, Entamoeba dispar
FFIMYFAQTIMFGIMSI

SEQ ID NO: 2382111 - protein, 18 aa, Entamoeba dispar
FFIPVCWLVNICLCCCKF

SEQ ID NO: 2382112 - protein, 19 aa, Entamoeba dispar
FFISFCIGEVCKKADGNDI

SEQ ID NO: 2382113 - protein, 19 aa, Entamoeba dispar
FFISFCIGEVCKKVDKNDF

SEQ ID NO: 2382114 - protein, 25 aa, Entamoeba dispar
FFKNPHISNGLPFYIISANKSFSQV

SEQ ID NO: 2382115 - protein, 24 aa, Entamoeba dispar
FFLFSRYILIFLFLFIILIHVYII

SEQ ID NO: 2382116 - protein, 23 aa, Entamoeba dispar
FFLPTRFAMTFTFGNILIFIGTS

SEQ ID NO: 2382117 - protein, 18 aa, Entamoeba dispar
FFLSKGRLIVLRRFVTLM

SEQ ID NO: 2382118 - protein, 19 aa, Entamoeba dispar
FFLSLFWVFSFFNLRCQCL

SEQ ID NO: 2382119 - protein, 23 aa, Entamoeba dispar
FFMSLEFGKCYYLDDSESEIITH

SEQ ID NO: 2382120 - protein, 17 aa, Entamoeba dispar
FFNCCLILLQLFVAGLI

SEQ ID NO: 2382121 - protein, 25 aa, Entamoeba dispar
FFNKSSNLLTLWKAPIYSVFSSNNA

SEQ ID NO: 2382122 - protein, 20 aa, Entamoeba dispar
FFRNEDWFPAQLFGQGKQDL

SEQ ID NO: 2382123 - protein, 17 aa, Entamoeba dispar
FFRTLFFRQTMHQLLKG

SEQ ID NO: 2382124 - protein, 24 aa, Entamoeba dispar
FFSDYIFCITFFIVGWITNNDSDS

SEQ ID NO: 2382125 - protein, 29 aa, Entamoeba dispar
FFSSFCSFSSFFFFGNSHINPFLLAILYT

SEQ ID NO: 2382126 - protein, 23 aa, Entamoeba dispar
FFSSSILLKLIIFFMLFLTNSIY

SEQ ID NO: 2382127 - protein, 26 aa, Entamoeba dispar
FFTDEIRVQLPFPLREKYHLLITVLF

SEQ ID NO: 2382128 - protein, 26 aa, Entamoeba dispar
FFTVTELFWRIAFVCVGSIQLMTFMY

SEQ ID NO: 2382129 - protein, 19 aa, Entamoeba dispar
FFVMTRFPLVNNIKTKENL

SEQ ID NO: 2382130 - protein, 18 aa, Entamoeba dispar
FFVNSGFNVFMLDLPGHG

SEQ ID NO: 2382131 - protein, 24 aa, Entamoeba dispar
FFVVLARPGFRVSRRKRMQDKIGR

SEQ ID NO: 2382132 - protein, 17 aa, Entamoeba dispar
FFVWYIYSIHSFFTTTH

SEQ ID NO: 2382133 - protein, 18 aa, Entamoeba dispar
FFYFLPFEINIDNDKKMY

SEQ ID NO: 2382134 - protein, 17 aa, Entamoeba dispar
FGALKYFGANDDFLGYH

SEQ ID NO: 2382135 - protein, 25 aa, Entamoeba dispar
FGCMFLLIDLMRNWFLSSNDNLPNG

SEQ ID NO: 2382136 - protein, 19 aa, Entamoeba dispar
FGCQRCNLGYFLYDGQCIS

SEQ ID NO: 2382137 - protein, 25 aa, Entamoeba dispar
FGDSDMKLYLLVGGKVKDKVVLRRI

SEQ ID NO: 2382138 - protein, 24 aa, Entamoeba dispar
FGELKHCLFFVISFKILFVHIHFI

SEQ ID NO: 2382139 - protein, 26 aa, Entamoeba dispar
FGELNWWPRKRPVKFNTYSEFLEHQT

SEQ ID NO: 2382140 - protein, 18 aa, Entamoeba dispar
FGEWCIQKIIGTEENKKF

SEQ ID NO: 2382141 - protein, 20 aa, Entamoeba dispar
FGFLSGFLYNKFVYMKDKRV

SEQ ID NO: 2382142 - protein, 21 aa, Entamoeba dispar
FGFRIKRPERRSQKTLQLMLI

SEQ ID NO: 2382143 - protein, 24 aa, Entamoeba dispar
FGGCCSFIIFSFIGSLVFEYIIFE

SEQ ID NO: 2382144 - protein, 18 aa, Entamoeba dispar
FGGGNGMAGLSLDKDLHC

SEQ ID NO: 2382145 - protein, 17 aa, Entamoeba dispar
FGGVHGLCELLNVDEKK

SEQ ID NO: 2382146 - protein, 17 aa, Entamoeba dispar
FGICVVEYMGFGVIPVA

SEQ ID NO: 2382147 - protein, 25 aa, Entamoeba dispar
FGIFAEFITALTLAARVEESRQKII

SEQ ID NO: 2382148 - protein, 19 aa, Entamoeba dispar
FGIIAFRTHPIFTLITEHK

SEQ ID NO: 2382149 - protein, 24 aa, Entamoeba dispar
FGKCGFSWVPVVIIILIFGFLFFV

SEQ ID NO: 2382150 - protein, 24 aa, Entamoeba dispar
FGKEYIRLRCPHAQFTEAKSSESD

SEQ ID NO: 2382151 - protein, 21 aa, Entamoeba dispar
FGKNEVWYKFNGIEGRNITVD

SEQ ID NO: 2382152 - protein, 18 aa, Entamoeba dispar
FGLCLCMILIIGGVQSFA

SEQ ID NO: 2382153 - protein, 19 aa, Entamoeba dispar
FGLILTLFVLWNFKVGQPA

SEQ ID NO: 2382154 - protein, 29 aa, Entamoeba dispar
FGLPVPYPLLWCRYSFFIVLYPMGVSGEV

SEQ ID NO: 2382155 - protein, 17 aa, Entamoeba dispar
FGLVLMATFIKRFPFNF

SEQ ID NO: 2382156 - protein, 17 aa, Entamoeba dispar
FGLVVEIIFTLRFFLYF

SEQ ID NO: 2382157 - protein, 26 aa, Entamoeba dispar
FGLYLATLLLFWGFTIKYCNNISFYY

SEQ ID NO: 2382158 - protein, 24 aa, Entamoeba dispar
FGMVTCLPGAFSMIRPQAMETVLN

SEQ ID NO: 2382159 - protein, 24 aa, Entamoeba dispar
FGPEWCPYTIILLNMISLVIVTLI

SEQ ID NO: 2382160 - protein, 24 aa, Entamoeba dispar
FGPLFYRLIKVIFMPKTTAPQTIS

SEQ ID NO: 2382161 - protein, 19 aa, Entamoeba dispar
FGPPDELFIIPAVMTVLDP

SEQ ID NO: 2382162 - protein, 20 aa, Entamoeba dispar
FGQKKIKIFNGFYSTATELA

SEQ ID NO: 2382163 - protein, 21 aa, Entamoeba dispar
FGQSELCLRWQSLIEQSLTPK

SEQ ID NO: 2382164 - protein, 21 aa, Entamoeba dispar
FGRKASLLSINMLRNIVTQAI

SEQ ID NO: 2382165 - protein, 26 aa, Entamoeba dispar
FGRVICLITSLPGFVLLLLLFSIDIS

SEQ ID NO: 2382166 - protein, 17 aa, Entamoeba dispar
FGSAISLFIATNICESI

SEQ ID NO: 2382167 - protein, 20 aa, Entamoeba dispar
FGSCVIGLFVSYFSAFVMNK

SEQ ID NO: 2382168 - protein, 26 aa, Entamoeba dispar
FGSHIFKDIRLMVSLVGIFFILPMTG

SEQ ID NO: 2382169 - protein, 17 aa, Entamoeba dispar
FGSKAFPSTAYDLVRIA

SEQ ID NO: 2382170 - protein, 17 aa, Entamoeba dispar
FGSRMLLPNDNGHRTLI

SEQ ID NO: 2382171 - protein, 17 aa, Entamoeba dispar
FGTAYGVVGRKLVGLKI

SEQ ID NO: 2382172 - protein, 20 aa, Entamoeba dispar
FGTKAVELFTSYKKADSSKS

SEQ ID NO: 2382173 - protein, 20 aa, Entamoeba dispar
FGVCCLEIIIEWWKERKGQT

SEQ ID NO: 2382174 - protein, 18 aa, Entamoeba dispar
FGVFAPMYFIVVVMLITL

SEQ ID NO: 2382175 - protein, 17 aa, Entamoeba dispar
FGVLAFLLGIFTRMALF

SEQ ID NO: 2382176 - protein, 26 aa, Entamoeba dispar
FGVLAKLCLAETFSIFETFINLFIEN

SEQ ID NO: 2382177 - protein, 20 aa, Entamoeba dispar
FGVREMVWSNTFLNVTKSSA

SEQ ID NO: 2382178 - protein, 21 aa, Entamoeba dispar
FGVTFFLIFFVDRVIVPHSHG

SEQ ID NO: 2382179 - protein, 18 aa, Entamoeba dispar
FGWMSFVAFDSCNTELFH

SEQ ID NO: 2382180 - protein, 24 aa, Entamoeba dispar
FGYIPELFLWHGRNAYKRTSLLSH

SEQ ID NO: 2382181 - protein, 18 aa, Entamoeba dispar
FHFDHIIITFGLKNKNIK

SEQ ID NO: 2382182 - protein, 17 aa, Entamoeba dispar
FHFSRSSFIFNVLLELF

SEQ ID NO: 2382183 - protein, 18 aa, Entamoeba dispar
FHHWQYVLSLNIIVQIII

SEQ ID NO: 2382184 - protein, 17 aa, Entamoeba dispar
FHMTFGVILSFFNHLHE

SEQ ID NO: 2382185 - protein, 23 aa, Entamoeba dispar
FHPKLIFRLYKGVPCNKRQDLWK

SEQ ID NO: 2382186 - protein, 20 aa, Entamoeba dispar
FHPSTLWTSFSYLSLYVKGV

SEQ ID NO: 2382187 - protein, 18 aa, Entamoeba dispar
FHRARKLLLEKVSELDKR

SEQ ID NO: 2382188 - protein, 19 aa, Entamoeba dispar
FHRKYPFFTGKFVLPNGTS

SEQ ID NO: 2382189 - protein, 18 aa, Entamoeba dispar
FHSIFLLNGELKITEPIV

SEQ ID NO: 2382190 - protein, 18 aa, Entamoeba dispar
FHSKRLHYSLSLTFKIIV

SEQ ID NO: 2382191 - protein, 18 aa, Entamoeba dispar
FHSNCFIENKYYRISLQQ

SEQ ID NO: 2382192 - protein, 19 aa, Entamoeba dispar
FHSSRWLQSSIIMFIVYLF

SEQ ID NO: 2382193 - protein, 17 aa, Entamoeba dispar
FHVFWKFYYYHFLYSFY

SEQ ID NO: 2382194 - protein, 25 aa, Entamoeba dispar
FHVSLILYCFFKILFHSLICDALQQ

SEQ ID NO: 2382195 - protein, 25 aa, Entamoeba dispar
FIADVMITFYLYCGWMDQLTEKLAD

SEQ ID NO: 2382196 - protein, 27 aa, Entamoeba dispar
FIALCIMLPIIICMKDFKWTMDPTQCF

SEQ ID NO: 2382197 - protein, 18 aa, Entamoeba dispar
FIASPWKQLILICRPVRF

SEQ ID NO: 2382198 - protein, 26 aa, Entamoeba dispar
FIATFCFCFMLSFWFSIVYLFCVSLG

SEQ ID NO: 2382199 - protein, 17 aa, Entamoeba dispar
FICCALSESFIMNLESD

SEQ ID NO: 2382200 - protein, 24 aa, Entamoeba dispar
FIDEPYFRGCYPCDPGTYRDERLI

SEQ ID NO: 2382201 - protein, 25 aa, Entamoeba dispar
FIDIPRLAPKVQIFKDSLLVVSGPK

SEQ ID NO: 2382202 - protein, 17 aa, Entamoeba dispar
FIDLIVVMMEMREGVDL

SEQ ID NO: 2382203 - protein, 21 aa, Entamoeba dispar
FIEDCLCVFMEFEVRKIALQL

SEQ ID NO: 2382204 - protein, 20 aa, Entamoeba dispar
FIEECYRKSMKDFNEINNRE

SEQ ID NO: 2382205 - protein, 17 aa, Entamoeba dispar
FIEILKVVYSISMREKI

SEQ ID NO: 2382206 - protein, 20 aa, Entamoeba dispar
FIEKELETFISQGRLAAQID

SEQ ID NO: 2382207 - protein, 18 aa, Entamoeba dispar
FIETYRFNYEYNERIPRE

SEQ ID NO: 2382208 - protein, 19 aa, Entamoeba dispar
FIFHIVYYISIFFNLILPY

SEQ ID NO: 2382209 - protein, 21 aa, Entamoeba dispar
FIFIETFKRKLIINFNNKIFI

SEQ ID NO: 2382210 - protein, 28 aa, Entamoeba dispar
FIFPKLIKHWLFWYVFSMIIFVFSVGGL

SEQ ID NO: 2382211 - protein, 17 aa, Entamoeba dispar
FIFRKKSTVDWIGHVSF

SEQ ID NO: 2382212 - protein, 17 aa, Entamoeba dispar
FIGCSSSLIGIMIIWIL

SEQ ID NO: 2382213 - protein, 19 aa, Entamoeba dispar
FIGECFSIWGISNNLGPSG

SEQ ID NO: 2382214 - protein, 23 aa, Entamoeba dispar
FIGFYCLFSNAITCTLKTDLSEG

SEQ ID NO: 2382215 - protein, 26 aa, Entamoeba dispar
FIGRILIPYWIFLILIGCVSGIVHWK

SEQ ID NO: 2382216 - protein, 18 aa, Entamoeba dispar
FIGSFKFGSFTLGSSDDS

SEQ ID NO: 2382217 - protein, 21 aa, Entamoeba dispar
FIGSPWCYFVAIYEAILFILM

SEQ ID NO: 2382218 - protein, 17 aa, Entamoeba dispar
FIHPLNYLIESIEYHPN

SEQ ID NO: 2382219 - protein, 18 aa, Entamoeba dispar
FIHTRNQITLTFQRVLCS

SEQ ID NO: 2382220 - protein, 17 aa, Entamoeba dispar
FIIDIYSVYSFVKFGSP

SEQ ID NO: 2382221 - protein, 24 aa, Entamoeba dispar
FIIGGEIIILFAFGILDIKQQLDA

SEQ ID NO: 2382222 - protein, 23 aa, Entamoeba dispar
FIIHYYRFSVIFIIILDILEVIK

SEQ ID NO: 2382223 - protein, 18 aa, Entamoeba dispar
FIIIGIPIIIIFLFIIIF

SEQ ID NO: 2382224 - protein, 17 aa, Entamoeba dispar
FIIIRFISLGAFNGKAS

SEQ ID NO: 2382225 - protein, 18 aa, Entamoeba dispar
FIIKKGVSITVVFIMVLI

SEQ ID NO: 2382226 - protein, 29 aa, Entamoeba dispar
FIIKQIRHSWVIKVIFRIISAPWKKVYFK

SEQ ID NO: 2382227 - protein, 18 aa, Entamoeba dispar
FIITFGYLLYRHIYLYFN

SEQ ID NO: 2382228 - protein, 19 aa, Entamoeba dispar
FIITKAGSIIIYRIFLDDR

SEQ ID NO: 2382229 - protein, 20 aa, Entamoeba dispar
FIIYNLRKGLPVANHITPTN

SEQ ID NO: 2382230 - protein, 19 aa, Entamoeba dispar
FIKCSIDGYIFEETGNGII

SEQ ID NO: 2382231 - protein, 24 aa, Entamoeba dispar
FIKDIKIQLNMSFKRDQNGHVICV

SEQ ID NO: 2382232 - protein, 17 aa, Entamoeba dispar
FIKKLCYNFFDSYSSDK

SEQ ID NO: 2382233 - protein, 18 aa, Entamoeba dispar
FIKLRYYFVWEFGELLSI

SEQ ID NO: 2382234 - protein, 23 aa, Entamoeba dispar
FIKSCINYLPSLVIKDINNFISF

SEQ ID NO: 2382235 - protein, 17 aa, Entamoeba dispar
FILCMCLIYSIVILAYN

SEQ ID NO: 2382236 - protein, 18 aa, Entamoeba dispar
FILCMCLIYSIVILAYNL

SEQ ID NO: 2382237 - protein, 18 aa, Entamoeba dispar
FILFLDFLHLYISMVKLH

SEQ ID NO: 2382238 - protein, 31 aa, Entamoeba dispar
FILFLQLPYTFSFPWLNAVIVYFISIVVSVS

SEQ ID NO: 2382239 - protein, 17 aa, Entamoeba dispar
FILFTISLTICYILFTP

SEQ ID NO: 2382240 - protein, 24 aa, Entamoeba dispar
FILGKRGVAVLPLYSIFHKQQDKF

SEQ ID NO: 2382241 - protein, 20 aa, Entamoeba dispar
FILKEMYIDFNVNRTQINQI

SEQ ID NO: 2382242 - protein, 28 aa, Entamoeba dispar
FILTRVSPRFVLYFVFYLINLYLSFSKF

SEQ ID NO: 2382243 - protein, 19 aa, Entamoeba dispar
FILYICIYSYLLVTYTINF

SEQ ID NO: 2382244 - protein, 25 aa, Entamoeba dispar
FIMSSNALGSWYGNFVVRGKGGTDN

SEQ ID NO: 2382245 - protein, 22 aa, Entamoeba dispar
FINESICLKKIILKLPLESQID

SEQ ID NO: 2382246 - protein, 29 aa, Entamoeba dispar
FINKTSYRFGFPYQYSFIVLLIFQAICIA

SEQ ID NO: 2382247 - protein, 17 aa, Entamoeba dispar
FINVTVIDPIKIRSVTT

SEQ ID NO: 2382248 - protein, 17 aa, Entamoeba dispar
FINYAYCIDLFYKTKYF

SEQ ID NO: 2382249 - protein, 24 aa, Entamoeba dispar
FIPADRVPLFIFIKSCLKSILAIN

SEQ ID NO: 2382250 - protein, 17 aa, Entamoeba dispar
FIPSKKQYISWVMALFE

SEQ ID NO: 2382251 - protein, 22 aa, Entamoeba dispar
FIQLKFGIIVERILGSSWYFIM

SEQ ID NO: 2382252 - protein, 26 aa, Entamoeba dispar
FIQNMIISFFLCWFVIGIGAICGFRL

SEQ ID NO: 2382253 - protein, 29 aa, Entamoeba dispar
FIQQPRLLLRIKYEYPFEMIEKGISNEGA

SEQ ID NO: 2382254 - protein, 21 aa, Entamoeba dispar
FIQRMGMVMIFIYSIVFRYFA

SEQ ID NO: 2382255 - protein, 23 aa, Entamoeba dispar
FISACPAFYWGLLWLTEQKQFGV

SEQ ID NO: 2382256 - protein, 20 aa, Entamoeba dispar
FISCCPCALDNPLPWKFFPT

SEQ ID NO: 2382257 - protein, 17 aa, Entamoeba dispar
FISCLWYSQYIKKINEV

SEQ ID NO: 2382258 - protein, 18 aa, Entamoeba dispar
FISQIIVTCWNHDPRIKA

SEQ ID NO: 2382259 - protein, 33 aa, Entamoeba dispar
FISYLYCIDFLFKTRYFLIGVISYCFGIIGTIL

SEQ ID NO: 2382260 - protein, 26 aa, Entamoeba dispar
FISYNGKYRFNGVCNLVTLHLECAFD

SEQ ID NO: 2382261 - protein, 17 aa, Entamoeba dispar
FITEIYIVISILLFIIS

SEQ ID NO: 2382262 - protein, 23 aa, Entamoeba dispar
FITELIGTFLLNFVADGIYTNLF

SEQ ID NO: 2382263 - protein, 19 aa, Entamoeba dispar
FITKRGLNCLITIIISSII

SEQ ID NO: 2382264 - protein, 17 aa, Entamoeba dispar
FITLLLLVYTICVYLIT

SEQ ID NO: 2382265 - protein, 17 aa, Entamoeba dispar
FITNIGVIFSIGAAIFS

SEQ ID NO: 2382266 - protein, 18 aa, Entamoeba dispar
FIVGIINLFCELMPKILV

SEQ ID NO: 2382267 - protein, 24 aa, Entamoeba dispar
FIVKPPRMREVRTFTARKSTEDDW

SEQ ID NO: 2382268 - protein, 43 aa, Entamoeba dispar
FIVLGRWSYWQYKQRFNLLALCIMLVVALGLLFSPNGWIVMIF

SEQ ID NO: 2382269 - protein, 19 aa, Entamoeba dispar
FIVLICILGSIIVILIIAG

SEQ ID NO: 2382270 - protein, 20 aa, Entamoeba dispar
FIVLICILGSIIVILIIAGV

SEQ ID NO: 2382271 - protein, 27 aa, Entamoeba dispar
FIVLTITFFLAFFLYRRSFKVTEVSEI

SEQ ID NO: 2382272 - protein, 17 aa, Entamoeba dispar
FIVPLVGVLLFFIGAVC

SEQ ID NO: 2382273 - protein, 26 aa, Entamoeba dispar
FIVSFALSCIACWIVFIYQPTFKPKV

SEQ ID NO: 2382274 - protein, 17 aa, Entamoeba dispar
FIWHCYGLYNSYSLLQQ

SEQ ID NO: 2382275 - protein, 17 aa, Entamoeba dispar
FIYCCKPQNIPDVFVHL

SEQ ID NO: 2382276 - protein, 18 aa, Entamoeba dispar
FIYCCWSETTEMTWCDSN

SEQ ID NO: 2382277 - protein, 23 aa, Entamoeba dispar
FIYKSRVTVMAALIFFVLSIPHK

SEQ ID NO: 2382278 - protein, 22 aa, Entamoeba dispar
FIYNMFCGNSIIQIIPKSVKIE

SEQ ID NO: 2382279 - protein, 18 aa, Entamoeba dispar
FKAERALEALENADVIHV

SEQ ID NO: 2382280 - protein, 21 aa, Entamoeba dispar
FKAGDKIAIFCETRYEWMAML

SEQ ID NO: 2382281 - protein, 17 aa, Entamoeba dispar
FKAKMGDEFKKILKEAN

SEQ ID NO: 2382282 - protein, 21 aa, Entamoeba dispar
FKCALNSVFGAGRLYVGTHHL

SEQ ID NO: 2382283 - protein, 20 aa, Entamoeba dispar
FKCQLRVESPLTLKTKQTLF

SEQ ID NO: 2382284 - protein, 24 aa, Entamoeba dispar
FKDHCYKCSNHLSVLFESTNYCAT

SEQ ID NO: 2382285 - protein, 18 aa, Entamoeba dispar
FKDSKGCNNVTCTCDVGF

SEQ ID NO: 2382286 - protein, 26 aa, Entamoeba dispar
FKDSLKRLFPFMQFFILTGILFLLTD

SEQ ID NO: 2382287 - protein, 23 aa, Entamoeba dispar
FKDYRMIEGLQKLFVEMKESKLQ

SEQ ID NO: 2382288 - protein, 23 aa, Entamoeba dispar
FKEIGIMLDSKFKIVNDKSKSDS

SEQ ID NO: 2382289 - protein, 21 aa, Entamoeba dispar
FKEYRCIYPGCNEGLKTKYNC

SEQ ID NO: 2382290 - protein, 26 aa, Entamoeba dispar
FKFFYFPRFLIVLLIGSFLVNLYLYN

SEQ ID NO: 2382291 - protein, 17 aa, Entamoeba dispar
FKFGKQYLHLNGSVLNL

SEQ ID NO: 2382292 - protein, 23 aa, Entamoeba dispar
FKFSPEIIYQLSIDSISGSFNNE

SEQ ID NO: 2382293 - protein, 19 aa, Entamoeba dispar
FKGACQCCPRLFPKNYEVM

SEQ ID NO: 2382294 - protein, 21 aa, Entamoeba dispar
FKGFLTVFDFIAYRMGLVQQY

SEQ ID NO: 2382295 - protein, 17 aa, Entamoeba dispar
FKGLFNVNPITFTVNAC

SEQ ID NO: 2382296 - protein, 22 aa, Entamoeba dispar
FKGNFLKQRKIWIIIQGINAII

SEQ ID NO: 2382297 - protein, 35 aa, Entamoeba dispar
FKGNKTFRKVICFIVSCILFIYPALHFIDVFFNHY

SEQ ID NO: 2382298 - protein, 20 aa, Entamoeba dispar
FKGSILPPFTKLEFYNKSAW

SEQ ID NO: 2382299 - protein, 18 aa, Entamoeba dispar
FKHMEMGDEAYLVKWKLF

SEQ ID NO: 2382300 - protein, 21 aa, Entamoeba dispar
FKIAAIMLIALFCYDIFWVFG

SEQ ID NO: 2382301 - protein, 17 aa, Entamoeba dispar
FKIDWNTLCGINGVDVF

SEQ ID NO: 2382302 - protein, 18 aa, Entamoeba dispar
FKIENKLKDDKFYIIQFK

SEQ ID NO: 2382303 - protein, 20 aa, Entamoeba dispar
FKIFIGVFVGIAIVIVAIIV

SEQ ID NO: 2382304 - protein, 21 aa, Entamoeba dispar
FKIFPCLKPKDVRKIPLPLIY

SEQ ID NO: 2382305 - protein, 29 aa, Entamoeba dispar
FKIGSPFGGMVYLRLDATFTNSFYVTFSN

SEQ ID NO: 2382306 - protein, 29 aa, Entamoeba dispar
FKIGSVFRRPLPILFCLLLLPLPKNNISF

SEQ ID NO: 2382307 - protein, 34 aa, Entamoeba dispar
FKILELLGYSWAKECYHISFGMVMGMSTRRGTAV

SEQ ID NO: 2382308 - protein, 20 aa, Entamoeba dispar
FKILYIDNVPYYGILTNVHL

SEQ ID NO: 2382309 - protein, 17 aa, Entamoeba dispar
FKIMENFESEVKLLVRT

SEQ ID NO: 2382310 - protein, 20 aa, Entamoeba dispar
FKIPNYRVVMEKELRNYSTL

SEQ ID NO: 2382311 - protein, 27 aa, Entamoeba dispar
FKKEQPDIIPMIIIYTLIPIIILLGCG

SEQ ID NO: 2382312 - protein, 25 aa, Entamoeba dispar
FKKSFNIPFELEFFMNLSNKSVIEH

SEQ ID NO: 2382313 - protein, 20 aa, Entamoeba dispar
FKKVSVKEFIQFIDDGGNMV

SEQ ID NO: 2382314 - protein, 21 aa, Entamoeba dispar
FKKYPNYIGKYFKIITEYSLE

SEQ ID NO: 2382315 - protein, 20 aa, Entamoeba dispar
FKLDCLLNKICGKIMTPIDF

SEQ ID NO: 2382316 - protein, 19 aa, Entamoeba dispar
FKLFKGSSLISIILSLSYL

SEQ ID NO: 2382317 - protein, 19 aa, Entamoeba dispar
FKLGECYLYGKGVPKNSSK

SEQ ID NO: 2382318 - protein, 24 aa, Entamoeba dispar
FKLLKLLPHYKLRIPLRSFFVVFT

SEQ ID NO: 2382319 - protein, 20 aa, Entamoeba dispar
FKLLNDMFCVVSPNDPNARA

SEQ ID NO: 2382320 - protein, 21 aa, Entamoeba dispar
FKLNAQAKFEWKQSKSKYIGK

SEQ ID NO: 2382321 - protein, 19 aa, Entamoeba dispar
FKLPSVEFDIACYIQQHPN

SEQ ID NO: 2382322 - protein, 24 aa, Entamoeba dispar
FKLYGYSCCPCFIPPPCSPANSHR

SEQ ID NO: 2382323 - protein, 30 aa, Entamoeba dispar
FKNAAFFLHLLWFACICMFTSQRLYDDYMM

SEQ ID NO: 2382324 - protein, 21 aa, Entamoeba dispar
FKNDISFNMDVCKLLDNVKTS

SEQ ID NO: 2382325 - protein, 20 aa, Entamoeba dispar
FKNGCKIGNETYCYQCKEGF

SEQ ID NO: 2382326 - protein, 20 aa, Entamoeba dispar
FKNGCKIGNKTYCYQCKEGF

SEQ ID NO: 2382327 - protein, 25 aa, Entamoeba dispar
FKNKIGSLVHLLKCSGIISQKTKHK

SEQ ID NO: 2382328 - protein, 26 aa, Entamoeba dispar
FKNKNIRLYIIVGMIVFLIIFIGIWS

SEQ ID NO: 2382329 - protein, 21 aa, Entamoeba dispar
FKNLPNCLGLLQLCDDIIIAR

SEQ ID NO: 2382330 - protein, 19 aa, Entamoeba dispar
FKPLAIKAESVICCRVSPK

SEQ ID NO: 2382331 - protein, 17 aa, Entamoeba dispar
FKPSFIYQSNSKFPSNT

SEQ ID NO: 2382332 - protein, 19 aa, Entamoeba dispar
FKPTLVNSIIFIVSNIINV

SEQ ID NO: 2382333 - protein, 20 aa, Entamoeba dispar
FKQFAVHLLFSIPVGIILVF

SEQ ID NO: 2382334 - protein, 30 aa, Entamoeba dispar
FKQKYELSSFIKCYIPILSTHQYYLNDIEC

SEQ ID NO: 2382335 - protein, 18 aa, Entamoeba dispar
FKREVNWFRFDVYKYQCN

SEQ ID NO: 2382336 - protein, 23 aa, Entamoeba dispar
FKSCLTNIFFKWANRLLPIILYL

SEQ ID NO: 2382337 - protein, 20 aa, Entamoeba dispar
FKSGRFLQIMDVFINTITNY

SEQ ID NO: 2382338 - protein, 20 aa, Entamoeba dispar
FKSKENILINSFKLVIEDFN

SEQ ID NO: 2382339 - protein, 18 aa, Entamoeba dispar
FKSLQRIIVKNVELLMGA

SEQ ID NO: 2382340 - protein, 26 aa, Entamoeba dispar
FKSQKDIECLYNFFDGYHDLRSVEIA

SEQ ID NO: 2382341 - protein, 29 aa, Entamoeba dispar
FKTIKLSSTKGWDVLRWKDIQRIRQSCID

SEQ ID NO: 2382342 - protein, 18 aa, Entamoeba dispar
FKTKRIVICTTMYHETEV

SEQ ID NO: 2382343 - protein, 19 aa, Entamoeba dispar
FKTLWKQCSDDYDFHTNQF

SEQ ID NO: 2382344 - protein, 17 aa, Entamoeba dispar
FKTSIGYVSQTDYLKGT

SEQ ID NO: 2382345 - protein, 34 aa, Entamoeba dispar
FKTVNYRSIYWPVFVSLYGWPLILLIIGLYCDMV

SEQ ID NO: 2382346 - protein, 21 aa, Entamoeba dispar
FKVETVYSCMAIFNCIKLPFQ

SEQ ID NO: 2382347 - protein, 25 aa, Entamoeba dispar
FKVIKICAMCFKIENKLKDDKFYII

SEQ ID NO: 2382348 - protein, 20 aa, Entamoeba dispar
FKVIQTWPGLLTLTSNKGID

SEQ ID NO: 2382349 - protein, 25 aa, Entamoeba dispar
FKVYWEYIKAGLVFLGAACIVFLAA

SEQ ID NO: 2382350 - protein, 19 aa, Entamoeba dispar
FKWANRLLPIILYLSILTL

SEQ ID NO: 2382351 - protein, 21 aa, Entamoeba dispar
FKYMLLRPFKIPSLNSITTSD

SEQ ID NO: 2382352 - protein, 17 aa, Entamoeba dispar
FKYPWSIADFVTKGNRL

SEQ ID NO: 2382353 - protein, 22 aa, Entamoeba dispar
FKYTQERAIELALRIGGEQTSP

SEQ ID NO: 2382354 - protein, 17 aa, Entamoeba dispar
FKYVVIHASIVIKEDNC

SEQ ID NO: 2382355 - protein, 24 aa, Entamoeba dispar
FLAIKEKYPILQWGLRSILFILYL

SEQ ID NO: 2382356 - protein, 18 aa, Entamoeba dispar
FLCGLNFKYYGLVRSCLH

SEQ ID NO: 2382357 - protein, 17 aa, Entamoeba dispar
FLCTFTFGGVFLILCIP

SEQ ID NO: 2382358 - protein, 26 aa, Entamoeba dispar
FLDLFKRYGVHVTFFIIGERVKGREE

SEQ ID NO: 2382359 - protein, 19 aa, Entamoeba dispar
FLECASYVRLRCGVITMKV

SEQ ID NO: 2382360 - protein, 31 aa, Entamoeba dispar
FLEEIHFILKRGIRINDHFLTLLQLINIAKE

SEQ ID NO: 2382361 - protein, 26 aa, Entamoeba dispar
FLEKGSRAFGLFPLEFFGPPIMVLFM

SEQ ID NO: 2382362 - protein, 24 aa, Entamoeba dispar
FLEMKMARLRTDFDDSINKFCSFE

SEQ ID NO: 2382363 - protein, 17 aa, Entamoeba dispar
FLENAVFTINEISVDQI

SEQ ID NO: 2382364 - protein, 17 aa, Entamoeba dispar
FLETFRHNYNYDESIPR

SEQ ID NO: 2382365 - protein, 23 aa, Entamoeba dispar
FLFIIWQFVPRKIAYSIGLEPFF

SEQ ID NO: 2382366 - protein, 20 aa, Entamoeba dispar
FLFISCLQLIPGLSPTGRYT

SEQ ID NO: 2382367 - protein, 23 aa, Entamoeba dispar
FLFLAICLFVFISGIIPYAIDNY

SEQ ID NO: 2382368 - protein, 17 aa, Entamoeba dispar
FLFLLCIYIYYICTYVL

SEQ ID NO: 2382369 - protein, 28 aa, Entamoeba dispar
FLFLPTPIIPFCFLDFIKQQENCKLNNQ

SEQ ID NO: 2382370 - protein, 24 aa, Entamoeba dispar
FLFLRVIYCKCSFVMTRLLLGPIL

SEQ ID NO: 2382371 - protein, 24 aa, Entamoeba dispar
FLFNFANYFYWLVVPLIMNDKGGS

SEQ ID NO: 2382372 - protein, 19 aa, Entamoeba dispar
FLFQYCLLNNQSFKEALSF

SEQ ID NO: 2382373 - protein, 17 aa, Entamoeba dispar
FLFVSSYAQFKVYIFNV

SEQ ID NO: 2382374 - protein, 20 aa, Entamoeba dispar
FLFYCYSEKIDLKKNKLDVV

SEQ ID NO: 2382375 - protein, 17 aa, Entamoeba dispar
FLGEILRSIKFIKNNAW

SEQ ID NO: 2382376 - protein, 24 aa, Entamoeba dispar
FLGEILRSIKFIKYNAWEEPLHKR

SEQ ID NO: 2382377 - protein, 19 aa, Entamoeba dispar
FLGFCFMIISICFVFIPPY

SEQ ID NO: 2382378 - protein, 17 aa, Entamoeba dispar
FLGLAGWALAILGQSPR

SEQ ID NO: 2382379 - protein, 25 aa, Entamoeba dispar
FLGLFRLPIKFQDAKQFPRCLSIVD

SEQ ID NO: 2382380 - protein, 21 aa, Entamoeba dispar
FLGVYATELFIIFFCVNVSRN

SEQ ID NO: 2382381 - protein, 18 aa, Entamoeba dispar
FLHGVSFKIPKRFDQQDS

SEQ ID NO: 2382382 - protein, 27 aa, Entamoeba dispar
FLHLYISMVKLHLFSGFYEYYVLVFLF

SEQ ID NO: 2382383 - protein, 19 aa, Entamoeba dispar
FLHYCCSKSFIYLLPLILK

SEQ ID NO: 2382384 - protein, 18 aa, Entamoeba dispar
FLIDMCMIDCEVFVDELS

SEQ ID NO: 2382385 - protein, 19 aa, Entamoeba dispar
FLIERCQWYLNQTNIKKST

SEQ ID NO: 2382386 - protein, 20 aa, Entamoeba dispar
FLIFVCIIIGILFIIQPDYT

SEQ ID NO: 2382387 - protein, 17 aa, Entamoeba dispar
FLIGFIILNANMNSKSF

SEQ ID NO: 2382388 - protein, 19 aa, Entamoeba dispar
FLIHRLFFQFFDSNRISSK

SEQ ID NO: 2382389 - protein, 25 aa, Entamoeba dispar
FLIIPSIIVFSVFYPSLKYPFDGLS

SEQ ID NO: 2382390 - protein, 18 aa, Entamoeba dispar
FLILCLAVGHAFQTVYLL

SEQ ID NO: 2382391 - protein, 23 aa, Entamoeba dispar
FLINLKIPLSMKVYEKLAFFASR

SEQ ID NO: 2382392 - protein, 18 aa, Entamoeba dispar
FLISLIAFVYQFVFFGET

SEQ ID NO: 2382393 - protein, 17 aa, Entamoeba dispar
FLISQIFHYFFATTILK

SEQ ID NO: 2382394 - protein, 25 aa, Entamoeba dispar
FLIVLTWYCCYGVALYCMQYQLQAN

SEQ ID NO: 2382395 - protein, 24 aa, Entamoeba dispar
FLIYPIQRLPRYLLLLETLSKNVP

SEQ ID NO: 2382396 - protein, 25 aa, Entamoeba dispar
FLKEYCYLCNGFNYIHSVFVLSASS

SEQ ID NO: 2382397 - protein, 19 aa, Entamoeba dispar
FLKHISIKLAIIVNDLLDQ

SEQ ID NO: 2382398 - protein, 27 aa, Entamoeba dispar
FLKKLRIDTDILRQMLFLFIWIICLRV

SEQ ID NO: 2382399 - protein, 17 aa, Entamoeba dispar
FLKVVFAKEMMSTNREL

SEQ ID NO: 2382400 - protein, 17 aa, Entamoeba dispar
FLLCAPAAVISLVSTIV

SEQ ID NO: 2382401 - protein, 24 aa, Entamoeba dispar
FLLDFCYYTNFLLLVTTILIFGFK

SEQ ID NO: 2382402 - protein, 35 aa, Entamoeba dispar
FLLEFFYLDALFLCLFWFLIEVTFDIDANGILNVT

SEQ ID NO: 2382403 - protein, 26 aa, Entamoeba dispar
FLLHYLCLKKIVTIHFTFDRQHSSKF

SEQ ID NO: 2382404 - protein, 17 aa, Entamoeba dispar
FLLILSVLSQLHFSISI

SEQ ID NO: 2382405 - protein, 19 aa, Entamoeba dispar
FLLLYVRLTKKIKQEIDEE

SEQ ID NO: 2382406 - protein, 19 aa, Entamoeba dispar
FLLNISRIRLDIMPFAIKR

SEQ ID NO: 2382407 - protein, 20 aa, Entamoeba dispar
FLLTYSFWMYRRCGDLSSFI

SEQ ID NO: 2382408 - protein, 18 aa, Entamoeba dispar
FLMAIGYPTHFIANRHAN

SEQ ID NO: 2382409 - protein, 17 aa, Entamoeba dispar
FLMFFGMFLALLIYYFT

SEQ ID NO: 2382410 - protein, 21 aa, Entamoeba dispar
FLMIFSNMFSYVFESVITMFL

SEQ ID NO: 2382411 - protein, 17 aa, Entamoeba dispar
FLNAVLVILGCLLCIPY

SEQ ID NO: 2382412 - protein, 17 aa, Entamoeba dispar
FLNFFIVSFSFCCLACW

SEQ ID NO: 2382413 - protein, 22 aa, Entamoeba dispar
FLNKKWFPIADICRIGFVLQAI

SEQ ID NO: 2382414 - protein, 25 aa, Entamoeba dispar
FLNKRMLQILPKIDLEIMYFTINNK

SEQ ID NO: 2382415 - protein, 24 aa, Entamoeba dispar
FLNSPCGFVKIVGHSGGEDFSKYC

SEQ ID NO: 2382416 - protein, 32 aa, Entamoeba dispar
FLNYYLMHFLFFTALCFVGAIIMILIDSKLNY

SEQ ID NO: 2382417 - protein, 23 aa, Entamoeba dispar
FLPEIIFMKMFQNFGIVTESNHM

SEQ ID NO: 2382418 - protein, 18 aa, Entamoeba dispar
FLPLGKFGILSALVIPTM

SEQ ID NO: 2382419 - protein, 18 aa, Entamoeba dispar
FLPYLFAYPCSEITFQKS

SEQ ID NO: 2382420 - protein, 26 aa, Entamoeba dispar
FLQTSRVFCKYAFPDNLARVLSRICF

SEQ ID NO: 2382421 - protein, 18 aa, Entamoeba dispar
FLRHVLKNKTLFIVVLSI

SEQ ID NO: 2382422 - protein, 25 aa, Entamoeba dispar
FLRQFLIPHPFQLVDIRAIVKASHS

SEQ ID NO: 2382423 - protein, 25 aa, Entamoeba dispar
FLSCLLPTIFPFVSFVAVLQNSFIG

SEQ ID NO: 2382424 - protein, 20 aa, Entamoeba dispar
FLSNVLAFLSSCIWSISISS

SEQ ID NO: 2382425 - protein, 18 aa, Entamoeba dispar
FLSSCIWSISISSRSSVI

SEQ ID NO: 2382426 - protein, 18 aa, Entamoeba dispar
FLSSYYKIKSMPCISSNG

SEQ ID NO: 2382427 - protein, 24 aa, Entamoeba dispar
FLTCGAYGAICWVFYQLDTNPELC

SEQ ID NO: 2382428 - protein, 32 aa, Entamoeba dispar
FLTGAYPFYAACASMAIGFIVFSFIYLNQIEK

SEQ ID NO: 2382429 - protein, 38 aa, Entamoeba dispar
FLTGYLVGFIKCWDLTLVILCMFPFIMISMMGLGMSAG

SEQ ID NO: 2382430 - protein, 19 aa, Entamoeba dispar
FLTIFSIFVIFSLPEFPFM

SEQ ID NO: 2382431 - protein, 17 aa, Entamoeba dispar
FLTPLGIKVCIKLLQVS

SEQ ID NO: 2382432 - protein, 27 aa, Entamoeba dispar
FLTRLVFIVSLSFLFAHYMFGYLPIAP

SEQ ID NO: 2382433 - protein, 17 aa, Entamoeba dispar
FLVIGGFGYSVGSIQRG

SEQ ID NO: 2382434 - protein, 17 aa, Entamoeba dispar
FLVSLPIKGHILKQQFI

SEQ ID NO: 2382435 - protein, 26 aa, Entamoeba dispar
FLYDTSCFFYWIVVPLLFNEQGATPV

SEQ ID NO: 2382436 - protein, 21 aa, Entamoeba dispar
FLYIVCWIVPFFNRLLPLFKI

SEQ ID NO: 2382437 - protein, 23 aa, Entamoeba dispar
FLYLPCVFISSFIEITLKYLYFI

SEQ ID NO: 2382438 - protein, 19 aa, Entamoeba dispar
FMCFCCANHTMATYFKEKT

SEQ ID NO: 2382439 - protein, 17 aa, Entamoeba dispar
FMCQCIFDGSNYLDSTL

SEQ ID NO: 2382440 - protein, 18 aa, Entamoeba dispar
FMEFEVRKIALQLSLDYL

SEQ ID NO: 2382441 - protein, 27 aa, Entamoeba dispar
FMEGSYSRWLFFKTHFVVYFGNLVGSI

SEQ ID NO: 2382442 - protein, 17 aa, Entamoeba dispar
FMFSCFLIILIIRKQQQ

SEQ ID NO: 2382443 - protein, 17 aa, Entamoeba dispar
FMFTFDVMLTLLLAEVM

SEQ ID NO: 2382444 - protein, 24 aa, Entamoeba dispar
FMIDFCYFCQIITLLCIFSLNTEY

SEQ ID NO: 2382445 - protein, 32 aa, Entamoeba dispar
FMLGDLLSRFAVYIPIPWNKWPILGLSLVRVL

SEQ ID NO: 2382446 - protein, 18 aa, Entamoeba dispar
FMPLVKLVDAMIFKPLCR

SEQ ID NO: 2382447 - protein, 19 aa, Entamoeba dispar
FMPQRWILAHIKLEKDWTM

SEQ ID NO: 2382448 - protein, 21 aa, Entamoeba dispar
FMRRLSEKKFWVRSFGAIFGS

SEQ ID NO: 2382449 - protein, 17 aa, Entamoeba dispar
FMSLSFFFLPTRFAMTF

SEQ ID NO: 2382450 - protein, 19 aa, Entamoeba dispar
FMVIAFATVILIMFLNDDR

SEQ ID NO: 2382451 - protein, 19 aa, Entamoeba dispar
FMVINDIPFIEIIDTTGLY

SEQ ID NO: 2382452 - protein, 19 aa, Entamoeba dispar
FMYILRGIPFKQWSLEQKC

SEQ ID NO: 2382453 - protein, 21 aa, Entamoeba dispar
FNADVWKFEDISGIKAKGKSL

SEQ ID NO: 2382454 - protein, 29 aa, Entamoeba dispar
FNAIKGQCFGIGFGFSIFFIFCSYALGNW

SEQ ID NO: 2382455 - protein, 29 aa, Entamoeba dispar
FNAIKGQCFGIGFGFSMFFIFCSYALGSW

SEQ ID NO: 2382456 - protein, 27 aa, Entamoeba dispar
FNAIKGQCFGIGFGFSTFFTYATYALG

SEQ ID NO: 2382457 - protein, 28 aa, Entamoeba dispar
FNAIKGQCFGIGFGFSTFFTYATYALGS

SEQ ID NO: 2382458 - protein, 17 aa, Entamoeba dispar
FNAKGKESFIFTDGKMN

SEQ ID NO: 2382459 - protein, 20 aa, Entamoeba dispar
FNCDGWPFELFCEKMMQNIF

SEQ ID NO: 2382460 - protein, 20 aa, Entamoeba dispar
FNCENAVSINLPFTRTQNVP

SEQ ID NO: 2382461 - protein, 26 aa, Entamoeba dispar
FNCRLSIYLPLFLKQFIPIIEQIQLY

SEQ ID NO: 2382462 - protein, 22 aa, Entamoeba dispar
FNDFFPVCIVIVSAFSLLNHFI

SEQ ID NO: 2382463 - protein, 23 aa, Entamoeba dispar
FNDFFPVCIVIVSAFSLLNHFIP

SEQ ID NO: 2382464 - protein, 21 aa, Entamoeba dispar
FNDIFEVWANYLIKIQQIIIS

SEQ ID NO: 2382465 - protein, 19 aa, Entamoeba dispar
FNDIKFIRKRIEIDSNSSS

SEQ ID NO: 2382466 - protein, 17 aa, Entamoeba dispar
FNDLLAYKMLNDVAKGM

SEQ ID NO: 2382467 - protein, 21 aa, Entamoeba dispar
FNEEWYKHPWSIITSFFCHSS

SEQ ID NO: 2382468 - protein, 23 aa, Entamoeba dispar
FNEFAGSLGYLVSKELFIGNFPK

SEQ ID NO: 2382469 - protein, 22 aa, Entamoeba dispar
FNEILCISLTHFLLKKVVDCNT

SEQ ID NO: 2382470 - protein, 23 aa, Entamoeba dispar
FNEKETWTHQSIFFNLNHYLNPK

SEQ ID NO: 2382471 - protein, 20 aa, Entamoeba dispar
FNFACLVLYLYGSLWAYAAT

SEQ ID NO: 2382472 - protein, 24 aa, Entamoeba dispar
FNFKCEVFPKFSLEGIVVYDIYSI

SEQ ID NO: 2382473 - protein, 19 aa, Entamoeba dispar
FNFKGSPHARAFHNITIEE

SEQ ID NO: 2382474 - protein, 22 aa, Entamoeba dispar
FNFNKINSFIPIICVINNCKIS

SEQ ID NO: 2382475 - protein, 25 aa, Entamoeba dispar
FNFVPLPLYIGWYMIFFTTIFNQLP

SEQ ID NO: 2382476 - protein, 18 aa, Entamoeba dispar
FNGILFFEECPLKDQHWR

SEQ ID NO: 2382477 - protein, 17 aa, Entamoeba dispar
FNGNYSIRIDSSNNNRV

SEQ ID NO: 2382478 - protein, 25 aa, Entamoeba dispar
FNHPFSLKRGLSFLSDSNEVSNSTS

SEQ ID NO: 2382479 - protein, 17 aa, Entamoeba dispar
FNIGTNSIVVWNGHVSF

SEQ ID NO: 2382480 - protein, 18 aa, Entamoeba dispar
FNIIEMTNFYNAFQNCLT

SEQ ID NO: 2382481 - protein, 20 aa, Entamoeba dispar
FNIIKAFLSKAFYGIGNPIE

SEQ ID NO: 2382482 - protein, 21 aa, Entamoeba dispar
FNIIKELFKFINEISEMTQLP

SEQ ID NO: 2382483 - protein, 21 aa, Entamoeba dispar
FNILCLLLGGFFFILVSIFEL

SEQ ID NO: 2382484 - protein, 19 aa, Entamoeba dispar
FNINDVWYLILSYDGTINK

SEQ ID NO: 2382485 - protein, 38 aa, Entamoeba dispar
FNIVKMTRFMGWKRFAFREYPVALAVYLFIWTPGMIFV

SEQ ID NO: 2382486 - protein, 19 aa, Entamoeba dispar
FNKEVIFNIITRWYIIISI

SEQ ID NO: 2382487 - protein, 24 aa, Entamoeba dispar
FNKWINVYEGYSFEEACSKIDSLS

SEQ ID NO: 2382488 - protein, 28 aa, Entamoeba dispar
FNLGILLNRFFKLWCLRKGNWEENYQRH

SEQ ID NO: 2382489 - protein, 17 aa, Entamoeba dispar
FNLGVIFFYIIVYTVNF

SEQ ID NO: 2382490 - protein, 18 aa, Entamoeba dispar
FNLIRLTPFDIKQKLNSV

SEQ ID NO: 2382491 - protein, 21 aa, Entamoeba dispar
FNLKSAEYILTPRLIIHLQPS

SEQ ID NO: 2382492 - protein, 23 aa, Entamoeba dispar
FNLNEYYLLFIITEHFIIESSID

SEQ ID NO: 2382493 - protein, 19 aa, Entamoeba dispar
FNLTFPFVILKALINTHSL

SEQ ID NO: 2382494 - protein, 17 aa, Entamoeba dispar
FNLYLQLYDIVKECTNC

SEQ ID NO: 2382495 - protein, 18 aa, Entamoeba dispar
FNMMDYGIRMRQLINGEF

SEQ ID NO: 2382496 - protein, 17 aa, Entamoeba dispar
FNNFKIFCDCLYDKKMK

SEQ ID NO: 2382497 - protein, 24 aa, Entamoeba dispar
FNNFLFWFIVEHPKMPVVDFTDTI

SEQ ID NO: 2382498 - protein, 23 aa, Entamoeba dispar
FNNNGRSAFIFDHKINKKIAENN

SEQ ID NO: 2382499 - protein, 24 aa, Entamoeba dispar
FNNPRFSHSLKHLVKVISDVFQFE

SEQ ID NO: 2382500 - protein, 18 aa, Entamoeba dispar
FNPNVCKGWDSYTTLTSP

SEQ ID NO: 2382501 - protein, 27 aa, Entamoeba dispar
FNPYILIRIAMCFFVVAVAIILIWPNT

SEQ ID NO: 2382502 - protein, 27 aa, Entamoeba dispar
FNQKIRIVDHYSVLKGLTVGLGLGAVM

SEQ ID NO: 2382503 - protein, 18 aa, Entamoeba dispar
FNQLCEWRETTAKNQNIS

SEQ ID NO: 2382504 - protein, 25 aa, Entamoeba dispar
FNQWKIRMIHIFGPISFLIFSCLFS

SEQ ID NO: 2382505 - protein, 18 aa, Entamoeba dispar
FNRINHDLFYEFNGGDGI

SEQ ID NO: 2382506 - protein, 21 aa, Entamoeba dispar
FNRMRLLWDIAFFSITLESNA

SEQ ID NO: 2382507 - protein, 21 aa, Entamoeba dispar
FNSEICKLFSTYEKVDVVINT

SEQ ID NO: 2382508 - protein, 24 aa, Entamoeba dispar
FNSIVKAVIWGRCVYDNIRKFIQF

SEQ ID NO: 2382509 - protein, 24 aa, Entamoeba dispar
FNSIVKAVMWGRCVYDNIRKFLQF

SEQ ID NO: 2382510 - protein, 24 aa, Entamoeba dispar
FNSSVYIHYAWEMFGLEDNLKSKR

SEQ ID NO: 2382511 - protein, 17 aa, Entamoeba dispar
FNSVPFDRLLITKMAQF

SEQ ID NO: 2382512 - protein, 23 aa, Entamoeba dispar
FNTPISFEFCLGAIGVLISISNY

SEQ ID NO: 2382513 - protein, 18 aa, Entamoeba dispar
FNWPIDWISFAFLLFNFG

SEQ ID NO: 2382514 - protein, 17 aa, Entamoeba dispar
FNYEARISLSAEIKSEE

SEQ ID NO: 2382515 - protein, 28 aa, Entamoeba dispar
FNYIQLILCPASLFISINRSVLFFLFIT

SEQ ID NO: 2382516 - protein, 19 aa, Entamoeba dispar
FNYQLFKFEMVRNMVSQNH

SEQ ID NO: 2382517 - protein, 17 aa, Entamoeba dispar
FNYSTRHKLVISLATLP

SEQ ID NO: 2382518 - protein, 32 aa, Entamoeba dispar
FNYYLNKLPSWRWYYKFHYAPFALDFALYLNE

SEQ ID NO: 2382519 - protein, 18 aa, Entamoeba dispar
FPARGIMCIVDTFKDLKE

SEQ ID NO: 2382520 - protein, 27 aa, Entamoeba dispar
FPAYFAYKLTKGWKKIMALIVMILGIL

SEQ ID NO: 2382521 - protein, 20 aa, Entamoeba dispar
FPDDCSLCDITKGYREDCTG

SEQ ID NO: 2382522 - protein, 21 aa, Entamoeba dispar
FPDGESILKFVGAGKRLEIPS

SEQ ID NO: 2382523 - protein, 22 aa, Entamoeba dispar
FPDGESILKFVGIKMKIRNKLL

SEQ ID NO: 2382524 - protein, 21 aa, Entamoeba dispar
FPDKCRKELSIIKSWKETQNL

SEQ ID NO: 2382525 - protein, 23 aa, Entamoeba dispar
FPDSESILRFVGAGKRLCVSDDC

SEQ ID NO: 2382526 - protein, 21 aa, Entamoeba dispar
FPDSESILRFVGAGKRLHVGD

SEQ ID NO: 2382527 - protein, 21 aa, Entamoeba dispar
FPDSESILRFVGAGKRLHVSD

SEQ ID NO: 2382528 - protein, 21 aa, Entamoeba dispar
FPDYANYHFLLPIKESVHSTN

SEQ ID NO: 2382529 - protein, 24 aa, Entamoeba dispar
FPEDMFRFLFAFILEVPISIICRY

SEQ ID NO: 2382530 - protein, 18 aa, Entamoeba dispar
FPEGCKTQKKEAISTEDL

SEQ ID NO: 2382531 - protein, 19 aa, Entamoeba dispar
FPFILKFIYELLNPPKHMT

SEQ ID NO: 2382532 - protein, 17 aa, Entamoeba dispar
FPFKLWNMVPYIQQLVF

SEQ ID NO: 2382533 - protein, 23 aa, Entamoeba dispar
FPHLQFLGTLIFYYLAIKTPPGY

SEQ ID NO: 2382534 - protein, 27 aa, Entamoeba dispar
FPIEHKIACLLPLFGPVLLLLIKSLFQ

SEQ ID NO: 2382535 - protein, 18 aa, Entamoeba dispar
FPIINYILPPVVDFTQYA

SEQ ID NO: 2382536 - protein, 20 aa, Entamoeba dispar
FPIIPLQYLFSAASKNYLRP

SEQ ID NO: 2382537 - protein, 20 aa, Entamoeba dispar
FPINEIEKYLKLILNLIHLL

SEQ ID NO: 2382538 - protein, 17 aa, Entamoeba dispar
FPISVILVKNGGGYVDL

SEQ ID NO: 2382539 - protein, 19 aa, Entamoeba dispar
FPIYRLPKDQIKKEYPSEK

SEQ ID NO: 2382540 - protein, 28 aa, Entamoeba dispar
FPKSDERFGFPWKIAEFITSGKRLERPI

SEQ ID NO: 2382541 - protein, 28 aa, Entamoeba dispar
FPKTEFKFPWDIANTITTGKRPPIIQEV

SEQ ID NO: 2382542 - protein, 28 aa, Entamoeba dispar
FPKTEFKFPWKIAEFISTGKRPPIIQEV

SEQ ID NO: 2382543 - protein, 28 aa, Entamoeba dispar
FPKTEFKFPWKIAEFISTGKRPTIIQEV

SEQ ID NO: 2382544 - protein, 22 aa, Entamoeba dispar
FPKTEFKFPWSIANATAQGQRP

SEQ ID NO: 2382545 - protein, 20 aa, Entamoeba dispar
FPLFCLTTYISLDTGFTQCH

SEQ ID NO: 2382546 - protein, 23 aa, Entamoeba dispar
FPLFYNWFNFLIAIIMTYLASSL

SEQ ID NO: 2382547 - protein, 17 aa, Entamoeba dispar
FPLGKWYTKPNIIKYGD

SEQ ID NO: 2382548 - protein, 23 aa, Entamoeba dispar
FPLKDIEALIKYLPNDAEYQIIK

SEQ ID NO: 2382549 - protein, 22 aa, Entamoeba dispar
FPMGIGALLMRKDVVDKMNPIY

SEQ ID NO: 2382550 - protein, 21 aa, Entamoeba dispar
FPMRESFVFLEAIKKAFISQF

SEQ ID NO: 2382551 - protein, 17 aa, Entamoeba dispar
FPMTFFGLILFLLNSFK

SEQ ID NO: 2382552 - protein, 21 aa, Entamoeba dispar
FPNIYFPSFVLLPPLNQSLNY

SEQ ID NO: 2382553 - protein, 18 aa, Entamoeba dispar
FPPSFIAICIGYVSASIT

SEQ ID NO: 2382554 - protein, 28 aa, Entamoeba dispar
FPSDFRCAMDRWLRLRILGSKIPTQIII

SEQ ID NO: 2382555 - protein, 18 aa, Entamoeba dispar
FPSICTAWDRNGVRINTA

SEQ ID NO: 2382556 - protein, 19 aa, Entamoeba dispar
FPSIFFVAKIFKLDRLTTR

SEQ ID NO: 2382557 - protein, 23 aa, Entamoeba dispar
FPSQLRTSIITGLRPTIPNSPYI

SEQ ID NO: 2382558 - protein, 19 aa, Entamoeba dispar
FPTCAGILRYIPKKWKIVQ

SEQ ID NO: 2382559 - protein, 26 aa, Entamoeba dispar
FPTFDGKWWPQSFMSFFTMAPFISAN

SEQ ID NO: 2382560 - protein, 17 aa, Entamoeba dispar
FPTGDGMFFQFTLTLGI

SEQ ID NO: 2382561 - protein, 26 aa, Entamoeba dispar
FPTKDFWRHVCIVWAKCFYYTSEKTL

SEQ ID NO: 2382562 - protein, 21 aa, Entamoeba dispar
FPTLKRFLPFIKENKLEKEYI

SEQ ID NO: 2382563 - protein, 29 aa, Entamoeba dispar
FPTSDGIFFQWVMCVGILLVGIFTMLFNG

SEQ ID NO: 2382564 - protein, 18 aa, Entamoeba dispar
FPWNAVAYSIQWIGVFAL

SEQ ID NO: 2382565 - protein, 25 aa, Entamoeba dispar
FQAICIAAMILCTVYQPFYEGKKFG

SEQ ID NO: 2382566 - protein, 17 aa, Entamoeba dispar
FQAMKRKLIKSNYIIYF

SEQ ID NO: 2382567 - protein, 23 aa, Entamoeba dispar
FQDGCGRTPLHIAVIKNDALAVS

SEQ ID NO: 2382568 - protein, 19 aa, Entamoeba dispar
FQDGIGPKFGMIFQIFSIA

SEQ ID NO: 2382569 - protein, 20 aa, Entamoeba dispar
FQDQCDILRLNIVSEEGNQL

SEQ ID NO: 2382570 - protein, 21 aa, Entamoeba dispar
FQESFIPFFLLGELANDISDI

SEQ ID NO: 2382571 - protein, 23 aa, Entamoeba dispar
FQFDSRLTYFWITHIGSGRFNNN

SEQ ID NO: 2382572 - protein, 21 aa, Entamoeba dispar
FQFPLSGIITFIIGGIYIIIS

SEQ ID NO: 2382573 - protein, 17 aa, Entamoeba dispar
FQFSDIQFNAGFIGIPF

SEQ ID NO: 2382574 - protein, 25 aa, Entamoeba dispar
FQGKRSTCWAFSSIFQLEYAYNKNL

SEQ ID NO: 2382575 - protein, 17 aa, Entamoeba dispar
FQGLDLLSLENTTFCID

SEQ ID NO: 2382576 - protein, 23 aa, Entamoeba dispar
FQHVVPLIFVLTVAVLKELFDEI

SEQ ID NO: 2382577 - protein, 21 aa, Entamoeba dispar
FQIKLKMWVESMLIENEINRI

SEQ ID NO: 2382578 - protein, 17 aa, Entamoeba dispar
FQILRVGFAGIFKIRTV

SEQ ID NO: 2382579 - protein, 18 aa, Entamoeba dispar
FQILRVGFAGIFKIRTVQ

SEQ ID NO: 2382580 - protein, 20 aa, Entamoeba dispar
FQKHIFYKGFSLTTFLKECI

SEQ ID NO: 2382581 - protein, 17 aa, Entamoeba dispar
FQKNIFSFILVSYTIIM

SEQ ID NO: 2382582 - protein, 17 aa, Entamoeba dispar
FQKTPKIISSMLCDISL

SEQ ID NO: 2382583 - protein, 17 aa, Entamoeba dispar
FQLKSMWRLCMKKQLGE

SEQ ID NO: 2382584 - protein, 19 aa, Entamoeba dispar
FQLLALRFVSQKHLETTNI

SEQ ID NO: 2382585 - protein, 27 aa, Entamoeba dispar
FQNKIKLCSLLTCFRRSSALQIDTMIE

SEQ ID NO: 2382586 - protein, 21 aa, Entamoeba dispar
FQNKLINEWFIKTQEELNKFN

SEQ ID NO: 2382587 - protein, 18 aa, Entamoeba dispar
FQNLPCTRIPTYTINSFD

SEQ ID NO: 2382588 - protein, 18 aa, Entamoeba dispar
FQNSIRFETTPSLNQPQL

SEQ ID NO: 2382589 - protein, 24 aa, Entamoeba dispar
FQPSIWRFLKYWFTSLLSSQINVT

SEQ ID NO: 2382590 - protein, 20 aa, Entamoeba dispar
FQSDCFKSLMKEFSDSQEAL

SEQ ID NO: 2382591 - protein, 34 aa, Entamoeba dispar
FQSNSRLAFDIVNGLICLCTKKIAPLRQEAIATL

SEQ ID NO: 2382592 - protein, 19 aa, Entamoeba dispar
FQSRLLRDLDQEYSHLRSE

SEQ ID NO: 2382593 - protein, 19 aa, Entamoeba dispar
FQSVFSFSIAIFVTFNQIV

SEQ ID NO: 2382594 - protein, 17 aa, Entamoeba dispar
FQVRIEPEMAILTKGEG

SEQ ID NO: 2382595 - protein, 23 aa, Entamoeba dispar
FQYIPPIYFAYFIFIALIEGLSI

SEQ ID NO: 2382596 - protein, 20 aa, Entamoeba dispar
FRAAPNEAFYLSSQQCGICY

SEQ ID NO: 2382597 - protein, 17 aa, Entamoeba dispar
FRATKYLVEHGPTAFIN

SEQ ID NO: 2382598 - protein, 24 aa, Entamoeba dispar
FRDILPILITCFIGSMKKTKVQES

SEQ ID NO: 2382599 - protein, 22 aa, Entamoeba dispar
FRDTWNRGWISQFFGHDTAYQY

SEQ ID NO: 2382600 - protein, 18 aa, Entamoeba dispar
FREQLIIEQERLKQKTMI

SEQ ID NO: 2382601 - protein, 21 aa, Entamoeba dispar
FRFILWTLWYCVTLMTTKAKI

SEQ ID NO: 2382602 - protein, 24 aa, Entamoeba dispar
FRFNTHVPLQLTIRTCSTGTEINN

SEQ ID NO: 2382603 - protein, 24 aa, Entamoeba dispar
FRGSKCLVCNNGLFLTEEGECIPC

SEQ ID NO: 2382604 - protein, 18 aa, Entamoeba dispar
FRGTEGCLENCYCDSNDY

SEQ ID NO: 2382605 - protein, 17 aa, Entamoeba dispar
FRHGMLVEEIVLIRIND

SEQ ID NO: 2382606 - protein, 20 aa, Entamoeba dispar
FRHLAKLILYHGRTSLLRNS

SEQ ID NO: 2382607 - protein, 21 aa, Entamoeba dispar
FRIKNIKTMYSINEIKQTMYE

SEQ ID NO: 2382608 - protein, 23 aa, Entamoeba dispar
FRKKEIIKLNSFDYYKGITLTFM

SEQ ID NO: 2382609 - protein, 17 aa, Entamoeba dispar
FRKLANVYFLFISCLQL

SEQ ID NO: 2382610 - protein, 27 aa, Entamoeba dispar
FRLECPIKEKFHCVFAIYTKNKLIEKV

SEQ ID NO: 2382611 - protein, 23 aa, Entamoeba dispar
FRLFTPKVCFDAAITVVVDVVVF

SEQ ID NO: 2382612 - protein, 18 aa, Entamoeba dispar
FRLTVGHCNSVFDPSSPY

SEQ ID NO: 2382613 - protein, 19 aa, Entamoeba dispar
FRNEDWMPSALFGQGKSDL

SEQ ID NO: 2382614 - protein, 18 aa, Entamoeba dispar
FRNIWSYFFGYWKDPNTE

SEQ ID NO: 2382615 - protein, 26 aa, Entamoeba dispar
FRNKCALFCQLLPLIVIILCGIIVLI

SEQ ID NO: 2382616 - protein, 22 aa, Entamoeba dispar
FRPEAITENSICFEGKKVVVGY

SEQ ID NO: 2382617 - protein, 20 aa, Entamoeba dispar
FRQMCYEVIEKKDLISSNNV

SEQ ID NO: 2382618 - protein, 34 aa, Entamoeba dispar
FRRRFFILRPFFRRRRFTLSPIIWKRRNQKRQIK

SEQ ID NO: 2382619 - protein, 17 aa, Entamoeba dispar
FRSEYIIHFYGARCLTG

SEQ ID NO: 2382620 - protein, 20 aa, Entamoeba dispar
FRSMINLWTLIAILAVDFHI

SEQ ID NO: 2382621 - protein, 17 aa, Entamoeba dispar
FRVFKKMFINLFSIGFI

SEQ ID NO: 2382622 - protein, 17 aa, Entamoeba dispar
FRVQKLMRVSSIPNPEV

SEQ ID NO: 2382623 - protein, 24 aa, Entamoeba dispar
FRYEPELPDGISLNYDKIGNLPRI

SEQ ID NO: 2382624 - protein, 17 aa, Entamoeba dispar
FRYNYAYKEKIPREFLT

SEQ ID NO: 2382625 - protein, 17 aa, Entamoeba dispar
FRYYLVPPCELRILGSK

SEQ ID NO: 2382626 - protein, 26 aa, Entamoeba dispar
FSAAFWAFSAFTFWPAAVGTVGKEAG

SEQ ID NO: 2382627 - protein, 25 aa, Entamoeba dispar
FSAIFTKFFLKRKVYAYQWVGVAFV

SEQ ID NO: 2382628 - protein, 23 aa, Entamoeba dispar
FSAKTAIFLFVFVIMMFILLLEI

SEQ ID NO: 2382629 - protein, 19 aa, Entamoeba dispar
FSCGSDLLAKIHINKLMVL

SEQ ID NO: 2382630 - protein, 19 aa, Entamoeba dispar
FSCIAFAEQYTMVGTNSNF

SEQ ID NO: 2382631 - protein, 20 aa, Entamoeba dispar
FSDEHISLFKSFDKESIVKM

SEQ ID NO: 2382632 - protein, 29 aa, Entamoeba dispar
FSDSFTILRWCFEYHKKIKKAFLNQKTNT

SEQ ID NO: 2382633 - protein, 17 aa, Entamoeba dispar
FSEFCYQKLKAFPLNYE

SEQ ID NO: 2382634 - protein, 26 aa, Entamoeba dispar
FSELKENRCPPFICISSNGISISSDG

SEQ ID NO: 2382635 - protein, 20 aa, Entamoeba dispar
FSERLFWNLSKEYRMKHCHD

SEQ ID NO: 2382636 - protein, 23 aa, Entamoeba dispar
FSFAITAWELFYAKEPYRECKSL

SEQ ID NO: 2382637 - protein, 21 aa, Entamoeba dispar
FSFFYFCFYSFILYIFFYFII

SEQ ID NO: 2382638 - protein, 21 aa, Entamoeba dispar
FSFGMVMAFVVLRRPLQTIVG

SEQ ID NO: 2382639 - protein, 17 aa, Entamoeba dispar
FSFHGMYILLTIINCCY

SEQ ID NO: 2382640 - protein, 22 aa, Entamoeba dispar
FSFKRFFLAPFINTYNGIKEIT

SEQ ID NO: 2382641 - protein, 21 aa, Entamoeba dispar
FSFLFAHVFYSIGFNATLSSD

SEQ ID NO: 2382642 - protein, 18 aa, Entamoeba dispar
FSFLFKFLYYQYKLLTNV

SEQ ID NO: 2382643 - protein, 18 aa, Entamoeba dispar
FSFNIKLNIALSETMGSS

SEQ ID NO: 2382644 - protein, 19 aa, Entamoeba dispar
FSFNYPWAVASRFLLGLVN

SEQ ID NO: 2382645 - protein, 17 aa, Entamoeba dispar
FSFQFAHKLSHNYKILF

SEQ ID NO: 2382646 - protein, 19 aa, Entamoeba dispar
FSFSINFFLTNAIKLFAGR

SEQ ID NO: 2382647 - protein, 17 aa, Entamoeba dispar
FSFTGFQMVAMKYETKA

SEQ ID NO: 2382648 - protein, 21 aa, Entamoeba dispar
FSFVFPGKRNELFAIGLRKKR

SEQ ID NO: 2382649 - protein, 24 aa, Entamoeba dispar
FSGCSYTDGVFCNRCEDPNRVPNQ

SEQ ID NO: 2382650 - protein, 20 aa, Entamoeba dispar
FSGECFYLATFEIHNNLAMT

SEQ ID NO: 2382651 - protein, 20 aa, Entamoeba dispar
FSGLCYCQLTSLPYALTRKV

SEQ ID NO: 2382652 - protein, 17 aa, Entamoeba dispar
FSGTKPKEWQMKYTKYP

SEQ ID NO: 2382653 - protein, 17 aa, Entamoeba dispar
FSGVERINSSKISSEAP

SEQ ID NO: 2382654 - protein, 19 aa, Entamoeba dispar
FSHIYARENVIFSVLDNVK

SEQ ID NO: 2382655 - protein, 21 aa, Entamoeba dispar
FSHMLKLLLWHGRNSYIRTSD

SEQ ID NO: 2382656 - protein, 17 aa, Entamoeba dispar
FSIEFSYNIPIINLFFI

SEQ ID NO: 2382657 - protein, 17 aa, Entamoeba dispar
FSIFFIFCSYALGNWYG

SEQ ID NO: 2382658 - protein, 22 aa, Entamoeba dispar
FSIILNNTWSYGGIKFLHQIEF

SEQ ID NO: 2382659 - protein, 25 aa, Entamoeba dispar
FSILFEIIELAPFVEFPENTKSKIV

SEQ ID NO: 2382660 - protein, 18 aa, Entamoeba dispar
FSISSPPFNCFSPNFYSK

SEQ ID NO: 2382661 - protein, 26 aa, Entamoeba dispar
FSKCYPNLPSNILIASLRLCSKICSF

SEQ ID NO: 2382662 - protein, 17 aa, Entamoeba dispar
FSKIALCPFLQESTVTI

SEQ ID NO: 2382663 - protein, 18 aa, Entamoeba dispar
FSKLKEYYSVYTLFIHLF

SEQ ID NO: 2382664 - protein, 17 aa, Entamoeba dispar
FSKQKAILFFLENNKKE

SEQ ID NO: 2382665 - protein, 17 aa, Entamoeba dispar
FSKRKQPLLTIDNLERI

SEQ ID NO: 2382666 - protein, 33 aa, Entamoeba dispar
FSKRRLEWHYLFLACGYTGIVLVTLYESLSVDS

SEQ ID NO: 2382667 - protein, 18 aa, Entamoeba dispar
FSKSEKFLGIPPLSTFIL

SEQ ID NO: 2382668 - protein, 22 aa, Entamoeba dispar
FSKYSHSIFRDGLLHASFIRYT

SEQ ID NO: 2382669 - protein, 18 aa, Entamoeba dispar
FSLDKTYLMEAYDYLFST

SEQ ID NO: 2382670 - protein, 17 aa, Entamoeba dispar
FSLFKVFQYFSNVNQKK

SEQ ID NO: 2382671 - protein, 25 aa, Entamoeba dispar
FSLIFCCISSIITLILIYLLIQQKD

SEQ ID NO: 2382672 - protein, 17 aa, Entamoeba dispar
FSLILVFVNEIIKIPNC

SEQ ID NO: 2382673 - protein, 18 aa, Entamoeba dispar
FSLLPSFSQMRFSQVEQK

SEQ ID NO: 2382674 - protein, 23 aa, Entamoeba dispar
FSLPEELDLIFSFSFTENPTERV

SEQ ID NO: 2382675 - protein, 17 aa, Entamoeba dispar
FSLSYSILETFKHNYKY

SEQ ID NO: 2382676 - protein, 17 aa, Entamoeba dispar
FSMKRGVLEYIHQLESP

SEQ ID NO: 2382677 - protein, 17 aa, Entamoeba dispar
FSNEGFLVRSDKRNKKE

SEQ ID NO: 2382678 - protein, 19 aa, Entamoeba dispar
FSNRIFKLYPNTQENIAES

SEQ ID NO: 2382679 - protein, 24 aa, Entamoeba dispar
FSNRVVELFVNFILSAKNLKHRIQ

SEQ ID NO: 2382680 - protein, 17 aa, Entamoeba dispar
FSNWYFLGICAGICVCQ

SEQ ID NO: 2382681 - protein, 17 aa, Entamoeba dispar
FSPDQYLILYFSLCIFT

SEQ ID NO: 2382682 - protein, 17 aa, Entamoeba dispar
FSPGVFIEGHIAVKLTN

SEQ ID NO: 2382683 - protein, 25 aa, Entamoeba dispar
FSPLFSWIYCLCIKTHATPSKTTLY

SEQ ID NO: 2382684 - protein, 17 aa, Entamoeba dispar
FSSARKRMSTIVYNEDN

SEQ ID NO: 2382685 - protein, 21 aa, Entamoeba dispar
FSSCLLGMVRLEGFNETTKWL

SEQ ID NO: 2382686 - protein, 21 aa, Entamoeba dispar
FSSFCCMLYLSSIKGIPINQW

SEQ ID NO: 2382687 - protein, 21 aa, Entamoeba dispar
FSSFSLFPLYFMDFFISPKLH

SEQ ID NO: 2382688 - protein, 18 aa, Entamoeba dispar
FSSIITIIIPIIFPSMYF

SEQ ID NO: 2382689 - protein, 19 aa, Entamoeba dispar
FSSIKILPFNERTVIYTKS

SEQ ID NO: 2382690 - protein, 25 aa, Entamoeba dispar
FSSLQWKQHWCDLFRDEMVIHKDAN

SEQ ID NO: 2382691 - protein, 20 aa, Entamoeba dispar
FSSNGNGIWYLISSYERTIN

SEQ ID NO: 2382692 - protein, 20 aa, Entamoeba dispar
FSTACPYNCLNGVCSVSKGG

SEQ ID NO: 2382693 - protein, 18 aa, Entamoeba dispar
FSTFFSVIFWNLNGVENA

SEQ ID NO: 2382694 - protein, 19 aa, Entamoeba dispar
FSTGQFIGSPWCYFVAIYE

SEQ ID NO: 2382695 - protein, 20 aa, Entamoeba dispar
FSTGQFIGSPWCYFVAIYEA

SEQ ID NO: 2382696 - protein, 23 aa, Entamoeba dispar
FSTLEGIPVTWSIDSVNGTKGSG

SEQ ID NO: 2382697 - protein, 18 aa, Entamoeba dispar
FSVPLKFNRQIVDSSDGG

SEQ ID NO: 2382698 - protein, 22 aa, Entamoeba dispar
FSVPTLSSFIVLPSELKLTCNL

SEQ ID NO: 2382699 - protein, 21 aa, Entamoeba dispar
FSYAFCLQEAMIGVINDKDVG

SEQ ID NO: 2382700 - protein, 19 aa, Entamoeba dispar
FSYDLRQLFTMDEEKARIF

SEQ ID NO: 2382701 - protein, 20 aa, Entamoeba dispar
FSYIFPLLFRLINFIEHSVK

SEQ ID NO: 2382702 - protein, 24 aa, Entamoeba dispar
FSYNIMKGLPLDLFSLTNLSILDV

SEQ ID NO: 2382703 - protein, 18 aa, Entamoeba dispar
FSYNIPIINLFFINNYSS

SEQ ID NO: 2382704 - protein, 22 aa, Entamoeba dispar
FTAPLCCSILNIVETVSYKDVL

SEQ ID NO: 2382705 - protein, 34 aa, Entamoeba dispar
FTFHEFLRKLPFPSFVCLFIIILMKISKCSYLYS

SEQ ID NO: 2382706 - protein, 21 aa, Entamoeba dispar
FTFTSCTIGTLIFSTAIAHEG

SEQ ID NO: 2382707 - protein, 44 aa, Entamoeba dispar
FTGHYANLFLRFIRRLLTSRGNYIFKENISFGFNILKSTISLCD

SEQ ID NO: 2382708 - protein, 17 aa, Entamoeba dispar
FTGLYSFTINKGESRYI

SEQ ID NO: 2382709 - protein, 18 aa, Entamoeba dispar
FTGSLKDSALQLITSISK

SEQ ID NO: 2382710 - protein, 23 aa, Entamoeba dispar
FTHLKGISLLSVFSLTMNIMIGT

SEQ ID NO: 2382711 - protein, 19 aa, Entamoeba dispar
FTHWKRFIYVIILIIYFQL

SEQ ID NO: 2382712 - protein, 19 aa, Entamoeba dispar
FTIACLYSVAAIYGISIHW

SEQ ID NO: 2382713 - protein, 18 aa, Entamoeba dispar
FTIIKTILHWYFGTDKTL

SEQ ID NO: 2382714 - protein, 22 aa, Entamoeba dispar
FTIKYCNNISFYYLFNILTTIF

SEQ ID NO: 2382715 - protein, 23 aa, Entamoeba dispar
FTILRPFGTEMWDIEMINFCDMT

SEQ ID NO: 2382716 - protein, 26 aa, Entamoeba dispar
FTIMNFLKYCRFNGFFNKEDKLSSFY

SEQ ID NO: 2382717 - protein, 18 aa, Entamoeba dispar
FTINCLVTVTTLEITADP

SEQ ID NO: 2382718 - protein, 17 aa, Entamoeba dispar
FTIRRWNWIIFASEASS

SEQ ID NO: 2382719 - protein, 17 aa, Entamoeba dispar
FTIYRFGKVTEIMSTYQ

SEQ ID NO: 2382720 - protein, 25 aa, Entamoeba dispar
FTKGLKEWGSAILVGFNGDPNGKDE

SEQ ID NO: 2382721 - protein, 19 aa, Entamoeba dispar
FTKRTQKSIFLIIAGEEHQ

SEQ ID NO: 2382722 - protein, 19 aa, Entamoeba dispar
FTLAFSILFIIGQSTLSAL

SEQ ID NO: 2382723 - protein, 36 aa, Entamoeba dispar
FTLCPCPIDSKCIVRLKVPRVYNINDLNTFKTKYSL

SEQ ID NO: 2382724 - protein, 24 aa, Entamoeba dispar
FTLFETFMYWDFFFIDLHKFLLLK

SEQ ID NO: 2382725 - protein, 22 aa, Entamoeba dispar
FTLLCDHCIMSNKTLQPSEHNG

SEQ ID NO: 2382726 - protein, 17 aa, Entamoeba dispar
FTLSLISYFGFIGKDTL

SEQ ID NO: 2382727 - protein, 24 aa, Entamoeba dispar
FTNCVLIISCVRAFFLYQDISWIF

SEQ ID NO: 2382728 - protein, 24 aa, Entamoeba dispar
FTNHMVVLVGFGFEAQGEGVNGNF

SEQ ID NO: 2382729 - protein, 18 aa, Entamoeba dispar
FTPLELTCKTTLYKPFMK

SEQ ID NO: 2382730 - protein, 24 aa, Entamoeba dispar
FTQFEICKTLRFTLAANKTNAKTR

SEQ ID NO: 2382731 - protein, 17 aa, Entamoeba dispar
FTQGFSYDLLKTIIDRN

SEQ ID NO: 2382732 - protein, 24 aa, Entamoeba dispar
FTQYGYKFGLTVIETYRYNYEYNE

SEQ ID NO: 2382733 - protein, 17 aa, Entamoeba dispar
FTRMKISNIPTTCVYIC

SEQ ID NO: 2382734 - protein, 23 aa, Entamoeba dispar
FTRMNFCKSLTLSIIAFAILTLF

SEQ ID NO: 2382735 - protein, 21 aa, Entamoeba dispar
FTRSVALMSMVGYILGLGDRH

SEQ ID NO: 2382736 - protein, 17 aa, Entamoeba dispar
FTSFLGIFFTIAVIAYQ

SEQ ID NO: 2382737 - protein, 17 aa, Entamoeba dispar
FTSFQSWAVDRMAASEI

SEQ ID NO: 2382738 - protein, 17 aa, Entamoeba dispar
FTSGGLLTLCFVSLCFF

SEQ ID NO: 2382739 - protein, 19 aa, Entamoeba dispar
FTSIPLCSLQTFFPPMLPF

SEQ ID NO: 2382740 - protein, 17 aa, Entamoeba dispar
FTSNGYGAVRWDGSPVE

SEQ ID NO: 2382741 - protein, 19 aa, Entamoeba dispar
FTSQLGLMDRSWVKRRGTL

SEQ ID NO: 2382742 - protein, 18 aa, Entamoeba dispar
FTSVHWMVRIYKVKKDNN

SEQ ID NO: 2382743 - protein, 24 aa, Entamoeba dispar
FTTDVFMKTTLVMKYICPNNCNQN

SEQ ID NO: 2382744 - protein, 17 aa, Entamoeba dispar
FTTDVPILFTPIVHPCS

SEQ ID NO: 2382745 - protein, 38 aa, Entamoeba dispar
FTTLCAYFSLIFKRKELWEMFRFHRIVWEWKTYHFITL

SEQ ID NO: 2382746 - protein, 25 aa, Entamoeba dispar
FTVFLKKYPNVVGAFLGRGTALAML

SEQ ID NO: 2382747 - protein, 18 aa, Entamoeba dispar
FTVLFTIVLIITSIRLIY

SEQ ID NO: 2382748 - protein, 18 aa, Entamoeba dispar
FTVLQLFYQFKTNKMTFF

SEQ ID NO: 2382749 - protein, 17 aa, Entamoeba dispar
FVALLLMVNGIYMIVSP

SEQ ID NO: 2382750 - protein, 18 aa, Entamoeba dispar
FVCCITCYGNLLTYGSQY

SEQ ID NO: 2382751 - protein, 19 aa, Entamoeba dispar
FVCGIFLILFLIWNENGDW

SEQ ID NO: 2382752 - protein, 19 aa, Entamoeba dispar
FVCKEWYLDSLLNPSQSTI

SEQ ID NO: 2382753 - protein, 21 aa, Entamoeba dispar
FVCLNCGGIYLLLISNKTKEK

SEQ ID NO: 2382754 - protein, 18 aa, Entamoeba dispar
FVCMYPLFFQVIAHLAII

SEQ ID NO: 2382755 - protein, 20 aa, Entamoeba dispar
FVDAIMCLWTVKRINEATKR

SEQ ID NO: 2382756 - protein, 18 aa, Entamoeba dispar
FVDPARPYTYGVWIQLNS

SEQ ID NO: 2382757 - protein, 18 aa, Entamoeba dispar
FVDYAFRYFGQQNHINPY

SEQ ID NO: 2382758 - protein, 19 aa, Entamoeba dispar
FVEEFAVVFLKKVMLKGTI

SEQ ID NO: 2382759 - protein, 18 aa, Entamoeba dispar
FVEYCFLFFGQQNHIDPY

SEQ ID NO: 2382760 - protein, 25 aa, Entamoeba dispar
FVFEPESKLGLVVNVSEWKGDPQYL

SEQ ID NO: 2382761 - protein, 17 aa, Entamoeba dispar
FVFIPPYYSKKMWPLVI

SEQ ID NO: 2382762 - protein, 24 aa, Entamoeba dispar
FVFMIYHLLSFFFFHSLCFLHVHF

SEQ ID NO: 2382763 - protein, 19 aa, Entamoeba dispar
FVHFIILITFYFVDIEEHW

SEQ ID NO: 2382764 - protein, 18 aa, Entamoeba dispar
FVHLFGELNWWPIKYKID

SEQ ID NO: 2382765 - protein, 25 aa, Entamoeba dispar
FVHLPNIFLSIIIKLGIIGILVISS

SEQ ID NO: 2382766 - protein, 25 aa, Entamoeba dispar
FVIAFCIISSIVIVVLIRKQIRQKR

SEQ ID NO: 2382767 - protein, 19 aa, Entamoeba dispar
FVIIAMGCFQVWYIKRQFK

SEQ ID NO: 2382768 - protein, 19 aa, Entamoeba dispar
FVIKNCFLNEPSIVEDEEN

SEQ ID NO: 2382769 - protein, 22 aa, Entamoeba dispar
FVINIPVPRVFALIHKTFPTLL

SEQ ID NO: 2382770 - protein, 19 aa, Entamoeba dispar
FVISIIFSGFIPLLIKILF

SEQ ID NO: 2382771 - protein, 23 aa, Entamoeba dispar
  misc_feature (18)..(19): Xaa can be any naturally occurring amino acid
FVIVLKLSAIYLYGSGFXXFHSL

SEQ ID NO: 2382772 - protein, 20 aa, Entamoeba dispar
FVKYKFHGSFTIETDAVNSI

SEQ ID NO: 2382773 - protein, 20 aa, Entamoeba dispar
FVLACACRGIIVVTVYATLG

SEQ ID NO: 2382774 - protein, 26 aa, Entamoeba dispar
FVLCAGCILSYCFILLLNRYTKLCVY

SEQ ID NO: 2382775 - protein, 17 aa, Entamoeba dispar
FVLESFEAMVNELLFSD

SEQ ID NO: 2382776 - protein, 23 aa, Entamoeba dispar
FVLPLWFHRVFYWISIIGAILFI

SEQ ID NO: 2382777 - protein, 25 aa, Entamoeba dispar
FVLSLRFSLKLFVGFYPSSSISIDE

SEQ ID NO: 2382778 - protein, 17 aa, Entamoeba dispar
FVLVLSFVLNPVIGCQY

SEQ ID NO: 2382779 - protein, 17 aa, Entamoeba dispar
FVLWNFKVGQPALLYLV

SEQ ID NO: 2382780 - protein, 19 aa, Entamoeba dispar
FVMPILCVLMLVFMLLSKL

SEQ ID NO: 2382781 - protein, 20 aa, Entamoeba dispar
FVMPILCVLMLVFMLLSKLL

SEQ ID NO: 2382782 - protein, 23 aa, Entamoeba dispar
FVMTPLFPPVMRLFNYLDQNTMH

SEQ ID NO: 2382783 - protein, 18 aa, Entamoeba dispar
FVNARLFQLNEFGSMEKI

SEQ ID NO: 2382784 - protein, 24 aa, Entamoeba dispar
FVNEIIKIPNCFNIVDENNKSIEL

SEQ ID NO: 2382785 - protein, 28 aa, Entamoeba dispar
FVPEFLRLPVWMLFLGIDVNLAYKRYNE

SEQ ID NO: 2382786 - protein, 25 aa, Entamoeba dispar
FVPILPIRICCALFGLIGLPIFAYA

SEQ ID NO: 2382787 - protein, 19 aa, Entamoeba dispar
FVPQDAFFMCQCIFDGSNY

SEQ ID NO: 2382788 - protein, 19 aa, Entamoeba dispar
FVPVCLVAPKCGRIGSMRY

SEQ ID NO: 2382789 - protein, 26 aa, Entamoeba dispar
FVQENIELFTQFGFEVIFREDKEVTQ

SEQ ID NO: 2382790 - protein, 23 aa, Entamoeba dispar
FVQKDWMCLLSYIVIGLGVMCAF

SEQ ID NO: 2382791 - protein, 25 aa, Entamoeba dispar
FVSCVYPKYWTAYRGGILRGLNCEK

SEQ ID NO: 2382792 - protein, 25 aa, Entamoeba dispar
FVSECPHINALFSMLEDMEILDFHS

SEQ ID NO: 2382793 - protein, 22 aa, Entamoeba dispar
FVSICSSYIYPGMLNNFSVTTI

SEQ ID NO: 2382794 - protein, 25 aa, Entamoeba dispar
FVSIFAFIIGFIIYRKKRSNNGYHD

SEQ ID NO: 2382795 - protein, 20 aa, Entamoeba dispar
FVSISAKIGLKYAAKERTIG

SEQ ID NO: 2382796 - protein, 17 aa, Entamoeba dispar
FVSNIWTPFSFKIGLLY

SEQ ID NO: 2382797 - protein, 24 aa, Entamoeba dispar
FVSYPGVCSETTYQYSLSTLTGID

SEQ ID NO: 2382798 - protein, 17 aa, Entamoeba dispar
FVTSVKASSDWSYYHSG

SEQ ID NO: 2382799 - protein, 24 aa, Entamoeba dispar
FVVAVCIVCVLIISIFVKKASSKI

SEQ ID NO: 2382800 - protein, 18 aa, Entamoeba dispar
FVVLTIFALRELMVSVDT

SEQ ID NO: 2382801 - protein, 22 aa, Entamoeba dispar
FVVSFGIMYPITFAIDIYGVAP

SEQ ID NO: 2382802 - protein, 20 aa, Entamoeba dispar
FWDCSINQFILESTSKLFLG

SEQ ID NO: 2382803 - protein, 29 aa, Entamoeba dispar
FWINIYHIMLLHGLLYWRHRPNIEFKDMI

SEQ ID NO: 2382804 - protein, 21 aa, Entamoeba dispar
FWMYRRCGDLSSFIKDRQNER

SEQ ID NO: 2382805 - protein, 23 aa, Entamoeba dispar
FWPSKYHKMELEIGRVYEFSLMP

SEQ ID NO: 2382806 - protein, 23 aa, Entamoeba dispar
FWYNEDMKWLFVMSQNTDIGNKD

SEQ ID NO: 2382807 - protein, 17 aa, Entamoeba dispar
FYAILGLKNKSNEEDIK

SEQ ID NO: 2382808 - protein, 28 aa, Entamoeba dispar
FYDSIGVICKFCLNNIQPHLLIQLHHCI

SEQ ID NO: 2382809 - protein, 24 aa, Entamoeba dispar
FYEILRRIIQYCISRYNNNQNNNQ

SEQ ID NO: 2382810 - protein, 23 aa, Entamoeba dispar
FYEVCSKPNLKRYVMCKNTTLSI

SEQ ID NO: 2382811 - protein, 26 aa, Entamoeba dispar
FYEVYRGCSCWCNILATKLSSKSSED

SEQ ID NO: 2382812 - protein, 20 aa, Entamoeba dispar
FYFYSVRFLGKIFRSRDNDT

SEQ ID NO: 2382813 - protein, 18 aa, Entamoeba dispar
FYGAVLIPGKISIVTEFA

SEQ ID NO: 2382814 - protein, 25 aa, Entamoeba dispar
FYGDWLKIFNVFIIISILFGGLMFV

SEQ ID NO: 2382815 - protein, 17 aa, Entamoeba dispar
FYGSLKGLKGYILEQEI

SEQ ID NO: 2382816 - protein, 17 aa, Entamoeba dispar
FYICLFLLYMFIPFKKY

SEQ ID NO: 2382817 - protein, 22 aa, Entamoeba dispar
FYILRQLWYISLFLTPLGIKVC

SEQ ID NO: 2382818 - protein, 20 aa, Entamoeba dispar
FYIPICIIAMISIYKKNIER

SEQ ID NO: 2382819 - protein, 17 aa, Entamoeba dispar
FYIPSGLTSYINFPMII

SEQ ID NO: 2382820 - protein, 31 aa, Entamoeba dispar
FYISMILSILLFFGWYIFYGFVGGFKFISMG

SEQ ID NO: 2382821 - protein, 18 aa, Entamoeba dispar
FYITRFVVLETINEYINK

SEQ ID NO: 2382822 - protein, 19 aa, Entamoeba dispar
FYIVCSGFIKVSYGKVTFK

SEQ ID NO: 2382823 - protein, 20 aa, Entamoeba dispar
FYKGCSGSLIPEIEQCEITK

SEQ ID NO: 2382824 - protein, 23 aa, Entamoeba dispar
FYLGYPRCRFINGPTLCQCQGPC

SEQ ID NO: 2382825 - protein, 28 aa, Entamoeba dispar
FYLHVFICLLPPLAPRLISYFFNLLCPP

SEQ ID NO: 2382826 - protein, 23 aa, Entamoeba dispar
FYLKSSNCQWALYNNDGLKNPLN

SEQ ID NO: 2382827 - protein, 18 aa, Entamoeba dispar
FYLLILIPPLLLGAKEMV

SEQ ID NO: 2382828 - protein, 19 aa, Entamoeba dispar
FYLNELCILCEEGKRSSNS

SEQ ID NO: 2382829 - protein, 17 aa, Entamoeba dispar
FYLSSQQCGICYEAVGE

SEQ ID NO: 2382830 - protein, 18 aa, Entamoeba dispar
FYLTCIAFGGFFEVVMMI

SEQ ID NO: 2382831 - protein, 28 aa, Entamoeba dispar
FYNDMFKIRFSFQNGRIITPYIPIHQNG

SEQ ID NO: 2382832 - protein, 17 aa, Entamoeba dispar
FYNKKCVVDVCGSTIES

SEQ ID NO: 2382833 - protein, 18 aa, Entamoeba dispar
FYPNEICPYTIRRGKGDW

SEQ ID NO: 2382834 - protein, 25 aa, Entamoeba dispar
FYPTFLFQVFMCYWMSNVVNGIFTV

SEQ ID NO: 2382835 - protein, 22 aa, Entamoeba dispar
FYQKLIEIYGVFASTITSSVVM

SEQ ID NO: 2382836 - protein, 23 aa, Entamoeba dispar
FYQPRTFSDIILITLGVGLTLMT

SEQ ID NO: 2382837 - protein, 24 aa, Entamoeba dispar
FYQSFGLPLIITRGNNVFGPHQFP

SEQ ID NO: 2382838 - protein, 23 aa, Entamoeba dispar
FYSACDYVFHFLVRVEPFTTMFI

SEQ ID NO: 2382839 - protein, 18 aa, Entamoeba dispar
FYSMFSAGHFIIGLGDII

SEQ ID NO: 2382840 - protein, 21 aa, Entamoeba dispar
FYSNICCGFSSMQGWRKTMED

SEQ ID NO: 2382841 - protein, 22 aa, Entamoeba dispar
FYSTYMRQCYPQIGQSTAIIVT

SEQ ID NO: 2382842 - protein, 25 aa, Entamoeba dispar
FYTFACTFLSFFFILFFGLFPLSLL

SEQ ID NO: 2382843 - protein, 17 aa, Entamoeba dispar
FYTFLTFEISSGLSTKL

SEQ ID NO: 2382844 - protein, 25 aa, Entamoeba dispar
FYTIPCTFIPISLYHYMFICIYDYM

SEQ ID NO: 2382845 - protein, 19 aa, Entamoeba dispar
FYVAEWLSIVMFFFALSQR

SEQ ID NO: 2382846 - protein, 28 aa, Entamoeba dispar
FYYDYLSLLSIESFCLIILKRSIIEPLI

SEQ ID NO: 2382847 - protein, 19 aa, Entamoeba dispar
GAACIVFLAARIVALYFYN

SEQ ID NO: 2382848 - protein, 17 aa, Entamoeba dispar
GACSLVINRNSLQRLTI

SEQ ID NO: 2382849 - protein, 26 aa, Entamoeba dispar
GACYLEKKMCIAIEFAPNGSLGHILK

SEQ ID NO: 2382850 - protein, 22 aa, Entamoeba dispar
GAELTVPIGKTFHSLQVKTNNP

SEQ ID NO: 2382851 - protein, 23 aa, Entamoeba dispar
GAEQLPPLYSYLLFKSKYPNVYS

SEQ ID NO: 2382852 - protein, 23 aa, Entamoeba dispar
GAFEIDIPFFAARDYPEVHKEIL

SEQ ID NO: 2382853 - protein, 22 aa, Entamoeba dispar
GAGAAFPFYSLNFVDLIRILMR

SEQ ID NO: 2382854 - protein, 24 aa, Entamoeba dispar
GAGCVGACCAMELSKYKSLKIALL

SEQ ID NO: 2382855 - protein, 17 aa, Entamoeba dispar
GAICAFGLLAHQNPWIT

SEQ ID NO: 2382856 - protein, 29 aa, Entamoeba dispar
GAIFPFFTLKIVDLIMCLLSINSDTLTDD

SEQ ID NO: 2382857 - protein, 17 aa, Entamoeba dispar
GAIKIPVDQDETAIIYY

SEQ ID NO: 2382858 - protein, 21 aa, Entamoeba dispar
GAILFSLKTLFLIINTFAFNN

SEQ ID NO: 2382859 - protein, 25 aa, Entamoeba dispar
GAINCISCIMGLYFHHTYLSKGYNA

SEQ ID NO: 2382860 - protein, 24 aa, Entamoeba dispar
GALIKSYHFHNSKSLFVLVPKQNH

SEQ ID NO: 2382861 - protein, 24 aa, Entamoeba dispar
GAQKKLRIESSMKLFRLNDSDQLE

SEQ ID NO: 2382862 - protein, 26 aa, Entamoeba dispar
GARLLIKIFSICIDKMYSKKPLWVLK

SEQ ID NO: 2382863 - protein, 21 aa, Entamoeba dispar
GASLFLHPHVNIVIRVIMPFL

SEQ ID NO: 2382864 - protein, 24 aa, Entamoeba dispar
GASSCLMCPIGTYSKGEKNTYCKQ

SEQ ID NO: 2382865 - protein, 25 aa, Entamoeba dispar
GATRENMSYFSLWRALQMPYFYLYS

SEQ ID NO: 2382866 - protein, 31 aa, Entamoeba dispar
GCEIAFIVIICLADTTLLIVLIVFGTLALLP

SEQ ID NO: 2382867 - protein, 19 aa, Entamoeba dispar
GCFHFPRKNSFLVQLKEKD

SEQ ID NO: 2382868 - protein, 25 aa, Entamoeba dispar
GCFIGVVVSCCLFCKRLIEQKKYIN

SEQ ID NO: 2382869 - protein, 17 aa, Entamoeba dispar
GCFSVLISITSTLTILT

SEQ ID NO: 2382870 - protein, 17 aa, Entamoeba dispar
GCGICKNGYYRNGKGCS

SEQ ID NO: 2382871 - protein, 20 aa, Entamoeba dispar
GCGILEFALAISIGGLGIVH

SEQ ID NO: 2382872 - protein, 25 aa, Entamoeba dispar
GCGKASRLTYHFTKPSYIFITGATQ

SEQ ID NO: 2382873 - protein, 17 aa, Entamoeba dispar
GCGYCSMGTDNVIRYHD

SEQ ID NO: 2382874 - protein, 17 aa, Entamoeba dispar
GCISPNECASCIEPAYQ

SEQ ID NO: 2382875 - protein, 17 aa, Entamoeba dispar
GCKECKNDLSAEGQKTR

SEQ ID NO: 2382876 - protein, 17 aa, Entamoeba dispar
GCKRCEEGYYLTKDMKC

SEQ ID NO: 2382877 - protein, 25 aa, Entamoeba dispar
GCKRCKEGYYLTKDMKCLKCDSNCE

SEQ ID NO: 2382878 - protein, 25 aa, Entamoeba dispar
GCKRCKEGYYLTKEMKCLKCDDKCE

SEQ ID NO: 2382879 - protein, 17 aa, Entamoeba dispar
GCLIQFASCPNIQIQGT

SEQ ID NO: 2382880 - protein, 20 aa, Entamoeba dispar
GCLLCIPYIIFEYLTLNDSN

SEQ ID NO: 2382881 - protein, 25 aa, Entamoeba dispar
GCNKLCKCTRRYKPNGSVSCEYKYL

SEQ ID NO: 2382882 - protein, 19 aa, Entamoeba dispar
GCNNVTCTCDVGFKAQDGI

SEQ ID NO: 2382883 - protein, 25 aa, Entamoeba dispar
GCQECIKVNSGVKCRMCSDSSLILV

SEQ ID NO: 2382884 - protein, 24 aa, Entamoeba dispar
GCQTGYYPFGLRCEKIVNQPKTCE

SEQ ID NO: 2382885 - protein, 26 aa, Entamoeba dispar
GCSKCLDGTYLYNGECYLCSNDCVTC

SEQ ID NO: 2382886 - protein, 21 aa, Entamoeba dispar
GCSLSLKSMSYWSLTPDKKED

SEQ ID NO: 2382887 - protein, 18 aa, Entamoeba dispar
GCSPIIRHKLVFSEPRFK

SEQ ID NO: 2382888 - protein, 19 aa, Entamoeba dispar
GCTIIELITGNPPYYDLNP

SEQ ID NO: 2382889 - protein, 27 aa, Entamoeba dispar
GCTKCKKRYSGELCNECASGYKGYPEC

SEQ ID NO: 2382890 - protein, 18 aa, Entamoeba dispar
GCVFAASVVMSFDMQTLT

SEQ ID NO: 2382891 - protein, 21 aa, Entamoeba dispar
GCVLSSLIIGFGVYGYTFLGN

SEQ ID NO: 2382892 - protein, 25 aa, Entamoeba dispar
GCYTEILKTLILYHILSREGSSNLF

SEQ ID NO: 2382893 - protein, 21 aa, Entamoeba dispar
GDAVGFIAIEFGKCYYYKNNA

SEQ ID NO: 2382894 - protein, 20 aa, Entamoeba dispar
GDAYTNGRYMYITADKKSQK

SEQ ID NO: 2382895 - protein, 19 aa, Entamoeba dispar
GDCGESIYINSETKDTGYW

SEQ ID NO: 2382896 - protein, 17 aa, Entamoeba dispar
GDCSLCLLEYYLDEGSC

SEQ ID NO: 2382897 - protein, 21 aa, Entamoeba dispar
GDCTKLAVGKIVFVIIIILII

SEQ ID NO: 2382898 - protein, 22 aa, Entamoeba dispar
GDCWIVPIYIGHCIDLTFFWDS

SEQ ID NO: 2382899 - protein, 17 aa, Entamoeba dispar
GDCYVCLETHYLDGSTC

SEQ ID NO: 2382900 - protein, 18 aa, Entamoeba dispar
GDDPFELIRNFGIAFSSF

SEQ ID NO: 2382901 - protein, 22 aa, Entamoeba dispar
GDEWKFTPYIFFYAIIFFLQLV

SEQ ID NO: 2382902 - protein, 25 aa, Entamoeba dispar
GDEWWSSVCLSMLTRACDFISKNPG

SEQ ID NO: 2382903 - protein, 24 aa, Entamoeba dispar
GDGKRYAMHTCASNSVFSSSDRID

SEQ ID NO: 2382904 - protein, 22 aa, Entamoeba dispar
GDGKSSLGNFILKKNIFNESND

SEQ ID NO: 2382905 - protein, 20 aa, Entamoeba dispar
GDGKSSLGNFILKKNTFKVS

SEQ ID NO: 2382906 - protein, 32 aa, Entamoeba dispar
GDGRWWAKKRMLIYLRRRWEKSNETIQLIDQI

SEQ ID NO: 2382907 - protein, 17 aa, Entamoeba dispar
GDGYLSIDVITSENPVL

SEQ ID NO: 2382908 - protein, 26 aa, Entamoeba dispar
GDKCTFKFGRRRIFLVVGAIIDVLGL

SEQ ID NO: 2382909 - protein, 26 aa, Entamoeba dispar
GDKGEWSTKCVLAYCDSGYKFDYNKN

SEQ ID NO: 2382910 - protein, 27 aa, Entamoeba dispar
GDKGEWSTKCVLAYCDSGYKFDYNSNQ

SEQ ID NO: 2382911 - protein, 26 aa, Entamoeba dispar
GDKGEWSTKCVMAYCDDGYKFDYNNN

SEQ ID NO: 2382912 - protein, 24 aa, Entamoeba dispar
GDKRVEGVPLFFSSSTKEAGQYPK

SEQ ID NO: 2382913 - protein, 21 aa, Entamoeba dispar
GDLDVFITFVYDYINILNRLF

SEQ ID NO: 2382914 - protein, 20 aa, Entamoeba dispar
GDLDVFLVFMNNVLNRFMKV

SEQ ID NO: 2382915 - protein, 17 aa, Entamoeba dispar
GDLLPADGIFVHGNDLR

SEQ ID NO: 2382916 - protein, 17 aa, Entamoeba dispar
GDMYEVAERGANLSGGQ

SEQ ID NO: 2382917 - protein, 29 aa, Entamoeba dispar
GDNGEWSTKCVLAYCDLGYKFDYINNNCI

SEQ ID NO: 2382918 - protein, 28 aa, Entamoeba dispar
GDNGEWSTKCVLAYCDSGYKFDYINNNC

SEQ ID NO: 2382919 - protein, 28 aa, Entamoeba dispar
GDNGEWSTKCVLAYCDSGYKFDYNKNKC

SEQ ID NO: 2382920 - protein, 26 aa, Entamoeba dispar
GDNGEWSTKCVLSYCDDGYKFDYINN

SEQ ID NO: 2382921 - protein, 26 aa, Entamoeba dispar
GDNGEWSTKCVLSYCDDGYKFDYNNN

SEQ ID NO: 2382922 - protein, 26 aa, Entamoeba dispar
GDNGEWSTKCVLSYCDEGYKFDYINN

SEQ ID NO: 2382923 - protein, 27 aa, Entamoeba dispar
GDNGEWSTKCVLSYCDPGYKFDYINNK

SEQ ID NO: 2382924 - protein, 27 aa, Entamoeba dispar
GDNGEWSTKCVLSYCDSGYKFDYINNK

SEQ ID NO: 2382925 - protein, 26 aa, Entamoeba dispar
GDNGEWSTKCVLSYCDSGYKFDYNNN

SEQ ID NO: 2382926 - protein, 26 aa, Entamoeba dispar
GDNGEWSTKCVMAYCDDGYKFDYNNN

SEQ ID NO: 2382927 - protein, 21 aa, Entamoeba dispar
GDPRISFIEVGWFGMNGMWDT

SEQ ID NO: 2382928 - protein, 22 aa, Entamoeba dispar
GDSYNRFIDVWGMTPEQCTANV

SEQ ID NO: 2382929 - protein, 17 aa, Entamoeba dispar
GDSYVFDPMCVKKDMDC

SEQ ID NO: 2382930 - protein, 17 aa, Entamoeba dispar
GDVLGVFFSVWMASQIL

SEQ ID NO: 2382931 - protein, 25 aa, Entamoeba dispar
GDVSAWISGLLYFFGRIPQIIHIYR

SEQ ID NO: 2382932 - protein, 18 aa, Entamoeba dispar
GDYIALMRSYFTGYDQRN

SEQ ID NO: 2382933 - protein, 21 aa, Entamoeba dispar
GEAFESIIIAYGQQFAKGKSV

SEQ ID NO: 2382934 - protein, 22 aa, Entamoeba dispar
GEALSWATLIQVFGFIVLAIGF

SEQ ID NO: 2382935 - protein, 22 aa, Entamoeba dispar
GEASSFKYVYGFFDITESKLYY

SEQ ID NO: 2382936 - protein, 19 aa, Entamoeba dispar
GECFNCINNYYLKEGECVD

SEQ ID NO: 2382937 - protein, 24 aa, Entamoeba dispar
GECHPFTDWFAYVFGICSSIVTFV

SEQ ID NO: 2382938 - protein, 21 aa, Entamoeba dispar
GECQIDSYGIKTCLSCISDEY

SEQ ID NO: 2382939 - protein, 21 aa, Entamoeba dispar
GECVYYPSAEHKIEKRKCTTE

SEQ ID NO: 2382940 - protein, 27 aa, Entamoeba dispar
GEDGLKWRPLFFYCRFLVTKIIVPIFL

SEQ ID NO: 2382941 - protein, 20 aa, Entamoeba dispar
GEFHVAFGKISFRQGRLNQF

SEQ ID NO: 2382942 - protein, 17 aa, Entamoeba dispar
GEFICQYGLDVLIELLY

SEQ ID NO: 2382943 - protein, 21 aa, Entamoeba dispar
GEFYNEGWCVLTIGDKLNNTT

SEQ ID NO: 2382944 - protein, 25 aa, Entamoeba dispar
GEGAFGVVFKGEFRGNKVAVKQMKN

SEQ ID NO: 2382945 - protein, 20 aa, Entamoeba dispar
GEGLRAIVVVLNFNEVRLSE

SEQ ID NO: 2382946 - protein, 21 aa, Entamoeba dispar
GEGSFGIVFLGKYRGVDVAIK

SEQ ID NO: 2382947 - protein, 21 aa, Entamoeba dispar
GEGSFGVVFLGNFKGNKVAIK

SEQ ID NO: 2382948 - protein, 27 aa, Entamoeba dispar
GEGTFGVVFKGEWRKIDVAVKCVKTDV

SEQ ID NO: 2382949 - protein, 18 aa, Entamoeba dispar
GEHGIYTLECGISKRGIY

SEQ ID NO: 2382950 - protein, 17 aa, Entamoeba dispar
GEIEFEYVKNIKETLNV

SEQ ID NO: 2382951 - protein, 20 aa, Entamoeba dispar
GEIKISGYATILSPDKIHFT

SEQ ID NO: 2382952 - protein, 24 aa, Entamoeba dispar
GEIPLEFSNLMKRFNVIEVPGDIK

SEQ ID NO: 2382953 - protein, 17 aa, Entamoeba dispar
GEIPRYTGGELFYYPNY

SEQ ID NO: 2382954 - protein, 22 aa, Entamoeba dispar
GEKFNILQGLFIQPFLHYTEVL

SEQ ID NO: 2382955 - protein, 19 aa, Entamoeba dispar
GEKNCKYFLFFLLSMSISL

SEQ ID NO: 2382956 - protein, 17 aa, Entamoeba dispar
GEKSGEIITATAPWETY

SEQ ID NO: 2382957 - protein, 21 aa, Entamoeba dispar
GEKSIPIYLYHTFNYLYTPFA

SEQ ID NO: 2382958 - protein, 26 aa, Entamoeba dispar
GEKVGWFTFIEVFGFIFLTGGFLLYT

SEQ ID NO: 2382959 - protein, 34 aa, Entamoeba dispar
GELELLITIIRSCWKLNVFEGYEGIISLQVLKKL

SEQ ID NO: 2382960 - protein, 21 aa, Entamoeba dispar
GELISKIILLFVSFLEYYANK

SEQ ID NO: 2382961 - protein, 21 aa, Entamoeba dispar
GELPENYFLVPAVMTVLDPIS

SEQ ID NO: 2382962 - protein, 24 aa, Entamoeba dispar
GELTCSLCPLFAGLLATAMDDRRY

SEQ ID NO: 2382963 - protein, 26 aa, Entamoeba dispar
GEMRISFIETFAWDYSFNQTIPREFL

SEQ ID NO: 2382964 - protein, 21 aa, Entamoeba dispar
GENPFSLAVVQLVLFVLEKFI

SEQ ID NO: 2382965 - protein, 17 aa, Entamoeba dispar
GEPFIFNVVILFVMLIR

SEQ ID NO: 2382966 - protein, 22 aa, Entamoeba dispar
GEPKRPQIVDMRERVWFLHDRV

SEQ ID NO: 2382967 - protein, 18 aa, Entamoeba dispar
GEPLGWQTALQVLGFLLL

SEQ ID NO: 2382968 - protein, 21 aa, Entamoeba dispar
GEPYGVFMFFAAYIDMEQGTS

SEQ ID NO: 2382969 - protein, 20 aa, Entamoeba dispar
GEQFSCSKKVLGHGSLGTIV

SEQ ID NO: 2382970 - protein, 19 aa, Entamoeba dispar
GERYRLSAMLFVHYLGWIF

SEQ ID NO: 2382971 - protein, 20 aa, Entamoeba dispar
GESDRVTAIIVGWNDDTMTS

SEQ ID NO: 2382972 - protein, 18 aa, Entamoeba dispar
GESIAFDIAENGFSLIGE

SEQ ID NO: 2382973 - protein, 23 aa, Entamoeba dispar
GETDWKIRKTIPFTQNIDKQDIP

SEQ ID NO: 2382974 - protein, 19 aa, Entamoeba dispar
GETSTSFCVCIVRKELLQF

SEQ ID NO: 2382975 - protein, 21 aa, Entamoeba dispar
GEVNPGFLYIITFPFLFGVMF

SEQ ID NO: 2382976 - protein, 21 aa, Entamoeba dispar
GEYIPIQWYFGMIILIIGVIL

SEQ ID NO: 2382977 - protein, 21 aa, Entamoeba dispar
GEYKLPVYTYDGTTGYMTSTD

SEQ ID NO: 2382978 - protein, 21 aa, Entamoeba dispar
GEYLCKKCSDGTYSDGVGATN

SEQ ID NO: 2382979 - protein, 23 aa, Entamoeba dispar
GEYSFNQPEIWTTTELTNGCPCN

SEQ ID NO: 2382980 - protein, 25 aa, Entamoeba dispar
GFASELKIDLALMLNLIDPLKRYGE

SEQ ID NO: 2382981 - protein, 19 aa, Entamoeba dispar
GFELKKCCAENEIHLKKED

SEQ ID NO: 2382982 - protein, 24 aa, Entamoeba dispar
GFEMKYRGCFLLLTGISLSYYSIF

SEQ ID NO: 2382983 - protein, 17 aa, Entamoeba dispar
GFGIILFLHLCFDVLTL

SEQ ID NO: 2382984 - protein, 24 aa, Entamoeba dispar
GFHNYRYFFLFLFYLWISMLIVDC

SEQ ID NO: 2382985 - protein, 21 aa, Entamoeba dispar
GFIHKAIELLGKWAKEDFASK

SEQ ID NO: 2382986 - protein, 25 aa, Entamoeba dispar
GFILFIPFLVAYIIGKKSKSKGIKL

SEQ ID NO: 2382987 - protein, 21 aa, Entamoeba dispar
GFIPCIKRCRAWAENKEKSYH

SEQ ID NO: 2382988 - protein, 31 aa, Entamoeba dispar
GFLVLKMPFPLSYRFKLITQQGLGGMDLDVS

SEQ ID NO: 2382989 - protein, 24 aa, Entamoeba dispar
GFMAPWESFFFYWESVLKKGIELS

SEQ ID NO: 2382990 - protein, 18 aa, Entamoeba dispar
GFMPHVFSTFAGNTVLVD

SEQ ID NO: 2382991 - protein, 31 aa, Entamoeba dispar
GFNAACIPLLWVCTLSSLILIIPNFHTINDF

SEQ ID NO: 2382992 - protein, 18 aa, Entamoeba dispar
GFNFEWCLIYKIDRINKR

SEQ ID NO: 2382993 - protein, 19 aa, Entamoeba dispar
GFNQYGIVGAFVFSYLACV

SEQ ID NO: 2382994 - protein, 18 aa, Entamoeba dispar
GFNRILFYLFSDYFKELF

SEQ ID NO: 2382995 - protein, 31 aa, Entamoeba dispar
GFNTVDFILCCCGGLLLLIFIAYITLIVIGL

SEQ ID NO: 2382996 - protein, 18 aa, Entamoeba dispar
GFPLLWCICFCVYSSSDD

SEQ ID NO: 2382997 - protein, 36 aa, Entamoeba dispar
GFQNLLIIFLICWCLFRILDSMIRFFLILFTPQPDD

SEQ ID NO: 2382998 - protein, 41 aa, Entamoeba dispar
GFSEIIDLIELWRCIIKHSLFQLIPWLGICVKSVSLNPNRA

SEQ ID NO: 2382999 - protein, 17 aa, Entamoeba dispar
GFSGVFMEKILKNKVDN

SEQ ID NO: 2383000 - protein, 18 aa, Entamoeba dispar
GFSIFPYFICIFATHNNL

SEQ ID NO: 2383001 - protein, 20 aa, Entamoeba dispar
GFSIGGLIVSRIASDKKASQ

SEQ ID NO: 2383002 - protein, 23 aa, Entamoeba dispar
GFSLFFIFVIWRVGVLYQQIDQK

SEQ ID NO: 2383003 - protein, 21 aa, Entamoeba dispar
GFTNFCIFGILFLVFHILEFS

SEQ ID NO: 2383004 - protein, 20 aa, Entamoeba dispar
GFYSYEFMSANELFPSINAI

SEQ ID NO: 2383005 - protein, 22 aa, Entamoeba dispar
GGAIYPFFTIKFIDLIVVMMEM

SEQ ID NO: 2383006 - protein, 23 aa, Entamoeba dispar
GGAIYPFFTIKFIDLIVVMMEMR

SEQ ID NO: 2383007 - protein, 20 aa, Entamoeba dispar
GGAQYPVFYLSIIGTDNDVV

SEQ ID NO: 2383008 - protein, 18 aa, Entamoeba dispar
GGAYICTFLLMSTLIYWV

SEQ ID NO: 2383009 - protein, 21 aa, Entamoeba dispar
GGDSDKPGFCFVGDITGFQWY

SEQ ID NO: 2383010 - protein, 23 aa, Entamoeba dispar
GGECNRFSFIYLRNVFNSSYAFI

SEQ ID NO: 2383011 - protein, 19 aa, Entamoeba dispar
GGEVIKGYYSCYLIPFHIA

SEQ ID NO: 2383012 - protein, 17 aa, Entamoeba dispar
GGFGIVYKGIFRENEVA

SEQ ID NO: 2383013 - protein, 17 aa, Entamoeba dispar
GGFIIYFYIIFQCGYGT

SEQ ID NO: 2383014 - protein, 24 aa, Entamoeba dispar
GGFLFLRFINPAIVSPQRFGSRML

SEQ ID NO: 2383015 - protein, 21 aa, Entamoeba dispar
GGGGEMVLWVIIKVLLHSFPN

SEQ ID NO: 2383016 - protein, 27 aa, Entamoeba dispar
GGGTFGIVYRADWRRVDVAVKVMKTDL

SEQ ID NO: 2383017 - protein, 26 aa, Entamoeba dispar
GGGTFGIVYRAEWRGVDVAVKVMKTD

SEQ ID NO: 2383018 - protein, 27 aa, Entamoeba dispar
GGGTFGIVYRAEWRKVDVAVKVMKSDL

SEQ ID NO: 2383019 - protein, 27 aa, Entamoeba dispar
GGGTFGIVYRAEWRMVDVAVKVMKTDL

SEQ ID NO: 2383020 - protein, 26 aa, Entamoeba dispar
GGGTFGIVYRAEWRRVDVAVKVMKTD

SEQ ID NO: 2383021 - protein, 21 aa, Entamoeba dispar
GGICECKSCRTENIKTNIKSN

SEQ ID NO: 2383022 - protein, 22 aa, Entamoeba dispar
GGIICGILLLLLVIIVIAIIVF

SEQ ID NO: 2383023 - protein, 25 aa, Entamoeba dispar
GGIILSFYIMLNWFMTLLEYLSIMS

SEQ ID NO: 2383024 - protein, 19 aa, Entamoeba dispar
GGIIPILFFLASIVLIISP

SEQ ID NO: 2383025 - protein, 18 aa, Entamoeba dispar
GGILTYYKWFSIGDNKTQ

SEQ ID NO: 2383026 - protein, 17 aa, Entamoeba dispar
GGILVALVMTYADVIVK

SEQ ID NO: 2383027 - protein, 26 aa, Entamoeba dispar
GGIVLSFYIMINWFFTLLEYLSIMSG

SEQ ID NO: 2383028 - protein, 25 aa, Entamoeba dispar
GGIYLNEECVLCFYNTEGITTPIEI

SEQ ID NO: 2383029 - protein, 18 aa, Entamoeba dispar
GGKCAICNIGYYNLNSNC

SEQ ID NO: 2383030 - protein, 20 aa, Entamoeba dispar
GGKGWCSIITLIFALSLHSF

SEQ ID NO: 2383031 - protein, 26 aa, Entamoeba dispar
GGKNCNPFCYCIEGYVPDIEDPLSCK

SEQ ID NO: 2383032 - protein, 28 aa, Entamoeba dispar
GGLIALCILLRFCMCFTHVVQYFNEFST

SEQ ID NO: 2383033 - protein, 33 aa, Entamoeba dispar
GGLLTLCFVSLCFFPLDVIITLGMGAAISIFIT

SEQ ID NO: 2383034 - protein, 26 aa, Entamoeba dispar
GGLPSIIIYLCISFAVKGSTTLSDYM

SEQ ID NO: 2383035 - protein, 25 aa, Entamoeba dispar
GGLTRILKYILPYVSSNLKEELYNQ

SEQ ID NO: 2383036 - protein, 19 aa, Entamoeba dispar
GGMIPALMNILKFKEFHLT

SEQ ID NO: 2383037 - protein, 25 aa, Entamoeba dispar
GGMLYLCVRNSFNVWLTIANLDALF

SEQ ID NO: 2383038 - protein, 19 aa, Entamoeba dispar
GGNFRHFLNAVLVILGCLL

SEQ ID NO: 2383039 - protein, 19 aa, Entamoeba dispar
GGNFRHFLNGGLVILGCLL

SEQ ID NO: 2383040 - protein, 43 aa, Entamoeba dispar
GGNLRVIICAGAPLSLDIAKFFRIVISDGFFIGYGMTETTGMG

SEQ ID NO: 2383041 - protein, 17 aa, Entamoeba dispar
GGQYLFSVNVFYPPLNK

SEQ ID NO: 2383042 - protein, 19 aa, Entamoeba dispar
GGSQAIRLSYKYSSDLLQF

SEQ ID NO: 2383043 - protein, 22 aa, Entamoeba dispar
GGSYKRYAKEGSDEAVMCDCHF

SEQ ID NO: 2383044 - protein, 18 aa, Entamoeba dispar
GGTNVWEVLFGQWKSILP

SEQ ID NO: 2383045 - protein, 25 aa, Entamoeba dispar
GGVKPRKGLWYKVVNNYKYAFPLFI

SEQ ID NO: 2383046 - protein, 24 aa, Entamoeba dispar
GGWGVGKAKWWALIIKYMILLFPI

SEQ ID NO: 2383047 - protein, 24 aa, Entamoeba dispar
GGYACEFEIFIIIKCTTKIKEQIM

SEQ ID NO: 2383048 - protein, 25 aa, Entamoeba dispar
GGYACEFEIFIIIKCTTKIKEQMMI

SEQ ID NO: 2383049 - protein, 19 aa, Entamoeba dispar
GGYGCDHCVCVDGTSKYAK

SEQ ID NO: 2383050 - protein, 19 aa, Entamoeba dispar
GGYGCDHCVCVNGTKKYAK

SEQ ID NO: 2383051 - protein, 19 aa, Entamoeba dispar
GGYGCDHCVCVNGTKKYAN

SEQ ID NO: 2383052 - protein, 18 aa, Entamoeba dispar
GHCVFKNIYFFITAPLGI

SEQ ID NO: 2383053 - protein, 18 aa, Entamoeba dispar
GHFCGIIIGVLYTRGFLD

SEQ ID NO: 2383054 - protein, 25 aa, Entamoeba dispar
GHFSLGWECQATYYGSILFYALLVV

SEQ ID NO: 2383055 - protein, 27 aa, Entamoeba dispar
GHGCKRCKEGYYLTKDMKCLKCDDKCE

SEQ ID NO: 2383056 - protein, 26 aa, Entamoeba dispar
GHILFFLLLVYYKFEPNQLVISEQAL

SEQ ID NO: 2383057 - protein, 17 aa, Entamoeba dispar
GHSSAIFNGMTFLALLF

SEQ ID NO: 2383058 - protein, 24 aa, Entamoeba dispar
GHVRCQQCSLDIITAILISPIFGE

SEQ ID NO: 2383059 - protein, 19 aa, Entamoeba dispar
GHVSFKHLITFETTPSLNQ

SEQ ID NO: 2383060 - protein, 25 aa, Entamoeba dispar
GIADFLHKFHINFNLTFVKNLNTMN

SEQ ID NO: 2383061 - protein, 24 aa, Entamoeba dispar
GIARRLATDKIIMVLIIVCVLVII

SEQ ID NO: 2383062 - protein, 20 aa, Entamoeba dispar
GIAWQVEFGGCIGLNIGLFL

SEQ ID NO: 2383063 - protein, 19 aa, Entamoeba dispar
GICEYPWDIIDFIQKDNYL

SEQ ID NO: 2383064 - protein, 20 aa, Entamoeba dispar
GICTICKIGTYSSGGINGCY

SEQ ID NO: 2383065 - protein, 26 aa, Entamoeba dispar
GICYSNKEKIIFIGICNGNLIGLKET

SEQ ID NO: 2383066 - protein, 25 aa, Entamoeba dispar
GIEQPRCVLTWGQLPITSHWGTISD

SEQ ID NO: 2383067 - protein, 19 aa, Entamoeba dispar
GIEVIKVIYELPVATAVVQ

SEQ ID NO: 2383068 - protein, 18 aa, Entamoeba dispar
GIFIFGLGLIFIIFQKKL

SEQ ID NO: 2383069 - protein, 18 aa, Entamoeba dispar
GIFQELRGQIVIPLYFAS

SEQ ID NO: 2383070 - protein, 27 aa, Entamoeba dispar
GIGLIAFRIRFDFDIITFISVSSAVVV

SEQ ID NO: 2383071 - protein, 17 aa, Entamoeba dispar
GIIEVYDPLKLDKINEI

SEQ ID NO: 2383072 - protein, 19 aa, Entamoeba dispar
GIIGEEIFDKLTLQSLDDL

SEQ ID NO: 2383073 - protein, 28 aa, Entamoeba dispar
GIIIGVLYTRGFLDWLFNSRLITIIDTV

SEQ ID NO: 2383074 - protein, 23 aa, Entamoeba dispar
GIIISVICFYNFNFFNKSEKIII

SEQ ID NO: 2383075 - protein, 20 aa, Entamoeba dispar
GIIKELLKNISISLNENQIY

SEQ ID NO: 2383076 - protein, 27 aa, Entamoeba dispar
GIILNFCICICCCKLIIHDRKSENFIK

SEQ ID NO: 2383077 - protein, 29 aa, Entamoeba dispar
GIILRRNAKFIFGNAFYYKSYSSQYTLFD

SEQ ID NO: 2383078 - protein, 24 aa, Entamoeba dispar
GIIMAVAFSGLFLAGVIVLDLFAF

SEQ ID NO: 2383079 - protein, 17 aa, Entamoeba dispar
GIISYDGLFSMAMAFIV

SEQ ID NO: 2383080 - protein, 25 aa, Entamoeba dispar
GIKLKRKTSFLSWFNKEELIDVDNA

SEQ ID NO: 2383081 - protein, 27 aa, Entamoeba dispar
GIKLLLSRIFDALCIFLINRLIYNYHE

SEQ ID NO: 2383082 - protein, 28 aa, Entamoeba dispar
GIKLTYKFKMRILKDVAKGMSFLHENSI

SEQ ID NO: 2383083 - protein, 18 aa, Entamoeba dispar
GIKNLCTPPTIATLLGIL

SEQ ID NO: 2383084 - protein, 26 aa, Entamoeba dispar
GIKQLLKSIWVYKFFVQLIQKLNTKN

SEQ ID NO: 2383085 - protein, 17 aa, Entamoeba dispar
GIKVCIKLLQVSTLNHK

SEQ ID NO: 2383086 - protein, 18 aa, Entamoeba dispar
GILCCFSYSIIAVGASMM

SEQ ID NO: 2383087 - protein, 18 aa, Entamoeba dispar
GILLYFLLRTTKFDINIY

SEQ ID NO: 2383088 - protein, 17 aa, Entamoeba dispar
GILTYYKWFSIGDNKTQ

SEQ ID NO: 2383089 - protein, 18 aa, Entamoeba dispar
GIMSLVAFSYQFILYGKS

SEQ ID NO: 2383090 - protein, 17 aa, Entamoeba dispar
GIMWAIAQVCWFVANTN

SEQ ID NO: 2383091 - protein, 17 aa, Entamoeba dispar
GINEAREIISLISKKRT

SEQ ID NO: 2383092 - protein, 23 aa, Entamoeba dispar
GINLSSFPSYFKVEGSRQIQGVL

SEQ ID NO: 2383093 - protein, 38 aa, Entamoeba dispar
GINTLFKYPHLKSHWSLSQFFLWITVFVLIHISFTISL

SEQ ID NO: 2383094 - protein, 24 aa, Entamoeba dispar
GIPDFRSSNGLWKRYDPSVYGSYS

SEQ ID NO: 2383095 - protein, 21 aa, Entamoeba dispar
GISKRGIYTFDIWINNKRIRA

SEQ ID NO: 2383096 - protein, 18 aa, Entamoeba dispar
GISLKKNFFIIALKNVTY

SEQ ID NO: 2383097 - protein, 22 aa, Entamoeba dispar
GISSKLKALLIFDQSYYYLELL

SEQ ID NO: 2383098 - protein, 26 aa, Entamoeba dispar
GITEPFIWYYYCVGFYGEKAFEKDHK

SEQ ID NO: 2383099 - protein, 19 aa, Entamoeba dispar
GITKYKLVGIVIHTGSAYG

SEQ ID NO: 2383100 - protein, 24 aa, Entamoeba dispar
GITLRRMYLPWALVVLNFILGAPI

SEQ ID NO: 2383101 - protein, 18 aa, Entamoeba dispar
GIVAFFWYTRKPRSVHSQ

SEQ ID NO: 2383102 - protein, 18 aa, Entamoeba dispar
GIVGKAQIDRSVKVPFAL

SEQ ID NO: 2383103 - protein, 19 aa, Entamoeba dispar
GIVSFCFVLFDIAGLYGYI

SEQ ID NO: 2383104 - protein, 19 aa, Entamoeba dispar
GIVSGALGLVHIQGFIFMM

SEQ ID NO: 2383105 - protein, 17 aa, Entamoeba dispar
GIWYGIKTYGGITYVAT

SEQ ID NO: 2383106 - protein, 27 aa, Entamoeba dispar
GIYRVDREIQHGFILFECTTELMKNAF

SEQ ID NO: 2383107 - protein, 26 aa, Entamoeba dispar
GIYSTLICFLIFLGLSCGEIQKPLLF

SEQ ID NO: 2383108 - protein, 20 aa, Entamoeba dispar
GKAFTLSFLKAIMVLISGCF

SEQ ID NO: 2383109 - protein, 19 aa, Entamoeba dispar
GKCISCTNGTYANNYQCLP

SEQ ID NO: 2383110 - protein, 17 aa, Entamoeba dispar
GKCKMVGCEKEFNKEII

SEQ ID NO: 2383111 - protein, 24 aa, Entamoeba dispar
GKCQECLEGYNLLRNETGTWVCNS

SEQ ID NO: 2383112 - protein, 19 aa, Entamoeba dispar
GKCSKCQDGCNVCYEDTQS

SEQ ID NO: 2383113 - protein, 25 aa, Entamoeba dispar
GKCSKCSQILCDVCEDYNICTSCSN

SEQ ID NO: 2383114 - protein, 17 aa, Entamoeba dispar
GKCVARFDHHCPWINQC

SEQ ID NO: 2383115 - protein, 18 aa, Entamoeba dispar
GKCVPLEAIVNCIETSNG

SEQ ID NO: 2383116 - protein, 19 aa, Entamoeba dispar
GKCVTCPDGTIINEDSTKC

SEQ ID NO: 2383117 - protein, 19 aa, Entamoeba dispar
GKDEIKGSCLENINVDNCL

SEQ ID NO: 2383118 - protein, 23 aa, Entamoeba dispar
GKEFMDLVDVCWYRLTTPENPMV

SEQ ID NO: 2383119 - protein, 21 aa, Entamoeba dispar
GKEGKLLVVPVTYFINPTPSI

SEQ ID NO: 2383120 - protein, 26 aa, Entamoeba dispar
GKEGKRLADFFTMSCFGRGLGFLCGG

SEQ ID NO: 2383121 - protein, 27 aa, Entamoeba dispar
GKENMAMLVVQHFLLRSVLRTIMDCID

SEQ ID NO: 2383122 - protein, 19 aa, Entamoeba dispar
GKENNIFEECIKKGIEIIG

SEQ ID NO: 2383123 - protein, 23 aa, Entamoeba dispar
GKFKNNLKYGYFKKQIFAEVGIY

SEQ ID NO: 2383124 - protein, 24 aa, Entamoeba dispar
GKFKTLRQFCQLWNIISNTKHCYI

SEQ ID NO: 2383125 - protein, 24 aa, Entamoeba dispar
GKFKTLRQFCQLWNIISNTKHCYV

SEQ ID NO: 2383126 - protein, 19 aa, Entamoeba dispar
GKGCVNGAAAMSVSLKGEQ

SEQ ID NO: 2383127 - protein, 21 aa, Entamoeba dispar
GKGFKFSIRAMKLMKDKQKLL

SEQ ID NO: 2383128 - protein, 24 aa, Entamoeba dispar
GKGIEGWLKPLLEIPAFQIKLKMW

SEQ ID NO: 2383129 - protein, 19 aa, Entamoeba dispar
GKGRIDAFVSQYISHLIED

SEQ ID NO: 2383130 - protein, 26 aa, Entamoeba dispar
GKIFAGRPRPHFYARIDAKPNEINDA

SEQ ID NO: 2383131 - protein, 18 aa, Entamoeba dispar
GKIISKLDFYARALVNSF

SEQ ID NO: 2383132 - protein, 17 aa, Entamoeba dispar
GKIIVKGDITFINFDVF

SEQ ID NO: 2383133 - protein, 21 aa, Entamoeba dispar
GKILIYIPIILVIGMIIFSPI

SEQ ID NO: 2383134 - protein, 27 aa, Entamoeba dispar
GKIMCSLCGIESLCLPIFMNLYNNIME

SEQ ID NO: 2383135 - protein, 17 aa, Entamoeba dispar
GKIPWYGLMVASVVIPY

SEQ ID NO: 2383136 - protein, 17 aa, Entamoeba dispar
GKKGISQNIDWIASAFK

SEQ ID NO: 2383137 - protein, 18 aa, Entamoeba dispar
GKKTIVWNRKEDREDDIE

SEQ ID NO: 2383138 - protein, 25 aa, Entamoeba dispar
GKKYLDPIRTCFGRLKNSYNSFKSE

SEQ ID NO: 2383139 - protein, 18 aa, Entamoeba dispar
GKLFTLLCDHCIMSNKTL

SEQ ID NO: 2383140 - protein, 27 aa, Entamoeba dispar
GKLGMGCAIIVFTILCIYWVMDAINYK

SEQ ID NO: 2383141 - protein, 24 aa, Entamoeba dispar
GKLQMALTFYRFFAFSVMLITCIV

SEQ ID NO: 2383142 - protein, 25 aa, Entamoeba dispar
GKLRIVYTCINLFIRGCSHNYNFYI

SEQ ID NO: 2383143 - protein, 27 aa, Entamoeba dispar
GKLSVAPRLGFCQLKMEKEEDIATLFS

SEQ ID NO: 2383144 - protein, 18 aa, Entamoeba dispar
GKLYFGSRDNTFKANKII

SEQ ID NO: 2383145 - protein, 19 aa, Entamoeba dispar
GKMCKRCESGYGFNSDKSA

SEQ ID NO: 2383146 - protein, 17 aa, Entamoeba dispar
GKNAGSWYHSYTNQYDV

SEQ ID NO: 2383147 - protein, 18 aa, Entamoeba dispar
GKNVPRYTIDMNQQGEWE

SEQ ID NO: 2383148 - protein, 20 aa, Entamoeba dispar
GKPICTICSLNTVVKNNTCS

SEQ ID NO: 2383149 - protein, 21 aa, Entamoeba dispar
GKQTINIFVLKTFYPETEVDN

SEQ ID NO: 2383150 - protein, 25 aa, Entamoeba dispar
GKRGKGKICEKIHLIIINSLKEINE

SEQ ID NO: 2383151 - protein, 20 aa, Entamoeba dispar
GKRGNELSELVWYNKKLYGF

SEQ ID NO: 2383152 - protein, 26 aa, Entamoeba dispar
GKRLEIPSGCLFSEVIERCWQQDPRD

SEQ ID NO: 2383153 - protein, 18 aa, Entamoeba dispar
GKRNELFAIGLRKKRFIS

SEQ ID NO: 2383154 - protein, 24 aa, Entamoeba dispar
GKRVDEAFYLLSFYSLISLFPFLL

SEQ ID NO: 2383155 - protein, 24 aa, Entamoeba dispar
GKSFWKLVLSCVLIITNVVPPELP

SEQ ID NO: 2383156 - protein, 30 aa, Entamoeba dispar
GKSSWFIRKIWKFISYFIFMVFTLIFCTIL

SEQ ID NO: 2383157 - protein, 20 aa, Entamoeba dispar
GKSTMMAGLFRIEEPAGGSI

SEQ ID NO: 2383158 - protein, 26 aa, Entamoeba dispar
GKTCFKYAAKRPLAYVYLNTKMTYAT

SEQ ID NO: 2383159 - protein, 19 aa, Entamoeba dispar
GKTGLEMARYGAIEKDRDL

SEQ ID NO: 2383160 - protein, 28 aa, Entamoeba dispar
GKTPRVDLYLMIFLKFLATVIPTMEYDY

SEQ ID NO: 2383161 - protein, 17 aa, Entamoeba dispar
GKVFCMLQNPYLSISAI

SEQ ID NO: 2383162 - protein, 19 aa, Entamoeba dispar
GKVIKGDVRGLVECFCSEE

SEQ ID NO: 2383163 - protein, 27 aa, Entamoeba dispar
GKVSIKELFRYAGVFEITLLIIGIIGS

SEQ ID NO: 2383164 - protein, 24 aa, Entamoeba dispar
GKVTLRLIVIIVFYLISVKYSIFE

SEQ ID NO: 2383165 - protein, 17 aa, Entamoeba dispar
GKVVVQRGASLTVPSMK

SEQ ID NO: 2383166 - protein, 20 aa, Entamoeba dispar
GKWSNKCKVAYCDHGYKWDE

SEQ ID NO: 2383167 - protein, 28 aa, Entamoeba dispar
GKYKLAMKTLDRLAGINIENHLEELQPS

SEQ ID NO: 2383168 - protein, 35 aa, Entamoeba dispar
GKYQISTLIKFCFYKNAAFFLMDIWFATISNFTCQ

SEQ ID NO: 2383169 - protein, 22 aa, Entamoeba dispar
GLCNIPVPFVIRKIVTTVASGN

SEQ ID NO: 2383170 - protein, 24 aa, Entamoeba dispar
GLDEMKLIALLLVYGIIHNKKIIL

SEQ ID NO: 2383171 - protein, 28 aa, Entamoeba dispar
GLFFEWKIPLKYIKVVLQVAIFKIIVGL

SEQ ID NO: 2383172 - protein, 19 aa, Entamoeba dispar
GLFICCVVIAIAALYEDIN

SEQ ID NO: 2383173 - protein, 18 aa, Entamoeba dispar
GLFSMAMAFIVIYIAIPI

SEQ ID NO: 2383174 - protein, 25 aa, Entamoeba dispar
GLGPKKIIWWIAMIFTILSIIEVIC

SEQ ID NO: 2383175 - protein, 17 aa, Entamoeba dispar
GLGRRIPIINIFLSPFV

SEQ ID NO: 2383176 - protein, 17 aa, Entamoeba dispar
GLIGRRCLQNWFTDIIS

SEQ ID NO: 2383177 - protein, 20 aa, Entamoeba dispar
GLIIPRNSIRGIKRMLYSSH

SEQ ID NO: 2383178 - protein, 24 aa, Entamoeba dispar
GLKELSILYPLIFFPTHLKMVFKY

SEQ ID NO: 2383179 - protein, 17 aa, Entamoeba dispar
GLKKLKCQVMRCFEMDY

SEQ ID NO: 2383180 - protein, 18 aa, Entamoeba dispar
GLLCPVIGLFLNKKWFPI

SEQ ID NO: 2383181 - protein, 24 aa, Entamoeba dispar
GLLKKALGDNALWVAIGCSGILLI

SEQ ID NO: 2383182 - protein, 23 aa, Entamoeba dispar
GLLPKEVLTFIVISIPVTILLAI

SEQ ID NO: 2383183 - protein, 23 aa, Entamoeba dispar
GLLVNIIGVFAFRDTDEDIEISN

SEQ ID NO: 2383184 - protein, 19 aa, Entamoeba dispar
GLLYYAGDVIGRFVEIFTK

SEQ ID NO: 2383185 - protein, 24 aa, Entamoeba dispar
GLNHKRFYVGGVISFNSQTNEPDW

SEQ ID NO: 2383186 - protein, 19 aa, Entamoeba dispar
GLNIITMVILRREEYIELY

SEQ ID NO: 2383187 - protein, 25 aa, Entamoeba dispar
GLPPNVICECLKMFLKQLPDSLINA

SEQ ID NO: 2383188 - protein, 19 aa, Entamoeba dispar
GLQIKQIVNKCWKCGKDKI

SEQ ID NO: 2383189 - protein, 26 aa, Entamoeba dispar
GLQKMLCIISYFFVMILYPEKNEKVH

SEQ ID NO: 2383190 - protein, 22 aa, Entamoeba dispar
GLRSGCFKKFLCNFKIYLSFFN

SEQ ID NO: 2383191 - protein, 21 aa, Entamoeba dispar
GLTCYIPGYSTYNISWNGFTY

SEQ ID NO: 2383192 - protein, 25 aa, Entamoeba dispar
GLTFFKFLYYLGVAPFGVYLFRNED

SEQ ID NO: 2383193 - protein, 32 aa, Entamoeba dispar
GLTIRDANLFFGEFIRDLSLLWRHDEMAKLID

SEQ ID NO: 2383194 - protein, 17 aa, Entamoeba dispar
GLVEFIWIELNNKMMGN

SEQ ID NO: 2383195 - protein, 20 aa, Entamoeba dispar
GLVIAGRGVKFFGFPLLGTW

SEQ ID NO: 2383196 - protein, 18 aa, Entamoeba dispar
GLVKLISKLHPQWITINT

SEQ ID NO: 2383197 - protein, 29 aa, Entamoeba dispar
GLVLGWVHAFIFWKYSVLMYFAGQELKKD

SEQ ID NO: 2383198 - protein, 27 aa, Entamoeba dispar
GLVLGWVHAFIFWKYSVLMYVAGQELK

SEQ ID NO: 2383199 - protein, 30 aa, Entamoeba dispar
GLVLGWVHAFIFWKYYVLMYVAGQELKDDP

SEQ ID NO: 2383200 - protein, 23 aa, Entamoeba dispar
GLYAKARAGIIKGFTGIDDPYEA

SEQ ID NO: 2383201 - protein, 18 aa, Entamoeba dispar
GMCTRECPGDCLTCDKAL

SEQ ID NO: 2383202 - protein, 28 aa, Entamoeba dispar
GMFLQSFSFDFLGLAGWALDLLGYSQHR

SEQ ID NO: 2383203 - protein, 19 aa, Entamoeba dispar
GMFNKGCEPNCGSCVVGYQ

SEQ ID NO: 2383204 - protein, 19 aa, Entamoeba dispar
GMGLYLDKLFELFSILPSY

SEQ ID NO: 2383205 - protein, 17 aa, Entamoeba dispar
GMIEMFEIPTLKKKIEL

SEQ ID NO: 2383206 - protein, 25 aa, Entamoeba dispar
GMIHFKKRIITIINICVQIFVVIMA

SEQ ID NO: 2383207 - protein, 19 aa, Entamoeba dispar
GMILVLLSFFLPMVATRDI

SEQ ID NO: 2383208 - protein, 17 aa, Entamoeba dispar
GMLCIFMSLSFFFLPTR

SEQ ID NO: 2383209 - protein, 23 aa, Entamoeba dispar
GMLICDTHLWYIWKMYYSNDNFP

SEQ ID NO: 2383210 - protein, 18 aa, Entamoeba dispar
GMMWGVAQVCWFIANSNL

SEQ ID NO: 2383211 - protein, 17 aa, Entamoeba dispar
GMPLTYHYSELYLLTLF

SEQ ID NO: 2383212 - protein, 22 aa, Entamoeba dispar
GMRKYCYCRRKIHTNDSECICI

SEQ ID NO: 2383213 - protein, 17 aa, Entamoeba dispar
GMSCSKTNWALIIPLII

SEQ ID NO: 2383214 - protein, 34 aa, Entamoeba dispar
GMSDLGCSSKLWIVCSKKTLSYKCPGNTQCTFKS

SEQ ID NO: 2383215 - protein, 23 aa, Entamoeba dispar
GMSEYKLSLIVTFRNLLLLIIEI

SEQ ID NO: 2383216 - protein, 19 aa, Entamoeba dispar
GMVRYFSYYCIEIHDITTE

SEQ ID NO: 2383217 - protein, 19 aa, Entamoeba dispar
GMVRYFSYYCIEIHNITTE

SEQ ID NO: 2383218 - protein, 22 aa, Entamoeba dispar
GMVVCSFILFSFLVVKKFFTMK

SEQ ID NO: 2383219 - protein, 20 aa, Entamoeba dispar
GMWERGSAIIVGYEGDPEGD

SEQ ID NO: 2383220 - protein, 20 aa, Entamoeba dispar
GNCLHYSFISNCINSSESKC

SEQ ID NO: 2383221 - protein, 25 aa, Entamoeba dispar
GNCVECKEGYYLKGQTLKSQNCFPC

SEQ ID NO: 2383222 - protein, 17 aa, Entamoeba dispar
GNDYYCQIYLGKIHITD

SEQ ID NO: 2383223 - protein, 20 aa, Entamoeba dispar
GNEEQTRYFALMTQENDVDI

SEQ ID NO: 2383224 - protein, 25 aa, Entamoeba dispar
GNEKYIAEILLHFEKLAKKELWYIN

SEQ ID NO: 2383225 - protein, 24 aa, Entamoeba dispar
GNERAWKRSGFCSEHGNQFKGNVV

SEQ ID NO: 2383226 - protein, 17 aa, Entamoeba dispar
GNESISFICEKDLSEAS

SEQ ID NO: 2383227 - protein, 19 aa, Entamoeba dispar
GNFIPYGVLIYYNDPALPS

SEQ ID NO: 2383228 - protein, 17 aa, Entamoeba dispar
GNFKNLYISASQYRTDT

SEQ ID NO: 2383229 - protein, 30 aa, Entamoeba dispar
GNFPGHVVPICFNWPVGKHSLYGNKKAKMM

SEQ ID NO: 2383230 - protein, 17 aa, Entamoeba dispar
GNFRHFLNGGLVILGCL

SEQ ID NO: 2383231 - protein, 20 aa, Entamoeba dispar
GNGKSSLGNFILKKNVFMVS

SEQ ID NO: 2383232 - protein, 20 aa, Entamoeba dispar
GNGKSSLGNFILKKNVFTVS

SEQ ID NO: 2383233 - protein, 21 aa, Entamoeba dispar
GNGNYQCWDCMLGYIKNGSYC

SEQ ID NO: 2383234 - protein, 21 aa, Entamoeba dispar
GNHMFNRFAAYKMTMEDFEEQ

SEQ ID NO: 2383235 - protein, 18 aa, Entamoeba dispar
GNHSFFLMLDEFLEDIEL

SEQ ID NO: 2383236 - protein, 23 aa, Entamoeba dispar
GNIDQGCPCRHDISESSDSCDVV

SEQ ID NO: 2383237 - protein, 19 aa, Entamoeba dispar
GNIEVLLFIHGLDHTLYDA

SEQ ID NO: 2383238 - protein, 18 aa, Entamoeba dispar
GNIIEIPQSLSFTNGFIF

SEQ ID NO: 2383239 - protein, 21 aa, Entamoeba dispar
GNIIPKRVVKMLQNIKVYSQY

SEQ ID NO: 2383240 - protein, 25 aa, Entamoeba dispar
GNIKMEFANLILLNSDYEVETFVED

SEQ ID NO: 2383241 - protein, 25 aa, Entamoeba dispar
GNIKTDYPSVFSIPSFFNNKQLDIL

SEQ ID NO: 2383242 - protein, 19 aa, Entamoeba dispar
GNIKWYVIVIALFVRMVVV

SEQ ID NO: 2383243 - protein, 20 aa, Entamoeba dispar
GNIMPIIAFTLMTILYPDYS

SEQ ID NO: 2383244 - protein, 18 aa, Entamoeba dispar
GNISISFEFVCPNNCGEH

SEQ ID NO: 2383245 - protein, 28 aa, Entamoeba dispar
GNKENGFRFVMCIIISMQIIRNIFFYMA

SEQ ID NO: 2383246 - protein, 21 aa, Entamoeba dispar
GNKMYRYMIEHYRDLPDVVFE

SEQ ID NO: 2383247 - protein, 24 aa, Entamoeba dispar
GNLCSTEYPCICSIINKKDLMNQV

SEQ ID NO: 2383248 - protein, 17 aa, Entamoeba dispar
GNLDKVSFVKKASREEN

SEQ ID NO: 2383249 - protein, 19 aa, Entamoeba dispar
GNLFIWLLSIFYIPRPTRP

SEQ ID NO: 2383250 - protein, 19 aa, Entamoeba dispar
GNLKYPDCHYLSYLYDFSL

SEQ ID NO: 2383251 - protein, 25 aa, Entamoeba dispar
GNMKIKPSYEWFLGGLVFILIVCTP

SEQ ID NO: 2383252 - protein, 24 aa, Entamoeba dispar
GNNFTSITSYISWLVLAVYQSVML

SEQ ID NO: 2383253 - protein, 18 aa, Entamoeba dispar
GNNLRYNDYYIIQKDEEE

SEQ ID NO: 2383254 - protein, 26 aa, Entamoeba dispar
GNNNIKIDVIDIFTSLPTRITFDNPV

SEQ ID NO: 2383255 - protein, 27 aa, Entamoeba dispar
GNNVWKCDKCGLLNEGDHCVLCNNENK

SEQ ID NO: 2383256 - protein, 23 aa, Entamoeba dispar
GNRTRFGYLSSIGCTCQYTTSFI

SEQ ID NO: 2383257 - protein, 19 aa, Entamoeba dispar
GNSIGAPVIGESIRLTLTT

SEQ ID NO: 2383258 - protein, 18 aa, Entamoeba dispar
GNSMFLFYGLSHLSLTNL

SEQ ID NO: 2383259 - protein, 17 aa, Entamoeba dispar
GNSVSVWGDAVLTVNNV

SEQ ID NO: 2383260 - protein, 24 aa, Entamoeba dispar
GNTKGSEGYNEFIKQLGEEINLKG

SEQ ID NO: 2383261 - protein, 25 aa, Entamoeba dispar
GNTPLHLACALGFLESVQKLIELGA

SEQ ID NO: 2383262 - protein, 24 aa, Entamoeba dispar
GNVARGVSFIGVISKYFRQDAPTI

SEQ ID NO: 2383263 - protein, 24 aa, Entamoeba dispar
GNVWKVTLCFVWVICLVLGISFSF

SEQ ID NO: 2383264 - protein, 19 aa, Entamoeba dispar
GNYYCSYNRREEVLIDIKQ

SEQ ID NO: 2383265 - protein, 18 aa, Entamoeba dispar
GPCTAGGKTVKCFCGRNI

SEQ ID NO: 2383266 - protein, 18 aa, Entamoeba dispar
GPFEVINYSWKIYQTCLY

SEQ ID NO: 2383267 - protein, 18 aa, Entamoeba dispar
GPFSCRFSRCCEKLLFGI

SEQ ID NO: 2383268 - protein, 19 aa, Entamoeba dispar
GPFSCRYSCNCQNYIRYKQ

SEQ ID NO: 2383269 - protein, 19 aa, Entamoeba dispar
GPHSVLCMVALLGVLVYLY

SEQ ID NO: 2383270 - protein, 17 aa, Entamoeba dispar
GPIARYSYESFYRYVKS

SEQ ID NO: 2383271 - protein, 19 aa, Entamoeba dispar
GPKGFGIKSVKWNNAGTKF

SEQ ID NO: 2383272 - protein, 26 aa, Entamoeba dispar
GPKVFLRLYGLFSMFVALWVLLFFFR

SEQ ID NO: 2383273 - protein, 26 aa, Entamoeba dispar
GPLNYCCIMSFLSLIYWRNYPPSIIG

SEQ ID NO: 2383274 - protein, 26 aa, Entamoeba dispar
GPLNYCCIMSFLSLLYWRNYPPSIIG

SEQ ID NO: 2383275 - protein, 17 aa, Entamoeba dispar
GPLPLKYIPKLVYPFEQ

SEQ ID NO: 2383276 - protein, 26 aa, Entamoeba dispar
GPMSIMMLWPRMEKLGDPNFRKLSVI

SEQ ID NO: 2383277 - protein, 17 aa, Entamoeba dispar
GPNSLWGKTMESINQNK

SEQ ID NO: 2383278 - protein, 18 aa, Entamoeba dispar
GPNSLWGKTMESINQNKN

SEQ ID NO: 2383279 - protein, 24 aa, Entamoeba dispar
GPPEPIIPMQIFWYIVYYGMIAFA

SEQ ID NO: 2383280 - protein, 18 aa, Entamoeba dispar
GPQRAVVILHYFESIKYF

SEQ ID NO: 2383281 - protein, 20 aa, Entamoeba dispar
GPSQNPVMCMIAGSVDVTIN

SEQ ID NO: 2383282 - protein, 22 aa, Entamoeba dispar
GPTKIPIHCSIVGTFTGTNPSM

SEQ ID NO: 2383283 - protein, 21 aa, Entamoeba dispar
GPTKREPKCAEEYQWALGMYG

SEQ ID NO: 2383284 - protein, 17 aa, Entamoeba dispar
GPVSLVLVLVQGQYIIQ

SEQ ID NO: 2383285 - protein, 17 aa, Entamoeba dispar
GQCESCNQFGSLCQKCT

SEQ ID NO: 2383286 - protein, 30 aa, Entamoeba dispar
GQCIPCSNSFLFCETCNLTSCISCRFSNYV

SEQ ID NO: 2383287 - protein, 20 aa, Entamoeba dispar
GQCKECPVGTYSQFERSIKC

SEQ ID NO: 2383288 - protein, 18 aa, Entamoeba dispar
GQCSYILQKCEDVSFLIN

SEQ ID NO: 2383289 - protein, 17 aa, Entamoeba dispar
GQDETGCFCIDQRTDGC

SEQ ID NO: 2383290 - protein, 22 aa, Entamoeba dispar
GQFLKDLLRFYSRTTTMEALES

SEQ ID NO: 2383291 - protein, 23 aa, Entamoeba dispar
GQGPPCKYLLVGNESWLNEQYQS

SEQ ID NO: 2383292 - protein, 27 aa, Entamoeba dispar
GQGSFGLVYRGFWRGVEVAIKMIKSDL

SEQ ID NO: 2383293 - protein, 19 aa, Entamoeba dispar
GQIFAKIFFSLLIGSVFFN

SEQ ID NO: 2383294 - protein, 29 aa, Entamoeba dispar
GQKCDLVPVWWNFIVVIIIISIIIKSCVI

SEQ ID NO: 2383295 - protein, 27 aa, Entamoeba dispar
GQKVGEFFSYFGMCITGYVIGFVKEWK

SEQ ID NO: 2383296 - protein, 18 aa, Entamoeba dispar
GQLPLLFSSFSQFTLYLW

SEQ ID NO: 2383297 - protein, 23 aa, Entamoeba dispar
GQLSYKSNIPIDYLLFTGDSKVT

SEQ ID NO: 2383298 - protein, 17 aa, Entamoeba dispar
GQNCPLHGCGEEKRSFI

SEQ ID NO: 2383299 - protein, 25 aa, Entamoeba dispar
GQNLSFKTFSAWMFISILQGSVIMM

SEQ ID NO: 2383300 - protein, 21 aa, Entamoeba dispar
GQQCSCPKGYIFYNNNCMVSL

SEQ ID NO: 2383301 - protein, 19 aa, Entamoeba dispar
GQQTYELLLKMMKDKTMEE

SEQ ID NO: 2383302 - protein, 19 aa, Entamoeba dispar
GQRSLAELFHNTKQQKDEI

SEQ ID NO: 2383303 - protein, 18 aa, Entamoeba dispar
GQSILKPGTTRAYMALTF

SEQ ID NO: 2383304 - protein, 19 aa, Entamoeba dispar
GQWGFLILYIISKGGKVEI

SEQ ID NO: 2383305 - protein, 22 aa, Entamoeba dispar
GQYECIKCDPPFISDKHHSSCE

SEQ ID NO: 2383306 - protein, 18 aa, Entamoeba dispar
GRCVQCKYNYYLNNQNPP

SEQ ID NO: 2383307 - protein, 24 aa, Entamoeba dispar
GRDGKPSDCIIYFNTNDIARVKWV

SEQ ID NO: 2383308 - protein, 19 aa, Entamoeba dispar
GRDGLFTGVMAISYTFEPP

SEQ ID NO: 2383309 - protein, 18 aa, Entamoeba dispar
GRDSWYLDIEEISVGKNT

SEQ ID NO: 2383310 - protein, 33 aa, Entamoeba dispar
GREFPRCGICIRLSGPSLKSSICTIVGATVMNV

SEQ ID NO: 2383311 - protein, 22 aa, Entamoeba dispar
GRFAINTKICLSITSFHPETWT

SEQ ID NO: 2383312 - protein, 22 aa, Entamoeba dispar
GRFFCVMELTVINEEVFQSRLL

SEQ ID NO: 2383313 - protein, 19 aa, Entamoeba dispar
GRGTFGNVYKATWRNTDVA

SEQ ID NO: 2383314 - protein, 17 aa, Entamoeba dispar
GRIKRFLLKPELQPIQV

SEQ ID NO: 2383315 - protein, 19 aa, Entamoeba dispar
GRKQYRLLGEQMIKNEQGL

SEQ ID NO: 2383316 - protein, 17 aa, Entamoeba dispar
GRLFPSLMGLDLTNNSI

SEQ ID NO: 2383317 - protein, 18 aa, Entamoeba dispar
GRLSILVIRISLLCLTTL

SEQ ID NO: 2383318 - protein, 18 aa, Entamoeba dispar
GRNGEGWIHINGKTYSPT

SEQ ID NO: 2383319 - protein, 18 aa, Entamoeba dispar
GRNSGIFFFVYQLNQTLG

SEQ ID NO: 2383320 - protein, 18 aa, Entamoeba dispar
GRRSHWVLANTHLPDPFV

SEQ ID NO: 2383321 - protein, 19 aa, Entamoeba dispar
GRSLLSLLCSAEIPSTVCE

SEQ ID NO: 2383322 - protein, 32 aa, Entamoeba dispar
GRYCFWKFHVTFCIASLFMLQNMVDWSIFKTN

SEQ ID NO: 2383323 - protein, 20 aa, Entamoeba dispar
GRYTYPACIPTTMIKIIRFS

SEQ ID NO: 2383324 - protein, 23 aa, Entamoeba dispar
GSAIGFAGIVIIAAVIGIVAVIL

SEQ ID NO: 2383325 - protein, 17 aa, Entamoeba dispar
GSCKNRLCNTCSSDDTC

SEQ ID NO: 2383326 - protein, 28 aa, Entamoeba dispar
GSCREKIFPSWGIALIIILSILVMIILI

SEQ ID NO: 2383327 - protein, 17 aa, Entamoeba dispar
GSCSIKSGFESVGNPSI

SEQ ID NO: 2383328 - protein, 21 aa, Entamoeba dispar
GSDVFPNLVFVHSIKEKDEVD

SEQ ID NO: 2383329 - protein, 19 aa, Entamoeba dispar
GSDVYGLIIRYCLGIPVKP

SEQ ID NO: 2383330 - protein, 18 aa, Entamoeba dispar
GSFGIVYIGEFRGNQVAI

SEQ ID NO: 2383331 - protein, 17 aa, Entamoeba dispar
GSFGIVYLGMFRGNKVA

SEQ ID NO: 2383332 - protein, 19 aa, Entamoeba dispar
GSFGVVFKGTFQGNKVAIK

SEQ ID NO: 2383333 - protein, 18 aa, Entamoeba dispar
GSFTVMIITCIIQVTVDG

SEQ ID NO: 2383334 - protein, 20 aa, Entamoeba dispar
GSFVIFISWIYHKIWKYYER

SEQ ID NO: 2383335 - protein, 18 aa, Entamoeba dispar
GSGCGICHKGYYRNGKGC

SEQ ID NO: 2383336 - protein, 22 aa, Entamoeba dispar
GSGCGICKNGYYRNEKGCSKCG

SEQ ID NO: 2383337 - protein, 22 aa, Entamoeba dispar
GSGCGICNKGYYRNEKGCSKCE

SEQ ID NO: 2383338 - protein, 18 aa, Entamoeba dispar
GSGGDLFVSFAVDSNLCI

SEQ ID NO: 2383339 - protein, 22 aa, Entamoeba dispar
GSGKSTMMAGLFRIEEPAGGSI

SEQ ID NO: 2383340 - protein, 24 aa, Entamoeba dispar
GSGLWCGKVGPSIHICSCIAAQLA

SEQ ID NO: 2383341 - protein, 23 aa, Entamoeba dispar
GSGSCGKLLCIADVNDTRGCNGG

SEQ ID NO: 2383342 - protein, 26 aa, Entamoeba dispar
GSGTFGIVYRAEWRGVDVAVKVMKTD

SEQ ID NO: 2383343 - protein, 26 aa, Entamoeba dispar
GSGTFGIVYRAEWRKVDVAVKVLKTD

SEQ ID NO: 2383344 - protein, 19 aa, Entamoeba dispar
GSIGIAVVIASLFPNDFKM

SEQ ID NO: 2383345 - protein, 19 aa, Entamoeba dispar
GSIIISFALGIVILLNGKL

SEQ ID NO: 2383346 - protein, 19 aa, Entamoeba dispar
GSIIPYFIGRYIAKRYVID

SEQ ID NO: 2383347 - protein, 26 aa, Entamoeba dispar
GSIPWIELLPLFFPLSFVYSILQKLF

SEQ ID NO: 2383348 - protein, 19 aa, Entamoeba dispar
GSITFRPKFGCYVIESEEK

SEQ ID NO: 2383349 - protein, 20 aa, Entamoeba dispar
GSIWRINNKYYWYLETQDKI

SEQ ID NO: 2383350 - protein, 22 aa, Entamoeba dispar
GSKKRYFFLGTIDHSIDIDVRF

SEQ ID NO: 2383351 - protein, 25 aa, Entamoeba dispar
GSKPQGKWCGPIICVIPAGDDMCYE

SEQ ID NO: 2383352 - protein, 19 aa, Entamoeba dispar
GSLGAMFMCWILFNNFYII

SEQ ID NO: 2383353 - protein, 17 aa, Entamoeba dispar
GSLIGIFFALLTYCSKF

SEQ ID NO: 2383354 - protein, 20 aa, Entamoeba dispar
GSLKGLKGYILEQEIENLLD

SEQ ID NO: 2383355 - protein, 17 aa, Entamoeba dispar
GSLLLLNLVDNKFYHIQ

SEQ ID NO: 2383356 - protein, 18 aa, Entamoeba dispar
GSMSCSKTNWALIIPLII

SEQ ID NO: 2383357 - protein, 18 aa, Entamoeba dispar
GSMSCSKTNWALIIPLVI

SEQ ID NO: 2383358 - protein, 18 aa, Entamoeba dispar
GSNAFKNSLITKIEIPNS

SEQ ID NO: 2383359 - protein, 20 aa, Entamoeba dispar
GSNLPFDVFLAVIKGPIEGN

SEQ ID NO: 2383360 - protein, 24 aa, Entamoeba dispar
GSSFQCAYSLMDIKHRYPVRSEKS

SEQ ID NO: 2383361 - protein, 17 aa, Entamoeba dispar
GSSLELAAMISIGTGCV

SEQ ID NO: 2383362 - protein, 18 aa, Entamoeba dispar
GSSMSIALFVTMVLSSSE

SEQ ID NO: 2383363 - protein, 18 aa, Entamoeba dispar
GSVIIFIALLQYFIKKRK

SEQ ID NO: 2383364 - protein, 26 aa, Entamoeba dispar
GSVLCQKCKEGSVLINNVCYISQDIP

SEQ ID NO: 2383365 - protein, 22 aa, Entamoeba dispar
GSVNRLGCRGGVLSQSLNSTVT

SEQ ID NO: 2383366 - protein, 23 aa, Entamoeba dispar
GSYECRDLEGCVIKQYNKSCEPK

SEQ ID NO: 2383367 - protein, 23 aa, Entamoeba dispar
GSYFAVPLCNNFFSKQKHGINYY

SEQ ID NO: 2383368 - protein, 19 aa, Entamoeba dispar
GTAATGFVFMLAMLASLNY

SEQ ID NO: 2383369 - protein, 24 aa, Entamoeba dispar
GTCIECNEGYKLMNGVCTAVTPES

SEQ ID NO: 2383370 - protein, 24 aa, Entamoeba dispar
GTCIPLSSVSHCLRVSNSSCSSCS

SEQ ID NO: 2383371 - protein, 18 aa, Entamoeba dispar
GTCLECINESALLKGEIC

SEQ ID NO: 2383372 - protein, 18 aa, Entamoeba dispar
GTCLECINESALLKGEVC

SEQ ID NO: 2383373 - protein, 24 aa, Entamoeba dispar
GTCSKCSESNCIVCKDNDGTCIEC

SEQ ID NO: 2383374 - protein, 17 aa, Entamoeba dispar
GTCYYFRAVNKCESSDG

SEQ ID NO: 2383375 - protein, 19 aa, Entamoeba dispar
GTETLKVFVEVGEIKERKF

SEQ ID NO: 2383376 - protein, 18 aa, Entamoeba dispar
GTFAILMTFIFMKLIPFP

SEQ ID NO: 2383377 - protein, 18 aa, Entamoeba dispar
GTFGNVWKATWRGQNVAV

SEQ ID NO: 2383378 - protein, 18 aa, Entamoeba dispar
GTFGSVFKGMFRGHMVAI

SEQ ID NO: 2383379 - protein, 17 aa, Entamoeba dispar
GTFGVVYKGEFKGNSVA

SEQ ID NO: 2383380 - protein, 22 aa, Entamoeba dispar
GTFRLNIYDNLPLINSRIDQAI

SEQ ID NO: 2383381 - protein, 25 aa, Entamoeba dispar
GTGKYYLVDTCSSLTQIDTYLVLVD

SEQ ID NO: 2383382 - protein, 19 aa, Entamoeba dispar
GTGSRWRKSMLDAINHSRF

SEQ ID NO: 2383383 - protein, 17 aa, Entamoeba dispar
GTIIIEGEITLYGSSNC

SEQ ID NO: 2383384 - protein, 22 aa, Entamoeba dispar
GTIKDTVCRYAIQTGHRVDRKF

SEQ ID NO: 2383385 - protein, 22 aa, Entamoeba dispar
GTILLCCYTIVYSLLISFGSIK

SEQ ID NO: 2383386 - protein, 18 aa, Entamoeba dispar
GTKPKEWQMKYTKYPYWR

SEQ ID NO: 2383387 - protein, 24 aa, Entamoeba dispar
GTLAMPFAMLYSGWGGGLILMTGA

SEQ ID NO: 2383388 - protein, 24 aa, Entamoeba dispar
GTLLRLLISMGYNIVLKKPKMAKK

SEQ ID NO: 2383389 - protein, 19 aa, Entamoeba dispar
GTLPSFFDFFVTSKLRNLL

SEQ ID NO: 2383390 - protein, 23 aa, Entamoeba dispar
GTLTYERFDIFSLSSSSLEKMDQ

SEQ ID NO: 2383391 - protein, 25 aa, Entamoeba dispar
GTMWGKRKHPFVGVAGVECIISGNY

SEQ ID NO: 2383392 - protein, 26 aa, Entamoeba dispar
GTNSKVTWSGCLSLNYQVIFKTVPEL

SEQ ID NO: 2383393 - protein, 24 aa, Entamoeba dispar
GTPMYRLLCSLLMKKRGQGPPCKY

SEQ ID NO: 2383394 - protein, 19 aa, Entamoeba dispar
GTTCKKCRYGFNSDGSCIV

SEQ ID NO: 2383395 - protein, 19 aa, Entamoeba dispar
GTTILCWTAIPFLQSYCSA

SEQ ID NO: 2383396 - protein, 19 aa, Entamoeba dispar
GTTLSLKKSYLIRSKANDN

SEQ ID NO: 2383397 - protein, 19 aa, Entamoeba dispar
GTYIKRNDLLNGYKHSKVD

SEQ ID NO: 2383398 - protein, 17 aa, Entamoeba dispar
GTYSLTVTYTFETRDFD

SEQ ID NO: 2383399 - protein, 17 aa, Entamoeba dispar
GTYYRIGTVNTCACSLK

SEQ ID NO: 2383400 - protein, 19 aa, Entamoeba dispar
GVACGGFLILWMKRHPIVR

SEQ ID NO: 2383401 - protein, 26 aa, Entamoeba dispar
GVASTFGCPIGGLLFSVEVTATYYPV

SEQ ID NO: 2383402 - protein, 24 aa, Entamoeba dispar
GVCKKCSTKFEFCNTCNFTQCLSC

SEQ ID NO: 2383403 - protein, 18 aa, Entamoeba dispar
GVCVKRSQGDYIAWNHYG

SEQ ID NO: 2383404 - protein, 21 aa, Entamoeba dispar
GVFGLRIIKNPSFSNKQCSHA

SEQ ID NO: 2383405 - protein, 32 aa, Entamoeba dispar
GVGCDGGNITGCIKMAELFINRGVKTLIVKLG

SEQ ID NO: 2383406 - protein, 22 aa, Entamoeba dispar
GVGCKKCKKGFFLHKQNACIAC

SEQ ID NO: 2383407 - protein, 19 aa, Entamoeba dispar
GVGCLNPLIMILTGDVVDT

SEQ ID NO: 2383408 - protein, 18 aa, Entamoeba dispar
GVHSMPTFILFKNGQEYD

SEQ ID NO: 2383409 - protein, 23 aa, Entamoeba dispar
GVIICIILSVLFSISFLVITNKR

SEQ ID NO: 2383410 - protein, 18 aa, Entamoeba dispar
GVIIFGSFRESRLPEQYS

SEQ ID NO: 2383411 - protein, 17 aa, Entamoeba dispar
GVIIRFFAWLNYLKENK

SEQ ID NO: 2383412 - protein, 19 aa, Entamoeba dispar
GVIIVFFIKCGKKLIHQHL

SEQ ID NO: 2383413 - protein, 17 aa, Entamoeba dispar
GVISFLKKMNLIDTNNK

SEQ ID NO: 2383414 - protein, 24 aa, Entamoeba dispar
GVKRSSKLGFEWLLKAAQQGNVKG

SEQ ID NO: 2383415 - protein, 23 aa, Entamoeba dispar
GVLCFKWGYPEYKSIPTPFLVKW

SEQ ID NO: 2383416 - protein, 23 aa, Entamoeba dispar
GVLCIGGIAYFGGVGYKNMYKNS

SEQ ID NO: 2383417 - protein, 20 aa, Entamoeba dispar
GVLFAIRLVCVYLTILPDPS

SEQ ID NO: 2383418 - protein, 17 aa, Entamoeba dispar
GVLLCFICFTHSLCSVI

SEQ ID NO: 2383419 - protein, 20 aa, Entamoeba dispar
GVLPNMYINIDITFPKMKCD

SEQ ID NO: 2383420 - protein, 21 aa, Entamoeba dispar
GVMKPEFIMRSLFPVVFAGVI

SEQ ID NO: 2383421 - protein, 23 aa, Entamoeba dispar
GVMWGIAQVCWFIANSNLPYVVS

SEQ ID NO: 2383422 - protein, 20 aa, Entamoeba dispar
GVNAWKVRMYAVIALLRSLT

SEQ ID NO: 2383423 - protein, 23 aa, Entamoeba dispar
GVPEMKVTLLGNHFPNFLTMRTL

SEQ ID NO: 2383424 - protein, 21 aa, Entamoeba dispar
GVPEMKVTLLGNHIPNLLTFK

SEQ ID NO: 2383425 - protein, 25 aa, Entamoeba dispar
GVPKKKLFPLLLMLLIEGISQNIIN

SEQ ID NO: 2383426 - protein, 20 aa, Entamoeba dispar
GVQYPLEWVEDINKHTNWYS

SEQ ID NO: 2383427 - protein, 20 aa, Entamoeba dispar
GVRVFELILSGAFSLSKFLS

SEQ ID NO: 2383428 - protein, 27 aa, Entamoeba dispar
GVSASPYLPVIETFKRISLSKYPYQKL

SEQ ID NO: 2383429 - protein, 18 aa, Entamoeba dispar
GVSISFASQECGKWEEVQ

SEQ ID NO: 2383430 - protein, 26 aa, Entamoeba dispar
GVSWIWRIIVIIAFEFLEMSVFLIPL

SEQ ID NO: 2383431 - protein, 27 aa, Entamoeba dispar
GVSWIWRIIVIIAFEFLEMSVFLIPLD

SEQ ID NO: 2383432 - protein, 20 aa, Entamoeba dispar
GVVCSIWFIIMSCLTFFMTG

SEQ ID NO: 2383433 - protein, 18 aa, Entamoeba dispar
GVVSEVWQSYSSGIINVS

SEQ ID NO: 2383434 - protein, 20 aa, Entamoeba dispar
GVYVSLMLLLWGCSQTLNTS

SEQ ID NO: 2383435 - protein, 18 aa, Entamoeba dispar
GWEKGEETLHCCSPRKCD

SEQ ID NO: 2383436 - protein, 19 aa, Entamoeba dispar
GWIIFGVVFFLIFVSIFAF

SEQ ID NO: 2383437 - protein, 25 aa, Entamoeba dispar
GWLGFAICFGCVILISYFFVVYYSL

SEQ ID NO: 2383438 - protein, 20 aa, Entamoeba dispar
GWMGNGYIDFTTKFNGLSAS

SEQ ID NO: 2383439 - protein, 22 aa, Entamoeba dispar
GWMGNGYIEFSTKFNGLSASII

SEQ ID NO: 2383440 - protein, 18 aa, Entamoeba dispar
GWNMINYRFMLYKEYLKE

SEQ ID NO: 2383441 - protein, 18 aa, Entamoeba dispar
GWNSLYFNNHDQPRQVSR

SEQ ID NO: 2383442 - protein, 17 aa, Entamoeba dispar
GWQYFMIDFCYFCQIIT

SEQ ID NO: 2383443 - protein, 18 aa, Entamoeba dispar
GYACEFEIFIIIKCTTKI

SEQ ID NO: 2383444 - protein, 23 aa, Entamoeba dispar
GYAFTYPFAWLAGAKIMTYTHYP

SEQ ID NO: 2383445 - protein, 20 aa, Entamoeba dispar
GYALHFIVIIILWTFLWTVC

SEQ ID NO: 2383446 - protein, 21 aa, Entamoeba dispar
GYCILPSITTLNNWIDINVIL

SEQ ID NO: 2383447 - protein, 20 aa, Entamoeba dispar
GYCTKCYDGYYLKDNSCTRC

SEQ ID NO: 2383448 - protein, 22 aa, Entamoeba dispar
GYECKPCTLGTLHCQNCSINGN

SEQ ID NO: 2383449 - protein, 29 aa, Entamoeba dispar
GYEFAIKTPCTMPRWKLYDEELTECWKNI

SEQ ID NO: 2383450 - protein, 18 aa, Entamoeba dispar
GYFFDFYNKKCVVDVCGS

SEQ ID NO: 2383451 - protein, 18 aa, Entamoeba dispar
GYFFVCYILFLNKTYSKP

SEQ ID NO: 2383452 - protein, 20 aa, Entamoeba dispar
GYGCKRCEEGYYLTKDKKCL

SEQ ID NO: 2383453 - protein, 18 aa, Entamoeba dispar
GYGGESCILKCWHNNTWQ

SEQ ID NO: 2383454 - protein, 17 aa, Entamoeba dispar
GYGGSDCHLLCYYNDQW

SEQ ID NO: 2383455 - protein, 18 aa, Entamoeba dispar
GYGKEDGREFFIMRNSWY

SEQ ID NO: 2383456 - protein, 22 aa, Entamoeba dispar
GYGLCQVCIIPLLNSLFDDSAI

SEQ ID NO: 2383457 - protein, 17 aa, Entamoeba dispar
GYIGILYMFYVKQCGGL

SEQ ID NO: 2383458 - protein, 19 aa, Entamoeba dispar
GYIILRFKKNVFYNSTQFM

SEQ ID NO: 2383459 - protein, 19 aa, Entamoeba dispar
GYIKAFSLMLIICGFIIVV

SEQ ID NO: 2383460 - protein, 23 aa, Entamoeba dispar
GYILCILGTIFGLIAGFDMEENM

SEQ ID NO: 2383461 - protein, 18 aa, Entamoeba dispar
GYISVALVYGFCGIGQFV

SEQ ID NO: 2383462 - protein, 24 aa, Entamoeba dispar
GYKDKKSLFGLGYDWRYADVNYNN

SEQ ID NO: 2383463 - protein, 21 aa, Entamoeba dispar
GYKFRISFTETYRYNYEYNER

SEQ ID NO: 2383464 - protein, 19 aa, Entamoeba dispar
GYLPKGIRLIDWMKRKDKL

SEQ ID NO: 2383465 - protein, 23 aa, Entamoeba dispar
GYLRIAAPFFDYSHLDAAKQPEE

SEQ ID NO: 2383466 - protein, 17 aa, Entamoeba dispar
GYLSRWVEKIISPYDDV

SEQ ID NO: 2383467 - protein, 19 aa, Entamoeba dispar
GYLTYIMWFRHKGFAVAIK

SEQ ID NO: 2383468 - protein, 21 aa, Entamoeba dispar
GYLVWCMFLVLLVSLYGLHIY

SEQ ID NO: 2383469 - protein, 19 aa, Entamoeba dispar
GYNVIRFGKVNTKIYNPIT

SEQ ID NO: 2383470 - protein, 21 aa, Entamoeba dispar
GYPVREYQLDWSLIPSDTSKL

SEQ ID NO: 2383471 - protein, 18 aa, Entamoeba dispar
GYQLIADMFICKGKVHVD

SEQ ID NO: 2383472 - protein, 25 aa, Entamoeba dispar
GYSTSSGMTCKKCRYGFNSDGSCIV

SEQ ID NO: 2383473 - protein, 18 aa, Entamoeba dispar
GYSVFNIILTFLFEIISV

SEQ ID NO: 2383474 - protein, 26 aa, Entamoeba dispar
GYTQLEWDLFWGFSVDYEFNSKQLFH

SEQ ID NO: 2383475 - protein, 24 aa, Entamoeba dispar
GYTQPNCPCGFSDNALKYSDNGCI

SEQ ID NO: 2383476 - protein, 25 aa, Entamoeba dispar
GYWFPLLFCLPFVLYFTFIPTFNFC

SEQ ID NO: 2383477 - protein, 18 aa, Entamoeba dispar
GYYLTKDMKCLKCDDKCE

SEQ ID NO: 2383478 - protein, 17 aa, Entamoeba dispar
HAAAYRYAKLLQLQLPR

SEQ ID NO: 2383479 - protein, 18 aa, Entamoeba dispar
HACSSSYYNIDWNTLASS

SEQ ID NO: 2383480 - protein, 17 aa, Entamoeba dispar
HAFQFSDIQFNAGFIGI

SEQ ID NO: 2383481 - protein, 19 aa, Entamoeba dispar
HAKELFRQVILKASVVICS

SEQ ID NO: 2383482 - protein, 19 aa, Entamoeba dispar
HAKHLISFMSKKQMLLSHL

SEQ ID NO: 2383483 - protein, 17 aa, Entamoeba dispar
HALILFGDYKFNSMESS

SEQ ID NO: 2383484 - protein, 25 aa, Entamoeba dispar
HAQFTEARSAISFGPLSDTPLSKEY

SEQ ID NO: 2383485 - protein, 20 aa, Entamoeba dispar
HAQVMKKRVDEMIADGKTPR

SEQ ID NO: 2383486 - protein, 21 aa, Entamoeba dispar
HCDLCTFSQCLVCENGYSYDS

SEQ ID NO: 2383487 - protein, 17 aa, Entamoeba dispar
HCFLQLGTFSQIYFDSI

SEQ ID NO: 2383488 - protein, 24 aa, Entamoeba dispar
HCFPETKGRFQVFVHGDFLPITLF

SEQ ID NO: 2383489 - protein, 20 aa, Entamoeba dispar
HCIFPIKDGKFFFLSPLQMT

SEQ ID NO: 2383490 - protein, 17 aa, Entamoeba dispar
HCINEIYNKLGSSINEE

SEQ ID NO: 2383491 - protein, 24 aa, Entamoeba dispar
HCIQCTLKKCIICEDNYINNNGVC

SEQ ID NO: 2383492 - protein, 23 aa, Entamoeba dispar
HCKYCNETNCFVCDENYAVNKNE

SEQ ID NO: 2383493 - protein, 20 aa, Entamoeba dispar
HCNEWRTTISQMFQSNIFVG

SEQ ID NO: 2383494 - protein, 18 aa, Entamoeba dispar
HCRKCLDHSNNVFFISSI

SEQ ID NO: 2383495 - protein, 32 aa, Entamoeba dispar
HCSISSPYGCLRCMTGYYLKDGICSSCDNNCR

SEQ ID NO: 2383496 - protein, 24 aa, Entamoeba dispar
HCSKCGRCVLKMDHHCPFVGSCIG

SEQ ID NO: 2383497 - protein, 22 aa, Entamoeba dispar
HCTSCSTISCYSCEENYVLIGD

SEQ ID NO: 2383498 - protein, 19 aa, Entamoeba dispar
HCYGYLNVIALTFTTVPGT

SEQ ID NO: 2383499 - protein, 19 aa, Entamoeba dispar
HDCSSSFLNFIIKTLPMIK

SEQ ID NO: 2383500 - protein, 21 aa, Entamoeba dispar
HDFSLKCPFFPEKSLETLKEY

SEQ ID NO: 2383501 - protein, 30 aa, Entamoeba dispar
HDGPCPKCSVQVEKSCYCGKEKSKFSCGDC

SEQ ID NO: 2383502 - protein, 22 aa, Entamoeba dispar
HDGQVFPFNYIVPLFHSKSYGM

SEQ ID NO: 2383503 - protein, 18 aa, Entamoeba dispar
HDGRPTYDIYTLNSNGLL

SEQ ID NO: 2383504 - protein, 24 aa, Entamoeba dispar
HDIYPLGVCFYRILTNKLPFGQTE

SEQ ID NO: 2383505 - protein, 23 aa, Entamoeba dispar
HDLDRLTSVYIHLFPGLVIYCIR

SEQ ID NO: 2383506 - protein, 22 aa, Entamoeba dispar
HEAAWVLCNGLLVFNNYQYFAQ

SEQ ID NO: 2383507 - protein, 25 aa, Entamoeba dispar
HEARDSGLFAVSWSFGKAIGYAAGG

SEQ ID NO: 2383508 - protein, 27 aa, Entamoeba dispar
HEARNSGLFAVCWSFGKAIGYAAGGTL

SEQ ID NO: 2383509 - protein, 24 aa, Entamoeba dispar
HEDPELHWMYGFKNECLGKYDTET

SEQ ID NO: 2383510 - protein, 19 aa, Entamoeba dispar
HEDPGCLHRNGGLSEYVLS

SEQ ID NO: 2383511 - protein, 23 aa, Entamoeba dispar
HEDWQLWMWFGIVTVVIMVVIVL

SEQ ID NO: 2383512 - protein, 26 aa, Entamoeba dispar
HEENRSSGLLIWTIWTIMTILAVTIL

SEQ ID NO: 2383513 - protein, 20 aa, Entamoeba dispar
HELLEGPFIYGVVISLITIL

SEQ ID NO: 2383514 - protein, 19 aa, Entamoeba dispar
HERYCDTLCPCEGDDCEMD

SEQ ID NO: 2383515 - protein, 21 aa, Entamoeba dispar
HEVNSLISLILMYQYGVYFDK

SEQ ID NO: 2383516 - protein, 19 aa, Entamoeba dispar
HFFPNLVLYYLRWKSSFPI

SEQ ID NO: 2383517 - protein, 25 aa, Entamoeba dispar
HFFPNLVLYYLRWKSSFPIPDHLTF

SEQ ID NO: 2383518 - protein, 19 aa, Entamoeba dispar
HFFTFIFDQLEVVIQKGND

SEQ ID NO: 2383519 - protein, 23 aa, Entamoeba dispar
HFIVIQLALKWGKEAAGPDYKIP

SEQ ID NO: 2383520 - protein, 30 aa, Entamoeba dispar
HFLLSEEWHFWRLLLINIYTLWTVPLLLLA

SEQ ID NO: 2383521 - protein, 18 aa, Entamoeba dispar
HFRKIHYIVMTIFLILFF

SEQ ID NO: 2383522 - protein, 19 aa, Entamoeba dispar
HFTTLKIIHGFVLGMVPAL

SEQ ID NO: 2383523 - protein, 24 aa, Entamoeba dispar
HFVKRYPDCRIVNVDKLDYCSSLK

SEQ ID NO: 2383524 - protein, 25 aa, Entamoeba dispar
HFYISFDYSQLIAINPSFFKSNNSF

SEQ ID NO: 2383525 - protein, 24 aa, Entamoeba dispar
HGFEKQFHCCYVFSNGTIQPECSC

SEQ ID NO: 2383526 - protein, 36 aa, Entamoeba dispar
HGFYPGYLLFFFCCGIPYEFCSKGFLKIINTYINKK

SEQ ID NO: 2383527 - protein, 18 aa, Entamoeba dispar
HGGSVGWQAPEAIKGERL

SEQ ID NO: 2383528 - protein, 24 aa, Entamoeba dispar
HGIYPGYYLSFGMLALHHDVSCGF

SEQ ID NO: 2383529 - protein, 28 aa, Entamoeba dispar
HGNICPKAFCIVDGVKLLVRERTEGEEC

SEQ ID NO: 2383530 - protein, 22 aa, Entamoeba dispar
HGRMKSPHGNFVRALNSITFSS

SEQ ID NO: 2383531 - protein, 23 aa, Entamoeba dispar
HGSGRACYCIDCDYISRADNDIW

SEQ ID NO: 2383532 - protein, 25 aa, Entamoeba dispar
HGSTYKLKVNWPKYSYKQLGGLITT

SEQ ID NO: 2383533 - protein, 17 aa, Entamoeba dispar
HHCPWLGNCIGRRNYKS

SEQ ID NO: 2383534 - protein, 17 aa, Entamoeba dispar
HHCSTCKQCIGRYDHHC

SEQ ID NO: 2383535 - protein, 17 aa, Entamoeba dispar
HHCSWMSACIGYHNARY

SEQ ID NO: 2383536 - protein, 17 aa, Entamoeba dispar
HHIEYTLNKQLDGKGNV

SEQ ID NO: 2383537 - protein, 25 aa, Entamoeba dispar
HHKKENRKGVSFGKPGSNQVLEKAL

SEQ ID NO: 2383538 - protein, 17 aa, Entamoeba dispar
HHLIKQCYQRIMNDVEV

SEQ ID NO: 2383539 - protein, 19 aa, Entamoeba dispar
HIAWIQRMIEEYVSYKMYC

SEQ ID NO: 2383540 - protein, 23 aa, Entamoeba dispar
HICSMVHSLLKLSEPSVIDLFAS

SEQ ID NO: 2383541 - protein, 23 aa, Entamoeba dispar
HIDHCIGIGKWLGTLTLHQNKPI

SEQ ID NO: 2383542 - protein, 17 aa, Entamoeba dispar
HIDWLEKKVNIIIKKFF

SEQ ID NO: 2383543 - protein, 19 aa, Entamoeba dispar
HIEISICSFILKVAQSIVL

SEQ ID NO: 2383544 - protein, 24 aa, Entamoeba dispar
HIFDIRWWPNDSLRVEYVRELQES

SEQ ID NO: 2383545 - protein, 29 aa, Entamoeba dispar
HIFQILNYFRRLCVHPMLVLDEQHPMKQK

SEQ ID NO: 2383546 - protein, 17 aa, Entamoeba dispar
HIFQIYMSVCFALICAN

SEQ ID NO: 2383547 - protein, 25 aa, Entamoeba dispar
HIFSNIFCRNMLLFISRSTKTAKYA

SEQ ID NO: 2383548 - protein, 18 aa, Entamoeba dispar
HIFYKPKNAILLMIVNSI

SEQ ID NO: 2383549 - protein, 19 aa, Entamoeba dispar
HIGINFTLILSEIIFIFQI

SEQ ID NO: 2383550 - protein, 20 aa, Entamoeba dispar
HIIDIGNYVFFNCFNLTRIE

SEQ ID NO: 2383551 - protein, 18 aa, Entamoeba dispar
HIISIIFIFIIYGLTCYI

SEQ ID NO: 2383552 - protein, 24 aa, Entamoeba dispar
HIKLCGCSQIIKADAQGAVKFDQK

SEQ ID NO: 2383553 - protein, 22 aa, Entamoeba dispar
HILKQQFIEGLTFYLQSQSKEE

SEQ ID NO: 2383554 - protein, 23 aa, Entamoeba dispar
HILQTIMCSLGFGVYSSPLILLA

SEQ ID NO: 2383555 - protein, 19 aa, Entamoeba dispar
HINKNMCLILIVVFVGWFA

SEQ ID NO: 2383556 - protein, 20 aa, Entamoeba dispar
HIPGLSGITMLTFIDFSFNT

SEQ ID NO: 2383557 - protein, 19 aa, Entamoeba dispar
HIRKELQVFTGIDTLHTDI

SEQ ID NO: 2383558 - protein, 17 aa, Entamoeba dispar
HITICLLNIQYPQKPND

SEQ ID NO: 2383559 - protein, 24 aa, Entamoeba dispar
HITNYLCNKGWKSITINDNGLLHY

SEQ ID NO: 2383560 - protein, 29 aa, Entamoeba dispar
HITRVCIMLCCLCPAPSVNIIYCVEYNVA

SEQ ID NO: 2383561 - protein, 20 aa, Entamoeba dispar
HIVYFFCIFLIQFILYCLLG

SEQ ID NO: 2383562 - protein, 20 aa, Entamoeba dispar
HKAIQKSSAVSIPINIQIPS

SEQ ID NO: 2383563 - protein, 25 aa, Entamoeba dispar
HKDLIPIFCCIAILLYLITSIAAYF

SEQ ID NO: 2383564 - protein, 19 aa, Entamoeba dispar
HKEEYHLLFIPSIIVLLSI

SEQ ID NO: 2383565 - protein, 21 aa, Entamoeba dispar
HKEIMWSCCMTFIMIENQLNL

SEQ ID NO: 2383566 - protein, 24 aa, Entamoeba dispar
HKEIPICNYGGMGINQTSDGSVEF

SEQ ID NO: 2383567 - protein, 19 aa, Entamoeba dispar
HKFKPMILNLVFMILSTIA

SEQ ID NO: 2383568 - protein, 17 aa, Entamoeba dispar
HKIHGLWVMVFVDVIYL

SEQ ID NO: 2383569 - protein, 24 aa, Entamoeba dispar
HKISTLIERRIWKYYYTNHNTIIC

SEQ ID NO: 2383570 - protein, 19 aa, Entamoeba dispar
HKIWSCPRCFTAVHSTCVV

SEQ ID NO: 2383571 - protein, 18 aa, Entamoeba dispar
HKLYSYGIDYGFDSTTSP

SEQ ID NO: 2383572 - protein, 26 aa, Entamoeba dispar
HKQCFFCSRCKNVLDEKSFVSIDDAN

SEQ ID NO: 2383573 - protein, 25 aa, Entamoeba dispar
HKQKRYRFAIKILKRNLKKIGLHKT

SEQ ID NO: 2383574 - protein, 22 aa, Entamoeba dispar
HKRGDIKLVILNSGTCKIPRIR

SEQ ID NO: 2383575 - protein, 19 aa, Entamoeba dispar
HKTPFAVKVLTEYEKDEDL

SEQ ID NO: 2383576 - protein, 17 aa, Entamoeba dispar
HKYYLILRLKHFKCWRV

SEQ ID NO: 2383577 - protein, 29 aa, Entamoeba dispar
HLDGISIKIARTFFLFGLNNISKIAHTSF

SEQ ID NO: 2383578 - protein, 19 aa, Entamoeba dispar
HLEFCIYKYQLIKYLQQLV

SEQ ID NO: 2383579 - protein, 19 aa, Entamoeba dispar
HLFPGLVIYCIRWYVLTTV

SEQ ID NO: 2383580 - protein, 17 aa, Entamoeba dispar
HLGICLYVLMSTFAFVA

SEQ ID NO: 2383581 - protein, 25 aa, Entamoeba dispar
HLIHLLKTKWYCVVFVIMFITFSMI

SEQ ID NO: 2383582 - protein, 24 aa, Entamoeba dispar
HLKEIRDIIKYDMMKYVEGFIHYF

SEQ ID NO: 2383583 - protein, 25 aa, Entamoeba dispar
HLLFIPSIIVLLSIIVSAICGSLDT

SEQ ID NO: 2383584 - protein, 19 aa, Entamoeba dispar
HLLITRPDKLGALYDAFFR

SEQ ID NO: 2383585 - protein, 24 aa, Entamoeba dispar
HLLITRPDKLGALYDAFFRTEAGN

SEQ ID NO: 2383586 - protein, 29 aa, Entamoeba dispar
HLLLFCGCFILKIAIYFVQPFLKSYLFWT

SEQ ID NO: 2383587 - protein, 25 aa, Entamoeba dispar
HLLPGMVAYCIRWYSDLDIPKELNF

SEQ ID NO: 2383588 - protein, 19 aa, Entamoeba dispar
HLLRVCPSKSINKAVECEM

SEQ ID NO: 2383589 - protein, 22 aa, Entamoeba dispar
HLNAFPFKLIQRISSNNNSVTV

SEQ ID NO: 2383590 - protein, 18 aa, Entamoeba dispar
HLQQLILLQYLFKKNEIE

SEQ ID NO: 2383591 - protein, 19 aa, Entamoeba dispar
HLRYHKARINDMFEKNVIF

SEQ ID NO: 2383592 - protein, 22 aa, Entamoeba dispar
HLSIPAQLLLQLCIIMTDSLDM

SEQ ID NO: 2383593 - protein, 20 aa, Entamoeba dispar
HLTELIKFDFIDSPDNEISN

SEQ ID NO: 2383594 - protein, 18 aa, Entamoeba dispar
HLTFLTGFVYPLIFYISW

SEQ ID NO: 2383595 - protein, 18 aa, Entamoeba dispar
HLVFPLSFSFFIISSSSY

SEQ ID NO: 2383596 - protein, 19 aa, Entamoeba dispar
HLVGTFLALFGLFVAFFGV

SEQ ID NO: 2383597 - protein, 17 aa, Entamoeba dispar
HLVPKWVAPNVITTSGG

SEQ ID NO: 2383598 - protein, 17 aa, Entamoeba dispar
HLYIDVCFYAVGSGLFW

SEQ ID NO: 2383599 - protein, 29 aa, Entamoeba dispar
HLYLCDCLYRYVNYYLKALTIFLTKNILL

SEQ ID NO: 2383600 - protein, 30 aa, Entamoeba dispar
HMINLCSKESITFLTALLKVCCKIESLSDV

SEQ ID NO: 2383601 - protein, 24 aa, Entamoeba dispar
HMNGIEVIHLFTGKPLLHVTLLTS

SEQ ID NO: 2383602 - protein, 18 aa, Entamoeba dispar
HMRQVLNFLTAVMNTLMF

SEQ ID NO: 2383603 - protein, 18 aa, Entamoeba dispar
HNACLKLHAQLLVFTPTC

SEQ ID NO: 2383604 - protein, 25 aa, Entamoeba dispar
HNCTIFRQVAFDIISFIINQSVEPL

SEQ ID NO: 2383605 - protein, 24 aa, Entamoeba dispar
HNISCYILALLFVFFICTTGSVSI

SEQ ID NO: 2383606 - protein, 25 aa, Entamoeba dispar
HNKGPIPICLMKLVNTFVVLIMCVC

SEQ ID NO: 2383607 - protein, 18 aa, Entamoeba dispar
HNLVYFPLYDGMLNNYTS

SEQ ID NO: 2383608 - protein, 21 aa, Entamoeba dispar
HNNFISIYLFLLLAAIGITVS

SEQ ID NO: 2383609 - protein, 18 aa, Entamoeba dispar
HNNGVSWERIVLMGHSLG

SEQ ID NO: 2383610 - protein, 23 aa, Entamoeba dispar
HNRGRKLVFIFSMQGIGNILAPL

SEQ ID NO: 2383611 - protein, 19 aa, Entamoeba dispar
HNRVVKMIIAILVVIFGVL

SEQ ID NO: 2383612 - protein, 24 aa, Entamoeba dispar
HNTLTFILCFLLGVCYNFHGNIIA

SEQ ID NO: 2383613 - protein, 19 aa, Entamoeba dispar
HNVPRLKSAPGTFLSKAIS

SEQ ID NO: 2383614 - protein, 32 aa, Entamoeba dispar
HNWYKRLTITIVCVILLFSYIFTYVLLKTTPD

SEQ ID NO: 2383615 - protein, 18 aa, Entamoeba dispar
HPDIFYFFVEQIKSYALP

SEQ ID NO: 2383616 - protein, 18 aa, Entamoeba dispar
HPEFILITKFLKNVNGIK

SEQ ID NO: 2383617 - protein, 18 aa, Entamoeba dispar
HPELFWKMTEEIHKITAY

SEQ ID NO: 2383618 - protein, 17 aa, Entamoeba dispar
HPFLISLFIKPTIEILF

SEQ ID NO: 2383619 - protein, 26 aa, Entamoeba dispar
HPHPILRIKAAKCYYDIWKKEEKDIL

SEQ ID NO: 2383620 - protein, 27 aa, Entamoeba dispar
HPIDTLKFFYYYILRQIKTLYNYVIHS

SEQ ID NO: 2383621 - protein, 18 aa, Entamoeba dispar
HPIFWSIVILTHLLICGC

SEQ ID NO: 2383622 - protein, 27 aa, Entamoeba dispar
HPLLFKTKKIWGFCILTISFILNNIGF

SEQ ID NO: 2383623 - protein, 24 aa, Entamoeba dispar
HPMFWKCIQGVGLCYLMLICFLLF

SEQ ID NO: 2383624 - protein, 26 aa, Entamoeba dispar
HPPFSLDMLSMISARGLLFGEVQVLQ

SEQ ID NO: 2383625 - protein, 18 aa, Entamoeba dispar
HPPIGGGTFGIVYRAEWR

SEQ ID NO: 2383626 - protein, 23 aa, Entamoeba dispar
HPRVTYEVLVFANRVLKSYPSLR

SEQ ID NO: 2383627 - protein, 18 aa, Entamoeba dispar
HPSFCLYVVSALVVSYHS

SEQ ID NO: 2383628 - protein, 20 aa, Entamoeba dispar
HPSGKKFSVINEMHKTNKYL

SEQ ID NO: 2383629 - protein, 18 aa, Entamoeba dispar
HPVQCILVSLNLFSLCNV

SEQ ID NO: 2383630 - protein, 20 aa, Entamoeba dispar
HPYCDLLRKPNQLLNDLDAE

SEQ ID NO: 2383631 - protein, 23 aa, Entamoeba dispar
HQEKIFSLWGFIISYIVSKGGIV

SEQ ID NO: 2383632 - protein, 25 aa, Entamoeba dispar
HQHAPMCLMWISLIIIQLLTGYVIL

SEQ ID NO: 2383633 - protein, 17 aa, Entamoeba dispar
HQHPCALMFIALSLFAR

SEQ ID NO: 2383634 - protein, 25 aa, Entamoeba dispar
HQMVLLCIQDIFAIYSLIIELVNCH

SEQ ID NO: 2383635 - protein, 17 aa, Entamoeba dispar
HQRTLFFSNDWTKTTVD

SEQ ID NO: 2383636 - protein, 17 aa, Entamoeba dispar
HQVDIQAVFPFDSNRKR

SEQ ID NO: 2383637 - protein, 25 aa, Entamoeba dispar
HRDANRSSLSFAELLQMCEKIGYVF

SEQ ID NO: 2383638 - protein, 22 aa, Entamoeba dispar
HREIVCKHLNYLVKNTTKSFTD

SEQ ID NO: 2383639 - protein, 18 aa, Entamoeba dispar
HRFEITFEVMLFYTNSNE

SEQ ID NO: 2383640 - protein, 20 aa, Entamoeba dispar
HRGKNFFGINEFSELVQQLK

SEQ ID NO: 2383641 - protein, 19 aa, Entamoeba dispar
HRIQILEFVCQIGIEAEEL

SEQ ID NO: 2383642 - protein, 17 aa, Entamoeba dispar
HRLSSRLKRTLDSYEQE

SEQ ID NO: 2383643 - protein, 24 aa, Entamoeba dispar
HRPQFRSAVLMFQREFAMRLVAKP

SEQ ID NO: 2383644 - protein, 19 aa, Entamoeba dispar
HRQFNLICQIDFTSSRKRM

SEQ ID NO: 2383645 - protein, 17 aa, Entamoeba dispar
HRVDRKFGWDTHGLPIE

SEQ ID NO: 2383646 - protein, 29 aa, Entamoeba dispar
HRVLLKYLNLICGIVIMLLAVNRKDVISY

SEQ ID NO: 2383647 - protein, 18 aa, Entamoeba dispar
HRWNYYIICMLKVSLNDT

SEQ ID NO: 2383648 - protein, 19 aa, Entamoeba dispar
HSCGDGYYMEGFMKCILLN

SEQ ID NO: 2383649 - protein, 24 aa, Entamoeba dispar
HSDVCGKLTDFGTCRNISERNRLN

SEQ ID NO: 2383650 - protein, 25 aa, Entamoeba dispar
HSEIKELFVQFLIDNDFICFLCIAI

SEQ ID NO: 2383651 - protein, 25 aa, Entamoeba dispar
HSFAIALCYFIIPYFSANHDFRKLA

SEQ ID NO: 2383652 - protein, 24 aa, Entamoeba dispar
HSFCANHILAPFIWEPLLKNVIPR

SEQ ID NO: 2383653 - protein, 18 aa, Entamoeba dispar
HSFSLLVISEIFSDVIVF

SEQ ID NO: 2383654 - protein, 19 aa, Entamoeba dispar
HSICSQKFFSTDSTISSIE

SEQ ID NO: 2383655 - protein, 20 aa, Entamoeba dispar
HSKMALDILQPLLVLISSSK

SEQ ID NO: 2383656 - protein, 23 aa, Entamoeba dispar
HSKTPMWLILLIAFLSFDNIVYV

SEQ ID NO: 2383657 - protein, 19 aa, Entamoeba dispar
HSLGKLLVVTRWLGRNPVL

SEQ ID NO: 2383658 - protein, 22 aa, Entamoeba dispar
HSLHPKISCIEIRKDDDPNQIP

SEQ ID NO: 2383659 - protein, 23 aa, Entamoeba dispar
HSLWYKWATTIMLVYTALFCTVL

SEQ ID NO: 2383660 - protein, 20 aa, Entamoeba dispar
HSNGCTICRLSLSKTVDKEK

SEQ ID NO: 2383661 - protein, 18 aa, Entamoeba dispar
HSPYHVLSFGKILLENKH

SEQ ID NO: 2383662 - protein, 18 aa, Entamoeba dispar
HSQYKLVYEKVFDNFVSF

SEQ ID NO: 2383663 - protein, 25 aa, Entamoeba dispar
HSRIFKRVILYYIIIIVFFIFTAIM

SEQ ID NO: 2383664 - protein, 24 aa, Entamoeba dispar
HSSHWKYAKLVSVIILITINLFHI

SEQ ID NO: 2383665 - protein, 18 aa, Entamoeba dispar
HSSMVFNGMMFISLLLCG

SEQ ID NO: 2383666 - protein, 24 aa, Entamoeba dispar
HSSVCGKLTDFGTCRNVSERSLAN

SEQ ID NO: 2383667 - protein, 22 aa, Entamoeba dispar
HSTKLKIGITLTDAYSGNTIKR

SEQ ID NO: 2383668 - protein, 18 aa, Entamoeba dispar
HSVCYLCNEHIFKDFVIY

SEQ ID NO: 2383669 - protein, 21 aa, Entamoeba dispar
HSVELCFTRTQGCSVVEKYGY

SEQ ID NO: 2383670 - protein, 20 aa, Entamoeba dispar
HSWIFLPSFIPDESFDNSKY

SEQ ID NO: 2383671 - protein, 30 aa, Entamoeba dispar
HSYKSWSLILLWCSLILFEFLLIVLSIISF

SEQ ID NO: 2383672 - protein, 27 aa, Entamoeba dispar
HSYPFCWRSDTPLIYRAIPSWFVNVES

SEQ ID NO: 2383673 - protein, 25 aa, Entamoeba dispar
HTAALFFCSMFWYHYIEKAPLINFK

SEQ ID NO: 2383674 - protein, 18 aa, Entamoeba dispar
HTFSRLIYPFIWQHVLIP

SEQ ID NO: 2383675 - protein, 20 aa, Entamoeba dispar
HTFVWPFYISMILSILLFFG

SEQ ID NO: 2383676 - protein, 19 aa, Entamoeba dispar
HTISCQLIWVTKKDGKDSV

SEQ ID NO: 2383677 - protein, 32 aa, Entamoeba dispar
HTKDCQVCRGVNWKNVFKLDFVKKEIKRRSLS

SEQ ID NO: 2383678 - protein, 19 aa, Entamoeba dispar
HTLSPEIIKNVIKCVNSII

SEQ ID NO: 2383679 - protein, 18 aa, Entamoeba dispar
HTNQFINIHIFKSTIQPE

SEQ ID NO: 2383680 - protein, 18 aa, Entamoeba dispar
HTVSYPWNSINIVTTSTL

SEQ ID NO: 2383681 - protein, 19 aa, Entamoeba dispar
HVFIPPSLYYDIDTPLEMM

SEQ ID NO: 2383682 - protein, 32 aa, Entamoeba dispar
HVKVWGLRALCAFLFYCLLTLVGFLILFGINL

SEQ ID NO: 2383683 - protein, 18 aa, Entamoeba dispar
HVLAGYRLPFPDFISPKM

SEQ ID NO: 2383684 - protein, 19 aa, Entamoeba dispar
HVLFQWLIQKVFMLSKSTQ

SEQ ID NO: 2383685 - protein, 17 aa, Entamoeba dispar
HVLISIFCGFYNKKIYS

SEQ ID NO: 2383686 - protein, 29 aa, Entamoeba dispar
HVLSSAICAISFLVTRVQKLFTRYASSFL

SEQ ID NO: 2383687 - protein, 22 aa, Entamoeba dispar
HVPLYINICVIIICIIIFDIIY

SEQ ID NO: 2383688 - protein, 18 aa, Entamoeba dispar
HVPYLFVIIYGLSFFFQN

SEQ ID NO: 2383689 - protein, 24 aa, Entamoeba dispar
HVTIQWKSGILVYLEVSNEKNYIM

SEQ ID NO: 2383690 - protein, 21 aa, Entamoeba dispar
HVVEHSVPCLITKFIFKLIFQ

SEQ ID NO: 2383691 - protein, 17 aa, Entamoeba dispar
HVYCEECIFKWLIQQPR

SEQ ID NO: 2383692 - protein, 18 aa, Entamoeba dispar
HYDPSFYWQLYRVTPSQR

SEQ ID NO: 2383693 - protein, 22 aa, Entamoeba dispar
HYFLIVCFSLWIPQIYQNIITN

SEQ ID NO: 2383694 - protein, 25 aa, Entamoeba dispar
HYHVPSARTSWEFSNQAMKVLETAG

SEQ ID NO: 2383695 - protein, 18 aa, Entamoeba dispar
HYIMDKIHIFAGVFVECV

SEQ ID NO: 2383696 - protein, 20 aa, Entamoeba dispar
HYIYFYKMLWLLLEKFDHKI

SEQ ID NO: 2383697 - protein, 27 aa, Entamoeba dispar
HYLNGFKMKFEIRVHVLFGTITLNAEV

SEQ ID NO: 2383698 - protein, 28 aa, Entamoeba dispar
HYMIQSAIKDICWIVMKIEKLAQLERIN

SEQ ID NO: 2383699 - protein, 24 aa, Entamoeba dispar
HYMIVFSILICYAVQDKKEVEVFY

SEQ ID NO: 2383700 - protein, 18 aa, Entamoeba dispar
HYSATCLNGECVVQAVGD

SEQ ID NO: 2383701 - protein, 17 aa, Entamoeba dispar
HYVRMFFQELLLYRCTV

SEQ ID NO: 2383702 - protein, 29 aa, Entamoeba dispar
HYYTYCLLHFFLYIGMIFCNYNYFNECFF

SEQ ID NO: 2383703 - protein, 19 aa, Entamoeba dispar
IAALCCGYFALNIFSLTTV

SEQ ID NO: 2383704 - protein, 30 aa, Entamoeba dispar
IAAPLLWVGVCFLCFLGIRINYLGLAIICF

SEQ ID NO: 2383705 - protein, 20 aa, Entamoeba dispar
IAAYFIRWVYNYHDIKDGFI

SEQ ID NO: 2383706 - protein, 20 aa, Entamoeba dispar
IACFCILSFIVLIFAKTRGS

SEQ ID NO: 2383707 - protein, 19 aa, Entamoeba dispar
IACLIYTIYFFWIVPSCLV

SEQ ID NO: 2383708 - protein, 21 aa, Entamoeba dispar
IACQCHILFFSAIILVGITII

SEQ ID NO: 2383709 - protein, 25 aa, Entamoeba dispar
IADERVLICRKGVLLIQQEDDNFDD

SEQ ID NO: 2383710 - protein, 23 aa, Entamoeba dispar
IADGSICKDGECADSNGKVYFFS

SEQ ID NO: 2383711 - protein, 17 aa, Entamoeba dispar
IADICRIGFVLQAISGI

SEQ ID NO: 2383712 - protein, 17 aa, Entamoeba dispar
IADIFVVQWEELKPLNR

SEQ ID NO: 2383713 - protein, 18 aa, Entamoeba dispar
IADQLLFERVKEYINQYS

SEQ ID NO: 2383714 - protein, 19 aa, Entamoeba dispar
IAEDCGFTYQELEEQPQEP

SEQ ID NO: 2383715 - protein, 23 aa, Entamoeba dispar
IAFLVFLCLYISFPLTITETPRN

SEQ ID NO: 2383716 - protein, 17 aa, Entamoeba dispar
IAFMDEWFFAFTKQYHM

SEQ ID NO: 2383717 - protein, 18 aa, Entamoeba dispar
IAFSGLFLSAILMLNQFA

SEQ ID NO: 2383718 - protein, 17 aa, Entamoeba dispar
IAGIAIYLFLFILVIIQ

SEQ ID NO: 2383719 - protein, 24 aa, Entamoeba dispar
IAGKEFYINLIIFFVLLIRIALFK

SEQ ID NO: 2383720 - protein, 23 aa, Entamoeba dispar
IAGVSVGMVFIRNGWILCAFAVV

SEQ ID NO: 2383721 - protein, 24 aa, Entamoeba dispar
IAHDGRPKFDIILLNNLGLMTSVS

SEQ ID NO: 2383722 - protein, 23 aa, Entamoeba dispar
IAHHLCLPRRLLRPFISDLVRDS

SEQ ID NO: 2383723 - protein, 18 aa, Entamoeba dispar
IAIAAMIGGILYFKLTHW

SEQ ID NO: 2383724 - protein, 28 aa, Entamoeba dispar
IAIICVSVIVGILLILAIVLLAFIIYRK

SEQ ID NO: 2383725 - protein, 24 aa, Entamoeba dispar
IAIIPRLIFDITMFIPIVAQTIMI

SEQ ID NO: 2383726 - protein, 18 aa, Entamoeba dispar
IAIIYTLMLFSGTIKNYL

SEQ ID NO: 2383727 - protein, 28 aa, Entamoeba dispar
IAILCNIQFMRFRVPFTYCEFGTHISLI

SEQ ID NO: 2383728 - protein, 17 aa, Entamoeba dispar
IAIMKITKRCLAKRLPT

SEQ ID NO: 2383729 - protein, 18 aa, Entamoeba dispar
IAIQPKWYIIGLLSPLFF

SEQ ID NO: 2383730 - protein, 32 aa, Entamoeba dispar
IAISNILFGFSFNYYFAVAMRFLNGMLNSTVG

SEQ ID NO: 2383731 - protein, 38 aa, Entamoeba dispar
IAIYPIIWIYVFGRCRGFVHFLSCFFKVLKTFFTQNNI

SEQ ID NO: 2383732 - protein, 29 aa, Entamoeba dispar
IAKHLNFFLKIIIKSLLFWMQKEDLFEKE

SEQ ID NO: 2383733 - protein, 19 aa, Entamoeba dispar
IAKILGLKSSITITAPLSI

SEQ ID NO: 2383734 - protein, 25 aa, Entamoeba dispar
IAKLKRSTPIYSLYFRNIETNIELE

SEQ ID NO: 2383735 - protein, 25 aa, Entamoeba dispar
IAKLPKLICSLSIDQFIYWFCSENY

SEQ ID NO: 2383736 - protein, 27 aa, Entamoeba dispar
IALDFCAILTWIFKRYRDTFIGLIEQE

SEQ ID NO: 2383737 - protein, 24 aa, Entamoeba dispar
IALIMCFFMTFLFSITVSRLVLLI

SEQ ID NO: 2383738 - protein, 17 aa, Entamoeba dispar
IALKPSGLDYLYVDVNV

SEQ ID NO: 2383739 - protein, 23 aa, Entamoeba dispar
IALLNVYCTFKLKRIPRQTNRTL

SEQ ID NO: 2383740 - protein, 25 aa, Entamoeba dispar
IALMSQMMICYAICDVIPMYLPVKQ

SEQ ID NO: 2383741 - protein, 37 aa, Entamoeba dispar
IALNGNFPFIWGFFMLCSLSYWISFQMVPNGQWDNNA

SEQ ID NO: 2383742 - protein, 24 aa, Entamoeba dispar
IALTILEYLLLYGYPFALKILLIL

SEQ ID NO: 2383743 - protein, 20 aa, Entamoeba dispar
IAMMIPKPILIYILKKKDQK

SEQ ID NO: 2383744 - protein, 22 aa, Entamoeba dispar
IANIIPLLFKWYSSSNNLIKKE

SEQ ID NO: 2383745 - protein, 25 aa, Entamoeba dispar
IANQPLCPFREEFMQPFSDYVLSQY

SEQ ID NO: 2383746 - protein, 25 aa, Entamoeba dispar
IAPTHFKGTFYLKNLATISDVIIDD

SEQ ID NO: 2383747 - protein, 17 aa, Entamoeba dispar
IAQDCLLYYNNKCVKCA

SEQ ID NO: 2383748 - protein, 17 aa, Entamoeba dispar
IAQIIALLICIILISIN

SEQ ID NO: 2383749 - protein, 17 aa, Entamoeba dispar
IARSCYNLFSITVVYSW

SEQ ID NO: 2383750 - protein, 19 aa, Entamoeba dispar
IASPLLKPSIDQLKSLEKD

SEQ ID NO: 2383751 - protein, 26 aa, Entamoeba dispar
IASTCYPETIIAPRIIVGTKCENGVT

SEQ ID NO: 2383752 - protein, 27 aa, Entamoeba dispar
IATIFTFFCVFKFRYILFILLSILLQL

SEQ ID NO: 2383753 - protein, 17 aa, Entamoeba dispar
IATNLSIQFRKDVLEQI

SEQ ID NO: 2383754 - protein, 21 aa, Entamoeba dispar
IATTCSILIHIKCYVTSINEK

SEQ ID NO: 2383755 - protein, 18 aa, Entamoeba dispar
IAVFCGVTSLLTGNTGLF

SEQ ID NO: 2383756 - protein, 18 aa, Entamoeba dispar
IAVFLCFSLIKIQPSLEC

SEQ ID NO: 2383757 - protein, 24 aa, Entamoeba dispar
IAVIPVWILFFILLFGYYILKVIV

SEQ ID NO: 2383758 - protein, 20 aa, Entamoeba dispar
IAVMFPVVWSAYLGSDPTGL

SEQ ID NO: 2383759 - protein, 17 aa, Entamoeba dispar
IAVVIASLFPNDFKMQQ

SEQ ID NO: 2383760 - protein, 19 aa, Entamoeba dispar
IAYARFRLWVFPRYVISAA

SEQ ID NO: 2383761 - protein, 18 aa, Entamoeba dispar
IAYIIVILFFNFAGTAVI

SEQ ID NO: 2383762 - protein, 21 aa, Entamoeba dispar
IAYSDSYSFCSLLNKVMINND

SEQ ID NO: 2383763 - protein, 22 aa, Entamoeba dispar
ICAIVLIVIVGIILLLTQYYST

SEQ ID NO: 2383764 - protein, 17 aa, Entamoeba dispar
ICASIFFVMIAGGMIIV

SEQ ID NO: 2383765 - protein, 18 aa, Entamoeba dispar
ICCMSARTIILKLLLNNW

SEQ ID NO: 2383766 - protein, 19 aa, Entamoeba dispar
ICDMKEAYIALSDIFDLYT

SEQ ID NO: 2383767 - protein, 19 aa, Entamoeba dispar
ICFGIFLIISGISVEIVSG

SEQ ID NO: 2383768 - protein, 17 aa, Entamoeba dispar
ICFSLIILVSTGYPCND

SEQ ID NO: 2383769 - protein, 17 aa, Entamoeba dispar
ICGDGIWDSFTEQCDGS

SEQ ID NO: 2383770 - protein, 17 aa, Entamoeba dispar
ICGDYFTKQCQSVAGFS

SEQ ID NO: 2383771 - protein, 20 aa, Entamoeba dispar
ICGKYPTSIEVEWYGTDTLG

SEQ ID NO: 2383772 - protein, 20 aa, Entamoeba dispar
ICGLLKSILMEMNPRFINGE

SEQ ID NO: 2383773 - protein, 24 aa, Entamoeba dispar
ICHCFKEFIENGLYVTDKCEDKTN

SEQ ID NO: 2383774 - protein, 17 aa, Entamoeba dispar
ICIGVLVLWLALLITFS

SEQ ID NO: 2383775 - protein, 24 aa, Entamoeba dispar
ICIVTEFARYGSLRDLMKNKNLNL

SEQ ID NO: 2383776 - protein, 17 aa, Entamoeba dispar
ICKNGYYYDKKNYRCNK

SEQ ID NO: 2383777 - protein, 21 aa, Entamoeba dispar
ICLEPLGILVDYMGEGTLQNY

SEQ ID NO: 2383778 - protein, 18 aa, Entamoeba dispar
ICLIPFYEVYHGCSCWCN

SEQ ID NO: 2383779 - protein, 20 aa, Entamoeba dispar
ICLLYFKIIHVLLFLIFLFF

SEQ ID NO: 2383780 - protein, 19 aa, Entamoeba dispar
ICLRYFFQRLDHITIYIMI

SEQ ID NO: 2383781 - protein, 21 aa, Entamoeba dispar
ICLYCGRVICTKRKCLEYHSH

SEQ ID NO: 2383782 - protein, 27 aa, Entamoeba dispar
ICMKCATHFLTPIPFFKIMAKDEYNPR

SEQ ID NO: 2383783 - protein, 17 aa, Entamoeba dispar
ICNCSLFNPTPSISAML

SEQ ID NO: 2383784 - protein, 19 aa, Entamoeba dispar
ICNILLTIVILCYDSSQKE

SEQ ID NO: 2383785 - protein, 19 aa, Entamoeba dispar
ICPSKCSISGKGMEEIKTI

SEQ ID NO: 2383786 - protein, 23 aa, Entamoeba dispar
ICQCLKPFRCHHCRICNCCIYRM

SEQ ID NO: 2383787 - protein, 26 aa, Entamoeba dispar
ICRNLYRITVWDSFNKYCCNINKNCQ

SEQ ID NO: 2383788 - protein, 21 aa, Entamoeba dispar
ICRTKAIVIGAIYPSVRDPTL

SEQ ID NO: 2383789 - protein, 17 aa, Entamoeba dispar
ICRTQFIATIGVSKNFI

SEQ ID NO: 2383790 - protein, 27 aa, Entamoeba dispar
ICSHHKRIIRELCCYVSPSLDNQKKRQ

SEQ ID NO: 2383791 - protein, 25 aa, Entamoeba dispar
ICSKLGEINPLFPISVEEMKKMVKM

SEQ ID NO: 2383792 - protein, 21 aa, Entamoeba dispar
ICSLLGALAWWYPKPWPESYW

SEQ ID NO: 2383793 - protein, 20 aa, Entamoeba dispar
ICSLVDFLNSFSVCLVYISL

SEQ ID NO: 2383794 - protein, 28 aa, Entamoeba dispar
ICSSLLVMLPICLITAELSSCLPSNGGL

SEQ ID NO: 2383795 - protein, 18 aa, Entamoeba dispar
ICTGETYKNIANCIRKII

SEQ ID NO: 2383796 - protein, 18 aa, Entamoeba dispar
ICTLYDFTQEVSFSNSPY

SEQ ID NO: 2383797 - protein, 18 aa, Entamoeba dispar
ICTYVLLILLCIYVLMYI

SEQ ID NO: 2383798 - protein, 20 aa, Entamoeba dispar
ICVDQKWIAEEICIICTGET

SEQ ID NO: 2383799 - protein, 21 aa, Entamoeba dispar
ICVFICVFVYILLYEYIIFYH

SEQ ID NO: 2383800 - protein, 23 aa, Entamoeba dispar
IDAKKLAYLYIMNYAKTQQDNAT

SEQ ID NO: 2383801 - protein, 17 aa, Entamoeba dispar
IDCALTLTNHWKYPMHF

SEQ ID NO: 2383802 - protein, 20 aa, Entamoeba dispar
IDCGYNFKNHITNAVCERYD

SEQ ID NO: 2383803 - protein, 21 aa, Entamoeba dispar
IDCTVFRPWHISTEMIGKMQP

SEQ ID NO: 2383804 - protein, 18 aa, Entamoeba dispar
IDDAEIILKKCAQMELNN

SEQ ID NO: 2383805 - protein, 18 aa, Entamoeba dispar
IDDAHCLKATKGKCEECI

SEQ ID NO: 2383806 - protein, 18 aa, Entamoeba dispar
IDEIRGKNVPRYTIDMNQ

SEQ ID NO: 2383807 - protein, 18 aa, Entamoeba dispar
IDELPFKGSSKNVSNHTD

SEQ ID NO: 2383808 - protein, 23 aa, Entamoeba dispar
IDESCSFKEIYVGIINITKESNI

SEQ ID NO: 2383809 - protein, 21 aa, Entamoeba dispar
IDEYSPLAVIDREFIAGKREV

SEQ ID NO: 2383810 - protein, 17 aa, Entamoeba dispar
IDFCRRVNRLLFPEFVI

SEQ ID NO: 2383811 - protein, 22 aa, Entamoeba dispar
IDFEIKKGVTYYILVKLVNPDD

SEQ ID NO: 2383812 - protein, 25 aa, Entamoeba dispar
IDFEPFRWLFTLPLSGLTTTLSPFF

SEQ ID NO: 2383813 - protein, 17 aa, Entamoeba dispar
IDFIRDLHQFVYFYEIN

SEQ ID NO: 2383814 - protein, 25 aa, Entamoeba dispar
IDFPLELRELLSFCSSKNMAISGLA

SEQ ID NO: 2383815 - protein, 20 aa, Entamoeba dispar
IDFQVKWLIVIACFVGAHAI

SEQ ID NO: 2383816 - protein, 17 aa, Entamoeba dispar
IDFYCGECNKLLTQIDN

SEQ ID NO: 2383817 - protein, 31 aa, Entamoeba dispar
IDGEALQHCLDCFPRSFFLFCDVSKAVICAR

SEQ ID NO: 2383818 - protein, 18 aa, Entamoeba dispar
IDGKLCFDTYPIVLSALA

SEQ ID NO: 2383819 - protein, 18 aa, Entamoeba dispar
IDGYILNDRVCTLCGNGK

SEQ ID NO: 2383820 - protein, 27 aa, Entamoeba dispar
IDGYSRITLCPLKIIPDNDCTCTFKNF

SEQ ID NO: 2383821 - protein, 23 aa, Entamoeba dispar
IDHRCIYCVSKNLPIQIHTEKDY

SEQ ID NO: 2383822 - protein, 24 aa, Entamoeba dispar
IDIDRVVRVLIHIFDLVDVPVSLI

SEQ ID NO: 2383823 - protein, 26 aa, Entamoeba dispar
IDILLKKRITSLIQWYPKEINCVESP

SEQ ID NO: 2383824 - protein, 20 aa, Entamoeba dispar
IDIYSVYSFVKFGSPDKTFQ

SEQ ID NO: 2383825 - protein, 25 aa, Entamoeba dispar
IDKIDYCSGFCFFQPNSTIVSSFLY

SEQ ID NO: 2383826 - protein, 23 aa, Entamoeba dispar
IDKKRLSNIFSEILEHKEALKIE

SEQ ID NO: 2383827 - protein, 26 aa, Entamoeba dispar
IDKMKTCGYWEFVFKPSKKEDVHYDG

SEQ ID NO: 2383828 - protein, 19 aa, Entamoeba dispar
IDKRWWKEGVVYQIYCKSF

SEQ ID NO: 2383829 - protein, 21 aa, Entamoeba dispar
IDKYFCKKKGSGYNDFNLEEM

SEQ ID NO: 2383830 - protein, 17 aa, Entamoeba dispar
IDLAKRKSLVVAEKLSK

SEQ ID NO: 2383831 - protein, 19 aa, Entamoeba dispar
IDLGSSCFSNYTLYSYIQS

SEQ ID NO: 2383832 - protein, 23 aa, Entamoeba dispar
IDLRIQKGIKMQLERRWDNNSFC

SEQ ID NO: 2383833 - protein, 19 aa, Entamoeba dispar
IDLRRLGNFYSQIVDASEI

SEQ ID NO: 2383834 - protein, 20 aa, Entamoeba dispar
IDLWEGYLHFRGFKCNTTQQ

SEQ ID NO: 2383835 - protein, 18 aa, Entamoeba dispar
IDLYRFTNIFKMSHLTVK

SEQ ID NO: 2383836 - protein, 20 aa, Entamoeba dispar
IDMIHPLEYLTFMLQLFVTP

SEQ ID NO: 2383837 - protein, 17 aa, Entamoeba dispar
IDMYIGIIFFFYFLAQT

SEQ ID NO: 2383838 - protein, 25 aa, Entamoeba dispar
IDMYIYRRVRINYPFIFDMQKRKYN

SEQ ID NO: 2383839 - protein, 19 aa, Entamoeba dispar
IDNCKNAGISVRMVTGDHV

SEQ ID NO: 2383840 - protein, 20 aa, Entamoeba dispar
IDNDFICFLCIAIENKQNIH

SEQ ID NO: 2383841 - protein, 24 aa, Entamoeba dispar
IDNKTRLRYWLTMANPEQYTIKNP

SEQ ID NO: 2383842 - protein, 24 aa, Entamoeba dispar
IDNYEFPAILLIVLGYSLINKKLQ

SEQ ID NO: 2383843 - protein, 33 aa, Entamoeba dispar
IDPIEDIKALKICQKRISTVVVMEKYQIKKLRD

SEQ ID NO: 2383844 - protein, 19 aa, Entamoeba dispar
IDPIELMKVYYADGSTQIF

SEQ ID NO: 2383845 - protein, 18 aa, Entamoeba dispar
IDPIKFLLSFAKKYGSYI

SEQ ID NO: 2383846 - protein, 23 aa, Entamoeba dispar
IDPKELYESFEFAYHQFSSILVF

SEQ ID NO: 2383847 - protein, 18 aa, Entamoeba dispar
IDPLRMITIWLTGLFIHY

SEQ ID NO: 2383848 - protein, 22 aa, Entamoeba dispar
IDPSGKFAVVFCIKAQHFHFID

SEQ ID NO: 2383849 - protein, 19 aa, Entamoeba dispar
IDQAIPIQPFQVIRTNNIL

SEQ ID NO: 2383850 - protein, 24 aa, Entamoeba dispar
IDQFKFNKCVIFKFNNNENHYMSE

SEQ ID NO: 2383851 - protein, 24 aa, Entamoeba dispar
IDQSRIIGYYGLFPALINLKNSFC

SEQ ID NO: 2383852 - protein, 23 aa, Entamoeba dispar
IDRERKIFFTLNMFKIDRGTTLR

SEQ ID NO: 2383853 - protein, 23 aa, Entamoeba dispar
IDRKLEFLAIPFVYKKNDNSFRS

SEQ ID NO: 2383854 - protein, 18 aa, Entamoeba dispar
IDRRGHWISVHMQCVEFI

SEQ ID NO: 2383855 - protein, 18 aa, Entamoeba dispar
IDRSWGNDLHNFFDGGYI

SEQ ID NO: 2383856 - protein, 20 aa, Entamoeba dispar
IDSFGYEFSCKWIFTLSMRV

SEQ ID NO: 2383857 - protein, 25 aa, Entamoeba dispar
IDSNIRIALCLNIKKLSALLFSKDA

SEQ ID NO: 2383858 - protein, 18 aa, Entamoeba dispar
IDSPCIIDTRVENIKFIG

SEQ ID NO: 2383859 - protein, 17 aa, Entamoeba dispar
IDTIEITKPVVIVYQHL

SEQ ID NO: 2383860 - protein, 28 aa, Entamoeba dispar
IDTIKSHCWNDIMIKSRIKEMEEEVEDK

SEQ ID NO: 2383861 - protein, 25 aa, Entamoeba dispar
IDTKEWYLTSSICSPVALINAPYIY

SEQ ID NO: 2383862 - protein, 25 aa, Entamoeba dispar
IDTLFLILLRLDFDVKYQSREDRVY

SEQ ID NO: 2383863 - protein, 29 aa, Entamoeba dispar
IDTLFPIRHAWTFTAIFLPGAVTRSYIGD

SEQ ID NO: 2383864 - protein, 17 aa, Entamoeba dispar
IDTSCGELCKPGYCQSG

SEQ ID NO: 2383865 - protein, 17 aa, Entamoeba dispar
IDVGKYCELSVSQLTST

SEQ ID NO: 2383866 - protein, 19 aa, Entamoeba dispar
IDVSDEFTSQLGLMDRSWV

SEQ ID NO: 2383867 - protein, 20 aa, Entamoeba dispar
IDYFPGQLPLLFSSFSQFTL

SEQ ID NO: 2383868 - protein, 18 aa, Entamoeba dispar
IEAGELVALMGGSGAGKS

SEQ ID NO: 2383869 - protein, 18 aa, Entamoeba dispar
IEANKVFEIFMKKYIEID

SEQ ID NO: 2383870 - protein, 18 aa, Entamoeba dispar
IECDKGMVTMDHITCVKN

SEQ ID NO: 2383871 - protein, 17 aa, Entamoeba dispar
IECDVNSPMVLQNPKCD

SEQ ID NO: 2383872 - protein, 18 aa, Entamoeba dispar
IECENGICQECMNNFDLS

SEQ ID NO: 2383873 - protein, 17 aa, Entamoeba dispar
IECKTYDKFSFKSNYLD

SEQ ID NO: 2383874 - protein, 20 aa, Entamoeba dispar
IECNEGYKLMNGVCTAVTPE

SEQ ID NO: 2383875 - protein, 39 aa, Entamoeba dispar
IECNGIELKKIFSILNKFKWNKIKIIIKCFDLREEHITW

SEQ ID NO: 2383876 - protein, 25 aa, Entamoeba dispar
IEDIIIDIVYSFKLFNTIRYNLDSS

SEQ ID NO: 2383877 - protein, 18 aa, Entamoeba dispar
IEDTEWIIGVTVYIGNET

SEQ ID NO: 2383878 - protein, 28 aa, Entamoeba dispar
IEDYKGFSWIRIVLKSGSKTPTLNIYDS

SEQ ID NO: 2383879 - protein, 21 aa, Entamoeba dispar
IEEIAGFFLDYLKEMKPKLFN

SEQ ID NO: 2383880 - protein, 19 aa, Entamoeba dispar
IEEYDFFKKWHSINLETLE

SEQ ID NO: 2383881 - protein, 22 aa, Entamoeba dispar
IEEYKYPLTYGSVVFIASIPKH

SEQ ID NO: 2383882 - protein, 17 aa, Entamoeba dispar
IEFGKCYYTGTRSSDYY

SEQ ID NO: 2383883 - protein, 24 aa, Entamoeba dispar
IEFIPDLFNIPDFVDLTSKQVQSI

SEQ ID NO: 2383884 - protein, 24 aa, Entamoeba dispar
IEGCKRMRGRLLASYIKASGQVIS

SEQ ID NO: 2383885 - protein, 21 aa, Entamoeba dispar
IEGCSSCIFNSISNIKCASCY

SEQ ID NO: 2383886 - protein, 24 aa, Entamoeba dispar
IEGEGKIETIFGCENWKKNMIKGI

SEQ ID NO: 2383887 - protein, 24 aa, Entamoeba dispar
IEGLPLYCDYDLFLERIRKTQKIE

SEQ ID NO: 2383888 - protein, 24 aa, Entamoeba dispar
IEGSEFKMGMTFNQIITSTTFDPS

SEQ ID NO: 2383889 - protein, 18 aa, Entamoeba dispar
IEGVCSKGVSISIIKVVM

SEQ ID NO: 2383890 - protein, 28 aa, Entamoeba dispar
IEGYFYLFPAFCLPWFVKQKKNIPMLNE

SEQ ID NO: 2383891 - protein, 18 aa, Entamoeba dispar
IEGYSPRGFLKCSKDPDI

SEQ ID NO: 2383892 - protein, 24 aa, Entamoeba dispar
IEHLPKWTKMILGIVLAIIAGIMY

SEQ ID NO: 2383893 - protein, 27 aa, Entamoeba dispar
IEHMLNELLGLYNHITFLVSTQEEMVR

SEQ ID NO: 2383894 - protein, 19 aa, Entamoeba dispar
IEHSLSIIAYYCVHLLTLL

SEQ ID NO: 2383895 - protein, 20 aa, Entamoeba dispar
IEIDVSYVFQHRSLHSQEPQ

SEQ ID NO: 2383896 - protein, 25 aa, Entamoeba dispar
IEIGGSMHPFKFILPKNIKKITIIG

SEQ ID NO: 2383897 - protein, 21 aa, Entamoeba dispar
IEIGLRSGVLMSEEDKDIIYS

SEQ ID NO: 2383898 - protein, 28 aa, Entamoeba dispar
IEIIHLLQWPYWSSIKCLEMKNKIEKKN

SEQ ID NO: 2383899 - protein, 23 aa, Entamoeba dispar
IEIINIYGSLLFDDSTTVLSQSQ

SEQ ID NO: 2383900 - protein, 20 aa, Entamoeba dispar
IEIISRILFVCIKQDINIAM

SEQ ID NO: 2383901 - protein, 25 aa, Entamoeba dispar
IEIISRRLLLMIFERIKFDELFFEC

SEQ ID NO: 2383902 - protein, 24 aa, Entamoeba dispar
IEIKEINYFLSLKTHEEYEIPNEK

SEQ ID NO: 2383903 - protein, 20 aa, Entamoeba dispar
IEIKSKYGIILYYKDNFNIL

SEQ ID NO: 2383904 - protein, 20 aa, Entamoeba dispar
IEILKKAGIVVSMLTGDMKE

SEQ ID NO: 2383905 - protein, 17 aa, Entamoeba dispar
IEIYQHCLFKYDCEEEI

SEQ ID NO: 2383906 - protein, 18 aa, Entamoeba dispar
IEKEYAYIVTVLITLCVA

SEQ ID NO: 2383907 - protein, 23 aa, Entamoeba dispar
IEKIFSPSYFEWYDVCLSASEDN

SEQ ID NO: 2383908 - protein, 19 aa, Entamoeba dispar
IEKIIKIGCIKRTHYQFTI

SEQ ID NO: 2383909 - protein, 23 aa, Entamoeba dispar
IEKTPLGHCFLSINCDSKCSVCS

SEQ ID NO: 2383910 - protein, 23 aa, Entamoeba dispar
IEKYKKFKIFSSFTEEFGEIQWH

SEQ ID NO: 2383911 - protein, 24 aa, Entamoeba dispar
IEKYLKLILNLIHLLLIVEYVSPQ

SEQ ID NO: 2383912 - protein, 20 aa, Entamoeba dispar
IEKYLPLALFIAGFFIPVCW

SEQ ID NO: 2383913 - protein, 18 aa, Entamoeba dispar
IELAKICPVSIICYEETQ

SEQ ID NO: 2383914 - protein, 21 aa, Entamoeba dispar
IELCRRRGEKSGEIITATAPW

SEQ ID NO: 2383915 - protein, 17 aa, Entamoeba dispar
IELIPSVSFETFKHTVS

SEQ ID NO: 2383916 - protein, 26 aa, Entamoeba dispar
IELIQRRGRPYFLSFENEKIYSMAMQ

SEQ ID NO: 2383917 - protein, 18 aa, Entamoeba dispar
IELLGKWAKEDFASKKRF

SEQ ID NO: 2383918 - protein, 17 aa, Entamoeba dispar
IELLKYHKINGYFNTPI

SEQ ID NO: 2383919 - protein, 17 aa, Entamoeba dispar
IELLSVFFRGLEQTHLS

SEQ ID NO: 2383920 - protein, 24 aa, Entamoeba dispar
IELNVWKNTISFRLDENYIDNRLV

SEQ ID NO: 2383921 - protein, 23 aa, Entamoeba dispar
IELPLCYILRYLPSNPRLKHFVY

SEQ ID NO: 2383922 - protein, 17 aa, Entamoeba dispar
IELRYLQKKGRFNGLQL

SEQ ID NO: 2383923 - protein, 23 aa, Entamoeba dispar
IELSCVIEALMLRIEANKKELKL

SEQ ID NO: 2383924 - protein, 17 aa, Entamoeba dispar
IELTISFIARCTTVLNE

SEQ ID NO: 2383925 - protein, 25 aa, Entamoeba dispar
IELVKCYKHLINILVSTFCHTSIVW

SEQ ID NO: 2383926 - protein, 17 aa, Entamoeba dispar
IELWNMTIAEYKAVVEI

SEQ ID NO: 2383927 - protein, 19 aa, Entamoeba dispar
IELYDRLIVQIALSCPDVF

SEQ ID NO: 2383928 - protein, 19 aa, Entamoeba dispar
IELYIKYHRPLLIHMKDSL

SEQ ID NO: 2383929 - protein, 23 aa, Entamoeba dispar
IEMLQIICVCYSFGDEYLKEIGN

SEQ ID NO: 2383930 - protein, 23 aa, Entamoeba dispar
IEMMACGGIAAFVGIISILVVFI

SEQ ID NO: 2383931 - protein, 17 aa, Entamoeba dispar
IENAFEFLKPMVDMLLT

SEQ ID NO: 2383932 - protein, 23 aa, Entamoeba dispar
IENCIYDYLRIMRYMTLSTRSSS

SEQ ID NO: 2383933 - protein, 19 aa, Entamoeba dispar
IENILRYYIKINNGLINLF

SEQ ID NO: 2383934 - protein, 17 aa, Entamoeba dispar
IENIWKRHQQVMAKCKI

SEQ ID NO: 2383935 - protein, 25 aa, Entamoeba dispar
IENLLRFIVHLYFPITKKYMNDILF

SEQ ID NO: 2383936 - protein, 18 aa, Entamoeba dispar
IENSITIAYALRGKSFKL

SEQ ID NO: 2383937 - protein, 18 aa, Entamoeba dispar
IEPIKYIRCQNLISLCRL

SEQ ID NO: 2383938 - protein, 18 aa, Entamoeba dispar
IEPLKGCLDKILNLTGKS

SEQ ID NO: 2383939 - protein, 27 aa, Entamoeba dispar
IEPLQRRLLVVILMNLVLISMLIYLLL

SEQ ID NO: 2383940 - protein, 18 aa, Entamoeba dispar
IEPTCIGYISKVLVKITE

SEQ ID NO: 2383941 - protein, 24 aa, Entamoeba dispar
IEQKKIFISFLFDGIRSQSISQFS

SEQ ID NO: 2383942 - protein, 29 aa, Entamoeba dispar
IEQYPLKWLDWLLILVAVLVHFVICETVK

SEQ ID NO: 2383943 - protein, 19 aa, Entamoeba dispar
IERICVVRESVKAADLLII

SEQ ID NO: 2383944 - protein, 23 aa, Entamoeba dispar
IERIDPELGMGHCLLLHFNNDYL

SEQ ID NO: 2383945 - protein, 28 aa, Entamoeba dispar
IERIKKVMKIFIHFIIKYMEENIKNKEI

SEQ ID NO: 2383946 - protein, 20 aa, Entamoeba dispar
IERIRLILPEVQFITKHKLH

SEQ ID NO: 2383947 - protein, 29 aa, Entamoeba dispar
IERRARKVVFCAAHSLPITYRILDSFFED

SEQ ID NO: 2383948 - protein, 18 aa, Entamoeba dispar
IERRKLQLTHCSRYVDPI

SEQ ID NO: 2383949 - protein, 23 aa, Entamoeba dispar
IESDLEFGGFILFSSPIKKESNE

SEQ ID NO: 2383950 - protein, 21 aa, Entamoeba dispar
IESIPFTKMVALPFEIENYCS

SEQ ID NO: 2383951 - protein, 20 aa, Entamoeba dispar
IESKFPINIYQIIDGEDKRM

SEQ ID NO: 2383952 - protein, 22 aa, Entamoeba dispar
IESKQLFEFLHLMICNNLTEQE

SEQ ID NO: 2383953 - protein, 33 aa, Entamoeba dispar
IESNEFLMILLLRLSPLFPFPISNYVLGPFCSF

SEQ ID NO: 2383954 - protein, 17 aa, Entamoeba dispar
IESYIGAISLDGVNENE

SEQ ID NO: 2383955 - protein, 20 aa, Entamoeba dispar
IESYSKFEGIVFSLQKVKVV

SEQ ID NO: 2383956 - protein, 19 aa, Entamoeba dispar
IETNIPKGDFEQHNLFFDG

SEQ ID NO: 2383957 - protein, 19 aa, Entamoeba dispar
IETSYCYKKMSLLSFDYYF

SEQ ID NO: 2383958 - protein, 17 aa, Entamoeba dispar
IETVFVFESKRYILFFI

SEQ ID NO: 2383959 - protein, 30 aa, Entamoeba dispar
IEVFKYSCAKFIDFWGLFICCVVIAIAALY

SEQ ID NO: 2383960 - protein, 20 aa, Entamoeba dispar
IEVGRILTLTSLNFKVLSCV

SEQ ID NO: 2383961 - protein, 20 aa, Entamoeba dispar
IEVIQFFTIEALNIIDYYPV

SEQ ID NO: 2383962 - protein, 18 aa, Entamoeba dispar
IEVNKEIRELICIGNEKK

SEQ ID NO: 2383963 - protein, 24 aa, Entamoeba dispar
IEVNKEIRELICIGNEKKEKKKIQ

SEQ ID NO: 2383964 - protein, 23 aa, Entamoeba dispar
IEVNKEIRELICIGNENKEKKKI

SEQ ID NO: 2383965 - protein, 24 aa, Entamoeba dispar
IEWYHLECVPAQFKTIKLSSTKGW

SEQ ID NO: 2383966 - protein, 17 aa, Entamoeba dispar
IEYILPNGIELVIEKGL

SEQ ID NO: 2383967 - protein, 23 aa, Entamoeba dispar
IEYLAIAVLCFIQSMRIVKNHHK

SEQ ID NO: 2383968 - protein, 23 aa, Entamoeba dispar
IEYLKQNFIPFGMFLFSSNPIRK

SEQ ID NO: 2383969 - protein, 22 aa, Entamoeba dispar
IEYLVKWGLTVCVIILVVLIRH

SEQ ID NO: 2383970 - protein, 20 aa, Entamoeba dispar
IFAAFLIPFLAVGFVGNSNM

SEQ ID NO: 2383971 - protein, 17 aa, Entamoeba dispar
IFASLVFFLCQRRTDNN

SEQ ID NO: 2383972 - protein, 17 aa, Entamoeba dispar
IFATLTIVLLPSCYILI

SEQ ID NO: 2383973 - protein, 18 aa, Entamoeba dispar
IFCVIKSGYETYLSKLLE

SEQ ID NO: 2383974 - protein, 18 aa, Entamoeba dispar
IFEDVCKGLEFLYQNKQI

SEQ ID NO: 2383975 - protein, 18 aa, Entamoeba dispar
IFEFCYPEAVVGKQKERL

SEQ ID NO: 2383976 - protein, 18 aa, Entamoeba dispar
IFESIRCKDVFTNLTSKS

SEQ ID NO: 2383977 - protein, 19 aa, Entamoeba dispar
IFFDIFKHFITVHFKDPSV

SEQ ID NO: 2383978 - protein, 19 aa, Entamoeba dispar
IFFICSWYYQPGYYVPYLF

SEQ ID NO: 2383979 - protein, 17 aa, Entamoeba dispar
IFFKGTYLMDFDELMEQ

SEQ ID NO: 2383980 - protein, 19 aa, Entamoeba dispar
IFFLILFIGFIVCLIITTV

SEQ ID NO: 2383981 - protein, 21 aa, Entamoeba dispar
IFGASHGLFFLPILLSLIPSV

SEQ ID NO: 2383982 - protein, 18 aa, Entamoeba dispar
IFGCLKCVEGYYAKNGDC

SEQ ID NO: 2383983 - protein, 18 aa, Entamoeba dispar
IFGILFLVFHILEFSYVA

SEQ ID NO: 2383984 - protein, 18 aa, Entamoeba dispar
IFGLRVSPLPKRENTNPL

SEQ ID NO: 2383985 - protein, 26 aa, Entamoeba dispar
IFHHETLRLLQYPVINAILAGHNALV

SEQ ID NO: 2383986 - protein, 21 aa, Entamoeba dispar
IFICEIIALILYLKRKKILVL

SEQ ID NO: 2383987 - protein, 17 aa, Entamoeba dispar
IFIEGEKSINVIVINSF

SEQ ID NO: 2383988 - protein, 18 aa, Entamoeba dispar
IFIINICLFSIIHILVTI

SEQ ID NO: 2383989 - protein, 23 aa, Entamoeba dispar
IFIKFIPFINAYLFPLTTDIETL

SEQ ID NO: 2383990 - protein, 24 aa, Entamoeba dispar
IFIKSCLKSILAINRYTVCNWLIL

SEQ ID NO: 2383991 - protein, 35 aa, Entamoeba dispar
IFILPKLPGIWFYCWGITCTLWFSTFQNKNELKYT

SEQ ID NO: 2383992 - protein, 26 aa, Entamoeba dispar
IFIMLRASIYLTICTDIFVIRSFTSF

SEQ ID NO: 2383993 - protein, 19 aa, Entamoeba dispar
IFINIKFIPNIIFISSTPF

SEQ ID NO: 2383994 - protein, 27 aa, Entamoeba dispar
IFINNFLIDVCIEMGYLFKSKYSRKSR

SEQ ID NO: 2383995 - protein, 17 aa, Entamoeba dispar
IFIPLLQCMNWMCIFRK

SEQ ID NO: 2383996 - protein, 18 aa, Entamoeba dispar
IFISSVSLKELWVSSKVE

SEQ ID NO: 2383997 - protein, 21 aa, Entamoeba dispar
IFITCILWIFVIINNSEVKEL

SEQ ID NO: 2383998 - protein, 17 aa, Entamoeba dispar
IFITFFALFLFTKKETF

SEQ ID NO: 2383999 - protein, 23 aa, Entamoeba dispar
IFITFRYGKLHAVLMDMNQQEHS

SEQ ID NO: 2384000 - protein, 25 aa, Entamoeba dispar
IFKESLRVALPVLEMRCSRCNSVIG

SEQ ID NO: 2384001 - protein, 25 aa, Entamoeba dispar
IFKQYGYKVGISFMESYRYKYSYDE

SEQ ID NO: 2384002 - protein, 18 aa, Entamoeba dispar
IFKSCPLLSPSTETKSTC

SEQ ID NO: 2384003 - protein, 20 aa, Entamoeba dispar
  misc_feature (15)..(16): Xaa can be any naturally occurring amino acid
IFLFHLIVSVSFLFXXSSFF

SEQ ID NO: 2384004 - protein, 23 aa, Entamoeba dispar
IFLINPTRFCTMYSSPYFSQVFK

SEQ ID NO: 2384005 - protein, 22 aa, Entamoeba dispar
IFLKEFTNIFTPKIIQSIQIEQ

SEQ ID NO: 2384006 - protein, 17 aa, Entamoeba dispar
IFLKYYTFKIFVVSFFH

SEQ ID NO: 2384007 - protein, 17 aa, Entamoeba dispar
IFLPCIIFNAGFTMKKR

SEQ ID NO: 2384008 - protein, 22 aa, Entamoeba dispar
IFLPGLGIYIFFVLVLSIINAI

SEQ ID NO: 2384009 - protein, 26 aa, Entamoeba dispar
IFLRFRYSHELEIWYTFSQKLIKIPF

SEQ ID NO: 2384010 - protein, 17 aa, Entamoeba dispar
IFLVLSLLSLSSSSYVK

SEQ ID NO: 2384011 - protein, 23 aa, Entamoeba dispar
IFLVVCATVAFGMGIDKPDVRFV

SEQ ID NO: 2384012 - protein, 23 aa, Entamoeba dispar
IFMKLTNCLLWYFEKILYQKDTT

SEQ ID NO: 2384013 - protein, 18 aa, Entamoeba dispar
IFMLETSDNFFVYFSYVM

SEQ ID NO: 2384014 - protein, 25 aa, Entamoeba dispar
IFMMSCIVTIPWIIFYFIIEKQYEY

SEQ ID NO: 2384015 - protein, 22 aa, Entamoeba dispar
IFNCSLTDLFNFYIKAKRITNI

SEQ ID NO: 2384016 - protein, 18 aa, Entamoeba dispar
IFNECFKCSTHCKKCKNI

SEQ ID NO: 2384017 - protein, 25 aa, Entamoeba dispar
IFNIITRWYIIISIGLIAFSMTFLM

SEQ ID NO: 2384018 - protein, 18 aa, Entamoeba dispar
IFNKSCNEIIKFFESFGW

SEQ ID NO: 2384019 - protein, 18 aa, Entamoeba dispar
IFNLIPFSLIYDVINIVL

SEQ ID NO: 2384020 - protein, 18 aa, Entamoeba dispar
IFNREIKSFLTIDYSHPS

SEQ ID NO: 2384021 - protein, 17 aa, Entamoeba dispar
IFNSISNIKCASCYAPY

SEQ ID NO: 2384022 - protein, 18 aa, Entamoeba dispar
IFNSLDLFKERRANKLIV

SEQ ID NO: 2384023 - protein, 20 aa, Entamoeba dispar
IFNTSIYPLFSIFNVSGMTT

SEQ ID NO: 2384024 - protein, 17 aa, Entamoeba dispar
IFNWELLSIGAILQYCQ

SEQ ID NO: 2384025 - protein, 26 aa, Entamoeba dispar
IFPHKYCWREGDDLYINIKGCDFFTH

SEQ ID NO: 2384026 - protein, 25 aa, Entamoeba dispar
IFQFKDVWKHICIVWTKCYNYTPES

SEQ ID NO: 2384027 - protein, 21 aa, Entamoeba dispar
IFQGLKYIIGDSMEKKLFDKR

SEQ ID NO: 2384028 - protein, 24 aa, Entamoeba dispar
IFQIMYKLIFGHPLLFKTKKIWGF

SEQ ID NO: 2384029 - protein, 25 aa, Entamoeba dispar
IFQLCGGLISLLVFWFVKDKTIKKL

SEQ ID NO: 2384030 - protein, 18 aa, Entamoeba dispar
IFQLRIFLESGQFPISSN

SEQ ID NO: 2384031 - protein, 19 aa, Entamoeba dispar
IFQNLPHIWASYYDTHIVP

SEQ ID NO: 2384032 - protein, 18 aa, Entamoeba dispar
IFQQMILHFTAAGISAPS

SEQ ID NO: 2384033 - protein, 18 aa, Entamoeba dispar
IFREILWAVSNFAGDELV

SEQ ID NO: 2384034 - protein, 27 aa, Entamoeba dispar
IFRLFTPKVCFDISFCIATDVMIGIGY

SEQ ID NO: 2384035 - protein, 20 aa, Entamoeba dispar
IFSFSILMYETFKWDRPYPE

SEQ ID NO: 2384036 - protein, 25 aa, Entamoeba dispar
IFSFSIVLYEIWKWDKAYPTEEFKF

SEQ ID NO: 2384037 - protein, 19 aa, Entamoeba dispar
IFSIAIYFISFFVLKSYFD

SEQ ID NO: 2384038 - protein, 31 aa, Entamoeba dispar
IFSLPEFPFMWGYCWFTTILSYLSLWNTRNE

SEQ ID NO: 2384039 - protein, 23 aa, Entamoeba dispar
IFSNCKIGSILGNGEFVSSRKVD

SEQ ID NO: 2384040 - protein, 23 aa, Entamoeba dispar
IFSSLCLIGIIPFLFIKMNVLPE

SEQ ID NO: 2384041 - protein, 35 aa, Entamoeba dispar
IFSVSPFPGIGVIQWITCLVLSSLSLVIGQFAIRY

SEQ ID NO: 2384042 - protein, 31 aa, Entamoeba dispar
IFTARADILPFNWISELPLNMKNLEIPTDYL

SEQ ID NO: 2384043 - protein, 17 aa, Entamoeba dispar
IFTDFSLNSPKENLPIL

SEQ ID NO: 2384044 - protein, 34 aa, Entamoeba dispar
IFTEIGSLCLMVFCYYYIKPFRKVIKIEPTSLVV

SEQ ID NO: 2384045 - protein, 23 aa, Entamoeba dispar
IFTQCVLVVFIAPIAIYMQLTNK

SEQ ID NO: 2384046 - protein, 26 aa, Entamoeba dispar
IFTRYEIFGILACSFFGIERSKIYHS

SEQ ID NO: 2384047 - protein, 24 aa, Entamoeba dispar
IFTSIKANTPWPSKVNFLNTLSSL

SEQ ID NO: 2384048 - protein, 22 aa, Entamoeba dispar
IFTSNIFYDFGILYGPTGLFWS

SEQ ID NO: 2384049 - protein, 18 aa, Entamoeba dispar
IFVFPIKVIMVIDTLLFL

SEQ ID NO: 2384050 - protein, 18 aa, Entamoeba dispar
IFVGFAIWAMITLAILIG

SEQ ID NO: 2384051 - protein, 18 aa, Entamoeba dispar
IFYFCLTWSYFNRAIYLT

SEQ ID NO: 2384052 - protein, 19 aa, Entamoeba dispar
IFYFPHLINLLFKEMSQSE

SEQ ID NO: 2384053 - protein, 27 aa, Entamoeba dispar
IFYKHYIICHTLRLRFYLNSININTIK

SEQ ID NO: 2384054 - protein, 18 aa, Entamoeba dispar
IFYLLRRVYFPEEQQKFA

SEQ ID NO: 2384055 - protein, 18 aa, Entamoeba dispar
IFYVLGLLLQFVMILIDR

SEQ ID NO: 2384056 - protein, 25 aa, Entamoeba dispar
IFYYFALLFAFFFPSFTVHYINESL

SEQ ID NO: 2384057 - protein, 25 aa, Entamoeba dispar
IFYYYKYYFKLLFPVINAFLIHINV

SEQ ID NO: 2384058 - protein, 22 aa, Entamoeba dispar
IGACVYLFIYIIGYIICLIMYL

SEQ ID NO: 2384059 - protein, 36 aa, Entamoeba dispar
IGAICLALIYLRNGWVLCVLAIPIGIISGYDLQSNV

SEQ ID NO: 2384060 - protein, 27 aa, Entamoeba dispar
IGAISTILFRLLRTWLSKTNNNSKNTE

SEQ ID NO: 2384061 - protein, 26 aa, Entamoeba dispar
IGASIPCFIAKYFLQNTIKSYLDDHS

SEQ ID NO: 2384062 - protein, 22 aa, Entamoeba dispar
IGAVGISELFSFIFEKYASPEK

SEQ ID NO: 2384063 - protein, 23 aa, Entamoeba dispar
IGCAIDYLSICVRLFTSSSVSIN

SEQ ID NO: 2384064 - protein, 19 aa, Entamoeba dispar
IGDVGGLLVRGSDDYSSNY

SEQ ID NO: 2384065 - protein, 18 aa, Entamoeba dispar
IGEGERWYDIELRKKESL

SEQ ID NO: 2384066 - protein, 25 aa, Entamoeba dispar
IGEKLRIVISVIFFLISCFFDIPRI

SEQ ID NO: 2384067 - protein, 21 aa, Entamoeba dispar
IGFFICSVIALIQGKKATIPP

SEQ ID NO: 2384068 - protein, 23 aa, Entamoeba dispar
IGFFIVGLIFQLLAETSMFVDAI

SEQ ID NO: 2384069 - protein, 19 aa, Entamoeba dispar
IGFIKSWDLALVVLATVLL

SEQ ID NO: 2384070 - protein, 19 aa, Entamoeba dispar
IGFIKSWDLALVVLATVPL

SEQ ID NO: 2384071 - protein, 24 aa, Entamoeba dispar
IGFSELRPIIILKPVSIDENKISV

SEQ ID NO: 2384072 - protein, 23 aa, Entamoeba dispar
IGGAVRFKSPIIEFDRTMVNAPD

SEQ ID NO: 2384073 - protein, 26 aa, Entamoeba dispar
IGGCVLSSLIIGFGIYGYTFIDTKVI

SEQ ID NO: 2384074 - protein, 17 aa, Entamoeba dispar
IGGCVLSSLIIGFGVYG

SEQ ID NO: 2384075 - protein, 27 aa, Entamoeba dispar
IGGGTFGIVYRAEWRGVDVAVKVMKTD

SEQ ID NO: 2384076 - protein, 20 aa, Entamoeba dispar
IGHVSFKHSITFETTPSLNQ

SEQ ID NO: 2384077 - protein, 17 aa, Entamoeba dispar
IGIAFLVLFIGTFIAHF

SEQ ID NO: 2384078 - protein, 25 aa, Entamoeba dispar
IGIDVPRLATKIIIKKSNKIILSGA

SEQ ID NO: 2384079 - protein, 17 aa, Entamoeba dispar
IGIKGHRSVGGFRASIY

SEQ ID NO: 2384080 - protein, 19 aa, Entamoeba dispar
IGILLAWIFRVNKIEKDDI

SEQ ID NO: 2384081 - protein, 17 aa, Entamoeba dispar
IGILLTLTGLLHFVNNK

SEQ ID NO: 2384082 - protein, 27 aa, Entamoeba dispar
IGILSLTICICFSWRGYNDIIESNMAI

SEQ ID NO: 2384083 - protein, 26 aa, Entamoeba dispar
IGINCCYWSLIICEIIEIKRDETIKR

SEQ ID NO: 2384084 - protein, 29 aa, Entamoeba dispar
IGIPNKLGYRLIQIAIRYEDYVLRGTDKT

SEQ ID NO: 2384085 - protein, 19 aa, Entamoeba dispar
IGISPDWKTNIEGIDIDKS

SEQ ID NO: 2384086 - protein, 18 aa, Entamoeba dispar
IGISYNLRIGNYVCKQLP

SEQ ID NO: 2384087 - protein, 19 aa, Entamoeba dispar
IGITLICIIAFSSRLYSII

SEQ ID NO: 2384088 - protein, 18 aa, Entamoeba dispar
IGIYSIVVLVIWIIGQFY

SEQ ID NO: 2384089 - protein, 23 aa, Entamoeba dispar
IGKEVHAALTIECESCNSIQLDY

SEQ ID NO: 2384090 - protein, 23 aa, Entamoeba dispar
IGKKFGFTLLMIFIFLFVLVLIP

SEQ ID NO: 2384091 - protein, 18 aa, Entamoeba dispar
IGKMGMFCAAVVFIVLTL

SEQ ID NO: 2384092 - protein, 23 aa, Entamoeba dispar
IGLGVMCAFSFGVYFAITYGSFV

SEQ ID NO: 2384093 - protein, 26 aa, Entamoeba dispar
IGLICVTCLFLIGSFVTFSFGVPRHT

SEQ ID NO: 2384094 - protein, 17 aa, Entamoeba dispar
IGLIGKIMCSLCGIESL

SEQ ID NO: 2384095 - protein, 26 aa, Entamoeba dispar
IGLILGRLFFPLLFTKGSDFVITLLL

SEQ ID NO: 2384096 - protein, 25 aa, Entamoeba dispar
IGLILLIFLLCWPETLVYWERNKCF

SEQ ID NO: 2384097 - protein, 17 aa, Entamoeba dispar
IGLISFIIFKFIIKNGI

SEQ ID NO: 2384098 - protein, 19 aa, Entamoeba dispar
IGLLTWKITYKNNLFTFQL

SEQ ID NO: 2384099 - protein, 17 aa, Entamoeba dispar
IGLMLFILLTYCHYKVI

SEQ ID NO: 2384100 - protein, 21 aa, Entamoeba dispar
IGLNGWEVIELCNYLRILHDV

SEQ ID NO: 2384101 - protein, 17 aa, Entamoeba dispar
IGLNSVQAGVQFCYSTI

SEQ ID NO: 2384102 - protein, 32 aa, Entamoeba dispar
IGLRSAMVTMMICANSCFFLPFGYQTNLMVMK

SEQ ID NO: 2384103 - protein, 24 aa, Entamoeba dispar
IGLTRYAFCFSKLRIQRDETNPLV

SEQ ID NO: 2384104 - protein, 18 aa, Entamoeba dispar
IGLYWCVPVITFPIIIGL

SEQ ID NO: 2384105 - protein, 19 aa, Entamoeba dispar
IGMKERFECSAVFTDKYTS

SEQ ID NO: 2384106 - protein, 17 aa, Entamoeba dispar
IGNLIIIILSFNIEISS

SEQ ID NO: 2384107 - protein, 20 aa, Entamoeba dispar
IGNLTLWDPSLIKIYGKSVK

SEQ ID NO: 2384108 - protein, 22 aa, Entamoeba dispar
IGNTKFKIGIIGDIIGYENNAK

SEQ ID NO: 2384109 - protein, 45 aa, Entamoeba dispar
IGPKRIKERRTLWMLWAFWWFVYALVCVMTFGALKYFGANDDFLG

SEQ ID NO: 2384110 - protein, 19 aa, Entamoeba dispar
IGPTMSFIMFLTMVLTEQE

SEQ ID NO: 2384111 - protein, 25 aa, Entamoeba dispar
IGQCSPEIIMIILGIIFNTSYSIAV

SEQ ID NO: 2384112 - protein, 19 aa, Entamoeba dispar
IGRCQKCAPGYYRSSERIC

SEQ ID NO: 2384113 - protein, 23 aa, Entamoeba dispar
IGRNTEYYDWFLINIVLHPQNVY

SEQ ID NO: 2384114 - protein, 24 aa, Entamoeba dispar
IGRRKELGEAIAHELNNKHFGQID

SEQ ID NO: 2384115 - protein, 24 aa, Entamoeba dispar
IGSCAIGLFVSYFSAFIFNKMKGI

SEQ ID NO: 2384116 - protein, 20 aa, Entamoeba dispar
IGSCSDWFNSRWGKRRPFLL

SEQ ID NO: 2384117 - protein, 20 aa, Entamoeba dispar
IGSFVTFSFGVPRHTYNKVT

SEQ ID NO: 2384118 - protein, 24 aa, Entamoeba dispar
IGSHFMCSLNFNCINYKMLQDFKI

SEQ ID NO: 2384119 - protein, 25 aa, Entamoeba dispar
IGSMICCFDALLKCNAEYFFDTTGY

SEQ ID NO: 2384120 - protein, 19 aa, Entamoeba dispar
IGSPWCYFVAIYEAILFIL

SEQ ID NO: 2384121 - protein, 17 aa, Entamoeba dispar
IGSYIVVILLFFFTHIF

SEQ ID NO: 2384122 - protein, 17 aa, Entamoeba dispar
IGTELEVIYKKTSDKSK

SEQ ID NO: 2384123 - protein, 17 aa, Entamoeba dispar
IGTKLGDVSLFYYLPNL

SEQ ID NO: 2384124 - protein, 18 aa, Entamoeba dispar
IGTKSHWFFIDFYSFIDP

SEQ ID NO: 2384125 - protein, 19 aa, Entamoeba dispar
IGTNSIVVWNGHVSFQNSI

SEQ ID NO: 2384126 - protein, 17 aa, Entamoeba dispar
IGVEVGDLDVFLVFMNN

SEQ ID NO: 2384127 - protein, 22 aa, Entamoeba dispar
IGVIISLIICYFINKTSYRFGF

SEQ ID NO: 2384128 - protein, 20 aa, Entamoeba dispar
IGVLFEFISITLLITSELIC

SEQ ID NO: 2384129 - protein, 20 aa, Entamoeba dispar
IGVLVLWLALLITFSLTSKI

SEQ ID NO: 2384130 - protein, 23 aa, Entamoeba dispar
IGVNNIHWVPGCEPICDSCAIGY

SEQ ID NO: 2384131 - protein, 17 aa, Entamoeba dispar
IGVVIGLIFGYSLSLIV

SEQ ID NO: 2384132 - protein, 25 aa, Entamoeba dispar
IGWADIPLIIGLKFLPSFLIILMMN

SEQ ID NO: 2384133 - protein, 22 aa, Entamoeba dispar
IGYKNGDKWISVPWKLTELKQN

SEQ ID NO: 2384134 - protein, 24 aa, Entamoeba dispar
IGYTAYCPTKFAIKGLLDSLRFEF

SEQ ID NO: 2384135 - protein, 22 aa, Entamoeba dispar
IHCKQEKGDVLVFLPGSEEIEK

SEQ ID NO: 2384136 - protein, 21 aa, Entamoeba dispar
IHCPCYGLNCITKFSKEDTII

SEQ ID NO: 2384137 - protein, 22 aa, Entamoeba dispar
IHFFLGVFLCFFALKTNSLLVL

SEQ ID NO: 2384138 - protein, 17 aa, Entamoeba dispar
IHGGHPCIEGRWYTLSC

SEQ ID NO: 2384139 - protein, 24 aa, Entamoeba dispar
IHICSCIAAQLAHLPFFHFIRENK

SEQ ID NO: 2384140 - protein, 18 aa, Entamoeba dispar
IHIMCHSLGSKFFMQSYL

SEQ ID NO: 2384141 - protein, 23 aa, Entamoeba dispar
IHISFTISLILGYGGIIISSIYF

SEQ ID NO: 2384142 - protein, 17 aa, Entamoeba dispar
IHIVITFIIRGISQSSS

SEQ ID NO: 2384143 - protein, 17 aa, Entamoeba dispar
IHKCSKCGGKGVVKENL

SEQ ID NO: 2384144 - protein, 19 aa, Entamoeba dispar
IHLIYLFIQHEVYKVYSLV

SEQ ID NO: 2384145 - protein, 18 aa, Entamoeba dispar
IHLKIQFFNEIFQRYPNT

SEQ ID NO: 2384146 - protein, 19 aa, Entamoeba dispar
IHLKKEWNKKEIINEGVLF

SEQ ID NO: 2384147 - protein, 22 aa, Entamoeba dispar
IHLLKACISYSFNTDNNKNFRQ

SEQ ID NO: 2384148 - protein, 25 aa, Entamoeba dispar
IHLRYHKARINDMFEKNVIFPPPEV

SEQ ID NO: 2384149 - protein, 19 aa, Entamoeba dispar
IHLVTLILIESCVIVSSDK

SEQ ID NO: 2384150 - protein, 17 aa, Entamoeba dispar
IHLYKILHTGMVYNLSF

SEQ ID NO: 2384151 - protein, 26 aa, Entamoeba dispar
IHNFLFDLALEFGFFFDSKLSRKSSK

SEQ ID NO: 2384152 - protein, 24 aa, Entamoeba dispar
IHNPNLVNFCMLRVNKTDITQQKE

SEQ ID NO: 2384153 - protein, 17 aa, Entamoeba dispar
IHNRYKLCLNIFAFETC

SEQ ID NO: 2384154 - protein, 21 aa, Entamoeba dispar
IHPKLFPTPLILPTAPNSMLR

SEQ ID NO: 2384155 - protein, 21 aa, Entamoeba dispar
IHPLFRLTSIQTFAILLKKIT

SEQ ID NO: 2384156 - protein, 17 aa, Entamoeba dispar
IHQSLLFFDKDTIKFND

SEQ ID NO: 2384157 - protein, 25 aa, Entamoeba dispar
IHQTLRFSSCWELFNPFAKQVPCDP

SEQ ID NO: 2384158 - protein, 24 aa, Entamoeba dispar
IHSEDIPIGWGLKENVYKEIMDKD

SEQ ID NO: 2384159 - protein, 25 aa, Entamoeba dispar
IHSEFGKRCIIGLFIGGVIGIIYAM

SEQ ID NO: 2384160 - protein, 26 aa, Entamoeba dispar
IHSKCYRCQSCFKVIVGDRESIDHRC

SEQ ID NO: 2384161 - protein, 17 aa, Entamoeba dispar
IHSKVLFDYSISKNLEI

SEQ ID NO: 2384162 - protein, 23 aa, Entamoeba dispar
IHSLGSIPTIYGVSLFQPKFYST

SEQ ID NO: 2384163 - protein, 18 aa, Entamoeba dispar
IHSLIPVTVIGPRKSGKS

SEQ ID NO: 2384164 - protein, 26 aa, Entamoeba dispar
IHSMKSIRSSIYFEKGQWDYEANSLD

SEQ ID NO: 2384165 - protein, 19 aa, Entamoeba dispar
IHTLGKLLVLTRWLGRNPV

SEQ ID NO: 2384166 - protein, 20 aa, Entamoeba dispar
IIADKLLFILWVATLTTFIL

SEQ ID NO: 2384167 - protein, 18 aa, Entamoeba dispar
IIAGSLIGIFFALLTYCS

SEQ ID NO: 2384168 - protein, 19 aa, Entamoeba dispar
IIALMLRFFQVFWDCSVVT

SEQ ID NO: 2384169 - protein, 17 aa, Entamoeba dispar
IIALTGWMYLSYFPVYK

SEQ ID NO: 2384170 - protein, 23 aa, Entamoeba dispar
IIAYTVACIFMVIAFATVILIMF

SEQ ID NO: 2384171 - protein, 22 aa, Entamoeba dispar
IICISLGVIGSFILITCTILLI

SEQ ID NO: 2384172 - protein, 20 aa, Entamoeba dispar
IICPKFETIISLTSSNQASL

SEQ ID NO: 2384173 - protein, 19 aa, Entamoeba dispar
IICTSMFYGIFPSLEGFNG

SEQ ID NO: 2384174 - protein, 19 aa, Entamoeba dispar
IIDKKYCIIFNRFSTITTY

SEQ ID NO: 2384175 - protein, 21 aa, Entamoeba dispar
IIDNLPILPIQSFSEACNEIC

SEQ ID NO: 2384176 - protein, 18 aa, Entamoeba dispar
IIDTSKWESLRMVIWRVS

SEQ ID NO: 2384177 - protein, 23 aa, Entamoeba dispar
IIDYFKRMVLVKENLFEKVTGQI

SEQ ID NO: 2384178 - protein, 24 aa, Entamoeba dispar
IIECEPRIAILGPHSSITVYFTIT

SEQ ID NO: 2384179 - protein, 22 aa, Entamoeba dispar
IIEEFFKGLLICQRVEIKEEEE

SEQ ID NO: 2384180 - protein, 25 aa, Entamoeba dispar
IIEELKVHIDFRFKFLRNKDTLNIN

SEQ ID NO: 2384181 - protein, 22 aa, Entamoeba dispar
IIEESKDILSLFIQTISPSTYL

SEQ ID NO: 2384182 - protein, 30 aa, Entamoeba dispar
IIEIYGAIVCFIYFPFSQIASFLIIDNTKR

SEQ ID NO: 2384183 - protein, 26 aa, Entamoeba dispar
IIERLIRVADYCFEYHNFDTLLCVLL

SEQ ID NO: 2384184 - protein, 26 aa, Entamoeba dispar
IIFARRGQCKCCQRYFCSSCIDNRTR

SEQ ID NO: 2384185 - protein, 26 aa, Entamoeba dispar
IIFFSRTKLPLTIEILKHSTFTLLHN

SEQ ID NO: 2384186 - protein, 18 aa, Entamoeba dispar
IIFFVGGVLLKYLPSHQM

SEQ ID NO: 2384187 - protein, 23 aa, Entamoeba dispar
IIFQCGYGTHYLVDRYIIPIFNK

SEQ ID NO: 2384188 - protein, 33 aa, Entamoeba dispar
IIFSCTRCCCGPCCAARHGVCCPKDEKAYSTFD

SEQ ID NO: 2384189 - protein, 17 aa, Entamoeba dispar
IIFSILQAFSFEIISGA

SEQ ID NO: 2384190 - protein, 17 aa, Entamoeba dispar
IIGEVYNNFVLIPIASI

SEQ ID NO: 2384191 - protein, 18 aa, Entamoeba dispar
IIGFWLWAYYLSYLRYAF

SEQ ID NO: 2384192 - protein, 20 aa, Entamoeba dispar
IIGIKYYQYLGAVLEACVNS

SEQ ID NO: 2384193 - protein, 23 aa, Entamoeba dispar
IIGYYYFWWLDAVGGIILSFYIM

SEQ ID NO: 2384194 - protein, 17 aa, Entamoeba dispar
IIHEFDPYFNFRATKYL

SEQ ID NO: 2384195 - protein, 31 aa, Entamoeba dispar
IIHIRLLTYIYKRWFLIHLLEVLLYLYYLYL

SEQ ID NO: 2384196 - protein, 20 aa, Entamoeba dispar
IIHNIKFIKYNSWEESMNKR

SEQ ID NO: 2384197 - protein, 24 aa, Entamoeba dispar
IIIAVICIFILILIIALISVLYKK

SEQ ID NO: 2384198 - protein, 17 aa, Entamoeba dispar
IIICISVILTFISVIIN

SEQ ID NO: 2384199 - protein, 18 aa, Entamoeba dispar
IIIDRAYKNIQCQLDAEF

SEQ ID NO: 2384200 - protein, 21 aa, Entamoeba dispar
IIIFNTIHAVEFILGCISNTA

SEQ ID NO: 2384201 - protein, 17 aa, Entamoeba dispar
IIIGCFIVSIILILILI

SEQ ID NO: 2384202 - protein, 23 aa, Entamoeba dispar
IIIGCVLCLLWAYYKSKKEAYRQ

SEQ ID NO: 2384203 - protein, 19 aa, Entamoeba dispar
IIIGSVWIAFILMIGIFLI

SEQ ID NO: 2384204 - protein, 21 aa, Entamoeba dispar
IIIGVLVYFFIFKPKKQSTYT

SEQ ID NO: 2384205 - protein, 18 aa, Entamoeba dispar
IIIIIWILYFIRKQRSIP

SEQ ID NO: 2384206 - protein, 19 aa, Entamoeba dispar
IIIILSIIFSFSYGFEQNY

SEQ ID NO: 2384207 - protein, 23 aa, Entamoeba dispar
IIILSRTSYFWGEKYKKRNTLVL

SEQ ID NO: 2384208 - protein, 18 aa, Entamoeba dispar
IIINEHLHLFKGDIPFVV

SEQ ID NO: 2384209 - protein, 20 aa, Entamoeba dispar
IIIPSVICIILIIIIIVLLS

SEQ ID NO: 2384210 - protein, 19 aa, Entamoeba dispar
IIIVEGWQLTLSIASTIFF

SEQ ID NO: 2384211 - protein, 17 aa, Entamoeba dispar
IIIVGSLALIILGIAML

SEQ ID NO: 2384212 - protein, 17 aa, Entamoeba dispar
IIIVLCVSAIREIIEDL

SEQ ID NO: 2384213 - protein, 21 aa, Entamoeba dispar
IIIWKSDWIHLYKPAGSQISK

SEQ ID NO: 2384214 - protein, 23 aa, Entamoeba dispar
IIKGKIRGIVNIGAIHKNNEVMQ

SEQ ID NO: 2384215 - protein, 22 aa, Entamoeba dispar
IIKKSFQGRSYIIFKKIKNKLK

SEQ ID NO: 2384216 - protein, 23 aa, Entamoeba dispar
IIKKSIEINSDFQIDEIITSDIT

SEQ ID NO: 2384217 - protein, 26 aa, Entamoeba dispar
IIKNITGYCVVGFKGLKHRIYGLRSF

SEQ ID NO: 2384218 - protein, 18 aa, Entamoeba dispar
IIKNPSFSNKQCSHAADI

SEQ ID NO: 2384219 - protein, 18 aa, Entamoeba dispar
IIKSCVIIGTALIQLIVK

SEQ ID NO: 2384220 - protein, 24 aa, Entamoeba dispar
IIKSEELSQCILKSLLKMANSSET

SEQ ID NO: 2384221 - protein, 24 aa, Entamoeba dispar
IIKSEHYSPFILKLFEFKNIDIIK

SEQ ID NO: 2384222 - protein, 22 aa, Entamoeba dispar
IIKSTWLPDNRKYIHINEPIEL

SEQ ID NO: 2384223 - protein, 18 aa, Entamoeba dispar
IIKTESKVSWDVRTVISI

SEQ ID NO: 2384224 - protein, 25 aa, Entamoeba dispar
IILAIIRFILGLGIGGEYPLSSSIA

SEQ ID NO: 2384225 - protein, 17 aa, Entamoeba dispar
IILCVGIYKIVFITDSL

SEQ ID NO: 2384226 - protein, 18 aa, Entamoeba dispar
IILDAAKGIALLHSKNYL

SEQ ID NO: 2384227 - protein, 18 aa, Entamoeba dispar
IILGIPIKIETNIQYKLV

SEQ ID NO: 2384228 - protein, 19 aa, Entamoeba dispar
IILIIRIMIEQMKMNFIFF

SEQ ID NO: 2384229 - protein, 18 aa, Entamoeba dispar
IILIYSMFSRLSFNYLSK

SEQ ID NO: 2384230 - protein, 21 aa, Entamoeba dispar
IILLCIITYWAFIPIGVCLLF

SEQ ID NO: 2384231 - protein, 20 aa, Entamoeba dispar
IILLCYLVRLNFSYIKKQAE

SEQ ID NO: 2384232 - protein, 17 aa, Entamoeba dispar
IILLFKSFPTLFSQLSI

SEQ ID NO: 2384233 - protein, 26 aa, Entamoeba dispar
IILLGCGIIFFLSCWVDKKENKKKFK

SEQ ID NO: 2384234 - protein, 25 aa, Entamoeba dispar
IILPCATIIGCLKLKSQDRREKLWA

SEQ ID NO: 2384235 - protein, 17 aa, Entamoeba dispar
IILPFELKMRILFDTAK

SEQ ID NO: 2384236 - protein, 23 aa, Entamoeba dispar
IILPICVWVFCHFAKETTFMSGG

SEQ ID NO: 2384237 - protein, 24 aa, Entamoeba dispar
IILQEFVYHIGYFINNKRQAKRAD

SEQ ID NO: 2384238 - protein, 17 aa, Entamoeba dispar
IILRCSIIDKGLVKEAL

SEQ ID NO: 2384239 - protein, 17 aa, Entamoeba dispar
IILRVLVERSFGKYHQV

SEQ ID NO: 2384240 - protein, 23 aa, Entamoeba dispar
IILVETIILWSVIIAQRKGINTL

SEQ ID NO: 2384241 - protein, 17 aa, Entamoeba dispar
IILYRRIKRIDIRIFKL

SEQ ID NO: 2384242 - protein, 17 aa, Entamoeba dispar
IIMCSLGKVLEPSNCFE

SEQ ID NO: 2384243 - protein, 20 aa, Entamoeba dispar
IIMMCKRPNPSKIIWNIISC

SEQ ID NO: 2384244 - protein, 24 aa, Entamoeba dispar
IIMNSRGSIFVHFQDVFKKTMFSL

SEQ ID NO: 2384245 - protein, 19 aa, Entamoeba dispar
IIMSCLTFFMTGVFGLVTS

SEQ ID NO: 2384246 - protein, 18 aa, Entamoeba dispar
IIMVLIIVCVLVIIGCSV

SEQ ID NO: 2384247 - protein, 35 aa, Entamoeba dispar
IINAINFGCCFLLSWVCGFINNFLPGWLLARIGVL

SEQ ID NO: 2384248 - protein, 21 aa, Entamoeba dispar
IINALICWYSYFNKLPTLKFF

SEQ ID NO: 2384249 - protein, 17 aa, Entamoeba dispar
IINCCYYFITNIILIHI

SEQ ID NO: 2384250 - protein, 27 aa, Entamoeba dispar
IINEVFLQLKLLWPLFNITNTTNDLFN

SEQ ID NO: 2384251 - protein, 18 aa, Entamoeba dispar
IINGCLHNDFLVKHKVLE

SEQ ID NO: 2384252 - protein, 22 aa, Entamoeba dispar
IINLCLCIIKIIAAVVSGSLTV

SEQ ID NO: 2384253 - protein, 22 aa, Entamoeba dispar
IINPNWWLTNIIAMCITISIQT

SEQ ID NO: 2384254 - protein, 20 aa, Entamoeba dispar
IINSIFCVFVMFYVLVIFEA

SEQ ID NO: 2384255 - protein, 23 aa, Entamoeba dispar
IIPERDLVSSLGMSGGSQIHIPC

SEQ ID NO: 2384256 - protein, 20 aa, Entamoeba dispar
IIPIITLILIVIFITHNTFP

SEQ ID NO: 2384257 - protein, 23 aa, Entamoeba dispar
IIPINNIIEIFIFHEKEMKENEI

SEQ ID NO: 2384258 - protein, 19 aa, Entamoeba dispar
IIPLCPGENVQQCNQTEIF

SEQ ID NO: 2384259 - protein, 24 aa, Entamoeba dispar
IIPLLCLLVPCILEATKVTTLAIS

SEQ ID NO: 2384260 - protein, 24 aa, Entamoeba dispar
IIQFKEYIHICIKSTLFYISAINW

SEQ ID NO: 2384261 - protein, 28 aa, Entamoeba dispar
IIQHLPKVFLLFCVYSWTTFVFSYFTSF

SEQ ID NO: 2384262 - protein, 17 aa, Entamoeba dispar
IIQKEYINLIIFNTLTI

SEQ ID NO: 2384263 - protein, 26 aa, Entamoeba dispar
IIQKYYRYAFKDIKGNQLVNEKRGEK

SEQ ID NO: 2384264 - protein, 20 aa, Entamoeba dispar
IIQPHLKGIYKIQIYAKKYK

SEQ ID NO: 2384265 - protein, 20 aa, Entamoeba dispar
IIQQRITIILSSFTSSIQKL

SEQ ID NO: 2384266 - protein, 32 aa, Entamoeba dispar
IIQQWRSLGISFKRKYPTVILNILVDEYDPNV

SEQ ID NO: 2384267 - protein, 17 aa, Entamoeba dispar
IIQTILNLCEFMEREGI

SEQ ID NO: 2384268 - protein, 29 aa, Entamoeba dispar
IIQTLKGECKFTFKEMQTLNVKRDKLNLK

SEQ ID NO: 2384269 - protein, 21 aa, Entamoeba dispar
IIRFLCVILMFGCNSAGGFFF

SEQ ID NO: 2384270 - protein, 24 aa, Entamoeba dispar
IIRFSIEYSGNFSIHISTAEENRI

SEQ ID NO: 2384271 - protein, 17 aa, Entamoeba dispar
IIRIGSNAFKNSLITKI

SEQ ID NO: 2384272 - protein, 27 aa, Entamoeba dispar
IIRLVCKFYYLNRLESIDAILNGVLCY

SEQ ID NO: 2384273 - protein, 19 aa, Entamoeba dispar
IIRMMKQKKGFNFINALCL

SEQ ID NO: 2384274 - protein, 18 aa, Entamoeba dispar
IIRMNGVRFINGVNDYHC

SEQ ID NO: 2384275 - protein, 22 aa, Entamoeba dispar
IIRYYCLLLKYNYIDENCSIIN

SEQ ID NO: 2384276 - protein, 22 aa, Entamoeba dispar
IISFLPLFLYNQFKHVTNIYFL

SEQ ID NO: 2384277 - protein, 18 aa, Entamoeba dispar
IISGLTFNGIEWPEVNGT

SEQ ID NO: 2384278 - protein, 26 aa, Entamoeba dispar
IISHFSPTCWVKLPNKRSFYMTYSQK

SEQ ID NO: 2384279 - protein, 22 aa, Entamoeba dispar
IISHWKKSCFTEQITKPQTTRY

SEQ ID NO: 2384280 - protein, 18 aa, Entamoeba dispar
IISICLASSQLEVKILPN

SEQ ID NO: 2384281 - protein, 21 aa, Entamoeba dispar
IISIFCFLISLIAFVYQFVFF

SEQ ID NO: 2384282 - protein, 17 aa, Entamoeba dispar
IISILGLIACLLALVVH

SEQ ID NO: 2384283 - protein, 25 aa, Entamoeba dispar
IISKAIEVLPQWALLDATAISQNHS

SEQ ID NO: 2384284 - protein, 27 aa, Entamoeba dispar
IISLCLFYSIIIICFFFYSLLSLLSFS

SEQ ID NO: 2384285 - protein, 25 aa, Entamoeba dispar
IISLLEVFSPLKWQHLLVPFLPIKY

SEQ ID NO: 2384286 - protein, 17 aa, Entamoeba dispar
IISLSFYKNYTWMDYLD

SEQ ID NO: 2384287 - protein, 26 aa, Entamoeba dispar
IISLVEWNFSYRKRFNLFKEEEGVWI

SEQ ID NO: 2384288 - protein, 18 aa, Entamoeba dispar
IISMFGVFAPWVYGISTI

SEQ ID NO: 2384289 - protein, 36 aa, Entamoeba dispar
IISSMCFGFGFALYYNWKLALCVIATSPIHALILFG

SEQ ID NO: 2384290 - protein, 19 aa, Entamoeba dispar
IISSMLCDISLLFNKKNKS

SEQ ID NO: 2384291 - protein, 18 aa, Entamoeba dispar
IISTVCWGLLINGIGLCF

SEQ ID NO: 2384292 - protein, 23 aa, Entamoeba dispar
IISVHYRFYWQIITVDLLFIIPY

SEQ ID NO: 2384293 - protein, 28 aa, Entamoeba dispar
IITCRPVPLSTRPNLFMQNSYGYSPIGA

SEQ ID NO: 2384294 - protein, 24 aa, Entamoeba dispar
IITEVIRFTTLIGVHYFTKKFDEI

SEQ ID NO: 2384295 - protein, 20 aa, Entamoeba dispar
IITKFCKPITVMLFSIFYTK

SEQ ID NO: 2384296 - protein, 23 aa, Entamoeba dispar
IITNDIIPIISFVFDDYSISTMI

SEQ ID NO: 2384297 - protein, 18 aa, Entamoeba dispar
IITQAITIILERFDKQKE

SEQ ID NO: 2384298 - protein, 26 aa, Entamoeba dispar
IITRMLAFIVHRLFEQKSKHCSKPQP

SEQ ID NO: 2384299 - protein, 25 aa, Entamoeba dispar
IIVFIKDFIKSFILETILNLVITTL

SEQ ID NO: 2384300 - protein, 19 aa, Entamoeba dispar
IIVGCVGGFLVIGIILAII

SEQ ID NO: 2384301 - protein, 21 aa, Entamoeba dispar
IIVGIFLWWRQRGEEVEGEVQ

SEQ ID NO: 2384302 - protein, 38 aa, Entamoeba dispar
IIVGIYLFIFRTFIFKTWIFEVKWTFILLIILVIQNNP

SEQ ID NO: 2384303 - protein, 24 aa, Entamoeba dispar
IIVQLRYSSPIYKLSFRNIETNIE

SEQ ID NO: 2384304 - protein, 18 aa, Entamoeba dispar
IIVSLVALLLCFFVMLLS

SEQ ID NO: 2384305 - protein, 26 aa, Entamoeba dispar
IIVTIICVLCLIKKKSKYASIGEEEE

SEQ ID NO: 2384306 - protein, 25 aa, Entamoeba dispar
IIVTVCCFLLFFIIIAIIGVLLAYY

SEQ ID NO: 2384307 - protein, 17 aa, Entamoeba dispar
IIWKSDYIHLYKDEKSI

SEQ ID NO: 2384308 - protein, 26 aa, Entamoeba dispar
IIYIICGLSILFRRSYTFTKQIILPI

SEQ ID NO: 2384309 - protein, 21 aa, Entamoeba dispar
IIYKVCTKLNISIPINLPQEF

SEQ ID NO: 2384310 - protein, 20 aa, Entamoeba dispar
IIYMGELFTNYVLDINSIFP

SEQ ID NO: 2384311 - protein, 28 aa, Entamoeba dispar
IIYNCAICMTCGCLLCYKDKKHQDIIHS

SEQ ID NO: 2384312 - protein, 21 aa, Entamoeba dispar
IKAAPCILSVLVAALDGLLKS

SEQ ID NO: 2384313 - protein, 23 aa, Entamoeba dispar
IKAKMFEAVKRWREIQKGKMAGL

SEQ ID NO: 2384314 - protein, 28 aa, Entamoeba dispar
IKAKVIPDCVSSIWVCCVDKRYENGRNG

SEQ ID NO: 2384315 - protein, 19 aa, Entamoeba dispar
IKAQNVFLMKVIDSPLQNI

SEQ ID NO: 2384316 - protein, 19 aa, Entamoeba dispar
IKCAVPTCGNGKIDEYEEC

SEQ ID NO: 2384317 - protein, 19 aa, Entamoeba dispar
IKCAVPTCGNGKVDEYEEC

SEQ ID NO: 2384318 - protein, 19 aa, Entamoeba dispar
IKCGTYIVANAFKDDVVCP

SEQ ID NO: 2384319 - protein, 21 aa, Entamoeba dispar
IKCKIPSFDRLSFPTLGMLIS

SEQ ID NO: 2384320 - protein, 17 aa, Entamoeba dispar
IKCLPGYSYYMGECFQC

SEQ ID NO: 2384321 - protein, 21 aa, Entamoeba dispar
IKCNNLPILISSIRSEGSVSF

SEQ ID NO: 2384322 - protein, 17 aa, Entamoeba dispar
IKDGKFFFLSPLQMTPK

SEQ ID NO: 2384323 - protein, 18 aa, Entamoeba dispar
IKDIIKVIISIEKQCVGI

SEQ ID NO: 2384324 - protein, 18 aa, Entamoeba dispar
IKDLCNRLTQLLESHERK

SEQ ID NO: 2384325 - protein, 20 aa, Entamoeba dispar
IKDSFEVMLRDAYYDFGSVY

SEQ ID NO: 2384326 - protein, 24 aa, Entamoeba dispar
IKDSKCVKCKYGYYNPSSCTKCPK

SEQ ID NO: 2384327 - protein, 28 aa, Entamoeba dispar
IKDWDLWGPMFVCYILSLLLSINVMVRK

SEQ ID NO: 2384328 - protein, 18 aa, Entamoeba dispar
IKEAKRLYDELLHGDPNK

SEQ ID NO: 2384329 - protein, 27 aa, Entamoeba dispar
IKEFIGSQHFNVWWYRNKMNELCKVSV

SEQ ID NO: 2384330 - protein, 22 aa, Entamoeba dispar
IKEICVFMGPFFSGLTVLVGYR

SEQ ID NO: 2384331 - protein, 20 aa, Entamoeba dispar
IKEILGFKRGYQKGMTMDVS

SEQ ID NO: 2384332 - protein, 25 aa, Entamoeba dispar
IKEKEWKKGEVISQEYMIMMLLIYN

SEQ ID NO: 2384333 - protein, 31 aa, Entamoeba dispar
IKEKEYSSVHGIHYFMIGIVSIIVFIINYTI

SEQ ID NO: 2384334 - protein, 25 aa, Entamoeba dispar
IKELILRGCSCFKMGTKLKTKGVLK

SEQ ID NO: 2384335 - protein, 22 aa, Entamoeba dispar
IKELTKRYSIDYSYQDEEGKTY

SEQ ID NO: 2384336 - protein, 19 aa, Entamoeba dispar
IKENIHINGIDGFNNSSLP

SEQ ID NO: 2384337 - protein, 32 aa, Entamoeba dispar
IKESYQMIDCSLILKTDVDSIIFLTKNNNKFL

SEQ ID NO: 2384338 - protein, 21 aa, Entamoeba dispar
IKEVNYLGCIAVSPTWDSLII

SEQ ID NO: 2384339 - protein, 25 aa, Entamoeba dispar
IKFFGPKIRECIKSYCNEHKNEDSC

SEQ ID NO: 2384340 - protein, 17 aa, Entamoeba dispar
IKFLLSFAKKYGSYISQ

SEQ ID NO: 2384341 - protein, 22 aa, Entamoeba dispar
IKFTATKAVSLTTCFKETTLNS

SEQ ID NO: 2384342 - protein, 23 aa, Entamoeba dispar
IKFVDCLYKTYPAAVLTKVDNNI

SEQ ID NO: 2384343 - protein, 17 aa, Entamoeba dispar
IKGGNFIQLYKGRIDDI

SEQ ID NO: 2384344 - protein, 19 aa, Entamoeba dispar
IKGNGFSVANIKYNTVNVE

SEQ ID NO: 2384345 - protein, 22 aa, Entamoeba dispar
IKGRSVIESRISFIELLSGEKK

SEQ ID NO: 2384346 - protein, 26 aa, Entamoeba dispar
IKHDGWKKLRIDPSFINCKILKMPVD

SEQ ID NO: 2384347 - protein, 20 aa, Entamoeba dispar
IKHVCSYTASTIKWQNIVKG

SEQ ID NO: 2384348 - protein, 24 aa, Entamoeba dispar
IKICAGYLIGASMNFKSDEVFIDF

SEQ ID NO: 2384349 - protein, 18 aa, Entamoeba dispar
IKICDGEIISKVSSLIFG

SEQ ID NO: 2384350 - protein, 19 aa, Entamoeba dispar
IKIECLDFMNLLKELIKIN

SEQ ID NO: 2384351 - protein, 22 aa, Entamoeba dispar
IKIEKLEIIVALANKDNIKEIL

SEQ ID NO: 2384352 - protein, 24 aa, Entamoeba dispar
IKIELIKVFGIIGAIDPYKYKLLT

SEQ ID NO: 2384353 - protein, 19 aa, Entamoeba dispar
IKIEVWKLILERRLKETKK

SEQ ID NO: 2384354 - protein, 18 aa, Entamoeba dispar
IKIFSLIFCCISSIITLI

SEQ ID NO: 2384355 - protein, 17 aa, Entamoeba dispar
IKIPYTIWLSKCKKSLQ

SEQ ID NO: 2384356 - protein, 17 aa, Entamoeba dispar
IKIRLLFSTIFNLIGLF

SEQ ID NO: 2384357 - protein, 27 aa, Entamoeba dispar
IKKEFFKEEMIILLTILLKIIPINNII

SEQ ID NO: 2384358 - protein, 22 aa, Entamoeba dispar
IKKGKYGIIGIWIIAALCCGYF

SEQ ID NO: 2384359 - protein, 17 aa, Entamoeba dispar
IKKIFKTKLGFFDVTPL

SEQ ID NO: 2384360 - protein, 18 aa, Entamoeba dispar
IKKKDIRVNLPLAAPNDM

SEQ ID NO: 2384361 - protein, 24 aa, Entamoeba dispar
IKKKNEFEIILPLLEVFKQKDDDF

SEQ ID NO: 2384362 - protein, 23 aa, Entamoeba dispar
IKKMFWKIYIMLVGEEKKDRSGY

SEQ ID NO: 2384363 - protein, 20 aa, Entamoeba dispar
IKKNRLFVCDSLNHRIQQFD

SEQ ID NO: 2384364 - protein, 20 aa, Entamoeba dispar
IKKPDLFSVFKTLGAEVLCE

SEQ ID NO: 2384365 - protein, 22 aa, Entamoeba dispar
IKKPKLIETCFSFFQRTKNESV

SEQ ID NO: 2384366 - protein, 19 aa, Entamoeba dispar
IKKRRMMIDINLNKITEEE

SEQ ID NO: 2384367 - protein, 20 aa, Entamoeba dispar
IKKSFGYYIFIVELFLVSLP

SEQ ID NO: 2384368 - protein, 18 aa, Entamoeba dispar
IKKYKCRRMNGEVVEYTP

SEQ ID NO: 2384369 - protein, 24 aa, Entamoeba dispar
IKLENEYLLPISFACIAPQNNCLI

SEQ ID NO: 2384370 - protein, 25 aa, Entamoeba dispar
IKLFAGRPRPNFYAMVDAGNIKDAY

SEQ ID NO: 2384371 - protein, 17 aa, Entamoeba dispar
IKLNCFGYFGCLIINNI

SEQ ID NO: 2384372 - protein, 25 aa, Entamoeba dispar
IKLPDAHIPWYRYLLFTIAMACCVV

SEQ ID NO: 2384373 - protein, 30 aa, Entamoeba dispar
IKLPLNVFYSCLLLYKHFYIIQSPQLFHPR

SEQ ID NO: 2384374 - protein, 25 aa, Entamoeba dispar
IKLTRRPLAVFPIMLFFTMLSWLTL

SEQ ID NO: 2384375 - protein, 25 aa, Entamoeba dispar
IKLVKAYFLMCEIIEYNETKENEEG

SEQ ID NO: 2384376 - protein, 18 aa, Entamoeba dispar
IKNCLKYINSGQCVECKE

SEQ ID NO: 2384377 - protein, 20 aa, Entamoeba dispar
IKNEELAIMADLEKLIKGIN

SEQ ID NO: 2384378 - protein, 23 aa, Entamoeba dispar
IKNEELAIMPDLEKLIKGINKSD

SEQ ID NO: 2384379 - protein, 23 aa, Entamoeba dispar
IKNFKELFKMIGEEESNILKEII

SEQ ID NO: 2384380 - protein, 22 aa, Entamoeba dispar
IKNGLGCIICNDGYYKKDSICF

SEQ ID NO: 2384381 - protein, 19 aa, Entamoeba dispar
IKNKILQKLSFRDDVISII

SEQ ID NO: 2384382 - protein, 17 aa, Entamoeba dispar
IKPDNMLVFSFAEQVGV

SEQ ID NO: 2384383 - protein, 23 aa, Entamoeba dispar
IKPKELRFVFVGREFKREHTLIT

SEQ ID NO: 2384384 - protein, 23 aa, Entamoeba dispar
IKPNHIFRGGFFFNKGEEDIKKL

SEQ ID NO: 2384385 - protein, 18 aa, Entamoeba dispar
IKPSCFVDTMEIEGSRDW

SEQ ID NO: 2384386 - protein, 25 aa, Entamoeba dispar
IKQIRLCLPGAFDTFLQRLYFYMYI

SEQ ID NO: 2384387 - protein, 21 aa, Entamoeba dispar
IKQLFPVQRLFVIPEPIDDHY

SEQ ID NO: 2384388 - protein, 19 aa, Entamoeba dispar
IKQPIPFHSNCFIENKYYR

SEQ ID NO: 2384389 - protein, 26 aa, Entamoeba dispar
IKQQIYKILVCFFARDLNIHLTSIIY

SEQ ID NO: 2384390 - protein, 20 aa, Entamoeba dispar
IKQTMKWKNISVENSVNINI

SEQ ID NO: 2384391 - protein, 23 aa, Entamoeba dispar
IKQYGYKVGISIIETYRYNYEYN

SEQ ID NO: 2384392 - protein, 22 aa, Entamoeba dispar
IKRGIKYYSEIKVKCETEITSR

SEQ ID NO: 2384393 - protein, 25 aa, Entamoeba dispar
IKRLKPESVEACFYAIEIMKKTGEF

SEQ ID NO: 2384394 - protein, 17 aa, Entamoeba dispar
IKRNVIFYGTLIILLIL

SEQ ID NO: 2384395 - protein, 23 aa, Entamoeba dispar
IKRSIMLLRLLKTGINKEMIIKN

SEQ ID NO: 2384396 - protein, 19 aa, Entamoeba dispar
IKSDCYINEYLIGVNKSTN

SEQ ID NO: 2384397 - protein, 18 aa, Entamoeba dispar
IKSGSLGRMPEKFGGEKQ

SEQ ID NO: 2384398 - protein, 17 aa, Entamoeba dispar
IKSKSGVFFGIPPLGGW

SEQ ID NO: 2384399 - protein, 18 aa, Entamoeba dispar
IKSLKRIGIIKERIIRSN

SEQ ID NO: 2384400 - protein, 17 aa, Entamoeba dispar
IKSQVSLLVPETMLASR

SEQ ID NO: 2384401 - protein, 17 aa, Entamoeba dispar
IKSRIKCGTYIVANAFK

SEQ ID NO: 2384402 - protein, 19 aa, Entamoeba dispar
IKSSINGTSSFDSFEDFGF

SEQ ID NO: 2384403 - protein, 17 aa, Entamoeba dispar
IKSYIIFNINNNFDKSV

SEQ ID NO: 2384404 - protein, 17 aa, Entamoeba dispar
IKTAFSICLHNFPEGIA

SEQ ID NO: 2384405 - protein, 20 aa, Entamoeba dispar
IKTELCKKGIKFISETDSEV

SEQ ID NO: 2384406 - protein, 17 aa, Entamoeba dispar
IKTFAFEVVIFCVIKSG

SEQ ID NO: 2384407 - protein, 20 aa, Entamoeba dispar
IKTHGMGIMNTCVNYVYQYL

SEQ ID NO: 2384408 - protein, 22 aa, Entamoeba dispar
IKTHQIRSGFVVAINNKTLKFF

SEQ ID NO: 2384409 - protein, 23 aa, Entamoeba dispar
IKTHWYERPFSKIIRIVQRHFKD

SEQ ID NO: 2384410 - protein, 23 aa, Entamoeba dispar
IKTKKDIIVIILMLNQVFLFISC

SEQ ID NO: 2384411 - protein, 28 aa, Entamoeba dispar
IKTKKECKECITVLCGDKKKIISITQAD

SEQ ID NO: 2384412 - protein, 17 aa, Entamoeba dispar
IKTLLRVDGEITSKGIL

SEQ ID NO: 2384413 - protein, 24 aa, Entamoeba dispar
IKTTICGTLAWIAPEVLARKPYCQ

SEQ ID NO: 2384414 - protein, 18 aa, Entamoeba dispar
IKVAVMKLAISFIENGHD

SEQ ID NO: 2384415 - protein, 23 aa, Entamoeba dispar
IKVCSISLVSTCKFAITEKNIAE

SEQ ID NO: 2384416 - protein, 18 aa, Entamoeba dispar
IKVCVFPFCTLTEESTIK

SEQ ID NO: 2384417 - protein, 18 aa, Entamoeba dispar
IKVIELKGSLRCGVLYLS

SEQ ID NO: 2384418 - protein, 19 aa, Entamoeba dispar
IKVIMVIDTLLFLYITEIL

SEQ ID NO: 2384419 - protein, 18 aa, Entamoeba dispar
IKVKLNLIDWVLRELPPT

SEQ ID NO: 2384420 - protein, 17 aa, Entamoeba dispar
IKYCDRWAYEQQMTNVI

SEQ ID NO: 2384421 - protein, 23 aa, Entamoeba dispar
IKYEEFKTLLTFNETIINVIAGD

SEQ ID NO: 2384422 - protein, 26 aa, Entamoeba dispar
IKYFSACTSFGYMICSCSSTIASYSL

SEQ ID NO: 2384423 - protein, 21 aa, Entamoeba dispar
IKYHCGQTFLQKAYKVQRSEF

SEQ ID NO: 2384424 - protein, 18 aa, Entamoeba dispar
IKYKKIKSLLSTFIQPIT

SEQ ID NO: 2384425 - protein, 18 aa, Entamoeba dispar
IKYSYSLVIKKYPFLTLF

SEQ ID NO: 2384426 - protein, 17 aa, Entamoeba dispar
IKYYPFTIYRFGKVTEI

SEQ ID NO: 2384427 - protein, 17 aa, Entamoeba dispar
ILACIGIICAVFTKDHH

SEQ ID NO: 2384428 - protein, 17 aa, Entamoeba dispar
ILCCIISFFETQDFGNQ

SEQ ID NO: 2384429 - protein, 18 aa, Entamoeba dispar
ILCDCAKGLMYLHNNHII

SEQ ID NO: 2384430 - protein, 17 aa, Entamoeba dispar
ILCGYSEDFSYIEVMKL

SEQ ID NO: 2384431 - protein, 18 aa, Entamoeba dispar
ILCIPTLLLFISVLMNLP

SEQ ID NO: 2384432 - protein, 23 aa, Entamoeba dispar
ILCSCLLYLYYLHFNLLTYYLIN

SEQ ID NO: 2384433 - protein, 21 aa, Entamoeba dispar
ILCYMCSTDALVSFVNQSELL

SEQ ID NO: 2384434 - protein, 21 aa, Entamoeba dispar
ILCYPMFALFLVFYKDKKEKG

SEQ ID NO: 2384435 - protein, 25 aa, Entamoeba dispar
ILDLYFRLLSTFKMLRQESIENNEI

SEQ ID NO: 2384436 - protein, 21 aa, Entamoeba dispar
ILEGLWYCLYVFLIIALMLRF

SEQ ID NO: 2384437 - protein, 24 aa, Entamoeba dispar
ILEGWWFLVMACAVAVISFLWYLA

SEQ ID NO: 2384438 - protein, 24 aa, Entamoeba dispar
ILEKVKLTFGFDFLDCNIQFYQIK

SEQ ID NO: 2384439 - protein, 18 aa, Entamoeba dispar
ILETSFKYNETILHLLPP

SEQ ID NO: 2384440 - protein, 18 aa, Entamoeba dispar
ILFCCSLVLNTSQGGILP

SEQ ID NO: 2384441 - protein, 24 aa, Entamoeba dispar
ILFDCIKRPKISLLTNHLNKRSSS

SEQ ID NO: 2384442 - protein, 19 aa, Entamoeba dispar
ILFEIEFDGDYSILIDTRG

SEQ ID NO: 2384443 - protein, 17 aa, Entamoeba dispar
ILFFSMSMYIEGKKNKV

SEQ ID NO: 2384444 - protein, 20 aa, Entamoeba dispar
ILFLFLNIFYFKAKSTTNNI

SEQ ID NO: 2384445 - protein, 22 aa, Entamoeba dispar
ILFLMYCIWTIYVLYDHVYYCF

SEQ ID NO: 2384446 - protein, 18 aa, Entamoeba dispar
ILFPKYLPLFSKIVYLVK

SEQ ID NO: 2384447 - protein, 25 aa, Entamoeba dispar
ILFPPEILPYIPSNVIIELLKIIKS

SEQ ID NO: 2384448 - protein, 23 aa, Entamoeba dispar
ILFTLCALAFWFNTKYNLSFNII

SEQ ID NO: 2384449 - protein, 30 aa, Entamoeba dispar
ILFVLGFFLPCIWIYNIIKYKNSGDLIEKR

SEQ ID NO: 2384450 - protein, 18 aa, Entamoeba dispar
ILFYSRSSVYTWEHILII

SEQ ID NO: 2384451 - protein, 25 aa, Entamoeba dispar
ILGAKRLSSVGVILTICVILPFVIL

SEQ ID NO: 2384452 - protein, 27 aa, Entamoeba dispar
ILGICFPPFLICSLVYMRKYRKSQKLS

SEQ ID NO: 2384453 - protein, 18 aa, Entamoeba dispar
ILGIKSFYIALACLITIE

SEQ ID NO: 2384454 - protein, 22 aa, Entamoeba dispar
ILGKKELQGFCDLLNDKENNFT

SEQ ID NO: 2384455 - protein, 21 aa, Entamoeba dispar
ILHIMIWRQGGALLIPGSVIV

SEQ ID NO: 2384456 - protein, 23 aa, Entamoeba dispar
ILHQSIMQFADWVRIINDETEIQ

SEQ ID NO: 2384457 - protein, 26 aa, Entamoeba dispar
ILHYIFSSSCSLCFESLENEESLSLI

SEQ ID NO: 2384458 - protein, 20 aa, Entamoeba dispar
ILIEKFPMWLAPNMITLTGG

SEQ ID NO: 2384459 - protein, 26 aa, Entamoeba dispar
ILIHGRYCYRQIGITLFYLLYKNIIL

SEQ ID NO: 2384460 - protein, 21 aa, Entamoeba dispar
ILIICILKFRVNLKTEIALLL

SEQ ID NO: 2384461 - protein, 18 aa, Entamoeba dispar
ILIICLLVGSILLIINII

SEQ ID NO: 2384462 - protein, 23 aa, Entamoeba dispar
ILIKILLRNIEIIEISKNHYKQH

SEQ ID NO: 2384463 - protein, 25 aa, Entamoeba dispar
ILILCIKEGFHIYYYIYYNITGTPK

SEQ ID NO: 2384464 - protein, 24 aa, Entamoeba dispar
ILILECYIVFYMNHFIGYFEGKLE

SEQ ID NO: 2384465 - protein, 29 aa, Entamoeba dispar
ILILPLVLFIWRFVIRRIIHPNPIQKYHA

SEQ ID NO: 2384466 - protein, 21 aa, Entamoeba dispar
ILINCCSVVIGLYRVFVIEVF

SEQ ID NO: 2384467 - protein, 24 aa, Entamoeba dispar
ILINCCSVVIGLYRVFVIEVFILF

SEQ ID NO: 2384468 - protein, 19 aa, Entamoeba dispar
ILIVICLINGVPISSYLLP

SEQ ID NO: 2384469 - protein, 18 aa, Entamoeba dispar
ILKEHIGNPVVYVNLEAY

SEQ ID NO: 2384470 - protein, 19 aa, Entamoeba dispar
ILKIPSHIKEFMASNCAND

SEQ ID NO: 2384471 - protein, 22 aa, Entamoeba dispar
ILKKNEGCIFTFKVKPMCSCTI

SEQ ID NO: 2384472 - protein, 18 aa, Entamoeba dispar
ILKLYSLRNNELTGNELQ

SEQ ID NO: 2384473 - protein, 22 aa, Entamoeba dispar
ILKNSWFFYELIVKSLTLEMDL

SEQ ID NO: 2384474 - protein, 27 aa, Entamoeba dispar
ILKRISQPMFREFLLRVHPQLYTHLLK

SEQ ID NO: 2384475 - protein, 22 aa, Entamoeba dispar
ILKRKKCIDFSYDNKNKEKKIS

SEQ ID NO: 2384476 - protein, 18 aa, Entamoeba dispar
ILKRRDGSGLSPSFLLIL

SEQ ID NO: 2384477 - protein, 19 aa, Entamoeba dispar
ILKYKPEMYYQCTAANIQK

SEQ ID NO: 2384478 - protein, 20 aa, Entamoeba dispar
ILLECFTVLFTIVLIITSIR

SEQ ID NO: 2384479 - protein, 23 aa, Entamoeba dispar
ILLESIPFVDGWIITNVQSNCLI

SEQ ID NO: 2384480 - protein, 20 aa, Entamoeba dispar
ILLFICLIKYFSTIKQYQLF

SEQ ID NO: 2384481 - protein, 17 aa, Entamoeba dispar
ILLFKIFLNFSTHLYVH

SEQ ID NO: 2384482 - protein, 18 aa, Entamoeba dispar
ILLFSWLYNYFVFALDDI

SEQ ID NO: 2384483 - protein, 19 aa, Entamoeba dispar
ILLGIAIIFFSFVCFVPQI

SEQ ID NO: 2384484 - protein, 17 aa, Entamoeba dispar
ILLHYLYFLDWYTHYET

SEQ ID NO: 2384485 - protein, 22 aa, Entamoeba dispar
ILLIAIICFSFALVQFVADVIG

SEQ ID NO: 2384486 - protein, 17 aa, Entamoeba dispar
ILLIIVCIICCLLYLLI

SEQ ID NO: 2384487 - protein, 25 aa, Entamoeba dispar
ILLILLWFMMHFMLAVQSIGPAVFA

SEQ ID NO: 2384488 - protein, 24 aa, Entamoeba dispar
ILLKGKYGIVSLCYGLLERTVEFD

SEQ ID NO: 2384489 - protein, 17 aa, Entamoeba dispar
ILLKIIPINNIIEIFIF

SEQ ID NO: 2384490 - protein, 20 aa, Entamoeba dispar
ILLLCKLLSMIESITLALRV

SEQ ID NO: 2384491 - protein, 19 aa, Entamoeba dispar
ILLLFNINDVWYLILSYDG

SEQ ID NO: 2384492 - protein, 24 aa, Entamoeba dispar
ILLLKSALWKEEWNSKKLTNLIID

SEQ ID NO: 2384493 - protein, 27 aa, Entamoeba dispar
ILLLPEALKLIPIFVLGAMKTSAFMPF

SEQ ID NO: 2384494 - protein, 24 aa, Entamoeba dispar
ILLPEILAAIFIGFTLLRFFVTPY

SEQ ID NO: 2384495 - protein, 17 aa, Entamoeba dispar
ILLPIIILTLLILRFKY

SEQ ID NO: 2384496 - protein, 21 aa, Entamoeba dispar
ILLPTFIQILLLMFPNTAPEI

SEQ ID NO: 2384497 - protein, 23 aa, Entamoeba dispar
ILLRKRKIKQLKEIEEDEMKALE

SEQ ID NO: 2384498 - protein, 18 aa, Entamoeba dispar
ILLSKEFRDLSNLKENEL

SEQ ID NO: 2384499 - protein, 27 aa, Entamoeba dispar
ILLTGKFRFGYVFGFTIIGSLAEYFIL

SEQ ID NO: 2384500 - protein, 24 aa, Entamoeba dispar
ILLTRNGYYYSIIFGISFIVLLIS

SEQ ID NO: 2384501 - protein, 21 aa, Entamoeba dispar
ILLVKTIYLFVLFAIGYMSSF

SEQ ID NO: 2384502 - protein, 17 aa, Entamoeba dispar
ILMTICIIITILDFNKM

SEQ ID NO: 2384503 - protein, 18 aa, Entamoeba dispar
ILNEITLPIYEHINELIP

SEQ ID NO: 2384504 - protein, 21 aa, Entamoeba dispar
ILNGIVCVLAITSLILTVVIE

SEQ ID NO: 2384505 - protein, 26 aa, Entamoeba dispar
ILNGMYWFECLFNAKKYHNIIELLRT

SEQ ID NO: 2384506 - protein, 19 aa, Entamoeba dispar
ILNILASYCMFVIVQSFPN

SEQ ID NO: 2384507 - protein, 20 aa, Entamoeba dispar
ILNINGFGFRIKRPERRSQK

SEQ ID NO: 2384508 - protein, 18 aa, Entamoeba dispar
ILNLCEFMEREGIKVPIK

SEQ ID NO: 2384509 - protein, 32 aa, Entamoeba dispar
ILNLYWLVRLHCFEISSLQCPVCNIDLSIANS

SEQ ID NO: 2384510 - protein, 23 aa, Entamoeba dispar
ILNTMYSLYCEFFFIHEEIEGRH

SEQ ID NO: 2384511 - protein, 25 aa, Entamoeba dispar
ILNYHISRYILLLIHTFPFIYSYLQ

SEQ ID NO: 2384512 - protein, 21 aa, Entamoeba dispar
ILPNLGIVFWILCILVALGGV

SEQ ID NO: 2384513 - protein, 22 aa, Entamoeba dispar
ILPVYHTYCGKYVVNNTKRDAV

SEQ ID NO: 2384514 - protein, 25 aa, Entamoeba dispar
ILQGEILSSVIIKTPIIKRIIISTT

SEQ ID NO: 2384515 - protein, 28 aa, Entamoeba dispar
ILQKCSYFEVIIPFLLFAECRLVVTSNA

SEQ ID NO: 2384516 - protein, 23 aa, Entamoeba dispar
ILQLYPSYVPLSFFELIIQATKL

SEQ ID NO: 2384517 - protein, 19 aa, Entamoeba dispar
ILQYNFRLPFTDFAQLNDY

SEQ ID NO: 2384518 - protein, 25 aa, Entamoeba dispar
ILQYSDDCSLHFFELIKQSAQCIDF

SEQ ID NO: 2384519 - protein, 19 aa, Entamoeba dispar
ILRSIKFIKNNAWEEPLHK

SEQ ID NO: 2384520 - protein, 19 aa, Entamoeba dispar
ILRSIKFIKYNAWEEPLHK

SEQ ID NO: 2384521 - protein, 18 aa, Entamoeba dispar
ILRTFAICLIPFYEVYRG

SEQ ID NO: 2384522 - protein, 17 aa, Entamoeba dispar
ILSASFLSYFQVRKYYL

SEQ ID NO: 2384523 - protein, 17 aa, Entamoeba dispar
ILSECFGSFILIFVLML

SEQ ID NO: 2384524 - protein, 18 aa, Entamoeba dispar
ILSFNCLDDIKLINNLLA

SEQ ID NO: 2384525 - protein, 19 aa, Entamoeba dispar
ILSIEGMMVISGFHDLYIS

SEQ ID NO: 2384526 - protein, 18 aa, Entamoeba dispar
ILSILSWESPKLVNSILR

SEQ ID NO: 2384527 - protein, 32 aa, Entamoeba dispar
ILSLSFCFIFLYYLICFFFKSFDIIIRIFINI

SEQ ID NO: 2384528 - protein, 34 aa, Entamoeba dispar
ILSNVFPFKDFWGHVCIVWNKCYYFFSQDQLEMQ

SEQ ID NO: 2384529 - protein, 24 aa, Entamoeba dispar
ILSRYGCCYGCFMFPNTCPNCHDC

SEQ ID NO: 2384530 - protein, 19 aa, Entamoeba dispar
ILSSFSWFCVCIAEFFVLI

SEQ ID NO: 2384531 - protein, 18 aa, Entamoeba dispar
ILSTHSVKIFNQLSLQAN

SEQ ID NO: 2384532 - protein, 20 aa, Entamoeba dispar
ILSVFELRISSIMLGITNEY

SEQ ID NO: 2384533 - protein, 17 aa, Entamoeba dispar
ILSYALKCSQMKKNMVY

SEQ ID NO: 2384534 - protein, 24 aa, Entamoeba dispar
ILTELLRFLPVSDLTIREEVIVKI

SEQ ID NO: 2384535 - protein, 17 aa, Entamoeba dispar
ILTHYGVNLPQEIIDNS

SEQ ID NO: 2384536 - protein, 24 aa, Entamoeba dispar
ILTINWPWLCICMVLLNATNPGFF

SEQ ID NO: 2384537 - protein, 19 aa, Entamoeba dispar
ILTIPINFITFYLPLLPLL

SEQ ID NO: 2384538 - protein, 17 aa, Entamoeba dispar
ILTISGFLFIGVFNSFL

SEQ ID NO: 2384539 - protein, 18 aa, Entamoeba dispar
ILTSIPIYTHSCALEFAI

SEQ ID NO: 2384540 - protein, 18 aa, Entamoeba dispar
ILTTEAYLFTIIFFICSW

SEQ ID NO: 2384541 - protein, 38 aa, Entamoeba dispar
ILVAVCLNFPFIIPKSVKFLNRISVLSIIVAVFVTFTV

SEQ ID NO: 2384542 - protein, 18 aa, Entamoeba dispar
ILVDDCFDSTLIIDKNWN

SEQ ID NO: 2384543 - protein, 18 aa, Entamoeba dispar
ILVSCIFYVCSDEDENIP

SEQ ID NO: 2384544 - protein, 23 aa, Entamoeba dispar
ILWAVCRFAFKIKNPLVSYICLF

SEQ ID NO: 2384545 - protein, 20 aa, Entamoeba dispar
ILYAISFKGKIISKLDFYAR

SEQ ID NO: 2384546 - protein, 26 aa, Entamoeba dispar
ILYCVFPCLIPPFISNKRIEKYIRAT

SEQ ID NO: 2384547 - protein, 18 aa, Entamoeba dispar
ILYIISFISLLTILLLIY

SEQ ID NO: 2384548 - protein, 23 aa, Entamoeba dispar
ILYIPYLFLFGWNIVSIEDHYNY

SEQ ID NO: 2384549 - protein, 19 aa, Entamoeba dispar
ILYKFCEKDNPFLIKCFNI

SEQ ID NO: 2384550 - protein, 23 aa, Entamoeba dispar
ILYKGIYPFNSFQFDYLILSLND

SEQ ID NO: 2384551 - protein, 26 aa, Entamoeba dispar
ILYPSLPFIWGYFALLSVGLWYSSRS

SEQ ID NO: 2384552 - protein, 17 aa, Entamoeba dispar
ILYVCFIGYITKNKPLI

SEQ ID NO: 2384553 - protein, 28 aa, Entamoeba dispar
ILYWIEVVASLILSFSMLFKQDNRFINP

SEQ ID NO: 2384554 - protein, 17 aa, Entamoeba dispar
ILYYFRPMVKAIVLISF

SEQ ID NO: 2384555 - protein, 20 aa, Entamoeba dispar
ILYYHPRDTLTILNPLSHII

SEQ ID NO: 2384556 - protein, 27 aa, Entamoeba dispar
ILYYIPQCWMEYRIIPFDEYKEKVFKS

SEQ ID NO: 2384557 - protein, 19 aa, Entamoeba dispar
IMAASFPLVHFAQRSLLDV

SEQ ID NO: 2384558 - protein, 17 aa, Entamoeba dispar
IMENGFEGYHECVMNRV

SEQ ID NO: 2384559 - protein, 17 aa, Entamoeba dispar
IMESIFLQQPYHEEIAP

SEQ ID NO: 2384560 - protein, 19 aa, Entamoeba dispar
IMESIRSQFIINFIGSVIT

SEQ ID NO: 2384561 - protein, 25 aa, Entamoeba dispar
IMFIKCPECMVALLIAPVLSANESF

SEQ ID NO: 2384562 - protein, 17 aa, Entamoeba dispar
IMFKNLPNCLGLLQLCD

SEQ ID NO: 2384563 - protein, 21 aa, Entamoeba dispar
IMGGGDGFPGLGFNRSLEGQT

SEQ ID NO: 2384564 - protein, 19 aa, Entamoeba dispar
IMIEQMKMNFIFFTLATLG

SEQ ID NO: 2384565 - protein, 19 aa, Entamoeba dispar
IMIESSLFIPIFSFGIETQ

SEQ ID NO: 2384566 - protein, 24 aa, Entamoeba dispar
IMISGCYLCFIFTRTFAKGYFKTG

SEQ ID NO: 2384567 - protein, 20 aa, Entamoeba dispar
IMIVYPYRHVKWLREKIKKE

SEQ ID NO: 2384568 - protein, 19 aa, Entamoeba dispar
IMLFVCFGEGKSLSRQSKR

SEQ ID NO: 2384569 - protein, 20 aa, Entamoeba dispar
IMNILFLGYLVFFVIAFFQS

SEQ ID NO: 2384570 - protein, 18 aa, Entamoeba dispar
IMNYCNYPDPDIRINATS

SEQ ID NO: 2384571 - protein, 23 aa, Entamoeba dispar
IMQLIYKYLRGVIVSIFMPCHCV

SEQ ID NO: 2384572 - protein, 25 aa, Entamoeba dispar
IMRNLRVVFLLVFIIFFTLNVRSEF

SEQ ID NO: 2384573 - protein, 42 aa, Entamoeba dispar
IMSTVSFGFGIGLYFSWKLSLCILAVFPIISFFMFINGQLNS

SEQ ID NO: 2384574 - protein, 28 aa, Entamoeba dispar
IMTVAFIIKIIWYRGVIRENSGLLMKIV

SEQ ID NO: 2384575 - protein, 17 aa, Entamoeba dispar
IMVPYTILDWNLNAEPS

SEQ ID NO: 2384576 - protein, 23 aa, Entamoeba dispar
INADIPGCFDLLLTTEINDEMKS

SEQ ID NO: 2384577 - protein, 24 aa, Entamoeba dispar
INAGPKIKGVILGMSECVGELTCC

SEQ ID NO: 2384578 - protein, 18 aa, Entamoeba dispar
INALSKFSICPNDKAANY

SEQ ID NO: 2384579 - protein, 18 aa, Entamoeba dispar
INASLYFPGETQFTELDR

SEQ ID NO: 2384580 - protein, 20 aa, Entamoeba dispar
INCFEIAGIIVEVVGGNKDV

SEQ ID NO: 2384581 - protein, 18 aa, Entamoeba dispar
INCGIQLTSGGSTLATKY

SEQ ID NO: 2384582 - protein, 21 aa, Entamoeba dispar
INCIGWKLLLKDCKTSSQQNM

SEQ ID NO: 2384583 - protein, 18 aa, Entamoeba dispar
INCYCFFCIEYFLIKCKN

SEQ ID NO: 2384584 - protein, 25 aa, Entamoeba dispar
INDEMKSLLVIYPFPRTLINTPIHI

SEQ ID NO: 2384585 - protein, 17 aa, Entamoeba dispar
INDLLPFHSFLDIYIIP

SEQ ID NO: 2384586 - protein, 19 aa, Entamoeba dispar
INEDFVRIMNQYEIEIITT

SEQ ID NO: 2384587 - protein, 37 aa, Entamoeba dispar
INEFPFNKKVFLFTIIFPCIGYYGIFHLNNSNRRERL

SEQ ID NO: 2384588 - protein, 24 aa, Entamoeba dispar
INEIKHYFCTGMYSTSFTMSVMEI

SEQ ID NO: 2384589 - protein, 19 aa, Entamoeba dispar
INELCKTNMVFKRDIARIK

SEQ ID NO: 2384590 - protein, 17 aa, Entamoeba dispar
INEPRIELLTSITSLFH

SEQ ID NO: 2384591 - protein, 18 aa, Entamoeba dispar
INESCKYIGNTLSFIRTI

SEQ ID NO: 2384592 - protein, 22 aa, Entamoeba dispar
INETKEMLGREINQLKLEKENT

SEQ ID NO: 2384593 - protein, 26 aa, Entamoeba dispar
INFSVSIACPFGCNGHGRCTENGCLC

SEQ ID NO: 2384594 - protein, 20 aa, Entamoeba dispar
INFVILCFAVRYAWKKQTII

SEQ ID NO: 2384595 - protein, 26 aa, Entamoeba dispar
INFYHFLKRYLKVISPLIVSSYVIDF

SEQ ID NO: 2384596 - protein, 20 aa, Entamoeba dispar
INGCIKPDVCMLCDEKNGYT

SEQ ID NO: 2384597 - protein, 25 aa, Entamoeba dispar
INGGPETWKGISILINTNENNKQNN

SEQ ID NO: 2384598 - protein, 42 aa, Entamoeba dispar
INGLLLLKVMLLKCSFTRLKKRMPTILNELITIFNLPFDKDP

SEQ ID NO: 2384599 - protein, 18 aa, Entamoeba dispar
INGSWGFKFEQLSHYTKA

SEQ ID NO: 2384600 - protein, 19 aa, Entamoeba dispar
INHFICGVVSHWIAQLLSA

SEQ ID NO: 2384601 - protein, 18 aa, Entamoeba dispar
INIILLCTYFFQLGVIGF

SEQ ID NO: 2384602 - protein, 17 aa, Entamoeba dispar
INIKFHWIDQNKYNELH

SEQ ID NO: 2384603 - protein, 24 aa, Entamoeba dispar
INILRIGFVASLLARSGAIVVCAP

SEQ ID NO: 2384604 - protein, 19 aa, Entamoeba dispar
INIPLKVLFTRGLQQTLGH

SEQ ID NO: 2384605 - protein, 17 aa, Entamoeba dispar
INIRLFMKIKILIDAAK

SEQ ID NO: 2384606 - protein, 18 aa, Entamoeba dispar
INISEMLFNEGIQSIRFV

SEQ ID NO: 2384607 - protein, 17 aa, Entamoeba dispar
INIYISFIFSTQSFLCL

SEQ ID NO: 2384608 - protein, 22 aa, Entamoeba dispar
INIYKFEIIKGITEIKDPNNKE

SEQ ID NO: 2384609 - protein, 18 aa, Entamoeba dispar
INKESSFKEQKIDIEHTY

SEQ ID NO: 2384610 - protein, 23 aa, Entamoeba dispar
INKIIKYEAIFKKIIEERNKIIN

SEQ ID NO: 2384611 - protein, 23 aa, Entamoeba dispar
INKKIGEQLLDWAKKSLSIDSCD

SEQ ID NO: 2384612 - protein, 18 aa, Entamoeba dispar
INKNCQRFSNGISGVDTK

SEQ ID NO: 2384613 - protein, 31 aa, Entamoeba dispar
INKSALVVIAFRNVGSFDRLKLNDQIIKNYF

SEQ ID NO: 2384614 - protein, 18 aa, Entamoeba dispar
INKVILPTRIRMAIEAIK

SEQ ID NO: 2384615 - protein, 25 aa, Entamoeba dispar
INKWNIDFVGCLSYNVFSDDKTLFI

SEQ ID NO: 2384616 - protein, 18 aa, Entamoeba dispar
INLAEFISRLMGVIDNEP

SEQ ID NO: 2384617 - protein, 28 aa, Entamoeba dispar
INLAPMQVKLLWLCLCNVLSSSSSSSLL

SEQ ID NO: 2384618 - protein, 34 aa, Entamoeba dispar
INLCAIAISFIFGSCLIRFFGLYLATLLLFWGFT

SEQ ID NO: 2384619 - protein, 17 aa, Entamoeba dispar
INLKFSSNYGIQYLISS

SEQ ID NO: 2384620 - protein, 34 aa, Entamoeba dispar
INLLIGFFLAEYWKFGFIIIICSPWFFNDKKTNK

SEQ ID NO: 2384621 - protein, 17 aa, Entamoeba dispar
INLLLWIEVNDITYNDP

SEQ ID NO: 2384622 - protein, 25 aa, Entamoeba dispar
INLNKGDMVLIDFSFFKRFLSISDS

SEQ ID NO: 2384623 - protein, 20 aa, Entamoeba dispar
INLNYTWGFSPGVFIEGHIA

SEQ ID NO: 2384624 - protein, 17 aa, Entamoeba dispar
INLPGLSKSVGLNHVNE

SEQ ID NO: 2384625 - protein, 19 aa, Entamoeba dispar
INMNIVFAFVAGNQVNTKM

SEQ ID NO: 2384626 - protein, 19 aa, Entamoeba dispar
INMYKWLIEIYYKEEKYNE

SEQ ID NO: 2384627 - protein, 22 aa, Entamoeba dispar
INNIKLIWNFIVKIWDVITEFV

SEQ ID NO: 2384628 - protein, 24 aa, Entamoeba dispar
INNKTHCGGAYVFFDNYFDYGYVP

SEQ ID NO: 2384629 - protein, 17 aa, Entamoeba dispar
INNKYYWYLETQDKIIP

SEQ ID NO: 2384630 - protein, 21 aa, Entamoeba dispar
INNLFCPIVVYLNTNGVDKLV

SEQ ID NO: 2384631 - protein, 19 aa, Entamoeba dispar
INNQLWFLLSWTIMVICGA

SEQ ID NO: 2384632 - protein, 17 aa, Entamoeba dispar
INPRRLLGTKAPFEMTR

SEQ ID NO: 2384633 - protein, 18 aa, Entamoeba dispar
INPSIDFEPFRWLFTLPL

SEQ ID NO: 2384634 - protein, 17 aa, Entamoeba dispar
INQCFPKLIGDLDINSM

SEQ ID NO: 2384635 - protein, 20 aa, Entamoeba dispar
INQIIRCLYGIKSIQFQFID

SEQ ID NO: 2384636 - protein, 19 aa, Entamoeba dispar
INQKISYGIIILIVLTTLI

SEQ ID NO: 2384637 - protein, 19 aa, Entamoeba dispar
INREIIKSLKLNSPSLEEE

SEQ ID NO: 2384638 - protein, 22 aa, Entamoeba dispar
INRKRLIFLTSFTSIIISVCLL

SEQ ID NO: 2384639 - protein, 18 aa, Entamoeba dispar
INSIFPILLLSVNGYKTT

SEQ ID NO: 2384640 - protein, 17 aa, Entamoeba dispar
INSRFGTMKDFEELLFK

SEQ ID NO: 2384641 - protein, 17 aa, Entamoeba dispar
INSSVPVIVTFDSSTPY

SEQ ID NO: 2384642 - protein, 18 aa, Entamoeba dispar
INTGISMMNSITKTQQTV

SEQ ID NO: 2384643 - protein, 18 aa, Entamoeba dispar
INTLMSMLIIAKKLTKCD

SEQ ID NO: 2384644 - protein, 35 aa, Entamoeba dispar
INVKSYLAYSWIFDCPKGFFDKSSWLLSLPEDWFE

SEQ ID NO: 2384645 - protein, 20 aa, Entamoeba dispar
INVLVCAKCTTKVDDNIFIT

SEQ ID NO: 2384646 - protein, 18 aa, Entamoeba dispar
INVQGSCTYCLNAKSKSY

SEQ ID NO: 2384647 - protein, 19 aa, Entamoeba dispar
INWIYRYATEPSYWSPLTW

SEQ ID NO: 2384648 - protein, 23 aa, Entamoeba dispar
INYFIFLKRGKWGLLGNTPTIVF

SEQ ID NO: 2384649 - protein, 19 aa, Entamoeba dispar
INYGMRTHQRIGGGRRWFE

SEQ ID NO: 2384650 - protein, 25 aa, Entamoeba dispar
INYLFKRLNQFFGQKLNFESIGIIG

SEQ ID NO: 2384651 - protein, 23 aa, Entamoeba dispar
INYVELCCLFSQYYENDFCKELN

SEQ ID NO: 2384652 - protein, 21 aa, Entamoeba dispar
IPACCDLCATALSNVGLLWIP

SEQ ID NO: 2384653 - protein, 21 aa, Entamoeba dispar
IPADGLSCFCEQIWETIKDNK

SEQ ID NO: 2384654 - protein, 22 aa, Entamoeba dispar
IPAQYGYFLFWALKSKENIGKY

SEQ ID NO: 2384655 - protein, 19 aa, Entamoeba dispar
IPCLQYRKDIVIILFVNSN

SEQ ID NO: 2384656 - protein, 17 aa, Entamoeba dispar
IPDAWPTQTGACLDEQE

SEQ ID NO: 2384657 - protein, 17 aa, Entamoeba dispar
IPDTLKFLDQKVLDNTD

SEQ ID NO: 2384658 - protein, 23 aa, Entamoeba dispar
IPEEMRYGYDIINGCRHNDILEN

SEQ ID NO: 2384659 - protein, 22 aa, Entamoeba dispar
IPEIVKYCVPFEEPISINLIKK

SEQ ID NO: 2384660 - protein, 17 aa, Entamoeba dispar
IPENRITPVKGQLARGT

SEQ ID NO: 2384661 - protein, 21 aa, Entamoeba dispar
IPERDPVAALGINGGLQMSIP

SEQ ID NO: 2384662 - protein, 19 aa, Entamoeba dispar
IPFEIVFHVLFTVLDLLFN

SEQ ID NO: 2384663 - protein, 17 aa, Entamoeba dispar
IPFISANSINLNYSNEV

SEQ ID NO: 2384664 - protein, 19 aa, Entamoeba dispar
IPFLHHIMLLILWTVPITR

SEQ ID NO: 2384665 - protein, 31 aa, Entamoeba dispar
IPFPCKELLLSCWKINTERLISIDEIVMKVE

SEQ ID NO: 2384666 - protein, 23 aa, Entamoeba dispar
IPFQENLLLLALSFYDVVRVAKR

SEQ ID NO: 2384667 - protein, 27 aa, Entamoeba dispar
IPFQLILGIISLCWLGWNQLIGGIAIV

SEQ ID NO: 2384668 - protein, 17 aa, Entamoeba dispar
IPFSSKCILEFCSKNQD

SEQ ID NO: 2384669 - protein, 19 aa, Entamoeba dispar
IPFVMVLSYFILKRRFNLI

SEQ ID NO: 2384670 - protein, 18 aa, Entamoeba dispar
IPFWKIVVGVFVRMVLFP

SEQ ID NO: 2384671 - protein, 24 aa, Entamoeba dispar
IPGIVRERILIFVLRHKRSNEFGD

SEQ ID NO: 2384672 - protein, 25 aa, Entamoeba dispar
IPHAKIVALLLWPSPTPLLYDDMKK

SEQ ID NO: 2384673 - protein, 23 aa, Entamoeba dispar
IPHCSFVSTKICERCEDGYYKTK

SEQ ID NO: 2384674 - protein, 23 aa, Entamoeba dispar
IPHFISLNMLMRFHQVSHNCGEA

SEQ ID NO: 2384675 - protein, 28 aa, Entamoeba dispar
IPHIGSLASLLHKPPEVFVSSLKAQAGG

SEQ ID NO: 2384676 - protein, 22 aa, Entamoeba dispar
IPHISVICAIIIAAYPIVDSTF

SEQ ID NO: 2384677 - protein, 22 aa, Entamoeba dispar
IPHLCALSLLFYAPTTVHGELE

SEQ ID NO: 2384678 - protein, 20 aa, Entamoeba dispar
IPHVCYTGSVKHDFTAGEIM

SEQ ID NO: 2384679 - protein, 27 aa, Entamoeba dispar
IPIATKFRIINEISKGLAYLHDLNPPI

SEQ ID NO: 2384680 - protein, 20 aa, Entamoeba dispar
IPICNLIIILSISFGTLYPV

SEQ ID NO: 2384681 - protein, 29 aa, Entamoeba dispar
IPIHCFELLWKVFIVLKYGLLNKLILTNN

SEQ ID NO: 2384682 - protein, 24 aa, Entamoeba dispar
IPIIERLLLYLLYFWDKVGLSLTI

SEQ ID NO: 2384683 - protein, 20 aa, Entamoeba dispar
IPIIICIIITLIIIICIGSI

SEQ ID NO: 2384684 - protein, 18 aa, Entamoeba dispar
IPIINIFLSPFVFASLVV

SEQ ID NO: 2384685 - protein, 21 aa, Entamoeba dispar
IPIIVKGLIGFKEDVMKDFYE

SEQ ID NO: 2384686 - protein, 25 aa, Entamoeba dispar
IPIMLNEWYSIYLLHKNDGSFQIQC

SEQ ID NO: 2384687 - protein, 21 aa, Entamoeba dispar
IPINLKFSSNYGIQYLISSYE

SEQ ID NO: 2384688 - protein, 23 aa, Entamoeba dispar
IPISIRVNLDISKLIYSMFISTD

SEQ ID NO: 2384689 - protein, 27 aa, Entamoeba dispar
IPISLRINLEISKIFYSLLINYDPNIP

SEQ ID NO: 2384690 - protein, 26 aa, Entamoeba dispar
IPISMRVNLDIAKMVYAFFINKDKDI

SEQ ID NO: 2384691 - protein, 21 aa, Entamoeba dispar
IPITLRYGQLGNILKEIKKEN

SEQ ID NO: 2384692 - protein, 17 aa, Entamoeba dispar
IPKCLFNQFKYFYNLYF

SEQ ID NO: 2384693 - protein, 17 aa, Entamoeba dispar
IPKENIMSFGRQINLYL

SEQ ID NO: 2384694 - protein, 17 aa, Entamoeba dispar
IPKLASVAMVSFINQNS

SEQ ID NO: 2384695 - protein, 17 aa, Entamoeba dispar
IPKQCLYHDMIKKCWKG

SEQ ID NO: 2384696 - protein, 19 aa, Entamoeba dispar
IPLEILSVYHKTNITANEE

SEQ ID NO: 2384697 - protein, 20 aa, Entamoeba dispar
IPLFECLMSDIFQFIIKYHS

SEQ ID NO: 2384698 - protein, 22 aa, Entamoeba dispar
IPLIFICSIFIINICLFSIIHI

SEQ ID NO: 2384699 - protein, 22 aa, Entamoeba dispar
IPLLQCMNWMCIFRKPRSERIR

SEQ ID NO: 2384700 - protein, 22 aa, Entamoeba dispar
IPLNEIPNGFTISFCTIHDECV

SEQ ID NO: 2384701 - protein, 22 aa, Entamoeba dispar
IPLPCLHSTALALTFSRDIFSR

SEQ ID NO: 2384702 - protein, 23 aa, Entamoeba dispar
IPLPPRAAVVLYYSYLGRSLEII

SEQ ID NO: 2384703 - protein, 19 aa, Entamoeba dispar
IPLSCEVTPFAKMFEGEKL

SEQ ID NO: 2384704 - protein, 17 aa, Entamoeba dispar
IPLSIYYIFSWGFTSLY

SEQ ID NO: 2384705 - protein, 23 aa, Entamoeba dispar
IPLSTMSGLIGWVPHSDTLHQLI

SEQ ID NO: 2384706 - protein, 17 aa, Entamoeba dispar
IPLTVVFLAFFSGSLSS

SEQ ID NO: 2384707 - protein, 20 aa, Entamoeba dispar
IPLVILWIILIVIEIGIFAV

SEQ ID NO: 2384708 - protein, 17 aa, Entamoeba dispar
IPMNLRIKFMIDAAKGI

SEQ ID NO: 2384709 - protein, 20 aa, Entamoeba dispar
IPMYRFMIEDTINYMYDSMK

SEQ ID NO: 2384710 - protein, 19 aa, Entamoeba dispar
IPNAIKFIIRSVQRKEGVL

SEQ ID NO: 2384711 - protein, 19 aa, Entamoeba dispar
IPNCDLCSPLELVCQECKN

SEQ ID NO: 2384712 - protein, 18 aa, Entamoeba dispar
IPNKIRIKFMLDGAKGIS

SEQ ID NO: 2384713 - protein, 19 aa, Entamoeba dispar
IPNKIRIKFMLDGAKGISY

SEQ ID NO: 2384714 - protein, 17 aa, Entamoeba dispar
IPNLLIILADNFLYCSH

SEQ ID NO: 2384715 - protein, 18 aa, Entamoeba dispar
IPNSISINFIITKYRKIN

SEQ ID NO: 2384716 - protein, 23 aa, Entamoeba dispar
IPNYVFWLSLPMLIKDGCKFIFC

SEQ ID NO: 2384717 - protein, 18 aa, Entamoeba dispar
IPPMFRFLQCFRSARDSG

SEQ ID NO: 2384718 - protein, 17 aa, Entamoeba dispar
IPPSLIVSVEGWFGVSF

SEQ ID NO: 2384719 - protein, 25 aa, Entamoeba dispar
IPQIRSGIHTIIWETIRYFLRSSNE

SEQ ID NO: 2384720 - protein, 17 aa, Entamoeba dispar
IPQNGFFSWALIHLFTL

SEQ ID NO: 2384721 - protein, 19 aa, Entamoeba dispar
IPQTIEWVGDRLYYIQGDL

SEQ ID NO: 2384722 - protein, 19 aa, Entamoeba dispar
IPSDCIIKTIQLCAKNKIM

SEQ ID NO: 2384723 - protein, 25 aa, Entamoeba dispar
IPSGHSGCTFAFLRINQPVDNVDKV

SEQ ID NO: 2384724 - protein, 24 aa, Entamoeba dispar
IPSLLPFLKAVCGSKKSWYARHTG

SEQ ID NO: 2384725 - protein, 32 aa, Entamoeba dispar
IPSQEKRSKCWLATQILRIDFISVLNSYEYFY

SEQ ID NO: 2384726 - protein, 19 aa, Entamoeba dispar
IPSSIIKPSARGVILNILD

SEQ ID NO: 2384727 - protein, 24 aa, Entamoeba dispar
IPSTEYKTSIVLLIQAISNVVSQN

SEQ ID NO: 2384728 - protein, 24 aa, Entamoeba dispar
IPSTEYKTSVILLIQALSTILNQI

SEQ ID NO: 2384729 - protein, 18 aa, Entamoeba dispar
IPTALKMIRFHLKGKIKQ

SEQ ID NO: 2384730 - protein, 23 aa, Entamoeba dispar
IPTCLKTLIDECWKQKPDERPKF

SEQ ID NO: 2384731 - protein, 24 aa, Entamoeba dispar
IPTDQRLISSFSYLENEYIEKTPL

SEQ ID NO: 2384732 - protein, 21 aa, Entamoeba dispar
IPTNGFRCVSEEVFEGQVVHG

SEQ ID NO: 2384733 - protein, 26 aa, Entamoeba dispar
IPTSMPFHYFMLFVRMLISLTNSIIL

SEQ ID NO: 2384734 - protein, 39 aa, Entamoeba dispar
IPTTFGIKWLRLLFSREFPLDLVLQLWDGIFAFGNGLII

SEQ ID NO: 2384735 - protein, 17 aa, Entamoeba dispar
IPTTMIKIIRFSIEYSG

SEQ ID NO: 2384736 - protein, 17 aa, Entamoeba dispar
IPVGIILVFTTYNYYYF

SEQ ID NO: 2384737 - protein, 24 aa, Entamoeba dispar
IPVKVIFCLIGICYLAVDALIIFV

SEQ ID NO: 2384738 - protein, 24 aa, Entamoeba dispar
IPVNRYTIPLIFYLTTSNNDFLQY

SEQ ID NO: 2384739 - protein, 19 aa, Entamoeba dispar
IPVTFKPICFDNCNNDKGH

SEQ ID NO: 2384740 - protein, 17 aa, Entamoeba dispar
IPWYGLMVASVVIPYYI

SEQ ID NO: 2384741 - protein, 17 aa, Entamoeba dispar
IPYDILTHYGVNLPQEI

SEQ ID NO: 2384742 - protein, 19 aa, Entamoeba dispar
IPYIFIKTLCKWNVSLPEK

SEQ ID NO: 2384743 - protein, 20 aa, Entamoeba dispar
IPYSYCRKVIPQMIQIPFLL

SEQ ID NO: 2384744 - protein, 19 aa, Entamoeba dispar
IQAKPTFSISGLKNLLMKI

SEQ ID NO: 2384745 - protein, 17 aa, Entamoeba dispar
IQAVFPFDSNRKRMSVL

SEQ ID NO: 2384746 - protein, 22 aa, Entamoeba dispar
IQDGGVFFVEIIFKISQTSFGL

SEQ ID NO: 2384747 - protein, 17 aa, Entamoeba dispar
IQEIYQFFISLKEQIIQ

SEQ ID NO: 2384748 - protein, 18 aa, Entamoeba dispar
IQEMILNGMYWFECLFNA

SEQ ID NO: 2384749 - protein, 24 aa, Entamoeba dispar
IQESFPIGILYPFHLLIESDVQTM

SEQ ID NO: 2384750 - protein, 25 aa, Entamoeba dispar
IQFGKLYGEIILKGVLKNCALIHLL

SEQ ID NO: 2384751 - protein, 21 aa, Entamoeba dispar
IQFGVCTSAKGFIEPLYGYFA

SEQ ID NO: 2384752 - protein, 25 aa, Entamoeba dispar
IQFLSKRPTHYFLYYINDIIFHLII

SEQ ID NO: 2384753 - protein, 21 aa, Entamoeba dispar
IQFPYSHIGLGRISNYIQVVE

SEQ ID NO: 2384754 - protein, 17 aa, Entamoeba dispar
IQFRGLGNIVCISKIEV

SEQ ID NO: 2384755 - protein, 19 aa, Entamoeba dispar
IQGCLECNEGFYLSEGSQC

SEQ ID NO: 2384756 - protein, 27 aa, Entamoeba dispar
IQHFVNRPLGIYFIKYFVQILRNYKEE

SEQ ID NO: 2384757 - protein, 27 aa, Entamoeba dispar
IQIKKLQECYILASKLPVTFCNHKEIM

SEQ ID NO: 2384758 - protein, 18 aa, Entamoeba dispar
IQIPESRCVSIFSNCKIG

SEQ ID NO: 2384759 - protein, 25 aa, Entamoeba dispar
IQISRYACEFEIFITIKCTTKIKEQ

SEQ ID NO: 2384760 - protein, 25 aa, Entamoeba dispar
IQIVTSVAIFLARGRVIKSLINHFK

SEQ ID NO: 2384761 - protein, 17 aa, Entamoeba dispar
IQKAFIISVIVGMEENS

SEQ ID NO: 2384762 - protein, 17 aa, Entamoeba dispar
IQKAFIISVIVGMEENT

SEQ ID NO: 2384763 - protein, 24 aa, Entamoeba dispar
IQKLSSGCVVIDCESVIKELVENA

SEQ ID NO: 2384764 - protein, 29 aa, Entamoeba dispar
IQLFVFSCVLYIFICLMFLISTVYQVQIW

SEQ ID NO: 2384765 - protein, 22 aa, Entamoeba dispar
IQLGSKELFVFLINLKIPLSMK

SEQ ID NO: 2384766 - protein, 25 aa, Entamoeba dispar
IQLHSILRCGRLIMNSKTRIVGYNG

SEQ ID NO: 2384767 - protein, 17 aa, Entamoeba dispar
IQLILFIVFVNRINGLS

SEQ ID NO: 2384768 - protein, 20 aa, Entamoeba dispar
IQLINPCIDKQVIFIIIDIL

SEQ ID NO: 2384769 - protein, 17 aa, Entamoeba dispar
IQLKVCSFLQPKHLFSL

SEQ ID NO: 2384770 - protein, 36 aa, Entamoeba dispar
IQLLEKDFHKMGGWFKVCIAVLISVLVLTVGVIIFG

SEQ ID NO: 2384771 - protein, 17 aa, Entamoeba dispar
IQLRIKIIKDISKAIQY

SEQ ID NO: 2384772 - protein, 18 aa, Entamoeba dispar
IQLSSLLLNNAYEYTLYL

SEQ ID NO: 2384773 - protein, 17 aa, Entamoeba dispar
IQLVVIFPIHFFFTNYY

SEQ ID NO: 2384774 - protein, 21 aa, Entamoeba dispar
IQNKVSWAKQQVELIKNEPGL

SEQ ID NO: 2384775 - protein, 19 aa, Entamoeba dispar
IQPSYFCLLSTRKLTQSNR

SEQ ID NO: 2384776 - protein, 19 aa, Entamoeba dispar
IQQYFKLVIGTLYLNNNID

SEQ ID NO: 2384777 - protein, 18 aa, Entamoeba dispar
IQRLELYNSTLINKNVTS

SEQ ID NO: 2384778 - protein, 17 aa, Entamoeba dispar
IQSIRFVDEAQAISRLY

SEQ ID NO: 2384779 - protein, 24 aa, Entamoeba dispar
IQSTICCKLGHYWNISQITGLPKL

SEQ ID NO: 2384780 - protein, 18 aa, Entamoeba dispar
IQTEISRTLEISRNHQCP

SEQ ID NO: 2384781 - protein, 19 aa, Entamoeba dispar
IQTGHRVDRKFGWDTHGLP

SEQ ID NO: 2384782 - protein, 25 aa, Entamoeba dispar
IQTKFNFLILLKFLIVKEIIEECKE

SEQ ID NO: 2384783 - protein, 18 aa, Entamoeba dispar
IQTLYCFEIIKREPSSLP

SEQ ID NO: 2384784 - protein, 17 aa, Entamoeba dispar
IQTPSLFSLIKKQTKTS

SEQ ID NO: 2384785 - protein, 19 aa, Entamoeba dispar
IQVKFKFLCTCFVNEIVDV

SEQ ID NO: 2384786 - protein, 24 aa, Entamoeba dispar
IQVYYKAGGSWGPLQNEMIVSNDQ

SEQ ID NO: 2384787 - protein, 22 aa, Entamoeba dispar
IQYFKQYCKIIGEYGVNSGVDV

SEQ ID NO: 2384788 - protein, 22 aa, Entamoeba dispar
IRALIMKHFIHIISYSKLQKIF

SEQ ID NO: 2384789 - protein, 17 aa, Entamoeba dispar
IRAVRGVVVNEIIEGEL

SEQ ID NO: 2384790 - protein, 18 aa, Entamoeba dispar
IRDIPKLASVAMVSFINQ

SEQ ID NO: 2384791 - protein, 18 aa, Entamoeba dispar
IREEVAKLFDIQTFSDNN

SEQ ID NO: 2384792 - protein, 25 aa, Entamoeba dispar
IREFGKKYLGLKCPHAQFTEARSAI

SEQ ID NO: 2384793 - protein, 30 aa, Entamoeba dispar
IREFGKKYMGLKCPHAQFTLAKDYLVKGYL

SEQ ID NO: 2384794 - protein, 20 aa, Entamoeba dispar
IREFGKKYSALKCPHAQFTE

SEQ ID NO: 2384795 - protein, 25 aa, Entamoeba dispar
IREFGKKYSALKCPHAQFTEARSAI

SEQ ID NO: 2384796 - protein, 24 aa, Entamoeba dispar
IREIKELSFDFSIKSNKKKEKKRS

SEQ ID NO: 2384797 - protein, 17 aa, Entamoeba dispar
IRELICIGNENKEKKKI

SEQ ID NO: 2384798 - protein, 23 aa, Entamoeba dispar
IRELRKSELLNFIKSPPKPSSFL

SEQ ID NO: 2384799 - protein, 25 aa, Entamoeba dispar
IRFFECGYELYGYCLVFELHIINLN

SEQ ID NO: 2384800 - protein, 17 aa, Entamoeba dispar
IRFLCVILMFVCNSAGG

SEQ ID NO: 2384801 - protein, 20 aa, Entamoeba dispar
IRFNQWFLTFTFVLAFILWP

SEQ ID NO: 2384802 - protein, 26 aa, Entamoeba dispar
IRGCKYCNDTKCFVCGNDEGKQLYLS

SEQ ID NO: 2384803 - protein, 18 aa, Entamoeba dispar
IRGRETFTVPEHWKNQKK

SEQ ID NO: 2384804 - protein, 18 aa, Entamoeba dispar
IRGYGIKDFIQWIENQQI

SEQ ID NO: 2384805 - protein, 20 aa, Entamoeba dispar
IRILMRLHPGINLTDEQANS

SEQ ID NO: 2384806 - protein, 19 aa, Entamoeba dispar
IRISLEKVLNANALERPLQ

SEQ ID NO: 2384807 - protein, 22 aa, Entamoeba dispar
IRKEIMSSIAVLNGTNYSSGNL

SEQ ID NO: 2384808 - protein, 27 aa, Entamoeba dispar
IRKKDVNCLYSLIPILGVILPLNVLIT

SEQ ID NO: 2384809 - protein, 17 aa, Entamoeba dispar
IRKPTIVNITKFQINMT

SEQ ID NO: 2384810 - protein, 21 aa, Entamoeba dispar
IRKSIFKSFMNILVKLNAVSE

SEQ ID NO: 2384811 - protein, 19 aa, Entamoeba dispar
IRLFMKIKILIDAAKGIQY

SEQ ID NO: 2384812 - protein, 21 aa, Entamoeba dispar
IRLISCNCVPQVYASQKIYSG

SEQ ID NO: 2384813 - protein, 17 aa, Entamoeba dispar
IRLITVFSLYVLSIIIL

SEQ ID NO: 2384814 - protein, 19 aa, Entamoeba dispar
IRLLISIPFTLNIPTLFYP

SEQ ID NO: 2384815 - protein, 19 aa, Entamoeba dispar
IRLPSCSFTSEMCKTCKNH

SEQ ID NO: 2384816 - protein, 21 aa, Entamoeba dispar
IRMKRTVMIIFSIIETIMCTM

SEQ ID NO: 2384817 - protein, 18 aa, Entamoeba dispar
IRNYLCSFDEIISETSFG

SEQ ID NO: 2384818 - protein, 22 aa, Entamoeba dispar
IRRLHVFGEIFAENGFLQRSDQ

SEQ ID NO: 2384819 - protein, 18 aa, Entamoeba dispar
IRRYHKIWSCPRCFTAVH

SEQ ID NO: 2384820 - protein, 21 aa, Entamoeba dispar
IRSEGSVSFEDCYSVSMDSGD

SEQ ID NO: 2384821 - protein, 22 aa, Entamoeba dispar
IRSLLFKFGRIYVPDKFPYIQM

SEQ ID NO: 2384822 - protein, 20 aa, Entamoeba dispar
IRSQFIINFIGSVITPDKLC

SEQ ID NO: 2384823 - protein, 25 aa, Entamoeba dispar
IRSTLMKEMNYRDYVNIPKIEPRKI

SEQ ID NO: 2384824 - protein, 24 aa, Entamoeba dispar
IRTCGVDAIPFWDAIRNCLDSDAV

SEQ ID NO: 2384825 - protein, 19 aa, Entamoeba dispar
IRTILDAMERWRMRTEEPM

SEQ ID NO: 2384826 - protein, 18 aa, Entamoeba dispar
IRTMIITYKEFIFKRPNN

SEQ ID NO: 2384827 - protein, 22 aa, Entamoeba dispar
IRVGANLIKKGTVRITVYTIPI

SEQ ID NO: 2384828 - protein, 17 aa, Entamoeba dispar
IRVGLDVNDTAFQDGSY

SEQ ID NO: 2384829 - protein, 18 aa, Entamoeba dispar
IRVITLRRSYTCNSRYST

SEQ ID NO: 2384830 - protein, 21 aa, Entamoeba dispar
IRVKCIEIIDKFILNDNDFTL

SEQ ID NO: 2384831 - protein, 17 aa, Entamoeba dispar
IRVKLSIPKHCYGYLNV

SEQ ID NO: 2384832 - protein, 33 aa, Entamoeba dispar
IRVLVFYFNKLISIILDWARYTKYSIIDFYHTL

SEQ ID NO: 2384833 - protein, 17 aa, Entamoeba dispar
IRVNKRWMSDSVGKDVA

SEQ ID NO: 2384834 - protein, 20 aa, Entamoeba dispar
IRVVIPLIIFLNIALFVTSN

SEQ ID NO: 2384835 - protein, 18 aa, Entamoeba dispar
IRVYAFNVICWLLPIKFG

SEQ ID NO: 2384836 - protein, 18 aa, Entamoeba dispar
IRYCYVCKCFIPQRCFHC

SEQ ID NO: 2384837 - protein, 17 aa, Entamoeba dispar
IRYGFCGLIGAITLLFV

SEQ ID NO: 2384838 - protein, 17 aa, Entamoeba dispar
ISAPCGYISTIEDYPGK

SEQ ID NO: 2384839 - protein, 18 aa, Entamoeba dispar
ISCCSIPLLIIIVGLFDV

SEQ ID NO: 2384840 - protein, 19 aa, Entamoeba dispar
ISCFLNFIWPKESIEKAYE

SEQ ID NO: 2384841 - protein, 17 aa, Entamoeba dispar
ISCYCFLLVFIRMLVEL

SEQ ID NO: 2384842 - protein, 39 aa, Entamoeba dispar
ISDCYIIILLFDRWRSVLFHWKYYLQRVLPNDETIKMRI

SEQ ID NO: 2384843 - protein, 21 aa, Entamoeba dispar
ISDEMILFVQLIRYISNLPKM

SEQ ID NO: 2384844 - protein, 19 aa, Entamoeba dispar
ISDGKCVSCNDGTDFIGCS

SEQ ID NO: 2384845 - protein, 21 aa, Entamoeba dispar
ISDIPKLVAFILYLISIALVL

SEQ ID NO: 2384846 - protein, 23 aa, Entamoeba dispar
ISDNRKNLLISFALSPLPICIVS

SEQ ID NO: 2384847 - protein, 22 aa, Entamoeba dispar
ISEEASVFVGVFLFVENVVQTI

SEQ ID NO: 2384848 - protein, 27 aa, Entamoeba dispar
ISEIQRKGGIFSNCLDEHVTHLIAYKK

SEQ ID NO: 2384849 - protein, 22 aa, Entamoeba dispar
ISELKELWILPVASIIHTSLQF

SEQ ID NO: 2384850 - protein, 21 aa, Entamoeba dispar
ISESIQLLSLQLFKNNPQMKK

SEQ ID NO: 2384851 - protein, 18 aa, Entamoeba dispar
ISESLAFFLGYLTSMPAV

SEQ ID NO: 2384852 - protein, 25 aa, Entamoeba dispar
ISFALRLINSHSFLSIRNLILRHIF

SEQ ID NO: 2384853 - protein, 20 aa, Entamoeba dispar
ISFELLLEFIYKSHRRNKSI

SEQ ID NO: 2384854 - protein, 21 aa, Entamoeba dispar
ISFFIGWHMVMAIGGADMPVV

SEQ ID NO: 2384855 - protein, 18 aa, Entamoeba dispar
ISFGTLYPVAKYSEYYSI

SEQ ID NO: 2384856 - protein, 22 aa, Entamoeba dispar
ISFIFNCIFALFLISQLVLLTL

SEQ ID NO: 2384857 - protein, 27 aa, Entamoeba dispar
ISFIIFKFIIKNGIAWQVEFGGCIGLN

SEQ ID NO: 2384858 - protein, 20 aa, Entamoeba dispar
ISFIPYLYLFGWNTISIEDT

SEQ ID NO: 2384859 - protein, 18 aa, Entamoeba dispar
ISFIYSLPLTIAFSNIIT

SEQ ID NO: 2384860 - protein, 20 aa, Entamoeba dispar
ISFLSIVKWLFCHSTKRKVD

SEQ ID NO: 2384861 - protein, 24 aa, Entamoeba dispar
ISFNYKSSSIVLWFCPQSIINESQ

SEQ ID NO: 2384862 - protein, 19 aa, Entamoeba dispar
ISFSDTHFDFGFSNKPAPV

SEQ ID NO: 2384863 - protein, 31 aa, Entamoeba dispar
ISFWRYPRIETFFKFLCCTQIRDHPLEFMCC

SEQ ID NO: 2384864 - protein, 23 aa, Entamoeba dispar
ISGGEIFIVYAAKVFAEKRDEYK

SEQ ID NO: 2384865 - protein, 20 aa, Entamoeba dispar
ISGIPILVTINGYRYPRNEN

SEQ ID NO: 2384866 - protein, 19 aa, Entamoeba dispar
ISGIVSNFIDKGRTNNDRI

SEQ ID NO: 2384867 - protein, 25 aa, Entamoeba dispar
ISGLARFSLTKVFCDIRPDYIIKSN

SEQ ID NO: 2384868 - protein, 20 aa, Entamoeba dispar
ISGLQIKSGYLILSSKRILM

SEQ ID NO: 2384869 - protein, 22 aa, Entamoeba dispar
ISHELKDEIAIFIVAIHSTIEQ

SEQ ID NO: 2384870 - protein, 19 aa, Entamoeba dispar
ISHHFKKSFNIPFELEFFM

SEQ ID NO: 2384871 - protein, 23 aa, Entamoeba dispar
ISHKLSCIVLEYYPLGTIDHFLD

SEQ ID NO: 2384872 - protein, 19 aa, Entamoeba dispar
ISHPCIDGAVDIDLIDVID

SEQ ID NO: 2384873 - protein, 26 aa, Entamoeba dispar
ISHVEPRLAVAVVLLFLYLGIFAGDI

SEQ ID NO: 2384874 - protein, 18 aa, Entamoeba dispar
ISHYLVCRKMIVIAMNSE

SEQ ID NO: 2384875 - protein, 22 aa, Entamoeba dispar
ISIEFKKCYYFGEDGSMYATHD

SEQ ID NO: 2384876 - protein, 20 aa, Entamoeba dispar
ISIIFSWKKTSGIAVSKVVL

SEQ ID NO: 2384877 - protein, 30 aa, Entamoeba dispar
ISIINIISSVLWRWLLGCMASDFPLYTTIE

SEQ ID NO: 2384878 - protein, 32 aa, Entamoeba dispar
ISIKLPFGMNIKKYWFNPSINNILSFSFKEDY

SEQ ID NO: 2384879 - protein, 18 aa, Entamoeba dispar
ISILERYKHNYNYNENIP

SEQ ID NO: 2384880 - protein, 24 aa, Entamoeba dispar
ISINRSVLFFLFITYFFKILSRNK

SEQ ID NO: 2384881 - protein, 26 aa, Entamoeba dispar
ISITSRIEGTFTFKKPVKLINIHSPK

SEQ ID NO: 2384882 - protein, 17 aa, Entamoeba dispar
ISITWENGESLTINYKI

SEQ ID NO: 2384883 - protein, 31 aa, Entamoeba dispar
ISIVIAGLVFRRASYSFGLFIFGGITAILFI

SEQ ID NO: 2384884 - protein, 20 aa, Entamoeba dispar
ISIYEILTWQEAYPTSDPRF

SEQ ID NO: 2384885 - protein, 20 aa, Entamoeba dispar
ISIYSVMTWEDPYPKQEFEY

SEQ ID NO: 2384886 - protein, 26 aa, Entamoeba dispar
ISKDKCLRCSSQFLLNEGKCITNEEA

SEQ ID NO: 2384887 - protein, 18 aa, Entamoeba dispar
ISKGACSLVINRNSLQRL

SEQ ID NO: 2384888 - protein, 30 aa, Entamoeba dispar
ISKNHYKQHFEIIKTIILLPQQLSEIALIT

SEQ ID NO: 2384889 - protein, 26 aa, Entamoeba dispar
ISKTLKWYYHLVILIAVMVGVMLIII

SEQ ID NO: 2384890 - protein, 25 aa, Entamoeba dispar
ISKYLNKWISSTFMNFRKEKPRKVS

SEQ ID NO: 2384891 - protein, 19 aa, Entamoeba dispar
ISLANGFLSFYIYRKSLIH

SEQ ID NO: 2384892 - protein, 20 aa, Entamoeba dispar
ISLCDGVLYPLIAILIGDVF

SEQ ID NO: 2384893 - protein, 22 aa, Entamoeba dispar
ISLDMDFTFLLIFYSLKSRKPT

SEQ ID NO: 2384894 - protein, 23 aa, Entamoeba dispar
ISLELKNPFFIFFATEVFQIQTT

SEQ ID NO: 2384895 - protein, 17 aa, Entamoeba dispar
ISLFIMTVPSAFEFSQQ

SEQ ID NO: 2384896 - protein, 20 aa, Entamoeba dispar
ISLIENWRDAFLVRKDLSLL

SEQ ID NO: 2384897 - protein, 21 aa, Entamoeba dispar
ISLIFICIGIYLFFKIKTLQP

SEQ ID NO: 2384898 - protein, 26 aa, Entamoeba dispar
ISLIICYKQRLSVIHYLYSLIPMATV

SEQ ID NO: 2384899 - protein, 19 aa, Entamoeba dispar
ISLIRKSLWARQADGSGLQ

SEQ ID NO: 2384900 - protein, 23 aa, Entamoeba dispar
ISLKDAYSVYKHRYVQELDAGLC

SEQ ID NO: 2384901 - protein, 17 aa, Entamoeba dispar
ISLKDIMQFPVLYLEMQ

SEQ ID NO: 2384902 - protein, 25 aa, Entamoeba dispar
ISLKYLCCDPLNCFALFVLTTYTLG

SEQ ID NO: 2384903 - protein, 17 aa, Entamoeba dispar
ISLKYNHKFNCSFFDPL

SEQ ID NO: 2384904 - protein, 17 aa, Entamoeba dispar
ISLLERYKHNYNYNENI

SEQ ID NO: 2384905 - protein, 23 aa, Entamoeba dispar
ISLLSPFCGFSIKKPRKQTLVRH

SEQ ID NO: 2384906 - protein, 20 aa, Entamoeba dispar
ISLLTPIIFICFCSFTTSVI

SEQ ID NO: 2384907 - protein, 18 aa, Entamoeba dispar
ISLPLSFAGAVVITLNLI

SEQ ID NO: 2384908 - protein, 20 aa, Entamoeba dispar
ISLPTSYKFNIQSNVTNLSI

SEQ ID NO: 2384909 - protein, 26 aa, Entamoeba dispar
ISLRVFDFILMDGFCALMSVARTVMF

SEQ ID NO: 2384910 - protein, 24 aa, Entamoeba dispar
ISLYVCLEIIKLIQAFFIENDEDI

SEQ ID NO: 2384911 - protein, 17 aa, Entamoeba dispar
ISLYVPPCRPLINLTYF

SEQ ID NO: 2384912 - protein, 17 aa, Entamoeba dispar
ISMADGFVLTYSITSKE

SEQ ID NO: 2384913 - protein, 24 aa, Entamoeba dispar
ISMPRSGSTFTHFCLASDPHASSI

SEQ ID NO: 2384914 - protein, 18 aa, Entamoeba dispar
ISNDKDCYQYCGSCMPGF

SEQ ID NO: 2384915 - protein, 19 aa, Entamoeba dispar
ISNHMAGYWILFVVGSIVF

SEQ ID NO: 2384916 - protein, 31 aa, Entamoeba dispar
ISNIRYFDYIFRIIETMSFYIVTLLVASGWS

SEQ ID NO: 2384917 - protein, 28 aa, Entamoeba dispar
ISNISFKWLTNEWLHFSKLKEYYSVYTL

SEQ ID NO: 2384918 - protein, 24 aa, Entamoeba dispar
ISNKVMLCPEGFYSDGTQCLHCEE

SEQ ID NO: 2384919 - protein, 24 aa, Entamoeba dispar
ISNLLRLVFNLKVFELNTEIINLE

SEQ ID NO: 2384920 - protein, 25 aa, Entamoeba dispar
ISNPLIPFHSCFALIQSSPEILDKN

SEQ ID NO: 2384921 - protein, 18 aa, Entamoeba dispar
ISNSYILRNGICTYFDDT

SEQ ID NO: 2384922 - protein, 23 aa, Entamoeba dispar
ISNYRKTIYFMFENELESVTPGS

SEQ ID NO: 2384923 - protein, 22 aa, Entamoeba dispar
ISPDFSYIFNIIKKEVMKKWPE

SEQ ID NO: 2384924 - protein, 28 aa, Entamoeba dispar
ISPESSVSFATCFSNYYRAFADSASTNC

SEQ ID NO: 2384925 - protein, 20 aa, Entamoeba dispar
ISPFIVVRMSMVFLTIGEAI

SEQ ID NO: 2384926 - protein, 21 aa, Entamoeba dispar
ISPFRISYRLTSKCECSSLDK

SEQ ID NO: 2384927 - protein, 27 aa, Entamoeba dispar
ISPNECASCIEPAYQWDCHNCGKGYHM

SEQ ID NO: 2384928 - protein, 18 aa, Entamoeba dispar
ISPYKLILRNGLYLCEDL

SEQ ID NO: 2384929 - protein, 21 aa, Entamoeba dispar
ISQCKTGTCTDKWYKLSGNSV

SEQ ID NO: 2384930 - protein, 17 aa, Entamoeba dispar
ISQIPDWLYLIITDCWN

SEQ ID NO: 2384931 - protein, 18 aa, Entamoeba dispar
ISRKELKQVYDYHDPTDE

SEQ ID NO: 2384932 - protein, 17 aa, Entamoeba dispar
ISRNRFWGTPIPIWTDD

SEQ ID NO: 2384933 - protein, 22 aa, Entamoeba dispar
ISRSTIRGTLLLRNELTKQWYE

SEQ ID NO: 2384934 - protein, 19 aa, Entamoeba dispar
ISSARKCDYTGYKIEMGYM

SEQ ID NO: 2384935 - protein, 23 aa, Entamoeba dispar
ISSCLRLASGAIYKNDRKNDYFL

SEQ ID NO: 2384936 - protein, 17 aa, Entamoeba dispar
ISSFSFATTFFFLVFSH

SEQ ID NO: 2384937 - protein, 23 aa, Entamoeba dispar
ISSIEIKFNYGIQLPDIIILTPS

SEQ ID NO: 2384938 - protein, 24 aa, Entamoeba dispar
ISSRSSVIPLTLIVVDNYLSLLKN

SEQ ID NO: 2384939 - protein, 19 aa, Entamoeba dispar
ISSVAGIPIDFAERSVELC

SEQ ID NO: 2384940 - protein, 18 aa, Entamoeba dispar
ISTISFNLLISFITYILS

SEQ ID NO: 2384941 - protein, 18 aa, Entamoeba dispar
ISTISLYLYRVIQQNSAL

SEQ ID NO: 2384942 - protein, 25 aa, Entamoeba dispar
ISTLCSLFKLGRIPADSLFDSISQI

SEQ ID NO: 2384943 - protein, 18 aa, Entamoeba dispar
ISTLLTFIFVSRKCFYSV

SEQ ID NO: 2384944 - protein, 20 aa, Entamoeba dispar
ISTMRIRGINKFKGNNNIKI

SEQ ID NO: 2384945 - protein, 26 aa, Entamoeba dispar
ISTSNFRKVLFGILFLLHYLCLKKIV

SEQ ID NO: 2384946 - protein, 23 aa, Entamoeba dispar
ISTTCLFSSIFIYFFEQANVYCR

SEQ ID NO: 2384947 - protein, 17 aa, Entamoeba dispar
ISTWDILNGISISSDFE

SEQ ID NO: 2384948 - protein, 26 aa, Entamoeba dispar
ISVAIWPFCTAFFWPVTTGTVGFEAP

SEQ ID NO: 2384949 - protein, 18 aa, Entamoeba dispar
ISVCLKKPQIEIICEIAS

SEQ ID NO: 2384950 - protein, 25 aa, Entamoeba dispar
ISVHMQCVEFILSLNKYQMDNNLIS

SEQ ID NO: 2384951 - protein, 17 aa, Entamoeba dispar
ISVLYRFNEIVEYRIDV

SEQ ID NO: 2384952 - protein, 24 aa, Entamoeba dispar
ISWQSCLLLLFSEFIGFTLGFLTG

SEQ ID NO: 2384953 - protein, 20 aa, Entamoeba dispar
ISYFCDIIFLVLLVLRLDRV

SEQ ID NO: 2384954 - protein, 18 aa, Entamoeba dispar
ISYFLKLYYTITHVLIYS

SEQ ID NO: 2384955 - protein, 25 aa, Entamoeba dispar
ISYSCKRVLYQFGGGAYAFHLKTDS

SEQ ID NO: 2384956 - protein, 17 aa, Entamoeba dispar
ISYVPVVVGLKMRDLQT

SEQ ID NO: 2384957 - protein, 27 aa, Entamoeba dispar
ITASFIIKIIWFRGIVRESSGLLMKIM

SEQ ID NO: 2384958 - protein, 18 aa, Entamoeba dispar
ITAWEIFYQDEPYKEFKS

SEQ ID NO: 2384959 - protein, 22 aa, Entamoeba dispar
ITCAACCSVDLMPFLNKANGEL

SEQ ID NO: 2384960 - protein, 23 aa, Entamoeba dispar
ITCAACCSVDLMPFLNKANGELS

SEQ ID NO: 2384961 - protein, 23 aa, Entamoeba dispar
ITCHFQHYIVFGVYQVIVGVITF

SEQ ID NO: 2384962 - protein, 31 aa, Entamoeba dispar
ITDKWTYHRSLCLLAQAIFLVFSLLLVVVFN

SEQ ID NO: 2384963 - protein, 20 aa, Entamoeba dispar
ITDVLLCWVSYFKKIDSLRV

SEQ ID NO: 2384964 - protein, 17 aa, Entamoeba dispar
ITECLIFDFILRIIIYR

SEQ ID NO: 2384965 - protein, 17 aa, Entamoeba dispar
ITEFIISLLEVFSPLKW

SEQ ID NO: 2384966 - protein, 21 aa, Entamoeba dispar
ITEILPMNSIIQFIQNCLLRI

SEQ ID NO: 2384967 - protein, 19 aa, Entamoeba dispar
ITEKTRIAYELVKDKTVDL

SEQ ID NO: 2384968 - protein, 23 aa, Entamoeba dispar
ITFHILDFKATFVNKDDSKYIKV

SEQ ID NO: 2384969 - protein, 18 aa, Entamoeba dispar
ITFKNIEFGKCYYTGTRS

SEQ ID NO: 2384970 - protein, 24 aa, Entamoeba dispar
ITFSEFIIQMSLDFNNFKDIPVGY

SEQ ID NO: 2384971 - protein, 18 aa, Entamoeba dispar
ITGGIAIAPGLVLKTKIV

SEQ ID NO: 2384972 - protein, 20 aa, Entamoeba dispar
ITGKMFIRNGFYLDKEVKIL

SEQ ID NO: 2384973 - protein, 24 aa, Entamoeba dispar
ITGLKHYLEAYVFKDILKNPPQPS

SEQ ID NO: 2384974 - protein, 18 aa, Entamoeba dispar
ITGNLSIPLGEFYTKPVP

SEQ ID NO: 2384975 - protein, 18 aa, Entamoeba dispar
ITHISRYFSLHTRQKLLV

SEQ ID NO: 2384976 - protein, 17 aa, Entamoeba dispar
ITIAYALRGKSFKLNAQ

SEQ ID NO: 2384977 - protein, 27 aa, Entamoeba dispar
ITICRPRKQCSVALCCAKVQTIHLNSE

SEQ ID NO: 2384978 - protein, 17 aa, Entamoeba dispar
ITIFFNLLETRKFKTIH

SEQ ID NO: 2384979 - protein, 19 aa, Entamoeba dispar
ITIIKEWIEEYGRIKEEEE

SEQ ID NO: 2384980 - protein, 18 aa, Entamoeba dispar
ITIISIHLFMIFIMVIIT

SEQ ID NO: 2384981 - protein, 25 aa, Entamoeba dispar
ITIIVIFCIWFFKKPVEDKPQTYRL

SEQ ID NO: 2384982 - protein, 23 aa, Entamoeba dispar
ITIKEGFLYIECGINTPSLITTP

SEQ ID NO: 2384983 - protein, 23 aa, Entamoeba dispar
ITIKELKIENGLTIKKTSGFIEN

SEQ ID NO: 2384984 - protein, 25 aa, Entamoeba dispar
ITIQPRYPLLGGWSTSFSINYHYKF

SEQ ID NO: 2384985 - protein, 25 aa, Entamoeba dispar
ITIQYWAKYCIIGFASLANSYYFYS

SEQ ID NO: 2384986 - protein, 21 aa, Entamoeba dispar
ITISCISRVLSVLMNLPTSNV

SEQ ID NO: 2384987 - protein, 22 aa, Entamoeba dispar
ITITFTCCFNILVGNFIKNLFG

SEQ ID NO: 2384988 - protein, 18 aa, Entamoeba dispar
ITKFIKWTYKLPTMSFPI

SEQ ID NO: 2384989 - protein, 25 aa, Entamoeba dispar
ITKGIKEWGGAIIVGFDGDPYGKDE

SEQ ID NO: 2384990 - protein, 24 aa, Entamoeba dispar
ITKHKLHAGMILDAVLKKVIDIKD

SEQ ID NO: 2384991 - protein, 23 aa, Entamoeba dispar
ITKKEIRLCFACYYPYQTNKGRI

SEQ ID NO: 2384992 - protein, 22 aa, Entamoeba dispar
ITKKEYSCLSALAYAKDLNESD

SEQ ID NO: 2384993 - protein, 25 aa, Entamoeba dispar
ITKLDLFHCMKLKPLALPITISQLY

SEQ ID NO: 2384994 - protein, 21 aa, Entamoeba dispar
ITKNRLVHLIIFCPCTCVPPI

SEQ ID NO: 2384995 - protein, 17 aa, Entamoeba dispar
ITKSCIVALLRGIWIMP

SEQ ID NO: 2384996 - protein, 17 aa, Entamoeba dispar
ITLIISLVIPHLFVFST

SEQ ID NO: 2384997 - protein, 17 aa, Entamoeba dispar
ITLKINDLLPFHSFLDI

SEQ ID NO: 2384998 - protein, 18 aa, Entamoeba dispar
ITLKRLIQINSVIKQYCM

SEQ ID NO: 2384999 - protein, 25 aa, Entamoeba dispar
ITLLRVSPVFPFPIINYILPPVVDF

SEQ ID NO: 2385000 - protein, 20 aa, Entamoeba dispar
ITLMSPFVWQHVLIPLLPKS

SEQ ID NO: 2385001 - protein, 35 aa, Entamoeba dispar
ITLSLHILRPFIVVLMFELYWFTILFFLLEAYNSF

SEQ ID NO: 2385002 - protein, 30 aa, Entamoeba dispar
ITLTMFVSEFTRLGGIGLVLEKIMKYEGNV

SEQ ID NO: 2385003 - protein, 21 aa, Entamoeba dispar
ITMYEIMKWGPAYDKTTFKYP

SEQ ID NO: 2385004 - protein, 19 aa, Entamoeba dispar
ITNIFKTLLILIFWIFVIQ

SEQ ID NO: 2385005 - protein, 17 aa, Entamoeba dispar
ITNIKQLDILSAPSTSD

SEQ ID NO: 2385006 - protein, 17 aa, Entamoeba dispar
ITNKGCTLCESSYYLEN

SEQ ID NO: 2385007 - protein, 19 aa, Entamoeba dispar
ITNKIFLIIMAIVFLIIIG

SEQ ID NO: 2385008 - protein, 32 aa, Entamoeba dispar
ITNKPCLCFVFFFCFLNTTYLLDGFIILGILM

SEQ ID NO: 2385009 - protein, 25 aa, Entamoeba dispar
ITNNCLRFGKRFKMKHFENKSCLGP

SEQ ID NO: 2385010 - protein, 22 aa, Entamoeba dispar
ITNVIKLLFGLMVKDIKVNEWC

SEQ ID NO: 2385011 - protein, 23 aa, Entamoeba dispar
ITNYLCNKGWKSITINDNGLLHY

SEQ ID NO: 2385012 - protein, 18 aa, Entamoeba dispar
ITNYRVLFIPSQFIQEDF

SEQ ID NO: 2385013 - protein, 21 aa, Entamoeba dispar
ITPPFWMEYVHCFTIPLLGFV

SEQ ID NO: 2385014 - protein, 19 aa, Entamoeba dispar
ITPTFKYEHCKIITSTSNI

SEQ ID NO: 2385015 - protein, 17 aa, Entamoeba dispar
ITQSILFPSFFDENFCR

SEQ ID NO: 2385016 - protein, 24 aa, Entamoeba dispar
ITSACLWVSFWRTRNEIHKNIKNV

SEQ ID NO: 2385017 - protein, 21 aa, Entamoeba dispar
ITSESLLECEGSIDSFSFKII

SEQ ID NO: 2385018 - protein, 25 aa, Entamoeba dispar
ITSFLCKISGIKLIDFYCGECNKLL

SEQ ID NO: 2385019 - protein, 21 aa, Entamoeba dispar
ITSLKIGMKFHEAINDSQIKE

SEQ ID NO: 2385020 - protein, 24 aa, Entamoeba dispar
ITSLPFKITLPMLNFVPEVQSCNN

SEQ ID NO: 2385021 - protein, 27 aa, Entamoeba dispar
ITSLPYFAEFDCESFAPKNKEVIESFQ

SEQ ID NO: 2385022 - protein, 24 aa, Entamoeba dispar
ITSMILLVIIYRGWALASPAIPPL

SEQ ID NO: 2385023 - protein, 26 aa, Entamoeba dispar
ITSNKKVNCKIKECYNSLECLTDEYN

SEQ ID NO: 2385024 - protein, 25 aa, Entamoeba dispar
ITSSFIWDIICLFSVIIHISSMRSR

SEQ ID NO: 2385025 - protein, 24 aa, Entamoeba dispar
ITSVALFGVCVYAFGYIPFQYVKQ

SEQ ID NO: 2385026 - protein, 19 aa, Entamoeba dispar
ITTCSSYTRMPVKIDLFDN

SEQ ID NO: 2385027 - protein, 26 aa, Entamoeba dispar
ITTEILRYSCKIIKSINSGKIKENLN

SEQ ID NO: 2385028 - protein, 18 aa, Entamoeba dispar
ITTEVEWERKTCPCSGDK

SEQ ID NO: 2385029 - protein, 20 aa, Entamoeba dispar
ITTIIKRKVIIITTNTIIQV

SEQ ID NO: 2385030 - protein, 25 aa, Entamoeba dispar
ITTIPRRSSVQFSYHNFIEKTRSVL

SEQ ID NO: 2385031 - protein, 24 aa, Entamoeba dispar
ITTLFRIILLIPILNNYLSNEFIS

SEQ ID NO: 2385032 - protein, 28 aa, Entamoeba dispar
ITTQRVIPILLHFGSLFKQNSLVVICEK

SEQ ID NO: 2385033 - protein, 21 aa, Entamoeba dispar
ITTTEGWAFGAFIAGHIPVPS

SEQ ID NO: 2385034 - protein, 27 aa, Entamoeba dispar
ITTTHLKRLFLLWGFSLSILLMIYGIY

SEQ ID NO: 2385035 - protein, 27 aa, Entamoeba dispar
ITTTSSLYFKFIDQFPDAPICEFGEVF

SEQ ID NO: 2385036 - protein, 24 aa, Entamoeba dispar
ITVICVILFLTFCGFYIGTVISTW

SEQ ID NO: 2385037 - protein, 30 aa, Entamoeba dispar
ITVIFPFVLCFYPDCIRIYNFFTGQLDDTI

SEQ ID NO: 2385038 - protein, 29 aa, Entamoeba dispar
ITVIPGLIFLWKTYCIVTGAAGGIGKAFA

SEQ ID NO: 2385039 - protein, 18 aa, Entamoeba dispar
ITVSRLVLLIPFVSYDND

SEQ ID NO: 2385040 - protein, 24 aa, Entamoeba dispar
ITVVVDCLFVVWIYWNKSNLKEWK

SEQ ID NO: 2385041 - protein, 17 aa, Entamoeba dispar
ITYGNSSNWWFGSNNSK

SEQ ID NO: 2385042 - protein, 24 aa, Entamoeba dispar
ITYNCPPIRCSYKQENKLPTGCYC

SEQ ID NO: 2385043 - protein, 34 aa, Entamoeba dispar
IVAIKGTFPFIWIFLVFASICYWSSNQFAPNGTF

SEQ ID NO: 2385044 - protein, 18 aa, Entamoeba dispar
IVAVVSVALMSIVINMML

SEQ ID NO: 2385045 - protein, 29 aa, Entamoeba dispar
IVCIINISLALFFLWKVILVVIFFILQVS

SEQ ID NO: 2385046 - protein, 17 aa, Entamoeba dispar
IVCLEFFFIHVILAILM

SEQ ID NO: 2385047 - protein, 25 aa, Entamoeba dispar
IVCSQCKGFCSLTYGGCLCNGVSCE

SEQ ID NO: 2385048 - protein, 22 aa, Entamoeba dispar
IVDFLPYMKWWFTTENGELPST

SEQ ID NO: 2385049 - protein, 18 aa, Entamoeba dispar
IVDFLYMIIILHFSLIIK

SEQ ID NO: 2385050 - protein, 20 aa, Entamoeba dispar
IVDPYFSWKLYVHSQSNYNE

SEQ ID NO: 2385051 - protein, 23 aa, Entamoeba dispar
IVEIKPTPNYLAFGVFTGEEDDN

SEQ ID NO: 2385052 - protein, 26 aa, Entamoeba dispar
IVFIFICSIVMIFLLIRFTKGHKIDL

SEQ ID NO: 2385053 - protein, 22 aa, Entamoeba dispar
IVFNLVLCFIYGFGQYTDSYIK

SEQ ID NO: 2385054 - protein, 25 aa, Entamoeba dispar
IVFVLYCWYYSYSLIIILLPLFIYL

SEQ ID NO: 2385055 - protein, 17 aa, Entamoeba dispar
IVGCLAVFIACLNIFGG

SEQ ID NO: 2385056 - protein, 24 aa, Entamoeba dispar
IVGGFCIIPFLLINIFQKSYLLII

SEQ ID NO: 2385057 - protein, 23 aa, Entamoeba dispar
IVGLMASNLFCFISGTRYVVYNF

SEQ ID NO: 2385058 - protein, 19 aa, Entamoeba dispar
IVGTIFRQGNSYDFQEQEE

SEQ ID NO: 2385059 - protein, 19 aa, Entamoeba dispar
IVGVCIFSSIILSYNKTHG

SEQ ID NO: 2385060 - protein, 24 aa, Entamoeba dispar
IVGVKIGRELLKCVTRALTQNLNL

SEQ ID NO: 2385061 - protein, 17 aa, Entamoeba dispar
IVIGIPIIICIIITLII

SEQ ID NO: 2385062 - protein, 22 aa, Entamoeba dispar
IVIGLVKGWLKPSSYSSTNLDD

SEQ ID NO: 2385063 - protein, 25 aa, Entamoeba dispar
IVIKLIKMGISFTITSHIKLIQEKL

SEQ ID NO: 2385064 - protein, 23 aa, Entamoeba dispar
IVIPLCAIPFWYIQIPLIIIGFL

SEQ ID NO: 2385065 - protein, 17 aa, Entamoeba dispar
IVIRIIVQLLQYYLNSE

SEQ ID NO: 2385066 - protein, 20 aa, Entamoeba dispar
IVISLTSLYLFQSILSFPMQ

SEQ ID NO: 2385067 - protein, 17 aa, Entamoeba dispar
IVISVLMTMAALIILFI

SEQ ID NO: 2385068 - protein, 18 aa, Entamoeba dispar
IVITCIISNFLRGTSLLP

SEQ ID NO: 2385069 - protein, 25 aa, Entamoeba dispar
IVITEFFGFILLVVILCDLYLLHKR

SEQ ID NO: 2385070 - protein, 19 aa, Entamoeba dispar
IVKCLRRKTPFIINEKYIQ

SEQ ID NO: 2385071 - protein, 17 aa, Entamoeba dispar
IVKTSQLFKEYGDTKSK

SEQ ID NO: 2385072 - protein, 22 aa, Entamoeba dispar
IVLFCLVLFKKFGTSLIPTLLM

SEQ ID NO: 2385073 - protein, 18 aa, Entamoeba dispar
IVLFWVFVLIWRKKKLIT

SEQ ID NO: 2385074 - protein, 17 aa, Entamoeba dispar
IVLICSYLLVLSFSTLS

SEQ ID NO: 2385075 - protein, 18 aa, Entamoeba dispar
IVLLICVTLVFIIFHRNQ

SEQ ID NO: 2385076 - protein, 17 aa, Entamoeba dispar
IVLLLFFISSINGKIHC

SEQ ID NO: 2385077 - protein, 26 aa, Entamoeba dispar
IVLLLKLLRSSFLINVDKTIREKPIK

SEQ ID NO: 2385078 - protein, 26 aa, Entamoeba dispar
IVLPSELKLTCNLMGISSQSFVEYWQ

SEQ ID NO: 2385079 - protein, 26 aa, Entamoeba dispar
IVLYLVCIMFNFNLIKEFNFIDKKDI

SEQ ID NO: 2385080 - protein, 32 aa, Entamoeba dispar
IVMRYSEEWKKVVWRCGRWIDMDHPYKTMDIN

SEQ ID NO: 2385081 - protein, 17 aa, Entamoeba dispar
IVNEIKYCYDKIPDFRT

SEQ ID NO: 2385082 - protein, 18 aa, Entamoeba dispar
IVNSTIWFISSVNTIQFN

SEQ ID NO: 2385083 - protein, 24 aa, Entamoeba dispar
IVNYEIVNEIAFWYYQQLFEEKCY

SEQ ID NO: 2385084 - protein, 23 aa, Entamoeba dispar
IVPLICIPFQYVLRKRQTTPLNQ

SEQ ID NO: 2385085 - protein, 18 aa, Entamoeba dispar
IVPLTTLVILFWNIPSNK

SEQ ID NO: 2385086 - protein, 25 aa, Entamoeba dispar
IVPNILRLFCLRFLVPGYYMVLQEI

SEQ ID NO: 2385087 - protein, 24 aa, Entamoeba dispar
IVPPMLHKWGPRFMMLIMLGATII

SEQ ID NO: 2385088 - protein, 24 aa, Entamoeba dispar
IVQFPRMYRTTAFSKLFENVYLCS

SEQ ID NO: 2385089 - protein, 18 aa, Entamoeba dispar
IVQKARLSWDNTEECDTF

SEQ ID NO: 2385090 - protein, 25 aa, Entamoeba dispar
IVRTLYKFLTCFTLLDNQIDYLKSL

SEQ ID NO: 2385091 - protein, 25 aa, Entamoeba dispar
IVRWRNYFRSWGMCFTCIGDEEELI

SEQ ID NO: 2385092 - protein, 27 aa, Entamoeba dispar
IVSDMFRRIRLYEMLMWSNGEKESCQS

SEQ ID NO: 2385093 - protein, 18 aa, Entamoeba dispar
IVSICLDQGFLDKDVNGN

SEQ ID NO: 2385094 - protein, 17 aa, Entamoeba dispar
IVSLCFGSGTYCHDPND

SEQ ID NO: 2385095 - protein, 19 aa, Entamoeba dispar
IVSLKPGKNYFIFLTTNTC

SEQ ID NO: 2385096 - protein, 23 aa, Entamoeba dispar
IVSNVCFFICYIFVEVRRCCRVL

SEQ ID NO: 2385097 - protein, 23 aa, Entamoeba dispar
IVTAVGLNSLWGKTKESLNQDKP

SEQ ID NO: 2385098 - protein, 20 aa, Entamoeba dispar
IVTGLKACRQRLWYQKGEEK

SEQ ID NO: 2385099 - protein, 26 aa, Entamoeba dispar
IVTSWSCAIGEYFFYFSCYGCPNGYF

SEQ ID NO: 2385100 - protein, 18 aa, Entamoeba dispar
IVVLVIWIIGQFYGDWLK

SEQ ID NO: 2385101 - protein, 18 aa, Entamoeba dispar
IVWFCLFISFISCIIHPL

SEQ ID NO: 2385102 - protein, 17 aa, Entamoeba dispar
IVYCVFNKRHVKQIHRI

SEQ ID NO: 2385103 - protein, 29 aa, Entamoeba dispar
IVYEGEGMYRISIDFYVRRFESTCEEPTN

SEQ ID NO: 2385104 - protein, 30 aa, Entamoeba dispar
IVYNEARVRIKVSIIRFIKTKKDIIVIILM

SEQ ID NO: 2385105 - protein, 17 aa, Entamoeba dispar
IVYTRYTPYLLHLYYSS

SEQ ID NO: 2385106 - protein, 17 aa, Entamoeba dispar
IVYYISIFFNLILPYSF

SEQ ID NO: 2385107 - protein, 21 aa, Entamoeba dispar
IWCFTPGIFPLIRSGATDIRT

SEQ ID NO: 2385108 - protein, 24 aa, Entamoeba dispar
IWILRATGFIAYFVFFLLYFILYY

SEQ ID NO: 2385109 - protein, 19 aa, Entamoeba dispar
IWMMCFDITLSIGATLGFI

SEQ ID NO: 2385110 - protein, 31 aa, Entamoeba dispar
IWNVFPIADFWRHVCIVWTKCYCYFPTEVIE

SEQ ID NO: 2385111 - protein, 23 aa, Entamoeba dispar
IWQSLLLTFVFHFMLDDVDVYSS

SEQ ID NO: 2385112 - protein, 18 aa, Entamoeba dispar
IWSEERSKVIAVDDLLVY

SEQ ID NO: 2385113 - protein, 19 aa, Entamoeba dispar
IWTIMAFSSVCFLFVSLFS

SEQ ID NO: 2385114 - protein, 17 aa, Entamoeba dispar
IWTLLIFVLPDLSDISI

SEQ ID NO: 2385115 - protein, 29 aa, Entamoeba dispar
IWTMMICVACGQTPPFSAMMILWANLVVD

SEQ ID NO: 2385116 - protein, 18 aa, Entamoeba dispar
IWYEFKFIERIHTLQKGD

SEQ ID NO: 2385117 - protein, 18 aa, Entamoeba dispar
IYADSIAGFWKYKHQPFV

SEQ ID NO: 2385118 - protein, 27 aa, Entamoeba dispar
IYAFAITIYEVMKWGPAYDNSDGLFEY

SEQ ID NO: 2385119 - protein, 27 aa, Entamoeba dispar
IYAIIFLCVLIVRYVIQMDVIISDDSQ

SEQ ID NO: 2385120 - protein, 19 aa, Entamoeba dispar
IYALLSFIIGFLIIFKLIF

SEQ ID NO: 2385121 - protein, 18 aa, Entamoeba dispar
IYANIQWERPIFLKETKL

SEQ ID NO: 2385122 - protein, 19 aa, Entamoeba dispar
IYCCKVIAAIGCGIVSGAL

SEQ ID NO: 2385123 - protein, 19 aa, Entamoeba dispar
IYCVSRWAIVPLVTTANLY

SEQ ID NO: 2385124 - protein, 20 aa, Entamoeba dispar
IYDDIPPFLKLVEGESNTAT

SEQ ID NO: 2385125 - protein, 19 aa, Entamoeba dispar
IYDKGCSHIVEMIDHFLYC

SEQ ID NO: 2385126 - protein, 25 aa, Entamoeba dispar
IYDMFLFLKLFKTFNIKRGNETKQI

SEQ ID NO: 2385127 - protein, 26 aa, Entamoeba dispar
IYEAILFILMVFRFISYAVSSIIKST

SEQ ID NO: 2385128 - protein, 23 aa, Entamoeba dispar
IYEFFKQCVHYTIMCNSDDEKQT

SEQ ID NO: 2385129 - protein, 24 aa, Entamoeba dispar
IYEKWKIMWEDAINNIKEREKLII

SEQ ID NO: 2385130 - protein, 19 aa, Entamoeba dispar
IYFDYLKGESTYDIELTSR

SEQ ID NO: 2385131 - protein, 20 aa, Entamoeba dispar
IYFGYAGLVEFIWIELNNKM

SEQ ID NO: 2385132 - protein, 17 aa, Entamoeba dispar
IYFIVFVIVLKLSAIYL

SEQ ID NO: 2385133 - protein, 17 aa, Entamoeba dispar
IYFTFKKLFSSNIIEAK

SEQ ID NO: 2385134 - protein, 25 aa, Entamoeba dispar
IYFVLRMMYRLIYFGMKQTSVNPEF

SEQ ID NO: 2385135 - protein, 27 aa, Entamoeba dispar
IYGKLYSLELPTIWKGWNQQQQAKYRE

SEQ ID NO: 2385136 - protein, 18 aa, Entamoeba dispar
IYHFVGWWARCVICRDWK

SEQ ID NO: 2385137 - protein, 23 aa, Entamoeba dispar
IYHLYGNLPWKKCIPTKLTLLSL

SEQ ID NO: 2385138 - protein, 20 aa, Entamoeba dispar
IYIAIGFVIICIILQEFVYH

SEQ ID NO: 2385139 - protein, 19 aa, Entamoeba dispar
IYIGHCIDLTFFWDSYKSA

SEQ ID NO: 2385140 - protein, 24 aa, Entamoeba dispar
IYIHIICLLLVFLLSIAILCNIQF

SEQ ID NO: 2385141 - protein, 19 aa, Entamoeba dispar
IYIIRAGLIAINYVPDTIK

SEQ ID NO: 2385142 - protein, 26 aa, Entamoeba dispar
IYILQFGLCYLIFPIIQTYSIVGDFT

SEQ ID NO: 2385143 - protein, 25 aa, Entamoeba dispar
IYILYRPLYQWIFQRVTEVYMMYFP

SEQ ID NO: 2385144 - protein, 17 aa, Entamoeba dispar
IYISFIFSTQSFLCLIL

SEQ ID NO: 2385145 - protein, 17 aa, Entamoeba dispar
IYISLVYPYPVKISKHY

SEQ ID NO: 2385146 - protein, 17 aa, Entamoeba dispar
IYKGRDGLFTGVMAISY

SEQ ID NO: 2385147 - protein, 17 aa, Entamoeba dispar
IYKKYIESAKCIIFMIA

SEQ ID NO: 2385148 - protein, 17 aa, Entamoeba dispar
IYLHSVFGIIHRDIKLE

SEQ ID NO: 2385149 - protein, 25 aa, Entamoeba dispar
IYLIYLVKPYVNWSRVYLEINELID

SEQ ID NO: 2385150 - protein, 35 aa, Entamoeba dispar
IYLLPLCCSLLIPFILQFTISWGMKAVLPITTTIL

SEQ ID NO: 2385151 - protein, 21 aa, Entamoeba dispar
IYLMIAFRPKKVISLSNEPKE

SEQ ID NO: 2385152 - protein, 19 aa, Entamoeba dispar
IYLQHPICQIIHSTATQFH

SEQ ID NO: 2385153 - protein, 18 aa, Entamoeba dispar
IYLSKYIKELPIFDTEGN

SEQ ID NO: 2385154 - protein, 17 aa, Entamoeba dispar
IYLYCLFIEVIKFLKRR

SEQ ID NO: 2385155 - protein, 19 aa, Entamoeba dispar
IYMAMGTCVYYCTIPTKLN

SEQ ID NO: 2385156 - protein, 25 aa, Entamoeba dispar
IYNCMKQFLCQSLIDKDLIGIRFFY

SEQ ID NO: 2385157 - protein, 17 aa, Entamoeba dispar
IYNDLVIIAGISFLQNN

SEQ ID NO: 2385158 - protein, 22 aa, Entamoeba dispar
IYNFRFLYVMLCGLCVFIGILF

SEQ ID NO: 2385159 - protein, 18 aa, Entamoeba dispar
IYNFTGYNVIRFGKVNTK

SEQ ID NO: 2385160 - protein, 23 aa, Entamoeba dispar
IYNIQFNGCNGIHTLNHNQAVAL

SEQ ID NO: 2385161 - protein, 25 aa, Entamoeba dispar
IYNKEIPADGLALFTKQVWSSIKSN

SEQ ID NO: 2385162 - protein, 18 aa, Entamoeba dispar
IYNTLLFQRLFTFKNSSH

SEQ ID NO: 2385163 - protein, 22 aa, Entamoeba dispar
IYPVHRYIASRFIWDILCLFAI

SEQ ID NO: 2385164 - protein, 19 aa, Entamoeba dispar
IYQFSIKKVHDIITLCVGI

SEQ ID NO: 2385165 - protein, 21 aa, Entamoeba dispar
IYQFWKIKESYQMIDCSLILK

SEQ ID NO: 2385166 - protein, 23 aa, Entamoeba dispar
IYSILFQARWLMWIINKINPKAL

SEQ ID NO: 2385167 - protein, 20 aa, Entamoeba dispar
IYSISFWYPGIISYDGLFSM

SEQ ID NO: 2385168 - protein, 24 aa, Entamoeba dispar
IYSKGYHPFNFCIFLHTINCIMYS

SEQ ID NO: 2385169 - protein, 22 aa, Entamoeba dispar
IYSLGYRKGDKIAIFCETRYEW

SEQ ID NO: 2385170 - protein, 33 aa, Entamoeba dispar
  misc_feature (32)..(33): Xaa can be any naturally occurring amino acid
IYSLPKLPGIWVYCWTLLLLCGQVRNSLSHIXX

SEQ ID NO: 2385171 - protein, 18 aa, Entamoeba dispar
IYSMFSFNSLVIKQNCNK

SEQ ID NO: 2385172 - protein, 25 aa, Entamoeba dispar
IYSNQTHCLIPFFNDAGCVICEDGY

SEQ ID NO: 2385173 - protein, 23 aa, Entamoeba dispar
IYSQCREAIILPVSKRFYRMTTY

SEQ ID NO: 2385174 - protein, 30 aa, Entamoeba dispar
IYSYAVTMYECFKWGSAFTSNIKPWCICDM

SEQ ID NO: 2385175 - protein, 19 aa, Entamoeba dispar
IYSYPLLMSLERLYILRMT

SEQ ID NO: 2385176 - protein, 22 aa, Entamoeba dispar
IYTIHCFFTIYCFFISIISTKS

SEQ ID NO: 2385177 - protein, 18 aa, Entamoeba dispar
IYTNDFLLILSVLSQLHF

SEQ ID NO: 2385178 - protein, 29 aa, Entamoeba dispar
IYTPSWKSIVIPLLIGFIIPLISNIIPIK

SEQ ID NO: 2385179 - protein, 19 aa, Entamoeba dispar
IYTTLTFFGIFAEFITALT

SEQ ID NO: 2385180 - protein, 17 aa, Entamoeba dispar
IYVPIIITLIIGIPLTI

SEQ ID NO: 2385181 - protein, 21 aa, Entamoeba dispar
IYYFRMYFMMLIFGASHGLFF

SEQ ID NO: 2385182 - protein, 17 aa, Entamoeba dispar
IYYGGRLIMNFNDFLER

SEQ ID NO: 2385183 - protein, 19 aa, Entamoeba dispar
IYYIFSWGFTSLYLLLSLG

SEQ ID NO: 2385184 - protein, 30 aa, Entamoeba dispar
IYYPKSWELLKEFIIILFIIILSRTSYFWG

SEQ ID NO: 2385185 - protein, 18 aa, Entamoeba dispar
KAATNICEMCVKYCKEHA

SEQ ID NO: 2385186 - protein, 17 aa, Entamoeba dispar
KADEVIFPLTQNVVVKT

SEQ ID NO: 2385187 - protein, 25 aa, Entamoeba dispar
KADHRKFAIALCNFIIPYFANNHEY

SEQ ID NO: 2385188 - protein, 19 aa, Entamoeba dispar
KADTIPIKILVKGREVTLH

SEQ ID NO: 2385189 - protein, 23 aa, Entamoeba dispar
KAEEIKLPATRYFYNEINSKSRS

SEQ ID NO: 2385190 - protein, 21 aa, Entamoeba dispar
KAELKLTQFYTSLWDMASCSS

SEQ ID NO: 2385191 - protein, 18 aa, Entamoeba dispar
KAGEIIILIISINDLIYY

SEQ ID NO: 2385192 - protein, 24 aa, Entamoeba dispar
KAGRTKIAVVLARKMSKDQINHQN

SEQ ID NO: 2385193 - protein, 22 aa, Entamoeba dispar
KAIDTEGTFRLNVYTLNPPSHS

SEQ ID NO: 2385194 - protein, 25 aa, Entamoeba dispar
KAIEKICLNNSIAIDHQRLLSIVRN

SEQ ID NO: 2385195 - protein, 19 aa, Entamoeba dispar
KAKAAQQMMGFLESPITQQ

SEQ ID NO: 2385196 - protein, 19 aa, Entamoeba dispar
KAKFLEYDRTLLVADPRRC

SEQ ID NO: 2385197 - protein, 19 aa, Entamoeba dispar
KAKGTLFFHSIPLSNCSLT

SEQ ID NO: 2385198 - protein, 19 aa, Entamoeba dispar
KAKSVGVIKKEEFMKEHET

SEQ ID NO: 2385199 - protein, 21 aa, Entamoeba dispar
KAKSVNFEFNKFIVNALYLSS

SEQ ID NO: 2385200 - protein, 31 aa, Entamoeba dispar
KALCEGCVLCDYRCEQCGLKSDAQRSEKYKK

SEQ ID NO: 2385201 - protein, 21 aa, Entamoeba dispar
KALCTCFKSIIKENDITDVNE

SEQ ID NO: 2385202 - protein, 17 aa, Entamoeba dispar
KALLSGIGCNWIVCCAV

SEQ ID NO: 2385203 - protein, 24 aa, Entamoeba dispar
KAQDGICIPLSCGNGQIDKGEECD

SEQ ID NO: 2385204 - protein, 19 aa, Entamoeba dispar
KAQFIINSWTYTRSILTII

SEQ ID NO: 2385205 - protein, 20 aa, Entamoeba dispar
KAQTCWMLFCFVYAIWNGAN

SEQ ID NO: 2385206 - protein, 19 aa, Entamoeba dispar
KARIGCMLSTCGNKKWDKG

SEQ ID NO: 2385207 - protein, 20 aa, Entamoeba dispar
KARVSGKIKLFIVSSYQSNH

SEQ ID NO: 2385208 - protein, 25 aa, Entamoeba dispar
KASCNNAESWICKKGIQWYVCSGNT

SEQ ID NO: 2385209 - protein, 18 aa, Entamoeba dispar
KASDQAINILTLFRNITA

SEQ ID NO: 2385210 - protein, 26 aa, Entamoeba dispar
KASESGEDFVLVFKYHNQIVVIVITV

SEQ ID NO: 2385211 - protein, 25 aa, Entamoeba dispar
KASWEMFKQTYFCFHLIALILFIWL

SEQ ID NO: 2385212 - protein, 30 aa, Entamoeba dispar
KATIKKPLLCFTRFFVVKLMMILLLGISSG

SEQ ID NO: 2385213 - protein, 26 aa, Entamoeba dispar
KATLIGYPFFIVYIIAAGLGIWIEGT

SEQ ID NO: 2385214 - protein, 18 aa, Entamoeba dispar
KATPPVLYDGFKIVFDGI

SEQ ID NO: 2385215 - protein, 28 aa, Entamoeba dispar
KATQMSWALKIDRLREAFSNGKGGSAQR

SEQ ID NO: 2385216 - protein, 18 aa, Entamoeba dispar
KAVICCRVTPLIKGEIIK

SEQ ID NO: 2385217 - protein, 24 aa, Entamoeba dispar
KAVYARPVKDTSVFIDIPRLAPKV

SEQ ID NO: 2385218 - protein, 28 aa, Entamoeba dispar
KAYEKRGIKELFEWQEECLKEKGVREGE

SEQ ID NO: 2385219 - protein, 25 aa, Entamoeba dispar
KAYLKDEFTQLLAIKVLSDCAKGMR

SEQ ID NO: 2385220 - protein, 31 aa, Entamoeba dispar
KAYSTFDWLLWLIVSIVIFAAFLIPFLAVGF

SEQ ID NO: 2385221 - protein, 23 aa, Entamoeba dispar
KCAEEYQWALGMYGALKSNPENF

SEQ ID NO: 2385222 - protein, 17 aa, Entamoeba dispar
KCANEWGQVIILDTISK

SEQ ID NO: 2385223 - protein, 22 aa, Entamoeba dispar
KCAVPTCGNGKIDVYEECDGGY

SEQ ID NO: 2385224 - protein, 23 aa, Entamoeba dispar
KCDKCDVLGCAWCQDDHTSCKRC

SEQ ID NO: 2385225 - protein, 17 aa, Entamoeba dispar
KCDKFLADRFVEGICPF

SEQ ID NO: 2385226 - protein, 24 aa, Entamoeba dispar
KCDVSNRWHFDWKCNVTYFTSIGV

SEQ ID NO: 2385227 - protein, 22 aa, Entamoeba dispar
KCECMTGLLLVDGICTLCGNGI

SEQ ID NO: 2385228 - protein, 18 aa, Entamoeba dispar
KCELCPAGTYSSITTANS

SEQ ID NO: 2385229 - protein, 28 aa, Entamoeba dispar
KCELCQVNICKKCMVKGMIINFKTKNLI

SEQ ID NO: 2385230 - protein, 24 aa, Entamoeba dispar
KCERIKFEITESFCSSLDEIYGCL

SEQ ID NO: 2385231 - protein, 18 aa, Entamoeba dispar
KCFCGRNIVHLGCGQDES

SEQ ID NO: 2385232 - protein, 19 aa, Entamoeba dispar
KCFVDGRVSNDFVKCNTFV

SEQ ID NO: 2385233 - protein, 17 aa, Entamoeba dispar
KCHEASNEYCMYKIENG

SEQ ID NO: 2385234 - protein, 20 aa, Entamoeba dispar
KCILGLVALLIIFQAFVLIF

SEQ ID NO: 2385235 - protein, 17 aa, Entamoeba dispar
KCKEFIVEIRGYYDLNK

SEQ ID NO: 2385236 - protein, 18 aa, Entamoeba dispar
KCKQLFVGQLFGKSNTIA

SEQ ID NO: 2385237 - protein, 25 aa, Entamoeba dispar
KCKVHSIEGAGFFLVNLLKGIKGSI

SEQ ID NO: 2385238 - protein, 21 aa, Entamoeba dispar
KCLECSYLSRLDKNGMCTREC

SEQ ID NO: 2385239 - protein, 20 aa, Entamoeba dispar
KCLECYKQLNIEKLNLENKI

SEQ ID NO: 2385240 - protein, 19 aa, Entamoeba dispar
KCLGCQLGCELCVSNKGCI

SEQ ID NO: 2385241 - protein, 22 aa, Entamoeba dispar
KCLSDGLNIRGRETFTVPEHWK

SEQ ID NO: 2385242 - protein, 31 aa, Entamoeba dispar
KCLSSLYGICYRCIPKYYPNGVKCEQCLEHC

SEQ ID NO: 2385243 - protein, 18 aa, Entamoeba dispar
KCLTCKDNYYISSYQCLE

SEQ ID NO: 2385244 - protein, 20 aa, Entamoeba dispar
KCLTCKPGYGINLKDGTCTA

SEQ ID NO: 2385245 - protein, 18 aa, Entamoeba dispar
KCLTCLPECDECNKKGIC

SEQ ID NO: 2385246 - protein, 18 aa, Entamoeba dispar
KCNDAFCKSCPNNKDECE

SEQ ID NO: 2385247 - protein, 21 aa, Entamoeba dispar
KCNVCNDGVYYHCNSGPSGES

SEQ ID NO: 2385248 - protein, 20 aa, Entamoeba dispar
KCSDWKHIFQIISTAAEDIE

SEQ ID NO: 2385249 - protein, 17 aa, Entamoeba dispar
KCSLNYKPTELGDYCEF

SEQ ID NO: 2385250 - protein, 24 aa, Entamoeba dispar
KCSPITRKGIFFSVKTVPYHTLVL

SEQ ID NO: 2385251 - protein, 25 aa, Entamoeba dispar
KCSSDSKCLLCEDGYKVGLSNYCEL

SEQ ID NO: 2385252 - protein, 22 aa, Entamoeba dispar
KCVECSNGLLLNFKGECINTKI

SEQ ID NO: 2385253 - protein, 22 aa, Entamoeba dispar
KCVIRFQIYYCIIDKRKEDYYA

SEQ ID NO: 2385254 - protein, 24 aa, Entamoeba dispar
KCVKGICAYPSSGNRTMIINLVMV

SEQ ID NO: 2385255 - protein, 26 aa, Entamoeba dispar
KCVNDCSVLLLKVCKLLDTSISPTPV

SEQ ID NO: 2385256 - protein, 19 aa, Entamoeba dispar
KCVNGKKIHGTDCIDVNDC

SEQ ID NO: 2385257 - protein, 23 aa, Entamoeba dispar
KCVPALLRVFFQAVSVRYNSESE

SEQ ID NO: 2385258 - protein, 18 aa, Entamoeba dispar
KCYYYELYQSESLVDTVD

SEQ ID NO: 2385259 - protein, 24 aa, Entamoeba dispar
KDDVVCPKQPFNLRGVNVVLVPKK

SEQ ID NO: 2385260 - protein, 25 aa, Entamoeba dispar
KDEECLRGSEGCLVNCQCQKDLGWV

SEQ ID NO: 2385261 - protein, 17 aa, Entamoeba dispar
KDERYSTTFLIKIQYCD

SEQ ID NO: 2385262 - protein, 20 aa, Entamoeba dispar
KDFKWTMDPTQCFPSNAEAI

SEQ ID NO: 2385263 - protein, 21 aa, Entamoeba dispar
KDGDFSYARLRAHILSDPEII

SEQ ID NO: 2385264 - protein, 17 aa, Entamoeba dispar
KDGDLVPRIDFKNNTRT

SEQ ID NO: 2385265 - protein, 25 aa, Entamoeba dispar
KDGIKRLAKFKGVHNDIQFCFYGMH

SEQ ID NO: 2385266 - protein, 25 aa, Entamoeba dispar
KDGSVLRIKYLVNERKLIIEIMVNH

SEQ ID NO: 2385267 - protein, 22 aa, Entamoeba dispar
KDGTCTACGYGNYSNGETSVCQ

SEQ ID NO: 2385268 - protein, 21 aa, Entamoeba dispar
KDGYFHKLILVIGYTVLSHSL

SEQ ID NO: 2385269 - protein, 19 aa, Entamoeba dispar
KDICLACNLQGGWFYDEQQ

SEQ ID NO: 2385270 - protein, 23 aa, Entamoeba dispar
KDIDELLELLAIDAKQYVNAPML

SEQ ID NO: 2385271 - protein, 19 aa, Entamoeba dispar
KDIFPVVLHPSIIKMKENA

SEQ ID NO: 2385272 - protein, 20 aa, Entamoeba dispar
KDIIEFLCYKGFRDILPILI

SEQ ID NO: 2385273 - protein, 18 aa, Entamoeba dispar
KDIIKILLEKELNKLRIR

SEQ ID NO: 2385274 - protein, 18 aa, Entamoeba dispar
KDIKQSWIPRPIQHQSFI

SEQ ID NO: 2385275 - protein, 24 aa, Entamoeba dispar
KDIPENIFWCKYFRFLYIKCGKEK

SEQ ID NO: 2385276 - protein, 18 aa, Entamoeba dispar
KDIYGFVADHWYTFSTLK

SEQ ID NO: 2385277 - protein, 24 aa, Entamoeba dispar
KDIYKYSLEFVLKLLHCSLNVFHP

SEQ ID NO: 2385278 - protein, 23 aa, Entamoeba dispar
KDKCFKCKEGYTLYEITTSEGIE

SEQ ID NO: 2385279 - protein, 18 aa, Entamoeba dispar
KDKCIICGEGYFMSSTGI

SEQ ID NO: 2385280 - protein, 20 aa, Entamoeba dispar
KDKCIICGEGYFMSSTGICK

SEQ ID NO: 2385281 - protein, 20 aa, Entamoeba dispar
KDKIEGFLMNFIQKEILGSF

SEQ ID NO: 2385282 - protein, 19 aa, Entamoeba dispar
KDKKCLKCDSNCETCYETP

SEQ ID NO: 2385283 - protein, 28 aa, Entamoeba dispar
KDKLLEYRRLLPILLNYGTGATPSIIKC

SEQ ID NO: 2385284 - protein, 18 aa, Entamoeba dispar
KDKMCYLCSEITECILCS

SEQ ID NO: 2385285 - protein, 20 aa, Entamoeba dispar
KDKRKILLIRYGFCGLIGAI

SEQ ID NO: 2385286 - protein, 35 aa, Entamoeba dispar
KDKSSRKPSNWEVYFKWGLIVVNVIILVVGVLLLL

SEQ ID NO: 2385287 - protein, 26 aa, Entamoeba dispar
KDLELSRIIFLISLICILIIGALFVI

SEQ ID NO: 2385288 - protein, 18 aa, Entamoeba dispar
KDLLRISPVLLTLTDAVN

SEQ ID NO: 2385289 - protein, 25 aa, Entamoeba dispar
KDLNRTAISFSWLLQYAEQNGVSFG

SEQ ID NO: 2385290 - protein, 19 aa, Entamoeba dispar
KDMKCLKCDSNCETCYETP

SEQ ID NO: 2385291 - protein, 23 aa, Entamoeba dispar
KDMQRYMTLLGIMFNNEQLEKRK

SEQ ID NO: 2385292 - protein, 31 aa, Entamoeba dispar
KDNENFIRFPFKLKIKILLDTARGMQFLHEN

SEQ ID NO: 2385293 - protein, 29 aa, Entamoeba dispar
KDNKCIFINSSICLRFINNHCSYCSFGGV

SEQ ID NO: 2385294 - protein, 18 aa, Entamoeba dispar
KDNSCIPCSNKSNCQTCS

SEQ ID NO: 2385295 - protein, 19 aa, Entamoeba dispar
KDPLLSFAILQKDEISIRN

SEQ ID NO: 2385296 - protein, 20 aa, Entamoeba dispar
KDPYLLKSNNLHVCLEMVRA

SEQ ID NO: 2385297 - protein, 18 aa, Entamoeba dispar
KDRISRLILEVSCLPLFD

SEQ ID NO: 2385298 - protein, 24 aa, Entamoeba dispar
KDSNYRKTFCFSFQHESDIIEWTN

SEQ ID NO: 2385299 - protein, 20 aa, Entamoeba dispar
KDSQCTKSPYIDDWDEKCGK

SEQ ID NO: 2385300 - protein, 17 aa, Entamoeba dispar
KDTFKGLELDYRHAFKK

SEQ ID NO: 2385301 - protein, 18 aa, Entamoeba dispar
KDTLIFNEEWYKHPWSII

SEQ ID NO: 2385302 - protein, 20 aa, Entamoeba dispar
KDTLKHHIEYTLNKQLDGKG

SEQ ID NO: 2385303 - protein, 25 aa, Entamoeba dispar
KDTRIFKTLIKCLGMINKMEQDFQS

SEQ ID NO: 2385304 - protein, 21 aa, Entamoeba dispar
KDVIQLLLKWIKSEVNEIVLP

SEQ ID NO: 2385305 - protein, 22 aa, Entamoeba dispar
KDVMPRYTMKGIPMTLNKVNLM

SEQ ID NO: 2385306 - protein, 25 aa, Entamoeba dispar
KDVPKVMIFYCMLFTGILIVTILTI

SEQ ID NO: 2385307 - protein, 17 aa, Entamoeba dispar
KDVVVGDHLIIKKNETI

SEQ ID NO: 2385308 - protein, 18 aa, Entamoeba dispar
KDYFLYKMQCEAYEDLEH

SEQ ID NO: 2385309 - protein, 18 aa, Entamoeba dispar
KDYIKLTSNFYFVITAEK

SEQ ID NO: 2385310 - protein, 21 aa, Entamoeba dispar
KEAGNLLLPIIVNLTNTNTKK

SEQ ID NO: 2385311 - protein, 24 aa, Entamoeba dispar
KEAHGDGGYDFAITGYDALGIDLQ

SEQ ID NO: 2385312 - protein, 18 aa, Entamoeba dispar
KEAIKKQNEVLIKKLETS

SEQ ID NO: 2385313 - protein, 22 aa, Entamoeba dispar
KEAKITFLPTFKIKIGNGEYVD

SEQ ID NO: 2385314 - protein, 19 aa, Entamoeba dispar
KECGFGRIRHVGIEKKTLI

SEQ ID NO: 2385315 - protein, 18 aa, Entamoeba dispar
KECIKCLPGYSYYMGECF

SEQ ID NO: 2385316 - protein, 19 aa, Entamoeba dispar
KECSKNFGSECTKCTATEC

SEQ ID NO: 2385317 - protein, 25 aa, Entamoeba dispar
KEDEPKKWLGFVYCGIILITQMIDS

SEQ ID NO: 2385318 - protein, 26 aa, Entamoeba dispar
KEDGREFFIMRNSWYDGWGDGDNYLK

SEQ ID NO: 2385319 - protein, 19 aa, Entamoeba dispar
KEDKCIKCSDSISNCTQCQ

SEQ ID NO: 2385320 - protein, 19 aa, Entamoeba dispar
KEDLILSFLLSGIILAPPY

SEQ ID NO: 2385321 - protein, 28 aa, Entamoeba dispar
KEDLVRIWKCLWKFIDMSVDIPNEERAE

SEQ ID NO: 2385322 - protein, 20 aa, Entamoeba dispar
KEDRSLYSFVLGFANVMYIP

SEQ ID NO: 2385323 - protein, 25 aa, Entamoeba dispar
KEDVINIYCILDWFIENDQQKKKVI

SEQ ID NO: 2385324 - protein, 23 aa, Entamoeba dispar
KEEDLKIKECQKEDCPEPNYHFF

SEQ ID NO: 2385325 - protein, 19 aa, Entamoeba dispar
KEEFWFISINRYEGKKNHK

SEQ ID NO: 2385326 - protein, 23 aa, Entamoeba dispar
KEEPTLFYLLEYFKSDGLLKQMY

SEQ ID NO: 2385327 - protein, 26 aa, Entamoeba dispar
KEESTCWFKIFMIYLYVEFIKLRYYF

SEQ ID NO: 2385328 - protein, 26 aa, Entamoeba dispar
KEEYVKLYFRYLDRYLFNYILHTSPG

SEQ ID NO: 2385329 - protein, 20 aa, Entamoeba dispar
KEFGEHVLIQVICENNIDIG

SEQ ID NO: 2385330 - protein, 20 aa, Entamoeba dispar
KEFITIGNMLWGWKIETYNK

SEQ ID NO: 2385331 - protein, 21 aa, Entamoeba dispar
KEFIVEIRGYYDLNKIKKINI

SEQ ID NO: 2385332 - protein, 17 aa, Entamoeba dispar
KEFKSIFDIKNYVESGK

SEQ ID NO: 2385333 - protein, 19 aa, Entamoeba dispar
KEFKSLFEIKDYVESGKRL

SEQ ID NO: 2385334 - protein, 17 aa, Entamoeba dispar
KEFKSLFEIKQYVEEGK

SEQ ID NO: 2385335 - protein, 20 aa, Entamoeba dispar
KEFLETYFVPYKVEGLLQET

SEQ ID NO: 2385336 - protein, 17 aa, Entamoeba dispar
KEFMPQRWILAHIKLEK

SEQ ID NO: 2385337 - protein, 24 aa, Entamoeba dispar
KEFNYKEIEGISSLFEEIQHIIMI

SEQ ID NO: 2385338 - protein, 22 aa, Entamoeba dispar
KEFPEKELFLLKYLNKESLSNE

SEQ ID NO: 2385339 - protein, 21 aa, Entamoeba dispar
KEGEFSRLALLERGVEEDDQI

SEQ ID NO: 2385340 - protein, 20 aa, Entamoeba dispar
KEGFNLILIARRTELLNEIK

SEQ ID NO: 2385341 - protein, 23 aa, Entamoeba dispar
KEGIEAKGVIGIDVDLKCNGLGI

SEQ ID NO: 2385342 - protein, 25 aa, Entamoeba dispar
KEGKIIVNGIMKWFESITIEKAKSL

SEQ ID NO: 2385343 - protein, 30 aa, Entamoeba dispar
KEGKIKLKQFIKLKCGIPVGQIKVKSTSYL

SEQ ID NO: 2385344 - protein, 18 aa, Entamoeba dispar
KEGKRFLHQMKLKKEPSK

SEQ ID NO: 2385345 - protein, 21 aa, Entamoeba dispar
KEGNPKLADFNAEVKRLEGEL

SEQ ID NO: 2385346 - protein, 25 aa, Entamoeba dispar
KEGQMWRSVIIVGTIFRQGNSYDFQ

SEQ ID NO: 2385347 - protein, 17 aa, Entamoeba dispar
KEGQRSLAELFHNTKQQ

SEQ ID NO: 2385348 - protein, 23 aa, Entamoeba dispar
KEGRASISATFVKGNGFSVRGNS

SEQ ID NO: 2385349 - protein, 25 aa, Entamoeba dispar
KEGVSEYWLGFYVRNYVIGLKGVKI

SEQ ID NO: 2385350 - protein, 22 aa, Entamoeba dispar
KEIEDLIKWARELKSIDEKEIN

SEQ ID NO: 2385351 - protein, 25 aa, Entamoeba dispar
KEIELLQKFRCEYIVDLLGTVEIHN

SEQ ID NO: 2385352 - protein, 20 aa, Entamoeba dispar
KEIIEYFYLLCSALLCSSCS

SEQ ID NO: 2385353 - protein, 21 aa, Entamoeba dispar
KEIIVSLTLSLIGSIIGYLLQ

SEQ ID NO: 2385354 - protein, 21 aa, Entamoeba dispar
KEIKEILIFIMNTFPKIEPTC

SEQ ID NO: 2385355 - protein, 20 aa, Entamoeba dispar
KEIKLGGSLYSKTLTITNTK

SEQ ID NO: 2385356 - protein, 21 aa, Entamoeba dispar
KEILESIKINIKGYFQNRKID

SEQ ID NO: 2385357 - protein, 21 aa, Entamoeba dispar
KEIPINKWVKIGLTVNSTSLT

SEQ ID NO: 2385358 - protein, 25 aa, Entamoeba dispar
KEIPQGELLLRGPALFKEYFNRPEE

SEQ ID NO: 2385359 - protein, 18 aa, Entamoeba dispar
KEIQILIVERIKCLKEPI

SEQ ID NO: 2385360 - protein, 25 aa, Entamoeba dispar
KEIQKERVFGCGKIITVVVLLAMAC

SEQ ID NO: 2385361 - protein, 21 aa, Entamoeba dispar
KEIRHPCIIQYFGYSIEYPHL

SEQ ID NO: 2385362 - protein, 22 aa, Entamoeba dispar
KEISYCVGGKYLSIVVQLSAFC

SEQ ID NO: 2385363 - protein, 19 aa, Entamoeba dispar
KEITIELIIIYILLMLSWI

SEQ ID NO: 2385364 - protein, 26 aa, Entamoeba dispar
KEIVERMCIFVQGFIAEGCKQIIIKE

SEQ ID NO: 2385365 - protein, 24 aa, Entamoeba dispar
KEIVRAELTASFKKMLQLVKEEKE

SEQ ID NO: 2385366 - protein, 24 aa, Entamoeba dispar
KEIYKYPWDIADAITTGKRPKIIQ

SEQ ID NO: 2385367 - protein, 22 aa, Entamoeba dispar
KEIYKYPWDIANTITTGKRPTI

SEQ ID NO: 2385368 - protein, 26 aa, Entamoeba dispar
KEIYNFPWDIAESITSGKRPPIIQEV

SEQ ID NO: 2385369 - protein, 22 aa, Entamoeba dispar
KEKCFKCLTGFIPYNEQCVTLK

SEQ ID NO: 2385370 - protein, 21 aa, Entamoeba dispar
KEKESIGIWYGIKTYGGITYV

SEQ ID NO: 2385371 - protein, 24 aa, Entamoeba dispar
KEKESIGIWYGIKTYGGITYVATS

SEQ ID NO: 2385372 - protein, 27 aa, Entamoeba dispar
KEKIWLYKIIYKFGINLSSFPSYFKVE

SEQ ID NO: 2385373 - protein, 22 aa, Entamoeba dispar
KEKKKSGIILNVYLRDSDSLFD

SEQ ID NO: 2385374 - protein, 27 aa, Entamoeba dispar
KEKKYARLTTIFAILGIFMPPLFILSF

SEQ ID NO: 2385375 - protein, 24 aa, Entamoeba dispar
KEKLWFENELKKWGGIEFLVSLFI

SEQ ID NO: 2385376 - protein, 25 aa, Entamoeba dispar
KEKNWRLGLYIICPLLGVLLIGNIF

SEQ ID NO: 2385377 - protein, 23 aa, Entamoeba dispar
KEKRELLKTIALQIKGWKDIIDR

SEQ ID NO: 2385378 - protein, 28 aa, Entamoeba dispar
KEKVGGLKPSWEIAYCSWEESISYAISV

SEQ ID NO: 2385379 - protein, 21 aa, Entamoeba dispar
KEKYHPIVWVQLFISAIFSVL

SEQ ID NO: 2385380 - protein, 22 aa, Entamoeba dispar
KELCFSMNLFYCTETNGVNCTT

SEQ ID NO: 2385381 - protein, 23 aa, Entamoeba dispar
KELELPKVLSCIVFQCRELTKVD

SEQ ID NO: 2385382 - protein, 20 aa, Entamoeba dispar
KELGDFSVPVAKIIRQMKTE

SEQ ID NO: 2385383 - protein, 19 aa, Entamoeba dispar
KELISFGECHTCMVSTCSL

SEQ ID NO: 2385384 - protein, 17 aa, Entamoeba dispar
KELKSITPRHAYRLLSV

SEQ ID NO: 2385385 - protein, 22 aa, Entamoeba dispar
KELLEFPVDLTVDLQKDLNDAF

SEQ ID NO: 2385386 - protein, 18 aa, Entamoeba dispar
KELSRITQAGGFVLNERV

SEQ ID NO: 2385387 - protein, 21 aa, Entamoeba dispar
KELVPYLSCDLSYIRLGTGSE

SEQ ID NO: 2385388 - protein, 29 aa, Entamoeba dispar
KEMADLITNCWSQDPSVRWTFQQIDEFLD

SEQ ID NO: 2385389 - protein, 18 aa, Entamoeba dispar
KEMASCLRTAGEYLPSAI

SEQ ID NO: 2385390 - protein, 19 aa, Entamoeba dispar
KEMLDICIVMDCREMIELI

SEQ ID NO: 2385391 - protein, 25 aa, Entamoeba dispar
KEMNQSIVMLWRLLKRENTIRNKLV

SEQ ID NO: 2385392 - protein, 17 aa, Entamoeba dispar
KENCLFIPGYYSKHAKK

SEQ ID NO: 2385393 - protein, 18 aa, Entamoeba dispar
KENCLKCNSTRDACAECL

SEQ ID NO: 2385394 - protein, 23 aa, Entamoeba dispar
KENELAELFLIIERIMALSKEGL

SEQ ID NO: 2385395 - protein, 19 aa, Entamoeba dispar
KENIMSFGRQINLYLLSLL

SEQ ID NO: 2385396 - protein, 17 aa, Entamoeba dispar
KENIPPFLLIDGDASVT

SEQ ID NO: 2385397 - protein, 20 aa, Entamoeba dispar
KENLFRYELENEIFNAYNYE

SEQ ID NO: 2385398 - protein, 24 aa, Entamoeba dispar
KENLKRLMNVLSNIILESFYQYQT

SEQ ID NO: 2385399 - protein, 24 aa, Entamoeba dispar
KENQELKSAIPLMRESVDKEKKYY

SEQ ID NO: 2385400 - protein, 27 aa, Entamoeba dispar
KENRNSSIYSVCWSFGKSLGYLFGGLL

SEQ ID NO: 2385401 - protein, 20 aa, Entamoeba dispar
KENTFHIIEKSFLRGEAFSE

SEQ ID NO: 2385402 - protein, 28 aa, Entamoeba dispar
KEPKLLKGRILEKFSKKKLECVECSEFD

SEQ ID NO: 2385403 - protein, 21 aa, Entamoeba dispar
KEPYQIIKFSLRIESSNEGTT

SEQ ID NO: 2385404 - protein, 19 aa, Entamoeba dispar
KEPYQKIEFSLTIKQSNEG

SEQ ID NO: 2385405 - protein, 27 aa, Entamoeba dispar
KEQCAPLVHSYCCRHVWGNDSKAFLYR

SEQ ID NO: 2385406 - protein, 17 aa, Entamoeba dispar
KEQFTQIFLKKLNEKNH

SEQ ID NO: 2385407 - protein, 32 aa, Entamoeba dispar
KEQKWIWPTAIRFVPLFACASVFLNNTPIVAM

SEQ ID NO: 2385408 - protein, 20 aa, Entamoeba dispar
KEQQPLIANFCNKNGSQQLL

SEQ ID NO: 2385409 - protein, 20 aa, Entamoeba dispar
KEQYKRLSIVDSSYEQELLQ

SEQ ID NO: 2385410 - protein, 17 aa, Entamoeba dispar
KEREDILMLGIKTAFSI

SEQ ID NO: 2385411 - protein, 18 aa, Entamoeba dispar
KERIRIEEVIRMLERIQS

SEQ ID NO: 2385412 - protein, 18 aa, Entamoeba dispar
KERIRIEEVVKMLEIIKN

SEQ ID NO: 2385413 - protein, 17 aa, Entamoeba dispar
KERIRIEEVVRMLERIE

SEQ ID NO: 2385414 - protein, 17 aa, Entamoeba dispar
KERIRIEEVVRMLESIE

SEQ ID NO: 2385415 - protein, 21 aa, Entamoeba dispar
KERVIRQLINLWKEDPVNEVS

SEQ ID NO: 2385416 - protein, 26 aa, Entamoeba dispar
KERVLRSEIWIQIYYLIITFGVVITP

SEQ ID NO: 2385417 - protein, 20 aa, Entamoeba dispar
KESIVKMLWSLLVISETNMY

SEQ ID NO: 2385418 - protein, 21 aa, Entamoeba dispar
KESKEILKPVVIAMGDSPLEK

SEQ ID NO: 2385419 - protein, 25 aa, Entamoeba dispar
KESPKQLIWRCLLNAAQGIQYLHQR

SEQ ID NO: 2385420 - protein, 22 aa, Entamoeba dispar
KESQCKSILAITQFSNRVVELF

SEQ ID NO: 2385421 - protein, 18 aa, Entamoeba dispar
KESVFKKYIQSVGGLPSI

SEQ ID NO: 2385422 - protein, 20 aa, Entamoeba dispar
KETDKRLIIYSANEYIYIAN

SEQ ID NO: 2385423 - protein, 18 aa, Entamoeba dispar
KETHKLGIVYVGVNQFKE

SEQ ID NO: 2385424 - protein, 24 aa, Entamoeba dispar
KETIEIIRNFLLQCMLHPHEIVSM

SEQ ID NO: 2385425 - protein, 19 aa, Entamoeba dispar
KETIPLLVVTNGIQYQQPT

SEQ ID NO: 2385426 - protein, 17 aa, Entamoeba dispar
KETKLFFEKTFIKDSPL

SEQ ID NO: 2385427 - protein, 23 aa, Entamoeba dispar
KETLKYAKGKIWVEPSGETSLKI

SEQ ID NO: 2385428 - protein, 24 aa, Entamoeba dispar
KETLPCALTVILAVTIDSNLLDVC

SEQ ID NO: 2385429 - protein, 21 aa, Entamoeba dispar
KETMGPTVFDWFIPSQRRSNE

SEQ ID NO: 2385430 - protein, 17 aa, Entamoeba dispar
KEVARQLTLKGYSLFSK

SEQ ID NO: 2385431 - protein, 19 aa, Entamoeba dispar
KEVCEFKITINPGCTCVIE

SEQ ID NO: 2385432 - protein, 19 aa, Entamoeba dispar
KEVFCDGKISMNFMNSDKL

SEQ ID NO: 2385433 - protein, 18 aa, Entamoeba dispar
KEVFQFLDCNGKFRREAL

SEQ ID NO: 2385434 - protein, 23 aa, Entamoeba dispar
KEVGCRVGTTVGYRVRFEEKMSK

SEQ ID NO: 2385435 - protein, 21 aa, Entamoeba dispar
KEVKQKLIERIKLLEKKIKKI

SEQ ID NO: 2385436 - protein, 20 aa, Entamoeba dispar
KEVYDWFDISFNYFGRTSTE

SEQ ID NO: 2385437 - protein, 20 aa, Entamoeba dispar
KEWFYKLIGLKTCYENNERT

SEQ ID NO: 2385438 - protein, 20 aa, Entamoeba dispar
KEWIFEQILTFTLMYILLLF

SEQ ID NO: 2385439 - protein, 19 aa, Entamoeba dispar
KEWTCDTCTKNIKYECKEI

SEQ ID NO: 2385440 - protein, 19 aa, Entamoeba dispar
KEYEAIQLITFDGISEENI

SEQ ID NO: 2385441 - protein, 26 aa, Entamoeba dispar
KEYGCRECLTGYYLINKECSKCGNKC

SEQ ID NO: 2385442 - protein, 18 aa, Entamoeba dispar
KEYIANLCQVFVVLEVYK

SEQ ID NO: 2385443 - protein, 20 aa, Entamoeba dispar
KEYQCTYPGCNEGLKTKYNC

SEQ ID NO: 2385444 - protein, 22 aa, Entamoeba dispar
KEYSYQASIQWNNVNKFQCNVV

SEQ ID NO: 2385445 - protein, 19 aa, Entamoeba dispar
KEYVRRTVQEFSEKRNVTI

SEQ ID NO: 2385446 - protein, 20 aa, Entamoeba dispar
KEYYVELVEVPNLLKGKVPP

SEQ ID NO: 2385447 - protein, 23 aa, Entamoeba dispar
KFAKEGFNLIIIARREEILKEMK

SEQ ID NO: 2385448 - protein, 24 aa, Entamoeba dispar
KFASCTEHCFIFFFDLADNKYKQI

SEQ ID NO: 2385449 - protein, 24 aa, Entamoeba dispar
KFCKERNIVCCVAISPSPYLISMM

SEQ ID NO: 2385450 - protein, 23 aa, Entamoeba dispar
KFCKTRNGAQMKLSEKFVVFSDA

SEQ ID NO: 2385451 - protein, 24 aa, Entamoeba dispar
KFDKKLHSHFSYWMDSVLEIFETC

SEQ ID NO: 2385452 - protein, 27 aa, Entamoeba dispar
KFDKLRCPLCDTVYCSIECKEKDKQKH

SEQ ID NO: 2385453 - protein, 21 aa, Entamoeba dispar
KFFGSEIEDFIGFVPHLGTTG

SEQ ID NO: 2385454 - protein, 17 aa, Entamoeba dispar
KFFKDPYLLKSNNLHVC

SEQ ID NO: 2385455 - protein, 19 aa, Entamoeba dispar
KFFKQPKMKTIIETTIPMT

SEQ ID NO: 2385456 - protein, 19 aa, Entamoeba dispar
KFFSFCLLIGLLTIPQVLR

SEQ ID NO: 2385457 - protein, 18 aa, Entamoeba dispar
KFFVLYISVAIWPFCTAF

SEQ ID NO: 2385458 - protein, 19 aa, Entamoeba dispar
KFGECKPCTEHCRTCLYNS

SEQ ID NO: 2385459 - protein, 24 aa, Entamoeba dispar
KFIGECKECLSIFINGSIEVINNL

SEQ ID NO: 2385460 - protein, 18 aa, Entamoeba dispar
KFIKDYYGDWMQKVLKYL

SEQ ID NO: 2385461 - protein, 18 aa, Entamoeba dispar
KFINSPINRFFDFQFTSL

SEQ ID NO: 2385462 - protein, 18 aa, Entamoeba dispar
KFKADYHFYYFIFQTDNS

SEQ ID NO: 2385463 - protein, 26 aa, Entamoeba dispar
KFKEFKRVVCEQLTLVLCKRETTPQN

SEQ ID NO: 2385464 - protein, 22 aa, Entamoeba dispar
KFKEKIGFAVLPSMVKTLEITD

SEQ ID NO: 2385465 - protein, 20 aa, Entamoeba dispar
KFKGQPFVEYTLNSCGDETT

SEQ ID NO: 2385466 - protein, 22 aa, Entamoeba dispar
KFKYPWNIASFIMNGDRLPKVS

SEQ ID NO: 2385467 - protein, 20 aa, Entamoeba dispar
KFLESYCIETNIPKGDFEQH

SEQ ID NO: 2385468 - protein, 31 aa, Entamoeba dispar
KFLLLKVVCCSIILCLKKLLLNKDFSSTLKI

SEQ ID NO: 2385469 - protein, 24 aa, Entamoeba dispar
KFNKPPPCFSQFYKINFNNLFVNI

SEQ ID NO: 2385470 - protein, 20 aa, Entamoeba dispar
KFNYMLAGIILMILSLLCGL

SEQ ID NO: 2385471 - protein, 25 aa, Entamoeba dispar
KFPEKIPFRLTRMIVNAMDVSGVEG

SEQ ID NO: 2385472 - protein, 24 aa, Entamoeba dispar
KFPIKIHYLFICVYIIVSLVVVYG

SEQ ID NO: 2385473 - protein, 29 aa, Entamoeba dispar
KFPTGDGFFYQWVMAIGVLLAGIFTLLIV

SEQ ID NO: 2385474 - protein, 19 aa, Entamoeba dispar
KFQECLCEKNFVPINGECT

SEQ ID NO: 2385475 - protein, 25 aa, Entamoeba dispar
KFSPILKKCIPLLCGNNKIDDIYLN

SEQ ID NO: 2385476 - protein, 19 aa, Entamoeba dispar
KFYQMMYWIIGIPAVAVEY

SEQ ID NO: 2385477 - protein, 23 aa, Entamoeba dispar
KGADLSSAIGRCVGSNPTGCILF

SEQ ID NO: 2385478 - protein, 24 aa, Entamoeba dispar
KGCSECIKSTFDLYATSVETIKKG

SEQ ID NO: 2385479 - protein, 25 aa, Entamoeba dispar
KGDKCVKCSQGFFITSDFKCLRCSD

SEQ ID NO: 2385480 - protein, 18 aa, Entamoeba dispar
KGDKIAIFCETRYEWMAF

SEQ ID NO: 2385481 - protein, 18 aa, Entamoeba dispar
KGDPQYLLFSPKKLFNQE

SEQ ID NO: 2385482 - protein, 21 aa, Entamoeba dispar
KGEACEFEIFIIPLCTCTIED

SEQ ID NO: 2385483 - protein, 19 aa, Entamoeba dispar
KGECINTIIEYCEEQNGYG

SEQ ID NO: 2385484 - protein, 19 aa, Entamoeba dispar
KGECINTIIEYCEEQNTYG

SEQ ID NO: 2385485 - protein, 19 aa, Entamoeba dispar
KGECQYYKLFGGYSSISFD

SEQ ID NO: 2385486 - protein, 17 aa, Entamoeba dispar
KGEECDGGDGCIECECQ

SEQ ID NO: 2385487 - protein, 27 aa, Entamoeba dispar
KGEGLKKNFLFNGDCLISIHVDMNSIS

SEQ ID NO: 2385488 - protein, 17 aa, Entamoeba dispar
KGELVCVLGSVGSGKSS

SEQ ID NO: 2385489 - protein, 25 aa, Entamoeba dispar
KGERKIKILCLIPFSSERKRMGIII

SEQ ID NO: 2385490 - protein, 19 aa, Entamoeba dispar
KGFDLTCLLKLKDLKTNTN

SEQ ID NO: 2385491 - protein, 27 aa, Entamoeba dispar
KGFNAACAPLLWVCTISMIILIVPNFR

SEQ ID NO: 2385492 - protein, 17 aa, Entamoeba dispar
KGFWFKIIGSDLTLDIS

SEQ ID NO: 2385493 - protein, 22 aa, Entamoeba dispar
KGGIFNIWFNTWFIHDNKLEFS

SEQ ID NO: 2385494 - protein, 19 aa, Entamoeba dispar
KGHINCTVCKYREYVEENR

SEQ ID NO: 2385495 - protein, 19 aa, Entamoeba dispar
KGHVNCTVCKYREYVEENR

SEQ ID NO: 2385496 - protein, 23 aa, Entamoeba dispar
KGIAPPCIYGICKSKQEKKLKKQ

SEQ ID NO: 2385497 - protein, 17 aa, Entamoeba dispar
KGIDVTSVIAIQLCNEP

SEQ ID NO: 2385498 - protein, 24 aa, Entamoeba dispar
KGIIFEPRFGLTIIQIAKNTKLYL

SEQ ID NO: 2385499 - protein, 30 aa, Entamoeba dispar
KGIKLLATISFLCFAVYFFALIGVITVTLI

SEQ ID NO: 2385500 - protein, 22 aa, Entamoeba dispar
KGIMRKPTCNEIVMIGVGAAAV

SEQ ID NO: 2385501 - protein, 19 aa, Entamoeba dispar
KGISQNIDWIASAFKTINI

SEQ ID NO: 2385502 - protein, 17 aa, Entamoeba dispar
KGIWYKVVNDYKYAFPL

SEQ ID NO: 2385503 - protein, 19 aa, Entamoeba dispar
KGKFLRERIQWKILQVLNF

SEQ ID NO: 2385504 - protein, 19 aa, Entamoeba dispar
KGKLTCVISDFGLSGTYNE

SEQ ID NO: 2385505 - protein, 23 aa, Entamoeba dispar
KGLEVIPNYLFWIGLPSLLVDGV

SEQ ID NO: 2385506 - protein, 26 aa, Entamoeba dispar
KGLEYCPKGRYILRQVFDKKKNLVEK

SEQ ID NO: 2385507 - protein, 20 aa, Entamoeba dispar
KGLIQDCWKQNVGERPSFEQ

SEQ ID NO: 2385508 - protein, 26 aa, Entamoeba dispar
KGLSKALTNFLFWGIGSIVYILYFFF

SEQ ID NO: 2385509 - protein, 20 aa, Entamoeba dispar
KGNCQMQCMYEDACSSGCIL

SEQ ID NO: 2385510 - protein, 33 aa, Entamoeba dispar
KGNGIMIIRIELPFGIWCDGCKNLIGKGTRFNA

SEQ ID NO: 2385511 - protein, 26 aa, Entamoeba dispar
KGNICKRKSMWWISLIVIPIFILIVI

SEQ ID NO: 2385512 - protein, 20 aa, Entamoeba dispar
KGNRSGCKTCDICYRVRWCS

SEQ ID NO: 2385513 - protein, 18 aa, Entamoeba dispar
KGNVTVKVVNNFPVESFK

SEQ ID NO: 2385514 - protein, 21 aa, Entamoeba dispar
KGRQSFWVYAVDELQHVNLRT

SEQ ID NO: 2385515 - protein, 24 aa, Entamoeba dispar
KGSNGYAIFHMLRWTQGNEANVER

SEQ ID NO: 2385516 - protein, 22 aa, Entamoeba dispar
KGSVSVFMMFKYATWIEIIFNI

SEQ ID NO: 2385517 - protein, 23 aa, Entamoeba dispar
KGTEGCIKYGYGSYLQNPENCQE

SEQ ID NO: 2385518 - protein, 28 aa, Entamoeba dispar
KGTFTMPYRVCIGKQDYLYQFVIPSKTI

SEQ ID NO: 2385519 - protein, 22 aa, Entamoeba dispar
KGTTLVGIKIKINRLIFFSNSS

SEQ ID NO: 2385520 - protein, 18 aa, Entamoeba dispar
KGVIAGDVLGVFFSVWMA

SEQ ID NO: 2385521 - protein, 28 aa, Entamoeba dispar
KGVLKNCALIHLLRVILWAVRESPKSNF

SEQ ID NO: 2385522 - protein, 18 aa, Entamoeba dispar
KGYCRNGEKVIVHTNEIL

SEQ ID NO: 2385523 - protein, 23 aa, Entamoeba dispar
KGYKLIYLKVHFYEMKLLILGFI

SEQ ID NO: 2385524 - protein, 18 aa, Entamoeba dispar
KGYQFHIRMNKGVVGNWR

SEQ ID NO: 2385525 - protein, 17 aa, Entamoeba dispar
KHCNIELQTYPTLPTIV

SEQ ID NO: 2385526 - protein, 25 aa, Entamoeba dispar
KHCSAHAKSSILLLPEALKLIPIFV

SEQ ID NO: 2385527 - protein, 17 aa, Entamoeba dispar
KHCYINHQIQIFVNGVI

SEQ ID NO: 2385528 - protein, 17 aa, Entamoeba dispar
KHELVFTPCRGILRKGQ

SEQ ID NO: 2385529 - protein, 20 aa, Entamoeba dispar
KHFSGSHFLICAVYALFKSH

SEQ ID NO: 2385530 - protein, 21 aa, Entamoeba dispar
KHGKFKLCSTVSSTKLQSATP

SEQ ID NO: 2385531 - protein, 22 aa, Entamoeba dispar
KHKITQPSIMKWETKKLMSKPR

SEQ ID NO: 2385532 - protein, 18 aa, Entamoeba dispar
KHKYCKRILNIVINKCIE

SEQ ID NO: 2385533 - protein, 20 aa, Entamoeba dispar
KHLEILKAILPLRNQKSPKV

SEQ ID NO: 2385534 - protein, 22 aa, Entamoeba dispar
KHLRHPCVLQFFGSGTDMNYIL

SEQ ID NO: 2385535 - protein, 17 aa, Entamoeba dispar
KHNCGYYAIGYNTIQRY

SEQ ID NO: 2385536 - protein, 21 aa, Entamoeba dispar
KHPRNPTDIIVMTDGFCYSAC

SEQ ID NO: 2385537 - protein, 17 aa, Entamoeba dispar
KHSKLALNQPSLRTKFA

SEQ ID NO: 2385538 - protein, 22 aa, Entamoeba dispar
KHSPSDLYSCEDYGYESNIEEV

SEQ ID NO: 2385539 - protein, 26 aa, Entamoeba dispar
KICWGLKIYFAYGFLMSIFIQITILL

SEQ ID NO: 2385540 - protein, 24 aa, Entamoeba dispar
KIDIPVFWPILLVYFIVLFVVTMH

SEQ ID NO: 2385541 - protein, 31 aa, Entamoeba dispar
KIDKMYFVYFLKFGIAIGIHLSILILKLLFS

SEQ ID NO: 2385542 - protein, 25 aa, Entamoeba dispar
KIDKRIYLPLILKRIRELANTYLSL

SEQ ID NO: 2385543 - protein, 18 aa, Entamoeba dispar
KIDSIWKRIKEIIMINEI

SEQ ID NO: 2385544 - protein, 22 aa, Entamoeba dispar
KIEAVYLMSIIPHFISLNMLMR

SEQ ID NO: 2385545 - protein, 23 aa, Entamoeba dispar
KIEDAATFSAHYLIEKKRINELS

SEQ ID NO: 2385546 - protein, 22 aa, Entamoeba dispar
KIEEARKAFLNGKEGVENVECA

SEQ ID NO: 2385547 - protein, 17 aa, Entamoeba dispar
KIEEWKVFKKELIYLIE

SEQ ID NO: 2385548 - protein, 27 aa, Entamoeba dispar
KIEFAKEIIGIFPFDQSILITFIDNTF

SEQ ID NO: 2385549 - protein, 18 aa, Entamoeba dispar
KIELFKGPIMESYLNAKK

SEQ ID NO: 2385550 - protein, 20 aa, Entamoeba dispar
KIEMKETLIAVLNDINAVGF

SEQ ID NO: 2385551 - protein, 31 aa, Entamoeba dispar
KIERSSCIVRFLFNTAFQFKKKFYVDYQLRP

SEQ ID NO: 2385552 - protein, 25 aa, Entamoeba dispar
KIFANPRCTIYGNGMTITFYNTSNT

SEQ ID NO: 2385553 - protein, 23 aa, Entamoeba dispar
KIFPCKCKKCQKLNEMRWKKPLT

SEQ ID NO: 2385554 - protein, 18 aa, Entamoeba dispar
KIGEIFGIHPLTIDDWLS

SEQ ID NO: 2385555 - protein, 18 aa, Entamoeba dispar
KIGLSLAVSVIPEGLVAV

SEQ ID NO: 2385556 - protein, 30 aa, Entamoeba dispar
KIGRMKFRPSRPHFVELISFEDQNISADIC

SEQ ID NO: 2385557 - protein, 21 aa, Entamoeba dispar
KIGVEKVCIMENGFEGYHECV

SEQ ID NO: 2385558 - protein, 19 aa, Entamoeba dispar
KIIGALCVIDKEILNNINK

SEQ ID NO: 2385559 - protein, 22 aa, Entamoeba dispar
KIIQKFRFFVGLIPIFIPVLLV

SEQ ID NO: 2385560 - protein, 20 aa, Entamoeba dispar
KIIVGLIVGLSIYFSTGNVA

SEQ ID NO: 2385561 - protein, 24 aa, Entamoeba dispar
KIKCPASKGLDCKAIPLVSQIYLT

SEQ ID NO: 2385562 - protein, 23 aa, Entamoeba dispar
KIKIGGITASYGFLISAYIDELI

SEQ ID NO: 2385563 - protein, 17 aa, Entamoeba dispar
KIKIVYVAPEFLSSSLK

SEQ ID NO: 2385564 - protein, 23 aa, Entamoeba dispar
KIKKICLFQVFGFKGTLIHVVAL

SEQ ID NO: 2385565 - protein, 18 aa, Entamoeba dispar
KIKLVHKGSILKSLSASL

SEQ ID NO: 2385566 - protein, 17 aa, Entamoeba dispar
KIKNIVIILKHYISFIL

SEQ ID NO: 2385567 - protein, 24 aa, Entamoeba dispar
KIKSDGIGKGFALWLTTKPIVSGN

SEQ ID NO: 2385568 - protein, 25 aa, Entamoeba dispar
KIKSFVEWYLYGGLQSILFFVIFYF

SEQ ID NO: 2385569 - protein, 21 aa, Entamoeba dispar
KIKVAKKIEGGIIVIDIDNNV

SEQ ID NO: 2385570 - protein, 19 aa, Entamoeba dispar
KIKYERIIKQMKVSDVRND

SEQ ID NO: 2385571 - protein, 23 aa, Entamoeba dispar
KILFCSLMGLSILMIIPDLIQHP

SEQ ID NO: 2385572 - protein, 20 aa, Entamoeba dispar
KILFVHIHFIVKRKSQIWKK

SEQ ID NO: 2385573 - protein, 22 aa, Entamoeba dispar
KILPTFIIKFIYLLLFYIFFSL

SEQ ID NO: 2385574 - protein, 31 aa, Entamoeba dispar
KILQFPSSLLIRRKLVLIAFQCLQSKVIKPE

SEQ ID NO: 2385575 - protein, 25 aa, Entamoeba dispar
KIMKEIFKLSISYINKFIEKEIIEV

SEQ ID NO: 2385576 - protein, 22 aa, Entamoeba dispar
KIPPIDWKQFFIVFGQGIILLG

SEQ ID NO: 2385577 - protein, 24 aa, Entamoeba dispar
KIQARTCDFLSFFIDSASTALMKE

SEQ ID NO: 2385578 - protein, 20 aa, Entamoeba dispar
KIQHFFDKRLPALRDSARNK

SEQ ID NO: 2385579 - protein, 17 aa, Entamoeba dispar
KIQLKRLLLRIKNGTPA

SEQ ID NO: 2385580 - protein, 31 aa, Entamoeba dispar
KIQNIIFQFCEILYAWSCIDVFIISVIAAVV

SEQ ID NO: 2385581 - protein, 19 aa, Entamoeba dispar
KIRCDYIVHFYGAFCFDFN

SEQ ID NO: 2385582 - protein, 17 aa, Entamoeba dispar
KIRCPYIVSFIGCVTNK

SEQ ID NO: 2385583 - protein, 17 aa, Entamoeba dispar
KIRKLRDKLDYVFAKRE

SEQ ID NO: 2385584 - protein, 17 aa, Entamoeba dispar
KISFRQGRLNQFITATQ

SEQ ID NO: 2385585 - protein, 19 aa, Entamoeba dispar
KISLFSLSVCSVLMVNIWS

SEQ ID NO: 2385586 - protein, 18 aa, Entamoeba dispar
KISLPCCDDSFTRDVYFI

SEQ ID NO: 2385587 - protein, 17 aa, Entamoeba dispar
KISNAIVNWFDKRNQQW

SEQ ID NO: 2385588 - protein, 19 aa, Entamoeba dispar
KISPYRIATGSLPFSRNQY

SEQ ID NO: 2385589 - protein, 25 aa, Entamoeba dispar
KISRKRPSHWQKFALENKDVIQLLL

SEQ ID NO: 2385590 - protein, 28 aa, Entamoeba dispar
KISTIKGFKLASFELTKTGFKFVACEIG

SEQ ID NO: 2385591 - protein, 26 aa, Entamoeba dispar
KITFLKIKCIYLMVVSKKFKSNNKKS

SEQ ID NO: 2385592 - protein, 20 aa, Entamoeba dispar
KITIFKRFPALLPQLCVASF

SEQ ID NO: 2385593 - protein, 19 aa, Entamoeba dispar
KITTEFISFRAFDISNQRN

SEQ ID NO: 2385594 - protein, 19 aa, Entamoeba dispar
KIYEYFGIEYSKEFDEALK

SEQ ID NO: 2385595 - protein, 25 aa, Entamoeba dispar
KIYFMRRIYIVIGLIDLLDSFNFKC

SEQ ID NO: 2385596 - protein, 23 aa, Entamoeba dispar
KIYKKIGWDKMKWEKRVEEVKKQ

SEQ ID NO: 2385597 - protein, 20 aa, Entamoeba dispar
KIYPSFYLKNYLIRLYFNLL

SEQ ID NO: 2385598 - protein, 19 aa, Entamoeba dispar
KIYQTCLYLSYNKEPQFEF

SEQ ID NO: 2385599 - protein, 33 aa, Entamoeba dispar
KIYYATNVCQRWLGMRIELIGCIGLGAVVIFSS

SEQ ID NO: 2385600 - protein, 17 aa, Entamoeba dispar
KKACLKSDVYSFGMVLW

SEQ ID NO: 2385601 - protein, 28 aa, Entamoeba dispar
KKAQITLCSSCGKPIIGSVALEVKGKKY

SEQ ID NO: 2385602 - protein, 32 aa, Entamoeba dispar
KKASKKLWIILCIAGGIVIVLGAIVTLVCILK

SEQ ID NO: 2385603 - protein, 23 aa, Entamoeba dispar
KKCQCIGDCTCCRDIIEDIHSVK

SEQ ID NO: 2385604 - protein, 24 aa, Entamoeba dispar
KKDGECSKCPVLVNNSVIKSNKLK

SEQ ID NO: 2385605 - protein, 20 aa, Entamoeba dispar
KKDLNGIGISPDWKTNIEGI

SEQ ID NO: 2385606 - protein, 21 aa, Entamoeba dispar
KKDRVWYLISYSICKFTVLDR

SEQ ID NO: 2385607 - protein, 18 aa, Entamoeba dispar
KKDVPVLVRAIIPDRDPV

SEQ ID NO: 2385608 - protein, 23 aa, Entamoeba dispar
KKECPQLASKCCINNQGCALYKG

SEQ ID NO: 2385609 - protein, 17 aa, Entamoeba dispar
KKEINSINEIMYKEEEE

SEQ ID NO: 2385610 - protein, 17 aa, Entamoeba dispar
KKEISINQCFPKLIGDL

SEQ ID NO: 2385611 - protein, 21 aa, Entamoeba dispar
KKEIVRYIFDIGYWIGNNKGV

SEQ ID NO: 2385612 - protein, 23 aa, Entamoeba dispar
KKEKIWWIIIIIIGGCGIIIIII

SEQ ID NO: 2385613 - protein, 22 aa, Entamoeba dispar
KKELIYLIEFNDIFEVWANYLI

SEQ ID NO: 2385614 - protein, 20 aa, Entamoeba dispar
KKENEVNCISSWNIVFKSWN

SEQ ID NO: 2385615 - protein, 19 aa, Entamoeba dispar
KKEQLNWNRFIGGLDSKNS

SEQ ID NO: 2385616 - protein, 21 aa, Entamoeba dispar
KKEREQRLNIEMKKKEEENKK

SEQ ID NO: 2385617 - protein, 28 aa, Entamoeba dispar
KKERIAEYFIPFLFDFIDNFERITEIWT

SEQ ID NO: 2385618 - protein, 24 aa, Entamoeba dispar
KKESKWKIILERIYEYSSIIPISV

SEQ ID NO: 2385619 - protein, 25 aa, Entamoeba dispar
KKETTLQYFAYRPLFEQGKLIINGE

SEQ ID NO: 2385620 - protein, 30 aa, Entamoeba dispar
KKEVKHILFVIAFRSCMNFIVWAIPPSVSF

SEQ ID NO: 2385621 - protein, 22 aa, Entamoeba dispar
KKFKCIECEKGYYLNSNKECQI

SEQ ID NO: 2385622 - protein, 18 aa, Entamoeba dispar
KKFNSAVVKIYLQDTQTI

SEQ ID NO: 2385623 - protein, 17 aa, Entamoeba dispar
KKFPMEVFRDTLKQIPI

SEQ ID NO: 2385624 - protein, 29 aa, Entamoeba dispar
KKFPTGDGFFFQWVMSIGILIVGIFSLLF

SEQ ID NO: 2385625 - protein, 18 aa, Entamoeba dispar
KKGELVCVLGSVGSGKSS

SEQ ID NO: 2385626 - protein, 19 aa, Entamoeba dispar
KKGELVCVLGSVGSGKSSF

SEQ ID NO: 2385627 - protein, 17 aa, Entamoeba dispar
KKGFTVEDMIARNFQEL

SEQ ID NO: 2385628 - protein, 30 aa, Entamoeba dispar
KKGVLKEKWLNRINPLYPFLQTELQEQLKL

SEQ ID NO: 2385629 - protein, 21 aa, Entamoeba dispar
KKHPNCCQIAFMQRAPKYIRK

SEQ ID NO: 2385630 - protein, 27 aa, Entamoeba dispar
KKICLNCGCLVCNNCFTEHRIICTNGF

SEQ ID NO: 2385631 - protein, 18 aa, Entamoeba dispar
KKIENGRIFQSCESVLPI

SEQ ID NO: 2385632 - protein, 19 aa, Entamoeba dispar
KKIFKNIINYEIKRVTDQL

SEQ ID NO: 2385633 - protein, 18 aa, Entamoeba dispar
KKIKCNQIGRAIVKGGMG

SEQ ID NO: 2385634 - protein, 20 aa, Entamoeba dispar
KKILKWVISNWKCMVFFVIF

SEQ ID NO: 2385635 - protein, 21 aa, Entamoeba dispar
KKILVAYPMALYFILFVLLVM

SEQ ID NO: 2385636 - protein, 18 aa, Entamoeba dispar
KKINFPRMRGTLGTTELK

SEQ ID NO: 2385637 - protein, 25 aa, Entamoeba dispar
KKIPPKRLKFNHIINRSLSTAIEIQ

SEQ ID NO: 2385638 - protein, 21 aa, Entamoeba dispar
KKIRYSYALIFLIGCIFFVAI

SEQ ID NO: 2385639 - protein, 23 aa, Entamoeba dispar
KKKAYPRLILRDGDFFSDKGMKI

SEQ ID NO: 2385640 - protein, 20 aa, Entamoeba dispar
KKKHVIMAWNEMSDINKING

SEQ ID NO: 2385641 - protein, 18 aa, Entamoeba dispar
KKKIISITQADDWVEEII

SEQ ID NO: 2385642 - protein, 19 aa, Entamoeba dispar
KKKIQGFEINCFEIAGIIV

SEQ ID NO: 2385643 - protein, 23 aa, Entamoeba dispar
KKKKEVFEKAYLTEIQTINQSEL

SEQ ID NO: 2385644 - protein, 19 aa, Entamoeba dispar
KKKKRIAIQNEINKMKMDI

SEQ ID NO: 2385645 - protein, 19 aa, Entamoeba dispar
KKKLCFPDNGRWLNITIVN

SEQ ID NO: 2385646 - protein, 26 aa, Entamoeba dispar
KKKLITFIVYCCLLIPIIMQCYLLVH

SEQ ID NO: 2385647 - protein, 18 aa, Entamoeba dispar
KKKLLNILQNFANIIEER

SEQ ID NO: 2385648 - protein, 29 aa, Entamoeba dispar
KKKRSITLRGYWQIFGYVMVAIFVILILY

SEQ ID NO: 2385649 - protein, 32 aa, Entamoeba dispar
KKKSLCKRIIQFPSWFFKQFFRTDPNGASMFL

SEQ ID NO: 2385650 - protein, 22 aa, Entamoeba dispar
KKKSSLFLLFSLLSLGLSASMC

SEQ ID NO: 2385651 - protein, 22 aa, Entamoeba dispar
KKKSWLCVFPGCKESVKTHYNC

SEQ ID NO: 2385652 - protein, 21 aa, Entamoeba dispar
KKKVIGLCEYCFSQNISSLPI

SEQ ID NO: 2385653 - protein, 20 aa, Entamoeba dispar
KKKYRLLDPSGFDLKIGNSK

SEQ ID NO: 2385654 - protein, 18 aa, Entamoeba dispar
KKLCMLLLQFSRDISDTP

SEQ ID NO: 2385655 - protein, 21 aa, Entamoeba dispar
KKLIRSIKRNVIFYGTLIILL

SEQ ID NO: 2385656 - protein, 23 aa, Entamoeba dispar
KKLITFIVYCCLLIPIIMQCYLL

SEQ ID NO: 2385657 - protein, 18 aa, Entamoeba dispar
KKLKSYKLLVANFEKALK

SEQ ID NO: 2385658 - protein, 18 aa, Entamoeba dispar
KKLLKGAMNFLFSPNKIV

SEQ ID NO: 2385659 - protein, 29 aa, Entamoeba dispar
KKLLVVKVFDCLFIFLINRISFHFREGHI

SEQ ID NO: 2385660 - protein, 19 aa, Entamoeba dispar
KKLMLKFNLGVIFFYIIVY

SEQ ID NO: 2385661 - protein, 26 aa, Entamoeba dispar
KKLNSIPIEYFIGGNIFNNSIDYLIQ

SEQ ID NO: 2385662 - protein, 19 aa, Entamoeba dispar
KKLPWKGKVKHIQYTRFKK

SEQ ID NO: 2385663 - protein, 23 aa, Entamoeba dispar
KKLREKARIEVMKEIKAKETKTE

SEQ ID NO: 2385664 - protein, 21 aa, Entamoeba dispar
KKLRHPCVLQFFGSGTDANFI

SEQ ID NO: 2385665 - protein, 28 aa, Entamoeba dispar
KKLYYYKDLCCFCIEKDQLSSWMTIIKA

SEQ ID NO: 2385666 - protein, 19 aa, Entamoeba dispar
KKMHLEILNEDTLKLIAVH

SEQ ID NO: 2385667 - protein, 23 aa, Entamoeba dispar
KKMSESIIGIGIREVSQSAYDIL

SEQ ID NO: 2385668 - protein, 17 aa, Entamoeba dispar
KKNCEVCDAITGICSTC

SEQ ID NO: 2385669 - protein, 23 aa, Entamoeba dispar
KKNFWSIYCSILYSIHGFGNTTF

SEQ ID NO: 2385670 - protein, 23 aa, Entamoeba dispar
KKNPKFIMRCVQAMALCHNVTPS

SEQ ID NO: 2385671 - protein, 18 aa, Entamoeba dispar
KKNVCPITKFIKWTYKLP

SEQ ID NO: 2385672 - protein, 19 aa, Entamoeba dispar
KKPADIYAFAITIYEVMKW

SEQ ID NO: 2385673 - protein, 24 aa, Entamoeba dispar
KKPESLSITFLVMWLGGDITNLLG

SEQ ID NO: 2385674 - protein, 19 aa, Entamoeba dispar
KKPLGLIEGEWKWKPKRNY

SEQ ID NO: 2385675 - protein, 18 aa, Entamoeba dispar
KKPLRFTSDIIVNRLTLS

SEQ ID NO: 2385676 - protein, 26 aa, Entamoeba dispar
KKPLTIKRFIAVLIMIVLIFLFYTLN

SEQ ID NO: 2385677 - protein, 19 aa, Entamoeba dispar
KKPQILFDIITKILQKYSE

SEQ ID NO: 2385678 - protein, 20 aa, Entamoeba dispar
KKPSNSICCKMTFNNELKEI

SEQ ID NO: 2385679 - protein, 23 aa, Entamoeba dispar
KKPTKFIGNFTMKITESAEGLGR

SEQ ID NO: 2385680 - protein, 24 aa, Entamoeba dispar
KKPVKQKWLWSLYIILTVMSIITL

SEQ ID NO: 2385681 - protein, 29 aa, Entamoeba dispar
KKQFKVKFYLKVVIGVSLFVSIFFLIMRT

SEQ ID NO: 2385682 - protein, 17 aa, Entamoeba dispar
KKQYISWVMALFELSSH

SEQ ID NO: 2385683 - protein, 21 aa, Entamoeba dispar
KKRESDQIFSIPIVHQKHLST

SEQ ID NO: 2385684 - protein, 19 aa, Entamoeba dispar
KKRIYSICVGVFQIILIFF

SEQ ID NO: 2385685 - protein, 18 aa, Entamoeba dispar
KKRKGEMNSNDFFENCSK

SEQ ID NO: 2385686 - protein, 26 aa, Entamoeba dispar
KKRRFSWSDGHSFSFPFFKKKKKCSS

SEQ ID NO: 2385687 - protein, 20 aa, Entamoeba dispar
KKRYGSYGSIRGWYGNYKFV

SEQ ID NO: 2385688 - protein, 21 aa, Entamoeba dispar
KKRYIYNQGFIKNWIKFLFRP

SEQ ID NO: 2385689 - protein, 19 aa, Entamoeba dispar
KKSLWKNWCEAFLIEDYQW

SEQ ID NO: 2385690 - protein, 23 aa, Entamoeba dispar
KKTEVEALFYLPFHPILLTLFVL

SEQ ID NO: 2385691 - protein, 26 aa, Entamoeba dispar
KKTFSIGKIIAFIAIILLIIFMLFMP

SEQ ID NO: 2385692 - protein, 20 aa, Entamoeba dispar
KKTFTQFGACEFMKDLQQIQ

SEQ ID NO: 2385693 - protein, 24 aa, Entamoeba dispar
KKTGYKAEVIFNLRGTFSSDKYQT

SEQ ID NO: 2385694 - protein, 21 aa, Entamoeba dispar
KKTYPRYILMDGDLNSDKGMK

SEQ ID NO: 2385695 - protein, 18 aa, Entamoeba dispar
KKVKEVIESAYILNNKKV

SEQ ID NO: 2385696 - protein, 22 aa, Entamoeba dispar
KKVLLNSGCSPVLIYRRDNGGV

SEQ ID NO: 2385697 - protein, 17 aa, Entamoeba dispar
KKVNIIFYTVLIIGFLV

SEQ ID NO: 2385698 - protein, 18 aa, Entamoeba dispar
KKVNIIIKKFFMVNAKPD

SEQ ID NO: 2385699 - protein, 23 aa, Entamoeba dispar
KKWPENALIAIGGFLFLRFINPA

SEQ ID NO: 2385700 - protein, 19 aa, Entamoeba dispar
KKYAKARIGCMLSTCGNKK

SEQ ID NO: 2385701 - protein, 22 aa, Entamoeba dispar
KKYEILNMFPFSSSTKRMGVIV

SEQ ID NO: 2385702 - protein, 18 aa, Entamoeba dispar
KKYFKIGVIALFLIGMIA

SEQ ID NO: 2385703 - protein, 17 aa, Entamoeba dispar
KKYHKQCFFCSRCKNVL

SEQ ID NO: 2385704 - protein, 19 aa, Entamoeba dispar
KKYIENLSMITAEDIVSDE

SEQ ID NO: 2385705 - protein, 18 aa, Entamoeba dispar
KKYIQSVGGLPSIIIYLC

SEQ ID NO: 2385706 - protein, 19 aa, Entamoeba dispar
KKYKIEKEYAYIVTVLITL

SEQ ID NO: 2385707 - protein, 22 aa, Entamoeba dispar
KKYNPSIIISYYIKQSIGGILF

SEQ ID NO: 2385708 - protein, 17 aa, Entamoeba dispar
KKYPVGDGFYFTFMMGL

SEQ ID NO: 2385709 - protein, 17 aa, Entamoeba dispar
KKYSRRCKAPIPFELPR

SEQ ID NO: 2385710 - protein, 20 aa, Entamoeba dispar
KKYYGILQFEFSYLSSIDFE

SEQ ID NO: 2385711 - protein, 21 aa, Entamoeba dispar
KLANVYFLFISCLQLIPGLSP

SEQ ID NO: 2385712 - protein, 19 aa, Entamoeba dispar
KLANVYFLIISIFQVIPGL

SEQ ID NO: 2385713 - protein, 17 aa, Entamoeba dispar
KLAVPGTAGCKIIAHGG

SEQ ID NO: 2385714 - protein, 25 aa, Entamoeba dispar
KLCAKKRYVSAFKIFKESFSKKYLS

SEQ ID NO: 2385715 - protein, 17 aa, Entamoeba dispar
KLCIDWYDSSPIKEDIV

SEQ ID NO: 2385716 - protein, 24 aa, Entamoeba dispar
KLEERKRSGLVLFSIIIILPLLTL

SEQ ID NO: 2385717 - protein, 20 aa, Entamoeba dispar
KLEMLKQYFEQWNEQVNMDY

SEQ ID NO: 2385718 - protein, 21 aa, Entamoeba dispar
KLEMSIQVILEINDRADVKVC

SEQ ID NO: 2385719 - protein, 17 aa, Entamoeba dispar
KLFCCSAQGQVYGISGN

SEQ ID NO: 2385720 - protein, 18 aa, Entamoeba dispar
KLFECVNSFDSNNYPIQV

SEQ ID NO: 2385721 - protein, 27 aa, Entamoeba dispar
KLFEKLSYRSLMLWILYDDIPEFEKET

SEQ ID NO: 2385722 - protein, 21 aa, Entamoeba dispar
KLFNFLKVYIIKKMTYLNKKA

SEQ ID NO: 2385723 - protein, 19 aa, Entamoeba dispar
KLFTIFQRWIFDLFNEKRI

SEQ ID NO: 2385724 - protein, 26 aa, Entamoeba dispar
KLGKLARRTVKVLGVIALCVSVGVVG

SEQ ID NO: 2385725 - protein, 21 aa, Entamoeba dispar
KLHPMVRFILFIITFLIGLTI

SEQ ID NO: 2385726 - protein, 21 aa, Entamoeba dispar
KLIEYRLSLKTVEEEIETMKM

SEQ ID NO: 2385727 - protein, 21 aa, Entamoeba dispar
KLIFNPCALLIRYYLKLLSNK

SEQ ID NO: 2385728 - protein, 25 aa, Entamoeba dispar
KLIGCCFPLLFGFLVAISRVRDYFH

SEQ ID NO: 2385729 - protein, 24 aa, Entamoeba dispar
KLIKETRFNIPYSQELKEMFEKRK

SEQ ID NO: 2385730 - protein, 20 aa, Entamoeba dispar
KLIKYLQLIPPISFPLNQKD

SEQ ID NO: 2385731 - protein, 20 aa, Entamoeba dispar
KLILLSFFTFIGLLFIATLF

SEQ ID NO: 2385732 - protein, 19 aa, Entamoeba dispar
KLIMSRLGFEIHDYHDKYN

SEQ ID NO: 2385733 - protein, 17 aa, Entamoeba dispar
KLIPKFITLLDRGQNCP

SEQ ID NO: 2385734 - protein, 19 aa, Entamoeba dispar
KLIPLLLLQICESFTNNSI

SEQ ID NO: 2385735 - protein, 20 aa, Entamoeba dispar
KLISCLLSSLDIEYYQQYTR

SEQ ID NO: 2385736 - protein, 22 aa, Entamoeba dispar
KLKEGLKIAMSISSVGNKYLQD

SEQ ID NO: 2385737 - protein, 19 aa, Entamoeba dispar
KLKEIFRCYYLQTPNLSLL

SEQ ID NO: 2385738 - protein, 25 aa, Entamoeba dispar
KLKTKEWEHFLSLLKGKDDIIKLAE

SEQ ID NO: 2385739 - protein, 19 aa, Entamoeba dispar
KLLCNDRILYHKATNSEVI

SEQ ID NO: 2385740 - protein, 18 aa, Entamoeba dispar
KLLDPVIVKNFKRINNGK

SEQ ID NO: 2385741 - protein, 25 aa, Entamoeba dispar
KLLEEAPTEFSFRIFSKQAIEYSEN

SEQ ID NO: 2385742 - protein, 25 aa, Entamoeba dispar
KLLEKDLPIHLAILSLLIKNSSFDH

SEQ ID NO: 2385743 - protein, 24 aa, Entamoeba dispar
KLLGGIGHIINWIGFILFFVRVDE

SEQ ID NO: 2385744 - protein, 18 aa, Entamoeba dispar
KLLILGFIIFCICGVLEC

SEQ ID NO: 2385745 - protein, 17 aa, Entamoeba dispar
KLLKVLFIFIRFNDSSL

SEQ ID NO: 2385746 - protein, 22 aa, Entamoeba dispar
KLLNIKIQLSFYITSLLGDVRV

SEQ ID NO: 2385747 - protein, 22 aa, Entamoeba dispar
KLLPSFISYIGIEPIHEMIKSL

SEQ ID NO: 2385748 - protein, 19 aa, Entamoeba dispar
KLLSQYPIYPWVISTFSED

SEQ ID NO: 2385749 - protein, 22 aa, Entamoeba dispar
KLLYNLIVLCLKYFGILLSPSL

SEQ ID NO: 2385750 - protein, 22 aa, Entamoeba dispar
KLNIWYKIRCINIDIDKATTIM

SEQ ID NO: 2385751 - protein, 18 aa, Entamoeba dispar
KLNLLRYYIGGFLMNMST

SEQ ID NO: 2385752 - protein, 18 aa, Entamoeba dispar
KLNNFWCITDLVNNNCND

SEQ ID NO: 2385753 - protein, 25 aa, Entamoeba dispar
KLNPEKRYFFFFTFHDDNLFINFNI

SEQ ID NO: 2385754 - protein, 18 aa, Entamoeba dispar
KLNSCLFEAKGRYIQFSL

SEQ ID NO: 2385755 - protein, 17 aa, Entamoeba dispar
KLNVKFMKSTIWKNRIE

SEQ ID NO: 2385756 - protein, 22 aa, Entamoeba dispar
KLPCDCPICLCLIEDSSDVLLT

SEQ ID NO: 2385757 - protein, 18 aa, Entamoeba dispar
KLPFCSISVIHSKNKNLC

SEQ ID NO: 2385758 - protein, 19 aa, Entamoeba dispar
KLPLSSILMKRSPQVDQLK

SEQ ID NO: 2385759 - protein, 17 aa, Entamoeba dispar
KLPRFINKIIITISSGN

SEQ ID NO: 2385760 - protein, 22 aa, Entamoeba dispar
KLPWNCWSDNLLVYGTLPMGIS

SEQ ID NO: 2385761 - protein, 26 aa, Entamoeba dispar
KLQDLRLWLCSLVKNSFYKVIIWIIY

SEQ ID NO: 2385762 - protein, 19 aa, Entamoeba dispar
KLQKCIELSLNEGVRRNKS

SEQ ID NO: 2385763 - protein, 22 aa, Entamoeba dispar
KLQLLSCIYVPIIITLIIGIPL

SEQ ID NO: 2385764 - protein, 21 aa, Entamoeba dispar
KLRDRKKDFIEFVDTERNLVN

SEQ ID NO: 2385765 - protein, 22 aa, Entamoeba dispar
KLRHIYNLTSLYVCGFCLSFSA

SEQ ID NO: 2385766 - protein, 18 aa, Entamoeba dispar
KLRNEPRLLTSIQSGNKI

SEQ ID NO: 2385767 - protein, 24 aa, Entamoeba dispar
KLRTKELWCMGGTMSARSSLVTLM

SEQ ID NO: 2385768 - protein, 23 aa, Entamoeba dispar
KLSKCGFLLIFAMFVVIVTFCIS

SEQ ID NO: 2385769 - protein, 19 aa, Entamoeba dispar
KLSKQKGKCVNVLCGNGII

SEQ ID NO: 2385770 - protein, 18 aa, Entamoeba dispar
KLSLKVSNLIFGPNVNSI

SEQ ID NO: 2385771 - protein, 26 aa, Entamoeba dispar
KLSMFALCWSLGKAIGFLLGGTLKVK

SEQ ID NO: 2385772 - protein, 19 aa, Entamoeba dispar
KLSSIYQLWDWVLQSPKFA

SEQ ID NO: 2385773 - protein, 23 aa, Entamoeba dispar
KLSTCVRLSVHIIKNQKYNYVQG

SEQ ID NO: 2385774 - protein, 20 aa, Entamoeba dispar
KLSWWSLLELAGFVILFFAT

SEQ ID NO: 2385775 - protein, 30 aa, Entamoeba dispar
KLTMLSAFAKLHATFPCLRDQIKSLFIKYS

SEQ ID NO: 2385776 - protein, 26 aa, Entamoeba dispar
KLTRKSAPYFIQWIVNILQTYGTLKR

SEQ ID NO: 2385777 - protein, 23 aa, Entamoeba dispar
KLTSLLLHYIYLLPIYKNNNLTS

SEQ ID NO: 2385778 - protein, 17 aa, Entamoeba dispar
KLVETVDMDTPIVFESY

SEQ ID NO: 2385779 - protein, 22 aa, Entamoeba dispar
KLVKTAFAMKRWKREIKQTVSI

SEQ ID NO: 2385780 - protein, 21 aa, Entamoeba dispar
KLVLHSALFLSEFLSEQNTII

SEQ ID NO: 2385781 - protein, 25 aa, Entamoeba dispar
KLVTEEWYYFILFIISFIPLLINGY

SEQ ID NO: 2385782 - protein, 20 aa, Entamoeba dispar
KLWKITGIIMKDHYPQMFDH

SEQ ID NO: 2385783 - protein, 25 aa, Entamoeba dispar
KLYCSKMPKWSIYPLTFIPGVVLYC

SEQ ID NO: 2385784 - protein, 17 aa, Entamoeba dispar
KLYEIGRRDLIEALMTH

SEQ ID NO: 2385785 - protein, 19 aa, Entamoeba dispar
KLYFKSLLRQDATWYDFQE

SEQ ID NO: 2385786 - protein, 19 aa, Entamoeba dispar
KLYFKSLLRQDATWYDLQE

SEQ ID NO: 2385787 - protein, 25 aa, Entamoeba dispar
KLYFRGCILAIIGVLLSFVVVSIWQ

SEQ ID NO: 2385788 - protein, 32 aa, Entamoeba dispar
KLYSICITNSIPFPQFLPSILHMCVQGDREHQ

SEQ ID NO: 2385789 - protein, 20 aa, Entamoeba dispar
KLYTSCYIQTGIFIKPSLNI

SEQ ID NO: 2385790 - protein, 17 aa, Entamoeba dispar
KMGLVGYTIWIILTIFY

SEQ ID NO: 2385791 - protein, 20 aa, Entamoeba dispar
KMHSGILKWIIRFHPDLVFS

SEQ ID NO: 2385792 - protein, 27 aa, Entamoeba dispar
KMIKSLKRKGVFTLDGYRYCLVDYSIM

SEQ ID NO: 2385793 - protein, 20 aa, Entamoeba dispar
KMISIVMFNLMGWDFVGNVS

SEQ ID NO: 2385794 - protein, 19 aa, Entamoeba dispar
KMKAFTLFLPHINKENLKE

SEQ ID NO: 2385795 - protein, 19 aa, Entamoeba dispar
KMKQLTCEECSKQLEEFQE

SEQ ID NO: 2385796 - protein, 22 aa, Entamoeba dispar
KMKRCHFVIIGNSIVFLLIISI

SEQ ID NO: 2385797 - protein, 23 aa, Entamoeba dispar
KMKSKGCLEFESYDNLLQLMKTL

SEQ ID NO: 2385798 - protein, 26 aa, Entamoeba dispar
KMLGIKCSFIPIILYLMVALLSINSQ

SEQ ID NO: 2385799 - protein, 30 aa, Entamoeba dispar
KMLVIGLGLLHLCCGESASLVMDTVRALPS

SEQ ID NO: 2385800 - protein, 17 aa, Entamoeba dispar
KMNCKWYVVIKIIITKV

SEQ ID NO: 2385801 - protein, 17 aa, Entamoeba dispar
KMNIPMSYLKYYSDHVL

SEQ ID NO: 2385802 - protein, 19 aa, Entamoeba dispar
KMRLSQCRIGLNSTDLPSS

SEQ ID NO: 2385803 - protein, 19 aa, Entamoeba dispar
KMSKIKVLFAGAEHLLHDE

SEQ ID NO: 2385804 - protein, 18 aa, Entamoeba dispar
KMSKKNFMRVIGECGPIY

SEQ ID NO: 2385805 - protein, 26 aa, Entamoeba dispar
KMSYCERIKLSPVFFNVSYPEEVIKA

SEQ ID NO: 2385806 - protein, 25 aa, Entamoeba dispar
KMVKKFFERNICPFILQEEVQKILS

SEQ ID NO: 2385807 - protein, 29 aa, Entamoeba dispar
KMYCEAGICCIHIALYLGLPESIDKRKLK

SEQ ID NO: 2385808 - protein, 25 aa, Entamoeba dispar
KMYIPEIIYLLNLIGSVFTTIHFSS

SEQ ID NO: 2385809 - protein, 28 aa, Entamoeba dispar
KMYYEMRTTISLPFYFYSVRFLGKIFRS

SEQ ID NO: 2385810 - protein, 19 aa, Entamoeba dispar
KNACGSFYEEVLWNDIING

SEQ ID NO: 2385811 - protein, 18 aa, Entamoeba dispar
KNAGISVRMVTGDHVKTA

SEQ ID NO: 2385812 - protein, 17 aa, Entamoeba dispar
KNALPLFKLKLLQTNNP

SEQ ID NO: 2385813 - protein, 22 aa, Entamoeba dispar
KNCGIKSRLAFNVEIGNEYFVF

SEQ ID NO: 2385814 - protein, 17 aa, Entamoeba dispar
KNCKGLIIENGFTTLLD

SEQ ID NO: 2385815 - protein, 22 aa, Entamoeba dispar
KNCTGIKGWIGELIKIGTGLQK

SEQ ID NO: 2385816 - protein, 20 aa, Entamoeba dispar
KNCTYYWGFALAVSINVNLF

SEQ ID NO: 2385817 - protein, 20 aa, Entamoeba dispar
KNCTYYYGFAIAVGINVNFF

SEQ ID NO: 2385818 - protein, 18 aa, Entamoeba dispar
KNDECVICQMDEKSPMGR

SEQ ID NO: 2385819 - protein, 17 aa, Entamoeba dispar
KNDICVLKEQYIDNCSV

SEQ ID NO: 2385820 - protein, 23 aa, Entamoeba dispar
KNDTRLYQIGSFELGRGSMGIRA

SEQ ID NO: 2385821 - protein, 23 aa, Entamoeba dispar
KNECMRLFMKIKRLLDSTQNIQA

SEQ ID NO: 2385822 - protein, 23 aa, Entamoeba dispar
KNELLFKIMTLIGLNDIVFTSLR

SEQ ID NO: 2385823 - protein, 20 aa, Entamoeba dispar
KNEPEAFVLFKVINDSWLAI

SEQ ID NO: 2385824 - protein, 20 aa, Entamoeba dispar
KNESVNMVKEWINFIREKIE

SEQ ID NO: 2385825 - protein, 17 aa, Entamoeba dispar
KNETIPCDGIVVSSSNK

SEQ ID NO: 2385826 - protein, 18 aa, Entamoeba dispar
KNFIPNGCIIRNTERLLL

SEQ ID NO: 2385827 - protein, 19 aa, Entamoeba dispar
KNFKDCTTLTIAHRLHSIM

SEQ ID NO: 2385828 - protein, 23 aa, Entamoeba dispar
KNFRPQAFCNRDIIMVLNEGTFN

SEQ ID NO: 2385829 - protein, 18 aa, Entamoeba dispar
KNGCKIGNKTYCYQCEEG

SEQ ID NO: 2385830 - protein, 19 aa, Entamoeba dispar
KNGEISFKIRSITNSNEKV

SEQ ID NO: 2385831 - protein, 23 aa, Entamoeba dispar
KNGIEVIHLFTGKPLLHVSLSSS

SEQ ID NO: 2385832 - protein, 27 aa, Entamoeba dispar
KNGILRISELCNIFRYFEIPKENGSKM

SEQ ID NO: 2385833 - protein, 24 aa, Entamoeba dispar
KNGKLWAVLTIYKLFDGENMEEIF

SEQ ID NO: 2385834 - protein, 19 aa, Entamoeba dispar
KNHLRRIVVLGITTATILY

SEQ ID NO: 2385835 - protein, 17 aa, Entamoeba dispar
KNICPLDNSFSSFAKES

SEQ ID NO: 2385836 - protein, 27 aa, Entamoeba dispar
KNIGDIAILFKKVCYKIKSYIDPLFKE

SEQ ID NO: 2385837 - protein, 17 aa, Entamoeba dispar
KNIGIAFLVLFIGTFIA

SEQ ID NO: 2385838 - protein, 31 aa, Entamoeba dispar
KNIIHLCSIIKTRFINTIRVLVFYFNKLISI

SEQ ID NO: 2385839 - protein, 18 aa, Entamoeba dispar
KNIIKILHLIGTLNEDYS

SEQ ID NO: 2385840 - protein, 20 aa, Entamoeba dispar
KNIKCDICGKKHKTKDHGKE

SEQ ID NO: 2385841 - protein, 29 aa, Entamoeba dispar
KNIKRCPRCGGYVNPFCNFEEGGKKMKCN

SEQ ID NO: 2385842 - protein, 21 aa, Entamoeba dispar
KNINKISGKLAKLTELAKSKS

SEQ ID NO: 2385843 - protein, 25 aa, Entamoeba dispar
KNIRKLCPLLIPYSSNPIFDTPSSY

SEQ ID NO: 2385844 - protein, 17 aa, Entamoeba dispar
KNIRRHYHHHFIITTDA

SEQ ID NO: 2385845 - protein, 21 aa, Entamoeba dispar
KNISGRLLVGLRWWNKVNEDG

SEQ ID NO: 2385846 - protein, 20 aa, Entamoeba dispar
KNIYLTWKRRLKMLHDAASG

SEQ ID NO: 2385847 - protein, 17 aa, Entamoeba dispar
KNKCVKGICAYPSSGNR

SEQ ID NO: 2385848 - protein, 29 aa, Entamoeba dispar
KNKDYISPISFCWWLFNAILSSFTIFFIS

SEQ ID NO: 2385849 - protein, 19 aa, Entamoeba dispar
KNKFKGELIEFIKQKMGQM

SEQ ID NO: 2385850 - protein, 24 aa, Entamoeba dispar
KNKIGSLVHLLKCSGIISQKTKHK

SEQ ID NO: 2385851 - protein, 24 aa, Entamoeba dispar
KNKMKDIFETIGFTTTTLNSWVFS

SEQ ID NO: 2385852 - protein, 23 aa, Entamoeba dispar
KNKQKRLQIELMKRKEEEKKLRI

SEQ ID NO: 2385853 - protein, 19 aa, Entamoeba dispar
KNLCSYCIELSQKYQEMKD

SEQ ID NO: 2385854 - protein, 22 aa, Entamoeba dispar
KNLKDAVHFCPNCKKRLGSKSA

SEQ ID NO: 2385855 - protein, 19 aa, Entamoeba dispar
KNLKELFQFLQNEKNKRIN

SEQ ID NO: 2385856 - protein, 23 aa, Entamoeba dispar
KNLKTDQYIGGAIEFLIDIDGID

SEQ ID NO: 2385857 - protein, 19 aa, Entamoeba dispar
KNLLICLSPSLRIQAKILS

SEQ ID NO: 2385858 - protein, 24 aa, Entamoeba dispar
KNLLRCIIEVLGIQMNSTQLAVQK

SEQ ID NO: 2385859 - protein, 30 aa, Entamoeba dispar
KNLQLIGWIMICVIIGILLIVIAGIYLFYR

SEQ ID NO: 2385860 - protein, 23 aa, Entamoeba dispar
KNLSESLSTIFRLFDVQTTLINY

SEQ ID NO: 2385861 - protein, 22 aa, Entamoeba dispar
KNNAKIGASIAHQLNLLTNHPN

SEQ ID NO: 2385862 - protein, 17 aa, Entamoeba dispar
KNNECIIDPNFDCQPVE

SEQ ID NO: 2385863 - protein, 20 aa, Entamoeba dispar
KNNECQRYSKTNFYYKTQNK

SEQ ID NO: 2385864 - protein, 23 aa, Entamoeba dispar
KNNKCSKCSFWYGINEEGTKCNK

SEQ ID NO: 2385865 - protein, 24 aa, Entamoeba dispar
KNNMKRIPIEGIIKELNKIIKVEG

SEQ ID NO: 2385866 - protein, 21 aa, Entamoeba dispar
KNNYIKAFYLRNGGNPSEKYV

SEQ ID NO: 2385867 - protein, 27 aa, Entamoeba dispar
KNPEGWCSCIPQTVLLLQRYGYDIYIE

SEQ ID NO: 2385868 - protein, 19 aa, Entamoeba dispar
KNQFGFVFDQTVKKKPEKE

SEQ ID NO: 2385869 - protein, 23 aa, Entamoeba dispar
KNQQCVACPAGYFQSKNECIECQ

SEQ ID NO: 2385870 - protein, 22 aa, Entamoeba dispar
KNQVPCYIGFFFLVISYARFRL

SEQ ID NO: 2385871 - protein, 20 aa, Entamoeba dispar
KNRAYHPNWFSGKDQNGTLN

SEQ ID NO: 2385872 - protein, 19 aa, Entamoeba dispar
KNRCILSGALSFLTQAVKP

SEQ ID NO: 2385873 - protein, 30 aa, Entamoeba dispar
KNSMHFIPFGIKWILSFSICGSSVALITSL

SEQ ID NO: 2385874 - protein, 19 aa, Entamoeba dispar
KNSTCKFTRFSEKGKNSEM

SEQ ID NO: 2385875 - protein, 17 aa, Entamoeba dispar
KNSYSFEKVQFIFFNGN

SEQ ID NO: 2385876 - protein, 18 aa, Entamoeba dispar
KNVFYLSAANGWFYKDGK

SEQ ID NO: 2385877 - protein, 18 aa, Entamoeba dispar
KNVICSILSLLQKALEIN

SEQ ID NO: 2385878 - protein, 17 aa, Entamoeba dispar
KNVRRHCHYHITIKTDA

SEQ ID NO: 2385879 - protein, 26 aa, Entamoeba dispar
KNYDCAYSIYCGLKSYCWINEKKREK

SEQ ID NO: 2385880 - protein, 18 aa, Entamoeba dispar
KNYFVCANIFVWGTSLVL

SEQ ID NO: 2385881 - protein, 18 aa, Entamoeba dispar
KNYGNFKAIAAMKPTTHT

SEQ ID NO: 2385882 - protein, 31 aa, Entamoeba dispar
KNYLKQYWPEILWRWYVKKGMYEESIKCILK

SEQ ID NO: 2385883 - protein, 29 aa, Entamoeba dispar
KNYTKGCAPFCGVCAFGYSCNQAAKCVKN

SEQ ID NO: 2385884 - protein, 17 aa, Entamoeba dispar
KNYWKLYVKGKRLSKGT

SEQ ID NO: 2385885 - protein, 19 aa, Entamoeba dispar
KPADIFAFAITMYEILDWK

SEQ ID NO: 2385886 - protein, 21 aa, Entamoeba dispar
KPETFGFVNFLFVFNEKTHEY

SEQ ID NO: 2385887 - protein, 25 aa, Entamoeba dispar
KPFGRFDSLISFKMLRSILFQAGYQ

SEQ ID NO: 2385888 - protein, 29 aa, Entamoeba dispar
KPFLQRLKSFPLWFCKQWLRTDEKGASLF

SEQ ID NO: 2385889 - protein, 26 aa, Entamoeba dispar
KPFMTFRMLCSIAFLSLLIETISFGI

SEQ ID NO: 2385890 - protein, 22 aa, Entamoeba dispar
KPGLKIRLKFMTSVNVQDETLH

SEQ ID NO: 2385891 - protein, 25 aa, Entamoeba dispar
KPGTTRAYMALTFYKNTKYYLFIQS

SEQ ID NO: 2385892 - protein, 20 aa, Entamoeba dispar
KPLFLNWAMFLGMTLCLILY

SEQ ID NO: 2385893 - protein, 25 aa, Entamoeba dispar
KPLMYCLLIVFGLTIILSFEIIPEL

SEQ ID NO: 2385894 - protein, 30 aa, Entamoeba dispar
KPLSTLPCKLFFCFNLPVYLGLDHSKLTNE

SEQ ID NO: 2385895 - protein, 29 aa, Entamoeba dispar
KPLVRQFGLRLTYVMTIICTSMFYGIFPS

SEQ ID NO: 2385896 - protein, 21 aa, Entamoeba dispar
KPNEDYCGYYFFPYDIVEQHQ

SEQ ID NO: 2385897 - protein, 18 aa, Entamoeba dispar
KPNEFTIISPTIYKEFPE

SEQ ID NO: 2385898 - protein, 24 aa, Entamoeba dispar
KPNPEILVTLLLPAVIVFLISINS

SEQ ID NO: 2385899 - protein, 25 aa, Entamoeba dispar
KPNSELVYFVYFLPFTIYIDNNKKM

SEQ ID NO: 2385900 - protein, 25 aa, Entamoeba dispar
KPPECIRTEMGYCVECASGYFLSDV

SEQ ID NO: 2385901 - protein, 29 aa, Entamoeba dispar
KPPEIRLSTAKVFRYRPFSLILTMSSTWR

SEQ ID NO: 2385902 - protein, 19 aa, Entamoeba dispar
KPPFCIFLSLFTYDVLGIS

SEQ ID NO: 2385903 - protein, 19 aa, Entamoeba dispar
KPPIKIVLIASIINVLIAT

SEQ ID NO: 2385904 - protein, 17 aa, Entamoeba dispar
KPTASIVSCGDHNRYGL

SEQ ID NO: 2385905 - protein, 25 aa, Entamoeba dispar
KPTNLPLICSFIIDGKLCFDTYPIV

SEQ ID NO: 2385906 - protein, 25 aa, Entamoeba dispar
KPTPFTVKIINDFEPLITFCTSSLC

SEQ ID NO: 2385907 - protein, 21 aa, Entamoeba dispar
KPVWWVCILISIYVIIVALSR

SEQ ID NO: 2385908 - protein, 31 aa, Entamoeba dispar
KPYIGKLHWRDVMKIAVKWRQISEPNDPVYW

SEQ ID NO: 2385909 - protein, 20 aa, Entamoeba dispar
KQAQNGFGFIENIKEIIYSY

SEQ ID NO: 2385910 - protein, 18 aa, Entamoeba dispar
KQASVFLILIPTTFDLIA

SEQ ID NO: 2385911 - protein, 17 aa, Entamoeba dispar
KQCLYHDMIKKCWKGTV

SEQ ID NO: 2385912 - protein, 20 aa, Entamoeba dispar
KQEAKERIRIEEVVKMLERI

SEQ ID NO: 2385913 - protein, 21 aa, Entamoeba dispar
KQEARKALLRDAKRNPRLFCG

SEQ ID NO: 2385914 - protein, 21 aa, Entamoeba dispar
KQEFEYPWVIATFVASGHRRP

SEQ ID NO: 2385915 - protein, 23 aa, Entamoeba dispar
KQFGFRSSRRIEWVESLNKIIVS

SEQ ID NO: 2385916 - protein, 24 aa, Entamoeba dispar
KQFIKFGIVSGIAFIIRSLLFKFG

SEQ ID NO: 2385917 - protein, 24 aa, Entamoeba dispar
KQGDMKSICLLTRYLNGDQTTNRL

SEQ ID NO: 2385918 - protein, 19 aa, Entamoeba dispar
KQGLVCFFTGLSGSGKSVV

SEQ ID NO: 2385919 - protein, 27 aa, Entamoeba dispar
KQGTCSKCSESNCIVCKDNDGTCIECN

SEQ ID NO: 2385920 - protein, 36 aa, Entamoeba dispar
KQHADMLWKLVDTFFTFPVTYPFSVTCAYLRSLQQL

SEQ ID NO: 2385921 - protein, 24 aa, Entamoeba dispar
KQHICKVHFGILLKEKDEWTFNES

SEQ ID NO: 2385922 - protein, 18 aa, Entamoeba dispar
KQIKRRKPRRKVISIDEI

SEQ ID NO: 2385923 - protein, 27 aa, Entamoeba dispar
KQIKYWIPRIIFFLFFFAAVELVFVYN

SEQ ID NO: 2385924 - protein, 25 aa, Entamoeba dispar
KQILNRMVSGLIYFFVTPFIDIQIH

SEQ ID NO: 2385925 - protein, 25 aa, Entamoeba dispar
KQIQYRGSYWIKIDLSSIKSTGSHG

SEQ ID NO: 2385926 - protein, 22 aa, Entamoeba dispar
KQIVNKCWKCGKDKIDLNSCSC

SEQ ID NO: 2385927 - protein, 23 aa, Entamoeba dispar
KQIYQFLLHIAIKQHKYSDAIRL

SEQ ID NO: 2385928 - protein, 22 aa, Entamoeba dispar
KQKWLKQREVIINTLSINQNGI

SEQ ID NO: 2385929 - protein, 23 aa, Entamoeba dispar
KQLHCYPESSTLISSIEKYYEVA

SEQ ID NO: 2385930 - protein, 21 aa, Entamoeba dispar
KQLKIRDPVLFLFAHADDDAM

SEQ ID NO: 2385931 - protein, 18 aa, Entamoeba dispar
KQLKREIEELKKRKGNEM

SEQ ID NO: 2385932 - protein, 24 aa, Entamoeba dispar
KQLLMTTFWQYRTPPVNSIHEVLT

SEQ ID NO: 2385933 - protein, 26 aa, Entamoeba dispar
KQLQLCLCPLCINGIPNYSDTKTDLI

SEQ ID NO: 2385934 - protein, 24 aa, Entamoeba dispar
KQLVSQLPWNCWSSSFEFSDNLPP

SEQ ID NO: 2385935 - protein, 24 aa, Entamoeba dispar
KQLYGFEINDSFLISLLNIIDTMF

SEQ ID NO: 2385936 - protein, 24 aa, Entamoeba dispar
KQMLNTFHSFEWNNFINKCLDKCI

SEQ ID NO: 2385937 - protein, 24 aa, Entamoeba dispar
KQNCKRIAEQMLFGIKDLTENVLQ

SEQ ID NO: 2385938 - protein, 23 aa, Entamoeba dispar
KQPKFKKVLFGAGYWIKRKCYVD

SEQ ID NO: 2385939 - protein, 17 aa, Entamoeba dispar
KQPLLTIDNLERITSVH

SEQ ID NO: 2385940 - protein, 18 aa, Entamoeba dispar
KQPLPKKYLNIMHLLPQT

SEQ ID NO: 2385941 - protein, 18 aa, Entamoeba dispar
KQQFKLFLIHLLQSDSPP

SEQ ID NO: 2385942 - protein, 23 aa, Entamoeba dispar
KQRLSLSSLIAWVSLSILQAVII

SEQ ID NO: 2385943 - protein, 24 aa, Entamoeba dispar
KQSAQCIDFIYSLIPSFEVLIQFI

SEQ ID NO: 2385944 - protein, 26 aa, Entamoeba dispar
KQSFGFNFRFSIILWVIIAGLTIVLI

SEQ ID NO: 2385945 - protein, 27 aa, Entamoeba dispar
KQSFGFNFRFSIILWVIIAGLTIVLII

SEQ ID NO: 2385946 - protein, 19 aa, Entamoeba dispar
KQSIFCVDEPFKSALISSL

SEQ ID NO: 2385947 - protein, 21 aa, Entamoeba dispar
KQSWIPRPIQHQSFIRSNYFK

SEQ ID NO: 2385948 - protein, 19 aa, Entamoeba dispar
KQTLFDFLSGCFQYDPKLR

SEQ ID NO: 2385949 - protein, 25 aa, Entamoeba dispar
KQTYECVICMAPIRRYHKIWSCPRC

SEQ ID NO: 2385950 - protein, 24 aa, Entamoeba dispar
KQVCGKLIGWELPYHLFPPSLHPC

SEQ ID NO: 2385951 - protein, 20 aa, Entamoeba dispar
KQVLIKVFEWYEILLKTTGT

SEQ ID NO: 2385952 - protein, 20 aa, Entamoeba dispar
KQVLLGIGFMCLNSLNKDQL

SEQ ID NO: 2385953 - protein, 19 aa, Entamoeba dispar
KQVYSPLLVVTPMDTPMVE

SEQ ID NO: 2385954 - protein, 22 aa, Entamoeba dispar
KQWTPYSRYLLRQTQELGHETE

SEQ ID NO: 2385955 - protein, 19 aa, Entamoeba dispar
KQYFSRQHMDSLWMIIIAQ

SEQ ID NO: 2385956 - protein, 20 aa, Entamoeba dispar
KQYLGIGFVDFNELINGKIK

SEQ ID NO: 2385957 - protein, 17 aa, Entamoeba dispar
KRAKIRIGKEKLNKKKK

SEQ ID NO: 2385958 - protein, 19 aa, Entamoeba dispar
KRALIVIFIVLVLLACVVV

SEQ ID NO: 2385959 - protein, 20 aa, Entamoeba dispar
KRAPFTAIINGLVLGWVHAF

SEQ ID NO: 2385960 - protein, 20 aa, Entamoeba dispar
KRELGVISLLAMMYVSCIGG

SEQ ID NO: 2385961 - protein, 21 aa, Entamoeba dispar
KRELRFLTYFTQIINADIPGC

SEQ ID NO: 2385962 - protein, 20 aa, Entamoeba dispar
KRETKDGFNEIIKKIEMEID

SEQ ID NO: 2385963 - protein, 25 aa, Entamoeba dispar
KRFINEYKLDIGLYLILIVINNFVG

SEQ ID NO: 2385964 - protein, 27 aa, Entamoeba dispar
KRFPALLPQLCVASFGFIALILAYFYL

SEQ ID NO: 2385965 - protein, 21 aa, Entamoeba dispar
KRFTYCVLDEGHIIKNPKTKL

SEQ ID NO: 2385966 - protein, 20 aa, Entamoeba dispar
KRIIFSASLFISMSLIGIVT

SEQ ID NO: 2385967 - protein, 23 aa, Entamoeba dispar
KRIISRLNPFGSIEAIESDVIGS

SEQ ID NO: 2385968 - protein, 21 aa, Entamoeba dispar
KRIYIPTFLIYPIQRLPRYLL

SEQ ID NO: 2385969 - protein, 18 aa, Entamoeba dispar
KRIYKKKKKSLCKRIIQF

SEQ ID NO: 2385970 - protein, 37 aa, Entamoeba dispar
KRKANNLPPRLKFNAHRRFTTKKGDSIDLPSIDLGES

SEQ ID NO: 2385971 - protein, 20 aa, Entamoeba dispar
KRKEAIPADLILLSSSEPNG

SEQ ID NO: 2385972 - protein, 21 aa, Entamoeba dispar
KRKEINCLMVLNNNIVIGEQN

SEQ ID NO: 2385973 - protein, 20 aa, Entamoeba dispar
KRKGNEMRNEIQPLKRKIEA

SEQ ID NO: 2385974 - protein, 18 aa, Entamoeba dispar
KRKIDIIITFIVFVLSKL

SEQ ID NO: 2385975 - protein, 20 aa, Entamoeba dispar
KRKLANLGKWLVLLAGILCL

SEQ ID NO: 2385976 - protein, 19 aa, Entamoeba dispar
KRKQLRKIYNKMKYSVDPI

SEQ ID NO: 2385977 - protein, 17 aa, Entamoeba dispar
KRKQPLLTIDNLERITS

SEQ ID NO: 2385978 - protein, 26 aa, Entamoeba dispar
KRKTKCGEFILGSVYIDIMKKIDQLN

SEQ ID NO: 2385979 - protein, 17 aa, Entamoeba dispar
KRKTWKEDIAKAMKKIL

SEQ ID NO: 2385980 - protein, 17 aa, Entamoeba dispar
KRKVVSCIIAIIICISV

SEQ ID NO: 2385981 - protein, 27 aa, Entamoeba dispar
KRKYRTGWRYPINIILHLFLFTIGGIS

SEQ ID NO: 2385982 - protein, 19 aa, Entamoeba dispar
KRLAIPSSVPKEMADLITN

SEQ ID NO: 2385983 - protein, 20 aa, Entamoeba dispar
KRLGQLLALGHFPKHIIPFV

SEQ ID NO: 2385984 - protein, 20 aa, Entamoeba dispar
KRLHYSLSLTFKIIVLLYVA

SEQ ID NO: 2385985 - protein, 24 aa, Entamoeba dispar
KRLINVLHFCLLKNASVSNNLWNV

SEQ ID NO: 2385986 - protein, 19 aa, Entamoeba dispar
KRLLGSSIRSGLRASKEIV

SEQ ID NO: 2385987 - protein, 20 aa, Entamoeba dispar
KRLRNPYIIGYIGSVTYNPE

SEQ ID NO: 2385988 - protein, 21 aa, Entamoeba dispar
KRLVIPLKVDFKGIVSNEEVD

SEQ ID NO: 2385989 - protein, 24 aa, Entamoeba dispar
KRMLRFLHKSSIYNIQFNGCNGIH

SEQ ID NO: 2385990 - protein, 18 aa, Entamoeba dispar
KRMLYRAITNKIFLIIMA

SEQ ID NO: 2385991 - protein, 20 aa, Entamoeba dispar
KRMSVLVERDGLYVLYCKGA

SEQ ID NO: 2385992 - protein, 18 aa, Entamoeba dispar
KRPNPSKIIWNIISCYCF

SEQ ID NO: 2385993 - protein, 18 aa, Entamoeba dispar
KRRYCSIINNNGGFDSNS

SEQ ID NO: 2385994 - protein, 18 aa, Entamoeba dispar
KRSAEAICVFKMKYSNVQ

SEQ ID NO: 2385995 - protein, 21 aa, Entamoeba dispar
KRSEEVIPIFSKVLEYDAPGV

SEQ ID NO: 2385996 - protein, 20 aa, Entamoeba dispar
KRSLLKEEINDWGRVPLESG

SEQ ID NO: 2385997 - protein, 24 aa, Entamoeba dispar
KRSNYKQFLGIGVTDLGEILIGNN

SEQ ID NO: 2385998 - protein, 21 aa, Entamoeba dispar
KRTDNCLIESVFGCQRCNLGY

SEQ ID NO: 2385999 - protein, 20 aa, Entamoeba dispar
KRTKMSAKEIWGVMKKADES

SEQ ID NO: 2386000 - protein, 19 aa, Entamoeba dispar
KRTLLFVSHISDIRKDSGV

SEQ ID NO: 2386001 - protein, 19 aa, Entamoeba dispar
KRTSFMLTSPVQLRIGALT

SEQ ID NO: 2386002 - protein, 30 aa, Entamoeba dispar
KRVDAIKLWECGLCENGIIHKCENKTINPT

SEQ ID NO: 2386003 - protein, 18 aa, Entamoeba dispar
KRVDEMIADGKTPRVDLY

SEQ ID NO: 2386004 - protein, 21 aa, Entamoeba dispar
KRVEWLKKKIQGFEINCFEIA

SEQ ID NO: 2386005 - protein, 19 aa, Entamoeba dispar
KRVKGEFTIIRNEYALLYN

SEQ ID NO: 2386006 - protein, 17 aa, Entamoeba dispar
KRYGNLSSMLNEHISVF

SEQ ID NO: 2386007 - protein, 19 aa, Entamoeba dispar
KRYWDPRGAEELTKNKEVQ

SEQ ID NO: 2386008 - protein, 19 aa, Entamoeba dispar
KSAIYRLKRTFNRINEKYQ

SEQ ID NO: 2386009 - protein, 17 aa, Entamoeba dispar
KSCKSDFLLKFKADYHF

SEQ ID NO: 2386010 - protein, 32 aa, Entamoeba dispar
KSDNWIIYHILWKVLQLEPLKWNLKYLSFIDV

SEQ ID NO: 2386011 - protein, 24 aa, Entamoeba dispar
KSDVARFWVMIVIVIIGGTPCQVN

SEQ ID NO: 2386012 - protein, 30 aa, Entamoeba dispar
KSDVFSFAICCTEIWLGRDPYDPEKFPDSE

SEQ ID NO: 2386013 - protein, 29 aa, Entamoeba dispar
KSDVFSFAICMLEIWLGKEPYDSVKFPDS

SEQ ID NO: 2386014 - protein, 28 aa, Entamoeba dispar
KSDVFSFAICMLEIWLGTSPYNSDLFPS

SEQ ID NO: 2386015 - protein, 21 aa, Entamoeba dispar
KSDVFSFAICMLEVYLRKNPY

SEQ ID NO: 2386016 - protein, 22 aa, Entamoeba dispar
KSEHIPFLLIQSSCDSIVNPKG

SEQ ID NO: 2386017 - protein, 17 aa, Entamoeba dispar
KSEITEITKSFKTNSVK

SEQ ID NO: 2386018 - protein, 17 aa, Entamoeba dispar
KSEIYGINISDDCYVYS

SEQ ID NO: 2386019 - protein, 25 aa, Entamoeba dispar
  misc_feature (21)..(22): Xaa can be any naturally occurring amino acid
KSELGETYHAYFVCNKYIAFXXGDL

SEQ ID NO: 2386020 - protein, 21 aa, Entamoeba dispar
KSELTNFFYFLPFTINIDNDK

SEQ ID NO: 2386021 - protein, 38 aa, Entamoeba dispar
KSFEEWDLESFYPFFKEGFCKHLIPAALHRYEEQPPFE

SEQ ID NO: 2386022 - protein, 25 aa, Entamoeba dispar
KSFELRLNYHKSILQLASDRRNDQP

SEQ ID NO: 2386023 - protein, 20 aa, Entamoeba dispar
KSFFIRSLSLVNCFLQTRET

SEQ ID NO: 2386024 - protein, 21 aa, Entamoeba dispar
KSFLMIIEYCCVIIIGFVGMI

SEQ ID NO: 2386025 - protein, 24 aa, Entamoeba dispar
KSFPLPDHRSSALSAQGSLLTMIL

SEQ ID NO: 2386026 - protein, 19 aa, Entamoeba dispar
KSFSCIQLFIFIIFFFYFC

SEQ ID NO: 2386027 - protein, 24 aa, Entamoeba dispar
KSFVSFPPLFWVVRDYALDERTES

SEQ ID NO: 2386028 - protein, 19 aa, Entamoeba dispar
KSGCDRTGMVFALASSLCQ

SEQ ID NO: 2386029 - protein, 21 aa, Entamoeba dispar
KSGIATKVYVPLSYEDEKNTL

SEQ ID NO: 2386030 - protein, 24 aa, Entamoeba dispar
KSHIPCLPKIVQIFLSNEPMTRQV

SEQ ID NO: 2386031 - protein, 23 aa, Entamoeba dispar
KSHLKCVLMVYKIAESDQQTARD

SEQ ID NO: 2386032 - protein, 20 aa, Entamoeba dispar
KSHWFFIDFYSFIDPIQIEL

SEQ ID NO: 2386033 - protein, 20 aa, Entamoeba dispar
KSIACIWFLTMGSLIITIII

SEQ ID NO: 2386034 - protein, 17 aa, Entamoeba dispar
KSIIHFIGSFKFGSFTL

SEQ ID NO: 2386035 - protein, 22 aa, Entamoeba dispar
KSINRSCILLTISDLSSLTLFI

SEQ ID NO: 2386036 - protein, 18 aa, Entamoeba dispar
KSINVIVINSFYYDVSNK

SEQ ID NO: 2386037 - protein, 21 aa, Entamoeba dispar
KSIPTPFLVKWGWIVTISLVV

SEQ ID NO: 2386038 - protein, 23 aa, Entamoeba dispar
KSIRDLLQLVLIFWILLNEFFSF

SEQ ID NO: 2386039 - protein, 18 aa, Entamoeba dispar
KSIRSLKSVFLKNSPYVI

SEQ ID NO: 2386040 - protein, 20 aa, Entamoeba dispar
KSISCKMLVIGLGLLHLCCG

SEQ ID NO: 2386041 - protein, 29 aa, Entamoeba dispar
KSITPRHAYRLLSVFLLKAVSIMNEQPSA

SEQ ID NO: 2386042 - protein, 17 aa, Entamoeba dispar
KSIYEIVGILIVGILII

SEQ ID NO: 2386043 - protein, 24 aa, Entamoeba dispar
KSKALTNFLFWGIGSIVYVLYYIF

SEQ ID NO: 2386044 - protein, 18 aa, Entamoeba dispar
KSKGVQFLQYIATGVVAL

SEQ ID NO: 2386045 - protein, 20 aa, Entamoeba dispar
KSKLLRLAKIINEGLYEEVY

SEQ ID NO: 2386046 - protein, 28 aa, Entamoeba dispar
KSKNRKEICLNFGLTLEFIGRNAKNIPN

SEQ ID NO: 2386047 - protein, 22 aa, Entamoeba dispar
KSKSARCAMFNTMMKVAEKVGK

SEQ ID NO: 2386048 - protein, 18 aa, Entamoeba dispar
KSKSEWLIHRDTMLSTSS

SEQ ID NO: 2386049 - protein, 32 aa, Entamoeba dispar
KSKVVVSSLIIAAGIFAIFVGIFISFTNTDDT

SEQ ID NO: 2386050 - protein, 18 aa, Entamoeba dispar
KSLEVFYPILPGRPFDKS

SEQ ID NO: 2386051 - protein, 19 aa, Entamoeba dispar
KSLFDIKNIVINGGRLEID

SEQ ID NO: 2386052 - protein, 19 aa, Entamoeba dispar
KSLGGIPIDVPEEIDDNQN

SEQ ID NO: 2386053 - protein, 24 aa, Entamoeba dispar
KSLHHFLYYFLIFFCPSFIVFSCN

SEQ ID NO: 2386054 - protein, 20 aa, Entamoeba dispar
KSLHIVWMLFCFFWAVWNGA

SEQ ID NO: 2386055 - protein, 17 aa, Entamoeba dispar
KSLKIAFDIYNDITNTL

SEQ ID NO: 2386056 - protein, 23 aa, Entamoeba dispar
KSLKKCFIIYSFIISYNLIKLLT

SEQ ID NO: 2386057 - protein, 24 aa, Entamoeba dispar
KSLKKEIQYFIGIETFLCDSEMIE

SEQ ID NO: 2386058 - protein, 19 aa, Entamoeba dispar
KSLPEEKYQNFALIYQLVE

SEQ ID NO: 2386059 - protein, 21 aa, Entamoeba dispar
KSLPHRRGTKIVWVFVTILLN

SEQ ID NO: 2386060 - protein, 18 aa, Entamoeba dispar
KSLPKSWRGKENEELEEA

SEQ ID NO: 2386061 - protein, 20 aa, Entamoeba dispar
KSLQEFFVKVLKTFESFSPN

SEQ ID NO: 2386062 - protein, 21 aa, Entamoeba dispar
KSLRSYQIYKIINGMVSALHY

SEQ ID NO: 2386063 - protein, 24 aa, Entamoeba dispar
KSLSEFDFQLNIGKTTSVPLTNLY

SEQ ID NO: 2386064 - protein, 30 aa, Entamoeba dispar
KSLVTYCAAPMPFVIGCLRTLYPEIQNECG

SEQ ID NO: 2386065 - protein, 25 aa, Entamoeba dispar
KSMALPKILGLSIHNNWGNKYQKIV

SEQ ID NO: 2386066 - protein, 26 aa, Entamoeba dispar
KSMNGSSKWWYSVVIYEHTLGIKSVE

SEQ ID NO: 2386067 - protein, 25 aa, Entamoeba dispar
KSNELSMTMVIRFAKNINNALDVLH

SEQ ID NO: 2386068 - protein, 22 aa, Entamoeba dispar
KSNKKIIDGFEFERTLLKNKLA

SEQ ID NO: 2386069 - protein, 21 aa, Entamoeba dispar
KSNQAKGVWKKVYNKYQDVNS

SEQ ID NO: 2386070 - protein, 23 aa, Entamoeba dispar
KSNRFEFGFKDELVFDGIKQLLK

SEQ ID NO: 2386071 - protein, 23 aa, Entamoeba dispar
KSNRFSIIRIMIEQMKMNFIFFT

SEQ ID NO: 2386072 - protein, 25 aa, Entamoeba dispar
KSNWICLLCSIILSIVTFTLFPSLL

SEQ ID NO: 2386073 - protein, 31 aa, Entamoeba dispar
KSNYLRLPYKLKIRMLFDTARGMEFLHENRI

SEQ ID NO: 2386074 - protein, 18 aa, Entamoeba dispar
KSPLFLLLKSMPKYLQMI

SEQ ID NO: 2386075 - protein, 19 aa, Entamoeba dispar
KSPMGRLIFLSGNGSVEIQ

SEQ ID NO: 2386076 - protein, 20 aa, Entamoeba dispar
KSQIAALMFPLISYAIEEKS

SEQ ID NO: 2386077 - protein, 18 aa, Entamoeba dispar
KSQIKYALLVHQNTSFSS

SEQ ID NO: 2386078 - protein, 24 aa, Entamoeba dispar
KSQRGRISVCYSLEQFAHQTWLIE

SEQ ID NO: 2386079 - protein, 21 aa, Entamoeba dispar
KSSDNLLLFKLGEEMAEMYSM

SEQ ID NO: 2386080 - protein, 21 aa, Entamoeba dispar
KSSHITTVWIAARLFVQISQT

SEQ ID NO: 2386081 - protein, 26 aa, Entamoeba dispar
KSSKKLKIILLVSLIIVLILALIIGI

SEQ ID NO: 2386082 - protein, 21 aa, Entamoeba dispar
KSSNNELYFYNSLKMKMSILI

SEQ ID NO: 2386083 - protein, 20 aa, Entamoeba dispar
KSSWIGANVDDCYQRTDKVT

SEQ ID NO: 2386084 - protein, 28 aa, Entamoeba dispar
KSSYLMDEFKSVLYYKGDTSQRESEIVC

SEQ ID NO: 2386085 - protein, 18 aa, Entamoeba dispar
KSTFKFNYMLAGIIITVL

SEQ ID NO: 2386086 - protein, 18 aa, Entamoeba dispar
KSTFKFNYMLAGIILMIL

SEQ ID NO: 2386087 - protein, 24 aa, Entamoeba dispar
KSTKLKKVLIDVCASIYNTVPTLI

SEQ ID NO: 2386088 - protein, 19 aa, Entamoeba dispar
KSTLLRIVRRDNNNNQYYQ

SEQ ID NO: 2386089 - protein, 18 aa, Entamoeba dispar
KSTLNLKQYRFVIFTEEV

SEQ ID NO: 2386090 - protein, 18 aa, Entamoeba dispar
KSTVIQLIERFYKPERGT

SEQ ID NO: 2386091 - protein, 21 aa, Entamoeba dispar
KSVEASKKWYGNGINEGVRRN

SEQ ID NO: 2386092 - protein, 26 aa, Entamoeba dispar
KSVILLGELLYLAGLLLPQRHLSLQK

SEQ ID NO: 2386093 - protein, 17 aa, Entamoeba dispar
KSYDWMILILINKIINI

SEQ ID NO: 2386094 - protein, 34 aa, Entamoeba dispar
KSYFDLSFVFSWEFWWKLVVIILLTSIPFIAKFF

SEQ ID NO: 2386095 - protein, 30 aa, Entamoeba dispar
KSYFKKGFSKLFLPLGFSGVLSIIFIVMYC

SEQ ID NO: 2386096 - protein, 18 aa, Entamoeba dispar
KSYLCSKDSYGITKKEYS

SEQ ID NO: 2386097 - protein, 27 aa, Entamoeba dispar
KTCVKGKRTPIKFSYTIFDSAEDINII

SEQ ID NO: 2386098 - protein, 19 aa, Entamoeba dispar
KTDLISWIYIIRIILFSLT

SEQ ID NO: 2386099 - protein, 22 aa, Entamoeba dispar
KTDPALMCRISFILQATCSLTI

SEQ ID NO: 2386100 - protein, 18 aa, Entamoeba dispar
KTEALLCVTDYPTILNQY

SEQ ID NO: 2386101 - protein, 24 aa, Entamoeba dispar
KTEHKIKGVLLIYKYAEIDPNGSK

SEQ ID NO: 2386102 - protein, 26 aa, Entamoeba dispar
KTEIPKFLVKVLVDFASTTFTIKSCI

SEQ ID NO: 2386103 - protein, 23 aa, Entamoeba dispar
KTEKNSTMGIWIKSCEQNTIHLC

SEQ ID NO: 2386104 - protein, 18 aa, Entamoeba dispar
KTELPVRYVRELQKVLLS

SEQ ID NO: 2386105 - protein, 17 aa, Entamoeba dispar
KTFLFMFTFDVMLTLLL

SEQ ID NO: 2386106 - protein, 27 aa, Entamoeba dispar
KTGIPPEVWRYYLLINRPEQSDTVFLW

SEQ ID NO: 2386107 - protein, 28 aa, Entamoeba dispar
KTGKAFGASNKWKGISVIFDTFQNGKME

SEQ ID NO: 2386108 - protein, 25 aa, Entamoeba dispar
KTGRLYVECFGKWIMYKLSSDSYIN

SEQ ID NO: 2386109 - protein, 21 aa, Entamoeba dispar
KTGVLKAFAFLFEYIGEKSKD

SEQ ID NO: 2386110 - protein, 25 aa, Entamoeba dispar
KTHLIEFITAIILFFVGMILEGFPG

SEQ ID NO: 2386111 - protein, 29 aa, Entamoeba dispar
KTHLSSICLTIFYLFKVVYWTISGLQIKS

SEQ ID NO: 2386112 - protein, 18 aa, Entamoeba dispar
KTHYNCYSHVWDAHLRHI

SEQ ID NO: 2386113 - protein, 19 aa, Entamoeba dispar
KTIGRPVGFYELIKRLVIS

SEQ ID NO: 2386114 - protein, 17 aa, Entamoeba dispar
KTIKGIIGEEIFDKLTL

SEQ ID NO: 2386115 - protein, 17 aa, Entamoeba dispar
KTIKRLHIKQVIEEQKN

SEQ ID NO: 2386116 - protein, 18 aa, Entamoeba dispar
KTILKLVNKYSIEKCCNC

SEQ ID NO: 2386117 - protein, 18 aa, Entamoeba dispar
KTIPGFTFYISDMNHACS

SEQ ID NO: 2386118 - protein, 24 aa, Entamoeba dispar
KTIRLEIWTCASVALINNFSESES

SEQ ID NO: 2386119 - protein, 18 aa, Entamoeba dispar
KTKECIQCEKRYYLNSNK

SEQ ID NO: 2386120 - protein, 23 aa, Entamoeba dispar
KTKEVIKNILIQGSESTVLIESS

SEQ ID NO: 2386121 - protein, 18 aa, Entamoeba dispar
KTKFVITCYFRCTDKDLK

SEQ ID NO: 2386122 - protein, 17 aa, Entamoeba dispar
KTKLGFFDVTPLGRIVN

SEQ ID NO: 2386123 - protein, 26 aa, Entamoeba dispar
KTKRKLRLFGGLTMISMMIFFMMLAL

SEQ ID NO: 2386124 - protein, 17 aa, Entamoeba dispar
KTLFYIIIATIVFIPIC

SEQ ID NO: 2386125 - protein, 29 aa, Entamoeba dispar
KTLKGMLRRAICNKVFLIILAIVFLIIIG

SEQ ID NO: 2386126 - protein, 19 aa, Entamoeba dispar
KTLKLRIYKELGPFNKNGV

SEQ ID NO: 2386127 - protein, 17 aa, Entamoeba dispar
KTLKRMLYRAITNKIFL

SEQ ID NO: 2386128 - protein, 22 aa, Entamoeba dispar
KTLLKISNFLSYFGTNALPGSE

SEQ ID NO: 2386129 - protein, 21 aa, Entamoeba dispar
KTLRAQNIIGYTDEWILPSDL

SEQ ID NO: 2386130 - protein, 21 aa, Entamoeba dispar
KTLYYGSRWGVVRQLDAASMM

SEQ ID NO: 2386131 - protein, 18 aa, Entamoeba dispar
KTNMVFKRDIARIKRKDL

SEQ ID NO: 2386132 - protein, 19 aa, Entamoeba dispar
KTNQIPAFVSDWFNNTPLN

SEQ ID NO: 2386133 - protein, 25 aa, Entamoeba dispar
KTPCGHGGYVQGFWVKFDSKAMEND

SEQ ID NO: 2386134 - protein, 21 aa, Entamoeba dispar
KTPGSIYMRTRVLGSDHKGFV

SEQ ID NO: 2386135 - protein, 28 aa, Entamoeba dispar
KTPGVYSFCFDNTMSLYTSKLVEFKLQL

SEQ ID NO: 2386136 - protein, 25 aa, Entamoeba dispar
KTQEELRTSYGFTEVEKLGVYNQER

SEQ ID NO: 2386137 - protein, 19 aa, Entamoeba dispar
KTRECIECEKGYYLNSNKE

SEQ ID NO: 2386138 - protein, 20 aa, Entamoeba dispar
KTRFNCYAHVWDIHLREYYT

SEQ ID NO: 2386139 - protein, 24 aa, Entamoeba dispar
KTRREVFQAIGIFIGFIICVSIVI

SEQ ID NO: 2386140 - protein, 22 aa, Entamoeba dispar
KTSFKILIILTTLCGIMSLVAF

SEQ ID NO: 2386141 - protein, 18 aa, Entamoeba dispar
KTSFYVFITGATENDVGV

SEQ ID NO: 2386142 - protein, 23 aa, Entamoeba dispar
KTSIILCILNWVAMVMLSQHQHD

SEQ ID NO: 2386143 - protein, 19 aa, Entamoeba dispar
KTSLFSLSVCSVLMVNLWS

SEQ ID NO: 2386144 - protein, 17 aa, Entamoeba dispar
KTSTLRTYLEKEVPIRC

SEQ ID NO: 2386145 - protein, 24 aa, Entamoeba dispar
KTTCSSCKIFGECAQCSFSGCTSC

SEQ ID NO: 2386146 - protein, 18 aa, Entamoeba dispar
KTTCTKKGDILVIDVDKK

SEQ ID NO: 2386147 - protein, 18 aa, Entamoeba dispar
KTTFKYPWSIADFVTKGN

SEQ ID NO: 2386148 - protein, 30 aa, Entamoeba dispar
KTTRIIIDFCFLIATGVCFLPIVLYSGALA

SEQ ID NO: 2386149 - protein, 24 aa, Entamoeba dispar
KTTSGIGCRECSYGYYWKQGTCSK

SEQ ID NO: 2386150 - protein, 25 aa, Entamoeba dispar
KTTVVKRKKFEFILSKPKVQEMKHI

SEQ ID NO: 2386151 - protein, 24 aa, Entamoeba dispar
KTTWSQNSVKDFILFGLNSIPHKK

SEQ ID NO: 2386152 - protein, 20 aa, Entamoeba dispar
KTVCIFKMKYSNLKFSLINE

SEQ ID NO: 2386153 - protein, 18 aa, Entamoeba dispar
KTVISICDVIISFYFDGP

SEQ ID NO: 2386154 - protein, 20 aa, Entamoeba dispar
KTVSFPGTFNGYIDKTMPVT

SEQ ID NO: 2386155 - protein, 25 aa, Entamoeba dispar
KTWNWILIIGHIISIIFIFIIYGLT

SEQ ID NO: 2386156 - protein, 20 aa, Entamoeba dispar
KTYCYQCKEGFIKENGECQK

SEQ ID NO: 2386157 - protein, 17 aa, Entamoeba dispar
KVAEKQASVFLILIPTT

SEQ ID NO: 2386158 - protein, 17 aa, Entamoeba dispar
KVDENLYYKYFEENSEM

SEQ ID NO: 2386159 - protein, 18 aa, Entamoeba dispar
KVELPYFDVCVSNTPYSI

SEQ ID NO: 2386160 - protein, 22 aa, Entamoeba dispar
KVFHLDAGVTYIAKFYAKESDS

SEQ ID NO: 2386161 - protein, 20 aa, Entamoeba dispar
KVGCAICNDGYYRKGTSCPK

SEQ ID NO: 2386162 - protein, 18 aa, Entamoeba dispar
KVGYLFQHVVPLIFVLTV

SEQ ID NO: 2386163 - protein, 24 aa, Entamoeba dispar
KVHFIRKGLHKIINWEKDNHQLID

SEQ ID NO: 2386164 - protein, 19 aa, Entamoeba dispar
KVHIKVVSLSEGFIESIVA

SEQ ID NO: 2386165 - protein, 24 aa, Entamoeba dispar
KVIDKRVAITLIIEITKIAQSYLV

SEQ ID NO: 2386166 - protein, 17 aa, Entamoeba dispar
KVIGWGDLVECFSITEP

SEQ ID NO: 2386167 - protein, 23 aa, Entamoeba dispar
KVIKSNCIYPLFDGNQYHVIYNQ

SEQ ID NO: 2386168 - protein, 20 aa, Entamoeba dispar
KVIQKPTLRKSVLTICVIIF

SEQ ID NO: 2386169 - protein, 20 aa, Entamoeba dispar
KVIRQCLSVPIIGKETSKNN

SEQ ID NO: 2386170 - protein, 17 aa, Entamoeba dispar
KVKGMLISNTLFRMGGA

SEQ ID NO: 2386171 - protein, 17 aa, Entamoeba dispar
KVKLPLNLNDQYHFFFL

SEQ ID NO: 2386172 - protein, 26 aa, Entamoeba dispar
KVKMIECGGIVLQECKTDTITYNCPP

SEQ ID NO: 2386173 - protein, 21 aa, Entamoeba dispar
KVKMTEYIHRFGLPYNESLIC

SEQ ID NO: 2386174 - protein, 23 aa, Entamoeba dispar
KVKVEGKILFLIDGLTIKPIPLT

SEQ ID NO: 2386175 - protein, 20 aa, Entamoeba dispar
KVLFPNCDQSFIINNQHLPI

SEQ ID NO: 2386176 - protein, 17 aa, Entamoeba dispar
KVLIDFPPHDKIGQFFI

SEQ ID NO: 2386177 - protein, 24 aa, Entamoeba dispar
KVLKECGCAILVGFDGDSYGKDDE

SEQ ID NO: 2386178 - protein, 18 aa, Entamoeba dispar
KVLNLDFWRESKYSNTNY

SEQ ID NO: 2386179 - protein, 23 aa, Entamoeba dispar
KVLPDKWNAISLVHSHDSNSMKI

SEQ ID NO: 2386180 - protein, 21 aa, Entamoeba dispar
KVMFHCAYLILSAILTLRLHL

SEQ ID NO: 2386181 - protein, 30 aa, Entamoeba dispar
KVNCFKGAVFKMDIGQYFGISASNGDLSDS

SEQ ID NO: 2386182 - protein, 23 aa, Entamoeba dispar
KVNSIKCNLKLVGGPFIINSLSD

SEQ ID NO: 2386183 - protein, 18 aa, Entamoeba dispar
KVPLEYVFPFIKNLFQTH

SEQ ID NO: 2386184 - protein, 26 aa, Entamoeba dispar
KVRISIICILVFFGIISLFLSFTFIL

SEQ ID NO: 2386185 - protein, 18 aa, Entamoeba dispar
KVRVLYKLNWVQPSDFED

SEQ ID NO: 2386186 - protein, 17 aa, Entamoeba dispar
KVRYDLCSPNFTQPTRC

SEQ ID NO: 2386187 - protein, 24 aa, Entamoeba dispar
KVSFIRLTISFIINMYVLCSPILR

SEQ ID NO: 2386188 - protein, 25 aa, Entamoeba dispar
KVSFSSKCLAAFPPLLLAMIKADLS

SEQ ID NO: 2386189 - protein, 19 aa, Entamoeba dispar
KVTDQYGCLECYYDQTNTE

SEQ ID NO: 2386190 - protein, 21 aa, Entamoeba dispar
KVVGGEGVISFLKKMNLIDTN

SEQ ID NO: 2386191 - protein, 20 aa, Entamoeba dispar
KVVNNYKYAFPLFIQTNVLL

SEQ ID NO: 2386192 - protein, 24 aa, Entamoeba dispar
KVVPEDRFGAFIGLANCAVVFAQF

SEQ ID NO: 2386193 - protein, 24 aa, Entamoeba dispar
KVVRIKFGSGWYIRTFTTLAIGIK

SEQ ID NO: 2386194 - protein, 21 aa, Entamoeba dispar
KVVSCIIAIIICISVILTFIS

SEQ ID NO: 2386195 - protein, 20 aa, Entamoeba dispar
KVVSLSEGFIESIVASGGIK

SEQ ID NO: 2386196 - protein, 20 aa, Entamoeba dispar
KVYIKAILDKSCTSFSNVFS

SEQ ID NO: 2386197 - protein, 28 aa, Entamoeba dispar
KWESLRMVIWRVSRGFVVTRSAPIDNRR

SEQ ID NO: 2386198 - protein, 23 aa, Entamoeba dispar
KWKGHVETLVPLLARFVSISAKI

SEQ ID NO: 2386199 - protein, 21 aa, Entamoeba dispar
KWKKMLEMWKETVPHKLNERV

SEQ ID NO: 2386200 - protein, 18 aa, Entamoeba dispar
KWKRCFGNNSFIATINSV

SEQ ID NO: 2386201 - protein, 19 aa, Entamoeba dispar
KWNNWKINIIVIILLLNFF

SEQ ID NO: 2386202 - protein, 20 aa, Entamoeba dispar
KWRQTWKNNNLVLFEDFIIS

SEQ ID NO: 2386203 - protein, 24 aa, Entamoeba dispar
KWTYKRTLFLIAMAVFTLFLILLT

SEQ ID NO: 2386204 - protein, 18 aa, Entamoeba dispar
KWVGVLVSIFIRKLSPDN

SEQ ID NO: 2386205 - protein, 20 aa, Entamoeba dispar
KWVKGELSNYEFLYEVNRYA

SEQ ID NO: 2386206 - protein, 28 aa, Entamoeba dispar
KWYFPSIKNHIYISIGFTFVALFFQSFR

SEQ ID NO: 2386207 - protein, 17 aa, Entamoeba dispar
KWYRLKVNKGEERIITT

SEQ ID NO: 2386208 - protein, 25 aa, Entamoeba dispar
KYCAKKNLWYVWVIIVVGIIFIISL

SEQ ID NO: 2386209 - protein, 18 aa, Entamoeba dispar
KYCDINAFSCNKTQCSGT

SEQ ID NO: 2386210 - protein, 17 aa, Entamoeba dispar
KYDEFVIQKDCCGKDYQ

SEQ ID NO: 2386211 - protein, 19 aa, Entamoeba dispar
KYEGLKISEDQIRGEDVNI

SEQ ID NO: 2386212 - protein, 25 aa, Entamoeba dispar
KYELTQVCRIYVALVPKGYTITECP

SEQ ID NO: 2386213 - protein, 24 aa, Entamoeba dispar
KYFIIKSYHYLFLFYNFTNFSLLN

SEQ ID NO: 2386214 - protein, 20 aa, Entamoeba dispar
KYFIIPFILSIGIILIVHLT

SEQ ID NO: 2386215 - protein, 18 aa, Entamoeba dispar
KYFINLFFLIIAILSCIP

SEQ ID NO: 2386216 - protein, 18 aa, Entamoeba dispar
KYFSSFVLSLPMTYYCRY

SEQ ID NO: 2386217 - protein, 22 aa, Entamoeba dispar
KYFTCAFKFPTIAPEVLLNRNH

SEQ ID NO: 2386218 - protein, 19 aa, Entamoeba dispar
KYFTDAKCTTAVEDNQDVT

SEQ ID NO: 2386219 - protein, 23 aa, Entamoeba dispar
KYFTELINALGLKEVKAPEQICT

SEQ ID NO: 2386220 - protein, 20 aa, Entamoeba dispar
KYFYYIQFISVYSINDTYLF

SEQ ID NO: 2386221 - protein, 26 aa, Entamoeba dispar
KYGGEKDVDCYKQRGICYQMIRNYEL

SEQ ID NO: 2386222 - protein, 25 aa, Entamoeba dispar
KYGIRSEPQLAFIKPGNAVEFNLFV

SEQ ID NO: 2386223 - protein, 19 aa, Entamoeba dispar
KYHCGQTFLEKAYKVQRNE

SEQ ID NO: 2386224 - protein, 21 aa, Entamoeba dispar
KYIDCPQIHIPWFKMIANEHE

SEQ ID NO: 2386225 - protein, 17 aa, Entamoeba dispar
KYILWWFGLGVLSSVGL

SEQ ID NO: 2386226 - protein, 19 aa, Entamoeba dispar
KYINSGQCVECKEGYYLVI

SEQ ID NO: 2386227 - protein, 26 aa, Entamoeba dispar
KYIPFLNAPCGFVKTVGHSGGEDFSK

SEQ ID NO: 2386228 - protein, 17 aa, Entamoeba dispar
KYIPIVLLFLYFIFFIK

SEQ ID NO: 2386229 - protein, 24 aa, Entamoeba dispar
KYIQVFNFISLIFFPITFVVNTFG

SEQ ID NO: 2386230 - protein, 22 aa, Entamoeba dispar
KYIRATMSISFIFTLLLIGVFI

SEQ ID NO: 2386231 - protein, 24 aa, Entamoeba dispar
KYISKLSGIKCLIKRHTTSPETLS

SEQ ID NO: 2386232 - protein, 23 aa, Entamoeba dispar
KYIVHICCILIGYPKVIILNYLK

SEQ ID NO: 2386233 - protein, 27 aa, Entamoeba dispar
KYKCDEVFKIPKKCTFKTENSNIDFNS

SEQ ID NO: 2386234 - protein, 23 aa, Entamoeba dispar
KYKFRIVECDTVLKKIKAYFHIT

SEQ ID NO: 2386235 - protein, 24 aa, Entamoeba dispar
KYKGTFPSAHWVLYAILELIISNF

SEQ ID NO: 2386236 - protein, 24 aa, Entamoeba dispar
KYKLGRIPYLYLFIVALFTSIVTA

SEQ ID NO: 2386237 - protein, 18 aa, Entamoeba dispar
KYKMPADVYSFAVTMLHI

SEQ ID NO: 2386238 - protein, 23 aa, Entamoeba dispar
KYKNEIIGLLLLGFIYTIHCFFT

SEQ ID NO: 2386239 - protein, 30 aa, Entamoeba dispar
KYLCLAFSCCVGMKCILSFSRKKTKNGTVF

SEQ ID NO: 2386240 - protein, 19 aa, Entamoeba dispar
KYLLVGLVVSVLFLVAGIY

SEQ ID NO: 2386241 - protein, 19 aa, Entamoeba dispar
KYLQFIQPLLINKSTANKQ

SEQ ID NO: 2386242 - protein, 23 aa, Entamoeba dispar
KYLRHPSYFGWFYWSIFTQFVLI

SEQ ID NO: 2386243 - protein, 21 aa, Entamoeba dispar
KYMRLKCPHAQFTEARSVISI

SEQ ID NO: 2386244 - protein, 24 aa, Entamoeba dispar
KYNCIPCPEGTYSILSSSSCPVCG

SEQ ID NO: 2386245 - protein, 21 aa, Entamoeba dispar
KYNEEFCMYFGKTLFSVGEFE

SEQ ID NO: 2386246 - protein, 22 aa, Entamoeba dispar
KYNELHKILTIMRTKNLLVKDI

SEQ ID NO: 2386247 - protein, 25 aa, Entamoeba dispar
KYNWFRPASFFPLGYMYEILDKYNY

SEQ ID NO: 2386248 - protein, 26 aa, Entamoeba dispar
KYNYYEIGWRFVFIILSCIVMGFFAF

SEQ ID NO: 2386249 - protein, 23 aa, Entamoeba dispar
KYPFLMCFNNFYLIFVDRIYFIY

SEQ ID NO: 2386250 - protein, 18 aa, Entamoeba dispar
KYPKVILHNCAKELDISH

SEQ ID NO: 2386251 - protein, 18 aa, Entamoeba dispar
KYPPFSFTLSKEIINRFE

SEQ ID NO: 2386252 - protein, 19 aa, Entamoeba dispar
KYPSTILDKAWIEIWKTKE

SEQ ID NO: 2386253 - protein, 22 aa, Entamoeba dispar
KYPTVFGKITIFKRFPALLPQL

SEQ ID NO: 2386254 - protein, 19 aa, Entamoeba dispar
KYPYFSFSCISLIGQYVLT

SEQ ID NO: 2386255 - protein, 22 aa, Entamoeba dispar
KYQGNTLFIKWWRGSKSKSGAL

SEQ ID NO: 2386256 - protein, 24 aa, Entamoeba dispar
KYQGSFPSAHWVLYAILELIISNY

SEQ ID NO: 2386257 - protein, 18 aa, Entamoeba dispar
KYRDETKALLSLFQINIH

SEQ ID NO: 2386258 - protein, 35 aa, Entamoeba dispar
KYRDYLNCLFIRYFPRAICPGCVMNLKQVSEVENV

SEQ ID NO: 2386259 - protein, 18 aa, Entamoeba dispar
KYRFLAVSFTSLIFFTTI

SEQ ID NO: 2386260 - protein, 24 aa, Entamoeba dispar
KYRLKEMFSNFNLLIQCWDITRLL

SEQ ID NO: 2386261 - protein, 18 aa, Entamoeba dispar
KYSALKCPHAQFTEAKDD

SEQ ID NO: 2386262 - protein, 21 aa, Entamoeba dispar
KYSHESCFLVAKGIQVLENMN

SEQ ID NO: 2386263 - protein, 18 aa, Entamoeba dispar
KYSHTIDCICTFFEKDDE

SEQ ID NO: 2386264 - protein, 33 aa, Entamoeba dispar
KYSIEILHVVSWMYCNICRIKLVLDPYNMKAIF

SEQ ID NO: 2386265 - protein, 23 aa, Entamoeba dispar
KYSKKENQSYCIFENDETYAGEQ

SEQ ID NO: 2386266 - protein, 26 aa, Entamoeba dispar
KYSLFFGGVCYVFYIATNVYLIRSLY

SEQ ID NO: 2386267 - protein, 20 aa, Entamoeba dispar
KYSRRGVILITQPLKNSLSR

SEQ ID NO: 2386268 - protein, 18 aa, Entamoeba dispar
KYSTAGNCVECKEGYYLK

SEQ ID NO: 2386269 - protein, 17 aa, Entamoeba dispar
KYTEMYKELSITIHKNI

SEQ ID NO: 2386270 - protein, 20 aa, Entamoeba dispar
KYTKELFCVANSLKTKEPIN

SEQ ID NO: 2386271 - protein, 18 aa, Entamoeba dispar
KYTKGWFVSLENPQSISP

SEQ ID NO: 2386272 - protein, 21 aa, Entamoeba dispar
KYTSFKSLHVQFPFSNSSILV

SEQ ID NO: 2386273 - protein, 21 aa, Entamoeba dispar
KYVLKIFMLFSSQRSACSRML

SEQ ID NO: 2386274 - protein, 17 aa, Entamoeba dispar
KYVNCIKTQQLGGIIGL

SEQ ID NO: 2386275 - protein, 25 aa, Entamoeba dispar
KYVNEDRTRFGFIAQELKEVITDAV

SEQ ID NO: 2386276 - protein, 25 aa, Entamoeba dispar
KYVNENRTTCSFKKEQPDIIPMIII

SEQ ID NO: 2386277 - protein, 24 aa, Entamoeba dispar
KYVYRSTLRIKEFQELLIKMHPQG

SEQ ID NO: 2386278 - protein, 17 aa, Entamoeba dispar
KYWKLIKRICLFQVFGY

SEQ ID NO: 2386279 - protein, 20 aa, Entamoeba dispar
KYYFDSFYAVLPFSIDIINE

SEQ ID NO: 2386280 - protein, 21 aa, Entamoeba dispar
LAAIHLLEFILKVKRSLHLNS

SEQ ID NO: 2386281 - protein, 22 aa, Entamoeba dispar
LAASVFRLFVITTLTSLISQGG

SEQ ID NO: 2386282 - protein, 19 aa, Entamoeba dispar
LAELKKVDAGYWFTEDGKT

SEQ ID NO: 2386283 - protein, 24 aa, Entamoeba dispar
LAFGCSDSLVGICCLNQPQEIPVY

SEQ ID NO: 2386284 - protein, 21 aa, Entamoeba dispar
LAFNGLFGRENWLMQNLTNII

SEQ ID NO: 2386285 - protein, 26 aa, Entamoeba dispar
LAFTLPCLFIFMSLYRFNGFTLFSIK

SEQ ID NO: 2386286 - protein, 18 aa, Entamoeba dispar
LAGLCLLSQIIQPFIQKF

SEQ ID NO: 2386287 - protein, 17 aa, Entamoeba dispar
LAGYRCVIEASNKFGRL

SEQ ID NO: 2386288 - protein, 24 aa, Entamoeba dispar
LAHIFEIGIEFALLMDFGTIGYAG

SEQ ID NO: 2386289 - protein, 17 aa, Entamoeba dispar
LAHKVFVALGLRNDVVN

SEQ ID NO: 2386290 - protein, 20 aa, Entamoeba dispar
LAIIRWVFILNFFISIIYAF

SEQ ID NO: 2386291 - protein, 17 aa, Entamoeba dispar
LAKDLINIFILKKNESV

SEQ ID NO: 2386292 - protein, 17 aa, Entamoeba dispar
LAKMTITISHEYDYLLF

SEQ ID NO: 2386293 - protein, 26 aa, Entamoeba dispar
LAKVFARISFVFSILYVLFISGFIGV

SEQ ID NO: 2386294 - protein, 18 aa, Entamoeba dispar
LALLEELPFGEIDINEYL

SEQ ID NO: 2386295 - protein, 17 aa, Entamoeba dispar
LALQKIYLVLGKVQQQA

SEQ ID NO: 2386296 - protein, 21 aa, Entamoeba dispar
LALSISYTWTGASSNLFESIS

SEQ ID NO: 2386297 - protein, 25 aa, Entamoeba dispar
LAMGWSCVLYGPLVFYFCPLSLVFY

SEQ ID NO: 2386298 - protein, 24 aa, Entamoeba dispar
LANECLLCSCHATELTRFSLDETN

SEQ ID NO: 2386299 - protein, 18 aa, Entamoeba dispar
LANLSFLVLNIIYLLDCA

SEQ ID NO: 2386300 - protein, 19 aa, Entamoeba dispar
LAQFIPITIKLALDVCNLD

SEQ ID NO: 2386301 - protein, 19 aa, Entamoeba dispar
LAQTCYKMGLVGYTIWIIL

SEQ ID NO: 2386302 - protein, 20 aa, Entamoeba dispar
LAREGLRTLVFGSRKMSQEE

SEQ ID NO: 2386303 - protein, 21 aa, Entamoeba dispar
LARSLTRAFLPLGKFGILSAL

SEQ ID NO: 2386304 - protein, 17 aa, Entamoeba dispar
LASEGYFGYPVCMPHIF

SEQ ID NO: 2386305 - protein, 17 aa, Entamoeba dispar
LASIPFQLILGIISLCW

SEQ ID NO: 2386306 - protein, 26 aa, Entamoeba dispar
LASLPLILPSFRQWKLKDMMEMIDAK

SEQ ID NO: 2386307 - protein, 17 aa, Entamoeba dispar
LASYCMFVIVQSFPNVV

SEQ ID NO: 2386308 - protein, 17 aa, Entamoeba dispar
LATKISTIKGFKLASFE

SEQ ID NO: 2386309 - protein, 29 aa, Entamoeba dispar
LATRFLSNHMCKSCYGYCQLNGNDTTELT

SEQ ID NO: 2386310 - protein, 17 aa, Entamoeba dispar
LAVCSFRKMGGEKDYIN

SEQ ID NO: 2386311 - protein, 19 aa, Entamoeba dispar
LAVVPKGYVIESCPDDPCG

SEQ ID NO: 2386312 - protein, 20 aa, Entamoeba dispar
LAYECVLNGFNFSSIHSEIE

SEQ ID NO: 2386313 - protein, 19 aa, Entamoeba dispar
LCAFAVVIGIISGYELQSI

SEQ ID NO: 2386314 - protein, 22 aa, Entamoeba dispar
LCAIAIIVLVVKWRFGKNHEES

SEQ ID NO: 2386315 - protein, 18 aa, Entamoeba dispar
LCCIGTFISPCVSTFKVG

SEQ ID NO: 2386316 - protein, 19 aa, Entamoeba dispar
LCEHARFLNITTEGDQFTQ

SEQ ID NO: 2386317 - protein, 17 aa, Entamoeba dispar
LCEPCPTNQVANLQKTV

SEQ ID NO: 2386318 - protein, 20 aa, Entamoeba dispar
LCETKYYLDESMKCVNCPAN

SEQ ID NO: 2386319 - protein, 17 aa, Entamoeba dispar
LCEVAIVYYLFNSLYGD

SEQ ID NO: 2386320 - protein, 22 aa, Entamoeba dispar
LCFIAFSLVVYFTDWKMAEIGD

SEQ ID NO: 2386321 - protein, 21 aa, Entamoeba dispar
LCGLCVFIGILFKPFTFLLLL

SEQ ID NO: 2386322 - protein, 17 aa, Entamoeba dispar
LCGVQYDPSIPINSSVY

SEQ ID NO: 2386323 - protein, 17 aa, Entamoeba dispar
LCHFIHSLIIPTSPLEL

SEQ ID NO: 2386324 - protein, 20 aa, Entamoeba dispar
LCIHLFKVTFHFKTTLPEII

SEQ ID NO: 2386325 - protein, 20 aa, Entamoeba dispar
LCILGCFAQNLTINIFHVGQ

SEQ ID NO: 2386326 - protein, 20 aa, Entamoeba dispar
LCISASIFSILFIVMIYFIA

SEQ ID NO: 2386327 - protein, 18 aa, Entamoeba dispar
LCIYWVMDAINYKPILIC

SEQ ID NO: 2386328 - protein, 18 aa, Entamoeba dispar
LCKDGYGGESCILKCWHN

SEQ ID NO: 2386329 - protein, 17 aa, Entamoeba dispar
LCKEGYGGDNCVLKCWY

SEQ ID NO: 2386330 - protein, 18 aa, Entamoeba dispar
LCKGTLLEDVFKGYESVN

SEQ ID NO: 2386331 - protein, 22 aa, Entamoeba dispar
LCKSAPIIIIWTTLFLVEILLA

SEQ ID NO: 2386332 - protein, 27 aa, Entamoeba dispar
LCLIISISLPIIVIFLFAKKRNSTYYF

SEQ ID NO: 2386333 - protein, 17 aa, Entamoeba dispar
LCLNCISCCSIPLLIII

SEQ ID NO: 2386334 - protein, 17 aa, Entamoeba dispar
LCLPIFMNLYNNIMELP

SEQ ID NO: 2386335 - protein, 20 aa, Entamoeba dispar
LCLPITQLIMLFSSILNERR

SEQ ID NO: 2386336 - protein, 24 aa, Entamoeba dispar
LCLSCIYGKCEICDKKAGMLVSCG

SEQ ID NO: 2386337 - protein, 17 aa, Entamoeba dispar
LCLSYLLYHIYFIISTL

SEQ ID NO: 2386338 - protein, 24 aa, Entamoeba dispar
LCLYRMCPIIPFTISNYILSPFVD

SEQ ID NO: 2386339 - protein, 17 aa, Entamoeba dispar
LCNGVSCETCGNNILDE

SEQ ID NO: 2386340 - protein, 17 aa, Entamoeba dispar
LCNPSFSLSQMKCPFSI

SEQ ID NO: 2386341 - protein, 18 aa, Entamoeba dispar
LCPCHYSDPKGEQDLIGT

SEQ ID NO: 2386342 - protein, 25 aa, Entamoeba dispar
LCQPMYVLSSLVFKGNKTFRKVICF

SEQ ID NO: 2386343 - protein, 27 aa, Entamoeba dispar
LCSAAEEFMFRFSFYKPTKEVLSLTPS

SEQ ID NO: 2386344 - protein, 17 aa, Entamoeba dispar
LCSPHKIALSPNALILV

SEQ ID NO: 2386345 - protein, 17 aa, Entamoeba dispar
LCSSGFLNIKGDCVTCE

SEQ ID NO: 2386346 - protein, 17 aa, Entamoeba dispar
LCSSSVYIHPLDYSKPT

SEQ ID NO: 2386347 - protein, 17 aa, Entamoeba dispar
LCSTASFIRSHTPLTVF

SEQ ID NO: 2386348 - protein, 20 aa, Entamoeba dispar
LCSVISILFLFHIFNVKVIF

SEQ ID NO: 2386349 - protein, 19 aa, Entamoeba dispar
LCTYFFQLGVIGFLDYSFL

SEQ ID NO: 2386350 - protein, 20 aa, Entamoeba dispar
LCVIVYFLPVKVINGYIPPI

SEQ ID NO: 2386351 - protein, 26 aa, Entamoeba dispar
LCVLMCVIDLIGIMYLWGVELNAVSC

SEQ ID NO: 2386352 - protein, 20 aa, Entamoeba dispar
LCVMDVCLALAAVFIVVMLL

SEQ ID NO: 2386353 - protein, 20 aa, Entamoeba dispar
LCYIICLKIYYLNHQLNYFN

SEQ ID NO: 2386354 - protein, 19 aa, Entamoeba dispar
LCYKGFRDILPILITCFIG

SEQ ID NO: 2386355 - protein, 18 aa, Entamoeba dispar
LDAGLCTFSSDSFTQNEC

SEQ ID NO: 2386356 - protein, 24 aa, Entamoeba dispar
LDAIKEVKQTIGFDHLITIETKEQ

SEQ ID NO: 2386357 - protein, 23 aa, Entamoeba dispar
LDALGKWSFLDSYVMILMIMAFY

SEQ ID NO: 2386358 - protein, 21 aa, Entamoeba dispar
LDARGMCVGEWEDPYANVDDG

SEQ ID NO: 2386359 - protein, 17 aa, Entamoeba dispar
LDCILRLIEDIIQYINR

SEQ ID NO: 2386360 - protein, 24 aa, Entamoeba dispar
LDCLLSEALVYFWVGENQKLYHIV

SEQ ID NO: 2386361 - protein, 28 aa, Entamoeba dispar
LDCLPIRKRYSCSLVYFNVDSKMSLFNE

SEQ ID NO: 2386362 - protein, 23 aa, Entamoeba dispar
LDDIKLILKEGSCNQMCSDHTPS

SEQ ID NO: 2386363 - protein, 26 aa, Entamoeba dispar
LDDSVMSDVLWSLSFIAESRAYDGFL

SEQ ID NO: 2386364 - protein, 21 aa, Entamoeba dispar
LDEFIAEILLVRKASDHTHNI

SEQ ID NO: 2386365 - protein, 24 aa, Entamoeba dispar
LDEMFIEFMNNYRRCLKESRKQQE

SEQ ID NO: 2386366 - protein, 19 aa, Entamoeba dispar
LDFSEKFFSFDMSEVTPSI

SEQ ID NO: 2386367 - protein, 18 aa, Entamoeba dispar
LDFVCVIVGLMASNLFCF

SEQ ID NO: 2386368 - protein, 20 aa, Entamoeba dispar
LDFYARALVNSFIPGTIAAL

SEQ ID NO: 2386369 - protein, 17 aa, Entamoeba dispar
LDGYRYCLVDYSIMDKI

SEQ ID NO: 2386370 - protein, 24 aa, Entamoeba dispar
LDIDSADVKLCYDFSNNSVVKPEN

SEQ ID NO: 2386371 - protein, 24 aa, Entamoeba dispar
LDIDSEHPADCTISAEELMILLEG

SEQ ID NO: 2386372 - protein, 23 aa, Entamoeba dispar
LDIFCIIQPQFLVRIKDNDGKIP

SEQ ID NO: 2386373 - protein, 19 aa, Entamoeba dispar
LDIIIKYILPLISNIPDIQ

SEQ ID NO: 2386374 - protein, 23 aa, Entamoeba dispar
LDIIKNFFGFQFKEEVKKKPEKD

SEQ ID NO: 2386375 - protein, 25 aa, Entamoeba dispar
LDILCTRIKLNSGIFNEEQFISIVE

SEQ ID NO: 2386376 - protein, 25 aa, Entamoeba dispar
LDILCTRIKLNSGIFNEEQFKYIIE

SEQ ID NO: 2386377 - protein, 25 aa, Entamoeba dispar
LDISIFIKNVEAFGVINEKKDRVFY

SEQ ID NO: 2386378 - protein, 17 aa, Entamoeba dispar
LDITRIGLFSKMCDTVK

SEQ ID NO: 2386379 - protein, 19 aa, Entamoeba dispar
LDIYHFFQASFKYNPVTVF

SEQ ID NO: 2386380 - protein, 23 aa, Entamoeba dispar
LDKELKNSCIINMMKNGLINNVI

SEQ ID NO: 2386381 - protein, 18 aa, Entamoeba dispar
LDKFRCEYIVQFYGACFI

SEQ ID NO: 2386382 - protein, 25 aa, Entamoeba dispar
LDKFRSEHIIHFYGAVFIPNKICMI

SEQ ID NO: 2386383 - protein, 18 aa, Entamoeba dispar
LDKIDLVDPFFAYITLKA

SEQ ID NO: 2386384 - protein, 29 aa, Entamoeba dispar
LDKIFQESKFRVVVFTTLQGMFSVLYRFI

SEQ ID NO: 2386385 - protein, 24 aa, Entamoeba dispar
LDKIRWRTLMELSTKWRQISEPND

SEQ ID NO: 2386386 - protein, 19 aa, Entamoeba dispar
LDKNGMCTRECPGDCLTCD

SEQ ID NO: 2386387 - protein, 19 aa, Entamoeba dispar
LDKYLKFGLAFILFILMSL

SEQ ID NO: 2386388 - protein, 17 aa, Entamoeba dispar
LDLFGYLSCKELHLKST

SEQ ID NO: 2386389 - protein, 17 aa, Entamoeba dispar
LDLIVSNPFKYQCIFQL

SEQ ID NO: 2386390 - protein, 19 aa, Entamoeba dispar
LDLPMKVLDMFGCSLPVLA

SEQ ID NO: 2386391 - protein, 25 aa, Entamoeba dispar
LDLSRYDFYDALSISLNGFILPNDN

SEQ ID NO: 2386392 - protein, 23 aa, Entamoeba dispar
LDLVTKYIIEWIGYIRYNDPEIY

SEQ ID NO: 2386393 - protein, 23 aa, Entamoeba dispar
LDNIKFGFKIAVYILSFTCPLFG

SEQ ID NO: 2386394 - protein, 37 aa, Entamoeba dispar
LDPFIKEIRIHYGICNGHNGMFCAIDNSFGICSSNEC

SEQ ID NO: 2386395 - protein, 17 aa, Entamoeba dispar
LDQLCWTAQWTSEDISL

SEQ ID NO: 2386396 - protein, 18 aa, Entamoeba dispar
LDRKGLIIIGVIFSILAV

SEQ ID NO: 2386397 - protein, 31 aa, Entamoeba dispar
LDRMIGMLYPTERRFSILKAQTTRLISTYLH

SEQ ID NO: 2386398 - protein, 21 aa, Entamoeba dispar
LDRRTVIHLFGLTILHTKKDD

SEQ ID NO: 2386399 - protein, 22 aa, Entamoeba dispar
LDSESFKNGWHIYSDNSNCSVI

SEQ ID NO: 2386400 - protein, 20 aa, Entamoeba dispar
LDSHCKRCSKEECYECEEGY

SEQ ID NO: 2386401 - protein, 18 aa, Entamoeba dispar
LDSLSMKSVIPAISSKSI

SEQ ID NO: 2386402 - protein, 19 aa, Entamoeba dispar
LDTAIQINVFDVCGETIIS

SEQ ID NO: 2386403 - protein, 17 aa, Entamoeba dispar
LDTELSSLVGEVYERSY

SEQ ID NO: 2386404 - protein, 27 aa, Entamoeba dispar
LDTLYSKELYLFWLFNVGNRKTKEDII

SEQ ID NO: 2386405 - protein, 17 aa, Entamoeba dispar
LDTPCMTDFVAVNLNSP

SEQ ID NO: 2386406 - protein, 27 aa, Entamoeba dispar
LDTRCTAINLYHCIKIISHFSGTEKSN

SEQ ID NO: 2386407 - protein, 18 aa, Entamoeba dispar
LDTTFKSVMVYVYHSSFN

SEQ ID NO: 2386408 - protein, 18 aa, Entamoeba dispar
LDVLPLPITPSWGRILEV

SEQ ID NO: 2386409 - protein, 25 aa, Entamoeba dispar
LDVLRIMKNIHSFVMKYHYNLYSQC

SEQ ID NO: 2386410 - protein, 17 aa, Entamoeba dispar
LDVPKTWYFAYIEIPIY

SEQ ID NO: 2386411 - protein, 18 aa, Entamoeba dispar
LDVPKTWYFAYIEIPIYI

SEQ ID NO: 2386412 - protein, 24 aa, Entamoeba dispar
LDVSYVSSMSWYILIFAGGRYIIR

SEQ ID NO: 2386413 - protein, 17 aa, Entamoeba dispar
LDYCSSLKNLEEIQDAP

SEQ ID NO: 2386414 - protein, 18 aa, Entamoeba dispar
LEACARRVISIVSPSLSY

SEQ ID NO: 2386415 - protein, 21 aa, Entamoeba dispar
LECLVICKQASIIHCDLKPEN

SEQ ID NO: 2386416 - protein, 22 aa, Entamoeba dispar
LECLVICKQASIIHCDLKPENV

SEQ ID NO: 2386417 - protein, 20 aa, Entamoeba dispar
LECVDRIAAEQAPIPITILI

SEQ ID NO: 2386418 - protein, 24 aa, Entamoeba dispar
LEEACGEKGAFFCHHSGFMLSCSN

SEQ ID NO: 2386419 - protein, 21 aa, Entamoeba dispar
LEECVECSFGYLYNSTSRICT

SEQ ID NO: 2386420 - protein, 20 aa, Entamoeba dispar
LEEKYPFLNFFFKNIPEMTV

SEQ ID NO: 2386421 - protein, 27 aa, Entamoeba dispar
LEEQWCYRKARRISCGIDSDILRFKQH

SEQ ID NO: 2386422 - protein, 20 aa, Entamoeba dispar
LEESRKFLSNVLAFLSSCIW

SEQ ID NO: 2386423 - protein, 18 aa, Entamoeba dispar
LEEVLKGKMETIFPLHGN

SEQ ID NO: 2386424 - protein, 17 aa, Entamoeba dispar
LEFISVLAESDHLYQIN

SEQ ID NO: 2386425 - protein, 18 aa, Entamoeba dispar
LEFSKWNLTSDGRFTPLK

SEQ ID NO: 2386426 - protein, 20 aa, Entamoeba dispar
LEFSLSYSILETFKHNYKYN

SEQ ID NO: 2386427 - protein, 32 aa, Entamoeba dispar
LEGFNGSSLIVKWAVYSAFSFCWNLVTQNGFS

SEQ ID NO: 2386428 - protein, 23 aa, Entamoeba dispar
LEGKGCNIETCRCNKNYIITEEQ

SEQ ID NO: 2386429 - protein, 22 aa, Entamoeba dispar
LEGKKIYFSKIFELKKVNVEVK

SEQ ID NO: 2386430 - protein, 20 aa, Entamoeba dispar
LEHSQWKCDIDVLIDSFELF

SEQ ID NO: 2386431 - protein, 17 aa, Entamoeba dispar
LEIEAVVPITVYSIEDS

SEQ ID NO: 2386432 - protein, 26 aa, Entamoeba dispar
LEIHKLCIVGTPVIAFKSYSVFLKWY

SEQ ID NO: 2386433 - protein, 17 aa, Entamoeba dispar
LEILKFIDIININPSID

SEQ ID NO: 2386434 - protein, 18 aa, Entamoeba dispar
LEISKCQSIILNLPSSLK

SEQ ID NO: 2386435 - protein, 18 aa, Entamoeba dispar
LEKIPLWLDVSPPTDECA

SEQ ID NO: 2386436 - protein, 35 aa, Entamoeba dispar
LEKLGWRATTSFEEGLKKTVEWYLEHRNNWERTDE

SEQ ID NO: 2386437 - protein, 23 aa, Entamoeba dispar
LEKLRSPCIVSFMGYCIDEETIC

SEQ ID NO: 2386438 - protein, 19 aa, Entamoeba dispar
LEKMFKIIYRDSYETTQKK

SEQ ID NO: 2386439 - protein, 19 aa, Entamoeba dispar
LEKPCICFHLSLRARIFGF

SEQ ID NO: 2386440 - protein, 24 aa, Entamoeba dispar
LEKRFCDCQKLYKLFGGTRNEMKH

SEQ ID NO: 2386441 - protein, 18 aa, Entamoeba dispar
LELCKDTWLSWGFDGTNI

SEQ ID NO: 2386442 - protein, 17 aa, Entamoeba dispar
LELDYRHAFKKVNNNST

SEQ ID NO: 2386443 - protein, 21 aa, Entamoeba dispar
LELKKKYVFQLFVGNKSLNIC

SEQ ID NO: 2386444 - protein, 18 aa, Entamoeba dispar
LELLNFSYNAPKCFMTRR

SEQ ID NO: 2386445 - protein, 23 aa, Entamoeba dispar
LELLSRRAQLFALKSELQNSGNL

SEQ ID NO: 2386446 - protein, 17 aa, Entamoeba dispar
LELLYCHNSYWIVLVCM

SEQ ID NO: 2386447 - protein, 19 aa, Entamoeba dispar
LEMRCSRCNSVIGIVQQKP

SEQ ID NO: 2386448 - protein, 17 aa, Entamoeba dispar
LEMSGILTIFVTGAVMS

SEQ ID NO: 2386449 - protein, 24 aa, Entamoeba dispar
LEMYPSRTGMIGGITGVMYDNCYL

SEQ ID NO: 2386450 - protein, 23 aa, Entamoeba dispar
LEMYPSRTGMIGGLTGVMYDNCY

SEQ ID NO: 2386451 - protein, 17 aa, Entamoeba dispar
LENGRITPLGKVMVALP

SEQ ID NO: 2386452 - protein, 17 aa, Entamoeba dispar
LENGVVCSIWFIIMSCL

SEQ ID NO: 2386453 - protein, 17 aa, Entamoeba dispar
LENLKFIHFTVHGTVAV

SEQ ID NO: 2386454 - protein, 20 aa, Entamoeba dispar
LENLNFSDCLLREMYRFTEG

SEQ ID NO: 2386455 - protein, 17 aa, Entamoeba dispar
LENYGKILFDESQSISN

SEQ ID NO: 2386456 - protein, 20 aa, Entamoeba dispar
LEPEEFVEYCFLFFGQQNHI

SEQ ID NO: 2386457 - protein, 17 aa, Entamoeba dispar
LEPFACELLALTAHHVE

SEQ ID NO: 2386458 - protein, 22 aa, Entamoeba dispar
LEPFSMIGGLLWATGNLTSVPI

SEQ ID NO: 2386459 - protein, 22 aa, Entamoeba dispar
LEPNTLVSYLFELSHVIASAFS

SEQ ID NO: 2386460 - protein, 19 aa, Entamoeba dispar
LEPYCSGNNCAFRSNCTDD

SEQ ID NO: 2386461 - protein, 26 aa, Entamoeba dispar
LEQTWKSGVMMLIIFIVLFTALSIWN

SEQ ID NO: 2386462 - protein, 17 aa, Entamoeba dispar
LEQYRCNAFTRNFDYVY

SEQ ID NO: 2386463 - protein, 23 aa, Entamoeba dispar
LEREPKINGALIMQEIGLNNQVI

SEQ ID NO: 2386464 - protein, 17 aa, Entamoeba dispar
LERGLRGVLDFFITQQM

SEQ ID NO: 2386465 - protein, 19 aa, Entamoeba dispar
LERITKIEGIFLYEIKQYK

SEQ ID NO: 2386466 - protein, 22 aa, Entamoeba dispar
LERKASDLASEWMISMRDATAL

SEQ ID NO: 2386467 - protein, 24 aa, Entamoeba dispar
LERRWSTRIFLQRHILINVVSLLL

SEQ ID NO: 2386468 - protein, 22 aa, Entamoeba dispar
LESFSCGSLAFKYSITKQPTNR

SEQ ID NO: 2386469 - protein, 19 aa, Entamoeba dispar
LESILSIPSSKSFERSESI

SEQ ID NO: 2386470 - protein, 21 aa, Entamoeba dispar
LESLFIFVLFLYYLITLICMS

SEQ ID NO: 2386471 - protein, 30 aa, Entamoeba dispar
LESNHCWLEILPFQFCLTVFTLGDYLILPL

SEQ ID NO: 2386472 - protein, 24 aa, Entamoeba dispar
LESPICKFALFFGNRISEEVELNY

SEQ ID NO: 2386473 - protein, 17 aa, Entamoeba dispar
LESTSKLFLGWFNSNEL

SEQ ID NO: 2386474 - protein, 18 aa, Entamoeba dispar
LESYRFNYEYDESIPREF

SEQ ID NO: 2386475 - protein, 24 aa, Entamoeba dispar
LETTLKIIVEECGISLKENKLNNK

SEQ ID NO: 2386476 - protein, 26 aa, Entamoeba dispar
LEVIFNFAGIFGFFLLFIIPGVLQIY

SEQ ID NO: 2386477 - protein, 18 aa, Entamoeba dispar
LEVNILFIFMEQYLFLIK

SEQ ID NO: 2386478 - protein, 26 aa, Entamoeba dispar
LEYCSKKGIVAHLFSAFRALYQANPK

SEQ ID NO: 2386479 - protein, 19 aa, Entamoeba dispar
LEYFIYILLFYTISFKLIG

SEQ ID NO: 2386480 - protein, 17 aa, Entamoeba dispar
LEYISLYIHLLMERLVT

SEQ ID NO: 2386481 - protein, 21 aa, Entamoeba dispar
LEYTSKIIINLVVACPHEELL

SEQ ID NO: 2386482 - protein, 19 aa, Entamoeba dispar
LEYYTLHIPYAFIIYYVLN

SEQ ID NO: 2386483 - protein, 18 aa, Entamoeba dispar
LFAASCCQMGIQFSYSAI

SEQ ID NO: 2386484 - protein, 20 aa, Entamoeba dispar
LFCDQLKLKSAEIIVYCSGF

SEQ ID NO: 2386485 - protein, 18 aa, Entamoeba dispar
LFCLFIVMWTFTFSLTCF

SEQ ID NO: 2386486 - protein, 20 aa, Entamoeba dispar
LFCVPTIASIIILTYIPMTM

SEQ ID NO: 2386487 - protein, 22 aa, Entamoeba dispar
LFDDQIKGILMKSLKTFDGKIY

SEQ ID NO: 2386488 - protein, 27 aa, Entamoeba dispar
LFDKEVVKLIVHFICITNDKLIGELLI

SEQ ID NO: 2386489 - protein, 25 aa, Entamoeba dispar
LFDLLIDILFEYGFIIFTSKMRNKV

SEQ ID NO: 2386490 - protein, 18 aa, Entamoeba dispar
LFDNKFLEDIKVFIQRLK

SEQ ID NO: 2386491 - protein, 19 aa, Entamoeba dispar
LFDVLLRFLHFIFPAKIIS

SEQ ID NO: 2386492 - protein, 17 aa, Entamoeba dispar
LFDVWIIMFLIRLDVPK

SEQ ID NO: 2386493 - protein, 18 aa, Entamoeba dispar
LFEAYTWDTPYPIEKFKY

SEQ ID NO: 2386494 - protein, 19 aa, Entamoeba dispar
LFEQLKIQGVVFYDSNSTH

SEQ ID NO: 2386495 - protein, 19 aa, Entamoeba dispar
LFEYFILNDQFRIWCIWCI

SEQ ID NO: 2386496 - protein, 18 aa, Entamoeba dispar
LFEYPWQIAEFVVSGKRL

SEQ ID NO: 2386497 - protein, 20 aa, Entamoeba dispar
LFFEWKNSWQTTKLALQALM

SEQ ID NO: 2386498 - protein, 24 aa, Entamoeba dispar
LFFLLEAYNSFSLTILSILILVII

SEQ ID NO: 2386499 - protein, 18 aa, Entamoeba dispar
LFFLTPFTLLVAIACVIQ

SEQ ID NO: 2386500 - protein, 17 aa, Entamoeba dispar
LFFRFFKKHKEELTNGK

SEQ ID NO: 2386501 - protein, 23 aa, Entamoeba dispar
LFFTSFMFCTSFTKTSIILCILN

SEQ ID NO: 2386502 - protein, 25 aa, Entamoeba dispar
LFFVCKEYGKSMVMVTVGNKIGKTH

SEQ ID NO: 2386503 - protein, 24 aa, Entamoeba dispar
LFFVICFWIMFVITIAVIVVLAVI

SEQ ID NO: 2386504 - protein, 24 aa, Entamoeba dispar
LFFVICFWIMFVVDIIVLVGLAVI

SEQ ID NO: 2386505 - protein, 24 aa, Entamoeba dispar
LFFVVCFWIMFVVAILVIIILVVL

SEQ ID NO: 2386506 - protein, 18 aa, Entamoeba dispar
LFGSKAFPSTAYDLVRIA

SEQ ID NO: 2386507 - protein, 17 aa, Entamoeba dispar
LFGTTGMSHLLVLVIGG

SEQ ID NO: 2386508 - protein, 18 aa, Entamoeba dispar
LFGYLSCKELHLKSTTRI

SEQ ID NO: 2386509 - protein, 17 aa, Entamoeba dispar
LFHTASWIGLNCNNNIT

SEQ ID NO: 2386510 - protein, 23 aa, Entamoeba dispar
LFHYIAELVIKFSEYALEQQTQI

SEQ ID NO: 2386511 - protein, 19 aa, Entamoeba dispar
LFICVPITLFTAGYQRKMR

SEQ ID NO: 2386512 - protein, 18 aa, Entamoeba dispar
LFIGIIVYISLFKITFLK

SEQ ID NO: 2386513 - protein, 18 aa, Entamoeba dispar
LFIHQWKENSQTIKINQK

SEQ ID NO: 2386514 - protein, 26 aa, Entamoeba dispar
LFIIGIWIWYLRRPYPVYLVSFATSI

SEQ ID NO: 2386515 - protein, 21 aa, Entamoeba dispar
LFIIHICFFDYGYINNYVDEI

SEQ ID NO: 2386516 - protein, 19 aa, Entamoeba dispar
LFILFIICLGFMTKDAHGI

SEQ ID NO: 2386517 - protein, 17 aa, Entamoeba dispar
LFINIILRTNIVIEKSY

SEQ ID NO: 2386518 - protein, 25 aa, Entamoeba dispar
LFIQHEVYKVYSLVLVHQQSLSKFD

SEQ ID NO: 2386519 - protein, 25 aa, Entamoeba dispar
LFIQKGKRALAWTSLIHDDFEYFPC

SEQ ID NO: 2386520 - protein, 28 aa, Entamoeba dispar
LFISFPLDFIGEYLLMFNSFPDKHAFIF

SEQ ID NO: 2386521 - protein, 18 aa, Entamoeba dispar
LFISQGLPNIRNERRPLI

SEQ ID NO: 2386522 - protein, 17 aa, Entamoeba dispar
LFISVAFFITKLWYFHT

SEQ ID NO: 2386523 - protein, 19 aa, Entamoeba dispar
LFIVYIVHVYLVRKRNLKV

SEQ ID NO: 2386524 - protein, 23 aa, Entamoeba dispar
LFIYTGVIKLNFFGIENNEQNEN

SEQ ID NO: 2386525 - protein, 22 aa, Entamoeba dispar
LFKEAAEAFGRAVSIKQDFVDG

SEQ ID NO: 2386526 - protein, 19 aa, Entamoeba dispar
LFKETILLYLGYIKGLPGT

SEQ ID NO: 2386527 - protein, 19 aa, Entamoeba dispar
LFKHPRPPLSQNINEGFPS

SEQ ID NO: 2386528 - protein, 17 aa, Entamoeba dispar
LFLCLSSLFLFLLYFSI

SEQ ID NO: 2386529 - protein, 17 aa, Entamoeba dispar
LFLCSLFLMSFLFLVSL

SEQ ID NO: 2386530 - protein, 18 aa, Entamoeba dispar
LFLFKLYHNYILFCSTRH

SEQ ID NO: 2386531 - protein, 17 aa, Entamoeba dispar
LFLFLLISIIYLFFYLI

SEQ ID NO: 2386532 - protein, 23 aa, Entamoeba dispar
LFLFSFSLFFLCYPEYISQHTFV

SEQ ID NO: 2386533 - protein, 18 aa, Entamoeba dispar
LFLHLCFDVLTLKATDSK

SEQ ID NO: 2386534 - protein, 18 aa, Entamoeba dispar
LFLIPTFFTVFIFFISCC

SEQ ID NO: 2386535 - protein, 30 aa, Entamoeba dispar
LFLLFIKEYISLFSSMNWTIHDSIIISILN

SEQ ID NO: 2386536 - protein, 18 aa, Entamoeba dispar
LFLLFLICFYLFLYPLIN

SEQ ID NO: 2386537 - protein, 17 aa, Entamoeba dispar
LFLLFTVFSYAFCLQEA

SEQ ID NO: 2386538 - protein, 20 aa, Entamoeba dispar
LFLLYCGRYISFLNAPCAYI

SEQ ID NO: 2386539 - protein, 22 aa, Entamoeba dispar
LFLVIRNVFGINIFEVHQVFLP

SEQ ID NO: 2386540 - protein, 20 aa, Entamoeba dispar
LFMENFFKSLQRIIVKNVEL

SEQ ID NO: 2386541 - protein, 20 aa, Entamoeba dispar
LFMPIVKLVNAIAFRPLAVS

SEQ ID NO: 2386542 - protein, 24 aa, Entamoeba dispar
LFMTSILGFIGFFICSVIALIQGK

SEQ ID NO: 2386543 - protein, 22 aa, Entamoeba dispar
LFNDPFVALGFYANYISIEYVD

SEQ ID NO: 2386544 - protein, 17 aa, Entamoeba dispar
LFNEGIQSIRFVDEAQA

SEQ ID NO: 2386545 - protein, 22 aa, Entamoeba dispar
LFNFASYFYWLVVPLKCVDMGG

SEQ ID NO: 2386546 - protein, 25 aa, Entamoeba dispar
LFNIPRFPYPLSYIPLMKEVTINQG

SEQ ID NO: 2386547 - protein, 25 aa, Entamoeba dispar
LFNKPRLLVYLNMSLVIYQFSRLLL

SEQ ID NO: 2386548 - protein, 19 aa, Entamoeba dispar
LFNLALPCVIFRNLYNNKT

SEQ ID NO: 2386549 - protein, 19 aa, Entamoeba dispar
LFNTLFCHWNHYVRMFFQE

SEQ ID NO: 2386550 - protein, 23 aa, Entamoeba dispar
LFNVCKLCKLLINDTEKEIVYGL

SEQ ID NO: 2386551 - protein, 21 aa, Entamoeba dispar
LFQCIPLIYTFSISRPLYENG

SEQ ID NO: 2386552 - protein, 20 aa, Entamoeba dispar
LFQNCPYNGMRVSLEQLTGN

SEQ ID NO: 2386553 - protein, 20 aa, Entamoeba dispar
LFRHEDWMPSALFGVGKSDL

SEQ ID NO: 2386554 - protein, 21 aa, Entamoeba dispar
LFRYEDWMPSALFGKGKQDLE

SEQ ID NO: 2386555 - protein, 18 aa, Entamoeba dispar
LFSDDLFWIIVGCVGGFL

SEQ ID NO: 2386556 - protein, 17 aa, Entamoeba dispar
LFSFHVISLLVLPIVLY

SEQ ID NO: 2386557 - protein, 20 aa, Entamoeba dispar
LFSFSSRFSFKFLSYRMSLQ

SEQ ID NO: 2386558 - protein, 26 aa, Entamoeba dispar
LFSKEFVGILCCFNYSIIAVGAAMML

SEQ ID NO: 2386559 - protein, 21 aa, Entamoeba dispar
LFSKEFVGILCCFSYSIIAVG

SEQ ID NO: 2386560 - protein, 24 aa, Entamoeba dispar
LFSKRYLQCNIKYKDILTEEKVEQ

SEQ ID NO: 2386561 - protein, 24 aa, Entamoeba dispar
LFSRLKSTFPKYSIPFINSLIQDD

SEQ ID NO: 2386562 - protein, 31 aa, Entamoeba dispar
LFSSFCFLIYLLIPCFFFFLFLFHYLSSSLL

SEQ ID NO: 2386563 - protein, 21 aa, Entamoeba dispar
LFSSICFGYYCLKEQKNDIIL

SEQ ID NO: 2386564 - protein, 24 aa, Entamoeba dispar
LFSTCLDCAVYPTLFVSYVSQKFI

SEQ ID NO: 2386565 - protein, 25 aa, Entamoeba dispar
LFSTHYLNRFDIILQHYCEVVDDPI

SEQ ID NO: 2386566 - protein, 18 aa, Entamoeba dispar
LFTDLRSVIITSKDCETV

SEQ ID NO: 2386567 - protein, 26 aa, Entamoeba dispar
LFTIFGGTCAFLFTKYVSPTANGSGV

SEQ ID NO: 2386568 - protein, 19 aa, Entamoeba dispar
LFTMKFNGNYSIRIDSSNN

SEQ ID NO: 2386569 - protein, 25 aa, Entamoeba dispar
LFTSELFRKIKLVEFFKSTSNATKN

SEQ ID NO: 2386570 - protein, 23 aa, Entamoeba dispar
LFVELKFIVIFIFDYCFNEENKN

SEQ ID NO: 2386571 - protein, 17 aa, Entamoeba dispar
LFWIIVGCVGGFLVIGI

SEQ ID NO: 2386572 - protein, 17 aa, Entamoeba dispar
LFYFIAVTIVGCLAVFI

SEQ ID NO: 2386573 - protein, 22 aa, Entamoeba dispar
LFYLVPCFEMYIYVNSSETFKE

SEQ ID NO: 2386574 - protein, 19 aa, Entamoeba dispar
LFYYFLINLAFMFVEVAYG

SEQ ID NO: 2386575 - protein, 17 aa, Entamoeba dispar
LGAGIGAIINVVGTVIG

SEQ ID NO: 2386576 - protein, 17 aa, Entamoeba dispar
LGCCLASVWTPFQKKSS

SEQ ID NO: 2386577 - protein, 18 aa, Entamoeba dispar
LGCFRCEDGFFLDLKGYC

SEQ ID NO: 2386578 - protein, 17 aa, Entamoeba dispar
LGCFSVVLSAIFLSHQN

SEQ ID NO: 2386579 - protein, 17 aa, Entamoeba dispar
LGCMMFFIMSSNALGSW

SEQ ID NO: 2386580 - protein, 18 aa, Entamoeba dispar
LGCVICLIFTVVVNLTIT

SEQ ID NO: 2386581 - protein, 21 aa, Entamoeba dispar
LGELLSLIFGNFFAIIVDICN

SEQ ID NO: 2386582 - protein, 26 aa, Entamoeba dispar
LGEQIFNFFVNMSHYMFRASVDEISF

SEQ ID NO: 2386583 - protein, 23 aa, Entamoeba dispar
LGFIIAKICSLNFETTLRNVLLP

SEQ ID NO: 2386584 - protein, 21 aa, Entamoeba dispar
LGFKGSLQFASPNQHLGKKYI

SEQ ID NO: 2386585 - protein, 18 aa, Entamoeba dispar
LGGYLFGLIIKYFTNIIE

SEQ ID NO: 2386586 - protein, 25 aa, Entamoeba dispar
LGGYMRISFFETFEWNYNYNETIPR

SEQ ID NO: 2386587 - protein, 39 aa, Entamoeba dispar
LGHFPKHIIPFVFSWPSCSNPFLYCCAANVSSDNAVHRD

SEQ ID NO: 2386588 - protein, 22 aa, Entamoeba dispar
LGIDTLWCFFIGTSVFYSFTIS

SEQ ID NO: 2386589 - protein, 19 aa, Entamoeba dispar
LGIFFEWHIPLKYLWPSIR

SEQ ID NO: 2386590 - protein, 25 aa, Entamoeba dispar
LGIFMPPLFILSFLFSRKSNKKSIR

SEQ ID NO: 2386591 - protein, 21 aa, Entamoeba dispar
LGKFNAIEPFYGFMQMMVDWK

SEQ ID NO: 2386592 - protein, 18 aa, Entamoeba dispar
LGKMLSFSAGVMIYVSFV

SEQ ID NO: 2386593 - protein, 24 aa, Entamoeba dispar
LGLFPPLFFGTSMSGFTKRYDYGL

SEQ ID NO: 2386594 - protein, 29 aa, Entamoeba dispar
LGLICILFLRIFLYYCHIDTSDLFTNFYT

SEQ ID NO: 2386595 - protein, 21 aa, Entamoeba dispar
LGLTVLCWGNSVGDFVSNVIV

SEQ ID NO: 2386596 - protein, 23 aa, Entamoeba dispar
LGMSATRSKIAWIEFPYECGLIQ

SEQ ID NO: 2386597 - protein, 26 aa, Entamoeba dispar
LGNLMVTLGLFLPVAVFNFSTSNRII

SEQ ID NO: 2386598 - protein, 18 aa, Entamoeba dispar
LGPLKITFPLVIITLLST

SEQ ID NO: 2386599 - protein, 26 aa, Entamoeba dispar
LGPPIYVAGCGLLFGTLAIIIALNGN

SEQ ID NO: 2386600 - protein, 18 aa, Entamoeba dispar
LGPSLLVPIGLIILTFLQ

SEQ ID NO: 2386601 - protein, 25 aa, Entamoeba dispar
LGPTEFVFPTAMFFTITSFYISLDG

SEQ ID NO: 2386602 - protein, 28 aa, Entamoeba dispar
LGPVSLRLKYYGGFTICVIILYLCLLIA

SEQ ID NO: 2386603 - protein, 17 aa, Entamoeba dispar
LGQRPPLINSIPFPCKE

SEQ ID NO: 2386604 - protein, 26 aa, Entamoeba dispar
LGRIYCTVYILAFFFIFPMRLGQIIT

SEQ ID NO: 2386605 - protein, 17 aa, Entamoeba dispar
LGSIVLCCFIYIGIALV

SEQ ID NO: 2386606 - protein, 20 aa, Entamoeba dispar
LGTLPFKLFEKLSYRSLMLW

SEQ ID NO: 2386607 - protein, 23 aa, Entamoeba dispar
LGVICGLFAVLFVMSVSTIFKTR

SEQ ID NO: 2386608 - protein, 18 aa, Entamoeba dispar
LGVLVLMQYVLQGLFHPA

SEQ ID NO: 2386609 - protein, 27 aa, Entamoeba dispar
LGYAVSLCIIFGFSLLAIKRFNRKNYG

SEQ ID NO: 2386610 - protein, 30 aa, Entamoeba dispar
LHALEFIHKYSLKYSDWLSIDSHITVRYLF

SEQ ID NO: 2386611 - protein, 23 aa, Entamoeba dispar
LHDFDFFIVYFLYTFFSFICYII

SEQ ID NO: 2386612 - protein, 25 aa, Entamoeba dispar
LHFEKVTPIRPWRHDHVARFQYQCY

SEQ ID NO: 2386613 - protein, 17 aa, Entamoeba dispar
LHFGVLAKLCLAETFSI

SEQ ID NO: 2386614 - protein, 26 aa, Entamoeba dispar
LHFLNIFMCCCGILIISIIASVYKRK

SEQ ID NO: 2386615 - protein, 19 aa, Entamoeba dispar
LHGSFNWSIITLIVPSAVG

SEQ ID NO: 2386616 - protein, 23 aa, Entamoeba dispar
LHHCKPPILHRDLKTNNLLVNDN

SEQ ID NO: 2386617 - protein, 24 aa, Entamoeba dispar
LHIFSESIVSLFIGIAIGLILLAL

SEQ ID NO: 2386618 - protein, 20 aa, Entamoeba dispar
LHKHHIRFTKIGRIANGEHY

SEQ ID NO: 2386619 - protein, 19 aa, Entamoeba dispar
LHKISGWLFGIFAIIHSFC

SEQ ID NO: 2386620 - protein, 20 aa, Entamoeba dispar
LHLECAFDFLELENQHNSMR

SEQ ID NO: 2386621 - protein, 18 aa, Entamoeba dispar
LHLFLDFYSFNIPSFGYF

SEQ ID NO: 2386622 - protein, 23 aa, Entamoeba dispar
LHLLNLYIPFIILLVYTLFFYII

SEQ ID NO: 2386623 - protein, 25 aa, Entamoeba dispar
LHLPISQLHPIQFIPKVYSIKIKMP

SEQ ID NO: 2386624 - protein, 35 aa, Entamoeba dispar
LHLVLTVACLVSFIFCIKMFNTPFLTYRLTPNWYQ

SEQ ID NO: 2386625 - protein, 24 aa, Entamoeba dispar
LHNCKYNDFFQWFIKNMKDALQNL

SEQ ID NO: 2386626 - protein, 18 aa, Entamoeba dispar
LHPGLGLGVSGRRSLLLK

SEQ ID NO: 2386627 - protein, 18 aa, Entamoeba dispar
LHQNCISTFIGTECKGYF

SEQ ID NO: 2386628 - protein, 19 aa, Entamoeba dispar
LHRLKRTFKAVSHDVQEKF

SEQ ID NO: 2386629 - protein, 19 aa, Entamoeba dispar
LHRPYKFGCNFTLAVLYAT

SEQ ID NO: 2386630 - protein, 20 aa, Entamoeba dispar
LHSFPNYSIVIFTADTSPKD

SEQ ID NO: 2386631 - protein, 21 aa, Entamoeba dispar
LHSRIPPIIHRDLKSSNLLVD

SEQ ID NO: 2386632 - protein, 24 aa, Entamoeba dispar
LHSSIPIQFTLSFPSSDYSFPSTI

SEQ ID NO: 2386633 - protein, 17 aa, Entamoeba dispar
LHSSVFFETPLKTIATE

SEQ ID NO: 2386634 - protein, 19 aa, Entamoeba dispar
LHTINCIMYSYPTIFEFTP

SEQ ID NO: 2386635 - protein, 19 aa, Entamoeba dispar
LHVAGEVFAENGFLQRSDR

SEQ ID NO: 2386636 - protein, 18 aa, Entamoeba dispar
LHVQFPFSNSSILVNSFK

SEQ ID NO: 2386637 - protein, 21 aa, Entamoeba dispar
LHWYYTRSVLFILCLCNEATF

SEQ ID NO: 2386638 - protein, 18 aa, Entamoeba dispar
LHYFLKFLAQNIEYKHYL

SEQ ID NO: 2386639 - protein, 17 aa, Entamoeba dispar
LIACIYLVFSNKFLLPS

SEQ ID NO: 2386640 - protein, 26 aa, Entamoeba dispar
LIALAFPLMLQYVIKWINNPQGTLKI

SEQ ID NO: 2386641 - protein, 25 aa, Entamoeba dispar
LIALFCYDIFWVFGSEVMMTVATHV

SEQ ID NO: 2386642 - protein, 25 aa, Entamoeba dispar
LIASALAYISCYVFYSSDTSKHLEI

SEQ ID NO: 2386643 - protein, 20 aa, Entamoeba dispar
LICAFKCSCKQSISKLGKLY

SEQ ID NO: 2386644 - protein, 18 aa, Entamoeba dispar
LICHLIRDILTPESMQSF

SEQ ID NO: 2386645 - protein, 18 aa, Entamoeba dispar
LICILIIGALFVIVYGGF

SEQ ID NO: 2386646 - protein, 18 aa, Entamoeba dispar
LICKYCHIDHLPISTNGI

SEQ ID NO: 2386647 - protein, 21 aa, Entamoeba dispar
LICSLIVINLMYYRYSMNKNI

SEQ ID NO: 2386648 - protein, 19 aa, Entamoeba dispar
LICVCMGPIYSVITCIVAY

SEQ ID NO: 2386649 - protein, 21 aa, Entamoeba dispar
LIDLCCYCFVSYTLSLNHLVM

SEQ ID NO: 2386650 - protein, 19 aa, Entamoeba dispar
LIDMVMDWYAFGGKMDIIG

SEQ ID NO: 2386651 - protein, 26 aa, Entamoeba dispar
LIDSVISFILSISWSSVLYLIQDLGL

SEQ ID NO: 2386652 - protein, 17 aa, Entamoeba dispar
LIDTVFFVAPYVLYIDI

SEQ ID NO: 2386653 - protein, 24 aa, Entamoeba dispar
LIECKTSDCYIELQTESSVTSETI

SEQ ID NO: 2386654 - protein, 18 aa, Entamoeba dispar
LIEGVSLLVRSVRTGMRY

SEQ ID NO: 2386655 - protein, 17 aa, Entamoeba dispar
LIEITGFKTNLSIDNLY

SEQ ID NO: 2386656 - protein, 27 aa, Entamoeba dispar
LIELLKETLAFDVIEKFAQLLSLEMTE

SEQ ID NO: 2386657 - protein, 19 aa, Entamoeba dispar
LIETYSFTIVETIKTHQIR

SEQ ID NO: 2386658 - protein, 22 aa, Entamoeba dispar
LIFCFAGWYYLVHHQRVSDLEL

SEQ ID NO: 2386659 - protein, 24 aa, Entamoeba dispar
LIFFFSACFSIIFFYCKNRFGWFV

SEQ ID NO: 2386660 - protein, 27 aa, Entamoeba dispar
LIFFPTHLKMVFKYIFSLEITSELELP

SEQ ID NO: 2386661 - protein, 19 aa, Entamoeba dispar
LIFFVCLFLIMGTGSTIIS

SEQ ID NO: 2386662 - protein, 19 aa, Entamoeba dispar
LIFIINIYISFIFSTQSFL

SEQ ID NO: 2386663 - protein, 17 aa, Entamoeba dispar
LIFKDKFINDMQEYQIL

SEQ ID NO: 2386664 - protein, 25 aa, Entamoeba dispar
LIFLHKIMNLSFCVVSTTLFGFLVI

SEQ ID NO: 2386665 - protein, 22 aa, Entamoeba dispar
LIFLPRYLKRGIATIPDFLEER

SEQ ID NO: 2386666 - protein, 21 aa, Entamoeba dispar
LIFNSILKFFGVRDHNKLTTA

SEQ ID NO: 2386667 - protein, 23 aa, Entamoeba dispar
LIFNSILKFFGVRDHNKLTTAQK

SEQ ID NO: 2386668 - protein, 31 aa, Entamoeba dispar
LIFPICVIGVTIFFKCCLYLYCRTVNNPSAS

SEQ ID NO: 2386669 - protein, 19 aa, Entamoeba dispar
LIFPLLGARYFIYKKNGWQ

SEQ ID NO: 2386670 - protein, 18 aa, Entamoeba dispar
LIFQSYHFLYVFLNLSSN

SEQ ID NO: 2386671 - protein, 17 aa, Entamoeba dispar
LIFQVLFLFLAICLFVF

SEQ ID NO: 2386672 - protein, 19 aa, Entamoeba dispar
LIFREDWITVGKEKKPKKV

SEQ ID NO: 2386673 - protein, 19 aa, Entamoeba dispar
LIFSCLFSSIITIIIPIIF

SEQ ID NO: 2386674 - protein, 23 aa, Entamoeba dispar
LIGCIGLGAVVIFSSMRISSVSP

SEQ ID NO: 2386675 - protein, 22 aa, Entamoeba dispar
LIGFWILFKRCCRLSKHKSVME

SEQ ID NO: 2386676 - protein, 17 aa, Entamoeba dispar
LIGIFFALLTYCSKFKS

SEQ ID NO: 2386677 - protein, 20 aa, Entamoeba dispar
LIHCCLDCILRLIEDIIQYI

SEQ ID NO: 2386678 - protein, 17 aa, Entamoeba dispar
LIHCILSVYGFTLIAPT

SEQ ID NO: 2386679 - protein, 31 aa, Entamoeba dispar
LIHFEARSGFAVEYIRCWGEYIRKEIISNIK

SEQ ID NO: 2386680 - protein, 17 aa, Entamoeba dispar
LIHLCKWGWSNWSIHGV

SEQ ID NO: 2386681 - protein, 22 aa, Entamoeba dispar
LIHLLLMIEFVFINPTKTQEGR

SEQ ID NO: 2386682 - protein, 25 aa, Entamoeba dispar
LIHSFKPLFVLISFSIFGDNSYVPL

SEQ ID NO: 2386683 - protein, 20 aa, Entamoeba dispar
LIIEPLEFANYVLTVIISVL

SEQ ID NO: 2386684 - protein, 17 aa, Entamoeba dispar
LIIFFYFSLSYSFTQNF

SEQ ID NO: 2386685 - protein, 24 aa, Entamoeba dispar
LIIFNTRSSYVFEKGLCIIQNILA

SEQ ID NO: 2386686 - protein, 17 aa, Entamoeba dispar
LIIHIGLLIIPFFHNLL

SEQ ID NO: 2386687 - protein, 17 aa, Entamoeba dispar
LIIICVIVLLIIIIVII

SEQ ID NO: 2386688 - protein, 26 aa, Entamoeba dispar
LIIMIPFCVFIYRFEWTLDNNQVVPL

SEQ ID NO: 2386689 - protein, 17 aa, Entamoeba dispar
LIIRYCLGIPVKPFRLF

SEQ ID NO: 2386690 - protein, 20 aa, Entamoeba dispar
LIITEVIPFLVLAIGVDNIF

SEQ ID NO: 2386691 - protein, 17 aa, Entamoeba dispar
LIITGFFIGLLYHRLNK

SEQ ID NO: 2386692 - protein, 19 aa, Entamoeba dispar
LIIVCRMLMIILVLMSYPA

SEQ ID NO: 2386693 - protein, 17 aa, Entamoeba dispar
LIIVCRMLMIIVVVISY

SEQ ID NO: 2386694 - protein, 20 aa, Entamoeba dispar
LIIVCVGVLIIPLIIIVYFF

SEQ ID NO: 2386695 - protein, 24 aa, Entamoeba dispar
LIIVTRTSFFWGRVYKKKERLMLF

SEQ ID NO: 2386696 - protein, 18 aa, Entamoeba dispar
LIIWKSDYIHLYKDKEFI

SEQ ID NO: 2386697 - protein, 18 aa, Entamoeba dispar
LIKNCTKCLSNGKCSECT

SEQ ID NO: 2386698 - protein, 23 aa, Entamoeba dispar
LIKSKFKPLIPVLTLKSEIDCSV

SEQ ID NO: 2386699 - protein, 21 aa, Entamoeba dispar
LILCFVGWYFLIKNQSISSLE

SEQ ID NO: 2386700 - protein, 17 aa, Entamoeba dispar
LILFLQYYIHQHHDPFF

SEQ ID NO: 2386701 - protein, 21 aa, Entamoeba dispar
LILFQKEFIGFDAFISGQTLL

SEQ ID NO: 2386702 - protein, 23 aa, Entamoeba dispar
LILLIIGLYCDMVLPRKYGTPES

SEQ ID NO: 2386703 - protein, 18 aa, Entamoeba dispar
LILLKMTLAPSFRINGGL

SEQ ID NO: 2386704 - protein, 17 aa, Entamoeba dispar
LILQKCKDLLVNDVKIF

SEQ ID NO: 2386705 - protein, 17 aa, Entamoeba dispar
LILRKYLKRRYETQQWI

SEQ ID NO: 2386706 - protein, 21 aa, Entamoeba dispar
LILYLKRKKILVLVALGPSLL

SEQ ID NO: 2386707 - protein, 34 aa, Entamoeba dispar
LINECLKPTLPVSDLFKLRVFYQAYIIYKKVGDK

SEQ ID NO: 2386708 - protein, 21 aa, Entamoeba dispar
LINFKWCYKVSPSVNEYGYPL

SEQ ID NO: 2386709 - protein, 18 aa, Entamoeba dispar
LINIFILKKNESVDIHSF

SEQ ID NO: 2386710 - protein, 18 aa, Entamoeba dispar
LINILSSFHCCQNQQIEL

SEQ ID NO: 2386711 - protein, 26 aa, Entamoeba dispar
LINPPVLRIKVFEPLFIVGKENYAKL

SEQ ID NO: 2386712 - protein, 17 aa, Entamoeba dispar
LIPEFFYLPDFLINENS

SEQ ID NO: 2386713 - protein, 23 aa, Entamoeba dispar
LIPEGYKGTVYFMTCATGTEIPT

SEQ ID NO: 2386714 - protein, 20 aa, Entamoeba dispar
LIPFVPILLRKGDSISPLDQ

SEQ ID NO: 2386715 - protein, 25 aa, Entamoeba dispar
LIPIFKVGMTFTYFAPLVFVVCLAI

SEQ ID NO: 2386716 - protein, 26 aa, Entamoeba dispar
LIPIILDVCGFYKIIQFSFLSVAALV

SEQ ID NO: 2386717 - protein, 20 aa, Entamoeba dispar
LIPKDVFKGVSVDVPQKIID

SEQ ID NO: 2386718 - protein, 26 aa, Entamoeba dispar
LIPLLLDIRLWRGVEYLFEYYIKQII

SEQ ID NO: 2386719 - protein, 18 aa, Entamoeba dispar
LIPPRDHSPLGFDDTSLS

SEQ ID NO: 2386720 - protein, 19 aa, Entamoeba dispar
LIPSFEVLIQFILQKCSYF

SEQ ID NO: 2386721 - protein, 17 aa, Entamoeba dispar
LIPTLLMFFAISKLLGF

SEQ ID NO: 2386722 - protein, 18 aa, Entamoeba dispar
LIQGCKSTTVLEPLYSGS

SEQ ID NO: 2386723 - protein, 19 aa, Entamoeba dispar
LIQHPNWFILVSLTRFMIL

SEQ ID NO: 2386724 - protein, 26 aa, Entamoeba dispar
LIQLSIYRSMIAFKLDATEVGQNLLT

SEQ ID NO: 2386725 - protein, 17 aa, Entamoeba dispar
LIQQKGIYETIIYEVII

SEQ ID NO: 2386726 - protein, 23 aa, Entamoeba dispar
LIRESTKIIGLIMGFCFVYYTNQ

SEQ ID NO: 2386727 - protein, 23 aa, Entamoeba dispar
LISCFSIIMSFNLCWMVHSKLSH

SEQ ID NO: 2386728 - protein, 17 aa, Entamoeba dispar
LISFCCSTLNKENVQHI

SEQ ID NO: 2386729 - protein, 25 aa, Entamoeba dispar
LISGLCLIIIPLASLTKFTFFNISS

SEQ ID NO: 2386730 - protein, 22 aa, Entamoeba dispar
LISMICLTGFLFINNGYILCIL

SEQ ID NO: 2386731 - protein, 23 aa, Entamoeba dispar
LISMLCAFLPSLSPVKNEWSIFY

SEQ ID NO: 2386732 - protein, 18 aa, Entamoeba dispar
LISNEKYEGLKISEDQIR

SEQ ID NO: 2386733 - protein, 18 aa, Entamoeba dispar
LISPMCSPEHWLFSQKNV

SEQ ID NO: 2386734 - protein, 26 aa, Entamoeba dispar
LISSLCAVLICLLLSVFKNSFILTLL

SEQ ID NO: 2386735 - protein, 23 aa, Entamoeba dispar
LISSSFPWLVFIYLIKPVLSISS

SEQ ID NO: 2386736 - protein, 26 aa, Entamoeba dispar
LITCAFQSIIMAFRVIFTTALTLTWV

SEQ ID NO: 2386737 - protein, 21 aa, Entamoeba dispar
LITKEFYAVFIAFTLFCLISV

SEQ ID NO: 2386738 - protein, 19 aa, Entamoeba dispar
LITKFIFKLIFQVLFLFLA

SEQ ID NO: 2386739 - protein, 18 aa, Entamoeba dispar
LITKSKRSSKRMLAYFPI

SEQ ID NO: 2386740 - protein, 17 aa, Entamoeba dispar
LITVFSLYVLSIIILPI

SEQ ID NO: 2386741 - protein, 20 aa, Entamoeba dispar
LIVAVPLSYFFQRFQMKMNI

SEQ ID NO: 2386742 - protein, 18 aa, Entamoeba dispar
LIVFTIFIIISFPLINLN

SEQ ID NO: 2386743 - protein, 17 aa, Entamoeba dispar
LIVMVAFVVFPRMPRNR

SEQ ID NO: 2386744 - protein, 18 aa, Entamoeba dispar
LIVNCINILLTIHSIILT

SEQ ID NO: 2386745 - protein, 17 aa, Entamoeba dispar
LIVPKSFTSGILKLYDF

SEQ ID NO: 2386746 - protein, 21 aa, Entamoeba dispar
LIVSNPFKYQCIFQLEANVLK

SEQ ID NO: 2386747 - protein, 17 aa, Entamoeba dispar
LIVVIFLIVVGSILLPI

SEQ ID NO: 2386748 - protein, 31 aa, Entamoeba dispar
LIYKSNVLKIYFEMAFNWKATQIDLMSQLIV

SEQ ID NO: 2386749 - protein, 25 aa, Entamoeba dispar
LIYLCYSFKCSPGCIGGCEADNTCR

SEQ ID NO: 2386750 - protein, 19 aa, Entamoeba dispar
LIYYFYKDVSILFCVPTIA

SEQ ID NO: 2386751 - protein, 20 aa, Entamoeba dispar
LKASLSAWGNFQILANSHTV

SEQ ID NO: 2386752 - protein, 29 aa, Entamoeba dispar
LKCICVFVCFQFMYMLAFIFFTFMNIKKD

SEQ ID NO: 2386753 - protein, 20 aa, Entamoeba dispar
LKCLPFFSILLIVYSLIFES

SEQ ID NO: 2386754 - protein, 20 aa, Entamoeba dispar
LKCQVMRCFEMDYGDYNYFL

SEQ ID NO: 2386755 - protein, 17 aa, Entamoeba dispar
LKCSNGYKIQNNQCIGD

SEQ ID NO: 2386756 - protein, 17 aa, Entamoeba dispar
LKCSNGYKIQNNQCNGD

SEQ ID NO: 2386757 - protein, 20 aa, Entamoeba dispar
LKCSNGYKIYINNGKCSNKE

SEQ ID NO: 2386758 - protein, 23 aa, Entamoeba dispar
LKCTDCGVLDSIVLGLGDFFISI

SEQ ID NO: 2386759 - protein, 25 aa, Entamoeba dispar
LKDELKIIINNCLKSTEERWSLDEL

SEQ ID NO: 2386760 - protein, 25 aa, Entamoeba dispar
LKDGRIRRSLFRGSYAFFSNDKDID

SEQ ID NO: 2386761 - protein, 17 aa, Entamoeba dispar
LKDGRKLLYYGPLKIIE

SEQ ID NO: 2386762 - protein, 28 aa, Entamoeba dispar
LKDKKARLLWFRNYFIGVLISILSNIDL

SEQ ID NO: 2386763 - protein, 21 aa, Entamoeba dispar
LKDKWRLIYTFFDEKKHEFYD

SEQ ID NO: 2386764 - protein, 18 aa, Entamoeba dispar
LKDLYEIYLSERLKRVEN

SEQ ID NO: 2386765 - protein, 18 aa, Entamoeba dispar
LKDMMEMIDAKFKEYKTN

SEQ ID NO: 2386766 - protein, 17 aa, Entamoeba dispar
LKDSFIQRLLEAEETEL

SEQ ID NO: 2386767 - protein, 19 aa, Entamoeba dispar
LKDTIKYSVVLAGHSLGGG

SEQ ID NO: 2386768 - protein, 18 aa, Entamoeba dispar
LKEFRWVGFGSMFTHVAF

SEQ ID NO: 2386769 - protein, 24 aa, Entamoeba dispar
LKEGECVDCSLKLNCKECSPNTDS

SEQ ID NO: 2386770 - protein, 18 aa, Entamoeba dispar
LKEICLFNVNELKNKRNE

SEQ ID NO: 2386771 - protein, 24 aa, Entamoeba dispar
LKELISTIFLPWFNTLRYLKQSFK

SEQ ID NO: 2386772 - protein, 25 aa, Entamoeba dispar
LKELVPELFKFFSLSITTIQNHSIT

SEQ ID NO: 2386773 - protein, 20 aa, Entamoeba dispar
LKENYPLFKKWESYSNYISS

SEQ ID NO: 2386774 - protein, 17 aa, Entamoeba dispar
LKEPKRDYKIIGNEEKV

SEQ ID NO: 2386775 - protein, 24 aa, Entamoeba dispar
LKEPYKFPADIFAFGVVIFETIKW

SEQ ID NO: 2386776 - protein, 24 aa, Entamoeba dispar
LKEQEILSNLSLLVLFLISLQEKS

SEQ ID NO: 2386777 - protein, 27 aa, Entamoeba dispar
LKEVFGDSWLYYFLPVWTTKGDGYSYP

SEQ ID NO: 2386778 - protein, 19 aa, Entamoeba dispar
LKFDSCALRNDLSSVDSLN

SEQ ID NO: 2386779 - protein, 21 aa, Entamoeba dispar
LKFGKEIVNSYCFKYIDPKGK

SEQ ID NO: 2386780 - protein, 28 aa, Entamoeba dispar
LKFIREYVWCLPRIKREVLTCLVNCVQL

SEQ ID NO: 2386781 - protein, 25 aa, Entamoeba dispar
LKFYSHYKYVFLLILGDFVGLMNDN

SEQ ID NO: 2386782 - protein, 18 aa, Entamoeba dispar
LKGCRNDMKVIVKKKHKI

SEQ ID NO: 2386783 - protein, 17 aa, Entamoeba dispar
LKGFLWGYVAIILGVIA

SEQ ID NO: 2386784 - protein, 19 aa, Entamoeba dispar
LKGIHKFHVYLNLQVESAL

SEQ ID NO: 2386785 - protein, 23 aa, Entamoeba dispar
LKGKRLKIDDFMPLNLKELIEDC

SEQ ID NO: 2386786 - protein, 24 aa, Entamoeba dispar
LKGRNELKEKLIIESNSNTIDIKD

SEQ ID NO: 2386787 - protein, 19 aa, Entamoeba dispar
LKGSSRCIPKSCGNKKIDT

SEQ ID NO: 2386788 - protein, 23 aa, Entamoeba dispar
LKHGLPYFCFTLMSFINILLVPN

SEQ ID NO: 2386789 - protein, 24 aa, Entamoeba dispar
LKHSNRFVLFRVIWNNYRHEYIFC

SEQ ID NO: 2386790 - protein, 17 aa, Entamoeba dispar
LKIAELNIEEGLCEVAI

SEQ ID NO: 2386791 - protein, 28 aa, Entamoeba dispar
LKIDASTLFKISKYLAGVLSSLLSLPLM

SEQ ID NO: 2386792 - protein, 18 aa, Entamoeba dispar
LKIIEIIHLLQWPYWSSI

SEQ ID NO: 2386793 - protein, 18 aa, Entamoeba dispar
LKIKMIVHATSDIMISTE

SEQ ID NO: 2386794 - protein, 17 aa, Entamoeba dispar
LKIMSILMAPFTPFFSE

SEQ ID NO: 2386795 - protein, 19 aa, Entamoeba dispar
LKIPTLIIFISILISVNIL

SEQ ID NO: 2386796 - protein, 25 aa, Entamoeba dispar
LKISTLICELEEGVIIINNLSQDEM

SEQ ID NO: 2386797 - protein, 19 aa, Entamoeba dispar
LKITFPLVIITLLSTLSSV

SEQ ID NO: 2386798 - protein, 21 aa, Entamoeba dispar
LKKCKEIIEEIKLNNKNNYLP

SEQ ID NO: 2386799 - protein, 19 aa, Entamoeba dispar
LKKEILLFFIEKVPQINND

SEQ ID NO: 2386800 - protein, 19 aa, Entamoeba dispar
LKKGEAFEAEIYITPLCTC

SEQ ID NO: 2386801 - protein, 20 aa, Entamoeba dispar
LKKGFACEFHIFIKPLCTCR

SEQ ID NO: 2386802 - protein, 23 aa, Entamoeba dispar
LKKGMFKESIFVPLCTNNKNWPE

SEQ ID NO: 2386803 - protein, 22 aa, Entamoeba dispar
LKKIAPPLGTLMSASKAYEIQY

SEQ ID NO: 2386804 - protein, 20 aa, Entamoeba dispar
LKKKDFKDTIILSRPQLPSH

SEQ ID NO: 2386805 - protein, 33 aa, Entamoeba dispar
LKKLSFPMEMRIKQCTLWEIIKKEFLLKNIVLN

SEQ ID NO: 2386806 - protein, 19 aa, Entamoeba dispar
LKKPLGPFYSKPVVDKFEN

SEQ ID NO: 2386807 - protein, 27 aa, Entamoeba dispar
LKKPYRNIFKWAPLLALVNSLSNLSNF

SEQ ID NO: 2386808 - protein, 27 aa, Entamoeba dispar
LKKPYRNIFKWAPLLALVNSLSYLLYF

SEQ ID NO: 2386809 - protein, 21 aa, Entamoeba dispar
LKKRKCKRSGTIGSDVEIIDA

SEQ ID NO: 2386810 - protein, 20 aa, Entamoeba dispar
LKLDLNGGWGDQWNQMQMDN

SEQ ID NO: 2386811 - protein, 17 aa, Entamoeba dispar
LKLENYGKILFDESQSI

SEQ ID NO: 2386812 - protein, 18 aa, Entamoeba dispar
LKLEPIVNTFNKEELNKQ

SEQ ID NO: 2386813 - protein, 18 aa, Entamoeba dispar
LKLFKTCTINVRPALIKG

SEQ ID NO: 2386814 - protein, 20 aa, Entamoeba dispar
LKLILQESFALVLEEPQLLF

SEQ ID NO: 2386815 - protein, 21 aa, Entamoeba dispar
LKLKASETILDMERYHLSTSK

SEQ ID NO: 2386816 - protein, 18 aa, Entamoeba dispar
LKLKVRMLPYEFRDDEIP

SEQ ID NO: 2386817 - protein, 20 aa, Entamoeba dispar
LKLLDPVIVKNFKRINNGKY

SEQ ID NO: 2386818 - protein, 27 aa, Entamoeba dispar
LKLLLQFCYSYGSSFNEAWQYPIKLFV

SEQ ID NO: 2386819 - protein, 23 aa, Entamoeba dispar
LKLLPRLQLLSVNCEQSTAILLA

SEQ ID NO: 2386820 - protein, 20 aa, Entamoeba dispar
LKLMEKCISSVWSTELLEQN

SEQ ID NO: 2386821 - protein, 17 aa, Entamoeba dispar
LKLPFSVNFAIGALGAI

SEQ ID NO: 2386822 - protein, 17 aa, Entamoeba dispar
LKLPTPTLHDMVQDKNL

SEQ ID NO: 2386823 - protein, 32 aa, Entamoeba dispar
LKLYYQRAFEAKKLKYGYVHKRITSITKTLFK

SEQ ID NO: 2386824 - protein, 17 aa, Entamoeba dispar
LKMVYKIITERGRIADP

SEQ ID NO: 2386825 - protein, 28 aa, Entamoeba dispar
LKNCGKIFWNFPRACLTGFLFNFANYFY

SEQ ID NO: 2386826 - protein, 24 aa, Entamoeba dispar
LKNINLICSIIIILLAITRKDMIS

SEQ ID NO: 2386827 - protein, 24 aa, Entamoeba dispar
LKNNFSVMFNYQFQENSTIDDAKH

SEQ ID NO: 2386828 - protein, 25 aa, Entamoeba dispar
LKNSYFQKKFCIFPSVSKEITIFFN

SEQ ID NO: 2386829 - protein, 19 aa, Entamoeba dispar
LKNWLLLLFDASYYKIIVW

SEQ ID NO: 2386830 - protein, 20 aa, Entamoeba dispar
LKNYLFKSHETIKEMKDALK

SEQ ID NO: 2386831 - protein, 17 aa, Entamoeba dispar
LKPFIISKCKVHSIEGA

SEQ ID NO: 2386832 - protein, 17 aa, Entamoeba dispar
LKPGTAIQVTFKIKMLC

SEQ ID NO: 2386833 - protein, 22 aa, Entamoeba dispar
LKPKLWVCLLIIVYVFIVAISR

SEQ ID NO: 2386834 - protein, 17 aa, Entamoeba dispar
LKPQYKVGYYAGLYYLD

SEQ ID NO: 2386835 - protein, 17 aa, Entamoeba dispar
LKQEIAFFLEQNGISLN

SEQ ID NO: 2386836 - protein, 18 aa, Entamoeba dispar
LKQLRNVVPYVYDITLGY

SEQ ID NO: 2386837 - protein, 25 aa, Entamoeba dispar
LKQPLRLLCAIVFLCCLTMTMLGLF

SEQ ID NO: 2386838 - protein, 23 aa, Entamoeba dispar
LKQTCTFALLGVKLLGGDAIPSM

SEQ ID NO: 2386839 - protein, 18 aa, Entamoeba dispar
LKQYRFVIFTEEVPKSSV

SEQ ID NO: 2386840 - protein, 25 aa, Entamoeba dispar
LKRIKHLRILYDMTLNQFTKENCQI

SEQ ID NO: 2386841 - protein, 24 aa, Entamoeba dispar
LKRLFTSPIICCFVFMILCGLLNG

SEQ ID NO: 2386842 - protein, 26 aa, Entamoeba dispar
LKRRIVELLYGFSLVGRPTPMSVIGI

SEQ ID NO: 2386843 - protein, 19 aa, Entamoeba dispar
LKSDVYSFGMVLWEMSTKK

SEQ ID NO: 2386844 - protein, 30 aa, Entamoeba dispar
LKSEIMKPSFKRLLIKGSIVKTAMAQILLK

SEQ ID NO: 2386845 - protein, 17 aa, Entamoeba dispar
LKSFIAKGGSVFMAYSP

SEQ ID NO: 2386846 - protein, 17 aa, Entamoeba dispar
LKSFPYVYFQNESSNSE

SEQ ID NO: 2386847 - protein, 25 aa, Entamoeba dispar
LKSILGVSFSQIFVSNELYLIGISN

SEQ ID NO: 2386848 - protein, 25 aa, Entamoeba dispar
LKSLVLRHFYSLFIQFYDPMDTVLS

SEQ ID NO: 2386849 - protein, 19 aa, Entamoeba dispar
LKSPHARFTYTRQTIGLFM

SEQ ID NO: 2386850 - protein, 20 aa, Entamoeba dispar
LKSQNCFPCNIHCKKCSSDS

SEQ ID NO: 2386851 - protein, 21 aa, Entamoeba dispar
LKSSHGRFTYAIESMSNQKLT

SEQ ID NO: 2386852 - protein, 20 aa, Entamoeba dispar
LKSVGCWEGAIKVRDGFCIS

SEQ ID NO: 2386853 - protein, 19 aa, Entamoeba dispar
LKSVLLMLIEKVFLQVIVE

SEQ ID NO: 2386854 - protein, 20 aa, Entamoeba dispar
LKTDCLMSSGYEKKMVTNNR

SEQ ID NO: 2386855 - protein, 20 aa, Entamoeba dispar
LKTILHFKIYPLISQISSNA

SEQ ID NO: 2386856 - protein, 24 aa, Entamoeba dispar
LKTKYNCLSHIWDIHLRHLSNITE

SEQ ID NO: 2386857 - protein, 19 aa, Entamoeba dispar
LKTKYNCLSHIWDMHIRTL

SEQ ID NO: 2386858 - protein, 17 aa, Entamoeba dispar
LKTLFLIINTFAFNNTI

SEQ ID NO: 2386859 - protein, 20 aa, Entamoeba dispar
LKTLKMSYCNKTRIPNLIST

SEQ ID NO: 2386860 - protein, 19 aa, Entamoeba dispar
LKTRIKFMCLRLPSERVWL

SEQ ID NO: 2386861 - protein, 22 aa, Entamoeba dispar
LKTRWYVVLSSFIGWYLAFLSP

SEQ ID NO: 2386862 - protein, 19 aa, Entamoeba dispar
LKTSVGIPLIDDGCYDGAL

SEQ ID NO: 2386863 - protein, 22 aa, Entamoeba dispar
LKTTFLRTAQALSYEFSRTMMI

SEQ ID NO: 2386864 - protein, 19 aa, Entamoeba dispar
LKVDYTVGCILCENGYRIT

SEQ ID NO: 2386865 - protein, 17 aa, Entamoeba dispar
LKVISIPIPTYLTPIEA

SEQ ID NO: 2386866 - protein, 17 aa, Entamoeba dispar
LKVKILDDMAVALSYLH

SEQ ID NO: 2386867 - protein, 17 aa, Entamoeba dispar
LKVSNLIFGPNVNSIYI

SEQ ID NO: 2386868 - protein, 23 aa, Entamoeba dispar
LKWIIRFHPDLVFSRKNPDIENM

SEQ ID NO: 2386869 - protein, 19 aa, Entamoeba dispar
LKYDKGVIFENTYYTCRSV

SEQ ID NO: 2386870 - protein, 22 aa, Entamoeba dispar
LKYIPDEVDFVFITSLLDPTLN

SEQ ID NO: 2386871 - protein, 17 aa, Entamoeba dispar
LKYLLTQGASLQTKTIS

SEQ ID NO: 2386872 - protein, 20 aa, Entamoeba dispar
LKYNHKFNCSFFDPLPSIYI

SEQ ID NO: 2386873 - protein, 22 aa, Entamoeba dispar
LLACVVVGFVYFRRNKQESQYI

SEQ ID NO: 2386874 - protein, 18 aa, Entamoeba dispar
LLATNCFCYYSGTLPYQT

SEQ ID NO: 2386875 - protein, 18 aa, Entamoeba dispar
LLAYSILGLFFEWKIPLK

SEQ ID NO: 2386876 - protein, 21 aa, Entamoeba dispar
LLCAIPILLLICNIYMMVYFQ

SEQ ID NO: 2386877 - protein, 22 aa, Entamoeba dispar
LLCAIPILLLICNIYMMVYFQN

SEQ ID NO: 2386878 - protein, 19 aa, Entamoeba dispar
LLCCSGILLYFLLRTTKFD

SEQ ID NO: 2386879 - protein, 21 aa, Entamoeba dispar
LLCCSNLRIETAELFKDIFFH

SEQ ID NO: 2386880 - protein, 20 aa, Entamoeba dispar
LLCFVSRAFNVFPISLLMNF

SEQ ID NO: 2386881 - protein, 18 aa, Entamoeba dispar
LLCGLIVIILIVTIIGII

SEQ ID NO: 2386882 - protein, 18 aa, Entamoeba dispar
LLDFFICTSDQDLINFIS

SEQ ID NO: 2386883 - protein, 24 aa, Entamoeba dispar
LLDGSFGKCPACYLNQMNLWCGFA

SEQ ID NO: 2386884 - protein, 17 aa, Entamoeba dispar
LLDPSGFDLKIGNSKST

SEQ ID NO: 2386885 - protein, 23 aa, Entamoeba dispar
LLDTTTLCNFEFSNCIATKLTNR

SEQ ID NO: 2386886 - protein, 17 aa, Entamoeba dispar
LLDYSECPLHLLRHTPL

SEQ ID NO: 2386887 - protein, 24 aa, Entamoeba dispar
LLELAGKTKNGWGAVINAIELSPK

SEQ ID NO: 2386888 - protein, 18 aa, Entamoeba dispar
LLEMSGILTIFVTGAVMS

SEQ ID NO: 2386889 - protein, 19 aa, Entamoeba dispar
LLFDCYKISNFTPIVTIIR

SEQ ID NO: 2386890 - protein, 19 aa, Entamoeba dispar
LLFFICFQLGHIIHSIIFQ

SEQ ID NO: 2386891 - protein, 18 aa, Entamoeba dispar
LLFLCSISTSFIIISCLC

SEQ ID NO: 2386892 - protein, 24 aa, Entamoeba dispar
LLFLSLFIYFYFKKSNIHLKSLPS

SEQ ID NO: 2386893 - protein, 26 aa, Entamoeba dispar
LLFLYPCYFFFLFNPFCFILISYPFF

SEQ ID NO: 2386894 - protein, 17 aa, Entamoeba dispar
LLFPLFFFFALLGECTI

SEQ ID NO: 2386895 - protein, 19 aa, Entamoeba dispar
LLFVCAKSNRIFKMEFKSK

SEQ ID NO: 2386896 - protein, 27 aa, Entamoeba dispar
LLGIFPKFFSKRGFIPCIKRCRAWAEN

SEQ ID NO: 2386897 - protein, 30 aa, Entamoeba dispar
LLGLICILFLRIFLYYCHIDTSDLFTNFYT

SEQ ID NO: 2386898 - protein, 22 aa, Entamoeba dispar
LLGYCLKQNIDYEARYTKLSSL

SEQ ID NO: 2386899 - protein, 18 aa, Entamoeba dispar
LLHDRELYLYSLVSETPT

SEQ ID NO: 2386900 - protein, 24 aa, Entamoeba dispar
LLHKELKGYLWVLVIGIIEGIVFL

SEQ ID NO: 2386901 - protein, 19 aa, Entamoeba dispar
LLHLFGELNWWPRKRPVKF

SEQ ID NO: 2386902 - protein, 17 aa, Entamoeba dispar
LLHSLLFYSKIYPTINT

SEQ ID NO: 2386903 - protein, 23 aa, Entamoeba dispar
LLICGCMGFLYFHHRSKVNYKAL

SEQ ID NO: 2386904 - protein, 18 aa, Entamoeba dispar
LLIERGWELKYCSITKSK

SEQ ID NO: 2386905 - protein, 19 aa, Entamoeba dispar
LLIGGLITFWILLFLDNIA

SEQ ID NO: 2386906 - protein, 19 aa, Entamoeba dispar
LLIIFSRIKRTGIIKTMMI

SEQ ID NO: 2386907 - protein, 19 aa, Entamoeba dispar
LLIILRVLYIIPFCIIKPL

SEQ ID NO: 2386908 - protein, 18 aa, Entamoeba dispar
LLILCLYLLLSNIVICIN

SEQ ID NO: 2386909 - protein, 21 aa, Entamoeba dispar
LLILKCYPIIQVSVIAFLGIF

SEQ ID NO: 2386910 - protein, 25 aa, Entamoeba dispar
LLINDIKLLLPLSSFIPLIPSYAQN

SEQ ID NO: 2386911 - protein, 22 aa, Entamoeba dispar
LLIPSCCGIAITMETIFINQKT

SEQ ID NO: 2386912 - protein, 17 aa, Entamoeba dispar
LLIQCWDITRLLLQKRN

SEQ ID NO: 2386913 - protein, 25 aa, Entamoeba dispar
LLIQFYGVWVASVFAKMEACGLIYR

SEQ ID NO: 2386914 - protein, 18 aa, Entamoeba dispar
LLIQKICSDALRIEKELE

SEQ ID NO: 2386915 - protein, 17 aa, Entamoeba dispar
LLISCFLNFIWPKESIE

SEQ ID NO: 2386916 - protein, 18 aa, Entamoeba dispar
LLITQKLWSAFPSVDEYI

SEQ ID NO: 2386917 - protein, 18 aa, Entamoeba dispar
LLITRPDKLGALYDAFFR

SEQ ID NO: 2386918 - protein, 25 aa, Entamoeba dispar
LLIVDEWKSRVVIIDAKTGKEVDVL

SEQ ID NO: 2386919 - protein, 29 aa, Entamoeba dispar
LLIYFNCSHIFYRNLFISIVFSSFHIITF

SEQ ID NO: 2386920 - protein, 22 aa, Entamoeba dispar
LLKEALREISLFPINERPDEYK

SEQ ID NO: 2386921 - protein, 24 aa, Entamoeba dispar
LLKEINPFIKWRLSPIENCKEQTG

SEQ ID NO: 2386922 - protein, 20 aa, Entamoeba dispar
LLKEVGCIKTDLMLKKWKES

SEQ ID NO: 2386923 - protein, 17 aa, Entamoeba dispar
LLKICDFEYQIQYCTTA

SEQ ID NO: 2386924 - protein, 29 aa, Entamoeba dispar
LLKISTCYPHTNFPAIVRIFSSCNKILSD

SEQ ID NO: 2386925 - protein, 24 aa, Entamoeba dispar
LLKPSENFVAAAIGIQCVNGDDDW

SEQ ID NO: 2386926 - protein, 23 aa, Entamoeba dispar
LLKRIILCDLDIRFENKKERIAE

SEQ ID NO: 2386927 - protein, 19 aa, Entamoeba dispar
LLKRKRVVEDECIITDRNI

SEQ ID NO: 2386928 - protein, 20 aa, Entamoeba dispar
LLKVCCKIESLSDVNKMNEQ

SEQ ID NO: 2386929 - protein, 24 aa, Entamoeba dispar
LLLDKENYFHIGLSSIVDSSPCHH

SEQ ID NO: 2386930 - protein, 26 aa, Entamoeba dispar
LLLDLHDLHMYFGFESSKDYYYWIDL

SEQ ID NO: 2386931 - protein, 23 aa, Entamoeba dispar
LLLELFPQFPPKVLHSREISDWC

SEQ ID NO: 2386932 - protein, 20 aa, Entamoeba dispar
LLLFFRLFILYFYLLILNIN

SEQ ID NO: 2386933 - protein, 23 aa, Entamoeba dispar
LLLFHCPSFAIKLESKRINLSNL

SEQ ID NO: 2386934 - protein, 32 aa, Entamoeba dispar
LLLIFPRFFRIKGLIPCNKWCVKYSNNVGSVF

SEQ ID NO: 2386935 - protein, 17 aa, Entamoeba dispar
LLLKCLILGFSLSSIGY

SEQ ID NO: 2386936 - protein, 19 aa, Entamoeba dispar
LLLLFILFSMGQYIGLFPS

SEQ ID NO: 2386937 - protein, 17 aa, Entamoeba dispar
LLLLFLFPFDFNISAIE

SEQ ID NO: 2386938 - protein, 25 aa, Entamoeba dispar
LLLLHPVWDKSLFKIDTKIQCIGII

SEQ ID NO: 2386939 - protein, 17 aa, Entamoeba dispar
LLLLNLVDNKFYHIQYS

SEQ ID NO: 2386940 - protein, 18 aa, Entamoeba dispar
LLLMLPIFIYSGLSQCYI

SEQ ID NO: 2386941 - protein, 17 aa, Entamoeba dispar
LLLMNWYHFVLLFFVYY

SEQ ID NO: 2386942 - protein, 17 aa, Entamoeba dispar
LLLNLLSSILFMPLLII

SEQ ID NO: 2386943 - protein, 20 aa, Entamoeba dispar
LLLNNWFNLLFLHWSSDVRK

SEQ ID NO: 2386944 - protein, 18 aa, Entamoeba dispar
LLLPDVINLITLLILTTN

SEQ ID NO: 2386945 - protein, 24 aa, Entamoeba dispar
LLLQWKMLMIICLIINKNYKQKNK

SEQ ID NO: 2386946 - protein, 20 aa, Entamoeba dispar
LLLSFFFHYFFFFLLYFSIS

SEQ ID NO: 2386947 - protein, 17 aa, Entamoeba dispar
LLLSFGMILFNDPFVAL

SEQ ID NO: 2386948 - protein, 32 aa, Entamoeba dispar
LLLSSLKCFLNWRLVLLFPLALLFGFSRSFYY

SEQ ID NO: 2386949 - protein, 21 aa, Entamoeba dispar
LLLTPSFYLLILIPPLLLGAK

SEQ ID NO: 2386950 - protein, 19 aa, Entamoeba dispar
LLLTVLAVFWYYWKNKQEF

SEQ ID NO: 2386951 - protein, 18 aa, Entamoeba dispar
LLLTYPIIFHQFLTELSY

SEQ ID NO: 2386952 - protein, 18 aa, Entamoeba dispar
LLLVFVMTCFFLIMEPRI

SEQ ID NO: 2386953 - protein, 17 aa, Entamoeba dispar
LLLYIALTHIYFHSEIK

SEQ ID NO: 2386954 - protein, 31 aa, Entamoeba dispar
LLMDCIWRFLETPFKFRMEKTVSVDNDLPMK

SEQ ID NO: 2386955 - protein, 19 aa, Entamoeba dispar
LLMKIMFNLTFPFVILKAL

SEQ ID NO: 2386956 - protein, 19 aa, Entamoeba dispar
LLMSKALIKINAYEQMKRM

SEQ ID NO: 2386957 - protein, 21 aa, Entamoeba dispar
LLNCLRKDFNNNLPFSMYWSG

SEQ ID NO: 2386958 - protein, 19 aa, Entamoeba dispar
LLNDFKRYITSGIDIENLE

SEQ ID NO: 2386959 - protein, 19 aa, Entamoeba dispar
LLNEIFKLSLEESIKTTLI

SEQ ID NO: 2386960 - protein, 24 aa, Entamoeba dispar
LLNEMKYYYSLICHTQMFEKIEIN

SEQ ID NO: 2386961 - protein, 27 aa, Entamoeba dispar
LLNGKLRFGNIYGFSIIASFVEYLVMN

SEQ ID NO: 2386962 - protein, 17 aa, Entamoeba dispar
LLNGSSFSMKRGVLEYI

SEQ ID NO: 2386963 - protein, 26 aa, Entamoeba dispar
LLNKICGKIMTPIDFIWAYHSEAKES

SEQ ID NO: 2386964 - protein, 18 aa, Entamoeba dispar
LLNSLSWKYITQLLNNVI

SEQ ID NO: 2386965 - protein, 17 aa, Entamoeba dispar
LLPLFIFTLFIQIVSTT

SEQ ID NO: 2386966 - protein, 24 aa, Entamoeba dispar
LLPLFKILPIQSFAILLQVISTII

SEQ ID NO: 2386967 - protein, 20 aa, Entamoeba dispar
LLQILPLSLIIFFFSLVTDV

SEQ ID NO: 2386968 - protein, 19 aa, Entamoeba dispar
LLQQFGICYILTKQFATIV

SEQ ID NO: 2386969 - protein, 18 aa, Entamoeba dispar
LLREELHELTQMLLSMKS

SEQ ID NO: 2386970 - protein, 21 aa, Entamoeba dispar
LLREKKIFIKKEEEIKEKENK

SEQ ID NO: 2386971 - protein, 26 aa, Entamoeba dispar
LLRGIWIMPIEWLFSKGDYFENEELY

SEQ ID NO: 2386972 - protein, 25 aa, Entamoeba dispar
LLRPRGFKTITCFMTLFCTTKIKDM

SEQ ID NO: 2386973 - protein, 19 aa, Entamoeba dispar
LLRTFAICLIPFYEVYHGC

SEQ ID NO: 2386974 - protein, 21 aa, Entamoeba dispar
LLRVFNHWHLNYAVYPFMRFE

SEQ ID NO: 2386975 - protein, 17 aa, Entamoeba dispar
LLRYYIGGFLMNMSTYF

SEQ ID NO: 2386976 - protein, 24 aa, Entamoeba dispar
LLSCFSFTGFEMVAMKYETKALSV

SEQ ID NO: 2386977 - protein, 19 aa, Entamoeba dispar
LLSEKEVIPQSALVFDAGD

SEQ ID NO: 2386978 - protein, 17 aa, Entamoeba dispar
LLSHYCISHYLDIIPAK

SEQ ID NO: 2386979 - protein, 24 aa, Entamoeba dispar
LLSKFKCSYIIQFLGAVINKNNIS

SEQ ID NO: 2386980 - protein, 25 aa, Entamoeba dispar
LLSLCNRFSLQITFLESLLDLDYSN

SEQ ID NO: 2386981 - protein, 22 aa, Entamoeba dispar
LLSLIYLFWLIFAIIRSFSEAR

SEQ ID NO: 2386982 - protein, 17 aa, Entamoeba dispar
LLSQIWGIFVFGEVRGW

SEQ ID NO: 2386983 - protein, 24 aa, Entamoeba dispar
LLSQRFQINLTREVELCKMIAEGK

SEQ ID NO: 2386984 - protein, 19 aa, Entamoeba dispar
LLSRICLYCGRVICTKRKC

SEQ ID NO: 2386985 - protein, 19 aa, Entamoeba dispar
LLSRSFKTSVITSRNNYSL

SEQ ID NO: 2386986 - protein, 26 aa, Entamoeba dispar
LLSSCGEAPCLTRCVSHLIPRVNRLC

SEQ ID NO: 2386987 - protein, 25 aa, Entamoeba dispar
LLSSICLYLIIGAVVNVLLFKRRGI

SEQ ID NO: 2386988 - protein, 24 aa, Entamoeba dispar
LLSTESFIPCIFILEKQLKKLNKK

SEQ ID NO: 2386989 - protein, 17 aa, Entamoeba dispar
LLSVFKNSFILTLLLVA

SEQ ID NO: 2386990 - protein, 25 aa, Entamoeba dispar
LLTAFVIGVLNWVGCTLVIHKRKRT

SEQ ID NO: 2386991 - protein, 17 aa, Entamoeba dispar
LLTETIKTISLFNIIGT

SEQ ID NO: 2386992 - protein, 23 aa, Entamoeba dispar
LLTIIYFCMIHKLFHLFDNSLII

SEQ ID NO: 2386993 - protein, 24 aa, Entamoeba dispar
LLTLSCSQWFISLGKYGILMGIFL

SEQ ID NO: 2386994 - protein, 18 aa, Entamoeba dispar
LLTLVGFLILFGINLNQC

SEQ ID NO: 2386995 - protein, 27 aa, Entamoeba dispar
LLTSKDWKQRLAFLTALNAAINSKKSS

SEQ ID NO: 2386996 - protein, 20 aa, Entamoeba dispar
LLTTEWCIYSSMIFGLIGLI

SEQ ID NO: 2386997 - protein, 23 aa, Entamoeba dispar
LLVKNGFCHICMSAVPFHSLHRQ

SEQ ID NO: 2386998 - protein, 24 aa, Entamoeba dispar
LLVRSVRTGMRYIQEYDLINDPTT

SEQ ID NO: 2386999 - protein, 17 aa, Entamoeba dispar
LLYAEIVINPHLSSTSF

SEQ ID NO: 2387000 - protein, 20 aa, Entamoeba dispar
LLYFYLCQYFSFILNIIILA

SEQ ID NO: 2387001 - protein, 21 aa, Entamoeba dispar
LLYIHCGYIVIGDMGMGQAVY

SEQ ID NO: 2387002 - protein, 21 aa, Entamoeba dispar
LLYKEVKGALKNSIKHSNNSQ

SEQ ID NO: 2387003 - protein, 17 aa, Entamoeba dispar
LLYLRLYATLFILFILS

SEQ ID NO: 2387004 - protein, 26 aa, Entamoeba dispar
LLYQHIERYLSLRLLLTSPKKQIDNI

SEQ ID NO: 2387005 - protein, 25 aa, Entamoeba dispar
LLYSSPIIPMFILCSIFITHRSELL

SEQ ID NO: 2387006 - protein, 17 aa, Entamoeba dispar
LLYWRNYPPSIIGMMIM

SEQ ID NO: 2387007 - protein, 19 aa, Entamoeba dispar
LLYYFCKNIKKEPILHLEE

SEQ ID NO: 2387008 - protein, 20 aa, Entamoeba dispar
LLYYLYELFGNELVKGISPR

SEQ ID NO: 2387009 - protein, 24 aa, Entamoeba dispar
LMAFPGFIVSFLLVDRIGRKPLQL

SEQ ID NO: 2387010 - protein, 18 aa, Entamoeba dispar
LMALALYTIWLLATMGNI

SEQ ID NO: 2387011 - protein, 23 aa, Entamoeba dispar
LMCSAYGSLWAYVATCVSTLSTL

SEQ ID NO: 2387012 - protein, 25 aa, Entamoeba dispar
LMECKVELPISYRISYCAKPQYIEI

SEQ ID NO: 2387013 - protein, 24 aa, Entamoeba dispar
LMEFPLPFVDEFHIDNDIFDKLSL

SEQ ID NO: 2387014 - protein, 24 aa, Entamoeba dispar
LMEKAGITFGKFIDRDAGVIKSGI

SEQ ID NO: 2387015 - protein, 22 aa, Entamoeba dispar
LMELKGTYYGLVKRQSMEEEVD

SEQ ID NO: 2387016 - protein, 18 aa, Entamoeba dispar
LMESWRRSIIFSEKLKQI

SEQ ID NO: 2387017 - protein, 24 aa, Entamoeba dispar
LMFIILRQYFQLILTHDKTISKMA

SEQ ID NO: 2387018 - protein, 25 aa, Entamoeba dispar
LMFPLCGWMGLIFAIIFWLSLLIII

SEQ ID NO: 2387019 - protein, 22 aa, Entamoeba dispar
LMFPLMLQFIVAWVKEDEPKKW

SEQ ID NO: 2387020 - protein, 19 aa, Entamoeba dispar
LMHFFPVIMSNLFGMFNNH

SEQ ID NO: 2387021 - protein, 17 aa, Entamoeba dispar
LMIRTCILILTTFCATF

SEQ ID NO: 2387022 - protein, 18 aa, Entamoeba dispar
LMISIIIIFVFSFAPGID

SEQ ID NO: 2387023 - protein, 18 aa, Entamoeba dispar
LMKEYRDIQELNKAENEN

SEQ ID NO: 2387024 - protein, 17 aa, Entamoeba dispar
LMKRLRNPYIIGYIGSV

SEQ ID NO: 2387025 - protein, 23 aa, Entamoeba dispar
LMKSLRHPCVLQFFGSGMDNNFM

SEQ ID NO: 2387026 - protein, 38 aa, Entamoeba dispar
LMLAPTVFNLDCSRLPPPCPYTGIDWGVMDTLLVDSMD

SEQ ID NO: 2387027 - protein, 18 aa, Entamoeba dispar
LMLLKWVRDPLFIRTDWS

SEQ ID NO: 2387028 - protein, 23 aa, Entamoeba dispar
LMLQRFTGNVVHIDFGDCFEVAI

SEQ ID NO: 2387029 - protein, 25 aa, Entamoeba dispar
LMLSCGYKYVLEFNRERFIAYLPLA

SEQ ID NO: 2387030 - protein, 18 aa, Entamoeba dispar
LMMVLKMIIKFNKQETRK

SEQ ID NO: 2387031 - protein, 26 aa, Entamoeba dispar
LMNLDCSFNRIFSFPPILSLTSLNII

SEQ ID NO: 2387032 - protein, 17 aa, Entamoeba dispar
LMNLGIVSFCFVLFDIA

SEQ ID NO: 2387033 - protein, 18 aa, Entamoeba dispar
LMNMSTYFFWLVVPLLMQ

SEQ ID NO: 2387034 - protein, 24 aa, Entamoeba dispar
LMPREMYVKLLAYLSIYYKMIVVW

SEQ ID NO: 2387035 - protein, 17 aa, Entamoeba dispar
LMQCIMLTLFAIPLDKI

SEQ ID NO: 2387036 - protein, 18 aa, Entamoeba dispar
LMQMAHTILKILYYHPRD

SEQ ID NO: 2387037 - protein, 19 aa, Entamoeba dispar
LMRMAFKPIMAKLFGNDNV

SEQ ID NO: 2387038 - protein, 28 aa, Entamoeba dispar
LMVKCYKILRIAAQYHREIVSHYIETSF

SEQ ID NO: 2387039 - protein, 22 aa, Entamoeba dispar
LMVLSFLSFMLLILLSLAVLLQ

SEQ ID NO: 2387040 - protein, 26 aa, Entamoeba dispar
LMVSKAFKSHTIFSLSLTITLVCIST

SEQ ID NO: 2387041 - protein, 20 aa, Entamoeba dispar
LMYETFKWDRPYPENLFKYP

SEQ ID NO: 2387042 - protein, 19 aa, Entamoeba dispar
LMYFLEVRNPAALFYFDRN

SEQ ID NO: 2387043 - protein, 26 aa, Entamoeba dispar
LMYLLKEIFNFIVIVFAFMGGLLIYS

SEQ ID NO: 2387044 - protein, 26 aa, Entamoeba dispar
LMYPEYRYLCCFDEECSPMLPAKEEV

SEQ ID NO: 2387045 - protein, 19 aa, Entamoeba dispar
LNAACKLENDLFKLTSTIL

SEQ ID NO: 2387046 - protein, 18 aa, Entamoeba dispar
LNAKPSYDIYVDKNHVTW

SEQ ID NO: 2387047 - protein, 18 aa, Entamoeba dispar
LNCCSSFCQWYCSNCCND

SEQ ID NO: 2387048 - protein, 19 aa, Entamoeba dispar
LNCINCYNGFGISKDLKTC

SEQ ID NO: 2387049 - protein, 18 aa, Entamoeba dispar
LNDLRSYRDLTLPISACN

SEQ ID NO: 2387050 - protein, 30 aa, Entamoeba dispar
LNDQFRIWCIWCIILFFSPFIIIKIYFTFK

SEQ ID NO: 2387051 - protein, 19 aa, Entamoeba dispar
LNDSIPWKAPEVLTGNKPT

SEQ ID NO: 2387052 - protein, 23 aa, Entamoeba dispar
LNDYFPPCEKVIEIGNNESIWNS

SEQ ID NO: 2387053 - protein, 30 aa, Entamoeba dispar
LNEHTIGLMKGCARGVYYLHKLGIVHRDLK

SEQ ID NO: 2387054 - protein, 24 aa, Entamoeba dispar
LNETRIPIIIHFPKIPRVVYLNNK

SEQ ID NO: 2387055 - protein, 18 aa, Entamoeba dispar
LNEYPQLTNLMQWKFDLY

SEQ ID NO: 2387056 - protein, 20 aa, Entamoeba dispar
LNEYWPKFHDIKEMDFGRII

SEQ ID NO: 2387057 - protein, 28 aa, Entamoeba dispar
LNFKVLSCVLAMVALKYHVTIQWKSGIL

SEQ ID NO: 2387058 - protein, 17 aa, Entamoeba dispar
LNFPSMIEVLSLANEVR

SEQ ID NO: 2387059 - protein, 27 aa, Entamoeba dispar
LNFYFSLRLLFVFALVFEISFIYTIIT

SEQ ID NO: 2387060 - protein, 17 aa, Entamoeba dispar
LNGECVVQAVGDVSNVG

SEQ ID NO: 2387061 - protein, 17 aa, Entamoeba dispar
LNGELKITEPIVITMLS

SEQ ID NO: 2387062 - protein, 17 aa, Entamoeba dispar
LNGKCPILVNKKVLTFD

SEQ ID NO: 2387063 - protein, 28 aa, Entamoeba dispar
LNGLIDFTSEILKEFSFLIELLDKDMQR

SEQ ID NO: 2387064 - protein, 18 aa, Entamoeba dispar
LNGLKYLHSNGVVHGNIS

SEQ ID NO: 2387065 - protein, 17 aa, Entamoeba dispar
LNGLVCLSCSSKGCEQC

SEQ ID NO: 2387066 - protein, 18 aa, Entamoeba dispar
LNGNLCVKCVEGCNYCNS

SEQ ID NO: 2387067 - protein, 17 aa, Entamoeba dispar
LNGSGPYTYFGYVTSTS

SEQ ID NO: 2387068 - protein, 17 aa, Entamoeba dispar
LNHNVFLMVLKKFVNTE

SEQ ID NO: 2387069 - protein, 17 aa, Entamoeba dispar
LNHSYTFLGPDIVCKKL

SEQ ID NO: 2387070 - protein, 35 aa, Entamoeba dispar
LNIIPWELLEPFKNCVRYFSFSGVERINSSKISSE

SEQ ID NO: 2387071 - protein, 21 aa, Entamoeba dispar
LNIIRLISPITFLKNKNIIKI

SEQ ID NO: 2387072 - protein, 24 aa, Entamoeba dispar
LNIITFPFLFGIMFSDAGHGIFIF

SEQ ID NO: 2387073 - protein, 23 aa, Entamoeba dispar
LNIKGCSPSVIQISIFSECKNGI

SEQ ID NO: 2387074 - protein, 18 aa, Entamoeba dispar
LNIKWLRNQIGLVGQEPI

SEQ ID NO: 2387075 - protein, 24 aa, Entamoeba dispar
LNIMYKRIIYIQALGQSKLSDYKE

SEQ ID NO: 2387076 - protein, 17 aa, Entamoeba dispar
LNINKGILITVPIPKED

SEQ ID NO: 2387077 - protein, 21 aa, Entamoeba dispar
LNINKWIDLIFGYKSCGEEAR

SEQ ID NO: 2387078 - protein, 17 aa, Entamoeba dispar
LNISIPINLPQEFPPSF

SEQ ID NO: 2387079 - protein, 25 aa, Entamoeba dispar
LNITRFEPKFDFRLNGRMKITTLII

SEQ ID NO: 2387080 - protein, 20 aa, Entamoeba dispar
LNKCSFELYLNKLYELMKKY

SEQ ID NO: 2387081 - protein, 24 aa, Entamoeba dispar
LNKCSICSPGFSLHDGYCVGCSTI

SEQ ID NO: 2387082 - protein, 22 aa, Entamoeba dispar
LNKEMKISDFLMKDFNNERNKI

SEQ ID NO: 2387083 - protein, 22 aa, Entamoeba dispar
LNKFKISVCPQILQHFKEAYKL

SEQ ID NO: 2387084 - protein, 23 aa, Entamoeba dispar
LNKKPFCSTGIFSHKSITPKITK

SEQ ID NO: 2387085 - protein, 26 aa, Entamoeba dispar
LNKKWDNARFWGCIISYNGDEAILGL

SEQ ID NO: 2387086 - protein, 22 aa, Entamoeba dispar
LNKRITQKLSLLIDSNLFVNEE

SEQ ID NO: 2387087 - protein, 25 aa, Entamoeba dispar
LNLAPGCHMGRFIIWTESAFKKLNT

SEQ ID NO: 2387088 - protein, 17 aa, Entamoeba dispar
LNLEYSFQPFSDIKLVS

SEQ ID NO: 2387089 - protein, 23 aa, Entamoeba dispar
LNLLSSILFMPLLIILSYIYISI

SEQ ID NO: 2387090 - protein, 20 aa, Entamoeba dispar
LNLSGLKQEIAFFLEQNGIS

SEQ ID NO: 2387091 - protein, 19 aa, Entamoeba dispar
LNLYKEGFDTVGMDDYPVQ

SEQ ID NO: 2387092 - protein, 19 aa, Entamoeba dispar
LNNCQELLLYIALTHIYFH

SEQ ID NO: 2387093 - protein, 24 aa, Entamoeba dispar
LNNFKVKNGRFFVDSDITASGSCT

SEQ ID NO: 2387094 - protein, 17 aa, Entamoeba dispar
LNNIPYWIFPLINVLIL

SEQ ID NO: 2387095 - protein, 28 aa, Entamoeba dispar
LNNTCTIQNAFVLLKLFFLFLPTPIIPF

SEQ ID NO: 2387096 - protein, 20 aa, Entamoeba dispar
LNQICVCLIGLIAIVTEQDQ

SEQ ID NO: 2387097 - protein, 25 aa, Entamoeba dispar
LNQLMPVVMSWKDIFLYLIDMIQHK

SEQ ID NO: 2387098 - protein, 20 aa, Entamoeba dispar
LNQMNLWCGFACDPNSARWT

SEQ ID NO: 2387099 - protein, 23 aa, Entamoeba dispar
LNSCSCGETLNIVFNKRGIQIGG

SEQ ID NO: 2387100 - protein, 23 aa, Entamoeba dispar
LNSELKRLIGDIVLSNDDINASE

SEQ ID NO: 2387101 - protein, 29 aa, Entamoeba dispar
LNSFDGLSRLLSCKEFEQWLNEYQENFNR

SEQ ID NO: 2387102 - protein, 18 aa, Entamoeba dispar
LNSILSDDLECFRGTEGC

SEQ ID NO: 2387103 - protein, 18 aa, Entamoeba dispar
LNSLHKILNYSGIMTDCG

SEQ ID NO: 2387104 - protein, 24 aa, Entamoeba dispar
LNSWNLECTSLFLLQTTRTQKNEI

SEQ ID NO: 2387105 - protein, 18 aa, Entamoeba dispar
LNSYCLIKIKKQKKQALV

SEQ ID NO: 2387106 - protein, 17 aa, Entamoeba dispar
LNTIPLFILESSETPIT

SEQ ID NO: 2387107 - protein, 22 aa, Entamoeba dispar
LNTMYSLYCEFFFIHEEIEGRH

SEQ ID NO: 2387108 - protein, 17 aa, Entamoeba dispar
LNVPFKVIIKVEYLNSF

SEQ ID NO: 2387109 - protein, 27 aa, Entamoeba dispar
LNYAVYPFMRFELIPSLIVLYRTYFLG

SEQ ID NO: 2387110 - protein, 17 aa, Entamoeba dispar
LNYLPLIPLILNKIQQL

SEQ ID NO: 2387111 - protein, 17 aa, Entamoeba dispar
LPAFPKIQAATINNFLY

SEQ ID NO: 2387112 - protein, 22 aa, Entamoeba dispar
LPDDIKSFLIVNEFKKFKELRK

SEQ ID NO: 2387113 - protein, 20 aa, Entamoeba dispar
LPEDAPIILVYHGLAGGSRE

SEQ ID NO: 2387114 - protein, 17 aa, Entamoeba dispar
LPEIFILIQECWDDNTV

SEQ ID NO: 2387115 - protein, 24 aa, Entamoeba dispar
LPELCIGILGLIFMKYYTTSTSLI

SEQ ID NO: 2387116 - protein, 18 aa, Entamoeba dispar
LPELKWNRIILKPDHPKC

SEQ ID NO: 2387117 - protein, 22 aa, Entamoeba dispar
LPESRPLFDEIIDILTDLIEMT

SEQ ID NO: 2387118 - protein, 17 aa, Entamoeba dispar
LPFAAELSSALGSCVQA

SEQ ID NO: 2387119 - protein, 22 aa, Entamoeba dispar
LPFEGTHYILGFIIEHHSLETI

SEQ ID NO: 2387120 - protein, 25 aa, Entamoeba dispar
LPFELKMRILFDTAKGMVFLHENNI

SEQ ID NO: 2387121 - protein, 19 aa, Entamoeba dispar
LPFFVQFPMCLFTAEMSLS

SEQ ID NO: 2387122 - protein, 17 aa, Entamoeba dispar
LPFIDIPYLPSYVLVGV

SEQ ID NO: 2387123 - protein, 26 aa, Entamoeba dispar
LPFILPYCFFSFIIILVETIILWSVI

SEQ ID NO: 2387124 - protein, 17 aa, Entamoeba dispar
LPFLKIGVEKVCIMENG

SEQ ID NO: 2387125 - protein, 20 aa, Entamoeba dispar
LPFLLICFVFGGITEEVYNQ

SEQ ID NO: 2387126 - protein, 22 aa, Entamoeba dispar
LPGGKCAICNAGYYTLNSNCHE

SEQ ID NO: 2387127 - protein, 17 aa, Entamoeba dispar
LPGNVPLLILLGIVCLF

SEQ ID NO: 2387128 - protein, 25 aa, Entamoeba dispar
LPHQLRFLMVYGCKDIVALDNLKNG

SEQ ID NO: 2387129 - protein, 21 aa, Entamoeba dispar
LPIDGFFSVSSLRVNKIIVSA

SEQ ID NO: 2387130 - protein, 17 aa, Entamoeba dispar
LPIFYVLGLLLQFVMIL

SEQ ID NO: 2387131 - protein, 18 aa, Entamoeba dispar
LPILIAFIPYIFIKTLCK

SEQ ID NO: 2387132 - protein, 27 aa, Entamoeba dispar
LPIYEHINELIPIFTIFSNLSQQIVSN

SEQ ID NO: 2387133 - protein, 18 aa, Entamoeba dispar
LPKIMATNPINFRIKNIK

SEQ ID NO: 2387134 - protein, 22 aa, Entamoeba dispar
LPKRSECGILCGFWVNERGVFD

SEQ ID NO: 2387135 - protein, 25 aa, Entamoeba dispar
LPKTGYCQGMSFLAGQILLVTQNPE

SEQ ID NO: 2387136 - protein, 18 aa, Entamoeba dispar
LPKVIAKVLVIGRINEDF

SEQ ID NO: 2387137 - protein, 17 aa, Entamoeba dispar
LPLAVTVSLAYSMKQMM

SEQ ID NO: 2387138 - protein, 32 aa, Entamoeba dispar
LPLFDLLSLPSLRRLEIRAGRNNLTENLPIRS

SEQ ID NO: 2387139 - protein, 17 aa, Entamoeba dispar
LPLIITRGNNVFGPHQF

SEQ ID NO: 2387140 - protein, 24 aa, Entamoeba dispar
LPLLKFAVFCIEWVIKHRIPSLVK

SEQ ID NO: 2387141 - protein, 23 aa, Entamoeba dispar
LPLPIPLVFCCLFLLQDITSSDF

SEQ ID NO: 2387142 - protein, 17 aa, Entamoeba dispar
LPLPWAMANVKAAKVHY

SEQ ID NO: 2387143 - protein, 17 aa, Entamoeba dispar
LPLSLIILKQFYLCLKD

SEQ ID NO: 2387144 - protein, 17 aa, Entamoeba dispar
LPLSVIGSSQFEGTMEV

SEQ ID NO: 2387145 - protein, 25 aa, Entamoeba dispar
LPLSVYRPSTTFYLYPKLINKIEFA

SEQ ID NO: 2387146 - protein, 17 aa, Entamoeba dispar
LPLTLSFGTFKRRYSVP

SEQ ID NO: 2387147 - protein, 18 aa, Entamoeba dispar
LPMCGDEILAGWEECDGG

SEQ ID NO: 2387148 - protein, 17 aa, Entamoeba dispar
LPMKFAKLFTVGNVLIL

SEQ ID NO: 2387149 - protein, 25 aa, Entamoeba dispar
LPMLIKDGCKFIFCCKKPSPEPFYE

SEQ ID NO: 2387150 - protein, 21 aa, Entamoeba dispar
LPNIDYHVFFGLSSKFEAGTL

SEQ ID NO: 2387151 - protein, 21 aa, Entamoeba dispar
LPNKKGYHLFSYDEEGNSPNA

SEQ ID NO: 2387152 - protein, 25 aa, Entamoeba dispar
LPNQIESIFLYIINSCCEKEFIMNK

SEQ ID NO: 2387153 - protein, 20 aa, Entamoeba dispar
LPNYYCEQALEIQSIPYSDI

SEQ ID NO: 2387154 - protein, 29 aa, Entamoeba dispar
LPPHALSFILAFVFNFLVINLFKYTNHWN

SEQ ID NO: 2387155 - protein, 24 aa, Entamoeba dispar
LPPLKIVAFEGIFGLIETVFIACP

SEQ ID NO: 2387156 - protein, 24 aa, Entamoeba dispar
LPPSSLRLDAEWLLNNIASHQIDN

SEQ ID NO: 2387157 - protein, 18 aa, Entamoeba dispar
LPQHPEMGKALYDIITNS

SEQ ID NO: 2387158 - protein, 19 aa, Entamoeba dispar
LPQTVSIYFQRRIKPTNTQ

SEQ ID NO: 2387159 - protein, 19 aa, Entamoeba dispar
LPQYCSYIILEATCIDTTN

SEQ ID NO: 2387160 - protein, 21 aa, Entamoeba dispar
LPSCSYFSPLFGEIPFVTITP

SEQ ID NO: 2387161 - protein, 17 aa, Entamoeba dispar
LPSHIIDIGNYVFFNCF

SEQ ID NO: 2387162 - protein, 23 aa, Entamoeba dispar
LPSHQRIALSLVLLIMTSSSVFK

SEQ ID NO: 2387163 - protein, 21 aa, Entamoeba dispar
LPSIEIGYFASFDIYSYANGF

SEQ ID NO: 2387164 - protein, 21 aa, Entamoeba dispar
LPSIFIRMILQAILISLYPKY

SEQ ID NO: 2387165 - protein, 24 aa, Entamoeba dispar
LPSIKGILFAIFLTFFVPIISIIF

SEQ ID NO: 2387166 - protein, 18 aa, Entamoeba dispar
LPSLSFSSFSLFPLYFMD

SEQ ID NO: 2387167 - protein, 24 aa, Entamoeba dispar
LPSSLTSIICRNCKTKSCFLPSSL

SEQ ID NO: 2387168 - protein, 26 aa, Entamoeba dispar
LPSSSPFILKFLFFIIFAVVIGGVIF

SEQ ID NO: 2387169 - protein, 25 aa, Entamoeba dispar
LPSWRWYYKFHYAPFALDFALYLNE

SEQ ID NO: 2387170 - protein, 20 aa, Entamoeba dispar
LPTILGGMRFICLDVKPEQI

SEQ ID NO: 2387171 - protein, 18 aa, Entamoeba dispar
LPTLLLLFLFPFDFNISA

SEQ ID NO: 2387172 - protein, 21 aa, Entamoeba dispar
LPTRIRMAIEAIKNNPSTDCP

SEQ ID NO: 2387173 - protein, 19 aa, Entamoeba dispar
LPTSNIILFEIVSKICTLE

SEQ ID NO: 2387174 - protein, 27 aa, Entamoeba dispar
LPTTRLYVIGKIHFKSVLFPQTNAIHW

SEQ ID NO: 2387175 - protein, 31 aa, Entamoeba dispar
LPVIPDYLICPSLPTFQWTMIITYSLDFSLQ

SEQ ID NO: 2387176 - protein, 23 aa, Entamoeba dispar
LPVKLLKDIIFKCQLRVESPLTL

SEQ ID NO: 2387177 - protein, 18 aa, Entamoeba dispar
LPVVTVGALNHCYKIIFA

SEQ ID NO: 2387178 - protein, 17 aa, Entamoeba dispar
LPWNCINPSLITNPHLP

SEQ ID NO: 2387179 - protein, 29 aa, Entamoeba dispar
LPYKLKLKIMRDVECGLHYLHESKLLHNN

SEQ ID NO: 2387180 - protein, 18 aa, Entamoeba dispar
LPYKMVCSIICALLAILP

SEQ ID NO: 2387181 - protein, 21 aa, Entamoeba dispar
LPYNESLICAFKCSCKQSISK

SEQ ID NO: 2387182 - protein, 18 aa, Entamoeba dispar
LQCASGLGARVSVEIHPS

SEQ ID NO: 2387183 - protein, 21 aa, Entamoeba dispar
LQDFTCLLGSVIVGLSLGVLY

SEQ ID NO: 2387184 - protein, 23 aa, Entamoeba dispar
LQECFYNILPYNVYFNYYSHSSD

SEQ ID NO: 2387185 - protein, 20 aa, Entamoeba dispar
LQEMKKTWNFESIGDRFYMK

SEQ ID NO: 2387186 - protein, 25 aa, Entamoeba dispar
LQFFIPLIIGFILRISTLDNRVFSF

SEQ ID NO: 2387187 - protein, 17 aa, Entamoeba dispar
LQFYYVRLFGKVFGPEL

SEQ ID NO: 2387188 - protein, 26 aa, Entamoeba dispar
LQGKKNLFFRTGFDNKKLYYYKDLCC

SEQ ID NO: 2387189 - protein, 18 aa, Entamoeba dispar
LQGQYGLSWQAWLLSLLL

SEQ ID NO: 2387190 - protein, 24 aa, Entamoeba dispar
LQHFKEAYKLLILLPETSFSTQQI

SEQ ID NO: 2387191 - protein, 20 aa, Entamoeba dispar
LQIECRLISLGFLFGNTSIL

SEQ ID NO: 2387192 - protein, 21 aa, Entamoeba dispar
LQILYLLFFWVFKNLSHQTLS

SEQ ID NO: 2387193 - protein, 17 aa, Entamoeba dispar
LQINIKFHWIDQNKYNE

SEQ ID NO: 2387194 - protein, 24 aa, Entamoeba dispar
LQIPKEFVSLMVILIFVVSGRIKN

SEQ ID NO: 2387195 - protein, 27 aa, Entamoeba dispar
LQIPKRGILKWGPLLSITNAITNLLTF

SEQ ID NO: 2387196 - protein, 25 aa, Entamoeba dispar
LQIQRRVGEIGIVFSEESVRNNDLK

SEQ ID NO: 2387197 - protein, 24 aa, Entamoeba dispar
LQIYSKFIIRRKWGSKTYVTSFSG

SEQ ID NO: 2387198 - protein, 25 aa, Entamoeba dispar
LQKKWVVTYSIYWLPYVNLAQDYTR

SEQ ID NO: 2387199 - protein, 17 aa, Entamoeba dispar
LQKRPVYRHLLFNHDES

SEQ ID NO: 2387200 - protein, 17 aa, Entamoeba dispar
LQLIILICHLIRDILTP

SEQ ID NO: 2387201 - protein, 20 aa, Entamoeba dispar
LQLILFIGVLFYTLLLYSNN

SEQ ID NO: 2387202 - protein, 17 aa, Entamoeba dispar
LQLKHDFVIFDALICVD

SEQ ID NO: 2387203 - protein, 29 aa, Entamoeba dispar
LQLKSIIDLLGKVYFSFELNNSLFTVKFQ

SEQ ID NO: 2387204 - protein, 19 aa, Entamoeba dispar
LQLLQCFKNQLSRLLPNNK

SEQ ID NO: 2387205 - protein, 17 aa, Entamoeba dispar
LQLSLDYLKSVKCNDLR

SEQ ID NO: 2387206 - protein, 18 aa, Entamoeba dispar
LQLYLGVYVSLMLLLWGC

SEQ ID NO: 2387207 - protein, 17 aa, Entamoeba dispar
LQMCEKIGYVFKKRPTK

SEQ ID NO: 2387208 - protein, 19 aa, Entamoeba dispar
LQMMKLKTVELIQFDSKLN

SEQ ID NO: 2387209 - protein, 18 aa, Entamoeba dispar
LQNGLKFVLGQVDPVLLL

SEQ ID NO: 2387210 - protein, 19 aa, Entamoeba dispar
LQNSLKLYYQRAFEAKKLK

SEQ ID NO: 2387211 - protein, 27 aa, Entamoeba dispar
LQNTVWRFSFPYSFLETFRHNYNYDES

SEQ ID NO: 2387212 - protein, 27 aa, Entamoeba dispar
LQPGCLRGNSKECFKCVNGKKIHGTDC

SEQ ID NO: 2387213 - protein, 17 aa, Entamoeba dispar
LQPLLLLTVDFHDLIQH

SEQ ID NO: 2387214 - protein, 19 aa, Entamoeba dispar
LQPPQIIELINDYKNYISR

SEQ ID NO: 2387215 - protein, 17 aa, Entamoeba dispar
LQQSAALAFFWSPCESL

SEQ ID NO: 2387216 - protein, 25 aa, Entamoeba dispar
LQQSGFKKRFVKYFNNITENERFIE

SEQ ID NO: 2387217 - protein, 17 aa, Entamoeba dispar
LQRIIVKNVELLMGAVK

SEQ ID NO: 2387218 - protein, 28 aa, Entamoeba dispar
LQRRCVIRMKNIHWEKINGVKEVNYDHQ

SEQ ID NO: 2387219 - protein, 29 aa, Entamoeba dispar
LQRTYHLKKKLVIKIVIFIIFIVIILILI

SEQ ID NO: 2387220 - protein, 17 aa, Entamoeba dispar
LQSCIELVTSSLIYNLD

SEQ ID NO: 2387221 - protein, 17 aa, Entamoeba dispar
LQSISFIMNCFSERVVP

SEQ ID NO: 2387222 - protein, 20 aa, Entamoeba dispar
LQSIWLYFIKLSRIDCNTLT

SEQ ID NO: 2387223 - protein, 20 aa, Entamoeba dispar
LQSLKILVLYFKKINQESID

SEQ ID NO: 2387224 - protein, 25 aa, Entamoeba dispar
LQTHCYRNGWEYSNKFGDNKDVDWF

SEQ ID NO: 2387225 - protein, 18 aa, Entamoeba dispar
LQTIFSKKKLCFPDNGRW

SEQ ID NO: 2387226 - protein, 21 aa, Entamoeba dispar
LQTRTKYSWSSRRGSTVLRPN

SEQ ID NO: 2387227 - protein, 27 aa, Entamoeba dispar
LQVGYRFTYTMPLAFVVILAMAKDAYD

SEQ ID NO: 2387228 - protein, 17 aa, Entamoeba dispar
LQYAHARCCGVERKSGI

SEQ ID NO: 2387229 - protein, 19 aa, Entamoeba dispar
LQYVCVGFAEFKFSNDGKL

SEQ ID NO: 2387230 - protein, 33 aa, Entamoeba dispar
LRAIGIGKFLLLRIYLAESFVVIFSASLMGMII

SEQ ID NO: 2387231 - protein, 20 aa, Entamoeba dispar
LRATNIWFNTHVNIDKLYVL

SEQ ID NO: 2387232 - protein, 24 aa, Entamoeba dispar
LRDEEIEEILSLLTQMIMRVDKES

SEQ ID NO: 2387233 - protein, 21 aa, Entamoeba dispar
LRDFPCLVELPQLQRLQSLSS

SEQ ID NO: 2387234 - protein, 18 aa, Entamoeba dispar
LRDQIKSLFIKYSSSSDA

SEQ ID NO: 2387235 - protein, 25 aa, Entamoeba dispar
LREFYGNPPLREWRNLNVVEINSGF

SEQ ID NO: 2387236 - protein, 27 aa, Entamoeba dispar
LREILYISLLNTWGFSFVFVKPKKFNI

SEQ ID NO: 2387237 - protein, 17 aa, Entamoeba dispar
LREISFIGFSSSKYIAK

SEQ ID NO: 2387238 - protein, 18 aa, Entamoeba dispar
LREKVWAILLKRKPLNTD

SEQ ID NO: 2387239 - protein, 19 aa, Entamoeba dispar
LRFNIEIVTGLKACRQRLW

SEQ ID NO: 2387240 - protein, 20 aa, Entamoeba dispar
LRFTPKQALAHPFITNGSLK

SEQ ID NO: 2387241 - protein, 20 aa, Entamoeba dispar
LRGDVTLEIVRRIAQTVKKQ

SEQ ID NO: 2387242 - protein, 17 aa, Entamoeba dispar
LRGLVKVILELFSQWLL

SEQ ID NO: 2387243 - protein, 20 aa, Entamoeba dispar
LRGQIVIPLYFASILQGLID

SEQ ID NO: 2387244 - protein, 19 aa, Entamoeba dispar
LRGSIFGKEIIQFIKDKHL

SEQ ID NO: 2387245 - protein, 19 aa, Entamoeba dispar
LRGVLDFFITQQMRNTTLT

SEQ ID NO: 2387246 - protein, 19 aa, Entamoeba dispar
LRHNAKICTFIADRTYIID

SEQ ID NO: 2387247 - protein, 25 aa, Entamoeba dispar
LRIDETMPLLLKIMIESCWKQNPQD

SEQ ID NO: 2387248 - protein, 28 aa, Entamoeba dispar
LRIFIDRPELWRMIPVITPLLIAGIIVL

SEQ ID NO: 2387249 - protein, 19 aa, Entamoeba dispar
LRIGLNQTIKGFFNSLIID

SEQ ID NO: 2387250 - protein, 19 aa, Entamoeba dispar
LRILIPIVLYLVVSHFYLL

SEQ ID NO: 2387251 - protein, 20 aa, Entamoeba dispar
LRILSCKETYKLWRNKLDQA

SEQ ID NO: 2387252 - protein, 19 aa, Entamoeba dispar
LRINKRLQKFISGEHVLDQ

SEQ ID NO: 2387253 - protein, 18 aa, Entamoeba dispar
LRIPLRSFFVVFTLILSI

SEQ ID NO: 2387254 - protein, 22 aa, Entamoeba dispar
LRIPSILKDIFESVGSKQIPIC

SEQ ID NO: 2387255 - protein, 17 aa, Entamoeba dispar
LRITIELGSHWLKNLEF

SEQ ID NO: 2387256 - protein, 20 aa, Entamoeba dispar
LRIYPKPLFISIHHPNTAVF

SEQ ID NO: 2387257 - protein, 29 aa, Entamoeba dispar
LRKKLETQMCWLLTVMNAMLNRTYSNGND

SEQ ID NO: 2387258 - protein, 27 aa, Entamoeba dispar
LRKLRTKELWCMGGTMSARSSLVTLML

SEQ ID NO: 2387259 - protein, 25 aa, Entamoeba dispar
LRKPLSGKQLVFWKKLDSIENIKSI

SEQ ID NO: 2387260 - protein, 18 aa, Entamoeba dispar
LRKRQSFIGAEVEETSSQ

SEQ ID NO: 2387261 - protein, 19 aa, Entamoeba dispar
LRKTLQLIPPYLVQRPQIE

SEQ ID NO: 2387262 - protein, 21 aa, Entamoeba dispar
LRKVCKDTCSLNLKNSIETLK

SEQ ID NO: 2387263 - protein, 22 aa, Entamoeba dispar
LRLDMVYRSPLYNTFQETLLGL

SEQ ID NO: 2387264 - protein, 17 aa, Entamoeba dispar
LRLEAIYDDNLRNKRIF

SEQ ID NO: 2387265 - protein, 17 aa, Entamoeba dispar
LRLIDMILKDSPITTTN

SEQ ID NO: 2387266 - protein, 19 aa, Entamoeba dispar
LRLPLLIEFIDGKFLIGLG

SEQ ID NO: 2387267 - protein, 17 aa, Entamoeba dispar
LRMLIFIGNEDSIKTLI

SEQ ID NO: 2387268 - protein, 18 aa, Entamoeba dispar
LRMLYNMYLFTYIVILNS

SEQ ID NO: 2387269 - protein, 20 aa, Entamoeba dispar
LRNFKTPQYFIGKTGTEVEK

SEQ ID NO: 2387270 - protein, 18 aa, Entamoeba dispar
LRNPFVVNYVGSVTYIPQ

SEQ ID NO: 2387271 - protein, 25 aa, Entamoeba dispar
LRNSEIIKICFYKNASFFLILLWYS

SEQ ID NO: 2387272 - protein, 17 aa, Entamoeba dispar
LRNVVPYVYDITLGYPN

SEQ ID NO: 2387273 - protein, 19 aa, Entamoeba dispar
LRQEAIATLYLFTKKDYER

SEQ ID NO: 2387274 - protein, 23 aa, Entamoeba dispar
LRQGELQSIIPIILIYPNPFMFI

SEQ ID NO: 2387275 - protein, 24 aa, Entamoeba dispar
LRQYTTLELINWLKPNIPKEFCEY

SEQ ID NO: 2387276 - protein, 22 aa, Entamoeba dispar
LRRAELIPILYLMLLIPLVTAR

SEQ ID NO: 2387277 - protein, 22 aa, Entamoeba dispar
LRRIGERWCLIVGGFCIIPFLL

SEQ ID NO: 2387278 - protein, 21 aa, Entamoeba dispar
LRSFSCLKCGDYIPNNGECPK

SEQ ID NO: 2387279 - protein, 18 aa, Entamoeba dispar
LRSIMIYILYLLVGISVI

SEQ ID NO: 2387280 - protein, 19 aa, Entamoeba dispar
LRSLCSSLVNYNWLSEQLM

SEQ ID NO: 2387281 - protein, 22 aa, Entamoeba dispar
LRSNHLRPKILLTDQLTRENYD

SEQ ID NO: 2387282 - protein, 20 aa, Entamoeba dispar
LRSPYLFMPIVKLVNAIAFR

SEQ ID NO: 2387283 - protein, 23 aa, Entamoeba dispar
LRSRSKFELTHLVRVNRAFDDES

SEQ ID NO: 2387284 - protein, 22 aa, Entamoeba dispar
LRSSKCSLSYFLTVSSNPYELT

SEQ ID NO: 2387285 - protein, 18 aa, Entamoeba dispar
LRTACIWIVQLIIGLFVA

SEQ ID NO: 2387286 - protein, 18 aa, Entamoeba dispar
LRTACIWIVQLVIGLFVA

SEQ ID NO: 2387287 - protein, 22 aa, Entamoeba dispar
LRTIIYPNFLNYYLMHFLFFTA

SEQ ID NO: 2387288 - protein, 43 aa, Entamoeba dispar
LRTSLMYIHCFIRRDFLFKREVPWVVFSCIIQILKHFQSIILI

SEQ ID NO: 2387289 - protein, 24 aa, Entamoeba dispar
LRVDCKDCTSFSLNAPKYTFIETF

SEQ ID NO: 2387290 - protein, 19 aa, Entamoeba dispar
LRVFNHWHLNYAVYPFMRF

SEQ ID NO: 2387291 - protein, 19 aa, Entamoeba dispar
LRVGDDWEILAEKRNILVQ

SEQ ID NO: 2387292 - protein, 17 aa, Entamoeba dispar
LRYLFTYNKNDDVQSYE

SEQ ID NO: 2387293 - protein, 22 aa, Entamoeba dispar
LRYLQKKGRFNGLQLMNGLLVF

SEQ ID NO: 2387294 - protein, 22 aa, Entamoeba dispar
LRYLWESHFMLFIPLIIILIGT

SEQ ID NO: 2387295 - protein, 28 aa, Entamoeba dispar
LRYYFVWEFGELLSILMGFGYSGMKDGE

SEQ ID NO: 2387296 - protein, 23 aa, Entamoeba dispar
LSAFCHKHKYLIIYDSEKKSFLN

SEQ ID NO: 2387297 - protein, 36 aa, Entamoeba dispar
LSAFLHTLRLHWIEFQNKFYLGDGVKFVPFQLSTNN

SEQ ID NO: 2387298 - protein, 27 aa, Entamoeba dispar
LSALWCSLSFCYLCISKIVKSFDILED

SEQ ID NO: 2387299 - protein, 20 aa, Entamoeba dispar
LSASCSKGLPVINLPFTAYD

SEQ ID NO: 2387300 - protein, 33 aa, Entamoeba dispar
LSASILIHVVDPFSSLCAGRCRNVIDMAVHSTT

SEQ ID NO: 2387301 - protein, 17 aa, Entamoeba dispar
LSCAEGYYRHNDSEKLC

SEQ ID NO: 2387302 - protein, 22 aa, Entamoeba dispar
LSCIVMGFFAFVSRKFVYSNWP

SEQ ID NO: 2387303 - protein, 22 aa, Entamoeba dispar
LSCKFKVYFIHWHLDTISQSKL

SEQ ID NO: 2387304 - protein, 21 aa, Entamoeba dispar
LSCKGAESSIVVSADTVIDEI

SEQ ID NO: 2387305 - protein, 19 aa, Entamoeba dispar
LSCSSLTNCKKCLNDTYCL

SEQ ID NO: 2387306 - protein, 20 aa, Entamoeba dispar
LSCVVSDTFRSSSFSETASD

SEQ ID NO: 2387307 - protein, 22 aa, Entamoeba dispar
LSDCAKGMRFLHANSIIHRDLK

SEQ ID NO: 2387308 - protein, 17 aa, Entamoeba dispar
LSDGTCSIHQGFKNNYV

SEQ ID NO: 2387309 - protein, 19 aa, Entamoeba dispar
LSDHIKCTTLFNLGSTQSI

SEQ ID NO: 2387310 - protein, 27 aa, Entamoeba dispar
LSDKRIKGYLNAWVFRGFIKTLNNSLV

SEQ ID NO: 2387311 - protein, 19 aa, Entamoeba dispar
LSEEMIKFIFTARADILPF

SEQ ID NO: 2387312 - protein, 19 aa, Entamoeba dispar
LSEFFKFSLDKTYLMEAYD

SEQ ID NO: 2387313 - protein, 20 aa, Entamoeba dispar
LSELVWYNKKLYGFDDKTGI

SEQ ID NO: 2387314 - protein, 24 aa, Entamoeba dispar
LSEQSLVTWVFKGIDSFQQANLHS

SEQ ID NO: 2387315 - protein, 26 aa, Entamoeba dispar
LSESKKFFGEVAFDIISFLQKSIGDY

SEQ ID NO: 2387316 - protein, 24 aa, Entamoeba dispar
LSESLTSLSGHCFADTHLISINLP

SEQ ID NO: 2387317 - protein, 18 aa, Entamoeba dispar
LSFAERKEILVTMKNINI

SEQ ID NO: 2387318 - protein, 19 aa, Entamoeba dispar
LSFDQVKLVFGQIVSSCIY

SEQ ID NO: 2387319 - protein, 17 aa, Entamoeba dispar
LSFHSIFLLNGELKITE

SEQ ID NO: 2387320 - protein, 23 aa, Entamoeba dispar
LSFSFKEDYFFGLFSSQKIQIEL

SEQ ID NO: 2387321 - protein, 29 aa, Entamoeba dispar
LSFVQSCLKANKVIKRICDIMYINYDNSS

SEQ ID NO: 2387322 - protein, 32 aa, Entamoeba dispar
LSFYTLQMAKIWYSQRLEWMGFTISTFTVLIL

SEQ ID NO: 2387323 - protein, 20 aa, Entamoeba dispar
LSGKTLRFERVHCIKKGKEL

SEQ ID NO: 2387324 - protein, 18 aa, Entamoeba dispar
LSGNSVMTFGKQRFIISA

SEQ ID NO: 2387325 - protein, 25 aa, Entamoeba dispar
LSGRLRWMIELFAYWNQLQFSPSPC

SEQ ID NO: 2387326 - protein, 20 aa, Entamoeba dispar
LSGYCLGAGIGAIINVVGTV

SEQ ID NO: 2387327 - protein, 19 aa, Entamoeba dispar
LSHHVYFGAILFSLKTLFL

SEQ ID NO: 2387328 - protein, 18 aa, Entamoeba dispar
LSHIKVPSFIIACIDVGA

SEQ ID NO: 2387329 - protein, 17 aa, Entamoeba dispar
LSIAILCNIQFMRFRVP

SEQ ID NO: 2387330 - protein, 34 aa, Entamoeba dispar
LSIAILCNIQFMRFRVPFTYCEFGTHISLILLLI

SEQ ID NO: 2387331 - protein, 25 aa, Entamoeba dispar
LSICILGVIVIYVFWLVFGIIRTYS

SEQ ID NO: 2387332 - protein, 17 aa, Entamoeba dispar
LSIIFIVMYCCDWKDNY

SEQ ID NO: 2387333 - protein, 26 aa, Entamoeba dispar
LSIKASIPFIVLTGFFFLSLIVNFIS

SEQ ID NO: 2387334 - protein, 25 aa, Entamoeba dispar
LSILIYKITFIFRNFQRVINNYFTV

SEQ ID NO: 2387335 - protein, 20 aa, Entamoeba dispar
LSIPSFYFSYTYDLTRSYQT

SEQ ID NO: 2387336 - protein, 23 aa, Entamoeba dispar
LSIRPLESIKILISRLSIEVRSN

SEQ ID NO: 2387337 - protein, 17 aa, Entamoeba dispar
LSIVMFFFALSQRKQGS

SEQ ID NO: 2387338 - protein, 17 aa, Entamoeba dispar
LSIYPYFINLLVKYDIT

SEQ ID NO: 2387339 - protein, 17 aa, Entamoeba dispar
LSIYYIFSWGFTSLYLL

SEQ ID NO: 2387340 - protein, 20 aa, Entamoeba dispar
LSKDRLDKIITIATHMFECG

SEQ ID NO: 2387341 - protein, 17 aa, Entamoeba dispar
LSKEEFLEDPIFDEYQF

SEQ ID NO: 2387342 - protein, 25 aa, Entamoeba dispar
LSKEEYCIFINKLLQFLQINKIITN

SEQ ID NO: 2387343 - protein, 34 aa, Entamoeba dispar
LSKHPSLFLAIFKKEWYHFLFAYILVTIYELFSL

SEQ ID NO: 2387344 - protein, 17 aa, Entamoeba dispar
LSKLRLASKNGDVKLYK

SEQ ID NO: 2387345 - protein, 26 aa, Entamoeba dispar
LSKNKRFAISKCYGVIQINSELKQYT

SEQ ID NO: 2387346 - protein, 27 aa, Entamoeba dispar
LSKSDIKGNIAWRRTIGKNGKKITAST

SEQ ID NO: 2387347 - protein, 24 aa, Entamoeba dispar
LSKSVYCPLCHTISNVFIEEHQPI

SEQ ID NO: 2387348 - protein, 22 aa, Entamoeba dispar
LSKTEYYAFVSIEDLTTFDVTI

SEQ ID NO: 2387349 - protein, 19 aa, Entamoeba dispar
LSKVCKLFYNDDKRKRQPT

SEQ ID NO: 2387350 - protein, 17 aa, Entamoeba dispar
LSLEVFNLLLQKRPSNI

SEQ ID NO: 2387351 - protein, 24 aa, Entamoeba dispar
LSLFARLIIHITFLIIESIDYTSG

SEQ ID NO: 2387352 - protein, 25 aa, Entamoeba dispar
LSLFCAKQLHSLICKGIKLNSETIS

SEQ ID NO: 2387353 - protein, 20 aa, Entamoeba dispar
LSLFGTIGFILPNIIMKLVE

SEQ ID NO: 2387354 - protein, 25 aa, Entamoeba dispar
LSLFILYCSQFFIFDSRYQTLMLRP

SEQ ID NO: 2387355 - protein, 20 aa, Entamoeba dispar
LSLFLLRIISFIISLTLFFN

SEQ ID NO: 2387356 - protein, 19 aa, Entamoeba dispar
LSLIINVFIIFSKVLRLHP

SEQ ID NO: 2387357 - protein, 19 aa, Entamoeba dispar
LSLISYFGFIGKDTLIFNE

SEQ ID NO: 2387358 - protein, 17 aa, Entamoeba dispar
LSLKVSNLIFGPNVNSI

SEQ ID NO: 2387359 - protein, 24 aa, Entamoeba dispar
LSLLEILQALTIPFFIIAKIPQIY

SEQ ID NO: 2387360 - protein, 18 aa, Entamoeba dispar
LSLNRFFLDYVTRNFEII

SEQ ID NO: 2387361 - protein, 20 aa, Entamoeba dispar
LSLPLLSLYFFFLFLLLLVC

SEQ ID NO: 2387362 - protein, 25 aa, Entamoeba dispar
LSLQRSGLLTGKWKNLVMNTFNDKN

SEQ ID NO: 2387363 - protein, 23 aa, Entamoeba dispar
LSLQSKRSFSIVIICSFILVFEM

SEQ ID NO: 2387364 - protein, 29 aa, Entamoeba dispar
LSLSYFCLLCFILMLVFMYRIFRVYNARE

SEQ ID NO: 2387365 - protein, 17 aa, Entamoeba dispar
LSLTLIILFNYMRYTIM

SEQ ID NO: 2387366 - protein, 19 aa, Entamoeba dispar
LSLYCKLGQAIGQNSKVKL

SEQ ID NO: 2387367 - protein, 19 aa, Entamoeba dispar
LSLYHFITLLLLVYTICVY

SEQ ID NO: 2387368 - protein, 20 aa, Entamoeba dispar
LSLYHFITLLLLVYTICVYL

SEQ ID NO: 2387369 - protein, 17 aa, Entamoeba dispar
LSLYPYWNPYDPQHNTI

SEQ ID NO: 2387370 - protein, 18 aa, Entamoeba dispar
LSNCFDKTIFRIEWFESF

SEQ ID NO: 2387371 - protein, 19 aa, Entamoeba dispar
LSNILFKLGYQNLQSSTPV

SEQ ID NO: 2387372 - protein, 18 aa, Entamoeba dispar
LSNLFLCHAQKQDWPLFH

SEQ ID NO: 2387373 - protein, 20 aa, Entamoeba dispar
LSNQTMRLFLSSIFTSFLPQ

SEQ ID NO: 2387374 - protein, 18 aa, Entamoeba dispar
LSPAPFAHWCIKEITEQP

SEQ ID NO: 2387375 - protein, 17 aa, Entamoeba dispar
LSPKCKRSYSVSSNGGR

SEQ ID NO: 2387376 - protein, 27 aa, Entamoeba dispar
LSPKFKHKEWKCIWKMVEQNHWMTICK

SEQ ID NO: 2387377 - protein, 17 aa, Entamoeba dispar
LSQCGWKMNDLIIHIGL

SEQ ID NO: 2387378 - protein, 18 aa, Entamoeba dispar
LSQFIKEIYKRYYEIEAD

SEQ ID NO: 2387379 - protein, 24 aa, Entamoeba dispar
LSQHRGNVFFRQFIPFYSNISENI

SEQ ID NO: 2387380 - protein, 22 aa, Entamoeba dispar
LSQRSTFKMSFVQVVSTLIALG

SEQ ID NO: 2387381 - protein, 20 aa, Entamoeba dispar
LSQRTFKFFYFPRFLIVLLI

SEQ ID NO: 2387382 - protein, 25 aa, Entamoeba dispar
LSQTCSGTGCLKCIASETCSSCKDL

SEQ ID NO: 2387383 - protein, 35 aa, Entamoeba dispar
LSQTCYKMGVIGFVAWCLATIVYFVITWNYFNRAI

SEQ ID NO: 2387384 - protein, 20 aa, Entamoeba dispar
LSQYAWYLLICRKKYNKGDY

SEQ ID NO: 2387385 - protein, 18 aa, Entamoeba dispar
LSRSFKTSVITSRNNYSL

SEQ ID NO: 2387386 - protein, 25 aa, Entamoeba dispar
LSSFMLPCAVVMLFIQIFADCGVNK

SEQ ID NO: 2387387 - protein, 18 aa, Entamoeba dispar
LSSFSFGSFNGYFKRKWF

SEQ ID NO: 2387388 - protein, 23 aa, Entamoeba dispar
LSSFSFTGFEMVAMKYETKALSV

SEQ ID NO: 2387389 - protein, 18 aa, Entamoeba dispar
LSSGLIFVIYYFRMYFMM

SEQ ID NO: 2387390 - protein, 20 aa, Entamoeba dispar
LSSICFYSSIRIELLNSSNL

SEQ ID NO: 2387391 - protein, 17 aa, Entamoeba dispar
LSSIDFESECIRWLGAF

SEQ ID NO: 2387392 - protein, 19 aa, Entamoeba dispar
LSSKEKFIKWRNYQTCQEA

SEQ ID NO: 2387393 - protein, 20 aa, Entamoeba dispar
LSSLLILFSIISNKLSNQEV

SEQ ID NO: 2387394 - protein, 29 aa, Entamoeba dispar
LSSLQGAVCIAVLTCSFFFVFMAVSGHVS

SEQ ID NO: 2387395 - protein, 17 aa, Entamoeba dispar
LSSLSLVIGQFAIRYLT

SEQ ID NO: 2387396 - protein, 17 aa, Entamoeba dispar
LSSRLKRTLDSYEQEKD

SEQ ID NO: 2387397 - protein, 27 aa, Entamoeba dispar
LSSSSCPVCGNGMWSYISSSGCYSCKS

SEQ ID NO: 2387398 - protein, 25 aa, Entamoeba dispar
LSSWAGVMQLPIPVSYVVDALMYDD

SEQ ID NO: 2387399 - protein, 20 aa, Entamoeba dispar
LSSYTRRSAPTAKQFLGRSK

SEQ ID NO: 2387400 - protein, 23 aa, Entamoeba dispar
LSTFTCFLLYGWTLIYMLFTYSE

SEQ ID NO: 2387401 - protein, 23 aa, Entamoeba dispar
LSTGMKVFIGIFIVVAVITIIAG

SEQ ID NO: 2387402 - protein, 18 aa, Entamoeba dispar
LSVCSVLMVNIWSHDVGR

SEQ ID NO: 2387403 - protein, 17 aa, Entamoeba dispar
LSVCSVLMVNLWSHDVG

SEQ ID NO: 2387404 - protein, 17 aa, Entamoeba dispar
LSVGVLIVNDIEDINNK

SEQ ID NO: 2387405 - protein, 17 aa, Entamoeba dispar
LSVLCILLASLNYKVLI

SEQ ID NO: 2387406 - protein, 22 aa, Entamoeba dispar
LSVLFQSRWLMYFLEVRNPAAL

SEQ ID NO: 2387407 - protein, 17 aa, Entamoeba dispar
LSVLRKLLDAQIPEHVA

SEQ ID NO: 2387408 - protein, 23 aa, Entamoeba dispar
LSVSSFKRNECYVMNERRTNVLI

SEQ ID NO: 2387409 - protein, 30 aa, Entamoeba dispar
LSVTIDYFWTFCVFAGIFLGIPYDESKLEL

SEQ ID NO: 2387410 - protein, 25 aa, Entamoeba dispar
LSYFEYFFELCFTRGVGCENLKEFL

SEQ ID NO: 2387411 - protein, 17 aa, Entamoeba dispar
LSYHVRFLRQFLIPHPF

SEQ ID NO: 2387412 - protein, 23 aa, Entamoeba dispar
LSYRVKCIMRNGGTSNYVRVPRM

SEQ ID NO: 2387413 - protein, 50 aa, Entamoeba dispar
LSYVICITVSLYGSILYSDCGWRCGFIPQRTGEILPIEYILISLKHQNMF

SEQ ID NO: 2387414 - protein, 17 aa, Entamoeba dispar
LTAFKLTSNPLFPVTSQ

SEQ ID NO: 2387415 - protein, 18 aa, Entamoeba dispar
LTAGFTIENFWPSKYHKM

SEQ ID NO: 2387416 - protein, 26 aa, Entamoeba dispar
LTALELFDIPSKCYLDGSLKQFTRIN

SEQ ID NO: 2387417 - protein, 25 aa, Entamoeba dispar
LTDGCLDVWVGRKWNNWLSDGEELG

SEQ ID NO: 2387418 - protein, 24 aa, Entamoeba dispar
LTECWKNIVRLVLTRKGKKGEDEA

SEQ ID NO: 2387419 - protein, 18 aa, Entamoeba dispar
LTEFECFEPLPFSTQTIS

SEQ ID NO: 2387420 - protein, 26 aa, Entamoeba dispar
LTENRMTVVRGWFGGEVMERDKPLDL

SEQ ID NO: 2387421 - protein, 18 aa, Entamoeba dispar
LTFCGDGQLGHAKVEMYD

SEQ ID NO: 2387422 - protein, 23 aa, Entamoeba dispar
LTFIPGVVLYCFVWVVVFIIFLR

SEQ ID NO: 2387423 - protein, 23 aa, Entamoeba dispar
LTFNRRYCNELKRCDELERKIRY

SEQ ID NO: 2387424 - protein, 20 aa, Entamoeba dispar
LTFSGFFMVFFTLCTQVKTW

SEQ ID NO: 2387425 - protein, 31 aa, Entamoeba dispar
LTGAYPFYAACASMAIGFIVFSFIYLNQIEK

SEQ ID NO: 2387426 - protein, 20 aa, Entamoeba dispar
LTGCIARMVLKKVVRAKDIS

SEQ ID NO: 2387427 - protein, 17 aa, Entamoeba dispar
LTGGSFCAFATLGSITG

SEQ ID NO: 2387428 - protein, 18 aa, Entamoeba dispar
LTGNRNGILYSFTTDNIP

SEQ ID NO: 2387429 - protein, 20 aa, Entamoeba dispar
LTGREHLRFYGSLKGLKGYI

SEQ ID NO: 2387430 - protein, 18 aa, Entamoeba dispar
LTGYYLINKECSKCGNKC

SEQ ID NO: 2387431 - protein, 23 aa, Entamoeba dispar
LTHCIPRSIAPNMITLIGGLFMV

SEQ ID NO: 2387432 - protein, 18 aa, Entamoeba dispar
LTHECIVKSPLQDIDLSN

SEQ ID NO: 2387433 - protein, 23 aa, Entamoeba dispar
LTICVILPFVILFFIATPKLDLS

SEQ ID NO: 2387434 - protein, 19 aa, Entamoeba dispar
LTIGEAIVAIWPSSKIAIY

SEQ ID NO: 2387435 - protein, 17 aa, Entamoeba dispar
LTIGMSVYLISKNRYIS

SEQ ID NO: 2387436 - protein, 19 aa, Entamoeba dispar
LTIICIFIYQIADNIDGRQ

SEQ ID NO: 2387437 - protein, 25 aa, Entamoeba dispar
LTIILWFVVALNWKDIKIFLKEGKS

SEQ ID NO: 2387438 - protein, 18 aa, Entamoeba dispar
LTIIRIFRYSSFYISSIV

SEQ ID NO: 2387439 - protein, 18 aa, Entamoeba dispar
LTITFMAKCTTLLNEKIP

SEQ ID NO: 2387440 - protein, 26 aa, Entamoeba dispar
LTITLCCVCPAPLLSIIYSVEYNVTR

SEQ ID NO: 2387441 - protein, 17 aa, Entamoeba dispar
LTKCIHLLSLIKPSNIT

SEQ ID NO: 2387442 - protein, 21 aa, Entamoeba dispar
LTKEEFVHFPVKARGIHDYSY

SEQ ID NO: 2387443 - protein, 27 aa, Entamoeba dispar
LTKHYYAISGMFSFFREYICLVDKFSL

SEQ ID NO: 2387444 - protein, 24 aa, Entamoeba dispar
LTKIGICEPFTYYFAYIFGILSSV

SEQ ID NO: 2387445 - protein, 24 aa, Entamoeba dispar
LTKNLKMPYIILFRLKQKLTSLLL

SEQ ID NO: 2387446 - protein, 26 aa, Entamoeba dispar
LTKTGFKFVACEIGQLSYKSNIPIDY

SEQ ID NO: 2387447 - protein, 19 aa, Entamoeba dispar
LTKYMTELHLFKFSPEIIY

SEQ ID NO: 2387448 - protein, 23 aa, Entamoeba dispar
LTLFLLLYIRLTKKIKQEIDDEK

SEQ ID NO: 2387449 - protein, 17 aa, Entamoeba dispar
LTLIILFNYMRYTIMMV

SEQ ID NO: 2387450 - protein, 23 aa, Entamoeba dispar
LTLLEAVGLFLLIAPVTCLFAFC

SEQ ID NO: 2387451 - protein, 19 aa, Entamoeba dispar
LTLPYSLHYFLKFLAQNIE

SEQ ID NO: 2387452 - protein, 23 aa, Entamoeba dispar
LTLSCIPSFIGMYIIVLIMWMIW

SEQ ID NO: 2387453 - protein, 18 aa, Entamoeba dispar
LTLSNAWGLILAIGLMGN

SEQ ID NO: 2387454 - protein, 32 aa, Entamoeba dispar
LTMDIITGVLFAFCILCILLYAAYLTYAKKYR

SEQ ID NO: 2387455 - protein, 24 aa, Entamoeba dispar
LTMQLRLGMIIERRWNSFRFLVVY

SEQ ID NO: 2387456 - protein, 31 aa, Entamoeba dispar
LTMTPALFLCFPRFFKLQSCIPCNKKCVKFT

SEQ ID NO: 2387457 - protein, 19 aa, Entamoeba dispar
LTNCKKCLNDTYCLQCEDG

SEQ ID NO: 2387458 - protein, 21 aa, Entamoeba dispar
LTNDCSISFTGITQINQMIIK

SEQ ID NO: 2387459 - protein, 17 aa, Entamoeba dispar
LTNGIGISLSYDSCENF

SEQ ID NO: 2387460 - protein, 24 aa, Entamoeba dispar
LTNHWKYPMHFTFHSGDYTKYEIM

SEQ ID NO: 2387461 - protein, 19 aa, Entamoeba dispar
LTNRISWHQCKNTIILACV

SEQ ID NO: 2387462 - protein, 17 aa, Entamoeba dispar
LTPFKRYQIQNINEESN

SEQ ID NO: 2387463 - protein, 24 aa, Entamoeba dispar
LTPLGRIGILFGIGIPTMVLTQVL

SEQ ID NO: 2387464 - protein, 20 aa, Entamoeba dispar
LTPLLNCIQKVNLKNEFKKC

SEQ ID NO: 2387465 - protein, 19 aa, Entamoeba dispar
LTPSDFVDYAFRYFGQQNH

SEQ ID NO: 2387466 - protein, 24 aa, Entamoeba dispar
LTPYRSCVIRRYFFLQGTIFLIRS

SEQ ID NO: 2387467 - protein, 25 aa, Entamoeba dispar
LTQMLNPNCQLRPDISSIVLSWSKI

SEQ ID NO: 2387468 - protein, 17 aa, Entamoeba dispar
LTQRLIVHRICKESVTY

SEQ ID NO: 2387469 - protein, 17 aa, Entamoeba dispar
LTQRLVVKRICKEPISM

SEQ ID NO: 2387470 - protein, 18 aa, Entamoeba dispar
LTQSIKNWGPVDIKCLKE

SEQ ID NO: 2387471 - protein, 25 aa, Entamoeba dispar
LTRDRITSFCFMIGLCVVWVGGVAM

SEQ ID NO: 2387472 - protein, 25 aa, Entamoeba dispar
LTRYFNIRFSNPFKSGNFIDAKNVM

SEQ ID NO: 2387473 - protein, 19 aa, Entamoeba dispar
LTSCISCRFSNYVLYDGQC

SEQ ID NO: 2387474 - protein, 17 aa, Entamoeba dispar
LTSGGCFNCNSDLVEFS

SEQ ID NO: 2387475 - protein, 18 aa, Entamoeba dispar
LTSIQTFAILLKKITHTP

SEQ ID NO: 2387476 - protein, 23 aa, Entamoeba dispar
LTSKEWFIKGYIEDKFIEIIMPP

SEQ ID NO: 2387477 - protein, 17 aa, Entamoeba dispar
LTSLPYALTRKVVKTDD

SEQ ID NO: 2387478 - protein, 23 aa, Entamoeba dispar
LTSPNLDGIFAYYEKTELLLTLS

SEQ ID NO: 2387479 - protein, 23 aa, Entamoeba dispar
LTTARGFIKRICQISRKQRYQRL

SEQ ID NO: 2387480 - protein, 17 aa, Entamoeba dispar
LTTMCVSLFEFFLQSLS

SEQ ID NO: 2387481 - protein, 30 aa, Entamoeba dispar
LTTTCLYCMMICLSPPYGFEFLNNIPYWIF

SEQ ID NO: 2387482 - protein, 17 aa, Entamoeba dispar
LTVCVIILVVLIRHYNC

SEQ ID NO: 2387483 - protein, 17 aa, Entamoeba dispar
LTVDYLGIIPIMVEALK

SEQ ID NO: 2387484 - protein, 20 aa, Entamoeba dispar
LTVFSAFWILSDGTCSIHQG

SEQ ID NO: 2387485 - protein, 18 aa, Entamoeba dispar
LTVHASFVAALFFEIYFF

SEQ ID NO: 2387486 - protein, 22 aa, Entamoeba dispar
LTVILCIILWIFVFINKTEAMN

SEQ ID NO: 2387487 - protein, 20 aa, Entamoeba dispar
LTVKEHWKYGINITSTLPIT

SEQ ID NO: 2387488 - protein, 19 aa, Entamoeba dispar
LTYGGCLCNGVSCETCGNN

SEQ ID NO: 2387489 - protein, 25 aa, Entamoeba dispar
LTYHYSELYLLTLFEEYDILDLLKM

SEQ ID NO: 2387490 - protein, 24 aa, Entamoeba dispar
LTYPITWAAVPGFVEITNVYLSEF

SEQ ID NO: 2387491 - protein, 23 aa, Entamoeba dispar
LTYSKLCWFDSIKIDSLSNTKLS

SEQ ID NO: 2387492 - protein, 19 aa, Entamoeba dispar
LTYVVGLIDMVMDWYAFGG

SEQ ID NO: 2387493 - protein, 19 aa, Entamoeba dispar
LVAFSCIITGFLCINDLNI

SEQ ID NO: 2387494 - protein, 28 aa, Entamoeba dispar
LVAVCLNLPLIIPKSVKFLSKISVLTLI

SEQ ID NO: 2387495 - protein, 35 aa, Entamoeba dispar
LVAYRFELLPSIEFLPICISFIVLMMSYNIYLVVI

SEQ ID NO: 2387496 - protein, 17 aa, Entamoeba dispar
LVCNVNCAVCIVNECLK

SEQ ID NO: 2387497 - protein, 23 aa, Entamoeba dispar
LVDSFYFILPFDIVILNDKSVKF

SEQ ID NO: 2387498 - protein, 17 aa, Entamoeba dispar
LVEWLGFSIFTLSPGAI

SEQ ID NO: 2387499 - protein, 17 aa, Entamoeba dispar
LVFEISFIYTIITSFSK

SEQ ID NO: 2387500 - protein, 27 aa, Entamoeba dispar
LVFISPVAGVLIRFFYEMWVEHSNEDW

SEQ ID NO: 2387501 - protein, 25 aa, Entamoeba dispar
LVFKEKRKTCLYLEFVMKTNETEEN

SEQ ID NO: 2387502 - protein, 18 aa, Entamoeba dispar
LVFLCLFLHGVSFKIPKR

SEQ ID NO: 2387503 - protein, 17 aa, Entamoeba dispar
LVGLCGYVSAKRGFLTK

SEQ ID NO: 2387504 - protein, 31 aa, Entamoeba dispar
LVGLCTYCISPIIAGCLMNLFGPEWCPYTII

SEQ ID NO: 2387505 - protein, 20 aa, Entamoeba dispar
LVGVALRFITNGLLLIILIS

SEQ ID NO: 2387506 - protein, 34 aa, Entamoeba dispar
LVHANIYFAEFMRSMLYLWRLGKVAEVIEKYLNV

SEQ ID NO: 2387507 - protein, 23 aa, Entamoeba dispar
LVHDTCIIPAFIEKLNYSDALAS

SEQ ID NO: 2387508 - protein, 25 aa, Entamoeba dispar
LVHGRYSFNRIGIFTSHTLYRSILL

SEQ ID NO: 2387509 - protein, 18 aa, Entamoeba dispar
LVIGAGIVFVWSIQSEFA

SEQ ID NO: 2387510 - protein, 24 aa, Entamoeba dispar
LVIGFICIGIIYAIQPSYQPTILN

SEQ ID NO: 2387511 - protein, 26 aa, Entamoeba dispar
LVIGMHVNVVWIHRSGWAIGIDERGN

SEQ ID NO: 2387512 - protein, 17 aa, Entamoeba dispar
LVIGSCHAFDAQIKNCS

SEQ ID NO: 2387513 - protein, 18 aa, Entamoeba dispar
LVIGTLYLNNNIDVGKYC

SEQ ID NO: 2387514 - protein, 19 aa, Entamoeba dispar
LVIIGSRIAHLGLIVQKAK

SEQ ID NO: 2387515 - protein, 17 aa, Entamoeba dispar
LVIKDINNFISFLQKLK

SEQ ID NO: 2387516 - protein, 23 aa, Entamoeba dispar
LVILRYLFAVVVIGVIIGVVFNY

SEQ ID NO: 2387517 - protein, 25 aa, Entamoeba dispar
LVLAKKSFLRFILKSKSRMVSKNLK

SEQ ID NO: 2387518 - protein, 31 aa, Entamoeba dispar
LVLEEPQLLFVIRWFFSFLLDPMNSVILSKL

SEQ ID NO: 2387519 - protein, 19 aa, Entamoeba dispar
LVLEPVISIPGFTSSERIY

SEQ ID NO: 2387520 - protein, 17 aa, Entamoeba dispar
LVLLCLIIVTIICVLCL

SEQ ID NO: 2387521 - protein, 17 aa, Entamoeba dispar
LVLMATFIKRFPFNFLA

SEQ ID NO: 2387522 - protein, 17 aa, Entamoeba dispar
LVLPGLIAFHLYQDLPK

SEQ ID NO: 2387523 - protein, 23 aa, Entamoeba dispar
LVLSCVLLIASCFFAFIESRRQN

SEQ ID NO: 2387524 - protein, 30 aa, Entamoeba dispar
LVLVLFLGVIFYKWIYPLLYKLISSLLKSR

SEQ ID NO: 2387525 - protein, 24 aa, Entamoeba dispar
LVLYCALFFLLTIPFFNKWIKKQA

SEQ ID NO: 2387526 - protein, 19 aa, Entamoeba dispar
LVLYYLRWKSSFPIPDHLT

SEQ ID NO: 2387527 - protein, 18 aa, Entamoeba dispar
LVNCIPLSSTINLTQFIK

SEQ ID NO: 2387528 - protein, 17 aa, Entamoeba dispar
LVNCSVSSLPIEGNYID

SEQ ID NO: 2387529 - protein, 34 aa, Entamoeba dispar
LVNELRCVLYGISYSTVFSLRYILPRQKNPLTGK

SEQ ID NO: 2387530 - protein, 19 aa, Entamoeba dispar
LVNHYSWISNFLTKSEAFY

SEQ ID NO: 2387531 - protein, 17 aa, Entamoeba dispar
LVNKYLIECDVNSPMVL

SEQ ID NO: 2387532 - protein, 20 aa, Entamoeba dispar
LVNKYSIEKCCNCHETDGDV

SEQ ID NO: 2387533 - protein, 18 aa, Entamoeba dispar
LVNRLILQGEVVAVTGDG

SEQ ID NO: 2387534 - protein, 26 aa, Entamoeba dispar
LVPIKKCCIHPNLIIMTDHFHTICSS

SEQ ID NO: 2387535 - protein, 20 aa, Entamoeba dispar
LVPLLARFVSISAKIGLKYA

SEQ ID NO: 2387536 - protein, 21 aa, Entamoeba dispar
LVQRKGLIFDIGYGIASIGMA

SEQ ID NO: 2387537 - protein, 24 aa, Entamoeba dispar
LVRHCMPRLKSLLFENEEIEVIKL

SEQ ID NO: 2387538 - protein, 19 aa, Entamoeba dispar
LVRVEPFTTMFIRMNENHY

SEQ ID NO: 2387539 - protein, 19 aa, Entamoeba dispar
LVSCAEILHRFNISLTTIS

SEQ ID NO: 2387540 - protein, 17 aa, Entamoeba dispar
LVSCFASSLLQPVNGLQ

SEQ ID NO: 2387541 - protein, 25 aa, Entamoeba dispar
LVSDLPCYFLFFPCYEKKTVSEAIT

SEQ ID NO: 2387542 - protein, 21 aa, Entamoeba dispar
LVSEAKRFMTIYHQPVLLTFD

SEQ ID NO: 2387543 - protein, 28 aa, Entamoeba dispar
LVSEELVRIAILWHEAWHEALEEASKEF

SEQ ID NO: 2387544 - protein, 19 aa, Entamoeba dispar
LVSFFCYVGLFMAAGEKMI

SEQ ID NO: 2387545 - protein, 17 aa, Entamoeba dispar
LVSLGPHYHEFTGNSEV

SEQ ID NO: 2387546 - protein, 36 aa, Entamoeba dispar
LVSSLWGILVFREIRGIKNFIFFGCGTLVLFSGLIC

SEQ ID NO: 2387547 - protein, 18 aa, Entamoeba dispar
LVSTCYFSADGVKRSSKL

SEQ ID NO: 2387548 - protein, 27 aa, Entamoeba dispar
LVTKGLKEWGGAILVGFDGDPNGKDEE

SEQ ID NO: 2387549 - protein, 17 aa, Entamoeba dispar
LVTLPFVEISNMKTHNS

SEQ ID NO: 2387550 - protein, 31 aa, Entamoeba dispar
LVVEIIFTLRFFLYFEHRWGIILFFVTYIIS

SEQ ID NO: 2387551 - protein, 19 aa, Entamoeba dispar
LVVIFPIHFFFTNYYTVVL

SEQ ID NO: 2387552 - protein, 17 aa, Entamoeba dispar
LVVILFLLVFALIAAGY

SEQ ID NO: 2387553 - protein, 19 aa, Entamoeba dispar
LVVILSEIIEGFVQFITSI

SEQ ID NO: 2387554 - protein, 18 aa, Entamoeba dispar
LVVSCLANQCKCELVEED

SEQ ID NO: 2387555 - protein, 35 aa, Entamoeba dispar
LVVYVFPAFFAFRVATGLLKWVSLGIMIIGFILGG

SEQ ID NO: 2387556 - protein, 20 aa, Entamoeba dispar
LVWLCLLIIIMFKYKKLTLE

SEQ ID NO: 2387557 - protein, 17 aa, Entamoeba dispar
LVYRMNKWHYFLLDFCY

SEQ ID NO: 2387558 - protein, 18 aa, Entamoeba dispar
LWCGFACDPNSARWTEID

SEQ ID NO: 2387559 - protein, 20 aa, Entamoeba dispar
LWELYCWSHPFPDVKNLSVV

SEQ ID NO: 2387560 - protein, 17 aa, Entamoeba dispar
LWFLLSWTIMVICGATA

SEQ ID NO: 2387561 - protein, 18 aa, Entamoeba dispar
LWILWIMGIMYAFSYVLF

SEQ ID NO: 2387562 - protein, 17 aa, Entamoeba dispar
LWIVLLIIKLELDTEWG

SEQ ID NO: 2387563 - protein, 25 aa, Entamoeba dispar
LWIVVGCIICAGLVMVIVIVVIIVR

SEQ ID NO: 2387564 - protein, 24 aa, Entamoeba dispar
LWSHYKLYCLLYHWFKSYTTKPFI

SEQ ID NO: 2387565 - protein, 25 aa, Entamoeba dispar
LYALPLFFCLPNFYPNKSFFTKERF

SEQ ID NO: 2387566 - protein, 19 aa, Entamoeba dispar
LYCRMSFYDKDYIKLTSNF

SEQ ID NO: 2387567 - protein, 24 aa, Entamoeba dispar
LYCVFPCLIPPFISNKRIEKYIRA

SEQ ID NO: 2387568 - protein, 17 aa, Entamoeba dispar
LYDGYGFLEDNEKVVEV

SEQ ID NO: 2387569 - protein, 23 aa, Entamoeba dispar
LYDIESLYVIFFFILKNLKETTI

SEQ ID NO: 2387570 - protein, 18 aa, Entamoeba dispar
LYDSLAPGDKQAACCLQM

SEQ ID NO: 2387571 - protein, 18 aa, Entamoeba dispar
LYEAIPLAQQLTGINQKG

SEQ ID NO: 2387572 - protein, 22 aa, Entamoeba dispar
LYEFCIKATNLFLVQTNCVAFI

SEQ ID NO: 2387573 - protein, 23 aa, Entamoeba dispar
LYEKDCPKPLVFKETAELPDIME

SEQ ID NO: 2387574 - protein, 18 aa, Entamoeba dispar
LYELLDKVCSFNLIEDVE

SEQ ID NO: 2387575 - protein, 23 aa, Entamoeba dispar
LYEQIIQSWLCEKISINENKTMT

SEQ ID NO: 2387576 - protein, 17 aa, Entamoeba dispar
LYFAILSTMGYTLLLEK

SEQ ID NO: 2387577 - protein, 23 aa, Entamoeba dispar
LYFCKETHLSPFLTSCVCPIPTI

SEQ ID NO: 2387578 - protein, 37 aa, Entamoeba dispar
LYFNGELNATGYGDCIYSKFEYLISCEEKGITSECAK

SEQ ID NO: 2387579 - protein, 21 aa, Entamoeba dispar
LYFSFCLFISVAFFITKLWYF

SEQ ID NO: 2387580 - protein, 26 aa, Entamoeba dispar
LYFVGIMVCGILSPLATIIVSLIGTI

SEQ ID NO: 2387581 - protein, 18 aa, Entamoeba dispar
LYFYIFVDLNGWIDHFID

SEQ ID NO: 2387582 - protein, 29 aa, Entamoeba dispar
LYGINSFCSCLFFLLTIFSFKLFLCFHSI

SEQ ID NO: 2387583 - protein, 17 aa, Entamoeba dispar
LYGLFKFIAQHSDKPFI

SEQ ID NO: 2387584 - protein, 20 aa, Entamoeba dispar
LYGTCSLEQCNIKEVFCDGK

SEQ ID NO: 2387585 - protein, 25 aa, Entamoeba dispar
LYHGSRLANFVSILSTGLKIAPPEA

SEQ ID NO: 2387586 - protein, 18 aa, Entamoeba dispar
LYHKECCDGINLMETKKL

SEQ ID NO: 2387587 - protein, 22 aa, Entamoeba dispar
LYHPGNDIFLSFYSHLVDSLYF

SEQ ID NO: 2387588 - protein, 24 aa, Entamoeba dispar
LYHPRCLLQLLFAGSFKQVEIILS

SEQ ID NO: 2387589 - protein, 23 aa, Entamoeba dispar
LYHSIILKNHFKSIDQYTSQFII

SEQ ID NO: 2387590 - protein, 17 aa, Entamoeba dispar
LYICIGLVLINMVVYPF

SEQ ID NO: 2387591 - protein, 23 aa, Entamoeba dispar
LYIRGISTWAISILCSNKKYEKM

SEQ ID NO: 2387592 - protein, 18 aa, Entamoeba dispar
LYISFPLTITETPRNLAS

SEQ ID NO: 2387593 - protein, 27 aa, Entamoeba dispar
LYKEKVFQCCFPLDFVKVLMFIQQPRL

SEQ ID NO: 2387594 - protein, 21 aa, Entamoeba dispar
LYKIPQLNIIYSYSINNKSPT

SEQ ID NO: 2387595 - protein, 19 aa, Entamoeba dispar
LYKTITIGTTDNWGISLTF

SEQ ID NO: 2387596 - protein, 17 aa, Entamoeba dispar
LYLFVFFLIFGLHISLY

SEQ ID NO: 2387597 - protein, 18 aa, Entamoeba dispar
LYLLLSNIVICINCKSGC

SEQ ID NO: 2387598 - protein, 18 aa, Entamoeba dispar
LYMFILFVWIFFHVDHLK

SEQ ID NO: 2387599 - protein, 24 aa, Entamoeba dispar
LYMIPIPWNRWVILAFSIARCVFY

SEQ ID NO: 2387600 - protein, 26 aa, Entamoeba dispar
LYNEFKELMNIIGINPVFICYMETMK

SEQ ID NO: 2387601 - protein, 19 aa, Entamoeba dispar
LYNSLPFIPKKILGICCTV

SEQ ID NO: 2387602 - protein, 23 aa, Entamoeba dispar
LYNVCLILVRLFFQLPGFCLTSD

SEQ ID NO: 2387603 - protein, 25 aa, Entamoeba dispar
LYPGIKDREVFAWDKKTIEVRYIKH

SEQ ID NO: 2387604 - protein, 18 aa, Entamoeba dispar
LYPIGWKQTTTYNLGLCY

SEQ ID NO: 2387605 - protein, 24 aa, Entamoeba dispar
LYPTERRFSILKAQTTRLISTYLH

SEQ ID NO: 2387606 - protein, 24 aa, Entamoeba dispar
LYPYKADVLFEMSKLICTIVDQNP

SEQ ID NO: 2387607 - protein, 19 aa, Entamoeba dispar
LYQLQMCILNGYKTKNESF

SEQ ID NO: 2387608 - protein, 18 aa, Entamoeba dispar
LYSLGIVLYYLIYLQFPF

SEQ ID NO: 2387609 - protein, 19 aa, Entamoeba dispar
LYSNMYHEWYIFPRKVSKI

SEQ ID NO: 2387610 - protein, 26 aa, Entamoeba dispar
LYSQILDLFNYFGLRTSLMYIHCFIR

SEQ ID NO: 2387611 - protein, 22 aa, Entamoeba dispar
LYSVYCPSAISIKIGMESKSSI

SEQ ID NO: 2387612 - protein, 17 aa, Entamoeba dispar
LYTFPEMNLSFSGTASD

SEQ ID NO: 2387613 - protein, 17 aa, Entamoeba dispar
LYTKLLLHIMKYQTNDA

SEQ ID NO: 2387614 - protein, 17 aa, Entamoeba dispar
LYTNGRIKFKLINEKYE

SEQ ID NO: 2387615 - protein, 18 aa, Entamoeba dispar
LYVFICYGKLVQVNLEKG

SEQ ID NO: 2387616 - protein, 18 aa, Entamoeba dispar
LYVFLLIALMFRFFQAFW

SEQ ID NO: 2387617 - protein, 24 aa, Entamoeba dispar
LYVFPRYIIYAAIQAYPFIPKNAT

SEQ ID NO: 2387618 - protein, 26 aa, Entamoeba dispar
LYVLICIIIAVLIRLYSVLRYESVIH

SEQ ID NO: 2387619 - protein, 19 aa, Entamoeba dispar
LYYDESIIDLWQFLGNVEN

SEQ ID NO: 2387620 - protein, 17 aa, Entamoeba dispar
LYYKYKSLHIVWMLFCF

SEQ ID NO: 2387621 - protein, 17 aa, Entamoeba dispar
LYYSNKVFPIFSECLIK

SEQ ID NO: 2387622 - protein, 19 aa, Entamoeba dispar
MADTSFCYYRQKYRLGKWF

SEQ ID NO: 2387623 - protein, 17 aa, Entamoeba dispar
MAFVVLRRPLQTIVGRS

SEQ ID NO: 2387624 - protein, 35 aa, Entamoeba dispar
MAFYTCKMAKLWYLQRMDWIGAFIIVVTTTVICIT

SEQ ID NO: 2387625 - protein, 17 aa, Entamoeba dispar
MAGFASWKYKNVVQDEG

SEQ ID NO: 2387626 - protein, 20 aa, Entamoeba dispar
MAKLLLRLLAYFHEHVSETD

SEQ ID NO: 2387627 - protein, 18 aa, Entamoeba dispar
MAKNVPVVRCAPLKEPWT

SEQ ID NO: 2387628 - protein, 29 aa, Entamoeba dispar
MALSIKSWNFFLALGFFVSFLLSLICILL

SEQ ID NO: 2387629 - protein, 31 aa, Entamoeba dispar
MALYTCKMAKYWYLQRMDWIGAAISIITVIV

SEQ ID NO: 2387630 - protein, 18 aa, Entamoeba dispar
MALYYCFELGYHLHSLMY

SEQ ID NO: 2387631 - protein, 25 aa, Entamoeba dispar
MAQILLKVICDLLKRNWHFNFHITL

SEQ ID NO: 2387632 - protein, 22 aa, Entamoeba dispar
MARIWGSMCCILYLFVFLIFGM

SEQ ID NO: 2387633 - protein, 17 aa, Entamoeba dispar
MASCPYIGPKKCLPPLL

SEQ ID NO: 2387634 - protein, 26 aa, Entamoeba dispar
MCFLSCIPLKISPTVFCGWRSIIIFG

SEQ ID NO: 2387635 - protein, 21 aa, Entamoeba dispar
MCHKKGGDYIALMRSYFTGYD

SEQ ID NO: 2387636 - protein, 17 aa, Entamoeba dispar
MCIALLYSSYITTRIVL

SEQ ID NO: 2387637 - protein, 19 aa, Entamoeba dispar
MCLRLPSERVWLGCEDEPE

SEQ ID NO: 2387638 - protein, 18 aa, Entamoeba dispar
MCSKCDFWYSVDVDGKEC

SEQ ID NO: 2387639 - protein, 23 aa, Entamoeba dispar
MCSQVHLLWSCSLEVIISIVWLF

SEQ ID NO: 2387640 - protein, 21 aa, Entamoeba dispar
MCTMPVIFIIFTVVMVTSVGG

SEQ ID NO: 2387641 - protein, 20 aa, Entamoeba dispar
MDAWLNVSVVEFLENSQVKF

SEQ ID NO: 2387642 - protein, 26 aa, Entamoeba dispar
MDDMCYKPVFGKGCIITSVTGYWQHD

SEQ ID NO: 2387643 - protein, 21 aa, Entamoeba dispar
MDHHCPFVGSCIGYANHKYFF

SEQ ID NO: 2387644 - protein, 25 aa, Entamoeba dispar
MDHHCPWLGTCVGFKNHKFFILFLS

SEQ ID NO: 2387645 - protein, 21 aa, Entamoeba dispar
MDHSRLTVMEAFFLGVSTSTD

SEQ ID NO: 2387646 - protein, 24 aa, Entamoeba dispar
MDISCIPIAILVLLWVLKSLSLMI

SEQ ID NO: 2387647 - protein, 23 aa, Entamoeba dispar
MDNDIYWSGLRVILSDSKVAGEG

SEQ ID NO: 2387648 - protein, 22 aa, Entamoeba dispar
MDPFNIWALEMYPESFIHDSTA

SEQ ID NO: 2387649 - protein, 23 aa, Entamoeba dispar
MDRKNKMRFSAIYIDSLEQVNDQ

SEQ ID NO: 2387650 - protein, 22 aa, Entamoeba dispar
MDTMPIYQWLIIKYEFIQYCTD

SEQ ID NO: 2387651 - protein, 32 aa, Entamoeba dispar
MDVICLPFYFIYRPIYQWIFQRVTEVYMMYFP

SEQ ID NO: 2387652 - protein, 25 aa, Entamoeba dispar
MDVLKRMFWGLIPFFGNFFKQTEGN

SEQ ID NO: 2387653 - protein, 23 aa, Entamoeba dispar
MEEMKLMKPVFIAAENGSDFEGI

SEQ ID NO: 2387654 - protein, 26 aa, Entamoeba dispar
MEFIMYRVGGSIGFMSSTHLKVVEDI

SEQ ID NO: 2387655 - protein, 22 aa, Entamoeba dispar
MEFTCSEPSVLMLTTQEVYESD

SEQ ID NO: 2387656 - protein, 19 aa, Entamoeba dispar
MEGALPFFETTIIPFNKEN

SEQ ID NO: 2387657 - protein, 23 aa, Entamoeba dispar
MEKLTLLCVLKVLLSNTPTNARK

SEQ ID NO: 2387658 - protein, 18 aa, Entamoeba dispar
MEKWKEKKDIIWKMKNNN

SEQ ID NO: 2387659 - protein, 17 aa, Entamoeba dispar
MELEIGRVYEFSLMPRE

SEQ ID NO: 2387660 - protein, 19 aa, Entamoeba dispar
MELKFKIKMLCTASVSDEI

SEQ ID NO: 2387661 - protein, 21 aa, Entamoeba dispar
MEPSQVILFTFQKKYKPLIHV

SEQ ID NO: 2387662 - protein, 23 aa, Entamoeba dispar
MERGTCWDFALIGFLEDNYRQNG

SEQ ID NO: 2387663 - protein, 17 aa, Entamoeba dispar
MESCSDIGLSKCLPPLL

SEQ ID NO: 2387664 - protein, 20 aa, Entamoeba dispar
MEWGHFLICFIAILISQLST

SEQ ID NO: 2387665 - protein, 19 aa, Entamoeba dispar
MEYVHCFTIPLLGFVNCLY

SEQ ID NO: 2387666 - protein, 17 aa, Entamoeba dispar
MFALVVVALIELLLVLL

SEQ ID NO: 2387667 - protein, 21 aa, Entamoeba dispar
MFCLFFPEFINFFVSIPQLFG

SEQ ID NO: 2387668 - protein, 20 aa, Entamoeba dispar
MFDGCIPHVLHREGLSFNMM

SEQ ID NO: 2387669 - protein, 20 aa, Entamoeba dispar
MFDILCHLKYLNISNRPLSP

SEQ ID NO: 2387670 - protein, 23 aa, Entamoeba dispar
MFECGKERVELVTVSLINEIVSL

SEQ ID NO: 2387671 - protein, 25 aa, Entamoeba dispar
MFEIPTLKKKIELFVIPKKLDASQK

SEQ ID NO: 2387672 - protein, 20 aa, Entamoeba dispar
MFEISSAFGTVGMSLGSSKD

SEQ ID NO: 2387673 - protein, 18 aa, Entamoeba dispar
MFFARLLGIRVFLTEHSL

SEQ ID NO: 2387674 - protein, 25 aa, Entamoeba dispar
MFFETEFKGDFSLLLDSTKSNRYVF

SEQ ID NO: 2387675 - protein, 20 aa, Entamoeba dispar
MFFINFSIKFIISFIYSFIL

SEQ ID NO: 2387676 - protein, 31 aa, Entamoeba dispar
MFFIRFLFMLLLTFHCSFTVFLGSRRLTTKF

SEQ ID NO: 2387677 - protein, 18 aa, Entamoeba dispar
MFICELLCFLFLVIFQGA

SEQ ID NO: 2387678 - protein, 23 aa, Entamoeba dispar
MFIILRQYFQLILSPDKTVSTMA

SEQ ID NO: 2387679 - protein, 17 aa, Entamoeba dispar
MFILSYKFYYLLNLYHL

SEQ ID NO: 2387680 - protein, 18 aa, Entamoeba dispar
MFISLYIIAIAAMIGGIL

SEQ ID NO: 2387681 - protein, 19 aa, Entamoeba dispar
MFITLPFTAIHSFDNSASQ

SEQ ID NO: 2387682 - protein, 27 aa, Entamoeba dispar
MFKIEDFWKHVCIIWTKCYYYTPEEQV

SEQ ID NO: 2387683 - protein, 18 aa, Entamoeba dispar
MFLLRRKNNKVFDDDDNI

SEQ ID NO: 2387684 - protein, 32 aa, Entamoeba dispar
MFNLRMETMGTKIFKVIEEMRLLRMNQAQEYA

SEQ ID NO: 2387685 - protein, 29 aa, Entamoeba dispar
MFNSFPDKHAFIFRSFKQESIVKMLWSLL

SEQ ID NO: 2387686 - protein, 18 aa, Entamoeba dispar
MFPFISFIVYSCYSLKTH

SEQ ID NO: 2387687 - protein, 21 aa, Entamoeba dispar
MFPLICLCIKITFNEKETENN

SEQ ID NO: 2387688 - protein, 21 aa, Entamoeba dispar
MFSEKRVNLVKGIPYMFDGCI

SEQ ID NO: 2387689 - protein, 24 aa, Entamoeba dispar
MFSKLCSPSKLFIKSKSSTEPLSE

SEQ ID NO: 2387690 - protein, 28 aa, Entamoeba dispar
MFVALCVYFINGHWKYYLDPVSSLVVSL

SEQ ID NO: 2387691 - protein, 28 aa, Entamoeba dispar
MGDELRYRFNHVWKEFLETYFVPYKVEG

SEQ ID NO: 2387692 - protein, 20 aa, Entamoeba dispar
MGGMLGNLFVARELKADVLK

SEQ ID NO: 2387693 - protein, 17 aa, Entamoeba dispar
MGIDKPDVRFVIHQTMP

SEQ ID NO: 2387694 - protein, 17 aa, Entamoeba dispar
MGIMNTCVNYVYQYLLK

SEQ ID NO: 2387695 - protein, 22 aa, Entamoeba dispar
MGIRLISVGFSFIITGIIGAIS

SEQ ID NO: 2387696 - protein, 17 aa, Entamoeba dispar
MGIWIGFQILRVGFAGI

SEQ ID NO: 2387697 - protein, 18 aa, Entamoeba dispar
MGIYKFLRFEKHFPNGIK

SEQ ID NO: 2387698 - protein, 20 aa, Entamoeba dispar
MGLFSIYCGALYNEFFGIAI

SEQ ID NO: 2387699 - protein, 24 aa, Entamoeba dispar
MGLMAIYCGIVFNEFFGFSIDIFG

SEQ ID NO: 2387700 - protein, 25 aa, Entamoeba dispar
MGNKGYVSIKYPMLINSITQKLNEQ

SEQ ID NO: 2387701 - protein, 18 aa, Entamoeba dispar
MGYISYWSGDYLLAKYCW

SEQ ID NO: 2387702 - protein, 17 aa, Entamoeba dispar
MHMNFFFVLGFVQILTG

SEQ ID NO: 2387703 - protein, 17 aa, Entamoeba dispar
MHTCFSFLNFTRYQTAG

SEQ ID NO: 2387704 - protein, 18 aa, Entamoeba dispar
MICLCCLNNEIFISPTIL

SEQ ID NO: 2387705 - protein, 20 aa, Entamoeba dispar
MICTTCSGLATAVGGIVVYL

SEQ ID NO: 2387706 - protein, 20 aa, Entamoeba dispar
MIDCCKGMTMMHSFNIIHRD

SEQ ID NO: 2387707 - protein, 19 aa, Entamoeba dispar
MIDELLLKRIEKMNYSYVL

SEQ ID NO: 2387708 - protein, 24 aa, Entamoeba dispar
MIDHFLYCGHLCIVQELLGQNLYQ

SEQ ID NO: 2387709 - protein, 24 aa, Entamoeba dispar
MIDIICSICILFPLIKTLNLLKKN

SEQ ID NO: 2387710 - protein, 19 aa, Entamoeba dispar
MIDTVRIGYMNSKKSIIAL

SEQ ID NO: 2387711 - protein, 41 aa, Entamoeba dispar
MIDYLKHIISIISFNLLLGIHFKKNIITYFTIISNILYQSE

SEQ ID NO: 2387712 - protein, 27 aa, Entamoeba dispar
MIELIIKTMCEWCVYYDFNSCKSCNIQ

SEQ ID NO: 2387713 - protein, 18 aa, Entamoeba dispar
MIEQMKMNFIFFTLATLG

SEQ ID NO: 2387714 - protein, 23 aa, Entamoeba dispar
MIHAIKFIKQVFDNICPNKNVSS

SEQ ID NO: 2387715 - protein, 19 aa, Entamoeba dispar
MIIGICILFIILIFVVVGA

SEQ ID NO: 2387716 - protein, 25 aa, Entamoeba dispar
MIIIQCIICLILSILSGHSHSIINN

SEQ ID NO: 2387717 - protein, 23 aa, Entamoeba dispar
MIIMPYPFLGNWERKYIIGEDES

SEQ ID NO: 2387718 - protein, 20 aa, Entamoeba dispar
MIINCYGILWSFVGTSVSSI

SEQ ID NO: 2387719 - protein, 19 aa, Entamoeba dispar
MIISICFVFIPPYYSKKMW

SEQ ID NO: 2387720 - protein, 17 aa, Entamoeba dispar
MIISKIIGIIIIILNVL

SEQ ID NO: 2387721 - protein, 28 aa, Entamoeba dispar
MIKADLSKIFGFTGIFGFVLILILPSMF

SEQ ID NO: 2387722 - protein, 17 aa, Entamoeba dispar
MIKCAKMANAHDFISKL

SEQ ID NO: 2387723 - protein, 21 aa, Entamoeba dispar
MIKSNLCFNDPTSIAQFLKKL

SEQ ID NO: 2387724 - protein, 19 aa, Entamoeba dispar
MILCPSYLYPQPMSSDKIL

SEQ ID NO: 2387725 - protein, 25 aa, Entamoeba dispar
MILSLLCGLFFVFGYPQFHFTTLKI

SEQ ID NO: 2387726 - protein, 18 aa, Entamoeba dispar
MINDEMCWLIKKNCCEIV

SEQ ID NO: 2387727 - protein, 26 aa, Entamoeba dispar
MIQVLLYCWLCYNSKNEKEWKILQGT

SEQ ID NO: 2387728 - protein, 22 aa, Entamoeba dispar
MIRNYMMLIIRGGMLQRLGVFG

SEQ ID NO: 2387729 - protein, 17 aa, Entamoeba dispar
MISREKPFVGCKFMSEI

SEQ ID NO: 2387730 - protein, 27 aa, Entamoeba dispar
MITASCMPEFFVGLIGYALLGDMIFPA

SEQ ID NO: 2387731 - protein, 28 aa, Entamoeba dispar
MITGLPLLYSCIRIVMQVVPKRFDLEKI

SEQ ID NO: 2387732 - protein, 20 aa, Entamoeba dispar
MITIWLTGLFIHYVITNKLG

SEQ ID NO: 2387733 - protein, 24 aa, Entamoeba dispar
MIVCFCIIIPISLFKNLSALKYVS

SEQ ID NO: 2387734 - protein, 19 aa, Entamoeba dispar
MIYFIPGIVSFVYGGKIKV

SEQ ID NO: 2387735 - protein, 25 aa, Entamoeba dispar
MIYILEFLLLFILLFVCAKSNRIFK

SEQ ID NO: 2387736 - protein, 24 aa, Entamoeba dispar
MIYRRNDMTTVFAGLIEGSSLPII

SEQ ID NO: 2387737 - protein, 20 aa, Entamoeba dispar
MIYWYISILFSMSYEHLNEF

SEQ ID NO: 2387738 - protein, 21 aa, Entamoeba dispar
MKAITCAMFDFIFLTTHENIF

SEQ ID NO: 2387739 - protein, 24 aa, Entamoeba dispar
MKCFDCISCMIVLPLLLEMITTQS

SEQ ID NO: 2387740 - protein, 17 aa, Entamoeba dispar
MKCKSITLLNTFSNLLW

SEQ ID NO: 2387741 - protein, 18 aa, Entamoeba dispar
MKDEMSLLSFIPKTNNKN

SEQ ID NO: 2387742 - protein, 18 aa, Entamoeba dispar
MKEADDGCGKSSKSSILA

SEQ ID NO: 2387743 - protein, 26 aa, Entamoeba dispar
MKEADKEAYCTYKITTRECKTCSLVE

SEQ ID NO: 2387744 - protein, 24 aa, Entamoeba dispar
MKEADKNLGCLLSFGTTTSPGIWL

SEQ ID NO: 2387745 - protein, 20 aa, Entamoeba dispar
MKEEGCVHYSTILHCKQAID

SEQ ID NO: 2387746 - protein, 20 aa, Entamoeba dispar
MKERGNGIIVGYLGDPEGEK

SEQ ID NO: 2387747 - protein, 20 aa, Entamoeba dispar
MKEWFWELINLGWNQNPKER

SEQ ID NO: 2387748 - protein, 29 aa, Entamoeba dispar
MKFIPIILLRPIFRIPLKQNDLIIGVVTL

SEQ ID NO: 2387749 - protein, 18 aa, Entamoeba dispar
MKGANGIVQRSCQDKNEE

SEQ ID NO: 2387750 - protein, 21 aa, Entamoeba dispar
MKGLKFRRNREIESFEKESTE

SEQ ID NO: 2387751 - protein, 21 aa, Entamoeba dispar
MKGVAYFDLLVYYHKKIQKKL

SEQ ID NO: 2387752 - protein, 17 aa, Entamoeba dispar
MKIKEKYERIIWRTFQV

SEQ ID NO: 2387753 - protein, 21 aa, Entamoeba dispar
MKISKCSYLYSFNNNKINLKL

SEQ ID NO: 2387754 - protein, 21 aa, Entamoeba dispar
MKKGETVYIFVGGMSSSDVGV

SEQ ID NO: 2387755 - protein, 21 aa, Entamoeba dispar
MKKIIKRLVELNKPWHCPHGR

SEQ ID NO: 2387756 - protein, 19 aa, Entamoeba dispar
MKKIKQWWVLLIILIIFSS

SEQ ID NO: 2387757 - protein, 24 aa, Entamoeba dispar
MKKLSKEYFGFIGSICDMKEAYIA

SEQ ID NO: 2387758 - protein, 21 aa, Entamoeba dispar
MKKNECVRIITDYDIELKFLN

SEQ ID NO: 2387759 - protein, 34 aa, Entamoeba dispar
MKKVMSCFFDIIPRFKQGYSFCFIGKEDQTESCG

SEQ ID NO: 2387760 - protein, 23 aa, Entamoeba dispar
MKLDKVPPALAFLTTWQQGGPKL

SEQ ID NO: 2387761 - protein, 18 aa, Entamoeba dispar
MKLKRKNLYNFFKDEIEA

SEQ ID NO: 2387762 - protein, 19 aa, Entamoeba dispar
MKLLPCKHYFHSSCIDEWI

SEQ ID NO: 2387763 - protein, 24 aa, Entamoeba dispar
MKLMLSCLKYNFLGTNMDETTEDI

SEQ ID NO: 2387764 - protein, 19 aa, Entamoeba dispar
MKLPEIIRFSIKNLFSIPT

SEQ ID NO: 2387765 - protein, 17 aa, Entamoeba dispar
MKLPFLKQVKDLVDHFP

SEQ ID NO: 2387766 - protein, 24 aa, Entamoeba dispar
MKLSDPSFSCFSRMNQFLSKSSHF

SEQ ID NO: 2387767 - protein, 20 aa, Entamoeba dispar
MKLSSCLSKYTATRLNSIES

SEQ ID NO: 2387768 - protein, 19 aa, Entamoeba dispar
MKNGDIILNCSHFLNGLLD

SEQ ID NO: 2387769 - protein, 21 aa, Entamoeba dispar
MKNKESFVAKGFEYLNNAPKL

SEQ ID NO: 2387770 - protein, 17 aa, Entamoeba dispar
MKNLPALQQSVLNMIFN

SEQ ID NO: 2387771 - protein, 28 aa, Entamoeba dispar
MKNSLITIFCCYYIAIYLVPRFINPVQR

SEQ ID NO: 2387772 - protein, 25 aa, Entamoeba dispar
MKNYCISEKVISYFIQVYCETIDRF

SEQ ID NO: 2387773 - protein, 18 aa, Entamoeba dispar
MKQMKIDNCFGTIQRVVE

SEQ ID NO: 2387774 - protein, 19 aa, Entamoeba dispar
MKQTCKNWHLGGMGCSASI

SEQ ID NO: 2387775 - protein, 28 aa, Entamoeba dispar
MKRGEVDACFSLGCKYCPPHTFRRNHKC

SEQ ID NO: 2387776 - protein, 21 aa, Entamoeba dispar
MKRHPIVRYKPLISYPTALMV

SEQ ID NO: 2387777 - protein, 20 aa, Entamoeba dispar
MKRKLIKSNYIIYFIEGTTE

SEQ ID NO: 2387778 - protein, 19 aa, Entamoeba dispar
MKSKVRAKIFVQRLKNITE

SEQ ID NO: 2387779 - protein, 17 aa, Entamoeba dispar
MKSVIPAISSKSIRTWI

SEQ ID NO: 2387780 - protein, 17 aa, Entamoeba dispar
MKTEEFVLGEWTFEYYM

SEQ ID NO: 2387781 - protein, 17 aa, Entamoeba dispar
MKTLLFLSKPLSDLSSV

SEQ ID NO: 2387782 - protein, 22 aa, Entamoeba dispar
MKVKKRIEVLLERIERKEQQEI

SEQ ID NO: 2387783 - protein, 27 aa, Entamoeba dispar
MKVLDMFGCSLPVLARGYQCLKDELVI

SEQ ID NO: 2387784 - protein, 22 aa, Entamoeba dispar
MKWKKSLHMALLMFSMNLIFLT

SEQ ID NO: 2387785 - protein, 21 aa, Entamoeba dispar
MKYTSSMFRYPEKVQEWNIII

SEQ ID NO: 2387786 - protein, 17 aa, Entamoeba dispar
MKYVLKVFYHLMKITNT

SEQ ID NO: 2387787 - protein, 20 aa, Entamoeba dispar
MLDKFRCDYVVYFYGAVFVP

SEQ ID NO: 2387788 - protein, 19 aa, Entamoeba dispar
MLDKFRCEYIVHFYGAVFI

SEQ ID NO: 2387789 - protein, 25 aa, Entamoeba dispar
MLDKFRSEYIIQFYGAVFIPNKICI

SEQ ID NO: 2387790 - protein, 24 aa, Entamoeba dispar
MLEEVCKIKLSLEGKKNIEKEFED

SEQ ID NO: 2387791 - protein, 22 aa, Entamoeba dispar
MLELSPFMAFILYLVYIQIDYH

SEQ ID NO: 2387792 - protein, 25 aa, Entamoeba dispar
MLFAMYVSCGISFVLLIIMIIVCIV

SEQ ID NO: 2387793 - protein, 24 aa, Entamoeba dispar
MLFAYKYGKVYAFGISVIIHTLSE

SEQ ID NO: 2387794 - protein, 22 aa, Entamoeba dispar
MLFSSITLFFGMTPMIEQQKNM

SEQ ID NO: 2387795 - protein, 23 aa, Entamoeba dispar
MLGDSRLKFIIQLLASSLTGREM

SEQ ID NO: 2387796 - protein, 21 aa, Entamoeba dispar
MLIRFECGNEFLIKMTETPKF

SEQ ID NO: 2387797 - protein, 18 aa, Entamoeba dispar
MLKLLPYSLKVHFVSGLE

SEQ ID NO: 2387798 - protein, 18 aa, Entamoeba dispar
MLKQANVRVWMLTGDKVE

SEQ ID NO: 2387799 - protein, 25 aa, Entamoeba dispar
MLLHWEYIDKILFLMYCIWTIYVLY

SEQ ID NO: 2387800 - protein, 20 aa, Entamoeba dispar
MLNLMCKNELSILVEGASLD

SEQ ID NO: 2387801 - protein, 25 aa, Entamoeba dispar
MLNQVFLFISCCLVGHCLAQTKYIC

SEQ ID NO: 2387802 - protein, 25 aa, Entamoeba dispar
MLPLLKEYFYPFITKFLPFLLQRCK

SEQ ID NO: 2387803 - protein, 20 aa, Entamoeba dispar
MLPSYKFIKTTWDLFVKDIN

SEQ ID NO: 2387804 - protein, 27 aa, Entamoeba dispar
MLQLLMFSAALIKFKPKYDPFKLVKPV

SEQ ID NO: 2387805 - protein, 18 aa, Entamoeba dispar
MLQNPYLSISAIENIVGI

SEQ ID NO: 2387806 - protein, 19 aa, Entamoeba dispar
MLQRRILALIITLDEKSIE

SEQ ID NO: 2387807 - protein, 24 aa, Entamoeba dispar
MLRRAELIPILYLMLLIPLVTARF

SEQ ID NO: 2387808 - protein, 25 aa, Entamoeba dispar
MLVIDPLAFRSWDDYVLNNLKHSEQ

SEQ ID NO: 2387809 - protein, 17 aa, Entamoeba dispar
MMFDFPRMLSFHLYAKG

SEQ ID NO: 2387810 - protein, 25 aa, Entamoeba dispar
MMHPEIPRHLVLPDFFFKVLPYFKQ

SEQ ID NO: 2387811 - protein, 27 aa, Entamoeba dispar
MMKEVMDIPEGYEIIFLGGGASLQFLM

SEQ ID NO: 2387812 - protein, 20 aa, Entamoeba dispar
MMLSMTFPLILCLVLGSFHE

SEQ ID NO: 2387813 - protein, 18 aa, Entamoeba dispar
MMLSSGVIYGSYESTFKE

SEQ ID NO: 2387814 - protein, 24 aa, Entamoeba dispar
MMNSIIKWACKRSEDDSIKIVSKN

SEQ ID NO: 2387815 - protein, 24 aa, Entamoeba dispar
MMPSENDYSIGLRIKYGNFIYATS

SEQ ID NO: 2387816 - protein, 25 aa, Entamoeba dispar
MMTCIISSMWLFFRFFKKHKEELTN

SEQ ID NO: 2387817 - protein, 19 aa, Entamoeba dispar
MNAWDIFLFLSSKSFIILR

SEQ ID NO: 2387818 - protein, 17 aa, Entamoeba dispar
MNCKILFESIISLISND

SEQ ID NO: 2387819 - protein, 18 aa, Entamoeba dispar
MNGCISYLSSLLFTIILF

SEQ ID NO: 2387820 - protein, 22 aa, Entamoeba dispar
MNKERINSIPLIHSEKIITENF

SEQ ID NO: 2387821 - protein, 20 aa, Entamoeba dispar
MNKRASLLKRKRVVEDECII

SEQ ID NO: 2387822 - protein, 20 aa, Entamoeba dispar
MNKSLPCIYQIEKRDPTLES

SEQ ID NO: 2387823 - protein, 22 aa, Entamoeba dispar
MNKTLPINWERRLKMLKDAASG

SEQ ID NO: 2387824 - protein, 21 aa, Entamoeba dispar
MNLERVVYCIDSRLFFFVGFG

SEQ ID NO: 2387825 - protein, 19 aa, Entamoeba dispar
MNLLECFPVFHPSLELLKI

SEQ ID NO: 2387826 - protein, 26 aa, Entamoeba dispar
MNQFVFGIFCFKIVIVIVATIAGSLF

SEQ ID NO: 2387827 - protein, 20 aa, Entamoeba dispar
MNWSLLISVLFWNINGVDGC

SEQ ID NO: 2387828 - protein, 25 aa, Entamoeba dispar
MPFFLCLLSLISLLFSFFILSVFNA

SEQ ID NO: 2387829 - protein, 20 aa, Entamoeba dispar
MPIIDVYKAKICVVNKRSLN

SEQ ID NO: 2387830 - protein, 20 aa, Entamoeba dispar
MPTILNELITIFNLPFDKGS

SEQ ID NO: 2387831 - protein, 21 aa, Entamoeba dispar
MPYFSFKLNLEYSFQPFSDIK

SEQ ID NO: 2387832 - protein, 21 aa, Entamoeba dispar
MQAYCAAHLFQTLLPNNFSLK

SEQ ID NO: 2387833 - protein, 19 aa, Entamoeba dispar
MQFKRGDTPLITYAENAEE

SEQ ID NO: 2387834 - protein, 18 aa, Entamoeba dispar
MQLARVITTIALFNSIRI

SEQ ID NO: 2387835 - protein, 17 aa, Entamoeba dispar
MQLERRWDNNSFCRGYY

SEQ ID NO: 2387836 - protein, 26 aa, Entamoeba dispar
MQNLLIDILLEFGFFFDSKMARHSQK

SEQ ID NO: 2387837 - protein, 24 aa, Entamoeba dispar
MREVDCGFSTYPSLYVHSVSNSMA

SEQ ID NO: 2387838 - protein, 19 aa, Entamoeba dispar
MRKECLSLVHIIIDSIKKL

SEQ ID NO: 2387839 - protein, 24 aa, Entamoeba dispar
MRLSTKSANEWTYFKISLKDLNVT

SEQ ID NO: 2387840 - protein, 20 aa, Entamoeba dispar
MRNKAMCYECQPGYIYDTLT

SEQ ID NO: 2387841 - protein, 17 aa, Entamoeba dispar
MSANELFPSINAICDSI

SEQ ID NO: 2387842 - protein, 25 aa, Entamoeba dispar
MSDEIGFNAVVQWEHASDILYSLLT

SEQ ID NO: 2387843 - protein, 31 aa, Entamoeba dispar
MSECVGELTCCLCPLFAGLIATQTDDRKWAL

SEQ ID NO: 2387844 - protein, 26 aa, Entamoeba dispar
MSEFLKTRFCQDIARGMEYLHENDIV

SEQ ID NO: 2387845 - protein, 18 aa, Entamoeba dispar
MSERCFEVGGRIFKSIEG

SEQ ID NO: 2387846 - protein, 17 aa, Entamoeba dispar
MSFVSLRSNLLSQEFLS

SEQ ID NO: 2387847 - protein, 26 aa, Entamoeba dispar
MSGFTKRYDYGLTWSNMLEKIPNSNV

SEQ ID NO: 2387848 - protein, 18 aa, Entamoeba dispar
MSGLFSFNMNGERDKFLF

SEQ ID NO: 2387849 - protein, 25 aa, Entamoeba dispar
MSIELKLRFCHDIASGMDYLHQNDI

SEQ ID NO: 2387850 - protein, 24 aa, Entamoeba dispar
MSKQRAIELLSLFIQSVIDKEIGL

SEQ ID NO: 2387851 - protein, 19 aa, Entamoeba dispar
MSLSLSFTIMNFLKYCRFN

SEQ ID NO: 2387852 - protein, 25 aa, Entamoeba dispar
MSLTMRFFIMLRIYLSKYIKELPIF

SEQ ID NO: 2387853 - protein, 35 aa, Entamoeba dispar
MSMFPICVIGATIFLKCCLFLYCRTVNNPAAGALA

SEQ ID NO: 2387854 - protein, 25 aa, Entamoeba dispar
MSSEGRQAYPACLPGTIMRVIRFSI

SEQ ID NO: 2387855 - protein, 18 aa, Entamoeba dispar
MSSLRKSNDIVIFSDGLC

SEQ ID NO: 2387856 - protein, 20 aa, Entamoeba dispar
MSTGRKVAWFIFAIGIIPLL

SEQ ID NO: 2387857 - protein, 18 aa, Entamoeba dispar
MSTYFFWLVVPLLMQDRD

SEQ ID NO: 2387858 - protein, 17 aa, Entamoeba dispar
MSVIAAIWFSPKHNRNT

SEQ ID NO: 2387859 - protein, 17 aa, Entamoeba dispar
MSYCNKTRIPNLISTMT

SEQ ID NO: 2387860 - protein, 17 aa, Entamoeba dispar
MTFDIVLPSAIYRGTVD

SEQ ID NO: 2387861 - protein, 24 aa, Entamoeba dispar
MTIIKATVDLVWRVWGAMMSAQPF

SEQ ID NO: 2387862 - protein, 18 aa, Entamoeba dispar
MTIIKFKFIVLYNFHQKY

SEQ ID NO: 2387863 - protein, 18 aa, Entamoeba dispar
MTIQKIPTVWARAIVEAS

SEQ ID NO: 2387864 - protein, 17 aa, Entamoeba dispar
MTIVICVAAIAYVSIFS

SEQ ID NO: 2387865 - protein, 20 aa, Entamoeba dispar
MTLAPSFRINGGLLQEEIQK

SEQ ID NO: 2387866 - protein, 19 aa, Entamoeba dispar
MTMAHIYVMFAFENYLSDM

SEQ ID NO: 2387867 - protein, 23 aa, Entamoeba dispar
MTMTEIRQGPNLYNFKTINGQFK

SEQ ID NO: 2387868 - protein, 21 aa, Entamoeba dispar
MTMYIVFKGKFLRERIQWKIL

SEQ ID NO: 2387869 - protein, 24 aa, Entamoeba dispar
MTRLRGPYIVGFIGACYLEKKMCI

SEQ ID NO: 2387870 - protein, 23 aa, Entamoeba dispar
MTTLTCLFLDFIILAQSNQITTF

SEQ ID NO: 2387871 - protein, 17 aa, Entamoeba dispar
MTVRVGEELDLIGYVKP

SEQ ID NO: 2387872 - protein, 17 aa, Entamoeba dispar
MTYADVIVKGFAVSVAI

SEQ ID NO: 2387873 - protein, 24 aa, Entamoeba dispar
MTYKEFYNLASIERCRIKDPLHNH

SEQ ID NO: 2387874 - protein, 20 aa, Entamoeba dispar
MVCSIICALLAILPAFSNMI

SEQ ID NO: 2387875 - protein, 23 aa, Entamoeba dispar
MVCVFVGIIFYYSFCNEFTTTNY

SEQ ID NO: 2387876 - protein, 18 aa, Entamoeba dispar
MVFPDCLHNSSLYDLTIF

SEQ ID NO: 2387877 - protein, 21 aa, Entamoeba dispar
MVITPTICWVATYLLYKYEIL

SEQ ID NO: 2387878 - protein, 23 aa, Entamoeba dispar
MVKESHFIYSFVIPQLGTVRQPE

SEQ ID NO: 2387879 - protein, 21 aa, Entamoeba dispar
MVLAKYFIKYVGNCLRMEEDM

SEQ ID NO: 2387880 - protein, 20 aa, Entamoeba dispar
MVLFYTRLRRVNVDKQCDGV

SEQ ID NO: 2387881 - protein, 23 aa, Entamoeba dispar
MVLHVRLNFLTQFMVQDETVYKL

SEQ ID NO: 2387882 - protein, 23 aa, Entamoeba dispar
MVLSSPPWNCFSPQIQTDIPLPQ

SEQ ID NO: 2387883 - protein, 27 aa, Entamoeba dispar
MVQLSKCPFCLIMGLFLFVSLEEAPIV

SEQ ID NO: 2387884 - protein, 22 aa, Entamoeba dispar
MVRNILDPCRMISIWFLSVLMY

SEQ ID NO: 2387885 - protein, 25 aa, Entamoeba dispar
MVSSLIKEGYVFDSYIKKFSSKKVN

SEQ ID NO: 2387886 - protein, 23 aa, Entamoeba dispar
MVVELEHLLRIAFITLNDVDIRF

SEQ ID NO: 2387887 - protein, 20 aa, Entamoeba dispar
MWEQYCEKYSFDWSSLTVLI

SEQ ID NO: 2387888 - protein, 18 aa, Entamoeba dispar
MWVVSCFLISYEVPIIIY

SEQ ID NO: 2387889 - protein, 27 aa, Entamoeba dispar
MYAKRGWCDDCLKTLEDVHLFEFELIN

SEQ ID NO: 2387890 - protein, 18 aa, Entamoeba dispar
MYEDACSSGCILPDVCEQ

SEQ ID NO: 2387891 - protein, 20 aa, Entamoeba dispar
MYEILDWKTPYNTPLFPFAW

SEQ ID NO: 2387892 - protein, 24 aa, Entamoeba dispar
MYEILGRVVRLMILFGKNTINANF

SEQ ID NO: 2387893 - protein, 19 aa, Entamoeba dispar
MYEVSIWRNPFPKEQFKYP

SEQ ID NO: 2387894 - protein, 17 aa, Entamoeba dispar
MYFPLIFYYIIGNRIIE

SEQ ID NO: 2387895 - protein, 18 aa, Entamoeba dispar
MYFVDSRGLHGFDNTSSE

SEQ ID NO: 2387896 - protein, 17 aa, Entamoeba dispar
MYIGIIFFFYFLAQTLV

SEQ ID NO: 2387897 - protein, 17 aa, Entamoeba dispar
MYINIDITFPKMKCDDF

SEQ ID NO: 2387898 - protein, 21 aa, Entamoeba dispar
MYIYMYFCIPLTKELYSQSNQ

SEQ ID NO: 2387899 - protein, 18 aa, Entamoeba dispar
MYKELSITIHKNIGNKNK

SEQ ID NO: 2387900 - protein, 21 aa, Entamoeba dispar
MYLEIPRKQILNFLQILISKI

SEQ ID NO: 2387901 - protein, 17 aa, Entamoeba dispar
MYLFEIIGVIIIVVSLA

SEQ ID NO: 2387902 - protein, 19 aa, Entamoeba dispar
MYLLGCGQTTYYYKKSKSD

SEQ ID NO: 2387903 - protein, 19 aa, Entamoeba dispar
MYTQGYEFFYFTKNEPEAF

SEQ ID NO: 2387904 - protein, 24 aa, Entamoeba dispar
MYVLCSPILRNIWEFSTTQHQFLT

SEQ ID NO: 2387905 - protein, 25 aa, Entamoeba dispar
NAAGFWVMICISTFNGLPTPINSSV

SEQ ID NO: 2387906 - protein, 22 aa, Entamoeba dispar
NACIKPKIVSLFKDGDSYEDLG

SEQ ID NO: 2387907 - protein, 17 aa, Entamoeba dispar
NACNKFTTIESEIFLFN

SEQ ID NO: 2387908 - protein, 19 aa, Entamoeba dispar
NAEQIFKFFSMTINQRAKM

SEQ ID NO: 2387909 - protein, 23 aa, Entamoeba dispar
NAERLSGPIVMRAQDLILRLFNK

SEQ ID NO: 2387910 - protein, 17 aa, Entamoeba dispar
NAEWPLIQFQGISGLII

SEQ ID NO: 2387911 - protein, 19 aa, Entamoeba dispar
NAFEFLKPMVDMLLTVTET

SEQ ID NO: 2387912 - protein, 24 aa, Entamoeba dispar
NAGTKFIVSDAMGYVAVYRFTVNE

SEQ ID NO: 2387913 - protein, 19 aa, Entamoeba dispar
NAKLLFDFISSINKGILGQ

SEQ ID NO: 2387914 - protein, 22 aa, Entamoeba dispar
NALKIDCLHPSISTTSISVSSS

SEQ ID NO: 2387915 - protein, 21 aa, Entamoeba dispar
NANIFSISWENPVSLDLSVPS

SEQ ID NO: 2387916 - protein, 18 aa, Entamoeba dispar
NANNLAVYGSMIIVGVWT

SEQ ID NO: 2387917 - protein, 23 aa, Entamoeba dispar
NAPDNECYILWTQVQPVYDNGDF

SEQ ID NO: 2387918 - protein, 19 aa, Entamoeba dispar
NAQDPLNWDTCYGNCYENN

SEQ ID NO: 2387919 - protein, 20 aa, Entamoeba dispar
NASFCTSCPTDYYLDQSTCV

SEQ ID NO: 2387920 - protein, 19 aa, Entamoeba dispar
NASSFILTVFSAFWILSDG

SEQ ID NO: 2387921 - protein, 20 aa, Entamoeba dispar
NASVICGFVALLLMVNGIYM

SEQ ID NO: 2387922 - protein, 18 aa, Entamoeba dispar
NATNMAFLYFVRYPLLEK

SEQ ID NO: 2387923 - protein, 26 aa, Entamoeba dispar
NAVGKEWRIDLTLKLLSVISLDRFGD

SEQ ID NO: 2387924 - protein, 24 aa, Entamoeba dispar
NAVLFVPMLVVSVFFDVKGTKEKQ

SEQ ID NO: 2387925 - protein, 19 aa, Entamoeba dispar
NAVLYLLSFWNKVITSTQL

SEQ ID NO: 2387926 - protein, 18 aa, Entamoeba dispar
NCFLQVGTNMLITFINSF

SEQ ID NO: 2387927 - protein, 28 aa, Entamoeba dispar
NCHDCMGCGLLTCMCCDWCTDCCYVSPY

SEQ ID NO: 2387928 - protein, 18 aa, Entamoeba dispar
NCIIFLLFQFKKLQIECR

SEQ ID NO: 2387929 - protein, 32 aa, Entamoeba dispar
NCIKLLKQRINEIVPISFDWSILSTKIEELQF

SEQ ID NO: 2387930 - protein, 19 aa, Entamoeba dispar
NCIMYSYPTIFEFTPYLLS

SEQ ID NO: 2387931 - protein, 23 aa, Entamoeba dispar
NCISCSVKHCTICTNEMCYNCQE

SEQ ID NO: 2387932 - protein, 17 aa, Entamoeba dispar
NCITSPIGNNGCLLNIR

SEQ ID NO: 2387933 - protein, 30 aa, Entamoeba dispar
NCIVLCLFFWFLRLYSVFNWALEQHLTGLL

SEQ ID NO: 2387934 - protein, 28 aa, Entamoeba dispar
NCKEYNKGRCVICSDGYFLNENGSCDAC

SEQ ID NO: 2387935 - protein, 26 aa, Entamoeba dispar
NCKFYSNGYCKLCKNGEYVNNLQYCS

SEQ ID NO: 2387936 - protein, 18 aa, Entamoeba dispar
NCKIKLKIFLDASKGIQY

SEQ ID NO: 2387937 - protein, 22 aa, Entamoeba dispar
NCKILKMPVDIQIFLTEFIDKE

SEQ ID NO: 2387938 - protein, 26 aa, Entamoeba dispar
NCKTKSCFLPSSLVSLQILGMKNMEE

SEQ ID NO: 2387939 - protein, 24 aa, Entamoeba dispar
NCKYCNSQECFQCEAGYTLVNNGG

SEQ ID NO: 2387940 - protein, 17 aa, Entamoeba dispar
NCLHEIGDWESLDITAK

SEQ ID NO: 2387941 - protein, 21 aa, Entamoeba dispar
NCLRSSNVMGCIECKEGYYLG

SEQ ID NO: 2387942 - protein, 31 aa, Entamoeba dispar
NCLTLSKQIPFIIFQLCDFMTSIIQIGGYDK

SEQ ID NO: 2387943 - protein, 25 aa, Entamoeba dispar
NCNWLLCILSYIAGLSSGFANQTSV

SEQ ID NO: 2387944 - protein, 24 aa, Entamoeba dispar
NCPCKGTYCDIVIYSSIINEPLIN

SEQ ID NO: 2387945 - protein, 21 aa, Entamoeba dispar
NCPYKKIIKSCWRSRSSKRPS

SEQ ID NO: 2387946 - protein, 25 aa, Entamoeba dispar
NCRKYKNGVCVKCFGPYKPINGTCT

SEQ ID NO: 2387947 - protein, 25 aa, Entamoeba dispar
NCSPLSQLNHLFRLFCDKYEGYIKA

SEQ ID NO: 2387948 - protein, 18 aa, Entamoeba dispar
NCSSCLNENYCFRCAPNY

SEQ ID NO: 2387949 - protein, 28 aa, Entamoeba dispar
NCSYFIKEGHKLIINSFFDTVLYNEGTV

SEQ ID NO: 2387950 - protein, 22 aa, Entamoeba dispar
NCTEFQMGPSLPVFNDPSIRRL

SEQ ID NO: 2387951 - protein, 24 aa, Entamoeba dispar
NCVECGGHCKVCYKDSDNQNHCTQ

SEQ ID NO: 2387952 - protein, 19 aa, Entamoeba dispar
NCYSHVWDAHLRHLNGEKE

SEQ ID NO: 2387953 - protein, 18 aa, Entamoeba dispar
NDCELIVEESQPVILYFD

SEQ ID NO: 2387954 - protein, 25 aa, Entamoeba dispar
NDCFLSFLLPLVIAVIIIRAHSCFA

SEQ ID NO: 2387955 - protein, 26 aa, Entamoeba dispar
NDCLSLKLKIKFIIDGAKGIEYLHSN

SEQ ID NO: 2387956 - protein, 25 aa, Entamoeba dispar
NDDSKKFASFVLETEGIELTNLKVK

SEQ ID NO: 2387957 - protein, 21 aa, Entamoeba dispar
NDDVPTWVIVILVIVGVIIVI

SEQ ID NO: 2387958 - protein, 25 aa, Entamoeba dispar
NDEGKGCILLCEVALGRQWETQEDK

SEQ ID NO: 2387959 - protein, 18 aa, Entamoeba dispar
NDEIELLLEIAVENITNL

SEQ ID NO: 2387960 - protein, 17 aa, Entamoeba dispar
NDFMLVMGPSTQINSNT

SEQ ID NO: 2387961 - protein, 23 aa, Entamoeba dispar
NDGKIPLEYAVQLQLPLLVRLIL

SEQ ID NO: 2387962 - protein, 26 aa, Entamoeba dispar
NDGMCCSELKEFCAIINEHEELIKLY

SEQ ID NO: 2387963 - protein, 27 aa, Entamoeba dispar
NDGYVLKDETCSLCGNGKLDEGEECDL

SEQ ID NO: 2387964 - protein, 18 aa, Entamoeba dispar
NDHYHVFAVTGTHEEKVL

SEQ ID NO: 2387965 - protein, 19 aa, Entamoeba dispar
NDIGLFLIMCCKYYNLFQI

SEQ ID NO: 2387966 - protein, 22 aa, Entamoeba dispar
NDIKVLLKNCVLLHSKTNEILQ

SEQ ID NO: 2387967 - protein, 19 aa, Entamoeba dispar
NDILFRSGTYYIPDIIEYT

SEQ ID NO: 2387968 - protein, 21 aa, Entamoeba dispar
NDILLSLGLEEAIVFNQTFNR

SEQ ID NO: 2387969 - protein, 27 aa, Entamoeba dispar
NDIPTVCYIELIAFMAFVNYQKEIPIV

SEQ ID NO: 2387970 - protein, 20 aa, Entamoeba dispar
NDIWQWAFGRIFGKHKPFTF

SEQ ID NO: 2387971 - protein, 25 aa, Entamoeba dispar
NDIYKVGLCLIDFIIENTRIDQIIS

SEQ ID NO: 2387972 - protein, 18 aa, Entamoeba dispar
NDKCLQCEDGYYRDGTLC

SEQ ID NO: 2387973 - protein, 22 aa, Entamoeba dispar
NDKLSYLWIFFTFIILYNNLVP

SEQ ID NO: 2387974 - protein, 17 aa, Entamoeba dispar
NDLKNIFFPYVEQCLSS

SEQ ID NO: 2387975 - protein, 24 aa, Entamoeba dispar
NDLLKIIGVIIVCVVMYFINGFNK

SEQ ID NO: 2387976 - protein, 31 aa, Entamoeba dispar
NDLLSWNRRGCPCDGGQCILKINDEEKPSVD

SEQ ID NO: 2387977 - protein, 22 aa, Entamoeba dispar
NDLTSYFGLIEFYENYLETHKN

SEQ ID NO: 2387978 - protein, 27 aa, Entamoeba dispar
NDLVASYCLMIWIRLGGNGPFEVINYS

SEQ ID NO: 2387979 - protein, 17 aa, Entamoeba dispar
NDMKNAFDVIVNLVNQA

SEQ ID NO: 2387980 - protein, 23 aa, Entamoeba dispar
NDMMMNVMILKTFYPVEEVMNFG

SEQ ID NO: 2387981 - protein, 17 aa, Entamoeba dispar
NDNCVKITLPMYTPDAE

SEQ ID NO: 2387982 - protein, 25 aa, Entamoeba dispar
NDNEIRWGTSTNCGKFIGFTQYYDN

SEQ ID NO: 2387983 - protein, 18 aa, Entamoeba dispar
NDNWCVKVSDFGLSTPLL

SEQ ID NO: 2387984 - protein, 24 aa, Entamoeba dispar
NDPEIYNQLYLLLKLYQNFIKPKN

SEQ ID NO: 2387985 - protein, 20 aa, Entamoeba dispar
NDPKDFYAILGLKNKSNEED

SEQ ID NO: 2387986 - protein, 22 aa, Entamoeba dispar
NDPKDFYAILGLKNKSNEEDIK

SEQ ID NO: 2387987 - protein, 23 aa, Entamoeba dispar
NDQARMFAILSMVFFLVSTIIIV

SEQ ID NO: 2387988 - protein, 24 aa, Entamoeba dispar
NDRFKEWIVESFGKENEQQFYRIA

SEQ ID NO: 2387989 - protein, 20 aa, Entamoeba dispar
NDSCLTCAKDYYLPRNYTGN

SEQ ID NO: 2387990 - protein, 23 aa, Entamoeba dispar
NDSLKWKIVHLNFYTPNETVASD

SEQ ID NO: 2387991 - protein, 25 aa, Entamoeba dispar
NDSRFSLKAQFDRCDYQIFYKHYII

SEQ ID NO: 2387992 - protein, 25 aa, Entamoeba dispar
NDSSIRPSFESIFLDYRIWSGCEKE

SEQ ID NO: 2387993 - protein, 18 aa, Entamoeba dispar
NDTFKIGSPFGGMVYLRL

SEQ ID NO: 2387994 - protein, 24 aa, Entamoeba dispar
NDTQIKFIVCQRIISTDLIGILSR

SEQ ID NO: 2387995 - protein, 21 aa, Entamoeba dispar
NDTTLWVNICEPFDFNNTRLY

SEQ ID NO: 2387996 - protein, 23 aa, Entamoeba dispar
NDWSCLFVLWLSITIQFKINNNH

SEQ ID NO: 2387997 - protein, 23 aa, Entamoeba dispar
NDYFCLLLSFLSYISLLLIFLNY

SEQ ID NO: 2387998 - protein, 26 aa, Entamoeba dispar
NDYLTWNWDEIFKLLTSLSQNMRYVP

SEQ ID NO: 2387999 - protein, 19 aa, Entamoeba dispar
NDYSISLRIQFGEFVYFTG

SEQ ID NO: 2388000 - protein, 24 aa, Entamoeba dispar
NEAMKLYYPYSIELSWLYNENEKI

SEQ ID NO: 2388001 - protein, 32 aa, Entamoeba dispar
NEASTHTFFWICFFLMQFCTVVLVLNLLKKKR

SEQ ID NO: 2388002 - protein, 33 aa, Entamoeba dispar
NEASTHTLFWICFFLMQFCTVVLVLNLLKKKRD

SEQ ID NO: 2388003 - protein, 21 aa, Entamoeba dispar
NECFVHIGGLPRLEQYRCNAF

SEQ ID NO: 2388004 - protein, 17 aa, Entamoeba dispar
NECKQNIISLGNDIKIL

SEQ ID NO: 2388005 - protein, 26 aa, Entamoeba dispar
NECLYFKGEFPHILLERCKSFEERLI

SEQ ID NO: 2388006 - protein, 19 aa, Entamoeba dispar
NECLYRRLENSVVNFCTEM

SEQ ID NO: 2388007 - protein, 18 aa, Entamoeba dispar
NECNILWTQVQPVYDKGN

SEQ ID NO: 2388008 - protein, 17 aa, Entamoeba dispar
NECTSCNKEGYEEDCYV

SEQ ID NO: 2388009 - protein, 25 aa, Entamoeba dispar
NEDTWKCYIVIDIGSIIIIQLISVL

SEQ ID NO: 2388010 - protein, 19 aa, Entamoeba dispar
NEDWVPAVLFGNGKQDISL

SEQ ID NO: 2388011 - protein, 25 aa, Entamoeba dispar
NEEFKEVVKAIGYFIGIHRNELPGS

SEQ ID NO: 2388012 - protein, 18 aa, Entamoeba dispar
NEELNEFITEYYLTTEEC

SEQ ID NO: 2388013 - protein, 24 aa, Entamoeba dispar
NEENCELCQLPFILNDKKECTLCS

SEQ ID NO: 2388014 - protein, 25 aa, Entamoeba dispar
NEFFMYKRWFFELLGKMMRKFQKIK

SEQ ID NO: 2388015 - protein, 24 aa, Entamoeba dispar
NEFIKKVGRKGIIYYLSLLLSTKY

SEQ ID NO: 2388016 - protein, 30 aa, Entamoeba dispar
NEFIKWRILSWKSHEWRNIIYIMCEDAMIK

SEQ ID NO: 2388017 - protein, 29 aa, Entamoeba dispar
NEFIKWRILSWKSNEWRNIIYIMCEDAMI

SEQ ID NO: 2388018 - protein, 24 aa, Entamoeba dispar
NEFMIRCQCALRRISAQQKKYQTH

SEQ ID NO: 2388019 - protein, 30 aa, Entamoeba dispar
NEFNEEVRPSLKWYFMIFFGPNVETMTNSL

SEQ ID NO: 2388020 - protein, 17 aa, Entamoeba dispar
NEFPISVILVKNGGGYV

SEQ ID NO: 2388021 - protein, 24 aa, Entamoeba dispar
NEFSVCPRCCKDKSNFLSLKKRTK

SEQ ID NO: 2388022 - protein, 23 aa, Entamoeba dispar
NEFTQKLSRCFSLKPFKSPIYLS

SEQ ID NO: 2388023 - protein, 31 aa, Entamoeba dispar
NEHEGKGSLCFKAKVTKFGLYGFRKPTSGKF

SEQ ID NO: 2388024 - protein, 25 aa, Entamoeba dispar
NEHLHLFKGDIPFVVVQQTKDAIDA

SEQ ID NO: 2388025 - protein, 23 aa, Entamoeba dispar
NEIGDIPHLLLFKNINILIKDYL

SEQ ID NO: 2388026 - protein, 22 aa, Entamoeba dispar
NEIIPMISLILFIIHYFRRSII

SEQ ID NO: 2388027 - protein, 22 aa, Entamoeba dispar
NEIKRRIIILCIPTLLLFISVL

SEQ ID NO: 2388028 - protein, 24 aa, Entamoeba dispar
NEINRFLDVAGFVPALSKVYITCA

SEQ ID NO: 2388029 - protein, 17 aa, Entamoeba dispar
NEISKMFNYMKEHQKLI

SEQ ID NO: 2388030 - protein, 21 aa, Entamoeba dispar
NEIYHLLEIILILVSSQNIQI

SEQ ID NO: 2388031 - protein, 17 aa, Entamoeba dispar
NEKGKRGKGKICEKIHL

SEQ ID NO: 2388032 - protein, 18 aa, Entamoeba dispar
NEKRKGIGTLAIEEESFH

SEQ ID NO: 2388033 - protein, 24 aa, Entamoeba dispar
NEKYFWELCWDILRSNSISRKPLL

SEQ ID NO: 2388034 - protein, 21 aa, Entamoeba dispar
NELFEQILLSIHYCLEYLQLS

SEQ ID NO: 2388035 - protein, 25 aa, Entamoeba dispar
NELIVNELIYCFKKCLESTEYNLLI

SEQ ID NO: 2388036 - protein, 28 aa, Entamoeba dispar
NELKERYLLSENIDFLWTENKKEYALLV

SEQ ID NO: 2388037 - protein, 21 aa, Entamoeba dispar
NELLIIKVCCDVIEGLVELKK

SEQ ID NO: 2388038 - protein, 23 aa, Entamoeba dispar
NELNTFYCCIAFLSKQSIYYSNK

SEQ ID NO: 2388039 - protein, 24 aa, Entamoeba dispar
NELRFLHIFPLNIIFACYNGYLTL

SEQ ID NO: 2388040 - protein, 24 aa, Entamoeba dispar
NELRKGSHCLYKIIKDIYFPTKEI

SEQ ID NO: 2388041 - protein, 21 aa, Entamoeba dispar
NELTESLFLIGDQKLIFDIVE

SEQ ID NO: 2388042 - protein, 19 aa, Entamoeba dispar
NELWYYIKVDNTFTSIPTN

SEQ ID NO: 2388043 - protein, 20 aa, Entamoeba dispar
NELYRKPMIEAAKNGQINEK

SEQ ID NO: 2388044 - protein, 22 aa, Entamoeba dispar
NEMGEIPLIVAIKHKQTSTINI

SEQ ID NO: 2388045 - protein, 19 aa, Entamoeba dispar
NEMRWKKPLTIKRFIAVLI

SEQ ID NO: 2388046 - protein, 17 aa, Entamoeba dispar
NENIPREFIKDVIDERV

SEQ ID NO: 2388047 - protein, 24 aa, Entamoeba dispar
NENKLWEEWKIKYGKTYNSINEIH

SEQ ID NO: 2388048 - protein, 26 aa, Entamoeba dispar
NENSKMVKCWIEFIEGKAMNINETFN

SEQ ID NO: 2388049 - protein, 28 aa, Entamoeba dispar
NEPIRFIFHGGDYLKYTISFIPAILSVH

SEQ ID NO: 2388050 - protein, 25 aa, Entamoeba dispar
NEQVKIRICQDISKGMEYLHINDIL

SEQ ID NO: 2388051 - protein, 24 aa, Entamoeba dispar
NERYFWELCWDILRSNSISRKPLL

SEQ ID NO: 2388052 - protein, 23 aa, Entamoeba dispar
NESFIKLKFEGIFDFSYDIITII

SEQ ID NO: 2388053 - protein, 23 aa, Entamoeba dispar
NESFKAFVEFIIRIVNDHCVPLN

SEQ ID NO: 2388054 - protein, 26 aa, Entamoeba dispar
NESILRAKIFKRIAFVIYCGEKEAFD

SEQ ID NO: 2388055 - protein, 19 aa, Entamoeba dispar
NESLFPLCKTVVVNNFKEQ

SEQ ID NO: 2388056 - protein, 22 aa, Entamoeba dispar
NESMKLLPCKHYFHSSCIDEWI

SEQ ID NO: 2388057 - protein, 25 aa, Entamoeba dispar
NETCSLCPINCRRCINNKCILCEDY

SEQ ID NO: 2388058 - protein, 20 aa, Entamoeba dispar
NETDCALLLFLKKIGISPSL

SEQ ID NO: 2388059 - protein, 18 aa, Entamoeba dispar
NETIHFPVECVSELPQRI

SEQ ID NO: 2388060 - protein, 25 aa, Entamoeba dispar
NEVGECIQCSIGFVLDSNNPVACIE

SEQ ID NO: 2388061 - protein, 22 aa, Entamoeba dispar
NEVIPLISCDSINTKVTNVKEA

SEQ ID NO: 2388062 - protein, 32 aa, Entamoeba dispar
NEVPPSYNIWLLICTAIFGALIIITATSSIIY

SEQ ID NO: 2388063 - protein, 20 aa, Entamoeba dispar
NEWCLNRHFFTFIFDQLEVV

SEQ ID NO: 2388064 - protein, 19 aa, Entamoeba dispar
NEWKWGNFGILFTHISVAF

SEQ ID NO: 2388065 - protein, 17 aa, Entamoeba dispar
NEWWAKNGYLVSLHDFG

SEQ ID NO: 2388066 - protein, 23 aa, Entamoeba dispar
NEYIPLLIQCISYFIQKDLSLSL

SEQ ID NO: 2388067 - protein, 30 aa, Entamoeba dispar
NEYNVKFGIFKDFVEEVVKSEGSNKITFHP

SEQ ID NO: 2388068 - protein, 17 aa, Entamoeba dispar
NEYPMFHPLSFFKRNYQ

SEQ ID NO: 2388069 - protein, 19 aa, Entamoeba dispar
NFASYFYWLVVPLKCVDMG

SEQ ID NO: 2388070 - protein, 22 aa, Entamoeba dispar
NFCSCKFSISLLQTILKSKSKE

SEQ ID NO: 2388071 - protein, 30 aa, Entamoeba dispar
NFDIKFYSCISWSIHCCIMAFEKASRYEQR

SEQ ID NO: 2388072 - protein, 26 aa, Entamoeba dispar
NFEEGRKCLWISILIDSITIVLLLSI

SEQ ID NO: 2388073 - protein, 18 aa, Entamoeba dispar
NFEIKYCDRWAYEQQMTN

SEQ ID NO: 2388074 - protein, 28 aa, Entamoeba dispar
NFENFFFKTKVYQILLSKEFRDLSNLKE

SEQ ID NO: 2388075 - protein, 25 aa, Entamoeba dispar
NFESCKNSTAAQCFLCKQKVVEDED

SEQ ID NO: 2388076 - protein, 19 aa, Entamoeba dispar
NFFECLVIGMILCSEVCYI

SEQ ID NO: 2388077 - protein, 25 aa, Entamoeba dispar
NFFIKNFYEVLAFCYQLGVFISRSS

SEQ ID NO: 2388078 - protein, 31 aa, Entamoeba dispar
NFFIVSFSFCCLACWVVFMFQPTFSCSVSTP

SEQ ID NO: 2388079 - protein, 17 aa, Entamoeba dispar
NFFKEEKDLEIVEDFCI

SEQ ID NO: 2388080 - protein, 25 aa, Entamoeba dispar
NFFQSLKMKIFFQIHQHAPMCLMWI

SEQ ID NO: 2388081 - protein, 26 aa, Entamoeba dispar
NFGDNGSICIIEFLKELRGIALNRSN

SEQ ID NO: 2388082 - protein, 24 aa, Entamoeba dispar
NFHHKYPCFDGCFHFPRKNSFLVQ

SEQ ID NO: 2388083 - protein, 17 aa, Entamoeba dispar
NFIDAKNVMALMCKKPT

SEQ ID NO: 2388084 - protein, 19 aa, Entamoeba dispar
NFIKIPKKIFISLIGKGFN

SEQ ID NO: 2388085 - protein, 25 aa, Entamoeba dispar
NFINKCLDKCIRRGDILLGPPTLQL

SEQ ID NO: 2388086 - protein, 25 aa, Entamoeba dispar
NFIQKEILGSFVLPSMKSFEIPDVT

SEQ ID NO: 2388087 - protein, 31 aa, Entamoeba dispar
NFKILIQLYQAFCKFALIYIRANSKNESRSE

SEQ ID NO: 2388088 - protein, 25 aa, Entamoeba dispar
NFKKEVEMLYKIRCDYIVHFYGAFC

SEQ ID NO: 2388089 - protein, 25 aa, Entamoeba dispar
NFLGEILRSIKFIKYNAWEEPLHKR

SEQ ID NO: 2388090 - protein, 21 aa, Entamoeba dispar
NFNCLRKKIIQCDSGYYYDSN

SEQ ID NO: 2388091 - protein, 20 aa, Entamoeba dispar
NFNEIYFKIMENFESEVKLL

SEQ ID NO: 2388092 - protein, 24 aa, Entamoeba dispar
NFPQHILPLVFNWPSSQNAACYYC

SEQ ID NO: 2388093 - protein, 27 aa, Entamoeba dispar
NFPTFKDKWWPSGVMDFFTMAPFITAN

SEQ ID NO: 2388094 - protein, 27 aa, Entamoeba dispar
NFRKWCCIGCGITIILAMAIHPTTVSI

SEQ ID NO: 2388095 - protein, 25 aa, Entamoeba dispar
NFTCTYRKDIICGRVEIIEQKVYRK

SEQ ID NO: 2388096 - protein, 21 aa, Entamoeba dispar
NFVEECSFILGLTASACEDID

SEQ ID NO: 2388097 - protein, 17 aa, Entamoeba dispar
NFVYLAITFCPYTLDDY

SEQ ID NO: 2388098 - protein, 24 aa, Entamoeba dispar
NFWKGENFGVLATRGKDEGLTVRI

SEQ ID NO: 2388099 - protein, 27 aa, Entamoeba dispar
NFYFDSFKAILPFKFIIDQSTVKTQII

SEQ ID NO: 2388100 - protein, 20 aa, Entamoeba dispar
NFYRLCITGLLFNFSAYFLW

SEQ ID NO: 2388101 - protein, 17 aa, Entamoeba dispar
NGACSFGSISTTINKGY

SEQ ID NO: 2388102 - protein, 17 aa, Entamoeba dispar
NGAISTFTLFAFVLLAF

SEQ ID NO: 2388103 - protein, 18 aa, Entamoeba dispar
NGAKRFGYNGGDNNEVQE

SEQ ID NO: 2388104 - protein, 26 aa, Entamoeba dispar
NGCIKKFNLEYCLYYKIIEQKMSINH

SEQ ID NO: 2388105 - protein, 18 aa, Entamoeba dispar
NGCKIGNETYCYQCKEEF

SEQ ID NO: 2388106 - protein, 18 aa, Entamoeba dispar
NGCKIGNETYCYQCKEGF

SEQ ID NO: 2388107 - protein, 17 aa, Entamoeba dispar
NGCLMCIDNYYFDIKTQ

SEQ ID NO: 2388108 - protein, 22 aa, Entamoeba dispar
NGCLRCSDGFFLLNNECSKCDD

SEQ ID NO: 2388109 - protein, 23 aa, Entamoeba dispar
NGCYKPDMCSLCNTTRYTKDCTG

SEQ ID NO: 2388110 - protein, 19 aa, Entamoeba dispar
NGECLLCSSYYPNCEECSL

SEQ ID NO: 2388111 - protein, 23 aa, Entamoeba dispar
NGEIKTLPNYIGFEGGQEDHDCA

SEQ ID NO: 2388112 - protein, 21 aa, Entamoeba dispar
NGEIRYGNWKIIKVESNEITT

SEQ ID NO: 2388113 - protein, 24 aa, Entamoeba dispar
NGEKIIGPWYVRRKKIQDALQAEN

SEQ ID NO: 2388114 - protein, 24 aa, Entamoeba dispar
NGFLWDISYDYSFDNYDYYQESSK

SEQ ID NO: 2388115 - protein, 18 aa, Entamoeba dispar
NGFYICFESETFDSVQFT

SEQ ID NO: 2388116 - protein, 21 aa, Entamoeba dispar
NGIGLCFFSDIIFVREASPTS

SEQ ID NO: 2388117 - protein, 22 aa, Entamoeba dispar
NGIKEVIPLLLQQLSYYSELLL

SEQ ID NO: 2388118 - protein, 22 aa, Entamoeba dispar
NGISIDQLVCFGECTLVGDFVV

SEQ ID NO: 2388119 - protein, 18 aa, Entamoeba dispar
NGITGIFLGNIVYIISSM

SEQ ID NO: 2388120 - protein, 17 aa, Entamoeba dispar
NGITGIFLGNTVYLISS

SEQ ID NO: 2388121 - protein, 20 aa, Entamoeba dispar
NGKAGGWAVVSMYLTFSGFF

SEQ ID NO: 2388122 - protein, 18 aa, Entamoeba dispar
NGKIRIGTLQLYETEIEE

SEQ ID NO: 2388123 - protein, 26 aa, Entamoeba dispar
NGKKFFPLGCYMNWYDDFDIEHFKDS

SEQ ID NO: 2388124 - protein, 19 aa, Entamoeba dispar
NGKLLWNIWMEKDDNGDIA

SEQ ID NO: 2388125 - protein, 27 aa, Entamoeba dispar
NGKLVKERVPVIFAFAMNGKRKELFDN

SEQ ID NO: 2388126 - protein, 24 aa, Entamoeba dispar
NGLECSYALLPYETLLRMNLLIRP

SEQ ID NO: 2388127 - protein, 23 aa, Entamoeba dispar
NGLKEYLEVYVLKDILKNPPQPS

SEQ ID NO: 2388128 - protein, 17 aa, Entamoeba dispar
NGLKKSFLVNTFMPSKA

SEQ ID NO: 2388129 - protein, 18 aa, Entamoeba dispar
NGLPRKKYEYDFSGIFLN

SEQ ID NO: 2388130 - protein, 17 aa, Entamoeba dispar
NGLYGIHLLWEVAMANK

SEQ ID NO: 2388131 - protein, 18 aa, Entamoeba dispar
NGNGWIGVNMLDGQYFAL

SEQ ID NO: 2388132 - protein, 25 aa, Entamoeba dispar
NGPIPSESLPQVYSRMEKEENDFNS

SEQ ID NO: 2388133 - protein, 18 aa, Entamoeba dispar
NGSCLKCPLYCYEGSCLD

SEQ ID NO: 2388134 - protein, 23 aa, Entamoeba dispar
NGTCVACAYGYWLDPEYGKCVEN

SEQ ID NO: 2388135 - protein, 23 aa, Entamoeba dispar
NGTLELRCKIIFENLNRLQKDSL

SEQ ID NO: 2388136 - protein, 21 aa, Entamoeba dispar
NGVERNGLCFSIKRIEIDKQK

SEQ ID NO: 2388137 - protein, 28 aa, Entamoeba dispar
NGVFYNDIYCVFTGIMLCLIGYLMYKTK

SEQ ID NO: 2388138 - protein, 17 aa, Entamoeba dispar
NGVLKWRKGIIPNTTIK

SEQ ID NO: 2388139 - protein, 25 aa, Entamoeba dispar
NGVWQCIRLNAMITQACGENDDFLQ

SEQ ID NO: 2388140 - protein, 29 aa, Entamoeba dispar
NGYGCKRCKEGYYLTKDMKCLKCDDKCET

SEQ ID NO: 2388141 - protein, 24 aa, Entamoeba dispar
NGYLRIAAPFFDYSHLDAAKQPSV

SEQ ID NO: 2388142 - protein, 26 aa, Entamoeba dispar
NGYVLRSGYCYKYLNNINCISINSNL

SEQ ID NO: 2388143 - protein, 22 aa, Entamoeba dispar
NHCTQCPEGCFLQLEDNKDTGI

SEQ ID NO: 2388144 - protein, 30 aa, Entamoeba dispar
NHEKELFIIKYLERENILILSKETLESYLI

SEQ ID NO: 2388145 - protein, 23 aa, Entamoeba dispar
NHFKMKSSQNMRIIPMVSKGIIK

SEQ ID NO: 2388146 - protein, 28 aa, Entamoeba dispar
NHIFMCCCGLLFDFGVYFYWLVIPVLLK

SEQ ID NO: 2388147 - protein, 21 aa, Entamoeba dispar
NHIYESFELFGGVLNKYKQSL

SEQ ID NO: 2388148 - protein, 25 aa, Entamoeba dispar
NHQEKIFSLWGFIISYIVSKGGIVT

SEQ ID NO: 2388149 - protein, 28 aa, Entamoeba dispar
NHSHVYSLCFFRVLYLDCLLSEALVYFW

SEQ ID NO: 2388150 - protein, 24 aa, Entamoeba dispar
NIAHGYCSFKEIFNQKDLTTLLIF

SEQ ID NO: 2388151 - protein, 24 aa, Entamoeba dispar
NIALCYVCNPQIKKMEKIASVVEE

SEQ ID NO: 2388152 - protein, 22 aa, Entamoeba dispar
NIALPCIVLKALINQHSLDSDA

SEQ ID NO: 2388153 - protein, 18 aa, Entamoeba dispar
NIASIILKLFENSINFGY

SEQ ID NO: 2388154 - protein, 18 aa, Entamoeba dispar
NICVPKCDIEGCINGCIS

SEQ ID NO: 2388155 - protein, 20 aa, Entamoeba dispar
NIDLLWSMKNIIHIQYNKQK

SEQ ID NO: 2388156 - protein, 39 aa, Entamoeba dispar
NIDLTKCKMCIICLKELLLLLRYTPRYEQDEGIIKLWSI

SEQ ID NO: 2388157 - protein, 26 aa, Entamoeba dispar
NIDMNFILSCLIIFIANAETVSFVLD

SEQ ID NO: 2388158 - protein, 24 aa, Entamoeba dispar
NIEIRLPVKYSLPIFNTSIYPLFS

SEQ ID NO: 2388159 - protein, 22 aa, Entamoeba dispar
NIEISSLFATLVAIFKKYIILI

SEQ ID NO: 2388160 - protein, 20 aa, Entamoeba dispar
NIFCCTFKYNNDESIRSGFI

SEQ ID NO: 2388161 - protein, 17 aa, Entamoeba dispar
NIFCLQKINSLIENFEE

SEQ ID NO: 2388162 - protein, 28 aa, Entamoeba dispar
NIFEECIKKGIEIIGIIYNITRSNKDRD

SEQ ID NO: 2388163 - protein, 17 aa, Entamoeba dispar
NIFGGFFITYRMLKMFH

SEQ ID NO: 2388164 - protein, 17 aa, Entamoeba dispar
NIFKEVMLLSSSVICCR

SEQ ID NO: 2388165 - protein, 17 aa, Entamoeba dispar
NIFNAIISYLIDLFPND

SEQ ID NO: 2388166 - protein, 23 aa, Entamoeba dispar
NIFTMCCCFVFGINYLLLYAAFT

SEQ ID NO: 2388167 - protein, 27 aa, Entamoeba dispar
NIFTMICFFCFGLNFLIYYNAVVNMGD

SEQ ID NO: 2388168 - protein, 18 aa, Entamoeba dispar
NIFYSILYFYYLGGIHQL

SEQ ID NO: 2388169 - protein, 25 aa, Entamoeba dispar
NIGGKYLCDKECFTSVIGIQKELSL

SEQ ID NO: 2388170 - protein, 32 aa, Entamoeba dispar
NIGTNSTVVWNGCVSFKHSITFETTPTLNQPQ

SEQ ID NO: 2388171 - protein, 26 aa, Entamoeba dispar
NIHLYLRNRCSPLAYHFLDAQFDHTS

SEQ ID NO: 2388172 - protein, 17 aa, Entamoeba dispar
NIICINKIFTFYDTQHY

SEQ ID NO: 2388173 - protein, 20 aa, Entamoeba dispar
NIIKRFSFSSSNQITINALI

SEQ ID NO: 2388174 - protein, 23 aa, Entamoeba dispar
NIIKTLFYWRNEKIIHQHPLLIS

SEQ ID NO: 2388175 - protein, 19 aa, Entamoeba dispar
NIILGMIVKLAIIVLLILS

SEQ ID NO: 2388176 - protein, 24 aa, Entamoeba dispar
NIILRNDINTFLGLQISPLKSMII

SEQ ID NO: 2388177 - protein, 24 aa, Entamoeba dispar
NIIRPHFSSLLSRFSEKAISMDNS

SEQ ID NO: 2388178 - protein, 19 aa, Entamoeba dispar
NIITCLSIIYYIYITYLGY

SEQ ID NO: 2388179 - protein, 26 aa, Entamoeba dispar
NIITGLCAIIYYIPRSSFKNDTLQYF

SEQ ID NO: 2388180 - protein, 23 aa, Entamoeba dispar
NIKELYTVDGLDEMKLIALLLVY

SEQ ID NO: 2388181 - protein, 25 aa, Entamoeba dispar
NIKIDGVSSYKCGTYYRIGTVNTCA

SEQ ID NO: 2388182 - protein, 25 aa, Entamoeba dispar
NIKRLCIAGELFSEAGFFQRSDQKN

SEQ ID NO: 2388183 - protein, 19 aa, Entamoeba dispar
NIKSYPIWTNWWGENFHWR

SEQ ID NO: 2388184 - protein, 18 aa, Entamoeba dispar
NIKVCPGYYYKIKYNTIY

SEQ ID NO: 2388185 - protein, 22 aa, Entamoeba dispar
NILCSFYGFNLFSKKGLSFIYL

SEQ ID NO: 2388186 - protein, 19 aa, Entamoeba dispar
NILCTSSIIGSKVCLELSS

SEQ ID NO: 2388187 - protein, 18 aa, Entamoeba dispar
NILELVFCVIMLYMKGNK

SEQ ID NO: 2388188 - protein, 25 aa, Entamoeba dispar
NILEPMRMISVWIVSVFIHYVISSS

SEQ ID NO: 2388189 - protein, 21 aa, Entamoeba dispar
NILFKNPIIFSSISIPLLPLL

SEQ ID NO: 2388190 - protein, 19 aa, Entamoeba dispar
NILINFIKTMFLRIIESTS

SEQ ID NO: 2388191 - protein, 24 aa, Entamoeba dispar
NILKGICIKTECSFDNLYQSEFIA

SEQ ID NO: 2388192 - protein, 25 aa, Entamoeba dispar
NILKKFKGGEGFQLIDKKMKLSIPK

SEQ ID NO: 2388193 - protein, 20 aa, Entamoeba dispar
NILKTYLLYIVIQKNIVLTV

SEQ ID NO: 2388194 - protein, 21 aa, Entamoeba dispar
NILSYDICILINQFNDNRKEF

SEQ ID NO: 2388195 - protein, 23 aa, Entamoeba dispar
NILTLPGCLIVLPTLIECLNTSK

SEQ ID NO: 2388196 - protein, 23 aa, Entamoeba dispar
NILYDLCLEMGYFFDARLSRKTE

SEQ ID NO: 2388197 - protein, 20 aa, Entamoeba dispar
NIMRLPLIRFPKLLNDTMQG

SEQ ID NO: 2388198 - protein, 23 aa, Entamoeba dispar
NINELVFQFLIQLSIYRSMIAFK

SEQ ID NO: 2388199 - protein, 23 aa, Entamoeba dispar
NINLTLPANFVFSDDQVLILKNS

SEQ ID NO: 2388200 - protein, 20 aa, Entamoeba dispar
NINSCLVDRCLISEKKDDGY

SEQ ID NO: 2388201 - protein, 32 aa, Entamoeba dispar
NIPDSFPPEMAKLISDCWVEDPSLRPKFTEIE

SEQ ID NO: 2388202 - protein, 19 aa, Entamoeba dispar
NIPELSCVVSDTFRSSSFS

SEQ ID NO: 2388203 - protein, 17 aa, Entamoeba dispar
NIPLLRKTLQLIPPYLV

SEQ ID NO: 2388204 - protein, 23 aa, Entamoeba dispar
NIPNGIECLSMIIYSNFFESPLF

SEQ ID NO: 2388205 - protein, 25 aa, Entamoeba dispar
NIPWSHLCVYFWKTKVLTFIVPILI

SEQ ID NO: 2388206 - protein, 24 aa, Entamoeba dispar
NIQFPHIYLVVLGFYTLVYLDDNL

SEQ ID NO: 2388207 - protein, 28 aa, Entamoeba dispar
NIQLLECQRWCFATLKLILLNPNKKVFS

SEQ ID NO: 2388208 - protein, 28 aa, Entamoeba dispar
NIQLQIKWLRKFFIQEIIKLIEKSSSEN

SEQ ID NO: 2388209 - protein, 18 aa, Entamoeba dispar
NIRFVIDSLLTFYSKHIC

SEQ ID NO: 2388210 - protein, 22 aa, Entamoeba dispar
NISEGIQLFYLVYHKSPQMKCK

SEQ ID NO: 2388211 - protein, 27 aa, Entamoeba dispar
NISLSESWIRFTVYISIIIQILVSSIT

SEQ ID NO: 2388212 - protein, 18 aa, Entamoeba dispar
NISVLFAGIVIGAISTIL

SEQ ID NO: 2388213 - protein, 18 aa, Entamoeba dispar
NITECPLLDPSSLKQLTQ

SEQ ID NO: 2388214 - protein, 27 aa, Entamoeba dispar
NITKATVIPFCLFFFNLFIKVIEVLII

SEQ ID NO: 2388215 - protein, 25 aa, Entamoeba dispar
NIVIILKHYISFILKINNTSKIYII

SEQ ID NO: 2388216 - protein, 19 aa, Entamoeba dispar
NIVYWIKFEFALRRYQFNI

SEQ ID NO: 2388217 - protein, 19 aa, Entamoeba dispar
NIWCGKSISGGNEMIAVKG

SEQ ID NO: 2388218 - protein, 18 aa, Entamoeba dispar
NIYFLNSCGIDYYNKNST

SEQ ID NO: 2388219 - protein, 32 aa, Entamoeba dispar
NIYRVSMNEPIRWRKHYHSWNIFFLSGSVIFV

SEQ ID NO: 2388220 - protein, 20 aa, Entamoeba dispar
NIYVSFNLLLSFGMILFNDP

SEQ ID NO: 2388221 - protein, 28 aa, Entamoeba dispar
NKAEDVFKIIFRLAPNHCFAHYLRGVLF

SEQ ID NO: 2388222 - protein, 33 aa, Entamoeba dispar
NKCKKCTIDNCKYCTSSNCLLCNDNYQLKDNKC

SEQ ID NO: 2388223 - protein, 19 aa, Entamoeba dispar
NKCQNCSDMYGLDCVSCNI

SEQ ID NO: 2388224 - protein, 22 aa, Entamoeba dispar
NKCSECDMNYGYCIGCEKDFIL

SEQ ID NO: 2388225 - protein, 25 aa, Entamoeba dispar
NKCTAGCSICEGGKCLQCEKKEDIL

SEQ ID NO: 2388226 - protein, 19 aa, Entamoeba dispar
NKCVNFWKGENFGVLATRG

SEQ ID NO: 2388227 - protein, 21 aa, Entamoeba dispar
NKDAFSPPSFIVVKVNNKPVR

SEQ ID NO: 2388228 - protein, 25 aa, Entamoeba dispar
NKDYCYRSSQIIGFIINSHKSEKNI

SEQ ID NO: 2388229 - protein, 20 aa, Entamoeba dispar
NKEIRELICIGNENKEKKKI

SEQ ID NO: 2388230 - protein, 18 aa, Entamoeba dispar
NKELLKKDYISLKHVLNN

SEQ ID NO: 2388231 - protein, 18 aa, Entamoeba dispar
NKEMVWWMIMIIIIIILI

SEQ ID NO: 2388232 - protein, 20 aa, Entamoeba dispar
NKEMVWWMIMIIIIIILIII

SEQ ID NO: 2388233 - protein, 28 aa, Entamoeba dispar
NKERVRLMKECAIGVYYLHSLGIVHRDI

SEQ ID NO: 2388234 - protein, 21 aa, Entamoeba dispar
NKETRELLCIANRSKHPIQIS

SEQ ID NO: 2388235 - protein, 17 aa, Entamoeba dispar
NKFSCVRTCKDKCIDCD

SEQ ID NO: 2388236 - protein, 17 aa, Entamoeba dispar
NKFYPFIQQYLTIINQT

SEQ ID NO: 2388237 - protein, 22 aa, Entamoeba dispar
NKGNKYNIDWSFIGSAPLCGIN

SEQ ID NO: 2388238 - protein, 20 aa, Entamoeba dispar
NKGRFVIFVCIVFINSVTAW

SEQ ID NO: 2388239 - protein, 36 aa, Entamoeba dispar
NKGRVSVVSSFIFFSFIIPLAFGYAVWRPMTLLWTL

SEQ ID NO: 2388240 - protein, 17 aa, Entamoeba dispar
NKGSLLLLNLVDNKFYH

SEQ ID NO: 2388241 - protein, 25 aa, Entamoeba dispar
NKHNWIKQNWLVLILITGVLLLTVL

SEQ ID NO: 2388242 - protein, 19 aa, Entamoeba dispar
NKIGDCYLVKERPEEKESI

SEQ ID NO: 2388243 - protein, 27 aa, Entamoeba dispar
NKIILSRLCMMLKYMIEHFKENGNEII

SEQ ID NO: 2388244 - protein, 17 aa, Entamoeba dispar
NKIKILLVILKLNVSFN

SEQ ID NO: 2388245 - protein, 21 aa, Entamoeba dispar
NKKAWKYALISILSIVDMDLC

SEQ ID NO: 2388246 - protein, 22 aa, Entamoeba dispar
NKKEWIIIIVFIIAVIVIGIII

SEQ ID NO: 2388247 - protein, 23 aa, Entamoeba dispar
NKKFKISFSIIFTTLILFLIFVC

SEQ ID NO: 2388248 - protein, 21 aa, Entamoeba dispar
NKKGCAICKNGYYYDKKNYRC

SEQ ID NO: 2388249 - protein, 21 aa, Entamoeba dispar
NKKGEWVRIRAIPFKPTNNLK

SEQ ID NO: 2388250 - protein, 24 aa, Entamoeba dispar
NKKGKIFFRNGCNIQTINNSSMEF

SEQ ID NO: 2388251 - protein, 23 aa, Entamoeba dispar
NKKKIPITLEWGNWKIVRHSMED

SEQ ID NO: 2388252 - protein, 21 aa, Entamoeba dispar
NKKRIRYCPKVIFNKRVICIL

SEQ ID NO: 2388253 - protein, 23 aa, Entamoeba dispar
NKKTCLWMTPFLIILAYIHLIAC

SEQ ID NO: 2388254 - protein, 25 aa, Entamoeba dispar
NKLFKRLKETTLFASNHVIHALAYY

SEQ ID NO: 2388255 - protein, 25 aa, Entamoeba dispar
NKLHGGWKYLFIVLSRFEQMNLIEH

SEQ ID NO: 2388256 - protein, 31 aa, Entamoeba dispar
NKLKDFIRLLILRHKHFLFEGTSQFSAILLK

SEQ ID NO: 2388257 - protein, 17 aa, Entamoeba dispar
NKLLILFGNTMENKGYY

SEQ ID NO: 2388258 - protein, 22 aa, Entamoeba dispar
NKLNHQECFTLNGILLEPPFLS

SEQ ID NO: 2388259 - protein, 28 aa, Entamoeba dispar
NKLRLIYNSMDFCCRHYVNLFEESEQLS

SEQ ID NO: 2388260 - protein, 20 aa, Entamoeba dispar
NKLSAWDYLLFLNGIVLASI

SEQ ID NO: 2388261 - protein, 21 aa, Entamoeba dispar
NKMLFFYKQIIIFYYFVNYQT

SEQ ID NO: 2388262 - protein, 23 aa, Entamoeba dispar
NKMSYEYCEGLLFIAQHNEELSK

SEQ ID NO: 2388263 - protein, 23 aa, Entamoeba dispar
NKMTFFYSCLNQICVCLIGLIAI

SEQ ID NO: 2388264 - protein, 19 aa, Entamoeba dispar
NKNAIVFLAPFSVSVPEAL

SEQ ID NO: 2388265 - protein, 23 aa, Entamoeba dispar
NKNCFKDAFEIEYLPSINGIILI

SEQ ID NO: 2388266 - protein, 25 aa, Entamoeba dispar
NKNFICDSIELGMLFIHDGYHFHLF

SEQ ID NO: 2388267 - protein, 24 aa, Entamoeba dispar
NKPEQFKSLLLVYGPFVSSIKLFN

SEQ ID NO: 2388268 - protein, 25 aa, Entamoeba dispar
NKPLKMGCLTCGYEDIIFIATNHEV

SEQ ID NO: 2388269 - protein, 20 aa, Entamoeba dispar
NKPRVSEMDILKSLINENYF

SEQ ID NO: 2388270 - protein, 19 aa, Entamoeba dispar
NKPVRFGVINEEYLKNRSE

SEQ ID NO: 2388271 - protein, 34 aa, Entamoeba dispar
NKRSPFRIEVLFKLIGPALCDFLGGYLMNVGLMY

SEQ ID NO: 2388272 - protein, 23 aa, Entamoeba dispar
NKRYEWMAFLLAATRQGIVIVTV

SEQ ID NO: 2388273 - protein, 25 aa, Entamoeba dispar
NKRYKRAVWYKVFVPRRGTISVNTC

SEQ ID NO: 2388274 - protein, 24 aa, Entamoeba dispar
NKSEIKRLCEMYMVEIDPMLDIQQ

SEQ ID NO: 2388275 - protein, 22 aa, Entamoeba dispar
NKSFFKRYGLENIISNDQPIAE

SEQ ID NO: 2388276 - protein, 18 aa, Entamoeba dispar
NKSFGRSWLSPRKLLQSS

SEQ ID NO: 2388277 - protein, 17 aa, Entamoeba dispar
NKSHGFSSIKLIPYQED

SEQ ID NO: 2388278 - protein, 24 aa, Entamoeba dispar
NKSHLRYGQCLELVGPTKIPIHCS

SEQ ID NO: 2388279 - protein, 17 aa, Entamoeba dispar
NKSYVNGKCVECLNTYS

SEQ ID NO: 2388280 - protein, 23 aa, Entamoeba dispar
NKTRIAITSSIGFFIVGLIFQLL

SEQ ID NO: 2388281 - protein, 19 aa, Entamoeba dispar
NKVFPIFSECLIKKEVLSL

SEQ ID NO: 2388282 - protein, 19 aa, Entamoeba dispar
NKVLQWSIFNGFDVLLETY

SEQ ID NO: 2388283 - protein, 17 aa, Entamoeba dispar
NKWIPMNYECFKTNQDS

SEQ ID NO: 2388284 - protein, 17 aa, Entamoeba dispar
NKWMYLIIVCVGVLIIP

SEQ ID NO: 2388285 - protein, 21 aa, Entamoeba dispar
NKWNDIFFYFLFNTAAIGSVI

SEQ ID NO: 2388286 - protein, 19 aa, Entamoeba dispar
NKYKMSLWVSYLEGEEQAD

SEQ ID NO: 2388287 - protein, 22 aa, Entamoeba dispar
NKYNGMFQLGLDMLKRLEKHQT

SEQ ID NO: 2388288 - protein, 27 aa, Entamoeba dispar
NKYPNVICKYIEWGRIEVIKEVIENQR

SEQ ID NO: 2388289 - protein, 23 aa, Entamoeba dispar
NLAKDGLRTLVFGKKVISKEDYE

SEQ ID NO: 2388290 - protein, 18 aa, Entamoeba dispar
NLAPNIISILGLIACLLA

SEQ ID NO: 2388291 - protein, 19 aa, Entamoeba dispar
NLCLSYLLYHIYFIISTLS

SEQ ID NO: 2388292 - protein, 18 aa, Entamoeba dispar
NLEHCMLIRQVGETFDSK

SEQ ID NO: 2388293 - protein, 24 aa, Entamoeba dispar
NLEIRTGQDYIFFNDFLAGYGNKN

SEQ ID NO: 2388294 - protein, 18 aa, Entamoeba dispar
NLFICLSDGILQSPQGKN

SEQ ID NO: 2388295 - protein, 20 aa, Entamoeba dispar
NLFIHFLHFYISFDYSQLIA

SEQ ID NO: 2388296 - protein, 17 aa, Entamoeba dispar
NLHDFTIIYAIYATFTL

SEQ ID NO: 2388297 - protein, 28 aa, Entamoeba dispar
NLHRYFRLFPRMYLLVNSFYSIFDDIVS

SEQ ID NO: 2388298 - protein, 17 aa, Entamoeba dispar
NLIKYKKIKSLLSTFIQ

SEQ ID NO: 2388299 - protein, 20 aa, Entamoeba dispar
NLILRHIFDIRWWPNDSLRV

SEQ ID NO: 2388300 - protein, 19 aa, Entamoeba dispar
NLIPLHAFLLLVFGRFTNR

SEQ ID NO: 2388301 - protein, 19 aa, Entamoeba dispar
NLIRLKLFNEKSIFYSIFQ

SEQ ID NO: 2388302 - protein, 22 aa, Entamoeba dispar
NLISCLELFLEWVRGTKYISNF

SEQ ID NO: 2388303 - protein, 23 aa, Entamoeba dispar
NLISNDFFILWKLVDVSHSSNFE

SEQ ID NO: 2388304 - protein, 18 aa, Entamoeba dispar
NLKEVFVPKDLNSIDTLK

SEQ ID NO: 2388305 - protein, 25 aa, Entamoeba dispar
NLKEWKKILKKYILSIFKYHYIATT

SEQ ID NO: 2388306 - protein, 19 aa, Entamoeba dispar
NLKIIPIATKFRIINEISK

SEQ ID NO: 2388307 - protein, 25 aa, Entamoeba dispar
NLKPRLKIKFMIDAAKGIQYLHSNG

SEQ ID NO: 2388308 - protein, 21 aa, Entamoeba dispar
NLKVRLAYFKFLTKLLEGYDE

SEQ ID NO: 2388309 - protein, 20 aa, Entamoeba dispar
NLLDIMCNMFQKHIFYKGFS

SEQ ID NO: 2388310 - protein, 18 aa, Entamoeba dispar
NLLIFSLNPQSPVCAKLT

SEQ ID NO: 2388311 - protein, 26 aa, Entamoeba dispar
NLLLSPCYLISFIATEINSLIQIQPN

SEQ ID NO: 2388312 - protein, 18 aa, Entamoeba dispar
NLLMPRVISYKEMIKFII

SEQ ID NO: 2388313 - protein, 26 aa, Entamoeba dispar
NLLPFTFPVKYFFVFYKQRKLFVPTI

SEQ ID NO: 2388314 - protein, 23 aa, Entamoeba dispar
NLLTKLVYWLAGMTFTPMVVLEV

SEQ ID NO: 2388315 - protein, 17 aa, Entamoeba dispar
NLMAFEYVWKCWSNFHF

SEQ ID NO: 2388316 - protein, 18 aa, Entamoeba dispar
NLMYYRYSMNKNIITLNT

SEQ ID NO: 2388317 - protein, 23 aa, Entamoeba dispar
NLNGRFHTCNEFIFRKKSTVDWI

SEQ ID NO: 2388318 - protein, 21 aa, Entamoeba dispar
NLPEWTTWTLLIGMACYDLVA

SEQ ID NO: 2388319 - protein, 25 aa, Entamoeba dispar
NLPYLLRFDFLNILRDFDFLYEKDC

SEQ ID NO: 2388320 - protein, 25 aa, Entamoeba dispar
NLQCHKKCSIKYLFNIPIYAKGIKF

SEQ ID NO: 2388321 - protein, 25 aa, Entamoeba dispar
NLQELSYFCFFLLISHMVSVTFDLS

SEQ ID NO: 2388322 - protein, 17 aa, Entamoeba dispar
NLSFSGTASDIFFIIYN

SEQ ID NO: 2388323 - protein, 27 aa, Entamoeba dispar
NLSNDFCCYCVIRPIYAILQNTNKTIK

SEQ ID NO: 2388324 - protein, 23 aa, Entamoeba dispar
NLTIKTVCPRDCGKRGICSTSSG

SEQ ID NO: 2388325 - protein, 18 aa, Entamoeba dispar
NLTLPDFIVKQLISEKVM

SEQ ID NO: 2388326 - protein, 18 aa, Entamoeba dispar
NLYALCGGIVEYDGISNE

SEQ ID NO: 2388327 - protein, 21 aa, Entamoeba dispar
NLYCFAMALLMVKNDKQELNR

SEQ ID NO: 2388328 - protein, 18 aa, Entamoeba dispar
NLYKNCTYYYGFAIAVGI

SEQ ID NO: 2388329 - protein, 20 aa, Entamoeba dispar
NLYLPVYIGIVIVLFCTILC

SEQ ID NO: 2388330 - protein, 24 aa, Entamoeba dispar
NMATYFCWLIIPLLMKENGASSFL

SEQ ID NO: 2388331 - protein, 23 aa, Entamoeba dispar
NMFLNCYRLNVFTNDTKKELIDS

SEQ ID NO: 2388332 - protein, 23 aa, Entamoeba dispar
NMGRSDWMKEFACEFDGHYLQYR

SEQ ID NO: 2388333 - protein, 19 aa, Entamoeba dispar
NMIIQFSIELNYFDLSQNL

SEQ ID NO: 2388334 - protein, 29 aa, Entamoeba dispar
NMISFCISEIIPWWLLCCHDSVKEVSESA

SEQ ID NO: 2388335 - protein, 18 aa, Entamoeba dispar
NMKLRYLFTYNKNDDVQS

SEQ ID NO: 2388336 - protein, 19 aa, Entamoeba dispar
NMNNGVFCIIDILSNNEIF

SEQ ID NO: 2388337 - protein, 21 aa, Entamoeba dispar
NMTIAEYKAVVEIQRKVSKKH

SEQ ID NO: 2388338 - protein, 23 aa, Entamoeba dispar
NMTRAFLLFSLLQIYWGIDMYIY

SEQ ID NO: 2388339 - protein, 27 aa, Entamoeba dispar
NMVCISNMLSFWMKYTSSMFRYPEKVQ

SEQ ID NO: 2388340 - protein, 24 aa, Entamoeba dispar
NNAPRLEPLIACDKIIQIADKRRK

SEQ ID NO: 2388341 - protein, 28 aa, Entamoeba dispar
NNAVVCSYGLCKTGLLSNINSECKICRY

SEQ ID NO: 2388342 - protein, 34 aa, Entamoeba dispar
NNCKESFEICYGCFLCGLIPIFISPRVSIVEINK

SEQ ID NO: 2388343 - protein, 25 aa, Entamoeba dispar
NNDLSWPIMLRFAYQIASGMASLHK

SEQ ID NO: 2388344 - protein, 33 aa, Entamoeba dispar
NNEASTHTLFWICFFLMQFCTVVLVLNLLKKKR

SEQ ID NO: 2388345 - protein, 27 aa, Entamoeba dispar
NNEGCAVCMKGYFRSSSLCRKCENNCS

SEQ ID NO: 2388346 - protein, 32 aa, Entamoeba dispar
NNFDIIYYLLLTWKRLIEITSIRSYPLDHSFK

SEQ ID NO: 2388347 - protein, 17 aa, Entamoeba dispar
NNGCSECSKNFYKNITY

SEQ ID NO: 2388348 - protein, 30 aa, Entamoeba dispar
NNGEICPIPHSFLIFIRIISLFIMTVPSAF

SEQ ID NO: 2388349 - protein, 20 aa, Entamoeba dispar
NNGTWKWKIVHQKTKTYDID

SEQ ID NO: 2388350 - protein, 24 aa, Entamoeba dispar
NNGWIKELKKIIAEHPHPILRIKA

SEQ ID NO: 2388351 - protein, 19 aa, Entamoeba dispar
NNHSFKQFAVHLLFSIPVG

SEQ ID NO: 2388352 - protein, 25 aa, Entamoeba dispar
NNIIPRLVLNVGVTKSPLKNEGNIL

SEQ ID NO: 2388353 - protein, 23 aa, Entamoeba dispar
NNIIRIPWRRILFTPNPKKPTIW

SEQ ID NO: 2388354 - protein, 17 aa, Entamoeba dispar
NNIKRFIDVLKEIKQPN

SEQ ID NO: 2388355 - protein, 17 aa, Entamoeba dispar
NNINICFLINNKQMKFI

SEQ ID NO: 2388356 - protein, 24 aa, Entamoeba dispar
NNKPLRPHFNPIFSKKIPPLLYLS

SEQ ID NO: 2388357 - protein, 22 aa, Entamoeba dispar
NNKYRFNFILKIEASASTDIDI

SEQ ID NO: 2388358 - protein, 21 aa, Entamoeba dispar
NNLKLNLPVFEIYDYHYNSSE

SEQ ID NO: 2388359 - protein, 23 aa, Entamoeba dispar
NNLLNRLAVCIGKKDELPNNYDE

SEQ ID NO: 2388360 - protein, 19 aa, Entamoeba dispar
NNLPIPVCMMKLMNTYFVI

SEQ ID NO: 2388361 - protein, 22 aa, Entamoeba dispar
NNMCLDKAISLYPILHQVTLTI

SEQ ID NO: 2388362 - protein, 19 aa, Entamoeba dispar
NNNCGKLYFGSRDNTFKAN

SEQ ID NO: 2388363 - protein, 25 aa, Entamoeba dispar
NNNEYKFKECTGITTNIEKSDLTTQ

SEQ ID NO: 2388364 - protein, 26 aa, Entamoeba dispar
NNPENFWLCIIPLCQPMYVLSSLVFK

SEQ ID NO: 2388365 - protein, 18 aa, Entamoeba dispar
NNPLSFHSIFLLNGELKI

SEQ ID NO: 2388366 - protein, 18 aa, Entamoeba dispar
NNQCISCSESYGLGCQIC

SEQ ID NO: 2388367 - protein, 18 aa, Entamoeba dispar
NNQGCALYKGSSLDNKYD

SEQ ID NO: 2388368 - protein, 24 aa, Entamoeba dispar
NNQQSPCVFGFHFTTIPNHLKLTH

SEQ ID NO: 2388369 - protein, 22 aa, Entamoeba dispar
NNQSFKEALSFIQTLLDNAEYI

SEQ ID NO: 2388370 - protein, 19 aa, Entamoeba dispar
NNRCSLCNEGYYLNNSKCI

SEQ ID NO: 2388371 - protein, 21 aa, Entamoeba dispar
NNRGGSFGIIKITLNGRGYCN

SEQ ID NO: 2388372 - protein, 24 aa, Entamoeba dispar
NNSEIPRHFILKLKIKGIYDSDEG

SEQ ID NO: 2388373 - protein, 18 aa, Entamoeba dispar
NNSWSNKCEPSYCDYNYF

SEQ ID NO: 2388374 - protein, 23 aa, Entamoeba dispar
NNTACLWCLLFLTLLSVSVSLVM

SEQ ID NO: 2388375 - protein, 24 aa, Entamoeba dispar
NNTQCFFKYFTPFWNNSNKRFESL

SEQ ID NO: 2388376 - protein, 27 aa, Entamoeba dispar
NNTSTLCFISFFFCDAIFTSYNSNIKK

SEQ ID NO: 2388377 - protein, 22 aa, Entamoeba dispar
NNVGCGQCETEVCKTCKMGYDD

SEQ ID NO: 2388378 - protein, 17 aa, Entamoeba dispar
NNVLCFISTSLLSCLPI

SEQ ID NO: 2388379 - protein, 18 aa, Entamoeba dispar
NNYEGWYNSELIKTYYSI

SEQ ID NO: 2388380 - protein, 27 aa, Entamoeba dispar
NNYLIILLCNYYIFNLIYLVPKIKNEG

SEQ ID NO: 2388381 - protein, 25 aa, Entamoeba dispar
NNYYEKKHCALKCPHAQFTEARSAI

SEQ ID NO: 2388382 - protein, 19 aa, Entamoeba dispar
NPEQITLKKGEAFEAEIYI

SEQ ID NO: 2388383 - protein, 26 aa, Entamoeba dispar
NPFIVIRIAMCFFVVAVTLILIFPEK

SEQ ID NO: 2388384 - protein, 24 aa, Entamoeba dispar
NPFNWKWVTSYGYPLKITLTSLYV

SEQ ID NO: 2388385 - protein, 22 aa, Entamoeba dispar
NPFYHCVFRLFDLIHCILSVYG

SEQ ID NO: 2388386 - protein, 17 aa, Entamoeba dispar
NPILGETFRTMWKHEDG

SEQ ID NO: 2388387 - protein, 29 aa, Entamoeba dispar
NPITDVLCCSALEAVCSIFSLAPLSLGEK

SEQ ID NO: 2388388 - protein, 24 aa, Entamoeba dispar
NPKKLKCFINDGIVSCHSVLPHKA

SEQ ID NO: 2388389 - protein, 24 aa, Entamoeba dispar
NPKLLDFLYCLSLCNSCTIERSDI

SEQ ID NO: 2388390 - protein, 18 aa, Entamoeba dispar
NPLIAFHSFELIRALIKS

SEQ ID NO: 2388391 - protein, 31 aa, Entamoeba dispar
NPLNFYFYPEFEISDSKPFIFAPHGEGTFVN

SEQ ID NO: 2388392 - protein, 24 aa, Entamoeba dispar
NPLPWKFFPTPSFILFPLATVISD

SEQ ID NO: 2388393 - protein, 17 aa, Entamoeba dispar
NPLRCIEDSNSISMIIG

SEQ ID NO: 2388394 - protein, 39 aa, Entamoeba dispar
NPNIGSAILHCIGYFSLFVCIIVTLKCRSVVSQLVKLHH

SEQ ID NO: 2388395 - protein, 25 aa, Entamoeba dispar
NPSKEVMVAIGLLFHLHFLSLQRWL

SEQ ID NO: 2388396 - protein, 19 aa, Entamoeba dispar
NPSLVWFFVILSLCLVWMI

SEQ ID NO: 2388397 - protein, 24 aa, Entamoeba dispar
NPTEALCILIIYQIIRTIFNLTPY

SEQ ID NO: 2388398 - protein, 20 aa, Entamoeba dispar
NPTKCPFKKINTMTLKHSKG

SEQ ID NO: 2388399 - protein, 25 aa, Entamoeba dispar
NPTNLCGTLAWIAPEILQNKPFGIK

SEQ ID NO: 2388400 - protein, 23 aa, Entamoeba dispar
NPTWLRAGSFVISNPVNNKQCFG

SEQ ID NO: 2388401 - protein, 27 aa, Entamoeba dispar
NPYLECFKPICLCLRAMSECFKCNLVN

SEQ ID NO: 2388402 - protein, 25 aa, Entamoeba dispar
NPYLLFRIADLFFIGCVVLTMVLNT

SEQ ID NO: 2388403 - protein, 18 aa, Entamoeba dispar
NQCNAVFQRGLTQFNLIM

SEQ ID NO: 2388404 - protein, 19 aa, Entamoeba dispar
NQCSSCKPGYYLSNGDCVS

SEQ ID NO: 2388405 - protein, 18 aa, Entamoeba dispar
NQDPILRPPFSEIVDKLS

SEQ ID NO: 2388406 - protein, 25 aa, Entamoeba dispar
NQELTRTSNYWAYQATNGNPITTPI

SEQ ID NO: 2388407 - protein, 17 aa, Entamoeba dispar
NQENGHCLIPFNTMNYY

SEQ ID NO: 2388408 - protein, 21 aa, Entamoeba dispar
NQETFYRMVLYPYKADVLFEM

SEQ ID NO: 2388409 - protein, 20 aa, Entamoeba dispar
NQFNEIYKFSSINIIIDLYR

SEQ ID NO: 2388410 - protein, 21 aa, Entamoeba dispar
NQGFLKYWRIKEIPNFLLCAP

SEQ ID NO: 2388411 - protein, 27 aa, Entamoeba dispar
NQGLEIVRLVLGRKITLIIFGTNNGKI

SEQ ID NO: 2388412 - protein, 17 aa, Entamoeba dispar
NQIEMYEAPPIVNEQQN

SEQ ID NO: 2388413 - protein, 19 aa, Entamoeba dispar
NQIIPCLSSPQVPFQEIFQ

SEQ ID NO: 2388414 - protein, 31 aa, Entamoeba dispar
NQIKEKSNVFGMMGVIFYWIITQKNYIIKEE

SEQ ID NO: 2388415 - protein, 17 aa, Entamoeba dispar
NQIKIRRFLPLKERLTL

SEQ ID NO: 2388416 - protein, 22 aa, Entamoeba dispar
NQKCIYCLDSHCKRCSKEECYE

SEQ ID NO: 2388417 - protein, 20 aa, Entamoeba dispar
NQKIRVVDRYSVLKGLTVGL

SEQ ID NO: 2388418 - protein, 24 aa, Entamoeba dispar
NQKQLWYLLLIPILFILVLFMITT

SEQ ID NO: 2388419 - protein, 21 aa, Entamoeba dispar
NQKYVWWNVFTIRKNSTGILL

SEQ ID NO: 2388420 - protein, 18 aa, Entamoeba dispar
NQLEYKYSCCGFDSATVN

SEQ ID NO: 2388421 - protein, 17 aa, Entamoeba dispar
NQLFYLLMVEVCLGMWS

SEQ ID NO: 2388422 - protein, 19 aa, Entamoeba dispar
NQMFVLFILLIKYSIYSFL

SEQ ID NO: 2388423 - protein, 27 aa, Entamoeba dispar
NQMIYRKGHWFFVDFNKIDSMTKVIMF

SEQ ID NO: 2388424 - protein, 22 aa, Entamoeba dispar
NQMKSNYCSLIIKGEIETSLII

SEQ ID NO: 2388425 - protein, 17 aa, Entamoeba dispar
NQMKVIWNILNMNSELL

SEQ ID NO: 2388426 - protein, 18 aa, Entamoeba dispar
NQPFKWNQFTVIEVHCSK

SEQ ID NO: 2388427 - protein, 21 aa, Entamoeba dispar
NQPKDCIEIIKLITNKESTKI

SEQ ID NO: 2388428 - protein, 18 aa, Entamoeba dispar
NQSLVVYFDLFMKYLQFI

SEQ ID NO: 2388429 - protein, 21 aa, Entamoeba dispar
NQTCVFCSSFISQCISCVSDI

SEQ ID NO: 2388430 - protein, 25 aa, Entamoeba dispar
NQTLTDFYLFFSIVAEQQPIDLSKV

SEQ ID NO: 2388431 - protein, 18 aa, Entamoeba dispar
NQVKLRFNAKDGSGKAVQ

SEQ ID NO: 2388432 - protein, 26 aa, Entamoeba dispar
NQVPVYCGFAFIAISFFQFRIFTLGY

SEQ ID NO: 2388433 - protein, 19 aa, Entamoeba dispar
NQYDCAVTIFAEVNKKEKK

SEQ ID NO: 2388434 - protein, 22 aa, Entamoeba dispar
NQYICIGMFLVLYLYENLSYFF

SEQ ID NO: 2388435 - protein, 25 aa, Entamoeba dispar
NQYPKFTCQWIELFSHRNVLYELSK

SEQ ID NO: 2388436 - protein, 17 aa, Entamoeba dispar
NRCKPCSDGCLECDTEK

SEQ ID NO: 2388437 - protein, 18 aa, Entamoeba dispar
NRDIIGFFMNGDEKVKVD

SEQ ID NO: 2388438 - protein, 27 aa, Entamoeba dispar
NRFKKWSILICICLIVVIFLIVVGSIL

SEQ ID NO: 2388439 - protein, 29 aa, Entamoeba dispar
NRIGKKRLWELLFVFLVGFFRCSFFTLTI

SEQ ID NO: 2388440 - protein, 18 aa, Entamoeba dispar
NRIKELIIETDILDIKSL

SEQ ID NO: 2388441 - protein, 23 aa, Entamoeba dispar
NRIPSRIRRLFLSTKASLLEIKN

SEQ ID NO: 2388442 - protein, 24 aa, Entamoeba dispar
NRKDLAAAVVRKSSPIQVHKNVLF

SEQ ID NO: 2388443 - protein, 17 aa, Entamoeba dispar
NRKSEIYGINISDDCYV

SEQ ID NO: 2388444 - protein, 24 aa, Entamoeba dispar
NRLEFFDCQTFELIETYSFTIVET

SEQ ID NO: 2388445 - protein, 22 aa, Entamoeba dispar
NRLIEALSCYLYPLHPFTKPPQ

SEQ ID NO: 2388446 - protein, 19 aa, Entamoeba dispar
NRLLPIILYLSILTLTIFV

SEQ ID NO: 2388447 - protein, 21 aa, Entamoeba dispar
NRMTVVNGWFGGIKMETRDQK

SEQ ID NO: 2388448 - protein, 24 aa, Entamoeba dispar
NRNVGITVWEVYPIVNNQVIRQQQ

SEQ ID NO: 2388449 - protein, 25 aa, Entamoeba dispar
NRRCPVSFNYKCPKMKFFNKYLRYL

SEQ ID NO: 2388450 - protein, 23 aa, Entamoeba dispar
NRRERLWGVAMLIYAVLMMVVVI

SEQ ID NO: 2388451 - protein, 18 aa, Entamoeba dispar
NRRRVYEGLYLVKFNRDY

SEQ ID NO: 2388452 - protein, 17 aa, Entamoeba dispar
NRRSAIFSVSWSIGKAF

SEQ ID NO: 2388453 - protein, 18 aa, Entamoeba dispar
NRVREMMKMLGMKMTPYW

SEQ ID NO: 2388454 - protein, 19 aa, Entamoeba dispar
NRYEKVIGTLCENLDSLDE

SEQ ID NO: 2388455 - protein, 20 aa, Entamoeba dispar
NRYKLCLNIFAFETCCLVII

SEQ ID NO: 2388456 - protein, 17 aa, Entamoeba dispar
NSAEIWTMMICVACGQT

SEQ ID NO: 2388457 - protein, 22 aa, Entamoeba dispar
NSDLVWRFILNITENEQLDQKI

SEQ ID NO: 2388458 - protein, 22 aa, Entamoeba dispar
NSDQAIIFWSRVCEKRNEKDDI

SEQ ID NO: 2388459 - protein, 22 aa, Entamoeba dispar
NSECRRCSKGYAFNSKHLCTKC

SEQ ID NO: 2388460 - protein, 29 aa, Entamoeba dispar
NSFNALCQSHLRFGGYFVQLILNVITLIK

SEQ ID NO: 2388461 - protein, 28 aa, Entamoeba dispar
NSFNDTFPICIFCIMVLTVFSLGFDYRR

SEQ ID NO: 2388462 - protein, 27 aa, Entamoeba dispar
NSFPSTYKWACLNSILILSTQTFNDNL

SEQ ID NO: 2388463 - protein, 17 aa, Entamoeba dispar
NSFTGLYSFTINKGESR

SEQ ID NO: 2388464 - protein, 17 aa, Entamoeba dispar
NSFYHFNYKTVFVKSRI

SEQ ID NO: 2388465 - protein, 24 aa, Entamoeba dispar
NSGICSLCGNGVYDVGEDCDPSVS

SEQ ID NO: 2388466 - protein, 22 aa, Entamoeba dispar
NSGLMKWCLFMSEQIDKLDVKE

SEQ ID NO: 2388467 - protein, 19 aa, Entamoeba dispar
NSHINPFLLAILYTKLQYG

SEQ ID NO: 2388468 - protein, 19 aa, Entamoeba dispar
NSIEMSIQWMISDVPSFVM

SEQ ID NO: 2388469 - protein, 18 aa, Entamoeba dispar
NSIKRQQLKIAYSTENCL

SEQ ID NO: 2388470 - protein, 24 aa, Entamoeba dispar
NSILRSCMIILCIGVITLVSFFCY

SEQ ID NO: 2388471 - protein, 27 aa, Entamoeba dispar
NSKCNKCSLPHCVQCYYGTDNEICSQC

SEQ ID NO: 2388472 - protein, 22 aa, Entamoeba dispar
NSKIPFRFIPFFKILSISIQTI

SEQ ID NO: 2388473 - protein, 24 aa, Entamoeba dispar
NSKSFRLLSGIGLVLFNTSGMLNY

SEQ ID NO: 2388474 - protein, 24 aa, Entamoeba dispar
NSLAIRLCSLMFYHYFSCSQECSL

SEQ ID NO: 2388475 - protein, 25 aa, Entamoeba dispar
NSLILRSLALVWLLFQECNYVIVID

SEQ ID NO: 2388476 - protein, 25 aa, Entamoeba dispar
NSLMYKLCYYRFGELMTEKNKPTGF

SEQ ID NO: 2388477 - protein, 19 aa, Entamoeba dispar
NSLPILLHCSSPALQPLLL

SEQ ID NO: 2388478 - protein, 26 aa, Entamoeba dispar
NSLSCAIPTFALHLFIQDCTTYISCN

SEQ ID NO: 2388479 - protein, 22 aa, Entamoeba dispar
NSLSLFPLFLLFLICFYLFLYP

SEQ ID NO: 2388480 - protein, 23 aa, Entamoeba dispar
NSNFCVVKWLYSLAGQLFSQPNF

SEQ ID NO: 2388481 - protein, 25 aa, Entamoeba dispar
NSNIFNWKKALIVLFQGMTMAIISI

SEQ ID NO: 2388482 - protein, 24 aa, Entamoeba dispar
NSPHGIKYIIEFFKSNIGHPETSL

SEQ ID NO: 2388483 - protein, 18 aa, Entamoeba dispar
NSPIYCLVMILLLIIRCF

SEQ ID NO: 2388484 - protein, 22 aa, Entamoeba dispar
NSPQLRLGFVAQEVKEILPDLV

SEQ ID NO: 2388485 - protein, 23 aa, Entamoeba dispar
NSQDLGMCLPFIENLAHQLKCNV

SEQ ID NO: 2388486 - protein, 21 aa, Entamoeba dispar
NSRSYKFLENAVFTINEISVD

SEQ ID NO: 2388487 - protein, 20 aa, Entamoeba dispar
NSRWGKRRPFLLLGNLIVII

SEQ ID NO: 2388488 - protein, 19 aa, Entamoeba dispar
NSSECLVCEYGYYPNEDEC

SEQ ID NO: 2388489 - protein, 30 aa, Entamoeba dispar
NSSLYRFILLFCLFTCYKRIKRMLMSYSCW

SEQ ID NO: 2388490 - protein, 21 aa, Entamoeba dispar
NSSSCSLCSSGFLNIKGDCVT

SEQ ID NO: 2388491 - protein, 24 aa, Entamoeba dispar
NSTCGFPIVLNTTFMNYKSINGNN

SEQ ID NO: 2388492 - protein, 23 aa, Entamoeba dispar
NSTCLTCFGGYYLTNNGNECVNA

SEQ ID NO: 2388493 - protein, 23 aa, Entamoeba dispar
NSTECLVCKSGYYPNGNGCEECS

SEQ ID NO: 2388494 - protein, 25 aa, Entamoeba dispar
NSTILFYLCCSLNILFIVSNVCFFI

SEQ ID NO: 2388495 - protein, 22 aa, Entamoeba dispar
NSTYFDLRFNQVTSTPIIFNLC

SEQ ID NO: 2388496 - protein, 22 aa, Entamoeba dispar
NSTYFDLRFNQVTSTPIIFRLC

SEQ ID NO: 2388497 - protein, 25 aa, Entamoeba dispar
NSYMKSCLKQIGGVSSIIIAVICIF

SEQ ID NO: 2388498 - protein, 20 aa, Entamoeba dispar
NSYQCISCTDGILKNFQCIP

SEQ ID NO: 2388499 - protein, 25 aa, Entamoeba dispar
NSYQFKAACHGIVLTNLEDKDIACP

SEQ ID NO: 2388500 - protein, 29 aa, Entamoeba dispar
NTCLTNNCGWCSVTKKCGYCEDINNLCNN

SEQ ID NO: 2388501 - protein, 23 aa, Entamoeba dispar
NTCSCISPFLPINFNGIIRCSLP

SEQ ID NO: 2388502 - protein, 17 aa, Entamoeba dispar
NTDKLLCNDRILYHKAT

SEQ ID NO: 2388503 - protein, 27 aa, Entamoeba dispar
NTDYRLLGSLFFKRGNVLRKILSNPVQ

SEQ ID NO: 2388504 - protein, 17 aa, Entamoeba dispar
NTECSISNDKDCYQYCG

SEQ ID NO: 2388505 - protein, 27 aa, Entamoeba dispar
NTEDFKEVFVWKVFYTSLIWVLKNIDK

SEQ ID NO: 2388506 - protein, 26 aa, Entamoeba dispar
NTEIPKKLRIKFMIDGAKGISYLHSN

SEQ ID NO: 2388507 - protein, 24 aa, Entamoeba dispar
NTEIPNKIRIKFMIDGAKGISYLH

SEQ ID NO: 2388508 - protein, 24 aa, Entamoeba dispar
NTEIPNKIRIKIMIDGAKGISYLH

SEQ ID NO: 2388509 - protein, 25 aa, Entamoeba dispar
NTEIPNKIRIKIMIDGAKGISYLHS

SEQ ID NO: 2388510 - protein, 21 aa, Entamoeba dispar
NTELSGGFAVRSLYPTYKEFF

SEQ ID NO: 2388511 - protein, 22 aa, Entamoeba dispar
NTGRIPVSFNIIYISTKKGEEI

SEQ ID NO: 2388512 - protein, 29 aa, Entamoeba dispar
NTHLENVVVCFLEMLIMKGEVLKPQKGEF

SEQ ID NO: 2388513 - protein, 23 aa, Entamoeba dispar
NTHLPDPFVFTFGVREMVWSNTF

SEQ ID NO: 2388514 - protein, 21 aa, Entamoeba dispar
NTIHLCKEFIEEGSKQSKVMF

SEQ ID NO: 2388515 - protein, 20 aa, Entamoeba dispar
NTINPLFSFGCRPRCGSCRN

SEQ ID NO: 2388516 - protein, 24 aa, Entamoeba dispar
NTIPFKIEKEFVLENFKLLNDMFC

SEQ ID NO: 2388517 - protein, 24 aa, Entamoeba dispar
NTISWEFDKGIFILFQLSTSLLHI

SEQ ID NO: 2388518 - protein, 17 aa, Entamoeba dispar
NTITFKGLFNVNPITFT

SEQ ID NO: 2388519 - protein, 17 aa, Entamoeba dispar
NTITLLILNCVFVSKHY

SEQ ID NO: 2388520 - protein, 24 aa, Entamoeba dispar
NTKSVLLEDIMKIWDNVARPECFK

SEQ ID NO: 2388521 - protein, 19 aa, Entamoeba dispar
NTLCKECLEEYIMNLDLYD

SEQ ID NO: 2388522 - protein, 24 aa, Entamoeba dispar
NTLMTFERFVFIASVTGILIFERG

SEQ ID NO: 2388523 - protein, 23 aa, Entamoeba dispar
NTLQYGSWFLIRGVEQSISISTC

SEQ ID NO: 2388524 - protein, 23 aa, Entamoeba dispar
NTMLKLPFSDGIRYLISSYEGTI

SEQ ID NO: 2388525 - protein, 20 aa, Entamoeba dispar
NTMSMCFVFILAIILFVYCI

SEQ ID NO: 2388526 - protein, 32 aa, Entamoeba dispar
NTNEFKRVFSWKRGEGPLSISSLDLQYPKVSI

SEQ ID NO: 2388527 - protein, 28 aa, Entamoeba dispar
NTPCSSTSCSFCSFIINGQIKYDFYYIN

SEQ ID NO: 2388528 - protein, 18 aa, Entamoeba dispar
NTSLPYVVVYPIVTTGPG

SEQ ID NO: 2388529 - protein, 19 aa, Entamoeba dispar
NTSWDRWFCTFRLKNCFID

SEQ ID NO: 2388530 - protein, 23 aa, Entamoeba dispar
NTTESLQWFYGINYLVHRIFFTF

SEQ ID NO: 2388531 - protein, 18 aa, Entamoeba dispar
NTTFGFDCTIQRDSKTNQ

SEQ ID NO: 2388532 - protein, 23 aa, Entamoeba dispar
NTVFTTRYAKYVLKPSSQTACSS

SEQ ID NO: 2388533 - protein, 20 aa, Entamoeba dispar
NTYIQLRISVGFAGPETKIY

SEQ ID NO: 2388534 - protein, 23 aa, Entamoeba dispar
NVCTSCSIGFTIKGNICKRKSMW

SEQ ID NO: 2388535 - protein, 19 aa, Entamoeba dispar
NVFNSSYAFIFFFKAGIYN

SEQ ID NO: 2388536 - protein, 32 aa, Entamoeba dispar
NVFPVSEFWGHVCIVWNKCYYFFSQNQLKMQK

SEQ ID NO: 2388537 - protein, 21 aa, Entamoeba dispar
NVGCSQCYLGFSRIEKIENQI

SEQ ID NO: 2388538 - protein, 22 aa, Entamoeba dispar
NVGRYYLMVGCEGMVTTEGALC

SEQ ID NO: 2388539 - protein, 20 aa, Entamoeba dispar
NVHFKVWDLIAKKVVAQLYR

SEQ ID NO: 2388540 - protein, 18 aa, Entamoeba dispar
NVIFPPPEVFFICDNCTD

SEQ ID NO: 2388541 - protein, 17 aa, Entamoeba dispar
NVIPRWLAPNILTTVGF

SEQ ID NO: 2388542 - protein, 25 aa, Entamoeba dispar
NVKQRYNGFCKIPFPDRTCEVCDEG

SEQ ID NO: 2388543 - protein, 29 aa, Entamoeba dispar
NVKVIAFRGTYSFKDCIYDIQLFTESSVP

SEQ ID NO: 2388544 - protein, 18 aa, Entamoeba dispar
NVLHIVEIMSLYTDGMAF

SEQ ID NO: 2388545 - protein, 26 aa, Entamoeba dispar
NVLLFKRRGIAVIPNYVFWLSLPMLI

SEQ ID NO: 2388546 - protein, 24 aa, Entamoeba dispar
NVLMEFYIFIVFIWIFFQVDHLRF

SEQ ID NO: 2388547 - protein, 18 aa, Entamoeba dispar
NVLRIFKTIIKEMKNSLI

SEQ ID NO: 2388548 - protein, 19 aa, Entamoeba dispar
NVMALMCKKPTPFTVKIIN

SEQ ID NO: 2388549 - protein, 24 aa, Entamoeba dispar
NVNSICAVCPVWGISAIETPELYS

SEQ ID NO: 2388550 - protein, 25 aa, Entamoeba dispar
NVPARAAGFGFALLVAFVVWLSTKA

SEQ ID NO: 2388551 - protein, 18 aa, Entamoeba dispar
NVPGCTAPAINMKSDGTL

SEQ ID NO: 2388552 - protein, 17 aa, Entamoeba dispar
NVQELWDYLTFSERLFW

SEQ ID NO: 2388553 - protein, 21 aa, Entamoeba dispar
NVQLKFLLEYVLENSIISISR

SEQ ID NO: 2388554 - protein, 19 aa, Entamoeba dispar
NVRIPGSCKSKPKAITPKP

SEQ ID NO: 2388555 - protein, 21 aa, Entamoeba dispar
NVSPDKRKVFFINEDNVLKLM

SEQ ID NO: 2388556 - protein, 24 aa, Entamoeba dispar
NVTALLCGVPWAFFLHKFGPKRAL

SEQ ID NO: 2388557 - protein, 26 aa, Entamoeba dispar
NVTFKCIKSSILLGFISCLWYSQYIK

SEQ ID NO: 2388558 - protein, 24 aa, Entamoeba dispar
NVTFKTVCPFGCGEHGFCNNNGIC

SEQ ID NO: 2388559 - protein, 25 aa, Entamoeba dispar
NVVIKPKMCCLINVLIMPYCSFNIQ

SEQ ID NO: 2388560 - protein, 29 aa, Entamoeba dispar
NVVSLLLSVFIFRFTHKFYSLQTSHTVFI

SEQ ID NO: 2388561 - protein, 33 aa, Entamoeba dispar
NVVSPYKVRLVWKEIRGVWQWIEGRTYEVKPEL

SEQ ID NO: 2388562 - protein, 19 aa, Entamoeba dispar
NVYSKIAYRCKHQDLIYGQ

SEQ ID NO: 2388563 - protein, 18 aa, Entamoeba dispar
NWDLFNFICVVPFFLLLI

SEQ ID NO: 2388564 - protein, 24 aa, Entamoeba dispar
NWFYLFGTAGCWFFFDIAFYGNSM

SEQ ID NO: 2388565 - protein, 28 aa, Entamoeba dispar
NWKKRKIRYCPPELLNELDLDETTDVYM

SEQ ID NO: 2388566 - protein, 17 aa, Entamoeba dispar
NWLGDWGSQFGLLAIGF

SEQ ID NO: 2388567 - protein, 17 aa, Entamoeba dispar
NWLSLRILIPIVLYLVV

SEQ ID NO: 2388568 - protein, 25 aa, Entamoeba dispar
NWNLFKCSFILLKFSLFAIPFTLRI

SEQ ID NO: 2388569 - protein, 17 aa, Entamoeba dispar
NWPGNKFITIVKGTTLK

SEQ ID NO: 2388570 - protein, 25 aa, Entamoeba dispar
NWQSIMGVSFLSWICPWYNENKEQN

SEQ ID NO: 2388571 - protein, 22 aa, Entamoeba dispar
NYDQRSKREWKRVEEIRQNSIQ

SEQ ID NO: 2388572 - protein, 19 aa, Entamoeba dispar
NYFGCLRMIKEIKVLLDSN

SEQ ID NO: 2388573 - protein, 17 aa, Entamoeba dispar
NYHCYSVACMNNSFYKI

SEQ ID NO: 2388574 - protein, 17 aa, Entamoeba dispar
NYIIHFYGAVLIPGKIS

SEQ ID NO: 2388575 - protein, 37 aa, Entamoeba dispar
NYISRIEGFVNLRVSFLEGLFFVFAYFMDVAHAEECV

SEQ ID NO: 2388576 - protein, 25 aa, Entamoeba dispar
NYKDNCLKDIFSLSLEVFNLLLQKR

SEQ ID NO: 2388577 - protein, 19 aa, Entamoeba dispar
NYLCSSGICVLDYSQSNQT

SEQ ID NO: 2388578 - protein, 19 aa, Entamoeba dispar
NYLLLCGDFTIRGYGIKDF

SEQ ID NO: 2388579 - protein, 23 aa, Entamoeba dispar
NYLSRVGPALAMNFIHMINFSST

SEQ ID NO: 2388580 - protein, 18 aa, Entamoeba dispar
NYNIQGSIPIIIKTYNGM

SEQ ID NO: 2388581 - protein, 20 aa, Entamoeba dispar
NYNKECKFEGSKVIPINSYL

SEQ ID NO: 2388582 - protein, 24 aa, Entamoeba dispar
NYPLHKYLGFSLLKLHLPANRILL

SEQ ID NO: 2388583 - protein, 18 aa, Entamoeba dispar
NYQLKVKILDDMAVALSY

SEQ ID NO: 2388584 - protein, 21 aa, Entamoeba dispar
NYRGYLCILFIAFSNFVYVLD

SEQ ID NO: 2388585 - protein, 23 aa, Entamoeba dispar
NYRNKRVYDLFGYTIFEYKELIC

SEQ ID NO: 2388586 - protein, 21 aa, Entamoeba dispar
NYSNILIRRNIHLLVNQTITI

SEQ ID NO: 2388587 - protein, 25 aa, Entamoeba dispar
NYSSDFRIYLSYVSYVFVPVLMCTF

SEQ ID NO: 2388588 - protein, 26 aa, Entamoeba dispar
NYTNILPMFRWKMYYIADNDNVTSFP

SEQ ID NO: 2388589 - protein, 26 aa, Entamoeba dispar
NYVEAGICAVHFVSYIYRYLKDKIPL

SEQ ID NO: 2388590 - protein, 20 aa, Entamoeba dispar
NYVQEYLREISFIGFSSSKY

SEQ ID NO: 2388591 - protein, 18 aa, Entamoeba dispar
NYVYPFGVDPIWKSSNNE

SEQ ID NO: 2388592 - protein, 17 aa, Entamoeba dispar
NYYRIKSQLSMKVARCY

SEQ ID NO: 2388593 - protein, 24 aa, Entamoeba dispar
NYYWTCAFIPILIVLILIHGFAII

SEQ ID NO: 2388594 - protein, 24 aa, Entamoeba dispar
PADQIRYLLAFFIELPLCYILRYL

SEQ ID NO: 2388595 - protein, 20 aa, Entamoeba dispar
PAFSNSISHVGFRSTDGKEH

SEQ ID NO: 2388596 - protein, 20 aa, Entamoeba dispar
PAHYVFTMYEILGRVVRLMI

SEQ ID NO: 2388597 - protein, 17 aa, Entamoeba dispar
PAISFFPWLIKDKWDNL

SEQ ID NO: 2388598 - protein, 18 aa, Entamoeba dispar
PALIKGLADIMYLIEKNI

SEQ ID NO: 2388599 - protein, 17 aa, Entamoeba dispar
PARLRMTSLQQYSSNFF

SEQ ID NO: 2388600 - protein, 24 aa, Entamoeba dispar
PATVTFKSSLDYFILNSAQSEEKR

SEQ ID NO: 2388601 - protein, 24 aa, Entamoeba dispar
PAVSWICTFFMWKHDILPSSKVFY

SEQ ID NO: 2388602 - protein, 19 aa, Entamoeba dispar
PCHHCQEYLFGKWFKIPKS

SEQ ID NO: 2388603 - protein, 33 aa, Entamoeba dispar
PCIEGRWYTLSCVPSYCDYGYKFDRTSQTCIED

SEQ ID NO: 2388604 - protein, 20 aa, Entamoeba dispar
PCSLWEGKPIHSKCYRCQSC

SEQ ID NO: 2388605 - protein, 22 aa, Entamoeba dispar
PCVSTFKVGLIGRMDEFGISIE

SEQ ID NO: 2388606 - protein, 21 aa, Entamoeba dispar
PCYANSLKCHGIHNSVCMIGE

SEQ ID NO: 2388607 - protein, 27 aa, Entamoeba dispar
PCYSLPNCASFQLWCSIFPLLSNISNI

SEQ ID NO: 2388608 - protein, 26 aa, Entamoeba dispar
PCYVHVFCTKGFYSVFKKMIKMNKKS

SEQ ID NO: 2388609 - protein, 17 aa, Entamoeba dispar
PDCFYDLSVGQREAFDK

SEQ ID NO: 2388610 - protein, 25 aa, Entamoeba dispar
PDCQSCKSIGCLTCSNRIYDPKSTY

SEQ ID NO: 2388611 - protein, 17 aa, Entamoeba dispar
PDFAPSFIVGPRDFLYG

SEQ ID NO: 2388612 - protein, 25 aa, Entamoeba dispar
PDGPFLSFIMNLFLYGFFSSFCSFS

SEQ ID NO: 2388613 - protein, 19 aa, Entamoeba dispar
PDHPKCLWDLLPEKKLNIS

SEQ ID NO: 2388614 - protein, 17 aa, Entamoeba dispar
PDHSGAINSCLWELTLL

SEQ ID NO: 2388615 - protein, 19 aa, Entamoeba dispar
PDIAQALRGEIIIKTPTLK

SEQ ID NO: 2388616 - protein, 19 aa, Entamoeba dispar
PDIVCKKLTFDGSNSNLEI

SEQ ID NO: 2388617 - protein, 23 aa, Entamoeba dispar
PDKCDECYITARNQFQFPILPKN

SEQ ID NO: 2388618 - protein, 17 aa, Entamoeba dispar
PDKGFKYTQERAIELAL

SEQ ID NO: 2388619 - protein, 21 aa, Entamoeba dispar
PDKKGNCIMSCMYGDGCLNGC

SEQ ID NO: 2388620 - protein, 18 aa, Entamoeba dispar
PDKNWNVLREESRQLVGK

SEQ ID NO: 2388621 - protein, 25 aa, Entamoeba dispar
PDLQYGLLVLFAFWFFHGIVDSLIG

SEQ ID NO: 2388622 - protein, 25 aa, Entamoeba dispar
PDLRDRGLFYWRLLAHDPELAKEMV

SEQ ID NO: 2388623 - protein, 19 aa, Entamoeba dispar
PDMVETVTILVLWSSDEMS

SEQ ID NO: 2388624 - protein, 18 aa, Entamoeba dispar
PDNLLLFSYSPKVQFAAK

SEQ ID NO: 2388625 - protein, 17 aa, Entamoeba dispar
PDNMLVFSFAEQVGVNL

SEQ ID NO: 2388626 - protein, 20 aa, Entamoeba dispar
PDPSYSMYFTDSFDCGCKSN

SEQ ID NO: 2388627 - protein, 19 aa, Entamoeba dispar
PDRFAVMDFTCLFSTKTDG

SEQ ID NO: 2388628 - protein, 21 aa, Entamoeba dispar
PDSESILRFVGAGKRLDVSDE

SEQ ID NO: 2388629 - protein, 21 aa, Entamoeba dispar
PDYYEGIAILVAVFAVSLIGA

SEQ ID NO: 2388630 - protein, 20 aa, Entamoeba dispar
PECKNYTTSIIIISIIGGIF

SEQ ID NO: 2388631 - protein, 22 aa, Entamoeba dispar
PEDFKTSCPDYIFVKPTTSLWW

SEQ ID NO: 2388632 - protein, 23 aa, Entamoeba dispar
PEDMLKEHMNYYAFSTKDGQLIW

SEQ ID NO: 2388633 - protein, 27 aa, Entamoeba dispar
PEELHFLSCLICAGHIEKEKLWFENEL

SEQ ID NO: 2388634 - protein, 23 aa, Entamoeba dispar
PEGCGGFCIKLLLKQLPPQLIHK

SEQ ID NO: 2388635 - protein, 22 aa, Entamoeba dispar
PEGKIIRMLEDFTSIENYKNFF

SEQ ID NO: 2388636 - protein, 18 aa, Entamoeba dispar
PEICGKKLPCGHICHSKC

SEQ ID NO: 2388637 - protein, 19 aa, Entamoeba dispar
PEIETWDLLHFLLFASILI

SEQ ID NO: 2388638 - protein, 19 aa, Entamoeba dispar
PEIFLKVPSMMKLNSDAFY

SEQ ID NO: 2388639 - protein, 17 aa, Entamoeba dispar
PEIFTDFSLNSPKENLP

SEQ ID NO: 2388640 - protein, 21 aa, Entamoeba dispar
PEIKESFKLQTLRDEINNLTQ

SEQ ID NO: 2388641 - protein, 24 aa, Entamoeba dispar
PEIVSIFFKDINIIVPIEESIISN

SEQ ID NO: 2388642 - protein, 20 aa, Entamoeba dispar
PELHGFFFKMFAIWYTGELA

SEQ ID NO: 2388643 - protein, 20 aa, Entamoeba dispar
PELNRCSFVYSSTKERMSYL

SEQ ID NO: 2388644 - protein, 21 aa, Entamoeba dispar
PENLFKYPWNIAEYVMQGNRL

SEQ ID NO: 2388645 - protein, 21 aa, Entamoeba dispar
PENLQSLIVNCWKQEPNERPN

SEQ ID NO: 2388646 - protein, 24 aa, Entamoeba dispar
PENMPDWYYILICKCWQNNPQERL

SEQ ID NO: 2388647 - protein, 18 aa, Entamoeba dispar
PENQRPVLYVSVGTLAFV

SEQ ID NO: 2388648 - protein, 23 aa, Entamoeba dispar
PEPLYKLITLCWAQEPKERLPID

SEQ ID NO: 2388649 - protein, 18 aa, Entamoeba dispar
PEQIVACSSFPSFQNIYV

SEQ ID NO: 2388650 - protein, 24 aa, Entamoeba dispar
PERAKGFIPLVVRAIMAIVISCSA

SEQ ID NO: 2388651 - protein, 20 aa, Entamoeba dispar
PERFIEDGIHDFPNEEESVE

SEQ ID NO: 2388652 - protein, 19 aa, Entamoeba dispar
PERNSGRVKAATKCVPALL

SEQ ID NO: 2388653 - protein, 26 aa, Entamoeba dispar
PESIYGSAVGLRFEKSVIELVQTYLR

SEQ ID NO: 2388654 - protein, 20 aa, Entamoeba dispar
PESLRSAAYRYLSVISTVCP

SEQ ID NO: 2388655 - protein, 24 aa, Entamoeba dispar
PESMGLVCGIVFMFITMLFSSLIS

SEQ ID NO: 2388656 - protein, 20 aa, Entamoeba dispar
PESPLFFLKWLNRKRNNLGE

SEQ ID NO: 2388657 - protein, 20 aa, Entamoeba dispar
PESYWHIVSIIVIYIIVDGY

SEQ ID NO: 2388658 - protein, 22 aa, Entamoeba dispar
PETWKGVVYLIVIAFMQILTSF

SEQ ID NO: 2388659 - protein, 22 aa, Entamoeba dispar
PEVKEYKPAVVASTISIAVVLS

SEQ ID NO: 2388660 - protein, 19 aa, Entamoeba dispar
PEWVYSIINKCWDEEPTKR

SEQ ID NO: 2388661 - protein, 17 aa, Entamoeba dispar
PEYVPVIYTPRVGPKRL

SEQ ID NO: 2388662 - protein, 25 aa, Entamoeba dispar
PFCPCKSNECLLNFNDENITELNDI

SEQ ID NO: 2388663 - protein, 25 aa, Entamoeba dispar
PFFIFQVVCSILWMMDDMPMFAFMM

SEQ ID NO: 2388664 - protein, 17 aa, Entamoeba dispar
PFFPWIDTAMSWETLVC

SEQ ID NO: 2388665 - protein, 19 aa, Entamoeba dispar
PFGKLGMLAALYIPTLLLT

SEQ ID NO: 2388666 - protein, 19 aa, Entamoeba dispar
PFHPTICYLLGYLDTIVDN

SEQ ID NO: 2388667 - protein, 20 aa, Entamoeba dispar
PFICGLLCSAFGKTWLHFLN

SEQ ID NO: 2388668 - protein, 19 aa, Entamoeba dispar
PFIFNVVILFVMLIRSAVF

SEQ ID NO: 2388669 - protein, 20 aa, Entamoeba dispar
PFIIGCTYSTFLQMVEEVEI

SEQ ID NO: 2388670 - protein, 18 aa, Entamoeba dispar
PFIKIWMKLPEIIRFSIK

SEQ ID NO: 2388671 - protein, 26 aa, Entamoeba dispar
PFILFACLFSTFFIIVIPIIFRSFYF

SEQ ID NO: 2388672 - protein, 20 aa, Entamoeba dispar
PFINCYKLLKKIGYYISQPF

SEQ ID NO: 2388673 - protein, 19 aa, Entamoeba dispar
PFKEMNWSLLISVLFWNIN

SEQ ID NO: 2388674 - protein, 18 aa, Entamoeba dispar
PFKKINTMTLKHSKGSRL

SEQ ID NO: 2388675 - protein, 23 aa, Entamoeba dispar
PFLPWKYIFYFLRYLVNSLDEIS

SEQ ID NO: 2388676 - protein, 18 aa, Entamoeba dispar
PFLQCFLSSLLLLIISFR

SEQ ID NO: 2388677 - protein, 24 aa, Entamoeba dispar
PFLQCFLSSLLLLIISFRHHLHPF

SEQ ID NO: 2388678 - protein, 19 aa, Entamoeba dispar
PFLTYRLTPNWYQHQPNYK

SEQ ID NO: 2388679 - protein, 17 aa, Entamoeba dispar
PFMCAFALSIIEYYVEK

SEQ ID NO: 2388680 - protein, 19 aa, Entamoeba dispar
PFNILLEKREYVLLLSGLL

SEQ ID NO: 2388681 - protein, 24 aa, Entamoeba dispar
PFNSSPYGICWCSEKSKANNCIIG

SEQ ID NO: 2388682 - protein, 21 aa, Entamoeba dispar
PFSCKSIELTPVLSVLKQGRS

SEQ ID NO: 2388683 - protein, 17 aa, Entamoeba dispar
PFSGPWSRIEVTGAVFI

SEQ ID NO: 2388684 - protein, 26 aa, Entamoeba dispar
PFSGSICCWCDDTAIQNKVSWAKQQV

SEQ ID NO: 2388685 - protein, 17 aa, Entamoeba dispar
PFSSPDFEQRWWRLTLI

SEQ ID NO: 2388686 - protein, 33 aa, Entamoeba dispar
PFTLNFFSYDGFLLGCVFSFNFFGFSSFFSLFN

SEQ ID NO: 2388687 - protein, 18 aa, Entamoeba dispar
PFTRILPLFQLRVAQPPT

SEQ ID NO: 2388688 - protein, 18 aa, Entamoeba dispar
PFVALSFLDATLMISSEF

SEQ ID NO: 2388689 - protein, 17 aa, Entamoeba dispar
PFVWQHVLIPLLPKSLV

SEQ ID NO: 2388690 - protein, 25 aa, Entamoeba dispar
PFVYEIRTILDWCLSKTSMFYKQWL

SEQ ID NO: 2388691 - protein, 25 aa, Entamoeba dispar
PFVYEIRTILDWTFAKTSMFYKLWL

SEQ ID NO: 2388692 - protein, 20 aa, Entamoeba dispar
PFWILWSGLIVLNLFILIVT

SEQ ID NO: 2388693 - protein, 18 aa, Entamoeba dispar
PFYTVVNVYPFKDGRKQN

SEQ ID NO: 2388694 - protein, 17 aa, Entamoeba dispar
PGCPTCLTNYTCADSCL

SEQ ID NO: 2388695 - protein, 20 aa, Entamoeba dispar
PGDFAELTITFMAKCTTLLN

SEQ ID NO: 2388696 - protein, 24 aa, Entamoeba dispar
PGDKQAACCLQMIADYALPRLFVG

SEQ ID NO: 2388697 - protein, 29 aa, Entamoeba dispar
PGEVQAPCYAKLYFPYNGFIIMTLILGAL

SEQ ID NO: 2388698 - protein, 22 aa, Entamoeba dispar
PGEVVTIKFPKGMSYKGVQVSI

SEQ ID NO: 2388699 - protein, 22 aa, Entamoeba dispar
PGGFKFNINFNYFLSSLSLFFL

SEQ ID NO: 2388700 - protein, 19 aa, Entamoeba dispar
PGGLCFIFLTFVYALFRLY

SEQ ID NO: 2388701 - protein, 21 aa, Entamoeba dispar
PGKTECKRCETEYGKYVNENR

SEQ ID NO: 2388702 - protein, 25 aa, Entamoeba dispar
PGLNPIPFKCLLKYSKKENQSYCIF

SEQ ID NO: 2388703 - protein, 20 aa, Entamoeba dispar
PGLSERILSFLILNSTSVIS

SEQ ID NO: 2388704 - protein, 17 aa, Entamoeba dispar
PGQRFSSFYTVASKSPI

SEQ ID NO: 2388705 - protein, 18 aa, Entamoeba dispar
PGQSVKINVLVCAKCTTK

SEQ ID NO: 2388706 - protein, 24 aa, Entamoeba dispar
PGTAGCKIIAHGGHGEYAYSVNGD

SEQ ID NO: 2388707 - protein, 17 aa, Entamoeba dispar
PGTAIQVTFKIKMLCTA

SEQ ID NO: 2388708 - protein, 25 aa, Entamoeba dispar
PGTCVPVCICCWFLNLFQNKKTRII

SEQ ID NO: 2388709 - protein, 20 aa, Entamoeba dispar
PGTYCSLFLGIVYFSQSFCF

SEQ ID NO: 2388710 - protein, 23 aa, Entamoeba dispar
PGVFFKYELSPYIVINEMNDHSF

SEQ ID NO: 2388711 - protein, 17 aa, Entamoeba dispar
PGYDCFINSPSTTNFEL

SEQ ID NO: 2388712 - protein, 17 aa, Entamoeba dispar
PHAPSYGYYIPIVIPPK

SEQ ID NO: 2388713 - protein, 22 aa, Entamoeba dispar
PHCIYEPRGVYSIIDTIKDIID

SEQ ID NO: 2388714 - protein, 23 aa, Entamoeba dispar
PHDSVLCKVSDFGTSRCFVESSK

SEQ ID NO: 2388715 - protein, 28 aa, Entamoeba dispar
PHEELLRHSIPIIIRLCQNKLLPNDFFK

SEQ ID NO: 2388716 - protein, 19 aa, Entamoeba dispar
PHFISEALQIFFISIQDSF

SEQ ID NO: 2388717 - protein, 18 aa, Entamoeba dispar
PHFLWCWGCMTEEKNDMV

SEQ ID NO: 2388718 - protein, 19 aa, Entamoeba dispar
PHVLHREGLSFNMMDVKRY

SEQ ID NO: 2388719 - protein, 18 aa, Entamoeba dispar
PHYEHFYENFVEEVNLMK

SEQ ID NO: 2388720 - protein, 17 aa, Entamoeba dispar
PHYLPYSIPRLSCLDDR

SEQ ID NO: 2388721 - protein, 17 aa, Entamoeba dispar
PIACPDKNWNVLREESR

SEQ ID NO: 2388722 - protein, 18 aa, Entamoeba dispar
PIALPLLINILSSFHCCQ

SEQ ID NO: 2388723 - protein, 18 aa, Entamoeba dispar
PICCLITFIDICSHWTHM

SEQ ID NO: 2388724 - protein, 21 aa, Entamoeba dispar
PICKSKFKLFLPLSNQISIIN

SEQ ID NO: 2388725 - protein, 23 aa, Entamoeba dispar
PICSLCLSAMIFCSVLPLLKNSA

SEQ ID NO: 2388726 - protein, 25 aa, Entamoeba dispar
PIDRKSVMIKFLLIYFVVLLIILGG

SEQ ID NO: 2388727 - protein, 18 aa, Entamoeba dispar
PIEFEIDKLLGIHTTEEV

SEQ ID NO: 2388728 - protein, 25 aa, Entamoeba dispar
PIEKFKYPWDVAQFIGSGKRLEKPN

SEQ ID NO: 2388729 - protein, 24 aa, Entamoeba dispar
PIELKRIVEHMILCHKDYPICQPE

SEQ ID NO: 2388730 - protein, 17 aa, Entamoeba dispar
PIEMKWYVKTPAKRNKN

SEQ ID NO: 2388731 - protein, 24 aa, Entamoeba dispar
PIEMVHLYLGIEIIRTINGWTPEI

SEQ ID NO: 2388732 - protein, 23 aa, Entamoeba dispar
PIESPNCMRIFKGITMATASLCN

SEQ ID NO: 2388733 - protein, 20 aa, Entamoeba dispar
PIFGWTVYNVMLTKTDLSTG

SEQ ID NO: 2388734 - protein, 18 aa, Entamoeba dispar
PIFKFLRNSNELFMQMLS

SEQ ID NO: 2388735 - protein, 22 aa, Entamoeba dispar
PIFKLDCLSSWPINSPTGYPLR

SEQ ID NO: 2388736 - protein, 23 aa, Entamoeba dispar
PIGEGAFGLVFRGTYRGQDVAIK

SEQ ID NO: 2388737 - protein, 18 aa, Entamoeba dispar
PIHCLSCNSLTGCIDCSQ

SEQ ID NO: 2388738 - protein, 17 aa, Entamoeba dispar
PIHEMIKSLLLSPNCTS

SEQ ID NO: 2388739 - protein, 19 aa, Entamoeba dispar
PIIDVYKAKICVVNKRSLN

SEQ ID NO: 2388740 - protein, 18 aa, Entamoeba dispar
PIITECLIENGILDLLNV

SEQ ID NO: 2388741 - protein, 18 aa, Entamoeba dispar
PIKKRNIEIPKVIDELPF

SEQ ID NO: 2388742 - protein, 19 aa, Entamoeba dispar
PIKSFKMEITLQMTSNKEG

SEQ ID NO: 2388743 - protein, 24 aa, Entamoeba dispar
PIKSFRYNFLYIFNEFITIIGDMI

SEQ ID NO: 2388744 - protein, 24 aa, Entamoeba dispar
PILHMVSLFVLWFAPLQRRFQSFL

SEQ ID NO: 2388745 - protein, 18 aa, Entamoeba dispar
PILKTSIGIDVPRLATKI

SEQ ID NO: 2388746 - protein, 18 aa, Entamoeba dispar
PILLKLRIFFESVHRTIA

SEQ ID NO: 2388747 - protein, 24 aa, Entamoeba dispar
PILPPDMLSLAFAPMPFIIGCTYS

SEQ ID NO: 2388748 - protein, 23 aa, Entamoeba dispar
PILPSDGSVVWAIIIKIIIMLLP

SEQ ID NO: 2388749 - protein, 34 aa, Entamoeba dispar
PILQLLRCYVLFPEHWPTFLALADMHELLAIYSE

SEQ ID NO: 2388750 - protein, 24 aa, Entamoeba dispar
PILRFNPKCIVCVGDPMQLDPVLQ

SEQ ID NO: 2388751 - protein, 22 aa, Entamoeba dispar
PILSIPYLPLFGQPLKNVMLCH

SEQ ID NO: 2388752 - protein, 18 aa, Entamoeba dispar
PIMGNGLGIWFTDSQIYK

SEQ ID NO: 2388753 - protein, 18 aa, Entamoeba dispar
PINCIKYVLMIGSIKTIS

SEQ ID NO: 2388754 - protein, 18 aa, Entamoeba dispar
PINLKFSSNKGIWYLISS

SEQ ID NO: 2388755 - protein, 17 aa, Entamoeba dispar
PINLKFSSNNGIWYLIS

SEQ ID NO: 2388756 - protein, 25 aa, Entamoeba dispar
PINPIRWTLYQGISLKYNHKFNCSF

SEQ ID NO: 2388757 - protein, 20 aa, Entamoeba dispar
PINRCKTLLIGILIFSICLL

SEQ ID NO: 2388758 - protein, 24 aa, Entamoeba dispar
PINYHSRESFTMYLTKPINFPTNT

SEQ ID NO: 2388759 - protein, 24 aa, Entamoeba dispar
PIQPKLPCDLIEITPSFPSKKENV

SEQ ID NO: 2388760 - protein, 27 aa, Entamoeba dispar
PIQRFPFSSLLKRMSVVVAIKDFSTNT

SEQ ID NO: 2388761 - protein, 18 aa, Entamoeba dispar
PISEVIEMIPMLKQYIMK

SEQ ID NO: 2388762 - protein, 18 aa, Entamoeba dispar
PISISICGDGIVDIFDEE

SEQ ID NO: 2388763 - protein, 27 aa, Entamoeba dispar
PITEYPYPWSISKFVCVGRRLPQPLDM

SEQ ID NO: 2388764 - protein, 26 aa, Entamoeba dispar
PITIFKRFWKVLIIPYYMVKSFFVRG

SEQ ID NO: 2388765 - protein, 18 aa, Entamoeba dispar
PITPMVLSSPPWNCFSPQ

SEQ ID NO: 2388766 - protein, 26 aa, Entamoeba dispar
PKAKEFICFSSGWHKVIERFRLLTNN

SEQ ID NO: 2388767 - protein, 32 aa, Entamoeba dispar
PKAPKITWRLQIMLWYAGLRGAIAVILALQMN

SEQ ID NO: 2388768 - protein, 17 aa, Entamoeba dispar
PKAPVPYDPHVLGVGIV

SEQ ID NO: 2388769 - protein, 20 aa, Entamoeba dispar
PKCTTLTEKTCYCSKNKVKI

SEQ ID NO: 2388770 - protein, 17 aa, Entamoeba dispar
PKDLILFSYQELQRKDK

SEQ ID NO: 2388771 - protein, 20 aa, Entamoeba dispar
PKEEFWFISINRYEGKKNHK

SEQ ID NO: 2388772 - protein, 24 aa, Entamoeba dispar
PKEFISQIIVICWNHDPRIKAIDT

SEQ ID NO: 2388773 - protein, 22 aa, Entamoeba dispar
PKEFPKKCCGIVGYVGNDSCSK

SEQ ID NO: 2388774 - protein, 25 aa, Entamoeba dispar
PKEKHIWNAIFGRFVDDIQTNSSPD

SEQ ID NO: 2388775 - protein, 18 aa, Entamoeba dispar
PKEKRPTANMFMSTVEKK

SEQ ID NO: 2388776 - protein, 24 aa, Entamoeba dispar
PKENIFLSFIHRYFNKSYLGLIII

SEQ ID NO: 2388777 - protein, 19 aa, Entamoeba dispar
PKERIRIEEVVKMLERIEN

SEQ ID NO: 2388778 - protein, 19 aa, Entamoeba dispar
PKERIRIEEVVRMLEIIKN

SEQ ID NO: 2388779 - protein, 19 aa, Entamoeba dispar
PKERIRIEEVVRMLERIEN

SEQ ID NO: 2388780 - protein, 20 aa, Entamoeba dispar
PKERITIKEVVRMLERIQSN

SEQ ID NO: 2388781 - protein, 17 aa, Entamoeba dispar
PKESVVLTVSFMAKCTT

SEQ ID NO: 2388782 - protein, 19 aa, Entamoeba dispar
PKFADILTIIESWGEDIRY

SEQ ID NO: 2388783 - protein, 18 aa, Entamoeba dispar
PKFGMIFQIFSIAITGYI

SEQ ID NO: 2388784 - protein, 26 aa, Entamoeba dispar
PKGFPTRKLIPLLLLQICEAFTKNSI

SEQ ID NO: 2388785 - protein, 22 aa, Entamoeba dispar
PKGFPTRKLIPLLLLQICESFT

SEQ ID NO: 2388786 - protein, 17 aa, Entamoeba dispar
PKGKNCYNTMAGYCEIC

SEQ ID NO: 2388787 - protein, 19 aa, Entamoeba dispar
PKGPLRILVNLAQERNEPI

SEQ ID NO: 2388788 - protein, 18 aa, Entamoeba dispar
PKILGEWYTKPNIIKYGG

SEQ ID NO: 2388789 - protein, 25 aa, Entamoeba dispar
PKILIEIIKAMYFKSDFFEDHFFEN

SEQ ID NO: 2388790 - protein, 20 aa, Entamoeba dispar
PKIRQCAVEILGNICRLYIK

SEQ ID NO: 2388791 - protein, 19 aa, Entamoeba dispar
PKKALLRYLIKTPTQKISK

SEQ ID NO: 2388792 - protein, 20 aa, Entamoeba dispar
PKKILGICCTVIVGVSYGAF

SEQ ID NO: 2388793 - protein, 25 aa, Entamoeba dispar
PKKVSRKGVQFSFVIPNTTHKMYAI

SEQ ID NO: 2388794 - protein, 20 aa, Entamoeba dispar
PKLFVGMLICLIFSEALALY

SEQ ID NO: 2388795 - protein, 29 aa, Entamoeba dispar
PKLMDFPPLEFAKQITLFTSELFRKIKLV

SEQ ID NO: 2388796 - protein, 30 aa, Entamoeba dispar
PKLQQIHAFSSRFWPYFSNVTLFSIFVPIL

SEQ ID NO: 2388797 - protein, 21 aa, Entamoeba dispar
PKNGGGYGYLSRWVEKIISPY

SEQ ID NO: 2388798 - protein, 17 aa, Entamoeba dispar
PKPLLAEIQEFLRKKGI

SEQ ID NO: 2388799 - protein, 20 aa, Entamoeba dispar
PKPSVSLSRIIAKSIIKNKN

SEQ ID NO: 2388800 - protein, 23 aa, Entamoeba dispar
PKPWSTNELSSWKCAGDDAQFNQ

SEQ ID NO: 2388801 - protein, 22 aa, Entamoeba dispar
PKQFFLTSFVMFNLLGIDVSNI

SEQ ID NO: 2388802 - protein, 19 aa, Entamoeba dispar
PKQLFLFYLLEGIIEGGSQ

SEQ ID NO: 2388803 - protein, 20 aa, Entamoeba dispar
PKQPLICLSHEPPFNMMDYG

SEQ ID NO: 2388804 - protein, 17 aa, Entamoeba dispar
PKSVCSRSVNGKAIQRY

SEQ ID NO: 2388805 - protein, 19 aa, Entamoeba dispar
PKTCMKRTLYHENEAQLEK

SEQ ID NO: 2388806 - protein, 26 aa, Entamoeba dispar
PKTEFKFPWKIAEFISTGKRPPIIQE

SEQ ID NO: 2388807 - protein, 19 aa, Entamoeba dispar
PKTFYYSSIIVHLFLYGVI

SEQ ID NO: 2388808 - protein, 19 aa, Entamoeba dispar
PKTRVVCRYDNGWKSKNCP

SEQ ID NO: 2388809 - protein, 26 aa, Entamoeba dispar
PKTRYNCYAHLWDLHLKQIVAEEGNN

SEQ ID NO: 2388810 - protein, 19 aa, Entamoeba dispar
PKTRYNCYSHVWDAHLRHL

SEQ ID NO: 2388811 - protein, 17 aa, Entamoeba dispar
PKVSTLMQRSPDLPDYV

SEQ ID NO: 2388812 - protein, 24 aa, Entamoeba dispar
PKWEIRHGAAICLREVLRAQSNAV

SEQ ID NO: 2388813 - protein, 20 aa, Entamoeba dispar
PKYCELCKKVIGILRILSKS

SEQ ID NO: 2388814 - protein, 26 aa, Entamoeba dispar
PKYLPFLKEFCETQMFESFINEKLDA

SEQ ID NO: 2388815 - protein, 29 aa, Entamoeba dispar
PKYTFIETFDISKLTGFFFTINAKVSSGV

SEQ ID NO: 2388816 - protein, 23 aa, Entamoeba dispar
PKYYSVMVSLFFWAVVTVLCFYD

SEQ ID NO: 2388817 - protein, 18 aa, Entamoeba dispar
PLAIYAFFYPLRNPFYHC

SEQ ID NO: 2388818 - protein, 17 aa, Entamoeba dispar
PLALLPFIIESLKELNV

SEQ ID NO: 2388819 - protein, 20 aa, Entamoeba dispar
PLALYHCFLQLGTFSQIYFD

SEQ ID NO: 2388820 - protein, 23 aa, Entamoeba dispar
PLCYKQAYPTLWYKIKGDGRYLV

SEQ ID NO: 2388821 - protein, 22 aa, Entamoeba dispar
PLEALKPIIVMFVGFYHKKYIK

SEQ ID NO: 2388822 - protein, 23 aa, Entamoeba dispar
PLEVVKYPIVQASDIEYIYVGDF

SEQ ID NO: 2388823 - protein, 19 aa, Entamoeba dispar
PLEYLTFMLQLFVTPPLTE

SEQ ID NO: 2388824 - protein, 26 aa, Entamoeba dispar
PLFHSECGDGIVLELNENLILCGVTS

SEQ ID NO: 2388825 - protein, 18 aa, Entamoeba dispar
PLFIPSAFFLSKLFWVIL

SEQ ID NO: 2388826 - protein, 29 aa, Entamoeba dispar
PLFKELLSYICADYCKIYCVNTFKQQTGY

SEQ ID NO: 2388827 - protein, 18 aa, Entamoeba dispar
PLFPFAWSIADFVTHGKR

SEQ ID NO: 2388828 - protein, 28 aa, Entamoeba dispar
PLGFFCCGCSFLFIFFFDRVVATHGGHA

SEQ ID NO: 2388829 - protein, 18 aa, Entamoeba dispar
PLGILLFRYEDWMPSALF

SEQ ID NO: 2388830 - protein, 17 aa, Entamoeba dispar
PLGIPIDVPEEIVNNEN

SEQ ID NO: 2388831 - protein, 35 aa, Entamoeba dispar
PLGYCIFLSIKRIESWKRHAMFWMIVLTPASIIGC

SEQ ID NO: 2388832 - protein, 23 aa, Entamoeba dispar
PLICAGPGLLSALWGIIVFGEIR

SEQ ID NO: 2388833 - protein, 27 aa, Entamoeba dispar
PLICAGPGLLSALWGIVVFREIRGWKN

SEQ ID NO: 2388834 - protein, 19 aa, Entamoeba dispar
PLIDIEAGFIRQLKLFEKK

SEQ ID NO: 2388835 - protein, 17 aa, Entamoeba dispar
PLIFYPRSLEPFCDVSL

SEQ ID NO: 2388836 - protein, 19 aa, Entamoeba dispar
PLILVGGVSLLFSITLGPF

SEQ ID NO: 2388837 - protein, 17 aa, Entamoeba dispar
PLIQCTINSNKNEFLTE

SEQ ID NO: 2388838 - protein, 24 aa, Entamoeba dispar
PLISSPLIAWSFTQKFPFNAHFTF

SEQ ID NO: 2388839 - protein, 18 aa, Entamoeba dispar
PLKYIPKLVYPFEQIDIL

SEQ ID NO: 2388840 - protein, 18 aa, Entamoeba dispar
PLLILLGIVCLFFAGITT

SEQ ID NO: 2388841 - protein, 25 aa, Entamoeba dispar
PLMKGAKKGIDFGFFEGETFGNMGS

SEQ ID NO: 2388842 - protein, 24 aa, Entamoeba dispar
PLPELKSLCLNNCPLKDNKQTIRS

SEQ ID NO: 2388843 - protein, 24 aa, Entamoeba dispar
PLPICIVSQLPLKYFIIPFILSIG

SEQ ID NO: 2388844 - protein, 20 aa, Entamoeba dispar
PLPIKRGIKNLCTPPTIATL

SEQ ID NO: 2388845 - protein, 20 aa, Entamoeba dispar
PLPKYNVLRIFKTIIKEMKN

SEQ ID NO: 2388846 - protein, 21 aa, Entamoeba dispar
PLQSVWCTLTYFNDSKQSKKL

SEQ ID NO: 2388847 - protein, 19 aa, Entamoeba dispar
PLQWSRGDDIIFLFMGNEL

SEQ ID NO: 2388848 - protein, 26 aa, Entamoeba dispar
PLSDFLKVRFCQDIARGMEYLHQNDI

SEQ ID NO: 2388849 - protein, 20 aa, Entamoeba dispar
PLSDHIKCTTLFNLGSTQSI

SEQ ID NO: 2388850 - protein, 25 aa, Entamoeba dispar
PLSLSCSTLTFGRSGTEPVPVDEEL

SEQ ID NO: 2388851 - protein, 26 aa, Entamoeba dispar
PLTDLLKVRFCQDIARGMEYLHQNDI

SEQ ID NO: 2388852 - protein, 29 aa, Entamoeba dispar
PLTYQIVCHLFATMFTFIFSIVSFVFGSV

SEQ ID NO: 2388853 - protein, 34 aa, Entamoeba dispar
PLVNSFKYDTCIGNEIFKNAILVTPYLPFTTDYN

SEQ ID NO: 2388854 - protein, 19 aa, Entamoeba dispar
PLVSYICLFGYSYTIYLIV

SEQ ID NO: 2388855 - protein, 20 aa, Entamoeba dispar
PLYFMDFFISPKLHYLMFSN

SEQ ID NO: 2388856 - protein, 17 aa, Entamoeba dispar
PLYLGSISNTFKANKVI

SEQ ID NO: 2388857 - protein, 18 aa, Entamoeba dispar
PMKENRVVENFITTNTFC

SEQ ID NO: 2388858 - protein, 27 aa, Entamoeba dispar
PMKVLCKKHRELTCCIDGKIYEEYSQN

SEQ ID NO: 2388859 - protein, 31 aa, Entamoeba dispar
PMLIATVITICFSRFFTVCVYDKIAIDKKLP

SEQ ID NO: 2388860 - protein, 22 aa, Entamoeba dispar
PMLSSFLDYFGYFVGGWKSNMD

SEQ ID NO: 2388861 - protein, 21 aa, Entamoeba dispar
PMNDFPIFFDIFKHFITVHFK

SEQ ID NO: 2388862 - protein, 27 aa, Entamoeba dispar
PMNLFYKRIGLGIAFYMLVWAISIFEP

SEQ ID NO: 2388863 - protein, 27 aa, Entamoeba dispar
PMSDFLKIRFCQDIARGMEYLHENDIL

SEQ ID NO: 2388864 - protein, 26 aa, Entamoeba dispar
PMSDLLKVRFCQDIARGMEYLHQNDI

SEQ ID NO: 2388865 - protein, 25 aa, Entamoeba dispar
PNAKFLICCEPIFFDYIQLLITYYL

SEQ ID NO: 2388866 - protein, 22 aa, Entamoeba dispar
PNDELRVLCDIFLQKTVHPNLC

SEQ ID NO: 2388867 - protein, 23 aa, Entamoeba dispar
PNDHVRFSISITPGVVILKKNTA

SEQ ID NO: 2388868 - protein, 24 aa, Entamoeba dispar
PNDICIRLRLIVEAMSLSMIIGIQ

SEQ ID NO: 2388869 - protein, 20 aa, Entamoeba dispar
PNEHAIALSSTVSFKETNLI

SEQ ID NO: 2388870 - protein, 28 aa, Entamoeba dispar
PNETNEFFYDCCYGMPLTYHYSELYLLT

SEQ ID NO: 2388871 - protein, 20 aa, Entamoeba dispar
PNFFKGNLLIPSVSLSQIIC

SEQ ID NO: 2388872 - protein, 30 aa, Entamoeba dispar
PNFLLCIDWLIVMIDFYFERQRSVFFGTFV

SEQ ID NO: 2388873 - protein, 22 aa, Entamoeba dispar
PNGCVSCSLIIPHCSQCTQTGN

SEQ ID NO: 2388874 - protein, 20 aa, Entamoeba dispar
PNGFFPYPDGSRCFTCQPGM

SEQ ID NO: 2388875 - protein, 26 aa, Entamoeba dispar
PNGMNPEFAQLVCDLWNSDRVERPSI

SEQ ID NO: 2388876 - protein, 17 aa, Entamoeba dispar
PNGRFAINTKICLSITS

SEQ ID NO: 2388877 - protein, 24 aa, Entamoeba dispar
PNHLKLTHCFTFPGNSSKVEGIVL

SEQ ID NO: 2388878 - protein, 19 aa, Entamoeba dispar
PNIAFFIGMILFVLLEKSI

SEQ ID NO: 2388879 - protein, 18 aa, Entamoeba dispar
PNIDFARDIFSDEGQKEL

SEQ ID NO: 2388880 - protein, 19 aa, Entamoeba dispar
PNIFKSIRIIFASNSGGKL

SEQ ID NO: 2388881 - protein, 23 aa, Entamoeba dispar
PNIPKEFCEYILTKKINGNTIRK

SEQ ID NO: 2388882 - protein, 26 aa, Entamoeba dispar
PNIYSKLVLCDAIHWFSQIITIPEYC

SEQ ID NO: 2388883 - protein, 19 aa, Entamoeba dispar
PNKCCYINLLFMPYCSFNI

SEQ ID NO: 2388884 - protein, 24 aa, Entamoeba dispar
PNKDFRFSTEFEYGGSQSDKKVLN

SEQ ID NO: 2388885 - protein, 23 aa, Entamoeba dispar
PNKKITILFLKIFLINPTRFCTM

SEQ ID NO: 2388886 - protein, 21 aa, Entamoeba dispar
PNKYFRREYIFVRDFITGLST

SEQ ID NO: 2388887 - protein, 22 aa, Entamoeba dispar
PNLEISDPLFGYIETSFTRLAD

SEQ ID NO: 2388888 - protein, 24 aa, Entamoeba dispar
PNLICKADNVLNCYLHDKNICVQC

SEQ ID NO: 2388889 - protein, 18 aa, Entamoeba dispar
PNLPFGGNCQSGIGCYHG

SEQ ID NO: 2388890 - protein, 23 aa, Entamoeba dispar
PNNKRDLLVYSFGFFTKGIYMRQ

SEQ ID NO: 2388891 - protein, 26 aa, Entamoeba dispar
PNPFMFIVWFIPQWIKSLKRIGIIKE

SEQ ID NO: 2388892 - protein, 25 aa, Entamoeba dispar
PNQGRCFYCQCSYLDGSAVLTMYEE

SEQ ID NO: 2388893 - protein, 23 aa, Entamoeba dispar
PNQHCAGSYGMIQCSAKVSSGTV

SEQ ID NO: 2388894 - protein, 17 aa, Entamoeba dispar
PNQPGSCREKIFPSWGI

SEQ ID NO: 2388895 - protein, 25 aa, Entamoeba dispar
PNSELVYFYYFLPFKIYIDNNKKMY

SEQ ID NO: 2388896 - protein, 23 aa, Entamoeba dispar
PNTQVCFCYLIPFLSKNKNNKYK

SEQ ID NO: 2388897 - protein, 26 aa, Entamoeba dispar
PNVLGECNCQIAIIIQPHLKGIYKIQ

SEQ ID NO: 2388898 - protein, 28 aa, Entamoeba dispar
PNYEMADALSWGRGVGCSFLEDCSKWPK

SEQ ID NO: 2388899 - protein, 34 aa, Entamoeba dispar
PPAYMAAVFICLAIVFQLIVCFSQEFGKKWIFVS

SEQ ID NO: 2388900 - protein, 21 aa, Entamoeba dispar
PPELLKQCISIFITMLNTNNP

SEQ ID NO: 2388901 - protein, 23 aa, Entamoeba dispar
PPEPIIPMQIFWYIVYYGMIAFA

SEQ ID NO: 2388902 - protein, 17 aa, Entamoeba dispar
PPFIPIVVLIKQELIKI

SEQ ID NO: 2388903 - protein, 19 aa, Entamoeba dispar
PPFLLILLFSFFKKSSKFL

SEQ ID NO: 2388904 - protein, 17 aa, Entamoeba dispar
PPFTIGWDMFGLIYQLL

SEQ ID NO: 2388905 - protein, 17 aa, Entamoeba dispar
PPLINSIPFPCKELLLS

SEQ ID NO: 2388906 - protein, 20 aa, Entamoeba dispar
PPNGYIRFYGFTKYSNYDNY

SEQ ID NO: 2388907 - protein, 23 aa, Entamoeba dispar
PPSCSFSWIKLKVYPFTLNFFSY

SEQ ID NO: 2388908 - protein, 24 aa, Entamoeba dispar
PPSGCKSFLKEAGFETEDNVADAL

SEQ ID NO: 2388909 - protein, 21 aa, Entamoeba dispar
PPTIASIILKMWDQIPEKRCK

SEQ ID NO: 2388910 - protein, 24 aa, Entamoeba dispar
PPTSELFINASWIFSVICRSLKVE

SEQ ID NO: 2388911 - protein, 18 aa, Entamoeba dispar
PPVPIKSASTISIKSKKN

SEQ ID NO: 2388912 - protein, 22 aa, Entamoeba dispar
PPYWINVWYVYIFYYFALLFAF

SEQ ID NO: 2388913 - protein, 34 aa, Entamoeba dispar
PQAKLLFVLGFVFCCLWPINACLYRHSTNKQIQQ

SEQ ID NO: 2388914 - protein, 17 aa, Entamoeba dispar
PQCKVCHSVPVRRSSEH

SEQ ID NO: 2388915 - protein, 18 aa, Entamoeba dispar
PQHIDSFIDYYFEILPLF

SEQ ID NO: 2388916 - protein, 22 aa, Entamoeba dispar
PQHMKRFNSAIVKNIIQSTEEL

SEQ ID NO: 2388917 - protein, 19 aa, Entamoeba dispar
PQIFCLIAIGFRYCKKDII

SEQ ID NO: 2388918 - protein, 23 aa, Entamoeba dispar
PQLIRLFLSFFLINSTRFAYLAK

SEQ ID NO: 2388919 - protein, 20 aa, Entamoeba dispar
PQLREFLFSCFKRDPNQRAS

SEQ ID NO: 2388920 - protein, 25 aa, Entamoeba dispar
PQQKECFELLSSKKIRSVIETIREE

SEQ ID NO: 2388921 - protein, 29 aa, Entamoeba dispar
PQRIKCHRVFRVVFELIYQCNSEKHLTLS

SEQ ID NO: 2388922 - protein, 17 aa, Entamoeba dispar
PQTLTFVFLNKWNFEEL

SEQ ID NO: 2388923 - protein, 19 aa, Entamoeba dispar
PQVAPVIGFSNSFTFSHTG

SEQ ID NO: 2388924 - protein, 25 aa, Entamoeba dispar
PQVFNLSVEFLRGFPYMTCAFTAHY

SEQ ID NO: 2388925 - protein, 18 aa, Entamoeba dispar
PQVHILRSHTIKVCTCFM

SEQ ID NO: 2388926 - protein, 17 aa, Entamoeba dispar
PQWKCDVCNDGFIFQCG

SEQ ID NO: 2388927 - protein, 19 aa, Entamoeba dispar
PQYIYPWKIIGELSAILSY

SEQ ID NO: 2388928 - protein, 24 aa, Entamoeba dispar
PRFKPIQFKWSKFIKKLDPDNEAF

SEQ ID NO: 2388929 - protein, 21 aa, Entamoeba dispar
PRGRIRFLLRPSGVVGCNTVN

SEQ ID NO: 2388930 - protein, 20 aa, Entamoeba dispar
PRIKAIDTVRAFHLSMGYMV

SEQ ID NO: 2388931 - protein, 20 aa, Entamoeba dispar
PRIYPKLKLSTSACNELHDT

SEQ ID NO: 2388932 - protein, 19 aa, Entamoeba dispar
PRKDCILPSCGNGRIDSGE

SEQ ID NO: 2388933 - protein, 30 aa, Entamoeba dispar
PRMIKVCDITEPFVPLAPKNFFKPISEVIE

SEQ ID NO: 2388934 - protein, 17 aa, Entamoeba dispar
PRMYCLSNKCGNNVLDE

SEQ ID NO: 2388935 - protein, 31 aa, Entamoeba dispar
PRNLPQRIVYVFNWPLLVILAYTIPDVKIKT

SEQ ID NO: 2388936 - protein, 18 aa, Entamoeba dispar
PRPPLSQNINEGFPSSHA

SEQ ID NO: 2388937 - protein, 21 aa, Entamoeba dispar
PRRVLRCPALLVFQNFLIQYY

SEQ ID NO: 2388938 - protein, 21 aa, Entamoeba dispar
PRSAFYKFTLKQNMPIEISTC

SEQ ID NO: 2388939 - protein, 19 aa, Entamoeba dispar
PRSLEPFCDVSLQQLEKNK

SEQ ID NO: 2388940 - protein, 17 aa, Entamoeba dispar
PRSMFLLVIMTVLTYII

SEQ ID NO: 2388941 - protein, 26 aa, Entamoeba dispar
PRSPVCAKLTDFGTCRNISERNLSAK

SEQ ID NO: 2388942 - protein, 20 aa, Entamoeba dispar
PRTPRLICNTIKKVRKSRSL

SEQ ID NO: 2388943 - protein, 24 aa, Entamoeba dispar
PRVRTSDLPQCFPLNKNIINKQKI

SEQ ID NO: 2388944 - protein, 19 aa, Entamoeba dispar
PRVTHCDICETCILRHDHH

SEQ ID NO: 2388945 - protein, 20 aa, Entamoeba dispar
PRVYFSLLIIFMALYSIYIG

SEQ ID NO: 2388946 - protein, 20 aa, Entamoeba dispar
PRWLAPNILTTVGFISMTFA

SEQ ID NO: 2388947 - protein, 21 aa, Entamoeba dispar
PSAGGLCLLYGISDVTVDAQV

SEQ ID NO: 2388948 - protein, 24 aa, Entamoeba dispar
PSCGICSTGYVCTKSGMCVEEPNM

SEQ ID NO: 2388949 - protein, 27 aa, Entamoeba dispar
PSCYELCLNELFAPFTTINLLRKQENR

SEQ ID NO: 2388950 - protein, 24 aa, Entamoeba dispar
PSELKIQECFNLTGNVAKIIQLNL

SEQ ID NO: 2388951 - protein, 21 aa, Entamoeba dispar
PSFELQLKFNVICKEKCGGGM

SEQ ID NO: 2388952 - protein, 24 aa, Entamoeba dispar
PSFFKSNNSFLFNSHLSILSPFLP

SEQ ID NO: 2388953 - protein, 24 aa, Entamoeba dispar
PSFLTKILCCGFCDKKDIVTSSSE

SEQ ID NO: 2388954 - protein, 23 aa, Entamoeba dispar
PSFNKEFYTTVDIDERLKNLSLE

SEQ ID NO: 2388955 - protein, 23 aa, Entamoeba dispar
PSFPELLPALKSMFTFPSPQHRS

SEQ ID NO: 2388956 - protein, 23 aa, Entamoeba dispar
PSICKKTEMGYCVQCDDKHFLQG

SEQ ID NO: 2388957 - protein, 26 aa, Entamoeba dispar
PSIIIKLCDFGVALKATREMEYGVGS

SEQ ID NO: 2388958 - protein, 34 aa, Entamoeba dispar
PSIIRDANLFFAEFIRDLAIMWRHDEMAKLVDTH

SEQ ID NO: 2388959 - protein, 19 aa, Entamoeba dispar
PSISCKANIMLSLYSYSKQ

SEQ ID NO: 2388960 - protein, 19 aa, Entamoeba dispar
PSKFELHDIIVPYLLATAS

SEQ ID NO: 2388961 - protein, 19 aa, Entamoeba dispar
PSKLRGVASEAMILAATSL

SEQ ID NO: 2388962 - protein, 23 aa, Entamoeba dispar
PSKRRRWILSMFIFSLIGLSSSF

SEQ ID NO: 2388963 - protein, 18 aa, Entamoeba dispar
PSKVEAFGISKNVIGFNE

SEQ ID NO: 2388964 - protein, 22 aa, Entamoeba dispar
PSLELYVPFLFVFVHLITSPNG

SEQ ID NO: 2388965 - protein, 18 aa, Entamoeba dispar
PSLLEFFGYTFFFPGIFS

SEQ ID NO: 2388966 - protein, 20 aa, Entamoeba dispar
PSLLLTYIDFIIAAKERLLR

SEQ ID NO: 2388967 - protein, 25 aa, Entamoeba dispar
PSLNPAKLIPLRRLTIDSSQINTPN

SEQ ID NO: 2388968 - protein, 20 aa, Entamoeba dispar
PSLPSCLGKDAIVNKSVNWE

SEQ ID NO: 2388969 - protein, 22 aa, Entamoeba dispar
PSLPSFIIAALVKFITGCTVIV

SEQ ID NO: 2388970 - protein, 20 aa, Entamoeba dispar
PSLRIQAKILSLILFHHDNF

SEQ ID NO: 2388971 - protein, 20 aa, Entamoeba dispar
PSLRLVILNIIRNLAVDEGL

SEQ ID NO: 2388972 - protein, 26 aa, Entamoeba dispar
PSPCDRNGWKWGTWNQLESTYKSYGL

SEQ ID NO: 2388973 - protein, 17 aa, Entamoeba dispar
PSPEVRKSVKLEPVDVC

SEQ ID NO: 2388974 - protein, 17 aa, Entamoeba dispar
PSPQRILFLSSLHNLIP

SEQ ID NO: 2388975 - protein, 24 aa, Entamoeba dispar
PSQMFCPHCNKLITTEVTYEAGSL

SEQ ID NO: 2388976 - protein, 18 aa, Entamoeba dispar
PSQSLCYCHLLSTDHFPL

SEQ ID NO: 2388977 - protein, 20 aa, Entamoeba dispar
PSSDGYCWSYTCDETTGFCK

SEQ ID NO: 2388978 - protein, 21 aa, Entamoeba dispar
PSSECTKMFSSIIKNKLLSSV

SEQ ID NO: 2388979 - protein, 30 aa, Entamoeba dispar
PSSFYTIHSSRRWKIDISTCETSTNMNYDI

SEQ ID NO: 2388980 - protein, 31 aa, Entamoeba dispar
PSSKFPTSLFIKIMHSVCLFETSRIIKATAS

SEQ ID NO: 2388981 - protein, 26 aa, Entamoeba dispar
PSSLLFPKEIEEIGLLMKRVTEKVYQ

SEQ ID NO: 2388982 - protein, 17 aa, Entamoeba dispar
PSTLKKSASGIIKKKTG

SEQ ID NO: 2388983 - protein, 23 aa, Entamoeba dispar
PSTLNLPPLMKFIINDLYSSYNP

SEQ ID NO: 2388984 - protein, 27 aa, Entamoeba dispar
PSTNFLKLRFCQDIARGMLYLHENDII

SEQ ID NO: 2388985 - protein, 21 aa, Entamoeba dispar
PSVCKQLRTRGYGIYIESGAG

SEQ ID NO: 2388986 - protein, 22 aa, Entamoeba dispar
PSVCKQLRTRGYGIYIESGAGL

SEQ ID NO: 2388987 - protein, 18 aa, Entamoeba dispar
PSVKVFSEECIKFYKSCN

SEQ ID NO: 2388988 - protein, 28 aa, Entamoeba dispar
PSVMKLTEIFKVFILRFNFKSKENILIN

SEQ ID NO: 2388989 - protein, 19 aa, Entamoeba dispar
PSVNSCLHKTMLTQTKDTF

SEQ ID NO: 2388990 - protein, 19 aa, Entamoeba dispar
PSVRWTFQQIDEFLDEYFK

SEQ ID NO: 2388991 - protein, 17 aa, Entamoeba dispar
PSVSKEITIFFNLLETR

SEQ ID NO: 2388992 - protein, 19 aa, Entamoeba dispar
PTCQCEKGYSLIEGYCVSD

SEQ ID NO: 2388993 - protein, 25 aa, Entamoeba dispar
PTDKNPQCLTRFLLTTDKITGVMQI

SEQ ID NO: 2388994 - protein, 24 aa, Entamoeba dispar
PTEGCAICKDGYYWKDKNCYSCQE

SEQ ID NO: 2388995 - protein, 21 aa, Entamoeba dispar
PTERVFDFLDDIYVTFVKTFN

SEQ ID NO: 2388996 - protein, 27 aa, Entamoeba dispar
PTGRFTTLFPLCIVIIVSMIKEFYEDI

SEQ ID NO: 2388997 - protein, 23 aa, Entamoeba dispar
PTIIFCVSCCILGLLSSTLTVIL

SEQ ID NO: 2388998 - protein, 20 aa, Entamoeba dispar
PTIPQPFKFISLPSTYQQLI

SEQ ID NO: 2388999 - protein, 19 aa, Entamoeba dispar
PTLLFPFITKKFFIEEYNL

SEQ ID NO: 2389000 - protein, 23 aa, Entamoeba dispar
PTLYEIWDSCLLIALEIETDTTL

SEQ ID NO: 2389001 - protein, 28 aa, Entamoeba dispar
PTMHSCVVIGWKLCLPPLLSYFQICELM

SEQ ID NO: 2389002 - protein, 18 aa, Entamoeba dispar
PTNDCLVKSITENSYEQE

SEQ ID NO: 2389003 - protein, 18 aa, Entamoeba dispar
PTNIIWFAFVTEPIVNLD

SEQ ID NO: 2389004 - protein, 28 aa, Entamoeba dispar
PTNRYRLEFRINLILSKCHGFSNFYILR

SEQ ID NO: 2389005 - protein, 18 aa, Entamoeba dispar
PTPICELTNLNILDLSQT

SEQ ID NO: 2389006 - protein, 20 aa, Entamoeba dispar
PTQRPFVCMIAGTFKTKPNH

SEQ ID NO: 2389007 - protein, 19 aa, Entamoeba dispar
PTRITKCRLIDIEFFLIIY

SEQ ID NO: 2389008 - protein, 23 aa, Entamoeba dispar
PTRKPRASFSIGSKRMSLRTLPL

SEQ ID NO: 2389009 - protein, 25 aa, Entamoeba dispar
PTSDPRFVYPWKIAEFVISGKRLEK

SEQ ID NO: 2389010 - protein, 21 aa, Entamoeba dispar
PTVFCGWRSIIIFGTVWGLVP

SEQ ID NO: 2389011 - protein, 28 aa, Entamoeba dispar
PTVLLLLSISCSIGYTCLDVMNNFKDVV

SEQ ID NO: 2389012 - protein, 23 aa, Entamoeba dispar
PTWRITFFYCWELGYHFHSLVYH

SEQ ID NO: 2389013 - protein, 20 aa, Entamoeba dispar
PTYYPFFNVYAMSYNGNYYG

SEQ ID NO: 2389014 - protein, 17 aa, Entamoeba dispar
PVALKIQREKDIKSIPM

SEQ ID NO: 2389015 - protein, 23 aa, Entamoeba dispar
PVAMKARIPDALPQMNTISLKSL

SEQ ID NO: 2389016 - protein, 26 aa, Entamoeba dispar
PVCEIQGCISGCRFPDDCSLCDITKG

SEQ ID NO: 2389017 - protein, 18 aa, Entamoeba dispar
PVDAVECCTLWDDFSIIY

SEQ ID NO: 2389018 - protein, 22 aa, Entamoeba dispar
PVDFCKRVNPFLIPEVIIQFIL

SEQ ID NO: 2389019 - protein, 24 aa, Entamoeba dispar
PVEHTKHFVSFDFLDREDRIELLR

SEQ ID NO: 2389020 - protein, 23 aa, Entamoeba dispar
PVICIGIHFTLWWYNIIPSDPMY

SEQ ID NO: 2389021 - protein, 20 aa, Entamoeba dispar
PVIGLFLNKKWFPIADICRI

SEQ ID NO: 2389022 - protein, 21 aa, Entamoeba dispar
PVIIAIGYILYVFIRPSNNTQ

SEQ ID NO: 2389023 - protein, 18 aa, Entamoeba dispar
PVIVDLFGLLLVSIILTS

SEQ ID NO: 2389024 - protein, 23 aa, Entamoeba dispar
PVKARGIHDYSYCAQCRLMKFLL

SEQ ID NO: 2389025 - protein, 20 aa, Entamoeba dispar
PVPFTQRITGNYTKYSSVIF

SEQ ID NO: 2389026 - protein, 22 aa, Entamoeba dispar
PVPIRISEHYHYVTLITESDNP

SEQ ID NO: 2389027 - protein, 23 aa, Entamoeba dispar
PVRIASFVKRILIMMLNCDSSIA

SEQ ID NO: 2389028 - protein, 24 aa, Entamoeba dispar
PVRQTLKAGFGIEVTFKIKMLCTA

SEQ ID NO: 2389029 - protein, 32 aa, Entamoeba dispar
PVRREVPRAVTICQRAGIIVRMVTGDNIATAR

SEQ ID NO: 2389030 - protein, 24 aa, Entamoeba dispar
PVSLIICSFMLYNLVGTAALYGII

SEQ ID NO: 2389031 - protein, 18 aa, Entamoeba dispar
PVTHNWLGFTGCNGGFGV

SEQ ID NO: 2389032 - protein, 17 aa, Entamoeba dispar
PVTIAWLIVTGIITLFY

SEQ ID NO: 2389033 - protein, 18 aa, Entamoeba dispar
PVTIRFGQLNSILKNIKK

SEQ ID NO: 2389034 - protein, 17 aa, Entamoeba dispar
PVVTVGALNHCYKIIFA

SEQ ID NO: 2389035 - protein, 17 aa, Entamoeba dispar
PVVWFIVLICILGSIIV

SEQ ID NO: 2389036 - protein, 23 aa, Entamoeba dispar
PVYFRRENVCIFAGENVWFSVKK

SEQ ID NO: 2389037 - protein, 19 aa, Entamoeba dispar
PVYLLKYFSSFVLSLPMTY

SEQ ID NO: 2389038 - protein, 26 aa, Entamoeba dispar
PWAWSPPRFECWWLVRVIPHIFLIFV

SEQ ID NO: 2389039 - protein, 18 aa, Entamoeba dispar
PWSIITSFFCHSSISQII

SEQ ID NO: 2389040 - protein, 21 aa, Entamoeba dispar
PYCTCKVDDPILIVSSDVKNN

SEQ ID NO: 2389041 - protein, 21 aa, Entamoeba dispar
PYFHLKWYNTIYMKQKELENY

SEQ ID NO: 2389042 - protein, 21 aa, Entamoeba dispar
PYHSGKSFLLNSLTNITDIFP

SEQ ID NO: 2389043 - protein, 20 aa, Entamoeba dispar
PYHYIFLNFGDWVMTNYIFI

SEQ ID NO: 2389044 - protein, 26 aa, Entamoeba dispar
PYIYGKWFKLNMNFNGYIAIETVFHY

SEQ ID NO: 2389045 - protein, 17 aa, Entamoeba dispar
PYIYIPALVICIIGQVI

SEQ ID NO: 2389046 - protein, 17 aa, Entamoeba dispar
PYKEFKSIFDIKNYVES

SEQ ID NO: 2389047 - protein, 22 aa, Entamoeba dispar
PYKEFKSLFEIKDFVLKGKRLK

SEQ ID NO: 2389048 - protein, 17 aa, Entamoeba dispar
PYKEFKSLFEIKQYVEE

SEQ ID NO: 2389049 - protein, 22 aa, Entamoeba dispar
PYKGTLSFFIIFTILLHYLYFL

SEQ ID NO: 2389050 - protein, 25 aa, Entamoeba dispar
PYKKQFFCHSPRKTVLPQTISTSIT

SEQ ID NO: 2389051 - protein, 28 aa, Entamoeba dispar
PYKYKSRIYMLFWGLCFYFGQQTEVLVQ

SEQ ID NO: 2389052 - protein, 22 aa, Entamoeba dispar
PYNCSACITGYVLTKNTTSDDT

SEQ ID NO: 2389053 - protein, 26 aa, Entamoeba dispar
PYPDGSRCFTCQPGMELTVSGCKDCQ

SEQ ID NO: 2389054 - protein, 18 aa, Entamoeba dispar
PYQIIKFSLTIEQSNEGT

SEQ ID NO: 2389055 - protein, 17 aa, Entamoeba dispar
PYRECKSLFDIKNIVIN

SEQ ID NO: 2389056 - protein, 23 aa, Entamoeba dispar
PYSCTIHYPFLLLKAFCIGFVIS

SEQ ID NO: 2389057 - protein, 19 aa, Entamoeba dispar
PYTGILMVCLIHFFLGVFL

SEQ ID NO: 2389058 - protein, 25 aa, Entamoeba dispar
PYVRFKKILGHGIGLISVYKSSNIV

SEQ ID NO: 2389059 - protein, 20 aa, Entamoeba dispar
PYYCGISCFLKSYNSPMVHY

SEQ ID NO: 2389060 - protein, 22 aa, Entamoeba dispar
QAAEICTVLTTFCGSDGIEEAA

SEQ ID NO: 2389061 - protein, 25 aa, Entamoeba dispar
QAALVGKIFRCMNLTDSIINYVDKT

SEQ ID NO: 2389062 - protein, 21 aa, Entamoeba dispar
QADCNFHYPPFLYTLKKNETT

SEQ ID NO: 2389063 - protein, 22 aa, Entamoeba dispar
QAEGVPNYFIFNATRQKELWTT

SEQ ID NO: 2389064 - protein, 22 aa, Entamoeba dispar
QAFEGIIYKRFTDICTEVYGMP

SEQ ID NO: 2389065 - protein, 19 aa, Entamoeba dispar
QAFETIQCLFSIYNSPNDI

SEQ ID NO: 2389066 - protein, 22 aa, Entamoeba dispar
QAFSLHFSNIFTLLSTHKSSNV

SEQ ID NO: 2389067 - protein, 19 aa, Entamoeba dispar
QAGEILRKKIEEFDELIQT

SEQ ID NO: 2389068 - protein, 18 aa, Entamoeba dispar
QAGGFNFKNLETLGEEFS

SEQ ID NO: 2389069 - protein, 21 aa, Entamoeba dispar
QAIALRLAKKGVHLSIASRSE

SEQ ID NO: 2389070 - protein, 17 aa, Entamoeba dispar
QAILFKKELTSMNLSTT

SEQ ID NO: 2389071 - protein, 33 aa, Entamoeba dispar
QAKNMLAWDVVCFYSFYFLICCCEQDALRKDYT

SEQ ID NO: 2389072 - protein, 19 aa, Entamoeba dispar
QALSCSDKIIGIVKSEAPI

SEQ ID NO: 2389073 - protein, 20 aa, Entamoeba dispar
QAMRRLFYRFQMVGESQIVG

SEQ ID NO: 2389074 - protein, 17 aa, Entamoeba dispar
QANEWLKYLPIKKKNEK

SEQ ID NO: 2389075 - protein, 18 aa, Entamoeba dispar
QAPLPKRYGLLLRNYIRH

SEQ ID NO: 2389076 - protein, 34 aa, Entamoeba dispar
QAVVLRKTYWWKNFKLWLLIVISLVLILCLIGGI

SEQ ID NO: 2389077 - protein, 19 aa, Entamoeba dispar
QAYGKLIFEYCQKHKEIPI

SEQ ID NO: 2389078 - protein, 22 aa, Entamoeba dispar
QCAIIKEFELIITISKILQKIL

SEQ ID NO: 2389079 - protein, 28 aa, Entamoeba dispar
QCAPMLPTMIPIILKRVNLNIVSQCEYC

SEQ ID NO: 2389080 - protein, 17 aa, Entamoeba dispar
QCCGWKTSRDFPPCDSA

SEQ ID NO: 2389081 - protein, 17 aa, Entamoeba dispar
QCDIDYITYFGVYEIIV

SEQ ID NO: 2389082 - protein, 18 aa, Entamoeba dispar
QCECIDGYVLVDGTCTLC

SEQ ID NO: 2389083 - protein, 24 aa, Entamoeba dispar
QCESCVIKKTFILSPFGNTFINGT

SEQ ID NO: 2389084 - protein, 21 aa, Entamoeba dispar
QCFLSSLLLLIISFRHHLHPF

SEQ ID NO: 2389085 - protein, 21 aa, Entamoeba dispar
QCGDIPWSEVFFGEEEDESYE

SEQ ID NO: 2389086 - protein, 22 aa, Entamoeba dispar
QCGLYCGVCRVGYSCSELGKCV

SEQ ID NO: 2389087 - protein, 21 aa, Entamoeba dispar
QCGYSVFNIILTFLFEIISVV

SEQ ID NO: 2389088 - protein, 21 aa, Entamoeba dispar
QCINCNQYLHQNCISTFIGTE

SEQ ID NO: 2389089 - protein, 26 aa, Entamoeba dispar
QCIPRCPKCGGLLKLDVVLFGEKLDR

SEQ ID NO: 2389090 - protein, 27 aa, Entamoeba dispar
QCIYKMMRWWFDKGIDGFRMDVINLIS

SEQ ID NO: 2389091 - protein, 18 aa, Entamoeba dispar
QCKVNVGVMQIDFKDNYL

SEQ ID NO: 2389092 - protein, 26 aa, Entamoeba dispar
QCLQVIQRKCRLWNGNIIEYLPKGNK

SEQ ID NO: 2389093 - protein, 24 aa, Entamoeba dispar
QCNNQRIIKCYGIASSWYSISSQL

SEQ ID NO: 2389094 - protein, 20 aa, Entamoeba dispar
QCNQCGIGYIVNYNGTRCVL

SEQ ID NO: 2389095 - protein, 20 aa, Entamoeba dispar
QCPKLKGIYLPKSLILMKTQ

SEQ ID NO: 2389096 - protein, 17 aa, Entamoeba dispar
QCQACVLKMDHHCPWLG

SEQ ID NO: 2389097 - protein, 19 aa, Entamoeba dispar
QCSRLGAVLDMITDRAGTT

SEQ ID NO: 2389098 - protein, 17 aa, Entamoeba dispar
QCSSCKPGYYLSNGDCV

SEQ ID NO: 2389099 - protein, 21 aa, Entamoeba dispar
QCVRIYESWFILKQYTPQPIA

SEQ ID NO: 2389100 - protein, 25 aa, Entamoeba dispar
QCVVPGVDIMQGFGMTELCGACSVM

SEQ ID NO: 2389101 - protein, 20 aa, Entamoeba dispar
QCYHCEEGFYLTKDQCTKCV

SEQ ID NO: 2389102 - protein, 17 aa, Entamoeba dispar
QDAEYVFYISLSFTTAI

SEQ ID NO: 2389103 - protein, 20 aa, Entamoeba dispar
QDCLIKTIIEQSWKHNPKDR

SEQ ID NO: 2389104 - protein, 33 aa, Entamoeba dispar
QDFIRLTQWATRTMKIRPSLVYIPTRLPTTVIG

SEQ ID NO: 2389105 - protein, 24 aa, Entamoeba dispar
QDIYDCPNDVFSYSITAWELFYGE

SEQ ID NO: 2389106 - protein, 18 aa, Entamoeba dispar
QDSCSLCGNGKKDEGEEC

SEQ ID NO: 2389107 - protein, 18 aa, Entamoeba dispar
QDSSYFAFDNHGCGFQAK

SEQ ID NO: 2389108 - protein, 25 aa, Entamoeba dispar
QDTLRLLTILFKYGKYQEVEEAIIE

SEQ ID NO: 2389109 - protein, 32 aa, Entamoeba dispar
QDVICIGRVIIIMSECYKLLKQAWEPLLSIVL

SEQ ID NO: 2389110 - protein, 23 aa, Entamoeba dispar
QDYCYECNDGFLIENDHCVSSKD

SEQ ID NO: 2389111 - protein, 26 aa, Entamoeba dispar
QDYWCIPGVLNGIAKVYGHLVRTITD

SEQ ID NO: 2389112 - protein, 20 aa, Entamoeba dispar
QEAKERIRIEEVVRMLERIE

SEQ ID NO: 2389113 - protein, 25 aa, Entamoeba dispar
QEATYRTLIVWDLMKVVIDIMENDI

SEQ ID NO: 2389114 - protein, 25 aa, Entamoeba dispar
QEELMKRFAIITTLFTPLTFLSTSF

SEQ ID NO: 2389115 - protein, 29 aa, Entamoeba dispar
QEFGKKWIFVSGLRIRNGLIGLIYDKALK

SEQ ID NO: 2389116 - protein, 26 aa, Entamoeba dispar
QEFGKKWLFVLAVRIRNGLIGLIYDK

SEQ ID NO: 2389117 - protein, 23 aa, Entamoeba dispar
QEFSDPVGGIFIQPYKGFVSVCI

SEQ ID NO: 2389118 - protein, 17 aa, Entamoeba dispar
QEFYFKSVLLITLVLAN

SEQ ID NO: 2389119 - protein, 24 aa, Entamoeba dispar
QEGGQECKKCFAGTYQNETGSTYC

SEQ ID NO: 2389120 - protein, 19 aa, Entamoeba dispar
QEHFAKFIAPQGVTATQTT

SEQ ID NO: 2389121 - protein, 22 aa, Entamoeba dispar
QEIIDIVSIISCYQTFITKTST

SEQ ID NO: 2389122 - protein, 20 aa, Entamoeba dispar
QELFILYDLFKSDRAIEELL

SEQ ID NO: 2389123 - protein, 26 aa, Entamoeba dispar
QELRKRKKLPLGFKFLQVIQEKDFEK

SEQ ID NO: 2389124 - protein, 21 aa, Entamoeba dispar
QELWDYLTFSERLFWNLSKEY

SEQ ID NO: 2389125 - protein, 22 aa, Entamoeba dispar
QEMPNLINSFAIFGVSPSTSPN

SEQ ID NO: 2389126 - protein, 45 aa, Entamoeba dispar
QEQELECTCLLCKMKLVILQNRYVPWISLARIFYLSLMTLHPSKI

SEQ ID NO: 2389127 - protein, 18 aa, Entamoeba dispar
QERAFDFIDEVVINFSKL

SEQ ID NO: 2389128 - protein, 25 aa, Entamoeba dispar
QERIKRSIVITGIFNLKTDKIEFTR

SEQ ID NO: 2389129 - protein, 21 aa, Entamoeba dispar
QESESRCLCFIISKTPEENLI

SEQ ID NO: 2389130 - protein, 20 aa, Entamoeba dispar
QESIVKMLWSLLVISEAGLY

SEQ ID NO: 2389131 - protein, 24 aa, Entamoeba dispar
QEVCKTWDGLYCIECKEGYYIEQM

SEQ ID NO: 2389132 - protein, 24 aa, Entamoeba dispar
QEVKDTKIYSVFLKNEASPEKLEE

SEQ ID NO: 2389133 - protein, 22 aa, Entamoeba dispar
QEWKCNVCNDGTWQQCGIYDDG

SEQ ID NO: 2389134 - protein, 21 aa, Entamoeba dispar
QEYMIMMLLIYNSFKEENKKK

SEQ ID NO: 2389135 - protein, 23 aa, Entamoeba dispar
QFAISDECYIYFNSDKNVLNYGK

SEQ ID NO: 2389136 - protein, 26 aa, Entamoeba dispar
QFAPFSVFVYLFFKKAYGLYTIKSNK

SEQ ID NO: 2389137 - protein, 19 aa, Entamoeba dispar
QFCNLRITIELGSHWLKNL

SEQ ID NO: 2389138 - protein, 29 aa, Entamoeba dispar
QFDSIYEIAWRFGGNSLRTFTKVVQLIYN

SEQ ID NO: 2389139 - protein, 37 aa, Entamoeba dispar
QFEDIWKHVCIVWTRCYDCFPSFMIENSKIEKKKFKE

SEQ ID NO: 2389140 - protein, 17 aa, Entamoeba dispar
QFEELKELFGNVVDVCF

SEQ ID NO: 2389141 - protein, 24 aa, Entamoeba dispar
QFFVIFKFIEFFLLDEALYTQFGF

SEQ ID NO: 2389142 - protein, 25 aa, Entamoeba dispar
QFIKRMKDFILRDGNGIDSYQTQQE

SEQ ID NO: 2389143 - protein, 25 aa, Entamoeba dispar
QFILYCLLGVLFGVTFILDVNWGLL

SEQ ID NO: 2389144 - protein, 17 aa, Entamoeba dispar
QFIPFEIVFHVLFTVLD

SEQ ID NO: 2389145 - protein, 18 aa, Entamoeba dispar
QFISSLRSGVLFINKFKK

SEQ ID NO: 2389146 - protein, 17 aa, Entamoeba dispar
QFLLEVLSDVDFIKNSK

SEQ ID NO: 2389147 - protein, 18 aa, Entamoeba dispar
QFNQGSCGSCYAASTANL

SEQ ID NO: 2389148 - protein, 22 aa, Entamoeba dispar
QFPLFICILSLFGSVSSFVLIT

SEQ ID NO: 2389149 - protein, 18 aa, Entamoeba dispar
QFSEKIGAIGITKEGTTI

SEQ ID NO: 2389150 - protein, 21 aa, Entamoeba dispar
QFSPSPCYATYSLHNYLVYQK

SEQ ID NO: 2389151 - protein, 26 aa, Entamoeba dispar
QFSSRLSEWPTYCVLLKDNKNVEAHE

SEQ ID NO: 2389152 - protein, 19 aa, Entamoeba dispar
QFYGACFIPTKTCMVTEYA

SEQ ID NO: 2389153 - protein, 20 aa, Entamoeba dispar
QFYPFAMLGGMIWATGNLLT

SEQ ID NO: 2389154 - protein, 17 aa, Entamoeba dispar
QGASILFVLGFFVCLTW

SEQ ID NO: 2389155 - protein, 22 aa, Entamoeba dispar
QGDCGSCYAISNAHELQLKYAN

SEQ ID NO: 2389156 - protein, 21 aa, Entamoeba dispar
QGFTVFVLYFIIKKKKRTQVN

SEQ ID NO: 2389157 - protein, 21 aa, Entamoeba dispar
QGGKLSFYTNFEIKDNSSITF

SEQ ID NO: 2389158 - protein, 18 aa, Entamoeba dispar
QGIHSVCAVFLSLSFNEA

SEQ ID NO: 2389159 - protein, 18 aa, Entamoeba dispar
QGITKREVVPLPHDQNHS

SEQ ID NO: 2389160 - protein, 25 aa, Entamoeba dispar
QGKLSFANNVLRIIVTTVVSLTSFV

SEQ ID NO: 2389161 - protein, 23 aa, Entamoeba dispar
QGKQEIPSVIALNDQGDIQFGEN

SEQ ID NO: 2389162 - protein, 21 aa, Entamoeba dispar
QGLADLFGFYVLVFNTDEETF

SEQ ID NO: 2389163 - protein, 19 aa, Entamoeba dispar
QGLSGWNYVSDGYSTIYKI

SEQ ID NO: 2389164 - protein, 21 aa, Entamoeba dispar
QGSCGSCYAASTANLGQYLYA

SEQ ID NO: 2389165 - protein, 20 aa, Entamoeba dispar
QGSFSIVFKGKFRGNIVAIK

SEQ ID NO: 2389166 - protein, 21 aa, Entamoeba dispar
QGSLFKYPWSIANFVADGNRL

SEQ ID NO: 2389167 - protein, 24 aa, Entamoeba dispar
QGYEYKSLNAIILLIRIFQQIGDF

SEQ ID NO: 2389168 - protein, 19 aa, Entamoeba dispar
QHCLFKYDCEEEIVEQQET

SEQ ID NO: 2389169 - protein, 24 aa, Entamoeba dispar
QHDGDMRLYWVIFVLSIISGLIPS

SEQ ID NO: 2389170 - protein, 18 aa, Entamoeba dispar
QHEKKLFLSDDEIKDLMF

SEQ ID NO: 2389171 - protein, 17 aa, Entamoeba dispar
QHFEKLLALGIVASSPA

SEQ ID NO: 2389172 - protein, 19 aa, Entamoeba dispar
QHFFKPLLFGLFSMVSELY

SEQ ID NO: 2389173 - protein, 19 aa, Entamoeba dispar
QHGGLAMFIFIKKIMKNEI

SEQ ID NO: 2389174 - protein, 23 aa, Entamoeba dispar
QHHGISGWGIWGILLYAVYFVII

SEQ ID NO: 2389175 - protein, 19 aa, Entamoeba dispar
QHPLEIGKICFKRCILLEI

SEQ ID NO: 2389176 - protein, 23 aa, Entamoeba dispar
QHPNQCGIVFCLSKKDCENLSKF

SEQ ID NO: 2389177 - protein, 24 aa, Entamoeba dispar
QHRLKEQYIEAGLCEVHLVLFIHH

SEQ ID NO: 2389178 - protein, 20 aa, Entamoeba dispar
QHSAISWGTGRAVARIPRIS

SEQ ID NO: 2389179 - protein, 26 aa, Entamoeba dispar
QHSSKFKPLLTFFLSLYPYWNPYDPQ

SEQ ID NO: 2389180 - protein, 20 aa, Entamoeba dispar
QHWRNNCVEKLFNFLYKILS

SEQ ID NO: 2389181 - protein, 29 aa, Entamoeba dispar
QIFIENGLSFALRMKIDMIHPLEYLTFML

SEQ ID NO: 2389182 - protein, 19 aa, Entamoeba dispar
QIFLFKRHNKFIVEYLLEA

SEQ ID NO: 2389183 - protein, 17 aa, Entamoeba dispar
QIGCIPSTCGNNLLDKE

SEQ ID NO: 2389184 - protein, 18 aa, Entamoeba dispar
QIGLSQILLRFLKNDKLL

SEQ ID NO: 2389185 - protein, 24 aa, Entamoeba dispar
QIGNAVLFIPMLVVSVFSDVKGNK

SEQ ID NO: 2389186 - protein, 21 aa, Entamoeba dispar
QIHLSDLFLLYSNLYHDSKYD

SEQ ID NO: 2389187 - protein, 30 aa, Entamoeba dispar
QIHRLPKFILEYIVAISICLSLFGTIGFIL

SEQ ID NO: 2389188 - protein, 18 aa, Entamoeba dispar
QIILALNTLHSFKFKHNI

SEQ ID NO: 2389189 - protein, 18 aa, Entamoeba dispar
QIITKGKIGYSLSSDLKC

SEQ ID NO: 2389190 - protein, 21 aa, Entamoeba dispar
QIKDIPSWVYSAIAFCEASYR

SEQ ID NO: 2389191 - protein, 23 aa, Entamoeba dispar
QIKFIKPRINNMNIIGLSDCINC

SEQ ID NO: 2389192 - protein, 25 aa, Entamoeba dispar
QIKIGSNPWLCFFVPGLVVIVVVYF

SEQ ID NO: 2389193 - protein, 21 aa, Entamoeba dispar
QILSLYLKLFKTCTINVRPAL

SEQ ID NO: 2389194 - protein, 21 aa, Entamoeba dispar
QIPELRTLLRKSLLTEYLTNF

SEQ ID NO: 2389195 - protein, 25 aa, Entamoeba dispar
QIPFIYRSVVNFILYTGCYVLLCLV

SEQ ID NO: 2389196 - protein, 19 aa, Entamoeba dispar
QIPQCYAHNQMSKDEYNFT

SEQ ID NO: 2389197 - protein, 21 aa, Entamoeba dispar
QISGCMTDFFVANKEYTSNSF

SEQ ID NO: 2389198 - protein, 22 aa, Entamoeba dispar
QISKRVRPAVVLNDGSKEDEEQ

SEQ ID NO: 2389199 - protein, 17 aa, Entamoeba dispar
QISLSFFVWYIYSIHSF

SEQ ID NO: 2389200 - protein, 18 aa, Entamoeba dispar
QITMEGVGSLLFIPQINE

SEQ ID NO: 2389201 - protein, 20 aa, Entamoeba dispar
QIVSGLIQYISKVNVSVQLC

SEQ ID NO: 2389202 - protein, 17 aa, Entamoeba dispar
QIWRTFRTKKCGSLSLT

SEQ ID NO: 2389203 - protein, 28 aa, Entamoeba dispar
QIYMSVCFALICANMFTRWVVPSKEHLV

SEQ ID NO: 2389204 - protein, 18 aa, Entamoeba dispar
QKCAPGYYRSSERICSKC

SEQ ID NO: 2389205 - protein, 23 aa, Entamoeba dispar
QKDTFRILYIQTFVISILIISIL

SEQ ID NO: 2389206 - protein, 22 aa, Entamoeba dispar
QKFSFPLNFEEYYSCGSENYKL

SEQ ID NO: 2389207 - protein, 20 aa, Entamoeba dispar
QKGLEAIALVLNFNSVQFLN

SEQ ID NO: 2389208 - protein, 21 aa, Entamoeba dispar
QKHPNVCGGYIARGTAFAMIG

SEQ ID NO: 2389209 - protein, 23 aa, Entamoeba dispar
QKIFNACYWIKEKLYVNFDLRSP

SEQ ID NO: 2389210 - protein, 23 aa, Entamoeba dispar
QKIKARIINAIKYWIENTWQITI

SEQ ID NO: 2389211 - protein, 20 aa, Entamoeba dispar
QKIPTVWARAIVEASEAIDS

SEQ ID NO: 2389212 - protein, 31 aa, Entamoeba dispar
QKISLSFFVSMDFVPIMWIFYIVGSYFAVPL

SEQ ID NO: 2389213 - protein, 19 aa, Entamoeba dispar
QKIYGTIIFNYSFPDKCRK

SEQ ID NO: 2389214 - protein, 17 aa, Entamoeba dispar
QKKCNLCEDHLMKVLNG

SEQ ID NO: 2389215 - protein, 17 aa, Entamoeba dispar
QKKEIQTEISFTKPAHK

SEQ ID NO: 2389216 - protein, 17 aa, Entamoeba dispar
QKKFKPLAIKAESVICC

SEQ ID NO: 2389217 - protein, 18 aa, Entamoeba dispar
QKKGFNFINALCLSRTNK

SEQ ID NO: 2389218 - protein, 24 aa, Entamoeba dispar
QKKIVIRVGEEFRDSKGEVEIYID

SEQ ID NO: 2389219 - protein, 19 aa, Entamoeba dispar
QKKSPRTSLAIEEKTERLS

SEQ ID NO: 2389220 - protein, 18 aa, Entamoeba dispar
QKKVIKLSHLFKQTQTQI

SEQ ID NO: 2389221 - protein, 25 aa, Entamoeba dispar
QKLGGCLGCNIGLFLFPILEILDGD

SEQ ID NO: 2389222 - protein, 17 aa, Entamoeba dispar
QKLKTLVFQLQFNFTSS

SEQ ID NO: 2389223 - protein, 20 aa, Entamoeba dispar
QKLLISFAFVFLSIFFFVFY

SEQ ID NO: 2389224 - protein, 43 aa, Entamoeba dispar
QKLYVSCLCKMISYLISEFKERAQICVYHCINEIYNKLGSSIN

SEQ ID NO: 2389225 - protein, 23 aa, Entamoeba dispar
QKNFANNLIFIFAKTNFIVTGNT

SEQ ID NO: 2389226 - protein, 23 aa, Entamoeba dispar
QKNFSNNLIFIFAKTNFIVTGNT

SEQ ID NO: 2389227 - protein, 18 aa, Entamoeba dispar
QKNHIFQILNYFRRLCVH

SEQ ID NO: 2389228 - protein, 21 aa, Entamoeba dispar
QKNPFCGRIIAGLELDVESSS

SEQ ID NO: 2389229 - protein, 18 aa, Entamoeba dispar
QKQDFSFDDFFSKSTDSN

SEQ ID NO: 2389230 - protein, 20 aa, Entamoeba dispar
QKRIPNLFYIQRGNGTEKGN

SEQ ID NO: 2389231 - protein, 18 aa, Entamoeba dispar
QKRLRVINEAFQEDSISD

SEQ ID NO: 2389232 - protein, 28 aa, Entamoeba dispar
QKTIWKYFSKEWCFYHNTNIKSNTSEYC

SEQ ID NO: 2389233 - protein, 21 aa, Entamoeba dispar
QKYIWPSAIRLFPFVMAVSLF

SEQ ID NO: 2389234 - protein, 18 aa, Entamoeba dispar
QKYKKPADIYAFAITIYE

SEQ ID NO: 2389235 - protein, 23 aa, Entamoeba dispar
QLAECFDLIEFCLKDEFEENEEK

SEQ ID NO: 2389236 - protein, 24 aa, Entamoeba dispar
QLAELWKSIDEMRIKLSANEQLIT

SEQ ID NO: 2389237 - protein, 19 aa, Entamoeba dispar
QLCAFKCVKELNDIITTVN

SEQ ID NO: 2389238 - protein, 28 aa, Entamoeba dispar
QLCFLMGILNKFCSLTFQRPRKKSSQTQ

SEQ ID NO: 2389239 - protein, 24 aa, Entamoeba dispar
QLDYEICEMWQYVIRQCEDKIDII

SEQ ID NO: 2389240 - protein, 23 aa, Entamoeba dispar
QLEKFTVGFKIFIGVFVGIAIVI

SEQ ID NO: 2389241 - protein, 18 aa, Entamoeba dispar
QLESIWVMMTQGRKKMVN

SEQ ID NO: 2389242 - protein, 17 aa, Entamoeba dispar
QLFHIIKLYTFISYFSF

SEQ ID NO: 2389243 - protein, 26 aa, Entamoeba dispar
QLFHPRFIMIACFCFGKKLEEFRFEG

SEQ ID NO: 2389244 - protein, 33 aa, Entamoeba dispar
QLFKSLELFELFRLRWKGNFIILHSISSLININ

SEQ ID NO: 2389245 - protein, 19 aa, Entamoeba dispar
QLFLEEFQNILLPILKASL

SEQ ID NO: 2389246 - protein, 21 aa, Entamoeba dispar
QLFNLFIKYDILKSVIDEVKG

SEQ ID NO: 2389247 - protein, 23 aa, Entamoeba dispar
QLFPSFDNWFWFNVFIQMLQTPV

SEQ ID NO: 2389248 - protein, 21 aa, Entamoeba dispar
QLFRANGGFTHLMSSFMKKEG

SEQ ID NO: 2389249 - protein, 26 aa, Entamoeba dispar
QLFTIPRWFSVGIVFIVFTFIVILWV

SEQ ID NO: 2389250 - protein, 20 aa, Entamoeba dispar
QLGSVFLEYVFYTLLELNNF

SEQ ID NO: 2389251 - protein, 22 aa, Entamoeba dispar
QLHYNFKIRYCGGQKELFNVLH

SEQ ID NO: 2389252 - protein, 25 aa, Entamoeba dispar
QLIHSFPLLMKLMLQLFNNEISNTE

SEQ ID NO: 2389253 - protein, 28 aa, Entamoeba dispar
QLIKVLKEVFPLILGVDMIFNDDEFKGT

SEQ ID NO: 2389254 - protein, 17 aa, Entamoeba dispar
QLIPLIKKFKVVDEGII

SEQ ID NO: 2389255 - protein, 22 aa, Entamoeba dispar
QLIPWQCDIIVLPLKSKKKLNI

SEQ ID NO: 2389256 - protein, 18 aa, Entamoeba dispar
QLISKIMWVVSCFLISYE

SEQ ID NO: 2389257 - protein, 18 aa, Entamoeba dispar
QLKCSFCNKELYKFDKLR

SEQ ID NO: 2389258 - protein, 22 aa, Entamoeba dispar
QLKHGLVTEELLIPIPSGIKDK

SEQ ID NO: 2389259 - protein, 24 aa, Entamoeba dispar
QLKKNEFRFIGNQICDEIAYPKKA

SEQ ID NO: 2389260 - protein, 17 aa, Entamoeba dispar
QLLHLAASLLFVSNDES

SEQ ID NO: 2389261 - protein, 22 aa, Entamoeba dispar
QLLIRFKNSFNALCQSHLRFGG

SEQ ID NO: 2389262 - protein, 24 aa, Entamoeba dispar
QLLKGLFLIYTFIIHYYRFSVIFI

SEQ ID NO: 2389263 - protein, 30 aa, Entamoeba dispar
QLLKSQLGGIFSFDAWRYYFNVNTSFVLKK

SEQ ID NO: 2389264 - protein, 22 aa, Entamoeba dispar
QLLLCSVMAGFASWKYKNVVQD

SEQ ID NO: 2389265 - protein, 21 aa, Entamoeba dispar
QLLPLRSGYLLATIFLVTGSK

SEQ ID NO: 2389266 - protein, 26 aa, Entamoeba dispar
QLLRCLALFLEYAWMKGIDGFNNEVN

SEQ ID NO: 2389267 - protein, 28 aa, Entamoeba dispar
QLPACIHIIGIFPLFAILEKEEYSGCLQ

SEQ ID NO: 2389268 - protein, 22 aa, Entamoeba dispar
QLPEPNNLLLFIIATLMIYLKA

SEQ ID NO: 2389269 - protein, 27 aa, Entamoeba dispar
QLPSLFKKRLPGIEVLYPNLMVTMERY

SEQ ID NO: 2389270 - protein, 20 aa, Entamoeba dispar
QLQKIPVYIIFPLIGITYIL

SEQ ID NO: 2389271 - protein, 18 aa, Entamoeba dispar
QLRHKCVVEFIGAVYTEG

SEQ ID NO: 2389272 - protein, 20 aa, Entamoeba dispar
QLRSEIKFLQILNEQQLASK

SEQ ID NO: 2389273 - protein, 21 aa, Entamoeba dispar
QLSILCFFLSLILSSLIIIFV

SEQ ID NO: 2389274 - protein, 18 aa, Entamoeba dispar
QLVYYVFKPKDRVTNELI

SEQ ID NO: 2389275 - protein, 17 aa, Entamoeba dispar
QLYELLDKSLQEFFVKV

SEQ ID NO: 2389276 - protein, 18 aa, Entamoeba dispar
QMGDNFYRFSKESIDAKC

SEQ ID NO: 2389277 - protein, 21 aa, Entamoeba dispar
QMKIPILKDELELMKKQTNSL

SEQ ID NO: 2389278 - protein, 24 aa, Entamoeba dispar
QMMDKMRCPYIINFIGAVDTPGYY

SEQ ID NO: 2389279 - protein, 18 aa, Entamoeba dispar
QMMWKGWTIPKLVENLVK

SEQ ID NO: 2389280 - protein, 31 aa, Entamoeba dispar
QMRKSLYEWAHLRTYFIIERIKKVMKIFIHF

SEQ ID NO: 2389281 - protein, 26 aa, Entamoeba dispar
QMTLRIPKWENMILLLKKGVFHPKFV

SEQ ID NO: 2389282 - protein, 21 aa, Entamoeba dispar
QNCQVSERFVASGIRSFSVIG

SEQ ID NO: 2389283 - protein, 24 aa, Entamoeba dispar
QNCSSRIWLEDTFRTVDDKKQKSY

SEQ ID NO: 2389284 - protein, 17 aa, Entamoeba dispar
QNERVCVQINKGKILVL

SEQ ID NO: 2389285 - protein, 20 aa, Entamoeba dispar
QNGFFSWALIHLFTLSFIVT

SEQ ID NO: 2389286 - protein, 24 aa, Entamoeba dispar
QNGVCVFNRDCIFEKAKQLNIGLN

SEQ ID NO: 2389287 - protein, 23 aa, Entamoeba dispar
QNHYQCVDALSLIESYTDTIPLK

SEQ ID NO: 2389288 - protein, 18 aa, Entamoeba dispar
QNICYPLFAVSQETTDIM

SEQ ID NO: 2389289 - protein, 21 aa, Entamoeba dispar
QNIDICLIKSLTHEFPELQLP

SEQ ID NO: 2389290 - protein, 19 aa, Entamoeba dispar
QNIEIIQLFCDFIYASWKL

SEQ ID NO: 2389291 - protein, 25 aa, Entamoeba dispar
QNILTCWRFFCFGVMALTCIIHVIY

SEQ ID NO: 2389292 - protein, 17 aa, Entamoeba dispar
QNKPCWSINATLSVILL

SEQ ID NO: 2389293 - protein, 21 aa, Entamoeba dispar
QNLILRGTIYISKDTNDANEG

SEQ ID NO: 2389294 - protein, 22 aa, Entamoeba dispar
QNLLPCDLIQLGATCQTLHNSI

SEQ ID NO: 2389295 - protein, 18 aa, Entamoeba dispar
QNMFKGILIMALRGLTDN

SEQ ID NO: 2389296 - protein, 24 aa, Entamoeba dispar
QNNNFCFINHLGIYIRETVIALYK

SEQ ID NO: 2389297 - protein, 24 aa, Entamoeba dispar
QNNVLELWSLFDFLMPGFLGTEKE

SEQ ID NO: 2389298 - protein, 23 aa, Entamoeba dispar
QNQYRPAKWLKLDTTGMTKQVVD

SEQ ID NO: 2389299 - protein, 26 aa, Entamoeba dispar
QNSFLRMYFPTVLNWMIGGVVGQNKF

SEQ ID NO: 2389300 - protein, 23 aa, Entamoeba dispar
QNSRKRLGLVLQMQDEPYALELI

SEQ ID NO: 2389301 - protein, 24 aa, Entamoeba dispar
QNTCGGCYAVGPAQHLSTIYAYLT

SEQ ID NO: 2389302 - protein, 23 aa, Entamoeba dispar
QNVFSFFLFCNFFNSFIILILHL

SEQ ID NO: 2389303 - protein, 30 aa, Entamoeba dispar
QNVIWYDCYYCFSKYRFIWDSISLKNLFIH

SEQ ID NO: 2389304 - protein, 23 aa, Entamoeba dispar
QNYLPVKICFALYGLLTKYQTKQ

SEQ ID NO: 2389305 - protein, 23 aa, Entamoeba dispar
QPIAYKLLLNYFISNYKKKTKSS

SEQ ID NO: 2389306 - protein, 18 aa, Entamoeba dispar
QPIKRKPNEFTIISPTIY

SEQ ID NO: 2389307 - protein, 18 aa, Entamoeba dispar
QPIPEKKLKQFLLCEKSL

SEQ ID NO: 2389308 - protein, 25 aa, Entamoeba dispar
QPIRFKKLWEYSGNISSQFAGWSVG

SEQ ID NO: 2389309 - protein, 21 aa, Entamoeba dispar
QPKFDQFRGSITIGNDKVSIN

SEQ ID NO: 2389310 - protein, 18 aa, Entamoeba dispar
QPLHFTFHSGDYTKYEIM

SEQ ID NO: 2389311 - protein, 19 aa, Entamoeba dispar
QPMYHCYVCDINCCNSCIK

SEQ ID NO: 2389312 - protein, 20 aa, Entamoeba dispar
QPRRVAAITLAERVSKEVGC

SEQ ID NO: 2389313 - protein, 24 aa, Entamoeba dispar
QPSKLRIGIQYLKLQWKGAKDIEE

SEQ ID NO: 2389314 - protein, 18 aa, Entamoeba dispar
QPTFKPKVSTLMQRSPDL

SEQ ID NO: 2389315 - protein, 18 aa, Entamoeba dispar
QPVVWFIVLICILGSIIV

SEQ ID NO: 2389316 - protein, 26 aa, Entamoeba dispar
QPYKGFVSVCIEWGVIIIIGCVLCLL

SEQ ID NO: 2389317 - protein, 24 aa, Entamoeba dispar
QPYYDYPELLGLLIEVASNERNQD

SEQ ID NO: 2389318 - protein, 18 aa, Entamoeba dispar
QQCGICYEAVGEKGSIRF

SEQ ID NO: 2389319 - protein, 26 aa, Entamoeba dispar
QQFTAISFDFVRVCLLHKREVEAFKK

SEQ ID NO: 2389320 - protein, 23 aa, Entamoeba dispar
QQIFCFVHSLYGFQWKYYTLTNL

SEQ ID NO: 2389321 - protein, 19 aa, Entamoeba dispar
QQKKLLKICDFEYQIQYCT

SEQ ID NO: 2389322 - protein, 17 aa, Entamoeba dispar
QQLKIAYSTENCLLQTI

SEQ ID NO: 2389323 - protein, 18 aa, Entamoeba dispar
QQLKSLGLINAFNESADF

SEQ ID NO: 2389324 - protein, 19 aa, Entamoeba dispar
QQLKSLGLINAFNESADFS

SEQ ID NO: 2389325 - protein, 17 aa, Entamoeba dispar
QQLLRLEFISVLAESDR

SEQ ID NO: 2389326 - protein, 24 aa, Entamoeba dispar
QQNNNIICGFPFKIQESESRCLCF

SEQ ID NO: 2389327 - protein, 25 aa, Entamoeba dispar
QQPLCGRIISGFEFDIQPMVAGPTK

SEQ ID NO: 2389328 - protein, 23 aa, Entamoeba dispar
QQRRTEFLFSYLQSIGYDLYNYK

SEQ ID NO: 2389329 - protein, 24 aa, Entamoeba dispar
QQSGSFKFIFSLFELLSIHPEQLN

SEQ ID NO: 2389330 - protein, 23 aa, Entamoeba dispar
QQSLEMLRHAGIRTWMLTGDKVE

SEQ ID NO: 2389331 - protein, 24 aa, Entamoeba dispar
QQSQLKWYFSIFTKILEKLKENII

SEQ ID NO: 2389332 - protein, 19 aa, Entamoeba dispar
QQYLLRRQWSNIIIENYRR

SEQ ID NO: 2389333 - protein, 17 aa, Entamoeba dispar
QRCDFCDDYYYYSSSLG

SEQ ID NO: 2389334 - protein, 26 aa, Entamoeba dispar
QRCKYWKRKSIVIILLIVLVLGIIGV

SEQ ID NO: 2389335 - protein, 22 aa, Entamoeba dispar
QRDVLPLLYLFIGNGNASSVLH

SEQ ID NO: 2389336 - protein, 21 aa, Entamoeba dispar
QRFMLPISLSILIITFIPLVY

SEQ ID NO: 2389337 - protein, 24 aa, Entamoeba dispar
QRGIKMVWEQQGFVEQIIAIGERA

SEQ ID NO: 2389338 - protein, 28 aa, Entamoeba dispar
QRGSIVNGIGSFWLNCRNLIERISETTV

SEQ ID NO: 2389339 - protein, 18 aa, Entamoeba dispar
QRHKELFNKVNIIQENKE

SEQ ID NO: 2389340 - protein, 18 aa, Entamoeba dispar
QRHNLPVYWNRRNPTEIH

SEQ ID NO: 2389341 - protein, 22 aa, Entamoeba dispar
QRIKAKYSRVVCANFMTQTIDQ

SEQ ID NO: 2389342 - protein, 17 aa, Entamoeba dispar
QRIKMYGTFTIIAIFIF

SEQ ID NO: 2389343 - protein, 17 aa, Entamoeba dispar
QRIRRPVVLPLLVSLFI

SEQ ID NO: 2389344 - protein, 18 aa, Entamoeba dispar
QRIYKAKLLVLFEDDSIQ

SEQ ID NO: 2389345 - protein, 21 aa, Entamoeba dispar
QRKGLEIIYLMNIVPYLENIS

SEQ ID NO: 2389346 - protein, 17 aa, Entamoeba dispar
QRLEKIPLWLDVSPPTD

SEQ ID NO: 2389347 - protein, 23 aa, Entamoeba dispar
QRLIWRVSRGLVLIKSMDLTEGS

SEQ ID NO: 2389348 - protein, 23 aa, Entamoeba dispar
QRLYVICGCYYLIMKGWTILFSS

SEQ ID NO: 2389349 - protein, 22 aa, Entamoeba dispar
QRMCSNPSKYSFQMKKVLLNSG

SEQ ID NO: 2389350 - protein, 22 aa, Entamoeba dispar
QRNKFFHFIAIPFVFDKIKNKI

SEQ ID NO: 2389351 - protein, 24 aa, Entamoeba dispar
QRNNLCIYPTCLSGQLGPKDECAQ

SEQ ID NO: 2389352 - protein, 18 aa, Entamoeba dispar
QRPNFGVISTWMLEIVNE

SEQ ID NO: 2389353 - protein, 23 aa, Entamoeba dispar
QRQKEFAQFLALAKFPETVFPII

SEQ ID NO: 2389354 - protein, 20 aa, Entamoeba dispar
QRRFSFHSFFILGMTKNQII

SEQ ID NO: 2389355 - protein, 22 aa, Entamoeba dispar
QRRKELIGVLPISLEKKEDLSD

SEQ ID NO: 2389356 - protein, 23 aa, Entamoeba dispar
QRSERYFERFIGWIQLIGVLQNI

SEQ ID NO: 2389357 - protein, 24 aa, Entamoeba dispar
QRSFLTRDVRMMYYHAVYTILSSG

SEQ ID NO: 2389358 - protein, 19 aa, Entamoeba dispar
QRSIKHSFLNPDLSKKHNT

SEQ ID NO: 2389359 - protein, 28 aa, Entamoeba dispar
QRSYCFCIISSYPSFTLFSNILDFLSQN

SEQ ID NO: 2389360 - protein, 21 aa, Entamoeba dispar
QRVEIPLAISARGELSNINIE

SEQ ID NO: 2389361 - protein, 20 aa, Entamoeba dispar
QSAALAFFWSPCESLITTES

SEQ ID NO: 2389362 - protein, 27 aa, Entamoeba dispar
QSCGSCYCVSNALALQLKWANLTYLRD

SEQ ID NO: 2389363 - protein, 17 aa, Entamoeba dispar
QSDGSCGIPHCQIEEDG

SEQ ID NO: 2389364 - protein, 18 aa, Entamoeba dispar
QSDLKGVLYTGSVKERSV

SEQ ID NO: 2389365 - protein, 20 aa, Entamoeba dispar
QSFCFWVLGQFSYWQYKQIL

SEQ ID NO: 2389366 - protein, 20 aa, Entamoeba dispar
QSFEQYGFFLVYIIGLLYSG

SEQ ID NO: 2389367 - protein, 43 aa, Entamoeba dispar
QSFLQKHFLSILITCFFSLFLFNYCSFSSYFSRELKIEPVQAC

SEQ ID NO: 2389368 - protein, 34 aa, Entamoeba dispar
QSHEMKKAMCWRKWKLWIIIGVIAAIIIIVIIVA

SEQ ID NO: 2389369 - protein, 18 aa, Entamoeba dispar
QSHFKTYLIVAIPACCDL

SEQ ID NO: 2389370 - protein, 34 aa, Entamoeba dispar
QSHQMKKAMCWRKWKLWIIIGVIAAIIIAVIVVV

SEQ ID NO: 2389371 - protein, 19 aa, Entamoeba dispar
QSIESCISMILTSIIDYSI

SEQ ID NO: 2389372 - protein, 17 aa, Entamoeba dispar
QSIRIVKNHHRFCGFQN

SEQ ID NO: 2389373 - protein, 37 aa, Entamoeba dispar
QSISKLGKLYVFHRYICFWPQVLKFNADVWKFEDISG

SEQ ID NO: 2389374 - protein, 25 aa, Entamoeba dispar
QSITWCAQGSLLTRCSKPEKRGRNS

SEQ ID NO: 2389375 - protein, 22 aa, Entamoeba dispar
QSIVNSVKWGRCVYDNIRKFLQ

SEQ ID NO: 2389376 - protein, 23 aa, Entamoeba dispar
QSKEFPQPFLIAKPINIFIPRPL

SEQ ID NO: 2389377 - protein, 25 aa, Entamoeba dispar
QSKGAFLLYKGRDAVVTTCNSMVTS

SEQ ID NO: 2389378 - protein, 27 aa, Entamoeba dispar
QSKMTTTIPFVFSIIIDKTILNIKDLA

SEQ ID NO: 2389379 - protein, 21 aa, Entamoeba dispar
QSLESFGWLDLLKIVGEFLFI

SEQ ID NO: 2389380 - protein, 21 aa, Entamoeba dispar
QSLFLKSEWILEGIDNNNSLL

SEQ ID NO: 2389381 - protein, 21 aa, Entamoeba dispar
QSLKRICIKSAYFNNNAPRLE

SEQ ID NO: 2389382 - protein, 17 aa, Entamoeba dispar
QSLQITELITRKWSGNK

SEQ ID NO: 2389383 - protein, 25 aa, Entamoeba dispar
QSNCLAHILCIVAMLAVDTQFFVSA

SEQ ID NO: 2389384 - protein, 25 aa, Entamoeba dispar
QSNLIIRSSIAWNYNLLTLLFNRYS

SEQ ID NO: 2389385 - protein, 25 aa, Entamoeba dispar
QSNLSIQCISRFCSSSLVFCSPNQL

SEQ ID NO: 2389386 - protein, 37 aa, Entamoeba dispar
QSPCCMLGSLPCHCCCYRCLSCFRIMLGDIKGDVNRM

SEQ ID NO: 2389387 - protein, 19 aa, Entamoeba dispar
QSRIILIDVSDEFTSQLGL

SEQ ID NO: 2389388 - protein, 25 aa, Entamoeba dispar
QSTIKELECVKGDFFNSTIISLVIS

SEQ ID NO: 2389389 - protein, 30 aa, Entamoeba dispar
QSVGKRRCVLRGLEYLKEIWSENSKVLKEI

SEQ ID NO: 2389390 - protein, 21 aa, Entamoeba dispar
QSVIIKFEFLCTTKVNDIIDV

SEQ ID NO: 2389391 - protein, 20 aa, Entamoeba dispar
QSVIYFDVVGRISVSDIEVD

SEQ ID NO: 2389392 - protein, 18 aa, Entamoeba dispar
QSYFPLHYRFTSITEKQH

SEQ ID NO: 2389393 - protein, 21 aa, Entamoeba dispar
QSYTRPSCYTVKEFAQTLTSY

SEQ ID NO: 2389394 - protein, 18 aa, Entamoeba dispar
QTFFRYFGLLSYLIPISC

SEQ ID NO: 2389395 - protein, 27 aa, Entamoeba dispar
QTFIKRKLTCGQQCAIIKEFELIITIS

SEQ ID NO: 2389396 - protein, 27 aa, Entamoeba dispar
QTFNRPNLRYEMRFKLPSVEFDIACYI

SEQ ID NO: 2389397 - protein, 18 aa, Entamoeba dispar
QTHPRYCYVLVIEFGSLD

SEQ ID NO: 2389398 - protein, 17 aa, Entamoeba dispar
QTILNLCEFMEREGIKV

SEQ ID NO: 2389399 - protein, 24 aa, Entamoeba dispar
QTIPERICLFLLETKSKYNSKDQT

SEQ ID NO: 2389400 - protein, 17 aa, Entamoeba dispar
QTLGFDLHALEFIHKYS

SEQ ID NO: 2389401 - protein, 24 aa, Entamoeba dispar
QTLHPTSSIDLMFVATDKYNQPTN

SEQ ID NO: 2389402 - protein, 24 aa, Entamoeba dispar
QTLLCLRFVPWYVVIINLISQAIY

SEQ ID NO: 2389403 - protein, 19 aa, Entamoeba dispar
QTLWCLCCVVEYFLHQLIC

SEQ ID NO: 2389404 - protein, 22 aa, Entamoeba dispar
QTRVWPSLLLMVITVATLSIFI

SEQ ID NO: 2389405 - protein, 25 aa, Entamoeba dispar
QTSELKRLQIGFAKNNMYVLNNGNV

SEQ ID NO: 2389406 - protein, 35 aa, Entamoeba dispar
QTSMLLFILGFFTCLTWVINIFMFRDSTNDNTKKW

SEQ ID NO: 2389407 - protein, 28 aa, Entamoeba dispar
QTTTRNCRRWKGSIIEYIPKGNKPINAL

SEQ ID NO: 2389408 - protein, 24 aa, Entamoeba dispar
QTVKQCRNSTCPTCYQICKNGAIS

SEQ ID NO: 2389409 - protein, 28 aa, Entamoeba dispar
QVAPCNIIPFRAKHCGAQVAFINCSKTP

SEQ ID NO: 2389410 - protein, 18 aa, Entamoeba dispar
QVCIYWKDIKKCISYDTS

SEQ ID NO: 2389411 - protein, 26 aa, Entamoeba dispar
QVDDYKGLCKYGTYGCDSYCQCNDPD

SEQ ID NO: 2389412 - protein, 19 aa, Entamoeba dispar
QVFIKLHFITVVNQKKNLV

SEQ ID NO: 2389413 - protein, 38 aa, Entamoeba dispar
QVFLCVYSAIMVILWGARKWLDVSFSSFFIVSFILCCI

SEQ ID NO: 2389414 - protein, 19 aa, Entamoeba dispar
QVGCGKTTLLNAILGECKH

SEQ ID NO: 2389415 - protein, 17 aa, Entamoeba dispar
QVICLVCEYGYYPMNSL

SEQ ID NO: 2389416 - protein, 30 aa, Entamoeba dispar
QVIDCKDGFYLKEGSCISCEDDCSKCLYDD

SEQ ID NO: 2389417 - protein, 25 aa, Entamoeba dispar
QVILFPSTTMPLSFEDFEKYSTKPK

SEQ ID NO: 2389418 - protein, 23 aa, Entamoeba dispar
QVISELPWNCWSSSFEFSDQLPP

SEQ ID NO: 2389419 - protein, 25 aa, Entamoeba dispar
QVKTWNLWTLASFIISLVLFFIFML

SEQ ID NO: 2389420 - protein, 18 aa, Entamoeba dispar
QVKYHFKNVDFITSVTSL

SEQ ID NO: 2389421 - protein, 20 aa, Entamoeba dispar
QVLELFSLLFERIGQNRIIA

SEQ ID NO: 2389422 - protein, 17 aa, Entamoeba dispar
QVMTIISIFCFLISLIA

SEQ ID NO: 2389423 - protein, 24 aa, Entamoeba dispar
QVPNELIIFLTRVWINRITNKKEG

SEQ ID NO: 2389424 - protein, 23 aa, Entamoeba dispar
QVSKNCYESFQMMHANPNYSLIT

SEQ ID NO: 2389425 - protein, 21 aa, Entamoeba dispar
QVSLFIVHALSIYPYFINLLV

SEQ ID NO: 2389426 - protein, 25 aa, Entamoeba dispar
QVTSSFKYPYIVAVVKNKLYSTLLS

SEQ ID NO: 2389427 - protein, 18 aa, Entamoeba dispar
QWCKIRGAQDGIIINTKI

SEQ ID NO: 2389428 - protein, 17 aa, Entamoeba dispar
QWDCHSCGDGYYMEGFM

SEQ ID NO: 2389429 - protein, 27 aa, Entamoeba dispar
QWEIWKKWDWDIDYSLRKYTLLMPVEQ

SEQ ID NO: 2389430 - protein, 20 aa, Entamoeba dispar
QWISGELFSYVHYNILVISI

SEQ ID NO: 2389431 - protein, 25 aa, Entamoeba dispar
QWNDNICILIGGLTRILKYILPYVS

SEQ ID NO: 2389432 - protein, 25 aa, Entamoeba dispar
QWTVKNCLIIPIGAFFAGVSAAYLG

SEQ ID NO: 2389433 - protein, 24 aa, Entamoeba dispar
QWVCLCTAASYILEYNEYYETKNY

SEQ ID NO: 2389434 - protein, 18 aa, Entamoeba dispar
QYAAKVEKILAAKKEALN

SEQ ID NO: 2389435 - protein, 23 aa, Entamoeba dispar
QYCGSCMPGFHCTSSGFCEISTS

SEQ ID NO: 2389436 - protein, 20 aa, Entamoeba dispar
QYCNIEWIIVVIILIITIII

SEQ ID NO: 2389437 - protein, 24 aa, Entamoeba dispar
QYECKTCGIGYYPQRMTCSRCEYH

SEQ ID NO: 2389438 - protein, 23 aa, Entamoeba dispar
QYEFLAPFLPVISWQLAHVDLSW

SEQ ID NO: 2389439 - protein, 21 aa, Entamoeba dispar
QYGDCSTAFGITQFPFYMNFN

SEQ ID NO: 2389440 - protein, 19 aa, Entamoeba dispar
QYHMCYPDKIIPSIQGVID

SEQ ID NO: 2389441 - protein, 27 aa, Entamoeba dispar
QYIEEGHCYLLFVPFEYNGHTCYSYNL

SEQ ID NO: 2389442 - protein, 23 aa, Entamoeba dispar
QYINEFSNVFALTIPSIPRPFEF

SEQ ID NO: 2389443 - protein, 32 aa, Entamoeba dispar
QYIPEMIIIPFFILCLSIIYLLNDYWKIKEEK

SEQ ID NO: 2389444 - protein, 23 aa, Entamoeba dispar
QYIREDNEIFLLMIELLSMNLHN

SEQ ID NO: 2389445 - protein, 27 aa, Entamoeba dispar
QYKLIDGLLEFICQTFSLKQYTPALKA

SEQ ID NO: 2389446 - protein, 25 aa, Entamoeba dispar
QYKQKYRFGKWFKINLNQVTNAVFV

SEQ ID NO: 2389447 - protein, 32 aa, Entamoeba dispar
QYLGACIYTSIKSFHWQFLITKSKRSSKRMLA

SEQ ID NO: 2389448 - protein, 19 aa, Entamoeba dispar
QYNCVGRFEKLRLLSHYCI

SEQ ID NO: 2389449 - protein, 18 aa, Entamoeba dispar
QYNIQCLLLTYNQVDITF

SEQ ID NO: 2389450 - protein, 18 aa, Entamoeba dispar
QYNLRIGLNQTIKGFFNS

SEQ ID NO: 2389451 - protein, 18 aa, Entamoeba dispar
QYPMKIIILTTVYYLIQY

SEQ ID NO: 2389452 - protein, 36 aa, Entamoeba dispar
QYPSEILHSCGFLLLRVMLLKCSFNKLKKKMPTILN

SEQ ID NO: 2389453 - protein, 23 aa, Entamoeba dispar
QYQRFSRCYSILLTIAYFKILLA

SEQ ID NO: 2389454 - protein, 23 aa, Entamoeba dispar
QYQYLSSFVHFEFTGIKETTIKI

SEQ ID NO: 2389455 - protein, 20 aa, Entamoeba dispar
QYVNAPMLFLTWVEQSAEIN

SEQ ID NO: 2389456 - protein, 17 aa, Entamoeba dispar
QYWTLVIPAGFVMGFFC

SEQ ID NO: 2389457 - protein, 18 aa, Entamoeba dispar
QYYCLMNGIKIESEKINE

SEQ ID NO: 2389458 - protein, 19 aa, Entamoeba dispar
QYYIHQHHDPFFLDFLQMS

SEQ ID NO: 2389459 - protein, 22 aa, Entamoeba dispar
QYYYYRYIKDWWIHRKDEKQPL

SEQ ID NO: 2389460 - protein, 25 aa, Entamoeba dispar
RAADEIYYALNILYFVSLVLDPYIP

SEQ ID NO: 2389461 - protein, 21 aa, Entamoeba dispar
RAELMPVFYAFIVIPLVTARY

SEQ ID NO: 2389462 - protein, 28 aa, Entamoeba dispar
RAERFDCPSCIEMQGYISVLEEIIQKKN

SEQ ID NO: 2389463 - protein, 20 aa, Entamoeba dispar
RAGALLGIGTCCSGVQSDVD

SEQ ID NO: 2389464 - protein, 23 aa, Entamoeba dispar
RAQVLKFFQRLFLNYQKCFKEVK

SEQ ID NO: 2389465 - protein, 26 aa, Entamoeba dispar
RASLFARLSLSMFAIGVIFSVLFICF

SEQ ID NO: 2389466 - protein, 26 aa, Entamoeba dispar
RATRWRFLGFWICAVLNLFVPNYISG

SEQ ID NO: 2389467 - protein, 22 aa, Entamoeba dispar
RAVSCPFQYNPSLVIIGEDLLR

SEQ ID NO: 2389468 - protein, 20 aa, Entamoeba dispar
RAVVILHYFESIKYFKYTNI

SEQ ID NO: 2389469 - protein, 17 aa, Entamoeba dispar
RAWLLSYSFAIVIVTML

SEQ ID NO: 2389470 - protein, 20 aa, Entamoeba dispar
RCDNGYFLEKGICSICDEKC

SEQ ID NO: 2389471 - protein, 17 aa, Entamoeba dispar
RCEEGYYLTKDMKCLKC

SEQ ID NO: 2389472 - protein, 28 aa, Entamoeba dispar
RCEEGYYLYSNICVSPFHLIDKCMDSRK

SEQ ID NO: 2389473 - protein, 18 aa, Entamoeba dispar
RCGECLELTGPSQTPFNC

SEQ ID NO: 2389474 - protein, 23 aa, Entamoeba dispar
RCGSCRNGLICSSGKCVKEISYN

SEQ ID NO: 2389475 - protein, 19 aa, Entamoeba dispar
RCIYFYFERKDFYELENFI

SEQ ID NO: 2389476 - protein, 19 aa, Entamoeba dispar
RCIYYSKIPYCIKAENSRC

SEQ ID NO: 2389477 - protein, 18 aa, Entamoeba dispar
RCKIPVTLRYGQAKDVIK

SEQ ID NO: 2389478 - protein, 24 aa, Entamoeba dispar
RCSDATECILCYGNDFYLENKKCE

SEQ ID NO: 2389479 - protein, 25 aa, Entamoeba dispar
RCSFDSFKLKCENLKSIVADSTQFN

SEQ ID NO: 2389480 - protein, 17 aa, Entamoeba dispar
RCSFPYTPTPNGCVSCS

SEQ ID NO: 2389481 - protein, 22 aa, Entamoeba dispar
RCSKELYSYDIVHINGVEKTEI

SEQ ID NO: 2389482 - protein, 21 aa, Entamoeba dispar
RCSSLKINLMSSISVNENSQF

SEQ ID NO: 2389483 - protein, 24 aa, Entamoeba dispar
RDAKEMLTCLDISWLNEIISHKKD

SEQ ID NO: 2389484 - protein, 17 aa, Entamoeba dispar
RDAKRNPRLFCGIFEEF

SEQ ID NO: 2389485 - protein, 18 aa, Entamoeba dispar
RDDNHCLQCEDGYTLSDD

SEQ ID NO: 2389486 - protein, 24 aa, Entamoeba dispar
RDDSVCKYALMVLAEQIIKMDTYR

SEQ ID NO: 2389487 - protein, 19 aa, Entamoeba dispar
RDENVIKGKEWFTQIENAI

SEQ ID NO: 2389488 - protein, 22 aa, Entamoeba dispar
RDEYKYRSLLPMIGNTQIGATV

SEQ ID NO: 2389489 - protein, 18 aa, Entamoeba dispar
RDGDGISVLEDEPLKIKI

SEQ ID NO: 2389490 - protein, 27 aa, Entamoeba dispar
RDIEKMKTCGEWSFKYRGTRPEIVHID

SEQ ID NO: 2389491 - protein, 27 aa, Entamoeba dispar
RDIEVITFGCGKENYYRGCYANPTIKT

SEQ ID NO: 2389492 - protein, 24 aa, Entamoeba dispar
RDITELWEKIDLFGERDESFYNET

SEQ ID NO: 2389493 - protein, 18 aa, Entamoeba dispar
RDIVKLLLVHGRYSFNRI

SEQ ID NO: 2389494 - protein, 24 aa, Entamoeba dispar
RDLFANGLNEIWYDDRFVKDDSPY

SEQ ID NO: 2389495 - protein, 17 aa, Entamoeba dispar
RDLKHSIDLTVRLLARI

SEQ ID NO: 2389496 - protein, 19 aa, Entamoeba dispar
RDLNKCYIGFSSIKRNVAT

SEQ ID NO: 2389497 - protein, 21 aa, Entamoeba dispar
RDLYIPMFICELLCFLFLVIF

SEQ ID NO: 2389498 - protein, 20 aa, Entamoeba dispar
RDQFPSLLEFIGYFYFFPSI

SEQ ID NO: 2389499 - protein, 20 aa, Entamoeba dispar
RDTIYLLPLHELRSQLGDLS

SEQ ID NO: 2389500 - protein, 25 aa, Entamoeba dispar
RDTRYLCSLFKYDIQQNVSEAIKNM

SEQ ID NO: 2389501 - protein, 23 aa, Entamoeba dispar
RDVKGENLLVFSLNPRSPVCAKL

SEQ ID NO: 2389502 - protein, 17 aa, Entamoeba dispar
RECKSLFDIKNIVINGG

SEQ ID NO: 2389503 - protein, 22 aa, Entamoeba dispar
REDIIPILRYILAPTPYSGLLT

SEQ ID NO: 2389504 - protein, 24 aa, Entamoeba dispar
REEIYEMFRVFRIIDLTKENKTDD

SEQ ID NO: 2389505 - protein, 24 aa, Entamoeba dispar
REETFKIILKWIKLKGSINQEEVE

SEQ ID NO: 2389506 - protein, 19 aa, Entamoeba dispar
REFIKGRSNERVALYDYSD

SEQ ID NO: 2389507 - protein, 27 aa, Entamoeba dispar
REGIRLRKLYFKSLLRQDATWYDFQES

SEQ ID NO: 2389508 - protein, 19 aa, Entamoeba dispar
REHCEFKPLTVLYDENSSK

SEQ ID NO: 2389509 - protein, 23 aa, Entamoeba dispar
REINLKFACCGWKSYNANSCSFT

SEQ ID NO: 2389510 - protein, 17 aa, Entamoeba dispar
REIPFSLNIFNSREDIV

SEQ ID NO: 2389511 - protein, 20 aa, Entamoeba dispar
REIRGWKNFIYFGSATIVLL

SEQ ID NO: 2389512 - protein, 26 aa, Entamoeba dispar
REKDVILALCSQFLLFGIKNENIRIT

SEQ ID NO: 2389513 - protein, 23 aa, Entamoeba dispar
REKHMREGIKMKAINGKILKENE

SEQ ID NO: 2389514 - protein, 26 aa, Entamoeba dispar
REKSDLSIKVFYQWLTTSLYEGTLIL

SEQ ID NO: 2389515 - protein, 17 aa, Entamoeba dispar
REKYMAFLMNDQIAYVK

SEQ ID NO: 2389516 - protein, 18 aa, Entamoeba dispar
RELSDLIMRFLAIYIPHI

SEQ ID NO: 2389517 - protein, 19 aa, Entamoeba dispar
RENKGLTYEQVFQAVAALK

SEQ ID NO: 2389518 - protein, 20 aa, Entamoeba dispar
REPIEMNEMIYGIINGILEI

SEQ ID NO: 2389519 - protein, 24 aa, Entamoeba dispar
REQNVFFKWIFNQVNMDYSIKRLI

SEQ ID NO: 2389520 - protein, 17 aa, Entamoeba dispar
RERIGIIPQDPLVFQGT

SEQ ID NO: 2389521 - protein, 23 aa, Entamoeba dispar
RESNFPSEWFFLIDSLKNVEIPK

SEQ ID NO: 2389522 - protein, 18 aa, Entamoeba dispar
RESSASWHPLRFSYDLIG

SEQ ID NO: 2389523 - protein, 19 aa, Entamoeba dispar
RETTSALLFQIFQETEEHP

SEQ ID NO: 2389524 - protein, 23 aa, Entamoeba dispar
REVLKRYISLEVGSKIMNFIELL

SEQ ID NO: 2389525 - protein, 19 aa, Entamoeba dispar
RFEKLRLLSHYCISHYLDI

SEQ ID NO: 2389526 - protein, 20 aa, Entamoeba dispar
RFERVHCIKKGKELTINRNG

SEQ ID NO: 2389527 - protein, 26 aa, Entamoeba dispar
RFFQFIRKIIRTYGDYLFKENLDFSY

SEQ ID NO: 2389528 - protein, 32 aa, Entamoeba dispar
RFGGPERYYAFPGFLTCLYKTITIGTTDNWGI

SEQ ID NO: 2389529 - protein, 19 aa, Entamoeba dispar
RFHTYNEFIFRKKSTVDWI

SEQ ID NO: 2389530 - protein, 18 aa, Entamoeba dispar
RFIMKLSSCLSKYTATRL

SEQ ID NO: 2389531 - protein, 28 aa, Entamoeba dispar
RFINNHCSYCSFGGVINGQCSKCEIEHC

SEQ ID NO: 2389532 - protein, 17 aa, Entamoeba dispar
RFITKKELCLDIKKTNI

SEQ ID NO: 2389533 - protein, 21 aa, Entamoeba dispar
RFKHLGKLILYHGRMSLYRNT

SEQ ID NO: 2389534 - protein, 19 aa, Entamoeba dispar
RFNGLQLMNGLLVFAVIGH

SEQ ID NO: 2389535 - protein, 20 aa, Entamoeba dispar
RFNNRCIVDVCFQESSSSEN

SEQ ID NO: 2389536 - protein, 18 aa, Entamoeba dispar
RFQFMLGGAFAGVVSRTA

SEQ ID NO: 2389537 - protein, 30 aa, Entamoeba dispar
RFQSFLYHCCEVLYAWSCIDVFVVSVIAAI

SEQ ID NO: 2389538 - protein, 24 aa, Entamoeba dispar
RFQYQCYPFYLAFFGMLISTLIFV

SEQ ID NO: 2389539 - protein, 18 aa, Entamoeba dispar
RFSAELIEGVSLLVRSVR

SEQ ID NO: 2389540 - protein, 20 aa, Entamoeba dispar
RFTNIFKMSHLTVKDQFNKI

SEQ ID NO: 2389541 - protein, 26 aa, Entamoeba dispar
RFTSVCWFGVLILASLIVKFTPKKVS

SEQ ID NO: 2389542 - protein, 25 aa, Entamoeba dispar
RFYFRADLFIKVPSILTLDIITNAE

SEQ ID NO: 2389543 - protein, 17 aa, Entamoeba dispar
RFYFYLEILYLLMNITI

SEQ ID NO: 2389544 - protein, 18 aa, Entamoeba dispar
RGALECVICMAPIENTHM

SEQ ID NO: 2389545 - protein, 22 aa, Entamoeba dispar
RGAVETRLPPKQKIVGSIPTGI

SEQ ID NO: 2389546 - protein, 17 aa, Entamoeba dispar
RGDENRDIIGFFMNGDE

SEQ ID NO: 2389547 - protein, 27 aa, Entamoeba dispar
RGFYGCLCCVIVLTLYYFMPFLPASIR

SEQ ID NO: 2389548 - protein, 21 aa, Entamoeba dispar
RGGTISTWKIMIGIIARMVIT

SEQ ID NO: 2389549 - protein, 19 aa, Entamoeba dispar
RGILNTILELCRLNNCQEL

SEQ ID NO: 2389550 - protein, 34 aa, Entamoeba dispar
RGKIWMNTLHVFRQFVKLCYSFLFIQNLTSLQFL

SEQ ID NO: 2389551 - protein, 17 aa, Entamoeba dispar
RGLNCLITIIISSIILG

SEQ ID NO: 2389552 - protein, 17 aa, Entamoeba dispar
RGMWFKFTATQSTHVID

SEQ ID NO: 2389553 - protein, 18 aa, Entamoeba dispar
RGNSINARKEREFKNQLA

SEQ ID NO: 2389554 - protein, 18 aa, Entamoeba dispar
RGQNCPIHGSGEEKRSFI

SEQ ID NO: 2389555 - protein, 18 aa, Entamoeba dispar
RGRFITEFIGAIFQLNKL

SEQ ID NO: 2389556 - protein, 22 aa, Entamoeba dispar
RGRIIESISIIGFYLNNSELTL

SEQ ID NO: 2389557 - protein, 19 aa, Entamoeba dispar
RGRIKMSVNTSLYKPKEKN

SEQ ID NO: 2389558 - protein, 27 aa, Entamoeba dispar
RGSLIKHLFKYVATFLSYYPVKIIGLF

SEQ ID NO: 2389559 - protein, 17 aa, Entamoeba dispar
RGSRIGQNVSVFKDLNG

SEQ ID NO: 2389560 - protein, 20 aa, Entamoeba dispar
RGSTFINFKMDLECKCKLLE

SEQ ID NO: 2389561 - protein, 18 aa, Entamoeba dispar
RGTAFAMIGQYQMAVEDF

SEQ ID NO: 2389562 - protein, 22 aa, Entamoeba dispar
RGTSLLPILVIIPLWYISLPTN

SEQ ID NO: 2389563 - protein, 25 aa, Entamoeba dispar
RGYWKQQYLLRRQWSNLIIENYRRQ

SEQ ID NO: 2389564 - protein, 19 aa, Entamoeba dispar
RHANMWRSSMKELNKKRAE

SEQ ID NO: 2389565 - protein, 22 aa, Entamoeba dispar
RHDLGFRRILFILSLINGGVSY

SEQ ID NO: 2389566 - protein, 19 aa, Entamoeba dispar
RHLQKLIYFHGRQALRRNT

SEQ ID NO: 2389567 - protein, 24 aa, Entamoeba dispar
RHNIPCDKQPFGLVGSKTLGGYPM

SEQ ID NO: 2389568 - protein, 17 aa, Entamoeba dispar
RHNKFIVEYLLEAVLSI

SEQ ID NO: 2389569 - protein, 20 aa, Entamoeba dispar
RIAQIPVFILLIVAFFFMCL

SEQ ID NO: 2389570 - protein, 21 aa, Entamoeba dispar
RIDETYCPLYVLNGKEVLDMK

SEQ ID NO: 2389571 - protein, 19 aa, Entamoeba dispar
RIDFISVLNSYEYFYEVNI

SEQ ID NO: 2389572 - protein, 17 aa, Entamoeba dispar
RIDFLIFQSYHFLYVFL

SEQ ID NO: 2389573 - protein, 17 aa, Entamoeba dispar
RIEGKLRIVYTCINLFI

SEQ ID NO: 2389574 - protein, 19 aa, Entamoeba dispar
RIEWFESFHEIILNPTIDH

SEQ ID NO: 2389575 - protein, 19 aa, Entamoeba dispar
RIHFRDHSKDTFKGLELDY

SEQ ID NO: 2389576 - protein, 33 aa, Entamoeba dispar
RIIANAFPIAGFWKHVCIVWTFCDCYKPQVYYN

SEQ ID NO: 2389577 - protein, 20 aa, Entamoeba dispar
RIIAQLKSICSIVLSYIPLP

SEQ ID NO: 2389578 - protein, 18 aa, Entamoeba dispar
RIILDASKGIAILHARNY

SEQ ID NO: 2389579 - protein, 27 aa, Entamoeba dispar
RIIQSCPFFPLILKLILQESFALVLEE

SEQ ID NO: 2389580 - protein, 17 aa, Entamoeba dispar
RIISFIVSISYLLSALW

SEQ ID NO: 2389581 - protein, 23 aa, Entamoeba dispar
RIKECYDLIELCLKDKLEETEEK

SEQ ID NO: 2389582 - protein, 17 aa, Entamoeba dispar
RIKEFLLTPELKPIPVS

SEQ ID NO: 2389583 - protein, 18 aa, Entamoeba dispar
RIKICMDAARGIEYLHQN

SEQ ID NO: 2389584 - protein, 17 aa, Entamoeba dispar
RIKPNIITIEGGYACEF

SEQ ID NO: 2389585 - protein, 22 aa, Entamoeba dispar
RIKRTGIIKTMMIFLITGILFF

SEQ ID NO: 2389586 - protein, 19 aa, Entamoeba dispar
RILFVCIKQDINIAMNTNI

SEQ ID NO: 2389587 - protein, 26 aa, Entamoeba dispar
RILHDVCPLEIILLLREILQSQLTIY

SEQ ID NO: 2389588 - protein, 25 aa, Entamoeba dispar
RILKVPTCLKEFISSGFIYDENDID

SEQ ID NO: 2389589 - protein, 23 aa, Entamoeba dispar
RILYLEFYISVIISQTKILYDII

SEQ ID NO: 2389590 - protein, 19 aa, Entamoeba dispar
RINEFISVYIGKLYSSFGY

SEQ ID NO: 2389591 - protein, 27 aa, Entamoeba dispar
RINENLKRLHVMGEIMAENGFLQRSDI

SEQ ID NO: 2389592 - protein, 22 aa, Entamoeba dispar
RIPLYLEFYSMFSAGHFIIGLG

SEQ ID NO: 2389593 - protein, 20 aa, Entamoeba dispar
RIQLYDTFLPFLIKELKKTD

SEQ ID NO: 2389594 - protein, 21 aa, Entamoeba dispar
RIRELKIMVSDHFFKRKQLRK

SEQ ID NO: 2389595 - protein, 17 aa, Entamoeba dispar
RITEFPYFTPILNVNEF

SEQ ID NO: 2389596 - protein, 19 aa, Entamoeba dispar
RITESLILVSFVILVAVAV

SEQ ID NO: 2389597 - protein, 19 aa, Entamoeba dispar
RITKEVTCYMTLHCTTKIN

SEQ ID NO: 2389598 - protein, 19 aa, Entamoeba dispar
RITKNDIRRTRRQIGENIN

SEQ ID NO: 2389599 - protein, 33 aa, Entamoeba dispar
RIVWEWKTYHFITLSLFAFLFILSLSFTVIMGS

SEQ ID NO: 2389600 - protein, 18 aa, Entamoeba dispar
RIYKGDCVACGGNCSTCY

SEQ ID NO: 2389601 - protein, 20 aa, Entamoeba dispar
RIYYKIYINTCNKFTTVTTS

SEQ ID NO: 2389602 - protein, 19 aa, Entamoeba dispar
RKAFQGFCIHAGGRGVIDA

SEQ ID NO: 2389603 - protein, 22 aa, Entamoeba dispar
RKCWMCVFPGCTEPPKTRYNCY

SEQ ID NO: 2389604 - protein, 19 aa, Entamoeba dispar
RKDAMKLCEMYVIYVDDSR

SEQ ID NO: 2389605 - protein, 18 aa, Entamoeba dispar
RKDLKVVVMSATLDSQLF

SEQ ID NO: 2389606 - protein, 18 aa, Entamoeba dispar
RKDVPYYLFIHSKYASKT

SEQ ID NO: 2389607 - protein, 20 aa, Entamoeba dispar
RKDYFNFAMFIKSIEETVLN

SEQ ID NO: 2389608 - protein, 23 aa, Entamoeba dispar
RKEGYKRVLLCSVKVMILSIILN

SEQ ID NO: 2389609 - protein, 19 aa, Entamoeba dispar
RKEIDLLSKFKCSYIIQFL

SEQ ID NO: 2389610 - protein, 21 aa, Entamoeba dispar
RKETLIPMKMKIKFMIDAAKG

SEQ ID NO: 2389611 - protein, 22 aa, Entamoeba dispar
RKGAYLCFGISLGYLLTIHIKR

SEQ ID NO: 2389612 - protein, 35 aa, Entamoeba dispar
RKGDKIFNFLFKYIHKLRFVIVIFWILAVIGFAYP

SEQ ID NO: 2389613 - protein, 21 aa, Entamoeba dispar
RKGIDLAVGIIPYICSKYPKV

SEQ ID NO: 2389614 - protein, 26 aa, Entamoeba dispar
RKHVTYGLAIGYPFAVLCLAAVNLGL

SEQ ID NO: 2389615 - protein, 25 aa, Entamoeba dispar
RKIGCNTPFLSKVEWSVVISQFNKE

SEQ ID NO: 2389616 - protein, 21 aa, Entamoeba dispar
RKIGNDFIMQIMIQDGGVFFV

SEQ ID NO: 2389617 - protein, 19 aa, Entamoeba dispar
RKIKERKGPLVVYGNDDLQ

SEQ ID NO: 2389618 - protein, 17 aa, Entamoeba dispar
RKIPIKIEVWKLILERR

SEQ ID NO: 2389619 - protein, 21 aa, Entamoeba dispar
RKISSSGIFLWKMWNINENSI

SEQ ID NO: 2389620 - protein, 19 aa, Entamoeba dispar
RKKEEIITFVNILEFMIDD

SEQ ID NO: 2389621 - protein, 22 aa, Entamoeba dispar
RKKEPYQRIEFSLTIEQSNEGI

SEQ ID NO: 2389622 - protein, 19 aa, Entamoeba dispar
RKKIEEFDELIQTTKAVSS

SEQ ID NO: 2389623 - protein, 18 aa, Entamoeba dispar
RKKILVLVALGPSLLVPI

SEQ ID NO: 2389624 - protein, 20 aa, Entamoeba dispar
RKKSTVDWIGHVSFKHSITF

SEQ ID NO: 2389625 - protein, 22 aa, Entamoeba dispar
RKKSWLCIFPGCKEPVKTHYNC

SEQ ID NO: 2389626 - protein, 42 aa, Entamoeba dispar
RKKTLYYKWIYPIAIAVDITLRFGWTINIILLYVAWFDENKI

SEQ ID NO: 2389627 - protein, 19 aa, Entamoeba dispar
RKLLKKYIENLSMITAEDI

SEQ ID NO: 2389628 - protein, 17 aa, Entamoeba dispar
RKLNINKGILITVPIPK

SEQ ID NO: 2389629 - protein, 20 aa, Entamoeba dispar
RKLPSLLSRSHVISKFTNVL

SEQ ID NO: 2389630 - protein, 23 aa, Entamoeba dispar
RKLSQRLTFYASHFKNNDGQKSR

SEQ ID NO: 2389631 - protein, 20 aa, Entamoeba dispar
RKLYFKSLLRQDATWYDFQE

SEQ ID NO: 2389632 - protein, 26 aa, Entamoeba dispar
RKMLTEIVTAISMLHSFHFIYRQLNP

SEQ ID NO: 2389633 - protein, 21 aa, Entamoeba dispar
RKMPLSYLLFFIGILLYIHCG

SEQ ID NO: 2389634 - protein, 24 aa, Entamoeba dispar
RKNKRYSQLMLFNYAIKTYGKEET

SEQ ID NO: 2389635 - protein, 19 aa, Entamoeba dispar
RKNVDLIFIAPIGIKLDSA

SEQ ID NO: 2389636 - protein, 29 aa, Entamoeba dispar
RKPLNVRKSFRFILPRALLLLTLFILVFT

SEQ ID NO: 2389637 - protein, 17 aa, Entamoeba dispar
RKQILNFLQILISKIIS

SEQ ID NO: 2389638 - protein, 18 aa, Entamoeba dispar
RKQLKLLINSFAKDEEIE

SEQ ID NO: 2389639 - protein, 19 aa, Entamoeba dispar
RKRIPEISIALQVLLEATY

SEQ ID NO: 2389640 - protein, 17 aa, Entamoeba dispar
RKRMSVLVRMWDGTLVL

SEQ ID NO: 2389641 - protein, 31 aa, Entamoeba dispar
RKSKYLFEYYNPRLSEIDLLYSSNLTNAKSQ

SEQ ID NO: 2389642 - protein, 18 aa, Entamoeba dispar
RKSLKIAASMFQETEEVG

SEQ ID NO: 2389643 - protein, 20 aa, Entamoeba dispar
RKSNALFYCILIHHQSNTNH

SEQ ID NO: 2389644 - protein, 19 aa, Entamoeba dispar
RKSSALKPVLATLLNIGNF

SEQ ID NO: 2389645 - protein, 26 aa, Entamoeba dispar
RKTAAMCVAKLYFLNQEECVRQGFVN

SEQ ID NO: 2389646 - protein, 27 aa, Entamoeba dispar
RKTCPCSGDKCIIDFSSTTSVMYKLIS

SEQ ID NO: 2389647 - protein, 17 aa, Entamoeba dispar
RKTIIRLLTELQFINDL

SEQ ID NO: 2389648 - protein, 19 aa, Entamoeba dispar
RKTTFFVFITGSDVNDVGI

SEQ ID NO: 2389649 - protein, 17 aa, Entamoeba dispar
RKVALDLGIKRIYIPTF

SEQ ID NO: 2389650 - protein, 20 aa, Entamoeba dispar
RKVDSCPFMPSTQVYINSTS

SEQ ID NO: 2389651 - protein, 18 aa, Entamoeba dispar
RKVLYPIQLIWRGLYFIN

SEQ ID NO: 2389652 - protein, 21 aa, Entamoeba dispar
RKWALWFGLILQCVGIVLCII

SEQ ID NO: 2389653 - protein, 25 aa, Entamoeba dispar
RKYAIVSCAVFPPFVLACLVGSVKT

SEQ ID NO: 2389654 - protein, 22 aa, Entamoeba dispar
RKYCGIVSIILIIGYEIILQYF

SEQ ID NO: 2389655 - protein, 25 aa, Entamoeba dispar
RKYILKMLYIYILGYDVDFGIPIIT

SEQ ID NO: 2389656 - protein, 18 aa, Entamoeba dispar
RLACSCIQYHYNYIKNAQ

SEQ ID NO: 2389657 - protein, 21 aa, Entamoeba dispar
RLCFIISLIVVVGYIALIIFI

SEQ ID NO: 2389658 - protein, 21 aa, Entamoeba dispar
RLCSKICSFFNSLITSDPMLA

SEQ ID NO: 2389659 - protein, 17 aa, Entamoeba dispar
RLDFKSFFFKKNSYITS

SEQ ID NO: 2389660 - protein, 29 aa, Entamoeba dispar
RLDFPKTFPPGICELIKKCWAHDPKQRPV

SEQ ID NO: 2389661 - protein, 21 aa, Entamoeba dispar
RLDLRDVLRSFAILLPKTGYC

SEQ ID NO: 2389662 - protein, 19 aa, Entamoeba dispar
RLEFISVLAESDRLYQING

SEQ ID NO: 2389663 - protein, 19 aa, Entamoeba dispar
RLEILKIDASTLFKISKYL

SEQ ID NO: 2389664 - protein, 24 aa, Entamoeba dispar
RLELYDSIHFLTLWSQSISFIPMK

SEQ ID NO: 2389665 - protein, 24 aa, Entamoeba dispar
RLEVEIHPDLTLNIHIGFLSASEK

SEQ ID NO: 2389666 - protein, 27 aa, Entamoeba dispar
RLFEKLPIGNLLLHYVNWMTNLCYLTD

SEQ ID NO: 2389667 - protein, 17 aa, Entamoeba dispar
RLGCIPATCGNKKWDEG

SEQ ID NO: 2389668 - protein, 18 aa, Entamoeba dispar
RLHWIEFQNKFYIGDGIP

SEQ ID NO: 2389669 - protein, 25 aa, Entamoeba dispar
RLIILRRYFTLMGVLFAIRLVCVYL

SEQ ID NO: 2389670 - protein, 27 aa, Entamoeba dispar
RLINKLCPRFDDLPFLQKVEVFERVLA

SEQ ID NO: 2389671 - protein, 25 aa, Entamoeba dispar
RLIQINSVIKQYCMLLLPKDFDNYE

SEQ ID NO: 2389672 - protein, 25 aa, Entamoeba dispar
RLIVLRRFVTLMGVMFLVRIICVYM

SEQ ID NO: 2389673 - protein, 19 aa, Entamoeba dispar
RLKALEMISDYISGSLDVL

SEQ ID NO: 2389674 - protein, 24 aa, Entamoeba dispar
RLKDTSIPFIEHWENELTKSEITT

SEQ ID NO: 2389675 - protein, 23 aa, Entamoeba dispar
RLKDTSMPFIENWVGDETIITDS

SEQ ID NO: 2389676 - protein, 40 aa, Entamoeba dispar
RLKEKRTLWYVWALWWFIYAVVCVATFTVLKLFIKKDDLL

SEQ ID NO: 2389677 - protein, 26 aa, Entamoeba dispar
RLKPTKEVFLLLKLFIDEHILPIHLA

SEQ ID NO: 2389678 - protein, 19 aa, Entamoeba dispar
RLLITKMAQFCTKRFTGSL

SEQ ID NO: 2389679 - protein, 20 aa, Entamoeba dispar
RLLLGPILVEAIRIIKNYKE

SEQ ID NO: 2389680 - protein, 17 aa, Entamoeba dispar
RLLNEINPFEYLDNIDW

SEQ ID NO: 2389681 - protein, 20 aa, Entamoeba dispar
RLLRRCLTRELILKTIYCRM

SEQ ID NO: 2389682 - protein, 24 aa, Entamoeba dispar
RLLYDCCVICFIYIITVHHMYDSD

SEQ ID NO: 2389683 - protein, 26 aa, Entamoeba dispar
RLNLKEVPWMILGFIGSMIYGALFPI

SEQ ID NO: 2389684 - protein, 19 aa, Entamoeba dispar
RLNQYCEVMTKCSYELANA

SEQ ID NO: 2389685 - protein, 19 aa, Entamoeba dispar
RLPKIHLKESIKVINVDGE

SEQ ID NO: 2389686 - protein, 25 aa, Entamoeba dispar
RLSKAMKNFLFWGIGACVYLFIYII

SEQ ID NO: 2389687 - protein, 19 aa, Entamoeba dispar
RLSKAQCMDALSSQNNLAG

SEQ ID NO: 2389688 - protein, 20 aa, Entamoeba dispar
RLSSLPMFDSKSNRFISEKR

SEQ ID NO: 2389689 - protein, 21 aa, Entamoeba dispar
RLSTINVAICKIKTAKEYLET

SEQ ID NO: 2389690 - protein, 25 aa, Entamoeba dispar
RLVDALKLKGYRIIENSNIIAQYLS

SEQ ID NO: 2389691 - protein, 31 aa, Entamoeba dispar
RLVELNKPWHCPHGRQTIRHLWDLRRSFNEI

SEQ ID NO: 2389692 - protein, 17 aa, Entamoeba dispar
RLVRSVLNFIRKFETIE

SEQ ID NO: 2389693 - protein, 17 aa, Entamoeba dispar
RLVTPRIKTSKQIKDQE

SEQ ID NO: 2389694 - protein, 40 aa, Entamoeba dispar
RLVVCCIIAGLLFRFKPLIYLTRFVPFTFIRKYRKMPLSY

SEQ ID NO: 2389695 - protein, 19 aa, Entamoeba dispar
RLVVKRICKEPISMMDNIF

SEQ ID NO: 2389696 - protein, 18 aa, Entamoeba dispar
RLYEYFTEIYNDWQNSGS

SEQ ID NO: 2389697 - protein, 19 aa, Entamoeba dispar
RLYTPIVNFMAKFFCNVPS

SEQ ID NO: 2389698 - protein, 19 aa, Entamoeba dispar
RLYVFPIYIIRAGLIAINY

SEQ ID NO: 2389699 - protein, 23 aa, Entamoeba dispar
RLYVGTHHLCFSYLKIIKKKHVI

SEQ ID NO: 2389700 - protein, 18 aa, Entamoeba dispar
RMAICGKNVPVTYQDCSC

SEQ ID NO: 2389701 - protein, 28 aa, Entamoeba dispar
RMIGINYEFVKNILIRNGDNLKTYTSIL

SEQ ID NO: 2389702 - protein, 20 aa, Entamoeba dispar
RMIGSAALPFLKIGVEKVCI

SEQ ID NO: 2389703 - protein, 21 aa, Entamoeba dispar
RMKDLWRKDDFEEFRKEIDLL

SEQ ID NO: 2389704 - protein, 32 aa, Entamoeba dispar
RMKISNIPTTCVYICNFRNVIGTMNNIEIEGA

SEQ ID NO: 2389705 - protein, 18 aa, Entamoeba dispar
RMKLGYYTKDLYRMTSRS

SEQ ID NO: 2389706 - protein, 21 aa, Entamoeba dispar
RMLKHLKNIILQLGKPKDQMF

SEQ ID NO: 2389707 - protein, 25 aa, Entamoeba dispar
RMLMSYSCWIYFIETYRFNYEYNER

SEQ ID NO: 2389708 - protein, 29 aa, Entamoeba dispar
RMMKEVMDIPEGYEIIFLGGGASLQFLMV

SEQ ID NO: 2389709 - protein, 17 aa, Entamoeba dispar
RMNALPVGTQFPFVKLR

SEQ ID NO: 2389710 - protein, 23 aa, Entamoeba dispar
RMSEFPSSLCLMKKLNKISLQRN

SEQ ID NO: 2389711 - protein, 24 aa, Entamoeba dispar
RMSIIPICEIRDIFGNVVFNEDLL

SEQ ID NO: 2389712 - protein, 26 aa, Entamoeba dispar
RMSNYMFINQLNFFAGYSYNDINNHP

SEQ ID NO: 2389713 - protein, 20 aa, Entamoeba dispar
RMTVVNGWFGGIKMETRDQR

SEQ ID NO: 2389714 - protein, 19 aa, Entamoeba dispar
RNALNYTVCNNSFECEIGD

SEQ ID NO: 2389715 - protein, 19 aa, Entamoeba dispar
RNAYVNWFLAFVGGLAGGF

SEQ ID NO: 2389716 - protein, 23 aa, Entamoeba dispar
RNCNVVLRWALLHGTYPIKKLKD

SEQ ID NO: 2389717 - protein, 23 aa, Entamoeba dispar
RNDCAYSFIPYQVLTNYMKLNPE

SEQ ID NO: 2389718 - protein, 20 aa, Entamoeba dispar
RNDGMFVIDMWRNATLPVSV

SEQ ID NO: 2389719 - protein, 18 aa, Entamoeba dispar
RNFFKNIIPILSYAIGGC

SEQ ID NO: 2389720 - protein, 21 aa, Entamoeba dispar
RNGKCTGCISGYYPKDNICFE

SEQ ID NO: 2389721 - protein, 19 aa, Entamoeba dispar
RNGLIGLIFEKALKLNSAG

SEQ ID NO: 2389722 - protein, 17 aa, Entamoeba dispar
RNGLLLFVTTLRIGALT

SEQ ID NO: 2389723 - protein, 18 aa, Entamoeba dispar
RNGNCIIVNQTLHPLTLN

SEQ ID NO: 2389724 - protein, 18 aa, Entamoeba dispar
RNHISYFNWFLYTTTLLF

SEQ ID NO: 2389725 - protein, 24 aa, Entamoeba dispar
RNIKEGFVGIFKRSSIPVSGINNN

SEQ ID NO: 2389726 - protein, 23 aa, Entamoeba dispar
RNISPKPVMPSLMKLLDSSDENI

SEQ ID NO: 2389727 - protein, 27 aa, Entamoeba dispar
RNKKKFKMMFEWGRIGDKLKRTYRESK

SEQ ID NO: 2389728 - protein, 24 aa, Entamoeba dispar
RNNELKVNLAFTICVGEKIKYFSA

SEQ ID NO: 2389729 - protein, 29 aa, Entamoeba dispar
RNNINFKWRLSQYVTWYIIFSLLISMLML

SEQ ID NO: 2389730 - protein, 20 aa, Entamoeba dispar
RNPIKCSNLIIKSGKVSIQD

SEQ ID NO: 2389731 - protein, 20 aa, Entamoeba dispar
RNQSYLMMLMFSFIGTSGLL

SEQ ID NO: 2389732 - protein, 20 aa, Entamoeba dispar
RNQVLIFSNRIFKLYPNTQE

SEQ ID NO: 2389733 - protein, 17 aa, Entamoeba dispar
RNREGLMSIDMKAVNEK

SEQ ID NO: 2389734 - protein, 21 aa, Entamoeba dispar
RNRIITFFLIFSIAIFFWLIT

SEQ ID NO: 2389735 - protein, 29 aa, Entamoeba dispar
RNSELIRLISFGMFKGALITLMVEIGPTM

SEQ ID NO: 2389736 - protein, 24 aa, Entamoeba dispar
RNSKRFSMRKTLLLEKVHFDIKIT

SEQ ID NO: 2389737 - protein, 18 aa, Entamoeba dispar
RNTINGRHSVMCQPMNQM

SEQ ID NO: 2389738 - protein, 23 aa, Entamoeba dispar
RNVKRLIKFIHLISFVNKVIDKV

SEQ ID NO: 2389739 - protein, 30 aa, Entamoeba dispar
RNVTLIKMCFYKNASFFLILFWYSFFNGQS

SEQ ID NO: 2389740 - protein, 18 aa, Entamoeba dispar
RNYCLKCSNGYKIENNQC

SEQ ID NO: 2389741 - protein, 18 aa, Entamoeba dispar
RPAKFSIIIYSWVLFILW

SEQ ID NO: 2389742 - protein, 23 aa, Entamoeba dispar
RPDIYTRGSVCLIKNMLKNQPTL

SEQ ID NO: 2389743 - protein, 25 aa, Entamoeba dispar
RPEVIDAVASCHRAGITVRMVTGDN

SEQ ID NO: 2389744 - protein, 26 aa, Entamoeba dispar
RPIDEKETLCGRREVLLMNPNETTSD

SEQ ID NO: 2389745 - protein, 21 aa, Entamoeba dispar
RPKESIDLIISFMAKCTTLLN

SEQ ID NO: 2389746 - protein, 22 aa, Entamoeba dispar
RPKIEKEFREQLIIEQERLKQK

SEQ ID NO: 2389747 - protein, 17 aa, Entamoeba dispar
RPLELPIPCINPKRHSE

SEQ ID NO: 2389748 - protein, 25 aa, Entamoeba dispar
RPQIEGYDSWVIFHLYDIVKQCNDP

SEQ ID NO: 2389749 - protein, 19 aa, Entamoeba dispar
RPQIVDMRETIWLLHDREL

SEQ ID NO: 2389750 - protein, 20 aa, Entamoeba dispar
RPVLYVSVGTLAFVGETLTF

SEQ ID NO: 2389751 - protein, 17 aa, Entamoeba dispar
RQCEDKIDIILEILLTK

SEQ ID NO: 2389752 - protein, 19 aa, Entamoeba dispar
RQEYEMLLNDFKRYITSGI

SEQ ID NO: 2389753 - protein, 17 aa, Entamoeba dispar
RQFKYTYNIFFLVTIIT

SEQ ID NO: 2389754 - protein, 21 aa, Entamoeba dispar
RQIFSPIPWNCMKYEVKSSQK

SEQ ID NO: 2389755 - protein, 23 aa, Entamoeba dispar
RQLICLARGLLSRSKVIVLDEAT

SEQ ID NO: 2389756 - protein, 23 aa, Entamoeba dispar
RQLIRLSRRGNFMAKKRIIEIDD

SEQ ID NO: 2389757 - protein, 30 aa, Entamoeba dispar
RQVFTTLFFLRYLFLPLISYPSLLKILQKA

SEQ ID NO: 2389758 - protein, 21 aa, Entamoeba dispar
RQVPDMFVSICACAMIISIIS

SEQ ID NO: 2389759 - protein, 19 aa, Entamoeba dispar
RQWKIYFDYLKGESTYDIE

SEQ ID NO: 2389760 - protein, 17 aa, Entamoeba dispar
RRCLQNWFTDIISIILL

SEQ ID NO: 2389761 - protein, 21 aa, Entamoeba dispar
RREAEIILKKIFKNIINYEIK

SEQ ID NO: 2389762 - protein, 25 aa, Entamoeba dispar
RREEMPCLFGTLFRDLNPSDLTKNE

SEQ ID NO: 2389763 - protein, 27 aa, Entamoeba dispar
RRFKHLTKLILFYGRNGKYQISTLIKF

SEQ ID NO: 2389764 - protein, 18 aa, Entamoeba dispar
RRGCDLCDANECFSCQPN

SEQ ID NO: 2389765 - protein, 17 aa, Entamoeba dispar
RRICHFGIFCYVLCQVN

SEQ ID NO: 2389766 - protein, 18 aa, Entamoeba dispar
RRIPEHITKLSVTKLDVS

SEQ ID NO: 2389767 - protein, 23 aa, Entamoeba dispar
RRKEIKKVIPPGCIERDANGKVI

SEQ ID NO: 2389768 - protein, 19 aa, Entamoeba dispar
RRKYYSILGKILFQDESCD

SEQ ID NO: 2389769 - protein, 20 aa, Entamoeba dispar
RRLKNMFSKTLQFKINGNLG

SEQ ID NO: 2389770 - protein, 19 aa, Entamoeba dispar
RRMGQMLALGNFPQHILPL

SEQ ID NO: 2389771 - protein, 23 aa, Entamoeba dispar
RRNTLIVKLSFYKNVAFILMQFW

SEQ ID NO: 2389772 - protein, 20 aa, Entamoeba dispar
RRPFMLIGLGVWLLGAIIIV

SEQ ID NO: 2389773 - protein, 17 aa, Entamoeba dispar
RRRAERFDCPSCIEMQG

SEQ ID NO: 2389774 - protein, 19 aa, Entamoeba dispar
RRRMYRSLSCIYENNGNYA

SEQ ID NO: 2389775 - protein, 18 aa, Entamoeba dispar
RRRQLMLTTMIILSNCLM

SEQ ID NO: 2389776 - protein, 26 aa, Entamoeba dispar
RRSIIFPLRISKGGKMPIIIMLMGML

SEQ ID NO: 2389777 - protein, 20 aa, Entamoeba dispar
RRVIESIHLKKEWNKKEIIN

SEQ ID NO: 2389778 - protein, 17 aa, Entamoeba dispar
RRYAFQHKVNWSLIIGS

SEQ ID NO: 2389779 - protein, 23 aa, Entamoeba dispar
RSACSRMLYLRLPTILLQTPSTK

SEQ ID NO: 2389780 - protein, 17 aa, Entamoeba dispar
RSAIFSVSWSIGKAFGY

SEQ ID NO: 2389781 - protein, 18 aa, Entamoeba dispar
RSASIVIAYLMKKNKWTY

SEQ ID NO: 2389782 - protein, 19 aa, Entamoeba dispar
RSCAACKEGFILQDGGTCE

SEQ ID NO: 2389783 - protein, 19 aa, Entamoeba dispar
RSDHIFVFVIGGISLGEIS

SEQ ID NO: 2389784 - protein, 22 aa, Entamoeba dispar
RSENYRFILSLNILCDLLSEFG

SEQ ID NO: 2389785 - protein, 28 aa, Entamoeba dispar
RSESIIPFTRFLRVFLPYTLVNREEGNP

SEQ ID NO: 2389786 - protein, 17 aa, Entamoeba dispar
RSEYLFLMDDIVQRMKK

SEQ ID NO: 2389787 - protein, 24 aa, Entamoeba dispar
RSFGSKRVVLFVDIILFIVTFILF

SEQ ID NO: 2389788 - protein, 17 aa, Entamoeba dispar
RSFKREVNWFRFDVYKY

SEQ ID NO: 2389789 - protein, 21 aa, Entamoeba dispar
RSFVLGLLFYLVPCFEMYIYV

SEQ ID NO: 2389790 - protein, 25 aa, Entamoeba dispar
RSGAIVVCAPIAPYREIRDEVRKMV

SEQ ID NO: 2389791 - protein, 21 aa, Entamoeba dispar
RSILELWILPEYVMTTKKMLN

SEQ ID NO: 2389792 - protein, 20 aa, Entamoeba dispar
RSIPVAIKMFKWENLTEEQT

SEQ ID NO: 2389793 - protein, 27 aa, Entamoeba dispar
RSIYNILRFWGMYSLYPSFIPSSFECV

SEQ ID NO: 2389794 - protein, 19 aa, Entamoeba dispar
RSIYRPEIINAPKYITNKV

SEQ ID NO: 2389795 - protein, 28 aa, Entamoeba dispar
RSKEDWFDWFRQIAMVFLKESPSQSLCY

SEQ ID NO: 2389796 - protein, 24 aa, Entamoeba dispar
RSKHLISILFCEATAIYGVIAGFI

SEQ ID NO: 2389797 - protein, 23 aa, Entamoeba dispar
RSLCFPYLRYVPNADGIRKRKPY

SEQ ID NO: 2389798 - protein, 20 aa, Entamoeba dispar
RSLESVDMYYVFPSVEDSKI

SEQ ID NO: 2389799 - protein, 24 aa, Entamoeba dispar
RSLFLLFQFFYLMFLITLGLSAQP

SEQ ID NO: 2389800 - protein, 23 aa, Entamoeba dispar
RSLKAPVIAASLMLTNLSTEQLV

SEQ ID NO: 2389801 - protein, 20 aa, Entamoeba dispar
RSLVLLTVKEHWKYGINITS

SEQ ID NO: 2389802 - protein, 21 aa, Entamoeba dispar
RSQILFLIVWVTRYLDIFYNF

SEQ ID NO: 2389803 - protein, 22 aa, Entamoeba dispar
RSQLKRVLFSFLRSGEEYCQGI

SEQ ID NO: 2389804 - protein, 22 aa, Entamoeba dispar
RSRGYWKQQYLLRRQWSNIIIE

SEQ ID NO: 2389805 - protein, 18 aa, Entamoeba dispar
RSRNEFIITINVNGIIYT

SEQ ID NO: 2389806 - protein, 17 aa, Entamoeba dispar
RSSEVLATIHFEVKTPE

SEQ ID NO: 2389807 - protein, 23 aa, Entamoeba dispar
RSSGGCGIYARYSFIVEADKNYS

SEQ ID NO: 2389808 - protein, 17 aa, Entamoeba dispar
RSSIGILQIFFIIVSLV

SEQ ID NO: 2389809 - protein, 19 aa, Entamoeba dispar
RSSSFSETASDVWSSPTCP

SEQ ID NO: 2389810 - protein, 19 aa, Entamoeba dispar
RSSVYTWEHILIIIPPIFV

SEQ ID NO: 2389811 - protein, 18 aa, Entamoeba dispar
RSTAPISVEDFITYKKSD

SEQ ID NO: 2389812 - protein, 30 aa, Entamoeba dispar
RSTQKCSINVIPLCSRATIDILIGQNENDY

SEQ ID NO: 2389813 - protein, 25 aa, Entamoeba dispar
RSVTRFEVLALIGLIVSAISALGYY

SEQ ID NO: 2389814 - protein, 17 aa, Entamoeba dispar
RSYKIIIRPDLFLKIPS

SEQ ID NO: 2389815 - protein, 27 aa, Entamoeba dispar
RTAGIACGWHYIILYLVAVCLNLPLII

SEQ ID NO: 2389816 - protein, 20 aa, Entamoeba dispar
RTECFICSDGFYLTNNGGEC

SEQ ID NO: 2389817 - protein, 21 aa, Entamoeba dispar
RTFYRSCLYDSLAPGDKQAAC

SEQ ID NO: 2389818 - protein, 20 aa, Entamoeba dispar
RTHHCSVCNQCVVRYDHHCA

SEQ ID NO: 2389819 - protein, 25 aa, Entamoeba dispar
RTHLKGIYETVCFEFIKFWHHALPL

SEQ ID NO: 2389820 - protein, 17 aa, Entamoeba dispar
RTIPFISANSINLNYSN

SEQ ID NO: 2389821 - protein, 26 aa, Entamoeba dispar
RTKPRHIVEMDSLYPFTKFVTSTKED

SEQ ID NO: 2389822 - protein, 19 aa, Entamoeba dispar
RTLFLPRVICLVFNEQIID

SEQ ID NO: 2389823 - protein, 27 aa, Entamoeba dispar
RTLFRMEWGHFLICFIAILISQLSTLV

SEQ ID NO: 2389824 - protein, 28 aa, Entamoeba dispar
RTLFRMEWGHFLICFIAILISQLSTLVI

SEQ ID NO: 2389825 - protein, 19 aa, Entamoeba dispar
RTLLMMTHICIPKMEGRKE

SEQ ID NO: 2389826 - protein, 17 aa, Entamoeba dispar
RTLRVWYIIIISFICQW

SEQ ID NO: 2389827 - protein, 27 aa, Entamoeba dispar
RTMGIRLRFSYCETYKLNYQFNETIPR

SEQ ID NO: 2389828 - protein, 27 aa, Entamoeba dispar
RTNYCNYCIGCCSVSIVFVITCTLLSI

SEQ ID NO: 2389829 - protein, 27 aa, Entamoeba dispar
RTQGCSVVEKYGYIFVFILFFILLLPF

SEQ ID NO: 2389830 - protein, 25 aa, Entamoeba dispar
RTQSSFYSLVAWCMGTTEHLDYFDT

SEQ ID NO: 2389831 - protein, 19 aa, Entamoeba dispar
RTSVVYDYYMKYRLLCHNK

SEQ ID NO: 2389832 - protein, 21 aa, Entamoeba dispar
RTTYEGNHLWKGEYRSKLEEL

SEQ ID NO: 2389833 - protein, 37 aa, Entamoeba dispar
RTTYSNSLVDRWLCLRVDCIGAFVMFGSVIAASLGGA

SEQ ID NO: 2389834 - protein, 24 aa, Entamoeba dispar
RTYQFDCLFPILSNAPNLFFQIKP

SEQ ID NO: 2389835 - protein, 18 aa, Entamoeba dispar
RVCKGTGCEYCEDGYSPS

SEQ ID NO: 2389836 - protein, 23 aa, Entamoeba dispar
RVDNEVLKGISFKAEQGKTIALV

SEQ ID NO: 2389837 - protein, 18 aa, Entamoeba dispar
RVELKCENGISFTCGNVE

SEQ ID NO: 2389838 - protein, 18 aa, Entamoeba dispar
RVFYGDVFELQFNLIFDK

SEQ ID NO: 2389839 - protein, 19 aa, Entamoeba dispar
RVGEGAGIEMLEEGQESSE

SEQ ID NO: 2389840 - protein, 18 aa, Entamoeba dispar
RVIFDVTGSFSFMLCFSL

SEQ ID NO: 2389841 - protein, 20 aa, Entamoeba dispar
RVIFTTALTLTWVFGISTVI

SEQ ID NO: 2389842 - protein, 17 aa, Entamoeba dispar
RVIMPFLILLNIALFIT

SEQ ID NO: 2389843 - protein, 22 aa, Entamoeba dispar
RVIRFSIWYQGDFSIVISTKQE

SEQ ID NO: 2389844 - protein, 30 aa, Entamoeba dispar
RVIRYFCQYDRAFKIVQELLPKQVQLKPEW

SEQ ID NO: 2389845 - protein, 17 aa, Entamoeba dispar
RVISWGAALLARPFTSV

SEQ ID NO: 2389846 - protein, 23 aa, Entamoeba dispar
RVKRIITRILGFREISSISRSLT

SEQ ID NO: 2389847 - protein, 17 aa, Entamoeba dispar
RVLCSSSVYIHPLDYSK

SEQ ID NO: 2389848 - protein, 17 aa, Entamoeba dispar
RVLDGKKGVWVQITAEQ

SEQ ID NO: 2389849 - protein, 18 aa, Entamoeba dispar
RVLLLSPLQRSEIINKEN

SEQ ID NO: 2389850 - protein, 18 aa, Entamoeba dispar
RVLPNVRSIIECFNYCPQ

SEQ ID NO: 2389851 - protein, 26 aa, Entamoeba dispar
RVLSRICFLCGLFGGIKSNQLDNIKK

SEQ ID NO: 2389852 - protein, 20 aa, Entamoeba dispar
RVLYIIPFCIIKPLFDNYSI

SEQ ID NO: 2389853 - protein, 21 aa, Entamoeba dispar
RVPGENEPSCYQVFHDEIYMA

SEQ ID NO: 2389854 - protein, 26 aa, Entamoeba dispar
RVPNCPICKSRVLLEQVIRVNKNKNQ

SEQ ID NO: 2389855 - protein, 24 aa, Entamoeba dispar
RVQDVPSLLTLIGIIYDNETQTSS

SEQ ID NO: 2389856 - protein, 21 aa, Entamoeba dispar
RVSCIKCQPGYSINKDKTKCM

SEQ ID NO: 2389857 - protein, 24 aa, Entamoeba dispar
RVVCINGPCDLTFFMEYTSTSKHD

SEQ ID NO: 2389858 - protein, 27 aa, Entamoeba dispar
RVVGSLKYWIESCLFDNKFLEDIKVFI

SEQ ID NO: 2389859 - protein, 27 aa, Entamoeba dispar
RWFCTFRLKNCFIDLMYAVLSYTSQHT

SEQ ID NO: 2389860 - protein, 19 aa, Entamoeba dispar
RWVAPEILINKPFTLAADV

SEQ ID NO: 2389861 - protein, 18 aa, Entamoeba dispar
RWYCGRYLLDPTNLGSSL

SEQ ID NO: 2389862 - protein, 20 aa, Entamoeba dispar
RYATEPSYWSPLTWICGSIQ

SEQ ID NO: 2389863 - protein, 22 aa, Entamoeba dispar
RYCEIAPVWWLIVIIILLSITL

SEQ ID NO: 2389864 - protein, 17 aa, Entamoeba dispar
RYCHCKREVYQRSYCFC

SEQ ID NO: 2389865 - protein, 23 aa, Entamoeba dispar
RYCQYNRGTCWALATIGLLEQSY

SEQ ID NO: 2389866 - protein, 17 aa, Entamoeba dispar
RYCYVCKCFIPQRCFHC

SEQ ID NO: 2389867 - protein, 24 aa, Entamoeba dispar
RYDIEYKFTLNLEVGIEAIDYENL

SEQ ID NO: 2389868 - protein, 17 aa, Entamoeba dispar
RYGLLLRNYIRHFGDHG

SEQ ID NO: 2389869 - protein, 17 aa, Entamoeba dispar
RYHLKLSNELLGYHKNL

SEQ ID NO: 2389870 - protein, 18 aa, Entamoeba dispar
RYHMSIEVWMNSLGHYFG

SEQ ID NO: 2389871 - protein, 25 aa, Entamoeba dispar
RYHRLYHAYFRFLARYAAENPNLVG

SEQ ID NO: 2389872 - protein, 18 aa, Entamoeba dispar
RYICLSGEALAHIKEECS

SEQ ID NO: 2389873 - protein, 24 aa, Entamoeba dispar
RYIKKPEFICTGVAKDNHSDSKIF

SEQ ID NO: 2389874 - protein, 24 aa, Entamoeba dispar
RYIPKKWKIVQLWNSRIIILMIRT

SEQ ID NO: 2389875 - protein, 19 aa, Entamoeba dispar
RYITLPSAIIITILSVILS

SEQ ID NO: 2389876 - protein, 19 aa, Entamoeba dispar
RYIVYGIAMLICIGLCVLS

SEQ ID NO: 2389877 - protein, 20 aa, Entamoeba dispar
RYKEYKCTFPGCNEPAKTKY

SEQ ID NO: 2389878 - protein, 17 aa, Entamoeba dispar
RYLKKRLLNEINPFEYL

SEQ ID NO: 2389879 - protein, 19 aa, Entamoeba dispar
RYPHFAWMLNFKGKKMTKK

SEQ ID NO: 2389880 - protein, 19 aa, Entamoeba dispar
RYSVLKGLTVGLGLGAVMF

SEQ ID NO: 2389881 - protein, 20 aa, Entamoeba dispar
RYSYESFYRYVKSIFNKTIQ

SEQ ID NO: 2389882 - protein, 20 aa, Entamoeba dispar
RYTGGELFYYPNYNIQNQIK

SEQ ID NO: 2389883 - protein, 19 aa, Entamoeba dispar
RYTQINILYSLIVFSISVI

SEQ ID NO: 2389884 - protein, 25 aa, Entamoeba dispar
RYTVCNWLILLFGWMSFVAFDSCNT

SEQ ID NO: 2389885 - protein, 20 aa, Entamoeba dispar
RYVQCFWSKGQFTDCTCKPE

SEQ ID NO: 2389886 - protein, 18 aa, Entamoeba dispar
RYYLTKDMKCLKCDDKCE

SEQ ID NO: 2389887 - protein, 19 aa, Entamoeba dispar
RYYLTKDMKCLKCDDKCET

SEQ ID NO: 2389888 - protein, 17 aa, Entamoeba dispar
SAASSFYRFILPEDQKV

SEQ ID NO: 2389889 - protein, 30 aa, Entamoeba dispar
SACSWVTKGLKEWGGAIIVGFDGDPNGKDE

SEQ ID NO: 2389890 - protein, 31 aa, Entamoeba dispar
SACSWVTKGLKEWGGAILVGFDGDPNGKDEE

SEQ ID NO: 2389891 - protein, 26 aa, Entamoeba dispar
SADICYECNEGFSLQENSCISVIKSI

SEQ ID NO: 2389892 - protein, 19 aa, Entamoeba dispar
SADVYARYCRMRGYNTLYV

SEQ ID NO: 2389893 - protein, 18 aa, Entamoeba dispar
SAESTLLCYCTPTDSTLT

SEQ ID NO: 2389894 - protein, 24 aa, Entamoeba dispar
SAFFLSKLFWVILGYFIIALAILT

SEQ ID NO: 2389895 - protein, 19 aa, Entamoeba dispar
SAFNCSLCPSECKTCQYSS

SEQ ID NO: 2389896 - protein, 19 aa, Entamoeba dispar
SAFPILSVTVFPLFTKQTL

SEQ ID NO: 2389897 - protein, 18 aa, Entamoeba dispar
SAHALLYFSSLCKEKEEL

SEQ ID NO: 2389898 - protein, 26 aa, Entamoeba dispar
SAHFLRFAPCALVMLFFQLPSFQELF

SEQ ID NO: 2389899 - protein, 17 aa, Entamoeba dispar
SAIELILLISYPILQII

SEQ ID NO: 2389900 - protein, 29 aa, Entamoeba dispar
SAIRKLWPYLPNGIKEWYCTKKLKEWYTK

SEQ ID NO: 2389901 - protein, 19 aa, Entamoeba dispar
SAISLRIPSILKDIFESVG

SEQ ID NO: 2389902 - protein, 22 aa, Entamoeba dispar
SAKDPLLSFAILQKDEISIRNY

SEQ ID NO: 2389903 - protein, 18 aa, Entamoeba dispar
SALFRCALLLISSLSSSN

SEQ ID NO: 2389904 - protein, 19 aa, Entamoeba dispar
SALKLVSLGPHYHEFTGNS

SEQ ID NO: 2389905 - protein, 20 aa, Entamoeba dispar
SAMGCLSVLISEAHKLLLPV

SEQ ID NO: 2389906 - protein, 21 aa, Entamoeba dispar
SAMGVCGLVISLAISTRLIYD

SEQ ID NO: 2389907 - protein, 23 aa, Entamoeba dispar
SANRLLMSVSFCAILGGMNSILG

SEQ ID NO: 2389908 - protein, 25 aa, Entamoeba dispar
SAQYCFKVHLLIVLVVFILAMIYKL

SEQ ID NO: 2389909 - protein, 22 aa, Entamoeba dispar
SARQFCSTINFYVHAANKNLFP

SEQ ID NO: 2389910 - protein, 18 aa, Entamoeba dispar
SASMTFFEFRGVNVLTEY

SEQ ID NO: 2389911 - protein, 20 aa, Entamoeba dispar
SATGLCFSAPNAALDFKAID

SEQ ID NO: 2389912 - protein, 25 aa, Entamoeba dispar
SATIFIFFIICVFIFGICFSIYHYF

SEQ ID NO: 2389913 - protein, 21 aa, Entamoeba dispar
SAYSRTVYNIAVAQKERTARA

SEQ ID NO: 2389914 - protein, 21 aa, Entamoeba dispar
SCALSSLVIQNCQFLFSNNEG

SEQ ID NO: 2389915 - protein, 17 aa, Entamoeba dispar
SCCKSYGIIFARRGQCK

SEQ ID NO: 2389916 - protein, 17 aa, Entamoeba dispar
SCDKRVILLGAEDNESN

SEQ ID NO: 2389917 - protein, 17 aa, Entamoeba dispar
SCDLESFNDLQLIRKIE

SEQ ID NO: 2389918 - protein, 18 aa, Entamoeba dispar
SCEYQCFGKGIKVNEQNN

SEQ ID NO: 2389919 - protein, 25 aa, Entamoeba dispar
SCFIKNDYCTYSFLTYSSFKKLKDI

SEQ ID NO: 2389920 - protein, 23 aa, Entamoeba dispar
SCFLKLIKKVVLWFNLCEEGDEW

SEQ ID NO: 2389921 - protein, 20 aa, Entamoeba dispar
SCGVSALFLIIINKYYRTFN

SEQ ID NO: 2389922 - protein, 18 aa, Entamoeba dispar
SCHSCFDKSSGISKVSCS

SEQ ID NO: 2389923 - protein, 19 aa, Entamoeba dispar
SCIDEWIRCHSFCPLCKVP

SEQ ID NO: 2389924 - protein, 20 aa, Entamoeba dispar
SCIDEWIRCHSFCPLCKVPF

SEQ ID NO: 2389925 - protein, 24 aa, Entamoeba dispar
SCIDNRTRYCWICEKHINSQKGCI

SEQ ID NO: 2389926 - protein, 21 aa, Entamoeba dispar
SCISCSLNHCDGCNSETGICP

SEQ ID NO: 2389927 - protein, 18 aa, Entamoeba dispar
SCITCSDGPLTNNCSSST

SEQ ID NO: 2389928 - protein, 20 aa, Entamoeba dispar
SCKECMKGYVLYNQTDCIKL

SEQ ID NO: 2389929 - protein, 19 aa, Entamoeba dispar
SCKRFYRLNKFSCVRTCKD

SEQ ID NO: 2389930 - protein, 17 aa, Entamoeba dispar
SCLPELCIGILGLIFMK

SEQ ID NO: 2389931 - protein, 19 aa, Entamoeba dispar
SCLTNCALCTEAYNCFQCT

SEQ ID NO: 2389932 - protein, 20 aa, Entamoeba dispar
SCLVSLEFSKMFQMLFMSFD

SEQ ID NO: 2389933 - protein, 23 aa, Entamoeba dispar
SCNTELFHFYSVVFYEKSLNIIT

SEQ ID NO: 2389934 - protein, 18 aa, Entamoeba dispar
SCQHCLWIDPYSNSNKAY

SEQ ID NO: 2389935 - protein, 22 aa, Entamoeba dispar
SCRIGVCRILFVGAHFSANVGP

SEQ ID NO: 2389936 - protein, 20 aa, Entamoeba dispar
SCRSLEIGLFLKIETSSGVV

SEQ ID NO: 2389937 - protein, 25 aa, Entamoeba dispar
SCSKFSITSSSVWGISNIITNSFEF

SEQ ID NO: 2389938 - protein, 20 aa, Entamoeba dispar
SCSLEVIISIVWLFCVVQWS

SEQ ID NO: 2389939 - protein, 28 aa, Entamoeba dispar
SCSNSNKCKLCFDGFVLNGLNCLSYKTI

SEQ ID NO: 2389940 - protein, 25 aa, Entamoeba dispar
SCSQECSLEYPVQVMQTIPVNRYTI

SEQ ID NO: 2389941 - protein, 23 aa, Entamoeba dispar
SCSQSKFIASLPFTQQLMQNHAN

SEQ ID NO: 2389942 - protein, 25 aa, Entamoeba dispar
SCTRCTSSLCLSCIDNYILDFGTCI

SEQ ID NO: 2389943 - protein, 20 aa, Entamoeba dispar
SCTVFCALFLLGGALSNGPR

SEQ ID NO: 2389944 - protein, 20 aa, Entamoeba dispar
SCVIGSLFIFLPSHISKKTL

SEQ ID NO: 2389945 - protein, 17 aa, Entamoeba dispar
SCVIPWLQHNSVCPLCK

SEQ ID NO: 2389946 - protein, 20 aa, Entamoeba dispar
SCVKCTGGICSSKFQECLCE

SEQ ID NO: 2389947 - protein, 26 aa, Entamoeba dispar
SCVPLYRPLTVILFFLITGIIFIPIG

SEQ ID NO: 2389948 - protein, 18 aa, Entamoeba dispar
SCYFDIIEVPFQYIDDTH

SEQ ID NO: 2389949 - protein, 22 aa, Entamoeba dispar
SDAFYSDVIRLIGIINQLVHRI

SEQ ID NO: 2389950 - protein, 18 aa, Entamoeba dispar
SDALRIEKELEEFKQEND

SEQ ID NO: 2389951 - protein, 19 aa, Entamoeba dispar
SDASPVYLTFYYLVNILIN

SEQ ID NO: 2389952 - protein, 20 aa, Entamoeba dispar
SDCGCFSQWVVCTQTSTELR

SEQ ID NO: 2389953 - protein, 26 aa, Entamoeba dispar
SDDCILKEIIEWAWSHTPSERPSFKE

SEQ ID NO: 2389954 - protein, 22 aa, Entamoeba dispar
SDEEMKRVLKLVNSVNELDDVV

SEQ ID NO: 2389955 - protein, 23 aa, Entamoeba dispar
SDEEMKRVLKLVNSVNELDDVVL

SEQ ID NO: 2389956 - protein, 23 aa, Entamoeba dispar
SDEIKYPIVYLLHGMDGDCQSFY

SEQ ID NO: 2389957 - protein, 20 aa, Entamoeba dispar
SDELKYRIIGLIVADIGISF

SEQ ID NO: 2389958 - protein, 18 aa, Entamoeba dispar
SDEMCALVIYTGNDTRLA

SEQ ID NO: 2389959 - protein, 27 aa, Entamoeba dispar
SDERYFKVARDWFLFLMSHDATLFISI

SEQ ID NO: 2389960 - protein, 26 aa, Entamoeba dispar
SDEYFQCFIPFISILIGNIFPSLIPL

SEQ ID NO: 2389961 - protein, 27 aa, Entamoeba dispar
SDFFSTEILNCIGILFNSLQDIDVTPE

SEQ ID NO: 2389962 - protein, 17 aa, Entamoeba dispar
SDFLIPQRMESLTLDIT

SEQ ID NO: 2389963 - protein, 22 aa, Entamoeba dispar
SDHCLSCAKDYYFVKGQTTCIH

SEQ ID NO: 2389964 - protein, 17 aa, Entamoeba dispar
SDHGICFNYIDKINQEE

SEQ ID NO: 2389965 - protein, 17 aa, Entamoeba dispar
SDHRSVSIASNFSSSKF

SEQ ID NO: 2389966 - protein, 20 aa, Entamoeba dispar
SDIFIPFLLIQGINDESVTM

SEQ ID NO: 2389967 - protein, 19 aa, Entamoeba dispar
SDIKYCILFEKQLICYCNN

SEQ ID NO: 2389968 - protein, 17 aa, Entamoeba dispar
SDISLGFNLSLNDSIPW

SEQ ID NO: 2389969 - protein, 25 aa, Entamoeba dispar
SDIYAYGIILWEMISREKPFVGCKF

SEQ ID NO: 2389970 - protein, 19 aa, Entamoeba dispar
SDIYIRTLILFLPLLIVFN

SEQ ID NO: 2389971 - protein, 21 aa, Entamoeba dispar
SDIYRTSILKVLRDEKDTVNN

SEQ ID NO: 2389972 - protein, 20 aa, Entamoeba dispar
  misc_feature (20)..(20): Xaa can be any naturally occurring amino acid
SDKLLMSDFWDCCEVNSLEX

SEQ ID NO: 2389973 - protein, 20 aa, Entamoeba dispar
SDNNIYCTFFKSFDTKETTT

SEQ ID NO: 2389974 - protein, 25 aa, Entamoeba dispar
SDPLRFSFNCSFLETFRHNYNYDES

SEQ ID NO: 2389975 - protein, 18 aa, Entamoeba dispar
SDRCYNCSKGMYQDEKGQ

SEQ ID NO: 2389976 - protein, 20 aa, Entamoeba dispar
SDRFKQFLINGLLETLIGFT

SEQ ID NO: 2389977 - protein, 20 aa, Entamoeba dispar
SDRSKLMFFTLFRSGGAAIL

SEQ ID NO: 2389978 - protein, 23 aa, Entamoeba dispar
SDSDFKYGFPMVVVGTKSDLVSE

SEQ ID NO: 2389979 - protein, 20 aa, Entamoeba dispar
SDSFFGKKFIFVARTQNGEW

SEQ ID NO: 2389980 - protein, 19 aa, Entamoeba dispar
SDSLWKKEQGPIILLSFLV

SEQ ID NO: 2389981 - protein, 27 aa, Entamoeba dispar
SDVFSFAICMLEIWLTHDPYPIIEFHD

SEQ ID NO: 2389982 - protein, 28 aa, Entamoeba dispar
SDVYSFAICMLEIWLGRDPYDPAKFPDS

SEQ ID NO: 2389983 - protein, 30 aa, Entamoeba dispar
SDVYSFAICMLEIWLGRDPYDPIKFPDSES

SEQ ID NO: 2389984 - protein, 28 aa, Entamoeba dispar
SDVYSFAICMLEIWLGRDPYNPTKFPDS

SEQ ID NO: 2389985 - protein, 26 aa, Entamoeba dispar
SDVYSFAICMLEIWNNGSLYDEQHFP

SEQ ID NO: 2389986 - protein, 28 aa, Entamoeba dispar
SDYCPKKFPGCISCTKDRCTKCSSGRVN

SEQ ID NO: 2389987 - protein, 23 aa, Entamoeba dispar
SDYKDQFPISGIFEIHQHVDKTN

SEQ ID NO: 2389988 - protein, 18 aa, Entamoeba dispar
SDYRMIGINYEFVKNILI

SEQ ID NO: 2389989 - protein, 24 aa, Entamoeba dispar
SEAVLSVENCFDRLESKTPYSYGF

SEQ ID NO: 2389990 - protein, 21 aa, Entamoeba dispar
SECFKCNLVNFAIFQMYQDNS

SEQ ID NO: 2389991 - protein, 18 aa, Entamoeba dispar
SECKICRYLTKEDGECIA

SEQ ID NO: 2389992 - protein, 18 aa, Entamoeba dispar
SECKTCQYSSVNQMPICT

SEQ ID NO: 2389993 - protein, 24 aa, Entamoeba dispar
SEDSIGIGINGIFGIGMRFIINSW

SEQ ID NO: 2389994 - protein, 22 aa, Entamoeba dispar
SEDYGVCSPGFAISSPSYYISK

SEQ ID NO: 2389995 - protein, 23 aa, Entamoeba dispar
SEECKHPVILEIGEEGIVSHSKI

SEQ ID NO: 2389996 - protein, 24 aa, Entamoeba dispar
SEEEVKTLLTWIRNLASLNVVEKV

SEQ ID NO: 2389997 - protein, 33 aa, Entamoeba dispar
SEEKEYLIHLNCMKFIVDKCIKNEFTQGFSYDL

SEQ ID NO: 2389998 - protein, 25 aa, Entamoeba dispar
SEELCFRGVFQFCSEHLYSTETATW

SEQ ID NO: 2389999 - protein, 27 aa, Entamoeba dispar
SEELDWRYSRSAGMLFGVIVTIVAIIS

SEQ ID NO: 2390000 - protein, 28 aa, Entamoeba dispar
SEFLSFLNFCFHFRTFFFLGYSGCYFVF

SEQ ID NO: 2390001 - protein, 19 aa, Entamoeba dispar
SEFYARWFNVDTMDVLKRM

SEQ ID NO: 2390002 - protein, 18 aa, Entamoeba dispar
SEGLGIWIQKLLAPNYDA

SEQ ID NO: 2390003 - protein, 17 aa, Entamoeba dispar
SEGQCSYILQKCEDVSF

SEQ ID NO: 2390004 - protein, 28 aa, Entamoeba dispar
SEGYFGYPVCMPHIFGKMIDLEYEFNIS

SEQ ID NO: 2390005 - protein, 18 aa, Entamoeba dispar
SEIIRLYDNIRFINEEVG

SEQ ID NO: 2390006 - protein, 24 aa, Entamoeba dispar
SEILKLDLNGGWGDQWNQMQMDNK

SEQ ID NO: 2390007 - protein, 20 aa, Entamoeba dispar
SEIMKYFYIFLGISGAMFIS

SEQ ID NO: 2390008 - protein, 32 aa, Entamoeba dispar
SEKASYAFDFCFKWINKLKWIIIVFWIIVALG

SEQ ID NO: 2390009 - protein, 25 aa, Entamoeba dispar
SEKEIKKLIEWAKKLKLIDKEEINK

SEQ ID NO: 2390010 - protein, 20 aa, Entamoeba dispar
SEKFLGIPPLSTFILNKASA

SEQ ID NO: 2390011 - protein, 22 aa, Entamoeba dispar
SEKHPIIGLFFFLGFIFPLIWL

SEQ ID NO: 2390012 - protein, 19 aa, Entamoeba dispar
SEKQVRCGDYYRTTKDDVQ

SEQ ID NO: 2390013 - protein, 31 aa, Entamoeba dispar
SELELKLALSGMSSFTPRILIYRKLPLFNIP

SEQ ID NO: 2390014 - protein, 20 aa, Entamoeba dispar
SELIKTYYSIHPKIRSFIYY

SEQ ID NO: 2390015 - protein, 21 aa, Entamoeba dispar
SELKKAAFVVLCGDCYTFDKI

SEQ ID NO: 2390016 - protein, 24 aa, Entamoeba dispar
SENEIESLIKWGSELTPINIDIIE

SEQ ID NO: 2390017 - protein, 23 aa, Entamoeba dispar
SENEIKSLIEWSRELKQNPFCFE

SEQ ID NO: 2390018 - protein, 22 aa, Entamoeba dispar
SENEKLRLNSMFEENLKEEKSI

SEQ ID NO: 2390019 - protein, 26 aa, Entamoeba dispar
SEPFPKQSFKFAWDVAEFIESGNHLP

SEQ ID NO: 2390020 - protein, 37 aa, Entamoeba dispar
SEPFSLLCFTGLYIPSSDGLVSWIYYHHKLHNPYFPI

SEQ ID NO: 2390021 - protein, 21 aa, Entamoeba dispar
SEPLLYQICVDPSYCNPSYCN

SEQ ID NO: 2390022 - protein, 19 aa, Entamoeba dispar
SESDYALTQGRLSLQPLSK

SEQ ID NO: 2390023 - protein, 20 aa, Entamoeba dispar
SESFLKWFHGFGMGRGLLSI

SEQ ID NO: 2390024 - protein, 19 aa, Entamoeba dispar
SESILRFVGAGKRLDISDD

SEQ ID NO: 2390025 - protein, 20 aa, Entamoeba dispar
SESIVSLFIGVIVGLVLLVL

SEQ ID NO: 2390026 - protein, 22 aa, Entamoeba dispar
SESVNPFLFRIGFTSVSPNART

SEQ ID NO: 2390027 - protein, 27 aa, Entamoeba dispar
SESWIKFTGLCYKNGKYKLAMKTLDRL

SEQ ID NO: 2390028 - protein, 20 aa, Entamoeba dispar
SETASDVWSSPTCPCTGNGC

SEQ ID NO: 2390029 - protein, 21 aa, Entamoeba dispar
SETCLSCKNGYYFDGDICKKV

SEQ ID NO: 2390030 - protein, 20 aa, Entamoeba dispar
SETDFAEGIYHGKFIFPYDY

SEQ ID NO: 2390031 - protein, 17 aa, Entamoeba dispar
SETFIYDPIRVTRNDIV

SEQ ID NO: 2390032 - protein, 18 aa, Entamoeba dispar
SETLRIIKKHSIALSTES

SEQ ID NO: 2390033 - protein, 18 aa, Entamoeba dispar
SETRFVFCRFLDRLKTNH

SEQ ID NO: 2390034 - protein, 17 aa, Entamoeba dispar
SEVDIYIVFGLLISLVS

SEQ ID NO: 2390035 - protein, 22 aa, Entamoeba dispar
SEVFELPHGISYKRRNATMGIT

SEQ ID NO: 2390036 - protein, 25 aa, Entamoeba dispar
SEVITCPPDVLGFTFVALFLSIRHI

SEQ ID NO: 2390037 - protein, 25 aa, Entamoeba dispar
SEVSMKLRIKFMLDSIKGIEYLHSN

SEQ ID NO: 2390038 - protein, 21 aa, Entamoeba dispar
SEYILSPRIVTWMNAGATQYI

SEQ ID NO: 2390039 - protein, 20 aa, Entamoeba dispar
SEYKYTYVLHYTASSSNGNA

SEQ ID NO: 2390040 - protein, 19 aa, Entamoeba dispar
SEYRWCSEMQRQLNIKLLE

SEQ ID NO: 2390041 - protein, 18 aa, Entamoeba dispar
SFAISFFLFYILIIFDSL

SEQ ID NO: 2390042 - protein, 20 aa, Entamoeba dispar
SFDFMKRNIHLYLRNRCSPL

SEQ ID NO: 2390043 - protein, 22 aa, Entamoeba dispar
SFDPLAYCVSLIPLLSAALVYC

SEQ ID NO: 2390044 - protein, 26 aa, Entamoeba dispar
SFEVYMMIGLVWSCLGDFMLEYSSSQ

SEQ ID NO: 2390045 - protein, 21 aa, Entamoeba dispar
SFFCYGALWAYSSVFSSSVTM

SEQ ID NO: 2390046 - protein, 25 aa, Entamoeba dispar
SFFIKLPQWISFLLQDDSYKNVIEN

SEQ ID NO: 2390047 - protein, 18 aa, Entamoeba dispar
SFFLIIVIGCYYILTQEI

SEQ ID NO: 2390048 - protein, 19 aa, Entamoeba dispar
SFFLYFSFSFLIYLISLSS

SEQ ID NO: 2390049 - protein, 19 aa, Entamoeba dispar
SFFPWLIKDKWDNLNEIKQ

SEQ ID NO: 2390050 - protein, 20 aa, Entamoeba dispar
SFFREGFISEIMVWIHNFLT

SEQ ID NO: 2390051 - protein, 25 aa, Entamoeba dispar
SFFREYICLVDKFSLNLLYPSISCK

SEQ ID NO: 2390052 - protein, 25 aa, Entamoeba dispar
SFFSRKRAALFVVVIFIGALIMLNN

SEQ ID NO: 2390053 - protein, 27 aa, Entamoeba dispar
SFFYLFCYGEQCVCTLKKPFMNDKASY

SEQ ID NO: 2390054 - protein, 20 aa, Entamoeba dispar
SFGIIMWEFLTRDVPYKNLP

SEQ ID NO: 2390055 - protein, 17 aa, Entamoeba dispar
SFGIVMWEILTRKRPYS

SEQ ID NO: 2390056 - protein, 18 aa, Entamoeba dispar
SFGLALWGGYIGIALIAS

SEQ ID NO: 2390057 - protein, 23 aa, Entamoeba dispar
SFHPETWTPVWSISSMLEAIRAF

SEQ ID NO: 2390058 - protein, 19 aa, Entamoeba dispar
SFHRARTLLITKVLELNKK

SEQ ID NO: 2390059 - protein, 26 aa, Entamoeba dispar
SFIITCCLICISLYYLKKPKLYFRGC

SEQ ID NO: 2390060 - protein, 26 aa, Entamoeba dispar
SFILLICFILKWSVLYISSLLINIRI

SEQ ID NO: 2390061 - protein, 20 aa, Entamoeba dispar
SFIPNKICVNDIIGRGSMHL

SEQ ID NO: 2390062 - protein, 20 aa, Entamoeba dispar
SFISSLLFLYSLLLFFYFFI

SEQ ID NO: 2390063 - protein, 18 aa, Entamoeba dispar
SFISYCFAFFSISFIVKF

SEQ ID NO: 2390064 - protein, 17 aa, Entamoeba dispar
SFITLMSPFVWQHVLIP

SEQ ID NO: 2390065 - protein, 25 aa, Entamoeba dispar
SFIVNVCLCLIKIVAAVMSGSLTVI

SEQ ID NO: 2390066 - protein, 21 aa, Entamoeba dispar
SFKFCSFKGYNILINGSLFCE

SEQ ID NO: 2390067 - protein, 22 aa, Entamoeba dispar
SFKQRDCNLLNIYEASYFSLVT

SEQ ID NO: 2390068 - protein, 22 aa, Entamoeba dispar
SFKSNIPREFIKGRSNERVALY

SEQ ID NO: 2390069 - protein, 19 aa, Entamoeba dispar
SFKTYAWVEMSMFLKNLKI

SEQ ID NO: 2390070 - protein, 24 aa, Entamoeba dispar
SFLCIFEMVIALCMYFFTKDDFIE

SEQ ID NO: 2390071 - protein, 28 aa, Entamoeba dispar
SFLIIKMIWFIILKRLQDWTVNSSSQFN

SEQ ID NO: 2390072 - protein, 29 aa, Entamoeba dispar
SFLKCSNIFCGWSCTYERGIDNFYNGVFF

SEQ ID NO: 2390073 - protein, 27 aa, Entamoeba dispar
SFLNQEIWSSICGRNNIMIVIKDWNGN

SEQ ID NO: 2390074 - protein, 17 aa, Entamoeba dispar
SFLNSFSLFKVFQYFSN

SEQ ID NO: 2390075 - protein, 24 aa, Entamoeba dispar
SFLSILCIAAIIGMGIYKFLRFEK

SEQ ID NO: 2390076 - protein, 19 aa, Entamoeba dispar
SFLVGLIWCLCKEGKHKKA

SEQ ID NO: 2390077 - protein, 18 aa, Entamoeba dispar
SFMFHLHLLLFCGCFILK

SEQ ID NO: 2390078 - protein, 26 aa, Entamoeba dispar
SFMLCFSLPCIFHYLSRRKVIAKFNK

SEQ ID NO: 2390079 - protein, 18 aa, Entamoeba dispar
SFMYICTYVYIYIFIYVY

SEQ ID NO: 2390080 - protein, 26 aa, Entamoeba dispar
SFNDFKGCFKFNGENTIALDSKNLLL

SEQ ID NO: 2390081 - protein, 25 aa, Entamoeba dispar
SFNESRISIGLTIIYSMGGMLGNLF

SEQ ID NO: 2390082 - protein, 22 aa, Entamoeba dispar
SFNGYFKRKWFETNKLKWYKYN

SEQ ID NO: 2390083 - protein, 18 aa, Entamoeba dispar
SFNKLKKKMPTILNELIT

SEQ ID NO: 2390084 - protein, 17 aa, Entamoeba dispar
SFNPIVLSFSVEVIDKF

SEQ ID NO: 2390085 - protein, 32 aa, Entamoeba dispar
SFPIKDFWKHVCIVWTKCYCHFSKKKLEKAKK

SEQ ID NO: 2390086 - protein, 23 aa, Entamoeba dispar
SFPMVSCFMYLPSSSTDRINKIP

SEQ ID NO: 2390087 - protein, 24 aa, Entamoeba dispar
SFPNFPQRDYYLLFDYFSSFSQPI

SEQ ID NO: 2390088 - protein, 24 aa, Entamoeba dispar
SFPSFEYLHSLALGVERDEQVKFF

SEQ ID NO: 2390089 - protein, 24 aa, Entamoeba dispar
SFPTPEQIFLNGLRNYFYTPLVSQ

SEQ ID NO: 2390090 - protein, 26 aa, Entamoeba dispar
SFSFIPLKISHDFTVEGFLSIQYSLQ

SEQ ID NO: 2390091 - protein, 26 aa, Entamoeba dispar
SFSIVFWELFYGVHAFSDLKTTYEIK

SEQ ID NO: 2390092 - protein, 20 aa, Entamoeba dispar
SFSKECSCNTFMSLSSECTS

SEQ ID NO: 2390093 - protein, 28 aa, Entamoeba dispar
SFSKNSICLKCPQGMMIDNDHTRCSTSC

SEQ ID NO: 2390094 - protein, 21 aa, Entamoeba dispar
SFTEFNKVYSFIIKNQSLQTI

SEQ ID NO: 2390095 - protein, 23 aa, Entamoeba dispar
SFTNDCIYQFSSYYIGGAGVNDG

SEQ ID NO: 2390096 - protein, 26 aa, Entamoeba dispar
SFTQKFPFNAHFTFFVMAVVPLINFL

SEQ ID NO: 2390097 - protein, 19 aa, Entamoeba dispar
SFVAYKLSSSKSRVVSPNN

SEQ ID NO: 2390098 - protein, 19 aa, Entamoeba dispar
SFVMTRLLLGPILVEAIRI

SEQ ID NO: 2390099 - protein, 17 aa, Entamoeba dispar
SFWYSIQLSESLDVIAS

SEQ ID NO: 2390100 - protein, 18 aa, Entamoeba dispar
SFYAICRQDIGWFDKKEN

SEQ ID NO: 2390101 - protein, 26 aa, Entamoeba dispar
SFYCKSICGTSIYTKSFIPHLFSLSA

SEQ ID NO: 2390102 - protein, 18 aa, Entamoeba dispar
SFYIALACLITIEIIYPI

SEQ ID NO: 2390103 - protein, 22 aa, Entamoeba dispar
SGAILSYIMCKAMNRSFMSVIF

SEQ ID NO: 2390104 - protein, 21 aa, Entamoeba dispar
SGAINSCLWELTLLQIHHNPQ

SEQ ID NO: 2390105 - protein, 25 aa, Entamoeba dispar
SGCELNCSCAFGWKRDYKGGCVPSS

SEQ ID NO: 2390106 - protein, 17 aa, Entamoeba dispar
SGCGICHKGYYRNGKGC

SEQ ID NO: 2390107 - protein, 22 aa, Entamoeba dispar
SGCGKDCLCKKGYTANGNGTCV

SEQ ID NO: 2390108 - protein, 21 aa, Entamoeba dispar
SGCGSNSRLARLVQKIDSQHI

SEQ ID NO: 2390109 - protein, 19 aa, Entamoeba dispar
SGCTSCYSHFYLKDGECHP

SEQ ID NO: 2390110 - protein, 24 aa, Entamoeba dispar
SGDKKRLVILLVLIIVVIFLIFII

SEQ ID NO: 2390111 - protein, 19 aa, Entamoeba dispar
SGEKVKVVMTFNVTNSLLR

SEQ ID NO: 2390112 - protein, 19 aa, Entamoeba dispar
SGERFKAIYPIELLSIELN

SEQ ID NO: 2390113 - protein, 19 aa, Entamoeba dispar
SGESKIEIFDSCSQSTCIQ

SEQ ID NO: 2390114 - protein, 23 aa, Entamoeba dispar
SGEYKCEMGYEVYDYSSMAQMWG

SEQ ID NO: 2390115 - protein, 17 aa, Entamoeba dispar
SGFKISYEGGPLPWYLN

SEQ ID NO: 2390116 - protein, 23 aa, Entamoeba dispar
SGGEIFGIIVAVLFLVVILLVVG

SEQ ID NO: 2390117 - protein, 22 aa, Entamoeba dispar
SGGEINWFYSFPGLYNQILPDS

SEQ ID NO: 2390118 - protein, 23 aa, Entamoeba dispar
SGGMKRRLSVAIACIANPKCIIL

SEQ ID NO: 2390119 - protein, 25 aa, Entamoeba dispar
SGGMRRRLSIAIAMTGNPKVIFLDE

SEQ ID NO: 2390120 - protein, 21 aa, Entamoeba dispar
SGHAFQFSDIQFNAGFIGIPF

SEQ ID NO: 2390121 - protein, 22 aa, Entamoeba dispar
SGICAMVFLIIGLVFTFICALF

SEQ ID NO: 2390122 - protein, 25 aa, Entamoeba dispar
SGIGCNWIVCCAVYLSASAKDLLSK

SEQ ID NO: 2390123 - protein, 30 aa, Entamoeba dispar
SGIITILSWRGTILYFKSIIIPDSFNAVEK

SEQ ID NO: 2390124 - protein, 29 aa, Entamoeba dispar
SGIKNCYECTIIGCEWCNNQCSLSFSDCS

SEQ ID NO: 2390125 - protein, 22 aa, Entamoeba dispar
SGILCCLNYWTLFGGLIELCGG

SEQ ID NO: 2390126 - protein, 19 aa, Entamoeba dispar
SGIVMKYAILPFAFVSVIY

SEQ ID NO: 2390127 - protein, 18 aa, Entamoeba dispar
SGKLKIGIEYNNSKELLI

SEQ ID NO: 2390128 - protein, 20 aa, Entamoeba dispar
SGKSSFLLSILGELEQSKGE

SEQ ID NO: 2390129 - protein, 25 aa, Entamoeba dispar
SGLKGQIPKKCRRSIGKTDEIDSNL

SEQ ID NO: 2390130 - protein, 20 aa, Entamoeba dispar
SGLQIRAGYNILSSKRILMI

SEQ ID NO: 2390131 - protein, 20 aa, Entamoeba dispar
SGNCKPCPSNCLVCDNNTCI

SEQ ID NO: 2390132 - protein, 21 aa, Entamoeba dispar
SGNDFIIFPPFIHQIDNIQIT

SEQ ID NO: 2390133 - protein, 17 aa, Entamoeba dispar
SGNIIPIAMSLFIVIAF

SEQ ID NO: 2390134 - protein, 33 aa, Entamoeba dispar
SGNIKLVGINVFNELILEGSIIKSDTSFDIDKV

SEQ ID NO: 2390135 - protein, 19 aa, Entamoeba dispar
SGNLKRVLVEKAIAQYNTT

SEQ ID NO: 2390136 - protein, 23 aa, Entamoeba dispar
SGPPLNFYHVHFALSSGMKEDNR

SEQ ID NO: 2390137 - protein, 17 aa, Entamoeba dispar
SGRRKHVTYGLAIGYPF

SEQ ID NO: 2390138 - protein, 24 aa, Entamoeba dispar
SGSCSDASSLHCLQGSPIFGCTEC

SEQ ID NO: 2390139 - protein, 21 aa, Entamoeba dispar
SGSMIKYIPELFKILKGKDSI

SEQ ID NO: 2390140 - protein, 26 aa, Entamoeba dispar
SGSPIKAALCALAYYYMALSWGAYVF

SEQ ID NO: 2390141 - protein, 24 aa, Entamoeba dispar
SGSTRLYSIFSYYLIIHHLVLFFL

SEQ ID NO: 2390142 - protein, 25 aa, Entamoeba dispar
SGTFGIVYRAEWRGVDVAVKLMKTD

SEQ ID NO: 2390143 - protein, 20 aa, Entamoeba dispar
SGTFLEYIKEQGFDNVFREW

SEQ ID NO: 2390144 - protein, 29 aa, Entamoeba dispar
SGTKILIYCGVGFAKIGVYGSHFLTHGYA

SEQ ID NO: 2390145 - protein, 31 aa, Entamoeba dispar
SGTKQLLCIARECLRDSKIICIDEATSSVDY

SEQ ID NO: 2390146 - protein, 24 aa, Entamoeba dispar
SGTWDILMDWGLMRKKYNFLRKKT

SEQ ID NO: 2390147 - protein, 18 aa, Entamoeba dispar
SGVARFSLYYDQKATDSS

SEQ ID NO: 2390148 - protein, 24 aa, Entamoeba dispar
SGYPIRIEEILSYGIILTSKNSND

SEQ ID NO: 2390149 - protein, 19 aa, Entamoeba dispar
SGYSPRFELLESYEGNAVG

SEQ ID NO: 2390150 - protein, 23 aa, Entamoeba dispar
SHCIECKCGYYLNLNTKTCEEFK

SEQ ID NO: 2390151 - protein, 25 aa, Entamoeba dispar
SHDSWKMLIVLLPFIIAGTVAISRT

SEQ ID NO: 2390152 - protein, 24 aa, Entamoeba dispar
SHELPRYGVKLGLTNYAAAYCTGL

SEQ ID NO: 2390153 - protein, 23 aa, Entamoeba dispar
SHFFDIFFDFLFTHMSITKSQHI

SEQ ID NO: 2390154 - protein, 18 aa, Entamoeba dispar
SHFHCSKNIFSETLISNF

SEQ ID NO: 2390155 - protein, 17 aa, Entamoeba dispar
SHFKSVIILPHQLGNLI

SEQ ID NO: 2390156 - protein, 24 aa, Entamoeba dispar
SHGFLHLVMKCISITQAIYIVLYI

SEQ ID NO: 2390157 - protein, 21 aa, Entamoeba dispar
SHGLDFIPWLQVHDNSLDEQH

SEQ ID NO: 2390158 - protein, 23 aa, Entamoeba dispar
SHHPLELILTIVIVIPLIYKKLD

SEQ ID NO: 2390159 - protein, 22 aa, Entamoeba dispar
SHITRLLLWHGRNSYIRSSDLA

SEQ ID NO: 2390160 - protein, 17 aa, Entamoeba dispar
SHKCIDGNTLIQINSPS

SEQ ID NO: 2390161 - protein, 21 aa, Entamoeba dispar
SHKCKKCELGSFFNRETKKCE

SEQ ID NO: 2390162 - protein, 24 aa, Entamoeba dispar
SHKIFDLFWFFLGLVEKSIVAYLQ

SEQ ID NO: 2390163 - protein, 17 aa, Entamoeba dispar
SHLIPRVNRLCCCNVPV

SEQ ID NO: 2390164 - protein, 18 aa, Entamoeba dispar
SHLYSLADFFLVDVDQRV

SEQ ID NO: 2390165 - protein, 24 aa, Entamoeba dispar
SHNIVLFCYSRTTNLLSINPLLLD

SEQ ID NO: 2390166 - protein, 26 aa, Entamoeba dispar
SHNQMKEYIQLFLPIILLMGKTALPQ

SEQ ID NO: 2390167 - protein, 25 aa, Entamoeba dispar
SHNYIMKINHSFFSWNSLIELNLRD

SEQ ID NO: 2390168 - protein, 20 aa, Entamoeba dispar
SHQCKLIIPSLSSLAKIDIE

SEQ ID NO: 2390169 - protein, 22 aa, Entamoeba dispar
SHQHVSHFFTFFFASQIIGLTR

SEQ ID NO: 2390170 - protein, 24 aa, Entamoeba dispar
SHRCSPCKTDYCFDCTSNRCNECI

SEQ ID NO: 2390171 - protein, 30 aa, Entamoeba dispar
SHSKHPSLFLVIFKLEWKMFLLCYITIVTY

SEQ ID NO: 2390172 - protein, 17 aa, Entamoeba dispar
SHSTICIYILNIIGDLT

SEQ ID NO: 2390173 - protein, 25 aa, Entamoeba dispar
SHTIKVCTCFMTLHCTTKIFGLKIH

SEQ ID NO: 2390174 - protein, 25 aa, Entamoeba dispar
SHTNSRFNRFVAIALIFDFIIILAS

SEQ ID NO: 2390175 - protein, 19 aa, Entamoeba dispar
SHYIFWFILGNIMYFLVTY

SEQ ID NO: 2390176 - protein, 23 aa, Entamoeba dispar
SIACQCHILFFSAIILVGITIIF

SEQ ID NO: 2390177 - protein, 19 aa, Entamoeba dispar
SIALSRIIDIFGILLILIV

SEQ ID NO: 2390178 - protein, 17 aa, Entamoeba dispar
SIASVVFSLHFTLHVAV

SEQ ID NO: 2390179 - protein, 18 aa, Entamoeba dispar
SICDFLGTYMMNFGLLYI

SEQ ID NO: 2390180 - protein, 27 aa, Entamoeba dispar
SICIVGYCVFPIFIGAIITTVATICWS

SEQ ID NO: 2390181 - protein, 17 aa, Entamoeba dispar
SICIYICAFSLIMFILI

SEQ ID NO: 2390182 - protein, 20 aa, Entamoeba dispar
SICSKDLIKGFWFRIKGAEQ

SEQ ID NO: 2390183 - protein, 25 aa, Entamoeba dispar
SICTGEICFHYTFIISAGMVVCSFI

SEQ ID NO: 2390184 - protein, 22 aa, Entamoeba dispar
SICTNCSFGYYLDEGSCIECSN

SEQ ID NO: 2390185 - protein, 18 aa, Entamoeba dispar
SIDDCLCLILSTLTPPFS

SEQ ID NO: 2390186 - protein, 20 aa, Entamoeba dispar
SIDGTCIFKGIVHIEKSDVL

SEQ ID NO: 2390187 - protein, 21 aa, Entamoeba dispar
SIDSLVCIEKMMRVMVNRGYS

SEQ ID NO: 2390188 - protein, 21 aa, Entamoeba dispar
SIECKICPIGSISNREGSKEC

SEQ ID NO: 2390189 - protein, 23 aa, Entamoeba dispar
SIEIKEKPYYIGYISFVEDDDQC

SEQ ID NO: 2390190 - protein, 32 aa, Entamoeba dispar
SIELYFLDLNLMFWIAISMTIALIILGIIMLV

SEQ ID NO: 2390191 - protein, 25 aa, Entamoeba dispar
SIESSFIIPCITRLSTIDNELNVDL

SEQ ID NO: 2390192 - protein, 24 aa, Entamoeba dispar
SIEYEILNVFPFSSSTKRMGIIVR

SEQ ID NO: 2390193 - protein, 23 aa, Entamoeba dispar
SIFFNLILPYSFKYFLYHQLFNE

SEQ ID NO: 2390194 - protein, 19 aa, Entamoeba dispar
SIFIFGIVIILSFISKFSP

SEQ ID NO: 2390195 - protein, 17 aa, Entamoeba dispar
SIFIRIFLLSALYFFFP

SEQ ID NO: 2390196 - protein, 17 aa, Entamoeba dispar
SIFPQLVYYVFKPKDRV

SEQ ID NO: 2390197 - protein, 28 aa, Entamoeba dispar
SIFPSLSVAIFPCFTKKTLLKISNFLSY

SEQ ID NO: 2390198 - protein, 17 aa, Entamoeba dispar
SIFSAKIYLIYFWSLCK

SEQ ID NO: 2390199 - protein, 23 aa, Entamoeba dispar
SIGLKCPPALNPEWGDISHSIQQ

SEQ ID NO: 2390200 - protein, 25 aa, Entamoeba dispar
SIGPMCGIILMYLLPFFVQFPMCLF

SEQ ID NO: 2390201 - protein, 18 aa, Entamoeba dispar
SIGYKNCNIMIYKQEIQE

SEQ ID NO: 2390202 - protein, 18 aa, Entamoeba dispar
SIGYKNCNMMIYKEIQEC

SEQ ID NO: 2390203 - protein, 19 aa, Entamoeba dispar
SIHIPTVLLLLSISCSIGY

SEQ ID NO: 2390204 - protein, 27 aa, Entamoeba dispar
SIHQIMRFLLMISYVYPSLVFTDGPFF

SEQ ID NO: 2390205 - protein, 24 aa, Entamoeba dispar
SIIFTCLLVISFVVALLLIITYFT

SEQ ID NO: 2390206 - protein, 17 aa, Entamoeba dispar
SIIFVSILFDYSPFFRR

SEQ ID NO: 2390207 - protein, 23 aa, Entamoeba dispar
SIIIEFLNAYILFSSLYTLIIIS

SEQ ID NO: 2390208 - protein, 24 aa, Entamoeba dispar
SIIKSFFPMNSMSPNLLDKVYSSV

SEQ ID NO: 2390209 - protein, 31 aa, Entamoeba dispar
SIIQFIQNCLLRIILFVCGIYSIQIKDKSTN

SEQ ID NO: 2390210 - protein, 24 aa, Entamoeba dispar
SIITLCLVSLCILFTLCALAFWFN

SEQ ID NO: 2390211 - protein, 39 aa, Entamoeba dispar
SIIVLRPTFEPSFVFSLGFWWRVAIITLINSFPFILKFI

SEQ ID NO: 2390212 - protein, 20 aa, Entamoeba dispar
SIIVSKMCQCFILQNQTNEI

SEQ ID NO: 2390213 - protein, 18 aa, Entamoeba dispar
SIIYQLLNSLSWKYITQL

SEQ ID NO: 2390214 - protein, 22 aa, Entamoeba dispar
SIKELIKLDAFNELNLVTRNPT

SEQ ID NO: 2390215 - protein, 19 aa, Entamoeba dispar
SIKLSDISLGFNLSLNDSI

SEQ ID NO: 2390216 - protein, 19 aa, Entamoeba dispar
SIKQHGWINVEGVFSKEEP

SEQ ID NO: 2390217 - protein, 22 aa, Entamoeba dispar
SILEVLKILLVNYIQQSELKDN

SEQ ID NO: 2390218 - protein, 26 aa, Entamoeba dispar
SILFDIYSLWQGHRFPFKHITLTSPK

SEQ ID NO: 2390219 - protein, 35 aa, Entamoeba dispar
SILFDYSPFFRRLMSLLLLSQVFIKLHFITVVNQK

SEQ ID NO: 2390220 - protein, 27 aa, Entamoeba dispar
SILFVLGFFVCLTWPACYCIYKNSSDS

SEQ ID NO: 2390221 - protein, 17 aa, Entamoeba dispar
SILHLLQSLYFYGDELK

SEQ ID NO: 2390222 - protein, 23 aa, Entamoeba dispar
SILNCCRIVFLTSKFQIENTYHC

SEQ ID NO: 2390223 - protein, 20 aa, Entamoeba dispar
SILQLLSAIFKRNEILRSQC

SEQ ID NO: 2390224 - protein, 24 aa, Entamoeba dispar
SILTELKVSFGQYNVDSIPHVCYT

SEQ ID NO: 2390225 - protein, 21 aa, Entamoeba dispar
SILTIICLFVSITSLILAIEG

SEQ ID NO: 2390226 - protein, 20 aa, Entamoeba dispar
SILYKNGMLMKIFKENNKIN

SEQ ID NO: 2390227 - protein, 19 aa, Entamoeba dispar
SIMIKRKEKGLIINMSSAT

SEQ ID NO: 2390228 - protein, 21 aa, Entamoeba dispar
SIMLCSLLLYVLVVMDALRKP

SEQ ID NO: 2390229 - protein, 31 aa, Entamoeba dispar
SINCKYIPFIIPMILEFVLVLSFVLNPVIGC

SEQ ID NO: 2390230 - protein, 23 aa, Entamoeba dispar
SINGMYLYFMVNWTTTINRKNKQ

SEQ ID NO: 2390231 - protein, 24 aa, Entamoeba dispar
SINKFCSFEWWCQAIESGKNLCSY

SEQ ID NO: 2390232 - protein, 25 aa, Entamoeba dispar
SINSCGYCRSSTLSFCGICGDYFTK

SEQ ID NO: 2390233 - protein, 23 aa, Entamoeba dispar
SIPKHFRFNRYIPYKTFDLTNTT

SEQ ID NO: 2390234 - protein, 19 aa, Entamoeba dispar
SIPKLSYQCIGSELLESIL

SEQ ID NO: 2390235 - protein, 24 aa, Entamoeba dispar
SIPLRTIIWILFYAPFKFFYLAVQ

SEQ ID NO: 2390236 - protein, 24 aa, Entamoeba dispar
SIQEFRIDIILNHILFTGTLGVLS

SEQ ID NO: 2390237 - protein, 23 aa, Entamoeba dispar
SISESIVSLSLLKNPISIIDALL

SEQ ID NO: 2390238 - protein, 17 aa, Entamoeba dispar
SISETIVSLSLLKNPIS

SEQ ID NO: 2390239 - protein, 24 aa, Entamoeba dispar
SISIEKRAKISFNGGSLYIPNKNE

SEQ ID NO: 2390240 - protein, 26 aa, Entamoeba dispar
SISKAAVDLCRLVFPLSSDENPRVRN

SEQ ID NO: 2390241 - protein, 17 aa, Entamoeba dispar
SISRCSRFVDMMKPYTY

SEQ ID NO: 2390242 - protein, 25 aa, Entamoeba dispar
SISRGITNFLFWGIGSIIYIIFYIL

SEQ ID NO: 2390243 - protein, 25 aa, Entamoeba dispar
SISSICAFVYHLIRPYPTSLLGIIL

SEQ ID NO: 2390244 - protein, 25 aa, Entamoeba dispar
SISTKECIICQPGFVLLNGQCYKSI

SEQ ID NO: 2390245 - protein, 18 aa, Entamoeba dispar
SISTSFIIISCLCVIIYL

SEQ ID NO: 2390246 - protein, 17 aa, Entamoeba dispar
SITFHIFEIISLSIIII

SEQ ID NO: 2390247 - protein, 27 aa, Entamoeba dispar
SITGICTKCLFGYFLKDEECKSCDLKN

SEQ ID NO: 2390248 - protein, 29 aa, Entamoeba dispar
SITGICTKCLFGYFLKDENCVACSDRMPG

SEQ ID NO: 2390249 - protein, 27 aa, Entamoeba dispar
SITKLNIFFQRFLKDMKSFEILLPTFI

SEQ ID NO: 2390250 - protein, 17 aa, Entamoeba dispar
SITRLTIFTLFCSVMNI

SEQ ID NO: 2390251 - protein, 21 aa, Entamoeba dispar
SIVFHALFRMRLIDMRHRVLS

SEQ ID NO: 2390252 - protein, 18 aa, Entamoeba dispar
SIVFYWFYPHEFKLHENL

SEQ ID NO: 2390253 - protein, 26 aa, Entamoeba dispar
SIVGIECGTPWYWILTVIGGPLMLTV

SEQ ID NO: 2390254 - protein, 18 aa, Entamoeba dispar
SIVLCCFIYIGIALVTSW

SEQ ID NO: 2390255 - protein, 19 aa, Entamoeba dispar
SIVLFIFFIMKYRVDKKNE

SEQ ID NO: 2390256 - protein, 21 aa, Entamoeba dispar
SIVNSIKWGRCVYDNIRKFLQ

SEQ ID NO: 2390257 - protein, 24 aa, Entamoeba dispar
SIYERWSLVMFNILFSILLPMVVA

SEQ ID NO: 2390258 - protein, 23 aa, Entamoeba dispar
SIYLLCWTLFTVYSWTAHEYGLI

SEQ ID NO: 2390259 - protein, 24 aa, Entamoeba dispar
SIYPEKYPLVYLYFSMIGAVFLNI

SEQ ID NO: 2390260 - protein, 18 aa, Entamoeba dispar
SKAIKVMVSSLIKEGYVF

SEQ ID NO: 2390261 - protein, 32 aa, Entamoeba dispar
SKAMSWYSKFLWKFKWIILAVVVLCCIILCVG

SEQ ID NO: 2390262 - protein, 24 aa, Entamoeba dispar
SKCHGFSNFYILRFKTIVGTKMTI

SEQ ID NO: 2390263 - protein, 26 aa, Entamoeba dispar
SKCREIISLKGIWYLLDLSRPANVTI

SEQ ID NO: 2390264 - protein, 22 aa, Entamoeba dispar
SKCRLTSYKFVYLISQSVNIIG

SEQ ID NO: 2390265 - protein, 24 aa, Entamoeba dispar
SKCSINCNCLYGFEPKNINGVRKC

SEQ ID NO: 2390266 - protein, 23 aa, Entamoeba dispar
SKCSVCSSTIKNTEEAFKCSNCN

SEQ ID NO: 2390267 - protein, 17 aa, Entamoeba dispar
SKCVECISGYILNSLGQ

SEQ ID NO: 2390268 - protein, 19 aa, Entamoeba dispar
SKCYFKKSTSSLGVIQYRL

SEQ ID NO: 2390269 - protein, 25 aa, Entamoeba dispar
SKDILPQGFAPLLFYGLTPGLSERI

SEQ ID NO: 2390270 - protein, 18 aa, Entamoeba dispar
SKEIAQDCLLYYNNKCVK

SEQ ID NO: 2390271 - protein, 24 aa, Entamoeba dispar
SKEIAQNIIFTRRNINSFERKVKE

SEQ ID NO: 2390272 - protein, 26 aa, Entamoeba dispar
SKEKRTAKKLDHFFPIQKIWNQSGVI

SEQ ID NO: 2390273 - protein, 23 aa, Entamoeba dispar
SKERVGGVKIFFDKYLTSTGSGR

SEQ ID NO: 2390274 - protein, 23 aa, Entamoeba dispar
SKEVVVFKAEITPLCSTQIDDKI

SEQ ID NO: 2390275 - protein, 19 aa, Entamoeba dispar
SKEVYKFPWTIASAVVEGK

SEQ ID NO: 2390276 - protein, 25 aa, Entamoeba dispar
SKEYLRIPLTIKWENGESVDVHYSI

SEQ ID NO: 2390277 - protein, 20 aa, Entamoeba dispar
SKFDDFFVNIVFTFTPDCAD

SEQ ID NO: 2390278 - protein, 18 aa, Entamoeba dispar
SKFQIIFLHLFDYSTFSS

SEQ ID NO: 2390279 - protein, 17 aa, Entamoeba dispar
SKFSGTKPKEWQMKYTK

SEQ ID NO: 2390280 - protein, 18 aa, Entamoeba dispar
SKFSLMLRDALLLYKGII

SEQ ID NO: 2390281 - protein, 18 aa, Entamoeba dispar
SKGCLRCKSGYYLEDGDC

SEQ ID NO: 2390282 - protein, 22 aa, Entamoeba dispar
SKGEVKITDFGLAKKVDDNASF

SEQ ID NO: 2390283 - protein, 20 aa, Entamoeba dispar
SKGKCVTFHYTIKPLCSTHI

SEQ ID NO: 2390284 - protein, 17 aa, Entamoeba dispar
SKGKILIYIPIILVIGM

SEQ ID NO: 2390285 - protein, 18 aa, Entamoeba dispar
SKGLPVINLPFTAYDKID

SEQ ID NO: 2390286 - protein, 21 aa, Entamoeba dispar
SKGSKVWDLLCSDYSKCIVEI

SEQ ID NO: 2390287 - protein, 18 aa, Entamoeba dispar
SKIAIYFSAAFWAFSAFT

SEQ ID NO: 2390288 - protein, 21 aa, Entamoeba dispar
SKIEAILKILIENSSMSTDIC

SEQ ID NO: 2390289 - protein, 18 aa, Entamoeba dispar
SKIMSYILVVKKNIIHLC

SEQ ID NO: 2390290 - protein, 23 aa, Entamoeba dispar
SKISSGCYVMMIGFMYLSSYPIT

SEQ ID NO: 2390291 - protein, 19 aa, Entamoeba dispar
SKKKWLMVIFHTPNSPKYV

SEQ ID NO: 2390292 - protein, 17 aa, Entamoeba dispar
SKKSFLIYIFALILLII

SEQ ID NO: 2390293 - protein, 26 aa, Entamoeba dispar
SKLDRKMIELMKKKELEQLVNDKKDL

SEQ ID NO: 2390294 - protein, 24 aa, Entamoeba dispar
SKLFECIKALALCHNVTPSISNEG

SEQ ID NO: 2390295 - protein, 18 aa, Entamoeba dispar
SKLFIMCGIVCLEFFFIH

SEQ ID NO: 2390296 - protein, 19 aa, Entamoeba dispar
SKLGCAVCNDGYYKKGSLC

SEQ ID NO: 2390297 - protein, 20 aa, Entamoeba dispar
SKLLHDFTINFTIENQEESL

SEQ ID NO: 2390298 - protein, 17 aa, Entamoeba dispar
SKLQWKHVIIIPFIGSL

SEQ ID NO: 2390299 - protein, 24 aa, Entamoeba dispar
SKMQPELIRFIFASMKMGNVQIIH

SEQ ID NO: 2390300 - protein, 24 aa, Entamoeba dispar
SKNCGIKSRLAFNVEIGNEYFVFV

SEQ ID NO: 2390301 - protein, 20 aa, Entamoeba dispar
SKNKYGRACMDICYNNITKE

SEQ ID NO: 2390302 - protein, 24 aa, Entamoeba dispar
SKNLKMKRIIIIVFVTTFVVAVCI

SEQ ID NO: 2390303 - protein, 20 aa, Entamoeba dispar
SKNWYGFIIPLVLVLFLGVI

SEQ ID NO: 2390304 - protein, 17 aa, Entamoeba dispar
SKPIPLKQNIFIILYHF

SEQ ID NO: 2390305 - protein, 26 aa, Entamoeba dispar
SKQLNITWKYSMKKILTKEARYENKN

SEQ ID NO: 2390306 - protein, 19 aa, Entamoeba dispar
SKRFEWIFRDGDGISVLED

SEQ ID NO: 2390307 - protein, 21 aa, Entamoeba dispar
SKRFVKSDSQIQCGCVYSDGY

SEQ ID NO: 2390308 - protein, 22 aa, Entamoeba dispar
SKRGIPGYSLFKISFVTFLVIL

SEQ ID NO: 2390309 - protein, 25 aa, Entamoeba dispar
SKRLDSAGVAIQWDKELSPIILQTI

SEQ ID NO: 2390310 - protein, 17 aa, Entamoeba dispar
SKRSFKREVNWFRFDVY

SEQ ID NO: 2390311 - protein, 20 aa, Entamoeba dispar
SKRSSKRMLAYFPIKKILDE

SEQ ID NO: 2390312 - protein, 18 aa, Entamoeba dispar
SKSCFSLILVFVNEIIKI

SEQ ID NO: 2390313 - protein, 20 aa, Entamoeba dispar
SKSGIKGFFRVFKKMFINLF

SEQ ID NO: 2390314 - protein, 17 aa, Entamoeba dispar
SKSGVFFGIPPLGGWIL

SEQ ID NO: 2390315 - protein, 17 aa, Entamoeba dispar
SKSSFAFKKIIQQQEKQ

SEQ ID NO: 2390316 - protein, 18 aa, Entamoeba dispar
SKTKCIRSRTDGCGNNSK

SEQ ID NO: 2390317 - protein, 22 aa, Entamoeba dispar
SKTLHKTICLIALINALKQSDI

SEQ ID NO: 2390318 - protein, 26 aa, Entamoeba dispar
SKTLLKFVDIHSCVMRRVIGIATEKG

SEQ ID NO: 2390319 - protein, 25 aa, Entamoeba dispar
SKTNKKWRSSMIIGTIFKQGNTYEF

SEQ ID NO: 2390320 - protein, 23 aa, Entamoeba dispar
SKTNWALIIPLVIVAVIIIIILL

SEQ ID NO: 2390321 - protein, 20 aa, Entamoeba dispar
SKTPYSYGFWFEINTKEEGY

SEQ ID NO: 2390322 - protein, 26 aa, Entamoeba dispar
SKTQKRISLIYAFVISIIFSGFIPLL

SEQ ID NO: 2390323 - protein, 20 aa, Entamoeba dispar
SKTSLLIRARVISAVKYWIE

SEQ ID NO: 2390324 - protein, 22 aa, Entamoeba dispar
SKTSMFYKQWLKVEDIHAELYM

SEQ ID NO: 2390325 - protein, 28 aa, Entamoeba dispar
SKTVIRGDVFFQFGFEEFNKTLTFGSVI

SEQ ID NO: 2390326 - protein, 25 aa, Entamoeba dispar
SKVIIKRNYSFIVIFVYLALVISSI

SEQ ID NO: 2390327 - protein, 21 aa, Entamoeba dispar
SKVKLTLCKLIGKVDDYPMLS

SEQ ID NO: 2390328 - protein, 19 aa, Entamoeba dispar
SKVQMAILMFYKSYISSYL

SEQ ID NO: 2390329 - protein, 18 aa, Entamoeba dispar
SKVSWDVRTVISIFDNLI

SEQ ID NO: 2390330 - protein, 23 aa, Entamoeba dispar
SKVWDVIIGITFITSAMFLQALQ

SEQ ID NO: 2390331 - protein, 22 aa, Entamoeba dispar
SKYSILSFLPKFLITQFTMVTN

SEQ ID NO: 2390332 - protein, 20 aa, Entamoeba dispar
SKYTLRCNPEQITLKKGEAF

SEQ ID NO: 2390333 - protein, 20 aa, Entamoeba dispar
SKYVGSSIEELVQFQQFSSC

SEQ ID NO: 2390334 - protein, 18 aa, Entamoeba dispar
SLCITLGLAFTMEIPTNG

SEQ ID NO: 2390335 - protein, 23 aa, Entamoeba dispar
SLCLIIEYFPLGSIRKFYTEHEV

SEQ ID NO: 2390336 - protein, 26 aa, Entamoeba dispar
SLCLSEYYLDGNLCKRCSNKPNCKTC

SEQ ID NO: 2390337 - protein, 30 aa, Entamoeba dispar
SLDIPESIKSNAIWNICRLEDYHVVSSIIR

SEQ ID NO: 2390338 - protein, 17 aa, Entamoeba dispar
SLDVSKLEKLGWKTTTS

SEQ ID NO: 2390339 - protein, 18 aa, Entamoeba dispar
SLDVSKLEKLGWRATTSF

SEQ ID NO: 2390340 - protein, 24 aa, Entamoeba dispar
SLEEKKELITLIFKVVSKVLITYK

SEQ ID NO: 2390341 - protein, 18 aa, Entamoeba dispar
SLEIEGIYFTTQLVQCQI

SEQ ID NO: 2390342 - protein, 27 aa, Entamoeba dispar
SLEKCYSLFCQLNLNYLPLIPLILNKI

SEQ ID NO: 2390343 - protein, 18 aa, Entamoeba dispar
SLEKLFFQCCAAVVSEAN

SEQ ID NO: 2390344 - protein, 17 aa, Entamoeba dispar
SLELKMITGVDVSNNAK

SEQ ID NO: 2390345 - protein, 18 aa, Entamoeba dispar
SLESIVFHALFRMRLIDM

SEQ ID NO: 2390346 - protein, 18 aa, Entamoeba dispar
SLETKRCSFITISNETLF

SEQ ID NO: 2390347 - protein, 18 aa, Entamoeba dispar
SLFCLQCAENFYFVSSNI

SEQ ID NO: 2390348 - protein, 24 aa, Entamoeba dispar
SLFEIIEWKEAYPADDPKFKYQWQ

SEQ ID NO: 2390349 - protein, 17 aa, Entamoeba dispar
SLFLMSFLFLVSLFLSF

SEQ ID NO: 2390350 - protein, 35 aa, Entamoeba dispar
SLFLNMFGASLFVDMLSHLLLERKFIFISESLQLL

SEQ ID NO: 2390351 - protein, 18 aa, Entamoeba dispar
SLFNYKTLILWVIEALII

SEQ ID NO: 2390352 - protein, 18 aa, Entamoeba dispar
SLFVYKTHQGVIKWLGFS

SEQ ID NO: 2390353 - protein, 18 aa, Entamoeba dispar
SLGDVTLPNWAFKHNLLD

SEQ ID NO: 2390354 - protein, 24 aa, Entamoeba dispar
SLGETAIKCSWIITNENTGSEFVY

SEQ ID NO: 2390355 - protein, 18 aa, Entamoeba dispar
SLGKRRSECLSPDEEGER

SEQ ID NO: 2390356 - protein, 18 aa, Entamoeba dispar
SLGKVLEPSNCFEIQEKS

SEQ ID NO: 2390357 - protein, 24 aa, Entamoeba dispar
SLGTWKHVDSSFKLTITEADKEKE

SEQ ID NO: 2390358 - protein, 25 aa, Entamoeba dispar
SLHFYLDACFIFSLLNNTSNTSSPI

SEQ ID NO: 2390359 - protein, 33 aa, Entamoeba dispar
SLHSLCFTRYTPCYWRSVLGFGYILLNFTMEVL

SEQ ID NO: 2390360 - protein, 18 aa, Entamoeba dispar
SLIALLILYMFQFNNILN

SEQ ID NO: 2390361 - protein, 17 aa, Entamoeba dispar
SLICKKSSTTLENCAVP

SEQ ID NO: 2390362 - protein, 18 aa, Entamoeba dispar
SLIHLWESIIQCFKVRKN

SEQ ID NO: 2390363 - protein, 29 aa, Entamoeba dispar
SLIIPFLIPNCVELLPILLSMERLEILKI

SEQ ID NO: 2390364 - protein, 23 aa, Entamoeba dispar
SLIKESRSEGLLFFRTKNEYKDF

SEQ ID NO: 2390365 - protein, 22 aa, Entamoeba dispar
SLIPRLSKFYNINGVIDSLAEM

SEQ ID NO: 2390366 - protein, 26 aa, Entamoeba dispar
SLIRAVIKREWWPFLLSLIAISISQI

SEQ ID NO: 2390367 - protein, 17 aa, Entamoeba dispar
SLIVILHIMIWRQGGAL

SEQ ID NO: 2390368 - protein, 24 aa, Entamoeba dispar
SLKARHAICTKAKVLGEEILNWAR

SEQ ID NO: 2390369 - protein, 30 aa, Entamoeba dispar
SLKEIFKQNNWWSILQFIIWSIIITLIISS

SEQ ID NO: 2390370 - protein, 20 aa, Entamoeba dispar
SLKIEPRTSSIVPLSAGCTR

SEQ ID NO: 2390371 - protein, 24 aa, Entamoeba dispar
SLKMKRLTLNIDIFIITFIATLFA

SEQ ID NO: 2390372 - protein, 32 aa, Entamoeba dispar
SLKQIYRLKLMWCEIEPFTCFFEGNQIPSMIN

SEQ ID NO: 2390373 - protein, 18 aa, Entamoeba dispar
SLKRSSYNTIVFMATSDA

SEQ ID NO: 2390374 - protein, 17 aa, Entamoeba dispar
SLLACYYLFLKNNIILS

SEQ ID NO: 2390375 - protein, 23 aa, Entamoeba dispar
SLLAEIMRSLSLFNDDTINKENY

SEQ ID NO: 2390376 - protein, 17 aa, Entamoeba dispar
SLLELIKSGSLGRMPEK

SEQ ID NO: 2390377 - protein, 27 aa, Entamoeba dispar
SLLETFSFNGFFCFPFVDYSFLSDTTK

SEQ ID NO: 2390378 - protein, 18 aa, Entamoeba dispar
SLLFLRECVMVEFTSHTL

SEQ ID NO: 2390379 - protein, 24 aa, Entamoeba dispar
SLLGCMKIGLTIYYSIKQTDKLAS

SEQ ID NO: 2390380 - protein, 26 aa, Entamoeba dispar
SLLKHFPTLLCWDEFDQKLKPMELEV

SEQ ID NO: 2390381 - protein, 20 aa, Entamoeba dispar
SLLLLFQFFYLMFLITLGLS

SEQ ID NO: 2390382 - protein, 28 aa, Entamoeba dispar
SLLNKLESVIIIIQFVRYHMSIEVWMNS

SEQ ID NO: 2390383 - protein, 26 aa, Entamoeba dispar
SLLQMKLDILFICFLLILLSFLAGLC

SEQ ID NO: 2390384 - protein, 18 aa, Entamoeba dispar
SLLRNCKEYMKPKYNEVL

SEQ ID NO: 2390385 - protein, 39 aa, Entamoeba dispar
SLLSSYFIKSIVVLLCCVFVGIIILFFIKSKRKSTEVEL

SEQ ID NO: 2390386 - protein, 24 aa, Entamoeba dispar
SLLTHIRKALLLFSRYPNTFIPNA

SEQ ID NO: 2390387 - protein, 24 aa, Entamoeba dispar
SLLTHIRKALLLFSRYPYDFIPNS

SEQ ID NO: 2390388 - protein, 19 aa, Entamoeba dispar
SLLVYYELILPRFKHKDQE

SEQ ID NO: 2390389 - protein, 20 aa, Entamoeba dispar
SLLVYYELILPRFKHKDQEK

SEQ ID NO: 2390390 - protein, 19 aa, Entamoeba dispar
SLMSLYPYKTFFSVKSDIP

SEQ ID NO: 2390391 - protein, 22 aa, Entamoeba dispar
SLNKCIIKIFSIDSLINAFFAF

SEQ ID NO: 2390392 - protein, 21 aa, Entamoeba dispar
SLNLFPYKSLYEENSNPQSQQ

SEQ ID NO: 2390393 - protein, 24 aa, Entamoeba dispar
SLNLKSLWIDDTLFAFQNITINSD

SEQ ID NO: 2390394 - protein, 24 aa, Entamoeba dispar
SLNPLKVKLFVLFYFYYSSVDYSY

SEQ ID NO: 2390395 - protein, 21 aa, Entamoeba dispar
SLNSGFKYLVSSFIITKNLVI

SEQ ID NO: 2390396 - protein, 25 aa, Entamoeba dispar
SLNSISTSCVIVWNESELALDTSLF

SEQ ID NO: 2390397 - protein, 25 aa, Entamoeba dispar
SLPEKIFGYPLDFVCVIVGLMASNL

SEQ ID NO: 2390398 - protein, 19 aa, Entamoeba dispar
SLPIASSIICLKKAPESLR

SEQ ID NO: 2390399 - protein, 25 aa, Entamoeba dispar
SLPLFKIKPVWILTMIQCILCIFMS

SEQ ID NO: 2390400 - protein, 20 aa, Entamoeba dispar
SLPNVKKFKYVNCDSDSSCI

SEQ ID NO: 2390401 - protein, 20 aa, Entamoeba dispar
SLPSFPFKVYGGLNIIGELT

SEQ ID NO: 2390402 - protein, 22 aa, Entamoeba dispar
SLPYFRTVTVFGLFPVSYIIWA

SEQ ID NO: 2390403 - protein, 20 aa, Entamoeba dispar
SLQFLSSVLVFLCLFLHGVS

SEQ ID NO: 2390404 - protein, 18 aa, Entamoeba dispar
SLQQLKLNKLFRAEKQYV

SEQ ID NO: 2390405 - protein, 23 aa, Entamoeba dispar
SLQRAMCRKKVNIIFYTVLIIGF

SEQ ID NO: 2390406 - protein, 20 aa, Entamoeba dispar
SLQSRTSRKLTHLLTGPFFV

SEQ ID NO: 2390407 - protein, 20 aa, Entamoeba dispar
SLQTGYLYFLFVGVNEQYSA

SEQ ID NO: 2390408 - protein, 22 aa, Entamoeba dispar
SLRLKRFYISQIRRETGSIRKI

SEQ ID NO: 2390409 - protein, 20 aa, Entamoeba dispar
SLRTFICRNRTTSTFPQQLF

SEQ ID NO: 2390410 - protein, 21 aa, Entamoeba dispar
SLSCSCIISSFLHFPYVFLLL

SEQ ID NO: 2390411 - protein, 19 aa, Entamoeba dispar
SLSKIWGKQIINYQLKVKI

SEQ ID NO: 2390412 - protein, 17 aa, Entamoeba dispar
SLSKMWGKREVSYDLKI

SEQ ID NO: 2390413 - protein, 17 aa, Entamoeba dispar
SLSQLRLNISFASLPSL

SEQ ID NO: 2390414 - protein, 18 aa, Entamoeba dispar
SLTGEWRNKMLVGPFESI

SEQ ID NO: 2390415 - protein, 18 aa, Entamoeba dispar
SLTLRMLIFIGNEDSIKT

SEQ ID NO: 2390416 - protein, 26 aa, Entamoeba dispar
SLTNEFIELFIPLQIQRRVGEIGIVF

SEQ ID NO: 2390417 - protein, 23 aa, Entamoeba dispar
SLTNGRLAILGSIDMLNNNYFEK

SEQ ID NO: 2390418 - protein, 22 aa, Entamoeba dispar
SLTPRKPIFLPLFTLNLSKQMT

SEQ ID NO: 2390419 - protein, 20 aa, Entamoeba dispar
SLTTFELLKNYSLKKLIQLG

SEQ ID NO: 2390420 - protein, 18 aa, Entamoeba dispar
SLTYKLSFRSIKTNFELE

SEQ ID NO: 2390421 - protein, 26 aa, Entamoeba dispar
SLVALLLCFFVMLLSFTSNVHENSWE

SEQ ID NO: 2390422 - protein, 23 aa, Entamoeba dispar
SLVFAEESYKYYVHQVEQGYQVI

SEQ ID NO: 2390423 - protein, 19 aa, Entamoeba dispar
SLVIIRLFIHFVLSSDEYF

SEQ ID NO: 2390424 - protein, 24 aa, Entamoeba dispar
SLVIPHLFVFSTFIIFGCDFIFTS

SEQ ID NO: 2390425 - protein, 24 aa, Entamoeba dispar
SLVLNCYAGLWAYVATCIKTFTTI

SEQ ID NO: 2390426 - protein, 25 aa, Entamoeba dispar
SLVLSELLILFSILFYFYPYFLMFI

SEQ ID NO: 2390427 - protein, 24 aa, Entamoeba dispar
SLVSRLLWQFLMKIKDDMEKVENV

SEQ ID NO: 2390428 - protein, 24 aa, Entamoeba dispar
SLYDYWSANVIEVMDNSQINLNGR

SEQ ID NO: 2390429 - protein, 25 aa, Entamoeba dispar
SLYITNECRLIFSVLPSISNVIMDN

SEQ ID NO: 2390430 - protein, 19 aa, Entamoeba dispar
SLYLFIGGIIFQLCGGLIS

SEQ ID NO: 2390431 - protein, 18 aa, Entamoeba dispar
SLYLSYFIIFNINLCAIA

SEQ ID NO: 2390432 - protein, 26 aa, Entamoeba dispar
SLYPHLLEYYALWFSRLFTGDLGIWI

SEQ ID NO: 2390433 - protein, 21 aa, Entamoeba dispar
SMDCVPRLSKAQCMDALSSQN

SEQ ID NO: 2390434 - protein, 19 aa, Entamoeba dispar
SMECLAVLCETYGTLGDAL

SEQ ID NO: 2390435 - protein, 25 aa, Entamoeba dispar
SMFIFPRYLSIFSIAVYLSTIIIRQ

SEQ ID NO: 2390436 - protein, 17 aa, Entamoeba dispar
SMFLLVIMTVLTYIIPC

SEQ ID NO: 2390437 - protein, 25 aa, Entamoeba dispar
SMGLKDAKLWEYARTLGYESVKTEF

SEQ ID NO: 2390438 - protein, 23 aa, Entamoeba dispar
SMIKYSKTFFRGFNYAIGASLFI

SEQ ID NO: 2390439 - protein, 21 aa, Entamoeba dispar
SMKPYQCMISGFFKIDNATND

SEQ ID NO: 2390440 - protein, 24 aa, Entamoeba dispar
SMKVEATCLSAFFTSSNEIVVIDT

SEQ ID NO: 2390441 - protein, 21 aa, Entamoeba dispar
SMLDKFRCDYIINFFGACCLK

SEQ ID NO: 2390442 - protein, 21 aa, Entamoeba dispar
SMLKLKKMMSSVMENTAPLIN

SEQ ID NO: 2390443 - protein, 24 aa, Entamoeba dispar
SMMDNIFYGYGFYIIILSIAFILH

SEQ ID NO: 2390444 - protein, 23 aa, Entamoeba dispar
SMRTTELYALFATPGLAEATFRN

SEQ ID NO: 2390445 - protein, 19 aa, Entamoeba dispar
SMRVRNGLIGLIFEKALKL

SEQ ID NO: 2390446 - protein, 27 aa, Entamoeba dispar
SMSDLLKIRFCQDIARGMEYLHQNDIL

SEQ ID NO: 2390447 - protein, 27 aa, Entamoeba dispar
SMSELLKIRFCQDIARGMEYLHQNDIL

SEQ ID NO: 2390448 - protein, 18 aa, Entamoeba dispar
SMYVRAGALLGIGTCCSG

SEQ ID NO: 2390449 - protein, 20 aa, Entamoeba dispar
SNAAGFIFAESITVEGTAES

SEQ ID NO: 2390450 - protein, 23 aa, Entamoeba dispar
SNAKKPRASEVVKQKKEQKKALI

SEQ ID NO: 2390451 - protein, 20 aa, Entamoeba dispar
SNAKTCCSRVGMAAYSNDGI

SEQ ID NO: 2390452 - protein, 24 aa, Entamoeba dispar
SNALIPLSTCFEGTSTYYTSYTEN

SEQ ID NO: 2390453 - protein, 24 aa, Entamoeba dispar
SNANAEFWFWAFGKTDASAKTITT

SEQ ID NO: 2390454 - protein, 19 aa, Entamoeba dispar
SNCILSLFYQFFSTNQSSF

SEQ ID NO: 2390455 - protein, 17 aa, Entamoeba dispar
SNCITHSLTGLLYIGNS

SEQ ID NO: 2390456 - protein, 22 aa, Entamoeba dispar
SNCLMKDCKAIFSSELGYKLIL

SEQ ID NO: 2390457 - protein, 19 aa, Entamoeba dispar
SNCRKDCICEDGYFPEDDV

SEQ ID NO: 2390458 - protein, 24 aa, Entamoeba dispar
SNDCKRKLIQVVIKLVIFNDSGIT

SEQ ID NO: 2390459 - protein, 24 aa, Entamoeba dispar
SNDLYLNEIVKFIKCIISNETNKN

SEQ ID NO: 2390460 - protein, 25 aa, Entamoeba dispar
SNEKFKCIQCKKGYYLNSKQECQYE

SEQ ID NO: 2390461 - protein, 25 aa, Entamoeba dispar
SNEKFKCIQCKKGYYLNSKQECQYN

SEQ ID NO: 2390462 - protein, 25 aa, Entamoeba dispar
SNEKFKCIQCKKGYYLNSNKECQIG

SEQ ID NO: 2390463 - protein, 21 aa, Entamoeba dispar
SNFFRYCLTGFLYNYSVFFYN

SEQ ID NO: 2390464 - protein, 24 aa, Entamoeba dispar
SNFKEKRNGVSLLINSISPLQQVR

SEQ ID NO: 2390465 - protein, 19 aa, Entamoeba dispar
SNFSLPLWILTLIIIGAIC

SEQ ID NO: 2390466 - protein, 20 aa, Entamoeba dispar
SNGLINMGFVLYYFINTMVP

SEQ ID NO: 2390467 - protein, 18 aa, Entamoeba dispar
SNGLWKYDEFVIQKDCCG

SEQ ID NO: 2390468 - protein, 22 aa, Entamoeba dispar
SNGYRFGKGIYFANCASKSLSY

SEQ ID NO: 2390469 - protein, 18 aa, Entamoeba dispar
SNHECSMNESCVALKKNQ

SEQ ID NO: 2390470 - protein, 29 aa, Entamoeba dispar
SNHIFWMSSCCCWILFNVKVFEELIYSRK

SEQ ID NO: 2390471 - protein, 27 aa, Entamoeba dispar
SNIAPALVCCRLFFRLTKQSKIYLSSS

SEQ ID NO: 2390472 - protein, 19 aa, Entamoeba dispar
SNIAQCKKLWRGTQYRLSK

SEQ ID NO: 2390473 - protein, 24 aa, Entamoeba dispar
SNICIPSSITKEFVSYPGVCSETT

SEQ ID NO: 2390474 - protein, 18 aa, Entamoeba dispar
SNIECLREKEGCSQTCSC

SEQ ID NO: 2390475 - protein, 22 aa, Entamoeba dispar
SNIIFPFVIQYNHYIQRAGYIK

SEQ ID NO: 2390476 - protein, 23 aa, Entamoeba dispar
SNIRRLGAQCFSVVLRYLPLHVT

SEQ ID NO: 2390477 - protein, 22 aa, Entamoeba dispar
SNIWTPFSFKIGLLYYFIIMMT

SEQ ID NO: 2390478 - protein, 22 aa, Entamoeba dispar
SNKCEPSYCDYNYFLDSITLNC

SEQ ID NO: 2390479 - protein, 24 aa, Entamoeba dispar
SNKCIYRYDHYCGFIGNSLGFHNY

SEQ ID NO: 2390480 - protein, 27 aa, Entamoeba dispar
SNLEVPKSIPFLYSLTNKWNQIDFIYF

SEQ ID NO: 2390481 - protein, 24 aa, Entamoeba dispar
SNLLDVCRGFSLADRLRNCIEHLN

SEQ ID NO: 2390482 - protein, 19 aa, Entamoeba dispar
SNLMKRGALQVSQILITHS

SEQ ID NO: 2390483 - protein, 18 aa, Entamoeba dispar
SNLSTAICQCFLPPKQSV

SEQ ID NO: 2390484 - protein, 18 aa, Entamoeba dispar
SNLSTAICQCFLPQKDNV

SEQ ID NO: 2390485 - protein, 28 aa, Entamoeba dispar
SNLYMFRWLTLLCCMEFTLFETFMYWDF

SEQ ID NO: 2390486 - protein, 19 aa, Entamoeba dispar
SNMKRELLARHGVGEHEIK

SEQ ID NO: 2390487 - protein, 25 aa, Entamoeba dispar
SNNCELLKCITDCFEVSCLGDNVEC

SEQ ID NO: 2390488 - protein, 18 aa, Entamoeba dispar
SNNPLSMELRIKIMLDAA

SEQ ID NO: 2390489 - protein, 17 aa, Entamoeba dispar
SNPENFCTIHILQMNNE

SEQ ID NO: 2390490 - protein, 17 aa, Entamoeba dispar
SNPKILSTHSVKIFNQL

SEQ ID NO: 2390491 - protein, 24 aa, Entamoeba dispar
SNQKRPKILVSYVDHYFEKPNKGS

SEQ ID NO: 2390492 - protein, 30 aa, Entamoeba dispar
SNQLRGVNCLVQLIKHFPVFFTEYKTALFN

SEQ ID NO: 2390493 - protein, 22 aa, Entamoeba dispar
SNQMIFCLLCCSFVNQCVVLAT

SEQ ID NO: 2390494 - protein, 26 aa, Entamoeba dispar
SNRISDLYLKYCIVITIIRFLFTPLR

SEQ ID NO: 2390495 - protein, 19 aa, Entamoeba dispar
SNSESSCYFCDPKNSYFIE

SEQ ID NO: 2390496 - protein, 23 aa, Entamoeba dispar
SNSFEPILWICFDNILNDFDIWA

SEQ ID NO: 2390497 - protein, 22 aa, Entamoeba dispar
SNSFLKRIKIISSINSSSQPIT

SEQ ID NO: 2390498 - protein, 18 aa, Entamoeba dispar
SNSICLSCAEGYYRHNDS

SEQ ID NO: 2390499 - protein, 18 aa, Entamoeba dispar
SNSSKPSSFYTIHSSRRW

SEQ ID NO: 2390500 - protein, 17 aa, Entamoeba dispar
SNSTEIDLRRLGNFYSQ

SEQ ID NO: 2390501 - protein, 17 aa, Entamoeba dispar
SNSTTKGSIGWQAPEML

SEQ ID NO: 2390502 - protein, 23 aa, Entamoeba dispar
SNSVCGTLAWTAPEMLKGKPVST

SEQ ID NO: 2390503 - protein, 22 aa, Entamoeba dispar
SNSYICPLPYTCIDSNNCQHQT

SEQ ID NO: 2390504 - protein, 40 aa, Entamoeba dispar
SNTFGCSYLCGGYILMMSLFIWRVIRKMIKNNPENFWLCI

SEQ ID NO: 2390505 - protein, 23 aa, Entamoeba dispar
SNTKHCYVNHQIQIFVNGVIHEF

SEQ ID NO: 2390506 - protein, 23 aa, Entamoeba dispar
SNTLLSIERIHLVNPSSVVILNV

SEQ ID NO: 2390507 - protein, 20 aa, Entamoeba dispar
SNTLMTMYWLFKNQPQMCDT

SEQ ID NO: 2390508 - protein, 25 aa, Entamoeba dispar
SNTTGFKNSFRWKSIKNETQITFQN

SEQ ID NO: 2390509 - protein, 24 aa, Entamoeba dispar
SNYFKAIVCGIIIFFVKFWIIKEI

SEQ ID NO: 2390510 - protein, 24 aa, Entamoeba dispar
SNYRNKRVYDLFGYTIFEYKELIC

SEQ ID NO: 2390511 - protein, 28 aa, Entamoeba dispar
SNYWMKEIHEILKLLTPHALEDMMNEMM

SEQ ID NO: 2390512 - protein, 21 aa, Entamoeba dispar
SPECANNLYLRGMPFTVSVPE

SEQ ID NO: 2390513 - protein, 26 aa, Entamoeba dispar
SPEEVKKLEIDLMMFYDEKIKNVQKQ

SEQ ID NO: 2390514 - protein, 18 aa, Entamoeba dispar
SPELLYYLYELFGNELVK

SEQ ID NO: 2390515 - protein, 31 aa, Entamoeba dispar
SPENFRIYFIRLCQLLSFHGPKVAPTMSSRV

SEQ ID NO: 2390516 - protein, 18 aa, Entamoeba dispar
SPEQALRSLLFCDTPSLL

SEQ ID NO: 2390517 - protein, 19 aa, Entamoeba dispar
SPFVIFCCVGVFDSNAHWD

SEQ ID NO: 2390518 - protein, 17 aa, Entamoeba dispar
SPHQIVIFTDGYCRGTC

SEQ ID NO: 2390519 - protein, 18 aa, Entamoeba dispar
SPHQRPQILLLKSQITEA

SEQ ID NO: 2390520 - protein, 28 aa, Entamoeba dispar
SPILLNLQYRCCPPISNIVNRLYYNGLL

SEQ ID NO: 2390521 - protein, 23 aa, Entamoeba dispar
SPKKSFLRFILKSKSNMVSKNLK

SEQ ID NO: 2390522 - protein, 18 aa, Entamoeba dispar
SPKLSYNEWYFVFYKIFF

SEQ ID NO: 2390523 - protein, 17 aa, Entamoeba dispar
SPKMFPIPIPNFSIVDY

SEQ ID NO: 2390524 - protein, 22 aa, Entamoeba dispar
SPKPHTFLFPGVTLFDTAVDVI

SEQ ID NO: 2390525 - protein, 22 aa, Entamoeba dispar
SPKSNFFCCGIYALKQFSSRLS

SEQ ID NO: 2390526 - protein, 20 aa, Entamoeba dispar
SPLCILAGYFRNIKNQIQPT

SEQ ID NO: 2390527 - protein, 20 aa, Entamoeba dispar
SPLFMQWDYWILPETKIEFV

SEQ ID NO: 2390528 - protein, 19 aa, Entamoeba dispar
SPLLFKPTLLATMFSNIIT

SEQ ID NO: 2390529 - protein, 18 aa, Entamoeba dispar
SPLSRLYNSLPFIPKKIL

SEQ ID NO: 2390530 - protein, 22 aa, Entamoeba dispar
SPMLSVYYCWALGYHFHSLVFH

SEQ ID NO: 2390531 - protein, 25 aa, Entamoeba dispar
SPNECSTCKQPAYQWDCHSCGDGYY

SEQ ID NO: 2390532 - protein, 18 aa, Entamoeba dispar
SPNKRGMFIVTFDIESSF

SEQ ID NO: 2390533 - protein, 21 aa, Entamoeba dispar
SPNLIFKILLFTMKFNGNYSI

SEQ ID NO: 2390534 - protein, 17 aa, Entamoeba dispar
SPNVCGLRSSEIVQNTR

SEQ ID NO: 2390535 - protein, 18 aa, Entamoeba dispar
SPSCCFFPGEGITIHMNI

SEQ ID NO: 2390536 - protein, 17 aa, Entamoeba dispar
SPSSFFLYFSFSFLIYL

SEQ ID NO: 2390537 - protein, 20 aa, Entamoeba dispar
SPSSYNFLFEKVLFNTNLKF

SEQ ID NO: 2390538 - protein, 30 aa, Entamoeba dispar
SPTVKIELPKPILATWQFYAVLFTIIGVMT

SEQ ID NO: 2390539 - protein, 24 aa, Entamoeba dispar
SPVCAKLTDFGTCRNISERNLSVK

SEQ ID NO: 2390540 - protein, 24 aa, Entamoeba dispar
SPVCAKLTDFGTCRNISERSLSVK

SEQ ID NO: 2390541 - protein, 27 aa, Entamoeba dispar
SPVSSCILWKYLSDIGYDYATLSLISI

SEQ ID NO: 2390542 - protein, 44 aa, Entamoeba dispar
SPVYCGSSFRIDDMILRIGGIIPFCSLLHFGFGYKEFNTSNIPS

SEQ ID NO: 2390543 - protein, 24 aa, Entamoeba dispar
SPWNCLDPELGFVFENNEIVWLGS

SEQ ID NO: 2390544 - protein, 18 aa, Entamoeba dispar
SPYVFDLLDVMVKSAVEQ

SEQ ID NO: 2390545 - protein, 24 aa, Entamoeba dispar
SQCMYCLYDNILIDPAKLIKMDCT

SEQ ID NO: 2390546 - protein, 38 aa, Entamoeba dispar
SQCNKSLPACEMIQCALCGIPICSAQCLKIHSQQPHNF

SEQ ID NO: 2390547 - protein, 28 aa, Entamoeba dispar
SQCYDECPYCLWGLCYSCTHGCNYGSWK

SEQ ID NO: 2390548 - protein, 25 aa, Entamoeba dispar
SQECINSFLMLLPFQSFSNKSLIDT

SEQ ID NO: 2390549 - protein, 23 aa, Entamoeba dispar
SQEELSTVLSIEWSNGEKCDVSY

SEQ ID NO: 2390550 - protein, 23 aa, Entamoeba dispar
SQEFLDRLMVFKEYIAIELNVEE

SEQ ID NO: 2390551 - protein, 23 aa, Entamoeba dispar
SQEWKMPHGFLFEYITCANYFCE

SEQ ID NO: 2390552 - protein, 33 aa, Entamoeba dispar
SQFCKTNLIAFYKFGTKFVMKRLFLNCDDTEIN

SEQ ID NO: 2390553 - protein, 24 aa, Entamoeba dispar
SQFKIGNSWFSYKLGEIKKIGTVS

SEQ ID NO: 2390554 - protein, 22 aa, Entamoeba dispar
SQFKYPWKIAEFVTSGKRLERV

SEQ ID NO: 2390555 - protein, 22 aa, Entamoeba dispar
SQFRFLVKLLLVHGRYNYRRLS

SEQ ID NO: 2390556 - protein, 18 aa, Entamoeba dispar
SQGMINFIYWGIGSIVYA

SEQ ID NO: 2390557 - protein, 21 aa, Entamoeba dispar
SQHKYILSIAFFLIGGAITEA

SEQ ID NO: 2390558 - protein, 19 aa, Entamoeba dispar
SQIAKLCYDDVPEKNRNVL

SEQ ID NO: 2390559 - protein, 21 aa, Entamoeba dispar
SQIESLHFLCKLITAHEISIE

SEQ ID NO: 2390560 - protein, 26 aa, Entamoeba dispar
SQIKFLSLILYYCIVSSMGSITFNLE

SEQ ID NO: 2390561 - protein, 17 aa, Entamoeba dispar
SQILLRFLKNDKLLPSL

SEQ ID NO: 2390562 - protein, 19 aa, Entamoeba dispar
SQINRRAALEVIKSYSDDL

SEQ ID NO: 2390563 - protein, 17 aa, Entamoeba dispar
SQKKYSRRCKAPIPFEL

SEQ ID NO: 2390564 - protein, 25 aa, Entamoeba dispar
SQKLYRFSIFKERVKLIRQRNAERT

SEQ ID NO: 2390565 - protein, 17 aa, Entamoeba dispar
SQLLLRFFLVLWTLFVI

SEQ ID NO: 2390566 - protein, 19 aa, Entamoeba dispar
SQLTRLPIFKFLRNSNELF

SEQ ID NO: 2390567 - protein, 23 aa, Entamoeba dispar
SQMIDLRYDLSFMSKVLVTILRM

SEQ ID NO: 2390568 - protein, 22 aa, Entamoeba dispar
SQMKCPFSISFLVSNQLACVAS

SEQ ID NO: 2390569 - protein, 17 aa, Entamoeba dispar
SQMNCNWIGKMNKHYKL

SEQ ID NO: 2390570 - protein, 27 aa, Entamoeba dispar
SQMNKRKCICLILPQKLKYLSILSFFI

SEQ ID NO: 2390571 - protein, 23 aa, Entamoeba dispar
SQMSKEMAIVFSGFLVSDENAIG

SEQ ID NO: 2390572 - protein, 22 aa, Entamoeba dispar
SQNCFMCSNGFALKDPTDPLSE

SEQ ID NO: 2390573 - protein, 18 aa, Entamoeba dispar
SQNNSWTILLWIVVGCII

SEQ ID NO: 2390574 - protein, 19 aa, Entamoeba dispar
SQQFLCYSSEAIDIDVIDS

SEQ ID NO: 2390575 - protein, 24 aa, Entamoeba dispar
SQSISFIPMKAFIYHRRSNFLEVI

SEQ ID NO: 2390576 - protein, 21 aa, Entamoeba dispar
SQSLVALFRLFAPLISSPLIA

SEQ ID NO: 2390577 - protein, 18 aa, Entamoeba dispar
SQSPSWPGTNSTIISGPN

SEQ ID NO: 2390578 - protein, 18 aa, Entamoeba dispar
SQSTCIQESNVVCGNHGY

SEQ ID NO: 2390579 - protein, 24 aa, Entamoeba dispar
SQTIKASFVNFFIVSFALSCIACW

SEQ ID NO: 2390580 - protein, 19 aa, Entamoeba dispar
SQVLKVFYPPTFKESLQNE

SEQ ID NO: 2390581 - protein, 29 aa, Entamoeba dispar
SQVVLREENRWFIPIAIVGVILIISIVLF

SEQ ID NO: 2390582 - protein, 18 aa, Entamoeba dispar
SQWSIYFIKSRKQFFEDI

SEQ ID NO: 2390583 - protein, 30 aa, Entamoeba dispar
SQYIKFFEWFFFDYYENVLFAGVDANGSLF

SEQ ID NO: 2390584 - protein, 20 aa, Entamoeba dispar
SQYSCCGWFSINTMTCKSLA

SEQ ID NO: 2390585 - protein, 27 aa, Entamoeba dispar
SQYTPCYWRSVVGFGFVFMNYVMEVFE

SEQ ID NO: 2390586 - protein, 22 aa, Entamoeba dispar
SRAKAKLIRLLTSVAEHFFNTA

SEQ ID NO: 2390587 - protein, 18 aa, Entamoeba dispar
SRALGFLLLGCAWSVTEV

SEQ ID NO: 2390588 - protein, 19 aa, Entamoeba dispar
SRAMWNIVQIFDWTVYNDS

SEQ ID NO: 2390589 - protein, 17 aa, Entamoeba dispar
SRCCEKLLFGINCSYHF

SEQ ID NO: 2390590 - protein, 23 aa, Entamoeba dispar
SRCGQCLEIKGPVGDPLYCVVAG

SEQ ID NO: 2390591 - protein, 25 aa, Entamoeba dispar
SRCSRNKIWFGKLIETERNLCNLNN

SEQ ID NO: 2390592 - protein, 23 aa, Entamoeba dispar
SRDRSLVILKIRNFGTLNIGHPK

SEQ ID NO: 2390593 - protein, 17 aa, Entamoeba dispar
SRECVACSKKFKDCNTC

SEQ ID NO: 2390594 - protein, 20 aa, Entamoeba dispar
SRFSFNSDFIGCATSGWFDH

SEQ ID NO: 2390595 - protein, 19 aa, Entamoeba dispar
SRGIFRIHQDLLWGSIVNH

SEQ ID NO: 2390596 - protein, 25 aa, Entamoeba dispar
SRGVMYKCLCVISMGLKDAKLWEYA

SEQ ID NO: 2390597 - protein, 22 aa, Entamoeba dispar
SRICRKEFAKFCNYFEQKRDEI

SEQ ID NO: 2390598 - protein, 19 aa, Entamoeba dispar
SRIIILMIRTCILILTTFC

SEQ ID NO: 2390599 - protein, 18 aa, Entamoeba dispar
SRIIPLNGKVYFPKDILQ

SEQ ID NO: 2390600 - protein, 17 aa, Entamoeba dispar
SRIKKYIVIIFAIIIGS

SEQ ID NO: 2390601 - protein, 20 aa, Entamoeba dispar
SRIRLDIMPFAIKRFEEIIK

SEQ ID NO: 2390602 - protein, 22 aa, Entamoeba dispar
SRIRYGYGNSFEFQDLKSSGIC

SEQ ID NO: 2390603 - protein, 21 aa, Entamoeba dispar
SRITQAGGFVLNERVNGNLNL

SEQ ID NO: 2390604 - protein, 20 aa, Entamoeba dispar
SRKICLYSYFPCLIQPICKR

SEQ ID NO: 2390605 - protein, 21 aa, Entamoeba dispar
SRKLSSLSFLPLGHVFAIVME

SEQ ID NO: 2390606 - protein, 21 aa, Entamoeba dispar
SRLIYPFIWQHVLIPILPPDM

SEQ ID NO: 2390607 - protein, 37 aa, Entamoeba dispar
SRLVEYYKKMEINFFKARVALVLGIIFNFFEDSKTSE

SEQ ID NO: 2390608 - protein, 26 aa, Entamoeba dispar
SRMCRFWTMWSCWGCAFYFFVAFCKQ

SEQ ID NO: 2390609 - protein, 21 aa, Entamoeba dispar
SRMDRSEISGFLYSNGQKQSK

SEQ ID NO: 2390610 - protein, 17 aa, Entamoeba dispar
SRMGCLATILPNININK

SEQ ID NO: 2390611 - protein, 20 aa, Entamoeba dispar
SRNKALWCLTNLLCHKKFSY

SEQ ID NO: 2390612 - protein, 17 aa, Entamoeba dispar
SRNTLRIIEKMRQVNVI

SEQ ID NO: 2390613 - protein, 19 aa, Entamoeba dispar
SRSCKSCLTNCALCTEAYN

SEQ ID NO: 2390614 - protein, 29 aa, Entamoeba dispar
SRSKCGVIADGLKGKWFVYTPKDTEKVSI

SEQ ID NO: 2390615 - protein, 24 aa, Entamoeba dispar
SRSSSSLTKTCHRAITSMSISPST

SEQ ID NO: 2390616 - protein, 18 aa, Entamoeba dispar
SRTKEIIVMNAVSSTFME

SEQ ID NO: 2390617 - protein, 17 aa, Entamoeba dispar
SRVKLLGAIQHCETRDV

SEQ ID NO: 2390618 - protein, 20 aa, Entamoeba dispar
SRVNKDFMIFGGVIDGFNAS

SEQ ID NO: 2390619 - protein, 27 aa, Entamoeba dispar
SRVQCFEPMFNPQLCAMNCNGISQMIA

SEQ ID NO: 2390620 - protein, 24 aa, Entamoeba dispar
SRYDCLYPDIQFMRGVRETFVSAL

SEQ ID NO: 2390621 - protein, 18 aa, Entamoeba dispar
SRYFSILISRSFSIYIFI

SEQ ID NO: 2390622 - protein, 24 aa, Entamoeba dispar
SSADLPKFPAIFKGVEFSTNEVVK

SEQ ID NO: 2390623 - protein, 17 aa, Entamoeba dispar
SSAEQFLPIIVSLLASN

SEQ ID NO: 2390624 - protein, 24 aa, Entamoeba dispar
SSALRLLVPSTWYSKDFINDALII

SEQ ID NO: 2390625 - protein, 19 aa, Entamoeba dispar
SSAMKGWKNPAFGEWCIQK

SEQ ID NO: 2390626 - protein, 24 aa, Entamoeba dispar
SSARSLYAAALWYLDDWNEFDSIV

SEQ ID NO: 2390627 - protein, 34 aa, Entamoeba dispar
SSATRLKRAMWWKNIKLYLIAGAILLIFLLVLLW

SEQ ID NO: 2390628 - protein, 22 aa, Entamoeba dispar
SSCCLFLSFVLLFPFTSSFFSL

SEQ ID NO: 2390629 - protein, 17 aa, Entamoeba dispar
SSCIKLFSFHVISLLVL

SEQ ID NO: 2390630 - protein, 25 aa, Entamoeba dispar
SSCKANFCTENDWSFEGEIVGFADY

SEQ ID NO: 2390631 - protein, 19 aa, Entamoeba dispar
SSCLNTSIQCLSCSDPNKI

SEQ ID NO: 2390632 - protein, 21 aa, Entamoeba dispar
SSCNSYRPLTMNDDSEICGNT

SEQ ID NO: 2390633 - protein, 17 aa, Entamoeba dispar
SSDFAFVDEMNWFEILL

SEQ ID NO: 2390634 - protein, 26 aa, Entamoeba dispar
SSDQFKMPWDIAKFVIAGKRLERKDN

SEQ ID NO: 2390635 - protein, 26 aa, Entamoeba dispar
SSDRIFKSDLSNVMFTGSGPLTLNNF

SEQ ID NO: 2390636 - protein, 23 aa, Entamoeba dispar
SSDSLCCAVTFFYFHYLFNLWGN

SEQ ID NO: 2390637 - protein, 25 aa, Entamoeba dispar
SSDYSFPSTIIILWSNFIVTLTKSD

SEQ ID NO: 2390638 - protein, 24 aa, Entamoeba dispar
SSEAPPLFLFFKCSDNIALDEARK

SEQ ID NO: 2390639 - protein, 24 aa, Entamoeba dispar
SSEARYLFPEKIHYVPTIIQRLDR

SEQ ID NO: 2390640 - protein, 24 aa, Entamoeba dispar
SSEIDWVILICRALMTIVVCIAYP

SEQ ID NO: 2390641 - protein, 25 aa, Entamoeba dispar
SSEKRSAKSYDHFFPINKMWDKNGV

SEQ ID NO: 2390642 - protein, 19 aa, Entamoeba dispar
SSENIWLDRQIYGEGQGLF

SEQ ID NO: 2390643 - protein, 24 aa, Entamoeba dispar
SSESENGWLFEIFGYKTLKQLAKK

SEQ ID NO: 2390644 - protein, 25 aa, Entamoeba dispar
SSESFPLELSNIIPDFHLNRGQFSS

SEQ ID NO: 2390645 - protein, 19 aa, Entamoeba dispar
SSFDKKICHGIDLNEQKTK

SEQ ID NO: 2390646 - protein, 17 aa, Entamoeba dispar
SSFEAPLAFMSMSLLHF

SEQ ID NO: 2390647 - protein, 30 aa, Entamoeba dispar
SSFFIVSFILCCIACFGVFIFQPTFSCDVS

SEQ ID NO: 2390648 - protein, 18 aa, Entamoeba dispar
SSFIFNVLLELFLSICWL

SEQ ID NO: 2390649 - protein, 19 aa, Entamoeba dispar
SSFIPKLQQIHAFSSRFWP

SEQ ID NO: 2390650 - protein, 19 aa, Entamoeba dispar
SSFLRIFATLTIVLLPSCY

SEQ ID NO: 2390651 - protein, 18 aa, Entamoeba dispar
SSFLSRIFIGKKVRYGQL

SEQ ID NO: 2390652 - protein, 18 aa, Entamoeba dispar
SSFNEAWQYPIKLFVHLI

SEQ ID NO: 2390653 - protein, 20 aa, Entamoeba dispar
SSFPTRRLTLDTSQINTLSS

SEQ ID NO: 2390654 - protein, 20 aa, Entamoeba dispar
SSFSDFTIDLDVDFTQSFNW

SEQ ID NO: 2390655 - protein, 23 aa, Entamoeba dispar
SSFYRLGFKGTYEGDCFGFLFDE

SEQ ID NO: 2390656 - protein, 38 aa, Entamoeba dispar
SSGSPTRLCYWLSTILRLYAMIHLARFDPKRKRLSEMC

SEQ ID NO: 2390657 - protein, 26 aa, Entamoeba dispar
SSGVTDHCKSCLQKGNTITCTSCQEG

SEQ ID NO: 2390658 - protein, 17 aa, Entamoeba dispar
SSHFFRDTIPIIASLAA

SEQ ID NO: 2390659 - protein, 17 aa, Entamoeba dispar
SSHTKCYVSTKMFFELF

SEQ ID NO: 2390660 - protein, 19 aa, Entamoeba dispar
SSIFIGFLMAVSFIMIMTM

SEQ ID NO: 2390661 - protein, 24 aa, Entamoeba dispar
SSIFWNFPRTCLTGFMFNFASYFY

SEQ ID NO: 2390662 - protein, 24 aa, Entamoeba dispar
SSIIPISVIITIEIARNIQKRNIE

SEQ ID NO: 2390663 - protein, 17 aa, Entamoeba dispar
SSIKHILNLLIGDKKRI

SEQ ID NO: 2390664 - protein, 25 aa, Entamoeba dispar
SSILQNLHFFFGFGKVINTKMIEST

SEQ ID NO: 2390665 - protein, 18 aa, Entamoeba dispar
SSKAKEGNAFFSGLFGKR

SEQ ID NO: 2390666 - protein, 18 aa, Entamoeba dispar
SSKQWKSVSYNSGSSLSL

SEQ ID NO: 2390667 - protein, 20 aa, Entamoeba dispar
SSLCRDKFKHLYDFNLIEAV

SEQ ID NO: 2390668 - protein, 18 aa, Entamoeba dispar
SSLDGMFDLTISKFTNVP

SEQ ID NO: 2390669 - protein, 27 aa, Entamoeba dispar
SSLILKNESLINWIVLDSIVTTKETIP

SEQ ID NO: 2390670 - protein, 17 aa, Entamoeba dispar
SSLLFWAYLTSLFTLSI

SEQ ID NO: 2390671 - protein, 24 aa, Entamoeba dispar
SSLLKIREFFFISAMTGSVVMLVI

SEQ ID NO: 2390672 - protein, 24 aa, Entamoeba dispar
SSLLLCGGLTMLAYILFPTLPQKN

SEQ ID NO: 2390673 - protein, 20 aa, Entamoeba dispar
SSLLSLPLMKLIKVTSLSLT

SEQ ID NO: 2390674 - protein, 26 aa, Entamoeba dispar
SSLNRCFPCTLLASQLCQKDNGISSC

SEQ ID NO: 2390675 - protein, 18 aa, Entamoeba dispar
SSLPSFVEAVNCTEFQMG

SEQ ID NO: 2390676 - protein, 28 aa, Entamoeba dispar
SSLQRIPTCMGMALTCRPNLQRIAHRLI

SEQ ID NO: 2390677 - protein, 17 aa, Entamoeba dispar
SSLRFISNFYMIVSAQT

SEQ ID NO: 2390678 - protein, 17 aa, Entamoeba dispar
SSLRGLVKVILELFSQW

SEQ ID NO: 2390679 - protein, 40 aa, Entamoeba dispar
SSLSLFFLHFWRSCLIFIVLPSFYIFKIITFVSLITGITG

SEQ ID NO: 2390680 - protein, 29 aa, Entamoeba dispar
SSMKLYPSQFIWFRHIYLAFSTYTKLNQL

SEQ ID NO: 2390681 - protein, 24 aa, Entamoeba dispar
SSNHPNGWFKLGIIKQYLDNDNRY

SEQ ID NO: 2390682 - protein, 18 aa, Entamoeba dispar
SSNNELYYTNSLKMKLSI

SEQ ID NO: 2390683 - protein, 24 aa, Entamoeba dispar
SSNQNFWFVVIIIFLLTVILFLIA

SEQ ID NO: 2390684 - protein, 23 aa, Entamoeba dispar
SSNRQNFMLAIDRFLGNSGDEQL

SEQ ID NO: 2390685 - protein, 23 aa, Entamoeba dispar
SSPIIRRMIYIFGKLLEIMNKST

SEQ ID NO: 2390686 - protein, 19 aa, Entamoeba dispar
SSPPFNCFSPNFYSKNLDS

SEQ ID NO: 2390687 - protein, 25 aa, Entamoeba dispar
SSQFYPLRLVRDYIATLIIESHSPS

SEQ ID NO: 2390688 - protein, 20 aa, Entamoeba dispar
SSQINWKVISVIGPYHSGKS

SEQ ID NO: 2390689 - protein, 25 aa, Entamoeba dispar
SSQTSFRLLFKMIKIVEYIHSKQII

SEQ ID NO: 2390690 - protein, 24 aa, Entamoeba dispar
SSRCGQCLEITGPTQRPFVCMIAG

SEQ ID NO: 2390691 - protein, 19 aa, Entamoeba dispar
SSRIKCYLFVKNLLRCIIE

SEQ ID NO: 2390692 - protein, 24 aa, Entamoeba dispar
SSRNTHLFFLKPLVPIQLTEIFIE

SEQ ID NO: 2390693 - protein, 22 aa, Entamoeba dispar
SSRSFKELMNIILVTGNYLNAD

SEQ ID NO: 2390694 - protein, 25 aa, Entamoeba dispar
SSSDFIIHNALEFLLEYCSKKGIVA

SEQ ID NO: 2390695 - protein, 24 aa, Entamoeba dispar
SSSFLIDRLEIWTPTLPVSVPTSL

SEQ ID NO: 2390696 - protein, 17 aa, Entamoeba dispar
SSSFTISWNSIISPNGF

SEQ ID NO: 2390697 - protein, 19 aa, Entamoeba dispar
SSSGPFILSYGGKDKSFTV

SEQ ID NO: 2390698 - protein, 20 aa, Entamoeba dispar
SSSLECCPLPSFDIIFTDSF

SEQ ID NO: 2390699 - protein, 23 aa, Entamoeba dispar
SSSRCLKCKEGITMINNYCIYVP

SEQ ID NO: 2390700 - protein, 19 aa, Entamoeba dispar
SSSSLWMRVPLYLLQDYPR

SEQ ID NO: 2390701 - protein, 26 aa, Entamoeba dispar
SSSTLPFIISNTIKFTSINIPTITSD

SEQ ID NO: 2390702 - protein, 24 aa, Entamoeba dispar
SSSVPTWACIIIGYVPPVLVILLM

SEQ ID NO: 2390703 - protein, 23 aa, Entamoeba dispar
SSTAFVCPEVITCVNYVDDKSSN

SEQ ID NO: 2390704 - protein, 21 aa, Entamoeba dispar
SSTALKWLCYATNSNIKNAMT

SEQ ID NO: 2390705 - protein, 23 aa, Entamoeba dispar
SSTEPLSEICHFSGQPQTFTEDN

SEQ ID NO: 2390706 - protein, 19 aa, Entamoeba dispar
SSTGISGWSIYGGSNACVI

SEQ ID NO: 2390707 - protein, 24 aa, Entamoeba dispar
SSTLCSFAVYLLIGLFGYFSLTPN

SEQ ID NO: 2390708 - protein, 19 aa, Entamoeba dispar
SSTMEYLRTIPFFTPLIDK

SEQ ID NO: 2390709 - protein, 25 aa, Entamoeba dispar
SSTNLKVTCSLPFSLKKYVQEKEKK

SEQ ID NO: 2390710 - protein, 23 aa, Entamoeba dispar
SSTPKKRGMFIVAFETENTIVPQ

SEQ ID NO: 2390711 - protein, 27 aa, Entamoeba dispar
SSTSLLKMWLHFIHFCGNVANITNPDV

SEQ ID NO: 2390712 - protein, 25 aa, Entamoeba dispar
SSVEYEFVQVCSIYLAVVPKGYVIE

SEQ ID NO: 2390713 - protein, 24 aa, Entamoeba dispar
SSVKCLHSPFNIYRVSMNEPIRWR

SEQ ID NO: 2390714 - protein, 42 aa, Entamoeba dispar
SSVKCLHSPFNIYRVSMNEPIRWRKHYHSWNIFFLSGSVIFV

SEQ ID NO: 2390715 - protein, 22 aa, Entamoeba dispar
SSVSLKELWVSSKVEKILLNGN

SEQ ID NO: 2390716 - protein, 21 aa, Entamoeba dispar
SSWPFILGLVLSFLGDFFLLF

SEQ ID NO: 2390717 - protein, 19 aa, Entamoeba dispar
SSYAQFKVYIFNVGQADSQ

SEQ ID NO: 2390718 - protein, 24 aa, Entamoeba dispar
SSYHAWRYIALTGNASLIPAIDTF

SEQ ID NO: 2390719 - protein, 25 aa, Entamoeba dispar
SSYIFSIVFICFWLGSIVISLNTKF

SEQ ID NO: 2390720 - protein, 29 aa, Entamoeba dispar
STAQFKSEHVFLILQLCGSIIFYHSSGET

SEQ ID NO: 2390721 - protein, 20 aa, Entamoeba dispar
STCAGILRYIPKKWKICQLW

SEQ ID NO: 2390722 - protein, 19 aa, Entamoeba dispar
STCQCIEGYSLKDHYCIST

SEQ ID NO: 2390723 - protein, 19 aa, Entamoeba dispar
STDCPLSSINKLRLIYNSM

SEQ ID NO: 2390724 - protein, 18 aa, Entamoeba dispar
STDLFYFIAVTIVGCLAV

SEQ ID NO: 2390725 - protein, 23 aa, Entamoeba dispar
STDVLCGIGQKIGDYIIPLNYIV

SEQ ID NO: 2390726 - protein, 24 aa, Entamoeba dispar
STECLSFLNSFYLLFASSPAKLLV

SEQ ID NO: 2390727 - protein, 17 aa, Entamoeba dispar
STEERWSLDELIMALQT

SEQ ID NO: 2390728 - protein, 23 aa, Entamoeba dispar
STEEYCRCLSTFICTTFTEMHGV

SEQ ID NO: 2390729 - protein, 17 aa, Entamoeba dispar
STEHCTNCYCDKGYKSV

SEQ ID NO: 2390730 - protein, 29 aa, Entamoeba dispar
STGSKWEAFKWALISGICEPFGALTVGAL

SEQ ID NO: 2390731 - protein, 23 aa, Entamoeba dispar
STGTEINNVIAIFKSCNTQKDED

SEQ ID NO: 2390732 - protein, 25 aa, Entamoeba dispar
STHIYPRKATIWLIIVFFMITFSEF

SEQ ID NO: 2390733 - protein, 31 aa, Entamoeba dispar
STHLKVVEDIGVLKPVVFAAVPRVLQLIYGG

SEQ ID NO: 2390734 - protein, 17 aa, Entamoeba dispar
STHRFILIVLFIISTGI

SEQ ID NO: 2390735 - protein, 31 aa, Entamoeba dispar
STICLTEGIFSFIKKLFVKRTYNKIYVDKIR

SEQ ID NO: 2390736 - protein, 32 aa, Entamoeba dispar
STICYFTYSYIYRKGEKWYLPDTDNVWKQTVL

SEQ ID NO: 2390737 - protein, 24 aa, Entamoeba dispar
STIDEIRNSYLLIYTYHDQGCKNL

SEQ ID NO: 2390738 - protein, 20 aa, Entamoeba dispar
STIDLCIFNLIPFSLIYDVI

SEQ ID NO: 2390739 - protein, 24 aa, Entamoeba dispar
STIGCTIGAIIVFYITRFVVLETI

SEQ ID NO: 2390740 - protein, 17 aa, Entamoeba dispar
STIIKVYPLAILTLETQ

SEQ ID NO: 2390741 - protein, 18 aa, Entamoeba dispar
STIKCYQNTFSIISGDFS

SEQ ID NO: 2390742 - protein, 23 aa, Entamoeba dispar
STIKVCPTCVVNINGEYTESLKI

SEQ ID NO: 2390743 - protein, 25 aa, Entamoeba dispar
STILNEWRHSVVIITKCLELFTVIS

SEQ ID NO: 2390744 - protein, 22 aa, Entamoeba dispar
STINFAKCRKLSDIVITINRIQ

SEQ ID NO: 2390745 - protein, 19 aa, Entamoeba dispar
STINGGLSPLFIGGTNDMY

SEQ ID NO: 2390746 - protein, 20 aa, Entamoeba dispar
STKGCTRCFDHFYLDSDGNC

SEQ ID NO: 2390747 - protein, 30 aa, Entamoeba dispar
STKTPHRVSVFNWFWNRQSYIPSEPYSTQL

SEQ ID NO: 2390748 - protein, 24 aa, Entamoeba dispar
STLFASSVIGCWQFEHNTQNLVNT

SEQ ID NO: 2390749 - protein, 20 aa, Entamoeba dispar
STLFVAYSMVYLRLLSKGIS

SEQ ID NO: 2390750 - protein, 17 aa, Entamoeba dispar
STLFYISAINWEEPNII

SEQ ID NO: 2390751 - protein, 18 aa, Entamoeba dispar
STLLILLVDFSRWYLNDH

SEQ ID NO: 2390752 - protein, 24 aa, Entamoeba dispar
STLLLCLLVSIIFYFIPIIIGYNS

SEQ ID NO: 2390753 - protein, 25 aa, Entamoeba dispar
STLQLSGSMTYHFIGVPIIFQSLSL

SEQ ID NO: 2390754 - protein, 18 aa, Entamoeba dispar
STNEYCVVLLKALQGLIP

SEQ ID NO: 2390755 - protein, 23 aa, Entamoeba dispar
STNIFDTRFENIIIKNHSKKKWL

SEQ ID NO: 2390756 - protein, 19 aa, Entamoeba dispar
STNKVCVKKFFKSKAGIIL

SEQ ID NO: 2390757 - protein, 20 aa, Entamoeba dispar
STNLKICFNSGFTDVTSCMS

SEQ ID NO: 2390758 - protein, 18 aa, Entamoeba dispar
STNYDWKRLRCFHFSLKE

SEQ ID NO: 2390759 - protein, 19 aa, Entamoeba dispar
STPVGWIIFGVLFYILFVI

SEQ ID NO: 2390760 - protein, 18 aa, Entamoeba dispar
STRLMAINIILLCTYFFQ

SEQ ID NO: 2390761 - protein, 21 aa, Entamoeba dispar
STRNCKLCDANSCFSCLENSY

SEQ ID NO: 2390762 - protein, 20 aa, Entamoeba dispar
STRTAGFAILDFSKISSGCY

SEQ ID NO: 2390763 - protein, 18 aa, Entamoeba dispar
STSKYKYNYAYRIAQIPV

SEQ ID NO: 2390764 - protein, 20 aa, Entamoeba dispar
STSLQVPIHFNRIDSSKSNK

SEQ ID NO: 2390765 - protein, 21 aa, Entamoeba dispar
STSVVKGRGVGVVVATGKVTE

SEQ ID NO: 2390766 - protein, 18 aa, Entamoeba dispar
STTCLICDDNYYLNTEGS

SEQ ID NO: 2390767 - protein, 21 aa, Entamoeba dispar
STTIQFFKFINTIMKINAITG

SEQ ID NO: 2390768 - protein, 19 aa, Entamoeba dispar
STTLPNICINKKAYSPFEK

SEQ ID NO: 2390769 - protein, 20 aa, Entamoeba dispar
STTMIGWNCFLQVGTNMLIT

SEQ ID NO: 2390770 - protein, 18 aa, Entamoeba dispar
STTVDCFELASSNSPFSD

SEQ ID NO: 2390771 - protein, 22 aa, Entamoeba dispar
STVEKYIGYGLFVFDHILLIID

SEQ ID NO: 2390772 - protein, 25 aa, Entamoeba dispar
STVGFSIVRYPSWVFFGMNYVAYLM

SEQ ID NO: 2390773 - protein, 18 aa, Entamoeba dispar
STVKCLEPYCSGNNCAFR

SEQ ID NO: 2390774 - protein, 19 aa, Entamoeba dispar
STWNVIRKVVMLVLSCVLL

SEQ ID NO: 2390775 - protein, 23 aa, Entamoeba dispar
STYCMSCPSGGYVLSENTCYLGN

SEQ ID NO: 2390776 - protein, 26 aa, Entamoeba dispar
STYFDEVFKGLILFHFLCHNGNGIIF

SEQ ID NO: 2390777 - protein, 25 aa, Entamoeba dispar
SVAIWPFCTAFYWPVTTGTVGFEAP

SEQ ID NO: 2390778 - protein, 23 aa, Entamoeba dispar
SVCPNSRGSVEWLNDNILHDYKK

SEQ ID NO: 2390779 - protein, 23 aa, Entamoeba dispar
SVDGCSLPPVSLNINDVIDISQC

SEQ ID NO: 2390780 - protein, 23 aa, Entamoeba dispar
SVEEYLLRVGEFVHEVYSIQFQP

SEQ ID NO: 2390781 - protein, 26 aa, Entamoeba dispar
SVEIKEIPDYIGYFGLDKDDNKCSHQ

SEQ ID NO: 2390782 - protein, 18 aa, Entamoeba dispar
SVEIPHLQQLILLQYLFK

SEQ ID NO: 2390783 - protein, 23 aa, Entamoeba dispar
SVFLCGIPSLLAIIIAVTRTRDH

SEQ ID NO: 2390784 - protein, 24 aa, Entamoeba dispar
SVFRDILMRFVVYFSTRAETKSEF

SEQ ID NO: 2390785 - protein, 17 aa, Entamoeba dispar
SVGFAATYMADFGNAKV

SEQ ID NO: 2390786 - protein, 20 aa, Entamoeba dispar
SVGIHPVYELGRCYNVLQGI

SEQ ID NO: 2390787 - protein, 23 aa, Entamoeba dispar
SVGKEIREILCIANITKKTIKVQ

SEQ ID NO: 2390788 - protein, 18 aa, Entamoeba dispar
SVGLSCRLFVSGQKMIYF

SEQ ID NO: 2390789 - protein, 27 aa, Entamoeba dispar
SVGSIQRGGAVSVYFDNYLVSTKDRFK

SEQ ID NO: 2390790 - protein, 26 aa, Entamoeba dispar
SVHFLLCGISMIFFILHLHEIFKTFI

SEQ ID NO: 2390791 - protein, 23 aa, Entamoeba dispar
SVIIGSIILLFAIVIISSSILVL

SEQ ID NO: 2390792 - protein, 23 aa, Entamoeba dispar
SVIKMTIGPIIGFFLQPIIGALS

SEQ ID NO: 2390793 - protein, 18 aa, Entamoeba dispar
SVILRINQKISYGIIILI

SEQ ID NO: 2390794 - protein, 22 aa, Entamoeba dispar
SVIPAISSKSIRTWIACNDSNL

SEQ ID NO: 2390795 - protein, 25 aa, Entamoeba dispar
SVISSFPLYRCFELIQIIKEPVLYF

SEQ ID NO: 2390796 - protein, 18 aa, Entamoeba dispar
SVKEDWCSLVDSKNGYIP

SEQ ID NO: 2390797 - protein, 24 aa, Entamoeba dispar
SVLCQKCKEGSVLINNVCYISQDI

SEQ ID NO: 2390798 - protein, 19 aa, Entamoeba dispar
SVLKRSLCELLDGVCINGL

SEQ ID NO: 2390799 - protein, 18 aa, Entamoeba dispar
SVLMYLISIIVLRPTFEP

SEQ ID NO: 2390800 - protein, 18 aa, Entamoeba dispar
SVLSLSLKGGFDLLSQKL

SEQ ID NO: 2390801 - protein, 17 aa, Entamoeba dispar
SVLYHCLKIMSILMAPF

SEQ ID NO: 2390802 - protein, 18 aa, Entamoeba dispar
SVLYRFIFSSDINTFQKL

SEQ ID NO: 2390803 - protein, 24 aa, Entamoeba dispar
SVMDRRMTDCLKKIDGEKKLVEYI

SEQ ID NO: 2390804 - protein, 25 aa, Entamoeba dispar
SVMKEVMEEIRLLKKLKHQHIVRYI

SEQ ID NO: 2390805 - protein, 20 aa, Entamoeba dispar
SVMLCGMGVILISENISTAT

SEQ ID NO: 2390806 - protein, 18 aa, Entamoeba dispar
SVNHKLALAMHYAMGYIS

SEQ ID NO: 2390807 - protein, 25 aa, Entamoeba dispar
SVPSPWLQVRILRTLRYITPKKGAE

SEQ ID NO: 2390808 - protein, 20 aa, Entamoeba dispar
SVRENICFLSPYKKEQYDKS

SEQ ID NO: 2390809 - protein, 17 aa, Entamoeba dispar
SVRKAYEKRGIKELFEW

SEQ ID NO: 2390810 - protein, 21 aa, Entamoeba dispar
SVSAPYKLSIEKLGSDSSEIV

SEQ ID NO: 2390811 - protein, 30 aa, Entamoeba dispar
SVSGGFRPICKLFICCVMMFGKHRGFPERV

SEQ ID NO: 2390812 - protein, 17 aa, Entamoeba dispar
SVSRCSFDSFKLKCENL

SEQ ID NO: 2390813 - protein, 35 aa, Entamoeba dispar
SVSSLLYFISVFSLFMKYHFPIYFSIEPSTLSLLL

SEQ ID NO: 2390814 - protein, 26 aa, Entamoeba dispar
SVTLKIWDMFLLEGFVWLVKVSSALL

SEQ ID NO: 2390815 - protein, 38 aa, Entamoeba dispar
SVVGMKRVLKYLVYWLLNGTVCIANFFATERQVDCLSF

SEQ ID NO: 2390816 - protein, 19 aa, Entamoeba dispar
SVVIPMCYVDSQPDEEDDN

SEQ ID NO: 2390817 - protein, 19 aa, Entamoeba dispar
SVVMSEYFIVSPLNKGNES

SEQ ID NO: 2390818 - protein, 25 aa, Entamoeba dispar
SVVTDQFFFEWSLKLVIDRNNKEIS

SEQ ID NO: 2390819 - protein, 17 aa, Entamoeba dispar
SVYCFKQYVNYDKKEMY

SEQ ID NO: 2390820 - protein, 19 aa, Entamoeba dispar
SVYNFKILYIDNVPYYGIL

SEQ ID NO: 2390821 - protein, 17 aa, Entamoeba dispar
SVYSFKFNKEMDFFVDI

SEQ ID NO: 2390822 - protein, 22 aa, Entamoeba dispar
SVYWSLPIILIFVSLKYGSNSI

SEQ ID NO: 2390823 - protein, 32 aa, Entamoeba dispar
SVYYFLKRIISYNCLPSFLTTLLHTSHENGLR

SEQ ID NO: 2390824 - protein, 19 aa, Entamoeba dispar
SWGTFFFDLHIVCFFIPLG

SEQ ID NO: 2390825 - protein, 29 aa, Entamoeba dispar
SWIMLLKFHISFLFSIQFEKLENLIYSVI

SEQ ID NO: 2390826 - protein, 33 aa, Entamoeba dispar
SWLFIFRIVPMLVIFMICLARAVIPLCYGLMNS

SEQ ID NO: 2390827 - protein, 20 aa, Entamoeba dispar
SWLMFISYIFVCLNCGGIYL

SEQ ID NO: 2390828 - protein, 18 aa, Entamoeba dispar
SWLSPRKLLQSSKSNTLC

SEQ ID NO: 2390829 - protein, 21 aa, Entamoeba dispar
SWQLAHVDLSWSLTQPQNNYQ

SEQ ID NO: 2390830 - protein, 25 aa, Entamoeba dispar
SWSSWLIGGSCGIILGLSNNIIYKL

SEQ ID NO: 2390831 - protein, 21 aa, Entamoeba dispar
SWVIPVINGIVYKDISQKLPI

SEQ ID NO: 2390832 - protein, 18 aa, Entamoeba dispar
SYCGNCVYSSTNKKVVCT

SEQ ID NO: 2390833 - protein, 17 aa, Entamoeba dispar
SYCMFVIVQSFPNVVRQ

SEQ ID NO: 2390834 - protein, 26 aa, Entamoeba dispar
SYDELKYPYCWDLIKDFLVIFFLIIV

SEQ ID NO: 2390835 - protein, 25 aa, Entamoeba dispar
SYEGGPLPWYLNKGLYFTNITLRNR

SEQ ID NO: 2390836 - protein, 24 aa, Entamoeba dispar
SYFILKRRFNLIQIFSAVIALSGF

SEQ ID NO: 2390837 - protein, 17 aa, Entamoeba dispar
SYFRFNTHVPLQLTIRT

SEQ ID NO: 2390838 - protein, 25 aa, Entamoeba dispar
SYFSIITCSLFYLLIAVCGNLSFDK

SEQ ID NO: 2390839 - protein, 24 aa, Entamoeba dispar
SYFYRFYENLFFYFVFIFLFISVL

SEQ ID NO: 2390840 - protein, 22 aa, Entamoeba dispar
SYGCAICKNGYFVSNLTCFHCN

SEQ ID NO: 2390841 - protein, 17 aa, Entamoeba dispar
SYGGKWRKYAIVSCAVF

SEQ ID NO: 2390842 - protein, 19 aa, Entamoeba dispar
SYGGPCFNLLIGLGGGVLA

SEQ ID NO: 2390843 - protein, 19 aa, Entamoeba dispar
SYGLSFFGTKAFKKTDKTL

SEQ ID NO: 2390844 - protein, 18 aa, Entamoeba dispar
SYHCKKCGYCIEKRDHHC

SEQ ID NO: 2390845 - protein, 19 aa, Entamoeba dispar
SYHQCPCFILISLSHFLSI

SEQ ID NO: 2390846 - protein, 19 aa, Entamoeba dispar
SYINFPMIILFTVTITAPI

SEQ ID NO: 2390847 - protein, 21 aa, Entamoeba dispar
SYKPEVFIVLCQNNGLTVFNE

SEQ ID NO: 2390848 - protein, 26 aa, Entamoeba dispar
SYLDLFRMLITFIGNSIGFVRMIRTG

SEQ ID NO: 2390849 - protein, 19 aa, Entamoeba dispar
SYLFIVSIISCFYQTYCNV

SEQ ID NO: 2390850 - protein, 23 aa, Entamoeba dispar
SYLGIKDMLPFVVTQYQISSIER

SEQ ID NO: 2390851 - protein, 20 aa, Entamoeba dispar
SYLLEGFASVPERSILQNDI

SEQ ID NO: 2390852 - protein, 42 aa, Entamoeba dispar
SYLLPSCTFFLGFSFIFGNYMKRVWESLVLVIFIRPFDIGDR

SEQ ID NO: 2390853 - protein, 27 aa, Entamoeba dispar
SYLRIKALCGFSPFVISSYTQRGGHCI

SEQ ID NO: 2390854 - protein, 18 aa, Entamoeba dispar
SYMSFDFSFYDSKLKTSL

SEQ ID NO: 2390855 - protein, 18 aa, Entamoeba dispar
SYNEALCPCHYSDPKGEQ

SEQ ID NO: 2390856 - protein, 24 aa, Entamoeba dispar
SYPMKKGESVYVFVAAHSNVDTGL

SEQ ID NO: 2390857 - protein, 22 aa, Entamoeba dispar
SYQCISCSPTTVFLKGSCIIPE

SEQ ID NO: 2390858 - protein, 24 aa, Entamoeba dispar
SYQFKAACHGIVLTNLEDKDIACP

SEQ ID NO: 2390859 - protein, 25 aa, Entamoeba dispar
SYQLKIKFLDDMAVALSYLHQNQII

SEQ ID NO: 2390860 - protein, 34 aa, Entamoeba dispar
SYRLLGLCLHFKIPFELQIAVGFFVFLFANTFIW

SEQ ID NO: 2390861 - protein, 18 aa, Entamoeba dispar
SYRRPPVSLLIQHITNLK

SEQ ID NO: 2390862 - protein, 17 aa, Entamoeba dispar
SYSCLSCGEGIINGTCV

SEQ ID NO: 2390863 - protein, 24 aa, Entamoeba dispar
SYSMLICIFAPFKQKINEPSESPL

SEQ ID NO: 2390864 - protein, 26 aa, Entamoeba dispar
SYSSIKLYLVIGICIVISLTSLYLFQ

SEQ ID NO: 2390865 - protein, 30 aa, Entamoeba dispar
SYSVFEMFWRMAFILFSSFCCMLYLSSIKG

SEQ ID NO: 2390866 - protein, 21 aa, Entamoeba dispar
SYSVFLKWYNTTSICGSYRSL

SEQ ID NO: 2390867 - protein, 24 aa, Entamoeba dispar
SYTLKCRPIICPNSSFVEQLKGYE

SEQ ID NO: 2390868 - protein, 21 aa, Entamoeba dispar
SYVFPCAFVLASRRISVARNG

SEQ ID NO: 2390869 - protein, 24 aa, Entamoeba dispar
SYVIDFLITFLVDYQKYVLKIFML

SEQ ID NO: 2390870 - protein, 20 aa, Entamoeba dispar
SYVLVPLRLLMKSFGLKRVY

SEQ ID NO: 2390871 - protein, 21 aa, Entamoeba dispar
SYWYIYMIIGICILFIILIFV

SEQ ID NO: 2390872 - protein, 26 aa, Entamoeba dispar
SYYLAQNLTNIWAFSSEHKYDFVDSR

SEQ ID NO: 2390873 - protein, 26 aa, Entamoeba dispar
SYYTLQMAKSWYSQRLDWLGVGLAII

SEQ ID NO: 2390874 - protein, 25 aa, Entamoeba dispar
TACVWLVMIIIEFCWAGHGEKLSWW

SEQ ID NO: 2390875 - protein, 26 aa, Entamoeba dispar
TAGIACGWHYILLILVAVCLNFPFII

SEQ ID NO: 2390876 - protein, 20 aa, Entamoeba dispar
TAIINPKIPYYIFVHSRYAS

SEQ ID NO: 2390877 - protein, 28 aa, Entamoeba dispar
TAIKVLKKSFGFKEVLTIITSYNPQLNL

SEQ ID NO: 2390878 - protein, 21 aa, Entamoeba dispar
TAIRWFLPLLSLSMKLSSIYQ

SEQ ID NO: 2390879 - protein, 22 aa, Entamoeba dispar
TALLCGVPWAFFLHKFGPKRAL

SEQ ID NO: 2390880 - protein, 20 aa, Entamoeba dispar
TAPLPWHKVITLQRGADTTI

SEQ ID NO: 2390881 - protein, 21 aa, Entamoeba dispar
TAPQTISWLFIFRIVPMLVIF

SEQ ID NO: 2390882 - protein, 20 aa, Entamoeba dispar
TAQALSYEFSRTMMISRGTY

SEQ ID NO: 2390883 - protein, 18 aa, Entamoeba dispar
TAQEWYKNKESILQEFAP

SEQ ID NO: 2390884 - protein, 22 aa, Entamoeba dispar
TARIWGSMCCILYAIIFLIFGM

SEQ ID NO: 2390885 - protein, 18 aa, Entamoeba dispar
TARRVVDSAIVWQTQHSG

SEQ ID NO: 2390886 - protein, 19 aa, Entamoeba dispar
TARVHIAWIQRMIEEYVSY

SEQ ID NO: 2390887 - protein, 18 aa, Entamoeba dispar
TARYLVYRMNKWHYFLLD

SEQ ID NO: 2390888 - protein, 18 aa, Entamoeba dispar
TASFIRSHTPLTVFRYIS

SEQ ID NO: 2390889 - protein, 25 aa, Entamoeba dispar
TASFKEKFGRIALLKMVELKEPKRD

SEQ ID NO: 2390890 - protein, 18 aa, Entamoeba dispar
TASTCGTESNLLTNISLL

SEQ ID NO: 2390891 - protein, 17 aa, Entamoeba dispar
TATKCCLPYLKFEENAI

SEQ ID NO: 2390892 - protein, 21 aa, Entamoeba dispar
TATQWRGLATLVLAVITVESA

SEQ ID NO: 2390893 - protein, 31 aa, Entamoeba dispar
TATSCIFGLLSLFYPFSWPGIFIPYIPDELF

SEQ ID NO: 2390894 - protein, 19 aa, Entamoeba dispar
TAVIRHLICLIDISKNVPE

SEQ ID NO: 2390895 - protein, 17 aa, Entamoeba dispar
TAWELFYGEEPYKEFKS

SEQ ID NO: 2390896 - protein, 27 aa, Entamoeba dispar
TCAGILRYIPKQWKFMTIWNGRLSILV

SEQ ID NO: 2390897 - protein, 17 aa, Entamoeba dispar
TCCSEGKVFNGIIKLAI

SEQ ID NO: 2390898 - protein, 17 aa, Entamoeba dispar
TCFKNASFCTSCPTDYY

SEQ ID NO: 2390899 - protein, 24 aa, Entamoeba dispar
TCHDRYGEMYNIFELNHLKTNKPL

SEQ ID NO: 2390900 - protein, 17 aa, Entamoeba dispar
TCIFSIYLFIKALEETL

SEQ ID NO: 2390901 - protein, 31 aa, Entamoeba dispar
TCISCSILSGCKRCSNAFACTECNSNYYLDG

SEQ ID NO: 2390902 - protein, 18 aa, Entamoeba dispar
TCIVAYLFGSRVHSDKAG

SEQ ID NO: 2390903 - protein, 20 aa, Entamoeba dispar
TCIYCVPCFGLVFTLLLFHI

SEQ ID NO: 2390904 - protein, 18 aa, Entamoeba dispar
TCKPGYTLNSGICSLCGN

SEQ ID NO: 2390905 - protein, 24 aa, Entamoeba dispar
TCKTALEFNAPFTLVEYKPNTGKT

SEQ ID NO: 2390906 - protein, 22 aa, Entamoeba dispar
TCKTALEFNAPFTVVEYKPNTG

SEQ ID NO: 2390907 - protein, 20 aa, Entamoeba dispar
TCNIGWKLLTIWWTVSTLRL

SEQ ID NO: 2390908 - protein, 26 aa, Entamoeba dispar
TCNSGGCISCADSSYLFDGQCIPCSN

SEQ ID NO: 2390909 - protein, 18 aa, Entamoeba dispar
TCPDSTPLLGERYYQGNG

SEQ ID NO: 2390910 - protein, 17 aa, Entamoeba dispar
TCPNGYYLNEDTWKCYI

SEQ ID NO: 2390911 - protein, 22 aa, Entamoeba dispar
TCQKEQCSIPYIPQTSFDCSNE

SEQ ID NO: 2390912 - protein, 29 aa, Entamoeba dispar
TCSFITKGLKEWGGAIIVGFDGDPNGKDE

SEQ ID NO: 2390913 - protein, 20 aa, Entamoeba dispar
TCSFLQAIIIILSSLIQILH

SEQ ID NO: 2390914 - protein, 18 aa, Entamoeba dispar
TCSLECEERQYSVHHVLL

SEQ ID NO: 2390915 - protein, 30 aa, Entamoeba dispar
TCSLLTKGLKEWGGAIIVGFSGDPNGKDDE

SEQ ID NO: 2390916 - protein, 17 aa, Entamoeba dispar
TCTSCKEGFYLDEITNI

SEQ ID NO: 2390917 - protein, 22 aa, Entamoeba dispar
TCTVAALMGLLGIILCVYSLIP

SEQ ID NO: 2390918 - protein, 17 aa, Entamoeba dispar
TCVCTYLSFKFFSREIN

SEQ ID NO: 2390919 - protein, 24 aa, Entamoeba dispar
TCVKLKKLVIIYVMKKVLDIAQTL

SEQ ID NO: 2390920 - protein, 19 aa, Entamoeba dispar
TCWYCDRTTNLILRVGDDW

SEQ ID NO: 2390921 - protein, 23 aa, Entamoeba dispar
TCYDRIIKPLGIFFFLSSGVYLL

SEQ ID NO: 2390922 - protein, 20 aa, Entamoeba dispar
TDARCMKEADDGCGKSSKSS

SEQ ID NO: 2390923 - protein, 17 aa, Entamoeba dispar
TDCLLEFGEIPNNIGHY

SEQ ID NO: 2390924 - protein, 33 aa, Entamoeba dispar
TDDMRWDVLISVLLCFFIAFLIMKFTRMNFCKS

SEQ ID NO: 2390925 - protein, 22 aa, Entamoeba dispar
TDEEIRELVKFCFNGISDKYYY

SEQ ID NO: 2390926 - protein, 20 aa, Entamoeba dispar
TDEFSFWRRSYTYDAQKLFC

SEQ ID NO: 2390927 - protein, 17 aa, Entamoeba dispar
TDFDCSVKEFYEKFVRN

SEQ ID NO: 2390928 - protein, 25 aa, Entamoeba dispar
TDGLQCISCTIVTPNCQICENKKCT

SEQ ID NO: 2390929 - protein, 24 aa, Entamoeba dispar
TDGYCRGTCSFFIKNLAESGSAII

SEQ ID NO: 2390930 - protein, 19 aa, Entamoeba dispar
TDICSYLRDFIVRFRVSLF

SEQ ID NO: 2390931 - protein, 23 aa, Entamoeba dispar
TDIPKKYIEIMGKVYGEMAKYPI

SEQ ID NO: 2390932 - protein, 17 aa, Entamoeba dispar
TDIQFGVCTSAKGFIEP

SEQ ID NO: 2390933 - protein, 23 aa, Entamoeba dispar
TDIYWSGCDGCYAFAAKEIAFIS

SEQ ID NO: 2390934 - protein, 17 aa, Entamoeba dispar
TDKCLKVDENLYYKYFE

SEQ ID NO: 2390935 - protein, 17 aa, Entamoeba dispar
TDKICSSNENWKWKYLI

SEQ ID NO: 2390936 - protein, 24 aa, Entamoeba dispar
TDNLEWSQWVGLIWGGIATVGCLT

SEQ ID NO: 2390937 - protein, 21 aa, Entamoeba dispar
TDPARFVFGGGNGMAGLSLDK

SEQ ID NO: 2390938 - protein, 27 aa, Entamoeba dispar
TDRLHFKSSRFYNEFIFHLDNISAVAI

SEQ ID NO: 2390939 - protein, 17 aa, Entamoeba dispar
TDSKCSKCDFWYSVSTS

SEQ ID NO: 2390940 - protein, 24 aa, Entamoeba dispar
TDSQSVCLYSMFARKIDLVCKGCI

SEQ ID NO: 2390941 - protein, 17 aa, Entamoeba dispar
TDTTCAFRDLISEAIGT

SEQ ID NO: 2390942 - protein, 17 aa, Entamoeba dispar
TDVFPLMKYWFINKQKK

SEQ ID NO: 2390943 - protein, 24 aa, Entamoeba dispar
TDVVECFLRLILMLLLSILLKTRD

SEQ ID NO: 2390944 - protein, 21 aa, Entamoeba dispar
TDWIEGIAILLAVLGVSLGGS

SEQ ID NO: 2390945 - protein, 22 aa, Entamoeba dispar
TDWIEGLAIFVAVIIVSVGSSI

SEQ ID NO: 2390946 - protein, 19 aa, Entamoeba dispar
TDYLGSLIIPSGKLYVHSN

SEQ ID NO: 2390947 - protein, 17 aa, Entamoeba dispar
TECTISGCIQCDLNNIL

SEQ ID NO: 2390948 - protein, 25 aa, Entamoeba dispar
TEDFLKFYLEMVSTILNEWRHSVVI

SEQ ID NO: 2390949 - protein, 17 aa, Entamoeba dispar
TEEFVLGEWTFEYYMGD

SEQ ID NO: 2390950 - protein, 22 aa, Entamoeba dispar
TEEGIKLLIKYCDNADYEEIKE

SEQ ID NO: 2390951 - protein, 23 aa, Entamoeba dispar
TEEGKCRCNPGFGGDDCHKLCYY

SEQ ID NO: 2390952 - protein, 22 aa, Entamoeba dispar
TEEMKKFLAGLIKINDQNLNEI

SEQ ID NO: 2390953 - protein, 19 aa, Entamoeba dispar
TEETLRYLWESHFMLFIPL

SEQ ID NO: 2390954 - protein, 22 aa, Entamoeba dispar
TEGCGSLARLYYDKFIVGEEYY

SEQ ID NO: 2390955 - protein, 27 aa, Entamoeba dispar
TEGNPDLYGPLWIPLTVVFLAFFSGSL

SEQ ID NO: 2390956 - protein, 17 aa, Entamoeba dispar
TEHCEYYGTFSCIKCES

SEQ ID NO: 2390957 - protein, 29 aa, Entamoeba dispar
TEHEVNDLLKIRMCDNIAQAMDYLHNKQI

SEQ ID NO: 2390958 - protein, 18 aa, Entamoeba dispar
TEHKRPLLFTKLANLVHR

SEQ ID NO: 2390959 - protein, 19 aa, Entamoeba dispar
TEICWTFSIFLEAVAILPQ

SEQ ID NO: 2390960 - protein, 22 aa, Entamoeba dispar
TEIIPFYSLWATIFGGFSSMIL

SEQ ID NO: 2390961 - protein, 22 aa, Entamoeba dispar
TEIPNKIRIKFMIDGANGISYL

SEQ ID NO: 2390962 - protein, 23 aa, Entamoeba dispar
TEIPNKIRIKIMIDGAKGISYLH

SEQ ID NO: 2390963 - protein, 20 aa, Entamoeba dispar
TEIYIVISILLFIISFNQIK

SEQ ID NO: 2390964 - protein, 17 aa, Entamoeba dispar
TEKEGFVKLPYKLKIKM

SEQ ID NO: 2390965 - protein, 27 aa, Entamoeba dispar
TEKIQKRCRCGKEIIDVLCGYEGEVTC

SEQ ID NO: 2390966 - protein, 22 aa, Entamoeba dispar
TEKLFKETLFFFTADENASNIY

SEQ ID NO: 2390967 - protein, 22 aa, Entamoeba dispar
TEKRSQIIIVIMRDFEVICFNP

SEQ ID NO: 2390968 - protein, 18 aa, Entamoeba dispar
TEKYQRFGGVHGLCELLN

SEQ ID NO: 2390969 - protein, 21 aa, Entamoeba dispar
TELCGACSVMPHGDATLSSIG

SEQ ID NO: 2390970 - protein, 25 aa, Entamoeba dispar
TELEVVKILERWGNEVKIEGITTGI

SEQ ID NO: 2390971 - protein, 19 aa, Entamoeba dispar
TELHLFKFSPEIIYQLSID

SEQ ID NO: 2390972 - protein, 23 aa, Entamoeba dispar
TELKSEIKSLLFVVDTLNPTSIN

SEQ ID NO: 2390973 - protein, 22 aa, Entamoeba dispar
TELLLSCLLHPFYFITFALDNP

SEQ ID NO: 2390974 - protein, 22 aa, Entamoeba dispar
TELQLLCIVGLFIIAINPNIIY

SEQ ID NO: 2390975 - protein, 17 aa, Entamoeba dispar
TELRINKRLQKFISGEH

SEQ ID NO: 2390976 - protein, 21 aa, Entamoeba dispar
TEMGYRLGSYPLKYFANLSLV

SEQ ID NO: 2390977 - protein, 26 aa, Entamoeba dispar
TEMTSCIGCGLALNQCYWNIKTHQCI

SEQ ID NO: 2390978 - protein, 17 aa, Entamoeba dispar
TEMYKELSITIHKNIGN

SEQ ID NO: 2390979 - protein, 25 aa, Entamoeba dispar
TENCALEYIVFFFIFVICAFSNQYV

SEQ ID NO: 2390980 - protein, 17 aa, Entamoeba dispar
TENVIDWVLQRRCVIRM

SEQ ID NO: 2390981 - protein, 22 aa, Entamoeba dispar
TEPPKYIGSMTFGGEDDKECSH

SEQ ID NO: 2390982 - protein, 29 aa, Entamoeba dispar
TEPRIEGFDKLSQCVRVMKNYCISEKVIS

SEQ ID NO: 2390983 - protein, 20 aa, Entamoeba dispar
TEPYLPNGLSFDISQKLFSL

SEQ ID NO: 2390984 - protein, 19 aa, Entamoeba dispar
TEQRKLRGSIFGKEIIQFI

SEQ ID NO: 2390985 - protein, 18 aa, Entamoeba dispar
TESCFIKPYVESLAIPSA

SEQ ID NO: 2390986 - protein, 21 aa, Entamoeba dispar
TESEKALSILFNLFTSKESNN

SEQ ID NO: 2390987 - protein, 19 aa, Entamoeba dispar
TESPKLKAYFISIGALGLG

SEQ ID NO: 2390988 - protein, 22 aa, Entamoeba dispar
TESRELFCIGNLTKKTIKIFLN

SEQ ID NO: 2390989 - protein, 19 aa, Entamoeba dispar
TESTCGFGSTIQLELYNSI

SEQ ID NO: 2390990 - protein, 17 aa, Entamoeba dispar
TESWFFSLLEASQRKEF

SEQ ID NO: 2390991 - protein, 23 aa, Entamoeba dispar
TETHILRVWSLLIMLYSFVHFII

SEQ ID NO: 2390992 - protein, 27 aa, Entamoeba dispar
TETKEFPMYMIAVIVIFFLVLVVVAIL

SEQ ID NO: 2390993 - protein, 29 aa, Entamoeba dispar
TETNLRYLALDAMCSMCTVGCDKEVQKYL

SEQ ID NO: 2390994 - protein, 24 aa, Entamoeba dispar
TEVMCFLVGISFNYLSEVLYSTTN

SEQ ID NO: 2390995 - protein, 21 aa, Entamoeba dispar
TEYLMKAGMGTILYDPETCEV

SEQ ID NO: 2390996 - protein, 20 aa, Entamoeba dispar
TFAFEVVIFCVIKSGYETYL

SEQ ID NO: 2390997 - protein, 23 aa, Entamoeba dispar
TFAKGYFKTGCLAIFIVIALALT

SEQ ID NO: 2390998 - protein, 25 aa, Entamoeba dispar
TFCGYRSLPYTVLDKISMAKTQDSY

SEQ ID NO: 2390999 - protein, 18 aa, Entamoeba dispar
TFDICVLDIIHLCTYVLI

SEQ ID NO: 2391000 - protein, 23 aa, Entamoeba dispar
TFDIIISTLFTWMKLYSKDEDMW

SEQ ID NO: 2391001 - protein, 19 aa, Entamoeba dispar
TFEELCFAQQTILSLMIRN

SEQ ID NO: 2391002 - protein, 28 aa, Entamoeba dispar
TFEGVLKKYCYSKCDSCDSFISDVLLSR

SEQ ID NO: 2391003 - protein, 26 aa, Entamoeba dispar
TFFEFRGVNVLTEYSQEITIVNTGKS

SEQ ID NO: 2391004 - protein, 26 aa, Entamoeba dispar
TFFIIFICITPFFVHGDCWYVSNDNE

SEQ ID NO: 2391005 - protein, 19 aa, Entamoeba dispar
TFFPYLAIIGLRYIYGPFF

SEQ ID NO: 2391006 - protein, 22 aa, Entamoeba dispar
TFFSFICYIIFFNVLLLVLQYS

SEQ ID NO: 2391007 - protein, 17 aa, Entamoeba dispar
TFGCIFLLMAVYIGVYF

SEQ ID NO: 2391008 - protein, 18 aa, Entamoeba dispar
TFIHSCEIYISSFYITLK

SEQ ID NO: 2391009 - protein, 19 aa, Entamoeba dispar
TFIYARISISYSFIPFVIY

SEQ ID NO: 2391010 - protein, 26 aa, Entamoeba dispar
TFKLCGELFIGFSHLYYIIAKDSNEV

SEQ ID NO: 2391011 - protein, 30 aa, Entamoeba dispar
TFKRRYSVPCSNSFGYVCPNNLPKVPCPSS

SEQ ID NO: 2391012 - protein, 20 aa, Entamoeba dispar
TFLKECIGYTISILTNSIPI

SEQ ID NO: 2391013 - protein, 21 aa, Entamoeba dispar
TFLSFITCGMFNYGRNKSTFH

SEQ ID NO: 2391014 - protein, 19 aa, Entamoeba dispar
TFNFYLLFHTASWIGLNCN

SEQ ID NO: 2391015 - protein, 23 aa, Entamoeba dispar
TFNLLLILCVAFLGYFVSELLEM

SEQ ID NO: 2391016 - protein, 21 aa, Entamoeba dispar
TFNMGRRRPFMLIGLGVWLLG

SEQ ID NO: 2391017 - protein, 24 aa, Entamoeba dispar
TFPGYPYFISLHMFESSNCILSLF

SEQ ID NO: 2391018 - protein, 25 aa, Entamoeba dispar
TFSCFAIPCKFGLTPSSTELFDCLN

SEQ ID NO: 2391019 - protein, 31 aa, Entamoeba dispar
TFSCLKLTWSQRMLFCLGFCGFGMLCIFMSL

SEQ ID NO: 2391020 - protein, 27 aa, Entamoeba dispar
TFSHCSICSSSHCTICSNNYYLDSLNQ

SEQ ID NO: 2391021 - protein, 19 aa, Entamoeba dispar
TFSMIVYFSDWRYEQIEGV

SEQ ID NO: 2391022 - protein, 23 aa, Entamoeba dispar
TFSSVIAAFTFRSIFNTYSNSPS

SEQ ID NO: 2391023 - protein, 26 aa, Entamoeba dispar
TFSTRRCGACLGLNGPSMKPYQCMIS

SEQ ID NO: 2391024 - protein, 22 aa, Entamoeba dispar
TFTIPIKLSLFLISPPYLTILS

SEQ ID NO: 2391025 - protein, 20 aa, Entamoeba dispar
TFTSTNAYRFIVPNRAQECV

SEQ ID NO: 2391026 - protein, 21 aa, Entamoeba dispar
TFTVNACDYVMTGNDITLEDQ

SEQ ID NO: 2391027 - protein, 18 aa, Entamoeba dispar
TFVKKWAEDHAFLKSPHG

SEQ ID NO: 2391028 - protein, 17 aa, Entamoeba dispar
TFVTLNLFKYITYEQLI

SEQ ID NO: 2391029 - protein, 21 aa, Entamoeba dispar
TFYKNHFFGILGVSYKSNEDN

SEQ ID NO: 2391030 - protein, 18 aa, Entamoeba dispar
TGAPSRFTVNDVQRLINM

SEQ ID NO: 2391031 - protein, 24 aa, Entamoeba dispar
TGCSKCLDGYYVYDSYCFSCPDNC

SEQ ID NO: 2391032 - protein, 28 aa, Entamoeba dispar
TGDCQRSLPLCCLKKGLTSPIDITNNYN

SEQ ID NO: 2391033 - protein, 22 aa, Entamoeba dispar
TGDGKSSLGNFILKKNAFKVND

SEQ ID NO: 2391034 - protein, 22 aa, Entamoeba dispar
TGDGKSSLGNFILKKNTFKVSA

SEQ ID NO: 2391035 - protein, 20 aa, Entamoeba dispar
TGDGMFFQFTLTLGIFLTAL

SEQ ID NO: 2391036 - protein, 24 aa, Entamoeba dispar
TGECSSCLPGYYLDRDSCIECSNK

SEQ ID NO: 2391037 - protein, 29 aa, Entamoeba dispar
TGEYFYFSFYEKFSYEIVFHVAPLLPDNE

SEQ ID NO: 2391038 - protein, 17 aa, Entamoeba dispar
TGFYSVAVGMLFVISGF

SEQ ID NO: 2391039 - protein, 18 aa, Entamoeba dispar
TGGLMHCAKTIEFIPDLF

SEQ ID NO: 2391040 - protein, 19 aa, Entamoeba dispar
TGGYGCFSVLISITSTLTI

SEQ ID NO: 2391041 - protein, 22 aa, Entamoeba dispar
TGHGKSSLGNFILKKNVFSVSV

SEQ ID NO: 2391042 - protein, 25 aa, Entamoeba dispar
TGICPNCYSGYYLDEGICKDCSEKE

SEQ ID NO: 2391043 - protein, 19 aa, Entamoeba dispar
TGINKAPAIVIAFLMYYQR

SEQ ID NO: 2391044 - protein, 17 aa, Entamoeba dispar
TGINQLCAFKCVKELND

SEQ ID NO: 2391045 - protein, 21 aa, Entamoeba dispar
TGKDYKLLVGKNVSDEIKTSL

SEQ ID NO: 2391046 - protein, 17 aa, Entamoeba dispar
TGKLKSVVVVGWDDNYP

SEQ ID NO: 2391047 - protein, 18 aa, Entamoeba dispar
TGKRIIVVTSDGKSKTLN

SEQ ID NO: 2391048 - protein, 23 aa, Entamoeba dispar
TGKSCFPCPEGTFQKYPGKTECK

SEQ ID NO: 2391049 - protein, 24 aa, Entamoeba dispar
TGLCVEKSRFIGCKTFGSVGCDEC

SEQ ID NO: 2391050 - protein, 17 aa, Entamoeba dispar
TGLDIKGTLNIRTGNKF

SEQ ID NO: 2391051 - protein, 22 aa, Entamoeba dispar
TGLFFYCFYIEMNWIQSHLFLL

SEQ ID NO: 2391052 - protein, 25 aa, Entamoeba dispar
TGLLFFFVFCAFWIGYIYGAKKIQK

SEQ ID NO: 2391053 - protein, 26 aa, Entamoeba dispar
TGLLFNFSAYFLWTVIPLKANDLGAS

SEQ ID NO: 2391054 - protein, 26 aa, Entamoeba dispar
TGLVYKIIGGIGMFALVVVALIELLL

SEQ ID NO: 2391055 - protein, 20 aa, Entamoeba dispar
TGRVRWEMNGGGGINQGLEI

SEQ ID NO: 2391056 - protein, 17 aa, Entamoeba dispar
TGSCAPILFLVVCIILL

SEQ ID NO: 2391057 - protein, 22 aa, Entamoeba dispar
TGSEFVYFFAYKNEAWGFTKIT

SEQ ID NO: 2391058 - protein, 24 aa, Entamoeba dispar
TGSFKIAGICFSNPPKFNEPTKTN

SEQ ID NO: 2391059 - protein, 18 aa, Entamoeba dispar
TGTICGLLKSILMEMNPR

SEQ ID NO: 2391060 - protein, 24 aa, Entamoeba dispar
TGTKWKQQYIYPISKGNEIIFEDN

SEQ ID NO: 2391061 - protein, 19 aa, Entamoeba dispar
TGTSFGWMSLVKIIVQFLV

SEQ ID NO: 2391062 - protein, 17 aa, Entamoeba dispar
TGYKAEVIFNVKGTFSS

SEQ ID NO: 2391063 - protein, 18 aa, Entamoeba dispar
THAIPLLFYPSNFYDTNN

SEQ ID NO: 2391064 - protein, 18 aa, Entamoeba dispar
THCLQCKPHHSLTNSLEC

SEQ ID NO: 2391065 - protein, 20 aa, Entamoeba dispar
THCYECGKSSSGNQLYLSVD

SEQ ID NO: 2391066 - protein, 24 aa, Entamoeba dispar
THDPKECRSCYGAETPEKKCCFTC

SEQ ID NO: 2391067 - protein, 22 aa, Entamoeba dispar
THEFPELQLPVNLKGFELKKCC

SEQ ID NO: 2391068 - protein, 17 aa, Entamoeba dispar
THIWEFSPLLNIASIFG

SEQ ID NO: 2391069 - protein, 17 aa, Entamoeba dispar
THLKSKFGTGYVLTLNI

SEQ ID NO: 2391070 - protein, 22 aa, Entamoeba dispar
THPSPIFALHWTNPITLTLPQN

SEQ ID NO: 2391071 - protein, 20 aa, Entamoeba dispar
THQGVIKWLGFSIMVLGVML

SEQ ID NO: 2391072 - protein, 24 aa, Entamoeba dispar
THTYGCLECEPGYFFNEDLECEKC

SEQ ID NO: 2391073 - protein, 21 aa, Entamoeba dispar
THYNPAFVMPLFRKTIIRLLT

SEQ ID NO: 2391074 - protein, 24 aa, Entamoeba dispar
TIACIRIGPEGSFVFEPESKLGLV

SEQ ID NO: 2391075 - protein, 25 aa, Entamoeba dispar
TIAKERLKYVWIIFALIIKSMVGYY

SEQ ID NO: 2391076 - protein, 18 aa, Entamoeba dispar
TIALEWVKIAQYIQSKYL

SEQ ID NO: 2391077 - protein, 26 aa, Entamoeba dispar
TIDNITCLDFKFDSVLVQSNINRISC

SEQ ID NO: 2391078 - protein, 24 aa, Entamoeba dispar
TIEIMKKFGIHFLIIEFLPNQNED

SEQ ID NO: 2391079 - protein, 25 aa, Entamoeba dispar
TIELKYKEFYVFATSYTIYIPAQYG

SEQ ID NO: 2391080 - protein, 19 aa, Entamoeba dispar
TIENFWPSKYHKMELEIGR

SEQ ID NO: 2391081 - protein, 21 aa, Entamoeba dispar
TIFIGLFITCFGFSTYILLPK

SEQ ID NO: 2391082 - protein, 33 aa, Entamoeba dispar
TIFSFKLFLCFHSIELILLASWCPIIPSCGVYD

SEQ ID NO: 2391083 - protein, 23 aa, Entamoeba dispar
TIFSREHLDLFVSFLKHISIKLA

SEQ ID NO: 2391084 - protein, 24 aa, Entamoeba dispar
TIGCVPCIQNTWSSEGADECIECD

SEQ ID NO: 2391085 - protein, 25 aa, Entamoeba dispar
TIGETYFMFICSWKDGNEYVQNGNY

SEQ ID NO: 2391086 - protein, 24 aa, Entamoeba dispar
TIGFFKWNWEFELWYLNDDGTNDK

SEQ ID NO: 2391087 - protein, 25 aa, Entamoeba dispar
TIHHLAWLLLFDIQRMYSIDKDKEV

SEQ ID NO: 2391088 - protein, 22 aa, Entamoeba dispar
TIHNPWIFPLIEILKEIYKLNL

SEQ ID NO: 2391089 - protein, 25 aa, Entamoeba dispar
TIHQPRPLIFQKFDKIIMLNRGHMM

SEQ ID NO: 2391090 - protein, 23 aa, Entamoeba dispar
TIIDCLYFNAMKLIRSFATSSSI

SEQ ID NO: 2391091 - protein, 26 aa, Entamoeba dispar
TIIFAMLLAIFWRKQKQYLFHFTGVG

SEQ ID NO: 2391092 - protein, 28 aa, Entamoeba dispar
TIIIPIIFPSMYFLMGLTVILCIILWIF

SEQ ID NO: 2391093 - protein, 25 aa, Entamoeba dispar
TIIKMAYFLFCFCFYSLMCISYYKV

SEQ ID NO: 2391094 - protein, 19 aa, Entamoeba dispar
TILFIRLLISIPFTLNIPT

SEQ ID NO: 2391095 - protein, 18 aa, Entamoeba dispar
TINYSWKEIQCVGPDSTL

SEQ ID NO: 2391096 - protein, 23 aa, Entamoeba dispar
TIPFWLCALISYVPPFLLILLFS

SEQ ID NO: 2391097 - protein, 21 aa, Entamoeba dispar
TIPGMRFVIDTGLVKEKEYQS

SEQ ID NO: 2391098 - protein, 25 aa, Entamoeba dispar
TIPQCISCSNILFLEANSRKIIGVE

SEQ ID NO: 2391099 - protein, 27 aa, Entamoeba dispar
TIQFIRWLRKSYVTGIVIIVDILMNLF

SEQ ID NO: 2391100 - protein, 18 aa, Entamoeba dispar
TIQQDFTSLLALQIDNLF

SEQ ID NO: 2391101 - protein, 21 aa, Entamoeba dispar
TIRSHTPFLRKAIKERFYLFV

SEQ ID NO: 2391102 - protein, 38 aa, Entamoeba dispar
TISRCGQCIEIIGPSLIPYKCMIAGWFTYNGSIIDDNI

SEQ ID NO: 2391103 - protein, 17 aa, Entamoeba dispar
TITECPKDPCGTNEAGV

SEQ ID NO: 2391104 - protein, 20 aa, Entamoeba dispar
TITICYNRATLIVFYLIGGL

SEQ ID NO: 2391105 - protein, 25 aa, Entamoeba dispar
TITLDYRFNEIFVLLRESFNTISYF

SEQ ID NO: 2391106 - protein, 31 aa, Entamoeba dispar
TITLPSFLIICFYVYLSFVIDKHIVNVINNI

SEQ ID NO: 2391107 - protein, 25 aa, Entamoeba dispar
TITPCGHAFCYQCIKEWLVRVPNCP

SEQ ID NO: 2391108 - protein, 24 aa, Entamoeba dispar
TIVFIPICISFHIATRPHSYTCSA

SEQ ID NO: 2391109 - protein, 20 aa, Entamoeba dispar
TIVGCLAVFIACLNIFGGFF

SEQ ID NO: 2391110 - protein, 24 aa, Entamoeba dispar
TIVSLCIEEWIAAGMLIVVIVSNI

SEQ ID NO: 2391111 - protein, 18 aa, Entamoeba dispar
TIVTSFVVSFGIMYPITF

SEQ ID NO: 2391112 - protein, 19 aa, Entamoeba dispar
TIWNGRLSILVIRISLLCL

SEQ ID NO: 2391113 - protein, 18 aa, Entamoeba dispar
TIWTYKRSLFLIGQIIIM

SEQ ID NO: 2391114 - protein, 23 aa, Entamoeba dispar
TIYRIPYSMEYCHKKGTIKNRIF

SEQ ID NO: 2391115 - protein, 23 aa, Entamoeba dispar
TIYSDLLWKNLFETFYINNNNIV

SEQ ID NO: 2391116 - protein, 18 aa, Entamoeba dispar
TKAKVLGEEILNWARKTS

SEQ ID NO: 2391117 - protein, 18 aa, Entamoeba dispar
TKALLSLFQINIHYKYQT

SEQ ID NO: 2391118 - protein, 22 aa, Entamoeba dispar
TKCDWLARNFLLVFLEDTTSIG

SEQ ID NO: 2391119 - protein, 22 aa, Entamoeba dispar
TKCEAYSYQGCMDFVEDKKVVN

SEQ ID NO: 2391120 - protein, 18 aa, Entamoeba dispar
TKCGNGVLDEGEECELNQ

SEQ ID NO: 2391121 - protein, 18 aa, Entamoeba dispar
TKCNDGAILKEGKCIGIP

SEQ ID NO: 2391122 - protein, 19 aa, Entamoeba dispar
TKCSFFYHIKNNVCTVNII

SEQ ID NO: 2391123 - protein, 19 aa, Entamoeba dispar
TKDRCTKCSSGRVNYDGTC

SEQ ID NO: 2391124 - protein, 27 aa, Entamoeba dispar
TKEDYRCAIVLFQLCVEGLQSLGVNEI

SEQ ID NO: 2391125 - protein, 17 aa, Entamoeba dispar
TKEFLLCLTSIAVTPSC

SEQ ID NO: 2391126 - protein, 23 aa, Entamoeba dispar
TKETRFGFLPLFEHGHLIQNDVY

SEQ ID NO: 2391127 - protein, 20 aa, Entamoeba dispar
TKFRIGNFAYEFTPIDNFPL

SEQ ID NO: 2391128 - protein, 21 aa, Entamoeba dispar
TKFTPYGSFVLNKIFPEKQQI

SEQ ID NO: 2391129 - protein, 21 aa, Entamoeba dispar
TKFVYVIICYCGIHTKLSLNQ

SEQ ID NO: 2391130 - protein, 24 aa, Entamoeba dispar
TKGLKEWGGAILVGYDGDPYGEDD

SEQ ID NO: 2391131 - protein, 26 aa, Entamoeba dispar
TKGLKEWGGAILVRFDGDPYGEDDDF

SEQ ID NO: 2391132 - protein, 24 aa, Entamoeba dispar
TKHKRFCQRIVKLNSYYILESVPI

SEQ ID NO: 2391133 - protein, 26 aa, Entamoeba dispar
TKHPCGNFSSYGYSYLMVRGGGDVEL

SEQ ID NO: 2391134 - protein, 24 aa, Entamoeba dispar
TKICYECIDGYELIDGMCKPLLNC

SEQ ID NO: 2391135 - protein, 20 aa, Entamoeba dispar
TKIHESVSCIFDSVEHALKR

SEQ ID NO: 2391136 - protein, 17 aa, Entamoeba dispar
TKIVYWFYYLLMILLFF

SEQ ID NO: 2391137 - protein, 23 aa, Entamoeba dispar
TKIYLECFKDIFNGISTTGSTLV

SEQ ID NO: 2391138 - protein, 17 aa, Entamoeba dispar
TKKELLIDENIYQFIDY

SEQ ID NO: 2391139 - protein, 19 aa, Entamoeba dispar
TKLCYPFVYVWNKFPSIVR

SEQ ID NO: 2391140 - protein, 21 aa, Entamoeba dispar
TKLKLTHQVIEQFYFIFESYT

SEQ ID NO: 2391141 - protein, 21 aa, Entamoeba dispar
TKLSVAEVLPFLKSTNYDSRM

SEQ ID NO: 2391142 - protein, 29 aa, Entamoeba dispar
TKMLLEMLPKQFAAFMFFDCHNRFYQEIL

SEQ ID NO: 2391143 - protein, 26 aa, Entamoeba dispar
TKNNKCSKCSFWYGINEEGTKCNKEM

SEQ ID NO: 2391144 - protein, 25 aa, Entamoeba dispar
TKNNKCSKCSFWYGINEKGTKCNKE

SEQ ID NO: 2391145 - protein, 24 aa, Entamoeba dispar
TKNNKCSKCSFWYGNNEEGTKCNK

SEQ ID NO: 2391146 - protein, 18 aa, Entamoeba dispar
TKNTVGYCGADSKSDIFV

SEQ ID NO: 2391147 - protein, 17 aa, Entamoeba dispar
TKNYLLKGIDIFIHFLH

SEQ ID NO: 2391148 - protein, 21 aa, Entamoeba dispar
TKPIRKYWLLTDVFLYEQGCN

SEQ ID NO: 2391149 - protein, 22 aa, Entamoeba dispar
TKQIPWKTIVVVLIISSIYSLL

SEQ ID NO: 2391150 - protein, 19 aa, Entamoeba dispar
TKQTNFCWVCNPRFGCGVD

SEQ ID NO: 2391151 - protein, 23 aa, Entamoeba dispar
TKQWFLSFCCKLLSNKLSEIDTI

SEQ ID NO: 2391152 - protein, 22 aa, Entamoeba dispar
TKRGFSLPLFFMGHSMGGLLTS

SEQ ID NO: 2391153 - protein, 21 aa, Entamoeba dispar
TKSECRYCATLGIYDKEEGIP

SEQ ID NO: 2391154 - protein, 21 aa, Entamoeba dispar
TKSFIPHLFSLSANGFSYYVY

SEQ ID NO: 2391155 - protein, 24 aa, Entamoeba dispar
TKSIAFCMFEIVWKQITQIKNFTT

SEQ ID NO: 2391156 - protein, 25 aa, Entamoeba dispar
TKSKSIIWMVSWKGVKFVLKDQKID

SEQ ID NO: 2391157 - protein, 18 aa, Entamoeba dispar
TKSLKYLLTQGASLQTKT

SEQ ID NO: 2391158 - protein, 30 aa, Entamoeba dispar
TKTRESSVFFSFRDETSFRLGNTDNSTIGI

SEQ ID NO: 2391159 - protein, 19 aa, Entamoeba dispar
TKTSILLLVVIWLYNIIVQ

SEQ ID NO: 2391160 - protein, 18 aa, Entamoeba dispar
TKVGEFFVNSGFNVFMLD

SEQ ID NO: 2391161 - protein, 17 aa, Entamoeba dispar
TKVIKLNSGIFPNVPTD

SEQ ID NO: 2391162 - protein, 19 aa, Entamoeba dispar
TKVNLALILPLCIGACLIL

SEQ ID NO: 2391163 - protein, 20 aa, Entamoeba dispar
TKVSGKVLKGSYFRFNTHVP

SEQ ID NO: 2391164 - protein, 27 aa, Entamoeba dispar
TKWFYPCGKFGILLGIFLPTLILAQPL

SEQ ID NO: 2391165 - protein, 20 aa, Entamoeba dispar
TKWYVTFFVFLGWGMSFAIP

SEQ ID NO: 2391166 - protein, 24 aa, Entamoeba dispar
TKYHFKGMNKIVVYGLIGSLFIAV

SEQ ID NO: 2391167 - protein, 23 aa, Entamoeba dispar
TLAFILKLCFFRTDVRKNSPLLM

SEQ ID NO: 2391168 - protein, 19 aa, Entamoeba dispar
TLAFISLSVIQLFHSFISK

SEQ ID NO: 2391169 - protein, 25 aa, Entamoeba dispar
TLAIIFCIIIPFSSVVLNDKQMVIN

SEQ ID NO: 2391170 - protein, 24 aa, Entamoeba dispar
TLAQTIRLRLCLSKQETNGIFYLN

SEQ ID NO: 2391171 - protein, 18 aa, Entamoeba dispar
TLCACFVTNIGVIFSIAS

SEQ ID NO: 2391172 - protein, 19 aa, Entamoeba dispar
TLCCIAIGILIFIIILIIL

SEQ ID NO: 2391173 - protein, 18 aa, Entamoeba dispar
TLCSVAIPNCDLCSPLEL

SEQ ID NO: 2391174 - protein, 18 aa, Entamoeba dispar
TLDCLPDEGGMLVVSQSG

SEQ ID NO: 2391175 - protein, 20 aa, Entamoeba dispar
TLDVSCCKIANDNIIVESSG

SEQ ID NO: 2391176 - protein, 21 aa, Entamoeba dispar
TLFCVGLFFSFLGDLLLLMDG

SEQ ID NO: 2391177 - protein, 21 aa, Entamoeba dispar
TLFGFSFNYWWAIISRSINGL

SEQ ID NO: 2391178 - protein, 23 aa, Entamoeba dispar
TLFGFSFNYWWAIISRSINGLVN

SEQ ID NO: 2391179 - protein, 19 aa, Entamoeba dispar
TLFIICFFFLLYFFLNDMY

SEQ ID NO: 2391180 - protein, 17 aa, Entamoeba dispar
TLFKYPSYTLRTYQLSV

SEQ ID NO: 2391181 - protein, 18 aa, Entamoeba dispar
TLFNLCILMSYQVIVTQY

SEQ ID NO: 2391182 - protein, 25 aa, Entamoeba dispar
TLFRVVSLLIGWLILHVLGDFTESG

SEQ ID NO: 2391183 - protein, 27 aa, Entamoeba dispar
TLGEMWGGQFLRWFNFACLVLYLYGSL

SEQ ID NO: 2391184 - protein, 21 aa, Entamoeba dispar
TLHCSTGLFVYESIKESKKLE

SEQ ID NO: 2391185 - protein, 19 aa, Entamoeba dispar
TLHNCGWNSLYFNNHDQPR

SEQ ID NO: 2391186 - protein, 20 aa, Entamoeba dispar
TLHSFKFKHNIVPVVKECIM

SEQ ID NO: 2391187 - protein, 20 aa, Entamoeba dispar
TLILSEIIFIFQIIELGFYV

SEQ ID NO: 2391188 - protein, 30 aa, Entamoeba dispar
TLKDIPKASPWRYGTTLTTLFVEYLGCEVI

SEQ ID NO: 2391189 - protein, 18 aa, Entamoeba dispar
TLKHLAFLSPYYLSAISG

SEQ ID NO: 2391190 - protein, 25 aa, Entamoeba dispar
TLLDCMNVIIGILVYYSNSFVNKLM

SEQ ID NO: 2391191 - protein, 19 aa, Entamoeba dispar
TLLGYCFGLILTLFVLWNF

SEQ ID NO: 2391192 - protein, 19 aa, Entamoeba dispar
TLLILSLMIFFAFSSFINI

SEQ ID NO: 2391193 - protein, 22 aa, Entamoeba dispar
TLLKLFKFVGWVLLEKWYCILF

SEQ ID NO: 2391194 - protein, 22 aa, Entamoeba dispar
TLLKREIIKAVLSVGILIIVWA

SEQ ID NO: 2391195 - protein, 18 aa, Entamoeba dispar
TLLNILWDCYPQFNTNST

SEQ ID NO: 2391196 - protein, 17 aa, Entamoeba dispar
TLLNYLFNTKFRILNEV

SEQ ID NO: 2391197 - protein, 17 aa, Entamoeba dispar
TLLPFISPFTMTPIELT

SEQ ID NO: 2391198 - protein, 19 aa, Entamoeba dispar
TLLRFRILKKSKLNYTLEN

SEQ ID NO: 2391199 - protein, 26 aa, Entamoeba dispar
TLLRMTRFWTYFGMWSCGGYFFINFL

SEQ ID NO: 2391200 - protein, 21 aa, Entamoeba dispar
TLLSEFLFDDQIKGILMKSLK

SEQ ID NO: 2391201 - protein, 17 aa, Entamoeba dispar
TLLVREVDDSMPATEEQ

SEQ ID NO: 2391202 - protein, 18 aa, Entamoeba dispar
TLLWYKFLPVNWELNQLD

SEQ ID NO: 2391203 - protein, 24 aa, Entamoeba dispar
TLMKVRICQDIAIGMGYLHQNDII

SEQ ID NO: 2391204 - protein, 21 aa, Entamoeba dispar
TLMLFDARWLLLGMGLMAIYC

SEQ ID NO: 2391205 - protein, 22 aa, Entamoeba dispar
TLNCVECFLPYFGYNGDCQINS

SEQ ID NO: 2391206 - protein, 28 aa, Entamoeba dispar
TLNLSKYQLRCCFLRGFPGVQKFKTLET

SEQ ID NO: 2391207 - protein, 19 aa, Entamoeba dispar
TLNSLSISTMRIRGINKFK

SEQ ID NO: 2391208 - protein, 19 aa, Entamoeba dispar
TLPNRSWAYLSIPFTIINQ

SEQ ID NO: 2391209 - protein, 23 aa, Entamoeba dispar
TLQCFGEKVIPFPNNERIINDIK

SEQ ID NO: 2391210 - protein, 19 aa, Entamoeba dispar
TLRCCKICGLIKSQEQFQR

SEQ ID NO: 2391211 - protein, 18 aa, Entamoeba dispar
TLRRCELGKEVGYKVRFD

SEQ ID NO: 2391212 - protein, 17 aa, Entamoeba dispar
TLSEIILFSVMYSLSKI

SEQ ID NO: 2391213 - protein, 20 aa, Entamoeba dispar
TLSFGRKCYYYELYQSESLV

SEQ ID NO: 2391214 - protein, 24 aa, Entamoeba dispar
TLSIPKRNSLSFVGIVEPPDYPMR

SEQ ID NO: 2391215 - protein, 23 aa, Entamoeba dispar
TLSPEIRDWVLIPLLIVTVCSNY

SEQ ID NO: 2391216 - protein, 17 aa, Entamoeba dispar
TLSSIGCLFPMYEAKLR

SEQ ID NO: 2391217 - protein, 18 aa, Entamoeba dispar
TLSSRLVVLIGYLFFILS

SEQ ID NO: 2391218 - protein, 27 aa, Entamoeba dispar
TLSSYDFICRYCHTCIHTNCLSLLKKD

SEQ ID NO: 2391219 - protein, 19 aa, Entamoeba dispar
TLSTFCWGFLNSKFTERIT

SEQ ID NO: 2391220 - protein, 23 aa, Entamoeba dispar
TLTEPKFLYFTPLYQQYTLRSLD

SEQ ID NO: 2391221 - protein, 23 aa, Entamoeba dispar
TLVDELLFCLAVLIRRTGKDIVL

SEQ ID NO: 2391222 - protein, 27 aa, Entamoeba dispar
TLYAIFVCIGMVLKIRPEVLLCNGPGT

SEQ ID NO: 2391223 - protein, 23 aa, Entamoeba dispar
TLYFICYAICFRNKPFMYKETTF

SEQ ID NO: 2391224 - protein, 19 aa, Entamoeba dispar
TLYLKDFRLTVGHCNSVFD

SEQ ID NO: 2391225 - protein, 19 aa, Entamoeba dispar
TLYTIKIFANPRCTIYGNG

SEQ ID NO: 2391226 - protein, 17 aa, Entamoeba dispar
TLYTSVGTLAFVSETLT

SEQ ID NO: 2391227 - protein, 26 aa, Entamoeba dispar
TMDFAMKYCKTGFVIGPPDFTFSKKT

SEQ ID NO: 2391228 - protein, 20 aa, Entamoeba dispar
TMFETMKWGPAYPKEQFKYP

SEQ ID NO: 2391229 - protein, 18 aa, Entamoeba dispar
TMGHLPLCIMTKGCPERT

SEQ ID NO: 2391230 - protein, 26 aa, Entamoeba dispar
TMIVCGCALGFIGYGYGGPVYAGLGG

SEQ ID NO: 2391231 - protein, 19 aa, Entamoeba dispar
TMLKFLIRSSHKNTFKMIK

SEQ ID NO: 2391232 - protein, 17 aa, Entamoeba dispar
TMLQCFTWQDPFPKTQF

SEQ ID NO: 2391233 - protein, 23 aa, Entamoeba dispar
TMNKLMICIFCFIINGMYAFELD

SEQ ID NO: 2391234 - protein, 36 aa, Entamoeba dispar
TMNNIRPQIFVGISMFNVLPAFSFSGEKVKVVMTFN

SEQ ID NO: 2391235 - protein, 20 aa, Entamoeba dispar
TMNRWHFIILIIITILISLA

SEQ ID NO: 2391236 - protein, 18 aa, Entamoeba dispar
TMSCFGRGLGFLCGGSVI

SEQ ID NO: 2391237 - protein, 26 aa, Entamoeba dispar
TMSFPIDFKPLFIFDIESIKPTKEID

SEQ ID NO: 2391238 - protein, 24 aa, Entamoeba dispar
TMYEYKSPISYGLATVQKAYYFEC

SEQ ID NO: 2391239 - protein, 25 aa, Entamoeba dispar
TNAMNRYPINWIPKVKLHCLYSSGI

SEQ ID NO: 2391240 - protein, 17 aa, Entamoeba dispar
TNCFCYYSGTLPYQTKL

SEQ ID NO: 2391241 - protein, 19 aa, Entamoeba dispar
TNCKPNEKIPLRILSCKET

SEQ ID NO: 2391242 - protein, 17 aa, Entamoeba dispar
TNCNSFCQCIDGHTPDP

SEQ ID NO: 2391243 - protein, 19 aa, Entamoeba dispar
TNCSNANIFSISWENPVSL

SEQ ID NO: 2391244 - protein, 18 aa, Entamoeba dispar
TNCTLCYAPSTLSEGVCK

SEQ ID NO: 2391245 - protein, 26 aa, Entamoeba dispar
TNFVLRQRFGLGIALYFDFLYYVLVS

SEQ ID NO: 2391246 - protein, 21 aa, Entamoeba dispar
TNHRLNILKLYSLRNNELTGN

SEQ ID NO: 2391247 - protein, 21 aa, Entamoeba dispar
TNIKCFKYPISNITIDPSGKF

SEQ ID NO: 2391248 - protein, 28 aa, Entamoeba dispar
TNIKSRLRISLLYTWCVILILNNVRIQD

SEQ ID NO: 2391249 - protein, 24 aa, Entamoeba dispar
TNISLCSDFICFCSDSGIVEPSII

SEQ ID NO: 2391250 - protein, 24 aa, Entamoeba dispar
TNKKIGEQLLDWAKRSLSIDSCEL

SEQ ID NO: 2391251 - protein, 26 aa, Entamoeba dispar
TNKKKACMIIFLILGICFPPFLICSL

SEQ ID NO: 2391252 - protein, 23 aa, Entamoeba dispar
TNKMPLLNGDKWKGVLEAIIQLE

SEQ ID NO: 2391253 - protein, 25 aa, Entamoeba dispar
TNKVECPYWLAPECIINKKACLKSD

SEQ ID NO: 2391254 - protein, 24 aa, Entamoeba dispar
TNLQCTMALPIIVQQSYIYHHKID

SEQ ID NO: 2391255 - protein, 20 aa, Entamoeba dispar
TNLRKFECIGMKEAFNAVGG

SEQ ID NO: 2391256 - protein, 22 aa, Entamoeba dispar
TNLSREALLVWLIAETIAVTFV

SEQ ID NO: 2391257 - protein, 21 aa, Entamoeba dispar
TNLVCPIDFSGKFTAEVPDYQ

SEQ ID NO: 2391258 - protein, 17 aa, Entamoeba dispar
TNMKLIVTGTVTYEEGK

SEQ ID NO: 2391259 - protein, 23 aa, Entamoeba dispar
TNNPRYAIILVRNILNQEGLLSQ

SEQ ID NO: 2391260 - protein, 23 aa, Entamoeba dispar
TNNWKYPMHFTFHSGDYTKYEIM

SEQ ID NO: 2391261 - protein, 29 aa, Entamoeba dispar
TNNYDWKRLPAWCDRVMFRVHQSYQLSIH

SEQ ID NO: 2391262 - protein, 25 aa, Entamoeba dispar
TNQIKRLHVFGEIFAENGYFVRSDV

SEQ ID NO: 2391263 - protein, 17 aa, Entamoeba dispar
TNRISWHQCKNTIILAC

SEQ ID NO: 2391264 - protein, 17 aa, Entamoeba dispar
TNSMTLWMMILVICAVV

SEQ ID NO: 2391265 - protein, 18 aa, Entamoeba dispar
TNTCFELAEFKTIPQTIM

SEQ ID NO: 2391266 - protein, 18 aa, Entamoeba dispar
TNTLRSVLSLSLKGGFDL

SEQ ID NO: 2391267 - protein, 17 aa, Entamoeba dispar
TNVLLPIIDPLFLSNQT

SEQ ID NO: 2391268 - protein, 34 aa, Entamoeba dispar
TNWFNKIFLILSIPFRFIMEFTTPHISDNRKNLL

SEQ ID NO: 2391269 - protein, 33 aa, Entamoeba dispar
TNYVKTISGIGCRECSYGYYWKQGTCSKCSESN

SEQ ID NO: 2391270 - protein, 24 aa, Entamoeba dispar
TPAPHLPPSFPLSIDIPDNYSNPI

SEQ ID NO: 2391271 - protein, 28 aa, Entamoeba dispar
TPDPIIIPFWKIWFEALQDKTLIILIIA

SEQ ID NO: 2391272 - protein, 28 aa, Entamoeba dispar
TPDPVLIPFWKIWFEALQDKTLIILILA

SEQ ID NO: 2391273 - protein, 17 aa, Entamoeba dispar
TPFFCQQLGFSFLIHLF

SEQ ID NO: 2391274 - protein, 38 aa, Entamoeba dispar
TPFTKTRWLLFIICLVWFMFRMTHYHKYYIYAYTSGIY

SEQ ID NO: 2391275 - protein, 25 aa, Entamoeba dispar
TPGLLRISSFIKMGSILKKFIQKLE

SEQ ID NO: 2391276 - protein, 22 aa, Entamoeba dispar
TPIHIILMIIERICVVRESVKA

SEQ ID NO: 2391277 - protein, 17 aa, Entamoeba dispar
TPINMNIVFAFVAGNQV

SEQ ID NO: 2391278 - protein, 28 aa, Entamoeba dispar
TPKASGLLKIYGLEFDCCSLHFKSVPIG

SEQ ID NO: 2391279 - protein, 23 aa, Entamoeba dispar
TPKKIRFGGPYIIRDCTDIGPPQ

SEQ ID NO: 2391280 - protein, 24 aa, Entamoeba dispar
TPKNCSSCSFGYYFNDEGVCEYIG

SEQ ID NO: 2391281 - protein, 18 aa, Entamoeba dispar
TPKYRVVVRITNKTVIAQ

SEQ ID NO: 2391282 - protein, 17 aa, Entamoeba dispar
TPLTVFRYISGSISFSY

SEQ ID NO: 2391283 - protein, 19 aa, Entamoeba dispar
TPNPSWASVPYGIFICIQC

SEQ ID NO: 2391284 - protein, 20 aa, Entamoeba dispar
TPVIHGSSFVFLSISSSSLI

SEQ ID NO: 2391285 - protein, 23 aa, Entamoeba dispar
TPVYNFLCSYLLKTYKHQSKGLF

SEQ ID NO: 2391286 - protein, 21 aa, Entamoeba dispar
TPYNWKYFPTPAFYAYVASNF

SEQ ID NO: 2391287 - protein, 36 aa, Entamoeba dispar
TQCGHTFCWKCIKGKVPGNCPFCSNPITLDSLVSIF

SEQ ID NO: 2391288 - protein, 17 aa, Entamoeba dispar
TQEFKAERALEALENAD

SEQ ID NO: 2391289 - protein, 21 aa, Entamoeba dispar
TQEILKYCTFVLNHFNNLENN

SEQ ID NO: 2391290 - protein, 17 aa, Entamoeba dispar
TQFVFRLEKDGVNHQVI

SEQ ID NO: 2391291 - protein, 18 aa, Entamoeba dispar
TQHPSDWASGCVNKEGLI

SEQ ID NO: 2391292 - protein, 19 aa, Entamoeba dispar
TQIFLRFIKKYNTQKVNKL

SEQ ID NO: 2391293 - protein, 18 aa, Entamoeba dispar
TQKFPFNAHFTFFVMAVV

SEQ ID NO: 2391294 - protein, 20 aa, Entamoeba dispar
TQKFPFNAHFTFFVMAVVPL

SEQ ID NO: 2391295 - protein, 25 aa, Entamoeba dispar
TQKKLWGYFCGVLEHPQADVLNEEF

SEQ ID NO: 2391296 - protein, 18 aa, Entamoeba dispar
TQLDFSWSQSDEIPLEIL

SEQ ID NO: 2391297 - protein, 24 aa, Entamoeba dispar
TQLESEFGYKMFIQGIIVDGVDCV

SEQ ID NO: 2391298 - protein, 20 aa, Entamoeba dispar
TQLFIYRPTVKFFGPLWTNR

SEQ ID NO: 2391299 - protein, 23 aa, Entamoeba dispar
TQLKEIIHSLLLSNHSIQTISYS

SEQ ID NO: 2391300 - protein, 23 aa, Entamoeba dispar
TQLKRVLSICILQVLTVVFVLLL

SEQ ID NO: 2391301 - protein, 26 aa, Entamoeba dispar
TQLNINFSRKLSCYFDIIEVPFQYID

SEQ ID NO: 2391302 - protein, 22 aa, Entamoeba dispar
TQPCNFSSIVEWKNIEQEQKKI

SEQ ID NO: 2391303 - protein, 26 aa, Entamoeba dispar
TQQELKKGLTLIGFRISDFNNDITQV

SEQ ID NO: 2391304 - protein, 23 aa, Entamoeba dispar
TQSRLKTLLLRSEDKVRWSLICY

SEQ ID NO: 2391305 - protein, 21 aa, Entamoeba dispar
TQVRFVDRGLLLKSKVPASKP

SEQ ID NO: 2391306 - protein, 21 aa, Entamoeba dispar
TQWGVCILLGLVSLPLGLLNG

SEQ ID NO: 2391307 - protein, 17 aa, Entamoeba dispar
TQYPSFWYSIQLSESLD

SEQ ID NO: 2391308 - protein, 17 aa, Entamoeba dispar
TQYSDAIDIFFKVIQTW

SEQ ID NO: 2391309 - protein, 23 aa, Entamoeba dispar
TRCVLKIQIWVHIFFLVAIVVTI

SEQ ID NO: 2391310 - protein, 19 aa, Entamoeba dispar
TRECKTCSLVESKDKVQEV

SEQ ID NO: 2391311 - protein, 27 aa, Entamoeba dispar
TRELWRSACSLLDYIKGIMRKPTCNEI

SEQ ID NO: 2391312 - protein, 19 aa, Entamoeba dispar
TRFVLPSLLTRQVVESEEV

SEQ ID NO: 2391313 - protein, 17 aa, Entamoeba dispar
TRHSVDWWMGNVSVDVE

SEQ ID NO: 2391314 - protein, 26 aa, Entamoeba dispar
TRKLAIPLMVDLCAKRCYCKNLIIPE

SEQ ID NO: 2391315 - protein, 20 aa, Entamoeba dispar
TRMNWFNAFLRWFEDGSPDI

SEQ ID NO: 2391316 - protein, 17 aa, Entamoeba dispar
TRNGNWFSLDGADHSIL

SEQ ID NO: 2391317 - protein, 21 aa, Entamoeba dispar
TRNQITLTFQRVLCSSSVYIH

SEQ ID NO: 2391318 - protein, 17 aa, Entamoeba dispar
TRPDMLILNNFNLEIKA

SEQ ID NO: 2391319 - protein, 22 aa, Entamoeba dispar
TRSDGSASFVVRGMENVKGDIE

SEQ ID NO: 2391320 - protein, 17 aa, Entamoeba dispar
TRTAAGIAVEAMAKNVP

SEQ ID NO: 2391321 - protein, 19 aa, Entamoeba dispar
TRTAGFSIINVRDLSPPVI

SEQ ID NO: 2391322 - protein, 22 aa, Entamoeba dispar
TRVCDLLFHLTNAIRFTSLITS

SEQ ID NO: 2391323 - protein, 30 aa, Entamoeba dispar
TRYDKIIQYILRYPRRCSTHIYPRKATIWL

SEQ ID NO: 2391324 - protein, 19 aa, Entamoeba dispar
TRYNCYAHIWDAHLRTELS

SEQ ID NO: 2391325 - protein, 25 aa, Entamoeba dispar
TRYYYMIPHIFDRGNIILIDNAEKV

SEQ ID NO: 2391326 - protein, 20 aa, Entamoeba dispar
TSAFQKYPLFLLAVISLIGQ

SEQ ID NO: 2391327 - protein, 22 aa, Entamoeba dispar
TSCICSTCFSKGNHEGHDAYAY

SEQ ID NO: 2391328 - protein, 19 aa, Entamoeba dispar
TSCKRCKEGYLLNNSACIS

SEQ ID NO: 2391329 - protein, 22 aa, Entamoeba dispar
TSCVLCSPGYWFDGNTCVKCND

SEQ ID NO: 2391330 - protein, 19 aa, Entamoeba dispar
TSCYFPLPSFSQIFQGREF

SEQ ID NO: 2391331 - protein, 28 aa, Entamoeba dispar
TSDIPMFIACCSFCIVMSTSFPLVHHAQ

SEQ ID NO: 2391332 - protein, 35 aa, Entamoeba dispar
TSDLKEIYRLFGELPKDITGLCALQHRKDNPQRVR

SEQ ID NO: 2391333 - protein, 19 aa, Entamoeba dispar
TSDNFFVYFSYVMMLFNNF

SEQ ID NO: 2391334 - protein, 19 aa, Entamoeba dispar
TSDYLPIFYVLGLLLQFVM

SEQ ID NO: 2391335 - protein, 17 aa, Entamoeba dispar
TSFCFQLSIKWIFVLSL

SEQ ID NO: 2391336 - protein, 20 aa, Entamoeba dispar
TSFDSLWIYVFEIEQQIFDV

SEQ ID NO: 2391337 - protein, 22 aa, Entamoeba dispar
TSFINEVIFFFGNSSFNIDGFI

SEQ ID NO: 2391338 - protein, 19 aa, Entamoeba dispar
TSFKRPNLFQQYIREDNEI

SEQ ID NO: 2391339 - protein, 19 aa, Entamoeba dispar
TSFPYILTIPINFITFITF

SEQ ID NO: 2391340 - protein, 19 aa, Entamoeba dispar
TSFPYILTIPINFITFYLP

SEQ ID NO: 2391341 - protein, 21 aa, Entamoeba dispar
TSFYEYFEWNLDYNKESNPRE

SEQ ID NO: 2391342 - protein, 22 aa, Entamoeba dispar
TSGCSRCSIGFYLNKGKCLQCT

SEQ ID NO: 2391343 - protein, 21 aa, Entamoeba dispar
TSGGLELIYLILTMKYDDKHK

SEQ ID NO: 2391344 - protein, 17 aa, Entamoeba dispar
TSIKHINKNMCLILIVV

SEQ ID NO: 2391345 - protein, 18 aa, Entamoeba dispar
TSIKLLFTFECVLGSVLF

SEQ ID NO: 2391346 - protein, 22 aa, Entamoeba dispar
TSKDWVAIIGISIAFRSLETSK

SEQ ID NO: 2391347 - protein, 24 aa, Entamoeba dispar
TSKRKWNVIKGFFIGQTISIINAS

SEQ ID NO: 2391348 - protein, 25 aa, Entamoeba dispar
TSKYSDFSFIFGLILIVISLVCDGI

SEQ ID NO: 2391349 - protein, 24 aa, Entamoeba dispar
  misc_feature (19)..(20): Xaa can be any naturally occurring amino acid
TSKYSDFSFIFGLILIVIXXFKMK

SEQ ID NO: 2391350 - protein, 18 aa, Entamoeba dispar
TSLIFSSLMLFSFSSDDL

SEQ ID NO: 2391351 - protein, 23 aa, Entamoeba dispar
TSLILPMYGIITLKGTFVNKKRI

SEQ ID NO: 2391352 - protein, 21 aa, Entamoeba dispar
TSLKNKTGFILLNRNLPFVVI

SEQ ID NO: 2391353 - protein, 17 aa, Entamoeba dispar
TSLLFALSLGFILFFYS

SEQ ID NO: 2391354 - protein, 21 aa, Entamoeba dispar
TSLLVCKMLSLLQPTSDQLNQ

SEQ ID NO: 2391355 - protein, 17 aa, Entamoeba dispar
TSLRLPLLIEFIDGKFL

SEQ ID NO: 2391356 - protein, 20 aa, Entamoeba dispar
TSLYELFLFLLISIIYLFFY

SEQ ID NO: 2391357 - protein, 27 aa, Entamoeba dispar
TSLYQVCWSVGKAFGFLFGGMLKSALG

SEQ ID NO: 2391358 - protein, 24 aa, Entamoeba dispar
TSMIKCGMCSPTLVPSDKNKPIIY

SEQ ID NO: 2391359 - protein, 25 aa, Entamoeba dispar
TSMKSWYFEHSYLLVLLFFTILYDA

SEQ ID NO: 2391360 - protein, 28 aa, Entamoeba dispar
TSNCKICNSEKCFLCFDNYIVSGTKCIE

SEQ ID NO: 2391361 - protein, 24 aa, Entamoeba dispar
TSNCKYMNNGVCLVCPPGKTQEPS

SEQ ID NO: 2391362 - protein, 19 aa, Entamoeba dispar
TSNEEFKYHLVITEENIQN

SEQ ID NO: 2391363 - protein, 23 aa, Entamoeba dispar
TSQIPMLICKQSPTIENCAEVDG

SEQ ID NO: 2391364 - protein, 24 aa, Entamoeba dispar
TSQWKELWVDLYYDEIVIRSDKTA

SEQ ID NO: 2391365 - protein, 31 aa, Entamoeba dispar
TSRGFSYITFIFLFLCFIAYILIATLVLHRT

SEQ ID NO: 2391366 - protein, 19 aa, Entamoeba dispar
TSRSFVLESFEAMVNELLF

SEQ ID NO: 2391367 - protein, 25 aa, Entamoeba dispar
TSRYFSILISRSFSIYIFIYVLSIL

SEQ ID NO: 2391368 - protein, 23 aa, Entamoeba dispar
TSSNLGGLVAQWSSHHVTKLKKS

SEQ ID NO: 2391369 - protein, 23 aa, Entamoeba dispar
TSTECLECLTGYYLDSKKCVKCD

SEQ ID NO: 2391370 - protein, 30 aa, Entamoeba dispar
TSTHCKRLSKWMYIGLAIGCFVVTDIVLYL

SEQ ID NO: 2391371 - protein, 26 aa, Entamoeba dispar
TSTLLKLRFCQDISRGMLYLHENNII

SEQ ID NO: 2391372 - protein, 24 aa, Entamoeba dispar
TSTPIIFNLCEWYSIIPEPDKHYS

SEQ ID NO: 2391373 - protein, 19 aa, Entamoeba dispar
TSVFNKGLILFLQYYIHQH

SEQ ID NO: 2391374 - protein, 19 aa, Entamoeba dispar
TSVIQRSFVYEIFLSSLPL

SEQ ID NO: 2391375 - protein, 17 aa, Entamoeba dispar
TSVISFVLIPPMGKTDM

SEQ ID NO: 2391376 - protein, 21 aa, Entamoeba dispar
TSYKYSFKYFSLQQRINFIIL

SEQ ID NO: 2391377 - protein, 17 aa, Entamoeba dispar
TSYVPVRLVETSISTQS

SEQ ID NO: 2391378 - protein, 33 aa, Entamoeba dispar
TTAISIWTIFALPKLPGIWVLLFITSACLWVSF

SEQ ID NO: 2391379 - protein, 18 aa, Entamoeba dispar
TTCFIGGSISGLAVQILN

SEQ ID NO: 2391380 - protein, 18 aa, Entamoeba dispar
TTCPYDCLNGVCSVSKGG

SEQ ID NO: 2391381 - protein, 17 aa, Entamoeba dispar
TTCSLCIENYYVSKGKC

SEQ ID NO: 2391382 - protein, 26 aa, Entamoeba dispar
TTEECLPCPKGSYFVNGQCLLCEEGT

SEQ ID NO: 2391383 - protein, 23 aa, Entamoeba dispar
TTFPRCVLVLYWFAFPYNFMNYR

SEQ ID NO: 2391384 - protein, 18 aa, Entamoeba dispar
TTGNIPSSLLFPKEIEEI

SEQ ID NO: 2391385 - protein, 17 aa, Entamoeba dispar
TTGYWKLRVKDNPWLGN

SEQ ID NO: 2391386 - protein, 33 aa, Entamoeba dispar
TTINNLECHKGCILEFISVTSLHIYNKECSIKT

SEQ ID NO: 2391387 - protein, 17 aa, Entamoeba dispar
TTIPNVACKCCRKKFHK

SEQ ID NO: 2391388 - protein, 24 aa, Entamoeba dispar
TTIRRGYSTLVFQYFVPAIIFTQT

SEQ ID NO: 2391389 - protein, 24 aa, Entamoeba dispar
TTISRIGFFLLFIVFAVLVVIALF

SEQ ID NO: 2391390 - protein, 26 aa, Entamoeba dispar
TTKEGFLVLLARVGVRVFELILSGAF

SEQ ID NO: 2391391 - protein, 18 aa, Entamoeba dispar
TTKFPGISKFVLRRKKTL

SEQ ID NO: 2391392 - protein, 20 aa, Entamoeba dispar
TTKGSIGWQAPEMLDDSPRL

SEQ ID NO: 2391393 - protein, 23 aa, Entamoeba dispar
TTKTPRFEQVLTMNATANTFNGN

SEQ ID NO: 2391394 - protein, 26 aa, Entamoeba dispar
TTLKIWCLFVTFSIISFIPYLYLFGW

SEQ ID NO: 2391395 - protein, 22 aa, Entamoeba dispar
TTLLICAYLQIIISEIISIISL

SEQ ID NO: 2391396 - protein, 25 aa, Entamoeba dispar
TTLQSCCLFFILFFYYLNKYLLTSL

SEQ ID NO: 2391397 - protein, 17 aa, Entamoeba dispar
TTLSFPAAYFTFKGTGT

SEQ ID NO: 2391398 - protein, 27 aa, Entamoeba dispar
TTLYLPPRYPLLGGWKTSFEVNYNYPL

SEQ ID NO: 2391399 - protein, 28 aa, Entamoeba dispar
TTLYLPPRYPLLGGWKTSFEVNYNYPLD

SEQ ID NO: 2391400 - protein, 18 aa, Entamoeba dispar
TTMCGVYVNAGRENSVAS

SEQ ID NO: 2391401 - protein, 25 aa, Entamoeba dispar
TTMPEKKLNMFIKFCDIIKTLHTKL

SEQ ID NO: 2391402 - protein, 23 aa, Entamoeba dispar
TTNDIPCSGIIHINDEKTTSIDL

SEQ ID NO: 2391403 - protein, 27 aa, Entamoeba dispar
TTNDLLKIRFCQDISRGMEYLHQNDIV

SEQ ID NO: 2391404 - protein, 19 aa, Entamoeba dispar
TTNFPAYFAQNFVTLLYYF

SEQ ID NO: 2391405 - protein, 23 aa, Entamoeba dispar
TTNNPYCYARGFLISTNESTSLQ

SEQ ID NO: 2391406 - protein, 24 aa, Entamoeba dispar
TTQLKVRICQDIARGMNYLHQNNI

SEQ ID NO: 2391407 - protein, 25 aa, Entamoeba dispar
TTQWTYRRSVILLGLIVTVILYLVM

SEQ ID NO: 2391408 - protein, 26 aa, Entamoeba dispar
TTREAAVMIICFKQIILPVDGINVSE

SEQ ID NO: 2391409 - protein, 19 aa, Entamoeba dispar
TTRLEKGQTYYIFVGGATY

SEQ ID NO: 2391410 - protein, 17 aa, Entamoeba dispar
TTRVFVYAISFGNTMYI

SEQ ID NO: 2391411 - protein, 18 aa, Entamoeba dispar
TTSLWWVSATIFIFFIIC

SEQ ID NO: 2391412 - protein, 25 aa, Entamoeba dispar
TTSSCICCQCFDKTKHQGHNYYPYL

SEQ ID NO: 2391413 - protein, 30 aa, Entamoeba dispar
TTSWKDGKAFCALVHHFKPELINFEKCKTQ

SEQ ID NO: 2391414 - protein, 26 aa, Entamoeba dispar
TTTLWFKFIGVRVIFVGIIFITLCCF

SEQ ID NO: 2391415 - protein, 19 aa, Entamoeba dispar
TTVDSKCVVCTDFDKYFDG

SEQ ID NO: 2391416 - protein, 23 aa, Entamoeba dispar
TTYEIKSSIIAGKRPELKSPMPQ

SEQ ID NO: 2391417 - protein, 19 aa, Entamoeba dispar
TTYLLKLLPLFIFTLFIQI

SEQ ID NO: 2391418 - protein, 23 aa, Entamoeba dispar
TVECLECPEGKVIVNGKSCQSIG

SEQ ID NO: 2391419 - protein, 27 aa, Entamoeba dispar
TVFEIFWRISLAFSNCIVLCLFFWFLR

SEQ ID NO: 2391420 - protein, 27 aa, Entamoeba dispar
TVFPGLMFTSAFIFKFLAYFNLIIDVR

SEQ ID NO: 2391421 - protein, 18 aa, Entamoeba dispar
TVFTDVWLPNDIDTNTEF

SEQ ID NO: 2391422 - protein, 22 aa, Entamoeba dispar
TVGHAALSLGLIFEGTMDGDIA

SEQ ID NO: 2391423 - protein, 22 aa, Entamoeba dispar
TVHCSLALYGRCIECESGYSLI

SEQ ID NO: 2391424 - protein, 30 aa, Entamoeba dispar
TVHIPKYFVKDSFLGWRYVDFNNSKLNPDK

SEQ ID NO: 2391425 - protein, 28 aa, Entamoeba dispar
TVHPNLCLCKQAIRSLRIISRCSEIIPN

SEQ ID NO: 2391426 - protein, 23 aa, Entamoeba dispar
TVHTAFCLFSIIIYYAGKMYAHR

SEQ ID NO: 2391427 - protein, 17 aa, Entamoeba dispar
TVIARWAPDRLFTYGYG

SEQ ID NO: 2391428 - protein, 17 aa, Entamoeba dispar
TVILIMFLNDDRYNLGL

SEQ ID NO: 2391429 - protein, 17 aa, Entamoeba dispar
TVIPLSVVLFIFLLITF

SEQ ID NO: 2391430 - protein, 17 aa, Entamoeba dispar
TVIRKSFDYSDINCTNE

SEQ ID NO: 2391431 - protein, 25 aa, Entamoeba dispar
TVITPSARLPWHIRMLKKASESGED

SEQ ID NO: 2391432 - protein, 19 aa, Entamoeba dispar
TVLCKAEFDLNLDDHSLFN

SEQ ID NO: 2391433 - protein, 25 aa, Entamoeba dispar
TVLITCPIFYYFRFSEELFVSDLTP

SEQ ID NO: 2391434 - protein, 24 aa, Entamoeba dispar
TVLVFKNPLLLLSTNNFKILIQLY

SEQ ID NO: 2391435 - protein, 18 aa, Entamoeba dispar
TVMIKILINYLKTQHTID

SEQ ID NO: 2391436 - protein, 18 aa, Entamoeba dispar
TVPGLFTIRAQKLNQLLF

SEQ ID NO: 2391437 - protein, 17 aa, Entamoeba dispar
TVPRSMFLLVIMTVLTY

SEQ ID NO: 2391438 - protein, 20 aa, Entamoeba dispar
TVSGCKDCQPGYYKNTTGKS

SEQ ID NO: 2391439 - protein, 19 aa, Entamoeba dispar
TVSIIKIGLSLAVSVIPEG

SEQ ID NO: 2391440 - protein, 20 aa, Entamoeba dispar
TVSTLRLKYYGTWKLTESLG

SEQ ID NO: 2391441 - protein, 26 aa, Entamoeba dispar
TVSTREAICAWDWKMRCIEGEDRFGT

SEQ ID NO: 2391442 - protein, 25 aa, Entamoeba dispar
TVSYKIIRIHTGFNTVDFILCCCGG

SEQ ID NO: 2391443 - protein, 25 aa, Entamoeba dispar
TVVKALKRRGEVVAMTGDGVNDAPA

SEQ ID NO: 2391444 - protein, 19 aa, Entamoeba dispar
TVVSAYLWDGLYISLDKVT

SEQ ID NO: 2391445 - protein, 17 aa, Entamoeba dispar
TVYRFVSFLIMFITCVV

SEQ ID NO: 2391446 - protein, 24 aa, Entamoeba dispar
TWQEGKWLLLYLIIFLFSILSNGV

SEQ ID NO: 2391447 - protein, 27 aa, Entamoeba dispar
TYCGCAAGGSWNCAIMRELAKAYCSES

SEQ ID NO: 2391448 - protein, 24 aa, Entamoeba dispar
TYCQRSPVWWVIILVIMVILLVII

SEQ ID NO: 2391449 - protein, 25 aa, Entamoeba dispar
TYCTLWMILSMITFVLFGIVLTCCM

SEQ ID NO: 2391450 - protein, 17 aa, Entamoeba dispar
TYCVVGWDDTFAGGGFI

SEQ ID NO: 2391451 - protein, 17 aa, Entamoeba dispar
TYCYQCKEGFIKEKGEC

SEQ ID NO: 2391452 - protein, 20 aa, Entamoeba dispar
TYCYQCKEGFIKEKGECQKN

SEQ ID NO: 2391453 - protein, 25 aa, Entamoeba dispar
TYEKHVWPSLLFMVLITFLLSVVID

SEQ ID NO: 2391454 - protein, 25 aa, Entamoeba dispar
TYEQVFQAVAALKCKKEGEEEEFAT

SEQ ID NO: 2391455 - protein, 19 aa, Entamoeba dispar
TYFEDCRFGILGISNDDKN

SEQ ID NO: 2391456 - protein, 18 aa, Entamoeba dispar
TYFNIRFSDPLNSGDLIH

SEQ ID NO: 2391457 - protein, 26 aa, Entamoeba dispar
TYGCKRCKEGYYLTKDKKCLKCDDKC

SEQ ID NO: 2391458 - protein, 27 aa, Entamoeba dispar
TYGCKRCKEGYYLTKDKKCLKCDDKCE

SEQ ID NO: 2391459 - protein, 19 aa, Entamoeba dispar
TYGDYLFKENLDFSYKLLR

SEQ ID NO: 2391460 - protein, 33 aa, Entamoeba dispar
TYGGIMIIYCIYKLINCIIHIIGLTHSDGSSWI

SEQ ID NO: 2391461 - protein, 17 aa, Entamoeba dispar
TYGSFVAIGLFGYTEGS

SEQ ID NO: 2391462 - protein, 26 aa, Entamoeba dispar
TYGYQRVEPLLGFINGFFLVLFSAFT

SEQ ID NO: 2391463 - protein, 26 aa, Entamoeba dispar
TYIKYGGWVYFTFVMVFFFISSFLLI

SEQ ID NO: 2391464 - protein, 29 aa, Entamoeba dispar
TYKIDKLWKSVSFDKAFEGDIINLESSNN

SEQ ID NO: 2391465 - protein, 22 aa, Entamoeba dispar
TYLHCPMIDYWIPDNRALYDSM

SEQ ID NO: 2391466 - protein, 21 aa, Entamoeba dispar
TYLRQLMKLKNGFERIKANLF

SEQ ID NO: 2391467 - protein, 19 aa, Entamoeba dispar
TYPDVCNELLFKLLTANFP

SEQ ID NO: 2391468 - protein, 26 aa, Entamoeba dispar
TYPIFLNWYNFFIAFGLVLMATFIKR

SEQ ID NO: 2391469 - protein, 18 aa, Entamoeba dispar
TYQIEVKQLKREIEELKK

SEQ ID NO: 2391470 - protein, 19 aa, Entamoeba dispar
TYTPLCICTPYYVFYSFLL

SEQ ID NO: 2391471 - protein, 23 aa, Entamoeba dispar
TYTPLCICTPYYVFYSFLLLLLF

SEQ ID NO: 2391472 - protein, 19 aa, Entamoeba dispar
TYTTWKWFMMAKWDIKEHR

SEQ ID NO: 2391473 - protein, 21 aa, Entamoeba dispar
TYYFLHYFHFLLITYYFLLIT

SEQ ID NO: 2391474 - protein, 25 aa, Entamoeba dispar
TYYLLCILYPLSVYLFLYIMFIYYP

SEQ ID NO: 2391475 - protein, 19 aa, Entamoeba dispar
TYYTLPFVYEIRTILDWCL

SEQ ID NO: 2391476 - protein, 24 aa, Entamoeba dispar
VADAMSVIGGFGFTTIKNGKEVWD

SEQ ID NO: 2391477 - protein, 23 aa, Entamoeba dispar
VADSKRIKYKWNQFQLKNKTYIY

SEQ ID NO: 2391478 - protein, 23 aa, Entamoeba dispar
VAEALCSLSNIILKMKVGIDDFF

SEQ ID NO: 2391479 - protein, 24 aa, Entamoeba dispar
VAFFILGLFKAWQFKITLNIISLL

SEQ ID NO: 2391480 - protein, 24 aa, Entamoeba dispar
VAKEMFKLLILKFPTLPPIEIPSV

SEQ ID NO: 2391481 - protein, 19 aa, Entamoeba dispar
VAKGRRMQFKRGDTPLITY

SEQ ID NO: 2391482 - protein, 19 aa, Entamoeba dispar
VAKLFFKKMHLEILNEDTL

SEQ ID NO: 2391483 - protein, 24 aa, Entamoeba dispar
VAKSDPGLWYLLKHNSSIVNEKYT

SEQ ID NO: 2391484 - protein, 19 aa, Entamoeba dispar
VALDLGIKRIYIPTFLIYP

SEQ ID NO: 2391485 - protein, 23 aa, Entamoeba dispar
VALFCLCFYWAGLFFVICFWIMF

SEQ ID NO: 2391486 - protein, 24 aa, Entamoeba dispar
VALGMVYCVFGFLKHTSMVVSPPK

SEQ ID NO: 2391487 - protein, 17 aa, Entamoeba dispar
VALIELLLVLLQRILCG

SEQ ID NO: 2391488 - protein, 17 aa, Entamoeba dispar
VALLCAEFKEISKKNKK

SEQ ID NO: 2391489 - protein, 23 aa, Entamoeba dispar
VALYLKGTTTFQLFLKVSKNCEN

SEQ ID NO: 2391490 - protein, 17 aa, Entamoeba dispar
VAMSIPLIFAWTKTSTQ

SEQ ID NO: 2391491 - protein, 19 aa, Entamoeba dispar
VARQLTLKGYSLFSKVKVN

SEQ ID NO: 2391492 - protein, 23 aa, Entamoeba dispar
VASENRALFCIGNISHSTKKVQF

SEQ ID NO: 2391493 - protein, 29 aa, Entamoeba dispar
VASIVPVCIMLGFSCIRELLDEFRKFRAD

SEQ ID NO: 2391494 - protein, 23 aa, Entamoeba dispar
VATCQKAGIIVRMVTGDNIATAR

SEQ ID NO: 2391495 - protein, 26 aa, Entamoeba dispar
VAVCLNFPLFIPKSVKFLNRISTLTV

SEQ ID NO: 2391496 - protein, 23 aa, Entamoeba dispar
VAVFAVSLIGAWNDYSKQSKFIE

SEQ ID NO: 2391497 - protein, 19 aa, Entamoeba dispar
VAVFEWYHSYILTSCTRKN

SEQ ID NO: 2391498 - protein, 17 aa, Entamoeba dispar
VAVGMLFVISGFFGLFA

SEQ ID NO: 2391499 - protein, 25 aa, Entamoeba dispar
VAVMFPVVWSAYWGKDPYGAERGKI

SEQ ID NO: 2391500 - protein, 19 aa, Entamoeba dispar
VAVPARLIKNISLKHYLNS

SEQ ID NO: 2391501 - protein, 20 aa, Entamoeba dispar
VAYLPYLIKVIPNISALYIN

SEQ ID NO: 2391502 - protein, 22 aa, Entamoeba dispar
VAYRCCGWKAYSQNDCAYYPIP

SEQ ID NO: 2391503 - protein, 25 aa, Entamoeba dispar
VAYSEDFFAILFFPIEHKIACLLPL

SEQ ID NO: 2391504 - protein, 21 aa, Entamoeba dispar
VAYSIQWIGVFALSKASYSVF

SEQ ID NO: 2391505 - protein, 25 aa, Entamoeba dispar
VCAIESRLLIIVPRYLKEVEDGYLA

SEQ ID NO: 2391506 - protein, 17 aa, Entamoeba dispar
VCAVFLSLSFNEAICSE

SEQ ID NO: 2391507 - protein, 17 aa, Entamoeba dispar
VCCCITQTLGIVVKRKH

SEQ ID NO: 2391508 - protein, 26 aa, Entamoeba dispar
VCDFTWKTIHRDSSSVKCLHSPFNIY

SEQ ID NO: 2391509 - protein, 23 aa, Entamoeba dispar
VCDRYPRPQTWRGILSIPSGIIL

SEQ ID NO: 2391510 - protein, 23 aa, Entamoeba dispar
VCDSGMKCALKFVMNKPTNCSGI

SEQ ID NO: 2391511 - protein, 17 aa, Entamoeba dispar
VCEGHRSKVRFNVLKNQ

SEQ ID NO: 2391512 - protein, 19 aa, Entamoeba dispar
VCGEFGKYLQLHVSSSEPI

SEQ ID NO: 2391513 - protein, 30 aa, Entamoeba dispar
VCGFCLSFSAYCFWLIIPILMRDIGASPFQ

SEQ ID NO: 2391514 - protein, 29 aa, Entamoeba dispar
VCLALNFIKNGWVCLIFAIPTGFISGLDL

SEQ ID NO: 2391515 - protein, 17 aa, Entamoeba dispar
VCLERSINKMACVQLQA

SEQ ID NO: 2391516 - protein, 18 aa, Entamoeba dispar
VCLLHKREVEAFKKSRVL

SEQ ID NO: 2391517 - protein, 17 aa, Entamoeba dispar
VCLLIAIIILKFPNNST

SEQ ID NO: 2391518 - protein, 19 aa, Entamoeba dispar
VCLSCSSKGCEQCDSENGD

SEQ ID NO: 2391519 - protein, 18 aa, Entamoeba dispar
VCNELLFKLLTANFPKTS

SEQ ID NO: 2391520 - protein, 31 aa, Entamoeba dispar
VCNGHTRLDLSLKDWPFTSFQSWAVDRMAAS

SEQ ID NO: 2391521 - protein, 18 aa, Entamoeba dispar
VCNLKPSKLRGVASEAMI

SEQ ID NO: 2391522 - protein, 21 aa, Entamoeba dispar
VCPGYYYKIKYNTIYISDQQN

SEQ ID NO: 2391523 - protein, 23 aa, Entamoeba dispar
VCQIQIPPLFPTVLNITAFGKCE

SEQ ID NO: 2391524 - protein, 20 aa, Entamoeba dispar
VCQTCCLCLYAYSTTQSCVI

SEQ ID NO: 2391525 - protein, 24 aa, Entamoeba dispar
VCSDRFSVWFLFEILFLSQTLSQI

SEQ ID NO: 2391526 - protein, 30 aa, Entamoeba dispar
VCSFSKNGICLKCPQGMMIDNDHTRCSTSC

SEQ ID NO: 2391527 - protein, 21 aa, Entamoeba dispar
VCSKLGEWNLYIAQNSNSFNY

SEQ ID NO: 2391528 - protein, 19 aa, Entamoeba dispar
VCSSIYPILFISCIDSSSE

SEQ ID NO: 2391529 - protein, 30 aa, Entamoeba dispar
VCVKKFFKSKAGIILGCVIGVVLLLIIITI

SEQ ID NO: 2391530 - protein, 21 aa, Entamoeba dispar
VCVRMYDNLLRLFIFAFQSLQ

SEQ ID NO: 2391531 - protein, 24 aa, Entamoeba dispar
VCVSEIEITIVYRILYPIITRIIP

SEQ ID NO: 2391532 - protein, 22 aa, Entamoeba dispar
VCVVVLFIICGTLSITLSKTCY

SEQ ID NO: 2391533 - protein, 22 aa, Entamoeba dispar
VCYECPEKSFPINGECQSCEIT

SEQ ID NO: 2391534 - protein, 25 aa, Entamoeba dispar
VCYFVCVIGGFIPFFIKFLPNRKLA

SEQ ID NO: 2391535 - protein, 17 aa, Entamoeba dispar
VCYKCNETYFLSTDQKR

SEQ ID NO: 2391536 - protein, 27 aa, Entamoeba dispar
VCYPVCIPNIIMKIILFEIEFDGDYSI

SEQ ID NO: 2391537 - protein, 29 aa, Entamoeba dispar
VDAGAAVAFVGRWFTQHPSDWASGCVNKE

SEQ ID NO: 2391538 - protein, 19 aa, Entamoeba dispar
VDALFCLRNISPKPVMPSL

SEQ ID NO: 2391539 - protein, 24 aa, Entamoeba dispar
VDALKELYCIKAIDENGHITQLGV

SEQ ID NO: 2391540 - protein, 22 aa, Entamoeba dispar
VDCDCKGDCVIDYTDVTNDIIY

SEQ ID NO: 2391541 - protein, 18 aa, Entamoeba dispar
VDCSKYCVERGVDVDYVG

SEQ ID NO: 2391542 - protein, 17 aa, Entamoeba dispar
VDCYNTVHLFDIEANTL

SEQ ID NO: 2391543 - protein, 18 aa, Entamoeba dispar
VDEPFKSALISSLAALEV

SEQ ID NO: 2391544 - protein, 22 aa, Entamoeba dispar
VDFDISQCYSFINSGLEQTYEN

SEQ ID NO: 2391545 - protein, 17 aa, Entamoeba dispar
VDFKARNDLNFNLIDTY

SEQ ID NO: 2391546 - protein, 17 aa, Entamoeba dispar
VDFSRWYLNDHFVYQIV

SEQ ID NO: 2391547 - protein, 23 aa, Entamoeba dispar
VDFWVGDWWGIWSTSAYLEQGLR

SEQ ID NO: 2391548 - protein, 21 aa, Entamoeba dispar
VDGDPVFFMSLEFGKCYYLDD

SEQ ID NO: 2391549 - protein, 21 aa, Entamoeba dispar
VDGEGVVNISLYNIIKQKLTE

SEQ ID NO: 2391550 - protein, 18 aa, Entamoeba dispar
VDGGEIIFEKNVILLNSL

SEQ ID NO: 2391551 - protein, 23 aa, Entamoeba dispar
VDGICTLCGNGILDENEDCDPTI

SEQ ID NO: 2391552 - protein, 25 aa, Entamoeba dispar
VDGLDGIIFPFTCGKANNLENINII

SEQ ID NO: 2391553 - protein, 17 aa, Entamoeba dispar
VDHLRFLAIKEKYPILQ

SEQ ID NO: 2391554 - protein, 21 aa, Entamoeba dispar
VDIDRYRAIIIICSVEGNHLS

SEQ ID NO: 2391555 - protein, 23 aa, Entamoeba dispar
VDIHSFRRSWLIKNSDEFISVKI

SEQ ID NO: 2391556 - protein, 20 aa, Entamoeba dispar
VDILTTYFNIRFSDPLNSGD

SEQ ID NO: 2391557 - protein, 21 aa, Entamoeba dispar
VDIMFPMVWHLYYGDSDSAEH

SEQ ID NO: 2391558 - protein, 17 aa, Entamoeba dispar
VDIQAVFPFDSNRKRMS

SEQ ID NO: 2391559 - protein, 17 aa, Entamoeba dispar
VDKKILVAYPMALYFIL

SEQ ID NO: 2391560 - protein, 18 aa, Entamoeba dispar
VDKLSLFRKMVEKEFEIL

SEQ ID NO: 2391561 - protein, 19 aa, Entamoeba dispar
VDLAAQMLVIDPLAFRSWD

SEQ ID NO: 2391562 - protein, 17 aa, Entamoeba dispar
VDLCVMDVCLALAAVFI

SEQ ID NO: 2391563 - protein, 25 aa, Entamoeba dispar
VDLMYSSLMARCWNEQPSNRPDFKE

SEQ ID NO: 2391564 - protein, 28 aa, Entamoeba dispar
VDLYIKLGKYLPECETLPEITCKIQETK

SEQ ID NO: 2391565 - protein, 22 aa, Entamoeba dispar
VDNHLTAVFAFQSPVQQFDHFS

SEQ ID NO: 2391566 - protein, 18 aa, Entamoeba dispar
VDNPRWVAPEILINKPFT

SEQ ID NO: 2391567 - protein, 21 aa, Entamoeba dispar
VDPKTCEKRGVYGDEGIEIED

SEQ ID NO: 2391568 - protein, 18 aa, Entamoeba dispar
VDPKTCIKRVLGNVKTKE

SEQ ID NO: 2391569 - protein, 17 aa, Entamoeba dispar
VDPRSPYSYTDERKTEV

SEQ ID NO: 2391570 - protein, 25 aa, Entamoeba dispar
VDQKLCRCCYAASIANFLQIKHHIA

SEQ ID NO: 2391571 - protein, 22 aa, Entamoeba dispar
VDSCIKRNIPFYNTLAKSHRKE

SEQ ID NO: 2391572 - protein, 19 aa, Entamoeba dispar
VDTIRRFVKNPGDESSDSY

SEQ ID NO: 2391573 - protein, 25 aa, Entamoeba dispar
VDVAVEYCWFFFDVIIKSLTLYLEE

SEQ ID NO: 2391574 - protein, 17 aa, Entamoeba dispar
VDVLICLFVDSLDLYHI

SEQ ID NO: 2391575 - protein, 23 aa, Entamoeba dispar
VDVSTCFPKTIIDTGIEITTGCF

SEQ ID NO: 2391576 - protein, 18 aa, Entamoeba dispar
VDYTFKHVVEHSVPCLIT

SEQ ID NO: 2391577 - protein, 24 aa, Entamoeba dispar
VEACKADDYKGCPKKRFDYSTNTG

SEQ ID NO: 2391578 - protein, 22 aa, Entamoeba dispar
VECNIPHCLTCSGEQDNSCSIC

SEQ ID NO: 2391579 - protein, 17 aa, Entamoeba dispar
VECPCSLGNGNSNTNCV

SEQ ID NO: 2391580 - protein, 24 aa, Entamoeba dispar
VECVSELPQRILVANELMKQFTSI

SEQ ID NO: 2391581 - protein, 18 aa, Entamoeba dispar
VEDIIKLFSLDMKKGTTI

SEQ ID NO: 2391582 - protein, 18 aa, Entamoeba dispar
VEDIIKLFSLDMKKGTTT

SEQ ID NO: 2391583 - protein, 27 aa, Entamoeba dispar
VEEKRIVEVMYRFFACSIESTKCKISD

SEQ ID NO: 2391584 - protein, 19 aa, Entamoeba dispar
VEFGGCIGLNIGLFLFPIL

SEQ ID NO: 2391585 - protein, 21 aa, Entamoeba dispar
VEFKHHCCGWLASNVDNCGAI

SEQ ID NO: 2391586 - protein, 19 aa, Entamoeba dispar
VEIALKILMETAKTRSLIP

SEQ ID NO: 2391587 - protein, 19 aa, Entamoeba dispar
VEIKKPPKHIGFHSVVDDD

SEQ ID NO: 2391588 - protein, 22 aa, Entamoeba dispar
VEIPKGKKIRVNTCNKHTDSNV

SEQ ID NO: 2391589 - protein, 19 aa, Entamoeba dispar
VEITQRLVFNLNDPVPIEE

SEQ ID NO: 2391590 - protein, 17 aa, Entamoeba dispar
VEKRLEHSLMHVGPSMM

SEQ ID NO: 2391591 - protein, 24 aa, Entamoeba dispar
VEKTAQLRKVFNCYDTECVSELNT

SEQ ID NO: 2391592 - protein, 30 aa, Entamoeba dispar
VELFHEQRVCFSLKEAKIMMVSSEEYNLPP

SEQ ID NO: 2391593 - protein, 24 aa, Entamoeba dispar
VELIKELMQLYSLLPLTQSSQLTQ

SEQ ID NO: 2391594 - protein, 26 aa, Entamoeba dispar
VELLEKIRCPFIINFIGSVTSSDTLA

SEQ ID NO: 2391595 - protein, 19 aa, Entamoeba dispar
VELSQFASFMVEPYCSAIL

SEQ ID NO: 2391596 - protein, 24 aa, Entamoeba dispar
VEMYIGIIFFCYFIAQTLVMAIMS

SEQ ID NO: 2391597 - protein, 23 aa, Entamoeba dispar
VEMYIGILFFCYFIAQTLVMSVM

SEQ ID NO: 2391598 - protein, 25 aa, Entamoeba dispar
VENIRWEIGTALPVNIRASMTNDEI

SEQ ID NO: 2391599 - protein, 22 aa, Entamoeba dispar
VENKLTFLLLFVLILFNNPFFS

SEQ ID NO: 2391600 - protein, 17 aa, Entamoeba dispar
VEPEVKSNIVIKKVELI

SEQ ID NO: 2391601 - protein, 17 aa, Entamoeba dispar
VEQCLSSVIPLIGLKAY

SEQ ID NO: 2391602 - protein, 17 aa, Entamoeba dispar
VEQIKSYALPLIISEKV

SEQ ID NO: 2391603 - protein, 18 aa, Entamoeba dispar
VEQPFGFPEYVAKNKLKK

SEQ ID NO: 2391604 - protein, 22 aa, Entamoeba dispar
VEQQGQCCFGSITFDSEECGCI

SEQ ID NO: 2391605 - protein, 29 aa, Entamoeba dispar
VERIKCLKEPINLLKFIVMIELFMQPNQI

SEQ ID NO: 2391606 - protein, 20 aa, Entamoeba dispar
VERRKLQLTLCSRFVDPARP

SEQ ID NO: 2391607 - protein, 23 aa, Entamoeba dispar
VESDIYSLGMLYIIIHMKFIPSK

SEQ ID NO: 2391608 - protein, 19 aa, Entamoeba dispar
VESYSYYLLQCLVGMLPDW

SEQ ID NO: 2391609 - protein, 19 aa, Entamoeba dispar
VETSCRVGVAVDVAGQAGS

SEQ ID NO: 2391610 - protein, 19 aa, Entamoeba dispar
VEVPYPFEFEMKISNKSEL

SEQ ID NO: 2391611 - protein, 20 aa, Entamoeba dispar
VEVSGRMGINATLLVSEAKR

SEQ ID NO: 2391612 - protein, 23 aa, Entamoeba dispar
VEYIKRGALHISYYDLNVYNSNE

SEQ ID NO: 2391613 - protein, 18 aa, Entamoeba dispar
VEYPLKFATENKFTHFDN

SEQ ID NO: 2391614 - protein, 26 aa, Entamoeba dispar
VFAFIGIFCGYRLSEVITCPPDVLGF

SEQ ID NO: 2391615 - protein, 24 aa, Entamoeba dispar
VFALSIYWFFYVFNWYMTYAKQLL

SEQ ID NO: 2391616 - protein, 19 aa, Entamoeba dispar
VFCTEWWLLMPGIIIFVIL

SEQ ID NO: 2391617 - protein, 18 aa, Entamoeba dispar
VFEMKRSNIKMEELYDVI

SEQ ID NO: 2391618 - protein, 18 aa, Entamoeba dispar
VFESIEFKENGIISTEGK

SEQ ID NO: 2391619 - protein, 29 aa, Entamoeba dispar
VFFASTLIPSVCRWYRLRQIIKQQELLNN

SEQ ID NO: 2391620 - protein, 20 aa, Entamoeba dispar
VFFEHTFKTISFATVLSDVK

SEQ ID NO: 2391621 - protein, 22 aa, Entamoeba dispar
VFFLRRGQTFWQTLVSIIAQFL

SEQ ID NO: 2391622 - protein, 18 aa, Entamoeba dispar
VFFVFKAPITFIICYIIS

SEQ ID NO: 2391623 - protein, 24 aa, Entamoeba dispar
VFFYFRLNIFVLYHLFFIFYFLFI

SEQ ID NO: 2391624 - protein, 26 aa, Entamoeba dispar
VFGQRAVAWAFPGEVVTIKFPKGMSY

SEQ ID NO: 2391625 - protein, 18 aa, Entamoeba dispar
VFIACLDKDLSYQVIKDN

SEQ ID NO: 2391626 - protein, 26 aa, Entamoeba dispar
VFIAPCIFHLLSIRLFQKCSLFSYHP

SEQ ID NO: 2391627 - protein, 19 aa, Entamoeba dispar
VFILICLIIAYYFIISYQQ

SEQ ID NO: 2391628 - protein, 17 aa, Entamoeba dispar
VFISMAFADIFTKDPIV

SEQ ID NO: 2391629 - protein, 17 aa, Entamoeba dispar
VFKNCTYYWGFALAVSI

SEQ ID NO: 2391630 - protein, 30 aa, Entamoeba dispar
VFKNKIGNFFELRKSVLVEGFKEEEKELRE

SEQ ID NO: 2391631 - protein, 25 aa, Entamoeba dispar
VFLEAPLVYLVTCEPIKFQHITSSN

SEQ ID NO: 2391632 - protein, 19 aa, Entamoeba dispar
VFMFSLIVCVGHMMVKANS

SEQ ID NO: 2391633 - protein, 21 aa, Entamoeba dispar
VFMVLCVLIIVVICYSLLVQY

SEQ ID NO: 2391634 - protein, 28 aa, Entamoeba dispar
VFNEILKFLICLVMLKFVHKKENLLQHV

SEQ ID NO: 2391635 - protein, 24 aa, Entamoeba dispar
VFPSALRFLPFVMILSLFLNNTPV

SEQ ID NO: 2391636 - protein, 19 aa, Entamoeba dispar
VFRDCIFKSQNKESGVVLA

SEQ ID NO: 2391637 - protein, 23 aa, Entamoeba dispar
VFSCANFTCLPVYKRAPCSFTKV

SEQ ID NO: 2391638 - protein, 21 aa, Entamoeba dispar
VFSGIWPYTKLVMLLIAWMIP

SEQ ID NO: 2391639 - protein, 28 aa, Entamoeba dispar
VFSILQLFSLNSFDTWIVVIIIILTLII

SEQ ID NO: 2391640 - protein, 23 aa, Entamoeba dispar
VFSKKCFLLIQSIVKFITSALQA

SEQ ID NO: 2391641 - protein, 21 aa, Entamoeba dispar
VFSLFCQFQSLFFVSVMLLGI

SEQ ID NO: 2391642 - protein, 23 aa, Entamoeba dispar
VFSLSMPQWLYIVVDDKCNRVRE

SEQ ID NO: 2391643 - protein, 26 aa, Entamoeba dispar
VFSSFHIITFIALILFISLQPFYYFE

SEQ ID NO: 2391644 - protein, 25 aa, Entamoeba dispar
VFSYAICLLEIWLGRSPYSPIKFPD

SEQ ID NO: 2391645 - protein, 21 aa, Entamoeba dispar
VFTKCSIGGKIYGKEEKEESF

SEQ ID NO: 2391646 - protein, 17 aa, Entamoeba dispar
VFVMFYVLVIFEALRKP

SEQ ID NO: 2391647 - protein, 20 aa, Entamoeba dispar
VFWLNCYIIILINAYLTQRL

SEQ ID NO: 2391648 - protein, 25 aa, Entamoeba dispar
VGAFLGRGTALAMLSNFEKAIQDFT

SEQ ID NO: 2391649 - protein, 21 aa, Entamoeba dispar
VGAHAICCFVLSLRFSLKLFV

SEQ ID NO: 2391650 - protein, 18 aa, Entamoeba dispar
VGASDCKKTVDYLPADKQ

SEQ ID NO: 2391651 - protein, 23 aa, Entamoeba dispar
VGATNCKLCPNGFFPYPDGSRCF

SEQ ID NO: 2391652 - protein, 24 aa, Entamoeba dispar
VGCVPSCLIGGCKTGCYTPDECGY

SEQ ID NO: 2391653 - protein, 18 aa, Entamoeba dispar
VGDSLSVITNGFYSYGIS

SEQ ID NO: 2391654 - protein, 25 aa, Entamoeba dispar
VGELLKRKIIKGVMYIHIVRIIINQ

SEQ ID NO: 2391655 - protein, 18 aa, Entamoeba dispar
VGELRRKASDQAINILTL

SEQ ID NO: 2391656 - protein, 17 aa, Entamoeba dispar
VGFFRCSFFTLTIEIGS

SEQ ID NO: 2391657 - protein, 18 aa, Entamoeba dispar
VGFYELIKRLVISDYRDP

SEQ ID NO: 2391658 - protein, 18 aa, Entamoeba dispar
VGGLCYYLTAPNSIFELI

SEQ ID NO: 2391659 - protein, 19 aa, Entamoeba dispar
VGGLCYYLTAPNSIFELVQ

SEQ ID NO: 2391660 - protein, 20 aa, Entamoeba dispar
VGGYFFLQAFETIQCLFSIY

SEQ ID NO: 2391661 - protein, 24 aa, Entamoeba dispar
VGIFTVFVSVCFLYILQNVVELVP

SEQ ID NO: 2391662 - protein, 18 aa, Entamoeba dispar
VGILFGEVLQCVATPNID

SEQ ID NO: 2391663 - protein, 19 aa, Entamoeba dispar
VGKCFKKIVQYLTIDSQIE

SEQ ID NO: 2391664 - protein, 21 aa, Entamoeba dispar
VGKVFTCIAYFNAIRRPFMNF

SEQ ID NO: 2391665 - protein, 24 aa, Entamoeba dispar
VGLFIYDLIRIFRNCHIPFYDGKS

SEQ ID NO: 2391666 - protein, 28 aa, Entamoeba dispar
VGLKKKYLPVYVVVSPPLLLVFQSQDDY

SEQ ID NO: 2391667 - protein, 20 aa, Entamoeba dispar
VGLVVSVLFLVAGIYIPYFN

SEQ ID NO: 2391668 - protein, 23 aa, Entamoeba dispar
VGMLPDWIESIGIKIVSQKATLN

SEQ ID NO: 2391669 - protein, 28 aa, Entamoeba dispar
VGPMCIMMLWPRIEKFGDPNFRKLSIID

SEQ ID NO: 2391670 - protein, 19 aa, Entamoeba dispar
VGQSPSIRMKELFEEENTD

SEQ ID NO: 2391671 - protein, 25 aa, Entamoeba dispar
VGRKTYKSKGKWYRVHTAGLGNNIE

SEQ ID NO: 2391672 - protein, 24 aa, Entamoeba dispar
VGTICGLLKSLLMEMNPRFINGES

SEQ ID NO: 2391673 - protein, 18 aa, Entamoeba dispar
VGTQFPFVKLRDVDYGTF

SEQ ID NO: 2391674 - protein, 32 aa, Entamoeba dispar
VGVLIIPLIIIVYFFFCYKTIPHFHSLFHITE

SEQ ID NO: 2391675 - protein, 17 aa, Entamoeba dispar
VGVLLFFIGAVCKCCCL

SEQ ID NO: 2391676 - protein, 21 aa, Entamoeba dispar
VHCPCYGLNCITKFSKEDTII

SEQ ID NO: 2391677 - protein, 25 aa, Entamoeba dispar
VHFLLCGISMIFFILHLHEIFKTFI

SEQ ID NO: 2391678 - protein, 17 aa, Entamoeba dispar
VHFVSGLERCEKYTEMY

SEQ ID NO: 2391679 - protein, 17 aa, Entamoeba dispar
VHHCRKCDFCVERFDHH

SEQ ID NO: 2391680 - protein, 17 aa, Entamoeba dispar
VHHQRVSDLELIFKYKY

SEQ ID NO: 2391681 - protein, 29 aa, Entamoeba dispar
VHIPKYFVKDSFLGWKYIDFNNSKFNPDK

SEQ ID NO: 2391682 - protein, 20 aa, Entamoeba dispar
VHKLEFKRIEGFNDIIECNT

SEQ ID NO: 2391683 - protein, 21 aa, Entamoeba dispar
VHLLFSIPVGIILVFTTYNYY

SEQ ID NO: 2391684 - protein, 18 aa, Entamoeba dispar
VHLNKITSFFFDNNSHML

SEQ ID NO: 2391685 - protein, 25 aa, Entamoeba dispar
VHRIHAIELLPLYSSNGLSVGETMK

SEQ ID NO: 2391686 - protein, 18 aa, Entamoeba dispar
VHSCLPPLYVGTRGLSKK

SEQ ID NO: 2391687 - protein, 18 aa, Entamoeba dispar
VHVIFHCYVIYSLLYFYI

SEQ ID NO: 2391688 - protein, 25 aa, Entamoeba dispar
VIAIFPFDIVRYIGIGCTISVTITL

SEQ ID NO: 2391689 - protein, 22 aa, Entamoeba dispar
VIALCVSVGVVGLGLGIAGGAG

SEQ ID NO: 2391690 - protein, 21 aa, Entamoeba dispar
VICETVKLVLRIASKKRESKY

SEQ ID NO: 2391691 - protein, 23 aa, Entamoeba dispar
VICFVESRLLITLPKYLKNVRQT

SEQ ID NO: 2391692 - protein, 17 aa, Entamoeba dispar
VICIILIIIIIVLLSIY

SEQ ID NO: 2391693 - protein, 22 aa, Entamoeba dispar
VICIPNFGMIWVWTIVVSFINW

SEQ ID NO: 2391694 - protein, 24 aa, Entamoeba dispar
VICKTMKHSFLIQGISLMQQENKY

SEQ ID NO: 2391695 - protein, 17 aa, Entamoeba dispar
VICLCLIAVWFSQHRKC

SEQ ID NO: 2391696 - protein, 24 aa, Entamoeba dispar
VICRDWKLTWFNSILFEFMELSFQ

SEQ ID NO: 2391697 - protein, 17 aa, Entamoeba dispar
VICSYTFNGKILTPVTL

SEQ ID NO: 2391698 - protein, 31 aa, Entamoeba dispar
VIECYDHPLIKGACLNFNLVKRQELFSHLFS

SEQ ID NO: 2391699 - protein, 18 aa, Entamoeba dispar
VIEFFSIQTKHIFFDQFK

SEQ ID NO: 2391700 - protein, 18 aa, Entamoeba dispar
VIEKVPFKTVKTVVEGKE

SEQ ID NO: 2391701 - protein, 23 aa, Entamoeba dispar
VIFCLIILCSILFDIYSLWQGHR

SEQ ID NO: 2391702 - protein, 35 aa, Entamoeba dispar
VIFEALRKPISWRKNIKFWIGRIMFFCAFMLVILI

SEQ ID NO: 2391703 - protein, 25 aa, Entamoeba dispar
VIFIGCAFLLGVAYFLTRDRHQAQY

SEQ ID NO: 2391704 - protein, 26 aa, Entamoeba dispar
VIFLSILCFIIYIPTYFVYGQSEPKF

SEQ ID NO: 2391705 - protein, 18 aa, Entamoeba dispar
VIFNDIFATFGINDLIWT

SEQ ID NO: 2391706 - protein, 17 aa, Entamoeba dispar
VIFTLFVLFKRYLLYTK

SEQ ID NO: 2391707 - protein, 25 aa, Entamoeba dispar
VIGFNELRMKAGLREEGEQLPLIMP

SEQ ID NO: 2391708 - protein, 26 aa, Entamoeba dispar
VIGFVKEWKLCFVMISVAPFMVGAAG

SEQ ID NO: 2391709 - protein, 24 aa, Entamoeba dispar
VIGIGAICGFRLMTKANLFCLFIV

SEQ ID NO: 2391710 - protein, 26 aa, Entamoeba dispar
VIGIICCFCASIYCTIIMTKMSKTWA

SEQ ID NO: 2391711 - protein, 20 aa, Entamoeba dispar
VIGLLALIILYVWFPKQQKR

SEQ ID NO: 2391712 - protein, 27 aa, Entamoeba dispar
VIGMFLISFSFDFLGLAGWALAILGQS

SEQ ID NO: 2391713 - protein, 23 aa, Entamoeba dispar
VIGMKERFECPAVFTDKYTSVNI

SEQ ID NO: 2391714 - protein, 18 aa, Entamoeba dispar
VIHALAYYSTENNEIINP

SEQ ID NO: 2391715 - protein, 20 aa, Entamoeba dispar
VIHKHIHFLNSLLIDVVTFL

SEQ ID NO: 2391716 - protein, 23 aa, Entamoeba dispar
VIIGFACSFCFGDATRTPVTHNW

SEQ ID NO: 2391717 - protein, 18 aa, Entamoeba dispar
VIIISFFIGWHMVMAIGG

SEQ ID NO: 2391718 - protein, 24 aa, Entamoeba dispar
VIISIIIAIVWWRRKKTAKAESKA

SEQ ID NO: 2391719 - protein, 19 aa, Entamoeba dispar
VIISIVWLFCVVQWSAFAG

SEQ ID NO: 2391720 - protein, 25 aa, Entamoeba dispar
VIIVFKYYLLYSIIISLCLFYSIII

SEQ ID NO: 2391721 - protein, 19 aa, Entamoeba dispar
VIKRNDIVGQFFCYIQLKE

SEQ ID NO: 2391722 - protein, 22 aa, Entamoeba dispar
VIKSFLFYLIFLFHLIVSVSFL

SEQ ID NO: 2391723 - protein, 19 aa, Entamoeba dispar
VILAKMYAKRGWCDDCLKT

SEQ ID NO: 2391724 - protein, 28 aa, Entamoeba dispar
VILFALSWCVFRVVDLMIAFFLFLFSDF

SEQ ID NO: 2391725 - protein, 27 aa, Entamoeba dispar
VILICDIRFPPKLAFVTMKNIYSFFYS

SEQ ID NO: 2391726 - protein, 17 aa, Entamoeba dispar
VILKCWFSVDTGMASVA

SEQ ID NO: 2391727 - protein, 23 aa, Entamoeba dispar
VILPGGVFYFMFVVMVHSLWYKW

SEQ ID NO: 2391728 - protein, 20 aa, Entamoeba dispar
VILSRLVYRKGIDLAVGIIP

SEQ ID NO: 2391729 - protein, 18 aa, Entamoeba dispar
VIMSNLFGMFNNHRIKRN

SEQ ID NO: 2391730 - protein, 20 aa, Entamoeba dispar
VINESISFITLYILFITLLY

SEQ ID NO: 2391731 - protein, 19 aa, Entamoeba dispar
VINNIKFKPSFIYQSNSKF

SEQ ID NO: 2391732 - protein, 23 aa, Entamoeba dispar
VIPERDPIAALGINGGLQMSIPC

SEQ ID NO: 2391733 - protein, 19 aa, Entamoeba dispar
VIPFAYYWYKFFGYQPGLI

SEQ ID NO: 2391734 - protein, 22 aa, Entamoeba dispar
VIPIIFRSFYFLIAFFGSLTII

SEQ ID NO: 2391735 - protein, 28 aa, Entamoeba dispar
VIPILPCELRKKVIFNFVLSHKLFNTLF

SEQ ID NO: 2391736 - protein, 17 aa, Entamoeba dispar
VIPSEILIFEGCSSEGI

SEQ ID NO: 2391737 - protein, 17 aa, Entamoeba dispar
VIPTILLLKSALWKEEW

SEQ ID NO: 2391738 - protein, 18 aa, Entamoeba dispar
VIQQLIFHLHINHVKFNK

SEQ ID NO: 2391739 - protein, 17 aa, Entamoeba dispar
VIQRRLKLLEIIDKDQN

SEQ ID NO: 2391740 - protein, 28 aa, Entamoeba dispar
VIQTLKGECKFTFKEMQTLNVKRDKVNL

SEQ ID NO: 2391741 - protein, 24 aa, Entamoeba dispar
VIRGIKIYFGKKVPKQINFKERNY

SEQ ID NO: 2391742 - protein, 17 aa, Entamoeba dispar
VIRQCEDKIDIILEILL

SEQ ID NO: 2391743 - protein, 19 aa, Entamoeba dispar
VISAFTFRAVTNIYKGRDG

SEQ ID NO: 2391744 - protein, 22 aa, Entamoeba dispar
VISALCPPFFFYIQRIYSKSED

SEQ ID NO: 2391745 - protein, 25 aa, Entamoeba dispar
VISIPFKLYITFVIREKYGMNNMSI

SEQ ID NO: 2391746 - protein, 17 aa, Entamoeba dispar
VISIPGFTSSERIYYQN

SEQ ID NO: 2391747 - protein, 22 aa, Entamoeba dispar
VISNWKCMVFFVIFTICLCLLY

SEQ ID NO: 2391748 - protein, 25 aa, Entamoeba dispar
VISRFACSWSLGKAIGFCVSGPMKT

SEQ ID NO: 2391749 - protein, 23 aa, Entamoeba dispar
VISYKEMIKFIIFFIKQKLGKID

SEQ ID NO: 2391750 - protein, 23 aa, Entamoeba dispar
VISYRDMFRFIIFFIKQKLGKID

SEQ ID NO: 2391751 - protein, 20 aa, Entamoeba dispar
VITHCFVCNCLYRGLYPYTI

SEQ ID NO: 2391752 - protein, 20 aa, Entamoeba dispar
VITIIPGLILLWKLIVKPKL

SEQ ID NO: 2391753 - protein, 19 aa, Entamoeba dispar
VIVGGTLNFTALARDADGV

SEQ ID NO: 2391754 - protein, 24 aa, Entamoeba dispar
VIVKICLIAEKFAKTPQWYVDIML

SEQ ID NO: 2391755 - protein, 19 aa, Entamoeba dispar
VIVTFCISISMTIPNPWFS

SEQ ID NO: 2391756 - protein, 20 aa, Entamoeba dispar
VIVWIEPWFVGGVLGVSLSL

SEQ ID NO: 2391757 - protein, 25 aa, Entamoeba dispar
VIYPYCFLHHYGLKKWSMIGLILHV

SEQ ID NO: 2391758 - protein, 25 aa, Entamoeba dispar
VKACLTIFYLFKVVYWTISGLQIRA

SEQ ID NO: 2391759 - protein, 23 aa, Entamoeba dispar
VKAISSICKKVCCYKDKVKEWLK

SEQ ID NO: 2391760 - protein, 18 aa, Entamoeba dispar
VKASSDWSYYHSGIYSHS

SEQ ID NO: 2391761 - protein, 19 aa, Entamoeba dispar
VKATGPICNVCRKNYLPQS

SEQ ID NO: 2391762 - protein, 18 aa, Entamoeba dispar
VKAYLVIFYALLIYFPQL

SEQ ID NO: 2391763 - protein, 26 aa, Entamoeba dispar
VKCADRIKSYIVISVVMLLGLLVSSM

SEQ ID NO: 2391764 - protein, 23 aa, Entamoeba dispar
VKCLSQSMPAKWYHMKGTGKYYL

SEQ ID NO: 2391765 - protein, 21 aa, Entamoeba dispar
VKCSHILPGGKCAICNAGYYT

SEQ ID NO: 2391766 - protein, 24 aa, Entamoeba dispar
VKDKYRIVIDHSKLNFGTEDNLAE

SEQ ID NO: 2391767 - protein, 25 aa, Entamoeba dispar
VKDSIEWYFKVFICQTKIEGIINSI

SEQ ID NO: 2391768 - protein, 18 aa, Entamoeba dispar
VKEFKFGKQYLHLNGSVL

SEQ ID NO: 2391769 - protein, 22 aa, Entamoeba dispar
VKEGKCELCNAVLSNCKNCLNE

SEQ ID NO: 2391770 - protein, 18 aa, Entamoeba dispar
VKELPKLLRVFELGSEGK

SEQ ID NO: 2391771 - protein, 17 aa, Entamoeba dispar
VKERHNWIDSLLLTQNG

SEQ ID NO: 2391772 - protein, 25 aa, Entamoeba dispar
VKFFALAYFRFPSFRVKLTQYYTNL

SEQ ID NO: 2391773 - protein, 24 aa, Entamoeba dispar
VKFFDERPVFSFRNSVVGMKRVLK

SEQ ID NO: 2391774 - protein, 18 aa, Entamoeba dispar
VKFFDGMIYIKTQSTLKN

SEQ ID NO: 2391775 - protein, 18 aa, Entamoeba dispar
VKFGIQFISYLLTFIGSI

SEQ ID NO: 2391776 - protein, 21 aa, Entamoeba dispar
VKFIISDSYVLVPLRLLMKSF

SEQ ID NO: 2391777 - protein, 33 aa, Entamoeba dispar
VKFINKYFINYTVFELIFLWFIISTSNFRKVLF

SEQ ID NO: 2391778 - protein, 21 aa, Entamoeba dispar
VKFLINIIMRINNVKDIETKD

SEQ ID NO: 2391779 - protein, 19 aa, Entamoeba dispar
VKFTQRRARFQGVGDQMWH

SEQ ID NO: 2391780 - protein, 21 aa, Entamoeba dispar
VKGELIWPIVDTIITRYTIAP

SEQ ID NO: 2391781 - protein, 27 aa, Entamoeba dispar
VKGFSIGCAIVLTTICSIFIFGTQVDT

SEQ ID NO: 2391782 - protein, 20 aa, Entamoeba dispar
VKGICAYPSSGNRIMTINLV

SEQ ID NO: 2391783 - protein, 21 aa, Entamoeba dispar
VKIGRDLLKCVTRALVQNLNQ

SEQ ID NO: 2391784 - protein, 17 aa, Entamoeba dispar
VKIIVLILLMLILGAII

SEQ ID NO: 2391785 - protein, 19 aa, Entamoeba dispar
VKILDDMAVALSYLHQNSI

SEQ ID NO: 2391786 - protein, 19 aa, Entamoeba dispar
VKISKDFTSTIKLSSNSYI

SEQ ID NO: 2391787 - protein, 18 aa, Entamoeba dispar
VKITLPMYTPDAEFDRHE

SEQ ID NO: 2391788 - protein, 23 aa, Entamoeba dispar
VKKDSRYFIAFRWFMVQLLINVK

SEQ ID NO: 2391789 - protein, 30 aa, Entamoeba dispar
VKKFPAGDGFFLQWMMSIGILIIGTFTMLI

SEQ ID NO: 2391790 - protein, 25 aa, Entamoeba dispar
VKKKFFRICLVVVIIILLSFLVGLI

SEQ ID NO: 2391791 - protein, 19 aa, Entamoeba dispar
VKKMYKIFFMYINEEEIEK

SEQ ID NO: 2391792 - protein, 18 aa, Entamoeba dispar
VKKPSLIEITGFKTNLSI

SEQ ID NO: 2391793 - protein, 24 aa, Entamoeba dispar
VKKSVRYLLKRAFETKSNETNKIL

SEQ ID NO: 2391794 - protein, 20 aa, Entamoeba dispar
VKLSIPKHCYGYLNVIALTF

SEQ ID NO: 2391795 - protein, 18 aa, Entamoeba dispar
VKMIIAILVVIFGVLCIG

SEQ ID NO: 2391796 - protein, 26 aa, Entamoeba dispar
VKMSKICSVSGCVSLGLSEINEIGEA

SEQ ID NO: 2391797 - protein, 17 aa, Entamoeba dispar
VKNDILLSLGLEEAIVF

SEQ ID NO: 2391798 - protein, 17 aa, Entamoeba dispar
VKNEFKIISPLFVNQKK

SEQ ID NO: 2391799 - protein, 21 aa, Entamoeba dispar
VKNGECAPCNELEHCASCSGD

SEQ ID NO: 2391800 - protein, 20 aa, Entamoeba dispar
VKNYKFGVLYAKPNQKTEDE

SEQ ID NO: 2391801 - protein, 24 aa, Entamoeba dispar
VKPECYLSILLFDTMASNECIIID

SEQ ID NO: 2391802 - protein, 20 aa, Entamoeba dispar
VKPYPGISLTQWGVCILLGL

SEQ ID NO: 2391803 - protein, 20 aa, Entamoeba dispar
VKRALDEKAIKEGKKPKFNT

SEQ ID NO: 2391804 - protein, 17 aa, Entamoeba dispar
VKRMVKEFYSFADNEMK

SEQ ID NO: 2391805 - protein, 22 aa, Entamoeba dispar
VKRVEEAIGIIEVIRKFLTNNK

SEQ ID NO: 2391806 - protein, 20 aa, Entamoeba dispar
VKRYLNKDVHDLFMNTLTQW

SEQ ID NO: 2391807 - protein, 19 aa, Entamoeba dispar
VKSLFFSHIIWFYTATLIV

SEQ ID NO: 2391808 - protein, 18 aa, Entamoeba dispar
VKSNIVIKKVELILISRR

SEQ ID NO: 2391809 - protein, 17 aa, Entamoeba dispar
VKSSFVLSNLPPVKFQG

SEQ ID NO: 2391810 - protein, 17 aa, Entamoeba dispar
VKTAISIFDIIPFEFPL

SEQ ID NO: 2391811 - protein, 18 aa, Entamoeba dispar
VKTKILLFQYLIDLIPNT

SEQ ID NO: 2391812 - protein, 21 aa, Entamoeba dispar
VKTLECGFVTFSNYIQYWVLG

SEQ ID NO: 2391813 - protein, 35 aa, Entamoeba dispar
VKTTKYCWWSFIPVFLFNQFKYFINLFFLIIAILS

SEQ ID NO: 2391814 - protein, 24 aa, Entamoeba dispar
VKTWNWYLLFSYIFSFILIFTIFY

SEQ ID NO: 2391815 - protein, 23 aa, Entamoeba dispar
VKVILELFSQWLLPNPSKIDHIL

SEQ ID NO: 2391816 - protein, 23 aa, Entamoeba dispar
VKVKDGYYRYSFSNSGAVCTLTC

SEQ ID NO: 2391817 - protein, 24 aa, Entamoeba dispar
VKVLIKLVLIISIITSIMFGIIRV

SEQ ID NO: 2391818 - protein, 18 aa, Entamoeba dispar
VKVPFALKSLAIIVDENT

SEQ ID NO: 2391819 - protein, 17 aa, Entamoeba dispar
VKYIKGINYDIFTYSSG

SEQ ID NO: 2391820 - protein, 17 aa, Entamoeba dispar
VKYTFTVEIKRVIGVKK

SEQ ID NO: 2391821 - protein, 24 aa, Entamoeba dispar
VLCFVMGIAVLCFFLNQLYIIYKG

SEQ ID NO: 2391822 - protein, 18 aa, Entamoeba dispar
VLCIHLTLAQCYKDGVVT

SEQ ID NO: 2391823 - protein, 18 aa, Entamoeba dispar
VLDKTLCTFTFPDHDLSS

SEQ ID NO: 2391824 - protein, 27 aa, Entamoeba dispar
VLEGWKFSYKSGYYFGLLNIIFVSVSF

SEQ ID NO: 2391825 - protein, 32 aa, Entamoeba dispar
VLEKACKKRTILKLKHSFPSVLEREEVIEQTN

SEQ ID NO: 2391826 - protein, 17 aa, Entamoeba dispar
VLFAGIVIGAISTILFR

SEQ ID NO: 2391827 - protein, 18 aa, Entamoeba dispar
VLFAIRLVCVYLTILPDP

SEQ ID NO: 2391828 - protein, 21 aa, Entamoeba dispar
VLFCGLIIMLVEYYFPSLSEN

SEQ ID NO: 2391829 - protein, 25 aa, Entamoeba dispar
VLFDCGFVWQYYCVLTIFYCIIMFI

SEQ ID NO: 2391830 - protein, 33 aa, Entamoeba dispar
VLFGIVLTCCMFLSTRLEGFTTKIIDNYEEILP

SEQ ID NO: 2391831 - protein, 18 aa, Entamoeba dispar
VLFLWLLLWVISGCFVCD

SEQ ID NO: 2391832 - protein, 25 aa, Entamoeba dispar
VLFMQKKFQSIISMIVQYDKKDIHF

SEQ ID NO: 2391833 - protein, 23 aa, Entamoeba dispar
VLGEKKYGLHLFENYLIGQTTVE

SEQ ID NO: 2391834 - protein, 27 aa, Entamoeba dispar
VLGMVPALFLRRIYDIGMSKFDQYVFF

SEQ ID NO: 2391835 - protein, 24 aa, Entamoeba dispar
VLHPEFKYYQGFHDIVSYLLFTSE

SEQ ID NO: 2391836 - protein, 19 aa, Entamoeba dispar
VLHPIFLKIVFALDDLLNY

SEQ ID NO: 2391837 - protein, 23 aa, Entamoeba dispar
VLICAMLSFELCYRKNETSILCT

SEQ ID NO: 2391838 - protein, 19 aa, Entamoeba dispar
VLIDPEIFTDFSLNSPKEN

SEQ ID NO: 2391839 - protein, 22 aa, Entamoeba dispar
VLIGIIWWRRSRSVKAETAAIK

SEQ ID NO: 2391840 - protein, 25 aa, Entamoeba dispar
VLIGITILCLFVFVFYIILFNISLT

SEQ ID NO: 2391841 - protein, 24 aa, Entamoeba dispar
VLIGKKNVLEWWVPSTIANIRTYN

SEQ ID NO: 2391842 - protein, 17 aa, Entamoeba dispar
VLIHISFTISLILGYGG

SEQ ID NO: 2391843 - protein, 17 aa, Entamoeba dispar
VLILIELLNIGFTIRRW

SEQ ID NO: 2391844 - protein, 23 aa, Entamoeba dispar
VLIMWMIWIPLHFISSIRFDIFP

SEQ ID NO: 2391845 - protein, 17 aa, Entamoeba dispar
VLIRINDLLSFDGNEGV

SEQ ID NO: 2391846 - protein, 17 aa, Entamoeba dispar
VLIRLHLFLDFYSFNIP

SEQ ID NO: 2391847 - protein, 17 aa, Entamoeba dispar
VLKGKMETIFPLHGNNF

SEQ ID NO: 2391848 - protein, 20 aa, Entamoeba dispar
VLKPKCKNWSIIAKVMDLQG

SEQ ID NO: 2391849 - protein, 17 aa, Entamoeba dispar
VLKQFGVVLSFAVLLDT

SEQ ID NO: 2391850 - protein, 24 aa, Entamoeba dispar
VLKTFYPEVEFDNFFEVFNQCIKT

SEQ ID NO: 2391851 - protein, 23 aa, Entamoeba dispar
VLLEAPKKYLLILPGETSTSFCV

SEQ ID NO: 2391852 - protein, 24 aa, Entamoeba dispar
VLLIFRYILLFVVFLSFIFNSFIK

SEQ ID NO: 2391853 - protein, 18 aa, Entamoeba dispar
VLLPEVIKRNDIVGQFFC

SEQ ID NO: 2391854 - protein, 18 aa, Entamoeba dispar
VLLPSCYILIFFFYSFSI

SEQ ID NO: 2391855 - protein, 22 aa, Entamoeba dispar
VLLQRILCGLSRKNATYQTLEI

SEQ ID NO: 2391856 - protein, 17 aa, Entamoeba dispar
VLLSHFLIGFIILNANM

SEQ ID NO: 2391857 - protein, 18 aa, Entamoeba dispar
VLLSKIIHSCWEHEEYRS

SEQ ID NO: 2391858 - protein, 29 aa, Entamoeba dispar
VLLVLRLDRVFMFPSIVPFLFFSVSIITK

SEQ ID NO: 2391859 - protein, 22 aa, Entamoeba dispar
VLLWAGCGITFSRCIPDKGDNT

SEQ ID NO: 2391860 - protein, 26 aa, Entamoeba dispar
VLLYVACGWCLFTIVRIHYTSDVFVG

SEQ ID NO: 2391861 - protein, 36 aa, Entamoeba dispar
VLMALPRYPLLTGWKTEFMIGYSLPNEVVISKGKAI

SEQ ID NO: 2391862 - protein, 17 aa, Entamoeba dispar
VLMCCFLSCCFYGVTVI

SEQ ID NO: 2391863 - protein, 31 aa, Entamoeba dispar
VLMIQFGVMLYFRFAPFIKENEIVASFEKSV

SEQ ID NO: 2391864 - protein, 25 aa, Entamoeba dispar
VLMMDKMRCPYIINFVGAVDTPDHY

SEQ ID NO: 2391865 - protein, 26 aa, Entamoeba dispar
VLMPMLMVFGSFIFFCINPSMCSLNV

SEQ ID NO: 2391866 - protein, 21 aa, Entamoeba dispar
VLNEKNCRCVGYIQRPTIPQP

SEQ ID NO: 2391867 - protein, 20 aa, Entamoeba dispar
VLNKFMLFIHQWKENSQTIK

SEQ ID NO: 2391868 - protein, 18 aa, Entamoeba dispar
VLNPRMVYANALRQRLKD

SEQ ID NO: 2391869 - protein, 24 aa, Entamoeba dispar
VLNQELFLRQSIIYISKSLLIESA

SEQ ID NO: 2391870 - protein, 19 aa, Entamoeba dispar
VLPCQFCGMNAISTDNGTK

SEQ ID NO: 2391871 - protein, 27 aa, Entamoeba dispar
VLPYKLKMRMLLDCAKGMVFLHENKIV

SEQ ID NO: 2391872 - protein, 26 aa, Entamoeba dispar
VLQPTVCPFKVFPKIYVKKQTDSYEI

SEQ ID NO: 2391873 - protein, 18 aa, Entamoeba dispar
VLRLCNFDLFTREVDDDY

SEQ ID NO: 2391874 - protein, 18 aa, Entamoeba dispar
VLRNKFPSSVSLGIDINN

SEQ ID NO: 2391875 - protein, 17 aa, Entamoeba dispar
VLRSFAILLPKTGYCQG

SEQ ID NO: 2391876 - protein, 23 aa, Entamoeba dispar
VLSQLHFSISILSYFIFIFISSF

SEQ ID NO: 2391877 - protein, 25 aa, Entamoeba dispar
VLSSCPHKIHLECYLKDYEDSGNEE

SEQ ID NO: 2391878 - protein, 21 aa, Entamoeba dispar
VLSSKLIKLMKEYRDIQELNK

SEQ ID NO: 2391879 - protein, 18 aa, Entamoeba dispar
VLTFVMTPLFPPVMRLFN

SEQ ID NO: 2391880 - protein, 21 aa, Entamoeba dispar
VLTIFYCIIMFISCINAIILS

SEQ ID NO: 2391881 - protein, 19 aa, Entamoeba dispar
VLTPEEFVNAGDFLVNKYR

SEQ ID NO: 2391882 - protein, 18 aa, Entamoeba dispar
VLTVGVIIFGSFRESRLP

SEQ ID NO: 2391883 - protein, 20 aa, Entamoeba dispar
VLVLKFLEYMLFNYSSDFRI

SEQ ID NO: 2391884 - protein, 19 aa, Entamoeba dispar
VLVVIAGMVMYVYKSDNLI

SEQ ID NO: 2391885 - protein, 19 aa, Entamoeba dispar
VLVVKWRFGKNHEESSVTT

SEQ ID NO: 2391886 - protein, 19 aa, Entamoeba dispar
VLYDGFKIVFDGIQNEPEK

SEQ ID NO: 2391887 - protein, 25 aa, Entamoeba dispar
VLYKKWSRKHAKSFTIDGQSYPFTP

SEQ ID NO: 2391888 - protein, 18 aa, Entamoeba dispar
VLYYLIYLQFPFKINSLN

SEQ ID NO: 2391889 - protein, 18 aa, Entamoeba dispar
VMFFYDIFWVFGSVNVSL

SEQ ID NO: 2391890 - protein, 17 aa, Entamoeba dispar
VMIGISIIFSWKKTSGI

SEQ ID NO: 2391891 - protein, 17 aa, Entamoeba dispar
VMIIFSIIETIMCTMPV

SEQ ID NO: 2391892 - protein, 24 aa, Entamoeba dispar
VMKDGVCRVCPDGYYSNRINCNKC

SEQ ID NO: 2391893 - protein, 29 aa, Entamoeba dispar
VMMSECFDHRFCLHLGEGHWHNERLREFY

SEQ ID NO: 2391894 - protein, 28 aa, Entamoeba dispar
VMNLEIKGDITINGFSRVDIKSQTGEFK

SEQ ID NO: 2391895 - protein, 20 aa, Entamoeba dispar
VMSFSTFWVYLRSLFLLFQF

SEQ ID NO: 2391896 - protein, 17 aa, Entamoeba dispar
VNACKFFNKVFKIGDND

SEQ ID NO: 2391897 - protein, 20 aa, Entamoeba dispar
VNAYGYYLGIYFMKKIINYK

SEQ ID NO: 2391898 - protein, 27 aa, Entamoeba dispar
VNDKFVARCGWGMVGLFEIILDSIIFV

SEQ ID NO: 2391899 - protein, 25 aa, Entamoeba dispar
VNFVVGLPVLFTRVLVKYINNYKEP

SEQ ID NO: 2391900 - protein, 17 aa, Entamoeba dispar
VNGAAAMSVSLKGEQQY

SEQ ID NO: 2391901 - protein, 19 aa, Entamoeba dispar
VNGGIGAICDTFLKKPNIQ

SEQ ID NO: 2391902 - protein, 19 aa, Entamoeba dispar
VNGGPGAICKTFLNKEGLD

SEQ ID NO: 2391903 - protein, 17 aa, Entamoeba dispar
VNICEPFDFNNTRLYNV

SEQ ID NO: 2391904 - protein, 19 aa, Entamoeba dispar
VNIERRRQLMLTTMIILSN

SEQ ID NO: 2391905 - protein, 19 aa, Entamoeba dispar
VNIIEYSLDWDKRNNNPMI

SEQ ID NO: 2391906 - protein, 21 aa, Entamoeba dispar
VNIVMKLACDQLFEQTKIDPT

SEQ ID NO: 2391907 - protein, 21 aa, Entamoeba dispar
VNKYRTWQWVGASDCKKTVDY

SEQ ID NO: 2391908 - protein, 18 aa, Entamoeba dispar
VNLIKKRDEDIIAENIQG

SEQ ID NO: 2391909 - protein, 17 aa, Entamoeba dispar
VNMLQRRILALIITLDE

SEQ ID NO: 2391910 - protein, 23 aa, Entamoeba dispar
VNNFTNDLDICFANTQKNYFYID

SEQ ID NO: 2391911 - protein, 25 aa, Entamoeba dispar
VNPHCSVHLIGIFKILIDNLSTGKR

SEQ ID NO: 2391912 - protein, 23 aa, Entamoeba dispar
VNPKECNPELVLFEILHQSIMQF

SEQ ID NO: 2391913 - protein, 18 aa, Entamoeba dispar
VNRMYAMMVDKNCDGTVK

SEQ ID NO: 2391914 - protein, 28 aa, Entamoeba dispar
VNSLITRGVFCFIRKSGNIYALLNNEEI

SEQ ID NO: 2391915 - protein, 18 aa, Entamoeba dispar
VNTLMARVIYLRDFIIKT

SEQ ID NO: 2391916 - protein, 22 aa, Entamoeba dispar
VNTMLCQVCLIFFQTTKETQYK

SEQ ID NO: 2391917 - protein, 22 aa, Entamoeba dispar
VNVFSIIAMCYVNAEQYHRAMS

SEQ ID NO: 2391918 - protein, 24 aa, Entamoeba dispar
VNYKKLELYFGILHALCKYTHYIP

SEQ ID NO: 2391919 - protein, 18 aa, Entamoeba dispar
VNYLYWKKFIQTHYPEVS

SEQ ID NO: 2391920 - protein, 19 aa, Entamoeba dispar
VNYTFEFPENVTFNNLYIH

SEQ ID NO: 2391921 - protein, 23 aa, Entamoeba dispar
VPAKLLLVICENGICKMSVDQRL

SEQ ID NO: 2391922 - protein, 19 aa, Entamoeba dispar
VPCPSSLGGDCVVLTFNPY

SEQ ID NO: 2391923 - protein, 22 aa, Entamoeba dispar
VPDKLSVITCIGVLQQYLDTTP

SEQ ID NO: 2391924 - protein, 20 aa, Entamoeba dispar
VPFTYCEFGTHISLILLLIF

SEQ ID NO: 2391925 - protein, 19 aa, Entamoeba dispar
VPGIPKYVFISMAFADIFT

SEQ ID NO: 2391926 - protein, 26 aa, Entamoeba dispar
VPGMSVRNISYWGWLFTLKQPLFYLM

SEQ ID NO: 2391927 - protein, 26 aa, Entamoeba dispar
VPIGFRCKKELTPCCIVPVVHNVPRL

SEQ ID NO: 2391928 - protein, 21 aa, Entamoeba dispar
VPIIIYRKAIKMLKYALNPEI

SEQ ID NO: 2391929 - protein, 21 aa, Entamoeba dispar
VPITLRYGQLGNILKDIKREN

SEQ ID NO: 2391930 - protein, 17 aa, Entamoeba dispar
VPIYLGVHIFHILEAVL

SEQ ID NO: 2391931 - protein, 21 aa, Entamoeba dispar
VPKGLPTKAIDQFMSTTTIQL

SEQ ID NO: 2391932 - protein, 18 aa, Entamoeba dispar
VPLINFLLLLLIPKSINY

SEQ ID NO: 2391933 - protein, 24 aa, Entamoeba dispar
VPLRMKFPYRDVPNGWRVDIDVTP

SEQ ID NO: 2391934 - protein, 18 aa, Entamoeba dispar
VPMVGFFGAVLFGAVIST

SEQ ID NO: 2391935 - protein, 17 aa, Entamoeba dispar
VPQLFMENFFKSLQRII

SEQ ID NO: 2391936 - protein, 25 aa, Entamoeba dispar
VPSKLKELYCFSSIVTIQNPNESLL

SEQ ID NO: 2391937 - protein, 17 aa, Entamoeba dispar
VPSLFQDQCDILRLNIV

SEQ ID NO: 2391938 - protein, 18 aa, Entamoeba dispar
VPSWCDRVLYKTERRHGV

SEQ ID NO: 2391939 - protein, 18 aa, Entamoeba dispar
VPTLAAIVPYFTKQTLSK

SEQ ID NO: 2391940 - protein, 17 aa, Entamoeba dispar
VPVAIKIFRWENLTEEE

SEQ ID NO: 2391941 - protein, 19 aa, Entamoeba dispar
VPVLDWIRNYGNTFSGLKS

SEQ ID NO: 2391942 - protein, 26 aa, Entamoeba dispar
VPVMCTDVLVGLCLDYDIFLFSRVLE

SEQ ID NO: 2391943 - protein, 19 aa, Entamoeba dispar
VPVTIRYGKFKQIMQELLE

SEQ ID NO: 2391944 - protein, 24 aa, Entamoeba dispar
VPVTLRYGKLKSILKEIEKNNPEV

SEQ ID NO: 2391945 - protein, 17 aa, Entamoeba dispar
VPWFDLRGNHDVDGVYG

SEQ ID NO: 2391946 - protein, 25 aa, Entamoeba dispar
VQDGMSLKFGRLFQTFSSFLTGYLV

SEQ ID NO: 2391947 - protein, 27 aa, Entamoeba dispar
VQFNPMVIVKYSWFFFDLIIRSLVYYL

SEQ ID NO: 2391948 - protein, 25 aa, Entamoeba dispar
VQKILSWKETDDFILKLQLDGKAVT

SEQ ID NO: 2391949 - protein, 17 aa, Entamoeba dispar
VQLRTLFINSEHCTEYK

SEQ ID NO: 2391950 - protein, 24 aa, Entamoeba dispar
VQMMLLFSDFFCRTCSYGCDTALP

SEQ ID NO: 2391951 - protein, 25 aa, Entamoeba dispar
VQMPSRISPELAYVGFFQMFPTIIK

SEQ ID NO: 2391952 - protein, 26 aa, Entamoeba dispar
VQQHMPVFYGLWIVYGIILLYLKFFV

SEQ ID NO: 2391953 - protein, 26 aa, Entamoeba dispar
VQQSDWKIFWIVLLVPLILATYFAFK

SEQ ID NO: 2391954 - protein, 26 aa, Entamoeba dispar
VQSRFLDFLLSWKIFGLLYVFSMAVG

SEQ ID NO: 2391955 - protein, 19 aa, Entamoeba dispar
VRAAKCYYDIWKKEEKDIL

SEQ ID NO: 2391956 - protein, 17 aa, Entamoeba dispar
VRAPVWYCMATEGCSYK

SEQ ID NO: 2391957 - protein, 17 aa, Entamoeba dispar
VRELQKVLLSIGINQIH

SEQ ID NO: 2391958 - protein, 18 aa, Entamoeba dispar
VRELRFNIEIVTGLKACR

SEQ ID NO: 2391959 - protein, 26 aa, Entamoeba dispar
VRGDGRRYAIHTCFTQSSGSDHTSLE

SEQ ID NO: 2391960 - protein, 22 aa, Entamoeba dispar
VRGEFIPLTFPVHTYTTDNTVY

SEQ ID NO: 2391961 - protein, 23 aa, Entamoeba dispar
VRGPDQLCCTITILFVIFGIISI

SEQ ID NO: 2391962 - protein, 19 aa, Entamoeba dispar
VRIFELFIIDILYAFYAFN

SEQ ID NO: 2391963 - protein, 26 aa, Entamoeba dispar
VRILKIPSSTLWFSFHELPKIGISYN

SEQ ID NO: 2391964 - protein, 26 aa, Entamoeba dispar
VRIQRFSVCFFKMLYFFITAPLGVGF

SEQ ID NO: 2391965 - protein, 18 aa, Entamoeba dispar
VRKATEWAVQKVNLIKKE

SEQ ID NO: 2391966 - protein, 23 aa, Entamoeba dispar
VRKAVRALGRCAIKLENVANQCI

SEQ ID NO: 2391967 - protein, 19 aa, Entamoeba dispar
VRKKAALTLKHLYLKNPTI

SEQ ID NO: 2391968 - protein, 19 aa, Entamoeba dispar
VRKSVKLEPVDVCCLLYSI

SEQ ID NO: 2391969 - protein, 17 aa, Entamoeba dispar
VRKVLYYLHQRYTYQQI

SEQ ID NO: 2391970 - protein, 22 aa, Entamoeba dispar
VRLTPSCIHLLLLTLKDKNVNE

SEQ ID NO: 2391971 - protein, 18 aa, Entamoeba dispar
VRLVPWLHIFSESIVSLF

SEQ ID NO: 2391972 - protein, 17 aa, Entamoeba dispar
VRMSMVFLTIGEAIVAI

SEQ ID NO: 2391973 - protein, 19 aa, Entamoeba dispar
VRNLLKFESYIVIPTSVKT

SEQ ID NO: 2391974 - protein, 23 aa, Entamoeba dispar
VRQLKYWGTLVIVYWIFFFILLF

SEQ ID NO: 2391975 - protein, 18 aa, Entamoeba dispar
VRSNLSLNSKRLYEISQI

SEQ ID NO: 2391976 - protein, 25 aa, Entamoeba dispar
VRSSVKRICKIFAIEHPDVGYQQGI

SEQ ID NO: 2391977 - protein, 21 aa, Entamoeba dispar
VRVGEELDLIGYVKPSVTGMF

SEQ ID NO: 2391978 - protein, 25 aa, Entamoeba dispar
VRYIKHPYLSRRGNDLVIDKKAVSK

SEQ ID NO: 2391979 - protein, 19 aa, Entamoeba dispar
VSAFFRKSLPEEKYQNFAL

SEQ ID NO: 2391980 - protein, 24 aa, Entamoeba dispar
VSAKEILSFMGGEICKNDNDKKKY

SEQ ID NO: 2391981 - protein, 21 aa, Entamoeba dispar
VSAKILYKIITTMRGVKTFDQ

SEQ ID NO: 2391982 - protein, 21 aa, Entamoeba dispar
VSAVVLCIIGSVFVGESPLNA

SEQ ID NO: 2391983 - protein, 17 aa, Entamoeba dispar
VSCAVMILLVIVEKDPK

SEQ ID NO: 2391984 - protein, 31 aa, Entamoeba dispar
VSCKREALCLKKNLKCLVAMINVFVAIIPKE

SEQ ID NO: 2391985 - protein, 20 aa, Entamoeba dispar
VSCNTFRIISKINTTLISDV

SEQ ID NO: 2391986 - protein, 23 aa, Entamoeba dispar
VSCPHYFCEIMTWIFFNALTGFP

SEQ ID NO: 2391987 - protein, 24 aa, Entamoeba dispar
VSDAFECIESVKINNTFTQYVQET

SEQ ID NO: 2391988 - protein, 23 aa, Entamoeba dispar
VSEFLLNYGFAFFSICIAEMCCF

SEQ ID NO: 2391989 - protein, 19 aa, Entamoeba dispar
VSEGLRLVNKYLIECDVNS

SEQ ID NO: 2391990 - protein, 22 aa, Entamoeba dispar
VSELLEILFWKYLKEEPGASAE

SEQ ID NO: 2391991 - protein, 18 aa, Entamoeba dispar
VSEQFGFTRTQDFIVPLK

SEQ ID NO: 2391992 - protein, 17 aa, Entamoeba dispar
VSEQFSHEFKCALNSVF

SEQ ID NO: 2391993 - protein, 17 aa, Entamoeba dispar
VSFFDLILFLFGQHQHF

SEQ ID NO: 2391994 - protein, 23 aa, Entamoeba dispar
VSFPRFRIYFLGWYLIPAAGGCI

SEQ ID NO: 2391995 - protein, 22 aa, Entamoeba dispar
VSGCDWHFRVNLYGTCSLEQCN

SEQ ID NO: 2391996 - protein, 18 aa, Entamoeba dispar
VSGCIVFGIICGSLSFLF

SEQ ID NO: 2391997 - protein, 17 aa, Entamoeba dispar
VSGKIWLYAITLEVAMT

SEQ ID NO: 2391998 - protein, 18 aa, Entamoeba dispar
VSGKLLYLTSGKGILEVL

SEQ ID NO: 2391999 - protein, 22 aa, Entamoeba dispar
VSHCYCDGMAAMRLLKDSTQHI

SEQ ID NO: 2392000 - protein, 26 aa, Entamoeba dispar
VSHHLKIKFCLDAAKAIEYLHSNGIL

SEQ ID NO: 2392001 - protein, 21 aa, Entamoeba dispar
VSIFELIKYFIFIIKNITGYC

SEQ ID NO: 2392002 - protein, 26 aa, Entamoeba dispar
VSIRQRYCELWKIKKRRMMIDINLNK

SEQ ID NO: 2392003 - protein, 23 aa, Entamoeba dispar
VSISEKISIGWIAKSLPWLMFIG

SEQ ID NO: 2392004 - protein, 17 aa, Entamoeba dispar
VSISFTALILIQLINVG

SEQ ID NO: 2392005 - protein, 22 aa, Entamoeba dispar
VSKDFLTVTGINPISFSTGFSE

SEQ ID NO: 2392006 - protein, 21 aa, Entamoeba dispar
VSKEIDRFIGLKYDMPNKVEA

SEQ ID NO: 2392007 - protein, 19 aa, Entamoeba dispar
VSLEVAKFIQTMLMECDTD

SEQ ID NO: 2392008 - protein, 19 aa, Entamoeba dispar
VSLFIELLSSFMLPCAVVM

SEQ ID NO: 2392009 - protein, 17 aa, Entamoeba dispar
VSLISFFIFKPRILSHI

SEQ ID NO: 2392010 - protein, 19 aa, Entamoeba dispar
VSLLRCFLASLPEPLIPES

SEQ ID NO: 2392011 - protein, 19 aa, Entamoeba dispar
VSLTTCFKETTLNSRLILT

SEQ ID NO: 2392012 - protein, 22 aa, Entamoeba dispar
VSMNCICCTFVDFIVIGLKTKV

SEQ ID NO: 2392013 - protein, 20 aa, Entamoeba dispar
VSMSHIYSMFSFNSLVIKQN

SEQ ID NO: 2392014 - protein, 17 aa, Entamoeba dispar
VSNAPRYDIEYKFTLNL

SEQ ID NO: 2392015 - protein, 19 aa, Entamoeba dispar
VSNINGFRRYVICQGQKSQ

SEQ ID NO: 2392016 - protein, 20 aa, Entamoeba dispar
VSNINGFRRYVICQGQKSQS

SEQ ID NO: 2392017 - protein, 26 aa, Entamoeba dispar
VSNPSRLSKWLPIISLVYSQHLDQVW

SEQ ID NO: 2392018 - protein, 27 aa, Entamoeba dispar
VSNRSTNAIAYWIATTCSILIHIKCYV

SEQ ID NO: 2392019 - protein, 18 aa, Entamoeba dispar
VSPQRFGSRMLLPNDNGH

SEQ ID NO: 2392020 - protein, 26 aa, Entamoeba dispar
VSPSLKQLHIFGAVFAENGFFQRSDS

SEQ ID NO: 2392021 - protein, 28 aa, Entamoeba dispar
VSRFNFSNIFTLIPIILIYSMFSRLSFN

SEQ ID NO: 2392022 - protein, 17 aa, Entamoeba dispar
VSSCAFAGTSNILKVQQ

SEQ ID NO: 2392023 - protein, 22 aa, Entamoeba dispar
VSSDFFIIFDILHICQSSLMIN

SEQ ID NO: 2392024 - protein, 30 aa, Entamoeba dispar
VSSETGKICRICFETGKCITFRNYGALSER

SEQ ID NO: 2392025 - protein, 17 aa, Entamoeba dispar
VSSKGVSNSWYNFVVKD

SEQ ID NO: 2392026 - protein, 18 aa, Entamoeba dispar
VSSLCIIQIESEETSGVL

SEQ ID NO: 2392027 - protein, 22 aa, Entamoeba dispar
VSSYDIPSGWGKYTNEYTYLVT

SEQ ID NO: 2392028 - protein, 18 aa, Entamoeba dispar
VSTIFVMSILIGYYSMNA

SEQ ID NO: 2392029 - protein, 25 aa, Entamoeba dispar
VSTKDRFKLIYSLVSNSSYDYMGYS

SEQ ID NO: 2392030 - protein, 26 aa, Entamoeba dispar
VSTLKMSSLYPCLSPITQALIRSECK

SEQ ID NO: 2392031 - protein, 21 aa, Entamoeba dispar
VSTRFSDCFIFDRTDDLITPH

SEQ ID NO: 2392032 - protein, 18 aa, Entamoeba dispar
VSVCAKLTDFGSARNINM

SEQ ID NO: 2392033 - protein, 26 aa, Entamoeba dispar
VSVCIWPFCTGFFWPVTTGTVGLEAP

SEQ ID NO: 2392034 - protein, 19 aa, Entamoeba dispar
VSVEGWFGVSFSVGTILFL

SEQ ID NO: 2392035 - protein, 19 aa, Entamoeba dispar
VSWERIVLMGHSLGGGVSI

SEQ ID NO: 2392036 - protein, 23 aa, Entamoeba dispar
VSYKTVICLISLGIMMTLILSEM

SEQ ID NO: 2392037 - protein, 25 aa, Entamoeba dispar
VSYPMKKGESVYVFVAAHSNVDTGL

SEQ ID NO: 2392038 - protein, 19 aa, Entamoeba dispar
VTCAYLRSLQQLKLNKLFR

SEQ ID NO: 2392039 - protein, 18 aa, Entamoeba dispar
VTDLCCKLIIGCHECKVV

SEQ ID NO: 2392040 - protein, 21 aa, Entamoeba dispar
VTEIKEPIGYDFAIKTPCKKS

SEQ ID NO: 2392041 - protein, 18 aa, Entamoeba dispar
VTELCPVYSPFFGSMGIT

SEQ ID NO: 2392042 - protein, 20 aa, Entamoeba dispar
VTFICAFVVIFIVFVITKLV

SEQ ID NO: 2392043 - protein, 22 aa, Entamoeba dispar
VTFILDVNWGLLLGVFAGYGLC

SEQ ID NO: 2392044 - protein, 17 aa, Entamoeba dispar
VTGYPWVFVSSYDQKHP

SEQ ID NO: 2392045 - protein, 24 aa, Entamoeba dispar
VTIKKIKSGIVLFDAERVPSHFIH

SEQ ID NO: 2392046 - protein, 17 aa, Entamoeba dispar
VTIPIEIEENGIKISGI

SEQ ID NO: 2392047 - protein, 26 aa, Entamoeba dispar
VTKAGFKGGFILKNSWNDTIYGNYPG

SEQ ID NO: 2392048 - protein, 25 aa, Entamoeba dispar
VTKGLKEWGGAIIVGYDGDPNGKDE

SEQ ID NO: 2392049 - protein, 25 aa, Entamoeba dispar
VTKGLKEWGGAILVGYDGDPNGKDE

SEQ ID NO: 2392050 - protein, 29 aa, Entamoeba dispar
VTLHFILLILFCICFILTLVVPTLTVSNP

SEQ ID NO: 2392051 - protein, 17 aa, Entamoeba dispar
VTLLYYFCKNIKKEPIL

SEQ ID NO: 2392052 - protein, 18 aa, Entamoeba dispar
VTMFKCYLAITNWIQNDI

SEQ ID NO: 2392053 - protein, 26 aa, Entamoeba dispar
VTMKICKCLMPCWKDSFDENDIAPQF

SEQ ID NO: 2392054 - protein, 19 aa, Entamoeba dispar
VTPGSVINICIFLETDPLV

SEQ ID NO: 2392055 - protein, 19 aa, Entamoeba dispar
VTQSLRPGQSVKINVLVCA

SEQ ID NO: 2392056 - protein, 22 aa, Entamoeba dispar
VTRNPTSFLFWFITLGVQGFTV

SEQ ID NO: 2392057 - protein, 27 aa, Entamoeba dispar
VTSTPIIFRLCEWYSIIPEPDKHYSFS

SEQ ID NO: 2392058 - protein, 21 aa, Entamoeba dispar
VTSVGYFLARRRFLKNLVNKL

SEQ ID NO: 2392059 - protein, 26 aa, Entamoeba dispar
VTSYIFGLINICFWMCAQFPQLYKTF

SEQ ID NO: 2392060 - protein, 20 aa, Entamoeba dispar
VVAAILLPIILKATGVTNKD

SEQ ID NO: 2392061 - protein, 28 aa, Entamoeba dispar
VVAGVCVDSKIFVKAQFGVGQHKCTAEN

SEQ ID NO: 2392062 - protein, 24 aa, Entamoeba dispar
VVAKEMKEGIPIVLTGHSLGGGIA

SEQ ID NO: 2392063 - protein, 30 aa, Entamoeba dispar
VVALSCIKPACIYLRCKEVCEFKITINPGC

SEQ ID NO: 2392064 - protein, 25 aa, Entamoeba dispar
VVAVCGLLLIFGMIIVKFAKRNNNE

SEQ ID NO: 2392065 - protein, 19 aa, Entamoeba dispar
VVCRYDNGWKSKNCPCKGT

SEQ ID NO: 2392066 - protein, 19 aa, Entamoeba dispar
VVECGMILVLLSFFLPMVA

SEQ ID NO: 2392067 - protein, 24 aa, Entamoeba dispar
VVEFLNEFLNVFIVPSQTVQIKEQ

SEQ ID NO: 2392068 - protein, 19 aa, Entamoeba dispar
VVFAGVIGLYGLIVCIVLF

SEQ ID NO: 2392069 - protein, 25 aa, Entamoeba dispar
VVFIEQRWLRFITIIIYILLGLTAL

SEQ ID NO: 2392070 - protein, 31 aa, Entamoeba dispar
VVFLMIVTFLTWLFISRCWKNKYTESEIPND

SEQ ID NO: 2392071 - protein, 26 aa, Entamoeba dispar
VVGFLYCVFCTFLVPKTEIEEPPKNH

SEQ ID NO: 2392072 - protein, 27 aa, Entamoeba dispar
VVGKQCAELKFSTGLNELNTTTSFSGN

SEQ ID NO: 2392073 - protein, 17 aa, Entamoeba dispar
VVGLEGFYGILLSIPGM

SEQ ID NO: 2392074 - protein, 23 aa, Entamoeba dispar
VVGYYYFWWLDAVGGIVLSFYIM

SEQ ID NO: 2392075 - protein, 23 aa, Entamoeba dispar
VVIDLNKVSAFFCIENAQEPTSY

SEQ ID NO: 2392076 - protein, 17 aa, Entamoeba dispar
VVITPFVGFIFKQVKFE

SEQ ID NO: 2392077 - protein, 20 aa, Entamoeba dispar
VVIYLFWLLFEVIRSFSERR

SEQ ID NO: 2392078 - protein, 26 aa, Entamoeba dispar
VVKGFVPNCVTLFPSLMTSEDEFERC

SEQ ID NO: 2392079 - protein, 17 aa, Entamoeba dispar
VVKGLIIESECYIHESL

SEQ ID NO: 2392080 - protein, 17 aa, Entamoeba dispar
VVLKLKYLNISLDETFF

SEQ ID NO: 2392081 - protein, 18 aa, Entamoeba dispar
VVMWTDWIATLLSMLDGL

SEQ ID NO: 2392082 - protein, 17 aa, Entamoeba dispar
VVNCPYKTVPSAVVKSI

SEQ ID NO: 2392083 - protein, 26 aa, Entamoeba dispar
VVNLKPKKMCKIKVCVFPFCTLTEES

SEQ ID NO: 2392084 - protein, 25 aa, Entamoeba dispar
VVNLPEIVRYLGLNMEDILPDLIGV

SEQ ID NO: 2392085 - protein, 22 aa, Entamoeba dispar
VVNRIVPFLNNFGIEKESVITT

SEQ ID NO: 2392086 - protein, 19 aa, Entamoeba dispar
VVQALKWFVDACDTGVGEK

SEQ ID NO: 2392087 - protein, 18 aa, Entamoeba dispar
VVRYYCQYQRAFEIVKKL

SEQ ID NO: 2392088 - protein, 23 aa, Entamoeba dispar
VVSELKKGGIPITFIDKIDQEII

SEQ ID NO: 2392089 - protein, 18 aa, Entamoeba dispar
VVSKWKGHVETLVPLLAR

SEQ ID NO: 2392090 - protein, 17 aa, Entamoeba dispar
VVYIFPSLFVYKTHQGV

SEQ ID NO: 2392091 - protein, 19 aa, Entamoeba dispar
VVYKGEFKGNSVAIKRMKP

SEQ ID NO: 2392092 - protein, 31 aa, Entamoeba dispar
VVYVCPLSIIMLWPRVEKFGDPNFRKLSVID

SEQ ID NO: 2392093 - protein, 18 aa, Entamoeba dispar
VWIAARLFVQISQTINHL

SEQ ID NO: 2392094 - protein, 21 aa, Entamoeba dispar
VWLFCVVQWSAFAGLVIMFLA

SEQ ID NO: 2392095 - protein, 20 aa, Entamoeba dispar
VWMLFCFFWAVWNGANFYFE

SEQ ID NO: 2392096 - protein, 23 aa, Entamoeba dispar
VWTIVVSFINWLSYWKSDWNDEA

SEQ ID NO: 2392097 - protein, 24 aa, Entamoeba dispar
VWVGKKIYCMIKLNRWYIKPKTIK

SEQ ID NO: 2392098 - protein, 34 aa, Entamoeba dispar
VWVVMSCIIVSFFVILLFNIVFFVIKNCFLNEPS

SEQ ID NO: 2392099 - protein, 24 aa, Entamoeba dispar
VYAGLGGAIGIFIGMIVDTLLVII

SEQ ID NO: 2392100 - protein, 26 aa, Entamoeba dispar
VYALPGKIQFTFVILLQFINNTIESV

SEQ ID NO: 2392101 - protein, 25 aa, Entamoeba dispar
VYCIDSRLFFFVGFGSLFTLSCFFV

SEQ ID NO: 2392102 - protein, 22 aa, Entamoeba dispar
VYDICYELGVNFISKLSKQSNK

SEQ ID NO: 2392103 - protein, 20 aa, Entamoeba dispar
VYEGLYLVKFNRDYAKASEL

SEQ ID NO: 2392104 - protein, 18 aa, Entamoeba dispar
VYELGRCYNVLQGISTVY

SEQ ID NO: 2392105 - protein, 17 aa, Entamoeba dispar
VYETVDFSFVYKTIDNL

SEQ ID NO: 2392106 - protein, 31 aa, Entamoeba dispar
VYFFSKCESKKKFLIVGGFFQQFEYSDDECK

SEQ ID NO: 2392107 - protein, 17 aa, Entamoeba dispar
VYFKRAVFTSLIGLLVI

SEQ ID NO: 2392108 - protein, 19 aa, Entamoeba dispar
VYFSDWRYEQIEGVSYKTV

SEQ ID NO: 2392109 - protein, 22 aa, Entamoeba dispar
VYFSLLSGFLFDNFGPRGTLIF

SEQ ID NO: 2392110 - protein, 17 aa, Entamoeba dispar
VYFVWCGSFITQQIDVI

SEQ ID NO: 2392111 - protein, 18 aa, Entamoeba dispar
VYIGFVFSLFLFKLYHNY

SEQ ID NO: 2392112 - protein, 20 aa, Entamoeba dispar
VYIGNILFGLLIYLLDEFDK

SEQ ID NO: 2392113 - protein, 29 aa, Entamoeba dispar
VYIKGNIRDTVKWCFYHNTNIKSNTSEYC

SEQ ID NO: 2392114 - protein, 24 aa, Entamoeba dispar
VYLFFKKAHGLYSIKSKDNKYQMY

SEQ ID NO: 2392115 - protein, 17 aa, Entamoeba dispar
VYLSFFIFLMITILFIR

SEQ ID NO: 2392116 - protein, 17 aa, Entamoeba dispar
VYLSLIPIYAFEMPLEL

SEQ ID NO: 2392117 - protein, 25 aa, Entamoeba dispar
VYMYICTLLLCLSYYTLLITPYNFI

SEQ ID NO: 2392118 - protein, 23 aa, Entamoeba dispar
VYNLSMVVGWTFILITYFLKALE

SEQ ID NO: 2392119 - protein, 17 aa, Entamoeba dispar
VYNNPFVMFAIMLLFSF

SEQ ID NO: 2392120 - protein, 27 aa, Entamoeba dispar
VYPFEQIDILTILKCYSKIKYPRIFNL

SEQ ID NO: 2392121 - protein, 24 aa, Entamoeba dispar
VYQIKTELLFPMTSYYSTLLSQGR

SEQ ID NO: 2392122 - protein, 20 aa, Entamoeba dispar
VYQKNEFNDLLAYKMLNDVA

SEQ ID NO: 2392123 - protein, 17 aa, Entamoeba dispar
VYSCGLTGGSFCAFATL

SEQ ID NO: 2392124 - protein, 24 aa, Entamoeba dispar
VYSFAICMLEVWISKDPYNSIKFP

SEQ ID NO: 2392125 - protein, 18 aa, Entamoeba dispar
VYSFAITAWEIFYQDEPY

SEQ ID NO: 2392126 - protein, 21 aa, Entamoeba dispar
VYSGLKYIMWMIGIGGGIVSV

SEQ ID NO: 2392127 - protein, 18 aa, Entamoeba dispar
VYTSGKFNGFDKLTIDTT

SEQ ID NO: 2392128 - protein, 19 aa, Entamoeba dispar
VYVGVSFIILISMLIVSIL

SEQ ID NO: 2392129 - protein, 17 aa, Entamoeba dispar
VYYKTVLLFNKKNIAII

SEQ ID NO: 2392130 - protein, 17 aa, Entamoeba dispar
VYYRSTLIANEKEISIQ

SEQ ID NO: 2392131 - protein, 17 aa, Entamoeba dispar
WAEDHAFLKSPHGRFTY

SEQ ID NO: 2392132 - protein, 24 aa, Entamoeba dispar
WAIANLILGIGFVFIAVVVVVLYL

SEQ ID NO: 2392133 - protein, 19 aa, Entamoeba dispar
WASKGYRTLSLSYKDMAPA

SEQ ID NO: 2392134 - protein, 33 aa, Entamoeba dispar
WCNCTINCPFSFIYSKFWLESGAYEMTSIENDN

SEQ ID NO: 2392135 - protein, 26 aa, Entamoeba dispar
WCNVFAGLILRIFNMLFLYKIPIKIR

SEQ ID NO: 2392136 - protein, 18 aa, Entamoeba dispar
WCSEMQRQLNIKLLEFCK

SEQ ID NO: 2392137 - protein, 17 aa, Entamoeba dispar
WCTGTFGLFGIDAQPVD

SEQ ID NO: 2392138 - protein, 18 aa, Entamoeba dispar
WDAHLRHIISFQTIGFKK

SEQ ID NO: 2392139 - protein, 24 aa, Entamoeba dispar
WDDLKLLRPEMNEIENERILLDKE

SEQ ID NO: 2392140 - protein, 24 aa, Entamoeba dispar
WDDRTSSIIFKKKFESDICGISLK

SEQ ID NO: 2392141 - protein, 19 aa, Entamoeba dispar
WDEKRKCVVRKSGDNVTRI

SEQ ID NO: 2392142 - protein, 20 aa, Entamoeba dispar
WDEKRKCVVRKSGDNVTRIS

SEQ ID NO: 2392143 - protein, 17 aa, Entamoeba dispar
WDIADAITTGKRPKIIQ

SEQ ID NO: 2392144 - protein, 17 aa, Entamoeba dispar
WDIANTITTGKRPTIIQ

SEQ ID NO: 2392145 - protein, 20 aa, Entamoeba dispar
WDILNGISISSDFECIYRKK

SEQ ID NO: 2392146 - protein, 18 aa, Entamoeba dispar
WDKDVLVLLDCVRDINLI

SEQ ID NO: 2392147 - protein, 18 aa, Entamoeba dispar
WDLLHFLLFASILIALLM

SEQ ID NO: 2392148 - protein, 22 aa, Entamoeba dispar
WDNLFCTMCKPGYYLQKQDCKP

SEQ ID NO: 2392149 - protein, 19 aa, Entamoeba dispar
WDNNSFCRGYYCNGGESVV

SEQ ID NO: 2392150 - protein, 17 aa, Entamoeba dispar
WDRAGCSCDGDSCQVNM

SEQ ID NO: 2392151 - protein, 19 aa, Entamoeba dispar
WDYSFIVWIFLCFLSYIHP

SEQ ID NO: 2392152 - protein, 17 aa, Entamoeba dispar
WDYTGKHIFIFGGSAGV

SEQ ID NO: 2392153 - protein, 24 aa, Entamoeba dispar
WEEKELKYYFSLFTHTFSTYGVKD

SEQ ID NO: 2392154 - protein, 22 aa, Entamoeba dispar
WEESISYAISVVEWLAQLIENV

SEQ ID NO: 2392155 - protein, 26 aa, Entamoeba dispar
WEGAIKVRDGFCISAIDAHCRGNGNY

SEQ ID NO: 2392156 - protein, 19 aa, Entamoeba dispar
WENELIKCMCKVTEGYHDK

SEQ ID NO: 2392157 - protein, 20 aa, Entamoeba dispar
WENTFYLLLDFLHKKKDKEN

SEQ ID NO: 2392158 - protein, 20 aa, Entamoeba dispar
WEVKHGALLVLKYTVAIVDK

SEQ ID NO: 2392159 - protein, 29 aa, Entamoeba dispar
WFACGLVSFLTCHICNIIGYSLTLHPGIT

SEQ ID NO: 2392160 - protein, 24 aa, Entamoeba dispar
WFDPDSWYPLGRNIGTTVFPGLMF

SEQ ID NO: 2392161 - protein, 24 aa, Entamoeba dispar
WFFVLRLAKQITVSRDFKYNYAPE

SEQ ID NO: 2392162 - protein, 18 aa, Entamoeba dispar
WFRPGSGIPSSFMYDCLE

SEQ ID NO: 2392163 - protein, 19 aa, Entamoeba dispar
WFYFCPISLLLWLLTGGVT

SEQ ID NO: 2392164 - protein, 24 aa, Entamoeba dispar
WFYKDGKEVIGYVFMRKLVSALSV

SEQ ID NO: 2392165 - protein, 20 aa, Entamoeba dispar
WFYPHEFKLHENLIVHIKGT

SEQ ID NO: 2392166 - protein, 17 aa, Entamoeba dispar
WGAALLARPFTSVSDPM

SEQ ID NO: 2392167 - protein, 25 aa, Entamoeba dispar
WGECSKITYAVGFCFGIGSTVTTLI

SEQ ID NO: 2392168 - protein, 22 aa, Entamoeba dispar
WGEDIRYAFNIEGDKKIQGSDA

SEQ ID NO: 2392169 - protein, 26 aa, Entamoeba dispar
WGEGKELWFAYIIKYLILFFPVFNLT

SEQ ID NO: 2392170 - protein, 20 aa, Entamoeba dispar
WGFTSLYLLLSLGLVISVIC

SEQ ID NO: 2392171 - protein, 19 aa, Entamoeba dispar
WGGIEFLVSLFIIESQNNK

SEQ ID NO: 2392172 - protein, 17 aa, Entamoeba dispar
WGLLINGIGLCFFSDII

SEQ ID NO: 2392173 - protein, 17 aa, Entamoeba dispar
WGNAGHSMAYWMQNISE

SEQ ID NO: 2392174 - protein, 23 aa, Entamoeba dispar
WGNWKELFKKIGIIETTKEESEQ

SEQ ID NO: 2392175 - protein, 18 aa, Entamoeba dispar
WGPAYPKEQFKYPWQIAQ

SEQ ID NO: 2392176 - protein, 18 aa, Entamoeba dispar
WGTGRAVARIPRISGSGS

SEQ ID NO: 2392177 - protein, 19 aa, Entamoeba dispar
WGTSIVFFAKQWRMRIDLI

SEQ ID NO: 2392178 - protein, 20 aa, Entamoeba dispar
WGVAQVCWFIANSNLPYVVS

SEQ ID NO: 2392179 - protein, 18 aa, Entamoeba dispar
WGYNKIGDCYLVKERPEE

SEQ ID NO: 2392180 - protein, 17 aa, Entamoeba dispar
WHISSEMFKCPSCGCDC

SEQ ID NO: 2392181 - protein, 23 aa, Entamoeba dispar
WHQKIPILWTYKPFYEARSIHLP

SEQ ID NO: 2392182 - protein, 17 aa, Entamoeba dispar
WIADRGFNNAKYTRVNV

SEQ ID NO: 2392183 - protein, 20 aa, Entamoeba dispar
WIAEEICIICTGETYKNIAN

SEQ ID NO: 2392184 - protein, 17 aa, Entamoeba dispar
WIAFILMIGIFLIINTF

SEQ ID NO: 2392185 - protein, 26 aa, Entamoeba dispar
WIEFQNKFYIGDGIPFIPLHLPKQSL

SEQ ID NO: 2392186 - protein, 18 aa, Entamoeba dispar
WIFLCFLSYIHPIHSPLC

SEQ ID NO: 2392187 - protein, 21 aa, Entamoeba dispar
WIGHVSFKHSITFETTPSLNQ

SEQ ID NO: 2392188 - protein, 17 aa, Entamoeba dispar
WIGVFALSKASYSVFNI

SEQ ID NO: 2392189 - protein, 23 aa, Entamoeba dispar
WIICLRVGAIVLIRLHLFLDFYS

SEQ ID NO: 2392190 - protein, 21 aa, Entamoeba dispar
WIRCHSFCPLCKVPFHLNTFG

SEQ ID NO: 2392191 - protein, 24 aa, Entamoeba dispar
WIRCHSFCPLCKVPFHLNTFGKNK

SEQ ID NO: 2392192 - protein, 24 aa, Entamoeba dispar
WIRDFKSSIIMKLFIIAMAVLLFL

SEQ ID NO: 2392193 - protein, 23 aa, Entamoeba dispar
WITKRLWVKISVWIICPIICLAV

SEQ ID NO: 2392194 - protein, 18 aa, Entamoeba dispar
WIVLLEIIIALFILIIII

SEQ ID NO: 2392195 - protein, 19 aa, Entamoeba dispar
WKALMRRGTAYLNMDKLDK

SEQ ID NO: 2392196 - protein, 19 aa, Entamoeba dispar
WKCDVCDDGIMFQCGVTST

SEQ ID NO: 2392197 - protein, 21 aa, Entamoeba dispar
WKCDVCNDGFIFQCGEMSTFV

SEQ ID NO: 2392198 - protein, 25 aa, Entamoeba dispar
WKDAFIKISSYILGEYGSLVVKDNM

SEQ ID NO: 2392199 - protein, 17 aa, Entamoeba dispar
WKDIFLYLIDMIQHKLN

SEQ ID NO: 2392200 - protein, 17 aa, Entamoeba dispar
WKDIKIFLKEGKSFIPS

SEQ ID NO: 2392201 - protein, 25 aa, Entamoeba dispar
WKDIKVGDILFIKRKEAIPADLILL

SEQ ID NO: 2392202 - protein, 25 aa, Entamoeba dispar
WKDLYEILFEFFKIFLTTKPFICEY

SEQ ID NO: 2392203 - protein, 24 aa, Entamoeba dispar
WKDRRKVDLTKEVKFIPNIFDGNS

SEQ ID NO: 2392204 - protein, 20 aa, Entamoeba dispar
WKDVICKSINRNGGNEYDES

SEQ ID NO: 2392205 - protein, 18 aa, Entamoeba dispar
WKEGVVYQIYCKSFKDTT

SEQ ID NO: 2392206 - protein, 24 aa, Entamoeba dispar
WKIIGELSAILSYELEYFECTCEG

SEQ ID NO: 2392207 - protein, 19 aa, Entamoeba dispar
WKINIIVIILLLNFFHILS

SEQ ID NO: 2392208 - protein, 23 aa, Entamoeba dispar
WKKCIPTKLTLLSLFLIFIINIY

SEQ ID NO: 2392209 - protein, 22 aa, Entamoeba dispar
WKKEQGPIILLSFLVKYSKQRQ

SEQ ID NO: 2392210 - protein, 19 aa, Entamoeba dispar
WKKIMALIVMILGILIGIV

SEQ ID NO: 2392211 - protein, 22 aa, Entamoeba dispar
WKKNMIKGIIVIMIIISVQGIC

SEQ ID NO: 2392212 - protein, 18 aa, Entamoeba dispar
WKKYSYPIMFTQTSVVYF

SEQ ID NO: 2392213 - protein, 23 aa, Entamoeba dispar
WKLIKRICLFQVFGYKGTLIHVV

SEQ ID NO: 2392214 - protein, 22 aa, Entamoeba dispar
WKLILERRLKETKKEIYQEPNQ

SEQ ID NO: 2392215 - protein, 17 aa, Entamoeba dispar
WKLIQQKGIYETIIYEV

SEQ ID NO: 2392216 - protein, 19 aa, Entamoeba dispar
WKLTFGHAGSKVSVDNLYE

SEQ ID NO: 2392217 - protein, 18 aa, Entamoeba dispar
WKMTEEIHKITAYPNHVH

SEQ ID NO: 2392218 - protein, 22 aa, Entamoeba dispar
WKNNKLLLAQGLRDLYIENPSS

SEQ ID NO: 2392219 - protein, 18 aa, Entamoeba dispar
WKNPAFGEWCIQKIIGTE

SEQ ID NO: 2392220 - protein, 26 aa, Entamoeba dispar
WKNQKKSMKWIYSIIIIPVIIAIGYI

SEQ ID NO: 2392221 - protein, 18 aa, Entamoeba dispar
WKQEPKERIRIEEVIRML

SEQ ID NO: 2392222 - protein, 24 aa, Entamoeba dispar
WKQEPKERITIEEVVRMLERIQSN

SEQ ID NO: 2392223 - protein, 23 aa, Entamoeba dispar
WKQLILICRPVRFSTLAFCIIGI

SEQ ID NO: 2392224 - protein, 19 aa, Entamoeba dispar
WKRIKEIIMINEINEELKN

SEQ ID NO: 2392225 - protein, 20 aa, Entamoeba dispar
WKRLRCFHFSLKEMRINDFN

SEQ ID NO: 2392226 - protein, 18 aa, Entamoeba dispar
WKSKNCPCKGTYCDIVIY

SEQ ID NO: 2392227 - protein, 17 aa, Entamoeba dispar
WKTLKLYGCGSPIDSQE

SEQ ID NO: 2392228 - protein, 17 aa, Entamoeba dispar
WKVISVIGPYHSGKSFL

SEQ ID NO: 2392229 - protein, 20 aa, Entamoeba dispar
WKWDKAYPTEEFKFPWKIAD

SEQ ID NO: 2392230 - protein, 20 aa, Entamoeba dispar
WKYYERFGYQNSEENFLHKM

SEQ ID NO: 2392231 - protein, 17 aa, Entamoeba dispar
WLAVCMIPTIAFYLIDT

SEQ ID NO: 2392232 - protein, 38 aa, Entamoeba dispar
WLEKEIPTRIEIFLIHLRRALLFFIHFPCSINNPIEEI

SEQ ID NO: 2392233 - protein, 25 aa, Entamoeba dispar
WLFMSLVVVCWCTFFLPDSYFVHPH

SEQ ID NO: 2392234 - protein, 18 aa, Entamoeba dispar
WLGIAVFFLYLTSLILYV

SEQ ID NO: 2392235 - protein, 17 aa, Entamoeba dispar
WLGNCIGRRNYKSYIGI

SEQ ID NO: 2392236 - protein, 19 aa, Entamoeba dispar
WLIVIACFVGAHAICCFVL

SEQ ID NO: 2392237 - protein, 17 aa, Entamoeba dispar
WLLFVAVIIYTICSIAI

SEQ ID NO: 2392238 - protein, 18 aa, Entamoeba dispar
WLLLGMGLMAIYCGIVFN

SEQ ID NO: 2392239 - protein, 19 aa, Entamoeba dispar
WLLPIKFGLSDIFDQNLYE

SEQ ID NO: 2392240 - protein, 18 aa, Entamoeba dispar
WLLSGFYLMPTGIKKPYN

SEQ ID NO: 2392241 - protein, 26 aa, Entamoeba dispar
WLLSLPEDWFEFGLTLSKTPMFCQYL

SEQ ID NO: 2392242 - protein, 19 aa, Entamoeba dispar
WLMFIGGLISSLGYLLTLL

SEQ ID NO: 2392243 - protein, 19 aa, Entamoeba dispar
WLNIFFNWIPEMMFMICSF

SEQ ID NO: 2392244 - protein, 17 aa, Entamoeba dispar
WLQSSIIMFIVYLFILI

SEQ ID NO: 2392245 - protein, 20 aa, Entamoeba dispar
WMCELSHKLKIAELNIEEGL

SEQ ID NO: 2392246 - protein, 23 aa, Entamoeba dispar
WMFEDINELFLRKIKLLMTVQPY

SEQ ID NO: 2392247 - protein, 17 aa, Entamoeba dispar
WMIPQFVIEGHRLERPD

SEQ ID NO: 2392248 - protein, 21 aa, Entamoeba dispar
WMKRKDKLDFLFVISYDDLDI

SEQ ID NO: 2392249 - protein, 18 aa, Entamoeba dispar
WMTICKYTKYLKETELIE

SEQ ID NO: 2392250 - protein, 17 aa, Entamoeba dispar
WMVIPWSGATTVEHGNS

SEQ ID NO: 2392251 - protein, 27 aa, Entamoeba dispar
WNADRLEVRYGVFGRVFGQRAVAWAFP

SEQ ID NO: 2392252 - protein, 19 aa, Entamoeba dispar
WNCYLKEYVPIIPVLQEEI

SEQ ID NO: 2392253 - protein, 26 aa, Entamoeba dispar
WNDVRFELVSDIPWNCFNPHLEVKGK

SEQ ID NO: 2392254 - protein, 17 aa, Entamoeba dispar
WNFIPLAYLRQFKYTYN

SEQ ID NO: 2392255 - protein, 19 aa, Entamoeba dispar
WNGHVSFQNSIRFETTPSL

SEQ ID NO: 2392256 - protein, 21 aa, Entamoeba dispar
WNKLKLLLISIQLFDYMSPSI

SEQ ID NO: 2392257 - protein, 18 aa, Entamoeba dispar
WNKNAIKVSKKFSKLFQE

SEQ ID NO: 2392258 - protein, 17 aa, Entamoeba dispar
WNKSLRSYQIYKIINGM

SEQ ID NO: 2392259 - protein, 26 aa, Entamoeba dispar
WNLSKEYRMKHCHDILNRWYTKPKTI

SEQ ID NO: 2392260 - protein, 19 aa, Entamoeba dispar
WNMCFLFNDIFVISKAIVI

SEQ ID NO: 2392261 - protein, 17 aa, Entamoeba dispar
WNPLILWCNVFAGLILR

SEQ ID NO: 2392262 - protein, 18 aa, Entamoeba dispar
WNQFTVIEVHCSKEEETK

SEQ ID NO: 2392263 - protein, 19 aa, Entamoeba dispar
WNTKMIFVWVKASFIDEKI

SEQ ID NO: 2392264 - protein, 19 aa, Entamoeba dispar
WNTLCGINGVDVFRNGNSL

SEQ ID NO: 2392265 - protein, 19 aa, Entamoeba dispar
WPFELFCEKMMQNIFDPKW

SEQ ID NO: 2392266 - protein, 23 aa, Entamoeba dispar
WPKQVAPLSAWRVVYYSVMCIAL

SEQ ID NO: 2392267 - protein, 22 aa, Entamoeba dispar
WQKFSAHFLVFGRVFRLNLKEV

SEQ ID NO: 2392268 - protein, 20 aa, Entamoeba dispar
WQKYFPMKTLLFLSKPLSDL

SEQ ID NO: 2392269 - protein, 24 aa, Entamoeba dispar
WQPSLIRRAVICLIFTSFAGMLSA

SEQ ID NO: 2392270 - protein, 18 aa, Entamoeba dispar
WQRKTPKQMRRFAVVSCI

SEQ ID NO: 2392271 - protein, 24 aa, Entamoeba dispar
WQSIMGVSFLSWICPWYNENKEQN

SEQ ID NO: 2392272 - protein, 18 aa, Entamoeba dispar
WQYPIKLFVHLINIQTDR

SEQ ID NO: 2392273 - protein, 17 aa, Entamoeba dispar
WRCNGYDYILIVNVRAV

SEQ ID NO: 2392274 - protein, 18 aa, Entamoeba dispar
WRHLKRKFIPSSNHIAEE

SEQ ID NO: 2392275 - protein, 20 aa, Entamoeba dispar
WRIKEIPNFLLCAPAAVISL

SEQ ID NO: 2392276 - protein, 19 aa, Entamoeba dispar
WRKKAKFELLTTVRIHHGK

SEQ ID NO: 2392277 - protein, 29 aa, Entamoeba dispar
WRNITVQSKPEWLTLCKKSEPSLTKQKEV

SEQ ID NO: 2392278 - protein, 20 aa, Entamoeba dispar
WRQGGALLIPGSVIVKNLKQ

SEQ ID NO: 2392279 - protein, 17 aa, Entamoeba dispar
WRRSYTYDAQKLFCYPP

SEQ ID NO: 2392280 - protein, 18 aa, Entamoeba dispar
WRYCACSLLYNYAAFLFW

SEQ ID NO: 2392281 - protein, 17 aa, Entamoeba dispar
WRYDKKSGKEEIKDIDE

SEQ ID NO: 2392282 - protein, 21 aa, Entamoeba dispar
WRYYFNVNTSFVLKKILMIIM

SEQ ID NO: 2392283 - protein, 23 aa, Entamoeba dispar
WSDLRDVFYFTDIFKTFSTNDLY

SEQ ID NO: 2392284 - protein, 25 aa, Entamoeba dispar
WSKGADLSSAIGRCVGSNPTGCILF

SEQ ID NO: 2392285 - protein, 26 aa, Entamoeba dispar
WSKGADLSSAIGRCVGSNPTGCILFI

SEQ ID NO: 2392286 - protein, 18 aa, Entamoeba dispar
WSNWDWDIDQTLRRYILL

SEQ ID NO: 2392287 - protein, 23 aa, Entamoeba dispar
WSSDLIFRFIGFIDVKWSNWTLY

SEQ ID NO: 2392288 - protein, 24 aa, Entamoeba dispar
WSSPTCPCTGNGCIIDTTKPTVAV

SEQ ID NO: 2392289 - protein, 19 aa, Entamoeba dispar
WSTECVASYCDPGYKFDRF

SEQ ID NO: 2392290 - protein, 29 aa, Entamoeba dispar
WSTYWHYFRAGGFIGLILCLMPFVVRCAS

SEQ ID NO: 2392291 - protein, 20 aa, Entamoeba dispar
WTCFSPDTESTCGFGSTIQL

SEQ ID NO: 2392292 - protein, 26 aa, Entamoeba dispar
WTFTFSLTCFAYFLATLINKTRIAIT

SEQ ID NO: 2392293 - protein, 19 aa, Entamoeba dispar
WTILLWIVVGCIICAGLVM

SEQ ID NO: 2392294 - protein, 21 aa, Entamoeba dispar
WTISCGLCNDGYYLVDGKCIK

SEQ ID NO: 2392295 - protein, 19 aa, Entamoeba dispar
WTKCYCYFPTEVIEEKKRN

SEQ ID NO: 2392296 - protein, 25 aa, Entamoeba dispar
WTLHFAARLPFSYYYFVSFLEDLLL

SEQ ID NO: 2392297 - protein, 21 aa, Entamoeba dispar
WTLQSGHSMGYFMGNHSLFNE

SEQ ID NO: 2392298 - protein, 17 aa, Entamoeba dispar
WTTEARNIISIDSNGRA

SEQ ID NO: 2392299 - protein, 23 aa, Entamoeba dispar
WTVSTLRLKYYGTWKLTESLGEI

SEQ ID NO: 2392300 - protein, 17 aa, Entamoeba dispar
WVATYLLYKYEILPSNK

SEQ ID NO: 2392301 - protein, 19 aa, Entamoeba dispar
WVEDPSLRPKFTEIEERVE

SEQ ID NO: 2392302 - protein, 23 aa, Entamoeba dispar
WVEIADLFESYFCEEMKEIYKEY

SEQ ID NO: 2392303 - protein, 17 aa, Entamoeba dispar
WVFILNFFISIIYAFVY

SEQ ID NO: 2392304 - protein, 17 aa, Entamoeba dispar
WVFPRYVISAAYNAKNF

SEQ ID NO: 2392305 - protein, 17 aa, Entamoeba dispar
WVLGQFSYWQYKQILNI

SEQ ID NO: 2392306 - protein, 18 aa, Entamoeba dispar
WVLLEKWYCILFVLCFIA

SEQ ID NO: 2392307 - protein, 23 aa, Entamoeba dispar
WVLQSPKFAKFMFFLLAYILSCE

SEQ ID NO: 2392308 - protein, 17 aa, Entamoeba dispar
WVSYFKKIDSLRVITKP

SEQ ID NO: 2392309 - protein, 18 aa, Entamoeba dispar
WVVLRRYFFLQGIIYFIR

SEQ ID NO: 2392310 - protein, 17 aa, Entamoeba dispar
WWAKNGYLVSLHDFGYL

SEQ ID NO: 2392311 - protein, 18 aa, Entamoeba dispar
WWLLMPGIIIFVILISVL

SEQ ID NO: 2392312 - protein, 29 aa, Entamoeba dispar
WWNIITQCWDHIPSKRPTFKDITIILQNE

SEQ ID NO: 2392313 - protein, 17 aa, Entamoeba dispar
WWVWLLIALGIVFIFIC

SEQ ID NO: 2392314 - protein, 17 aa, Entamoeba dispar
WYDIELRKKESLLNNIN

SEQ ID NO: 2392315 - protein, 18 aa, Entamoeba dispar
WYEFMFLERCELLQKNDR

SEQ ID NO: 2392316 - protein, 17 aa, Entamoeba dispar
WYFIPFFFFIQVILLSL

SEQ ID NO: 2392317 - protein, 18 aa, Entamoeba dispar
WYGSIVIRGKGGSKGVIA

SEQ ID NO: 2392318 - protein, 23 aa, Entamoeba dispar
WYICKRDEVWTSLVLKTTGRVTY

SEQ ID NO: 2392319 - protein, 19 aa, Entamoeba dispar
WYLARPCLGGVRGTQGCLC

SEQ ID NO: 2392320 - protein, 19 aa, Entamoeba dispar
WYLLICRKKYNKGDYQILS

SEQ ID NO: 2392321 - protein, 17 aa, Entamoeba dispar
WYNTIYMKQKELENYME

SEQ ID NO: 2392322 - protein, 27 aa, Entamoeba dispar
WYPEMKSLCPHTPFFLIATQSEKRNKC

SEQ ID NO: 2392323 - protein, 23 aa, Entamoeba dispar
WYQLCGIVLFVFVHKHIKSQIKM

SEQ ID NO: 2392324 - protein, 24 aa, Entamoeba dispar
  misc_feature (1)..(1): Xaa can be any naturally occurring amino acid
XLLSDCKLFFGVEFLYNCLVSFLL

SEQ ID NO: 2392325 - protein, 20 aa, Entamoeba dispar
YADVIVKGFAVSVAIVCTTT

SEQ ID NO: 2392326 - protein, 23 aa, Entamoeba dispar
YAEEGLRILVIAGRELKKEEIQN

SEQ ID NO: 2392327 - protein, 18 aa, Entamoeba dispar
YAFGYIPFQYVKQSKALQ

SEQ ID NO: 2392328 - protein, 22 aa, Entamoeba dispar
YAFNVICWLLPIKFGLSDIFDQ

SEQ ID NO: 2392329 - protein, 17 aa, Entamoeba dispar
YAFVKLMLMTKYTQKEV

SEQ ID NO: 2392330 - protein, 17 aa, Entamoeba dispar
YAGRPRPNMYALVAQGK

SEQ ID NO: 2392331 - protein, 19 aa, Entamoeba dispar
YAIFIFKMFRRYAQKHNLN

SEQ ID NO: 2392332 - protein, 20 aa, Entamoeba dispar
YALESMSFVSLRSNLLSQEF

SEQ ID NO: 2392333 - protein, 20 aa, Entamoeba dispar
YALGNWYGSIVIRGKGGSKG

SEQ ID NO: 2392334 - protein, 23 aa, Entamoeba dispar
YALGSWYGSIVIRGKGGSKGVIA

SEQ ID NO: 2392335 - protein, 18 aa, Entamoeba dispar
YALTYSGIRSFDIDYQLL

SEQ ID NO: 2392336 - protein, 25 aa, Entamoeba dispar
YAPECPTACRLFHYIAELVIKFSEY

SEQ ID NO: 2392337 - protein, 19 aa, Entamoeba dispar
YAREFFKTTLFPPPFNKQN

SEQ ID NO: 2392338 - protein, 18 aa, Entamoeba dispar
YASWKLIQQKGIYETIIY

SEQ ID NO: 2392339 - protein, 22 aa, Entamoeba dispar
YATTYYGCFLIFIALLISFLTV

SEQ ID NO: 2392340 - protein, 25 aa, Entamoeba dispar
YAVYPFMRFELIPSLIVLYRTYFLG

SEQ ID NO: 2392341 - protein, 17 aa, Entamoeba dispar
YAYLIDSVISFILSISW

SEQ ID NO: 2392342 - protein, 20 aa, Entamoeba dispar
YCCKEYKGITKYKLVGIVIH

SEQ ID NO: 2392343 - protein, 18 aa, Entamoeba dispar
YCDPVEGPIIFNFNNEKS

SEQ ID NO: 2392344 - protein, 19 aa, Entamoeba dispar
YCFLVFYFFLYVPSIVLTI

SEQ ID NO: 2392345 - protein, 30 aa, Entamoeba dispar
YCFSKIVDFWGIFICCFVIAFAAFFESINI

SEQ ID NO: 2392346 - protein, 19 aa, Entamoeba dispar
YCGYNDVFDSFKIKIIDNE

SEQ ID NO: 2392347 - protein, 26 aa, Entamoeba dispar
YCIISHLDCLYNFVINSYIDKEQKIS

SEQ ID NO: 2392348 - protein, 22 aa, Entamoeba dispar
YCIPSVLLFIIKVWQIGIIDMI

SEQ ID NO: 2392349 - protein, 24 aa, Entamoeba dispar
YCKICSSASILTCNSCFPNYYLKD

SEQ ID NO: 2392350 - protein, 21 aa, Entamoeba dispar
YCMSCKGNAILSNHTCLNDYK

SEQ ID NO: 2392351 - protein, 23 aa, Entamoeba dispar
YCNSNECILCYNGYQLQNKKCIL

SEQ ID NO: 2392352 - protein, 23 aa, Entamoeba dispar
YCPHKDFTDCKVYVLRELCDELL

SEQ ID NO: 2392353 - protein, 25 aa, Entamoeba dispar
YCPNTRLERWWFIITDVRNQVVLNA

SEQ ID NO: 2392354 - protein, 18 aa, Entamoeba dispar
YCRMSLYDKNYIKLTSDF

SEQ ID NO: 2392355 - protein, 17 aa, Entamoeba dispar
YCRPWFNTCMMVNVLYF

SEQ ID NO: 2392356 - protein, 17 aa, Entamoeba dispar
YCSCLPAVALIFPDTKK

SEQ ID NO: 2392357 - protein, 22 aa, Entamoeba dispar
YCSELHSGCGVCSTNNGECSVC

SEQ ID NO: 2392358 - protein, 23 aa, Entamoeba dispar
YCSESPSILKGVLQYHNLLSNNE

SEQ ID NO: 2392359 - protein, 18 aa, Entamoeba dispar
YCSNKSYVNGKCVECLNT

SEQ ID NO: 2392360 - protein, 20 aa, Entamoeba dispar
YCSNKSYVNGKCVECLNTYS

SEQ ID NO: 2392361 - protein, 22 aa, Entamoeba dispar
YCSSADEGIVCYWKENRTFVHY

SEQ ID NO: 2392362 - protein, 18 aa, Entamoeba dispar
YCSWEESISYAISVVEWL

SEQ ID NO: 2392363 - protein, 20 aa, Entamoeba dispar
YCSYTKDWIEGKITTYEYLC

SEQ ID NO: 2392364 - protein, 24 aa, Entamoeba dispar
YCTLKSGVDSIIFEEKDCNEEYTG

SEQ ID NO: 2392365 - protein, 29 aa, Entamoeba dispar
YCVHHKKHICIECIFKGHINCTVCKYREY

SEQ ID NO: 2392366 - protein, 28 aa, Entamoeba dispar
YCVHHKKHICIECIFKGHVNCTVCKYRE

SEQ ID NO: 2392367 - protein, 17 aa, Entamoeba dispar
YCYKCKRGCEACDEEYH

SEQ ID NO: 2392368 - protein, 26 aa, Entamoeba dispar
YDCEKYHRLYHCLAYDLSCDYFNETI

SEQ ID NO: 2392369 - protein, 23 aa, Entamoeba dispar
YDDELNNFVGFFIQAVVLYTDIF

SEQ ID NO: 2392370 - protein, 21 aa, Entamoeba dispar
YDDFNSFDWKMIVETYKENSA

SEQ ID NO: 2392371 - protein, 28 aa, Entamoeba dispar
YDGCDSYGYCPNGWSYFNHKCYENQGKL

SEQ ID NO: 2392372 - protein, 25 aa, Entamoeba dispar
YDGITRCKYCLLGTYQNLKGQKNCK

SEQ ID NO: 2392373 - protein, 18 aa, Entamoeba dispar
YDGNSFIRYWNNIKFTGN

SEQ ID NO: 2392374 - protein, 23 aa, Entamoeba dispar
YDGSCLSCSSRGCSECNVDTGDC

SEQ ID NO: 2392375 - protein, 22 aa, Entamoeba dispar
YDHLIKIKVPYHYIFLNFGDWV

SEQ ID NO: 2392376 - protein, 19 aa, Entamoeba dispar
YDIFIGVFFCTIYFMYTIG

SEQ ID NO: 2392377 - protein, 17 aa, Entamoeba dispar
YDIITIIGLDKPIIYII

SEQ ID NO: 2392378 - protein, 22 aa, Entamoeba dispar
YDILDLLKMVTAFMLEHKILII

SEQ ID NO: 2392379 - protein, 23 aa, Entamoeba dispar
YDILVDYCFPEGVLHKRKEAKSV

SEQ ID NO: 2392380 - protein, 23 aa, Entamoeba dispar
YDIPCLIKSYGIVHSVIQYQDYY

SEQ ID NO: 2392381 - protein, 26 aa, Entamoeba dispar
YDKELEACWKKLALLILTRKGEKSEE

SEQ ID NO: 2392382 - protein, 19 aa, Entamoeba dispar
YDKNDCALRSSSLDLDVKI

SEQ ID NO: 2392383 - protein, 28 aa, Entamoeba dispar
YDLCEWRTSVCMKCIDGYQFDESSGNCK

SEQ ID NO: 2392384 - protein, 18 aa, Entamoeba dispar
YDLFYSFSELKENRCPPF

SEQ ID NO: 2392385 - protein, 21 aa, Entamoeba dispar
YDLKATCLNEKYIKENVLNTR

SEQ ID NO: 2392386 - protein, 24 aa, Entamoeba dispar
YDLLYRFVQTLGMLPFSLLSTGNK

SEQ ID NO: 2392387 - protein, 21 aa, Entamoeba dispar
YDLTFAIYVNDVFKTNNVILK

SEQ ID NO: 2392388 - protein, 19 aa, Entamoeba dispar
YDNFLCFINVLYGAVPRIN

SEQ ID NO: 2392389 - protein, 20 aa, Entamoeba dispar
YDNSIPCIHPSIITTNPRRI

SEQ ID NO: 2392390 - protein, 26 aa, Entamoeba dispar
YDNVNRFFTLQGMRVLAFGYKVINGE

SEQ ID NO: 2392391 - protein, 27 aa, Entamoeba dispar
YDRKGCVRYTSGWSVALIIIGITLFIG

SEQ ID NO: 2392392 - protein, 18 aa, Entamoeba dispar
YDRVICKSDVKFSTNKDV

SEQ ID NO: 2392393 - protein, 25 aa, Entamoeba dispar
YDSSLKRILDFGGFGSESGKFNEPT

SEQ ID NO: 2392394 - protein, 25 aa, Entamoeba dispar
YDVFYYLAMQPWRHFVWTTCSGNGN

SEQ ID NO: 2392395 - protein, 17 aa, Entamoeba dispar
YDVKGCPEPGSHHASMM

SEQ ID NO: 2392396 - protein, 19 aa, Entamoeba dispar
YDYEVKYIKGINYDIFTYS

SEQ ID NO: 2392397 - protein, 19 aa, Entamoeba dispar
YDYLLFVGITEEYEANVKV

SEQ ID NO: 2392398 - protein, 25 aa, Entamoeba dispar
YEAILFILMVFRFISYAVSSIIKST

SEQ ID NO: 2392399 - protein, 19 aa, Entamoeba dispar
YECECQAGWFEAHSVGCQR

SEQ ID NO: 2392400 - protein, 31 aa, Entamoeba dispar
YEDAIKCLLIIIECYNRPVALQYSIELIQTL

SEQ ID NO: 2392401 - protein, 25 aa, Entamoeba dispar
YEDKRKEYALCFNVTVQLLQFQNDE

SEQ ID NO: 2392402 - protein, 17 aa, Entamoeba dispar
YEDLLMASFRVEMTDDP

SEQ ID NO: 2392403 - protein, 26 aa, Entamoeba dispar
YEDRSTFILCYLLFLTLYIASLFIVS

SEQ ID NO: 2392404 - protein, 22 aa, Entamoeba dispar
YEFLSKRIGSLSSQTINIAIKT

SEQ ID NO: 2392405 - protein, 18 aa, Entamoeba dispar
YEFSCKWIFTLSMRVRNG

SEQ ID NO: 2392406 - protein, 21 aa, Entamoeba dispar
YEIDGRYWLGGEVQRYDTLKF

SEQ ID NO: 2392407 - protein, 23 aa, Entamoeba dispar
YEIESPILFFGDDTKQVWQYQFQ

SEQ ID NO: 2392408 - protein, 29 aa, Entamoeba dispar
YEIFCGQFIRLLRCPKCGKVADKYIEYDN

SEQ ID NO: 2392409 - protein, 19 aa, Entamoeba dispar
YEIPRKCYRNGLISESSEE

SEQ ID NO: 2392410 - protein, 19 aa, Entamoeba dispar
YEKEEIGGICYSNKEKIIF

SEQ ID NO: 2392411 - protein, 19 aa, Entamoeba dispar
YEKELALYFDFQMFNLRME

SEQ ID NO: 2392412 - protein, 18 aa, Entamoeba dispar
YELENEIFNAYNYELKNS

SEQ ID NO: 2392413 - protein, 25 aa, Entamoeba dispar
YELIYKLVIFEGYQPYYLEEFPPER

SEQ ID NO: 2392414 - protein, 26 aa, Entamoeba dispar
YELLPILNKKYRVMLITFIMDNFEHF

SEQ ID NO: 2392415 - protein, 24 aa, Entamoeba dispar
YELTQVCRIYVALVPKGYTITECP

SEQ ID NO: 2392416 - protein, 22 aa, Entamoeba dispar
YENNIYYLISFVYSEETICGDG

SEQ ID NO: 2392417 - protein, 17 aa, Entamoeba dispar
YEPCGLVAASFFNDSFE

SEQ ID NO: 2392418 - protein, 21 aa, Entamoeba dispar
YEREFKKKFDLPDMLPSYKFI

SEQ ID NO: 2392419 - protein, 17 aa, Entamoeba dispar
YEREWSTLITTGVDSKI

SEQ ID NO: 2392420 - protein, 19 aa, Entamoeba dispar
YERSVLFSDFLVYCSDNKI

SEQ ID NO: 2392421 - protein, 23 aa, Entamoeba dispar
YESKLPKQCQFIGRDYGKFDKII

SEQ ID NO: 2392422 - protein, 24 aa, Entamoeba dispar
YEVFCPFPQFCQGNITIPSEHPEN

SEQ ID NO: 2392423 - protein, 25 aa, Entamoeba dispar
YEVYHGCSCWCNILATKLSSKTSED

SEQ ID NO: 2392424 - protein, 26 aa, Entamoeba dispar
YEYFHFKFPSLFTVLYSFIKEFYSHS

SEQ ID NO: 2392425 - protein, 26 aa, Entamoeba dispar
YEYVFASTLFVFWKLIINSIFCVFVM

SEQ ID NO: 2392426 - protein, 19 aa, Entamoeba dispar
YFALLSVGLWYSSRSSNVS

SEQ ID NO: 2392427 - protein, 17 aa, Entamoeba dispar
YFAPRKISNIAYNETYD

SEQ ID NO: 2392428 - protein, 17 aa, Entamoeba dispar
YFAQNFVTLLYYFCKNI

SEQ ID NO: 2392429 - protein, 20 aa, Entamoeba dispar
YFATKGCDNVCNLMDIPRAT

SEQ ID NO: 2392430 - protein, 17 aa, Entamoeba dispar
YFCRPRVNKALDVENTN

SEQ ID NO: 2392431 - protein, 18 aa, Entamoeba dispar
YFCVDVIGLLALIILYVW

SEQ ID NO: 2392432 - protein, 36 aa, Entamoeba dispar
YFDVGCNPLKIILCPASFVNNYACEGRIDCVFKDTD

SEQ ID NO: 2392433 - protein, 17 aa, Entamoeba dispar
YFFFKGSLDAMVLTTKM

SEQ ID NO: 2392434 - protein, 24 aa, Entamoeba dispar
YFFPLPDYVTSYSFLIEPTQETTK

SEQ ID NO: 2392435 - protein, 25 aa, Entamoeba dispar
YFGVAIPDILVYLGVTRETLSEIMG

SEQ ID NO: 2392436 - protein, 21 aa, Entamoeba dispar
YFILSCLTFFITGVLGLVVGA

SEQ ID NO: 2392437 - protein, 35 aa, Entamoeba dispar
YFIMKYFYFKWSWGEKIFWFYFELHYTYYQIFWSF

SEQ ID NO: 2392438 - protein, 21 aa, Entamoeba dispar
YFIRGLCVFTTILPDPSGRPS

SEQ ID NO: 2392439 - protein, 27 aa, Entamoeba dispar
YFIRYFLVICIFFILACIGIICAVFTK

SEQ ID NO: 2392440 - protein, 24 aa, Entamoeba dispar
YFISACIFLVFSIILILTCLKLWG

SEQ ID NO: 2392441 - protein, 17 aa, Entamoeba dispar
YFISFKLDCLLNKICGK

SEQ ID NO: 2392442 - protein, 17 aa, Entamoeba dispar
YFIYKAIIEPSGIILKE

SEQ ID NO: 2392443 - protein, 26 aa, Entamoeba dispar
YFKDHCYKCSNHLSVLFGSTNYCATC

SEQ ID NO: 2392444 - protein, 18 aa, Entamoeba dispar
YFKEKYCSYLVKPSKRAP

SEQ ID NO: 2392445 - protein, 22 aa, Entamoeba dispar
YFKSEKHLILLLTNYPTVVAAL

SEQ ID NO: 2392446 - protein, 19 aa, Entamoeba dispar
YFLAILIICCIPSISTVTP

SEQ ID NO: 2392447 - protein, 22 aa, Entamoeba dispar
YFLCNACSQLIPIFKVGMTFTY

SEQ ID NO: 2392448 - protein, 18 aa, Entamoeba dispar
YFLFLLCIYIYYICTYVL

SEQ ID NO: 2392449 - protein, 17 aa, Entamoeba dispar
YFLYILSIYIVYQSNSL

SEQ ID NO: 2392450 - protein, 24 aa, Entamoeba dispar
YFLYKRKIWLCALFFGLSIHMKIY

SEQ ID NO: 2392451 - protein, 19 aa, Entamoeba dispar
YFMLCKDVPYISYKSPIFF

SEQ ID NO: 2392452 - protein, 26 aa, Entamoeba dispar
YFNAIRRPFMNFGYFVSCVTTFKVAI

SEQ ID NO: 2392453 - protein, 21 aa, Entamoeba dispar
YFNKYGFKFGPLPSTTILLYL

SEQ ID NO: 2392454 - protein, 20 aa, Entamoeba dispar
YFNRSKCHKLVISLATLPYQ

SEQ ID NO: 2392455 - protein, 23 aa, Entamoeba dispar
YFNSLWMIMCLLPPPQSFIDQFK

SEQ ID NO: 2392456 - protein, 26 aa, Entamoeba dispar
YFNTHRISIIFPLILIFQLSLIQSSW

SEQ ID NO: 2392457 - protein, 23 aa, Entamoeba dispar
YFNVSGLDTWYGLQFFEPLRDTP

SEQ ID NO: 2392458 - protein, 18 aa, Entamoeba dispar
YFPTPAFYAYVASNFIAD

SEQ ID NO: 2392459 - protein, 21 aa, Entamoeba dispar
YFRKWKYRSHFTVLEVILLLG

SEQ ID NO: 2392460 - protein, 18 aa, Entamoeba dispar
YFSLSIDGKTHFLELEIN

SEQ ID NO: 2392461 - protein, 17 aa, Entamoeba dispar
YFSTISMIPALFGLAFY

SEQ ID NO: 2392462 - protein, 17 aa, Entamoeba dispar
YFTRRFVELQILNEQSI

SEQ ID NO: 2392463 - protein, 18 aa, Entamoeba dispar
YFTVIWIGIHVKSIVSVI

SEQ ID NO: 2392464 - protein, 18 aa, Entamoeba dispar
YFVFDLIYLFLLISLISV

SEQ ID NO: 2392465 - protein, 18 aa, Entamoeba dispar
YFVIVMCFCFYQIKNDLA

SEQ ID NO: 2392466 - protein, 17 aa, Entamoeba dispar
YFVRASIEMQRLEGVTR

SEQ ID NO: 2392467 - protein, 19 aa, Entamoeba dispar
YFVRASIEMQRLEGVTRSP

SEQ ID NO: 2392468 - protein, 18 aa, Entamoeba dispar
YFVSICNGIGGGIRSLYK

SEQ ID NO: 2392469 - protein, 19 aa, Entamoeba dispar
YFYLISIQTLYCFEIIKRE

SEQ ID NO: 2392470 - protein, 21 aa, Entamoeba dispar
YFYMNRCGSDFAIQGTLSDGF

SEQ ID NO: 2392471 - protein, 25 aa, Entamoeba dispar
YFYNSLKMKMSILIGVGHMTIGIWI

SEQ ID NO: 2392472 - protein, 25 aa, Entamoeba dispar
YFYSTYMRQCYPQIGQSTAIIVTVC

SEQ ID NO: 2392473 - protein, 20 aa, Entamoeba dispar
YGADALRLSLINSPAVRAET

SEQ ID NO: 2392474 - protein, 17 aa, Entamoeba dispar
YGASLLHHSLITLMADD

SEQ ID NO: 2392475 - protein, 18 aa, Entamoeba dispar
YGCKRCEEGYYLTKDKKC

SEQ ID NO: 2392476 - protein, 22 aa, Entamoeba dispar
YGCKRCEEGYYLTKDMKCLKCD

SEQ ID NO: 2392477 - protein, 26 aa, Entamoeba dispar
YGCKRCKEGYYLTKDKKCLKCDSNCE

SEQ ID NO: 2392478 - protein, 27 aa, Entamoeba dispar
YGCKRCKEGYYLTKEMKCLKCDDKCET

SEQ ID NO: 2392479 - protein, 24 aa, Entamoeba dispar
YGCKRCKEGYYLTNDMKCLKCDDK

SEQ ID NO: 2392480 - protein, 20 aa, Entamoeba dispar
YGCPNGYFCPGDDYDYSCNC

SEQ ID NO: 2392481 - protein, 18 aa, Entamoeba dispar
YGCQRCIDGYFLSSDLTC

SEQ ID NO: 2392482 - protein, 17 aa, Entamoeba dispar
YGCREWLTGYYLINKEC

SEQ ID NO: 2392483 - protein, 17 aa, Entamoeba dispar
YGDGCLNGCYKPDMCSL

SEQ ID NO: 2392484 - protein, 23 aa, Entamoeba dispar
YGEPSVKRYVPFALALTSIGKPK

SEQ ID NO: 2392485 - protein, 19 aa, Entamoeba dispar
YGFRCYQCNSTHFLENGVC

SEQ ID NO: 2392486 - protein, 17 aa, Entamoeba dispar
YGFRGEALYCISNMGEV

SEQ ID NO: 2392487 - protein, 23 aa, Entamoeba dispar
YGIRSEPQLAFIKPGNAVEFNLF

SEQ ID NO: 2392488 - protein, 25 aa, Entamoeba dispar
YGKDLRDAFELCIRFKNKGKRVSEK

SEQ ID NO: 2392489 - protein, 18 aa, Entamoeba dispar
YGLIGAVCSVTFGETVQT

SEQ ID NO: 2392490 - protein, 18 aa, Entamoeba dispar
YGLVFGRIRIPKPLKQEH

SEQ ID NO: 2392491 - protein, 30 aa, Entamoeba dispar
YGNEGFLLMIFYYLGCTLTLRKIKKEGKNQ

SEQ ID NO: 2392492 - protein, 24 aa, Entamoeba dispar
YGNEGFLLMILYYLGCYITLSKLQ

SEQ ID NO: 2392493 - protein, 20 aa, Entamoeba dispar
YGNLSSMLNEHISVFITLAQ

SEQ ID NO: 2392494 - protein, 19 aa, Entamoeba dispar
YGSCLRCKDGYYASNGICK

SEQ ID NO: 2392495 - protein, 20 aa, Entamoeba dispar
YGSCLRCKDGYYASNGICKK

SEQ ID NO: 2392496 - protein, 22 aa, Entamoeba dispar
YGSPLLFVFVYRFILFSFQYIS

SEQ ID NO: 2392497 - protein, 23 aa, Entamoeba dispar
YGTKGKRSTDIICSMKKEGINSG

SEQ ID NO: 2392498 - protein, 19 aa, Entamoeba dispar
YGTNESLQWLLKHDANTKI

SEQ ID NO: 2392499 - protein, 24 aa, Entamoeba dispar
YGVWAIVALSAWPNAAFDLCGMCC

SEQ ID NO: 2392500 - protein, 17 aa, Entamoeba dispar
YHCLKIMSILMAPFTPF

SEQ ID NO: 2392501 - protein, 25 aa, Entamoeba dispar
YHCYSKRFIEFLPFQVYGLASVYSY

SEQ ID NO: 2392502 - protein, 26 aa, Entamoeba dispar
YHFNYKTVFVKSRILLGILGIVIVLF

SEQ ID NO: 2392503 - protein, 18 aa, Entamoeba dispar
YHFQCGYSVFNIILTFLF

SEQ ID NO: 2392504 - protein, 20 aa, Entamoeba dispar
YHINDSFVFYNFNKLLFAIT

SEQ ID NO: 2392505 - protein, 28 aa, Entamoeba dispar
YHLEVGKVFTCIAYFNAIRRPFMNFGYF

SEQ ID NO: 2392506 - protein, 28 aa, Entamoeba dispar
YHLTLFAHEVCKIYPIVIVNLMNEFLSI

SEQ ID NO: 2392507 - protein, 18 aa, Entamoeba dispar
YHNIIELLTILPPSNNII

SEQ ID NO: 2392508 - protein, 25 aa, Entamoeba dispar
YHPFYEIMRRMLLSIYELCPTFSNQ

SEQ ID NO: 2392509 - protein, 19 aa, Entamoeba dispar
YHPRINFVINTYYILPKSI

SEQ ID NO: 2392510 - protein, 18 aa, Entamoeba dispar
YHVRFLRQFLIPHPFQLV

SEQ ID NO: 2392511 - protein, 17 aa, Entamoeba dispar
YIDLCVLRNKFPSSVSL

SEQ ID NO: 2392512 - protein, 24 aa, Entamoeba dispar
YIEARSILTYNILQYLNIALNNYF

SEQ ID NO: 2392513 - protein, 24 aa, Entamoeba dispar
YIFGGCGFLLFYFICSIIVDLVIE

SEQ ID NO: 2392514 - protein, 17 aa, Entamoeba dispar
YIFPIKRVIFILRKQLK

SEQ ID NO: 2392515 - protein, 17 aa, Entamoeba dispar
YIFVCLNCGGIYLLLIS

SEQ ID NO: 2392516 - protein, 18 aa, Entamoeba dispar
YIFYLLFNFCLLNTFSVF

SEQ ID NO: 2392517 - protein, 25 aa, Entamoeba dispar
YIGKYFKIITEYSLENGEFIIILNS

SEQ ID NO: 2392518 - protein, 18 aa, Entamoeba dispar
YIGPKKCLPPLLSYFQMM

SEQ ID NO: 2392519 - protein, 17 aa, Entamoeba dispar
YIGPLVLYFIPFFILKA

SEQ ID NO: 2392520 - protein, 26 aa, Entamoeba dispar
YIHHRRPQDSWGYFEIFIKSPETGEM

SEQ ID NO: 2392521 - protein, 17 aa, Entamoeba dispar
YIIGDSMEKKLFDKRLE

SEQ ID NO: 2392522 - protein, 27 aa, Entamoeba dispar
YIIGYIICLIMYLRLTKKIKQEIEDEK

SEQ ID NO: 2392523 - protein, 24 aa, Entamoeba dispar
YIIKSTWLPDNRKYIHINEPIELI

SEQ ID NO: 2392524 - protein, 23 aa, Entamoeba dispar
YIITFPFLFGVMFGDIGHGTIVF

SEQ ID NO: 2392525 - protein, 26 aa, Entamoeba dispar
YIKLPYKLKVKMLFDTARGMQFLHEN

SEQ ID NO: 2392526 - protein, 18 aa, Entamoeba dispar
YIKSLKLSVKESVFDYAK

SEQ ID NO: 2392527 - protein, 21 aa, Entamoeba dispar
YIKYGDGFVLIYSITSKESFE

SEQ ID NO: 2392528 - protein, 19 aa, Entamoeba dispar
YIKYISIIFDNVFSLFVKV

SEQ ID NO: 2392529 - protein, 18 aa, Entamoeba dispar
YILICLYVLIIMYISIPL

SEQ ID NO: 2392530 - protein, 25 aa, Entamoeba dispar
YILSGCYYLITKGWSFLFSKEKRTA

SEQ ID NO: 2392531 - protein, 24 aa, Entamoeba dispar
YILSMIACGFSIPKVSLASLAKEK

SEQ ID NO: 2392532 - protein, 22 aa, Entamoeba dispar
YILSPRITSVIYPKTPYYLFVH

SEQ ID NO: 2392533 - protein, 19 aa, Entamoeba dispar
YINGFKAKMGDEFKKILKE

SEQ ID NO: 2392534 - protein, 25 aa, Entamoeba dispar
YINIKGCDFFTHPSGKKFSVINEMH

SEQ ID NO: 2392535 - protein, 27 aa, Entamoeba dispar
YINKSCGKPMKFIFLIDVSKDSLTRVF

SEQ ID NO: 2392536 - protein, 28 aa, Entamoeba dispar
YINLLFMPYCSFNIQIPFQIIIVEDNIK

SEQ ID NO: 2392537 - protein, 19 aa, Entamoeba dispar
YINSVECPQAIVTKNTIIE

SEQ ID NO: 2392538 - protein, 23 aa, Entamoeba dispar
YINYWSAALKYRFNIGERTVKMV

SEQ ID NO: 2392539 - protein, 22 aa, Entamoeba dispar
YIPKEYLSYFVITLSVLPSLPL

SEQ ID NO: 2392540 - protein, 18 aa, Entamoeba dispar
YIPLLFISFRTHPLFIAD

SEQ ID NO: 2392541 - protein, 21 aa, Entamoeba dispar
YIRATCIISDCAVTLKVDKTD

SEQ ID NO: 2392542 - protein, 21 aa, Entamoeba dispar
YIRSSLCLATMFIYQLVPIMF

SEQ ID NO: 2392543 - protein, 18 aa, Entamoeba dispar
YISETKIPLWKDEKDKRK

SEQ ID NO: 2392544 - protein, 35 aa, Entamoeba dispar
YISLDGRFPFIWAYSALLATCYWISNRLCSNGSWN

SEQ ID NO: 2392545 - protein, 18 aa, Entamoeba dispar
YISSCLIFPIALTQMDIS

SEQ ID NO: 2392546 - protein, 18 aa, Entamoeba dispar
YISTRIYPFIVHQNKVIR

SEQ ID NO: 2392547 - protein, 25 aa, Entamoeba dispar
YITGCSFGTLLACILGYAEIPEFVA

SEQ ID NO: 2392548 - protein, 23 aa, Entamoeba dispar
YITNAWFYFGLVNTFKANKVIVR

SEQ ID NO: 2392549 - protein, 24 aa, Entamoeba dispar
YITSDIFYVIGFVIWTIGINMIQL

SEQ ID NO: 2392550 - protein, 18 aa, Entamoeba dispar
YIVCIPLVKPTFLRCLED

SEQ ID NO: 2392551 - protein, 25 aa, Entamoeba dispar
YIVHFYGAFCFDFNKSIIMEYAPYG

SEQ ID NO: 2392552 - protein, 19 aa, Entamoeba dispar
YIVSCRETYLLISQLLEKT

SEQ ID NO: 2392553 - protein, 33 aa, Entamoeba dispar
YIYFFKRRLWFTLEFISFIGIFYSFVTLHFILL

SEQ ID NO: 2392554 - protein, 18 aa, Entamoeba dispar
YIYFNLCGPITTQFEGYD

SEQ ID NO: 2392555 - protein, 24 aa, Entamoeba dispar
YIYNLKALYFLGGALLVVVALLSL

SEQ ID NO: 2392556 - protein, 19 aa, Entamoeba dispar
YIYRYLKDKIPLLNENYLT

SEQ ID NO: 2392557 - protein, 19 aa, Entamoeba dispar
YKAEVIFNVKGTFSSDKYQ

SEQ ID NO: 2392558 - protein, 27 aa, Entamoeba dispar
YKAKDSKCVKCFDGYYLKNQQCIPEDK

SEQ ID NO: 2392559 - protein, 23 aa, Entamoeba dispar
YKCGCSTGVYGYCSNNTNDSNSV

SEQ ID NO: 2392560 - protein, 18 aa, Entamoeba dispar
YKDFKSLFDIKRFVENGE

SEQ ID NO: 2392561 - protein, 20 aa, Entamoeba dispar
YKDFKSLFQIKEFVKSGKRL

SEQ ID NO: 2392562 - protein, 22 aa, Entamoeba dispar
YKDKEFINKFIINNPVNNKQCF

SEQ ID NO: 2392563 - protein, 17 aa, Entamoeba dispar
YKDVIVFIRSIAYMISR

SEQ ID NO: 2392564 - protein, 18 aa, Entamoeba dispar
YKEIRFIFIETFKRKLII

SEQ ID NO: 2392565 - protein, 20 aa, Entamoeba dispar
YKEIVIMNILNAFYNKFEKM

SEQ ID NO: 2392566 - protein, 24 aa, Entamoeba dispar
YKEKEFPITLLMKLSSFSFGSFNG

SEQ ID NO: 2392567 - protein, 18 aa, Entamoeba dispar
YKEKLKIPFSPNIFTINV

SEQ ID NO: 2392568 - protein, 22 aa, Entamoeba dispar
YKEKVSLNWAFNERLKYIPDEV

SEQ ID NO: 2392569 - protein, 19 aa, Entamoeba dispar
YKERKEFGEHVLIQVICEN

SEQ ID NO: 2392570 - protein, 19 aa, Entamoeba dispar
YKETIPLRTFRLTQVDRFL

SEQ ID NO: 2392571 - protein, 20 aa, Entamoeba dispar
YKFGLTVLESYRFNYEYDES

SEQ ID NO: 2392572 - protein, 20 aa, Entamoeba dispar
YKFIGANLYYTDRISSVDMK

SEQ ID NO: 2392573 - protein, 17 aa, Entamoeba dispar
YKGLSGLFYTIKGNGDR

SEQ ID NO: 2392574 - protein, 26 aa, Entamoeba dispar
YKIIIRPDLFLKIPSVISNDIPFLTT

SEQ ID NO: 2392575 - protein, 25 aa, Entamoeba dispar
YKIIPDSVFIEWMIKYDNAKSLVVG

SEQ ID NO: 2392576 - protein, 18 aa, Entamoeba dispar
YKIITTMRGVKTFDQYQI

SEQ ID NO: 2392577 - protein, 17 aa, Entamoeba dispar
YKIKCKLFNSTTNHCEI

SEQ ID NO: 2392578 - protein, 18 aa, Entamoeba dispar
YKIKDFIIFGIPLMILSF

SEQ ID NO: 2392579 - protein, 21 aa, Entamoeba dispar
YKILKELDVDYVLVIFGGVIG

SEQ ID NO: 2392580 - protein, 31 aa, Entamoeba dispar
YKIPDGYSLRLSFLESFRYNYAYKEKIPREF

SEQ ID NO: 2392581 - protein, 20 aa, Entamoeba dispar
YKIRINEYFIGQEYFNASEI

SEQ ID NO: 2392582 - protein, 20 aa, Entamoeba dispar
YKITLNGGIKIISNERGYTS

SEQ ID NO: 2392583 - protein, 21 aa, Entamoeba dispar
YKKDWISLFTLCKRTTIYSLT

SEQ ID NO: 2392584 - protein, 27 aa, Entamoeba dispar
YKKLPETLVFHLKRFGYNEQFQIVKYN

SEQ ID NO: 2392585 - protein, 18 aa, Entamoeba dispar
YKLCIDWYDSSPIKEDIV

SEQ ID NO: 2392586 - protein, 18 aa, Entamoeba dispar
YKLDLPDYVVKQIINDKV

SEQ ID NO: 2392587 - protein, 21 aa, Entamoeba dispar
YKLKKLRVKRNINDFPSSFNP

SEQ ID NO: 2392588 - protein, 19 aa, Entamoeba dispar
YKLLHIIPFDSDRKRMSII

SEQ ID NO: 2392589 - protein, 19 aa, Entamoeba dispar
YKLPSDIFSFGVSLFEAYT

SEQ ID NO: 2392590 - protein, 20 aa, Entamoeba dispar
YKLVGIVIHTGSAYGGHYFS

SEQ ID NO: 2392591 - protein, 27 aa, Entamoeba dispar
YKNASFFLILLWYSFISNFTCQVVYDD

SEQ ID NO: 2392592 - protein, 27 aa, Entamoeba dispar
YKNEYCLKCPKGTFSQDLQNCKEECNE

SEQ ID NO: 2392593 - protein, 24 aa, Entamoeba dispar
YKNIILIMCEFIYNMFCGNSIIQI

SEQ ID NO: 2392594 - protein, 26 aa, Entamoeba dispar
YKNTILPMIICRLNSISIIRMIISNI

SEQ ID NO: 2392595 - protein, 23 aa, Entamoeba dispar
YKNVAFILMQFWFGIQNAFSGQS

SEQ ID NO: 2392596 - protein, 17 aa, Entamoeba dispar
YKPLPRHKEVIVIDEHN

SEQ ID NO: 2392597 - protein, 24 aa, Entamoeba dispar
YKPTELGDYCEFHLNVLIVILPII

SEQ ID NO: 2392598 - protein, 25 aa, Entamoeba dispar
YKPTELGDYCEFHLNVLIVILPIIG

SEQ ID NO: 2392599 - protein, 33 aa, Entamoeba dispar
YKQETSQCLFEWRGKCWKCKDGYYMNSESVPQC

SEQ ID NO: 2392600 - protein, 17 aa, Entamoeba dispar
YKQIIIFYYFVNYQTND

SEQ ID NO: 2392601 - protein, 24 aa, Entamoeba dispar
YKQQYKILIIILFFLETVTQNNPM

SEQ ID NO: 2392602 - protein, 24 aa, Entamoeba dispar
YKQYQMYIGITGFIVITTILLLIL

SEQ ID NO: 2392603 - protein, 17 aa, Entamoeba dispar
YKRPRRVLRCPALLVFQ

SEQ ID NO: 2392604 - protein, 18 aa, Entamoeba dispar
YKSCLCSFDDLTIKAKYE

SEQ ID NO: 2392605 - protein, 23 aa, Entamoeba dispar
YKSCNVLLQTICMFKNSNNQIEK

SEQ ID NO: 2392606 - protein, 17 aa, Entamoeba dispar
YKSIKLISCDPLEDKTI

SEQ ID NO: 2392607 - protein, 18 aa, Entamoeba dispar
YKSLKIALLEKARDVSNG

SEQ ID NO: 2392608 - protein, 29 aa, Entamoeba dispar
YKTCENIHPVLSVYALFFSKCYPNLPSNI

SEQ ID NO: 2392609 - protein, 18 aa, Entamoeba dispar
YKTFNFNKINSFIPIICV

SEQ ID NO: 2392610 - protein, 19 aa, Entamoeba dispar
YKTGCKNLQLIGWIMICVI

SEQ ID NO: 2392611 - protein, 21 aa, Entamoeba dispar
YKTHCTGIVLIDGFDGLTVNG

SEQ ID NO: 2392612 - protein, 18 aa, Entamoeba dispar
YKTKIIKSKVIIDNTSTL

SEQ ID NO: 2392613 - protein, 19 aa, Entamoeba dispar
YKTLELVKSFQNCPLEESP

SEQ ID NO: 2392614 - protein, 25 aa, Entamoeba dispar
YKTTFSIRGSFIFYHELLPQIFIND

SEQ ID NO: 2392615 - protein, 24 aa, Entamoeba dispar
YKTWKIKCWEYFIEFISDVFPVHS

SEQ ID NO: 2392616 - protein, 22 aa, Entamoeba dispar
YKTYCYQCKEGFIKENGECKEI

SEQ ID NO: 2392617 - protein, 20 aa, Entamoeba dispar
YKVLICASTNVAVDRVLESL

SEQ ID NO: 2392618 - protein, 25 aa, Entamoeba dispar
YKVVNDYKYAFPLFIQANVLLASST

SEQ ID NO: 2392619 - protein, 19 aa, Entamoeba dispar
YKYAFPLFIQTNVLLASST

SEQ ID NO: 2392620 - protein, 25 aa, Entamoeba dispar
YKYKSRLYMIFWGIWFYCSEQTEVF

SEQ ID NO: 2392621 - protein, 22 aa, Entamoeba dispar
YKYSRFVPLVAFLCYASLALHD

SEQ ID NO: 2392622 - protein, 23 aa, Entamoeba dispar
YLAELTHSVSIYAEGILAMETTF

SEQ ID NO: 2392623 - protein, 26 aa, Entamoeba dispar
YLARYCIYCNHFLPPRAYHCMICNKC

SEQ ID NO: 2392624 - protein, 19 aa, Entamoeba dispar
YLCQCIEGYYSVHSLSCRR

SEQ ID NO: 2392625 - protein, 19 aa, Entamoeba dispar
YLCSFDEIISETSFGEMIK

SEQ ID NO: 2392626 - protein, 24 aa, Entamoeba dispar
YLCSILFCHSCFIWYEPFYSTTLI

SEQ ID NO: 2392627 - protein, 23 aa, Entamoeba dispar
YLDKATESFSHFNTLNKITLIVF

SEQ ID NO: 2392628 - protein, 32 aa, Entamoeba dispar
YLEKEVPIRCSMLMTQIEWALKVISIPIPTYL

SEQ ID NO: 2392629 - protein, 18 aa, Entamoeba dispar
YLEKQAQNGFGFIENIKE

SEQ ID NO: 2392630 - protein, 17 aa, Entamoeba dispar
YLELPCSLRTFIAKQSL

SEQ ID NO: 2392631 - protein, 23 aa, Entamoeba dispar
YLFFKKAHGLYSIKSKDNKYQMY

SEQ ID NO: 2392632 - protein, 17 aa, Entamoeba dispar
YLFTIIFFICSWYYQPG

SEQ ID NO: 2392633 - protein, 26 aa, Entamoeba dispar
YLGFLVVIMVFRFFLSKGRLIVLRRF

SEQ ID NO: 2392634 - protein, 23 aa, Entamoeba dispar
YLHCEWAYPIKFTVIPRPVRKNN

SEQ ID NO: 2392635 - protein, 31 aa, Entamoeba dispar
YLILRLKHFKCWRVMTLIAGFMLMLVGGSIF

SEQ ID NO: 2392636 - protein, 27 aa, Entamoeba dispar
YLINKRFSYFFFHWSDLIRTAFFHIIL

SEQ ID NO: 2392637 - protein, 17 aa, Entamoeba dispar
YLISMGIIYTIQKTEYP

SEQ ID NO: 2392638 - protein, 36 aa, Entamoeba dispar
YLISSICFAFGFALYYEWKVALCVIATSPILVLILF

SEQ ID NO: 2392639 - protein, 19 aa, Entamoeba dispar
YLIVKNWWNGWGEDEKGYM

SEQ ID NO: 2392640 - protein, 26 aa, Entamoeba dispar
YLIWKKGGYIGLIFDKIMHLFEVIIL

SEQ ID NO: 2392641 - protein, 28 aa, Entamoeba dispar
YLKECTKIKWKQCIIFDNYHRLLPTLPL

SEQ ID NO: 2392642 - protein, 17 aa, Entamoeba dispar
YLKLFAASCCQMGIQFS

SEQ ID NO: 2392643 - protein, 18 aa, Entamoeba dispar
YLLAKYCWEKVYTSKNHQ

SEQ ID NO: 2392644 - protein, 29 aa, Entamoeba dispar
YLLCSALLCSSCSEISIFNCLTKTIHTWR

SEQ ID NO: 2392645 - protein, 18 aa, Entamoeba dispar
YLLEKGCSYMKELGVSSV

SEQ ID NO: 2392646 - protein, 18 aa, Entamoeba dispar
YLLFALQVSFRFSGITIL

SEQ ID NO: 2392647 - protein, 20 aa, Entamoeba dispar
YLLFNFCLLNTFSVFVGPLH

SEQ ID NO: 2392648 - protein, 17 aa, Entamoeba dispar
YLLFRIIYFSLLSLLLF

SEQ ID NO: 2392649 - protein, 19 aa, Entamoeba dispar
YLLFTIAMACCVVLCILSI

SEQ ID NO: 2392650 - protein, 21 aa, Entamoeba dispar
YLLIQIVFYFSLFYSTSYAVL

SEQ ID NO: 2392651 - protein, 18 aa, Entamoeba dispar
YLLKRYGNLSSMLNEHIS

SEQ ID NO: 2392652 - protein, 25 aa, Entamoeba dispar
YLLKSKYWITIFIDMAVSLVSSKEY

SEQ ID NO: 2392653 - protein, 17 aa, Entamoeba dispar
YLLTQGASLQTKTISGT

SEQ ID NO: 2392654 - protein, 23 aa, Entamoeba dispar
YLLYKRYQRRLEITRANGVFPLK

SEQ ID NO: 2392655 - protein, 18 aa, Entamoeba dispar
YLMTCIFVAFNKVYTMQY

SEQ ID NO: 2392656 - protein, 24 aa, Entamoeba dispar
YLNLPKWLKWIYTISYYRITHNIC

SEQ ID NO: 2392657 - protein, 23 aa, Entamoeba dispar
YLNNCGRCGCLILILHDIVDAIM

SEQ ID NO: 2392658 - protein, 18 aa, Entamoeba dispar
YLNNNIDVGKYCELSVSQ

SEQ ID NO: 2392659 - protein, 19 aa, Entamoeba dispar
YLNSWIDLIFGCLQQSVNH

SEQ ID NO: 2392660 - protein, 20 aa, Entamoeba dispar
YLPEDFKNGLVMSDGKAYLI

SEQ ID NO: 2392661 - protein, 24 aa, Entamoeba dispar
YLPHISIICAIIFAAYPTIYTTPE

SEQ ID NO: 2392662 - protein, 17 aa, Entamoeba dispar
YLPIFYSTFFTFFGGVM

SEQ ID NO: 2392663 - protein, 18 aa, Entamoeba dispar
YLPSNPRLKHFVYSTVGV

SEQ ID NO: 2392664 - protein, 25 aa, Entamoeba dispar
YLPYKLKIKMLFDTARGMQFLHENR

SEQ ID NO: 2392665 - protein, 27 aa, Entamoeba dispar
YLPYSIPRLSCLDDRCGNGIIDETEEC

SEQ ID NO: 2392666 - protein, 18 aa, Entamoeba dispar
YLQISLLSLYCKLGQAIG

SEQ ID NO: 2392667 - protein, 19 aa, Entamoeba dispar
YLRGGNWGIKEPGEETNNV

SEQ ID NO: 2392668 - protein, 22 aa, Entamoeba dispar
YLRHPSYFGWFWWSITTQIVML

SEQ ID NO: 2392669 - protein, 17 aa, Entamoeba dispar
YLRQFKYTYNIFFLVTI

SEQ ID NO: 2392670 - protein, 22 aa, Entamoeba dispar
YLRTIPFFTPLIDKIWPKDDNK

SEQ ID NO: 2392671 - protein, 19 aa, Entamoeba dispar
YLSAPRCILFFTGNPSLLA

SEQ ID NO: 2392672 - protein, 24 aa, Entamoeba dispar
YLSDLRLGMHYPLGSVVMLTNTTD

SEQ ID NO: 2392673 - protein, 24 aa, Entamoeba dispar
YLSIYYKMIVVWKRGIICSERVDS

SEQ ID NO: 2392674 - protein, 19 aa, Entamoeba dispar
YLSSTAFKFEAVRMYGNSF

SEQ ID NO: 2392675 - protein, 25 aa, Entamoeba dispar
YLTAIQDLRLSYVYTTKQLRTLGDT

SEQ ID NO: 2392676 - protein, 22 aa, Entamoeba dispar
YLTLFCTIKLLGMKIPSTVYFS

SEQ ID NO: 2392677 - protein, 19 aa, Entamoeba dispar
YLTNKLNIWYKIRCINIDI

SEQ ID NO: 2392678 - protein, 26 aa, Entamoeba dispar
YLTTEECILCLDIICKRKIGCNTPFL

SEQ ID NO: 2392679 - protein, 26 aa, Entamoeba dispar
YLVICWSCTFSLIFLINIIVPGKSPR

SEQ ID NO: 2392680 - protein, 27 aa, Entamoeba dispar
YLVNLLKRYPNMLSISMQRSFLTRDVR

SEQ ID NO: 2392681 - protein, 22 aa, Entamoeba dispar
YLVYKNPLILNAINHFVPTKTS

SEQ ID NO: 2392682 - protein, 24 aa, Entamoeba dispar
YMEGFMKCILLNPSELYSCDKMLK

SEQ ID NO: 2392683 - protein, 21 aa, Entamoeba dispar
YMFIVCPTFLLSGISSLLFIF

SEQ ID NO: 2392684 - protein, 27 aa, Entamoeba dispar
YMKLFEMLCVVFPCYPLKRNHISYFNW

SEQ ID NO: 2392685 - protein, 29 aa, Entamoeba dispar
YMKMVGMYDSVYWIAHFIQNMIISFFLCW

SEQ ID NO: 2392686 - protein, 19 aa, Entamoeba dispar
YMLHYHFQIDLGEIPLTSD

SEQ ID NO: 2392687 - protein, 23 aa, Entamoeba dispar
YMLVEVFSLPLFYFISQNKPCWS

SEQ ID NO: 2392688 - protein, 27 aa, Entamoeba dispar
YMTEQRIQIRLAREVNILKSGIESCKF

SEQ ID NO: 2392689 - protein, 17 aa, Entamoeba dispar
YNCKSGTIFNSERQCVV

SEQ ID NO: 2392690 - protein, 17 aa, Entamoeba dispar
YNCQLSLSTNNYIIRNN

SEQ ID NO: 2392691 - protein, 25 aa, Entamoeba dispar
YNCSKFCKYCFDDLMKLISRTPKGE

SEQ ID NO: 2392692 - protein, 21 aa, Entamoeba dispar
YNDPFDLILHFNKVEFDQADV

SEQ ID NO: 2392693 - protein, 31 aa, Entamoeba dispar
YNEFLYIVGVLAEIYISIGLYDSAFQLLALR

SEQ ID NO: 2392694 - protein, 24 aa, Entamoeba dispar
YNELKPSIISILIKILLRNIEIIE

SEQ ID NO: 2392695 - protein, 32 aa, Entamoeba dispar
YNEWYFVFYKIFFRILEPIGYYHLKSENVFNS

SEQ ID NO: 2392696 - protein, 19 aa, Entamoeba dispar
YNFMNYRVDGILVITLFSL

SEQ ID NO: 2392697 - protein, 21 aa, Entamoeba dispar
YNIFTFLPLVLLEQFRKLANV

SEQ ID NO: 2392698 - protein, 28 aa, Entamoeba dispar
YNIISEYMVSTCLSFFSSILRSFYSILS

SEQ ID NO: 2392699 - protein, 25 aa, Entamoeba dispar
YNILQRLQNIFARIIGIAFQQQNVS

SEQ ID NO: 2392700 - protein, 24 aa, Entamoeba dispar
YNKDGECLSCNSIKPNCAVCNITS

SEQ ID NO: 2392701 - protein, 23 aa, Entamoeba dispar
YNKIPHLTICFNYFSEPYYSNEI

SEQ ID NO: 2392702 - protein, 22 aa, Entamoeba dispar
YNKKIYSCYSIYYIFATILSMQ

SEQ ID NO: 2392703 - protein, 18 aa, Entamoeba dispar
YNKKTCTVSEEFPTITPN

SEQ ID NO: 2392704 - protein, 18 aa, Entamoeba dispar
YNKLPMVYQEICKYFEQI

SEQ ID NO: 2392705 - protein, 25 aa, Entamoeba dispar
YNLKLRMLYDTARGMSFLHENNILH

SEQ ID NO: 2392706 - protein, 26 aa, Entamoeba dispar
YNLNPFTSRAQIHFIIQRGHHKLKHD

SEQ ID NO: 2392707 - protein, 23 aa, Entamoeba dispar
YNLPPELLQIYKYSIMIKPISDE

SEQ ID NO: 2392708 - protein, 17 aa, Entamoeba dispar
YNLVPLQTFLGGTIIGK

SEQ ID NO: 2392709 - protein, 24 aa, Entamoeba dispar
YNNCISDGLFLFKGVQVPYVSGGQ

SEQ ID NO: 2392710 - protein, 24 aa, Entamoeba dispar
YNNRLELFASAALSLYNKYQTDCN

SEQ ID NO: 2392711 - protein, 26 aa, Entamoeba dispar
YNRSREGLELFAIYITSFMLSLLLFA

SEQ ID NO: 2392712 - protein, 23 aa, Entamoeba dispar
YNVRKTFYTNWPYKSKNDVHAVR

SEQ ID NO: 2392713 - protein, 25 aa, Entamoeba dispar
YNYRRLSYVILYSFYKNIIMYLTQF

SEQ ID NO: 2392714 - protein, 20 aa, Entamoeba dispar
YNYTRMSAIFFGKGGKMTSI

SEQ ID NO: 2392715 - protein, 19 aa, Entamoeba dispar
YPCHEVISGLKYISHFVPT

SEQ ID NO: 2392716 - protein, 17 aa, Entamoeba dispar
YPDCHYLSYLFDLSLNI

SEQ ID NO: 2392717 - protein, 24 aa, Entamoeba dispar
YPEKEFPYIWNIASFIANGKRRPK

SEQ ID NO: 2392718 - protein, 20 aa, Entamoeba dispar
YPFDNFKILKPIIIVKKEIQ

SEQ ID NO: 2392719 - protein, 17 aa, Entamoeba dispar
YPFLSERTIESKIRSFK

SEQ ID NO: 2392720 - protein, 25 aa, Entamoeba dispar
YPFTSRLCPCFGSNCITHSLTGLLY

SEQ ID NO: 2392721 - protein, 17 aa, Entamoeba dispar
YPGTRGVVLILTINNNT

SEQ ID NO: 2392722 - protein, 20 aa, Entamoeba dispar
YPIQLIWRGLYFINTYSYFR

SEQ ID NO: 2392723 - protein, 17 aa, Entamoeba dispar
YPIWTNWWGENFHWRER

SEQ ID NO: 2392724 - protein, 26 aa, Entamoeba dispar
YPKGVKSCSAILFWCYMFAILNIIFG

SEQ ID NO: 2392725 - protein, 20 aa, Entamoeba dispar
YPLCLQCSWTTTSTSCVLCS

SEQ ID NO: 2392726 - protein, 22 aa, Entamoeba dispar
YPLCPSADIRLHKNLTTQSMQR

SEQ ID NO: 2392727 - protein, 23 aa, Entamoeba dispar
YPLFCIIPRLYVYHLVLIFYLYS

SEQ ID NO: 2392728 - protein, 17 aa, Entamoeba dispar
YPLGRIVGVTVYPGLMY

SEQ ID NO: 2392729 - protein, 17 aa, Entamoeba dispar
YPLLKWTVIGLLLISVL

SEQ ID NO: 2392730 - protein, 18 aa, Entamoeba dispar
YPLLQPFSSIPISSIQSK

SEQ ID NO: 2392731 - protein, 28 aa, Entamoeba dispar
YPLNEFPYPWSISKFVCVGRRLPQHPEM

SEQ ID NO: 2392732 - protein, 26 aa, Entamoeba dispar
YPLNSCIDFSDYAAYFFYNNNTHMNF

SEQ ID NO: 2392733 - protein, 19 aa, Entamoeba dispar
YPLWFLCLYDAAGRASKAL

SEQ ID NO: 2392734 - protein, 19 aa, Entamoeba dispar
YPMFHPLSFFKRNYQESIN

SEQ ID NO: 2392735 - protein, 20 aa, Entamoeba dispar
YPMRFYGKVYFNNTLKITKS

SEQ ID NO: 2392736 - protein, 20 aa, Entamoeba dispar
YPNCCQIAFIQRALKYIRKG

SEQ ID NO: 2392737 - protein, 22 aa, Entamoeba dispar
YPNEHAIALSSTVSFKETNLIL

SEQ ID NO: 2392738 - protein, 22 aa, Entamoeba dispar
YPNIIEYYGFIFFYPGLFSGPT

SEQ ID NO: 2392739 - protein, 18 aa, Entamoeba dispar
YPQFLWRYSSLSNKVLPE

SEQ ID NO: 2392740 - protein, 18 aa, Entamoeba dispar
YPQGCLTSSTNLVINTDQ

SEQ ID NO: 2392741 - protein, 20 aa, Entamoeba dispar
YPQKPFTLFLIKRPAIVNLQ

SEQ ID NO: 2392742 - protein, 18 aa, Entamoeba dispar
YPSDLDRSVSISTNNLYN

SEQ ID NO: 2392743 - protein, 25 aa, Entamoeba dispar
YPTFSGKLWPTGAMDFFTMAPFITA

SEQ ID NO: 2392744 - protein, 21 aa, Entamoeba dispar
YPTYICSLLVIFGLGPIIEIL

SEQ ID NO: 2392745 - protein, 18 aa, Entamoeba dispar
YPVGDGFYFTFMMGLGVM

SEQ ID NO: 2392746 - protein, 19 aa, Entamoeba dispar
YPWEIADFISEGKRPKKDE

SEQ ID NO: 2392747 - protein, 21 aa, Entamoeba dispar
YPYCSTDSMGECLTEQYSNCG

SEQ ID NO: 2392748 - protein, 21 aa, Entamoeba dispar
YPYCYECESGYRLNKDSSCEL

SEQ ID NO: 2392749 - protein, 18 aa, Entamoeba dispar
YPYFLMFILSYKFYYLLN

SEQ ID NO: 2392750 - protein, 17 aa, Entamoeba dispar
YQFKEFINTLDLVTKYI

SEQ ID NO: 2392751 - protein, 27 aa, Entamoeba dispar
YQIEDECYRCPPGTYSDKYNCIPCPEG

SEQ ID NO: 2392752 - protein, 17 aa, Entamoeba dispar
YQILKYPLSEEFTFDPN

SEQ ID NO: 2392753 - protein, 26 aa, Entamoeba dispar
YQKKEFRIPISIFIDQQFLSLMKLYY

SEQ ID NO: 2392754 - protein, 24 aa, Entamoeba dispar
YQLDFKVICSVLIVYLVAVVIVSY

SEQ ID NO: 2392755 - protein, 17 aa, Entamoeba dispar
YQLDWSLIPSDTSKLPV

SEQ ID NO: 2392756 - protein, 20 aa, Entamoeba dispar
YQLHFKSFLMDSIPNEDDSV

SEQ ID NO: 2392757 - protein, 24 aa, Entamoeba dispar
YQLLSFKSPDPFNSSCSVEPIEIV

SEQ ID NO: 2392758 - protein, 19 aa, Entamoeba dispar
YQLQSRVKLLGAIQHCETR

SEQ ID NO: 2392759 - protein, 26 aa, Entamoeba dispar
YQLRPRYLFIPFIKLFDSLVFKKIKE

SEQ ID NO: 2392760 - protein, 21 aa, Entamoeba dispar
YQLSFEMFPFISFIVYSCYSL

SEQ ID NO: 2392761 - protein, 20 aa, Entamoeba dispar
YQLTRILRRIIIFTTSLLLL

SEQ ID NO: 2392762 - protein, 24 aa, Entamoeba dispar
YQMASGLSIFGWLLASVFIIAAAI

SEQ ID NO: 2392763 - protein, 17 aa, Entamoeba dispar
YQNMISLHFYLDACFIF

SEQ ID NO: 2392764 - protein, 18 aa, Entamoeba dispar
YQNTFSIISGDFSSGAAC

SEQ ID NO: 2392765 - protein, 19 aa, Entamoeba dispar
YQQFKNAFLRGSILQSSLF

SEQ ID NO: 2392766 - protein, 20 aa, Entamoeba dispar
YQSFGLPLIITRGNNVFGPH

SEQ ID NO: 2392767 - protein, 17 aa, Entamoeba dispar
YQSKIGMEALKTTWVSK

SEQ ID NO: 2392768 - protein, 19 aa, Entamoeba dispar
YQTLMLRPKAPVPYDPHVL

SEQ ID NO: 2392769 - protein, 17 aa, Entamoeba dispar
YQTVPFETLITLLSIAK

SEQ ID NO: 2392770 - protein, 21 aa, Entamoeba dispar
YQVICEFFKSLPYAHVIGTSV

SEQ ID NO: 2392771 - protein, 17 aa, Entamoeba dispar
YRALYIINWIYRYATEP

SEQ ID NO: 2392772 - protein, 23 aa, Entamoeba dispar
YRDHLKRTLDFVIKGLSRMTFDI

SEQ ID NO: 2392773 - protein, 20 aa, Entamoeba dispar
YRFHPDIKYQQFILDDIGFT

SEQ ID NO: 2392774 - protein, 22 aa, Entamoeba dispar
YRFKLDVIIVIIAFIGYISYEI

SEQ ID NO: 2392775 - protein, 17 aa, Entamoeba dispar
YRFNGFTLFSIKPKTPF

SEQ ID NO: 2392776 - protein, 21 aa, Entamoeba dispar
YRFTEGFRKKEIIKLNSFDYY

SEQ ID NO: 2392777 - protein, 20 aa, Entamoeba dispar
YRFVSFLIMFITCVVQLGKN

SEQ ID NO: 2392778 - protein, 22 aa, Entamoeba dispar
YRIAEISTLMLMDISLISTPND

SEQ ID NO: 2392779 - protein, 21 aa, Entamoeba dispar
YRIAQIPVFILLIVAFFFMCL

SEQ ID NO: 2392780 - protein, 25 aa, Entamoeba dispar
YRIKSQLSMKVARCYAQINNIVVHY

SEQ ID NO: 2392781 - protein, 22 aa, Entamoeba dispar
YRITHNICFSIFFDGVDLLCDE

SEQ ID NO: 2392782 - protein, 25 aa, Entamoeba dispar
YRKELPEVLKDISFSIHHGEKIGVC

SEQ ID NO: 2392783 - protein, 23 aa, Entamoeba dispar
YRKKEPYQRIEFSLTIETSNEGT

SEQ ID NO: 2392784 - protein, 20 aa, Entamoeba dispar
YRKTMRLVAICNPFFQLSST

SEQ ID NO: 2392785 - protein, 27 aa, Entamoeba dispar
YRLIILRRYFTLMGVLFAIRLVCVYLT

SEQ ID NO: 2392786 - protein, 19 aa, Entamoeba dispar
YRLPFPDFISPKMKNVIIK

SEQ ID NO: 2392787 - protein, 19 aa, Entamoeba dispar
YRLSQGLCIGCPTESGEGV

SEQ ID NO: 2392788 - protein, 20 aa, Entamoeba dispar
YRMIRFMVINDIPFIEIIDT

SEQ ID NO: 2392789 - protein, 18 aa, Entamoeba dispar
YRNKLEYFYSVVLRLTLL

SEQ ID NO: 2392790 - protein, 20 aa, Entamoeba dispar
YRPTVKFFGPLWTNRIGSIG

SEQ ID NO: 2392791 - protein, 21 aa, Entamoeba dispar
YRPTVKFFGPLWTNRIGSIGN

SEQ ID NO: 2392792 - protein, 18 aa, Entamoeba dispar
YRQHFLRMIDDCVSYIPS

SEQ ID NO: 2392793 - protein, 19 aa, Entamoeba dispar
YRQKVLRSKGFGTVSSTTT

SEQ ID NO: 2392794 - protein, 23 aa, Entamoeba dispar
YRQRLTRVWVFFIFPVLISAYRC

SEQ ID NO: 2392795 - protein, 20 aa, Entamoeba dispar
YRRATYRYTPLLAEILIPDI

SEQ ID NO: 2392796 - protein, 18 aa, Entamoeba dispar
YRSHFTVLEVILLLGCII

SEQ ID NO: 2392797 - protein, 26 aa, Entamoeba dispar
YRSWLHCLWIIFIGCSGILVFSFIFH

SEQ ID NO: 2392798 - protein, 22 aa, Entamoeba dispar
YRTLGTILFNCRLSIYLPLFLK

SEQ ID NO: 2392799 - protein, 21 aa, Entamoeba dispar
YRTLKGFLILFQKEFIGFDAF

SEQ ID NO: 2392800 - protein, 17 aa, Entamoeba dispar
YRYVTPVILDFAQNLKN

SEQ ID NO: 2392801 - protein, 32 aa, Entamoeba dispar
YSACSWVTKGLKEWGGAIIVGFDGDPYGKDDE

SEQ ID NO: 2392802 - protein, 17 aa, Entamoeba dispar
YSAIPLKEINEAILKNK

SEQ ID NO: 2392803 - protein, 25 aa, Entamoeba dispar
YSCLDGLSCDICDISVNAIKSSTTC

SEQ ID NO: 2392804 - protein, 17 aa, Entamoeba dispar
YSDGILLLSSMNNVDLL

SEQ ID NO: 2392805 - protein, 25 aa, Entamoeba dispar
YSECKRNHSIFSIISINEEWENTFY

SEQ ID NO: 2392806 - protein, 25 aa, Entamoeba dispar
YSEKARFDKLLLYASSCAAYYPEPQ

SEQ ID NO: 2392807 - protein, 17 aa, Entamoeba dispar
YSFDWSSLTGIIDYFII

SEQ ID NO: 2392808 - protein, 17 aa, Entamoeba dispar
YSFFRFITSMSHGHGKL

SEQ ID NO: 2392809 - protein, 19 aa, Entamoeba dispar
YSFMYICTYVYIYIFIYVY

SEQ ID NO: 2392810 - protein, 21 aa, Entamoeba dispar
YSFTISISIFFFSPLTYLQLL

SEQ ID NO: 2392811 - protein, 17 aa, Entamoeba dispar
YSFYCRKTSIWSLIDRQ

SEQ ID NO: 2392812 - protein, 19 aa, Entamoeba dispar
YSGGISELLLPSSLKNIRL

SEQ ID NO: 2392813 - protein, 24 aa, Entamoeba dispar
YSGIKFVLRLSFVQSCLKANKVIK

SEQ ID NO: 2392814 - protein, 20 aa, Entamoeba dispar
YSGIVPRLFHYLGNVRFNGL

SEQ ID NO: 2392815 - protein, 25 aa, Entamoeba dispar
YSGRCECKPGYVFKDDGCTQCGNGV

SEQ ID NO: 2392816 - protein, 17 aa, Entamoeba dispar
YSGSLIIEKGIGDYFNM

SEQ ID NO: 2392817 - protein, 20 aa, Entamoeba dispar
YSHQKKYLFLSVFGCIYQLN

SEQ ID NO: 2392818 - protein, 31 aa, Entamoeba dispar
YSIEYPHLYLLMEFMPKYSLFNVLHSNLKII

SEQ ID NO: 2392819 - protein, 20 aa, Entamoeba dispar
YSIFELCEYYILGHKEESTC

SEQ ID NO: 2392820 - protein, 19 aa, Entamoeba dispar
YSIFICFKVKHPTRQQFIP

SEQ ID NO: 2392821 - protein, 17 aa, Entamoeba dispar
YSINCGIQLTSGGSTLA

SEQ ID NO: 2392822 - protein, 25 aa, Entamoeba dispar
YSIPEFRFLVKLILIHGRYCYRQIG

SEQ ID NO: 2392823 - protein, 21 aa, Entamoeba dispar
YSISCFRRLACHHIHVSGKIW

SEQ ID NO: 2392824 - protein, 18 aa, Entamoeba dispar
YSISLPSFLCFNIIAVIL

SEQ ID NO: 2392825 - protein, 25 aa, Entamoeba dispar
YSITNIPVSLSFKVTGIEVSNSLCE

SEQ ID NO: 2392826 - protein, 33 aa, Entamoeba dispar
YSIVFRYFATWKMAECMGILFGFGYSGIQENKP

SEQ ID NO: 2392827 - protein, 21 aa, Entamoeba dispar
YSKEQFKAFNQLCEWRETTAK

SEQ ID NO: 2392828 - protein, 20 aa, Entamoeba dispar
YSKIKYPRIFNLVLQTKEII

SEQ ID NO: 2392829 - protein, 27 aa, Entamoeba dispar
YSKKPLWVLKMIINIQISMNNKNIKDL

SEQ ID NO: 2392830 - protein, 32 aa, Entamoeba dispar
YSKLLTLVSVYSCYILPFLFFLGFVYSLGSLY

SEQ ID NO: 2392831 - protein, 18 aa, Entamoeba dispar
YSKMLRHHVHVINENEIL

SEQ ID NO: 2392832 - protein, 21 aa, Entamoeba dispar
YSKYYFIIYLDFFKEEFSNQF

SEQ ID NO: 2392833 - protein, 23 aa, Entamoeba dispar
YSLCAARSPLIILVRDDTNALFG

SEQ ID NO: 2392834 - protein, 21 aa, Entamoeba dispar
YSLCLPIVWITQSAKLCLVKY

SEQ ID NO: 2392835 - protein, 18 aa, Entamoeba dispar
YSLDWDKRNNNPMIKISS

SEQ ID NO: 2392836 - protein, 18 aa, Entamoeba dispar
YSLMWKQKQIFIKTFTKA

SEQ ID NO: 2392837 - protein, 18 aa, Entamoeba dispar
YSLNESFTYYITSSENSY

SEQ ID NO: 2392838 - protein, 18 aa, Entamoeba dispar
YSMKVCAKLTDYDLPNEL

SEQ ID NO: 2392839 - protein, 18 aa, Entamoeba dispar
YSMLCALYYTFPSNYQDD

SEQ ID NO: 2392840 - protein, 26 aa, Entamoeba dispar
YSMLLMFCIGIFWIIVGTLILISSES

SEQ ID NO: 2392841 - protein, 19 aa, Entamoeba dispar
YSMMYKMCYHNFYKASNGY

SEQ ID NO: 2392842 - protein, 22 aa, Entamoeba dispar
YSNETKKVFNIFGTNQLIFDNN

SEQ ID NO: 2392843 - protein, 20 aa, Entamoeba dispar
YSNHELKGVLTIYKNAEADL

SEQ ID NO: 2392844 - protein, 24 aa, Entamoeba dispar
YSNIQFFLCKTIKGIELNKQCIAY

SEQ ID NO: 2392845 - protein, 20 aa, Entamoeba dispar
YSNPILIYLFTLLYIFIYCY

SEQ ID NO: 2392846 - protein, 20 aa, Entamoeba dispar
YSPFYSKQVLLGIGFMCLNS

SEQ ID NO: 2392847 - protein, 21 aa, Entamoeba dispar
YSPIGAFSMPAPKQVYSPLLV

SEQ ID NO: 2392848 - protein, 26 aa, Entamoeba dispar
YSQFISLEFFTSLLLIKQNQKLFNSI

SEQ ID NO: 2392849 - protein, 22 aa, Entamoeba dispar
YSQFKNCFTVPVLCNDKSQCNQ

SEQ ID NO: 2392850 - protein, 25 aa, Entamoeba dispar
YSRRCKAPIPFELPRSDSLDLPLDK

SEQ ID NO: 2392851 - protein, 25 aa, Entamoeba dispar
YSSFKSLHVQFPFSYSSILDNSFKK

SEQ ID NO: 2392852 - protein, 18 aa, Entamoeba dispar
YSSIPGYGPDLFSVSSDT

SEQ ID NO: 2392853 - protein, 17 aa, Entamoeba dispar
YSSLHYFYFFTSILHVI

SEQ ID NO: 2392854 - protein, 18 aa, Entamoeba dispar
YSSLRIVDSICVFADAFH

SEQ ID NO: 2392855 - protein, 23 aa, Entamoeba dispar
YSSTKGCTRCFDHFYLDSDGNCQ

SEQ ID NO: 2392856 - protein, 20 aa, Entamoeba dispar
YSTRHKLVISLATLPYQLQN

SEQ ID NO: 2392857 - protein, 22 aa, Entamoeba dispar
YSTSRLAWCVLIISIILFAFSV

SEQ ID NO: 2392858 - protein, 25 aa, Entamoeba dispar
YSVFYYLTMQPWRNLEWTSIDSNFP

SEQ ID NO: 2392859 - protein, 30 aa, Entamoeba dispar
YSVKIPRQYIIKVDLLFQSCCNKEDYYKFV

SEQ ID NO: 2392860 - protein, 26 aa, Entamoeba dispar
YSVKRLKINPFYSCKLTNTKERIKSL

SEQ ID NO: 2392861 - protein, 18 aa, Entamoeba dispar
YSVLMYFAGQELKKDPSQ

SEQ ID NO: 2392862 - protein, 27 aa, Entamoeba dispar
YSYAIVMWEFLARADPYPDIPRFHLIE

SEQ ID NO: 2392863 - protein, 21 aa, Entamoeba dispar
YSYFFKTLIKFSLTNEKAVIQ

SEQ ID NO: 2392864 - protein, 17 aa, Entamoeba dispar
YTANGPQRCTLVCNNNF

SEQ ID NO: 2392865 - protein, 18 aa, Entamoeba dispar
YTCSTNSCTLCDRNMTIS

SEQ ID NO: 2392866 - protein, 19 aa, Entamoeba dispar
YTECTPCFTNFTDKKRPVP

SEQ ID NO: 2392867 - protein, 24 aa, Entamoeba dispar
YTFAVPVKVPISFVKEIDKKSSHV

SEQ ID NO: 2392868 - protein, 20 aa, Entamoeba dispar
YTFTIRIFPHKYCWREGDDL

SEQ ID NO: 2392869 - protein, 21 aa, Entamoeba dispar
YTFTTLMKWLCDVDDIPEWYT

SEQ ID NO: 2392870 - protein, 17 aa, Entamoeba dispar
YTFVPWNIMIMTTLTGI

SEQ ID NO: 2392871 - protein, 20 aa, Entamoeba dispar
YTGKHIFIFGGSAGVGQAIA

SEQ ID NO: 2392872 - protein, 24 aa, Entamoeba dispar
YTGPFGASFVYDFKLLNIKIQLSF

SEQ ID NO: 2392873 - protein, 18 aa, Entamoeba dispar
YTHNCFYDGLDVTSYIFG

SEQ ID NO: 2392874 - protein, 19 aa, Entamoeba dispar
YTHYAKWIGPFIKDEYFST

SEQ ID NO: 2392875 - protein, 28 aa, Entamoeba dispar
YTIKVRNPINWRQYQVLFNHFSDDNRFI

SEQ ID NO: 2392876 - protein, 23 aa, Entamoeba dispar
YTISFKLIGFIVILITCYTSNET

SEQ ID NO: 2392877 - protein, 23 aa, Entamoeba dispar
YTIYLKEFIKIIIEINQQEFNEV

SEQ ID NO: 2392878 - protein, 19 aa, Entamoeba dispar
YTKLSSLIYQQFAFSSARK

SEQ ID NO: 2392879 - protein, 17 aa, Entamoeba dispar
YTKLVILLFTWFMPSTL

SEQ ID NO: 2392880 - protein, 19 aa, Entamoeba dispar
YTKRCGHIIMLSFLGSILL

SEQ ID NO: 2392881 - protein, 25 aa, Entamoeba dispar
YTKYPYWRCGLTFTNEEKQNIIDEN

SEQ ID NO: 2392882 - protein, 19 aa, Entamoeba dispar
YTLCIGYFIPTYHIMSLFI

SEQ ID NO: 2392883 - protein, 27 aa, Entamoeba dispar
YTLFELCWKFVFIFYSCIIVGIYLFIF

SEQ ID NO: 2392884 - protein, 18 aa, Entamoeba dispar
YTLFHWVKGFTEREVRVI

SEQ ID NO: 2392885 - protein, 19 aa, Entamoeba dispar
YTLGESLSFKSLTDSCNNI

SEQ ID NO: 2392886 - protein, 17 aa, Entamoeba dispar
YTLKEVFLFGLPIFLWV

SEQ ID NO: 2392887 - protein, 20 aa, Entamoeba dispar
YTLKSGEAMELKFKIKMLCT

SEQ ID NO: 2392888 - protein, 19 aa, Entamoeba dispar
YTLLKNKLLILFGNTMENK

SEQ ID NO: 2392889 - protein, 26 aa, Entamoeba dispar
YTLPSLCPNNNLPLVLTTNSDNKINV

SEQ ID NO: 2392890 - protein, 22 aa, Entamoeba dispar
YTLQMAKSWYSQRLDWLGVGLA

SEQ ID NO: 2392891 - protein, 20 aa, Entamoeba dispar
YTNNCARIGVLVLILHDVVD

SEQ ID NO: 2392892 - protein, 26 aa, Entamoeba dispar
YTNSLKMKLSILIGVFHMTFGVILSF

SEQ ID NO: 2392893 - protein, 19 aa, Entamoeba dispar
YTPDECGYCDEKGYRSDCL

SEQ ID NO: 2392894 - protein, 20 aa, Entamoeba dispar
YTPKCTYHYSTKGIKTTIKT

SEQ ID NO: 2392895 - protein, 23 aa, Entamoeba dispar
YTPLKLDYVWRTALALGAVPCIL

SEQ ID NO: 2392896 - protein, 28 aa, Entamoeba dispar
YTPNEKQTDCIFCPVGTHFIDEPYFRGC

SEQ ID NO: 2392897 - protein, 25 aa, Entamoeba dispar
YTPPEVLNGLPFTKSGDVFSFAIAC

SEQ ID NO: 2392898 - protein, 18 aa, Entamoeba dispar
YTSACSVSIPNTLNGKNI

SEQ ID NO: 2392899 - protein, 19 aa, Entamoeba dispar
YTTLFPLCVVLIVSGIKEI

SEQ ID NO: 2392900 - protein, 24 aa, Entamoeba dispar
YTTLKRWVNESSFIGINAMSNDIA

SEQ ID NO: 2392901 - protein, 28 aa, Entamoeba dispar
YTVQIPNDWKNFFEDITFVQQLFNVYFN

SEQ ID NO: 2392902 - protein, 22 aa, Entamoeba dispar
YVACVCCGFVNASMNVTIRRFI

SEQ ID NO: 2392903 - protein, 24 aa, Entamoeba dispar
YVANCKRFIGSVCIKCNDGYFIQS

SEQ ID NO: 2392904 - protein, 18 aa, Entamoeba dispar
YVARLRTIIYPNFLNYYL

SEQ ID NO: 2392905 - protein, 23 aa, Entamoeba dispar
YVDELKSLIIYREYSLEESRKFL

SEQ ID NO: 2392906 - protein, 19 aa, Entamoeba dispar
YVDMSFIITCCLICISLYY

SEQ ID NO: 2392907 - protein, 19 aa, Entamoeba dispar
YVFHFMPQVHILRSHTIKV

SEQ ID NO: 2392908 - protein, 17 aa, Entamoeba dispar
YVFHFSPQVTILSPKSQ

SEQ ID NO: 2392909 - protein, 27 aa, Entamoeba dispar
YVFLLFYVLITFEFYRYGKGTKQIKYW

SEQ ID NO: 2392910 - protein, 17 aa, Entamoeba dispar
YVFRRFLFNELLQSLHP

SEQ ID NO: 2392911 - protein, 33 aa, Entamoeba dispar
YVFYISLSFTTAIFLRWVNRIDGLMVNNKFLKQ

SEQ ID NO: 2392912 - protein, 17 aa, Entamoeba dispar
YVGFIITFNCSSKFTTG

SEQ ID NO: 2392913 - protein, 18 aa, Entamoeba dispar
YVIDQGLAKVLRSSSGAE

SEQ ID NO: 2392914 - protein, 18 aa, Entamoeba dispar
YVIESCPDDPCGTSDAVI

SEQ ID NO: 2392915 - protein, 22 aa, Entamoeba dispar
YVIKKKIDYINGFKAKMGDEFK

SEQ ID NO: 2392916 - protein, 18 aa, Entamoeba dispar
YVLLILLCIYVLMYIFIY

SEQ ID NO: 2392917 - protein, 18 aa, Entamoeba dispar
YVLLLCFVSRAFNVFPIS

SEQ ID NO: 2392918 - protein, 24 aa, Entamoeba dispar
YVLSPRVSVILRKDVPYYLFIHSK

SEQ ID NO: 2392919 - protein, 19 aa, Entamoeba dispar
YVLYKRIIFSASLFISMSL

SEQ ID NO: 2392920 - protein, 24 aa, Entamoeba dispar
YVNAMLRYVYDGIKIDQYLYTVRF

SEQ ID NO: 2392921 - protein, 26 aa, Entamoeba dispar
YVNGKCVECLNGLLLNFKGECINTKI

SEQ ID NO: 2392922 - protein, 17 aa, Entamoeba dispar
YVNHSFDGMMAILQPLY

SEQ ID NO: 2392923 - protein, 20 aa, Entamoeba dispar
YVNPCGRLLYDYLVNSTSPS

SEQ ID NO: 2392924 - protein, 18 aa, Entamoeba dispar
YVNYGIWYLISSCEAVIN

SEQ ID NO: 2392925 - protein, 20 aa, Entamoeba dispar
YVPHCIKYNYEACIECETNY

SEQ ID NO: 2392926 - protein, 17 aa, Entamoeba dispar
YVPLSGVVSEVWQSYSS

SEQ ID NO: 2392927 - protein, 24 aa, Entamoeba dispar
YVSSFKRIIKYVVFTASDEKCLNE

SEQ ID NO: 2392928 - protein, 20 aa, Entamoeba dispar
YVSVLCFDYLYISNSTKIPM

SEQ ID NO: 2392929 - protein, 18 aa, Entamoeba dispar
YVSVLTCSSLFIIMAVSG

SEQ ID NO: 2392930 - protein, 19 aa, Entamoeba dispar
YVYEKHLIKQISDYNSSRC

SEQ ID NO: 2392931 - protein, 18 aa, Entamoeba dispar
YVYSIFLFKRKDWDYTGK

SEQ ID NO: 2392932 - protein, 22 aa, Entamoeba dispar
YWERNKCFAMQSSLKLSSIDRY

SEQ ID NO: 2392933 - protein, 20 aa, Entamoeba dispar
YWHYFRAGGFIGLILCLMPF

SEQ ID NO: 2392934 - protein, 19 aa, Entamoeba dispar
YWIENTWQITIDKSMPIVE

SEQ ID NO: 2392935 - protein, 19 aa, Entamoeba dispar
YWIKRKCYVDYDLRTPFLF

SEQ ID NO: 2392936 - protein, 18 aa, Entamoeba dispar
YWILFVVGSIVFVGLISC

SEQ ID NO: 2392937 - protein, 23 aa, Entamoeba dispar
YYDEVLHQIILLKPSENFVAAAI

SEQ ID NO: 2392938 - protein, 17 aa, Entamoeba dispar
YYDIWKKEEKDILQLDD

SEQ ID NO: 2392939 - protein, 26 aa, Entamoeba dispar
YYEEAARLFVLISIRIPDLYEGILET

SEQ ID NO: 2392940 - protein, 19 aa, Entamoeba dispar
YYFAYCFVASVFLQITILL

SEQ ID NO: 2392941 - protein, 21 aa, Entamoeba dispar
YYFKEEGAITVCEYSNNGFNM

SEQ ID NO: 2392942 - protein, 19 aa, Entamoeba dispar
YYKKVGCSVGKVNVIGRPY

SEQ ID NO: 2392943 - protein, 20 aa, Entamoeba dispar
YYKLLSELVLRYKKNGGNSE

SEQ ID NO: 2392944 - protein, 19 aa, Entamoeba dispar
YYKTLKFTTRYDLDDLDDI

SEQ ID NO: 2392945 - protein, 18 aa, Entamoeba dispar
YYKVELIKAPAKYDKFHI

SEQ ID NO: 2392946 - protein, 24 aa, Entamoeba dispar
YYLENDANCSFGIIKSDETKENNN

SEQ ID NO: 2392947 - protein, 24 aa, Entamoeba dispar
YYLEVLPLIKLKIFMLETSDNFFV

SEQ ID NO: 2392948 - protein, 17 aa, Entamoeba dispar
YYLHLFLEEQPDLNWEN

SEQ ID NO: 2392949 - protein, 17 aa, Entamoeba dispar
YYLHVFGHYGIVPTEDL

SEQ ID NO: 2392950 - protein, 18 aa, Entamoeba dispar
YYLINLFPLLSLYHFITL

SEQ ID NO: 2392951 - protein, 17 aa, Entamoeba dispar
YYLMILSVFELRISSIM

SEQ ID NO: 2392952 - protein, 25 aa, Entamoeba dispar
YYLSYLRYAFELVMLNQFDDIPLFC

SEQ ID NO: 2392953 - protein, 17 aa, Entamoeba dispar
YYLTKDMKCLKCDDKCE

SEQ ID NO: 2392954 - protein, 25 aa, Entamoeba dispar
YYMKYRLLCHNKLLKFFIGEFIGSY

SEQ ID NO: 2392955 - protein, 17 aa, Entamoeba dispar
YYMVKSFFVRGDFTKEL

SEQ ID NO: 2392956 - protein, 19 aa, Entamoeba dispar
YYPLFLSYIRFIIREKTEF

SEQ ID NO: 2392957 - protein, 17 aa, Entamoeba dispar
YYPSPTIDRVRKYVLDT

SEQ ID NO: 2392958 - protein, 18 aa, Entamoeba dispar
YYPYWTCFSPDTESTCGF

SEQ ID NO: 2392959 - protein, 17 aa, Entamoeba dispar
YYQARIFFFKLILLKMT

SEQ ID NO: 2392960 - protein, 18 aa, Entamoeba dispar
YYQDASCQHCLWIDPYSN

SEQ ID NO: 2392961 - protein, 24 aa, Entamoeba dispar
YYQLIGRNNWKVEVSVDGKVEQTI

SEQ ID NO: 2392962 - protein, 29 aa, Entamoeba dispar
YYQSHAHMMLPVWCALHGQTVELFHEQRV

SEQ ID NO: 2392963 - protein, 18 aa, Entamoeba dispar
YYRGLLLMQNFCSLNNEA

SEQ ID NO: 2392964 - protein, 25 aa, Entamoeba dispar
YYSKKMWPLVIVFIILQIITEIIVQ

SEQ ID NO: 2392965 - protein, 24 aa, Entamoeba dispar
YYSTETRLLLSLSKHNETILTVQA

SEQ ID NO: 2392966 - protein, 18 aa, Entamoeba dispar
YYSVYTLFIHLFISHINM

SEQ ID NO: 2392967 - protein, 25 aa, Entamoeba dispar
YYTLNYIFCRSMLSILFNIIKAFLS

SEQ ID NO: 2392968 - protein, 17 aa, Entamoeba dispar
YYVPLRMKFPYRDVPNG

SEQ ID NO: 2392969 - protein, 17 aa, Entamoeba dispar
YYVPYLFCCVLLGLFSL

SEQ ID NO: 2392970 - protein, 17 aa, Entamoeba dispar
YYYDFMYAVLPFIPDIV

SEQ ID NO: 2392971 - protein, 22 aa, Entamoeba dispar
YYYDIELWYSLLAHSKVPFLTF

SEQ ID NO: 2392972 - protein, 24 aa, Entamoeba dispar
YYYKRPQRYYSFCDIMNHRSKKKY

SEQ ID NO: 2392973 - protein, 23 aa, Entamoeba dispar
YYYYRYGFEFLWETYLYHGTRTD

SEQ ID NO: 2392974 - protein, 18 aa, Entamoeba dispar
FLFSRYILIFLFLFIILI

SEQ ID NO: 2392975 - protein, 19 aa, Entamoeba dispar
YGCRECLTGYYLINKECSK

SEQ ID NO: 2392976 - protein, 20 aa, Entamoeba dispar
KNNKCSKCSFWYGINEEGTK

SEQ ID NO: 2392977 - protein, 19 aa, Entamoeba dispar
NNKCSKCSFWYGINEEGTK

SEQ ID NO: 2392978 - protein, 18 aa, Entamoeba dispar
YGCRECLTGYYLINKECS

SEQ ID NO: 2392979 - protein, 20 aa, Entamoeba dispar
EYGCRECLTGYYLINKECSK

SEQ ID NO: 2392980 - protein, 21 aa, Entamoeba dispar
KNNKCSKCSFWYGINEEGTKC

SEQ ID NO: 2392981 - protein, 20 aa, Entamoeba dispar
LKEWGGAILVGFDGDPNGKD

SEQ ID NO: 2392982 - protein, 18 aa, Entamoeba dispar
LRERRSATELSRLILLLP

SEQ ID NO: 2392983 - protein, 18 aa, Entamoeba dispar
LYIYTCLYSIFLYHLVCF

SEQ ID NO: 2392984 - protein, 22 aa, Entamoeba dispar
RRSATELSRLILLLPISIFTLS

SEQ ID NO: 2392985 - protein, 22 aa, Entamoeba dispar
TEFKFPWKIAEFISTGKRPTII

SEQ ID NO: 2392986 - protein, 21 aa, Entamoeba dispar
TFGIVYRAEWRGVDVAVKVMK

SEQ ID NO: 2392987 - protein, 26 aa, Entamoeba dispar
VYSFAICMLEIWLGRDPYDPMKFPDS

SEQ ID NO: 2392988 - protein, 17 aa, Entamoeba dispar
YMGLKCPHAQFTLAKDY

SEQ ID NO: 2392989 - protein, 21 aa, Entamoeba dispar
AAYLCRLCAPLALNILHMIKF

SEQ ID NO: 2392990 - protein, 20 aa, Entamoeba dispar
ACIPLCIGYAIYSLYNNEFK

SEQ ID NO: 2392991 - protein, 24 aa, Entamoeba dispar
AIKGQCFGIGFGFSTFFTYATYAL

SEQ ID NO: 2392992 - protein, 22 aa, Entamoeba dispar
CIYLYIYICIYLYMYICIYVPS

SEQ ID NO: 2392993 - protein, 24 aa, Entamoeba dispar
CQKCTPNQCTLCLDGIINENGICV

SEQ ID NO: 2392994 - protein, 19 aa, Entamoeba dispar
DDVIFLIYLYQRWIYPVDK

SEQ ID NO: 2392995 - protein, 22 aa, Entamoeba dispar
DIELIMSFGCYFIVTQQTTFKS

SEQ ID NO: 2392996 - protein, 18 aa, Entamoeba dispar
DKACGKYISVGYDYLAVK

SEQ ID NO: 2392997 - protein, 25 aa, Entamoeba dispar
DNGEWSTKCVLAYCDDGYKFDYINN

SEQ ID NO: 2392998 - protein, 24 aa, Entamoeba dispar
DNGEWSTKCVLSYCDEGYKFDYNN

SEQ ID NO: 2392999 - protein, 19 aa, Entamoeba dispar
FKEKMMWTGITLLVFLVCS

SEQ ID NO: 2393000 - protein, 17 aa, Entamoeba dispar
GFAKDWDLTLVIMSMSP

SEQ ID NO: 2393001 - protein, 18 aa, Entamoeba dispar
GWVLCVLAIPIGIISGYD

SEQ ID NO: 2393002 - protein, 19 aa, Entamoeba dispar
IESLLKWARKLSFIDVDKV

SEQ ID NO: 2393003 - protein, 20 aa, Entamoeba dispar
IYFKGEWKTPFKILPKKMKF

SEQ ID NO: 2393004 - protein, 17 aa, Entamoeba dispar
KENRVGSLITRLSSDPT

SEQ ID NO: 2393005 - protein, 17 aa, Entamoeba dispar
KLIVFGGVFGVGSSAIV

SEQ ID NO: 2393006 - protein, 20 aa, Entamoeba dispar
KNNKCSKCSFWYGINEDGTK

SEQ ID NO: 2393007 - protein, 24 aa, Entamoeba dispar
KRRTSLPNALPFKINATPFIPKRK

SEQ ID NO: 2393008 - protein, 21 aa, Entamoeba dispar
KSRDCVFMFISWCCTLSALSV

SEQ ID NO: 2393009 - protein, 22 aa, Entamoeba dispar
LGIAFYYDWRVSLCVMAVSPVL

SEQ ID NO: 2393010 - protein, 17 aa, Entamoeba dispar
LHRIACFRDDVIFLIYL

SEQ ID NO: 2393011 - protein, 20 aa, Entamoeba dispar
LIKWIFLILFFIQWISFLLC

SEQ ID NO: 2393012 - protein, 17 aa, Entamoeba dispar
LNHCYKIIFAFWKELNK

SEQ ID NO: 2393013 - protein, 23 aa, Entamoeba dispar
LNVPFQFVCCGIFQLICDGILVS

SEQ ID NO: 2393014 - protein, 19 aa, Entamoeba dispar
LYLPPRYPLLGGWKTSFEV

SEQ ID NO: 2393015 - protein, 18 aa, Entamoeba dispar
NRVGSLITRLSSDPTKLN

SEQ ID NO: 2393016 - protein, 23 aa, Entamoeba dispar
NTEFPKWTIGVIVIFVIALIVIV

SEQ ID NO: 2393017 - protein, 18 aa, Entamoeba dispar
PFSQCVSSGKGWEYDRNS

SEQ ID NO: 2393018 - protein, 28 aa, Entamoeba dispar
PLLLFKAWMLRWWKIMYLRLLDLQKWKV

SEQ ID NO: 2393019 - protein, 19 aa, Entamoeba dispar
RVGGVKIFFDKYLTSTGSG

SEQ ID NO: 2393020 - protein, 17 aa, Entamoeba dispar
SKYCLRCNTGYYMDKGE

SEQ ID NO: 2393021 - protein, 20 aa, Entamoeba dispar
SLFVSFLIVCAVILIVAVVV

SEQ ID NO: 2393022 - protein, 19 aa, Entamoeba dispar
SSTKLSFLIPSFMRKRSNS

SEQ ID NO: 2393023 - protein, 26 aa, Entamoeba dispar
THTLFWICFFLMQFCTVVLVLNLLKK

SEQ ID NO: 2393024 - protein, 24 aa, Entamoeba dispar
TKIGEKMIKEWIRQPLIDKDKINK

SEQ ID NO: 2393025 - protein, 23 aa, Entamoeba dispar
TTIRFLNDYGLEWNDIYFETRTS

SEQ ID NO: 2393026 - protein, 22 aa, Entamoeba dispar
VGELTCCLCPLFAGLIATQTDD

SEQ ID NO: 2393027 - protein, 20 aa, Entamoeba dispar
VPKWAIAVIVVVGLIIIIAL

SEQ ID NO: 2393028 - protein, 17 aa, Entamoeba dispar
WGGAIIVGFDGDPNGKD

SEQ ID NO: 2393029 - protein, 17 aa, Entamoeba dispar
YIYTCLYSIFLYHLVCF

SEQ ID NO: 2393030 - protein, 19 aa, Entamoeba dispar
YRIPFDWLEEKSMGLSDSI

SEQ ID NO: 2393031 - protein, 20 aa, Entamoeba dispar
AAFWAFSAFTFWPAAVGTVG

SEQ ID NO: 2393032 - protein, 17 aa, Entamoeba dispar
AAMCVAKLYFLNQEECV

SEQ ID NO: 2393033 - protein, 27 aa, Entamoeba dispar
ACEMIQCALCGIPICSAQCLKIHSQQP

SEQ ID NO: 2393034 - protein, 19 aa, Entamoeba dispar
ACTFLSFFFILFFGLFPLS

SEQ ID NO: 2393035 - protein, 20 aa, Entamoeba dispar
ADKAIWRIIFIISPITLILL

SEQ ID NO: 2393036 - protein, 17 aa, Entamoeba dispar
ADKNLGCLLSFGTTTSP

SEQ ID NO: 2393037 - protein, 23 aa, Entamoeba dispar
AELFKDIFFHTAFWMRTSGEVFY

SEQ ID NO: 2393038 - protein, 17 aa, Entamoeba dispar
AFAKLHATFPCLRDQIK

SEQ ID NO: 2393039 - protein, 18 aa, Entamoeba dispar
AFFAFRVATGLLKWVSLG

SEQ ID NO: 2393040 - protein, 18 aa, Entamoeba dispar
AFKSHTIFSLSLTITLVC

SEQ ID NO: 2393041 - protein, 18 aa, Entamoeba dispar
AFLLGVAYFLTRDRHQAQ

SEQ ID NO: 2393042 - protein, 23 aa, Entamoeba dispar
AFTLPCLFIFMSLYRFNGFTLFS

SEQ ID NO: 2393043 - protein, 18 aa, Entamoeba dispar
AGAAVAFVGRWFTQHPSD

SEQ ID NO: 2393044 - protein, 20 aa, Entamoeba dispar
AGICAVHFVSYIYRYLKDKI

SEQ ID NO: 2393045 - protein, 20 aa, Entamoeba dispar
AGICCIHIALYLGLPESIDK

SEQ ID NO: 2393046 - protein, 18 aa, Entamoeba dispar
AHEVCKIYPIVIVNLMNE

SEQ ID NO: 2393047 - protein, 23 aa, Entamoeba dispar
AIFKKEWYHFLFAYILVTIYELF

SEQ ID NO: 2393048 - protein, 18 aa, Entamoeba dispar
AIIFCIIIPFSSVVLNDK

SEQ ID NO: 2393049 - protein, 18 aa, Entamoeba dispar
AIKDICWIVMKIEKLAQL

SEQ ID NO: 2393050 - protein, 23 aa, Entamoeba dispar
AIKGQCFGIGFGFSIFFIFCSYA

SEQ ID NO: 2393051 - protein, 23 aa, Entamoeba dispar
AIKGQCFGIGFGFSMFFIFCSYA

SEQ ID NO: 2393052 - protein, 17 aa, Entamoeba dispar
AIWPFCTAFYWPVTTGT

SEQ ID NO: 2393053 - protein, 18 aa, Entamoeba dispar
AKFFRIVISDGFFIGYGM

SEQ ID NO: 2393054 - protein, 24 aa, Entamoeba dispar
AKVIPDCVSSIWVCCVDKRYENGR

SEQ ID NO: 2393055 - protein, 17 aa, Entamoeba dispar
AKVTKFGLYGFRKPTSG

SEQ ID NO: 2393056 - protein, 18 aa, Entamoeba dispar
AKYWYLQRMDWIGAAISI

SEQ ID NO: 2393057 - protein, 23 aa, Entamoeba dispar
ALAFPLMLQYVIKWINNPQGTLK

SEQ ID NO: 2393058 - protein, 22 aa, Entamoeba dispar
ALCILLRFCMCFTHVVQYFNEF

SEQ ID NO: 2393059 - protein, 20 aa, Entamoeba dispar
ALCLKKNLKCLVAMINVFVA

SEQ ID NO: 2393060 - protein, 24 aa, Entamoeba dispar
ALGGQEQWKGLAIFVDTFQNSYTS

SEQ ID NO: 2393061 - protein, 17 aa, Entamoeba dispar
ALICANMFTRWVVPSKE

SEQ ID NO: 2393062 - protein, 18 aa, Entamoeba dispar
ALIHLLRVILWAVRESPK

SEQ ID NO: 2393063 - protein, 20 aa, Entamoeba dispar
ALLCSSCSEISIFNCLTKTI

SEQ ID NO: 2393064 - protein, 23 aa, Entamoeba dispar
ALLPTIQCLYQWLCTIQDNTEWY

SEQ ID NO: 2393065 - protein, 19 aa, Entamoeba dispar
ALPRAKKILLLLGEAPSPT

SEQ ID NO: 2393066 - protein, 25 aa, Entamoeba dispar
ALSCIKPACIYLRCKEVCEFKITIN

SEQ ID NO: 2393067 - protein, 19 aa, Entamoeba dispar
ALSFILAFVFNFLVINLFK

SEQ ID NO: 2393068 - protein, 24 aa, Entamoeba dispar
ALYYNWKLALCVIATSPIHALILF

SEQ ID NO: 2393069 - protein, 19 aa, Entamoeba dispar
AMFAFPWYITWFLHSVEDI

SEQ ID NO: 2393070 - protein, 19 aa, Entamoeba dispar
AMFDFTFYWYNFMPLSRGT

SEQ ID NO: 2393071 - protein, 19 aa, Entamoeba dispar
AMMRCCLPLEPPRDVIINK

SEQ ID NO: 2393072 - protein, 17 aa, Entamoeba dispar
AMVCLKCTTVINERVPV

SEQ ID NO: 2393073 - protein, 29 aa, Entamoeba dispar
ANAFPIAGFWKHVCIVWTFCDCYKPQVYY

SEQ ID NO: 2393074 - protein, 20 aa, Entamoeba dispar
APLVHSYCCRHVWGNDSKAF

SEQ ID NO: 2393075 - protein, 17 aa, Entamoeba dispar
APLVYLVTCEPIKFQHI

SEQ ID NO: 2393076 - protein, 17 aa, Entamoeba dispar
AQLWKLYFPMNLKLKAS

SEQ ID NO: 2393077 - protein, 20 aa, Entamoeba dispar
ARFRIGNFHFFKTILSEEMI

SEQ ID NO: 2393078 - protein, 20 aa, Entamoeba dispar
ARLLWFRNYFIGVLISILSN

SEQ ID NO: 2393079 - protein, 17 aa, Entamoeba dispar
ARMFAILSMVFFLVSTI

SEQ ID NO: 2393080 - protein, 23 aa, Entamoeba dispar
ARNSGLFAVCWSFGKAIGYAAGG

SEQ ID NO: 2393081 - protein, 20 aa, Entamoeba dispar
ARSGFAVEYIRCWGEYIRKE

SEQ ID NO: 2393082 - protein, 20 aa, Entamoeba dispar
ARVRIKVSIIRFIKTKKDII

SEQ ID NO: 2393083 - protein, 20 aa, Entamoeba dispar
ASGLLKIYGLEFDCCSLHFK

SEQ ID NO: 2393084 - protein, 18 aa, Entamoeba dispar
ASIYLTICTDIFVIRSFT

SEQ ID NO: 2393085 - protein, 23 aa, Entamoeba dispar
ASNRISIYILFGIVLIVSLFSIS

SEQ ID NO: 2393086 - protein, 24 aa, Entamoeba dispar
ASTLIPSVCRWYRLRQIIKQQELL

SEQ ID NO: 2393087 - protein, 19 aa, Entamoeba dispar
ATGLLKWVSLGIMIIGFIL

SEQ ID NO: 2393088 - protein, 25 aa, Entamoeba dispar
ATIKKPLLCFTRFFVVKLMMILLLG

SEQ ID NO: 2393089 - protein, 20 aa, Entamoeba dispar
AVGKEWRIDLTLKLLSVISL

SEQ ID NO: 2393090 - protein, 17 aa, Entamoeba dispar
AVIFCFSYCYGINNQCS

SEQ ID NO: 2393091 - protein, 25 aa, Entamoeba dispar
AVTMYECFKWGSAFTSNIKPWCICD

SEQ ID NO: 2393092 - protein, 17 aa, Entamoeba dispar
AVVLCIIGSVFVGESPL

SEQ ID NO: 2393093 - protein, 17 aa, Entamoeba dispar
AYCPTKFAIKGLLDSLR

SEQ ID NO: 2393094 - protein, 25 aa, Entamoeba dispar
AYEKRGIKELFEWQEECLKEKGVRE

SEQ ID NO: 2393095 - protein, 17 aa, Entamoeba dispar
AYFAYKLTKGWKKIMAL

SEQ ID NO: 2393096 - protein, 17 aa, Entamoeba dispar
AYMALTFYKNTKYYLFI

SEQ ID NO: 2393097 - protein, 19 aa, Entamoeba dispar
CAAGGSWNCAIMRELAKAY

SEQ ID NO: 2393098 - protein, 20 aa, Entamoeba dispar
CAETCKCYFGFTPITINGIT

SEQ ID NO: 2393099 - protein, 23 aa, Entamoeba dispar
CAICMTCGCLLCYKDKKHQDIIH

SEQ ID NO: 2393100 - protein, 21 aa, Entamoeba dispar
CAIESRLLIIVPRYLKEVEDG

SEQ ID NO: 2393101 - protein, 18 aa, Entamoeba dispar
CAVLICLLLSVFKNSFIL

SEQ ID NO: 2393102 - protein, 17 aa, Entamoeba dispar
CCFLLFFIIIAIIGVLL

SEQ ID NO: 2393103 - protein, 19 aa, Entamoeba dispar
CDCLYRYVNYYLKALTIFL

SEQ ID NO: 2393104 - protein, 22 aa, Entamoeba dispar
CDSYGYCPNGWSYFNHKCYENQ

SEQ ID NO: 2393105 - protein, 19 aa, Entamoeba dispar
CDVFSFSICLLEIWLTHQP

SEQ ID NO: 2393106 - protein, 19 aa, Entamoeba dispar
CEILYAWSCIDVFIISVIA

SEQ ID NO: 2393107 - protein, 17 aa, Entamoeba dispar
CELLKCITDCFEVSCLG

SEQ ID NO: 2393108 - protein, 18 aa, Entamoeba dispar
CERIKFEITESFCSSLDE

SEQ ID NO: 2393109 - protein, 18 aa, Entamoeba dispar
CFFPLDVIITLGMGAAIS

SEQ ID NO: 2393110 - protein, 21 aa, Entamoeba dispar
CGHGGYVQGFWVKFDSKAMEN

SEQ ID NO: 2393111 - protein, 18 aa, Entamoeba dispar
CGIKSRLAFNVEIGNEYF

SEQ ID NO: 2393112 - protein, 19 aa, Entamoeba dispar
CGIKSRLAFNVEIGNEYFV

SEQ ID NO: 2393113 - protein, 20 aa, Entamoeba dispar
CGKPMKFIFLIDVSKDSLTR

SEQ ID NO: 2393114 - protein, 17 aa, Entamoeba dispar
CGTPWYWILTVIGGPLM

SEQ ID NO: 2393115 - protein, 22 aa, Entamoeba dispar
CGWSDRCTFKYGRRRIFIGIGV

SEQ ID NO: 2393116 - protein, 25 aa, Entamoeba dispar
CHCCCYRCLSCFRIMLGDIKGDVNR

SEQ ID NO: 2393117 - protein, 19 aa, Entamoeba dispar
CIFHLLSIRLFQKCSLFSY

SEQ ID NO: 2393118 - protein, 19 aa, Entamoeba dispar
CIFINSSICLRFINNHCSY

SEQ ID NO: 2393119 - protein, 17 aa, Entamoeba dispar
CIFVQGFIAEGCKQIII

SEQ ID NO: 2393120 - protein, 18 aa, Entamoeba dispar
CIMLCCLCPAPSVNIIYC

SEQ ID NO: 2393121 - protein, 17 aa, Entamoeba dispar
CIMLPIIICMKDFKWTM

SEQ ID NO: 2393122 - protein, 20 aa, Entamoeba dispar
CIMMLWPRIEKFGDPNFRKL

SEQ ID NO: 2393123 - protein, 21 aa, Entamoeba dispar
CKAMAILAFCNFFSVCDQDQF

SEQ ID NO: 2393124 - protein, 24 aa, Entamoeba dispar
CKHYHIFKLLGIQSIQFFVIFKFI

SEQ ID NO: 2393125 - protein, 17 aa, Entamoeba dispar
CKLFFGVEFLYNCLVSF

SEQ ID NO: 2393126 - protein, 17 aa, Entamoeba dispar
CKMKLVILQNRYVPWIS

SEQ ID NO: 2393127 - protein, 18 aa, Entamoeba dispar
CKRDEVWTSLVLKTTGRV

SEQ ID NO: 2393128 - protein, 19 aa, Entamoeba dispar
CLALIYLRNGWVLCVLAIP

SEQ ID NO: 2393129 - protein, 27 aa, Entamoeba dispar
CLKLTWSQRMLFCLGFCGFGMLCIFMS

SEQ ID NO: 2393130 - protein, 20 aa, Entamoeba dispar
CLNCGCLVCNNCFTEHRIIC

SEQ ID NO: 2393131 - protein, 20 aa, Entamoeba dispar
CMFLLIDLMRNWFLSSNDNL

SEQ ID NO: 2393132 - protein, 18 aa, Entamoeba dispar
CMLGSLPCHCCCYRCLSC

SEQ ID NO: 2393133 - protein, 17 aa, Entamoeba dispar
CMPEFFVGLIGYALLGD

SEQ ID NO: 2393134 - protein, 17 aa, Entamoeba dispar
CNCQIAIIIQPHLKGIY

SEQ ID NO: 2393135 - protein, 18 aa, Entamoeba dispar
CNGIELKKIFSILNKFKW

SEQ ID NO: 2393136 - protein, 20 aa, Entamoeba dispar
CNKSLPACEMIQCALCGIPI

SEQ ID NO: 2393137 - protein, 20 aa, Entamoeba dispar
CNPFCYCIEGYVPDIEDPLS

SEQ ID NO: 2393138 - protein, 20 aa, Entamoeba dispar
CNSEKCFLCFDNYIVSGTKC

SEQ ID NO: 2393139 - protein, 19 aa, Entamoeba dispar
CNVVLRWALLHGTYPIKKL

SEQ ID NO: 2393140 - protein, 21 aa, Entamoeba dispar
CPEHCLDCLNSEYCFKCENGY

SEQ ID NO: 2393141 - protein, 18 aa, Entamoeba dispar
CPKCSYSPCTQCNILEEC

SEQ ID NO: 2393142 - protein, 20 aa, Entamoeba dispar
CPKGRYILRQVFDKKKNLVE

SEQ ID NO: 2393143 - protein, 21 aa, Entamoeba dispar
CPNEELFGVFCIYDITMEKKL

SEQ ID NO: 2393144 - protein, 18 aa, Entamoeba dispar
CQSCIGVFRDCIFKSQNK

SEQ ID NO: 2393145 - protein, 21 aa, Entamoeba dispar
CQSHLRFGGYFVQLILNVITL

SEQ ID NO: 2393146 - protein, 17 aa, Entamoeba dispar
CSAHAKSSILLLPEALK

SEQ ID NO: 2393147 - protein, 17 aa, Entamoeba dispar
CSCNLLLDSEHCIECSE

SEQ ID NO: 2393148 - protein, 17 aa, Entamoeba dispar
CSFNRIFSFPPILSLTS

SEQ ID NO: 2393149 - protein, 19 aa, Entamoeba dispar
CSHIFYRNLFISIVFSSFH

SEQ ID NO: 2393150 - protein, 17 aa, Entamoeba dispar
CSIIKTRFINTIRVLVF

SEQ ID NO: 2393151 - protein, 17 aa, Entamoeba dispar
CSLFKYDIQQNVSEAIK

SEQ ID NO: 2393152 - protein, 18 aa, Entamoeba dispar
CSLPRFWIVLLYIVCIPL

SEQ ID NO: 2393153 - protein, 24 aa, Entamoeba dispar
CSMCSPQECYSCFNSSEIITTDKS

SEQ ID NO: 2393154 - protein, 21 aa, Entamoeba dispar
CSNIFCGWSCTYERGIDNFYN

SEQ ID NO: 2393155 - protein, 17 aa, Entamoeba dispar
CSSCGKPIIGSVALEVK

SEQ ID NO: 2393156 - protein, 24 aa, Entamoeba dispar
CSSTSCSFCSFIINGQIKYDFYYI

SEQ ID NO: 2393157 - protein, 18 aa, Entamoeba dispar
CTLWMILSMITFVLFGIV

SEQ ID NO: 2393158 - protein, 19 aa, Entamoeba dispar
CVACGQTPPFSAMMILWAN

SEQ ID NO: 2393159 - protein, 17 aa, Entamoeba dispar
CVIRFQIYYCIIDKRKE

SEQ ID NO: 2393160 - protein, 23 aa, Entamoeba dispar
CVKGKRTPIKFSYTIFDSAEDIN

SEQ ID NO: 2393161 - protein, 24 aa, Entamoeba dispar
CVNDCSVLLLKVCKLLDTSISPTP

SEQ ID NO: 2393162 - protein, 20 aa, Entamoeba dispar
CVPFCGTCKFGFSCNKAAKC

SEQ ID NO: 2393163 - protein, 20 aa, Entamoeba dispar
CVPSYCDYGYKFDRTSQTCI

SEQ ID NO: 2393164 - protein, 20 aa, Entamoeba dispar
CVVIGWKLCLPPLLSYFQIC

SEQ ID NO: 2393165 - protein, 18 aa, Entamoeba dispar
CVYGCGFALLSTFIFDSN

SEQ ID NO: 2393166 - protein, 20 aa, Entamoeba dispar
CWGLKIYFAYGFLMSIFIQI

SEQ ID NO: 2393167 - protein, 19 aa, Entamoeba dispar
CWNDIMIKSRIKEMEEEVE

SEQ ID NO: 2393168 - protein, 24 aa, Entamoeba dispar
CYDECPYCLWGLCYSCTHGCNYGS

SEQ ID NO: 2393169 - protein, 20 aa, Entamoeba dispar
CYECTIIGCEWCNNQCSLSF

SEQ ID NO: 2393170 - protein, 18 aa, Entamoeba dispar
CYILPFLFFLGFVYSLGS

SEQ ID NO: 2393171 - protein, 17 aa, Entamoeba dispar
CYIVIDIGSIIIIQLIS

SEQ ID NO: 2393172 - protein, 20 aa, Entamoeba dispar
CYNLFSITVVYSWKNPDNSE

SEQ ID NO: 2393173 - protein, 20 aa, Entamoeba dispar
CYRCQSCFKVIVGDRESIDH

SEQ ID NO: 2393174 - protein, 18 aa, Entamoeba dispar
CYSKRFIEFLPFQVYGLA

SEQ ID NO: 2393175 - protein, 23 aa, Entamoeba dispar
DALKELYCIKAIDENGHITQLGV

SEQ ID NO: 2393176 - protein, 18 aa, Entamoeba dispar
DALWKLWDYLLLSEDPCF

SEQ ID NO: 2393177 - protein, 22 aa, Entamoeba dispar
DCMGCGLLTCMCCDWCTDCCYV

SEQ ID NO: 2393178 - protein, 19 aa, Entamoeba dispar
DCNVCYSGGYRKCGLNSYI

SEQ ID NO: 2393179 - protein, 20 aa, Entamoeba dispar
DDCNVCYSGGYRKCGLNSYI

SEQ ID NO: 2393180 - protein, 17 aa, Entamoeba dispar
DEIRFNSFWNYKKFEIK

SEQ ID NO: 2393181 - protein, 21 aa, Entamoeba dispar
DEIRVQLPFPLREKYHLLITV

SEQ ID NO: 2393182 - protein, 25 aa, Entamoeba dispar
DELRYRFNHVWKEFLETYFVPYKVE

SEQ ID NO: 2393183 - protein, 20 aa, Entamoeba dispar
DEMKSLLVIYPFPRTLINTP

SEQ ID NO: 2393184 - protein, 21 aa, Entamoeba dispar
DFTSEILKEFSFLIELLDKDM

SEQ ID NO: 2393185 - protein, 19 aa, Entamoeba dispar
DGECSKCPVLVNNSVIKSN

SEQ ID NO: 2393186 - protein, 18 aa, Entamoeba dispar
DGFYLKEGSCISCEDDCS

SEQ ID NO: 2393187 - protein, 18 aa, Entamoeba dispar
DGIKRLAKFKGVHNDIQF

SEQ ID NO: 2393188 - protein, 24 aa, Entamoeba dispar
DGISIKIARTFFLFGLNNISKIAH

SEQ ID NO: 2393189 - protein, 17 aa, Entamoeba dispar
DGKWWPQSFMSFFTMAP

SEQ ID NO: 2393190 - protein, 18 aa, Entamoeba dispar
DGLKGKWFVYTPKDTEKV

SEQ ID NO: 2393191 - protein, 18 aa, Entamoeba dispar
DGSVLRIKYLVNERKLII

SEQ ID NO: 2393192 - protein, 24 aa, Entamoeba dispar
DIIPRFKQGYSFCFIGKEDQTESC

SEQ ID NO: 2393193 - protein, 18 aa, Entamoeba dispar
DILFICFLLILLSFLAGL

SEQ ID NO: 2393194 - protein, 23 aa, Entamoeba dispar
DILLKKRITSLIQWYPKEINCVE

SEQ ID NO: 2393195 - protein, 18 aa, Entamoeba dispar
DILPFNWISELPLNMKNL

SEQ ID NO: 2393196 - protein, 18 aa, Entamoeba dispar
DILPQGFAPLLFYGLTPG

SEQ ID NO: 2393197 - protein, 18 aa, Entamoeba dispar
DILSCIICSLIIIILILI

SEQ ID NO: 2393198 - protein, 21 aa, Entamoeba dispar
DILSCIICSLIIIILILIIVN

SEQ ID NO: 2393199 - protein, 24 aa, Entamoeba dispar
DIYKVGLCLIDFIIENTRIDQIIS

SEQ ID NO: 2393200 - protein, 20 aa, Entamoeba dispar
DKEVVKLIVHFICITNDKLI

SEQ ID NO: 2393201 - protein, 24 aa, Entamoeba dispar
DKGEWSTKCVLAYCDSGYKFDYNK

SEQ ID NO: 2393202 - protein, 24 aa, Entamoeba dispar
DKGEWSTKCVMAYCDDGYKFDYNN

SEQ ID NO: 2393203 - protein, 19 aa, Entamoeba dispar
DKKRLVILLVLIIVVIFLI

SEQ ID NO: 2393204 - protein, 23 aa, Entamoeba dispar
DKRIKGYLNAWVFRGFIKTLNNS

SEQ ID NO: 2393205 - protein, 20 aa, Entamoeba dispar
DLFKRYGVHVTFFIIGERVK

SEQ ID NO: 2393206 - protein, 24 aa, Entamoeba dispar
DLHIVCFFIPLGIYFMLKNITDES

SEQ ID NO: 2393207 - protein, 21 aa, Entamoeba dispar
DLLKVRFCQDIARGMEYLHQN

SEQ ID NO: 2393208 - protein, 19 aa, Entamoeba dispar
DLPIHLAILSLLIKNSSFD

SEQ ID NO: 2393209 - protein, 18 aa, Entamoeba dispar
DLRKCIPLIIVGNGAYGT

SEQ ID NO: 2393210 - protein, 19 aa, Entamoeba dispar
DLSRYDFYDALSISLNGFI

SEQ ID NO: 2393211 - protein, 25 aa, Entamoeba dispar
DLVRIWKCLWKFIDMSVDIPNEERA

SEQ ID NO: 2393212 - protein, 18 aa, Entamoeba dispar
DLVWRFILNITENEQLDQ

SEQ ID NO: 2393213 - protein, 24 aa, Entamoeba dispar
DMPCLYPMAVALTFSREVFQKISN

SEQ ID NO: 2393214 - protein, 18 aa, Entamoeba dispar
DNCKYCTSSNCLLCNDNY

SEQ ID NO: 2393215 - protein, 25 aa, Entamoeba dispar
DNGEWSTKCVLAYCDLGYKFDYINN

SEQ ID NO: 2393216 - protein, 25 aa, Entamoeba dispar
DNGEWSTKCVLAYCDSGYKFDYINN

SEQ ID NO: 2393217 - protein, 25 aa, Entamoeba dispar
DNGEWSTKCVLAYCDSGYKFDYNKN

SEQ ID NO: 2393218 - protein, 24 aa, Entamoeba dispar
DNGEWSTKCVLSYCDDGYKFDYIN

SEQ ID NO: 2393219 - protein, 24 aa, Entamoeba dispar
DNGEWSTKCVLSYCDDGYKFDYNN

SEQ ID NO: 2393220 - protein, 24 aa, Entamoeba dispar
DNGEWSTKCVLSYCDEGYKFDYIN

SEQ ID NO: 2393221 - protein, 24 aa, Entamoeba dispar
DNGEWSTKCVLSYCDPGYKFDYIN

SEQ ID NO: 2393222 - protein, 24 aa, Entamoeba dispar
DNGEWSTKCVLSYCDSGYKFDYIN

SEQ ID NO: 2393223 - protein, 24 aa, Entamoeba dispar
DNGEWSTKCVLSYCDSGYKFDYNN

SEQ ID NO: 2393224 - protein, 24 aa, Entamoeba dispar
DNGEWSTKCVMAYCDDGYKFDYNN

SEQ ID NO: 2393225 - protein, 18 aa, Entamoeba dispar
DNITCLDFKFDSVLVQSN

SEQ ID NO: 2393226 - protein, 23 aa, Entamoeba dispar
DNQIKYFYCEGVSHVEPQCLDNQ

SEQ ID NO: 2393227 - protein, 22 aa, Entamoeba dispar
DPIEDIKALKICQKRISTVVVM

SEQ ID NO: 2393228 - protein, 17 aa, Entamoeba dispar
DPYFNFRATKYLVEHGP

SEQ ID NO: 2393229 - protein, 19 aa, Entamoeba dispar
DQFFFEWSLKLVIDRNNKE

SEQ ID NO: 2393230 - protein, 23 aa, Entamoeba dispar
DQFKMPWDIAKFVIAGKRLERKD

SEQ ID NO: 2393231 - protein, 27 aa, Entamoeba dispar
DQFRIWCIWCIILFFSPFIIIKIYFTF

SEQ ID NO: 2393232 - protein, 25 aa, Entamoeba dispar
DSFTILRWCFEYHKKIKKAFLNQKT

SEQ ID NO: 2393233 - protein, 17 aa, Entamoeba dispar
DSIGIGINGIFGIGMRF

SEQ ID NO: 2393234 - protein, 17 aa, Entamoeba dispar
DSLISFKMLRSILFQAG

SEQ ID NO: 2393235 - protein, 23 aa, Entamoeba dispar
DSSLKRILDFGGFGSESGKFNEP

SEQ ID NO: 2393236 - protein, 18 aa, Entamoeba dispar
DSVISFILSISWSSVLYL

SEQ ID NO: 2393237 - protein, 24 aa, Entamoeba dispar
DTLFPIRHAWTFTAIFLPGAVTRS

SEQ ID NO: 2393238 - protein, 23 aa, Entamoeba dispar
DTLRLLTILFKYGKYQEVEEAII

SEQ ID NO: 2393239 - protein, 18 aa, Entamoeba dispar
DTQIKFIVCQRIISTDLI

SEQ ID NO: 2393240 - protein, 19 aa, Entamoeba dispar
DTSCFFYWIVVPLLFNEQG

SEQ ID NO: 2393241 - protein, 17 aa, Entamoeba dispar
DTWKCYIVIDIGSIIII

SEQ ID NO: 2393242 - protein, 18 aa, Entamoeba dispar
DTWNRGWISQFFGHDTAY

SEQ ID NO: 2393243 - protein, 26 aa, Entamoeba dispar
DVFSFAICCTEIWLGRDPYDPEKFPD

SEQ ID NO: 2393244 - protein, 25 aa, Entamoeba dispar
DVFSFAICMLEIWLGKEPYDSVKFP

SEQ ID NO: 2393245 - protein, 25 aa, Entamoeba dispar
DVFSFAICMLEIWLGTSPYNSDLFP

SEQ ID NO: 2393246 - protein, 25 aa, Entamoeba dispar
DVFSFAICMLEIWLTHDPYPIIEFH

SEQ ID NO: 2393247 - protein, 17 aa, Entamoeba dispar
DVLLCWVSYFKKIDSLR

SEQ ID NO: 2393248 - protein, 23 aa, Entamoeba dispar
DVNYASAMALIFMGKYEDSLKVV

SEQ ID NO: 2393249 - protein, 17 aa, Entamoeba dispar
DWLARNFLLVFLEDTTS

SEQ ID NO: 2393250 - protein, 20 aa, Entamoeba dispar
DYKGLCKYGTYGCDSYCQCN

SEQ ID NO: 2393251 - protein, 19 aa, Entamoeba dispar
DYLICPSLPTFQWTMIITY

SEQ ID NO: 2393252 - protein, 22 aa, Entamoeba dispar
DYRLLGSLFFKRGNVLRKILSN

SEQ ID NO: 2393253 - protein, 21 aa, Entamoeba dispar
EAAVMIICFKQIILPVDGINV

SEQ ID NO: 2393254 - protein, 18 aa, Entamoeba dispar
ECEFPCYAAASGEYIRDD

SEQ ID NO: 2393255 - protein, 21 aa, Entamoeba dispar
ECKRNHSIFSIISINEEWENT

SEQ ID NO: 2393256 - protein, 22 aa, Entamoeba dispar
ECLKPTLPVSDLFKLRVFYQAY

SEQ ID NO: 2393257 - protein, 21 aa, Entamoeba dispar
ECTCLLCKMKLVILQNRYVPW

SEQ ID NO: 2393258 - protein, 25 aa, Entamoeba dispar
EDLFFKSGLLFYVLVILYIIVSRTI

SEQ ID NO: 2393259 - protein, 18 aa, Entamoeba dispar
EDMFRFLFAFILEVPISI

SEQ ID NO: 2393260 - protein, 19 aa, Entamoeba dispar
EDRTRFGFIAQELKEVITD

SEQ ID NO: 2393261 - protein, 19 aa, Entamoeba dispar
EDVFKIIFRLAPNHCFAHY

SEQ ID NO: 2393262 - protein, 17 aa, Entamoeba dispar
EDYIRNAIDDMKMMYLS

SEQ ID NO: 2393263 - protein, 22 aa, Entamoeba dispar
EECLPCPKGSYFVNGQCLLCEE

SEQ ID NO: 2393264 - protein, 20 aa, Entamoeba dispar
EEGHCYLLFVPFEYNGHTCY

SEQ ID NO: 2393265 - protein, 22 aa, Entamoeba dispar
EEGRKCLWISILIDSITIVLLL

SEQ ID NO: 2393266 - protein, 20 aa, Entamoeba dispar
EELRLSTLQVLLKGILSAEV

SEQ ID NO: 2393267 - protein, 19 aa, Entamoeba dispar
EEWHFWRLLLINIYTLWTV

SEQ ID NO: 2393268 - protein, 18 aa, Entamoeba dispar
EFAKEIIGIFPFDQSILI

SEQ ID NO: 2393269 - protein, 23 aa, Entamoeba dispar
EFFKEEMIILLTILLKIIPINNI

SEQ ID NO: 2393270 - protein, 18 aa, Entamoeba dispar
EFGKRCIIGLFIGGVIGI

SEQ ID NO: 2393271 - protein, 19 aa, Entamoeba dispar
EFIMYRVGGSIGFMSSTHL

SEQ ID NO: 2393272 - protein, 21 aa, Entamoeba dispar
EFLRLPVWMLFLGIDVNLAYK

SEQ ID NO: 2393273 - protein, 18 aa, Entamoeba dispar
EFQNKFYLGDGVKFVPFQ

SEQ ID NO: 2393274 - protein, 17 aa, Entamoeba dispar
EGKCYRCEDSFDGILEN

SEQ ID NO: 2393275 - protein, 17 aa, Entamoeba dispar
EGKELWFAYIIKYLILF

SEQ ID NO: 2393276 - protein, 17 aa, Entamoeba dispar
EGLRILVIAGRELKKEE

SEQ ID NO: 2393277 - protein, 17 aa, Entamoeba dispar
EGWKFSYKSGYYFGLLN

SEQ ID NO: 2393278 - protein, 19 aa, Entamoeba dispar
EGYPWCDIDKNMSWCDIND

SEQ ID NO: 2393279 - protein, 23 aa, Entamoeba dispar
EHKIACLLPLFGPVLLLLIKSLF

SEQ ID NO: 2393280 - protein, 18 aa, Entamoeba dispar
EHWPTFLALADMHELLAI

SEQ ID NO: 2393281 - protein, 30 aa, Entamoeba dispar
EIIDCPMPFFIFEWHYLWYVHAFNFEISLR

SEQ ID NO: 2393282 - protein, 19 aa, Entamoeba dispar
EIISLKGIWYLLDLSRPAN

SEQ ID NO: 2393283 - protein, 22 aa, Entamoeba dispar
EIISRRLLLMIFERIKFDELFF

SEQ ID NO: 2393284 - protein, 21 aa, Entamoeba dispar
EIKEIPDYIGYFGLDKDDNKC

SEQ ID NO: 2393285 - protein, 25 aa, Entamoeba dispar
EILHSCGFLLLRVMLLKCSFNKLKK

SEQ ID NO: 2393286 - protein, 19 aa, Entamoeba dispar
EIMKKFGIHFLIIEFLPNQ

SEQ ID NO: 2393287 - protein, 19 aa, Entamoeba dispar
EINYFLSLKTHEEYEIPNE

SEQ ID NO: 2393288 - protein, 18 aa, Entamoeba dispar
EIPICNYGGMGINQTSDG

SEQ ID NO: 2393289 - protein, 32 aa, Entamoeba dispar
EIPTRIEIFLIHLRRALLFFIHFPCSINNPIE

SEQ ID NO: 2393290 - protein, 19 aa, Entamoeba dispar
EIQRKGGIFSNCLDEHVTH

SEQ ID NO: 2393291 - protein, 22 aa, Entamoeba dispar
EIYEVLIKWGYFVQMPSVSPFI

SEQ ID NO: 2393292 - protein, 17 aa, Entamoeba dispar
EIYRLFGELPKDITGLC

SEQ ID NO: 2393293 - protein, 19 aa, Entamoeba dispar
EKFGRIALLKMVELKEPKR

SEQ ID NO: 2393294 - protein, 24 aa, Entamoeba dispar
EKIWLYKIIYKFGINLSSFPSYFK

SEQ ID NO: 2393295 - protein, 17 aa, Entamoeba dispar
EKLRIVISVIFFLISCF

SEQ ID NO: 2393296 - protein, 23 aa, Entamoeba dispar
EKRTLWYVWALWWFIYAVVCVAT

SEQ ID NO: 2393297 - protein, 19 aa, Entamoeba dispar
EKSKWWISLIILGVLLILF

SEQ ID NO: 2393298 - protein, 17 aa, Entamoeba dispar
EKWEWTDMEGLEISPFD

SEQ ID NO: 2393299 - protein, 19 aa, Entamoeba dispar
EKWLNRINPLYPFLQTELQ

SEQ ID NO: 2393300 - protein, 18 aa, Entamoeba dispar
ELEACWKKLALLILTRKG

SEQ ID NO: 2393301 - protein, 22 aa, Entamoeba dispar
ELERRFGEEMAHDKSLKKELID

SEQ ID NO: 2393302 - protein, 21 aa, Entamoeba dispar
ELILCPTCLILGVDKYSAIPL

SEQ ID NO: 2393303 - protein, 19 aa, Entamoeba dispar
ELILRGCSCFKMGTKLKTK

SEQ ID NO: 2393304 - protein, 19 aa, Entamoeba dispar
ELKLALSGMSSFTPRILIY

SEQ ID NO: 2393305 - protein, 24 aa, Entamoeba dispar
ELKRKDWYGVLAFSGIEPINEINE

SEQ ID NO: 2393306 - protein, 20 aa, Entamoeba dispar
ELLSYICADYCKIYCVNTFK

SEQ ID NO: 2393307 - protein, 19 aa, Entamoeba dispar
ELMKRFAIITTLFTPLTFL

SEQ ID NO: 2393308 - protein, 19 aa, Entamoeba dispar
ELVRIAILWHEAWHEALEE

SEQ ID NO: 2393309 - protein, 21 aa, Entamoeba dispar
EMADALSWGRGVGCSFLEDCS

SEQ ID NO: 2393310 - protein, 23 aa, Entamoeba dispar
EMTSCIGCGLALNQCYWNIKTHQ

SEQ ID NO: 2393311 - protein, 19 aa, Entamoeba dispar
EMVHLYLGIEIIRTINGWT

SEQ ID NO: 2393312 - protein, 22 aa, Entamoeba dispar
ENQELKSAIPLMRESVDKEKKY

SEQ ID NO: 2393313 - protein, 24 aa, Entamoeba dispar
ENRGSMVYQCCKLFVHLLEIRDCN

SEQ ID NO: 2393314 - protein, 24 aa, Entamoeba dispar
ENSKMVKCWIEFIEGKAMNINETF

SEQ ID NO: 2393315 - protein, 18 aa, Entamoeba dispar
EPFIWYYYCVGFYGEKAF

SEQ ID NO: 2393316 - protein, 18 aa, Entamoeba dispar
EPIRWRKHYHSWNIFFLS

SEQ ID NO: 2393317 - protein, 21 aa, Entamoeba dispar
EPRNYCSLKMLPTCYHVLITP

SEQ ID NO: 2393318 - protein, 23 aa, Entamoeba dispar
EPYCGKCGPGLRCISGKCGYLTT

SEQ ID NO: 2393319 - protein, 25 aa, Entamoeba dispar
EQRWWRLTLIFFLLGFCCFPFWIPS

SEQ ID NO: 2393320 - protein, 35 aa, Entamoeba dispar
EQRWWRLTLIFFLLGFCFFPFWIPSFILSQKSSQR

SEQ ID NO: 2393321 - protein, 23 aa, Entamoeba dispar
EQTWKSGVMMLIIFIVLFTALSI

SEQ ID NO: 2393322 - protein, 20 aa, Entamoeba dispar
EQWCYRKARRISCGIDSDIL

SEQ ID NO: 2393323 - protein, 22 aa, Entamoeba dispar
ERIKRSIVITGIFNLKTDKIEF

SEQ ID NO: 2393324 - protein, 17 aa, Entamoeba dispar
ERKECPNEELFGVFCIY

SEQ ID NO: 2393325 - protein, 17 aa, Entamoeba dispar
ERLWGVAMLIYAVLMMV

SEQ ID NO: 2393326 - protein, 18 aa, Entamoeba dispar
ERYLLSENIDFLWTENKK

SEQ ID NO: 2393327 - protein, 19 aa, Entamoeba dispar
ESIKSNAIWNICRLEDYHV

SEQ ID NO: 2393328 - protein, 20 aa, Entamoeba dispar
ESKFRVVVFTTLQGMFSVLY

SEQ ID NO: 2393329 - protein, 18 aa, Entamoeba dispar
ESLLKWARKLSFIDVDKV

SEQ ID NO: 2393330 - protein, 18 aa, Entamoeba dispar
ESRECLYRNGGISEYIRN

SEQ ID NO: 2393331 - protein, 17 aa, Entamoeba dispar
ETCSLCGNGKLDEGEEC

SEQ ID NO: 2393332 - protein, 17 aa, Entamoeba dispar
ETMKMIAKRGIKIKENI

SEQ ID NO: 2393333 - protein, 19 aa, Entamoeba dispar
ETQMCWLLTVMNAMLNRTY

SEQ ID NO: 2393334 - protein, 19 aa, Entamoeba dispar
EVFPLILGVDMIFNDDEFK

SEQ ID NO: 2393335 - protein, 19 aa, Entamoeba dispar
EVFQAIGIFIGFIICVSIV

SEQ ID NO: 2393336 - protein, 24 aa, Entamoeba dispar
EVIKFLKRRNEIFKTTFILTCGSG

SEQ ID NO: 2393337 - protein, 24 aa, Entamoeba dispar
EVKATLDNGCWCLFAGVIVYTVTT

SEQ ID NO: 2393338 - protein, 24 aa, Entamoeba dispar
EVNDLLKIRMCDNIAQAMDYLHNK

SEQ ID NO: 2393339 - protein, 17 aa, Entamoeba dispar
EWMAMLLACCRQGIIIV

SEQ ID NO: 2393340 - protein, 17 aa, Entamoeba dispar
EWYCIYPPFAFVQALER

SEQ ID NO: 2393341 - protein, 17 aa, Entamoeba dispar
EYCKSNRGCCSSCKTML

SEQ ID NO: 2393342 - protein, 25 aa, Entamoeba dispar
EYPHLYLLMEFMPKYSLFNVLHSNL

SEQ ID NO: 2393343 - protein, 18 aa, Entamoeba dispar
EYVWKCWSNFHFYFYIIL

SEQ ID NO: 2393344 - protein, 17 aa, Entamoeba dispar
FAFCILCILLYAAYLTY

SEQ ID NO: 2393345 - protein, 21 aa, Entamoeba dispar
FAGRPRPHFYARIDAKPNEIN

SEQ ID NO: 2393346 - protein, 20 aa, Entamoeba dispar
FAICMLEIWNNGSLYDEQHF

SEQ ID NO: 2393347 - protein, 20 aa, Entamoeba dispar
FAICMLEVWISKDPYNSIKF

SEQ ID NO: 2393348 - protein, 19 aa, Entamoeba dispar
FAIPCKFGLTPSSTELFDC

SEQ ID NO: 2393349 - protein, 24 aa, Entamoeba dispar
FATWKMAECMGILFGFGYSGIQEN

SEQ ID NO: 2393350 - protein, 17 aa, Entamoeba dispar
FCCYCVIRPIYAILQNT

SEQ ID NO: 2393351 - protein, 17 aa, Entamoeba dispar
FCGCFSCNLLPWAWSPP

SEQ ID NO: 2393352 - protein, 17 aa, Entamoeba dispar
FCIIIPFSSVVLNDKQM

SEQ ID NO: 2393353 - protein, 17 aa, Entamoeba dispar
FCILCILLYAAYLTYAK

SEQ ID NO: 2393354 - protein, 24 aa, Entamoeba dispar
FCPCKSNECLLNFNDENITELNDI

SEQ ID NO: 2393355 - protein, 17 aa, Entamoeba dispar
FCTKGFYSVFKKMIKMN

SEQ ID NO: 2393356 - protein, 17 aa, Entamoeba dispar
FCVVKWLYSLAGQLFSQ

SEQ ID NO: 2393357 - protein, 21 aa, Entamoeba dispar
FDCGFVWQYYCVLTIFYCIIM

SEQ ID NO: 2393358 - protein, 20 aa, Entamoeba dispar
FDIAGLYGYIAHNFEKYNKR

SEQ ID NO: 2393359 - protein, 17 aa, Entamoeba dispar
FDISKLTGFFFTINAKV

SEQ ID NO: 2393360 - protein, 17 aa, Entamoeba dispar
FDKLLLYASSCAAYYPE

SEQ ID NO: 2393361 - protein, 17 aa, Entamoeba dispar
FDLALEFGFFFDSKLSR

SEQ ID NO: 2393362 - protein, 23 aa, Entamoeba dispar
FEECIKKGIEIIGIIYNITRSNK

SEQ ID NO: 2393363 - protein, 18 aa, Entamoeba dispar
FEFRGVNVLTEYSQEITI

SEQ ID NO: 2393364 - protein, 19 aa, Entamoeba dispar
FEIFWRISLAFSNCIVLCL

SEQ ID NO: 2393365 - protein, 19 aa, Entamoeba dispar
FEIIELAPFVEFPENTKSK

SEQ ID NO: 2393366 - protein, 18 aa, Entamoeba dispar
FEKLPIGNLLLHYVNWMT

SEQ ID NO: 2393367 - protein, 17 aa, Entamoeba dispar
FELCWKFVFIFYSCIIV

SEQ ID NO: 2393368 - protein, 17 aa, Entamoeba dispar
FELQIAVGFFVFLFANT

SEQ ID NO: 2393369 - protein, 23 aa, Entamoeba dispar
FENCSKAQCSLELQMKGEVNKEE

SEQ ID NO: 2393370 - protein, 20 aa, Entamoeba dispar
FEWKIPLKYIKVVLQVAIFK

SEQ ID NO: 2393371 - protein, 17 aa, Entamoeba dispar
FFAILFFPIEHKIACLL

SEQ ID NO: 2393372 - protein, 19 aa, Entamoeba dispar
FFCVFKFRYILFILLSILL

SEQ ID NO: 2393373 - protein, 17 aa, Entamoeba dispar
FFECGYELYGYCLVFEL

SEQ ID NO: 2393374 - protein, 18 aa, Entamoeba dispar
FFETEFKGDFSLLLDSTK

SEQ ID NO: 2393375 - protein, 18 aa, Entamoeba dispar
FFILCLSIIYLLNDYWKI

SEQ ID NO: 2393376 - protein, 18 aa, Entamoeba dispar
FFWFLRLYSVFNWALEQH

SEQ ID NO: 2393377 - protein, 23 aa, Entamoeba dispar
FFYFPRFLIVLLIGSFLVNLYLY

SEQ ID NO: 2393378 - protein, 25 aa, Entamoeba dispar
FFYHLFCFITFYLLFIFSTFYFYSL

SEQ ID NO: 2393379 - protein, 19 aa, Entamoeba dispar
FGIFCFKIVIVIVATIAGS

SEQ ID NO: 2393380 - protein, 24 aa, Entamoeba dispar
FGIICGSLSFLFGYSIQFIGIYSI

SEQ ID NO: 2393381 - protein, 27 aa, Entamoeba dispar
FGISVLLICWKKMIGLIESGVQINQLA

SEQ ID NO: 2393382 - protein, 19 aa, Entamoeba dispar
FGIVYRADWRRVDVAVKVM

SEQ ID NO: 2393383 - protein, 20 aa, Entamoeba dispar
FGIVYRAEWRGVDVAVKLMK

SEQ ID NO: 2393384 - protein, 20 aa, Entamoeba dispar
FGIVYRAEWRKVDVAVKVMK

SEQ ID NO: 2393385 - protein, 17 aa, Entamoeba dispar
FGLVYRGFWRGVEVAIK

SEQ ID NO: 2393386 - protein, 17 aa, Entamoeba dispar
FGVVYKGIWRSVDVAVK

SEQ ID NO: 2393387 - protein, 18 aa, Entamoeba dispar
FGWTINIILLYVAWFDEN

SEQ ID NO: 2393388 - protein, 30 aa, Entamoeba dispar
FHEFLRKLPFPSFVCLFIIILMKISKCSYL

SEQ ID NO: 2393389 - protein, 17 aa, Entamoeba dispar
FHFKFPSLFTVLYSFIK

SEQ ID NO: 2393390 - protein, 17 aa, Entamoeba dispar
FIAVLIMIVLIFLFYTL

SEQ ID NO: 2393391 - protein, 19 aa, Entamoeba dispar
FIFLYYLICFFFKSFDIII

SEQ ID NO: 2393392 - protein, 18 aa, Entamoeba dispar
FIFNCIFALFLISQLVLL

SEQ ID NO: 2393393 - protein, 17 aa, Entamoeba dispar
FIFQVVCSILWMMDDMP

SEQ ID NO: 2393394 - protein, 17 aa, Entamoeba dispar
FIGCLIIYIPIPENSIN

SEQ ID NO: 2393395 - protein, 18 aa, Entamoeba dispar
FIICCIVAYKFCDKTESS

SEQ ID NO: 2393396 - protein, 23 aa, Entamoeba dispar
FIIFKFIIKNGIAWQVEFGGCIG

SEQ ID NO: 2393397 - protein, 18 aa, Entamoeba dispar
FIIPLAFGYAVWRPMTLL

SEQ ID NO: 2393398 - protein, 19 aa, Entamoeba dispar
FIKDFIKSFILETILNLVI

SEQ ID NO: 2393399 - protein, 18 aa, Entamoeba dispar
FIKFLIFFQPHFNIKQQK

SEQ ID NO: 2393400 - protein, 19 aa, Entamoeba dispar
FIKLPQWISFLLQDDSYKN

SEQ ID NO: 2393401 - protein, 17 aa, Entamoeba dispar
FIKNDYCTYSFLTYSSF

SEQ ID NO: 2393402 - protein, 18 aa, Entamoeba dispar
FILCCIACFGVFIFQPTF

SEQ ID NO: 2393403 - protein, 25 aa, Entamoeba dispar
FILCCVLCFLGLLCFSCIPCCLDGL

SEQ ID NO: 2393404 - protein, 19 aa, Entamoeba dispar
FILKRGIRINDHFLTLLQL

SEQ ID NO: 2393405 - protein, 19 aa, Entamoeba dispar
FILLFCLFTCYKRIKRMLM

SEQ ID NO: 2393406 - protein, 23 aa, Entamoeba dispar
FILPYCFFSFIIILVETIILWSV

SEQ ID NO: 2393407 - protein, 17 aa, Entamoeba dispar
FINKRLVEIISRGMNCE

SEQ ID NO: 2393408 - protein, 20 aa, Entamoeba dispar
FIPFGIKWILSFSICGSSVA

SEQ ID NO: 2393409 - protein, 23 aa, Entamoeba dispar
FIQHEVYKVYSLVLVHQQSLSKF

SEQ ID NO: 2393410 - protein, 18 aa, Entamoeba dispar
FIQKEILGSFVLPSMKSF

SEQ ID NO: 2393411 - protein, 18 aa, Entamoeba dispar
FIRFPFKLKIKILLDTAR

SEQ ID NO: 2393412 - protein, 17 aa, Entamoeba dispar
FISRLVLPLTRLLQNEI

SEQ ID NO: 2393413 - protein, 17 aa, Entamoeba dispar
FITALTLAARVEESRQK

SEQ ID NO: 2393414 - protein, 20 aa, Entamoeba dispar
FKDFWGHVCIVWNKCYYFFS

SEQ ID NO: 2393415 - protein, 20 aa, Entamoeba dispar
FKEKMMWTGITLLVFLVCSQ

SEQ ID NO: 2393416 - protein, 21 aa, Entamoeba dispar
FKELMNIIGINPVFICYMETM

SEQ ID NO: 2393417 - protein, 20 aa, Entamoeba dispar
FKERAQICVYHCINEIYNKL

SEQ ID NO: 2393418 - protein, 19 aa, Entamoeba dispar
FKFNKCVIFKFNNNENHYM

SEQ ID NO: 2393419 - protein, 17 aa, Entamoeba dispar
FKFPSLFTVLYSFIKEF

SEQ ID NO: 2393420 - protein, 19 aa, Entamoeba dispar
FKFPWKIAEFISTGKRPPI

SEQ ID NO: 2393421 - protein, 22 aa, Entamoeba dispar
FKHLTKLILFYGRNGKYQISTL

SEQ ID NO: 2393422 - protein, 17 aa, Entamoeba dispar
FKKRFVKYFNNITENER

SEQ ID NO: 2393423 - protein, 19 aa, Entamoeba dispar
FKNQLAFQHCLLIGVLNQF

SEQ ID NO: 2393424 - protein, 17 aa, Entamoeba dispar
FKNSFRWKSIKNETQIT

SEQ ID NO: 2393425 - protein, 23 aa, Entamoeba dispar
FKRRYSVPCSNSFGYVCPNNLPK

SEQ ID NO: 2393426 - protein, 22 aa, Entamoeba dispar
FKSEHVFLILQLCGSIIFYHSS

SEQ ID NO: 2393427 - protein, 20 aa, Entamoeba dispar
FKYIHKLRFVIVIFWILAVI

SEQ ID NO: 2393428 - protein, 17 aa, Entamoeba dispar
FLCFAVYFFALIGVITV

SEQ ID NO: 2393429 - protein, 25 aa, Entamoeba dispar
FLDIRWRYKLILSFCSSMLIVIIYP

SEQ ID NO: 2393430 - protein, 17 aa, Entamoeba dispar
FLFDLALEFGFFFDSKL

SEQ ID NO: 2393431 - protein, 18 aa, Entamoeba dispar
FLHIFPLNIIFACYNGYL

SEQ ID NO: 2393432 - protein, 18 aa, Entamoeba dispar
FLHKSSIYNIQFNGCNGI

SEQ ID NO: 2393433 - protein, 18 aa, Entamoeba dispar
FLIDVCIEMGYLFKSKYS

SEQ ID NO: 2393434 - protein, 18 aa, Entamoeba dispar
FLILLKFLIVKEIIEECK

SEQ ID NO: 2393435 - protein, 20 aa, Entamoeba dispar
FLKTRFCQDIARGMEYLHEN

SEQ ID NO: 2393436 - protein, 20 aa, Entamoeba dispar
FLKVRFCQDIARGMEYLHQN

SEQ ID NO: 2393437 - protein, 18 aa, Entamoeba dispar
FLLEFFYLDALFLCLFWF

SEQ ID NO: 2393438 - protein, 17 aa, Entamoeba dispar
FLLMLIPAFCDFLATYL

SEQ ID NO: 2393439 - protein, 18 aa, Entamoeba dispar
FLLTYSFWMYRRCGDLSS

SEQ ID NO: 2393440 - protein, 23 aa, Entamoeba dispar
FLMILLLRLSPLFPFPISNYVLG

SEQ ID NO: 2393441 - protein, 17 aa, Entamoeba dispar
FLMYCIWTIYVLYDHVY

SEQ ID NO: 2393442 - protein, 23 aa, Entamoeba dispar
FLMYYQRLSFINAFNKVQGLYPL

SEQ ID NO: 2393443 - protein, 22 aa, Entamoeba dispar
FLNDEFRYIFVYGTGGQETLSV

SEQ ID NO: 2393444 - protein, 21 aa, Entamoeba dispar
FLRMYFPTVLNWMIGGVVGQN

SEQ ID NO: 2393445 - protein, 17 aa, Entamoeba dispar
FLSCLICAGHIEKEKLW

SEQ ID NO: 2393446 - protein, 21 aa, Entamoeba dispar
FLYHCCEVLYAWSCIDVFVVS

SEQ ID NO: 2393447 - protein, 17 aa, Entamoeba dispar
FLYIVGVLAEIYISIGL

SEQ ID NO: 2393448 - protein, 19 aa, Entamoeba dispar
FMCCCGLLFDFGVYFYWLV

SEQ ID NO: 2393449 - protein, 17 aa, Entamoeba dispar
FMCSLNFNCINYKMLQD

SEQ ID NO: 2393450 - protein, 23 aa, Entamoeba dispar
FMLCFSLPCIFHYLSRRKVIAKF

SEQ ID NO: 2393451 - protein, 22 aa, Entamoeba dispar
FMRSMLYLWRLGKVAEVIEKYL

SEQ ID NO: 2393452 - protein, 18 aa, Entamoeba dispar
FNAHRRFTTKKGDSIDLP

SEQ ID NO: 2393453 - protein, 17 aa, Entamoeba dispar
FNAVVQWEHASDILYSL

SEQ ID NO: 2393454 - protein, 25 aa, Entamoeba dispar
FNEEVRPSLKWYFMIFFGPNVETMT

SEQ ID NO: 2393455 - protein, 25 aa, Entamoeba dispar
FNEILKFLICLVMLKFVHKKENLLQ

SEQ ID NO: 2393456 - protein, 19 aa, Entamoeba dispar
FNLDCSRLPPPCPYTGIDW

SEQ ID NO: 2393457 - protein, 18 aa, Entamoeba dispar
FNQPEIWTTTELTNGCPC

SEQ ID NO: 2393458 - protein, 18 aa, Entamoeba dispar
FNVFPISLLMNFRPKAPK

SEQ ID NO: 2393459 - protein, 24 aa, Entamoeba dispar
FPIADFWRHVCIVWTKCYCYFPTE

SEQ ID NO: 2393460 - protein, 21 aa, Entamoeba dispar
FPIDFKPLFIFDIESIKPTKE

SEQ ID NO: 2393461 - protein, 25 aa, Entamoeba dispar
FPIKDFWKHVCIVWTKCYCHFSKKK

SEQ ID NO: 2393462 - protein, 22 aa, Entamoeba dispar
FPKHIIPFVFSWPSCSNPFLYC

SEQ ID NO: 2393463 - protein, 20 aa, Entamoeba dispar
FPLCICWSTIPILSWLVPCL

SEQ ID NO: 2393464 - protein, 19 aa, Entamoeba dispar
FPLLSSILLCFSLIDIFDI

SEQ ID NO: 2393465 - protein, 19 aa, Entamoeba dispar
FPMYMIAVIVIFFLVLVVV

SEQ ID NO: 2393466 - protein, 17 aa, Entamoeba dispar
FPPFLICSLVYMRKYRK

SEQ ID NO: 2393467 - protein, 17 aa, Entamoeba dispar
FPPLEFAKQITLFTSEL

SEQ ID NO: 2393468 - protein, 17 aa, Entamoeba dispar
FPSLFTVLYSFIKEFYS

SEQ ID NO: 2393469 - protein, 22 aa, Entamoeba dispar
FPSSHAQFWCCFLVLFCYYTNQ

SEQ ID NO: 2393470 - protein, 23 aa, Entamoeba dispar
FPSTYKWACLNSILILSTQTFND

SEQ ID NO: 2393471 - protein, 22 aa, Entamoeba dispar
FPTHLKMVFKYIFSLEITSELE

SEQ ID NO: 2393472 - protein, 17 aa, Entamoeba dispar
FPYPLSYIPLMKEVTIN

SEQ ID NO: 2393473 - protein, 18 aa, Entamoeba dispar
FQKKFCIFPSVSKEITIF

SEQ ID NO: 2393474 - protein, 18 aa, Entamoeba dispar
FQLILGIISLCWLGWNQL

SEQ ID NO: 2393475 - protein, 17 aa, Entamoeba dispar
FQLIPWLGICVKSVSLN

SEQ ID NO: 2393476 - protein, 18 aa, Entamoeba dispar
FQSFLYHCCEVLYAWSCI

SEQ ID NO: 2393477 - protein, 17 aa, Entamoeba dispar
FQSLKMKIFFQIHQHAP

SEQ ID NO: 2393478 - protein, 19 aa, Entamoeba dispar
FREYICLVDKFSLNLLYPS

SEQ ID NO: 2393479 - protein, 19 aa, Entamoeba dispar
FRIIETMSFYIVTLLVASG

SEQ ID NO: 2393480 - protein, 17 aa, Entamoeba dispar
FRIKGLIPCNKWCVKYS

SEQ ID NO: 2393481 - protein, 18 aa, Entamoeba dispar
FRKVICFIVSCILFIYPA

SEQ ID NO: 2393482 - protein, 17 aa, Entamoeba dispar
FRMNFKGDYSILLDSTT

SEQ ID NO: 2393483 - protein, 21 aa, Entamoeba dispar
FRPREFFNITVLLRLSKALDI

SEQ ID NO: 2393484 - protein, 24 aa, Entamoeba dispar
FRVLDRIYFIIGIIICALILKYFI

SEQ ID NO: 2393485 - protein, 20 aa, Entamoeba dispar
FRYSHELEIWYTFSQKLIKI

SEQ ID NO: 2393486 - protein, 20 aa, Entamoeba dispar
FSCCVGMKCILSFSRKKTKN

SEQ ID NO: 2393487 - protein, 18 aa, Entamoeba dispar
FSELRPIIILKPVSIDEN

SEQ ID NO: 2393488 - protein, 24 aa, Entamoeba dispar
FSFIPLKISHDFTVEGFLSIQYSL

SEQ ID NO: 2393489 - protein, 17 aa, Entamoeba dispar
FSGKLWPTGAMDFFTMA

SEQ ID NO: 2393490 - protein, 20 aa, Entamoeba dispar
FSLLCFTGLYIPSSDGLVSW

SEQ ID NO: 2393491 - protein, 21 aa, Entamoeba dispar
FSMMVVCMFVTLSLSKIRVYL

SEQ ID NO: 2393492 - protein, 23 aa, Entamoeba dispar
FSSFCSFSSFFFFGNSHINPFLL

SEQ ID NO: 2393493 - protein, 19 aa, Entamoeba dispar
FSSRFWPYFSNVTLFSIFV

SEQ ID NO: 2393494 - protein, 24 aa, Entamoeba dispar
FSSRLSEWPTYCVLLKDNKNVEAH

SEQ ID NO: 2393495 - protein, 21 aa, Entamoeba dispar
FSTEILNCIGILFNSLQDIDV

SEQ ID NO: 2393496 - protein, 19 aa, Entamoeba dispar
FSVCFFKMLYFFITAPLGV

SEQ ID NO: 2393497 - protein, 17 aa, Entamoeba dispar
FSVWFLFEILFLSQTLS

SEQ ID NO: 2393498 - protein, 18 aa, Entamoeba dispar
FSYITFIFLFLCFIAYIL

SEQ ID NO: 2393499 - protein, 22 aa, Entamoeba dispar
FTCLTWVINIFMFRDSTNDNTK

SEQ ID NO: 2393500 - protein, 22 aa, Entamoeba dispar
FTFSLTCFAYFLATLINKTRIA

SEQ ID NO: 2393501 - protein, 24 aa, Entamoeba dispar
FTIFGGTCAFLFTKYVSPTANGSG

SEQ ID NO: 2393502 - protein, 18 aa, Entamoeba dispar
FTIPRWFSVGIVFIVFTF

SEQ ID NO: 2393503 - protein, 17 aa, Entamoeba dispar
FTQKLSRCFSLKPFKSP

SEQ ID NO: 2393504 - protein, 20 aa, Entamoeba dispar
FTSDCKIIFQTADMFTLADI

SEQ ID NO: 2393505 - protein, 23 aa, Entamoeba dispar
FTVTELFWRIAFVCVGSIQLMTF

SEQ ID NO: 2393506 - protein, 20 aa, Entamoeba dispar
FVARCGWGMVGLFEIILDSI

SEQ ID NO: 2393507 - protein, 18 aa, Entamoeba dispar
FVCKEYGKSMVMVTVGNK

SEQ ID NO: 2393508 - protein, 23 aa, Entamoeba dispar
FVFSWEFWWKLVVIILLTSIPFI

SEQ ID NO: 2393509 - protein, 19 aa, Entamoeba dispar
FVHRKDRRLGFFGEIIHNI

SEQ ID NO: 2393510 - protein, 17 aa, Entamoeba dispar
FVKEWKLCFVMISVAPF

SEQ ID NO: 2393511 - protein, 19 aa, Entamoeba dispar
FVLRMMYRLIYFGMKQTSV

SEQ ID NO: 2393512 - protein, 20 aa, Entamoeba dispar
FVVQCLYRFVTHSTSLDIKQ

SEQ ID NO: 2393513 - protein, 19 aa, Entamoeba dispar
FVYEIRTILDWTFAKTSMF

SEQ ID NO: 2393514 - protein, 19 aa, Entamoeba dispar
FVYFLKFGIAIGIHLSILI

SEQ ID NO: 2393515 - protein, 17 aa, Entamoeba dispar
FWCCFLVLFCYYTNQQS

SEQ ID NO: 2393516 - protein, 24 aa, Entamoeba dispar
FYFSLRLLFVFALVFEISFIYTII

SEQ ID NO: 2393517 - protein, 23 aa, Entamoeba dispar
FYHFLKRYLKVISPLIVSSYVID

SEQ ID NO: 2393518 - protein, 19 aa, Entamoeba dispar
FYIPLFISEALCFLFLIIF

SEQ ID NO: 2393519 - protein, 17 aa, Entamoeba dispar
FYLEMVSTILNEWRHSV

SEQ ID NO: 2393520 - protein, 17 aa, Entamoeba dispar
FYNLASIERCRIKDPLH

SEQ ID NO: 2393521 - protein, 17 aa, Entamoeba dispar
FYPEFEISDSKPFIFAP

SEQ ID NO: 2393522 - protein, 19 aa, Entamoeba dispar
FYSCISWSIHCCIMAFEKA

SEQ ID NO: 2393523 - protein, 19 aa, Entamoeba dispar
GAFGVVFKGEFRGNKVAVK

SEQ ID NO: 2393524 - protein, 18 aa, Entamoeba dispar
GASNKWKGISVIFDTFQN

SEQ ID NO: 2393525 - protein, 20 aa, Entamoeba dispar
GCAPFCGVCAFGYSCNQAAK

SEQ ID NO: 2393526 - protein, 23 aa, Entamoeba dispar
GCELNCSCAFGWKRDYKGGCVPS

SEQ ID NO: 2393527 - protein, 19 aa, Entamoeba dispar
GCILSYCFILLLNRYTKLC

SEQ ID NO: 2393528 - protein, 18 aa, Entamoeba dispar
GCSCWCNILATKLSSKSS

SEQ ID NO: 2393529 - protein, 17 aa, Entamoeba dispar
GCYLCFIFTRTFAKGYF

SEQ ID NO: 2393530 - protein, 17 aa, Entamoeba dispar
GDFSYARLRAHILSDPE

SEQ ID NO: 2393531 - protein, 17 aa, Entamoeba dispar
GDICYKCPLGYYNINGI

SEQ ID NO: 2393532 - protein, 17 aa, Entamoeba dispar
GDIKLVILNSGTCKIPR

SEQ ID NO: 2393533 - protein, 25 aa, Entamoeba dispar
GDKGEWSTKCVLAYCDEGYKFDYNS

SEQ ID NO: 2393534 - protein, 26 aa, Entamoeba dispar
GDKGEWSTKCVLAYCDSGYKFDYNSN

SEQ ID NO: 2393535 - protein, 26 aa, Entamoeba dispar
GDKGEWSTKCVLSYCDSGYKFDYNNN

SEQ ID NO: 2393536 - protein, 22 aa, Entamoeba dispar
GDNGSICIIEFLKELRGIALNR

SEQ ID NO: 2393537 - protein, 19 aa, Entamoeba dispar
GDSDMKLYLLVGGKVKDKV

SEQ ID NO: 2393538 - protein, 18 aa, Entamoeba dispar
GEALQHCLDCFPRSFFLF

SEQ ID NO: 2393539 - protein, 22 aa, Entamoeba dispar
GEGMYRISIDFYVRRFESTCEE

SEQ ID NO: 2393540 - protein, 17 aa, Entamoeba dispar
GELFIGFSHLYYIIAKD

SEQ ID NO: 2393541 - protein, 17 aa, Entamoeba dispar
GELPKDITGLCALQHRK

SEQ ID NO: 2393542 - protein, 23 aa, Entamoeba dispar
GEQCKKCGCSICDKKQGCSIGCD

SEQ ID NO: 2393543 - protein, 18 aa, Entamoeba dispar
GESLFVFATTILREGSGN

SEQ ID NO: 2393544 - protein, 21 aa, Entamoeba dispar
GETAIKCSWIITNENTGSEFV

SEQ ID NO: 2393545 - protein, 20 aa, Entamoeba dispar
GFFLPCIWIYNIIKYKNSGD

SEQ ID NO: 2393546 - protein, 23 aa, Entamoeba dispar
GFGMEILPLLKFIGSSQTYAEFL

SEQ ID NO: 2393547 - protein, 18 aa, Entamoeba dispar
GFKGGFILKNSWNDTIYG

SEQ ID NO: 2393548 - protein, 18 aa, Entamoeba dispar
GFLTCLYKTITIGTTDNW

SEQ ID NO: 2393549 - protein, 19 aa, Entamoeba dispar
GFLVLLARVGVRVFELILS

SEQ ID NO: 2393550 - protein, 18 aa, Entamoeba dispar
GFLWDISYDYSFDNYDYY

SEQ ID NO: 2393551 - protein, 24 aa, Entamoeba dispar
GFVFCCLWPINACLYRHSTNKQIQ

SEQ ID NO: 2393552 - protein, 20 aa, Entamoeba dispar
GFVPNCVTLFPSLMTSEDEF

SEQ ID NO: 2393553 - protein, 19 aa, Entamoeba dispar
GHNGMFCAIDNSFGICSSN

SEQ ID NO: 2393554 - protein, 18 aa, Entamoeba dispar
GICFPPFLICSLVYMRKY

SEQ ID NO: 2393555 - protein, 17 aa, Entamoeba dispar
GIFFQWVMCVGILLVGI

SEQ ID NO: 2393556 - protein, 25 aa, Entamoeba dispar
GILSLTICICFSWRGYNDIIESNMA

SEQ ID NO: 2393557 - protein, 24 aa, Entamoeba dispar
GIPPEVWRYYLLINRPEQSDTVFL

SEQ ID NO: 2393558 - protein, 18 aa, Entamoeba dispar
GISFKRKYPTVILNILVD

SEQ ID NO: 2393559 - protein, 20 aa, Entamoeba dispar
GITRCKYCLLGTYQNLKGQK

SEQ ID NO: 2393560 - protein, 19 aa, Entamoeba dispar
GIVYRAEWRKVDVAVKVLK

SEQ ID NO: 2393561 - protein, 20 aa, Entamoeba dispar
GIVYRAKWRKIEIAVKVLKT

SEQ ID NO: 2393562 - protein, 18 aa, Entamoeba dispar
GKASRLTYHFTKPSYIFI

SEQ ID NO: 2393563 - protein, 19 aa, Entamoeba dispar
GKCGDGIWDWFSEECDGTS

SEQ ID NO: 2393564 - protein, 20 aa, Entamoeba dispar
GKGSLCFKAKVTKFGLYGFR

SEQ ID NO: 2393565 - protein, 19 aa, Entamoeba dispar
GKIFWNFPRACLTGFLFNF

SEQ ID NO: 2393566 - protein, 19 aa, Entamoeba dispar
GKKRLWELLFVFLVGFFRC

SEQ ID NO: 2393567 - protein, 19 aa, Entamoeba dispar
GKLKVGMEVVSSRHDGFDI

SEQ ID NO: 2393568 - protein, 18 aa, Entamoeba dispar
GKVPGNCPFCSNPITLDS

SEQ ID NO: 2393569 - protein, 25 aa, Entamoeba dispar
GKVSIKELFRYAGVFEITLLIIGII

SEQ ID NO: 2393570 - protein, 22 aa, Entamoeba dispar
GLICVTCLFLIGSFVTFSFGVP

SEQ ID NO: 2393571 - protein, 22 aa, Entamoeba dispar
GLKEWGGAILVRFDGDPYGEDD

SEQ ID NO: 2393572 - protein, 21 aa, Entamoeba dispar
GLKWRPLFFYCRFLVTKIIVP

SEQ ID NO: 2393573 - protein, 17 aa, Entamoeba dispar
GLQCISCTIVTPNCQIC

SEQ ID NO: 2393574 - protein, 23 aa, Entamoeba dispar
GLRALCAFLFYCLLTLVGFLILF

SEQ ID NO: 2393575 - protein, 18 aa, Entamoeba dispar
GLRTLFIAKRVFTLEEII

SEQ ID NO: 2393576 - protein, 22 aa, Entamoeba dispar
GLSRLLSCKEFEQWLNEYQENF

SEQ ID NO: 2393577 - protein, 17 aa, Entamoeba dispar
GLVSWIYYHHKLHNPYF

SEQ ID NO: 2393578 - protein, 22 aa, Entamoeba dispar
GMCCSELKEFCAIINEHEELIK

SEQ ID NO: 2393579 - protein, 23 aa, Entamoeba dispar
GMFKCGMCVPVVEGQETIYAKYE

SEQ ID NO: 2393580 - protein, 18 aa, Entamoeba dispar
GMRRRLSIAIAMTGNPKV

SEQ ID NO: 2393581 - protein, 17 aa, Entamoeba dispar
GMTCKKCRYGFNSDGSC

SEQ ID NO: 2393582 - protein, 19 aa, Entamoeba dispar
GNITGCIKMAELFINRGVK

SEQ ID NO: 2393583 - protein, 24 aa, Entamoeba dispar
GNYMKRVWESLVLVIFIRPFDIGD

SEQ ID NO: 2393584 - protein, 18 aa, Entamoeba dispar
GRNELKEKLIIESNSNTI

SEQ ID NO: 2393585 - protein, 23 aa, Entamoeba dispar
GSIQRGGAVSVYFDNYLVSTKDR

SEQ ID NO: 2393586 - protein, 18 aa, Entamoeba dispar
GSKCLVCNNGLFLTEEGE

SEQ ID NO: 2393587 - protein, 19 aa, Entamoeba dispar
GSMICCFDALLKCNAEYFF

SEQ ID NO: 2393588 - protein, 24 aa, Entamoeba dispar
GSPIKAALCALAYYYMALSWGAYV

SEQ ID NO: 2393589 - protein, 25 aa, Entamoeba dispar
GSPTRLCYWLSTILRLYAMIHLARF

SEQ ID NO: 2393590 - protein, 17 aa, Entamoeba dispar
GSYWIKIDLSSIKSTGS

SEQ ID NO: 2393591 - protein, 22 aa, Entamoeba dispar
GTFGVVFKGEWRKIDVAVKCVK

SEQ ID NO: 2393592 - protein, 21 aa, Entamoeba dispar
GVMLYFRFAPFIKENEIVASF

SEQ ID NO: 2393593 - protein, 18 aa, Entamoeba dispar
GVMQLPIPVSYVVDALMY

SEQ ID NO: 2393594 - protein, 19 aa, Entamoeba dispar
GVSSYKCGTYYRIGTVNTC

SEQ ID NO: 2393595 - protein, 19 aa, Entamoeba dispar
GVVVSCCLFCKRLIEQKKY

SEQ ID NO: 2393596 - protein, 19 aa, Entamoeba dispar
GVYSFCFDNTMSLYTSKLV

SEQ ID NO: 2393597 - protein, 18 aa, Entamoeba dispar
GWCSCIPQTVLLLQRYGY

SEQ ID NO: 2393598 - protein, 18 aa, Entamoeba dispar
GWNKYCGKLDTKFETDGD

SEQ ID NO: 2393599 - protein, 19 aa, Entamoeba dispar
GWVYFTFVMVFFFISSFLL

SEQ ID NO: 2393600 - protein, 24 aa, Entamoeba dispar
GYFGYPVCMPHIFGKMIDLEYEFN

SEQ ID NO: 2393601 - protein, 18 aa, Entamoeba dispar
GYIICLIMYLRLTKKIKQ

SEQ ID NO: 2393602 - protein, 18 aa, Entamoeba dispar
GYKRVLLCSVKVMILSII

SEQ ID NO: 2393603 - protein, 24 aa, Entamoeba dispar
GYSLRLSFLESFRYNYAYKEKIPR

SEQ ID NO: 2393604 - protein, 33 aa, Entamoeba dispar
HADMLWKLVDTFFTFPVTYPFSVTCAYLRSLQQ

SEQ ID NO: 2393605 - protein, 17 aa, Entamoeba dispar
HAFCYQCIKEWLVRVPN

SEQ ID NO: 2393606 - protein, 18 aa, Entamoeba dispar
HAFIFWKYYVLMYVAGQE

SEQ ID NO: 2393607 - protein, 17 aa, Entamoeba dispar
HATFPCLRDQIKSLFIK

SEQ ID NO: 2393608 - protein, 18 aa, Entamoeba dispar
HCLDCFPRSFFLFCDVSK

SEQ ID NO: 2393609 - protein, 17 aa, Entamoeba dispar
HCLWIIFIGCSGILVFS

SEQ ID NO: 2393610 - protein, 17 aa, Entamoeba dispar
HCMPRLKSLLFENEEIE

SEQ ID NO: 2393611 - protein, 17 aa, Entamoeba dispar
HCYRNGWEYSNKFGDNK

SEQ ID NO: 2393612 - protein, 17 aa, Entamoeba dispar
HFKIPFELQIAVGFFVF

SEQ ID NO: 2393613 - protein, 19 aa, Entamoeba dispar
HFPTLLCWDEFDQKLKPME

SEQ ID NO: 2393614 - protein, 20 aa, Entamoeba dispar
HGVIIGCLFFDYSKSKKALR

SEQ ID NO: 2393615 - protein, 21 aa, Entamoeba dispar
HHCPWLGTCVGFKNHKFFILF

SEQ ID NO: 2393616 - protein, 17 aa, Entamoeba dispar
HHRRPQDSWGYFEIFIK

SEQ ID NO: 2393617 - protein, 17 aa, Entamoeba dispar
HIMIWRQGGALLIPGSV

SEQ ID NO: 2393618 - protein, 21 aa, Entamoeba dispar
HKRIIRELCCYVSPSLDNQKK

SEQ ID NO: 2393619 - protein, 18 aa, Entamoeba dispar
HLHLFKGDIPFVVVQQTK

SEQ ID NO: 2393620 - protein, 17 aa, Entamoeba dispar
HLICNGFEIKCSVKITE

SEQ ID NO: 2393621 - protein, 22 aa, Entamoeba dispar
HPCGNFSSYGYSYLMVRGGGDV

SEQ ID NO: 2393622 - protein, 24 aa, Entamoeba dispar
HPSLFLVIFKLEWKMFLLCYITIV

SEQ ID NO: 2393623 - protein, 17 aa, Entamoeba dispar
HQIRSGFVVAINNKTLK

SEQ ID NO: 2393624 - protein, 28 aa, Entamoeba dispar
HQMKKAMCWRKWKLWIIIGVIAAIIIAV

SEQ ID NO: 2393625 - protein, 18 aa, Entamoeba dispar
HSFKPLFVLISFSIFGDN

SEQ ID NO: 2393626 - protein, 17 aa, Entamoeba dispar
HSNRFVLFRVIWNNYRH

SEQ ID NO: 2393627 - protein, 18 aa, Entamoeba dispar
HSSIPIQFTLSFPSSDYS

SEQ ID NO: 2393628 - protein, 20 aa, Entamoeba dispar
HSYKSWSLILLWCSLILFEF

SEQ ID NO: 2393629 - protein, 18 aa, Entamoeba dispar
HTIKVCTCFMTLHCTTKI

SEQ ID NO: 2393630 - protein, 18 aa, Entamoeba dispar
HVIFWSIFEGIVFLLWII

SEQ ID NO: 2393631 - protein, 19 aa, Entamoeba dispar
HVSCLKEWLSGASDCPICR

SEQ ID NO: 2393632 - protein, 18 aa, Entamoeba dispar
HVVPICFNWPVGKHSLYG

SEQ ID NO: 2393633 - protein, 17 aa, Entamoeba dispar
HWSLSQFFLWITVFVLI

SEQ ID NO: 2393634 - protein, 19 aa, Entamoeba dispar
HYANLFLRFIRRLLTSRGN

SEQ ID NO: 2393635 - protein, 22 aa, Entamoeba dispar
HYKQHFEIIKTIILLPQQLSEI

SEQ ID NO: 2393636 - protein, 26 aa, Entamoeba dispar
IAEKHFPRLFSWRSFHSYIKELSIDE

SEQ ID NO: 2393637 - protein, 23 aa, Entamoeba dispar
IAESCLRLPLPADKLVSLMFISL

SEQ ID NO: 2393638 - protein, 22 aa, Entamoeba dispar
IAIKLKGSFGYKNKMVLNDINL

SEQ ID NO: 2393639 - protein, 25 aa, Entamoeba dispar
IAISFIFGSCLIRFFGLYLATLLLF

SEQ ID NO: 2393640 - protein, 17 aa, Entamoeba dispar
IAPCIFHLLSIRLFQKC

SEQ ID NO: 2393641 - protein, 17 aa, Entamoeba dispar
IATDFGFIFITSKMKNK

SEQ ID NO: 2393642 - protein, 17 aa, Entamoeba dispar
IAYELPIKLPYHYPLWK

SEQ ID NO: 2393643 - protein, 17 aa, Entamoeba dispar
ICAIVLIVIVGIILLLT

SEQ ID NO: 2393644 - protein, 19 aa, Entamoeba dispar
ICALSEAFILYIQAMGGIF

SEQ ID NO: 2393645 - protein, 18 aa, Entamoeba dispar
ICAWCIEVNETIHFPVEC

SEQ ID NO: 2393646 - protein, 18 aa, Entamoeba dispar
ICFNWPVGKHSLYGNKKA

SEQ ID NO: 2393647 - protein, 17 aa, Entamoeba dispar
ICLELGYFFTLKKSRKM

SEQ ID NO: 2393648 - protein, 19 aa, Entamoeba dispar
ICLIMYLRLTKKIKQEIED

SEQ ID NO: 2393649 - protein, 17 aa, Entamoeba dispar
ICLYLIIGAVVNVLLFK

SEQ ID NO: 2393650 - protein, 25 aa, Entamoeba dispar
ICYGCFLCGLIPIFISPRVSIVEIN

SEQ ID NO: 2393651 - protein, 21 aa, Entamoeba dispar
IDDMILRIGGIIPFCSLLHFG

SEQ ID NO: 2393652 - protein, 17 aa, Entamoeba dispar
IDFCFLIATGVCFLPIV

SEQ ID NO: 2393653 - protein, 18 aa, Entamoeba dispar
IDRLEIWTPTLPVSVPTS

SEQ ID NO: 2393654 - protein, 20 aa, Entamoeba dispar
IDTLKFFYYYILRQIKTLYN

SEQ ID NO: 2393655 - protein, 18 aa, Entamoeba dispar
IDTLKILIGLAIILLCCG

SEQ ID NO: 2393656 - protein, 18 aa, Entamoeba dispar
IDVPRLATKIIIKKSNKI

SEQ ID NO: 2393657 - protein, 18 aa, Entamoeba dispar
IDWLIVMIDFYFERQRSV

SEQ ID NO: 2393658 - protein, 17 aa, Entamoeba dispar
IDWVILICRALMTIVVC

SEQ ID NO: 2393659 - protein, 18 aa, Entamoeba dispar
IECLYNFFDGYHDLRSVE

SEQ ID NO: 2393660 - protein, 18 aa, Entamoeba dispar
IEGTFTFKKPVKLINIHS

SEQ ID NO: 2393661 - protein, 17 aa, Entamoeba dispar
IELFIPLQIQRRVGEIG

SEQ ID NO: 2393662 - protein, 19 aa, Entamoeba dispar
IELKLRFCHDIASGMDYLH

SEQ ID NO: 2393663 - protein, 19 aa, Entamoeba dispar
IELPKPILATWQFYAVLFT

SEQ ID NO: 2393664 - protein, 18 aa, Entamoeba dispar
IEQPRCVLTWGQLPITSH

SEQ ID NO: 2393665 - protein, 17 aa, Entamoeba dispar
IEQRWLRFITIIIYILL

SEQ ID NO: 2393666 - protein, 19 aa, Entamoeba dispar
IETFFKFLCCTQIRDHPLE

SEQ ID NO: 2393667 - protein, 17 aa, Entamoeba dispar
IEVIHLFTGKPLLHVTL

SEQ ID NO: 2393668 - protein, 19 aa, Entamoeba dispar
IFCGYRLSEVITCPPDVLG

SEQ ID NO: 2393669 - protein, 20 aa, Entamoeba dispar
IFDCPKGFFDKSSWLLSLPE

SEQ ID NO: 2393670 - protein, 25 aa, Entamoeba dispar
IFGFHWKTSFPLIFFFTLVFMSFTI

SEQ ID NO: 2393671 - protein, 20 aa, Entamoeba dispar
IFGLLSLFYPFSWPGIFIPY

SEQ ID NO: 2393672 - protein, 17 aa, Entamoeba dispar
IFGYPLDFVCVIVGLMA

SEQ ID NO: 2393673 - protein, 17 aa, Entamoeba dispar
IFISFLFDGIRSQSISQ

SEQ ID NO: 2393674 - protein, 17 aa, Entamoeba dispar
IFIVLPSFYIFKIITFV

SEQ ID NO: 2393675 - protein, 17 aa, Entamoeba dispar
IFLILSIPFRFIMEFTT

SEQ ID NO: 2393676 - protein, 17 aa, Entamoeba dispar
IFNFLFKYIHKLRFVIV

SEQ ID NO: 2393677 - protein, 19 aa, Entamoeba dispar
IFPSWGIALIIILSILVMI

SEQ ID NO: 2393678 - protein, 20 aa, Entamoeba dispar
IFRFIFKSEVPWIQKLGGCL

SEQ ID NO: 2393679 - protein, 17 aa, Entamoeba dispar
IFSPIPWNCMKYEVKSS

SEQ ID NO: 2393680 - protein, 27 aa, Entamoeba dispar
IFTLLGCCYCGLIACCMKNLKDAVHFC

SEQ ID NO: 2393681 - protein, 17 aa, Entamoeba dispar
IGCAIVLTTICSIFIFG

SEQ ID NO: 2393682 - protein, 18 aa, Entamoeba dispar
IGCVPCIQNTWSSEGADE

SEQ ID NO: 2393683 - protein, 20 aa, Entamoeba dispar
IGINYEFVKNILIRNGDNLK

SEQ ID NO: 2393684 - protein, 21 aa, Entamoeba dispar
IGLMKGCARGVYYLHKLGIVH

SEQ ID NO: 2393685 - protein, 30 aa, Entamoeba dispar
IGLYFSWKLSLCILAVFPIISFFMFINGQL

SEQ ID NO: 2393686 - protein, 22 aa, Entamoeba dispar
IGNIALLCFDILLLVFVFWIFT

SEQ ID NO: 2393687 - protein, 18 aa, Entamoeba dispar
IGNLLLHYVNWMTNLCYL

SEQ ID NO: 2393688 - protein, 17 aa, Entamoeba dispar
IGSFWLNCRNLIERISE

SEQ ID NO: 2393689 - protein, 19 aa, Entamoeba dispar
IGSPFGGMVYLRLDATFTN

SEQ ID NO: 2393690 - protein, 17 aa, Entamoeba dispar
IGVIIGVCFQFIPRNNN

SEQ ID NO: 2393691 - protein, 23 aa, Entamoeba dispar
IHPLATPCLFSFNANNYYFSLSI

SEQ ID NO: 2393692 - protein, 19 aa, Entamoeba dispar
IHSSRRWKIDISTCETSTN

SEQ ID NO: 2393693 - protein, 17 aa, Entamoeba dispar
IHYYRFSVIFIIILDIL

SEQ ID NO: 2393694 - protein, 22 aa, Entamoeba dispar
IIDLIELWRCIIKHSLFQLIPW

SEQ ID NO: 2393695 - protein, 18 aa, Entamoeba dispar
IIDLLGKVYFSFELNNSL

SEQ ID NO: 2393696 - protein, 18 aa, Entamoeba dispar
IIFEPRFGLTIIQIAKNT

SEQ ID NO: 2393697 - protein, 22 aa, Entamoeba dispar
IIFGSWCLVNFILGKRGVAVLP

SEQ ID NO: 2393698 - protein, 17 aa, Entamoeba dispar
IIFIISPITLILLILGI

SEQ ID NO: 2393699 - protein, 18 aa, Entamoeba dispar
IIFLICWCLFRILDSMIR

SEQ ID NO: 2393700 - protein, 19 aa, Entamoeba dispar
IIFRLCEWYSIIPEPDKHY

SEQ ID NO: 2393701 - protein, 18 aa, Entamoeba dispar
IIGIFPFDQSILITFIDN

SEQ ID NO: 2393702 - protein, 20 aa, Entamoeba dispar
IIIKTWWRLVIFIINGIMVG

SEQ ID NO: 2393703 - protein, 17 aa, Entamoeba dispar
IIIYLCISFAVKGSTTL

SEQ ID NO: 2393704 - protein, 18 aa, Entamoeba dispar
IIKHSLFQLIPWLGICVK

SEQ ID NO: 2393705 - protein, 18 aa, Entamoeba dispar
IILDVCGFYKIIQFSFLS

SEQ ID NO: 2393706 - protein, 18 aa, Entamoeba dispar
IILSRLCMMLKYMIEHFK

SEQ ID NO: 2393707 - protein, 18 aa, Entamoeba dispar
IIPFYSLWATIFGGFSSM

SEQ ID NO: 2393708 - protein, 19 aa, Entamoeba dispar
IIPIITLILIVIFITHNTF

SEQ ID NO: 2393709 - protein, 30 aa, Entamoeba dispar
IIRDANLFFAEFIRDLAIMWRHDEMAKLVD

SEQ ID NO: 2393710 - protein, 18 aa, Entamoeba dispar
IISISLPIIVIFLFAKKR

SEQ ID NO: 2393711 - protein, 17 aa, Entamoeba dispar
IISLCWLGWNQLIGGIA

SEQ ID NO: 2393712 - protein, 18 aa, Entamoeba dispar
IISSMWLFFRFFKKHKEE

SEQ ID NO: 2393713 - protein, 18 aa, Entamoeba dispar
IITCCLICISLYYLKKPK

SEQ ID NO: 2393714 - protein, 18 aa, Entamoeba dispar
IITQCWDHIPSKRPTFKD

SEQ ID NO: 2393715 - protein, 17 aa, Entamoeba dispar
IIVFKYYLLYSIIISLC

SEQ ID NO: 2393716 - protein, 17 aa, Entamoeba dispar
IIVFSVFYPSLKYPFDG

SEQ ID NO: 2393717 - protein, 26 aa, Entamoeba dispar
IKERRTLWMLWAFWWFVYALVCVMTF

SEQ ID NO: 2393718 - protein, 21 aa, Entamoeba dispar
IKEYISLFSSMNWTIHDSIII

SEQ ID NO: 2393719 - protein, 25 aa, Entamoeba dispar
IKGNIRDTVKWCFYHNTNIKSNTSE

SEQ ID NO: 2393720 - protein, 24 aa, Entamoeba dispar
IKHFRIVAVLLKYWLKIRNLNCPF

SEQ ID NO: 2393721 - protein, 21 aa, Entamoeba dispar
IKKFNLEYCLYYKIIEQKMSI

SEQ ID NO: 2393722 - protein, 24 aa, Entamoeba dispar
IKKVMKIFIHFIIKYMEENIKNKE

SEQ ID NO: 2393723 - protein, 18 aa, Entamoeba dispar
IKLLATISFLCFAVYFFA

SEQ ID NO: 2393724 - protein, 23 aa, Entamoeba dispar
IKMCNRINPTLAMYEAYATHALS

SEQ ID NO: 2393725 - protein, 21 aa, Entamoeba dispar
IKMKRMNGIFALRHCTVTMMN

SEQ ID NO: 2393726 - protein, 17 aa, Entamoeba dispar
IKNHIYISIGFTFVALF

SEQ ID NO: 2393727 - protein, 17 aa, Entamoeba dispar
IKNKISLFLNESSTEKL

SEQ ID NO: 2393728 - protein, 19 aa, Entamoeba dispar
IKPSYEWFLGGLVFILIVC

SEQ ID NO: 2393729 - protein, 20 aa, Entamoeba dispar
IKSWNFFLALGFFVSFLLSL

SEQ ID NO: 2393730 - protein, 21 aa, Entamoeba dispar
IKTPCKKSRWILYDKELEACW

SEQ ID NO: 2393731 - protein, 17 aa, Entamoeba dispar
IKYGGWVYFTFVMVFFF

SEQ ID NO: 2393732 - protein, 17 aa, Entamoeba dispar
IKYPIVYLLHGMDGDCQ

SEQ ID NO: 2393733 - protein, 20 aa, Entamoeba dispar
ILCCCGGLLLLIFIAYITLI

SEQ ID NO: 2393734 - protein, 17 aa, Entamoeba dispar
ILDVNWGLLLGVFAGYG

SEQ ID NO: 2393735 - protein, 17 aa, Entamoeba dispar
ILFEIIELAPFVEFPEN

SEQ ID NO: 2393736 - protein, 18 aa, Entamoeba dispar
ILFFLLLVYYKFEPNQLV

SEQ ID NO: 2393737 - protein, 19 aa, Entamoeba dispar
ILFGFSFNYYFAVAMRFLN

SEQ ID NO: 2393738 - protein, 19 aa, Entamoeba dispar
ILFIPFLVAYIIGKKSKSK

SEQ ID NO: 2393739 - protein, 17 aa, Entamoeba dispar
ILFLRIFLYYCHIDTSD

SEQ ID NO: 2393740 - protein, 17 aa, Entamoeba dispar
ILFPSTTMPLSFEDFEK

SEQ ID NO: 2393741 - protein, 17 aa, Entamoeba dispar
ILFRLLRTWLSKTNNNS

SEQ ID NO: 2393742 - protein, 18 aa, Entamoeba dispar
ILIGLAIILLCCGLIWKS

SEQ ID NO: 2393743 - protein, 17 aa, Entamoeba dispar
ILIIGHIISIIFIFIIY

SEQ ID NO: 2393744 - protein, 17 aa, Entamoeba dispar
ILKMPVDIQIFLTEFID

SEQ ID NO: 2393745 - protein, 17 aa, Entamoeba dispar
ILKRRFNLIQIFSAVIA

SEQ ID NO: 2393746 - protein, 18 aa, Entamoeba dispar
ILLFFGWYIFYGFVGGFK

SEQ ID NO: 2393747 - protein, 22 aa, Entamoeba dispar
ILLICFILKWSVLYISSLLINI

SEQ ID NO: 2393748 - protein, 19 aa, Entamoeba dispar
ILNKFKWNKIKIIIKCFDL

SEQ ID NO: 2393749 - protein, 24 aa, Entamoeba dispar
ILPKLPGIWFYCWGITCTLWFSTF

SEQ ID NO: 2393750 - protein, 19 aa, Entamoeba dispar
ILPMFRWKMYYIADNDNVT

SEQ ID NO: 2393751 - protein, 21 aa, Entamoeba dispar
ILQLFSLNSFDTWIVVIIIIL

SEQ ID NO: 2393752 - protein, 25 aa, Entamoeba dispar
ILRRNAKFIFGNAFYYKSYSSQYTL

SEQ ID NO: 2393753 - protein, 23 aa, Entamoeba dispar
ILSIPFRFIMEFTTPHISDNRKN

SEQ ID NO: 2393754 - protein, 18 aa, Entamoeba dispar
ILYISLLNTWGFSFVFVK

SEQ ID NO: 2393755 - protein, 18 aa, Entamoeba dispar
ILYPLSVYLFLYIMFIYY

SEQ ID NO: 2393756 - protein, 17 aa, Entamoeba dispar
IMHSVCLFETSRIIKAT

SEQ ID NO: 2393757 - protein, 24 aa, Entamoeba dispar
IMKPSFKRLLIKGSIVKTAMAQIL

SEQ ID NO: 2393758 - protein, 17 aa, Entamoeba dispar
IMLNEWYSIYLLHKNDG

SEQ ID NO: 2393759 - protein, 21 aa, Entamoeba dispar
IMNFLKYCRFNGFFNKEDKLS

SEQ ID NO: 2393760 - protein, 17 aa, Entamoeba dispar
IMRRMLLSIYELCPTFS

SEQ ID NO: 2393761 - protein, 17 aa, Entamoeba dispar
IMYKRIIYIQALGQSKL

SEQ ID NO: 2393762 - protein, 22 aa, Entamoeba dispar
INCCYWSLIICEIIEIKRDETI

SEQ ID NO: 2393763 - protein, 25 aa, Entamoeba dispar
INFFKARVALVLGIIFNFFEDSKTS

SEQ ID NO: 2393764 - protein, 19 aa, Entamoeba dispar
INFGCCFLLSWVCGFINNF

SEQ ID NO: 2393765 - protein, 25 aa, Entamoeba dispar
INFKWRLSQYVTWYIIFSLLISMLM

SEQ ID NO: 2393766 - protein, 22 aa, Entamoeba dispar
INKRFSYFFFHWSDLIRTAFFH

SEQ ID NO: 2393767 - protein, 17 aa, Entamoeba dispar
INLEISKIFYSLLINYD

SEQ ID NO: 2393768 - protein, 23 aa, Entamoeba dispar
INNHCSYCSFGGVINGQCSKCEI

SEQ ID NO: 2393769 - protein, 17 aa, Entamoeba dispar
INNLECHKGCILEFISV

SEQ ID NO: 2393770 - protein, 26 aa, Entamoeba dispar
INPPFKMSWRIAITFLVSLFDAITED

SEQ ID NO: 2393771 - protein, 18 aa, Entamoeba dispar
INSFLMLLPFQSFSNKSL

SEQ ID NO: 2393772 - protein, 17 aa, Entamoeba dispar
IPFHSCFALIQSSPEIL

SEQ ID NO: 2393773 - protein, 17 aa, Entamoeba dispar
IPFVFSIIIDKTILNIK

SEQ ID NO: 2393774 - protein, 19 aa, Entamoeba dispar
IPIFCCIAILLYLITSIAA

SEQ ID NO: 2393775 - protein, 18 aa, Entamoeba dispar
IPIGWGLKENVYKEIMDK

SEQ ID NO: 2393776 - protein, 22 aa, Entamoeba dispar
IPIILLRPIFRIPLKQNDLIIG

SEQ ID NO: 2393777 - protein, 20 aa, Entamoeba dispar
IPKFLVKVLVDFASTTFTIK

SEQ ID NO: 2393778 - protein, 23 aa, Entamoeba dispar
IPLKYLWPSIRVVLYRTVYGLIY

SEQ ID NO: 2393779 - protein, 19 aa, Entamoeba dispar
IPMILEFVLVLSFVLNPVI

SEQ ID NO: 2393780 - protein, 17 aa, Entamoeba dispar
IPNCVELLPILLSMERL

SEQ ID NO: 2393781 - protein, 22 aa, Entamoeba dispar
IPRCPKCGGLLKLDVVLFGEKL

SEQ ID NO: 2393782 - protein, 24 aa, Entamoeba dispar
IPSLCLWMFILLCVIGFIIVLLYQ

SEQ ID NO: 2393783 - protein, 18 aa, Entamoeba dispar
IPSSTLWFSFHELPKIGI

SEQ ID NO: 2393784 - protein, 19 aa, Entamoeba dispar
IPVSLSFKVTGIEVSNSLC

SEQ ID NO: 2393785 - protein, 21 aa, Entamoeba dispar
IPYDCCGWKLINTSSLTNSTC

SEQ ID NO: 2393786 - protein, 17 aa, Entamoeba dispar
IQECFNLTGNVAKIIQL

SEQ ID NO: 2393787 - protein, 24 aa, Entamoeba dispar
IQIRFRYAYELEYWDKILNELCEL

SEQ ID NO: 2393788 - protein, 21 aa, Entamoeba dispar
IQKERVFGCGKIITVVVLLAM

SEQ ID NO: 2393789 - protein, 18 aa, Entamoeba dispar
IRFNSFWNYKKFEIKMCD

SEQ ID NO: 2393790 - protein, 18 aa, Entamoeba dispar
IRHSWVIKVIFRIISAPW

SEQ ID NO: 2393791 - protein, 19 aa, Entamoeba dispar
IRIALCLNIKKLSALLFSK

SEQ ID NO: 2393792 - protein, 18 aa, Entamoeba dispar
IRKLCPLLIPYSSNPIFD

SEQ ID NO: 2393793 - protein, 17 aa, Entamoeba dispar
IRLPVKYSLPIFNTSIY

SEQ ID NO: 2393794 - protein, 20 aa, Entamoeba dispar
IRLRFSYCETYKLNYQFNET

SEQ ID NO: 2393795 - protein, 17 aa, Entamoeba dispar
IRMKNIHWEKINGVKEV

SEQ ID NO: 2393796 - protein, 17 aa, Entamoeba dispar
IRVGEEFRDSKGEVEIY

SEQ ID NO: 2393797 - protein, 18 aa, Entamoeba dispar
IRVIGNIALLCFDILLLV

SEQ ID NO: 2393798 - protein, 19 aa, Entamoeba dispar
IRYCPPELLNELDLDETTD

SEQ ID NO: 2393799 - protein, 17 aa, Entamoeba dispar
ISDCWVEDPSLRPKFTE

SEQ ID NO: 2393800 - protein, 20 aa, Entamoeba dispar
ISEIIPWWLLCCHDSVKEVS

SEQ ID NO: 2393801 - protein, 19 aa, Entamoeba dispar
ISFIETFAWDYSFNQTIPR

SEQ ID NO: 2393802 - protein, 20 aa, Entamoeba dispar
ISIICILVFFGIISLFLSFT

SEQ ID NO: 2393803 - protein, 17 aa, Entamoeba dispar
ISIIFPLILIFQLSLIQ

SEQ ID NO: 2393804 - protein, 17 aa, Entamoeba dispar
ISKEEKFYCTLKSGVDS

SEQ ID NO: 2393805 - protein, 23 aa, Entamoeba dispar
ISMFNVLPAFSFSGEKVKVVMTF

SEQ ID NO: 2393806 - protein, 18 aa, Entamoeba dispar
ISPELAYVGFFQMFPTII

SEQ ID NO: 2393807 - protein, 21 aa, Entamoeba dispar
ISSICAFVYHLIRPYPTSLLG

SEQ ID NO: 2393808 - protein, 18 aa, Entamoeba dispar
ISTIFLPWFNTLRYLKQS

SEQ ID NO: 2393809 - protein, 20 aa, Entamoeba dispar
ISVLLCFFIAFLIMKFTRMN

SEQ ID NO: 2393810 - protein, 17 aa, Entamoeba dispar
ITCTLWFSTFQNKNELK

SEQ ID NO: 2393811 - protein, 21 aa, Entamoeba dispar
ITEVIRFTTLIGVHYFTKKFD

SEQ ID NO: 2393812 - protein, 20 aa, Entamoeba dispar
ITIYEVMKWGPAYDNSDGLF

SEQ ID NO: 2393813 - protein, 22 aa, Entamoeba dispar
ITLCCVCPAPLLSIIYSVEYNV

SEQ ID NO: 2393814 - protein, 17 aa, Entamoeba dispar
ITSLPGFVLLLLLFSID

SEQ ID NO: 2393815 - protein, 17 aa, Entamoeba dispar
ITVVYSWKNPDNSEIFL

SEQ ID NO: 2393816 - protein, 20 aa, Entamoeba dispar
IVCGCALGFIGYGYGGPVYA

SEQ ID NO: 2393817 - protein, 17 aa, Entamoeba dispar
IVDEWKSRVVIIDAKTG

SEQ ID NO: 2393818 - protein, 18 aa, Entamoeba dispar
IVERMCIFVQGFIAEGCK

SEQ ID NO: 2393819 - protein, 22 aa, Entamoeba dispar
IVLSFYIMINWFFTLLEYLSIM

SEQ ID NO: 2393820 - protein, 18 aa, Entamoeba dispar
IVLTCCMFLSTRLEGFTT

SEQ ID NO: 2393821 - protein, 18 aa, Entamoeba dispar
IVLYEIWKWDKAYPTEEF

SEQ ID NO: 2393822 - protein, 24 aa, Entamoeba dispar
IVSFALSCIACWIVFIYQPTFKPK

SEQ ID NO: 2393823 - protein, 25 aa, Entamoeba dispar
IVSFSFCCLACWVVFMFQPTFSCSV

SEQ ID NO: 2393824 - protein, 18 aa, Entamoeba dispar
IVSIFFKDINIIVPIEES

SEQ ID NO: 2393825 - protein, 19 aa, Entamoeba dispar
IVTFLTWLFISRCWKNKYT

SEQ ID NO: 2393826 - protein, 19 aa, Entamoeba dispar
IVTRTSFFWGRVYKKKERL

SEQ ID NO: 2393827 - protein, 18 aa, Entamoeba dispar
IVYRAEWRMVDVAVKVMK

SEQ ID NO: 2393828 - protein, 17 aa, Entamoeba dispar
IWMVSWKGVKFVLKDQK

SEQ ID NO: 2393829 - protein, 25 aa, Entamoeba dispar
IWPTAIRFVPLFACASVFLNNTPIV

SEQ ID NO: 2393830 - protein, 18 aa, Entamoeba dispar
IWRFLKYWFTSLLSSQIN

SEQ ID NO: 2393831 - protein, 17 aa, Entamoeba dispar
IYCIYKLINCIIHIIGL

SEQ ID NO: 2393832 - protein, 23 aa, Entamoeba dispar
IYCPSCLEKGFFHIVNQESLKKG

SEQ ID NO: 2393833 - protein, 17 aa, Entamoeba dispar
IYFAYGFLMSIFIQITI

SEQ ID NO: 2393834 - protein, 24 aa, Entamoeba dispar
IYKMMRWWFDKGIDGFRMDVINLI

SEQ ID NO: 2393835 - protein, 18 aa, Entamoeba dispar
IYMLLNWLWLLGTLIYLN

SEQ ID NO: 2393836 - protein, 18 aa, Entamoeba dispar
IYPYCFLHHYGLKKWSMI

SEQ ID NO: 2393837 - protein, 18 aa, Entamoeba dispar
IYQFSIKKVHDIITLCVG

SEQ ID NO: 2393838 - protein, 20 aa, Entamoeba dispar
IYRKGHWFFVDFNKIDSMTK

SEQ ID NO: 2393839 - protein, 17 aa, Entamoeba dispar
IYYALNILYFVSLVLDP

SEQ ID NO: 2393840 - protein, 20 aa, Entamoeba dispar
KAAVDLCRLVFPLSSDENPR

SEQ ID NO: 2393841 - protein, 21 aa, Entamoeba dispar
KAIEIFFRFCELDLFKESKEI

SEQ ID NO: 2393842 - protein, 18 aa, Entamoeba dispar
KAPAFIRRFVKSIDNKTR

SEQ ID NO: 2393843 - protein, 19 aa, Entamoeba dispar
KAYPRLILRDGDFFSDKGM

SEQ ID NO: 2393844 - protein, 17 aa, Entamoeba dispar
KCDVLGCAWCQDDHTSC

SEQ ID NO: 2393845 - protein, 22 aa, Entamoeba dispar
KCESKKKFLIVGGFFQQFEYSD

SEQ ID NO: 2393846 - protein, 22 aa, Entamoeba dispar
KCHRVFRVVFELIYQCNSEKHL

SEQ ID NO: 2393847 - protein, 23 aa, Entamoeba dispar
KCNKCSLPHCVQCYYGTDNEICS

SEQ ID NO: 2393848 - protein, 18 aa, Entamoeba dispar
KCSVQVEKSCYCGKEKSK

SEQ ID NO: 2393849 - protein, 21 aa, Entamoeba dispar
KCSYFEVIIPFLLFAECRLVV

SEQ ID NO: 2393850 - protein, 22 aa, Entamoeba dispar
KCTFKFGRRRIFLVVGAIIDVL

SEQ ID NO: 2393851 - protein, 19 aa, Entamoeba dispar
KDGKEVIGYVFMRKLVSAL

SEQ ID NO: 2393852 - protein, 22 aa, Entamoeba dispar
KDHCYKCSNHLSVLFGSTNYCA

SEQ ID NO: 2393853 - protein, 19 aa, Entamoeba dispar
KDIIRWLMCVDGKRVCKLV

SEQ ID NO: 2393854 - protein, 17 aa, Entamoeba dispar
KDITGLCALQHRKDNPQ

SEQ ID NO: 2393855 - protein, 21 aa, Entamoeba dispar
KDLRDAFELCIRFKNKGKRVS

SEQ ID NO: 2393856 - protein, 17 aa, Entamoeba dispar
KDNCLKDIFSLSLEVFN

SEQ ID NO: 2393857 - protein, 19 aa, Entamoeba dispar
KDNSLWAILFVYRNADAKQ

SEQ ID NO: 2393858 - protein, 21 aa, Entamoeba dispar
KDSKCVKCFDGYYLKNQQCIP

SEQ ID NO: 2393859 - protein, 18 aa, Entamoeba dispar
KDVNCLYSLIPILGVILP

SEQ ID NO: 2393860 - protein, 21 aa, Entamoeba dispar
KDYCYRSSQIIGFIINSHKSE

SEQ ID NO: 2393861 - protein, 26 aa, Entamoeba dispar
KDYISPISFCWWLFNAILSSFTIFFI

SEQ ID NO: 2393862 - protein, 32 aa, Entamoeba dispar
KECHDILRPSLRWYFSILFWRRIKTLKSTFKQ

SEQ ID NO: 2393863 - protein, 24 aa, Entamoeba dispar
KEDYRCAIVLFQLCVEGLQSLGVN

SEQ ID NO: 2393864 - protein, 18 aa, Entamoeba dispar
KEEYCIFINKLLQFLQIN

SEQ ID NO: 2393865 - protein, 20 aa, Entamoeba dispar
KEFISQIIVICWNHDPRIKA

SEQ ID NO: 2393866 - protein, 21 aa, Entamoeba dispar
KEFMLRTGFSMGVTVVVTFTL

SEQ ID NO: 2393867 - protein, 22 aa, Entamoeba dispar
KEFRIPISIFIDQQFLSLMKLY

SEQ ID NO: 2393868 - protein, 18 aa, Entamoeba dispar
KEGKRLADFFTMSCFGRG

SEQ ID NO: 2393869 - protein, 21 aa, Entamoeba dispar
KEIFSKWGIQNIIGFNDNDNI

SEQ ID NO: 2393870 - protein, 20 aa, Entamoeba dispar
KEILGSFVLPSMKSFEIPDV

SEQ ID NO: 2393871 - protein, 19 aa, Entamoeba dispar
KEKHIWNAIFGRFVDDIQT

SEQ ID NO: 2393872 - protein, 24 aa, Entamoeba dispar
KEKKKRIINMIGIIMYQMRKSLYE

SEQ ID NO: 2393873 - protein, 24 aa, Entamoeba dispar
KEKSFRMFIELGKKILIPLQLRTK

SEQ ID NO: 2393874 - protein, 22 aa, Entamoeba dispar
KEKSNVFGMMGVIFYWIITQKN

SEQ ID NO: 2393875 - protein, 21 aa, Entamoeba dispar
KELLLSCWKINTERLISIDEI

SEQ ID NO: 2393876 - protein, 18 aa, Entamoeba dispar
KELPEVLKDISFSIHHGE

SEQ ID NO: 2393877 - protein, 19 aa, Entamoeba dispar
KELTKRYSIDYSYQDEEGK

SEQ ID NO: 2393878 - protein, 24 aa, Entamoeba dispar
KELVPELFKFFSLSITTIQNHSIT

SEQ ID NO: 2393879 - protein, 19 aa, Entamoeba dispar
KEMLTCLDISWLNEIISHK

SEQ ID NO: 2393880 - protein, 21 aa, Entamoeba dispar
KENRCPPFICISSNGISISSD

SEQ ID NO: 2393881 - protein, 17 aa, Entamoeba dispar
KEPYQRIEFSLTIEQSN

SEQ ID NO: 2393882 - protein, 17 aa, Entamoeba dispar
KEREFKNQLAFQHCLLI

SEQ ID NO: 2393883 - protein, 25 aa, Entamoeba dispar
KERIAEYFIPFLFDFIDNFERITEI

SEQ ID NO: 2393884 - protein, 17 aa, Entamoeba dispar
KERLKYVWIIFALIIKS

SEQ ID NO: 2393885 - protein, 19 aa, Entamoeba dispar
KESMTWKGFLLMLIPAFCD

SEQ ID NO: 2393886 - protein, 20 aa, Entamoeba dispar
KETLAFDVIEKFAQLLSLEM

SEQ ID NO: 2393887 - protein, 20 aa, Entamoeba dispar
KEVVKAIGYFIGIHRNELPG

SEQ ID NO: 2393888 - protein, 17 aa, Entamoeba dispar
KEYSSVHGIHYFMIGIV

SEQ ID NO: 2393889 - protein, 19 aa, Entamoeba dispar
KFCSFEWWCQAIESGKNLC

SEQ ID NO: 2393890 - protein, 18 aa, Entamoeba dispar
KFFPLGCYMNWYDDFDIE

SEQ ID NO: 2393891 - protein, 18 aa, Entamoeba dispar
KFRRCIKEFQGLDLLSLE

SEQ ID NO: 2393892 - protein, 18 aa, Entamoeba dispar
KFSPEIIYQLSIDSISGS

SEQ ID NO: 2393893 - protein, 19 aa, Entamoeba dispar
KFYSLCGGLVISDLPEDQV

SEQ ID NO: 2393894 - protein, 21 aa, Entamoeba dispar
KGAVFKMDIGQYFGISASNGD

SEQ ID NO: 2393895 - protein, 17 aa, Entamoeba dispar
KGDMVLIDFSFFKRFLS

SEQ ID NO: 2393896 - protein, 19 aa, Entamoeba dispar
KGECKFTFKEMQTLNVKRD

SEQ ID NO: 2393897 - protein, 20 aa, Entamoeba dispar
KGECKFTFKEMQTLNVKRDK

SEQ ID NO: 2393898 - protein, 17 aa, Entamoeba dispar
KGENFGVLATRGKDEGL

SEQ ID NO: 2393899 - protein, 19 aa, Entamoeba dispar
KGTFPFIWIFLVFASICYW

SEQ ID NO: 2393900 - protein, 17 aa, Entamoeba dispar
KHCALKCPHAQFTEARS

SEQ ID NO: 2393901 - protein, 23 aa, Entamoeba dispar
KHFKCWRVMTLIAGFMLMLVGGS

SEQ ID NO: 2393902 - protein, 22 aa, Entamoeba dispar
KHFRIVAVLLKYWLKTRNLNCP

SEQ ID NO: 2393903 - protein, 19 aa, Entamoeba dispar
KHVWPSLLFMVLITFLLSV

SEQ ID NO: 2393904 - protein, 20 aa, Entamoeba dispar
KHWLELSVMLSWVFIIVFAA

SEQ ID NO: 2393905 - protein, 18 aa, Entamoeba dispar
KIAGICFSNPPKFNEPTK

SEQ ID NO: 2393906 - protein, 18 aa, Entamoeba dispar
KIEDFWKHVCIIWTKCYY

SEQ ID NO: 2393907 - protein, 17 aa, Entamoeba dispar
KIEKEFREQLIIEQERL

SEQ ID NO: 2393908 - protein, 17 aa, Entamoeba dispar
KIINDFEPLITFCTSSL

SEQ ID NO: 2393909 - protein, 22 aa, Entamoeba dispar
KIIPDSVFIEWMIKYDNAKSLV

SEQ ID NO: 2393910 - protein, 18 aa, Entamoeba dispar
KILSWKETDDFILKLQLD

SEQ ID NO: 2393911 - protein, 19 aa, Entamoeba dispar
KIRMIHIFGPISFLIFSCL

SEQ ID NO: 2393912 - protein, 21 aa, Entamoeba dispar
KIVDFWGIFICCFVIAFAAFF

SEQ ID NO: 2393913 - protein, 23 aa, Entamoeba dispar
KKECKECITVLCGDKKKIISITQ

SEQ ID NO: 2393914 - protein, 17 aa, Entamoeba dispar
KKFKGGEGFQLIDKKMK

SEQ ID NO: 2393915 - protein, 19 aa, Entamoeba dispar
KKGKIFFRNGCNIQTINNS

SEQ ID NO: 2393916 - protein, 19 aa, Entamoeba dispar
KKLEIDLMMFYDEKIKNVQ

SEQ ID NO: 2393917 - protein, 18 aa, Entamoeba dispar
KKLIEWAKKLKLIDKEEI

SEQ ID NO: 2393918 - protein, 18 aa, Entamoeba dispar
KKLNMFIKFCDIIKTLHT

SEQ ID NO: 2393919 - protein, 17 aa, Entamoeba dispar
KKLPIGFKYLQMVQQEH

SEQ ID NO: 2393920 - protein, 19 aa, Entamoeba dispar
KKLWGYFCGVLEHPQADVL

SEQ ID NO: 2393921 - protein, 19 aa, Entamoeba dispar
KKNVLEWWVPSTIANIRTY

SEQ ID NO: 2393922 - protein, 25 aa, Entamoeba dispar
KKRIWWLRIVEEIWLVLVGFVRSSF

SEQ ID NO: 2393923 - protein, 20 aa, Entamoeba dispar
KKRLPHFFQILSLTPIGRGI

SEQ ID NO: 2393924 - protein, 17 aa, Entamoeba dispar
KKSGIILNVYLRDSDSL

SEQ ID NO: 2393925 - protein, 17 aa, Entamoeba dispar
KKSLFGLGYDWRYADVN

SEQ ID NO: 2393926 - protein, 18 aa, Entamoeba dispar
KKSNGLNCVASYTGSAAS

SEQ ID NO: 2393927 - protein, 17 aa, Entamoeba dispar
KKWLGFVYCGIILITQM

SEQ ID NO: 2393928 - protein, 24 aa, Entamoeba dispar
KKYARLTTIFAILGIFMPPLFILS

SEQ ID NO: 2393929 - protein, 18 aa, Entamoeba dispar
KLCKEVIETALLLSQKMG

SEQ ID NO: 2393930 - protein, 19 aa, Entamoeba dispar
KLESVIIIIQFVRYHMSIE

SEQ ID NO: 2393931 - protein, 18 aa, Entamoeba dispar
KLFECIKALALCHNVTPS

SEQ ID NO: 2393932 - protein, 18 aa, Entamoeba dispar
KLGYRLIQIAIRYEDYVL

SEQ ID NO: 2393933 - protein, 22 aa, Entamoeba dispar
KLHWRDVMKIAVKWRQISEPND

SEQ ID NO: 2393934 - protein, 18 aa, Entamoeba dispar
KLINCIIHIIGLTHSDGS

SEQ ID NO: 2393935 - protein, 18 aa, Entamoeba dispar
KLKHLICNGFEIKCSVKI

SEQ ID NO: 2393936 - protein, 19 aa, Entamoeba dispar
KLPETLVFHLKRFGYNEQF

SEQ ID NO: 2393937 - protein, 21 aa, Entamoeba dispar
KLSSTKGWDVLRWKDIQRIRQ

SEQ ID NO: 2393938 - protein, 25 aa, Entamoeba dispar
KLTKLKTLLLFIAIMVFASTLIIFL

SEQ ID NO: 2393939 - protein, 18 aa, Entamoeba dispar
KLTYKFKMRILKDVAKGM

SEQ ID NO: 2393940 - protein, 17 aa, Entamoeba dispar
KLWEYSGNISSQFAGWS

SEQ ID NO: 2393941 - protein, 21 aa, Entamoeba dispar
KLWIILCIAGGIVIVLGAIVT

SEQ ID NO: 2393942 - protein, 19 aa, Entamoeba dispar
KLWIVCSKKTLSYKCPGNT

SEQ ID NO: 2393943 - protein, 22 aa, Entamoeba dispar
KLWKYLCLFVSFSIKQKNITRT

SEQ ID NO: 2393944 - protein, 26 aa, Entamoeba dispar
KMAKLWYLQRMDWIGAFIIVVTTTVI

SEQ ID NO: 2393945 - protein, 18 aa, Entamoeba dispar
KMFNCFLLTLGLAFNFIS

SEQ ID NO: 2393946 - protein, 18 aa, Entamoeba dispar
KMKCNLCEYLSDVDDNYF

SEQ ID NO: 2393947 - protein, 18 aa, Entamoeba dispar
KMKRCHFVIIGNSIVFLL

SEQ ID NO: 2393948 - protein, 18 aa, Entamoeba dispar
KMPKWSIYPLTFIPGVVL

SEQ ID NO: 2393949 - protein, 18 aa, Entamoeba dispar
KMRILKDVAKGMSFLHEN

SEQ ID NO: 2393950 - protein, 18 aa, Entamoeba dispar
KNCSSCSFGYYFNDEGVC

SEQ ID NO: 2393951 - protein, 22 aa, Entamoeba dispar
KNGICLKCPQGMMIDNDHTRCS

SEQ ID NO: 2393952 - protein, 21 aa, Entamoeba dispar
KNICYRCHRIWQFLSSEEYYQ

SEQ ID NO: 2393953 - protein, 17 aa, Entamoeba dispar
KNIRLYIIVGMIVFLII

SEQ ID NO: 2393954 - protein, 18 aa, Entamoeba dispar
KNKMRFSAIYIDSLEQVN

SEQ ID NO: 2393955 - protein, 20 aa, Entamoeba dispar
KNLFFRTGFDNKKLYYYKDL

SEQ ID NO: 2393956 - protein, 17 aa, Entamoeba dispar
KNLGCLLSFGTTTSPGI

SEQ ID NO: 2393957 - protein, 27 aa, Entamoeba dispar
KNMLAWDVVCFYSFYFLICCCEQDALR

SEQ ID NO: 2393958 - protein, 18 aa, Entamoeba dispar
KNNFSVMFNYQFQENSTI

SEQ ID NO: 2393959 - protein, 24 aa, Entamoeba dispar
KNNKCSKCSFWYGINEEGTKCNKE

SEQ ID NO: 2393960 - protein, 22 aa, Entamoeba dispar
KNRKEICLNFGLTLEFIGRNAK

SEQ ID NO: 2393961 - protein, 23 aa, Entamoeba dispar
KNSICLKCPQGMMIDNDHTRCST

SEQ ID NO: 2393962 - protein, 18 aa, Entamoeba dispar
KNVLKLTSSFIRNNLKTS

SEQ ID NO: 2393963 - protein, 20 aa, Entamoeba dispar
KPRKGLWYKVVNNYKYAFPL

SEQ ID NO: 2393964 - protein, 21 aa, Entamoeba dispar
KPRLKIKFMIDAAKGIQYLHS

SEQ ID NO: 2393965 - protein, 18 aa, Entamoeba dispar
KPSNWEVYFKWGLIVVNV

SEQ ID NO: 2393966 - protein, 22 aa, Entamoeba dispar
KQKYRFGKWFKINLNQVTNAVF

SEQ ID NO: 2393967 - protein, 17 aa, Entamoeba dispar
KQLIWRCLLNAAQGIQY

SEQ ID NO: 2393968 - protein, 20 aa, Entamoeba dispar
KQRINEIVPISFDWSILSTK

SEQ ID NO: 2393969 - protein, 20 aa, Entamoeba dispar
KQTDCIFCPVGTHFIDEPYF

SEQ ID NO: 2393970 - protein, 19 aa, Entamoeba dispar
KRAALFVVVIFIGALIMLN

SEQ ID NO: 2393971 - protein, 19 aa, Entamoeba dispar
KRAMWWKNIKLYLIAGAIL

SEQ ID NO: 2393972 - protein, 20 aa, Entamoeba dispar
KRFAFREYPVALAVYLFIWT

SEQ ID NO: 2393973 - protein, 20 aa, Entamoeba dispar
KRIISYNCLPSFLTTLLHTS

SEQ ID NO: 2393974 - protein, 20 aa, Entamoeba dispar
KRIKHLRILYDMTLNQFTKE

SEQ ID NO: 2393975 - protein, 17 aa, Entamoeba dispar
KRIKYKWNQFQLKNKTY

SEQ ID NO: 2393976 - protein, 23 aa, Entamoeba dispar
KRISQPMFREFLLRVHPQLYTHL

SEQ ID NO: 2393977 - protein, 21 aa, Entamoeba dispar
KRKELWEMFRFHRIVWEWKTY

SEQ ID NO: 2393978 - protein, 17 aa, Entamoeba dispar
KRKTCLYLEFVMKTNET

SEQ ID NO: 2393979 - protein, 20 aa, Entamoeba dispar
KRLADFFTMSCFGRGLGFLC

SEQ ID NO: 2393980 - protein, 19 aa, Entamoeba dispar
KRLAKFKGVHNDIQFCFYG

SEQ ID NO: 2393981 - protein, 17 aa, Entamoeba dispar
KRLDAITLMYLFTKCNY

SEQ ID NO: 2393982 - protein, 20 aa, Entamoeba dispar
KRLFTSPIICCFVFMILCGL

SEQ ID NO: 2393983 - protein, 20 aa, Entamoeba dispar
KRLKETTLFASNHVIHALAY

SEQ ID NO: 2393984 - protein, 17 aa, Entamoeba dispar
KRRFNLIQIFSAVIALS

SEQ ID NO: 2393985 - protein, 23 aa, Entamoeba dispar
KRRIVELLYGFSLVGRPTPMSVI

SEQ ID NO: 2393986 - protein, 25 aa, Entamoeba dispar
KRTMWWKNMKLWFIIGGVVAIIVIV

SEQ ID NO: 2393987 - protein, 20 aa, Entamoeba dispar
KRYPNMLSISMQRSFLTRDV

SEQ ID NO: 2393988 - protein, 19 aa, Entamoeba dispar
KSAPYFIQWIVNILQTYGT

SEQ ID NO: 2393989 - protein, 18 aa, Entamoeba dispar
KSDLSIKVFYQWLTTSLY

SEQ ID NO: 2393990 - protein, 17 aa, Entamoeba dispar
KSGIKMTWWLGINLTLI

SEQ ID NO: 2393991 - protein, 18 aa, Entamoeba dispar
KSHLRYGQCLELVGPTKI

SEQ ID NO: 2393992 - protein, 17 aa, Entamoeba dispar
KSIPFLYSLTNKWNQID

SEQ ID NO: 2393993 - protein, 28 aa, Entamoeba dispar
KSLCKRIIQFPSWFFKQFFRTDPNGASM

SEQ ID NO: 2393994 - protein, 18 aa, Entamoeba dispar
KSQLSMKVARCYAQINNI

SEQ ID NO: 2393995 - protein, 18 aa, Entamoeba dispar
KSSLKMKVIRKMKIYNPS

SEQ ID NO: 2393996 - protein, 24 aa, Entamoeba dispar
KSSNWKIGLVIGVLIVVLIIIIIL

SEQ ID NO: 2393997 - protein, 20 aa, Entamoeba dispar
KSVMIKFLLIYFVVLLIILG

SEQ ID NO: 2393998 - protein, 18 aa, Entamoeba dispar
KTALEFNAPFTLVEYKPN

SEQ ID NO: 2393999 - protein, 19 aa, Entamoeba dispar
KTCGYWEFVFKPSKKEDVH

SEQ ID NO: 2394000 - protein, 23 aa, Entamoeba dispar
KTFKPALVSFKFTYGKNETDPFI

SEQ ID NO: 2394001 - protein, 18 aa, Entamoeba dispar
KTGFKFVACEIGQLSYKS

SEQ ID NO: 2394002 - protein, 18 aa, Entamoeba dispar
KTLFYWRNEKIIHQHPLL

SEQ ID NO: 2394003 - protein, 23 aa, Entamoeba dispar
KTLYYKWIYPIAIAVDITLRFGW

SEQ ID NO: 2394004 - protein, 19 aa, Entamoeba dispar
KTMCEWCVYYDFNSCKSCN

SEQ ID NO: 2394005 - protein, 26 aa, Entamoeba dispar
KTPHRVSVFNWFWNRQSYIPSEPYST

SEQ ID NO: 2394006 - protein, 24 aa, Entamoeba dispar
KTQKRISLIYAFVISIIFSGFIPL

SEQ ID NO: 2394007 - protein, 18 aa, Entamoeba dispar
KTRCCVCGIEASKIIYNC

SEQ ID NO: 2394008 - protein, 20 aa, Entamoeba dispar
KTSMFYKLWLKVEDIHAELY

SEQ ID NO: 2394009 - protein, 18 aa, Entamoeba dispar
KTTICGTLAWIAPEVLAR

SEQ ID NO: 2394010 - protein, 25 aa, Entamoeba dispar
KTTKYCWWSFIPVFLFNQFKYFINL

SEQ ID NO: 2394011 - protein, 20 aa, Entamoeba dispar
KTVLICLGFLIAIIGIIIFS

SEQ ID NO: 2394012 - protein, 22 aa, Entamoeba dispar
KVGGLKPSWEIAYCSWEESISY

SEQ ID NO: 2394013 - protein, 26 aa, Entamoeba dispar
KVRLVWKEIRGVWQWIEGRTYEVKPE

SEQ ID NO: 2394014 - protein, 21 aa, Entamoeba dispar
KVSRKGVQFSFVIPNTTHKMY

SEQ ID NO: 2394015 - protein, 18 aa, Entamoeba dispar
KVVFCAAHSLPITYRILD

SEQ ID NO: 2394016 - protein, 19 aa, Entamoeba dispar
KWEAFKWALISGICEPFGA

SEQ ID NO: 2394017 - protein, 20 aa, Entamoeba dispar
KYFVKDSFLGWKYIDFNNSK

SEQ ID NO: 2394018 - protein, 19 aa, Entamoeba dispar
KYIPFIIPMILEFVLVLSF

SEQ ID NO: 2394019 - protein, 17 aa, Entamoeba dispar
KYLDPIRTCFGRLKNSY

SEQ ID NO: 2394020 - protein, 21 aa, Entamoeba dispar
KYLNLICGIVIMLLAVNRKDV

SEQ ID NO: 2394021 - protein, 22 aa, Entamoeba dispar
KYPYWRCGLTFTNEEKQNIIDE

SEQ ID NO: 2394022 - protein, 25 aa, Entamoeba dispar
KYQISTLIKFCFYKNAAFFLMDIWF

SEQ ID NO: 2394023 - protein, 18 aa, Entamoeba dispar
KYRGCFLLLTGISLSYYS

SEQ ID NO: 2394024 - protein, 19 aa, Entamoeba dispar
KYSDFSFIFGLILIVISLV

SEQ ID NO: 2394025 - protein, 20 aa, Entamoeba dispar
KYWIPRIIFFLFFFAAVELV

SEQ ID NO: 2394026 - protein, 17 aa, Entamoeba dispar
LAEYWKFGFIIIICSPW

SEQ ID NO: 2394027 - protein, 17 aa, Entamoeba dispar
LAIIRFILGLGIGGEYP

SEQ ID NO: 2394028 - protein, 17 aa, Entamoeba dispar
LAIVFQLIVCFSQEFGK

SEQ ID NO: 2394029 - protein, 17 aa, Entamoeba dispar
LAQNLTNIWAFSSEHKY

SEQ ID NO: 2394030 - protein, 17 aa, Entamoeba dispar
LATQILRIDFISVLNSY

SEQ ID NO: 2394031 - protein, 18 aa, Entamoeba dispar
LCAGCILSYCFILLLNRY

SEQ ID NO: 2394032 - protein, 17 aa, Entamoeba dispar
LCDHCIMSNKTLQPSEH

SEQ ID NO: 2394033 - protein, 18 aa, Entamoeba dispar
LCDKECFTSVIGIQKELS

SEQ ID NO: 2394034 - protein, 17 aa, Entamoeba dispar
LCGELFIGFSHLYYIIA

SEQ ID NO: 2394035 - protein, 19 aa, Entamoeba dispar
LCIAGELFSEAGFFQRSDQ

SEQ ID NO: 2394036 - protein, 17 aa, Entamoeba dispar
LCIEEWIAAGMLIVVIV

SEQ ID NO: 2394037 - protein, 18 aa, Entamoeba dispar
LCIISYFFVMILYPEKNE

SEQ ID NO: 2394038 - protein, 18 aa, Entamoeba dispar
LCILGCFAQNLTINIFHV

SEQ ID NO: 2394039 - protein, 17 aa, Entamoeba dispar
LCILYPLSVYLFLYIMF

SEQ ID NO: 2394040 - protein, 20 aa, Entamoeba dispar
LCKSAPIIIIWTTLFLVEIL

SEQ ID NO: 2394041 - protein, 17 aa, Entamoeba dispar
LCLRFVPWYVVIINLIS

SEQ ID NO: 2394042 - protein, 18 aa, Entamoeba dispar
LCMMLKYMIEHFKENGNE

SEQ ID NO: 2394043 - protein, 20 aa, Entamoeba dispar
LCSLFKLGRIPADSLFDSIS

SEQ ID NO: 2394044 - protein, 17 aa, Entamoeba dispar
LCVYFWKTKVLTFIVPI

SEQ ID NO: 2394045 - protein, 17 aa, Entamoeba dispar
LDCSFNRIFSFPPILSL

SEQ ID NO: 2394046 - protein, 19 aa, Entamoeba dispar
LDFIGEYLLMFNSFPDKHA

SEQ ID NO: 2394047 - protein, 19 aa, Entamoeba dispar
LDLHDLHMYFGFESSKDYY

SEQ ID NO: 2394048 - protein, 19 aa, Entamoeba dispar
LDLNLMFWIAISMTIALII

SEQ ID NO: 2394049 - protein, 21 aa, Entamoeba dispar
LDWRYSRSAGMLFGVIVTIVA

SEQ ID NO: 2394050 - protein, 17 aa, Entamoeba dispar
LDYRFNEIFVLLRESFN

SEQ ID NO: 2394051 - protein, 17 aa, Entamoeba dispar
LECFKDIFNGISTTGST

SEQ ID NO: 2394052 - protein, 23 aa, Entamoeba dispar
LECPIKEKFHCVFAIYTKNKLIE

SEQ ID NO: 2394053 - protein, 18 aa, Entamoeba dispar
LECTSLFLLQTTRTQKNE

SEQ ID NO: 2394054 - protein, 20 aa, Entamoeba dispar
LEIKGDITINGFSRVDIKSQ

SEQ ID NO: 2394055 - protein, 17 aa, Entamoeba dispar
LEIRTGQDYIFFNDFLA

SEQ ID NO: 2394056 - protein, 19 aa, Entamoeba dispar
LEKKMCIAIEFAPNGSLGH

SEQ ID NO: 2394057 - protein, 20 aa, Entamoeba dispar
LELLITIIRSCWKLNVFEGY

SEQ ID NO: 2394058 - protein, 17 aa, Entamoeba dispar
LELRELLSFCSSKNMAI

SEQ ID NO: 2394059 - protein, 21 aa, Entamoeba dispar
LEMLPKQFAAFMFFDCHNRFY

SEQ ID NO: 2394060 - protein, 21 aa, Entamoeba dispar
LESEFGYKMFIQGIIVDGVDC

SEQ ID NO: 2394061 - protein, 19 aa, Entamoeba dispar
LETPFKFRMEKTVSVDNDL

SEQ ID NO: 2394062 - protein, 21 aa, Entamoeba dispar
LEYRRLLPILLNYGTGATPSI

SEQ ID NO: 2394063 - protein, 21 aa, Entamoeba dispar
LFAGRPRPNFYAMVDAGNIKD

SEQ ID NO: 2394064 - protein, 27 aa, Entamoeba dispar
LFALGFLCCCVWCYGWCQYRHSTNDQA

SEQ ID NO: 2394065 - protein, 24 aa, Entamoeba dispar
LFCGCFILKIAIYFVQPFLKSYLF

SEQ ID NO: 2394066 - protein, 18 aa, Entamoeba dispar
LFDRWRSVLFHWKYYLQR

SEQ ID NO: 2394067 - protein, 22 aa, Entamoeba dispar
LFEMLCVVFPCYPLKRNHISYF

SEQ ID NO: 2394068 - protein, 25 aa, Entamoeba dispar
LFIFRIVPMLVIFMICLARAVIPLC

SEQ ID NO: 2394069 - protein, 18 aa, Entamoeba dispar
LFILGFFTCLTWVINIFM

SEQ ID NO: 2394070 - protein, 22 aa, Entamoeba dispar
LFLCFPRFFKLQSCIPCNKKCV

SEQ ID NO: 2394071 - protein, 18 aa, Entamoeba dispar
LFLEYAWMKGIDGFNNEV

SEQ ID NO: 2394072 - protein, 25 aa, Entamoeba dispar
LFLQLPYTFSFPWLNAVIVYFISIV

SEQ ID NO: 2394073 - protein, 19 aa, Entamoeba dispar
LFSREFPLDLVLQLWDGIF

SEQ ID NO: 2394074 - protein, 18 aa, Entamoeba dispar
LFVEHAFRFFELLSKIEK

SEQ ID NO: 2394075 - protein, 17 aa, Entamoeba dispar
LFVLGFVFCCLWPINAC

SEQ ID NO: 2394076 - protein, 17 aa, Entamoeba dispar
LFYCYSEKIDLKKNKLD

SEQ ID NO: 2394077 - protein, 18 aa, Entamoeba dispar
LFYPFSWPGIFIPYIPDE

SEQ ID NO: 2394078 - protein, 17 aa, Entamoeba dispar
LFYRLIKVIFMPKTTAP

SEQ ID NO: 2394079 - protein, 18 aa, Entamoeba dispar
LGCYMNWYDDFDIEHFKD

SEQ ID NO: 2394080 - protein, 17 aa, Entamoeba dispar
LGDKFIFYKSYWEPGVR

SEQ ID NO: 2394081 - protein, 23 aa, Entamoeba dispar
LGEMWGGQFLRWFNFACLVLYLY

SEQ ID NO: 2394082 - protein, 26 aa, Entamoeba dispar
LGFFCCGCSFLFIFFFDRVVATHGGH

SEQ ID NO: 2394083 - protein, 19 aa, Entamoeba dispar
LGGCLGCNIGLFLFPILEI

SEQ ID NO: 2394084 - protein, 22 aa, Entamoeba dispar
LGIKCSFIPIILYLMVALLSIN

SEQ ID NO: 2394085 - protein, 17 aa, Entamoeba dispar
LGLCLHFKIPFELQIAV

SEQ ID NO: 2394086 - protein, 19 aa, Entamoeba dispar
LGMRIELIGCIGLGAVVIF

SEQ ID NO: 2394087 - protein, 24 aa, Entamoeba dispar
LGMVPALFLRRIYDIGMSKFDQYV

SEQ ID NO: 2394088 - protein, 22 aa, Entamoeba dispar
LHFKSSRFYNEFIFHLDNISAV

SEQ ID NO: 2394089 - protein, 21 aa, Entamoeba dispar
LHGGWKYLFIVLSRFEQMNLI

SEQ ID NO: 2394090 - protein, 17 aa, Entamoeba dispar
LHMYFGFESSKDYYYWI

SEQ ID NO: 2394091 - protein, 19 aa, Entamoeba dispar
LHSILRCGRLIMNSKTRIV

SEQ ID NO: 2394092 - protein, 19 aa, Entamoeba dispar
LHVRLNFLTQFMVQDETVY

SEQ ID NO: 2394093 - protein, 17 aa, Entamoeba dispar
LHWMYGFKNECLGKYDT

SEQ ID NO: 2394094 - protein, 25 aa, Entamoeba dispar
LHYIFSSSCSLCFESLENEESLSLI

SEQ ID NO: 2394095 - protein, 18 aa, Entamoeba dispar
LIAFRIRFDFDIITFISV

SEQ ID NO: 2394096 - protein, 24 aa, Entamoeba dispar
LIAFYKFGTKFVMKRLFLNCDDTE

SEQ ID NO: 2394097 - protein, 24 aa, Entamoeba dispar
LICDIRFPPKLAFVTMKNIYSFFY

SEQ ID NO: 2394098 - protein, 18 aa, Entamoeba dispar
LICFFFKSFDIIIRIFIN

SEQ ID NO: 2394099 - protein, 17 aa, Entamoeba dispar
LICQISLCLNCISCCSI

SEQ ID NO: 2394100 - protein, 17 aa, Entamoeba dispar
LIHVCCEWMKVAVQYDL

SEQ ID NO: 2394101 - protein, 20 aa, Entamoeba dispar
LIIHLQPSIPIYVFIHSPYG

SEQ ID NO: 2394102 - protein, 22 aa, Entamoeba dispar
LIIIVYFFFCYKTIPHFHSLFH

SEQ ID NO: 2394103 - protein, 18 aa, Entamoeba dispar
LIILRRYFTLMGVLFAIR

SEQ ID NO: 2394104 - protein, 19 aa, Entamoeba dispar
LIKHLFKYVATFLSYYPVK

SEQ ID NO: 2394105 - protein, 18 aa, Entamoeba dispar
LIKICAWCIEVNETIHFP

SEQ ID NO: 2394106 - protein, 17 aa, Entamoeba dispar
LILCFVGWYFLIKNQSI

SEQ ID NO: 2394107 - protein, 18 aa, Entamoeba dispar
LILERRLKETKKEIYQEP

SEQ ID NO: 2394108 - protein, 23 aa, Entamoeba dispar
LILGRLFFPLLFTKGSDFVITLL

SEQ ID NO: 2394109 - protein, 19 aa, Entamoeba dispar
LINVLHFCLLKNASVSNNL

SEQ ID NO: 2394110 - protein, 23 aa, Entamoeba dispar
LISSICFAFGFALYYEWKVALCV

SEQ ID NO: 2394111 - protein, 21 aa, Entamoeba dispar
LIYLCYSFKCSPGCIGGCEAD

SEQ ID NO: 2394112 - protein, 21 aa, Entamoeba dispar
LKDFIRLLILRHKHFLFEGTS

SEQ ID NO: 2394113 - protein, 21 aa, Entamoeba dispar
LKELFGNVVDVCFAYESITER

SEQ ID NO: 2394114 - protein, 20 aa, Entamoeba dispar
LKEWGGAIIVGFDGDPYGKD

SEQ ID NO: 2394115 - protein, 25 aa, Entamoeba dispar
LKGMLRRAICNKVFLIILAIVFLII

SEQ ID NO: 2394116 - protein, 18 aa, Entamoeba dispar
LKIDLALMLNLIDPLKRY

SEQ ID NO: 2394117 - protein, 17 aa, Entamoeba dispar
LKIDRLREAFSNGKGGS

SEQ ID NO: 2394118 - protein, 20 aa, Entamoeba dispar
LKIKFCLDAAKAIEYLHSNG

SEQ ID NO: 2394119 - protein, 19 aa, Entamoeba dispar
LKIKFCLDAAKGIQYLHSN

SEQ ID NO: 2394120 - protein, 17 aa, Entamoeba dispar
LKIRMLFDTARGMEFLH

SEQ ID NO: 2394121 - protein, 20 aa, Entamoeba dispar
LKKEIQYFIGIETFLCDSEM

SEQ ID NO: 2394122 - protein, 20 aa, Entamoeba dispar
LKKMIIEWSMNIKLFDKKND

SEQ ID NO: 2394123 - protein, 17 aa, Entamoeba dispar
LKKYCYSKCDSCDSFIS

SEQ ID NO: 2394124 - protein, 18 aa, Entamoeba dispar
LKLDYVWRTALALGAVPC

SEQ ID NO: 2394125 - protein, 19 aa, Entamoeba dispar
LKLTSSFIRNNLKTSSDNK

SEQ ID NO: 2394126 - protein, 18 aa, Entamoeba dispar
LKQLRPGMDLGRISFPSH

SEQ ID NO: 2394127 - protein, 21 aa, Entamoeba dispar
LKRSISLIGIRYFYQKLFNLI

SEQ ID NO: 2394128 - protein, 17 aa, Entamoeba dispar
LKSLCLNNCPLKDNKQT

SEQ ID NO: 2394129 - protein, 22 aa, Entamoeba dispar
LKSVKWYYCLGITLCDITATFC

SEQ ID NO: 2394130 - protein, 22 aa, Entamoeba dispar
LKTKEWEHFLSLLKGKDDIIKL

SEQ ID NO: 2394131 - protein, 17 aa, Entamoeba dispar
LKVPTCLKEFISSGFIY

SEQ ID NO: 2394132 - protein, 19 aa, Entamoeba dispar
LKWYFSIFTKILEKLKENI

SEQ ID NO: 2394133 - protein, 17 aa, Entamoeba dispar
LKYYGGFTICVIILYLC

SEQ ID NO: 2394134 - protein, 17 aa, Entamoeba dispar
LLATCYWISNRLCSNGS

SEQ ID NO: 2394135 - protein, 21 aa, Entamoeba dispar
LLCFSCIPCCLDGLKDAHHKW

SEQ ID NO: 2394136 - protein, 17 aa, Entamoeba dispar
LLCSIILSIVTFTLFPS

SEQ ID NO: 2394137 - protein, 18 aa, Entamoeba dispar
LLDFCYYTNFLLLVTTIL

SEQ ID NO: 2394138 - protein, 20 aa, Entamoeba dispar
LLECQRWCFATLKLILLNPN

SEQ ID NO: 2394139 - protein, 30 aa, Entamoeba dispar
LLEKDFHKMGGWFKVCIAVLISVLVLTVGV

SEQ ID NO: 2394140 - protein, 18 aa, Entamoeba dispar
LLFFTGIALYASFVASLF

SEQ ID NO: 2394141 - protein, 17 aa, Entamoeba dispar
LLFGINCSYHFAMYHLL

SEQ ID NO: 2394142 - protein, 20 aa, Entamoeba dispar
LLGFCCFPFWIPSFVLSRKS

SEQ ID NO: 2394143 - protein, 17 aa, Entamoeba dispar
LLHLCCGESASLVMDTV

SEQ ID NO: 2394144 - protein, 19 aa, Entamoeba dispar
LLIDIATDFGFIFITSKMK

SEQ ID NO: 2394145 - protein, 21 aa, Entamoeba dispar
LLILFCICFILTLVVPTLTVS

SEQ ID NO: 2394146 - protein, 24 aa, Entamoeba dispar
LLLKVVCCSIILCLKKLLLNKDFS

SEQ ID NO: 2394147 - protein, 18 aa, Entamoeba dispar
LLLLKVMLLKCSFTRLKK

SEQ ID NO: 2394148 - protein, 17 aa, Entamoeba dispar
LLNRFFKLWCLRKGNWE

SEQ ID NO: 2394149 - protein, 21 aa, Entamoeba dispar
LLNRYTKLCVYTFSIILPIIA

SEQ ID NO: 2394150 - protein, 17 aa, Entamoeba dispar
LLNYGFAFFSICIAEMC

SEQ ID NO: 2394151 - protein, 23 aa, Entamoeba dispar
LLPEALKLIPIFVLGAMKTSAFM

SEQ ID NO: 2394152 - protein, 24 aa, Entamoeba dispar
LLSRFAVYIPIPWNKWPILGLSLV

SEQ ID NO: 2394153 - protein, 25 aa, Entamoeba dispar
LLTGKFRFGYVFGFTIIGSLAEYFI

SEQ ID NO: 2394154 - protein, 18 aa, Entamoeba dispar
LLTWKRLIEITSIRSYPL

SEQ ID NO: 2394155 - protein, 24 aa, Entamoeba dispar
LLWVGVCFLCFLGIRINYLGLAII

SEQ ID NO: 2394156 - protein, 17 aa, Entamoeba dispar
LLYRFVQTLGMLPFSLL

SEQ ID NO: 2394157 - protein, 34 aa, Entamoeba dispar
LMALPRYPLLTGWKTEFMIGYSLPNEVVISKGKA

SEQ ID NO: 2394158 - protein, 22 aa, Entamoeba dispar
LMCFPAALPAIFSFSNGNSIRY

SEQ ID NO: 2394159 - protein, 19 aa, Entamoeba dispar
LMDEFKSVLYYKGDTSQRE

SEQ ID NO: 2394160 - protein, 17 aa, Entamoeba dispar
LMSVSFCAILGGMNSIL

SEQ ID NO: 2394161 - protein, 28 aa, Entamoeba dispar
LMYIHCFIRRDFLFKREVPWVVFSCIIQ

SEQ ID NO: 2394162 - protein, 18 aa, Entamoeba dispar
LNFCICICCCKLIIHDRK

SEQ ID NO: 2394163 - protein, 19 aa, Entamoeba dispar
LNFTEGVSFYFEQEPNSQS

SEQ ID NO: 2394164 - protein, 18 aa, Entamoeba dispar
LNGFKMKFEIRVHVLFGT

SEQ ID NO: 2394165 - protein, 25 aa, Entamoeba dispar
LNGKLRFGNIYGFSIIASFVEYLVM

SEQ ID NO: 2394166 - protein, 22 aa, Entamoeba dispar
LNLQYRCCPPISNIVNRLYYNG

SEQ ID NO: 2394167 - protein, 18 aa, Entamoeba dispar
LNPIPFKCLLKYSKKENQ

SEQ ID NO: 2394168 - protein, 17 aa, Entamoeba dispar
LNQEIWSSICGRNNIMI

SEQ ID NO: 2394169 - protein, 17 aa, Entamoeba dispar
LNQLLSLVSNWPLQKSI

SEQ ID NO: 2394170 - protein, 23 aa, Entamoeba dispar
LNSISTSCVIVWNESELALDTSL

SEQ ID NO: 2394171 - protein, 17 aa, Entamoeba dispar
LNVFPFSSSTKRMGIIV

SEQ ID NO: 2394172 - protein, 17 aa, Entamoeba dispar
LNYHKSILQLASDRRND

SEQ ID NO: 2394173 - protein, 22 aa, Entamoeba dispar
LPCATIIGCLKLKSQDRREKLW

SEQ ID NO: 2394174 - protein, 18 aa, Entamoeba dispar
LPCELRKKVIFNFVLSHK

SEQ ID NO: 2394175 - protein, 25 aa, Entamoeba dispar
LPEFPFMWGYCWFTTILSYLSLWNT

SEQ ID NO: 2394176 - protein, 22 aa, Entamoeba dispar
LPFTFPVKYFFVFYKQRKLFVP

SEQ ID NO: 2394177 - protein, 17 aa, Entamoeba dispar
LPILNKKYRVMLITFIM

SEQ ID NO: 2394178 - protein, 19 aa, Entamoeba dispar
LPKILGLSIHNNWGNKYQK

SEQ ID NO: 2394179 - protein, 17 aa, Entamoeba dispar
LPLILPSFRQWKLKDMM

SEQ ID NO: 2394180 - protein, 23 aa, Entamoeba dispar
LPTGCYCTYSLISKQECIFDCEN

SEQ ID NO: 2394181 - protein, 25 aa, Entamoeba dispar
LPVPYPLLWCRYSFFIVLYPMGVSG

SEQ ID NO: 2394182 - protein, 21 aa, Entamoeba dispar
LPYFAEFDCESFAPKNKEVIE

SEQ ID NO: 2394183 - protein, 17 aa, Entamoeba dispar
LQCMNWMCIFRKPRSER

SEQ ID NO: 2394184 - protein, 17 aa, Entamoeba dispar
LQLIGWIMICVIIGILL

SEQ ID NO: 2394185 - protein, 17 aa, Entamoeba dispar
LQLSGSMTYHFIGVPII

SEQ ID NO: 2394186 - protein, 23 aa, Entamoeba dispar
LQTSRVFCKYAFPDNLARVLSRI

SEQ ID NO: 2394187 - protein, 21 aa, Entamoeba dispar
LRAMFSFTFFWYNFMPLTRGT

SEQ ID NO: 2394188 - protein, 18 aa, Entamoeba dispar
LRCLALFLEYAWMKGIDG

SEQ ID NO: 2394189 - protein, 21 aa, Entamoeba dispar
LRCPLCDTVYCSIECKEKDKQ

SEQ ID NO: 2394190 - protein, 21 aa, Entamoeba dispar
LRCVLYGISYSTVFSLRYILP

SEQ ID NO: 2394191 - protein, 19 aa, Entamoeba dispar
LRFSFNCSFLETFRHNYNY

SEQ ID NO: 2394192 - protein, 19 aa, Entamoeba dispar
LRFSSCWELFNPFAKQVPC

SEQ ID NO: 2394193 - protein, 19 aa, Entamoeba dispar
LRGECWFPSEYLDIIVTKL

SEQ ID NO: 2394194 - protein, 18 aa, Entamoeba dispar
LRIKEDYIRNAIDDMKMM

SEQ ID NO: 2394195 - protein, 17 aa, Entamoeba dispar
LRINLEISKIFYSLLIN

SEQ ID NO: 2394196 - protein, 18 aa, Entamoeba dispar
LRIVISVIFFLISCFFDI

SEQ ID NO: 2394197 - protein, 20 aa, Entamoeba dispar
LRIYLAESFVVIFSASLMGM

SEQ ID NO: 2394198 - protein, 17 aa, Entamoeba dispar
LRIYRRCVILEAIDRYL

SEQ ID NO: 2394199 - protein, 23 aa, Entamoeba dispar
LRKRKKLPLGFKFLQVIQEKDFE

SEQ ID NO: 2394200 - protein, 17 aa, Entamoeba dispar
LRLDAEWLLNNIASHQI

SEQ ID NO: 2394201 - protein, 20 aa, Entamoeba dispar
LRLLVPSTWYSKDFINDALI

SEQ ID NO: 2394202 - protein, 20 aa, Entamoeba dispar
LRMGLIILCVFAIFQCLSVF

SEQ ID NO: 2394203 - protein, 22 aa, Entamoeba dispar
LSCAIPTFALHLFIQDCTTYIS

SEQ ID NO: 2394204 - protein, 19 aa, Entamoeba dispar
LSCSLKACKLCNSMTGECS

SEQ ID NO: 2394205 - protein, 20 aa, Entamoeba dispar
LSDLRLGMHYPLGSVVMLTN

SEQ ID NO: 2394206 - protein, 19 aa, Entamoeba dispar
LSEDPCFFVFILVALFLLK

SEQ ID NO: 2394207 - protein, 17 aa, Entamoeba dispar
LSFKSPDPFNSSCSVEP

SEQ ID NO: 2394208 - protein, 21 aa, Entamoeba dispar
LSFSAYCFWLIIPILMRDIGA

SEQ ID NO: 2394209 - protein, 23 aa, Entamoeba dispar
LSFTTAIFLRWVNRIDGLMVNNK

SEQ ID NO: 2394210 - protein, 20 aa, Entamoeba dispar
LSILCFIIYIPTYFVYGQSE

SEQ ID NO: 2394211 - protein, 20 aa, Entamoeba dispar
LSISCSIGYTCLDVMNNFKD

SEQ ID NO: 2394212 - protein, 17 aa, Entamoeba dispar
LSLCKIGYMLSVSFFSF

SEQ ID NO: 2394213 - protein, 19 aa, Entamoeba dispar
LSLCNRFSLQITFLESLLD

SEQ ID NO: 2394214 - protein, 25 aa, Entamoeba dispar
LSLFFLHFWRSCLIFIVLPSFYIFK

SEQ ID NO: 2394215 - protein, 20 aa, Entamoeba dispar
LSLPEDWFEFGLTLSKTPMF

SEQ ID NO: 2394216 - protein, 23 aa, Entamoeba dispar
LSLPSLRRLEIRAGRNNLTENLP

SEQ ID NO: 2394217 - protein, 19 aa, Entamoeba dispar
LSMTMVIRFAKNINNALDV

SEQ ID NO: 2394218 - protein, 17 aa, Entamoeba dispar
LSNLFLCHAQKQDWPLF

SEQ ID NO: 2394219 - protein, 18 aa, Entamoeba dispar
LSPLFPFPISNYVLGPFC

SEQ ID NO: 2394220 - protein, 17 aa, Entamoeba dispar
LSQRFQINLTREVELCK

SEQ ID NO: 2394221 - protein, 23 aa, Entamoeba dispar
LSSCGEAPCLTRCVSHLIPRVNR

SEQ ID NO: 2394222 - protein, 18 aa, Entamoeba dispar
LSTCVRLSVHIIKNQKYN

SEQ ID NO: 2394223 - protein, 18 aa, Entamoeba dispar
LSVYRPSTTFYLYPKLIN

SEQ ID NO: 2394224 - protein, 17 aa, Entamoeba dispar
LSYFCFFLLISHMVSVT

SEQ ID NO: 2394225 - protein, 18 aa, Entamoeba dispar
LSYKRIRIIPSIFLMSLV

SEQ ID NO: 2394226 - protein, 17 aa, Entamoeba dispar
LSYVILYSFYKNIIMYL

SEQ ID NO: 2394227 - protein, 18 aa, Entamoeba dispar
LTCHICNIIGYSLTLHPG

SEQ ID NO: 2394228 - protein, 18 aa, Entamoeba dispar
LTEDILLFDCYKISNFTP

SEQ ID NO: 2394229 - protein, 17 aa, Entamoeba dispar
LTHCFTFPGNSSKVEGI

SEQ ID NO: 2394230 - protein, 21 aa, Entamoeba dispar
LTKCKMCIICLKELLLLLRYT

SEQ ID NO: 2394231 - protein, 19 aa, Entamoeba dispar
LTNNCGWCSVTKKCGYCED

SEQ ID NO: 2394232 - protein, 19 aa, Entamoeba dispar
LTRIVPLYLAVHIFAESPC

SEQ ID NO: 2394233 - protein, 23 aa, Entamoeba dispar
LVDALKLKGYRIIENSNIIAQYL

SEQ ID NO: 2394234 - protein, 17 aa, Entamoeba dispar
LVFLCLYISFPLTITET

SEQ ID NO: 2394235 - protein, 17 aa, Entamoeba dispar
LVFREIRGIKNFIFFGC

SEQ ID NO: 2394236 - protein, 17 aa, Entamoeba dispar
LVGSFLSVGFFTEYLTK

SEQ ID NO: 2394237 - protein, 17 aa, Entamoeba dispar
LVILLLILYFVFFKMDW

SEQ ID NO: 2394238 - protein, 22 aa, Entamoeba dispar
LVKERVPVIFAFAMNGKRKELF

SEQ ID NO: 2394239 - protein, 21 aa, Entamoeba dispar
LVLFIWRFVIRRIIHPNPIQK

SEQ ID NO: 2394240 - protein, 24 aa, Entamoeba dispar
LVLFLGVIFYKWIYPLLYKLISSL

SEQ ID NO: 2394241 - protein, 24 aa, Entamoeba dispar
LVLKMPFPLSYRFKLITQQGLGGM

SEQ ID NO: 2394242 - protein, 17 aa, Entamoeba dispar
LVLNVGVTKSPLKNEGN

SEQ ID NO: 2394243 - protein, 23 aa, Entamoeba dispar
LVLSELLILFSILFYFYPYFLMF

SEQ ID NO: 2394244 - protein, 20 aa, Entamoeba dispar
LVPVWWNFIVVIIIISIIIK

SEQ ID NO: 2394245 - protein, 17 aa, Entamoeba dispar
LVRSVRTGMRYIQEYDL

SEQ ID NO: 2394246 - protein, 17 aa, Entamoeba dispar
LVYKIIGGIGMFALVVV

SEQ ID NO: 2394247 - protein, 17 aa, Entamoeba dispar
LWESHFMLFIPLIIILI

SEQ ID NO: 2394248 - protein, 21 aa, Entamoeba dispar
LWFTLEFISFIGIFYSFVTLH

SEQ ID NO: 2394249 - protein, 21 aa, Entamoeba dispar
LWRSACSLLDYIKGIMRKPTC

SEQ ID NO: 2394250 - protein, 18 aa, Entamoeba dispar
LYGLFSMFVALWVLLFFF

SEQ ID NO: 2394251 - protein, 20 aa, Entamoeba dispar
LYHAYFRFLARYAAENPNLV

SEQ ID NO: 2394252 - protein, 17 aa, Entamoeba dispar
LYLWNFIHQQRDILDIE

SEQ ID NO: 2394253 - protein, 17 aa, Entamoeba dispar
LYSIFSYYLIIHHLVLF

SEQ ID NO: 2394254 - protein, 20 aa, Entamoeba dispar
LYVACGWCLFTIVRIHYTSD

SEQ ID NO: 2394255 - protein, 17 aa, Entamoeba dispar
LYYEWKVALCVIATSPI

SEQ ID NO: 2394256 - protein, 19 aa, Entamoeba dispar
LYYKHYPAFEVDSIVDVHG

SEQ ID NO: 2394257 - protein, 17 aa, Entamoeba dispar
LYYPYSIELSWLYNENE

SEQ ID NO: 2394258 - protein, 23 aa, Entamoeba dispar
LYYYKDLCCFCIEKDQLSSWMTI

SEQ ID NO: 2394259 - protein, 19 aa, Entamoeba dispar
MAGFLTERIEVIVNTLSQI

SEQ ID NO: 2394260 - protein, 19 aa, Entamoeba dispar
MCFGFGFALYYNWKLALCV

SEQ ID NO: 2394261 - protein, 19 aa, Entamoeba dispar
MCVIDLIGIMYLWGVELNA

SEQ ID NO: 2394262 - protein, 17 aa, Entamoeba dispar
MFAILSMVFFLVSTIII

SEQ ID NO: 2394263 - protein, 23 aa, Entamoeba dispar
MFIFPRYLSIFSIAVYLSTIIIR

SEQ ID NO: 2394264 - protein, 23 aa, Entamoeba dispar
MFIKCPECMVALLIAPVLSANES

SEQ ID NO: 2394265 - protein, 17 aa, Entamoeba dispar
MFPVVWSAYWGKDPYGA

SEQ ID NO: 2394266 - protein, 21 aa, Entamoeba dispar
MGGLKPSWEIAYCSWEESINY

SEQ ID NO: 2394267 - protein, 19 aa, Entamoeba dispar
MIALFCVTIFYAILVLIVI

SEQ ID NO: 2394268 - protein, 19 aa, Entamoeba dispar
MIECGGIVLQECKTDTITY

SEQ ID NO: 2394269 - protein, 23 aa, Entamoeba dispar
MIRPYSKYIICWFGLDTLQLLNF

SEQ ID NO: 2394270 - protein, 17 aa, Entamoeba dispar
MKEGIPIVLTGHSLGGG

SEQ ID NO: 2394271 - protein, 19 aa, Entamoeba dispar
MKRVCIIPIWLSHEDYPYL

SEQ ID NO: 2394272 - protein, 24 aa, Entamoeba dispar
MKRVLKYLVYWLLNGTVCIANFFA

SEQ ID NO: 2394273 - protein, 17 aa, Entamoeba dispar
MKSICLLTRYLNGDQTT

SEQ ID NO: 2394274 - protein, 18 aa, Entamoeba dispar
MKSKGCLEFESYDNLLQL

SEQ ID NO: 2394275 - protein, 17 aa, Entamoeba dispar
MKYSWILFTILFKGIVM

SEQ ID NO: 2394276 - protein, 17 aa, Entamoeba dispar
MLCPEGFYSDGTQCLHC

SEQ ID NO: 2394277 - protein, 17 aa, Entamoeba dispar
MLCSIAFLSLLIETISF

SEQ ID NO: 2394278 - protein, 25 aa, Entamoeba dispar
MLIATVITICFSRFFTVCVYDKIAI

SEQ ID NO: 2394279 - protein, 17 aa, Entamoeba dispar
MLICIFAPFKQKINEPS

SEQ ID NO: 2394280 - protein, 23 aa, Entamoeba dispar
MLLMFCIGIFWIIVGTLILISSE

SEQ ID NO: 2394281 - protein, 17 aa, Entamoeba dispar
MLNLRPGFVNFLCMWGA

SEQ ID NO: 2394282 - protein, 18 aa, Entamoeba dispar
MLYLCVRNSFNVWLTIAN

SEQ ID NO: 2394283 - protein, 17 aa, Entamoeba dispar
MMICYAICDVIPMYLPV

SEQ ID NO: 2394284 - protein, 23 aa, Entamoeba dispar
MMSLFIWRVIRKMIKNNPENFWL

SEQ ID NO: 2394285 - protein, 25 aa, Entamoeba dispar
MNEPIRWRKHYHSWNIFFLSGSVIF

SEQ ID NO: 2394286 - protein, 20 aa, Entamoeba dispar
MNFILSCLIIFIANAETVSF

SEQ ID NO: 2394287 - protein, 19 aa, Entamoeba dispar
MNGSSKWWYSVVIYEHTLG

SEQ ID NO: 2394288 - protein, 25 aa, Entamoeba dispar
MNLFYKRIGLGIAFYMLVWAISIFE

SEQ ID NO: 2394289 - protein, 17 aa, Entamoeba dispar
MNQSIVMLWRLLKRENT

SEQ ID NO: 2394290 - protein, 21 aa, Entamoeba dispar
MPMLMVFGSFIFFCINPSMCS

SEQ ID NO: 2394291 - protein, 17 aa, Entamoeba dispar
MPSRISPELAYVGFFQM

SEQ ID NO: 2394292 - protein, 17 aa, Entamoeba dispar
MQVKLLWLCLCNVLSSS

SEQ ID NO: 2394293 - protein, 22 aa, Entamoeba dispar
MRIKQCTLWEIIKKEFLLKNIV

SEQ ID NO: 2394294 - protein, 22 aa, Entamoeba dispar
MRNLRVVFLLVFIIFFTLNVRS

SEQ ID NO: 2394295 - protein, 20 aa, Entamoeba dispar
MRTTISLPFYFYSVRFLGKI

SEQ ID NO: 2394296 - protein, 25 aa, Entamoeba dispar
MSDFLKIRFCQDIARGMEYLHENDI

SEQ ID NO: 2394297 - protein, 25 aa, Entamoeba dispar
MSECFDHRFCLHLGEGHWHNERLRE

SEQ ID NO: 2394298 - protein, 23 aa, Entamoeba dispar
MSKICSVSGCVSLGLSEINEIGE

SEQ ID NO: 2394299 - protein, 17 aa, Entamoeba dispar
MTDCLKKIDGEKKLVEY

SEQ ID NO: 2394300 - protein, 18 aa, Entamoeba dispar
MTPLFPPVMRLFNYLDQN

SEQ ID NO: 2394301 - protein, 18 aa, Entamoeba dispar
MTVVRGWFGGEVMERDKP

SEQ ID NO: 2394302 - protein, 18 aa, Entamoeba dispar
MVAYCIRWYSDLDIPKEL

SEQ ID NO: 2394303 - protein, 18 aa, Entamoeba dispar
MYFKSCKLVNWSSVPKLI

SEQ ID NO: 2394304 - protein, 19 aa, Entamoeba dispar
MYIPEIIYLLNLIGSVFTT

SEQ ID NO: 2394305 - protein, 24 aa, Entamoeba dispar
MYLLKEIFNFIVIVFAFMGGLLIY

SEQ ID NO: 2394306 - protein, 18 aa, Entamoeba dispar
MYWFECLFNAKKYHNIIE

SEQ ID NO: 2394307 - protein, 24 aa, Entamoeba dispar
NADRLEVRYGVFGRVFGQRAVAWA

SEQ ID NO: 2394308 - protein, 18 aa, Entamoeba dispar
NALGSWYGNFVVRGKGGT

SEQ ID NO: 2394309 - protein, 18 aa, Entamoeba dispar
NAMLRYVYDGIKIDQYLY

SEQ ID NO: 2394310 - protein, 17 aa, Entamoeba dispar
NAVKFIKLEFEKCYRTS

SEQ ID NO: 2394311 - protein, 26 aa, Entamoeba dispar
NCKECYKDKCILCFGNDIVISGICYP

SEQ ID NO: 2394312 - protein, 17 aa, Entamoeba dispar
NCKRIAEQMLFGIKDLT

SEQ ID NO: 2394313 - protein, 17 aa, Entamoeba dispar
NCLYRFNLLLSSNITHL

SEQ ID NO: 2394314 - protein, 23 aa, Entamoeba dispar
NCQKESNCAFIFEDQEQITLHIP

SEQ ID NO: 2394315 - protein, 18 aa, Entamoeba dispar
NDCIYQFSSYYIGGAGVN

SEQ ID NO: 2394316 - protein, 23 aa, Entamoeba dispar
NDLLKIRFCQDISRGMEYLHQND

SEQ ID NO: 2394317 - protein, 22 aa, Entamoeba dispar
NDMFKIRFSFQNGRIITPYIPI

SEQ ID NO: 2394318 - protein, 17 aa, Entamoeba dispar
NECASCIEPAYQWDCHN

SEQ ID NO: 2394319 - protein, 17 aa, Entamoeba dispar
NEFKELMNIIGINPVFI

SEQ ID NO: 2394320 - protein, 17 aa, Entamoeba dispar
NEFLMILLLRLSPLFPF

SEQ ID NO: 2394321 - protein, 23 aa, Entamoeba dispar
NEFPYPWSISKFVCVGRRLPQHP

SEQ ID NO: 2394322 - protein, 21 aa, Entamoeba dispar
NEKYIAEILLHFEKLAKKELW

SEQ ID NO: 2394323 - protein, 17 aa, Entamoeba dispar
NELIPIFTIFSNLSQQI

SEQ ID NO: 2394324 - protein, 19 aa, Entamoeba dispar
NELLFKIMTLIGLNDIVFT

SEQ ID NO: 2394325 - protein, 23 aa, Entamoeba dispar
NELLKRILKIIALYPKSNQVLIN

SEQ ID NO: 2394326 - protein, 17 aa, Entamoeba dispar
NEMEWYCAIFIFQQKNN

SEQ ID NO: 2394327 - protein, 22 aa, Entamoeba dispar
NEYCLKCPKGTFSQDLQNCKEE

SEQ ID NO: 2394328 - protein, 17 aa, Entamoeba dispar
NEYKFKECTGITTNIEK

SEQ ID NO: 2394329 - protein, 18 aa, Entamoeba dispar
NFGPRGTLIFSFIFGTIG

SEQ ID NO: 2394330 - protein, 19 aa, Entamoeba dispar
NFISRFGVKFTITSNNNHL

SEQ ID NO: 2394331 - protein, 20 aa, Entamoeba dispar
NFLCMWGALVLTTFTSQGMY

SEQ ID NO: 2394332 - protein, 18 aa, Entamoeba dispar
NGCVSFKHSITFETTPTL

SEQ ID NO: 2394333 - protein, 17 aa, Entamoeba dispar
NGEICPIPHSFLIFIRI

SEQ ID NO: 2394334 - protein, 17 aa, Entamoeba dispar
NGEIRYGNWKIIKVESN

SEQ ID NO: 2394335 - protein, 21 aa, Entamoeba dispar
NGFRFVMCIIISMQIIRNIFF

SEQ ID NO: 2394336 - protein, 23 aa, Entamoeba dispar
NGGPETWKGISILINTNENNKQN

SEQ ID NO: 2394337 - protein, 26 aa, Entamoeba dispar
NGIMIIRIELPFGIWCDGCKNLIGKG

SEQ ID NO: 2394338 - protein, 22 aa, Entamoeba dispar
NGNFPFIWGFFMLCSLSYWISF

SEQ ID NO: 2394339 - protein, 17 aa, Entamoeba dispar
NGTYRFSLLPSFSQMRF

SEQ ID NO: 2394340 - protein, 17 aa, Entamoeba dispar
NGYYYSIIFGISFIVLL

SEQ ID NO: 2394341 - protein, 23 aa, Entamoeba dispar
NIAPALVCCRLFFRLTKQSKIYL

SEQ ID NO: 2394342 - protein, 17 aa, Entamoeba dispar
NIFLSFIHRYFNKSYLG

SEQ ID NO: 2394343 - protein, 17 aa, Entamoeba dispar
NIGSAILHCIGYFSLFV

SEQ ID NO: 2394344 - protein, 20 aa, Entamoeba dispar
NIIPRLVLNVGVTKSPLKNE

SEQ ID NO: 2394345 - protein, 18 aa, Entamoeba dispar
NIITRWYIIISIGLIAFS

SEQ ID NO: 2394346 - protein, 18 aa, Entamoeba dispar
NIKFVVQCLYRFVTHSTS

SEQ ID NO: 2394347 - protein, 22 aa, Entamoeba dispar
NIKMEFANLILLNSDYEVETFV

SEQ ID NO: 2394348 - protein, 26 aa, Entamoeba dispar
NIKSRLRISLLYTWCVILILNNVRIQ

SEQ ID NO: 2394349 - protein, 23 aa, Entamoeba dispar
NILQRLQNIFARIIGIAFQQQNV

SEQ ID NO: 2394350 - protein, 18 aa, Entamoeba dispar
NITGYCVVGFKGLKHRIY

SEQ ID NO: 2394351 - protein, 22 aa, Entamoeba dispar
NKDFRFSTEFEYGGSQSDKKVL

SEQ ID NO: 2394352 - protein, 23 aa, Entamoeba dispar
NKEGCIYHVIWWIVLLEIIIALF

SEQ ID NO: 2394353 - protein, 19 aa, Entamoeba dispar
NKIGSLVHLLKCSGIISQK

SEQ ID NO: 2394354 - protein, 20 aa, Entamoeba dispar
NKIGSLVHLLKCSGIISQKT

SEQ ID NO: 2394355 - protein, 24 aa, Entamoeba dispar
NKKKFKMMFEWGRIGDKLKRTYRE

SEQ ID NO: 2394356 - protein, 18 aa, Entamoeba dispar
NKKVNCKIKECYNSLECL

SEQ ID NO: 2394357 - protein, 18 aa, Entamoeba dispar
NKMKDIFETIGFTTTTLN

SEQ ID NO: 2394358 - protein, 23 aa, Entamoeba dispar
NKVECPYWLAPECIINKKACLKS

SEQ ID NO: 2394359 - protein, 19 aa, Entamoeba dispar
NLECHKGCILEFISVTSLH

SEQ ID NO: 2394360 - protein, 22 aa, Entamoeba dispar
NLLIDILLEFGFFFDSKMARHS

SEQ ID NO: 2394361 - protein, 18 aa, Entamoeba dispar
NLLNRLAVCIGKKDELPN

SEQ ID NO: 2394362 - protein, 20 aa, Entamoeba dispar
NLLRCIIEVLGIQMNSTQLA

SEQ ID NO: 2394363 - protein, 17 aa, Entamoeba dispar
NLLRLVFNLKVFELNTE

SEQ ID NO: 2394364 - protein, 24 aa, Entamoeba dispar
NLSKYQLRCCFLRGFPGVQKFKTL

SEQ ID NO: 2394365 - protein, 20 aa, Entamoeba dispar
NMLFDICLELGYFFTLKKSR

SEQ ID NO: 2394366 - protein, 20 aa, Entamoeba dispar
NNIICGFPFKIQESESRCLC

SEQ ID NO: 2394367 - protein, 23 aa, Entamoeba dispar
NNIRPQIFVGISMFNVLPAFSFS

SEQ ID NO: 2394368 - protein, 18 aa, Entamoeba dispar
NNKCSKCSFWYEINEEGT

SEQ ID NO: 2394369 - protein, 19 aa, Entamoeba dispar
NNKCSKCSFWYGINEDGTK

SEQ ID NO: 2394370 - protein, 18 aa, Entamoeba dispar
NNKCSKCSFWYGINEEGT

SEQ ID NO: 2394371 - protein, 19 aa, Entamoeba dispar
NNKRLLCRSLIYNPEPYYS

SEQ ID NO: 2394372 - protein, 19 aa, Entamoeba dispar
NNLPPRLKFNAHRRFTTKK

SEQ ID NO: 2394373 - protein, 18 aa, Entamoeba dispar
NNYPRWLMWGSVVNGNQT

SEQ ID NO: 2394374 - protein, 23 aa, Entamoeba dispar
NPIWKGSDCSFLIQRNNQIQSID

SEQ ID NO: 2394375 - protein, 21 aa, Entamoeba dispar
NPMRYWRIGVLFGGTIYVIIL

SEQ ID NO: 2394376 - protein, 19 aa, Entamoeba dispar
NPQQAFCPRCNTMVTTVVR

SEQ ID NO: 2394377 - protein, 19 aa, Entamoeba dispar
NPRLFCGIFEEFLGNGIEE

SEQ ID NO: 2394378 - protein, 18 aa, Entamoeba dispar
NPRLSEIDLLYSSNLTNA

SEQ ID NO: 2394379 - protein, 22 aa, Entamoeba dispar
NPSRLSKWLPIISLVYSQHLDQ

SEQ ID NO: 2394380 - protein, 18 aa, Entamoeba dispar
NQQCVACPAGYFQSKNEC

SEQ ID NO: 2394381 - protein, 19 aa, Entamoeba dispar
NRFFTLQGMRVLAFGYKVI

SEQ ID NO: 2394382 - protein, 18 aa, Entamoeba dispar
NRKGVSFGKPGSNQVLEK

SEQ ID NO: 2394383 - protein, 22 aa, Entamoeba dispar
NRNSSIYSVCWSFGKSLGYLFG

SEQ ID NO: 2394384 - protein, 21 aa, Entamoeba dispar
NRSSGLLIWTIWTIMTILAVT

SEQ ID NO: 2394385 - protein, 20 aa, Entamoeba dispar
NRTAISFSWLLQYAEQNGVS

SEQ ID NO: 2394386 - protein, 19 aa, Entamoeba dispar
NRVVELFVNFILSAKNLKH

SEQ ID NO: 2394387 - protein, 25 aa, Entamoeba dispar
NRYRLEFRINLILSKCHGFSNFYIL

SEQ ID NO: 2394388 - protein, 18 aa, Entamoeba dispar
NSCGYCRSSTLSFCGICG

SEQ ID NO: 2394389 - protein, 24 aa, Entamoeba dispar
NSDTCPICYSLFYLRTTTIPNVAC

SEQ ID NO: 2394390 - protein, 17 aa, Entamoeba dispar
NSLRLVSFVLKKPIKPE

SEQ ID NO: 2394391 - protein, 22 aa, Entamoeba dispar
NSNKCKLCFDGFVLNGLNCLSY

SEQ ID NO: 2394392 - protein, 17 aa, Entamoeba dispar
NSTAAQCFLCKQKVVED

SEQ ID NO: 2394393 - protein, 26 aa, Entamoeba dispar
NTLFKYPHLKSHWSLSQFFLWITVFV

SEQ ID NO: 2394394 - protein, 18 aa, Entamoeba dispar
NVIPLCSRATIDILIGQN

SEQ ID NO: 2394395 - protein, 17 aa, Entamoeba dispar
NWFQFKMTLRIVDYNLS

SEQ ID NO: 2394396 - protein, 18 aa, Entamoeba dispar
NYEFPAILLIVLGYSLIN

SEQ ID NO: 2394397 - protein, 22 aa, Entamoeba dispar
NYLFKRLNQFFGQKLNFESIGI

SEQ ID NO: 2394398 - protein, 20 aa, Entamoeba dispar
NYLRLPYKLKIRMLFDTARG

SEQ ID NO: 2394399 - protein, 20 aa, Entamoeba dispar
PAGDGFFLQWMMSIGILIIG

SEQ ID NO: 2394400 - protein, 17 aa, Entamoeba dispar
PCDCPICLCLIEDSSDV

SEQ ID NO: 2394401 - protein, 18 aa, Entamoeba dispar
PCTMPRWKLYDEELTECW

SEQ ID NO: 2394402 - protein, 20 aa, Entamoeba dispar
PEKIPFRLTRMIVNAMDVSG

SEQ ID NO: 2394403 - protein, 21 aa, Entamoeba dispar
PEKRYFFFFTFHDDNLFINFN

SEQ ID NO: 2394404 - protein, 23 aa, Entamoeba dispar
PEMKSLCPHTPFFLIATQSEKRN

SEQ ID NO: 2394405 - protein, 20 aa, Entamoeba dispar
PEMMRLPIIQGFIGRSECAV

SEQ ID NO: 2394406 - protein, 19 aa, Entamoeba dispar
PEPMYKLYISIEEAMNGCQ

SEQ ID NO: 2394407 - protein, 23 aa, Entamoeba dispar
PEPSFPWFYKLWRVQGYYNLLIL

SEQ ID NO: 2394408 - protein, 20 aa, Entamoeba dispar
PEQFKSLLLVYGPFVSSIKL

SEQ ID NO: 2394409 - protein, 20 aa, Entamoeba dispar
PESLSITFLVMWLGGDITNL

SEQ ID NO: 2394410 - protein, 23 aa, Entamoeba dispar
PESYKYWHHWALINFEIVSYIEL

SEQ ID NO: 2394411 - protein, 21 aa, Entamoeba dispar
PEVLNGLPFTKSGDVFSFAIA

SEQ ID NO: 2394412 - protein, 18 aa, Entamoeba dispar
PFAEFDCNLYATNMESPL

SEQ ID NO: 2394413 - protein, 19 aa, Entamoeba dispar
PFCDFQDLFSIKSHVLAGY

SEQ ID NO: 2394414 - protein, 18 aa, Entamoeba dispar
PFGKLIGKFKTLRQFCQL

SEQ ID NO: 2394415 - protein, 19 aa, Entamoeba dispar
PFGKLIGKFKTLRQFCQLW

SEQ ID NO: 2394416 - protein, 23 aa, Entamoeba dispar
PFIKEIRIHYGICNGHNGMFCAI

SEQ ID NO: 2394417 - protein, 18 aa, Entamoeba dispar
PFILKFLFFIIFAVVIGG

SEQ ID NO: 2394418 - protein, 22 aa, Entamoeba dispar
PFMFIVWFIPQWIKSLKRIGII

SEQ ID NO: 2394419 - protein, 18 aa, Entamoeba dispar
PHKIHLECYLKDYEDSGN

SEQ ID NO: 2394420 - protein, 19 aa, Entamoeba dispar
PHKYCWREGDDLYINIKGC

SEQ ID NO: 2394421 - protein, 21 aa, Entamoeba dispar
PHLLEYYALWFSRLFTGDLGI

SEQ ID NO: 2394422 - protein, 17 aa, Entamoeba dispar
PIIPMFILCSIFITHRS

SEQ ID NO: 2394423 - protein, 21 aa, Entamoeba dispar
PIKKCCIHPNLIIMTDHFHTI

SEQ ID NO: 2394424 - protein, 18 aa, Entamoeba dispar
PIRIEEILSYGIILTSKN

SEQ ID NO: 2394425 - protein, 18 aa, Entamoeba dispar
PKASPWRYGTTLTTLFVE

SEQ ID NO: 2394426 - protein, 20 aa, Entamoeba dispar
PKFILEYIVAISICLSLFGT

SEQ ID NO: 2394427 - protein, 19 aa, Entamoeba dispar
PKFTCQWIELFSHRNVLYE

SEQ ID NO: 2394428 - protein, 17 aa, Entamoeba dispar
PKILVSYVDHYFEKPNK

SEQ ID NO: 2394429 - protein, 21 aa, Entamoeba dispar
PKLIKHWLFWYVFSMIIFVFS

SEQ ID NO: 2394430 - protein, 17 aa, Entamoeba dispar
PKQSFKFAWDVAEFIES

SEQ ID NO: 2394431 - protein, 22 aa, Entamoeba dispar
PKSWELLKEFIIILFIIILSRT

SEQ ID NO: 2394432 - protein, 18 aa, Entamoeba dispar
PLIYLTRFVPFTFIRKYR

SEQ ID NO: 2394433 - protein, 17 aa, Entamoeba dispar
PLLFGFLVAISRVRDYF

SEQ ID NO: 2394434 - protein, 18 aa, Entamoeba dispar
PLMYCLLIVFGLTIILSF

SEQ ID NO: 2394435 - protein, 18 aa, Entamoeba dispar
PLPDHRSSALSAQGSLLT

SEQ ID NO: 2394436 - protein, 23 aa, Entamoeba dispar
PLQRRLLVVILMNLVLISMLIYL

SEQ ID NO: 2394437 - protein, 17 aa, Entamoeba dispar
PLYLEFYSMFSAGHFII

SEQ ID NO: 2394438 - protein, 17 aa, Entamoeba dispar
PMLPTMIPIILKRVNLN

SEQ ID NO: 2394439 - protein, 18 aa, Entamoeba dispar
PNQCGIVFCLSKKDCENL

SEQ ID NO: 2394440 - protein, 18 aa, Entamoeba dispar
PNVICKYIEWGRIEVIKE

SEQ ID NO: 2394441 - protein, 20 aa, Entamoeba dispar
PPIYVAGCGLLFGTLAIIIA

SEQ ID NO: 2394442 - protein, 19 aa, Entamoeba dispar
PPSSLRLDAEWLLNNIASH

SEQ ID NO: 2394443 - protein, 19 aa, Entamoeba dispar
PQCISCSNILFLEANSRKI

SEQ ID NO: 2394444 - protein, 17 aa, Entamoeba dispar
PQCLTRFLLTTDKITGV

SEQ ID NO: 2394445 - protein, 17 aa, Entamoeba dispar
PQGKWCGPIICVIPAGD

SEQ ID NO: 2394446 - protein, 24 aa, Entamoeba dispar
PQLLFVIRWFFSFLLDPMNSVILS

SEQ ID NO: 2394447 - protein, 18 aa, Entamoeba dispar
PQTFPIVFAPSSNVRFRD

SEQ ID NO: 2394448 - protein, 21 aa, Entamoeba dispar
PQWLMKRLSLVDGDYIDIQTV

SEQ ID NO: 2394449 - protein, 20 aa, Entamoeba dispar
PRGTLIFSFIFGTIGYLLFA

SEQ ID NO: 2394450 - protein, 23 aa, Entamoeba dispar
PRHAYRLLSVFLLKAVSIMNEQP

SEQ ID NO: 2394451 - protein, 17 aa, Entamoeba dispar
PRKAVVFTVLIKPLVCC

SEQ ID NO: 2394452 - protein, 21 aa, Entamoeba dispar
PRKYRYCFEIKTAAASSTHID

SEQ ID NO: 2394453 - protein, 19 aa, Entamoeba dispar
PRLLLRIKYEYPFEMIEKG

SEQ ID NO: 2394454 - protein, 25 aa, Entamoeba dispar
PSFLIICFYVYLSFVIDKHIVNVIN

SEQ ID NO: 2394455 - protein, 20 aa, Entamoeba dispar
PSGCKSFLKEAGFETEDNVA

SEQ ID NO: 2394456 - protein, 23 aa, Entamoeba dispar
PSGHSGCTFAFLRINQPVDNVDK

SEQ ID NO: 2394457 - protein, 17 aa, Entamoeba dispar
PSILKDIFESVGSKQIP

SEQ ID NO: 2394458 - protein, 23 aa, Entamoeba dispar
PSLFKKRLPGIEVLYPNLMVTME

SEQ ID NO: 2394459 - protein, 24 aa, Entamoeba dispar
PSLIPYKCMIAGWFTYNGSIIDDN

SEQ ID NO: 2394460 - protein, 22 aa, Entamoeba dispar
PSLKQLHIFGAVFAENGFFQRS

SEQ ID NO: 2394461 - protein, 17 aa, Entamoeba dispar
PSSLKRLYCQREQLPHC

SEQ ID NO: 2394462 - protein, 20 aa, Entamoeba dispar
PSSLLIRRKLVLIAFQCLQS

SEQ ID NO: 2394463 - protein, 25 aa, Entamoeba dispar
PSYNIWLLICTAIFGALIIITATSS

SEQ ID NO: 2394464 - protein, 19 aa, Entamoeba dispar
PTCLKEFISSGFIYDENDI

SEQ ID NO: 2394465 - protein, 28 aa, Entamoeba dispar
PTFEPSFVFSLGFWWRVAIITLINSFPF

SEQ ID NO: 2394466 - protein, 23 aa, Entamoeba dispar
PTFKDKWWPSGVMDFFTMAPFIT

SEQ ID NO: 2394467 - protein, 24 aa, Entamoeba dispar
PTKDFWRHVCIVWAKCFYYTSEKT

SEQ ID NO: 2394468 - protein, 17 aa, Entamoeba dispar
PTKEVFLLLKLFIDEHI

SEQ ID NO: 2394469 - protein, 21 aa, Entamoeba dispar
PTPIIPFCFLDFIKQQENCKL

SEQ ID NO: 2394470 - protein, 23 aa, Entamoeba dispar
PTSMPFHYFMLFVRMLISLTNSI

SEQ ID NO: 2394471 - protein, 18 aa, Entamoeba dispar
PVCICCWFLNLFQNKKTR

SEQ ID NO: 2394472 - protein, 19 aa, Entamoeba dispar
PVKPFRLFIPMSFINEIPF

SEQ ID NO: 2394473 - protein, 22 aa, Entamoeba dispar
PVSEFWGHVCIVWNKCYYFFSQ

SEQ ID NO: 2394474 - protein, 18 aa, Entamoeba dispar
PWSISKFVCVGRRLPQPL

SEQ ID NO: 2394475 - protein, 18 aa, Entamoeba dispar
PYWLAPEVILNNHFTEAS

SEQ ID NO: 2394476 - protein, 17 aa, Entamoeba dispar
QCIEIIGPSLIPYKCMI

SEQ ID NO: 2394477 - protein, 19 aa, Entamoeba dispar
QCIICLILSILSGHSHSII

SEQ ID NO: 2394478 - protein, 19 aa, Entamoeba dispar
QCIRLNAMITQACGENDDF

SEQ ID NO: 2394479 - protein, 18 aa, Entamoeba dispar
QDGCGRTPLHIAVIKNDA

SEQ ID NO: 2394480 - protein, 18 aa, Entamoeba dispar
QDGMSLKFGRLFQTFSSF

SEQ ID NO: 2394481 - protein, 17 aa, Entamoeba dispar
QEFRIDIILNHILFTGT

SEQ ID NO: 2394482 - protein, 20 aa, Entamoeba dispar
QEIIDRINLFPGVTNGLKKS

SEQ ID NO: 2394483 - protein, 22 aa, Entamoeba dispar
QEKRSKCWLATQILRIDFISVL

SEQ ID NO: 2394484 - protein, 23 aa, Entamoeba dispar
QELTRTSNYWAYQATNGNPITTP

SEQ ID NO: 2394485 - protein, 20 aa, Entamoeba dispar
QFGFRSSRRIEWVESLNKII

SEQ ID NO: 2394486 - protein, 20 aa, Entamoeba dispar
QFISLEFFTSLLLIKQNQKL

SEQ ID NO: 2394487 - protein, 24 aa, Entamoeba dispar
QFNPMVIVKYSWFFFDLIIRSLVY

SEQ ID NO: 2394488 - protein, 18 aa, Entamoeba dispar
QFTEARSAISFGPLSDTP

SEQ ID NO: 2394489 - protein, 17 aa, Entamoeba dispar
QFVKLCYSFLFIQNLTS

SEQ ID NO: 2394490 - protein, 22 aa, Entamoeba dispar
QHLPKVFLLFCVYSWTTFVFSY

SEQ ID NO: 2394491 - protein, 25 aa, Entamoeba dispar
QIEDECYRCPPGTYSDKYNCIPCPE

SEQ ID NO: 2394492 - protein, 22 aa, Entamoeba dispar
QIKRLHVFGEIFAENGYFVRSD

SEQ ID NO: 2394493 - protein, 17 aa, Entamoeba dispar
QKFPFNAHFTFFVMAVV

SEQ ID NO: 2394494 - protein, 18 aa, Entamoeba dispar
QKHFLSILITCFFSLFLF

SEQ ID NO: 2394495 - protein, 19 aa, Entamoeba dispar
QKIRIVDHYSVLKGLTVGL

SEQ ID NO: 2394496 - protein, 17 aa, Entamoeba dispar
QKKEFRIPISIFIDQQF

SEQ ID NO: 2394497 - protein, 20 aa, Entamoeba dispar
QKKSMKWIYSIIIIPVIIAI

SEQ ID NO: 2394498 - protein, 20 aa, Entamoeba dispar
QKRYRFAIKILKRNLKKIGL

SEQ ID NO: 2394499 - protein, 19 aa, Entamoeba dispar
QLCLCPLCINGIPNYSDTK

SEQ ID NO: 2394500 - protein, 18 aa, Entamoeba dispar
QLILCPASLFISINRSVL

SEQ ID NO: 2394501 - protein, 22 aa, Entamoeba dispar
QLLKSIWVYKFFVQLIQKLNTK

SEQ ID NO: 2394502 - protein, 18 aa, Entamoeba dispar
QLPFGKNPQQAFCPRCNT

SEQ ID NO: 2394503 - protein, 25 aa, Entamoeba dispar
QLQIKWLRKFFIQEIIKLIEKSSSE

SEQ ID NO: 2394504 - protein, 24 aa, Entamoeba dispar
QMAKIWYSQRLEWMGFTISTFTVL

SEQ ID NO: 2394505 - protein, 21 aa, Entamoeba dispar
QNFISRFGVKFTITSNNNHLK

SEQ ID NO: 2394506 - protein, 25 aa, Entamoeba dispar
QNKIKLCSLLTCFRRSSALQIDTMI

SEQ ID NO: 2394507 - protein, 17 aa, Entamoeba dispar
QNLTNIWAFSSEHKYDF

SEQ ID NO: 2394508 - protein, 22 aa, Entamoeba dispar
QNMIISFFLCWFVIGIGAICGF

SEQ ID NO: 2394509 - protein, 19 aa, Entamoeba dispar
QNNWWSILQFIIWSIIITL

SEQ ID NO: 2394510 - protein, 25 aa, Entamoeba dispar
QNTVWRFSFPYSFLETFRHNYNYDE

SEQ ID NO: 2394511 - protein, 20 aa, Entamoeba dispar
QNVFFKWIFNQVNMDYSIKR

SEQ ID NO: 2394512 - protein, 18 aa, Entamoeba dispar
QPDIIPMIIIYTLIPIII

SEQ ID NO: 2394513 - protein, 20 aa, Entamoeba dispar
QPTVCPFKVFPKIYVKKQTD

SEQ ID NO: 2394514 - protein, 23 aa, Entamoeba dispar
QQELKKGLTLIGFRISDFNNDIT

SEQ ID NO: 2394515 - protein, 19 aa, Entamoeba dispar
QQHMPVFYGLWIVYGIILL

SEQ ID NO: 2394516 - protein, 18 aa, Entamoeba dispar
QQIYKILVCFFARDLNIH

SEQ ID NO: 2394517 - protein, 17 aa, Entamoeba dispar
QQSPCVFGFHFTTIPNH

SEQ ID NO: 2394518 - protein, 17 aa, Entamoeba dispar
QRAMCRKKVNIIFYTVL

SEQ ID NO: 2394519 - protein, 17 aa, Entamoeba dispar
QRFGLGIALYFDFLYYV

SEQ ID NO: 2394520 - protein, 21 aa, Entamoeba dispar
QRVEPLLGFINGFFLVLFSAF

SEQ ID NO: 2394521 - protein, 22 aa, Entamoeba dispar
QRVIPILLHFGSLFKQNSLVVI

SEQ ID NO: 2394522 - protein, 17 aa, Entamoeba dispar
QRYNGFCKIPFPDRTCE

SEQ ID NO: 2394523 - protein, 18 aa, Entamoeba dispar
QSFKFAWDVAEFIESGNH

SEQ ID NO: 2394524 - protein, 22 aa, Entamoeba dispar
QSSFYSLVAWCMGTTEHLDYFD

SEQ ID NO: 2394525 - protein, 23 aa, Entamoeba dispar
QTLTDFYLFFSIVAEQQPIDLSK

SEQ ID NO: 2394526 - protein, 26 aa, Entamoeba dispar
QWVLRSCVLIAYFFCFILYFFMNILH

SEQ ID NO: 2394527 - protein, 17 aa, Entamoeba dispar
QYLSSFVHFEFTGIKET

SEQ ID NO: 2394528 - protein, 19 aa, Entamoeba dispar
RAHLQWRCGYIQYITSIII

SEQ ID NO: 2394529 - protein, 17 aa, Entamoeba dispar
RAPCSFTKVIYCTIPSC

SEQ ID NO: 2394530 - protein, 21 aa, Entamoeba dispar
RAVIKREWWPFLLSLIAISIS

SEQ ID NO: 2394531 - protein, 17 aa, Entamoeba dispar
RCHFVIIGNSIVFLLII

SEQ ID NO: 2394532 - protein, 23 aa, Entamoeba dispar
RCPRCGGYVNPFCNFEEGGKKMK

SEQ ID NO: 2394533 - protein, 18 aa, Entamoeba dispar
RDSFGCGIHGRIIKKLEY

SEQ ID NO: 2394534 - protein, 22 aa, Entamoeba dispar
RDYLNCLFIRYFPRAICPGCVM

SEQ ID NO: 2394535 - protein, 21 aa, Entamoeba dispar
REAICAWDWKMRCIEGEDRFG

SEQ ID NO: 2394536 - protein, 17 aa, Entamoeba dispar
REFKNQLAFQHCLLIGV

SEQ ID NO: 2394537 - protein, 20 aa, Entamoeba dispar
REGLELFAIYITSFMLSLLL

SEQ ID NO: 2394538 - protein, 25 aa, Entamoeba dispar
REGRFRFGGFWGKKWAKLTVNKNES

SEQ ID NO: 2394539 - protein, 17 aa, Entamoeba dispar
REVPWVVFSCIIQILKH

SEQ ID NO: 2394540 - protein, 19 aa, Entamoeba dispar
RFINEYKLDIGLYLILIVI

SEQ ID NO: 2394541 - protein, 22 aa, Entamoeba dispar
RFIWDILCLFAILIHLSCMRSR

SEQ ID NO: 2394542 - protein, 22 aa, Entamoeba dispar
RFLSNHMCKSCYGYCQLNGNDT

SEQ ID NO: 2394543 - protein, 20 aa, Entamoeba dispar
RGCPCDGGQCILKINDEEKP

SEQ ID NO: 2394544 - protein, 18 aa, Entamoeba dispar
RGILKWGPLLSITNAITN

SEQ ID NO: 2394545 - protein, 23 aa, Entamoeba dispar
RGIWIMPIEWLFSKGDYFENEEL

SEQ ID NO: 2394546 - protein, 17 aa, Entamoeba dispar
RGSEGCLVNCQCQKDLG

SEQ ID NO: 2394547 - protein, 17 aa, Entamoeba dispar
RIAMCFFVVAVAIILIW

SEQ ID NO: 2394548 - protein, 18 aa, Entamoeba dispar
RIICPNGYLYVKGECIKS

SEQ ID NO: 2394549 - protein, 18 aa, Entamoeba dispar
RIINEISKGLAYLHDLNP

SEQ ID NO: 2394550 - protein, 21 aa, Entamoeba dispar
RIKALCGFSPFVISSYTQRGG

SEQ ID NO: 2394551 - protein, 32 aa, Entamoeba dispar
RIKANLFLANFIRDLMRFWKLTYVVGLIDMVM

SEQ ID NO: 2394552 - protein, 22 aa, Entamoeba dispar
RISDLYLKYCIVITIIRFLFTP

SEQ ID NO: 2394553 - protein, 18 aa, Entamoeba dispar
RISIGLTIIYSMGGMLGN

SEQ ID NO: 2394554 - protein, 20 aa, Entamoeba dispar
RIVEVMYRFFACSIESTKCK

SEQ ID NO: 2394555 - protein, 21 aa, Entamoeba dispar
RKCWMCVFPGCTEPPKTRYNC

SEQ ID NO: 2394556 - protein, 20 aa, Entamoeba dispar
RKIKILCLIPFSSERKRMGI

SEQ ID NO: 2394557 - protein, 20 aa, Entamoeba dispar
RKLTCGQQCAIIKEFELIIT

SEQ ID NO: 2394558 - protein, 25 aa, Entamoeba dispar
RKPISWRKNIKFWIGRIMFFCAFML

SEQ ID NO: 2394559 - protein, 18 aa, Entamoeba dispar
RKPLSGKQLVFWKKLDSI

SEQ ID NO: 2394560 - protein, 18 aa, Entamoeba dispar
RKRPSHWQKFALENKDVI

SEQ ID NO: 2394561 - protein, 20 aa, Entamoeba dispar
RKRYSCSLVYFNVDSKMSLF

SEQ ID NO: 2394562 - protein, 25 aa, Entamoeba dispar
RKTYWWKNFKLWLLIVISLVLILCL

SEQ ID NO: 2394563 - protein, 23 aa, Entamoeba dispar
RKWCCIGCGITIILAMAIHPTTV

SEQ ID NO: 2394564 - protein, 19 aa, Entamoeba dispar
RKWNVIKGFFIGQTISIIN

SEQ ID NO: 2394565 - protein, 17 aa, Entamoeba dispar
RLAIPLKVDFKGIVSNE

SEQ ID NO: 2394566 - protein, 19 aa, Entamoeba dispar
RLCFIISLIVVVGYIALII

SEQ ID NO: 2394567 - protein, 19 aa, Entamoeba dispar
RLGKWFKLDMSSIYTDTLS

SEQ ID NO: 2394568 - protein, 18 aa, Entamoeba dispar
RLKPFLKEEMVIAEIERK

SEQ ID NO: 2394569 - protein, 20 aa, Entamoeba dispar
RLKSFPLWFCKQWLRTDEKG

SEQ ID NO: 2394570 - protein, 21 aa, Entamoeba dispar
RLTITIVCVILLFSYIFTYVL

SEQ ID NO: 2394571 - protein, 23 aa, Entamoeba dispar
RNCRRWKGSIIEYIPKGNKPINA

SEQ ID NO: 2394572 - protein, 22 aa, Entamoeba dispar
RNGWVLCVLAIPIGIISGYDLQ

SEQ ID NO: 2394573 - protein, 18 aa, Entamoeba dispar
RNISYWGWLFTLKQPLFY

SEQ ID NO: 2394574 - protein, 17 aa, Entamoeba dispar
RPCCSQIKKVLQKVSKN

SEQ ID NO: 2394575 - protein, 18 aa, Entamoeba dispar
RPGHKLRIKFMIDAAKGI

SEQ ID NO: 2394576 - protein, 17 aa, Entamoeba dispar
RPLESIKILISRLSIEV

SEQ ID NO: 2394577 - protein, 18 aa, Entamoeba dispar
RRCGACLGLNGPSMKPYQ

SEQ ID NO: 2394578 - protein, 22 aa, Entamoeba dispar
RRFSWSDGHSFSFPFFKKKKKC

SEQ ID NO: 2394579 - protein, 18 aa, Entamoeba dispar
RRKLVLIAFQCLQSKVIK

SEQ ID NO: 2394580 - protein, 17 aa, Entamoeba dispar
RRLSYVILYSFYKNIIM

SEQ ID NO: 2394581 - protein, 21 aa, Entamoeba dispar
RRPQDSWGYFEIFIKSPETGE

SEQ ID NO: 2394582 - protein, 21 aa, Entamoeba dispar
RSATELSRLILLLPISIFTLS

SEQ ID NO: 2394583 - protein, 17 aa, Entamoeba dispar
RSGCLNLIISMFVLALL

SEQ ID NO: 2394584 - protein, 20 aa, Entamoeba dispar
RSGLLTGKWKNLVMNTFNDK

SEQ ID NO: 2394585 - protein, 19 aa, Entamoeba dispar
RSLYAAALWYLDDWNEFDS

SEQ ID NO: 2394586 - protein, 19 aa, Entamoeba dispar
RTAKKLDHFFPIQKIWNQS

SEQ ID NO: 2394587 - protein, 19 aa, Entamoeba dispar
RTFIFKTWIFEVKWTFILL

SEQ ID NO: 2394588 - protein, 19 aa, Entamoeba dispar
RTGLMSACFLVYMLDSLNA

SEQ ID NO: 2394589 - protein, 17 aa, Entamoeba dispar
RVCFSLKEAKIMMVSSE

SEQ ID NO: 2394590 - protein, 18 aa, Entamoeba dispar
RVFSWKRGEGPLSISSLD

SEQ ID NO: 2394591 - protein, 22 aa, Entamoeba dispar
RVLRSEIWIQIYYLIITFGVVI

SEQ ID NO: 2394592 - protein, 17 aa, Entamoeba dispar
RVLYQFGGGAYAFHLKT

SEQ ID NO: 2394593 - protein, 20 aa, Entamoeba dispar
RVPLESGITFLANVSNCYEI

SEQ ID NO: 2394594 - protein, 17 aa, Entamoeba dispar
RVYDLFGYTIFEYKELI

SEQ ID NO: 2394595 - protein, 18 aa, Entamoeba dispar
RWFSVGIVFIVFTFIVIL

SEQ ID NO: 2394596 - protein, 19 aa, Entamoeba dispar
RWSLICYLCCVLIIVIFLA

SEQ ID NO: 2394597 - protein, 18 aa, Entamoeba dispar
RYACEFEIFITIKCTTKI

SEQ ID NO: 2394598 - protein, 19 aa, Entamoeba dispar
RYDYGLTWSNMLEKIPNSN

SEQ ID NO: 2394599 - protein, 22 aa, Entamoeba dispar
RYFKVARDWFLFLMSHDATLFI

SEQ ID NO: 2394600 - protein, 20 aa, Entamoeba dispar
RYLIRNCGDRELFIWYCETN

SEQ ID NO: 2394601 - protein, 23 aa, Entamoeba dispar
SAAEEFMFRFSFYKPTKEVLSLT

SEQ ID NO: 2394602 - protein, 17 aa, Entamoeba dispar
SALRLLVPSTWYSKDFI

SEQ ID NO: 2394603 - protein, 25 aa, Entamoeba dispar
SALWCSLSFCYLCISKIVKSFDILE

SEQ ID NO: 2394604 - protein, 19 aa, Entamoeba dispar
SAWISGLLYFFGRIPQIIH

SEQ ID NO: 2394605 - protein, 23 aa, Entamoeba dispar
SCASRKWLIIGIVVGILVVIVII

SEQ ID NO: 2394606 - protein, 18 aa, Entamoeba dispar
SCCSIMLSAILLLQQYLF

SEQ ID NO: 2394607 - protein, 17 aa, Entamoeba dispar
SCIICSLIIIILILIIV

SEQ ID NO: 2394608 - protein, 20 aa, Entamoeba dispar
SCIIVSFFVILLFNIVFFVI

SEQ ID NO: 2394609 - protein, 18 aa, Entamoeba dispar
SCILWKYLSDIGYDYATL

SEQ ID NO: 2394610 - protein, 19 aa, Entamoeba dispar
SCLMCPIGTYSKGEKNTYC

SEQ ID NO: 2394611 - protein, 20 aa, Entamoeba dispar
SCPFFPLILKLILQESFALV

SEQ ID NO: 2394612 - protein, 17 aa, Entamoeba dispar
SCPFQYNPSLVIIGEDL

SEQ ID NO: 2394613 - protein, 17 aa, Entamoeba dispar
SCVLYIFICLMFLISTV

SEQ ID NO: 2394614 - protein, 22 aa, Entamoeba dispar
SDIKGNIAWRRTIGKNGKKITA

SEQ ID NO: 2394615 - protein, 23 aa, Entamoeba dispar
SDLLKIRFCQDIARGMEYLHQND

SEQ ID NO: 2394616 - protein, 22 aa, Entamoeba dispar
SDLLKVRFCQDIARGMEYLHQN

SEQ ID NO: 2394617 - protein, 17 aa, Entamoeba dispar
SDLLWKNLFETFYINNN

SEQ ID NO: 2394618 - protein, 19 aa, Entamoeba dispar
SELKLTCNLMGISSQSFVE

SEQ ID NO: 2394619 - protein, 24 aa, Entamoeba dispar
SELLKIRFCQDIARGMEYLHQNDI

SEQ ID NO: 2394620 - protein, 23 aa, Entamoeba dispar
SEQWFAHQMCCFLLPYYDCSSNI

SEQ ID NO: 2394621 - protein, 22 aa, Entamoeba dispar
SETGKICRICFETGKCITFRNY

SEQ ID NO: 2394622 - protein, 22 aa, Entamoeba dispar
SFCSCLFFLLTIFSFKLFLCFH

SEQ ID NO: 2394623 - protein, 18 aa, Entamoeba dispar
SFDSFKLKCENLKSIVAD

SEQ ID NO: 2394624 - protein, 21 aa, Entamoeba dispar
SFHTICIFILFIALVYRHTIT

SEQ ID NO: 2394625 - protein, 17 aa, Entamoeba dispar
SFIPNKICVNDIIGRGS

SEQ ID NO: 2394626 - protein, 22 aa, Entamoeba dispar
SFPDKHAFIFRSFKQESIVKML

SEQ ID NO: 2394627 - protein, 18 aa, Entamoeba dispar
SFRLLFKMIKIVEYIHSK

SEQ ID NO: 2394628 - protein, 17 aa, Entamoeba dispar
SFYIFKIITFVSLITGI

SEQ ID NO: 2394629 - protein, 19 aa, Entamoeba dispar
SGFTKRYDYGLTWSNMLEK

SEQ ID NO: 2394630 - protein, 19 aa, Entamoeba dispar
SGSICCWCDDTAIQNKVSW

SEQ ID NO: 2394631 - protein, 17 aa, Entamoeba dispar
SGSTFTHFCLASDPHAS

SEQ ID NO: 2394632 - protein, 29 aa, Entamoeba dispar
SHEMKKAMCWRKWKLWIIIGVIAAIIIIV

SEQ ID NO: 2394633 - protein, 17 aa, Entamoeba dispar
SHFALGLVLRGSSISVT

SEQ ID NO: 2394634 - protein, 17 aa, Entamoeba dispar
SHIFKDIRLMVSLVGIF

SEQ ID NO: 2394635 - protein, 23 aa, Entamoeba dispar
SHVEPRLAVAVVLLFLYLGIFAG

SEQ ID NO: 2394636 - protein, 24 aa, Entamoeba dispar
SICKERLKYCWVIYSLLIKSIIGY

SEQ ID NO: 2394637 - protein, 19 aa, Entamoeba dispar
SIECLSCSNDLFLKDNKCQ

SEQ ID NO: 2394638 - protein, 18 aa, Entamoeba dispar
SIFEGIVFLLWIISLLLL

SEQ ID NO: 2394639 - protein, 17 aa, Entamoeba dispar
SIIFSWKKTSGIAVSKV

SEQ ID NO: 2394640 - protein, 25 aa, Entamoeba dispar
SIINIISSVLWRWLLGCMASDFPLY

SEQ ID NO: 2394641 - protein, 17 aa, Entamoeba dispar
SIIPFTRFLRVFLPYTL

SEQ ID NO: 2394642 - protein, 20 aa, Entamoeba dispar
SILITCFFSLFLFNYCSFSS

SEQ ID NO: 2394643 - protein, 17 aa, Entamoeba dispar
SILTYNILQYLNIALNN

SEQ ID NO: 2394644 - protein, 18 aa, Entamoeba dispar
SIPFKLYITFVIREKYGM

SEQ ID NO: 2394645 - protein, 20 aa, Entamoeba dispar
SIPRLSCLDDRCGNGIIDET

SEQ ID NO: 2394646 - protein, 18 aa, Entamoeba dispar
SITSRIEGTFTFKKPVKL

SEQ ID NO: 2394647 - protein, 24 aa, Entamoeba dispar
SIVPVCIMLGFSCIRELLDEFRKF

SEQ ID NO: 2394648 - protein, 22 aa, Entamoeba dispar
SKAIEVLPQWALLDATAISQNH

SEQ ID NO: 2394649 - protein, 20 aa, Entamoeba dispar
SKCSQILCDVCEDYNICTSC

SEQ ID NO: 2394650 - protein, 18 aa, Entamoeba dispar
SKCVKCKYGYYNPSSCTK

SEQ ID NO: 2394651 - protein, 21 aa, Entamoeba dispar
SKEVMVAIGLLFHLHFLSLQR

SEQ ID NO: 2394652 - protein, 17 aa, Entamoeba dispar
SKFSITSSSVWGISNII

SEQ ID NO: 2394653 - protein, 17 aa, Entamoeba dispar
SKIPVHFDITFPYSSCP

SEQ ID NO: 2394654 - protein, 22 aa, Entamoeba dispar
SKKLKIILLVSLIIVLILALII

SEQ ID NO: 2394655 - protein, 20 aa, Entamoeba dispar
SKLGEINPLFPISVEEMKKM

SEQ ID NO: 2394656 - protein, 22 aa, Entamoeba dispar
SKLKELYCFSSIVTIQNPNESL

SEQ ID NO: 2394657 - protein, 23 aa, Entamoeba dispar
SKNKRFAISKCYGVIQINSELKQ

SEQ ID NO: 2394658 - protein, 23 aa, Entamoeba dispar
SKTLKWYYHLVILIAVMVGVMLI

SEQ ID NO: 2394659 - protein, 26 aa, Entamoeba dispar
SLDGRFPFIWAYSALLATCYWISNRL

SEQ ID NO: 2394660 - protein, 21 aa, Entamoeba dispar
SLFMKYHFPIYFSIEPSTLSL

SEQ ID NO: 2394661 - protein, 18 aa, Entamoeba dispar
SLFTRYSRRSVEHGIAII

SEQ ID NO: 2394662 - protein, 21 aa, Entamoeba dispar
SLHILRPFIVVLMFELYWFTI

SEQ ID NO: 2394663 - protein, 23 aa, Entamoeba dispar
SLIICYKQRLSVIHYLYSLIPMA

SEQ ID NO: 2394664 - protein, 18 aa, Entamoeba dispar
SLIVKWAVYSAFSFCWNL

SEQ ID NO: 2394665 - protein, 20 aa, Entamoeba dispar
SLKRKGVFTLDGYRYCLVDY

SEQ ID NO: 2394666 - protein, 22 aa, Entamoeba dispar
SLKTSIFLFLFVELKFIVIFIF

SEQ ID NO: 2394667 - protein, 19 aa, Entamoeba dispar
SLLCGLFFVFGYPQFHFTT

SEQ ID NO: 2394668 - protein, 24 aa, Entamoeba dispar
SLNRCFPCTLLASQLCQKDNGISS

SEQ ID NO: 2394669 - protein, 24 aa, Entamoeba dispar
SLPKLPGIWVYCWTLLLLCGQVRN

SEQ ID NO: 2394670 - protein, 18 aa, Entamoeba dispar
SLPLCCLKKGLTSPIDIT

SEQ ID NO: 2394671 - protein, 18 aa, Entamoeba dispar
SLQRSGLLTGKWKNLVMN

SEQ ID NO: 2394672 - protein, 18 aa, Entamoeba dispar
SLQWKQHWCDLFRDEMVI

SEQ ID NO: 2394673 - protein, 23 aa, Entamoeba dispar
SLSESWIRFTVYISIIIQILVSS

SEQ ID NO: 2394674 - protein, 18 aa, Entamoeba dispar
SMHPFKFILPKNIKKITI

SEQ ID NO: 2394675 - protein, 22 aa, Entamoeba dispar
SMKSIRSSIYFEKGQWDYEANS

SEQ ID NO: 2394676 - protein, 22 aa, Entamoeba dispar
SNCLKCLNGVCIQCKDNHYLDN

SEQ ID NO: 2394677 - protein, 23 aa, Entamoeba dispar
SNCLKCLNGVCIQCKDNHYLDNG

SEQ ID NO: 2394678 - protein, 17 aa, Entamoeba dispar
SNFFCCGIYALKQFSSR

SEQ ID NO: 2394679 - protein, 23 aa, Entamoeba dispar
SNHCWLEILPFQFCLTVFTLGDY

SEQ ID NO: 2394680 - protein, 17 aa, Entamoeba dispar
SNIRIALCLNIKKLSAL

SEQ ID NO: 2394681 - protein, 17 aa, Entamoeba dispar
SNNELYFYNSLKMKMSI

SEQ ID NO: 2394682 - protein, 18 aa, Entamoeba dispar
SNPWLCFFVPGLVVIVVV

SEQ ID NO: 2394683 - protein, 24 aa, Entamoeba dispar
SNVLKIYFEMAFNWKATQIDLMSQ

SEQ ID NO: 2394684 - protein, 20 aa, Entamoeba dispar
SNWICLLCSIILSIVTFTLF

SEQ ID NO: 2394685 - protein, 17 aa, Entamoeba dispar
SNYRKTFCFSFQHESDI

SEQ ID NO: 2394686 - protein, 23 aa, Entamoeba dispar
SPCDRNGWKWGTWNQLESTYKSY

SEQ ID NO: 2394687 - protein, 18 aa, Entamoeba dispar
SPCIISFIGYCITNESIC

SEQ ID NO: 2394688 - protein, 17 aa, Entamoeba dispar
SPCVFGFHFTTIPNHLK

SEQ ID NO: 2394689 - protein, 19 aa, Entamoeba dispar
SPEIIMIILGIIFNTSYSI

SEQ ID NO: 2394690 - protein, 19 aa, Entamoeba dispar
SPHGIKYIIEFFKSNIGHP

SEQ ID NO: 2394691 - protein, 18 aa, Entamoeba dispar
SPLLWYRLACSCIQYHYN

SEQ ID NO: 2394692 - protein, 19 aa, Entamoeba dispar
SQKDIECLYNFFDGYHDLR

SEQ ID NO: 2394693 - protein, 20 aa, Entamoeba dispar
SQLGGIFSFDAWRYYFNVNT

SEQ ID NO: 2394694 - protein, 17 aa, Entamoeba dispar
SRFPIVLVPAFMSSSLH

SEQ ID NO: 2394695 - protein, 17 aa, Entamoeba dispar
SRISPELAYVGFFQMFP

SEQ ID NO: 2394696 - protein, 19 aa, Entamoeba dispar
SRLPPPCPYTGIDWGVMDT

SEQ ID NO: 2394697 - protein, 21 aa, Entamoeba dispar
SSAICAISFLVTRVQKLFTRY

SEQ ID NO: 2394698 - protein, 22 aa, Entamoeba dispar
SSCIVRFLFNTAFQFKKKFYVD

SEQ ID NO: 2394699 - protein, 18 aa, Entamoeba dispar
SSCNLDFVVNGEYNTFGN

SEQ ID NO: 2394700 - protein, 21 aa, Entamoeba dispar
SSFHIITFIALILFISLQPFY

SEQ ID NO: 2394701 - protein, 19 aa, Entamoeba dispar
SSFRIDDMILRIGGIIPFC

SEQ ID NO: 2394702 - protein, 22 aa, Entamoeba dispar
SSIEIINGLLLIGSNENKSNNI

SEQ ID NO: 2394703 - protein, 17 aa, Entamoeba dispar
SSIIFKKKFESDICGIS

SEQ ID NO: 2394704 - protein, 19 aa, Entamoeba dispar
SSILLCFSLIDIFDINDFY

SEQ ID NO: 2394705 - protein, 24 aa, Entamoeba dispar
SSLAFRFSILLSFLYFMIFSVYDV

SEQ ID NO: 2394706 - protein, 28 aa, Entamoeba dispar
SSLKCFLNWRLVLLFPLALLFGFSRSFY

SEQ ID NO: 2394707 - protein, 24 aa, Entamoeba dispar
SSRDLLKHKWFITNGIKIEESKKP

SEQ ID NO: 2394708 - protein, 24 aa, Entamoeba dispar
SSSCPVCGNGMWSYISSSGCYSCK

SEQ ID NO: 2394709 - protein, 23 aa, Entamoeba dispar
SSTLPFIISNTIKFTSINIPTIT

SEQ ID NO: 2394710 - protein, 18 aa, Entamoeba dispar
SSVKRICKIFAIEHPDVG

SEQ ID NO: 2394711 - protein, 18 aa, Entamoeba dispar
SSVSFATCFSNYYRAFAD

SEQ ID NO: 2394712 - protein, 17 aa, Entamoeba dispar
STILFRLLRTWLSKTNN

SEQ ID NO: 2394713 - protein, 20 aa, Entamoeba dispar
STISKFKFFIPFNIEEKLQP

SEQ ID NO: 2394714 - protein, 17 aa, Entamoeba dispar
STLFKISKYLAGVLSSL

SEQ ID NO: 2394715 - protein, 24 aa, Entamoeba dispar
STLLKLRFCQDISRGMLYLHENNI

SEQ ID NO: 2394716 - protein, 23 aa, Entamoeba dispar
STLPCKLFFCFNLPVYLGLDHSK

SEQ ID NO: 2394717 - protein, 18 aa, Entamoeba dispar
SVAPRLGFCQLKMEKEED

SEQ ID NO: 2394718 - protein, 23 aa, Entamoeba dispar
SVFEMFWRMAFILFSSFCCMLYL

SEQ ID NO: 2394719 - protein, 17 aa, Entamoeba dispar
SVFLKWYNTTSICGSYR

SEQ ID NO: 2394720 - protein, 24 aa, Entamoeba dispar
SVFYRALFIFLRFLYHQSCDPYFL

SEQ ID NO: 2394721 - protein, 18 aa, Entamoeba dispar
SVLCCPGCFTLLRLEAIY

SEQ ID NO: 2394722 - protein, 23 aa, Entamoeba dispar
SVLPHLSALVAIVFPRLNDTEAT

SEQ ID NO: 2394723 - protein, 17 aa, Entamoeba dispar
SWIPRPIQHQSFIRSNY

SEQ ID NO: 2394724 - protein, 19 aa, Entamoeba dispar
SYCERIKLSPVFFNVSYPE

SEQ ID NO: 2394725 - protein, 18 aa, Entamoeba dispar
SYIYRKGEKWYLPDTDNV

SEQ ID NO: 2394726 - protein, 18 aa, Entamoeba dispar
SYLAYSWIFDCPKGFFDK

SEQ ID NO: 2394727 - protein, 18 aa, Entamoeba dispar
SYNGKYRFNGVCNLVTLH

SEQ ID NO: 2394728 - protein, 24 aa, Entamoeba dispar
TASFIIKIIWFRGIVRESSGLLMK

SEQ ID NO: 2394729 - protein, 17 aa, Entamoeba dispar
TATKAVSLTTCFKETTL

SEQ ID NO: 2394730 - protein, 17 aa, Entamoeba dispar
TCGEWSFKYRGTRPEIV

SEQ ID NO: 2394731 - protein, 19 aa, Entamoeba dispar
TCLDFKFDSVLVQSNINRI

SEQ ID NO: 2394732 - protein, 19 aa, Entamoeba dispar
TCLKTLIDECWKQKPDERP

SEQ ID NO: 2394733 - protein, 22 aa, Entamoeba dispar
TCPCSGDKCIIDFSSTTSVMYK

SEQ ID NO: 2394734 - protein, 19 aa, Entamoeba dispar
TCSKCSESNCIVCKDNDGT

SEQ ID NO: 2394735 - protein, 18 aa, Entamoeba dispar
TCYPHTNFPAIVRIFSSC

SEQ ID NO: 2394736 - protein, 19 aa, Entamoeba dispar
TDYPSVFSIPSFFNNKQLD

SEQ ID NO: 2394737 - protein, 23 aa, Entamoeba dispar
TEDFKEVFVWKVFYTSLIWVLKN

SEQ ID NO: 2394738 - protein, 21 aa, Entamoeba dispar
TEEFKFPWKIADFISDGKRLL

SEQ ID NO: 2394739 - protein, 21 aa, Entamoeba dispar
TEFKFPWDIANTITTGKRPPI

SEQ ID NO: 2394740 - protein, 22 aa, Entamoeba dispar
TEFKFPWKIAEFISTGKRPPII

SEQ ID NO: 2394741 - protein, 21 aa, Entamoeba dispar
TEFKFPWKIAEFISTGKRPTI

SEQ ID NO: 2394742 - protein, 24 aa, Entamoeba dispar
TEIGSLCLMVFCYYYIKPFRKVIK

SEQ ID NO: 2394743 - protein, 22 aa, Entamoeba dispar
TEILRYSCKIIKSINSGKIKEN

SEQ ID NO: 2394744 - protein, 23 aa, Entamoeba dispar
TEQRIQIRLAREVNILKSGIESC

SEQ ID NO: 2394745 - protein, 17 aa, Entamoeba dispar
TERIEVIVNTLSQISNA

SEQ ID NO: 2394746 - protein, 17 aa, Entamoeba dispar
TEYYDWFLINIVLHPQN

SEQ ID NO: 2394747 - protein, 17 aa, Entamoeba dispar
TFACTFLSFFFILFFGL

SEQ ID NO: 2394748 - protein, 18 aa, Entamoeba dispar
TFCFCFMLSFWFSIVYLF

SEQ ID NO: 2394749 - protein, 20 aa, Entamoeba dispar
TFPICIFCIMVLTVFSLGFD

SEQ ID NO: 2394750 - protein, 19 aa, Entamoeba dispar
TGCAICKDGFYRKDVDCQE

SEQ ID NO: 2394751 - protein, 17 aa, Entamoeba dispar
TGCKQCYIGYVFDTEKK

SEQ ID NO: 2394752 - protein, 19 aa, Entamoeba dispar
TGDGFFFQWVMSIGILIVG

SEQ ID NO: 2394753 - protein, 19 aa, Entamoeba dispar
TGDGFFYQWVMAIGVLLAG

SEQ ID NO: 2394754 - protein, 22 aa, Entamoeba dispar
TGICTKCLFGYFLKDEECKSCD

SEQ ID NO: 2394755 - protein, 22 aa, Entamoeba dispar
TGICTKCLFGYFLKDENCVACS

SEQ ID NO: 2394756 - protein, 18 aa, Entamoeba dispar
TGRLYVECFGKWIMYKLS

SEQ ID NO: 2394757 - protein, 25 aa, Entamoeba dispar
TGYGDCIYSKFEYLISCEEKGITSE

SEQ ID NO: 2394758 - protein, 17 aa, Entamoeba dispar
THCTGIVLIDGFDGLTV

SEQ ID NO: 2394759 - protein, 26 aa, Entamoeba dispar
THTFFWICFFLMQFCTVVLVLNLLKK

SEQ ID NO: 2394760 - protein, 21 aa, Entamoeba dispar
TIEGIPLFVEHAFRFFELLSK

SEQ ID NO: 2394761 - protein, 18 aa, Entamoeba dispar
TIFCCYYIAIYLVPRFIN

SEQ ID NO: 2394762 - protein, 18 aa, Entamoeba dispar
TIFLKCCLFLYCRTVNNP

SEQ ID NO: 2394763 - protein, 25 aa, Entamoeba dispar
TIIRSCWKLNVFEGYEGIISLQVLK

SEQ ID NO: 2394764 - protein, 22 aa, Entamoeba dispar
TIIVIFCIWFFKKPVEDKPQTY

SEQ ID NO: 2394765 - protein, 19 aa, Entamoeba dispar
TIKELECVKGDFFNSTIIS

SEQ ID NO: 2394766 - protein, 20 aa, Entamoeba dispar
TILRLYAMIHLARFDPKRKR

SEQ ID NO: 2394767 - protein, 21 aa, Entamoeba dispar
TILSWRGTILYFKSIIIPDSF

SEQ ID NO: 2394768 - protein, 24 aa, Entamoeba dispar
TIRDANLFFGEFIRDLSLLWRHDE

SEQ ID NO: 2394769 - protein, 19 aa, Entamoeba dispar
TKIKWKQCIIFDNYHRLLP

SEQ ID NO: 2394770 - protein, 22 aa, Entamoeba dispar
TKKEGCIICRSCEDSENDPLGF

SEQ ID NO: 2394771 - protein, 17 aa, Entamoeba dispar
TKLNIFFQRFLKDMKSF

SEQ ID NO: 2394772 - protein, 18 aa, Entamoeba dispar
TKTPRFEQVLTMNATANT

SEQ ID NO: 2394773 - protein, 17 aa, Entamoeba dispar
TKVYQILLSKEFRDLSN

SEQ ID NO: 2394774 - protein, 28 aa, Entamoeba dispar
TKYCSVKGWKLSSLEIKLIMTLRIDFSK

SEQ ID NO: 2394775 - protein, 20 aa, Entamoeba dispar
TLCFISFFFCDAIFTSYNSN

SEQ ID NO: 2394776 - protein, 19 aa, Entamoeba dispar
TLFFLRYLFLPLISYPSLL

SEQ ID NO: 2394777 - protein, 17 aa, Entamoeba dispar
TLFLIAMAVFTLFLILL

SEQ ID NO: 2394778 - protein, 23 aa, Entamoeba dispar
TLKIWCLFVTFSIISFIPYLYLF

SEQ ID NO: 2394779 - protein, 21 aa, Entamoeba dispar
TLLNRIICWILMISHNFTTPD

SEQ ID NO: 2394780 - protein, 19 aa, Entamoeba dispar
TLLRLLISMGYNIVLKKPK

SEQ ID NO: 2394781 - protein, 19 aa, Entamoeba dispar
TLLVLIQWSGLFQIRHSLH

SEQ ID NO: 2394782 - protein, 18 aa, Entamoeba dispar
TLWFKFIGVRVIFVGIIF

SEQ ID NO: 2394783 - protein, 17 aa, Entamoeba dispar
TLYKFLTCFTLLDNQID

SEQ ID NO: 2394784 - protein, 23 aa, Entamoeba dispar
TLYSKELYLFWLFNVGNRKTKED

SEQ ID NO: 2394785 - protein, 18 aa, Entamoeba dispar
TMALPIIVQQSYIYHHKI

SEQ ID NO: 2394786 - protein, 18 aa, Entamoeba dispar
TMHSCVVIGWKLCLPPLL

SEQ ID NO: 2394787 - protein, 20 aa, Entamoeba dispar
TMICFFCFGLNFLIYYNAVV

SEQ ID NO: 2394788 - protein, 18 aa, Entamoeba dispar
TNAIAYWIATTCSILIHI

SEQ ID NO: 2394789 - protein, 24 aa, Entamoeba dispar
TNFLKLRFCQDIARGMLYLHENDI

SEQ ID NO: 2394790 - protein, 20 aa, Entamoeba dispar
TNLCGTLAWIAPEILQNKPF

SEQ ID NO: 2394791 - protein, 17 aa, Entamoeba dispar
TNLRYLALDAMCSMCTV

SEQ ID NO: 2394792 - protein, 19 aa, Entamoeba dispar
TNPIFGPECIIVISNISQP

SEQ ID NO: 2394793 - protein, 18 aa, Entamoeba dispar
TNSTVVWNGCVSFKHSIT

SEQ ID NO: 2394794 - protein, 19 aa, Entamoeba dispar
TPCYWRSVVGFGFVFMNYV

SEQ ID NO: 2394795 - protein, 17 aa, Entamoeba dispar
TPPEVLNGLPFTKSGDV

SEQ ID NO: 2394796 - protein, 22 aa, Entamoeba dispar
TPRVDLYLMIFLKFLATVIPTM

SEQ ID NO: 2394797 - protein, 17 aa, Entamoeba dispar
TPSWKSIVIPLLIGFII

SEQ ID NO: 2394798 - protein, 18 aa, Entamoeba dispar
TQFKFAWDIADLVANGKR

SEQ ID NO: 2394799 - protein, 17 aa, Entamoeba dispar
TQKCSINVIPLCSRATI

SEQ ID NO: 2394800 - protein, 24 aa, Entamoeba dispar
TQNLSELLKLFGYIYLNVDNEKTK

SEQ ID NO: 2394801 - protein, 17 aa, Entamoeba dispar
TRCTAINLYHCIKIISH

SEQ ID NO: 2394802 - protein, 17 aa, Entamoeba dispar
TREAAVMIICFKQIILP

SEQ ID NO: 2394803 - protein, 19 aa, Entamoeba dispar
TRFMGWKRFAFREYPVALA

SEQ ID NO: 2394804 - protein, 20 aa, Entamoeba dispar
TRMLAFIVHRLFEQKSKHCS

SEQ ID NO: 2394805 - protein, 18 aa, Entamoeba dispar
TRSLPLYLSIFIFGESSN

SEQ ID NO: 2394806 - protein, 19 aa, Entamoeba dispar
TRWLLFIICLVWFMFRMTH

SEQ ID NO: 2394807 - protein, 20 aa, Entamoeba dispar
TSIKSFHWQFLITKSKRSSK

SEQ ID NO: 2394808 - protein, 23 aa, Entamoeba dispar
TSKDWKQRLAFLTALNAAINSKK

SEQ ID NO: 2394809 - protein, 17 aa, Entamoeba dispar
TSLFIKIMHSVCLFETS

SEQ ID NO: 2394810 - protein, 22 aa, Entamoeba dispar
TSLLKMWLHFIHFCGNVANITN

SEQ ID NO: 2394811 - protein, 18 aa, Entamoeba dispar
TSLLPILVIIPLWYISLP

SEQ ID NO: 2394812 - protein, 18 aa, Entamoeba dispar
TSSFKYPYIVAVVKNKLY

SEQ ID NO: 2394813 - protein, 24 aa, Entamoeba dispar
TSWKDGKAFCALVHHFKPELINFE

SEQ ID NO: 2394814 - protein, 20 aa, Entamoeba dispar
TTEECILCLDIICKRKIGCN

SEQ ID NO: 2394815 - protein, 17 aa, Entamoeba dispar
TTFSIRGSFIFYHELLP

SEQ ID NO: 2394816 - protein, 23 aa, Entamoeba dispar
TTIPRRSSVQFSYHNFIEKTRSV

SEQ ID NO: 2394817 - protein, 18 aa, Entamoeba dispar
TTLGFGYPTVIKMYELFS

SEQ ID NO: 2394818 - protein, 25 aa, Entamoeba dispar
TTTHLKRLFLLWGFSLSILLMIYGI

SEQ ID NO: 2394819 - protein, 22 aa, Entamoeba dispar
TTVVKRKKFEFILSKPKVQEMK

SEQ ID NO: 2394820 - protein, 18 aa, Entamoeba dispar
TVIPFCLFFFNLFIKVIE

SEQ ID NO: 2394821 - protein, 23 aa, Entamoeba dispar
TVPMCLYDFLIVHIFPLITPLIS

SEQ ID NO: 2394822 - protein, 19 aa, Entamoeba dispar
TWIFEVKWTFILLIILVIQ

SEQ ID NO: 2394823 - protein, 19 aa, Entamoeba dispar
TWRLQIMLWYAGLRGAIAV

SEQ ID NO: 2394824 - protein, 23 aa, Entamoeba dispar
TYCLLHFFLYIGMIFCNYNYFNE

SEQ ID NO: 2394825 - protein, 27 aa, Entamoeba dispar
TYSNSLVDRWLCLRVDCIGAFVMFGSV

SEQ ID NO: 2394826 - protein, 19 aa, Entamoeba dispar
VACLVSFIFCIKMFNTPFL

SEQ ID NO: 2394827 - protein, 23 aa, Entamoeba dispar
VAFCSNCKCEYGYSYDKEKNVCN

SEQ ID NO: 2394828 - protein, 21 aa, Entamoeba dispar
VAFIIKIIWYRGVIRENSGLL

SEQ ID NO: 2394829 - protein, 18 aa, Entamoeba dispar
VAIFPCFTKKTLLKISNF

SEQ ID NO: 2394830 - protein, 18 aa, Entamoeba dispar
VAIPDILVYLGVTRETLS

SEQ ID NO: 2394831 - protein, 19 aa, Entamoeba dispar
VAIWPFCTAFFWPVTTGTV

SEQ ID NO: 2394832 - protein, 17 aa, Entamoeba dispar
VAKLYFLNQEECVRQGF

SEQ ID NO: 2394833 - protein, 19 aa, Entamoeba dispar
VALLLCFFVMLLSFTSNVH

SEQ ID NO: 2394834 - protein, 21 aa, Entamoeba dispar
VASYCLMIWIRLGGNGPFEVI

SEQ ID NO: 2394835 - protein, 17 aa, Entamoeba dispar
VAVCLNFPFIIPKSVKF

SEQ ID NO: 2394836 - protein, 20 aa, Entamoeba dispar
VCDITEPFVPLAPKNFFKPI

SEQ ID NO: 2394837 - protein, 17 aa, Entamoeba dispar
VCGSSLFTILFISAIVL

SEQ ID NO: 2394838 - protein, 18 aa, Entamoeba dispar
VCIWPFCTGFFWPVTTGT

SEQ ID NO: 2394839 - protein, 18 aa, Entamoeba dispar
VCLCLIKIVAAVMSGSLT

SEQ ID NO: 2394840 - protein, 20 aa, Entamoeba dispar
VCLNFPFIIPKSVKFLNRIS

SEQ ID NO: 2394841 - protein, 18 aa, Entamoeba dispar
VCQRWLGMRIELIGCIGL

SEQ ID NO: 2394842 - protein, 17 aa, Entamoeba dispar
VCSKKTLSYKCPGNTQC

SEQ ID NO: 2394843 - protein, 21 aa, Entamoeba dispar
VCSYGLCKTGLLSNINSECKI

SEQ ID NO: 2394844 - protein, 17 aa, Entamoeba dispar
VCVLDLDTGILLQKYEY

SEQ ID NO: 2394845 - protein, 18 aa, Entamoeba dispar
VCYIELIAFMAFVNYQKE

SEQ ID NO: 2394846 - protein, 17 aa, Entamoeba dispar
VDCIGAFVMFGSVIAAS

SEQ ID NO: 2394847 - protein, 21 aa, Entamoeba dispar
VDITLRFGWTINIILLYVAWF

SEQ ID NO: 2394848 - protein, 19 aa, Entamoeba dispar
VECFLRLILMLLLSILLKT

SEQ ID NO: 2394849 - protein, 17 aa, Entamoeba dispar
VEKSRFIGCKTFGSVGC

SEQ ID NO: 2394850 - protein, 18 aa, Entamoeba dispar
VEMLYKIRCDYIVHFYGA

SEQ ID NO: 2394851 - protein, 19 aa, Entamoeba dispar
VFGDSWLYYFLPVWTTKGD

SEQ ID NO: 2394852 - protein, 18 aa, Entamoeba dispar
VFGLRIIKNPSFSNKQCS

SEQ ID NO: 2394853 - protein, 19 aa, Entamoeba dispar
VFLQLKLLWPLFNITNTTN

SEQ ID NO: 2394854 - protein, 18 aa, Entamoeba dispar
VFVSVCFLYILQNVVELV

SEQ ID NO: 2394855 - protein, 17 aa, Entamoeba dispar
VFWELFYGVHAFSDLKT

SEQ ID NO: 2394856 - protein, 27 aa, Entamoeba dispar
VGCNPLKIILCPASFVNNYACEGRIDC

SEQ ID NO: 2394857 - protein, 20 aa, Entamoeba dispar
VGEFFSYFGMCITGYVIGFV

SEQ ID NO: 2394858 - protein, 25 aa, Entamoeba dispar
VGELTCCLCPLFAGLIATQTDDRKW

SEQ ID NO: 2394859 - protein, 29 aa, Entamoeba dispar
VGFIKCWDLTLVILCMFPFIMISMMGLGM

SEQ ID NO: 2394860 - protein, 24 aa, Entamoeba dispar
VGFLYCVFCTFLVPKTEIEEPPKN

SEQ ID NO: 2394861 - protein, 17 aa, Entamoeba dispar
VGMTFTYFAPLVFVVCL

SEQ ID NO: 2394862 - protein, 19 aa, Entamoeba dispar
VGVLAEIYISIGLYDSAFQ

SEQ ID NO: 2394863 - protein, 17 aa, Entamoeba dispar
VHIDFRFKFLRNKDTLN

SEQ ID NO: 2394864 - protein, 22 aa, Entamoeba dispar
VHPCVAFPYVIQWNDIINTNGL

SEQ ID NO: 2394865 - protein, 18 aa, Entamoeba dispar
VIAFRGTYSFKDCIYDIQ

SEQ ID NO: 2394866 - protein, 19 aa, Entamoeba dispar
VICTCSYYLIIVVVLVLIA

SEQ ID NO: 2394867 - protein, 18 aa, Entamoeba dispar
VIGVTIFFKCCLYLYCRT

SEQ ID NO: 2394868 - protein, 19 aa, Entamoeba dispar
VIILKHYISFILKINNTSK

SEQ ID NO: 2394869 - protein, 17 aa, Entamoeba dispar
VILLFSYIFTYVLLKTT

SEQ ID NO: 2394870 - protein, 19 aa, Entamoeba dispar
VILLGELLYLAGLLLPQRH

SEQ ID NO: 2394871 - protein, 17 aa, Entamoeba dispar
VILPFVILFFIATPKLD

SEQ ID NO: 2394872 - protein, 23 aa, Entamoeba dispar
VILQNRYVPWISLARIFYLSLMT

SEQ ID NO: 2394873 - protein, 19 aa, Entamoeba dispar
VIQRKCRLWNGNIIEYLPK

SEQ ID NO: 2394874 - protein, 22 aa, Entamoeba dispar
VIRGDVFFQFGFEEFNKTLTFG

SEQ ID NO: 2394875 - protein, 26 aa, Entamoeba dispar
VIWYDCYYCFSKYRFIWDSISLKNLF

SEQ ID NO: 2394876 - protein, 23 aa, Entamoeba dispar
VIYHEMVRLLGIIAARQPSLSHN

SEQ ID NO: 2394877 - protein, 17 aa, Entamoeba dispar
VIYRYLLNATFVYPTEQ

SEQ ID NO: 2394878 - protein, 22 aa, Entamoeba dispar
VKHILFVIAFRSCMNFIVWAIP

SEQ ID NO: 2394879 - protein, 26 aa, Entamoeba dispar
VKKFFKSKAGIILGCVIGVVLLLIII

SEQ ID NO: 2394880 - protein, 17 aa, Entamoeba dispar
VKNILIRNGDNLKTYTS

SEQ ID NO: 2394881 - protein, 19 aa, Entamoeba dispar
VLAKLCLAETFSIFETFIN

SEQ ID NO: 2394882 - protein, 18 aa, Entamoeba dispar
VLARPGFRVSRRKRMQDK

SEQ ID NO: 2394883 - protein, 17 aa, Entamoeba dispar
VLCKAEFDLNLDDHSLF

SEQ ID NO: 2394884 - protein, 20 aa, Entamoeba dispar
VLCQKCKEGSVLINNVCYIS

SEQ ID NO: 2394885 - protein, 19 aa, Entamoeba dispar
VLECFWIKWFVLGNLMVTL

SEQ ID NO: 2394886 - protein, 17 aa, Entamoeba dispar
VLFDIAGLYGYIAHNFE

SEQ ID NO: 2394887 - protein, 18 aa, Entamoeba dispar
VLFIPMLVVSVFSDVKGN

SEQ ID NO: 2394888 - protein, 19 aa, Entamoeba dispar
VLGECNCQIAIIIQPHLKG

SEQ ID NO: 2394889 - protein, 24 aa, Entamoeba dispar
VLKPHRRLAIALAIEYLKKMNSCI

SEQ ID NO: 2394890 - protein, 19 aa, Entamoeba dispar
VLLLLSISCSIGYTCLDVM

SEQ ID NO: 2394891 - protein, 18 aa, Entamoeba dispar
VLPSELKLTCNLMGISSQ

SEQ ID NO: 2394892 - protein, 24 aa, Entamoeba dispar
VLSRICFLCGLFGGIKSNQLDNIK

SEQ ID NO: 2394893 - protein, 24 aa, Entamoeba dispar
VLYLVCIMFNFNLIKEFNFIDKKD

SEQ ID NO: 2394894 - protein, 17 aa, Entamoeba dispar
VMIDFYFERQRSVFFGT

SEQ ID NO: 2394895 - protein, 24 aa, Entamoeba dispar
VMKLTEIFKVFILRFNFKSKENIL

SEQ ID NO: 2394896 - protein, 19 aa, Entamoeba dispar
VMLLKCSFTRLKKRMPTIL

SEQ ID NO: 2394897 - protein, 19 aa, Entamoeba dispar
VNICKKCMVKGMIINFKTK

SEQ ID NO: 2394898 - protein, 17 aa, Entamoeba dispar
VNSVKWGRCVYDNIRKF

SEQ ID NO: 2394899 - protein, 22 aa, Entamoeba dispar
VNYEIVNEIAFWYYQQLFEEKC

SEQ ID NO: 2394900 - protein, 19 aa, Entamoeba dispar
VPKVMIFYCMLFTGILIVT

SEQ ID NO: 2394901 - protein, 23 aa, Entamoeba dispar
VPLYRPLTVILFFLITGIIFIPI

SEQ ID NO: 2394902 - protein, 24 aa, Entamoeba dispar
VQENIELFTQFGFEVIFREDKEVT

SEQ ID NO: 2394903 - protein, 23 aa, Entamoeba dispar
VQLRLLKIVLNWLIPEVFNECLY

SEQ ID NO: 2394904 - protein, 23 aa, Entamoeba dispar
VQLSKCPFCLIMGLFLFVSLEEA

SEQ ID NO: 2394905 - protein, 18 aa, Entamoeba dispar
VRKSFRFILPRALLLLTL

SEQ ID NO: 2394906 - protein, 19 aa, Entamoeba dispar
VRNPINWRQYQVLFNHFSD

SEQ ID NO: 2394907 - protein, 20 aa, Entamoeba dispar
VRTSDLPQCFPLNKNIINKQ

SEQ ID NO: 2394908 - protein, 17 aa, Entamoeba dispar
VSFLEGLFFVFAYFMDV

SEQ ID NO: 2394909 - protein, 17 aa, Entamoeba dispar
VSLCIEEWIAAGMLIVV

SEQ ID NO: 2394910 - protein, 18 aa, Entamoeba dispar
VSLKELWVSSKVEKILLN

SEQ ID NO: 2394911 - protein, 18 aa, Entamoeba dispar
VSLLLSVFIFRFTHKFYS

SEQ ID NO: 2394912 - protein, 19 aa, Entamoeba dispar
VSPRFVLYFVFYLINLYLS

SEQ ID NO: 2394913 - protein, 18 aa, Entamoeba dispar
VSPVFPFPIINYILPPVV

SEQ ID NO: 2394914 - protein, 20 aa, Entamoeba dispar
VSSFKRIIKYVVFTASDEKC

SEQ ID NO: 2394915 - protein, 18 aa, Entamoeba dispar
VSTLRLKYYGTWKLTESL

SEQ ID NO: 2394916 - protein, 24 aa, Entamoeba dispar
VSWIWRIIVIIAFEFLEMSVFLIP

SEQ ID NO: 2394917 - protein, 25 aa, Entamoeba dispar
VSWIWRIIVIIAFEFLEMSVFLIPL

SEQ ID NO: 2394918 - protein, 19 aa, Entamoeba dispar
VTIDYFWTFCVFAGIFLGI

SEQ ID NO: 2394919 - protein, 21 aa, Entamoeba dispar
VTVCCFLLFFIIIAIIGVLLA

SEQ ID NO: 2394920 - protein, 18 aa, Entamoeba dispar
VVASLILSFSMLFKQDNR

SEQ ID NO: 2394921 - protein, 25 aa, Entamoeba dispar
VVCCIIAGLLFRFKPLIYLTRFVPF

SEQ ID NO: 2394922 - protein, 17 aa, Entamoeba dispar
VVCSILWMMDDMPMFAF

SEQ ID NO: 2394923 - protein, 18 aa, Entamoeba dispar
VVECPYWLAPEVILNNHF

SEQ ID NO: 2394924 - protein, 20 aa, Entamoeba dispar
VVICTCSYYLIIVVVLVLIA

SEQ ID NO: 2394925 - protein, 17 aa, Entamoeba dispar
VVLARFIVRQMRKLMII

SEQ ID NO: 2394926 - protein, 26 aa, Entamoeba dispar
VVLREENRWFIPIAIVGVILIISIVL

SEQ ID NO: 2394927 - protein, 24 aa, Entamoeba dispar
VVNLPEIVRYLGLNMEDILPDLIG

SEQ ID NO: 2394928 - protein, 18 aa, Entamoeba dispar
VVTYSIYWLPYVNLAQDY

SEQ ID NO: 2394929 - protein, 19 aa, Entamoeba dispar
VWKCDKCGLLNEGDHCVLC

SEQ ID NO: 2394930 - protein, 20 aa, Entamoeba dispar
VYEIRTILDWCLSKTSMFYK

SEQ ID NO: 2394931 - protein, 18 aa, Entamoeba dispar
VYFKWGLIIVNVIILVVG

SEQ ID NO: 2394932 - protein, 19 aa, Entamoeba dispar
VYFKWGLIVVNVIILVVGV

SEQ ID NO: 2394933 - protein, 21 aa, Entamoeba dispar
VYPFMRFELIPSLIVLYRTYF

SEQ ID NO: 2394934 - protein, 18 aa, Entamoeba dispar
VYSAIMVILWGARKWLDV

SEQ ID NO: 2394935 - protein, 25 aa, Entamoeba dispar
VYSFAICMLEIWLGRDPYDPAKFPD

SEQ ID NO: 2394936 - protein, 26 aa, Entamoeba dispar
VYSFAICMLEIWLGRDPYDPIKFPDS

SEQ ID NO: 2394937 - protein, 25 aa, Entamoeba dispar
VYSFAICMLEIWLGRDPYNPTKFPD

SEQ ID NO: 2394938 - protein, 18 aa, Entamoeba dispar
VYSFAICMLEIWNNGSLY

SEQ ID NO: 2394939 - protein, 20 aa, Entamoeba dispar
WAKECYHISFGMVMGMSTRR

SEQ ID NO: 2394940 - protein, 17 aa, Entamoeba dispar
WDIICLFSVIIHISSMR

SEQ ID NO: 2394941 - protein, 17 aa, Entamoeba dispar
WDISYDYSFDNYDYYQE

SEQ ID NO: 2394942 - protein, 19 aa, Entamoeba dispar
WDLFWGFSVDYEFNSKQLF

SEQ ID NO: 2394943 - protein, 17 aa, Entamoeba dispar
WDNARFWGCIISYNGDE

SEQ ID NO: 2394944 - protein, 17 aa, Entamoeba dispar
WDVLISVLLCFFIAFLI

SEQ ID NO: 2394945 - protein, 18 aa, Entamoeba dispar
WELLFVFLVGFFRCSFFT

SEQ ID NO: 2394946 - protein, 20 aa, Entamoeba dispar
WFRPASFFPLGYMYEILDKY

SEQ ID NO: 2394947 - protein, 22 aa, Entamoeba dispar
WFYPCGKFGILLGIFLPTLILA

SEQ ID NO: 2394948 - protein, 19 aa, Entamoeba dispar
WIMICVIIGILLIVIAGIY

SEQ ID NO: 2394949 - protein, 26 aa, Entamoeba dispar
WIMLLKFHISFLFSIQFEKLENLIYS

SEQ ID NO: 2394950 - protein, 17 aa, Entamoeba dispar
WISELPLNMKNLEIPTD

SEQ ID NO: 2394951 - protein, 21 aa, Entamoeba dispar
WKFHVTFCIASLFMLQNMVDW

SEQ ID NO: 2394952 - protein, 21 aa, Entamoeba dispar
WKFSYKSGYYFGLLNIIFVSV

SEQ ID NO: 2394953 - protein, 31 aa, Entamoeba dispar
WKHVCIVWTRCYDCFPSFMIENSKIEKKKFK

SEQ ID NO: 2394954 - protein, 21 aa, Entamoeba dispar
WKSIVIPLLIGFIIPLISNII

SEQ ID NO: 2394955 - protein, 22 aa, Entamoeba dispar
WLLNGTVCIANFFATERQVDCL

SEQ ID NO: 2394956 - protein, 19 aa, Entamoeba dispar
WLTNEWLHFSKLKEYYSVY

SEQ ID NO: 2394957 - protein, 20 aa, Entamoeba dispar
WMSSCCCWILFNVKVFEELI

SEQ ID NO: 2394958 - protein, 18 aa, Entamoeba dispar
WNKIKIIIKCFDLREEHI

SEQ ID NO: 2394959 - protein, 19 aa, Entamoeba dispar
WNLFKCSFILLKFSLFAIP

SEQ ID NO: 2394960 - protein, 18 aa, Entamoeba dispar
WPIMLRFAYQIASGMASL

SEQ ID NO: 2394961 - protein, 17 aa, Entamoeba dispar
WPQVLKFNADVWKFEDI

SEQ ID NO: 2394962 - protein, 24 aa, Entamoeba dispar
WPSCSNPFLYCCAANVSSDNAVHR

SEQ ID NO: 2394963 - protein, 19 aa, Entamoeba dispar
WQAAEIIAIIVTFGGIDIV

SEQ ID NO: 2394964 - protein, 17 aa, Entamoeba dispar
WRHSVVIITKCLELFTV

SEQ ID NO: 2394965 - protein, 18 aa, Entamoeba dispar
WRIDLTLKLLSVISLDRF

SEQ ID NO: 2394966 - protein, 17 aa, Entamoeba dispar
WRITLLTCMCCCTLFFM

SEQ ID NO: 2394967 - protein, 18 aa, Entamoeba dispar
WRKHYHSWNIFFLSGSVI

SEQ ID NO: 2394968 - protein, 17 aa, Entamoeba dispar
WRSSMIIGTIFKQGNTY

SEQ ID NO: 2394969 - protein, 21 aa, Entamoeba dispar
WSCAIGEYFFYFSCYGCPNGY

SEQ ID NO: 2394970 - protein, 17 aa, Entamoeba dispar
WSIHCCIMAFEKASRYE

SEQ ID NO: 2394971 - protein, 21 aa, Entamoeba dispar
WSPPRFECWWLVRVIPHIFLI

SEQ ID NO: 2394972 - protein, 17 aa, Entamoeba dispar
WVVFSCIIQILKHFQSI

SEQ ID NO: 2394973 - protein, 24 aa, Entamoeba dispar
WWFIYAVVCVATFTVLKLFIKKDD

SEQ ID NO: 2394974 - protein, 25 aa, Entamoeba dispar
WWFVYALVCVMTFGALKYFGANDDF

SEQ ID NO: 2394975 - protein, 18 aa, Entamoeba dispar
WYHLECVPAQFKTIKLSS

SEQ ID NO: 2394976 - protein, 18 aa, Entamoeba dispar
YACGSCVDSVKTICPSNT

SEQ ID NO: 2394977 - protein, 21 aa, Entamoeba dispar
YAFDFCFKWINKLKWIIIVFW

SEQ ID NO: 2394978 - protein, 21 aa, Entamoeba dispar
YAICILEIWICESVYPEDEFH

SEQ ID NO: 2394979 - protein, 20 aa, Entamoeba dispar
YAICLLEIWLGRSPYSPIKF

SEQ ID NO: 2394980 - protein, 19 aa, Entamoeba dispar
YAIFVCIGMVLKIRPEVLL

SEQ ID NO: 2394981 - protein, 19 aa, Entamoeba dispar
YAVSLCIIFGFSLLAIKRF

SEQ ID NO: 2394982 - protein, 19 aa, Entamoeba dispar
YCPCYSSNCILQLLPSISF

SEQ ID NO: 2394983 - protein, 19 aa, Entamoeba dispar
YCVSNALALQLKWANLTYL

SEQ ID NO: 2394984 - protein, 24 aa, Entamoeba dispar
YDSIGVICKFCLNNIQPHLLIQLH

SEQ ID NO: 2394985 - protein, 17 aa, Entamoeba dispar
YDSWVIFHLYDIVKQCN

SEQ ID NO: 2394986 - protein, 24 aa, Entamoeba dispar
YDYLSLLSIESFCLIILKRSIIEP

SEQ ID NO: 2394987 - protein, 27 aa, Entamoeba dispar
YEAGGMACLVCCIFTLLGCCYCGLIAC

SEQ ID NO: 2394988 - protein, 19 aa, Entamoeba dispar
YECIPQFYSCYSLFTPNEK

SEQ ID NO: 2394989 - protein, 24 aa, Entamoeba dispar
YEEAARLFVLISIRIPDLYEGILE

SEQ ID NO: 2394990 - protein, 23 aa, Entamoeba dispar
YEFSESITTFFLFIGIHFFFLSG

SEQ ID NO: 2394991 - protein, 19 aa, Entamoeba dispar
YEIAWRFGGNSLRTFTKVV

SEQ ID NO: 2394992 - protein, 19 aa, Entamoeba dispar
YEILRRIIQYCISRYNNNQ

SEQ ID NO: 2394993 - protein, 19 aa, Entamoeba dispar
YFDEVFKGLILFHFLCHNG

SEQ ID NO: 2394994 - protein, 19 aa, Entamoeba dispar
YFDSFKAILPFKFIIDQST

SEQ ID NO: 2394995 - protein, 18 aa, Entamoeba dispar
YFHLKWYNTIYMKQKELE

SEQ ID NO: 2394996 - protein, 31 aa, Entamoeba dispar
YFIKSIVVLLCCVFVGIIILFFIKSKRKSTE

SEQ ID NO: 2394997 - protein, 21 aa, Entamoeba dispar
YFIRLCQLLSFHGPKVAPTMS

SEQ ID NO: 2394998 - protein, 17 aa, Entamoeba dispar
YFKAIVCGIIIFFVKFW

SEQ ID NO: 2394999 - protein, 25 aa, Entamoeba dispar
YFNKLISIILDWARYTKYSIIDFYH

SEQ ID NO: 2395000 - protein, 19 aa, Entamoeba dispar
YFRRLCVHPMLVLDEQHPM

SEQ ID NO: 2395001 - protein, 20 aa, Entamoeba dispar
YFSKEWCFYHNTNIKSNTSE

SEQ ID NO: 2395002 - protein, 19 aa, Entamoeba dispar
YFVKDSFLGWRYVDFNNSK

SEQ ID NO: 2395003 - protein, 19 aa, Entamoeba dispar
YFWELCWDILRSNSISRKP

SEQ ID NO: 2395004 - protein, 20 aa, Entamoeba dispar
YFWTFCVFAGIFLGIPYDES

SEQ ID NO: 2395005 - protein, 21 aa, Entamoeba dispar
YFYCSFCTSLLKKRKCDSDLS

SEQ ID NO: 2395006 - protein, 22 aa, Entamoeba dispar
YFYLFPAFCLPWFVKQKKNIPM

SEQ ID NO: 2395007 - protein, 17 aa, Entamoeba dispar
YGAFCFDFNKSIIMEYA

SEQ ID NO: 2395008 - protein, 19 aa, Entamoeba dispar
YGARCLTGYYLINKECSKC

SEQ ID NO: 2395009 - protein, 19 aa, Entamoeba dispar
YGCLRCMTGYYLKDGICSS

SEQ ID NO: 2395010 - protein, 22 aa, Entamoeba dispar
YGICYRCIPKYYPNGVKCEQCL

SEQ ID NO: 2395011 - protein, 17 aa, Entamoeba dispar
YGVHVTFFIIGERVKGR

SEQ ID NO: 2395012 - protein, 18 aa, Entamoeba dispar
YGYQRVEPLLGFINGFFL

SEQ ID NO: 2395013 - protein, 17 aa, Entamoeba dispar
YHAWRYIALTGNASLIP

SEQ ID NO: 2395014 - protein, 17 aa, Entamoeba dispar
YHPRCLLQLLFAGSFKQ

SEQ ID NO: 2395015 - protein, 17 aa, Entamoeba dispar
YICPLPYTCIDSNNCQH

SEQ ID NO: 2395016 - protein, 18 aa, Entamoeba dispar
YIFCITFFIVGWITNNDS

SEQ ID NO: 2395017 - protein, 17 aa, Entamoeba dispar
YIFRIIETMSFYIVTLL

SEQ ID NO: 2395018 - protein, 20 aa, Entamoeba dispar
YIICHTLRLRFYLNSININT

SEQ ID NO: 2395019 - protein, 20 aa, Entamoeba dispar
YITNECRLIFSVLPSISNVI

SEQ ID NO: 2395020 - protein, 23 aa, Entamoeba dispar
YITYRFIHRYGFDLDSGMICKDN

SEQ ID NO: 2395021 - protein, 17 aa, Entamoeba dispar
YIYKRWFLIHLLEVLLY

SEQ ID NO: 2395022 - protein, 20 aa, Entamoeba dispar
YKANCYRFNKQTGVCNSNCY

SEQ ID NO: 2395023 - protein, 24 aa, Entamoeba dispar
YKCDEVFKIPKKCTFKTENSNIDF

SEQ ID NO: 2395024 - protein, 17 aa, Entamoeba dispar
YKEIEGISSLFEEIQHI

SEQ ID NO: 2395025 - protein, 20 aa, Entamoeba dispar
YKFKECTGITTNIEKSDLTT

SEQ ID NO: 2395026 - protein, 19 aa, Entamoeba dispar
YKGFSWIRIVLKSGSKTPT

SEQ ID NO: 2395027 - protein, 20 aa, Entamoeba dispar
YKIIGGIGMFALVVVALIEL

SEQ ID NO: 2395028 - protein, 18 aa, Entamoeba dispar
YKILRIAAQYHREIVSHY

SEQ ID NO: 2395029 - protein, 18 aa, Entamoeba dispar
YKKWSRKHAKSFTIDGQS

SEQ ID NO: 2395030 - protein, 19 aa, Entamoeba dispar
YKLCYYRFGELMTEKNKPT

SEQ ID NO: 2395031 - protein, 24 aa, Entamoeba dispar
YKLKLKIMRDVECGLHYLHESKLL

SEQ ID NO: 2395032 - protein, 17 aa, Entamoeba dispar
YKLKVNWPKYSYKQLGG

SEQ ID NO: 2395033 - protein, 18 aa, Entamoeba dispar
YKLLRGIMNYCNYPDPDI

SEQ ID NO: 2395034 - protein, 18 aa, Entamoeba dispar
YKNAAFFLMDIWFATISN

SEQ ID NO: 2395035 - protein, 17 aa, Entamoeba dispar
YKQFLGIGVTDLGEILI

SEQ ID NO: 2395036 - protein, 20 aa, Entamoeba dispar
YKWKEMFLNFDLIQKLWKIT

SEQ ID NO: 2395037 - protein, 18 aa, Entamoeba dispar
YLALDAMCSMCTVGCDKE

SEQ ID NO: 2395038 - protein, 18 aa, Entamoeba dispar
YLCNGFNYIHSVFVLSAS

SEQ ID NO: 2395039 - protein, 22 aa, Entamoeba dispar
YLECFKPICLCLRAMSECFKCN

SEQ ID NO: 2395040 - protein, 22 aa, Entamoeba dispar
YLENDANCSFGIIKSDETKENN

SEQ ID NO: 2395041 - protein, 17 aa, Entamoeba dispar
YLILCFIIKLVMIALAI

SEQ ID NO: 2395042 - protein, 20 aa, Entamoeba dispar
YLKDEFTQLLAIKVLSDCAK

SEQ ID NO: 2395043 - protein, 17 aa, Entamoeba dispar
YLKHIISIISFNLLLGI

SEQ ID NO: 2395044 - protein, 27 aa, Entamoeba dispar
YLKQYWPEILWRWYVKKGMYEESIKCI

SEQ ID NO: 2395045 - protein, 17 aa, Entamoeba dispar
YLPLFLKQFIPIIEQIQ

SEQ ID NO: 2395046 - protein, 23 aa, Entamoeba dispar
YMFICIYDYMTICLYVYMYISLY

SEQ ID NO: 2395047 - protein, 24 aa, Entamoeba dispar
YMFRWLTLLCCMEFTLFETFMYWD

SEQ ID NO: 2395048 - protein, 19 aa, Entamoeba dispar
YMIQSAIKDICWIVMKIEK

SEQ ID NO: 2395049 - protein, 18 aa, Entamoeba dispar
YMKSCLKQIGGVSSIIIA

SEQ ID NO: 2395050 - protein, 17 aa, Entamoeba dispar
YMSVCFALICANMFTRW

SEQ ID NO: 2395051 - protein, 17 aa, Entamoeba dispar
YNPSIIISYYIKQSIGG

SEQ ID NO: 2395052 - protein, 18 aa, Entamoeba dispar
YNSIRPHWNISIVKLITI

SEQ ID NO: 2395053 - protein, 17 aa, Entamoeba dispar
YPELLGLLIEVASNERN

SEQ ID NO: 2395054 - protein, 18 aa, Entamoeba dispar
YPEYRYLCCFDEECSPML

SEQ ID NO: 2395055 - protein, 23 aa, Entamoeba dispar
YPFCWRSDTPLIYRAIPSWFVNV

SEQ ID NO: 2395056 - protein, 22 aa, Entamoeba dispar
YPGTCPLLKFIVVGGLGTIIDI

SEQ ID NO: 2395057 - protein, 17 aa, Entamoeba dispar
YPILQWVLRSCVLIAYF

SEQ ID NO: 2395058 - protein, 17 aa, Entamoeba dispar
YPITWAAVPGFVEITNV

SEQ ID NO: 2395059 - protein, 18 aa, Entamoeba dispar
YPSIHLLYLIVSYRPELF

SEQ ID NO: 2395060 - protein, 18 aa, Entamoeba dispar
YPSPFRIAYELPIKLPYH

SEQ ID NO: 2395061 - protein, 17 aa, Entamoeba dispar
YPYCWDLIKDFLVIFFL

SEQ ID NO: 2395062 - protein, 19 aa, Entamoeba dispar
YQKCYLFYTIIGLFVLFAY

SEQ ID NO: 2395063 - protein, 17 aa, Entamoeba dispar
YRFGFPYQYSFIVLLIF

SEQ ID NO: 2395064 - protein, 17 aa, Entamoeba dispar
YRFNEIFVLLRESFNTI

SEQ ID NO: 2395065 - protein, 18 aa, Entamoeba dispar
YRFTYTMPLAFVVILAMA

SEQ ID NO: 2395066 - protein, 25 aa, Entamoeba dispar
YRHCFYLICGLVILLLILYFVFFKM

SEQ ID NO: 2395067 - protein, 17 aa, Entamoeba dispar
YRKTFCFSFQHESDIIE

SEQ ID NO: 2395068 - protein, 17 aa, Entamoeba dispar
YRLIKVIFMPKTTAPQT

SEQ ID NO: 2395069 - protein, 17 aa, Entamoeba dispar
YRNGWEYSNKFGDNKDV

SEQ ID NO: 2395070 - protein, 20 aa, Entamoeba dispar
YRNIFKWAPLLALVNSLSNL

SEQ ID NO: 2395071 - protein, 20 aa, Entamoeba dispar
YRNIFKWAPLLALVNSLSYL

SEQ ID NO: 2395072 - protein, 17 aa, Entamoeba dispar
YRRSVILLGLIVTVILY

SEQ ID NO: 2395073 - protein, 18 aa, Entamoeba dispar
YRSHFLRMIEEIIDFIPS

SEQ ID NO: 2395074 - protein, 22 aa, Entamoeba dispar
YRTGWRYPINIILHLFLFTIGG

SEQ ID NO: 2395075 - protein, 21 aa, Entamoeba dispar
YRVDREIQHGFILFECTTELM

SEQ ID NO: 2395076 - protein, 17 aa, Entamoeba dispar
YRYLCCFDEECSPMLPA

SEQ ID NO: 2395077 - protein, 17 aa, Entamoeba dispar
YRYLLNATFVYPTEQNN

SEQ ID NO: 2395078 - protein, 19 aa, Entamoeba dispar
YRYTKCLNVWTGTPHGVFA

SEQ ID NO: 2395079 - protein, 17 aa, Entamoeba dispar
YSCAKFIDFWGLFICCV

SEQ ID NO: 2395080 - protein, 24 aa, Entamoeba dispar
YSDCGWRCGFIPQRTGEILPIEYI

SEQ ID NO: 2395081 - protein, 21 aa, Entamoeba dispar
YSDDCSLHFFELIKQSAQCID

SEQ ID NO: 2395082 - protein, 26 aa, Entamoeba dispar
YSEEWKKVVWRCGRWIDMDHPYKTMD

SEQ ID NO: 2395083 - protein, 17 aa, Entamoeba dispar
YSFPSTIIILWSNFIVT

SEQ ID NO: 2395084 - protein, 21 aa, Entamoeba dispar
YSGCLQLRLTSLQIINTILTK

SEQ ID NO: 2395085 - protein, 17 aa, Entamoeba dispar
YSICITNSIPFPQFLPS

SEQ ID NO: 2395086 - protein, 22 aa, Entamoeba dispar
YSKFLWKFKWIILAVVVLCCII

SEQ ID NO: 2395087 - protein, 18 aa, Entamoeba dispar
YSLCFFRVLYLDCLLSEA

SEQ ID NO: 2395088 - protein, 20 aa, Entamoeba dispar
YSLELPTIWKGWNQQQQAKY

SEQ ID NO: 2395089 - protein, 21 aa, Entamoeba dispar
YSPFFRRLMSLLLLSQVFIKL

SEQ ID NO: 2395090 - protein, 22 aa, Entamoeba dispar
YSRITLCPLKIIPDNDCTCTFK

SEQ ID NO: 2395091 - protein, 21 aa, Entamoeba dispar
YSSNCILQLLPSISFFDIDHF

SEQ ID NO: 2395092 - protein, 19 aa, Entamoeba dispar
YSSVHGIHYFMIGIVSIIV

SEQ ID NO: 2395093 - protein, 20 aa, Entamoeba dispar
YSSYCIYFFNNFAYGMPGIE

SEQ ID NO: 2395094 - protein, 23 aa, Entamoeba dispar
YTIPCTFIPISLYHYMFICIYDY

SEQ ID NO: 2395095 - protein, 17 aa, Entamoeba dispar
YTIPLIFYLTTSNNDFL

SEQ ID NO: 2395096 - protein, 18 aa, Entamoeba dispar
YTLSCVPSYCDYGYKFDR

SEQ ID NO: 2395097 - protein, 22 aa, Entamoeba dispar
YTPCYWRSVLGFGYILLNFTME

SEQ ID NO: 2395098 - protein, 17 aa, Entamoeba dispar
YTPVCILEIKEDITDDL

SEQ ID NO: 2395099 - protein, 18 aa, Entamoeba dispar
YTQELLRWNRLIVTVCLN

SEQ ID NO: 2395100 - protein, 18 aa, Entamoeba dispar
YTQLEWDLFWGFSVDYEF

SEQ ID NO: 2395101 - protein, 20 aa, Entamoeba dispar
YTSDLKLRWKQQVYSSIAQP

SEQ ID NO: 2395102 - protein, 26 aa, Entamoeba dispar
YVKLPYRLKIRMLFDTARGMQFLHEN

SEQ ID NO: 2395103 - protein, 24 aa, Entamoeba dispar
YVSCLCKMISYLISEFKERAQICV

SEQ ID NO: 2395104 - protein, 18 aa, Entamoeba dispar
YWLGFYVRNYVIGLKGVK

SEQ ID NO: 2395105 - protein, 18 aa, Entamoeba dispar
YYAFPGFLTCLYKTITIG

SEQ ID NO: 2395106 - protein, 24 aa, Entamoeba dispar
YYFVWEFGELLSILMGFGYSGMKD

SEQ ID NO: 2395107 - protein, 24 aa, Entamoeba dispar
YYIPQCWMEYRIIPFDEYKEKVFK

SEQ ID NO: 2395108 - protein, 18 aa, Entamoeba dispar
YYLLCILYPLSVYLFLYI

SEQ ID NO: 2395109 - protein, 44 aa, Entamoeba dispar
KCNKEIVWWMIMIIIIIILIIIIIIIIIIIIMINYIIKRKEKKE

SEQ ID NO: 2395110 - protein, 26 aa, Entamoeba dispar
DKFRSEYIIHFYGAVFIPNKICMITE

SEQ ID NO: 2395111 - protein, 19 aa, Entamoeba dispar
VYTLFFYIIYTILYYFILS

SEQ ID NO: 2395112 - protein, 42 aa, Entamoeba dispar
CNKEIVWWMIMIIIIIILIIIIIIIIIIIIMINYIIKRKEKK

SEQ ID NO: 2395113 - protein, 18 aa, Entamoeba dispar
ACEFEIFITIKCTTKIKE

SEQ ID NO: 2395114 - protein, 19 aa, Entamoeba dispar
ACEFEIFITIKCTTKIKEQ

SEQ ID NO: 2395115 - protein, 43 aa, Entamoeba dispar
CNKEIVWWMIMIIIIIILIIIIIIIIIIIIMINYIIKRKEKKE

SEQ ID NO: 2395116 - protein, 26 aa, Entamoeba dispar
DKFRSEYIIHFYGAVFIPNKICMVTE

SEQ ID NO: 2395117 - protein, 32 aa, Entamoeba dispar
GKVNLIKLFKYSDWIDLILLIIGIISSIGNGI

SEQ ID NO: 2395118 - protein, 22 aa, Entamoeba dispar
DFHSFTYFPINKCTYYDGNYYE

SEQ ID NO: 2395119 - protein, 23 aa, Entamoeba dispar
ESEKGIIKIKKARHPLIENNSIN

SEQ ID NO: 2395120 - protein, 25 aa, Entamoeba dispar
EVGKVFTCIAYFNAIRRPFMNFGYF

SEQ ID NO: 2395121 - protein, 28 aa, Entamoeba dispar
FFNCCLILLQLFVAGLIVLLLDELLSNG

SEQ ID NO: 2395122 - protein, 19 aa, Entamoeba dispar
KIRDMKIPYTVWFSKSKST

SEQ ID NO: 2395123 - protein, 17 aa, Entamoeba dispar
LCVFADKYYVVDDFHSF

SEQ ID NO: 2395124 - protein, 28 aa, Entamoeba dispar
LDKFRSEYIIHFYGAVFIPNKICMITEY

SEQ ID NO: 2395125 - protein, 18 aa, Entamoeba dispar
LIVVIVSGLIFVGLVVFA

SEQ ID NO: 2395126 - protein, 27 aa, Entamoeba dispar
NKEIVWWMIMIIIIIILIIIIIIIIII

SEQ ID NO: 2395127 - protein, 17 aa, Entamoeba dispar
RECIECEKGYYLNSNKE

SEQ ID NO: 2395128 - protein, 18 aa, Entamoeba dispar
SFAICMLEIWLGRDPYDP

SEQ ID NO: 2395129 - protein, 20 aa, Entamoeba dispar
SMVLSFMRTFSLFVVSQREG

SEQ ID NO: 2395130 - protein, 29 aa, Entamoeba dispar
VILDNFRHEWFLSILGFIGGIGGGAIFPF

SEQ ID NO: 2395131 - protein, 20 aa, Entamoeba dispar
YACEFEIFITIKCTTKIKEQ

SEQ ID NO: 2395132 - protein, 25 aa, Entamoeba dispar
ADVLNEFNLLILKSGSKQTAHYYSH

SEQ ID NO: 2395133 - protein, 20 aa, Entamoeba dispar
AFLTSSIIIIFLLYAKIINN

SEQ ID NO: 2395134 - protein, 22 aa, Entamoeba dispar
AGKSYLQPFLELNPPKHEEEID

SEQ ID NO: 2395135 - protein, 27 aa, Entamoeba dispar
ALLGLICILFLRIFLYYCHIDTSDLFT

SEQ ID NO: 2395136 - protein, 24 aa, Entamoeba dispar
ALPQIHYLLHRPAIPSYRYPDVDP

SEQ ID NO: 2395137 - protein, 31 aa, Entamoeba dispar
ALREPRRGIYKWAPLLSIFNCLTTLLTQVMN

SEQ ID NO: 2395138 - protein, 23 aa, Entamoeba dispar
CAVILIVAVVVRKYLNLKSQKQN

SEQ ID NO: 2395139 - protein, 27 aa, Entamoeba dispar
CFRDDVIFLIYLYQRWIYPVDKNRMDS

SEQ ID NO: 2395140 - protein, 24 aa, Entamoeba dispar
CGKSTIIGLLQRLYEPVDGKIMID

SEQ ID NO: 2395141 - protein, 43 aa, Entamoeba dispar
CNKEIVWWMIMIIIIIILIIIIIIIIIIIIMINYIITRKEKKE

SEQ ID NO: 2395142 - protein, 25 aa, Entamoeba dispar
DCTSIVIIATVSPFLRVLHQKEKAT

SEQ ID NO: 2395143 - protein, 25 aa, Entamoeba dispar
DKFRSEYIIHFYGAVFIPNKICMIT

SEQ ID NO: 2395144 - protein, 27 aa, Entamoeba dispar
DKFRSEYIIHFYGAVFIPNKICMVTEY

SEQ ID NO: 2395145 - protein, 25 aa, Entamoeba dispar
DKFRSEYIIQFYGAVFIPNKICMIT

SEQ ID NO: 2395146 - protein, 35 aa, Entamoeba dispar
DYTAYKPNLILKVLSYFLPFSIYINDDNKKMYLRT

SEQ ID NO: 2395147 - protein, 18 aa, Entamoeba dispar
DYYKAFLKQLEQGHIPLI

SEQ ID NO: 2395148 - protein, 23 aa, Entamoeba dispar
EEEPKEEFWFISINRYEGKKNHK

SEQ ID NO: 2395149 - protein, 28 aa, Entamoeba dispar
EGEGLQAIVLMPFQLLAFGKSVLDEHIK

SEQ ID NO: 2395150 - protein, 28 aa, Entamoeba dispar
EGIRVRKLYFKSLLRQDATWYDFQESGE

SEQ ID NO: 2395151 - protein, 31 aa, Entamoeba dispar
EISIRNYIAYFYYFLPFNIMIDKEKHMYLIP

SEQ ID NO: 2395152 - protein, 21 aa, Entamoeba dispar
EKFKCIQCKKGYYLNSKQECQ

SEQ ID NO: 2395153 - protein, 23 aa, Entamoeba dispar
EKMIKEWIRQPLIDKDKINKRLE

SEQ ID NO: 2395154 - protein, 31 aa, Entamoeba dispar
EPPRDVIINKPYFFIITGEEQYPLFFGKVSH

SEQ ID NO: 2395155 - protein, 31 aa, Entamoeba dispar
ERQGIKIRMLYFRALLRQDAGWYDFHESGEL

SEQ ID NO: 2395156 - protein, 24 aa, Entamoeba dispar
ETVRLPCFCVFHKDCLISLFDQSI

SEQ ID NO: 2395157 - protein, 20 aa, Entamoeba dispar
FALGIAFYYDWRVSLCVMAV

SEQ ID NO: 2395158 - protein, 21 aa, Entamoeba dispar
FFIILVLITFCLSILTTFTFI

SEQ ID NO: 2395159 - protein, 17 aa, Entamoeba dispar
FGDKKEMTLFKHLNRTH

SEQ ID NO: 2395160 - protein, 31 aa, Entamoeba dispar
FGPLRQLILFNFFLGGYVFLPYVFSIEKSTP

SEQ ID NO: 2395161 - protein, 20 aa, Entamoeba dispar
FIFIISFVLILYVPTQIENN

SEQ ID NO: 2395162 - protein, 23 aa, Entamoeba dispar
FNAIRRPFMNFGYFVSCVTTFKV

SEQ ID NO: 2395163 - protein, 18 aa, Entamoeba dispar
FNLFLVLVNWRVGAMVRK

SEQ ID NO: 2395164 - protein, 25 aa, Entamoeba dispar
FSMTITGYIIGFIKSWDLALVVLAT

SEQ ID NO: 2395165 - protein, 17 aa, Entamoeba dispar
GACKDRYYLDPSSHLCG

SEQ ID NO: 2395166 - protein, 17 aa, Entamoeba dispar
GCGICKNGYYRNGKGCS

SEQ ID NO: 2395167 - protein, 27 aa, Entamoeba dispar
GEYIPIQWYFGMIILIIGVILLIVDNY

SEQ ID NO: 2395168 - protein, 23 aa, Entamoeba dispar
GLTVFMCTIFSREWIKVSGSSSA

SEQ ID NO: 2395169 - protein, 20 aa, Entamoeba dispar
GQEPILFAGTIRENIILGTR

SEQ ID NO: 2395170 - protein, 21 aa, Entamoeba dispar
GQEPILFAGTIRENIILGTRE

SEQ ID NO: 2395171 - protein, 25 aa, Entamoeba dispar
GRHNLLLFYFFFLTLITLCLYGFVC

SEQ ID NO: 2395172 - protein, 19 aa, Entamoeba dispar
GSIINFFHLLITRPDKLGA

SEQ ID NO: 2395173 - protein, 22 aa, Entamoeba dispar
GVCLKCQIGFNLASDQTKCVKC

SEQ ID NO: 2395174 - protein, 20 aa, Entamoeba dispar
GYSFSLYFSALIVMVAFVVF

SEQ ID NO: 2395175 - protein, 22 aa, Entamoeba dispar
HQELIDLKGFYYTLAMQQFGTV

SEQ ID NO: 2395176 - protein, 21 aa, Entamoeba dispar
HQELIELKGFYYTLAMQQFGT

SEQ ID NO: 2395177 - protein, 26 aa, Entamoeba dispar
IATQGLSIIAIPLNIFATAKASAYRI

SEQ ID NO: 2395178 - protein, 26 aa, Entamoeba dispar
IDESYSLLFVLLIPRVNLLPRYNNVG

SEQ ID NO: 2395179 - protein, 25 aa, Entamoeba dispar
IEKRIMIDSLPYTGVALLGGSRSQW

SEQ ID NO: 2395180 - protein, 33 aa, Entamoeba dispar
IEVFILFMIVYIFSLLYIYFWSSGYAVFASTLI

SEQ ID NO: 2395181 - protein, 24 aa, Entamoeba dispar
IFGGMKFFETFPFILPNLVCSSIT

SEQ ID NO: 2395182 - protein, 17 aa, Entamoeba dispar
IFIIITMLALLFLSSKL

SEQ ID NO: 2395183 - protein, 18 aa, Entamoeba dispar
IFKSPILRTFKPIPQTHN

SEQ ID NO: 2395184 - protein, 27 aa, Entamoeba dispar
IGFGFSTFFTYATYALGSWYSNIAVRG

SEQ ID NO: 2395185 - protein, 23 aa, Entamoeba dispar
IGFVLIQFYSLPSSFFISFITAN

SEQ ID NO: 2395186 - protein, 28 aa, Entamoeba dispar
IGGGAIFPFFTLKIVDLIMCLLSINSDT

SEQ ID NO: 2395187 - protein, 24 aa, Entamoeba dispar
IGLILCLMPFVVRCASRVCYNLFI

SEQ ID NO: 2395188 - protein, 21 aa, Entamoeba dispar
IGMIIGYYFYCYKTITVTFTG

SEQ ID NO: 2395189 - protein, 33 aa, Entamoeba dispar
IGSIGNFILYNIPPCIYYLYPYGNVALWIGLSV

SEQ ID NO: 2395190 - protein, 27 aa, Entamoeba dispar
IIVSSLFVSFLIVCAVILIVAVVVRKY

SEQ ID NO: 2395191 - protein, 19 aa, Entamoeba dispar
IKMIMRLILEMYPSRTGMI

SEQ ID NO: 2395192 - protein, 25 aa, Entamoeba dispar
ILSQWIIIPTIIFIGPAFSVVYTAS

SEQ ID NO: 2395193 - protein, 26 aa, Entamoeba dispar
INMSTYFCWLIIPLLMKENGATPFDI

SEQ ID NO: 2395194 - protein, 18 aa, Entamoeba dispar
IPNKIRIKFMLDGAKGIS

SEQ ID NO: 2395195 - protein, 18 aa, Entamoeba dispar
ISIMIFTLNMIPFLLIID

SEQ ID NO: 2395196 - protein, 39 aa, Entamoeba dispar
ISKKLIKWIFLILFFIQWISFLLCYIIANYIVFYGIAFL

SEQ ID NO: 2395197 - protein, 17 aa, Entamoeba dispar
ITFIINYVIGQTNSTSE

SEQ ID NO: 2395198 - protein, 22 aa, Entamoeba dispar
ITGLKYYLEAYVFKDILKNPPQ

SEQ ID NO: 2395199 - protein, 18 aa, Entamoeba dispar
IVEILDHFLYCNHLCIVT

SEQ ID NO: 2395200 - protein, 28 aa, Entamoeba dispar
IVFSTHSMFIAFSLLYIGAASETKTQLE

SEQ ID NO: 2395201 - protein, 28 aa, Entamoeba dispar
IYNQPSFGTYYKKPIVRLILKEVDMSDN

SEQ ID NO: 2395202 - protein, 24 aa, Entamoeba dispar
KDWDLTLVIMSMSPFIVLSMTLLA

SEQ ID NO: 2395203 - protein, 20 aa, Entamoeba dispar
KFKCIQCKKGYYLNSKQECQ

SEQ ID NO: 2395204 - protein, 17 aa, Entamoeba dispar
KGVWYHITAPEDKTLQA

SEQ ID NO: 2395205 - protein, 17 aa, Entamoeba dispar
KGYRYMYSLFYRKDGTI

SEQ ID NO: 2395206 - protein, 21 aa, Entamoeba dispar
KYKMIYIIFSGLMNGMISYWK

SEQ ID NO: 2395207 - protein, 26 aa, Entamoeba dispar
LCLLPLLIVILLIVLPSLISCIKKRQ

SEQ ID NO: 2395208 - protein, 19 aa, Entamoeba dispar
LDHFLYCNHLCIVTELLGC

SEQ ID NO: 2395209 - protein, 27 aa, Entamoeba dispar
LDKFRSEYIIQFYGAVFIPNKICMITE

SEQ ID NO: 2395210 - protein, 26 aa, Entamoeba dispar
LGAVMFFIMGAFSLGSWYASVVLRGK

SEQ ID NO: 2395211 - protein, 17 aa, Entamoeba dispar
LHTIFDFLAYKNDIQFW

SEQ ID NO: 2395212 - protein, 17 aa, Entamoeba dispar
LILIFYFLLFTFYFFYV

SEQ ID NO: 2395213 - protein, 18 aa, Entamoeba dispar
LKTDKWELTFNLAKSKAI

SEQ ID NO: 2395214 - protein, 27 aa, Entamoeba dispar
LLMPTKSLFIFIIFAVLVVVSVCMVCT

SEQ ID NO: 2395215 - protein, 22 aa, Entamoeba dispar
LNIDHDIILYNFISAKQINVND

SEQ ID NO: 2395216 - protein, 24 aa, Entamoeba dispar
LNVPSYLQLLYSTLTPRLLLSPVM

SEQ ID NO: 2395217 - protein, 21 aa, Entamoeba dispar
LQPVMLLLMGDVIDSYIYTSE

SEQ ID NO: 2395218 - protein, 18 aa, Entamoeba dispar
LTVMYFQGFKVDIPLSSK

SEQ ID NO: 2395219 - protein, 18 aa, Entamoeba dispar
LVSLIELLPYLNGNSRKR

SEQ ID NO: 2395220 - protein, 21 aa, Entamoeba dispar
MAIGFIVFSFIYLNQIEKKEI

SEQ ID NO: 2395221 - protein, 28 aa, Entamoeba dispar
MIEQMKMNFIFFTLATLGGIVGGAIYPF

SEQ ID NO: 2395222 - protein, 20 aa, Entamoeba dispar
MMWTGITLLVFLVCSQIPLI

SEQ ID NO: 2395223 - protein, 19 aa, Entamoeba dispar
MTFRLITDKFVQIGIIALL

SEQ ID NO: 2395224 - protein, 26 aa, Entamoeba dispar
MVAEMFFGIPLFVANSELGLLRKQIK

SEQ ID NO: 2395225 - protein, 23 aa, Entamoeba dispar
NAVEFNLFVKPYCTCKVDDPILI

SEQ ID NO: 2395226 - protein, 26 aa, Entamoeba dispar
NEFKSWYSYILSLLVGLVYTFGFLQM

SEQ ID NO: 2395227 - protein, 24 aa, Entamoeba dispar
NHCYKIIFAFWKELNKAISFGYSS

SEQ ID NO: 2395228 - protein, 25 aa, Entamoeba dispar
NISIQLLEDFLFEKGYRYMYSLFYR

SEQ ID NO: 2395229 - protein, 17 aa, Entamoeba dispar
NPQLMTIPKGKALEFEV

SEQ ID NO: 2395230 - protein, 19 aa, Entamoeba dispar
NSFLDLLMPTKSLFIFIIF

SEQ ID NO: 2395231 - protein, 36 aa, Entamoeba dispar
NSRKRIIFDLLLEQYFRYFFMHWCDSVQFAFQTILL

SEQ ID NO: 2395232 - protein, 20 aa, Entamoeba dispar
NYPIQLIFSKNSGGSVLLSN

SEQ ID NO: 2395233 - protein, 20 aa, Entamoeba dispar
NYSIRLFYTSNMPIILHSAL

SEQ ID NO: 2395234 - protein, 24 aa, Entamoeba dispar
PATLRLTLFDFLNKCLTYKPEDRL

SEQ ID NO: 2395235 - protein, 21 aa, Entamoeba dispar
PEGYEIIFLGGGASLQFLMVA

SEQ ID NO: 2395236 - protein, 24 aa, Entamoeba dispar
PFPKTEFKFPWKIAEFISTGKRPP

SEQ ID NO: 2395237 - protein, 25 aa, Entamoeba dispar
PKRALQLMLILLFFGMGCLVLTGMK

SEQ ID NO: 2395238 - protein, 25 aa, Entamoeba dispar
PTGSILIILNFILKVLYALPQIHYL

SEQ ID NO: 2395239 - protein, 19 aa, Entamoeba dispar
PVDVYAYGIVLYETYVEHN

SEQ ID NO: 2395240 - protein, 24 aa, Entamoeba dispar
QCNVCEEMWVFDSLKQDCVYDSSS

SEQ ID NO: 2395241 - protein, 26 aa, Entamoeba dispar
QFAPFNILVYLFFKKAHGLYSIKSKD

SEQ ID NO: 2395242 - protein, 28 aa, Entamoeba dispar
QTTGSERIIFPMFFVNSKPLAGYDNSRS

SEQ ID NO: 2395243 - protein, 17 aa, Entamoeba dispar
RFVVRLYQFLFKQNTVQ

SEQ ID NO: 2395244 - protein, 26 aa, Entamoeba dispar
RIAQIPVFILLIVAFFFMCLVKNHHK

SEQ ID NO: 2395245 - protein, 22 aa, Entamoeba dispar
RLNIPVWMITYIGNIVSVIVMG

SEQ ID NO: 2395246 - protein, 19 aa, Entamoeba dispar
RQGMLEITALLILNKFYDS

SEQ ID NO: 2395247 - protein, 17 aa, Entamoeba dispar
RVSLCVMAVSPVLIVVV

SEQ ID NO: 2395248 - protein, 23 aa, Entamoeba dispar
SEKYKFLFTTHLCPLSDHIKCTT

SEQ ID NO: 2395249 - protein, 22 aa, Entamoeba dispar
SIKFDPLLFYDYLLNFSKSNNY

SEQ ID NO: 2395250 - protein, 23 aa, Entamoeba dispar
SILYIPYVFTPLVLLICLLSCII

SEQ ID NO: 2395251 - protein, 18 aa, Entamoeba dispar
SLCVMAVSPVLIVVVFIN

SEQ ID NO: 2395252 - protein, 17 aa, Entamoeba dispar
SLNQPQLIIWKSDYIHL

SEQ ID NO: 2395253 - protein, 23 aa, Entamoeba dispar
SPAVFIMAFFLTSSILTKVGMNK

SEQ ID NO: 2395254 - protein, 17 aa, Entamoeba dispar
SQNYSIRLFYTSNMPII

SEQ ID NO: 2395255 - protein, 25 aa, Entamoeba dispar
SQPSKIIFDKLIQTPSLGIHQLKKL

SEQ ID NO: 2395256 - protein, 23 aa, Entamoeba dispar
SSILLPTFLMYKALCLDTFASLT

SEQ ID NO: 2395257 - protein, 20 aa, Entamoeba dispar
SSVYLLDKYIPIAASFGGMC

SEQ ID NO: 2395258 - protein, 25 aa, Entamoeba dispar
STNVWNVILWYFFEISYHFYNCIVN

SEQ ID NO: 2395259 - protein, 27 aa, Entamoeba dispar
SVQFAFQTILLYRITLARFSKLDSLHP

SEQ ID NO: 2395260 - protein, 18 aa, Entamoeba dispar
SYSITMLQIITWEDPFPK

SEQ ID NO: 2395261 - protein, 18 aa, Entamoeba dispar
TFCFFVMSERQGIKIRML

SEQ ID NO: 2395262 - protein, 17 aa, Entamoeba dispar
TFFNLFLVLVNWRVGAM

SEQ ID NO: 2395263 - protein, 32 aa, Entamoeba dispar
TIGFIVFMPIYIILFCILIFKCISLAPLITLP

SEQ ID NO: 2395264 - protein, 22 aa, Entamoeba dispar
TKYPKFFDEITLVSGTQLSSIV

SEQ ID NO: 2395265 - protein, 26 aa, Entamoeba dispar
TLNMIPFLLIIDCIGFVLIQFYSLPS

SEQ ID NO: 2395266 - protein, 30 aa, Entamoeba dispar
TQTERDKFFNMIFPFVLFILDDSEKINEWK

SEQ ID NO: 2395267 - protein, 30 aa, Entamoeba dispar
TTFKLQNYKSLLYIIVEREYCFSDTANQEN

SEQ ID NO: 2395268 - protein, 26 aa, Entamoeba dispar
VGGAIYPFFTIKFIDLIVVMMEMREG

SEQ ID NO: 2395269 - protein, 17 aa, Entamoeba dispar
VGLGLGAVMFFIMGAFS

SEQ ID NO: 2395270 - protein, 30 aa, Entamoeba dispar
VIGVASFISYFMYIGLFLSAGFKMIGRVRK

SEQ ID NO: 2395271 - protein, 18 aa, Entamoeba dispar
VIIEFLQPGTISGDTIAV

SEQ ID NO: 2395272 - protein, 19 aa, Entamoeba dispar
VQESFALAFFWSICEYLLS

SEQ ID NO: 2395273 - protein, 32 aa, Entamoeba dispar
VTVRQLYRYANWLDLILLAVGIFGSIGCGVLT

SEQ ID NO: 2395274 - protein, 26 aa, Entamoeba dispar
VYLPQIFFYLLFYPNKKEFALFKLPL

SEQ ID NO: 2395275 - protein, 17 aa, Entamoeba dispar
WLQLIYQILISIDESYS

SEQ ID NO: 2395276 - protein, 19 aa, Entamoeba dispar
WRVFVYKFLNTIVDDLFAF

SEQ ID NO: 2395277 - protein, 21 aa, Entamoeba dispar
YACEFEIFITIKCTTKIKEQI

SEQ ID NO: 2395278 - protein, 17 aa, Entamoeba dispar
YITFFNLFLVLVNWRVG

SEQ ID NO: 2395279 - protein, 21 aa, Entamoeba dispar
YIYDRPAVFHTTLCSKTFLIW

SEQ ID NO: 2395280 - protein, 23 aa, Entamoeba dispar
YMYPLIMFILLLPFLLLLITLSY

SEQ ID NO: 2395281 - protein, 17 aa, Entamoeba dispar
YPDCLYNGSLYTLTVSN

SEQ ID NO: 2395282 - protein, 35 aa, Entamoeba dispar
YSYSITMLQIITWQDPFPKTLYPHPWDIANTISTG

SEQ ID NO: 2395283 - protein, 19 aa, Entamoeba dispar
YYRVSMFIFVFIGSLLVDV

SEQ ID NO: 2395284 - protein, 22 aa, Entamoeba dispar
AAAVYVLIGFFLIVASIVFTKD

SEQ ID NO: 2395285 - protein, 26 aa, Entamoeba dispar
AACTALFLLVLIFLLFFSGIISEETT

SEQ ID NO: 2395286 - protein, 33 aa, Entamoeba dispar
AADFIGRILIPYWIFLILIGCVSGIVHWKVTSK

SEQ ID NO: 2395287 - protein, 30 aa, Entamoeba dispar
AAELLRIDFLSILSSFPYFVEVSVPVVTPT

SEQ ID NO: 2395288 - protein, 33 aa, Entamoeba dispar
AAFVTLVDYYRYSPLLWYRLACSCIQYHYNYIK

SEQ ID NO: 2395289 - protein, 30 aa, Entamoeba dispar
AAHKKTLKHLAFLSPYYLSAISGLLLKNVN

SEQ ID NO: 2395290 - protein, 25 aa, Entamoeba dispar
AAIDTLIHDTIFFYGEREYSKSRCR

SEQ ID NO: 2395291 - protein, 32 aa, Entamoeba dispar
AALCFMICHYFTTFDPPLFPSDFRYYLVPPCE

SEQ ID NO: 2395292 - protein, 25 aa, Entamoeba dispar
AALFFCSMFWYHYIEKAPLINFKWC

SEQ ID NO: 2395293 - protein, 28 aa, Entamoeba dispar
AALTLIAILIFLHKIMNLSFCVVSTTLF

SEQ ID NO: 2395294 - protein, 37 aa, Entamoeba dispar
AANASTLWFAIIIIVVVILLTLWQVRSLKAFFLRRKL

SEQ ID NO: 2395295 - protein, 18 aa, Entamoeba dispar
AAQMLVIDPLAFRSWDDY

SEQ ID NO: 2395296 - protein, 28 aa, Entamoeba dispar
AARLPFSYYYFVSFLEDLLLIFEYTSDQ

SEQ ID NO: 2395297 - protein, 22 aa, Entamoeba dispar
AASGMFYLHSLTPPIIHLDLKS

SEQ ID NO: 2395298 - protein, 25 aa, Entamoeba dispar
AASSKKLFFLNNKNLEIFDITKATP

SEQ ID NO: 2395299 - protein, 26 aa, Entamoeba dispar
AASSKKLFFLNNKNLEIFDITKATPV

SEQ ID NO: 2395300 - protein, 24 aa, Entamoeba dispar
AAVDNPLFFYSNTRMFLSDCKKGF

SEQ ID NO: 2395301 - protein, 21 aa, Entamoeba dispar
AAVFIAFYIFTVKPVIEMQRL

SEQ ID NO: 2395302 - protein, 22 aa, Entamoeba dispar
AAVFVAFYIFTSKPVIEMQRLE

SEQ ID NO: 2395303 - protein, 18 aa, Entamoeba dispar
ACALGFLESVQKLIELGA

SEQ ID NO: 2395304 - protein, 23 aa, Entamoeba dispar
ACDYVFHFLVRVEPFTTMFIRMN

SEQ ID NO: 2395305 - protein, 18 aa, Entamoeba dispar
ACEFEIFIIIKCTTKIKE

SEQ ID NO: 2395306 - protein, 19 aa, Entamoeba dispar
ACEFEIFIIIKCTTKIKEQ

SEQ ID NO: 2395307 - protein, 27 aa, Entamoeba dispar
ACLGSLYVFPTLKRFLPFIKENKLEKE

SEQ ID NO: 2395308 - protein, 19 aa, Entamoeba dispar
ACPAFYWGLLWLTEQKQFG

SEQ ID NO: 2395309 - protein, 22 aa, Entamoeba dispar
ACQCHILFFSAIILVGITIIFT

SEQ ID NO: 2395310 - protein, 25 aa, Entamoeba dispar
ACSQLPIFRFILSSNIYTMNVGYIR

SEQ ID NO: 2395311 - protein, 26 aa, Entamoeba dispar
ADCNFHYPPFLYTLKKNETTVELQIL

SEQ ID NO: 2395312 - protein, 19 aa, Entamoeba dispar
ADESWKLLFKTESIRLKKF

SEQ ID NO: 2395313 - protein, 21 aa, Entamoeba dispar
ADFPTLLIQPVQRTMRYPLLL

SEQ ID NO: 2395314 - protein, 18 aa, Entamoeba dispar
ADGFQIDLLIKLRETRLP

SEQ ID NO: 2395315 - protein, 18 aa, Entamoeba dispar
ADIPLIIGLKFLPSFLII

SEQ ID NO: 2395316 - protein, 23 aa, Entamoeba dispar
ADIWALGCTIIELITGNPPYYDL

SEQ ID NO: 2395317 - protein, 19 aa, Entamoeba dispar
ADIYSFAITMYELEKWGQP

SEQ ID NO: 2395318 - protein, 44 aa, Entamoeba dispar
ADIYSFGITMYETFHWGECYPKLLFKFPWAIADFINRGQRRERP

SEQ ID NO: 2395319 - protein, 30 aa, Entamoeba dispar
ADLYDIETLYIIFFFILKNLKEETVQQWLV

SEQ ID NO: 2395320 - protein, 23 aa, Entamoeba dispar
ADNLGKRFLVYAPTIKFALNKYC

SEQ ID NO: 2395321 - protein, 28 aa, Entamoeba dispar
ADSDGVIQLLWLLIQYHDPQLSNHFKSL

SEQ ID NO: 2395322 - protein, 20 aa, Entamoeba dispar
ADYALPRLFVGVQIPVILSA

SEQ ID NO: 2395323 - protein, 31 aa, Entamoeba dispar
AEFVPFSVKFFALAYFRFPSFRVKLTQYYTN

SEQ ID NO: 2395324 - protein, 31 aa, Entamoeba dispar
AEKTPVRLPAVFLAPIRGDVVHFVYRNQSKN

SEQ ID NO: 2395325 - protein, 24 aa, Entamoeba dispar
AELKQFDFGYWFTDGKRYPYRGKG

SEQ ID NO: 2395326 - protein, 18 aa, Entamoeba dispar
AELQYFLQAILPDVSVMQ

SEQ ID NO: 2395327 - protein, 23 aa, Entamoeba dispar
AENYFLYILSIYIVYQSNSLVEF

SEQ ID NO: 2395328 - protein, 27 aa, Entamoeba dispar
AEQLPPLYSYLLFKSKYPNVYSDSMLI

SEQ ID NO: 2395329 - protein, 25 aa, Entamoeba dispar
AERKVTLLKLFKFVGWVLLEKWYCI

SEQ ID NO: 2395330 - protein, 18 aa, Entamoeba dispar
AEYALFRQLLPETDIVIT

SEQ ID NO: 2395331 - protein, 20 aa, Entamoeba dispar
AEYCLIVVDIFYKLIDSQYG

SEQ ID NO: 2395332 - protein, 25 aa, Entamoeba dispar
AEYIDSIYCINLPGLSKSVGLNHVN

SEQ ID NO: 2395333 - protein, 32 aa, Entamoeba dispar
AFAILTLFMIFSVWQLSILDTIKLLFFAVTGL

SEQ ID NO: 2395334 - protein, 17 aa, Entamoeba dispar
AFCIIGIVGIWLSIFHI

SEQ ID NO: 2395335 - protein, 17 aa, Entamoeba dispar
AFFLHLLWFACICMFTS

SEQ ID NO: 2395336 - protein, 18 aa, Entamoeba dispar
AFGFTIYCAIVIVSCFHL

SEQ ID NO: 2395337 - protein, 25 aa, Entamoeba dispar
AFGVFAPMYFIVVVMLITLTTTAIV

SEQ ID NO: 2395338 - protein, 28 aa, Entamoeba dispar
AFITLGLFNIMRLPLIRFPKLLNDTMQG

SEQ ID NO: 2395339 - protein, 19 aa, Entamoeba dispar
AFIVGFSNFGLIYSNENDT

SEQ ID NO: 2395340 - protein, 28 aa, Entamoeba dispar
AFKKSRVLVLLLMVFNPNSLPTISNELL

SEQ ID NO: 2395341 - protein, 25 aa, Entamoeba dispar
AFLHTLRLHWIEFQNKFYLGDGVKF

SEQ ID NO: 2395342 - protein, 17 aa, Entamoeba dispar
AFLVLFIGTFIAHFAGY

SEQ ID NO: 2395343 - protein, 25 aa, Entamoeba dispar
AFMSMSLLHFMHLKGKYYYKNNDKT

SEQ ID NO: 2395344 - protein, 20 aa, Entamoeba dispar
AFNEFLMYWSDSLYTIEDLI

SEQ ID NO: 2395345 - protein, 44 aa, Entamoeba dispar
AFNILCLLLGGFFFILVSIFELIKYFIFIIKNITGYCVVGFKGL

SEQ ID NO: 2395346 - protein, 29 aa, Entamoeba dispar
AFSLLNHFIPIPLIFNSILKFFGVRDHNK

SEQ ID NO: 2395347 - protein, 33 aa, Entamoeba dispar
AFTHDYYYYLFIPLSLYLFDVLLRFLHFIFPAK

SEQ ID NO: 2395348 - protein, 24 aa, Entamoeba dispar
AFVFLSIFFFVFYRFLKGTLTGTA

SEQ ID NO: 2395349 - protein, 30 aa, Entamoeba dispar
AFVIYSQKHIYIINPRRLLGTKAPFEMTRE

SEQ ID NO: 2395350 - protein, 17 aa, Entamoeba dispar
AFVSLFLALVMPKSQTC

SEQ ID NO: 2395351 - protein, 20 aa, Entamoeba dispar
AFYEQILNLFEKYLPKVDAV

SEQ ID NO: 2395352 - protein, 32 aa, Entamoeba dispar
AGAAFPFYSLNFVDLIRILMRLHPGINLTDEQ

SEQ ID NO: 2395353 - protein, 30 aa, Entamoeba dispar
AGAPLSLDIAKFFRIVISDGFFIGYGMTET

SEQ ID NO: 2395354 - protein, 20 aa, Entamoeba dispar
AGFGIEVTFKIKMLCTAIVN

SEQ ID NO: 2395355 - protein, 20 aa, Entamoeba dispar
AGGFVFMMSVLASIGKQIGK

SEQ ID NO: 2395356 - protein, 17 aa, Entamoeba dispar
AGILRYIPKQWKFMTIW

SEQ ID NO: 2395357 - protein, 52 aa, Entamoeba dispar
AGLLFRFKPLIYLTRFVPFTFIRKYRKMPLSYLLFFIGILLYIHCGYIVIGD

SEQ ID NO: 2395358 - protein, 29 aa, Entamoeba dispar
AGLVYFVLSFVNYKPVYLLDFAVAELPEE

SEQ ID NO: 2395359 - protein, 17 aa, Entamoeba dispar
AGPLLMAIILWTNSFVF

SEQ ID NO: 2395360 - protein, 17 aa, Entamoeba dispar
AGSLFIILYQDQRSPEI

SEQ ID NO: 2395361 - protein, 23 aa, Entamoeba dispar
AGSLIGIFFALLTYCSKFKSLSD

SEQ ID NO: 2395362 - protein, 20 aa, Entamoeba dispar
AGVNPRFIPLPDPNGKSSGY

SEQ ID NO: 2395363 - protein, 19 aa, Entamoeba dispar
AHAFGTDTLIALVKSYYGL

SEQ ID NO: 2395364 - protein, 35 aa, Entamoeba dispar
AHAKSSILLLPEALKLIPIFVLGAMKTSAFMPFFQ

SEQ ID NO: 2395365 - protein, 27 aa, Entamoeba dispar
AHDGRPKFDIILLNNLGLMTSVSNNGA

SEQ ID NO: 2395366 - protein, 18 aa, Entamoeba dispar
AHFYYFLRHVIPVHYPTL

SEQ ID NO: 2395367 - protein, 22 aa, Entamoeba dispar
AHGVIIGCLFFDYSKSKKALRD

SEQ ID NO: 2395368 - protein, 17 aa, Entamoeba dispar
AHIFELTIEFCNLVYGG

SEQ ID NO: 2395369 - protein, 23 aa, Entamoeba dispar
AIALFDYELPWEIIKRYPKSHRE

SEQ ID NO: 2395370 - protein, 17 aa, Entamoeba dispar
AIANKWYFAPRKCSKEK

SEQ ID NO: 2395371 - protein, 30 aa, Entamoeba dispar
AIDDMKMMYLSYVPLLYSPSMIALAIHYHQ

SEQ ID NO: 2395372 - protein, 24 aa, Entamoeba dispar
AIDIFFKVIQTWPGLLTLTSNKGI

SEQ ID NO: 2395373 - protein, 28 aa, Entamoeba dispar
AIEVLKQYLYFISIPTFPKYYNIISEYM

SEQ ID NO: 2395374 - protein, 21 aa, Entamoeba dispar
AIFIDFILQITVYAVLLCYDV

SEQ ID NO: 2395375 - protein, 31 aa, Entamoeba dispar
AIFNNLAYIYIIILGLFPPLFFGTSMSGFTK

SEQ ID NO: 2395376 - protein, 24 aa, Entamoeba dispar
AIGGITFSLPLFKPTYPMKFENYY

SEQ ID NO: 2395377 - protein, 23 aa, Entamoeba dispar
AIGLYFIYMVFGIIAFRTHPIFT

SEQ ID NO: 2395378 - protein, 20 aa, Entamoeba dispar
AIHFLPSIVNYFIFYTKENS

SEQ ID NO: 2395379 - protein, 19 aa, Entamoeba dispar
AIHYGGFNTMWKIVKERAK

SEQ ID NO: 2395380 - protein, 18 aa, Entamoeba dispar
AIIIILSSLIQILHSTHN

SEQ ID NO: 2395381 - protein, 25 aa, Entamoeba dispar
AIIVDVMVIIYSGERFKAIYPIELL

SEQ ID NO: 2395382 - protein, 19 aa, Entamoeba dispar
AIIVFYLYQIHSSLSFIIA

SEQ ID NO: 2395383 - protein, 26 aa, Entamoeba dispar
AIIVYALFFIFMDGYFVISFSICLLL

SEQ ID NO: 2395384 - protein, 19 aa, Entamoeba dispar
AIKLWECGLCENGIIHKCE

SEQ ID NO: 2395385 - protein, 25 aa, Entamoeba dispar
AIKVNSIKCNLKLVGGPFIINSLSD

SEQ ID NO: 2395386 - protein, 22 aa, Entamoeba dispar
AILFTLLAIVLFIQSVLLMNHS

SEQ ID NO: 2395387 - protein, 20 aa, Entamoeba dispar
AILIPMFFSSIVYPLVIILT

SEQ ID NO: 2395388 - protein, 17 aa, Entamoeba dispar
AILPIIDDFLEDFLIEY

SEQ ID NO: 2395389 - protein, 40 aa, Entamoeba dispar
AIMSFSTFWIYMRSLLLLFQFFYLMFLITLGLSAQPYVNW

SEQ ID NO: 2395390 - protein, 24 aa, Entamoeba dispar
AIMYIVMVIFIIIFTPIFSNKISK

SEQ ID NO: 2395391 - protein, 26 aa, Entamoeba dispar
AIPHAKIVALLLWPSPTPLLYDDMKK

SEQ ID NO: 2395392 - protein, 20 aa, Entamoeba dispar
AIQLLIFFIKIICDCKQQHE

SEQ ID NO: 2395393 - protein, 25 aa, Entamoeba dispar
AIQPKWYIIGLLSPLFFSLPHPRKL

SEQ ID NO: 2395394 - protein, 17 aa, Entamoeba dispar
AIRELPFLHSSKPSGEI

SEQ ID NO: 2395395 - protein, 26 aa, Entamoeba dispar
AISAFYLVVFLLVSLGFYITKMSVLR

SEQ ID NO: 2395396 - protein, 19 aa, Entamoeba dispar
AISITPYFDIYDSGTFTLT

SEQ ID NO: 2395397 - protein, 26 aa, Entamoeba dispar
AISLESMFFARLLGIRVFLTEHSLFG

SEQ ID NO: 2395398 - protein, 20 aa, Entamoeba dispar
AISQFRFLVKLLLVHGRYNY

SEQ ID NO: 2395399 - protein, 18 aa, Entamoeba dispar
AISWRRIVKKYTTHNAVF

SEQ ID NO: 2395400 - protein, 33 aa, Entamoeba dispar
AITIIVQFIIVQFLGILFDGIPFIPLQGQYGLS

SEQ ID NO: 2395401 - protein, 17 aa, Entamoeba dispar
AITSAFFYYLAQGSYCS

SEQ ID NO: 2395402 - protein, 19 aa, Entamoeba dispar
AIVIPWMIYYYAKIVHNDN

SEQ ID NO: 2395403 - protein, 24 aa, Entamoeba dispar
AIVMEFIMYRVGGSIGFMSSTHLK

SEQ ID NO: 2395404 - protein, 29 aa, Entamoeba dispar
AKATLIGYPFFIVYIIAAGLGIWIEGTFE

SEQ ID NO: 2395405 - protein, 27 aa, Entamoeba dispar
AKERLKYVWIIFALIIKSMVGYYEDKK

SEQ ID NO: 2395406 - protein, 24 aa, Entamoeba dispar
AKLSMFIFPRYLSIFSIAVYLSTI

SEQ ID NO: 2395407 - protein, 26 aa, Entamoeba dispar
AKLYFPYNGFIIMTLILGALASVMCV

SEQ ID NO: 2395408 - protein, 25 aa, Entamoeba dispar
AKPKLLRVMFRLNGKAMLIAIIPRL

SEQ ID NO: 2395409 - protein, 45 aa, Entamoeba dispar
AKQSSKLMCIILIVVAIIMIIVVAAILLPIILKATGVTNKDEGSY

SEQ ID NO: 2395410 - protein, 21 aa, Entamoeba dispar
AKSSLFLVLKGSGVVSISISE

SEQ ID NO: 2395411 - protein, 19 aa, Entamoeba dispar
AKVIGLIFAIGSGLWCGKV

SEQ ID NO: 2395412 - protein, 32 aa, Entamoeba dispar
AKVLQFLVLAKKSFLRFILKSKSRMVSKNLKI

SEQ ID NO: 2395413 - protein, 31 aa, Entamoeba dispar
AKYDKFHIANARFFLFYDYMMKHRSEIDRVL

SEQ ID NO: 2395414 - protein, 19 aa, Entamoeba dispar
ALAFFWSICEYLLSNEIYQ

SEQ ID NO: 2395415 - protein, 19 aa, Entamoeba dispar
ALAVYLFIWTPGMIFVYAL

SEQ ID NO: 2395416 - protein, 32 aa, Entamoeba dispar
ALCISASIFSILFIVMIYFIAKKEPSVYLVGF

SEQ ID NO: 2395417 - protein, 26 aa, Entamoeba dispar
ALDNPLPWKFFPTPSFILFPLATVIS

SEQ ID NO: 2395418 - protein, 34 aa, Entamoeba dispar
ALDNTLIYLPDPLFDKYYILKSDEFPPLDTIKIF

SEQ ID NO: 2395419 - protein, 27 aa, Entamoeba dispar
ALFEQQLIITIFIISIIFLLCCVCCVK

SEQ ID NO: 2395420 - protein, 25 aa, Entamoeba dispar
ALFFEIYFFFTIPSASIHFVVLMFL

SEQ ID NO: 2395421 - protein, 21 aa, Entamoeba dispar
ALFLTDLLRIYRRCVILEAID

SEQ ID NO: 2395422 - protein, 20 aa, Entamoeba dispar
ALHDFFRFAIRPYPFMDKWG

SEQ ID NO: 2395423 - protein, 20 aa, Entamoeba dispar
ALICMAYILLFVNWDLFNFI

SEQ ID NO: 2395424 - protein, 30 aa, Entamoeba dispar
ALIFVIAYIFWLIYILIRSFSDGIKLGKTK

SEQ ID NO: 2395425 - protein, 26 aa, Entamoeba dispar
ALIHKTFPTLLELGLSKSLVSLINQS

SEQ ID NO: 2395426 - protein, 38 aa, Entamoeba dispar
ALILEGWWFLVMACAVAVISFLWYLARPCLGGVRGTQG

SEQ ID NO: 2395427 - protein, 26 aa, Entamoeba dispar
ALILLISILFYYIFAKSLNSQDDLKF

SEQ ID NO: 2395428 - protein, 20 aa, Entamoeba dispar
ALINAPYIYGKWFKLNMNFN

SEQ ID NO: 2395429 - protein, 21 aa, Entamoeba dispar
ALLIYMYVCMVLTSQGELRSF

SEQ ID NO: 2395430 - protein, 21 aa, Entamoeba dispar
ALLSFFIYYYLFLIHSSHWKY

SEQ ID NO: 2395431 - protein, 18 aa, Entamoeba dispar
ALLVIYFLLRIALIVLAC

SEQ ID NO: 2395432 - protein, 33 aa, Entamoeba dispar
ALNGNFPFIWGFFMLCSLSYWISFQMVPNGQWD

SEQ ID NO: 2395433 - protein, 37 aa, Entamoeba dispar
ALNLCSLPRFWIVLLYIVCIPLVKPTFLRCLEDIKKQ

SEQ ID NO: 2395434 - protein, 17 aa, Entamoeba dispar
ALNLLKNLLRFSNSATK

SEQ ID NO: 2395435 - protein, 17 aa, Entamoeba dispar
ALPKILGLSIHNNWGNK

SEQ ID NO: 2395436 - protein, 28 aa, Entamoeba dispar
ALQLYLGVYVSLMLLLWGCSQTLNTSFL

SEQ ID NO: 2395437 - protein, 21 aa, Entamoeba dispar
ALRNRQFVINYYKNLAKEQMK

SEQ ID NO: 2395438 - protein, 31 aa, Entamoeba dispar
ALSEAFILYIQAMGGIFIPTLFISKDKNLTD

SEQ ID NO: 2395439 - protein, 26 aa, Entamoeba dispar
ALSLVLLFIFYLLTSCTALYVLEAIS

SEQ ID NO: 2395440 - protein, 26 aa, Entamoeba dispar
ALTEYSMNYYLYPKDLVFKEKRKTCL

SEQ ID NO: 2395441 - protein, 25 aa, Entamoeba dispar
ALVCCRLFFRLTKQSKIYLSSSQEI

SEQ ID NO: 2395442 - protein, 29 aa, Entamoeba dispar
ALVDGLLLCFFYLIVFIFTITNNCLRFGK

SEQ ID NO: 2395443 - protein, 24 aa, Entamoeba dispar
ALVLFKAIYFWISAPLGILLFRYE

SEQ ID NO: 2395444 - protein, 19 aa, Entamoeba dispar
ALYFDFLYYVLVSDLVIGA

SEQ ID NO: 2395445 - protein, 23 aa, Entamoeba dispar
ALYGIIGLFICVPITLFTAGYQR

SEQ ID NO: 2395446 - protein, 17 aa, Entamoeba dispar
ALYLWIGVMTLNIIISL

SEQ ID NO: 2395447 - protein, 31 aa, Entamoeba dispar
ALYVLSVLPYFLPLLSCFLKLIKKVVLWFNL

SEQ ID NO: 2395448 - protein, 19 aa, Entamoeba dispar
AMELSKYKSLKIALLEKAR

SEQ ID NO: 2395449 - protein, 18 aa, Entamoeba dispar
AMKLYYPYSIELSWLYNE

SEQ ID NO: 2395450 - protein, 23 aa, Entamoeba dispar
AMNRYPINWIPKVKLHCLYSSGI

SEQ ID NO: 2395451 - protein, 21 aa, Entamoeba dispar
AMPKWLQMIVGLILAITSGIL

SEQ ID NO: 2395452 - protein, 22 aa, Entamoeba dispar
AMSIPLIFAWTKTSTQPASKLL

SEQ ID NO: 2395453 - protein, 25 aa, Entamoeba dispar
AMTLKNPHFILLNDNRLYKYCPNHI

SEQ ID NO: 2395454 - protein, 17 aa, Entamoeba dispar
AMVFLKESPSQSLCYCH

SEQ ID NO: 2395455 - protein, 29 aa, Entamoeba dispar
ANEVFIDLWEGYLHFRGFKCNTTQQDNAI

SEQ ID NO: 2395456 - protein, 30 aa, Entamoeba dispar
ANLHSFAIALCYFIIPYFSANHDFRKLAQT

SEQ ID NO: 2395457 - protein, 21 aa, Entamoeba dispar
ANRELMFYGILNTLSDEKSLV

SEQ ID NO: 2395458 - protein, 30 aa, Entamoeba dispar
ANSVVRLFGSYFLLLLNKIKPKELIEIELL

SEQ ID NO: 2395459 - protein, 23 aa, Entamoeba dispar
ANTAFNYMLHYHFQIDLGEIPLT

SEQ ID NO: 2395460 - protein, 36 aa, Entamoeba dispar
APATTYLLILLWISFFIYIMYIIALTMMSFFSKKRV

SEQ ID NO: 2395461 - protein, 27 aa, Entamoeba dispar
APATVKPIQVLPLYAALPPEQQLLIFS

SEQ ID NO: 2395462 - protein, 35 aa, Entamoeba dispar
APDSCRYFKIILITMQIVLLSPLIYNELKKKIKEF

SEQ ID NO: 2395463 - protein, 26 aa, Entamoeba dispar
APKITWRLQIMLWYAGLRGAIAVILA

SEQ ID NO: 2395464 - protein, 21 aa, Entamoeba dispar
APLRQEAIATLYLFTKKDYER

SEQ ID NO: 2395465 - protein, 17 aa, Entamoeba dispar
APYTTLIKNWKKIGKTN

SEQ ID NO: 2395466 - protein, 17 aa, Entamoeba dispar
APYYYRGNNGSFCSPFS

SEQ ID NO: 2395467 - protein, 18 aa, Entamoeba dispar
AQFKLGECYLYGKGVPKN

SEQ ID NO: 2395468 - protein, 20 aa, Entamoeba dispar
AQFLALAKFPETVFPIICHL

SEQ ID NO: 2395469 - protein, 17 aa, Entamoeba dispar
AQKLTIINSFSTSVSIT

SEQ ID NO: 2395470 - protein, 22 aa, Entamoeba dispar
AQNLIPNELYYIAVSPTGGILK

SEQ ID NO: 2395471 - protein, 41 aa, Entamoeba dispar
AQNYQKKASKKLWIILCIAGGIVIVLGAIVTLVCILKFSGK

SEQ ID NO: 2395472 - protein, 25 aa, Entamoeba dispar
AQQIFYPPMNIVPPSKLHFVSMDLD

SEQ ID NO: 2395473 - protein, 23 aa, Entamoeba dispar
ARDKKILPLKQPLRKITIIHGSQ

SEQ ID NO: 2395474 - protein, 28 aa, Entamoeba dispar
ARFGGPERYYAFPGFLTCLYKTITIGTT

SEQ ID NO: 2395475 - protein, 21 aa, Entamoeba dispar
ARFTQLLWNDLISSSYTTMVS

SEQ ID NO: 2395476 - protein, 18 aa, Entamoeba dispar
ARIFGFLCTFTFGGVFLI

SEQ ID NO: 2395477 - protein, 25 aa, Entamoeba dispar
ARISSPIDLFNLLEILYSSDPIASE

SEQ ID NO: 2395478 - protein, 18 aa, Entamoeba dispar
ARLVLFNNPITKISEEIT

SEQ ID NO: 2395479 - protein, 31 aa, Entamoeba dispar
ARSVLYSIIQLYLRSGFYGRVLDYHIELIML

SEQ ID NO: 2395480 - protein, 21 aa, Entamoeba dispar
ARVSGKIKLFIVSSYQSNHIG

SEQ ID NO: 2395481 - protein, 26 aa, Entamoeba dispar
ASASKYLHMNLIKKIFKTKLGFFDVT

SEQ ID NO: 2395482 - protein, 27 aa, Entamoeba dispar
ASAVQYYVPLRMKFPYRDVPNGWRVDI

SEQ ID NO: 2395483 - protein, 31 aa, Entamoeba dispar
ASDVFSFGMILWELYCWSHPFPDVKNLSVVR

SEQ ID NO: 2395484 - protein, 26 aa, Entamoeba dispar
ASHGLFFLPILLSLIPSVSLSHITDP

SEQ ID NO: 2395485 - protein, 19 aa, Entamoeba dispar
ASILVYITLKMIHRNPLIF

SEQ ID NO: 2395486 - protein, 28 aa, Entamoeba dispar
ASIPDLQLFDYLFQPLLNNSDSLWKKEQ

SEQ ID NO: 2395487 - protein, 22 aa, Entamoeba dispar
ASLVKGFFDYYKNFDYDYPIQP

SEQ ID NO: 2395488 - protein, 35 aa, Entamoeba dispar
ASLVNLQFILFLQLPYTFSFPWLNAVIVYFISIVV

SEQ ID NO: 2395489 - protein, 24 aa, Entamoeba dispar
ASNNPLVHLNINSSLRLLTIDDCP

SEQ ID NO: 2395490 - protein, 41 aa, Entamoeba dispar
ASQVKTWNWYLLFSYIFSFILIFTIFYILPDDLQNISYIRS

SEQ ID NO: 2395491 - protein, 29 aa, Entamoeba dispar
ASSSSLWMRVPLYLLQDYPRQSRKLSSLS

SEQ ID NO: 2395492 - protein, 25 aa, Entamoeba dispar
ASSTVWLLLVLSFLGGLVAGFAYQT

SEQ ID NO: 2395493 - protein, 23 aa, Entamoeba dispar
ASSYLDILLVVLAGLQDSLLHDN

SEQ ID NO: 2395494 - protein, 29 aa, Entamoeba dispar
ASTHTLFWICFFLMQFCTVVLVLNLLKKK

SEQ ID NO: 2395495 - protein, 23 aa, Entamoeba dispar
ASTLFVFWKLIINSIFCVFVMFY

SEQ ID NO: 2395496 - protein, 17 aa, Entamoeba dispar
ASTLLTLIVGQISFFIP

SEQ ID NO: 2395497 - protein, 22 aa, Entamoeba dispar
ASVNKWYFAPRKCSKERYDDIK

SEQ ID NO: 2395498 - protein, 40 aa, Entamoeba dispar
ASYAFDFCFKWINKLKWIIIVFWIIVALGMVYCVFGFLKH

SEQ ID NO: 2395499 - protein, 25 aa, Entamoeba dispar
ATCGYLVWCMFLVLLVSLYGLHIYW

SEQ ID NO: 2395500 - protein, 26 aa, Entamoeba dispar
ATGIAMMRLCLPLEPPRDVIINKPYF

SEQ ID NO: 2395501 - protein, 24 aa, Entamoeba dispar
ATGVCFLPIVLYSGALALNSLFHV

SEQ ID NO: 2395502 - protein, 24 aa, Entamoeba dispar
ATISFLCFAVYFFALIGVITVTLI

SEQ ID NO: 2395503 - protein, 24 aa, Entamoeba dispar
ATISNPLFSFNPYKVTFDDCGDIP

SEQ ID NO: 2395504 - protein, 25 aa, Entamoeba dispar
ATKTEAYDVCRMDFIGGRSITFRSF

SEQ ID NO: 2395505 - protein, 25 aa, Entamoeba dispar
ATLLGILLILMYPVRDLLFNDGKLA

SEQ ID NO: 2395506 - protein, 20 aa, Entamoeba dispar
ATNHRLNILKLYSLRNNELT

SEQ ID NO: 2395507 - protein, 26 aa, Entamoeba dispar
ATNMESPLLVFVYSGSETIKLTSNKF

SEQ ID NO: 2395508 - protein, 33 aa, Entamoeba dispar
ATPLLITLFIIILIVIIFTVMIKILINYLKTQH

SEQ ID NO: 2395509 - protein, 21 aa, Entamoeba dispar
ATQILRIDFISVLNSYEYFYE

SEQ ID NO: 2395510 - protein, 37 aa, Entamoeba dispar
ATSCIFGLLSLFYPFSWPGIFIPYIPDELFEFYETPV

SEQ ID NO: 2395511 - protein, 24 aa, Entamoeba dispar
ATSDTLLFLFKSYSLWSTLINDSI

SEQ ID NO: 2395512 - protein, 27 aa, Entamoeba dispar
ATSVLPLYFILIIQSAGFALFWSPTES

SEQ ID NO: 2395513 - protein, 30 aa, Entamoeba dispar
ATYIPSLCLWMFILLCVIGFIIVLLYQNHI

SEQ ID NO: 2395514 - protein, 24 aa, Entamoeba dispar
ATYKYLQEVAWKDAFIKISSYILG

SEQ ID NO: 2395515 - protein, 18 aa, Entamoeba dispar
AVAVVLLFLYLGIFAGDI

SEQ ID NO: 2395516 - protein, 23 aa, Entamoeba dispar
AVCLNFPLFIPKSVKFLNRISTL

SEQ ID NO: 2395517 - protein, 23 aa, Entamoeba dispar
AVCLNLPLIIPKSVKFLSKISVL

SEQ ID NO: 2395518 - protein, 31 aa, Entamoeba dispar
AVDGKWRLLVYALQYVIVPLIRVHHKEFTGN

SEQ ID NO: 2395519 - protein, 17 aa, Entamoeba dispar
AVDHYALTYSGIRSFDI

SEQ ID NO: 2395520 - protein, 25 aa, Entamoeba dispar
AVDIFTLGCLFYYIATRKHPYGDSL

SEQ ID NO: 2395521 - protein, 25 aa, Entamoeba dispar
AVFCTEWWLLMPGIIIFVILISVLL

SEQ ID NO: 2395522 - protein, 26 aa, Entamoeba dispar
AVFEKWGCLQFGLLNPARADQYSAIQ

SEQ ID NO: 2395523 - protein, 17 aa, Entamoeba dispar
AVFLMIFLGLETLILEI

SEQ ID NO: 2395524 - protein, 25 aa, Entamoeba dispar
AVFTARLWIHRISYTNIIEGKDDPV

SEQ ID NO: 2395525 - protein, 21 aa, Entamoeba dispar
AVGCFFIVVLFVSAVMIVILQ

SEQ ID NO: 2395526 - protein, 30 aa, Entamoeba dispar
AVGKIVFVIIIILIIILVLVGIISGILFFI

SEQ ID NO: 2395527 - protein, 31 aa, Entamoeba dispar
AVHIPYIPYTIFSIPFAQYPLFINPCLSVRD

SEQ ID NO: 2395528 - protein, 26 aa, Entamoeba dispar
AVIIMFLCMVLFKDTFLNIVSISFTA

SEQ ID NO: 2395529 - protein, 17 aa, Entamoeba dispar
AVLLRRLKPTKEVFLLL

SEQ ID NO: 2395530 - protein, 22 aa, Entamoeba dispar
AVLYTFFYFCLSICGILFACSF

SEQ ID NO: 2395531 - protein, 25 aa, Entamoeba dispar
AVMNTLMFLVLFAKLYNFIDKKTGG

SEQ ID NO: 2395532 - protein, 25 aa, Entamoeba dispar
AVNALDIFILLQDHPPFSLDMLSMI

SEQ ID NO: 2395533 - protein, 23 aa, Entamoeba dispar
AVQTVAVLPFRAGIVAKPGNLKI

SEQ ID NO: 2395534 - protein, 23 aa, Entamoeba dispar
AVSFILLMIISLIINSIEKQPYS

SEQ ID NO: 2395535 - protein, 25 aa, Entamoeba dispar
AVSFISIEFKKCYYFGEDGSMYATH

SEQ ID NO: 2395536 - protein, 23 aa, Entamoeba dispar
AVSNYRIMWIPYNTRIFKDKMNC

SEQ ID NO: 2395537 - protein, 23 aa, Entamoeba dispar
AVSWICTFFMWKHDILPSSKVFY

SEQ ID NO: 2395538 - protein, 17 aa, Entamoeba dispar
AVTMYECFKWGSAFTSN

SEQ ID NO: 2395539 - protein, 18 aa, Entamoeba dispar
AVVIVSYSLFITQPGYDC

SEQ ID NO: 2395540 - protein, 36 aa, Entamoeba dispar
AVVLRKTYWWKNFKLWLLIVISLVLILCLIGGIVTL

SEQ ID NO: 2395541 - protein, 27 aa, Entamoeba dispar
AVVPLINFLLLLLIPKSINYPKEEVQY

SEQ ID NO: 2395542 - protein, 18 aa, Entamoeba dispar
AVYLLKKINAYSDVLKVI

SEQ ID NO: 2395543 - protein, 19 aa, Entamoeba dispar
AWDQLFFNHGIWHLIVWFA

SEQ ID NO: 2395544 - protein, 35 aa, Entamoeba dispar
AWSVYGKYLKFGGILFFLICMIPFIMRTGALVCYN

SEQ ID NO: 2395545 - protein, 26 aa, Entamoeba dispar
AWTLERLIFAIIVIYPDIYQKTQFRI

SEQ ID NO: 2395546 - protein, 17 aa, Entamoeba dispar
AYARFRLWVFPRYVISA

SEQ ID NO: 2395547 - protein, 24 aa, Entamoeba dispar
AYEIQYVALRNIRLILQKCKDLLV

SEQ ID NO: 2395548 - protein, 21 aa, Entamoeba dispar
AYFSVIWYLVLLVVIVFEVYW

SEQ ID NO: 2395549 - protein, 25 aa, Entamoeba dispar
AYLIPANLMFYLFRGFNFNIVKMTR

SEQ ID NO: 2395550 - protein, 24 aa, Entamoeba dispar
AYLLSNNKLIRFCPTGTELDRTVV

SEQ ID NO: 2395551 - protein, 26 aa, Entamoeba dispar
AYRNPLVDVLQFFETFHKGHYKVYNF

SEQ ID NO: 2395552 - protein, 34 aa, Entamoeba dispar
AYTPLKHIPSLMKGYFFHAIINGKNFFYPAQYYY

SEQ ID NO: 2395553 - protein, 18 aa, Entamoeba dispar
AYVFKDILKNPPQPSFSN

SEQ ID NO: 2395554 - protein, 23 aa, Entamoeba dispar
AYVNLYCFFVAILNLPSLERQNS

SEQ ID NO: 2395555 - protein, 23 aa, Entamoeba dispar
CAAPMPFVIGCLRTLYPEIQNEC

SEQ ID NO: 2395556 - protein, 19 aa, Entamoeba dispar
CAICKDGFYQIYKSCAPCN

SEQ ID NO: 2395557 - protein, 22 aa, Entamoeba dispar
CAICKNGYFVSNLTCFHCNEAC

SEQ ID NO: 2395558 - protein, 28 aa, Entamoeba dispar
CAPLLWVCTISMIILIVPNFRTINQLID

SEQ ID NO: 2395559 - protein, 23 aa, Entamoeba dispar
CASFQLWCSIFPLLSNISNISEL

SEQ ID NO: 2395560 - protein, 18 aa, Entamoeba dispar
CATSGWFDHYKKCERLVI

SEQ ID NO: 2395561 - protein, 29 aa, Entamoeba dispar
CCFPLDFVKVLMFIQQPRLLLRIKYEYPF

SEQ ID NO: 2395562 - protein, 18 aa, Entamoeba dispar
CCFPLLFGFLVAISRVRD

SEQ ID NO: 2395563 - protein, 19 aa, Entamoeba dispar
CCLCPLFAGLIATQTDDRK

SEQ ID NO: 2395564 - protein, 26 aa, Entamoeba dispar
CDEKDSFVHFYYLENVLSYIEYTAGT

SEQ ID NO: 2395565 - protein, 23 aa, Entamoeba dispar
CDGTTYFCKFVPLTDDPSLDIAY

SEQ ID NO: 2395566 - protein, 47 aa, Entamoeba dispar
CDIIAIFVVICTCSYYLIIVVVLVLIAFFLFHKYFVRASIEMQRLEG

SEQ ID NO: 2395567 - protein, 17 aa, Entamoeba dispar
CDLGYKFDYINNNCIEN

SEQ ID NO: 2395568 - protein, 18 aa, Entamoeba dispar
CDNGYFFDFYNKKCVVDV

SEQ ID NO: 2395569 - protein, 31 aa, Entamoeba dispar
CDPHAPSYGYYIPIVIPPKKMLRVSTCNKDT

SEQ ID NO: 2395570 - protein, 25 aa, Entamoeba dispar
CDVFSFSICLLEIWLTHQPYNPEQF

SEQ ID NO: 2395571 - protein, 19 aa, Entamoeba dispar
CDYLCECLFNLSLILKEHI

SEQ ID NO: 2395572 - protein, 18 aa, Entamoeba dispar
CEEGKFLDQYNLCQVCDL

SEQ ID NO: 2395573 - protein, 43 aa, Entamoeba dispar
CEIKQNYFIVIGIPIIICIIITLIIIICIGSIVLYITKKQKTR

SEQ ID NO: 2395574 - protein, 26 aa, Entamoeba dispar
CEIMTWIFFNIMTGFSLFGIAFSCCG

SEQ ID NO: 2395575 - protein, 28 aa, Entamoeba dispar
CEINIKWWIIIIIIFIIIIGMMIILLIL

SEQ ID NO: 2395576 - protein, 19 aa, Entamoeba dispar
CEKGIMYQCGALSTMVISV

SEQ ID NO: 2395577 - protein, 25 aa, Entamoeba dispar
CEKYHRLYHCLAYDLSCDYFNETIG

SEQ ID NO: 2395578 - protein, 24 aa, Entamoeba dispar
CEKYIEKIITISAPFIGTIKALRS

SEQ ID NO: 2395579 - protein, 18 aa, Entamoeba dispar
CELFYLTRLAYFCTFLLI

SEQ ID NO: 2395580 - protein, 18 aa, Entamoeba dispar
CELKYKLIDKLDAYEVFC

SEQ ID NO: 2395581 - protein, 35 aa, Entamoeba dispar
CENIHPVLSVYALFFSKCYPNLPSNILIASLRLCS

SEQ ID NO: 2395582 - protein, 27 aa, Entamoeba dispar
CENLSKFLVNYGIRATYYHAGLDPKRR

SEQ ID NO: 2395583 - protein, 31 aa, Entamoeba dispar
CENWKKNMIKGIIVIMIIISVQGICFTYSEE

SEQ ID NO: 2395584 - protein, 22 aa, Entamoeba dispar
CEQAISIISLPFSRSAPLNDSW

SEQ ID NO: 2395585 - protein, 17 aa, Entamoeba dispar
CEQIDNFKPELSFSSFC

SEQ ID NO: 2395586 - protein, 52 aa, Entamoeba dispar
CETVPMCLYDFLIVHIFPLITPLISLLQRTPILLIPLLRLLSDIASSKNFQE

SEQ ID NO: 2395587 - protein, 22 aa, Entamoeba dispar
CFDCISCMIVLPLLLEMITTQS

SEQ ID NO: 2395588 - protein, 17 aa, Entamoeba dispar
CFDCQPDYIIQPNGKCV

SEQ ID NO: 2395589 - protein, 18 aa, Entamoeba dispar
CFFVVAVAIILIWPNTFF

SEQ ID NO: 2395590 - protein, 18 aa, Entamoeba dispar
CFFVYLSNANYTVFSNGT

SEQ ID NO: 2395591 - protein, 27 aa, Entamoeba dispar
CFGCVILISYFFVVYYSLDELDPEVTI

SEQ ID NO: 2395592 - protein, 28 aa, Entamoeba dispar
CFGSFILIFVLMLITYRKQNAALLIPGV

SEQ ID NO: 2395593 - protein, 18 aa, Entamoeba dispar
CFGVFIFQPTFSCDVSTP

SEQ ID NO: 2395594 - protein, 40 aa, Entamoeba dispar
CFHYRPVLIGITILCLFVFVFYIILFNISLTPNPYQYQPV

SEQ ID NO: 2395595 - protein, 17 aa, Entamoeba dispar
CFIAILISQLSTLVIPA

SEQ ID NO: 2395596 - protein, 20 aa, Entamoeba dispar
CFIMFYSFSNATECSCNLLL

SEQ ID NO: 2395597 - protein, 19 aa, Entamoeba dispar
CFKGIDSPYYGQIKYMYVG

SEQ ID NO: 2395598 - protein, 45 aa, Entamoeba dispar
CFLFQHNSVSSLLYFISVFSLFMKYHFPIYFSIEPSTLSLLLHSL

SEQ ID NO: 2395599 - protein, 26 aa, Entamoeba dispar
CFSFILLMFVYYPFVWVVSITPLPFI

SEQ ID NO: 2395600 - protein, 26 aa, Entamoeba dispar
CFSLLACYYLFLKNNIILSCVFFALA

SEQ ID NO: 2395601 - protein, 20 aa, Entamoeba dispar
CFTGYFKTPDMLWCESTISL

SEQ ID NO: 2395602 - protein, 28 aa, Entamoeba dispar
CFTTTCPYFLALFPLLHYIAERSYRNKL

SEQ ID NO: 2395603 - protein, 17 aa, Entamoeba dispar
CFVSLCFFPLDVIITLG

SEQ ID NO: 2395604 - protein, 18 aa, Entamoeba dispar
CFVTLFKLPFTLTTLTTI

SEQ ID NO: 2395605 - protein, 31 aa, Entamoeba dispar
CFVVTDIVLYLLVLFFSWISERKLDKVISAE

SEQ ID NO: 2395606 - protein, 21 aa, Entamoeba dispar
CGELFIGFSHLYYIIAKDSNE

SEQ ID NO: 2395607 - protein, 23 aa, Entamoeba dispar
CGFHIWPYSYIERNQKYRGFFDV

SEQ ID NO: 2395608 - protein, 24 aa, Entamoeba dispar
CGGLISLLVFWFVKDKTIKKLSIF

SEQ ID NO: 2395609 - protein, 17 aa, Entamoeba dispar
CGGYFFINFLRQLSMLL

SEQ ID NO: 2395610 - protein, 29 aa, Entamoeba dispar
CGGYILMMSLFIWRVIRKMIKNNPENFWL

SEQ ID NO: 2395611 - protein, 17 aa, Entamoeba dispar
CGIFLILFLIWNENGDW

SEQ ID NO: 2395612 - protein, 21 aa, Entamoeba dispar
CGLNKFPIDLTLLSNLTSLNL

SEQ ID NO: 2395613 - protein, 19 aa, Entamoeba dispar
CGPNQYSLKGAISCLSCDS

SEQ ID NO: 2395614 - protein, 26 aa, Entamoeba dispar
CGVSALFLIIINKYYRTFNGFLELIH

SEQ ID NO: 2395615 - protein, 22 aa, Entamoeba dispar
CGYTYLSLYIAGELRIFIDRPE

SEQ ID NO: 2395616 - protein, 17 aa, Entamoeba dispar
CHIYLTKQIPWKTIVVV

SEQ ID NO: 2395617 - protein, 19 aa, Entamoeba dispar
CHVKISILPYCTCFINDSI

SEQ ID NO: 2395618 - protein, 26 aa, Entamoeba dispar
CIAYPVIMFPTCAGILRYIPKQWKFM

SEQ ID NO: 2395619 - protein, 17 aa, Entamoeba dispar
CIDGFYQDNQNNCQPCD

SEQ ID NO: 2395620 - protein, 25 aa, Entamoeba dispar
CIDKQVIFIIIDILVVLAKYKQTKK

SEQ ID NO: 2395621 - protein, 23 aa, Entamoeba dispar
CIECEYGYYLNLNTKTCKILKNE

SEQ ID NO: 2395622 - protein, 25 aa, Entamoeba dispar
CIEGYLRNAFVLLQSRINNSLLLKS

SEQ ID NO: 2395623 - protein, 18 aa, Entamoeba dispar
CIFNLIPFSLIYDVINIV

SEQ ID NO: 2395624 - protein, 22 aa, Entamoeba dispar
CIGPMLNVQYISLGSLGLFIKL

SEQ ID NO: 2395625 - protein, 20 aa, Entamoeba dispar
CIICLKELLLLLRYTPRYEQ

SEQ ID NO: 2395626 - protein, 20 aa, Entamoeba dispar
CILLFFKSKGFHCSPGCTSE

SEQ ID NO: 2395627 - protein, 28 aa, Entamoeba dispar
CIMIVIMLSILWFPLLLMSSAAPNFIQP

SEQ ID NO: 2395628 - protein, 18 aa, Entamoeba dispar
CIMMLWPRIEKFGDPNFR

SEQ ID NO: 2395629 - protein, 18 aa, Entamoeba dispar
CIPLLWVCTLSSLILIIP

SEQ ID NO: 2395630 - protein, 19 aa, Entamoeba dispar
CIPYYSSSIQLDNCLIVKQ

SEQ ID NO: 2395631 - protein, 23 aa, Entamoeba dispar
CIQQIAMLMGCSVLPHLSALVAI

SEQ ID NO: 2395632 - protein, 17 aa, Entamoeba dispar
CIRLRLIVEAMSLSMII

SEQ ID NO: 2395633 - protein, 18 aa, Entamoeba dispar
CISGYYPKDNICFECSTK

SEQ ID NO: 2395634 - protein, 22 aa, Entamoeba dispar
CIVCVLIISIFVKKASSKIIAI

SEQ ID NO: 2395635 - protein, 39 aa, Entamoeba dispar
CIVGTLYFIFPKLIKHWLFWYVFSMIIFVFSVGGLVYNV

SEQ ID NO: 2395636 - protein, 19 aa, Entamoeba dispar
CIYSKFEYLISCEEKGITS

SEQ ID NO: 2395637 - protein, 22 aa, Entamoeba dispar
CIYVPIIITLIIGIPLTIVYAL

SEQ ID NO: 2395638 - protein, 18 aa, Entamoeba dispar
CKCYFGFTPITINGITKC

SEQ ID NO: 2395639 - protein, 20 aa, Entamoeba dispar
CKDRYYLDPSSHLCGSCSSH

SEQ ID NO: 2395640 - protein, 23 aa, Entamoeba dispar
CKKCKKGFFLHKQNACIACQSSC

SEQ ID NO: 2395641 - protein, 21 aa, Entamoeba dispar
CKPITVMLFSIFYTKKYEIRQ

SEQ ID NO: 2395642 - protein, 18 aa, Entamoeba dispar
CKSDSYCFRILSTYSGTS

SEQ ID NO: 2395643 - protein, 22 aa, Entamoeba dispar
CKTMKHSFLIQGISLMQQENKY

SEQ ID NO: 2395644 - protein, 17 aa, Entamoeba dispar
CKYNDFFQWFIKNMKDA

SEQ ID NO: 2395645 - protein, 28 aa, Entamoeba dispar
CLCCVIVLTLYYFMPFLPASIRENIVDT

SEQ ID NO: 2395646 - protein, 17 aa, Entamoeba dispar
CLFARADDIPTNLQCTM

SEQ ID NO: 2395647 - protein, 26 aa, Entamoeba dispar
CLFISVAFFITKLWYFHTQAICKNYT

SEQ ID NO: 2395648 - protein, 18 aa, Entamoeba dispar
CLFNLIVPKSFTSGILKL

SEQ ID NO: 2395649 - protein, 33 aa, Entamoeba dispar
CLGVLISIIISLTLLRFRILKKSKLNYTLENMS

SEQ ID NO: 2395650 - protein, 22 aa, Entamoeba dispar
CLILYFIQFHILPLFKKDLKSE

SEQ ID NO: 2395651 - protein, 20 aa, Entamoeba dispar
CLLCFILMLVFMYRIFRVYN

SEQ ID NO: 2395652 - protein, 25 aa, Entamoeba dispar
CLMSDIFQFIIKYHSLLPELTIDDF

SEQ ID NO: 2395653 - protein, 18 aa, Entamoeba dispar
CLPGYYLDRDSCIECSNK

SEQ ID NO: 2395654 - protein, 22 aa, Entamoeba dispar
CLPPLLSYFQICELMILCYPMF

SEQ ID NO: 2395655 - protein, 21 aa, Entamoeba dispar
CLPRRLLRPFISDLVRDSFIN

SEQ ID NO: 2395656 - protein, 17 aa, Entamoeba dispar
CLSILTTFTFIFDNIPN

SEQ ID NO: 2395657 - protein, 22 aa, Entamoeba dispar
CLSPLQYNVLIRTLRFMLIIMN

SEQ ID NO: 2395658 - protein, 22 aa, Entamoeba dispar
CLTIFYLFKVVYWTISGLQIKS

SEQ ID NO: 2395659 - protein, 36 aa, Entamoeba dispar
CLTIILGLICFVTVTFFLLFKYSPKVPPPIPVTTPL

SEQ ID NO: 2395660 - protein, 26 aa, Entamoeba dispar
CLTNKITLTIIINSLQKIPSIGSMAL

SEQ ID NO: 2395661 - protein, 17 aa, Entamoeba dispar
CLVAYLMVFLFDCILYY

SEQ ID NO: 2395662 - protein, 34 aa, Entamoeba dispar
CLVSLCILFTLCALAFWFNTKYNLSFNIIISVLV

SEQ ID NO: 2395663 - protein, 18 aa, Entamoeba dispar
CLWIVLLIIKLELDTEWG

SEQ ID NO: 2395664 - protein, 21 aa, Entamoeba dispar
CMAIFNCIKLPFQSFGYLIAC

SEQ ID NO: 2395665 - protein, 26 aa, Entamoeba dispar
CMCCCTLFFMYILRGIPFKQWSLEQK

SEQ ID NO: 2395666 - protein, 33 aa, Entamoeba dispar
CMEFTLFETFMYWDFFFIDLHKFLLLKVVCCSI

SEQ ID NO: 2395667 - protein, 27 aa, Entamoeba dispar
CMHPDIFYFFVEQIKSYALPLIISEKV

SEQ ID NO: 2395668 - protein, 32 aa, Entamoeba dispar
CMIILCIGVITLVSFFCYVGLFMAAGEKMIGR

SEQ ID NO: 2395669 - protein, 27 aa, Entamoeba dispar
CMKCATHFLTPIPFFKIMAKDEYNPRI

SEQ ID NO: 2395670 - protein, 18 aa, Entamoeba dispar
CMLGSLPCHCCCYRCLSC

SEQ ID NO: 2395671 - protein, 36 aa, Entamoeba dispar
CMSARTIILKLLLNNWFNLLFLHWSSDVRKGFVHLL

SEQ ID NO: 2395672 - protein, 19 aa, Entamoeba dispar
CMYCLYDNILIDPAKLIKM

SEQ ID NO: 2395673 - protein, 30 aa, Entamoeba dispar
CNCLYRGLYPYTIVQFDYFFIAFDELVRER

SEQ ID NO: 2395674 - protein, 19 aa, Entamoeba dispar
CNDGFLLEKGKCIQCETNP

SEQ ID NO: 2395675 - protein, 19 aa, Entamoeba dispar
CNDNIKYVIADDAVVKYTY

SEQ ID NO: 2395676 - protein, 25 aa, Entamoeba dispar
CNIELIPEFFYLPDFLINENSFEFG

SEQ ID NO: 2395677 - protein, 21 aa, Entamoeba dispar
CNIGWKLLTIWWTVSTLRLKY

SEQ ID NO: 2395678 - protein, 44 aa, Entamoeba dispar
CNKEIVWWMIMIIIIIILIIIIIIIIIIIIIMINYIIKRKEKKE

SEQ ID NO: 2395679 - protein, 44 aa, Entamoeba dispar
CNKEIVWWMIMIIIIIILIIIIIIIIIIIIMINYIITRKEKKEQ

SEQ ID NO: 2395680 - protein, 26 aa, Entamoeba dispar
CNNISFYYLFNILTTIFIIAVFLCFS

SEQ ID NO: 2395681 - protein, 24 aa, Entamoeba dispar
CNNQRIIKCYGIASSWYSISSQLQ

SEQ ID NO: 2395682 - protein, 27 aa, Entamoeba dispar
CPCNGEYCFFYLDNLKYKELYLDETNK

SEQ ID NO: 2395683 - protein, 38 aa, Entamoeba dispar
CPITKFIKWTYKLPTMSFPIDFKPLFIFDIESIKPTKE

SEQ ID NO: 2395684 - protein, 17 aa, Entamoeba dispar
CPKKRFDYSTNTGYPQF

SEQ ID NO: 2395685 - protein, 17 aa, Entamoeba dispar
CPKLKGIYLPKSLILMK

SEQ ID NO: 2395686 - protein, 25 aa, Entamoeba dispar
CPLGSLRKFMKINPLTDLLKVRFCQ

SEQ ID NO: 2395687 - protein, 18 aa, Entamoeba dispar
CPPSLLYKYIPSVDLLKK

SEQ ID NO: 2395688 - protein, 23 aa, Entamoeba dispar
CQEYLFGKWFKIPKSSIPNSRVF

SEQ ID NO: 2395689 - protein, 23 aa, Entamoeba dispar
CQICENNYILNSLTLNCISINLV

SEQ ID NO: 2395690 - protein, 34 aa, Entamoeba dispar
CQIIIIGCFIVSIILILILIMYNASIRAKVNAIR

SEQ ID NO: 2395691 - protein, 19 aa, Entamoeba dispar
CQLIPLIKKFKVVDEGIIC

SEQ ID NO: 2395692 - protein, 17 aa, Entamoeba dispar
CRKLYFNGELNATGYGD

SEQ ID NO: 2395693 - protein, 17 aa, Entamoeba dispar
CRSIILKELLNKCPSAN

SEQ ID NO: 2395694 - protein, 25 aa, Entamoeba dispar
CSCSFNGLLPFARLNMKTGEMTFFN

SEQ ID NO: 2395695 - protein, 32 aa, Entamoeba dispar
CSDASPVYLTFYYLVNILINGKIYKKTSNQFV

SEQ ID NO: 2395696 - protein, 28 aa, Entamoeba dispar
CSENYPSIHLLYLIVSYRPELFSRQNAN

SEQ ID NO: 2395697 - protein, 19 aa, Entamoeba dispar
CSFCSFIINGQIKYDFYYI

SEQ ID NO: 2395698 - protein, 17 aa, Entamoeba dispar
CSFILFSFLVVKKFFTM

SEQ ID NO: 2395699 - protein, 25 aa, Entamoeba dispar
CSGYIIYYFIYLIIKRIYPRDLDKQ

SEQ ID NO: 2395700 - protein, 23 aa, Entamoeba dispar
CSIKYLFNIPIYAKGIKFNFYQV

SEQ ID NO: 2395701 - protein, 22 aa, Entamoeba dispar
CSKCEIGFMFGKTSDNKITCIR

SEQ ID NO: 2395702 - protein, 30 aa, Entamoeba dispar
CSKKGIVAHLFSAFRALYQANPKKGLKILG

SEQ ID NO: 2395703 - protein, 24 aa, Entamoeba dispar
CSKPQPLLYILKAPTRMSLSFFSS

SEQ ID NO: 2395704 - protein, 19 aa, Entamoeba dispar
CSKSGGPILYYPDPNKISS

SEQ ID NO: 2395705 - protein, 23 aa, Entamoeba dispar
CSKYLFEGLMILQNRGYDSAGIA

SEQ ID NO: 2395706 - protein, 48 aa, Entamoeba dispar
CSLLATFIIIFMASYILIPIVIIVIIVFLIFHTFFIKASIEMQRLEGI

SEQ ID NO: 2395707 - protein, 17 aa, Entamoeba dispar
CSLTDLFNFYIKAKRIT

SEQ ID NO: 2395708 - protein, 31 aa, Entamoeba dispar
CSMLMTQIEWALKVISIPIPTYLTPIEAFRE

SEQ ID NO: 2395709 - protein, 17 aa, Entamoeba dispar
CSPIVLHKGLPPTWDRF

SEQ ID NO: 2395710 - protein, 32 aa, Entamoeba dispar
CSQLIPIFKVGMTFTYFAPLVFVVCLAICKDA

SEQ ID NO: 2395711 - protein, 23 aa, Entamoeba dispar
CSRCSIGFYLNKGKCLQCTSNCK

SEQ ID NO: 2395712 - protein, 30 aa, Entamoeba dispar
CSRNITTMIFIQYKLIDGLLEFICQTFSLK

SEQ ID NO: 2395713 - protein, 28 aa, Entamoeba dispar
CSSSFLNFIIKTLPMIKFLSINSITKQE

SEQ ID NO: 2395714 - protein, 27 aa, Entamoeba dispar
CSVDIYSWIFFLPYSPDELIKSKFKPL

SEQ ID NO: 2395715 - protein, 20 aa, Entamoeba dispar
CSYLRDFIVRFRVSLFTRSI

SEQ ID NO: 2395716 - protein, 27 aa, Entamoeba dispar
CSYVQIRGSIPLLWSQIPNIKYKPKIA

SEQ ID NO: 2395717 - protein, 23 aa, Entamoeba dispar
CTAPKIISIPFTTVGFIDTTQSN

SEQ ID NO: 2395718 - protein, 19 aa, Entamoeba dispar
CTCSLNESILLVALDMKKG

SEQ ID NO: 2395719 - protein, 36 aa, Entamoeba dispar
CTCSYYLIIVVVLVLIAFFLFHKYFVRASIEMQRLE

SEQ ID NO: 2395720 - protein, 29 aa, Entamoeba dispar
CTHYTLIFWYFILILLFIGLKLDNIVHWY

SEQ ID NO: 2395721 - protein, 39 aa, Entamoeba dispar
CTIQNAFVLLKLFFLFLPTPIIPFCFLDFIKQQENCKLN

SEQ ID NO: 2395722 - protein, 23 aa, Entamoeba dispar
CTLLSNNKLLRYCPTSNIEDIVE

SEQ ID NO: 2395723 - protein, 21 aa, Entamoeba dispar
CTLTIHWQFDVTLRGLRKVLV

SEQ ID NO: 2395724 - protein, 20 aa, Entamoeba dispar
CTQLFIYRPTVKFFGPLWTN

SEQ ID NO: 2395725 - protein, 50 aa, Entamoeba dispar
CTRLSKAMKNFLFWGIGACVYLFIYIIGYIICLIMYLRLTKKIKQEIEDE

SEQ ID NO: 2395726 - protein, 18 aa, Entamoeba dispar
CTSCFTGYFKTPDMLWCE

SEQ ID NO: 2395727 - protein, 18 aa, Entamoeba dispar
CVAVTFLIGSLLQVFLCV

SEQ ID NO: 2395728 - protein, 18 aa, Entamoeba dispar
CVDGYYLFDYHCIKCSDN

SEQ ID NO: 2395729 - protein, 49 aa, Entamoeba dispar
CVFNKISLVLVIGIPLFGIFVIIVLTIIIISYLLFALHKKKKLEERKAK

SEQ ID NO: 2395730 - protein, 31 aa, Entamoeba dispar
CVFVCFQFMYMLAFIFFTFMNIKKDAYVLKK

SEQ ID NO: 2395731 - protein, 23 aa, Entamoeba dispar
CVGLFFSFLGDLLLLMDGLQWFA

SEQ ID NO: 2395732 - protein, 24 aa, Entamoeba dispar
CVIALLCYVLKFRALWSKNSGEIK

SEQ ID NO: 2395733 - protein, 20 aa, Entamoeba dispar
CVIIVAIIILIESWCHRAVK

SEQ ID NO: 2395734 - protein, 25 aa, Entamoeba dispar
CVILIIFGSWCLVNFILGKRGVAVL

SEQ ID NO: 2395735 - protein, 25 aa, Entamoeba dispar
CVIRNIHIVIISSLLILIQYENISQ

SEQ ID NO: 2395736 - protein, 20 aa, Entamoeba dispar
CVLMLVFMLLSKLLCKNKRE

SEQ ID NO: 2395737 - protein, 21 aa, Entamoeba dispar
CVLMLVFMLLSKLLCKNKREK

SEQ ID NO: 2395738 - protein, 20 aa, Entamoeba dispar
CVPPIPIMVGTDYRPFCDVS

SEQ ID NO: 2395739 - protein, 24 aa, Entamoeba dispar
CVTPPMLLLNQFKLIIEGFIEKNK

SEQ ID NO: 2395740 - protein, 24 aa, Entamoeba dispar
CVYGIFVTVFAYFHSDRKEIISKT

SEQ ID NO: 2395741 - protein, 20 aa, Entamoeba dispar
CVYPKYWTAYRGGILRGLNC

SEQ ID NO: 2395742 - protein, 17 aa, Entamoeba dispar
CWMCVFPGCTEPPKTRY

SEQ ID NO: 2395743 - protein, 19 aa, Entamoeba dispar
CWWLVRVIPHIFLIFVSLF

SEQ ID NO: 2395744 - protein, 18 aa, Entamoeba dispar
CYFPLPSFSQIFQGREFP

SEQ ID NO: 2395745 - protein, 30 aa, Entamoeba dispar
CYFVAIYEAILFILMVFRFISYAVSSIIKS

SEQ ID NO: 2395746 - protein, 18 aa, Entamoeba dispar
CYIIGCFVTLFKLPFTLT

SEQ ID NO: 2395747 - protein, 24 aa, Entamoeba dispar
CYKKDIITYRFLIDDIGMAEIWNN

SEQ ID NO: 2395748 - protein, 23 aa, Entamoeba dispar
CYKKMSLLSFDYYFTLEMLNHGQ

SEQ ID NO: 2395749 - protein, 24 aa, Entamoeba dispar
CYNKLMYLFERNTELRKIVLSSFT

SEQ ID NO: 2395750 - protein, 25 aa, Entamoeba dispar
CYRKTMRLVAICNPFFQLSSTVFIG

SEQ ID NO: 2395751 - protein, 31 aa, Entamoeba dispar
CYVDYDLRTPFLFMPLVKLVDAMIFKPLCRS

SEQ ID NO: 2395752 - protein, 25 aa, Entamoeba dispar
DAAEKSWLYSFIKYEKKAPKSNHSH

SEQ ID NO: 2395753 - protein, 17 aa, Entamoeba dispar
DAFESVMKITLGTTLIG

SEQ ID NO: 2395754 - protein, 19 aa, Entamoeba dispar
DAFSYIFPLLFRLINFIEH

SEQ ID NO: 2395755 - protein, 25 aa, Entamoeba dispar
DAHISWLTINYPDCLYNGSLYTLTV

SEQ ID NO: 2395756 - protein, 32 aa, Entamoeba dispar
DAIEFGYVRFYMITLPYFTTPATVLHFICDNN

SEQ ID NO: 2395757 - protein, 25 aa, Entamoeba dispar
DAKEMLTCLDISWLNEIISHKKDFM

SEQ ID NO: 2395758 - protein, 18 aa, Entamoeba dispar
DALLMVSFLGLLVNIIGV

SEQ ID NO: 2395759 - protein, 25 aa, Entamoeba dispar
DAMIFKPLCRSLLGTNIKAIVIGGS

SEQ ID NO: 2395760 - protein, 23 aa, Entamoeba dispar
DASIKQLFVRPPKFAAATTFKLQ

SEQ ID NO: 2395761 - protein, 27 aa, Entamoeba dispar
DASYYKIIVWILFTIFGGTCAFLFTKY

SEQ ID NO: 2395762 - protein, 21 aa, Entamoeba dispar
DAWVLYRYCIKRQRRWYTKPK

SEQ ID NO: 2395763 - protein, 24 aa, Entamoeba dispar
DCEKILDLYFRLLSTFKMLRQESI

SEQ ID NO: 2395764 - protein, 22 aa, Entamoeba dispar
DCHLLCFYNFTWQVSDYSQLCY

SEQ ID NO: 2395765 - protein, 18 aa, Entamoeba dispar
DCLFPILSNAPNLFFQIK

SEQ ID NO: 2395766 - protein, 23 aa, Entamoeba dispar
DCLGCTEGYIPQGYLKCVTFNES

SEQ ID NO: 2395767 - protein, 20 aa, Entamoeba dispar
DCLQYIHLLCNKLTPERADR

SEQ ID NO: 2395768 - protein, 21 aa, Entamoeba dispar
DCPQIHIPWFKMIANEHEKRG

SEQ ID NO: 2395769 - protein, 24 aa, Entamoeba dispar
DCSIDVHSWIFLPSFIPDESFDNS

SEQ ID NO: 2395770 - protein, 44 aa, Entamoeba dispar
DCTSFSLNAPKYTFIETFDISKLTGFFFTINAKVSSGVSVELPS

SEQ ID NO: 2395771 - protein, 20 aa, Entamoeba dispar
DDAAPSMFIAIAAVIAFFFF

SEQ ID NO: 2395772 - protein, 23 aa, Entamoeba dispar
DDAWVLYRYCIRRQRRWYTKPKT

SEQ ID NO: 2395773 - protein, 31 aa, Entamoeba dispar
DDDDFPVVGIILLLILLSSICLYLIIGAVVN

SEQ ID NO: 2395774 - protein, 29 aa, Entamoeba dispar
DDFTFFKQFLYLQPKTIFYIFPESATILC

SEQ ID NO: 2395775 - protein, 26 aa, Entamoeba dispar
DDKSYQIWLPLGKIQPTKVRPNSFQL

SEQ ID NO: 2395776 - protein, 21 aa, Entamoeba dispar
DDLISLFITYQLNKKRNDKWL

SEQ ID NO: 2395777 - protein, 25 aa, Entamoeba dispar
DDNKWNEILIPFTNIPPVLPNNPIP

SEQ ID NO: 2395778 - protein, 38 aa, Entamoeba dispar
DDQMFLIFITGFIGIIIIIWILYFIRKQRSIPTTFPCQ

SEQ ID NO: 2395779 - protein, 22 aa, Entamoeba dispar
DDSFPVIFSINATMYKLTCAIE

SEQ ID NO: 2395780 - protein, 20 aa, Entamoeba dispar
DDSLPRWLHDLFSTVVQSNS

SEQ ID NO: 2395781 - protein, 25 aa, Entamoeba dispar
DDSTTLLICAYLQIIISEIISIISL

SEQ ID NO: 2395782 - protein, 24 aa, Entamoeba dispar
DDVSLVILDVIELAFNGLFGRENW

SEQ ID NO: 2395783 - protein, 23 aa, Entamoeba dispar
DDWVMTCFNTFFTSLPPAAIALF

SEQ ID NO: 2395784 - protein, 25 aa, Entamoeba dispar
DDYIMTFFNILFTQIQPILIGIFDR

SEQ ID NO: 2395785 - protein, 25 aa, Entamoeba dispar
DDYTMTFFNIFITSLPPVFIACLDK

SEQ ID NO: 2395786 - protein, 23 aa, Entamoeba dispar
DEAFYLLSFYSLISLFPFLLFHF

SEQ ID NO: 2395787 - protein, 18 aa, Entamoeba dispar
DECPYCLWGLCYSCTHGC

SEQ ID NO: 2395788 - protein, 17 aa, Entamoeba dispar
DEFLAKTILPKKEYHRL

SEQ ID NO: 2395789 - protein, 28 aa, Entamoeba dispar
DEFTLSMILQLYPSYVPLSFFELIIQAT

SEQ ID NO: 2395790 - protein, 34 aa, Entamoeba dispar
DEGYIFIISYLKCLPFFSILLIVYSLIFESDSKD

SEQ ID NO: 2395791 - protein, 38 aa, Entamoeba dispar
DEICRYQKCYLYYLKIGLLILLSYAGNTFLPCDFISAK

SEQ ID NO: 2395792 - protein, 25 aa, Entamoeba dispar
DEIIRLVCKFYYLNRLESIDAILNG

SEQ ID NO: 2395793 - protein, 35 aa, Entamoeba dispar
DEIRVQLPFPLREKYHLLITVLFISYDDFSQKPMY

SEQ ID NO: 2395794 - protein, 19 aa, Entamoeba dispar
DEITKSFFRVFDDKNTQKT

SEQ ID NO: 2395795 - protein, 41 aa, Entamoeba dispar
DEKAYSTFDWLLWLIVSIVIFAAFLIPFLAVGFVGNSNMTV

SEQ ID NO: 2395796 - protein, 27 aa, Entamoeba dispar
DEKKRLPHFFQILSLTPIGRGILKDNN

SEQ ID NO: 2395797 - protein, 22 aa, Entamoeba dispar
DEKPIRKPFRPLPNRETQSMRN

SEQ ID NO: 2395798 - protein, 23 aa, Entamoeba dispar
DELGIWIQKLLAPNYDADLISSA

SEQ ID NO: 2395799 - protein, 21 aa, Entamoeba dispar
DEMERVLLLSPLQRSEIINKE

SEQ ID NO: 2395800 - protein, 26 aa, Entamoeba dispar
DEMKSLLVIYPFPRTLINTPIHIILM

SEQ ID NO: 2395801 - protein, 18 aa, Entamoeba dispar
DEPKKWLGFVYCGIILIT

SEQ ID NO: 2395802 - protein, 27 aa, Entamoeba dispar
DEQHHTLIVSIIWIIGIAFVGLISHYC

SEQ ID NO: 2395803 - protein, 27 aa, Entamoeba dispar
DEQHHTLIVSIIWIIGIAIVGLISHYF

SEQ ID NO: 2395804 - protein, 31 aa, Entamoeba dispar
DERDSRYFFLVMVICLIVLVLQQIVFKKLKW

SEQ ID NO: 2395805 - protein, 26 aa, Entamoeba dispar
DERFNQPWMIPQFVIEGHRLERPDNM

SEQ ID NO: 2395806 - protein, 23 aa, Entamoeba dispar
DERFNQPWMIPQFVIEGNRLEKP

SEQ ID NO: 2395807 - protein, 24 aa, Entamoeba dispar
DERVNLYKFFDNKLGQFITKAKDI

SEQ ID NO: 2395808 - protein, 23 aa, Entamoeba dispar
DERYNLITLLRQSTLHVSYHELV

SEQ ID NO: 2395809 - protein, 27 aa, Entamoeba dispar
DETIHFITDKWGTKLYLWEDEFYHPLQ

SEQ ID NO: 2395810 - protein, 18 aa, Entamoeba dispar
DEVLHQIILLKPSENFVA

SEQ ID NO: 2395811 - protein, 20 aa, Entamoeba dispar
DEYYIWGKINYYKDILINGV

SEQ ID NO: 2395812 - protein, 36 aa, Entamoeba dispar
DFAGIIAFFLAFTLPCLFIFMSLYRFNGFTLFSIKP

SEQ ID NO: 2395813 - protein, 24 aa, Entamoeba dispar
DFDGTFRLNIYDNLPLINSRIDQA

SEQ ID NO: 2395814 - protein, 38 aa, Entamoeba dispar
DFESECIRWLGAFRFILWTLWYCVTLMTTKAKIKTKKY

SEQ ID NO: 2395815 - protein, 18 aa, Entamoeba dispar
DFFPVCIVIVSAFSLLNH

SEQ ID NO: 2395816 - protein, 28 aa, Entamoeba dispar
DFHTWKKRYFIIKNEFIYYFSSASPTST

SEQ ID NO: 2395817 - protein, 19 aa, Entamoeba dispar
DFIQSHWSILSQLSQFGTG

SEQ ID NO: 2395818 - protein, 26 aa, Entamoeba dispar
DFLKSISCKMLVIGLGLLHLCCGESA

SEQ ID NO: 2395819 - protein, 17 aa, Entamoeba dispar
DFLLVIGTSLQVAPCNI

SEQ ID NO: 2395820 - protein, 20 aa, Entamoeba dispar
DFMALLYIIISLVAVICPHK

SEQ ID NO: 2395821 - protein, 31 aa, Entamoeba dispar
DFNINTRKLNHNVFLMVLKKFVNTEEIVNKI

SEQ ID NO: 2395822 - protein, 23 aa, Entamoeba dispar
DFNTLQFYFFFEGENDTNFTVSL

SEQ ID NO: 2395823 - protein, 17 aa, Entamoeba dispar
DFPFQLPTWRITFFYCW

SEQ ID NO: 2395824 - protein, 23 aa, Entamoeba dispar
DFTFNENFPFKFGSEELRFGSEK

SEQ ID NO: 2395825 - protein, 18 aa, Entamoeba dispar
DFVLPPREFPYKVYGHVV

SEQ ID NO: 2395826 - protein, 21 aa, Entamoeba dispar
DFWGLFICCVVIAIAALYEDI

SEQ ID NO: 2395827 - protein, 20 aa, Entamoeba dispar
DGDIYIVKYLTSSVEQKRVI

SEQ ID NO: 2395828 - protein, 26 aa, Entamoeba dispar
DGDSVIPTILLLKSALWKEEWNSKKL

SEQ ID NO: 2395829 - protein, 27 aa, Entamoeba dispar
DGEGIINLLFNYGLIPKVQIILEEEKY

SEQ ID NO: 2395830 - protein, 25 aa, Entamoeba dispar
DGEIEWVYYFRKYNSKFFYPNEICP

SEQ ID NO: 2395831 - protein, 17 aa, Entamoeba dispar
DGFYQYYNNYIWMKDAY

SEQ ID NO: 2395832 - protein, 23 aa, Entamoeba dispar
DGGVFFVEIIFKISQTSFGLSLK

SEQ ID NO: 2395833 - protein, 23 aa, Entamoeba dispar
DGIALWFTQSPLKTGKAFGASNK

SEQ ID NO: 2395834 - protein, 33 aa, Entamoeba dispar
DGISDIIGHILFFLLLVYYKFEPNQLVISEQAL

SEQ ID NO: 2395835 - protein, 32 aa, Entamoeba dispar
DGKTPRVDLYLMIFLKFLATVIPTMEYDYGKD

SEQ ID NO: 2395836 - protein, 17 aa, Entamoeba dispar
DGLVLIFKYSQDEAIQQ

SEQ ID NO: 2395837 - protein, 28 aa, Entamoeba dispar
DGLVSWIYYHHKLHNPYFPISKPSESTS

SEQ ID NO: 2395838 - protein, 17 aa, Entamoeba dispar
DGMLLRTALLDPDLKSY

SEQ ID NO: 2395839 - protein, 21 aa, Entamoeba dispar
DGQCIAMSDYCPKKFPGCISC

SEQ ID NO: 2395840 - protein, 30 aa, Entamoeba dispar
DGRYYCQVITSLLPVLFAKNESICKERLKY

SEQ ID NO: 2395841 - protein, 22 aa, Entamoeba dispar
DGSVEFIYYLGDYAKNIILPSS

SEQ ID NO: 2395842 - protein, 43 aa, Entamoeba dispar
DGTYCQRSPVWWVIILVIMVILLVIIITLISIGWCSRKYYRYK

SEQ ID NO: 2395843 - protein, 30 aa, Entamoeba dispar
DGYGECDGHKFLWVRNSWGNDWGIENGHFK

SEQ ID NO: 2395844 - protein, 22 aa, Entamoeba dispar
DGYSMLIVMKYLEYESDFINIV

SEQ ID NO: 2395845 - protein, 23 aa, Entamoeba dispar
DGYSRITLCPLKIIPDNDCTCTF

SEQ ID NO: 2395846 - protein, 19 aa, Entamoeba dispar
DGYVNLFQLLKDAGKPNKA

SEQ ID NO: 2395847 - protein, 18 aa, Entamoeba dispar
DHCLSCAKDYYFVKGQTT

SEQ ID NO: 2395848 - protein, 17 aa, Entamoeba dispar
DHIPSKRPTFKDITIIL

SEQ ID NO: 2395849 - protein, 26 aa, Entamoeba dispar
DHQEKIFSLWGFIISYIVSKGGIVTV

SEQ ID NO: 2395850 - protein, 27 aa, Entamoeba dispar
DHQEKIFSLWGFIISYIVSKGGIVTVK

SEQ ID NO: 2395851 - protein, 25 aa, Entamoeba dispar
DHRKFAIALCNFIIPYFANNHEYNA

SEQ ID NO: 2395852 - protein, 26 aa, Entamoeba dispar
DHSNVFLMLDLLELLLVLKSLLFLRE

SEQ ID NO: 2395853 - protein, 28 aa, Entamoeba dispar
DHWQDEDIIFIFRIFTKLLSSKENYSNI

SEQ ID NO: 2395854 - protein, 17 aa, Entamoeba dispar
DHYALTYSGIRSFDIDY

SEQ ID NO: 2395855 - protein, 22 aa, Entamoeba dispar
DIAFFLTCKWAWTLNLYLDSFA

SEQ ID NO: 2395856 - protein, 18 aa, Entamoeba dispar
DICDDIMTLPFNKIFLKE

SEQ ID NO: 2395857 - protein, 19 aa, Entamoeba dispar
DICIQCEPNYLLINGSCFF

SEQ ID NO: 2395858 - protein, 26 aa, Entamoeba dispar
DIEGAWEIFFRIYKRIHKSINAVAVL

SEQ ID NO: 2395859 - protein, 24 aa, Entamoeba dispar
DIELIMSFGCYFIVTQQTTFKSIS

SEQ ID NO: 2395860 - protein, 21 aa, Entamoeba dispar
DIFFLAMFIIPFSFYKRISFK

SEQ ID NO: 2395861 - protein, 21 aa, Entamoeba dispar
DIFIITFIATLFALNIALRKY

SEQ ID NO: 2395862 - protein, 20 aa, Entamoeba dispar
DIFMYFVFSQSRQKLSLRLR

SEQ ID NO: 2395863 - protein, 21 aa, Entamoeba dispar
DIGCVYGILFTFFFTITTVKN

SEQ ID NO: 2395864 - protein, 32 aa, Entamoeba dispar
DIGSYIVVILLFFFTHIFYTIFIIVDFIQHYY

SEQ ID NO: 2395865 - protein, 32 aa, Entamoeba dispar
DIGVEIYYFNSLLSIVLLFKTTTERNNFISKL

SEQ ID NO: 2395866 - protein, 17 aa, Entamoeba dispar
DIIAIFVVICTCSYYLI

SEQ ID NO: 2395867 - protein, 20 aa, Entamoeba dispar
DIIQIRFRYAYELEYWDKIL

SEQ ID NO: 2395868 - protein, 35 aa, Entamoeba dispar
DILEGLWYCLYVFLIIALMLRFFQVFWDCSVVTFI

SEQ ID NO: 2395869 - protein, 21 aa, Entamoeba dispar
DILIANILINELMNFQVIIGS

SEQ ID NO: 2395870 - protein, 20 aa, Entamoeba dispar
DILLFDCYKISNFTPIVTII

SEQ ID NO: 2395871 - protein, 26 aa, Entamoeba dispar
DILLGPPTLQLFKSLELFELFRLRWK

SEQ ID NO: 2395872 - protein, 18 aa, Entamoeba dispar
DILLKKEKWYKDINIYRL

SEQ ID NO: 2395873 - protein, 17 aa, Entamoeba dispar
DILQWRNGTRLMSVNND

SEQ ID NO: 2395874 - protein, 30 aa, Entamoeba dispar
DILRPSLRWYFSILFWRRIKTLKSTFKQST

SEQ ID NO: 2395875 - protein, 25 aa, Entamoeba dispar
DIMTLPFNKIFLKESIDKLKGLNQV

SEQ ID NO: 2395876 - protein, 20 aa, Entamoeba dispar
DINELFLRKIKLLMTVQPYE

SEQ ID NO: 2395877 - protein, 20 aa, Entamoeba dispar
DINKQLLYHGSRLANFVSIL

SEQ ID NO: 2395878 - protein, 21 aa, Entamoeba dispar
DIPKASPWRYGTTLTTLFVEY

SEQ ID NO: 2395879 - protein, 31 aa, Entamoeba dispar
DIPREWYFIPFFFFIQVILLSLHSLCFSQYT

SEQ ID NO: 2395880 - protein, 22 aa, Entamoeba dispar
DIQDITFHILDFKATFVNKDDS

SEQ ID NO: 2395881 - protein, 19 aa, Entamoeba dispar
DIQRIRFMTFKLGEGQTLS

SEQ ID NO: 2395882 - protein, 22 aa, Entamoeba dispar
DIRYCNIVFISLPYNKQIMVNK

SEQ ID NO: 2395883 - protein, 20 aa, Entamoeba dispar
DISIIYSHFDRTPKVWLLGY

SEQ ID NO: 2395884 - protein, 18 aa, Entamoeba dispar
DISLLHISQFPLTSQYCI

SEQ ID NO: 2395885 - protein, 25 aa, Entamoeba dispar
DISLYRIYLHILLLHLRHQNITSVL

SEQ ID NO: 2395886 - protein, 23 aa, Entamoeba dispar
DISSFLILLQIINKIIANSGISN

SEQ ID NO: 2395887 - protein, 25 aa, Entamoeba dispar
DITKGFWFKIIGSDLTLDISTCESS

SEQ ID NO: 2395888 - protein, 23 aa, Entamoeba dispar
DIVGQFFCYIQLKEYQNAIKSLI

SEQ ID NO: 2395889 - protein, 25 aa, Entamoeba dispar
DIYIGCIVAFLLFKLYHNYILTIYT

SEQ ID NO: 2395890 - protein, 23 aa, Entamoeba dispar
DIYSFALTMYAIDTLSNPYPLNE

SEQ ID NO: 2395891 - protein, 25 aa, Entamoeba dispar
DKCDQLMCFPAALPAIFSFSNGNSI

SEQ ID NO: 2395892 - protein, 25 aa, Entamoeba dispar
DKCVKCSQGFFITSDFKCLRCSDDC

SEQ ID NO: 2395893 - protein, 29 aa, Entamoeba dispar
DKDNHYYYDFMYAVLPFIPDIVDNEVVLY

SEQ ID NO: 2395894 - protein, 24 aa, Entamoeba dispar
DKDNSLWAILFVYRNADAKQNTMR

SEQ ID NO: 2395895 - protein, 21 aa, Entamoeba dispar
DKEIIRYLIRNCGDRELFIWY

SEQ ID NO: 2395896 - protein, 27 aa, Entamoeba dispar
DKFRCDYIIHFYGAVFIPNKICMVTEF

SEQ ID NO: 2395897 - protein, 26 aa, Entamoeba dispar
DKFRNEYIIHFYGAVFIPNKICMVTE

SEQ ID NO: 2395898 - protein, 25 aa, Entamoeba dispar
DKFRNEYVIHFYGAVFIHNKICMVT

SEQ ID NO: 2395899 - protein, 30 aa, Entamoeba dispar
DKFRSDYIVHFYGAIFIPNKICLVTEYADY

SEQ ID NO: 2395900 - protein, 27 aa, Entamoeba dispar
DKFRSEYIIHFYGAVFIPNKICMITEY

SEQ ID NO: 2395901 - protein, 25 aa, Entamoeba dispar
DKFRSEYIIHFYGAVFIPNKICMVT

SEQ ID NO: 2395902 - protein, 26 aa, Entamoeba dispar
DKFRSEYIVHFYGAVFIPNKICMVTE

SEQ ID NO: 2395903 - protein, 25 aa, Entamoeba dispar
DKGKAVEFSIFIQPLCTTTVVDSLV

SEQ ID NO: 2395904 - protein, 29 aa, Entamoeba dispar
DKHKFHPKLIFRLYKGVPCNKRQDLWKIM

SEQ ID NO: 2395905 - protein, 23 aa, Entamoeba dispar
DKHKYYFDILNIKPKEIFNKFIS

SEQ ID NO: 2395906 - protein, 21 aa, Entamoeba dispar
DKIIQYILRYPRRCSTHIYPR

SEQ ID NO: 2395907 - protein, 30 aa, Entamoeba dispar
DKIIWLLYSFLFITFFLIYSSKPKELTESY

SEQ ID NO: 2395908 - protein, 28 aa, Entamoeba dispar
DKIPYFHKLFISLLNEKYLFPLDSLLYN

SEQ ID NO: 2395909 - protein, 26 aa, Entamoeba dispar
DKIRSEYIIHFYGAVFIPNKICMVTE

SEQ ID NO: 2395910 - protein, 27 aa, Entamoeba dispar
DKKARLLWFRNYFIGVLISILSNIDLT

SEQ ID NO: 2395911 - protein, 17 aa, Entamoeba dispar
DKKEMTLFKHLNRTHTK

SEQ ID NO: 2395912 - protein, 21 aa, Entamoeba dispar
DKKKIFIAILPFITLDNSKIR

SEQ ID NO: 2395913 - protein, 23 aa, Entamoeba dispar
DKKKYRLLDPSGFDLKIGNSKST

SEQ ID NO: 2395914 - protein, 27 aa, Entamoeba dispar
DKKTLIHHFPFIMQSLFNIFQNVKDST

SEQ ID NO: 2395915 - protein, 25 aa, Entamoeba dispar
DKLTSFFSFLPMLSDSLLSLIHGVF

SEQ ID NO: 2395916 - protein, 24 aa, Entamoeba dispar
DKMSYLIVDINIHSTIFAGSTSLY

SEQ ID NO: 2395917 - protein, 42 aa, Entamoeba dispar
DKNEVVLFGLWGIFLFLIIPSIIVFSVFYPSLKYPFDGLSDT

SEQ ID NO: 2395918 - protein, 26 aa, Entamoeba dispar
DKNVKGIITWFSLHNCQTRFEGTRKE

SEQ ID NO: 2395919 - protein, 26 aa, Entamoeba dispar
DKQHIIICCQLFLLNVYHMIHKFKSY

SEQ ID NO: 2395920 - protein, 33 aa, Entamoeba dispar
DKRKETLIPMKMKIKFMIDAAKGIQYLHSNGIL

SEQ ID NO: 2395921 - protein, 24 aa, Entamoeba dispar
DKSIFGFCALYQEGKYTKGWFVSL

SEQ ID NO: 2395922 - protein, 24 aa, Entamoeba dispar
DKSYQIWLPLGKIQPTKVRPNSFQ

SEQ ID NO: 2395923 - protein, 42 aa, Entamoeba dispar
DKTLIAIICVSVIVGILLILAIVLLAFIIYRKCTSKNDYENL

SEQ ID NO: 2395924 - protein, 51 aa, Entamoeba dispar
DKTMPLKRKLANLGKWLVLLAGILCLIVVGLLVLWLFIKNGSMTWDDTVSI

SEQ ID NO: 2395925 - protein, 26 aa, Entamoeba dispar
DKYFDSYFPYYINALSKFSICPNDKA

SEQ ID NO: 2395926 - protein, 30 aa, Entamoeba dispar
DKYLGFLVVIMVFRFFLSKGRLIVLRRFVT

SEQ ID NO: 2395927 - protein, 17 aa, Entamoeba dispar
DLDKIIPLVKRTEYIVG

SEQ ID NO: 2395928 - protein, 33 aa, Entamoeba dispar
DLDVFITFVYDYINILNRLFDFILNAEPTVING

SEQ ID NO: 2395929 - protein, 20 aa, Entamoeba dispar
DLEKNYSFQFTLRNTYKKVL

SEQ ID NO: 2395930 - protein, 17 aa, Entamoeba dispar
DLFGYLSCKELHLKSTT

SEQ ID NO: 2395931 - protein, 26 aa, Entamoeba dispar
DLFPSLFILVFLSLFRYFLTKHILNQ

SEQ ID NO: 2395932 - protein, 21 aa, Entamoeba dispar
DLIALYFSTLCNILKKLNLLL

SEQ ID NO: 2395933 - protein, 17 aa, Entamoeba dispar
DLILPIDGFFSVSSLRV

SEQ ID NO: 2395934 - protein, 26 aa, Entamoeba dispar
DLINPPVLRIKVFEPLFIVGKENYAK

SEQ ID NO: 2395935 - protein, 23 aa, Entamoeba dispar
DLINPYLLFRIADLFFIGCVVLT

SEQ ID NO: 2395936 - protein, 26 aa, Entamoeba dispar
DLIRTAFFHIILYRSLFIKSNHLLSS

SEQ ID NO: 2395937 - protein, 21 aa, Entamoeba dispar
DLITFIMLLISIGQESLFAIS

SEQ ID NO: 2395938 - protein, 17 aa, Entamoeba dispar
DLKFIREYVWCLPRIKR

SEQ ID NO: 2395939 - protein, 19 aa, Entamoeba dispar
DLLHFLFSLLQSLDFCLNE

SEQ ID NO: 2395940 - protein, 17 aa, Entamoeba dispar
DLLIFKTVNYRSIYWPV

SEQ ID NO: 2395941 - protein, 18 aa, Entamoeba dispar
DLLIILFTRYEHSEILHS

SEQ ID NO: 2395942 - protein, 35 aa, Entamoeba dispar
DLLKIIGVIIVCVVMYFINGFNKNLARKLANKIQI

SEQ ID NO: 2395943 - protein, 21 aa, Entamoeba dispar
DLLVLPPIYTTLQYLKTIDIS

SEQ ID NO: 2395944 - protein, 21 aa, Entamoeba dispar
DLMSQLIVLIISLYSQVKSLI

SEQ ID NO: 2395945 - protein, 21 aa, Entamoeba dispar
DLMYTLFTNIFCGKKILYEQE

SEQ ID NO: 2395946 - protein, 20 aa, Entamoeba dispar
DLNQCLSCKTKLLLNGICTL

SEQ ID NO: 2395947 - protein, 26 aa, Entamoeba dispar
DLNQYPMKIIILTTVYYLIQYRDTQQ

SEQ ID NO: 2395948 - protein, 23 aa, Entamoeba dispar
DLNYSFILSSLFTTKLVLHSALF

SEQ ID NO: 2395949 - protein, 35 aa, Entamoeba dispar
DLPPHALSFILAFVFNFLVINLFKYTNHWNTEEKK

SEQ ID NO: 2395950 - protein, 29 aa, Entamoeba dispar
DLQIPKRGILKWGPLLSITNAITNLLTFS

SEQ ID NO: 2395951 - protein, 25 aa, Entamoeba dispar
DLQIREFYMFYSNKAYMKNIYYETD

SEQ ID NO: 2395952 - protein, 30 aa, Entamoeba dispar
DLQKKWVVTYSIYWLPYVNLAQDYTRKECN

SEQ ID NO: 2395953 - protein, 27 aa, Entamoeba dispar
DLQQKLKTPLLLLPKEKRPTANMFMST

SEQ ID NO: 2395954 - protein, 17 aa, Entamoeba dispar
DLRKCIPLIIVGNGAYG

SEQ ID NO: 2395955 - protein, 17 aa, Entamoeba dispar
DLRLWLCSLVKNSFYKV

SEQ ID NO: 2395956 - protein, 17 aa, Entamoeba dispar
DLRTRHCFGGFLTIICV

SEQ ID NO: 2395957 - protein, 19 aa, Entamoeba dispar
DLSLKDWPFTSFQSWAVDR

SEQ ID NO: 2395958 - protein, 34 aa, Entamoeba dispar
DLSNDVFSIVFRQPYFYLVTLFTVIVGIVPNILR

SEQ ID NO: 2395959 - protein, 25 aa, Entamoeba dispar
DLSNYYLTSIPYYIWQKIQKEQIQV

SEQ ID NO: 2395960 - protein, 26 aa, Entamoeba dispar
DLSYVNIGIWYLISSYEGSINKITST

SEQ ID NO: 2395961 - protein, 27 aa, Entamoeba dispar
DLTGLISFILVFIAPCIFHLLSIRLFQ

SEQ ID NO: 2395962 - protein, 35 aa, Entamoeba dispar
DLTRTFLIVAILVSFCIFISFFNNLFYSSQVRIEK

SEQ ID NO: 2395963 - protein, 24 aa, Entamoeba dispar
DLTSYFGLIEFYENYLETHKNLIN

SEQ ID NO: 2395964 - protein, 24 aa, Entamoeba dispar
DLTTQLFIFIFLLTVFYMSHWEEY

SEQ ID NO: 2395965 - protein, 19 aa, Entamoeba dispar
DLVCVSCKSGYFMKEDFTC

SEQ ID NO: 2395966 - protein, 21 aa, Entamoeba dispar
DLVFVLFCGLIIMLVEYYFPS

SEQ ID NO: 2395967 - protein, 18 aa, Entamoeba dispar
DMEGIPLNQLTFPKIKTA

SEQ ID NO: 2395968 - protein, 29 aa, Entamoeba dispar
DMIHPLEYLTFMLQLFVTPPLTEDFLISE

SEQ ID NO: 2395969 - protein, 34 aa, Entamoeba dispar
DMMLGVFALSIYWFFYVFNWYMTYAKQLLRLDMV

SEQ ID NO: 2395970 - protein, 25 aa, Entamoeba dispar
DMPIDQFVFTLLKLKNSLINTDETQ

SEQ ID NO: 2395971 - protein, 24 aa, Entamoeba dispar
DMTLESMKLFREIEYLLTTLSNKF

SEQ ID NO: 2395972 - protein, 25 aa, Entamoeba dispar
DMVLIDFSFFKRFLSISDSILTVNG

SEQ ID NO: 2395973 - protein, 22 aa, Entamoeba dispar
DNDFRYVAPNNLFFPKSNNKEE

SEQ ID NO: 2395974 - protein, 26 aa, Entamoeba dispar
DNDGLYTVFVFLKGLVVYFLHEGLLN

SEQ ID NO: 2395975 - protein, 23 aa, Entamoeba dispar
DNDKKMYLTPRYYYGLNSVNTPN

SEQ ID NO: 2395976 - protein, 30 aa, Entamoeba dispar
DNESILTISGFLFIGVFNSFLVSNERFWKY

SEQ ID NO: 2395977 - protein, 37 aa, Entamoeba dispar
DNFEHFFVHWYYQARIFFFKLILLKMTLAPSFRINGG

SEQ ID NO: 2395978 - protein, 18 aa, Entamoeba dispar
DNGISGVLVLSIFTILMI

SEQ ID NO: 2395979 - protein, 23 aa, Entamoeba dispar
DNHQLCWTGFTKTPNRMCVPFKY

SEQ ID NO: 2395980 - protein, 22 aa, Entamoeba dispar
DNIRKFIQFQVTVNIVALALCV

SEQ ID NO: 2395981 - protein, 24 aa, Entamoeba dispar
DNIRKFLQFQLTVNISALSLCVIG

SEQ ID NO: 2395982 - protein, 24 aa, Entamoeba dispar
DNKIIEKYLKIIRIYIKKQSSSYE

SEQ ID NO: 2395983 - protein, 23 aa, Entamoeba dispar
DNKLLNNQLIPVLFAICCREKIS

SEQ ID NO: 2395984 - protein, 25 aa, Entamoeba dispar
DNKNAVLYLLSFWNKVITSTQLNGD

SEQ ID NO: 2395985 - protein, 20 aa, Entamoeba dispar
DNLITIPVPLKKVSLPTELS

SEQ ID NO: 2395986 - protein, 22 aa, Entamoeba dispar
DNLYSCIFSMNSLSTKLIKSEQ

SEQ ID NO: 2395987 - protein, 25 aa, Entamoeba dispar
DNNENLLIQFFFYDKSTETKITETS

SEQ ID NO: 2395988 - protein, 23 aa, Entamoeba dispar
DNNEYPITIILPMNGGGSGDLVS

SEQ ID NO: 2395989 - protein, 24 aa, Entamoeba dispar
DNNIRFVIDSLLTFYSKHICLTIQ

SEQ ID NO: 2395990 - protein, 26 aa, Entamoeba dispar
DNNLNNALFTFTYPSVMKLTEIFKVF

SEQ ID NO: 2395991 - protein, 49 aa, Entamoeba dispar
DNNYYNYHLPIQRTYFNSIPINLKFSSNKGIWYLISSYEGIINKITSKS

SEQ ID NO: 2395992 - protein, 24 aa, Entamoeba dispar
DNNYYNYHLPIQRTYINSKPTKLI

SEQ ID NO: 2395993 - protein, 30 aa, Entamoeba dispar
DNPDLRDRGLFYWRLLAHDPELAKEMVCSE

SEQ ID NO: 2395994 - protein, 27 aa, Entamoeba dispar
DNPYSKEVYKFPWTIASAVVEGKRPDI

SEQ ID NO: 2395995 - protein, 27 aa, Entamoeba dispar
DNSFTQGNLLLLPLSNHYLNTPITITW

SEQ ID NO: 2395996 - protein, 24 aa, Entamoeba dispar
DNSKQFILYHRMLLESPIVSEEIH

SEQ ID NO: 2395997 - protein, 24 aa, Entamoeba dispar
DNSSQVFFIKNLFKGIKDLINTEK

SEQ ID NO: 2395998 - protein, 27 aa, Entamoeba dispar
DNSTFGQWDCLLYSPYLSLVINSDSIY

SEQ ID NO: 2395999 - protein, 18 aa, Entamoeba dispar
DNVLIYPSYSFKTCEMSP

SEQ ID NO: 2396000 - protein, 24 aa, Entamoeba dispar
DNVNRFFTLQGMRVLAFGYKVING

SEQ ID NO: 2396001 - protein, 26 aa, Entamoeba dispar
DPCRMISIWFLSVLMYYIFNKKYGEP

SEQ ID NO: 2396002 - protein, 37 aa, Entamoeba dispar
DPEEGIAYYLIIPNFLLCIDWLIVMIDFYFERQRSVF

SEQ ID NO: 2396003 - protein, 18 aa, Entamoeba dispar
DPFNIWALEMYPESFIHD

SEQ ID NO: 2396004 - protein, 21 aa, Entamoeba dispar
DPLLFVPALTCCHLKKLSFPM

SEQ ID NO: 2396005 - protein, 24 aa, Entamoeba dispar
DPNDSILLCLCQERNLQEIDNLMN

SEQ ID NO: 2396006 - protein, 25 aa, Entamoeba dispar
DPNGNILIPNFKFFIPFNIEEMLQP

SEQ ID NO: 2396007 - protein, 24 aa, Entamoeba dispar
DPNHFEYVFPLLSSILLCFSLIDI

SEQ ID NO: 2396008 - protein, 38 aa, Entamoeba dispar
DPNQVNYPLHKYLGFSLLKLHLPANRILLQKIQNLDNT

SEQ ID NO: 2396009 - protein, 20 aa, Entamoeba dispar
DPNSIPFVFTLLVELTDNMS

SEQ ID NO: 2396010 - protein, 24 aa, Entamoeba dispar
DPNTNNALWWRRPSESSLDTQSLC

SEQ ID NO: 2396011 - protein, 26 aa, Entamoeba dispar
DPTTSLYYPLSISVLPFLPTCPLHVD

SEQ ID NO: 2396012 - protein, 26 aa, Entamoeba dispar
DPVISSLLLDFYRYSFGFYASTYHEK

SEQ ID NO: 2396013 - protein, 22 aa, Entamoeba dispar
DPVYWIDLLTPEQFEEGFGSHT

SEQ ID NO: 2396014 - protein, 28 aa, Entamoeba dispar
DQCVRIYESWFILKQYTPQPIAQKFKEF

SEQ ID NO: 2396015 - protein, 24 aa, Entamoeba dispar
DQDYSYLRIKALCGFSPFVISSYT

SEQ ID NO: 2396016 - protein, 39 aa, Entamoeba dispar
DQLSSWMTIIKATVDLVWRVWGAMMSAQPFDPSLFGSVN

SEQ ID NO: 2396017 - protein, 22 aa, Entamoeba dispar
DQNDRGIILRRNAKFIFGNAFY

SEQ ID NO: 2396018 - protein, 28 aa, Entamoeba dispar
DQRELLKKKLTYLLKKRFYAKTIIDKEI

SEQ ID NO: 2396019 - protein, 24 aa, Entamoeba dispar
DQRYSLDVSKLEKLGWKTTTSFEE

SEQ ID NO: 2396020 - protein, 23 aa, Entamoeba dispar
DQRYSLDVSKLEKLGWRATTSFE

SEQ ID NO: 2396021 - protein, 21 aa, Entamoeba dispar
DQRYYIFVTSYYQEAGTFQLT

SEQ ID NO: 2396022 - protein, 25 aa, Entamoeba dispar
DQTKGIYWVVPIISVPIICGLSLDY

SEQ ID NO: 2396023 - protein, 20 aa, Entamoeba dispar
DQYGCLECYYDQTNTELCYS

SEQ ID NO: 2396024 - protein, 19 aa, Entamoeba dispar
DQYVLKHQVCIYWKDIKKC

SEQ ID NO: 2396025 - protein, 20 aa, Entamoeba dispar
DRFKQFLINGLLETLIGFTQ

SEQ ID NO: 2396026 - protein, 24 aa, Entamoeba dispar
DRKWALWFGLILQCVGIVLCIITQ

SEQ ID NO: 2396027 - protein, 22 aa, Entamoeba dispar
DRPTFIDILKTIESWGEDIKYA

SEQ ID NO: 2396028 - protein, 23 aa, Entamoeba dispar
DRQLIQTIRFIFDKYPTHEIITQ

SEQ ID NO: 2396029 - protein, 30 aa, Entamoeba dispar
DRSFLIIIISFILIYPLSFSKTLDALKYFS

SEQ ID NO: 2396030 - protein, 17 aa, Entamoeba dispar
DRYYLDPSSHLCGSCSS

SEQ ID NO: 2396031 - protein, 25 aa, Entamoeba dispar
DSAFYAIRVLFICIAYILLRYRYPN

SEQ ID NO: 2396032 - protein, 18 aa, Entamoeba dispar
DSCIECQPGFFPYNDSCI

SEQ ID NO: 2396033 - protein, 18 aa, Entamoeba dispar
DSDFKYGFPMVVVGTKSD

SEQ ID NO: 2396034 - protein, 27 aa, Entamoeba dispar
DSEIMKYFYIFLGISGAMFISTYLHKA

SEQ ID NO: 2396035 - protein, 30 aa, Entamoeba dispar
DSEQFVTGLLILFTIPLISELLKEVGCIKT

SEQ ID NO: 2396036 - protein, 21 aa, Entamoeba dispar
DSFCYSGCSLVTKGLKEWGGA

SEQ ID NO: 2396037 - protein, 18 aa, Entamoeba dispar
DSFFPTLIVDMTASYIVF

SEQ ID NO: 2396038 - protein, 24 aa, Entamoeba dispar
DSFKTIIKPSLPQQPLIVSTKCLS

SEQ ID NO: 2396039 - protein, 19 aa, Entamoeba dispar
DSFKYMLLRPFKIPSLNSI

SEQ ID NO: 2396040 - protein, 18 aa, Entamoeba dispar
DSGDIFMYFVFSQSRQKL

SEQ ID NO: 2396041 - protein, 19 aa, Entamoeba dispar
DSGYIHDIIIYNSLIEIKK

SEQ ID NO: 2396042 - protein, 27 aa, Entamoeba dispar
DSHILHNIILSLLQLNDKLINIELTKL

SEQ ID NO: 2396043 - protein, 21 aa, Entamoeba dispar
DSHLLHYFIPKIKSDMVALLP

SEQ ID NO: 2396044 - protein, 20 aa, Entamoeba dispar
DSHSVISYIDLPWTKNNEFC

SEQ ID NO: 2396045 - protein, 36 aa, Entamoeba dispar
DSIDKFIALTILEYLLLYGYPFALKILLILIEQTST

SEQ ID NO: 2396046 - protein, 24 aa, Entamoeba dispar
DSIEIQFALPSFFIITGKSKNELK

SEQ ID NO: 2396047 - protein, 21 aa, Entamoeba dispar
DSINKFCSFEWWCQAIESGKN

SEQ ID NO: 2396048 - protein, 27 aa, Entamoeba dispar
DSIQRSIFFILPDLLVEYFASLISLMK

SEQ ID NO: 2396049 - protein, 29 aa, Entamoeba dispar
DSISFVSIKFGNLDKVSFVKKASREENVE

SEQ ID NO: 2396050 - protein, 23 aa, Entamoeba dispar
DSLIVLVFLLYIFTYECCKCKKT

SEQ ID NO: 2396051 - protein, 23 aa, Entamoeba dispar
DSLIYYSYWVLTFIYARISISYS

SEQ ID NO: 2396052 - protein, 28 aa, Entamoeba dispar
DSLKRLFPFMQFFILTGILFLLTDELFI

SEQ ID NO: 2396053 - protein, 21 aa, Entamoeba dispar
DSNCCRLFKIPLFNSQLIINE

SEQ ID NO: 2396054 - protein, 18 aa, Entamoeba dispar
DSPYYGQIKYMYVGIETT

SEQ ID NO: 2396055 - protein, 20 aa, Entamoeba dispar
DSQHIYFLYLAINEEYSASI

SEQ ID NO: 2396056 - protein, 22 aa, Entamoeba dispar
DSQLLIFPSGYTVLIDLGENRD

SEQ ID NO: 2396057 - protein, 23 aa, Entamoeba dispar
DSSNKLFFLDIGDDHVFKVNSLS

SEQ ID NO: 2396058 - protein, 47 aa, Entamoeba dispar
DSTKQSLLSSYFIKSIVVLLCCVFVGIIILFFIKSKRKSTEVELEDI

SEQ ID NO: 2396059 - protein, 18 aa, Entamoeba dispar
DTAKALARGLLDLGLKKG

SEQ ID NO: 2396060 - protein, 29 aa, Entamoeba dispar
DTDILRQMLFLFIWIICLRVGAIVLIRLH

SEQ ID NO: 2396061 - protein, 23 aa, Entamoeba dispar
DTIGTPMYRLLCSLLMKKRGQGP

SEQ ID NO: 2396062 - protein, 19 aa, Entamoeba dispar
DTIITIKPINNNSANLNIG

SEQ ID NO: 2396063 - protein, 27 aa, Entamoeba dispar
DTINKLVLKMLYFAIGNMVAGFLQTIC

SEQ ID NO: 2396064 - protein, 23 aa, Entamoeba dispar
DTITYKITKYIRPKKIKYNEEFI

SEQ ID NO: 2396065 - protein, 31 aa, Entamoeba dispar
DTKTDLISWIYIIRIILFSLTKLYPQTEYFT

SEQ ID NO: 2396066 - protein, 21 aa, Entamoeba dispar
DTLIALVKSYYGLWYENNYEG

SEQ ID NO: 2396067 - protein, 17 aa, Entamoeba dispar
DTLKHHIEYTLNKQLDG

SEQ ID NO: 2396068 - protein, 22 aa, Entamoeba dispar
DTSEIAMLLDITRIGLFSKMCD

SEQ ID NO: 2396069 - protein, 28 aa, Entamoeba dispar
DTSKYSYWVFHYLLPLQKSLSFHRKYPF

SEQ ID NO: 2396070 - protein, 21 aa, Entamoeba dispar
DTSLMTLKFSEQSFTLYPIES

SEQ ID NO: 2396071 - protein, 24 aa, Entamoeba dispar
DTSLNSWNLECTSLFLLQTTRTQK

SEQ ID NO: 2396072 - protein, 17 aa, Entamoeba dispar
DTTPLEQMILKKVLLTP

SEQ ID NO: 2396073 - protein, 28 aa, Entamoeba dispar
DTVDLIRYMMIILLFSFSSRFSFKFLSY

SEQ ID NO: 2396074 - protein, 24 aa, Entamoeba dispar
DTVKKLCMLLLQFSRDISDTPIIS

SEQ ID NO: 2396075 - protein, 33 aa, Entamoeba dispar
DTYCSNFSLPLWILTLIIIGAICCLGVLISIII

SEQ ID NO: 2396076 - protein, 23 aa, Entamoeba dispar
DVCNELLFKLLTANFPKTSTEEY

SEQ ID NO: 2396077 - protein, 28 aa, Entamoeba dispar
DVFKGIFTNYIFIGIELLQIIVQTSIVI

SEQ ID NO: 2396078 - protein, 18 aa, Entamoeba dispar
DVGYFYSTYMRQCYPQIG

SEQ ID NO: 2396079 - protein, 35 aa, Entamoeba dispar
DVHLIDTLFPIRHAWTFTAIFLPGAVTRSYIGDGD

SEQ ID NO: 2396080 - protein, 18 aa, Entamoeba dispar
DVIGIIPILVEALKEIHK

SEQ ID NO: 2396081 - protein, 24 aa, Entamoeba dispar
DVINPPFKMSWRIAITFLVSLFDA

SEQ ID NO: 2396082 - protein, 18 aa, Entamoeba dispar
DVIYKWEPLPYSARPKFG

SEQ ID NO: 2396083 - protein, 20 aa, Entamoeba dispar
DVKFNYHLPIQRTYFSSTNT

SEQ ID NO: 2396084 - protein, 17 aa, Entamoeba dispar
DVKIFWLNIVGAILAAI

SEQ ID NO: 2396085 - protein, 23 aa, Entamoeba dispar
DVKQLPPVRIASFVKRILIMMLN

SEQ ID NO: 2396086 - protein, 26 aa, Entamoeba dispar
DVLLEAFFPFVMLVMNFEGKVALITG

SEQ ID NO: 2396087 - protein, 24 aa, Entamoeba dispar
DVRKGFVHLLLYRGTVNRRSHLNW

SEQ ID NO: 2396088 - protein, 25 aa, Entamoeba dispar
DVRKIPLPLIYLYDDKKNKKFPGNK

SEQ ID NO: 2396089 - protein, 22 aa, Entamoeba dispar
DVRVRILKIPSSTLWFSFHELP

SEQ ID NO: 2396090 - protein, 26 aa, Entamoeba dispar
DVSAWISGLLYFFGRIPQIIHIYRTK

SEQ ID NO: 2396091 - protein, 17 aa, Entamoeba dispar
DVVFQFLPEIIFMKMFQ

SEQ ID NO: 2396092 - protein, 20 aa, Entamoeba dispar
DVYMWAMNIFYLTTTVHPFQ

SEQ ID NO: 2396093 - protein, 18 aa, Entamoeba dispar
DVYPEKEFPYIWNIASFI

SEQ ID NO: 2396094 - protein, 24 aa, Entamoeba dispar
DVYVDIPIFILNSSIPKYMKVIDS

SEQ ID NO: 2396095 - protein, 26 aa, Entamoeba dispar
DWDLWGPMFVCYILSLLLSINVMVRK

SEQ ID NO: 2396096 - protein, 17 aa, Entamoeba dispar
DWMFPVDNRKWYEKIPA

SEQ ID NO: 2396097 - protein, 22 aa, Entamoeba dispar
DYAVTLHYLFTATEPFIQNPQM

SEQ ID NO: 2396098 - protein, 33 aa, Entamoeba dispar
DYDGNNFLVDSFYFILPFDIVILNDKSVKFVLK

SEQ ID NO: 2396099 - protein, 32 aa, Entamoeba dispar
DYDYNYHLPIQRTYFNSIPINLKFSSNYGIQY

SEQ ID NO: 2396100 - protein, 28 aa, Entamoeba dispar
DYELTRIVPLYLAVHIFAESPCKALRVY

SEQ ID NO: 2396101 - protein, 23 aa, Entamoeba dispar
DYFDTKIFFGLISTFHAHLLMSK

SEQ ID NO: 2396102 - protein, 17 aa, Entamoeba dispar
DYFIFVSSTKRSLFEVE

SEQ ID NO: 2396103 - protein, 20 aa, Entamoeba dispar
DYFTVFLKKYPNVVGAFLGR

SEQ ID NO: 2396104 - protein, 24 aa, Entamoeba dispar
DYHERPLFNIINPQLTKLIDSSEQ

SEQ ID NO: 2396105 - protein, 19 aa, Entamoeba dispar
DYHVFFGLSSKFEAGTLPI

SEQ ID NO: 2396106 - protein, 28 aa, Entamoeba dispar
DYISPISFCWWLFNAILSSFTIFFISYV

SEQ ID NO: 2396107 - protein, 33 aa, Entamoeba dispar
DYIVKLICFTVIYFVLRMMYRLIYFGMKQTSVN

SEQ ID NO: 2396108 - protein, 25 aa, Entamoeba dispar
DYIVKQLEFLVRKKTFTQFGACEFM

SEQ ID NO: 2396109 - protein, 24 aa, Entamoeba dispar
DYIVMYFLLGIWYFMYMLDHCIFV

SEQ ID NO: 2396110 - protein, 22 aa, Entamoeba dispar
DYKPLEFSLSYSILETFKHNYK

SEQ ID NO: 2396111 - protein, 19 aa, Entamoeba dispar
DYLILPLFSFGFNLLLFIL

SEQ ID NO: 2396112 - protein, 20 aa, Entamoeba dispar
DYLTFSERLFWNLSKEYRMK

SEQ ID NO: 2396113 - protein, 17 aa, Entamoeba dispar
DYNRLLPHFIQEANIME

SEQ ID NO: 2396114 - protein, 23 aa, Entamoeba dispar
DYSIPEFRFLVKLILIHGRYCYR

SEQ ID NO: 2396115 - protein, 17 aa, Entamoeba dispar
DYSPFYSKQVLLGIGFM

SEQ ID NO: 2396116 - protein, 21 aa, Entamoeba dispar
DYSRLIYYDISINLNYENSDE

SEQ ID NO: 2396117 - protein, 23 aa, Entamoeba dispar
DYVKLPYRLKIRMLFDTARGMQF

SEQ ID NO: 2396118 - protein, 22 aa, Entamoeba dispar
EAELLEKIRCPYIVSFIGCVTN

SEQ ID NO: 2396119 - protein, 41 aa, Entamoeba dispar
EAEQQFYYYVSTYYFQPILLDLTLVQLLLSYVSPKQFFLTS

SEQ ID NO: 2396120 - protein, 29 aa, Entamoeba dispar
EAGCDAMFAFPWYITWFLHSVEDIEVGLR

SEQ ID NO: 2396121 - protein, 30 aa, Entamoeba dispar
EAGLCEVHLILFIHHLLPSELVSINVDSLK

SEQ ID NO: 2396122 - protein, 30 aa, Entamoeba dispar
EAIKNMNYPTYYPFFNVYAMSYNGNYYGRT

SEQ ID NO: 2396123 - protein, 18 aa, Entamoeba dispar
EAIQQAVLLGILNINGFG

SEQ ID NO: 2396124 - protein, 26 aa, Entamoeba dispar
EAISIINALYPLRSLDLCMYYEKSNI

SEQ ID NO: 2396125 - protein, 17 aa, Entamoeba dispar
EAKRFMTIYHQPVLLTF

SEQ ID NO: 2396126 - protein, 22 aa, Entamoeba dispar
EALIKKLYKAFPTKDFWRHVCI

SEQ ID NO: 2396127 - protein, 25 aa, Entamoeba dispar
EALLQLCKFKYTFINKRLVEIISRG

SEQ ID NO: 2396128 - protein, 19 aa, Entamoeba dispar
EALNFYIKLKAPLSSRQSE

SEQ ID NO: 2396129 - protein, 23 aa, Entamoeba dispar
EAMVNELLFSDCSFISSINGITA

SEQ ID NO: 2396130 - protein, 24 aa, Entamoeba dispar
EAPEYVPIVYTPRIGPKRIKERRT

SEQ ID NO: 2396131 - protein, 32 aa, Entamoeba dispar
EASTHTFFWICFFLMQFCTVVLVLNLLKKKRD

SEQ ID NO: 2396132 - protein, 33 aa, Entamoeba dispar
EASTHTLFWICFFLMQFCTVVLVLNLLKKKRDM

SEQ ID NO: 2396133 - protein, 17 aa, Entamoeba dispar
EATRKVIIEFLQPGTIS

SEQ ID NO: 2396134 - protein, 18 aa, Entamoeba dispar
EAVDYFTVFLKKYPNVVG

SEQ ID NO: 2396135 - protein, 18 aa, Entamoeba dispar
EAYVFKDILKNPPQPSFS

SEQ ID NO: 2396136 - protein, 19 aa, Entamoeba dispar
ECAIGVYYLHSLGIVHRDI

SEQ ID NO: 2396137 - protein, 24 aa, Entamoeba dispar
ECCSAPFDYYFFTGSTYVGKLVNQ

SEQ ID NO: 2396138 - protein, 46 aa, Entamoeba dispar
ECELSLPFISVLIVSVTFICAFVVIFIVFVITKLVVQKKAIDFSQN

SEQ ID NO: 2396139 - protein, 26 aa, Entamoeba dispar
ECFTLNGILLEPPFLSFSGKTSNVSA

SEQ ID NO: 2396140 - protein, 22 aa, Entamoeba dispar
ECFYNILPYNVYFNYYSHSSDN

SEQ ID NO: 2396141 - protein, 29 aa, Entamoeba dispar
ECGFVTFSNYIQYWVLGSTPRMIKVCDIT

SEQ ID NO: 2396142 - protein, 26 aa, Entamoeba dispar
ECINSFLMLLPFQSFSNKSLIDTYLS

SEQ ID NO: 2396143 - protein, 43 aa, Entamoeba dispar
ECKKKSYWYIYMIIGICILFIILIFVVVGAYYYFKKSMKIKQN

SEQ ID NO: 2396144 - protein, 26 aa, Entamoeba dispar
ECLACQLNYFLPLENPYQCLHISKFS

SEQ ID NO: 2396145 - protein, 23 aa, Entamoeba dispar
ECNEQWLFINRKDAKCLSDGLNI

SEQ ID NO: 2396146 - protein, 22 aa, Entamoeba dispar
ECRDLEGCVIKQYNKSCEPKVK

SEQ ID NO: 2396147 - protein, 17 aa, Entamoeba dispar
ECTACESGYYLSNGECF

SEQ ID NO: 2396148 - protein, 18 aa, Entamoeba dispar
ECVFPPRPNLNSGMPIMT

SEQ ID NO: 2396149 - protein, 18 aa, Entamoeba dispar
ECVYSLTLLAIIGTPSIT

SEQ ID NO: 2396150 - protein, 33 aa, Entamoeba dispar
EDDFNLFIVTIIMSLLPNYNYYMALSTNNYIIR

SEQ ID NO: 2396151 - protein, 27 aa, Entamoeba dispar
EDDNFVYLAITFCPYTLDDYLIKLEEI

SEQ ID NO: 2396152 - protein, 21 aa, Entamoeba dispar
EDGLIIHISPKKLFSVCLHEV

SEQ ID NO: 2396153 - protein, 24 aa, Entamoeba dispar
EDGREFFIMRNSWYDGWGDGDNYL

SEQ ID NO: 2396154 - protein, 26 aa, Entamoeba dispar
EDIHLLQGIVLNLAKPLKQMFRLFSR

SEQ ID NO: 2396155 - protein, 26 aa, Entamoeba dispar
EDIIIDIVYSFKLFNTIRYNLDSSST

SEQ ID NO: 2396156 - protein, 32 aa, Entamoeba dispar
EDIKKILSEILQYNFRLPFTDFAQLNDYIETN

SEQ ID NO: 2396157 - protein, 31 aa, Entamoeba dispar
EDLFFKSGLLFYVLVILYIIVSRTIVSWFFS

SEQ ID NO: 2396158 - protein, 17 aa, Entamoeba dispar
EDNITLSPAPFAHWCIK

SEQ ID NO: 2396159 - protein, 24 aa, Entamoeba dispar
EDNQHFFKPLLFGLFSMVSELYQQ

SEQ ID NO: 2396160 - protein, 23 aa, Entamoeba dispar
EDQFDMFHRCFSLILSALQQLFI

SEQ ID NO: 2396161 - protein, 20 aa, Entamoeba dispar
EDSSISIFITFIGFAIFLIF

SEQ ID NO: 2396162 - protein, 17 aa, Entamoeba dispar
EDSSVLIIMTLTVTLLI

SEQ ID NO: 2396163 - protein, 17 aa, Entamoeba dispar
EDWAEGFIVKPPRMREV

SEQ ID NO: 2396164 - protein, 20 aa, Entamoeba dispar
EDYKFRYRRGLPLVLNGINA

SEQ ID NO: 2396165 - protein, 21 aa, Entamoeba dispar
EDYVKLPYKLKVRMLFDTARG

SEQ ID NO: 2396166 - protein, 25 aa, Entamoeba dispar
EEAARLFVLISIRIPDLYEGILETL

SEQ ID NO: 2396167 - protein, 24 aa, Entamoeba dispar
EEAFKLLLFVFEQLDIQIRPKLSK

SEQ ID NO: 2396168 - protein, 30 aa, Entamoeba dispar
EEALKPYLKPYTLPFWISGGILQTIIGGAV

SEQ ID NO: 2396169 - protein, 18 aa, Entamoeba dispar
EECIQLTKKYFGVLFREE

SEQ ID NO: 2396170 - protein, 18 aa, Entamoeba dispar
EECVSITKLYLSNDIRYP

SEQ ID NO: 2396171 - protein, 25 aa, Entamoeba dispar
EEDCTLLCVFGIEDPLRPEVIDAVA

SEQ ID NO: 2396172 - protein, 24 aa, Entamoeba dispar
EEDGYLWLGVYPNNKCEKSERSRN

SEQ ID NO: 2396173 - protein, 26 aa, Entamoeba dispar
EEEIDIHLIYLFIQHEVYKVYSLVLV

SEQ ID NO: 2396174 - protein, 27 aa, Entamoeba dispar
EEEIEKLIKWARGLKPFGKEKISKLIN

SEQ ID NO: 2396175 - protein, 29 aa, Entamoeba dispar
EEESQIKFLSLILYYCIVSSMGSITFNLE

SEQ ID NO: 2396176 - protein, 17 aa, Entamoeba dispar
EEGFYLTKDQCTKCVDG

SEQ ID NO: 2396177 - protein, 24 aa, Entamoeba dispar
EEGLCEVAIVYYLFNSLYGDNVVG

SEQ ID NO: 2396178 - protein, 24 aa, Entamoeba dispar
EEGTIMHDPNLRNFLLNVEEIRNQ

SEQ ID NO: 2396179 - protein, 28 aa, Entamoeba dispar
EEHEDWQLWMWFGIVTVVIMVVIVLMVV

SEQ ID NO: 2396180 - protein, 25 aa, Entamoeba dispar
EEIGRLLTRLYPYTIHKKFETRTAA

SEQ ID NO: 2396181 - protein, 35 aa, Entamoeba dispar
EEIIKQIPIFMKLTNCLLWYFEKILYQKDTTDQRL

SEQ ID NO: 2396182 - protein, 18 aa, Entamoeba dispar
EEKKYFKLLAISGSENSQ

SEQ ID NO: 2396183 - protein, 26 aa, Entamoeba dispar
EEKNEWNMCFLFNDIFVISKAIVIGA

SEQ ID NO: 2396184 - protein, 24 aa, Entamoeba dispar
EEKRNIINILLKPIIYLLMNGCIS

SEQ ID NO: 2396185 - protein, 51 aa, Entamoeba dispar
EEKTACIFYSKKQWIVYLLSFLIFAIVLIIFVLMLAFHILNYYKEKRRESE

SEQ ID NO: 2396186 - protein, 34 aa, Entamoeba dispar
EEKYKWKEMFLNFDLIQKLWKITGIIMKDHYPQM

SEQ ID NO: 2396187 - protein, 19 aa, Entamoeba dispar
EEKYPFLNFFFKNIPEMTV

SEQ ID NO: 2396188 - protein, 24 aa, Entamoeba dispar
EELIYSRKLLLVSNIVLDICMIPT

SEQ ID NO: 2396189 - protein, 20 aa, Entamoeba dispar
EELLPIKNLIISGCGTSYYA

SEQ ID NO: 2396190 - protein, 19 aa, Entamoeba dispar
EEMIKFIFTARADILPFNW

SEQ ID NO: 2396191 - protein, 25 aa, Entamoeba dispar
EENGFNFEWCLIYKIDRINKRIISL

SEQ ID NO: 2396192 - protein, 34 aa, Entamoeba dispar
EENLLMKKFGAIATLFLPMSFIAALFGMNVTVPG

SEQ ID NO: 2396193 - protein, 37 aa, Entamoeba dispar
EEPDPGLRMLGLVKWLLSGFYLMPTGIKKPYNPILNE

SEQ ID NO: 2396194 - protein, 41 aa, Entamoeba dispar
EEPYPILQWVLRSCVLIAYFFCFILYFFMNILHHSSSIAGS

SEQ ID NO: 2396195 - protein, 37 aa, Entamoeba dispar
EEQHHPIFWSIVILTHLLICGCMGFLYFHHRSKVNYK

SEQ ID NO: 2396196 - protein, 23 aa, Entamoeba dispar
EERKRRNMFSQLKLGELPPQQQL

SEQ ID NO: 2396197 - protein, 18 aa, Entamoeba dispar
EERYGRIIDLLRKWKNSK

SEQ ID NO: 2396198 - protein, 17 aa, Entamoeba dispar
EESTEVIILPPLLIPNQ

SEQ ID NO: 2396199 - protein, 38 aa, Entamoeba dispar
EFAGLRMIIFIITIIFIVVLLIVIYPYCFLHHYGLKKW

SEQ ID NO: 2396200 - protein, 26 aa, Entamoeba dispar
EFDEKYYSYFFKTLIKFSLTNEKAVI

SEQ ID NO: 2396201 - protein, 23 aa, Entamoeba dispar
EFDKGIFILFQLSTSLLHILVYK

SEQ ID NO: 2396202 - protein, 23 aa, Entamoeba dispar
EFEIFIKPLCSCSMKHEIVLLAS

SEQ ID NO: 2396203 - protein, 17 aa, Entamoeba dispar
EFEIFIQPLCTCKIEEK

SEQ ID NO: 2396204 - protein, 18 aa, Entamoeba dispar
EFEIFITPYCTTRIEDKL

SEQ ID NO: 2396205 - protein, 26 aa, Entamoeba dispar
EFFMYKRWFFELLGKMMRKFQKIKEN

SEQ ID NO: 2396206 - protein, 18 aa, Entamoeba dispar
EFGALFNEDLDKLYFCVI

SEQ ID NO: 2396207 - protein, 25 aa, Entamoeba dispar
EFHHNLVYFPLYDGMLNNYTSLTSL

SEQ ID NO: 2396208 - protein, 19 aa, Entamoeba dispar
EFHLTLLEIIIFAIKKDIH

SEQ ID NO: 2396209 - protein, 21 aa, Entamoeba dispar
EFHPQIYLVLLEMIIEVLVEK

SEQ ID NO: 2396210 - protein, 24 aa, Entamoeba dispar
EFIGSQHFNVWWYRNKMNELCKVS

SEQ ID NO: 2396211 - protein, 27 aa, Entamoeba dispar
EFIMFGYLILCFIIKLVMIALAIIFSK

SEQ ID NO: 2396212 - protein, 21 aa, Entamoeba dispar
EFLDYFMSILDIIISRVPESL

SEQ ID NO: 2396213 - protein, 21 aa, Entamoeba dispar
EFMIRCQCALRRISAQQKKYQ

SEQ ID NO: 2396214 - protein, 17 aa, Entamoeba dispar
EFNLVCYPFFLIPDEVH

SEQ ID NO: 2396215 - protein, 20 aa, Entamoeba dispar
EFNPLFRHYLLKKSKNMYFL

SEQ ID NO: 2396216 - protein, 39 aa, Entamoeba dispar
EFNTHLIKFFYYHCYSKRFIEFLPFQVYGLASVYSYLQI

SEQ ID NO: 2396217 - protein, 24 aa, Entamoeba dispar
EFPQPFLIAKPINIFIPRPLDIQK

SEQ ID NO: 2396218 - protein, 20 aa, Entamoeba dispar
EFQIFFTKVKHPCSNNYYDI

SEQ ID NO: 2396219 - protein, 18 aa, Entamoeba dispar
EFTLEAPYTTLIKNWKKI

SEQ ID NO: 2396220 - protein, 44 aa, Entamoeba dispar
EFVFPTAMFFTITSFYISLDGRFPFIWAYSALLATCYWISNRLC

SEQ ID NO: 2396221 - protein, 18 aa, Entamoeba dispar
EFVLKLLHCSLNVFHPQI

SEQ ID NO: 2396222 - protein, 17 aa, Entamoeba dispar
EFYAMTVIGLLLNILRD

SEQ ID NO: 2396223 - protein, 24 aa, Entamoeba dispar
EGCAICKDGYYWKDKNCYSCQEKC

SEQ ID NO: 2396224 - protein, 26 aa, Entamoeba dispar
EGDESWKIIQLLKIDFIRDLHQFVYF

SEQ ID NO: 2396225 - protein, 17 aa, Entamoeba dispar
EGDTYFLFLGINEEYSA

SEQ ID NO: 2396226 - protein, 28 aa, Entamoeba dispar
EGFENKVFYVWFDAPIGYLSITANYTDD

SEQ ID NO: 2396227 - protein, 19 aa, Entamoeba dispar
EGGLLLIICIPGIIVYEIV

SEQ ID NO: 2396228 - protein, 25 aa, Entamoeba dispar
EGGYVEWLYAFTDLYDKVLPESACP

SEQ ID NO: 2396229 - protein, 26 aa, Entamoeba dispar
EGIPDMRFFRWRLYTKINGLINKLQP

SEQ ID NO: 2396230 - protein, 22 aa, Entamoeba dispar
EGIQKIIDFVKATGLQGIILTL

SEQ ID NO: 2396231 - protein, 28 aa, Entamoeba dispar
EGIRVRKLYFKSLLRQDATWYDLQESGE

SEQ ID NO: 2396232 - protein, 28 aa, Entamoeba dispar
EGKNYTNILPMFRWKMYYIADNDNVTSF

SEQ ID NO: 2396233 - protein, 21 aa, Entamoeba dispar
EGKSIIWELLKQVRPGMDLSR

SEQ ID NO: 2396234 - protein, 32 aa, Entamoeba dispar
EGKTQWYAYIIRYLIVFFPLVNLTSSFPIVAQ

SEQ ID NO: 2396235 - protein, 23 aa, Entamoeba dispar
EGKTVLFMWDLLKGLDNTTVIAP

SEQ ID NO: 2396236 - protein, 24 aa, Entamoeba dispar
EGLDKIFEIYLILSKELNRPIINK

SEQ ID NO: 2396237 - protein, 31 aa, Entamoeba dispar
EGLPPNVICECLKMFLKQLPDSLINAELTNT

SEQ ID NO: 2396238 - protein, 27 aa, Entamoeba dispar
EGNEEIIIVDLYPGIKDREVFAWDKKT

SEQ ID NO: 2396239 - protein, 21 aa, Entamoeba dispar
EGRIQLYDTFLPFLIKELKKT

SEQ ID NO: 2396240 - protein, 29 aa, Entamoeba dispar
EGRNHRFYFRADLFIKVPSILTLDIITNA

SEQ ID NO: 2396241 - protein, 21 aa, Entamoeba dispar
EGSIFKLLSPHADNYIYGSVR

SEQ ID NO: 2396242 - protein, 17 aa, Entamoeba dispar
EGSYYWYDNTHICTYET

SEQ ID NO: 2396243 - protein, 25 aa, Entamoeba dispar
EGTFGIVYLGIFRGNKVAIKRMKDI

SEQ ID NO: 2396244 - protein, 26 aa, Entamoeba dispar
EGYIKAFSLMLIICGFIIVVIEMFLY

SEQ ID NO: 2396245 - protein, 20 aa, Entamoeba dispar
EHGIIRSPIAGGLLVMYLIS

SEQ ID NO: 2396246 - protein, 24 aa, Entamoeba dispar
EHIIMVLFPLLFPTPWKPKCIRSD

SEQ ID NO: 2396247 - protein, 19 aa, Entamoeba dispar
EHIVYIKGNIRDTVKWCFY

SEQ ID NO: 2396248 - protein, 39 aa, Entamoeba dispar
EHKKLQQIIIQQWRSLGISFKRKYPTVILNILVDEYDPN

SEQ ID NO: 2396249 - protein, 32 aa, Entamoeba dispar
EHMASMFVFIFIQLYIFFSWIKSKLSEQQFKR

SEQ ID NO: 2396250 - protein, 22 aa, Entamoeba dispar
EHPMFLTFMMFVGMMLCLFIHI

SEQ ID NO: 2396251 - protein, 30 aa, Entamoeba dispar
EICEMFFVQTYYFSFPLPNQIITSFTLYFT

SEQ ID NO: 2396252 - protein, 26 aa, Entamoeba dispar
EICYSPKMFPIPIPNFSIVDYLKDIG

SEQ ID NO: 2396253 - protein, 25 aa, Entamoeba dispar
EIDKSFFRFFFPIAPSYLHSSFLCI

SEQ ID NO: 2396254 - protein, 25 aa, Entamoeba dispar
EIEQKKIFISFLFDGIRSQSISQFS

SEQ ID NO: 2396255 - protein, 20 aa, Entamoeba dispar
EIESLLKWARKLSFIDVDKV

SEQ ID NO: 2396256 - protein, 27 aa, Entamoeba dispar
EIETWDLLHFLLFASILIALLMKKGFN

SEQ ID NO: 2396257 - protein, 39 aa, Entamoeba dispar
EIFLPFHAIQMFLSIYFMFVTFLMLCQQLYHIVQNETGI

SEQ ID NO: 2396258 - protein, 26 aa, Entamoeba dispar
EIFTKPPIKIVLIASIINVLIATITI

SEQ ID NO: 2396259 - protein, 18 aa, Entamoeba dispar
EIGLFLKIETSSGVVLYI

SEQ ID NO: 2396260 - protein, 17 aa, Entamoeba dispar
EIGNLIIIILSFNIEIS

SEQ ID NO: 2396261 - protein, 17 aa, Entamoeba dispar
EIHFSEMIALKYLSITF

SEQ ID NO: 2396262 - protein, 17 aa, Entamoeba dispar
EIIFLSICYGSVEHCAK

SEQ ID NO: 2396263 - protein, 19 aa, Entamoeba dispar
EIILFTRLINHFDSHFFLN

SEQ ID NO: 2396264 - protein, 19 aa, Entamoeba dispar
EIILICSAGLLTALVAVVP

SEQ ID NO: 2396265 - protein, 23 aa, Entamoeba dispar
EIINVLKYYLEAYVFKDILKNPP

SEQ ID NO: 2396266 - protein, 25 aa, Entamoeba dispar
EIKEILIFIMNTFPKIEPTCIGYIS

SEQ ID NO: 2396267 - protein, 24 aa, Entamoeba dispar
EIKEIPDYIGYFGLDKDDNKCSHQ

SEQ ID NO: 2396268 - protein, 30 aa, Entamoeba dispar
EIKENIFFYMYFICFFIVPPMLHKWGPRFM

SEQ ID NO: 2396269 - protein, 27 aa, Entamoeba dispar
EIKIIENIMSIIYYLFNYKRDMEIKEI

SEQ ID NO: 2396270 - protein, 32 aa, Entamoeba dispar
EIKNYLKQYWPEILWRWYVKKGMYEESIKCIL

SEQ ID NO: 2396271 - protein, 25 aa, Entamoeba dispar
EIKSKYGIILYYKDNFNILKNYNIQ

SEQ ID NO: 2396272 - protein, 19 aa, Entamoeba dispar
EIKYPIVYLLHGMDGDCQS

SEQ ID NO: 2396273 - protein, 19 aa, Entamoeba dispar
EILPIFRQQTTTTTQTIAA

SEQ ID NO: 2396274 - protein, 26 aa, Entamoeba dispar
EIMTISENIFYFPHLINLLFKEMSQS

SEQ ID NO: 2396275 - protein, 23 aa, Entamoeba dispar
EINFELFNILVVTVAFVKGLTIC

SEQ ID NO: 2396276 - protein, 25 aa, Entamoeba dispar
EINKEIIEYFYLLCSALLCSSCSEI

SEQ ID NO: 2396277 - protein, 36 aa, Entamoeba dispar
EINNIIVILFYLIIVIILYFIPKLYLPLQYSDKEFP

SEQ ID NO: 2396278 - protein, 19 aa, Entamoeba dispar
EINPFIKWRLSPIENCKEQ

SEQ ID NO: 2396279 - protein, 24 aa, Entamoeba dispar
EINYFLNGFSIINVPISITSRIEG

SEQ ID NO: 2396280 - protein, 36 aa, Entamoeba dispar
EIPTRIEIFLIHLRRALLFFIHFPCSINNPIEEIKD

SEQ ID NO: 2396281 - protein, 24 aa, Entamoeba dispar
EIQHGFILFECTTELMKNAFIVIR

SEQ ID NO: 2396282 - protein, 17 aa, Entamoeba dispar
EIQLNFDYISMTTLTCL

SEQ ID NO: 2396283 - protein, 41 aa, Entamoeba dispar
EIQYCNIEWIIVVIILIITIIILLSIVIIGVLFIKKQAQQE

SEQ ID NO: 2396284 - protein, 19 aa, Entamoeba dispar
EIRGIKNFIFFGCGTLVLF

SEQ ID NO: 2396285 - protein, 19 aa, Entamoeba dispar
EIRIYYNGEIRYGNWKIIK

SEQ ID NO: 2396286 - protein, 25 aa, Entamoeba dispar
EIRKTKIIIVGSLALIILGIAMLLV

SEQ ID NO: 2396287 - protein, 26 aa, Entamoeba dispar
EIRKTKIIIVGSLALIILGIAMLLVQ

SEQ ID NO: 2396288 - protein, 19 aa, Entamoeba dispar
EIRLTIMKLLDERFDSFLA

SEQ ID NO: 2396289 - protein, 24 aa, Entamoeba dispar
EIRTKNGMFILIYCSSKVNELFDS

SEQ ID NO: 2396290 - protein, 18 aa, Entamoeba dispar
EISKFIHLLINDKRFNKT

SEQ ID NO: 2396291 - protein, 26 aa, Entamoeba dispar
EISRIKKYFLLFVNNLTIGKGLLEKR

SEQ ID NO: 2396292 - protein, 17 aa, Entamoeba dispar
EISYLFQTQMTLAINYI

SEQ ID NO: 2396293 - protein, 23 aa, Entamoeba dispar
EITDIFWVIGSICTVIVACTNSV

SEQ ID NO: 2396294 - protein, 27 aa, Entamoeba dispar
EITRISFIYFLIISIIEGIITKEKEGT

SEQ ID NO: 2396295 - protein, 28 aa, Entamoeba dispar
EITSGMPEWYFLIIQNSWKQNPSERYNI

SEQ ID NO: 2396296 - protein, 26 aa, Entamoeba dispar
EITTMRYSLFLYYKNSGLSYNNTLKQ

SEQ ID NO: 2396297 - protein, 29 aa, Entamoeba dispar
EIVLAICGFIIFRFIFKSEVPWIQKLGGC

SEQ ID NO: 2396298 - protein, 26 aa, Entamoeba dispar
EIVLFWVFVLIWRKKKLITFIVYCCL

SEQ ID NO: 2396299 - protein, 31 aa, Entamoeba dispar
EIVLTILVAFMVLFFLIIGGMLLAQPGFECY

SEQ ID NO: 2396300 - protein, 18 aa, Entamoeba dispar
EIVNSYCFKYIDPKGKSI

SEQ ID NO: 2396301 - protein, 19 aa, Entamoeba dispar
EIYFLFCDIPNYIKMDYKV

SEQ ID NO: 2396302 - protein, 24 aa, Entamoeba dispar
EIYFNIFSNLIILSSSILAGRDPT

SEQ ID NO: 2396303 - protein, 18 aa, Entamoeba dispar
EIYHDFYNTLFISPIEVI

SEQ ID NO: 2396304 - protein, 22 aa, Entamoeba dispar
EIYHLLEIILILVSSQNIQIIS

SEQ ID NO: 2396305 - protein, 32 aa, Entamoeba dispar
EIYVQHNYFILYFTVIWIGIHVKSIVSVIVDA

SEQ ID NO: 2396306 - protein, 24 aa, Entamoeba dispar
EIYYILFIIIPLLILFISYIKLLN

SEQ ID NO: 2396307 - protein, 22 aa, Entamoeba dispar
EIYYLYLGINYDNEINWNCFEK

SEQ ID NO: 2396308 - protein, 24 aa, Entamoeba dispar
EIYYQLFNLFIKYDILKSVIDEVK

SEQ ID NO: 2396309 - protein, 35 aa, Entamoeba dispar
EKCPTLLIPLLYQHIERYLSLRLLLTSPKKQIDNI

SEQ ID NO: 2396310 - protein, 34 aa, Entamoeba dispar
EKDKRKILLIRYGFCGLIGAITLLFVGVFIVIGI

SEQ ID NO: 2396311 - protein, 18 aa, Entamoeba dispar
EKDLPIHLAILSLLIKNS

SEQ ID NO: 2396312 - protein, 26 aa, Entamoeba dispar
EKDTEYPFILYNLNTGGQGFIRIGYC

SEQ ID NO: 2396313 - protein, 27 aa, Entamoeba dispar
EKEATISLPFYGLNKTTIYNPRNANNL

SEQ ID NO: 2396314 - protein, 17 aa, Entamoeba dispar
EKEDYVKLPYKLKVRML

SEQ ID NO: 2396315 - protein, 23 aa, Entamoeba dispar
EKEIKKLIEWAKKLKLIDKEEIN

SEQ ID NO: 2396316 - protein, 25 aa, Entamoeba dispar
EKELEGPIYLLRTSYQNFISRFGVK

SEQ ID NO: 2396317 - protein, 24 aa, Entamoeba dispar
EKEYFHFMNFLSYYEIAVLRLCNF

SEQ ID NO: 2396318 - protein, 21 aa, Entamoeba dispar
EKFKCIQCKKGYYLNSNKECQ

SEQ ID NO: 2396319 - protein, 25 aa, Entamoeba dispar
EKHILELTYYWLDKCPETCNPTVIN

SEQ ID NO: 2396320 - protein, 33 aa, Entamoeba dispar
EKHPIIGLFFFLGFIFPLIWLVQIIIYAFKSNL

SEQ ID NO: 2396321 - protein, 21 aa, Entamoeba dispar
EKIDCICYCPWYIKTEMTKIR

SEQ ID NO: 2396322 - protein, 27 aa, Entamoeba dispar
EKIREFIKFLIFFQPHFNIKQQKLLIS

SEQ ID NO: 2396323 - protein, 25 aa, Entamoeba dispar
EKKKRIFINNFLIDVCIEMGYLFKS

SEQ ID NO: 2396324 - protein, 40 aa, Entamoeba dispar
EKKYARLTTIFAILGIFMPPLFILSFLFSRKSNKKSIRVI

SEQ ID NO: 2396325 - protein, 30 aa, Entamoeba dispar
EKLDGFIPGYKPLKLLAQTLMWKTKTQNDF

SEQ ID NO: 2396326 - protein, 24 aa, Entamoeba dispar
EKLENLIYSVIFFIIKNQSLDELQ

SEQ ID NO: 2396327 - protein, 27 aa, Entamoeba dispar
EKLSWWSLLELAGFVILFFATLVYNRV

SEQ ID NO: 2396328 - protein, 26 aa, Entamoeba dispar
EKMHSGILKWIIRFHPDLVFSRKNPD

SEQ ID NO: 2396329 - protein, 22 aa, Entamoeba dispar
EKMKRVCIIPIWLSHEDYPYLL

SEQ ID NO: 2396330 - protein, 30 aa, Entamoeba dispar
EKNKRIFIHNFLFDLALEFGFFFDSKLSRK

SEQ ID NO: 2396331 - protein, 36 aa, Entamoeba dispar
EKNRKFILGFYITIIVIIFPVSVWLMIRKYNKKDNN

SEQ ID NO: 2396332 - protein, 36 aa, Entamoeba dispar
EKPMKKRIWWLRIVEEIWLVLVGFVRSSFYTITIEI

SEQ ID NO: 2396333 - protein, 22 aa, Entamoeba dispar
EKPRYIDGESLILHLTIEENVK

SEQ ID NO: 2396334 - protein, 23 aa, Entamoeba dispar
EKQASVFLILIPTTFDLIASTLM

SEQ ID NO: 2396335 - protein, 29 aa, Entamoeba dispar
EKQLLRCLALFLEYAWMKGIDGFNNEVNE

SEQ ID NO: 2396336 - protein, 24 aa, Entamoeba dispar
EKQNRYRIGHWLELNLLEFSDSIN

SEQ ID NO: 2396337 - protein, 24 aa, Entamoeba dispar
EKSILDQLPFYAIAKELKIQICTW

SEQ ID NO: 2396338 - protein, 24 aa, Entamoeba dispar
EKSKDYIYPVIPLLCDALAEKDAV

SEQ ID NO: 2396339 - protein, 22 aa, Entamoeba dispar
EKSPLLLKYIAAESLYTFPEMN

SEQ ID NO: 2396340 - protein, 18 aa, Entamoeba dispar
EKSTISLSLALDFAARQA

SEQ ID NO: 2396341 - protein, 20 aa, Entamoeba dispar
EKVLKIYYWGNTICLEYRLN

SEQ ID NO: 2396342 - protein, 30 aa, Entamoeba dispar
EKYIRATMSISFIFTLLLIGVFIGELCICG

SEQ ID NO: 2396343 - protein, 24 aa, Entamoeba dispar
EKYSDIFIPFLLIQGINDESVTMK

SEQ ID NO: 2396344 - protein, 18 aa, Entamoeba dispar
ELAIKIGYLGIGCGIIVF

SEQ ID NO: 2396345 - protein, 17 aa, Entamoeba dispar
ELANALEFCQNKMIISL

SEQ ID NO: 2396346 - protein, 20 aa, Entamoeba dispar
ELFEYFILNDQFRIWCIWCI

SEQ ID NO: 2396347 - protein, 27 aa, Entamoeba dispar
ELGQLYIIMLPMSLYLLILTPHLHFLA

SEQ ID NO: 2396348 - protein, 22 aa, Entamoeba dispar
ELGYIHDFVNRMYAMMVDKNCD

SEQ ID NO: 2396349 - protein, 23 aa, Entamoeba dispar
ELHKWLLKAFSLLNGLPRKKYEY

SEQ ID NO: 2396350 - protein, 18 aa, Entamoeba dispar
ELIHLPSPLLKIAESCLR

SEQ ID NO: 2396351 - protein, 23 aa, Entamoeba dispar
ELIPILYLMLLIPLVTARFLVYR

SEQ ID NO: 2396352 - protein, 24 aa, Entamoeba dispar
ELIQELQVILFPSTTMPLSFEDFE

SEQ ID NO: 2396353 - protein, 18 aa, Entamoeba dispar
ELIQTIITYYPSLLSQSI

SEQ ID NO: 2396354 - protein, 27 aa, Entamoeba dispar
ELITGNPPYYDLNPTAALYKIVNDDYP

SEQ ID NO: 2396355 - protein, 19 aa, Entamoeba dispar
ELITPIYIIAEAYGSFSCI

SEQ ID NO: 2396356 - protein, 29 aa, Entamoeba dispar
ELKCEGNFLFFIRQSPKGCYIFSINETQF

SEQ ID NO: 2396357 - protein, 23 aa, Entamoeba dispar
ELKKIFSILNKFKWNKIKIIIKC

SEQ ID NO: 2396358 - protein, 17 aa, Entamoeba dispar
ELKPIMPPIGEGAFGMV

SEQ ID NO: 2396359 - protein, 22 aa, Entamoeba dispar
ELKYPYCWDLIKDFLVIFFLII

SEQ ID NO: 2396360 - protein, 18 aa, Entamoeba dispar
ELLFKIMTLIGLNDIVFT

SEQ ID NO: 2396361 - protein, 19 aa, Entamoeba dispar
ELLIIEHFIYTYFGHEGII

SEQ ID NO: 2396362 - protein, 18 aa, Entamoeba dispar
ELLKYHKINGYFNTPISC

SEQ ID NO: 2396363 - protein, 26 aa, Entamoeba dispar
ELLRHSIPIIIRLCQNKLLPNDFFKK

SEQ ID NO: 2396364 - protein, 26 aa, Entamoeba dispar
ELNALTYKPILPLLFESFEPPFTQIQ

SEQ ID NO: 2396365 - protein, 19 aa, Entamoeba dispar
ELNNLILNGQFTITNIPKD

SEQ ID NO: 2396366 - protein, 19 aa, Entamoeba dispar
ELPLCYILRYLPSNPRLKH

SEQ ID NO: 2396367 - protein, 29 aa, Entamoeba dispar
ELPLYSSLIQFITDKYYWTYNGFVELIFV

SEQ ID NO: 2396368 - protein, 43 aa, Entamoeba dispar
ELQSIIPIILIYPNPFMFIVWFIPQWIKSLKRIGIIKERIIRS

SEQ ID NO: 2396369 - protein, 26 aa, Entamoeba dispar
ELQTLVFNMFVFAQIFNLFNSRKVNG

SEQ ID NO: 2396370 - protein, 19 aa, Entamoeba dispar
ELREFRKKFPSVQTIMFTA

SEQ ID NO: 2396371 - protein, 24 aa, Entamoeba dispar
ELREKVWAILLKRKPLNTDEYIQY

SEQ ID NO: 2396372 - protein, 26 aa, Entamoeba dispar
ELRKRKKLPLGFKFLQVIQEKDFEKI

SEQ ID NO: 2396373 - protein, 18 aa, Entamoeba dispar
ELRLNYHKSILQLASDRR

SEQ ID NO: 2396374 - protein, 20 aa, Entamoeba dispar
ELSELVWYNKKLYGFDDKTG

SEQ ID NO: 2396375 - protein, 26 aa, Entamoeba dispar
ELSSIPNIFLLLKTYCDKGKSNFVMV

SEQ ID NO: 2396376 - protein, 27 aa, Entamoeba dispar
ELTFKPYKCYYSFDKWLGYSKGNIGLF

SEQ ID NO: 2396377 - protein, 40 aa, Entamoeba dispar
ELTMDIITGVLFAFCILCILLYAAYLTYAKKYRLLREDAT

SEQ ID NO: 2396378 - protein, 38 aa, Entamoeba dispar
ELTNQKQLWYLLLIPILFILVLFMITTLMCVYKIYQRR

SEQ ID NO: 2396379 - protein, 26 aa, Entamoeba dispar
ELVGFNWMHLASIVEYLITAITIVVV

SEQ ID NO: 2396380 - protein, 25 aa, Entamoeba dispar
ELVPYLSCDLSYIRLGTGSETCLCM

SEQ ID NO: 2396381 - protein, 18 aa, Entamoeba dispar
ELYLLTLFEEYDILDLLK

SEQ ID NO: 2396382 - protein, 18 aa, Entamoeba dispar
EMEWYCAIFIFQQKNNEM

SEQ ID NO: 2396383 - protein, 26 aa, Entamoeba dispar
EMFVGVFFFFLYLAQTTSLILMALTT

SEQ ID NO: 2396384 - protein, 22 aa, Entamoeba dispar
EMKMHLMEFPLKDKDFICMKCA

SEQ ID NO: 2396385 - protein, 19 aa, Entamoeba dispar
EMNLLLKNTWDHSPLKRIN

SEQ ID NO: 2396386 - protein, 23 aa, Entamoeba dispar
EMNQSIVMLWRLLKRENTIRNKL

SEQ ID NO: 2396387 - protein, 24 aa, Entamoeba dispar
EMNWFEILLGIAIIFFSFVCFVPQ

SEQ ID NO: 2396388 - protein, 17 aa, Entamoeba dispar
EMVDFRTSFYQCLGLLL

SEQ ID NO: 2396389 - protein, 18 aa, Entamoeba dispar
EMVFVIIHTIKLFLDVIN

SEQ ID NO: 2396390 - protein, 17 aa, Entamoeba dispar
EMYNIIQPYLIESILTN

SEQ ID NO: 2396391 - protein, 35 aa, Entamoeba dispar
ENCAICKDGYFHKLILVIGYTVLSHSLCFYRNSRK

SEQ ID NO: 2396392 - protein, 29 aa, Entamoeba dispar
ENCALEYIVFFFIFVICAFSNQYVSPLFH

SEQ ID NO: 2396393 - protein, 19 aa, Entamoeba dispar
ENFSFVLTGIDGMRKYCYC

SEQ ID NO: 2396394 - protein, 23 aa, Entamoeba dispar
ENFYQWFLPVKSVISGTFNGSKE

SEQ ID NO: 2396395 - protein, 24 aa, Entamoeba dispar
ENHSFFNPWSLKKEYKKLYSDAIA

SEQ ID NO: 2396396 - protein, 24 aa, Entamoeba dispar
ENIKRSIMLLRLLKTGINKEMIIK

SEQ ID NO: 2396397 - protein, 21 aa, Entamoeba dispar
ENINQIFEIITRNILEQKYQR

SEQ ID NO: 2396398 - protein, 20 aa, Entamoeba dispar
ENIWLDRQIYGEGQGLFIAG

SEQ ID NO: 2396399 - protein, 25 aa, Entamoeba dispar
ENKEYFIVTGLYLQIYEIKKRESDQ

SEQ ID NO: 2396400 - protein, 24 aa, Entamoeba dispar
ENKGKFYILQGLIAGIKSFKIEDR

SEQ ID NO: 2396401 - protein, 25 aa, Entamoeba dispar
ENKKGEWVRIRAIPFKPTNNLKNNK

SEQ ID NO: 2396402 - protein, 22 aa, Entamoeba dispar
ENKKKFIIQIFNNIINIEINKE

SEQ ID NO: 2396403 - protein, 18 aa, Entamoeba dispar
ENKSLFERIFNNSIPKHE

SEQ ID NO: 2396404 - protein, 26 aa, Entamoeba dispar
ENKWNDIFFYFLFNTAAIGSVILAIY

SEQ ID NO: 2396405 - protein, 47 aa, Entamoeba dispar
ENKYLLFCIKLHPMVRFILFIITFLIGLTILLLTLPLTGLYVEQPII

SEQ ID NO: 2396406 - protein, 22 aa, Entamoeba dispar
ENLKFIHFTVHGTVAVFGNQYI

SEQ ID NO: 2396407 - protein, 24 aa, Entamoeba dispar
ENLREILYISLLNTWGFSFVFVKP

SEQ ID NO: 2396408 - protein, 26 aa, Entamoeba dispar
ENLSIPLLTILIPDSIYLLSLIEMVI

SEQ ID NO: 2396409 - protein, 26 aa, Entamoeba dispar
ENMAMLVVQHFLLRSVLRTIMDCIDM

SEQ ID NO: 2396410 - protein, 25 aa, Entamoeba dispar
ENNFSNLLVLLRNVLCVIFPTITSD

SEQ ID NO: 2396411 - protein, 17 aa, Entamoeba dispar
ENNIYYLISFVYSEETI

SEQ ID NO: 2396412 - protein, 36 aa, Entamoeba dispar
ENNKYQWWNFIPLAYLRQFKYTYNIFFLVTIITQFI

SEQ ID NO: 2396413 - protein, 26 aa, Entamoeba dispar
ENNTYYYDNFYASLPFTIDIVDGNYI

SEQ ID NO: 2396414 - protein, 72 aa, Entamoeba dispar
ENPIWYKIRTLLGPPPFILFACLFSTFFIIVIPIIFRSFYFLIAFFGSLTIILWFVVALNWKDIKIFLKEGK

SEQ ID NO: 2396415 - protein, 25 aa, Entamoeba dispar
ENQQRPSFFSMLADCDETKKEGNNI

SEQ ID NO: 2396416 - protein, 17 aa, Entamoeba dispar
ENSITIAYALRGKSFKL

SEQ ID NO: 2396417 - protein, 26 aa, Entamoeba dispar
ENSTAIRWFLPLLSLSMKLSSIYQLW

SEQ ID NO: 2396418 - protein, 26 aa, Entamoeba dispar
ENVISLFAQLLLFKGTFAKIKNIENN

SEQ ID NO: 2396419 - protein, 23 aa, Entamoeba dispar
EPANFACLFFFVGTLVSYLIIKE

SEQ ID NO: 2396420 - protein, 36 aa, Entamoeba dispar
EPDPGLRMLGLVKWLLSGFYLMPTGIKKPYNPILGE

SEQ ID NO: 2396421 - protein, 18 aa, Entamoeba dispar
EPFLIERCQWYLNQTNIK

SEQ ID NO: 2396422 - protein, 19 aa, Entamoeba dispar
EPFPKTEFKFPWKIAEFIS

SEQ ID NO: 2396423 - protein, 18 aa, Entamoeba dispar
EPFQKFIYVIAIQASRYL

SEQ ID NO: 2396424 - protein, 26 aa, Entamoeba dispar
EPFSELLRMIYYLFCQIKDSSRRTGD

SEQ ID NO: 2396425 - protein, 21 aa, Entamoeba dispar
EPFSLLCFTGLYIPSSDGLVS

SEQ ID NO: 2396426 - protein, 21 aa, Entamoeba dispar
EPFVPLAPKNFFKPISEVIEM

SEQ ID NO: 2396427 - protein, 25 aa, Entamoeba dispar
EPIKSLIISAWYQESAKRIKAKEII

SEQ ID NO: 2396428 - protein, 23 aa, Entamoeba dispar
EPINLLKFIVMIELFMQPNQITK

SEQ ID NO: 2396429 - protein, 32 aa, Entamoeba dispar
EPIRWRKHYHSWNIFFLSGSVIFVLGLLGVIG

SEQ ID NO: 2396430 - protein, 21 aa, Entamoeba dispar
EPNDNLPTEPLFGVFSIYSAD

SEQ ID NO: 2396431 - protein, 28 aa, Entamoeba dispar
EPQDKQIYQFLLHIAIKQHKYSDAIRLM

SEQ ID NO: 2396432 - protein, 25 aa, Entamoeba dispar
EPQIKKWWYVISLVLMPMLMVFGSF

SEQ ID NO: 2396433 - protein, 24 aa, Entamoeba dispar
EPSYCDYNYFLDSITLNCIKNSCV

SEQ ID NO: 2396434 - protein, 24 aa, Entamoeba dispar
EPVENKLFKRLKETTLFASNHVIH

SEQ ID NO: 2396435 - protein, 23 aa, Entamoeba dispar
EPYFRGCYPCDPGTYRDERLIES

SEQ ID NO: 2396436 - protein, 35 aa, Entamoeba dispar
EQAKPYIGKLHWRDVMKIAVKWRQISEPNDPVYWI

SEQ ID NO: 2396437 - protein, 31 aa, Entamoeba dispar
EQAPIPITILIDQYIPKLLPFSGHVLPSVRT

SEQ ID NO: 2396438 - protein, 26 aa, Entamoeba dispar
EQENIENFILNQNKLSPIKLGTNDDK

SEQ ID NO: 2396439 - protein, 30 aa, Entamoeba dispar
EQERNLMFKNQLRRMLLKRKKDYDKYSREA

SEQ ID NO: 2396440 - protein, 27 aa, Entamoeba dispar
EQFKSLLLVYGPFVSSIKLFNGIQGYK

SEQ ID NO: 2396441 - protein, 20 aa, Entamoeba dispar
EQIGLWYFLQGADRNVLIST

SEQ ID NO: 2396442 - protein, 29 aa, Entamoeba dispar
EQITFYNLTLPYSLHYFLKFLAQNIEYKH

SEQ ID NO: 2396443 - protein, 23 aa, Entamoeba dispar
EQITLHIPYTTRTIPFISANSIN

SEQ ID NO: 2396444 - protein, 23 aa, Entamoeba dispar
EQLMSDIFLLQLASSKTEELLQL

SEQ ID NO: 2396445 - protein, 24 aa, Entamoeba dispar
EQLTILLYKTLISGITKLLLALNK

SEQ ID NO: 2396446 - protein, 31 aa, Entamoeba dispar
EQNKSILWLSLCMLFIPLTAAFARQRNIYLS

SEQ ID NO: 2396447 - protein, 17 aa, Entamoeba dispar
EQRLLLTTISRIGFFLL

SEQ ID NO: 2396448 - protein, 30 aa, Entamoeba dispar
EQVTELCFSILLLLIKSNPNFRELWFEHSG

SEQ ID NO: 2396449 - protein, 34 aa, Entamoeba dispar
ERAADEIYYALNILYFVSLVLDPYIPEFGKKVRE

SEQ ID NO: 2396450 - protein, 32 aa, Entamoeba dispar
EREKDVILALCSQFLLFGIKNENIRITISKIL

SEQ ID NO: 2396451 - protein, 26 aa, Entamoeba dispar
ERFGLTFFKFLYYLGVAPFGVYLFRN

SEQ ID NO: 2396452 - protein, 25 aa, Entamoeba dispar
ERFKAIYPIELLSIELNVWKNTISF

SEQ ID NO: 2396453 - protein, 17 aa, Entamoeba dispar
ERFNQPWMIPQFVIEGN

SEQ ID NO: 2396454 - protein, 19 aa, Entamoeba dispar
ERHLFLIPTFFTVFIFFIS

SEQ ID NO: 2396455 - protein, 27 aa, Entamoeba dispar
ERIGFNRILFYLFSDYFKELFDKKQIN

SEQ ID NO: 2396456 - protein, 21 aa, Entamoeba dispar
ERIRCPYIVNFIGSVTTPDTL

SEQ ID NO: 2396457 - protein, 21 aa, Entamoeba dispar
ERKLSIFGLGLAYAGTRKIEM

SEQ ID NO: 2396458 - protein, 17 aa, Entamoeba dispar
ERLLVLIVIFTVKFFDG

SEQ ID NO: 2396459 - protein, 17 aa, Entamoeba dispar
ERLVTFYQIIRARGFNF

SEQ ID NO: 2396460 - protein, 21 aa, Entamoeba dispar
ERNYGIVVYSGYSWCSPCTTI

SEQ ID NO: 2396461 - protein, 23 aa, Entamoeba dispar
ERQWKIYFDYLKGESTYDIELTS

SEQ ID NO: 2396462 - protein, 29 aa, Entamoeba dispar
ERSESIIPFTRFLRVFLPYTLVNREEGNP

SEQ ID NO: 2396463 - protein, 18 aa, Entamoeba dispar
ERSSCIVRFLFNTAFQFK

SEQ ID NO: 2396464 - protein, 20 aa, Entamoeba dispar
ERTESWFFSLLEASQRKEFG

SEQ ID NO: 2396465 - protein, 24 aa, Entamoeba dispar
ERTSSNQLVIFDPIVWQCENGVPN

SEQ ID NO: 2396466 - protein, 26 aa, Entamoeba dispar
ERVGGVKIFFDKYLTSTGSGRFALVY

SEQ ID NO: 2396467 - protein, 27 aa, Entamoeba dispar
ERVNIYSYPYIIDIFEEETKQIRWGYQ

SEQ ID NO: 2396468 - protein, 19 aa, Entamoeba dispar
ERVPTIPEKLYNVIEECWK

SEQ ID NO: 2396469 - protein, 26 aa, Entamoeba dispar
ESCDFMQFMRPFDTKLKFLITSIQSG

SEQ ID NO: 2396470 - protein, 26 aa, Entamoeba dispar
ESDVFSFSIVFWELFYGVHAFSDLKT

SEQ ID NO: 2396471 - protein, 32 aa, Entamoeba dispar
ESHDVIFKQAILSKGFSVSAPYKLSIEKLGSD

SEQ ID NO: 2396472 - protein, 18 aa, Entamoeba dispar
ESIFLYIINSCCEKEFIM

SEQ ID NO: 2396473 - protein, 21 aa, Entamoeba dispar
ESIKIITLIIGSNTLTLVLTK

SEQ ID NO: 2396474 - protein, 23 aa, Entamoeba dispar
ESKDIIKILLEKELNKLRIRVAK

SEQ ID NO: 2396475 - protein, 22 aa, Entamoeba dispar
ESKSCFSLILVFVNEIIKIPNC

SEQ ID NO: 2396476 - protein, 35 aa, Entamoeba dispar
ESLAIPSAFLIILFIIVVIIIIIFSCTRCCCGPCC

SEQ ID NO: 2396477 - protein, 23 aa, Entamoeba dispar
ESLCLPIFMNLYNNIMELPIQPK

SEQ ID NO: 2396478 - protein, 19 aa, Entamoeba dispar
ESLILHLTIEENVKRDINV

SEQ ID NO: 2396479 - protein, 32 aa, Entamoeba dispar
ESMKSWWTPKKIAGIMFYIAGLMLLISHLTSK

SEQ ID NO: 2396480 - protein, 25 aa, Entamoeba dispar
ESNDKYLLEIQPPLVVLDGGYACEF

SEQ ID NO: 2396481 - protein, 24 aa, Entamoeba dispar
ESNEFLMILLLRLSPLFPFPISNY

SEQ ID NO: 2396482 - protein, 25 aa, Entamoeba dispar
ESPFETFQRLPSPNLLLTYPIIFHQ

SEQ ID NO: 2396483 - protein, 24 aa, Entamoeba dispar
ESPKQLIWRCLLNAAQGIQYLHQR

SEQ ID NO: 2396484 - protein, 17 aa, Entamoeba dispar
ESPLFIIGNEKPFKMDS

SEQ ID NO: 2396485 - protein, 19 aa, Entamoeba dispar
ESQCLGCESSKNVYLNTTT

SEQ ID NO: 2396486 - protein, 27 aa, Entamoeba dispar
ESQIQGTLLRLLISMGYNIVLKKPKMA

SEQ ID NO: 2396487 - protein, 25 aa, Entamoeba dispar
ESSNQAIFKIYRKKEPYQIIKFSLT

SEQ ID NO: 2396488 - protein, 25 aa, Entamoeba dispar
ESSNQAIFKIYRKKEPYQKIEFSLT

SEQ ID NO: 2396489 - protein, 25 aa, Entamoeba dispar
ESSTTIQFFKFINTIMKINAITGQV

SEQ ID NO: 2396490 - protein, 17 aa, Entamoeba dispar
ESSYYLENLTCHLCSEV

SEQ ID NO: 2396491 - protein, 25 aa, Entamoeba dispar
ESTFFHIDFGYLLNERPKFDANLFA

SEQ ID NO: 2396492 - protein, 24 aa, Entamoeba dispar
ESTSLLMNVTLKDIPKASPWRYGT

SEQ ID NO: 2396493 - protein, 23 aa, Entamoeba dispar
ESVDVHYILLKLSIYHCINQEDK

SEQ ID NO: 2396494 - protein, 26 aa, Entamoeba dispar
ESYSKYYFIIYLDFFKEEFSNQFKLP

SEQ ID NO: 2396495 - protein, 24 aa, Entamoeba dispar
ESYSYYLLQCLVGMLPDWIESIGI

SEQ ID NO: 2396496 - protein, 23 aa, Entamoeba dispar
ETAELFKDIFFHTAFWMRTSGEV

SEQ ID NO: 2396497 - protein, 17 aa, Entamoeba dispar
ETCKCYFGFTPITINGI

SEQ ID NO: 2396498 - protein, 18 aa, Entamoeba dispar
ETCLSCLSGYYLSLGQCQ

SEQ ID NO: 2396499 - protein, 19 aa, Entamoeba dispar
ETCMCNFGYIPVTINGITK

SEQ ID NO: 2396500 - protein, 24 aa, Entamoeba dispar
ETDALKIFILLNLNRKDLAAAVVR

SEQ ID NO: 2396501 - protein, 20 aa, Entamoeba dispar
ETEIRPFRVSSDVELALLSA

SEQ ID NO: 2396502 - protein, 25 aa, Entamoeba dispar
ETFDSKRILYLEFYISVIISQTKIL

SEQ ID NO: 2396503 - protein, 17 aa, Entamoeba dispar
ETFKRKLIINFNNKIFI

SEQ ID NO: 2396504 - protein, 25 aa, Entamoeba dispar
ETGSKTLLVIMRLPKENEIKVEEYQ

SEQ ID NO: 2396505 - protein, 17 aa, Entamoeba dispar
ETHYFIRVKLSIPKHCY

SEQ ID NO: 2396506 - protein, 36 aa, Entamoeba dispar
ETIKTISLFNIIGTPLALYHCFLQLGTFSQIYFDSI

SEQ ID NO: 2396507 - protein, 24 aa, Entamoeba dispar
ETIPLRTFRLTQVDRFLTGAYPFY

SEQ ID NO: 2396508 - protein, 29 aa, Entamoeba dispar
ETLFNSLYITNECRLIFSVLPSISNVIMD

SEQ ID NO: 2396509 - protein, 24 aa, Entamoeba dispar
ETLKLIQIPMFLNEKYKKIEYSFD

SEQ ID NO: 2396510 - protein, 33 aa, Entamoeba dispar
ETMQQALLIGLLNPFCQFIIKKPRKQTIVRHCM

SEQ ID NO: 2396511 - protein, 27 aa, Entamoeba dispar
ETNSINGMYLYFMVNWTTTINRKNKQI

SEQ ID NO: 2396512 - protein, 25 aa, Entamoeba dispar
ETNTIAEIIYWNRKLNINKGILITV

SEQ ID NO: 2396513 - protein, 24 aa, Entamoeba dispar
ETNYILYKELCFSMNLFYCTETNG

SEQ ID NO: 2396514 - protein, 31 aa, Entamoeba dispar
ETPLHIACLTKKLKMVILLIEQYHHPLVCFT

SEQ ID NO: 2396515 - protein, 40 aa, Entamoeba dispar
ETPLNGIVILPIVDFLYMIIILHFSLIIKSEELSQCILKS

SEQ ID NO: 2396516 - protein, 32 aa, Entamoeba dispar
ETQKFQIMILLNIFVMVYYIQSWILLSSESND

SEQ ID NO: 2396517 - protein, 20 aa, Entamoeba dispar
ETRECIQCEKGYYLNSTKEC

SEQ ID NO: 2396518 - protein, 22 aa, Entamoeba dispar
ETRELWKCGSCENSTIYKCESK

SEQ ID NO: 2396519 - protein, 18 aa, Entamoeba dispar
ETTSLCDYYLFKEGSVLC

SEQ ID NO: 2396520 - protein, 19 aa, Entamoeba dispar
ETTSLCDYYLFKEGSVLCQ

SEQ ID NO: 2396521 - protein, 18 aa, Entamoeba dispar
ETVCMMLFIFHNLSRVSR

SEQ ID NO: 2396522 - protein, 27 aa, Entamoeba dispar
ETVQNPYFLYILFTLLTTTHYIENKII

SEQ ID NO: 2396523 - protein, 32 aa, Entamoeba dispar
ETVQQWLVSDFLPSLLNSLLTHIRKALLLFSR

SEQ ID NO: 2396524 - protein, 21 aa, Entamoeba dispar
ETYLLISQLLEKTIKGIIGEE

SEQ ID NO: 2396525 - protein, 22 aa, Entamoeba dispar
EVDSPQTFPIVFAPSSNVRFRD

SEQ ID NO: 2396526 - protein, 31 aa, Entamoeba dispar
EVEALFYLPFHPILLTLFVLPTILLSVFQLF

SEQ ID NO: 2396527 - protein, 22 aa, Entamoeba dispar
EVELKVILAKMYAKRGWCDDCL

SEQ ID NO: 2396528 - protein, 26 aa, Entamoeba dispar
EVFGDSWLYYFLPVWTTKGDGYSYPT

SEQ ID NO: 2396529 - protein, 30 aa, Entamoeba dispar
EVFKKYPNYIGKYFKIITEYSLENGEFIII

SEQ ID NO: 2396530 - protein, 17 aa, Entamoeba dispar
EVFMYEPMDLEAPILTG

SEQ ID NO: 2396531 - protein, 36 aa, Entamoeba dispar
EVHWYSIYICSALCLFLLTVLIFASYKRVKRIITRI

SEQ ID NO: 2396532 - protein, 22 aa, Entamoeba dispar
EVIDDWLFDLIEHCWNQNPKER

SEQ ID NO: 2396533 - protein, 29 aa, Entamoeba dispar
EVIHLFTGKPLLHVTLLTSTISAASSFAD

SEQ ID NO: 2396534 - protein, 17 aa, Entamoeba dispar
EVITVSVYVPLLTKKQK

SEQ ID NO: 2396535 - protein, 23 aa, Entamoeba dispar
EVKDPLFLLAVSGGGLVVNIIGM

SEQ ID NO: 2396536 - protein, 26 aa, Entamoeba dispar
EVKDTKIYSVFLKNEASPEKLEENKE

SEQ ID NO: 2396537 - protein, 27 aa, Entamoeba dispar
EVKKLEIDLMMFYDEKIKNVQKQCKDL

SEQ ID NO: 2396538 - protein, 17 aa, Entamoeba dispar
EVKKMYKIFFMYINEEE

SEQ ID NO: 2396539 - protein, 17 aa, Entamoeba dispar
EVLFSPLTEILMYDLKL

SEQ ID NO: 2396540 - protein, 22 aa, Entamoeba dispar
EVLIQFILQKCSYFEVIIPFLL

SEQ ID NO: 2396541 - protein, 20 aa, Entamoeba dispar
EVNLYYYINIIYAIYVFLMV

SEQ ID NO: 2396542 - protein, 25 aa, Entamoeba dispar
EVNPGFLYIITFPFLFGVMFGDIGH

SEQ ID NO: 2396543 - protein, 29 aa, Entamoeba dispar
EVPPSYNIWLLICTAIFGALIIITATSSI

SEQ ID NO: 2396544 - protein, 23 aa, Entamoeba dispar
EVRALIKKNWFYLFGTAGCWFFF

SEQ ID NO: 2396545 - protein, 28 aa, Entamoeba dispar
EVRPSLKWYFMIFFGPNVETMTNSLPKE

SEQ ID NO: 2396546 - protein, 23 aa, Entamoeba dispar
EVSNAYMLFYQQINILEEKENET

SEQ ID NO: 2396547 - protein, 26 aa, Entamoeba dispar
EVVKRVFFFMRQKITLTMFVSEFTRL

SEQ ID NO: 2396548 - protein, 23 aa, Entamoeba dispar
EVVVLKPHFPLLEDIFSSFGVPY

SEQ ID NO: 2396549 - protein, 34 aa, Entamoeba dispar
EVYLSFFIFLMITILFIRLLISIPFTLNIPTLFY

SEQ ID NO: 2396550 - protein, 24 aa, Entamoeba dispar
EWGIWLMIIIMLIVGLIGGSGYVQ

SEQ ID NO: 2396551 - protein, 31 aa, Entamoeba dispar
EWHFWRLLLINIYTLWTVPLLLLASAVIAPE

SEQ ID NO: 2396552 - protein, 24 aa, Entamoeba dispar
EWNFSYRKRFNLFKEEEGVWIAHK

SEQ ID NO: 2396553 - protein, 27 aa, Entamoeba dispar
EYAKYGSLYHLIFKQGMKKLPKEAVRI

SEQ ID NO: 2396554 - protein, 26 aa, Entamoeba dispar
EYCEKHPKFIILLPSKNEAAQEIQQN

SEQ ID NO: 2396555 - protein, 32 aa, Entamoeba dispar
EYCKSLIDTVFFVAPYVLYIDIQMTVKIIADI

SEQ ID NO: 2396556 - protein, 21 aa, Entamoeba dispar
EYCRIHYLEIMLSTQSFKEKN

SEQ ID NO: 2396557 - protein, 20 aa, Entamoeba dispar
EYEALRFLNISMADGFVLTY

SEQ ID NO: 2396558 - protein, 17 aa, Entamoeba dispar
EYEFVQVCSIYLAVVPK

SEQ ID NO: 2396559 - protein, 28 aa, Entamoeba dispar
EYEIYQQLTLIALLNVYCTFKLKRIPRQ

SEQ ID NO: 2396560 - protein, 23 aa, Entamoeba dispar
EYFIVIIVFKYYLLYSIIISLCL

SEQ ID NO: 2396561 - protein, 30 aa, Entamoeba dispar
EYHPRINFVINTYYILPKSIITLTGREITY

SEQ ID NO: 2396562 - protein, 24 aa, Entamoeba dispar
EYHYTFYIDLFLPHMLNGDLNISK

SEQ ID NO: 2396563 - protein, 19 aa, Entamoeba dispar
EYIIQFYGAVFIPNKICMI

SEQ ID NO: 2396564 - protein, 17 aa, Entamoeba dispar
EYILYQGKCIHYSIINH

SEQ ID NO: 2396565 - protein, 25 aa, Entamoeba dispar
EYIPPQELFLQHLFSHPSELTLQQR

SEQ ID NO: 2396566 - protein, 23 aa, Entamoeba dispar
EYIQIILMLLTVMSLITLHLIAF

SEQ ID NO: 2396567 - protein, 18 aa, Entamoeba dispar
EYISLYIHLLMERLVTET

SEQ ID NO: 2396568 - protein, 23 aa, Entamoeba dispar
EYLIRLPKNNLMPELFIVIVRIM

SEQ ID NO: 2396569 - protein, 19 aa, Entamoeba dispar
EYLKKEILLFFIEKVPQIN

SEQ ID NO: 2396570 - protein, 26 aa, Entamoeba dispar
EYLPVKLLKDIIFKCQLRVESPLTLK

SEQ ID NO: 2396571 - protein, 17 aa, Entamoeba dispar
EYNKCIPGKLLVSCLNG

SEQ ID NO: 2396572 - protein, 19 aa, Entamoeba dispar
EYNRWLQLIYQILISIDES

SEQ ID NO: 2396573 - protein, 41 aa, Entamoeba dispar
EYNTLFTSLPILIFSIFDRDIPPYIIFKYPKLYKNKDYISP

SEQ ID NO: 2396574 - protein, 32 aa, Entamoeba dispar
EYNYHSVPSPWLQVRILRTLRYITPKKGAEEN

SEQ ID NO: 2396575 - protein, 28 aa, Entamoeba dispar
EYQGIKIRSLYFKALLRQDPGWFDCHKT

SEQ ID NO: 2396576 - protein, 29 aa, Entamoeba dispar
EYSFVCMYPLFFQVIAHLAIIFLVTTLSI

SEQ ID NO: 2396577 - protein, 19 aa, Entamoeba dispar
EYSIFRKKQQAYLLINMLR

SEQ ID NO: 2396578 - protein, 43 aa, Entamoeba dispar
EYSVHTKFYQYIPEMIIIPFFILCLSIIYLLNDYWKIKEEKEE

SEQ ID NO: 2396579 - protein, 29 aa, Entamoeba dispar
EYTNKLKDFIRLLILRHKHFLFEGTSQFS

SEQ ID NO: 2396580 - protein, 23 aa, Entamoeba dispar
EYVSRLYIGPKIAPLFVNKFEHC

SEQ ID NO: 2396581 - protein, 18 aa, Entamoeba dispar
FAFLFEYIGEKSKDYIYP

SEQ ID NO: 2396582 - protein, 33 aa, Entamoeba dispar
FAGIVIGAISTILFRLLRTWLSKTNNNSKNTER

SEQ ID NO: 2396583 - protein, 19 aa, Entamoeba dispar
FAGVIGLYGLIVCIVLFIN

SEQ ID NO: 2396584 - protein, 19 aa, Entamoeba dispar
FAIRYSNIHFNKFNNYSPL

SEQ ID NO: 2396585 - protein, 26 aa, Entamoeba dispar
FAISFFLFYILIIFDSLRKPVNKMST

SEQ ID NO: 2396586 - protein, 25 aa, Entamoeba dispar
FAKSIYPYIFNGILFFEECPLKDQH

SEQ ID NO: 2396587 - protein, 20 aa, Entamoeba dispar
FALFQRWSDQYLLFESLLNN

SEQ ID NO: 2396588 - protein, 25 aa, Entamoeba dispar
FALLQLLDFIVPFEYTSFCKAPCTL

SEQ ID NO: 2396589 - protein, 27 aa, Entamoeba dispar
FALSCIACWIVFIYQPTFKPKVSTLMQ

SEQ ID NO: 2396590 - protein, 32 aa, Entamoeba dispar
FANKKYFLLLLFYVTLMILFILLVNTPLAIYA

SEQ ID NO: 2396591 - protein, 18 aa, Entamoeba dispar
FAQNFVTLLYYFCKNIKK

SEQ ID NO: 2396592 - protein, 44 aa, Entamoeba dispar
FAQYIKTMIKVIWNVFPIADFWRHVCIVWTKCYCYFPTEVIEEK

SEQ ID NO: 2396593 - protein, 27 aa, Entamoeba dispar
FARIFQTIFLPLIIFNAGFTMKKRNFF

SEQ ID NO: 2396594 - protein, 29 aa, Entamoeba dispar
FARLLSKPELFFFAFPKKPELVVPICIIA

SEQ ID NO: 2396595 - protein, 21 aa, Entamoeba dispar
FASFQIPAFKLYVNKITHACS

SEQ ID NO: 2396596 - protein, 29 aa, Entamoeba dispar
FATEHPFLISLFIKPTIEILFYYATMICD

SEQ ID NO: 2396597 - protein, 30 aa, Entamoeba dispar
FAVTMLQCFTWQDPFPKTQFKFAWDIADLV

SEQ ID NO: 2396598 - protein, 18 aa, Entamoeba dispar
FCERHFVLFSSTVKKLRA

SEQ ID NO: 2396599 - protein, 17 aa, Entamoeba dispar
FCFNYRSLLQTLATFMP

SEQ ID NO: 2396600 - protein, 23 aa, Entamoeba dispar
FCFSVIAIFPFDIVRYIGIGCTI

SEQ ID NO: 2396601 - protein, 29 aa, Entamoeba dispar
FCLIILKRSIIEPLIASALAYISCYVFYS

SEQ ID NO: 2396602 - protein, 32 aa, Entamoeba dispar
FCNKKAPITGYYIPVIIPPNKMLRVSTCNHDT

SEQ ID NO: 2396603 - protein, 18 aa, Entamoeba dispar
FCSLMGLSILMIIPDLIQ

SEQ ID NO: 2396604 - protein, 17 aa, Entamoeba dispar
FCSLTYGGCLCNGVSCE

SEQ ID NO: 2396605 - protein, 26 aa, Entamoeba dispar
FCTMYSSPYFSQVFKVIFHSILNMKW

SEQ ID NO: 2396606 - protein, 24 aa, Entamoeba dispar
FCTSCFTGYFKTPDMLWCESTISL

SEQ ID NO: 2396607 - protein, 19 aa, Entamoeba dispar
FCTTKIMGMKIPYTIYFSK

SEQ ID NO: 2396608 - protein, 26 aa, Entamoeba dispar
FCTVLMVVILLFIFFVRSFGSKRVVL

SEQ ID NO: 2396609 - protein, 30 aa, Entamoeba dispar
FCVITIIPGLILLWKLIVKPKLFKNSPQKY

SEQ ID NO: 2396610 - protein, 24 aa, Entamoeba dispar
FDEKMELLLTLLVEKLQIVFEKFH

SEQ ID NO: 2396611 - protein, 24 aa, Entamoeba dispar
FDEYIKYISIIFDNVFSLFVKVKL

SEQ ID NO: 2396612 - protein, 25 aa, Entamoeba dispar
FDFGVYFYWLVIPVLLKNDGQSPLV

SEQ ID NO: 2396613 - protein, 24 aa, Entamoeba dispar
FDFVAPLVPECQLKKLYQGCLSSS

SEQ ID NO: 2396614 - protein, 28 aa, Entamoeba dispar
FDFYSAQLWKLYFPMNLKLKASGEHDKI

SEQ ID NO: 2396615 - protein, 20 aa, Entamoeba dispar
FDICLELGYFFTLKKSRKMS

SEQ ID NO: 2396616 - protein, 23 aa, Entamoeba dispar
FDIMIVCFCIIIPISLFKNLSAL

SEQ ID NO: 2396617 - protein, 34 aa, Entamoeba dispar
FDINYQLRKLKKVSILLIVLYNILLTLQKKDEQR

SEQ ID NO: 2396618 - protein, 18 aa, Entamoeba dispar
FDLYEFCIKATNLFLVQT

SEQ ID NO: 2396619 - protein, 24 aa, Entamoeba dispar
FDNIMKFVMYLLSANSAEIWTMMI

SEQ ID NO: 2396620 - protein, 33 aa, Entamoeba dispar
FDPQTFLKFYSHYKYVFLLILGDFVGLMNDNEV

SEQ ID NO: 2396621 - protein, 25 aa, Entamoeba dispar
FDQDVLIAYLPLAHIFELCIEFAVI

SEQ ID NO: 2396622 - protein, 27 aa, Entamoeba dispar
FDSYYQLFIKVILITSLLVIITIINYL

SEQ ID NO: 2396623 - protein, 23 aa, Entamoeba dispar
FDTEYPFNILLEKREYVLLLSGL

SEQ ID NO: 2396624 - protein, 22 aa, Entamoeba dispar
FDTIIYFPNEPGKYIRAHSFIL

SEQ ID NO: 2396625 - protein, 29 aa, Entamoeba dispar
FDVIEGLLYFFLYSWALYHLAMTYNKVTI

SEQ ID NO: 2396626 - protein, 17 aa, Entamoeba dispar
FDYTLLLCPLTQSKTKS

SEQ ID NO: 2396627 - protein, 20 aa, Entamoeba dispar
FEALQQGILLAILSSYGYSF

SEQ ID NO: 2396628 - protein, 17 aa, Entamoeba dispar
FEAPLAFMSMSLLHFMH

SEQ ID NO: 2396629 - protein, 24 aa, Entamoeba dispar
FEDYKFRYRRGLPLVLNGINALIE

SEQ ID NO: 2396630 - protein, 19 aa, Entamoeba dispar
FEFGLTLSKTPMFCQYLYK

SEQ ID NO: 2396631 - protein, 20 aa, Entamoeba dispar
FEFPYECIPQFYSCYSLFTP

SEQ ID NO: 2396632 - protein, 29 aa, Entamoeba dispar
FEHGKIPWYGLMVASVVIPYYIKKNKYKE

SEQ ID NO: 2396633 - protein, 25 aa, Entamoeba dispar
FEHLLTSISFIQPFTAQFLLSHYSL

SEQ ID NO: 2396634 - protein, 27 aa, Entamoeba dispar
FEHSGHIYLLKQLPKYSTLQLLHEILK

SEQ ID NO: 2396635 - protein, 19 aa, Entamoeba dispar
FEIPIFYNDSIGGRDTNFV

SEQ ID NO: 2396636 - protein, 32 aa, Entamoeba dispar
  misc_feature (29)..(30): Xaa can be any naturally occurring amino acid
FEIRVVIKSFLFYLIFLFHLIVSVSFLFXXSS

SEQ ID NO: 2396637 - protein, 25 aa, Entamoeba dispar
FEISLRVFDFILMDGFCALMSVART

SEQ ID NO: 2396638 - protein, 27 aa, Entamoeba dispar
FEKNKKIFVINILYDLCLEMGYFFDAR

SEQ ID NO: 2396639 - protein, 27 aa, Entamoeba dispar
FEKNKRIFVINLLYDLCLEKGYFFDAR

SEQ ID NO: 2396640 - protein, 18 aa, Entamoeba dispar
FELCWKFVFIFYSCIIVG

SEQ ID NO: 2396641 - protein, 22 aa, Entamoeba dispar
FELIRNFGIAFSSFKSPHAQFT

SEQ ID NO: 2396642 - protein, 20 aa, Entamoeba dispar
FEMLIFPICVIGVTIFFKCC

SEQ ID NO: 2396643 - protein, 19 aa, Entamoeba dispar
FEMPLFEIGIVAFPLAIAG

SEQ ID NO: 2396644 - protein, 18 aa, Entamoeba dispar
FEMVIALCMYFFTKDDFI

SEQ ID NO: 2396645 - protein, 28 aa, Entamoeba dispar
FENAVKINLWLIPLTISIEPILQYLPNI

SEQ ID NO: 2396646 - protein, 25 aa, Entamoeba dispar
FENKFPPILYYEQATTLLFQLQGHI

SEQ ID NO: 2396647 - protein, 21 aa, Entamoeba dispar
FENVKFIFYNGNSPTRITGGV

SEQ ID NO: 2396648 - protein, 18 aa, Entamoeba dispar
FEPKYCQLIFVIDGRRDR

SEQ ID NO: 2396649 - protein, 23 aa, Entamoeba dispar
FEPQVLLLRPRGFKTITCFMTLF

SEQ ID NO: 2396650 - protein, 28 aa, Entamoeba dispar
FEQKKILLFFIFLQVLSNILYLIAKENE

SEQ ID NO: 2396651 - protein, 17 aa, Entamoeba dispar
FERIFNNSIPKHENNEM

SEQ ID NO: 2396652 - protein, 18 aa, Entamoeba dispar
FERKISLFSLSVCSVLMV

SEQ ID NO: 2396653 - protein, 24 aa, Entamoeba dispar
FESDIVFLVLLLFALGSSLTITIT

SEQ ID NO: 2396654 - protein, 23 aa, Entamoeba dispar
FETLLLMISLFMIVILLPRDGVF

SEQ ID NO: 2396655 - protein, 19 aa, Entamoeba dispar
FETYVYKDILLSPPAIKGK

SEQ ID NO: 2396656 - protein, 28 aa, Entamoeba dispar
FEYHNFDTLLCVLLLFNTSAIHRLKRSF

SEQ ID NO: 2396657 - protein, 18 aa, Entamoeba dispar
FEYPWVIATFVASGHRRP

SEQ ID NO: 2396658 - protein, 17 aa, Entamoeba dispar
FEYQINPVLILSELIFD

SEQ ID NO: 2396659 - protein, 18 aa, Entamoeba dispar
FFAKLPLYQKGTIVQGGE

SEQ ID NO: 2396660 - protein, 25 aa, Entamoeba dispar
FFCCGCSFLFIFFFDRVVATHGGHA

SEQ ID NO: 2396661 - protein, 17 aa, Entamoeba dispar
FFCKQSILTNMPCSLWE

SEQ ID NO: 2396662 - protein, 18 aa, Entamoeba dispar
FFCRCVFNLLFNGIAVTR

SEQ ID NO: 2396663 - protein, 21 aa, Entamoeba dispar
FFDITPLGRLLNYFSRDLRFV

SEQ ID NO: 2396664 - protein, 18 aa, Entamoeba dispar
FFFAVSLCLFLTNAFKLF

SEQ ID NO: 2396665 - protein, 26 aa, Entamoeba dispar
FFFDLHIVCFFIPLGIYFMLKNITDE

SEQ ID NO: 2396666 - protein, 25 aa, Entamoeba dispar
FFFHYFFFFLLYFSISSIFLSISFI

SEQ ID NO: 2396667 - protein, 17 aa, Entamoeba dispar
FFFLFFIVSFCFCFAPF

SEQ ID NO: 2396668 - protein, 18 aa, Entamoeba dispar
FFGLCLCMILIIGGVQSF

SEQ ID NO: 2396669 - protein, 19 aa, Entamoeba dispar
FFIIFDILHICQSSLMINQ

SEQ ID NO: 2396670 - protein, 19 aa, Entamoeba dispar
FFIIFSFAHETKPILLVLQ

SEQ ID NO: 2396671 - protein, 31 aa, Entamoeba dispar
FFIQKDNIIGFWLWAYYLSYLRYAFELVMLN

SEQ ID NO: 2396672 - protein, 21 aa, Entamoeba dispar
FFIVDKWYKNIISHKVFIICS

SEQ ID NO: 2396673 - protein, 30 aa, Entamoeba dispar
FFIVYLKPKLWVCLLIIVYVFIVAISRIYM

SEQ ID NO: 2396674 - protein, 17 aa, Entamoeba dispar
FFKQFFRTDPNGASMFL

SEQ ID NO: 2396675 - protein, 23 aa, Entamoeba dispar
FFKWNWEFELWYLNDDGTNDKLS

SEQ ID NO: 2396676 - protein, 18 aa, Entamoeba dispar
FFLQGTIFLIRSFSKILQ

SEQ ID NO: 2396677 - protein, 17 aa, Entamoeba dispar
FFNLLKFKSLIFSLLTL

SEQ ID NO: 2396678 - protein, 17 aa, Entamoeba dispar
FFRQFIPFYSNISENIL

SEQ ID NO: 2396679 - protein, 17 aa, Entamoeba dispar
FFSDSFTILRWCFEYHK

SEQ ID NO: 2396680 - protein, 21 aa, Entamoeba dispar
FFSIFFFFLLFLCSLFLMSFL

SEQ ID NO: 2396681 - protein, 18 aa, Entamoeba dispar
FFTYFFLASFNGATRENM

SEQ ID NO: 2396682 - protein, 18 aa, Entamoeba dispar
FFVGMILEGFPGYHMEIP

SEQ ID NO: 2396683 - protein, 33 aa, Entamoeba dispar
FFVIALFFLIFYWAGLFFVICFWIMFVVDIIVL

SEQ ID NO: 2396684 - protein, 30 aa, Entamoeba dispar
FFVIALIMCFFMTFLFSITVSRLVLLIPFV

SEQ ID NO: 2396685 - protein, 29 aa, Entamoeba dispar
FFVPIISIIFPLYSILHRSLTTKPSTILE

SEQ ID NO: 2396686 - protein, 29 aa, Entamoeba dispar
FFVSMDFVPIMWIFYIVGSYFAVPLCNNF

SEQ ID NO: 2396687 - protein, 18 aa, Entamoeba dispar
FFVVCFWIMFVVAILVII

SEQ ID NO: 2396688 - protein, 19 aa, Entamoeba dispar
FFYQWVMAIGVLLAGIFTL

SEQ ID NO: 2396689 - protein, 19 aa, Entamoeba dispar
FGCLKCVEGYYAKNGDCVE

SEQ ID NO: 2396690 - protein, 18 aa, Entamoeba dispar
FGCSYLCGGYILMMSLFI

SEQ ID NO: 2396691 - protein, 31 aa, Entamoeba dispar
FGDCWIVPIYIGHCIDLTFFWDSYKSARQAL

SEQ ID NO: 2396692 - protein, 43 aa, Entamoeba dispar
FGDWVMTNYIFIAVIPVWILFFILLFGYYILKVIVIRQAEEVH

SEQ ID NO: 2396693 - protein, 30 aa, Entamoeba dispar
FGELKHCLFFVISFKILFVHIHFIVKRKSQ

SEQ ID NO: 2396694 - protein, 43 aa, Entamoeba dispar
FGFGIGLYFSWKLSLCILAVFPIISFFMFINGQLNSKNAAPAK

SEQ ID NO: 2396695 - protein, 28 aa, Entamoeba dispar
FGFPYQYSFIVLLIFQAICIAAMILCTV

SEQ ID NO: 2396696 - protein, 19 aa, Entamoeba dispar
FGFVPHPMYFGGALLFISS

SEQ ID NO: 2396697 - protein, 26 aa, Entamoeba dispar
FGGFIEAPITFLPTYKFEKGTNNYDW

SEQ ID NO: 2396698 - protein, 19 aa, Entamoeba dispar
FGGIVDRYYYDCALFMVHS

SEQ ID NO: 2396699 - protein, 20 aa, Entamoeba dispar
FGIFMFICSLVDFLNSFSVC

SEQ ID NO: 2396700 - protein, 26 aa, Entamoeba dispar
FGIGFGFSIFFIFCSYALGNWYGSIV

SEQ ID NO: 2396701 - protein, 26 aa, Entamoeba dispar
FGIGFGFSMFFIFCSYALGSWYGSIV

SEQ ID NO: 2396702 - protein, 19 aa, Entamoeba dispar
FGILFKYINPLKTRWYVVL

SEQ ID NO: 2396703 - protein, 25 aa, Entamoeba dispar
FGIVMWEILTRKRPYSKLTPYQIML

SEQ ID NO: 2396704 - protein, 18 aa, Entamoeba dispar
FGKKYMRLKCPHAQFTEA

SEQ ID NO: 2396705 - protein, 31 aa, Entamoeba dispar
FGLCMSVVGYYYFWWLDAVGGIVLSFYIMIN

SEQ ID NO: 2396706 - protein, 18 aa, Entamoeba dispar
FGLMKFLSKVEEIKHQLM

SEQ ID NO: 2396707 - protein, 31 aa, Entamoeba dispar
FGMCMSIIGYYYFWWLDAVGGIILSFYIMLN

SEQ ID NO: 2396708 - protein, 24 aa, Entamoeba dispar
FGMVMAFVVLRRPLQTIVGRSIEI

SEQ ID NO: 2396709 - protein, 33 aa, Entamoeba dispar
FGPIPVTIYFAVILTIMSIVLPFTYHYQYIIWG

SEQ ID NO: 2396710 - protein, 20 aa, Entamoeba dispar
FGQNVWQYLKNQYGFENITD

SEQ ID NO: 2396711 - protein, 21 aa, Entamoeba dispar
FGRLFQTFSSFLTGYLVGFIK

SEQ ID NO: 2396712 - protein, 21 aa, Entamoeba dispar
FGRSWLSPRKLLQSSKSNTLC

SEQ ID NO: 2396713 - protein, 33 aa, Entamoeba dispar
FGSCLIRFFGLYLATLLLFWGFTIKYCNNISFY

SEQ ID NO: 2396714 - protein, 19 aa, Entamoeba dispar
FGSNWIVVKKFPAGDGFFL

SEQ ID NO: 2396715 - protein, 28 aa, Entamoeba dispar
FGSQNSFLRMYFPTVLNWMIGGVVGQNK

SEQ ID NO: 2396716 - protein, 22 aa, Entamoeba dispar
FGVCVYAFGYIPFQYVKQSKAL

SEQ ID NO: 2396717 - protein, 17 aa, Entamoeba dispar
FHCKNIVSIDFLSCLCN

SEQ ID NO: 2396718 - protein, 18 aa, Entamoeba dispar
FHISALHLVLTVACLVSF

SEQ ID NO: 2396719 - protein, 35 aa, Entamoeba dispar
FHKMGGWFKVCIAVLISVLVLTVGVIIFGSFRESR

SEQ ID NO: 2396720 - protein, 17 aa, Entamoeba dispar
FHKQCIYGWFRSTGRHD

SEQ ID NO: 2396721 - protein, 18 aa, Entamoeba dispar
FHMTFGVILSFFNHLHEK

SEQ ID NO: 2396722 - protein, 28 aa, Entamoeba dispar
FHNYRYFFLFLFYLWISMLIVDCHVYLL

SEQ ID NO: 2396723 - protein, 24 aa, Entamoeba dispar
FHTNQFINIHIFKSTIQPERSDPS

SEQ ID NO: 2396724 - protein, 35 aa, Entamoeba dispar
FHTTLCSKTFLIWVTKDRPYLYLYQEKNDTAKKEI

SEQ ID NO: 2396725 - protein, 19 aa, Entamoeba dispar
FHTVLMNEIVFSKILCSDV

SEQ ID NO: 2396726 - protein, 19 aa, Entamoeba dispar
FHTYNEFIFRKKSTVDWIG

SEQ ID NO: 2396727 - protein, 17 aa, Entamoeba dispar
FHVSLILYCFFKILFHS

SEQ ID NO: 2396728 - protein, 21 aa, Entamoeba dispar
FHVTTPCKSLYFDDPDKPGTK

SEQ ID NO: 2396729 - protein, 17 aa, Entamoeba dispar
FHYTIPKSTTTQNYLNV

SEQ ID NO: 2396730 - protein, 17 aa, Entamoeba dispar
FIAATLAKDSLVITSAK

SEQ ID NO: 2396731 - protein, 23 aa, Entamoeba dispar
FIADVMITFYLYCGWMDQLTEKL

SEQ ID NO: 2396732 - protein, 18 aa, Entamoeba dispar
FIALINASLCSNGQWFDG

SEQ ID NO: 2396733 - protein, 26 aa, Entamoeba dispar
FIARAFYQSFGLPLIITRGNNVFGPH

SEQ ID NO: 2396734 - protein, 30 aa, Entamoeba dispar
FIARSFYQSFGLPLIITRGNNVFGPHQFPE

SEQ ID NO: 2396735 - protein, 28 aa, Entamoeba dispar
FIATFCFCFMLSFWFSIVYLFCVSLGTY

SEQ ID NO: 2396736 - protein, 19 aa, Entamoeba dispar
FIAVALAKDSLVIGLDKDK

SEQ ID NO: 2396737 - protein, 17 aa, Entamoeba dispar
FICCALSESFIMNLESD

SEQ ID NO: 2396738 - protein, 24 aa, Entamoeba dispar
FICFLMFYVLSMFEALRKPLNVRK

SEQ ID NO: 2396739 - protein, 36 aa, Entamoeba dispar
FICPQLLTFILFLFLAFIHFHFIPYHNLIPVSLTLP

SEQ ID NO: 2396740 - protein, 17 aa, Entamoeba dispar
FIDFWGLFICCVVIAIA

SEQ ID NO: 2396741 - protein, 24 aa, Entamoeba dispar
FIDQQFLSLMKLYYPSMIDVRGDI

SEQ ID NO: 2396742 - protein, 27 aa, Entamoeba dispar
FIDRPELWRMIPVITPLLIAGIIVLTR

SEQ ID NO: 2396743 - protein, 28 aa, Entamoeba dispar
FIELGKKILIPLQLRTKLLGQMRLLNKE

SEQ ID NO: 2396744 - protein, 17 aa, Entamoeba dispar
FIENIIGIIIKLASTKD

SEQ ID NO: 2396745 - protein, 28 aa, Entamoeba dispar
FIESCALVQIFWSLCLLLDRHFKNVLFN

SEQ ID NO: 2396746 - protein, 19 aa, Entamoeba dispar
FIETLPELSPYDPPLLSSY

SEQ ID NO: 2396747 - protein, 17 aa, Entamoeba dispar
FIFIFHFTLFFPKTLFI

SEQ ID NO: 2396748 - protein, 18 aa, Entamoeba dispar
FIFILLMFSFLFLLYLSL

SEQ ID NO: 2396749 - protein, 26 aa, Entamoeba dispar
FIFLTTNTCMCHYGYFPMLLNGTIKC

SEQ ID NO: 2396750 - protein, 25 aa, Entamoeba dispar
FIFTRYEIFGILACSFFGIERSKIY

SEQ ID NO: 2396751 - protein, 35 aa, Entamoeba dispar
FIGAICLALIYLRNGWVLCVLAIPIGIISGYDLQS

SEQ ID NO: 2396752 - protein, 17 aa, Entamoeba dispar
FIGFPLLVLSQTCSGTG

SEQ ID NO: 2396753 - protein, 17 aa, Entamoeba dispar
FIGFYCLFSNAITCTLK

SEQ ID NO: 2396754 - protein, 28 aa, Entamoeba dispar
FIGILFKPFTFLLLLMQAIPIIIYKVCT

SEQ ID NO: 2396755 - protein, 20 aa, Entamoeba dispar
FIGLIFLGAFIPFYEFKLFG

SEQ ID NO: 2396756 - protein, 18 aa, Entamoeba dispar
FIHDGYHFHLFESNEFLK

SEQ ID NO: 2396757 - protein, 24 aa, Entamoeba dispar
FIIALFFPLFIKNKMWALYISMII

SEQ ID NO: 2396758 - protein, 25 aa, Entamoeba dispar
FIILSIFIRIFLLSALYFFFPLFTY

SEQ ID NO: 2396759 - protein, 18 aa, Entamoeba dispar
FIIPSSSCYGIVLVGGSL

SEQ ID NO: 2396760 - protein, 18 aa, Entamoeba dispar
FIIRSLLFKFGRIYVPDK

SEQ ID NO: 2396761 - protein, 17 aa, Entamoeba dispar
FIISLPPSSLRLDAEWL

SEQ ID NO: 2396762 - protein, 27 aa, Entamoeba dispar
FIIVICTILFFLRKKPLPKEKFGCWVG

SEQ ID NO: 2396763 - protein, 20 aa, Entamoeba dispar
FIIYSFIISYNLIKLLTQTF

SEQ ID NO: 2396764 - protein, 18 aa, Entamoeba dispar
FIKYIYLNGYYSLEEDKI

SEQ ID NO: 2396765 - protein, 18 aa, Entamoeba dispar
FILKLFEFKNIDIIKILL

SEQ ID NO: 2396766 - protein, 21 aa, Entamoeba dispar
FILLALIIAFFFIIPTELSTL

SEQ ID NO: 2396767 - protein, 25 aa, Entamoeba dispar
FILLFYFILFLYISYLFLSFYLFLF

SEQ ID NO: 2396768 - protein, 18 aa, Entamoeba dispar
FIMKSLSNYWNANTFKIL

SEQ ID NO: 2396769 - protein, 25 aa, Entamoeba dispar
FINEFIKWRILSWKSHEWRNIIYIM

SEQ ID NO: 2396770 - protein, 26 aa, Entamoeba dispar
FINEFIKWRILSWKSNEWRNIIYIMC

SEQ ID NO: 2396771 - protein, 17 aa, Entamoeba dispar
FINFLRQLSMLLLSEVN

SEQ ID NO: 2396772 - protein, 24 aa, Entamoeba dispar
FINIICWSIFFINTSSFNCQRSTT

SEQ ID NO: 2396773 - protein, 17 aa, Entamoeba dispar
FINPLEGALFRTFDENL

SEQ ID NO: 2396774 - protein, 32 aa, Entamoeba dispar
FIQKLYEPYFKIYFFLISGILCCLNYWTLFGG

SEQ ID NO: 2396775 - protein, 17 aa, Entamoeba dispar
FIQNMLLYIILQNTQAA

SEQ ID NO: 2396776 - protein, 25 aa, Entamoeba dispar
FIQSFLLFMTYPFYLPLLSIFQHLT

SEQ ID NO: 2396777 - protein, 17 aa, Entamoeba dispar
FIRDLHQFVYFYEINVP

SEQ ID NO: 2396778 - protein, 37 aa, Entamoeba dispar
FISDKMFVQPPPAQYIKRFFQFIRKIIRTYGDYLFKE

SEQ ID NO: 2396779 - protein, 17 aa, Entamoeba dispar
FISFCNGEYCQKVEGND

SEQ ID NO: 2396780 - protein, 19 aa, Entamoeba dispar
FISFVFSKDLVVTLIEDDD

SEQ ID NO: 2396781 - protein, 19 aa, Entamoeba dispar
FISIGSLLGLVMCLCFMMI

SEQ ID NO: 2396782 - protein, 22 aa, Entamoeba dispar
FISLEFFTSLLLIKQNQKLFNS

SEQ ID NO: 2396783 - protein, 18 aa, Entamoeba dispar
FISPLRNLLMAKESIKLL

SEQ ID NO: 2396784 - protein, 27 aa, Entamoeba dispar
FISVAMSEYFIMTFDSAIYGMPTALTA

SEQ ID NO: 2396785 - protein, 25 aa, Entamoeba dispar
FISVVMSEYFIVSPLNKGNESVGIH

SEQ ID NO: 2396786 - protein, 17 aa, Entamoeba dispar
FISVVMSKSLVVDLVKG

SEQ ID NO: 2396787 - protein, 18 aa, Entamoeba dispar
FITSITFLLPNANGWVAE

SEQ ID NO: 2396788 - protein, 20 aa, Entamoeba dispar
FIVLSMTLLAVFATKFTVLG

SEQ ID NO: 2396789 - protein, 17 aa, Entamoeba dispar
FIVQTFKNNIYPTYLCY

SEQ ID NO: 2396790 - protein, 23 aa, Entamoeba dispar
FIVSVIIIYFFSSPFTLERLQDT

SEQ ID NO: 2396791 - protein, 19 aa, Entamoeba dispar
FIVVMLLMFDPIVAIMIVL

SEQ ID NO: 2396792 - protein, 17 aa, Entamoeba dispar
FIYEFLSKRIGSLSSQT

SEQ ID NO: 2396793 - protein, 17 aa, Entamoeba dispar
FIYFVCVVWGIKTYSLP

SEQ ID NO: 2396794 - protein, 26 aa, Entamoeba dispar
FIYFYYLFLFYFLVLVLFLLLFLLLF

SEQ ID NO: 2396795 - protein, 26 aa, Entamoeba dispar
FKAGPTWLMILLSSPSILFCLFTVFY

SEQ ID NO: 2396796 - protein, 19 aa, Entamoeba dispar
FKCSFILLKFSLFAIPFTL

SEQ ID NO: 2396797 - protein, 18 aa, Entamoeba dispar
FKCSYIIQFLGAVINKNN

SEQ ID NO: 2396798 - protein, 33 aa, Entamoeba dispar
FKDSTWNVIRKVVMLVLSCVLLIASCFFAFIES

SEQ ID NO: 2396799 - protein, 20 aa, Entamoeba dispar
FKEDLVRIWKCLWKFIDMSV

SEQ ID NO: 2396800 - protein, 17 aa, Entamoeba dispar
FKFFSMTINQRAKMRDG

SEQ ID NO: 2396801 - protein, 24 aa, Entamoeba dispar
FKFVGWVLLEKWYCILFVLCFIAF

SEQ ID NO: 2396802 - protein, 29 aa, Entamoeba dispar
FKGTLIHVVALYLFMLGLLGGLTGTTMDI

SEQ ID NO: 2396803 - protein, 20 aa, Entamoeba dispar
FKGYNILINGSLFCEILQVD

SEQ ID NO: 2396804 - protein, 18 aa, Entamoeba dispar
FKIFPCLKPKDVRKIPLP

SEQ ID NO: 2396805 - protein, 22 aa, Entamoeba dispar
FKKQNLLLLLLSNHYLNTPLTI

SEQ ID NO: 2396806 - protein, 19 aa, Entamoeba dispar
FKLLNIKIQLSFYITSLLG

SEQ ID NO: 2396807 - protein, 24 aa, Entamoeba dispar
FKLLSQYPIYPWVISTFSEDFRLN

SEQ ID NO: 2396808 - protein, 24 aa, Entamoeba dispar
FKNHKFFILFLSYAGLTCCIVTVF

SEQ ID NO: 2396809 - protein, 23 aa, Entamoeba dispar
FKQILYCVFPCLIPPFISNKRIE

SEQ ID NO: 2396810 - protein, 27 aa, Entamoeba dispar
FKQLPACIHIIGIFPLFAILEKEEYSG

SEQ ID NO: 2396811 - protein, 31 aa, Entamoeba dispar
FKQTYFCFHLIALILFIWLTVAPPKIPKEEK

SEQ ID NO: 2396812 - protein, 29 aa, Entamoeba dispar
FKRFRNKYYPFWLIIFPEGTRAKPEKIVE

SEQ ID NO: 2396813 - protein, 18 aa, Entamoeba dispar
FKRKWFETNKLKWYKYNQ

SEQ ID NO: 2396814 - protein, 26 aa, Entamoeba dispar
FKSEKHLILLLTNYPTVVAALISILI

SEQ ID NO: 2396815 - protein, 28 aa, Entamoeba dispar
FKSISSSTLPFIISNTIKFTSINIPTIT

SEQ ID NO: 2396816 - protein, 19 aa, Entamoeba dispar
FKSYLNQCNFIISSSLMNE

SEQ ID NO: 2396817 - protein, 24 aa, Entamoeba dispar
FKTNKMTFFYSCLNQICVCLIGLI

SEQ ID NO: 2396818 - protein, 27 aa, Entamoeba dispar
FKWANRLLPIILYLSILTLTIFVIHFV

SEQ ID NO: 2396819 - protein, 26 aa, Entamoeba dispar
FKYNETILHLLPPPPKPLRQYTTLEL

SEQ ID NO: 2396820 - protein, 18 aa, Entamoeba dispar
FKYQCIFQLEANVLKSFD

SEQ ID NO: 2396821 - protein, 26 aa, Entamoeba dispar
FLCVSGLIHVLLYLNTEWSLSFNVKI

SEQ ID NO: 2396822 - protein, 17 aa, Entamoeba dispar
FLDLFKRYGVHVTFFII

SEQ ID NO: 2396823 - protein, 21 aa, Entamoeba dispar
FLEEFQNILLPILKASLTTNG

SEQ ID NO: 2396824 - protein, 18 aa, Entamoeba dispar
FLEFLTNPTHQFYPFAML

SEQ ID NO: 2396825 - protein, 19 aa, Entamoeba dispar
FLEIAIIYTLMLFSGTIKN

SEQ ID NO: 2396826 - protein, 17 aa, Entamoeba dispar
FLEWVRGTKYISNFALY

SEQ ID NO: 2396827 - protein, 20 aa, Entamoeba dispar
FLFALVMIIFQKKIELTKRN

SEQ ID NO: 2396828 - protein, 17 aa, Entamoeba dispar
FLFCFCFYSLMCISYYK

SEQ ID NO: 2396829 - protein, 26 aa, Entamoeba dispar
FLFIGIYVLFFGLFMGLTHFIHICTR

SEQ ID NO: 2396830 - protein, 18 aa, Entamoeba dispar
FLFLFSYQITSLPIFDEI

SEQ ID NO: 2396831 - protein, 21 aa, Entamoeba dispar
FLFVSSYAQFKVYIFNVGQAD

SEQ ID NO: 2396832 - protein, 18 aa, Entamoeba dispar
FLFYCYSEKIDLKKNKLD

SEQ ID NO: 2396833 - protein, 17 aa, Entamoeba dispar
FLFYLLFLCSISTSFII

SEQ ID NO: 2396834 - protein, 18 aa, Entamoeba dispar
FLGEILRSIKFIKYNAWE

SEQ ID NO: 2396835 - protein, 17 aa, Entamoeba dispar
FLGRNYMFLFLDDSTHI

SEQ ID NO: 2396836 - protein, 18 aa, Entamoeba dispar
FLGYLMQLGIFGTSAVVT

SEQ ID NO: 2396837 - protein, 18 aa, Entamoeba dispar
FLHLVLMVNFYQTIMYIH

SEQ ID NO: 2396838 - protein, 25 aa, Entamoeba dispar
FLHTLRLHWIEFQNKFYIGDGIPFI

SEQ ID NO: 2396839 - protein, 28 aa, Entamoeba dispar
FLIAGVFYYHFWLLCILFCIARTSFELV

SEQ ID NO: 2396840 - protein, 18 aa, Entamoeba dispar
FLKVIQKPTLRKSVLTIC

SEQ ID NO: 2396841 - protein, 25 aa, Entamoeba dispar
FLLCGISMIFFILHLHEIFKTFIDV

SEQ ID NO: 2396842 - protein, 26 aa, Entamoeba dispar
FLLCGISMIFFILHLHEIFKTFIDVE

SEQ ID NO: 2396843 - protein, 33 aa, Entamoeba dispar
FLLEFFYLDALFLCLFWFLIEVTFDIDANGILN

SEQ ID NO: 2396844 - protein, 20 aa, Entamoeba dispar
FLLFNYIQLILCPASLFISI

SEQ ID NO: 2396845 - protein, 18 aa, Entamoeba dispar
FLLILAFNQVFAVINATI

SEQ ID NO: 2396846 - protein, 18 aa, Entamoeba dispar
FLLIPSAILIIMGSLIYG

SEQ ID NO: 2396847 - protein, 37 aa, Entamoeba dispar
FLLIVDNILPFYFFQQYGIVQFIWNTFDKLVLFFNNE

SEQ ID NO: 2396848 - protein, 20 aa, Entamoeba dispar
FLLSIKILIILLKNTSTSED

SEQ ID NO: 2396849 - protein, 20 aa, Entamoeba dispar
FLLTYSFWMYRRCGDLSSFI

SEQ ID NO: 2396850 - protein, 27 aa, Entamoeba dispar
FLNASTNPILLIPPLPELKSLCLNNCP

SEQ ID NO: 2396851 - protein, 17 aa, Entamoeba dispar
FLNKCSFELYLNKLYEL

SEQ ID NO: 2396852 - protein, 17 aa, Entamoeba dispar
FLPLFEHGHLIQNDVYK

SEQ ID NO: 2396853 - protein, 21 aa, Entamoeba dispar
FLPQIFCLIAIGFRYCKKDII

SEQ ID NO: 2396854 - protein, 21 aa, Entamoeba dispar
FLPYLFAYPCSEITFQKSFTF

SEQ ID NO: 2396855 - protein, 27 aa, Entamoeba dispar
FLQLFMALYRIIMFSILLITITIQLFY

SEQ ID NO: 2396856 - protein, 19 aa, Entamoeba dispar
FLQVPFKFQSLLNSFFLII

SEQ ID NO: 2396857 - protein, 28 aa, Entamoeba dispar
FLSALLLELIIIFITRIFYRDTDFYNRV

SEQ ID NO: 2396858 - protein, 19 aa, Entamoeba dispar
FLSEEFLMAGLLSQPIMQL

SEQ ID NO: 2396859 - protein, 17 aa, Entamoeba dispar
FLSIKKLEPFACELLAL

SEQ ID NO: 2396860 - protein, 20 aa, Entamoeba dispar
FLSIRNLILRHIFDIRWWPN

SEQ ID NO: 2396861 - protein, 19 aa, Entamoeba dispar
FLSKILFCSLMGLSILMII

SEQ ID NO: 2396862 - protein, 19 aa, Entamoeba dispar
FLSLLYWRNYPPSIIGMMI

SEQ ID NO: 2396863 - protein, 19 aa, Entamoeba dispar
FLTALFLEFLTNPTHQFYP

SEQ ID NO: 2396864 - protein, 20 aa, Entamoeba dispar
FLTCFTLLDNQIDYLKSLYI

SEQ ID NO: 2396865 - protein, 27 aa, Entamoeba dispar
FLTFTFVLAFILWPYGGFWIVSGDLFG

SEQ ID NO: 2396866 - protein, 18 aa, Entamoeba dispar
FLTLSEYLCPTDGSILTF

SEQ ID NO: 2396867 - protein, 24 aa, Entamoeba dispar
FLTTYKHFVFKTITIKTFLHQLIS

SEQ ID NO: 2396868 - protein, 18 aa, Entamoeba dispar
FLTVFDFIAYRMGLVQQY

SEQ ID NO: 2396869 - protein, 19 aa, Entamoeba dispar
FLTVMYFQGFKVDIPLSSK

SEQ ID NO: 2396870 - protein, 19 aa, Entamoeba dispar
FLVFLMIVGVIQNIYGFFD

SEQ ID NO: 2396871 - protein, 18 aa, Entamoeba dispar
FLVKWGWIVTISLVVVFG

SEQ ID NO: 2396872 - protein, 17 aa, Entamoeba dispar
FLVLLARVGVRVFELIL

SEQ ID NO: 2396873 - protein, 18 aa, Entamoeba dispar
FLVPAVMTVLDPISLVNC

SEQ ID NO: 2396874 - protein, 30 aa, Entamoeba dispar
FLVSLPFLPWKYIFYFLRYLVNSLDEISLI

SEQ ID NO: 2396875 - protein, 17 aa, Entamoeba dispar
FLYSLRNTKIKKIHFLG

SEQ ID NO: 2396876 - protein, 18 aa, Entamoeba dispar
FMMSGEFLTYRVRKLSFY

SEQ ID NO: 2396877 - protein, 34 aa, Entamoeba dispar
FMQILTSFCFQLSIKWIFVLSLRLRNGLISMIYE

SEQ ID NO: 2396878 - protein, 19 aa, Entamoeba dispar
FMQSYLLVQSLFKKVSKNS

SEQ ID NO: 2396879 - protein, 24 aa, Entamoeba dispar
FMTFRMLCSIAFLSLLIETISFGI

SEQ ID NO: 2396880 - protein, 23 aa, Entamoeba dispar
FNFANYFYWLVVPLIMNDKGGST

SEQ ID NO: 2396881 - protein, 23 aa, Entamoeba dispar
FNHVWKEFLETYFVPYKVEGLLQ

SEQ ID NO: 2396882 - protein, 24 aa, Entamoeba dispar
FNIIISVLVLFFVGVAIVIGVSYL

SEQ ID NO: 2396883 - protein, 17 aa, Entamoeba dispar
FNILQPFIRNLINQRTH

SEQ ID NO: 2396884 - protein, 17 aa, Entamoeba dispar
FNKFIVNALYLSSNVDF

SEQ ID NO: 2396885 - protein, 18 aa, Entamoeba dispar
FNKGLILFLQYYIHQHHD

SEQ ID NO: 2396886 - protein, 26 aa, Entamoeba dispar
FNKKVFLFTIIFPCIGYYGIFHLNNS

SEQ ID NO: 2396887 - protein, 27 aa, Entamoeba dispar
FNLGVLLVFFFFGIHFFFLSGHAFQFS

SEQ ID NO: 2396888 - protein, 19 aa, Entamoeba dispar
FNLIRNNDIERITLIGSSG

SEQ ID NO: 2396889 - protein, 23 aa, Entamoeba dispar
FNNAHIIIYPINNMYRIQVYYKA

SEQ ID NO: 2396890 - protein, 21 aa, Entamoeba dispar
FNPFNWKWVTSYGYPLKITLT

SEQ ID NO: 2396891 - protein, 25 aa, Entamoeba dispar
FNPLKYKMIIFGIILFILISVLYRF

SEQ ID NO: 2396892 - protein, 26 aa, Entamoeba dispar
FNQKDLTTLLIFKYNKQKLTVQVSLQ

SEQ ID NO: 2396893 - protein, 19 aa, Entamoeba dispar
FNQPWMIPQFVIEGNRLEK

SEQ ID NO: 2396894 - protein, 27 aa, Entamoeba dispar
FNQWKIRMIHIFGPISFLIFSCLFSSI

SEQ ID NO: 2396895 - protein, 27 aa, Entamoeba dispar
FNRERFIAYLPLAHIFEIGIEFALLMD

SEQ ID NO: 2396896 - protein, 31 aa, Entamoeba dispar
FNRFVAIALIFDFIIILASTICYFTYSYIYR

SEQ ID NO: 2396897 - protein, 21 aa, Entamoeba dispar
FNSFQFDYLILSLNDLVKQNL

SEQ ID NO: 2396898 - protein, 18 aa, Entamoeba dispar
FNSILLTVLLKPFQRYRY

SEQ ID NO: 2396899 - protein, 26 aa, Entamoeba dispar
FNSIMLFFIPLITAIYHKFLSHLYFP

SEQ ID NO: 2396900 - protein, 24 aa, Entamoeba dispar
FNSKIPFRFIPFFKILSISIQTIP

SEQ ID NO: 2396901 - protein, 23 aa, Entamoeba dispar
FNSSYAFIFFFKAGIYNTLVMDS

SEQ ID NO: 2396902 - protein, 18 aa, Entamoeba dispar
FNVRCDVKYISIGKTFNP

SEQ ID NO: 2396903 - protein, 26 aa, Entamoeba dispar
FPEKLIPKFITLLDRGQNCPLHGCGE

SEQ ID NO: 2396904 - protein, 22 aa, Entamoeba dispar
FPELQLPVNLKGFELKKCCAEN

SEQ ID NO: 2396905 - protein, 32 aa, Entamoeba dispar
FPIFHGIMNILFLGYLVFFVIAFFQSLRIEEG

SEQ ID NO: 2396906 - protein, 19 aa, Entamoeba dispar
FPIFIIVTQFVVSILILCF

SEQ ID NO: 2396907 - protein, 18 aa, Entamoeba dispar
FPILLKDWNIINIKITSF

SEQ ID NO: 2396908 - protein, 17 aa, Entamoeba dispar
FPILVVSYIIRIPKEDR

SEQ ID NO: 2396909 - protein, 42 aa, Entamoeba dispar
FPITQKVAVILIFLVLMIQFGVMLYFRFAPFIKENEIVASFE

SEQ ID NO: 2396910 - protein, 18 aa, Entamoeba dispar
FPKGFPTRKLIPLLLLQI

SEQ ID NO: 2396911 - protein, 22 aa, Entamoeba dispar
FPKGFPTRKLIPLLLLQICESF

SEQ ID NO: 2396912 - protein, 19 aa, Entamoeba dispar
FPKTEFKFPWDIANTITTG

SEQ ID NO: 2396913 - protein, 19 aa, Entamoeba dispar
FPMIILFTVTITAPIILFS

SEQ ID NO: 2396914 - protein, 23 aa, Entamoeba dispar
FPNLVLYYLRWKSSFPIPDHLTF

SEQ ID NO: 2396915 - protein, 24 aa, Entamoeba dispar
FPPFLICSLVYMRKYRKSQKLSSI

SEQ ID NO: 2396916 - protein, 20 aa, Entamoeba dispar
FPQRDYYLLFDYFSSFSQPI

SEQ ID NO: 2396917 - protein, 24 aa, Entamoeba dispar
FPRFRIYFLGWYLIPAAGGCIKYV

SEQ ID NO: 2396918 - protein, 27 aa, Entamoeba dispar
FPRNGLLLFVTTLRIGALTTTLEKLKV

SEQ ID NO: 2396919 - protein, 29 aa, Entamoeba dispar
FPSKFVINNFLTLTFPDIIYFVETPCFNI

SEQ ID NO: 2396920 - protein, 34 aa, Entamoeba dispar
FPSKKENVYFILLSFIISLIPITTIQYIPHLCAL

SEQ ID NO: 2396921 - protein, 17 aa, Entamoeba dispar
FPTLGMLISKKLKKQRI

SEQ ID NO: 2396922 - protein, 22 aa, Entamoeba dispar
FPTPEQIFLNGLRNYFYTPLVS

SEQ ID NO: 2396923 - protein, 17 aa, Entamoeba dispar
FPVFNLTSSFPILSNTL

SEQ ID NO: 2396924 - protein, 26 aa, Entamoeba dispar
FQDFTWTYFILKIPTLIIFISILISV

SEQ ID NO: 2396925 - protein, 19 aa, Entamoeba dispar
FQENLLLLALSFYDVVRVA

SEQ ID NO: 2396926 - protein, 17 aa, Entamoeba dispar
FQFAISDECYIYFNSDK

SEQ ID NO: 2396927 - protein, 19 aa, Entamoeba dispar
FQFAISDQCYIYFNSDKNV

SEQ ID NO: 2396928 - protein, 20 aa, Entamoeba dispar
FQFLPEIIFMKMFQNFGIVT

SEQ ID NO: 2396929 - protein, 19 aa, Entamoeba dispar
FQKLLMILINGLQSTDPNI

SEQ ID NO: 2396930 - protein, 32 aa, Entamoeba dispar
FQKNRNIILKINKYGWHLLLKNSNDEIIESIV

SEQ ID NO: 2396931 - protein, 22 aa, Entamoeba dispar
FQKYPLFLLAVISLIGQIIIAI

SEQ ID NO: 2396932 - protein, 18 aa, Entamoeba dispar
FQLPTWRITFFYCWELGY

SEQ ID NO: 2396933 - protein, 17 aa, Entamoeba dispar
FQVYGLASVYSYLQIHK

SEQ ID NO: 2396934 - protein, 26 aa, Entamoeba dispar
FRCEYIVHFYGAVFIPTKICLVTEYA

SEQ ID NO: 2396935 - protein, 26 aa, Entamoeba dispar
FRCPQIVYFYGAVFNPKRLTIVMEFA

SEQ ID NO: 2396936 - protein, 30 aa, Entamoeba dispar
FREDVSLLWKGIIFEPRFGLTIIQIAKNTK

SEQ ID NO: 2396937 - protein, 18 aa, Entamoeba dispar
FRFAIRPYPFMDKWGIMP

SEQ ID NO: 2396938 - protein, 35 aa, Entamoeba dispar
FRIAYELPIKLPYHYPLWKAMIAITSLLIPIILDV

SEQ ID NO: 2396939 - protein, 19 aa, Entamoeba dispar
FRLYVFPRYIIYAAIQAYP

SEQ ID NO: 2396940 - protein, 28 aa, Entamoeba dispar
FRRWHQKIPILWTYKPFYEARSIHLPSI

SEQ ID NO: 2396941 - protein, 45 aa, Entamoeba dispar
FRTSFYQCLGLLLYNIPLSYHVRFLRQFLIPHPFQLVDIRAIVKA

SEQ ID NO: 2396942 - protein, 26 aa, Entamoeba dispar
FSCDNKGIWYLISSYEGIINQLTPNS

SEQ ID NO: 2396943 - protein, 19 aa, Entamoeba dispar
FSCIKCESGYYLDTLKCTE

SEQ ID NO: 2396944 - protein, 28 aa, Entamoeba dispar
FSCIQLFIFIIFFFYFCSSLINSGFWIT

SEQ ID NO: 2396945 - protein, 20 aa, Entamoeba dispar
FSCNLLPWAWSPPRFECWWL

SEQ ID NO: 2396946 - protein, 24 aa, Entamoeba dispar
FSDDLFWIIVGCVGGFLVIGIILA

SEQ ID NO: 2396947 - protein, 24 aa, Entamoeba dispar
FSDYIFCITFFIVGWITNNDSDSE

SEQ ID NO: 2396948 - protein, 17 aa, Entamoeba dispar
FSEDDMELLYLQSIPWY

SEQ ID NO: 2396949 - protein, 20 aa, Entamoeba dispar
FSFAITAWELFYAKEPYREC

SEQ ID NO: 2396950 - protein, 22 aa, Entamoeba dispar
FSFIFFFYFFFLSYLSIISSSI

SEQ ID NO: 2396951 - protein, 17 aa, Entamoeba dispar
FSFIFKYVKELFSISFV

SEQ ID NO: 2396952 - protein, 18 aa, Entamoeba dispar
FSFIQQPLTQELIMSYPG

SEQ ID NO: 2396953 - protein, 39 aa, Entamoeba dispar
FSFLFKFLYYQYKLLTNVYFLINMIISCIPFISTVTPIT

SEQ ID NO: 2396954 - protein, 21 aa, Entamoeba dispar
FSFSLGPRYITLPSAIIITIL

SEQ ID NO: 2396955 - protein, 31 aa, Entamoeba dispar
FSGFYEYYVLVFLFSFLLMISMHYSNPILIY

SEQ ID NO: 2396956 - protein, 22 aa, Entamoeba dispar
FSIAIFFWLITFPFILVFVAAP

SEQ ID NO: 2396957 - protein, 21 aa, Entamoeba dispar
FSIIFFYCKNRFGWFVSYKSK

SEQ ID NO: 2396958 - protein, 27 aa, Entamoeba dispar
FSIISFIPYLYLFGWNTISIEDTINFN

SEQ ID NO: 2396959 - protein, 21 aa, Entamoeba dispar
FSIPINVIVSVGLLIDKWEII

SEQ ID NO: 2396960 - protein, 17 aa, Entamoeba dispar
FSISLYQTIIYHDPYKG

SEQ ID NO: 2396961 - protein, 32 aa, Entamoeba dispar
FSKDILPQGFAPLLFYGLTPGLSERILSFLIL

SEQ ID NO: 2396962 - protein, 19 aa, Entamoeba dispar
FSLEYLLTDLIANSVVRLF

SEQ ID NO: 2396963 - protein, 17 aa, Entamoeba dispar
FSLFFIFVIWRVGVLYQ

SEQ ID NO: 2396964 - protein, 19 aa, Entamoeba dispar
FSLMLRDALLLYKGIIMDL

SEQ ID NO: 2396965 - protein, 18 aa, Entamoeba dispar
FSLVMSESIIITNSKSSD

SEQ ID NO: 2396966 - protein, 25 aa, Entamoeba dispar
FSMAMAFIVIYIAIPILTANGMILL

SEQ ID NO: 2396967 - protein, 29 aa, Entamoeba dispar
FSNIMNLLQKLFINIKLPSLLDSKNVSII

SEQ ID NO: 2396968 - protein, 26 aa, Entamoeba dispar
FSPFLPVTIFLYPATLPLLLPLLPSL

SEQ ID NO: 2396969 - protein, 25 aa, Entamoeba dispar
FSPNKIVYLPALRFFGNLSSKDSNF

SEQ ID NO: 2396970 - protein, 24 aa, Entamoeba dispar
FSSQQFGYIPELFLWHGRNAYKRT

SEQ ID NO: 2396971 - protein, 27 aa, Entamoeba dispar
FSVGPVFYLIYYFYKDVSILFCVPTIA

SEQ ID NO: 2396972 - protein, 20 aa, Entamoeba dispar
FSVISYIIIGLLVFSETYNF

SEQ ID NO: 2396973 - protein, 23 aa, Entamoeba dispar
FSVLFLGRKLSVAQWRALALLVT

SEQ ID NO: 2396974 - protein, 21 aa, Entamoeba dispar
FSVLTLNFFFTDSLIAFSSKT

SEQ ID NO: 2396975 - protein, 30 aa, Entamoeba dispar
FSVVALFIYICYIPLLFISFRTHPLFIADP

SEQ ID NO: 2396976 - protein, 21 aa, Entamoeba dispar
FSVVLRYLPLHVTPPPDLPDK

SEQ ID NO: 2396977 - protein, 24 aa, Entamoeba dispar
FSWCIPVVVIFYFAKKRDSVKYFM

SEQ ID NO: 2396978 - protein, 19 aa, Entamoeba dispar
FTAIINGLVLGWVHAFIFW

SEQ ID NO: 2396979 - protein, 24 aa, Entamoeba dispar
FTCQWIELFSHRNVLYELSKPSEM

SEQ ID NO: 2396980 - protein, 20 aa, Entamoeba dispar
FTDHQNICYPLFAVSQETTD

SEQ ID NO: 2396981 - protein, 25 aa, Entamoeba dispar
FTDIISIILLFLFLLLGGLTLDGFI

SEQ ID NO: 2396982 - protein, 17 aa, Entamoeba dispar
FTEVRVLGLHKIPSLCY

SEQ ID NO: 2396983 - protein, 19 aa, Entamoeba dispar
FTEWNIDSFDPLFKEGFCK

SEQ ID NO: 2396984 - protein, 26 aa, Entamoeba dispar
FTGIFGFVLILILPSMFQIFSKKTYK

SEQ ID NO: 2396985 - protein, 33 aa, Entamoeba dispar
FTHFTYNLFPMTFFGLILFLLNSFKATFVLFFS

SEQ ID NO: 2396986 - protein, 20 aa, Entamoeba dispar
FTIFYLPHWVQHQTGWMIFG

SEQ ID NO: 2396987 - protein, 40 aa, Entamoeba dispar
FTIGWDMFGLIYQLLLTPSFYLLILIPPLLLGAKEMVILF

SEQ ID NO: 2396988 - protein, 26 aa, Entamoeba dispar
FTIIAIFIFFVLLLSDYFIGYRSNAA

SEQ ID NO: 2396989 - protein, 18 aa, Entamoeba dispar
FTILRWCFEYHKKIKKAF

SEQ ID NO: 2396990 - protein, 24 aa, Entamoeba dispar
FTIRRWNWIILGSEIFSIAIYFIS

SEQ ID NO: 2396991 - protein, 18 aa, Entamoeba dispar
FTIYCAIVIVSCFHLATY

SEQ ID NO: 2396992 - protein, 26 aa, Entamoeba dispar
FTKNEPEAFVLFKVINDSWLAIKENN

SEQ ID NO: 2396993 - protein, 24 aa, Entamoeba dispar
FTKSPTLLNLWKIPIYSVYTANGA

SEQ ID NO: 2396994 - protein, 20 aa, Entamoeba dispar
FTLIEFNLCYYYGVNSSSYF

SEQ ID NO: 2396995 - protein, 49 aa, Entamoeba dispar
FTLILSEIIFIFQIIELGFYVWYVSLLILILFIPLYILATISYNRCVQV

SEQ ID NO: 2396996 - protein, 30 aa, Entamoeba dispar
FTNVPKYLTFENINLTLPANFVFSDDQVLI

SEQ ID NO: 2396997 - protein, 31 aa, Entamoeba dispar
FTPAFQGKMMKLLDIPLSCEVTPFAKMFEGE

SEQ ID NO: 2396998 - protein, 20 aa, Entamoeba dispar
FTQCLSCMLNYSLNTMNNCV

SEQ ID NO: 2396999 - protein, 20 aa, Entamoeba dispar
FTQGAFYVRSPFGNKTWQSL

SEQ ID NO: 2397000 - protein, 18 aa, Entamoeba dispar
FTQYGYKFGLTVLESYRF

SEQ ID NO: 2397001 - protein, 19 aa, Entamoeba dispar
FTRTQNVPSAWPLTPVISE

SEQ ID NO: 2397002 - protein, 25 aa, Entamoeba dispar
FTSGNEFIFKSFKVTLTDNKNTIPE

SEQ ID NO: 2397003 - protein, 20 aa, Entamoeba dispar
FTTAIFLRWVNRIDGLMVNN

SEQ ID NO: 2397004 - protein, 19 aa, Entamoeba dispar
FTTIAFGLFRKIIGGVFVE

SEQ ID NO: 2397005 - protein, 18 aa, Entamoeba dispar
FVALRDQYIKYGDGFVLI

SEQ ID NO: 2397006 - protein, 18 aa, Entamoeba dispar
FVCSKYFQVIYSKGYHPF

SEQ ID NO: 2397007 - protein, 26 aa, Entamoeba dispar
FVCTVFLFINPYFALLYGFILGVTSL

SEQ ID NO: 2397008 - protein, 21 aa, Entamoeba dispar
FVDIMLLLMVVIAALFYAIKS

SEQ ID NO: 2397009 - protein, 23 aa, Entamoeba dispar
FVELIFVEFVQSNYFFFCNNGEI

SEQ ID NO: 2397010 - protein, 27 aa, Entamoeba dispar
FVFESKRYILFFILILIVFSSFIIFYK

SEQ ID NO: 2397011 - protein, 17 aa, Entamoeba dispar
FVFGYPQFHFTTLKIIH

SEQ ID NO: 2397012 - protein, 18 aa, Entamoeba dispar
FVFHFEPQVLLLRPRGFK

SEQ ID NO: 2397013 - protein, 20 aa, Entamoeba dispar
FVGFTLLVAVITWWKVRKTD

SEQ ID NO: 2397014 - protein, 17 aa, Entamoeba dispar
FVGPMLMEIAGKSVFEC

SEQ ID NO: 2397015 - protein, 19 aa, Entamoeba dispar
FVHDSLMQILRYLSPSIAE

SEQ ID NO: 2397016 - protein, 24 aa, Entamoeba dispar
FVHTHLEFCIYKYQLIKYLQQLVE

SEQ ID NO: 2397017 - protein, 17 aa, Entamoeba dispar
FVIYCLGQSAKQLKNKQ

SEQ ID NO: 2397018 - protein, 25 aa, Entamoeba dispar
FVKEWKLCFVMISVAPFMVGAAGIF

SEQ ID NO: 2397019 - protein, 18 aa, Entamoeba dispar
FVKRILIMMLNCDSSIAL

SEQ ID NO: 2397020 - protein, 17 aa, Entamoeba dispar
FVLFPRMPRNRSGITRS

SEQ ID NO: 2397021 - protein, 47 aa, Entamoeba dispar
FVLISQYLHWSLFINILLHLIQLPSPQRILFLSSLHNLIPLPTLNQL

SEQ ID NO: 2397022 - protein, 19 aa, Entamoeba dispar
FVLMDIFFDILPYVQSNRI

SEQ ID NO: 2397023 - protein, 24 aa, Entamoeba dispar
FVNDLMILCPSYLYPQPMSSDKIL

SEQ ID NO: 2397024 - protein, 32 aa, Entamoeba dispar
FVNLRVSFLEGLFFVFAYFMDVAHAEECVSIT

SEQ ID NO: 2397025 - protein, 24 aa, Entamoeba dispar
FVNTPFLIFFFFECQCVKLCLVLF

SEQ ID NO: 2397026 - protein, 17 aa, Entamoeba dispar
FVPILPIRICCALFGLI

SEQ ID NO: 2397027 - protein, 19 aa, Entamoeba dispar
FVPLIVFNTYIQLRISVGF

SEQ ID NO: 2397028 - protein, 18 aa, Entamoeba dispar
FVPMMILSVDIRSLINSK

SEQ ID NO: 2397029 - protein, 18 aa, Entamoeba dispar
FVPTILRSIQHFGTKREL

SEQ ID NO: 2397030 - protein, 26 aa, Entamoeba dispar
FVQVCSIYLAVVPKGYVIESCPDDPC

SEQ ID NO: 2397031 - protein, 27 aa, Entamoeba dispar
FVSFLLSLICILLVSFVPQMSKRGLST

SEQ ID NO: 2397032 - protein, 23 aa, Entamoeba dispar
FVSLNIFMFLFFKDTQKLTEATG

SEQ ID NO: 2397033 - protein, 17 aa, Entamoeba dispar
FVSNPSRLSKWLPIISL

SEQ ID NO: 2397034 - protein, 19 aa, Entamoeba dispar
FVSVIPYTALSLRLPILTV

SEQ ID NO: 2397035 - protein, 28 aa, Entamoeba dispar
FVTASFLFILFYIVVLLLALPATPLNLA

SEQ ID NO: 2397036 - protein, 39 aa, Entamoeba dispar
FVTKGNRLPIISQIPDWLYLIITDCWNPISAKRLSISKL

SEQ ID NO: 2397037 - protein, 27 aa, Entamoeba dispar
FVVSLIFALCFFISPIIIFFSRTKLPL

SEQ ID NO: 2397038 - protein, 25 aa, Entamoeba dispar
FVVTYLFLMLFVFSLMLYSSKQSCF

SEQ ID NO: 2397039 - protein, 28 aa, Entamoeba dispar
FVVYVCPLSIIMLWPRVEKFGDPNFRKL

SEQ ID NO: 2397040 - protein, 17 aa, Entamoeba dispar
FVWEFGELLSILMGFGY

SEQ ID NO: 2397041 - protein, 19 aa, Entamoeba dispar
FVYLFVVGGLLYVSIRIFF

SEQ ID NO: 2397042 - protein, 20 aa, Entamoeba dispar
FWGIFICCFVIAFAAFFESI

SEQ ID NO: 2397043 - protein, 18 aa, Entamoeba dispar
FWKFYYYHFLYSFYFLIF

SEQ ID NO: 2397044 - protein, 19 aa, Entamoeba dispar
FWKLVLSCVLIITNVVPPE

SEQ ID NO: 2397045 - protein, 17 aa, Entamoeba dispar
FWQAFDTGKDAYMARHT

SEQ ID NO: 2397046 - protein, 17 aa, Entamoeba dispar
FWYNEDMKWLFVMSQNT

SEQ ID NO: 2397047 - protein, 20 aa, Entamoeba dispar
FYDIMVIIVFVIISIVCVLV

SEQ ID NO: 2397048 - protein, 19 aa, Entamoeba dispar
FYDYNYHLPIQRTYINSNP

SEQ ID NO: 2397049 - protein, 21 aa, Entamoeba dispar
FYEFKLFGIPVFQLILPIIGG

SEQ ID NO: 2397050 - protein, 17 aa, Entamoeba dispar
FYEHSLLPSINFVPVIA

SEQ ID NO: 2397051 - protein, 25 aa, Entamoeba dispar
FYFLLIGLPLLYCFVPTYNNNLISD

SEQ ID NO: 2397052 - protein, 24 aa, Entamoeba dispar
FYFYPYFLMFILSYKFYYLLNLYH

SEQ ID NO: 2397053 - protein, 26 aa, Entamoeba dispar
FYGIAFLYFLLVILSFYLSFSSSLRP

SEQ ID NO: 2397054 - protein, 25 aa, Entamoeba dispar
FYGRVLDYHIELIMLDNLEGVKLFE

SEQ ID NO: 2397055 - protein, 27 aa, Entamoeba dispar
FYHIIHSPFIFFDTTPMGRILNRFTKD

SEQ ID NO: 2397056 - protein, 20 aa, Entamoeba dispar
FYILVGMIFFISLLLIFHSL

SEQ ID NO: 2397057 - protein, 22 aa, Entamoeba dispar
FYKIIQFSFLSVAALVLTGVLT

SEQ ID NO: 2397058 - protein, 26 aa, Entamoeba dispar
FYKTISFIIFLNQLFLSFLWIILLFT

SEQ ID NO: 2397059 - protein, 19 aa, Entamoeba dispar
FYLGYPRCRFINGPTLCQC

SEQ ID NO: 2397060 - protein, 29 aa, Entamoeba dispar
FYMLVKSPFILCMCLIYSIVILAYNLFGM

SEQ ID NO: 2397061 - protein, 19 aa, Entamoeba dispar
FYNGTSLTFLSLCLLLLLI

SEQ ID NO: 2397062 - protein, 26 aa, Entamoeba dispar
FYPIIKLFKITIPFKLFKGSSLISII

SEQ ID NO: 2397063 - protein, 17 aa, Entamoeba dispar
FYRLNKFSCVRTCKDKC

SEQ ID NO: 2397064 - protein, 17 aa, Entamoeba dispar
FYSFFGNGFLVILNTFF

SEQ ID NO: 2397065 - protein, 20 aa, Entamoeba dispar
FYSILYFYYLGGIHQLHFEN

SEQ ID NO: 2397066 - protein, 19 aa, Entamoeba dispar
FYSYYYTISSCLLFHEFIN

SEQ ID NO: 2397067 - protein, 29 aa, Entamoeba dispar
FYTCKMAKLWYLQRMDWIGAFIIVVTTTV

SEQ ID NO: 2397068 - protein, 32 aa, Entamoeba dispar
FYVDYQLRPRYLFIPFIKLFDSLVFKKIKEEI

SEQ ID NO: 2397069 - protein, 47 aa, Entamoeba dispar
GAAAPPMFILVYIALGIIAKIWCLIPLGVMAIFLILNGMFGKGIGVF

SEQ ID NO: 2397070 - protein, 17 aa, Entamoeba dispar
GACCAMELSKYKSLKIA

SEQ ID NO: 2397071 - protein, 18 aa, Entamoeba dispar
GAIIGIILGSSAGLLFII

SEQ ID NO: 2397072 - protein, 22 aa, Entamoeba dispar
GAILFFFWTFANLTPRARSIHL

SEQ ID NO: 2397073 - protein, 20 aa, Entamoeba dispar
GAIVGGVLIIIGWLSKLFDS

SEQ ID NO: 2397074 - protein, 23 aa, Entamoeba dispar
GAKDLLEYLYAKNFAPFEIDERG

SEQ ID NO: 2397075 - protein, 28 aa, Entamoeba dispar
GAKEPEFQIPPIKYSRPTRFLTNAYRTI

SEQ ID NO: 2397076 - protein, 25 aa, Entamoeba dispar
GALTVGALFYPFLTPSAIEICLCGV

SEQ ID NO: 2397077 - protein, 20 aa, Entamoeba dispar
GALVFIALTIYYIVSQFTHN

SEQ ID NO: 2397078 - protein, 26 aa, Entamoeba dispar
GAPLNSCLTYYRFLSNGNSYYVKFSN

SEQ ID NO: 2397079 - protein, 19 aa, Entamoeba dispar
GASLFICGILLIITSSLMN

SEQ ID NO: 2397080 - protein, 26 aa, Entamoeba dispar
GATLMCYLIFGQFYFFQCIISGLIGA

SEQ ID NO: 2397081 - protein, 17 aa, Entamoeba dispar
GAVFIISLLLFITAVVF

SEQ ID NO: 2397082 - protein, 24 aa, Entamoeba dispar
GAYDEAISIIWKNATEKIVNRNSV

SEQ ID NO: 2397083 - protein, 29 aa, Entamoeba dispar
GAYVFIINLIPLHAFLLLVFGRFTNRLYT

SEQ ID NO: 2397084 - protein, 22 aa, Entamoeba dispar
GCAICKNGYYYDKKNYRCNKCD

SEQ ID NO: 2397085 - protein, 23 aa, Entamoeba dispar
GCDWHFRVNLYGTCSLEQCNIKE

SEQ ID NO: 2397086 - protein, 25 aa, Entamoeba dispar
GCEDALIHMLNYVWPNIFETSPHVI

SEQ ID NO: 2397087 - protein, 17 aa, Entamoeba dispar
GCGICHKGYYRNGKGCS

SEQ ID NO: 2397088 - protein, 25 aa, Entamoeba dispar
GCILSYCFILLLNRYTKLCVYTFSI

SEQ ID NO: 2397089 - protein, 20 aa, Entamoeba dispar
GCIVFGIICGSLSFLFGYSI

SEQ ID NO: 2397090 - protein, 18 aa, Entamoeba dispar
GCKSCQSGYYLKNGDCVK

SEQ ID NO: 2397091 - protein, 17 aa, Entamoeba dispar
GCLNCKSSYTLNATKGC

SEQ ID NO: 2397092 - protein, 24 aa, Entamoeba dispar
GCLSSLLCLPITQLIMLFSSILNE

SEQ ID NO: 2397093 - protein, 18 aa, Entamoeba dispar
GCSKCLDGTYLYNGECYL

SEQ ID NO: 2397094 - protein, 19 aa, Entamoeba dispar
GCVLCQKGYLAFNKTCIDT

SEQ ID NO: 2397095 - protein, 18 aa, Entamoeba dispar
GCVRCQTGYYLDSTTTTC

SEQ ID NO: 2397096 - protein, 17 aa, Entamoeba dispar
GCWLLFVAVIIYTICSI

SEQ ID NO: 2397097 - protein, 21 aa, Entamoeba dispar
GDDIDLALQKIYLVLGKVQQQ

SEQ ID NO: 2397098 - protein, 41 aa, Entamoeba dispar
GDEWKFTPYIFFYAIIFFLQLVLFILFIICLGFMTKDAHGI

SEQ ID NO: 2397099 - protein, 22 aa, Entamoeba dispar
GDGFFLQWMMSIGILIIGTFTM

SEQ ID NO: 2397100 - protein, 25 aa, Entamoeba dispar
GDGYYMEGFMKCILLNPSELYSCDK

SEQ ID NO: 2397101 - protein, 31 aa, Entamoeba dispar
GDISGPYLFVIYLINFIIFLNLIVGEKENEH

SEQ ID NO: 2397102 - protein, 31 aa, Entamoeba dispar
GDSRSIYNILRFWGMYSLYPSFIPSSFECVV

SEQ ID NO: 2397103 - protein, 20 aa, Entamoeba dispar
GDVFELQFNLIFDKENNKGI

SEQ ID NO: 2397104 - protein, 38 aa, Entamoeba dispar
GEDEALLRAMFDFTFYWYNFMPLSRGTAATGFVFMLAM

SEQ ID NO: 2397105 - protein, 23 aa, Entamoeba dispar
GEDFIRIYYINQNIRRLHVFGEI

SEQ ID NO: 2397106 - protein, 23 aa, Entamoeba dispar
GEETKAINMYKWLIEIYYKEEKY

SEQ ID NO: 2397107 - protein, 31 aa, Entamoeba dispar
GEFSGFMAPWESFFFYWESVLKKGIELSCVI

SEQ ID NO: 2397108 - protein, 33 aa, Entamoeba dispar
GEGKELWFAYIIKYLILFFPVFNLTSSFPILSN

SEQ ID NO: 2397109 - protein, 24 aa, Entamoeba dispar
GEHYTYVYFNFKKYIYNTEDGLFY

SEQ ID NO: 2397110 - protein, 32 aa, Entamoeba dispar
GEIISIVLSLFYLIYAILLPNLHDLYYHDFYF

SEQ ID NO: 2397111 - protein, 18 aa, Entamoeba dispar
GELLLRGPALFKEYFNRP

SEQ ID NO: 2397112 - protein, 17 aa, Entamoeba dispar
GELTCCLCPLFAGLIAT

SEQ ID NO: 2397113 - protein, 30 aa, Entamoeba dispar
GEMRISFIETFAWDYSFNQTIPREFLIHPV

SEQ ID NO: 2397114 - protein, 26 aa, Entamoeba dispar
GENFILTIVVFIALGLMSFVIEKITE

SEQ ID NO: 2397115 - protein, 24 aa, Entamoeba dispar
GEPFIFNVVILFVMLIRSAVFRQI

SEQ ID NO: 2397116 - protein, 18 aa, Entamoeba dispar
GEPNFFKGNLLIPSVSLS

SEQ ID NO: 2397117 - protein, 30 aa, Entamoeba dispar
GEQEKYHFVMLYFIMNFPNDVKNLLLTMRA

SEQ ID NO: 2397118 - protein, 17 aa, Entamoeba dispar
GEQLLDWAKRSLSIDSC

SEQ ID NO: 2397119 - protein, 26 aa, Entamoeba dispar
GESWNDWSYLQLAGFFFLLEGLFIYN

SEQ ID NO: 2397120 - protein, 38 aa, Entamoeba dispar
GESWNDWSYLQLAGFFFLLEGLFIYNGYLRIAAPFFDY

SEQ ID NO: 2397121 - protein, 22 aa, Entamoeba dispar
GETTIYHIKYFTDAKCTTAVED

SEQ ID NO: 2397122 - protein, 19 aa, Entamoeba dispar
GETYFMFICSWKDGNEYVQ

SEQ ID NO: 2397123 - protein, 27 aa, Entamoeba dispar
GEVLLYDAFTLALLFSYSADRKTKSVT

SEQ ID NO: 2397124 - protein, 46 aa, Entamoeba dispar
GEVPKWAIAVIVVVGLIIIIALILLVAFILYAKLVLLKNRKNNKVF

SEQ ID NO: 2397125 - protein, 23 aa, Entamoeba dispar
GEWYCIYPPFAFVQALERMNSDL

SEQ ID NO: 2397126 - protein, 22 aa, Entamoeba dispar
GEYQICFYVSNAPRYDIEYKFT

SEQ ID NO: 2397127 - protein, 31 aa, Entamoeba dispar
GFCGFGMLCIFMSLSFFFLPTRFAMTFTFGN

SEQ ID NO: 2397128 - protein, 25 aa, Entamoeba dispar
GFCIKLLLKQLPPQLIHKSMKYFEE

SEQ ID NO: 2397129 - protein, 23 aa, Entamoeba dispar
GFCSYCNPGNYYKKIYSYSCYSC

SEQ ID NO: 2397130 - protein, 30 aa, Entamoeba dispar
GFESSKDYYYWIDLIGIVLPFTVSIKQTHE

SEQ ID NO: 2397131 - protein, 18 aa, Entamoeba dispar
GFFALFDIFAKIEGTGKS

SEQ ID NO: 2397132 - protein, 18 aa, Entamoeba dispar
GFHMNLPSFPEYFEKLNK

SEQ ID NO: 2397133 - protein, 20 aa, Entamoeba dispar
GFIALILAYFYLLENNVIKR

SEQ ID NO: 2397134 - protein, 30 aa, Entamoeba dispar
GFIAYFVFFLLYFILYYLPSNKSPFSVVDD

SEQ ID NO: 2397135 - protein, 21 aa, Entamoeba dispar
GFIGIPFYSFFGNGFLVILNT

SEQ ID NO: 2397136 - protein, 17 aa, Entamoeba dispar
GFIIKNSWTLQSGHSMG

SEQ ID NO: 2397137 - protein, 39 aa, Entamoeba dispar
GFKNHKYFIQFLWYAPFILILGFIWHCYGLYNSYSLLQQ

SEQ ID NO: 2397138 - protein, 24 aa, Entamoeba dispar
GFKVFNQLIRFIPLTFNNINQLFN

SEQ ID NO: 2397139 - protein, 18 aa, Entamoeba dispar
GFLLFQGFFPKAGEIIIL

SEQ ID NO: 2397140 - protein, 19 aa, Entamoeba dispar
GFLTQYFELLDKNPGDLIR

SEQ ID NO: 2397141 - protein, 43 aa, Entamoeba dispar
GFNFRFSIILWVIIAGLTIVLIIFIIWVLYIPSKSNTKNKTTT

SEQ ID NO: 2397142 - protein, 19 aa, Entamoeba dispar
GFRVQKLMRVSSIPNPEVK

SEQ ID NO: 2397143 - protein, 18 aa, Entamoeba dispar
GFSIVNAKLICGAKNTKG

SEQ ID NO: 2397144 - protein, 29 aa, Entamoeba dispar
GFTLLRFFVTPYRWVVLRRYFFLQGIIYF

SEQ ID NO: 2397145 - protein, 19 aa, Entamoeba dispar
GFVLTQWHKMKILLTSSFD

SEQ ID NO: 2397146 - protein, 25 aa, Entamoeba dispar
GFVSYHPFYEIMRRMLLSIYELCPT

SEQ ID NO: 2397147 - protein, 26 aa, Entamoeba dispar
GFVYYLLNGFLISNANGKWFIFHSSG

SEQ ID NO: 2397148 - protein, 18 aa, Entamoeba dispar
GFYPGYLLFFFCCGIPYE

SEQ ID NO: 2397149 - protein, 34 aa, Entamoeba dispar
GGAIGIFIGMIVDTLLVIIYSNKLGKHKSHSKYQ

SEQ ID NO: 2397150 - protein, 24 aa, Entamoeba dispar
GGAILYYDYYLTDQPIRFKKLWEY

SEQ ID NO: 2397151 - protein, 27 aa, Entamoeba dispar
GGAYICTFLLMSTLIYWVFGYSFIQKN

SEQ ID NO: 2397152 - protein, 29 aa, Entamoeba dispar
GGDGRWWAKKRMLIYLRRRWEKSNETIQL

SEQ ID NO: 2397153 - protein, 20 aa, Entamoeba dispar
GGEGCYLCQCIEGYYSVHSL

SEQ ID NO: 2397154 - protein, 23 aa, Entamoeba dispar
GGFLVYLVVIFQLGYFIYKIIDK

SEQ ID NO: 2397155 - protein, 24 aa, Entamoeba dispar
GGHYLCTIILSTLPIIFDKAETIA

SEQ ID NO: 2397156 - protein, 23 aa, Entamoeba dispar
GGHYYLFVGMKRGVDCTLTVSVV

SEQ ID NO: 2397157 - protein, 24 aa, Entamoeba dispar
GGIGLYLTYFLSKENIHKYKENEL

SEQ ID NO: 2397158 - protein, 26 aa, Entamoeba dispar
GGIINLMLLIFIIGSISYFSYDLRQL

SEQ ID NO: 2397159 - protein, 22 aa, Entamoeba dispar
GGILTYYKWFSIGDNKTQLYDY

SEQ ID NO: 2397160 - protein, 34 aa, Entamoeba dispar
GGIVLSFYIMINWFFTLLEYLSIMSGKAAPKEFI

SEQ ID NO: 2397161 - protein, 33 aa, Entamoeba dispar
GGIVLTVITIIILLVFIRIIIGKATKYSQNKKQ

SEQ ID NO: 2397162 - protein, 24 aa, Entamoeba dispar
GGLITFWILLFLDNIAILYAIHKT

SEQ ID NO: 2397163 - protein, 24 aa, Entamoeba dispar
GGLPLSAIILIGFFIINVTTMNYL

SEQ ID NO: 2397164 - protein, 19 aa, Entamoeba dispar
GGMVRYFSIKNIKFHSATS

SEQ ID NO: 2397165 - protein, 17 aa, Entamoeba dispar
GGPILYYPDPNKISSGG

SEQ ID NO: 2397166 - protein, 22 aa, Entamoeba dispar
GGQYLFSVNVFYPPLNKSKVVS

SEQ ID NO: 2397167 - protein, 24 aa, Entamoeba dispar
GGSMHPFKFILPKNIKKITIIGDL

SEQ ID NO: 2397168 - protein, 23 aa, Entamoeba dispar
GGSPETQLPFGKNPQQAFCPRCN

SEQ ID NO: 2397169 - protein, 33 aa, Entamoeba dispar
GGSTGLLFFFVFCAFWIGYIYGAKKIQKRDMSA

SEQ ID NO: 2397170 - protein, 24 aa, Entamoeba dispar
GGTIYVIILLIIKIISYYTSIKQS

SEQ ID NO: 2397171 - protein, 33 aa, Entamoeba dispar
GGTVGLILILIFFIVLLIFVLRYKKVDINIYKI

SEQ ID NO: 2397172 - protein, 27 aa, Entamoeba dispar
GGVAWSTYWHYFRAGGFIGLILCLMPF

SEQ ID NO: 2397173 - protein, 31 aa, Entamoeba dispar
GGVAWSTYWHYFRAGGFIGLILCLMPFVVRC

SEQ ID NO: 2397174 - protein, 23 aa, Entamoeba dispar
GGYPLGWTLFGVTFFLIFFVDRV

SEQ ID NO: 2397175 - protein, 20 aa, Entamoeba dispar
GHAALSLGLIFEGTMDGDIA

SEQ ID NO: 2397176 - protein, 29 aa, Entamoeba dispar
GHIISIIFIFIIYGLTCYIPGYSTYNISW

SEQ ID NO: 2397177 - protein, 18 aa, Entamoeba dispar
GHTITFKNIEFGKCYYTG

SEQ ID NO: 2397178 - protein, 20 aa, Entamoeba dispar
GHTRLDLSLKDWPFTSFQSW

SEQ ID NO: 2397179 - protein, 17 aa, Entamoeba dispar
GHVSFKHLITFETTPSL

SEQ ID NO: 2397180 - protein, 31 aa, Entamoeba dispar
GIAYMAENLFFYFKFPNLNSLPLNFSSETKK

SEQ ID NO: 2397181 - protein, 26 aa, Entamoeba dispar
GICEYPWDIIDFIQKDNYLPFPNEAT

SEQ ID NO: 2397182 - protein, 48 aa, Entamoeba dispar
GICQKKEKIWWIIIIIIGGCGIIIIIIMIISIFYFVFKTKKRVSINIY

SEQ ID NO: 2397183 - protein, 26 aa, Entamoeba dispar
GIECGTPWYWILTVIGGPLMLTVTII

SEQ ID NO: 2397184 - protein, 28 aa, Entamoeba dispar
GIEGWLKPLLEIPAFQIKLKMWVESMLI

SEQ ID NO: 2397185 - protein, 21 aa, Entamoeba dispar
GIFFSVKTVPYHTLVLDTKLS

SEQ ID NO: 2397186 - protein, 29 aa, Entamoeba dispar
GIFHDFSIYTLIMIFVMSVGGILVALVMT

SEQ ID NO: 2397187 - protein, 17 aa, Entamoeba dispar
GIFIIYYLFNQIIERVT

SEQ ID NO: 2397188 - protein, 17 aa, Entamoeba dispar
GIFRIHQDLLWGSIVNH

SEQ ID NO: 2397189 - protein, 25 aa, Entamoeba dispar
GIGCGIIVFIILSIYYIISQITHKD

SEQ ID NO: 2397190 - protein, 18 aa, Entamoeba dispar
GIGFVFIAVVVVVLYLIF

SEQ ID NO: 2397191 - protein, 25 aa, Entamoeba dispar
GIGVIQWITCLVLSSLSLVIGQFAI

SEQ ID NO: 2397192 - protein, 33 aa, Entamoeba dispar
GIIAAIFLAFIIIVIIVAVIVIIIIKKKGKSYS

SEQ ID NO: 2397193 - protein, 34 aa, Entamoeba dispar
GIIAAIFLAFIIIVIIVAVIVIIIIKKKGKSYSD

SEQ ID NO: 2397194 - protein, 23 aa, Entamoeba dispar
GIICTQLFIYRPTVKFFGPLWTN

SEQ ID NO: 2397195 - protein, 18 aa, Entamoeba dispar
GIICVMFISSFYAFVHLP

SEQ ID NO: 2397196 - protein, 25 aa, Entamoeba dispar
GIIISSIYFGIFLGLALLAYIIYNS

SEQ ID NO: 2397197 - protein, 41 aa, Entamoeba dispar
GIILGCVIGVVLLLIIITIIVIFCIWFFKKPVEDKPQTYRL

SEQ ID NO: 2397198 - protein, 25 aa, Entamoeba dispar
GIKCSFIPIILYLMVALLSINSQRY

SEQ ID NO: 2397199 - protein, 19 aa, Entamoeba dispar
GIKLLIKYCDNADYEEIKE

SEQ ID NO: 2397200 - protein, 17 aa, Entamoeba dispar
GILLFVINIAQLVAFFI

SEQ ID NO: 2397201 - protein, 18 aa, Entamoeba dispar
GILLIIYPYCLPPEVRER

SEQ ID NO: 2397202 - protein, 38 aa, Entamoeba dispar
GILPTQVIFFILIFVLVFLAISFLSIVKWLFCHSTKRK

SEQ ID NO: 2397203 - protein, 23 aa, Entamoeba dispar
GILSILVIIPFGFGLPSHTFDKK

SEQ ID NO: 2397204 - protein, 29 aa, Entamoeba dispar
GIMGILISILYIISFISLLTILLLIYFNC

SEQ ID NO: 2397205 - protein, 32 aa, Entamoeba dispar
GINQPISMYYPLLTLLVYAISLTESPFETFQR

SEQ ID NO: 2397206 - protein, 22 aa, Entamoeba dispar
GINTIIIDFIVKLLGVIFVASI

SEQ ID NO: 2397207 - protein, 17 aa, Entamoeba dispar
GINYFYSLILQKLINKN

SEQ ID NO: 2397208 - protein, 17 aa, Entamoeba dispar
GIPFAYFTGGLPLSAII

SEQ ID NO: 2397209 - protein, 38 aa, Entamoeba dispar
GIPLICILMIIIISGLLVYYFIHLHFIHYFNKKQGVIP

SEQ ID NO: 2397210 - protein, 26 aa, Entamoeba dispar
GIPPEVWRYYLLINRPEQSDTVFLWN

SEQ ID NO: 2397211 - protein, 19 aa, Entamoeba dispar
GIQSLYFAILSTMGYTLLL

SEQ ID NO: 2397212 - protein, 27 aa, Entamoeba dispar
GIRALPVDIWLHVIPQIIARIQSNVPA

SEQ ID NO: 2397213 - protein, 28 aa, Entamoeba dispar
GISIKIARTFFLFGLNNISKIAHTSFLD

SEQ ID NO: 2397214 - protein, 25 aa, Entamoeba dispar
GISLKKNFFIIALKNVTYVYRLSTG

SEQ ID NO: 2397215 - protein, 29 aa, Entamoeba dispar
GISPIFIIVLILHTQIFLRFIKKYNTQKV

SEQ ID NO: 2397216 - protein, 32 aa, Entamoeba dispar
GITGFIVITTILLLILRKYLKRRYETQQWINQ

SEQ ID NO: 2397217 - protein, 19 aa, Entamoeba dispar
GIVSFCFVLFDIAGLYGYI

SEQ ID NO: 2397218 - protein, 26 aa, Entamoeba dispar
GIYHGKFIFPYDYPKNPPEVYFFTPN

SEQ ID NO: 2397219 - protein, 29 aa, Entamoeba dispar
GKDNIVFHSVLFPSTLLGTGQPWTMVRKL

SEQ ID NO: 2397220 - protein, 30 aa, Entamoeba dispar
GKECKSSPVWWVIVLVIIGGIVLTVITIII

SEQ ID NO: 2397221 - protein, 33 aa, Entamoeba dispar
GKEFYINLIIFFVLLIRIALFKQLPEVFKQIKE

SEQ ID NO: 2397222 - protein, 23 aa, Entamoeba dispar
GKEVIGYVFMRKLVSALSVLGVT

SEQ ID NO: 2397223 - protein, 27 aa, Entamoeba dispar
GKIAIDTLFLILLRLDFDVKYQSREDR

SEQ ID NO: 2397224 - protein, 18 aa, Entamoeba dispar
GKIDVIAYTPWYIKTDMT

SEQ ID NO: 2397225 - protein, 33 aa, Entamoeba dispar
GKIIAFIAIILLIIFMLFMPEMFVTAFMSFVLA

SEQ ID NO: 2397226 - protein, 23 aa, Entamoeba dispar
GKKFFPLGCYMNWYDDFDIEHFK

SEQ ID NO: 2397227 - protein, 22 aa, Entamoeba dispar
GKLARRTVKVLGVIALCVSVGV

SEQ ID NO: 2397228 - protein, 26 aa, Entamoeba dispar
GKLDDFWNIVLGAKAVICCRVTPLIK

SEQ ID NO: 2397229 - protein, 27 aa, Entamoeba dispar
GKLIGWELPYHLFPPSLHPCYQSYSKE

SEQ ID NO: 2397230 - protein, 24 aa, Entamoeba dispar
GKLKKMIIEWSMNIKLFDKKNDKK

SEQ ID NO: 2397231 - protein, 21 aa, Entamoeba dispar
GKLLVVTRWLGRNPVLHDIDT

SEQ ID NO: 2397232 - protein, 17 aa, Entamoeba dispar
GKLLYLSYKGVSSVIGM

SEQ ID NO: 2397233 - protein, 20 aa, Entamoeba dispar
GKLRIVYTCINLFIRGCSHN

SEQ ID NO: 2397234 - protein, 25 aa, Entamoeba dispar
GKLSDYWIPTLLTTSIYTPPEVLNG

SEQ ID NO: 2397235 - protein, 27 aa, Entamoeba dispar
GKLTKPYVEPLLNILLPKLEESINKSH

SEQ ID NO: 2397236 - protein, 19 aa, Entamoeba dispar
GKNIDIFPITLGNSSIVGP

SEQ ID NO: 2397237 - protein, 26 aa, Entamoeba dispar
GKNIRKLCPLLIPYSSNPIFDTPSSY

SEQ ID NO: 2397238 - protein, 19 aa, Entamoeba dispar
GKQIEYPIKIKFSTILSSH

SEQ ID NO: 2397239 - protein, 20 aa, Entamoeba dispar
GKRRHILKAQIKDAKDLIEK

SEQ ID NO: 2397240 - protein, 32 aa, Entamoeba dispar
GKTCFKYAAKRPLAYVYLNTKMTYATKTEAYD

SEQ ID NO: 2397241 - protein, 21 aa, Entamoeba dispar
GKTSLLINKLSIESATGLCFS

SEQ ID NO: 2397242 - protein, 22 aa, Entamoeba dispar
GKVELRLTAIKYQKKYFNNARM

SEQ ID NO: 2397243 - protein, 24 aa, Entamoeba dispar
GKVPPKIFEFGLSESVDLAAQMLV

SEQ ID NO: 2397244 - protein, 23 aa, Entamoeba dispar
GKYGILMGIFLPTILLAQPFANT

SEQ ID NO: 2397245 - protein, 27 aa, Entamoeba dispar
GLASPVMFIVLFVLIYINMGKWVYVPL

SEQ ID NO: 2397246 - protein, 48 aa, Entamoeba dispar
GLASPVMFIVLFVLIYIYMGKWVYVPLIVFVVFNIINFGFGFLSGFLY

SEQ ID NO: 2397247 - protein, 23 aa, Entamoeba dispar
GLCEVHLVLFIHHLLPEELVSIN

SEQ ID NO: 2397248 - protein, 24 aa, Entamoeba dispar
GLCLIYLGFLALVGISLGLSSIAP

SEQ ID NO: 2397249 - protein, 35 aa, Entamoeba dispar
GLDNKGFVNLPYLLRFDFLNILRDFDFLYEKDCPK

SEQ ID NO: 2397250 - protein, 34 aa, Entamoeba dispar
GLECSYALLPYETLLRMNLLIRPTKVNKLGNSYM

SEQ ID NO: 2397251 - protein, 30 aa, Entamoeba dispar
GLELFAIYITSFMLSLLLFAACTFHYQMAS

SEQ ID NO: 2397252 - protein, 24 aa, Entamoeba dispar
GLFGTLILLVVFNKALPALPISIF

SEQ ID NO: 2397253 - protein, 18 aa, Entamoeba dispar
GLFGYYIADEPSTNCVSS

SEQ ID NO: 2397254 - protein, 23 aa, Entamoeba dispar
GLGIAFYMLVWAISIFEPLLADY

SEQ ID NO: 2397255 - protein, 27 aa, Entamoeba dispar
GLGPKKIIWWIAMIFTILSIIEVICIP

SEQ ID NO: 2397256 - protein, 24 aa, Entamoeba dispar
GLKEYLEVYVLKDILKNPPQPSFS

SEQ ID NO: 2397257 - protein, 22 aa, Entamoeba dispar
GLKGKWFVYTPKDTEKVSIQTD

SEQ ID NO: 2397258 - protein, 18 aa, Entamoeba dispar
GLLEKVRGPDKMLMTIMM

SEQ ID NO: 2397259 - protein, 26 aa, Entamoeba dispar
GLLFLSLFIYFYFKKSNIHLKSLPSV

SEQ ID NO: 2397260 - protein, 18 aa, Entamoeba dispar
GLLIDKWEIIPIEEMLLV

SEQ ID NO: 2397261 - protein, 22 aa, Entamoeba dispar
GLNIGLFLFPILETLDPINGVT

SEQ ID NO: 2397262 - protein, 17 aa, Entamoeba dispar
GLQWFACGLVSFLTCHI

SEQ ID NO: 2397263 - protein, 23 aa, Entamoeba dispar
GLSGITMLTFIDFSFNTIKDVSP

SEQ ID NO: 2397264 - protein, 25 aa, Entamoeba dispar
GLSKPTNLPLICSFIIDGKLCFDTY

SEQ ID NO: 2397265 - protein, 26 aa, Entamoeba dispar
GLSQSLVALFRLFAPLISSPLIAWSF

SEQ ID NO: 2397266 - protein, 18 aa, Entamoeba dispar
GLSRMTFDIVLPSAIYRG

SEQ ID NO: 2397267 - protein, 22 aa, Entamoeba dispar
GLSSFQVFLYGIIPGFYSCTNG

SEQ ID NO: 2397268 - protein, 23 aa, Entamoeba dispar
GLSSFQVFLYGIIPGFYSCTNGD

SEQ ID NO: 2397269 - protein, 21 aa, Entamoeba dispar
GLTEGVFLEFPDMAKVPVTLS

SEQ ID NO: 2397270 - protein, 29 aa, Entamoeba dispar
GLTNTTILYLIRTLIFLTSSLKKAVNKTS

SEQ ID NO: 2397271 - protein, 26 aa, Entamoeba dispar
GLTVILCIILWIFVFINKTEAMNFLT

SEQ ID NO: 2397272 - protein, 23 aa, Entamoeba dispar
GLVFTFICALFYLLHAFGPCQKC

SEQ ID NO: 2397273 - protein, 30 aa, Entamoeba dispar
GLVILGCLLCIPYIIFEYLTLNDSNIVNNL

SEQ ID NO: 2397274 - protein, 23 aa, Entamoeba dispar
GLVIWIISFISMLAGKRFNKHNR

SEQ ID NO: 2397275 - protein, 26 aa, Entamoeba dispar
GLVKVILELFSQWLLPNPSKIDHILS

SEQ ID NO: 2397276 - protein, 21 aa, Entamoeba dispar
GLYQIYKAIAPMKNALDKIAQ

SEQ ID NO: 2397277 - protein, 18 aa, Entamoeba dispar
GMFGTSPIILGTFKCTVM

SEQ ID NO: 2397278 - protein, 17 aa, Entamoeba dispar
GMFYLHHCKPPILHRDL

SEQ ID NO: 2397279 - protein, 27 aa, Entamoeba dispar
GMIVKLAIIVLLILSILLVQSLLTINI

SEQ ID NO: 2397280 - protein, 31 aa, Entamoeba dispar
GMIWVWTIVVSFINWLSYWKSDWNDEAINNN

SEQ ID NO: 2397281 - protein, 18 aa, Entamoeba dispar
GMKQSLIESIIILIKEIC

SEQ ID NO: 2397282 - protein, 20 aa, Entamoeba dispar
GMLSQLRHQTIVSLIGAVYT

SEQ ID NO: 2397283 - protein, 18 aa, Entamoeba dispar
GMMIGFSSIVYLLLVAMQ

SEQ ID NO: 2397284 - protein, 18 aa, Entamoeba dispar
GMNYQKLYFAYLTTEPEE

SEQ ID NO: 2397285 - protein, 33 aa, Entamoeba dispar
GMTISLTPRKPIFLPLFTLNLSKQMTYYVFLIS

SEQ ID NO: 2397286 - protein, 17 aa, Entamoeba dispar
GMTLCLILYFIQFHILP

SEQ ID NO: 2397287 - protein, 32 aa, Entamoeba dispar
GMTMAIISISLFFMTLYIKPLAEFGGYDMPTG

SEQ ID NO: 2397288 - protein, 17 aa, Entamoeba dispar
GMVYLRLDATFTNSFYV

SEQ ID NO: 2397289 - protein, 18 aa, Entamoeba dispar
GMYYLHSRIPPIIHRDLK

SEQ ID NO: 2397290 - protein, 36 aa, Entamoeba dispar
GNCIDSYIFRLNNFGVYEYLPTINLLKNFNTTKING

SEQ ID NO: 2397291 - protein, 22 aa, Entamoeba dispar
GNDFIIFPPFIHQIDNIQITKG

SEQ ID NO: 2397292 - protein, 27 aa, Entamoeba dispar
GNDNYNNYYYYLPIQRTYINSNPINLK

SEQ ID NO: 2397293 - protein, 26 aa, Entamoeba dispar
GNEDDLLKYMLFWKNSSLLIYDIETS

SEQ ID NO: 2397294 - protein, 29 aa, Entamoeba dispar
GNEIFKNAILVTPYLPFTTDYNIADKVWK

SEQ ID NO: 2397295 - protein, 26 aa, Entamoeba dispar
GNFGARLLIKIFSICIDKMYSKKPLW

SEQ ID NO: 2397296 - protein, 25 aa, Entamoeba dispar
GNFIPYGVLIYYNDPALPSLMQCIM

SEQ ID NO: 2397297 - protein, 27 aa, Entamoeba dispar
GNFPQHILPLVFNWPSSQNAACYYCAA

SEQ ID NO: 2397298 - protein, 22 aa, Entamoeba dispar
GNGIMIIRIELPFGIWCDGCKN

SEQ ID NO: 2397299 - protein, 24 aa, Entamoeba dispar
GNGSLLTLLLSLLPLVMAGIVAVT

SEQ ID NO: 2397300 - protein, 25 aa, Entamoeba dispar
GNGVIIRFFAWLNYLKENKGKYDRV

SEQ ID NO: 2397301 - protein, 22 aa, Entamoeba dispar
GNIFTNHMVVLVGFGFEAQGEG

SEQ ID NO: 2397302 - protein, 25 aa, Entamoeba dispar
GNIKLVGINVFNELILEGSIIKSDT

SEQ ID NO: 2397303 - protein, 24 aa, Entamoeba dispar
GNILGMILLYIGFGVYVIGYSVYD

SEQ ID NO: 2397304 - protein, 23 aa, Entamoeba dispar
GNKEGIVLPFALKNKILLDTAKG

SEQ ID NO: 2397305 - protein, 22 aa, Entamoeba dispar
GNKHMMIIFHTPNNPKFVFHFE

SEQ ID NO: 2397306 - protein, 22 aa, Entamoeba dispar
GNLIEYALMSVLLLLGTKVLTI

SEQ ID NO: 2397307 - protein, 24 aa, Entamoeba dispar
GNNIIINLKKPLGPFYSKPVVDKF

SEQ ID NO: 2397308 - protein, 25 aa, Entamoeba dispar
GNNKRLLCRSLIYNPEPYYSKYNTC

SEQ ID NO: 2397309 - protein, 17 aa, Entamoeba dispar
GNTIFLPKLSPTNSPQG

SEQ ID NO: 2397310 - protein, 21 aa, Entamoeba dispar
GNYITLLNITGKYKVSVWGTS

SEQ ID NO: 2397311 - protein, 26 aa, Entamoeba dispar
GNYNKTIILFIIKYSFYNISLIETTI

SEQ ID NO: 2397312 - protein, 25 aa, Entamoeba dispar
GPEFTILPFLFISTGIFYPILVLLS

SEQ ID NO: 2397313 - protein, 24 aa, Entamoeba dispar
GPEGTLLGLLTPSEVFELPHGISY

SEQ ID NO: 2397314 - protein, 18 aa, Entamoeba dispar
GPFFVLTWKFYPSTSLSC

SEQ ID NO: 2397315 - protein, 22 aa, Entamoeba dispar
GPIFLEPFSMIGGLLWATGNLT

SEQ ID NO: 2397316 - protein, 17 aa, Entamoeba dispar
GPLLNLLVKHYSGLEAY

SEQ ID NO: 2397317 - protein, 18 aa, Entamoeba dispar
GPLWIPLTVVFLAFFSGS

SEQ ID NO: 2397318 - protein, 25 aa, Entamoeba dispar
GPMCGIILMYLLPFFVQFPMCLFTA

SEQ ID NO: 2397319 - protein, 22 aa, Entamoeba dispar
GPQLPFRFVYICEYIGPLALYV

SEQ ID NO: 2397320 - protein, 22 aa, Entamoeba dispar
GPSLLVPIGLIILTFLQSKDIH

SEQ ID NO: 2397321 - protein, 25 aa, Entamoeba dispar
GPTKQYYFKLLKRQLDLITDDMRWD

SEQ ID NO: 2397322 - protein, 22 aa, Entamoeba dispar
GPTTFLLSIGFFLVMLRSFSVI

SEQ ID NO: 2397323 - protein, 23 aa, Entamoeba dispar
GPYIILAIIRFILGLGIGGEYPL

SEQ ID NO: 2397324 - protein, 24 aa, Entamoeba dispar
GQFLRWFNFACLVLYLYGSLWAYA

SEQ ID NO: 2397325 - protein, 28 aa, Entamoeba dispar
GQHNYLYYYLFILFTVITTGLNCIIFLL

SEQ ID NO: 2397326 - protein, 41 aa, Entamoeba dispar
GQIAAIIICIIILISIIILIGIGIYLLYKRYQRRLEITRAN

SEQ ID NO: 2397327 - protein, 25 aa, Entamoeba dispar
GQIFAKIFFSLLIGSVFFNIQNDQQ

SEQ ID NO: 2397328 - protein, 18 aa, Entamoeba dispar
GQISFFIPVPTSKPKKFK

SEQ ID NO: 2397329 - protein, 21 aa, Entamoeba dispar
GQIVIPLYFASILQGLIDINT

SEQ ID NO: 2397330 - protein, 24 aa, Entamoeba dispar
GQKIGDYIIPLNYIVFAGNCKLDK

SEQ ID NO: 2397331 - protein, 20 aa, Entamoeba dispar
GQKKIKIFNGFYSTATELAE

SEQ ID NO: 2397332 - protein, 23 aa, Entamoeba dispar
GQLIIFTPIEWKCDNGISGVLVL

SEQ ID NO: 2397333 - protein, 20 aa, Entamoeba dispar
GQPVQQPMYAQPPPMGQPVQ

SEQ ID NO: 2397334 - protein, 21 aa, Entamoeba dispar
GQQFLFLWQLLGFSLSITFHI

SEQ ID NO: 2397335 - protein, 27 aa, Entamoeba dispar
GQQNHINPYWFHYLMDIGTSTIPEAIF

SEQ ID NO: 2397336 - protein, 31 aa, Entamoeba dispar
GQSMKFIPIILLRPIFRIPLKQNDLIIGVVT

SEQ ID NO: 2397337 - protein, 34 aa, Entamoeba dispar
GQSYFTSIFTTLYAIFVCIGMVLKIRPEVLLCNG

SEQ ID NO: 2397338 - protein, 24 aa, Entamoeba dispar
GQYIKKYFRTIFNYVSQQKEGKII

SEQ ID NO: 2397339 - protein, 20 aa, Entamoeba dispar
GRITPLGKVMVALPVAPPFA

SEQ ID NO: 2397340 - protein, 26 aa, Entamoeba dispar
GRKGIIYYLSLLLSTKYKKSTEIYYE

SEQ ID NO: 2397341 - protein, 26 aa, Entamoeba dispar
GRLMISIIIIFVFSFAPGIDYSAHIF

SEQ ID NO: 2397342 - protein, 19 aa, Entamoeba dispar
GRNPIKCSNLIIKSGKVSI

SEQ ID NO: 2397343 - protein, 24 aa, Entamoeba dispar
GRSYKIIIRPDLFLKIPSVISNDI

SEQ ID NO: 2397344 - protein, 18 aa, Entamoeba dispar
GRVLIPVTLYAEAGMVTQ

SEQ ID NO: 2397345 - protein, 21 aa, Entamoeba dispar
GRVVTPIRFLPKKNQYDCAVT

SEQ ID NO: 2397346 - protein, 50 aa, Entamoeba dispar
GSCRSKPIGWWVWLLIALGIVFIFICSIVMIFLLIRFTKGHKIDLNVFKT

SEQ ID NO: 2397347 - protein, 69 aa, Entamoeba dispar
GSEIFSIAIYFISFFVLKSYFDLSFVFSWEFWWKLVVIILLTSIPFIAKFFYQLIFPPKYMTVENRRCP

SEQ ID NO: 2397348 - protein, 19 aa, Entamoeba dispar
GSELLITFSFQPGSSNYFY

SEQ ID NO: 2397349 - protein, 25 aa, Entamoeba dispar
GSERIIFPMFFVNSKPLAGYDNSRS

SEQ ID NO: 2397350 - protein, 25 aa, Entamoeba dispar
GSGNEFGTFMYWAVRRDNKGTTFDN

SEQ ID NO: 2397351 - protein, 23 aa, Entamoeba dispar
GSHTPMFIGQTRVVRYYCQYQRA

SEQ ID NO: 2397352 - protein, 17 aa, Entamoeba dispar
GSIFLLSLLPDSPIPKV

SEQ ID NO: 2397353 - protein, 21 aa, Entamoeba dispar
GSILNFFHLLITRPDKLGALY

SEQ ID NO: 2397354 - protein, 22 aa, Entamoeba dispar
GSKELFVFLINLKIPLSMKVYE

SEQ ID NO: 2397355 - protein, 25 aa, Entamoeba dispar
GSKPQGKWCGPIICVIPAGDDMCYE

SEQ ID NO: 2397356 - protein, 26 aa, Entamoeba dispar
GSLCLMVFCYYYIKPFRKVIKIEPTS

SEQ ID NO: 2397357 - protein, 32 aa, Entamoeba dispar
GSLIITIIIFCTIEIGWYIYIFIHQKASLTSF

SEQ ID NO: 2397358 - protein, 18 aa, Entamoeba dispar
GSLIVLIVILLCCAFHSN

SEQ ID NO: 2397359 - protein, 22 aa, Entamoeba dispar
GSLKKYLQSMPTSTLLKLRFCQ

SEQ ID NO: 2397360 - protein, 24 aa, Entamoeba dispar
GSLTTLLFFYKPLVRQFGLRLTYV

SEQ ID NO: 2397361 - protein, 35 aa, Entamoeba dispar
GSPWCYFVAIYEAILFILMVFRFISYAVSSIIKST

SEQ ID NO: 2397362 - protein, 35 aa, Entamoeba dispar
GSRAFGLFPLEFFGPPIMVLFMAIGFTIFSIILPF

SEQ ID NO: 2397363 - protein, 25 aa, Entamoeba dispar
GSTRYKIHLYILQLIIHSYSNSLHL

SEQ ID NO: 2397364 - protein, 23 aa, Entamoeba dispar
GSVLFIFAFGHFLMIITNQTSLE

SEQ ID NO: 2397365 - protein, 24 aa, Entamoeba dispar
GSVYIYFDNLLSGYSPRFELLESY

SEQ ID NO: 2397366 - protein, 20 aa, Entamoeba dispar
GSYFRFNTHVPLQLTIRTCS

SEQ ID NO: 2397367 - protein, 29 aa, Entamoeba dispar
GSYGLIVFVVLIFIIIRFISLGAFNGKAS

SEQ ID NO: 2397368 - protein, 26 aa, Entamoeba dispar
GTAATGFVFMLAMLASLNYQINKHIP

SEQ ID NO: 2397369 - protein, 27 aa, Entamoeba dispar
GTAGEIFCFLFFGFSLLPCFDKILGNC

SEQ ID NO: 2397370 - protein, 30 aa, Entamoeba dispar
GTCVPVCICCWFLNLFQNKKTRIIYLESVC

SEQ ID NO: 2397371 - protein, 22 aa, Entamoeba dispar
GTCVYYCTIPTKLNPDNIVVLE

SEQ ID NO: 2397372 - protein, 18 aa, Entamoeba dispar
GTCWDFALIGFLEDNYRQ

SEQ ID NO: 2397373 - protein, 24 aa, Entamoeba dispar
GTCWIFATISLIESSLRKIAIENG

SEQ ID NO: 2397374 - protein, 53 aa, Entamoeba dispar
GTECIYHLNLFIIIGIPIIIIFLFIIIFMFSCFLIILIIRKQQQKKIKEATIC

SEQ ID NO: 2397375 - protein, 18 aa, Entamoeba dispar
GTEDGLVLIFKYSQDEAI

SEQ ID NO: 2397376 - protein, 25 aa, Entamoeba dispar
GTEKPTIDLLKRKPFKRTDSLLSKQ

SEQ ID NO: 2397377 - protein, 26 aa, Entamoeba dispar
GTFAFIILLCYLVRLNFSYIKKQAES

SEQ ID NO: 2397378 - protein, 37 aa, Entamoeba dispar
GTFPDGFYEYFHFKFPSLFTVLYSFIKEFYSHSDSLS

SEQ ID NO: 2397379 - protein, 24 aa, Entamoeba dispar
GTGLGCMMFFIMSSNALGSWYGNF

SEQ ID NO: 2397380 - protein, 21 aa, Entamoeba dispar
GTILLIWNYQMGVPALLSIVP

SEQ ID NO: 2397381 - protein, 19 aa, Entamoeba dispar
GTIYPLKIYEDLFTLISTE

SEQ ID NO: 2397382 - protein, 28 aa, Entamoeba dispar
GTKPKEWQMKYTKYPYWRCGLTFTNEEK

SEQ ID NO: 2397383 - protein, 29 aa, Entamoeba dispar
GTLIILLILFFILFWVFKGDELITSGQEY

SEQ ID NO: 2397384 - protein, 24 aa, Entamoeba dispar
GTLPSFFDFFVTSKLRNLLVSILG

SEQ ID NO: 2397385 - protein, 28 aa, Entamoeba dispar
GTLSIIVFLLFNLIRLTPFDIKQKLNSV

SEQ ID NO: 2397386 - protein, 25 aa, Entamoeba dispar
GTNKNKILKLSYNPSSLTFNSPYNE

SEQ ID NO: 2397387 - protein, 25 aa, Entamoeba dispar
GTPESPLFFLKWLNRKRNNLGESKI

SEQ ID NO: 2397388 - protein, 24 aa, Entamoeba dispar
GTSSNDSWRYLFTGRITSVNTNDN

SEQ ID NO: 2397389 - protein, 25 aa, Entamoeba dispar
GTSYYASMFGCSIMRKLKSFNTVEV

SEQ ID NO: 2397390 - protein, 40 aa, Entamoeba dispar
GTTAISIWTIFALPKLPGIWVLLFITSACLWVSFWRTRNE

SEQ ID NO: 2397391 - protein, 20 aa, Entamoeba dispar
GTTCMTVNLVMIIIGIITLI

SEQ ID NO: 2397392 - protein, 26 aa, Entamoeba dispar
GTTRAYMALTFYKNTKYYLFIQSEED

SEQ ID NO: 2397393 - protein, 25 aa, Entamoeba dispar
GTVYLQLIHFFLSTLSLMVHASTSL

SEQ ID NO: 2397394 - protein, 18 aa, Entamoeba dispar
GTYKNYIYLGTTSVIHMI

SEQ ID NO: 2397395 - protein, 21 aa, Entamoeba dispar
GTYLTVVFLLNYGLSTLCPLP

SEQ ID NO: 2397396 - protein, 26 aa, Entamoeba dispar
GVAAVHEIYFIYKAIIEPSGIILKES

SEQ ID NO: 2397397 - protein, 31 aa, Entamoeba dispar
GVALRFITNGLLLIILISLPMGIIAAYEFQG

SEQ ID NO: 2397398 - protein, 17 aa, Entamoeba dispar
GVAYYFIDYSKTLRNIV

SEQ ID NO: 2397399 - protein, 19 aa, Entamoeba dispar
GVCNSNCYLGYVKSADGKC

SEQ ID NO: 2397400 - protein, 17 aa, Entamoeba dispar
GVCQPCSKLFHCKLCDS

SEQ ID NO: 2397401 - protein, 29 aa, Entamoeba dispar
GVDKKRVDYPLWFLCLYDAAGRASKALET

SEQ ID NO: 2397402 - protein, 24 aa, Entamoeba dispar
GVEYLFEYYIKQIILRCSIIDKGL

SEQ ID NO: 2397403 - protein, 17 aa, Entamoeba dispar
GVFAPWVYGISTIILML

SEQ ID NO: 2397404 - protein, 21 aa, Entamoeba dispar
GVFVRMVLFPAVSWICTFFMW

SEQ ID NO: 2397405 - protein, 22 aa, Entamoeba dispar
GVGFIFSLIWAITHHWIFNNFL

SEQ ID NO: 2397406 - protein, 32 aa, Entamoeba dispar
GVGKAKWWALIIKYMILLFPIVNLTNEFPLVA

SEQ ID NO: 2397407 - protein, 17 aa, Entamoeba dispar
GVGVYCALIPTAWWIHP

SEQ ID NO: 2397408 - protein, 19 aa, Entamoeba dispar
GVHYMIVFSILICYAVQDK

SEQ ID NO: 2397409 - protein, 31 aa, Entamoeba dispar
GVIGSFILITCTILLIIKIRNKKKNTFTSFN

SEQ ID NO: 2397410 - protein, 19 aa, Entamoeba dispar
GVIMIYFIPGIVSFVYGGK

SEQ ID NO: 2397411 - protein, 18 aa, Entamoeba dispar
GVIMLLFVFGINSLIIMI

SEQ ID NO: 2397412 - protein, 23 aa, Entamoeba dispar
GVIVIYVFWLVFGIIRTYSESRK

SEQ ID NO: 2397413 - protein, 20 aa, Entamoeba dispar
GVKFFGFPLLGTWILRQAQP

SEQ ID NO: 2397414 - protein, 38 aa, Entamoeba dispar
GVKPRKGLWYKVVNNYKYAFPLFIQTNVLLASSTKHTA

SEQ ID NO: 2397415 - protein, 19 aa, Entamoeba dispar
GVLLILFKFTFIGLFIEFF

SEQ ID NO: 2397416 - protein, 20 aa, Entamoeba dispar
GVLNWVGCTLVIHKRKRTAV

SEQ ID NO: 2397417 - protein, 26 aa, Entamoeba dispar
GVNCECDVGYFYSTYMRQCYPQIGQS

SEQ ID NO: 2397418 - protein, 21 aa, Entamoeba dispar
GVNYPYILRKLIPPTTFVTLN

SEQ ID NO: 2397419 - protein, 28 aa, Entamoeba dispar
GVPKKKLFPLLLMLLIEGISQNIINAYV

SEQ ID NO: 2397420 - protein, 18 aa, Entamoeba dispar
GVPNILIMFGVFSIFFML

SEQ ID NO: 2397421 - protein, 24 aa, Entamoeba dispar
GVQGFTVFVLYFIIKKKKRTQVNM

SEQ ID NO: 2397422 - protein, 19 aa, Entamoeba dispar
GVQIIFTLMSMIGISIYGL

SEQ ID NO: 2397423 - protein, 17 aa, Entamoeba dispar
GVQLFKIAHVYSFAIAL

SEQ ID NO: 2397424 - protein, 40 aa, Entamoeba dispar
GVSSIIIAVICIFILILIIALISVLYKKWSRKHAKSFTID

SEQ ID NO: 2397425 - protein, 25 aa, Entamoeba dispar
GVVCSIWFIIMSCLTFFMTGVFGLV

SEQ ID NO: 2397426 - protein, 17 aa, Entamoeba dispar
GVVLFFIELLKETPNIY

SEQ ID NO: 2397427 - protein, 24 aa, Entamoeba dispar
GVVYLIVIAFMQILTSFCFQLSIK

SEQ ID NO: 2397428 - protein, 19 aa, Entamoeba dispar
GVWGKIVSWLLFIGALLTS

SEQ ID NO: 2397429 - protein, 20 aa, Entamoeba dispar
GVYCALIPTAWWIHPSSESL

SEQ ID NO: 2397430 - protein, 20 aa, Entamoeba dispar
GVYIAFVPTAWWLHPSEDSI

SEQ ID NO: 2397431 - protein, 25 aa, Entamoeba dispar
GVYPLSILIMVFSGIWPYTKLVMLL

SEQ ID NO: 2397432 - protein, 24 aa, Entamoeba dispar
GVYPSLMILILFLIVNNITSGYVL

SEQ ID NO: 2397433 - protein, 33 aa, Entamoeba dispar
GVYSGPFMFFLHYFLLLISCFLNFIWPKESIEK

SEQ ID NO: 2397434 - protein, 31 aa, Entamoeba dispar
GWAVVSMYLTFSGFFMVFFTLCTQVKTWNLW

SEQ ID NO: 2397435 - protein, 19 aa, Entamoeba dispar
GWHYILLILVAVCLNFPFI

SEQ ID NO: 2397436 - protein, 25 aa, Entamoeba dispar
GWKLSSLEIKLIMTLRIDFSKQKIR

SEQ ID NO: 2397437 - protein, 24 aa, Entamoeba dispar
GWSKLIFTYFMPAIVFYQTATAID

SEQ ID NO: 2397438 - protein, 40 aa, Entamoeba dispar
GYANHKYFFLTLFYTFILCTFLFVLTILILCTIIAKIISK

SEQ ID NO: 2397439 - protein, 27 aa, Entamoeba dispar
GYDDTVDIPFVSLLFAIINGIVRLSSG

SEQ ID NO: 2397440 - protein, 18 aa, Entamoeba dispar
GYDQSLLNHMYFAGYFNS

SEQ ID NO: 2397441 - protein, 24 aa, Entamoeba dispar
GYDRLMFCLFFPEFINFFVSIPQL

SEQ ID NO: 2397442 - protein, 18 aa, Entamoeba dispar
GYFFTLKKSRKMSSTIRI

SEQ ID NO: 2397443 - protein, 21 aa, Entamoeba dispar
GYICLFISVILFGSNYIVTKK

SEQ ID NO: 2397444 - protein, 45 aa, Entamoeba dispar
GYIETIIIRMLPLLKEYFYPFITKFLPFLLQRCKIQIPIKNASGL

SEQ ID NO: 2397445 - protein, 29 aa, Entamoeba dispar
GYIQRPTIPQPFKFISLPSTYQQLINEVL

SEQ ID NO: 2397446 - protein, 27 aa, Entamoeba dispar
GYISNCIIILSEFFKFSLDKTYLMEAY

SEQ ID NO: 2397447 - protein, 30 aa, Entamoeba dispar
GYLSIIFLLFVLFIESLLFCLQWITKSNKA

SEQ ID NO: 2397448 - protein, 17 aa, Entamoeba dispar
GYLSRWVEKIISPYDDV

SEQ ID NO: 2397449 - protein, 20 aa, Entamoeba dispar
GYLTLLKYFSSFTSKNLILL

SEQ ID NO: 2397450 - protein, 23 aa, Entamoeba dispar
GYPIRIEEILSYGIILTSKNSND

SEQ ID NO: 2397451 - protein, 18 aa, Entamoeba dispar
GYQHGHSLKYWLQQHSIK

SEQ ID NO: 2397452 - protein, 25 aa, Entamoeba dispar
GYSYAIVYFFLIFVRLLNSNDLYPQ

SEQ ID NO: 2397453 - protein, 26 aa, Entamoeba dispar
GYVIQITILMFPLVNLTSEYPLVSAT

SEQ ID NO: 2397454 - protein, 19 aa, Entamoeba dispar
GYVSIKYPMLINSITQKLN

SEQ ID NO: 2397455 - protein, 25 aa, Entamoeba dispar
GYYLSLIEMIFTLISMWCRNYKVLM

SEQ ID NO: 2397456 - protein, 34 aa, Entamoeba dispar
HADMLWKLVDTFFTFPVTYPFSVTCAYLRSLQQL

SEQ ID NO: 2397457 - protein, 24 aa, Entamoeba dispar
HAKVPLEYVFPFIKNLFQTHCKDR

SEQ ID NO: 2397458 - protein, 40 aa, Entamoeba dispar
HAMDCTYLSEYYTFKLRPLQEFIPHEYLWNSLSTEGVETQ

SEQ ID NO: 2397459 - protein, 17 aa, Entamoeba dispar
HATLGRTYLYPCDSKSP

SEQ ID NO: 2397460 - protein, 34 aa, Entamoeba dispar
HCFYLICGLVILLLILYFVFFKMDWSSSKVDIVP

SEQ ID NO: 2397461 - protein, 17 aa, Entamoeba dispar
HCMKLKPLALPITISQL

SEQ ID NO: 2397462 - protein, 22 aa, Entamoeba dispar
HCSVHLIGIFKILIDNLSTGKR

SEQ ID NO: 2397463 - protein, 19 aa, Entamoeba dispar
HCYVNHQIQIFVNGVIHEF

SEQ ID NO: 2397464 - protein, 20 aa, Entamoeba dispar
HDGAPIYIVPTSSKLFCCSA

SEQ ID NO: 2397465 - protein, 28 aa, Entamoeba dispar
HDGDMRLYWVIFVLSIISGLIPSTRALS

SEQ ID NO: 2397466 - protein, 26 aa, Entamoeba dispar
HDGFDIEWYHLECVPAQFKTIKLSST

SEQ ID NO: 2397467 - protein, 25 aa, Entamoeba dispar
HDGTYDIVFTPPYAGNYLIAVYVND

SEQ ID NO: 2397468 - protein, 18 aa, Entamoeba dispar
HDIIIYNSLIEIKKGPLY

SEQ ID NO: 2397469 - protein, 18 aa, Entamoeba dispar
HDLFMNTLTQWCKIRGAQ

SEQ ID NO: 2397470 - protein, 27 aa, Entamoeba dispar
HDNIIGLIRFTVLQLFYQFKTNKMTFF

SEQ ID NO: 2397471 - protein, 17 aa, Entamoeba dispar
HDSIIISILNFIELILN

SEQ ID NO: 2397472 - protein, 42 aa, Entamoeba dispar
HEFNFIQYIAYFGSLIFYFGWGFVYGLITWIPPFTIGWDMFG

SEQ ID NO: 2397473 - protein, 28 aa, Entamoeba dispar
HEHQHAFFPLYPLTIRLFSLIGTISGFS

SEQ ID NO: 2397474 - protein, 24 aa, Entamoeba dispar
HEKPEDVVLPYKLKMRMLLDCAKG

SEQ ID NO: 2397475 - protein, 21 aa, Entamoeba dispar
HERFYIRYQSYTNRPYLNLQV

SEQ ID NO: 2397476 - protein, 19 aa, Entamoeba dispar
HESGYVWESVYPNNKCELD

SEQ ID NO: 2397477 - protein, 23 aa, Entamoeba dispar
HEYKKVHDKYFWQAFDTGKDAYM

SEQ ID NO: 2397478 - protein, 18 aa, Entamoeba dispar
HFDRTPKVWLLGYDEDHK

SEQ ID NO: 2397479 - protein, 19 aa, Entamoeba dispar
HFFKRKQLRKIYNKMKYSV

SEQ ID NO: 2397480 - protein, 21 aa, Entamoeba dispar
HFFSDPYFFVRDMVLGLALDC

SEQ ID NO: 2397481 - protein, 27 aa, Entamoeba dispar
HFGYYGISGLWHLFEVGNFTAGKFIER

SEQ ID NO: 2397482 - protein, 25 aa, Entamoeba dispar
HFIGFLCLLISPFFLYGPMGMIKKI

SEQ ID NO: 2397483 - protein, 19 aa, Entamoeba dispar
HFISEALQIFFISIQDSFL

SEQ ID NO: 2397484 - protein, 17 aa, Entamoeba dispar
HFLFSLNANGRVVTPIR

SEQ ID NO: 2397485 - protein, 17 aa, Entamoeba dispar
HFLYYFLIFFCPSFIVF

SEQ ID NO: 2397486 - protein, 25 aa, Entamoeba dispar
HFRIVAVLLKYWLKIRNLNCPFKGG

SEQ ID NO: 2397487 - protein, 35 aa, Entamoeba dispar
HFRKIHYIVMTIFLILFFLFTIILGIFGPSEYSLK

SEQ ID NO: 2397488 - protein, 55 aa, Entamoeba dispar
HFSIGPAIITLLLALLFSILSGLVIFILPKLPGIWFYCWGITCTLWFSTFQNKNE

SEQ ID NO: 2397489 - protein, 17 aa, Entamoeba dispar
HFTFFVMAVVPLINFLL

SEQ ID NO: 2397490 - protein, 18 aa, Entamoeba dispar
HFTFNYMKFLTNFVSVGN

SEQ ID NO: 2397491 - protein, 19 aa, Entamoeba dispar
HFVFTLKNPFNIEPMILHR

SEQ ID NO: 2397492 - protein, 24 aa, Entamoeba dispar
HFYEMKLLILGFIIFCICGVLECF

SEQ ID NO: 2397493 - protein, 20 aa, Entamoeba dispar
HFYFYIILAGMYILQFIIPP

SEQ ID NO: 2397494 - protein, 24 aa, Entamoeba dispar
HGDGMAFWLTPEQLEIGTALGGQE

SEQ ID NO: 2397495 - protein, 31 aa, Entamoeba dispar
HGDKPIIAKNYKYLTFALNWEDQFCNLRITI

SEQ ID NO: 2397496 - protein, 17 aa, Entamoeba dispar
HGFFFKMFAIWYTGELA

SEQ ID NO: 2397497 - protein, 19 aa, Entamoeba dispar
HGFIPMKEEIKMLPNSKGH

SEQ ID NO: 2397498 - protein, 20 aa, Entamoeba dispar
HGFLHFLIGICSIVGGIFTT

SEQ ID NO: 2397499 - protein, 21 aa, Entamoeba dispar
HGFLYIIMEYMESGSLLNIVK

SEQ ID NO: 2397500 - protein, 25 aa, Entamoeba dispar
HGGDYLKYTISFIPAILSVHPGETG

SEQ ID NO: 2397501 - protein, 24 aa, Entamoeba dispar
HGHWLIFPHLQFLGTLIFYYLAIK

SEQ ID NO: 2397502 - protein, 18 aa, Entamoeba dispar
HGLKIPGGIIGGLWYCLY

SEQ ID NO: 2397503 - protein, 23 aa, Entamoeba dispar
HGPTAFINWFDPDSWYPLGRNIG

SEQ ID NO: 2397504 - protein, 24 aa, Entamoeba dispar
HGRKNVLFLITTTEGWAFGAFIAG

SEQ ID NO: 2397505 - protein, 31 aa, Entamoeba dispar
HGSYRNYIAYFYYFLPFNIMIDKEKHMYLIP

SEQ ID NO: 2397506 - protein, 22 aa, Entamoeba dispar
HGVGGYFFLQAFETIQCLFSIY

SEQ ID NO: 2397507 - protein, 18 aa, Entamoeba dispar
HHELLSFCLLTTDIITVI

SEQ ID NO: 2397508 - protein, 25 aa, Entamoeba dispar
HHFKKSFNIPFELEFFMNLSNKSVI

SEQ ID NO: 2397509 - protein, 17 aa, Entamoeba dispar
HHIAGVPQIPLVVNSKS

SEQ ID NO: 2397510 - protein, 27 aa, Entamoeba dispar
HHICNTTLMLLLRYFELNMNKQTQKFI

SEQ ID NO: 2397511 - protein, 23 aa, Entamoeba dispar
HHISSFHFPILTWVVEDYNQIMK

SEQ ID NO: 2397512 - protein, 18 aa, Entamoeba dispar
HICIVWTKCYNYTPESKL

SEQ ID NO: 2397513 - protein, 22 aa, Entamoeba dispar
HICKVHFGILLKEKDEWTFNES

SEQ ID NO: 2397514 - protein, 17 aa, Entamoeba dispar
HIDPFVALSFLDATLMI

SEQ ID NO: 2397515 - protein, 27 aa, Entamoeba dispar
HIDPYWFHYLMDIGAWLYPTDIFGSMI

SEQ ID NO: 2397516 - protein, 23 aa, Entamoeba dispar
HIFQTIFLPCIIFNAGFTMKKRN

SEQ ID NO: 2397517 - protein, 23 aa, Entamoeba dispar
HIFSNIFCRNMLLFISRSTKTAK

SEQ ID NO: 2397518 - protein, 18 aa, Entamoeba dispar
HIIPFVFSWPSCSNPFLY

SEQ ID NO: 2397519 - protein, 29 aa, Entamoeba dispar
HILLQCVIGPIYHLMISYYQLRAVLGKIL

SEQ ID NO: 2397520 - protein, 23 aa, Entamoeba dispar
HILSYSQFLFLELVDESVAKEMF

SEQ ID NO: 2397521 - protein, 17 aa, Entamoeba dispar
HILTDKPVIEFYGDDEL

SEQ ID NO: 2397522 - protein, 32 aa, Entamoeba dispar
HINKLMVLSFLSFMLLILLSLAVLLQSFVIEV

SEQ ID NO: 2397523 - protein, 33 aa, Entamoeba dispar
HINPYNVVAYLPYLIKVIPNISALYINALEAQD

SEQ ID NO: 2397524 - protein, 25 aa, Entamoeba dispar
HISKTLYFQPRLLPHIEPITLNEYW

SEQ ID NO: 2397525 - protein, 24 aa, Entamoeba dispar
HITPPYQVLTFPTLSPTPIIQYIH

SEQ ID NO: 2397526 - protein, 17 aa, Entamoeba dispar
HKIWKYYERFGYQNSEE

SEQ ID NO: 2397527 - protein, 30 aa, Entamoeba dispar
HKKGLEVIPNYLFWIGLPSLLVDGVKFTFC

SEQ ID NO: 2397528 - protein, 22 aa, Entamoeba dispar
HKKYLGIDQLLISLISPMCSPE

SEQ ID NO: 2397529 - protein, 18 aa, Entamoeba dispar
HKLGKITSLLFSVGPVFY

SEQ ID NO: 2397530 - protein, 23 aa, Entamoeba dispar
HKLSSVSIVLFLFTSDSLDVLKE

SEQ ID NO: 2397531 - protein, 25 aa, Entamoeba dispar
HKQTSTINILLPLSPLNVPDNYGQL

SEQ ID NO: 2397532 - protein, 17 aa, Entamoeba dispar
HLACALGFLESVQKLIE

SEQ ID NO: 2397533 - protein, 35 aa, Entamoeba dispar
HLDSLFYTFTIPIKLSLFLISPPYLTILSPDFLSL

SEQ ID NO: 2397534 - protein, 20 aa, Entamoeba dispar
HLFFIFYFLFIHSSLISFTI

SEQ ID NO: 2397535 - protein, 19 aa, Entamoeba dispar
HLHHKFLLNFIPTIPKNHI

SEQ ID NO: 2397536 - protein, 31 aa, Entamoeba dispar
HLHLDHVGMVYKNGFWYLMEKAGITFGKFID

SEQ ID NO: 2397537 - protein, 24 aa, Entamoeba dispar
HLHYHKVFSFVFPGKRNELFAIGL

SEQ ID NO: 2397538 - protein, 19 aa, Entamoeba dispar
HLIIGLLFYMYVLFDTLDG

SEQ ID NO: 2397539 - protein, 17 aa, Entamoeba dispar
HLKLLKKKTKSTKELLG

SEQ ID NO: 2397540 - protein, 17 aa, Entamoeba dispar
HLKLLLPKLSILINYIV

SEQ ID NO: 2397541 - protein, 20 aa, Entamoeba dispar
HLKRKILISRLLIGGLITFW

SEQ ID NO: 2397542 - protein, 24 aa, Entamoeba dispar
HLLSVLCILLASLNYKVLICASTN

SEQ ID NO: 2397543 - protein, 23 aa, Entamoeba dispar
HLNKIKLLQLIKKELFEWSCSGD

SEQ ID NO: 2397544 - protein, 25 aa, Entamoeba dispar
HLPMNDFPIFFDIFKHFITVHFKDP

SEQ ID NO: 2397545 - protein, 22 aa, Entamoeba dispar
HLPNIFLSIIIKLGIIGILVIS

SEQ ID NO: 2397546 - protein, 27 aa, Entamoeba dispar
HLQNIMKPLLLPLFEQSNKNMWEQVRK

SEQ ID NO: 2397547 - protein, 19 aa, Entamoeba dispar
HLQQLILLQYLFKKNEIEQ

SEQ ID NO: 2397548 - protein, 24 aa, Entamoeba dispar
HLQTFLVVVSLFIEILPQLIEDND

SEQ ID NO: 2397549 - protein, 31 aa, Entamoeba dispar
HLSTECLSFLNSFYLLFASSPAKLLVVGLGS

SEQ ID NO: 2397550 - protein, 18 aa, Entamoeba dispar
HLSWYKTLSEKQGERGNY

SEQ ID NO: 2397551 - protein, 21 aa, Entamoeba dispar
HLTLKPKETVMFFITTDETEG

SEQ ID NO: 2397552 - protein, 19 aa, Entamoeba dispar
HLVLYISFTLIFISFYHIN

SEQ ID NO: 2397553 - protein, 20 aa, Entamoeba dispar
HMAGYWILFVVGSIVFVGLI

SEQ ID NO: 2397554 - protein, 25 aa, Entamoeba dispar
HMEPSQVILFTFQKKYKPLIHVIEG

SEQ ID NO: 2397555 - protein, 20 aa, Entamoeba dispar
HMGRFIIWTESAFKKLNTIF

SEQ ID NO: 2397556 - protein, 21 aa, Entamoeba dispar
HNARYFFLFMVGCFRGMLICD

SEQ ID NO: 2397557 - protein, 22 aa, Entamoeba dispar
HNDILILVGAIAELRQMFVDLA

SEQ ID NO: 2397558 - protein, 24 aa, Entamoeba dispar
HNIRYFYLFLLYGSIITITNFIKI

SEQ ID NO: 2397559 - protein, 23 aa, Entamoeba dispar
HNRFYQEILALARSIDFRRERDE

SEQ ID NO: 2397560 - protein, 25 aa, Entamoeba dispar
HNTLTFILCFLLGVCYNFHGNIIAG

SEQ ID NO: 2397561 - protein, 24 aa, Entamoeba dispar
HNTTYLFLMIFDVMLTILIADFIN

SEQ ID NO: 2397562 - protein, 17 aa, Entamoeba dispar
HNVFERIFSNWYFLGIC

SEQ ID NO: 2397563 - protein, 17 aa, Entamoeba dispar
HPGFYLNDKNQCEPCGR

SEQ ID NO: 2397564 - protein, 20 aa, Entamoeba dispar
HPIIIIFLHIDNSKSMLLFK

SEQ ID NO: 2397565 - protein, 17 aa, Entamoeba dispar
HPIPVYLQRLKGEGTHL

SEQ ID NO: 2397566 - protein, 26 aa, Entamoeba dispar
HPKSRKLFYYFLINLAFMFVEVAYGW

SEQ ID NO: 2397567 - protein, 22 aa, Entamoeba dispar
HPLDRMIGMLYPTERRFSILKA

SEQ ID NO: 2397568 - protein, 23 aa, Entamoeba dispar
HPNLHDQVFYYDIALDILNGLKY

SEQ ID NO: 2397569 - protein, 24 aa, Entamoeba dispar
HPSYIYTLFYVPVYFNFLGNIIPL

SEQ ID NO: 2397570 - protein, 24 aa, Entamoeba dispar
HPTKPYTYGQYLKVTLPAGQEDTY

SEQ ID NO: 2397571 - protein, 20 aa, Entamoeba dispar
HPYYCGISCFLKSYNSPMVH

SEQ ID NO: 2397572 - protein, 22 aa, Entamoeba dispar
HQELIELKGFYYTLAMQQFGTM

SEQ ID NO: 2397573 - protein, 24 aa, Entamoeba dispar
HQHVSHFFTFFFASQIIGLTRYAF

SEQ ID NO: 2397574 - protein, 17 aa, Entamoeba dispar
HQINIFREILWAVSNFA

SEQ ID NO: 2397575 - protein, 33 aa, Entamoeba dispar
HQMKKAMCWRKWKLWIIIGVIAAIIIAVIVVVV

SEQ ID NO: 2397576 - protein, 23 aa, Entamoeba dispar
HQNQLLLLFKPLINSIEKIVLQN

SEQ ID NO: 2397577 - protein, 24 aa, Entamoeba dispar
HQVIEQFYFIFESYTPHTSILTEL

SEQ ID NO: 2397578 - protein, 18 aa, Entamoeba dispar
HQVLDGLTFIHDQAANIL

SEQ ID NO: 2397579 - protein, 19 aa, Entamoeba dispar
HRDVKSPNVLLKFNQQHQL

SEQ ID NO: 2397580 - protein, 25 aa, Entamoeba dispar
HRKYILTFSFFILTNIILLFIEIRL

SEQ ID NO: 2397581 - protein, 32 aa, Entamoeba dispar
HRTFINLINILFIILYWIEVVASLILSFSMLF

SEQ ID NO: 2397582 - protein, 18 aa, Entamoeba dispar
HSAHLYQEKEACKFAFEI

SEQ ID NO: 2397583 - protein, 35 aa, Entamoeba dispar
HSGNNNIIMILLGFVLVVLLGISSIIIIKLMKKKS

SEQ ID NO: 2397584 - protein, 17 aa, Entamoeba dispar
HSIFLLNGELKITEPIV

SEQ ID NO: 2397585 - protein, 55 aa, Entamoeba dispar
HSKHPSLFLVIFKLEWKMFLLCYITIVTYELIALAFPLMLQYVIKWINNPQGTLK

SEQ ID NO: 2397586 - protein, 23 aa, Entamoeba dispar
HSLPFFIIGFIRLFATRATGYQH

SEQ ID NO: 2397587 - protein, 31 aa, Entamoeba dispar
HSSKFKPLLTFFLSLYPYWNPYDPQHNTIID

SEQ ID NO: 2397588 - protein, 40 aa, Entamoeba dispar
HSYKSWSLILLWCSLILFEFLLIVLSIISFFSLVDGVVDF

SEQ ID NO: 2397589 - protein, 22 aa, Entamoeba dispar
HTCFSFLNFTRYQTAGLGVAFP

SEQ ID NO: 2397590 - protein, 25 aa, Entamoeba dispar
HTDKQFVIWIQVPKKDKFFLQSDIE

SEQ ID NO: 2397591 - protein, 25 aa, Entamoeba dispar
HTKVLFYMPPLIKQWNDNICILIGG

SEQ ID NO: 2397592 - protein, 17 aa, Entamoeba dispar
HTMMVMEYAPFGSVKKA

SEQ ID NO: 2397593 - protein, 22 aa, Entamoeba dispar
HTSFILHILLFVITPFALVFIE

SEQ ID NO: 2397594 - protein, 20 aa, Entamoeba dispar
HTSLQFFPILVVSYIIRIPK

SEQ ID NO: 2397595 - protein, 27 aa, Entamoeba dispar
HTTVERLLWFNSHGFLHLVMKCISITQ

SEQ ID NO: 2397596 - protein, 17 aa, Entamoeba dispar
HTYFIPHIIALTGWMYL

SEQ ID NO: 2397597 - protein, 18 aa, Entamoeba dispar
HVFGEIFAENGFLQRSDQ

SEQ ID NO: 2397598 - protein, 33 aa, Entamoeba dispar
HVIDENVKILFPKYLPLFSKIVYLVKKFFAKEG

SEQ ID NO: 2397599 - protein, 18 aa, Entamoeba dispar
HVNLKYLLQSNVLLKLKN

SEQ ID NO: 2397600 - protein, 17 aa, Entamoeba dispar
HVREPYWRVYNNMYIGN

SEQ ID NO: 2397601 - protein, 25 aa, Entamoeba dispar
HVTNIYFLLVAIISLIPQISATNPI

SEQ ID NO: 2397602 - protein, 25 aa, Entamoeba dispar
HWNHYVRMFFQELLLYRCTVSPSRN

SEQ ID NO: 2397603 - protein, 26 aa, Entamoeba dispar
HYIATTIFLFIMITSGIITILSWRGT

SEQ ID NO: 2397604 - protein, 19 aa, Entamoeba dispar
HYIVLLIYTWGQRLMGIWI

SEQ ID NO: 2397605 - protein, 21 aa, Entamoeba dispar
HYKDFLPHLVPSNRKPRTIVE

SEQ ID NO: 2397606 - protein, 20 aa, Entamoeba dispar
HYLQPSCFILPTSLQTITFT

SEQ ID NO: 2397607 - protein, 27 aa, Entamoeba dispar
HYNFPADIFAFAITMYQLLSWNDPYPN

SEQ ID NO: 2397608 - protein, 17 aa, Entamoeba dispar
HYPFLLLKAFCIGFVIS

SEQ ID NO: 2397609 - protein, 18 aa, Entamoeba dispar
IAAGDKYVFVKKGKSISL

SEQ ID NO: 2397610 - protein, 17 aa, Entamoeba dispar
IAAIIIIVIIVAIVIPL

SEQ ID NO: 2397611 - protein, 20 aa, Entamoeba dispar
IADIWCFTPGIFPLIRSGAT

SEQ ID NO: 2397612 - protein, 21 aa, Entamoeba dispar
IAEHLIHRFVLLSKSFEKDPI

SEQ ID NO: 2397613 - protein, 27 aa, Entamoeba dispar
IAEKHFPRLFSWRSFHSYIKELSIDEQ

SEQ ID NO: 2397614 - protein, 25 aa, Entamoeba dispar
IAEMVMVAIFGVVLILTCVNKPKQK

SEQ ID NO: 2397615 - protein, 24 aa, Entamoeba dispar
IAFFYLIFLVQSTNYETIIESESS

SEQ ID NO: 2397616 - protein, 17 aa, Entamoeba dispar
IAFIDFICSVGIIIVGC

SEQ ID NO: 2397617 - protein, 17 aa, Entamoeba dispar
IAFIVYCSITIYTHQWT

SEQ ID NO: 2397618 - protein, 24 aa, Entamoeba dispar
IAFLGIFLIYLDYSTFIGFPLKPI

SEQ ID NO: 2397619 - protein, 24 aa, Entamoeba dispar
IAFVGLISHYCYVGLFGSSGEHLI

SEQ ID NO: 2397620 - protein, 22 aa, Entamoeba dispar
IAFVLYILTYAYISASGSILHH

SEQ ID NO: 2397621 - protein, 22 aa, Entamoeba dispar
IAGFFIPVCWLVNICLCCCKFK

SEQ ID NO: 2397622 - protein, 27 aa, Entamoeba dispar
IAIFICEIIALILYLKRKKILVLVALG

SEQ ID NO: 2397623 - protein, 17 aa, Entamoeba dispar
IAILVAVFAVSLIGAWN

SEQ ID NO: 2397624 - protein, 18 aa, Entamoeba dispar
IAIQLCNEPYLTNKLNIW

SEQ ID NO: 2397625 - protein, 24 aa, Entamoeba dispar
IAIYLFLFILVIIQFVHTLYMSHK

SEQ ID NO: 2397626 - protein, 27 aa, Entamoeba dispar
IAIYSGIIILLLGVLFGLIYYNSLEKK

SEQ ID NO: 2397627 - protein, 33 aa, Entamoeba dispar
IAKHLNFFLKIIIKSLLFWMQKEDLFEKENRFQ

SEQ ID NO: 2397628 - protein, 17 aa, Entamoeba dispar
IALIRAVEFDTCENPQI

SEQ ID NO: 2397629 - protein, 21 aa, Entamoeba dispar
IALLCFDILLLVFVFWIFTSY

SEQ ID NO: 2397630 - protein, 20 aa, Entamoeba dispar
IALTFLFNLIPQNGFFSWAL

SEQ ID NO: 2397631 - protein, 20 aa, Entamoeba dispar
IAPQWLMKRLSLVDGDYIDI

SEQ ID NO: 2397632 - protein, 36 aa, Entamoeba dispar
IAQLVAFFILGLFKAWQFKITLNIISLLISMICLTG

SEQ ID NO: 2397633 - protein, 25 aa, Entamoeba dispar
IASETYLVNLLKRYPNMLSISMQRS

SEQ ID NO: 2397634 - protein, 38 aa, Entamoeba dispar
IASIFAHKLIWFFIISILTMLFLYIIQIGLVIAGRGVK

SEQ ID NO: 2397635 - protein, 25 aa, Entamoeba dispar
IASRFIWDILCLFAILIHLSCMRSR

SEQ ID NO: 2397636 - protein, 33 aa, Entamoeba dispar
IASVLSLFILYCSQFFIFDSRYQTLMLRPKAPV

SEQ ID NO: 2397637 - protein, 21 aa, Entamoeba dispar
IATFFFFLGVLLILFKFTFIG

SEQ ID NO: 2397638 - protein, 26 aa, Entamoeba dispar
IAVMVGVMLIIICIVLLVIFTRKRKN

SEQ ID NO: 2397639 - protein, 30 aa, Entamoeba dispar
ICAIVLIVIVGIILLLTQYYSTKTPHRVSV

SEQ ID NO: 2397640 - protein, 29 aa, Entamoeba dispar
ICAVHFVSYIYRYLKDKIPLLNENYLTEI

SEQ ID NO: 2397641 - protein, 19 aa, Entamoeba dispar
ICCIHIALYLGLPESIDKR

SEQ ID NO: 2397642 - protein, 17 aa, Entamoeba dispar
ICDFTKVERLDLFGYLS

SEQ ID NO: 2397643 - protein, 25 aa, Entamoeba dispar
ICECYYLNELFLFGEKERYLHFLSN

SEQ ID NO: 2397644 - protein, 32 aa, Entamoeba dispar
ICELMILCYPMFALFLVFYKDKKEKGYKRSLI

SEQ ID NO: 2397645 - protein, 18 aa, Entamoeba dispar
ICFILISILIWSKTKKHY

SEQ ID NO: 2397646 - protein, 18 aa, Entamoeba dispar
ICFLINNKQMKFIYEDSQ

SEQ ID NO: 2397647 - protein, 19 aa, Entamoeba dispar
ICFSLIILVSTGYPCNDLC

SEQ ID NO: 2397648 - protein, 39 aa, Entamoeba dispar
ICIALYYIKGTLLLPIFFILILQSFALAFFWSICEFMLS

SEQ ID NO: 2397649 - protein, 18 aa, Entamoeba dispar
ICIGMFLVLYLYENLSYF

SEQ ID NO: 2397650 - protein, 22 aa, Entamoeba dispar
ICINKIFTFYDTQHYGRQIEYG

SEQ ID NO: 2397651 - protein, 31 aa, Entamoeba dispar
ICKERLKYCWVIYSLLIKSIIGYLKDYKAFD

SEQ ID NO: 2397652 - protein, 17 aa, Entamoeba dispar
ICLSCKSGYYLETNKTC

SEQ ID NO: 2397653 - protein, 18 aa, Entamoeba dispar
ICLYLNNCKISTISFNLL

SEQ ID NO: 2397654 - protein, 31 aa, Entamoeba dispar
ICPYITRHKWLLISLYFVGIMVCGILSPLAT

SEQ ID NO: 2397655 - protein, 17 aa, Entamoeba dispar
ICRDMIIRNLPTSLTQK

SEQ ID NO: 2397656 - protein, 25 aa, Entamoeba dispar
ICSFGYLCFLIILKWCNPDKDPAPM

SEQ ID NO: 2397657 - protein, 18 aa, Entamoeba dispar
ICSFMLYNLVGTAALYGI

SEQ ID NO: 2397658 - protein, 23 aa, Entamoeba dispar
ICSICILFPLIKTLNLLKKNTGT

SEQ ID NO: 2397659 - protein, 25 aa, Entamoeba dispar
ICVILPFVILFFIATPKLDLSQLVN

SEQ ID NO: 2397660 - protein, 17 aa, Entamoeba dispar
ICVRHYGLIDSDGTRIL

SEQ ID NO: 2397661 - protein, 17 aa, Entamoeba dispar
ICWYSYFNKLPTLKFFS

SEQ ID NO: 2397662 - protein, 24 aa, Entamoeba dispar
IDDKEYFLPIFSGQPFEGYLTSTY

SEQ ID NO: 2397663 - protein, 29 aa, Entamoeba dispar
IDDMKMMYLSYVPLLYSPSMIALAIHYHQ

SEQ ID NO: 2397664 - protein, 38 aa, Entamoeba dispar
IDENTFFYLKQSYNKLLIYLIYLVKPYVNWSRVYLEIN

SEQ ID NO: 2397665 - protein, 24 aa, Entamoeba dispar
IDEVKIQLPFPLNEKHHLLFVIKD

SEQ ID NO: 2397666 - protein, 19 aa, Entamoeba dispar
IDFININKLFYKNKIYQLK

SEQ ID NO: 2397667 - protein, 18 aa, Entamoeba dispar
IDFIYSLIPSFEVLIQFI

SEQ ID NO: 2397668 - protein, 17 aa, Entamoeba dispar
IDFLFKTRYFLIGVISY

SEQ ID NO: 2397669 - protein, 22 aa, Entamoeba dispar
IDFLITFLVDYQKYVLKIFMLF

SEQ ID NO: 2397670 - protein, 20 aa, Entamoeba dispar
IDFSLPYYIEPLLSNISTIV

SEQ ID NO: 2397671 - protein, 17 aa, Entamoeba dispar
IDGFVLLIPLTIYFFCF

SEQ ID NO: 2397672 - protein, 17 aa, Entamoeba dispar
IDIALISMDFVETIIGV

SEQ ID NO: 2397673 - protein, 57 aa, Entamoeba dispar
IDIGSIIIIQLISVLIFITSMILLVIIYRGWALASPAIPPLITPSWLTFGFNEEAPV

SEQ ID NO: 2397674 - protein, 20 aa, Entamoeba dispar
IDIIITFIVFVLSKLFSLLP

SEQ ID NO: 2397675 - protein, 26 aa, Entamoeba dispar
IDIPVFWPILLVYFIVLFVVTMHSQI

SEQ ID NO: 2397676 - protein, 24 aa, Entamoeba dispar
IDISQYYIFPWTTTVFDKPFNQIY

SEQ ID NO: 2397677 - protein, 25 aa, Entamoeba dispar
IDKILFLMYCIWTIYVLYDHVYYCF

SEQ ID NO: 2397678 - protein, 31 aa, Entamoeba dispar
IDKKFNIFVFVMIIIQCIICLILSILSGHSH

SEQ ID NO: 2397679 - protein, 36 aa, Entamoeba dispar
IDLIELWRCIIKHSLFQLIPWLGICVKSVSLNPNRA

SEQ ID NO: 2397680 - protein, 17 aa, Entamoeba dispar
IDLLIKLRETRLPQKQV

SEQ ID NO: 2397681 - protein, 19 aa, Entamoeba dispar
IDLLSKFKCSYIIQFLGAV

SEQ ID NO: 2397682 - protein, 25 aa, Entamoeba dispar
IDMYGNSMFLFYGLSHLSLTNLTLH

SEQ ID NO: 2397683 - protein, 27 aa, Entamoeba dispar
IDMYIGIIFFFYFLAQTLVMVVMSLTM

SEQ ID NO: 2397684 - protein, 26 aa, Entamoeba dispar
IDNDKKMYLIPRKSLGGIPIDVPEID

SEQ ID NO: 2397685 - protein, 22 aa, Entamoeba dispar
IDNDMMMNVMILKTFYPVEEVM

SEQ ID NO: 2397686 - protein, 21 aa, Entamoeba dispar
IDNFPLSLSCSTLTFGRSGTE

SEQ ID NO: 2397687 - protein, 20 aa, Entamoeba dispar
IDNLILNFAIYDQSKKEKIS

SEQ ID NO: 2397688 - protein, 21 aa, Entamoeba dispar
IDRESVFEHLLTSISFIQPFT

SEQ ID NO: 2397689 - protein, 22 aa, Entamoeba dispar
IDRKLEFLAIPFVYKKNDNSFR

SEQ ID NO: 2397690 - protein, 26 aa, Entamoeba dispar
IDSSPFPLIQLTPLAFINPILTPLQS

SEQ ID NO: 2397691 - protein, 18 aa, Entamoeba dispar
IDSTGRVLIWEATQNRMF

SEQ ID NO: 2397692 - protein, 26 aa, Entamoeba dispar
IDVKGENLLIFSLNPQSPVCAKLTDF

SEQ ID NO: 2397693 - protein, 28 aa, Entamoeba dispar
IDWISFAFLLFNFGILGVVSIFYISPMK

SEQ ID NO: 2397694 - protein, 25 aa, Entamoeba dispar
IDYHYDLVHFLPCILQRCIDVLNDR

SEQ ID NO: 2397695 - protein, 27 aa, Entamoeba dispar
IDYVLPFFLGLFLTATAFFGAYTFAFR

SEQ ID NO: 2397696 - protein, 27 aa, Entamoeba dispar
IEAKKYFAVLMKSLLLNNTHLYNLIMK

SEQ ID NO: 2397697 - protein, 25 aa, Entamoeba dispar
IECATYVLLIYIMQNIYCECKTTNG

SEQ ID NO: 2397698 - protein, 23 aa, Entamoeba dispar
IEDILLMVILLFGNGMTIFCLGK

SEQ ID NO: 2397699 - protein, 27 aa, Entamoeba dispar
IEDKTLLQPLIDPLLSFFRGNVQHRNL

SEQ ID NO: 2397700 - protein, 19 aa, Entamoeba dispar
IEDSLVTFISKYIHQISLH

SEQ ID NO: 2397701 - protein, 26 aa, Entamoeba dispar
IEEGHCYLLFVPFEYNGHTCYSYNLV

SEQ ID NO: 2397702 - protein, 22 aa, Entamoeba dispar
IEEMIFMILDIMSGASALGRLN

SEQ ID NO: 2397703 - protein, 25 aa, Entamoeba dispar
IEESIDFPMYFIDSKPLENHDNTRS

SEQ ID NO: 2397704 - protein, 30 aa, Entamoeba dispar
IEEVDQPFYPFYKKINKLLLDLHDLHMYFG

SEQ ID NO: 2397705 - protein, 18 aa, Entamoeba dispar
IEEVYYKTVLLFNKKNIA

SEQ ID NO: 2397706 - protein, 17 aa, Entamoeba dispar
IEFALLMDFGTIGYAGI

SEQ ID NO: 2397707 - protein, 25 aa, Entamoeba dispar
IEGKATTPFLLNYLNTHSNSQTIRA

SEQ ID NO: 2397708 - protein, 18 aa, Entamoeba dispar
IEHKLLYPNQFVFAENLN

SEQ ID NO: 2397709 - protein, 23 aa, Entamoeba dispar
IEIFHRYIKYCIISHLDCLYNFV

SEQ ID NO: 2397710 - protein, 22 aa, Entamoeba dispar
IEIIGPSLIPYKCMIAGWFTYN

SEQ ID NO: 2397711 - protein, 30 aa, Entamoeba dispar
IEIIGQFNKGFIIGKLGYDLYIIDQHAADE

SEQ ID NO: 2397712 - protein, 17 aa, Entamoeba dispar
IEIINILDMFLHNIPDI

SEQ ID NO: 2397713 - protein, 26 aa, Entamoeba dispar
IEIIQLFCDFIYASWKLIQQKGIYET

SEQ ID NO: 2397714 - protein, 17 aa, Entamoeba dispar
IEIRLVVCCIIAGLLFR

SEQ ID NO: 2397715 - protein, 27 aa, Entamoeba dispar
IEITIVYRILYPIITRIIPSLGPIEGG

SEQ ID NO: 2397716 - protein, 23 aa, Entamoeba dispar
IEKYLPLALFIAGFFIPVCWLVN

SEQ ID NO: 2397717 - protein, 24 aa, Entamoeba dispar
IELAFNGLFGRENWLMQNLTNIIS

SEQ ID NO: 2397718 - protein, 26 aa, Entamoeba dispar
IELCGGLFYVYLFYKGELIKASQFIV

SEQ ID NO: 2397719 - protein, 17 aa, Entamoeba dispar
IELFVIPKKLDASQKIP

SEQ ID NO: 2397720 - protein, 17 aa, Entamoeba dispar
IELLNEIPGFIEILKVV

SEQ ID NO: 2397721 - protein, 18 aa, Entamoeba dispar
IELNLLELLITTTSLEIN

SEQ ID NO: 2397722 - protein, 24 aa, Entamoeba dispar
IELNNILCIHLFKVTFHFKTTLPE

SEQ ID NO: 2397723 - protein, 18 aa, Entamoeba dispar
IELRYKILHDAALGILFL

SEQ ID NO: 2397724 - protein, 30 aa, Entamoeba dispar
IELSVYLPELKWNRIILKPDHPKCLWDLLP

SEQ ID NO: 2397725 - protein, 20 aa, Entamoeba dispar
IEMIPMLKQYIMKNITEGVI

SEQ ID NO: 2397726 - protein, 24 aa, Entamoeba dispar
IENAIEITLPFTEVRVLGLHKIPS

SEQ ID NO: 2397727 - protein, 20 aa, Entamoeba dispar
IENHFLWIDISNPSKEVMVA

SEQ ID NO: 2397728 - protein, 20 aa, Entamoeba dispar
IENIFFATHDLHLTFRISSN

SEQ ID NO: 2397729 - protein, 17 aa, Entamoeba dispar
IENLLILSTKLHRFEIT

SEQ ID NO: 2397730 - protein, 32 aa, Entamoeba dispar
IENSVFYRALFIFLRFLYHQSCDPYFLEIYHA

SEQ ID NO: 2397731 - protein, 23 aa, Entamoeba dispar
IEQYLIFHIINQLSSWINLSKEG

SEQ ID NO: 2397732 - protein, 18 aa, Entamoeba dispar
IERLFTLLYSRIDTRYYS

SEQ ID NO: 2397733 - protein, 19 aa, Entamoeba dispar
IESAKCIIFMIAGDEIKKT

SEQ ID NO: 2397734 - protein, 17 aa, Entamoeba dispar
IESIIILIKEICERNNI

SEQ ID NO: 2397735 - protein, 18 aa, Entamoeba dispar
IESKFPINIYQIIDGEDK

SEQ ID NO: 2397736 - protein, 39 aa, Entamoeba dispar
IESKYLNIKLFIIVPTHNDFLFISLLQNGTTALDNTLIY

SEQ ID NO: 2397737 - protein, 18 aa, Entamoeba dispar
IESLLKWARKLSFIDVDK

SEQ ID NO: 2397738 - protein, 28 aa, Entamoeba dispar
IESWKRHAMFWMIVLTPASIIGCVLFII

SEQ ID NO: 2397739 - protein, 26 aa, Entamoeba dispar
IETKTWNWILIIGHIISIIFIFIIYG

SEQ ID NO: 2397740 - protein, 22 aa, Entamoeba dispar
IETLLCTLIRKLINTDLVDHEN

SEQ ID NO: 2397741 - protein, 18 aa, Entamoeba dispar
IETLLILSLMIFFAFSSF

SEQ ID NO: 2397742 - protein, 18 aa, Entamoeba dispar
IETNFRLELVKNSYSFEK

SEQ ID NO: 2397743 - protein, 18 aa, Entamoeba dispar
IETPYPIRKSIFKSFMNI

SEQ ID NO: 2397744 - protein, 37 aa, Entamoeba dispar
IETSSGVVLYILVWLCLLIIIMFKYKKLTLEIKEEWR

SEQ ID NO: 2397745 - protein, 20 aa, Entamoeba dispar
IEWYFKVFICQTKIEGIINS

SEQ ID NO: 2397746 - protein, 18 aa, Entamoeba dispar
IEYKHYLLSILTPLLVEP

SEQ ID NO: 2397747 - protein, 28 aa, Entamoeba dispar
IEYKIDKRIYLPLILKRIRELANTYLSL

SEQ ID NO: 2397748 - protein, 28 aa, Entamoeba dispar
IEYPHLYLLMEFMPKYSLFNVLHSNLKI

SEQ ID NO: 2397749 - protein, 22 aa, Entamoeba dispar
IEYTIILIMWNLDVISASITKH

SEQ ID NO: 2397750 - protein, 18 aa, Entamoeba dispar
IEYTLFLLFYQDKHSRIF

SEQ ID NO: 2397751 - protein, 20 aa, Entamoeba dispar
IFCLGLYRALYIINWIYRYA

SEQ ID NO: 2397752 - protein, 27 aa, Entamoeba dispar
IFCMTQYFIFLILTLSLILLLHINSDY

SEQ ID NO: 2397753 - protein, 22 aa, Entamoeba dispar
IFDDVLMNRFIMKLSSCLSKYT

SEQ ID NO: 2397754 - protein, 28 aa, Entamoeba dispar
IFDVYIPQLAQFIPITIKLALDVCNLDE

SEQ ID NO: 2397755 - protein, 28 aa, Entamoeba dispar
IFEEFYYQLFQFLVLIASIIQTFIKRKL

SEQ ID NO: 2397756 - protein, 25 aa, Entamoeba dispar
IFFLILFIGFIVCLIITTVYSSQHD

SEQ ID NO: 2397757 - protein, 19 aa, Entamoeba dispar
IFFNLNHYLNPKPAPQNHA

SEQ ID NO: 2397758 - protein, 19 aa, Entamoeba dispar
IFFSFVCFVPQIYKILKRR

SEQ ID NO: 2397759 - protein, 18 aa, Entamoeba dispar
IFGCENWKKNMIKGIIVI

SEQ ID NO: 2397760 - protein, 25 aa, Entamoeba dispar
IFGGCGFLLFYFICSIIVDLVIELI

SEQ ID NO: 2397761 - protein, 22 aa, Entamoeba dispar
IFGISFIVLLISFIPTLIVADE

SEQ ID NO: 2397762 - protein, 18 aa, Entamoeba dispar
IFGYPLDFVCVIVGLMAS

SEQ ID NO: 2397763 - protein, 17 aa, Entamoeba dispar
IFHMLRWTQGNEANVER

SEQ ID NO: 2397764 - protein, 20 aa, Entamoeba dispar
IFIALLQYFIKKRKLLLHQI

SEQ ID NO: 2397765 - protein, 27 aa, Entamoeba dispar
IFIFGLGLIFIIFQKKLKKITLDEITL

SEQ ID NO: 2397766 - protein, 17 aa, Entamoeba dispar
IFIITLVNGQCVIKDYQ

SEQ ID NO: 2397767 - protein, 31 aa, Entamoeba dispar
IFISLPIILIIVIVIAYLIVFITGGICYVYS

SEQ ID NO: 2397768 - protein, 37 aa, Entamoeba dispar
IFKEEYVKLYFRYLDRYLFNYILHTSPGINVEIALKI

SEQ ID NO: 2397769 - protein, 19 aa, Entamoeba dispar
IFKMYFTRDDLPVVSILFY

SEQ ID NO: 2397770 - protein, 23 aa, Entamoeba dispar
IFLKYYTFKIFVVSFFHLSICDN

SEQ ID NO: 2397771 - protein, 17 aa, Entamoeba dispar
IFLLMIELLSMNLHNDI

SEQ ID NO: 2397772 - protein, 19 aa, Entamoeba dispar
IFLPSIKGILFAIFLTFFV

SEQ ID NO: 2397773 - protein, 18 aa, Entamoeba dispar
IFLSFYSHLVDSLYFSFL

SEQ ID NO: 2397774 - protein, 42 aa, Entamoeba dispar
IFLTIFSIFVIFSLPEFPFMWGYCWFTTILSYLSLWNTRNEL

SEQ ID NO: 2397775 - protein, 19 aa, Entamoeba dispar
IFLYYFIPLFLYYLIILLY

SEQ ID NO: 2397776 - protein, 19 aa, Entamoeba dispar
IFNFLNLICKKAIDFTIKL

SEQ ID NO: 2397777 - protein, 19 aa, Entamoeba dispar
IFNINFICPQAIGEYTYRT

SEQ ID NO: 2397778 - protein, 25 aa, Entamoeba dispar
IFNNFKIFCDCLYDKKMKEFMNIAS

SEQ ID NO: 2397779 - protein, 30 aa, Entamoeba dispar
IFNVVAPVVWFLLTPMMYVIIPIYAVCNFD

SEQ ID NO: 2397780 - protein, 18 aa, Entamoeba dispar
IFNWELLSIGAILQYCQM

SEQ ID NO: 2397781 - protein, 28 aa, Entamoeba dispar
IFPDGDITLHKLILPSGATISGKGSLSV

SEQ ID NO: 2397782 - protein, 21 aa, Entamoeba dispar
IFQNLPHIWASYYDTHIVPAH

SEQ ID NO: 2397783 - protein, 38 aa, Entamoeba dispar
IFSFLTQIVADPYYRTLKGFLILFQKEFIGFDAFISGQ

SEQ ID NO: 2397784 - protein, 25 aa, Entamoeba dispar
IFSHLKYLIMTSLISSIPALIYFFQ

SEQ ID NO: 2397785 - protein, 19 aa, Entamoeba dispar
IFSIFVVYVGPMCIMMLWP

SEQ ID NO: 2397786 - protein, 33 aa, Entamoeba dispar
IFSIICAIIGFIWFIIWIFNWLMALLKANSEEF

SEQ ID NO: 2397787 - protein, 22 aa, Entamoeba dispar
IFSIVFICFWLGSIVISLNTKF

SEQ ID NO: 2397788 - protein, 24 aa, Entamoeba dispar
IFSLVWVLSIWFLSIIISLIGMYY

SEQ ID NO: 2397789 - protein, 26 aa, Entamoeba dispar
IFSSFTIVIVVRFMILFSSIIPISIR

SEQ ID NO: 2397790 - protein, 26 aa, Entamoeba dispar
IFTARADILPFNWISELPLNMKNLEI

SEQ ID NO: 2397791 - protein, 25 aa, Entamoeba dispar
IFTLGLYYIPYIYPLVVFSPLCILA

SEQ ID NO: 2397792 - protein, 17 aa, Entamoeba dispar
IFTLIPIILIYSMFSRL

SEQ ID NO: 2397793 - protein, 17 aa, Entamoeba dispar
IFTSKWFRVINLYSSTI

SEQ ID NO: 2397794 - protein, 26 aa, Entamoeba dispar
IFTSVPMYFYPLGYLIGLCNIPVPFV

SEQ ID NO: 2397795 - protein, 17 aa, Entamoeba dispar
IFVELQNCIFGNLIEVG

SEQ ID NO: 2397796 - protein, 17 aa, Entamoeba dispar
IFVFNSIALTCEESYYE

SEQ ID NO: 2397797 - protein, 18 aa, Entamoeba dispar
IFVIIWNIFITFFALFLF

SEQ ID NO: 2397798 - protein, 17 aa, Entamoeba dispar
IFWRISLAFSNCIVLCL

SEQ ID NO: 2397799 - protein, 24 aa, Entamoeba dispar
IGDLIGLMLFILLTYCHYKVIHTS

SEQ ID NO: 2397800 - protein, 23 aa, Entamoeba dispar
IGEKLRIVISVIFFLISCFFDIP

SEQ ID NO: 2397801 - protein, 17 aa, Entamoeba dispar
IGFFLIVASIVFTKDIN

SEQ ID NO: 2397802 - protein, 39 aa, Entamoeba dispar
IGFTIFSIILPFILPYCFFSFIIILVETIILWSVIIAQR

SEQ ID NO: 2397803 - protein, 24 aa, Entamoeba dispar
IGFTIRRWNWIIFASEASSVLMYL

SEQ ID NO: 2397804 - protein, 26 aa, Entamoeba dispar
IGGEAFIYNILFDDPYSNYFISINGN

SEQ ID NO: 2397805 - protein, 29 aa, Entamoeba dispar
IGGGAIFPFFTLKIVDLIMCLLSINSDTL

SEQ ID NO: 2397806 - protein, 30 aa, Entamoeba dispar
IGGISFSLQQPLFQPYIPFSARAVEMLNQT

SEQ ID NO: 2397807 - protein, 22 aa, Entamoeba dispar
IGHSRILVIIVTNDFDIFGIYN

SEQ ID NO: 2397808 - protein, 26 aa, Entamoeba dispar
IGIAIVGLISHYFYIGLFGTSGEHLI

SEQ ID NO: 2397809 - protein, 26 aa, Entamoeba dispar
IGIHNIRFFFLFISSLSLSLLLGAVT

SEQ ID NO: 2397810 - protein, 17 aa, Entamoeba dispar
IGIIFFCYFIAQTLVMA

SEQ ID NO: 2397811 - protein, 18 aa, Entamoeba dispar
IGILLQFVTTSYSPILLS

SEQ ID NO: 2397812 - protein, 24 aa, Entamoeba dispar
IGIQSLYFAILSTMGYTLLLEKPK

SEQ ID NO: 2397813 - protein, 26 aa, Entamoeba dispar
IGISNYCFTIIKTILHWYFGTDKTLK

SEQ ID NO: 2397814 - protein, 40 aa, Entamoeba dispar
IGITISSIIIFIILLCCSGILLYFLLRTTKFDINIYLQQQ

SEQ ID NO: 2397815 - protein, 23 aa, Entamoeba dispar
IGITSLPFKITLPMLNFVPEVQS

SEQ ID NO: 2397816 - protein, 17 aa, Entamoeba dispar
IGIYFRKWKYRSHFTVL

SEQ ID NO: 2397817 - protein, 26 aa, Entamoeba dispar
IGIYSIVVLVIWIIGQFYGDWLKIFN

SEQ ID NO: 2397818 - protein, 30 aa, Entamoeba dispar
IGKFKTLRQFCQLWNIISNTKHCYINHQIQ

SEQ ID NO: 2397819 - protein, 29 aa, Entamoeba dispar
IGKFKTLRQFCQLWNIISNTKHCYVNHQI

SEQ ID NO: 2397820 - protein, 31 aa, Entamoeba dispar
IGKKRLWELLFVFLVGFFRCSFFTLTIEIGS

SEQ ID NO: 2397821 - protein, 34 aa, Entamoeba dispar
IGLFLIMCCKYYNLFQIIFSLNNFLSLIVHMASL

SEQ ID NO: 2397822 - protein, 17 aa, Entamoeba dispar
IGLLVFSETYNFLNPQW

SEQ ID NO: 2397823 - protein, 21 aa, Entamoeba dispar
IGLPIFLTLEKNRKFILGFYI

SEQ ID NO: 2397824 - protein, 44 aa, Entamoeba dispar
IGMIIGITIGTFIIVLIIVITIIIIISLFYIQHKKEKKKMDNIC

SEQ ID NO: 2397825 - protein, 21 aa, Entamoeba dispar
IGMYNIMNYIYNSLSNNLDWF

SEQ ID NO: 2397826 - protein, 22 aa, Entamoeba dispar
IGNSRVQCFEPMFNPQLCAMNC

SEQ ID NO: 2397827 - protein, 18 aa, Entamoeba dispar
IGPLALYVLIYLISLFTG

SEQ ID NO: 2397828 - protein, 35 aa, Entamoeba dispar
IGQFYGDWLKIFNVFIIISILFGGLMFVLSIIQPG

SEQ ID NO: 2397829 - protein, 25 aa, Entamoeba dispar
IGQYVFIFVGLYSLAAFLTLSFTMF

SEQ ID NO: 2397830 - protein, 17 aa, Entamoeba dispar
IGSFFFTYFFLASFNGA

SEQ ID NO: 2397831 - protein, 26 aa, Entamoeba dispar
IGSIILLFAIVIISSSILVLVFARNN

SEQ ID NO: 2397832 - protein, 25 aa, Entamoeba dispar
IGSLFLIFVFFYPSTAKYFIYASVF

SEQ ID NO: 2397833 - protein, 29 aa, Entamoeba dispar
IGSTILILFVLIIIITAWILSRKRKTKKR

SEQ ID NO: 2397834 - protein, 36 aa, Entamoeba dispar
IGTPSITFVLLFLFALVIIVILILYAHRREPKKESW

SEQ ID NO: 2397835 - protein, 27 aa, Entamoeba dispar
IGTPVYNFLCSYLLKTYKHQSKGLFIG

SEQ ID NO: 2397836 - protein, 32 aa, Entamoeba dispar
IGTQRICPLELKSACGAILYASPYFPDHTEMM

SEQ ID NO: 2397837 - protein, 22 aa, Entamoeba dispar
IGVAFTMYYFVSDKHVYLLDFA

SEQ ID NO: 2397838 - protein, 29 aa, Entamoeba dispar
IGVASFISYFMYIGLFLSAGFKMIGRVRK

SEQ ID NO: 2397839 - protein, 20 aa, Entamoeba dispar
IGVAYILSILNQRELFYQLH

SEQ ID NO: 2397840 - protein, 24 aa, Entamoeba dispar
IGVFVFILVFIYWTILKKYTILPE

SEQ ID NO: 2397841 - protein, 18 aa, Entamoeba dispar
IGVKVNINYVPKQKTRLF

SEQ ID NO: 2397842 - protein, 18 aa, Entamoeba dispar
IGVLSFVVFFVSVVSLFC

SEQ ID NO: 2397843 - protein, 26 aa, Entamoeba dispar
IGWIAKSLPWLMFIGGLISSLGYLLT

SEQ ID NO: 2397844 - protein, 19 aa, Entamoeba dispar
IHFPKIPRVVYLNNKCIEA

SEQ ID NO: 2397845 - protein, 24 aa, Entamoeba dispar
IHIGLLIIPFFHNLLDPFYQLTRI

SEQ ID NO: 2397846 - protein, 17 aa, Entamoeba dispar
IHISFTISLILGYGGII

SEQ ID NO: 2397847 - protein, 17 aa, Entamoeba dispar
IHLLINDKRFNKTITNL

SEQ ID NO: 2397848 - protein, 18 aa, Entamoeba dispar
IHLLKLPESKVLVSSLCI

SEQ ID NO: 2397849 - protein, 18 aa, Entamoeba dispar
IHNFFLVVSDSYQIPTFL

SEQ ID NO: 2397850 - protein, 18 aa, Entamoeba dispar
IHPLLKGYFMQVNSDWSF

SEQ ID NO: 2397851 - protein, 32 aa, Entamoeba dispar
IHQHAPMCLMWISLIIIQLLTGYVILKTNVNV

SEQ ID NO: 2397852 - protein, 25 aa, Entamoeba dispar
IHQPRPLIFQKFDKIIMLNRGHMMY

SEQ ID NO: 2397853 - protein, 28 aa, Entamoeba dispar
IHRDLKPDNLLLFSYSPKVQFAAKISDF

SEQ ID NO: 2397854 - protein, 31 aa, Entamoeba dispar
IHSLPLMLPIFFIIHVIILVLMPRCKEYNPT

SEQ ID NO: 2397855 - protein, 33 aa, Entamoeba dispar
IHSNHIYFHSFFNFSYFFISVSFLNSFSLFKVF

SEQ ID NO: 2397856 - protein, 17 aa, Entamoeba dispar
IHTIIWETIRYFLRSSN

SEQ ID NO: 2397857 - protein, 26 aa, Entamoeba dispar
IHTLGKLLVLTRWLGRNPVLHDIDNF

SEQ ID NO: 2397858 - protein, 19 aa, Entamoeba dispar
IHWIELNGKCPILVNKKVL

SEQ ID NO: 2397859 - protein, 20 aa, Entamoeba dispar
IIALLICIILISINFSITEH

SEQ ID NO: 2397860 - protein, 24 aa, Entamoeba dispar
IIALSIMVILIMAEVITVSVYVPL

SEQ ID NO: 2397861 - protein, 23 aa, Entamoeba dispar
IIAVFLCFSLIKIQPSLECKLYQ

SEQ ID NO: 2397862 - protein, 51 aa, Entamoeba dispar
IIAYLINILLTYVLSLIFRRNPFYTLLSIFFPFLTEFLLFILNKPNLGEGK

SEQ ID NO: 2397863 - protein, 36 aa, Entamoeba dispar
IIAYTVACIFMVIAFATVILIMFLNDDRYNLGLKEK

SEQ ID NO: 2397864 - protein, 17 aa, Entamoeba dispar
IICGFPFKIQESESRCL

SEQ ID NO: 2397865 - protein, 20 aa, Entamoeba dispar
IICISLGVIGSFILITCTIL

SEQ ID NO: 2397866 - protein, 34 aa, Entamoeba dispar
IICKIQLFVFSCVLYIFICLMFLISTVYQVQIWF

SEQ ID NO: 2397867 - protein, 18 aa, Entamoeba dispar
IICSFSLKVIPKLEYLKG

SEQ ID NO: 2397868 - protein, 18 aa, Entamoeba dispar
IICSIICSLLGALAWWYP

SEQ ID NO: 2397869 - protein, 26 aa, Entamoeba dispar
IIDHKTPFTNLLLIPWNEQSNIVIQN

SEQ ID NO: 2397870 - protein, 25 aa, Entamoeba dispar
IIDKGNIIFLLMAYASVMDITEQEH

SEQ ID NO: 2397871 - protein, 18 aa, Entamoeba dispar
IIDKNWNSVQPTKECTIT

SEQ ID NO: 2397872 - protein, 28 aa, Entamoeba dispar
IIDPTGVHIILLYSGNKMSYCERIKLSP

SEQ ID NO: 2397873 - protein, 24 aa, Entamoeba dispar
IIDSMDSVYLRYANTHLFACPDNK

SEQ ID NO: 2397874 - protein, 35 aa, Entamoeba dispar
IIEFLITTYRQIVSFFDLILFLFGQHQHFTSEFKF

SEQ ID NO: 2397875 - protein, 19 aa, Entamoeba dispar
IIEGNYFIYSLETSPKTEN

SEQ ID NO: 2397876 - protein, 18 aa, Entamoeba dispar
IIEICSCIWYIASYIPYA

SEQ ID NO: 2397877 - protein, 18 aa, Entamoeba dispar
IIEKLLSAIKKIKSPQAV

SEQ ID NO: 2397878 - protein, 18 aa, Entamoeba dispar
IIEYYGFIFFYPGLFSGP

SEQ ID NO: 2397879 - protein, 24 aa, Entamoeba dispar
IIFAMLLAIFWRKQKQYLFHFTGV

SEQ ID NO: 2397880 - protein, 17 aa, Entamoeba dispar
IIFFCYFIAQTLVMAIM

SEQ ID NO: 2397881 - protein, 23 aa, Entamoeba dispar
IIFFLFYIFLIVMAVFRCESGDA

SEQ ID NO: 2397882 - protein, 33 aa, Entamoeba dispar
IIFSQPSTYLFILLYVILAITPLLLRNFCNRTI

SEQ ID NO: 2397883 - protein, 17 aa, Entamoeba dispar
IIFSSFLSRIFIGKKVR

SEQ ID NO: 2397884 - protein, 36 aa, Entamoeba dispar
IIFSSISIPLLPLLLPLFKILPIQSFAILLQVISTI

SEQ ID NO: 2397885 - protein, 17 aa, Entamoeba dispar
IIFYYQPGKYMDVIYCC

SEQ ID NO: 2397886 - protein, 23 aa, Entamoeba dispar
IIGFFTTLLFYCSKFNSLSSEHS

SEQ ID NO: 2397887 - protein, 19 aa, Entamoeba dispar
IIGGNFRHFLNGGLVILGC

SEQ ID NO: 2397888 - protein, 30 aa, Entamoeba dispar
IIGICVIVTLIVLVIGLIFCVKKKHHKSSY

SEQ ID NO: 2397889 - protein, 20 aa, Entamoeba dispar
IIGLFITVFVLTLISTIVLF

SEQ ID NO: 2397890 - protein, 20 aa, Entamoeba dispar
IIGLFLFSFSLFFLCYPEYI

SEQ ID NO: 2397891 - protein, 26 aa, Entamoeba dispar
IIGYVPPVLVILLMTIKKKSSLFLLF

SEQ ID NO: 2397892 - protein, 37 aa, Entamoeba dispar
IIHIEVILPFFFLPILLPLVFVYPILLLAPLGLFAFN

SEQ ID NO: 2397893 - protein, 36 aa, Entamoeba dispar
IIICLVFRFFITKYRLIILRRYFTLMGVLFAIRLVC

SEQ ID NO: 2397894 - protein, 38 aa, Entamoeba dispar
IIIICLVFRFFITKYRLIILRRYFTLMGVLFAIRLVCV

SEQ ID NO: 2397895 - protein, 25 aa, Entamoeba dispar
IIIIIIIIIIIIMINYIIKLKEKKE

SEQ ID NO: 2397896 - protein, 23 aa, Entamoeba dispar
IIIIIIIIIIIIMINYIIKRKEK

SEQ ID NO: 2397897 - protein, 24 aa, Entamoeba dispar
IIIIIIIIIIIIMINYIIKRKEKK

SEQ ID NO: 2397898 - protein, 30 aa, Entamoeba dispar
IIIIILIIIIIIIIIIIIMINYIIKRKEKK

SEQ ID NO: 2397899 - protein, 31 aa, Entamoeba dispar
IIIILNVLMYVLYKRIIFSASLFISMSLIGI

SEQ ID NO: 2397900 - protein, 24 aa, Entamoeba dispar
IIIILSIIFSFSYGFEQNYEVVHQ

SEQ ID NO: 2397901 - protein, 42 aa, Entamoeba dispar
IIIIVSISCIVIILSSLIAVFIISYLVSLKREKLSKKIKNKR

SEQ ID NO: 2397902 - protein, 25 aa, Entamoeba dispar
IIIKYTDFINPLYGLNLCSLKIENK

SEQ ID NO: 2397903 - protein, 19 aa, Entamoeba dispar
IIIMLLFIVVAASSTVWLL

SEQ ID NO: 2397904 - protein, 18 aa, Entamoeba dispar
IIINEHLHLFKGDIPFVV

SEQ ID NO: 2397905 - protein, 18 aa, Entamoeba dispar
IIIPLLCLLVPCILEATK

SEQ ID NO: 2397906 - protein, 27 aa, Entamoeba dispar
IIIQTIYQLIIMLSIVFVGKYIPFLNS

SEQ ID NO: 2397907 - protein, 19 aa, Entamoeba dispar
IIISLIMKLLYSIVHDVFP

SEQ ID NO: 2397908 - protein, 18 aa, Entamoeba dispar
IIITLIISSIIITLIIGI

SEQ ID NO: 2397909 - protein, 17 aa, Entamoeba dispar
IIIVRTQEKFKPETFGF

SEQ ID NO: 2397910 - protein, 24 aa, Entamoeba dispar
IIIYSWVLFILWCYDIINFGYVLI

SEQ ID NO: 2397911 - protein, 23 aa, Entamoeba dispar
IIKFFESFGWLMKLNNNNIITPG

SEQ ID NO: 2397912 - protein, 22 aa, Entamoeba dispar
IIKRLVELNKPWHCPHGRQTIR

SEQ ID NO: 2397913 - protein, 23 aa, Entamoeba dispar
IIKYQIQTLYFLMSTYKDNSLYK

SEQ ID NO: 2397914 - protein, 22 aa, Entamoeba dispar
IILAILLLVILSFIQPSYFCLL

SEQ ID NO: 2397915 - protein, 46 aa, Entamoeba dispar
IILDSIIFVSILFDYSPFFRRLMSLLLLSQVFIKLHFITVVNQKKN

SEQ ID NO: 2397916 - protein, 26 aa, Entamoeba dispar
IILEQNEFNLLLREELHELTQMLLSM

SEQ ID NO: 2397917 - protein, 22 aa, Entamoeba dispar
IILKPQLLPIQNIKPLTLSGLK

SEQ ID NO: 2397918 - protein, 20 aa, Entamoeba dispar
IILMLTLFFSLFTLHLPMMV

SEQ ID NO: 2397919 - protein, 23 aa, Entamoeba dispar
IILNFCICICCCKLIIHDRKSEN

SEQ ID NO: 2397920 - protein, 44 aa, Entamoeba dispar
IILQGKKNLFFRTGFDNKKLYYYKDLCCFCIEKDQLSSWMTIIK

SEQ ID NO: 2397921 - protein, 32 aa, Entamoeba dispar
IILRRNNEMILNLLLLIFSFIDGFSIDLITNT

SEQ ID NO: 2397922 - protein, 21 aa, Entamoeba dispar
IILSRLCMMLKYMIEHFKENG

SEQ ID NO: 2397923 - protein, 28 aa, Entamoeba dispar
IINGQIKYDFYYINKGIYLNPDSTLSLA

SEQ ID NO: 2397924 - protein, 31 aa, Entamoeba dispar
IINIIPIIERLLLYLLYFWDKVGLSLTIKNL

SEQ ID NO: 2397925 - protein, 29 aa, Entamoeba dispar
IINKSYCFLVFYFFLYVPSIVLTIWSYYR

SEQ ID NO: 2397926 - protein, 24 aa, Entamoeba dispar
IINLLFIIIIFFMFSITNLMLGSL

SEQ ID NO: 2397927 - protein, 18 aa, Entamoeba dispar
IINLWNDCYILFNQCNQY

SEQ ID NO: 2397928 - protein, 36 aa, Entamoeba dispar
IINMTRAFLLFSLLQIYWGIDMYIYRRVRINYPFIF

SEQ ID NO: 2397929 - protein, 26 aa, Entamoeba dispar
IINNQHLPILFSIYDKLLTYAQTTHG

SEQ ID NO: 2397930 - protein, 18 aa, Entamoeba dispar
IINPYTYNFFTLQSLQSK

SEQ ID NO: 2397931 - protein, 18 aa, Entamoeba dispar
IINTFRKRKSFDPKALLV

SEQ ID NO: 2397932 - protein, 20 aa, Entamoeba dispar
IINVIMYFIQMFYDVFIVND

SEQ ID NO: 2397933 - protein, 40 aa, Entamoeba dispar
IIPFIGCPLLLFKAWMLRWWKIMYLRLLDLQKWKVIHGLY

SEQ ID NO: 2397934 - protein, 17 aa, Entamoeba dispar
IIPFLLINIFQKSYLLI

SEQ ID NO: 2397935 - protein, 20 aa, Entamoeba dispar
IIPIGLFIINLWYVMCFATN

SEQ ID NO: 2397936 - protein, 18 aa, Entamoeba dispar
IIPIITLILIVIFITHNT

SEQ ID NO: 2397937 - protein, 18 aa, Entamoeba dispar
IIPLVKRTEYIVGSSKKP

SEQ ID NO: 2397938 - protein, 22 aa, Entamoeba dispar
IIQCFKIIHYYLPKIISDSMKM

SEQ ID NO: 2397939 - protein, 26 aa, Entamoeba dispar
IIQFDTLFIFSLFELITLTYNKHFVQ

SEQ ID NO: 2397940 - protein, 18 aa, Entamoeba dispar
IIQFSIELNYFDLSQNLK

SEQ ID NO: 2397941 - protein, 24 aa, Entamoeba dispar
IIQKEYINLIIFNTLTINQWESTP

SEQ ID NO: 2397942 - protein, 18 aa, Entamoeba dispar
IIQVKFLINIIMRINNVK

SEQ ID NO: 2397943 - protein, 54 aa, Entamoeba dispar
IIRIHTGFNTVDFILCCCGGLLLLIFIAYITLIVIGLVKGWLKPSSYSSTNLDD

SEQ ID NO: 2397944 - protein, 18 aa, Entamoeba dispar
IIRLISPITFLKNKNIIK

SEQ ID NO: 2397945 - protein, 20 aa, Entamoeba dispar
IIRTCGVDAIPFWDAIRNCL

SEQ ID NO: 2397946 - protein, 18 aa, Entamoeba dispar
IISFSLALNHCIESNDSG

SEQ ID NO: 2397947 - protein, 25 aa, Entamoeba dispar
IISFVLILIYFILRILRKPKSMRVT

SEQ ID NO: 2397948 - protein, 26 aa, Entamoeba dispar
IISICFVFIPPYYSKKMWPLVIVFII

SEQ ID NO: 2397949 - protein, 24 aa, Entamoeba dispar
IISIHLFMIFIMVIITVCGGILSY

SEQ ID NO: 2397950 - protein, 20 aa, Entamoeba dispar
IISLLLFITAVVFIIKELVT

SEQ ID NO: 2397951 - protein, 25 aa, Entamoeba dispar
IISPSWLIIIVLVILLGFTSYKTFA

SEQ ID NO: 2397952 - protein, 19 aa, Entamoeba dispar
IISSMCFGFGFALYYNWKL

SEQ ID NO: 2397953 - protein, 22 aa, Entamoeba dispar
IISSMWLFFRFFKKHKEELTNG

SEQ ID NO: 2397954 - protein, 20 aa, Entamoeba dispar
IITCSLFYLLIAVCGNLSFD

SEQ ID NO: 2397955 - protein, 24 aa, Entamoeba dispar
IITDSILFIGYYKSNGIPDTIRVG

SEQ ID NO: 2397956 - protein, 19 aa, Entamoeba dispar
IITLFNMIMTSMPPVFIGA

SEQ ID NO: 2397957 - protein, 43 aa, Entamoeba dispar
IITLILIYLLIQQKDTFRILYIQTFVISILIISILIIGCMIIS

SEQ ID NO: 2397958 - protein, 28 aa, Entamoeba dispar
IITNMFILFILYYFSFHGMYILLTIINC

SEQ ID NO: 2397959 - protein, 20 aa, Entamoeba dispar
IITPGLLRISSFIKMGSILK

SEQ ID NO: 2397960 - protein, 20 aa, Entamoeba dispar
IITRFIFIILFQLLGYAQIH

SEQ ID NO: 2397961 - protein, 18 aa, Entamoeba dispar
IITSLFIASLFYGLIGAV

SEQ ID NO: 2397962 - protein, 18 aa, Entamoeba dispar
IITSVILPFIGKAPVKTI

SEQ ID NO: 2397963 - protein, 32 aa, Entamoeba dispar
IITTFPRCVLVLYWFAFPYNFMNYRVDGILVI

SEQ ID NO: 2397964 - protein, 26 aa, Entamoeba dispar
IITVIPGLIFLWKTYCIVTGAAGGIG

SEQ ID NO: 2397965 - protein, 17 aa, Entamoeba dispar
IITYKEFIFKRPNNLAL

SEQ ID NO: 2397966 - protein, 17 aa, Entamoeba dispar
IIVCIIFYTFVMTNDQY

SEQ ID NO: 2397967 - protein, 30 aa, Entamoeba dispar
IIVICIGGILLVIIIIILSVTLTSFIIRTK

SEQ ID NO: 2397968 - protein, 19 aa, Entamoeba dispar
IIVLILIKKGYISAWSGRF

SEQ ID NO: 2397969 - protein, 22 aa, Entamoeba dispar
IIVNGIMKWFESITIEKAKSLK

SEQ ID NO: 2397970 - protein, 21 aa, Entamoeba dispar
IIVQFLGILFSGVPFSPSQGQ

SEQ ID NO: 2397971 - protein, 32 aa, Entamoeba dispar
IIVTVCCFLLFFIIIAIIGVLLAYYMKSKEQK

SEQ ID NO: 2397972 - protein, 18 aa, Entamoeba dispar
IIYSIHQCEDECIIDGSV

SEQ ID NO: 2397973 - protein, 17 aa, Entamoeba dispar
IKAILSILLNFIENNYL

SEQ ID NO: 2397974 - protein, 24 aa, Entamoeba dispar
IKASFVNFFIVSFALSCIACWIVF

SEQ ID NO: 2397975 - protein, 47 aa, Entamoeba dispar
IKASKTLIIILSILSILIFLGIIVALILIFLVYKKNKKRSPKTKFRI

SEQ ID NO: 2397976 - protein, 23 aa, Entamoeba dispar
IKDDNIIIFIVVGSIIGICVIVT

SEQ ID NO: 2397977 - protein, 23 aa, Entamoeba dispar
IKDIILLILQTYIDLIKEINETK

SEQ ID NO: 2397978 - protein, 23 aa, Entamoeba dispar
IKDLPFFRYVTIPHYINETKDSC

SEQ ID NO: 2397979 - protein, 27 aa, Entamoeba dispar
IKDMKIPYSVWFSKKKKVLLKISQILL

SEQ ID NO: 2397980 - protein, 20 aa, Entamoeba dispar
IKDPILICVLSCVVGAFMAR

SEQ ID NO: 2397981 - protein, 29 aa, Entamoeba dispar
IKEIELIIHLILLNNLILITYFIISFYYK

SEQ ID NO: 2397982 - protein, 40 aa, Entamoeba dispar
IKEIREKRFNGLRRAWLLSYSFAIVIVTMLVTFYNNVFHQ

SEQ ID NO: 2397983 - protein, 18 aa, Entamoeba dispar
IKETLPCALTVILAVTID

SEQ ID NO: 2397984 - protein, 18 aa, Entamoeba dispar
IKFLLSFAKKYGSYISQH

SEQ ID NO: 2397985 - protein, 20 aa, Entamoeba dispar
IKHHLYDKLLSFVRNYCISK

SEQ ID NO: 2397986 - protein, 17 aa, Entamoeba dispar
IKHIIIDPKCISRYFQY

SEQ ID NO: 2397987 - protein, 22 aa, Entamoeba dispar
IKIKTHWYERPFSKIIRIVQRH

SEQ ID NO: 2397988 - protein, 27 aa, Entamoeba dispar
IKKAEEPLYLYLISRVFPPVHSLNALS

SEQ ID NO: 2397989 - protein, 39 aa, Entamoeba dispar
IKKLIKTIYSMFKIEDFWKHVCIIWTKCYYYTPEEQVEQ

SEQ ID NO: 2397990 - protein, 24 aa, Entamoeba dispar
IKKLLIQFYGVWVASVFAKMEACG

SEQ ID NO: 2397991 - protein, 29 aa, Entamoeba dispar
IKKLTFGYVSVLCFDYLYISNSTKIPMCP

SEQ ID NO: 2397992 - protein, 35 aa, Entamoeba dispar
IKKPLLCFTRFFVVKLMMILLLGISSGLVIAGMFL

SEQ ID NO: 2397993 - protein, 25 aa, Entamoeba dispar
IKKPQILFDIITKILQKYSEMMKKG

SEQ ID NO: 2397994 - protein, 23 aa, Entamoeba dispar
IKKSPWKELRGKRPMVLRMEKHI

SEQ ID NO: 2397995 - protein, 17 aa, Entamoeba dispar
IKLCSLLTCFRRSSALQ

SEQ ID NO: 2397996 - protein, 18 aa, Entamoeba dispar
IKLNLFTEFCNIMKLLHA

SEQ ID NO: 2397997 - protein, 25 aa, Entamoeba dispar
IKLPDAHIPIWRYIVYGIAMLICIG

SEQ ID NO: 2397998 - protein, 40 aa, Entamoeba dispar
IKLRQKYYLTTTKTIFLVFFLVVFVVFLIVWGHCGISFEQ

SEQ ID NO: 2397999 - protein, 32 aa, Entamoeba dispar
IKMIRLDIVFILLALMFGWFAFQPFNTNFTNY

SEQ ID NO: 2398000 - protein, 25 aa, Entamoeba dispar
IKNGKLWAVLTIYKLFDGENMEEIF

SEQ ID NO: 2398001 - protein, 28 aa, Entamoeba dispar
IKNHVNDFPIIPLQYLFSAASKNYLRPL

SEQ ID NO: 2398002 - protein, 26 aa, Entamoeba dispar
IKNIVIILKHYISFILKINNTSKIYI

SEQ ID NO: 2398003 - protein, 24 aa, Entamoeba dispar
IKNMAPHQLAELWKSIDEMRIKLS

SEQ ID NO: 2398004 - protein, 25 aa, Entamoeba dispar
IKNPTLLFPFITKKFFIEEYNLRIF

SEQ ID NO: 2398005 - protein, 17 aa, Entamoeba dispar
IKPLCTCVIDEYIVISC

SEQ ID NO: 2398006 - protein, 19 aa, Entamoeba dispar
IKPLFLGLCFFLLLCGYQT

SEQ ID NO: 2398007 - protein, 20 aa, Entamoeba dispar
IKQFSHMLKLLLWHGRNSYI

SEQ ID NO: 2398008 - protein, 34 aa, Entamoeba dispar
IKQFTLLMRHFTVITKLIIFLPNPSENIKHFFWN

SEQ ID NO: 2398009 - protein, 29 aa, Entamoeba dispar
IKQLLKSIWVYKFFVQLIQKLNTKNKNFI

SEQ ID NO: 2398010 - protein, 18 aa, Entamoeba dispar
IKQYGYKFRISFTETYRY

SEQ ID NO: 2398011 - protein, 17 aa, Entamoeba dispar
IKRFPFNFLAHFSFILY

SEQ ID NO: 2398012 - protein, 26 aa, Entamoeba dispar
IKRIDIRIFKLQQPVYYYYISGSKKV

SEQ ID NO: 2398013 - protein, 34 aa, Entamoeba dispar
IKSDNWIIYHILWKVLQLEPLKWNLKYLSFIDVF

SEQ ID NO: 2398014 - protein, 23 aa, Entamoeba dispar
IKSIKSCLLTIKPLSDTLQQLFQ

SEQ ID NO: 2398015 - protein, 28 aa, Entamoeba dispar
IKSLEYFIYILLFYTISFKLIGFIVILI

SEQ ID NO: 2398016 - protein, 17 aa, Entamoeba dispar
IKSTWLPDNRKYIHINE

SEQ ID NO: 2398017 - protein, 25 aa, Entamoeba dispar
IKTLRAQNIIGYTDEWILPSDLTVS

SEQ ID NO: 2398018 - protein, 21 aa, Entamoeba dispar
IKVIEVLIIIVRTQEKFKPET

SEQ ID NO: 2398019 - protein, 17 aa, Entamoeba dispar
IKWIPLSGRSQILVNKR

SEQ ID NO: 2398020 - protein, 41 aa, Entamoeba dispar
IKYGGWVYFTFVMVFFFISSFLLIGSNFWLVIWTDEEKKNN

SEQ ID NO: 2398021 - protein, 25 aa, Entamoeba dispar
IKYIPELFKILKGKDSIIIKICAGY

SEQ ID NO: 2398022 - protein, 26 aa, Entamoeba dispar
IKYKYLTYGLFMLMLFSLLALHIYWF

SEQ ID NO: 2398023 - protein, 22 aa, Entamoeba dispar
IKYNEEFCMYFGKTLFSVGEFE

SEQ ID NO: 2398024 - protein, 20 aa, Entamoeba dispar
IKYPYNSFDLIKNPNVFVVH

SEQ ID NO: 2398025 - protein, 19 aa, Entamoeba dispar
IKYVIADDAVVKYTYADAD

SEQ ID NO: 2398026 - protein, 23 aa, Entamoeba dispar
IKYYPFTIYRFGKVTEIMSTYQI

SEQ ID NO: 2398027 - protein, 25 aa, Entamoeba dispar
ILAPFIWEPLLKNVIPRWLAPNILT

SEQ ID NO: 2398028 - protein, 18 aa, Entamoeba dispar
ILCSFIVSFFFALFSSKQ

SEQ ID NO: 2398029 - protein, 25 aa, Entamoeba dispar
ILDYKENIPPFLLIDGDASVTIKTN

SEQ ID NO: 2398030 - protein, 31 aa, Entamoeba dispar
ILEVSCLPLFDLLSLPSLRRLEIRAGRNNLT

SEQ ID NO: 2398031 - protein, 17 aa, Entamoeba dispar
ILFALISTLLPLIPVLK

SEQ ID NO: 2398032 - protein, 17 aa, Entamoeba dispar
ILFCLFTVFYGITTDLT

SEQ ID NO: 2398033 - protein, 23 aa, Entamoeba dispar
ILFFISIFGFIFYLNMTSNPIVC

SEQ ID NO: 2398034 - protein, 18 aa, Entamoeba dispar
ILFIFLKHEVNGQLCDKT

SEQ ID NO: 2398035 - protein, 18 aa, Entamoeba dispar
ILFITFINDVIASSIVEE

SEQ ID NO: 2398036 - protein, 19 aa, Entamoeba dispar
ILFLGIYAQSDTQSDGCKE

SEQ ID NO: 2398037 - protein, 17 aa, Entamoeba dispar
ILFMVLTLVAAFAVILF

SEQ ID NO: 2398038 - protein, 18 aa, Entamoeba dispar
ILFTPIVHPCSYVYSIVN

SEQ ID NO: 2398039 - protein, 18 aa, Entamoeba dispar
ILGLYYKTIIFFNEYEQI

SEQ ID NO: 2398040 - protein, 33 aa, Entamoeba dispar
ILGSIIVILIIAGVVVLSWYFIKKTNQNKRPDN

SEQ ID NO: 2398041 - protein, 18 aa, Entamoeba dispar
ILHCIGYFSLFVCIIVTL

SEQ ID NO: 2398042 - protein, 28 aa, Entamoeba dispar
ILHEEYLPYLYLIINQVILILDTRCTAI

SEQ ID NO: 2398043 - protein, 17 aa, Entamoeba dispar
ILHHYGPISTAIYSNAD

SEQ ID NO: 2398044 - protein, 26 aa, Entamoeba dispar
ILHMVSLFVLWFAPLQRRFQSFLYHC

SEQ ID NO: 2398045 - protein, 24 aa, Entamoeba dispar
ILIFSIILVMIPFVVWLIGNDRYS

SEQ ID NO: 2398046 - protein, 22 aa, Entamoeba dispar
ILIIVWAVMFFIVILKGGEKMD

SEQ ID NO: 2398047 - protein, 17 aa, Entamoeba dispar
ILILVQSQKQELVRCVT

SEQ ID NO: 2398048 - protein, 19 aa, Entamoeba dispar
ILKCIDLFDSNKYPIQLIF

SEQ ID NO: 2398049 - protein, 23 aa, Entamoeba dispar
ILKDGRKLLYYGPLKIIEEKNEW

SEQ ID NO: 2398050 - protein, 19 aa, Entamoeba dispar
ILKHIPLFIFLRPTIVSVE

SEQ ID NO: 2398051 - protein, 25 aa, Entamoeba dispar
ILKKSPLVLSYYTHLLIALIDSNFF

SEQ ID NO: 2398052 - protein, 18 aa, Entamoeba dispar
ILKLPLSSILMKRSPQVD

SEQ ID NO: 2398053 - protein, 22 aa, Entamoeba dispar
ILKQQFIEGLTFYLQSQSKEEI

SEQ ID NO: 2398054 - protein, 17 aa, Entamoeba dispar
ILKRFIQRYFFPDMYHV

SEQ ID NO: 2398055 - protein, 23 aa, Entamoeba dispar
ILKTILHFKIYPLISQISSNAFM

SEQ ID NO: 2398056 - protein, 31 aa, Entamoeba dispar
ILLAARITALFYYNIFLTTWGRSIRPKLGLP

SEQ ID NO: 2398057 - protein, 17 aa, Entamoeba dispar
ILLATTKKVFLFIESEH

SEQ ID NO: 2398058 - protein, 17 aa, Entamoeba dispar
ILLCGVIFIYFRRKMTS

SEQ ID NO: 2398059 - protein, 33 aa, Entamoeba dispar
ILLIMDVICLPFYFIYRPIYQWIFQRVTEVYMM

SEQ ID NO: 2398060 - protein, 17 aa, Entamoeba dispar
ILLIPILNNYLSNEFIS

SEQ ID NO: 2398061 - protein, 44 aa, Entamoeba dispar
ILLLLLIIVSLLLFIIYSILFQARWLMWIINKINPKALFYFSIN

SEQ ID NO: 2398062 - protein, 17 aa, Entamoeba dispar
ILLLMKKKQELYHKSIE

SEQ ID NO: 2398063 - protein, 19 aa, Entamoeba dispar
ILLMNIIVFVAITSAFFYY

SEQ ID NO: 2398064 - protein, 28 aa, Entamoeba dispar
ILLPIIILTLLILRFKYQKKRTIAFFHP

SEQ ID NO: 2398065 - protein, 23 aa, Entamoeba dispar
ILLTGCFILFFIALIFTTADVKM

SEQ ID NO: 2398066 - protein, 26 aa, Entamoeba dispar
ILLVKTIYLFVLFAIGYMSSFFMNFV

SEQ ID NO: 2398067 - protein, 21 aa, Entamoeba dispar
ILMFYKSYISSYLWDESKNYR

SEQ ID NO: 2398068 - protein, 35 aa, Entamoeba dispar
ILNDFDIWALSRPIQLIFLLRPNSFDTLMLALTKK

SEQ ID NO: 2398069 - protein, 23 aa, Entamoeba dispar
ILNDFHFNIILLNNYLRSYFYNN

SEQ ID NO: 2398070 - protein, 23 aa, Entamoeba dispar
ILNFIIFIFSVVVVKVYVFFLAG

SEQ ID NO: 2398071 - protein, 29 aa, Entamoeba dispar
ILNGSFLVILLLPFVFIPGAISAFYLVVF

SEQ ID NO: 2398072 - protein, 35 aa, Entamoeba dispar
ILNIVLGQRPPLINSIPFPCKELLLSCWKINTERL

SEQ ID NO: 2398073 - protein, 22 aa, Entamoeba dispar
ILNYFRRLCVHPMLVLDEQHPM

SEQ ID NO: 2398074 - protein, 18 aa, Entamoeba dispar
ILPTIMLIVLFTIIIMLV

SEQ ID NO: 2398075 - protein, 17 aa, Entamoeba dispar
ILQFLCDGLIQPPIKGS

SEQ ID NO: 2398076 - protein, 29 aa, Entamoeba dispar
ILQISLYSLLIYVISLLLNFQIPTIYSSS

SEQ ID NO: 2398077 - protein, 18 aa, Entamoeba dispar
ILQITVYAVLLCYDVKRQ

SEQ ID NO: 2398078 - protein, 17 aa, Entamoeba dispar
ILQKFITTFNPLIIEPL

SEQ ID NO: 2398079 - protein, 22 aa, Entamoeba dispar
ILQNLHFFFGFGKVINTKMIES

SEQ ID NO: 2398080 - protein, 24 aa, Entamoeba dispar
ILQVLNFFILIVQNIFVLSSLLTY

SEQ ID NO: 2398081 - protein, 17 aa, Entamoeba dispar
ILRALNRDYTIPKLIKE

SEQ ID NO: 2398082 - protein, 19 aa, Entamoeba dispar
ILRHIFDIRWWPNDSLRVE

SEQ ID NO: 2398083 - protein, 18 aa, Entamoeba dispar
ILRLYAMIHLARFDPKRK

SEQ ID NO: 2398084 - protein, 25 aa, Entamoeba dispar
ILRTFAICLIPFYEVYRGCSCWCNI

SEQ ID NO: 2398085 - protein, 17 aa, Entamoeba dispar
ILSCVYGIFVTVFAYFH

SEQ ID NO: 2398086 - protein, 23 aa, Entamoeba dispar
ILSDTDVLLCNQRLLRRCLTREL

SEQ ID NO: 2398087 - protein, 24 aa, Entamoeba dispar
ILSELLLELFPQFPPKVLHSREIS

SEQ ID NO: 2398088 - protein, 24 aa, Entamoeba dispar
ILSGIFVIAFCIISSIVIVVLIRK

SEQ ID NO: 2398089 - protein, 25 aa, Entamoeba dispar
ILSIIILLLMFQFIDPLKTKWYVTF

SEQ ID NO: 2398090 - protein, 23 aa, Entamoeba dispar
ILSIYDDFLLFFDKYVTEETFTT

SEQ ID NO: 2398091 - protein, 17 aa, Entamoeba dispar
ILSLMIFFAFSSFINIE

SEQ ID NO: 2398092 - protein, 32 aa, Entamoeba dispar
ILSPGGKFLDIIFSLLLMSFLGIGYLEQELLR

SEQ ID NO: 2398093 - protein, 27 aa, Entamoeba dispar
ILSPRITSVIYPKTPYYLFVHSKYASN

SEQ ID NO: 2398094 - protein, 19 aa, Entamoeba dispar
ILSPTLQYLYSLSPPSALA

SEQ ID NO: 2398095 - protein, 25 aa, Entamoeba dispar
ILSSEKKYYFIGEKKMCYLLKKRKC

SEQ ID NO: 2398096 - protein, 20 aa, Entamoeba dispar
ILSYIMCKAMNRSFMSVIFG

SEQ ID NO: 2398097 - protein, 23 aa, Entamoeba dispar
ILTLIIDILFLLHSLFSIYFTGY

SEQ ID NO: 2398098 - protein, 26 aa, Entamoeba dispar
ILTNNWKYPMHFTFHSGDYTKYEIMC

SEQ ID NO: 2398099 - protein, 22 aa, Entamoeba dispar
ILTNQFFDLVRYGVTYTLNKND

SEQ ID NO: 2398100 - protein, 56 aa, Entamoeba dispar
ILTTEAYLFTIIFFICSWYYQPGYYVPYLFCCVLLGLFSLFIYSTSLRLKRFYISQ

SEQ ID NO: 2398101 - protein, 19 aa, Entamoeba dispar
ILVFSFFCRCVFNLLFNGI

SEQ ID NO: 2398102 - protein, 17 aa, Entamoeba dispar
ILVFSSDPGIKSDTLSE

SEQ ID NO: 2398103 - protein, 17 aa, Entamoeba dispar
ILVLLSTILEAKTIQFF

SEQ ID NO: 2398104 - protein, 18 aa, Entamoeba dispar
ILVMLFFGYQLLSIMIFT

SEQ ID NO: 2398105 - protein, 35 aa, Entamoeba dispar
ILVSEHPFVSMVLLTVTMILIGLIVMWWSSEYDDE

SEQ ID NO: 2398106 - protein, 17 aa, Entamoeba dispar
ILYSLIVFSISVIIFIV

SEQ ID NO: 2398107 - protein, 23 aa, Entamoeba dispar
ILYYKEVLMPIYMLPINEIITNL

SEQ ID NO: 2398108 - protein, 28 aa, Entamoeba dispar
ILYYQQFQILTQLFISPLRNLLMAKESI

SEQ ID NO: 2398109 - protein, 18 aa, Entamoeba dispar
IMCKPFTGTIRPGDYVEL

SEQ ID NO: 2398110 - protein, 18 aa, Entamoeba dispar
IMCTMPVIFIIFTVVMVT

SEQ ID NO: 2398111 - protein, 28 aa, Entamoeba dispar
IMEREHFFHGLLIRQYIKLIVKDIQETD

SEQ ID NO: 2398112 - protein, 26 aa, Entamoeba dispar
IMIDKEKHMYLIPKYYYKDTKIDVPT

SEQ ID NO: 2398113 - protein, 28 aa, Entamoeba dispar
IMIDKEKHMYLIPKYYYKNLKIDVPTEI

SEQ ID NO: 2398114 - protein, 28 aa, Entamoeba dispar
IMIDKEKHMYLIPKYYYKNVKIDIPTEI

SEQ ID NO: 2398115 - protein, 26 aa, Entamoeba dispar
IMIESSLFIPIFSFGIETQKFAYQNN

SEQ ID NO: 2398116 - protein, 20 aa, Entamoeba dispar
IMIIFAFQIKRLSLRHFIFT

SEQ ID NO: 2398117 - protein, 31 aa, Entamoeba dispar
IMIIVMVILPFILFIFTAIPFMNWRNLSTYL

SEQ ID NO: 2398118 - protein, 17 aa, Entamoeba dispar
IMIYPESLNSTHLEIIK

SEQ ID NO: 2398119 - protein, 25 aa, Entamoeba dispar
IMKIPKYIIISFISSQILVFNNENN

SEQ ID NO: 2398120 - protein, 19 aa, Entamoeba dispar
IMLFVCFGEGKSLSRQSKR

SEQ ID NO: 2398121 - protein, 21 aa, Entamoeba dispar
IMLIILLFPLPPFIARKIPFF

SEQ ID NO: 2398122 - protein, 18 aa, Entamoeba dispar
IMNFLKYCRFNGFFNKED

SEQ ID NO: 2398123 - protein, 18 aa, Entamoeba dispar
IMQFPVLYLEMQKGQNLS

SEQ ID NO: 2398124 - protein, 23 aa, Entamoeba dispar
IMQLWNCYLKEYVPIIPVLQEEI

SEQ ID NO: 2398125 - protein, 17 aa, Entamoeba dispar
IMRSYLAVRLDVFAKEF

SEQ ID NO: 2398126 - protein, 18 aa, Entamoeba dispar
IMRVIRFSIWYQGDFSIV

SEQ ID NO: 2398127 - protein, 30 aa, Entamoeba dispar
IMSLLCILLLLHIYWFTLILKMVYKIITER

SEQ ID NO: 2398128 - protein, 19 aa, Entamoeba dispar
IMVTPFTSQLLSLGNDFIR

SEQ ID NO: 2398129 - protein, 18 aa, Entamoeba dispar
INAEQIFKFFSMTINQRA

SEQ ID NO: 2398130 - protein, 24 aa, Entamoeba dispar
INAIKYTLLIEKIKFELNHQNIIC

SEQ ID NO: 2398131 - protein, 23 aa, Entamoeba dispar
INAPKCIILMKDTKDWKIRRISI

SEQ ID NO: 2398132 - protein, 17 aa, Entamoeba dispar
INCFIACSFHPYSKVSY

SEQ ID NO: 2398133 - protein, 25 aa, Entamoeba dispar
INCKYIPFIIPMILEFVLVLSFVLN

SEQ ID NO: 2398134 - protein, 29 aa, Entamoeba dispar
INCPEPSFPWFYKLWRVQGYYNLLILKCY

SEQ ID NO: 2398135 - protein, 25 aa, Entamoeba dispar
INCQRNCNVVLRWALLHGTYPIKKL

SEQ ID NO: 2398136 - protein, 20 aa, Entamoeba dispar
INDIDPIKFLLSFAKKYGSY

SEQ ID NO: 2398137 - protein, 28 aa, Entamoeba dispar
INDIKVMYLCMFFVLKNISYSTMKSWLE

SEQ ID NO: 2398138 - protein, 19 aa, Entamoeba dispar
INDLIYYFILICCILGCFK

SEQ ID NO: 2398139 - protein, 23 aa, Entamoeba dispar
INDSFLISLLNIIDTMFASSNPK

SEQ ID NO: 2398140 - protein, 39 aa, Entamoeba dispar
INDSTPVGWIIFGVLFYILFVIVLAIIIIGIIMKRKNSG

SEQ ID NO: 2398141 - protein, 25 aa, Entamoeba dispar
INEGVLFYENIKLFGGKNKIIHLSI

SEQ ID NO: 2398142 - protein, 24 aa, Entamoeba dispar
INELALWTLKCCGLYYQRLEGGDE

SEQ ID NO: 2398143 - protein, 28 aa, Entamoeba dispar
INEYLYHNIIELLTILPPSNNIIEKFQN

SEQ ID NO: 2398144 - protein, 17 aa, Entamoeba dispar
INFFQSLKMKIFFQIHQ

SEQ ID NO: 2398145 - protein, 26 aa, Entamoeba dispar
INFMESVWWVFKQLYEKNLVYRGLKI

SEQ ID NO: 2398146 - protein, 23 aa, Entamoeba dispar
INGHGYILLVAVLNAQIIGFASF

SEQ ID NO: 2398147 - protein, 23 aa, Entamoeba dispar
INGTLFYYFLIDNSLNINYPNIY

SEQ ID NO: 2398148 - protein, 22 aa, Entamoeba dispar
INICPYIRYETVPSSSLPGSTE

SEQ ID NO: 2398149 - protein, 26 aa, Entamoeba dispar
INICVIIICIIIFDIIYRLMYFINSR

SEQ ID NO: 2398150 - protein, 25 aa, Entamoeba dispar
INIDMNFILSCLIIFIANAETVSFV

SEQ ID NO: 2398151 - protein, 18 aa, Entamoeba dispar
INIFIPRPLDIQKVIIAI

SEQ ID NO: 2398152 - protein, 25 aa, Entamoeba dispar
INISYIMLILLFLAKTICFSVYGIM

SEQ ID NO: 2398153 - protein, 22 aa, Entamoeba dispar
INKFVSEGLRLVNKYLIECDVN

SEQ ID NO: 2398154 - protein, 17 aa, Entamoeba dispar
INKIIAIITLIIIIIFI

SEQ ID NO: 2398155 - protein, 40 aa, Entamoeba dispar
INKITITLIVILLVLIIFIVLIIIIVIIVIVIPKKKKSTK

SEQ ID NO: 2398156 - protein, 37 aa, Entamoeba dispar
INKRRKYILSGCYYLITKGWSFLFSKEKRTAKKLDHF

SEQ ID NO: 2398157 - protein, 19 aa, Entamoeba dispar
INLKFSSNNGIWYLISSYE

SEQ ID NO: 2398158 - protein, 17 aa, Entamoeba dispar
INLYVYPAYGFVTLMLG

SEQ ID NO: 2398159 - protein, 26 aa, Entamoeba dispar
INMATYFCWLIIPLLMKENGASSFLI

SEQ ID NO: 2398160 - protein, 23 aa, Entamoeba dispar
INNFWKIQHFFDKRLPALRDSAR

SEQ ID NO: 2398161 - protein, 17 aa, Entamoeba dispar
INNLKELTKLRSPLLIN

SEQ ID NO: 2398162 - protein, 18 aa, Entamoeba dispar
INNLTIRGFYQLYSKGKI

SEQ ID NO: 2398163 - protein, 20 aa, Entamoeba dispar
INNMYRIQVYYKAGGSWGPL

SEQ ID NO: 2398164 - protein, 27 aa, Entamoeba dispar
INNNVIYLHQLYLKNALTIRESWIKEN

SEQ ID NO: 2398165 - protein, 18 aa, Entamoeba dispar
INPIRWTLYQGISLKYNH

SEQ ID NO: 2398166 - protein, 24 aa, Entamoeba dispar
INPMRYWRIGVLFGGTIYVIILLI

SEQ ID NO: 2398167 - protein, 25 aa, Entamoeba dispar
INRSVLFFLFITYFFKILSRNKYNH

SEQ ID NO: 2398168 - protein, 24 aa, Entamoeba dispar
INRYTVCNWLILLFGWMSFVAFDS

SEQ ID NO: 2398169 - protein, 33 aa, Entamoeba dispar
INSIYHMQIVRNKKKFKMMFEWGRIGDKLKRTY

SEQ ID NO: 2398170 - protein, 25 aa, Entamoeba dispar
INSVFYPFKLCSCILNITIYIYIYH

SEQ ID NO: 2398171 - protein, 18 aa, Entamoeba dispar
INTHYFIDLTLFDIRKYY

SEQ ID NO: 2398172 - protein, 23 aa, Entamoeba dispar
INTLIGFWILFKRCCRLSKHKSV

SEQ ID NO: 2398173 - protein, 28 aa, Entamoeba dispar
INTLLIFFTLMIYIVLYLVCIMFNFNLI

SEQ ID NO: 2398174 - protein, 18 aa, Entamoeba dispar
INVIVINSFYYDVSNKTS

SEQ ID NO: 2398175 - protein, 22 aa, Entamoeba dispar
INVMMVIFYIMGILIHINCLYQ

SEQ ID NO: 2398176 - protein, 18 aa, Entamoeba dispar
INVQGSCTYCLNAKSKSY

SEQ ID NO: 2398177 - protein, 17 aa, Entamoeba dispar
INWRQYQVLFNHFSDDN

SEQ ID NO: 2398178 - protein, 20 aa, Entamoeba dispar
INYIAIYPIIWIYVFGRCRG

SEQ ID NO: 2398179 - protein, 19 aa, Entamoeba dispar
IPANYYTIYLKPVEVTIFI

SEQ ID NO: 2398180 - protein, 25 aa, Entamoeba dispar
IPCFFFFLFLFHYLSSSLLLSFFFH

SEQ ID NO: 2398181 - protein, 31 aa, Entamoeba dispar
IPESKSLEVFYPILPGRPFDKSFTTAAPYSK

SEQ ID NO: 2398182 - protein, 22 aa, Entamoeba dispar
IPETLLKRLALAKNLPTKIAVW

SEQ ID NO: 2398183 - protein, 38 aa, Entamoeba dispar
IPFIGCPLLLFKAWMLRWWKIMYLRLLDLQKWKVIHGL

SEQ ID NO: 2398184 - protein, 36 aa, Entamoeba dispar
IPGGIIGGLWYCLYVFLLIALMFRFFQAFWDCNKKT

SEQ ID NO: 2398185 - protein, 20 aa, Entamoeba dispar
IPISIFIDQQFLSLMKLYYP

SEQ ID NO: 2398186 - protein, 20 aa, Entamoeba dispar
IPITIPIKKMFWKIYIMLVG

SEQ ID NO: 2398187 - protein, 19 aa, Entamoeba dispar
IPKLSLNPLKVKLFVLFYF

SEQ ID NO: 2398188 - protein, 18 aa, Entamoeba dispar
IPLFISEALCFLFLIIFQ

SEQ ID NO: 2398189 - protein, 24 aa, Entamoeba dispar
IPLRSFFVVFTLILSIILSSFIIL

SEQ ID NO: 2398190 - protein, 27 aa, Entamoeba dispar
IPLTIYMLLNWLWLLGTLIYLNYVDPG

SEQ ID NO: 2398191 - protein, 27 aa, Entamoeba dispar
IPLVILWIILIVIEIGIFAVSMASYFI

SEQ ID NO: 2398192 - protein, 23 aa, Entamoeba dispar
IPMEKLTLLCVLKVLLSNTPTNA

SEQ ID NO: 2398193 - protein, 24 aa, Entamoeba dispar
IPNEKIEYLLPYLQFKINQINCKI

SEQ ID NO: 2398194 - protein, 26 aa, Entamoeba dispar
IPNTTLIMMKLPFLKQVKDLVDHFPE

SEQ ID NO: 2398195 - protein, 23 aa, Entamoeba dispar
IPPKNFLVRQIQKDLKKFEKRSD

SEQ ID NO: 2398196 - protein, 22 aa, Entamoeba dispar
IPQLIEIVTIYFIQIRKLIPSD

SEQ ID NO: 2398197 - protein, 24 aa, Entamoeba dispar
IPQMIQIPFLLQLDTSILLSNELL

SEQ ID NO: 2398198 - protein, 28 aa, Entamoeba dispar
IPRHLVLPDFFFKVLPYFKQSWVCDIYI

SEQ ID NO: 2398199 - protein, 22 aa, Entamoeba dispar
IPSYSFIKPLKSMKNRVVSKEI

SEQ ID NO: 2398200 - protein, 19 aa, Entamoeba dispar
IPTIIFPVLLFYLGMNNGL

SEQ ID NO: 2398201 - protein, 25 aa, Entamoeba dispar
IPTLFYPIIYIFWLDNEKLTSFKPL

SEQ ID NO: 2398202 - protein, 27 aa, Entamoeba dispar
IPTSPKEIFMFLKDPNKPILSRKVLVQ

SEQ ID NO: 2398203 - protein, 19 aa, Entamoeba dispar
IPTTCVYICNFRNVIGTMN

SEQ ID NO: 2398204 - protein, 18 aa, Entamoeba dispar
IPVHFDITFPYSSCPITS

SEQ ID NO: 2398205 - protein, 26 aa, Entamoeba dispar
IPVKPFRLFIPMSFINEIPFLIVLHF

SEQ ID NO: 2398206 - protein, 27 aa, Entamoeba dispar
IPVNRYTIPLIFYLTTSNNDFLQYNEI

SEQ ID NO: 2398207 - protein, 22 aa, Entamoeba dispar
IPVVLFLWLLLWVISGCFVCDR

SEQ ID NO: 2398208 - protein, 20 aa, Entamoeba dispar
IPWKTIVVVLIISSIYSLLQ

SEQ ID NO: 2398209 - protein, 20 aa, Entamoeba dispar
IPYTIWLSKCKKSLQMIAEL

SEQ ID NO: 2398210 - protein, 19 aa, Entamoeba dispar
IPYTIYFSKKKEILKEIIN

SEQ ID NO: 2398211 - protein, 18 aa, Entamoeba dispar
IQELLKIRKPTIVNITKF

SEQ ID NO: 2398212 - protein, 22 aa, Entamoeba dispar
IQEYVGFIITFNCSSKFTTGCL

SEQ ID NO: 2398213 - protein, 17 aa, Entamoeba dispar
IQFIKLLTNIVRISDHR

SEQ ID NO: 2398214 - protein, 19 aa, Entamoeba dispar
IQFISYLLTFIGSIVLDSS

SEQ ID NO: 2398215 - protein, 19 aa, Entamoeba dispar
IQFTRTKIYPGTRGVVLIL

SEQ ID NO: 2398216 - protein, 19 aa, Entamoeba dispar
IQHPIPHCKIYISQLSNYQ

SEQ ID NO: 2398217 - protein, 18 aa, Entamoeba dispar
IQIIWARYPCFDGIYDFS

SEQ ID NO: 2398218 - protein, 25 aa, Entamoeba dispar
IQIVTSVAIFLARGRVIKSLINHFK

SEQ ID NO: 2398219 - protein, 21 aa, Entamoeba dispar
IQLQIKWLRKFFIQEIIKLIE

SEQ ID NO: 2398220 - protein, 28 aa, Entamoeba dispar
IQNILFSGIGLYLPPSPLTTSLLKAQNS

SEQ ID NO: 2398221 - protein, 26 aa, Entamoeba dispar
IQNKTLDLFLLFIKEYISLFSSMNWT

SEQ ID NO: 2398222 - protein, 34 aa, Entamoeba dispar
IQNKYNDLFHLPHLFYICILELIWYLTENKCDNI

SEQ ID NO: 2398223 - protein, 18 aa, Entamoeba dispar
IQQGLFDLFIQTLQIFKN

SEQ ID NO: 2398224 - protein, 17 aa, Entamoeba dispar
IQQPLTQELIMSYPGCG

SEQ ID NO: 2398225 - protein, 24 aa, Entamoeba dispar
IQQYPIFHTYILNSFSFIPLKISH

SEQ ID NO: 2398226 - protein, 29 aa, Entamoeba dispar
IQSIQFFVIFKFIEFFLLDEALYTQFGFD

SEQ ID NO: 2398227 - protein, 23 aa, Entamoeba dispar
IQSKGAFLLYKGRDAVVTTCNSM

SEQ ID NO: 2398228 - protein, 26 aa, Entamoeba dispar
IQTMIFNAFVFCQIFNEINSRKVNGE

SEQ ID NO: 2398229 - protein, 25 aa, Entamoeba dispar
IQTVVLQIIPLIQLLLHSFKSSKDI

SEQ ID NO: 2398230 - protein, 32 aa, Entamoeba dispar
IQTWIFIPTSILLSIYLLCWTLFTVYSWTAHE

SEQ ID NO: 2398231 - protein, 22 aa, Entamoeba dispar
IRALFHLLIVPYLLAIFGHPTK

SEQ ID NO: 2398232 - protein, 26 aa, Entamoeba dispar
IRALIMKHFIHIISYSKLQKIFLVIS

SEQ ID NO: 2398233 - protein, 20 aa, Entamoeba dispar
IRARVISAVKYWIENIWGVI

SEQ ID NO: 2398234 - protein, 18 aa, Entamoeba dispar
IRCPYIVNFIGSVATADT

SEQ ID NO: 2398235 - protein, 25 aa, Entamoeba dispar
IRDANLFFAEFIRDLAIMWRHDEMA

SEQ ID NO: 2398236 - protein, 26 aa, Entamoeba dispar
IRDLLQLVLIFWILLNEFFSFTEVMN

SEQ ID NO: 2398237 - protein, 29 aa, Entamoeba dispar
IRDLTTRYYYMIPHIFDRGNIILIDNAEK

SEQ ID NO: 2398238 - protein, 19 aa, Entamoeba dispar
IRFIFIETFKRKLIINFNN

SEQ ID NO: 2398239 - protein, 49 aa, Entamoeba dispar
IRFSALGCFTFSGIIFFILSIVLALFPLNPIIQKWYLPIPQAINSIITD

SEQ ID NO: 2398240 - protein, 23 aa, Entamoeba dispar
IRGWKNFLFFAIGTLILIGGIVC

SEQ ID NO: 2398241 - protein, 27 aa, Entamoeba dispar
IRHDLGFRRILFILSLINGGVSYVQGM

SEQ ID NO: 2398242 - protein, 28 aa, Entamoeba dispar
IRIASLLHSLLFYSKIYPTINTLLSDDM

SEQ ID NO: 2398243 - protein, 27 aa, Entamoeba dispar
IRIETPQLLTYLYFTSLKDFDNTVWNI

SEQ ID NO: 2398244 - protein, 17 aa, Entamoeba dispar
IRKIWKFISYFIFMVFT

SEQ ID NO: 2398245 - protein, 32 aa, Entamoeba dispar
IRNPRLTAIINPKIPYYIFVHSRYASMTIPSF

SEQ ID NO: 2398246 - protein, 18 aa, Entamoeba dispar
IRNTLDLLFIHFHTFQKE

SEQ ID NO: 2398247 - protein, 33 aa, Entamoeba dispar
IRPEVTYFSLLLLLILISLCGSYFIRMNKPSFG

SEQ ID NO: 2398248 - protein, 22 aa, Entamoeba dispar
IRPYPTKFFWNLLSLYNVCLIL

SEQ ID NO: 2398249 - protein, 27 aa, Entamoeba dispar
IRPYSKYIICWFGLDTLQLLNFSIKIR

SEQ ID NO: 2398250 - protein, 24 aa, Entamoeba dispar
IRRFKHLTKLILFYGRNGKYQIST

SEQ ID NO: 2398251 - protein, 17 aa, Entamoeba dispar
IRRLHVFGEIFAENGFL

SEQ ID NO: 2398252 - protein, 24 aa, Entamoeba dispar
IRRQRRWYTKPKTIKYGDIKHKIT

SEQ ID NO: 2398253 - protein, 22 aa, Entamoeba dispar
IRSEPQLAFIKPGNAVEFNLFV

SEQ ID NO: 2398254 - protein, 17 aa, Entamoeba dispar
IRSIKRNVIFYGTLIIL

SEQ ID NO: 2398255 - protein, 19 aa, Entamoeba dispar
IRSKPLIIGGNFRHFLNGG

SEQ ID NO: 2398256 - protein, 20 aa, Entamoeba dispar
IRSNVWKLLLGYYTPRKREW

SEQ ID NO: 2398257 - protein, 28 aa, Entamoeba dispar
IRTKILDIIIKYILPLISNIPDIQKAFI

SEQ ID NO: 2398258 - protein, 18 aa, Entamoeba dispar
IRTRFVLPSLLTRQVVES

SEQ ID NO: 2398259 - protein, 27 aa, Entamoeba dispar
IRTYGDYLFKENLDFSYKLLRGIMNYC

SEQ ID NO: 2398260 - protein, 19 aa, Entamoeba dispar
ISCFYLILQPIFDYAPLLS

SEQ ID NO: 2398261 - protein, 23 aa, Entamoeba dispar
ISCGLCNDGYYLVDGKCIKCPSS

SEQ ID NO: 2398262 - protein, 23 aa, Entamoeba dispar
ISCYCFLLVFIRMLVELPGFCLT

SEQ ID NO: 2398263 - protein, 26 aa, Entamoeba dispar
ISDEMILFVQLIRYISNLPKMYIIYT

SEQ ID NO: 2398264 - protein, 25 aa, Entamoeba dispar
ISDSNSYICPLPYTCIDSNNCQHQT

SEQ ID NO: 2398265 - protein, 24 aa, Entamoeba dispar
ISDVFQFEDIWKHVCIVWTRCYDC

SEQ ID NO: 2398266 - protein, 23 aa, Entamoeba dispar
ISELCNIFRYFEIPKENGSKMIK

SEQ ID NO: 2398267 - protein, 25 aa, Entamoeba dispar
ISELLRIIEIAFISTPIFYSMSVTC

SEQ ID NO: 2398268 - protein, 23 aa, Entamoeba dispar
ISFCISEIIPWWLLCCHDSVKEV

SEQ ID NO: 2398269 - protein, 26 aa, Entamoeba dispar
ISFIIVIPALIYIIFASNLLPNKKDS

SEQ ID NO: 2398270 - protein, 26 aa, Entamoeba dispar
ISFIPMKAFIYHRRSNFLEVINIHYS

SEQ ID NO: 2398271 - protein, 18 aa, Entamoeba dispar
ISFKIRSITNSNEKVKMI

SEQ ID NO: 2398272 - protein, 20 aa, Entamoeba dispar
ISFLIFSCLFSSIITIIIPI

SEQ ID NO: 2398273 - protein, 20 aa, Entamoeba dispar
ISFLWIFNCAKGQDETGCFC

SEQ ID NO: 2398274 - protein, 21 aa, Entamoeba dispar
ISFNIFNVIWKRFLNKNYGIN

SEQ ID NO: 2398275 - protein, 24 aa, Entamoeba dispar
ISFSFDFLGLAGWALAILGQSPRR

SEQ ID NO: 2398276 - protein, 30 aa, Entamoeba dispar
ISFTSDIILLFFTLLFSVFIIISHWKKSCF

SEQ ID NO: 2398277 - protein, 26 aa, Entamoeba dispar
ISGFHDLYISLILLSLKKSDKMKKEK

SEQ ID NO: 2398278 - protein, 17 aa, Entamoeba dispar
ISGFLYSNGQKQSKYDT

SEQ ID NO: 2398279 - protein, 28 aa, Entamoeba dispar
ISGQTLLLLVLFFLAIEELINQNLSQFQ

SEQ ID NO: 2398280 - protein, 28 aa, Entamoeba dispar
ISHAFGIFLILCYIIVFIATLMTWVGAA

SEQ ID NO: 2398281 - protein, 24 aa, Entamoeba dispar
ISHIDHCIGIGKWLGTLTLHQNKP

SEQ ID NO: 2398282 - protein, 19 aa, Entamoeba dispar
ISHYIIKSTWLPDNRKYIH

SEQ ID NO: 2398283 - protein, 26 aa, Entamoeba dispar
ISIFALLLTFYLWIRAVKSGSPIKAA

SEQ ID NO: 2398284 - protein, 24 aa, Entamoeba dispar
ISIFILLLIAFFIPNSPLKSVIIS

SEQ ID NO: 2398285 - protein, 32 aa, Entamoeba dispar
ISIGTVIVLILFVLLFIFLSSFIKSKKVNIEV

SEQ ID NO: 2398286 - protein, 18 aa, Entamoeba dispar
ISILLGVICGLFAVLFVM

SEQ ID NO: 2398287 - protein, 33 aa, Entamoeba dispar
ISIMQAVFSMVFYFTPITLFTGILLVGYSTFYT

SEQ ID NO: 2398288 - protein, 25 aa, Entamoeba dispar
ISISLPIIVIFLFAKKRNSTYYFIT

SEQ ID NO: 2398289 - protein, 18 aa, Entamoeba dispar
ISITPYFDIYDSGTFTLT

SEQ ID NO: 2398290 - protein, 17 aa, Entamoeba dispar
ISIVERMLILLEKKDSG

SEQ ID NO: 2398291 - protein, 17 aa, Entamoeba dispar
ISKFHVYLNLQVESALS

SEQ ID NO: 2398292 - protein, 38 aa, Entamoeba dispar
ISKIPLPPRAAVVLYYSYLGRSLEIISPLLAMLNQENL

SEQ ID NO: 2398293 - protein, 37 aa, Entamoeba dispar
ISKLGKLYVFHRYICFWPQVLKFNADVWKFEDISGIK

SEQ ID NO: 2398294 - protein, 27 aa, Entamoeba dispar
ISKLKNWLLLLFDASYYKIIVWILFTI

SEQ ID NO: 2398295 - protein, 35 aa, Entamoeba dispar
ISKMKIKYYNNTSPLFIPLLQHDVVIWMGDLNYRI

SEQ ID NO: 2398296 - protein, 22 aa, Entamoeba dispar
ISKPLLTIKKMESLLTLLVLVF

SEQ ID NO: 2398297 - protein, 23 aa, Entamoeba dispar
ISKYWDFFTLYIFVAVVAILVII

SEQ ID NO: 2398298 - protein, 19 aa, Entamoeba dispar
ISLCHFIHSLIIPTSPLEL

SEQ ID NO: 2398299 - protein, 28 aa, Entamoeba dispar
ISLDMDFTFLLIFYSLKSRKPTNYIKMN

SEQ ID NO: 2398300 - protein, 24 aa, Entamoeba dispar
ISLFSSMNWTIHDSIIISILNFIE

SEQ ID NO: 2398301 - protein, 24 aa, Entamoeba dispar
ISLGFFQLLLWKYYPEEPTARIWG

SEQ ID NO: 2398302 - protein, 23 aa, Entamoeba dispar
ISLIFVPFIIPLFYKKTPLQEDQ

SEQ ID NO: 2398303 - protein, 20 aa, Entamoeba dispar
ISLITILFWYDTPVGIVSII

SEQ ID NO: 2398304 - protein, 17 aa, Entamoeba dispar
ISLKHVLNNFQEFLYSG

SEQ ID NO: 2398305 - protein, 29 aa, Entamoeba dispar
ISLLFIVIGFFFPLVWIINYVLFSSSKDK

SEQ ID NO: 2398306 - protein, 25 aa, Entamoeba dispar
ISLLTILLLIYFNCSHIFYRNLFIS

SEQ ID NO: 2398307 - protein, 18 aa, Entamoeba dispar
ISLLYLLGYIIDLILSIL

SEQ ID NO: 2398308 - protein, 25 aa, Entamoeba dispar
ISLNDYVLMLRFIQILGKEAFEVLI

SEQ ID NO: 2398309 - protein, 25 aa, Entamoeba dispar
ISLTLFFNYFIFSVRWYCGRYLLDP

SEQ ID NO: 2398310 - protein, 22 aa, Entamoeba dispar
ISMLHSFHFIYRQLNPSSILVA

SEQ ID NO: 2398311 - protein, 23 aa, Entamoeba dispar
ISNKYFITSKWTKLVKRNYHEKV

SEQ ID NO: 2398312 - protein, 44 aa, Entamoeba dispar
ISNNLKIMIQILSNVFPFKDFWGHVCIVWNKCYYFFSQDQLEMQ

SEQ ID NO: 2398313 - protein, 25 aa, Entamoeba dispar
ISNNLKIMIQILSNVFPVSEFWGHV

SEQ ID NO: 2398314 - protein, 22 aa, Entamoeba dispar
ISNSFIYVFLDTLYIQYFVKQI

SEQ ID NO: 2398315 - protein, 25 aa, Entamoeba dispar
ISPDFSYIFNIIKKEVMKKWPENAL

SEQ ID NO: 2398316 - protein, 27 aa, Entamoeba dispar
ISQIAMLMFPLMLQFIVAWVKEDEPKK

SEQ ID NO: 2398317 - protein, 25 aa, Entamoeba dispar
ISQVVIHFIVIQLALKWGKEAAGPD

SEQ ID NO: 2398318 - protein, 17 aa, Entamoeba dispar
ISQYFYEHSLLPSINFV

SEQ ID NO: 2398319 - protein, 35 aa, Entamoeba dispar
ISRDVYSLIIPFLIPNCVELLPILLSMERLEILKI

SEQ ID NO: 2398320 - protein, 24 aa, Entamoeba dispar
ISRKPLLTYMLLKLDCPIKEEQLA

SEQ ID NO: 2398321 - protein, 23 aa, Entamoeba dispar
ISRKPLLTYMLLRLDTPLKEEQI

SEQ ID NO: 2398322 - protein, 28 aa, Entamoeba dispar
ISRLCIPPMIQFFHLLNNTPELISCITS

SEQ ID NO: 2398323 - protein, 17 aa, Entamoeba dispar
ISRYKYIDLCVLRNKFP

SEQ ID NO: 2398324 - protein, 26 aa, Entamoeba dispar
ISSEAPPLFLFFKCSDNIALDEARKQ

SEQ ID NO: 2398325 - protein, 20 aa, Entamoeba dispar
ISSFSFATTFFFLVFSHLLS

SEQ ID NO: 2398326 - protein, 17 aa, Entamoeba dispar
ISSIIIIKLMKKKSTNQ

SEQ ID NO: 2398327 - protein, 26 aa, Entamoeba dispar
ISSIPALIYFFQNILCQLSLANIQPG

SEQ ID NO: 2398328 - protein, 21 aa, Entamoeba dispar
ISSIVICEYGYYYNGSICTQC

SEQ ID NO: 2398329 - protein, 23 aa, Entamoeba dispar
ISSLNYGLIIGIPLICILMIIII

SEQ ID NO: 2398330 - protein, 18 aa, Entamoeba dispar
ISSLSPLIYLTTLKFLNA

SEQ ID NO: 2398331 - protein, 32 aa, Entamoeba dispar
ISSMSLTMRFFIMLRIYLSKYIKELPIFDTEG

SEQ ID NO: 2398332 - protein, 17 aa, Entamoeba dispar
ISSPYGCLRCMTGYYLK

SEQ ID NO: 2398333 - protein, 28 aa, Entamoeba dispar
ISSQMHLTLLDLLLFSTSGFIDFSISLF

SEQ ID NO: 2398334 - protein, 25 aa, Entamoeba dispar
ISSTLSIPSFYFSYTYDLTRSYQTQ

SEQ ID NO: 2398335 - protein, 23 aa, Entamoeba dispar
ISTISFNLLISFITYILSNQKNI

SEQ ID NO: 2398336 - protein, 37 aa, Entamoeba dispar
ISVAIVIGLFIIGIWIWYLRRPYPVYLVSFATSIPED

SEQ ID NO: 2398337 - protein, 37 aa, Entamoeba dispar
ISVATLFLFAYIPLSIYYIFSWGFTSLYLLLSLGLVI

SEQ ID NO: 2398338 - protein, 37 aa, Entamoeba dispar
ISVHYRFYWQIITVDLLFIIPYWRSYLTGLSSVHIKQ

SEQ ID NO: 2398339 - protein, 27 aa, Entamoeba dispar
ISVLFLVFTFFLIFVSYQSLKTKPQKA

SEQ ID NO: 2398340 - protein, 24 aa, Entamoeba dispar
ISVSLMFWILYFKSPSTVFRATDE

SEQ ID NO: 2398341 - protein, 25 aa, Entamoeba dispar
ISVSLNFALINLGLVSVAVTFLMGS

SEQ ID NO: 2398342 - protein, 33 aa, Entamoeba dispar
ISWVFNYYLNKLPSWRWYYKFHYAPFALDFALY

SEQ ID NO: 2398343 - protein, 22 aa, Entamoeba dispar
ISYFCDIIFLVLLVLRLDRVFM

SEQ ID NO: 2398344 - protein, 34 aa, Entamoeba dispar
ISYGIIILIVLTTLIIILITIGMFIVIYRIYNKR

SEQ ID NO: 2398345 - protein, 31 aa, Entamoeba dispar
ISYITNLRVAPKTYFSIRKLNLHITKMYGTE

SEQ ID NO: 2398346 - protein, 28 aa, Entamoeba dispar
ISYKEMIKFIIFFIKQKLGKIDSKEVFM

SEQ ID NO: 2398347 - protein, 29 aa, Entamoeba dispar
ISYPALMFPTCAGILRYIPKKWKIVQLWN

SEQ ID NO: 2398348 - protein, 18 aa, Entamoeba dispar
ISYYLYHNSLSFTTGNGL

SEQ ID NO: 2398349 - protein, 25 aa, Entamoeba dispar
ITAKTSFPLYIYTQSYELFELTRTN

SEQ ID NO: 2398350 - protein, 22 aa, Entamoeba dispar
ITASFIIKIIWFRGIVRESSGL

SEQ ID NO: 2398351 - protein, 19 aa, Entamoeba dispar
ITFLTALLKVCCKIESLSD

SEQ ID NO: 2398352 - protein, 30 aa, Entamoeba dispar
ITFNVPSFTPLLIPIFHVTPLTSPIPSCDD

SEQ ID NO: 2398353 - protein, 19 aa, Entamoeba dispar
ITFSIIFLGLPIYYIAKTY

SEQ ID NO: 2398354 - protein, 19 aa, Entamoeba dispar
ITGFGIILFLHLCFDVLTL

SEQ ID NO: 2398355 - protein, 26 aa, Entamoeba dispar
ITIEEVLSHPLFWNCKKRLEFIQKVS

SEQ ID NO: 2398356 - protein, 28 aa, Entamoeba dispar
ITIELIIIYILLMLSWIGYYPASFNMTI

SEQ ID NO: 2398357 - protein, 19 aa, Entamoeba dispar
ITIKCNNLPILISSIRSEG

SEQ ID NO: 2398358 - protein, 24 aa, Entamoeba dispar
ITIKPNVILTYNGKTSLLINKLSI

SEQ ID NO: 2398359 - protein, 18 aa, Entamoeba dispar
ITILGILQCNILTISGNS

SEQ ID NO: 2398360 - protein, 19 aa, Entamoeba dispar
ITIQRILTLLYSYADLFSS

SEQ ID NO: 2398361 - protein, 27 aa, Entamoeba dispar
ITKASIYLVIFALVIAAVFIAFYIFTV

SEQ ID NO: 2398362 - protein, 27 aa, Entamoeba dispar
ITKASIYLVILVLVIAAVFVAFYIFTS

SEQ ID NO: 2398363 - protein, 23 aa, Entamoeba dispar
ITKELILVICPLLSSITKNHIEL

SEQ ID NO: 2398364 - protein, 23 aa, Entamoeba dispar
ITKFLQHKLFQIEDYAIFPITEH

SEQ ID NO: 2398365 - protein, 21 aa, Entamoeba dispar
ITKLNIFFQRFLKDMKSFEIL

SEQ ID NO: 2398366 - protein, 29 aa, Entamoeba dispar
ITKNRLVHLIIFCPCTCVPPIPIMVGTDY

SEQ ID NO: 2398367 - protein, 17 aa, Entamoeba dispar
ITKQRIRWKKQFELPVQ

SEQ ID NO: 2398368 - protein, 25 aa, Entamoeba dispar
ITKRGFSLPLFFMGHSMGGLLTSIL

SEQ ID NO: 2398369 - protein, 23 aa, Entamoeba dispar
ITLALTITTLIILSTKLGEINYT

SEQ ID NO: 2398370 - protein, 27 aa, Entamoeba dispar
ITLCVGITFFLFSLHVTVFHVQYNSLP

SEQ ID NO: 2398371 - protein, 22 aa, Entamoeba dispar
ITLFLKGFIMSYWFGYSDNPIN

SEQ ID NO: 2398372 - protein, 19 aa, Entamoeba dispar
ITLIVFILGMLRKIKDSST

SEQ ID NO: 2398373 - protein, 25 aa, Entamoeba dispar
ITLKYLYFISYFFNFFYQKVINITT

SEQ ID NO: 2398374 - protein, 29 aa, Entamoeba dispar
ITLRFGWTINIILLYVAWFDENKIVRECI

SEQ ID NO: 2398375 - protein, 17 aa, Entamoeba dispar
ITLSFGRKCYYYELYQS

SEQ ID NO: 2398376 - protein, 21 aa, Entamoeba dispar
ITLTSLYVWVYVMIGWCLFVM

SEQ ID NO: 2398377 - protein, 27 aa, Entamoeba dispar
ITMNAWDIFLFLSSKSFIILRRNNEMI

SEQ ID NO: 2398378 - protein, 22 aa, Entamoeba dispar
ITNFITVLFQLLRAFGLNTIAG

SEQ ID NO: 2398379 - protein, 30 aa, Entamoeba dispar
ITNIFKTLLILIFWIFVIQPELTMIGKLKT

SEQ ID NO: 2398380 - protein, 22 aa, Entamoeba dispar
ITNLRVLLKQLVNNRHITDTNL

SEQ ID NO: 2398381 - protein, 30 aa, Entamoeba dispar
ITNSIDLLIEYFFIILKKNNKSYDWMILIL

SEQ ID NO: 2398382 - protein, 23 aa, Entamoeba dispar
ITPSARLPWHIRMLKKASESGED

SEQ ID NO: 2398383 - protein, 26 aa, Entamoeba dispar
ITQKHLIITYFIRELLNIYTREGPVG

SEQ ID NO: 2398384 - protein, 23 aa, Entamoeba dispar
ITQRSIVVLPKKKLMKNPRKPTD

SEQ ID NO: 2398385 - protein, 18 aa, Entamoeba dispar
ITRKGIFFSVKTVPYHTL

SEQ ID NO: 2398386 - protein, 24 aa, Entamoeba dispar
ITRQLVMCIIILYIRFYGNVIERW

SEQ ID NO: 2398387 - protein, 25 aa, Entamoeba dispar
ITRTMRILYNIFLLGIILTIVSSSI

SEQ ID NO: 2398388 - protein, 18 aa, Entamoeba dispar
ITRYPLFIQTLISGISQE

SEQ ID NO: 2398389 - protein, 18 aa, Entamoeba dispar
ITSAFGYYLSLIEMIFTL

SEQ ID NO: 2398390 - protein, 23 aa, Entamoeba dispar
ITSFIVLLFIIIPLVINGNISDQ

SEQ ID NO: 2398391 - protein, 28 aa, Entamoeba dispar
ITSGGLELIYLILTMKYDDKHKGNMNVV

SEQ ID NO: 2398392 - protein, 30 aa, Entamoeba dispar
ITSILLVLLCLIIVTIICVLCLIKKKSKYA

SEQ ID NO: 2398393 - protein, 19 aa, Entamoeba dispar
ITSLLVCKMLSLLQPTSDQ

SEQ ID NO: 2398394 - protein, 33 aa, Entamoeba dispar
ITSSVFGLLALLYPFIWQGVLIPFVPVQLQEFL

SEQ ID NO: 2398395 - protein, 25 aa, Entamoeba dispar
ITTGLNCIIFLLFQFKKLQIECRLI

SEQ ID NO: 2398396 - protein, 31 aa, Entamoeba dispar
ITTIQYIPHLCALSLLFYAPTTVHGELEACA

SEQ ID NO: 2398397 - protein, 20 aa, Entamoeba dispar
ITTLFRIILLIPILNNYLSN

SEQ ID NO: 2398398 - protein, 24 aa, Entamoeba dispar
ITVENPFFSFLSPNIEFGKEVPLD

SEQ ID NO: 2398399 - protein, 19 aa, Entamoeba dispar
ITVFSLYVLSIIILPICVW

SEQ ID NO: 2398400 - protein, 56 aa, Entamoeba dispar
ITVHSKTPMWLILLIAFLSFDNIVYVLKSPTLLALTLIIIAIIYSLNKFGYAYLID

SEQ ID NO: 2398401 - protein, 22 aa, Entamoeba dispar
ITVYFTITLLCTCKEYEAIQLI

SEQ ID NO: 2398402 - protein, 26 aa, Entamoeba dispar
ITYEDYPYFIIAESRPFTIRTSLENT

SEQ ID NO: 2398403 - protein, 21 aa, Entamoeba dispar
ITYILIMTLIIFLLPKVYGDE

SEQ ID NO: 2398404 - protein, 18 aa, Entamoeba dispar
ITYRFIHRYGFDLDSGMI

SEQ ID NO: 2398405 - protein, 22 aa, Entamoeba dispar
ITYYIIPMSLLQMKLDILFICF

SEQ ID NO: 2398406 - protein, 21 aa, Entamoeba dispar
IVAEMFLGIPLFPANSEYDLL

SEQ ID NO: 2398407 - protein, 31 aa, Entamoeba dispar
IVAIKGTFPFIWIFLVFASICYWSSNQFAPN

SEQ ID NO: 2398408 - protein, 24 aa, Entamoeba dispar
IVCRMLMIIVVVISYPALMFPTCA

SEQ ID NO: 2398409 - protein, 23 aa, Entamoeba dispar
IVDGQLILYLQSFARYMVNVLQE

SEQ ID NO: 2398410 - protein, 24 aa, Entamoeba dispar
IVDWTIPIFQFPLSGIITFIIGGI

SEQ ID NO: 2398411 - protein, 18 aa, Entamoeba dispar
IVDYRKNVFYLSAANGWF

SEQ ID NO: 2398412 - protein, 27 aa, Entamoeba dispar
IVEPPDYPMRFYGKVYFNNTLKITKSD

SEQ ID NO: 2398413 - protein, 20 aa, Entamoeba dispar
IVFLAPFSVSVPEALEIGCS

SEQ ID NO: 2398414 - protein, 18 aa, Entamoeba dispar
IVFNTYIQLRISVGFAGP

SEQ ID NO: 2398415 - protein, 18 aa, Entamoeba dispar
IVFWIGHVSFKHSITFET

SEQ ID NO: 2398416 - protein, 23 aa, Entamoeba dispar
IVGFSLFVLIIVSLSIIGLASVQ

SEQ ID NO: 2398417 - protein, 29 aa, Entamoeba dispar
IVHNFHFETLPSIFWSLLNAGNNKRLLCR

SEQ ID NO: 2398418 - protein, 18 aa, Entamoeba dispar
IVIMNILNAFYNKFEKMD

SEQ ID NO: 2398419 - protein, 26 aa, Entamoeba dispar
IVIPLCAIPFWYIQIPLIIIGFLVMS

SEQ ID NO: 2398420 - protein, 19 aa, Entamoeba dispar
IVIQLLSLHFSFSKDILPQ

SEQ ID NO: 2398421 - protein, 17 aa, Entamoeba dispar
IVITLLACCQGAVIVDF

SEQ ID NO: 2398422 - protein, 38 aa, Entamoeba dispar
IVKASGFKISYEGGPLPWYLNKGLYFTNITLRNRIADV

SEQ ID NO: 2398423 - protein, 27 aa, Entamoeba dispar
IVKFITHPFLWSFVFMVICGYWNGIFQ

SEQ ID NO: 2398424 - protein, 35 aa, Entamoeba dispar
IVKQTFIQCLSSIPLKLLYKLILLIKPNNSLSYPT

SEQ ID NO: 2398425 - protein, 25 aa, Entamoeba dispar
IVLFWVFVLIWRKKKLITFIVYCCL

SEQ ID NO: 2398426 - protein, 37 aa, Entamoeba dispar
IVLGRWSYWQYKQRFNLLALCIMLVVALGLLFSPNGW

SEQ ID NO: 2398427 - protein, 26 aa, Entamoeba dispar
IVLIISPRLLFKFLSVSLAFIMFIYL

SEQ ID NO: 2398428 - protein, 24 aa, Entamoeba dispar
IVLIRLHLFLDFYSFNIPSFGYFY

SEQ ID NO: 2398429 - protein, 22 aa, Entamoeba dispar
IVLLEKAQIFAVPLISSMKYNI

SEQ ID NO: 2398430 - protein, 21 aa, Entamoeba dispar
IVLLLFFISSINGKIHCNNGV

SEQ ID NO: 2398431 - protein, 19 aa, Entamoeba dispar
IVLLLFYFILYIIFVVYSQ

SEQ ID NO: 2398432 - protein, 42 aa, Entamoeba dispar
IVLQLIENTPYYLFVHKPFGIPFTTDVPILFTPIVHPCSYVY

SEQ ID NO: 2398433 - protein, 18 aa, Entamoeba dispar
IVLSPETLTKIIKIDFDC

SEQ ID NO: 2398434 - protein, 20 aa, Entamoeba dispar
IVLTMDFNNPRFSHSLKHLV

SEQ ID NO: 2398435 - protein, 35 aa, Entamoeba dispar
IVLYRTYFLGYLIPLFLYLWLSYYPPHLSYQNTMN

SEQ ID NO: 2398436 - protein, 25 aa, Entamoeba dispar
IVMRAQDLILRLFNKLSSEEKKYFK

SEQ ID NO: 2398437 - protein, 18 aa, Entamoeba dispar
IVNHDLFYLNDSGSIRII

SEQ ID NO: 2398438 - protein, 30 aa, Entamoeba dispar
IVNPNQMFVLFILLIKYSIYSFLSGISCVQ

SEQ ID NO: 2398439 - protein, 22 aa, Entamoeba dispar
IVQRNYNGKLLWNIWMEKDDNG

SEQ ID NO: 2398440 - protein, 58 aa, Entamoeba dispar
IVRYPLHILPPLKSIPLRTIIWILFYAPFKFFYLAVQLLYLLLFKLPNYSHILIQNPP

SEQ ID NO: 2398441 - protein, 18 aa, Entamoeba dispar
IVSFFFALFSSKQIVPHQ

SEQ ID NO: 2398442 - protein, 23 aa, Entamoeba dispar
IVSGNYEFMFAYTGLGDLGNPVA

SEQ ID NO: 2398443 - protein, 25 aa, Entamoeba dispar
IVSIIALILFIIYSLTVFSSELLLP

SEQ ID NO: 2398444 - protein, 20 aa, Entamoeba dispar
IVSIIKILRRCCEIDLFQFH

SEQ ID NO: 2398445 - protein, 17 aa, Entamoeba dispar
IVSLCFILALRGLSTQI

SEQ ID NO: 2398446 - protein, 28 aa, Entamoeba dispar
IVSLSVLIFCIITIIISFNLSLHNMFYK

SEQ ID NO: 2398447 - protein, 28 aa, Entamoeba dispar
IVSQLPLKYFIIPFILSIGIILIVHLTE

SEQ ID NO: 2398448 - protein, 18 aa, Entamoeba dispar
IVSSLLKEALREISLFPI

SEQ ID NO: 2398449 - protein, 17 aa, Entamoeba dispar
IVSVIIFVLLLVVAFFL

SEQ ID NO: 2398450 - protein, 20 aa, Entamoeba dispar
IVSVIIIIVIIVTLRNKKDE

SEQ ID NO: 2398451 - protein, 20 aa, Entamoeba dispar
IVSWLLFIGALLTSTGLLLN

SEQ ID NO: 2398452 - protein, 20 aa, Entamoeba dispar
IVSYEVFLRKIPYGNGCFVH

SEQ ID NO: 2398453 - protein, 28 aa, Entamoeba dispar
IVTLILLLLQWKMLMIICLIINKNYKQK

SEQ ID NO: 2398454 - protein, 21 aa, Entamoeba dispar
IVTVFRQFHPSTLWTSFSYLS

SEQ ID NO: 2398455 - protein, 18 aa, Entamoeba dispar
IVTWMNAGATQYIFVHKK

SEQ ID NO: 2398456 - protein, 23 aa, Entamoeba dispar
IVVDPALFMMLSGFYKETATDVL

SEQ ID NO: 2398457 - protein, 22 aa, Entamoeba dispar
IVVLLVIWRKTSMKSWYFEHSY

SEQ ID NO: 2398458 - protein, 32 aa, Entamoeba dispar
IVVNKLSAWDYLLFLNGIVLASILVYITLKMI

SEQ ID NO: 2398459 - protein, 29 aa, Entamoeba dispar
IVVTIIFILMIIFYLLRRVYFPEEQQKFA

SEQ ID NO: 2398460 - protein, 21 aa, Entamoeba dispar
IVVVLGIIWFAIGIVYVALSL

SEQ ID NO: 2398461 - protein, 19 aa, Entamoeba dispar
IVVVMIIIAIGIKQTVDIV

SEQ ID NO: 2398462 - protein, 19 aa, Entamoeba dispar
IVVYGLIGSLFIAVFCGVT

SEQ ID NO: 2398463 - protein, 19 aa, Entamoeba dispar
IWFDFTIACSSRFPIVLVP

SEQ ID NO: 2398464 - protein, 31 aa, Entamoeba dispar
IWLSIFHITNSLLILILSILLQALCFTLYCL

SEQ ID NO: 2398465 - protein, 19 aa, Entamoeba dispar
IWLVLPFSHQHYVLIIYSF

SEQ ID NO: 2398466 - protein, 19 aa, Entamoeba dispar
IYAQTFFNGLQNHFTRMIL

SEQ ID NO: 2398467 - protein, 27 aa, Entamoeba dispar
IYDETMAKLLLRLLAYFHEHVSETDQI

SEQ ID NO: 2398468 - protein, 18 aa, Entamoeba dispar
IYEMFRVFRIIDLTKENK

SEQ ID NO: 2398469 - protein, 22 aa, Entamoeba dispar
IYFIVFVIVLKLSAIYLYGSGF

SEQ ID NO: 2398470 - protein, 19 aa, Entamoeba dispar
IYFLFPLFCLTTYISLDTG

SEQ ID NO: 2398471 - protein, 29 aa, Entamoeba dispar
IYFVETPCFNILPYLIQQTKGYYYVLYSE

SEQ ID NO: 2398472 - protein, 19 aa, Entamoeba dispar
IYGKWFKLNMNFNGYIAIE

SEQ ID NO: 2398473 - protein, 30 aa, Entamoeba dispar
IYGSPLLFVFVYRFILFSFQYISVSIKFYS

SEQ ID NO: 2398474 - protein, 17 aa, Entamoeba dispar
IYHDALVGIFDYIQSDG

SEQ ID NO: 2398475 - protein, 28 aa, Entamoeba dispar
IYHYSAFAILLFFTAWLPQAAIAMHGSQ

SEQ ID NO: 2398476 - protein, 23 aa, Entamoeba dispar
IYICLFYLLYKYLVFYEIFTFIT

SEQ ID NO: 2398477 - protein, 35 aa, Entamoeba dispar
IYINMGKWVYVPLIVFIVFLLLNIGFGFLNGKFFS

SEQ ID NO: 2398478 - protein, 21 aa, Entamoeba dispar
IYKFISPYYFPKEIKTLFDSF

SEQ ID NO: 2398479 - protein, 18 aa, Entamoeba dispar
IYKLVIFEGYQPYYLEEF

SEQ ID NO: 2398480 - protein, 17 aa, Entamoeba dispar
IYKYSLEFVLKLLHCSL

SEQ ID NO: 2398481 - protein, 31 aa, Entamoeba dispar
IYLLPLCCSLLIPFILQFTISWGMKAVLPIT

SEQ ID NO: 2398482 - protein, 19 aa, Entamoeba dispar
IYLRDILDDTLRLLEKLQS

SEQ ID NO: 2398483 - protein, 17 aa, Entamoeba dispar
IYLTWKRRLKMLHDAAS

SEQ ID NO: 2398484 - protein, 21 aa, Entamoeba dispar
IYNVLFTFLPIIVFGIFDRDI

SEQ ID NO: 2398485 - protein, 19 aa, Entamoeba dispar
IYPLGVCFYRILTNKLPFG

SEQ ID NO: 2398486 - protein, 27 aa, Entamoeba dispar
IYSLGMLYIIIHMKFIPSKKQYISWVM

SEQ ID NO: 2398487 - protein, 23 aa, Entamoeba dispar
IYSTLICFLIFLGLSCGEIQKPL

SEQ ID NO: 2398488 - protein, 23 aa, Entamoeba dispar
IYTKSFIPHLFSLSANGFSYYVY

SEQ ID NO: 2398489 - protein, 28 aa, Entamoeba dispar
IYYIIPIIIFIFYFWIINGSDSCNKIRF

SEQ ID NO: 2398490 - protein, 24 aa, Entamoeba dispar
KAATKCVPALLRVFFQAVSVRYNS

SEQ ID NO: 2398491 - protein, 23 aa, Entamoeba dispar
KAAVDLCRLVFPLSSDENPRVRN

SEQ ID NO: 2398492 - protein, 25 aa, Entamoeba dispar
KACMIIFLILGICFPPFLICSLVYM

SEQ ID NO: 2398493 - protein, 30 aa, Entamoeba dispar
KAEDVFKIIFRLAPNHCFAHYLRGVLFQQI

SEQ ID NO: 2398494 - protein, 24 aa, Entamoeba dispar
KAERIEFLELITDNFFSLNALTCT

SEQ ID NO: 2398495 - protein, 30 aa, Entamoeba dispar
KAFPTKDFWRHVCIVWAKCFYYTSEKTLEK

SEQ ID NO: 2398496 - protein, 25 aa, Entamoeba dispar
KAIVCGIIIFFVKFWIIKEIENKMN

SEQ ID NO: 2398497 - protein, 25 aa, Entamoeba dispar
KAKTKFFITISRFGNLQFTNALSLA

SEQ ID NO: 2398498 - protein, 21 aa, Entamoeba dispar
KAKYYRVEIPKGKKIRVNTCN

SEQ ID NO: 2398499 - protein, 20 aa, Entamoeba dispar
KALARGLLDLGLKKGDVIGF

SEQ ID NO: 2398500 - protein, 17 aa, Entamoeba dispar
KAMEKLFNYYKVELIKA

SEQ ID NO: 2398501 - protein, 26 aa, Entamoeba dispar
KAMLIAIIPRLIFDITMFIPIVAQTI

SEQ ID NO: 2398502 - protein, 27 aa, Entamoeba dispar
KANILFILGIFIPLLQCMNWMCIFRKP

SEQ ID NO: 2398503 - protein, 31 aa, Entamoeba dispar
KANYFTPNYVLYLPYYLLGSQVTLRIITISI

SEQ ID NO: 2398504 - protein, 25 aa, Entamoeba dispar
KAPKHIYDFLITELNWEEFIAKLPK

SEQ ID NO: 2398505 - protein, 32 aa, Entamoeba dispar
KAQTLICAYLTRIKLPKYLKYTLYSMIPDLRK

SEQ ID NO: 2398506 - protein, 19 aa, Entamoeba dispar
KARVTNNMFLSDKINFIRT

SEQ ID NO: 2398507 - protein, 24 aa, Entamoeba dispar
KASRLTYHFTKPSYIFITGATQLD

SEQ ID NO: 2398508 - protein, 21 aa, Entamoeba dispar
KATQMSWALKIDRLREAFSNG

SEQ ID NO: 2398509 - protein, 29 aa, Entamoeba dispar
KATRVKIIVLILLMLILGAIIVLVLKVAL

SEQ ID NO: 2398510 - protein, 17 aa, Entamoeba dispar
KAYSTFDFAILEEIPLT

SEQ ID NO: 2398511 - protein, 28 aa, Entamoeba dispar
KCDVSYQMLYIPFYSLTKKAQSIVNRKL

SEQ ID NO: 2398512 - protein, 18 aa, Entamoeba dispar
KCFALYVLGTSKTTGFIS

SEQ ID NO: 2398513 - protein, 23 aa, Entamoeba dispar
KCFKCLTGFIPYNEQCVTLKSIN

SEQ ID NO: 2398514 - protein, 17 aa, Entamoeba dispar
KCFSCDSSLNLYLLNSH

SEQ ID NO: 2398515 - protein, 34 aa, Entamoeba dispar
KCILGLVALLIIFQAFVLIFIFTSGYVTLDNYQL

SEQ ID NO: 2398516 - protein, 17 aa, Entamoeba dispar
KCISFRLLNRCIKSKNN

SEQ ID NO: 2398517 - protein, 22 aa, Entamoeba dispar
KCKLCFDGFVLNGLNCLSYKTI

SEQ ID NO: 2398518 - protein, 21 aa, Entamoeba dispar
KCKTGYFAFEGKCYLCDPRCA

SEQ ID NO: 2398519 - protein, 17 aa, Entamoeba dispar
KCLKLINTGLIGLNKFK

SEQ ID NO: 2398520 - protein, 19 aa, Entamoeba dispar
KCMLSKTNIIIIVSISCIV

SEQ ID NO: 2398521 - protein, 44 aa, Entamoeba dispar
KCNKEIIWWMIMIIIIIILIIIIIIIIIIIIMINYIIKRKEKKE

SEQ ID NO: 2398522 - protein, 45 aa, Entamoeba dispar
KCNKEIVWWMIMIIIIIILIIIIIIIIIIIIIMINYIIKRKEKKE

SEQ ID NO: 2398523 - protein, 45 aa, Entamoeba dispar
KCNKEIVWWMIMIIIIIILIIIIIIIIIIITMINYIIKLKEKKEQ

SEQ ID NO: 2398524 - protein, 44 aa, Entamoeba dispar
KCNKEIVWWMIMIIIIIILIIIITIIIIIIIMINYIIKRKEKKE

SEQ ID NO: 2398525 - protein, 44 aa, Entamoeba dispar
KCNKEIVWWMIMIIIIIILIIIITIIIIIITMINYIIKRKEKKE

SEQ ID NO: 2398526 - protein, 44 aa, Entamoeba dispar
KCNKEMVWWMIMIIIIIILIIIIIIIIIIIIMINYIIKRKEKKE

SEQ ID NO: 2398527 - protein, 45 aa, Entamoeba dispar
KCNKEMVWWMIMIIIIIILIIIIIIIIIIITMINYIIKLKEKKEQ

SEQ ID NO: 2398528 - protein, 24 aa, Entamoeba dispar
KCNYQLWRLITPIFLHGGIIHLIC

SEQ ID NO: 2398529 - protein, 17 aa, Entamoeba dispar
KCPECMVALLIAPVLSA

SEQ ID NO: 2398530 - protein, 17 aa, Entamoeba dispar
KCQYNNFLYQSYCYECS

SEQ ID NO: 2398531 - protein, 18 aa, Entamoeba dispar
KCSFNKLKKKMPTILNEL

SEQ ID NO: 2398532 - protein, 20 aa, Entamoeba dispar
KCVLAYCDLGYKFDYINNNC

SEQ ID NO: 2398533 - protein, 34 aa, Entamoeba dispar
KCYSLFCQLNLNYLPLIPLILNKIQQLYDYTKTQ

SEQ ID NO: 2398534 - protein, 24 aa, Entamoeba dispar
KDENFYYIFINVKEYKVVTVSLTI

SEQ ID NO: 2398535 - protein, 26 aa, Entamoeba dispar
KDIEKWIEKTLYWYKNKEKKGAEEWK

SEQ ID NO: 2398536 - protein, 23 aa, Entamoeba dispar
KDIIEFLCYKGFRDILPILITCF

SEQ ID NO: 2398537 - protein, 21 aa, Entamoeba dispar
KDIIYSMFLAIQILSEEYESN

SEQ ID NO: 2398538 - protein, 21 aa, Entamoeba dispar
KDIPVIIFFGIYASSDTDYFI

SEQ ID NO: 2398539 - protein, 17 aa, Entamoeba dispar
KDKINIVYFVVLTIFAL

SEQ ID NO: 2398540 - protein, 28 aa, Entamoeba dispar
KDKIYIRAILFFLLSVTFLIISILLVFI

SEQ ID NO: 2398541 - protein, 29 aa, Entamoeba dispar
KDKKKIEDIKLIELIKQPTPYINENKKET

SEQ ID NO: 2398542 - protein, 17 aa, Entamoeba dispar
KDKWRLIYTFFDEKKHE

SEQ ID NO: 2398543 - protein, 21 aa, Entamoeba dispar
KDLFNFITSSLFWNIIKKGLS

SEQ ID NO: 2398544 - protein, 18 aa, Entamoeba dispar
KDLVFKEKRKTCLYLEFV

SEQ ID NO: 2398545 - protein, 34 aa, Entamoeba dispar
KDMKSFEILLPTFIQILLLMFPNTAPEITNKLKV

SEQ ID NO: 2398546 - protein, 22 aa, Entamoeba dispar
KDNYVLFFVHTHLEFCIYKYQL

SEQ ID NO: 2398547 - protein, 21 aa, Entamoeba dispar
KDPMHFTFHSGDYTKYEIMCR

SEQ ID NO: 2398548 - protein, 30 aa, Entamoeba dispar
KDPNDVAIIYILLGRIPALAALYRLNKEMK

SEQ ID NO: 2398549 - protein, 45 aa, Entamoeba dispar
KDTIIYLSSIIIFYIFFWIALLIIHYFIYIKLNKIIMKELNEQEM

SEQ ID NO: 2398550 - protein, 25 aa, Entamoeba dispar
KDTPLLLVVGQWLTALFSINFDKSV

SEQ ID NO: 2398551 - protein, 28 aa, Entamoeba dispar
KDVGWEDYFFPLPDYVTSYSFLIEPTQE

SEQ ID NO: 2398552 - protein, 22 aa, Entamoeba dispar
KDVKIIFHHQSTLGYTKIHPST

SEQ ID NO: 2398553 - protein, 25 aa, Entamoeba dispar
KDVKTYKLFFSKKKLCFPDNGKWWN

SEQ ID NO: 2398554 - protein, 17 aa, Entamoeba dispar
KDWLIIVCRMLMIILVL

SEQ ID NO: 2398555 - protein, 28 aa, Entamoeba dispar
KDYSFSITIPPAPTRTFYRSCLYDSLAP

SEQ ID NO: 2398556 - protein, 18 aa, Entamoeba dispar
KEAKITFLPTFKIKIGNG

SEQ ID NO: 2398557 - protein, 17 aa, Entamoeba dispar
KECIQCEKGYYLNSNKE

SEQ ID NO: 2398558 - protein, 45 aa, Entamoeba dispar
KECKSSPVWWVIVLAIIGGIMFFILFIVFVIFIVRKTIKRLHIKQ

SEQ ID NO: 2398559 - protein, 24 aa, Entamoeba dispar
KEDLIHSINIFEEILTALKISILS

SEQ ID NO: 2398560 - protein, 24 aa, Entamoeba dispar
KEDNRPCHYIYSSLLNYDEFVTDI

SEQ ID NO: 2398561 - protein, 21 aa, Entamoeba dispar
KEDSPKTLILFVIRDRDQKKP

SEQ ID NO: 2398562 - protein, 23 aa, Entamoeba dispar
KEDVINIYCILDWFIENDQQKKK

SEQ ID NO: 2398563 - protein, 26 aa, Entamoeba dispar
KEDWFDWFRQIAMVFLKESPSQSLCY

SEQ ID NO: 2398564 - protein, 22 aa, Entamoeba dispar
KEEGISFPMFFVDSQPDEGEDN

SEQ ID NO: 2398565 - protein, 27 aa, Entamoeba dispar
KEEKQIVVNYLYWKKFIQTHYPEVSDF

SEQ ID NO: 2398566 - protein, 25 aa, Entamoeba dispar
KEERKDCYSLFYNGTSLTFLSLCLL

SEQ ID NO: 2398567 - protein, 25 aa, Entamoeba dispar
KEGHKLIINSFFDTVLYNEGTVIFK

SEQ ID NO: 2398568 - protein, 24 aa, Entamoeba dispar
KEGKLLVVPVTYFINPTPSIDQRG

SEQ ID NO: 2398569 - protein, 19 aa, Entamoeba dispar
KEHYKLPSDIYSFAITMYE

SEQ ID NO: 2398570 - protein, 23 aa, Entamoeba dispar
KEHYQVIQLFIYALKNPYQLEQN

SEQ ID NO: 2398571 - protein, 20 aa, Entamoeba dispar
KEIIINCPFINDYKYQVKTY

SEQ ID NO: 2398572 - protein, 19 aa, Entamoeba dispar
KEIPEEFLTLLYQGSEVHP

SEQ ID NO: 2398573 - protein, 31 aa, Entamoeba dispar
KEIVYGLFNTKLIFFIVKVLLRCDSLDKELK

SEQ ID NO: 2398574 - protein, 20 aa, Entamoeba dispar
KEIYRLFGELPKDITGLCAL

SEQ ID NO: 2398575 - protein, 21 aa, Entamoeba dispar
KEKEFPITLLMKLSSFSFGSF

SEQ ID NO: 2398576 - protein, 23 aa, Entamoeba dispar
KEKKSPLFLLLKSMPKYLQMIVG

SEQ ID NO: 2398577 - protein, 24 aa, Entamoeba dispar
KEKRKNILKAIGLGGLAVGATVAT

SEQ ID NO: 2398578 - protein, 36 aa, Entamoeba dispar
KEKYPILQWGLRSILFILYLFALLIYFFSNLVHQYS

SEQ ID NO: 2398579 - protein, 17 aa, Entamoeba dispar
KELFQFLQNEKNKRINE

SEQ ID NO: 2398580 - protein, 24 aa, Entamoeba dispar
KELFVQFLIDNDFICFLCIAIENK

SEQ ID NO: 2398581 - protein, 31 aa, Entamoeba dispar
KELIKNTKYLKLFEIKKINLFPRIINYQQQK

SEQ ID NO: 2398582 - protein, 27 aa, Entamoeba dispar
KELLTTFITLIYPQLSVTSPTLLAALH

SEQ ID NO: 2398583 - protein, 22 aa, Entamoeba dispar
KELWEMFRFHRIVWEWKTYHFI

SEQ ID NO: 2398584 - protein, 17 aa, Entamoeba dispar
KEMTLFKHLNRTHTKIG

SEQ ID NO: 2398585 - protein, 18 aa, Entamoeba dispar
KEMVLAKYFIKYVGNCLR

SEQ ID NO: 2398586 - protein, 26 aa, Entamoeba dispar
KENELAELFLIIERIMALSKEGLMIH

SEQ ID NO: 2398587 - protein, 41 aa, Entamoeba dispar
KENIFLSFIHRYFNKSYLGLIIIITFLILMTVWGSLQTSIE

SEQ ID NO: 2398588 - protein, 17 aa, Entamoeba dispar
KENVIEHKLLYPNQFVF

SEQ ID NO: 2398589 - protein, 26 aa, Entamoeba dispar
KEPPNDFLRIYPKPLFISIHHPNTAV

SEQ ID NO: 2398590 - protein, 27 aa, Entamoeba dispar
KEQNDKFLLRIQPPLVALDGGYACEFE

SEQ ID NO: 2398591 - protein, 28 aa, Entamoeba dispar
KERIAEYFIPFLFDFIDNFERITEIWTK

SEQ ID NO: 2398592 - protein, 23 aa, Entamoeba dispar
KESIKLLDKLIPPIMMVERKVSR

SEQ ID NO: 2398593 - protein, 28 aa, Entamoeba dispar
KESKNHLILLIKKILTDLGYFGDPELIL

SEQ ID NO: 2398594 - protein, 24 aa, Entamoeba dispar
KESNEYIFPTYDATFPITMADING

SEQ ID NO: 2398595 - protein, 28 aa, Entamoeba dispar
KESTLKEIIVFLIKEFQHLFPENVSDIT

SEQ ID NO: 2398596 - protein, 26 aa, Entamoeba dispar
KETIPFWLCALISYVPPFLLILLFSF

SEQ ID NO: 2398597 - protein, 25 aa, Entamoeba dispar
KETIPLRTFRLTQVDRFLTGAYPFY

SEQ ID NO: 2398598 - protein, 24 aa, Entamoeba dispar
KETKLIMCYPNELRKWLINEAKKN

SEQ ID NO: 2398599 - protein, 32 aa, Entamoeba dispar
KETNPLIIILKQYELLLPLYFDYHFTVTKTMK

SEQ ID NO: 2398600 - protein, 20 aa, Entamoeba dispar
KETYFLPQYNKEIPADGLSC

SEQ ID NO: 2398601 - protein, 21 aa, Entamoeba dispar
KEVIPLLLQQLSYYSELLLTT

SEQ ID NO: 2398602 - protein, 20 aa, Entamoeba dispar
KEVKFIIHPVAGRLPGHMNV

SEQ ID NO: 2398603 - protein, 23 aa, Entamoeba dispar
KEVLLLSFSLFKQTFKTKPFDIT

SEQ ID NO: 2398604 - protein, 20 aa, Entamoeba dispar
KEWEHFLSLLKGKDDIIKLA

SEQ ID NO: 2398605 - protein, 20 aa, Entamoeba dispar
KEWMRICHELLDAFKAHKKS

SEQ ID NO: 2398606 - protein, 28 aa, Entamoeba dispar
KEYPQKPFTLFLIKRPAIVNLQNIVKRQ

SEQ ID NO: 2398607 - protein, 20 aa, Entamoeba dispar
KEYYLALSTLLQNVAYQGLS

SEQ ID NO: 2398608 - protein, 20 aa, Entamoeba dispar
KFDDFFVNIVFTFTPDCADY

SEQ ID NO: 2398609 - protein, 23 aa, Entamoeba dispar
KFDFFELFFDHIFNLQFSQDLFI

SEQ ID NO: 2398610 - protein, 17 aa, Entamoeba dispar
KFDFRLNGRMKITTLII

SEQ ID NO: 2398611 - protein, 18 aa, Entamoeba dispar
KFEYTGEHQTFNYPILIA

SEQ ID NO: 2398612 - protein, 33 aa, Entamoeba dispar
KFGKILLWLSIGVYLFYILAIYLTNKLSKEIII

SEQ ID NO: 2398613 - protein, 17 aa, Entamoeba dispar
KFGPKRALQLMLILLFF

SEQ ID NO: 2398614 - protein, 19 aa, Entamoeba dispar
KFGRRRIFLVVGAIIDVLG

SEQ ID NO: 2398615 - protein, 40 aa, Entamoeba dispar
KFGYAYLIDSVISFILSISWSSVLYLIQDLGLFKNLLPKP

SEQ ID NO: 2398616 - protein, 28 aa, Entamoeba dispar
KFIDKQYITLFIEYGGVLKLFDSIAQSE

SEQ ID NO: 2398617 - protein, 27 aa, Entamoeba dispar
KFIISDSYVLVPLRLLMKSFGLKRVYE

SEQ ID NO: 2398618 - protein, 53 aa, Entamoeba dispar
KFINKYFINYTVFELIFLWFIISTSNFRKVLFGILFLLHYLCLKKIVTIHFTF

SEQ ID NO: 2398619 - protein, 23 aa, Entamoeba dispar
KFISYFIFMVFTLIFCTILVVII

SEQ ID NO: 2398620 - protein, 26 aa, Entamoeba dispar
KFITTFNPLIIEPLEFANYVLTVIIS

SEQ ID NO: 2398621 - protein, 18 aa, Entamoeba dispar
KFKMIQQLMFYYLLQELV

SEQ ID NO: 2398622 - protein, 17 aa, Entamoeba dispar
KFLFIKYVKKNRIPPSQ

SEQ ID NO: 2398623 - protein, 24 aa, Entamoeba dispar
KFLPPILVYFFSSAVVHFLIASLC

SEQ ID NO: 2398624 - protein, 19 aa, Entamoeba dispar
KFLTNVIIARGCDTLHIVI

SEQ ID NO: 2398625 - protein, 25 aa, Entamoeba dispar
KFNIKFIIWAWIKYSFYILQTFLIG

SEQ ID NO: 2398626 - protein, 20 aa, Entamoeba dispar
KFPINIYQIIDGEDKRMKIK

SEQ ID NO: 2398627 - protein, 19 aa, Entamoeba dispar
KFQLFTREYEIGETVIAAV

SEQ ID NO: 2398628 - protein, 19 aa, Entamoeba dispar
KFRCDYIINFFGACCLKDH

SEQ ID NO: 2398629 - protein, 24 aa, Entamoeba dispar
KFRSEYIIHFYGAVFIPNKICMIT

SEQ ID NO: 2398630 - protein, 24 aa, Entamoeba dispar
KFRSEYIIHFYGAVFIPNKICMVT

SEQ ID NO: 2398631 - protein, 25 aa, Entamoeba dispar
KFRSEYIIHFYGAVMVPNKYCMVTE

SEQ ID NO: 2398632 - protein, 24 aa, Entamoeba dispar
KFRSEYIVHFYGAVFIPTKICMVT

SEQ ID NO: 2398633 - protein, 26 aa, Entamoeba dispar
KFTINGLVFLLLLYTNGRIKFKLINE

SEQ ID NO: 2398634 - protein, 25 aa, Entamoeba dispar
KFVFIFYSCIIVGIYLFIFRTFIFK

SEQ ID NO: 2398635 - protein, 17 aa, Entamoeba dispar
KFYNHLLSNLDLFSELL

SEQ ID NO: 2398636 - protein, 21 aa, Entamoeba dispar
KGCILLCEVALGRQWETQEDK

SEQ ID NO: 2398637 - protein, 19 aa, Entamoeba dispar
KGCTLCESSYYLENLTCHL

SEQ ID NO: 2398638 - protein, 41 aa, Entamoeba dispar
KGDKIFNFLFKYIHKLRFVIVIFWILAVIGFAYPALKFLGA

SEQ ID NO: 2398639 - protein, 28 aa, Entamoeba dispar
KGDNQTLTDFYLFFSIVAEQQPIDLSKV

SEQ ID NO: 2398640 - protein, 33 aa, Entamoeba dispar
KGDVIGFFSKRRLEWHYLFLACGYTGIVLVTLY

SEQ ID NO: 2398641 - protein, 25 aa, Entamoeba dispar
KGFACEFHIFIKPLCTCRIKDQLNL

SEQ ID NO: 2398642 - protein, 20 aa, Entamoeba dispar
KGFALWLTTKPIVSGNNFGG

SEQ ID NO: 2398643 - protein, 19 aa, Entamoeba dispar
KGGFILKNSWNDTIYGNYP

SEQ ID NO: 2398644 - protein, 25 aa, Entamoeba dispar
KGGIFNIWFNTWFIHDNKLEFSKME

SEQ ID NO: 2398645 - protein, 32 aa, Entamoeba dispar
KGHGRRKYILKMLYIYILGYDVDFGIPIITEL

SEQ ID NO: 2398646 - protein, 25 aa, Entamoeba dispar
KGITLFVWVLTFIQSFLLFMTYPFY

SEQ ID NO: 2398647 - protein, 26 aa, Entamoeba dispar
KGIVGLTRALLILDYMLRYHNDFSAD

SEQ ID NO: 2398648 - protein, 42 aa, Entamoeba dispar
KGIYLHVGIGLLCGLIVIILIVTIIGIILYRRIKRIDIRIFK

SEQ ID NO: 2398649 - protein, 28 aa, Entamoeba dispar
KGKAVEFEIFIKPLCTCSLNESILLVAL

SEQ ID NO: 2398650 - protein, 34 aa, Entamoeba dispar
KGLKHRIYGLRSFVLGLLFYLVPCFEMYIYVNSS

SEQ ID NO: 2398651 - protein, 24 aa, Entamoeba dispar
KGNKYNIDWSFIGSAPLCGINSVE

SEQ ID NO: 2398652 - protein, 23 aa, Entamoeba dispar
KGNYEIQLLIIKATEFIIYVEKK

SEQ ID NO: 2398653 - protein, 21 aa, Entamoeba dispar
KGQWFFVEGANLNIKFDTCSS

SEQ ID NO: 2398654 - protein, 30 aa, Entamoeba dispar
KGSIFTIHNPWIFPLIEILKEIYKLNLSGL

SEQ ID NO: 2398655 - protein, 20 aa, Entamoeba dispar
KGSLRCGVLYLSNTTKIIGF

SEQ ID NO: 2398656 - protein, 26 aa, Entamoeba dispar
KGSPFMQTIVKLLRLLHTMNNNGCMM

SEQ ID NO: 2398657 - protein, 28 aa, Entamoeba dispar
KGTLIHVVAFYLFLLGILSAIIGVSMDI

SEQ ID NO: 2398658 - protein, 23 aa, Entamoeba dispar
KGVPMNYRRDLWKKLLEIDNIEE

SEQ ID NO: 2398659 - protein, 22 aa, Entamoeba dispar
KGWKKIMALIVMILGILIGIVG

SEQ ID NO: 2398660 - protein, 23 aa, Entamoeba dispar
KGWQTICQYGYADPYGGCEKCNG

SEQ ID NO: 2398661 - protein, 21 aa, Entamoeba dispar
KGYLWVLVIGIIEGIVFLGYS

SEQ ID NO: 2398662 - protein, 30 aa, Entamoeba dispar
KHCIFPIKDGKFFFLSPLQMTPKPYNQDPS

SEQ ID NO: 2398663 - protein, 21 aa, Entamoeba dispar
KHCYINHQIQIFVNGVIHEFN

SEQ ID NO: 2398664 - protein, 25 aa, Entamoeba dispar
KHFRIVAVLLKYWLKTRNLNCPFKG

SEQ ID NO: 2398665 - protein, 23 aa, Entamoeba dispar
KHGFLLDFPKLRNEPRLLTSIQS

SEQ ID NO: 2398666 - protein, 25 aa, Entamoeba dispar
KHGPFALIEKGLPVILIILDDEHAN

SEQ ID NO: 2398667 - protein, 17 aa, Entamoeba dispar
KHKYLIIYDSEKKSFLN

SEQ ID NO: 2398668 - protein, 25 aa, Entamoeba dispar
KHLQSLKILVLYFKKINQESIDLIV

SEQ ID NO: 2398669 - protein, 31 aa, Entamoeba dispar
KHMDIFIFPIAIIIFLYVIRNIVLVVIPICN

SEQ ID NO: 2398670 - protein, 18 aa, Entamoeba dispar
KHQPFVLMDIFFDILPYV

SEQ ID NO: 2398671 - protein, 22 aa, Entamoeba dispar
KHSDIVIPIKLHLFTQLDCSLD

SEQ ID NO: 2398672 - protein, 25 aa, Entamoeba dispar
KHSNRFVLFRVIWNNYRHEYIFCTL

SEQ ID NO: 2398673 - protein, 20 aa, Entamoeba dispar
KHVLNNFQEFLYSGIGLTDE

SEQ ID NO: 2398674 - protein, 27 aa, Entamoeba dispar
KHVWPSLLFMVLITFLLSVVIDNIPVV

SEQ ID NO: 2398675 - protein, 23 aa, Entamoeba dispar
KHWMIKILFVVVLDIIIYGLILQ

SEQ ID NO: 2398676 - protein, 31 aa, Entamoeba dispar
KIAIYFVQPFLKSYLFWTSQTLLYCGLTYTI

SEQ ID NO: 2398677 - protein, 23 aa, Entamoeba dispar
KICGKIMTPIDFIWAYHSEAKES

SEQ ID NO: 2398678 - protein, 20 aa, Entamoeba dispar
KICYYLLFIFVSIGRILFHV

SEQ ID NO: 2398679 - protein, 19 aa, Entamoeba dispar
KIDFYLDEFKVKLPLNLND

SEQ ID NO: 2398680 - protein, 23 aa, Entamoeba dispar
KIDKMYFVYFLKFGIAIGIHLSI

SEQ ID NO: 2398681 - protein, 23 aa, Entamoeba dispar
KIDQYLYTVRFIPVLFRDTKQNV

SEQ ID NO: 2398682 - protein, 23 aa, Entamoeba dispar
KIDVIDIFTSLPTRITFDNPVSI

SEQ ID NO: 2398683 - protein, 17 aa, Entamoeba dispar
KIFWLNIVGAILAAISV

SEQ ID NO: 2398684 - protein, 17 aa, Entamoeba dispar
KIHMDNESILTISGFLF

SEQ ID NO: 2398685 - protein, 22 aa, Entamoeba dispar
KIHYLFICVYIIVSLVVVYGLQ

SEQ ID NO: 2398686 - protein, 28 aa, Entamoeba dispar
KIIAIITLIIIIIFINTIVHSQIITTII

SEQ ID NO: 2398687 - protein, 25 aa, Entamoeba dispar
KIIEIIHLLQWPYWSSIKCLEMKNK

SEQ ID NO: 2398688 - protein, 21 aa, Entamoeba dispar
KIIGPWYVRRKKIQDALQAEN

SEQ ID NO: 2398689 - protein, 25 aa, Entamoeba dispar
KIIIDLINYFFFKGSLDAMVLTTKM

SEQ ID NO: 2398690 - protein, 33 aa, Entamoeba dispar
KIINKIFIHKKFYYLIILYEFINEKNILQIINE

SEQ ID NO: 2398691 - protein, 20 aa, Entamoeba dispar
KIIQLFISLKNIIQSNIIIT

SEQ ID NO: 2398692 - protein, 29 aa, Entamoeba dispar
KIIRVILPIYAIIFLCVLIVRYVIQMDVI

SEQ ID NO: 2398693 - protein, 32 aa, Entamoeba dispar
KIISQFIIGLFVLLLLLIFDKTLIEQPSFTLT

SEQ ID NO: 2398694 - protein, 26 aa, Entamoeba dispar
KIIVQLRYSSPIYKLSFRNIETNIEL

SEQ ID NO: 2398695 - protein, 17 aa, Entamoeba dispar
KIKCWEYFIEFISDVFP

SEQ ID NO: 2398696 - protein, 21 aa, Entamoeba dispar
KIKGVLLIYKYAEIDPNGSKE

SEQ ID NO: 2398697 - protein, 18 aa, Entamoeba dispar
KILDDLAIALQFLHQNQI

SEQ ID NO: 2398698 - protein, 30 aa, Entamoeba dispar
KILHETLILLNILFKNPIIFSSISIPLLPL

SEQ ID NO: 2398699 - protein, 20 aa, Entamoeba dispar
KILTELLRFLPVSDLTIREE

SEQ ID NO: 2398700 - protein, 26 aa, Entamoeba dispar
KILTMKEWFWELINLGWNQNPKERIT

SEQ ID NO: 2398701 - protein, 21 aa, Entamoeba dispar
KIMFNLTFPFVILKALINTHS

SEQ ID NO: 2398702 - protein, 20 aa, Entamoeba dispar
KIMGMKIPYTIYFSKKKEIL

SEQ ID NO: 2398703 - protein, 22 aa, Entamoeba dispar
KIMIDNDIIISSLILDGKNSRI

SEQ ID NO: 2398704 - protein, 20 aa, Entamoeba dispar
KINIVYFVVLTIFALRELMV

SEQ ID NO: 2398705 - protein, 24 aa, Entamoeba dispar
KINPKALFYFSINTKIIVLTIDDA

SEQ ID NO: 2398706 - protein, 18 aa, Entamoeba dispar
KINQIIRCLYGIKSIQFQ

SEQ ID NO: 2398707 - protein, 17 aa, Entamoeba dispar
KINTFFIVSFDPKDAYV

SEQ ID NO: 2398708 - protein, 24 aa, Entamoeba dispar
KINYDFMLDIIKLLQQLLENKADK

SEQ ID NO: 2398709 - protein, 17 aa, Entamoeba dispar
KIPLLNENYLTEITTDF

SEQ ID NO: 2398710 - protein, 21 aa, Entamoeba dispar
KIPYLKELGISIVWLNPIYST

SEQ ID NO: 2398711 - protein, 24 aa, Entamoeba dispar
KIQKYFMFFLIYTNDFLLILSVLS

SEQ ID NO: 2398712 - protein, 17 aa, Entamoeba dispar
KIRIKFMLDGAKGISYL

SEQ ID NO: 2398713 - protein, 21 aa, Entamoeba dispar
KIRPSLVYIPTRLPTTVIGDI

SEQ ID NO: 2398714 - protein, 19 aa, Entamoeba dispar
KIRYSYALIFLIGCIFFVA

SEQ ID NO: 2398715 - protein, 23 aa, Entamoeba dispar
KITEFPYFTPVLNVSLFTRKQDF

SEQ ID NO: 2398716 - protein, 35 aa, Entamoeba dispar
KITFTGHYANLFLRFIRRLLTSRGNYIFKENISFG

SEQ ID NO: 2398717 - protein, 20 aa, Entamoeba dispar
KITGNMNIIINKEAIIEKEH

SEQ ID NO: 2398718 - protein, 18 aa, Entamoeba dispar
KITIFKRFPALLPQLCVA

SEQ ID NO: 2398719 - protein, 17 aa, Entamoeba dispar
KIVIIGLFLFSFSLFFL

SEQ ID NO: 2398720 - protein, 20 aa, Entamoeba dispar
KIYYFSFRVTSASRFVGIPI

SEQ ID NO: 2398721 - protein, 22 aa, Entamoeba dispar
KKAFLVGFPDNVAIRQPDNTYL

SEQ ID NO: 2398722 - protein, 24 aa, Entamoeba dispar
KKALVTMQFLPIESLIFSNEDSIS

SEQ ID NO: 2398723 - protein, 18 aa, Entamoeba dispar
KKCFIIYSFIISYNLIKL

SEQ ID NO: 2398724 - protein, 20 aa, Entamoeba dispar
KKCLSCVDLYYMKASGCYSG

SEQ ID NO: 2398725 - protein, 31 aa, Entamoeba dispar
KKDSRYFIAFRWFMVQLLINVKSYLAYSWIF

SEQ ID NO: 2398726 - protein, 21 aa, Entamoeba dispar
KKDYYIFVSYQTSSFAMINFS

SEQ ID NO: 2398727 - protein, 32 aa, Entamoeba dispar
KKEAYSFLLILIPSKIISSIILCIFNQSINIC

SEQ ID NO: 2398728 - protein, 34 aa, Entamoeba dispar
KKEFFKEEMIILLTILLKIIPINNIIEIFIFHEK

SEQ ID NO: 2398729 - protein, 31 aa, Entamoeba dispar
KKEKNINIRLFMKIKILIDAAKGIQYLHSNG

SEQ ID NO: 2398730 - protein, 42 aa, Entamoeba dispar
KKEQPDIIPMIIIYTLIPIIILLGCGIIFFLSCWVDKKENKK

SEQ ID NO: 2398731 - protein, 24 aa, Entamoeba dispar
KKEYESIFYLQSYTLIQCLDEFTL

SEQ ID NO: 2398732 - protein, 19 aa, Entamoeba dispar
KKEYIANLCQVFVVLEVYK

SEQ ID NO: 2398733 - protein, 26 aa, Entamoeba dispar
KKFDFNMLFLIIYSVSVFYFSCVMSR

SEQ ID NO: 2398734 - protein, 25 aa, Entamoeba dispar
KKFFGYFNLISYTIPISVGVTIEVC

SEQ ID NO: 2398735 - protein, 38 aa, Entamoeba dispar
KKFKISFSIIFTTLILFLIFVCIIIGILFIIQPDYTCS

SEQ ID NO: 2398736 - protein, 28 aa, Entamoeba dispar
KKGEACEFEIFIIPLCTCTIEDDITIVG

SEQ ID NO: 2398737 - protein, 21 aa, Entamoeba dispar
KKHILFLLNYQALQPILNTIS

SEQ ID NO: 2398738 - protein, 29 aa, Entamoeba dispar
KKHPSIFNLIFFRRSFPQIIKGRKGSLNV

SEQ ID NO: 2398739 - protein, 17 aa, Entamoeba dispar
KKIFKTKLGFFDVTPLG

SEQ ID NO: 2398740 - protein, 28 aa, Entamoeba dispar
KKIINITELFIPIIFNSLSLQDNYIQTM

SEQ ID NO: 2398741 - protein, 25 aa, Entamoeba dispar
KKIISKVYVLGKRLILEGSNIKLSE

SEQ ID NO: 2398742 - protein, 30 aa, Entamoeba dispar
KKIKEDLILSFLLSGIILAPPYVVIYQNFV

SEQ ID NO: 2398743 - protein, 26 aa, Entamoeba dispar
KKILKKYILSIFKYHYIATTIFLFIM

SEQ ID NO: 2398744 - protein, 22 aa, Entamoeba dispar
KKILMIIMPYPFLGNWERKYII

SEQ ID NO: 2398745 - protein, 26 aa, Entamoeba dispar
KKKESIPKLSIRLRFLLDAAKGIQYL

SEQ ID NO: 2398746 - protein, 24 aa, Entamoeba dispar
KKKIQILQFCYFLVFVRLVICTLY

SEQ ID NO: 2398747 - protein, 21 aa, Entamoeba dispar
KKLEPFACELLALTAHHVEQL

SEQ ID NO: 2398748 - protein, 32 aa, Entamoeba dispar
KKLFGTTGMSHLLVLVIGGIGILVVIYVLAFK

SEQ ID NO: 2398749 - protein, 20 aa, Entamoeba dispar
KKLLPQVNPVYPLFGQIHRE

SEQ ID NO: 2398750 - protein, 24 aa, Entamoeba dispar
KKMCIAIEFAPNGSLGHILKKIKL

SEQ ID NO: 2398751 - protein, 24 aa, Entamoeba dispar
KKMNIPMSYLKYYSDHVLSNGCPN

SEQ ID NO: 2398752 - protein, 19 aa, Entamoeba dispar
KKMYKIFFMYINEEEIEKE

SEQ ID NO: 2398753 - protein, 34 aa, Entamoeba dispar
KKNPSLIRAVIKREWWPFLLSLIAISISQIAMLM

SEQ ID NO: 2398754 - protein, 21 aa, Entamoeba dispar
KKPLGLIEGEWKWKPKRNYNW

SEQ ID NO: 2398755 - protein, 40 aa, Entamoeba dispar
KKQFKVKFYLKVVIGVSLFVSIFFLIMRTITIKKSYVCSK

SEQ ID NO: 2398756 - protein, 27 aa, Entamoeba dispar
KKQIQSIFIIIKPILIEALTDVGHDES

SEQ ID NO: 2398757 - protein, 18 aa, Entamoeba dispar
KKQSILAEMFLLNISRIR

SEQ ID NO: 2398758 - protein, 24 aa, Entamoeba dispar
KKRKLFFYVSLFLSISIYGSLAIM

SEQ ID NO: 2398759 - protein, 27 aa, Entamoeba dispar
KKSLCKRIIQFPSWFFKQFFRTDPNGA

SEQ ID NO: 2398760 - protein, 19 aa, Entamoeba dispar
KKSQIMIIRMNGVRFSNVV

SEQ ID NO: 2398761 - protein, 42 aa, Entamoeba dispar
KKSYLPLIISIFSGLFFIISLILIIVIWGYPIILPDPKQSNE

SEQ ID NO: 2398762 - protein, 27 aa, Entamoeba dispar
KKTGRLYVECFGKWIMYKLSSDSYINC

SEQ ID NO: 2398763 - protein, 32 aa, Entamoeba dispar
KKVCVRMYDNLLRLFIFAFQSLQQLQDFRDEL

SEQ ID NO: 2398764 - protein, 25 aa, Entamoeba dispar
KKVFSFYIIFISLFQFQLLNDYDQE

SEQ ID NO: 2398765 - protein, 22 aa, Entamoeba dispar
KKVLNFVIYTPAEGDKNIYFAM

SEQ ID NO: 2398766 - protein, 23 aa, Entamoeba dispar
KKVMKIFIHFIIKYMEENIKNKE

SEQ ID NO: 2398767 - protein, 20 aa, Entamoeba dispar
KKWLGFVYCGIILITQMIDS

SEQ ID NO: 2398768 - protein, 25 aa, Entamoeba dispar
KKYCLILNILLYNKYFNLNEYYLLF

SEQ ID NO: 2398769 - protein, 25 aa, Entamoeba dispar
KLAGYLMIFSIILAILLLVILSFIQ

SEQ ID NO: 2398770 - protein, 20 aa, Entamoeba dispar
KLAYLYIMNYAKTQQDNATR

SEQ ID NO: 2398771 - protein, 22 aa, Entamoeba dispar
KLDRKMIELMKKKELEQLVNDK

SEQ ID NO: 2398772 - protein, 21 aa, Entamoeba dispar
KLEHDVILTYILKVLAALLKE

SEQ ID NO: 2398773 - protein, 37 aa, Entamoeba dispar
KLEIIDCPMPFFIFEWHYLWYVHAFNFEISLRVFDFI

SEQ ID NO: 2398774 - protein, 40 aa, Entamoeba dispar
KLFFTVLEWAVLIATIVSIILIITSVISFVLIPPMGKTDM

SEQ ID NO: 2398775 - protein, 27 aa, Entamoeba dispar
KLFVGMLICLIFSEALALYGFIVALIM

SEQ ID NO: 2398776 - protein, 26 aa, Entamoeba dispar
KLGDVSLFYYLPNLFYLSNGTTIVLL

SEQ ID NO: 2398777 - protein, 32 aa, Entamoeba dispar
KLGMGCAIIVFTILCIYWVMDAINYKPILICD

SEQ ID NO: 2398778 - protein, 33 aa, Entamoeba dispar
KLHTISILKNSWFFYELIVKSLTLEMDLSGLLN

SEQ ID NO: 2398779 - protein, 24 aa, Entamoeba dispar
KLIDFVFFLLFIYLYFYYYLIILQ

SEQ ID NO: 2398780 - protein, 29 aa, Entamoeba dispar
KLIHQHLYLFVFFLIFGLHISLYFKISQQ

SEQ ID NO: 2398781 - protein, 18 aa, Entamoeba dispar
KLILLNPNKKVFSFYIIF

SEQ ID NO: 2398782 - protein, 33 aa, Entamoeba dispar
KLILLSFFTFIGLLFIATLFFDTTQPPPDIRMK

SEQ ID NO: 2398783 - protein, 21 aa, Entamoeba dispar
KLINSSFLTYKMISLSSNKLI

SEQ ID NO: 2398784 - protein, 18 aa, Entamoeba dispar
KLIPLRRLTIDSSQINTP

SEQ ID NO: 2398785 - protein, 19 aa, Entamoeba dispar
KLKIKFIIDGAKGIEYLHS

SEQ ID NO: 2398786 - protein, 32 aa, Entamoeba dispar
KLKKIIVKIIKFILIGSLIIMLIFNLNEHGIE

SEQ ID NO: 2398787 - protein, 24 aa, Entamoeba dispar
KLKRNFYTVLIHNFRLECPIKEKF

SEQ ID NO: 2398788 - protein, 21 aa, Entamoeba dispar
KLKRSTPIYSLYFRNIETNIE

SEQ ID NO: 2398789 - protein, 28 aa, Entamoeba dispar
KLLDKIRWRTLMELSTKWRQISEPNDPV

SEQ ID NO: 2398790 - protein, 17 aa, Entamoeba dispar
KLLFIRLLLYQLLFIFV

SEQ ID NO: 2398791 - protein, 17 aa, Entamoeba dispar
KLLIYDEQKIDKLNRYC

SEQ ID NO: 2398792 - protein, 18 aa, Entamoeba dispar
KLLKIQFSTKDQLDKYEI

SEQ ID NO: 2398793 - protein, 17 aa, Entamoeba dispar
KLLLDLHDLHMYFGFES

SEQ ID NO: 2398794 - protein, 19 aa, Entamoeba dispar
KLLSFRLNTLNDLIQRKVG

SEQ ID NO: 2398795 - protein, 18 aa, Entamoeba dispar
KLLWLCLCNVLSSSSSSS

SEQ ID NO: 2398796 - protein, 19 aa, Entamoeba dispar
KLMICIFCFIINGMYAFEL

SEQ ID NO: 2398797 - protein, 24 aa, Entamoeba dispar
KLMNFVLLIQPLILSILLTIQEFF

SEQ ID NO: 2398798 - protein, 36 aa, Entamoeba dispar
KLNFLHYCCSKSFIYLLPLILKKFPLLMNFQDGCGR

SEQ ID NO: 2398799 - protein, 24 aa, Entamoeba dispar
KLNMSSMDVVWLKGYESDHECPNI

SEQ ID NO: 2398800 - protein, 28 aa, Entamoeba dispar
KLNPEKRYFFFFTFHDDNLFINFNIKIV

SEQ ID NO: 2398801 - protein, 23 aa, Entamoeba dispar
KLNSFDYYKGITLTFMALTYYFA

SEQ ID NO: 2398802 - protein, 19 aa, Entamoeba dispar
KLNTLYSSSLIIPLEYTKN

SEQ ID NO: 2398803 - protein, 28 aa, Entamoeba dispar
KLPDAHIPWYRYLLFTIAMACCVVLCIL

SEQ ID NO: 2398804 - protein, 24 aa, Entamoeba dispar
KLPETLVFHLKRFGYNEQFQIVKY

SEQ ID NO: 2398805 - protein, 24 aa, Entamoeba dispar
KLQESVIPPILPETEEIPKMNALE

SEQ ID NO: 2398806 - protein, 28 aa, Entamoeba dispar
KLQNKEKFYIIFRSLLKCLVKNVLCQLN

SEQ ID NO: 2398807 - protein, 22 aa, Entamoeba dispar
KLRNPFIVNYIGSVTYIPEICM

SEQ ID NO: 2398808 - protein, 26 aa, Entamoeba dispar
KLSRDRSLVILKIRNFGTLNIGHPKF

SEQ ID NO: 2398809 - protein, 42 aa, Entamoeba dispar
KLSSIYQLWDWVLQSPKFAKFMFFLLAYILSCEPMILEYNDP

SEQ ID NO: 2398810 - protein, 29 aa, Entamoeba dispar
KLTNWFNKIFLILSIPFRFIMEFTTPHIS

SEQ ID NO: 2398811 - protein, 40 aa, Entamoeba dispar
KLTSKEWFIKGYIEDKFIEIIMPPMINGRFNGDGSVICDD

SEQ ID NO: 2398812 - protein, 20 aa, Entamoeba dispar
KLVIYFFLVNSVQFSIEFSY

SEQ ID NO: 2398813 - protein, 18 aa, Entamoeba dispar
KLWCLRKGNWEENYQRHI

SEQ ID NO: 2398814 - protein, 17 aa, Entamoeba dispar
KLWNMVPYIQQLVFLML

SEQ ID NO: 2398815 - protein, 30 aa, Entamoeba dispar
KLYCSKMPKWSIYPLTFIPGVVLYCFVWVV

SEQ ID NO: 2398816 - protein, 23 aa, Entamoeba dispar
KLYESYFIFVYLFGLSLFNNFIE

SEQ ID NO: 2398817 - protein, 20 aa, Entamoeba dispar
KLYEYSLKLFPYKSQFEDTS

SEQ ID NO: 2398818 - protein, 20 aa, Entamoeba dispar
KLYNMKFLISLLTPIIFICF

SEQ ID NO: 2398819 - protein, 27 aa, Entamoeba dispar
KMDTMPIYQWLIIKYEFIQYCTDIIIR

SEQ ID NO: 2398820 - protein, 18 aa, Entamoeba dispar
KMFMPSNSPIKIINAIKS

SEQ ID NO: 2398821 - protein, 22 aa, Entamoeba dispar
KMGVIGFVAWCLATIVYFVITW

SEQ ID NO: 2398822 - protein, 38 aa, Entamoeba dispar
KMKLVILQNRYVPWISLARIFYLSLMTLHPSKIYFSVK

SEQ ID NO: 2398823 - protein, 18 aa, Entamoeba dispar
KMKSFIFNSILITGKLKT

SEQ ID NO: 2398824 - protein, 20 aa, Entamoeba dispar
KMLDPLVLVLPGLIAFHLYQ

SEQ ID NO: 2398825 - protein, 24 aa, Entamoeba dispar
KMMAIQNILLLLIFLVLFGIFLKK

SEQ ID NO: 2398826 - protein, 18 aa, Entamoeba dispar
KMMALRKSAQSQSPDISV

SEQ ID NO: 2398827 - protein, 35 aa, Entamoeba dispar
KMMIRNLFGTLLSFFDITPLGRLLNYFSRDLRFVD

SEQ ID NO: 2398828 - protein, 19 aa, Entamoeba dispar
KMNCSIFYQIPIKSIQQSS

SEQ ID NO: 2398829 - protein, 21 aa, Entamoeba dispar
KMQTVILSPPFQQLVESPCHE

SEQ ID NO: 2398830 - protein, 25 aa, Entamoeba dispar
KMRSNQLILMHLFNEMFKRKNLVDP

SEQ ID NO: 2398831 - protein, 20 aa, Entamoeba dispar
KMYAIIFVVLAAISIVLIPI

SEQ ID NO: 2398832 - protein, 25 aa, Entamoeba dispar
KNALDLVYIMVKYNFIFSQNISRSM

SEQ ID NO: 2398833 - protein, 29 aa, Entamoeba dispar
KNATNMAFLYFVRYPLLEKIYENIIKNEE

SEQ ID NO: 2398834 - protein, 26 aa, Entamoeba dispar
KNCALIHLLRVILWAVRESPKSNFFC

SEQ ID NO: 2398835 - protein, 26 aa, Entamoeba dispar
KNCKYFLFFLLSMSISLLIVTYYCVV

SEQ ID NO: 2398836 - protein, 29 aa, Entamoeba dispar
KNDFELLFSFINFILPFAPHQISLSFFVW

SEQ ID NO: 2398837 - protein, 21 aa, Entamoeba dispar
KNDPYLLSYPLYTFNFNICGP

SEQ ID NO: 2398838 - protein, 30 aa, Entamoeba dispar
KNENRLRSIMIYILYLLVGISVITMVVAVI

SEQ ID NO: 2398839 - protein, 25 aa, Entamoeba dispar
KNFANNLIFIFAKTNFIVTGNTVAT

SEQ ID NO: 2398840 - protein, 21 aa, Entamoeba dispar
KNFFHSQLFWGIISMIICGYW

SEQ ID NO: 2398841 - protein, 20 aa, Entamoeba dispar
KNFILLKRSMLIFNKRRKEY

SEQ ID NO: 2398842 - protein, 25 aa, Entamoeba dispar
KNFSNNLIFIFAKTNFIVTGNTVAT

SEQ ID NO: 2398843 - protein, 17 aa, Entamoeba dispar
KNGFVLTQWHKMKILLT

SEQ ID NO: 2398844 - protein, 19 aa, Entamoeba dispar
KNGIKVYYLPLLRMFNECC

SEQ ID NO: 2398845 - protein, 18 aa, Entamoeba dispar
KNGKYKLAMKTLDRLAGI

SEQ ID NO: 2398846 - protein, 20 aa, Entamoeba dispar
KNGMLFFKDNITTGLKFVNE

SEQ ID NO: 2398847 - protein, 26 aa, Entamoeba dispar
KNHFKILSIFNPFSIISSLLITKNEV

SEQ ID NO: 2398848 - protein, 18 aa, Entamoeba dispar
KNIFKEVMLLSSSVICCR

SEQ ID NO: 2398849 - protein, 20 aa, Entamoeba dispar
KNIKFWIGRIMFFCAFMLVI

SEQ ID NO: 2398850 - protein, 18 aa, Entamoeba dispar
KNIKIPYTIWLSKCKKSL

SEQ ID NO: 2398851 - protein, 26 aa, Entamoeba dispar
KNIKTFISNFLIDTALELGFTFDSKM

SEQ ID NO: 2398852 - protein, 23 aa, Entamoeba dispar
KNINKFYTFLTFEISSGLSTKLD

SEQ ID NO: 2398853 - protein, 24 aa, Entamoeba dispar
KNIYFAMKGKVIPTLFYTTNLTET

SEQ ID NO: 2398854 - protein, 27 aa, Entamoeba dispar
KNKIDKMLFFNFSFGPAIVTLFASIFL

SEQ ID NO: 2398855 - protein, 35 aa, Entamoeba dispar
KNKKNKFYMMKLDKVPPALAFLTTWQQGGPKLHID

SEQ ID NO: 2398856 - protein, 32 aa, Entamoeba dispar
KNKKVFMQNLLIDILLEFGFFFDSKMARHSQK

SEQ ID NO: 2398857 - protein, 38 aa, Entamoeba dispar
KNKSKVVVSSLIIAAGIFAIFVGIFISFTNTDDTGNTG

SEQ ID NO: 2398858 - protein, 24 aa, Entamoeba dispar
KNKTALFYLYIQKNPSFLKGNIER

SEQ ID NO: 2398859 - protein, 17 aa, Entamoeba dispar
KNLILLNKYHFTKYAWL

SEQ ID NO: 2398860 - protein, 17 aa, Entamoeba dispar
KNLPKTIIPKKVELIKK

SEQ ID NO: 2398861 - protein, 36 aa, Entamoeba dispar
KNLQLIGWIMICVIIGILLIVIAGIYLFYRYRHEKK

SEQ ID NO: 2398862 - protein, 17 aa, Entamoeba dispar
KNLSNVYLLLFSEKHKY

SEQ ID NO: 2398863 - protein, 26 aa, Entamoeba dispar
KNNMKFFVQFIFYASLALLLASVING

SEQ ID NO: 2398864 - protein, 36 aa, Entamoeba dispar
KNNNQMKVIWNILNMNSELLFQLHPELLNNEKTHGE

SEQ ID NO: 2398865 - protein, 22 aa, Entamoeba dispar
KNPKNALPLFKLKLLQTNNPEV

SEQ ID NO: 2398866 - protein, 22 aa, Entamoeba dispar
KNPPEVYFFTPNGRFAINTKIC

SEQ ID NO: 2398867 - protein, 34 aa, Entamoeba dispar
KNQFAFSCFVFIVIIIMFIFVMSYALLSVNVPSN

SEQ ID NO: 2398868 - protein, 36 aa, Entamoeba dispar
KNQKNEPVFFLLPDQSICYLLLQKIGVVEQLLNAQL

SEQ ID NO: 2398869 - protein, 46 aa, Entamoeba dispar
KNQSKNWYGFIIPLVLVLFLGVIFYKWIYPLLYKLISSLLKSRFSI

SEQ ID NO: 2398870 - protein, 24 aa, Entamoeba dispar
KNRDSFLIIFQALMKIDLKTTFLR

SEQ ID NO: 2398871 - protein, 44 aa, Entamoeba dispar
KNRTPDPIIIPFWKIWFEALQDKTLIILIIAAIISLILAFVVPN

SEQ ID NO: 2398872 - protein, 44 aa, Entamoeba dispar
KNRTPDPVLIPFWKIWFEALQDKTLIILILAAVVSLILAFVVPN

SEQ ID NO: 2398873 - protein, 31 aa, Entamoeba dispar
KNSFYKVIIWIIYTIILVTIAFLWTKFISPT

SEQ ID NO: 2398874 - protein, 24 aa, Entamoeba dispar
KNSMNLFFVIHFFFGYLIINLNLV

SEQ ID NO: 2398875 - protein, 18 aa, Entamoeba dispar
KNSPLLMKVLFNLALPCV

SEQ ID NO: 2398876 - protein, 49 aa, Entamoeba dispar
KNTEFPKWTIGVIVIFVIALIVIVVVIIVYAVYVYLQRQRNLKVFSEGE

SEQ ID NO: 2398877 - protein, 26 aa, Entamoeba dispar
KNTQKTTFFTFASKMLAYPTLNDHEK

SEQ ID NO: 2398878 - protein, 28 aa, Entamoeba dispar
KNTVQTFFRYFGLLSYLIPISCAVSLEV

SEQ ID NO: 2398879 - protein, 20 aa, Entamoeba dispar
KNVIFPPPEVFFICDNCTDS

SEQ ID NO: 2398880 - protein, 25 aa, Entamoeba dispar
KNVQLKFLLEYVLENSIISISRSIE

SEQ ID NO: 2398881 - protein, 22 aa, Entamoeba dispar
KNWIKFLFRPIPPIYPLFKNIF

SEQ ID NO: 2398882 - protein, 28 aa, Entamoeba dispar
KNYLNLPKWLKWIYTISYYRITHNICFS

SEQ ID NO: 2398883 - protein, 25 aa, Entamoeba dispar
KNYNKEPYVVLPNKDFRFSTEFEYG

SEQ ID NO: 2398884 - protein, 26 aa, Entamoeba dispar
KNYPPIIMMWIFLLVLMVVIAFLPHQ

SEQ ID NO: 2398885 - protein, 27 aa, Entamoeba dispar
KNYPPIIMMWIFLLVLMVVIAFLPHQP

SEQ ID NO: 2398886 - protein, 18 aa, Entamoeba dispar
KNYSLKKLIQLGISQKDA

SEQ ID NO: 2398887 - protein, 48 aa, Entamoeba dispar
KNYTTSIIIISIIGGIFLIIIFIIIIIIIIILLRKRKIKQLKEIEEDE

SEQ ID NO: 2398888 - protein, 25 aa, Entamoeba dispar
KPACIYLRCKEVCEFKITINPGCTC

SEQ ID NO: 2398889 - protein, 19 aa, Entamoeba dispar
KPEWATIVDDTLYLGSQGL

SEQ ID NO: 2398890 - protein, 24 aa, Entamoeba dispar
KPKEPFLLMRNYILEYNLTGNDAH

SEQ ID NO: 2398891 - protein, 27 aa, Entamoeba dispar
KPKMCCLINVLIMPYCSFNIQQEFKCI

SEQ ID NO: 2398892 - protein, 33 aa, Entamoeba dispar
KPLFFNSLMFFAMALCTFPYLLLKYVFSDKMSK

SEQ ID NO: 2398893 - protein, 26 aa, Entamoeba dispar
KPNDSYLISLYEFIRTMIITYKEFIF

SEQ ID NO: 2398894 - protein, 29 aa, Entamoeba dispar
KPNSELTNFFYFLPFEINIDNDKKMYLIP

SEQ ID NO: 2398895 - protein, 29 aa, Entamoeba dispar
KPSNWEVYFKWGLIVVNVIILVVGVLLLL

SEQ ID NO: 2398896 - protein, 29 aa, Entamoeba dispar
KPTFSGIFKYLVFNTYLSIGGKFTLTILS

SEQ ID NO: 2398897 - protein, 26 aa, Entamoeba dispar
KPTWNTILKVIFYSLKKMFPMKEYFS

SEQ ID NO: 2398898 - protein, 23 aa, Entamoeba dispar
KPYGSNYFGGMFKLALTNTDGNN

SEQ ID NO: 2398899 - protein, 20 aa, Entamoeba dispar
KPYTYGVWFKLTSTINTFVS

SEQ ID NO: 2398900 - protein, 20 aa, Entamoeba dispar
KQCISCVSNLYYLNKDKMCE

SEQ ID NO: 2398901 - protein, 17 aa, Entamoeba dispar
KQDWPLFHSECGDGIVL

SEQ ID NO: 2398902 - protein, 19 aa, Entamoeba dispar
KQIISLHRLILTGTPIQNN

SEQ ID NO: 2398903 - protein, 21 aa, Entamoeba dispar
KQIMLMPYEKEVRQLVKSVIE

SEQ ID NO: 2398904 - protein, 24 aa, Entamoeba dispar
KQITLFTSELFRKIKLVEFFKSTS

SEQ ID NO: 2398905 - protein, 22 aa, Entamoeba dispar
KQKNFFIFYKELTNNKSMSIKE

SEQ ID NO: 2398906 - protein, 21 aa, Entamoeba dispar
KQKSYIWMTFNEYQLISNADT

SEQ ID NO: 2398907 - protein, 17 aa, Entamoeba dispar
KQKYRFGKWFKINLNQV

SEQ ID NO: 2398908 - protein, 22 aa, Entamoeba dispar
KQLILICRPVRFSTLAFCIIGI

SEQ ID NO: 2398909 - protein, 23 aa, Entamoeba dispar
KQLIPWQCDIIVLPLKSKKKLNI

SEQ ID NO: 2398910 - protein, 25 aa, Entamoeba dispar
KQLKKIHFELYRTLGTILFNCRLSI

SEQ ID NO: 2398911 - protein, 39 aa, Entamoeba dispar
KQMLIKIAIQVIYQLGILLIILFFGSTFKFISAPCGYIS

SEQ ID NO: 2398912 - protein, 23 aa, Entamoeba dispar
KQMTYYVFLISDTKIQINEQILY

SEQ ID NO: 2398913 - protein, 28 aa, Entamoeba dispar
KQNNWWSILQFIIWSIIITLIISSIIIT

SEQ ID NO: 2398914 - protein, 20 aa, Entamoeba dispar
KQPLHFTFHSGDYTKYEIMC

SEQ ID NO: 2398915 - protein, 26 aa, Entamoeba dispar
KQQCHPYLISMYFITLEKQSYEEKLN

SEQ ID NO: 2398916 - protein, 26 aa, Entamoeba dispar
KQQFKLFLIHLLQSDSPPALLRAYSS

SEQ ID NO: 2398917 - protein, 18 aa, Entamoeba dispar
KQRLSVIHYLYSLIPMAT

SEQ ID NO: 2398918 - protein, 29 aa, Entamoeba dispar
KQSTRIMIQVLLYCWLCYNSKNEKEWKIL

SEQ ID NO: 2398919 - protein, 17 aa, Entamoeba dispar
KQVCYNTFIVRLASLIN

SEQ ID NO: 2398920 - protein, 17 aa, Entamoeba dispar
KQYISWVMALFELSSHC

SEQ ID NO: 2398921 - protein, 34 aa, Entamoeba dispar
KQYPCTQIYINGLLLLKVMLLKCSFTRLKKRMPT

SEQ ID NO: 2398922 - protein, 21 aa, Entamoeba dispar
KQYQMYIGITGFIVITTILLL

SEQ ID NO: 2398923 - protein, 23 aa, Entamoeba dispar
KRAALFVVVIFIGALIMLNNLDV

SEQ ID NO: 2398924 - protein, 24 aa, Entamoeba dispar
KRDTRYLCSLFKYDIQQNVSEAIK

SEQ ID NO: 2398925 - protein, 23 aa, Entamoeba dispar
KREPKLMDFPPLEFAKQITLFTS

SEQ ID NO: 2398926 - protein, 30 aa, Entamoeba dispar
KRFIAVLIMIVLIFLFYTLNKQRKKCCTEV

SEQ ID NO: 2398927 - protein, 21 aa, Entamoeba dispar
KRFMTIYHQPVLLTFDDFVDR

SEQ ID NO: 2398928 - protein, 19 aa, Entamoeba dispar
KRFNLFRKSLNSEKQFFQI

SEQ ID NO: 2398929 - protein, 18 aa, Entamoeba dispar
KRFSMRKTLLLEKVHFDI

SEQ ID NO: 2398930 - protein, 25 aa, Entamoeba dispar
KRHNKFIVEYLLEAVLSIACILFGP

SEQ ID NO: 2398931 - protein, 23 aa, Entamoeba dispar
KRIENNMIIKLLSDAAHGIQYLH

SEQ ID NO: 2398932 - protein, 41 aa, Entamoeba dispar
KRLKEKRTLWYVWALWWFIYAVVCVATFTVLKLFIKKDDLL

SEQ ID NO: 2398933 - protein, 36 aa, Entamoeba dispar
KRLTITIVCVILLFSYIFTYVLLKTTPDTKEIKKIL

SEQ ID NO: 2398934 - protein, 19 aa, Entamoeba dispar
KRLVIPLKVDFKGIVSNEE

SEQ ID NO: 2398935 - protein, 17 aa, Entamoeba dispar
KRMFVSDEKLKVITQAT

SEQ ID NO: 2398936 - protein, 24 aa, Entamoeba dispar
KRNDKWLHSIGINPQMMKASEQVS

SEQ ID NO: 2398937 - protein, 24 aa, Entamoeba dispar
KRNEQLYYKHYPAFEVDSIVDVHG

SEQ ID NO: 2398938 - protein, 29 aa, Entamoeba dispar
KRNHISYFNWFLYTTTLLFKQLNLNQEDI

SEQ ID NO: 2398939 - protein, 23 aa, Entamoeba dispar
KRNWITDSFFLFITLVAGTGIYA

SEQ ID NO: 2398940 - protein, 24 aa, Entamoeba dispar
KRNYSFIVIFVYLALVISSIIISS

SEQ ID NO: 2398941 - protein, 18 aa, Entamoeba dispar
KRQRRWYTKPKTIKYGDI

SEQ ID NO: 2398942 - protein, 27 aa, Entamoeba dispar
KRSSKRMLAYFPIKKILDENGKTIFDD

SEQ ID NO: 2398943 - protein, 24 aa, Entamoeba dispar
KRSVQLCFLMGILNKFCSLTFQRP

SEQ ID NO: 2398944 - protein, 20 aa, Entamoeba dispar
KRTILKLKHSFPSVLEREEV

SEQ ID NO: 2398945 - protein, 25 aa, Entamoeba dispar
KRVILYYIIIIVFFIFTAIMVSISL

SEQ ID NO: 2398946 - protein, 22 aa, Entamoeba dispar
KRVKAPTWYPIYHTSLNFKNFE

SEQ ID NO: 2398947 - protein, 25 aa, Entamoeba dispar
KRVWESLVLVIFIRPFDIGDRIQVT

SEQ ID NO: 2398948 - protein, 42 aa, Entamoeba dispar
KRYEVITETYNLTYIYLYCLFIEVIKFLKRRNEIFKTTFILT

SEQ ID NO: 2398949 - protein, 54 aa, Entamoeba dispar
KRYTILNFIALFFSIILFITLLFIQQLFPSFDNWFWFNVFIQMLQTPVFYALVL

SEQ ID NO: 2398950 - protein, 32 aa, Entamoeba dispar
KSAEYILTPRLIIHLQPSIPIYVFIHSPYGKT

SEQ ID NO: 2398951 - protein, 25 aa, Entamoeba dispar
KSAPYFIQWIVNILQTYGTLKRLAL

SEQ ID NO: 2398952 - protein, 27 aa, Entamoeba dispar
KSCSAILFWCYMFAILNIIFGVVLSMK

SEQ ID NO: 2398953 - protein, 23 aa, Entamoeba dispar
KSDNILLFDLTLEAPVRAKLTDF

SEQ ID NO: 2398954 - protein, 23 aa, Entamoeba dispar
KSDTPCVLVIKPSYDTNTNKIHI

SEQ ID NO: 2398955 - protein, 26 aa, Entamoeba dispar
KSEHVFLILQLCGSIIFYHSSGETCV

SEQ ID NO: 2398956 - protein, 29 aa, Entamoeba dispar
KSEKIIIKTWWRLVIFIINGIMVGIMNIK

SEQ ID NO: 2398957 - protein, 24 aa, Entamoeba dispar
KSENKFYPFIQQYLTIINQTKIFN

SEQ ID NO: 2398958 - protein, 25 aa, Entamoeba dispar
KSENLFLSLIKLLEGYLANSLVEVS

SEQ ID NO: 2398959 - protein, 33 aa, Entamoeba dispar
KSFEEWDLESFYPFFKEGFCKHLIPAALHRYEE

SEQ ID NO: 2398960 - protein, 21 aa, Entamoeba dispar
KSFFREGFISEIMVWIHNFLT

SEQ ID NO: 2398961 - protein, 20 aa, Entamoeba dispar
KSFFRVFDDKNTQKTTFFTF

SEQ ID NO: 2398962 - protein, 28 aa, Entamoeba dispar
KSFIEQFMLFINPLINNNIQLNGLLTLC

SEQ ID NO: 2398963 - protein, 19 aa, Entamoeba dispar
KSFRMFIELGKKILIPLQL

SEQ ID NO: 2398964 - protein, 33 aa, Entamoeba dispar
KSFVAFLSYPISGYALKMPLFGSTFKSVQIEST

SEQ ID NO: 2398965 - protein, 17 aa, Entamoeba dispar
KSFWKLVLSCVLIITNV

SEQ ID NO: 2398966 - protein, 26 aa, Entamoeba dispar
KSGNKYMLIIFHTPNNPKFVFNFEKQ

SEQ ID NO: 2398967 - protein, 31 aa, Entamoeba dispar
KSHWSLSQFFLWITVFVLIHISFTISLILGY

SEQ ID NO: 2398968 - protein, 20 aa, Entamoeba dispar
KSIAFCMFEIVWKQITQIKN

SEQ ID NO: 2398969 - protein, 23 aa, Entamoeba dispar
KSIQHHEFLIKPTYQIRKEEDLK

SEQ ID NO: 2398970 - protein, 49 aa, Entamoeba dispar
KSKALTNFLFWGIGSIVYVLYYIFALTLFLLLYIRLTKKIKQEIDDEKL

SEQ ID NO: 2398971 - protein, 24 aa, Entamoeba dispar
KSKEWIMAISIGSTILILFVLIII

SEQ ID NO: 2398972 - protein, 23 aa, Entamoeba dispar
KSKSIIWMVSWKGVKFVLKDQKI

SEQ ID NO: 2398973 - protein, 21 aa, Entamoeba dispar
KSKYIGKLTSKEWFIKGYIED

SEQ ID NO: 2398974 - protein, 28 aa, Entamoeba dispar
KSLELFELFRLRWKGNFIILHSISSLIN

SEQ ID NO: 2398975 - protein, 19 aa, Entamoeba dispar
KSLPIIFDILFISIQYSTS

SEQ ID NO: 2398976 - protein, 17 aa, Entamoeba dispar
KSLQRIIVKNVELLMGA

SEQ ID NO: 2398977 - protein, 17 aa, Entamoeba dispar
KSLRHPCVLQFFGSGMD

SEQ ID NO: 2398978 - protein, 23 aa, Entamoeba dispar
KSLSYFEYFFELCFTRGVGCENL

SEQ ID NO: 2398979 - protein, 28 aa, Entamoeba dispar
KSNIFVIGMFILELIFALISTIMGSIWR

SEQ ID NO: 2398980 - protein, 24 aa, Entamoeba dispar
KSNLRAFWQFLVSMGLIGFIGSYH

SEQ ID NO: 2398981 - protein, 34 aa, Entamoeba dispar
KSNSYLLMIIIADKLLFILWVATLTTFILIDKLR

SEQ ID NO: 2398982 - protein, 44 aa, Entamoeba dispar
KSNTIYYIVGGIICGILLLLLVIIVIAIIVFFVMRKKKGSEYHD

SEQ ID NO: 2398983 - protein, 31 aa, Entamoeba dispar
KSNVFGMMGVIFYWIITQKNYIIKEEYIDNL

SEQ ID NO: 2398984 - protein, 24 aa, Entamoeba dispar
KSPALYLQTFPLLKSAFEIFEQTP

SEQ ID NO: 2398985 - protein, 32 aa, Entamoeba dispar
KSQQKIETVPNIILLFFNSLEEWNIHKDIPNN

SEQ ID NO: 2398986 - protein, 32 aa, Entamoeba dispar
KSRWILYDKELEACWKKLALLILTRKGEKSEE

SEQ ID NO: 2398987 - protein, 37 aa, Entamoeba dispar
KSSIIMKLFIIAMAVLLFLFVMSVIAAIWFSPKHNRN

SEQ ID NO: 2398988 - protein, 22 aa, Entamoeba dispar
KSSLGNFILKKNTFKVSADPNS

SEQ ID NO: 2398989 - protein, 18 aa, Entamoeba dispar
KSTLNPFYGYEPAPNGTD

SEQ ID NO: 2398990 - protein, 24 aa, Entamoeba dispar
KSVKLMIFESIKPFNKIGFQQFAE

SEQ ID NO: 2398991 - protein, 18 aa, Entamoeba dispar
KSWDLALVVLATVLLSCF

SEQ ID NO: 2398992 - protein, 19 aa, Entamoeba dispar
KSWLCVFPGCKESVKTHYN

SEQ ID NO: 2398993 - protein, 22 aa, Entamoeba dispar
KSYDHFFPINKMWDKNGVLVFS

SEQ ID NO: 2398994 - protein, 23 aa, Entamoeba dispar
KSYFKKGFSKLFLPLGFSGVLSI

SEQ ID NO: 2398995 - protein, 37 aa, Entamoeba dispar
KSYIPWISLVRIIYLSLMSLYPYKTFFSVKSDIPDFI

SEQ ID NO: 2398996 - protein, 23 aa, Entamoeba dispar
KSYSLFGFLHYFKSLKLQPNSSN

SEQ ID NO: 2398997 - protein, 29 aa, Entamoeba dispar
KTAISIFDIIPFEFPLGKWYTKPNIIKYG

SEQ ID NO: 2398998 - protein, 18 aa, Entamoeba dispar
KTAMAQILLKVICDLLKR

SEQ ID NO: 2398999 - protein, 24 aa, Entamoeba dispar
KTCTKCLDGYYLDDDSCFQIKHCD

SEQ ID NO: 2399000 - protein, 23 aa, Entamoeba dispar
KTEIPKFLVKVLVDFASTTFTIK

SEQ ID NO: 2399001 - protein, 18 aa, Entamoeba dispar
KTELINLFEQLAIFIRKS

SEQ ID NO: 2399002 - protein, 26 aa, Entamoeba dispar
KTESILPIYFLLLQQSAALAFFWSPC

SEQ ID NO: 2399003 - protein, 18 aa, Entamoeba dispar
KTFFSVKSDIPDFIKSHW

SEQ ID NO: 2399004 - protein, 34 aa, Entamoeba dispar
KTFPITGLILCIILFVLIGLYIIVTVILNIFVFH

SEQ ID NO: 2399005 - protein, 21 aa, Entamoeba dispar
KTFSYSSWLYSFINAIYPPSN

SEQ ID NO: 2399006 - protein, 20 aa, Entamoeba dispar
KTFTQALFAAAVEYLLPFRR

SEQ ID NO: 2399007 - protein, 36 aa, Entamoeba dispar
KTGEHEPFWINIYHIMLLHGLLYWRHRPNIEFKDMI

SEQ ID NO: 2399008 - protein, 22 aa, Entamoeba dispar
KTGVLKAFAFLFEYIGEKSKDY

SEQ ID NO: 2399009 - protein, 24 aa, Entamoeba dispar
KTHKQYIHPLKHKSLPVTSLTPPS

SEQ ID NO: 2399010 - protein, 22 aa, Entamoeba dispar
KTICLLYHEYYSICTDKEDECN

SEQ ID NO: 2399011 - protein, 29 aa, Entamoeba dispar
KTIETQDLYLCLIWVLKNLNREVLKRYIS

SEQ ID NO: 2399012 - protein, 18 aa, Entamoeba dispar
KTIIIGILIIFNVIGMII

SEQ ID NO: 2399013 - protein, 18 aa, Entamoeba dispar
KTIKLSSTKGWDVLRWKD

SEQ ID NO: 2399014 - protein, 21 aa, Entamoeba dispar
KTIKTTICGTLAWIAPEVLAR

SEQ ID NO: 2399015 - protein, 19 aa, Entamoeba dispar
KTILHWYFGTDKTLKWRFI

SEQ ID NO: 2399016 - protein, 17 aa, Entamoeba dispar
KTIWIFHGARTDGLFVG

SEQ ID NO: 2399017 - protein, 24 aa, Entamoeba dispar
KTIYPFIIIIIIALFIMMKKTNSS

SEQ ID NO: 2399018 - protein, 18 aa, Entamoeba dispar
KTIYTIYLKEFIKIIIEI

SEQ ID NO: 2399019 - protein, 23 aa, Entamoeba dispar
KTLIEYINAQQFRYGFDSIITVQ

SEQ ID NO: 2399020 - protein, 20 aa, Entamoeba dispar
KTLLHGLFSLYPPTLEGLYK

SEQ ID NO: 2399021 - protein, 34 aa, Entamoeba dispar
KTLPIFIISQLLLRFFLVLWTLFVIFPSNSFFEP

SEQ ID NO: 2399022 - protein, 18 aa, Entamoeba dispar
KTMFDVFAKLSQLFPSLI

SEQ ID NO: 2399023 - protein, 20 aa, Entamoeba dispar
KTMLKFLIRSSHKNTFKMIK

SEQ ID NO: 2399024 - protein, 28 aa, Entamoeba dispar
KTNIIYLVIGYLGFLIPAACIGIFIASR

SEQ ID NO: 2399025 - protein, 24 aa, Entamoeba dispar
KTNKDFIPMYFVDSQPEAGDNTRS

SEQ ID NO: 2399026 - protein, 22 aa, Entamoeba dispar
KTNPFIIMRLGILAFIIALFFP

SEQ ID NO: 2399027 - protein, 17 aa, Entamoeba dispar
KTPFFKTLIKFYQPSKK

SEQ ID NO: 2399028 - protein, 31 aa, Entamoeba dispar
KTPHRVSVFNWFWNRQSYIPSEPYSTQLRRY

SEQ ID NO: 2399029 - protein, 39 aa, Entamoeba dispar
KTQFITILLFFFTSGCWILLSLLLMFLDCQYHLKIMGIS

SEQ ID NO: 2399030 - protein, 23 aa, Entamoeba dispar
KTRIKFMCLRLPSERVWLGCEDE

SEQ ID NO: 2399031 - protein, 24 aa, Entamoeba dispar
KTSAFMPFFQLNSMSSGYGIDGII

SEQ ID NO: 2399032 - protein, 43 aa, Entamoeba dispar
KTSCPDYIFVKPTTSLWWVSATIFIFFIICVFIFGICFSIYHY

SEQ ID NO: 2399033 - protein, 41 aa, Entamoeba dispar
KTSESLLFDSFYILRQLWYISLFLTPLGIKVCIKLLQVSTL

SEQ ID NO: 2399034 - protein, 46 aa, Entamoeba dispar
KTTKYCWWSFIPVFLFNQFKYFINLFFLIIAILSCIPQLSAASPVA

SEQ ID NO: 2399035 - protein, 26 aa, Entamoeba dispar
KVARDWFLFLMSHDATLFISIVMGVL

SEQ ID NO: 2399036 - protein, 21 aa, Entamoeba dispar
KVCVKKFFKSKAGIILGCVIG

SEQ ID NO: 2399037 - protein, 17 aa, Entamoeba dispar
KVEFGKCYYFGSDSGAM

SEQ ID NO: 2399038 - protein, 26 aa, Entamoeba dispar
KVELAPIALPLLINILSSFHCCQNQQ

SEQ ID NO: 2399039 - protein, 19 aa, Entamoeba dispar
KVERLDLFGYLSCKELHLK

SEQ ID NO: 2399040 - protein, 25 aa, Entamoeba dispar
KVFFFCDEFMFKRWTKYINDSVEGK

SEQ ID NO: 2399041 - protein, 21 aa, Entamoeba dispar
KVFLCLVLMWTNSLPIYLFSI

SEQ ID NO: 2399042 - protein, 17 aa, Entamoeba dispar
KVFQCCFPLDFVKVLMF

SEQ ID NO: 2399043 - protein, 27 aa, Entamoeba dispar
KVICLCIILLVINLLLFLEKKSDEINV

SEQ ID NO: 2399044 - protein, 20 aa, Entamoeba dispar
KVIFNFVLSHKLFNTLFCHW

SEQ ID NO: 2399045 - protein, 24 aa, Entamoeba dispar
KVIHGIIEYLFYKPNPLLIIFMGV

SEQ ID NO: 2399046 - protein, 23 aa, Entamoeba dispar
KVKDGYYRYSFSNSGAVCTLTCL

SEQ ID NO: 2399047 - protein, 23 aa, Entamoeba dispar
KVKKLVYLIMSNLIYYNEQDVNK

SEQ ID NO: 2399048 - protein, 18 aa, Entamoeba dispar
KVMLCPEGFYSDGTQCLH

SEQ ID NO: 2399049 - protein, 40 aa, Entamoeba dispar
KVMWNGGPLILYFKHNNFISIYLFLLLAAIGITVSMIMGT

SEQ ID NO: 2399050 - protein, 18 aa, Entamoeba dispar
KVNVFKMLWNQITDFIVM

SEQ ID NO: 2399051 - protein, 17 aa, Entamoeba dispar
KVRSITVLVLYSLAIFI

SEQ ID NO: 2399052 - protein, 40 aa, Entamoeba dispar
KVSSVILTVLQILVVLPEKDLYVLPNTQIPYKVFTTKRNE

SEQ ID NO: 2399053 - protein, 17 aa, Entamoeba dispar
KVSVLFTLFVLSPFVIF

SEQ ID NO: 2399054 - protein, 23 aa, Entamoeba dispar
KVTKIIIHPDKFSDSHLPVINVI

SEQ ID NO: 2399055 - protein, 20 aa, Entamoeba dispar
KVVLLYYQKKEFRIPISIFI

SEQ ID NO: 2399056 - protein, 22 aa, Entamoeba dispar
KVYQIKLFNFIGTSIFINIKFI

SEQ ID NO: 2399057 - protein, 26 aa, Entamoeba dispar
KVYTMQYFIWWFVLLPFVVPKIIEGA

SEQ ID NO: 2399058 - protein, 19 aa, Entamoeba dispar
KWFETNKLKWYKYNQLAYI

SEQ ID NO: 2399059 - protein, 27 aa, Entamoeba dispar
KWIIEGTPFLWYLLNTLLIISTPLCVL

SEQ ID NO: 2399060 - protein, 17 aa, Entamoeba dispar
KWIMYKLSSDSYINCNP

SEQ ID NO: 2399061 - protein, 23 aa, Entamoeba dispar
KWIYLLFFFLLFGILMIMKYFII

SEQ ID NO: 2399062 - protein, 19 aa, Entamoeba dispar
KWLNRINPLYPFLQTELQE

SEQ ID NO: 2399063 - protein, 31 aa, Entamoeba dispar
KWMKLPDAPVPIWRYFVFGTAMFCCLVLCIL

SEQ ID NO: 2399064 - protein, 22 aa, Entamoeba dispar
KWRPLFFYCRFLVTKIIVPIFL

SEQ ID NO: 2399065 - protein, 21 aa, Entamoeba dispar
KWTFILNIVLILFNNPFFFYE

SEQ ID NO: 2399066 - protein, 27 aa, Entamoeba dispar
KYCIVITIIRFLFTPLRSIILRRYCFI

SEQ ID NO: 2399067 - protein, 33 aa, Entamoeba dispar
KYDSHSFIYFFIFFLDIFCIIQPQFLVRIKDND

SEQ ID NO: 2399068 - protein, 29 aa, Entamoeba dispar
KYEKLYTTVKTQLYFFFSSSGNDLLNGLI

SEQ ID NO: 2399069 - protein, 18 aa, Entamoeba dispar
KYEKQLFIILDHFNVHPK

SEQ ID NO: 2399070 - protein, 25 aa, Entamoeba dispar
KYELTQVCRIYVALVPKGYTITECP

SEQ ID NO: 2399071 - protein, 17 aa, Entamoeba dispar
KYFHYTIPKSTTTQNYL

SEQ ID NO: 2399072 - protein, 21 aa, Entamoeba dispar
KYGIIGIWIIAALCCGYFALN

SEQ ID NO: 2399073 - protein, 18 aa, Entamoeba dispar
KYGKYFHYTIPKSTTTQN

SEQ ID NO: 2399074 - protein, 29 aa, Entamoeba dispar
KYGSYETYYYDIELWYSLLAHSKVPFLTF

SEQ ID NO: 2399075 - protein, 20 aa, Entamoeba dispar
KYHPEIYTKIMRLGGYDSLY

SEQ ID NO: 2399076 - protein, 27 aa, Entamoeba dispar
KYIAEILLHFEKLAKKELWYINEEQIK

SEQ ID NO: 2399077 - protein, 20 aa, Entamoeba dispar
KYLLRILKRNNATATFFMLG

SEQ ID NO: 2399078 - protein, 22 aa, Entamoeba dispar
KYNFCPFFMMTFKASWEMFKQT

SEQ ID NO: 2399079 - protein, 27 aa, Entamoeba dispar
KYNFLRKKTLYYKWIYPIAIAVDITLR

SEQ ID NO: 2399080 - protein, 21 aa, Entamoeba dispar
KYNKMFVVSLIRNVFTNNFLE

SEQ ID NO: 2399081 - protein, 19 aa, Entamoeba dispar
KYNMLVLDTIFRTYFRVLK

SEQ ID NO: 2399082 - protein, 21 aa, Entamoeba dispar
KYPDCHYLSYLFDLSLNIDNT

SEQ ID NO: 2399083 - protein, 20 aa, Entamoeba dispar
KYPDCHYLSYLYDFSLNTEN

SEQ ID NO: 2399084 - protein, 22 aa, Entamoeba dispar
KYPKLYIILNPFSGTKKGEIIM

SEQ ID NO: 2399085 - protein, 22 aa, Entamoeba dispar
KYPNILINFIKTMFLRIIESTS

SEQ ID NO: 2399086 - protein, 19 aa, Entamoeba dispar
KYRFGKWFKINLNQVTNAV

SEQ ID NO: 2399087 - protein, 17 aa, Entamoeba dispar
KYSFKYFSLQQRINFII

SEQ ID NO: 2399088 - protein, 32 aa, Entamoeba dispar
KYSLPIFNTSIYPLFSIFNVSGMTTLFLLLMT

SEQ ID NO: 2399089 - protein, 35 aa, Entamoeba dispar
KYTVYNFIPYFLYEQFRKLANVYFLFISCLQLIPG

SEQ ID NO: 2399090 - protein, 25 aa, Entamoeba dispar
KYVIKRYHHFFIIKTDAASSTHLDM

SEQ ID NO: 2399091 - protein, 20 aa, Entamoeba dispar
KYVWWNVFTIRKNSTGILLR

SEQ ID NO: 2399092 - protein, 28 aa, Entamoeba dispar
KYWKRKSIVIILLIVLVLGIIGVIIGVC

SEQ ID NO: 2399093 - protein, 19 aa, Entamoeba dispar
KYYGILQFEFSYLSSIDFE

SEQ ID NO: 2399094 - protein, 19 aa, Entamoeba dispar
KYYISNFFSYFGPLYILFV

SEQ ID NO: 2399095 - protein, 28 aa, Entamoeba dispar
LAAIHPKLFPTPLILPTAPNSMLRLNRL

SEQ ID NO: 2399096 - protein, 17 aa, Entamoeba dispar
LACVVVGFVYFRRNKQE

SEQ ID NO: 2399097 - protein, 32 aa, Entamoeba dispar
LADLYDIESLYVIFFFILKNLKETTIQQWLVS

SEQ ID NO: 2399098 - protein, 33 aa, Entamoeba dispar
LADTTLLIVLIVFGTLALLPMIKRKLGKGEDDY

SEQ ID NO: 2399099 - protein, 18 aa, Entamoeba dispar
LAFFIELPLCYILRYLPS

SEQ ID NO: 2399100 - protein, 18 aa, Entamoeba dispar
LAFFWSICEYLLSNEIYQ

SEQ ID NO: 2399101 - protein, 32 aa, Entamoeba dispar
LAFSNCIVLCLFFWFLRLYSVFNWALEQHLTG

SEQ ID NO: 2399102 - protein, 33 aa, Entamoeba dispar
LAFSTRLLQILPLSLIIFFFSLVTDVPKQFIPI

SEQ ID NO: 2399103 - protein, 27 aa, Entamoeba dispar
LAGFFFLLEGLFIYNGYLRIAAPFFDY

SEQ ID NO: 2399104 - protein, 23 aa, Entamoeba dispar
LAGHNALVLMPTGGGKSLCYQLP

SEQ ID NO: 2399105 - protein, 17 aa, Entamoeba dispar
LAHLPFFHFIRENKELF

SEQ ID NO: 2399106 - protein, 19 aa, Entamoeba dispar
LAITGVYPLTIKTLNRDKS

SEQ ID NO: 2399107 - protein, 23 aa, Entamoeba dispar
LAIVIVEAFDRKCPYSMLGSSWE

SEQ ID NO: 2399108 - protein, 26 aa, Entamoeba dispar
LAKPLKQMFRLFSRISQMSKEMAIVF

SEQ ID NO: 2399109 - protein, 18 aa, Entamoeba dispar
LALSISYTWTGASSNLFE

SEQ ID NO: 2399110 - protein, 21 aa, Entamoeba dispar
LALYVLIYLISLFTGYPNLLQ

SEQ ID NO: 2399111 - protein, 17 aa, Entamoeba dispar
LAPIPFGLISKFIKNRT

SEQ ID NO: 2399112 - protein, 18 aa, Entamoeba dispar
LARLLYFVIITYSLSKGK

SEQ ID NO: 2399113 - protein, 26 aa, Entamoeba dispar
LATIVYFVITWNYFNRAIYITGAATM

SEQ ID NO: 2399114 - protein, 18 aa, Entamoeba dispar
LATNKLLDDILSVSFQKI

SEQ ID NO: 2399115 - protein, 45 aa, Entamoeba dispar
LATYSHTFVWPFYISMILSILLFFGWYIFYGFVGGFKFISMGESV

SEQ ID NO: 2399116 - protein, 24 aa, Entamoeba dispar
LAVYQSVMLYLLSSSIIITNDVFD

SEQ ID NO: 2399117 - protein, 26 aa, Entamoeba dispar
LAYSILGLFFEWKIPLKYIKVVLQVA

SEQ ID NO: 2399118 - protein, 25 aa, Entamoeba dispar
LAYVGFFQMFPTIIKGIYSALDNGS

SEQ ID NO: 2399119 - protein, 17 aa, Entamoeba dispar
LCDIFLQKTVHPNLCLC

SEQ ID NO: 2399120 - protein, 25 aa, Entamoeba dispar
LCEQIHFFLPFHFINIEDNFVDTKF

SEQ ID NO: 2399121 - protein, 17 aa, Entamoeba dispar
LCFIAFSLVVYFTDWKM

SEQ ID NO: 2399122 - protein, 21 aa, Entamoeba dispar
LCFLGIRINYLGLAIICFVMQ

SEQ ID NO: 2399123 - protein, 18 aa, Entamoeba dispar
LCFLLVIVLGDNTNTTVD

SEQ ID NO: 2399124 - protein, 18 aa, Entamoeba dispar
LCFNIIAVILCFPLSFHQ

SEQ ID NO: 2399125 - protein, 23 aa, Entamoeba dispar
LCIAYIIVILFFNFAGTAVIQYS

SEQ ID NO: 2399126 - protein, 17 aa, Entamoeba dispar
LCIGLDAAAIEEFISYL

SEQ ID NO: 2399127 - protein, 18 aa, Entamoeba dispar
LCILGCFAQNLTINIFHV

SEQ ID NO: 2399128 - protein, 21 aa, Entamoeba dispar
LCKGLIVIFTIVLCLPSLQTC

SEQ ID NO: 2399129 - protein, 34 aa, Entamoeba dispar
LCKSAPIIIIWTTLFLVEILLAIIVVLIAQTGCQ

SEQ ID NO: 2399130 - protein, 27 aa, Entamoeba dispar
LCLCVSIMFWILYFKSPSAVFRVSEDW

SEQ ID NO: 2399131 - protein, 18 aa, Entamoeba dispar
LCLIPCYLTHECIVKSPL

SEQ ID NO: 2399132 - protein, 18 aa, Entamoeba dispar
LCNNFFLNSLWTFPQQVD

SEQ ID NO: 2399133 - protein, 23 aa, Entamoeba dispar
LCNRFSLQITFLESLLDLDYSNQ

SEQ ID NO: 2399134 - protein, 21 aa, Entamoeba dispar
LCPNNNLPLVLTTNSDNKINV

SEQ ID NO: 2399135 - protein, 20 aa, Entamoeba dispar
LCVIVYFLPVKVINGYIPPI

SEQ ID NO: 2399136 - protein, 18 aa, Entamoeba dispar
LCVIYAIIFFFMIKPENN

SEQ ID NO: 2399137 - protein, 28 aa, Entamoeba dispar
LCVPTVYDTLPLYRTLFHPKDNEFVVNV

SEQ ID NO: 2399138 - protein, 20 aa, Entamoeba dispar
LCVRNSFNVWLTIANLDALF

SEQ ID NO: 2399139 - protein, 25 aa, Entamoeba dispar
LCYNHNILGHWFRFIGNKSVSYQIQ

SEQ ID NO: 2399140 - protein, 19 aa, Entamoeba dispar
LCYQLPSLFKDGYTLVISP

SEQ ID NO: 2399141 - protein, 24 aa, Entamoeba dispar
LDAFESVMKITLGTTLIGAIIIIA

SEQ ID NO: 2399142 - protein, 19 aa, Entamoeba dispar
LDDILHRPIGGIALEPRVG

SEQ ID NO: 2399143 - protein, 24 aa, Entamoeba dispar
LDEMKLIALLLVYGIIHNKKIILE

SEQ ID NO: 2399144 - protein, 23 aa, Entamoeba dispar
LDETFFLEDPPIYSVVDALKELY

SEQ ID NO: 2399145 - protein, 17 aa, Entamoeba dispar
LDFLSRLIHRTGLGDHT

SEQ ID NO: 2399146 - protein, 22 aa, Entamoeba dispar
LDFSYKLLRGIMNYCNYPDPDI

SEQ ID NO: 2399147 - protein, 21 aa, Entamoeba dispar
LDHEHLYFLYLEINEEYAATI

SEQ ID NO: 2399148 - protein, 18 aa, Entamoeba dispar
LDIPFQENLLLLALSFYD

SEQ ID NO: 2399149 - protein, 29 aa, Entamoeba dispar
LDKFRCDYVVYFYGAVFVPNKICIVTEFA

SEQ ID NO: 2399150 - protein, 29 aa, Entamoeba dispar
LDKFRNDYIVHFYGAVFIPNKICMVMELA

SEQ ID NO: 2399151 - protein, 29 aa, Entamoeba dispar
LDKFRNEYIIHFFGAVFIPNKISIVTEYA

SEQ ID NO: 2399152 - protein, 29 aa, Entamoeba dispar
LDKFRNEYIVHFYGAVFIPKKICMVTEFA

SEQ ID NO: 2399153 - protein, 27 aa, Entamoeba dispar
LDKFRNEYLVHFYGAVFIPNKICMVNE

SEQ ID NO: 2399154 - protein, 29 aa, Entamoeba dispar
LDKFRSDYIVYFYGAVFIPSKICIVTEFA

SEQ ID NO: 2399155 - protein, 27 aa, Entamoeba dispar
LDKFRSEYIIHFYGAVFIPNKICMITE

SEQ ID NO: 2399156 - protein, 27 aa, Entamoeba dispar
LDKFRSEYIIHFYGAVMIPGKVCMVTE

SEQ ID NO: 2399157 - protein, 29 aa, Entamoeba dispar
LDKFRSEYIIQFYGAVFIPNKICIVTEYA

SEQ ID NO: 2399158 - protein, 26 aa, Entamoeba dispar
LDKFRSEYIIQFYGAVFIPNKICMIT

SEQ ID NO: 2399159 - protein, 29 aa, Entamoeba dispar
LDKFRSNYIIHFYGAVLIPGKISIVTEFA

SEQ ID NO: 2399160 - protein, 40 aa, Entamoeba dispar
LDLGIKRIYIPTFLIYPIQRLPRYLLLLETLSKNVPENYE

SEQ ID NO: 2399161 - protein, 28 aa, Entamoeba dispar
LDRNEILYLLIGYLSCLIPAACIGIFIA

SEQ ID NO: 2399162 - protein, 22 aa, Entamoeba dispar
LDRRTVIHLFGLTILHTKKDDY

SEQ ID NO: 2399163 - protein, 18 aa, Entamoeba dispar
LDSELKYVIKRYHHFFII

SEQ ID NO: 2399164 - protein, 40 aa, Entamoeba dispar
LDSLRMRIFGFHWKTSFPLIFFFTLVFMSFTIFGTKSVNS

SEQ ID NO: 2399165 - protein, 24 aa, Entamoeba dispar
LDSMIRFFLILFTPQPDDFIDQTT

SEQ ID NO: 2399166 - protein, 26 aa, Entamoeba dispar
LDSPMNIIDIIPYPINIKINEQEIPF

SEQ ID NO: 2399167 - protein, 20 aa, Entamoeba dispar
LDTFLLFVSSCSQSKFIASL

SEQ ID NO: 2399168 - protein, 22 aa, Entamoeba dispar
LDYIKGIMRKPTCNEIVMIGVG

SEQ ID NO: 2399169 - protein, 18 aa, Entamoeba dispar
LDYKQYQMYIGITGFIVI

SEQ ID NO: 2399170 - protein, 19 aa, Entamoeba dispar
LEAYVFKDILKNPPQPSFS

SEQ ID NO: 2399171 - protein, 27 aa, Entamoeba dispar
LECCPLPSFDIIFTDSFHSFWTYTNKN

SEQ ID NO: 2399172 - protein, 19 aa, Entamoeba dispar
LECHKGCILEFISVTSLHI

SEQ ID NO: 2399173 - protein, 27 aa, Entamoeba dispar
LECPIKEKFHCVFAIYTKNKLIEKVTS

SEQ ID NO: 2399174 - protein, 24 aa, Entamoeba dispar
LECQRWCFATLKLILLNPNKKVFS

SEQ ID NO: 2399175 - protein, 17 aa, Entamoeba dispar
LECYYDQTNTELCYSLK

SEQ ID NO: 2399176 - protein, 25 aa, Entamoeba dispar
LEEEKMVVLFELLIDIATDFGFIFI

SEQ ID NO: 2399177 - protein, 27 aa, Entamoeba dispar
LEESKFQIIFLHLFDYSTFSSDIYSII

SEQ ID NO: 2399178 - protein, 17 aa, Entamoeba dispar
LEEVKLLEQLRSPCIIS

SEQ ID NO: 2399179 - protein, 21 aa, Entamoeba dispar
LEGPIYLLRTSYQNFISRFGV

SEQ ID NO: 2399180 - protein, 26 aa, Entamoeba dispar
LEGSTIIKVYPLAILTLETQVIENTK

SEQ ID NO: 2399181 - protein, 25 aa, Entamoeba dispar
LEHVPYLFVIIYGLSFFFQNMGPNT

SEQ ID NO: 2399182 - protein, 19 aa, Entamoeba dispar
LEIILLLREILQSQLTIYS

SEQ ID NO: 2399183 - protein, 24 aa, Entamoeba dispar
LEKFRCNYIIHFYGAVIIQDNRCV

SEQ ID NO: 2399184 - protein, 18 aa, Entamoeba dispar
LEKIGTPVYNFLCSYLLK

SEQ ID NO: 2399185 - protein, 27 aa, Entamoeba dispar
LEKMGTILQIVAVVSVALMSIVINMML

SEQ ID NO: 2399186 - protein, 25 aa, Entamoeba dispar
LEKSNYLIVITKKKLITKFLQHKLF

SEQ ID NO: 2399187 - protein, 25 aa, Entamoeba dispar
LELSPFMAFILYLVYIQIDYHLEVG

SEQ ID NO: 2399188 - protein, 20 aa, Entamoeba dispar
LELWSLFDFLMPGFLGTEKE

SEQ ID NO: 2399189 - protein, 22 aa, Entamoeba dispar
LELYVPFLFVFVHLITSPNGDD

SEQ ID NO: 2399190 - protein, 33 aa, Entamoeba dispar
LENHVIWKYLLKSKYWITIFIDMAVSLVSSKEY

SEQ ID NO: 2399191 - protein, 36 aa, Entamoeba dispar
LEPYKGTLSFFIIFTILLHYLYFLDWYTHYETQLHN

SEQ ID NO: 2399192 - protein, 26 aa, Entamoeba dispar
LEQTPKLLFFTGIALYASFVASLFKN

SEQ ID NO: 2399193 - protein, 30 aa, Entamoeba dispar
LERADGFGMEILPLLKFIGSSQTYAEFLTT

SEQ ID NO: 2399194 - protein, 38 aa, Entamoeba dispar
LERTTEISFYLWNKTEYIPMGYYPITTIPTKVMNIIQK

SEQ ID NO: 2399195 - protein, 26 aa, Entamoeba dispar
LESKLWKYLCLFVSFSIKQKNITRTT

SEQ ID NO: 2399196 - protein, 29 aa, Entamoeba dispar
LESLLKLLGLIYDILPYFIKTSRDILLLD

SEQ ID NO: 2399197 - protein, 24 aa, Entamoeba dispar
LESTSKLFLGWFNSNELKFDGTIE

SEQ ID NO: 2399198 - protein, 28 aa, Entamoeba dispar
LETFSFNGFFCFPFVDYSFLSDTTKVSS

SEQ ID NO: 2399199 - protein, 29 aa, Entamoeba dispar
LETSKLYPLLLPDVINLITLLILTTNEAL

SEQ ID NO: 2399200 - protein, 25 aa, Entamoeba dispar
LETTKEFFLFTYNNNTQQIIRRKKN

SEQ ID NO: 2399201 - protein, 18 aa, Entamoeba dispar
LEVEYPLKFATENKFTHF

SEQ ID NO: 2399202 - protein, 17 aa, Entamoeba dispar
LEVNPVRQTLKAGFGIE

SEQ ID NO: 2399203 - protein, 17 aa, Entamoeba dispar
LEYILGKELPHNYDELF

SEQ ID NO: 2399204 - protein, 17 aa, Entamoeba dispar
LEYVFYTLLELNNFFLT

SEQ ID NO: 2399205 - protein, 20 aa, Entamoeba dispar
LFAIFLTFFVPIISIIFPLY

SEQ ID NO: 2399206 - protein, 26 aa, Entamoeba dispar
LFALSSLIIFIFYYHLIKLPQINIQM

SEQ ID NO: 2399207 - protein, 24 aa, Entamoeba dispar
LFAMPLVYLPWISLLLHASFMTEL

SEQ ID NO: 2399208 - protein, 17 aa, Entamoeba dispar
LFCIVFSQYNCSLGCGS

SEQ ID NO: 2399209 - protein, 18 aa, Entamoeba dispar
LFCTMCKPGYYLQKQDCK

SEQ ID NO: 2399210 - protein, 25 aa, Entamoeba dispar
LFDELTFDLILPPRAFITSQELLMN

SEQ ID NO: 2399211 - protein, 17 aa, Entamoeba dispar
LFDGDIYIVKYLTSSVE

SEQ ID NO: 2399212 - protein, 31 aa, Entamoeba dispar
LFEAYTWDTPYPIEKFKYPWDVAQFIGSGKR

SEQ ID NO: 2399213 - protein, 21 aa, Entamoeba dispar
LFFISMFGFIFYLNMTSNPIV

SEQ ID NO: 2399214 - protein, 20 aa, Entamoeba dispar
LFFNHGIWHLIVWFANFQHS

SEQ ID NO: 2399215 - protein, 24 aa, Entamoeba dispar
LFGFLVIGFICIGIIYAIQPSYQP

SEQ ID NO: 2399216 - protein, 24 aa, Entamoeba dispar
LFGIFYAIFIFKMFRRYAQKHNLN

SEQ ID NO: 2399217 - protein, 20 aa, Entamoeba dispar
LFGRYLKAIIIGGSALPSEL

SEQ ID NO: 2399218 - protein, 17 aa, Entamoeba dispar
LFGYFLKDENCVACSDR

SEQ ID NO: 2399219 - protein, 18 aa, Entamoeba dispar
LFHEFINVIFISLTKRRA

SEQ ID NO: 2399220 - protein, 25 aa, Entamoeba dispar
LFHIGLLYLFIYCSSADEGIVCYWK

SEQ ID NO: 2399221 - protein, 22 aa, Entamoeba dispar
LFHQFYFVFMIYHLLSFFFFHS

SEQ ID NO: 2399222 - protein, 18 aa, Entamoeba dispar
LFIGYLTEKVPNLEQWAI

SEQ ID NO: 2399223 - protein, 20 aa, Entamoeba dispar
LFIHHLLPEELVSINVDVLN

SEQ ID NO: 2399224 - protein, 26 aa, Entamoeba dispar
LFIICFFFLLYFFLNDMYFILFEILL

SEQ ID NO: 2399225 - protein, 20 aa, Entamoeba dispar
LFIIDILYAFYAFNLKLQLR

SEQ ID NO: 2399226 - protein, 20 aa, Entamoeba dispar
LFIIVFLTILSNKSCLGEKC

SEQ ID NO: 2399227 - protein, 18 aa, Entamoeba dispar
LFIMSLLNGNISLSVEQL

SEQ ID NO: 2399228 - protein, 19 aa, Entamoeba dispar
LFINLVSSQFLSIKSPIDE

SEQ ID NO: 2399229 - protein, 30 aa, Entamoeba dispar
LFIPFMTLPILIAFIPYIFIKTLCKWNVSL

SEQ ID NO: 2399230 - protein, 19 aa, Entamoeba dispar
LFIRVIQFIHLAMFLKKVF

SEQ ID NO: 2399231 - protein, 19 aa, Entamoeba dispar
LFISFCNGEFCKKVEENDI

SEQ ID NO: 2399232 - protein, 28 aa, Entamoeba dispar
LFITSLQILIICILKFRVNLKTEIALLL

SEQ ID NO: 2399233 - protein, 18 aa, Entamoeba dispar
LFIYSLTNAQITVNFDEI

SEQ ID NO: 2399234 - protein, 18 aa, Entamoeba dispar
LFKELLSYICADYCKIYC

SEQ ID NO: 2399235 - protein, 35 aa, Entamoeba dispar
LFKIAHVYSFAIALYNFIIPYFISNKNYSELALAH

SEQ ID NO: 2399236 - protein, 20 aa, Entamoeba dispar
LFLIGQIIIMLLFIVVAASS

SEQ ID NO: 2399237 - protein, 26 aa, Entamoeba dispar
LFLINKVFHFLDFILTVLKPFNSQSY

SEQ ID NO: 2399238 - protein, 22 aa, Entamoeba dispar
LFLKGFLFLLLFSSLKIPLSLP

SEQ ID NO: 2399239 - protein, 22 aa, Entamoeba dispar
LFLLFTVFSYAFCLQEAMIGVI

SEQ ID NO: 2399240 - protein, 20 aa, Entamoeba dispar
LFLLIMLIIGFIVFILLHYI

SEQ ID NO: 2399241 - protein, 23 aa, Entamoeba dispar
LFLSFTFILLPMKFAKLFTVGNV

SEQ ID NO: 2399242 - protein, 22 aa, Entamoeba dispar
LFLVYIAFFVLLESIHRLIHPS

SEQ ID NO: 2399243 - protein, 20 aa, Entamoeba dispar
LFMICYILGLLLISLSTFFL

SEQ ID NO: 2399244 - protein, 25 aa, Entamoeba dispar
LFNEKSIFYSIFQIFPKISIQETLK

SEQ ID NO: 2399245 - protein, 24 aa, Entamoeba dispar
LFNFASYFYWLVVPLKCVDMGGST

SEQ ID NO: 2399246 - protein, 18 aa, Entamoeba dispar
LFNFLKVYIIKKMTYLNK

SEQ ID NO: 2399247 - protein, 17 aa, Entamoeba dispar
LFNVCKLCKLLINDTEK

SEQ ID NO: 2399248 - protein, 25 aa, Entamoeba dispar
LFPLFLLFLICFYLFLYPLINMYFY

SEQ ID NO: 2399249 - protein, 19 aa, Entamoeba dispar
LFPMTTIYYRGISFTLPDS

SEQ ID NO: 2399250 - protein, 31 aa, Entamoeba dispar
LFPSDFRCAMDRWLRLRILGSKIPTQIIIQH

SEQ ID NO: 2399251 - protein, 26 aa, Entamoeba dispar
LFPSDFRYYLVPPCELRILGSKLPAQ

SEQ ID NO: 2399252 - protein, 19 aa, Entamoeba dispar
LFPVIPSVWNGYIKSLKLS

SEQ ID NO: 2399253 - protein, 32 aa, Entamoeba dispar
LFQEYNIFIKFIPFINAYLFPLTTDIETLNHF

SEQ ID NO: 2399254 - protein, 19 aa, Entamoeba dispar
LFSIIHILVTILSLPFNLF

SEQ ID NO: 2399255 - protein, 24 aa, Entamoeba dispar
LFSKKGLSFIYLLKYTPFSPNNTI

SEQ ID NO: 2399256 - protein, 18 aa, Entamoeba dispar
LFSMVLILLAARITALFY

SEQ ID NO: 2399257 - protein, 27 aa, Entamoeba dispar
LFSNLIEYLIFHKFTPLKKQIIPDIKI

SEQ ID NO: 2399258 - protein, 25 aa, Entamoeba dispar
LFSPNGWIVMIFSVPMGIVAGYELQ

SEQ ID NO: 2399259 - protein, 17 aa, Entamoeba dispar
LFSSICFGYYCLKEQKN

SEQ ID NO: 2399260 - protein, 20 aa, Entamoeba dispar
LFTLFVLSPFVIFCCVGVFD

SEQ ID NO: 2399261 - protein, 25 aa, Entamoeba dispar
LFTLHLPMMVLSLTIFLFLIHLPNL

SEQ ID NO: 2399262 - protein, 18 aa, Entamoeba dispar
LFTLIIATPISCDSYQSQ

SEQ ID NO: 2399263 - protein, 20 aa, Entamoeba dispar
LFTLIIATPISCDSYQSQSG

SEQ ID NO: 2399264 - protein, 19 aa, Entamoeba dispar
LFTSLFLSPSLFGLVVEII

SEQ ID NO: 2399265 - protein, 27 aa, Entamoeba dispar
LFVALYIVLFCLVLFKKFGTSLIPTLL

SEQ ID NO: 2399266 - protein, 22 aa, Entamoeba dispar
LFVHIVDRPLVPGRFKILNKHI

SEQ ID NO: 2399267 - protein, 20 aa, Entamoeba dispar
LFVINIAQLVAFFILGLFKA

SEQ ID NO: 2399268 - protein, 21 aa, Entamoeba dispar
LFYIPFLFLYCFFYCFFFSSI

SEQ ID NO: 2399269 - protein, 21 aa, Entamoeba dispar
LFYKSMALPKILGLSIHNNWG

SEQ ID NO: 2399270 - protein, 19 aa, Entamoeba dispar
LFYLCCSLNILFIVSNVCF

SEQ ID NO: 2399271 - protein, 18 aa, Entamoeba dispar
LFYNILNCFGYDVIGAGC

SEQ ID NO: 2399272 - protein, 26 aa, Entamoeba dispar
LFYSIIIICFFFYSLLSLLSFSSFII

SEQ ID NO: 2399273 - protein, 17 aa, Entamoeba dispar
LGAFIPFYEFKLFGIPV

SEQ ID NO: 2399274 - protein, 25 aa, Entamoeba dispar
LGALAWWYPKPWPESYWHIVSIIVI

SEQ ID NO: 2399275 - protein, 18 aa, Entamoeba dispar
LGCCLASVWTPFQKKSSC

SEQ ID NO: 2399276 - protein, 37 aa, Entamoeba dispar
LGCCLFIRVIPVEDLIILLSALVLQRKLLIKSKNRCI

SEQ ID NO: 2399277 - protein, 20 aa, Entamoeba dispar
LGCQLGCELCVSNKGCIECL

SEQ ID NO: 2399278 - protein, 19 aa, Entamoeba dispar
LGFIIAKICSLNFETTLRN

SEQ ID NO: 2399279 - protein, 23 aa, Entamoeba dispar
LGFIVVVMLVYINYIQKGINSSS

SEQ ID NO: 2399280 - protein, 26 aa, Entamoeba dispar
LGHYYCKELLFYQAQYYLKQKVYQKA

SEQ ID NO: 2399281 - protein, 24 aa, Entamoeba dispar
LGIDTLWCFFIGTSVFYSFTISIS

SEQ ID NO: 2399282 - protein, 27 aa, Entamoeba dispar
LGIGCGIIVFIILSIYYIISQITHKDV

SEQ ID NO: 2399283 - protein, 27 aa, Entamoeba dispar
LGIILPDTIYLLTLISLIICYKQRLSV

SEQ ID NO: 2399284 - protein, 17 aa, Entamoeba dispar
LGIIQYSYSNECTCTVS

SEQ ID NO: 2399285 - protein, 26 aa, Entamoeba dispar
LGIPRLYYHFFPLKAHIIQAPFTSVG

SEQ ID NO: 2399286 - protein, 26 aa, Entamoeba dispar
LGKNQFYYDYLSLLSIESFCLIILKR

SEQ ID NO: 2399287 - protein, 28 aa, Entamoeba dispar
LGKPCYLMYMQLIGYLLLIGMELHDKIY

SEQ ID NO: 2399288 - protein, 18 aa, Entamoeba dispar
LGLDMKKGKQYEARIGIS

SEQ ID NO: 2399289 - protein, 31 aa, Entamoeba dispar
LGLQKMLCIISYFFVMILYPEKNEKVHFIRK

SEQ ID NO: 2399290 - protein, 43 aa, Entamoeba dispar
LGLQTVLLHYNFLNQFKFYQQKLVFQCFLYQIFNDWIYQIYQL

SEQ ID NO: 2399291 - protein, 26 aa, Entamoeba dispar
LGLSRLYYFLNPNNVEYFFAPYLSMK

SEQ ID NO: 2399292 - protein, 27 aa, Entamoeba dispar
LGPDDAIFPIYRLPKDQIKKEYPSEKE

SEQ ID NO: 2399293 - protein, 23 aa, Entamoeba dispar
LGRLFFPLLFTKGSDFVITLLLI

SEQ ID NO: 2399294 - protein, 25 aa, Entamoeba dispar
LGRRIPIINIFLSPFVFASLVVMCD

SEQ ID NO: 2399295 - protein, 30 aa, Entamoeba dispar
LGSIPWIELLPLFFPLSFVYSILQKLFQKC

SEQ ID NO: 2399296 - protein, 18 aa, Entamoeba dispar
LGSLFFKRGNVLRKILSN

SEQ ID NO: 2399297 - protein, 35 aa, Entamoeba dispar
LGSSAGLLFIIGLFILLFFILLRYERTNIEIFKQQ

SEQ ID NO: 2399298 - protein, 23 aa, Entamoeba dispar
LGSSSGPFILSYGGKDKSFTVTS

SEQ ID NO: 2399299 - protein, 25 aa, Entamoeba dispar
LGSSWYFIMYLFCGTMPLFGSYLFA

SEQ ID NO: 2399300 - protein, 27 aa, Entamoeba dispar
LGTIIDILIFTLFISIGLPGGFAQTLS

SEQ ID NO: 2399301 - protein, 40 aa, Entamoeba dispar
LGTILFALLVFLLPTSIIYYLYFTFVLMLVQLFKKILSVL

SEQ ID NO: 2399302 - protein, 35 aa, Entamoeba dispar
LGTILFNCRLSIYLPLFLKQFIPIIEQIQLYIKQP

SEQ ID NO: 2399303 - protein, 37 aa, Entamoeba dispar
LGVTTAIIVVFLMIVTFLTWLFISRCWKNKYTESEIP

SEQ ID NO: 2399304 - protein, 21 aa, Entamoeba dispar
LGWGIFTLIAAGLWIGVVFVG

SEQ ID NO: 2399305 - protein, 24 aa, Entamoeba dispar
LHARNYLHYNIKPSNILLISTNIN

SEQ ID NO: 2399306 - protein, 18 aa, Entamoeba dispar
LHCFISNSFILLALIIAF

SEQ ID NO: 2399307 - protein, 18 aa, Entamoeba dispar
LHCTTKIFGLKIHVSCYF

SEQ ID NO: 2399308 - protein, 32 aa, Entamoeba dispar
LHCTTKIMGMKIPYTVWFSKHSKTLLKIASLL

SEQ ID NO: 2399309 - protein, 21 aa, Entamoeba dispar
LHDGFLDISLLHISQFPLTSQ

SEQ ID NO: 2399310 - protein, 33 aa, Entamoeba dispar
LHEKKWLNIFFNWIPEMMFMICSFGYLCFLIIL

SEQ ID NO: 2399311 - protein, 18 aa, Entamoeba dispar
LHFAARLPFSYYYFVSFL

SEQ ID NO: 2399312 - protein, 29 aa, Entamoeba dispar
LHFGTVLVLFFFSFLYCLTKKVSWQPIPS

SEQ ID NO: 2399313 - protein, 24 aa, Entamoeba dispar
LHHYGLKKWSMIGLILHVIVIIII

SEQ ID NO: 2399314 - protein, 19 aa, Entamoeba dispar
LHKAFFMMSGEFLTYRVRK

SEQ ID NO: 2399315 - protein, 29 aa, Entamoeba dispar
LHKIFHHETLRLLQYPVINAILAGHNALV

SEQ ID NO: 2399316 - protein, 19 aa, Entamoeba dispar
LHLLLFCGCFILKIAIYFV

SEQ ID NO: 2399317 - protein, 28 aa, Entamoeba dispar
LHLPISQLHPIQFIPKVYSIKIKMPDYP

SEQ ID NO: 2399318 - protein, 29 aa, Entamoeba dispar
LHLTNPTKTIPYFISVTPNKLPLVGDSFY

SEQ ID NO: 2399319 - protein, 27 aa, Entamoeba dispar
LHNDGTLLWYKFLPVNWELNQLDLTTF

SEQ ID NO: 2399320 - protein, 19 aa, Entamoeba dispar
LHQFVYFYEINVPTISPMT

SEQ ID NO: 2399321 - protein, 26 aa, Entamoeba dispar
LHQNKPILMIQLNLKPFIISKCKVHS

SEQ ID NO: 2399322 - protein, 29 aa, Entamoeba dispar
LHRDIKPDNLLIFSLDKNVPVFAKITDFG

SEQ ID NO: 2399323 - protein, 25 aa, Entamoeba dispar
LHRSHTFILPSPPQQTIWDVETPLN

SEQ ID NO: 2399324 - protein, 20 aa, Entamoeba dispar
LHWRPSLHKLGKITSLLFSV

SEQ ID NO: 2399325 - protein, 20 aa, Entamoeba dispar
LIACIYLVFSNKFLLPSHVK

SEQ ID NO: 2399326 - protein, 27 aa, Entamoeba dispar
LIAGVFYYHFWLLCILFCIARTSFELV

SEQ ID NO: 2399327 - protein, 18 aa, Entamoeba dispar
LIASFQKFKLITTSGKPT

SEQ ID NO: 2399328 - protein, 30 aa, Entamoeba dispar
LIDKDLIGIRFFYYIHLISSGFSKQQELLW

SEQ ID NO: 2399329 - protein, 24 aa, Entamoeba dispar
LIDKMKVLYKNYVDVAYALNPAYK

SEQ ID NO: 2399330 - protein, 25 aa, Entamoeba dispar
LIEEKKYFDIFHFKPIGFIGQIEIF

SEQ ID NO: 2399331 - protein, 26 aa, Entamoeba dispar
LIEIILIFITCILWIFVIINNSEVKE

SEQ ID NO: 2399332 - protein, 17 aa, Entamoeba dispar
LIEPNDNLPTEPLFGVF

SEQ ID NO: 2399333 - protein, 22 aa, Entamoeba dispar
LIFCFAGWYYLVHHQRVSDLEL

SEQ ID NO: 2399334 - protein, 29 aa, Entamoeba dispar
LIFDIAHAAIMFYSFYSFQINCDNYDFAK

SEQ ID NO: 2399335 - protein, 32 aa, Entamoeba dispar
LIFDSDIYIRTLILFLPLLIVFNKERIDKNVR

SEQ ID NO: 2399336 - protein, 19 aa, Entamoeba dispar
LIFISNALIPLSTCFEGTS

SEQ ID NO: 2399337 - protein, 26 aa, Entamoeba dispar
LIFPEKFFVLYISVAIWPFCTAFYWP

SEQ ID NO: 2399338 - protein, 25 aa, Entamoeba dispar
LIFSFIITLFLLQVLIYTPKVSLDV

SEQ ID NO: 2399339 - protein, 23 aa, Entamoeba dispar
LIGLLRGILRRRKDLKVVVMSAT

SEQ ID NO: 2399340 - protein, 19 aa, Entamoeba dispar
LIGMYAYLDILQSPLKEDQ

SEQ ID NO: 2399341 - protein, 21 aa, Entamoeba dispar
LIGSLFIAVFCGVTSLLTGNT

SEQ ID NO: 2399342 - protein, 52 aa, Entamoeba dispar
LIGSLLQVFLCVYSAIMVILWGARKWLDVSFSSFFIVSFILCCIACFGVFIF

SEQ ID NO: 2399343 - protein, 29 aa, Entamoeba dispar
LIGTNHIWPLTFVSVPPLEALKPIIVMFV

SEQ ID NO: 2399344 - protein, 26 aa, Entamoeba dispar
LIHFFLGVFLCFFALKTNSLLVLSFL

SEQ ID NO: 2399345 - protein, 17 aa, Entamoeba dispar
LIHNFRLECPIKEKFHC

SEQ ID NO: 2399346 - protein, 18 aa, Entamoeba dispar
LIHYVIAEKYDCIPLGSS

SEQ ID NO: 2399347 - protein, 21 aa, Entamoeba dispar
LIIFFYFSLSYSFTQNFKFMS

SEQ ID NO: 2399348 - protein, 27 aa, Entamoeba dispar
LIIGGNFRHFLNAVLVILGCLLCIPYI

SEQ ID NO: 2399349 - protein, 26 aa, Entamoeba dispar
LIIGGNFRHFLNGGLVILGCLLCIPY

SEQ ID NO: 2399350 - protein, 27 aa, Entamoeba dispar
LIIIFTIVVIIILGYSIFICFKVKHPT

SEQ ID NO: 2399351 - protein, 24 aa, Entamoeba dispar
LIIIIIIIIIIIIMINYIIKRKEK

SEQ ID NO: 2399352 - protein, 19 aa, Entamoeba dispar
LIIIILSFNIEISSLFATL

SEQ ID NO: 2399353 - protein, 23 aa, Entamoeba dispar
LIIMGSLIYGMILGAITGFYQMA

SEQ ID NO: 2399354 - protein, 23 aa, Entamoeba dispar
LIIMIPFCVFIYRFEWTLDNNQV

SEQ ID NO: 2399355 - protein, 30 aa, Entamoeba dispar
LIINVIILPIYILYRPLYQWIFQRVTEVYM

SEQ ID NO: 2399356 - protein, 24 aa, Entamoeba dispar
LIIPSFLYILWQIIYLIITEGFKK

SEQ ID NO: 2399357 - protein, 17 aa, Entamoeba dispar
LIISDLVPQLFMENFFK

SEQ ID NO: 2399358 - protein, 18 aa, Entamoeba dispar
LIISINDLIYYFILICCI

SEQ ID NO: 2399359 - protein, 29 aa, Entamoeba dispar
LIISLIFICIGIYLFFKIKTLQPTQPLQH

SEQ ID NO: 2399360 - protein, 28 aa, Entamoeba dispar
LIIVSCIAENFIRFPYPGLPSTDIDGKK

SEQ ID NO: 2399361 - protein, 19 aa, Entamoeba dispar
LIIWKSDYIHLYKDKEFIN

SEQ ID NO: 2399362 - protein, 17 aa, Entamoeba dispar
LIIYDSEKKSFLNQEIW

SEQ ID NO: 2399363 - protein, 26 aa, Entamoeba dispar
LIKDFLVIFFLIIVTRTSFFWGRVYK

SEQ ID NO: 2399364 - protein, 20 aa, Entamoeba dispar
LIKELMQLYSLLPLTQSSQL

SEQ ID NO: 2399365 - protein, 18 aa, Entamoeba dispar
LIKGFWFRIKGAEQTIVI

SEQ ID NO: 2399366 - protein, 27 aa, Entamoeba dispar
LIKIKVPYHYIFLNFGDWVMTNYIFIA

SEQ ID NO: 2399367 - protein, 25 aa, Entamoeba dispar
LIKQDDLFHYYFYDPSVITILKQEV

SEQ ID NO: 2399368 - protein, 23 aa, Entamoeba dispar
LILCFVGWYFLIKNQSISSLELL

SEQ ID NO: 2399369 - protein, 18 aa, Entamoeba dispar
LILFANSKSLLGIETKDV

SEQ ID NO: 2399370 - protein, 20 aa, Entamoeba dispar
LILFLQYYIHQHHDPFFLDF

SEQ ID NO: 2399371 - protein, 18 aa, Entamoeba dispar
LILFPPEILPYIPSNVII

SEQ ID NO: 2399372 - protein, 18 aa, Entamoeba dispar
LILISFYSLLFSSLFIHN

SEQ ID NO: 2399373 - protein, 19 aa, Entamoeba dispar
LILLIRITAEEVSKKEYDN

SEQ ID NO: 2399374 - protein, 34 aa, Entamoeba dispar
LILRIFNMLFLYKIPIKIRLLFSTIFNLIGLFGI

SEQ ID NO: 2399375 - protein, 20 aa, Entamoeba dispar
LILTFYLWIEAVYNNSPILS

SEQ ID NO: 2399376 - protein, 23 aa, Entamoeba dispar
LILTLFVLWNFKVGQPALLYLVP

SEQ ID NO: 2399377 - protein, 17 aa, Entamoeba dispar
LIMEPRIFTRLMTQNNK

SEQ ID NO: 2399378 - protein, 17 aa, Entamoeba dispar
LIMKKLDMPIQKNTMRY

SEQ ID NO: 2399379 - protein, 25 aa, Entamoeba dispar
LINKQKPLEYLRTLSNKLISLKNAN

SEQ ID NO: 2399380 - protein, 19 aa, Entamoeba dispar
LINLFEQLAIFIRKSVQSK

SEQ ID NO: 2399381 - protein, 18 aa, Entamoeba dispar
LINLHLPLISKDISFNRT

SEQ ID NO: 2399382 - protein, 18 aa, Entamoeba dispar
LINPICIILYAWASWSFF

SEQ ID NO: 2399383 - protein, 21 aa, Entamoeba dispar
LINTFLFLRVIYCKCSFVMTR

SEQ ID NO: 2399384 - protein, 17 aa, Entamoeba dispar
LINYINADGYDCIPKGY

SEQ ID NO: 2399385 - protein, 18 aa, Entamoeba dispar
LIPFDNLPRHLLVAFLYD

SEQ ID NO: 2399386 - protein, 19 aa, Entamoeba dispar
LIPIILDVCGFYKIIQFSF

SEQ ID NO: 2399387 - protein, 20 aa, Entamoeba dispar
LIPILYLMLLIPLVTARFLV

SEQ ID NO: 2399388 - protein, 23 aa, Entamoeba dispar
LIPTLLMFFAISKLLGFTLSIEY

SEQ ID NO: 2399389 - protein, 17 aa, Entamoeba dispar
LIQFFQKNRNIILKINK

SEQ ID NO: 2399390 - protein, 20 aa, Entamoeba dispar
LIRYTALFISIIIPFVLGSI

SEQ ID NO: 2399391 - protein, 21 aa, Entamoeba dispar
LISCLELFLEWVRGTKYISNF

SEQ ID NO: 2399392 - protein, 20 aa, Entamoeba dispar
LISFFYFTMFIVHTFIEGGP

SEQ ID NO: 2399393 - protein, 20 aa, Entamoeba dispar
LISFLLILISFYSLLFSSLF

SEQ ID NO: 2399394 - protein, 18 aa, Entamoeba dispar
LISFVMSESIIITTLKSS

SEQ ID NO: 2399395 - protein, 31 aa, Entamoeba dispar
LISIHQIMRFLLMISYVYPSLVFTDGPFFPW

SEQ ID NO: 2399396 - protein, 19 aa, Entamoeba dispar
LISKVIGLVFVLGGGMWAG

SEQ ID NO: 2399397 - protein, 20 aa, Entamoeba dispar
LISLIISIGMPWLVFEVLYP

SEQ ID NO: 2399398 - protein, 22 aa, Entamoeba dispar
LISNDFFILWKLVDVSHSSNFE

SEQ ID NO: 2399399 - protein, 25 aa, Entamoeba dispar
LISNTFCIGLLHKELKGYLWVLVIG

SEQ ID NO: 2399400 - protein, 22 aa, Entamoeba dispar
LISSPFFEGIFFEAINSIQFNC

SEQ ID NO: 2399401 - protein, 19 aa, Entamoeba dispar
LISVIIGSIILLFAIVIIS

SEQ ID NO: 2399402 - protein, 19 aa, Entamoeba dispar
LISWVRIFSQLQTENYQWS

SEQ ID NO: 2399403 - protein, 17 aa, Entamoeba dispar
LISYLWNGMISLIIIYF

SEQ ID NO: 2399404 - protein, 22 aa, Entamoeba dispar
LITKLRKIPIKIEVWKLILERR

SEQ ID NO: 2399405 - protein, 30 aa, Entamoeba dispar
LITLHLIAFLVFLCLYISFPLTITETPRNL

SEQ ID NO: 2399406 - protein, 25 aa, Entamoeba dispar
LITRGVFCFIRKSGNIYALLNNEEI

SEQ ID NO: 2399407 - protein, 26 aa, Entamoeba dispar
LIVAQQLIFFDYSMFKVIQPIQFYHY

SEQ ID NO: 2399408 - protein, 27 aa, Entamoeba dispar
LIVGFSFFLLLVVGIVFIYLIGGSLNS

SEQ ID NO: 2399409 - protein, 25 aa, Entamoeba dispar
LIVMLILLLPILLLCHADSDAQKYT

SEQ ID NO: 2399410 - protein, 19 aa, Entamoeba dispar
LIVPKSFTSGILKLYDFVG

SEQ ID NO: 2399411 - protein, 25 aa, Entamoeba dispar
LIVSPTLNIIPWELLEPFKNCVRYF

SEQ ID NO: 2399412 - protein, 35 aa, Entamoeba dispar
LIVTSWSCAIGEYFFYFSCYGCPNGYFCPGDDYDY

SEQ ID NO: 2399413 - protein, 19 aa, Entamoeba dispar
LIWRGLYFINTYSYFRIFI

SEQ ID NO: 2399414 - protein, 21 aa, Entamoeba dispar
LIWYCVAIPSIKLIEKFPYEE

SEQ ID NO: 2399415 - protein, 22 aa, Entamoeba dispar
LIYASFFTLLFLIPFLICGPRL

SEQ ID NO: 2399416 - protein, 17 aa, Entamoeba dispar
LIYFVIAGYKSSINNQQ

SEQ ID NO: 2399417 - protein, 21 aa, Entamoeba dispar
LIYLCYSFKCSPGCIGGCEAD

SEQ ID NO: 2399418 - protein, 18 aa, Entamoeba dispar
LKAFGISLFFLSALGIRM

SEQ ID NO: 2399419 - protein, 24 aa, Entamoeba dispar
LKALQMLWVNMIMDTLAALALGTE

SEQ ID NO: 2399420 - protein, 26 aa, Entamoeba dispar
LKEFIIILFIIILSRTSYFWGEKYKK

SEQ ID NO: 2399421 - protein, 22 aa, Entamoeba dispar
LKEGVLYYIRATCIISDCAVTL

SEQ ID NO: 2399422 - protein, 36 aa, Entamoeba dispar
LKELSILYPLIFFPTHLKMVFKYIFSLEITSELELP

SEQ ID NO: 2399423 - protein, 21 aa, Entamoeba dispar
LKEYENSPLMPKFKELNEKLG

SEQ ID NO: 2399424 - protein, 26 aa, Entamoeba dispar
LKFIIYSILFYIQYTNAFVESINTPC

SEQ ID NO: 2399425 - protein, 21 aa, Entamoeba dispar
LKGIYLPKSLILMKTQWDNKI

SEQ ID NO: 2399426 - protein, 25 aa, Entamoeba dispar
LKHGLPYFCFTLMSFINILLVPNTF

SEQ ID NO: 2399427 - protein, 19 aa, Entamoeba dispar
LKHHIEYTLNKQLDGKGNV

SEQ ID NO: 2399428 - protein, 31 aa, Entamoeba dispar
LKHQNMFFIRFLFMLLLTFHCSFTVFLGSRR

SEQ ID NO: 2399429 - protein, 17 aa, Entamoeba dispar
LKHYLEAYVFKDILKNP

SEQ ID NO: 2399430 - protein, 22 aa, Entamoeba dispar
LKKIKAYFHITNFGKRLLKNQG

SEQ ID NO: 2399431 - protein, 18 aa, Entamoeba dispar
LKKIKLTYEQKLKFMIDC

SEQ ID NO: 2399432 - protein, 19 aa, Entamoeba dispar
LKKKYVFQLFVGNKSLNIC

SEQ ID NO: 2399433 - protein, 17 aa, Entamoeba dispar
LKKPKLYFRGCILAIIG

SEQ ID NO: 2399434 - protein, 22 aa, Entamoeba dispar
LKKQFIFCTEPFRIPFAGIVDI

SEQ ID NO: 2399435 - protein, 30 aa, Entamoeba dispar
LKKSKNMYFLYSILLFIATFCFCFMLSFWF

SEQ ID NO: 2399436 - protein, 23 aa, Entamoeba dispar
LKLHAQLLVFTPTCGISLESILE

SEQ ID NO: 2399437 - protein, 26 aa, Entamoeba dispar
LKLLNNPDLCLVSCAVMILLVIVEKD

SEQ ID NO: 2399438 - protein, 20 aa, Entamoeba dispar
LKNIIFFFPNLIVDWTIPIF

SEQ ID NO: 2399439 - protein, 26 aa, Entamoeba dispar
LKNKTYIYLGYIMQLGLFGASCVITN

SEQ ID NO: 2399440 - protein, 28 aa, Entamoeba dispar
LKNNNIPLLRKTLQLIPPYLVQRPQIEG

SEQ ID NO: 2399441 - protein, 36 aa, Entamoeba dispar
LKPIIVMFVGFYHKKYIKRMLRFLHKSSIYNIQFNG

SEQ ID NO: 2399442 - protein, 22 aa, Entamoeba dispar
LKSHKLQFVGPLLNLLVKHYSG

SEQ ID NO: 2399443 - protein, 24 aa, Entamoeba dispar
LKSKSAIILQPLLSIILMTPEDFV

SEQ ID NO: 2399444 - protein, 21 aa, Entamoeba dispar
LKTRDIFGEESLYTVLSLVGE

SEQ ID NO: 2399445 - protein, 33 aa, Entamoeba dispar
LKTRWYVVLSSFIGWYLAFLSPLLMPLDIVSTF

SEQ ID NO: 2399446 - protein, 22 aa, Entamoeba dispar
LKTSTLRTYLEKEVPIRCSMLM

SEQ ID NO: 2399447 - protein, 29 aa, Entamoeba dispar
LKYINIAIIIIGIFLLFHGITNALFSKHP

SEQ ID NO: 2399448 - protein, 19 aa, Entamoeba dispar
LKYIRVLVACLPQFNQNDL

SEQ ID NO: 2399449 - protein, 38 aa, Entamoeba dispar
LLAIGILINIILILPLVLFIWRFVIRRIIHPNPIQKYH

SEQ ID NO: 2399450 - protein, 25 aa, Entamoeba dispar
LLALHIYWFYLIIQMLIHLISGKGA

SEQ ID NO: 2399451 - protein, 17 aa, Entamoeba dispar
LLALNKMNIIKSPEFLL

SEQ ID NO: 2399452 - protein, 18 aa, Entamoeba dispar
LLALQIDNLFYKLDNENN

SEQ ID NO: 2399453 - protein, 55 aa, Entamoeba dispar
LLAMKHHRPFYLFTSYIVFVLYCWYYSYSLIIILLPLFIYLISFIIETDDYPHTY

SEQ ID NO: 2399454 - protein, 17 aa, Entamoeba dispar
LLAMVYLPQIFFYLLFY

SEQ ID NO: 2399455 - protein, 18 aa, Entamoeba dispar
LLAMVYLPQIFFYLLFYP

SEQ ID NO: 2399456 - protein, 17 aa, Entamoeba dispar
LLAPIFRELQCLVNVIL

SEQ ID NO: 2399457 - protein, 25 aa, Entamoeba dispar
LLASKQLIYPFFGSPLFLSNVCSLH

SEQ ID NO: 2399458 - protein, 20 aa, Entamoeba dispar
LLAVFATKFTVLGEEYLASA

SEQ ID NO: 2399459 - protein, 18 aa, Entamoeba dispar
LLCKMKLVILQNRYVPWI

SEQ ID NO: 2399460 - protein, 18 aa, Entamoeba dispar
LLDDILSVSFQKIIKDNQ

SEQ ID NO: 2399461 - protein, 19 aa, Entamoeba dispar
LLDIFFNFNHNCTIFRQVA

SEQ ID NO: 2399462 - protein, 20 aa, Entamoeba dispar
LLDIIKNFFGFQFKEEVKKK

SEQ ID NO: 2399463 - protein, 25 aa, Entamoeba dispar
LLDIMCNMFQKHIFYKGFSLTTFLK

SEQ ID NO: 2399464 - protein, 18 aa, Entamoeba dispar
LLFEDFSTEAIFKGDGYL

SEQ ID NO: 2399465 - protein, 24 aa, Entamoeba dispar
LLFFYFFIYLLFRIIYFSLLSLLL

SEQ ID NO: 2399466 - protein, 21 aa, Entamoeba dispar
LLFGTLAIIIALNGNFPFIWG

SEQ ID NO: 2399467 - protein, 18 aa, Entamoeba dispar
LLFIICLVWFMFRMTHYH

SEQ ID NO: 2399468 - protein, 37 aa, Entamoeba dispar
LLFKRRGIAVIPNYVFWLSLPMLIKDGCKFIFCCKKP

SEQ ID NO: 2399469 - protein, 19 aa, Entamoeba dispar
LLFLFHVLLLFLFSLISFY

SEQ ID NO: 2399470 - protein, 27 aa, Entamoeba dispar
LLFLIFLFFIYFLLFLSLYSFFTLITL

SEQ ID NO: 2399471 - protein, 24 aa, Entamoeba dispar
LLFNFSAYFLWTVIPLKANDLGAS

SEQ ID NO: 2399472 - protein, 19 aa, Entamoeba dispar
LLFYTLYVPTIDSIVIIFI

SEQ ID NO: 2399473 - protein, 19 aa, Entamoeba dispar
LLGIFTRMALFTTAVSLIF

SEQ ID NO: 2399474 - protein, 20 aa, Entamoeba dispar
LLGIILCVYSLIPKPTMGIV

SEQ ID NO: 2399475 - protein, 28 aa, Entamoeba dispar
LLGLVMCLCFMMIGISYIKNIFKRAFFH

SEQ ID NO: 2399476 - protein, 19 aa, Entamoeba dispar
LLGNWFVITAPENKTLLVF

SEQ ID NO: 2399477 - protein, 29 aa, Entamoeba dispar
LLGSILIYGYPLVLNIILITLQLCDHPPL

SEQ ID NO: 2399478 - protein, 25 aa, Entamoeba dispar
LLHSKNYLHYNIKPANVLLISDDLN

SEQ ID NO: 2399479 - protein, 20 aa, Entamoeba dispar
LLICVTLVFIIFHRNQIKAK

SEQ ID NO: 2399480 - protein, 18 aa, Entamoeba dispar
LLIFTHFTYNLFPMTFFG

SEQ ID NO: 2399481 - protein, 17 aa, Entamoeba dispar
LLIGILIFSICLLLHCF

SEQ ID NO: 2399482 - protein, 26 aa, Entamoeba dispar
LLIGTVIFLVFFFNGLLQIELIPLAP

SEQ ID NO: 2399483 - protein, 40 aa, Entamoeba dispar
LLIICIPGIIVYEIVLVIILIIFLIQYHLLNDKIIFEQKE

SEQ ID NO: 2399484 - protein, 22 aa, Entamoeba dispar
LLIIFMLFMPEMFVTAFMSFVL

SEQ ID NO: 2399485 - protein, 19 aa, Entamoeba dispar
LLIIGIIGSIGVGCLNPLI

SEQ ID NO: 2399486 - protein, 17 aa, Entamoeba dispar
LLILACDGVWDVLTNEE

SEQ ID NO: 2399487 - protein, 18 aa, Entamoeba dispar
LLILIPESNCLQIDSPCI

SEQ ID NO: 2399488 - protein, 17 aa, Entamoeba dispar
LLIVFNKERIDKNVRRL

SEQ ID NO: 2399489 - protein, 19 aa, Entamoeba dispar
LLKQAWEPLLSIVLNIEII

SEQ ID NO: 2399490 - protein, 24 aa, Entamoeba dispar
LLKQKSIIMNIKKLKIKMIVHATS

SEQ ID NO: 2399491 - protein, 22 aa, Entamoeba dispar
LLKTFSTFHYNSIVCLTICEEN

SEQ ID NO: 2399492 - protein, 17 aa, Entamoeba dispar
LLLCCLADKLNEFSADI

SEQ ID NO: 2399493 - protein, 18 aa, Entamoeba dispar
LLLEKVHFDIKITTLKKL

SEQ ID NO: 2399494 - protein, 19 aa, Entamoeba dispar
LLLFDIILLYRKLILGWYS

SEQ ID NO: 2399495 - protein, 20 aa, Entamoeba dispar
LLLIFITLIFSSNSYECSVG

SEQ ID NO: 2399496 - protein, 18 aa, Entamoeba dispar
LLLINYALAATCTASEEN

SEQ ID NO: 2399497 - protein, 29 aa, Entamoeba dispar
LLLLFILFSMGQYIGLFPSNHECSMNESC

SEQ ID NO: 2399498 - protein, 21 aa, Entamoeba dispar
LLLLMDGLQWFACGLVSFLTC

SEQ ID NO: 2399499 - protein, 19 aa, Entamoeba dispar
LLLMIFERIKFDELFFECI

SEQ ID NO: 2399500 - protein, 27 aa, Entamoeba dispar
LLLSCLLHPFYFITFALDNPITLHIDH

SEQ ID NO: 2399501 - protein, 35 aa, Entamoeba dispar
LLLSSLKCFLNWRLVLLFPLALLFGFSRSFYYTSM

SEQ ID NO: 2399502 - protein, 20 aa, Entamoeba dispar
LLLVCRMFFYILPPTTSSEK

SEQ ID NO: 2399503 - protein, 21 aa, Entamoeba dispar
LLLVLHIGVVILPFIGIIYGE

SEQ ID NO: 2399504 - protein, 19 aa, Entamoeba dispar
LLNEKIPITLRYGQLGNIL

SEQ ID NO: 2399505 - protein, 24 aa, Entamoeba dispar
LLNHFIPIPLIFNSILKFFGVRDH

SEQ ID NO: 2399506 - protein, 19 aa, Entamoeba dispar
LLNNYAMIVGGALIGSSGA

SEQ ID NO: 2399507 - protein, 21 aa, Entamoeba dispar
LLNRPYSLPIDVYAFAIVSYE

SEQ ID NO: 2399508 - protein, 18 aa, Entamoeba dispar
LLPITIHLPTDKKMLLLG

SEQ ID NO: 2399509 - protein, 32 aa, Entamoeba dispar
LLPVTVYLEAPLQRFFKYPKIFGNLLSSVDPK

SEQ ID NO: 2399510 - protein, 19 aa, Entamoeba dispar
LLQICSCPIFVYIKKPDLF

SEQ ID NO: 2399511 - protein, 18 aa, Entamoeba dispar
LLQIGMTRLILNTKSKLP

SEQ ID NO: 2399512 - protein, 19 aa, Entamoeba dispar
LLQPNLFIEFINYTKDKNP

SEQ ID NO: 2399513 - protein, 23 aa, Entamoeba dispar
LLQVVLVFWILMSEFFSFTQVMN

SEQ ID NO: 2399514 - protein, 18 aa, Entamoeba dispar
LLRLLKISITSVSIACQC

SEQ ID NO: 2399515 - protein, 20 aa, Entamoeba dispar
LLRLLKISITSVSIACQCHI

SEQ ID NO: 2399516 - protein, 24 aa, Entamoeba dispar
LLRTFAICLIPFYEVYHGCSCWCN

SEQ ID NO: 2399517 - protein, 17 aa, Entamoeba dispar
LLSFLTYHTFSHRFSTI

SEQ ID NO: 2399518 - protein, 17 aa, Entamoeba dispar
LLSIESFCLIILKRSII

SEQ ID NO: 2399519 - protein, 17 aa, Entamoeba dispar
LLSKQMLIKIAIQVIYQ

SEQ ID NO: 2399520 - protein, 27 aa, Entamoeba dispar
LLSLPTLLLLFLFPFDFNISAIELILL

SEQ ID NO: 2399521 - protein, 23 aa, Entamoeba dispar
LLSLYFFFLFLLLLVCHFHYMIV

SEQ ID NO: 2399522 - protein, 26 aa, Entamoeba dispar
LLSLYLLIPFLFVTIVLFYYNKFPSK

SEQ ID NO: 2399523 - protein, 18 aa, Entamoeba dispar
LLSMSLSSTMEYLRTIPF

SEQ ID NO: 2399524 - protein, 23 aa, Entamoeba dispar
LLSQLYTFIIKNPIEKYHLLAPL

SEQ ID NO: 2399525 - protein, 19 aa, Entamoeba dispar
LLSVFNWPIDWISFAFLLF

SEQ ID NO: 2399526 - protein, 19 aa, Entamoeba dispar
LLSYVSPKQFFLTSFVMFN

SEQ ID NO: 2399527 - protein, 21 aa, Entamoeba dispar
LLTTLIISGGILITITGGAYL

SEQ ID NO: 2399528 - protein, 22 aa, Entamoeba dispar
LLTVLLKPFQRYRYYEPKLIIL

SEQ ID NO: 2399529 - protein, 18 aa, Entamoeba dispar
LLVGMLCSLLILHIYWFK

SEQ ID NO: 2399530 - protein, 18 aa, Entamoeba dispar
LLVGVVIGFLIFNKAKKK

SEQ ID NO: 2399531 - protein, 20 aa, Entamoeba dispar
LLVLIVIFTVKFFDGMIYIK

SEQ ID NO: 2399532 - protein, 32 aa, Entamoeba dispar
LLVNDVKIFYCKYNDPLYIKIEKLEIIVALAN

SEQ ID NO: 2399533 - protein, 25 aa, Entamoeba dispar
LLVPSFVHLFGELNWWPIKYKIDTT

SEQ ID NO: 2399534 - protein, 26 aa, Entamoeba dispar
LLVRTICYTYFLYSLIIDELGDIIHN

SEQ ID NO: 2399535 - protein, 17 aa, Entamoeba dispar
LLVVDQMEKEMDTFTIW

SEQ ID NO: 2399536 - protein, 20 aa, Entamoeba dispar
LLYKYIPSVDLLKKTLATIL

SEQ ID NO: 2399537 - protein, 26 aa, Entamoeba dispar
LLYNYAAFLFWLVVPLVATKQDASNW

SEQ ID NO: 2399538 - protein, 19 aa, Entamoeba dispar
LLYQLFLQVPFKFQSLLNS

SEQ ID NO: 2399539 - protein, 23 aa, Entamoeba dispar
LLYTFHGKENPKYKLIFSPTTGA

SEQ ID NO: 2399540 - protein, 28 aa, Entamoeba dispar
LLYTHMPFTRILPLFQLRVAQPPTTVRD

SEQ ID NO: 2399541 - protein, 18 aa, Entamoeba dispar
LMAGLLSQPIMQLNKLPG

SEQ ID NO: 2399542 - protein, 18 aa, Entamoeba dispar
LMAIILWTNSFVFHDLTK

SEQ ID NO: 2399543 - protein, 40 aa, Entamoeba dispar
LMARVIYLRDFIIKTAKKFYQMMYWIIGIPAVAVEYNPIT

SEQ ID NO: 2399544 - protein, 19 aa, Entamoeba dispar
LMDCIWRFLETPFKFRMEK

SEQ ID NO: 2399545 - protein, 18 aa, Entamoeba dispar
LMELKKTYFSIEDYPIFL

SEQ ID NO: 2399546 - protein, 24 aa, Entamoeba dispar
LMESWRRSIIFSEKLKQITKRQTN

SEQ ID NO: 2399547 - protein, 27 aa, Entamoeba dispar
LMFINDNLWILWIMGIMYAFSYVLFWI

SEQ ID NO: 2399548 - protein, 20 aa, Entamoeba dispar
LMFITTLTILIIFSILQAFS

SEQ ID NO: 2399549 - protein, 19 aa, Entamoeba dispar
LMIFRRKFNQLLKYDKNIF

SEQ ID NO: 2399550 - protein, 28 aa, Entamoeba dispar
LMITLMSLLILPLTFFKNLSALKFTSII

SEQ ID NO: 2399551 - protein, 29 aa, Entamoeba dispar
LMIYNSILLFSWLYNYFVFALDDIGRVII

SEQ ID NO: 2399552 - protein, 28 aa, Entamoeba dispar
LMKEEPTLFYLLEYFKSDGLLKQMYGVN

SEQ ID NO: 2399553 - protein, 31 aa, Entamoeba dispar
LMKKIKQWWVLLIILIIFSSFTPLGAIIGKF

SEQ ID NO: 2399554 - protein, 18 aa, Entamoeba dispar
LMKVLFNLALPCVIFRNL

SEQ ID NO: 2399555 - protein, 25 aa, Entamoeba dispar
LMLFDARWLLLGMGLMAIYCGIVFN

SEQ ID NO: 2399556 - protein, 20 aa, Entamoeba dispar
LMLFSSITLFFGMTPMIEQQ

SEQ ID NO: 2399557 - protein, 17 aa, Entamoeba dispar
LMLHKVIVYFTVNDTFH

SEQ ID NO: 2399558 - protein, 27 aa, Entamoeba dispar
LMLKYITIEQFIYTLLIMFNVIESTNE

SEQ ID NO: 2399559 - protein, 23 aa, Entamoeba dispar
LMLNQFAFILMFSVLLDTFIIRS

SEQ ID NO: 2399560 - protein, 17 aa, Entamoeba dispar
LMMSLSCIFIIPVAFSS

SEQ ID NO: 2399561 - protein, 24 aa, Entamoeba dispar
LMNRSFIVYIVLSIIALLPFITTC

SEQ ID NO: 2399562 - protein, 21 aa, Entamoeba dispar
LMNVILYLPTINELINFLQVS

SEQ ID NO: 2399563 - protein, 25 aa, Entamoeba dispar
LMSLTTIWTYKRSLFLIGQIIIMLL

SEQ ID NO: 2399564 - protein, 24 aa, Entamoeba dispar
LMSSFNSIFYYQLNNPPTCSSINL

SEQ ID NO: 2399565 - protein, 18 aa, Entamoeba dispar
LMTTFWQYRTPPVNSIHE

SEQ ID NO: 2399566 - protein, 18 aa, Entamoeba dispar
LMWLSQQLDPFIKTNSEE

SEQ ID NO: 2399567 - protein, 20 aa, Entamoeba dispar
LNDIVFTSLRYSHQKKYLFL

SEQ ID NO: 2399568 - protein, 17 aa, Entamoeba dispar
LNDKNFILLKRSMLIFN

SEQ ID NO: 2399569 - protein, 20 aa, Entamoeba dispar
LNDLLLLKTYLLQNPNHYSS

SEQ ID NO: 2399570 - protein, 32 aa, Entamoeba dispar
LNEKTINFLVKSNDFMLVMGPSTQINSNTLEV

SEQ ID NO: 2399571 - protein, 18 aa, Entamoeba dispar
LNEKVPITLRYGQLGNIL

SEQ ID NO: 2399572 - protein, 30 aa, Entamoeba dispar
LNENNEITLFYYFLPFTINIDNDKKMYLTP

SEQ ID NO: 2399573 - protein, 22 aa, Entamoeba dispar
LNESFIIQPIKMTKSIAFCMFE

SEQ ID NO: 2399574 - protein, 30 aa, Entamoeba dispar
LNFDYISMTTLTCLFLDFIILAQSNQITTF

SEQ ID NO: 2399575 - protein, 17 aa, Entamoeba dispar
LNFFFKNIPEMTVESIR

SEQ ID NO: 2399576 - protein, 25 aa, Entamoeba dispar
LNFKFTTILYFPKTLTSLMIDNCGA

SEQ ID NO: 2399577 - protein, 26 aa, Entamoeba dispar
LNFVELLYFYLCQYFSFILNIIILAY

SEQ ID NO: 2399578 - protein, 25 aa, Entamoeba dispar
LNFYFSLRLLFVFALVFEISFIYTI

SEQ ID NO: 2399579 - protein, 33 aa, Entamoeba dispar
LNFYNAPLIPFWRSIFYMIFRVPFKVMFHCAYL

SEQ ID NO: 2399580 - protein, 18 aa, Entamoeba dispar
LNIIPLLMMGSISVGGFG

SEQ ID NO: 2399581 - protein, 21 aa, Entamoeba dispar
LNIIVQIFIGAICLALIYLRN

SEQ ID NO: 2399582 - protein, 19 aa, Entamoeba dispar
LNILFPAIGRGTFGNVYKA

SEQ ID NO: 2399583 - protein, 35 aa, Entamoeba dispar
LNIQQENLYLLLTLLQQFGICYILTKQFATIVNEE

SEQ ID NO: 2399584 - protein, 31 aa, Entamoeba dispar
LNKPKSELTNFFYFLPFTINIDNDKKMYLIP

SEQ ID NO: 2399585 - protein, 18 aa, Entamoeba dispar
LNLDNVLIYPSYSFKTCE

SEQ ID NO: 2399586 - protein, 19 aa, Entamoeba dispar
LNLKMIYTDYLLSSLKSND

SEQ ID NO: 2399587 - protein, 34 aa, Entamoeba dispar
LNMLLSVIHFNIYRIFYIYNSLSTTLFPILNSIS

SEQ ID NO: 2399588 - protein, 27 aa, Entamoeba dispar
LNNFFLTFIGFAVFALITLGILIGMES

SEQ ID NO: 2399589 - protein, 19 aa, Entamoeba dispar
LNQCLSCKTKLLLNGICTL

SEQ ID NO: 2399590 - protein, 30 aa, Entamoeba dispar
LNQIQTKFNFLILLKFLIVKEIIEECKEEM

SEQ ID NO: 2399591 - protein, 19 aa, Entamoeba dispar
LNQKPIFISSPLILTDLSS

SEQ ID NO: 2399592 - protein, 18 aa, Entamoeba dispar
LNQRELFYQLHFLDSLEK

SEQ ID NO: 2399593 - protein, 26 aa, Entamoeba dispar
LNQRITEFPYFTPILNVNEFTQTKDK

SEQ ID NO: 2399594 - protein, 20 aa, Entamoeba dispar
LNQTWYEKLGRWQQALNIYE

SEQ ID NO: 2399595 - protein, 25 aa, Entamoeba dispar
LNQYLPFYILMIVGVINSMLMLLTP

SEQ ID NO: 2399596 - protein, 26 aa, Entamoeba dispar
LNSMQMLWVNLIMDTLAALALGTEKP

SEQ ID NO: 2399597 - protein, 28 aa, Entamoeba dispar
LNSQHKYILSIAFFLIGGAITEAIQISF

SEQ ID NO: 2399598 - protein, 22 aa, Entamoeba dispar
LNTFYCCIAFLSKQSIYYSNKK

SEQ ID NO: 2399599 - protein, 26 aa, Entamoeba dispar
LNTTYNTLYYIFISGIHKSTGSYFLQ

SEQ ID NO: 2399600 - protein, 44 aa, Entamoeba dispar
LNVFYSCLLLYKHFYIIQSPQLFHPRFIMIACFCFGKKLEEFRF

SEQ ID NO: 2399601 - protein, 28 aa, Entamoeba dispar
LNVGYWFPLLFCLPFVLYFTFIPTFNFC

SEQ ID NO: 2399602 - protein, 31 aa, Entamoeba dispar
LNVRKSFRFILPRALLLLTLFILVFTELMYN

SEQ ID NO: 2399603 - protein, 22 aa, Entamoeba dispar
LNYNILIKELTTLKFMIINKPL

SEQ ID NO: 2399604 - protein, 19 aa, Entamoeba dispar
LNYYLFTLSFFILFLCFIV

SEQ ID NO: 2399605 - protein, 28 aa, Entamoeba dispar
LPADKLVSLMFISLPIASSIICLKKAPE

SEQ ID NO: 2399606 - protein, 18 aa, Entamoeba dispar
LPCHCCCYRCLSCFRIML

SEQ ID NO: 2399607 - protein, 18 aa, Entamoeba dispar
LPDMLPSYKFIKTTWDLF

SEQ ID NO: 2399608 - protein, 24 aa, Entamoeba dispar
LPEKMELYGMYIYIQGNKTHLNKS

SEQ ID NO: 2399609 - protein, 17 aa, Entamoeba dispar
LPEQLKIKEDWAEKVKA

SEQ ID NO: 2399610 - protein, 23 aa, Entamoeba dispar
LPETLIMNPYLYKSIKSLFNYKT

SEQ ID NO: 2399611 - protein, 20 aa, Entamoeba dispar
LPEYGAFLFYASYGIETRGS

SEQ ID NO: 2399612 - protein, 18 aa, Entamoeba dispar
LPFLHILHYIFSSSCSLC

SEQ ID NO: 2399613 - protein, 20 aa, Entamoeba dispar
LPFLKAVCGSKKSWYARHTG

SEQ ID NO: 2399614 - protein, 21 aa, Entamoeba dispar
LPFLLICFVFGGITEEVYNQI

SEQ ID NO: 2399615 - protein, 39 aa, Entamoeba dispar
LPFTYHYQYIIWGYFIFTTLCAYFSLIFKRKELWEMFRF

SEQ ID NO: 2399616 - protein, 24 aa, Entamoeba dispar
LPHQLRFLMVYGCKDIVALDNLKN

SEQ ID NO: 2399617 - protein, 17 aa, Entamoeba dispar
LPIIVSAVSSFLAAGIS

SEQ ID NO: 2399618 - protein, 17 aa, Entamoeba dispar
LPILLSMERLEILKIDA

SEQ ID NO: 2399619 - protein, 26 aa, Entamoeba dispar
LPKKYLNIMHLLPQTFRINYLSNHVT

SEQ ID NO: 2399620 - protein, 18 aa, Entamoeba dispar
LPLIITRGNNVFGPHQFP

SEQ ID NO: 2399621 - protein, 45 aa, Entamoeba dispar
LPLVITGSCAPILFLVVCIILLCIITYWAFIPIGVCLLFVCVNML

SEQ ID NO: 2399622 - protein, 20 aa, Entamoeba dispar
LPLYLVCLNGIRNLLQLTSV

SEQ ID NO: 2399623 - protein, 33 aa, Entamoeba dispar
LPMTVSIIISLLFYLSICHWYWISEIFEGMCIY

SEQ ID NO: 2399624 - protein, 19 aa, Entamoeba dispar
LPNIDYHVFFGLSSKFEAG

SEQ ID NO: 2399625 - protein, 20 aa, Entamoeba dispar
LPNLVRYYMSYSDRNFIYIA

SEQ ID NO: 2399626 - protein, 32 aa, Entamoeba dispar
LPPHDLGYYVARLRTIIYPNFLNYYLMHFLFF

SEQ ID NO: 2399627 - protein, 32 aa, Entamoeba dispar
LPPQNNIIRIPWRRILFTPNPKKPTIWDDIKI

SEQ ID NO: 2399628 - protein, 25 aa, Entamoeba dispar
LPSLMQCIMLTLFAIPLDKIFQESK

SEQ ID NO: 2399629 - protein, 32 aa, Entamoeba dispar
LPSPTLVGIFYMYFYTLNIPLLPINDLESINN

SEQ ID NO: 2399630 - protein, 31 aa, Entamoeba dispar
LPSQSFLIIKMIWFIILKRLQDWTVNSSSQF

SEQ ID NO: 2399631 - protein, 43 aa, Entamoeba dispar
LPSSSPFILKFLFFIIFAVVIGGVIFFIFGKKKNKFRNDRIEL

SEQ ID NO: 2399632 - protein, 20 aa, Entamoeba dispar
LPSWRWYYKFHYAPFALDFA

SEQ ID NO: 2399633 - protein, 18 aa, Entamoeba dispar
LPTGCYCTYSLISKQECI

SEQ ID NO: 2399634 - protein, 21 aa, Entamoeba dispar
LPVEQIWYSFTNIDDTTLSIP

SEQ ID NO: 2399635 - protein, 26 aa, Entamoeba dispar
LQAKVQYYFRTLFNDIGRLLSAHILL

SEQ ID NO: 2399636 - protein, 22 aa, Entamoeba dispar
LQATFNLYIRRIHHPCSYVNQE

SEQ ID NO: 2399637 - protein, 35 aa, Entamoeba dispar
LQEMKITHILTIGPLQPIFPELFVYKQINIDDSVK

SEQ ID NO: 2399638 - protein, 28 aa, Entamoeba dispar
LQEVELLEKIRCPFIINFIGSVTSSDTL

SEQ ID NO: 2399639 - protein, 38 aa, Entamoeba dispar
LQGQYGLSWQAWLLSLLLSFITLIIGQISFFIPVPTSK

SEQ ID NO: 2399640 - protein, 21 aa, Entamoeba dispar
LQHGALLLMVSLLRNCKEYMK

SEQ ID NO: 2399641 - protein, 17 aa, Entamoeba dispar
LQIITWEDPFPKTEFKF

SEQ ID NO: 2399642 - protein, 20 aa, Entamoeba dispar
LQKHFLSILITCFFSLFLFN

SEQ ID NO: 2399643 - protein, 18 aa, Entamoeba dispar
LQKVLYVNLIMEYNREIC

SEQ ID NO: 2399644 - protein, 17 aa, Entamoeba dispar
LQLFLHCKVIDKRVAIT

SEQ ID NO: 2399645 - protein, 31 aa, Entamoeba dispar
LQMKLDILFICFLLILLSFLAGLCLLSQIIQ

SEQ ID NO: 2399646 - protein, 22 aa, Entamoeba dispar
LQNKKCILYKEPCNYFKGDICY

SEQ ID NO: 2399647 - protein, 25 aa, Entamoeba dispar
LQNNKYNWFRPASFFPLGYMYEILD

SEQ ID NO: 2399648 - protein, 34 aa, Entamoeba dispar
LQNPAFILFVLGFFLPCIWIYNIIKYKNSGDLIE

SEQ ID NO: 2399649 - protein, 27 aa, Entamoeba dispar
LQNTTLQIFFIIPLGYCIFLSIKRIES

SEQ ID NO: 2399650 - protein, 25 aa, Entamoeba dispar
LQNTVWRFSFPYSFLETFRHNYNYD

SEQ ID NO: 2399651 - protein, 23 aa, Entamoeba dispar
LQQNMEEMKLMKPVFIAAENGSD

SEQ ID NO: 2399652 - protein, 18 aa, Entamoeba dispar
LQRRILALIITLDEKSIE

SEQ ID NO: 2399653 - protein, 26 aa, Entamoeba dispar
LQTHNALFMIYPNWISEMGITVESEK

SEQ ID NO: 2399654 - protein, 23 aa, Entamoeba dispar
LQTICFFVLSEYQGIKIRSLYFK

SEQ ID NO: 2399655 - protein, 25 aa, Entamoeba dispar
LQTIIFNTFVFCQIFNEVNSRRVNG

SEQ ID NO: 2399656 - protein, 17 aa, Entamoeba dispar
LQVLYKQATRKNILGFD

SEQ ID NO: 2399657 - protein, 22 aa, Entamoeba dispar
LQWKHVIIIPFIGSLFLIFVFF

SEQ ID NO: 2399658 - protein, 26 aa, Entamoeba dispar
LQYGLLVLFAFWFFHGIVDSLIGSSL

SEQ ID NO: 2399659 - protein, 22 aa, Entamoeba dispar
LRESNFPSEWFFLIDSLKNVEI

SEQ ID NO: 2399660 - protein, 17 aa, Entamoeba dispar
LRFLLDAAKGIQYLHNN

SEQ ID NO: 2399661 - protein, 17 aa, Entamoeba dispar
LRFMLIIMNSRGSIFVH

SEQ ID NO: 2399662 - protein, 35 aa, Entamoeba dispar
LRFNQVTSTPIIFRLCEWYSIIPEPDKHYSFSVPT

SEQ ID NO: 2399663 - protein, 25 aa, Entamoeba dispar
LRHPSYFGWFWWSITTQIVMLNPLS

SEQ ID NO: 2399664 - protein, 18 aa, Entamoeba dispar
LRIRNGLIGLIYDKALKL

SEQ ID NO: 2399665 - protein, 22 aa, Entamoeba dispar
LRMTRFWTYFGMWSCGGYFFIN

SEQ ID NO: 2399666 - protein, 17 aa, Entamoeba dispar
LRNPFVVNYVGSVTYIP

SEQ ID NO: 2399667 - protein, 18 aa, Entamoeba dispar
LRNQSFGTFLFVALLLIF

SEQ ID NO: 2399668 - protein, 39 aa, Entamoeba dispar
LRNVTLIKMCFYKNASFFLILFWYSFFNGQSGMSMYDDY

SEQ ID NO: 2399669 - protein, 23 aa, Entamoeba dispar
LRQAATSVLYLFAKTNYQVTGDT

SEQ ID NO: 2399670 - protein, 30 aa, Entamoeba dispar
LRRTNFIICLFFILYSLYQIGILLAWIFRV

SEQ ID NO: 2399671 - protein, 27 aa, Entamoeba dispar
LRSEIWIQIYYLIITFGVVITPFVGFI

SEQ ID NO: 2399672 - protein, 23 aa, Entamoeba dispar
LRTYFIIERIKKVMKIFIHFIIK

SEQ ID NO: 2399673 - protein, 26 aa, Entamoeba dispar
LRVDDQKYIILLAAKDFNGLEQYNIP

SEQ ID NO: 2399674 - protein, 34 aa, Entamoeba dispar
LRVWSLLIMLYSFVHFIILITFYFVDIEEHWGLM

SEQ ID NO: 2399675 - protein, 36 aa, Entamoeba dispar
LRYIPKKWKIVQLWNSRIIILMIRTCILILTTFCAT

SEQ ID NO: 2399676 - protein, 21 aa, Entamoeba dispar
LSALYFFFPLFTYSAFSTSCR

SEQ ID NO: 2399677 - protein, 25 aa, Entamoeba dispar
LSAQGSLLTMILFLSPQTLNNNISF

SEQ ID NO: 2399678 - protein, 25 aa, Entamoeba dispar
LSASLMKYFTIGKYYLHVFGHYGIV

SEQ ID NO: 2399679 - protein, 50 aa, Entamoeba dispar
LSCKKLNLGLIISLIIVGLLFIVIIISIIIFLIWRKRRKIIKEREKEIKP

SEQ ID NO: 2399680 - protein, 30 aa, Entamoeba dispar
LSDCKLFFGVEFLYNCLVSFLLTILERRKV

SEQ ID NO: 2399681 - protein, 17 aa, Entamoeba dispar
LSDERYGIVALDALCNE

SEQ ID NO: 2399682 - protein, 20 aa, Entamoeba dispar
LSELLKLFGYIYLNVDNEKT

SEQ ID NO: 2399683 - protein, 24 aa, Entamoeba dispar
LSFIIAFSLLFITTLLMSSVTFIA

SEQ ID NO: 2399684 - protein, 22 aa, Entamoeba dispar
LSFILLICFILKWSVLYISSLL

SEQ ID NO: 2399685 - protein, 18 aa, Entamoeba dispar
LSFLFQINNQLWFLLSWT

SEQ ID NO: 2399686 - protein, 19 aa, Entamoeba dispar
LSFPAAYFTFKGTGTGVSI

SEQ ID NO: 2399687 - protein, 25 aa, Entamoeba dispar
LSFSAYCFWLIIPILMRDIGASPFQ

SEQ ID NO: 2399688 - protein, 32 aa, Entamoeba dispar
LSFSSFSLFPLYFMDFFISPKLHYLMFSNHSI

SEQ ID NO: 2399689 - protein, 19 aa, Entamoeba dispar
LSFTIMNFLKYCRFNGFFN

SEQ ID NO: 2399690 - protein, 17 aa, Entamoeba dispar
LSFVNARLFQLNEFGSM

SEQ ID NO: 2399691 - protein, 25 aa, Entamoeba dispar
LSGFLLPILSIFRLIKGKLVIVIPF

SEQ ID NO: 2399692 - protein, 39 aa, Entamoeba dispar
LSGGEIFGIIVAVLFLVVILLVVGLFVGYIGYKKYQNKH

SEQ ID NO: 2399693 - protein, 21 aa, Entamoeba dispar
LSHFHLILYIIGTNAGPMLSS

SEQ ID NO: 2399694 - protein, 28 aa, Entamoeba dispar
LSHHVYFGAILFSLKTLFLIINTFAFNN

SEQ ID NO: 2399695 - protein, 21 aa, Entamoeba dispar
LSHRIFLSVLFAYCNTFFSGI

SEQ ID NO: 2399696 - protein, 21 aa, Entamoeba dispar
LSIAEFTFYLQREVVPQLLVD

SEQ ID NO: 2399697 - protein, 24 aa, Entamoeba dispar
LSIEPLALLPFIIESLKELNVQLK

SEQ ID NO: 2399698 - protein, 24 aa, Entamoeba dispar
LSIIPTLIIYFFKPNPEILVTLLL

SEQ ID NO: 2399699 - protein, 18 aa, Entamoeba dispar
LSIKFLKQNPLPKTIYTI

SEQ ID NO: 2399700 - protein, 17 aa, Entamoeba dispar
LSILIPILAVIKGSLTL

SEQ ID NO: 2399701 - protein, 18 aa, Entamoeba dispar
LSILITCFFSLFLFNYCS

SEQ ID NO: 2399702 - protein, 17 aa, Entamoeba dispar
LSILLVQSLLTINIESQ

SEQ ID NO: 2399703 - protein, 42 aa, Entamoeba dispar
LSILMIIPDLIQHPNWFILVSLTRFMILFSSIIPISMRVNLD

SEQ ID NO: 2399704 - protein, 37 aa, Entamoeba dispar
LSILVSEHPFVSMVLLTVTMILIGLIVMWWSSEYDDE

SEQ ID NO: 2399705 - protein, 32 aa, Entamoeba dispar
LSISFMDLTFLPFLVFPIVIMGYTHYAKWIGP

SEQ ID NO: 2399706 - protein, 23 aa, Entamoeba dispar
LSITIHKGCTFFLKLPSKLEELN

SEQ ID NO: 2399707 - protein, 46 aa, Entamoeba dispar
LSKALTNFLFWGIGSIVYILYFFFVITLFLILHIKLTRKIKQDIDD

SEQ ID NO: 2399708 - protein, 45 aa, Entamoeba dispar
LSKHPSLFLAIFKKEWYHFLFAYILVTIYELFSLAFPLESQYIVK

SEQ ID NO: 2399709 - protein, 23 aa, Entamoeba dispar
LSKILLILYTILIVGSIALTIII

SEQ ID NO: 2399710 - protein, 30 aa, Entamoeba dispar
LSKRPTHYFLYYINDIIFHLIIYGTVGIIQ

SEQ ID NO: 2399711 - protein, 28 aa, Entamoeba dispar
LSLDSHFFDIFFDFLFTHMSITKSQHII

SEQ ID NO: 2399712 - protein, 18 aa, Entamoeba dispar
LSLHFSFSKDILPQGFAP

SEQ ID NO: 2399713 - protein, 18 aa, Entamoeba dispar
LSLIYWRNYPPSIIGMMI

SEQ ID NO: 2399714 - protein, 19 aa, Entamoeba dispar
LSLMFYFYKHNTLLSVAML

SEQ ID NO: 2399715 - protein, 58 aa, Entamoeba dispar
LSLQEYIYFFKRRLWFTLEFISFIGIFYSFVTLHFILLILFCICFILTLVVPTLTVSN

SEQ ID NO: 2399716 - protein, 23 aa, Entamoeba dispar
LSLVLLIMTSSSVFKLFQVVKFN

SEQ ID NO: 2399717 - protein, 24 aa, Entamoeba dispar
LSLYNVCLILVRLFFQLPGFCLTS

SEQ ID NO: 2399718 - protein, 22 aa, Entamoeba dispar
LSLYPKLKMLVISSNKAYPIKY

SEQ ID NO: 2399719 - protein, 24 aa, Entamoeba dispar
LSLYSILYFLLNKVLFLCFLYSTH

SEQ ID NO: 2399720 - protein, 37 aa, Entamoeba dispar
LSNAPNLFFQIKPLYTLLLQVLIPKLPVIINSTLQYH

SEQ ID NO: 2399721 - protein, 25 aa, Entamoeba dispar
LSNEIKWRIIKLTLFIPKEIKAEDK

SEQ ID NO: 2399722 - protein, 22 aa, Entamoeba dispar
LSNLFLCHAQKQDWPLFHSECG

SEQ ID NO: 2399723 - protein, 23 aa, Entamoeba dispar
LSNLSLLVLFLISLQEKSIQLLP

SEQ ID NO: 2399724 - protein, 26 aa, Entamoeba dispar
LSNNYITILPSLTSLPLKLLDISFNN

SEQ ID NO: 2399725 - protein, 24 aa, Entamoeba dispar
LSNQKTIWKYFSKEWCFYHNTNIK

SEQ ID NO: 2399726 - protein, 20 aa, Entamoeba dispar
LSNVYLLLFSEKHKYCKRIL

SEQ ID NO: 2399727 - protein, 25 aa, Entamoeba dispar
LSPLIYLTTLKFLNASTNPILLIPP

SEQ ID NO: 2399728 - protein, 26 aa, Entamoeba dispar
LSPRVSVILRKDVPYYLFIHSKYASK

SEQ ID NO: 2399729 - protein, 19 aa, Entamoeba dispar
LSPSFLLILAFNQVFAVIN

SEQ ID NO: 2399730 - protein, 30 aa, Entamoeba dispar
LSPTMATLLIPVFPLLITPFLGVMNSNHES

SEQ ID NO: 2399731 - protein, 24 aa, Entamoeba dispar
LSQSLVALFRLFAPLISSPLIAWS

SEQ ID NO: 2399732 - protein, 25 aa, Entamoeba dispar
LSQSLVALFRLFAPLISSPLIAWSF

SEQ ID NO: 2399733 - protein, 26 aa, Entamoeba dispar
LSREGRFRFGGFWGKKWAKLTVNKNE

SEQ ID NO: 2399734 - protein, 24 aa, Entamoeba dispar
LSSFIKCYIPILSTHQYYLNDIEC

SEQ ID NO: 2399735 - protein, 17 aa, Entamoeba dispar
LSSFVLYFDGLIKLFSS

SEQ ID NO: 2399736 - protein, 24 aa, Entamoeba dispar
LSSGFPAFLLLYVNTLPLLLFRSH

SEQ ID NO: 2399737 - protein, 25 aa, Entamoeba dispar
LSSGFPAFLLLYVNTLPLLLFRSHF

SEQ ID NO: 2399738 - protein, 24 aa, Entamoeba dispar
LSSIGCLFPMYEAKLRDVPELGYL

SEQ ID NO: 2399739 - protein, 17 aa, Entamoeba dispar
LSSLFLFDLNQYPMKII

SEQ ID NO: 2399740 - protein, 32 aa, Entamoeba dispar
LSSLQYGPLPLKYIPKLVYPFEQIDILTILKC

SEQ ID NO: 2399741 - protein, 29 aa, Entamoeba dispar
LSTAKVFRYRPFSLILTMSSTWRENKGLT

SEQ ID NO: 2399742 - protein, 27 aa, Entamoeba dispar
LSTDHFPLARDLFNYAFLSMWQDSTDN

SEQ ID NO: 2399743 - protein, 20 aa, Entamoeba dispar
LSTIFPLFSNIFTENPHITK

SEQ ID NO: 2399744 - protein, 20 aa, Entamoeba dispar
LSTVFFQLLLCSVMAGFASW

SEQ ID NO: 2399745 - protein, 22 aa, Entamoeba dispar
LSVDVLGIIPFLVESLKQLNSE

SEQ ID NO: 2399746 - protein, 25 aa, Entamoeba dispar
LSVFPTLIFLIIEVVVHYLPAPSFE

SEQ ID NO: 2399747 - protein, 22 aa, Entamoeba dispar
LSVIAYILLLISSIAHFIHFKL

SEQ ID NO: 2399748 - protein, 19 aa, Entamoeba dispar
LSVIYLCYAYVSWSSERSL

SEQ ID NO: 2399749 - protein, 17 aa, Entamoeba dispar
LSVLFAYCNTFFSGIIF

SEQ ID NO: 2399750 - protein, 26 aa, Entamoeba dispar
LSVMLSWVFIIVFAAIIHGQWFSIFN

SEQ ID NO: 2399751 - protein, 27 aa, Entamoeba dispar
LSWINLIPPMHLFIPFVLCAGCILSYC

SEQ ID NO: 2399752 - protein, 18 aa, Entamoeba dispar
LSWVSYLISYFGSNAFTK

SEQ ID NO: 2399753 - protein, 34 aa, Entamoeba dispar
LSYDIFQIMYKLIFGHPLLFKTKKIWGFCILTIS

SEQ ID NO: 2399754 - protein, 26 aa, Entamoeba dispar
LSYKSNIPIDYLLFTGDSKVTDIVNG

SEQ ID NO: 2399755 - protein, 25 aa, Entamoeba dispar
LSYLVKTYCFLQLPKESEKILQEFF

SEQ ID NO: 2399756 - protein, 30 aa, Entamoeba dispar
LTADYWNPLFIPYVLLLCFVSRAFNVFPIS

SEQ ID NO: 2399757 - protein, 18 aa, Entamoeba dispar
LTCPILSLFYHQSLPNNA

SEQ ID NO: 2399758 - protein, 29 aa, Entamoeba dispar
LTCYKYAAKPPLTAAYFLEKIYDVTNKYA

SEQ ID NO: 2399759 - protein, 17 aa, Entamoeba dispar
LTDLLKIKNTRITIKKK

SEQ ID NO: 2399760 - protein, 26 aa, Entamoeba dispar
LTDNFNNFLFWFIVEHPKMPVVDFTD

SEQ ID NO: 2399761 - protein, 23 aa, Entamoeba dispar
LTEGIFSFIKKLFVKRTYNKIYV

SEQ ID NO: 2399762 - protein, 21 aa, Entamoeba dispar
LTFIFFFTNAERRKITTIQTP

SEQ ID NO: 2399763 - protein, 22 aa, Entamoeba dispar
LTGCKQCYIGYVFDTEKKLCVS

SEQ ID NO: 2399764 - protein, 25 aa, Entamoeba dispar
LTGFVYPLIFYISWQVIYVIITEVI

SEQ ID NO: 2399765 - protein, 42 aa, Entamoeba dispar
LTGYLVGFIKCWDLTLVILCMFPFIMISMMGLGMSAGIFTIK

SEQ ID NO: 2399766 - protein, 26 aa, Entamoeba dispar
LTHIRKALLLFSRYPNTFIPNASKTY

SEQ ID NO: 2399767 - protein, 33 aa, Entamoeba dispar
LTHIRKALLLFSRYPYDFIPNSTAIYSKELIQL

SEQ ID NO: 2399768 - protein, 26 aa, Entamoeba dispar
LTHLESPILRILLLEDNPIYNIQSYL

SEQ ID NO: 2399769 - protein, 22 aa, Entamoeba dispar
LTHYIEFYSPKLSYNEWYFVFY

SEQ ID NO: 2399770 - protein, 26 aa, Entamoeba dispar
LTIDILQTLFYLQVSYRTNKMPLLNG

SEQ ID NO: 2399771 - protein, 18 aa, Entamoeba dispar
LTIEPKLVILSKGKCVTF

SEQ ID NO: 2399772 - protein, 24 aa, Entamoeba dispar
LTIFYLFKVVYWTISGLQIRAGYN

SEQ ID NO: 2399773 - protein, 26 aa, Entamoeba dispar
LTIIYNSWILCEAILIELGYSSVTYT

SEQ ID NO: 2399774 - protein, 18 aa, Entamoeba dispar
LTIKLIFSYFIDNPSYIP

SEQ ID NO: 2399775 - protein, 37 aa, Entamoeba dispar
LTILTTMALSIKSWNFFLALGFFVSFLLSLICILLVS

SEQ ID NO: 2399776 - protein, 26 aa, Entamoeba dispar
LTITPSLLLIFPRFFRIKGLIPCNKW

SEQ ID NO: 2399777 - protein, 17 aa, Entamoeba dispar
LTIWWTVSTLRLKYYGT

SEQ ID NO: 2399778 - protein, 32 aa, Entamoeba dispar
LTKIFSKYLFSKQFQPIAYKLLLNYFISNYKK

SEQ ID NO: 2399779 - protein, 23 aa, Entamoeba dispar
LTKLRSPLLINIIGIVTTPKHEC

SEQ ID NO: 2399780 - protein, 33 aa, Entamoeba dispar
LTKQWYEFYVIVTTPYLLIFESEEKMNKMEYYA

SEQ ID NO: 2399781 - protein, 22 aa, Entamoeba dispar
LTKTKTIPPIFKIQNIKFEKEE

SEQ ID NO: 2399782 - protein, 26 aa, Entamoeba dispar
LTKYMTELHLFKFSPEIIYQLSIDSI

SEQ ID NO: 2399783 - protein, 36 aa, Entamoeba dispar
LTLFSKPQHYIYFYKMLWLLLEKFDHKIAFMDEWFF

SEQ ID NO: 2399784 - protein, 36 aa, Entamoeba dispar
LTLLFRNKCALFCQLLPLIVIILCGIIVLIMRADRE

SEQ ID NO: 2399785 - protein, 18 aa, Entamoeba dispar
LTLSIASTIFFLLKDKIM

SEQ ID NO: 2399786 - protein, 27 aa, Entamoeba dispar
LTLSKQIPFIIFQLCDFMTSIIQIGGY

SEQ ID NO: 2399787 - protein, 28 aa, Entamoeba dispar
LTLTNHWKYPMHFTFHSGDYTKYEIMCK

SEQ ID NO: 2399788 - protein, 17 aa, Entamoeba dispar
LTLVYIPLLSFAVCNAC

SEQ ID NO: 2399789 - protein, 18 aa, Entamoeba dispar
LTMFVSEFTRLGGIGLVL

SEQ ID NO: 2399790 - protein, 32 aa, Entamoeba dispar
LTNKWNQIDFIYFYQLMIKFFTQINVNELSLC

SEQ ID NO: 2399791 - protein, 20 aa, Entamoeba dispar
LTPKLTNVLLPIIDPLFLSN

SEQ ID NO: 2399792 - protein, 26 aa, Entamoeba dispar
LTPSLLGIFPKFFSKRGFIPCIKRCR

SEQ ID NO: 2399793 - protein, 24 aa, Entamoeba dispar
LTSIPFIQIELLQNALKRLHVAGE

SEQ ID NO: 2399794 - protein, 37 aa, Entamoeba dispar
LTTILNNYLIILLCNYYIFNLIYLVPKIKNEGKRHIS

SEQ ID NO: 2399795 - protein, 22 aa, Entamoeba dispar
LTVAIISILYSFFRFITSMSHG

SEQ ID NO: 2399796 - protein, 22 aa, Entamoeba dispar
LTVDYLGIIPLLVEALKEIHNN

SEQ ID NO: 2399797 - protein, 18 aa, Entamoeba dispar
LTVETISSGILFISNILS

SEQ ID NO: 2399798 - protein, 23 aa, Entamoeba dispar
LTVLAVFWYYWKNKQEFVHVKEV

SEQ ID NO: 2399799 - protein, 18 aa, Entamoeba dispar
LTYIRKLDFISGTSKILN

SEQ ID NO: 2399800 - protein, 17 aa, Entamoeba dispar
LTYKFKMRILKDVAKGM

SEQ ID NO: 2399801 - protein, 39 aa, Entamoeba dispar
LTYMAPEIFLKEPYKFPADIFAFGVVIFETIKWGDAFEQ

SEQ ID NO: 2399802 - protein, 23 aa, Entamoeba dispar
LTYNELVIMNILNEYYNKYKDIG

SEQ ID NO: 2399803 - protein, 20 aa, Entamoeba dispar
LTYYLWVILSSSILPPYDLQ

SEQ ID NO: 2399804 - protein, 32 aa, Entamoeba dispar
LVAPGWFYFCPISLLLWLLTGGVTYYLGTIFF

SEQ ID NO: 2399805 - protein, 23 aa, Entamoeba dispar
LVAYRFELLPSIEFLPICISFIV

SEQ ID NO: 2399806 - protein, 25 aa, Entamoeba dispar
LVDETLIRTYLWIVENLFVTVCELD

SEQ ID NO: 2399807 - protein, 18 aa, Entamoeba dispar
LVEILLDKLIDTIKQYPC

SEQ ID NO: 2399808 - protein, 18 aa, Entamoeba dispar
LVFFDKLLQFIPENTSII

SEQ ID NO: 2399809 - protein, 18 aa, Entamoeba dispar
LVFLIKTFSDVQSSFVSV

SEQ ID NO: 2399810 - protein, 18 aa, Entamoeba dispar
LVFLLIDCFLFKQGNTRV

SEQ ID NO: 2399811 - protein, 18 aa, Entamoeba dispar
LVFSLTLSFSLSASCSKG

SEQ ID NO: 2399812 - protein, 20 aa, Entamoeba dispar
LVFYSLFNDKHKYQWFFDAS

SEQ ID NO: 2399813 - protein, 26 aa, Entamoeba dispar
LVGCFAQHTVYYFKQSDLGAQHKRLR

SEQ ID NO: 2399814 - protein, 27 aa, Entamoeba dispar
LVGKTYVPLFPYFKDLKGCFRVVADDY

SEQ ID NO: 2399815 - protein, 25 aa, Entamoeba dispar
LVGLILVIILFIFTPQIYDFLKCQE

SEQ ID NO: 2399816 - protein, 17 aa, Entamoeba dispar
LVIIPFGFGLPSHTFDK

SEQ ID NO: 2399817 - protein, 43 aa, Entamoeba dispar
LVITGSCAPILFLVVCIILLCIITYWAFIPIGVCLLFVCVNML

SEQ ID NO: 2399818 - protein, 25 aa, Entamoeba dispar
LVIVTIISFFIGWHMVMAIGGADMP

SEQ ID NO: 2399819 - protein, 17 aa, Entamoeba dispar
LVKCTCILRCKIPVTLR

SEQ ID NO: 2399820 - protein, 25 aa, Entamoeba dispar
LVKKHYLLVLLIIVYKMKSVMIRRE

SEQ ID NO: 2399821 - protein, 25 aa, Entamoeba dispar
LVKSPFILCMCLIYSIVILAYNLFG

SEQ ID NO: 2399822 - protein, 22 aa, Entamoeba dispar
LVLFEDFIISDLKFIREYVWCL

SEQ ID NO: 2399823 - protein, 18 aa, Entamoeba dispar
LVLIFKYSQDEAIQQTAI

SEQ ID NO: 2399824 - protein, 36 aa, Entamoeba dispar
LVLKTKIVYWFYYLLMILLFFFPKIFIPCPSNHKIF

SEQ ID NO: 2399825 - protein, 24 aa, Entamoeba dispar
LVLRHFYSLFIQFYDPMDTVLSLY

SEQ ID NO: 2399826 - protein, 20 aa, Entamoeba dispar
LVLYCALFFLLTIPFFNKWI

SEQ ID NO: 2399827 - protein, 23 aa, Entamoeba dispar
LVPAFFFIFFDFIITIKQFFEPN

SEQ ID NO: 2399828 - protein, 20 aa, Entamoeba dispar
LVRIAILWHEAWHEALEEAS

SEQ ID NO: 2399829 - protein, 42 aa, Entamoeba dispar
LVRKMAIYPFLYIVCWIVPFFNRLLPLFKITPPFWMEYVHCF

SEQ ID NO: 2399830 - protein, 31 aa, Entamoeba dispar
LVTEEWYYFILFIISFIPLLINGYCCSTKED

SEQ ID NO: 2399831 - protein, 30 aa, Entamoeba dispar
LVTKIIVPIFLFISFVLLVIGMFLISFSFD

SEQ ID NO: 2399832 - protein, 30 aa, Entamoeba dispar
LVTRNPTSFLFWFITLGVQGFTVFVLYFII

SEQ ID NO: 2399833 - protein, 27 aa, Entamoeba dispar
LVVASPQIFQLFYLAVQKFTLPDDLNS

SEQ ID NO: 2399834 - protein, 18 aa, Entamoeba dispar
LVVGFVCGIFLILFLIWN

SEQ ID NO: 2399835 - protein, 18 aa, Entamoeba dispar
LVVISFLVLTFVSLDFEN

SEQ ID NO: 2399836 - protein, 28 aa, Entamoeba dispar
LVVKVFDCLFIFLINRISFHFREGHIHE

SEQ ID NO: 2399837 - protein, 28 aa, Entamoeba dispar
LVVVIVSLIILYYLRPNGYDQKLNGCFV

SEQ ID NO: 2399838 - protein, 19 aa, Entamoeba dispar
LVYISLFLIVLHLDIVVES

SEQ ID NO: 2399839 - protein, 20 aa, Entamoeba dispar
LWILIKRNALIQWRSPGKII

SEQ ID NO: 2399840 - protein, 17 aa, Entamoeba dispar
LWTVCHSNRLNFHRAKL

SEQ ID NO: 2399841 - protein, 18 aa, Entamoeba dispar
LWVCTLSSLILIIPNFHT

SEQ ID NO: 2399842 - protein, 26 aa, Entamoeba dispar
LYDTSCFFYWIVVPLLFNEQGATPVQ

SEQ ID NO: 2399843 - protein, 19 aa, Entamoeba dispar
LYHGSRLANFVSILSTGLK

SEQ ID NO: 2399844 - protein, 17 aa, Entamoeba dispar
LYHKVSDGDLPLYLVCL

SEQ ID NO: 2399845 - protein, 22 aa, Entamoeba dispar
LYHKYFILLYFYTFILLYLYTF

SEQ ID NO: 2399846 - protein, 47 aa, Entamoeba dispar
LYKAIISINPPYWINVWYVYIFYYFALLFAFFFPSFTVHYINESLFN

SEQ ID NO: 2399847 - protein, 27 aa, Entamoeba dispar
LYKPFMKLMYYLFIPISATLILCVIVA

SEQ ID NO: 2399848 - protein, 21 aa, Entamoeba dispar
LYLFISFGLTKHFMSFSAGVI

SEQ ID NO: 2399849 - protein, 18 aa, Entamoeba dispar
LYLSYKGVSSVIGMETRI

SEQ ID NO: 2399850 - protein, 18 aa, Entamoeba dispar
LYLVKFNRDYAKASELLV

SEQ ID NO: 2399851 - protein, 30 aa, Entamoeba dispar
LYNSVISSFPLYRCFELIQIIKEPVLYFNN

SEQ ID NO: 2399852 - protein, 34 aa, Entamoeba dispar
LYQYLGACIYTSIKSFHWQFLITKSKRSSKRMLA

SEQ ID NO: 2399853 - protein, 19 aa, Entamoeba dispar
LYSFYKNIIMYLTQFSFLF

SEQ ID NO: 2399854 - protein, 29 aa, Entamoeba dispar
LYSLGIVLYYLIYLQFPFKINSLNELKER

SEQ ID NO: 2399855 - protein, 26 aa, Entamoeba dispar
LYSNFDIKFYSCISWSIHCCIMAFEK

SEQ ID NO: 2399856 - protein, 18 aa, Entamoeba dispar
LYSVLTQVKILSAAILSV

SEQ ID NO: 2399857 - protein, 31 aa, Entamoeba dispar
LYSYLVDEILFLFLNIFYFKAKSTTNNISSY

SEQ ID NO: 2399858 - protein, 20 aa, Entamoeba dispar
LYTDIFGQKKIKIFNGFYST

SEQ ID NO: 2399859 - protein, 20 aa, Entamoeba dispar
LYTRSSILVMLFFGYQLLSI

SEQ ID NO: 2399860 - protein, 21 aa, Entamoeba dispar
LYYIIMFFFYSLIPLFFLFSR

SEQ ID NO: 2399861 - protein, 19 aa, Entamoeba dispar
LYYWSFQQCVLVDKLWNCS

SEQ ID NO: 2399862 - protein, 35 aa, Entamoeba dispar
MADKAIWRIIFIISPITLILLILGIVGLVVTTYLL

SEQ ID NO: 2399863 - protein, 22 aa, Entamoeba dispar
MAKKIRDVLPEWVFGGLTEEQA

SEQ ID NO: 2399864 - protein, 17 aa, Entamoeba dispar
MAKKSLPFLTVVSLQRG

SEQ ID NO: 2399865 - protein, 17 aa, Entamoeba dispar
MALTCRPNLQRIAHRLI

SEQ ID NO: 2399866 - protein, 18 aa, Entamoeba dispar
MALYNFIFTSIPPVFISF

SEQ ID NO: 2399867 - protein, 20 aa, Entamoeba dispar
MASLNLVYPLTFRLNKHRNN

SEQ ID NO: 2399868 - protein, 18 aa, Entamoeba dispar
MAYFLFCFCFYSLMCISY

SEQ ID NO: 2399869 - protein, 27 aa, Entamoeba dispar
MCCILYAIIFLIFGMGWIKGVIADFLI

SEQ ID NO: 2399870 - protein, 33 aa, Entamoeba dispar
MCFGFGFALYYNWKLALCVIATSPIHALILFGD

SEQ ID NO: 2399871 - protein, 17 aa, Entamoeba dispar
MCVGYLGIIYYPSFFSL

SEQ ID NO: 2399872 - protein, 38 aa, Entamoeba dispar
MDFGRIINFQYIPPIYFAYFIFIALIEGLSITKVFMNQ

SEQ ID NO: 2399873 - protein, 34 aa, Entamoeba dispar
MDNSQMHWFYGINFLIHRLFFQFFDSNRISSKIK

SEQ ID NO: 2399874 - protein, 24 aa, Entamoeba dispar
MDNSVTISFIKVTQVSGKCNSNSA

SEQ ID NO: 2399875 - protein, 25 aa, Entamoeba dispar
MDPSPINRYFTWTPTLTYSNETKKV

SEQ ID NO: 2399876 - protein, 17 aa, Entamoeba dispar
MDRSEISGFLYSNGQKQ

SEQ ID NO: 2399877 - protein, 39 aa, Entamoeba dispar
MDTVLSLYDRLLYSSPIIPMFILCSIFITHRSELLKTTS

SEQ ID NO: 2399878 - protein, 27 aa, Entamoeba dispar
MDVSELLEILFWKYLKEEPGASAELDK

SEQ ID NO: 2399879 - protein, 22 aa, Entamoeba dispar
MDYENLLFVYPTEICLGKEKKR

SEQ ID NO: 2399880 - protein, 25 aa, Entamoeba dispar
MEETVLLGALVIGSIFIGSNVEKKK

SEQ ID NO: 2399881 - protein, 20 aa, Entamoeba dispar
MEGSYSRWLFFKTHFVVYFG

SEQ ID NO: 2399882 - protein, 20 aa, Entamoeba dispar
MEGVGSLLFIPQINEMWSID

SEQ ID NO: 2399883 - protein, 17 aa, Entamoeba dispar
MEITPICSTTISQQIRF

SEQ ID NO: 2399884 - protein, 19 aa, Entamoeba dispar
MEKLFNYYKVELIKAPAKY

SEQ ID NO: 2399885 - protein, 24 aa, Entamoeba dispar
MELIVFPIALIILLYVVQSPVLLI

SEQ ID NO: 2399886 - protein, 32 aa, Entamoeba dispar
MELNNNLIKLVKAYFLMCEIIEYNETKENEEG

SEQ ID NO: 2399887 - protein, 29 aa, Entamoeba dispar
MEMGDEAYLVKWKLFRSLALEDLKKTYER

SEQ ID NO: 2399888 - protein, 18 aa, Entamoeba dispar
METAKTRSLIPSELKIQE

SEQ ID NO: 2399889 - protein, 46 aa, Entamoeba dispar
MEYNYFNEIIFISLLYSIALILLLIVTLILIGFYFYSNRKFKRNQD

SEQ ID NO: 2399890 - protein, 29 aa, Entamoeba dispar
MFDGFLVLKMPFPLSYRFKLITQQGLGGM

SEQ ID NO: 2399891 - protein, 18 aa, Entamoeba dispar
MFDILCHLKYLNISNRPL

SEQ ID NO: 2399892 - protein, 18 aa, Entamoeba dispar
MFETIKWDNPYSKEVYKF

SEQ ID NO: 2399893 - protein, 28 aa, Entamoeba dispar
MFETMKWGPAYPKEQFKYPWQIAQFVCD

SEQ ID NO: 2399894 - protein, 24 aa, Entamoeba dispar
MFFGMFLALLIYYFTELIKFCINC

SEQ ID NO: 2399895 - protein, 31 aa, Entamoeba dispar
MFGNKYLLVGLVVSVLFLVAGIYIPYFNDII

SEQ ID NO: 2399896 - protein, 18 aa, Entamoeba dispar
MFKFFNKKNFWSIYCSIL

SEQ ID NO: 2399897 - protein, 19 aa, Entamoeba dispar
MFKIIYRDSYETTQKKLWG

SEQ ID NO: 2399898 - protein, 27 aa, Entamoeba dispar
MFLLSVVIYLFWLLFEVIRSFSERRKM

SEQ ID NO: 2399899 - protein, 23 aa, Entamoeba dispar
MFNFASYFYWLVVPLKCVDMGGS

SEQ ID NO: 2399900 - protein, 24 aa, Entamoeba dispar
MFNSFTIILLVINFLIQNDYLPEL

SEQ ID NO: 2399901 - protein, 28 aa, Entamoeba dispar
MFPVDNRKWYEKIPALKWYKQFHKPRSI

SEQ ID NO: 2399902 - protein, 19 aa, Entamoeba dispar
MFREFLLRVHPQLYTHLLK

SEQ ID NO: 2399903 - protein, 21 aa, Entamoeba dispar
MFRFLFAFILEVPISIICRYI

SEQ ID NO: 2399904 - protein, 19 aa, Entamoeba dispar
MFSILFEIIELAPFVEFPE

SEQ ID NO: 2399905 - protein, 25 aa, Entamoeba dispar
MFSMIYELLPILNKKYRVMLITFIM

SEQ ID NO: 2399906 - protein, 31 aa, Entamoeba dispar
MGLVGYTIWIILTIFYFCLTWSYFNRAIYLT

SEQ ID NO: 2399907 - protein, 34 aa, Entamoeba dispar
MGMFCAAVVFIVLTLWWFYKALTFTGYVQPDDHC

SEQ ID NO: 2399908 - protein, 23 aa, Entamoeba dispar
MGVLILNILFISLVIASFIALFI

SEQ ID NO: 2399909 - protein, 18 aa, Entamoeba dispar
MHCNLKPQNILIYSYNSL

SEQ ID NO: 2399910 - protein, 36 aa, Entamoeba dispar
MHYSNPILIYLFTLLYIFIYCYTLISNILITGTDES

SEQ ID NO: 2399911 - protein, 25 aa, Entamoeba dispar
MICANSCFFLPFGYQTNLMVMKDGG

SEQ ID NO: 2399912 - protein, 17 aa, Entamoeba dispar
MIFLITGILFFISMFGF

SEQ ID NO: 2399913 - protein, 38 aa, Entamoeba dispar
MIIDVILFIIVWVTFFGIIVYLFYPALPPEIYPTPTIV

SEQ ID NO: 2399914 - protein, 19 aa, Entamoeba dispar
MIIELGVIIVFFIKCGKKL

SEQ ID NO: 2399915 - protein, 17 aa, Entamoeba dispar
MIILIHGFCTYAGVMKR

SEQ ID NO: 2399916 - protein, 17 aa, Entamoeba dispar
MIILLNFYNNPFNILRF

SEQ ID NO: 2399917 - protein, 17 aa, Entamoeba dispar
MIIYVLDIPFQENLLLL

SEQ ID NO: 2399918 - protein, 17 aa, Entamoeba dispar
MILVLLSFFLPMVATRD

SEQ ID NO: 2399919 - protein, 17 aa, Entamoeba dispar
MIMTSMPPVFIGAFEID

SEQ ID NO: 2399920 - protein, 27 aa, Entamoeba dispar
MIQNGLFEYKVFFTPKLIGEHLIIVSV

SEQ ID NO: 2399921 - protein, 26 aa, Entamoeba dispar
MIRNLFGTLLSFFDITPLGRLLNYFS

SEQ ID NO: 2399922 - protein, 34 aa, Entamoeba dispar
MISCIIMIVYLVFKSLFSLFLDYPAKPTVGLTRA

SEQ ID NO: 2399923 - protein, 23 aa, Entamoeba dispar
MISLHFYLDACFIFSLLNNTSNT

SEQ ID NO: 2399924 - protein, 22 aa, Entamoeba dispar
MISLILFIIHYFRRSIIFPLRI

SEQ ID NO: 2399925 - protein, 34 aa, Entamoeba dispar
MISLKNLKVLSLIGNPLIFYPRSLEPFCDVSLQQ

SEQ ID NO: 2399926 - protein, 22 aa, Entamoeba dispar
MISMMIFFMMLALSFFFGNQQT

SEQ ID NO: 2399927 - protein, 17 aa, Entamoeba dispar
MISNFKKFAYKIGGICY

SEQ ID NO: 2399928 - protein, 29 aa, Entamoeba dispar
MITKIIYDMFLFLKLFKTFNIKRGNETKQ

SEQ ID NO: 2399929 - protein, 26 aa, Entamoeba dispar
MITLMSLLILPLTFFKNLSALKFTSI

SEQ ID NO: 2399930 - protein, 22 aa, Entamoeba dispar
MIYGALFPIFSYYLCESIVMLV

SEQ ID NO: 2399931 - protein, 27 aa, Entamoeba dispar
MKDADLALMAKKPLRFTSDIIVNRLTL

SEQ ID NO: 2399932 - protein, 28 aa, Entamoeba dispar
MKDFGAIAILFLPMAFIASLFGMNVTVP

SEQ ID NO: 2399933 - protein, 29 aa, Entamoeba dispar
MKDKQKLLQPYLITFIDSLFPKGKLTEIK

SEQ ID NO: 2399934 - protein, 23 aa, Entamoeba dispar
MKEFIHPLNYLIESIEYHPNITS

SEQ ID NO: 2399935 - protein, 34 aa, Entamoeba dispar
MKEKKPVKQKWLWSLYIILTVMSIITLALTITTL

SEQ ID NO: 2399936 - protein, 23 aa, Entamoeba dispar
MKEVALYTHHLLDHNFTEWNIDS

SEQ ID NO: 2399937 - protein, 27 aa, Entamoeba dispar
MKEYIQLFLPIILLMGKTALPQIRVKC

SEQ ID NO: 2399938 - protein, 25 aa, Entamoeba dispar
MKFFNKYLRYLSYLNPYNYCHKNEE

SEQ ID NO: 2399939 - protein, 17 aa, Entamoeba dispar
MKGLPLDLFSLTNLSIL

SEQ ID NO: 2399940 - protein, 19 aa, Entamoeba dispar
MKGVAYFDLLVYYHKKIQK

SEQ ID NO: 2399941 - protein, 23 aa, Entamoeba dispar
MKHLQLFGIIVWTVNGTLELRCK

SEQ ID NO: 2399942 - protein, 25 aa, Entamoeba dispar
MKIKPSYEWFLGGLVFILIVCTPCL

SEQ ID NO: 2399943 - protein, 33 aa, Entamoeba dispar
MKKAMCWRKWKLWIIIGVIAAIIIIVIIVAIVI

SEQ ID NO: 2399944 - protein, 18 aa, Entamoeba dispar
MKKIMIYPESLNSTHLEI

SEQ ID NO: 2399945 - protein, 25 aa, Entamoeba dispar
MKKVYPTIILGIPRIYEKIIEKMKQ

SEQ ID NO: 2399946 - protein, 35 aa, Entamoeba dispar
MKKWPENALIAIGGFLFLRFINPAIVSPQRFGSRM

SEQ ID NO: 2399947 - protein, 24 aa, Entamoeba dispar
MKLKQDFLTPFLKSLSIALSNNLS

SEQ ID NO: 2399948 - protein, 27 aa, Entamoeba dispar
MKLTEIFKVFILRFNFKSKENILINSF

SEQ ID NO: 2399949 - protein, 30 aa, Entamoeba dispar
MKPLLYVEFIVNCYLLLSWIYECIVNLHTQ

SEQ ID NO: 2399950 - protein, 23 aa, Entamoeba dispar
MKSIRSSIYFEKGQWDYEANSLD

SEQ ID NO: 2399951 - protein, 27 aa, Entamoeba dispar
MLCSLLILHIYWFKLIIEMIFKVASHE

SEQ ID NO: 2399952 - protein, 43 aa, Entamoeba dispar
MLGMKMTPYWVLHIVYFFCIFLIQFILYCLLGVLFGVTFILDV

SEQ ID NO: 2399953 - protein, 29 aa, Entamoeba dispar
MLIFIMTVAFIIKIIWYRGVIRENSGLLM

SEQ ID NO: 2399954 - protein, 20 aa, Entamoeba dispar
MLIINRILNLFFQIELNLQS

SEQ ID NO: 2399955 - protein, 17 aa, Entamoeba dispar
MLILNNFNLEIKAGHSV

SEQ ID NO: 2399956 - protein, 17 aa, Entamoeba dispar
MLPSYKFIKTTWDLFVK

SEQ ID NO: 2399957 - protein, 19 aa, Entamoeba dispar
MLQIITWEDPFPKTEFKFP

SEQ ID NO: 2399958 - protein, 24 aa, Entamoeba dispar
MLQIITWEDPFPKTLYPHPWDTAN

SEQ ID NO: 2399959 - protein, 39 aa, Entamoeba dispar
MLQTPVFYALVLLIPLILFSKDFLWRHLKRKFIPSSNHI

SEQ ID NO: 2399960 - protein, 18 aa, Entamoeba dispar
MLSSYKYCYSCKSGYYLF

SEQ ID NO: 2399961 - protein, 25 aa, Entamoeba dispar
MLTNIAPDFLLYEPSKISNGMVSAF

SEQ ID NO: 2399962 - protein, 17 aa, Entamoeba dispar
MLTPLTCRCGKTKIMPP

SEQ ID NO: 2399963 - protein, 22 aa, Entamoeba dispar
MLTQLRHKCVVEFIGAVYTEGE

SEQ ID NO: 2399964 - protein, 41 aa, Entamoeba dispar
MLVEYILNFFPIQLTILIITILILITCAFQSIIMAFRVIFT

SEQ ID NO: 2399965 - protein, 26 aa, Entamoeba dispar
MLVIDPLAFRSWDDYVLNNLKHSEQL

SEQ ID NO: 2399966 - protein, 30 aa, Entamoeba dispar
MMDDMPMFAFMMLIMLFVFEGMTTLTRLKN

SEQ ID NO: 2399967 - protein, 23 aa, Entamoeba dispar
MMERIRCPYIVNFIGSVVTYDTL

SEQ ID NO: 2399968 - protein, 18 aa, Entamoeba dispar
MMFIGMFGCLFVFEGKHL

SEQ ID NO: 2399969 - protein, 18 aa, Entamoeba dispar
MMILLTSILLVFLQIITP

SEQ ID NO: 2399970 - protein, 24 aa, Entamoeba dispar
MMIPKPILIYILKKKDQKRNENGQ

SEQ ID NO: 2399971 - protein, 18 aa, Entamoeba dispar
MMIYVLFYLIFKIFLIVI

SEQ ID NO: 2399972 - protein, 18 aa, Entamoeba dispar
MMKQAILPIIDDFLEDFL

SEQ ID NO: 2399973 - protein, 33 aa, Entamoeba dispar
MMMQPMNYLINLVFTYLCGYYQINIVPMVVKKS

SEQ ID NO: 2399974 - protein, 27 aa, Entamoeba dispar
MMSCIVTIPWIIFYFIIEKQYEYTINF

SEQ ID NO: 2399975 - protein, 23 aa, Entamoeba dispar
MMYSIVLILISESSYRLLNETLQ

SEQ ID NO: 2399976 - protein, 26 aa, Entamoeba dispar
MNEVMKKLYDQGLFSYLVIDEAHCIS

SEQ ID NO: 2399977 - protein, 25 aa, Entamoeba dispar
MNGSSKWWYSVVIYEHTLGIKSVEV

SEQ ID NO: 2399978 - protein, 26 aa, Entamoeba dispar
MNLHNDIIVLLLKLLRSSFLINVDKT

SEQ ID NO: 2399979 - protein, 25 aa, Entamoeba dispar
MNMSTYFFWLVVPLLMQDRDASSFQ

SEQ ID NO: 2399980 - protein, 17 aa, Entamoeba dispar
MNSLLELIKSGSLGRMP

SEQ ID NO: 2399981 - protein, 19 aa, Entamoeba dispar
MNTSNIKWIPLSGRSQILV

SEQ ID NO: 2399982 - protein, 19 aa, Entamoeba dispar
MNWLGDWGSQFGLLAIGFE

SEQ ID NO: 2399983 - protein, 24 aa, Entamoeba dispar
MNWYHFVLLFFVYYLSFSTFLIAI

SEQ ID NO: 2399984 - protein, 20 aa, Entamoeba dispar
MNYVAYLMFPLICLCIKITF

SEQ ID NO: 2399985 - protein, 17 aa, Entamoeba dispar
MPFFLCLLSLISLLFSF

SEQ ID NO: 2399986 - protein, 17 aa, Entamoeba dispar
MPPIGEGAFGMVFRGTY

SEQ ID NO: 2399987 - protein, 17 aa, Entamoeba dispar
MPQLFLEEFQNILLPIL

SEQ ID NO: 2399988 - protein, 25 aa, Entamoeba dispar
MPTDPNWFKIVRLPNATYDKCTAPT

SEQ ID NO: 2399989 - protein, 23 aa, Entamoeba dispar
MQIFWYIVYYGMIAFAAIILPFG

SEQ ID NO: 2399990 - protein, 33 aa, Entamoeba dispar
MQILTSFCFQLSIKWIFVLSLRLRNGLISMIYE

SEQ ID NO: 2399991 - protein, 17 aa, Entamoeba dispar
MQVILKEIAAELKYFIQ

SEQ ID NO: 2399992 - protein, 19 aa, Entamoeba dispar
MRCPYIINFIGAVDTPGYY

SEQ ID NO: 2399993 - protein, 19 aa, Entamoeba dispar
MRESFVFLEAIKKAFISQF

SEQ ID NO: 2399994 - protein, 19 aa, Entamoeba dispar
MRFLAIYIPHISVICAIII

SEQ ID NO: 2399995 - protein, 24 aa, Entamoeba dispar
MRFLSIYLPHISIICAIIFAAYPT

SEQ ID NO: 2399996 - protein, 17 aa, Entamoeba dispar
MRGRLLASYIKASGQVI

SEQ ID NO: 2399997 - protein, 26 aa, Entamoeba dispar
MRQGQTLISFFYPAKNLKLLDLAVKK

SEQ ID NO: 2399998 - protein, 33 aa, Entamoeba dispar
MSCIIVSFFVILLFNIVFFVIKNCFLNEPSIVE

SEQ ID NO: 2399999 - protein, 48 aa, Entamoeba dispar
MSCSKTNWALIIPLIIVAVIIIIIILIVIIGIIWWRRRKSVKAESTAI

SEQ ID NO: 2400000 - protein, 48 aa, Entamoeba dispar
MSCSKTNWALIIPLIIVGIIIIIVIISIIIAIVWWRRKKTAKAESKAI

SEQ ID NO: 2400001 - protein, 48 aa, Entamoeba dispar
MSCSKTNWALIIPLVIVAVIIIIILLLVLIGIIWWRRSRSVKAETAAI

SEQ ID NO: 2400002 - protein, 17 aa, Entamoeba dispar
MSLLFLLIGLITSLKYM

SEQ ID NO: 2400003 - protein, 25 aa, Entamoeba dispar
MSMCFVFILAIILFVYCISIILSHS

SEQ ID NO: 2400004 - protein, 23 aa, Entamoeba dispar
MSNSDPLFIAFSGKKAYSYQGKF

SEQ ID NO: 2400005 - protein, 17 aa, Entamoeba dispar
MSPFIVLSMTLLAVFAT

SEQ ID NO: 2400006 - protein, 24 aa, Entamoeba dispar
MSPFIVLSMTLLAVFATKFTVLGE

SEQ ID NO: 2400007 - protein, 24 aa, Entamoeba dispar
MSRNPLILLIKAKGKIFGAYMNDS

SEQ ID NO: 2400008 - protein, 38 aa, Entamoeba dispar
MSSFTPRILIYRKLPLFNIPRFPYPLSYIPLMKEVTIN

SEQ ID NO: 2400009 - protein, 26 aa, Entamoeba dispar
MSTYPIFLNWYNFFIAFGLVLMATFI

SEQ ID NO: 2400010 - protein, 24 aa, Entamoeba dispar
MSYSSCNYVILPSLLVIRSNSTTL

SEQ ID NO: 2400011 - protein, 26 aa, Entamoeba dispar
MTDCSLFFFYVLMRMAFKPIMAKLFG

SEQ ID NO: 2400012 - protein, 22 aa, Entamoeba dispar
MTDVWWNIITQCWDHIPSKRPT

SEQ ID NO: 2400013 - protein, 23 aa, Entamoeba dispar
MTFFDDVYLPDTSLSIDGTCIFK

SEQ ID NO: 2400014 - protein, 18 aa, Entamoeba dispar
MTFTKGIGSPKYMAPEIL

SEQ ID NO: 2400015 - protein, 43 aa, Entamoeba dispar
MTGIIIGCVLAGIIILLIIITTISLILFIRIERSIKKRSAEAI

SEQ ID NO: 2400016 - protein, 21 aa, Entamoeba dispar
MTKFDYLAIRNLIITLRQIKP

SEQ ID NO: 2400017 - protein, 17 aa, Entamoeba dispar
MTNMTFTKGIGTPVYMA

SEQ ID NO: 2400018 - protein, 34 aa, Entamoeba dispar
MTNTLRNIFNAIISYLIDLFPNDTSFAYYVNSQN

SEQ ID NO: 2400019 - protein, 25 aa, Entamoeba dispar
MVAIGLLFHLHFLSLQRWLDEDQRE

SEQ ID NO: 2400020 - protein, 17 aa, Entamoeba dispar
MVCSIICALLAILPAFS

SEQ ID NO: 2400021 - protein, 30 aa, Entamoeba dispar
MVDPNNRYIGYFYLVSFFGTFANAGKKYVY

SEQ ID NO: 2400022 - protein, 24 aa, Entamoeba dispar
MVELSFEYFVANNLLNRLAVCIGK

SEQ ID NO: 2400023 - protein, 22 aa, Entamoeba dispar
MVFFVIFTICLCLLYFCDWKVH

SEQ ID NO: 2400024 - protein, 17 aa, Entamoeba dispar
MVFNGMMFISLLLCGEL

SEQ ID NO: 2400025 - protein, 26 aa, Entamoeba dispar
MVINYRRPFLSYLEYKETIPLRTFRL

SEQ ID NO: 2400026 - protein, 19 aa, Entamoeba dispar
MVIQYFQLGSLGDYIRHEK

SEQ ID NO: 2400027 - protein, 22 aa, Entamoeba dispar
MVITEIDADLYRLVEPTQVIIS

SEQ ID NO: 2400028 - protein, 17 aa, Entamoeba dispar
MVMFIYISLSLGNSFYH

SEQ ID NO: 2400029 - protein, 19 aa, Entamoeba dispar
MVPALFLRRIYDIGMSKFD

SEQ ID NO: 2400030 - protein, 17 aa, Entamoeba dispar
MVPYTILDWNLNAEPSN

SEQ ID NO: 2400031 - protein, 17 aa, Entamoeba dispar
MVSNMFIGLLAYVNLYC

SEQ ID NO: 2400032 - protein, 24 aa, Entamoeba dispar
MVVDQFILLYKEKVFQCCFPLDFV

SEQ ID NO: 2400033 - protein, 26 aa, Entamoeba dispar
MVVIVLMVVAIFIYEFIQKKRYNRFS

SEQ ID NO: 2400034 - protein, 18 aa, Entamoeba dispar
MVVYVSLFVLIGGLLIIM

SEQ ID NO: 2400035 - protein, 18 aa, Entamoeba dispar
MWDVYYAPLFTYDERILL

SEQ ID NO: 2400036 - protein, 19 aa, Entamoeba dispar
MWTGITLLVFLVCSQIPLI

SEQ ID NO: 2400037 - protein, 17 aa, Entamoeba dispar
MWYGFRNVKLNDFFFSN

SEQ ID NO: 2400038 - protein, 19 aa, Entamoeba dispar
MYAFSYVLFWIPIQTSISR

SEQ ID NO: 2400039 - protein, 20 aa, Entamoeba dispar
MYHSLPITKPILSSSNKYIF

SEQ ID NO: 2400040 - protein, 23 aa, Entamoeba dispar
MYIGILFFCYFIAQTLVMSVMSF

SEQ ID NO: 2400041 - protein, 28 aa, Entamoeba dispar
MYIIVLIMWMIWIPLHFISSIRFDIFPI

SEQ ID NO: 2400042 - protein, 19 aa, Entamoeba dispar
MYLILIVVFFGWISWTPMK

SEQ ID NO: 2400043 - protein, 38 aa, Entamoeba dispar
MYNVPPCIHYLYPYGTLLLWIVFGFYSASLQTVMQFAL

SEQ ID NO: 2400044 - protein, 25 aa, Entamoeba dispar
MYSKKPLWVLKMIINIQISMNNKNI

SEQ ID NO: 2400045 - protein, 27 aa, Entamoeba dispar
MYVYKSDNLIRIFPIQFTRTKIYPGTR

SEQ ID NO: 2400046 - protein, 23 aa, Entamoeba dispar
NAFCFYFLIEYLYLNSNQFYSID

SEQ ID NO: 2400047 - protein, 36 aa, Entamoeba dispar
NAHFTFFVMAVVPLINFLLLLLIPKSINYPKEEVQY

SEQ ID NO: 2400048 - protein, 19 aa, Entamoeba dispar
NAIAFRPLAVSLFGRYLKA

SEQ ID NO: 2400049 - protein, 24 aa, Entamoeba dispar
NAIQVTFKIKVLCTCSLSDQLGIS

SEQ ID NO: 2400050 - protein, 17 aa, Entamoeba dispar
NAIRRPFMNFGYFVSCV

SEQ ID NO: 2400051 - protein, 21 aa, Entamoeba dispar
NALALQLKWANLTYLRDGKPQ

SEQ ID NO: 2400052 - protein, 17 aa, Entamoeba dispar
NALLVLMSDEIGFNAVV

SEQ ID NO: 2400053 - protein, 23 aa, Entamoeba dispar
NALQMLWVNMIMDTLAALALGTE

SEQ ID NO: 2400054 - protein, 29 aa, Entamoeba dispar
NAPSCVPIQFLLIPLVLVQAVGIALLVLS

SEQ ID NO: 2400055 - protein, 21 aa, Entamoeba dispar
NARDWAISRNRFWGTPIPIWT

SEQ ID NO: 2400056 - protein, 26 aa, Entamoeba dispar
NARKTYYINVIPTLFKYPSYTLRTYQ

SEQ ID NO: 2400057 - protein, 23 aa, Entamoeba dispar
NASLYLKKIAPPLGTLMSASKAY

SEQ ID NO: 2400058 - protein, 39 aa, Entamoeba dispar
NASMRYFILVLIVLVIVILIMVLIFFKSALVPLRVVFTT

SEQ ID NO: 2400059 - protein, 24 aa, Entamoeba dispar
NASSFILIPTILKSIQKLEKLPNI

SEQ ID NO: 2400060 - protein, 25 aa, Entamoeba dispar
NASSFILTVFSAFWILSDGTCSIHQ

SEQ ID NO: 2400061 - protein, 31 aa, Entamoeba dispar
NASSVLHYILDLPIIALLLTIIPPGTVDHEK

SEQ ID NO: 2400062 - protein, 25 aa, Entamoeba dispar
NATNDPFIIDYFKRMVLVKENLFEK

SEQ ID NO: 2400063 - protein, 17 aa, Entamoeba dispar
NCCFIPSKIIFNNAINY

SEQ ID NO: 2400064 - protein, 18 aa, Entamoeba dispar
NCENAVSINLPFTRTQNV

SEQ ID NO: 2400065 - protein, 31 aa, Entamoeba dispar
NCISSWNIVFKSWNNILPMGIEVLKKASEIQ

SEQ ID NO: 2400066 - protein, 34 aa, Entamoeba dispar
NCKESFEICYGCFLCGLIPIFISPRVSIVEINKV

SEQ ID NO: 2400067 - protein, 19 aa, Entamoeba dispar
NCKIKLKIFLDASKGIQYL

SEQ ID NO: 2400068 - protein, 21 aa, Entamoeba dispar
NCSHIFYRNLFISIVFSSFHI

SEQ ID NO: 2400069 - protein, 24 aa, Entamoeba dispar
NCSNDIWTLLFPNGMTISLTPRKP

SEQ ID NO: 2400070 - protein, 33 aa, Entamoeba dispar
NCVAVKFNWWRITDLVDYFIIAVTIVVVAVPEG

SEQ ID NO: 2400071 - protein, 19 aa, Entamoeba dispar
NCVECFLPYFGYNGDCQIN

SEQ ID NO: 2400072 - protein, 31 aa, Entamoeba dispar
NCVSVLEMLFISFPLDFIGEYLLMFNSFPDK

SEQ ID NO: 2400073 - protein, 36 aa, Entamoeba dispar
NDCHSSGLFYLKPQYKVGYYAGLYYLDDKCTKETGL

SEQ ID NO: 2400074 - protein, 47 aa, Entamoeba dispar
NDDNFGKIYNFYLPCQAYVTATYHYSSLFNLTKYKLHLPQSEEFMKE

SEQ ID NO: 2400075 - protein, 29 aa, Entamoeba dispar
NDDNLVLMALPRYPLLTGWKTEFMIGYSL

SEQ ID NO: 2400076 - protein, 26 aa, Entamoeba dispar
NDDTMYYYFFSLPEELDLIFSFSFTE

SEQ ID NO: 2400077 - protein, 20 aa, Entamoeba dispar
NDFIKFKLISFSKPEIILIS

SEQ ID NO: 2400078 - protein, 19 aa, Entamoeba dispar
NDFIMQIMIQDGGVFFVEI

SEQ ID NO: 2400079 - protein, 17 aa, Entamoeba dispar
NDFSKQKFTFGHDSLII

SEQ ID NO: 2400080 - protein, 23 aa, Entamoeba dispar
NDGDDIDLALQKIYLVLGKVQQQ

SEQ ID NO: 2400081 - protein, 27 aa, Entamoeba dispar
NDGLKNPLNFYFYPEFEISDSKPFIFA

SEQ ID NO: 2400082 - protein, 21 aa, Entamoeba dispar
NDIKLLLPLSSFIPLIPSYAQ

SEQ ID NO: 2400083 - protein, 30 aa, Entamoeba dispar
NDIKTLSILIYKITFIFRNFQRVINNYFTV

SEQ ID NO: 2400084 - protein, 23 aa, Entamoeba dispar
NDIRILCRNQIPSSLRSSIYKLF

SEQ ID NO: 2400085 - protein, 35 aa, Entamoeba dispar
NDKHKYQWFFDASHLAYYLAYFTLIMLLGASDNFE

SEQ ID NO: 2400086 - protein, 32 aa, Entamoeba dispar
NDKLSYLWIFFTFIILYNNLVPISLYVCLEII

SEQ ID NO: 2400087 - protein, 29 aa, Entamoeba dispar
NDLLPNPLILLWAFIPFVLIYALRVLCIE

SEQ ID NO: 2400088 - protein, 19 aa, Entamoeba dispar
NDLPLWLIDGQCKSQTQIF

SEQ ID NO: 2400089 - protein, 17 aa, Entamoeba dispar
NDLYSLFLDNSSCFRTT

SEQ ID NO: 2400090 - protein, 23 aa, Entamoeba dispar
NDMYFDSLFIYLNEINLGKDKKH

SEQ ID NO: 2400091 - protein, 27 aa, Entamoeba dispar
NDMYLGLFFFIFYFAQTIAMVLMSLTT

SEQ ID NO: 2400092 - protein, 20 aa, Entamoeba dispar
NDNFVLTCRFLMKFRTTQLT

SEQ ID NO: 2400093 - protein, 36 aa, Entamoeba dispar
NDNNNYYYYHLPIQRTYFNSIPINLKFSSNNGIWYL

SEQ ID NO: 2400094 - protein, 23 aa, Entamoeba dispar
NDSYFHFDHIIITFGLKNKNIKL

SEQ ID NO: 2400095 - protein, 27 aa, Entamoeba dispar
NDTIKQIIYIIISILYQPLGNIVKKSI

SEQ ID NO: 2400096 - protein, 17 aa, Entamoeba dispar
NDTTKWKWGEYKQFHMI

SEQ ID NO: 2400097 - protein, 23 aa, Entamoeba dispar
NDVHYFIKPLFLNWAMFLGMTLC

SEQ ID NO: 2400098 - protein, 18 aa, Entamoeba dispar
NDVPLSYHLQIYSQSYSS

SEQ ID NO: 2400099 - protein, 29 aa, Entamoeba dispar
NDYGNEGFLLMIFYYLGCTLTLRKIKKEG

SEQ ID NO: 2400100 - protein, 21 aa, Entamoeba dispar
NDYILSASFLSYFQVRKYYLH

SEQ ID NO: 2400101 - protein, 25 aa, Entamoeba dispar
NDYSYYFNKAFKYSGLAFKCNRTYL

SEQ ID NO: 2400102 - protein, 25 aa, Entamoeba dispar
NDYSYYFNKDFTYSGLAFNCNRTYL

SEQ ID NO: 2400103 - protein, 26 aa, Entamoeba dispar
NEAWQYPIKLFVHLINIQTDRITSIP

SEQ ID NO: 2400104 - protein, 24 aa, Entamoeba dispar
NECILCYNGYQLQNKKCILYKEPC

SEQ ID NO: 2400105 - protein, 21 aa, Entamoeba dispar
NECMRLFMKIKRLLDSTQNIQ

SEQ ID NO: 2400106 - protein, 23 aa, Entamoeba dispar
NEDDLLKYMLFWKNSSVLVYDIE

SEQ ID NO: 2400107 - protein, 24 aa, Entamoeba dispar
NEDFKLYFNLINKFNSSQIPLLNN

SEQ ID NO: 2400108 - protein, 39 aa, Entamoeba dispar
NEEGVLLNCFLMILPVLKPHRRLAIALAIEYLKKMNSCI

SEQ ID NO: 2400109 - protein, 35 aa, Entamoeba dispar
NEFITFIIMTIIGILLIIFLFKFFDYSIQMSKNYS

SEQ ID NO: 2400110 - protein, 25 aa, Entamoeba dispar
NEFKELMNIIGINPVFICYMETMKN

SEQ ID NO: 2400111 - protein, 18 aa, Entamoeba dispar
NEFLYIVGVLAEIYISIG

SEQ ID NO: 2400112 - protein, 18 aa, Entamoeba dispar
NEFPFNKKVFLFTIIFPC

SEQ ID NO: 2400113 - protein, 27 aa, Entamoeba dispar
NEIEKYLKLILNLIHLLLIVEYVSPQS

SEQ ID NO: 2400114 - protein, 26 aa, Entamoeba dispar
NEIGDIPHLLLFKNINILIKDYLISP

SEQ ID NO: 2400115 - protein, 18 aa, Entamoeba dispar
NEIINYILKILFKHPRPP

SEQ ID NO: 2400116 - protein, 19 aa, Entamoeba dispar
NEILCISLTHFLLKKVVDC

SEQ ID NO: 2400117 - protein, 31 aa, Entamoeba dispar
NELDTLYSKELYLFWLFNVGNRKTKEDIICN

SEQ ID NO: 2400118 - protein, 23 aa, Entamoeba dispar
NENGILFKFLKNGKSFLTSQRIQ

SEQ ID NO: 2400119 - protein, 18 aa, Entamoeba dispar
NENLKPEPMYKLYISIEE

SEQ ID NO: 2400120 - protein, 28 aa, Entamoeba dispar
NENWKWKYLIHLSSYLTPTVLGKVFCML

SEQ ID NO: 2400121 - protein, 18 aa, Entamoeba dispar
NEPGLFGYYIADEPSTNC

SEQ ID NO: 2400122 - protein, 32 aa, Entamoeba dispar
NEPITIKYFGPPDELFIIPAVMTVLDPTSFEN

SEQ ID NO: 2400123 - protein, 26 aa, Entamoeba dispar
NEPKKQFIIHLFQLVLTGAVLVLDIK

SEQ ID NO: 2400124 - protein, 23 aa, Entamoeba dispar
NEPSCYQVFHDEIYMAMGTCVYY

SEQ ID NO: 2400125 - protein, 25 aa, Entamoeba dispar
NEQCSSLLFWAYLTSLFTLSIGMIG

SEQ ID NO: 2400126 - protein, 24 aa, Entamoeba dispar
NEQQFYRIAEISTLMLMDISLIST

SEQ ID NO: 2400127 - protein, 23 aa, Entamoeba dispar
NERPKFDANLFAIPSVLRNQLQK

SEQ ID NO: 2400128 - protein, 22 aa, Entamoeba dispar
NERRKLIRKLKESKIKLLNYQE

SEQ ID NO: 2400129 - protein, 27 aa, Entamoeba dispar
NERSRLLPYTLFRLGGAAILLTNKWNL

SEQ ID NO: 2400130 - protein, 30 aa, Entamoeba dispar
NERVFITTVVSTYLWDGLYVSLAKVTMRES

SEQ ID NO: 2400131 - protein, 23 aa, Entamoeba dispar
NESILLVALDMKKGKQFNCKINL

SEQ ID NO: 2400132 - protein, 27 aa, Entamoeba dispar
NETDCALLLFLKKIGISPSLIRSTNVI

SEQ ID NO: 2400133 - protein, 26 aa, Entamoeba dispar
NETRKKMIFINKKIQQIILYDKTFRG

SEQ ID NO: 2400134 - protein, 24 aa, Entamoeba dispar
NEVINYFKFISYNGKYRFNGVCNL

SEQ ID NO: 2400135 - protein, 25 aa, Entamoeba dispar
NEVPRRLKLKLLIDAAHGIKYLHQN

SEQ ID NO: 2400136 - protein, 33 aa, Entamoeba dispar
NEYKDFYVIQQGILLSFLNSYCLIKIKKQKKQA

SEQ ID NO: 2400137 - protein, 46 aa, Entamoeba dispar
NEYKKWYIQPIVLIKLLYNLIVLCLKYFGILLSPSLLLKKQWTPYS

SEQ ID NO: 2400138 - protein, 27 aa, Entamoeba dispar
NFAGIFGFFLLFIIPGVLQIYSKFIIR

SEQ ID NO: 2400139 - protein, 34 aa, Entamoeba dispar
NFDKNYYYMMIMDMILLLIRLLQEKEFEDECYRI

SEQ ID NO: 2400140 - protein, 25 aa, Entamoeba dispar
NFDYSYPIDVYAYGIVLYETYIEKG

SEQ ID NO: 2400141 - protein, 17 aa, Entamoeba dispar
NFFVNMSHYMFRASVDE

SEQ ID NO: 2400142 - protein, 33 aa, Entamoeba dispar
NFIGTSIFINIKFIPNIIFISSTPFPITYNEST

SEQ ID NO: 2400143 - protein, 24 aa, Entamoeba dispar
NFIIPKDVYFDFNTLAKKPKPVDA

SEQ ID NO: 2400144 - protein, 25 aa, Entamoeba dispar
NFIKIPKKIFISLIGKGFNGLVKEI

SEQ ID NO: 2400145 - protein, 17 aa, Entamoeba dispar
NFILKKNVFMACESPNS

SEQ ID NO: 2400146 - protein, 18 aa, Entamoeba dispar
NFILLKRSMIIFNKRRKE

SEQ ID NO: 2400147 - protein, 19 aa, Entamoeba dispar
NFIYIALTYCECTLEQHIN

SEQ ID NO: 2400148 - protein, 23 aa, Entamoeba dispar
NFKILIQLYQAFCKFALIYIRAN

SEQ ID NO: 2400149 - protein, 20 aa, Entamoeba dispar
NFKILYIDNVPYYGILTNVH

SEQ ID NO: 2400150 - protein, 34 aa, Entamoeba dispar
NFKVVWVCYIYQIALILFGILYQYTPKILKPIED

SEQ ID NO: 2400151 - protein, 19 aa, Entamoeba dispar
NFLGEILRSIKFIKYNAWE

SEQ ID NO: 2400152 - protein, 26 aa, Entamoeba dispar
NFLNYYLMHFLFFTALCFVGAIIMIL

SEQ ID NO: 2400153 - protein, 23 aa, Entamoeba dispar
NFNQQPIIILSNTSKLTGLKSIQ

SEQ ID NO: 2400154 - protein, 24 aa, Entamoeba dispar
NFPSTTIHFFLFNSSKIQLQNNTS

SEQ ID NO: 2400155 - protein, 22 aa, Entamoeba dispar
NFQLYVPQIITKGKIGYSLSSD

SEQ ID NO: 2400156 - protein, 17 aa, Entamoeba dispar
NFRAIVFIKRGLSGIEV

SEQ ID NO: 2400157 - protein, 21 aa, Entamoeba dispar
NFTTSWKDGKAFCALVHHFKP

SEQ ID NO: 2400158 - protein, 26 aa, Entamoeba dispar
NFVSFNFFIMYFAQTIMFGIMSITDK

SEQ ID NO: 2400159 - protein, 25 aa, Entamoeba dispar
NFYNGFLFPLLFYSTWQSFYLIYTE

SEQ ID NO: 2400160 - protein, 18 aa, Entamoeba dispar
NGAFSFLSTFFVGILLLS

SEQ ID NO: 2400161 - protein, 24 aa, Entamoeba dispar
NGEDPFNIIRKFGKKYIGLRSPHA

SEQ ID NO: 2400162 - protein, 28 aa, Entamoeba dispar
NGEDPFNIIRKFGKKYIGLRSPHAQFEK

SEQ ID NO: 2400163 - protein, 21 aa, Entamoeba dispar
NGEFIIILNSLNNWLEKINKE

SEQ ID NO: 2400164 - protein, 34 aa, Entamoeba dispar
NGEICPIPHSFLIFIRIISLFIMTVPSAFEFSQQ

SEQ ID NO: 2400165 - protein, 17 aa, Entamoeba dispar
NGEKIIGPWYVRRKKIQ

SEQ ID NO: 2400166 - protein, 42 aa, Entamoeba dispar
NGFERIKANLFLANFIRDLMRFWKLTYVVGLIDMVMDWYAFG

SEQ ID NO: 2400167 - protein, 23 aa, Entamoeba dispar
NGFFSWALIHLFTLSFIVTAFGA

SEQ ID NO: 2400168 - protein, 30 aa, Entamoeba dispar
NGGILIIVIIISFFIGWHMVMAIGGADMPV

SEQ ID NO: 2400169 - protein, 26 aa, Entamoeba dispar
NGIEDYKGFSWIRIVLKSGSKTPTLN

SEQ ID NO: 2400170 - protein, 24 aa, Entamoeba dispar
NGIEVIHLFTGKPLLHVSLSSSTM

SEQ ID NO: 2400171 - protein, 30 aa, Entamoeba dispar
NGINDGLIILIMWMNLFSYDINPIPKEIED

SEQ ID NO: 2400172 - protein, 26 aa, Entamoeba dispar
NGIQQLVKPVWYILNSTKDTTFTVST

SEQ ID NO: 2400173 - protein, 22 aa, Entamoeba dispar
NGKYLDLYRTQLALRKEKHEEA

SEQ ID NO: 2400174 - protein, 22 aa, Entamoeba dispar
NGLIIIRSIFMLLMLDCSKEED

SEQ ID NO: 2400175 - protein, 30 aa, Entamoeba dispar
NGLKNYLIIIRYYCLLLKYNYIDENCSIIN

SEQ ID NO: 2400176 - protein, 20 aa, Entamoeba dispar
NGLKYYLEAYVFKDILKNPP

SEQ ID NO: 2400177 - protein, 41 aa, Entamoeba dispar
NGLSTGMKVFIGIFIVVAVITIIAGIIAIIFAVVKTKKSGY

SEQ ID NO: 2400178 - protein, 29 aa, Entamoeba dispar
NGLVLGWVHAFIFWKYSVLMYVAGQELKK

SEQ ID NO: 2400179 - protein, 17 aa, Entamoeba dispar
NGNEFMIRCQCALRRIS

SEQ ID NO: 2400180 - protein, 21 aa, Entamoeba dispar
NGNIDFYLDDIKLILKEGSCN

SEQ ID NO: 2400181 - protein, 35 aa, Entamoeba dispar
NGQKCDLVPVWWNFIVVIIIISIIIKSCVIIGTAL

SEQ ID NO: 2400182 - protein, 24 aa, Entamoeba dispar
NGRVIIFIIRCSILFVTTLCACFV

SEQ ID NO: 2400183 - protein, 25 aa, Entamoeba dispar
NGTTPLMLSLYKNFPDIIKILLNAN

SEQ ID NO: 2400184 - protein, 17 aa, Entamoeba dispar
NGTVCIANFFATERQVD

SEQ ID NO: 2400185 - protein, 33 aa, Entamoeba dispar
NGVPISSYLLPSCTFFLGFSFIFGNYMKRVWES

SEQ ID NO: 2400186 - protein, 18 aa, Entamoeba dispar
NGVQPLIIGILSFILLLI

SEQ ID NO: 2400187 - protein, 17 aa, Entamoeba dispar
NGYAIFHMLRWTQGNEA

SEQ ID NO: 2400188 - protein, 22 aa, Entamoeba dispar
NGYTKDCTGCQPGYMWFGEGNC

SEQ ID NO: 2400189 - protein, 17 aa, Entamoeba dispar
NHEHRLYFFVYVTSDQS

SEQ ID NO: 2400190 - protein, 25 aa, Entamoeba dispar
NHFSHNLFIYPLKVTSSSFSLKKKF

SEQ ID NO: 2400191 - protein, 18 aa, Entamoeba dispar
NHPFFPWIDTAMSWETLV

SEQ ID NO: 2400192 - protein, 29 aa, Entamoeba dispar
NHQEKIFSLWGFIISYIVSKGGIVTVKLP

SEQ ID NO: 2400193 - protein, 18 aa, Entamoeba dispar
NHQELKKIFLLENDKKNL

SEQ ID NO: 2400194 - protein, 30 aa, Entamoeba dispar
NHQQLLDYINLLHAKLHIIKIGLSNKFIGE

SEQ ID NO: 2400195 - protein, 26 aa, Entamoeba dispar
NHSKKKWLMVIFHTPNSPKYVFYFDP

SEQ ID NO: 2400196 - protein, 24 aa, Entamoeba dispar
NIAVTLSIFYNWNDSGQLPTSFFS

SEQ ID NO: 2400197 - protein, 17 aa, Entamoeba dispar
NIAWRRTIGKNGKKITA

SEQ ID NO: 2400198 - protein, 18 aa, Entamoeba dispar
NICFIITFGYLLYRHIYL

SEQ ID NO: 2400199 - protein, 47 aa, Entamoeba dispar
NICKRKSMWWISLIVIPIFILIVIMIYFILTLISKKIIRLKQDNTLN

SEQ ID NO: 2400200 - protein, 20 aa, Entamoeba dispar
NIDHDIILYNFISVKQINVN

SEQ ID NO: 2400201 - protein, 27 aa, Entamoeba dispar
NIDNDKKMYLIPRKSLGGIPIDVPEEI

SEQ ID NO: 2400202 - protein, 20 aa, Entamoeba dispar
NIDNGLLDIIKNFFGFQFKE

SEQ ID NO: 2400203 - protein, 28 aa, Entamoeba dispar
NIFIISQLLFKRFPTNFLINLFGSWSVV

SEQ ID NO: 2400204 - protein, 29 aa, Entamoeba dispar
NIFIISQLLFKRFPTNFLINLFGSWSVVS

SEQ ID NO: 2400205 - protein, 19 aa, Entamoeba dispar
NIFNWKKALIVLFQGMTMA

SEQ ID NO: 2400206 - protein, 26 aa, Entamoeba dispar
NIFSNYMFVGIVSMTIIVQTLIVVFA

SEQ ID NO: 2400207 - protein, 25 aa, Entamoeba dispar
NIGIQSLYFAILSTMGYTLLLEKPK

SEQ ID NO: 2400208 - protein, 20 aa, Entamoeba dispar
NIHSLKLNTLYSSSLIIPLE

SEQ ID NO: 2400209 - protein, 32 aa, Entamoeba dispar
NIIKKSFGYYIFIVELFLVSLPIKGHILKQQF

SEQ ID NO: 2400210 - protein, 19 aa, Entamoeba dispar
NIILDIDQEVKDTKIYSVF

SEQ ID NO: 2400211 - protein, 20 aa, Entamoeba dispar
NIIMYLTQFSFLFFNGYSGT

SEQ ID NO: 2400212 - protein, 21 aa, Entamoeba dispar
NIINEVLIYNLFKQYNITNIF

SEQ ID NO: 2400213 - protein, 24 aa, Entamoeba dispar
NIIQPYLIESILTNIQPIRKVIAE

SEQ ID NO: 2400214 - protein, 21 aa, Entamoeba dispar
NIIRIKSIIPVLNIIPSKQRP

SEQ ID NO: 2400215 - protein, 20 aa, Entamoeba dispar
NIKLIWNFIVKIWDVITEFV

SEQ ID NO: 2400216 - protein, 26 aa, Entamoeba dispar
NIKNDWSCLFVLWLSITIQFKINNNH

SEQ ID NO: 2400217 - protein, 25 aa, Entamoeba dispar
NIKSYPIWTNWWGENFHWRERVDEV

SEQ ID NO: 2400218 - protein, 24 aa, Entamoeba dispar
NIKTKLCYPFVYVWNKFPSIVRSS

SEQ ID NO: 2400219 - protein, 28 aa, Entamoeba dispar
NILAPLVVLILLYTPLKLDYVWRTALAL

SEQ ID NO: 2400220 - protein, 26 aa, Entamoeba dispar
NILFIFMEQYLFLIKYEFHIFIQMEY

SEQ ID NO: 2400221 - protein, 24 aa, Entamoeba dispar
NILGCLCIFFFIMQLIYKYLRGVI

SEQ ID NO: 2400222 - protein, 18 aa, Entamoeba dispar
NILGHIFYKPKNAILLMI

SEQ ID NO: 2400223 - protein, 20 aa, Entamoeba dispar
NILKQYGYNLGLTVIETYRF

SEQ ID NO: 2400224 - protein, 24 aa, Entamoeba dispar
NILKTYLLYIVIQKNIVLTVHSEP

SEQ ID NO: 2400225 - protein, 17 aa, Entamoeba dispar
NILLPKLEESINKSHST

SEQ ID NO: 2400226 - protein, 20 aa, Entamoeba dispar
NILLYYFITLFLYSFITLFL

SEQ ID NO: 2400227 - protein, 21 aa, Entamoeba dispar
NILQQILYICETILTEIIDCF

SEQ ID NO: 2400228 - protein, 30 aa, Entamoeba dispar
NIMSFGRQINLYLLSLLSNKKQLILKKEDK

SEQ ID NO: 2400229 - protein, 18 aa, Entamoeba dispar
NIMYLIMIGLETVLGIFI

SEQ ID NO: 2400230 - protein, 28 aa, Entamoeba dispar
NINELVFQFLIQLSIYRSMIAFKLDATE

SEQ ID NO: 2400231 - protein, 18 aa, Entamoeba dispar
NINGFGFRIKRPERRSQK

SEQ ID NO: 2400232 - protein, 17 aa, Entamoeba dispar
NINKIIYYIGITGIDCY

SEQ ID NO: 2400233 - protein, 21 aa, Entamoeba dispar
NINNLFCPIVVYLNTNGVDKL

SEQ ID NO: 2400234 - protein, 22 aa, Entamoeba dispar
NIPDIQLISKIMWVVSCFLISY

SEQ ID NO: 2400235 - protein, 27 aa, Entamoeba dispar
NIPVIQLMHFFPVIMSNLFGMFNNHRI

SEQ ID NO: 2400236 - protein, 20 aa, Entamoeba dispar
NIRPQIFVGISMFNVLPAFS

SEQ ID NO: 2400237 - protein, 21 aa, Entamoeba dispar
NIRYFDYIFRIIETMSFYIVT

SEQ ID NO: 2400238 - protein, 24 aa, Entamoeba dispar
NISSLPIHYGYYKLLSELVLRYKK

SEQ ID NO: 2400239 - protein, 17 aa, Entamoeba dispar
NISVLFAGIVIGAISTI

SEQ ID NO: 2400240 - protein, 37 aa, Entamoeba dispar
NISWNGFTYVFQSFTFYLITIFTIIISVAPLILKRFI

SEQ ID NO: 2400241 - protein, 27 aa, Entamoeba dispar
NITVITIYSISFWYPGIISYDGLFSMA

SEQ ID NO: 2400242 - protein, 17 aa, Entamoeba dispar
NITVQSKPEWLTLCKKS

SEQ ID NO: 2400243 - protein, 26 aa, Entamoeba dispar
NIVMISSIVFYWFYPHEFKLHENLIV

SEQ ID NO: 2400244 - protein, 36 aa, Entamoeba dispar
NIVTQAIYQLFVLLFLLYCGRYISFLNAPCAYINHG

SEQ ID NO: 2400245 - protein, 18 aa, Entamoeba dispar
NIYISTLCSLFKLGRIPA

SEQ ID NO: 2400246 - protein, 29 aa, Entamoeba dispar
NIYTTLTFFGIFAEFITALTLAARVEESR

SEQ ID NO: 2400247 - protein, 29 aa, Entamoeba dispar
NKAICIGVLVLWLALLITFSLTSKIEDME

SEQ ID NO: 2400248 - protein, 25 aa, Entamoeba dispar
NKCIEPLIVLLTFSSSLDLTLLQLI

SEQ ID NO: 2400249 - protein, 18 aa, Entamoeba dispar
NKCIPGKLLVSCLNGKIY

SEQ ID NO: 2400250 - protein, 24 aa, Entamoeba dispar
NKCTKCLPDYFLKDGYCYSCYKCK

SEQ ID NO: 2400251 - protein, 17 aa, Entamoeba dispar
NKCVLIVGFVIILGLIA

SEQ ID NO: 2400252 - protein, 19 aa, Entamoeba dispar
NKCVLIVGFVIILGLIAGG

SEQ ID NO: 2400253 - protein, 17 aa, Entamoeba dispar
NKCYYFFSQDQLEMQKK

SEQ ID NO: 2400254 - protein, 24 aa, Entamoeba dispar
NKDVIQLLLKWIKSEVNEIVLPAV

SEQ ID NO: 2400255 - protein, 20 aa, Entamoeba dispar
NKDYYLLVHGYYGSPLDTFT

SEQ ID NO: 2400256 - protein, 41 aa, Entamoeba dispar
NKEGCIYHVIWWIVLLEIIIALFILIIIISIVCVITKIFIY

SEQ ID NO: 2400257 - protein, 37 aa, Entamoeba dispar
NKEIVWWMIMIIIIIILIIIIIIITIIIIMINYIIKR

SEQ ID NO: 2400258 - protein, 37 aa, Entamoeba dispar
NKEIVWWMIMIIIIIILIIIITIIIIIIIMINYIIKR

SEQ ID NO: 2400259 - protein, 46 aa, Entamoeba dispar
NKEKNWRLGLYIICPLLGVLLIGNIFVIVLYIIRKFRNNSYTSLSV

SEQ ID NO: 2400260 - protein, 41 aa, Entamoeba dispar
NKELSKIITLIQNYALMLINIKIILIHQFKKSNNILLQSNG

SEQ ID NO: 2400261 - protein, 24 aa, Entamoeba dispar
NKEQKWIWPTAIRFVPLFACASVF

SEQ ID NO: 2400262 - protein, 30 aa, Entamoeba dispar
NKEVIFNIITRWYIIISIGLIAFSMTFLMG

SEQ ID NO: 2400263 - protein, 26 aa, Entamoeba dispar
NKEWNKYLLFIYDNQNKKPNILLKYL

SEQ ID NO: 2400264 - protein, 25 aa, Entamoeba dispar
NKEYIQTLLTYFLNVPFKVIIKVEY

SEQ ID NO: 2400265 - protein, 29 aa, Entamoeba dispar
NKFEQPILSIPYLPLFGQPLKNVMLCHRP

SEQ ID NO: 2400266 - protein, 26 aa, Entamoeba dispar
NKGSKPIFSALMQSLLKLFTEISEYD

SEQ ID NO: 2400267 - protein, 25 aa, Entamoeba dispar
NKGSLLLLNLVDNKFYHIQYSCPKT

SEQ ID NO: 2400268 - protein, 17 aa, Entamoeba dispar
NKIKLCSLLTCFRRSSA

SEQ ID NO: 2400269 - protein, 21 aa, Entamoeba dispar
NKKEYALLVDLLKKLIVFERK

SEQ ID NO: 2400270 - protein, 22 aa, Entamoeba dispar
NKKIGEQLLDWAKKSLSIDSCD

SEQ ID NO: 2400271 - protein, 24 aa, Entamoeba dispar
NKKNKFLPELLKLTKEPTGTEGSV

SEQ ID NO: 2400272 - protein, 24 aa, Entamoeba dispar
NKKPNDCLSLKLKIKFIIDGAKGI

SEQ ID NO: 2400273 - protein, 25 aa, Entamoeba dispar
NKKPNILLKYLISNPRFITNFCNNV

SEQ ID NO: 2400274 - protein, 20 aa, Entamoeba dispar
NKKTCLWMTPFLIILAYIHL

SEQ ID NO: 2400275 - protein, 20 aa, Entamoeba dispar
NKLLPNDFFKKLYQNAERLS

SEQ ID NO: 2400276 - protein, 19 aa, Entamoeba dispar
NKLPLVGDSFYLISCDNQP

SEQ ID NO: 2400277 - protein, 27 aa, Entamoeba dispar
NKPLRPHFNPIFSKKIPPLLYLSCAQA

SEQ ID NO: 2400278 - protein, 31 aa, Entamoeba dispar
NKPNSELTNFFYFLPFTINIDNDKKMYLTPR

SEQ ID NO: 2400279 - protein, 43 aa, Entamoeba dispar
NKPNSELVYFVYFLPFTIYIDNNKKMYLIPRNELLDTPFGVPE

SEQ ID NO: 2400280 - protein, 34 aa, Entamoeba dispar
NKPNSELVYFYYFLPFKIYIDNNKKMYLIPRNEV

SEQ ID NO: 2400281 - protein, 25 aa, Entamoeba dispar
NKQRSIYFTYLPLENGNLLINSCDK

SEQ ID NO: 2400282 - protein, 26 aa, Entamoeba dispar
NKRDKYMLVIIHLPKSPKYVFHTEPE

SEQ ID NO: 2400283 - protein, 24 aa, Entamoeba dispar
NKRDLLIYGGYFPDKQKWLKQREV

SEQ ID NO: 2400284 - protein, 23 aa, Entamoeba dispar
NKRFSYFFFHWSDLIRTAFFHII

SEQ ID NO: 2400285 - protein, 36 aa, Entamoeba dispar
NKRIMVNTILILYPTGLQMYLIPLDNTIVESIWISV

SEQ ID NO: 2400286 - protein, 25 aa, Entamoeba dispar
NKRYKRAVWYKVFVPRRGTISVNTC

SEQ ID NO: 2400287 - protein, 17 aa, Entamoeba dispar
NKSIIMEYAPYGSLRNL

SEQ ID NO: 2400288 - protein, 38 aa, Entamoeba dispar
NKSNKWMMIIFHTPKTPKYIFYFEPQILIIKSKHKKIE

SEQ ID NO: 2400289 - protein, 25 aa, Entamoeba dispar
NKSYDWMILILINKIINIFITNNSI

SEQ ID NO: 2400290 - protein, 33 aa, Entamoeba dispar
NKTSLKFMYIGIGLFFTSLIRTIIFDVTGGNQI

SEQ ID NO: 2400291 - protein, 25 aa, Entamoeba dispar
NKTVKPLFTPQRWIDKAIPGGTNLQ

SEQ ID NO: 2400292 - protein, 23 aa, Entamoeba dispar
NKVMLFAMYVSCGISFVLLIIMI

SEQ ID NO: 2400293 - protein, 31 aa, Entamoeba dispar
NKVQYEFLAPFLPVISWQLAHVDLSWSLTQP

SEQ ID NO: 2400294 - protein, 17 aa, Entamoeba dispar
NKWHYFLLDFCYFTNCV

SEQ ID NO: 2400295 - protein, 21 aa, Entamoeba dispar
NKWHYFLLDFCYYTNFLLLVT

SEQ ID NO: 2400296 - protein, 22 aa, Entamoeba dispar
NKYFRREYIFVRDFITGLSTKT

SEQ ID NO: 2400297 - protein, 21 aa, Entamoeba dispar
NKYGFKFGPLPSTTILLYLNQ

SEQ ID NO: 2400298 - protein, 41 aa, Entamoeba dispar
NKYKNEIIGLLLLGFIYTIHCFFTIYCFFISIISTKSFEIS

SEQ ID NO: 2400299 - protein, 19 aa, Entamoeba dispar
NKYRFNFILKIEASASTDI

SEQ ID NO: 2400300 - protein, 23 aa, Entamoeba dispar
NKYTLVVVYAFNLGILLNRFFKL

SEQ ID NO: 2400301 - protein, 17 aa, Entamoeba dispar
NLARLVLFNNPITKISE

SEQ ID NO: 2400302 - protein, 24 aa, Entamoeba dispar
NLARVLSRICFLCGLFGGIKSNQL

SEQ ID NO: 2400303 - protein, 18 aa, Entamoeba dispar
NLCYLVITKYSPFVISLE

SEQ ID NO: 2400304 - protein, 21 aa, Entamoeba dispar
NLDAASSPFIILFAFIMAIVF

SEQ ID NO: 2400305 - protein, 26 aa, Entamoeba dispar
NLDCSFNRIFSFPPILSLTSLNIISN

SEQ ID NO: 2400306 - protein, 25 aa, Entamoeba dispar
NLEDAQYISDYWLKAISISNYAVTL

SEQ ID NO: 2400307 - protein, 23 aa, Entamoeba dispar
NLEDNYLVFKTLFDTNTNGFDKN

SEQ ID NO: 2400308 - protein, 22 aa, Entamoeba dispar
NLEQWAILLIKFGVTSIATILN

SEQ ID NO: 2400309 - protein, 24 aa, Entamoeba dispar
NLFFYFVFIFLFISVLFIIVINVT

SEQ ID NO: 2400310 - protein, 18 aa, Entamoeba dispar
NLFKMIDFSLLEQTLQTL

SEQ ID NO: 2400311 - protein, 22 aa, Entamoeba dispar
NLFQEFPTYNFSMGPAVITLVA

SEQ ID NO: 2400312 - protein, 27 aa, Entamoeba dispar
NLFSVQSLVLLFLKWMNVGKNCNFPLN

SEQ ID NO: 2400313 - protein, 25 aa, Entamoeba dispar
NLGILLNRFFKLWCLRKGNWEENYQ

SEQ ID NO: 2400314 - protein, 18 aa, Entamoeba dispar
NLGKLFINIILRTNIVIE

SEQ ID NO: 2400315 - protein, 18 aa, Entamoeba dispar
NLGLVSVAVTFLMGSALQ

SEQ ID NO: 2400316 - protein, 23 aa, Entamoeba dispar
NLGVIFFYIIVYTVNFILIHFVP

SEQ ID NO: 2400317 - protein, 23 aa, Entamoeba dispar
NLHKNLIHKLLKAKLGFFDVTPM

SEQ ID NO: 2400318 - protein, 28 aa, Entamoeba dispar
NLIGLIIFLPITFLTLTGGFVFGYSKGL

SEQ ID NO: 2400319 - protein, 26 aa, Entamoeba dispar
NLINSPYILKLYGISFDPLALVMDIC

SEQ ID NO: 2400320 - protein, 44 aa, Entamoeba dispar
NLKEVPWMILGFIGSMIYGALFPIFAYFLAEAICMLVTVYLTGM

SEQ ID NO: 2400321 - protein, 22 aa, Entamoeba dispar
NLKGFLWGYVAIILGVIATLLT

SEQ ID NO: 2400322 - protein, 26 aa, Entamoeba dispar
NLKMKRIIIIVFVTTFVVAVCIVCVL

SEQ ID NO: 2400323 - protein, 20 aa, Entamoeba dispar
NLKVTCSLPFSLKKYVQEKE

SEQ ID NO: 2400324 - protein, 20 aa, Entamoeba dispar
NLLGYWILNIIALIGQLAPI

SEQ ID NO: 2400325 - protein, 17 aa, Entamoeba dispar
NLLIIESLGALPKSTPI

SEQ ID NO: 2400326 - protein, 21 aa, Entamoeba dispar
NLLILSTKLHRFEITFEVMLF

SEQ ID NO: 2400327 - protein, 26 aa, Entamoeba dispar
NLLLTYPIIFHQFLTELSYDQLWTRN

SEQ ID NO: 2400328 - protein, 21 aa, Entamoeba dispar
NLLQDYWCIPGVLNGIAKVYG

SEQ ID NO: 2400329 - protein, 25 aa, Entamoeba dispar
NLNKKKLIYKLPIKVQTELSPKLDI

SEQ ID NO: 2400330 - protein, 21 aa, Entamoeba dispar
NLPEYGAFLFYASYGIETRGS

SEQ ID NO: 2400331 - protein, 31 aa, Entamoeba dispar
NLPLIKFYGKLLFALLFPLVMFLVITQLMEL

SEQ ID NO: 2400332 - protein, 24 aa, Entamoeba dispar
NLPNFETILLEDLKYWNSINFETK

SEQ ID NO: 2400333 - protein, 25 aa, Entamoeba dispar
NLQELSYFCFFLLISHMVSVTFDLS

SEQ ID NO: 2400334 - protein, 26 aa, Entamoeba dispar
NLRVVFLLVFIIFFTLNVRSEFQLFG

SEQ ID NO: 2400335 - protein, 29 aa, Entamoeba dispar
NLSGRLRWMIELFAYWNQLQFSPSPCYAT

SEQ ID NO: 2400336 - protein, 30 aa, Entamoeba dispar
NLSKSFVSFPPLFWVVRDYALDERTESWFF

SEQ ID NO: 2400337 - protein, 29 aa, Entamoeba dispar
NLSLVIFVWIFYFFLIRNWLSLRILIPIV

SEQ ID NO: 2400338 - protein, 28 aa, Entamoeba dispar
NLSTIFQFIIIGILTFIFIRNIIKINSS

SEQ ID NO: 2400339 - protein, 24 aa, Entamoeba dispar
NLVCYPFFLIPDEVHWYSIYICSA

SEQ ID NO: 2400340 - protein, 25 aa, Entamoeba dispar
NLVILFVILDFLRIQFAPNGTLSQL

SEQ ID NO: 2400341 - protein, 21 aa, Entamoeba dispar
NLVLLPLSKEYLRIPLTIKWE

SEQ ID NO: 2400342 - protein, 20 aa, Entamoeba dispar
NLVPWLFMSLVVVCWCTFFL

SEQ ID NO: 2400343 - protein, 18 aa, Entamoeba dispar
NLYAIIPISLRTDKERYS

SEQ ID NO: 2400344 - protein, 19 aa, Entamoeba dispar
NLYMFRWLTLLCCMEFTLF

SEQ ID NO: 2400345 - protein, 30 aa, Entamoeba dispar
NMEVKTKILLFQYLIDLIPNTLLNNIIEQC

SEQ ID NO: 2400346 - protein, 17 aa, Entamoeba dispar
NMGFVLYYFINTMVPFS

SEQ ID NO: 2400347 - protein, 25 aa, Entamoeba dispar
NMGNNQLFFVCKEYGKSMVMVTVGN

SEQ ID NO: 2400348 - protein, 26 aa, Entamoeba dispar
NMKEFYIMIMIIIFIIMGIISSELNK

SEQ ID NO: 2400349 - protein, 27 aa, Entamoeba dispar
NMMNDETLIFVLLRALDKVICDSTNIK

SEQ ID NO: 2400350 - protein, 20 aa, Entamoeba dispar
NMPDNYWNLITKCWDQEADK

SEQ ID NO: 2400351 - protein, 26 aa, Entamoeba dispar
NMTRKGHMFSPLKNFRKWQRKTPKQM

SEQ ID NO: 2400352 - protein, 23 aa, Entamoeba dispar
NNAILAHFILLNIGLACVAVTFL

SEQ ID NO: 2400353 - protein, 25 aa, Entamoeba dispar
NNCVEKLFNFLYKILSKDRLDKIIT

SEQ ID NO: 2400354 - protein, 24 aa, Entamoeba dispar
NNDLFNFIFTANSHFALFLTDLLR

SEQ ID NO: 2400355 - protein, 31 aa, Entamoeba dispar
NNDNKDLLYFYYFLPFNITIDRNKKMYLIPK

SEQ ID NO: 2400356 - protein, 30 aa, Entamoeba dispar
NNDPPKYIYNLKALYFLGGALLVVVALLSL

SEQ ID NO: 2400357 - protein, 18 aa, Entamoeba dispar
NNDTYLIYTVPQGIFIDK

SEQ ID NO: 2400358 - protein, 24 aa, Entamoeba dispar
NNEENSFIIIKLISCLLSSLDIEY

SEQ ID NO: 2400359 - protein, 27 aa, Entamoeba dispar
NNEHRNTLSRYLFLMNVIAVNQRLNRM

SEQ ID NO: 2400360 - protein, 31 aa, Entamoeba dispar
NNEISKYALIILLKRIILCDLDIRFENKKER

SEQ ID NO: 2400361 - protein, 22 aa, Entamoeba dispar
NNEYTILVLDRIVRVCPKDNLD

SEQ ID NO: 2400362 - protein, 21 aa, Entamoeba dispar
NNFFIVVCIVTLFETSALHRL

SEQ ID NO: 2400363 - protein, 24 aa, Entamoeba dispar
NNFSLPTFGFTVYGGLKVNGILTI

SEQ ID NO: 2400364 - protein, 37 aa, Entamoeba dispar
NNFTMRLIFTILCATVCLLFIIAITSIFLILKREREE

SEQ ID NO: 2400365 - protein, 33 aa, Entamoeba dispar
NNGLDGLLRKLGWLTFLDVLPLPITPSWGRILE

SEQ ID NO: 2400366 - protein, 43 aa, Entamoeba dispar
NNGVKVGWIIFGVVFFLIFVSIFAFIIGFIIYRKKRSNNGYHD

SEQ ID NO: 2400367 - protein, 31 aa, Entamoeba dispar
NNIDLYLFISSLKIYYSIPSLSLLIHSYTNA

SEQ ID NO: 2400368 - protein, 17 aa, Entamoeba dispar
NNIEALIKKLYKAFPTK

SEQ ID NO: 2400369 - protein, 22 aa, Entamoeba dispar
NNIFKQYGYKVGISFMESYRYK

SEQ ID NO: 2400370 - protein, 29 aa, Entamoeba dispar
NNIFLQNDFVWLLQSLYQAKFKRVHILCH

SEQ ID NO: 2400371 - protein, 20 aa, Entamoeba dispar
NNIMIVIKDWNGNVFGSFHE

SEQ ID NO: 2400372 - protein, 38 aa, Entamoeba dispar
NNINFKWRLSQYVTWYIIFSLLISMLMLSIIIGYHVII

SEQ ID NO: 2400373 - protein, 27 aa, Entamoeba dispar
NNKWNYLNIVYWIKFEFALRRYQFNIM

SEQ ID NO: 2400374 - protein, 31 aa, Entamoeba dispar
NNLESLVVILFLLVFALIAAGYVFVDGINKG

SEQ ID NO: 2400375 - protein, 20 aa, Entamoeba dispar
NNLWNVFISHSIEWQLDGEV

SEQ ID NO: 2400376 - protein, 25 aa, Entamoeba dispar
NNNNKIRIIDNLPILPIQSFSEACN

SEQ ID NO: 2400377 - protein, 20 aa, Entamoeba dispar
NNPEILYPLFKELLSYICAD

SEQ ID NO: 2400378 - protein, 22 aa, Entamoeba dispar
NNPFFFYEYVVDSVTFLLFNTG

SEQ ID NO: 2400379 - protein, 23 aa, Entamoeba dispar
NNPKILGEWYTKPNIIKYGGVEH

SEQ ID NO: 2400380 - protein, 24 aa, Entamoeba dispar
NNPVERYIWVCTEYSLYKIHAVKP

SEQ ID NO: 2400381 - protein, 17 aa, Entamoeba dispar
NNQKYVWWNVFTIRKNS

SEQ ID NO: 2400382 - protein, 29 aa, Entamoeba dispar
NNRDQQWIKTIFPIIFMSKKMNKWKNELV

SEQ ID NO: 2400383 - protein, 42 aa, Entamoeba dispar
NNRIGFIPPISDCYIIILLFDRWRSVLFHWKYYLQRVLPNDE

SEQ ID NO: 2400384 - protein, 17 aa, Entamoeba dispar
NNRLLHHAVANAGLLIT

SEQ ID NO: 2400385 - protein, 22 aa, Entamoeba dispar
NNTFDIIISTLFTWMKLYSKDE

SEQ ID NO: 2400386 - protein, 26 aa, Entamoeba dispar
NNTSKIYIIIIKLIDKINKINNYLEW

SEQ ID NO: 2400387 - protein, 18 aa, Entamoeba dispar
NNWFFYTIFVIYAIIFFL

SEQ ID NO: 2400388 - protein, 23 aa, Entamoeba dispar
NNYNWIHIIGIIIPLFGVIVGLV

SEQ ID NO: 2400389 - protein, 25 aa, Entamoeba dispar
NNYSYYFNKNFTYSGLAFNCNRTYL

SEQ ID NO: 2400390 - protein, 18 aa, Entamoeba dispar
NNYWFGVGLFYLTLVYIP

SEQ ID NO: 2400391 - protein, 27 aa, Entamoeba dispar
NPEDTLWIFTYFMKDLNLYGLFCDGLP

SEQ ID NO: 2400392 - protein, 25 aa, Entamoeba dispar
NPENFWLCIIPLCQPMYVLSSLVFK

SEQ ID NO: 2400393 - protein, 27 aa, Entamoeba dispar
NPFVFSPFLLLYATLSALLFIYLSHKL

SEQ ID NO: 2400394 - protein, 19 aa, Entamoeba dispar
NPLSFHSIFLLNGELKITE

SEQ ID NO: 2400395 - protein, 28 aa, Entamoeba dispar
NPQLIRLFLSFFLINSTRFAYLAKVDNF

SEQ ID NO: 2400396 - protein, 24 aa, Entamoeba dispar
NPRFKPIQFKWSKFIKKLDPDNEA

SEQ ID NO: 2400397 - protein, 22 aa, Entamoeba dispar
NPRSDHIFVFVIGGISLGEISM

SEQ ID NO: 2400398 - protein, 29 aa, Entamoeba dispar
NPSKFDKLIPFVPILLRKGDSISPLDQIT

SEQ ID NO: 2400399 - protein, 19 aa, Entamoeba dispar
NQCIECQIGYVLFNKKCYI

SEQ ID NO: 2400400 - protein, 18 aa, Entamoeba dispar
NQEFIPYEREWSTLITTG

SEQ ID NO: 2400401 - protein, 25 aa, Entamoeba dispar
NQETFYRMVLYPYKADVLFEMSKLI

SEQ ID NO: 2400402 - protein, 25 aa, Entamoeba dispar
NQFVFGIFCFKIVIVIVATIAGSLF

SEQ ID NO: 2400403 - protein, 21 aa, Entamoeba dispar
NQGFLKYWRIKEIPNFLLCAP

SEQ ID NO: 2400404 - protein, 31 aa, Entamoeba dispar
NQIHTFIVLYFVDVLICLFVDSLDLYHIHIL

SEQ ID NO: 2400405 - protein, 26 aa, Entamoeba dispar
NQILTNNYYHIIAGKLTTKECIVVVN

SEQ ID NO: 2400406 - protein, 22 aa, Entamoeba dispar
NQISLYQLIDWFKKDIHCKEDI

SEQ ID NO: 2400407 - protein, 24 aa, Entamoeba dispar
NQKGILFHIMRVLKILISGLCLII

SEQ ID NO: 2400408 - protein, 23 aa, Entamoeba dispar
NQKYRGFFDVIHFDITWDDRSYV

SEQ ID NO: 2400409 - protein, 27 aa, Entamoeba dispar
NQLFLSFLWIILLFTILFIYQLFLFFG

SEQ ID NO: 2400410 - protein, 21 aa, Entamoeba dispar
NQLLLPILLATVVTISLSRFF

SEQ ID NO: 2400411 - protein, 25 aa, Entamoeba dispar
NQMIYRKGHWFFVDFNKIDSMTKVI

SEQ ID NO: 2400412 - protein, 43 aa, Entamoeba dispar
NQNNSNTIWLIIIPSVICIILIIIIIVLLSIYLHKLLIKRRRF

SEQ ID NO: 2400413 - protein, 22 aa, Entamoeba dispar
NQQTIPIILDNPSIINLYNSVI

SEQ ID NO: 2400414 - protein, 32 aa, Entamoeba dispar
NQSLVVYFDLFMKYLQFIQPLLINKSTANKQI

SEQ ID NO: 2400415 - protein, 24 aa, Entamoeba dispar
NQTGLWYFIEKSGFKIKKYVGRNI

SEQ ID NO: 2400416 - protein, 23 aa, Entamoeba dispar
NQTIPERICLFLLETKSKYNSKD

SEQ ID NO: 2400417 - protein, 20 aa, Entamoeba dispar
NQVLFLSSIKQPIPFHSNCF

SEQ ID NO: 2400418 - protein, 26 aa, Entamoeba dispar
NRIILYQQYMALFLWVIHYLKRIFET

SEQ ID NO: 2400419 - protein, 19 aa, Entamoeba dispar
NRLYRTPYPFPATTTYGEI

SEQ ID NO: 2400420 - protein, 18 aa, Entamoeba dispar
NRMVSGLIYFFVTPFIDI

SEQ ID NO: 2400421 - protein, 18 aa, Entamoeba dispar
NRNIYFLNSCGIDYYNKN

SEQ ID NO: 2400422 - protein, 28 aa, Entamoeba dispar
NRQFRRRFFILRPFFRRRRFTLSPIIWK

SEQ ID NO: 2400423 - protein, 33 aa, Entamoeba dispar
NRQQLEAYLLSIIYIIFVCCVSILIAFVIIIIL

SEQ ID NO: 2400424 - protein, 23 aa, Entamoeba dispar
NRSDFEIHWITFSQLNDLTIEFF

SEQ ID NO: 2400425 - protein, 34 aa, Entamoeba dispar
NRSSGLLIWTIWTIMTILAVTILTVSIISLIFFN

SEQ ID NO: 2400426 - protein, 17 aa, Entamoeba dispar
NRTHAVFYNLTYDISVQ

SEQ ID NO: 2400427 - protein, 29 aa, Entamoeba dispar
NRTPVGLYTFIFSIILPCATIIGCLKLKS

SEQ ID NO: 2400428 - protein, 31 aa, Entamoeba dispar
NRWCNCTINCPFSFIYSKFWLESGAYEMTSI

SEQ ID NO: 2400429 - protein, 17 aa, Entamoeba dispar
NSCICVEWYEITPEPWK

SEQ ID NO: 2400430 - protein, 18 aa, Entamoeba dispar
NSCISCEDNFFLYNGRQC

SEQ ID NO: 2400431 - protein, 18 aa, Entamoeba dispar
NSCSCGETLNIVFNKRGI

SEQ ID NO: 2400432 - protein, 35 aa, Entamoeba dispar
NSEIIKICFYKNASFFLILLWYSFISNFTCQVVYD

SEQ ID NO: 2400433 - protein, 25 aa, Entamoeba dispar
NSEKQFFQILPPLLIPSDGKAHDGR

SEQ ID NO: 2400434 - protein, 35 aa, Entamoeba dispar
NSEYDLLYRFVQTLGMLPFSLLSTGNKSKCYFKKS

SEQ ID NO: 2400435 - protein, 27 aa, Entamoeba dispar
NSFGIITLFLLFSPLFSWIYCLCIKTH

SEQ ID NO: 2400436 - protein, 17 aa, Entamoeba dispar
NSFILLALIIAFFFIIP

SEQ ID NO: 2400437 - protein, 33 aa, Entamoeba dispar
NSFLFNSHLSILSPFLPFLNLTRRFDSQLIQLQ

SEQ ID NO: 2400438 - protein, 25 aa, Entamoeba dispar
NSFPSTYKWACLNSILILSTQTFND

SEQ ID NO: 2400439 - protein, 26 aa, Entamoeba dispar
NSFQLSPFLYFQPDVFVLAFDISNIK

SEQ ID NO: 2400440 - protein, 26 aa, Entamoeba dispar
NSFTQGKLLLLPLSKEYLNTPITITW

SEQ ID NO: 2400441 - protein, 29 aa, Entamoeba dispar
NSIHCGYYFQPYSTIRFLVSDYKAWGYES

SEQ ID NO: 2400442 - protein, 24 aa, Entamoeba dispar
NSIIQFIQNCLLRIILFVCGIYSI

SEQ ID NO: 2400443 - protein, 25 aa, Entamoeba dispar
NSIVLSFILKQLPSLFKKRLPGIEV

SEQ ID NO: 2400444 - protein, 22 aa, Entamoeba dispar
NSKEFIIMEIYLDQLRKDCKAD

SEQ ID NO: 2400445 - protein, 28 aa, Entamoeba dispar
NSLAIRLCSLMFYHYFSCSQECSLEYPV

SEQ ID NO: 2400446 - protein, 23 aa, Entamoeba dispar
NSLCLIIEYFPLGSIRKFYTEHE

SEQ ID NO: 2400447 - protein, 27 aa, Entamoeba dispar
NSMESPYFHLKWYNTIYMKQKELENYM

SEQ ID NO: 2400448 - protein, 18 aa, Entamoeba dispar
NSMFYHIIHSPFIFFDTT

SEQ ID NO: 2400449 - protein, 25 aa, Entamoeba dispar
NSMTLWMMILVICAVVGSTLYQIRS

SEQ ID NO: 2400450 - protein, 22 aa, Entamoeba dispar
NSQRTIITTIKKLKLATKNNDE

SEQ ID NO: 2400451 - protein, 41 aa, Entamoeba dispar
NSQRYAHLKYFYLSLPSLLLTYIDFIIAAKERLLRNSTNLD

SEQ ID NO: 2400452 - protein, 26 aa, Entamoeba dispar
NSRAMWNIVQIFDWTVYNDSYNLDWS

SEQ ID NO: 2400453 - protein, 22 aa, Entamoeba dispar
NSRFIIVLMTLLYVFAQEYFMS

SEQ ID NO: 2400454 - protein, 27 aa, Entamoeba dispar
NSSETLLRLFSSRLIYLTLKSEFVLSN

SEQ ID NO: 2400455 - protein, 25 aa, Entamoeba dispar
NSSKYMLLIFHTPNNPKYVFHFMPQ

SEQ ID NO: 2400456 - protein, 20 aa, Entamoeba dispar
NSSPSYLFFIEFLMIIILLF

SEQ ID NO: 2400457 - protein, 25 aa, Entamoeba dispar
NSVIKQYCMLLLPKDFDNYEIEKLE

SEQ ID NO: 2400458 - protein, 22 aa, Entamoeba dispar
NSVLSTIILSPGGKFLDIIFSL

SEQ ID NO: 2400459 - protein, 23 aa, Entamoeba dispar
NSWVFSWLMFISYIFVCLNCGGI

SEQ ID NO: 2400460 - protein, 19 aa, Entamoeba dispar
NSYLNSYYIDQIKKLTVIN

SEQ ID NO: 2400461 - protein, 22 aa, Entamoeba dispar
NTAWLNIITFPFLFGIMFSDAG

SEQ ID NO: 2400462 - protein, 22 aa, Entamoeba dispar
NTCMMVNVLYFMFFHITTPSKG

SEQ ID NO: 2400463 - protein, 26 aa, Entamoeba dispar
NTDFSLPSFPFKVYGGLNIIGELTFE

SEQ ID NO: 2400464 - protein, 20 aa, Entamoeba dispar
NTFKRMFKFFNKKNFWSIYC

SEQ ID NO: 2400465 - protein, 17 aa, Entamoeba dispar
NTFKYPIVLDNYQSYEK

SEQ ID NO: 2400466 - protein, 23 aa, Entamoeba dispar
NTGISIVFFLRRGQTFWQTLVSI

SEQ ID NO: 2400467 - protein, 30 aa, Entamoeba dispar
NTGLFMTSILGFIGFFICSVIALIQGKKAT

SEQ ID NO: 2400468 - protein, 26 aa, Entamoeba dispar
NTGSEFVYFFAYKNEAWGFTKITAKT

SEQ ID NO: 2400469 - protein, 21 aa, Entamoeba dispar
NTHFILPICPSKCSISGKGME

SEQ ID NO: 2400470 - protein, 36 aa, Entamoeba dispar
NTIELCIEIIYILITLYPFDNFKILKPIIIVKKEIQ

SEQ ID NO: 2400471 - protein, 26 aa, Entamoeba dispar
NTIHHLAWLLLFDIQRMYSIDKDKEV

SEQ ID NO: 2400472 - protein, 28 aa, Entamoeba dispar
NTLMTFERFVFIASVTGILIFERGRMKK

SEQ ID NO: 2400473 - protein, 42 aa, Entamoeba dispar
NTNKKEWIIIIVFIIAVIVIGIIIIGIIFVGVYLSKRKEKGY

SEQ ID NO: 2400474 - protein, 23 aa, Entamoeba dispar
NTNPIIVILPMNGGGYADLEANF

SEQ ID NO: 2400475 - protein, 19 aa, Entamoeba dispar
NTNVIVESLLFKQSYYYAD

SEQ ID NO: 2400476 - protein, 23 aa, Entamoeba dispar
NTQCFFKYFTPFWNNSNKRFESL

SEQ ID NO: 2400477 - protein, 19 aa, Entamoeba dispar
NTQELLLFGPSPGLGSAEA

SEQ ID NO: 2400478 - protein, 25 aa, Entamoeba dispar
NTQLKTIQFVLYYESTNTSEVPIII

SEQ ID NO: 2400479 - protein, 24 aa, Entamoeba dispar
NTQYPTTIYLYKKVTTSNGCMGDA

SEQ ID NO: 2400480 - protein, 28 aa, Entamoeba dispar
NTSLIKLIFFKNAAFFLHLLWFACICMF

SEQ ID NO: 2400481 - protein, 35 aa, Entamoeba dispar
NTSRGFSYITFIFLFLCFIAYILIATLVLHRTENC

SEQ ID NO: 2400482 - protein, 34 aa, Entamoeba dispar
NTTESLQWFYGINYLVHRIFFTFYDNNSFLSLIK

SEQ ID NO: 2400483 - protein, 22 aa, Entamoeba dispar
NTTFMTIYPLLMIASVGSGGFG

SEQ ID NO: 2400484 - protein, 24 aa, Entamoeba dispar
NTTNSFIKFSFYNITLTSAELITF

SEQ ID NO: 2400485 - protein, 29 aa, Entamoeba dispar
NTVIPLSVVLFIFLLITFSVISNRKRRDD

SEQ ID NO: 2400486 - protein, 23 aa, Entamoeba dispar
NVALNKIFELIALSKPALKAVHY

SEQ ID NO: 2400487 - protein, 22 aa, Entamoeba dispar
NVDGRFFCVMELTVINEEVFQS

SEQ ID NO: 2400488 - protein, 29 aa, Entamoeba dispar
NVELTIDTLIPCDYLSFGPGISVKTTNVG

SEQ ID NO: 2400489 - protein, 20 aa, Entamoeba dispar
NVEYFFAPYLSMKGFDILTD

SEQ ID NO: 2400490 - protein, 19 aa, Entamoeba dispar
NVFDYINVDNILTLPGCLI

SEQ ID NO: 2400491 - protein, 23 aa, Entamoeba dispar
NVFRKLFHLPLYPVEEEIVFGHL

SEQ ID NO: 2400492 - protein, 29 aa, Entamoeba dispar
NVFSNLFTNFIFLSIIAITIIVQFIIVQF

SEQ ID NO: 2400493 - protein, 21 aa, Entamoeba dispar
NVGIFIFMILSLCLLSYTNHC

SEQ ID NO: 2400494 - protein, 28 aa, Entamoeba dispar
NVLITILFFIFLIWYFNKHSFNLGVLLV

SEQ ID NO: 2400495 - protein, 30 aa, Entamoeba dispar
NVLMELYMFILFVWIFFHVDHLKLLAIEEP

SEQ ID NO: 2400496 - protein, 18 aa, Entamoeba dispar
NVLQLIKPLISTGGQLTI

SEQ ID NO: 2400497 - protein, 21 aa, Entamoeba dispar
NVMMVIFYIMGILIHINCLYQ

SEQ ID NO: 2400498 - protein, 26 aa, Entamoeba dispar
NVNIIIFLIIIFIIVILIFAYTYPFN

SEQ ID NO: 2400499 - protein, 27 aa, Entamoeba dispar
NVPISSIIGIKYYQYLGAVLEACVNST

SEQ ID NO: 2400500 - protein, 17 aa, Entamoeba dispar
NVPYGLFIKDQSKWNTE

SEQ ID NO: 2400501 - protein, 24 aa, Entamoeba dispar
NVQKLDRILPPIISILLTQQDERN

SEQ ID NO: 2400502 - protein, 24 aa, Entamoeba dispar
NVQTFIIYHFWVDVIVRAGIASIP

SEQ ID NO: 2400503 - protein, 18 aa, Entamoeba dispar
NVVECPYWLAPEVILNNH

SEQ ID NO: 2400504 - protein, 25 aa, Entamoeba dispar
NVVLPSAPLFISGTVYFVGGITVQR

SEQ ID NO: 2400505 - protein, 23 aa, Entamoeba dispar
NVVVCFLEMLIMKGEVLKPQKGE

SEQ ID NO: 2400506 - protein, 18 aa, Entamoeba dispar
NVYFACHDTIYVYISDSN

SEQ ID NO: 2400507 - protein, 25 aa, Entamoeba dispar
NWFFTLWYFILSCLTFFITGVLGLV

SEQ ID NO: 2400508 - protein, 31 aa, Entamoeba dispar
NWKDLYEILFEFFKIFLTTKPFICEYQNVLI

SEQ ID NO: 2400509 - protein, 26 aa, Entamoeba dispar
NWKINIIVIILLLNFFHILSLSVIDI

SEQ ID NO: 2400510 - protein, 23 aa, Entamoeba dispar
NWKKVPLIIIIKTALWVKEKIQQ

SEQ ID NO: 2400511 - protein, 18 aa, Entamoeba dispar
NWNDVRFELVSDIPWNCF

SEQ ID NO: 2400512 - protein, 18 aa, Entamoeba dispar
NWNTKMIFVWVKASFIDE

SEQ ID NO: 2400513 - protein, 18 aa, Entamoeba dispar
NWPGNKFITIVKGTTLKT

SEQ ID NO: 2400514 - protein, 17 aa, Entamoeba dispar
NWRYCPKYKEEEGFDAD

SEQ ID NO: 2400515 - protein, 17 aa, Entamoeba dispar
NWSLLISVLFWNINGVD

SEQ ID NO: 2400516 - protein, 25 aa, Entamoeba dispar
NYCQKLWPIVIIYTLLIVLMEMIVQ

SEQ ID NO: 2400517 - protein, 30 aa, Entamoeba dispar
NYDEFTFIIFISIFIVVTLKVFFITKRYTI

SEQ ID NO: 2400518 - protein, 23 aa, Entamoeba dispar
NYDITRSLPLYLSIFIFGESSNE

SEQ ID NO: 2400519 - protein, 23 aa, Entamoeba dispar
NYDWKRLRCFHFSLKEMRINDFN

SEQ ID NO: 2400520 - protein, 22 aa, Entamoeba dispar
NYENLPHTFYFDDITLIRDENA

SEQ ID NO: 2400521 - protein, 18 aa, Entamoeba dispar
NYFIGYISSCLIFPIALT

SEQ ID NO: 2400522 - protein, 23 aa, Entamoeba dispar
NYGMFISLYIIAIAAMIGGILYF

SEQ ID NO: 2400523 - protein, 20 aa, Entamoeba dispar
NYGYILYSPNGWNETIIESV

SEQ ID NO: 2400524 - protein, 24 aa, Entamoeba dispar
NYHEKVYWNLWLEKDGNGDIGIID

SEQ ID NO: 2400525 - protein, 29 aa, Entamoeba dispar
NYHLNSMTFFIIFICITPFFVHGDCWYVS

SEQ ID NO: 2400526 - protein, 38 aa, Entamoeba dispar
NYIDVIIEGYFYLFPAFCLPWFVKQKKNIPMLNEALKK

SEQ ID NO: 2400527 - protein, 17 aa, Entamoeba dispar
NYIVCSPNWAYVGDESK

SEQ ID NO: 2400528 - protein, 25 aa, Entamoeba dispar
NYIVIVWFCLFISFISCIIHPLLNS

SEQ ID NO: 2400529 - protein, 24 aa, Entamoeba dispar
NYKEIIMPNFLFLIKICLQNKDIC

SEQ ID NO: 2400530 - protein, 25 aa, Entamoeba dispar
NYKKIIHLLEQRIWRYYYIHYKQIQ

SEQ ID NO: 2400531 - protein, 24 aa, Entamoeba dispar
NYNLLTLLFNRYSFFKYYPSKYLI

SEQ ID NO: 2400532 - protein, 24 aa, Entamoeba dispar
NYNYNYHLPIQRTYFNSNPINLKF

SEQ ID NO: 2400533 - protein, 19 aa, Entamoeba dispar
NYPFQLIFEFMLEKNAKCL

SEQ ID NO: 2400534 - protein, 20 aa, Entamoeba dispar
NYQCWDCMLGYIKNGSYCAR

SEQ ID NO: 2400535 - protein, 27 aa, Entamoeba dispar
NYQNKKIFFFFFENQPNYCYPPNKIID

SEQ ID NO: 2400536 - protein, 25 aa, Entamoeba dispar
NYRHEYIFCTLGLIGGIGAGAAFPF

SEQ ID NO: 2400537 - protein, 36 aa, Entamoeba dispar
NYRSIYWPVFVSLYGWPLILLIIGLYCDMVLPRKYG

SEQ ID NO: 2400538 - protein, 26 aa, Entamoeba dispar
NYSRNKWMMIIFHTPNNPKYVFYFEP

SEQ ID NO: 2400539 - protein, 32 aa, Entamoeba dispar
NYSTTIFFTFLLFLLSIFIYTIFLCCKNLKEW

SEQ ID NO: 2400540 - protein, 31 aa, Entamoeba dispar
NYSVLIQLIFIFLISIISFSGTLYWSHGLTT

SEQ ID NO: 2400541 - protein, 37 aa, Entamoeba dispar
NYSYSYFKELYPIYYYFNINLIISQLWGLVYKGFNDT

SEQ ID NO: 2400542 - protein, 24 aa, Entamoeba dispar
NYVQRVLEVIPEQVFLLINSIAKL

SEQ ID NO: 2400543 - protein, 17 aa, Entamoeba dispar
NYYIFKQIQVAVSILCG

SEQ ID NO: 2400544 - protein, 18 aa, Entamoeba dispar
PADIYSFAITMFETIKWD

SEQ ID NO: 2400545 - protein, 44 aa, Entamoeba dispar
PADIYSFAITMYEIMKWGPAYDKTTFKYPWSIADFVTKGNRLPI

SEQ ID NO: 2400546 - protein, 36 aa, Entamoeba dispar
PAFLAVFFGMLFLFVKPLYNFFFTGPLRVVGNTMKV

SEQ ID NO: 2400547 - protein, 28 aa, Entamoeba dispar
PAHYVFTMYEILGRVVRLMILFGKNTIN

SEQ ID NO: 2400548 - protein, 17 aa, Entamoeba dispar
PAILFMVLTLVAAFAVI

SEQ ID NO: 2400549 - protein, 18 aa, Entamoeba dispar
PAQFKTIKLSSTKGWDVL

SEQ ID NO: 2400550 - protein, 17 aa, Entamoeba dispar
PATLPLLLPLLPSLSPT

SEQ ID NO: 2400551 - protein, 23 aa, Entamoeba dispar
PATTLYPIGWKQTTTYNLGLCYL

SEQ ID NO: 2400552 - protein, 17 aa, Entamoeba dispar
PCILSVLVAALDGLLKS

SEQ ID NO: 2400553 - protein, 24 aa, Entamoeba dispar
PCSRQLQPGTWFFLKGADETIMIS

SEQ ID NO: 2400554 - protein, 19 aa, Entamoeba dispar
PCYIGFFFLVISYARFRLY

SEQ ID NO: 2400555 - protein, 41 aa, Entamoeba dispar
PDFNSLAFLIFPLLVTFLAIIILILFPFLKTYFIPSNSHST

SEQ ID NO: 2400556 - protein, 25 aa, Entamoeba dispar
PDFSMPYNVLALTLAIFALGIGNSI

SEQ ID NO: 2400557 - protein, 58 aa, Entamoeba dispar
PDGPFLSFIMNLFLYGFFSSFCSFSSFFFFGNSHINPFLLAILYTKLQYGFFRANFSS

SEQ ID NO: 2400558 - protein, 22 aa, Entamoeba dispar
PDNECYILWTQVQPVYDNGDFI

SEQ ID NO: 2400559 - protein, 23 aa, Entamoeba dispar
PDNKQFIQLLLSLLEIFITNGNY

SEQ ID NO: 2400560 - protein, 26 aa, Entamoeba dispar
PDNYYKTFNFNKINSFIPIICVINNC

SEQ ID NO: 2400561 - protein, 25 aa, Entamoeba dispar
PDQYLILYFSLCIFTSIINQTLFLS

SEQ ID NO: 2400562 - protein, 24 aa, Entamoeba dispar
PEAKAAMIWIIGEYSDRITNVADL

SEQ ID NO: 2400563 - protein, 25 aa, Entamoeba dispar
PEELSLFHFFLGEVMFDPNVTIHTF

SEQ ID NO: 2400564 - protein, 38 aa, Entamoeba dispar
PEGFFNKIVWVGKKIYCMIKLNRWYIKPKTIKYGNVKH

SEQ ID NO: 2400565 - protein, 44 aa, Entamoeba dispar
PEGKYCAKKNLWYVWVIIVVGIIFIISLIILGIVYKRIHHKIKK

SEQ ID NO: 2400566 - protein, 29 aa, Entamoeba dispar
PEIAKARLFLFYCARIVLGNGLRLLGLEP

SEQ ID NO: 2400567 - protein, 22 aa, Entamoeba dispar
PEIRDWVLIPLLIVTVCSNYLR

SEQ ID NO: 2400568 - protein, 26 aa, Entamoeba dispar
PEIYNQLYLLLKLYQNFIKPKNQSFI

SEQ ID NO: 2400569 - protein, 28 aa, Entamoeba dispar
PEKEFMPQRWILAHIKLEKDWTMKEIIE

SEQ ID NO: 2400570 - protein, 35 aa, Entamoeba dispar
PEKLILQPNKCCYINLLFMPYCSFNIQIPFQIIIV

SEQ ID NO: 2400571 - protein, 20 aa, Entamoeba dispar
PEKLLKRPVFQRTAFSSLNL

SEQ ID NO: 2400572 - protein, 32 aa, Entamoeba dispar
PELNHLQLIVWNSDFIFLSKGALLETQTFRIK

SEQ ID NO: 2400573 - protein, 26 aa, Entamoeba dispar
PENFRIYFIRLCQLLSFHGPKVAPTM

SEQ ID NO: 2400574 - protein, 25 aa, Entamoeba dispar
PENMPDWYYILICKCWQNNPQERLT

SEQ ID NO: 2400575 - protein, 26 aa, Entamoeba dispar
PEPNNLLLFIIATLMIYLKANKKIVN

SEQ ID NO: 2400576 - protein, 31 aa, Entamoeba dispar
PEQALRSLLFCDTPSLLYCYCDSLLKQTVSL

SEQ ID NO: 2400577 - protein, 25 aa, Entamoeba dispar
PESYKYWHHWALINFEIVSYIELDE

SEQ ID NO: 2400578 - protein, 20 aa, Entamoeba dispar
PETFGFVNFLFVFNEKTHEY

SEQ ID NO: 2400579 - protein, 23 aa, Entamoeba dispar
PEVKILIQNLIKTILLSLQQSSF

SEQ ID NO: 2400580 - protein, 21 aa, Entamoeba dispar
PEYVPVIYTPRVGPKRLKEKR

SEQ ID NO: 2400581 - protein, 25 aa, Entamoeba dispar
PFCWRSDTPLIYRAIPSWFVNVESF

SEQ ID NO: 2400582 - protein, 29 aa, Entamoeba dispar
PFFGIFLAIIRWVFILNFFISIIYAFVYN

SEQ ID NO: 2400583 - protein, 25 aa, Entamoeba dispar
PFICGLLCSAFGKTWLHFLNIFMCC

SEQ ID NO: 2400584 - protein, 20 aa, Entamoeba dispar
PFIYDYSKPIPLKQNIFIIL

SEQ ID NO: 2400585 - protein, 20 aa, Entamoeba dispar
PFIYIVFISICYITFCIEQK

SEQ ID NO: 2400586 - protein, 17 aa, Entamoeba dispar
PFLIVLHFTIPYMNNIH

SEQ ID NO: 2400587 - protein, 18 aa, Entamoeba dispar
PFLLLGNLIVIISIGIQV

SEQ ID NO: 2400588 - protein, 17 aa, Entamoeba dispar
PFLNAPCGFVKTVGHSG

SEQ ID NO: 2400589 - protein, 23 aa, Entamoeba dispar
PFLPINFNGIIRCSLPSCGNHQI

SEQ ID NO: 2400590 - protein, 24 aa, Entamoeba dispar
PFLYSLITVIFWFVIAQILVYLIT

SEQ ID NO: 2400591 - protein, 26 aa, Entamoeba dispar
PFPPTQKVFAILPYKNLNVLSGSDTF

SEQ ID NO: 2400592 - protein, 37 aa, Entamoeba dispar
PFTAIINGLVLGWVHAFIFWKYSVLMYFAGQELKKDP

SEQ ID NO: 2400593 - protein, 38 aa, Entamoeba dispar
PFTAIINGLVLGWVHAFIFWKYYVLMYVAGQELKDDPN

SEQ ID NO: 2400594 - protein, 26 aa, Entamoeba dispar
PFVFSPFLLLYATLSALLFIYLSHKL

SEQ ID NO: 2400595 - protein, 17 aa, Entamoeba dispar
PFWVYPERSVEGLIKFI

SEQ ID NO: 2400596 - protein, 20 aa, Entamoeba dispar
PFYFFFFSIFFFFLLFLCSL

SEQ ID NO: 2400597 - protein, 31 aa, Entamoeba dispar
PGERATRWRFLGFWICAVLNLFVPNYISGFD

SEQ ID NO: 2400598 - protein, 17 aa, Entamoeba dispar
PGFIYFIQNMLLYIILQ

SEQ ID NO: 2400599 - protein, 29 aa, Entamoeba dispar
PGISLTQWGVCILLGLVSLPLGLLNGIFK

SEQ ID NO: 2400600 - protein, 21 aa, Entamoeba dispar
PGKRNELFAIGLRKKRFISRD

SEQ ID NO: 2400601 - protein, 24 aa, Entamoeba dispar
PGLSERILSFLILNSTSVISQQPK

SEQ ID NO: 2400602 - protein, 22 aa, Entamoeba dispar
PGNVFIIIFSLISAMIMFSMSC

SEQ ID NO: 2400603 - protein, 29 aa, Entamoeba dispar
PGNVPLLILLGIVCLFFAGITTLFIIKFF

SEQ ID NO: 2400604 - protein, 19 aa, Entamoeba dispar
PGVFFKYELSPYIVINEMN

SEQ ID NO: 2400605 - protein, 18 aa, Entamoeba dispar
PHISNGLPFYIISANKSF

SEQ ID NO: 2400606 - protein, 26 aa, Entamoeba dispar
PHQISLSFFVWYIYSIHSFFTTTHPS

SEQ ID NO: 2400607 - protein, 36 aa, Entamoeba dispar
PIAGCLAIIIVIILIIIFLIFIIQTRRKKKEREEKI

SEQ ID NO: 2400608 - protein, 17 aa, Entamoeba dispar
PIAIRELPFLHSSKPSG

SEQ ID NO: 2400609 - protein, 17 aa, Entamoeba dispar
PICVWVFCHFAKETTFM

SEQ ID NO: 2400610 - protein, 26 aa, Entamoeba dispar
PIDTLKFFYYYILRQIKTLYNYVIHS

SEQ ID NO: 2400611 - protein, 29 aa, Entamoeba dispar
PIEYTFPTLLLVIVIISAILFALISTLLP

SEQ ID NO: 2400612 - protein, 20 aa, Entamoeba dispar
PIFCCIAILLYLITSIAAYF

SEQ ID NO: 2400613 - protein, 18 aa, Entamoeba dispar
PIFIHFDQTLLGLSTIRT

SEQ ID NO: 2400614 - protein, 27 aa, Entamoeba dispar
PIFISSPLILTDLSSISFTLPLQSCIE

SEQ ID NO: 2400615 - protein, 26 aa, Entamoeba dispar
PIFQSIVMFFAMSLCFFIEKLIELYK

SEQ ID NO: 2400616 - protein, 18 aa, Entamoeba dispar
PIFYTFACTFLSFFFILF

SEQ ID NO: 2400617 - protein, 20 aa, Entamoeba dispar
PIGILYPFHLLIESDVQTMD

SEQ ID NO: 2400618 - protein, 17 aa, Entamoeba dispar
PIGVFRDGEDINIIVST

SEQ ID NO: 2400619 - protein, 18 aa, Entamoeba dispar
PIHLAILSLLIKNSSFDH

SEQ ID NO: 2400620 - protein, 17 aa, Entamoeba dispar
PIIFICFCSFTTSVIIG

SEQ ID NO: 2400621 - protein, 20 aa, Entamoeba dispar
PIIIESIPFTKMVALPFEIE

SEQ ID NO: 2400622 - protein, 17 aa, Entamoeba dispar
PIIIHFPKIPRVVYLNN

SEQ ID NO: 2400623 - protein, 18 aa, Entamoeba dispar
PIIISPLLSWGLSNEFSY

SEQ ID NO: 2400624 - protein, 23 aa, Entamoeba dispar
PIIRRMIYIFGKLLEIMNKSTLF

SEQ ID NO: 2400625 - protein, 20 aa, Entamoeba dispar
PIIVFGIFDRDILPETLIMN

SEQ ID NO: 2400626 - protein, 20 aa, Entamoeba dispar
PIIWIYVFGRCRGFVHFLSC

SEQ ID NO: 2400627 - protein, 18 aa, Entamoeba dispar
PIKILIEQLNIIAKNAHF

SEQ ID NO: 2400628 - protein, 30 aa, Entamoeba dispar
PILFLVVCIILLCIITYWAFIPIGVCLLFV

SEQ ID NO: 2400629 - protein, 17 aa, Entamoeba dispar
PILIRNAALIAVTTILI

SEQ ID NO: 2400630 - protein, 25 aa, Entamoeba dispar
PINGDDWFFVLRLAKQITVSRDFKY

SEQ ID NO: 2400631 - protein, 25 aa, Entamoeba dispar
PINRKRLFFLTPFTLLVAIACVIQL

SEQ ID NO: 2400632 - protein, 17 aa, Entamoeba dispar
PIQLIFPKNGGGDYDYS

SEQ ID NO: 2400633 - protein, 18 aa, Entamoeba dispar
PIRFKKLWEYSGNISSQF

SEQ ID NO: 2400634 - protein, 19 aa, Entamoeba dispar
PIRKSIFKSFMNILVKLNA

SEQ ID NO: 2400635 - protein, 38 aa, Entamoeba dispar
PISHVIFWSIFEGIVFLLWIISLLLLVITKKVRKGVTS

SEQ ID NO: 2400636 - protein, 26 aa, Entamoeba dispar
PISLQLHFLVWPLEQRTDICQYLINT

SEQ ID NO: 2400637 - protein, 20 aa, Entamoeba dispar
PISLSEILKLDLNGGWGDQW

SEQ ID NO: 2400638 - protein, 27 aa, Entamoeba dispar
PISLSILIITFIPLVYYVITEESIFHN

SEQ ID NO: 2400639 - protein, 20 aa, Entamoeba dispar
PITEYPYPWSISKFVCVGRR

SEQ ID NO: 2400640 - protein, 18 aa, Entamoeba dispar
PITKPILSSSNKYIFELI

SEQ ID NO: 2400641 - protein, 25 aa, Entamoeba dispar
PITQVRIQLVHLLLSLTLSNYSYIY

SEQ ID NO: 2400642 - protein, 33 aa, Entamoeba dispar
PIVINDFIFLIQYYINCISLISFYYFTSQRNIS

SEQ ID NO: 2400643 - protein, 19 aa, Entamoeba dispar
PIVKEFISFALRLINSHSF

SEQ ID NO: 2400644 - protein, 18 aa, Entamoeba dispar
PIVLFTFQKNACGSFYEE

SEQ ID NO: 2400645 - protein, 20 aa, Entamoeba dispar
PIVPYIGLILSDLTFTNFGN

SEQ ID NO: 2400646 - protein, 19 aa, Entamoeba dispar
PIYLYHTFNYLYTPFAQMY

SEQ ID NO: 2400647 - protein, 27 aa, Entamoeba dispar
PIYTPYYFMMYYFNNLVIHFTVYGTIA

SEQ ID NO: 2400648 - protein, 30 aa, Entamoeba dispar
PKAKFIRLKPLVFDFFKIPNYRVVMEKELR

SEQ ID NO: 2400649 - protein, 33 aa, Entamoeba dispar
PKCLFNQFKYFYNLYFLITALSQFVPILQVGYR

SEQ ID NO: 2400650 - protein, 27 aa, Entamoeba dispar
PKDIPENIFWCKYFRFLYIKCGKEKQY

SEQ ID NO: 2400651 - protein, 25 aa, Entamoeba dispar
PKEVLTFIVISIPVTILLAIYSIIA

SEQ ID NO: 2400652 - protein, 17 aa, Entamoeba dispar
PKEYVTQYIYRDPPKEK

SEQ ID NO: 2400653 - protein, 24 aa, Entamoeba dispar
PKKSNWIVVGVIVLGVVVGAVVGG

SEQ ID NO: 2400654 - protein, 21 aa, Entamoeba dispar
PKKYLLILPGETSTSFCVCIV

SEQ ID NO: 2400655 - protein, 23 aa, Entamoeba dispar
PKLSDTQRIFYIAKIKLNEDNNT

SEQ ID NO: 2400656 - protein, 34 aa, Entamoeba dispar
PKLSYNEWYFVFYKIFFRILEPIGYYHLKSENVF

SEQ ID NO: 2400657 - protein, 21 aa, Entamoeba dispar
PKNYLFIISGVWFGLIHFINI

SEQ ID NO: 2400658 - protein, 22 aa, Entamoeba dispar
PKQFFLTSFVMFNLLGIDVSNI

SEQ ID NO: 2400659 - protein, 23 aa, Entamoeba dispar
PKQKTRLFNFESCKNSTAAQCFL

SEQ ID NO: 2400660 - protein, 18 aa, Entamoeba dispar
PKQRPVFSEIDRITSKLF

SEQ ID NO: 2400661 - protein, 26 aa, Entamoeba dispar
PKSPSLLRTLFRMEWGHFLICFIAIL

SEQ ID NO: 2400662 - protein, 38 aa, Entamoeba dispar
PKSPSLLRTLFRMEWGHFLICFIAILISQLSTLVIPAI

SEQ ID NO: 2400663 - protein, 41 aa, Entamoeba dispar
PKTISIIFTCLLVISFVVALLLIITYFTFVVISDKVGKKYI

SEQ ID NO: 2400664 - protein, 24 aa, Entamoeba dispar
PKTKINIDLTKPIKSYIPQHLKKE

SEQ ID NO: 2400665 - protein, 20 aa, Entamoeba dispar
PKTPVYFEYGKVIFEGTIYF

SEQ ID NO: 2400666 - protein, 24 aa, Entamoeba dispar
PKTTKFIRPYLDQLKQFHSQLING

SEQ ID NO: 2400667 - protein, 27 aa, Entamoeba dispar
PKVEFLQEFVWSLPSIDFLPTSVVLKI

SEQ ID NO: 2400668 - protein, 25 aa, Entamoeba dispar
PKYFVKDSFLGWKYIDFNNSKFNPD

SEQ ID NO: 2400669 - protein, 20 aa, Entamoeba dispar
PKYVFHFNPQVKILGPRRSK

SEQ ID NO: 2400670 - protein, 18 aa, Entamoeba dispar
PKYVFISMAFADIFTKDP

SEQ ID NO: 2400671 - protein, 18 aa, Entamoeba dispar
PLAGMPIIDVYKAKICVV

SEQ ID NO: 2400672 - protein, 28 aa, Entamoeba dispar
PLAVFPIMLFFTMLSWLTLVVNITGFTI

SEQ ID NO: 2400673 - protein, 32 aa, Entamoeba dispar
PLCSLQTFFPPMLPFLFRSLTQPKQPLPKKYL

SEQ ID NO: 2400674 - protein, 27 aa, Entamoeba dispar
PLCYKQAYPTLWYKIKGDGRYLVVNTC

SEQ ID NO: 2400675 - protein, 24 aa, Entamoeba dispar
PLEESPFNLLKLDVQIQLKVCSFL

SEQ ID NO: 2400676 - protein, 19 aa, Entamoeba dispar
PLENLQVPYFVFTASRYLE

SEQ ID NO: 2400677 - protein, 27 aa, Entamoeba dispar
PLEYAVQLQLPLLVRLILDIDSADVKL

SEQ ID NO: 2400678 - protein, 31 aa, Entamoeba dispar
PLFGKHYLFALFLLFIVRFTITAMSISMPVP

SEQ ID NO: 2400679 - protein, 21 aa, Entamoeba dispar
PLGIYFIKYFVQILRNYKEEI

SEQ ID NO: 2400680 - protein, 19 aa, Entamoeba dispar
PLGWYYPVIYHYGQKELYG

SEQ ID NO: 2400681 - protein, 17 aa, Entamoeba dispar
PLHLACALGFLESVQKL

SEQ ID NO: 2400682 - protein, 23 aa, Entamoeba dispar
PLLIQCISYFIQKDLSLSLFCAK

SEQ ID NO: 2400683 - protein, 21 aa, Entamoeba dispar
PLLLLKCLILGFSLSSIGYFM

SEQ ID NO: 2400684 - protein, 28 aa, Entamoeba dispar
PLNLNDQYHFFFLIQDVTFPEEQKKETT

SEQ ID NO: 2400685 - protein, 34 aa, Entamoeba dispar
PLSQRTFKFFYFPRFLIVLLIGSFLVNLYLYNSE

SEQ ID NO: 2400686 - protein, 24 aa, Entamoeba dispar
PLSTYFDYFFLLVQDIIIILLILY

SEQ ID NO: 2400687 - protein, 20 aa, Entamoeba dispar
PLTQFNGLYGTFYKIKQNGV

SEQ ID NO: 2400688 - protein, 21 aa, Entamoeba dispar
PLYLYILILLYFYTFIPITIY

SEQ ID NO: 2400689 - protein, 22 aa, Entamoeba dispar
PLYMAPEILLNRPYSLPIDVYA

SEQ ID NO: 2400690 - protein, 26 aa, Entamoeba dispar
PLYTTIETIHLILLKGKYGIVSLCYG

SEQ ID NO: 2400691 - protein, 19 aa, Entamoeba dispar
PMIILSGLQLFDMLQIIPE

SEQ ID NO: 2400692 - protein, 34 aa, Entamoeba dispar
PMIYTPSWKSIVIPLLIGFIIPLISNIIPIKKAL

SEQ ID NO: 2400693 - protein, 24 aa, Entamoeba dispar
PMQIFWYIVYYGMIAFAAIILPFG

SEQ ID NO: 2400694 - protein, 25 aa, Entamoeba dispar
PMVQPAQQPMYAQPAPMGQPIQQPM

SEQ ID NO: 2400695 - protein, 25 aa, Entamoeba dispar
PNDPVYWIDLLTHEQFEEGFGSHTP

SEQ ID NO: 2400696 - protein, 26 aa, Entamoeba dispar
PNEISLFMLSKIYRDIFNLYIIKIKE

SEQ ID NO: 2400697 - protein, 18 aa, Entamoeba dispar
PNIAFFIGMILFVLLEKS

SEQ ID NO: 2400698 - protein, 28 aa, Entamoeba dispar
PNILRLFCLRFLVPGYYMVLQEIYSDKK

SEQ ID NO: 2400699 - protein, 30 aa, Entamoeba dispar
PNKKITILFLKIFLINPTRFCTMYSSPYFS

SEQ ID NO: 2400700 - protein, 26 aa, Entamoeba dispar
PNNYRIVIFCLIILCSILFDIYSLWQ

SEQ ID NO: 2400701 - protein, 25 aa, Entamoeba dispar
PNQIKIRRFLPLKERLTLGRVLNDI

SEQ ID NO: 2400702 - protein, 28 aa, Entamoeba dispar
PNSFQLSPFLYFQPDVFVLAFDISNIKN

SEQ ID NO: 2400703 - protein, 25 aa, Entamoeba dispar
PNSIIKFFRTLFFRQTMHQLLKGRK

SEQ ID NO: 2400704 - protein, 33 aa, Entamoeba dispar
PNSSKFTFYSYPQTKILLPKTKQKIILFFTAHC

SEQ ID NO: 2400705 - protein, 36 aa, Entamoeba dispar
PNSSSHHIIFLLLLIIIVIILIVLIVLMLMNNTNQS

SEQ ID NO: 2400706 - protein, 18 aa, Entamoeba dispar
PNVLLKFNQQHQLIAVLS

SEQ ID NO: 2400707 - protein, 21 aa, Entamoeba dispar
PPHGELLFRGLPVTKGYFNRP

SEQ ID NO: 2400708 - protein, 25 aa, Entamoeba dispar
PPPNGYIRFYGFTKYSNYDNYLSDL

SEQ ID NO: 2400709 - protein, 21 aa, Entamoeba dispar
PPSNFFVFFNLSYSLSSQHTT

SEQ ID NO: 2400710 - protein, 33 aa, Entamoeba dispar
PPYGFEFLNNIPYWIFPLINVLILTIVFIIKQI

SEQ ID NO: 2400711 - protein, 29 aa, Entamoeba dispar
PQFMPYYYVILIFPLLGARYFIYKKNGWQ

SEQ ID NO: 2400712 - protein, 19 aa, Entamoeba dispar
PQGELLFRGLPVSKGYFNR

SEQ ID NO: 2400713 - protein, 29 aa, Entamoeba dispar
PQGTLKIGLLFILLTIIFQLISCFTQEFG

SEQ ID NO: 2400714 - protein, 24 aa, Entamoeba dispar
PQKLPKLSLQFKKIPTNPFDEPTT

SEQ ID NO: 2400715 - protein, 23 aa, Entamoeba dispar
PQLHFTWMCELSHKLKIAELNIE

SEQ ID NO: 2400716 - protein, 27 aa, Entamoeba dispar
PQPPKYILYYFINALILHFHVYGTIAI

SEQ ID NO: 2400717 - protein, 21 aa, Entamoeba dispar
PQSFMSFFTMAPFISANFQVH

SEQ ID NO: 2400718 - protein, 23 aa, Entamoeba dispar
PQSKQLLYIVAEPAGYYPYYYNP

SEQ ID NO: 2400719 - protein, 23 aa, Entamoeba dispar
PRHAYRLLSVFLLKAVSIMNEQP

SEQ ID NO: 2400720 - protein, 17 aa, Entamoeba dispar
PRHFILKLKIKGIYDSD

SEQ ID NO: 2400721 - protein, 19 aa, Entamoeba dispar
PRRVLRCPALLVFQNFLIQ

SEQ ID NO: 2400722 - protein, 27 aa, Entamoeba dispar
PSAQWVMYALLMDIIKGYKLIMKHIEE

SEQ ID NO: 2400723 - protein, 23 aa, Entamoeba dispar
PSDQWLDNISRWSNDRMPIDSIG

SEQ ID NO: 2400724 - protein, 22 aa, Entamoeba dispar
PSFDRLSFPTLGMLISKKLKKQ

SEQ ID NO: 2400725 - protein, 22 aa, Entamoeba dispar
PSFLIICFYVYLSFVIDKHIVN

SEQ ID NO: 2400726 - protein, 19 aa, Entamoeba dispar
PSGKYVTLTLIPKHIQDTD

SEQ ID NO: 2400727 - protein, 28 aa, Entamoeba dispar
PSIDFEPFRWLFTLPLSGLTTTLSPFFN

SEQ ID NO: 2400728 - protein, 21 aa, Entamoeba dispar
PSIEFLPICISFIVLMMSYNI

SEQ ID NO: 2400729 - protein, 18 aa, Entamoeba dispar
PSIKYFNTMFSTSSRRIC

SEQ ID NO: 2400730 - protein, 17 aa, Entamoeba dispar
PSIMKFEIKKLMKNPRK

SEQ ID NO: 2400731 - protein, 20 aa, Entamoeba dispar
PSLEAFIHLIFRIPQKQSNP

SEQ ID NO: 2400732 - protein, 21 aa, Entamoeba dispar
PSLLEFIGYFYFFPSIFSGPC

SEQ ID NO: 2400733 - protein, 21 aa, Entamoeba dispar
PSLNPAKLIPLRRLTIDSSQI

SEQ ID NO: 2400734 - protein, 37 aa, Entamoeba dispar
PSLNQPQLIIWKSDYIDLYNPTWLRAGSFVISNPVNN

SEQ ID NO: 2400735 - protein, 20 aa, Entamoeba dispar
PSLRLVILNIIRNLAVDEGL

SEQ ID NO: 2400736 - protein, 19 aa, Entamoeba dispar
PSLVTLKKGFACEFHIFIK

SEQ ID NO: 2400737 - protein, 32 aa, Entamoeba dispar
PSLYEFIRSMITTYRDFIFKRPNNLALNLLKN

SEQ ID NO: 2400738 - protein, 17 aa, Entamoeba dispar
PSMTVNLVMIIIGIITL

SEQ ID NO: 2400739 - protein, 25 aa, Entamoeba dispar
PSNILELVFCVIMLYMKGNKKLINT

SEQ ID NO: 2400740 - protein, 20 aa, Entamoeba dispar
PSRFLFYVSALLHSISDYLP

SEQ ID NO: 2400741 - protein, 22 aa, Entamoeba dispar
PSSNYLTKYIGKVLLKNTHLII

SEQ ID NO: 2400742 - protein, 25 aa, Entamoeba dispar
PSSYNFLFEKVLFNTNLKFIEDQPE

SEQ ID NO: 2400743 - protein, 18 aa, Entamoeba dispar
PSWVYSAIAFCEASYRKN

SEQ ID NO: 2400744 - protein, 17 aa, Entamoeba dispar
PSYKFIKTTWDLFVKDI

SEQ ID NO: 2400745 - protein, 25 aa, Entamoeba dispar
PTDPQVFLRICQLIYVCLTTQPIDN

SEQ ID NO: 2400746 - protein, 31 aa, Entamoeba dispar
PTLNQPQIIIWKSDWIHLYKPAGSQISKFEV

SEQ ID NO: 2400747 - protein, 29 aa, Entamoeba dispar
PTMETFLQTSRVFCKYAFPDNLARVLSRI

SEQ ID NO: 2400748 - protein, 24 aa, Entamoeba dispar
PTSDPRFVYPWKIAEFVISGKRLE

SEQ ID NO: 2400749 - protein, 27 aa, Entamoeba dispar
PTSMPFHYFMLFVRMLISLTNSIILIV

SEQ ID NO: 2400750 - protein, 17 aa, Entamoeba dispar
PTSNFFRYCLTGFLYNY

SEQ ID NO: 2400751 - protein, 36 aa, Entamoeba dispar
PTTIYLVIFYFILSTILYIPYLFLFGWNIVSIEDHY

SEQ ID NO: 2400752 - protein, 21 aa, Entamoeba dispar
PTVFILLYLLTLFTLCLCVNR

SEQ ID NO: 2400753 - protein, 25 aa, Entamoeba dispar
PVFMAPEILLLQKYKKPADIYAFAI

SEQ ID NO: 2400754 - protein, 17 aa, Entamoeba dispar
PVGLLVLMLIITILVSC

SEQ ID NO: 2400755 - protein, 19 aa, Entamoeba dispar
PVHIIFKTVLSTKLDYNDL

SEQ ID NO: 2400756 - protein, 26 aa, Entamoeba dispar
PVIPDYLICPSLPTFQWTMIITYSLD

SEQ ID NO: 2400757 - protein, 29 aa, Entamoeba dispar
PVIVDLFGLLLVSIILTSSIFLVIKTMKL

SEQ ID NO: 2400758 - protein, 17 aa, Entamoeba dispar
PVKLLEDGIRKALGRRL

SEQ ID NO: 2400759 - protein, 20 aa, Entamoeba dispar
PVNYIKVEFGKCYYFGSDSG

SEQ ID NO: 2400760 - protein, 25 aa, Entamoeba dispar
PVQRTMRYPLLLETIKKHTPPLHPD

SEQ ID NO: 2400761 - protein, 28 aa, Entamoeba dispar
PVSDLFKLRVFYQAYIIYKKVGDKSKCN

SEQ ID NO: 2400762 - protein, 33 aa, Entamoeba dispar
PVSEFWGHVCIVWNKCYYFFSQNQLKMQKENKR

SEQ ID NO: 2400763 - protein, 24 aa, Entamoeba dispar
PVSPLSPLLNFYCEVLLNLNKNNK

SEQ ID NO: 2400764 - protein, 25 aa, Entamoeba dispar
PVVEFILLTLVIINSIWTIPLEPLD

SEQ ID NO: 2400765 - protein, 17 aa, Entamoeba dispar
PYCPSSFEAPLAFMSMS

SEQ ID NO: 2400766 - protein, 17 aa, Entamoeba dispar
PYFTIDPPSIDFQEERV

SEQ ID NO: 2400767 - protein, 26 aa, Entamoeba dispar
PYHNNILQLLMYFYDISIDLDVIEHQ

SEQ ID NO: 2400768 - protein, 21 aa, Entamoeba dispar
PYIFIKTLCKWNVSLPEKIFG

SEQ ID NO: 2400769 - protein, 19 aa, Entamoeba dispar
PYILIRIAMCFFVVAVAII

SEQ ID NO: 2400770 - protein, 28 aa, Entamoeba dispar
PYKQQYKILIIILFFLETVTQNNPMFDC

SEQ ID NO: 2400771 - protein, 20 aa, Entamoeba dispar
PYLGLIIYLMNLLYILCTSI

SEQ ID NO: 2400772 - protein, 19 aa, Entamoeba dispar
PYMLVEVFSLPLFYFISQN

SEQ ID NO: 2400773 - protein, 23 aa, Entamoeba dispar
PYPLNEFPYPWSISKFVCVGRRL

SEQ ID NO: 2400774 - protein, 18 aa, Entamoeba dispar
PYPLQHPYYCGISCFLKS

SEQ ID NO: 2400775 - protein, 31 aa, Entamoeba dispar
PYSTIPILLFPLFFFFALLGECTIAFIGFNI

SEQ ID NO: 2400776 - protein, 19 aa, Entamoeba dispar
PYTYGVWIELIHDKEAKVA

SEQ ID NO: 2400777 - protein, 17 aa, Entamoeba dispar
PYVIILDGLYSLYSLEI

SEQ ID NO: 2400778 - protein, 17 aa, Entamoeba dispar
PYYYNPITVEAGVSGIF

SEQ ID NO: 2400779 - protein, 24 aa, Entamoeba dispar
QAEGVPNYFIFNATRQKELWTTVD

SEQ ID NO: 2400780 - protein, 18 aa, Entamoeba dispar
QAFCKFALIYIRANSKNE

SEQ ID NO: 2400781 - protein, 22 aa, Entamoeba dispar
QAINILTLFRNITANVAIENDY

SEQ ID NO: 2400782 - protein, 20 aa, Entamoeba dispar
QAITEFIKYIYLNGYYSLEE

SEQ ID NO: 2400783 - protein, 28 aa, Entamoeba dispar
QALESLFIFVLFLYYLITLICMSSKNSL

SEQ ID NO: 2400784 - protein, 22 aa, Entamoeba dispar
QAMRRLFYRFQMVGESQIVGRV

SEQ ID NO: 2400785 - protein, 26 aa, Entamoeba dispar
QAPLPKRYGLLLRNYIRHFGDHGNVV

SEQ ID NO: 2400786 - protein, 26 aa, Entamoeba dispar
QARMFAILSMVFFLVSTIIIVISIGF

SEQ ID NO: 2400787 - protein, 18 aa, Entamoeba dispar
QARTCDFLSFFIDSASTA

SEQ ID NO: 2400788 - protein, 40 aa, Entamoeba dispar
QASRYLPIQTLRFIFFYFDVVYLRLPRQPLTSKWNILLHE

SEQ ID NO: 2400789 - protein, 23 aa, Entamoeba dispar
QAVLLGILNINGFGFRIKRPERR

SEQ ID NO: 2400790 - protein, 21 aa, Entamoeba dispar
QCAEDYFRYGLELSTLCLPQT

SEQ ID NO: 2400791 - protein, 25 aa, Entamoeba dispar
QCETNPYCILFDGSCNKCIKCKSSY

SEQ ID NO: 2400792 - protein, 25 aa, Entamoeba dispar
QCIIFDNYHRLLPTLPLHLMLERVL

SEQ ID NO: 2400793 - protein, 18 aa, Entamoeba dispar
QCLFEWRGKCWKCKDGYY

SEQ ID NO: 2400794 - protein, 17 aa, Entamoeba dispar
QCMFASAVQYYVPLRMK

SEQ ID NO: 2400795 - protein, 27 aa, Entamoeba dispar
QDAEYVFYISLSFTTAIFLRWVNRIDG

SEQ ID NO: 2400796 - protein, 32 aa, Entamoeba dispar
QDIIDKKLELPPLLRSRIILDAAKGIALLHSK

SEQ ID NO: 2400797 - protein, 23 aa, Entamoeba dispar
QDIIIILLILYYANKFTPIFYTF

SEQ ID NO: 2400798 - protein, 18 aa, Entamoeba dispar
QDLLWGSIVNHDLFYLND

SEQ ID NO: 2400799 - protein, 26 aa, Entamoeba dispar
QDSKIMKEIFKLSISYINKFIEKEII

SEQ ID NO: 2400800 - protein, 27 aa, Entamoeba dispar
QEDCSSEYIDLSKMILVFSSDPGIKSD

SEQ ID NO: 2400801 - protein, 32 aa, Entamoeba dispar
QEELMKRFAIITTLFTPLTFLSTSFGMNVLVP

SEQ ID NO: 2400802 - protein, 29 aa, Entamoeba dispar
QEESLVSRLLWQFLMKIKDDMEKVENVMK

SEQ ID NO: 2400803 - protein, 26 aa, Entamoeba dispar
QEFRIDIILNHILFTGTLGVLSSSLS

SEQ ID NO: 2400804 - protein, 31 aa, Entamoeba dispar
QEHYVVLPLFALDLLFMYLKEVVGHCLSVKD

SEQ ID NO: 2400805 - protein, 24 aa, Entamoeba dispar
QELESPILYLFLSLNEMADVSLEI

SEQ ID NO: 2400806 - protein, 22 aa, Entamoeba dispar
QELLLYIALTHIYFHSEIKELF

SEQ ID NO: 2400807 - protein, 25 aa, Entamoeba dispar
QELLSKYFYYIQFISVYSINDTYLF

SEQ ID NO: 2400808 - protein, 20 aa, Entamoeba dispar
QEMILNGMYWFECLFNAKKY

SEQ ID NO: 2400809 - protein, 18 aa, Entamoeba dispar
QEMKKKILLLMKKKQELY

SEQ ID NO: 2400810 - protein, 40 aa, Entamoeba dispar
QEMKSCVPLYRPLTVILFFLITGIIFIPIGIAVFVVTNNC

SEQ ID NO: 2400811 - protein, 23 aa, Entamoeba dispar
QENIELFTQFGFEVIFREDKEVT

SEQ ID NO: 2400812 - protein, 25 aa, Entamoeba dispar
QENKYWKLIKRICLFQVFGYKGTLI

SEQ ID NO: 2400813 - protein, 29 aa, Entamoeba dispar
QENTYYFIRYFLVICIFFILACIGIICAV

SEQ ID NO: 2400814 - protein, 24 aa, Entamoeba dispar
QEPTSYLSCKIPKQPNGKYDMGLL

SEQ ID NO: 2400815 - protein, 19 aa, Entamoeba dispar
QEPVNKSNIILFFEDIESL

SEQ ID NO: 2400816 - protein, 19 aa, Entamoeba dispar
QESKFRVVVFTTLQGMFSV

SEQ ID NO: 2400817 - protein, 17 aa, Entamoeba dispar
QEVLIMLLNNLKVLDRQ

SEQ ID NO: 2400818 - protein, 19 aa, Entamoeba dispar
QEYFISVIMFIVCGILSIS

SEQ ID NO: 2400819 - protein, 25 aa, Entamoeba dispar
QFAPFSVFVYLFFKKAYGLYTIKSN

SEQ ID NO: 2400820 - protein, 21 aa, Entamoeba dispar
QFDSRLTYFWITHIGSGRFNN

SEQ ID NO: 2400821 - protein, 17 aa, Entamoeba dispar
QFEICKTLRFTLAANKT

SEQ ID NO: 2400822 - protein, 19 aa, Entamoeba dispar
QFENAFVLAYTKYNSPSSH

SEQ ID NO: 2400823 - protein, 18 aa, Entamoeba dispar
QFHPSTLWTSFSYLSLYV

SEQ ID NO: 2400824 - protein, 17 aa, Entamoeba dispar
QFIFRFACRALKEKKVL

SEQ ID NO: 2400825 - protein, 20 aa, Entamoeba dispar
QFIIIYILRVILVENIFLKL

SEQ ID NO: 2400826 - protein, 20 aa, Entamoeba dispar
QFKCIQCKKGYYLNSKQECQ

SEQ ID NO: 2400827 - protein, 21 aa, Entamoeba dispar
QFKCIQCKKGYYLNSKQECQY

SEQ ID NO: 2400828 - protein, 27 aa, Entamoeba dispar
QFKDKRLFEKLPIGNLLLHYVNWMTNL

SEQ ID NO: 2400829 - protein, 18 aa, Entamoeba dispar
QFKLLNIMYKRIIYIQAL

SEQ ID NO: 2400830 - protein, 19 aa, Entamoeba dispar
QFKVYIFNVGQADSQLIVY

SEQ ID NO: 2400831 - protein, 21 aa, Entamoeba dispar
QFLGTLIFYYLAIKTPPGYIK

SEQ ID NO: 2400832 - protein, 25 aa, Entamoeba dispar
QFLMMLYCVIVFALMLITCFVQLGF

SEQ ID NO: 2400833 - protein, 25 aa, Entamoeba dispar
QFLTSLLFIIIFDFISTVISIPFKL

SEQ ID NO: 2400834 - protein, 28 aa, Entamoeba dispar
QFNFSWIYLFYIVLWFLSFVCYYKCVTT

SEQ ID NO: 2400835 - protein, 34 aa, Entamoeba dispar
QFNPMVIVKYSWFFFDLIIRSLVYYLNDEINKGN

SEQ ID NO: 2400836 - protein, 26 aa, Entamoeba dispar
QFPSSLLIRRKLVLIAFQCLQSKVIK

SEQ ID NO: 2400837 - protein, 35 aa, Entamoeba dispar
QFRIWCIWCIILFFSPFIIIKIYFTFKKLFSSNII

SEQ ID NO: 2400838 - protein, 19 aa, Entamoeba dispar
QFSIIIRFLCVILMFGCNS

SEQ ID NO: 2400839 - protein, 20 aa, Entamoeba dispar
QFSIIIRFLCVILMFVCNSA

SEQ ID NO: 2400840 - protein, 32 aa, Entamoeba dispar
QFTLAKDYLVKGYLGFTPLSKEYLNTPISITW

SEQ ID NO: 2400841 - protein, 23 aa, Entamoeba dispar
QFTLPQQIYLISLAVLPICISII

SEQ ID NO: 2400842 - protein, 18 aa, Entamoeba dispar
QFVLSTVFFQLLLCSVMA

SEQ ID NO: 2400843 - protein, 21 aa, Entamoeba dispar
QGELLIGTWIDGVPVGPFEST

SEQ ID NO: 2400844 - protein, 25 aa, Entamoeba dispar
QGEPYGVFMFFAAYIDMEQGTSIEN

SEQ ID NO: 2400845 - protein, 21 aa, Entamoeba dispar
QGFQFRMYFVPPVLQNHYGFG

SEQ ID NO: 2400846 - protein, 32 aa, Entamoeba dispar
QGLEIVRLVLGRKITLIIFGTNNGKIHCLDGS

SEQ ID NO: 2400847 - protein, 24 aa, Entamoeba dispar
QGMFSVLYRFIFSSDINTFQKLLM

SEQ ID NO: 2400848 - protein, 27 aa, Entamoeba dispar
QGNPKLLNAYIYGLGIVLLLGVEVINP

SEQ ID NO: 2400849 - protein, 23 aa, Entamoeba dispar
QGSNTIFNIKYSNSLWIKADNSN

SEQ ID NO: 2400850 - protein, 24 aa, Entamoeba dispar
QGVIWFFVLFIAAFPFYLTCIAFG

SEQ ID NO: 2400851 - protein, 29 aa, Entamoeba dispar
QHIDSFIDYYFEILPLFKEIPKPIQGLIN

SEQ ID NO: 2400852 - protein, 24 aa, Entamoeba dispar
QHIILIILLFVYINNGAICGVGCI

SEQ ID NO: 2400853 - protein, 26 aa, Entamoeba dispar
QHKSIACIWFLTMGSLIITIIIFCTI

SEQ ID NO: 2400854 - protein, 20 aa, Entamoeba dispar
QHLSTIYAYLTKQANNDKPK

SEQ ID NO: 2400855 - protein, 18 aa, Entamoeba dispar
QIAFHKFKPMILNLVFMI

SEQ ID NO: 2400856 - protein, 24 aa, Entamoeba dispar
QIAVGFFVFLFANTFIWTKNGTYL

SEQ ID NO: 2400857 - protein, 23 aa, Entamoeba dispar
QIAYIYPTFYSACDYVFHFLVRV

SEQ ID NO: 2400858 - protein, 26 aa, Entamoeba dispar
QIDNDLFVLLIKTLFDEFKRIKDFPK

SEQ ID NO: 2400859 - protein, 26 aa, Entamoeba dispar
QIFLGVYICVMLFVWGGSQTIKASFV

SEQ ID NO: 2400860 - protein, 22 aa, Entamoeba dispar
QIGDIIVYNLPSKGIPIIHRVI

SEQ ID NO: 2400861 - protein, 22 aa, Entamoeba dispar
QIGLLTWKITYKNNLFTFQLIK

SEQ ID NO: 2400862 - protein, 27 aa, Entamoeba dispar
QIGLSQILLRFLKNDKLLPSLTTMCVS

SEQ ID NO: 2400863 - protein, 18 aa, Entamoeba dispar
QIICLARALLKKSKILIM

SEQ ID NO: 2400864 - protein, 32 aa, Entamoeba dispar
QIIEIYGAIVCFIYFPFSQIASFLIIDNTKRI

SEQ ID NO: 2400865 - protein, 21 aa, Entamoeba dispar
QIIISTIKIISFLYSRNISNN

SEQ ID NO: 2400866 - protein, 19 aa, Entamoeba dispar
QIILLKPSENFVAAAIGIQ

SEQ ID NO: 2400867 - protein, 20 aa, Entamoeba dispar
QIINFFNYYPTNITFIVRAM

SEQ ID NO: 2400868 - protein, 25 aa, Entamoeba dispar
QIISPIFIVILMIFTGFFIQKDNII

SEQ ID NO: 2400869 - protein, 20 aa, Entamoeba dispar
QIIYSLLLVYTFRTLERRWS

SEQ ID NO: 2400870 - protein, 28 aa, Entamoeba dispar
QIKYWIPRIIFFLFFFAAVELVFVYNKS

SEQ ID NO: 2400871 - protein, 19 aa, Entamoeba dispar
QILFFVNSYASECIINEGT

SEQ ID NO: 2400872 - protein, 23 aa, Entamoeba dispar
QILHKEFIIIGLFITVFVLTLIS

SEQ ID NO: 2400873 - protein, 18 aa, Entamoeba dispar
QILPLLMSITLEQQERHI

SEQ ID NO: 2400874 - protein, 17 aa, Entamoeba dispar
QILRMKLGYYTKDLYRM

SEQ ID NO: 2400875 - protein, 27 aa, Entamoeba dispar
QILTFTLMYILLLFNNPLALIEYQAHH

SEQ ID NO: 2400876 - protein, 36 aa, Entamoeba dispar
QISTLIKFCFYKNAAFFLMDIWFATISNFTCQIIYD

SEQ ID NO: 2400877 - protein, 23 aa, Entamoeba dispar
QITDFIVMVLIVGTIVSLCIEEW

SEQ ID NO: 2400878 - protein, 23 aa, Entamoeba dispar
QIYKILVCFFARDLNIHLTSIIY

SEQ ID NO: 2400879 - protein, 18 aa, Entamoeba dispar
QIYRLFTSLFLSPSLFGL

SEQ ID NO: 2400880 - protein, 20 aa, Entamoeba dispar
QIYRLKLMWCEIEPFTCFFE

SEQ ID NO: 2400881 - protein, 28 aa, Entamoeba dispar
QKALQTEKLFKETLFFFTADENASNIYT

SEQ ID NO: 2400882 - protein, 30 aa, Entamoeba dispar
QKCSYFEVIIPFLLFAECRLVVTSNAILLN

SEQ ID NO: 2400883 - protein, 21 aa, Entamoeba dispar
QKEEIILLLKEMGNIVLMCGD

SEQ ID NO: 2400884 - protein, 23 aa, Entamoeba dispar
QKFITYIIITPFQSAIQSIVLKN

SEQ ID NO: 2400885 - protein, 18 aa, Entamoeba dispar
QKGLPAAYKQLSASILIH

SEQ ID NO: 2400886 - protein, 26 aa, Entamoeba dispar
QKHYTKLYIALISLLFETGTKGQTDI

SEQ ID NO: 2400887 - protein, 34 aa, Entamoeba dispar
QKIIIVINALTSCNLFFLLFADICNKNIPNFIHS

SEQ ID NO: 2400888 - protein, 42 aa, Entamoeba dispar
QKIVEPLLLILIIISLLLMFIPKPIFLYIKLRKQQKAHPESR

SEQ ID NO: 2400889 - protein, 29 aa, Entamoeba dispar
QKKETTLQYFAYRPLFEQGKLIINGEYKL

SEQ ID NO: 2400890 - protein, 19 aa, Entamoeba dispar
QKKLFLRKKPEQPRTIIIP

SEQ ID NO: 2400891 - protein, 35 aa, Entamoeba dispar
QKKNLVVIYFVLGSLLHFLYAISSLIYSKPSRQEE

SEQ ID NO: 2400892 - protein, 36 aa, Entamoeba dispar
QKKRQVFTTLFFLRYLFLPLISYPSLLKILQKATSE

SEQ ID NO: 2400893 - protein, 29 aa, Entamoeba dispar
QKLTSLLLHYIYLLPIYKNNNLTSILNEK

SEQ ID NO: 2400894 - protein, 21 aa, Entamoeba dispar
QKMSKIKVLFAGAEHLLHDEI

SEQ ID NO: 2400895 - protein, 24 aa, Entamoeba dispar
QKNIKIIKLLVLSLFNQFNSIEEL

SEQ ID NO: 2400896 - protein, 23 aa, Entamoeba dispar
QKNYLIIINLLNAGSLTLLVLIQ

SEQ ID NO: 2400897 - protein, 38 aa, Entamoeba dispar
QKRTINVVSPYKVRLVWKEIRGVWQWIEGRTYEVKPEL

SEQ ID NO: 2400898 - protein, 24 aa, Entamoeba dispar
QKRYRFAIKILKRNLKKIGLHKTR

SEQ ID NO: 2400899 - protein, 25 aa, Entamoeba dispar
QKSLYLSYFIIFNINLCAIAISFIF

SEQ ID NO: 2400900 - protein, 22 aa, Entamoeba dispar
QKSVPHRILLTTYITLLRSFNN

SEQ ID NO: 2400901 - protein, 33 aa, Entamoeba dispar
QKTIQLKHGLVTEELLIPIPSGIKDKEQVKVGD

SEQ ID NO: 2400902 - protein, 23 aa, Entamoeba dispar
QKTIQLLIRFKNSFNALCQSHLR

SEQ ID NO: 2400903 - protein, 26 aa, Entamoeba dispar
QKYGMFIMIGVLILTFFFKGNSGPEP

SEQ ID NO: 2400904 - protein, 17 aa, Entamoeba dispar
QLALPTSYELLCQVFHC

SEQ ID NO: 2400905 - protein, 26 aa, Entamoeba dispar
QLDIASYLHYVLLALPSECITKKCFD

SEQ ID NO: 2400906 - protein, 20 aa, Entamoeba dispar
QLEFKLRNQLPYLSPKEIDD

SEQ ID NO: 2400907 - protein, 19 aa, Entamoeba dispar
QLFFHILQLRKSCNNKIVC

SEQ ID NO: 2400908 - protein, 30 aa, Entamoeba dispar
QLGPSKNIYLIPYLKLFLNFEPTQPPIVKQ

SEQ ID NO: 2400909 - protein, 23 aa, Entamoeba dispar
QLIGLFLALLINKRIILTSRCTT

SEQ ID NO: 2400910 - protein, 17 aa, Entamoeba dispar
QLIIWKSDYIHLYKDEK

SEQ ID NO: 2400911 - protein, 18 aa, Entamoeba dispar
QLKSHIPCLPKIVQIFLS

SEQ ID NO: 2400912 - protein, 17 aa, Entamoeba dispar
QLLFILRNNIHSSPIVQ

SEQ ID NO: 2400913 - protein, 20 aa, Entamoeba dispar
QLLLGIYFADTLKQYENSFK

SEQ ID NO: 2400914 - protein, 17 aa, Entamoeba dispar
QLLYHKVSDGDLPLYLV

SEQ ID NO: 2400915 - protein, 41 aa, Entamoeba dispar
QLLYSSIFNFVPLPLYIGWYMIFFTTIFNQLPIIMFITDFD

SEQ ID NO: 2400916 - protein, 25 aa, Entamoeba dispar
QLNDKIVDLYIKLGKYLPECETLPE

SEQ ID NO: 2400917 - protein, 18 aa, Entamoeba dispar
QLPIIMFITDFDLYRYST

SEQ ID NO: 2400918 - protein, 21 aa, Entamoeba dispar
QLPLIMPIHHICNTTLMLLLR

SEQ ID NO: 2400919 - protein, 19 aa, Entamoeba dispar
QLPPELLVNVKLFEISYIQ

SEQ ID NO: 2400920 - protein, 17 aa, Entamoeba dispar
QLPYMLVEVFSLPLFYF

SEQ ID NO: 2400921 - protein, 39 aa, Entamoeba dispar
QLPYRFVYLLEYIGPLVLYFIPFFILKALNRIILYQQYM

SEQ ID NO: 2400922 - protein, 26 aa, Entamoeba dispar
QLQIPKEFVSLMVILIFVVSGRIKNY

SEQ ID NO: 2400923 - protein, 22 aa, Entamoeba dispar
QLQPILQTFTVIPSYPILLKGE

SEQ ID NO: 2400924 - protein, 30 aa, Entamoeba dispar
QLQQRHTLMFIILRQYFQLILSPDKTVSTM

SEQ ID NO: 2400925 - protein, 29 aa, Entamoeba dispar
QLQQRHTLMFIILRQYFQLILTHDKTISK

SEQ ID NO: 2400926 - protein, 19 aa, Entamoeba dispar
QLQYSTYFYILLDTNHYIN

SEQ ID NO: 2400927 - protein, 23 aa, Entamoeba dispar
QLRLLKIVLNWLIPEVFNECLYF

SEQ ID NO: 2400928 - protein, 18 aa, Entamoeba dispar
QLRQNCVVELIGAVYTEG

SEQ ID NO: 2400929 - protein, 21 aa, Entamoeba dispar
QLSIGFIIEVPTNGFRCISDE

SEQ ID NO: 2400930 - protein, 34 aa, Entamoeba dispar
QLSSTVFIGFIHKFLYPINPIFLTKRVTEPPTKL

SEQ ID NO: 2400931 - protein, 20 aa, Entamoeba dispar
QLTIFYYYKYYFKLLFPVIN

SEQ ID NO: 2400932 - protein, 23 aa, Entamoeba dispar
QLTRLPIFKFLRNSNELFMQMLS

SEQ ID NO: 2400933 - protein, 22 aa, Entamoeba dispar
QLVLQFVDLLPNSLPILLHCSS

SEQ ID NO: 2400934 - protein, 23 aa, Entamoeba dispar
QLVLTVYRFVSFLIMFITCVVQL

SEQ ID NO: 2400935 - protein, 20 aa, Entamoeba dispar
QLWFLLSWTIMVICGATAVY

SEQ ID NO: 2400936 - protein, 18 aa, Entamoeba dispar
QLYTIVIDLAKRGDLEPS

SEQ ID NO: 2400937 - protein, 18 aa, Entamoeba dispar
QMAHTILKILYYHPRDTL

SEQ ID NO: 2400938 - protein, 21 aa, Entamoeba dispar
QMALTFYRFFAFSVMLITCIV

SEQ ID NO: 2400939 - protein, 31 aa, Entamoeba dispar
QMASGLSIFGWLLASVFIIAAAITYPMDIAV

SEQ ID NO: 2400940 - protein, 32 aa, Entamoeba dispar
QMEKEMDTFTIWISLEESFLGTQKTIQLKHGL

SEQ ID NO: 2400941 - protein, 19 aa, Entamoeba dispar
QMFFNLFPKHYALNHLNYL

SEQ ID NO: 2400942 - protein, 18 aa, Entamoeba dispar
QMIDLRYDLSFMSKVLVT

SEQ ID NO: 2400943 - protein, 20 aa, Entamoeba dispar
QMIVTAVGLNSLWGKTKESL

SEQ ID NO: 2400944 - protein, 18 aa, Entamoeba dispar
QNFIPFGMFLFSSNPIRK

SEQ ID NO: 2400945 - protein, 27 aa, Entamoeba dispar
QNGFSIVILICDIRFPPKLAFVTMKNI

SEQ ID NO: 2400946 - protein, 17 aa, Entamoeba dispar
QNGILHRDIKPDNFLVV

SEQ ID NO: 2400947 - protein, 32 aa, Entamoeba dispar
QNHFLSIVIVIFIGCAFLLGVAYFLTRDRHQA

SEQ ID NO: 2400948 - protein, 28 aa, Entamoeba dispar
QNIEHMLNELLGLYNHITFLVSTQEEMV

SEQ ID NO: 2400949 - protein, 22 aa, Entamoeba dispar
QNIFIILYHFFTFKEVKNIIEV

SEQ ID NO: 2400950 - protein, 19 aa, Entamoeba dispar
QNILTVIFFFFFGSSYLMF

SEQ ID NO: 2400951 - protein, 30 aa, Entamoeba dispar
QNIPDVFVHLLLYILYDYLISAKSLQREYM

SEQ ID NO: 2400952 - protein, 28 aa, Entamoeba dispar
QNKLHGGWKYLFIVLSRFEQMNLIEHQT

SEQ ID NO: 2400953 - protein, 26 aa, Entamoeba dispar
QNLETLFRVVSLLIGWLILHVLGDFT

SEQ ID NO: 2400954 - protein, 22 aa, Entamoeba dispar
QNLLIIFLICWCLFRILDSMIR

SEQ ID NO: 2400955 - protein, 22 aa, Entamoeba dispar
QNMQFHVLKKEQLGFIARSDIL

SEQ ID NO: 2400956 - protein, 27 aa, Entamoeba dispar
QNNHRYFIQFLYYLPINGLTGMVIQIW

SEQ ID NO: 2400957 - protein, 17 aa, Entamoeba dispar
QNQLLVEILLDKLIDTI

SEQ ID NO: 2400958 - protein, 28 aa, Entamoeba dispar
QNRMIMLFISLILILLEHILQLPLIIIS

SEQ ID NO: 2400959 - protein, 21 aa, Entamoeba dispar
QNRYRIGHWLELNLLEFSDSI

SEQ ID NO: 2400960 - protein, 27 aa, Entamoeba dispar
QNSETTFILILSLITVILGFIVVVMLV

SEQ ID NO: 2400961 - protein, 23 aa, Entamoeba dispar
QNVKPYIFGLKLISTYVGHLPMN

SEQ ID NO: 2400962 - protein, 29 aa, Entamoeba dispar
QPDNLLTKLVYWLAGMTFTPMVVLEVIPF

SEQ ID NO: 2400963 - protein, 18 aa, Entamoeba dispar
QPEHCLRNTINGRHSVMC

SEQ ID NO: 2400964 - protein, 28 aa, Entamoeba dispar
QPFMADIIHIVITFIIRGISQSSSVAVL

SEQ ID NO: 2400965 - protein, 25 aa, Entamoeba dispar
QPHNFDFYLTYITSLTIQKFLSIKD

SEQ ID NO: 2400966 - protein, 30 aa, Entamoeba dispar
QPITIFKRFWKVLIIPYYMVKSFFVRGDFT

SEQ ID NO: 2400967 - protein, 33 aa, Entamoeba dispar
QPNAKFLICCEPIFFDYIQLLITYYLENDANCS

SEQ ID NO: 2400968 - protein, 23 aa, Entamoeba dispar
QPTLLTSALLFDYLCEHPKERID

SEQ ID NO: 2400969 - protein, 17 aa, Entamoeba dispar
QPWMIPQFVIEGNRLSK

SEQ ID NO: 2400970 - protein, 30 aa, Entamoeba dispar
QPYKNQLIHSFPLLMKLMLQLFNNEISNTE

SEQ ID NO: 2400971 - protein, 25 aa, Entamoeba dispar
QPYTYGIWIKLISFTERYVSVALND

SEQ ID NO: 2400972 - protein, 21 aa, Entamoeba dispar
QPYVNWFLAFMGGLAGGFAYQ

SEQ ID NO: 2400973 - protein, 20 aa, Entamoeba dispar
QQFHLFLPEINMIQKLLIDI

SEQ ID NO: 2400974 - protein, 21 aa, Entamoeba dispar
QQFILLIEHYFNRKISLPCCD

SEQ ID NO: 2400975 - protein, 18 aa, Entamoeba dispar
QQHGGLAMFIFIKKIMKN

SEQ ID NO: 2400976 - protein, 35 aa, Entamoeba dispar
QQLESDVFPIIQIPELRTLLRKSLLTEYLTNFQDT

SEQ ID NO: 2400977 - protein, 27 aa, Entamoeba dispar
QQLPNSILNFLILFLTNIYEINFDYTS

SEQ ID NO: 2400978 - protein, 28 aa, Entamoeba dispar
QQLVFLMLITLLPFPYMTEPGLLSIPYL

SEQ ID NO: 2400979 - protein, 24 aa, Entamoeba dispar
QQNCIECPQLYWSNPNSISCKVCD

SEQ ID NO: 2400980 - protein, 23 aa, Entamoeba dispar
QQQKDLLVPIAQKLIEFHIEHNA

SEQ ID NO: 2400981 - protein, 21 aa, Entamoeba dispar
QQRVSLLRCFLASLPEPLIPE

SEQ ID NO: 2400982 - protein, 25 aa, Entamoeba dispar
QQSQLKWYFSIFTKILEKLKENIIN

SEQ ID NO: 2400983 - protein, 24 aa, Entamoeba dispar
QQSYLLFSFFHYTLSLVLLNFVHL

SEQ ID NO: 2400984 - protein, 25 aa, Entamoeba dispar
QQSYSLYHPRCLLQLLFAGSFKQVE

SEQ ID NO: 2400985 - protein, 26 aa, Entamoeba dispar
QQTQPFVVIFLVYLFISFGSHIFKDI

SEQ ID NO: 2400986 - protein, 21 aa, Entamoeba dispar
QRGILLKQMSMVLMGLSKPTN

SEQ ID NO: 2400987 - protein, 18 aa, Entamoeba dispar
QRIAIARALIRKPSILLL

SEQ ID NO: 2400988 - protein, 26 aa, Entamoeba dispar
QRIRRPVVLPLLVSLFIELLSSFMLP

SEQ ID NO: 2400989 - protein, 28 aa, Entamoeba dispar
QRIVYVFNWPLLVILAYTIPDVKIKTCA

SEQ ID NO: 2400990 - protein, 23 aa, Entamoeba dispar
QRKKSWLCIFPGCKEPVKTHYNC

SEQ ID NO: 2400991 - protein, 20 aa, Entamoeba dispar
QRLEIFNNPYFSFSDSIISF

SEQ ID NO: 2400992 - protein, 23 aa, Entamoeba dispar
QRLIMVYKVPLWMTFDECTIRPL

SEQ ID NO: 2400993 - protein, 27 aa, Entamoeba dispar
QRLTRVWVFFIFPVLISAYRCNPTICY

SEQ ID NO: 2400994 - protein, 29 aa, Entamoeba dispar
QRLYVICGCYYLIMKGWTILFSSEKRSAK

SEQ ID NO: 2400995 - protein, 17 aa, Entamoeba dispar
QRMGMVMIFIYSIVFRY

SEQ ID NO: 2400996 - protein, 25 aa, Entamoeba dispar
QRSERYFERFIGWIQLIGVLQNINY

SEQ ID NO: 2400997 - protein, 19 aa, Entamoeba dispar
QRSLPLCCLKKGLTSPIDI

SEQ ID NO: 2400998 - protein, 19 aa, Entamoeba dispar
QRTWREKIWRIILQGNEDF

SEQ ID NO: 2400999 - protein, 31 aa, Entamoeba dispar
QRVEPLLGFINGFFLVLFSAFTLMQCVERMI

SEQ ID NO: 2401000 - protein, 18 aa, Entamoeba dispar
QRYLKLYNMHVKCSHPDV

SEQ ID NO: 2401001 - protein, 37 aa, Entamoeba dispar
QSATFILGEYYFNSLWMIMCLLPPPQSFIDQFKDKRL

SEQ ID NO: 2401002 - protein, 26 aa, Entamoeba dispar
QSFEQYGFFLVYIIGLLYSGYGFYIV

SEQ ID NO: 2401003 - protein, 17 aa, Entamoeba dispar
QSGYYLKNGDCVKCDSK

SEQ ID NO: 2401004 - protein, 33 aa, Entamoeba dispar
QSIFMLLISSSFPWLVFIYLIKPVLSISSTFSP

SEQ ID NO: 2401005 - protein, 17 aa, Entamoeba dispar
QSIIMAFRVIFTTALTL

SEQ ID NO: 2401006 - protein, 26 aa, Entamoeba dispar
QSIKKYQYYLYKTSTKQIWVILGDHI

SEQ ID NO: 2401007 - protein, 17 aa, Entamoeba dispar
QSIVLLQPNLFIEFINY

SEQ ID NO: 2401008 - protein, 20 aa, Entamoeba dispar
QSLGFFFATLIDHLKPMYSN

SEQ ID NO: 2401009 - protein, 21 aa, Entamoeba dispar
QSLLNHMYFAGYFNSLNVTMA

SEQ ID NO: 2401010 - protein, 21 aa, Entamoeba dispar
QSLLTKCPLLVNSITAIPEAT

SEQ ID NO: 2401011 - protein, 24 aa, Entamoeba dispar
QSNHIFWMSSCCCWILFNVKVFEE

SEQ ID NO: 2401012 - protein, 26 aa, Entamoeba dispar
QSNTLKCIMTQYPSFWYSIQLSESLD

SEQ ID NO: 2401013 - protein, 29 aa, Entamoeba dispar
QSRVQELLILCLYLLLSNIVICINCKSGC

SEQ ID NO: 2401014 - protein, 17 aa, Entamoeba dispar
QSRWLMYFLEVRNPAAL

SEQ ID NO: 2401015 - protein, 28 aa, Entamoeba dispar
QSVIGMMLFFGYILFSWGTLFDTLIIGY

SEQ ID NO: 2401016 - protein, 29 aa, Entamoeba dispar
QTDDRKWALWFGLILQCVGIVLCIITQAI

SEQ ID NO: 2401017 - protein, 27 aa, Entamoeba dispar
QTFLIYVAFIFICIIVNLPKKAPLRII

SEQ ID NO: 2401018 - protein, 33 aa, Entamoeba dispar
QTFSLKQYTPALKAITIIILIIDSIMRNDTQIK

SEQ ID NO: 2401019 - protein, 18 aa, Entamoeba dispar
QTIFSKKKLCFPDNGRWL

SEQ ID NO: 2401020 - protein, 24 aa, Entamoeba dispar
QTIGMKVHKLLSIFFQNSNKVTTI

SEQ ID NO: 2401021 - protein, 24 aa, Entamoeba dispar
QTILYFMNKYFKDELKILIEQMKI

SEQ ID NO: 2401022 - protein, 38 aa, Entamoeba dispar
QTKKKYILFNIAGVIICIILSVLFSISFLVITNKRIEK

SEQ ID NO: 2401023 - protein, 23 aa, Entamoeba dispar
QTLIFNIFVFCQVFNEFNSRKVN

SEQ ID NO: 2401024 - protein, 25 aa, Entamoeba dispar
QTLYISIIYQLLNSLSWKYITQLLN

SEQ ID NO: 2401025 - protein, 21 aa, Entamoeba dispar
QTLYTMFFDGPRDIGPNIPAH

SEQ ID NO: 2401026 - protein, 26 aa, Entamoeba dispar
QTRGWFYSLIVISTALFGKAPFKNCV

SEQ ID NO: 2401027 - protein, 30 aa, Entamoeba dispar
QTSHTVFIIYYYLEVLPLIKLKIFMLETSD

SEQ ID NO: 2401028 - protein, 28 aa, Entamoeba dispar
QTTGSERIIFPMFFVDSKPLAGYDNSRS

SEQ ID NO: 2401029 - protein, 26 aa, Entamoeba dispar
QTTLNYPLSGLTLSLKLIYSSIDSIL

SEQ ID NO: 2401030 - protein, 22 aa, Entamoeba dispar
QTTTLPQFYVPNSNIHIPSINE

SEQ ID NO: 2401031 - protein, 31 aa, Entamoeba dispar
QTVITFICNLFIFVFIIFTVKMYYLMMYGFQ

SEQ ID NO: 2401032 - protein, 21 aa, Entamoeba dispar
QTVYLLLLLTYVIIKLFFVVM

SEQ ID NO: 2401033 - protein, 22 aa, Entamoeba dispar
QTWDCLHFLLFITTMVCLLSKK

SEQ ID NO: 2401034 - protein, 23 aa, Entamoeba dispar
QTYGTLKRLALTQFKLLNIMYKR

SEQ ID NO: 2401035 - protein, 17 aa, Entamoeba dispar
QVCGKLIGWELPYHLFP

SEQ ID NO: 2401036 - protein, 18 aa, Entamoeba dispar
QVFMCYWMSNVVNGIFTV

SEQ ID NO: 2401037 - protein, 25 aa, Entamoeba dispar
QVFPINYPLFKETILLYLGYIKGLP

SEQ ID NO: 2401038 - protein, 21 aa, Entamoeba dispar
QVIIGSFVPLEPKKYVIFQHQ

SEQ ID NO: 2401039 - protein, 29 aa, Entamoeba dispar
QVKSNLPTILLIIRSLYYTFKNKKKESHQ

SEQ ID NO: 2401040 - protein, 28 aa, Entamoeba dispar
QVQNDWMNGIFLVVCATVAFGMGIDKPD

SEQ ID NO: 2401041 - protein, 24 aa, Entamoeba dispar
QVRFVDRGLLLKSKVPASKPLCYK

SEQ ID NO: 2401042 - protein, 33 aa, Entamoeba dispar
QVSLFIVHALSIYPYFINLLVKYDITVFEDLKS

SEQ ID NO: 2401043 - protein, 26 aa, Entamoeba dispar
QVTTRQCPLLLYNTLKFLVQFTNSTY

SEQ ID NO: 2401044 - protein, 22 aa, Entamoeba dispar
QWFAHQMCCFLLPYYDCSSNIV

SEQ ID NO: 2401045 - protein, 31 aa, Entamoeba dispar
QWIIDTLKILIGLAIILLCCGLIWKSHTEMI

SEQ ID NO: 2401046 - protein, 20 aa, Entamoeba dispar
QWMLVGFIILIFVSYSMDIT

SEQ ID NO: 2401047 - protein, 19 aa, Entamoeba dispar
QYALDKPFLPLPCTLKAMD

SEQ ID NO: 2401048 - protein, 19 aa, Entamoeba dispar
QYCINIIPSPVLPLYGDQE

SEQ ID NO: 2401049 - protein, 21 aa, Entamoeba dispar
QYGAFHFYAQYPASLQQYSSF

SEQ ID NO: 2401050 - protein, 26 aa, Entamoeba dispar
QYKGLLLLIFFVCLFLIMGTGSTIIS

SEQ ID NO: 2401051 - protein, 26 aa, Entamoeba dispar
QYKVKVLIKLVLIISIITSIMFGIIR

SEQ ID NO: 2401052 - protein, 24 aa, Entamoeba dispar
QYKYDNFLCFINVLYGAVPRINLT

SEQ ID NO: 2401053 - protein, 29 aa, Entamoeba dispar
QYQPFIIAFFVITSFLFLFKKFFIPNDVI

SEQ ID NO: 2401054 - protein, 20 aa, Entamoeba dispar
QYTSQFIISLPPSSLRLDAE

SEQ ID NO: 2401055 - protein, 28 aa, Entamoeba dispar
QYVLTFVMTPLFPPVMRLFNYLDQNTMH

SEQ ID NO: 2401056 - protein, 26 aa, Entamoeba dispar
QYVVAGVCVDSKIFVKAQFGVGQHKC

SEQ ID NO: 2401057 - protein, 20 aa, Entamoeba dispar
QYVYDTLILLPETLYNTIAL

SEQ ID NO: 2401058 - protein, 18 aa, Entamoeba dispar
RAGGFIGLILCLMPFVVR

SEQ ID NO: 2401059 - protein, 18 aa, Entamoeba dispar
RAICNHSRYLRDCFVSTA

SEQ ID NO: 2401060 - protein, 20 aa, Entamoeba dispar
RAIFTCVPLYALVLGYLCGL

SEQ ID NO: 2401061 - protein, 26 aa, Entamoeba dispar
RALQMPYFYLYSLLAIILAITPNILK

SEQ ID NO: 2401062 - protein, 17 aa, Entamoeba dispar
RAPRHNGFYSLFSDDST

SEQ ID NO: 2401063 - protein, 24 aa, Entamoeba dispar
RAQIQEFYQLKKSALIIGSIKNYL

SEQ ID NO: 2401064 - protein, 32 aa, Entamoeba dispar
RASLLQFLVSPKKSFLRFILKSKSNMVSKNLK

SEQ ID NO: 2401065 - protein, 22 aa, Entamoeba dispar
RASMEMTFIGNQLLNSATFPSI

SEQ ID NO: 2401066 - protein, 23 aa, Entamoeba dispar
RAVIPLCYGLMNSTIYKQTDIKY

SEQ ID NO: 2401067 - protein, 19 aa, Entamoeba dispar
RCILFFTGNPSLLAFYIDF

SEQ ID NO: 2401068 - protein, 20 aa, Entamoeba dispar
RCKDGYYLENSKCLYYANKL

SEQ ID NO: 2401069 - protein, 26 aa, Entamoeba dispar
RCQNLISLCRLTLKHWTQFKDLPTSN

SEQ ID NO: 2401070 - protein, 20 aa, Entamoeba dispar
RCTTFVMQWWSNALINNEKA

SEQ ID NO: 2401071 - protein, 32 aa, Entamoeba dispar
RCVLKIQIWVHIFFLVAIVVTIIFILMIIFYL

SEQ ID NO: 2401072 - protein, 17 aa, Entamoeba dispar
RCVLRGLEYLKEIWSEN

SEQ ID NO: 2401073 - protein, 25 aa, Entamoeba dispar
RDANLFFGEFIRDLSLLWRHDEMAK

SEQ ID NO: 2401074 - protein, 20 aa, Entamoeba dispar
RDDMLYLINISSLSLYFSNL

SEQ ID NO: 2401075 - protein, 18 aa, Entamoeba dispar
RDDTVRVYVTDSCYKCLG

SEQ ID NO: 2401076 - protein, 19 aa, Entamoeba dispar
RDIFRRYPNRYEKVIGTLC

SEQ ID NO: 2401077 - protein, 25 aa, Entamoeba dispar
RDIKPDNILVFSLDTNIKINAKLTD

SEQ ID NO: 2401078 - protein, 19 aa, Entamoeba dispar
RDIPKLYNMKFLISLLTPI

SEQ ID NO: 2401079 - protein, 21 aa, Entamoeba dispar
RDLLVYSFGFFTKGIYMRQRT

SEQ ID NO: 2401080 - protein, 19 aa, Entamoeba dispar
RDLRRFLYSLRNTKIKKIH

SEQ ID NO: 2401081 - protein, 23 aa, Entamoeba dispar
RDQYIKYGDGFVLIYSITSKESF

SEQ ID NO: 2401082 - protein, 33 aa, Entamoeba dispar
RDSLIFKIIIYIIPIFFGVLMMTFYFMQKKTLK

SEQ ID NO: 2401083 - protein, 17 aa, Entamoeba dispar
RDTVKWCFYHNTNIKSN

SEQ ID NO: 2401084 - protein, 25 aa, Entamoeba dispar
RDVKGENLLIFSINPHSPVCAKLTD

SEQ ID NO: 2401085 - protein, 18 aa, Entamoeba dispar
RECIECEKGYYLNSNKEC

SEQ ID NO: 2401086 - protein, 18 aa, Entamoeba dispar
RECIECEKGYYLNSTKEC

SEQ ID NO: 2401087 - protein, 31 aa, Entamoeba dispar
REDRVYIGNILFGLLIYLLDEFDKIKDVHYN

SEQ ID NO: 2401088 - protein, 24 aa, Entamoeba dispar
REELKHELLITQKLWSAFPSVDEY

SEQ ID NO: 2401089 - protein, 29 aa, Entamoeba dispar
REEMKMFRLYTIITPLVDLLVTLSNWYIR

SEQ ID NO: 2401090 - protein, 18 aa, Entamoeba dispar
REFFNITVLLRLSKALDI

SEQ ID NO: 2401091 - protein, 29 aa, Entamoeba dispar
REGIRLRKLYFKSLLRQDATWYDFQESGE

SEQ ID NO: 2401092 - protein, 24 aa, Entamoeba dispar
REIISLKGIWYLLDLSRPANVTIQ

SEQ ID NO: 2401093 - protein, 21 aa, Entamoeba dispar
RELLEKMFKIIYRDSYETTQK

SEQ ID NO: 2401094 - protein, 33 aa, Entamoeba dispar
RETLKKYWNKLKLLLISIQLFDYMSPSIGIILS

SEQ ID NO: 2401095 - protein, 33 aa, Entamoeba dispar
RETSKYIQVFNFISLIFFPITFVVNTFGCNIRV

SEQ ID NO: 2401096 - protein, 18 aa, Entamoeba dispar
REVLGAEQLPPLYSYLLF

SEQ ID NO: 2401097 - protein, 22 aa, Entamoeba dispar
REYQLDWSLIPSDTSKLPVVSI

SEQ ID NO: 2401098 - protein, 21 aa, Entamoeba dispar
REYVLLLSGLLSTQLTIQKTD

SEQ ID NO: 2401099 - protein, 20 aa, Entamoeba dispar
RFDYSTNTGYPQFLWRYSSL

SEQ ID NO: 2401100 - protein, 38 aa, Entamoeba dispar
RFEDEKIVILFDLLIDILFEYGFIIFTSKMRNKVNKSK

SEQ ID NO: 2401101 - protein, 17 aa, Entamoeba dispar
RFEPILKIIPSDYQLIL

SEQ ID NO: 2401102 - protein, 22 aa, Entamoeba dispar
RFILLIMYINIVNGINNLLYTN

SEQ ID NO: 2401103 - protein, 23 aa, Entamoeba dispar
RFILLIMYINIVNGINNLLYTNK

SEQ ID NO: 2401104 - protein, 27 aa, Entamoeba dispar
RFKDSSPLILLPHQMNYIRYIPSIIGD

SEQ ID NO: 2401105 - protein, 18 aa, Entamoeba dispar
RFMGWKRFAFREYPVALA

SEQ ID NO: 2401106 - protein, 34 aa, Entamoeba dispar
RFNPISIQSLTLFPFIQTLYLYSSFDPFIKGIDQ

SEQ ID NO: 2401107 - protein, 33 aa, Entamoeba dispar
RFNQVTSTPIIFNLCEWYSIIPEPDKHYSFSVP

SEQ ID NO: 2401108 - protein, 29 aa, Entamoeba dispar
RFPFNFLAHFSFILYLILFVLSPIVLNYI

SEQ ID NO: 2401109 - protein, 26 aa, Entamoeba dispar
RFRNKYYPFWLTIYPEGTRVKPQKLI

SEQ ID NO: 2401110 - protein, 21 aa, Entamoeba dispar
RFSRLQELKLLPRLQLLSVNC

SEQ ID NO: 2401111 - protein, 19 aa, Entamoeba dispar
RFVTILRLNGSGPYTYFGY

SEQ ID NO: 2401112 - protein, 19 aa, Entamoeba dispar
RFWPYFSNVTLFSIFVPIL

SEQ ID NO: 2401113 - protein, 25 aa, Entamoeba dispar
RFYFYLEILYLLMNITIQPPNFHIS

SEQ ID NO: 2401114 - protein, 20 aa, Entamoeba dispar
RFYTFFISYFFQLTTKTDIH

SEQ ID NO: 2401115 - protein, 20 aa, Entamoeba dispar
RGEFIPLTFPVHTYTTDNTV

SEQ ID NO: 2401116 - protein, 17 aa, Entamoeba dispar
RGILSLEYPMQKEPIDY

SEQ ID NO: 2401117 - protein, 34 aa, Entamoeba dispar
RGIYTFDIWINNKRIRALLFNTHFILPICPSKCS

SEQ ID NO: 2401118 - protein, 19 aa, Entamoeba dispar
RGKYFLILLLVGVIISTFL

SEQ ID NO: 2401119 - protein, 24 aa, Entamoeba dispar
RGLYVLICIIIAVLIRLYSVLRYE

SEQ ID NO: 2401120 - protein, 18 aa, Entamoeba dispar
RGNELSELVWYNKKLYGF

SEQ ID NO: 2401121 - protein, 25 aa, Entamoeba dispar
RGNYIFKENISFGFNILKSTISLCD

SEQ ID NO: 2401122 - protein, 25 aa, Entamoeba dispar
RGRFITEFIGAIFQLNKLAIVTEYA

SEQ ID NO: 2401123 - protein, 22 aa, Entamoeba dispar
RGSFIFYHELLPQIFINDKNTS

SEQ ID NO: 2401124 - protein, 27 aa, Entamoeba dispar
RGTLIFSFIFGTIGYLLFALQVSFRFS

SEQ ID NO: 2401125 - protein, 17 aa, Entamoeba dispar
RGWKNFLLFGCGTVTLI

SEQ ID NO: 2401126 - protein, 30 aa, Entamoeba dispar
RHEEYIFGQWGFLILYIISKGGKVEILYPK

SEQ ID NO: 2401127 - protein, 18 aa, Entamoeba dispar
RHHLHPFYFLFPSSSHTD

SEQ ID NO: 2401128 - protein, 19 aa, Entamoeba dispar
RHHLHPFYFLFPSSSHTDL

SEQ ID NO: 2401129 - protein, 18 aa, Entamoeba dispar
RHIVEMDSLYPFTKFVTS
